United States Patent 7,374,927 (METHODS OF ANALYSIS OF DEGRADED NUCLEIC ACID SAMPLES) - sequence listing, part 15

SEQ ID NO: 561490 - DNA, 25 bp, Homo sapien
cgtcgctgtggtagctgagtgaaca

SEQ ID NO: 561491 - DNA, 25 bp, Homo sapien
agagagttcacggttcctgcagcct

SEQ ID NO: 561492 - DNA, 25 bp, Homo sapien
tgcagcctcgggtcatgctgacgcc

SEQ ID NO: 561493 - DNA, 25 bp, Homo sapien
ccgggcggtgctaacacgtaacacg

SEQ ID NO: 561494 - DNA, 25 bp, Homo sapien
ggtgctaacacgtaacacgcgggac

SEQ ID NO: 561495 - DNA, 25 bp, Homo sapien
gtaacacgcgggacctcgagagcta

SEQ ID NO: 561496 - DNA, 25 bp, Homo sapien
cacgcgggacctcgagagctaagaa

SEQ ID NO: 561497 - DNA, 25 bp, Homo sapien
tcgagagctaagaagcagggcgact

SEQ ID NO: 561498 - DNA, 25 bp, Homo sapien
agcagggcgactaagacgcagccct

SEQ ID NO: 561499 - DNA, 25 bp, Homo sapien
acagatgaggacataggccccaggg

SEQ ID NO: 561500 - DNA, 25 bp, Homo sapien
acataggccccagggagcaagtgac

SEQ ID NO: 561501 - DNA, 25 bp, Homo sapien
tgacttacccgtggtcactcagctt

SEQ ID NO: 561502 - DNA, 25 bp, Homo sapien
cactcagcttgtgtgtggtagggca

SEQ ID NO: 561503 - DNA, 25 bp, Homo sapien
tggagccggcagacttttcctgagg

SEQ ID NO: 561504 - DNA, 25 bp, Homo sapien
cagacttttcctgagggacgtccgg

SEQ ID NO: 561505 - DNA, 25 bp, Homo sapien
gacgtccggcctaataatcaacttg

SEQ ID NO: 561506 - DNA, 25 bp, Homo sapien
aacttggcaatatatctggctcgta

SEQ ID NO: 561507 - DNA, 25 bp, Homo sapien
atatctggctcgtagactgcggcga

SEQ ID NO: 561508 - DNA, 25 bp, Homo sapien
cgatgggcgttgatgtggatatcct

SEQ ID NO: 561509 - DNA, 25 bp, Homo sapien
tggatatcctagattcctctgggtt

SEQ ID NO: 561510 - DNA, 25 bp, Homo sapien
gaattgtgtggcatgcaaatatgaa

SEQ ID NO: 561511 - DNA, 25 bp, Homo sapien
taatgtcagtataccatatctgcaa

SEQ ID NO: 561512 - DNA, 25 bp, Homo sapien
gtataccatatctgcaaattcgttc

SEQ ID NO: 561513 - DNA, 25 bp, Homo sapien
taccatatctgcaaattcgttcaat

SEQ ID NO: 561514 - DNA, 25 bp, Homo sapien
tctgcaaattcgttcaataaagatt

SEQ ID NO: 561515 - DNA, 25 bp, Homo sapien
aaatttggtttagctcttgtcatag

SEQ ID NO: 561516 - DNA, 25 bp, Homo sapien
gctcttgtcatagaaagctctcagc

SEQ ID NO: 561517 - DNA, 25 bp, Homo sapien
ggaatttatccagagatcagggcaa

SEQ ID NO: 561518 - DNA, 25 bp, Homo sapien
gagatcagggcaatttaggaacctt

SEQ ID NO: 561519 - DNA, 25 bp, Homo sapien
tcagggcaatttaggaaccttattt

SEQ ID NO: 561520 - DNA, 25 bp, Homo sapien
taccaatgtgagaattgtgtggcat

SEQ ID NO: 561521 - DNA, 25 bp, Homo sapien
taaaagtgactttgtaccataaaat

SEQ ID NO: 561522 - DNA, 25 bp, Homo sapien
taaaataaccccaaagccactctct

SEQ ID NO: 561523 - DNA, 25 bp, Homo sapien
caaagccactctctagggtttttat

SEQ ID NO: 561524 - DNA, 25 bp, Homo sapien
tgtctttatcttttctaacttagtt

SEQ ID NO: 561525 - DNA, 25 bp, Homo sapien
attacgttagctactttggttccat

SEQ ID NO: 561526 - DNA, 25 bp, Homo sapien
agctactttggttccatagaacaag

SEQ ID NO: 561527 - DNA, 25 bp, Homo sapien
gggtctacagttcctacagtgtgct

SEQ ID NO: 561528 - DNA, 25 bp, Homo sapien
ctacagtgtgctcattgtctcagtg

SEQ ID NO: 561529 - DNA, 25 bp, Homo sapien
tgtctcagtgaagttcttttgtttt

SEQ ID NO: 561530 - DNA, 25 bp, Homo sapien
gttttcaaagattcatggtaacaaa

SEQ ID NO: 561531 - DNA, 25 bp, Homo sapien
aaatgtattttactgctacaactaa

SEQ ID NO: 561532 - DNA, 25 bp, Homo sapien
gttctgcaaagtcttacacaaaagc

SEQ ID NO: 561533 - DNA, 25 bp, Homo sapien
gtcttacacaaaagcccaatacagt

SEQ ID NO: 561534 - DNA, 25 bp, Homo sapien
cacaaaagcccaatacagtacatga

SEQ ID NO: 561535 - DNA, 25 bp, Homo sapien
gcccaatacagtacatgaactacgg

SEQ ID NO: 561536 - DNA, 25 bp, Homo sapien
tgaactacggaaaagcagaactgct

SEQ ID NO: 561537 - DNA, 25 bp, Homo sapien
aagcagaactgctctgaacaaggaa

SEQ ID NO: 561538 - DNA, 25 bp, Homo sapien
gtgggagatctgagtcctggcccca

SEQ ID NO: 561539 - DNA, 25 bp, Homo sapien
ttcaacttcagtcacctccttggaa

SEQ ID NO: 561540 - DNA, 25 bp, Homo sapien
aacttcagtcacctccttggaatct

SEQ ID NO: 561541 - DNA, 25 bp, Homo sapien
cttcagtcacctccttggaatctgg

SEQ ID NO: 561542 - DNA, 25 bp, Homo sapien
agtcaatgtgaaaagctcccagttt

SEQ ID NO: 561543 - DNA, 25 bp, Homo sapien
tttaaggtgaaagcgtctcacgcac

SEQ ID NO: 561544 - DNA, 25 bp, Homo sapien
tctcacgcacaagtcaggcctgttg

SEQ ID NO: 561545 - DNA, 25 bp, Homo sapien
gaaagaggcctgacccagaccacca

SEQ ID NO: 561546 - DNA, 25 bp, Homo sapien
acagctgacccgtgctgagggtcca

SEQ ID NO: 561547 - DNA, 25 bp, Homo sapien
tgagggtccaggctccattggcaaa

SEQ ID NO: 561548 - DNA, 25 bp, Homo sapien
tccattggcaaagccggtcaggcac

SEQ ID NO: 561549 - DNA, 25 bp, Homo sapien
aggcacgagggcgactgaggcacgt

SEQ ID NO: 561550 - DNA, 25 bp, Homo sapien
aggagggcacccaggttctgttcac

SEQ ID NO: 561551 - DNA, 25 bp, Homo sapien
gggcacccaggttctgttcacaact

SEQ ID NO: 561552 - DNA, 25 bp, Homo sapien
tgttcacaactcacttcacttcata

SEQ ID NO: 561553 - DNA, 25 bp, Homo sapien
cacttcatacatccttttaatttct

SEQ ID NO: 561554 - DNA, 25 bp, Homo sapien
tttagtcttttctcctctatcgccg

SEQ ID NO: 561555 - DNA, 25 bp, Homo sapien
tatcgccgccttaccggttgtacaa

SEQ ID NO: 561556 - DNA, 25 bp, Homo sapien
gccttaccggttgtacaacattgga

SEQ ID NO: 561557 - DNA, 25 bp, Homo sapien
attggaccagccattctccccaagg

SEQ ID NO: 561558 - DNA, 25 bp, Homo sapien
aaggcctcggcattttcattgttaa

SEQ ID NO: 561559 - DNA, 25 bp, Homo sapien
tgggaacactcctaattcacactgt

SEQ ID NO: 561560 - DNA, 25 bp, Homo sapien
acactcctaattcacactgttgctg

SEQ ID NO: 561561 - DNA, 25 bp, Homo sapien
acactgttgctgtgaggattacatt

SEQ ID NO: 561562 - DNA, 25 bp, Homo sapien
aaggcgaacatgtaaccctctacct

SEQ ID NO: 561563 - DNA, 25 bp, Homo sapien
atgtaaccctctacctgtgggcgca

SEQ ID NO: 561564 - DNA, 25 bp, Homo sapien
acctgtgggcgcacatttgctgtgg

SEQ ID NO: 561565 - DNA, 25 bp, Homo sapien
aagtttatcatctatttgttactgg

SEQ ID NO: 561566 - DNA, 25 bp, Homo sapien
ttgttactggaactgcaatgcactt

SEQ ID NO: 561567 - DNA, 25 bp, Homo sapien
ggaactgcaatgcactttcatttca

SEQ ID NO: 561568 - DNA, 25 bp, Homo sapien
gcactttcatttcaagtcacttttt

SEQ ID NO: 561569 - DNA, 25 bp, Homo sapien
gccacaatcctgaagttatctacta

SEQ ID NO: 561570 - DNA, 25 bp, Homo sapien
ttttaataattatgcccaagttgga

SEQ ID NO: 561571 - DNA, 25 bp, Homo sapien
caagttggaaattcaagttgtccga

SEQ ID NO: 561572 - DNA, 25 bp, Homo sapien
tgtccgaaaagacttaatttcttgt

SEQ ID NO: 561573 - DNA, 25 bp, Homo sapien
atttcttgtttcagtcaacgcttcc

SEQ ID NO: 561574 - DNA, 25 bp, Homo sapien
ttgtttcagtcaacgcttcccatct

SEQ ID NO: 561575 - DNA, 25 bp, Homo sapien
cgcttcccatcttcaaccagaggaa

SEQ ID NO: 561576 - DNA, 25 bp, Homo sapien
gtacaaccagagtgctcaggacatc

SEQ ID NO: 561577 - DNA, 25 bp, Homo sapien
tcaagatggttacccagagagcctg

SEQ ID NO: 561578 - DNA, 25 bp, Homo sapien
cctggccagaatatttgcggtggag

SEQ ID NO: 561579 - DNA, 25 bp, Homo sapien
tgcggtggagagaaacgatcttgtt

SEQ ID NO: 561580 - DNA, 25 bp, Homo sapien
agaatcaggcacacatcctttactc

SEQ ID NO: 561581 - DNA, 25 bp, Homo sapien
acatcctttactctgttgtgcaaat

SEQ ID NO: 561582 - DNA, 25 bp, Homo sapien
ttgtgcaaatctcaccttactgtgt

SEQ ID NO: 561583 - DNA, 25 bp, Homo sapien
ctgtgtgtttgtattctattcctcc

SEQ ID NO: 561584 - DNA, 25 bp, Homo sapien
gtattctattcctccacaatcttta

SEQ ID NO: 561585 - DNA, 25 bp, Homo sapien
tcacagagatttgttggtgccaact

SEQ ID NO: 561586 - DNA, 25 bp, Homo sapien
gtgccaactaaatgagcccaacagc

SEQ ID NO: 561587 - DNA, 25 bp, Homo sapien
tcttcacagaccaagcttgatcctt

SEQ ID NO: 561588 - DNA, 25 bp, Homo sapien
acagaccaagcttgatccttattag

SEQ ID NO: 561589 - DNA, 25 bp, Homo sapien
agcttgatccttattagtccatgtc

SEQ ID NO: 561590 - DNA, 25 bp, Homo sapien
gatccttattagtccatgtccagaa

SEQ ID NO: 561591 - DNA, 25 bp, Homo sapien
ttattagtccatgtccagaatcagt

SEQ ID NO: 561592 - DNA, 25 bp, Homo sapien
tagtccatgtccagaatcagtaaat

SEQ ID NO: 561593 - DNA, 25 bp, Homo sapien
gtccagaatcagtaaatgtccctag

SEQ ID NO: 561594 - DNA, 25 bp, Homo sapien
gaatcagtaaatgtccctagaaaat

SEQ ID NO: 561595 - DNA, 25 bp, Homo sapien
aatggccacttacctcaggaggact

SEQ ID NO: 561596 - DNA, 25 bp, Homo sapien
ggccacttacctcaggaggactcct

SEQ ID NO: 561597 - DNA, 25 bp, Homo sapien
tcaggaggactcctccctctctgga

SEQ ID NO: 561598 - DNA, 25 bp, Homo sapien
aaatccaaggatacagtctcagagg

SEQ ID NO: 561599 - DNA, 25 bp, Homo sapien
tcagaggacaccattaggctaatag

SEQ ID NO: 561600 - DNA, 25 bp, Homo sapien
gagaaacagatcagccaaatggccg

SEQ ID NO: 561601 - DNA, 25 bp, Homo sapien
aaatggccgatgacacagtggcaga

SEQ ID NO: 561602 - DNA, 25 bp, Homo sapien
agtggcagaactggacaggcatctg

SEQ ID NO: 561603 - DNA, 25 bp, Homo sapien
acaggcatctggcagtgaagaccaa

SEQ ID NO: 561604 - DNA, 25 bp, Homo sapien
gaagaccaaagaactccttggatga

SEQ ID NO: 561605 - DNA, 25 bp, Homo sapien
agcaatactccagagcccagtttct

SEQ ID NO: 561606 - DNA, 25 bp, Homo sapien
agagcccagtttctgctggatccca

SEQ ID NO: 561607 - DNA, 25 bp, Homo sapien
tgggtggcacattgggacttctctc

SEQ ID NO: 561608 - DNA, 25 bp, Homo sapien
agaagcctgtccttgtaaggcccag

SEQ ID NO: 561609 - DNA, 25 bp, Homo sapien
ttcctcttggaagccacacatgtca

SEQ ID NO: 561610 - DNA, 25 bp, Homo sapien
acatgtcaaggtcatcagtaagcag

SEQ ID NO: 561611 - DNA, 25 bp, Homo sapien
cagtaagcaggcctactctttcttc

SEQ ID NO: 561612 - DNA, 25 bp, Homo sapien
atattctgggttaatgttcaccttg

SEQ ID NO: 561613 - DNA, 25 bp, Homo sapien
gactgcttggtaaatttccctcact

SEQ ID NO: 561614 - DNA, 25 bp, Homo sapien
atttccctcactggtgctgaagtaa

SEQ ID NO: 561615 - DNA, 25 bp, Homo sapien
gggaaatagtatatctgggcctata

SEQ ID NO: 561616 - DNA, 25 bp, Homo sapien
tgggcctatagagaagttgggtcat

SEQ ID NO: 561617 - DNA, 25 bp, Homo sapien
tggaaaagtacatagactgcttgcc

SEQ ID NO: 561618 - DNA, 25 bp, Homo sapien
gtttgttgtaccatgtacctgttca

SEQ ID NO: 561619 - DNA, 25 bp, Homo sapien
atgtacctgttcacagactcttttc

SEQ ID NO: 561620 - DNA, 25 bp, Homo sapien
gagtacaatggcgctatcttatctt

SEQ ID NO: 561621 - DNA, 25 bp, Homo sapien
agtacaatggcgctatcttatcttg

SEQ ID NO: 561622 - DNA, 25 bp, Homo sapien
gtacaatggcgctatcttatcttgg

SEQ ID NO: 561623 - DNA, 25 bp, Homo sapien
tacaatggcgctatcttatcttggc

SEQ ID NO: 561624 - DNA, 25 bp, Homo sapien
acaatggcgctatcttatcttggcc

SEQ ID NO: 561625 - DNA, 25 bp, Homo sapien
caatggcgctatcttatcttggcca

SEQ ID NO: 561626 - DNA, 25 bp, Homo sapien
aatggcgctatcttatcttggccac

SEQ ID NO: 561627 - DNA, 25 bp, Homo sapien
atggcgctatcttatcttggccact

SEQ ID NO: 561628 - DNA, 25 bp, Homo sapien
gctatcttatcttggccactgcaac

SEQ ID NO: 561629 - DNA, 25 bp, Homo sapien
ttatcttggccactgcaactcctgg

SEQ ID NO: 561630 - DNA, 25 bp, Homo sapien
tcttggccactgcaactcctgggtt

SEQ ID NO: 561631 - DNA, 25 bp, Homo sapien
ggaccttgccaagccaacatttgtg

SEQ ID NO: 561632 - DNA, 25 bp, Homo sapien
tttctcttgtcatccaaccccttaa

SEQ ID NO: 561633 - DNA, 25 bp, Homo sapien
cttgtcatccaaccccttaatactt

SEQ ID NO: 561634 - DNA, 25 bp, Homo sapien
agactgatttgagtccttctcctgt

SEQ ID NO: 561635 - DNA, 25 bp, Homo sapien
tgatttgagtccttctcctgtctcc

SEQ ID NO: 561636 - DNA, 25 bp, Homo sapien
gctggccagccttgtaacaaagcct

SEQ ID NO: 561637 - DNA, 25 bp, Homo sapien
ggtgccatagtattagtttctatgt

SEQ ID NO: 561638 - DNA, 25 bp, Homo sapien
ggcagggagtccatttgctgtataa

SEQ ID NO: 561639 - DNA, 25 bp, Homo sapien
gggagtccatttgctgtataacagt

SEQ ID NO: 561640 - DNA, 25 bp, Homo sapien
tataacagtcgctcaatatccacca

SEQ ID NO: 561641 - DNA, 25 bp, Homo sapien
accaccagcatgaacaaacactaat

SEQ ID NO: 561642 - DNA, 25 bp, Homo sapien
gcctgagcccagagtttcgcggcct

SEQ ID NO: 561643 - DNA, 25 bp, Homo sapien
aaccttaaagaggatccagagtcat

SEQ ID NO: 561644 - DNA, 25 bp, Homo sapien
ggttgtaaatgcagaaggtattccc

SEQ ID NO: 561645 - DNA, 25 bp, Homo sapien
gaaggtattcccatccgaacaacct

SEQ ID NO: 561646 - DNA, 25 bp, Homo sapien
catccgaacaaccttggacaactca

SEQ ID NO: 561647 - DNA, 25 bp, Homo sapien
cttggacaactcaacaactgttcaa

SEQ ID NO: 561648 - DNA, 25 bp, Homo sapien
aactgttcaatatgcaggccttctt

SEQ ID NO: 561649 - DNA, 25 bp, Homo sapien
gccttcttcatcacctgacaatgaa

SEQ ID NO: 561650 - DNA, 25 bp, Homo sapien
gaaagccaaaagcacagttcgtgat

SEQ ID NO: 561651 - DNA, 25 bp, Homo sapien
gcacagttcgtgatattgatcctca

SEQ ID NO: 561652 - DNA, 25 bp, Homo sapien
ttgacatcccgggaggctgtgccgc

SEQ ID NO: 561653 - DNA, 25 bp, Homo sapien
gctgtccctctgaatgaagccacaa

SEQ ID NO: 561654 - DNA, 25 bp, Homo sapien
tgaagccacaagagcttcaggtgat

SEQ ID NO: 561655 - DNA, 25 bp, Homo sapien
aatctaagtcatttacaggtggagg

SEQ ID NO: 561656 - DNA, 25 bp, Homo sapien
gaggatacagattgggtagttcttt

SEQ ID NO: 561657 - DNA, 25 bp, Homo sapien
gtagttctttttgtaagcggtctga

SEQ ID NO: 561658 - DNA, 25 bp, Homo sapien
aagcggtctgaatatatctatggag

SEQ ID NO: 561659 - DNA, 25 bp, Homo sapien
ggagaaaatcagctgcaagatgttc

SEQ ID NO: 561660 - DNA, 25 bp, Homo sapien
tcagattttgcttaaactgtggagc

SEQ ID NO: 561661 - DNA, 25 bp, Homo sapien
gtggagcaatggtttcagtttagat

SEQ ID NO: 561662 - DNA, 25 bp, Homo sapien
gaattgagaccttacaatgaaccaa

SEQ ID NO: 561663 - DNA, 25 bp, Homo sapien
atatagttcgaccttcaactgggaa

SEQ ID NO: 561664 - DNA, 25 bp, Homo sapien
gactgtgtcctcatctagaaccaaa

SEQ ID NO: 561665 - DNA, 25 bp, Homo sapien
gggctccaaaagaatcaccagtgag

SEQ ID NO: 561666 - DNA, 25 bp, Homo sapien
agatgggactgacaactccctggat

SEQ ID NO: 561667 - DNA, 25 bp, Homo sapien
gacaactccctggatatctatctgt

SEQ ID NO: 561668 - DNA, 25 bp, Homo sapien
tatctatctgtttgggcagcactga

SEQ ID NO: 561669 - DNA, 25 bp, Homo sapien
actgatctgctctgccctattgctt

SEQ ID NO: 561670 - DNA, 25 bp, Homo sapien
tctgccctattgcttcctgcacaaa

SEQ ID NO: 561671 - DNA, 25 bp, Homo sapien
tgtcatggaaagagacgccttcttt

SEQ ID NO: 561672 - DNA, 25 bp, Homo sapien
gaaagagacgccttctttctgtccc

SEQ ID NO: 561673 - DNA, 25 bp, Homo sapien
tttctgtcccctcatggagactgtg

SEQ ID NO: 561674 - DNA, 25 bp, Homo sapien
atggagactgtgtcctcatctagaa

SEQ ID NO: 561675 - DNA, 25 bp, Homo sapien
gaatttggctagctggttttctacc

SEQ ID NO: 561676 - DNA, 25 bp, Homo sapien
ttggactgtctgaaaatactctttt

SEQ ID NO: 561677 - DNA, 25 bp, Homo sapien
actcttttctgggagtatgttcgta

SEQ ID NO: 561678 - DNA, 25 bp, Homo sapien
ggagtatgttcgtagacaactgaaa

SEQ ID NO: 561679 - DNA, 25 bp, Homo sapien
aataaactgcaactcactggtgcca

SEQ ID NO: 561680 - DNA, 25 bp, Homo sapien
tgcaactcactggtgccaaatatat

SEQ ID NO: 561681 - DNA, 25 bp, Homo sapien
gccaaatatatcacacatcagccca

SEQ ID NO: 561682 - DNA, 25 bp, Homo sapien
tcctgccacggtgagcttgtagcag

SEQ ID NO: 561683 - DNA, 25 bp, Homo sapien
gaaatgcacttaattgggtaaacag

SEQ ID NO: 561684 - DNA, 25 bp, Homo sapien
atcttcttttaagctttctgaacga

SEQ ID NO: 561685 - DNA, 25 bp, Homo sapien
ctgaacgaacagaatttggctagct

SEQ ID NO: 561686 - DNA, 25 bp, Homo sapien
taagtatttcatatgcaattttatg

SEQ ID NO: 561687 - DNA, 25 bp, Homo sapien
attttatgtaatttgctgtgtgtta

SEQ ID NO: 561688 - DNA, 25 bp, Homo sapien
gttacataattaacagcttcagtaa

SEQ ID NO: 561689 - DNA, 25 bp, Homo sapien
gcttcagtaaagcttgtgttcctat

SEQ ID NO: 561690 - DNA, 25 bp, Homo sapien
ttcagtaaagcttgtgttcctatat

SEQ ID NO: 561691 - DNA, 25 bp, Homo sapien
cagtaaagcttgtgttcctatattg

SEQ ID NO: 561692 - DNA, 25 bp, Homo sapien
gtaaagcttgtgttcctatattgaa

SEQ ID NO: 561693 - DNA, 25 bp, Homo sapien
aaagcttgtgttcctatattgaact

SEQ ID NO: 561694 - DNA, 25 bp, Homo sapien
gcttgtgttcctatattgaacttca

SEQ ID NO: 561695 - DNA, 25 bp, Homo sapien
tgtgttcctatattgaacttcaata

SEQ ID NO: 561696 - DNA, 25 bp, Homo sapien
taacctcaaggataagtttaatcat

SEQ ID NO: 561697 - DNA, 25 bp, Homo sapien
gacactgagtgatttgctgaaaatc

SEQ ID NO: 561698 - DNA, 25 bp, Homo sapien
ttgacagaaagtaacatagcatgct

SEQ ID NO: 561699 - DNA, 25 bp, Homo sapien
tagcatgctggttaaagactgtttt

SEQ ID NO: 561700 - DNA, 25 bp, Homo sapien
agactgtttttattcgaatcctggc

SEQ ID NO: 561701 - DNA, 25 bp, Homo sapien
ttgctgaaaatcacacatctagatg

SEQ ID NO: 561702 - DNA, 25 bp, Homo sapien
acacatctagatgcaaagccagaat

SEQ ID NO: 561703 - DNA, 25 bp, Homo sapien
aagccagaatgcgagcagtgaccac

SEQ ID NO: 561704 - DNA, 25 bp, Homo sapien
atgcgagcagtgaccaccacacttg

SEQ ID NO: 561705 - DNA, 25 bp, Homo sapien
ccaccacacttgacaaatccgttgt

SEQ ID NO: 561706 - DNA, 25 bp, Homo sapien
gacaaatccgttgttgcacacattt

SEQ ID NO: 561707 - DNA, 25 bp, Homo sapien
cgttgttgcacacatttgtactctt

SEQ ID NO: 561708 - DNA, 25 bp, Homo sapien
gttctggcccaaggaaaatgtccat

SEQ ID NO: 561709 - DNA, 25 bp, Homo sapien
tgtccattctatgaccttctctttt

SEQ ID NO: 561710 - DNA, 25 bp, Homo sapien
tctcacttctgcagctattctcaca

SEQ ID NO: 561711 - DNA, 25 bp, Homo sapien
tattctcacacatctaacctctagg

SEQ ID NO: 561712 - DNA, 25 bp, Homo sapien
taacctctaggcaacatgcactaaa

SEQ ID NO: 561713 - DNA, 25 bp, Homo sapien
cttgcctcaacagtcacctaataaa

SEQ ID NO: 561714 - DNA, 25 bp, Homo sapien
aacagtcacctaataaagcccacct

SEQ ID NO: 561715 - DNA, 25 bp, Homo sapien
ggcgttagggaagctggtatcaaat

SEQ ID NO: 561716 - DNA, 25 bp, Homo sapien
gaagctggtatcaaatggtgacctt

SEQ ID NO: 561717 - DNA, 25 bp, Homo sapien
atggtgaccttggtggagtctccta

SEQ ID NO: 561718 - DNA, 25 bp, Homo sapien
gagtctcctatgtgaagagtaccct

SEQ ID NO: 561719 - DNA, 25 bp, Homo sapien
aaccagtgatatcaggcaaacgcca

SEQ ID NO: 561720 - DNA, 25 bp, Homo sapien
aaacgccacatccttcgatgcatgg

SEQ ID NO: 561721 - DNA, 25 bp, Homo sapien
atccttcgatgcatgggtaacagtg

SEQ ID NO: 561722 - DNA, 25 bp, Homo sapien
gtggaatttgtagggcctcttgcaa

SEQ ID NO: 561723 - DNA, 25 bp, Homo sapien
tcatctctgccgtgctgcagggaac

SEQ ID NO: 561724 - DNA, 25 bp, Homo sapien
gcaaaaagaacgaacagccctacct

SEQ ID NO: 561725 - DNA, 25 bp, Homo sapien
cagccctacctctattgcagaaatt

SEQ ID NO: 561726 - DNA, 25 bp, Homo sapien
cagaaattgtcagtcctgctgcctc

SEQ ID NO: 561727 - DNA, 25 bp, Homo sapien
ctccagtcctacatgaggataagca

SEQ ID NO: 561728 - DNA, 25 bp, Homo sapien
gaggataagcatttctggcaaagag

SEQ ID NO: 561729 - DNA, 25 bp, Homo sapien
tcctctcaggtctgccagccatgaa

SEQ ID NO: 561730 - DNA, 25 bp, Homo sapien
cattacctaatgcttgactaaatat

SEQ ID NO: 561731 - DNA, 25 bp, Homo sapien
tgactaaatatagccagcccttaag

SEQ ID NO: 561732 - DNA, 25 bp, Homo sapien
ccagcccttaagtaggtagagtatt

SEQ ID NO: 561733 - DNA, 25 bp, Homo sapien
gttgtttaagtctgtggagtccctc

SEQ ID NO: 561734 - DNA, 25 bp, Homo sapien
aagtctgtggagtccctctttggtt

SEQ ID NO: 561735 - DNA, 25 bp, Homo sapien
tgtggagtccctctttggtttcttt

SEQ ID NO: 561736 - DNA, 25 bp, Homo sapien
ttggtttctttaacttttgcagtca

SEQ ID NO: 561737 - DNA, 25 bp, Homo sapien
taacttttgcagtcattagggcaga

SEQ ID NO: 561738 - DNA, 25 bp, Homo sapien
tttgcagtcattagggcagagtata

SEQ ID NO: 561739 - DNA, 25 bp, Homo sapien
tttatttacatttctccaagcaaag

SEQ ID NO: 561740 - DNA, 25 bp, Homo sapien
tttctccaagcaaagtcttgctctg

SEQ ID NO: 561741 - DNA, 25 bp, Homo sapien
ccagttcttcctgcgtgcgggcgag

SEQ ID NO: 561742 - DNA, 25 bp, Homo sapien
tgggccctcgggaacccactcagag

SEQ ID NO: 561743 - DNA, 25 bp, Homo sapien
gggaacccactcagagcgaggctaa

SEQ ID NO: 561744 - DNA, 25 bp, Homo sapien
gcgaggctaaatttacggagggact

SEQ ID NO: 561745 - DNA, 25 bp, Homo sapien
cggagggactttctgttagcagcat

SEQ ID NO: 561746 - DNA, 25 bp, Homo sapien
ttctgttagcagcatgagggcctgt

SEQ ID NO: 561747 - DNA, 25 bp, Homo sapien
gagggcctgtggttagacctataga

SEQ ID NO: 561748 - DNA, 25 bp, Homo sapien
atggcctcaacacgtccctaacttg

SEQ ID NO: 561749 - DNA, 25 bp, Homo sapien
gtccctaacttgtggcccagctctg

SEQ ID NO: 561750 - DNA, 25 bp, Homo sapien
tgctccatggctaccctgaaccaga

SEQ ID NO: 561751 - DNA, 25 bp, Homo sapien
tggctaccctgaaccagatgcaccg

SEQ ID NO: 561752 - DNA, 25 bp, Homo sapien
gaaaatgtcacggaggtcaccagac

SEQ ID NO: 561753 - DNA, 25 bp, Homo sapien
ggtcaccagacctgtctatgtatca

SEQ ID NO: 561754 - DNA, 25 bp, Homo sapien
cataagatgtcaggcccttcctgga

SEQ ID NO: 561755 - DNA, 25 bp, Homo sapien
actgcttatattctgccccatttaa

SEQ ID NO: 561756 - DNA, 25 bp, Homo sapien
gaacaagagtccctccatccagata

SEQ ID NO: 561757 - DNA, 25 bp, Homo sapien
catccagataaagtagggcaggttc

SEQ ID NO: 561758 - DNA, 25 bp, Homo sapien
gtacagccactgttgatgccaccaa

SEQ ID NO: 561759 - DNA, 25 bp, Homo sapien
atgccaccaaggacgttctgatgtt

SEQ ID NO: 561760 - DNA, 25 bp, Homo sapien
aggcagagctatgttgtcctcagtg

SEQ ID NO: 561761 - DNA, 25 bp, Homo sapien
gtcagccacccggaaggtttggagt

SEQ ID NO: 561762 - DNA, 25 bp, Homo sapien
ttggagttatgcaacgagtcttcag

SEQ ID NO: 561763 - DNA, 25 bp, Homo sapien
gtatgttctacagtttttctgatgt

SEQ ID NO: 561764 - DNA, 25 bp, Homo sapien
aaatttacttattaccagcttgact

SEQ ID NO: 561765 - DNA, 25 bp, Homo sapien
cagcttgactttagatgggttgtta

SEQ ID NO: 561766 - DNA, 25 bp, Homo sapien
gttaatcttctcaagccttaatttt

SEQ ID NO: 561767 - DNA, 25 bp, Homo sapien
tactgtacttactgtgttgtgagga

SEQ ID NO: 561768 - DNA, 25 bp, Homo sapien
taaagaaaagttgtagtgccttgta

SEQ ID NO: 561769 - DNA, 25 bp, Homo sapien
atgtatcacatggtagttcctccta

SEQ ID NO: 561770 - DNA, 25 bp, Homo sapien
agttcctcctattccattgctaatg

SEQ ID NO: 561771 - DNA, 25 bp, Homo sapien
gggatatttccgtgttctcttgtac

SEQ ID NO: 561772 - DNA, 25 bp, Homo sapien
atttccgtgttctcttgtaccataa

SEQ ID NO: 561773 - DNA, 25 bp, Homo sapien
ccgtgttctcttgtaccataaaatg

SEQ ID NO: 561774 - DNA, 25 bp, Homo sapien
gcgcgaggagcagttcctgtttcat

SEQ ID NO: 561775 - DNA, 25 bp, Homo sapien
tccagcccggtcattgtagtgcgaa

SEQ ID NO: 561776 - DNA, 25 bp, Homo sapien
ggtcattgtagtgcgaaccagaaca

SEQ ID NO: 561777 - DNA, 25 bp, Homo sapien
taacagaggcactcaggagcctttt

SEQ ID NO: 561778 - DNA, 25 bp, Homo sapien
ggagccttttagtgctactgttcca

SEQ ID NO: 561779 - DNA, 25 bp, Homo sapien
gccttttagtgctactgttccagga

SEQ ID NO: 561780 - DNA, 25 bp, Homo sapien
actgaagaggcctcggtatgggaat

SEQ ID NO: 561781 - DNA, 25 bp, Homo sapien
aaacagcacgtggttggagcgccga

SEQ ID NO: 561782 - DNA, 25 bp, Homo sapien
agcgccgaggaggagactcgctcca

SEQ ID NO: 561783 - DNA, 25 bp, Homo sapien
gaggagactcgctccacctggtggc

SEQ ID NO: 561784 - DNA, 25 bp, Homo sapien
acctggtggcggtgatgtcctctcg

SEQ ID NO: 561785 - DNA, 25 bp, Homo sapien
caacttaacgtatggtggaatgagc

SEQ ID NO: 561786 - DNA, 25 bp, Homo sapien
tggaatgagcgactttgctgtgaaa

SEQ ID NO: 561787 - DNA, 25 bp, Homo sapien
gattagtaggtgtctggaacttttt

SEQ ID NO: 561788 - DNA, 25 bp, Homo sapien
ggagaacccagagcatgaataaaag

SEQ ID NO: 561789 - DNA, 25 bp, Homo sapien
taaaagttacacttggcagccagga

SEQ ID NO: 561790 - DNA, 25 bp, Homo sapien
ttacacttggcagccaggaactctt

SEQ ID NO: 561791 - DNA, 25 bp, Homo sapien
gatattctccgaaaggatcccagga

SEQ ID NO: 561792 - DNA, 25 bp, Homo sapien
caactgccatttattatgtgaagtg

SEQ ID NO: 561793 - DNA, 25 bp, Homo sapien
gggacttttaactaagccatctaag

SEQ ID NO: 561794 - DNA, 25 bp, Homo sapien
agccatctaagttaatctcccaata

SEQ ID NO: 561795 - DNA, 25 bp, Homo sapien
aagttaatctcccaatagcactatg

SEQ ID NO: 561796 - DNA, 25 bp, Homo sapien
aatggaagcagatgtacctcgacct

SEQ ID NO: 561797 - DNA, 25 bp, Homo sapien
atgtacctcgaccttttcttggata

SEQ ID NO: 561798 - DNA, 25 bp, Homo sapien
cctcgaccttttcttggatatctgt

SEQ ID NO: 561799 - DNA, 25 bp, Homo sapien
ggatatctgtcaaaataccacctca

SEQ ID NO: 561800 - DNA, 25 bp, Homo sapien
atgacccactgagtatttcttctga

SEQ ID NO: 561801 - DNA, 25 bp, Homo sapien
agatgtaatcacttcctctctagca

SEQ ID NO: 561802 - DNA, 25 bp, Homo sapien
tctctagcacacactcattcataca

SEQ ID NO: 561803 - DNA, 25 bp, Homo sapien
agcacacactcattcatacattgaa

SEQ ID NO: 561804 - DNA, 25 bp, Homo sapien
gaaacgcatgtctaaatgtattctg

SEQ ID NO: 561805 - DNA, 25 bp, Homo sapien
aatgtattctgccttcagaccatct

SEQ ID NO: 561806 - DNA, 25 bp, Homo sapien
tcagaccatctagtacctgctggta

SEQ ID NO: 561807 - DNA, 25 bp, Homo sapien
aatgacttctaaggctctttctggc

SEQ ID NO: 561808 - DNA, 25 bp, Homo sapien
aaggctctttctggcttgaactgtc

SEQ ID NO: 561809 - DNA, 25 bp, Homo sapien
tgaactgtcagagccaagcccacat

SEQ ID NO: 561810 - DNA, 25 bp, Homo sapien
tctgggagccggagcgatgctgtgt

SEQ ID NO: 561811 - DNA, 25 bp, Homo sapien
ccaaggatgaagctggcactgaaca

SEQ ID NO: 561812 - DNA, 25 bp, Homo sapien
ggcactgaacagtaagcggctccag

SEQ ID NO: 561813 - DNA, 25 bp, Homo sapien
actgaacagtaagcggctccaggcc

SEQ ID NO: 561814 - DNA, 25 bp, Homo sapien
tgtagaacgctctctggattccata

SEQ ID NO: 561815 - DNA, 25 bp, Homo sapien
gaacgctctctggattccatagctg

SEQ ID NO: 561816 - DNA, 25 bp, Homo sapien
tccatagctggaatctcctctctta

SEQ ID NO: 561817 - DNA, 25 bp, Homo sapien
gctggaatctcctctcttagctcag

SEQ ID NO: 561818 - DNA, 25 bp, Homo sapien
gaaaatacaagggtactctattcct

SEQ ID NO: 561819 - DNA, 25 bp, Homo sapien
agggtactctattccttatatggag

SEQ ID NO: 561820 - DNA, 25 bp, Homo sapien
ccttatatggagttgttgaacacag

SEQ ID NO: 561821 - DNA, 25 bp, Homo sapien
gaacacagtggtactatgaggtcgg

SEQ ID NO: 561822 - DNA, 25 bp, Homo sapien
gaaccgcaaatagtcatctctctaa

SEQ ID NO: 561823 - DNA, 25 bp, Homo sapien
ggcagtggtttcacatcagcgacac

SEQ ID NO: 561824 - DNA, 25 bp, Homo sapien
tcagcgacacacatgtgcaagctgt

SEQ ID NO: 561825 - DNA, 25 bp, Homo sapien
atgtgcaagctgtgcctacaactaa

SEQ ID NO: 561826 - DNA, 25 bp, Homo sapien
gctgtgcctacaactaaagtactaa

SEQ ID NO: 561827 - DNA, 25 bp, Homo sapien
gtactaaactcacaagcgtacctcc

SEQ ID NO: 561828 - DNA, 25 bp, Homo sapien
cacaagcgtacctcctattttatga

SEQ ID NO: 561829 - DNA, 25 bp, Homo sapien
gagatccttttaatacacgactgag

SEQ ID NO: 561830 - DNA, 25 bp, Homo sapien
ttaatacacgactgagtgccagctt

SEQ ID NO: 561831 - DNA, 25 bp, Homo sapien
agtgccagcttatttgtgatgcccc

SEQ ID NO: 561832 - DNA, 25 bp, Homo sapien
cttcccagaccaggttaggattcct

SEQ ID NO: 561833 - DNA, 25 bp, Homo sapien
gattcctgggaaggccgcggattcc

SEQ ID NO: 561834 - DNA, 25 bp, Homo sapien
gcaggatcctggagcagttttgtga

SEQ ID NO: 561835 - DNA, 25 bp, Homo sapien
gtgaggcttttgtgctcccatacgc

SEQ ID NO: 561836 - DNA, 25 bp, Homo sapien
gagtgtaaagaagactttgcctctc

SEQ ID NO: 561837 - DNA, 25 bp, Homo sapien
tttgcctctcacaactacatgtatg

SEQ ID NO: 561838 - DNA, 25 bp, Homo sapien
ctggaatcctggtaagaagccttta

SEQ ID NO: 561839 - DNA, 25 bp, Homo sapien
gtaagaagcctttatgccagcccga

SEQ ID NO: 561840 - DNA, 25 bp, Homo sapien
ggaattcccattcacctagtcctta

SEQ ID NO: 561841 - DNA, 25 bp, Homo sapien
attcacctagtccttattgctttca

SEQ ID NO: 561842 - DNA, 25 bp, Homo sapien
agtccttattgctttcatagctctc

SEQ ID NO: 561843 - DNA, 25 bp, Homo sapien
ttcatagctctcacatatctttaaa

SEQ ID NO: 561844 - DNA, 25 bp, Homo sapien
tatgatctttataatttttccatct

SEQ ID NO: 561845 - DNA, 25 bp, Homo sapien
ttccatctttttctagttgttgcag

SEQ ID NO: 561846 - DNA, 25 bp, Homo sapien
tttttctagttgttgcaggcaaagt

SEQ ID NO: 561847 - DNA, 25 bp, Homo sapien
aaagttttaggctgccatgacctac

SEQ ID NO: 561848 - DNA, 25 bp, Homo sapien
gccatgacctactatatcctattta

SEQ ID NO: 561849 - DNA, 25 bp, Homo sapien
tcctatttagaagtggaagtctcta

SEQ ID NO: 561850 - DNA, 25 bp, Homo sapien
attacagatgtgtggatattagctt

SEQ ID NO: 561851 - DNA, 25 bp, Homo sapien
gggttcaagtcggtgatgtcgtcca

SEQ ID NO: 561852 - DNA, 25 bp, Homo sapien
gtgatgtcgtccaccgagatgatca

SEQ ID NO: 561853 - DNA, 25 bp, Homo sapien
gtcgtccaccgagatgatcaatggc

SEQ ID NO: 561854 - DNA, 25 bp, Homo sapien
tgatcaatggccacaaggtcaccac

SEQ ID NO: 561855 - DNA, 25 bp, Homo sapien
aggtcaccaccaagcgcatcgtgga

SEQ ID NO: 561856 - DNA, 25 bp, Homo sapien
aagacgggcagctcaagtcggtgac

SEQ ID NO: 561857 - DNA, 25 bp, Homo sapien
agctcaagtcggtgactgtgaacgg

SEQ ID NO: 561858 - DNA, 25 bp, Homo sapien
ggccttctcggcaggctttggagaa

SEQ ID NO: 561859 - DNA, 25 bp, Homo sapien
tctcggcaggctttggagaatttcc

SEQ ID NO: 561860 - DNA, 25 bp, Homo sapien
atccttcaacatgctgggctgcagc

SEQ ID NO: 561861 - DNA, 25 bp, Homo sapien
cttcaacatgctgggctgcagcggg

SEQ ID NO: 561862 - DNA, 25 bp, Homo sapien
gtggcttaggaaggccatacctgct

SEQ ID NO: 561863 - DNA, 25 bp, Homo sapien
gggctgccagtttctttctgggacc

SEQ ID NO: 561864 - DNA, 25 bp, Homo sapien
tcgtcctcgggcattgcactggaag

SEQ ID NO: 561865 - DNA, 25 bp, Homo sapien
gaaggctggaaccagcccaaactgc

SEQ ID NO: 561866 - DNA, 25 bp, Homo sapien
aggaaggccatacctgctccctggg

SEQ ID NO: 561867 - DNA, 25 bp, Homo sapien
acctgcttcacttccaatgactagg

SEQ ID NO: 561868 - DNA, 25 bp, Homo sapien
cttccaatgactaggagccagccca

SEQ ID NO: 561869 - DNA, 25 bp, Homo sapien
ggccagtgccttgcgtttgatgtta

SEQ ID NO: 561870 - DNA, 25 bp, Homo sapien
tgcgtttgatgttacctccacacca

SEQ ID NO: 561871 - DNA, 25 bp, Homo sapien
tgggctgtggctttttctggtccct

SEQ ID NO: 561872 - DNA, 25 bp, Homo sapien
tctggtccctgctgaggccgactgg

SEQ ID NO: 561873 - DNA, 25 bp, Homo sapien
ggagactcacaagccaaacagagct

SEQ ID NO: 561874 - DNA, 25 bp, Homo sapien
acaagccaaacagagctgctttggg

SEQ ID NO: 561875 - DNA, 25 bp, Homo sapien
tgcttcctgagccatatgcccattc

SEQ ID NO: 561876 - DNA, 25 bp, Homo sapien
ccatatgcccattcctcaagctgta

SEQ ID NO: 561877 - DNA, 25 bp, Homo sapien
aagctgtacccctttcttggctatg

SEQ ID NO: 561878 - DNA, 25 bp, Homo sapien
tacccctttcttggctatgtaggat

SEQ ID NO: 561879 - DNA, 25 bp, Homo sapien
atgtaggatgagttcctcctaggcc

SEQ ID NO: 561880 - DNA, 25 bp, Homo sapien
atgagttcctcctaggcccttgtta

SEQ ID NO: 561881 - DNA, 25 bp, Homo sapien
ctaggcccttgttaggagtggctat

SEQ ID NO: 561882 - DNA, 25 bp, Homo sapien
agtggctattggattctaagcggtt

SEQ ID NO: 561883 - DNA, 25 bp, Homo sapien
aaagaacctatacattcaagaacaa

SEQ ID NO: 561884 - DNA, 25 bp, Homo sapien
aaggctcttccaccaccaaggatga

SEQ ID NO: 561885 - DNA, 25 bp, Homo sapien
tacaagcagtggtccagcatgcgca

SEQ ID NO: 561886 - DNA, 25 bp, Homo sapien
agcatgcgcacagagccagtcaagc

SEQ ID NO: 561887 - DNA, 25 bp, Homo sapien
tatgtgccccacctgcctatcaata

SEQ ID NO: 561888 - DNA, 25 bp, Homo sapien
attggtctggccctcgaggaaatgt

SEQ ID NO: 561889 - DNA, 25 bp, Homo sapien
gccctcgaggaaatgtccctgtgga

SEQ ID NO: 561890 - DNA, 25 bp, Homo sapien
atgtccctgtggaaagccagaccac

SEQ ID NO: 561891 - DNA, 25 bp, Homo sapien
tggaaagccagaccacctacaccat

SEQ ID NO: 561892 - DNA, 25 bp, Homo sapien
caccatcagctttactcccaaggaa

SEQ ID NO: 561893 - DNA, 25 bp, Homo sapien
atgggcaggtgcctagcttcatatc

SEQ ID NO: 561894 - DNA, 25 bp, Homo sapien
tagcttcatatcctgagcctcctgg

SEQ ID NO: 561895 - DNA, 25 bp, Homo sapien
aatgctatcttttaagcctgaacat

SEQ ID NO: 561896 - DNA, 25 bp, Homo sapien
taagcctgaacatgtgggtttttta

SEQ ID NO: 561897 - DNA, 25 bp, Homo sapien
agacaactgatgtcatgctgtcttg

SEQ ID NO: 561898 - DNA, 25 bp, Homo sapien
catgctgtcttggtatccatactaa

SEQ ID NO: 561899 - DNA, 25 bp, Homo sapien
ttgtgctgtgaaacactattcagtg

SEQ ID NO: 561900 - DNA, 25 bp, Homo sapien
gacttaatacctgaaatgcactttt

SEQ ID NO: 561901 - DNA, 25 bp, Homo sapien
gtttgccttatatccaagtgtttac

SEQ ID NO: 561902 - DNA, 25 bp, Homo sapien
aagtgtttacttgtatccatgacct

SEQ ID NO: 561903 - DNA, 25 bp, Homo sapien
gtatccatgacctaaccgtctattg

SEQ ID NO: 561904 - DNA, 25 bp, Homo sapien
gacctaaccgtctattgaaaagaat

SEQ ID NO: 561905 - DNA, 25 bp, Homo sapien
gaatgtttgcagatgcagattgcaa

SEQ ID NO: 561906 - DNA, 25 bp, Homo sapien
ggcaaggcctgcctgagactgagga

SEQ ID NO: 561907 - DNA, 25 bp, Homo sapien
ggtttgaccactcccgaggctgcca

SEQ ID NO: 561908 - DNA, 25 bp, Homo sapien
cactcccgaggctgccatgcggtgg

SEQ ID NO: 561909 - DNA, 25 bp, Homo sapien
atgcggtgggaccaccctgctgtcc

SEQ ID NO: 561910 - DNA, 25 bp, Homo sapien
ttgtctctccagcaagactgtgcac

SEQ ID NO: 561911 - DNA, 25 bp, Homo sapien
tgctgctcttgtgtcccacgtggta

SEQ ID NO: 561912 - DNA, 25 bp, Homo sapien
tgtcccacgtggtacttagttcaag

SEQ ID NO: 561913 - DNA, 25 bp, Homo sapien
gtggtacttagttcaaggctgcccc

SEQ ID NO: 561914 - DNA, 25 bp, Homo sapien
ggtacttagttcaaggctgccccag

SEQ ID NO: 561915 - DNA, 25 bp, Homo sapien
gatgcttaataaacagctcttcact

SEQ ID NO: 561916 - DNA, 25 bp, Homo sapien
gcttaataaacagctcttcactttc

SEQ ID NO: 561917 - DNA, 25 bp, Homo sapien
tgtctaaaagttaggccttcgggct

SEQ ID NO: 561918 - DNA, 25 bp, Homo sapien
ggccttcgggcttcaaaagttagtg

SEQ ID NO: 561919 - DNA, 25 bp, Homo sapien
gttagtggtcatcgaaaagcattaa

SEQ ID NO: 561920 - DNA, 25 bp, Homo sapien
gttagcttttttcatacagtgtatt

SEQ ID NO: 561921 - DNA, 25 bp, Homo sapien
caacacattggttttgattagggat

SEQ ID NO: 561922 - DNA, 25 bp, Homo sapien
gtattgacaggaattgagagctatt

SEQ ID NO: 561923 - DNA, 25 bp, Homo sapien
gagagctattggtaggccagtgtat

SEQ ID NO: 561924 - DNA, 25 bp, Homo sapien
aaatttactgagtcagcttgctgaa

SEQ ID NO: 561925 - DNA, 25 bp, Homo sapien
cttgctgaataagacagaagcccaa

SEQ ID NO: 561926 - DNA, 25 bp, Homo sapien
gaagcccaagaattttaacagtgtg

SEQ ID NO: 561927 - DNA, 25 bp, Homo sapien
acagtgtgtagctttagttgtctaa

SEQ ID NO: 561928 - DNA, 25 bp, Homo sapien
ttttccttccgaacctggagtatca

SEQ ID NO: 561929 - DNA, 25 bp, Homo sapien
aaacagcagtttcacaccagaatag

SEQ ID NO: 561930 - DNA, 25 bp, Homo sapien
accagaatagcagtgccctttcttt

SEQ ID NO: 561931 - DNA, 25 bp, Homo sapien
ttgtacatactgattggacctttct

SEQ ID NO: 561932 - DNA, 25 bp, Homo sapien
gattggacctttctttactgttacg

SEQ ID NO: 561933 - DNA, 25 bp, Homo sapien
tactgttacgtggacactttctatg

SEQ ID NO: 561934 - DNA, 25 bp, Homo sapien
ggacactttctatgttagttttgat

SEQ ID NO: 561935 - DNA, 25 bp, Homo sapien
gatgcataattctttgaatcctttt

SEQ ID NO: 561936 - DNA, 25 bp, Homo sapien
gaatccttttatacaaactagaatg

SEQ ID NO: 561937 - DNA, 25 bp, Homo sapien
gtgtaagaatacctgtccctgcaat

SEQ ID NO: 561938 - DNA, 25 bp, Homo sapien
acctgtccctgcaatgtagtaacta

SEQ ID NO: 561939 - DNA, 25 bp, Homo sapien
gaattcaactcacatgtctcttgca

SEQ ID NO: 561940 - DNA, 25 bp, Homo sapien
tctcttgcatggagaaccctcacct

SEQ ID NO: 561941 - DNA, 25 bp, Homo sapien
agaaccctcacctactgtgttgaga

SEQ ID NO: 561942 - DNA, 25 bp, Homo sapien
ccaggtgggatcctctctcgacttc

SEQ ID NO: 561943 - DNA, 25 bp, Homo sapien
ccatacatttctttcacagcattta

SEQ ID NO: 561944 - DNA, 25 bp, Homo sapien
ctttcacagcatttacatagtccat

SEQ ID NO: 561945 - DNA, 25 bp, Homo sapien
catagtccatgatagtttacttgtg

SEQ ID NO: 561946 - DNA, 25 bp, Homo sapien
ttaatctttgcctttaacaccaggg

SEQ ID NO: 561947 - DNA, 25 bp, Homo sapien
tgcctttaacaccagggttccttgg

SEQ ID NO: 561948 - DNA, 25 bp, Homo sapien
tgctactacctctgcttgaacagct

SEQ ID NO: 561949 - DNA, 25 bp, Homo sapien
tccaaccctacccttgtataggtga

SEQ ID NO: 561950 - DNA, 25 bp, Homo sapien
atatgaataacccacagatgtactg

SEQ ID NO: 561951 - DNA, 25 bp, Homo sapien
gtactgaattacttttggtgctatc

SEQ ID NO: 561952 - DNA, 25 bp, Homo sapien
cttttggtgctatcttgtactcttc

SEQ ID NO: 561953 - DNA, 25 bp, Homo sapien
tgtactcttcaatctgtaacacaat

SEQ ID NO: 561954 - DNA, 25 bp, Homo sapien
taaaatccctttgtacgatgtctaa

SEQ ID NO: 561955 - DNA, 25 bp, Homo sapien
gcaccctgagccataaattgcttaa

SEQ ID NO: 561956 - DNA, 25 bp, Homo sapien
atcagcccattgatacatgtattca

SEQ ID NO: 561957 - DNA, 25 bp, Homo sapien
attcatgagctctcagcattcccat

SEQ ID NO: 561958 - DNA, 25 bp, Homo sapien
catccagctctgcagtgcattgagg

SEQ ID NO: 561959 - DNA, 25 bp, Homo sapien
gaggcttctctttaatggtcaccac

SEQ ID NO: 561960 - DNA, 25 bp, Homo sapien
tggtcaccactgtggtggtttttcc

SEQ ID NO: 561961 - DNA, 25 bp, Homo sapien
tggtattggagtatagcatatctat

SEQ ID NO: 561962 - DNA, 25 bp, Homo sapien
tagcatatctattattctgctcaat

SEQ ID NO: 561963 - DNA, 25 bp, Homo sapien
tctgctcaattagaagatattgttc

SEQ ID NO: 561964 - DNA, 25 bp, Homo sapien
gcagatgcatccatctcttggattc

SEQ ID NO: 561965 - DNA, 25 bp, Homo sapien
gatgcatccatctcttggattctca

SEQ ID NO: 561966 - DNA, 25 bp, Homo sapien
catctcttggattctcattccttct

SEQ ID NO: 561967 - DNA, 25 bp, Homo sapien
tctcattccttctaccactgcagaa

SEQ ID NO: 561968 - DNA, 25 bp, Homo sapien
gaactttcacctgtaatcactttcc

SEQ ID NO: 561969 - DNA, 25 bp, Homo sapien
tcacctgtaatcactttcctttggc

SEQ ID NO: 561970 - DNA, 25 bp, Homo sapien
tttccaatttttgaccagatataat

SEQ ID NO: 561971 - DNA, 25 bp, Homo sapien
ttcctgaaaaatactattgttgtgg

SEQ ID NO: 561972 - DNA, 25 bp, Homo sapien
actttcctggaagatcgatgtcccg

SEQ ID NO: 561973 - DNA, 25 bp, Homo sapien
tttcctggaagatcgatgtcccgat

SEQ ID NO: 561974 - DNA, 25 bp, Homo sapien
ggaagatcgatgtcccgatcaggaa

SEQ ID NO: 561975 - DNA, 25 bp, Homo sapien
tcgatgtcccgatcaggaaggtaga

SEQ ID NO: 561976 - DNA, 25 bp, Homo sapien
gtagagagttttcctgttcagatta

SEQ ID NO: 561977 - DNA, 25 bp, Homo sapien
gagagttttcctgttcagattaccc

SEQ ID NO: 561978 - DNA, 25 bp, Homo sapien
gagttttcctgttcagattaccctg

SEQ ID NO: 561979 - DNA, 25 bp, Homo sapien
gttttcctgttcagattaccctgcc

SEQ ID NO: 561980 - DNA, 25 bp, Homo sapien
ttcctgttcagattaccctgcccag

SEQ ID NO: 561981 - DNA, 25 bp, Homo sapien
tgcccagcaggaactggaatacagt

SEQ ID NO: 561982 - DNA, 25 bp, Homo sapien
caggaactggaatacagtgttcggg

SEQ ID NO: 561983 - DNA, 25 bp, Homo sapien
aaataacattcggcaatatttgaaa

SEQ ID NO: 561984 - DNA, 25 bp, Homo sapien
aataacattcggcaatatttgaaag

SEQ ID NO: 561985 - DNA, 25 bp, Homo sapien
ataacattcggcaatatttgaaaga

SEQ ID NO: 561986 - DNA, 25 bp, Homo sapien
taacattcggcaatatttgaaagat

SEQ ID NO: 561987 - DNA, 25 bp, Homo sapien
aacattcggcaatatttgaaagata

SEQ ID NO: 561988 - DNA, 25 bp, Homo sapien
acattcggcaatatttgaaagatac

SEQ ID NO: 561989 - DNA, 25 bp, Homo sapien
cattcggcaatatttgaaagatacc

SEQ ID NO: 561990 - DNA, 25 bp, Homo sapien
attcggcaatatttgaaagatacca

SEQ ID NO: 561991 - DNA, 25 bp, Homo sapien
ttcggcaatatttgaaagataccac

SEQ ID NO: 561992 - DNA, 25 bp, Homo sapien
tcggcaatatttgaaagataccact

SEQ ID NO: 561993 - DNA, 25 bp, Homo sapien
gtgtcatggttaggtcccacagcta

SEQ ID NO: 561994 - DNA, 25 bp, Homo sapien
tggttaggtcccacagctagactac

SEQ ID NO: 561995 - DNA, 25 bp, Homo sapien
gtcccacagctagactacctgagtt

SEQ ID NO: 561996 - DNA, 25 bp, Homo sapien
tgtacaaattcactcaggtcatatg

SEQ ID NO: 561997 - DNA, 25 bp, Homo sapien
ggaatattaatagtctacacctcat

SEQ ID NO: 561998 - DNA, 25 bp, Homo sapien
agtctacacctcataagattgttgt

SEQ ID NO: 561999 - DNA, 25 bp, Homo sapien
aggtcatatgtactggagtcacaat

SEQ ID NO: 562000 - DNA, 25 bp, Homo sapien
tggagtcacaattcaaacctagatg

SEQ ID NO: 562001 - DNA, 25 bp, Homo sapien
cctagatgtaagttttccagagtca

SEQ ID NO: 562002 - DNA, 25 bp, Homo sapien
gtcagggtgcttgtggtatgcttaa

SEQ ID NO: 562003 - DNA, 25 bp, Homo sapien
gtggtatgcttaatacaagctttta

SEQ ID NO: 562004 - DNA, 25 bp, Homo sapien
cacaggcatacataaatcggcttta

SEQ ID NO: 562005 - DNA, 25 bp, Homo sapien
ggcatacataaatcggctttaaaat

SEQ ID NO: 562006 - DNA, 25 bp, Homo sapien
aaaatatttgactcagttactcaga

SEQ ID NO: 562007 - DNA, 25 bp, Homo sapien
atatttgactcagttactcagatgt

SEQ ID NO: 562008 - DNA, 25 bp, Homo sapien
gtatacaacattggataacactttc

SEQ ID NO: 562009 - DNA, 25 bp, Homo sapien
attggataacactttcaaatgaata

SEQ ID NO: 562010 - DNA, 25 bp, Homo sapien
cattttggaaagatcttgggtgcct

SEQ ID NO: 562011 - DNA, 25 bp, Homo sapien
tggaaagatcttgggtgcctaatca

SEQ ID NO: 562012 - DNA, 25 bp, Homo sapien
aaagatcttgggtgcctaatcacat

SEQ ID NO: 562013 - DNA, 25 bp, Homo sapien
gatcttgggtgcctaatcacatatt

SEQ ID NO: 562014 - DNA, 25 bp, Homo sapien
cttgggtgcctaatcacatattttc

SEQ ID NO: 562015 - DNA, 25 bp, Homo sapien
ttcttccttcatgaaaatttctcca

SEQ ID NO: 562016 - DNA, 25 bp, Homo sapien
atgaaaatttctccaacagccactc

SEQ ID NO: 562017 - DNA, 25 bp, Homo sapien
cacggtcctgtgtgttccggatatt

SEQ ID NO: 562018 - DNA, 25 bp, Homo sapien
ctgtgtgttccggatattttaaaat

SEQ ID NO: 562019 - DNA, 25 bp, Homo sapien
atggctataaggttgagcacttcag

SEQ ID NO: 562020 - DNA, 25 bp, Homo sapien
tgagcacttcaggatacgctgtttt

SEQ ID NO: 562021 - DNA, 25 bp, Homo sapien
aggatacgctgttttgctgtgtgca

SEQ ID NO: 562022 - DNA, 25 bp, Homo sapien
cgctgttttgctgtgtgcagatgga

SEQ ID NO: 562023 - DNA, 25 bp, Homo sapien
tggctggagtgaatgaacggcaaca

SEQ ID NO: 562024 - DNA, 25 bp, Homo sapien
gaatgaacggcaacacttgctggca

SEQ ID NO: 562025 - DNA, 25 bp, Homo sapien
aacggcaacacttgctggcaaccgg

SEQ ID NO: 562026 - DNA, 25 bp, Homo sapien
atggcagaaccaaacaagagtagta

SEQ ID NO: 562027 - DNA, 25 bp, Homo sapien
caagagtagtacaccttggagtttt

SEQ ID NO: 562028 - DNA, 25 bp, Homo sapien
caccttggagttttttcgaaatatg

SEQ ID NO: 562029 - DNA, 25 bp, Homo sapien
aatttaaatgccttcagcgtctgtg

SEQ ID NO: 562030 - DNA, 25 bp, Homo sapien
tcagcgtctgtgataggtgccaaca

SEQ ID NO: 562031 - DNA, 25 bp, Homo sapien
gtgataggtgccaacatgaagctac

SEQ ID NO: 562032 - DNA, 25 bp, Homo sapien
aacatgaagctaccgagttccagag

SEQ ID NO: 562033 - DNA, 25 bp, Homo sapien
gaagctaccgagttccagagaaaga

SEQ ID NO: 562034 - DNA, 25 bp, Homo sapien
gggagagctgatcactcatcagtgc

SEQ ID NO: 562035 - DNA, 25 bp, Homo sapien
aagggcccttcaggacctatctgtt

SEQ ID NO: 562036 - DNA, 25 bp, Homo sapien
ttcaggacctatctgttctttgtgt

SEQ ID NO: 562037 - DNA, 25 bp, Homo sapien
ttgctgttacaataagcttgcctgc

SEQ ID NO: 562038 - DNA, 25 bp, Homo sapien
ctgttacaataagcttgcctgcctt

SEQ ID NO: 562039 - DNA, 25 bp, Homo sapien
tgaagaaaagaagaccagggccaaa

SEQ ID NO: 562040 - DNA, 25 bp, Homo sapien
accagggccaaagggaaatcagtca

SEQ ID NO: 562041 - DNA, 25 bp, Homo sapien
gaaatcagtcaagggagcctgtttt

SEQ ID NO: 562042 - DNA, 25 bp, Homo sapien
aagggagcctgttttgtctgaaata

SEQ ID NO: 562043 - DNA, 25 bp, Homo sapien
gcctgttttgtctgaaataatgcat

SEQ ID NO: 562044 - DNA, 25 bp, Homo sapien
gagtataactgtctttttacatcag

SEQ ID NO: 562045 - DNA, 25 bp, Homo sapien
aagagaacatccaaggccactccta

SEQ ID NO: 562046 - DNA, 25 bp, Homo sapien
ggccactcctagcttgagtagatta

SEQ ID NO: 562047 - DNA, 25 bp, Homo sapien
gcttgagtagattaaatttgtcctt

SEQ ID NO: 562048 - DNA, 25 bp, Homo sapien
tgtattttcccatgatgcacattat

SEQ ID NO: 562049 - DNA, 25 bp, Homo sapien
tgtgggaggctgtcattcattcatt

SEQ ID NO: 562050 - DNA, 25 bp, Homo sapien
tcatttttactgctgaaggcttaca

SEQ ID NO: 562051 - DNA, 25 bp, Homo sapien
aaggcttacatatcgttttaccaca

SEQ ID NO: 562052 - DNA, 25 bp, Homo sapien
tttaccacaatttcaccagtttcct

SEQ ID NO: 562053 - DNA, 25 bp, Homo sapien
caccagtttcctattgatgtacatg

SEQ ID NO: 562054 - DNA, 25 bp, Homo sapien
tgtacatgtggctgattccagtttt

SEQ ID NO: 562055 - DNA, 25 bp, Homo sapien
attagtgtgcatgtctcctgtgcac

SEQ ID NO: 562056 - DNA, 25 bp, Homo sapien
atgtctcctgtgcacataggcaaga

SEQ ID NO: 562057 - DNA, 25 bp, Homo sapien
gctggtttttaagcttcctgtatag

SEQ ID NO: 562058 - DNA, 25 bp, Homo sapien
gcaaattcctactgcatgtattttc

SEQ ID NO: 562059 - DNA, 25 bp, Homo sapien
gggatggcttttggacttcagtgaa

SEQ ID NO: 562060 - DNA, 25 bp, Homo sapien
gaatttctgctactcattgttgata

SEQ ID NO: 562061 - DNA, 25 bp, Homo sapien
gttgataacgcttcagtactgtata

SEQ ID NO: 562062 - DNA, 25 bp, Homo sapien
cacgtaatttgttttctatgatatg

SEQ ID NO: 562063 - DNA, 25 bp, Homo sapien
gaacttttattataatttgcctcag

SEQ ID NO: 562064 - DNA, 25 bp, Homo sapien
tttgcctcagtcttgatagaatctt

SEQ ID NO: 562065 - DNA, 25 bp, Homo sapien
atctgtggtcgtctgaggtattctc

SEQ ID NO: 562066 - DNA, 25 bp, Homo sapien
aggtattctccatgctataacccag

SEQ ID NO: 562067 - DNA, 25 bp, Homo sapien
gacagtaaataccttgttcttgtat

SEQ ID NO: 562068 - DNA, 25 bp, Homo sapien
gttcttgtattaggtctatatcctg

SEQ ID NO: 562069 - DNA, 25 bp, Homo sapien
atatcctgaattgacctttagcaag

SEQ ID NO: 562070 - DNA, 25 bp, Homo sapien
cccgctggagctgtttgatccagta

SEQ ID NO: 562071 - DNA, 25 bp, Homo sapien
tgatccagtagagccagtcgaagcc

SEQ ID NO: 562072 - DNA, 25 bp, Homo sapien
ggaccctgacttgaatcttgctttc

SEQ ID NO: 562073 - DNA, 25 bp, Homo sapien
aatcttgctttctgacatgctggct

SEQ ID NO: 562074 - DNA, 25 bp, Homo sapien
gaataagagcttgcttactcccggt

SEQ ID NO: 562075 - DNA, 25 bp, Homo sapien
ggtgttcaccacagcggaaccatgg

SEQ ID NO: 562076 - DNA, 25 bp, Homo sapien
aattctcaaccagcccagtttaatc

SEQ ID NO: 562077 - DNA, 25 bp, Homo sapien
accagcccagtttaatcagcgaaag

SEQ ID NO: 562078 - DNA, 25 bp, Homo sapien
acaatagagcttgcaggcggtgtca

SEQ ID NO: 562079 - DNA, 25 bp, Homo sapien
aggcggtgtcatgctgagtatctga

SEQ ID NO: 562080 - DNA, 25 bp, Homo sapien
tgagtatctgaacacaccatggctg

SEQ ID NO: 562081 - DNA, 25 bp, Homo sapien
ggaagatctctctaacacctctcgg

SEQ ID NO: 562082 - DNA, 25 bp, Homo sapien
acctctcggccaacttcagaagtgt

SEQ ID NO: 562083 - DNA, 25 bp, Homo sapien
agaagtgtataagatcagctttatc

SEQ ID NO: 562084 - DNA, 25 bp, Homo sapien
atcagctttatctttccaaatggag

SEQ ID NO: 562085 - DNA, 25 bp, Homo sapien
tggagacaagtatgatggtgactgt

SEQ ID NO: 562086 - DNA, 25 bp, Homo sapien
tggtgactgtacaagaacatcttct

SEQ ID NO: 562087 - DNA, 25 bp, Homo sapien
atcttctggaatctacgagagaaat

SEQ ID NO: 562088 - DNA, 25 bp, Homo sapien
aggtattcataccactcctaatggg

SEQ ID NO: 562089 - DNA, 25 bp, Homo sapien
actcctaatgggattgtctacacag

SEQ ID NO: 562090 - DNA, 25 bp, Homo sapien
gggattgtctacacaggaagctgga

SEQ ID NO: 562091 - DNA, 25 bp, Homo sapien
aggataatatgtttcatggactggg

SEQ ID NO: 562092 - DNA, 25 bp, Homo sapien
gtcgtagaatggaaagctgtaacac

SEQ ID NO: 562093 - DNA, 25 bp, Homo sapien
actgagaatgatgaaccgatgccgc

SEQ ID NO: 562094 - DNA, 25 bp, Homo sapien
aatgatgaaccgatgccgcatgcaa

SEQ ID NO: 562095 - DNA, 25 bp, Homo sapien
cgatgccgcatgcaaccaggttgaa

SEQ ID NO: 562096 - DNA, 25 bp, Homo sapien
gcaaccaggttgaatctcagaagca

SEQ ID NO: 562097 - DNA, 25 bp, Homo sapien
gaatctcagaagcataattgtaagg

SEQ ID NO: 562098 - DNA, 25 bp, Homo sapien
gtaagggcaatgagctggatataga

SEQ ID NO: 562099 - DNA, 25 bp, Homo sapien
gctccagaaacagtagtgtttgggc

SEQ ID NO: 562100 - DNA, 25 bp, Homo sapien
agtgtttgggcatctatatttgagt

SEQ ID NO: 562101 - DNA, 25 bp, Homo sapien
ggcatctatatttgagtggtaaagc

SEQ ID NO: 562102 - DNA, 25 bp, Homo sapien
cagctaaaactgtcatgagagtgtt

SEQ ID NO: 562103 - DNA, 25 bp, Homo sapien
acgcacacgctgtctatgtcgatta

SEQ ID NO: 562104 - DNA, 25 bp, Homo sapien
acgctgtctatgtcgattaggctgc

SEQ ID NO: 562105 - DNA, 25 bp, Homo sapien
atgtcgattaggctgctgtgccgtc

SEQ ID NO: 562106 - DNA, 25 bp, Homo sapien
agccttcagctccttgatctgctca

SEQ ID NO: 562107 - DNA, 25 bp, Homo sapien
gccaactccgggttcaagtcaaact

SEQ ID NO: 562108 - DNA, 25 bp, Homo sapien
ggttcaagtcaaactccgctgggaa

SEQ ID NO: 562109 - DNA, 25 bp, Homo sapien
agatccagtacctgaccaggtggca

SEQ ID NO: 562110 - DNA, 25 bp, Homo sapien
tacctgaccaggtggcacgttttca

SEQ ID NO: 562111 - DNA, 25 bp, Homo sapien
cacgttttcacctgcagggaattgg

SEQ ID NO: 562112 - DNA, 25 bp, Homo sapien
cctgcagggaattggagttgtcctt

SEQ ID NO: 562113 - DNA, 25 bp, Homo sapien
gatggtataggatactgagtgcccc

SEQ ID NO: 562114 - DNA, 25 bp, Homo sapien
attagacccactttacagataggga

SEQ ID NO: 562115 - DNA, 25 bp, Homo sapien
agacacacggcccaagtgagagaag

SEQ ID NO: 562116 - DNA, 25 bp, Homo sapien
agtgaggacgacacctggactccat

SEQ ID NO: 562117 - DNA, 25 bp, Homo sapien
tggactccatctcgtgaccaaaatg

SEQ ID NO: 562118 - DNA, 25 bp, Homo sapien
gtgaccaaaatgttcgtggccactg

SEQ ID NO: 562119 - DNA, 25 bp, Homo sapien
atgttcgtggccactgaagggaccc

SEQ ID NO: 562120 - DNA, 25 bp, Homo sapien
ctgaagggacccgtctctgggtgaa

SEQ ID NO: 562121 - DNA, 25 bp, Homo sapien
gggcccagtctttaccttggtgaga

SEQ ID NO: 562122 - DNA, 25 bp, Homo sapien
aggacctggcccctcatatgatttg

SEQ ID NO: 562123 - DNA, 25 bp, Homo sapien
cccctcatatgatttggcccattta

SEQ ID NO: 562124 - DNA, 25 bp, Homo sapien
tggcccatttaatccttgcaaagag

SEQ ID NO: 562125 - DNA, 25 bp, Homo sapien
gaactatgccctggttattctaatc

SEQ ID NO: 562126 - DNA, 25 bp, Homo sapien
actatgccctggttattctaatccc

SEQ ID NO: 562127 - DNA, 25 bp, Homo sapien
tgccctggttattctaatcccaatt

SEQ ID NO: 562128 - DNA, 25 bp, Homo sapien
agcaaagtgttatactgatcttgag

SEQ ID NO: 562129 - DNA, 25 bp, Homo sapien
agtgttatactgatcttgaggaaaa

SEQ ID NO: 562130 - DNA, 25 bp, Homo sapien
atcttgaggaaaaccagaatgcttt

SEQ ID NO: 562131 - DNA, 25 bp, Homo sapien
aaccagaatgctttgaagttctgta

SEQ ID NO: 562132 - DNA, 25 bp, Homo sapien
ttggctttattgcttcctactgtta

SEQ ID NO: 562133 - DNA, 25 bp, Homo sapien
gctttattgcttcctactgttacca

SEQ ID NO: 562134 - DNA, 25 bp, Homo sapien
tattgcttcctactgttaccaaaga

SEQ ID NO: 562135 - DNA, 25 bp, Homo sapien
tgcttcctactgttaccaaagagga

SEQ ID NO: 562136 - DNA, 25 bp, Homo sapien
gtgatttcactagtcaaaaatttcc

SEQ ID NO: 562137 - DNA, 25 bp, Homo sapien
aaaaatttccaagactacatctagt

SEQ ID NO: 562138 - DNA, 25 bp, Homo sapien
gactacatctagtatttttctcaat

SEQ ID NO: 562139 - DNA, 25 bp, Homo sapien
tttctcaattgacctttatctcatg

SEQ ID NO: 562140 - DNA, 25 bp, Homo sapien
gacctttatctcatgattgtacagc

SEQ ID NO: 562141 - DNA, 25 bp, Homo sapien
atctcatgattgtacagcatacttg

SEQ ID NO: 562142 - DNA, 25 bp, Homo sapien
gcatacttgataactgattctcaga

SEQ ID NO: 562143 - DNA, 25 bp, Homo sapien
gattctcagaacattgatattcatc

SEQ ID NO: 562144 - DNA, 25 bp, Homo sapien
atgggtcaccagataagaattattt

SEQ ID NO: 562145 - DNA, 25 bp, Homo sapien
tgttttcctgatacaagctgtttgt

SEQ ID NO: 562146 - DNA, 25 bp, Homo sapien
atgaccaacttttaatcacacttga

SEQ ID NO: 562147 - DNA, 25 bp, Homo sapien
tggatgtacattcagaaatgttctt

SEQ ID NO: 562148 - DNA, 25 bp, Homo sapien
gacactttcatggtccagaaagctg

SEQ ID NO: 562149 - DNA, 25 bp, Homo sapien
tcatggtccagaaagctgaaggcct

SEQ ID NO: 562150 - DNA, 25 bp, Homo sapien
tgaaggcctgggcatctcttgtgac

SEQ ID NO: 562151 - DNA, 25 bp, Homo sapien
tcttgtgacatttttctaatattag

SEQ ID NO: 562152 - DNA, 25 bp, Homo sapien
ttagattttcacgtattaggcactt

SEQ ID NO: 562153 - DNA, 25 bp, Homo sapien
gattttcacgtattaggcactttag

SEQ ID NO: 562154 - DNA, 25 bp, Homo sapien
aggcactttagttgaatcttccagc

SEQ ID NO: 562155 - DNA, 25 bp, Homo sapien
tagttgaatcttccagcaaaagctg

SEQ ID NO: 562156 - DNA, 25 bp, Homo sapien
ccagcaaaagctgtctactttctct

SEQ ID NO: 562157 - DNA, 25 bp, Homo sapien
gtctactttctcttttattcactgt

SEQ ID NO: 562158 - DNA, 25 bp, Homo sapien
gtaacttttgaaaggcagcctgcct

SEQ ID NO: 562159 - DNA, 25 bp, Homo sapien
acttttgaaaggcagcctgcctcct

SEQ ID NO: 562160 - DNA, 25 bp, Homo sapien
gcaaatgaggtgttccactgtgtcc

SEQ ID NO: 562161 - DNA, 25 bp, Homo sapien
gttccactgtgtccactttgagtgt

SEQ ID NO: 562162 - DNA, 25 bp, Homo sapien
gtgtccactttgagtgtccagagca

SEQ ID NO: 562163 - DNA, 25 bp, Homo sapien
gtccactttgagtgtccagagcagc

SEQ ID NO: 562164 - DNA, 25 bp, Homo sapien
gcagccagaaggaggaaaatagtga

SEQ ID NO: 562165 - DNA, 25 bp, Homo sapien
ggacaccagcctggccggtcagcag

SEQ ID NO: 562166 - DNA, 25 bp, Homo sapien
gcgggcgcctagtggcagctcacta

SEQ ID NO: 562167 - DNA, 25 bp, Homo sapien
ccaaccggcagcaccaataaaggag

SEQ ID NO: 562168 - DNA, 25 bp, Homo sapien
aggcagcgggcctggtgtgacttgg

SEQ ID NO: 562169 - DNA, 25 bp, Homo sapien
tatgaatcggcagaaatgtggaaaa

SEQ ID NO: 562170 - DNA, 25 bp, Homo sapien
gaaaacttgtaatttgttcaaagag

SEQ ID NO: 562171 - DNA, 25 bp, Homo sapien
ttttttggactgtcttggtacagtt

SEQ ID NO: 562172 - DNA, 25 bp, Homo sapien
ggactgtcttggtacagttatgatt

SEQ ID NO: 562173 - DNA, 25 bp, Homo sapien
gaaaaatggcagaagtcagataatt

SEQ ID NO: 562174 - DNA, 25 bp, Homo sapien
ggaataatatggagtcatcttataa

SEQ ID NO: 562175 - DNA, 25 bp, Homo sapien
atggagtcatcttataattatgaag

SEQ ID NO: 562176 - DNA, 25 bp, Homo sapien
cttgtcatgacatggcatcatatta

SEQ ID NO: 562177 - DNA, 25 bp, Homo sapien
gtcatgacatggcatcatattaagc

SEQ ID NO: 562178 - DNA, 25 bp, Homo sapien
atcatattaagcagagcacaactca

SEQ ID NO: 562179 - DNA, 25 bp, Homo sapien
ttaagcagagcacaactcaaaattg

SEQ ID NO: 562180 - DNA, 25 bp, Homo sapien
ggtggctatgaacccagaggtcgtg

SEQ ID NO: 562181 - DNA, 25 bp, Homo sapien
gctatgaacccagaggtcgtggagg

SEQ ID NO: 562182 - DNA, 25 bp, Homo sapien
cagaggtggcatgggcggaagtgac

SEQ ID NO: 562183 - DNA, 25 bp, Homo sapien
cggaagtgaccgtggtggcttcaat

SEQ ID NO: 562184 - DNA, 25 bp, Homo sapien
ggaagtgaccgtggtggcttcaata

SEQ ID NO: 562185 - DNA, 25 bp, Homo sapien
aagtgaccgtggtggcttcaataaa

SEQ ID NO: 562186 - DNA, 25 bp, Homo sapien
agtgaccgtggtggcttcaataaat

SEQ ID NO: 562187 - DNA, 25 bp, Homo sapien
tgaccgtggtggcttcaataaattt

SEQ ID NO: 562188 - DNA, 25 bp, Homo sapien
gaccgtggtggcttcaataaatttg

SEQ ID NO: 562189 - DNA, 25 bp, Homo sapien
accgtggtggcttcaataaatttgg

SEQ ID NO: 562190 - DNA, 25 bp, Homo sapien
cgtggtggcttcaataaatttggtg

SEQ ID NO: 562191 - DNA, 25 bp, Homo sapien
taatgtcagtataccatatctgcaa

SEQ ID NO: 562192 - DNA, 25 bp, Homo sapien
gtataccatatctgcaaattcgttc

SEQ ID NO: 562193 - DNA, 25 bp, Homo sapien
atatctgcaaattcgttcaataaag

SEQ ID NO: 562194 - DNA, 25 bp, Homo sapien
aaatttggtttagctcttgtcatag

SEQ ID NO: 562195 - DNA, 25 bp, Homo sapien
gctcttgtcatagaaagctctcagc

SEQ ID NO: 562196 - DNA, 25 bp, Homo sapien
cagagtggtggatatgttcttggct

SEQ ID NO: 562197 - DNA, 25 bp, Homo sapien
ttcacaaagtctattctgccagtcc

SEQ ID NO: 562198 - DNA, 25 bp, Homo sapien
ctattctgccagtcccatatttgga

SEQ ID NO: 562199 - DNA, 25 bp, Homo sapien
ggaatttatccagagatcagggcaa

SEQ ID NO: 562200 - DNA, 25 bp, Homo sapien
gatcagggcaatttaggaaccttat

SEQ ID NO: 562201 - DNA, 25 bp, Homo sapien
atgtgagaattgtgtggcatgcaaa

SEQ ID NO: 562202 - DNA, 25 bp, Homo sapien
atattttacttgtactgaacttgaa

SEQ ID NO: 562203 - DNA, 25 bp, Homo sapien
aaatggctaacactatgatttgtct

SEQ ID NO: 562204 - DNA, 25 bp, Homo sapien
ggctaacactatgatttgtcttatt

SEQ ID NO: 562205 - DNA, 25 bp, Homo sapien
agatgtctctgcaccggtaagatta

SEQ ID NO: 562206 - DNA, 25 bp, Homo sapien
gtctctgcaccggtaagattaatac

SEQ ID NO: 562207 - DNA, 25 bp, Homo sapien
tctgcaccggtaagattaatacaat

SEQ ID NO: 562208 - DNA, 25 bp, Homo sapien
acaatatgtgaatgtctatttttta

SEQ ID NO: 562209 - DNA, 25 bp, Homo sapien
tttttatatcttaactcacaatgag

SEQ ID NO: 562210 - DNA, 25 bp, Homo sapien
ttttagtcatgagtttatttcaata

SEQ ID NO: 562211 - DNA, 25 bp, Homo sapien
ttttattctttccttgtatctaaat

SEQ ID NO: 562212 - DNA, 25 bp, Homo sapien
attctttccttgtatctaaatataa

SEQ ID NO: 562213 - DNA, 25 bp, Homo sapien
caaagaggataaagaggcacagaaa

SEQ ID NO: 562214 - DNA, 25 bp, Homo sapien
aaagaggataaagaggcacagaaag

SEQ ID NO: 562215 - DNA, 25 bp, Homo sapien
gagatgcaaaaaataatgacttcct

SEQ ID NO: 562216 - DNA, 25 bp, Homo sapien
gatgcaaaaaataatgacttccttg

SEQ ID NO: 562217 - DNA, 25 bp, Homo sapien
atgcaaaaaataatgacttccttga

SEQ ID NO: 562218 - DNA, 25 bp, Homo sapien
gcaaaaaataatgacttccttgaag

SEQ ID NO: 562219 - DNA, 25 bp, Homo sapien
aaaaaataatgacttccttgaagag

SEQ ID NO: 562220 - DNA, 25 bp, Homo sapien
aaaaataatgacttccttgaagagg

SEQ ID NO: 562221 - DNA, 25 bp, Homo sapien
aaaataatgacttccttgaagaggt

SEQ ID NO: 562222 - DNA, 25 bp, Homo sapien
aaataatgacttccttgaagaggta

SEQ ID NO: 562223 - DNA, 25 bp, Homo sapien
aataatgacttccttgaagaggtaa

SEQ ID NO: 562224 - DNA, 25 bp, Homo sapien
gcaccatgtccaatagtcattagtc

SEQ ID NO: 562225 - DNA, 25 bp, Homo sapien
agaagccattggctacctggcattt

SEQ ID NO: 562226 - DNA, 25 bp, Homo sapien
ggctacctggcattttgaaagtttt

SEQ ID NO: 562227 - DNA, 25 bp, Homo sapien
gttttccagtggttgaacatttaca

SEQ ID NO: 562228 - DNA, 25 bp, Homo sapien
ggcttccaaatactgatcgttccta

SEQ ID NO: 562229 - DNA, 25 bp, Homo sapien
gtcattagtcaagctctgtggtctg

SEQ ID NO: 562230 - DNA, 25 bp, Homo sapien
gttcctaaacattctcttaccagca

SEQ ID NO: 562231 - DNA, 25 bp, Homo sapien
agctctgtggtctggtatttacaaa

SEQ ID NO: 562232 - DNA, 25 bp, Homo sapien
ttccaggaaacgagtccagcgtggt

SEQ ID NO: 562233 - DNA, 25 bp, Homo sapien
tggtgcgagaggctctccgttactt

SEQ ID NO: 562234 - DNA, 25 bp, Homo sapien
ggctctccgttactttgttcagtaa

SEQ ID NO: 562235 - DNA, 25 bp, Homo sapien
tgcaggtggtgatcgggcagcagct

SEQ ID NO: 562236 - DNA, 25 bp, Homo sapien
agctgcgctcacagcgccagaagga

SEQ ID NO: 562237 - DNA, 25 bp, Homo sapien
gggcccgccggtggctttctcagta

SEQ ID NO: 562238 - DNA, 25 bp, Homo sapien
cggtggctttctcagtaacctcttc

SEQ ID NO: 562239 - DNA, 25 bp, Homo sapien
gtaacctcttccgaaggacctgacg

SEQ ID NO: 562240 - DNA, 25 bp, Homo sapien
ttccgaaggacctgacggctgggcc

SEQ ID NO: 562241 - DNA, 25 bp, Homo sapien
agagggctgcccttgcccacttagg

SEQ ID NO: 562242 - DNA, 25 bp, Homo sapien
tcactttcctcttcaggccaatgga

SEQ ID NO: 562243 - DNA, 25 bp, Homo sapien
tcctcttcaggccaatggagcgaca

SEQ ID NO: 562244 - DNA, 25 bp, Homo sapien
gccaatggagcgacagggcccagat

SEQ ID NO: 562245 - DNA, 25 bp, Homo sapien
agggcccagattgtcttccaaaaga

SEQ ID NO: 562246 - DNA, 25 bp, Homo sapien
agccactgcagccttcttaagctta

SEQ ID NO: 562247 - DNA, 25 bp, Homo sapien
gccttcttaagcttagtgtttgcac

SEQ ID NO: 562248 - DNA, 25 bp, Homo sapien
gtgtttgcacagtatacctctttct

SEQ ID NO: 562249 - DNA, 25 bp, Homo sapien
gcacagtatacctctttctattaat

SEQ ID NO: 562250 - DNA, 25 bp, Homo sapien
tacctctttctattaatttactttg

SEQ ID NO: 562251 - DNA, 25 bp, Homo sapien
taatttactttgtgcttctgtgcct

SEQ ID NO: 562252 - DNA, 25 bp, Homo sapien
gtgcttctgtgcctatttaaagtag

SEQ ID NO: 562253 - DNA, 25 bp, Homo sapien
tatacttgagacttgcatttttatc

SEQ ID NO: 562254 - DNA, 25 bp, Homo sapien
gagacttgcatttttatctgttctc

SEQ ID NO: 562255 - DNA, 25 bp, Homo sapien
ggtttctaatttacatgtttcctgt

SEQ ID NO: 562256 - DNA, 25 bp, Homo sapien
aatttacatgtttcctgtttagata

SEQ ID NO: 562257 - DNA, 25 bp, Homo sapien
catcaggcacaggagcctcaggttt

SEQ ID NO: 562258 - DNA, 25 bp, Homo sapien
ggagcctcaggttttaaggcctcaa

SEQ ID NO: 562259 - DNA, 25 bp, Homo sapien
tttaaggcctcaatgttaggccaac

SEQ ID NO: 562260 - DNA, 25 bp, Homo sapien
aatgtcacttgtcataaaggagggt

SEQ ID NO: 562261 - DNA, 25 bp, Homo sapien
atcataattgaagttcccctcattt

SEQ ID NO: 562262 - DNA, 25 bp, Homo sapien
gatgctaagtttatgtctgatcatg

SEQ ID NO: 562263 - DNA, 25 bp, Homo sapien
gaaaagaacatcgttcccctgtggt

SEQ ID NO: 562264 - DNA, 25 bp, Homo sapien
atcgttcccctgtggtcagcaaagt

SEQ ID NO: 562265 - DNA, 25 bp, Homo sapien
gtggtcagcaaagtctgtcagccca

SEQ ID NO: 562266 - DNA, 25 bp, Homo sapien
agcaaagtctgtcagcccagtggaa

SEQ ID NO: 562267 - DNA, 25 bp, Homo sapien
tctgtcagcccagtggaagtcggct

SEQ ID NO: 562268 - DNA, 25 bp, Homo sapien
gtaggacaagcctcaccattttact

SEQ ID NO: 562269 - DNA, 25 bp, Homo sapien
cattttactcttctccttcaaagtg

SEQ ID NO: 562270 - DNA, 25 bp, Homo sapien
actttcacatgttccattcctctct

SEQ ID NO: 562271 - DNA, 25 bp, Homo sapien
cattcctctctaccctaaatgggat

SEQ ID NO: 562272 - DNA, 25 bp, Homo sapien
gccctcccacatgttagaattctat

SEQ ID NO: 562273 - DNA, 25 bp, Homo sapien
gattcgtaaatgattggcatcttta

SEQ ID NO: 562274 - DNA, 25 bp, Homo sapien
ggcatctttatgtaactgggacgtt

SEQ ID NO: 562275 - DNA, 25 bp, Homo sapien
actgggacgttctattcattaatac

SEQ ID NO: 562276 - DNA, 25 bp, Homo sapien
ataaccttctgggtttcaatggctg

SEQ ID NO: 562277 - DNA, 25 bp, Homo sapien
ggtttcaatggctggttcacaccca

SEQ ID NO: 562278 - DNA, 25 bp, Homo sapien
tggttcacacccacgggtattttat

SEQ ID NO: 562279 - DNA, 25 bp, Homo sapien
gcctgtgtgtgtacaccacgtgtga

SEQ ID NO: 562280 - DNA, 25 bp, Homo sapien
gtacaccacgtgtgaacgccaactg

SEQ ID NO: 562281 - DNA, 25 bp, Homo sapien
gtgaacgccaactgggaacacggcc

SEQ ID NO: 562282 - DNA, 25 bp, Homo sapien
acaagttgatagctgtactcgcccc

SEQ ID NO: 562283 - DNA, 25 bp, Homo sapien
gtactcgccccttttggaagacgca

SEQ ID NO: 562284 - DNA, 25 bp, Homo sapien
ttttggaagacgcacgcccaaggca

SEQ ID NO: 562285 - DNA, 25 bp, Homo sapien
ccaaggcacccgtgtgtgcacacgt

SEQ ID NO: 562286 - DNA, 25 bp, Homo sapien
acgtatccgtgtgtggacctctgtc

SEQ ID NO: 562287 - DNA, 25 bp, Homo sapien
tcacgaggaaggacactgacagctt

SEQ ID NO: 562288 - DNA, 25 bp, Homo sapien
aaggacactgacagcttcggagaag

SEQ ID NO: 562289 - DNA, 25 bp, Homo sapien
agcttcggagaaggctgcccagtgt

SEQ ID NO: 562290 - DNA, 25 bp, Homo sapien
aatccctctcattaaattttacatt

SEQ ID NO: 562291 - DNA, 25 bp, Homo sapien
atgaacttccggcatttgggaaact

SEQ ID NO: 562292 - DNA, 25 bp, Homo sapien
aatggactagattttaaaactcaga

SEQ ID NO: 562293 - DNA, 25 bp, Homo sapien
aactttagattttgtgtggtgtgta

SEQ ID NO: 562294 - DNA, 25 bp, Homo sapien
gtgtggtgtgtacatctatgtgcac

SEQ ID NO: 562295 - DNA, 25 bp, Homo sapien
gtgtgtacatctatgtgcacagtat

SEQ ID NO: 562296 - DNA, 25 bp, Homo sapien
gaaatttaattcctgtgtgtctata

SEQ ID NO: 562297 - DNA, 25 bp, Homo sapien
aattcctgtgtgtctatacaatatt

SEQ ID NO: 562298 - DNA, 25 bp, Homo sapien
tgggaaacttaatctgctccatgga

SEQ ID NO: 562299 - DNA, 25 bp, Homo sapien
gctccatggatataattgtaattgt

SEQ ID NO: 562300 - DNA, 25 bp, Homo sapien
aaacctaacaatcaaatccctctca

SEQ ID NO: 562301 - DNA, 25 bp, Homo sapien
ttatggcaatcaagaccagagtggt

SEQ ID NO: 562302 - DNA, 25 bp, Homo sapien
tggcagcggtggctatggacagcag

SEQ ID NO: 562303 - DNA, 25 bp, Homo sapien
tggacagcaggaccgtggaggccgc

SEQ ID NO: 562304 - DNA, 25 bp, Homo sapien
ggttacaaccgcagcagtggtggct

SEQ ID NO: 562305 - DNA, 25 bp, Homo sapien
acaaccgcagcagtggtggctatga

SEQ ID NO: 562306 - DNA, 25 bp, Homo sapien
ccgcagcagtggtggctatgaaccc

SEQ ID NO: 562307 - DNA, 25 bp, Homo sapien
tggtggctatgaacccagaggtcgt

SEQ ID NO: 562308 - DNA, 25 bp, Homo sapien
agtgaccgtggtggcttcaataaat

SEQ ID NO: 562309 - DNA, 25 bp, Homo sapien
caataaatttggtgtgttcaagaag

SEQ ID NO: 562310 - DNA, 25 bp, Homo sapien
gtgtatcttcatacatcaccactcc

SEQ ID NO: 562311 - DNA, 25 bp, Homo sapien
tcaccactcctgaaagcagatgtgc

SEQ ID NO: 562312 - DNA, 25 bp, Homo sapien
aagttgacaaccactggccaggtga

SEQ ID NO: 562313 - DNA, 25 bp, Homo sapien
tgacttctccagtgaaaggcgcctc

SEQ ID NO: 562314 - DNA, 25 bp, Homo sapien
aaaggcgcctcatttgtcaccagta

SEQ ID NO: 562315 - DNA, 25 bp, Homo sapien
tcaccagtaccaatccccggaaatt

SEQ ID NO: 562316 - DNA, 25 bp, Homo sapien
tggcttttcagccaagcccaacaac

SEQ ID NO: 562317 - DNA, 25 bp, Homo sapien
aaatgtgaccccaggcataaggact

SEQ ID NO: 562318 - DNA, 25 bp, Homo sapien
aaggactgtctgctacgggagtttc

SEQ ID NO: 562319 - DNA, 25 bp, Homo sapien
gggagtttcgaaagttatgcgccat

SEQ ID NO: 562320 - DNA, 25 bp, Homo sapien
aagttatgcgccatggtggccgata

SEQ ID NO: 562321 - DNA, 25 bp, Homo sapien
ggtggccgataatcctagctacaac

SEQ ID NO: 562322 - DNA, 25 bp, Homo sapien
atcctagctacaacacgaagaccca

SEQ ID NO: 562323 - DNA, 25 bp, Homo sapien
gagggcaagttctttcatcgtggaa

SEQ ID NO: 562324 - DNA, 25 bp, Homo sapien
gaactttgacgctagcttgacaggc

SEQ ID NO: 562325 - DNA, 25 bp, Homo sapien
tagcttgacaggctgaatggacctt

SEQ ID NO: 562326 - DNA, 25 bp, Homo sapien
tgaatggaccttgacagatggccaa

SEQ ID NO: 562327 - DNA, 25 bp, Homo sapien
agatggccaagtcaaaacccctcat

SEQ ID NO: 562328 - DNA, 25 bp, Homo sapien
ttatgtgtgatctttgactttcatc

SEQ ID NO: 562329 - DNA, 25 bp, Homo sapien
gactttcatcacagtatccttgtaa

SEQ ID NO: 562330 - DNA, 25 bp, Homo sapien
cttgttttttctatgccaggtctcc

SEQ ID NO: 562331 - DNA, 25 bp, Homo sapien
gccaggtctcctcagatgaaacaca

SEQ ID NO: 562332 - DNA, 25 bp, Homo sapien
caatcctgaattggcgtggtcgtct

SEQ ID NO: 562333 - DNA, 25 bp, Homo sapien
gtggtcgtctagcttttatattcaa

SEQ ID NO: 562334 - DNA, 25 bp, Homo sapien
atttggctattaattggattttgac

SEQ ID NO: 562335 - DNA, 25 bp, Homo sapien
ttccttctttattgtaacttcttga

SEQ ID NO: 562336 - DNA, 25 bp, Homo sapien
gtaatgctaacttaatgaatctgct

SEQ ID NO: 562337 - DNA, 25 bp, Homo sapien
taatgaatctgcttattgtatggat

SEQ ID NO: 562338 - DNA, 25 bp, Homo sapien
atcactaatattattcccatgtatt

SEQ ID NO: 562339 - DNA, 25 bp, Homo sapien
tattcccatgtattttgttttacta

SEQ ID NO: 562340 - DNA, 25 bp, Homo sapien
ttgtaacttcttgaaaagctctttt

SEQ ID NO: 562341 - DNA, 25 bp, Homo sapien
aagctcttttacagtggctttgttt

SEQ ID NO: 562342 - DNA, 25 bp, Homo sapien
gctttgtttcaataagcccttaagt

SEQ ID NO: 562343 - DNA, 25 bp, Homo sapien
aagttaagggctgattgcacttaga

SEQ ID NO: 562344 - DNA, 25 bp, Homo sapien
agggctgattgcacttagaaataag

SEQ ID NO: 562345 - DNA, 25 bp, Homo sapien
gttatggcaatcaagaccagagtgg

SEQ ID NO: 562346 - DNA, 25 bp, Homo sapien
ttatggcaatcaagaccagagtggt

SEQ ID NO: 562347 - DNA, 25 bp, Homo sapien
tggcagcggtggctatggacagcag

SEQ ID NO: 562348 - DNA, 25 bp, Homo sapien
agcggtggctatggacagcaggacc

SEQ ID NO: 562349 - DNA, 25 bp, Homo sapien
ggtggctatggacagcaggaccgtg

SEQ ID NO: 562350 - DNA, 25 bp, Homo sapien
tggctatggacagcaggaccgtgga

SEQ ID NO: 562351 - DNA, 25 bp, Homo sapien
tatggacagcaggaccgtggaggcc

SEQ ID NO: 562352 - DNA, 25 bp, Homo sapien
tggacagcaggaccgtggaggccgc

SEQ ID NO: 562353 - DNA, 25 bp, Homo sapien
agcaggaccgtggaggccgcggcag

SEQ ID NO: 562354 - DNA, 25 bp, Homo sapien
ggttacaaccgcagcagtggtggct

SEQ ID NO: 562355 - DNA, 25 bp, Homo sapien
gttacaaccgcagcagtggtggcta

SEQ ID NO: 562356 - DNA, 25 bp, Homo sapien
tgatctccgcagaggctgcctgctg

SEQ ID NO: 562357 - DNA, 25 bp, Homo sapien
ggccggccttcgtgctccgaaacaa

SEQ ID NO: 562358 - DNA, 25 bp, Homo sapien
ggccttcgtgctccgaaacaagaga

SEQ ID NO: 562359 - DNA, 25 bp, Homo sapien
ttcgtgctccgaaacaagagacctg

SEQ ID NO: 562360 - DNA, 25 bp, Homo sapien
tttctcaccagcccgccagttgtgg

SEQ ID NO: 562361 - DNA, 25 bp, Homo sapien
agcccgccagttgtggcaaccctgt

SEQ ID NO: 562362 - DNA, 25 bp, Homo sapien
ttgttcccctaatctatcactttgt

SEQ ID NO: 562363 - DNA, 25 bp, Homo sapien
tgttcccctaatctatcactttgtt

SEQ ID NO: 562364 - DNA, 25 bp, Homo sapien
ttcccctaatctatcactttgttct

SEQ ID NO: 562365 - DNA, 25 bp, Homo sapien
cccctaatctatcactttgttcttt

SEQ ID NO: 562366 - DNA, 25 bp, Homo sapien
gaagctgcggccctgatctccgcag

SEQ ID NO: 562367 - DNA, 25 bp, Homo sapien
gatcaactgtacttaactatatttt

SEQ ID NO: 562368 - DNA, 25 bp, Homo sapien
agctgtgacatttatctacctggtt

SEQ ID NO: 562369 - DNA, 25 bp, Homo sapien
ttgctgaatcatgctccagtatttg

SEQ ID NO: 562370 - DNA, 25 bp, Homo sapien
gatgttttaaatatcctatgtctga

SEQ ID NO: 562371 - DNA, 25 bp, Homo sapien
ataattcctcctaattgtgtggtaa

SEQ ID NO: 562372 - DNA, 25 bp, Homo sapien
ttgcttttactgtttccacagtatt

SEQ ID NO: 562373 - DNA, 25 bp, Homo sapien
cacagtatttcaggtctttgctcat

SEQ ID NO: 562374 - DNA, 25 bp, Homo sapien
gtctttgctcattcactcagtaata

SEQ ID NO: 562375 - DNA, 25 bp, Homo sapien
aatactgagcacttaccatgtacca

SEQ ID NO: 562376 - DNA, 25 bp, Homo sapien
tgagcacttaccatgtaccagaatt

SEQ ID NO: 562377 - DNA, 25 bp, Homo sapien
accagaattttactaggcacaacca

SEQ ID NO: 562378 - DNA, 25 bp, Homo sapien
ataatcttttcctgtccttgggtct

SEQ ID NO: 562379 - DNA, 25 bp, Homo sapien
tcctgtccttgggtctgcaagagaa

SEQ ID NO: 562380 - DNA, 25 bp, Homo sapien
gggataatcgttgctcaaaaacctg

SEQ ID NO: 562381 - DNA, 25 bp, Homo sapien
aaacctgccacgaagagggattgct

SEQ ID NO: 562382 - DNA, 25 bp, Homo sapien
agagggattgctcctctgagcccta

SEQ ID NO: 562383 - DNA, 25 bp, Homo sapien
tactgcagctgctctgactgccaga

SEQ ID NO: 562384 - DNA, 25 bp, Homo sapien
tgactgccagagtcccttgtccaca

SEQ ID NO: 562385 - DNA, 25 bp, Homo sapien
cttgtccacatcagggtttacttcc

SEQ ID NO: 562386 - DNA, 25 bp, Homo sapien
gatggactccaatcttttccaggaa

SEQ ID NO: 562387 - DNA, 25 bp, Homo sapien
aggaaagcactgtttccctcatgtg

SEQ ID NO: 562388 - DNA, 25 bp, Homo sapien
tgtttccctcatgtgtgcagtggtg

SEQ ID NO: 562389 - DNA, 25 bp, Homo sapien
catgctgttaataaaatagtgaggc

SEQ ID NO: 562390 - DNA, 25 bp, Homo sapien
ataaaatagtgaggcatgttgtata

SEQ ID NO: 562391 - DNA, 25 bp, Homo sapien
gtgtgttttatgtctcaattgaaat

SEQ ID NO: 562392 - DNA, 25 bp, Homo sapien
aatagatcatgatgggttttgaatc

SEQ ID NO: 562393 - DNA, 25 bp, Homo sapien
gatgggttttgaatctgatttctaa

SEQ ID NO: 562394 - DNA, 25 bp, Homo sapien
atgttatgagcttttgttgctttcc

SEQ ID NO: 562395 - DNA, 25 bp, Homo sapien
tatgagcttttgttgctttcctatt

SEQ ID NO: 562396 - DNA, 25 bp, Homo sapien
gagcttttgttgctttcctatttca

SEQ ID NO: 562397 - DNA, 25 bp, Homo sapien
gcttttgttgctttcctatttcata

SEQ ID NO: 562398 - DNA, 25 bp, Homo sapien
ttgttgctttcctatttcatacaca

SEQ ID NO: 562399 - DNA, 25 bp, Homo sapien
aatgctaatggaagaggtgagattt

SEQ ID NO: 562400 - DNA, 25 bp, Homo sapien
tggtgttggcctatgccctgcacat

SEQ ID NO: 562401 - DNA, 25 bp, Homo sapien
acatgctcatctacctgcggtatct

SEQ ID NO: 562402 - DNA, 25 bp, Homo sapien
tacctgcggtatctggaccaacaat

SEQ ID NO: 562403 - DNA, 25 bp, Homo sapien
accaacaatatgatctcatcgcctc

SEQ ID NO: 562404 - DNA, 25 bp, Homo sapien
tgaaagctcgagacacagccgaaga

SEQ ID NO: 562405 - DNA, 25 bp, Homo sapien
gaagccaacagatcagcaaaatcta

SEQ ID NO: 562406 - DNA, 25 bp, Homo sapien
gcaaaatctatgtttagcagcacag

SEQ ID NO: 562407 - DNA, 25 bp, Homo sapien
atgtttagcagcacaggctggcccc

SEQ ID NO: 562408 - DNA, 25 bp, Homo sapien
tccacagtgggctccgaaagttgtc

SEQ ID NO: 562409 - DNA, 25 bp, Homo sapien
gaaagttgtctctgttctgtgctat

SEQ ID NO: 562410 - DNA, 25 bp, Homo sapien
ctgttctgtgctatttgacttgtga

SEQ ID NO: 562411 - DNA, 25 bp, Homo sapien
ttctatttgatagaggtctgtccct

SEQ ID NO: 562412 - DNA, 25 bp, Homo sapien
gatagaggtctgtccctcagatcag

SEQ ID NO: 562413 - DNA, 25 bp, Homo sapien
tgtccctcagatcagcaatgtctta

SEQ ID NO: 562414 - DNA, 25 bp, Homo sapien
agatcagcaatgtcttagcccctct

SEQ ID NO: 562415 - DNA, 25 bp, Homo sapien
ttccttcctgttggtactcatttct

SEQ ID NO: 562416 - DNA, 25 bp, Homo sapien
gttggtactcatttcttctaacttt

SEQ ID NO: 562417 - DNA, 25 bp, Homo sapien
tacattacagtaagtgctatttaga

SEQ ID NO: 562418 - DNA, 25 bp, Homo sapien
taagaatcctttagagaaggcacat

SEQ ID NO: 562419 - DNA, 25 bp, Homo sapien
actttatttggtgcagtcagggctc

SEQ ID NO: 562420 - DNA, 25 bp, Homo sapien
tgcagtcagggctccatttagttcc

SEQ ID NO: 562421 - DNA, 25 bp, Homo sapien
ttagttccctcactctgcttctaat

SEQ ID NO: 562422 - DNA, 25 bp, Homo sapien
atatcaggctgagtatcataccatt

SEQ ID NO: 562423 - DNA, 25 bp, Homo sapien
caaatatgggttcttcatttctcta

SEQ ID NO: 562424 - DNA, 25 bp, Homo sapien
ttctctaagtcagtgtatatctatc

SEQ ID NO: 562425 - DNA, 25 bp, Homo sapien
tagttttgatcattttacttactgc

SEQ ID NO: 562426 - DNA, 25 bp, Homo sapien
ttactgctgcccttgtaaggcattt

SEQ ID NO: 562427 - DNA, 25 bp, Homo sapien
gcatttaagtttttagtcctcactg

SEQ ID NO: 562428 - DNA, 25 bp, Homo sapien
agtcctcactgtaaatgtttgtttt

SEQ ID NO: 562429 - DNA, 25 bp, Homo sapien
tttttcctgtttatcgagtatggcc

SEQ ID NO: 562430 - DNA, 25 bp, Homo sapien
gaaaaacatttctggtgtctcatga

SEQ ID NO: 562431 - DNA, 25 bp, Homo sapien
aaatattgaaagctgagccttcatt

SEQ ID NO: 562432 - DNA, 25 bp, Homo sapien
agccttcatttctacatggcaataa

SEQ ID NO: 562433 - DNA, 25 bp, Homo sapien
gtggtgaaggaatttctgagaaaca

SEQ ID NO: 562434 - DNA, 25 bp, Homo sapien
aggatcttagaaatggccttacaga

SEQ ID NO: 562435 - DNA, 25 bp, Homo sapien
atggccttacagaagatatgcagaa

SEQ ID NO: 562436 - DNA, 25 bp, Homo sapien
agaagctagacagcctctgtctaca

SEQ ID NO: 562437 - DNA, 25 bp, Homo sapien
gcctctgtctacatcaaaaactgga

SEQ ID NO: 562438 - DNA, 25 bp, Homo sapien
aggaaggcctgaggttgcccgtcaa

SEQ ID NO: 562439 - DNA, 25 bp, Homo sapien
ggttgcccgtcaacaaaaatcaggc

SEQ ID NO: 562440 - DNA, 25 bp, Homo sapien
aaatcaggcatgttctgtgaaagtc

SEQ ID NO: 562441 - DNA, 25 bp, Homo sapien
cttcaagagatatatcttcaagcag

SEQ ID NO: 562442 - DNA, 25 bp, Homo sapien
gaggtgttgcctgaagagctctcaa

SEQ ID NO: 562443 - DNA, 25 bp, Homo sapien
agagctctcaaatcgactggaagtg

SEQ ID NO: 562444 - DNA, 25 bp, Homo sapien
tcaggcctgttatattaactttttg

SEQ ID NO: 562445 - DNA, 25 bp, Homo sapien
tagaaaactgttggctcagtcttct

SEQ ID NO: 562446 - DNA, 25 bp, Homo sapien
ggtttttaactgtcaccgataccag

SEQ ID NO: 562447 - DNA, 25 bp, Homo sapien
tgtcaccgataccagaatagctcat

SEQ ID NO: 562448 - DNA, 25 bp, Homo sapien
gaatagctcatctccaaggtaactg

SEQ ID NO: 562449 - DNA, 25 bp, Homo sapien
ctgtaacagaacactcagcagatta

SEQ ID NO: 562450 - DNA, 25 bp, Homo sapien
taaaagtttggtagggtctatgtct

SEQ ID NO: 562451 - DNA, 25 bp, Homo sapien
tgctctctggtgtgtcctggatcat

SEQ ID NO: 562452 - DNA, 25 bp, Homo sapien
tcctggatcatcaacttggttacaa

SEQ ID NO: 562453 - DNA, 25 bp, Homo sapien
caacttggttacaacatggtgttaa

SEQ ID NO: 562454 - DNA, 25 bp, Homo sapien
gtgggactgattgtgtttcttgtta

SEQ ID NO: 562455 - DNA, 25 bp, Homo sapien
tctacaaagtagatacctcattata

SEQ ID NO: 562456 - DNA, 25 bp, Homo sapien
gatacctcattatacatcttacaga

SEQ ID NO: 562457 - DNA, 25 bp, Homo sapien
tacatcttacagagagcatcattgg

SEQ ID NO: 562458 - DNA, 25 bp, Homo sapien
cagagagcatcattggtgtttccaa

SEQ ID NO: 562459 - DNA, 25 bp, Homo sapien
gcatcattggtgtttccaaggtcac

SEQ ID NO: 562460 - DNA, 25 bp, Homo sapien
tgagtctgcttgtctgtttgcccca

SEQ ID NO: 562461 - DNA, 25 bp, Homo sapien
agtctgcttgtctgtttgccccatg

SEQ ID NO: 562462 - DNA, 25 bp, Homo sapien
cctccaggcacccacaagaatataa

SEQ ID NO: 562463 - DNA, 25 bp, Homo sapien
aatcttgtacaaggatgtcgatatt

SEQ ID NO: 562464 - DNA, 25 bp, Homo sapien
tgtcgatattactattgccattccc

SEQ ID NO: 562465 - DNA, 25 bp, Homo sapien
aagtgcacctgcacctgtagtatca

SEQ ID NO: 562466 - DNA, 25 bp, Homo sapien
aatgcaaaagcaggccaggcgcaat

SEQ ID NO: 562467 - DNA, 25 bp, Homo sapien
tctcccataaccatggtgtgccctt

SEQ ID NO: 562468 - DNA, 25 bp, Homo sapien
cataaccatggtgtgcccttgagga

SEQ ID NO: 562469 - DNA, 25 bp, Homo sapien
taaccatggtgtgcccttgaggatg

SEQ ID NO: 562470 - DNA, 25 bp, Homo sapien
atggtgtgcccttgaggatgtgcgg

SEQ ID NO: 562471 - DNA, 25 bp, Homo sapien
gacattgaattgtatgcactagctt

SEQ ID NO: 562472 - DNA, 25 bp, Homo sapien
ttgaattgtatgcactagctttctt

SEQ ID NO: 562473 - DNA, 25 bp, Homo sapien
aattgtatgcactagctttcttaat

SEQ ID NO: 562474 - DNA, 25 bp, Homo sapien
ttgtatgcactagctttcttaatta

SEQ ID NO: 562475 - DNA, 25 bp, Homo sapien
atgcactagctttcttaattaaatg

SEQ ID NO: 562476 - DNA, 25 bp, Homo sapien
ctagctttcttaattaaatgcctta

SEQ ID NO: 562477 - DNA, 25 bp, Homo sapien
gtgcctgaggcactatgtgaaaatg

SEQ ID NO: 562478 - DNA, 25 bp, Homo sapien
gggagatactgttgcctcaatatca

SEQ ID NO: 562479 - DNA, 25 bp, Homo sapien
aaagccagcaacacttgcactgact

SEQ ID NO: 562480 - DNA, 25 bp, Homo sapien
ttgcactgactcttcaagactatgt

SEQ ID NO: 562481 - DNA, 25 bp, Homo sapien
gactcttcaagactatgttacaata

SEQ ID NO: 562482 - DNA, 25 bp, Homo sapien
gaaaatttcccaagcctgaagacac

SEQ ID NO: 562483 - DNA, 25 bp, Homo sapien
gaagacacagtctacataaatcaaa

SEQ ID NO: 562484 - DNA, 25 bp, Homo sapien
acaatttcgttttcacttgcttctc

SEQ ID NO: 562485 - DNA, 25 bp, Homo sapien
tgcttctcaacctagtctaataaac

SEQ ID NO: 562486 - DNA, 25 bp, Homo sapien
gatgagatatacatcttcttccttc

SEQ ID NO: 562487 - DNA, 25 bp, Homo sapien
ttccttctggtttcttgatccttaa

SEQ ID NO: 562488 - DNA, 25 bp, Homo sapien
gctgtgaaatagatcatggcggtct

SEQ ID NO: 562489 - DNA, 25 bp, Homo sapien
catggcggtctggaaaacgagctaa

SEQ ID NO: 562490 - DNA, 25 bp, Homo sapien
agctaattccgtgccgatggaggtg

SEQ ID NO: 562491 - DNA, 25 bp, Homo sapien
attccgtgccgatggaggtgttgat

SEQ ID NO: 562492 - DNA, 25 bp, Homo sapien
ggtgttgatggatgtccaccactct

SEQ ID NO: 562493 - DNA, 25 bp, Homo sapien
tcaggtctagcttctctctgtgact

SEQ ID NO: 562494 - DNA, 25 bp, Homo sapien
ctctctgtgactgagtaccttggga

SEQ ID NO: 562495 - DNA, 25 bp, Homo sapien
actgagtaccttgggaaagtgggct

SEQ ID NO: 562496 - DNA, 25 bp, Homo sapien
gaggaaagggacttacttgcccaag

SEQ ID NO: 562497 - DNA, 25 bp, Homo sapien
gccacagctgccaagtggcaggtaa

SEQ ID NO: 562498 - DNA, 25 bp, Homo sapien
gcaggtaagggaccgttattctcct

SEQ ID NO: 562499 - DNA, 25 bp, Homo sapien
ccttttgacatctctgccttggcta

SEQ ID NO: 562500 - DNA, 25 bp, Homo sapien
ctctgccttggctagattcaaatgg

SEQ ID NO: 562501 - DNA, 25 bp, Homo sapien
aagtctgagtttaagcagctttacc

SEQ ID NO: 562502 - DNA, 25 bp, Homo sapien
gcagctttaccgaaaacgcaaggga

SEQ ID NO: 562503 - DNA, 25 bp, Homo sapien
acgcaagggaagtttcattccattt

SEQ ID NO: 562504 - DNA, 25 bp, Homo sapien
cattccatttatacttctccagacc

SEQ ID NO: 562505 - DNA, 25 bp, Homo sapien
tacccacacaggcagaataaaaggc

SEQ ID NO: 562506 - DNA, 25 bp, Homo sapien
gtcccatgaaggcaaagattggtct

SEQ ID NO: 562507 - DNA, 25 bp, Homo sapien
ttggtctcttgtgttcactgctgtc

SEQ ID NO: 562508 - DNA, 25 bp, Homo sapien
gttcactgctgtctgtagtacttag

SEQ ID NO: 562509 - DNA, 25 bp, Homo sapien
gttggcccagagttggtgtttgatt

SEQ ID NO: 562510 - DNA, 25 bp, Homo sapien
aactgtgacccgaaccccagactgt

SEQ ID NO: 562511 - DNA, 25 bp, Homo sapien
gcgttcgcaagactgtgaccccaga

SEQ ID NO: 562512 - DNA, 25 bp, Homo sapien
tgtgacccttgacatcaaaccgtga

SEQ ID NO: 562513 - DNA, 25 bp, Homo sapien
gacccttgacatcaaaccgtgacac

SEQ ID NO: 562514 - DNA, 25 bp, Homo sapien
ttttccctactctgacctaggacac

SEQ ID NO: 562515 - DNA, 25 bp, Homo sapien
tgacctaggacacgtccccaacgga

SEQ ID NO: 562516 - DNA, 25 bp, Homo sapien
aaacccctgacccagactgtgacat

SEQ ID NO: 562517 - DNA, 25 bp, Homo sapien
agactgtgacatccgactcctaaaa

SEQ ID NO: 562518 - DNA, 25 bp, Homo sapien
tgtgacatccgactcctaaaatggt

SEQ ID NO: 562519 - DNA, 25 bp, Homo sapien
atccgactcctaaaatggtcatccg

SEQ ID NO: 562520 - DNA, 25 bp, Homo sapien
aaatggtcatccgactccagactgt

SEQ ID NO: 562521 - DNA, 25 bp, Homo sapien
ccctgttccaattgctaatccagca

SEQ ID NO: 562522 - DNA, 25 bp, Homo sapien
gcatttgcggatagctccaaactgg

SEQ ID NO: 562523 - DNA, 25 bp, Homo sapien
ggatagctccaaactgggatatacg

SEQ ID NO: 562524 - DNA, 25 bp, Homo sapien
gatatacgggccaaggttgctcacg

SEQ ID NO: 562525 - DNA, 25 bp, Homo sapien
actacaagctccattggaatcggga

SEQ ID NO: 562526 - DNA, 25 bp, Homo sapien
agctccattggaatcgggattttga

SEQ ID NO: 562527 - DNA, 25 bp, Homo sapien
gaatcgggattttgaactgtcttgt

SEQ ID NO: 562528 - DNA, 25 bp, Homo sapien
gggattttgaactgtcttgttcaac

SEQ ID NO: 562529 - DNA, 25 bp, Homo sapien
gtcttgttcaacactccactccagt

SEQ ID NO: 562530 - DNA, 25 bp, Homo sapien
actccactccagtgcctagacagtg

SEQ ID NO: 562531 - DNA, 25 bp, Homo sapien
cagtgcctagacagtgccttgtgta

SEQ ID NO: 562532 - DNA, 25 bp, Homo sapien
tcgcaatttcaaacctgtagtgtat

SEQ ID NO: 562533 - DNA, 25 bp, Homo sapien
tcaaacctgtagtgtatcacggagt

SEQ ID NO: 562534 - DNA, 25 bp, Homo sapien
ggaatttatcgtatttctaaagcaa

SEQ ID NO: 562535 - DNA, 25 bp, Homo sapien
cctgccaccaccattcagaaattat

SEQ ID NO: 562536 - DNA, 25 bp, Homo sapien
gcactaaagattattcatcaagcac

SEQ ID NO: 562537 - DNA, 25 bp, Homo sapien
acttgtgttgagtttggaagatgac

SEQ ID NO: 562538 - DNA, 25 bp, Homo sapien
gaagatgacgaaagactcctgctga

SEQ ID NO: 562539 - DNA, 25 bp, Homo sapien
gacgaaagactcctgctgaaagaag

SEQ ID NO: 562540 - DNA, 25 bp, Homo sapien
aaagaagacagcactctgaaagcag

SEQ ID NO: 562541 - DNA, 25 bp, Homo sapien
cactctgaaagcagctggaatcgcc

SEQ ID NO: 562542 - DNA, 25 bp, Homo sapien
ctggaatcgccagtgaaactgaaat

SEQ ID NO: 562543 - DNA, 25 bp, Homo sapien
attcccccctgttccaattgctaat

SEQ ID NO: 562544 - DNA, 25 bp, Homo sapien
gcatttgcggatagctccaaactgg

SEQ ID NO: 562545 - DNA, 25 bp, Homo sapien
catttgcggatagctccaaactggg

SEQ ID NO: 562546 - DNA, 25 bp, Homo sapien
atttgcggatagctccaaactggga

SEQ ID NO: 562547 - DNA, 25 bp, Homo sapien
tttgcggatagctccaaactgggat

SEQ ID NO: 562548 - DNA, 25 bp, Homo sapien
ttgcggatagctccaaactgggata

SEQ ID NO: 562549 - DNA, 25 bp, Homo sapien
tgcggatagctccaaactgggatat

SEQ ID NO: 562550 - DNA, 25 bp, Homo sapien
gcggatagctccaaactgggatata

SEQ ID NO: 562551 - DNA, 25 bp, Homo sapien
cggatagctccaaactgggatatac

SEQ ID NO: 562552 - DNA, 25 bp, Homo sapien
ggatagctccaaactgggatatacg

SEQ ID NO: 562553 - DNA, 25 bp, Homo sapien
attttctcacttgcagctcaagtct

SEQ ID NO: 562554 - DNA, 25 bp, Homo sapien
gcagctcaagtctgtgaacaccatg

SEQ ID NO: 562555 - DNA, 25 bp, Homo sapien
gaacaccatgaggtttaatcaacat

SEQ ID NO: 562556 - DNA, 25 bp, Homo sapien
atcaacatgaggtttaagccaactt

SEQ ID NO: 562557 - DNA, 25 bp, Homo sapien
ttataggcttcctatatctcccttc

SEQ ID NO: 562558 - DNA, 25 bp, Homo sapien
ctcccttcctggtcagcaatatagc

SEQ ID NO: 562559 - DNA, 25 bp, Homo sapien
gtcagcaatatagcccattctctgg

SEQ ID NO: 562560 - DNA, 25 bp, Homo sapien
tcccagtgaattcttcctattagtt

SEQ ID NO: 562561 - DNA, 25 bp, Homo sapien
gaattcttcctattagttatctaag

SEQ ID NO: 562562 - DNA, 25 bp, Homo sapien
tgttgaaatgttttccgtcatcttt

SEQ ID NO: 562563 - DNA, 25 bp, Homo sapien
tctttagatccttttgaaaccactt

SEQ ID NO: 562564 - DNA, 25 bp, Homo sapien
tagggatatggcaggactcctggca

SEQ ID NO: 562565 - DNA, 25 bp, Homo sapien
atatggcaggactcctggcagggcc

SEQ ID NO: 562566 - DNA, 25 bp, Homo sapien
gggaacacatctggctgcacaggct

SEQ ID NO: 562567 - DNA, 25 bp, Homo sapien
acacatctggctgcacaggctgaaa

SEQ ID NO: 562568 - DNA, 25 bp, Homo sapien
atctggctgcacaggctgaaatatc

SEQ ID NO: 562569 - DNA, 25 bp, Homo sapien
ggctgcacaggctgaaatatccacc

SEQ ID NO: 562570 - DNA, 25 bp, Homo sapien
ccagcaggcagagtggcgtggcctc

SEQ ID NO: 562571 - DNA, 25 bp, Homo sapien
agtggcgtggcctccccatgggcac

SEQ ID NO: 562572 - DNA, 25 bp, Homo sapien
catgggcacagtggtgacccccttg

SEQ ID NO: 562573 - DNA, 25 bp, Homo sapien
cagtgcctccacatgctgcctggca

SEQ ID NO: 562574 - DNA, 25 bp, Homo sapien
tgcctggcacagaccaggcctttga

SEQ ID NO: 562575 - DNA, 25 bp, Homo sapien
gactgagtacttgctgtcatatcat

SEQ ID NO: 562576 - DNA, 25 bp, Homo sapien
gtcatatcatgcttatgtgacttgt

SEQ ID NO: 562577 - DNA, 25 bp, Homo sapien
gtgacttgttatatgtgctttgcat

SEQ ID NO: 562578 - DNA, 25 bp, Homo sapien
gatggagttgacacatggcctttta

SEQ ID NO: 562579 - DNA, 25 bp, Homo sapien
gacacatggccttttacaaactaaa

SEQ ID NO: 562580 - DNA, 25 bp, Homo sapien
gattcagaatgctaggcagctcatt

SEQ ID NO: 562581 - DNA, 25 bp, Homo sapien
tgctaggcagctcattaacatatgg

SEQ ID NO: 562582 - DNA, 25 bp, Homo sapien
atatggcctcaatccaggtgaccaa

SEQ ID NO: 562583 - DNA, 25 bp, Homo sapien
gtgaccaagcagtgagtctggagtc

SEQ ID NO: 562584 - DNA, 25 bp, Homo sapien
agcaatttgtgatctgtcatcttaa

SEQ ID NO: 562585 - DNA, 25 bp, Homo sapien
tcttagtctgtgctggcaggtgact

SEQ ID NO: 562586 - DNA, 25 bp, Homo sapien
tatgaccctgccttggtgggagtga

SEQ ID NO: 562587 - DNA, 25 bp, Homo sapien
ctgccttggtgggagtgacatattc

SEQ ID NO: 562588 - DNA, 25 bp, Homo sapien
acatacatgcttgttaccttattac

SEQ ID NO: 562589 - DNA, 25 bp, Homo sapien
gcttgttaccttattacaatagcat

SEQ ID NO: 562590 - DNA, 25 bp, Homo sapien
agttctgggtagacaggagtcctgc

SEQ ID NO: 562591 - DNA, 25 bp, Homo sapien
gacaggagtcctgctgagtagctct

SEQ ID NO: 562592 - DNA, 25 bp, Homo sapien
atacagctgaacaccatatcttaga

SEQ ID NO: 562593 - DNA, 25 bp, Homo sapien
agctgaacaccatatcttagatcta

SEQ ID NO: 562594 - DNA, 25 bp, Homo sapien
atcttagatctaaactctcatacaa

SEQ ID NO: 562595 - DNA, 25 bp, Homo sapien
aactctcatacaataagccttaaaa

SEQ ID NO: 562596 - DNA, 25 bp, Homo sapien
tctgggagttcatatgaccctgcct

SEQ ID NO: 562597 - DNA, 25 bp, Homo sapien
gaagacgaggattaaatttcattta

SEQ ID NO: 562598 - DNA, 25 bp, Homo sapien
agacgaggattaaatttcatttatc

SEQ ID NO: 562599 - DNA, 25 bp, Homo sapien
gacgaggattaaatttcatttatct

SEQ ID NO: 562600 - DNA, 25 bp, Homo sapien
gaggattaaatttcatttatctgga

SEQ ID NO: 562601 - DNA, 25 bp, Homo sapien
ggattaaatttcatttatctggaaa

SEQ ID NO: 562602 - DNA, 25 bp, Homo sapien
atctggaaaattttgtatgagttct

SEQ ID NO: 562603 - DNA, 25 bp, Homo sapien
ctggaaaattttgtatgagttcttg

SEQ ID NO: 562604 - DNA, 25 bp, Homo sapien
gaaaattttgtatgagttcttgaat

SEQ ID NO: 562605 - DNA, 25 bp, Homo sapien
aaaattttgtatgagttcttgaata

SEQ ID NO: 562606 - DNA, 25 bp, Homo sapien
aaattttgtatgagttcttgaataa

SEQ ID NO: 562607 - DNA, 25 bp, Homo sapien
aattttgtatgagttcttgaataaa

SEQ ID NO: 562608 - DNA, 25 bp, Homo sapien
aagtctttccacatctgttacaatg

SEQ ID NO: 562609 - DNA, 25 bp, Homo sapien
acaatggtagggtttcttccactat

SEQ ID NO: 562610 - DNA, 25 bp, Homo sapien
ggtttcttccactatgaatccgttg

SEQ ID NO: 562611 - DNA, 25 bp, Homo sapien
atgaatccgttgatgtcgagtgagg

SEQ ID NO: 562612 - DNA, 25 bp, Homo sapien
gagcggcaattgaaggcgtttccat

SEQ ID NO: 562613 - DNA, 25 bp, Homo sapien
gaaggcgtttccatattcactgcac

SEQ ID NO: 562614 - DNA, 25 bp, Homo sapien
tattcactgcactcactgggctact

SEQ ID NO: 562615 - DNA, 25 bp, Homo sapien
cactgggctactctcagtgtggatg

SEQ ID NO: 562616 - DNA, 25 bp, Homo sapien
gaatgagatctgtgctctcacaaga

SEQ ID NO: 562617 - DNA, 25 bp, Homo sapien
acaagaaacgttcccactctggatg

SEQ ID NO: 562618 - DNA, 25 bp, Homo sapien
actctggatgggttcgtgggacttc

SEQ ID NO: 562619 - DNA, 25 bp, Homo sapien
ttcagcatacctgagggacttccag

SEQ ID NO: 562620 - DNA, 25 bp, Homo sapien
gggctcagcgattgacagttcacgc

SEQ ID NO: 562621 - DNA, 25 bp, Homo sapien
agttcacgctaagatactggttgac

SEQ ID NO: 562622 - DNA, 25 bp, Homo sapien
atactggttgacagtctccccttat

SEQ ID NO: 562623 - DNA, 25 bp, Homo sapien
tccccttatccctagctgaaaaaga

SEQ ID NO: 562624 - DNA, 25 bp, Homo sapien
gagacagacaagctgagcccaactc

SEQ ID NO: 562625 - DNA, 25 bp, Homo sapien
tgagcccaactcagcacagtatgaa

SEQ ID NO: 562626 - DNA, 25 bp, Homo sapien
tgaagtagccaatcagctgcttgcc

SEQ ID NO: 562627 - DNA, 25 bp, Homo sapien
aatcagctgcttgcccaaggaaact

SEQ ID NO: 562628 - DNA, 25 bp, Homo sapien
tcaagagctagttagggccctgtgt

SEQ ID NO: 562629 - DNA, 25 bp, Homo sapien
gccctgtgttaataggcctcacggg

SEQ ID NO: 562630 - DNA, 25 bp, Homo sapien
ttatctacatctcacacaggtaagg

SEQ ID NO: 562631 - DNA, 25 bp, Homo sapien
tctacatctcacacaggtaaggttc

SEQ ID NO: 562632 - DNA, 25 bp, Homo sapien
acatctcacacaggtaaggttccat

SEQ ID NO: 562633 - DNA, 25 bp, Homo sapien
tctcacacaggtaaggttccatgat

SEQ ID NO: 562634 - DNA, 25 bp, Homo sapien
acacaggtaaggttccatgataaca

SEQ ID NO: 562635 - DNA, 25 bp, Homo sapien
ggtaaggttccatgataacaaatat

SEQ ID NO: 562636 - DNA, 25 bp, Homo sapien
ttctgtgtgacataaaacttcctat

SEQ ID NO: 562637 - DNA, 25 bp, Homo sapien
tgtgtgacataaaacttcctatagt

SEQ ID NO: 562638 - DNA, 25 bp, Homo sapien
taaaacttcctatagtcaagtcagg

SEQ ID NO: 562639 - DNA, 25 bp, Homo sapien
ctatagtcaagtcaggagtcaatta

SEQ ID NO: 562640 - DNA, 25 bp, Homo sapien
aaaacagaacttgagaggtagttat

SEQ ID NO: 562641 - DNA, 25 bp, Homo sapien
ttgctttaatatactgaacacttgg

SEQ ID NO: 562642 - DNA, 25 bp, Homo sapien
tactgaacacttggaagtcaccttt

SEQ ID NO: 562643 - DNA, 25 bp, Homo sapien
gaacacttggaagtcacctttactt

SEQ ID NO: 562644 - DNA, 25 bp, Homo sapien
acacttggaagtcacctttacttgc

SEQ ID NO: 562645 - DNA, 25 bp, Homo sapien
acttggaagtcacctttacttgcct

SEQ ID NO: 562646 - DNA, 25 bp, Homo sapien
gaagtcacctttacttgcctttgca

SEQ ID NO: 562647 - DNA, 25 bp, Homo sapien
aaacctaagtaagagtcatgcctgg

SEQ ID NO: 562648 - DNA, 25 bp, Homo sapien
cctaagtaagagtcatgcctggata

SEQ ID NO: 562649 - DNA, 25 bp, Homo sapien
aagtaagagtcatgcctggatattg

SEQ ID NO: 562650 - DNA, 25 bp, Homo sapien
agagtcatgcctggatattgggata

SEQ ID NO: 562651 - DNA, 25 bp, Homo sapien
catgcctggatattgggataagcca

SEQ ID NO: 562652 - DNA, 25 bp, Homo sapien
acagcttaaatttcccatcagtgac

SEQ ID NO: 562653 - DNA, 25 bp, Homo sapien
taaatttcccatcagtgactggagg

SEQ ID NO: 562654 - DNA, 25 bp, Homo sapien
ttcccatcagtgactggaggaattt

SEQ ID NO: 562655 - DNA, 25 bp, Homo sapien
tttttcaggtgcttcctatattacc

SEQ ID NO: 562656 - DNA, 25 bp, Homo sapien
aggtgcttcctatattaccatccct

SEQ ID NO: 562657 - DNA, 25 bp, Homo sapien
gtgatgtctatagaagtagcctgga

SEQ ID NO: 562658 - DNA, 25 bp, Homo sapien
tctatagaagtagcctggaaaacca

SEQ ID NO: 562659 - DNA, 25 bp, Homo sapien
atgagttttggagttcagtgacccc

SEQ ID NO: 562660 - DNA, 25 bp, Homo sapien
cccttcccaaggcattgaagctgaa

SEQ ID NO: 562661 - DNA, 25 bp, Homo sapien
agctgaatgtgccaactggcagtta

SEQ ID NO: 562662 - DNA, 25 bp, Homo sapien
gcagttagaagcgaaagatggcatt

SEQ ID NO: 562663 - DNA, 25 bp, Homo sapien
gaagctaccatgacctaccagattt

SEQ ID NO: 562664 - DNA, 25 bp, Homo sapien
gatttccaacgcctgccaaaattaa

SEQ ID NO: 562665 - DNA, 25 bp, Homo sapien
aagaggccataccattgtggccctt

SEQ ID NO: 562666 - DNA, 25 bp, Homo sapien
gtggcccttgaaacttactgtatga

SEQ ID NO: 562667 - DNA, 25 bp, Homo sapien
agcgaacagttcacatacccaaatg

SEQ ID NO: 562668 - DNA, 25 bp, Homo sapien
atacccaaatggttgtaactgatac

SEQ ID NO: 562669 - DNA, 25 bp, Homo sapien
tagatttactacactgaagccctcc

SEQ ID NO: 562670 - DNA, 25 bp, Homo sapien
gtaactgatactgctgaatatattg

SEQ ID NO: 562671 - DNA, 25 bp, Homo sapien
atgtataacacttcttttgattgta

SEQ ID NO: 562672 - DNA, 25 bp, Homo sapien
gatgcctctaacgaaggaaaggact

SEQ ID NO: 562673 - DNA, 25 bp, Homo sapien
gtttctgatgaagctaccatgacct

SEQ ID NO: 562674 - DNA, 25 bp, Homo sapien
agcccaagggagctaagaccaggag

SEQ ID NO: 562675 - DNA, 25 bp, Homo sapien
ggctgttgggcctacaaggcttcca

SEQ ID NO: 562676 - DNA, 25 bp, Homo sapien
gggatgccatccagcctgtaggaaa

SEQ ID NO: 562677 - DNA, 25 bp, Homo sapien
atgccatccagcctgtaggaaacca

SEQ ID NO: 562678 - DNA, 25 bp, Homo sapien
gaaaccaaagatgggaagtggctcc

SEQ ID NO: 562679 - DNA, 25 bp, Homo sapien
agtaccacatatactttctctcctt

SEQ ID NO: 562680 - DNA, 25 bp, Homo sapien
taccacatatactttctctccttct

SEQ ID NO: 562681 - DNA, 25 bp, Homo sapien
agggccccaccaatctgtttacata

SEQ ID NO: 562682 - DNA, 25 bp, Homo sapien
gccccaccaatctgtttacatattt

SEQ ID NO: 562683 - DNA, 25 bp, Homo sapien
atatttattatcctatgggggcctg

SEQ ID NO: 562684 - DNA, 25 bp, Homo sapien
ggcctgagcaggattgagggagcca

SEQ ID NO: 562685 - DNA, 25 bp, Homo sapien
cgacgatgataggtaggtgggcttc

SEQ ID NO: 562686 - DNA, 25 bp, Homo sapien
ggtagctgtaagaaagtgcctggta

SEQ ID NO: 562687 - DNA, 25 bp, Homo sapien
gaaagtgcctggtaggcatccttcc

SEQ ID NO: 562688 - DNA, 25 bp, Homo sapien
tccttcccccaggttgaacttggag

SEQ ID NO: 562689 - DNA, 25 bp, Homo sapien
ggacctcttagagaaacctggcctg

SEQ ID NO: 562690 - DNA, 25 bp, Homo sapien
ctcttagagaaacctggcctgggca

SEQ ID NO: 562691 - DNA, 25 bp, Homo sapien
tggcctgggcatagccactgcacac

SEQ ID NO: 562692 - DNA, 25 bp, Homo sapien
ggcatagccactgcacacagttgat

SEQ ID NO: 562693 - DNA, 25 bp, Homo sapien
actgcacacagttgatttcggaccc

SEQ ID NO: 562694 - DNA, 25 bp, Homo sapien
gcacacagttgatttcggacccact

SEQ ID NO: 562695 - DNA, 25 bp, Homo sapien
agttgatttcggacccactccctct

SEQ ID NO: 562696 - DNA, 25 bp, Homo sapien
ggctgtgtcttaaatgtggccatca

SEQ ID NO: 562697 - DNA, 25 bp, Homo sapien
cagggctgtggcagaaattctcagg

SEQ ID NO: 562698 - DNA, 25 bp, Homo sapien
aattctcaggagcagcatgccttga

SEQ ID NO: 562699 - DNA, 25 bp, Homo sapien
atgccttgaagcactatctgacgcc

SEQ ID NO: 562700 - DNA, 25 bp, Homo sapien
atctgacgccaagatctgaacctca

SEQ ID NO: 562701 - DNA, 25 bp, Homo sapien
aagatctgaacctcactgtctggtt

SEQ ID NO: 562702 - DNA, 25 bp, Homo sapien
ctcactgtctggttcttagtttgga

SEQ ID NO: 562703 - DNA, 25 bp, Homo sapien
tgaggtccagtattgtagttcaaac

SEQ ID NO: 562704 - DNA, 25 bp, Homo sapien
gtagttcaaaccagttgggtcaagt

SEQ ID NO: 562705 - DNA, 25 bp, Homo sapien
aacaagccagcattacaactccaaa

SEQ ID NO: 562706 - DNA, 25 bp, Homo sapien
agcattacaactccaaagccagcag

SEQ ID NO: 562707 - DNA, 25 bp, Homo sapien
cgtttagttctctcgacaactacct

SEQ ID NO: 562708 - DNA, 25 bp, Homo sapien
gtttccaggaactcatgtgatcatg

SEQ ID NO: 562709 - DNA, 25 bp, Homo sapien
atgtgatcatgagactctgcagtca

SEQ ID NO: 562710 - DNA, 25 bp, Homo sapien
atgagactctgcagtcacttcaggg

SEQ ID NO: 562711 - DNA, 25 bp, Homo sapien
gggctggtgtcaagcccaagcagaa

SEQ ID NO: 562712 - DNA, 25 bp, Homo sapien
aagcccaagcagaagagccctcaga

SEQ ID NO: 562713 - DNA, 25 bp, Homo sapien
caagcagccctgcttctgtggattc

SEQ ID NO: 562714 - DNA, 25 bp, Homo sapien
tggattctggatggcatcatcacca

SEQ ID NO: 562715 - DNA, 25 bp, Homo sapien
tggatggcatcatcaccaggcgggt

SEQ ID NO: 562716 - DNA, 25 bp, Homo sapien
accaggcgggtccttcagagtactg

SEQ ID NO: 562717 - DNA, 25 bp, Homo sapien
agagtactgggagcagcatgcagcc

SEQ ID NO: 562718 - DNA, 25 bp, Homo sapien
cttttaccagaaggtcctcctctag

SEQ ID NO: 562719 - DNA, 25 bp, Homo sapien
attcccaccctgatggtcccaagat

SEQ ID NO: 562720 - DNA, 25 bp, Homo sapien
ctcctctagactactactcatgttt

SEQ ID NO: 562721 - DNA, 25 bp, Homo sapien
gactactactcatgtttcattggac

SEQ ID NO: 562722 - DNA, 25 bp, Homo sapien
ggacaaatttggtcccatggaattt

SEQ ID NO: 562723 - DNA, 25 bp, Homo sapien
atcatgactggattagactacctaa

SEQ ID NO: 562724 - DNA, 25 bp, Homo sapien
aagattcaccactcctgagcctgga

SEQ ID NO: 562725 - DNA, 25 bp, Homo sapien
tgcagcagtttcagccatgttatcc

SEQ ID NO: 562726 - DNA, 25 bp, Homo sapien
gtttcagccatgttatcctaatcca

SEQ ID NO: 562727 - DNA, 25 bp, Homo sapien
gttatcctaatccaccaacatctgg

SEQ ID NO: 562728 - DNA, 25 bp, Homo sapien
tcttttcaatctccatctattacaa

SEQ ID NO: 562729 - DNA, 25 bp, Homo sapien
atgggccacaccaggaacaaaccac

SEQ ID NO: 562730 - DNA, 25 bp, Homo sapien
aggaacaaaccactggaccaaattg

SEQ ID NO: 562731 - DNA, 25 bp, Homo sapien
ggaccaaattgactcaggacacctg

SEQ ID NO: 562732 - DNA, 25 bp, Homo sapien
aggacacctgctctggacccagttt

SEQ ID NO: 562733 - DNA, 25 bp, Homo sapien
catcccatcccaggtttgtatttaa

SEQ ID NO: 562734 - DNA, 25 bp, Homo sapien
tttctgcataatgcatgttctctgc

SEQ ID NO: 562735 - DNA, 25 bp, Homo sapien
atgttctctgcatgttctgaagtac

SEQ ID NO: 562736 - DNA, 25 bp, Homo sapien
aagtactttccatcaagtccttcat

SEQ ID NO: 562737 - DNA, 25 bp, Homo sapien
taaatgaagctgtgcataacctctt

SEQ ID NO: 562738 - DNA, 25 bp, Homo sapien
taacctctttttgaggctctctttg

SEQ ID NO: 562739 - DNA, 25 bp, Homo sapien
ctttggcttttcttgcacaatttta

SEQ ID NO: 562740 - DNA, 25 bp, Homo sapien
aagacttcattatagattctaggga

SEQ ID NO: 562741 - DNA, 25 bp, Homo sapien
agggaacctgatgcaactactcgtg

SEQ ID NO: 562742 - DNA, 25 bp, Homo sapien
gcaactactcgtgtatgtgaactac

SEQ ID NO: 562743 - DNA, 25 bp, Homo sapien
gtgtatgtgaactactgaagtacca

SEQ ID NO: 562744 - DNA, 25 bp, Homo sapien
tgaagtaccaaggagagcactgtct

SEQ ID NO: 562745 - DNA, 25 bp, Homo sapien
aaatgcagcagtggtccattcctcc

SEQ ID NO: 562746 - DNA, 25 bp, Homo sapien
ctccatttcctgtaagtggccatga

SEQ ID NO: 562747 - DNA, 25 bp, Homo sapien
tttcctgtaagtggccatgacatca

SEQ ID NO: 562748 - DNA, 25 bp, Homo sapien
gggctctattacaacagttgcgaga

SEQ ID NO: 562749 - DNA, 25 bp, Homo sapien
acaacagttgcgagaacagtggaaa

SEQ ID NO: 562750 - DNA, 25 bp, Homo sapien
gaagacctaaaactgatggctacta

SEQ ID NO: 562751 - DNA, 25 bp, Homo sapien
taccttattaccactcaaataccag

SEQ ID NO: 562752 - DNA, 25 bp, Homo sapien
attaccactcaaataccagtgtgtg

SEQ ID NO: 562753 - DNA, 25 bp, Homo sapien
accactcaaataccagtgtgtgtgt

SEQ ID NO: 562754 - DNA, 25 bp, Homo sapien
tgttttcttctctgagctagactga

SEQ ID NO: 562755 - DNA, 25 bp, Homo sapien
tttcttctctgagctagactgagct

SEQ ID NO: 562756 - DNA, 25 bp, Homo sapien
gctggggatctaagatgtacttctc

SEQ ID NO: 562757 - DNA, 25 bp, Homo sapien
gtacttctctgactacaaaagggac

SEQ ID NO: 562758 - DNA, 25 bp, Homo sapien
gactacaaaagggacagtatcattt

SEQ ID NO: 562759 - DNA, 25 bp, Homo sapien
ggacagtatcatttagattttttgc

SEQ ID NO: 562760 - DNA, 25 bp, Homo sapien
agaaatgggttgttgagtgtgttaa

SEQ ID NO: 562761 - DNA, 25 bp, Homo sapien
ttgagtgtgttaaggctgggatgaa

SEQ ID NO: 562762 - DNA, 25 bp, Homo sapien
atgtaagtgaatttcctctgggaag

SEQ ID NO: 562763 - DNA, 25 bp, Homo sapien
ggtttgggaggtggatattaatatc

SEQ ID NO: 562764 - DNA, 25 bp, Homo sapien
taatatcattatgcgctttctcacc

SEQ ID NO: 562765 - DNA, 25 bp, Homo sapien
tatcattatgcgctttctcacctac

SEQ ID NO: 562766 - DNA, 25 bp, Homo sapien
tatgcgctttctcacctacagaaga

SEQ ID NO: 562767 - DNA, 25 bp, Homo sapien
gctttctcacctacagaagactagt

SEQ ID NO: 562768 - DNA, 25 bp, Homo sapien
gaagactagtctgaacttgtggcag

SEQ ID NO: 562769 - DNA, 25 bp, Homo sapien
agtctgaacttgtggcaggaaccta

SEQ ID NO: 562770 - DNA, 25 bp, Homo sapien
cttgtggcaggaacctagccagctt

SEQ ID NO: 562771 - DNA, 25 bp, Homo sapien
aggaacctagccagcttgattgcct

SEQ ID NO: 562772 - DNA, 25 bp, Homo sapien
cctagccagcttgattgcctgctaa

SEQ ID NO: 562773 - DNA, 25 bp, Homo sapien
gaaaggccagctgactagatctctg

SEQ ID NO: 562774 - DNA, 25 bp, Homo sapien
tggattctaattttggccctacctg

SEQ ID NO: 562775 - DNA, 25 bp, Homo sapien
tggccctacctgtaacttaattttg

SEQ ID NO: 562776 - DNA, 25 bp, Homo sapien
tgaccacagttgtaccattcaccgt

SEQ ID NO: 562777 - DNA, 25 bp, Homo sapien
gtgcctgggctctagtttcctggtt

SEQ ID NO: 562778 - DNA, 25 bp, Homo sapien
tttcctggtttgtaaggcagcccca

SEQ ID NO: 562779 - DNA, 25 bp, Homo sapien
gccccagcgttcatgttctgtgata

SEQ ID NO: 562780 - DNA, 25 bp, Homo sapien
gagcagaactgaacttattacctaa

SEQ ID NO: 562781 - DNA, 25 bp, Homo sapien
attacctaattaactctctgctatg

SEQ ID NO: 562782 - DNA, 25 bp, Homo sapien
taagcaggtgtgtgggctcctttag

SEQ ID NO: 562783 - DNA, 25 bp, Homo sapien
gctcctttaggcaggttacagttaa

SEQ ID NO: 562784 - DNA, 25 bp, Homo sapien
gcttttgtggccttgtatgggactt

SEQ ID NO: 562785 - DNA, 25 bp, Homo sapien
gtggccttgtatgggactttcatta

SEQ ID NO: 562786 - DNA, 25 bp, Homo sapien
ggactttcattaatgtctgagcaca

SEQ ID NO: 562787 - DNA, 25 bp, Homo sapien
ggaacaaagagtgtctacgtccctt

SEQ ID NO: 562788 - DNA, 25 bp, Homo sapien
gtgtctacgtccctttgtgttgtaa

SEQ ID NO: 562789 - DNA, 25 bp, Homo sapien
gtccctttgtgttgtaagttaccag

SEQ ID NO: 562790 - DNA, 25 bp, Homo sapien
agaaagttaggcagcctgcttccca

SEQ ID NO: 562791 - DNA, 25 bp, Homo sapien
ctgcttcccatagacgtgttgttgt

SEQ ID NO: 562792 - DNA, 25 bp, Homo sapien
gacgtgttgttgtctccctaaagaa

SEQ ID NO: 562793 - DNA, 25 bp, Homo sapien
gaaagcaattgtcattatcgttaag

SEQ ID NO: 562794 - DNA, 25 bp, Homo sapien
gtattctttttgtagctctttctta

SEQ ID NO: 562795 - DNA, 25 bp, Homo sapien
tcatcagactatccagtagtcttag

SEQ ID NO: 562796 - DNA, 25 bp, Homo sapien
aagggacacatgacttgtactctat

SEQ ID NO: 562797 - DNA, 25 bp, Homo sapien
gggacacatgacttgtactctatta

SEQ ID NO: 562798 - DNA, 25 bp, Homo sapien
gacttgtactctattatatcctgca

SEQ ID NO: 562799 - DNA, 25 bp, Homo sapien
actctattatatcctgcattctcta

SEQ ID NO: 562800 - DNA, 25 bp, Homo sapien
gttgacagcctcatgaaatggctat

SEQ ID NO: 562801 - DNA, 25 bp, Homo sapien
tttttatgtctaacagtcccatcaa

SEQ ID NO: 562802 - DNA, 25 bp, Homo sapien
tatgtctaacagtcccatcaacttt

SEQ ID NO: 562803 - DNA, 25 bp, Homo sapien
gtctaacagtcccatcaactttatt

SEQ ID NO: 562804 - DNA, 25 bp, Homo sapien
acagtcccatcaactttattctagt

SEQ ID NO: 562805 - DNA, 25 bp, Homo sapien
ttaagaacattgtcacagaaaggaa

SEQ ID NO: 562806 - DNA, 25 bp, Homo sapien
gtgactgctctgacagcaaaaacaa

SEQ ID NO: 562807 - DNA, 25 bp, Homo sapien
aaaacaagcaaatatctccagaggg

SEQ ID NO: 562808 - DNA, 25 bp, Homo sapien
gggattaatccttctgcttcaaagt

SEQ ID NO: 562809 - DNA, 25 bp, Homo sapien
gattaatccttctgcttcaaagtaa

SEQ ID NO: 562810 - DNA, 25 bp, Homo sapien
aatccttctgcttcaaagtaactaa

SEQ ID NO: 562811 - DNA, 25 bp, Homo sapien
gaaagctgagccagcttcactggaa

SEQ ID NO: 562812 - DNA, 25 bp, Homo sapien
aagctgagccagcttcactggaaac

SEQ ID NO: 562813 - DNA, 25 bp, Homo sapien
ggaaacaacacctgtccatcagaca

SEQ ID NO: 562814 - DNA, 25 bp, Homo sapien
aacaacacctgtccatcagacaagg

SEQ ID NO: 562815 - DNA, 25 bp, Homo sapien
aacacctgtccatcagacaaggatg

SEQ ID NO: 562816 - DNA, 25 bp, Homo sapien
gtccatcagacaaggatgagctaat

SEQ ID NO: 562817 - DNA, 25 bp, Homo sapien
gcagccactggctccgcgggcacag

SEQ ID NO: 562818 - DNA, 25 bp, Homo sapien
cctgggcgctgcacttgggctagcc

SEQ ID NO: 562819 - DNA, 25 bp, Homo sapien
ctgcacttgggctagcctggtccca

SEQ ID NO: 562820 - DNA, 25 bp, Homo sapien
tcaggggggacatgctctctcttac

SEQ ID NO: 562821 - DNA, 25 bp, Homo sapien
tctcttaccctgtcacttggtctag

SEQ ID NO: 562822 - DNA, 25 bp, Homo sapien
tcttaccctgtcacttggtctagac

SEQ ID NO: 562823 - DNA, 25 bp, Homo sapien
ctgtcacttggtctagacccagaga

SEQ ID NO: 562824 - DNA, 25 bp, Homo sapien
tctagacccagagaccccagaaagg

SEQ ID NO: 562825 - DNA, 25 bp, Homo sapien
tagacccagagaccccagaaaggga

SEQ ID NO: 562826 - DNA, 25 bp, Homo sapien
gagggcctagtaataaatcctattt

SEQ ID NO: 562827 - DNA, 25 bp, Homo sapien
ggcctagtaataaatcctattttga

SEQ ID NO: 562828 - DNA, 25 bp, Homo sapien
gtgtgcctggcacagtcagattcat

SEQ ID NO: 562829 - DNA, 25 bp, Homo sapien
ggcacagtcagattcataaagacaa

SEQ ID NO: 562830 - DNA, 25 bp, Homo sapien
tagattagaggctgccaggaactgg

SEQ ID NO: 562831 - DNA, 25 bp, Homo sapien
gggaaggaatgacttagtttctaat

SEQ ID NO: 562832 - DNA, 25 bp, Homo sapien
tttctaatagggacagagtttctgc

SEQ ID NO: 562833 - DNA, 25 bp, Homo sapien
gagtttctgcttagaatgcttaaca

SEQ ID NO: 562834 - DNA, 25 bp, Homo sapien
atgcttaacaagttctggatatggt

SEQ ID NO: 562835 - DNA, 25 bp, Homo sapien
atatggtgcggatggttgcacattt

SEQ ID NO: 562836 - DNA, 25 bp, Homo sapien
taagaaatgacctgtaagcctgcca

SEQ ID NO: 562837 - DNA, 25 bp, Homo sapien
tgtaagcctgccatctggataactc

SEQ ID NO: 562838 - DNA, 25 bp, Homo sapien
gcctgccatctggataactccagta

SEQ ID NO: 562839 - DNA, 25 bp, Homo sapien
ttagaacttgaatatttgcatgctt

SEQ ID NO: 562840 - DNA, 25 bp, Homo sapien
agaacttgaatatttgcatgcttaa

SEQ ID NO: 562841 - DNA, 25 bp, Homo sapien
acttgaatatttgcatgcttaaggc

SEQ ID NO: 562842 - DNA, 25 bp, Homo sapien
gaatatttgcatgcttaaggcactg

SEQ ID NO: 562843 - DNA, 25 bp, Homo sapien
aatatttgcatgcttaaggcactgt

SEQ ID NO: 562844 - DNA, 25 bp, Homo sapien
tatttgcatgcttaaggcactgttt

SEQ ID NO: 562845 - DNA, 25 bp, Homo sapien
atttgcatgcttaaggcactgtttt

SEQ ID NO: 562846 - DNA, 25 bp, Homo sapien
ttgcatgcttaaggcactgttttag

SEQ ID NO: 562847 - DNA, 25 bp, Homo sapien
ggcactgttttagaagcttacttag

SEQ ID NO: 562848 - DNA, 25 bp, Homo sapien
gcactgttttagaagcttacttagt

SEQ ID NO: 562849 - DNA, 25 bp, Homo sapien
cactgttttagaagcttacttagtt

SEQ ID NO: 562850 - DNA, 25 bp, Homo sapien
gtaaagaccttgctgaatgtttcca

SEQ ID NO: 562851 - DNA, 25 bp, Homo sapien
taaagaccttgctgaatgtttccaa

SEQ ID NO: 562852 - DNA, 25 bp, Homo sapien
aaagaccttgctgaatgtttccaat

SEQ ID NO: 562853 - DNA, 25 bp, Homo sapien
aagaccttgctgaatgtttccaata

SEQ ID NO: 562854 - DNA, 25 bp, Homo sapien
agaccttgctgaatgtttccaatag

SEQ ID NO: 562855 - DNA, 25 bp, Homo sapien
gaccttgctgaatgtttccaataga

SEQ ID NO: 562856 - DNA, 25 bp, Homo sapien
accttgctgaatgtttccaatagac

SEQ ID NO: 562857 - DNA, 25 bp, Homo sapien
cttgctgaatgtttccaatagacta

SEQ ID NO: 562858 - DNA, 25 bp, Homo sapien
gctgaatgtttccaatagactaaat

SEQ ID NO: 562859 - DNA, 25 bp, Homo sapien
gaatgtttccaatagactaaatact

SEQ ID NO: 562860 - DNA, 25 bp, Homo sapien
aatccggaataaatactacctggag

SEQ ID NO: 562861 - DNA, 25 bp, Homo sapien
tcacctactgacatcgggactgaca

SEQ ID NO: 562862 - DNA, 25 bp, Homo sapien
actgacatcgggactgacattcctg

SEQ ID NO: 562863 - DNA, 25 bp, Homo sapien
acatcgggactgacattcctgaacc

SEQ ID NO: 562864 - DNA, 25 bp, Homo sapien
ggactgacattcctgaacccctggt

SEQ ID NO: 562865 - DNA, 25 bp, Homo sapien
gaacccctggtatgaggccagcctg

SEQ ID NO: 562866 - DNA, 25 bp, Homo sapien
tgctgcccatctatgcagtcactgt

SEQ ID NO: 562867 - DNA, 25 bp, Homo sapien
tctatgcagtcactgtttccatggg

SEQ ID NO: 562868 - DNA, 25 bp, Homo sapien
gtcgggtgatggtgtattctgccct

SEQ ID NO: 562869 - DNA, 25 bp, Homo sapien
tgatggtgtattctgccctgcgcat

SEQ ID NO: 562870 - DNA, 25 bp, Homo sapien
gcatcccacccgaggactgagggaa

SEQ ID NO: 562871 - DNA, 25 bp, Homo sapien
cacccgaggactgagggaacctagg

SEQ ID NO: 562872 - DNA, 25 bp, Homo sapien
tccaggagaagagagctaagccagc

SEQ ID NO: 562873 - DNA, 25 bp, Homo sapien
ccaggagaagagagctaagccagcc

SEQ ID NO: 562874 - DNA, 25 bp, Homo sapien
caggagaagagagctaagccagccc

SEQ ID NO: 562875 - DNA, 25 bp, Homo sapien
aggagaagagagctaagccagccct

SEQ ID NO: 562876 - DNA, 25 bp, Homo sapien
ggagaagagagctaagccagccctt

SEQ ID NO: 562877 - DNA, 25 bp, Homo sapien
gagaagagagctaagccagcccttg

SEQ ID NO: 562878 - DNA, 25 bp, Homo sapien
agaagagagctaagccagcccttgg

SEQ ID NO: 562879 - DNA, 25 bp, Homo sapien
gactacaagaggaccggaggagaca

SEQ ID NO: 562880 - DNA, 25 bp, Homo sapien
actacaagaggaccggaggagacag

SEQ ID NO: 562881 - DNA, 25 bp, Homo sapien
acaagaggaccggaggagacaggga

SEQ ID NO: 562882 - DNA, 25 bp, Homo sapien
caagaggaccggaggagacagggaa

SEQ ID NO: 562883 - DNA, 25 bp, Homo sapien
gaaatcagtggcagaaataatcctg

SEQ ID NO: 562884 - DNA, 25 bp, Homo sapien
atcagtggcagaaataatcctgctg

SEQ ID NO: 562885 - DNA, 25 bp, Homo sapien
cagtggcagaaataatcctgctgtt

SEQ ID NO: 562886 - DNA, 25 bp, Homo sapien
agtggcagaaataatcctgctgtta

SEQ ID NO: 562887 - DNA, 25 bp, Homo sapien
taatcctgctgttattggtgtttgt

SEQ ID NO: 562888 - DNA, 25 bp, Homo sapien
taactttttattagctcttcctaag

SEQ ID NO: 562889 - DNA, 25 bp, Homo sapien
ttactttaagagcataaactcgttt

SEQ ID NO: 562890 - DNA, 25 bp, Homo sapien
tactttaagagcataaactcgtttt

SEQ ID NO: 562891 - DNA, 25 bp, Homo sapien
gagcataaactcgtttttattttgc

SEQ ID NO: 562892 - DNA, 25 bp, Homo sapien
gcataaactcgtttttattttgcac

SEQ ID NO: 562893 - DNA, 25 bp, Homo sapien
taaactcgtttttattttgcacact

SEQ ID NO: 562894 - DNA, 25 bp, Homo sapien
aaaatggcttagtattgaaaggaga

SEQ ID NO: 562895 - DNA, 25 bp, Homo sapien
aaggagagagaagtattggtctttg

SEQ ID NO: 562896 - DNA, 25 bp, Homo sapien
ttggaaagtgtgaatcaataactat

SEQ ID NO: 562897 - DNA, 25 bp, Homo sapien
ttaattatactatttgcccattctt

SEQ ID NO: 562898 - DNA, 25 bp, Homo sapien
atactatttgcccattctttttctc

SEQ ID NO: 562899 - DNA, 25 bp, Homo sapien
tttctctgcagtgcatttcacagaa

SEQ ID NO: 562900 - DNA, 25 bp, Homo sapien
ctgcagtgcatttcacagaataaat

SEQ ID NO: 562901 - DNA, 25 bp, Homo sapien
gcagtgcatttcacagaataaatcc

SEQ ID NO: 562902 - DNA, 25 bp, Homo sapien
gaataaatcctctaacttgtctcta

SEQ ID NO: 562903 - DNA, 25 bp, Homo sapien
taaatcctctaacttgtctctacta

SEQ ID NO: 562904 - DNA, 25 bp, Homo sapien
tagtgggctgaggttgcgtcattgc

SEQ ID NO: 562905 - DNA, 25 bp, Homo sapien
ggataaaactgcctacacacctgtc

SEQ ID NO: 562906 - DNA, 25 bp, Homo sapien
ataaaactgcctacacacctgtcct

SEQ ID NO: 562907 - DNA, 25 bp, Homo sapien
aaactgcctacacacctgtcctgaa

SEQ ID NO: 562908 - DNA, 25 bp, Homo sapien
gtgccgaaattatgtggactctttt

SEQ ID NO: 562909 - DNA, 25 bp, Homo sapien
gaaattatgtggactctttttgctc

SEQ ID NO: 562910 - DNA, 25 bp, Homo sapien
aattatgtggactctttttgctctg

SEQ ID NO: 562911 - DNA, 25 bp, Homo sapien
ttatgtggactctttttgctctgga

SEQ ID NO: 562912 - DNA, 25 bp, Homo sapien
atgtggactctttttgctctggata

SEQ ID NO: 562913 - DNA, 25 bp, Homo sapien
gtggactctttttgctctggatatg

SEQ ID NO: 562914 - DNA, 25 bp, Homo sapien
ggactctttttgctctggatatgaa

SEQ ID NO: 562915 - DNA, 25 bp, Homo sapien
actctttttgctctggatatgaaat

SEQ ID NO: 562916 - DNA, 25 bp, Homo sapien
gtaacaagcgcagagaggaatgact

SEQ ID NO: 562917 - DNA, 25 bp, Homo sapien
gaatgactgcctctgctgatggtaa

SEQ ID NO: 562918 - DNA, 25 bp, Homo sapien
tgcctctgctgatggtaaccttgaa

SEQ ID NO: 562919 - DNA, 25 bp, Homo sapien
gacactggagcctttctgagactag

SEQ ID NO: 562920 - DNA, 25 bp, Homo sapien
gagcctttctgagactagtgttgca

SEQ ID NO: 562921 - DNA, 25 bp, Homo sapien
gactagtgttgcatgggtcctcaat

SEQ ID NO: 562922 - DNA, 25 bp, Homo sapien
tgggtcctcaataaaatcacactgt

SEQ ID NO: 562923 - DNA, 25 bp, Homo sapien
aatcacactgttgttactcacttcc

SEQ ID NO: 562924 - DNA, 25 bp, Homo sapien
ctgttgttactcacttcctttgggt

SEQ ID NO: 562925 - DNA, 25 bp, Homo sapien
gtggagtaaaccctcgacttgaatt

SEQ ID NO: 562926 - DNA, 25 bp, Homo sapien
aatctcacatcaggcactctatttg

SEQ ID NO: 562927 - DNA, 25 bp, Homo sapien
atacgttaccatcacaatttcatga

SEQ ID NO: 562928 - DNA, 25 bp, Homo sapien
aatgaagatctagcccttccatgcc

SEQ ID NO: 562929 - DNA, 25 bp, Homo sapien
catgcctcctgctgaactatgtcac

SEQ ID NO: 562930 - DNA, 25 bp, Homo sapien
cctgctgaactatgtcacctgtgat

SEQ ID NO: 562931 - DNA, 25 bp, Homo sapien
gtcacctgtgataataaaacctcta

SEQ ID NO: 562932 - DNA, 25 bp, Homo sapien
ggcttaaagaagcttgtgttactga

SEQ ID NO: 562933 - DNA, 25 bp, Homo sapien
ctgaagttaacgcagaagtctggcc

SEQ ID NO: 562934 - DNA, 25 bp, Homo sapien
agaagtctggcctccgtttgtggga

SEQ ID NO: 562935 - DNA, 25 bp, Homo sapien
atatcctacgggatcagagtcatct

SEQ ID NO: 562936 - DNA, 25 bp, Homo sapien
ttagaaacagtgatagccctgggta

SEQ ID NO: 562937 - DNA, 25 bp, Homo sapien
tagccctgggtataaataaacattt

SEQ ID NO: 562938 - DNA, 25 bp, Homo sapien
ttgcacctgaagcaagacagccgag

SEQ ID NO: 562939 - DNA, 25 bp, Homo sapien
tgaagcaagacagccgagaacaccg

SEQ ID NO: 562940 - DNA, 25 bp, Homo sapien
gtagtgcgtcagaaccagatgttta

SEQ ID NO: 562941 - DNA, 25 bp, Homo sapien
gaaccagatgtttataaggcttatg

SEQ ID NO: 562942 - DNA, 25 bp, Homo sapien
gtattttatcacctctgctgtacag

SEQ ID NO: 562943 - DNA, 25 bp, Homo sapien
gtttatggtttacaatggctgcaag

SEQ ID NO: 562944 - DNA, 25 bp, Homo sapien
caatggctgcaaggaaatcggatca

SEQ ID NO: 562945 - DNA, 25 bp, Homo sapien
aatgtattctaatttggctgagtta

SEQ ID NO: 562946 - DNA, 25 bp, Homo sapien
aagtcagccaatatgcaacaggata

SEQ ID NO: 562947 - DNA, 25 bp, Homo sapien
gaatgttcattaatgcttccaagta

SEQ ID NO: 562948 - DNA, 25 bp, Homo sapien
ttccaagtaaaagccatttgtctgt

SEQ ID NO: 562949 - DNA, 25 bp, Homo sapien
tttaggcttcagtttcacatatctc

SEQ ID NO: 562950 - DNA, 25 bp, Homo sapien
gtgatgggatgattaagagactatt

SEQ ID NO: 562951 - DNA, 25 bp, Homo sapien
gagactattaaagctattacctctt

SEQ ID NO: 562952 - DNA, 25 bp, Homo sapien
aaagctattacctctttagagtcat

SEQ ID NO: 562953 - DNA, 25 bp, Homo sapien
tacctctttagagtcatgttcaaaa

SEQ ID NO: 562954 - DNA, 25 bp, Homo sapien
tattagatctgaaaagggacttgtg

SEQ ID NO: 562955 - DNA, 25 bp, Homo sapien
tgttgttgtttatccttctgcttct

SEQ ID NO: 562956 - DNA, 25 bp, Homo sapien
ttctgcttctccaatttgtgttgta

SEQ ID NO: 562957 - DNA, 25 bp, Homo sapien
ttaattttgtgttccctcattacag

SEQ ID NO: 562958 - DNA, 25 bp, Homo sapien
tttgtgttccctcattacagtttat

SEQ ID NO: 562959 - DNA, 25 bp, Homo sapien
gtttatcaaagtacattctgtatat

SEQ ID NO: 562960 - DNA, 25 bp, Homo sapien
aagtgacggcaaaatgttttggtca

SEQ ID NO: 562961 - DNA, 25 bp, Homo sapien
gttttggtcatttgacgaagcaatt

SEQ ID NO: 562962 - DNA, 25 bp, Homo sapien
gaagcaattgatgacattggctgat

SEQ ID NO: 562963 - DNA, 25 bp, Homo sapien
attgatgacattggctgatggacgt

SEQ ID NO: 562964 - DNA, 25 bp, Homo sapien
ggctctagaaggaggacatgatctc

SEQ ID NO: 562965 - DNA, 25 bp, Homo sapien
cacagccatctgtgatgcatcagaa

SEQ ID NO: 562966 - DNA, 25 bp, Homo sapien
ctgtgatgcatcagaagcctgtgta

SEQ ID NO: 562967 - DNA, 25 bp, Homo sapien
gaagcctgtgtaaatgcccttctag

SEQ ID NO: 562968 - DNA, 25 bp, Homo sapien
gcctgtgtaaatgcccttctaggaa

SEQ ID NO: 562969 - DNA, 25 bp, Homo sapien
atgcccttctaggaaatgagctgga

SEQ ID NO: 562970 - DNA, 25 bp, Homo sapien
taggaaatgagctggagccacttgc

SEQ ID NO: 562971 - DNA, 25 bp, Homo sapien
gatgaacaacatagagctgcacaag

SEQ ID NO: 562972 - DNA, 25 bp, Homo sapien
atagagctgcacaagcagggcctgc

SEQ ID NO: 562973 - DNA, 25 bp, Homo sapien
tgctgcttttcgctgaaatcctgac

SEQ ID NO: 562974 - DNA, 25 bp, Homo sapien
ttttcgctgaaatcctgacccggca

SEQ ID NO: 562975 - DNA, 25 bp, Homo sapien
ctgaaatcctgacccggcagccaga

SEQ ID NO: 562976 - DNA, 25 bp, Homo sapien
gccagaggagatcaagctgttcaca

SEQ ID NO: 562977 - DNA, 25 bp, Homo sapien
aagctgttcacaagctcagccatgt

SEQ ID NO: 562978 - DNA, 25 bp, Homo sapien
cacaagctcagccatgtgcagagat

SEQ ID NO: 562979 - DNA, 25 bp, Homo sapien
gtgcagagatgctggccgtgccctc

SEQ ID NO: 562980 - DNA, 25 bp, Homo sapien
cgtgccctccaagaagcagttagca

SEQ ID NO: 562981 - DNA, 25 bp, Homo sapien
caagaagcagttagcagccctgtgc

SEQ ID NO: 562982 - DNA, 25 bp, Homo sapien
gataacacagccacaggttccaggg

SEQ ID NO: 562983 - DNA, 25 bp, Homo sapien
caggttccagggatcaggacatctt

SEQ ID NO: 562984 - DNA, 25 bp, Homo sapien
tccagggatcaggacatcttgtggg

SEQ ID NO: 562985 - DNA, 25 bp, Homo sapien
gggaagggcattattcagccaacca

SEQ ID NO: 562986 - DNA, 25 bp, Homo sapien
attattcagccaaccacatccatgg

SEQ ID NO: 562987 - DNA, 25 bp, Homo sapien
gccaaccacatccatggtcaaatgc

SEQ ID NO: 562988 - DNA, 25 bp, Homo sapien
ggtgggaggcactcaccctcaaggc

SEQ ID NO: 562989 - DNA, 25 bp, Homo sapien
accctcaaggcctgtgcaagtgcat

SEQ ID NO: 562990 - DNA, 25 bp, Homo sapien
ctgtgcaagtgcatagctgctcctt

SEQ ID NO: 562991 - DNA, 25 bp, Homo sapien
gctgctcctttctgtattgaaaact

SEQ ID NO: 562992 - DNA, 25 bp, Homo sapien
gaaaactttgatcttttgttcatca

SEQ ID NO: 562993 - DNA, 25 bp, Homo sapien
agatgcatcaccttaaaaccaagat

SEQ ID NO: 562994 - DNA, 25 bp, Homo sapien
gatgacattgttcttcttggaacat

SEQ ID NO: 562995 - DNA, 25 bp, Homo sapien
ttcttggaacatgttaagacatcga

SEQ ID NO: 562996 - DNA, 25 bp, Homo sapien
gacatcgaatggtggcgggttaaac

SEQ ID NO: 562997 - DNA, 25 bp, Homo sapien
tggtggcgggttaaactgtactgct

SEQ ID NO: 562998 - DNA, 25 bp, Homo sapien
gtactgcttaagtggagcggctacc

SEQ ID NO: 562999 - DNA, 25 bp, Homo sapien
agcggctaccgttatgcatctatca

SEQ ID NO: 563000 - DNA, 25 bp, Homo sapien
ccgttatgcatctatcacagttggg

SEQ ID NO: 563001 - DNA, 25 bp, Homo sapien
gaaaacttgtcaatagttcagctga

SEQ ID NO: 563002 - DNA, 25 bp, Homo sapien
gttcagctgaaatgactgaatcaca

SEQ ID NO: 563003 - DNA, 25 bp, Homo sapien
aatgtatcgcattgttatctaatat

SEQ ID NO: 563004 - DNA, 25 bp, Homo sapien
tgtgttttgtggtagaagtggttaa

SEQ ID NO: 563005 - DNA, 25 bp, Homo sapien
gtgttttgtggtagaagtggttaag

SEQ ID NO: 563006 - DNA, 25 bp, Homo sapien
tgttttgtggtagaagtggttaagg

SEQ ID NO: 563007 - DNA, 25 bp, Homo sapien
ttgtggtagaagtggttaaggcagt

SEQ ID NO: 563008 - DNA, 25 bp, Homo sapien
tgtggtagaagtggttaaggcagtg

SEQ ID NO: 563009 - DNA, 25 bp, Homo sapien
gtggtagaagtggttaaggcagtgg

SEQ ID NO: 563010 - DNA, 25 bp, Homo sapien
tggtagaagtggttaaggcagtggt

SEQ ID NO: 563011 - DNA, 25 bp, Homo sapien
ggtagaagtggttaaggcagtggtg

SEQ ID NO: 563012 - DNA, 25 bp, Homo sapien
gtagaagtggttaaggcagtggtgt

SEQ ID NO: 563013 - DNA, 25 bp, Homo sapien
tagaagtggttaaggcagtggtgtt

SEQ ID NO: 563014 - DNA, 25 bp, Homo sapien
agaagtggttaaggcagtggtgttc

SEQ ID NO: 563015 - DNA, 25 bp, Homo sapien
acttgcaagccctgctctaccaggc

SEQ ID NO: 563016 - DNA, 25 bp, Homo sapien
ccacaggcagttccgaagcaagttt

SEQ ID NO: 563017 - DNA, 25 bp, Homo sapien
ggcagttccgaagcaagtttcccta

SEQ ID NO: 563018 - DNA, 25 bp, Homo sapien
gttccgaagcaagtttccctactct

SEQ ID NO: 563019 - DNA, 25 bp, Homo sapien
cgaagcaagtttccctactctctca

SEQ ID NO: 563020 - DNA, 25 bp, Homo sapien
acccccacaggtacaggtacagcag

SEQ ID NO: 563021 - DNA, 25 bp, Homo sapien
tacagcagcccctctgtacaatggc

SEQ ID NO: 563022 - DNA, 25 bp, Homo sapien
agcccctctgtacaatggctgaggc

SEQ ID NO: 563023 - DNA, 25 bp, Homo sapien
cctctgtacaatggctgaggccaca

SEQ ID NO: 563024 - DNA, 25 bp, Homo sapien
gtacaatggctgaggccacagaaat

SEQ ID NO: 563025 - DNA, 25 bp, Homo sapien
tgtctgtttacaactccaagtccca

SEQ ID NO: 563026 - DNA, 25 bp, Homo sapien
tttataaacactgctcatttttgga

SEQ ID NO: 563027 - DNA, 25 bp, Homo sapien
gaattgttacccatcagcattgtag

SEQ ID NO: 563028 - DNA, 25 bp, Homo sapien
cagcattgtagaatagtgtcttcaa

SEQ ID NO: 563029 - DNA, 25 bp, Homo sapien
gtagaaggagtatggttaagcacac

SEQ ID NO: 563030 - DNA, 25 bp, Homo sapien
ggttaagcacactcttgaaaactgg

SEQ ID NO: 563031 - DNA, 25 bp, Homo sapien
aaactggagctttgtattctgtgac

SEQ ID NO: 563032 - DNA, 25 bp, Homo sapien
tttgtattctgtgactgctatggct

SEQ ID NO: 563033 - DNA, 25 bp, Homo sapien
tgctatggctagctttgtaaccaaa

SEQ ID NO: 563034 - DNA, 25 bp, Homo sapien
tgagaatttcactctacctgcatga

SEQ ID NO: 563035 - DNA, 25 bp, Homo sapien
ctctacctgcatgagtataacaatt

SEQ ID NO: 563036 - DNA, 25 bp, Homo sapien
aacaattttgatactgctcatttag

SEQ ID NO: 563037 - DNA, 25 bp, Homo sapien
gaggctgaaatctactgatatgtac

SEQ ID NO: 563038 - DNA, 25 bp, Homo sapien
aggctgaaatctactgatatgtaca

SEQ ID NO: 563039 - DNA, 25 bp, Homo sapien
ggctgaaatctactgatatgtacac

SEQ ID NO: 563040 - DNA, 25 bp, Homo sapien
gctgaaatctactgatatgtacacc

SEQ ID NO: 563041 - DNA, 25 bp, Homo sapien
ctgaaatctactgatatgtacacct

SEQ ID NO: 563042 - DNA, 25 bp, Homo sapien
tgaaatctactgatatgtacacctc

SEQ ID NO: 563043 - DNA, 25 bp, Homo sapien
gaaatctactgatatgtacacctcc

SEQ ID NO: 563044 - DNA, 25 bp, Homo sapien
aatgggaataataaagctcctactt

SEQ ID NO: 563045 - DNA, 25 bp, Homo sapien
aggtgctactccttcaggaaggtac

SEQ ID NO: 563046 - DNA, 25 bp, Homo sapien
ggtgctactccttcaggaaggtacc

SEQ ID NO: 563047 - DNA, 25 bp, Homo sapien
gtgctactccttcaggaaggtacca

SEQ ID NO: 563048 - DNA, 25 bp, Homo sapien
gctactccttcaggaaggtaccatc

SEQ ID NO: 563049 - DNA, 25 bp, Homo sapien
tactccttcaggaaggtaccatcaa

SEQ ID NO: 563050 - DNA, 25 bp, Homo sapien
tccttcaggaaggtaccatcaagct

SEQ ID NO: 563051 - DNA, 25 bp, Homo sapien
ccttcaggaaggtaccatcaagctc

SEQ ID NO: 563052 - DNA, 25 bp, Homo sapien
cttcaggaaggtaccatcaagctcc

SEQ ID NO: 563053 - DNA, 25 bp, Homo sapien
cttccccactacctagtcattagag

SEQ ID NO: 563054 - DNA, 25 bp, Homo sapien
ttccccactacctagtcattagagc

SEQ ID NO: 563055 - DNA, 25 bp, Homo sapien
tccccactacctagtcattagagcg

SEQ ID NO: 563056 - DNA, 25 bp, Homo sapien
ggccacggcatagctggacctttga

SEQ ID NO: 563057 - DNA, 25 bp, Homo sapien
ggacctttgattgcaacggccttta

SEQ ID NO: 563058 - DNA, 25 bp, Homo sapien
aacggcctttacaaatggataccat

SEQ ID NO: 563059 - DNA, 25 bp, Homo sapien
gataccattgagcaggtgctttcgt

SEQ ID NO: 563060 - DNA, 25 bp, Homo sapien
tttcgttgccatctcactctgagag

SEQ ID NO: 563061 - DNA, 25 bp, Homo sapien
actctgagagcatacctggatgtcc

SEQ ID NO: 563062 - DNA, 25 bp, Homo sapien
ctgagtggccctttgtttaggtgat

SEQ ID NO: 563063 - DNA, 25 bp, Homo sapien
taggtgatgtcctcagacctggacc

SEQ ID NO: 563064 - DNA, 25 bp, Homo sapien
accagagatggctcacttcggatcg

SEQ ID NO: 563065 - DNA, 25 bp, Homo sapien
acttcggatcgagggttgactacat

SEQ ID NO: 563066 - DNA, 25 bp, Homo sapien
tcatcatctcacgaatctgctgtaa

SEQ ID NO: 563067 - DNA, 25 bp, Homo sapien
ttcagggcaggcctaacctgtgcta

SEQ ID NO: 563068 - DNA, 25 bp, Homo sapien
aggcctaacctgtgctagggcagca

SEQ ID NO: 563069 - DNA, 25 bp, Homo sapien
taacctgtgctagggcagcatgatg

SEQ ID NO: 563070 - DNA, 25 bp, Homo sapien
gggcagcatgatgcctggtacagaa

SEQ ID NO: 563071 - DNA, 25 bp, Homo sapien
gtgtgtccccagttctggacactta

SEQ ID NO: 563072 - DNA, 25 bp, Homo sapien
tccccagttctggacacttattcag

SEQ ID NO: 563073 - DNA, 25 bp, Homo sapien
ctggacacttattcagcagacctgt

SEQ ID NO: 563074 - DNA, 25 bp, Homo sapien
gcagacctgtaagttttgctggcca

SEQ ID NO: 563075 - DNA, 25 bp, Homo sapien
gacctgtaagttttgctggccagcc

SEQ ID NO: 563076 - DNA, 25 bp, Homo sapien
gtaagttttgctggccagcctatct

SEQ ID NO: 563077 - DNA, 25 bp, Homo sapien
cagcctatctccctggctagactga

SEQ ID NO: 563078 - DNA, 25 bp, Homo sapien
gggctctacagtcagacagacccaa

SEQ ID NO: 563079 - DNA, 25 bp, Homo sapien
gtcagacagacccaacttcaaatct

SEQ ID NO: 563080 - DNA, 25 bp, Homo sapien
aaatcttaccttgcaccttagttag

SEQ ID NO: 563081 - DNA, 25 bp, Homo sapien
gttagatctgcgtgatgtgcaacaa

SEQ ID NO: 563082 - DNA, 25 bp, Homo sapien
aatgcatttagcttcttggagtctt

SEQ ID NO: 563083 - DNA, 25 bp, Homo sapien
aaacatgtcagctgtcattcaaatg

SEQ ID NO: 563084 - DNA, 25 bp, Homo sapien
aatgtcactacaatggccttttttc

SEQ ID NO: 563085 - DNA, 25 bp, Homo sapien
ggccttttttcaagtgtgatccact

SEQ ID NO: 563086 - DNA, 25 bp, Homo sapien
gatccacttgcaccaaaattacctg

SEQ ID NO: 563087 - DNA, 25 bp, Homo sapien
attacctgaggtgcttgtgacaagg

SEQ ID NO: 563088 - DNA, 25 bp, Homo sapien
tacagattcagtctccacggaaggt

SEQ ID NO: 563089 - DNA, 25 bp, Homo sapien
gcaaaagtggtgtctttttcctgca

SEQ ID NO: 563090 - DNA, 25 bp, Homo sapien
aaaagtggtgtctttttcctgcaga

SEQ ID NO: 563091 - DNA, 25 bp, Homo sapien
aaagtggtgtctttttcctgcagat

SEQ ID NO: 563092 - DNA, 25 bp, Homo sapien
agtggtgtctttttcctgcagatgg

SEQ ID NO: 563093 - DNA, 25 bp, Homo sapien
tggtgtctttttcctgcagatggac

SEQ ID NO: 563094 - DNA, 25 bp, Homo sapien
gtgtctttttcctgcagatggaccc

SEQ ID NO: 563095 - DNA, 25 bp, Homo sapien
gtctttttcctgcagatggaccctc

SEQ ID NO: 563096 - DNA, 25 bp, Homo sapien
tttttcctgcagatggaccctccct

SEQ ID NO: 563097 - DNA, 25 bp, Homo sapien
tgcagatggaccctccctgatacag

SEQ ID NO: 563098 - DNA, 25 bp, Homo sapien
cagatggaccctccctgatacagga

SEQ ID NO: 563099 - DNA, 25 bp, Homo sapien
atggaccctccctgatacaggagga

SEQ ID NO: 563100 - DNA, 25 bp, Homo sapien
taccaggcagagaactgaagtactg

SEQ ID NO: 563101 - DNA, 25 bp, Homo sapien
agaactgaagtactggggcctcctc

SEQ ID NO: 563102 - DNA, 25 bp, Homo sapien
tcctccactgggtccgaatcagtag

SEQ ID NO: 563103 - DNA, 25 bp, Homo sapien
gtccgaatcagtaggtgaccccgcc

SEQ ID NO: 563104 - DNA, 25 bp, Homo sapien
atcagtaggtgaccccgcccctgga

SEQ ID NO: 563105 - DNA, 25 bp, Homo sapien
gagattcccagttaaaaggctccag

SEQ ID NO: 563106 - DNA, 25 bp, Homo sapien
gattcccagttaaaaggctccagaa

SEQ ID NO: 563107 - DNA, 25 bp, Homo sapien
aaaggctccagaatcgtgtaccagg

SEQ ID NO: 563108 - DNA, 25 bp, Homo sapien
ggctccagaatcgtgtaccaggcag

SEQ ID NO: 563109 - DNA, 25 bp, Homo sapien
tccagaatcgtgtaccaggcagaga

SEQ ID NO: 563110 - DNA, 25 bp, Homo sapien
aatcgtgtaccaggcagagaactga

SEQ ID NO: 563111 - DNA, 25 bp, Homo sapien
aagacagttgattatgggacggaag

SEQ ID NO: 563112 - DNA, 25 bp, Homo sapien
agagagctaagccagcccttgggat

SEQ ID NO: 563113 - DNA, 25 bp, Homo sapien
gccagcccttgggatgactacaaga

SEQ ID NO: 563114 - DNA, 25 bp, Homo sapien
gaggctgaaatctactgatatgtac

SEQ ID NO: 563115 - DNA, 25 bp, Homo sapien
ggctgaaatctactgatatgtacac

SEQ ID NO: 563116 - DNA, 25 bp, Homo sapien
gaaatctactgatatgtacacctcc

SEQ ID NO: 563117 - DNA, 25 bp, Homo sapien
ctactgatatgtacacctccaagga

SEQ ID NO: 563118 - DNA, 25 bp, Homo sapien
acacctccaaggacacatgtgtcac

SEQ ID NO: 563119 - DNA, 25 bp, Homo sapien
catgtgtcacatcagaatagttgct

SEQ ID NO: 563120 - DNA, 25 bp, Homo sapien
aatagttgctgaatcccactgggcc

SEQ ID NO: 563121 - DNA, 25 bp, Homo sapien
aatgggaataataaagctcctactt

SEQ ID NO: 563122 - DNA, 25 bp, Homo sapien
gaagttgcagtcaagttttcagttg

SEQ ID NO: 563123 - DNA, 25 bp, Homo sapien
gttttcagttgaggctatagtcatc

SEQ ID NO: 563124 - DNA, 25 bp, Homo sapien
aggctatagtcatctgaaggtctga

SEQ ID NO: 563125 - DNA, 25 bp, Homo sapien
aggctggaagatctgcttgcaagat

SEQ ID NO: 563126 - DNA, 25 bp, Homo sapien
tctgcttgcaagatgactcactcac

SEQ ID NO: 563127 - DNA, 25 bp, Homo sapien
gactcactcacatggctaacaagtt

SEQ ID NO: 563128 - DNA, 25 bp, Homo sapien
catggctaacaagttggtcctagtt

SEQ ID NO: 563129 - DNA, 25 bp, Homo sapien
ttctcaactggctgcttaagtgtcc

SEQ ID NO: 563130 - DNA, 25 bp, Homo sapien
aactggctgcttaagtgtcctcaca

SEQ ID NO: 563131 - DNA, 25 bp, Homo sapien
agtgtcctcacacttggtgactggc

SEQ ID NO: 563132 - DNA, 25 bp, Homo sapien
acacttggtgactggcttccctcag

SEQ ID NO: 563133 - DNA, 25 bp, Homo sapien
ttctctcatgtcctctgtgctttct

SEQ ID NO: 563134 - DNA, 25 bp, Homo sapien
ctctcatgtcctctgtgctttcttc

SEQ ID NO: 563135 - DNA, 25 bp, Homo sapien
tgtggccttggcagaacccactttt

SEQ ID NO: 563136 - DNA, 25 bp, Homo sapien
ggccttggcagaacccacttttcta

SEQ ID NO: 563137 - DNA, 25 bp, Homo sapien
cttggcagaacccacttttctacct

SEQ ID NO: 563138 - DNA, 25 bp, Homo sapien
tggcagaacccacttttctacctct

SEQ ID NO: 563139 - DNA, 25 bp, Homo sapien
ttttctacctctcccaagtgccagg

SEQ ID NO: 563140 - DNA, 25 bp, Homo sapien
agggggcttcttcctctcctacatt

SEQ ID NO: 563141 - DNA, 25 bp, Homo sapien
ctgtccccctcaactaagtgggtgt

SEQ ID NO: 563142 - DNA, 25 bp, Homo sapien
cctcaactaagtgggtgtcacctgg

SEQ ID NO: 563143 - DNA, 25 bp, Homo sapien
caactaagtgggtgtcacctggtgg

SEQ ID NO: 563144 - DNA, 25 bp, Homo sapien
ttgatgcattggaaggccacacccc

SEQ ID NO: 563145 - DNA, 25 bp, Homo sapien
tgatgcattggaaggccacacccct

SEQ ID NO: 563146 - DNA, 25 bp, Homo sapien
gatgcattggaaggccacacccctc

SEQ ID NO: 563147 - DNA, 25 bp, Homo sapien
atgcattggaaggccacacccctcc

SEQ ID NO: 563148 - DNA, 25 bp, Homo sapien
tgcattggaaggccacacccctcct

SEQ ID NO: 563149 - DNA, 25 bp, Homo sapien
gcattggaaggccacacccctcctc

SEQ ID NO: 563150 - DNA, 25 bp, Homo sapien
cattggaaggccacacccctcctct

SEQ ID NO: 563151 - DNA, 25 bp, Homo sapien
attggaaggccacacccctcctcta

SEQ ID NO: 563152 - DNA, 25 bp, Homo sapien
ttggaaggccacacccctcctctag

SEQ ID NO: 563153 - DNA, 25 bp, Homo sapien
tggaaggccacacccctcctctagg

SEQ ID NO: 563154 - DNA, 25 bp, Homo sapien
agatgtcactttgcgtcctcagagg

SEQ ID NO: 563155 - DNA, 25 bp, Homo sapien
atggccggcttgtctggaggccctt

SEQ ID NO: 563156 - DNA, 25 bp, Homo sapien
ctggaggcccttggagatctaggat

SEQ ID NO: 563157 - DNA, 25 bp, Homo sapien
gaaactcaagattcagcatcctaga

SEQ ID NO: 563158 - DNA, 25 bp, Homo sapien
agcatcctagaattgtctctggcaa

SEQ ID NO: 563159 - DNA, 25 bp, Homo sapien
aattgtctctggcaagttggtttcc

SEQ ID NO: 563160 - DNA, 25 bp, Homo sapien
agttggtttccagccatagtgagtg

SEQ ID NO: 563161 - DNA, 25 bp, Homo sapien
atagtgagtgggaacaatggcccca

SEQ ID NO: 563162 - DNA, 25 bp, Homo sapien
aacaatggccccagaggctgtgtgg

SEQ ID NO: 563163 - DNA, 25 bp, Homo sapien
cccagaggctgtgtggcagtttaaa

SEQ ID NO: 563164 - DNA, 25 bp, Homo sapien
gtggcagtttaaacacagtttccac

SEQ ID NO: 563165 - DNA, 25 bp, Homo sapien
gggaggactggtatctttactaaat

SEQ ID NO: 563166 - DNA, 25 bp, Homo sapien
tatctttactaaatcttctaaccca

SEQ ID NO: 563167 - DNA, 25 bp, Homo sapien
tcttctaacccataaacatgatatt

SEQ ID NO: 563168 - DNA, 25 bp, Homo sapien
atttaggtcttcttgtctttcacca

SEQ ID NO: 563169 - DNA, 25 bp, Homo sapien
tcttgtctttcaccaacattttgta

SEQ ID NO: 563170 - DNA, 25 bp, Homo sapien
gtaattttcaacatgtagattctat

SEQ ID NO: 563171 - DNA, 25 bp, Homo sapien
acaattttgttgagattatgtcatc

SEQ ID NO: 563172 - DNA, 25 bp, Homo sapien
tcaaaatcgttttggctgtttaagg

SEQ ID NO: 563173 - DNA, 25 bp, Homo sapien
aagtacatacttctgtgaaatacct

SEQ ID NO: 563174 - DNA, 25 bp, Homo sapien
gtgaaataccttactaagcttctga

SEQ ID NO: 563175 - DNA, 25 bp, Homo sapien
accttactaagcttctgataggaaa

SEQ ID NO: 563176 - DNA, 25 bp, Homo sapien
agtcattcctgacattctgatcagc

SEQ ID NO: 563177 - DNA, 25 bp, Homo sapien
aacagtcttaacttgtttacaagat

SEQ ID NO: 563178 - DNA, 25 bp, Homo sapien
tttgcttttagctatgaacggatcg

SEQ ID NO: 563179 - DNA, 25 bp, Homo sapien
gaacggatcgtaattccacccagaa

SEQ ID NO: 563180 - DNA, 25 bp, Homo sapien
gtaattccacccagaatgtaatgtt

SEQ ID NO: 563181 - DNA, 25 bp, Homo sapien
ttttttctcaactttaacacacagt

SEQ ID NO: 563182 - DNA, 25 bp, Homo sapien
aacacacagttcaactgttcctagt

SEQ ID NO: 563183 - DNA, 25 bp, Homo sapien
tgaggcttttttcagtatctcgaag

SEQ ID NO: 563184 - DNA, 25 bp, Homo sapien
gtatctcgaagtccaaatgccaaag

SEQ ID NO: 563185 - DNA, 25 bp, Homo sapien
atgccaaaggaacctcacacactgt

SEQ ID NO: 563186 - DNA, 25 bp, Homo sapien
ggaacctcacacactgtttgtaatg

SEQ ID NO: 563187 - DNA, 25 bp, Homo sapien
atgcccagatgaagatatcagagaa

SEQ ID NO: 563188 - DNA, 25 bp, Homo sapien
agaagcaattggagatgtgggtcta

SEQ ID NO: 563189 - DNA, 25 bp, Homo sapien
aattggagatgtgggtctagagtct

SEQ ID NO: 563190 - DNA, 25 bp, Homo sapien
gacataactacagaagtcatcactg

SEQ ID NO: 563191 - DNA, 25 bp, Homo sapien
aagtcatcactgaaatcatgggaag

SEQ ID NO: 563192 - DNA, 25 bp, Homo sapien
atcatgggaagggtctgtagggaaa

SEQ ID NO: 563193 - DNA, 25 bp, Homo sapien
actgggagaaaaccctgaggaagct

SEQ ID NO: 563194 - DNA, 25 bp, Homo sapien
agaaaaccctgaggaagctctgtca

SEQ ID NO: 563195 - DNA, 25 bp, Homo sapien
aggaagctctgtcaggcaaaaagat

SEQ ID NO: 563196 - DNA, 25 bp, Homo sapien
agctctgtcaggcaaaaagattaca

SEQ ID NO: 563197 - DNA, 25 bp, Homo sapien
tgcagggcgggtgtggtgggtcaca

SEQ ID NO: 563198 - DNA, 25 bp, Homo sapien
aatctcaaattgtgacttgcagtgg

SEQ ID NO: 563199 - DNA, 25 bp, Homo sapien
atctcaaattgtgacttgcagtgga

SEQ ID NO: 563200 - DNA, 25 bp, Homo sapien
tctcaaattgtgacttgcagtggag

SEQ ID NO: 563201 - DNA, 25 bp, Homo sapien
tcaaattgtgacttgcagtggaggt

SEQ ID NO: 563202 - DNA, 25 bp, Homo sapien
caaattgtgacttgcagtggaggtg

SEQ ID NO: 563203 - DNA, 25 bp, Homo sapien
ggaggtggaattcaattattattaa

SEQ ID NO: 563204 - DNA, 25 bp, Homo sapien
ttaagaatgtaggtcaatgtttcat

SEQ ID NO: 563205 - DNA, 25 bp, Homo sapien
aagatgaaaactaagcccacgaagc

SEQ ID NO: 563206 - DNA, 25 bp, Homo sapien
gatgaaaactaagcccacgaagctt

SEQ ID NO: 563207 - DNA, 25 bp, Homo sapien
gaaaactaagcccacgaagcttgag

SEQ ID NO: 563208 - DNA, 25 bp, Homo sapien
aaaactaagcccacgaagcttgagt

SEQ ID NO: 563209 - DNA, 25 bp, Homo sapien
gacagtgctgccttataccacctca

SEQ ID NO: 563210 - DNA, 25 bp, Homo sapien
ttataccacctcactactctggaga

SEQ ID NO: 563211 - DNA, 25 bp, Homo sapien
actactctggagaccctgtttctga

SEQ ID NO: 563212 - DNA, 25 bp, Homo sapien
ctggagaccctgtttctgagtggaa

SEQ ID NO: 563213 - DNA, 25 bp, Homo sapien
cctgtttctgagtggaaacccctgg

SEQ ID NO: 563214 - DNA, 25 bp, Homo sapien
ggaaacccctggaagtgcaactgct

SEQ ID NO: 563215 - DNA, 25 bp, Homo sapien
aagtgcaactgctctttcctggact

SEQ ID NO: 563216 - DNA, 25 bp, Homo sapien
tggacttcgccatcttcttaatagt

SEQ ID NO: 563217 - DNA, 25 bp, Homo sapien
ttcttaatagtgttccatatggacc

SEQ ID NO: 563218 - DNA, 25 bp, Homo sapien
catatggacccctcagatgatctaa

SEQ ID NO: 563219 - DNA, 25 bp, Homo sapien
ctcagatgatctaaatgccacatgt

SEQ ID NO: 563220 - DNA, 25 bp, Homo sapien
aagccacagtcttctctagtacaat

SEQ ID NO: 563221 - DNA, 25 bp, Homo sapien
agtcttctctagtacaattcaggga

SEQ ID NO: 563222 - DNA, 25 bp, Homo sapien
gtacaattcagggaagccagacagg

SEQ ID NO: 563223 - DNA, 25 bp, Homo sapien
caggttgtggagagctttacaggca

SEQ ID NO: 563224 - DNA, 25 bp, Homo sapien
gggcagcccctgctaagaaagacaa

SEQ ID NO: 563225 - DNA, 25 bp, Homo sapien
gagaacacagaaatcctagggacac

SEQ ID NO: 563226 - DNA, 25 bp, Homo sapien
atcctagggacacatcacgaattct

SEQ ID NO: 563227 - DNA, 25 bp, Homo sapien
gacacatcacgaattctggatccga

SEQ ID NO: 563228 - DNA, 25 bp, Homo sapien
ttctggatccgatacgtaacgcgtc

SEQ ID NO: 563229 - DNA, 25 bp, Homo sapien
gatacgtaacgcgtctgcagcatgc

SEQ ID NO: 563230 - DNA, 25 bp, Homo sapien
taacgcgtctgcagcatgcgtggta

SEQ ID NO: 563231 - DNA, 25 bp, Homo sapien
ccaggaacctgacccagccaggctg

SEQ ID NO: 563232 - DNA, 25 bp, Homo sapien
tctctcatccctccagctggtctct

SEQ ID NO: 563233 - DNA, 25 bp, Homo sapien
cagctggtctctcactgccttcgag

SEQ ID NO: 563234 - DNA, 25 bp, Homo sapien
agctggtctctcactgccttcgagc

SEQ ID NO: 563235 - DNA, 25 bp, Homo sapien
gctggtctctcactgccttcgagcc

SEQ ID NO: 563236 - DNA, 25 bp, Homo sapien
ctggtctctcactgccttcgagccc

SEQ ID NO: 563237 - DNA, 25 bp, Homo sapien
tggtctctcactgccttcgagcccc

SEQ ID NO: 563238 - DNA, 25 bp, Homo sapien
gtctctcactgccttcgagccccat

SEQ ID NO: 563239 - DNA, 25 bp, Homo sapien
tctcactgccttcgagccccatcac

SEQ ID NO: 563240 - DNA, 25 bp, Homo sapien
cttcgagccccatcacctgctcggg

SEQ ID NO: 563241 - DNA, 25 bp, Homo sapien
ttcgagccccatcacctgctcgggc

SEQ ID NO: 563242 - DNA, 25 bp, Homo sapien
aaacatcagtgccagcttgcctcca

SEQ ID NO: 563243 - DNA, 25 bp, Homo sapien
gcctccatccttttcacatattatg

SEQ ID NO: 563244 - DNA, 25 bp, Homo sapien
cacatattatgcaggccaattgaca

SEQ ID NO: 563245 - DNA, 25 bp, Homo sapien
ttttcccactcttgcctctttgtgc

SEQ ID NO: 563246 - DNA, 25 bp, Homo sapien
ttgtgctgctgtttcgtatcctcct

SEQ ID NO: 563247 - DNA, 25 bp, Homo sapien
gtatcctcctcacaccgtgtatttc

SEQ ID NO: 563248 - DNA, 25 bp, Homo sapien
cgtgtatttcccacccactcagggt

SEQ ID NO: 563249 - DNA, 25 bp, Homo sapien
cactcagggtcacagcctactaatt

SEQ ID NO: 563250 - DNA, 25 bp, Homo sapien
ggtcacagcctactaattcctcaaa

SEQ ID NO: 563251 - DNA, 25 bp, Homo sapien
cagcctactaattcctcaaacttct

SEQ ID NO: 563252 - DNA, 25 bp, Homo sapien
aaacttctctccctggactaggaga

SEQ ID NO: 563253 - DNA, 25 bp, Homo sapien
ctcaatgtatagtcggaaagcagcc

SEQ ID NO: 563254 - DNA, 25 bp, Homo sapien
gaaagcagccgaagaagtgaagcga

SEQ ID NO: 563255 - DNA, 25 bp, Homo sapien
aaagtgaactattacattctagaag

SEQ ID NO: 563256 - DNA, 25 bp, Homo sapien
cattctagaagagtcatggtgtgta

SEQ ID NO: 563257 - DNA, 25 bp, Homo sapien
gtgtgtaagaagatccaagcctggt

SEQ ID NO: 563258 - DNA, 25 bp, Homo sapien
cagtatgcctgaaatttgggatgta

SEQ ID NO: 563259 - DNA, 25 bp, Homo sapien
gatgtagaagatcctgccaatgctg

SEQ ID NO: 563260 - DNA, 25 bp, Homo sapien
gatcctgccaatgctgggaaaactc

SEQ ID NO: 563261 - DNA, 25 bp, Homo sapien
gaaaactcccttatgtaacctcttg

SEQ ID NO: 563262 - DNA, 25 bp, Homo sapien
actcccttatgtaacctcttggtga

SEQ ID NO: 563263 - DNA, 25 bp, Homo sapien
tggtgaaggattccaaacctcactt

SEQ ID NO: 563264 - DNA, 25 bp, Homo sapien
caggagaatggtgcggagcttgcag

SEQ ID NO: 563265 - DNA, 25 bp, Homo sapien
ggtggaggtttcattgagccacgac

SEQ ID NO: 563266 - DNA, 25 bp, Homo sapien
ggaggtttcattgagccacgacagt

SEQ ID NO: 563267 - DNA, 25 bp, Homo sapien
gaggtttcattgagccacgacagtg

SEQ ID NO: 563268 - DNA, 25 bp, Homo sapien
aggtttcattgagccacgacagtgc

SEQ ID NO: 563269 - DNA, 25 bp, Homo sapien
gtttcattgagccacgacagtgcat

SEQ ID NO: 563270 - DNA, 25 bp, Homo sapien
tttcattgagccacgacagtgcatg

SEQ ID NO: 563271 - DNA, 25 bp, Homo sapien
tcattgagccacgacagtgcatgca

SEQ ID NO: 563272 - DNA, 25 bp, Homo sapien
attgagccacgacagtgcatgcact

SEQ ID NO: 563273 - DNA, 25 bp, Homo sapien
ttgagccacgacagtgcatgcactc

SEQ ID NO: 563274 - DNA, 25 bp, Homo sapien
gagccacgacagtgcatgcactcca

SEQ ID NO: 563275 - DNA, 25 bp, Homo sapien
gaaatccaggagtgtcccatagctc

SEQ ID NO: 563276 - DNA, 25 bp, Homo sapien
agtgtcccatagctcaagaatccct

SEQ ID NO: 563277 - DNA, 25 bp, Homo sapien
tagctcaagaatccctggaatccca

SEQ ID NO: 563278 - DNA, 25 bp, Homo sapien
catggtgggtcatcaggtgagcttc

SEQ ID NO: 563279 - DNA, 25 bp, Homo sapien
tgagcttcacgttgcacgagggtgt

SEQ ID NO: 563280 - DNA, 25 bp, Homo sapien
actttggagccaccgacctggatgt

SEQ ID NO: 563281 - DNA, 25 bp, Homo sapien
atgtggccaacttctacgtgtcaca

SEQ ID NO: 563282 - DNA, 25 bp, Homo sapien
aacttctacgtgtcacagctgcaga

SEQ ID NO: 563283 - DNA, 25 bp, Homo sapien
gtcacagctgcagactcccataggt

SEQ ID NO: 563284 - DNA, 25 bp, Homo sapien
aggcgctgctccgatgtagtgacat

SEQ ID NO: 563285 - DNA, 25 bp, Homo sapien
attatttcatataccttcaagccat

SEQ ID NO: 563286 - DNA, 25 bp, Homo sapien
tttctttatttgagtgtaagtgctg

SEQ ID NO: 563287 - DNA, 25 bp, Homo sapien
ttatttgagtgtaagtgctgtgggt

SEQ ID NO: 563288 - DNA, 25 bp, Homo sapien
gggcccgaatgccttgcatgtttca

SEQ ID NO: 563289 - DNA, 25 bp, Homo sapien
ggcccgaatgccttgcatgtttcat

SEQ ID NO: 563290 - DNA, 25 bp, Homo sapien
gcccgaatgccttgcatgtttcatc

SEQ ID NO: 563291 - DNA, 25 bp, Homo sapien
gaatgccttgcatgtttcatctcag

SEQ ID NO: 563292 - DNA, 25 bp, Homo sapien
aatgccttgcatgtttcatctcagc

SEQ ID NO: 563293 - DNA, 25 bp, Homo sapien
gcccaaacctgaagtgggccttcat

SEQ ID NO: 563294 - DNA, 25 bp, Homo sapien
caaacctgaagtgggccttcattta

SEQ ID NO: 563295 - DNA, 25 bp, Homo sapien
gaagtgggccttcatttaagtattt

SEQ ID NO: 563296 - DNA, 25 bp, Homo sapien
gtgggccttcatttaagtatttggg

SEQ ID NO: 563297 - DNA, 25 bp, Homo sapien
tagatcatagcaaattatcttctca

SEQ ID NO: 563298 - DNA, 25 bp, Homo sapien
tatcttctcaaaaggctgtatcatt

SEQ ID NO: 563299 - DNA, 25 bp, Homo sapien
atattcccaccaacatacttgttta

SEQ ID NO: 563300 - DNA, 25 bp, Homo sapien
cccaccaacatacttgtttactctt

SEQ ID NO: 563301 - DNA, 25 bp, Homo sapien
actctttcttgccaacattggatat

SEQ ID NO: 563302 - DNA, 25 bp, Homo sapien
gccaacattggatattatctctaat

SEQ ID NO: 563303 - DNA, 25 bp, Homo sapien
atctctaatattttacaagtctgta

SEQ ID NO: 563304 - DNA, 25 bp, Homo sapien
agtgatgttagtataccaaatgagc

SEQ ID NO: 563305 - DNA, 25 bp, Homo sapien
ttagcttatccaatcttgctcatac

SEQ ID NO: 563306 - DNA, 25 bp, Homo sapien
tatccaatcttgctcatactcactt

SEQ ID NO: 563307 - DNA, 25 bp, Homo sapien
tgctcatactcacttgctcaagaag

SEQ ID NO: 563308 - DNA, 25 bp, Homo sapien
tattccacatagagacaagactttt

SEQ ID NO: 563309 - DNA, 25 bp, Homo sapien
gacaagacttttgaattactttctc

SEQ ID NO: 563310 - DNA, 25 bp, Homo sapien
gacttttgaattactttctctcttc

SEQ ID NO: 563311 - DNA, 25 bp, Homo sapien
cttccctttctcagaagtccactat

SEQ ID NO: 563312 - DNA, 25 bp, Homo sapien
cctttctcagaagtccactatcagt

SEQ ID NO: 563313 - DNA, 25 bp, Homo sapien
agaagtccactatcagtttctgacc

SEQ ID NO: 563314 - DNA, 25 bp, Homo sapien
aagtccactatcagtttctgacctc

SEQ ID NO: 563315 - DNA, 25 bp, Homo sapien
cactatcagtttctgacctccaaaa

SEQ ID NO: 563316 - DNA, 25 bp, Homo sapien
tatcagtttctgacctccaaaaact

SEQ ID NO: 563317 - DNA, 25 bp, Homo sapien
taaggaaactgattaactttgcaat

SEQ ID NO: 563318 - DNA, 25 bp, Homo sapien
gaaactgattaactttgcaatttat

SEQ ID NO: 563319 - DNA, 25 bp, Homo sapien
gagttacttgtcatcaccggagccc

SEQ ID NO: 563320 - DNA, 25 bp, Homo sapien
aacagtttggtgctattaataatta

SEQ ID NO: 563321 - DNA, 25 bp, Homo sapien
aataattacttccacaagagatagg

SEQ ID NO: 563322 - DNA, 25 bp, Homo sapien
gtttttaagtattctactggcatct

SEQ ID NO: 563323 - DNA, 25 bp, Homo sapien
ctactggcatcttcaaagtgtgata

SEQ ID NO: 563324 - DNA, 25 bp, Homo sapien
caaagtgtgatagaagcaaccactg

SEQ ID NO: 563325 - DNA, 25 bp, Homo sapien
gcaaccactgaaaagaatgtcctag

SEQ ID NO: 563326 - DNA, 25 bp, Homo sapien
aaaaacagcagcaaccagggtctct

SEQ ID NO: 563327 - DNA, 25 bp, Homo sapien
accagggtctctaagttcatatgta

SEQ ID NO: 563328 - DNA, 25 bp, Homo sapien
gatacttctacattgtcttataggc

SEQ ID NO: 563329 - DNA, 25 bp, Homo sapien
cattgtcttataggccaagtattag

SEQ ID NO: 563330 - DNA, 25 bp, Homo sapien
ctcttctgggtgctagggcaggaca

SEQ ID NO: 563331 - DNA, 25 bp, Homo sapien
tagggcaggacaggagccctaccct

SEQ ID NO: 563332 - DNA, 25 bp, Homo sapien
aggagccctaccctgaaggtctggt

SEQ ID NO: 563333 - DNA, 25 bp, Homo sapien
aaggtctggttctcagctcgtgtgc

SEQ ID NO: 563334 - DNA, 25 bp, Homo sapien
gttctcagctcgtgtgcgtgtgcgt

SEQ ID NO: 563335 - DNA, 25 bp, Homo sapien
ggaagtctggaataggttctctctg

SEQ ID NO: 563336 - DNA, 25 bp, Homo sapien
tctggaataggttctctctgactcc

SEQ ID NO: 563337 - DNA, 25 bp, Homo sapien
aataggttctctctgactcccgagt

SEQ ID NO: 563338 - DNA, 25 bp, Homo sapien
gactcccgagtcagtgccataacca

SEQ ID NO: 563339 - DNA, 25 bp, Homo sapien
tgccataaccactaagcctttgctg

SEQ ID NO: 563340 - DNA, 25 bp, Homo sapien
taaccactaagcctttgctgttctc

SEQ ID NO: 563341 - DNA, 25 bp, Homo sapien
gggacagatgcagactcagtgccat

SEQ ID NO: 563342 - DNA, 25 bp, Homo sapien
gatgcagactcagtgccatatgtca

SEQ ID NO: 563343 - DNA, 25 bp, Homo sapien
ccatatgtcaatcagcacggcttta

SEQ ID NO: 563344 - DNA, 25 bp, Homo sapien
acctattttgctgtggatgccagtt

SEQ ID NO: 563345 - DNA, 25 bp, Homo sapien
gtggatgccagttattctgccaagg

SEQ ID NO: 563346 - DNA, 25 bp, Homo sapien
atgggagaaagcacatgtacgttgt

SEQ ID NO: 563347 - DNA, 25 bp, Homo sapien
acatgtacgttgtgcgagtacttac

SEQ ID NO: 563348 - DNA, 25 bp, Homo sapien
gagtacttactggagtcttcacaaa

SEQ ID NO: 563349 - DNA, 25 bp, Homo sapien
gggacgtgcaggattagtcacccct

SEQ ID NO: 563350 - DNA, 25 bp, Homo sapien
aagaatcctcacaatcccacagatc

SEQ ID NO: 563351 - DNA, 25 bp, Homo sapien
acaatcccacagatctctttgactc

SEQ ID NO: 563352 - DNA, 25 bp, Homo sapien
actggtcctcccacgcctgacaccg

SEQ ID NO: 563353 - DNA, 25 bp, Homo sapien
ctggtcctcccacgcctgacaccga

SEQ ID NO: 563354 - DNA, 25 bp, Homo sapien
acgcctgacaccgacgtcgccagga

SEQ ID NO: 563355 - DNA, 25 bp, Homo sapien
cgcctgacaccgacgtcgccaggac

SEQ ID NO: 563356 - DNA, 25 bp, Homo sapien
gcctgacaccgacgtcgccaggacc

SEQ ID NO: 563357 - DNA, 25 bp, Homo sapien
cctgacaccgacgtcgccaggaccg

SEQ ID NO: 563358 - DNA, 25 bp, Homo sapien
ctgacaccgacgtcgccaggaccgc

SEQ ID NO: 563359 - DNA, 25 bp, Homo sapien
tgacaccgacgtcgccaggaccgcg

SEQ ID NO: 563360 - DNA, 25 bp, Homo sapien
gacaccgacgtcgccaggaccgcgg

SEQ ID NO: 563361 - DNA, 25 bp, Homo sapien
acaccgacgtcgccaggaccgcggg

SEQ ID NO: 563362 - DNA, 25 bp, Homo sapien
gacgtcgccaggaccgcggggttgg

SEQ ID NO: 563363 - DNA, 25 bp, Homo sapien
gagtgtgaactctattgtgaattgc

SEQ ID NO: 563364 - DNA, 25 bp, Homo sapien
gaactctattgtgaattgcacacac

SEQ ID NO: 563365 - DNA, 25 bp, Homo sapien
gtgaattgcacacacaagggatcta

SEQ ID NO: 563366 - DNA, 25 bp, Homo sapien
gaattgcacacacaagggatctagc

SEQ ID NO: 563367 - DNA, 25 bp, Homo sapien
gcacacacaagggatctagcacttc

SEQ ID NO: 563368 - DNA, 25 bp, Homo sapien
acacacaagggatctagcacttctt

SEQ ID NO: 563369 - DNA, 25 bp, Homo sapien
acacaagggatctagcacttcttat

SEQ ID NO: 563370 - DNA, 25 bp, Homo sapien
agggatctagcacttcttatgacaa

SEQ ID NO: 563371 - DNA, 25 bp, Homo sapien
gggatctagcacttcttatgacaat

SEQ ID NO: 563372 - DNA, 25 bp, Homo sapien
gatctagcacttcttatgacaatct

SEQ ID NO: 563373 - DNA, 25 bp, Homo sapien
tctagcacttcttatgacaatctaa

SEQ ID NO: 563374 - DNA, 25 bp, Homo sapien
gggccagagccttgataatctcatc

SEQ ID NO: 563375 - DNA, 25 bp, Homo sapien
gagccttgataatctcatcaaagtg

SEQ ID NO: 563376 - DNA, 25 bp, Homo sapien
tcatcaaagtgacccctgaagtaaa

SEQ ID NO: 563377 - DNA, 25 bp, Homo sapien
gtgacccctgaagtaaagagaagta

SEQ ID NO: 563378 - DNA, 25 bp, Homo sapien
gttccaaagaccttaataacttcat

SEQ ID NO: 563379 - DNA, 25 bp, Homo sapien
taacttcatcaaagtgtatccagga

SEQ ID NO: 563380 - DNA, 25 bp, Homo sapien
tcatcaaagtgtatccaggaacaga

SEQ ID NO: 563381 - DNA, 25 bp, Homo sapien
caaagtctcgacagcctcattaaag

SEQ ID NO: 563382 - DNA, 25 bp, Homo sapien
agtctcgacagcctcattaaagtga

SEQ ID NO: 563383 - DNA, 25 bp, Homo sapien
ctcgacagcctcattaaagtgactc

SEQ ID NO: 563384 - DNA, 25 bp, Homo sapien
accaagacttggaaaatcttatcaa

SEQ ID NO: 563385 - DNA, 25 bp, Homo sapien
tcttgtcttcttgtattgtgtagaa

SEQ ID NO: 563386 - DNA, 25 bp, Homo sapien
tcttgtattgtgtagaacctccaaa

SEQ ID NO: 563387 - DNA, 25 bp, Homo sapien
gtattgtgtagaacctccaaaataa

SEQ ID NO: 563388 - DNA, 25 bp, Homo sapien
gtgtagaacctccaaaataataatg

SEQ ID NO: 563389 - DNA, 25 bp, Homo sapien
cccagacgttgaatagtaagtagaa

SEQ ID NO: 563390 - DNA, 25 bp, Homo sapien
agagctgtcagttttgtcttgtatc

SEQ ID NO: 563391 - DNA, 25 bp, Homo sapien
agctgtcagttttgtcttgtatcca

SEQ ID NO: 563392 - DNA, 25 bp, Homo sapien
ttgtcttgtatccaacttgccaaat

SEQ ID NO: 563393 - DNA, 25 bp, Homo sapien
ccaacttgccaaattatcttaagta

SEQ ID NO: 563394 - DNA, 25 bp, Homo sapien
attatcttaagtatcacaatattga

SEQ ID NO: 563395 - DNA, 25 bp, Homo sapien
attgaatgatgttactttgatttta

SEQ ID NO: 563396 - DNA, 25 bp, Homo sapien
agaattacctcagcctgacaacatt

SEQ ID NO: 563397 - DNA, 25 bp, Homo sapien
tgacaacattttatctcgtgcgcca

SEQ ID NO: 563398 - DNA, 25 bp, Homo sapien
caacattttatctcgtgcgccactt

SEQ ID NO: 563399 - DNA, 25 bp, Homo sapien
attttatctcgtgcgccacttcggg

SEQ ID NO: 563400 - DNA, 25 bp, Homo sapien
tcgtgcgccacttcgggatccgagt

SEQ ID NO: 563401 - DNA, 25 bp, Homo sapien
ccgagtggagccgaaagtcgagata

SEQ ID NO: 563402 - DNA, 25 bp, Homo sapien
ccgaaagtcgagatagagcgcagtt

SEQ ID NO: 563403 - DNA, 25 bp, Homo sapien
tagagcgcagttgggccttgggttc

SEQ ID NO: 563404 - DNA, 25 bp, Homo sapien
gaaattctgcggaatagaagtcttt

SEQ ID NO: 563405 - DNA, 25 bp, Homo sapien
ttaagaaatgagatcgtgcccttta

SEQ ID NO: 563406 - DNA, 25 bp, Homo sapien
aaatgagatcgtgccctttaaaact

SEQ ID NO: 563407 - DNA, 25 bp, Homo sapien
agacaagaatttgatgtaacgcaaa

SEQ ID NO: 563408 - DNA, 25 bp, Homo sapien
gtaacgcaaatggaaaaactcgaca

SEQ ID NO: 563409 - DNA, 25 bp, Homo sapien
aaaaactcgacaccacatttcaggc

SEQ ID NO: 563410 - DNA, 25 bp, Homo sapien
actcgacaccacatttcaggcttta

SEQ ID NO: 563411 - DNA, 25 bp, Homo sapien
atttcaggctttacccaacatcgaa

SEQ ID NO: 563412 - DNA, 25 bp, Homo sapien
aggctttacccaacatcgaaataat

SEQ ID NO: 563413 - DNA, 25 bp, Homo sapien
attgttaatacatagtcccaatctt

SEQ ID NO: 563414 - DNA, 25 bp, Homo sapien
cattgcacaaaaatctagggttgac

SEQ ID NO: 563415 - DNA, 25 bp, Homo sapien
tctagggttgacttggtaaatgcag

SEQ ID NO: 563416 - DNA, 25 bp, Homo sapien
aatgcagtgacattttctcatggag

SEQ ID NO: 563417 - DNA, 25 bp, Homo sapien
atgtattctaagtaggtacgtttat

SEQ ID NO: 563418 - DNA, 25 bp, Homo sapien
gtagaataccttcaggccaggcgcg

SEQ ID NO: 563419 - DNA, 25 bp, Homo sapien
tagaataccttcaggccaggcgcgg

SEQ ID NO: 563420 - DNA, 25 bp, Homo sapien
agaataccttcaggccaggcgcggt

SEQ ID NO: 563421 - DNA, 25 bp, Homo sapien
gaataccttcaggccaggcgcggtg

SEQ ID NO: 563422 - DNA, 25 bp, Homo sapien
aataccttcaggccaggcgcggtgg

SEQ ID NO: 563423 - DNA, 25 bp, Homo sapien
attgcactccatcctggacaacagg

SEQ ID NO: 563424 - DNA, 25 bp, Homo sapien
ttgcactccatcctggacaacagga

SEQ ID NO: 563425 - DNA, 25 bp, Homo sapien
tgcactccatcctggacaacaggag

SEQ ID NO: 563426 - DNA, 25 bp, Homo sapien
cactccatcctggacaacaggagtg

SEQ ID NO: 563427 - DNA, 25 bp, Homo sapien
ctccatcctggacaacaggagtgaa

SEQ ID NO: 563428 - DNA, 25 bp, Homo sapien
tccatcctggacaacaggagtgaaa

SEQ ID NO: 563429 - DNA, 25 bp, Homo sapien
gagtgtgaactctattgtgaattgc

SEQ ID NO: 563430 - DNA, 25 bp, Homo sapien
gaactctattgtgaattgcacacac

SEQ ID NO: 563431 - DNA, 25 bp, Homo sapien
gtgaattgcacacacaagggatcta

SEQ ID NO: 563432 - DNA, 25 bp, Homo sapien
gaattgcacacacaagggatctagc

SEQ ID NO: 563433 - DNA, 25 bp, Homo sapien
gcacacacaagggatctagcacttc

SEQ ID NO: 563434 - DNA, 25 bp, Homo sapien
acacaagggatctagcacttcttat

SEQ ID NO: 563435 - DNA, 25 bp, Homo sapien
agggatctagcacttcttatgacaa

SEQ ID NO: 563436 - DNA, 25 bp, Homo sapien
ggatctagcacttcttatgacaatc

SEQ ID NO: 563437 - DNA, 25 bp, Homo sapien
tctagcacttcttatgacaatctaa

SEQ ID NO: 563438 - DNA, 25 bp, Homo sapien
caagttcagggctcctactgattgt

SEQ ID NO: 563439 - DNA, 25 bp, Homo sapien
ttcagggctcctactgattgtacat

SEQ ID NO: 563440 - DNA, 25 bp, Homo sapien
agtttttgcttactcacatggcata

SEQ ID NO: 563441 - DNA, 25 bp, Homo sapien
ttttgcttactcacatggcataatg

SEQ ID NO: 563442 - DNA, 25 bp, Homo sapien
tgcttactcacatggcataatgggt

SEQ ID NO: 563443 - DNA, 25 bp, Homo sapien
cacatggcataatgggtgctttcaa

SEQ ID NO: 563444 - DNA, 25 bp, Homo sapien
cataatgggtgctttcaataatttc

SEQ ID NO: 563445 - DNA, 25 bp, Homo sapien
ttctcactaccaccttgacatgagc

SEQ ID NO: 563446 - DNA, 25 bp, Homo sapien
tcactaccaccttgacatgagcaag

SEQ ID NO: 563447 - DNA, 25 bp, Homo sapien
ttaatctctctaacctttgtttctc

SEQ ID NO: 563448 - DNA, 25 bp, Homo sapien
gtgggaatgataatacgaacctacc

SEQ ID NO: 563449 - DNA, 25 bp, Homo sapien
gaatgataatacgaacctaccctta

SEQ ID NO: 563450 - DNA, 25 bp, Homo sapien
gagatgacttgtttatcatgatcat

SEQ ID NO: 563451 - DNA, 25 bp, Homo sapien
gttccttcaagggtcatatcaatga

SEQ ID NO: 563452 - DNA, 25 bp, Homo sapien
ccttcaagggtcatatcaatgaaaa

SEQ ID NO: 563453 - DNA, 25 bp, Homo sapien
ttgtaggcctggcttccaatggaga

SEQ ID NO: 563454 - DNA, 25 bp, Homo sapien
tgtaggcctggcttccaatggagat

SEQ ID NO: 563455 - DNA, 25 bp, Homo sapien
aggcctggcttccaatggagattat

SEQ ID NO: 563456 - DNA, 25 bp, Homo sapien
cttgtggaagtgaaaataactctct

SEQ ID NO: 563457 - DNA, 25 bp, Homo sapien
ttgatacagtcaaaagtgttctcga

SEQ ID NO: 563458 - DNA, 25 bp, Homo sapien
agtgttctcgacaaagaccgaaaag

SEQ ID NO: 563459 - DNA, 25 bp, Homo sapien
gctgattgctgctaacagtcagggt

SEQ ID NO: 563460 - DNA, 25 bp, Homo sapien
gctgctaacagtcagggtacaatta

SEQ ID NO: 563461 - DNA, 25 bp, Homo sapien
gtcagggtacaattaaggtgctaga

SEQ ID NO: 563462 - DNA, 25 bp, Homo sapien
gtcatgagtcatgctgtggtccaga

SEQ ID NO: 563463 - DNA, 25 bp, Homo sapien
atagcagatggccaactgggacact

SEQ ID NO: 563464 - DNA, 25 bp, Homo sapien
gggacactgaaatttctgtactgct

SEQ ID NO: 563465 - DNA, 25 bp, Homo sapien
atttctgtactgctactgcctatgt

SEQ ID NO: 563466 - DNA, 25 bp, Homo sapien
actgctactgcctatgtttctatca

SEQ ID NO: 563467 - DNA, 25 bp, Homo sapien
gtttctatcacaacaaatatcctga

SEQ ID NO: 563468 - DNA, 25 bp, Homo sapien
atatcctgatccctcactgttaagg

SEQ ID NO: 563469 - DNA, 25 bp, Homo sapien
gatccctcactgttaaggattcaga

SEQ ID NO: 563470 - DNA, 25 bp, Homo sapien
ggattcagaactgtcctccaagttt

SEQ ID NO: 563471 - DNA, 25 bp, Homo sapien
tattggactggtccggttctaccct

SEQ ID NO: 563472 - DNA, 25 bp, Homo sapien
taccctctttcttacttgcagtttt

SEQ ID NO: 563473 - DNA, 25 bp, Homo sapien
tgtcttcctgtcaaagcttattaaa

SEQ ID NO: 563474 - DNA, 25 bp, Homo sapien
gtgtctttgcggatgaatggtactt

SEQ ID NO: 563475 - DNA, 25 bp, Homo sapien
gcggatgaatggtactttccacaag

SEQ ID NO: 563476 - DNA, 25 bp, Homo sapien
ggtactttccacaagtgcatttgag

SEQ ID NO: 563477 - DNA, 25 bp, Homo sapien
tccacaagtgcatttgagtagaagc

SEQ ID NO: 563478 - DNA, 25 bp, Homo sapien
gtagaagcataacctattctcagtt

SEQ ID NO: 563479 - DNA, 25 bp, Homo sapien
gtttaaaacatgtactggtttgtat

SEQ ID NO: 563480 - DNA, 25 bp, Homo sapien
cactttatagtcaagatacatctca

SEQ ID NO: 563481 - DNA, 25 bp, Homo sapien
actctttcaaatacaaattcgcata

SEQ ID NO: 563482 - DNA, 25 bp, Homo sapien
aatacaaattcgcatattcacagaa

SEQ ID NO: 563483 - DNA, 25 bp, Homo sapien
aagttacaaatcagttttactattg

SEQ ID NO: 563484 - DNA, 25 bp, Homo sapien
atttcattctccatgatctctggca

SEQ ID NO: 563485 - DNA, 25 bp, Homo sapien
attctccatgatctctggcagtttc

SEQ ID NO: 563486 - DNA, 25 bp, Homo sapien
atgctgtaggagaagctaacgaatt

SEQ ID NO: 563487 - DNA, 25 bp, Homo sapien
gctaacgaattatttgcaatgccat

SEQ ID NO: 563488 - DNA, 25 bp, Homo sapien
tctctgttaaattttctaagccttg

SEQ ID NO: 563489 - DNA, 25 bp, Homo sapien
aaactgtttccatttttcatatcat

SEQ ID NO: 563490 - DNA, 25 bp, Homo sapien
attttgtttagttctaagtcagtga

SEQ ID NO: 563491 - DNA, 25 bp, Homo sapien
tgaatatttttagtcttaggtccca

SEQ ID NO: 563492 - DNA, 25 bp, Homo sapien
ttaggtcccaccacatagtgaatgt

SEQ ID NO: 563493 - DNA, 25 bp, Homo sapien
catagtgaatgtgtctgccttttat

SEQ ID NO: 563494 - DNA, 25 bp, Homo sapien
gtctgccttttatgtatctgtgaac

SEQ ID NO: 563495 - DNA, 25 bp, Homo sapien
gaataaaaaagcctatcctccttag

SEQ ID NO: 563496 - DNA, 25 bp, Homo sapien
aaaagcctatcctccttaggagcca

SEQ ID NO: 563497 - DNA, 25 bp, Homo sapien
ccttaggagccatagacttttattc

SEQ ID NO: 563498 - DNA, 25 bp, Homo sapien
tgacttagagctaaacttcctccaa

SEQ ID NO: 563499 - DNA, 25 bp, Homo sapien
gctaaacttcctccaattcagacat

SEQ ID NO: 563500 - DNA, 25 bp, Homo sapien
caattcagacataaagcataggcag

SEQ ID NO: 563501 - DNA, 25 bp, Homo sapien
ggcagatacttttgctaatgaggct

SEQ ID NO: 563502 - DNA, 25 bp, Homo sapien
ttttgctaatgaggctaagctggga

SEQ ID NO: 563503 - DNA, 25 bp, Homo sapien
agctgggaagaaaaccctgagttct

SEQ ID NO: 563504 - DNA, 25 bp, Homo sapien
accctgagttctactttaattcttg

SEQ ID NO: 563505 - DNA, 25 bp, Homo sapien
gcattgacttcaaactaagatgact

SEQ ID NO: 563506 - DNA, 25 bp, Homo sapien
gaaataagaccgctaagctctaaac

SEQ ID NO: 563507 - DNA, 25 bp, Homo sapien
taagaccgctaagctctaaacaaat

SEQ ID NO: 563508 - DNA, 25 bp, Homo sapien
gaccgctaagctctaaacaaatccg

SEQ ID NO: 563509 - DNA, 25 bp, Homo sapien
ccgctaagctctaaacaaatccgtt

SEQ ID NO: 563510 - DNA, 25 bp, Homo sapien
gctaagctctaaacaaatccgttaa

SEQ ID NO: 563511 - DNA, 25 bp, Homo sapien
gctctaaacaaatccgttaaagctt

SEQ ID NO: 563512 - DNA, 25 bp, Homo sapien
aacaaatccgttaaagcttcacagg

SEQ ID NO: 563513 - DNA, 25 bp, Homo sapien
aaatccgttaaagcttcacagggca

SEQ ID NO: 563514 - DNA, 25 bp, Homo sapien
aatccgttaaagcttcacagggcag

SEQ ID NO: 563515 - DNA, 25 bp, Homo sapien
atccgttaaagcttcacagggcaga

SEQ ID NO: 563516 - DNA, 25 bp, Homo sapien
tccgttaaagcttcacagggcagag

SEQ ID NO: 563517 - DNA, 25 bp, Homo sapien
gggaaaaattgcgattcttcattaa

SEQ ID NO: 563518 - DNA, 25 bp, Homo sapien
ggaaaaattgcgattcttcattaaa

SEQ ID NO: 563519 - DNA, 25 bp, Homo sapien
aaattgcgattcttcattaaataat

SEQ ID NO: 563520 - DNA, 25 bp, Homo sapien
ataatattctttatgtcactagcat

SEQ ID NO: 563521 - DNA, 25 bp, Homo sapien
atattctttatgtcactagcataca

SEQ ID NO: 563522 - DNA, 25 bp, Homo sapien
attctttatgtcactagcatacaat

SEQ ID NO: 563523 - DNA, 25 bp, Homo sapien
tatgtcactagcatacaatttatgt

SEQ ID NO: 563524 - DNA, 25 bp, Homo sapien
gtcactagcatacaatttatgttag

SEQ ID NO: 563525 - DNA, 25 bp, Homo sapien
gttagtagacatctttaaatctctt

SEQ ID NO: 563526 - DNA, 25 bp, Homo sapien
ttagtagacatctttaaatctcttt

SEQ ID NO: 563527 - DNA, 25 bp, Homo sapien
aaatctctttaatgagtgaatccat

SEQ ID NO: 563528 - DNA, 25 bp, Homo sapien
gggagtccgtcatcctgctgggccc

SEQ ID NO: 563529 - DNA, 25 bp, Homo sapien
gagtccgtcatcctgctgggcccta

SEQ ID NO: 563530 - DNA, 25 bp, Homo sapien
tgggccctacagtgggcaccgagtc

SEQ ID NO: 563531 - DNA, 25 bp, Homo sapien
cctacagtgggcaccgagtcaaagg

SEQ ID NO: 563532 - DNA, 25 bp, Homo sapien
acagtgggcaccgagtcaaaggtcc

SEQ ID NO: 563533 - DNA, 25 bp, Homo sapien
gtgggcaccgagtcaaaggtccaga

SEQ ID NO: 563534 - DNA, 25 bp, Homo sapien
ggcaccgagtcaaaggtccagagct

SEQ ID NO: 563535 - DNA, 25 bp, Homo sapien
ccgagtcaaaggtccagagctggtt

SEQ ID NO: 563536 - DNA, 25 bp, Homo sapien
cgagtcaaaggtccagagctggttt

SEQ ID NO: 563537 - DNA, 25 bp, Homo sapien
aaaggtccagagctggtttgagtcc

SEQ ID NO: 563538 - DNA, 25 bp, Homo sapien
aggtccagagctggtttgagtcctc

SEQ ID NO: 563539 - DNA, 25 bp, Homo sapien
atgtgcggcggtgaaacccaggccc

SEQ ID NO: 563540 - DNA, 25 bp, Homo sapien
gggtgcggtcgctcgcgaggtctgg

SEQ ID NO: 563541 - DNA, 25 bp, Homo sapien
gtcgctcgcgaggtctggcccctga

SEQ ID NO: 563542 - DNA, 25 bp, Homo sapien
cctgactcctgaccccgactgcaga

SEQ ID NO: 563543 - DNA, 25 bp, Homo sapien
gactgcagacccctaaccttgttct

SEQ ID NO: 563544 - DNA, 25 bp, Homo sapien
tgcagacccctaaccttgttctttc

SEQ ID NO: 563545 - DNA, 25 bp, Homo sapien
gcagacccctaaccttgttctttct

SEQ ID NO: 563546 - DNA, 25 bp, Homo sapien
ctaaccttgttctttctccgcagga

SEQ ID NO: 563547 - DNA, 25 bp, Homo sapien
aaccttgttctttctccgcaggaca

SEQ ID NO: 563548 - DNA, 25 bp, Homo sapien
gttctttctccgcaggacactggtc

SEQ ID NO: 563549 - DNA, 25 bp, Homo sapien
ttctttctccgcaggacactggtcc

SEQ ID NO: 563550 - DNA, 25 bp, Homo sapien
ttttcttttgggtagtactgctgga

SEQ ID NO: 563551 - DNA, 25 bp, Homo sapien
ttttgggtagtactgctggaacact

SEQ ID NO: 563552 - DNA, 25 bp, Homo sapien
gggtagtactgctggaacactaagc

SEQ ID NO: 563553 - DNA, 25 bp, Homo sapien
tactgctggaacactaagcaggcag

SEQ ID NO: 563554 - DNA, 25 bp, Homo sapien
aggcagatcgccagaacacaataca

SEQ ID NO: 563555 - DNA, 25 bp, Homo sapien
ggcagatcgccagaacacaatacag

SEQ ID NO: 563556 - DNA, 25 bp, Homo sapien
agaacacaatacaggttgagcatac

SEQ ID NO: 563557 - DNA, 25 bp, Homo sapien
caatacaggttgagcatacctaatc

SEQ ID NO: 563558 - DNA, 25 bp, Homo sapien
tgagcatacctaatctaaaaatctg

SEQ ID NO: 563559 - DNA, 25 bp, Homo sapien
gcatacctaatctaaaaatctgaaa

SEQ ID NO: 563560 - DNA, 25 bp, Homo sapien
tcaaaggtattttggactgaggcgg

SEQ ID NO: 563561 - DNA, 25 bp, Homo sapien
tgttgtaacatctcaggatctatat

SEQ ID NO: 563562 - DNA, 25 bp, Homo sapien
aattctccttaattctttcatttag

SEQ ID NO: 563563 - DNA, 25 bp, Homo sapien
tttcatttagagaggtgcacaaaca

SEQ ID NO: 563564 - DNA, 25 bp, Homo sapien
agagaggtgcacaaacaggacacat

SEQ ID NO: 563565 - DNA, 25 bp, Homo sapien
ggacacattctctgttaacctaaga

SEQ ID NO: 563566 - DNA, 25 bp, Homo sapien
tctgttaacctaagaagctgtaatt

SEQ ID NO: 563567 - DNA, 25 bp, Homo sapien
atttcagcaagatttccctccacaa

SEQ ID NO: 563568 - DNA, 25 bp, Homo sapien
gcaagatttccctccacaagagata

SEQ ID NO: 563569 - DNA, 25 bp, Homo sapien
gatttccctccacaagagatatacc

SEQ ID NO: 563570 - DNA, 25 bp, Homo sapien
gagatataccacctttaaaatcatg

SEQ ID NO: 563571 - DNA, 25 bp, Homo sapien
taccacctttaaaatcatgttctaa

SEQ ID NO: 563572 - DNA, 25 bp, Homo sapien
atgaaaggtaattctccaaactcct

SEQ ID NO: 563573 - DNA, 25 bp, Homo sapien
gtaattctccaaactccttttgtat

SEQ ID NO: 563574 - DNA, 25 bp, Homo sapien
ttctccaaactccttttgtatgcag

SEQ ID NO: 563575 - DNA, 25 bp, Homo sapien
caaactccttttgtatgcagtgtgt

SEQ ID NO: 563576 - DNA, 25 bp, Homo sapien
ctccttttgtatgcagtgtgtaatt

SEQ ID NO: 563577 - DNA, 25 bp, Homo sapien
ttgtatgcagtgtgtaattatttac

SEQ ID NO: 563578 - DNA, 25 bp, Homo sapien
ttatcaaatctcaggactagtttaa

SEQ ID NO: 563579 - DNA, 25 bp, Homo sapien
atctcaggactagtttaaattccag

SEQ ID NO: 563580 - DNA, 25 bp, Homo sapien
ttccagtaatttaagctgtatgtta

SEQ ID NO: 563581 - DNA, 25 bp, Homo sapien
aagctgtatgttatcctatttgtaa

SEQ ID NO: 563582 - DNA, 25 bp, Homo sapien
gtatgttatcctatttgtaacttat

SEQ ID NO: 563583 - DNA, 25 bp, Homo sapien
aaaatgacaatgaactcctaaaatt

SEQ ID NO: 563584 - DNA, 25 bp, Homo sapien
tcctaaaattgattccattcctgga

SEQ ID NO: 563585 - DNA, 25 bp, Homo sapien
gattccattcctggagaagcttgta

SEQ ID NO: 563586 - DNA, 25 bp, Homo sapien
tccattcctggagaagcttgtagaa

SEQ ID NO: 563587 - DNA, 25 bp, Homo sapien
aactgaatgaagatgttcgaccaca

SEQ ID NO: 563588 - DNA, 25 bp, Homo sapien
gttcgaccacacatcagagacagat

SEQ ID NO: 563589 - DNA, 25 bp, Homo sapien
cagagacagatttcgcttgcatgat

SEQ ID NO: 563590 - DNA, 25 bp, Homo sapien
gacagatttcgcttgcatgatttgc

SEQ ID NO: 563591 - DNA, 25 bp, Homo sapien
atttcgcttgcatgatttgctgccc

SEQ ID NO: 563592 - DNA, 25 bp, Homo sapien
tgctgcccccagattaagtacaaag

SEQ ID NO: 563593 - DNA, 25 bp, Homo sapien
aaagacttgtcaaatcactgaaggg

SEQ ID NO: 563594 - DNA, 25 bp, Homo sapien
acactgcaagctaaatacataacta

SEQ ID NO: 563595 - DNA, 25 bp, Homo sapien
taattgtttgactactgcatgcatg

SEQ ID NO: 563596 - DNA, 25 bp, Homo sapien
ttgtttgactactgcatgcatgtgc

SEQ ID NO: 563597 - DNA, 25 bp, Homo sapien
actactgcatgcatgtgcaaataca

SEQ ID NO: 563598 - DNA, 25 bp, Homo sapien
acatgggaatgtttagttcactaca

SEQ ID NO: 563599 - DNA, 25 bp, Homo sapien
gtttagttcactacatttcaatgtt

SEQ ID NO: 563600 - DNA, 25 bp, Homo sapien
gtactcatgtacgatgtctacaagg

SEQ ID NO: 563601 - DNA, 25 bp, Homo sapien
aaacctgctgaacttttataccaat

SEQ ID NO: 563602 - DNA, 25 bp, Homo sapien
ataccaattctggtctttgggaaat

SEQ ID NO: 563603 - DNA, 25 bp, Homo sapien
tgttccatgaagtgccaaaattatg

SEQ ID NO: 563604 - DNA, 25 bp, Homo sapien
ttctttacccatttcacattcatta

SEQ ID NO: 563605 - DNA, 25 bp, Homo sapien
acaggaacaacaaccgggatgtcat

SEQ ID NO: 563606 - DNA, 25 bp, Homo sapien
acaacaaccgggatgtcatgcgggc

SEQ ID NO: 563607 - DNA, 25 bp, Homo sapien
ttgtggccccagtgcacagaattct

SEQ ID NO: 563608 - DNA, 25 bp, Homo sapien
tgcacagaattctggtggacccacc

SEQ ID NO: 563609 - DNA, 25 bp, Homo sapien
tggacccaccatgtgtgggagctca

SEQ ID NO: 563610 - DNA, 25 bp, Homo sapien
tcctcacacatcgtacgctgaaggt

SEQ ID NO: 563611 - DNA, 25 bp, Homo sapien
tcgtacgctgaaggtggagcacact

SEQ ID NO: 563612 - DNA, 25 bp, Homo sapien
gggaaaatgtgcatgcatcaagaag

SEQ ID NO: 563613 - DNA, 25 bp, Homo sapien
aaactgattttgtgcaacatttcca

SEQ ID NO: 563614 - DNA, 25 bp, Homo sapien
tgtgcaacatttccactgttcttgg

SEQ ID NO: 563615 - DNA, 25 bp, Homo sapien
acatttccactgttcttggaagaat

SEQ ID NO: 563616 - DNA, 25 bp, Homo sapien
agcatttgggaatagtccctaactt

SEQ ID NO: 563617 - DNA, 25 bp, Homo sapien
agttcagtacaagatacccggcaga

SEQ ID NO: 563618 - DNA, 25 bp, Homo sapien
gagagagcactgctttttcattgtt

SEQ ID NO: 563619 - DNA, 25 bp, Homo sapien
gctttttcattgtttgcactgctgt

SEQ ID NO: 563620 - DNA, 25 bp, Homo sapien
gtttgcactgctgtcaaatcctact

SEQ ID NO: 563621 - DNA, 25 bp, Homo sapien
tcaaatcctactcttcaactaccat

SEQ ID NO: 563622 - DNA, 25 bp, Homo sapien
tcaactaccatctctggactcacag

SEQ ID NO: 563623 - DNA, 25 bp, Homo sapien
accctttcacacaattcatgtcatc

SEQ ID NO: 563624 - DNA, 25 bp, Homo sapien
ttacggatttctgcttcctaataga

SEQ ID NO: 563625 - DNA, 25 bp, Homo sapien
gaattgtgaagaaatcggacctact

SEQ ID NO: 563626 - DNA, 25 bp, Homo sapien
agaaatcggacctacttctgcactt

SEQ ID NO: 563627 - DNA, 25 bp, Homo sapien
gcagacctccttgatagcatctagg

SEQ ID NO: 563628 - DNA, 25 bp, Homo sapien
agacctccttgatagcatctaggag

SEQ ID NO: 563629 - DNA, 25 bp, Homo sapien
ttgggccgaggaactcaaacagttt

SEQ ID NO: 563630 - DNA, 25 bp, Homo sapien
ggccgaggaactcaaacagttttga

SEQ ID NO: 563631 - DNA, 25 bp, Homo sapien
ccccagttatgttaaaaggcagatt

SEQ ID NO: 563632 - DNA, 25 bp, Homo sapien
aaaggcagattggatttgagaggct

SEQ ID NO: 563633 - DNA, 25 bp, Homo sapien
ttggatttgagaggctgcttctcct

SEQ ID NO: 563634 - DNA, 25 bp, Homo sapien
gatttgagaggctgcttctcctgcc

SEQ ID NO: 563635 - DNA, 25 bp, Homo sapien
tgccttcttgctttagccgagtcaa

SEQ ID NO: 563636 - DNA, 25 bp, Homo sapien
ccttcttgctttagccgagtcaaat

SEQ ID NO: 563637 - DNA, 25 bp, Homo sapien
ttgctttagccgagtcaaataaacc

SEQ ID NO: 563638 - DNA, 25 bp, Homo sapien
agcaagaaaccattatcgctccctc

SEQ ID NO: 563639 - DNA, 25 bp, Homo sapien
ttatcgctccctcatctgaactgca

SEQ ID NO: 563640 - DNA, 25 bp, Homo sapien
ctcatctgaactgcactgcgagtaa

SEQ ID NO: 563641 - DNA, 25 bp, Homo sapien
ctgaactgcactgcgagtaagctgg

SEQ ID NO: 563642 - DNA, 25 bp, Homo sapien
accacagtgtcctggaagccatgtt

SEQ ID NO: 563643 - DNA, 25 bp, Homo sapien
acagtgtcctggaagccatgtttgc

SEQ ID NO: 563644 - DNA, 25 bp, Homo sapien
cctgccacttcaagataatctctta

SEQ ID NO: 563645 - DNA, 25 bp, Homo sapien
gataatctcttaacaatctattcct

SEQ ID NO: 563646 - DNA, 25 bp, Homo sapien
ttaacaatctattccttctgcctgg

SEQ ID NO: 563647 - DNA, 25 bp, Homo sapien
agctaactccattctttggcccctg

SEQ ID NO: 563648 - DNA, 25 bp, Homo sapien
attctttggcccctgcatcactttc

SEQ ID NO: 563649 - DNA, 25 bp, Homo sapien
tcttttaatttaagggatgtcaaat

SEQ ID NO: 563650 - DNA, 25 bp, Homo sapien
aaaataaatgagctataaaggccca

SEQ ID NO: 563651 - DNA, 25 bp, Homo sapien
atgagctataaaggcccataacata

SEQ ID NO: 563652 - DNA, 25 bp, Homo sapien
gctataaaggcccataacatactaa

SEQ ID NO: 563653 - DNA, 25 bp, Homo sapien
aaggcccataacatactaaaacagg

SEQ ID NO: 563654 - DNA, 25 bp, Homo sapien
catactaaaacaggcagtttcaggt

SEQ ID NO: 563655 - DNA, 25 bp, Homo sapien
aaacaggcagtttcaggtatgtaag

SEQ ID NO: 563656 - DNA, 25 bp, Homo sapien
caggcagtttcaggtatgtaaggaa

SEQ ID NO: 563657 - DNA, 25 bp, Homo sapien
ggaaaggaacattatacttacctag

SEQ ID NO: 563658 - DNA, 25 bp, Homo sapien
ggaacattatacttacctagaaagt

SEQ ID NO: 563659 - DNA, 25 bp, Homo sapien
atacttacctagaaagtgagatcta

SEQ ID NO: 563660 - DNA, 25 bp, Homo sapien
ggtgacacagcttgaagacctccca

SEQ ID NO: 563661 - DNA, 25 bp, Homo sapien
gaagacctcccacgccagagctgaa

SEQ ID NO: 563662 - DNA, 25 bp, Homo sapien
agagctgaaagcctgagtcaactgc

SEQ ID NO: 563663 - DNA, 25 bp, Homo sapien
tgaaagcctgagtcaactgccagtg

SEQ ID NO: 563664 - DNA, 25 bp, Homo sapien
gtcaactgccagtggtgttttgaat

SEQ ID NO: 563665 - DNA, 25 bp, Homo sapien
ctgccagtggtgttttgaatcattt

SEQ ID NO: 563666 - DNA, 25 bp, Homo sapien
gaaaatcttacttcttccaaacagt

SEQ ID NO: 563667 - DNA, 25 bp, Homo sapien
atcttacttcttccaaacagtgtga

SEQ ID NO: 563668 - DNA, 25 bp, Homo sapien
aacagtgtgatattgctactttcat

SEQ ID NO: 563669 - DNA, 25 bp, Homo sapien
ataaaatactctaacgatcgctggt

SEQ ID NO: 563670 - DNA, 25 bp, Homo sapien
atactctaacgatcgctggtgagct

SEQ ID NO: 563671 - DNA, 25 bp, Homo sapien
cgggcgtctaggactcagcagccac

SEQ ID NO: 563672 - DNA, 25 bp, Homo sapien
cagcaaagggctgaggagcgtccct

SEQ ID NO: 563673 - DNA, 25 bp, Homo sapien
gtccctgagacactttaaggccgtc

SEQ ID NO: 563674 - DNA, 25 bp, Homo sapien
gagacactttaaggccgtctggtgg

SEQ ID NO: 563675 - DNA, 25 bp, Homo sapien
tttaaggccgtctggtggcagctat

SEQ ID NO: 563676 - DNA, 25 bp, Homo sapien
gccgtctggtggcagctatgtttaa

SEQ ID NO: 563677 - DNA, 25 bp, Homo sapien
ggcagctatgtttaagagaccagcg

SEQ ID NO: 563678 - DNA, 25 bp, Homo sapien
aggctgttcagacctcagcgttgac

SEQ ID NO: 563679 - DNA, 25 bp, Homo sapien
gttcagacctcagcgttgacactga

SEQ ID NO: 563680 - DNA, 25 bp, Homo sapien
agcgttgacactgaaactggcccct

SEQ ID NO: 563681 - DNA, 25 bp, Homo sapien
gttgacactgaaactggcccctccg

SEQ ID NO: 563682 - DNA, 25 bp, Homo sapien
gagtttatcaaattggaaccattct

SEQ ID NO: 563683 - DNA, 25 bp, Homo sapien
gaaccattctcccattaccgagtaa

SEQ ID NO: 563684 - DNA, 25 bp, Homo sapien
gtaagcttttagattcgtgggcaga

SEQ ID NO: 563685 - DNA, 25 bp, Homo sapien
agaaggatatcctgccacgttcgag

SEQ ID NO: 563686 - DNA, 25 bp, Homo sapien
acgttcgagtctcatgttcctggca

SEQ ID NO: 563687 - DNA, 25 bp, Homo sapien
tgttcctggcatttactcacgcgta

SEQ ID NO: 563688 - DNA, 25 bp, Homo sapien
atttactcacgcgtaggcgtctcat

SEQ ID NO: 563689 - DNA, 25 bp, Homo sapien
gtctcatccatctggcacttaggtt

SEQ ID NO: 563690 - DNA, 25 bp, Homo sapien
tccatctggcacttaggttgtgtgt

SEQ ID NO: 563691 - DNA, 25 bp, Homo sapien
ggtctcacgtttcttgcccatgaga

SEQ ID NO: 563692 - DNA, 25 bp, Homo sapien
ccagggagtggatggtcctctgcca

SEQ ID NO: 563693 - DNA, 25 bp, Homo sapien
tgttagcattaactgctgcttctga

SEQ ID NO: 563694 - DNA, 25 bp, Homo sapien
gctgcttctgatgaaccattcagga

SEQ ID NO: 563695 - DNA, 25 bp, Homo sapien
accattcaggaaagcacactctaga

SEQ ID NO: 563696 - DNA, 25 bp, Homo sapien
ggaaagcacactctagacactagta

SEQ ID NO: 563697 - DNA, 25 bp, Homo sapien
gtatattgaggcacataggacacta

SEQ ID NO: 563698 - DNA, 25 bp, Homo sapien
tttcccaagaccagctatatctctc

SEQ ID NO: 563699 - DNA, 25 bp, Homo sapien
gctatatctctcatctacgcatgat

SEQ ID NO: 563700 - DNA, 25 bp, Homo sapien
tacgcatgatttcagtgttaagtct

SEQ ID NO: 563701 - DNA, 25 bp, Homo sapien
tgttaagtctatcatatgttacccc

SEQ ID NO: 563702 - DNA, 25 bp, Homo sapien
gacattcttagcacaactgagaggg

SEQ ID NO: 563703 - DNA, 25 bp, Homo sapien
gcaccacaggtgagtcccaagattt

SEQ ID NO: 563704 - DNA, 25 bp, Homo sapien
tgccctttaggaaaaatgaggctga

SEQ ID NO: 563705 - DNA, 25 bp, Homo sapien
atgaggctgacaatcccatgccgtg

SEQ ID NO: 563706 - DNA, 25 bp, Homo sapien
tgacaatcccatgccgtgcagtgac

SEQ ID NO: 563707 - DNA, 25 bp, Homo sapien
atcccatgccgtgcagtgacttgta

SEQ ID NO: 563708 - DNA, 25 bp, Homo sapien
tgccgtgcagtgacttgtacacatc

SEQ ID NO: 563709 - DNA, 25 bp, Homo sapien
gtgacttgtacacatctgcagtgtt

SEQ ID NO: 563710 - DNA, 25 bp, Homo sapien
ttgtacacatctgcagtgttttgat

SEQ ID NO: 563711 - DNA, 25 bp, Homo sapien
tttgatgctgccctctatctacaaa

SEQ ID NO: 563712 - DNA, 25 bp, Homo sapien
tgatgctgccctctatctacaaatg

SEQ ID NO: 563713 - DNA, 25 bp, Homo sapien
ctgtgtgtgacaaaaaagctgccta

SEQ ID NO: 563714 - DNA, 25 bp, Homo sapien
aaaagctgcctatgaaagtctaata

SEQ ID NO: 563715 - DNA, 25 bp, Homo sapien
agtccgatgccctctgctgatgaag

SEQ ID NO: 563716 - DNA, 25 bp, Homo sapien
ctctgctgatgaaggtgttaccata

SEQ ID NO: 563717 - DNA, 25 bp, Homo sapien
tggatgtctatttcattccccattc

SEQ ID NO: 563718 - DNA, 25 bp, Homo sapien
ttccccattccaaataggtgccagg

SEQ ID NO: 563719 - DNA, 25 bp, Homo sapien
gacacagattctccaacacacatat

SEQ ID NO: 563720 - DNA, 25 bp, Homo sapien
caacacacatatcaggctccgggaa

SEQ ID NO: 563721 - DNA, 25 bp, Homo sapien
atcaggctccgggaagtttccgaag

SEQ ID NO: 563722 - DNA, 25 bp, Homo sapien
gaagtttccgaagaggtatccattg

SEQ ID NO: 563723 - DNA, 25 bp, Homo sapien
aggtatccattgagggctggaaaca

SEQ ID NO: 563724 - DNA, 25 bp, Homo sapien
aaacacgctagtggaagagactccc

SEQ ID NO: 563725 - DNA, 25 bp, Homo sapien
cctgcagaggcgactgggaccagaa

SEQ ID NO: 563726 - DNA, 25 bp, Homo sapien
cgctattcgggctcctataatgatt

SEQ ID NO: 563727 - DNA, 25 bp, Homo sapien
tataatgattacctgcgggcggctc

SEQ ID NO: 563728 - DNA, 25 bp, Homo sapien
gggcggctcagatgcactctggcta

SEQ ID NO: 563729 - DNA, 25 bp, Homo sapien
agcgccgcatgtagggccatcctgg

SEQ ID NO: 563730 - DNA, 25 bp, Homo sapien
gtagggttacagatccaggttataa

SEQ ID NO: 563731 - DNA, 25 bp, Homo sapien
aggttataactactctggcccatac

SEQ ID NO: 563732 - DNA, 25 bp, Homo sapien
ggcccatacctttcctggttgtggt

SEQ ID NO: 563733 - DNA, 25 bp, Homo sapien
ggttgtggtttttcatgccctctac

SEQ ID NO: 563734 - DNA, 25 bp, Homo sapien
agatgatcctgttaagtgttcggca

SEQ ID NO: 563735 - DNA, 25 bp, Homo sapien
gtgttcggcagtaacctactttgtt

SEQ ID NO: 563736 - DNA, 25 bp, Homo sapien
agcaaatcttgctactggctctaga

SEQ ID NO: 563737 - DNA, 25 bp, Homo sapien
agaatcgttttaacccagaagacag

SEQ ID NO: 563738 - DNA, 25 bp, Homo sapien
gaatcgttttaacccagaagacagg

SEQ ID NO: 563739 - DNA, 25 bp, Homo sapien
atcgttttaacccagaagacaggct

SEQ ID NO: 563740 - DNA, 25 bp, Homo sapien
tcgttttaacccagaagacaggctg

SEQ ID NO: 563741 - DNA, 25 bp, Homo sapien
cgttttaacccagaagacaggctgc

SEQ ID NO: 563742 - DNA, 25 bp, Homo sapien
gttttaacccagaagacaggctgca

SEQ ID NO: 563743 - DNA, 25 bp, Homo sapien
ttttaacccagaagacaggctgcag

SEQ ID NO: 563744 - DNA, 25 bp, Homo sapien
tttaacccagaagacaggctgcagt

SEQ ID NO: 563745 - DNA, 25 bp, Homo sapien
ttaacccagaagacaggctgcagtg

SEQ ID NO: 563746 - DNA, 25 bp, Homo sapien
ccctgatctagggtgattgtgtctg

SEQ ID NO: 563747 - DNA, 25 bp, Homo sapien
ggtgattgtgtctggagacccttaa

SEQ ID NO: 563748 - DNA, 25 bp, Homo sapien
gtctggagacccttaattatgttta

SEQ ID NO: 563749 - DNA, 25 bp, Homo sapien
tggagacccttaattatgtttacaa

SEQ ID NO: 563750 - DNA, 25 bp, Homo sapien
atgtttacaaagacccatgttccaa

SEQ ID NO: 563751 - DNA, 25 bp, Homo sapien
aagacccatgttccaagtaagtttg

SEQ ID NO: 563752 - DNA, 25 bp, Homo sapien
gttccaagtaagtttgtattcacat

SEQ ID NO: 563753 - DNA, 25 bp, Homo sapien
gggatacttttcagtccatgacagt

SEQ ID NO: 563754 - DNA, 25 bp, Homo sapien
tccatgacagttactaaaggacatt

SEQ ID NO: 563755 - DNA, 25 bp, Homo sapien
tcatatgattgttaggagactacct

SEQ ID NO: 563756 - DNA, 25 bp, Homo sapien
agtggcattatgatttttgaatata

SEQ ID NO: 563757 - DNA, 25 bp, Homo sapien
gggtgcggtcgctcgcgaggtctgg

SEQ ID NO: 563758 - DNA, 25 bp, Homo sapien
gtcgctcgcgaggtctggcccctga

SEQ ID NO: 563759 - DNA, 25 bp, Homo sapien
gctcgcgaggtctggcccctgactc

SEQ ID NO: 563760 - DNA, 25 bp, Homo sapien
cctgactcctgaccccgactgcaga

SEQ ID NO: 563761 - DNA, 25 bp, Homo sapien
gactgcagacccctaaccttgttct

SEQ ID NO: 563762 - DNA, 25 bp, Homo sapien
actgcagacccctaaccttgttctt

SEQ ID NO: 563763 - DNA, 25 bp, Homo sapien
ctgcagacccctaaccttgttcttt

SEQ ID NO: 563764 - DNA, 25 bp, Homo sapien
tgcagacccctaaccttgttctttc

SEQ ID NO: 563765 - DNA, 25 bp, Homo sapien
gcagacccctaaccttgttctttct

SEQ ID NO: 563766 - DNA, 25 bp, Homo sapien
gttctttctccgcaggacactggtc

SEQ ID NO: 563767 - DNA, 25 bp, Homo sapien
ttctttctccgcaggacactggtcc

SEQ ID NO: 563768 - DNA, 25 bp, Homo sapien
gctttttatgcactttccatttcat

SEQ ID NO: 563769 - DNA, 25 bp, Homo sapien
gcactttccatttcatcctatagag

SEQ ID NO: 563770 - DNA, 25 bp, Homo sapien
ccatttcatcctatagagtactaca

SEQ ID NO: 563771 - DNA, 25 bp, Homo sapien
gtactacaaagatgtgtacttcaca

SEQ ID NO: 563772 - DNA, 25 bp, Homo sapien
tgtgtacttcacattcaagatttaa

SEQ ID NO: 563773 - DNA, 25 bp, Homo sapien
gttaatagttttactgcttcaacga

SEQ ID NO: 563774 - DNA, 25 bp, Homo sapien
agttttactgcttcaacgaggacat

SEQ ID NO: 563775 - DNA, 25 bp, Homo sapien
ttttttactgtgagtgcatagtggt

SEQ ID NO: 563776 - DNA, 25 bp, Homo sapien
gagtgcatagtggtaatgacagtaa

SEQ ID NO: 563777 - DNA, 25 bp, Homo sapien
ttacccatcactgcttttacatcat

SEQ ID NO: 563778 - DNA, 25 bp, Homo sapien
atcactgcttttacatcatcaatga

SEQ ID NO: 563779 - DNA, 25 bp, Homo sapien
agagctggaaaagcatggaatgcaa

SEQ ID NO: 563780 - DNA, 25 bp, Homo sapien
agctggaaaagcatggaatgcaagt

SEQ ID NO: 563781 - DNA, 25 bp, Homo sapien
gctggaaaagcatggaatgcaagtc

SEQ ID NO: 563782 - DNA, 25 bp, Homo sapien
ctggaaaagcatggaatgcaagtcc

SEQ ID NO: 563783 - DNA, 25 bp, Homo sapien
tggaaaagcatggaatgcaagtccc

SEQ ID NO: 563784 - DNA, 25 bp, Homo sapien
ggaaaagcatggaatgcaagtccct

SEQ ID NO: 563785 - DNA, 25 bp, Homo sapien
gaaaagcatggaatgcaagtccctg

SEQ ID NO: 563786 - DNA, 25 bp, Homo sapien
aaaagcatggaatgcaagtccctgc

SEQ ID NO: 563787 - DNA, 25 bp, Homo sapien
aaagcatggaatgcaagtccctgcc

SEQ ID NO: 563788 - DNA, 25 bp, Homo sapien
aagcatggaatgcaagtccctgccc

SEQ ID NO: 563789 - DNA, 25 bp, Homo sapien
gcacacaagaggaagaggctggccc

SEQ ID NO: 563790 - DNA, 25 bp, Homo sapien
tgctgatccaggcactgtccgtgag

SEQ ID NO: 563791 - DNA, 25 bp, Homo sapien
aggcactgtccgtgagctcggccga

SEQ ID NO: 563792 - DNA, 25 bp, Homo sapien
ggccgaccgcacctacaagggcaag

SEQ ID NO: 563793 - DNA, 25 bp, Homo sapien
acaagggcaagtgcagacaccttca

SEQ ID NO: 563794 - DNA, 25 bp, Homo sapien
gcagacaccttcagggatacaaccc

SEQ ID NO: 563795 - DNA, 25 bp, Homo sapien
atacaaccccttcgaccagggctgt

SEQ ID NO: 563796 - DNA, 25 bp, Homo sapien
gccagcaactggtatttaacaattt

SEQ ID NO: 563797 - DNA, 25 bp, Homo sapien
cactgggacccaaggctgctgcatc

SEQ ID NO: 563798 - DNA, 25 bp, Homo sapien
caaggctgctgcatcctggatgagg

SEQ ID NO: 563799 - DNA, 25 bp, Homo sapien
tcctggatgaggctggcctcagctt

SEQ ID NO: 563800 - DNA, 25 bp, Homo sapien
agagctaagccctgggccgtgtgct

SEQ ID NO: 563801 - DNA, 25 bp, Homo sapien
gcaatatctaaagcctctcaggaaa

SEQ ID NO: 563802 - DNA, 25 bp, Homo sapien
aggcattttcccatgttcccactat

SEQ ID NO: 563803 - DNA, 25 bp, Homo sapien
atgttcccactattttgctatgata

SEQ ID NO: 563804 - DNA, 25 bp, Homo sapien
atactgtatttgattaccttctgtt

SEQ ID NO: 563805 - DNA, 25 bp, Homo sapien
gatcattctttaatgctgaggccat

SEQ ID NO: 563806 - DNA, 25 bp, Homo sapien
ctgaggccatttgcggagagtgatc

SEQ ID NO: 563807 - DNA, 25 bp, Homo sapien
gagtgatccagttggaaccagtgat

SEQ ID NO: 563808 - DNA, 25 bp, Homo sapien
gaaccagtgatttcgagaattccag

SEQ ID NO: 563809 - DNA, 25 bp, Homo sapien
tcgagaattccagacgtgagagact

SEQ ID NO: 563810 - DNA, 25 bp, Homo sapien
aagacaagtgacgaagttttacagt

SEQ ID NO: 563811 - DNA, 25 bp, Homo sapien
gacgaagttttacagtcaggaaaca

SEQ ID NO: 563812 - DNA, 25 bp, Homo sapien
ggaaggacgggcctatatccctcct

SEQ ID NO: 563813 - DNA, 25 bp, Homo sapien
tatatccctcctacaaagttcgaga

SEQ ID NO: 563814 - DNA, 25 bp, Homo sapien
atccctcctacaaagttcgagagaa

SEQ ID NO: 563815 - DNA, 25 bp, Homo sapien
gatagaaacggtcaagtaccccaca

SEQ ID NO: 563816 - DNA, 25 bp, Homo sapien
gaaacggtcaagtaccccacatatc

SEQ ID NO: 563817 - DNA, 25 bp, Homo sapien
gtaccccacatatcctgaggctgag

SEQ ID NO: 563818 - DNA, 25 bp, Homo sapien
gagataaacgaccaaactcagttcg

SEQ ID NO: 563819 - DNA, 25 bp, Homo sapien
gaccaaactcagttcgaccaaactc

SEQ ID NO: 563820 - DNA, 25 bp, Homo sapien
gttcgaccaaactcagttcaaacca

SEQ ID NO: 563821 - DNA, 25 bp, Homo sapien
gaagagggctctgatctaacaaaat

SEQ ID NO: 563822 - DNA, 25 bp, Homo sapien
tatatgagtagatactctcagcacc

SEQ ID NO: 563823 - DNA, 25 bp, Homo sapien
tcatttctgttgtaaggaaggtggc

SEQ ID NO: 563824 - DNA, 25 bp, Homo sapien
atttctgttgtaaggaaggtggctg

SEQ ID NO: 563825 - DNA, 25 bp, Homo sapien
ctgttgtaaggaaggtggctgggaa

SEQ ID NO: 563826 - DNA, 25 bp, Homo sapien
tggctgggaacaggttgacgacatc

SEQ ID NO: 563827 - DNA, 25 bp, Homo sapien
ggctgggaacaggttgacgacatca

SEQ ID NO: 563828 - DNA, 25 bp, Homo sapien
gctgggaacaggttgacgacatcag

SEQ ID NO: 563829 - DNA, 25 bp, Homo sapien
tgggaacaggttgacgacatcagtc

SEQ ID NO: 563830 - DNA, 25 bp, Homo sapien
gggaacaggttgacgacatcagtcc

SEQ ID NO: 563831 - DNA, 25 bp, Homo sapien
ggaacaggttgacgacatcagtccg

SEQ ID NO: 563832 - DNA, 25 bp, Homo sapien
gaacaggttgacgacatcagtccga

SEQ ID NO: 563833 - DNA, 25 bp, Homo sapien
ggaccagaaatgttgagaaaacact

SEQ ID NO: 563834 - DNA, 25 bp, Homo sapien
gacaggaaatcctaagtcattgatt

SEQ ID NO: 563835 - DNA, 25 bp, Homo sapien
aagtcattgattttggtaagctcat

SEQ ID NO: 563836 - DNA, 25 bp, Homo sapien
ggtaagctcatgatagtgcagttta

SEQ ID NO: 563837 - DNA, 25 bp, Homo sapien
gcagtttattcaaactctaggcttt

SEQ ID NO: 563838 - DNA, 25 bp, Homo sapien
aatactttaggcctatgactcagaa

SEQ ID NO: 563839 - DNA, 25 bp, Homo sapien
gcctatgactcagaatggaaaccaa

SEQ ID NO: 563840 - DNA, 25 bp, Homo sapien
tgagatactttttctgattcaccag

SEQ ID NO: 563841 - DNA, 25 bp, Homo sapien
ttttctgattcaccagtgaggtaat

SEQ ID NO: 563842 - DNA, 25 bp, Homo sapien
gttggtaattccatatgagattgtt

SEQ ID NO: 563843 - DNA, 25 bp, Homo sapien
aggaacaattaagagcttcccaaga

SEQ ID NO: 563844 - DNA, 25 bp, Homo sapien
cattccacatttaacttggtaaagc

SEQ ID NO: 563845 - DNA, 25 bp, Homo sapien
tttccattggcgatgaacaatccca

SEQ ID NO: 563846 - DNA, 25 bp, Homo sapien
ggcgatgaacaatcccattgtcact

SEQ ID NO: 563847 - DNA, 25 bp, Homo sapien
aatcccattgtcactccccatgggt

SEQ ID NO: 563848 - DNA, 25 bp, Homo sapien
atgggtgtgcccaccggaagctgct

SEQ ID NO: 563849 - DNA, 25 bp, Homo sapien
ttcaagctggtttttccagccccta

SEQ ID NO: 563850 - DNA, 25 bp, Homo sapien
ctaccacagcgctgggtgtgtaggt

SEQ ID NO: 563851 - DNA, 25 bp, Homo sapien
tgaggaagcgcatgaacacctgagc

SEQ ID NO: 563852 - DNA, 25 bp, Homo sapien
acacctgagcgtgtgagaattcggt

SEQ ID NO: 563853 - DNA, 25 bp, Homo sapien
gggtgaatgccactccaaatgtgtg

SEQ ID NO: 563854 - DNA, 25 bp, Homo sapien
atgccactccaaatgtgtgtcaaat

SEQ ID NO: 563855 - DNA, 25 bp, Homo sapien
aagtgggtcaaggagatattcagaa

SEQ ID NO: 563856 - DNA, 25 bp, Homo sapien
agattccttgagcatgtggactgtt

SEQ ID NO: 563857 - DNA, 25 bp, Homo sapien
gcatgtggactgttggaagcctcat

SEQ ID NO: 563858 - DNA, 25 bp, Homo sapien
aagcctcataggtagggtgcatgca

SEQ ID NO: 563859 - DNA, 25 bp, Homo sapien
taagcacaggctcttgaaccaaact

SEQ ID NO: 563860 - DNA, 25 bp, Homo sapien
gctcttgaaccaaactgcctgagtt

SEQ ID NO: 563861 - DNA, 25 bp, Homo sapien
gttcaaatcctagcccttctgctta

SEQ ID NO: 563862 - DNA, 25 bp, Homo sapien
tagcccttctgcttactagctcagt

SEQ ID NO: 563863 - DNA, 25 bp, Homo sapien
ctagctcagtgatcttggccaagtt

SEQ ID NO: 563864 - DNA, 25 bp, Homo sapien
tggccaagttattttacctttgtct

SEQ ID NO: 563865 - DNA, 25 bp, Homo sapien
tttacctttgtcttcagtttatctg

SEQ ID NO: 563866 - DNA, 25 bp, Homo sapien
gttagaactgtgactggtacttaat

SEQ ID NO: 563867 - DNA, 25 bp, Homo sapien
ttccatgtaatataccaagaccaga

SEQ ID NO: 563868 - DNA, 25 bp, Homo sapien
ctggtataagggttacacagatagt

SEQ ID NO: 563869 - DNA, 25 bp, Homo sapien
acacagatagtaagtagcagaagaa

SEQ ID NO: 563870 - DNA, 25 bp, Homo sapien
tttctaatttactgccaaagctgct

SEQ ID NO: 563871 - DNA, 25 bp, Homo sapien
aatttactgccaaagctgctaaata

SEQ ID NO: 563872 - DNA, 25 bp, Homo sapien
ataagggtgattttaaggccatttg

SEQ ID NO: 563873 - DNA, 25 bp, Homo sapien
gggtgattttaaggccatttggaat

SEQ ID NO: 563874 - DNA, 25 bp, Homo sapien
aaggccatttggaatacttgcacat

SEQ ID NO: 563875 - DNA, 25 bp, Homo sapien
gaatacttgcacatgagcttacaag

SEQ ID NO: 563876 - DNA, 25 bp, Homo sapien
gcacatgagcttacaagttggagaa

SEQ ID NO: 563877 - DNA, 25 bp, Homo sapien
gagcttacaagttggagaatttctc

SEQ ID NO: 563878 - DNA, 25 bp, Homo sapien
taataatttctagtgatgggatgat

SEQ ID NO: 563879 - DNA, 25 bp, Homo sapien
gtgatgggatgattaagagactatt

SEQ ID NO: 563880 - DNA, 25 bp, Homo sapien
gagactattaaagctattacctctt

SEQ ID NO: 563881 - DNA, 25 bp, Homo sapien
aaagctattacctctttagagtcat

SEQ ID NO: 563882 - DNA, 25 bp, Homo sapien
tacctctttagagtcatgttcaaaa

SEQ ID NO: 563883 - DNA, 25 bp, Homo sapien
ctctttagagtcatgttcaaaataa

SEQ ID NO: 563884 - DNA, 25 bp, Homo sapien
tattagatctgaaaagggacttgtg

SEQ ID NO: 563885 - DNA, 25 bp, Homo sapien
ttaattttgtgttccctcattacag

SEQ ID NO: 563886 - DNA, 25 bp, Homo sapien
attttgtgttccctcattacagttt

SEQ ID NO: 563887 - DNA, 25 bp, Homo sapien
tttgtgttccctcattacagtttat

SEQ ID NO: 563888 - DNA, 25 bp, Homo sapien
gtttatcaaagtacattctgtatat

SEQ ID NO: 563889 - DNA, 25 bp, Homo sapien
catctggagatgaagcagtcgcagc

SEQ ID NO: 563890 - DNA, 25 bp, Homo sapien
cagtcgcagcggagcagtcttggta

SEQ ID NO: 563891 - DNA, 25 bp, Homo sapien
tcgcagcggagcagtcttggtaatg

SEQ ID NO: 563892 - DNA, 25 bp, Homo sapien
ctgagcaaggaagcttggagaagcc

SEQ ID NO: 563893 - DNA, 25 bp, Homo sapien
gatgcctggccagggctgaatgctc

SEQ ID NO: 563894 - DNA, 25 bp, Homo sapien
cctggccagggctgaatgctcagaa

SEQ ID NO: 563895 - DNA, 25 bp, Homo sapien
tggccagggctgaatgctcagaaat

SEQ ID NO: 563896 - DNA, 25 bp, Homo sapien
cagggctgaatgctcagaaatggaa

SEQ ID NO: 563897 - DNA, 25 bp, Homo sapien
gggaaagctcaggagattatcactg

SEQ ID NO: 563898 - DNA, 25 bp, Homo sapien
agctcaggagattatcactgaatca

SEQ ID NO: 563899 - DNA, 25 bp, Homo sapien
caggagattatcactgaatcaaagt

SEQ ID NO: 563900 - DNA, 25 bp, Homo sapien
ccaggacaacaaattagcaaataag

SEQ ID NO: 563901 - DNA, 25 bp, Homo sapien
caaataaggcaagttagaaagcagc

SEQ ID NO: 563902 - DNA, 25 bp, Homo sapien
atgacttctgaagggatcacacaaa

SEQ ID NO: 563903 - DNA, 25 bp, Homo sapien
ctgaagggatcacacaaacatcttt

SEQ ID NO: 563904 - DNA, 25 bp, Homo sapien
acaaacatctttaaagacttctttg

SEQ ID NO: 563905 - DNA, 25 bp, Homo sapien
agacttctttgttaatcagaaaaca

SEQ ID NO: 563906 - DNA, 25 bp, Homo sapien
ttacatgcaaatttccacactggag

SEQ ID NO: 563907 - DNA, 25 bp, Homo sapien
atgcaaatttccacactggagagcc

SEQ ID NO: 563908 - DNA, 25 bp, Homo sapien
agccgaccgagatcaatactttcat

SEQ ID NO: 563909 - DNA, 25 bp, Homo sapien
gaccgagatcaatactttcatgatt

SEQ ID NO: 563910 - DNA, 25 bp, Homo sapien
actttcatgattattcccaatttac

SEQ ID NO: 563911 - DNA, 25 bp, Homo sapien
caaacaattctaacaaacatggctg

SEQ ID NO: 563912 - DNA, 25 bp, Homo sapien
aacatggctgtttgatttccaactc

SEQ ID NO: 563913 - DNA, 25 bp, Homo sapien
ggctgtttgatttccaactccatag

SEQ ID NO: 563914 - DNA, 25 bp, Homo sapien
gtttgatttccaactccatagcaga

SEQ ID NO: 563915 - DNA, 25 bp, Homo sapien
tgatttccaactccatagcagactc

SEQ ID NO: 563916 - DNA, 25 bp, Homo sapien
ttccaactccatagcagactcagga

SEQ ID NO: 563917 - DNA, 25 bp, Homo sapien
actccatagcagactcaggaaggaa

SEQ ID NO: 563918 - DNA, 25 bp, Homo sapien
agataaaagtgtgtccattggcaga

SEQ ID NO: 563919 - DNA, 25 bp, Homo sapien
aaagtgtgtccattggcagaggact

SEQ ID NO: 563920 - DNA, 25 bp, Homo sapien
attggcagaggactaaaggagattt

SEQ ID NO: 563921 - DNA, 25 bp, Homo sapien
agatttgagcacctgtcagatgggt

SEQ ID NO: 563922 - DNA, 25 bp, Homo sapien
tgttagtggactacttacagaagca

SEQ ID NO: 563923 - DNA, 25 bp, Homo sapien
acaagagcctgttatgattgtgctt

SEQ ID NO: 563924 - DNA, 25 bp, Homo sapien
gtgctttgtgaacaagctgatctaa

SEQ ID NO: 563925 - DNA, 25 bp, Homo sapien
aagtgcttagtatcatgactgtcag

SEQ ID NO: 563926 - DNA, 25 bp, Homo sapien
agaaccattctgcaactgagtatga

SEQ ID NO: 563927 - DNA, 25 bp, Homo sapien
cacagaccagtgaggtgagctaatt

SEQ ID NO: 563928 - DNA, 25 bp, Homo sapien
gtgagctaattcatgttaaactgtt

SEQ ID NO: 563929 - DNA, 25 bp, Homo sapien
aactgttaggccactgctttgttaa

SEQ ID NO: 563930 - DNA, 25 bp, Homo sapien
ctgctttgttaatgactcctctaaa

SEQ ID NO: 563931 - DNA, 25 bp, Homo sapien
atgactcctctaaatgcatagtgtg

SEQ ID NO: 563932 - DNA, 25 bp, Homo sapien
gcatagtgtgatgcgatcctctggc

SEQ ID NO: 563933 - DNA, 25 bp, Homo sapien
attattttcttcatcagcaaagggt

SEQ ID NO: 563934 - DNA, 25 bp, Homo sapien
gcaaagggttaagagcagtttacac

SEQ ID NO: 563935 - DNA, 25 bp, Homo sapien
tacaccaaaccaagttaccaagcag

SEQ ID NO: 563936 - DNA, 25 bp, Homo sapien
aaccaagttaccaagcagatcacaa

SEQ ID NO: 563937 - DNA, 25 bp, Homo sapien
gcagatcacaatcagttcacaggtt

SEQ ID NO: 563938 - DNA, 25 bp, Homo sapien
tcacaggttggataagtcacggcac

SEQ ID NO: 563939 - DNA, 25 bp, Homo sapien
ataagtcacggcacgcaggccagaa

SEQ ID NO: 563940 - DNA, 25 bp, Homo sapien
gcacgcaggccagaaaatgtacttt

SEQ ID NO: 563941 - DNA, 25 bp, Homo sapien
cagcctagtctttaacttccggctt

SEQ ID NO: 563942 - DNA, 25 bp, Homo sapien
taacttccggctttaagcagtcctc

SEQ ID NO: 563943 - DNA, 25 bp, Homo sapien
aagtattgatattatgggcatgagc

SEQ ID NO: 563944 - DNA, 25 bp, Homo sapien
gtaaatattaccaagagagtacctc

SEQ ID NO: 563945 - DNA, 25 bp, Homo sapien
tattaccaagagagtacctcacttt

SEQ ID NO: 563946 - DNA, 25 bp, Homo sapien
caagagagtacctcactttaattac

SEQ ID NO: 563947 - DNA, 25 bp, Homo sapien
acctcactttaattactggcctgaa

SEQ ID NO: 563948 - DNA, 25 bp, Homo sapien
cactttaattactggcctgaacatt

SEQ ID NO: 563949 - DNA, 25 bp, Homo sapien
ttaattactggcctgaacattggtt

SEQ ID NO: 563950 - DNA, 25 bp, Homo sapien
attactggcctgaacattggtttca

SEQ ID NO: 563951 - DNA, 25 bp, Homo sapien
actggcctgaacattggtttcaatt

SEQ ID NO: 563952 - DNA, 25 bp, Homo sapien
ggcctgaacattggtttcaatttac

SEQ ID NO: 563953 - DNA, 25 bp, Homo sapien
attggtttcaatttacatgtatttt

SEQ ID NO: 563954 - DNA, 25 bp, Homo sapien
aattagccacagaagggttcaccta

SEQ ID NO: 563955 - DNA, 25 bp, Homo sapien
aaaggagaaagacctggagctgcac

SEQ ID NO: 563956 - DNA, 25 bp, Homo sapien
aggccaggaggacacactccacccc

SEQ ID NO: 563957 - DNA, 25 bp, Homo sapien
aggaggacacactccaccccgacct

SEQ ID NO: 563958 - DNA, 25 bp, Homo sapien
aggacacactccaccccgaccttag

SEQ ID NO: 563959 - DNA, 25 bp, Homo sapien
gaccttagcccaaggggctttcagg

SEQ ID NO: 563960 - DNA, 25 bp, Homo sapien
gggctttcaggaaataaaggagcta

SEQ ID NO: 563961 - DNA, 25 bp, Homo sapien
aagcatggaatgcaagtccctgccc

SEQ ID NO: 563962 - DNA, 25 bp, Homo sapien
cccaggagatgtggccagtcccaag

SEQ ID NO: 563963 - DNA, 25 bp, Homo sapien
ccaggagatgtggccagtcccaagc

SEQ ID NO: 563964 - DNA, 25 bp, Homo sapien
tggccagtcccaagcccctaaaagg

SEQ ID NO: 563965 - DNA, 25 bp, Homo sapien
gccagtcccaagcccctaaaaggag

SEQ ID NO: 563966 - DNA, 25 bp, Homo sapien
aagaagttactatccagttgtacag

SEQ ID NO: 563967 - DNA, 25 bp, Homo sapien
gttactatccagttgtacagaaaag

SEQ ID NO: 563968 - DNA, 25 bp, Homo sapien
caaaaatttaatcacatgggtagtt

SEQ ID NO: 563969 - DNA, 25 bp, Homo sapien
ttttttagctatgggttcatgctgt

SEQ ID NO: 563970 - DNA, 25 bp, Homo sapien
ctatgggttcatgctgtatttggtt

SEQ ID NO: 563971 - DNA, 25 bp, Homo sapien
atgggttcatgctgtatttggttgc

SEQ ID NO: 563972 - DNA, 25 bp, Homo sapien
gttcatgctgtatttggttgcatca

SEQ ID NO: 563973 - DNA, 25 bp, Homo sapien
atgctgtatttggttgcatcatatt

SEQ ID NO: 563974 - DNA, 25 bp, Homo sapien
agaagcttccaacttagcatgaaat

SEQ ID NO: 563975 - DNA, 25 bp, Homo sapien
gcttccaacttagcatgaaatacct

SEQ ID NO: 563976 - DNA, 25 bp, Homo sapien
gcatgaaatacctaaagacaatttt

SEQ ID NO: 563977 - DNA, 25 bp, Homo sapien
aataagtctttgtctccattacaaa

SEQ ID NO: 563978 - DNA, 25 bp, Homo sapien
gtctccattacaaaacaaatctcag

SEQ ID NO: 563979 - DNA, 25 bp, Homo sapien
caaatctcagagctaccttcaaaga

SEQ ID NO: 563980 - DNA, 25 bp, Homo sapien
atctcagagctaccttcaaagaaga

SEQ ID NO: 563981 - DNA, 25 bp, Homo sapien
gccctcagttggtgaatgaagatac

SEQ ID NO: 563982 - DNA, 25 bp, Homo sapien
atactttgacattttcctatgagca

SEQ ID NO: 563983 - DNA, 25 bp, Homo sapien
gacattttcctatgagcatggtgaa

SEQ ID NO: 563984 - DNA, 25 bp, Homo sapien
tcctatgagcatggtgaaacaggtt

SEQ ID NO: 563985 - DNA, 25 bp, Homo sapien
aatagcttgaagcaatccttattgg

SEQ ID NO: 563986 - DNA, 25 bp, Homo sapien
gaagcaatccttattgggaattaca

SEQ ID NO: 563987 - DNA, 25 bp, Homo sapien
caaggtggaattttagtcacaggaa

SEQ ID NO: 563988 - DNA, 25 bp, Homo sapien
tgattccatgataaggctatttgtc

SEQ ID NO: 563989 - DNA, 25 bp, Homo sapien
aaggaacttccacatagcccagaga

SEQ ID NO: 563990 - DNA, 25 bp, Homo sapien
ggaacttccacatagcccagagaaa

SEQ ID NO: 563991 - DNA, 25 bp, Homo sapien
ctttttcaagtttacagagtcaatt

SEQ ID NO: 563992 - DNA, 25 bp, Homo sapien
ttgaaattcaatctcctgatcccca

SEQ ID NO: 563993 - DNA, 25 bp, Homo sapien
gatccccagtctattgggagttctt

SEQ ID NO: 563994 - DNA, 25 bp, Homo sapien
ccagtctattgggagttctttcaga

SEQ ID NO: 563995 - DNA, 25 bp, Homo sapien
gagttctttcagaatgtcccttgac

SEQ ID NO: 563996 - DNA, 25 bp, Homo sapien
ttcagaatgtcccttgactgtccct

SEQ ID NO: 563997 - DNA, 25 bp, Homo sapien
ttgactgtccctcaaagtgccagca

SEQ ID NO: 563998 - DNA, 25 bp, Homo sapien
gtccctcaaagtgccagcatgtatg

SEQ ID NO: 563999 - DNA, 25 bp, Homo sapien
gatctaaagttctggctgtccatta

SEQ ID NO: 564000 - DNA, 25 bp, Homo sapien
atctaaagttctggctgtccattaa

SEQ ID NO: 564001 - DNA, 25 bp, Homo sapien
ctaaagttctggctgtccattaacc

SEQ ID NO: 564002 - DNA, 25 bp, Homo sapien
ctggtgtgtatcaacattatttaat

SEQ ID NO: 564003 - DNA, 25 bp, Homo sapien
tggtgtgtatcaacattatttaatg

SEQ ID NO: 564004 - DNA, 25 bp, Homo sapien
ggtgtgtatcaacattatttaatgt

SEQ ID NO: 564005 - DNA, 25 bp, Homo sapien
gtgtgtatcaacattatttaatgtc

SEQ ID NO: 564006 - DNA, 25 bp, Homo sapien
gtgtatcaacattatttaatgtctt

SEQ ID NO: 564007 - DNA, 25 bp, Homo sapien
gtatcaacattatttaatgtcttct

SEQ ID NO: 564008 - DNA, 25 bp, Homo sapien
taagtatgtctataaacattgaact

SEQ ID NO: 564009 - DNA, 25 bp, Homo sapien
aagtatgtctataaacattgaactt

SEQ ID NO: 564010 - DNA, 25 bp, Homo sapien
tagtgagaccttctcccctcttcaa

SEQ ID NO: 564011 - DNA, 25 bp, Homo sapien
agtgagaccttctcccctcttcaaa

SEQ ID NO: 564012 - DNA, 25 bp, Homo sapien
tctcccctcttcaaaccgacagaaa

SEQ ID NO: 564013 - DNA, 25 bp, Homo sapien
aattaaccgggcagctggacgtggt

SEQ ID NO: 564014 - DNA, 25 bp, Homo sapien
attaaccgggcagctggacgtggtg

SEQ ID NO: 564015 - DNA, 25 bp, Homo sapien
ttaaccgggcagctggacgtggtgg

SEQ ID NO: 564016 - DNA, 25 bp, Homo sapien
ggacgtggtggtgcaggtctgcagt

SEQ ID NO: 564017 - DNA, 25 bp, Homo sapien
gtggtggtgcaggtctgcagtccca

SEQ ID NO: 564018 - DNA, 25 bp, Homo sapien
gctactcttgaaggctgagctggga

SEQ ID NO: 564019 - DNA, 25 bp, Homo sapien
agtgagcagtaatcccgccactgca

SEQ ID NO: 564020 - DNA, 25 bp, Homo sapien
gtgagcagtaatcccgccactgcac

SEQ ID NO: 564021 - DNA, 25 bp, Homo sapien
ttgctgaaacccgggagtcagaggc

SEQ ID NO: 564022 - DNA, 25 bp, Homo sapien
tgctgaaacccgggagtcagaggct

SEQ ID NO: 564023 - DNA, 25 bp, Homo sapien
gctgaaacccgggagtcagaggctg

SEQ ID NO: 564024 - DNA, 25 bp, Homo sapien
ctgaaacccgggagtcagaggctgc

SEQ ID NO: 564025 - DNA, 25 bp, Homo sapien
tgaaacccgggagtcagaggctgca

SEQ ID NO: 564026 - DNA, 25 bp, Homo sapien
ctgcagagagccgagactgggccac

SEQ ID NO: 564027 - DNA, 25 bp, Homo sapien
tgcagagagccgagactgggccact

SEQ ID NO: 564028 - DNA, 25 bp, Homo sapien
gcagagagccgagactgggccactg

SEQ ID NO: 564029 - DNA, 25 bp, Homo sapien
cagagagccgagactgggccactgc

SEQ ID NO: 564030 - DNA, 25 bp, Homo sapien
agagagccgagactgggccactgca

SEQ ID NO: 564031 - DNA, 25 bp, Homo sapien
gagagccgagactgggccactgcac

SEQ ID NO: 564032 - DNA, 25 bp, Homo sapien
aatgttaacttccatctgtgtgtgt

SEQ ID NO: 564033 - DNA, 25 bp, Homo sapien
gtgagcgcacctgtgcgtgtgcaca

SEQ ID NO: 564034 - DNA, 25 bp, Homo sapien
gctttgggaatctcttactagccaa

SEQ ID NO: 564035 - DNA, 25 bp, Homo sapien
gggaatctcttactagccaaagttg

SEQ ID NO: 564036 - DNA, 25 bp, Homo sapien
tagccaaagttgctccgtggtttca

SEQ ID NO: 564037 - DNA, 25 bp, Homo sapien
tgctccgtggtttcaacagttgggc

SEQ ID NO: 564038 - DNA, 25 bp, Homo sapien
gtttcaacagttgggctgtgtttgc

SEQ ID NO: 564039 - DNA, 25 bp, Homo sapien
gggaatactgaacacacccggcttt

SEQ ID NO: 564040 - DNA, 25 bp, Homo sapien
ttggttttccagtgacaagttagtc

SEQ ID NO: 564041 - DNA, 25 bp, Homo sapien
gtaaacattctacaagaacacagtt

SEQ ID NO: 564042 - DNA, 25 bp, Homo sapien
acacagttattttgagttcacttaa

SEQ ID NO: 564043 - DNA, 25 bp, Homo sapien
gttacatgaaatagtgccagctgga

SEQ ID NO: 564044 - DNA, 25 bp, Homo sapien
agctggaggttctttgccagcacca

SEQ ID NO: 564045 - DNA, 25 bp, Homo sapien
atttactctctctattatacaccag

SEQ ID NO: 564046 - DNA, 25 bp, Homo sapien
tatacaccagtgtgtgcctgcagca

SEQ ID NO: 564047 - DNA, 25 bp, Homo sapien
agcctccacagccacgatgggtttg

SEQ ID NO: 564048 - DNA, 25 bp, Homo sapien
agccacgatgggtttgtttctgttt

SEQ ID NO: 564049 - DNA, 25 bp, Homo sapien
ggagagcaggtttcagatccttact

SEQ ID NO: 564050 - DNA, 25 bp, Homo sapien
aggtttcagatccttacttgccgag

SEQ ID NO: 564051 - DNA, 25 bp, Homo sapien
cttgccgagccgtttgtttaggtag

SEQ ID NO: 564052 - DNA, 25 bp, Homo sapien
caaagagtgtgtgggctttcctgtt

SEQ ID NO: 564053 - DNA, 25 bp, Homo sapien
ctgtttctaaactttcgctactata

SEQ ID NO: 564054 - DNA, 25 bp, Homo sapien
cagagacatctatttttctgggctc

SEQ ID NO: 564055 - DNA, 25 bp, Homo sapien
ttttctgggctccaacccaacatgc

SEQ ID NO: 564056 - DNA, 25 bp, Homo sapien
gccaccatgttgacataagttccta

SEQ ID NO: 564057 - DNA, 25 bp, Homo sapien
taagttcctacctgactatgctttc

SEQ ID NO: 564058 - DNA, 25 bp, Homo sapien
tatgctttctctcctaggagctgtc

SEQ ID NO: 564059 - DNA, 25 bp, Homo sapien
tggtgggcccaggtccttgtatcat

SEQ ID NO: 564060 - DNA, 25 bp, Homo sapien
ggtcccaactacagggtcctagctg

SEQ ID NO: 564061 - DNA, 25 bp, Homo sapien
accagcctgtccctgttgtaaggaa

SEQ ID NO: 564062 - DNA, 25 bp, Homo sapien
taaggaagccaggtcttctctcttc

SEQ ID NO: 564063 - DNA, 25 bp, Homo sapien
ttctctcttcattcctcttaggaga

SEQ ID NO: 564064 - DNA, 25 bp, Homo sapien
taggagagtgccaaactcagggacc

SEQ ID NO: 564065 - DNA, 25 bp, Homo sapien
cagtgagactcaaagtaagtgcaag

SEQ ID NO: 564066 - DNA, 25 bp, Homo sapien
gagactcaaagtaagtgcaaggccc

SEQ ID NO: 564067 - DNA, 25 bp, Homo sapien
agactcaaagtaagtgcaaggccct

SEQ ID NO: 564068 - DNA, 25 bp, Homo sapien
gactcaaagtaagtgcaaggccctc

SEQ ID NO: 564069 - DNA, 25 bp, Homo sapien
actcaaagtaagtgcaaggccctcc

SEQ ID NO: 564070 - DNA, 25 bp, Homo sapien
ctcaaagtaagtgcaaggccctcct

SEQ ID NO: 564071 - DNA, 25 bp, Homo sapien
tcaaagtaagtgcaaggccctcctc

SEQ ID NO: 564072 - DNA, 25 bp, Homo sapien
caaagtaagtgcaaggccctcctca

SEQ ID NO: 564073 - DNA, 25 bp, Homo sapien
aaagtaagtgcaaggccctcctcac

SEQ ID NO: 564074 - DNA, 25 bp, Homo sapien
aagtaagtgcaaggccctcctcaca

SEQ ID NO: 564075 - DNA, 25 bp, Homo sapien
taagtgcaaggccctcctcacacat

SEQ ID NO: 564076 - DNA, 25 bp, Homo sapien
gggatatcatctggttctggagaca

SEQ ID NO: 564077 - DNA, 25 bp, Homo sapien
catctggttctggagacagcctgta

SEQ ID NO: 564078 - DNA, 25 bp, Homo sapien
gagacagcctgtatttcttggatct

SEQ ID NO: 564079 - DNA, 25 bp, Homo sapien
gtatttcttggatcttggcttcctt

SEQ ID NO: 564080 - DNA, 25 bp, Homo sapien
gatcttggcttccttccatcttcaa

SEQ ID NO: 564081 - DNA, 25 bp, Homo sapien
aacgatgaccagtgtagactttcta

SEQ ID NO: 564082 - DNA, 25 bp, Homo sapien
gactttctatgctgcttcaatctga

SEQ ID NO: 564083 - DNA, 25 bp, Homo sapien
ttcaatctgacatggagtccctgcc

SEQ ID NO: 564084 - DNA, 25 bp, Homo sapien
tgccttccacatctaaagtaccctt

SEQ ID NO: 564085 - DNA, 25 bp, Homo sapien
tctaaagtacccttgcaattacatt

SEQ ID NO: 564086 - DNA, 25 bp, Homo sapien
tacattggccaagataacccagaat

SEQ ID NO: 564087 - DNA, 25 bp, Homo sapien
aggccaggaggacacactccacccc

SEQ ID NO: 564088 - DNA, 25 bp, Homo sapien
ggccaggaggacacactccaccccg

SEQ ID NO: 564089 - DNA, 25 bp, Homo sapien
gccaggaggacacactccaccccga

SEQ ID NO: 564090 - DNA, 25 bp, Homo sapien
aggaggacacactccaccccgacct

SEQ ID NO: 564091 - DNA, 25 bp, Homo sapien
ggaggacacactccaccccgacctt

SEQ ID NO: 564092 - DNA, 25 bp, Homo sapien
aggacacactccaccccgaccttag

SEQ ID NO: 564093 - DNA, 25 bp, Homo sapien
cactccaccccgaccttagcccaag

SEQ ID NO: 564094 - DNA, 25 bp, Homo sapien
ttcaggaaataaaggagctattttg

SEQ ID NO: 564095 - DNA, 25 bp, Homo sapien
cccaggagatgtggccagtcccaag

SEQ ID NO: 564096 - DNA, 25 bp, Homo sapien
ccaggagatgtggccagtcccaagc

SEQ ID NO: 564097 - DNA, 25 bp, Homo sapien
gccagtcccaagcccctaaaaggag

SEQ ID NO: 564098 - DNA, 25 bp, Homo sapien
gttttcaaatctattctctatgagt

SEQ ID NO: 564099 - DNA, 25 bp, Homo sapien
gtagtttgtttataagccggtactg

SEQ ID NO: 564100 - DNA, 25 bp, Homo sapien
ataagccggtactggttgttgaaag

SEQ ID NO: 564101 - DNA, 25 bp, Homo sapien
gaaaggcaacttcatattatgtaaa

SEQ ID NO: 564102 - DNA, 25 bp, Homo sapien
agtccaactgactcataacctgaag

SEQ ID NO: 564103 - DNA, 25 bp, Homo sapien
ttgacagatgagatagacctaggat

SEQ ID NO: 564104 - DNA, 25 bp, Homo sapien
agacctaggatagtaactgcactta

SEQ ID NO: 564105 - DNA, 25 bp, Homo sapien
gatagtaactgcacttagtatttca

SEQ ID NO: 564106 - DNA, 25 bp, Homo sapien
tagtatttcatagcactttacagtg

SEQ ID NO: 564107 - DNA, 25 bp, Homo sapien
cactttacagtgtgcaaatgcttga

SEQ ID NO: 564108 - DNA, 25 bp, Homo sapien
aatccaataaagactccatgagaca

SEQ ID NO: 564109 - DNA, 25 bp, Homo sapien
gtagagatactaggttactccgtgg

SEQ ID NO: 564110 - DNA, 25 bp, Homo sapien
agatactaggttactccgtggtgag

SEQ ID NO: 564111 - DNA, 25 bp, Homo sapien
ctaggttactccgtggtgaggcttg

SEQ ID NO: 564112 - DNA, 25 bp, Homo sapien
cccaatgactagatatgtcttaatt

SEQ ID NO: 564113 - DNA, 25 bp, Homo sapien
taatttgtaagacggctctctccca

SEQ ID NO: 564114 - DNA, 25 bp, Homo sapien
tttgtaagacggctctctcccatgt

SEQ ID NO: 564115 - DNA, 25 bp, Homo sapien
atgtgactttctctcctctacctat

SEQ ID NO: 564116 - DNA, 25 bp, Homo sapien
tttctctcctctacctatgtcaact

SEQ ID NO: 564117 - DNA, 25 bp, Homo sapien
ctatgtcaactttgtgttgggagtg

SEQ ID NO: 564118 - DNA, 25 bp, Homo sapien
actttgtgttgggagtgttcaggac

SEQ ID NO: 564119 - DNA, 25 bp, Homo sapien
tgtgttgggagtgttcaggacaata

SEQ ID NO: 564120 - DNA, 25 bp, Homo sapien
gtcgaaatgcctttactcttggcag

SEQ ID NO: 564121 - DNA, 25 bp, Homo sapien
aaatgcctttactcttggcaggaca

SEQ ID NO: 564122 - DNA, 25 bp, Homo sapien
gcctttactcttggcaggacacaag

SEQ ID NO: 564123 - DNA, 25 bp, Homo sapien
ggacacaagcgccataacctaagag

SEQ ID NO: 564124 - DNA, 25 bp, Homo sapien
caagcgccataacctaagaggatgt

SEQ ID NO: 564125 - DNA, 25 bp, Homo sapien
tgatttgagtggagttttcatgccc

SEQ ID NO: 564126 - DNA, 25 bp, Homo sapien
ttttcatgccctgtgtgcttattgt

SEQ ID NO: 564127 - DNA, 25 bp, Homo sapien
gccctgtgtgcttattgtattcttg

SEQ ID NO: 564128 - DNA, 25 bp, Homo sapien
gtgcttattgtattcttgctactga

SEQ ID NO: 564129 - DNA, 25 bp, Homo sapien
gtattcttgctactgatgcaaacat

SEQ ID NO: 564130 - DNA, 25 bp, Homo sapien
aaaattgcaggctttgtggaacaaa

SEQ ID NO: 564131 - DNA, 25 bp, Homo sapien
gtgaacttatcactagtcccagatc

SEQ ID NO: 564132 - DNA, 25 bp, Homo sapien
cactagtcccagatcatgtgatcct

SEQ ID NO: 564133 - DNA, 25 bp, Homo sapien
atgtgatccttagagcagcaagctt

SEQ ID NO: 564134 - DNA, 25 bp, Homo sapien
atgaaaggtaattctccaaactcct

SEQ ID NO: 564135 - DNA, 25 bp, Homo sapien
gtaattctccaaactccttttgtat

SEQ ID NO: 564136 - DNA, 25 bp, Homo sapien
caaactccttttgtatgcagtgtgt

SEQ ID NO: 564137 - DNA, 25 bp, Homo sapien
ctccttttgtatgcagtgtgtaatt

SEQ ID NO: 564138 - DNA, 25 bp, Homo sapien
ttatcaaatctcaggactagtttaa

SEQ ID NO: 564139 - DNA, 25 bp, Homo sapien
atctcaggactagtttaaattccag

SEQ ID NO: 564140 - DNA, 25 bp, Homo sapien
ttccagtaatttaagctgtatgtta

SEQ ID NO: 564141 - DNA, 25 bp, Homo sapien
aagctgtatgttatcctatttgtaa

SEQ ID NO: 564142 - DNA, 25 bp, Homo sapien
cagaattcaaacagtgggccggcaa

SEQ ID NO: 564143 - DNA, 25 bp, Homo sapien
gggccggcaaagagctgtaaaagtt

SEQ ID NO: 564144 - DNA, 25 bp, Homo sapien
gagcaggccagactctgtagttcgt

SEQ ID NO: 564145 - DNA, 25 bp, Homo sapien
ctgtagttcgttgttggtcgtgttt

SEQ ID NO: 564146 - DNA, 25 bp, Homo sapien
taatgaatcaggaccgcgaaccgaa

SEQ ID NO: 564147 - DNA, 25 bp, Homo sapien
gaccgcgaaccgaaagaacgcacaa

SEQ ID NO: 564148 - DNA, 25 bp, Homo sapien
gaacgcacaaaattctgtcctgaaa

SEQ ID NO: 564149 - DNA, 25 bp, Homo sapien
aaacacgaaaacctgagccagccgt

SEQ ID NO: 564150 - DNA, 25 bp, Homo sapien
tgcttctctgctgtaggtcgactgt

SEQ ID NO: 564151 - DNA, 25 bp, Homo sapien
gctgtaggtcgactgtgctaagaat

SEQ ID NO: 564152 - DNA, 25 bp, Homo sapien
ttaaccattttctgcttcacagaat

SEQ ID NO: 564153 - DNA, 25 bp, Homo sapien
acctccaaaggcctggcaacatgcg

SEQ ID NO: 564154 - DNA, 25 bp, Homo sapien
aaaggcctggcaacatgcgagggct

SEQ ID NO: 564155 - DNA, 25 bp, Homo sapien
gcctggcaacatgcgagggcttcat

SEQ ID NO: 564156 - DNA, 25 bp, Homo sapien
ggcaacatgcgagggcttcatagcc

SEQ ID NO: 564157 - DNA, 25 bp, Homo sapien
atgcgagggcttcatagccaccctc

SEQ ID NO: 564158 - DNA, 25 bp, Homo sapien
ccacctgtcaatgccacatgtgatg

SEQ ID NO: 564159 - DNA, 25 bp, Homo sapien
gtcaatgccacatgtgatgtcatcc

SEQ ID NO: 564160 - DNA, 25 bp, Homo sapien
tcatccttgctctctggttgctgag

SEQ ID NO: 564161 - DNA, 25 bp, Homo sapien
tccttgctctctggttgctgagcaa

SEQ ID NO: 564162 - DNA, 25 bp, Homo sapien
agcctggagaccaaaggcccctggg

SEQ ID NO: 564163 - DNA, 25 bp, Homo sapien
cctggagaccaaaggcccctgggca

SEQ ID NO: 564164 - DNA, 25 bp, Homo sapien
agcagggcatccactcgattctttg

SEQ ID NO: 564165 - DNA, 25 bp, Homo sapien
atccactcgattctttgtaccttaa

SEQ ID NO: 564166 - DNA, 25 bp, Homo sapien
aaataggaattctttgaggagctca

SEQ ID NO: 564167 - DNA, 25 bp, Homo sapien
gaggagctcagtgtatctctcaact

SEQ ID NO: 564168 - DNA, 25 bp, Homo sapien
gtgtatctctcaactgaagcagctg

SEQ ID NO: 564169 - DNA, 25 bp, Homo sapien
gaagcagctgcctgcatcctacagg

SEQ ID NO: 564170 - DNA, 25 bp, Homo sapien
aagcccagcactgtgttttctgatg

SEQ ID NO: 564171 - DNA, 25 bp, Homo sapien
aatgttgctttggtgatcatcagta

SEQ ID NO: 564172 - DNA, 25 bp, Homo sapien
gtagtgtctggaactctgcaaggga

SEQ ID NO: 564173 - DNA, 25 bp, Homo sapien
aggagtgtccctgtgagagctgtac

SEQ ID NO: 564174 - DNA, 25 bp, Homo sapien
agagctgtactgtgtcctgagttaa

SEQ ID NO: 564175 - DNA, 25 bp, Homo sapien
aaggaattccttccttctcaagctg

SEQ ID NO: 564176 - DNA, 25 bp, Homo sapien
tctcaagctgtaggtgtcaggcttt

SEQ ID NO: 564177 - DNA, 25 bp, Homo sapien
gacagtggattttctactccttcag

SEQ ID NO: 564178 - DNA, 25 bp, Homo sapien
gattttctactccttcagcaaactt

SEQ ID NO: 564179 - DNA, 25 bp, Homo sapien
ctactccttcagcaaactttctgga

SEQ ID NO: 564180 - DNA, 25 bp, Homo sapien
agcaaactttctggaaaccccatca

SEQ ID NO: 564181 - DNA, 25 bp, Homo sapien
aactttctggaaaccccatcacctg

SEQ ID NO: 564182 - DNA, 25 bp, Homo sapien
atcacctgccacgtgtgtgtggagg

SEQ ID NO: 564183 - DNA, 25 bp, Homo sapien
gctgtgtgggtatacaaaggcgaat

SEQ ID NO: 564184 - DNA, 25 bp, Homo sapien
aattaagatgtgatcctgggtcagg

SEQ ID NO: 564185 - DNA, 25 bp, Homo sapien
gggtcagggacagtggctgccacct

SEQ ID NO: 564186 - DNA, 25 bp, Homo sapien
cagaggctgccatgcttgcacaatg

SEQ ID NO: 564187 - DNA, 25 bp, Homo sapien
gcttgcacaatgtgacactgtctct

SEQ ID NO: 564188 - DNA, 25 bp, Homo sapien
gtgacactgtctctatggacacatt

SEQ ID NO: 564189 - DNA, 25 bp, Homo sapien
ggacacattaattggtcctgatgta

SEQ ID NO: 564190 - DNA, 25 bp, Homo sapien
tcctgatgtagaacttgacccaaga

SEQ ID NO: 564191 - DNA, 25 bp, Homo sapien
tgtagaacttgacccaagatcaggg

SEQ ID NO: 564192 - DNA, 25 bp, Homo sapien
tttccaggtgtttcaataacatgta

SEQ ID NO: 564193 - DNA, 25 bp, Homo sapien
aacatgtaaaacttggaattcgata

SEQ ID NO: 564194 - DNA, 25 bp, Homo sapien
tggaattcgatagcagccatcttct

SEQ ID NO: 564195 - DNA, 25 bp, Homo sapien
atagcagccatcttctgccatgaga

SEQ ID NO: 564196 - DNA, 25 bp, Homo sapien
ggaagagagaaagcctatagtgata

SEQ ID NO: 564197 - DNA, 25 bp, Homo sapien
gggagattctgcctggcccaactca

SEQ ID NO: 564198 - DNA, 25 bp, Homo sapien
ggagattctgcctggcccaactcag

SEQ ID NO: 564199 - DNA, 25 bp, Homo sapien
tggcccaactcaggcggtgactgca

SEQ ID NO: 564200 - DNA, 25 bp, Homo sapien
aactcaggcggtgactgcagcagga

SEQ ID NO: 564201 - DNA, 25 bp, Homo sapien
gtgcagtcggaagaaaggtcttgct

SEQ ID NO: 564202 - DNA, 25 bp, Homo sapien
ggaagaaaggtcttgctgagcaaac

SEQ ID NO: 564203 - DNA, 25 bp, Homo sapien
gtcttgctgagcaaacgggacccaa

SEQ ID NO: 564204 - DNA, 25 bp, Homo sapien
aacgggacccaaagagggatgtgca

SEQ ID NO: 564205 - DNA, 25 bp, Homo sapien
gggatgtgcaagatctggaaacaac

SEQ ID NO: 564206 - DNA, 25 bp, Homo sapien
gatgtgcaagatctggaaacaacaa

SEQ ID NO: 564207 - DNA, 25 bp, Homo sapien
tggttttcaaactcaatagtcccct

SEQ ID NO: 564208 - DNA, 25 bp, Homo sapien
cgaggaagggaaagctggaaatcca

SEQ ID NO: 564209 - DNA, 25 bp, Homo sapien
gctggaaatccaggtgtgaattgat

SEQ ID NO: 564210 - DNA, 25 bp, Homo sapien
atccaggtgtgaattgatggtcttc

SEQ ID NO: 564211 - DNA, 25 bp, Homo sapien
gtgtgaattgatggtcttctggctt

SEQ ID NO: 564212 - DNA, 25 bp, Homo sapien
gtgaattgatggtcttctggctttc

SEQ ID NO: 564213 - DNA, 25 bp, Homo sapien
gaattgatggtcttctggctttcca

SEQ ID NO: 564214 - DNA, 25 bp, Homo sapien
aattgatggtcttctggctttccag

SEQ ID NO: 564215 - DNA, 25 bp, Homo sapien
ctcccgcatcataaatctcagcatt

SEQ ID NO: 564216 - DNA, 25 bp, Homo sapien
tcccgcatcataaatctcagcattt

SEQ ID NO: 564217 - DNA, 25 bp, Homo sapien
cgcatcataaatctcagcatttaaa

SEQ ID NO: 564218 - DNA, 25 bp, Homo sapien
ttaaaaataactgcaagctgggtgt

SEQ ID NO: 564219 - DNA, 25 bp, Homo sapien
gggagcaatatgttctgtgaaaata

SEQ ID NO: 564220 - DNA, 25 bp, Homo sapien
tcttgaaattgtacaccaaaacctt

SEQ ID NO: 564221 - DNA, 25 bp, Homo sapien
cttacaaccaacttatttgaacatt

SEQ ID NO: 564222 - DNA, 25 bp, Homo sapien
gctgcaatctcagtgcctgagggaa

SEQ ID NO: 564223 - DNA, 25 bp, Homo sapien
cagtgcctgagggaagatgcctagt

SEQ ID NO: 564224 - DNA, 25 bp, Homo sapien
gatgcctagtagaggaaagcttaat

SEQ ID NO: 564225 - DNA, 25 bp, Homo sapien
gtagaggaaagcttaatactctttt

SEQ ID NO: 564226 - DNA, 25 bp, Homo sapien
tttcctgaaagaatatcatcctctg

SEQ ID NO: 564227 - DNA, 25 bp, Homo sapien
tgaaagaatatcatcctctgcatta

SEQ ID NO: 564228 - DNA, 25 bp, Homo sapien
atcatcctctgcattatccccatgg

SEQ ID NO: 564229 - DNA, 25 bp, Homo sapien
gaacgtttcactttaaccctgactg

SEQ ID NO: 564230 - DNA, 25 bp, Homo sapien
gtcggtgttaggtttgctgtatatc

SEQ ID NO: 564231 - DNA, 25 bp, Homo sapien
tcggtgttaggtttgctgtatatca

SEQ ID NO: 564232 - DNA, 25 bp, Homo sapien
cggtgttaggtttgctgtatatcag

SEQ ID NO: 564233 - DNA, 25 bp, Homo sapien
ggtgttaggtttgctgtatatcagg

SEQ ID NO: 564234 - DNA, 25 bp, Homo sapien
tgctgtatatcaggtacatgaaccc

SEQ ID NO: 564235 - DNA, 25 bp, Homo sapien
gctgtatatcaggtacatgaaccca

SEQ ID NO: 564236 - DNA, 25 bp, Homo sapien
ctgtatatcaggtacatgaacccaa

SEQ ID NO: 564237 - DNA, 25 bp, Homo sapien
tgtatatcaggtacatgaacccaaa

SEQ ID NO: 564238 - DNA, 25 bp, Homo sapien
gtatatcaggtacatgaacccaaaa

SEQ ID NO: 564239 - DNA, 25 bp, Homo sapien
atatcaggtacatgaacccaaaatt

SEQ ID NO: 564240 - DNA, 25 bp, Homo sapien
atcaggtacatgaacccaaaatttg

SEQ ID NO: 564241 - DNA, 25 bp, Homo sapien
gcctggccactctgttagaggaagt

SEQ ID NO: 564242 - DNA, 25 bp, Homo sapien
gttagaggaagtctccacggtccct

SEQ ID NO: 564243 - DNA, 25 bp, Homo sapien
tcattacatcttcaccattctcaac

SEQ ID NO: 564244 - DNA, 25 bp, Homo sapien
cagggcgtcttcatcctattgtttg

SEQ ID NO: 564245 - DNA, 25 bp, Homo sapien
ctattgtttggttgcctcatggaca

SEQ ID NO: 564246 - DNA, 25 bp, Homo sapien
ggttgcctcatggacaggaagatac

SEQ ID NO: 564247 - DNA, 25 bp, Homo sapien
gatacaagaagctttgcgcaaacgc

SEQ ID NO: 564248 - DNA, 25 bp, Homo sapien
aagctttgcgcaaacgcttctgccg

SEQ ID NO: 564249 - DNA, 25 bp, Homo sapien
atctccctggtgagttgctgccttc

SEQ ID NO: 564250 - DNA, 25 bp, Homo sapien
cttcagatcctcagctgtgcatcca

SEQ ID NO: 564251 - DNA, 25 bp, Homo sapien
atgtcagaaggcattccatggccct

SEQ ID NO: 564252 - DNA, 25 bp, Homo sapien
tgttaaattccttttacagtaatgc

SEQ ID NO: 564253 - DNA, 25 bp, Homo sapien
aattccttttacagtaatgccaaag

SEQ ID NO: 564254 - DNA, 25 bp, Homo sapien
acagtaatgccaaagatttaaggat

SEQ ID NO: 564255 - DNA, 25 bp, Homo sapien
gatttaaggattacattatctggat

SEQ ID NO: 564256 - DNA, 25 bp, Homo sapien
cattatctggatgtgttttcttttg

SEQ ID NO: 564257 - DNA, 25 bp, Homo sapien
gtgttttcttttggcaccataactt

SEQ ID NO: 564258 - DNA, 25 bp, Homo sapien
tcttttggcaccataacttaaggtc

SEQ ID NO: 564259 - DNA, 25 bp, Homo sapien
ggcaccataacttaaggtcatgttg

SEQ ID NO: 564260 - DNA, 25 bp, Homo sapien
cttaaggtcatgttgaattagtcaa

SEQ ID NO: 564261 - DNA, 25 bp, Homo sapien
gtattattcacattgcacttttgat

SEQ ID NO: 564262 - DNA, 25 bp, Homo sapien
acattgcacttttgatgtgatggag

SEQ ID NO: 564263 - DNA, 25 bp, Homo sapien
tatcacttggtgtctgtatattgtc

SEQ ID NO: 564264 - DNA, 25 bp, Homo sapien
gtatattgtcctatccatatttaca

SEQ ID NO: 564265 - DNA, 25 bp, Homo sapien
gtcctatccatatttacaatttatt

SEQ ID NO: 564266 - DNA, 25 bp, Homo sapien
atatgatgtccttacaatcttgatg

SEQ ID NO: 564267 - DNA, 25 bp, Homo sapien
tgatgtccttacaatcttgatgatg

SEQ ID NO: 564268 - DNA, 25 bp, Homo sapien
aatcttgatgatggactgtctatat

SEQ ID NO: 564269 - DNA, 25 bp, Homo sapien
agagatgtacatcctagtcacttgt

SEQ ID NO: 564270 - DNA, 25 bp, Homo sapien
gtacatcctagtcacttgtaatcat

SEQ ID NO: 564271 - DNA, 25 bp, Homo sapien
gtcacttgtaatcataagttgtctt

SEQ ID NO: 564272 - DNA, 25 bp, Homo sapien
aagttgtctttaactcagctggctc

SEQ ID NO: 564273 - DNA, 25 bp, Homo sapien
ttgtctttaactcagctggctccag

SEQ ID NO: 564274 - DNA, 25 bp, Homo sapien
ggctctgccagaatttatgactttg

SEQ ID NO: 564275 - DNA, 25 bp, Homo sapien
gactttggatttctctaggtcccat

SEQ ID NO: 564276 - DNA, 25 bp, Homo sapien
tctctaggtcccattttcttgaaaa

SEQ ID NO: 564277 - DNA, 25 bp, Homo sapien
gatgaagtttgactagctaacccta

SEQ ID NO: 564278 - DNA, 25 bp, Homo sapien
gactagctaaccctaaaatcttgtt

SEQ ID NO: 564279 - DNA, 25 bp, Homo sapien
tcctaaaattctatagtctcagttt

SEQ ID NO: 564280 - DNA, 25 bp, Homo sapien
aattgctagcagtttccgttcacat

SEQ ID NO: 564281 - DNA, 25 bp, Homo sapien
agtttccgttcacattggcctagac

SEQ ID NO: 564282 - DNA, 25 bp, Homo sapien
gttcacattggcctagacgcaaacc

SEQ ID NO: 564283 - DNA, 25 bp, Homo sapien
caaaccagcattttgcagtaactgt

SEQ ID NO: 564284 - DNA, 25 bp, Homo sapien
gttttttgacctaacagctgaacat

SEQ ID NO: 564285 - DNA, 25 bp, Homo sapien
gagtgtattcaccaaccctagtgtt

SEQ ID NO: 564286 - DNA, 25 bp, Homo sapien
ccaaccctagtgttgaacgagataa

SEQ ID NO: 564287 - DNA, 25 bp, Homo sapien
gcaaaaatgcaccataggattccat

SEQ ID NO: 564288 - DNA, 25 bp, Homo sapien
ccagcaaaattcatccatgcggttg

SEQ ID NO: 564289 - DNA, 25 bp, Homo sapien
atgcggttgcaagtagagatcagtc

SEQ ID NO: 564290 - DNA, 25 bp, Homo sapien
tttcttgatctggttgccggttacc

SEQ ID NO: 564291 - DNA, 25 bp, Homo sapien
atctggttgccggttacctgggtgc

SEQ ID NO: 564292 - DNA, 25 bp, Homo sapien
tacctgggtgctttccgtttgtgaa

SEQ ID NO: 564293 - DNA, 25 bp, Homo sapien
ggtgctttccgtttgtgaacattct

SEQ ID NO: 564294 - DNA, 25 bp, Homo sapien
gagctgtacacttttgatctgggca

SEQ ID NO: 564295 - DNA, 25 bp, Homo sapien
acacttttgatctgggcacttttct

SEQ ID NO: 564296 - DNA, 25 bp, Homo sapien
tgtgattatgctactggacctccta

SEQ ID NO: 564297 - DNA, 25 bp, Homo sapien
tgattatgctactggacctcctacc

SEQ ID NO: 564298 - DNA, 25 bp, Homo sapien
atgctactggacctcctaccctgga

SEQ ID NO: 564299 - DNA, 25 bp, Homo sapien
cctggacaagggtagccgtgatcat

SEQ ID NO: 564300 - DNA, 25 bp, Homo sapien
aagggtagccgtgatcatgctgcgt

SEQ ID NO: 564301 - DNA, 25 bp, Homo sapien
gtagccgtgatcatgctgcgtggtc

SEQ ID NO: 564302 - DNA, 25 bp, Homo sapien
cgtgatcatgctgcgtggtctccta

SEQ ID NO: 564303 - DNA, 25 bp, Homo sapien
tgatcatgctgcgtggtctcctacc

SEQ ID NO: 564304 - DNA, 25 bp, Homo sapien
ggtctcctaccctggaccagaaagt

SEQ ID NO: 564305 - DNA, 25 bp, Homo sapien
tcctaccctggaccagaaagtgaga

SEQ ID NO: 564306 - DNA, 25 bp, Homo sapien
tattttacctattttattgtgctta

SEQ ID NO: 564307 - DNA, 25 bp, Homo sapien
actctttaaattgtttccattactg

SEQ ID NO: 564308 - DNA, 25 bp, Homo sapien
ctctttaaattgtttccattactga

SEQ ID NO: 564309 - DNA, 25 bp, Homo sapien
tctttaaattgtttccattactgat

SEQ ID NO: 564310 - DNA, 25 bp, Homo sapien
ctttaaattgtttccattactgatt

SEQ ID NO: 564311 - DNA, 25 bp, Homo sapien
tttaaattgtttccattactgatta

SEQ ID NO: 564312 - DNA, 25 bp, Homo sapien
ttaaattgtttccattactgattat

SEQ ID NO: 564313 - DNA, 25 bp, Homo sapien
taaattgtttccattactgattatg

SEQ ID NO: 564314 - DNA, 25 bp, Homo sapien
aaattgtttccattactgattatgc

SEQ ID NO: 564315 - DNA, 25 bp, Homo sapien
tttcttgtaagctcagctgtgtcct

SEQ ID NO: 564316 - DNA, 25 bp, Homo sapien
tgtaagctcagctgtgtcctcaaat

SEQ ID NO: 564317 - DNA, 25 bp, Homo sapien
agctcagctgtgtcctcaaatatat

SEQ ID NO: 564318 - DNA, 25 bp, Homo sapien
gctgtgtcctcaaatatattgcatt

SEQ ID NO: 564319 - DNA, 25 bp, Homo sapien
atatattgcattttacccagcattt

SEQ ID NO: 564320 - DNA, 25 bp, Homo sapien
gttatcttagtctttgatattgtgt

SEQ ID NO: 564321 - DNA, 25 bp, Homo sapien
gatattgtgtaagcgaaattctcca

SEQ ID NO: 564322 - DNA, 25 bp, Homo sapien
taagcgaaattctccaatcccatct

SEQ ID NO: 564323 - DNA, 25 bp, Homo sapien
tccaatcccatctcctagatgattt

SEQ ID NO: 564324 - DNA, 25 bp, Homo sapien
gattatgcttaacagctgtttcctg

SEQ ID NO: 564325 - DNA, 25 bp, Homo sapien
taacagctgtttcctgtttctctta

SEQ ID NO: 564326 - DNA, 25 bp, Homo sapien
agggctgctgggtccctcgttcaat

SEQ ID NO: 564327 - DNA, 25 bp, Homo sapien
tgctgggtccctcgttcaatattgt

SEQ ID NO: 564328 - DNA, 25 bp, Homo sapien
ggtccctcgttcaatattgtccaaa

SEQ ID NO: 564329 - DNA, 25 bp, Homo sapien
ccctcgttcaatattgtccaaaatc

SEQ ID NO: 564330 - DNA, 25 bp, Homo sapien
gcggattttaaatttgactctcatt

SEQ ID NO: 564331 - DNA, 25 bp, Homo sapien
gtgtgtgtatgcaagtcctctctaa

SEQ ID NO: 564332 - DNA, 25 bp, Homo sapien
tcctctctaaaaggacttaggagaa

SEQ ID NO: 564333 - DNA, 25 bp, Homo sapien
gaagctagggagagtgtttacctac

SEQ ID NO: 564334 - DNA, 25 bp, Homo sapien
tagggagagtgtttacctacaggga

SEQ ID NO: 564335 - DNA, 25 bp, Homo sapien
gaattaaggcatgtattacctcttt

SEQ ID NO: 564336 - DNA, 25 bp, Homo sapien
gcatgtattacctctttaacaacca

SEQ ID NO: 564337 - DNA, 25 bp, Homo sapien
atggaacgtggctcgcacggtcaaa

SEQ ID NO: 564338 - DNA, 25 bp, Homo sapien
gtggctcgcacggtcaaaatcagcg

SEQ ID NO: 564339 - DNA, 25 bp, Homo sapien
gtcaaaatcagcgaccccgacttgt

SEQ ID NO: 564340 - DNA, 25 bp, Homo sapien
atcaagttctgcctgctgcagtcca

SEQ ID NO: 564341 - DNA, 25 bp, Homo sapien
agttctgcctgctgcagtccatgaa

SEQ ID NO: 564342 - DNA, 25 bp, Homo sapien
gcctgctgcagtccatgaagcactg

SEQ ID NO: 564343 - DNA, 25 bp, Homo sapien
agtccatgaagcactgccaggtgca

SEQ ID NO: 564344 - DNA, 25 bp, Homo sapien
gccgtgtcaaggacgagccagccta

SEQ ID NO: 564345 - DNA, 25 bp, Homo sapien
gagccagcctactactgcaacgagt

SEQ ID NO: 564346 - DNA, 25 bp, Homo sapien
agcctactactgcaacgagtgcgat

SEQ ID NO: 564347 - DNA, 25 bp, Homo sapien
actactgcaacgagtgcgatgtgga

SEQ ID NO: 564348 - DNA, 25 bp, Homo sapien
gccagatttgaatagccacctgaat

SEQ ID NO: 564349 - DNA, 25 bp, Homo sapien
ccacctgaatgctgaagttttacca

SEQ ID NO: 564350 - DNA, 25 bp, Homo sapien
gaagttttaccagctctcttgggct

SEQ ID NO: 564351 - DNA, 25 bp, Homo sapien
ttgggctgtgtacccttcatcgtat

SEQ ID NO: 564352 - DNA, 25 bp, Homo sapien
catcgtatcttccaggttccttaaa

SEQ ID NO: 564353 - DNA, 25 bp, Homo sapien
ttaaaacctacccttgggcacagct

SEQ ID NO: 564354 - DNA, 25 bp, Homo sapien
agctgggatgtgcactggctcttca

SEQ ID NO: 564355 - DNA, 25 bp, Homo sapien
tggctcttcacagctagatccagca

SEQ ID NO: 564356 - DNA, 25 bp, Homo sapien
gctagatccagcatgcactgactct

SEQ ID NO: 564357 - DNA, 25 bp, Homo sapien
aatagaggtggcgttccggccgctc

SEQ ID NO: 564358 - DNA, 25 bp, Homo sapien
cccacagcgtttcaagtgcagcaag

SEQ ID NO: 564359 - DNA, 25 bp, Homo sapien
tgcctgctcccataatgtccattct

SEQ ID NO: 564360 - DNA, 25 bp, Homo sapien
gctcccataatgtccattctctcta

SEQ ID NO: 564361 - DNA, 25 bp, Homo sapien
cataatgtccattctctctatcttg

SEQ ID NO: 564362 - DNA, 25 bp, Homo sapien
ataatgtccattctctctatcttga

SEQ ID NO: 564363 - DNA, 25 bp, Homo sapien
aatgtccattctctctatcttgata

SEQ ID NO: 564364 - DNA, 25 bp, Homo sapien
atgtccattctctctatcttgatac

SEQ ID NO: 564365 - DNA, 25 bp, Homo sapien
gtccattctctctatcttgatactt

SEQ ID NO: 564366 - DNA, 25 bp, Homo sapien
attctctctatcttgatactttgca

SEQ ID NO: 564367 - DNA, 25 bp, Homo sapien
tctctctatcttgatactttgcagt

SEQ ID NO: 564368 - DNA, 25 bp, Homo sapien
ctctatcttgatactttgcagttgt

SEQ ID NO: 564369 - DNA, 25 bp, Homo sapien
atcttgatactttgcagttgtaaaa

SEQ ID NO: 564370 - DNA, 25 bp, Homo sapien
tactggacgctgccctgcatgctgc

SEQ ID NO: 564371 - DNA, 25 bp, Homo sapien
ggcctggattcacgccctcttgttt

SEQ ID NO: 564372 - DNA, 25 bp, Homo sapien
gattcacgccctcttgtttcctttt

SEQ ID NO: 564373 - DNA, 25 bp, Homo sapien
ctctggtgatggtttccacaggaac

SEQ ID NO: 564374 - DNA, 25 bp, Homo sapien
ggtgatggtttccacaggaacaaca

SEQ ID NO: 564375 - DNA, 25 bp, Homo sapien
gtttccacaggaacaacagcatctt

SEQ ID NO: 564376 - DNA, 25 bp, Homo sapien
tccacaggaacaacagcatctttca

SEQ ID NO: 564377 - DNA, 25 bp, Homo sapien
acagcatctttcaccaagatgggtg

SEQ ID NO: 564378 - DNA, 25 bp, Homo sapien
tggcaccaaccttgctgggacttgg

SEQ ID NO: 564379 - DNA, 25 bp, Homo sapien
gcaccaaccttgctgggacttggat

SEQ ID NO: 564380 - DNA, 25 bp, Homo sapien
aaccttgctgggacttggatcccag

SEQ ID NO: 564381 - DNA, 25 bp, Homo sapien
ttgcattcgtagaaaatgtccctcc

SEQ ID NO: 564382 - DNA, 25 bp, Homo sapien
gttggcagaaaggatcagcttaatc

SEQ ID NO: 564383 - DNA, 25 bp, Homo sapien
gtggtatttcacttcagacttctcc

SEQ ID NO: 564384 - DNA, 25 bp, Homo sapien
agacttctccagaggtgacactgcg

SEQ ID NO: 564385 - DNA, 25 bp, Homo sapien
tgacactgcgtacaccaagctagct

SEQ ID NO: 564386 - DNA, 25 bp, Homo sapien
aagctagctctggatcggcacactg

SEQ ID NO: 564387 - DNA, 25 bp, Homo sapien
tcggcacactgacactacctatttt

SEQ ID NO: 564388 - DNA, 25 bp, Homo sapien
tacctattttcaagagccctgtggc

SEQ ID NO: 564389 - DNA, 25 bp, Homo sapien
agccctgtggcattcaagtgtttca

SEQ ID NO: 564390 - DNA, 25 bp, Homo sapien
atgaaggaactggtggcaggacact

SEQ ID NO: 564391 - DNA, 25 bp, Homo sapien
ggacactgctagtagatggattcta

SEQ ID NO: 564392 - DNA, 25 bp, Homo sapien
tgaagcagctgtaccgcatccttca

SEQ ID NO: 564393 - DNA, 25 bp, Homo sapien
gaagcagctgtaccgcatccttcaa

SEQ ID NO: 564394 - DNA, 25 bp, Homo sapien
agctgtaccgcatccttcaaaccca

SEQ ID NO: 564395 - DNA, 25 bp, Homo sapien
tattgtttagatttaaccagctttt

SEQ ID NO: 564396 - DNA, 25 bp, Homo sapien
ttaaccagcttttaaatctctcttt

SEQ ID NO: 564397 - DNA, 25 bp, Homo sapien
ttgtgattctccaaatatgcctaga

SEQ ID NO: 564398 - DNA, 25 bp, Homo sapien
tgtgattctccaaatatgcctagat

SEQ ID NO: 564399 - DNA, 25 bp, Homo sapien
gtgattctccaaatatgcctagatt

SEQ ID NO: 564400 - DNA, 25 bp, Homo sapien
gattctccaaatatgcctagattta

SEQ ID NO: 564401 - DNA, 25 bp, Homo sapien
attctccaaatatgcctagatttaa

SEQ ID NO: 564402 - DNA, 25 bp, Homo sapien
caaatatgcctagatttaaagctga

SEQ ID NO: 564403 - DNA, 25 bp, Homo sapien
tattttttgccagctgatcatcttg

SEQ ID NO: 564404 - DNA, 25 bp, Homo sapien
tttttgccagctgatcatcttgagg

SEQ ID NO: 564405 - DNA, 25 bp, Homo sapien
tttgccagctgatcatcttgaggtt

SEQ ID NO: 564406 - DNA, 25 bp, Homo sapien
gccagctgatcatcttgaggttata

SEQ ID NO: 564407 - DNA, 25 bp, Homo sapien
cagctgatcatcttgaggttatatt

SEQ ID NO: 564408 - DNA, 25 bp, Homo sapien
gtaagtgtgagaaccttttatggaa

SEQ ID NO: 564409 - DNA, 25 bp, Homo sapien
aaatactttatgcaacagttgtgga

SEQ ID NO: 564410 - DNA, 25 bp, Homo sapien
acagttgtggactaaaaatagcaat

SEQ ID NO: 564411 - DNA, 25 bp, Homo sapien
gcagaaaataatatctcttacatat

SEQ ID NO: 564412 - DNA, 25 bp, Homo sapien
gtaatcaaattggttagctcatgaa

SEQ ID NO: 564413 - DNA, 25 bp, Homo sapien
caaattggttagctcatgaataaaa

SEQ ID NO: 564414 - DNA, 25 bp, Homo sapien
gggataaaagttacacctaccacat

SEQ ID NO: 564415 - DNA, 25 bp, Homo sapien
gttacacctaccacatatgattgtt

SEQ ID NO: 564416 - DNA, 25 bp, Homo sapien
aggtagcaagtagcatatttagcac

SEQ ID NO: 564417 - DNA, 25 bp, Homo sapien
gtagcatatttagcacagtcctggc

SEQ ID NO: 564418 - DNA, 25 bp, Homo sapien
cagtcctggcatacaataaatgctc

SEQ ID NO: 564419 - DNA, 25 bp, Homo sapien
acaataaatgctcaagaaacacttc

SEQ ID NO: 564420 - DNA, 25 bp, Homo sapien
gaaacacttcataaatcggagacat

SEQ ID NO: 564421 - DNA, 25 bp, Homo sapien
aatcggagacattctgaacaactgt

SEQ ID NO: 564422 - DNA, 25 bp, Homo sapien
gaacaactgtgtttatagtctgtcg

SEQ ID NO: 564423 - DNA, 25 bp, Homo sapien
atagtctgtcgaacttttagatgac

SEQ ID NO: 564424 - DNA, 25 bp, Homo sapien
tttgaattcagtctattttgaacca

SEQ ID NO: 564425 - DNA, 25 bp, Homo sapien
actggccctggcttgtatgtaactt

SEQ ID NO: 564426 - DNA, 25 bp, Homo sapien
gccctggcttgtatgtaacttttaa

SEQ ID NO: 564427 - DNA, 25 bp, Homo sapien
agtaattcatattcactgtacaaag

SEQ ID NO: 564428 - DNA, 25 bp, Homo sapien
tcatattcactgtacaaagcttgga

SEQ ID NO: 564429 - DNA, 25 bp, Homo sapien
ttcactgtacaaagcttggaaaaga

SEQ ID NO: 564430 - DNA, 25 bp, Homo sapien
acggacaagcagaagtaatagccta

SEQ ID NO: 564431 - DNA, 25 bp, Homo sapien
gtaatagcctaatagtcacccataa

SEQ ID NO: 564432 - DNA, 25 bp, Homo sapien
atagcctaatagtcacccataatcc

SEQ ID NO: 564433 - DNA, 25 bp, Homo sapien
atggttagtgtttttatgtctgtgt

SEQ ID NO: 564434 - DNA, 25 bp, Homo sapien
gtctgtgttttatacaaacagtttg

SEQ ID NO: 564435 - DNA, 25 bp, Homo sapien
cagtttggatataactgtgtgcacc

SEQ ID NO: 564436 - DNA, 25 bp, Homo sapien
gacattgatgtgaatgctgctgcag

SEQ ID NO: 564437 - DNA, 25 bp, Homo sapien
atgtgaatgctgctgcaggtgccaa

SEQ ID NO: 564438 - DNA, 25 bp, Homo sapien
aatgctgctgcaggtgccaaggcac

SEQ ID NO: 564439 - DNA, 25 bp, Homo sapien
tgctgctgcaggtgccaaggcacat

SEQ ID NO: 564440 - DNA, 25 bp, Homo sapien
aggtgccaaggcacatcatgctgct

SEQ ID NO: 564441 - DNA, 25 bp, Homo sapien
gtgccaaggcacatcatgctgctgg

SEQ ID NO: 564442 - DNA, 25 bp, Homo sapien
atgctgctggacagtctgtgcgaag

SEQ ID NO: 564443 - DNA, 25 bp, Homo sapien
gcgcttaggtgcaggtgccctgaat

SEQ ID NO: 564444 - DNA, 25 bp, Homo sapien
ttaggtgcaggtgccctgaatgcag

SEQ ID NO: 564445 - DNA, 25 bp, Homo sapien
tgaatgcaggttcctatgcgtcact

SEQ ID NO: 564446 - DNA, 25 bp, Homo sapien
aatgcaggttcctatgcgtcactag

SEQ ID NO: 564447 - DNA, 25 bp, Homo sapien
gataggatgggctttttctgtagta

SEQ ID NO: 564448 - DNA, 25 bp, Homo sapien
ggctttttctgtagtaataatccct

SEQ ID NO: 564449 - DNA, 25 bp, Homo sapien
aattgtctcatgcaaaaaaccactg

SEQ ID NO: 564450 - DNA, 25 bp, Homo sapien
tgtcaaatctatcaagctttttctt

SEQ ID NO: 564451 - DNA, 25 bp, Homo sapien
atgtcttatttgagaaatccttcta

SEQ ID NO: 564452 - DNA, 25 bp, Homo sapien
gagaaatccttctataccccaagat

SEQ ID NO: 564453 - DNA, 25 bp, Homo sapien
ttctataccccaagatcatgaggat

SEQ ID NO: 564454 - DNA, 25 bp, Homo sapien
catgaggatgtttcctgtgttctct

SEQ ID NO: 564455 - DNA, 25 bp, Homo sapien
cctgtgttctcttctgaaagctata

SEQ ID NO: 564456 - DNA, 25 bp, Homo sapien
agctatatagtctttgtcatttagg

SEQ ID NO: 564457 - DNA, 25 bp, Homo sapien
gtcatttaggtttatctttatacgt

SEQ ID NO: 564458 - DNA, 25 bp, Homo sapien
attcattcatctatgcattggttaa

SEQ ID NO: 564459 - DNA, 25 bp, Homo sapien
ggttaaatcactggccaactcacta

SEQ ID NO: 564460 - DNA, 25 bp, Homo sapien
actggccaactcactaactcattca

SEQ ID NO: 564461 - DNA, 25 bp, Homo sapien
attcacacttttctgcaatgatttg

SEQ ID NO: 564462 - DNA, 25 bp, Homo sapien
ttcacttgttcactcccttgcttat

SEQ ID NO: 564463 - DNA, 25 bp, Homo sapien
cattcactcattcttcaatacattg

SEQ ID NO: 564464 - DNA, 25 bp, Homo sapien
attgaccaagccattcactgacatt

SEQ ID NO: 564465 - DNA, 25 bp, Homo sapien
attcagctacatttattctttcatg

SEQ ID NO: 564466 - DNA, 25 bp, Homo sapien
atttattctttcatgcattggtttc

SEQ ID NO: 564467 - DNA, 25 bp, Homo sapien
tggtttctggatttatttggtcatt

SEQ ID NO: 564468 - DNA, 25 bp, Homo sapien
aaactgtatatattttcatgtgcaa

SEQ ID NO: 564469 - DNA, 25 bp, Homo sapien
gtccaccacgtcagtgactctggac

SEQ ID NO: 564470 - DNA, 25 bp, Homo sapien
acgtcagtgactctggaccggctgc

SEQ ID NO: 564471 - DNA, 25 bp, Homo sapien
gaccggctgctgaattgcctttgga

SEQ ID NO: 564472 - DNA, 25 bp, Homo sapien
gaattgcctttggatgtaccacaca

SEQ ID NO: 564473 - DNA, 25 bp, Homo sapien
gtaccacacattaggcttgactcac

SEQ ID NO: 564474 - DNA, 25 bp, Homo sapien
attaggcttgactcaccaccttcat

SEQ ID NO: 564475 - DNA, 25 bp, Homo sapien
gactcaccaccttcatttgacaata

SEQ ID NO: 564476 - DNA, 25 bp, Homo sapien
atttgacaataccacctacaccagc

SEQ ID NO: 564477 - DNA, 25 bp, Homo sapien
ttgattccccatcaggaaaaccttc

SEQ ID NO: 564478 - DNA, 25 bp, Homo sapien
ctctacctcctaaggtcctggtctg

SEQ ID NO: 564479 - DNA, 25 bp, Homo sapien
ctaacaatcagactccatccagcta

SEQ ID NO: 564480 - DNA, 25 bp, Homo sapien
ctgggttgagggactgttgatttca

SEQ ID NO: 564481 - DNA, 25 bp, Homo sapien
tcgaaaatatcttcaggtggtccat

SEQ ID NO: 564482 - DNA, 25 bp, Homo sapien
tccatgtaggcctggtgtctgctgc

SEQ ID NO: 564483 - DNA, 25 bp, Homo sapien
tgctgcctccatctttgaaggaaca

SEQ ID NO: 564484 - DNA, 25 bp, Homo sapien
ggaggagccctttctctgtaggagc

SEQ ID NO: 564485 - DNA, 25 bp, Homo sapien
gagccctaagtctgggttttatctt

SEQ ID NO: 564486 - DNA, 25 bp, Homo sapien
atcttaaaagaacacaccagtcatt

SEQ ID NO: 564487 - DNA, 25 bp, Homo sapien
gtctccccttattgccattgccagg

SEQ ID NO: 564488 - DNA, 25 bp, Homo sapien
gggagggtcgtctagtccttaagca

SEQ ID NO: 564489 - DNA, 25 bp, Homo sapien
gtccttaagcataaacactggctgt

SEQ ID NO: 564490 - DNA, 25 bp, Homo sapien
ccaacactttgccagacagttcttt

SEQ ID NO: 564491 - DNA, 25 bp, Homo sapien
aatactcgactctgcatttcggtac

SEQ ID NO: 564492 - DNA, 25 bp, Homo sapien
gactctgcatttcggtacttatatc

SEQ ID NO: 564493 - DNA, 25 bp, Homo sapien
ctgcatttcggtacttatatctgaa

SEQ ID NO: 564494 - DNA, 25 bp, Homo sapien
taatgacaacattcgtgccagacat

SEQ ID NO: 564495 - DNA, 25 bp, Homo sapien
acattcgtgccagacattactgcaa

SEQ ID NO: 564496 - DNA, 25 bp, Homo sapien
gtgccagacattactgcaagtgagg

SEQ ID NO: 564497 - DNA, 25 bp, Homo sapien
aacaaaatgccttccaagagagaaa

SEQ ID NO: 564498 - DNA, 25 bp, Homo sapien
tgaaggttaacaaagactggtctaa

SEQ ID NO: 564499 - DNA, 25 bp, Homo sapien
gactggtctaaggaatagttcacta

SEQ ID NO: 564500 - DNA, 25 bp, Homo sapien
gcaatgctcttctcactaatactcg

SEQ ID NO: 564501 - DNA, 25 bp, Homo sapien
ttctcactaatactcgactctgcat

SEQ ID NO: 564502 - DNA, 25 bp, Homo sapien
ggagtggctggatgacaaatcgtca

SEQ ID NO: 564503 - DNA, 25 bp, Homo sapien
tgacgcgagaaggaagccaggttta

SEQ ID NO: 564504 - DNA, 25 bp, Homo sapien
ggaagccaggtttatgaccacgatt

SEQ ID NO: 564505 - DNA, 25 bp, Homo sapien
aggtttatgaccacgattcttcaga

SEQ ID NO: 564506 - DNA, 25 bp, Homo sapien
cacgattcttcagatgtgtcttcag

SEQ ID NO: 564507 - DNA, 25 bp, Homo sapien
aaaactggctgaagacctatggctt

SEQ ID NO: 564508 - DNA, 25 bp, Homo sapien
aagacctatggcttggtcgccaaga

SEQ ID NO: 564509 - DNA, 25 bp, Homo sapien
tggcttggtcgccaagaaactcacc

SEQ ID NO: 564510 - DNA, 25 bp, Homo sapien
aaactcaccctcatggatgccttgt

SEQ ID NO: 564511 - DNA, 25 bp, Homo sapien
gatgccttgtcagtggcagcagtcc

SEQ ID NO: 564512 - DNA, 25 bp, Homo sapien
tgtcagtggcagcagtcccgcacag

SEQ ID NO: 564513 - DNA, 25 bp, Homo sapien
agaggaccaggttctagcccattca

SEQ ID NO: 564514 - DNA, 25 bp, Homo sapien
agcccattcattgctggattgcgga

SEQ ID NO: 564515 - DNA, 25 bp, Homo sapien
acatgcagcatgtcccagcaaagct

SEQ ID NO: 564516 - DNA, 25 bp, Homo sapien
gcaaagcttcgcaaagatgtcagta

SEQ ID NO: 564517 - DNA, 25 bp, Homo sapien
agtattaattgtcaccatcctccag

SEQ ID NO: 564518 - DNA, 25 bp, Homo sapien
aaagcaacagcccacaattgcctgc

SEQ ID NO: 564519 - DNA, 25 bp, Homo sapien
ttcaaaaccacttctgctccaaaga

SEQ ID NO: 564520 - DNA, 25 bp, Homo sapien
gctccaaagaccatgaacctgaact

SEQ ID NO: 564521 - DNA, 25 bp, Homo sapien
gaactgaagaaacgactccttcctg

SEQ ID NO: 564522 - DNA, 25 bp, Homo sapien
cttcctgctggtgtgagataattca

SEQ ID NO: 564523 - DNA, 25 bp, Homo sapien
gataattcagtctccatgatgtctt

SEQ ID NO: 564524 - DNA, 25 bp, Homo sapien
ggatgactgtcacaggactttcaaa

SEQ ID NO: 564525 - DNA, 25 bp, Homo sapien
ctttcaaattgtttagcagtcagca

SEQ ID NO: 564526 - DNA, 25 bp, Homo sapien
agcagtcagcatagtcaggatccaa

SEQ ID NO: 564527 - DNA, 25 bp, Homo sapien
gcatagtcaggatccaagcccgcaa

SEQ ID NO: 564528 - DNA, 25 bp, Homo sapien
atccaagcccgcaatcttgttttaa

SEQ ID NO: 564529 - DNA, 25 bp, Homo sapien
tttgtcacccaatattaggactgaa

SEQ ID NO: 564530 - DNA, 25 bp, Homo sapien
ctgaaattcagactcggtaacttgt

SEQ ID NO: 564531 - DNA, 25 bp, Homo sapien
gatctgcaagactgaacatccccta

SEQ ID NO: 564532 - DNA, 25 bp, Homo sapien
aacatcccctactgtatagtttcct

SEQ ID NO: 564533 - DNA, 25 bp, Homo sapien
cattttcatttagcctttcctaatt

SEQ ID NO: 564534 - DNA, 25 bp, Homo sapien
atttttgtctatagtctgttgtagg

SEQ ID NO: 564535 - DNA, 25 bp, Homo sapien
ggtctgatgccgagctcgagtgtca

SEQ ID NO: 564536 - DNA, 25 bp, Homo sapien
gagctcgagtgtcagtcttacggaa

SEQ ID NO: 564537 - DNA, 25 bp, Homo sapien
gtcttacggaaacggagcccacctg

SEQ ID NO: 564538 - DNA, 25 bp, Homo sapien
gagcccacctggcatctatcctgag

SEQ ID NO: 564539 - DNA, 25 bp, Homo sapien
cagcaccatagcagagtacataagt

SEQ ID NO: 564540 - DNA, 25 bp, Homo sapien
gcagagtacataagtggctatcaga

SEQ ID NO: 564541 - DNA, 25 bp, Homo sapien
ggctatcagagaagccagccgatat

SEQ ID NO: 564542 - DNA, 25 bp, Homo sapien
ccgatatggattggcctgcacgacc

SEQ ID NO: 564543 - DNA, 25 bp, Homo sapien
ctgcttgtttttcctttggccatag

SEQ ID NO: 564544 - DNA, 25 bp, Homo sapien
ggtttaccagtagaatccttgctag

SEQ ID NO: 564545 - DNA, 25 bp, Homo sapien
atccttgctaggttgatgtgggcca

SEQ ID NO: 564546 - DNA, 25 bp, Homo sapien
attgccactggaataaatgtgcctt

SEQ ID NO: 564547 - DNA, 25 bp, Homo sapien
tgcattgcatacacttgaactggac

SEQ ID NO: 564548 - DNA, 25 bp, Homo sapien
gggaagctgcttgagagttctcaat

SEQ ID NO: 564549 - DNA, 25 bp, Homo sapien
gagagttctcaattactttcttaaa

SEQ ID NO: 564550 - DNA, 25 bp, Homo sapien
cagtgttttctgaaggcgtgtgtca

SEQ ID NO: 564551 - DNA, 25 bp, Homo sapien
tctgaaggcgtgtgtcatgatacaa

SEQ ID NO: 564552 - DNA, 25 bp, Homo sapien
gaattctaccttagggactctggtt

SEQ ID NO: 564553 - DNA, 25 bp, Homo sapien
gttaaactattggtgaggagctcga

SEQ ID NO: 564554 - DNA, 25 bp, Homo sapien
aggagctcgagtggtttgtatagac

SEQ ID NO: 564555 - DNA, 25 bp, Homo sapien
gtggtttgtatagaccccagatttt

SEQ ID NO: 564556 - DNA, 25 bp, Homo sapien
ctctacttatttaaattgccactgg

SEQ ID NO: 564557 - DNA, 25 bp, Homo sapien
tggtgccctgaaggctgcgatggcc

SEQ ID NO: 564558 - DNA, 25 bp, Homo sapien
tgcgatggccccctgaatcaggagc

SEQ ID NO: 564559 - DNA, 25 bp, Homo sapien
ccagctgatcggacgaggtgcactt

SEQ ID NO: 564560 - DNA, 25 bp, Homo sapien
tgatcggacgaggtgcactttggca

SEQ ID NO: 564561 - DNA, 25 bp, Homo sapien
gtgcactttggcacctcaaagctgg

SEQ ID NO: 564562 - DNA, 25 bp, Homo sapien
ttggcacctcaaagctgggagccag

SEQ ID NO: 564563 - DNA, 25 bp, Homo sapien
gaggaccgcccatattcccataggg

SEQ ID NO: 564564 - DNA, 25 bp, Homo sapien
gcccatattcccatagggtgtgcag

SEQ ID NO: 564565 - DNA, 25 bp, Homo sapien
agcaggcgttgctctggcatgccgc

SEQ ID NO: 564566 - DNA, 25 bp, Homo sapien
gcatgccgcccttttggctactttg

SEQ ID NO: 564567 - DNA, 25 bp, Homo sapien
gctactttgtgatcaaagccagcct

SEQ ID NO: 564568 - DNA, 25 bp, Homo sapien
tggcttctgcacatctagattcctg

SEQ ID NO: 564569 - DNA, 25 bp, Homo sapien
gcttctgcacatctagattcctgtt

SEQ ID NO: 564570 - DNA, 25 bp, Homo sapien
ttctgcacatctagattcctgttcc

SEQ ID NO: 564571 - DNA, 25 bp, Homo sapien
tgcacatctagattcctgttcccct

SEQ ID NO: 564572 - DNA, 25 bp, Homo sapien
aaaagctgttgctagcagtcacatt

SEQ ID NO: 564573 - DNA, 25 bp, Homo sapien
aagctgttgctagcagtcacatttt

SEQ ID NO: 564574 - DNA, 25 bp, Homo sapien
gctgttgctagcagtcacatttttt

SEQ ID NO: 564575 - DNA, 25 bp, Homo sapien
gaaaagcaaaatccatctctccttc

SEQ ID NO: 564576 - DNA, 25 bp, Homo sapien
agatacacctttttatttgtgcctc

SEQ ID NO: 564577 - DNA, 25 bp, Homo sapien
ttatttgtgcctcaggatgcacaga

SEQ ID NO: 564578 - DNA, 25 bp, Homo sapien
tatttgtgcctcaggatgcacagaa

SEQ ID NO: 564579 - DNA, 25 bp, Homo sapien
agccacagtcttctctagtacaatt

SEQ ID NO: 564580 - DNA, 25 bp, Homo sapien
gccacagtcttctctagtacaattc

SEQ ID NO: 564581 - DNA, 25 bp, Homo sapien
acagtcttctctagtacaattcagg

SEQ ID NO: 564582 - DNA, 25 bp, Homo sapien
agtcttctctagtacaattcaggga

SEQ ID NO: 564583 - DNA, 25 bp, Homo sapien
tctctagtacaattcagggaagcca

SEQ ID NO: 564584 - DNA, 25 bp, Homo sapien
gtacaattcagggaagccagacagg

SEQ ID NO: 564585 - DNA, 25 bp, Homo sapien
gccagacaggttgtggagagcttta

SEQ ID NO: 564586 - DNA, 25 bp, Homo sapien
caggttgtggagagctttacaggca

SEQ ID NO: 564587 - DNA, 25 bp, Homo sapien
ggagagctttacaggcagggcagcc

SEQ ID NO: 564588 - DNA, 25 bp, Homo sapien
gggcagcccctgctaagaaagacaa

SEQ ID NO: 564589 - DNA, 25 bp, Homo sapien
gcagcccctgctaagaaagacaaaa

SEQ ID NO: 564590 - DNA, 25 bp, Homo sapien
agttgctactacatctgcaaagttt

SEQ ID NO: 564591 - DNA, 25 bp, Homo sapien
gtttaatcgaaaaatttgccagtga

SEQ ID NO: 564592 - DNA, 25 bp, Homo sapien
gccagtgatatgatggccttgtcac

SEQ ID NO: 564593 - DNA, 25 bp, Homo sapien
tcacagagatcacaagggacacgga

SEQ ID NO: 564594 - DNA, 25 bp, Homo sapien
caagggacacggagttgacttttgc

SEQ ID NO: 564595 - DNA, 25 bp, Homo sapien
tgacttttgctcaaggtggaacgac

SEQ ID NO: 564596 - DNA, 25 bp, Homo sapien
tcaaggtggaacgacagagctgtgt

SEQ ID NO: 564597 - DNA, 25 bp, Homo sapien
acagagctgtgtaggcaagatgaga

SEQ ID NO: 564598 - DNA, 25 bp, Homo sapien
gaaattgcgaacttgttcggccaaa

SEQ ID NO: 564599 - DNA, 25 bp, Homo sapien
aggcagaatcgctttgggatgacat

SEQ ID NO: 564600 - DNA, 25 bp, Homo sapien
aatcgctttgggatgacattcagaa

SEQ ID NO: 564601 - DNA, 25 bp, Homo sapien
tggacaaagcggcaatgggcccttc

SEQ ID NO: 564602 - DNA, 25 bp, Homo sapien
tgggcccttcctgagacacagtgcg

SEQ ID NO: 564603 - DNA, 25 bp, Homo sapien
acacagtgcggccatctactggaaa

SEQ ID NO: 564604 - DNA, 25 bp, Homo sapien
gtgcggccatctactggaaaactgc

SEQ ID NO: 564605 - DNA, 25 bp, Homo sapien
aaaactgcccagtgtgactctgatg

SEQ ID NO: 564606 - DNA, 25 bp, Homo sapien
gtgactctgatgactgtgatgtgaa

SEQ ID NO: 564607 - DNA, 25 bp, Homo sapien
gactgtgatgtgaatcctacagcaa

SEQ ID NO: 564608 - DNA, 25 bp, Homo sapien
gaatcctacagcaaagttgagcagt

SEQ ID NO: 564609 - DNA, 25 bp, Homo sapien
tgagcagtgcgcaacctgggctact

SEQ ID NO: 564610 - DNA, 25 bp, Homo sapien
ccccagagctctaattgtcactgag

SEQ ID NO: 564611 - DNA, 25 bp, Homo sapien
aattgtcactgagattttatgtttc

SEQ ID NO: 564612 - DNA, 25 bp, Homo sapien
gatctttcaataggagtttaactag

SEQ ID NO: 564613 - DNA, 25 bp, Homo sapien
tctttcaataggagtttaactagtc

SEQ ID NO: 564614 - DNA, 25 bp, Homo sapien
ctttcaataggagtttaactagtct

SEQ ID NO: 564615 - DNA, 25 bp, Homo sapien
ataggagtttaactagtctttgtca

SEQ ID NO: 564616 - DNA, 25 bp, Homo sapien
taggagtttaactagtctttgtcat

SEQ ID NO: 564617 - DNA, 25 bp, Homo sapien
aggagtttaactagtctttgtcata

SEQ ID NO: 564618 - DNA, 25 bp, Homo sapien
ggagtttaactagtctttgtcatat

SEQ ID NO: 564619 - DNA, 25 bp, Homo sapien
gagtttaactagtctttgtcatatc

SEQ ID NO: 564620 - DNA, 25 bp, Homo sapien
agtttaactagtctttgtcatatca

SEQ ID NO: 564621 - DNA, 25 bp, Homo sapien
gtttaactagtctttgtcatatcag

SEQ ID NO: 564622 - DNA, 25 bp, Homo sapien
tttaactagtctttgtcatatcaga

SEQ ID NO: 564623 - DNA, 25 bp, Homo sapien
ctacatctgcaaagtttaatcgaaa

SEQ ID NO: 564624 - DNA, 25 bp, Homo sapien
gtttaatcgaaaaatttgccagtga

SEQ ID NO: 564625 - DNA, 25 bp, Homo sapien
gccagtgatatgatggccttgtcac

SEQ ID NO: 564626 - DNA, 25 bp, Homo sapien
ttgtcacagagatcacaagggacac

SEQ ID NO: 564627 - DNA, 25 bp, Homo sapien
cagagatcacaagggacacggagtt

SEQ ID NO: 564628 - DNA, 25 bp, Homo sapien
atcacaagggacacggagttgactt

SEQ ID NO: 564629 - DNA, 25 bp, Homo sapien
caagggacacggagttgacttttgc

SEQ ID NO: 564630 - DNA, 25 bp, Homo sapien
agttgacttttgctcaaggtggaac

SEQ ID NO: 564631 - DNA, 25 bp, Homo sapien
tgacttttgctcaaggtggaacgac

SEQ ID NO: 564632 - DNA, 25 bp, Homo sapien
cttttgctcaaggtggaacgacaga

SEQ ID NO: 564633 - DNA, 25 bp, Homo sapien
tcaaggtggaacgacagagctgtgt

SEQ ID NO: 564634 - DNA, 25 bp, Homo sapien
gggacctggcacactactgccaact

SEQ ID NO: 564635 - DNA, 25 bp, Homo sapien
cacactactgccaactagccaagtt

SEQ ID NO: 564636 - DNA, 25 bp, Homo sapien
actagccaagttggactcagaccca

SEQ ID NO: 564637 - DNA, 25 bp, Homo sapien
gacctctgccttgtgtgatcaggtg

SEQ ID NO: 564638 - DNA, 25 bp, Homo sapien
ctctgccttgtgtgatcaggtgcaa

SEQ ID NO: 564639 - DNA, 25 bp, Homo sapien
ctgccttgtgtgatcaggtgcaaac

SEQ ID NO: 564640 - DNA, 25 bp, Homo sapien
gccttgtgtgatcaggtgcaaacag

SEQ ID NO: 564641 - DNA, 25 bp, Homo sapien
gtgtgatcaggtgcaaacagacaac

SEQ ID NO: 564642 - DNA, 25 bp, Homo sapien
aaacagacaacaacccagcaggact

SEQ ID NO: 564643 - DNA, 25 bp, Homo sapien
gcaggactcctcttgcagaatctgg

SEQ ID NO: 564644 - DNA, 25 bp, Homo sapien
caggactcctcttgcagaatctgga

SEQ ID NO: 564645 - DNA, 25 bp, Homo sapien
gtctatgccaaaatatatggctgta

SEQ ID NO: 564646 - DNA, 25 bp, Homo sapien
tctatgccaaaatatatggctgtaa

SEQ ID NO: 564647 - DNA, 25 bp, Homo sapien
ctatgccaaaatatatggctgtaaa

SEQ ID NO: 564648 - DNA, 25 bp, Homo sapien
tatgccaaaatatatggctgtaaaa

SEQ ID NO: 564649 - DNA, 25 bp, Homo sapien
atgccaaaatatatggctgtaaaac

SEQ ID NO: 564650 - DNA, 25 bp, Homo sapien
tgccaaaatatatggctgtaaaaca

SEQ ID NO: 564651 - DNA, 25 bp, Homo sapien
gccaaaatatatggctgtaaaacag

SEQ ID NO: 564652 - DNA, 25 bp, Homo sapien
ccaaaatatatggctgtaaaacagt

SEQ ID NO: 564653 - DNA, 25 bp, Homo sapien
taatatttggagatctttagtttaa

SEQ ID NO: 564654 - DNA, 25 bp, Homo sapien
aattcttccataaaatagctttcag

SEQ ID NO: 564655 - DNA, 25 bp, Homo sapien
ataaaatagctttcagggccaggcg

SEQ ID NO: 564656 - DNA, 25 bp, Homo sapien
aaaatagctttcagggccaggcgtg

SEQ ID NO: 564657 - DNA, 25 bp, Homo sapien
aggcgtggtagctcagacttctact

SEQ ID NO: 564658 - DNA, 25 bp, Homo sapien
tggtagctcagacttctactccaag

SEQ ID NO: 564659 - DNA, 25 bp, Homo sapien
ttaagataaattagcgggcatggtc

SEQ ID NO: 564660 - DNA, 25 bp, Homo sapien
aaattagcgggcatggtcgcacatg

SEQ ID NO: 564661 - DNA, 25 bp, Homo sapien
attagcgggcatggtcgcacatgta

SEQ ID NO: 564662 - DNA, 25 bp, Homo sapien
tagcgggcatggtcgcacatgtagc

SEQ ID NO: 564663 - DNA, 25 bp, Homo sapien
gggcatggtcgcacatgtagctact

SEQ ID NO: 564664 - DNA, 25 bp, Homo sapien
gaaaatgcccacgtaaatagctgtc

SEQ ID NO: 564665 - DNA, 25 bp, Homo sapien
aaatgcccacgtaaatagctgtcat

SEQ ID NO: 564666 - DNA, 25 bp, Homo sapien
tgcccacgtaaatagctgtcatcat

SEQ ID NO: 564667 - DNA, 25 bp, Homo sapien
cacgtaaatagctgtcatcatcatt

SEQ ID NO: 564668 - DNA, 25 bp, Homo sapien
taaatagctgtcatcatcattatct

SEQ ID NO: 564669 - DNA, 25 bp, Homo sapien
tttatccattatccctggaacttat

SEQ ID NO: 564670 - DNA, 25 bp, Homo sapien
ccattatccctggaacttattgtga

SEQ ID NO: 564671 - DNA, 25 bp, Homo sapien
ttatccctggaacttattgtgaaag

SEQ ID NO: 564672 - DNA, 25 bp, Homo sapien
attgtgaaagttgtgctgttttcta

SEQ ID NO: 564673 - DNA, 25 bp, Homo sapien
gaaagttgtgctgttttctaagtaa

SEQ ID NO: 564674 - DNA, 25 bp, Homo sapien
gttgtgctgttttctaagtaaaata

SEQ ID NO: 564675 - DNA, 25 bp, Homo sapien
aggtgctactccttcaggaaggtac

SEQ ID NO: 564676 - DNA, 25 bp, Homo sapien
gtgctactccttcaggaaggtacca

SEQ ID NO: 564677 - DNA, 25 bp, Homo sapien
gctactccttcaggaaggtaccatc

SEQ ID NO: 564678 - DNA, 25 bp, Homo sapien
tccttcaggaaggtaccatcaagct

SEQ ID NO: 564679 - DNA, 25 bp, Homo sapien
ccttcaggaaggtaccatcaagctc

SEQ ID NO: 564680 - DNA, 25 bp, Homo sapien
cttcaggaaggtaccatcaagctcc

SEQ ID NO: 564681 - DNA, 25 bp, Homo sapien
cttccccactacctagtcattagag

SEQ ID NO: 564682 - DNA, 25 bp, Homo sapien
ttccccactacctagtcattagagc

SEQ ID NO: 564683 - DNA, 25 bp, Homo sapien
tccccactacctagtcattagagcg

SEQ ID NO: 564684 - DNA, 25 bp, Homo sapien
tcattagagcgtcagcatccacttc

SEQ ID NO: 564685 - DNA, 25 bp, Homo sapien
gtcagcatccacttcctgaaaggaa

SEQ ID NO: 564686 - DNA, 25 bp, Homo sapien
taaaactctttacagggccccacag

SEQ ID NO: 564687 - DNA, 25 bp, Homo sapien
aggatctcactatagactcttcctc

SEQ ID NO: 564688 - DNA, 25 bp, Homo sapien
atagactcttcctcttgcctaatta

SEQ ID NO: 564689 - DNA, 25 bp, Homo sapien
ttgcctaattacatcccacgttgtc

SEQ ID NO: 564690 - DNA, 25 bp, Homo sapien
cctttggagcctgtgcatatgcagt

SEQ ID NO: 564691 - DNA, 25 bp, Homo sapien
gcagttttttggaatattgtgcccc

SEQ ID NO: 564692 - DNA, 25 bp, Homo sapien
taacctcatgactcacctcctttag

SEQ ID NO: 564693 - DNA, 25 bp, Homo sapien
cctcctttaggtgtcactgtgtcaa

SEQ ID NO: 564694 - DNA, 25 bp, Homo sapien
tgtgtcaaagagtcctttaccaccc

SEQ ID NO: 564695 - DNA, 25 bp, Homo sapien
cttcacctttggagctcttcagtcc

SEQ ID NO: 564696 - DNA, 25 bp, Homo sapien
agtccctcacctttgcttgaatttt

SEQ ID NO: 564697 - DNA, 25 bp, Homo sapien
tccaggacagccctctggagccgtg

SEQ ID NO: 564698 - DNA, 25 bp, Homo sapien
gcctggccctgaaggacgaggtgga

SEQ ID NO: 564699 - DNA, 25 bp, Homo sapien
tggagagcatcttccctgacttctt

SEQ ID NO: 564700 - DNA, 25 bp, Homo sapien
tgacttctttgcctgctagcagcca

SEQ ID NO: 564701 - DNA, 25 bp, Homo sapien
tttgcctgctagcagccaggctgtg

SEQ ID NO: 564702 - DNA, 25 bp, Homo sapien
cgtgtgtgtccctgtcgcgtgcttg

SEQ ID NO: 564703 - DNA, 25 bp, Homo sapien
tgtcgcgtgcttgggcattttattt

SEQ ID NO: 564704 - DNA, 25 bp, Homo sapien
gttgcagctgcaccctaatttgagc

SEQ ID NO: 564705 - DNA, 25 bp, Homo sapien
gcaccctaatttgagcgaggcttac

SEQ ID NO: 564706 - DNA, 25 bp, Homo sapien
tttgagcgaggcttacaggctgtga

SEQ ID NO: 564707 - DNA, 25 bp, Homo sapien
gcttacaggctgtgagaagaggata

SEQ ID NO: 564708 - DNA, 25 bp, Homo sapien
tcttccttactttcccctgtgagat

SEQ ID NO: 564709 - DNA, 25 bp, Homo sapien
ccctgtgagatgcttttctgtcctt

SEQ ID NO: 564710 - DNA, 25 bp, Homo sapien
ttttctgtccttttactgcacctct

SEQ ID NO: 564711 - DNA, 25 bp, Homo sapien
gtccttttactgcacctcttccaga

SEQ ID NO: 564712 - DNA, 25 bp, Homo sapien
acctcttccagacctatggcatttg

SEQ ID NO: 564713 - DNA, 25 bp, Homo sapien
ctcttccagacctatggcatttggg

SEQ ID NO: 564714 - DNA, 25 bp, Homo sapien
ggacgggtcacccttcctagagtga

SEQ ID NO: 564715 - DNA, 25 bp, Homo sapien
cacccttcctagagtgatcctgaat

SEQ ID NO: 564716 - DNA, 25 bp, Homo sapien
ttcctagagtgatcctgaatccagc

SEQ ID NO: 564717 - DNA, 25 bp, Homo sapien
agagtgatcctgaatccagctgcct

SEQ ID NO: 564718 - DNA, 25 bp, Homo sapien
gtgatcctgaatccagctgcctctt

SEQ ID NO: 564719 - DNA, 25 bp, Homo sapien
ggttcttgcaagttgtgtgcgtgtt

SEQ ID NO: 564720 - DNA, 25 bp, Homo sapien
gtgcgtgttttatctgcccctacta

SEQ ID NO: 564721 - DNA, 25 bp, Homo sapien
gcccctactagcttttaggtgtctt

SEQ ID NO: 564722 - DNA, 25 bp, Homo sapien
ttaggtgtcttgagagcatgactct

SEQ ID NO: 564723 - DNA, 25 bp, Homo sapien
agagcatgactctggcttactcatc

SEQ ID NO: 564724 - DNA, 25 bp, Homo sapien
ggcttactcatctgtctattccaga

SEQ ID NO: 564725 - DNA, 25 bp, Homo sapien
atctgtctattccagaagaccttgt

SEQ ID NO: 564726 - DNA, 25 bp, Homo sapien
gaccttgtctgttcttggcatttat

SEQ ID NO: 564727 - DNA, 25 bp, Homo sapien
actgggttgaagtagttgcatgtca

SEQ ID NO: 564728 - DNA, 25 bp, Homo sapien
gcatgtcaagtttatatcagctgtt

SEQ ID NO: 564729 - DNA, 25 bp, Homo sapien
tcagctgttaaatacctttctggaa

SEQ ID NO: 564730 - DNA, 25 bp, Homo sapien
atgcggagtgagaaaagcctgttgc

SEQ ID NO: 564731 - DNA, 25 bp, Homo sapien
gaaaagcctgttgcagaagactaca

SEQ ID NO: 564732 - DNA, 25 bp, Homo sapien
aagcctgttgcagaagactacatac

SEQ ID NO: 564733 - DNA, 25 bp, Homo sapien
gcctgttgcagaagactacatacaa

SEQ ID NO: 564734 - DNA, 25 bp, Homo sapien
gcagaagactacatacaacaggatt

SEQ ID NO: 564735 - DNA, 25 bp, Homo sapien
gactacatacaacaggatttgacac

SEQ ID NO: 564736 - DNA, 25 bp, Homo sapien
ggatttgacacttgtaaggctccaa

SEQ ID NO: 564737 - DNA, 25 bp, Homo sapien
ttgacacttgtaaggctccaaaaca

SEQ ID NO: 564738 - DNA, 25 bp, Homo sapien
gatattgtttaggttttcatacata

SEQ ID NO: 564739 - DNA, 25 bp, Homo sapien
attgtttaggttttcatacataggt

SEQ ID NO: 564740 - DNA, 25 bp, Homo sapien
tacataggtgataaaagtgtgtttc

SEQ ID NO: 564741 - DNA, 25 bp, Homo sapien
gccgagggcatggacagggacttgt

SEQ ID NO: 564742 - DNA, 25 bp, Homo sapien
tggacagggacttgtggatccacga

SEQ ID NO: 564743 - DNA, 25 bp, Homo sapien
gggacttgtggatccacgagcagca

SEQ ID NO: 564744 - DNA, 25 bp, Homo sapien
acttgtggatccacgagcagcaggt

SEQ ID NO: 564745 - DNA, 25 bp, Homo sapien
agcaggtggccacactgacggaggc

SEQ ID NO: 564746 - DNA, 25 bp, Homo sapien
ccgaggcacagaagcgcgccgacgt

SEQ ID NO: 564747 - DNA, 25 bp, Homo sapien
agaagcgcgccgacgtgctgctcct

SEQ ID NO: 564748 - DNA, 25 bp, Homo sapien
ggagaactcgctgcagaaggcgttc

SEQ ID NO: 564749 - DNA, 25 bp, Homo sapien
aactcgctgcagaaggcgttcgctg

SEQ ID NO: 564750 - DNA, 25 bp, Homo sapien
tgcagaaggcgttcgctgccgccgc

SEQ ID NO: 564751 - DNA, 25 bp, Homo sapien
gagttggagagcctcatctgccagg

SEQ ID NO: 564752 - DNA, 25 bp, Homo sapien
atattagatgggtaagtatatccct

SEQ ID NO: 564753 - DNA, 25 bp, Homo sapien
tgggtaagtatatcccttttaacag

SEQ ID NO: 564754 - DNA, 25 bp, Homo sapien
gtaagtatatcccttttaacagctg

SEQ ID NO: 564755 - DNA, 25 bp, Homo sapien
aagtatatcccttttaacagctgat

SEQ ID NO: 564756 - DNA, 25 bp, Homo sapien
atcccttttaacagctgatatggac

SEQ ID NO: 564757 - DNA, 25 bp, Homo sapien
gactaatacaacagctgttggcaat

SEQ ID NO: 564758 - DNA, 25 bp, Homo sapien
tacaacagctgttggcaatgccttt

SEQ ID NO: 564759 - DNA, 25 bp, Homo sapien
cagctgttggcaatgcctttgttca

SEQ ID NO: 564760 - DNA, 25 bp, Homo sapien
aatgcctttgttcactacaacttac

SEQ ID NO: 564761 - DNA, 25 bp, Homo sapien
gcctttgttcactacaacttactga

SEQ ID NO: 564762 - DNA, 25 bp, Homo sapien
actacaacttactgaactaaattct

SEQ ID NO: 564763 - DNA, 25 bp, Homo sapien
ggcagtgagaccaggtcccttgctg

SEQ ID NO: 564764 - DNA, 25 bp, Homo sapien
tttcgggctgttaatttccttgaca

SEQ ID NO: 564765 - DNA, 25 bp, Homo sapien
tcgggctgttaatttccttgacaat

SEQ ID NO: 564766 - DNA, 25 bp, Homo sapien
gggctgttaatttccttgacaataa

SEQ ID NO: 564767 - DNA, 25 bp, Homo sapien
gttaatttccttgacaataaaatgg

SEQ ID NO: 564768 - DNA, 25 bp, Homo sapien
aatggatgaaaccaatcagcacggg

SEQ ID NO: 564769 - DNA, 25 bp, Homo sapien
gtgatttggccgccggccactcaga

SEQ ID NO: 564770 - DNA, 25 bp, Homo sapien
taccttttggatactgtggttctat

SEQ ID NO: 564771 - DNA, 25 bp, Homo sapien
ccttttggatactgtggttctattt

SEQ ID NO: 564772 - DNA, 25 bp, Homo sapien
ttggatactgtggttctatttgata

SEQ ID NO: 564773 - DNA, 25 bp, Homo sapien
gatactgtggttctatttgataata

SEQ ID NO: 564774 - DNA, 25 bp, Homo sapien
aaaactctcagcaagttagggatag

SEQ ID NO: 564775 - DNA, 25 bp, Homo sapien
gggataggaattacttcaacttaat

SEQ ID NO: 564776 - DNA, 25 bp, Homo sapien
accactctggtggtgaatgttgcta

SEQ ID NO: 564777 - DNA, 25 bp, Homo sapien
ctctggtggtgaatgttgctaagga

SEQ ID NO: 564778 - DNA, 25 bp, Homo sapien
ctaaggagggaagctatacatgtgt

SEQ ID NO: 564779 - DNA, 25 bp, Homo sapien
gatgtgtgagcaatttctgtacctt

SEQ ID NO: 564780 - DNA, 25 bp, Homo sapien
tgtgagcaatttctgtaccttctac

SEQ ID NO: 564781 - DNA, 25 bp, Homo sapien
agcaatttctgtaccttctactcaa

SEQ ID NO: 564782 - DNA, 25 bp, Homo sapien
atttctgtaccttctactcaatctt

SEQ ID NO: 564783 - DNA, 25 bp, Homo sapien
gtaccttctactcaatcttctgtga

SEQ ID NO: 564784 - DNA, 25 bp, Homo sapien
cttctactcaatcttctgtgagact

SEQ ID NO: 564785 - DNA, 25 bp, Homo sapien
atacagaaggcgtgatagatgggat

SEQ ID NO: 564786 - DNA, 25 bp, Homo sapien
tgggatgtcacttttgtggcttctg

SEQ ID NO: 564787 - DNA, 25 bp, Homo sapien
ttctgtcttgggtgctcgctctctc

SEQ ID NO: 564788 - DNA, 25 bp, Homo sapien
ggatttctcactcttggggaagcca

SEQ ID NO: 564789 - DNA, 25 bp, Homo sapien
ttggaaatggatcttctgacgctgc

SEQ ID NO: 564790 - DNA, 25 bp, Homo sapien
aaatggatcttctgacgctgccaac

SEQ ID NO: 564791 - DNA, 25 bp, Homo sapien
atcttctgacgctgccaacatccat

SEQ ID NO: 564792 - DNA, 25 bp, Homo sapien
gaaacttgaaggtgcctcagctcca

SEQ ID NO: 564793 - DNA, 25 bp, Homo sapien
gatggcagctcatgagagaccctca

SEQ ID NO: 564794 - DNA, 25 bp, Homo sapien
gcagctcatgagagaccctcagcca

SEQ ID NO: 564795 - DNA, 25 bp, Homo sapien
gctaagccactctggatttctgacc

SEQ ID NO: 564796 - DNA, 25 bp, Homo sapien
ttttcagtggccaaatagtcaggac

SEQ ID NO: 564797 - DNA, 25 bp, Homo sapien
cagtggccaaatagtcaggacattc

SEQ ID NO: 564798 - DNA, 25 bp, Homo sapien
aatagtcaggacattcaaaggttta

SEQ ID NO: 564799 - DNA, 25 bp, Homo sapien
caaaggtttatgtggtaatatcagt

SEQ ID NO: 564800 - DNA, 25 bp, Homo sapien
atcagtgatatttcgaactgtgaaa

SEQ ID NO: 564801 - DNA, 25 bp, Homo sapien
ggacttaataattagaccatttcta

SEQ ID NO: 564802 - DNA, 25 bp, Homo sapien
ttagaccatttctacaaagaacaac

SEQ ID NO: 564803 - DNA, 25 bp, Homo sapien
gaacaactgaataggtggaaaacat

SEQ ID NO: 564804 - DNA, 25 bp, Homo sapien
acatggaatttcttttaggtgcagt

SEQ ID NO: 564805 - DNA, 25 bp, Homo sapien
ggtggtcttcaaattacattagttt

SEQ ID NO: 564806 - DNA, 25 bp, Homo sapien
gagaaagcttaagacctgcttcaaa

SEQ ID NO: 564807 - DNA, 25 bp, Homo sapien
gatctaaagttctggctgtccatta

SEQ ID NO: 564808 - DNA, 25 bp, Homo sapien
atctaaagttctggctgtccattaa

SEQ ID NO: 564809 - DNA, 25 bp, Homo sapien
ctaaagttctggctgtccattaacc

SEQ ID NO: 564810 - DNA, 25 bp, Homo sapien
ctggtgtgtatcaacattatttaat

SEQ ID NO: 564811 - DNA, 25 bp, Homo sapien
tggtgtgtatcaacattatttaatg

SEQ ID NO: 564812 - DNA, 25 bp, Homo sapien
ggtgtgtatcaacattatttaatgt

SEQ ID NO: 564813 - DNA, 25 bp, Homo sapien
gtgtgtatcaacattatttaatgtc

SEQ ID NO: 564814 - DNA, 25 bp, Homo sapien
tatttaatgtcttctaattcagtca

SEQ ID NO: 564815 - DNA, 25 bp, Homo sapien
taatgtcttctaattcagtcatttt

SEQ ID NO: 564816 - DNA, 25 bp, Homo sapien
gtcttctaattcagtcattttttta

SEQ ID NO: 564817 - DNA, 25 bp, Homo sapien
aagtatgtctataaacattgaactt

SEQ ID NO: 564818 - DNA, 25 bp, Homo sapien
aatttccttgccttggccacactga

SEQ ID NO: 564819 - DNA, 25 bp, Homo sapien
ggccacactgaattgtcaactgatt

SEQ ID NO: 564820 - DNA, 25 bp, Homo sapien
tgcctgctctgggatcagagaccag

SEQ ID NO: 564821 - DNA, 25 bp, Homo sapien
gagaccagggttcaaacctcagttc

SEQ ID NO: 564822 - DNA, 25 bp, Homo sapien
gacaagtgactttatctctgagcct

SEQ ID NO: 564823 - DNA, 25 bp, Homo sapien
tcctcatgtgtaaagcaatgcctgc

SEQ ID NO: 564824 - DNA, 25 bp, Homo sapien
aatgcctgcccctagggttgtgcca

SEQ ID NO: 564825 - DNA, 25 bp, Homo sapien
ggttgtgccagtgttccatgagaca

SEQ ID NO: 564826 - DNA, 25 bp, Homo sapien
gagacagtgcactcatatgttagta

SEQ ID NO: 564827 - DNA, 25 bp, Homo sapien
aacaagctggcggttatcagccaat

SEQ ID NO: 564828 - DNA, 25 bp, Homo sapien
ttatcagccaataaacgctgcctct

SEQ ID NO: 564829 - DNA, 25 bp, Homo sapien
taagaaaaatattgaccgcgatggt

SEQ ID NO: 564830 - DNA, 25 bp, Homo sapien
gaccgcgatggtgataatagaaatg

SEQ ID NO: 564831 - DNA, 25 bp, Homo sapien
tttctggttctggaggttaaggcct

SEQ ID NO: 564832 - DNA, 25 bp, Homo sapien
aaggcctcagttctagctgttcaac

SEQ ID NO: 564833 - DNA, 25 bp, Homo sapien
gctgttcaactcttgtatgtgcttg

SEQ ID NO: 564834 - DNA, 25 bp, Homo sapien
ttaatttctctcaccctctcgactt

SEQ ID NO: 564835 - DNA, 25 bp, Homo sapien
ctcgacttccttatctgcagattgg

SEQ ID NO: 564836 - DNA, 25 bp, Homo sapien
gattgggagcaacaatttctgcata

SEQ ID NO: 564837 - DNA, 25 bp, Homo sapien
tcttaaccacacgtccaacagtaga

SEQ ID NO: 564838 - DNA, 25 bp, Homo sapien
aaactcattcgcaagagagtgttat

SEQ ID NO: 564839 - DNA, 25 bp, Homo sapien
gacggcgatgatgaaacttgtggta

SEQ ID NO: 564840 - DNA, 25 bp, Homo sapien
agtgtcacaaagagtccagcaccct

SEQ ID NO: 564841 - DNA, 25 bp, Homo sapien
tctccttccaggtatataaacggtg

SEQ ID NO: 564842 - DNA, 25 bp, Homo sapien
ataaacggtgcattgctgggctcct

SEQ ID NO: 564843 - DNA, 25 bp, Homo sapien
gggctcctttgcagttggataggtc

SEQ ID NO: 564844 - DNA, 25 bp, Homo sapien
ttactatgtttcacttctaagccga

SEQ ID NO: 564845 - DNA, 25 bp, Homo sapien
taagccgaagcatttgattgtcaat

SEQ ID NO: 564846 - DNA, 25 bp, Homo sapien
ttgtcaatggaataccctccagctc

SEQ ID NO: 564847 - DNA, 25 bp, Homo sapien
gatgacagagttcccaatagcctag

SEQ ID NO: 564848 - DNA, 25 bp, Homo sapien
ccaatagcctagattcctgaatgac

SEQ ID NO: 564849 - DNA, 25 bp, Homo sapien
tgacttagtggagctgagtcctcca

SEQ ID NO: 564850 - DNA, 25 bp, Homo sapien
gagtcctccacaggtccatgttgga

SEQ ID NO: 564851 - DNA, 25 bp, Homo sapien
tgctactccatcctgaaagccaaga

SEQ ID NO: 564852 - DNA, 25 bp, Homo sapien
actccatcctgaaagccaagaacgc

SEQ ID NO: 564853 - DNA, 25 bp, Homo sapien
gccaagaacgcagggatgtcgctgg

SEQ ID NO: 564854 - DNA, 25 bp, Homo sapien
agtggctgtgccaccaagcattcct

SEQ ID NO: 564855 - DNA, 25 bp, Homo sapien
aagcattcctgctcaagctgactcg

SEQ ID NO: 564856 - DNA, 25 bp, Homo sapien
tgctcaagctgactcgacaccgtgt

SEQ ID NO: 564857 - DNA, 25 bp, Homo sapien
gactcgacaccgtgtcacctacgtg

SEQ ID NO: 564858 - DNA, 25 bp, Homo sapien
gtgtcacctacgtgccactcctggg

SEQ ID NO: 564859 - DNA, 25 bp, Homo sapien
agcccagacgcagctgagtcggaag

SEQ ID NO: 564860 - DNA, 25 bp, Homo sapien
gacgcagctgagtcggaagctcccg

SEQ ID NO: 564861 - DNA, 25 bp, Homo sapien
gacgacgctgactgccctggaggcc

SEQ ID NO: 564862 - DNA, 25 bp, Homo sapien
agtaaaagtttattcctgcatgagg

SEQ ID NO: 564863 - DNA, 25 bp, Homo sapien
agtttattcctgcatgagggatttt

SEQ ID NO: 564864 - DNA, 25 bp, Homo sapien
gagggattttttggccagctgctct

SEQ ID NO: 564865 - DNA, 25 bp, Homo sapien
tggccagctgctctgatgcctggat

SEQ ID NO: 564866 - DNA, 25 bp, Homo sapien
ctggatttttcttcccaccaatctt

SEQ ID NO: 564867 - DNA, 25 bp, Homo sapien
ttttcttcccaccaatcttcataag

SEQ ID NO: 564868 - DNA, 25 bp, Homo sapien
atcttcataagcagccatggagggc

SEQ ID NO: 564869 - DNA, 25 bp, Homo sapien
atggagggctcagctactgacacct

SEQ ID NO: 564870 - DNA, 25 bp, Homo sapien
tactgacacctcctcagagaagatt

SEQ ID NO: 564871 - DNA, 25 bp, Homo sapien
gagaagatttccctcaccgcattat

SEQ ID NO: 564872 - DNA, 25 bp, Homo sapien
accgcattatctgtagtagctccca

SEQ ID NO: 564873 - DNA, 25 bp, Homo sapien
gcctaaaagatgatcttaccaagtt

SEQ ID NO: 564874 - DNA, 25 bp, Homo sapien
taccaagttgaagtcatttaccgtg

SEQ ID NO: 564875 - DNA, 25 bp, Homo sapien
gttgaagtcatttaccgtgatgctg

SEQ ID NO: 564876 - DNA, 25 bp, Homo sapien
gtcatttaccgtgatgctggttgat

SEQ ID NO: 564877 - DNA, 25 bp, Homo sapien
tgcaagaggaagaacaccatagtaa

SEQ ID NO: 564878 - DNA, 25 bp, Homo sapien
tcagacttgaagttgagaagctaca

SEQ ID NO: 564879 - DNA, 25 bp, Homo sapien
gagtaaatctgagtgcacccagcta

SEQ ID NO: 564880 - DNA, 25 bp, Homo sapien
tctgagtgcacccagctacatttaa

SEQ ID NO: 564881 - DNA, 25 bp, Homo sapien
gtgcacccagctacatttaaatctg

SEQ ID NO: 564882 - DNA, 25 bp, Homo sapien
gaacttaaccaaagacctgctaaat

SEQ ID NO: 564883 - DNA, 25 bp, Homo sapien
aggtggtcaagagtcgagttaaaga

SEQ ID NO: 564884 - DNA, 25 bp, Homo sapien
gagcaagcactggatgggcaatgca

SEQ ID NO: 564885 - DNA, 25 bp, Homo sapien
caagcactggatgggcaatgcagca

SEQ ID NO: 564886 - DNA, 25 bp, Homo sapien
gacttcagcaaatgaactagctgtg

SEQ ID NO: 564887 - DNA, 25 bp, Homo sapien
cagcaaatgaactagctgtgtgact

SEQ ID NO: 564888 - DNA, 25 bp, Homo sapien
aagtcacttccctacactagatgct

SEQ ID NO: 564889 - DNA, 25 bp, Homo sapien
ttccctacactagatgcttcttgaa

SEQ ID NO: 564890 - DNA, 25 bp, Homo sapien
gatgcttcttgaaattccttttggc

SEQ ID NO: 564891 - DNA, 25 bp, Homo sapien
gcttcttgaaattccttttggccaa

SEQ ID NO: 564892 - DNA, 25 bp, Homo sapien
tcttgaaattccttttggccaaaat

SEQ ID NO: 564893 - DNA, 25 bp, Homo sapien
cttttggccaaaatgttctatactt

SEQ ID NO: 564894 - DNA, 25 bp, Homo sapien
ggccaaaatgttctatactttaatg

SEQ ID NO: 564895 - DNA, 25 bp, Homo sapien
gggaaaaattgcgattcttcattaa

SEQ ID NO: 564896 - DNA, 25 bp, Homo sapien
aaattgcgattcttcattaaataat

SEQ ID NO: 564897 - DNA, 25 bp, Homo sapien
ataatattctttatgtcactagcat

SEQ ID NO: 564898 - DNA, 25 bp, Homo sapien
tattctttatgtcactagcatacaa

SEQ ID NO: 564899 - DNA, 25 bp, Homo sapien
gtcactagcatacaatttatgttag

SEQ ID NO: 564900 - DNA, 25 bp, Homo sapien
gttagtagacatctttaaatctctt

SEQ ID NO: 564901 - DNA, 25 bp, Homo sapien
aaatctctttaatgagtgaatccat

SEQ ID NO: 564902 - DNA, 25 bp, Homo sapien
tgagtgaatccatgcaagccccata

SEQ ID NO: 564903 - DNA, 25 bp, Homo sapien
gcaagccccataaaacagttcctag

SEQ ID NO: 564904 - DNA, 25 bp, Homo sapien
aaacagttcctagcatgcagaaaat

SEQ ID NO: 564905 - DNA, 25 bp, Homo sapien
tgcccacgtaaatagctgtcatcat

SEQ ID NO: 564906 - DNA, 25 bp, Homo sapien
gtctccaaaactcttaacagtgtgt

SEQ ID NO: 564907 - DNA, 25 bp, Homo sapien
cagtgtgtaaaccatttgatcttca

SEQ ID NO: 564908 - DNA, 25 bp, Homo sapien
gatcttcatgcatctccacatgcat

SEQ ID NO: 564909 - DNA, 25 bp, Homo sapien
catctccacatgcatctattaaaag

SEQ ID NO: 564910 - DNA, 25 bp, Homo sapien
aaattttggcagacatcgaagcaga

SEQ ID NO: 564911 - DNA, 25 bp, Homo sapien
aacacgttggccttatttgtctcca

SEQ ID NO: 564912 - DNA, 25 bp, Homo sapien
tgtctccaaggcgtaagtcaccagt

SEQ ID NO: 564913 - DNA, 25 bp, Homo sapien
tgtgcaggtgtaaaccctgtgcctt

SEQ ID NO: 564914 - DNA, 25 bp, Homo sapien
aaaccctgtgccttgtaactgcaac

SEQ ID NO: 564915 - DNA, 25 bp, Homo sapien
gtgcccacggtatcttccagaggac

SEQ ID NO: 564916 - DNA, 25 bp, Homo sapien
tccagaggacgagaacaagccgtaa

SEQ ID NO: 564917 - DNA, 25 bp, Homo sapien
cagagagagcctactgtatgccaga

SEQ ID NO: 564918 - DNA, 25 bp, Homo sapien
agagagagcctactgtatgccagat

SEQ ID NO: 564919 - DNA, 25 bp, Homo sapien
gagagagcctactgtatgccagata

SEQ ID NO: 564920 - DNA, 25 bp, Homo sapien
agagagcctactgtatgccagatac

SEQ ID NO: 564921 - DNA, 25 bp, Homo sapien
gagagcctactgtatgccagatact

SEQ ID NO: 564922 - DNA, 25 bp, Homo sapien
ctactgtatgccagatacttaacag

SEQ ID NO: 564923 - DNA, 25 bp, Homo sapien
gtatgccagatacttaacagaagga

SEQ ID NO: 564924 - DNA, 25 bp, Homo sapien
tgccagatacttaacagaaggaaag

SEQ ID NO: 564925 - DNA, 25 bp, Homo sapien
ttatatgtaaactctgggaaaagtg

SEQ ID NO: 564926 - DNA, 25 bp, Homo sapien
taaactctgggaaaagtggagccaa

SEQ ID NO: 564927 - DNA, 25 bp, Homo sapien
actctgggaaaagtggagccaaatg

SEQ ID NO: 564928 - DNA, 25 bp, Homo sapien
atgatgaaaccccaaggccttggtt

SEQ ID NO: 564929 - DNA, 25 bp, Homo sapien
aaggccttggtttatccaatctcaa

SEQ ID NO: 564930 - DNA, 25 bp, Homo sapien
actatgggagtgatgtcctcgccaa

SEQ ID NO: 564931 - DNA, 25 bp, Homo sapien
tgatgtcctcgccaacctagtacaa

SEQ ID NO: 564932 - DNA, 25 bp, Homo sapien
ctagtacaaccacacctcagtagac

SEQ ID NO: 564933 - DNA, 25 bp, Homo sapien
acctcagtagaccacactttcaaaa

SEQ ID NO: 564934 - DNA, 25 bp, Homo sapien
gaaaattacacagggatgcatcttg

SEQ ID NO: 564935 - DNA, 25 bp, Homo sapien
tcccaagatggaatgtagtcctcct

SEQ ID NO: 564936 - DNA, 25 bp, Homo sapien
agtacaaagagctgagtcccttcaa

SEQ ID NO: 564937 - DNA, 25 bp, Homo sapien
gagctgagtcccttcaaagactgaa

SEQ ID NO: 564938 - DNA, 25 bp, Homo sapien
ctcagatgcctacctggttatgtgc

SEQ ID NO: 564939 - DNA, 25 bp, Homo sapien
gtataccctactagatatttccaaa

SEQ ID NO: 564940 - DNA, 25 bp, Homo sapien
aattgttctcttagactcctgagaa

SEQ ID NO: 564941 - DNA, 25 bp, Homo sapien
ctcttagactcctgagaactggtaa

SEQ ID NO: 564942 - DNA, 25 bp, Homo sapien
aatgaggatggctcaattttttatt

SEQ ID NO: 564943 - DNA, 25 bp, Homo sapien
taacaggttttcactatttcaaata

SEQ ID NO: 564944 - DNA, 25 bp, Homo sapien
atttcagtagctgtatatacatgga

SEQ ID NO: 564945 - DNA, 25 bp, Homo sapien
ggaagtacaattgctcatacatcat

SEQ ID NO: 564946 - DNA, 25 bp, Homo sapien
gctcatacatcatacactctttcag

SEQ ID NO: 564947 - DNA, 25 bp, Homo sapien
atacactctttcagttatgttagat

SEQ ID NO: 564948 - DNA, 25 bp, Homo sapien
ataatactaaatcaaccatgggttc

SEQ ID NO: 564949 - DNA, 25 bp, Homo sapien
aaccatgggttctgtataccctact

SEQ ID NO: 564950 - DNA, 25 bp, Homo sapien
gctgcttatctgtctaacttggctg

SEQ ID NO: 564951 - DNA, 25 bp, Homo sapien
atctgtctaacttggctggtggtgt

SEQ ID NO: 564952 - DNA, 25 bp, Homo sapien
taacttggctggtggtgtggacccc

SEQ ID NO: 564953 - DNA, 25 bp, Homo sapien
ggaccccactgcctgctagggaata

SEQ ID NO: 564954 - DNA, 25 bp, Homo sapien
tgcctgctagggaataccagcgctt

SEQ ID NO: 564955 - DNA, 25 bp, Homo sapien
ccccatctggtgatgcttgagtgca

SEQ ID NO: 564956 - DNA, 25 bp, Homo sapien
gatgcttgagtgcacagagaccaac

SEQ ID NO: 564957 - DNA, 25 bp, Homo sapien
acagagaccaactccctgggcttca

SEQ ID NO: 564958 - DNA, 25 bp, Homo sapien
aactccctgggcttcatactggcct

SEQ ID NO: 564959 - DNA, 25 bp, Homo sapien
tgggcttcatactggccttcctcta

SEQ ID NO: 564960 - DNA, 25 bp, Homo sapien
tctccatcagtgcctttgcctgcag

SEQ ID NO: 564961 - DNA, 25 bp, Homo sapien
gcccaagtcattcttctggtcattc

SEQ ID NO: 564962 - DNA, 25 bp, Homo sapien
ggtcattcttctaattgctattgca

SEQ ID NO: 564963 - DNA, 25 bp, Homo sapien
ctattgcaaacttcttcattggaac

SEQ ID NO: 564964 - DNA, 25 bp, Homo sapien
gcaaacttcttcattggaactgtca

SEQ ID NO: 564965 - DNA, 25 bp, Homo sapien
ggaactgtcattccatccaacaatg

SEQ ID NO: 564966 - DNA, 25 bp, Homo sapien
tccagaggtttctttaattaccaag

SEQ ID NO: 564967 - DNA, 25 bp, Homo sapien
aattaccaagcatcaatatttgcag

SEQ ID NO: 564968 - DNA, 25 bp, Homo sapien
agcagctactgggattcttgctggt

SEQ ID NO: 564969 - DNA, 25 bp, Homo sapien
actgggattcttgctggtgccaata

SEQ ID NO: 564970 - DNA, 25 bp, Homo sapien
gattcttgctggtgccaatatctca

SEQ ID NO: 564971 - DNA, 25 bp, Homo sapien
gctggtgccaatatctcaggagatt

SEQ ID NO: 564972 - DNA, 25 bp, Homo sapien
aagccttgggtcaccaattcgtgtc

SEQ ID NO: 564973 - DNA, 25 bp, Homo sapien
accaattcgtgtccgctcagagatt

SEQ ID NO: 564974 - DNA, 25 bp, Homo sapien
ctcagagattactcagccagacaga

SEQ ID NO: 564975 - DNA, 25 bp, Homo sapien
agagattactcagccagacagagat

SEQ ID NO: 564976 - DNA, 25 bp, Homo sapien
gattactcagccagacagagatatt

SEQ ID NO: 564977 - DNA, 25 bp, Homo sapien
gacagagatattccactggtgcgaa

SEQ ID NO: 564978 - DNA, 25 bp, Homo sapien
aagttacgttccattcacagctttg

SEQ ID NO: 564979 - DNA, 25 bp, Homo sapien
tggagccaaagccagacactgacaa

SEQ ID NO: 564980 - DNA, 25 bp, Homo sapien
ggagccaaagccagacactgacaag

SEQ ID NO: 564981 - DNA, 25 bp, Homo sapien
agccagacactgacaagttccttga

SEQ ID NO: 564982 - DNA, 25 bp, Homo sapien
caagttccttgagacctggtataaa

SEQ ID NO: 564983 - DNA, 25 bp, Homo sapien
gaaaagcagagattctttcccactg

SEQ ID NO: 564984 - DNA, 25 bp, Homo sapien
attctttcccactgccatgtttgaa

SEQ ID NO: 564985 - DNA, 25 bp, Homo sapien
tttcccactgccatgtttgaatagt

SEQ ID NO: 564986 - DNA, 25 bp, Homo sapien
cccactgccatgtttgaatagtttg

SEQ ID NO: 564987 - DNA, 25 bp, Homo sapien
aatagtttggttagcaattccctgt

SEQ ID NO: 564988 - DNA, 25 bp, Homo sapien
ttggttagcaattccctgtagtaga

SEQ ID NO: 564989 - DNA, 25 bp, Homo sapien
ttccctgtagtagagaaagcatttg

SEQ ID NO: 564990 - DNA, 25 bp, Homo sapien
catttgagaaatgttcgtgagatca

SEQ ID NO: 564991 - DNA, 25 bp, Homo sapien
aatgttcgtgagatcagaagtcaaa

SEQ ID NO: 564992 - DNA, 25 bp, Homo sapien
aaaggtgggtctgtcccactcacgc

SEQ ID NO: 564993 - DNA, 25 bp, Homo sapien
actcacgcagcactggatcagtcgg

SEQ ID NO: 564994 - DNA, 25 bp, Homo sapien
aacagcaaggctagttcaaaaggag

SEQ ID NO: 564995 - DNA, 25 bp, Homo sapien
ttcaaaaggagcataaaggactact

SEQ ID NO: 564996 - DNA, 25 bp, Homo sapien
ggactacttgaggatggagctcact

SEQ ID NO: 564997 - DNA, 25 bp, Homo sapien
acctcccagataagactgtctggct

SEQ ID NO: 564998 - DNA, 25 bp, Homo sapien
ataagactgtctggcttcagagagc

SEQ ID NO: 564999 - DNA, 25 bp, Homo sapien
gactgtctggcttcagagagcggat

SEQ ID NO: 565000 - DNA, 25 bp, Homo sapien
tggcttcagagagcggatcagctgt

SEQ ID NO: 565001 - DNA, 25 bp, Homo sapien
gtcctttgaggcctggtaaccattc

SEQ ID NO: 565002 - DNA, 25 bp, Homo sapien
gaggcctggtaaccattccaggtga

SEQ ID NO: 565003 - DNA, 25 bp, Homo sapien
gtaaccattccaggtgatgtgggta

SEQ ID NO: 565004 - DNA, 25 bp, Homo sapien
ccattccaggtgatgtgggtagtga

SEQ ID NO: 565005 - DNA, 25 bp, Homo sapien
cccatgtggcaacacaagcactgcg

SEQ ID NO: 565006 - DNA, 25 bp, Homo sapien
aagcactgcgatttcacacaagacc

SEQ ID NO: 565007 - DNA, 25 bp, Homo sapien
agaccaaatcagaattggccggagg

SEQ ID NO: 565008 - DNA, 25 bp, Homo sapien
acgtcagattcttagggagtgttac

SEQ ID NO: 565009 - DNA, 25 bp, Homo sapien
ggagtgttactccaactaatgctac

SEQ ID NO: 565010 - DNA, 25 bp, Homo sapien
tactccaactaatgctacactcagg

SEQ ID NO: 565011 - DNA, 25 bp, Homo sapien
aatgctacactcagggcgacttctt

SEQ ID NO: 565012 - DNA, 25 bp, Homo sapien
aaaagccccatagtctagccataca

SEQ ID NO: 565013 - DNA, 25 bp, Homo sapien
ccatagtctagccatacaactttcc

SEQ ID NO: 565014 - DNA, 25 bp, Homo sapien
gttctgtgagactctttcctcatcc

SEQ ID NO: 565015 - DNA, 25 bp, Homo sapien
tcctcatccccaaaaatggaaggtc

SEQ ID NO: 565016 - DNA, 25 bp, Homo sapien
gaaaggcattctaaaccaaaggaag

SEQ ID NO: 565017 - DNA, 25 bp, Homo sapien
atttgtgatctgatccacatacaag

SEQ ID NO: 565018 - DNA, 25 bp, Homo sapien
ccacatacaagcacagtgtagtaca

SEQ ID NO: 565019 - DNA, 25 bp, Homo sapien
gtgtagtacagctggaatatagaga

SEQ ID NO: 565020 - DNA, 25 bp, Homo sapien
aagagcttgaagacttatgagcaac

SEQ ID NO: 565021 - DNA, 25 bp, Homo sapien
gacttatgagcaactatcccggtac

SEQ ID NO: 565022 - DNA, 25 bp, Homo sapien
atgagcaactatcccggtactcttg

SEQ ID NO: 565023 - DNA, 25 bp, Homo sapien
tatcccggtactcttggaggctctg

SEQ ID NO: 565024 - DNA, 25 bp, Homo sapien
ggaggctctgcaaccacagtttgag

SEQ ID NO: 565025 - DNA, 25 bp, Homo sapien
acagtttgagaaactccgcgttcaa

SEQ ID NO: 565026 - DNA, 25 bp, Homo sapien
aagttaaaaactgtcacctgaatag

SEQ ID NO: 565027 - DNA, 25 bp, Homo sapien
ccagcctggtcccatatcatagtga

SEQ ID NO: 565028 - DNA, 25 bp, Homo sapien
gcctggtcccatatcatagtgaaat

SEQ ID NO: 565029 - DNA, 25 bp, Homo sapien
catatcatagtgaaatggtgcctgt

SEQ ID NO: 565030 - DNA, 25 bp, Homo sapien
aaatggtgcctgtaaagctctcagc

SEQ ID NO: 565031 - DNA, 25 bp, Homo sapien
aagctctcagcattggcttggcaca

SEQ ID NO: 565032 - DNA, 25 bp, Homo sapien
tcagcattggcttggcacatgcagt

SEQ ID NO: 565033 - DNA, 25 bp, Homo sapien
ttggcttggcacatgcagttggtac

SEQ ID NO: 565034 - DNA, 25 bp, Homo sapien
gcttggcacatgcagttggtactca

SEQ ID NO: 565035 - DNA, 25 bp, Homo sapien
ggcacatgcagttggtactcaataa

SEQ ID NO: 565036 - DNA, 25 bp, Homo sapien
ggtactcaataaacggctgttgcta

SEQ ID NO: 565037 - DNA, 25 bp, Homo sapien
tcaataaacggctgttgctatcccc

SEQ ID NO: 565038 - DNA, 25 bp, Homo sapien
tctccaaactcttgacccacagaac

SEQ ID NO: 565039 - DNA, 25 bp, Homo sapien
aaactaatgcaaggagatatcaatt

SEQ ID NO: 565040 - DNA, 25 bp, Homo sapien
caattattgtaaaaagcttagcttt

SEQ ID NO: 565041 - DNA, 25 bp, Homo sapien
tgttttaaaatatagttcaccagta

SEQ ID NO: 565042 - DNA, 25 bp, Homo sapien
atatagttcaccagtagtaagttac

SEQ ID NO: 565043 - DNA, 25 bp, Homo sapien
tagttcaccagtagtaagttactaa

SEQ ID NO: 565044 - DNA, 25 bp, Homo sapien
aagcaagccatttacaaatcaataa

SEQ ID NO: 565045 - DNA, 25 bp, Homo sapien
taattaatcaatttctgtacgcctg

SEQ ID NO: 565046 - DNA, 25 bp, Homo sapien
taatcaatttctgtacgcctgtaat

SEQ ID NO: 565047 - DNA, 25 bp, Homo sapien
tcaatttctgtacgcctgtaatgaa

SEQ ID NO: 565048 - DNA, 25 bp, Homo sapien
ttctgtacgcctgtaatgaaaataa

SEQ ID NO: 565049 - DNA, 25 bp, Homo sapien
cagagaacactttagttcttgtcta

SEQ ID NO: 565050 - DNA, 25 bp, Homo sapien
agttcttgtctataaggcttaccaa

SEQ ID NO: 565051 - DNA, 25 bp, Homo sapien
gaaaggtggtcctgtgctgttacca

SEQ ID NO: 565052 - DNA, 25 bp, Homo sapien
ctgtgctgttaccactttgaccaag

SEQ ID NO: 565053 - DNA, 25 bp, Homo sapien
gctgttaccactttgaccaagagaa

SEQ ID NO: 565054 - DNA, 25 bp, Homo sapien
gaccaagagaagaacctggagattg

SEQ ID NO: 565055 - DNA, 25 bp, Homo sapien
cctggagattgggatgtttttgcat

SEQ ID NO: 565056 - DNA, 25 bp, Homo sapien
ggatgtttttgcatgtcaggattta

SEQ ID NO: 565057 - DNA, 25 bp, Homo sapien
gagggatgatgcttctcacttattc

SEQ ID NO: 565058 - DNA, 25 bp, Homo sapien
gatgcttctcacttattctgatgaa

SEQ ID NO: 565059 - DNA, 25 bp, Homo sapien
aatgcttatgtcttgaattggcaca

SEQ ID NO: 565060 - DNA, 25 bp, Homo sapien
ttggctgtctcagtccagatgatgt

SEQ ID NO: 565061 - DNA, 25 bp, Homo sapien
ccagatgatgtttggttagtttcca

SEQ ID NO: 565062 - DNA, 25 bp, Homo sapien
ttagtttccattcccagaaccacaa

SEQ ID NO: 565063 - DNA, 25 bp, Homo sapien
ccagaaccacaagcctttgagttct

SEQ ID NO: 565064 - DNA, 25 bp, Homo sapien
gggagatgtgagattcccagcccac

SEQ ID NO: 565065 - DNA, 25 bp, Homo sapien
cctcgagttagtggtaaattttgct

SEQ ID NO: 565066 - DNA, 25 bp, Homo sapien
atggaaaatatctcttgtcaagacc

SEQ ID NO: 565067 - DNA, 25 bp, Homo sapien
ctcttgtcaagaccaagctccggcg

SEQ ID NO: 565068 - DNA, 25 bp, Homo sapien
tccctcttttggatggccatggcat

SEQ ID NO: 565069 - DNA, 25 bp, Homo sapien
atggccatggcatctcatgaaccac

SEQ ID NO: 565070 - DNA, 25 bp, Homo sapien
tcatgaaccacttggaaatgtgttt

SEQ ID NO: 565071 - DNA, 25 bp, Homo sapien
agtatcttctctcttacctatttga

SEQ ID NO: 565072 - DNA, 25 bp, Homo sapien
gtatcttctctcttacctatttgag

SEQ ID NO: 565073 - DNA, 25 bp, Homo sapien
atcttctctcttacctatttgagcc

SEQ ID NO: 565074 - DNA, 25 bp, Homo sapien
ttctctcttacctatttgagcccct

SEQ ID NO: 565075 - DNA, 25 bp, Homo sapien
ctcttacctatttgagcccctctag

SEQ ID NO: 565076 - DNA, 25 bp, Homo sapien
tatttgagcccctctagctacagtc

SEQ ID NO: 565077 - DNA, 25 bp, Homo sapien
ttgagcccctctagctacagtctgg

SEQ ID NO: 565078 - DNA, 25 bp, Homo sapien
ccctctagctacagtctggcttaaa

SEQ ID NO: 565079 - DNA, 25 bp, Homo sapien
ctagctacagtctggcttaaatgaa

SEQ ID NO: 565080 - DNA, 25 bp, Homo sapien
gctacagtctggcttaaatgaaagg

SEQ ID NO: 565081 - DNA, 25 bp, Homo sapien
atatgcaccactgccatcacagtcc

SEQ ID NO: 565082 - DNA, 25 bp, Homo sapien
ggttcagcttctggcatgtttgaga

SEQ ID NO: 565083 - DNA, 25 bp, Homo sapien
ggtctaagcccataattacatcagt

SEQ ID NO: 565084 - DNA, 25 bp, Homo sapien
atcagtgccactgccggatttatgt

SEQ ID NO: 565085 - DNA, 25 bp, Homo sapien
ggatttatgtctgtgcaccttcttg

SEQ ID NO: 565086 - DNA, 25 bp, Homo sapien
cctggtgcctcttggcatttaaact

SEQ ID NO: 565087 - DNA, 25 bp, Homo sapien
tcttggcatttaaactattggcaca

SEQ ID NO: 565088 - DNA, 25 bp, Homo sapien
catcttcttgtcattttgcttactg

SEQ ID NO: 565089 - DNA, 25 bp, Homo sapien
attttgcttactgacctcagaatat

SEQ ID NO: 565090 - DNA, 25 bp, Homo sapien
ataggtgggccattctgtgtatcat

SEQ ID NO: 565091 - DNA, 25 bp, Homo sapien
tgggccattctgtgtatcattcttt

SEQ ID NO: 565092 - DNA, 25 bp, Homo sapien
ttcccataaggactgtggttcagct

SEQ ID NO: 565093 - DNA, 25 bp, Homo sapien
gcttcatccatgactggggacttca

SEQ ID NO: 565094 - DNA, 25 bp, Homo sapien
gggacttcatccacgactggagact

SEQ ID NO: 565095 - DNA, 25 bp, Homo sapien
atccacgactggagacttcatccat

SEQ ID NO: 565096 - DNA, 25 bp, Homo sapien
actggagacttcatccataggctgg

SEQ ID NO: 565097 - DNA, 25 bp, Homo sapien
gggcttcatctacagctggagactt

SEQ ID NO: 565098 - DNA, 25 bp, Homo sapien
acagctggagacttcatccacagca

SEQ ID NO: 565099 - DNA, 25 bp, Homo sapien
gctggagacttcatccacagcaggg

SEQ ID NO: 565100 - DNA, 25 bp, Homo sapien
gcttcatccttggttggtttgcctg

SEQ ID NO: 565101 - DNA, 25 bp, Homo sapien
atccttggttggtttgcctgatctg

SEQ ID NO: 565102 - DNA, 25 bp, Homo sapien
gcctgatctgtatctgagccacaga

SEQ ID NO: 565103 - DNA, 25 bp, Homo sapien
ccacagatacagattattaaacaga

SEQ ID NO: 565104 - DNA, 25 bp, Homo sapien
accacgaaactcagcccagtagaca

SEQ ID NO: 565105 - DNA, 25 bp, Homo sapien
gaaactcagcccagtagacaccatc

SEQ ID NO: 565106 - DNA, 25 bp, Homo sapien
agcccagtagacaccatcctggtag

SEQ ID NO: 565107 - DNA, 25 bp, Homo sapien
gtagacaccatcctggtagcggctt

SEQ ID NO: 565108 - DNA, 25 bp, Homo sapien
accatcctggtagcggcttcggtag

SEQ ID NO: 565109 - DNA, 25 bp, Homo sapien
tccccgctggtacagggcacagtta

SEQ ID NO: 565110 - DNA, 25 bp, Homo sapien
ctggtacagggcacagttacctgag

SEQ ID NO: 565111 - DNA, 25 bp, Homo sapien
tgtcctctcaccagaataaaagcct

SEQ ID NO: 565112 - DNA, 25 bp, Homo sapien
caccagaataaaagcctctacctgc

SEQ ID NO: 565113 - DNA, 25 bp, Homo sapien
acagtgcaaggcttttgccaggcat

SEQ ID NO: 565114 - DNA, 25 bp, Homo sapien
aaggcttttgccaggcatcccctgg

SEQ ID NO: 565115 - DNA, 25 bp, Homo sapien
aagtatcccaaatcggtgtaccttg

SEQ ID NO: 565116 - DNA, 25 bp, Homo sapien
aatcggtgtaccttgggcgaattgt

SEQ ID NO: 565117 - DNA, 25 bp, Homo sapien
gacaaatggcaactgacttctttag

SEQ ID NO: 565118 - DNA, 25 bp, Homo sapien
cttctttagaattttgcagttaaca

SEQ ID NO: 565119 - DNA, 25 bp, Homo sapien
catgtttcttgtaaaggcgtctgac

SEQ ID NO: 565120 - DNA, 25 bp, Homo sapien
aaaggcgtctgacagtcctgagaat

SEQ ID NO: 565121 - DNA, 25 bp, Homo sapien
gacagtcctgagaattattgatggt

SEQ ID NO: 565122 - DNA, 25 bp, Homo sapien
aaaaatgtacagatgactcagtgaa

SEQ ID NO: 565123 - DNA, 25 bp, Homo sapien
gaaactgaggcttctcttatgaaac

SEQ ID NO: 565124 - DNA, 25 bp, Homo sapien
taactactaaatgtttatgcctctg

SEQ ID NO: 565125 - DNA, 25 bp, Homo sapien
tatgcctctgtaaaccaaatttctt

SEQ ID NO: 565126 - DNA, 25 bp, Homo sapien
gggtctacctttgtattcgttgctc

SEQ ID NO: 565127 - DNA, 25 bp, Homo sapien
tttgtattcgttgctccctcagagg

SEQ ID NO: 565128 - DNA, 25 bp, Homo sapien
attcgttgctccctcagaggtggag

SEQ ID NO: 565129 - DNA, 25 bp, Homo sapien
aagtgaagtgtagtggttccactct

SEQ ID NO: 565130 - DNA, 25 bp, Homo sapien
gagggtcggcggaaccaccgcagac

SEQ ID NO: 565131 - DNA, 25 bp, Homo sapien
agacggaaagtagtgcccggccctg

SEQ ID NO: 565132 - DNA, 25 bp, Homo sapien
actgggtccgtccagatccagaggc

SEQ ID NO: 565133 - DNA, 25 bp, Homo sapien
cggcagcgggagacgaaaaaatgaa

SEQ ID NO: 565134 - DNA, 25 bp, Homo sapien
ccgcgggaaagtaggcgacagctat

SEQ ID NO: 565135 - DNA, 25 bp, Homo sapien
gtaggcgacagctattcaaagcttt

SEQ ID NO: 565136 - DNA, 25 bp, Homo sapien
gcgacagctattcaaagcttttggg

SEQ ID NO: 565137 - DNA, 25 bp, Homo sapien
ttatgtcttcttcaattgattcacc

SEQ ID NO: 565138 - DNA, 25 bp, Homo sapien
ttcttcaattgattcaccttccatt

SEQ ID NO: 565139 - DNA, 25 bp, Homo sapien
attcaccttccattcttggacaata

SEQ ID NO: 565140 - DNA, 25 bp, Homo sapien
caccttccattcttggacaatattt

SEQ ID NO: 565141 - DNA, 25 bp, Homo sapien
gacaatattttggagcctccagtta

SEQ ID NO: 565142 - DNA, 25 bp, Homo sapien
agaggaagatcttgttatcactaac

SEQ ID NO: 565143 - DNA, 25 bp, Homo sapien
gttatcactaacacttgcctagaca

SEQ ID NO: 565144 - DNA, 25 bp, Homo sapien
atcactaacacttgcctagacagag

SEQ ID NO: 565145 - DNA, 25 bp, Homo sapien
aacacttgcctagacagagaactta

SEQ ID NO: 565146 - DNA, 25 bp, Homo sapien
gcctagacagagaacttattccaag

SEQ ID NO: 565147 - DNA, 25 bp, Homo sapien
ttattccaagcttatgtctacctga

SEQ ID NO: 565148 - DNA, 25 bp, Homo sapien
gaagcattatcatggaaattatatt

SEQ ID NO: 565149 - DNA, 25 bp, Homo sapien
tctgaggtcagtaagcaaaatgaca

SEQ ID NO: 565150 - DNA, 25 bp, Homo sapien
ctgtgccaatagtttaaatgccaag

SEQ ID NO: 565151 - DNA, 25 bp, Homo sapien
atgccaagaggcaccaggccaagaa

SEQ ID NO: 565152 - DNA, 25 bp, Homo sapien
gaaggtgcacagacataaatccggc

SEQ ID NO: 565153 - DNA, 25 bp, Homo sapien
acataaatccggcagtggcactgat

SEQ ID NO: 565154 - DNA, 25 bp, Homo sapien
gtggcactgatgtaattatgggctt

SEQ ID NO: 565155 - DNA, 25 bp, Homo sapien
actgatgtaattatgggcttagacc

SEQ ID NO: 565156 - DNA, 25 bp, Homo sapien
agctgaaccacagtccttatgggaa

SEQ ID NO: 565157 - DNA, 25 bp, Homo sapien
atgatacacagaatggcccacctat

SEQ ID NO: 565158 - DNA, 25 bp, Homo sapien
aatggcccacctattcctatccagg

SEQ ID NO: 565159 - DNA, 25 bp, Homo sapien
atgctctgtgaccattgttcgtggg

SEQ ID NO: 565160 - DNA, 25 bp, Homo sapien
ttcaggacactcgtcaacagctgta

SEQ ID NO: 565161 - DNA, 25 bp, Homo sapien
aacagctgtaagaggcttcccatcc

SEQ ID NO: 565162 - DNA, 25 bp, Homo sapien
agttcataggtcaccgcaaccggcc

SEQ ID NO: 565163 - DNA, 25 bp, Homo sapien
aaccggccgaacaatacgcgattat

SEQ ID NO: 565164 - DNA, 25 bp, Homo sapien
tacgcgattattcaacgggctccaa

SEQ ID NO: 565165 - DNA, 25 bp, Homo sapien
attcaacgggctccaattcattttc

SEQ ID NO: 565166 - DNA, 25 bp, Homo sapien
gggctccaattcattttcctctgct

SEQ ID NO: 565167 - DNA, 25 bp, Homo sapien
gaaaaatagcccctgccagccaact

SEQ ID NO: 565168 - DNA, 25 bp, Homo sapien
cagccaacttcttctcctaaatgta

SEQ ID NO: 565169 - DNA, 25 bp, Homo sapien
aagtggagccgatgctctgtgacca

SEQ ID NO: 565170 - DNA, 25 bp, Homo sapien
tgcaggcaaaaatcaagttaccagg

SEQ ID NO: 565171 - DNA, 25 bp, Homo sapien
tttgaatcatttgccttttctcaac

SEQ ID NO: 565172 - DNA, 25 bp, Homo sapien
gccttttctcaacactggattttaa

SEQ ID NO: 565173 - DNA, 25 bp, Homo sapien
tctcaacactggattttaagcaagg

SEQ ID NO: 565174 - DNA, 25 bp, Homo sapien
ctggattttaagcaaggaacaagac

SEQ ID NO: 565175 - DNA, 25 bp, Homo sapien
ggaacaagactattccagttctaaa

SEQ ID NO: 565176 - DNA, 25 bp, Homo sapien
attccagttctaaatgctttaatga

SEQ ID NO: 565177 - DNA, 25 bp, Homo sapien
gggtattgggttttagcatcaacat

SEQ ID NO: 565178 - DNA, 25 bp, Homo sapien
tagcatcaacatgatctatcctcac

SEQ ID NO: 565179 - DNA, 25 bp, Homo sapien
tctatcctcactctgaagctttaac

SEQ ID NO: 565180 - DNA, 25 bp, Homo sapien
tcctcactctgaagctttaacttga

SEQ ID NO: 565181 - DNA, 25 bp, Homo sapien
cttagtcatgactgtgagccaaaca

SEQ ID NO: 565182 - DNA, 25 bp, Homo sapien
gccaaacagaagtacaatgcctccc

SEQ ID NO: 565183 - DNA, 25 bp, Homo sapien
gccaccttcgacatttcaagccaaa

SEQ ID NO: 565184 - DNA, 25 bp, Homo sapien
aaatgacaagtcctttggttagtga

SEQ ID NO: 565185 - DNA, 25 bp, Homo sapien
aagtcctttggttagtgatgatgat

SEQ ID NO: 565186 - DNA, 25 bp, Homo sapien
gatgatgatgtattcccactgtctc

SEQ ID NO: 565187 - DNA, 25 bp, Homo sapien
agatatgtccttcccagcatctttg

SEQ ID NO: 565188 - DNA, 25 bp, Homo sapien
cagcatctttggctgcacagcattt

SEQ ID NO: 565189 - DNA, 25 bp, Homo sapien
gctgcacagcatttccttctggaag

SEQ ID NO: 565190 - DNA, 25 bp, Homo sapien
atattgatgaactgcaaagacacac

SEQ ID NO: 565191 - DNA, 25 bp, Homo sapien
tgcaaagacacacagaatttactct

SEQ ID NO: 565192 - DNA, 25 bp, Homo sapien
gaatggccataatctaaaaatcgaa

SEQ ID NO: 565193 - DNA, 25 bp, Homo sapien
atggccataatctaaaaatcgaaaa

SEQ ID NO: 565194 - DNA, 25 bp, Homo sapien
cgaaaaatagtagatgttggcatgg

SEQ ID NO: 565195 - DNA, 25 bp, Homo sapien
gtggtgatcagggaacacttcaaca

SEQ ID NO: 565196 - DNA, 25 bp, Homo sapien
ggtgatcagggaacacttcaacatg

SEQ ID NO: 565197 - DNA, 25 bp, Homo sapien
gatcagggaacacttcaacatggct

SEQ ID NO: 565198 - DNA, 25 bp, Homo sapien
atcagggaacacttcaacatggctg

SEQ ID NO: 565199 - DNA, 25 bp, Homo sapien
cagggaacacttcaacatggctggt

SEQ ID NO: 565200 - DNA, 25 bp, Homo sapien
agggaacacttcaacatggctggtg

SEQ ID NO: 565201 - DNA, 25 bp, Homo sapien
gggaacacttcaacatggctggtgg

SEQ ID NO: 565202 - DNA, 25 bp, Homo sapien
gaacacttcaacatggctggtggga

SEQ ID NO: 565203 - DNA, 25 bp, Homo sapien
aaggatctctgtacagtatgtagtg

SEQ ID NO: 565204 - DNA, 25 bp, Homo sapien
ggatctctgtacagtatgtagtgac

SEQ ID NO: 565205 - DNA, 25 bp, Homo sapien
tctctgtacagtatgtagtgactta

SEQ ID NO: 565206 - DNA, 25 bp, Homo sapien
gtacagtatgtagtgacttaattac

SEQ ID NO: 565207 - DNA, 25 bp, Homo sapien
gtatgtagtgacttaattactattc

SEQ ID NO: 565208 - DNA, 25 bp, Homo sapien
attactattcatatatctctccttt

SEQ ID NO: 565209 - DNA, 25 bp, Homo sapien
actattcatatatctctcctttaga

SEQ ID NO: 565210 - DNA, 25 bp, Homo sapien
tcatatatctctcctttagatttta

SEQ ID NO: 565211 - DNA, 25 bp, Homo sapien
tcctttatcttggtacatacctatt

SEQ ID NO: 565212 - DNA, 25 bp, Homo sapien
ttatcttggtacatacctatttgaa

SEQ ID NO: 565213 - DNA, 25 bp, Homo sapien
atacctatttgaaaatgctactaaa

SEQ ID NO: 565214 - DNA, 25 bp, Homo sapien
ttccgttaggtgagatgctgcctgc

SEQ ID NO: 565215 - DNA, 25 bp, Homo sapien
agatgctgcctgctaattcacattt

SEQ ID NO: 565216 - DNA, 25 bp, Homo sapien
taattcacatttgcctgggattgct

SEQ ID NO: 565217 - DNA, 25 bp, Homo sapien
gataacatcaactctatcatttaat

SEQ ID NO: 565218 - DNA, 25 bp, Homo sapien
attaagcctattgttattgggcatt

SEQ ID NO: 565219 - DNA, 25 bp, Homo sapien
gcatattaggtttaagggttcctca

SEQ ID NO: 565220 - DNA, 25 bp, Homo sapien
agggttcctcaatatcttaatctat

SEQ ID NO: 565221 - DNA, 25 bp, Homo sapien
ttaatctatattgccttcggaaaga

SEQ ID NO: 565222 - DNA, 25 bp, Homo sapien
gccttcggaaagaagcaatccttag

SEQ ID NO: 565223 - DNA, 25 bp, Homo sapien
ctccatttcattagtgcatgagact

SEQ ID NO: 565224 - DNA, 25 bp, Homo sapien
agtgcatgagactgagacaggtatt

SEQ ID NO: 565225 - DNA, 25 bp, Homo sapien
aaatgtaggcccagatgctttcctc

SEQ ID NO: 565226 - DNA, 25 bp, Homo sapien
ttcctccaccttttttgacaggctg

SEQ ID NO: 565227 - DNA, 25 bp, Homo sapien
tgacaggctgccacatacagtttca

SEQ ID NO: 565228 - DNA, 25 bp, Homo sapien
gccacatacagtttcacaggttgct

SEQ ID NO: 565229 - DNA, 25 bp, Homo sapien
ttcacaggttgctaactgcacaggg

SEQ ID NO: 565230 - DNA, 25 bp, Homo sapien
agcctgtcctccatttgccaagtca

SEQ ID NO: 565231 - DNA, 25 bp, Homo sapien
caagtcacactttctggcacagaga

SEQ ID NO: 565232 - DNA, 25 bp, Homo sapien
gggtgtcttgttctaatttgtcttt

SEQ ID NO: 565233 - DNA, 25 bp, Homo sapien
taatttgtctttgtggcctgctctc

SEQ ID NO: 565234 - DNA, 25 bp, Homo sapien
ggcctgctctcttctgttcttgaag

SEQ ID NO: 565235 - DNA, 25 bp, Homo sapien
gaaaagcagtcagtctcatagaaaa

SEQ ID NO: 565236 - DNA, 25 bp, Homo sapien
aaatctcatgatttaactgctatat

SEQ ID NO: 565237 - DNA, 25 bp, Homo sapien
aatctcatgatttaactgctatata

SEQ ID NO: 565238 - DNA, 25 bp, Homo sapien
atctcatgatttaactgctatataa

SEQ ID NO: 565239 - DNA, 25 bp, Homo sapien
tctcatgatttaactgctatataac

SEQ ID NO: 565240 - DNA, 25 bp, Homo sapien
ctcatgatttaactgctatataacc

SEQ ID NO: 565241 - DNA, 25 bp, Homo sapien
atttaactgctatataaccttggcc

SEQ ID NO: 565242 - DNA, 25 bp, Homo sapien
tttaactgctatataaccttggcca

SEQ ID NO: 565243 - DNA, 25 bp, Homo sapien
ttaactgctatataaccttggccaa

SEQ ID NO: 565244 - DNA, 25 bp, Homo sapien
aggactgccctctcagggacccaag

SEQ ID NO: 565245 - DNA, 25 bp, Homo sapien
tctcagggacccaagaggaagggac

SEQ ID NO: 565246 - DNA, 25 bp, Homo sapien
aaggaagaaggtcccgggccatctg

SEQ ID NO: 565247 - DNA, 25 bp, Homo sapien
aaggtcccgggccatctgcgtcatg

SEQ ID NO: 565248 - DNA, 25 bp, Homo sapien
agtcccttggcgtgtgccggtgcaa

SEQ ID NO: 565249 - DNA, 25 bp, Homo sapien
tggcgtgtgccggtgcaaatacact

SEQ ID NO: 565250 - DNA, 25 bp, Homo sapien
gtgtgccggtgcaaatacactcctg

SEQ ID NO: 565251 - DNA, 25 bp, Homo sapien
gtgccggtgcaaatacactcctgta

SEQ ID NO: 565252 - DNA, 25 bp, Homo sapien
gccggtgcaaatacactcctgtaac

SEQ ID NO: 565253 - DNA, 25 bp, Homo sapien
ggtgcaaatacactcctgtaacggg

SEQ ID NO: 565254 - DNA, 25 bp, Homo sapien
atctagaatctcctctcggaatgag

SEQ ID NO: 565255 - DNA, 25 bp, Homo sapien
cacaagatagggatgccggcatact

SEQ ID NO: 565256 - DNA, 25 bp, Homo sapien
ggatgccggcatactgttataattg

SEQ ID NO: 565257 - DNA, 25 bp, Homo sapien
ctacctgtgactaatttatgaattc

SEQ ID NO: 565258 - DNA, 25 bp, Homo sapien
acatggtatgtataaggttcagtac

SEQ ID NO: 565259 - DNA, 25 bp, Homo sapien
ggtatgtataaggttcagtactatc

SEQ ID NO: 565260 - DNA, 25 bp, Homo sapien
tatctgcagtttcagacatcccctg

SEQ ID NO: 565261 - DNA, 25 bp, Homo sapien
ttgtgttttatagagtagttgtgag

SEQ ID NO: 565262 - DNA, 25 bp, Homo sapien
taatccataatgtgtggctcatgat

SEQ ID NO: 565263 - DNA, 25 bp, Homo sapien
ataatgtgtggctcatgatactcat

SEQ ID NO: 565264 - DNA, 25 bp, Homo sapien
gtgtggctcatgatactcattgata

SEQ ID NO: 565265 - DNA, 25 bp, Homo sapien
ggctcatgatactcattgatagatg

SEQ ID NO: 565266 - DNA, 25 bp, Homo sapien
tctgctattgattctttagggtccg

SEQ ID NO: 565267 - DNA, 25 bp, Homo sapien
ttagggtccgttttccacacagtag

SEQ ID NO: 565268 - DNA, 25 bp, Homo sapien
aatgtgattctcttctttgtggctt

SEQ ID NO: 565269 - DNA, 25 bp, Homo sapien
atctgtaaggccctaatgacctgtc

SEQ ID NO: 565270 - DNA, 25 bp, Homo sapien
taatgacctgtccttcactacgtgt

SEQ ID NO: 565271 - DNA, 25 bp, Homo sapien
gtgtctgaccctatagcctactgtt

SEQ ID NO: 565272 - DNA, 25 bp, Homo sapien
tactgttctccccttgtgcggtgta

SEQ ID NO: 565273 - DNA, 25 bp, Homo sapien
tgtgcggtgtactgcagccacgttg

SEQ ID NO: 565274 - DNA, 25 bp, Homo sapien
gaatacaagggagcttctacttcaa

SEQ ID NO: 565275 - DNA, 25 bp, Homo sapien
acattggctgttgccttagcttaga

SEQ ID NO: 565276 - DNA, 25 bp, Homo sapien
tgccttagcttagaacgctctttct

SEQ ID NO: 565277 - DNA, 25 bp, Homo sapien
ttctaagggcacattatggccattt

SEQ ID NO: 565278 - DNA, 25 bp, Homo sapien
cattatggccattttccttatctcc

SEQ ID NO: 565279 - DNA, 25 bp, Homo sapien
attatggccattttccttatctccc

SEQ ID NO: 565280 - DNA, 25 bp, Homo sapien
ttatggccattttccttatctccct

SEQ ID NO: 565281 - DNA, 25 bp, Homo sapien
ttatgtatcttctaaattgtatata

SEQ ID NO: 565282 - DNA, 25 bp, Homo sapien
gtgatttttcaatacagtgtggaat

SEQ ID NO: 565283 - DNA, 25 bp, Homo sapien
tgatttttcaatacagtgtggaatg

SEQ ID NO: 565284 - DNA, 25 bp, Homo sapien
gatttttcaatacagtgtggaatga

SEQ ID NO: 565285 - DNA, 25 bp, Homo sapien
atttttcaatacagtgtggaatgag

SEQ ID NO: 565286 - DNA, 25 bp, Homo sapien
tttttcaatacagtgtggaatgaga

SEQ ID NO: 565287 - DNA, 25 bp, Homo sapien
tttcaatacagtgtggaatgagaat

SEQ ID NO: 565288 - DNA, 25 bp, Homo sapien
aatgaacatgattttctcaacagat

SEQ ID NO: 565289 - DNA, 25 bp, Homo sapien
aattggacaacattcatctttttat

SEQ ID NO: 565290 - DNA, 25 bp, Homo sapien
atgttccttgacacaattacagcca

SEQ ID NO: 565291 - DNA, 25 bp, Homo sapien
attacagccaggtatcacaagccca

SEQ ID NO: 565292 - DNA, 25 bp, Homo sapien
agccaggtatcacaagcccatcata

SEQ ID NO: 565293 - DNA, 25 bp, Homo sapien
tcacaagcccatcatactcaacaat

SEQ ID NO: 565294 - DNA, 25 bp, Homo sapien
gaaagcttttccttcaggatcggga

SEQ ID NO: 565295 - DNA, 25 bp, Homo sapien
ggatcgggaacaagaccaggattct

SEQ ID NO: 565296 - DNA, 25 bp, Homo sapien
aagaccaggattcttactcacacca

SEQ ID NO: 565297 - DNA, 25 bp, Homo sapien
ttcttactcacaccatttctattca

SEQ ID NO: 565298 - DNA, 25 bp, Homo sapien
tgtagtattagaaatccttgccaga

SEQ ID NO: 565299 - DNA, 25 bp, Homo sapien
tgtattttttctctcaactaaaaca

SEQ ID NO: 565300 - DNA, 25 bp, Homo sapien
gtattttttctctcaactaaaacat

SEQ ID NO: 565301 - DNA, 25 bp, Homo sapien
tattttttctctcaactaaaacatc

SEQ ID NO: 565302 - DNA, 25 bp, Homo sapien
ttttttctctcaactaaaacatcca

SEQ ID NO: 565303 - DNA, 25 bp, Homo sapien
actaaaacatccattttaatcaata

SEQ ID NO: 565304 - DNA, 25 bp, Homo sapien
ctaaaacatccattttaatcaatat

SEQ ID NO: 565305 - DNA, 25 bp, Homo sapien
taaaacatccattttaatcaatatt

SEQ ID NO: 565306 - DNA, 25 bp, Homo sapien
tttggcaagaaaatatatacctgtt

SEQ ID NO: 565307 - DNA, 25 bp, Homo sapien
aatatatacctgtttcatcttcact

SEQ ID NO: 565308 - DNA, 25 bp, Homo sapien
ccataaactggaaagaaggactgtc

SEQ ID NO: 565309 - DNA, 25 bp, Homo sapien
ccatgagatgtttaagcaaaaggga

SEQ ID NO: 565310 - DNA, 25 bp, Homo sapien
ctgtgcctggtcttggccggggagc

SEQ ID NO: 565311 - DNA, 25 bp, Homo sapien
gtgcctggtcttggccggggagcca

SEQ ID NO: 565312 - DNA, 25 bp, Homo sapien
ggtcttggccggggagccacaggca

SEQ ID NO: 565313 - DNA, 25 bp, Homo sapien
gccacaggcagggtctgctggtttc

SEQ ID NO: 565314 - DNA, 25 bp, Homo sapien
ccacaggcagggtctgctggtttcg

SEQ ID NO: 565315 - DNA, 25 bp, Homo sapien
cacaggcagggtctgctggtttcgg

SEQ ID NO: 565316 - DNA, 25 bp, Homo sapien
acaggcagggtctgctggtttcggt

SEQ ID NO: 565317 - DNA, 25 bp, Homo sapien
ctggtttcggtgtcaggggcacatc

SEQ ID NO: 565318 - DNA, 25 bp, Homo sapien
tggtttcggtgtcaggggcacatcc

SEQ ID NO: 565319 - DNA, 25 bp, Homo sapien
ttggctgtgcctggtcttggccggg

SEQ ID NO: 565320 - DNA, 25 bp, Homo sapien
ggctgtgcctggtcttggccgggga

SEQ ID NO: 565321 - DNA, 25 bp, Homo sapien
cagtttgctgactgaatacgcgaag

SEQ ID NO: 565322 - DNA, 25 bp, Homo sapien
agtttgctgactgaatacgcgaaga

SEQ ID NO: 565323 - DNA, 25 bp, Homo sapien
gtttgctgactgaatacgcgaagaa

SEQ ID NO: 565324 - DNA, 25 bp, Homo sapien
ttgctgactgaatacgcgaagaagg

SEQ ID NO: 565325 - DNA, 25 bp, Homo sapien
tgctgactgaatacgcgaagaagga

SEQ ID NO: 565326 - DNA, 25 bp, Homo sapien
gctgactgaatacgcgaagaaggac

SEQ ID NO: 565327 - DNA, 25 bp, Homo sapien
gactgaatacgcgaagaaggacctg

SEQ ID NO: 565328 - DNA, 25 bp, Homo sapien
actgaatacgcgaagaaggacctga

SEQ ID NO: 565329 - DNA, 25 bp, Homo sapien
tttcttcatgtcctggttgacccag

SEQ ID NO: 565330 - DNA, 25 bp, Homo sapien
tggttgacccagaggccccgagtct

SEQ ID NO: 565331 - DNA, 25 bp, Homo sapien
agtctgtggtctgggttcccctgtt

SEQ ID NO: 565332 - DNA, 25 bp, Homo sapien
ggttcccctgtttccttaggctgag

SEQ ID NO: 565333 - DNA, 25 bp, Homo sapien
taggctgagccagttgtagccacag

SEQ ID NO: 565334 - DNA, 25 bp, Homo sapien
gtagccacagaactcaattctcctc

SEQ ID NO: 565335 - DNA, 25 bp, Homo sapien
ccacacccgaagctgctcggaaatg

SEQ ID NO: 565336 - DNA, 25 bp, Homo sapien
ttccagcattacctgcaccaatggt

SEQ ID NO: 565337 - DNA, 25 bp, Homo sapien
gcaccaatggtaataggcagctatg

SEQ ID NO: 565338 - DNA, 25 bp, Homo sapien
tgaggcaaatctaccccagtgggtt

SEQ ID NO: 565339 - DNA, 25 bp, Homo sapien
aatctaccccagtgggttgaagatg

SEQ ID NO: 565340 - DNA, 25 bp, Homo sapien
ttcaggaatctgtgcatagaatgcc

SEQ ID NO: 565341 - DNA, 25 bp, Homo sapien
gcatagaatgccatagtgcagagga

SEQ ID NO: 565342 - DNA, 25 bp, Homo sapien
agagagtatcatggaactgaacttt

SEQ ID NO: 565343 - DNA, 25 bp, Homo sapien
tgaactttcaagatcatggcatctg

SEQ ID NO: 565344 - DNA, 25 bp, Homo sapien
catggcatctggacatcgagaaaac

SEQ ID NO: 565345 - DNA, 25 bp, Homo sapien
atctggccacctgctgctttttgac

SEQ ID NO: 565346 - DNA, 25 bp, Homo sapien
tgctgctttttgaccaattcccata

SEQ ID NO: 565347 - DNA, 25 bp, Homo sapien
ttgaccaattcccatataaaccgct

SEQ ID NO: 565348 - DNA, 25 bp, Homo sapien
attcccatataaaccgctaacttca

SEQ ID NO: 565349 - DNA, 25 bp, Homo sapien
atataaaccgctaacttcagtcagt

SEQ ID NO: 565350 - DNA, 25 bp, Homo sapien
ttctgtctctcaggtgatgtcacca

SEQ ID NO: 565351 - DNA, 25 bp, Homo sapien
acttgagcatgtcgcccaccaagct

SEQ ID NO: 565352 - DNA, 25 bp, Homo sapien
accaagcttgtctgaggccacagag

SEQ ID NO: 565353 - DNA, 25 bp, Homo sapien
cagccctgttttccaggactggtgg

SEQ ID NO: 565354 - DNA, 25 bp, Homo sapien
tgcctcacggtgtggccttgtgcat

SEQ ID NO: 565355 - DNA, 25 bp, Homo sapien
ggtgtggccttgtgcatccccatgg

SEQ ID NO: 565356 - DNA, 25 bp, Homo sapien
tggacccaagggaacggcagtcaga

SEQ ID NO: 565357 - DNA, 25 bp, Homo sapien
ggcagtcagagactacagtccagac

SEQ ID NO: 565358 - DNA, 25 bp, Homo sapien
agtccagacgtttgtgtctaggcct

SEQ ID NO: 565359 - DNA, 25 bp, Homo sapien
gtgtctaggccttgctggtagctaa

SEQ ID NO: 565360 - DNA, 25 bp, Homo sapien
ttgctggtagctaaggaaatgcctt

SEQ ID NO: 565361 - DNA, 25 bp, Homo sapien
aggaaatgccttctgttgggaaaag

SEQ ID NO: 565362 - DNA, 25 bp, Homo sapien
gtgcatgctggcagaatcacctgct

SEQ ID NO: 565363 - DNA, 25 bp, Homo sapien
gaatcacctgctatgcatccaggga

SEQ ID NO: 565364 - DNA, 25 bp, Homo sapien
gcatgctcagcatgacaccagctta

SEQ ID NO: 565365 - DNA, 25 bp, Homo sapien
taatcagtctcatccaaatcttctc

SEQ ID NO: 565366 - DNA, 25 bp, Homo sapien
aaatcttctcctgcagtagcagctt

SEQ ID NO: 565367 - DNA, 25 bp, Homo sapien
agcttctaaagctgcaagggcctcc

SEQ ID NO: 565368 - DNA, 25 bp, Homo sapien
atctccatcggagccatgggtatcc

SEQ ID NO: 565369 - DNA, 25 bp, Homo sapien
tgcctgtttcctgagtcaaccacag

SEQ ID NO: 565370 - DNA, 25 bp, Homo sapien
ggcatggcatgaacaggacccttct

SEQ ID NO: 565371 - DNA, 25 bp, Homo sapien
gaacaggacccttctcattaaagca

SEQ ID NO: 565372 - DNA, 25 bp, Homo sapien
gacccttctcattaaagcagatgct

SEQ ID NO: 565373 - DNA, 25 bp, Homo sapien
ggtcacatcaccgagcagagtggga

SEQ ID NO: 565374 - DNA, 25 bp, Homo sapien
atcaccgagcagagtgggacccacg

SEQ ID NO: 565375 - DNA, 25 bp, Homo sapien
gagcagagtgggacccacggctatc

SEQ ID NO: 565376 - DNA, 25 bp, Homo sapien
tacctggtcaggaagaagcacatct

SEQ ID NO: 565377 - DNA, 25 bp, Homo sapien
gaagcacatctatatccccaagaac

SEQ ID NO: 565378 - DNA, 25 bp, Homo sapien
ctatatccccaagaacggtcagatt

SEQ ID NO: 565379 - DNA, 25 bp, Homo sapien
cggtcagattaacttcagctgtatc

SEQ ID NO: 565380 - DNA, 25 bp, Homo sapien
tcagctgtatcaatgccaacaacat

SEQ ID NO: 565381 - DNA, 25 bp, Homo sapien
aacataaattacatcactgagggca

SEQ ID NO: 565382 - DNA, 25 bp, Homo sapien
attacatcactgagggcatcaatga

SEQ ID NO: 565383 - DNA, 25 bp, Homo sapien
gagggcatcaatgaggctgtcctcc

SEQ ID NO: 565384 - DNA, 25 bp, Homo sapien
tggatctggatcgagcaagagctgc

SEQ ID NO: 565385 - DNA, 25 bp, Homo sapien
gaatgtggatactccgttcaagtga

SEQ ID NO: 565386 - DNA, 25 bp, Homo sapien
cgttcaagtgatatccatggagcca

SEQ ID NO: 565387 - DNA, 25 bp, Homo sapien
gagctgctctcccaaaaataacatg

SEQ ID NO: 565388 - DNA, 25 bp, Homo sapien
ataacatgattgtgggagtccccat

SEQ ID NO: 565389 - DNA, 25 bp, Homo sapien
ttgatattttgccatccgtcttcac

SEQ ID NO: 565390 - DNA, 25 bp, Homo sapien
gtcttcacgttggatgcccagtggc

SEQ ID NO: 565391 - DNA, 25 bp, Homo sapien
gcccagtggcattcaggaggttctt

SEQ ID NO: 565392 - DNA, 25 bp, Homo sapien
gaaacagcattagccatcttgaacc

SEQ ID NO: 565393 - DNA, 25 bp, Homo sapien
gccatcttgaacctattgtgctcag

SEQ ID NO: 565394 - DNA, 25 bp, Homo sapien
agtaaaggctccctgcaaagcatca

SEQ ID NO: 565395 - DNA, 25 bp, Homo sapien
agactgcagaggtagtgagttcttt

SEQ ID NO: 565396 - DNA, 25 bp, Homo sapien
gagttctttggttgagcttccagac

SEQ ID NO: 565397 - DNA, 25 bp, Homo sapien
gttgagcttccagacatgtgatgtt

SEQ ID NO: 565398 - DNA, 25 bp, Homo sapien
tgttgctaaagatcctgactccacc

SEQ ID NO: 565399 - DNA, 25 bp, Homo sapien
cttcctcaccgtttgaccttgggca

SEQ ID NO: 565400 - DNA, 25 bp, Homo sapien
catctctgagcctagtttccttatc

SEQ ID NO: 565401 - DNA, 25 bp, Homo sapien
gatacagtggaaacgtacttttcta

SEQ ID NO: 565402 - DNA, 25 bp, Homo sapien
gagatttgttctaaagtcacagcaa

SEQ ID NO: 565403 - DNA, 25 bp, Homo sapien
aagtcacagcaaacggcagaactaa

SEQ ID NO: 565404 - DNA, 25 bp, Homo sapien
taatccttgaaaatccccagtctcg

SEQ ID NO: 565405 - DNA, 25 bp, Homo sapien
gctgggtcatccgagattgcgccac

SEQ ID NO: 565406 - DNA, 25 bp, Homo sapien
ggactcttcaccgtactggcctgag

SEQ ID NO: 565407 - DNA, 25 bp, Homo sapien
accgtactggcctgagtgctcgctg

SEQ ID NO: 565408 - DNA, 25 bp, Homo sapien
gagtgctcgctgctgttgtagctac

SEQ ID NO: 565409 - DNA, 25 bp, Homo sapien
tcgctgctgttgtagctaccaccaa

SEQ ID NO: 565410 - DNA, 25 bp, Homo sapien
tgctgttgtagctaccaccaacttt

SEQ ID NO: 565411 - DNA, 25 bp, Homo sapien
tagctaccaccaactttctactgaa

SEQ ID NO: 565412 - DNA, 25 bp, Homo sapien
taccaccaactttctactgaagatg

SEQ ID NO: 565413 - DNA, 25 bp, Homo sapien
ctgaagatgataacccagggcataa

SEQ ID NO: 565414 - DNA, 25 bp, Homo sapien
ggcataagaaatgacttcagaccca

SEQ ID NO: 565415 - DNA, 25 bp, Homo sapien
gaaatgacttcagacccaaggttct

SEQ ID NO: 565416 - DNA, 25 bp, Homo sapien
tcagacccaaggttctgaaagggcc

SEQ ID NO: 565417 - DNA, 25 bp, Homo sapien
ttctgggtgtcatctgtcacatttg

SEQ ID NO: 565418 - DNA, 25 bp, Homo sapien
ctgggtgtcatctgtcacatttgta

SEQ ID NO: 565419 - DNA, 25 bp, Homo sapien
gggtgtcatctgtcacatttgtaaa

SEQ ID NO: 565420 - DNA, 25 bp, Homo sapien
gagtatattatcacacaatccttcg

SEQ ID NO: 565421 - DNA, 25 bp, Homo sapien
tattatcacacaatccttcgcaact

SEQ ID NO: 565422 - DNA, 25 bp, Homo sapien
ttccctagcaaactgcaaacttgag

SEQ ID NO: 565423 - DNA, 25 bp, Homo sapien
ccctagcaaactgcaaacttgagtt

SEQ ID NO: 565424 - DNA, 25 bp, Homo sapien
cagtttacatgagaaaaggcaagtt

SEQ ID NO: 565425 - DNA, 25 bp, Homo sapien
gaagtaccattaaactctgtcacct

SEQ ID NO: 565426 - DNA, 25 bp, Homo sapien
gtaccattaaactctgtcacctagt

SEQ ID NO: 565427 - DNA, 25 bp, Homo sapien
cattaaactctgtcacctagtgaaa

SEQ ID NO: 565428 - DNA, 25 bp, Homo sapien
caaggagttgtctgtctttaaggac

SEQ ID NO: 565429 - DNA, 25 bp, Homo sapien
gacagactgtatgaactggacatct

SEQ ID NO: 565430 - DNA, 25 bp, Homo sapien
gtatgaactggacatctcgttccct

SEQ ID NO: 565431 - DNA, 25 bp, Homo sapien
cccagctacccgtacagtgaggacg

SEQ ID NO: 565432 - DNA, 25 bp, Homo sapien
agctacccgtacagtgaggacgccc

SEQ ID NO: 565433 - DNA, 25 bp, Homo sapien
gcccgccagggtgagcagtacatga

SEQ ID NO: 565434 - DNA, 25 bp, Homo sapien
gagcagtacatgaacacccggtgcc

SEQ ID NO: 565435 - DNA, 25 bp, Homo sapien
atgaacacccggtgcccagcctggt

SEQ ID NO: 565436 - DNA, 25 bp, Homo sapien
agcctggtgtgaccgcatcctcatg

SEQ ID NO: 565437 - DNA, 25 bp, Homo sapien
tggtgtgaccgcatcctcatgtccc

SEQ ID NO: 565438 - DNA, 25 bp, Homo sapien
tcatgtccccgtctgccaaggagct

SEQ ID NO: 565439 - DNA, 25 bp, Homo sapien
atgcgttttcattccaaaagtgggt

SEQ ID NO: 565440 - DNA, 25 bp, Homo sapien
agtgggttctaaatgcctggctgca

SEQ ID NO: 565441 - DNA, 25 bp, Homo sapien
gtcgcgccaacacgtcatactcaat

SEQ ID NO: 565442 - DNA, 25 bp, Homo sapien
catactcaatgcctcagactttcat

SEQ ID NO: 565443 - DNA, 25 bp, Homo sapien
gactttcatatttctgtgttgctga

SEQ ID NO: 565444 - DNA, 25 bp, Homo sapien
gtgttgctgagatgcctttcaatgc

SEQ ID NO: 565445 - DNA, 25 bp, Homo sapien
tttcaatgcaatcgtctgggctcgt

SEQ ID NO: 565446 - DNA, 25 bp, Homo sapien
tgggctcgtggatatgtccctcagg

SEQ ID NO: 565447 - DNA, 25 bp, Homo sapien
tgtccctcaggtgcggtgacagaat

SEQ ID NO: 565448 - DNA, 25 bp, Homo sapien
ggtggcaccacgatatgtgttctct

SEQ ID NO: 565449 - DNA, 25 bp, Homo sapien
atgtgttctcttgtgttgtttttcc

SEQ ID NO: 565450 - DNA, 25 bp, Homo sapien
ttttaagcttctcacttcagtatct

SEQ ID NO: 565451 - DNA, 25 bp, Homo sapien
tttaagcttctcacttcagtatcta

SEQ ID NO: 565452 - DNA, 25 bp, Homo sapien
taagcttctcacttcagtatctacc

SEQ ID NO: 565453 - DNA, 25 bp, Homo sapien
aagcttctcacttcagtatctacca

SEQ ID NO: 565454 - DNA, 25 bp, Homo sapien
agcttctcacttcagtatctaccag

SEQ ID NO: 565455 - DNA, 25 bp, Homo sapien
gcttctcacttcagtatctaccaga

SEQ ID NO: 565456 - DNA, 25 bp, Homo sapien
ttctcacttcagtatctaccagaca

SEQ ID NO: 565457 - DNA, 25 bp, Homo sapien
ctcacttcagtatctaccagacagg

SEQ ID NO: 565458 - DNA, 25 bp, Homo sapien
ctaccagacaggcttgtgcaaggag

SEQ ID NO: 565459 - DNA, 25 bp, Homo sapien
ccagacaggcttgtgcaaggagtga

SEQ ID NO: 565460 - DNA, 25 bp, Homo sapien
agacaggcttgtgcaaggagtgaac

SEQ ID NO: 565461 - DNA, 25 bp, Homo sapien
tactggcagaagacacaggactctt

SEQ ID NO: 565462 - DNA, 25 bp, Homo sapien
caggactcttgggtcagagacaaaa

SEQ ID NO: 565463 - DNA, 25 bp, Homo sapien
gacaaaagacttcagcactcatggg

SEQ ID NO: 565464 - DNA, 25 bp, Homo sapien
aagacttcagcactcatgggattga

SEQ ID NO: 565465 - DNA, 25 bp, Homo sapien
cagcactcatgggattgaagttagc

SEQ ID NO: 565466 - DNA, 25 bp, Homo sapien
gaagttagcctgctactgttttgtg

SEQ ID NO: 565467 - DNA, 25 bp, Homo sapien
tgttttgtggatactggcagaagac

SEQ ID NO: 565468 - DNA, 25 bp, Homo sapien
aaggacttcagtattcatgggacaa

SEQ ID NO: 565469 - DNA, 25 bp, Homo sapien
tcatgggacaacagtggccagagca

SEQ ID NO: 565470 - DNA, 25 bp, Homo sapien
ggccagagcagatactattcatcct

SEQ ID NO: 565471 - DNA, 25 bp, Homo sapien
tactattcatcctgtaggtttgcat

SEQ ID NO: 565472 - DNA, 25 bp, Homo sapien
gggaagtcccttcgaggctccgccg

SEQ ID NO: 565473 - DNA, 25 bp, Homo sapien
gcccactgccggaaaacttggacgc

SEQ ID NO: 565474 - DNA, 25 bp, Homo sapien
ggaaaacttggacgcaccgctttgg

SEQ ID NO: 565475 - DNA, 25 bp, Homo sapien
aacttggacgcaccgctttggaact

SEQ ID NO: 565476 - DNA, 25 bp, Homo sapien
ttggacgcaccgctttggaactctc

SEQ ID NO: 565477 - DNA, 25 bp, Homo sapien
gcaccgctttggaactctcccggga

SEQ ID NO: 565478 - DNA, 25 bp, Homo sapien
cgcggcagttcagctggcctgagct

SEQ ID NO: 565479 - DNA, 25 bp, Homo sapien
tgggttgcaggtgccttgcccccga

SEQ ID NO: 565480 - DNA, 25 bp, Homo sapien
atttattggtgctcctgtgataccg

SEQ ID NO: 565481 - DNA, 25 bp, Homo sapien
attggtgctcctgtgataccgaatt

SEQ ID NO: 565482 - DNA, 25 bp, Homo sapien
gtgctcctgtgataccgaattaaat

SEQ ID NO: 565483 - DNA, 25 bp, Homo sapien
tcacgttcgaggactctgggaaccc

SEQ ID NO: 565484 - DNA, 25 bp, Homo sapien
gttcgaggactctgggaaccccaag

SEQ ID NO: 565485 - DNA, 25 bp, Homo sapien
ttcgaggactctgggaaccccaaga

SEQ ID NO: 565486 - DNA, 25 bp, Homo sapien
cgaggactctgggaaccccaagagc

SEQ ID NO: 565487 - DNA, 25 bp, Homo sapien
gaggactctgggaaccccaagagcc

SEQ ID NO: 565488 - DNA, 25 bp, Homo sapien
ggactctgggaaccccaagagccca

SEQ ID NO: 565489 - DNA, 25 bp, Homo sapien
tgggaaccccaagagcccagacaag

SEQ ID NO: 565490 - DNA, 25 bp, Homo sapien
cagacaaggcccaggctgagcagga

SEQ ID NO: 565491 - DNA, 25 bp, Homo sapien
gccgaagagtccgagagcagcagca

SEQ ID NO: 565492 - DNA, 25 bp, Homo sapien
cagcagcggctcggagacagaaggg

SEQ ID NO: 565493 - DNA, 25 bp, Homo sapien
ggccgtaactgcagcgctgccagct

SEQ ID NO: 565494 - DNA, 25 bp, Homo sapien
tagagattcacaagttaggccgggc

SEQ ID NO: 565495 - DNA, 25 bp, Homo sapien
agagattcacaagttaggccgggcg

SEQ ID NO: 565496 - DNA, 25 bp, Homo sapien
gagattcacaagttaggccgggcgc

SEQ ID NO: 565497 - DNA, 25 bp, Homo sapien
agattcacaagttaggccgggcgcg

SEQ ID NO: 565498 - DNA, 25 bp, Homo sapien
gattcacaagttaggccgggcgcgg

SEQ ID NO: 565499 - DNA, 25 bp, Homo sapien
atcctggctggcgcggtggaaccct

SEQ ID NO: 565500 - DNA, 25 bp, Homo sapien
ctggctggcgcggtggaaccctgtc

SEQ ID NO: 565501 - DNA, 25 bp, Homo sapien
tggctggcgcggtggaaccctgtct

SEQ ID NO: 565502 - DNA, 25 bp, Homo sapien
tacaaaaaactagccggcctggtgg

SEQ ID NO: 565503 - DNA, 25 bp, Homo sapien
aactagccggcctggtggcgggcgc

SEQ ID NO: 565504 - DNA, 25 bp, Homo sapien
ctagccggcctggtggcgggcgcct

SEQ ID NO: 565505 - DNA, 25 bp, Homo sapien
ttgctgtcctgtggtacagacatta

SEQ ID NO: 565506 - DNA, 25 bp, Homo sapien
tgctgtcctgtggtacagacattaa

SEQ ID NO: 565507 - DNA, 25 bp, Homo sapien
gctgtcctgtggtacagacattaaa

SEQ ID NO: 565508 - DNA, 25 bp, Homo sapien
ctgtcctgtggtacagacattaaag

SEQ ID NO: 565509 - DNA, 25 bp, Homo sapien
tggccacacaccacttttattggcc

SEQ ID NO: 565510 - DNA, 25 bp, Homo sapien
gccacacaccacttttattggccat

SEQ ID NO: 565511 - DNA, 25 bp, Homo sapien
ccacacaccacttttattggccata

SEQ ID NO: 565512 - DNA, 25 bp, Homo sapien
acacaccacttttattggccataag

SEQ ID NO: 565513 - DNA, 25 bp, Homo sapien
acaccacttttattggccataagga

SEQ ID NO: 565514 - DNA, 25 bp, Homo sapien
caccacttttattggccataaggaa

SEQ ID NO: 565515 - DNA, 25 bp, Homo sapien
tttattggccataaggaaaagaagt

SEQ ID NO: 565516 - DNA, 25 bp, Homo sapien
gatttaactgtctgatggctacggt

SEQ ID NO: 565517 - DNA, 25 bp, Homo sapien
ctgatggctacggtttcgggaaagt

SEQ ID NO: 565518 - DNA, 25 bp, Homo sapien
gggaaagtgccagaacctccacgtc

SEQ ID NO: 565519 - DNA, 25 bp, Homo sapien
gagccacagcaatgggccccaagaa

SEQ ID NO: 565520 - DNA, 25 bp, Homo sapien
atggtccacggaagacgctgcttac

SEQ ID NO: 565521 - DNA, 25 bp, Homo sapien
aagacgctgcttactggccccgggt

SEQ ID NO: 565522 - DNA, 25 bp, Homo sapien
cccgggttacctggagtcatgtgca

SEQ ID NO: 565523 - DNA, 25 bp, Homo sapien
gtcatgtgcattctccttacatcaa

SEQ ID NO: 565524 - DNA, 25 bp, Homo sapien
agttctcccttctgacaacaggcaa

SEQ ID NO: 565525 - DNA, 25 bp, Homo sapien
ggcaagtggaccctagtagaccttc

SEQ ID NO: 565526 - DNA, 25 bp, Homo sapien
gaccctagtagaccttccagaaaag

SEQ ID NO: 565527 - DNA, 25 bp, Homo sapien
tgcactatgagcagggcgaactcac

SEQ ID NO: 565528 - DNA, 25 bp, Homo sapien
tatgagcagggcgaactcaccttct

SEQ ID NO: 565529 - DNA, 25 bp, Homo sapien
atgagcagggcgaactcaccttctt

SEQ ID NO: 565530 - DNA, 25 bp, Homo sapien
tgagcagggcgaactcaccttcttc

SEQ ID NO: 565531 - DNA, 25 bp, Homo sapien
agcagggcgaactcaccttcttcga

SEQ ID NO: 565532 - DNA, 25 bp, Homo sapien
tcttcgatgccgaccgccccgatga

SEQ ID NO: 565533 - DNA, 25 bp, Homo sapien
ggccgctctacaccttccaggccga

SEQ ID NO: 565534 - DNA, 25 bp, Homo sapien
tccaggccgacttccagggcaagct

SEQ ID NO: 565535 - DNA, 25 bp, Homo sapien
aggccgacttccagggcaagctcta

SEQ ID NO: 565536 - DNA, 25 bp, Homo sapien
acttccagggcaagctctaccccat

SEQ ID NO: 565537 - DNA, 25 bp, Homo sapien
agctctaccccatcctggacacctg

SEQ ID NO: 565538 - DNA, 25 bp, Homo sapien
aggaccctgcaccttggccgctcca

SEQ ID NO: 565539 - DNA, 25 bp, Homo sapien
ggaccctgcaccttggccgctccag

SEQ ID NO: 565540 - DNA, 25 bp, Homo sapien
gaccctgcaccttggccgctccagg

SEQ ID NO: 565541 - DNA, 25 bp, Homo sapien
accctgcaccttggccgctccaggg

SEQ ID NO: 565542 - DNA, 25 bp, Homo sapien
ccctgcaccttggccgctccagggc

SEQ ID NO: 565543 - DNA, 25 bp, Homo sapien
cctgcaccttggccgctccagggcg

SEQ ID NO: 565544 - DNA, 25 bp, Homo sapien
ctgcaccttggccgctccagggcgc

SEQ ID NO: 565545 - DNA, 25 bp, Homo sapien
tgcaccttggccgctccagggcgcc

SEQ ID NO: 565546 - DNA, 25 bp, Homo sapien
gcaccttggccgctccagggcgccc

SEQ ID NO: 565547 - DNA, 25 bp, Homo sapien
caccttggccgctccagggcgcccc

SEQ ID NO: 565548 - DNA, 25 bp, Homo sapien
ctcagagattactcagccagacaga

SEQ ID NO: 565549 - DNA, 25 bp, Homo sapien
tcagagattactcagccagacagag

SEQ ID NO: 565550 - DNA, 25 bp, Homo sapien
cagagattactcagccagacagaga

SEQ ID NO: 565551 - DNA, 25 bp, Homo sapien
agagattactcagccagacagagat

SEQ ID NO: 565552 - DNA, 25 bp, Homo sapien
gagattactcagccagacagagata

SEQ ID NO: 565553 - DNA, 25 bp, Homo sapien
agattactcagccagacagagatat

SEQ ID NO: 565554 - DNA, 25 bp, Homo sapien
gattactcagccagacagagatatt

SEQ ID NO: 565555 - DNA, 25 bp, Homo sapien
agacagagatattccactggtgcga

SEQ ID NO: 565556 - DNA, 25 bp, Homo sapien
gacagagatattccactggtgcgaa

SEQ ID NO: 565557 - DNA, 25 bp, Homo sapien
tggagccaaagccagacactgacaa

SEQ ID NO: 565558 - DNA, 25 bp, Homo sapien
ggagccaaagccagacactgacaag

SEQ ID NO: 565559 - DNA, 25 bp, Homo sapien
gaaaatccccgaagaggcagaaaca

SEQ ID NO: 565560 - DNA, 25 bp, Homo sapien
gaagggccgccagccagtggatttc

SEQ ID NO: 565561 - DNA, 25 bp, Homo sapien
gccgccagccagtggatttcccggg

SEQ ID NO: 565562 - DNA, 25 bp, Homo sapien
tcagccctctggagtgtacgagttt

SEQ ID NO: 565563 - DNA, 25 bp, Homo sapien
gagttttggagaaacctcttcctct

SEQ ID NO: 565564 - DNA, 25 bp, Homo sapien
ctcttcctctgtatatgcttttgac

SEQ ID NO: 565565 - DNA, 25 bp, Homo sapien
tctgtatatgcttttgactttcctg

SEQ ID NO: 565566 - DNA, 25 bp, Homo sapien
ttgactttcctggactgatgtaaaa

SEQ ID NO: 565567 - DNA, 25 bp, Homo sapien
taaaaatactcttttctttgacctg

SEQ ID NO: 565568 - DNA, 25 bp, Homo sapien
ttatttttaagacacgacgtgattg

SEQ ID NO: 565569 - DNA, 25 bp, Homo sapien
acgacgtgattgtgtcagcttatat

SEQ ID NO: 565570 - DNA, 25 bp, Homo sapien
tcttttgggaggttttcccagtctg

SEQ ID NO: 565571 - DNA, 25 bp, Homo sapien
gttttcccagtctgaagggcagtgg

SEQ ID NO: 565572 - DNA, 25 bp, Homo sapien
ggcagtggaaacctctgctgattcc

SEQ ID NO: 565573 - DNA, 25 bp, Homo sapien
tgctgattccctatgcagtggatga

SEQ ID NO: 565574 - DNA, 25 bp, Homo sapien
gcagtggatgaatttttggctaaag

SEQ ID NO: 565575 - DNA, 25 bp, Homo sapien
ctgccttatttactggtatagcaag

SEQ ID NO: 565576 - DNA, 25 bp, Homo sapien
atagcaagttggtgtatgtggcata

SEQ ID NO: 565577 - DNA, 25 bp, Homo sapien
aactctagagttagcagacccaggc

SEQ ID NO: 565578 - DNA, 25 bp, Homo sapien
gttagcagacccaggctctggttct

SEQ ID NO: 565579 - DNA, 25 bp, Homo sapien
ttttgctgtttctggtcactgtagg

SEQ ID NO: 565580 - DNA, 25 bp, Homo sapien
tcactgtagggttagctcttggctg

SEQ ID NO: 565581 - DNA, 25 bp, Homo sapien
aaatcaaggcacactccaggaagac

SEQ ID NO: 565582 - DNA, 25 bp, Homo sapien
aatcaaggcacactccaggaagact

SEQ ID NO: 565583 - DNA, 25 bp, Homo sapien
atcaaggcacactccaggaagactg

SEQ ID NO: 565584 - DNA, 25 bp, Homo sapien
tcaaggcacactccaggaagactgc

SEQ ID NO: 565585 - DNA, 25 bp, Homo sapien
caaggcacactccaggaagactgcc

SEQ ID NO: 565586 - DNA, 25 bp, Homo sapien
aaggcacactccaggaagactgccg

SEQ ID NO: 565587 - DNA, 25 bp, Homo sapien
gcacactccaggaagactgccgcgt

SEQ ID NO: 565588 - DNA, 25 bp, Homo sapien
acactccaggaagactgccgcgtcg

SEQ ID NO: 565589 - DNA, 25 bp, Homo sapien
ctccaggaagactgccgcgtcgcgc

SEQ ID NO: 565590 - DNA, 25 bp, Homo sapien
tccaggaagactgccgcgtcgcgcc

SEQ ID NO: 565591 - DNA, 25 bp, Homo sapien
ggaagactgccgcgtcgcgccaaca

SEQ ID NO: 565592 - DNA, 25 bp, Homo sapien
tggaggcaaaacaacaaaaactgga

SEQ ID NO: 565593 - DNA, 25 bp, Homo sapien
gaggcaaaacaacaaaaactggagg

SEQ ID NO: 565594 - DNA, 25 bp, Homo sapien
aaagataactgaagattctgccatg

SEQ ID NO: 565595 - DNA, 25 bp, Homo sapien
aagataactgaagattctgccatgt

SEQ ID NO: 565596 - DNA, 25 bp, Homo sapien
agataactgaagattctgccatgta

SEQ ID NO: 565597 - DNA, 25 bp, Homo sapien
gataactgaagattctgccatgtaa

SEQ ID NO: 565598 - DNA, 25 bp, Homo sapien
gccatgtaaatgtcagcttgagtgg

SEQ ID NO: 565599 - DNA, 25 bp, Homo sapien
catgtaaatgtcagcttgagtggac

SEQ ID NO: 565600 - DNA, 25 bp, Homo sapien
tgtaaatgtcagcttgagtggactc

SEQ ID NO: 565601 - DNA, 25 bp, Homo sapien
gtaaatgtcagcttgagtggactcc

SEQ ID NO: 565602 - DNA, 25 bp, Homo sapien
taaatgtcagcttgagtggactcca

SEQ ID NO: 565603 - DNA, 25 bp, Homo sapien
aaatcaataaagtctcccctcctgc

SEQ ID NO: 565604 - DNA, 25 bp, Homo sapien
tgaatgctctaagtgcttgcacacc

SEQ ID NO: 565605 - DNA, 25 bp, Homo sapien
atgctctaagtgcttgcacacctca

SEQ ID NO: 565606 - DNA, 25 bp, Homo sapien
tcctctcctcggaaggcaattgtgg

SEQ ID NO: 565607 - DNA, 25 bp, Homo sapien
ctcctcggaaggcaattgtggcata

SEQ ID NO: 565608 - DNA, 25 bp, Homo sapien
gcaattgtggcatatctgtgtccag

SEQ ID NO: 565609 - DNA, 25 bp, Homo sapien
tggcatatctgtgtccagacgtgtt

SEQ ID NO: 565610 - DNA, 25 bp, Homo sapien
atctgtgtccagacgtgttctattg

SEQ ID NO: 565611 - DNA, 25 bp, Homo sapien
ccagacgtgttctattggtatctca

SEQ ID NO: 565612 - DNA, 25 bp, Homo sapien
gttctattggtatctcactccacat

SEQ ID NO: 565613 - DNA, 25 bp, Homo sapien
attggtatctcactccacatcccag

SEQ ID NO: 565614 - DNA, 25 bp, Homo sapien
aaagaatgaacaccggaagctctca

SEQ ID NO: 565615 - DNA, 25 bp, Homo sapien
gaacaccggaagctctcaaacaaag

SEQ ID NO: 565616 - DNA, 25 bp, Homo sapien
aacaaagccgcctgggtctcacacc

SEQ ID NO: 565617 - DNA, 25 bp, Homo sapien
ttcatctgcaaaactgatgctttgc

SEQ ID NO: 565618 - DNA, 25 bp, Homo sapien
gcaaaactgatgctttgctctttct

SEQ ID NO: 565619 - DNA, 25 bp, Homo sapien
tcttctacatggagccatttttggg

SEQ ID NO: 565620 - DNA, 25 bp, Homo sapien
aaacatacccttgggcatagccttg

SEQ ID NO: 565621 - DNA, 25 bp, Homo sapien
atacccttgggcatagccttgagtt

SEQ ID NO: 565622 - DNA, 25 bp, Homo sapien
cccttgggcatagccttgagttgaa

SEQ ID NO: 565623 - DNA, 25 bp, Homo sapien
tgagggtgttttctgtccaaatgac

SEQ ID NO: 565624 - DNA, 25 bp, Homo sapien
gtgttttctgtccaaatgactgaaa

SEQ ID NO: 565625 - DNA, 25 bp, Homo sapien
ctcaatcttagccaggtaagtgcta

SEQ ID NO: 565626 - DNA, 25 bp, Homo sapien
gtaagtgctatgggctactgccttc

SEQ ID NO: 565627 - DNA, 25 bp, Homo sapien
gggccctgcactgttgttactttct

SEQ ID NO: 565628 - DNA, 25 bp, Homo sapien
cctgcactgttgttactttctggag

SEQ ID NO: 565629 - DNA, 25 bp, Homo sapien
tgcactgttgttactttctggagaa

SEQ ID NO: 565630 - DNA, 25 bp, Homo sapien
cactgttgttactttctggagaacc

SEQ ID NO: 565631 - DNA, 25 bp, Homo sapien
gttgttactttctggagaaccctgc

SEQ ID NO: 565632 - DNA, 25 bp, Homo sapien
tgttactttctggagaaccctgctt

SEQ ID NO: 565633 - DNA, 25 bp, Homo sapien
ttactttctggagaaccctgcttct

SEQ ID NO: 565634 - DNA, 25 bp, Homo sapien
tggagaaccctgcttctggctggat

SEQ ID NO: 565635 - DNA, 25 bp, Homo sapien
agaaccctgcttctggctggatgct

SEQ ID NO: 565636 - DNA, 25 bp, Homo sapien
cgcctcctcgggaaatttgtgcaca

SEQ ID NO: 565637 - DNA, 25 bp, Homo sapien
gcctcctcgggaaatttgtgcacag

SEQ ID NO: 565638 - DNA, 25 bp, Homo sapien
cctcctcgggaaatttgtgcacaga

SEQ ID NO: 565639 - DNA, 25 bp, Homo sapien
gcacagagataacacaggggatatg

SEQ ID NO: 565640 - DNA, 25 bp, Homo sapien
cacagagataacacaggggatatgc

SEQ ID NO: 565641 - DNA, 25 bp, Homo sapien
cagagataacacaggggatatgcca

SEQ ID NO: 565642 - DNA, 25 bp, Homo sapien
agagataacacaggggatatgccat

SEQ ID NO: 565643 - DNA, 25 bp, Homo sapien
gagataacacaggggatatgccata

SEQ ID NO: 565644 - DNA, 25 bp, Homo sapien
taacacaggggatatgccatatgaa

SEQ ID NO: 565645 - DNA, 25 bp, Homo sapien
aacacaggggatatgccatatgaag

SEQ ID NO: 565646 - DNA, 25 bp, Homo sapien
acacaggggatatgccatatgaaga

SEQ ID NO: 565647 - DNA, 25 bp, Homo sapien
acagtcctaatttggctctttctaa

SEQ ID NO: 565648 - DNA, 25 bp, Homo sapien
gtcctaatttggctctttctaactt

SEQ ID NO: 565649 - DNA, 25 bp, Homo sapien
tctgcaaagggctcccatttttcgt

SEQ ID NO: 565650 - DNA, 25 bp, Homo sapien
gggctcccatttttcgtcatttaat

SEQ ID NO: 565651 - DNA, 25 bp, Homo sapien
tcccatttttcgtcatttaatcatg

SEQ ID NO: 565652 - DNA, 25 bp, Homo sapien
gggatggattaaatgactggtgtca

SEQ ID NO: 565653 - DNA, 25 bp, Homo sapien
gactggtgtcatcacttacaaccat

SEQ ID NO: 565654 - DNA, 25 bp, Homo sapien
gtgtcatcacttacaaccatggttg

SEQ ID NO: 565655 - DNA, 25 bp, Homo sapien
aagcttcaccagtctttttctaccg

SEQ ID NO: 565656 - DNA, 25 bp, Homo sapien
agtctttttctaccgcaacaatgct

SEQ ID NO: 565657 - DNA, 25 bp, Homo sapien
tttttctaccgcaacaatgctccca

SEQ ID NO: 565658 - DNA, 25 bp, Homo sapien
attcatatcctcaaacacggtgctc

SEQ ID NO: 565659 - DNA, 25 bp, Homo sapien
aactgtagggacagagctcccgtct

SEQ ID NO: 565660 - DNA, 25 bp, Homo sapien
agagctcccgtctaaggtgggcctg

SEQ ID NO: 565661 - DNA, 25 bp, Homo sapien
tgtggtgaggtctccccagtggtac

SEQ ID NO: 565662 - DNA, 25 bp, Homo sapien
ggtctccccagtggtacactttaat

SEQ ID NO: 565663 - DNA, 25 bp, Homo sapien
ggtacactttaatcccacagcaggg

SEQ ID NO: 565664 - DNA, 25 bp, Homo sapien
aacactgggcaggatctagcctcca

SEQ ID NO: 565665 - DNA, 25 bp, Homo sapien
gcaggatctagcctccaaacctttg

SEQ ID NO: 565666 - DNA, 25 bp, Homo sapien
tagtataaaatgatagctcggtgct

SEQ ID NO: 565667 - DNA, 25 bp, Homo sapien
tgatagctcggtgctattttggttt

SEQ ID NO: 565668 - DNA, 25 bp, Homo sapien
ttggttttgcatttccatggtgaac

SEQ ID NO: 565669 - DNA, 25 bp, Homo sapien
agatggtgtgccaagtcattccctc

SEQ ID NO: 565670 - DNA, 25 bp, Homo sapien
tcattccctcattcggcctattaga

SEQ ID NO: 565671 - DNA, 25 bp, Homo sapien
ggcctattagatggttagtttcctt

SEQ ID NO: 565672 - DNA, 25 bp, Homo sapien
agagacatgggttagttccacagaa

SEQ ID NO: 565673 - DNA, 25 bp, Homo sapien
gttccacagaaggaattcctgactg

SEQ ID NO: 565674 - DNA, 25 bp, Homo sapien
attcctgactgggagaattagccct

SEQ ID NO: 565675 - DNA, 25 bp, Homo sapien
aattagccctggcacaggttccaag

SEQ ID NO: 565676 - DNA, 25 bp, Homo sapien
gaattagaacccatcgtggaaccta

SEQ ID NO: 565677 - DNA, 25 bp, Homo sapien
atcgtggaacctaggcagagctgga

SEQ ID NO: 565678 - DNA, 25 bp, Homo sapien
cctgcaggctctggctcagaatgga

SEQ ID NO: 565679 - DNA, 25 bp, Homo sapien
gctctggctcagaatggaggttaca

SEQ ID NO: 565680 - DNA, 25 bp, Homo sapien
ccttttgaataaccatgtacatatt

SEQ ID NO: 565681 - DNA, 25 bp, Homo sapien
taaaagtattttatagccctatgta

SEQ ID NO: 565682 - DNA, 25 bp, Homo sapien
tattgcatattcatcttgaatgtga

SEQ ID NO: 565683 - DNA, 25 bp, Homo sapien
catcttgaatgtgaatttactgttg

SEQ ID NO: 565684 - DNA, 25 bp, Homo sapien
gaataatgctagtcagtcagatcac

SEQ ID NO: 565685 - DNA, 25 bp, Homo sapien
tgctagtcagtcagatcacagattt

SEQ ID NO: 565686 - DNA, 25 bp, Homo sapien
cttattgagagggacatctgaggca

SEQ ID NO: 565687 - DNA, 25 bp, Homo sapien
atctgaggcagtagtcttcgtcttt

SEQ ID NO: 565688 - DNA, 25 bp, Homo sapien
gaggcagtagtcttcgtctttaatt

SEQ ID NO: 565689 - DNA, 25 bp, Homo sapien
cagtagtcttcgtctttaatttttg

SEQ ID NO: 565690 - DNA, 25 bp, Homo sapien
gggcagattggtgctttggttttaa

SEQ ID NO: 565691 - DNA, 25 bp, Homo sapien
taacagtgagaatttgtcagtggtg

SEQ ID NO: 565692 - DNA, 25 bp, Homo sapien
tgctgtcctgtggtacagacattaa

SEQ ID NO: 565693 - DNA, 25 bp, Homo sapien
gaagaacaaggctggccacacacca

SEQ ID NO: 565694 - DNA, 25 bp, Homo sapien
acacaccacttttattggccataag

SEQ ID NO: 565695 - DNA, 25 bp, Homo sapien
tctcatagattctggtgctgatcca

SEQ ID NO: 565696 - DNA, 25 bp, Homo sapien
tcatagattctggtgctgatccaaa

SEQ ID NO: 565697 - DNA, 25 bp, Homo sapien
gatccaaatattgtagatgtgtatg

SEQ ID NO: 565698 - DNA, 25 bp, Homo sapien
tggcaacacagctgtccattatgct

SEQ ID NO: 565699 - DNA, 25 bp, Homo sapien
cagctgtccattatgctgttaacag

SEQ ID NO: 565700 - DNA, 25 bp, Homo sapien
gctgtccattatgctgttaacagtg

SEQ ID NO: 565701 - DNA, 25 bp, Homo sapien
gtccattatgctgttaacagtgaga

SEQ ID NO: 565702 - DNA, 25 bp, Homo sapien
tgctgcgggtgagtgtgtgctgccc

SEQ ID NO: 565703 - DNA, 25 bp, Homo sapien
gctgcgggtgagtgtgtgctgcccc

SEQ ID NO: 565704 - DNA, 25 bp, Homo sapien
gccctgggcacagagggatgtggag

SEQ ID NO: 565705 - DNA, 25 bp, Homo sapien
ccctgggcacagagggatgtggagc

SEQ ID NO: 565706 - DNA, 25 bp, Homo sapien
tgggcacagagggatgtggagcgct

SEQ ID NO: 565707 - DNA, 25 bp, Homo sapien
cacagagggatgtggagcgctgggt

SEQ ID NO: 565708 - DNA, 25 bp, Homo sapien
ggatgtggagcgctgggtctggtct

SEQ ID NO: 565709 - DNA, 25 bp, Homo sapien
gatgtggagcgctgggtctggtctg

SEQ ID NO: 565710 - DNA, 25 bp, Homo sapien
atgtggagcgctgggtctggtctgg

SEQ ID NO: 565711 - DNA, 25 bp, Homo sapien
gtggagcgctgggtctggtctggcc

SEQ ID NO: 565712 - DNA, 25 bp, Homo sapien
cagccctggtgacagggccccaggg

SEQ ID NO: 565713 - DNA, 25 bp, Homo sapien
atagactaaatgtttatgtcctccc

SEQ ID NO: 565714 - DNA, 25 bp, Homo sapien
agactaaatgtttatgtcctcccaa

SEQ ID NO: 565715 - DNA, 25 bp, Homo sapien
atgtcctcccaaacttcatattttg

SEQ ID NO: 565716 - DNA, 25 bp, Homo sapien
gtcctcccaaacttcatattttgga

SEQ ID NO: 565717 - DNA, 25 bp, Homo sapien
ttggaagccagacatggtaactcac

SEQ ID NO: 565718 - DNA, 25 bp, Homo sapien
tggaagccagacatggtaactcaca

SEQ ID NO: 565719 - DNA, 25 bp, Homo sapien
ggaagccagacatggtaactcacac

SEQ ID NO: 565720 - DNA, 25 bp, Homo sapien
tgagccatgatattgccagcctggg

SEQ ID NO: 565721 - DNA, 25 bp, Homo sapien
gagccatgatattgccagcctgggt

SEQ ID NO: 565722 - DNA, 25 bp, Homo sapien
agccatgatattgccagcctgggtg

SEQ ID NO: 565723 - DNA, 25 bp, Homo sapien
gccatgatattgccagcctgggtga

SEQ ID NO: 565724 - DNA, 25 bp, Homo sapien
catcaatattactttctgttaacat

SEQ ID NO: 565725 - DNA, 25 bp, Homo sapien
acatattaggaaatgcagactcaga

SEQ ID NO: 565726 - DNA, 25 bp, Homo sapien
tgcagactcagaaagattaagcccc

SEQ ID NO: 565727 - DNA, 25 bp, Homo sapien
atctgaaatcaggtctatgactcca

SEQ ID NO: 565728 - DNA, 25 bp, Homo sapien
ggtctatgactccaaactatacttt

SEQ ID NO: 565729 - DNA, 25 bp, Homo sapien
gactccaaactatactttgtctatt

SEQ ID NO: 565730 - DNA, 25 bp, Homo sapien
atactttgtctattacatgccccga

SEQ ID NO: 565731 - DNA, 25 bp, Homo sapien
actttgtctattacatgccccgatg

SEQ ID NO: 565732 - DNA, 25 bp, Homo sapien
ttgtctattacatgccccgatgtta

SEQ ID NO: 565733 - DNA, 25 bp, Homo sapien
tgccccgatgttaaacatcactgag

SEQ ID NO: 565734 - DNA, 25 bp, Homo sapien
cagtgtgaccacaattatgtgtaaa

SEQ ID NO: 565735 - DNA, 25 bp, Homo sapien
ttgcaatcaatgttgatcagcggtc

SEQ ID NO: 565736 - DNA, 25 bp, Homo sapien
gatcagcggtcaaagcattccagat

SEQ ID NO: 565737 - DNA, 25 bp, Homo sapien
attccagatgaacttgtcataaagc

SEQ ID NO: 565738 - DNA, 25 bp, Homo sapien
agaagctcaactccccagaagtctg

SEQ ID NO: 565739 - DNA, 25 bp, Homo sapien
ccccagaagtctgtcactttggtta

SEQ ID NO: 565740 - DNA, 25 bp, Homo sapien
attatcactgaaataccatcacttt

SEQ ID NO: 565741 - DNA, 25 bp, Homo sapien
atcactttcacaggatgccatgact

SEQ ID NO: 565742 - DNA, 25 bp, Homo sapien
ggatgccatgactaccttacagcaa

SEQ ID NO: 565743 - DNA, 25 bp, Homo sapien
acttaaacctgaaacctgatgttat

SEQ ID NO: 565744 - DNA, 25 bp, Homo sapien
agtgtcctgactatgatttgtgcca

SEQ ID NO: 565745 - DNA, 25 bp, Homo sapien
gacagcacaataatacgggatacat

SEQ ID NO: 565746 - DNA, 25 bp, Homo sapien
ttaacacctttgctcagattagttt

SEQ ID NO: 565747 - DNA, 25 bp, Homo sapien
acctttgctcagattagtttctcga

SEQ ID NO: 565748 - DNA, 25 bp, Homo sapien
attagtttctcgagctgttttccca

SEQ ID NO: 565749 - DNA, 25 bp, Homo sapien
tcgagctgttttcccacctggtgag

SEQ ID NO: 565750 - DNA, 25 bp, Homo sapien
tgttttcccacctggtgagcagata

SEQ ID NO: 565751 - DNA, 25 bp, Homo sapien
ttcccacctggtgagcagataagag

SEQ ID NO: 565752 - DNA, 25 bp, Homo sapien
aagtgccagagagagaaggccttgc

SEQ ID NO: 565753 - DNA, 25 bp, Homo sapien
aggcaggagcccctgagtatcctaa

SEQ ID NO: 565754 - DNA, 25 bp, Homo sapien
ggagcccctgagtatcctaaggaga

SEQ ID NO: 565755 - DNA, 25 bp, Homo sapien
cctaaggagaagtaccagcgattta

SEQ ID NO: 565756 - DNA, 25 bp, Homo sapien
gaagtaccagcgatttagggaagaa

SEQ ID NO: 565757 - DNA, 25 bp, Homo sapien
gttaaatctgatttccacgcagctc

SEQ ID NO: 565758 - DNA, 25 bp, Homo sapien
aaatctgatttccacgcagctctgt

SEQ ID NO: 565759 - DNA, 25 bp, Homo sapien
atctgatttccacgcagctctgtgg

SEQ ID NO: 565760 - DNA, 25 bp, Homo sapien
ggattccgaatgtccacagtatgat

SEQ ID NO: 565761 - DNA, 25 bp, Homo sapien
ttccgaatgtccacagtatgatgtt

SEQ ID NO: 565762 - DNA, 25 bp, Homo sapien
gaatgtccacagtatgatgttatct

SEQ ID NO: 565763 - DNA, 25 bp, Homo sapien
gtccacagtatgatgttatctcaat

SEQ ID NO: 565764 - DNA, 25 bp, Homo sapien
cagtatgatgttatctcaattccca

SEQ ID NO: 565765 - DNA, 25 bp, Homo sapien
attcgctcagttgctctacactaaa

SEQ ID NO: 565766 - DNA, 25 bp, Homo sapien
cgctcagttgctctacactaaaatt

SEQ ID NO: 565767 - DNA, 25 bp, Homo sapien
cagttgctctacactaaaatttgct

SEQ ID NO: 565768 - DNA, 25 bp, Homo sapien
caagttgttcttggttatgtggaac

SEQ ID NO: 565769 - DNA, 25 bp, Homo sapien
ttatgtggaactatgtgcaggaaac

SEQ ID NO: 565770 - DNA, 25 bp, Homo sapien
gacacaaaattccaaaagctgcaat

SEQ ID NO: 565771 - DNA, 25 bp, Homo sapien
aaaagctgcaatataaggatctctg

SEQ ID NO: 565772 - DNA, 25 bp, Homo sapien
ggttcaacaagcttatcgacttctt

SEQ ID NO: 565773 - DNA, 25 bp, Homo sapien
aacaagcttatcgacttcttggaaa

SEQ ID NO: 565774 - DNA, 25 bp, Homo sapien
tcgacttcttggaaaaacacagaca

SEQ ID NO: 565775 - DNA, 25 bp, Homo sapien
cacagacagcaatggatcaacttca

SEQ ID NO: 565776 - DNA, 25 bp, Homo sapien
ggatcaacttcatatgcacttcacc

SEQ ID NO: 565777 - DNA, 25 bp, Homo sapien
aagccattcacaacaccgtgtttca

SEQ ID NO: 565778 - DNA, 25 bp, Homo sapien
aacaccgtgtttcaagttgttcttg

SEQ ID NO: 565779 - DNA, 25 bp, Homo sapien
tgtatgccagggaccgttcgccgtt

SEQ ID NO: 565780 - DNA, 25 bp, Homo sapien
gttcgccgttggaactatccgtctc

SEQ ID NO: 565781 - DNA, 25 bp, Homo sapien
tatccgtctcccctgtgcattgcaa

SEQ ID NO: 565782 - DNA, 25 bp, Homo sapien
ctgtgcattgcaacctgtggaggga

SEQ ID NO: 565783 - DNA, 25 bp, Homo sapien
aacctgtggagggacgctgagcacc

SEQ ID NO: 565784 - DNA, 25 bp, Homo sapien
tgagcaccttgggtggtgtgatcct

SEQ ID NO: 565785 - DNA, 25 bp, Homo sapien
accttgggtggtgtgatcctgagcc

SEQ ID NO: 565786 - DNA, 25 bp, Homo sapien
tgagccccggcttcccaggttctta

SEQ ID NO: 565787 - DNA, 25 bp, Homo sapien
caacaacttagactgcacctggagg

SEQ ID NO: 565788 - DNA, 25 bp, Homo sapien
tagactgcacctggaggatctcatt

SEQ ID NO: 565789 - DNA, 25 bp, Homo sapien
aggatctcattacccatcggctatg

SEQ ID NO: 565790 - DNA, 25 bp, Homo sapien
agggcagggcacttgcacagggaac

SEQ ID NO: 565791 - DNA, 25 bp, Homo sapien
agccacagccctactggaaccaggg

SEQ ID NO: 565792 - DNA, 25 bp, Homo sapien
cagccctactggaaccagggtttct

SEQ ID NO: 565793 - DNA, 25 bp, Homo sapien
ggacaggcggccttcctgtgggagt

SEQ ID NO: 565794 - DNA, 25 bp, Homo sapien
tccttggaggcgaccagacaccttc

SEQ ID NO: 565795 - DNA, 25 bp, Homo sapien
gacaccttccctaactggaggaaat

SEQ ID NO: 565796 - DNA, 25 bp, Homo sapien
ccttccctaactggaggaaattctg

SEQ ID NO: 565797 - DNA, 25 bp, Homo sapien
ggaaattctgaaccccagacctgga

SEQ ID NO: 565798 - DNA, 25 bp, Homo sapien
ttctgaaccccagacctggaaagtt

SEQ ID NO: 565799 - DNA, 25 bp, Homo sapien
agacctggaaagttcaaagctgaaa

SEQ ID NO: 565800 - DNA, 25 bp, Homo sapien
agctgaaataaaatcgccccttgtt

SEQ ID NO: 565801 - DNA, 25 bp, Homo sapien
aaagaagtgaaaaggccctgccaca

SEQ ID NO: 565802 - DNA, 25 bp, Homo sapien
agtgaaaaggccctgccacacctta

SEQ ID NO: 565803 - DNA, 25 bp, Homo sapien
gtgaaaaggccctgccacaccttaa

SEQ ID NO: 565804 - DNA, 25 bp, Homo sapien
aaaaggccctgccacaccttaactg

SEQ ID NO: 565805 - DNA, 25 bp, Homo sapien
ggccctgccacaccttaactgatga

SEQ ID NO: 565806 - DNA, 25 bp, Homo sapien
caccttcactgagtgattaaccctg

SEQ ID NO: 565807 - DNA, 25 bp, Homo sapien
ccttcactgagtgattaaccctgtg

SEQ ID NO: 565808 - DNA, 25 bp, Homo sapien
cttcactgagtgattaaccctgtga

SEQ ID NO: 565809 - DNA, 25 bp, Homo sapien
actgagtgattaaccctgtgaattt

SEQ ID NO: 565810 - DNA, 25 bp, Homo sapien
ctgagtgattaaccctgtgaatttc

SEQ ID NO: 565811 - DNA, 25 bp, Homo sapien
gtgattaaccctgtgaatttccttc

SEQ ID NO: 565812 - DNA, 25 bp, Homo sapien
caggtctggtttacattttgatgag

SEQ ID NO: 565813 - DNA, 25 bp, Homo sapien
aggtctggtttacattttgatgagt

SEQ ID NO: 565814 - DNA, 25 bp, Homo sapien
ggtctggtttacattttgatgagtt

SEQ ID NO: 565815 - DNA, 25 bp, Homo sapien
gtctggtttacattttgatgagttt

SEQ ID NO: 565816 - DNA, 25 bp, Homo sapien
ctggtttacattttgatgagtttta

SEQ ID NO: 565817 - DNA, 25 bp, Homo sapien
tttacattttgatgagttttaactc

SEQ ID NO: 565818 - DNA, 25 bp, Homo sapien
tttaactcatttaacattactatgg

SEQ ID NO: 565819 - DNA, 25 bp, Homo sapien
aactcatttaacattactatggaac

SEQ ID NO: 565820 - DNA, 25 bp, Homo sapien
tttaacattactatggaacccacct

SEQ ID NO: 565821 - DNA, 25 bp, Homo sapien
ttaacattactatggaacccacctc

SEQ ID NO: 565822 - DNA, 25 bp, Homo sapien
aacattactatggaacccacctcct

SEQ ID NO: 565823 - DNA, 25 bp, Homo sapien
ctgtaggtaactctggttatattta

SEQ ID NO: 565824 - DNA, 25 bp, Homo sapien
acatcctcgtgggaagtccaactgg

SEQ ID NO: 565825 - DNA, 25 bp, Homo sapien
tcctcgtgggaagtccaactggact

SEQ ID NO: 565826 - DNA, 25 bp, Homo sapien
caactggactaagaaccctggactc

SEQ ID NO: 565827 - DNA, 25 bp, Homo sapien
ctaagaaccctggactctagcactg

SEQ ID NO: 565828 - DNA, 25 bp, Homo sapien
ggtattatcactaccgtgactctac

SEQ ID NO: 565829 - DNA, 25 bp, Homo sapien
ccgtgactctactgcctgttggaga

SEQ ID NO: 565830 - DNA, 25 bp, Homo sapien
gggtggtcctcttccactttgtcac

SEQ ID NO: 565831 - DNA, 25 bp, Homo sapien
actttgtcactctgatccaagcatg

SEQ ID NO: 565832 - DNA, 25 bp, Homo sapien
gtcactctgatccaagcatgaaaga

SEQ ID NO: 565833 - DNA, 25 bp, Homo sapien
caagcatgaaagatttcttcctcta

SEQ ID NO: 565834 - DNA, 25 bp, Homo sapien
agatctcgatcccaaactccctcct

SEQ ID NO: 565835 - DNA, 25 bp, Homo sapien
ctcctgccagaatctggacccgaat

SEQ ID NO: 565836 - DNA, 25 bp, Homo sapien
aatctggacccgaatccacccattg

SEQ ID NO: 565837 - DNA, 25 bp, Homo sapien
gctgccgctggagagaatctctgag

SEQ ID NO: 565838 - DNA, 25 bp, Homo sapien
gctggagagaatctctgaggtcccc

SEQ ID NO: 565839 - DNA, 25 bp, Homo sapien
ggagagcctgcctgcacggaagaga

SEQ ID NO: 565840 - DNA, 25 bp, Homo sapien
tgcacggaagagacgcctcctcggg

SEQ ID NO: 565841 - DNA, 25 bp, Homo sapien
gcctcctcgggaaatttgtgcacag

SEQ ID NO: 565842 - DNA, 25 bp, Homo sapien
cctcctcgggaaatttgtgcacaga

SEQ ID NO: 565843 - DNA, 25 bp, Homo sapien
gggatatgccatatgaagatgaagg

SEQ ID NO: 565844 - DNA, 25 bp, Homo sapien
ctacaagcccagggatgccaaagat

SEQ ID NO: 565845 - DNA, 25 bp, Homo sapien
gtgtgtgactatattgcatactggt

SEQ ID NO: 565846 - DNA, 25 bp, Homo sapien
ttagtgtaaccatcatctgaataat

SEQ ID NO: 565847 - DNA, 25 bp, Homo sapien
aatatacattgtacccactaagtaa

SEQ ID NO: 565848 - DNA, 25 bp, Homo sapien
ctgaatttcagagaccttaggtatc

SEQ ID NO: 565849 - DNA, 25 bp, Homo sapien
agaccttaggtatcagctactctgg

SEQ ID NO: 565850 - DNA, 25 bp, Homo sapien
tctggtctcacacccagggttgaaa

SEQ ID NO: 565851 - DNA, 25 bp, Homo sapien
agggttgaaatcctttctacaccat

SEQ ID NO: 565852 - DNA, 25 bp, Homo sapien
tttctacaccatcctgatcgtcagt

SEQ ID NO: 565853 - DNA, 25 bp, Homo sapien
gatcgtcagtcttttcttgaacact

SEQ ID NO: 565854 - DNA, 25 bp, Homo sapien
ttgaacacttaataccccaacccag

SEQ ID NO: 565855 - DNA, 25 bp, Homo sapien
aacccaggtggtctgatttgttgtg

SEQ ID NO: 565856 - DNA, 25 bp, Homo sapien
tagaacccactgatctaatgaacag

SEQ ID NO: 565857 - DNA, 25 bp, Homo sapien
tgccatctgcttgcaactgtatgag

SEQ ID NO: 565858 - DNA, 25 bp, Homo sapien
gcttgcaactgtatgaggccctgac

SEQ ID NO: 565859 - DNA, 25 bp, Homo sapien
tgtatgaggccctgacccacgtgtc

SEQ ID NO: 565860 - DNA, 25 bp, Homo sapien
gacccacgtgtcagaggactgtttc

SEQ ID NO: 565861 - DNA, 25 bp, Homo sapien
gactgtttccctttgctagatggct

SEQ ID NO: 565862 - DNA, 25 bp, Homo sapien
ttccctttgctagatggctgcagaa

SEQ ID NO: 565863 - DNA, 25 bp, Homo sapien
ggcagaaatggcaggcccttgcaga

SEQ ID NO: 565864 - DNA, 25 bp, Homo sapien
caggcccttgcagaacagcaggaga

SEQ ID NO: 565865 - DNA, 25 bp, Homo sapien
caagcggaactgagtggcctatttc

SEQ ID NO: 565866 - DNA, 25 bp, Homo sapien
gagtggcctatttcatgcagagttg

SEQ ID NO: 565867 - DNA, 25 bp, Homo sapien
cacatctgttcagctctcatgaaga

SEQ ID NO: 565868 - DNA, 25 bp, Homo sapien
catctgttcagctctcatgaagata

SEQ ID NO: 565869 - DNA, 25 bp, Homo sapien
tctgttcagctctcatgaagataac

SEQ ID NO: 565870 - DNA, 25 bp, Homo sapien
gttcagctctcatgaagataaccaa

SEQ ID NO: 565871 - DNA, 25 bp, Homo sapien
taaatagtggtattacacctccgtt

SEQ ID NO: 565872 - DNA, 25 bp, Homo sapien
aatagtggtattacacctccgttgc

SEQ ID NO: 565873 - DNA, 25 bp, Homo sapien
atagtggtattacacctccgttgcc

SEQ ID NO: 565874 - DNA, 25 bp, Homo sapien
gttgccctccaagactgacaattat

SEQ ID NO: 565875 - DNA, 25 bp, Homo sapien
tgccctccaagactgacaattatat

SEQ ID NO: 565876 - DNA, 25 bp, Homo sapien
gccctccaagactgacaattatatg

SEQ ID NO: 565877 - DNA, 25 bp, Homo sapien
ctccaagactgacaattatatgtat

SEQ ID NO: 565878 - DNA, 25 bp, Homo sapien
agatctcgatcccaaactccctcct

SEQ ID NO: 565879 - DNA, 25 bp, Homo sapien
gatctcgatcccaaactccctcctg

SEQ ID NO: 565880 - DNA, 25 bp, Homo sapien
atctcgatcccaaactccctcctgc

SEQ ID NO: 565881 - DNA, 25 bp, Homo sapien
tccctcctgccagaatctggacccg

SEQ ID NO: 565882 - DNA, 25 bp, Homo sapien
ccctcctgccagaatctggacccga

SEQ ID NO: 565883 - DNA, 25 bp, Homo sapien
ctgccagaatctggacccgaatcca

SEQ ID NO: 565884 - DNA, 25 bp, Homo sapien
tgccagaatctggacccgaatccac

SEQ ID NO: 565885 - DNA, 25 bp, Homo sapien
gccagaatctggacccgaatccacc

SEQ ID NO: 565886 - DNA, 25 bp, Homo sapien
aatctggacccgaatccacccattg

SEQ ID NO: 565887 - DNA, 25 bp, Homo sapien
atctggacccgaatccacccattgc

SEQ ID NO: 565888 - DNA, 25 bp, Homo sapien
ggagagcctgcctgcacggaagaga

SEQ ID NO: 565889 - DNA, 25 bp, Homo sapien
aataaaacctacctgacactcttgc

SEQ ID NO: 565890 - DNA, 25 bp, Homo sapien
cctacctgacactcttgcaaatgtt

SEQ ID NO: 565891 - DNA, 25 bp, Homo sapien
tgacactcttgcaaatgtttaggga

SEQ ID NO: 565892 - DNA, 25 bp, Homo sapien
gggaaagtgtgtctccctttatatt

SEQ ID NO: 565893 - DNA, 25 bp, Homo sapien
atatttactgtttctctctgaagcc

SEQ ID NO: 565894 - DNA, 25 bp, Homo sapien
ttactgtttctctctgaagccaatt

SEQ ID NO: 565895 - DNA, 25 bp, Homo sapien
atcctggccatctgcattcatataa

SEQ ID NO: 565896 - DNA, 25 bp, Homo sapien
tggccatctgcattcatataaagtg

SEQ ID NO: 565897 - DNA, 25 bp, Homo sapien
ggtatctggaataaattcattgcaa

SEQ ID NO: 565898 - DNA, 25 bp, Homo sapien
cattgcaaaattgatgttacctgtt

SEQ ID NO: 565899 - DNA, 25 bp, Homo sapien
cctgttaaatcttcctagtagtttg

SEQ ID NO: 565900 - DNA, 25 bp, Homo sapien
tggccctcgactcacagattttcaa

SEQ ID NO: 565901 - DNA, 25 bp, Homo sapien
gccctcgactcacagattttcaaaa

SEQ ID NO: 565902 - DNA, 25 bp, Homo sapien
ctcgactcacagattttcaaaatac

SEQ ID NO: 565903 - DNA, 25 bp, Homo sapien
tacttttgaacagtaagctgaggac

SEQ ID NO: 565904 - DNA, 25 bp, Homo sapien
tgaacagtaagctgaggacagtgtt

SEQ ID NO: 565905 - DNA, 25 bp, Homo sapien
gaggacagtgtttattatgactata

SEQ ID NO: 565906 - DNA, 25 bp, Homo sapien
attatgactatactggtctcctttc

SEQ ID NO: 565907 - DNA, 25 bp, Homo sapien
tgactatactggtctcctttcacta

SEQ ID NO: 565908 - DNA, 25 bp, Homo sapien
tctcctttcactagctcacaaaatt

SEQ ID NO: 565909 - DNA, 25 bp, Homo sapien
tttcactagctcacaaaatttaact

SEQ ID NO: 565910 - DNA, 25 bp, Homo sapien
gctcacaaaatttaactacatcact

SEQ ID NO: 565911 - DNA, 25 bp, Homo sapien
gagaatgacttccagatagcttatt

SEQ ID NO: 565912 - DNA, 25 bp, Homo sapien
gacttccagatagcttattggctat

SEQ ID NO: 565913 - DNA, 25 bp, Homo sapien
tattggctatcaatctaggagctct

SEQ ID NO: 565914 - DNA, 25 bp, Homo sapien
ctatcaatctaggagctcttacagc

SEQ ID NO: 565915 - DNA, 25 bp, Homo sapien
gctcttacagctgagaaacattttg

SEQ ID NO: 565916 - DNA, 25 bp, Homo sapien
agctttaagaagtacatgtgtttta

SEQ ID NO: 565917 - DNA, 25 bp, Homo sapien
ggtctcattcacacccagatttata

SEQ ID NO: 565918 - DNA, 25 bp, Homo sapien
tcacacccagatttataggagccag

SEQ ID NO: 565919 - DNA, 25 bp, Homo sapien
tttataggagccagcactatgtgct

SEQ ID NO: 565920 - DNA, 25 bp, Homo sapien
agcactatgtgctcggtatataata

SEQ ID NO: 565921 - DNA, 25 bp, Homo sapien
ctcggtatataatagaagctcagtt

SEQ ID NO: 565922 - DNA, 25 bp, Homo sapien
catccggcgcccagagaaggagttg

SEQ ID NO: 565923 - DNA, 25 bp, Homo sapien
tccggcgcccagagaaggagttgct

SEQ ID NO: 565924 - DNA, 25 bp, Homo sapien
aggagttgctctattatcctggcac

SEQ ID NO: 565925 - DNA, 25 bp, Homo sapien
gagttgctctattatcctggcactc

SEQ ID NO: 565926 - DNA, 25 bp, Homo sapien
tgctctattatcctggcactccata

SEQ ID NO: 565927 - DNA, 25 bp, Homo sapien
acaggtagaaataagcgcttcttac

SEQ ID NO: 565928 - DNA, 25 bp, Homo sapien
gaaataagcgcttcttaccaagatg

SEQ ID NO: 565929 - DNA, 25 bp, Homo sapien
taagcgcttcttaccaagatgaaat

SEQ ID NO: 565930 - DNA, 25 bp, Homo sapien
agatgaaatccacccatcatttctg

SEQ ID NO: 565931 - DNA, 25 bp, Homo sapien
gaaatccacccatcatttctgaatg

SEQ ID NO: 565932 - DNA, 25 bp, Homo sapien
ccacccatcatttctgaatggctca

SEQ ID NO: 565933 - DNA, 25 bp, Homo sapien
atccccaggaccacgtctgagatgg

SEQ ID NO: 565934 - DNA, 25 bp, Homo sapien
caggaccacgtctgagatgggaagt

SEQ ID NO: 565935 - DNA, 25 bp, Homo sapien
ccacgtctgagatgggaagtgcctt

SEQ ID NO: 565936 - DNA, 25 bp, Homo sapien
ttctttccgagtaactttagaacat

SEQ ID NO: 565937 - DNA, 25 bp, Homo sapien
gtaactttagaacatgtcgcttcaa

SEQ ID NO: 565938 - DNA, 25 bp, Homo sapien
tagaacatgtcgcttcaaatataac

SEQ ID NO: 565939 - DNA, 25 bp, Homo sapien
tttcagtggacttgcatggaaggaa

SEQ ID NO: 565940 - DNA, 25 bp, Homo sapien
agtggacttgcatggaaggaaacgc

SEQ ID NO: 565941 - DNA, 25 bp, Homo sapien
gaaggaaacgcaagttcatttgcca

SEQ ID NO: 565942 - DNA, 25 bp, Homo sapien
gaggggagcattccacaagccgcaa

SEQ ID NO: 565943 - DNA, 25 bp, Homo sapien
ccacaagccgcaagagcctggacac

SEQ ID NO: 565944 - DNA, 25 bp, Homo sapien
gaacactattcaaaggaccatgatg

SEQ ID NO: 565945 - DNA, 25 bp, Homo sapien
attttttctcctatgcctggagaat

SEQ ID NO: 565946 - DNA, 25 bp, Homo sapien
tcctatgcctggagaatcctgtgag

SEQ ID NO: 565947 - DNA, 25 bp, Homo sapien
ggagaatcctgtgagaatgccaaca

SEQ ID NO: 565948 - DNA, 25 bp, Homo sapien
ctgtgagaatgccaacacttcgttg

SEQ ID NO: 565949 - DNA, 25 bp, Homo sapien
gaatgccaacacttcgttgggcaga

SEQ ID NO: 565950 - DNA, 25 bp, Homo sapien
cgttgggcagaagaatgtcagttaa

SEQ ID NO: 565951 - DNA, 25 bp, Homo sapien
ctctggtaagtcattgcttcagtta

SEQ ID NO: 565952 - DNA, 25 bp, Homo sapien
cattgcttcagttaatctataccct

SEQ ID NO: 565953 - DNA, 25 bp, Homo sapien
atctataccctgattattttattat

SEQ ID NO: 565954 - DNA, 25 bp, Homo sapien
ataactgttgaacgtcagattattc

SEQ ID NO: 565955 - DNA, 25 bp, Homo sapien
aagaagaagcagactcctcactcct

SEQ ID NO: 565956 - DNA, 25 bp, Homo sapien
tccttcaccagggtggatttgctgg

SEQ ID NO: 565957 - DNA, 25 bp, Homo sapien
atttgctggtttgaagcagacctga

SEQ ID NO: 565958 - DNA, 25 bp, Homo sapien
gaaatatttctttagactggtctat

SEQ ID NO: 565959 - DNA, 25 bp, Homo sapien
tagactggtctatacttttttcttt

SEQ ID NO: 565960 - DNA, 25 bp, Homo sapien
atatctaaaattcactggaagagct

SEQ ID NO: 565961 - DNA, 25 bp, Homo sapien
gaagagctatgaaatctgtccaaga

SEQ ID NO: 565962 - DNA, 25 bp, Homo sapien
tgtccaagatttcgttcagttcagg

SEQ ID NO: 565963 - DNA, 25 bp, Homo sapien
ataaccaccaggtaatacacatgtg

SEQ ID NO: 565964 - DNA, 25 bp, Homo sapien
tacacatgtgactcagattggtaac

SEQ ID NO: 565965 - DNA, 25 bp, Homo sapien
atgtgtccaagacctcaagttgaaa

SEQ ID NO: 565966 - DNA, 25 bp, Homo sapien
tgatcacctgatacttccaagcaag

SEQ ID NO: 565967 - DNA, 25 bp, Homo sapien
cttccaagcaagcaggtgttctttt

SEQ ID NO: 565968 - DNA, 25 bp, Homo sapien
agcaggtgttcttttcagaagccag

SEQ ID NO: 565969 - DNA, 25 bp, Homo sapien
gccagaagctgataacctgggcttt

SEQ ID NO: 565970 - DNA, 25 bp, Homo sapien
ataacctgggctttctgatctaacc

SEQ ID NO: 565971 - DNA, 25 bp, Homo sapien
taaccccagcccaaattcattgcaa

SEQ ID NO: 565972 - DNA, 25 bp, Homo sapien
gggaggagattcttcctactgagaa

SEQ ID NO: 565973 - DNA, 25 bp, Homo sapien
agaagtgggtgccaactctcccttt

SEQ ID NO: 565974 - DNA, 25 bp, Homo sapien
tgccaactctccctttcaaatttgt

SEQ ID NO: 565975 - DNA, 25 bp, Homo sapien
gaaccactggaataatgctcctgcc

SEQ ID NO: 565976 - DNA, 25 bp, Homo sapien
gtcaagagcgcagaccccatgatca

SEQ ID NO: 565977 - DNA, 25 bp, Homo sapien
gaatgcagtgtgttgactcttcttt

SEQ ID NO: 565978 - DNA, 25 bp, Homo sapien
agtgtgttgactcttcttttgtttt

SEQ ID NO: 565979 - DNA, 25 bp, Homo sapien
tcagccttggctctgtttttgaact

SEQ ID NO: 565980 - DNA, 25 bp, Homo sapien
gccttggctctgtttttgaactgaa

SEQ ID NO: 565981 - DNA, 25 bp, Homo sapien
ggctctgtttttgaactgaaattat

SEQ ID NO: 565982 - DNA, 25 bp, Homo sapien
gaaattatggtgagctggtcattca

SEQ ID NO: 565983 - DNA, 25 bp, Homo sapien
atggtgagctggtcattcaaagctg

SEQ ID NO: 565984 - DNA, 25 bp, Homo sapien
gtcattcaaagctgtatgtgagtac

SEQ ID NO: 565985 - DNA, 25 bp, Homo sapien
gctgtatgtgagtacatgtgttttt

SEQ ID NO: 565986 - DNA, 25 bp, Homo sapien
aattgctcttttgagtaattcattc

SEQ ID NO: 565987 - DNA, 25 bp, Homo sapien
tgagtaattcattcacatggtgtaa

SEQ ID NO: 565988 - DNA, 25 bp, Homo sapien
atatataatgtacatgtcccttttg

SEQ ID NO: 565989 - DNA, 25 bp, Homo sapien
agatgtggaaatgcctcactgctaa

SEQ ID NO: 565990 - DNA, 25 bp, Homo sapien
tggaaatgcctcactgctaagacat

SEQ ID NO: 565991 - DNA, 25 bp, Homo sapien
agacatgctcattcttgacaggctg

SEQ ID NO: 565992 - DNA, 25 bp, Homo sapien
tgctcattcttgacaggctgggaac

SEQ ID NO: 565993 - DNA, 25 bp, Homo sapien
tgaatgctgtagtgtcaccactgcc

SEQ ID NO: 565994 - DNA, 25 bp, Homo sapien
tgtcctgtacctacctatcttttca

SEQ ID NO: 565995 - DNA, 25 bp, Homo sapien
tacctatcttttcactcatttcctc

SEQ ID NO: 565996 - DNA, 25 bp, Homo sapien
atttcctccaagctcaggttttcag

SEQ ID NO: 565997 - DNA, 25 bp, Homo sapien
ggtatgtgccacctaacagtgagct

SEQ ID NO: 565998 - DNA, 25 bp, Homo sapien
acctaacagtgagctgtggaactgc

SEQ ID NO: 565999 - DNA, 25 bp, Homo sapien
gtgaaaactccaaagcttaacattc

SEQ ID NO: 566000 - DNA, 25 bp, Homo sapien
gcttaacattctaaccactctaggg

SEQ ID NO: 566001 - DNA, 25 bp, Homo sapien
tctaaccactctagggagggaggat

SEQ ID NO: 566002 - DNA, 25 bp, Homo sapien
agtgtgcaccaaggagcggtaagat

SEQ ID NO: 566003 - DNA, 25 bp, Homo sapien
gagcggtaagatgccagacctgtga

SEQ ID NO: 566004 - DNA, 25 bp, Homo sapien
atgccagacctgtgagtgaagaagc

SEQ ID NO: 566005 - DNA, 25 bp, Homo sapien
gaagcatcttggaagtggaccctat

SEQ ID NO: 566006 - DNA, 25 bp, Homo sapien
gaagtggaccctatagctccaggca

SEQ ID NO: 566007 - DNA, 25 bp, Homo sapien
tatagctccaggcacctgctgacac

SEQ ID NO: 566008 - DNA, 25 bp, Homo sapien
ggcacctgctgacacatagtcggag

SEQ ID NO: 566009 - DNA, 25 bp, Homo sapien
gctgacacatagtcggaggcaaacc

SEQ ID NO: 566010 - DNA, 25 bp, Homo sapien
agaggcggagacgggcggatcagca

SEQ ID NO: 566011 - DNA, 25 bp, Homo sapien
cggagacgggcggatcagcagaggt

SEQ ID NO: 566012 - DNA, 25 bp, Homo sapien
ggagacgggcggatcagcagaggtc

SEQ ID NO: 566013 - DNA, 25 bp, Homo sapien
actgacattgagaaaccccaccgct

SEQ ID NO: 566014 - DNA, 25 bp, Homo sapien
ctgacattgagaaaccccaccgctc

SEQ ID NO: 566015 - DNA, 25 bp, Homo sapien
tgacattgagaaaccccaccgctcc

SEQ ID NO: 566016 - DNA, 25 bp, Homo sapien
gacattgagaaaccccaccgctcct

SEQ ID NO: 566017 - DNA, 25 bp, Homo sapien
cattgagaaaccccaccgctcctaa

SEQ ID NO: 566018 - DNA, 25 bp, Homo sapien
ttgaaccgaggtggtagaggttgag

SEQ ID NO: 566019 - DNA, 25 bp, Homo sapien
accgaggtggtagaggttgaggtga

SEQ ID NO: 566020 - DNA, 25 bp, Homo sapien
cgaggtggtagaggttgaggtgagc

SEQ ID NO: 566021 - DNA, 25 bp, Homo sapien
ccacccgaccagcagagctttttaa

SEQ ID NO: 566022 - DNA, 25 bp, Homo sapien
acacatacacagagactctttcatt

SEQ ID NO: 566023 - DNA, 25 bp, Homo sapien
acatacacagagactctttcatttt

SEQ ID NO: 566024 - DNA, 25 bp, Homo sapien
atacacagagactctttcatttttc

SEQ ID NO: 566025 - DNA, 25 bp, Homo sapien
ctttcatttttcttgtacatatgtg

SEQ ID NO: 566026 - DNA, 25 bp, Homo sapien
ttgaatattcccaattttcgaagtc

SEQ ID NO: 566027 - DNA, 25 bp, Homo sapien
tgaatattcccaattttcgaagtca

SEQ ID NO: 566028 - DNA, 25 bp, Homo sapien
gaatattcccaattttcgaagtcag

SEQ ID NO: 566029 - DNA, 25 bp, Homo sapien
aatattcccaattttcgaagtcagt

SEQ ID NO: 566030 - DNA, 25 bp, Homo sapien
atattcccaattttcgaagtcagta

SEQ ID NO: 566031 - DNA, 25 bp, Homo sapien
tattcccaattttcgaagtcagtaa

SEQ ID NO: 566032 - DNA, 25 bp, Homo sapien
ttctctcacttgtcacttgaattgg

SEQ ID NO: 566033 - DNA, 25 bp, Homo sapien
tgtcacttgaattggcagaccgcat

SEQ ID NO: 566034 - DNA, 25 bp, Homo sapien
ggcagaccgcatactgttagcagtc

SEQ ID NO: 566035 - DNA, 25 bp, Homo sapien
ttgggtaccaccgttataagttcat

SEQ ID NO: 566036 - DNA, 25 bp, Homo sapien
ttattcaaaagactggccaagcaat

SEQ ID NO: 566037 - DNA, 25 bp, Homo sapien
gcagatggatctgggacattgcatg

SEQ ID NO: 566038 - DNA, 25 bp, Homo sapien
acattgcatgggacagctgggtcgc

SEQ ID NO: 566039 - DNA, 25 bp, Homo sapien
gctgggtcgcagctaaacacgaagc

SEQ ID NO: 566040 - DNA, 25 bp, Homo sapien
agcagaatcctacgtggcactggtc

SEQ ID NO: 566041 - DNA, 25 bp, Homo sapien
ttggtgtttgccctttattatgaat

SEQ ID NO: 566042 - DNA, 25 bp, Homo sapien
gaatagctcattacaggtactaagg

SEQ ID NO: 566043 - DNA, 25 bp, Homo sapien
tgtgaacattttatgggctataagt

SEQ ID NO: 566044 - DNA, 25 bp, Homo sapien
tatgggctataagtattgtgacaga

SEQ ID NO: 566045 - DNA, 25 bp, Homo sapien
gggctataagtattgtgacagatat

SEQ ID NO: 566046 - DNA, 25 bp, Homo sapien
ctgaatcacatgtctccttgaaata

SEQ ID NO: 566047 - DNA, 25 bp, Homo sapien
gaatcacatgtctccttgaaatatc

SEQ ID NO: 566048 - DNA, 25 bp, Homo sapien
aattctgtatctggaatactcatag

SEQ ID NO: 566049 - DNA, 25 bp, Homo sapien
ttctgtatctggaatactcatagag

SEQ ID NO: 566050 - DNA, 25 bp, Homo sapien
tgtatctggaatactcatagagttt

SEQ ID NO: 566051 - DNA, 25 bp, Homo sapien
ggaatactcatagagtttgtacaaa

SEQ ID NO: 566052 - DNA, 25 bp, Homo sapien
atactcatagagtttgtacaaaata

SEQ ID NO: 566053 - DNA, 25 bp, Homo sapien
atgaaagctgtcatttggttaaatt

SEQ ID NO: 566054 - DNA, 25 bp, Homo sapien
cactatcattgtgcctccactgaaa

SEQ ID NO: 566055 - DNA, 25 bp, Homo sapien
gtgcctccactgaaaactcagcttg

SEQ ID NO: 566056 - DNA, 25 bp, Homo sapien
aactcagcttggtgactgcactgta

SEQ ID NO: 566057 - DNA, 25 bp, Homo sapien
tcaggtctcctgagcaataagacta

SEQ ID NO: 566058 - DNA, 25 bp, Homo sapien
aagactaagccagtcgcttcagtga

SEQ ID NO: 566059 - DNA, 25 bp, Homo sapien
gtcgcttcagtgagtgggcagtcat

SEQ ID NO: 566060 - DNA, 25 bp, Homo sapien
agtgggcagtcatctggatgctgta

SEQ ID NO: 566061 - DNA, 25 bp, Homo sapien
agtcatctggatgctgtatcacccc

SEQ ID NO: 566062 - DNA, 25 bp, Homo sapien
cacagggtatcgagctcaacgcggg

SEQ ID NO: 566063 - DNA, 25 bp, Homo sapien
ggaccagtgcagcacaaccactcaa

SEQ ID NO: 566064 - DNA, 25 bp, Homo sapien
agcacaaccactcaatcttagccag

SEQ ID NO: 566065 - DNA, 25 bp, Homo sapien
agtccctccctccatacgtggggat

SEQ ID NO: 566066 - DNA, 25 bp, Homo sapien
ggacacagagtcagaccgtatcaat

SEQ ID NO: 566067 - DNA, 25 bp, Homo sapien
acacagagtcagaccgtatcaatag

SEQ ID NO: 566068 - DNA, 25 bp, Homo sapien
cagagtcagaccgtatcaataggta

SEQ ID NO: 566069 - DNA, 25 bp, Homo sapien
gagtcagaccgtatcaataggtata

SEQ ID NO: 566070 - DNA, 25 bp, Homo sapien
tatcaataggtatataacacagtat

SEQ ID NO: 566071 - DNA, 25 bp, Homo sapien
catcttgcatgactggaactttgta

SEQ ID NO: 566072 - DNA, 25 bp, Homo sapien
atcttgcatgactggaactttgtac

SEQ ID NO: 566073 - DNA, 25 bp, Homo sapien
ttgcatgactggaactttgtacctt

SEQ ID NO: 566074 - DNA, 25 bp, Homo sapien
gcatgactggaactttgtaccttgg

SEQ ID NO: 566075 - DNA, 25 bp, Homo sapien
tgactggaactttgtaccttgggta

SEQ ID NO: 566076 - DNA, 25 bp, Homo sapien
actgtgcatcctcaagcttgcagga

SEQ ID NO: 566077 - DNA, 25 bp, Homo sapien
gcatcctcaagcttgcaggaaccga

SEQ ID NO: 566078 - DNA, 25 bp, Homo sapien
tcaagcttgcaggaaccgagacttt

SEQ ID NO: 566079 - DNA, 25 bp, Homo sapien
agcttgcaggaaccgagacttttca

SEQ ID NO: 566080 - DNA, 25 bp, Homo sapien
gcaggaaccgagacttttcagccaa

SEQ ID NO: 566081 - DNA, 25 bp, Homo sapien
aggaaccgagacttttcagccaact

SEQ ID NO: 566082 - DNA, 25 bp, Homo sapien
gaaccgagacttttcagccaacttg

SEQ ID NO: 566083 - DNA, 25 bp, Homo sapien
cgagacttttcagccaacttgcaag

SEQ ID NO: 566084 - DNA, 25 bp, Homo sapien
gacttttcagccaacttgcaagcct

SEQ ID NO: 566085 - DNA, 25 bp, Homo sapien
ttcagccaacttgcaagccttggtg

SEQ ID NO: 566086 - DNA, 25 bp, Homo sapien
agccaacttgcaagccttggtggct

SEQ ID NO: 566087 - DNA, 25 bp, Homo sapien
agcctgggctgagctatccccagga

SEQ ID NO: 566088 - DNA, 25 bp, Homo sapien
tgggctgagctatccccaggagcca

SEQ ID NO: 566089 - DNA, 25 bp, Homo sapien
agacagcaccccaggaggagcgggt

SEQ ID NO: 566090 - DNA, 25 bp, Homo sapien
gtgtggatggtctccctggtcaaca

SEQ ID NO: 566091 - DNA, 25 bp, Homo sapien
tggatggtctccctggtcaacacaa

SEQ ID NO: 566092 - DNA, 25 bp, Homo sapien
atggtctccctggtcaacacaagga

SEQ ID NO: 566093 - DNA, 25 bp, Homo sapien
gtctccctggtcaacacaaggagtt

SEQ ID NO: 566094 - DNA, 25 bp, Homo sapien
gtcaacacaaggagttacagagctt

SEQ ID NO: 566095 - DNA, 25 bp, Homo sapien
acacaaggagttacagagctttatc

SEQ ID NO: 566096 - DNA, 25 bp, Homo sapien
tacaaaatgaaggtccccagagttc

SEQ ID NO: 566097 - DNA, 25 bp, Homo sapien
aatgaaggtccccagagttcccctg

SEQ ID NO: 566098 - DNA, 25 bp, Homo sapien
tcttgaagccaatccaaggcctcag

SEQ ID NO: 566099 - DNA, 25 bp, Homo sapien
ccaaggcctcagatgcagaaagaat

SEQ ID NO: 566100 - DNA, 25 bp, Homo sapien
agaaagaatgcctaccttacctctt

SEQ ID NO: 566101 - DNA, 25 bp, Homo sapien
ggtgctctacataatgcgaatctgt

SEQ ID NO: 566102 - DNA, 25 bp, Homo sapien
tcatgcattcatctactcttttatt

SEQ ID NO: 566103 - DNA, 25 bp, Homo sapien
tgcattcaattcctcaaccatttat

SEQ ID NO: 566104 - DNA, 25 bp, Homo sapien
atacctggtgtcaagcactgtgcta

SEQ ID NO: 566105 - DNA, 25 bp, Homo sapien
actgtgctagctactggacacgtca

SEQ ID NO: 566106 - DNA, 25 bp, Homo sapien
tgagattttgtcctctgccttgaga

SEQ ID NO: 566107 - DNA, 25 bp, Homo sapien
tgtcctctgccttgagattaaggta

SEQ ID NO: 566108 - DNA, 25 bp, Homo sapien
atgttttaacataccaagtccagtg

SEQ ID NO: 566109 - DNA, 25 bp, Homo sapien
atttaaatattcctatctgcttata

SEQ ID NO: 566110 - DNA, 25 bp, Homo sapien
tttaaatattcctatctgcttataa

SEQ ID NO: 566111 - DNA, 25 bp, Homo sapien
aggatttgtcagataatcaagccac

SEQ ID NO: 566112 - DNA, 25 bp, Homo sapien
atttgtcagataatcaagccacact

SEQ ID NO: 566113 - DNA, 25 bp, Homo sapien
ttgtcagataatcaagccacactaa

SEQ ID NO: 566114 - DNA, 25 bp, Homo sapien
gtcagataatcaagccacactaact

SEQ ID NO: 566115 - DNA, 25 bp, Homo sapien
tcagataatcaagccacactaacta

SEQ ID NO: 566116 - DNA, 25 bp, Homo sapien
tataatctacttaaactctaatcag

SEQ ID NO: 566117 - DNA, 25 bp, Homo sapien
aatctacttaaactctaatcagaaa

SEQ ID NO: 566118 - DNA, 25 bp, Homo sapien
caggattagaacatgcttataccta

SEQ ID NO: 566119 - DNA, 25 bp, Homo sapien
aggattagaacatgcttatacctat

SEQ ID NO: 566120 - DNA, 25 bp, Homo sapien
tctggtacctctttgttctctctgc

SEQ ID NO: 566121 - DNA, 25 bp, Homo sapien
ggtacctctttgttctctctgcttg

SEQ ID NO: 566122 - DNA, 25 bp, Homo sapien
ttctctctgcttgttgatgacaatc

SEQ ID NO: 566123 - DNA, 25 bp, Homo sapien
ctctgcttgttgatgacaatctgaa

SEQ ID NO: 566124 - DNA, 25 bp, Homo sapien
gatgacaatctgaacactgtccttc

SEQ ID NO: 566125 - DNA, 25 bp, Homo sapien
aacactgtccttcaatggaggtcaa

SEQ ID NO: 566126 - DNA, 25 bp, Homo sapien
tgtccttcaatggaggtcaaagccc

SEQ ID NO: 566127 - DNA, 25 bp, Homo sapien
ccttcaatggaggtcaaagccctaa

SEQ ID NO: 566128 - DNA, 25 bp, Homo sapien
ggtcaaagccctaaacaagatcctt

SEQ ID NO: 566129 - DNA, 25 bp, Homo sapien
caaagccctaaacaagatcctttct

SEQ ID NO: 566130 - DNA, 25 bp, Homo sapien
atcctttctcctcctcaggggaaga

SEQ ID NO: 566131 - DNA, 25 bp, Homo sapien
gagaaggtgtctgtggtggcggcgg

SEQ ID NO: 566132 - DNA, 25 bp, Homo sapien
tggcggcggcagaaggagtcagaac

SEQ ID NO: 566133 - DNA, 25 bp, Homo sapien
attgatttgtcatgagtctctttgt

SEQ ID NO: 566134 - DNA, 25 bp, Homo sapien
gtcatgagtctctttgttatagcca

SEQ ID NO: 566135 - DNA, 25 bp, Homo sapien
gagtctctttgttatagccacttaa

SEQ ID NO: 566136 - DNA, 25 bp, Homo sapien
tgttatagccacttaacgttacctt

SEQ ID NO: 566137 - DNA, 25 bp, Homo sapien
tatagccacttaacgttaccttaat

SEQ ID NO: 566138 - DNA, 25 bp, Homo sapien
gttaccttaatacacccacttcatg

SEQ ID NO: 566139 - DNA, 25 bp, Homo sapien
taccttaatacacccacttcatgga

SEQ ID NO: 566140 - DNA, 25 bp, Homo sapien
taatacacccacttcatggataagt

SEQ ID NO: 566141 - DNA, 25 bp, Homo sapien
tacacccacttcatggataagtaaa

SEQ ID NO: 566142 - DNA, 25 bp, Homo sapien
actggatacacatctgttcagctct

SEQ ID NO: 566143 - DNA, 25 bp, Homo sapien
cacatctgttcagctctcatgaaga

SEQ ID NO: 566144 - DNA, 25 bp, Homo sapien
catctgttcagctctcatgaagata

SEQ ID NO: 566145 - DNA, 25 bp, Homo sapien
gttcagctctcatgaagataaccaa

SEQ ID NO: 566146 - DNA, 25 bp, Homo sapien
taaatagtggtattacacctccgtt

SEQ ID NO: 566147 - DNA, 25 bp, Homo sapien
atagtggtattacacctccgttgcc

SEQ ID NO: 566148 - DNA, 25 bp, Homo sapien
gttgccctccaagactgacaattat

SEQ ID NO: 566149 - DNA, 25 bp, Homo sapien
gccctccaagactgacaattatatg

SEQ ID NO: 566150 - DNA, 25 bp, Homo sapien
ctccaagactgacaattatatgtat

SEQ ID NO: 566151 - DNA, 25 bp, Homo sapien
gtacctataaatgtcttctgctgct

SEQ ID NO: 566152 - DNA, 25 bp, Homo sapien
ttatctcagcactttctaaacccaa

SEQ ID NO: 566153 - DNA, 25 bp, Homo sapien
gaaaggagacatagcaatcttcaac

SEQ ID NO: 566154 - DNA, 25 bp, Homo sapien
agacatagcaatcttcaactccctc

SEQ ID NO: 566155 - DNA, 25 bp, Homo sapien
atagcaatcttcaactccctccttt

SEQ ID NO: 566156 - DNA, 25 bp, Homo sapien
tccctcctttacttttgaataagag

SEQ ID NO: 566157 - DNA, 25 bp, Homo sapien
taaagacactggtcatacccaccac

SEQ ID NO: 566158 - DNA, 25 bp, Homo sapien
tggtcatacccaccactcagaattt

SEQ ID NO: 566159 - DNA, 25 bp, Homo sapien
tacccaccactcagaatttcaatca

SEQ ID NO: 566160 - DNA, 25 bp, Homo sapien
gcttaatatagtacacctggcatgg

SEQ ID NO: 566161 - DNA, 25 bp, Homo sapien
tatagtacacctggcatggagtggt

SEQ ID NO: 566162 - DNA, 25 bp, Homo sapien
acacctggcatggagtggtaactca

SEQ ID NO: 566163 - DNA, 25 bp, Homo sapien
cctggcatggagtggtaactcaata

SEQ ID NO: 566164 - DNA, 25 bp, Homo sapien
gaataatgcagatagtgatcccatg

SEQ ID NO: 566165 - DNA, 25 bp, Homo sapien
atgcagatagtgatcccatgtttgt

SEQ ID NO: 566166 - DNA, 25 bp, Homo sapien
gatcccatgtttgttaattgccatc

SEQ ID NO: 566167 - DNA, 25 bp, Homo sapien
atgtttgttaattgccatcatggaa

SEQ ID NO: 566168 - DNA, 25 bp, Homo sapien
ttgccatcatggaagtcagagaatt

SEQ ID NO: 566169 - DNA, 25 bp, Homo sapien
ggaagtcagagaattaaccaattaa

SEQ ID NO: 566170 - DNA, 25 bp, Homo sapien
taaccaattaagtgacggtaactat

SEQ ID NO: 566171 - DNA, 25 bp, Homo sapien
tttgtataccttgttctttgtgatc

SEQ ID NO: 566172 - DNA, 25 bp, Homo sapien
taccttgttctttgtgatctataaa

SEQ ID NO: 566173 - DNA, 25 bp, Homo sapien
taccgttttgttgaccttgtacaca

SEQ ID NO: 566174 - DNA, 25 bp, Homo sapien
cgttttgttgaccttgtacacaaga

SEQ ID NO: 566175 - DNA, 25 bp, Homo sapien
tgaccactgagcctcaggaaggttg

SEQ ID NO: 566176 - DNA, 25 bp, Homo sapien
aggaaggttgagctccttccaccct

SEQ ID NO: 566177 - DNA, 25 bp, Homo sapien
tcaggatcagaaccctggaggcacc

SEQ ID NO: 566178 - DNA, 25 bp, Homo sapien
cgagtcagggcagtgcctcaccaag

SEQ ID NO: 566179 - DNA, 25 bp, Homo sapien
ttttcccctggatgactgtcacagc

SEQ ID NO: 566180 - DNA, 25 bp, Homo sapien
actgtcacagcctcatacctggtct

SEQ ID NO: 566181 - DNA, 25 bp, Homo sapien
ggcccatccgctacacaagagagaa

SEQ ID NO: 566182 - DNA, 25 bp, Homo sapien
gaaactaatctcctatagcaccact

SEQ ID NO: 566183 - DNA, 25 bp, Homo sapien
tcctatagcaccactttcatcttgt

SEQ ID NO: 566184 - DNA, 25 bp, Homo sapien
atcttgtctccgtcctgctcaaaaa

SEQ ID NO: 566185 - DNA, 25 bp, Homo sapien
gtgccttcaagataaagttgtgtct

SEQ ID NO: 566186 - DNA, 25 bp, Homo sapien
agaagtcgccggatggtacccgagt

SEQ ID NO: 566187 - DNA, 25 bp, Homo sapien
tcgccggatggtacccgagtcgtag

SEQ ID NO: 566188 - DNA, 25 bp, Homo sapien
gaaatgcggtggttactgtggaaaa

SEQ ID NO: 566189 - DNA, 25 bp, Homo sapien
aatgcggtggttactgtggaaaatg

SEQ ID NO: 566190 - DNA, 25 bp, Homo sapien
tggaaaatgcactccatcctctggt

SEQ ID NO: 566191 - DNA, 25 bp, Homo sapien
ggaaaatgcactccatcctctggta

SEQ ID NO: 566192 - DNA, 25 bp, Homo sapien
atcctctggtactggcctggaggtg

SEQ ID NO: 566193 - DNA, 25 bp, Homo sapien
cctggaggtgcgagttttatagcta

SEQ ID NO: 566194 - DNA, 25 bp, Homo sapien
gtgcgagttttatagctaaggtgct

SEQ ID NO: 566195 - DNA, 25 bp, Homo sapien
gagttttatagctaaggtgctttga

SEQ ID NO: 566196 - DNA, 25 bp, Homo sapien
taatgcaatacctccaccttaattt

SEQ ID NO: 566197 - DNA, 25 bp, Homo sapien
tctcagggacccaagaggaagggac

SEQ ID NO: 566198 - DNA, 25 bp, Homo sapien
aaggaagaaggtcccgggccatctg

SEQ ID NO: 566199 - DNA, 25 bp, Homo sapien
aaggtcccgggccatctgcgtcatg

SEQ ID NO: 566200 - DNA, 25 bp, Homo sapien
aggtcccgggccatctgcgtcatgg

SEQ ID NO: 566201 - DNA, 25 bp, Homo sapien
agtcccttggcgtgtgccggtgcaa

SEQ ID NO: 566202 - DNA, 25 bp, Homo sapien
cccttggcgtgtgccggtgcaaata

SEQ ID NO: 566203 - DNA, 25 bp, Homo sapien
tggcgtgtgccggtgcaaatacact

SEQ ID NO: 566204 - DNA, 25 bp, Homo sapien
gtgtgccggtgcaaatacactcctg

SEQ ID NO: 566205 - DNA, 25 bp, Homo sapien
gtgccggtgcaaatacactcctgta

SEQ ID NO: 566206 - DNA, 25 bp, Homo sapien
gccggtgcaaatacactcctgtaac

SEQ ID NO: 566207 - DNA, 25 bp, Homo sapien
ggtgcaaatacactcctgtaacggg

SEQ ID NO: 566208 - DNA, 25 bp, Homo sapien
tatggcccagtgagtcaggaaaata

SEQ ID NO: 566209 - DNA, 25 bp, Homo sapien
ataaggccaattcgcacttgagcca

SEQ ID NO: 566210 - DNA, 25 bp, Homo sapien
aattcgcacttgagccataacagga

SEQ ID NO: 566211 - DNA, 25 bp, Homo sapien
ggaaatgtcctctccataggacgta

SEQ ID NO: 566212 - DNA, 25 bp, Homo sapien
cctctccataggacgtatgccgtaa

SEQ ID NO: 566213 - DNA, 25 bp, Homo sapien
gacgtatgccgtaaatgactttgta

SEQ ID NO: 566214 - DNA, 25 bp, Homo sapien
ttacttcatccttttcgtttatata

SEQ ID NO: 566215 - DNA, 25 bp, Homo sapien
atatagggcgtacctcaagtagagg

SEQ ID NO: 566216 - DNA, 25 bp, Homo sapien
tttgagcccctattctcaggcccgt

SEQ ID NO: 566217 - DNA, 25 bp, Homo sapien
tcccacacggtggagttgactttca

SEQ ID NO: 566218 - DNA, 25 bp, Homo sapien
acggtggagttgactttcattttca

SEQ ID NO: 566219 - DNA, 25 bp, Homo sapien
actgacattgagaaaccccaccgct

SEQ ID NO: 566220 - DNA, 25 bp, Homo sapien
ctgacattgagaaaccccaccgctc

SEQ ID NO: 566221 - DNA, 25 bp, Homo sapien
tgacattgagaaaccccaccgctcc

SEQ ID NO: 566222 - DNA, 25 bp, Homo sapien
gacattgagaaaccccaccgctcct

SEQ ID NO: 566223 - DNA, 25 bp, Homo sapien
acattgagaaaccccaccgctccta

SEQ ID NO: 566224 - DNA, 25 bp, Homo sapien
cattgagaaaccccaccgctcctaa

SEQ ID NO: 566225 - DNA, 25 bp, Homo sapien
ttgaaccgaggtggtagaggttgag

SEQ ID NO: 566226 - DNA, 25 bp, Homo sapien
tgaaccgaggtggtagaggttgagg

SEQ ID NO: 566227 - DNA, 25 bp, Homo sapien
gaaccgaggtggtagaggttgaggt

SEQ ID NO: 566228 - DNA, 25 bp, Homo sapien
accgaggtggtagaggttgaggtga

SEQ ID NO: 566229 - DNA, 25 bp, Homo sapien
ccgaggtggtagaggttgaggtgag

SEQ ID NO: 566230 - DNA, 25 bp, Homo sapien
ccctcttactccatggtattcaact

SEQ ID NO: 566231 - DNA, 25 bp, Homo sapien
tactccatggtattcaacttctaaa

SEQ ID NO: 566232 - DNA, 25 bp, Homo sapien
tccatggtattcaacttctaaacta

SEQ ID NO: 566233 - DNA, 25 bp, Homo sapien
ggtattcaacttctaaactaagagg

SEQ ID NO: 566234 - DNA, 25 bp, Homo sapien
ggaaagcccgagctagaggtcctat

SEQ ID NO: 566235 - DNA, 25 bp, Homo sapien
aagcccgagctagaggtcctatgca

SEQ ID NO: 566236 - DNA, 25 bp, Homo sapien
ccgagctagaggtcctatgcatcaa

SEQ ID NO: 566237 - DNA, 25 bp, Homo sapien
gctagaggtcctatgcatcaatcag

SEQ ID NO: 566238 - DNA, 25 bp, Homo sapien
gaggtcctatgcatcaatcagggaa

SEQ ID NO: 566239 - DNA, 25 bp, Homo sapien
ggtcctatgcatcaatcagggaaga

SEQ ID NO: 566240 - DNA, 25 bp, Homo sapien
atgcatcaatcagggaagagatatt

SEQ ID NO: 566241 - DNA, 25 bp, Homo sapien
atttggaggcactgaggaaacaagg

SEQ ID NO: 566242 - DNA, 25 bp, Homo sapien
gaggcactgaggaaacaaggagctt

SEQ ID NO: 566243 - DNA, 25 bp, Homo sapien
ggcactgaggaaacaaggagcttca

SEQ ID NO: 566244 - DNA, 25 bp, Homo sapien
gcactgaggaaacaaggagcttcac

SEQ ID NO: 566245 - DNA, 25 bp, Homo sapien
actgaggaaacaaggagcttcacct

SEQ ID NO: 566246 - DNA, 25 bp, Homo sapien
gaggaaacaaggagcttcacctctc

SEQ ID NO: 566247 - DNA, 25 bp, Homo sapien
aggaaacaaggagcttcacctctcc

SEQ ID NO: 566248 - DNA, 25 bp, Homo sapien
ggaaacaaggagcttcacctctccc

SEQ ID NO: 566249 - DNA, 25 bp, Homo sapien
gaaacaaggagcttcacctctccct

SEQ ID NO: 566250 - DNA, 25 bp, Homo sapien
tcacctctccctcaaggagctcaga

SEQ ID NO: 566251 - DNA, 25 bp, Homo sapien
aggagctcagagtcgaaggaggaga

SEQ ID NO: 566252 - DNA, 25 bp, Homo sapien
tgccagcgttgctgtctgtatgccc

SEQ ID NO: 566253 - DNA, 25 bp, Homo sapien
ccagcgttgctgtctgtatgccctg

SEQ ID NO: 566254 - DNA, 25 bp, Homo sapien
gagctcaggtgggacgagggctgca

SEQ ID NO: 566255 - DNA, 25 bp, Homo sapien
agggctgcagtgaaggccgtgcctg

SEQ ID NO: 566256 - DNA, 25 bp, Homo sapien
gaaggccgtgcctggaagtgggccc

SEQ ID NO: 566257 - DNA, 25 bp, Homo sapien
ttctcctggtccttcaccttgacgc

SEQ ID NO: 566258 - DNA, 25 bp, Homo sapien
ttcaccttgacgccccgttggtggg

SEQ ID NO: 566259 - DNA, 25 bp, Homo sapien
tcccttcagctaacagcatcttgtg

SEQ ID NO: 566260 - DNA, 25 bp, Homo sapien
cttcagctaacagcatcttgtgttg

SEQ ID NO: 566261 - DNA, 25 bp, Homo sapien
cagctaacagcatcttgtgttggaa

SEQ ID NO: 566262 - DNA, 25 bp, Homo sapien
taacagcatcttgtgttggaaacgc

SEQ ID NO: 566263 - DNA, 25 bp, Homo sapien
acttatattcaggaggaggcgggcc

SEQ ID NO: 566264 - DNA, 25 bp, Homo sapien
acgctcagcatcacaaggacgcagg

SEQ ID NO: 566265 - DNA, 25 bp, Homo sapien
agcatcacaaggacgcaggcaggag

SEQ ID NO: 566266 - DNA, 25 bp, Homo sapien
gggttttggtgctgaggttttatct

SEQ ID NO: 566267 - DNA, 25 bp, Homo sapien
ggttttatctttagctcaacagatc

SEQ ID NO: 566268 - DNA, 25 bp, Homo sapien
tttagctcaacagatccagccgcaa

SEQ ID NO: 566269 - DNA, 25 bp, Homo sapien
agatccagccgcaaaatatttagct

SEQ ID NO: 566270 - DNA, 25 bp, Homo sapien
aagaagtgcctttcccagcggacgg

SEQ ID NO: 566271 - DNA, 25 bp, Homo sapien
acccgtgagcaagcggcttcacagg

SEQ ID NO: 566272 - DNA, 25 bp, Homo sapien
agcaagcggcttcacagggcatttt

SEQ ID NO: 566273 - DNA, 25 bp, Homo sapien
ctttggaataaattagcctgctagt

SEQ ID NO: 566274 - DNA, 25 bp, Homo sapien
actcagctaattgtccaatgatgca

SEQ ID NO: 566275 - DNA, 25 bp, Homo sapien
tgcatcaagagcatgaggaacttac

SEQ ID NO: 566276 - DNA, 25 bp, Homo sapien
ggaacttacagtcctctattcagaa

SEQ ID NO: 566277 - DNA, 25 bp, Homo sapien
acagtcctctattcagaactgaaga

SEQ ID NO: 566278 - DNA, 25 bp, Homo sapien
tgaagaagacacacccagacgactc

SEQ ID NO: 566279 - DNA, 25 bp, Homo sapien
gacacacccagacgactctgcaggg

SEQ ID NO: 566280 - DNA, 25 bp, Homo sapien
gaaaactatgagaatgtaccacgtg

SEQ ID NO: 566281 - DNA, 25 bp, Homo sapien
gtaccacgtgtattactggcctcag

SEQ ID NO: 566282 - DNA, 25 bp, Homo sapien
tgtattactggcctcagaccactag

SEQ ID NO: 566283 - DNA, 25 bp, Homo sapien
caggaaacagcctgcaccatttttt

SEQ ID NO: 566284 - DNA, 25 bp, Homo sapien
ctgcctcctacgaggctgggctgca

SEQ ID NO: 566285 - DNA, 25 bp, Homo sapien
gaccttgggcaagtacaatgtcaac

SEQ ID NO: 566286 - DNA, 25 bp, Homo sapien
atgactgaactcaagtcctgcagag

SEQ ID NO: 566287 - DNA, 25 bp, Homo sapien
gcctgcagccaatgcacaaggcgga

SEQ ID NO: 566288 - DNA, 25 bp, Homo sapien
acaaggcggagctggtcaagctgct

SEQ ID NO: 566289 - DNA, 25 bp, Homo sapien
cagtcaggacggtgcctaagtggac

SEQ ID NO: 566290 - DNA, 25 bp, Homo sapien
cggtgcctaagtggacctcagacat

SEQ ID NO: 566291 - DNA, 25 bp, Homo sapien
tcagccataggacctgccacacaag

SEQ ID NO: 566292 - DNA, 25 bp, Homo sapien
tgccacacaagcagccgtggacaca

SEQ ID NO: 566293 - DNA, 25 bp, Homo sapien
cctcccacatggaaatgtatcctca

SEQ ID NO: 566294 - DNA, 25 bp, Homo sapien
gaaatgtatcctcaaaccgtttaat

SEQ ID NO: 566295 - DNA, 25 bp, Homo sapien
cgtttaatcaataaagcctcttccg

SEQ ID NO: 566296 - DNA, 25 bp, Homo sapien
aatccactccaaccacattgggttt

SEQ ID NO: 566297 - DNA, 25 bp, Homo sapien
tcctggaacacactgaacacacact

SEQ ID NO: 566298 - DNA, 25 bp, Homo sapien
gaacacacactaatagcactgtgct

SEQ ID NO: 566299 - DNA, 25 bp, Homo sapien
actgtgctttcctctgtctgaaaca

SEQ ID NO: 566300 - DNA, 25 bp, Homo sapien
tgaaacactttcctcagttatccca

SEQ ID NO: 566301 - DNA, 25 bp, Homo sapien
aagccttctttcacgtccttcaggt

SEQ ID NO: 566302 - DNA, 25 bp, Homo sapien
gtccttcaggtccttactcaaatgt

SEQ ID NO: 566303 - DNA, 25 bp, Homo sapien
ggtccttactcaaatgtcacattca

SEQ ID NO: 566304 - DNA, 25 bp, Homo sapien
cacattcatagtgtagactttctga

SEQ ID NO: 566305 - DNA, 25 bp, Homo sapien
ctaaaccctcctcatacagatatgt

SEQ ID NO: 566306 - DNA, 25 bp, Homo sapien
gttatttattgacccaccaggaccg

SEQ ID NO: 566307 - DNA, 25 bp, Homo sapien
tacctctgggactctcatctcgtga

SEQ ID NO: 566308 - DNA, 25 bp, Homo sapien
ggactctcatctcgtgagtgtgctt

SEQ ID NO: 566309 - DNA, 25 bp, Homo sapien
tgtgtccaaccgtttttcctagtga

SEQ ID NO: 566310 - DNA, 25 bp, Homo sapien
gacaaagtctgggtaattctgtggg

SEQ ID NO: 566311 - DNA, 25 bp, Homo sapien
tatattggtgtatctgggaggtccc

SEQ ID NO: 566312 - DNA, 25 bp, Homo sapien
tatctgggaggtcccatgtgtctca

SEQ ID NO: 566313 - DNA, 25 bp, Homo sapien
atgtgtctcagtggtggtccctgtt

SEQ ID NO: 566314 - DNA, 25 bp, Homo sapien
gtgtctgtgaatgtccatgtgtctc

SEQ ID NO: 566315 - DNA, 25 bp, Homo sapien
aatgtccatgtgtctcactgcacag

SEQ ID NO: 566316 - DNA, 25 bp, Homo sapien
ttccagtctttgtgtgatgaaatat

SEQ ID NO: 566317 - DNA, 25 bp, Homo sapien
gcctagcaggctcagagttattaat

SEQ ID NO: 566318 - DNA, 25 bp, Homo sapien
gaaaactatgagaatgtaccacgtg

SEQ ID NO: 566319 - DNA, 25 bp, Homo sapien
aactatgagaatgtaccacgtgtat

SEQ ID NO: 566320 - DNA, 25 bp, Homo sapien
gaatgtaccacgtgtattactggcc

SEQ ID NO: 566321 - DNA, 25 bp, Homo sapien
gtaccacgtgtattactggcctcag

SEQ ID NO: 566322 - DNA, 25 bp, Homo sapien
accacgtgtattactggcctcagac

SEQ ID NO: 566323 - DNA, 25 bp, Homo sapien
acgtgtattactggcctcagaccac

SEQ ID NO: 566324 - DNA, 25 bp, Homo sapien
tgtattactggcctcagaccactag

SEQ ID NO: 566325 - DNA, 25 bp, Homo sapien
tattactggcctcagaccactagcc

SEQ ID NO: 566326 - DNA, 25 bp, Homo sapien
accactagccccttacccagagtgg

SEQ ID NO: 566327 - DNA, 25 bp, Homo sapien
caggaaacagcctgcaccatttttt

SEQ ID NO: 566328 - DNA, 25 bp, Homo sapien
ctgcctcctacgaggctgggctgca

SEQ ID NO: 566329 - DNA, 25 bp, Homo sapien
gaagtcgctgcagctagacggtgaa

SEQ ID NO: 566330 - DNA, 25 bp, Homo sapien
cggtgaatctacgtgaggagtatct

SEQ ID NO: 566331 - DNA, 25 bp, Homo sapien
aggagtatctggctgttccttgtac

SEQ ID NO: 566332 - DNA, 25 bp, Homo sapien
tgttctttcaactttctgtgggttt

SEQ ID NO: 566333 - DNA, 25 bp, Homo sapien
gtttttcaagcactgtttgagagga

SEQ ID NO: 566334 - DNA, 25 bp, Homo sapien
tattaaagagccattcagaagactg

SEQ ID NO: 566335 - DNA, 25 bp, Homo sapien
gactatgaccctcagtgccagcgat

SEQ ID NO: 566336 - DNA, 25 bp, Homo sapien
agtgccagcgatttctcctttccat

SEQ ID NO: 566337 - DNA, 25 bp, Homo sapien
tctcctttccataaacttttgtttg

SEQ ID NO: 566338 - DNA, 25 bp, Homo sapien
gaccttaaatcattgtgacaccact

SEQ ID NO: 566339 - DNA, 25 bp, Homo sapien
gtgacaccactgagcagggaatctc

SEQ ID NO: 566340 - DNA, 25 bp, Homo sapien
aaaattcatgctcatatgctattga

SEQ ID NO: 566341 - DNA, 25 bp, Homo sapien
gcatttagtgacattgcagctacct

SEQ ID NO: 566342 - DNA, 25 bp, Homo sapien
gtgacattgcagctaccttatttga

SEQ ID NO: 566343 - DNA, 25 bp, Homo sapien
tatatcaccctctaagtatggcatg

SEQ ID NO: 566344 - DNA, 25 bp, Homo sapien
aagtatggcatgctcctcttacaaa

SEQ ID NO: 566345 - DNA, 25 bp, Homo sapien
gcatgctcctcttacaaacagttaa

SEQ ID NO: 566346 - DNA, 25 bp, Homo sapien
taagcttcagagcagtagtgcagga

SEQ ID NO: 566347 - DNA, 25 bp, Homo sapien
aaagtacagtttcttacctgatact

SEQ ID NO: 566348 - DNA, 25 bp, Homo sapien
tcttacctgatactggaatccctgc

SEQ ID NO: 566349 - DNA, 25 bp, Homo sapien
tactggaatccctgctataatatag

SEQ ID NO: 566350 - DNA, 25 bp, Homo sapien
gctagtcattgccaagctacacttg

SEQ ID NO: 566351 - DNA, 25 bp, Homo sapien
cagctagaaagacccttgcaaacat

SEQ ID NO: 566352 - DNA, 25 bp, Homo sapien
agaaagacccttgcaaacatcctgt

SEQ ID NO: 566353 - DNA, 25 bp, Homo sapien
aggcctcagcgtgggaaacatgttc

SEQ ID NO: 566354 - DNA, 25 bp, Homo sapien
cctcagcgtgggaaacatgttctat

SEQ ID NO: 566355 - DNA, 25 bp, Homo sapien
aaacatgttctatgtcttctccgac

SEQ ID NO: 566356 - DNA, 25 bp, Homo sapien
aacatgttctatgtcttctccgacg

SEQ ID NO: 566357 - DNA, 25 bp, Homo sapien
gtatcatcgtcatccatcctgtgga

SEQ ID NO: 566358 - DNA, 25 bp, Homo sapien
gtcatccatcctgtggactgtgaga

SEQ ID NO: 566359 - DNA, 25 bp, Homo sapien
catcctgtggactgtgagatccaga

SEQ ID NO: 566360 - DNA, 25 bp, Homo sapien
tgtgagatccagaggcacctcaaac

SEQ ID NO: 566361 - DNA, 25 bp, Homo sapien
gaggcacctcaaacccacggaaaag

SEQ ID NO: 566362 - DNA, 25 bp, Homo sapien
cactgccccagtaatgcaggctaaa

SEQ ID NO: 566363 - DNA, 25 bp, Homo sapien
atattaagcttattacccccacaga

SEQ ID NO: 566364 - DNA, 25 bp, Homo sapien
ctgccaactgaacattgtgccagat

SEQ ID NO: 566365 - DNA, 25 bp, Homo sapien
ttgtgccagataccaagaattgagg

SEQ ID NO: 566366 - DNA, 25 bp, Homo sapien
gaattgaggcgattatgccctgcat

SEQ ID NO: 566367 - DNA, 25 bp, Homo sapien
tatgccctgcatgctgcttggtata

SEQ ID NO: 566368 - DNA, 25 bp, Homo sapien
gcatgctgcttggtatactgaagat

SEQ ID NO: 566369 - DNA, 25 bp, Homo sapien
ctgaagatgggcgttcttttacttt

SEQ ID NO: 566370 - DNA, 25 bp, Homo sapien
ctgtatgttcaggagccattttctc

SEQ ID NO: 566371 - DNA, 25 bp, Homo sapien
aggagccattttctccagagattcc

SEQ ID NO: 566372 - DNA, 25 bp, Homo sapien
tctccagagattccaacaataatac

SEQ ID NO: 566373 - DNA, 25 bp, Homo sapien
tgcccagggcagaaaaccacttaaa

SEQ ID NO: 566374 - DNA, 25 bp, Homo sapien
gggcagaaaaccacttaaaggcatt

SEQ ID NO: 566375 - DNA, 25 bp, Homo sapien
cagaaaaccacttaaaggcattctt

SEQ ID NO: 566376 - DNA, 25 bp, Homo sapien
ggcattcttaaaccacaaacagtag

SEQ ID NO: 566377 - DNA, 25 bp, Homo sapien
gcattcttaaaccacaaacagtagc

SEQ ID NO: 566378 - DNA, 25 bp, Homo sapien
attcttaaaccacaaacagtagcat

SEQ ID NO: 566379 - DNA, 25 bp, Homo sapien
aaccacaaacagtagcatgagcgat

SEQ ID NO: 566380 - DNA, 25 bp, Homo sapien
aaacagtagcatgagcgatctgtgc

SEQ ID NO: 566381 - DNA, 25 bp, Homo sapien
gacccacccctttatttcaggccat

SEQ ID NO: 566382 - DNA, 25 bp, Homo sapien
ctttatttcaggccatcccttcatt

SEQ ID NO: 566383 - DNA, 25 bp, Homo sapien
ttatttcaggccatcccttcatttc

SEQ ID NO: 566384 - DNA, 25 bp, Homo sapien
agtagcatgaaatccaaatctaaaa

SEQ ID NO: 566385 - DNA, 25 bp, Homo sapien
atccaaatctaaaatcattgtctcc

SEQ ID NO: 566386 - DNA, 25 bp, Homo sapien
aatcattgtctccatgcttcattga

SEQ ID NO: 566387 - DNA, 25 bp, Homo sapien
tcattgtctccatgcttcattgaag

SEQ ID NO: 566388 - DNA, 25 bp, Homo sapien
attgtctccatgcttcattgaagaa

SEQ ID NO: 566389 - DNA, 25 bp, Homo sapien
gtctccatgcttcattgaagaaaat

SEQ ID NO: 566390 - DNA, 25 bp, Homo sapien
gaacgtgaaaaaatccaatagcagc

SEQ ID NO: 566391 - DNA, 25 bp, Homo sapien
aatccaatagcagctgcaaaccatt

SEQ ID NO: 566392 - DNA, 25 bp, Homo sapien
tagcagctgcaaaccatttaagaat

SEQ ID NO: 566393 - DNA, 25 bp, Homo sapien
gctgcaaaccatttaagaattccta

SEQ ID NO: 566394 - DNA, 25 bp, Homo sapien
agaattcctagttaaactgcaaaat

SEQ ID NO: 566395 - DNA, 25 bp, Homo sapien
gggaactgtgagcttcctctctgac

SEQ ID NO: 566396 - DNA, 25 bp, Homo sapien
gaaggaacagatgcctctaacccct

SEQ ID NO: 566397 - DNA, 25 bp, Homo sapien
aacccctccaaggtttgatcatgat

SEQ ID NO: 566398 - DNA, 25 bp, Homo sapien
gggaccagtgctcaagactcttgga

SEQ ID NO: 566399 - DNA, 25 bp, Homo sapien
agtcatttggatgtcacagccttat

SEQ ID NO: 566400 - DNA, 25 bp, Homo sapien
aatcttgctcttgtcccttgcagca

SEQ ID NO: 566401 - DNA, 25 bp, Homo sapien
agagtcctcgtgcagataacagtgt

SEQ ID NO: 566402 - DNA, 25 bp, Homo sapien
ataacagtgtccctggaacaccaac

SEQ ID NO: 566403 - DNA, 25 bp, Homo sapien
caggaaaatctctgcctctgaattt

SEQ ID NO: 566404 - DNA, 25 bp, Homo sapien
ctctgaatttgaccggcctcttaga

SEQ ID NO: 566405 - DNA, 25 bp, Homo sapien
cggcctcttagacccattgttgtca

SEQ ID NO: 566406 - DNA, 25 bp, Homo sapien
ctttgctctctactggctgagcaaa

SEQ ID NO: 566407 - DNA, 25 bp, Homo sapien
agctcagttgttctgttgcaaggcg

SEQ ID NO: 566408 - DNA, 25 bp, Homo sapien
cagttgttctgttgcaaggcggagc

SEQ ID NO: 566409 - DNA, 25 bp, Homo sapien
gtcccgggcactgggagcatacaga

SEQ ID NO: 566410 - DNA, 25 bp, Homo sapien
actgggagcatacagatgtctgaaa

SEQ ID NO: 566411 - DNA, 25 bp, Homo sapien
gtctgaaattagtgtgacctcgttc

SEQ ID NO: 566412 - DNA, 25 bp, Homo sapien
tgacctcgttcactgggtgtagtgt

SEQ ID NO: 566413 - DNA, 25 bp, Homo sapien
ggcagaggacagattctagcttttc

SEQ ID NO: 566414 - DNA, 25 bp, Homo sapien
ggacagattctagcttttcaaggaa

SEQ ID NO: 566415 - DNA, 25 bp, Homo sapien
tcccagcgtgtgtatccgactctaa

SEQ ID NO: 566416 - DNA, 25 bp, Homo sapien
gtatccgactctaagctgtgtgcag

SEQ ID NO: 566417 - DNA, 25 bp, Homo sapien
ccttggccaacgagatctctgacaa

SEQ ID NO: 566418 - DNA, 25 bp, Homo sapien
ggccaacgagatctctgacaatgac

SEQ ID NO: 566419 - DNA, 25 bp, Homo sapien
tctgacaatgacatcctggaagccc

SEQ ID NO: 566420 - DNA, 25 bp, Homo sapien
tggaagccctgcagagaattatctc

SEQ ID NO: 566421 - DNA, 25 bp, Homo sapien
atctcagagagaagcgactactata

SEQ ID NO: 566422 - DNA, 25 bp, Homo sapien
gcgactactataatcagctgaagca

SEQ ID NO: 566423 - DNA, 25 bp, Homo sapien
aagcagaaaggcgtcaaagtgcccc

SEQ ID NO: 566424 - DNA, 25 bp, Homo sapien
ccccaaatacggtcagcccagcaga

SEQ ID NO: 566425 - DNA, 25 bp, Homo sapien
atgcgtcctgctctcagactcagaa

SEQ ID NO: 566426 - DNA, 25 bp, Homo sapien
gtcctgctctcagactcagaattaa

SEQ ID NO: 566427 - DNA, 25 bp, Homo sapien
gactcagaattaaaccccggtgttg

SEQ ID NO: 566428 - DNA, 25 bp, Homo sapien
gtagagtaagtaaaacttctctgaa

SEQ ID NO: 566429 - DNA, 25 bp, Homo sapien
gaaagctgaacttatttatagaagg

SEQ ID NO: 566430 - DNA, 25 bp, Homo sapien
tatagaagggagtctggatatcaga

SEQ ID NO: 566431 - DNA, 25 bp, Homo sapien
tctggatatcagactaacagcctat

SEQ ID NO: 566432 - DNA, 25 bp, Homo sapien
tatcagactaacagcctatggaaga

SEQ ID NO: 566433 - DNA, 25 bp, Homo sapien
aagttgttcaagaactacccttgca

SEQ ID NO: 566434 - DNA, 25 bp, Homo sapien
aagaactacccttgcaaaagatgca

SEQ ID NO: 566435 - DNA, 25 bp, Homo sapien
tacccttgcaaaagatgcaacatgc

SEQ ID NO: 566436 - DNA, 25 bp, Homo sapien
atgcagataactacaattaggttct

SEQ ID NO: 566437 - DNA, 25 bp, Homo sapien
ctacaattaggttctaagaggtctt

SEQ ID NO: 566438 - DNA, 25 bp, Homo sapien
aaaatgattcctattttgttcagac

SEQ ID NO: 566439 - DNA, 25 bp, Homo sapien
tactccatggtattcaacttctaaa

SEQ ID NO: 566440 - DNA, 25 bp, Homo sapien
ggaaagcccgagctagaggtcctat

SEQ ID NO: 566441 - DNA, 25 bp, Homo sapien
gaggtcctatgcatcaatcagggaa

SEQ ID NO: 566442 - DNA, 25 bp, Homo sapien
gtattttttctctcaactaaaacat

SEQ ID NO: 566443 - DNA, 25 bp, Homo sapien
ttttttctctcaactaaaacatcca

SEQ ID NO: 566444 - DNA, 25 bp, Homo sapien
tttggcaagaaaatatatacctgtt

SEQ ID NO: 566445 - DNA, 25 bp, Homo sapien
aatatatacctgtttcatcttcact

SEQ ID NO: 566446 - DNA, 25 bp, Homo sapien
atacctgtttcatcttcactggtta

SEQ ID NO: 566447 - DNA, 25 bp, Homo sapien
ttcactggttatttccataaactgg

SEQ ID NO: 566448 - DNA, 25 bp, Homo sapien
ccataaactggaaagaaggactgtc

SEQ ID NO: 566449 - DNA, 25 bp, Homo sapien
ccatgagatgtttaagcaaaaggga

SEQ ID NO: 566450 - DNA, 25 bp, Homo sapien
aggacaaggagcctttcactttctc

SEQ ID NO: 566451 - DNA, 25 bp, Homo sapien
aaggagcctttcactttctccagcc

SEQ ID NO: 566452 - DNA, 25 bp, Homo sapien
tgccagtggcaggtctattcgttct

SEQ ID NO: 566453 - DNA, 25 bp, Homo sapien
agtggcaggtctattcgttctcctt

SEQ ID NO: 566454 - DNA, 25 bp, Homo sapien
tggcaggtctattcgttctccttcc

SEQ ID NO: 566455 - DNA, 25 bp, Homo sapien
tctccttccctttcagactgagaag

SEQ ID NO: 566456 - DNA, 25 bp, Homo sapien
aaaagacctttcctttcatgtccag

SEQ ID NO: 566457 - DNA, 25 bp, Homo sapien
gacctttcctttcatgtccagaaga

SEQ ID NO: 566458 - DNA, 25 bp, Homo sapien
ttcctttcatgtccagaagaatgta

SEQ ID NO: 566459 - DNA, 25 bp, Homo sapien
gaaaggattcgcctctcctacagaa

SEQ ID NO: 566460 - DNA, 25 bp, Homo sapien
aggattcgcctctcctacagaaatt

SEQ ID NO: 566461 - DNA, 25 bp, Homo sapien
gggcagtgacccaaattgagcagtg

SEQ ID NO: 566462 - DNA, 25 bp, Homo sapien
ttgagcagtggaactagttatcagt

SEQ ID NO: 566463 - DNA, 25 bp, Homo sapien
agttgactgaattatctgttgaatc

SEQ ID NO: 566464 - DNA, 25 bp, Homo sapien
ctgttgaatcagtgaagtcctaaac

SEQ ID NO: 566465 - DNA, 25 bp, Homo sapien
aaagaaatagactgtatgattcctt

SEQ ID NO: 566466 - DNA, 25 bp, Homo sapien
gattcctttttagacctcagtttgg

SEQ ID NO: 566467 - DNA, 25 bp, Homo sapien
aaatttgcgtctcagtaatccctac

SEQ ID NO: 566468 - DNA, 25 bp, Homo sapien
tcagtaatccctaccgcctgggtga

SEQ ID NO: 566469 - DNA, 25 bp, Homo sapien
taccgcctgggtgataccggatgaa

SEQ ID NO: 566470 - DNA, 25 bp, Homo sapien
ccggatgaaatggtggttcttgctt

SEQ ID NO: 566471 - DNA, 25 bp, Homo sapien
gaaatggtggttcttgcttatgtga

SEQ ID NO: 566472 - DNA, 25 bp, Homo sapien
agtctcccctcctgctgttctgaat

SEQ ID NO: 566473 - DNA, 25 bp, Homo sapien
gtctcccctcctgctgttctgaatg

SEQ ID NO: 566474 - DNA, 25 bp, Homo sapien
tcccctcctgctgttctgaatgctc

SEQ ID NO: 566475 - DNA, 25 bp, Homo sapien
cccctcctgctgttctgaatgctct

SEQ ID NO: 566476 - DNA, 25 bp, Homo sapien
ctcctgctgttctgaatgctctaag

SEQ ID NO: 566477 - DNA, 25 bp, Homo sapien
tcctgctgttctgaatgctctaagt

SEQ ID NO: 566478 - DNA, 25 bp, Homo sapien
ctaaattcatccaaggtagttcaat

SEQ ID NO: 566479 - DNA, 25 bp, Homo sapien
taaattcatccaaggtagttcaatt

SEQ ID NO: 566480 - DNA, 25 bp, Homo sapien
aaattcatccaaggtagttcaatta

SEQ ID NO: 566481 - DNA, 25 bp, Homo sapien
aattcatccaaggtagttcaattaa

SEQ ID NO: 566482 - DNA, 25 bp, Homo sapien
attcatccaaggtagttcaattaaa

SEQ ID NO: 566483 - DNA, 25 bp, Homo sapien
atgtggatgtactgaaccctatgcc

SEQ ID NO: 566484 - DNA, 25 bp, Homo sapien
gaaccctatgccagcatgtttttat

SEQ ID NO: 566485 - DNA, 25 bp, Homo sapien
tgtcccggaaagaggcaactgagat

SEQ ID NO: 566486 - DNA, 25 bp, Homo sapien
gatgctccagaagaacccttctttg

SEQ ID NO: 566487 - DNA, 25 bp, Homo sapien
gaacccttctttgggaaatatgatc

SEQ ID NO: 566488 - DNA, 25 bp, Homo sapien
gatcctgaggcctggtagtgacagt

SEQ ID NO: 566489 - DNA, 25 bp, Homo sapien
aaactactccatcactattcggcag

SEQ ID NO: 566490 - DNA, 25 bp, Homo sapien
attcggcaggagatagacattccaa

SEQ ID NO: 566491 - DNA, 25 bp, Homo sapien
acattccaagaatcaagcactacaa

SEQ ID NO: 566492 - DNA, 25 bp, Homo sapien
gacaaaactacactattgaactgga

SEQ ID NO: 566493 - DNA, 25 bp, Homo sapien
cccaaaccttttcagtgtcattgat

SEQ ID NO: 566494 - DNA, 25 bp, Homo sapien
tatagttttacctcctgaatccaca

SEQ ID NO: 566495 - DNA, 25 bp, Homo sapien
tttacctcctgaatccacatttaca

SEQ ID NO: 566496 - DNA, 25 bp, Homo sapien
catttacaggtataggtgcatatca

SEQ ID NO: 566497 - DNA, 25 bp, Homo sapien
tcaaaatcattgcttcattgtatcc

SEQ ID NO: 566498 - DNA, 25 bp, Homo sapien
attgtatcccaacagcagcttattt

SEQ ID NO: 566499 - DNA, 25 bp, Homo sapien
ggaggagaagcaactaaggtcatat

SEQ ID NO: 566500 - DNA, 25 bp, Homo sapien
gaaatactcaaaacttctgttgaat

SEQ ID NO: 566501 - DNA, 25 bp, Homo sapien
ataaatggtagttggctgtcttgaa

SEQ ID NO: 566502 - DNA, 25 bp, Homo sapien
ttggctgtcttgaaaggcaacaacc

SEQ ID NO: 566503 - DNA, 25 bp, Homo sapien
acaaccagctgactgcaggatggca

SEQ ID NO: 566504 - DNA, 25 bp, Homo sapien
ggatggcaggcttcctattatttat

SEQ ID NO: 566505 - DNA, 25 bp, Homo sapien
gggtggtgacgctcaagttcgtcaa

SEQ ID NO: 566506 - DNA, 25 bp, Homo sapien
gtggtgacgctcaagttcgtcaaga

SEQ ID NO: 566507 - DNA, 25 bp, Homo sapien
tggtgacgctcaagttcgtcaagaa

SEQ ID NO: 566508 - DNA, 25 bp, Homo sapien
ggtgacgctcaagttcgtcaagaaa

SEQ ID NO: 566509 - DNA, 25 bp, Homo sapien
gtgacgctcaagttcgtcaagaaag

SEQ ID NO: 566510 - DNA, 25 bp, Homo sapien
gacgctcaagttcgtcaagaaaggt

SEQ ID NO: 566511 - DNA, 25 bp, Homo sapien
cgctcaagttcgtcaagaaaggtaa

SEQ ID NO: 566512 - DNA, 25 bp, Homo sapien
caagttcgtcaagaaaggtaagcac

SEQ ID NO: 566513 - DNA, 25 bp, Homo sapien
gttcgtcaagaaaggtaagcacgtc

SEQ ID NO: 566514 - DNA, 25 bp, Homo sapien
tcgtcaagaaaggtaagcacgtctt

SEQ ID NO: 566515 - DNA, 25 bp, Homo sapien
cgtcaagaaaggtaagcacgtcttt

SEQ ID NO: 566516 - DNA, 25 bp, Homo sapien
tttttaaaaaagtgggccaggcatg

SEQ ID NO: 566517 - DNA, 25 bp, Homo sapien
ttttaaaaaagtgggccaggcatgg

SEQ ID NO: 566518 - DNA, 25 bp, Homo sapien
gcagatcacttaggctaggaattca

SEQ ID NO: 566519 - DNA, 25 bp, Homo sapien
cagatcacttaggctaggaattcaa

SEQ ID NO: 566520 - DNA, 25 bp, Homo sapien
atcacttaggctaggaattcaagac

SEQ ID NO: 566521 - DNA, 25 bp, Homo sapien
tcacttaggctaggaattcaagacc

SEQ ID NO: 566522 - DNA, 25 bp, Homo sapien
cacttaggctaggaattcaagacca

SEQ ID NO: 566523 - DNA, 25 bp, Homo sapien
tggtgttgtgcacctataattccag

SEQ ID NO: 566524 - DNA, 25 bp, Homo sapien
ggtgttgtgcacctataattccagc

SEQ ID NO: 566525 - DNA, 25 bp, Homo sapien
gtgttgtgcacctataattccagct

SEQ ID NO: 566526 - DNA, 25 bp, Homo sapien
tgttgtgcacctataattccagcta

SEQ ID NO: 566527 - DNA, 25 bp, Homo sapien
tcaggaacagcgcaccagcagaaac

SEQ ID NO: 566528 - DNA, 25 bp, Homo sapien
acagcgcaccagcagaaacggaaac

SEQ ID NO: 566529 - DNA, 25 bp, Homo sapien
aaacggaaactgtagcaagctgctc

SEQ ID NO: 566530 - DNA, 25 bp, Homo sapien
aactgtagcaagctgctccttgaac

SEQ ID NO: 566531 - DNA, 25 bp, Homo sapien
gctgctccttgaactgcgtcataaa

SEQ ID NO: 566532 - DNA, 25 bp, Homo sapien
gctccttgaactgcgtcataaagag

SEQ ID NO: 566533 - DNA, 25 bp, Homo sapien
aactgcgtcataaagagatttgtct

SEQ ID NO: 566534 - DNA, 25 bp, Homo sapien
gatttgtctttatcagtcattcgtg

SEQ ID NO: 566535 - DNA, 25 bp, Homo sapien
gtctttatcagtcattcgtggctat

SEQ ID NO: 566536 - DNA, 25 bp, Homo sapien
atcagtcattcgtggctattcatat

SEQ ID NO: 566537 - DNA, 25 bp, Homo sapien
tcattcgtggctattcatatattca

SEQ ID NO: 566538 - DNA, 25 bp, Homo sapien
attggaatcggaaccttgctgtctc

SEQ ID NO: 566539 - DNA, 25 bp, Homo sapien
ccttgctgtctcactgtggttgaaa

SEQ ID NO: 566540 - DNA, 25 bp, Homo sapien
ctctggttatgaagctcctcggatc

SEQ ID NO: 566541 - DNA, 25 bp, Homo sapien
aagctcctcggatcccagtgaataa

SEQ ID NO: 566542 - DNA, 25 bp, Homo sapien
taaaagaatcttcaccaccacacac

SEQ ID NO: 566543 - DNA, 25 bp, Homo sapien
ccagggtgtgtttttcttgaagtag

SEQ ID NO: 566544 - DNA, 25 bp, Homo sapien
tgcctttgctgggttacctacctca

SEQ ID NO: 566545 - DNA, 25 bp, Homo sapien
ctcaggacctgattggaacatcgat

SEQ ID NO: 566546 - DNA, 25 bp, Homo sapien
gaacatcgatcctaagctacctgca

SEQ ID NO: 566547 - DNA, 25 bp, Homo sapien
gatcatcccctatctgattcatgta

SEQ ID NO: 566548 - DNA, 25 bp, Homo sapien
atctgattcatgtacatcaccctgc

SEQ ID NO: 566549 - DNA, 25 bp, Homo sapien
tgcactatgagcagggcgaactcac

SEQ ID NO: 566550 - DNA, 25 bp, Homo sapien
tatgagcagggcgaactcaccttct

SEQ ID NO: 566551 - DNA, 25 bp, Homo sapien
atgagcagggcgaactcaccttctt

SEQ ID NO: 566552 - DNA, 25 bp, Homo sapien
agcagggcgaactcaccttcttcga

SEQ ID NO: 566553 - DNA, 25 bp, Homo sapien
tcttcgatgccgaccgccccgatga

SEQ ID NO: 566554 - DNA, 25 bp, Homo sapien
tccaggccgacttccagggcaagct

SEQ ID NO: 566555 - DNA, 25 bp, Homo sapien
aggccgacttccagggcaagctcta

SEQ ID NO: 566556 - DNA, 25 bp, Homo sapien
agggcaagctctaccccatcctgga

SEQ ID NO: 566557 - DNA, 25 bp, Homo sapien
ctggacacctgctggcacgagaggg

SEQ ID NO: 566558 - DNA, 25 bp, Homo sapien
gcagcaactcgctgcccatggtgct

SEQ ID NO: 566559 - DNA, 25 bp, Homo sapien
gcttctgctgggtcccgcctgaggt

SEQ ID NO: 566560 - DNA, 25 bp, Homo sapien
agttcagaggtacaagtgcagtaaa

SEQ ID NO: 566561 - DNA, 25 bp, Homo sapien
gaggtacaagtgcagtaaagcttta

SEQ ID NO: 566562 - DNA, 25 bp, Homo sapien
gaaatagttcacaagtcaaccaggg

SEQ ID NO: 566563 - DNA, 25 bp, Homo sapien
gtcaaccagggatacttatgtcata

SEQ ID NO: 566564 - DNA, 25 bp, Homo sapien
cttatgtcatacttgggaaaccagg

SEQ ID NO: 566565 - DNA, 25 bp, Homo sapien
gcccaggaggtctgagaattgcatg

SEQ ID NO: 566566 - DNA, 25 bp, Homo sapien
gaattgcatgttaccttcagaggaa

SEQ ID NO: 566567 - DNA, 25 bp, Homo sapien
aaatctaacagcagatctctcgtgt

SEQ ID NO: 566568 - DNA, 25 bp, Homo sapien
acagcagatctctcgtgtgttgaaa

SEQ ID NO: 566569 - DNA, 25 bp, Homo sapien
gatctctcgtgtgttgaaaattctc

SEQ ID NO: 566570 - DNA, 25 bp, Homo sapien
aaattctcagattgttttgtgtaaa

SEQ ID NO: 566571 - DNA, 25 bp, Homo sapien
gagactagaatttgcaactttgact

SEQ ID NO: 566572 - DNA, 25 bp, Homo sapien
atttgcaactttgacttccattcag

SEQ ID NO: 566573 - DNA, 25 bp, Homo sapien
tgcaactttgacttccattcagttt

SEQ ID NO: 566574 - DNA, 25 bp, Homo sapien
aatctctaacgtaattttgcgtaca

SEQ ID NO: 566575 - DNA, 25 bp, Homo sapien
taacgtaattttgcgtacaactttg

SEQ ID NO: 566576 - DNA, 25 bp, Homo sapien
tttgcgtacaactttgtttttatgt

SEQ ID NO: 566577 - DNA, 25 bp, Homo sapien
gtttttatgtttctgtgctgtattt

SEQ ID NO: 566578 - DNA, 25 bp, Homo sapien
atgtttctgtgctgtattttggtta

SEQ ID NO: 566579 - DNA, 25 bp, Homo sapien
ttctgtgctgtattttggttatatg

SEQ ID NO: 566580 - DNA, 25 bp, Homo sapien
aaatgtgtgctttaccttcaaagta

SEQ ID NO: 566581 - DNA, 25 bp, Homo sapien
taaaagactaaatttcaaggaactg

SEQ ID NO: 566582 - DNA, 25 bp, Homo sapien
aagtctttctcatttcccaactcac

SEQ ID NO: 566583 - DNA, 25 bp, Homo sapien
tcatttcccaactcactgtcaaggt

SEQ ID NO: 566584 - DNA, 25 bp, Homo sapien
tttcccaactcactgtcaaggtcta

SEQ ID NO: 566585 - DNA, 25 bp, Homo sapien
cccaactcactgtcaaggtctacag

SEQ ID NO: 566586 - DNA, 25 bp, Homo sapien
ctcactgtcaaggtctacagagtct

SEQ ID NO: 566587 - DNA, 25 bp, Homo sapien
actgtcaaggtctacagagtctgag

SEQ ID NO: 566588 - DNA, 25 bp, Homo sapien
gagtctgagatttgatactacttgc

SEQ ID NO: 566589 - DNA, 25 bp, Homo sapien
ctgagatttgatactacttgcagac

SEQ ID NO: 566590 - DNA, 25 bp, Homo sapien
cagactaacaagtttgcctgccact

SEQ ID NO: 566591 - DNA, 25 bp, Homo sapien
gactaacaagtttgcctgccactgt

SEQ ID NO: 566592 - DNA, 25 bp, Homo sapien
aacaagtttgcctgccactgttttg

SEQ ID NO: 566593 - DNA, 25 bp, Homo sapien
gaacccacctcctttgaagatacag

SEQ ID NO: 566594 - DNA, 25 bp, Homo sapien
tcatccagaaagttctcctgtgctt

SEQ ID NO: 566595 - DNA, 25 bp, Homo sapien
tcctgtgctttcatgctgtcccgca

SEQ ID NO: 566596 - DNA, 25 bp, Homo sapien
gaacatgctgaggacattggtactg

SEQ ID NO: 566597 - DNA, 25 bp, Homo sapien
acattggtactggattctggccgcc

SEQ ID NO: 566598 - DNA, 25 bp, Homo sapien
tggccgccccaaaagagccgctttg

SEQ ID NO: 566599 - DNA, 25 bp, Homo sapien
aaagagccgctttgaccaggcttac

SEQ ID NO: 566600 - DNA, 25 bp, Homo sapien
tgaccaggcttacccagcactaaat

SEQ ID NO: 566601 - DNA, 25 bp, Homo sapien
ctgctctctcaaaatttccatcttt

SEQ ID NO: 566602 - DNA, 25 bp, Homo sapien
tggttgtacctataaccctccctca

SEQ ID NO: 566603 - DNA, 25 bp, Homo sapien
aaccctccctcatcaagtcaataga

SEQ ID NO: 566604 - DNA, 25 bp, Homo sapien
aaatctggcctcacgtaagagttgc

SEQ ID NO: 566605 - DNA, 25 bp, Homo sapien
aatctggcctcacgtaagagttgct

SEQ ID NO: 566606 - DNA, 25 bp, Homo sapien
atctggcctcacgtaagagttgctt

SEQ ID NO: 566607 - DNA, 25 bp, Homo sapien
tctggcctcacgtaagagttgcttg

SEQ ID NO: 566608 - DNA, 25 bp, Homo sapien
ctggcctcacgtaagagttgcttgg

SEQ ID NO: 566609 - DNA, 25 bp, Homo sapien
tggcctcacgtaagagttgcttggg

SEQ ID NO: 566610 - DNA, 25 bp, Homo sapien
ctcacgtaagagttgcttggggaac

SEQ ID NO: 566611 - DNA, 25 bp, Homo sapien
cttggggaacttctctaaaatacag

SEQ ID NO: 566612 - DNA, 25 bp, Homo sapien
ttttgattcagtagatttcagccac

SEQ ID NO: 566613 - DNA, 25 bp, Homo sapien
tttgattcagtagatttcagccact

SEQ ID NO: 566614 - DNA, 25 bp, Homo sapien
ttgattcagtagatttcagccactt

SEQ ID NO: 566615 - DNA, 25 bp, Homo sapien
agatataaaaatcccactccctcag

SEQ ID NO: 566616 - DNA, 25 bp, Homo sapien
tcagcctcaattccagtgtgctaag

SEQ ID NO: 566617 - DNA, 25 bp, Homo sapien
attccagtgtgctaagagtgatcct

SEQ ID NO: 566618 - DNA, 25 bp, Homo sapien
gatcctggtggttaaaggtacaaca

SEQ ID NO: 566619 - DNA, 25 bp, Homo sapien
aggtacaacactcgaatctttcaaa

SEQ ID NO: 566620 - DNA, 25 bp, Homo sapien
aaacaacttggctcctaaacacaag

SEQ ID NO: 566621 - DNA, 25 bp, Homo sapien
acaagccaacaatctcatctgctgc

SEQ ID NO: 566622 - DNA, 25 bp, Homo sapien
aatctcatctgctgctcaactgaaa

SEQ ID NO: 566623 - DNA, 25 bp, Homo sapien
aaacattctccactttttagcatcc

SEQ ID NO: 566624 - DNA, 25 bp, Homo sapien
tccactttttagcatccaggcatgt

SEQ ID NO: 566625 - DNA, 25 bp, Homo sapien
gcatccaggcatgtggagttcctaa

SEQ ID NO: 566626 - DNA, 25 bp, Homo sapien
catccctagcctcggataatgcaga

SEQ ID NO: 566627 - DNA, 25 bp, Homo sapien
ccctagcctcggataatgcagaatc

SEQ ID NO: 566628 - DNA, 25 bp, Homo sapien
tagcctcggataatgcagaatcact

SEQ ID NO: 566629 - DNA, 25 bp, Homo sapien
gcctcggataatgcagaatcactcc

SEQ ID NO: 566630 - DNA, 25 bp, Homo sapien
tcggataatgcagaatcactccttt

SEQ ID NO: 566631 - DNA, 25 bp, Homo sapien
agaatcactcctttgttgttttatg

SEQ ID NO: 566632 - DNA, 25 bp, Homo sapien
aatcactcctttgttgttttatggg

SEQ ID NO: 566633 - DNA, 25 bp, Homo sapien
gtcttccctggcatggatgaaaata

SEQ ID NO: 566634 - DNA, 25 bp, Homo sapien
ttccctggcatggatgaaaataagc

SEQ ID NO: 566635 - DNA, 25 bp, Homo sapien
ggatgaaaataagcccccttctcac

SEQ ID NO: 566636 - DNA, 25 bp, Homo sapien
ttcttttacccatccacactggcct

SEQ ID NO: 566637 - DNA, 25 bp, Homo sapien
gaattcaggaggtatgaaaccctat

SEQ ID NO: 566638 - DNA, 25 bp, Homo sapien
gtatgaaaccctattttaccatgtt

SEQ ID NO: 566639 - DNA, 25 bp, Homo sapien
ttaccatgttagaaaacagcccagg

SEQ ID NO: 566640 - DNA, 25 bp, Homo sapien
aaacagcccaggattttctcattgc

SEQ ID NO: 566641 - DNA, 25 bp, Homo sapien
ttttctcattgctctgccatcatat

SEQ ID NO: 566642 - DNA, 25 bp, Homo sapien
tctcattgctctgccatcatatatg

SEQ ID NO: 566643 - DNA, 25 bp, Homo sapien
tgctctgccatcatatatgtctatg

SEQ ID NO: 566644 - DNA, 25 bp, Homo sapien
tatgtctatgacttgagcccttatt

SEQ ID NO: 566645 - DNA, 25 bp, Homo sapien
gtctatgacttgagcccttattttt

SEQ ID NO: 566646 - DNA, 25 bp, Homo sapien
tgacttgagcccttatttttccatc

SEQ ID NO: 566647 - DNA, 25 bp, Homo sapien
tgagcccttatttttccatctgcaa

SEQ ID NO: 566648 - DNA, 25 bp, Homo sapien
acggctatcttggactcaactccca

SEQ ID NO: 566649 - DNA, 25 bp, Homo sapien
cagagagctcagagatgtgtcttcc

SEQ ID NO: 566650 - DNA, 25 bp, Homo sapien
gagagctcagagatgtgtcttccaa

SEQ ID NO: 566651 - DNA, 25 bp, Homo sapien
agagctcagagatgtgtcttccaaa

SEQ ID NO: 566652 - DNA, 25 bp, Homo sapien
gagctcagagatgtgtcttccaaag

SEQ ID NO: 566653 - DNA, 25 bp, Homo sapien
agctcagagatgtgtcttccaaagg

SEQ ID NO: 566654 - DNA, 25 bp, Homo sapien
ctcagagatgtgtcttccaaaggaa

SEQ ID NO: 566655 - DNA, 25 bp, Homo sapien
cagagatgtgtcttccaaaggaaaa

SEQ ID NO: 566656 - DNA, 25 bp, Homo sapien
gagatgtgtcttccaaaggaaaaaa

SEQ ID NO: 566657 - DNA, 25 bp, Homo sapien
aacactgattggaataaaactttag

SEQ ID NO: 566658 - DNA, 25 bp, Homo sapien
ctgattggaataaaactttagtctt

SEQ ID NO: 566659 - DNA, 25 bp, Homo sapien
aagaccaagaagctggttttatcca

SEQ ID NO: 566660 - DNA, 25 bp, Homo sapien
gttttatccagggactccaagtcac

SEQ ID NO: 566661 - DNA, 25 bp, Homo sapien
ggactccaagtcaccaaagactgct

SEQ ID NO: 566662 - DNA, 25 bp, Homo sapien
gtcaccaaagactgctaaaaccaat

SEQ ID NO: 566663 - DNA, 25 bp, Homo sapien
aagaagccgagagcgacaactccta

SEQ ID NO: 566664 - DNA, 25 bp, Homo sapien
gcgacaactcctaaaactgttagga

SEQ ID NO: 566665 - DNA, 25 bp, Homo sapien
ggagccaagggtaagcaacagcaga

SEQ ID NO: 566666 - DNA, 25 bp, Homo sapien
aaggcaagggcttcgaagtcaaaat

SEQ ID NO: 566667 - DNA, 25 bp, Homo sapien
agtcaaaattgacccaacatcatga

SEQ ID NO: 566668 - DNA, 25 bp, Homo sapien
ttgacccaacatcatgaagttaatg

SEQ ID NO: 566669 - DNA, 25 bp, Homo sapien
gttaatgttagaaaggccacatcta

SEQ ID NO: 566670 - DNA, 25 bp, Homo sapien
ttagtaatatccattctgactggta

SEQ ID NO: 566671 - DNA, 25 bp, Homo sapien
cttgcatttctgtaatggtcaatga

SEQ ID NO: 566672 - DNA, 25 bp, Homo sapien
atggtcaatgatgttcagcttttct

SEQ ID NO: 566673 - DNA, 25 bp, Homo sapien
tgcttgttgcccacatgtatgtttt

SEQ ID NO: 566674 - DNA, 25 bp, Homo sapien
tgttgcccacatgtatgttttgttt

SEQ ID NO: 566675 - DNA, 25 bp, Homo sapien
agtgtttgttcgtgtcctttatcca

SEQ ID NO: 566676 - DNA, 25 bp, Homo sapien
tttgttcgtgtcctttatccacttt

SEQ ID NO: 566677 - DNA, 25 bp, Homo sapien
ttccttatagatgttatgacctagc

SEQ ID NO: 566678 - DNA, 25 bp, Homo sapien
tagatgttatgacctagcagctgta

SEQ ID NO: 566679 - DNA, 25 bp, Homo sapien
acctagcagctgtaccttttttaat

SEQ ID NO: 566680 - DNA, 25 bp, Homo sapien
ctagcagctgtaccttttttaattt

SEQ ID NO: 566681 - DNA, 25 bp, Homo sapien
gtccaggcagacatgtggactctgg

SEQ ID NO: 566682 - DNA, 25 bp, Homo sapien
tagcgggaattcttgcaacgtgtat

SEQ ID NO: 566683 - DNA, 25 bp, Homo sapien
gcaacgtgtatatcatcctaaaagt

SEQ ID NO: 566684 - DNA, 25 bp, Homo sapien
aagacagcccccaggaactgataag

SEQ ID NO: 566685 - DNA, 25 bp, Homo sapien
agaagggatgaactcccgtactctc

SEQ ID NO: 566686 - DNA, 25 bp, Homo sapien
atgaactcccgtactctccagagta

SEQ ID NO: 566687 - DNA, 25 bp, Homo sapien
tactctccagagtactgaagattct

SEQ ID NO: 566688 - DNA, 25 bp, Homo sapien
gggatgtgaaactggaattctcaga

SEQ ID NO: 566689 - DNA, 25 bp, Homo sapien
attctcagatgcctgaggagctccc

SEQ ID NO: 566690 - DNA, 25 bp, Homo sapien
gaggagctcccagtctcaaaggact

SEQ ID NO: 566691 - DNA, 25 bp, Homo sapien
aggactctggtgtctcacccatcca

SEQ ID NO: 566692 - DNA, 25 bp, Homo sapien
agagaccacttttctttagaagttg

SEQ ID NO: 566693 - DNA, 25 bp, Homo sapien
ttctttagaagttgcccggccccag

SEQ ID NO: 566694 - DNA, 25 bp, Homo sapien
aggtgtcccttgatagccacacaaa

SEQ ID NO: 566695 - DNA, 25 bp, Homo sapien
gatagccacacaaatgttcacctgt

SEQ ID NO: 566696 - DNA, 25 bp, Homo sapien
gctataaattcagattctcaggccc

SEQ ID NO: 566697 - DNA, 25 bp, Homo sapien
agacctgctgagtcagaaactccag

SEQ ID NO: 566698 - DNA, 25 bp, Homo sapien
ctgccttttaccaggaacctgtgtg

SEQ ID NO: 566699 - DNA, 25 bp, Homo sapien
ggaacctgtgtgattcccatacaga

SEQ ID NO: 566700 - DNA, 25 bp, Homo sapien
gtgtgattcccatacagagtttgag

SEQ ID NO: 566701 - DNA, 25 bp, Homo sapien
gaacctctggtctctggaactgcat

SEQ ID NO: 566702 - DNA, 25 bp, Homo sapien
ctggaactgcatgctttaaatgggt

SEQ ID NO: 566703 - DNA, 25 bp, Homo sapien
agaagtcgccggatggtacccgagt

SEQ ID NO: 566704 - DNA, 25 bp, Homo sapien
gaagtcgccggatggtacccgagtc

SEQ ID NO: 566705 - DNA, 25 bp, Homo sapien
tcgccggatggtacccgagtcgtag

SEQ ID NO: 566706 - DNA, 25 bp, Homo sapien
gaaatgcggtggttactgtggaaaa

SEQ ID NO: 566707 - DNA, 25 bp, Homo sapien
aatgcggtggttactgtggaaaatg

SEQ ID NO: 566708 - DNA, 25 bp, Homo sapien
tggaaaatgcactccatcctctggt

SEQ ID NO: 566709 - DNA, 25 bp, Homo sapien
ggaaaatgcactccatcctctggta

SEQ ID NO: 566710 - DNA, 25 bp, Homo sapien
cctggaggtgcgagttttatagcta

SEQ ID NO: 566711 - DNA, 25 bp, Homo sapien
gtgcgagttttatagctaaggtgct

SEQ ID NO: 566712 - DNA, 25 bp, Homo sapien
gcgagttttatagctaaggtgcttt

SEQ ID NO: 566713 - DNA, 25 bp, Homo sapien
tttatagctaaggtgctttgaagag

SEQ ID NO: 566714 - DNA, 25 bp, Homo sapien
aaaaatctgagtctcgtgacttggt

SEQ ID NO: 566715 - DNA, 25 bp, Homo sapien
gtctcgtgacttggtataacttctg

SEQ ID NO: 566716 - DNA, 25 bp, Homo sapien
gtgacttggtataacttctgaaact

SEQ ID NO: 566717 - DNA, 25 bp, Homo sapien
ggtataacttctgaaacttactgtt

SEQ ID NO: 566718 - DNA, 25 bp, Homo sapien
acttactgttaatttatagcagagc

SEQ ID NO: 566719 - DNA, 25 bp, Homo sapien
gctatttgagtaatatgctcttcta

SEQ ID NO: 566720 - DNA, 25 bp, Homo sapien
atgctcttctatgagtatgaacaat

SEQ ID NO: 566721 - DNA, 25 bp, Homo sapien
tttggactacaaaataagagcatgg

SEQ ID NO: 566722 - DNA, 25 bp, Homo sapien
tgctgaggatgtactgtgtattagg

SEQ ID NO: 566723 - DNA, 25 bp, Homo sapien
gtactgtgtattaggtgtggtgcat

SEQ ID NO: 566724 - DNA, 25 bp, Homo sapien
gtgtattaggtgtggtgcatataaa

SEQ ID NO: 566725 - DNA, 25 bp, Homo sapien
taggttgcgtagtgtaatgagagaa

SEQ ID NO: 566726 - DNA, 25 bp, Homo sapien
tttgagaccgctacaatgtctgtgt

SEQ ID NO: 566727 - DNA, 25 bp, Homo sapien
gagaccgctacaatgtctgtgtctt

SEQ ID NO: 566728 - DNA, 25 bp, Homo sapien
accgctacaatgtctgtgtcttctt

SEQ ID NO: 566729 - DNA, 25 bp, Homo sapien
cgctacaatgtctgtgtcttcttgg

SEQ ID NO: 566730 - DNA, 25 bp, Homo sapien
cttggccaacatttcagtaagagta

SEQ ID NO: 566731 - DNA, 25 bp, Homo sapien
gtaagagtagtaagcatatctccac

SEQ ID NO: 566732 - DNA, 25 bp, Homo sapien
tcgtaaccctgctaagtctgtgctt

SEQ ID NO: 566733 - DNA, 25 bp, Homo sapien
gtaaccctgctaagtctgtgctttg

SEQ ID NO: 566734 - DNA, 25 bp, Homo sapien
accctgctaagtctgtgctttgcaa

SEQ ID NO: 566735 - DNA, 25 bp, Homo sapien
gctaagtctgtgctttgcaaaaatt

SEQ ID NO: 566736 - DNA, 25 bp, Homo sapien
gaaatctcgcccctacctgcttcac

SEQ ID NO: 566737 - DNA, 25 bp, Homo sapien
acccacagcgcacttttcgggacct

SEQ ID NO: 566738 - DNA, 25 bp, Homo sapien
acagcgcacttttcgggacctccca

SEQ ID NO: 566739 - DNA, 25 bp, Homo sapien
catcctggtgcccacgaaaggtcgt

SEQ ID NO: 566740 - DNA, 25 bp, Homo sapien
atcctggtgcccacgaaaggtcgtc

SEQ ID NO: 566741 - DNA, 25 bp, Homo sapien
tggtgcccacgaaaggtcgtcccag

SEQ ID NO: 566742 - DNA, 25 bp, Homo sapien
gtgcccacgaaaggtcgtcccagtt

SEQ ID NO: 566743 - DNA, 25 bp, Homo sapien
ccctcttctctacctcaaaggagga

SEQ ID NO: 566744 - DNA, 25 bp, Homo sapien
ctcttctctacctcaaaggaggagg

SEQ ID NO: 566745 - DNA, 25 bp, Homo sapien
cttctctacctcaaaggaggaggtg

SEQ ID NO: 566746 - DNA, 25 bp, Homo sapien
ggaggaggtgcaaatgaggaagcct

SEQ ID NO: 566747 - DNA, 25 bp, Homo sapien
gagaaggataaatcaaatgtggtaa

SEQ ID NO: 566748 - DNA, 25 bp, Homo sapien
ggtagaggggatctgggaattattt

SEQ ID NO: 566749 - DNA, 25 bp, Homo sapien
gtagaggggatctgggaattatttg

SEQ ID NO: 566750 - DNA, 25 bp, Homo sapien
tagaggggatctgggaattatttgt

SEQ ID NO: 566751 - DNA, 25 bp, Homo sapien
agaggggatctgggaattatttgta

SEQ ID NO: 566752 - DNA, 25 bp, Homo sapien
gaggggatctgggaattatttgtac

SEQ ID NO: 566753 - DNA, 25 bp, Homo sapien
aggggatctgggaattatttgtact

SEQ ID NO: 566754 - DNA, 25 bp, Homo sapien
ggggatctgggaattatttgtacta

SEQ ID NO: 566755 - DNA, 25 bp, Homo sapien
gggatctgggaattatttgtactat

SEQ ID NO: 566756 - DNA, 25 bp, Homo sapien
gttttggctggttccatattctatg

SEQ ID NO: 566757 - DNA, 25 bp, Homo sapien
ggttccatattctatgatgctcatg

SEQ ID NO: 566758 - DNA, 25 bp, Homo sapien
gatgctcatgaagtgcttttgtaat

SEQ ID NO: 566759 - DNA, 25 bp, Homo sapien
aattttctttgctatcggtaagtga

SEQ ID NO: 566760 - DNA, 25 bp, Homo sapien
atagcagatttttaggaggcctaat

SEQ ID NO: 566761 - DNA, 25 bp, Homo sapien
ggaggcctaataaatccataaatcc

SEQ ID NO: 566762 - DNA, 25 bp, Homo sapien
gtctgcagtggagttggctctatgt

SEQ ID NO: 566763 - DNA, 25 bp, Homo sapien
ggagttggctctatgttcttgatat

SEQ ID NO: 566764 - DNA, 25 bp, Homo sapien
ggctctatgttcttgatatttacca

SEQ ID NO: 566765 - DNA, 25 bp, Homo sapien
gatatttaccagaatgcctagcagc

SEQ ID NO: 566766 - DNA, 25 bp, Homo sapien
tgcctagcagctaattcaacaaatt

SEQ ID NO: 566767 - DNA, 25 bp, Homo sapien
cccatcggctatggtaagtgaaaat

SEQ ID NO: 566768 - DNA, 25 bp, Homo sapien
atcggctatggtaagtgaaaatgtt

SEQ ID NO: 566769 - DNA, 25 bp, Homo sapien
tgttaccaattcctaaaagttcatt

SEQ ID NO: 566770 - DNA, 25 bp, Homo sapien
aaatgccttattctgttggcataac

SEQ ID NO: 566771 - DNA, 25 bp, Homo sapien
tgccttattctgttggcataactgt

SEQ ID NO: 566772 - DNA, 25 bp, Homo sapien
gccttattctgttggcataactgta

SEQ ID NO: 566773 - DNA, 25 bp, Homo sapien
tattctgttggcataactgtatctg

SEQ ID NO: 566774 - DNA, 25 bp, Homo sapien
tctgttggcataactgtatctgtaa

SEQ ID NO: 566775 - DNA, 25 bp, Homo sapien
gttggcataactgtatctgtaattg

SEQ ID NO: 566776 - DNA, 25 bp, Homo sapien
ggcataactgtatctgtaattgaaa

SEQ ID NO: 566777 - DNA, 25 bp, Homo sapien
taactgtatctgtaattgaaagtgg

SEQ ID NO: 566778 - DNA, 25 bp, Homo sapien
aaatgcctatgaatcatgcccacac

SEQ ID NO: 566779 - DNA, 25 bp, Homo sapien
cgggctcaggttaggtcaatcgtgt

SEQ ID NO: 566780 - DNA, 25 bp, Homo sapien
ggtcaatcgtgtttgaagactgaat

SEQ ID NO: 566781 - DNA, 25 bp, Homo sapien
tgaatgtcttcatttgctaccctca

SEQ ID NO: 566782 - DNA, 25 bp, Homo sapien
taccctcagaagcccagtccggaaa

SEQ ID NO: 566783 - DNA, 25 bp, Homo sapien
attccagtgcaaggtttttggcttg

SEQ ID NO: 566784 - DNA, 25 bp, Homo sapien
aggtttttggcttgaatgagatccc

SEQ ID NO: 566785 - DNA, 25 bp, Homo sapien
gaatgagatcccaagaatcaccttc

SEQ ID NO: 566786 - DNA, 25 bp, Homo sapien
atcaccttcaggttgtcaggaaaat

SEQ ID NO: 566787 - DNA, 25 bp, Homo sapien
aacaaagggtatgggaatgagcaca

SEQ ID NO: 566788 - DNA, 25 bp, Homo sapien
gagcacataacactatggacagctg

SEQ ID NO: 566789 - DNA, 25 bp, Homo sapien
tccacatggtctccagttcagctaa

SEQ ID NO: 566790 - DNA, 25 bp, Homo sapien
tggtctccagttcagctaaacataa

SEQ ID NO: 566791 - DNA, 25 bp, Homo sapien
acataaatgagaccaaaatccagtg

SEQ ID NO: 566792 - DNA, 25 bp, Homo sapien
aatccagtggcacggaaaggacaac

SEQ ID NO: 566793 - DNA, 25 bp, Homo sapien
aggacaaccaggtgcctaagtctgt

SEQ ID NO: 566794 - DNA, 25 bp, Homo sapien
tgcctaagtctgtgtgttccagcga

SEQ ID NO: 566795 - DNA, 25 bp, Homo sapien
gtgtgttccagcgactgtcttgaag

SEQ ID NO: 566796 - DNA, 25 bp, Homo sapien
gactgtcttgaagggcaccagcgag

SEQ ID NO: 566797 - DNA, 25 bp, Homo sapien
ccagcgagtggttacgggtttccat

SEQ ID NO: 566798 - DNA, 25 bp, Homo sapien
agtggttacgggtttccatcactgc

SEQ ID NO: 566799 - DNA, 25 bp, Homo sapien
ggtttccatcactgctgctttgagt

SEQ ID NO: 566800 - DNA, 25 bp, Homo sapien
ccctgggaacgggtgaccttcatat

SEQ ID NO: 566801 - DNA, 25 bp, Homo sapien
gaagaggcacctccagcagccttga

SEQ ID NO: 566802 - DNA, 25 bp, Homo sapien
acctccagcagccttgagaagcaag

SEQ ID NO: 566803 - DNA, 25 bp, Homo sapien
agcaagaacatggttccggacccag

SEQ ID NO: 566804 - DNA, 25 bp, Homo sapien
cagggctgagggaactctgctatgt

SEQ ID NO: 566805 - DNA, 25 bp, Homo sapien
gggacttcctgggacaagcaaggaa

SEQ ID NO: 566806 - DNA, 25 bp, Homo sapien
aggaaagtactgaggcagccacttg

SEQ ID NO: 566807 - DNA, 25 bp, Homo sapien
actgaggcagccacttgattgaacg

SEQ ID NO: 566808 - DNA, 25 bp, Homo sapien
gccacttgattgaacggtgttgcaa

SEQ ID NO: 566809 - DNA, 25 bp, Homo sapien
gaacggtgttgcaatgtggagacat

SEQ ID NO: 566810 - DNA, 25 bp, Homo sapien
ggagacatggagttttattgaggta

SEQ ID NO: 566811 - DNA, 25 bp, Homo sapien
gtctaccatgaattggaaggttctt

SEQ ID NO: 566812 - DNA, 25 bp, Homo sapien
catgaattggaaggttcttgagcac

SEQ ID NO: 566813 - DNA, 25 bp, Homo sapien
tgaattggaaggttcttgagcacgt

SEQ ID NO: 566814 - DNA, 25 bp, Homo sapien
aattggaaggttcttgagcacgtgc

SEQ ID NO: 566815 - DNA, 25 bp, Homo sapien
attggaaggttcttgagcacgtgcc

SEQ ID NO: 566816 - DNA, 25 bp, Homo sapien
ttggaaggttcttgagcacgtgccc

SEQ ID NO: 566817 - DNA, 25 bp, Homo sapien
tggaaggttcttgagcacgtgcccc

SEQ ID NO: 566818 - DNA, 25 bp, Homo sapien
ggaaggttcttgagcacgtgcccct

SEQ ID NO: 566819 - DNA, 25 bp, Homo sapien
gaaggttcttgagcacgtgcccctg

SEQ ID NO: 566820 - DNA, 25 bp, Homo sapien
aaggttcttgagcacgtgcccctgc

SEQ ID NO: 566821 - DNA, 25 bp, Homo sapien
ggttcttgagcacgtgcccctgctg

SEQ ID NO: 566822 - DNA, 25 bp, Homo sapien
tcttaagagtccaatgcccaccgaa

SEQ ID NO: 566823 - DNA, 25 bp, Homo sapien
taagagtccaatgcccaccgaaaca

SEQ ID NO: 566824 - DNA, 25 bp, Homo sapien
gtccaatgcccaccgaaacacagta

SEQ ID NO: 566825 - DNA, 25 bp, Homo sapien
atgcccaccgaaacacagtaggctg

SEQ ID NO: 566826 - DNA, 25 bp, Homo sapien
caccgaaacacagtaggctgcacag

SEQ ID NO: 566827 - DNA, 25 bp, Homo sapien
taggctgcacagcatccactactgg

SEQ ID NO: 566828 - DNA, 25 bp, Homo sapien
gcacagcatccactactggaagtag

SEQ ID NO: 566829 - DNA, 25 bp, Homo sapien
atccactactggaagtagagttgct

SEQ ID NO: 566830 - DNA, 25 bp, Homo sapien
tagagttgctggaaaagacagacca

SEQ ID NO: 566831 - DNA, 25 bp, Homo sapien
gacagaccaaacatacttaataagc

SEQ ID NO: 566832 - DNA, 25 bp, Homo sapien
aatgtaatcgttgaattaaagacca

SEQ ID NO: 566833 - DNA, 25 bp, Homo sapien
gcaatcctactgtaatataatcctg

SEQ ID NO: 566834 - DNA, 25 bp, Homo sapien
taatcctgtatactgatatttttca

SEQ ID NO: 566835 - DNA, 25 bp, Homo sapien
ttttcacctatcactgtatgttgag

SEQ ID NO: 566836 - DNA, 25 bp, Homo sapien
gtatgttgagcattttcaatagtca

SEQ ID NO: 566837 - DNA, 25 bp, Homo sapien
gtaacctttcaaataggtgtgtctt

SEQ ID NO: 566838 - DNA, 25 bp, Homo sapien
tttaaaccagtccacaattattgta

SEQ ID NO: 566839 - DNA, 25 bp, Homo sapien
tgtatattgaagtcatttcccaaat

SEQ ID NO: 566840 - DNA, 25 bp, Homo sapien
gtaagtataagtattgcatccatcc

SEQ ID NO: 566841 - DNA, 25 bp, Homo sapien
gtattgcatccatccttatatgtat

SEQ ID NO: 566842 - DNA, 25 bp, Homo sapien
aatgcatctcttattatttccttga

SEQ ID NO: 566843 - DNA, 25 bp, Homo sapien
atttccttgagataagttcctagaa

SEQ ID NO: 566844 - DNA, 25 bp, Homo sapien
tttccaacactctgttagggttact

SEQ ID NO: 566845 - DNA, 25 bp, Homo sapien
ggttactaaatgtgctccctacaaa

SEQ ID NO: 566846 - DNA, 25 bp, Homo sapien
aatgtgctccctacaaatggactag

SEQ ID NO: 566847 - DNA, 25 bp, Homo sapien
tagggccaaggaattatgcaagatc

SEQ ID NO: 566848 - DNA, 25 bp, Homo sapien
tgcaagatccttcaagcaaagagat

SEQ ID NO: 566849 - DNA, 25 bp, Homo sapien
gagatggtattttgtaacttccctg

SEQ ID NO: 566850 - DNA, 25 bp, Homo sapien
gtaacttccctgagtttctccagga

SEQ ID NO: 566851 - DNA, 25 bp, Homo sapien
tctccaggaagatgaaatgcacaac

SEQ ID NO: 566852 - DNA, 25 bp, Homo sapien
atatcaacctacatatgtcagagag

SEQ ID NO: 566853 - DNA, 25 bp, Homo sapien
agagaggtagtcttgtctgaccaaa

SEQ ID NO: 566854 - DNA, 25 bp, Homo sapien
ggtagtcttgtctgaccaaagccct

SEQ ID NO: 566855 - DNA, 25 bp, Homo sapien
gagacccacctgggcaaaacaggga

SEQ ID NO: 566856 - DNA, 25 bp, Homo sapien
agacccacctgggcaaaacagggag

SEQ ID NO: 566857 - DNA, 25 bp, Homo sapien
gacccacctgggcaaaacagggaga

SEQ ID NO: 566858 - DNA, 25 bp, Homo sapien
ggcaaaacagggagacctcatcttt

SEQ ID NO: 566859 - DNA, 25 bp, Homo sapien
gcaaaacagggagacctcatcttta

SEQ ID NO: 566860 - DNA, 25 bp, Homo sapien
caaaacagggagacctcatctttac

SEQ ID NO: 566861 - DNA, 25 bp, Homo sapien
aacagggagacctcatctttacaaa

SEQ ID NO: 566862 - DNA, 25 bp, Homo sapien
aagtaataaattacctggacatggt

SEQ ID NO: 566863 - DNA, 25 bp, Homo sapien
gtaataaattacctggacatggtgg

SEQ ID NO: 566864 - DNA, 25 bp, Homo sapien
ggaaggatcacttgacccttggagg

SEQ ID NO: 566865 - DNA, 25 bp, Homo sapien
gaaggatcacttgacccttggaggt

SEQ ID NO: 566866 - DNA, 25 bp, Homo sapien
aggcctggcctaatcacttaagagc

SEQ ID NO: 566867 - DNA, 25 bp, Homo sapien
ggcctaatcacttaagagctcttaa

SEQ ID NO: 566868 - DNA, 25 bp, Homo sapien
gaaaaaagagcttctgctaaccctg

SEQ ID NO: 566869 - DNA, 25 bp, Homo sapien
aagagcttctgctaaccctgaaaag

SEQ ID NO: 566870 - DNA, 25 bp, Homo sapien
tgaaaagcaagcaacaaccctgtga

SEQ ID NO: 566871 - DNA, 25 bp, Homo sapien
acaaccctgtgaactgctatggaga

SEQ ID NO: 566872 - DNA, 25 bp, Homo sapien
gagagagatggcctctaacagctga

SEQ ID NO: 566873 - DNA, 25 bp, Homo sapien
tggcctctaacagctgaggacctca

SEQ ID NO: 566874 - DNA, 25 bp, Homo sapien
tccagatgagaacacccaggtcaac

SEQ ID NO: 566875 - DNA, 25 bp, Homo sapien
cacccaggtcaactcaggtcatgag

SEQ ID NO: 566876 - DNA, 25 bp, Homo sapien
aggtcatgagcagagaaccctgtta

SEQ ID NO: 566877 - DNA, 25 bp, Homo sapien
gcattaacatgctaaattgtcctgc

SEQ ID NO: 566878 - DNA, 25 bp, Homo sapien
attaacatgctaaattgtcctgctg

SEQ ID NO: 566879 - DNA, 25 bp, Homo sapien
taacatgctaaattgtcctgctgta

SEQ ID NO: 566880 - DNA, 25 bp, Homo sapien
aacatgctaaattgtcctgctgtag

SEQ ID NO: 566881 - DNA, 25 bp, Homo sapien
ttgtcctgctgtagagttactataa

SEQ ID NO: 566882 - DNA, 25 bp, Homo sapien
gtcctgctgtagagttactataaaa

SEQ ID NO: 566883 - DNA, 25 bp, Homo sapien
cctgctgtagagttactataaaata

SEQ ID NO: 566884 - DNA, 25 bp, Homo sapien
taaacatgactattccaaaagagat

SEQ ID NO: 566885 - DNA, 25 bp, Homo sapien
catgactattccaaaagagattttt

SEQ ID NO: 566886 - DNA, 25 bp, Homo sapien
gagatttttttccagtctaaggaat

SEQ ID NO: 566887 - DNA, 25 bp, Homo sapien
tttccagtctaaggaatattttgga

SEQ ID NO: 566888 - DNA, 25 bp, Homo sapien
cttctcctgaagctcggtatggcca

SEQ ID NO: 566889 - DNA, 25 bp, Homo sapien
tgaagctcggtatggccacaacact

SEQ ID NO: 566890 - DNA, 25 bp, Homo sapien
gctcggtatggccacaacactaaat

SEQ ID NO: 566891 - DNA, 25 bp, Homo sapien
acaacactaaattctgcccgaggag

SEQ ID NO: 566892 - DNA, 25 bp, Homo sapien
attctgcccgaggagattaagcaaa

SEQ ID NO: 566893 - DNA, 25 bp, Homo sapien
taagcaaaatagtatgggacttcca

SEQ ID NO: 566894 - DNA, 25 bp, Homo sapien
ccatcctggaaggtgaaagcctcat

SEQ ID NO: 566895 - DNA, 25 bp, Homo sapien
cctggaaggtgaaagcctcatacta

SEQ ID NO: 566896 - DNA, 25 bp, Homo sapien
ggacgtcagacagcgaaataagagc

SEQ ID NO: 566897 - DNA, 25 bp, Homo sapien
gaaataagagcctgggtccttgacc

SEQ ID NO: 566898 - DNA, 25 bp, Homo sapien
gggtccttgaccctgtagacatctc

SEQ ID NO: 566899 - DNA, 25 bp, Homo sapien
tcacgttcgaggactctgggaaccc

SEQ ID NO: 566900 - DNA, 25 bp, Homo sapien
gttcgaggactctgggaaccccaag

SEQ ID NO: 566901 - DNA, 25 bp, Homo sapien
ttcgaggactctgggaaccccaaga

SEQ ID NO: 566902 - DNA, 25 bp, Homo sapien
tcgaggactctgggaaccccaagag

SEQ ID NO: 566903 - DNA, 25 bp, Homo sapien
cgaggactctgggaaccccaagagc

SEQ ID NO: 566904 - DNA, 25 bp, Homo sapien
gaggactctgggaaccccaagagcc

SEQ ID NO: 566905 - DNA, 25 bp, Homo sapien
gccgaagagtccgagagcagcagca

SEQ ID NO: 566906 - DNA, 25 bp, Homo sapien
cagcagcggctcggagacagaaggg

SEQ ID NO: 566907 - DNA, 25 bp, Homo sapien
cagcggctcggagacagaaggggag

SEQ ID NO: 566908 - DNA, 25 bp, Homo sapien
ggccgtaactgcagcgctgccagct

SEQ ID NO: 566909 - DNA, 25 bp, Homo sapien
gccgtaactgcagcgctgccagctc

SEQ ID NO: 566910 - DNA, 25 bp, Homo sapien
ccattatgctgttaacagtgagaat

SEQ ID NO: 566911 - DNA, 25 bp, Homo sapien
taacagtgagaatttgtcagtggtg

SEQ ID NO: 566912 - DNA, 25 bp, Homo sapien
gatccaaatattgtagatgtgtatg

SEQ ID NO: 566913 - DNA, 25 bp, Homo sapien
atccaaatattgtagatgtgtatgg

SEQ ID NO: 566914 - DNA, 25 bp, Homo sapien
tggcaacacagctgtccattatgct

SEQ ID NO: 566915 - DNA, 25 bp, Homo sapien
cagctgtccattatgctgttaacag

SEQ ID NO: 566916 - DNA, 25 bp, Homo sapien
agctgtccattatgctgttaacagt

SEQ ID NO: 566917 - DNA, 25 bp, Homo sapien
gctgtccattatgctgttaacagtg

SEQ ID NO: 566918 - DNA, 25 bp, Homo sapien
ctgtccattatgctgttaacagtga

SEQ ID NO: 566919 - DNA, 25 bp, Homo sapien
tgtccattatgctgttaacagtgag

SEQ ID NO: 566920 - DNA, 25 bp, Homo sapien
gtccattatgctgttaacagtgaga

SEQ ID NO: 566921 - DNA, 25 bp, Homo sapien
ttgcttctataatgcggtggtagtt

SEQ ID NO: 566922 - DNA, 25 bp, Homo sapien
ttagagctaccattcagagtacatg

SEQ ID NO: 566923 - DNA, 25 bp, Homo sapien
gaaatgcattgctgattccacacat

SEQ ID NO: 566924 - DNA, 25 bp, Homo sapien
gctgattccacacatagagagcgaa

SEQ ID NO: 566925 - DNA, 25 bp, Homo sapien
agagaggagcactcccattggcagc

SEQ ID NO: 566926 - DNA, 25 bp, Homo sapien
aggctgacctgagcataatcctggt

SEQ ID NO: 566927 - DNA, 25 bp, Homo sapien
taatcctggtccctaccttaatgtt

SEQ ID NO: 566928 - DNA, 25 bp, Homo sapien
aatgttcaaggtccctcattcagtc

SEQ ID NO: 566929 - DNA, 25 bp, Homo sapien
attcagtcagtgctggatttgtcag

SEQ ID NO: 566930 - DNA, 25 bp, Homo sapien
atttgtcagcagcttttctgtgctt

SEQ ID NO: 566931 - DNA, 25 bp, Homo sapien
ctgtgcttcatttgcttctataatg

SEQ ID NO: 566932 - DNA, 25 bp, Homo sapien
acaaaggtaaccactgcccagaatt

SEQ ID NO: 566933 - DNA, 25 bp, Homo sapien
gtaaccactgcccagaattttatgg

SEQ ID NO: 566934 - DNA, 25 bp, Homo sapien
tggcattcacttccatacttctcct

SEQ ID NO: 566935 - DNA, 25 bp, Homo sapien
atacttctcctatggttttgccgtg

SEQ ID NO: 566936 - DNA, 25 bp, Homo sapien
ggttttgccgtggaagcatacatcc

SEQ ID NO: 566937 - DNA, 25 bp, Homo sapien
gcatacatccaaataccataggcta

SEQ ID NO: 566938 - DNA, 25 bp, Homo sapien
cataggctagttttgcatggttttt

SEQ ID NO: 566939 - DNA, 25 bp, Homo sapien
taattatgatatttgtccagactat

SEQ ID NO: 566940 - DNA, 25 bp, Homo sapien
tccagactattgaatgtagctgtag

SEQ ID NO: 566941 - DNA, 25 bp, Homo sapien
gtagctgtagtttattcatttttat

SEQ ID NO: 566942 - DNA, 25 bp, Homo sapien
gtatttatccacatttgagcactaa

SEQ ID NO: 566943 - DNA, 25 bp, Homo sapien
tcctagattcactgatctttttgaa

SEQ ID NO: 566944 - DNA, 25 bp, Homo sapien
gattcactgatctttttgaaaggtt

SEQ ID NO: 566945 - DNA, 25 bp, Homo sapien
ttttggttattgtcttctactagct

SEQ ID NO: 566946 - DNA, 25 bp, Homo sapien
attgtcttctactagctttgggctt

SEQ ID NO: 566947 - DNA, 25 bp, Homo sapien
gtcttctactagctttgggcttggt

SEQ ID NO: 566948 - DNA, 25 bp, Homo sapien
tcaattctattacttctaattcatt

SEQ ID NO: 566949 - DNA, 25 bp, Homo sapien
aattcatttaaaagttgtcctcaat

SEQ ID NO: 566950 - DNA, 25 bp, Homo sapien
gttgtcctcaattcagttaaaaaat

SEQ ID NO: 566951 - DNA, 25 bp, Homo sapien
taaagattcttcacaacaaattatg

SEQ ID NO: 566952 - DNA, 25 bp, Homo sapien
tagtcagaccattttcttaaaacgt

SEQ ID NO: 566953 - DNA, 25 bp, Homo sapien
taattttatttattccatgatgaga

SEQ ID NO: 566954 - DNA, 25 bp, Homo sapien
gaatctccttctaaacaaagaatgt

SEQ ID NO: 566955 - DNA, 25 bp, Homo sapien
aatctccttctaaacaaagaatgtt

SEQ ID NO: 566956 - DNA, 25 bp, Homo sapien
atctccttctaaacaaagaatgttt

SEQ ID NO: 566957 - DNA, 25 bp, Homo sapien
tctccttctaaacaaagaatgtttt

SEQ ID NO: 566958 - DNA, 25 bp, Homo sapien
tccttctaaacaaagaatgtttttg

SEQ ID NO: 566959 - DNA, 25 bp, Homo sapien
aagcccaaattaatgtgattctggg

SEQ ID NO: 566960 - DNA, 25 bp, Homo sapien
agcccaaattaatgtgattctgggt

SEQ ID NO: 566961 - DNA, 25 bp, Homo sapien
gcccaaattaatgtgattctgggtg

SEQ ID NO: 566962 - DNA, 25 bp, Homo sapien
tcaatcgagttccttagcccttcac

SEQ ID NO: 566963 - DNA, 25 bp, Homo sapien
aggtgagggctgatcatcctgtcct

SEQ ID NO: 566964 - DNA, 25 bp, Homo sapien
gcaagactgctctaacgctgacgtt

SEQ ID NO: 566965 - DNA, 25 bp, Homo sapien
tctaacgctgacgtttccttttagt

SEQ ID NO: 566966 - DNA, 25 bp, Homo sapien
tccactgacacccacttgtaattta

SEQ ID NO: 566967 - DNA, 25 bp, Homo sapien
gacacccacttgtaatttatagcca

SEQ ID NO: 566968 - DNA, 25 bp, Homo sapien
gcaagatacactgctccttggctat

SEQ ID NO: 566969 - DNA, 25 bp, Homo sapien
ttggctataagttattttccctgtt

SEQ ID NO: 566970 - DNA, 25 bp, Homo sapien
cactccccgactacaaaatcgatag

SEQ ID NO: 566971 - DNA, 25 bp, Homo sapien
aaatcgatagcagtggtccctatac

SEQ ID NO: 566972 - DNA, 25 bp, Homo sapien
agcagtggtccctatacctattgca

SEQ ID NO: 566973 - DNA, 25 bp, Homo sapien
gacagtattgttgagtgaaggtcct

SEQ ID NO: 566974 - DNA, 25 bp, Homo sapien
tgagtgaaggtcctgtagccagcct

SEQ ID NO: 566975 - DNA, 25 bp, Homo sapien
tgaaggtcctgtagccagcctccta

SEQ ID NO: 566976 - DNA, 25 bp, Homo sapien
cagcctcctaccaaagactgtttag

SEQ ID NO: 566977 - DNA, 25 bp, Homo sapien
ccaaagactgtttagcaagtggctt

SEQ ID NO: 566978 - DNA, 25 bp, Homo sapien
caagtggctttttcagaaacatgta

SEQ ID NO: 566979 - DNA, 25 bp, Homo sapien
gctttttcagaaacatgtaggatca

SEQ ID NO: 566980 - DNA, 25 bp, Homo sapien
gtaggatcaacttgttccatcgtcc

SEQ ID NO: 566981 - DNA, 25 bp, Homo sapien
aacttgttccatcgtcctacgttag

SEQ ID NO: 566982 - DNA, 25 bp, Homo sapien
gttccatcgtcctacgttagataga

SEQ ID NO: 566983 - DNA, 25 bp, Homo sapien
atcgtcctacgttagatagactgga

SEQ ID NO: 566984 - DNA, 25 bp, Homo sapien
aaagccatatgaatagacgaagttt

SEQ ID NO: 566985 - DNA, 25 bp, Homo sapien
tgaatagacgaagtttcatcatgtt

SEQ ID NO: 566986 - DNA, 25 bp, Homo sapien
cacacccgcccttgaaatactgttt

SEQ ID NO: 566987 - DNA, 25 bp, Homo sapien
cacccgcccttgaaatactgtttct

SEQ ID NO: 566988 - DNA, 25 bp, Homo sapien
aggcaaggataatcaagacccagct

SEQ ID NO: 566989 - DNA, 25 bp, Homo sapien
ggataatcaagacccagctgataaa

SEQ ID NO: 566990 - DNA, 25 bp, Homo sapien
gacccagctgataaaaaaggtggaa

SEQ ID NO: 566991 - DNA, 25 bp, Homo sapien
ggtggaagaacttgccctaatgaat

SEQ ID NO: 566992 - DNA, 25 bp, Homo sapien
gaagaacttgccctaatgaatatca

SEQ ID NO: 566993 - DNA, 25 bp, Homo sapien
actatagtaattaagatgctgttgc

SEQ ID NO: 566994 - DNA, 25 bp, Homo sapien
gatgctgttgcattgtacacagaca

SEQ ID NO: 566995 - DNA, 25 bp, Homo sapien
attgcctctaatggtgtctacaccc

SEQ ID NO: 566996 - DNA, 25 bp, Homo sapien
acccgtcatactaccagctgagatg

SEQ ID NO: 566997 - DNA, 25 bp, Homo sapien
atactaccagctgagatggtggtgg

SEQ ID NO: 566998 - DNA, 25 bp, Homo sapien
gagaatttgtgcctataacccttag

SEQ ID NO: 566999 - DNA, 25 bp, Homo sapien
atttgtgcctataacccttagtgtg

SEQ ID NO: 567000 - DNA, 25 bp, Homo sapien
gtgcctataacccttagtgtgttct

SEQ ID NO: 567001 - DNA, 25 bp, Homo sapien
ctataacccttagtgtgttctggtt

SEQ ID NO: 567002 - DNA, 25 bp, Homo sapien
agtgcacagttcagtaacgttaact

SEQ ID NO: 567003 - DNA, 25 bp, Homo sapien
cattcataatgctgtgtggccgtca

SEQ ID NO: 567004 - DNA, 25 bp, Homo sapien
ataatgctgtgtggccgtcaccgcc

SEQ ID NO: 567005 - DNA, 25 bp, Homo sapien
cattaaacagtaattcccactcctc

SEQ ID NO: 567006 - DNA, 25 bp, Homo sapien
gcttgtgttgatcaggagtgaattc

SEQ ID NO: 567007 - DNA, 25 bp, Homo sapien
gagtgaattcacagtctaccatgaa

SEQ ID NO: 567008 - DNA, 25 bp, Homo sapien
tggaaggttcttgagcacgtgcccc

SEQ ID NO: 567009 - DNA, 25 bp, Homo sapien
gctgctgtatatcttggcagcaaaa

SEQ ID NO: 567010 - DNA, 25 bp, Homo sapien
aaaacattaattctctgcctgacat

SEQ ID NO: 567011 - DNA, 25 bp, Homo sapien
aattctctgcctgacatttgctggg

SEQ ID NO: 567012 - DNA, 25 bp, Homo sapien
tggaggcaaaacaacaaaaactgga

SEQ ID NO: 567013 - DNA, 25 bp, Homo sapien
aaagataactgaagattctgccatg

SEQ ID NO: 567014 - DNA, 25 bp, Homo sapien
gataactgaagattctgccatgtaa

SEQ ID NO: 567015 - DNA, 25 bp, Homo sapien
gccatgtaaatgtcagcttgagtgg

SEQ ID NO: 567016 - DNA, 25 bp, Homo sapien
taaatgtcagcttgagtggactcca

SEQ ID NO: 567017 - DNA, 25 bp, Homo sapien
ggcattcttaaaccacaaacagtag

SEQ ID NO: 567018 - DNA, 25 bp, Homo sapien
gcattcttaaaccacaaacagtagc

SEQ ID NO: 567019 - DNA, 25 bp, Homo sapien
cattcttaaaccacaaacagtagca

SEQ ID NO: 567020 - DNA, 25 bp, Homo sapien
attcttaaaccacaaacagtagcat

SEQ ID NO: 567021 - DNA, 25 bp, Homo sapien
gacccacccctttatttcaggccat

SEQ ID NO: 567022 - DNA, 25 bp, Homo sapien
cacccctttatttcaggccatccct

SEQ ID NO: 567023 - DNA, 25 bp, Homo sapien
ccctttatttcaggccatcccttca

SEQ ID NO: 567024 - DNA, 25 bp, Homo sapien
cctttatttcaggccatcccttcat

SEQ ID NO: 567025 - DNA, 25 bp, Homo sapien
ctttatttcaggccatcccttcatt

SEQ ID NO: 567026 - DNA, 25 bp, Homo sapien
agggcgccgaggtctgacctgcagc

SEQ ID NO: 567027 - DNA, 25 bp, Homo sapien
acctgcagcgcctgaggtccgactg

SEQ ID NO: 567028 - DNA, 25 bp, Homo sapien
agcgcctgaggtccgactgtctctg

SEQ ID NO: 567029 - DNA, 25 bp, Homo sapien
tgaggtccgactgtctctgcctgca

SEQ ID NO: 567030 - DNA, 25 bp, Homo sapien
ccgcctccgcatgcatgtggataga

SEQ ID NO: 567031 - DNA, 25 bp, Homo sapien
cctccgcatgcatgtggatagaccc

SEQ ID NO: 567032 - DNA, 25 bp, Homo sapien
ggccgtggccaacgcttgtccctgg

SEQ ID NO: 567033 - DNA, 25 bp, Homo sapien
ccacacagggacactggaggtcaca

SEQ ID NO: 567034 - DNA, 25 bp, Homo sapien
gggacactggaggtcacagttattt

SEQ ID NO: 567035 - DNA, 25 bp, Homo sapien
actggaggtcacagttatttattga

SEQ ID NO: 567036 - DNA, 25 bp, Homo sapien
gatcacaattgtggacattaaaaca

SEQ ID NO: 567037 - DNA, 25 bp, Homo sapien
gatcgatttctcctatttctcttct

SEQ ID NO: 567038 - DNA, 25 bp, Homo sapien
gatttctcctatttctcttctttgt

SEQ ID NO: 567039 - DNA, 25 bp, Homo sapien
ttgtttcttgcatatccagaattct

SEQ ID NO: 567040 - DNA, 25 bp, Homo sapien
gcatatccagaattctagagccctt

SEQ ID NO: 567041 - DNA, 25 bp, Homo sapien
atatccagaattctagagcccttcc

SEQ ID NO: 567042 - DNA, 25 bp, Homo sapien
atccagaattctagagcccttcctc

SEQ ID NO: 567043 - DNA, 25 bp, Homo sapien
gcccttcctcacaattccagttaag

SEQ ID NO: 567044 - DNA, 25 bp, Homo sapien
ttcctcacaattccagttaagattt

SEQ ID NO: 567045 - DNA, 25 bp, Homo sapien
ctcacaattccagttaagatttgac

SEQ ID NO: 567046 - DNA, 25 bp, Homo sapien
taagatttgactgtgaaaactccaa

SEQ ID NO: 567047 - DNA, 25 bp, Homo sapien
gcagtcaagttcaacccaaattcct

SEQ ID NO: 567048 - DNA, 25 bp, Homo sapien
gccatggccaggcaaatggtcttct

SEQ ID NO: 567049 - DNA, 25 bp, Homo sapien
catggccaggcaaatggtcttctca

SEQ ID NO: 567050 - DNA, 25 bp, Homo sapien
tggccaggcaaatggtcttctcaat

SEQ ID NO: 567051 - DNA, 25 bp, Homo sapien
gccaggcaaatggtcttctcaatgc

SEQ ID NO: 567052 - DNA, 25 bp, Homo sapien
tgggtcaccaattcgtgtccgctca

SEQ ID NO: 567053 - DNA, 25 bp, Homo sapien
ggtcaccaattcgtgtccgctcaga

SEQ ID NO: 567054 - DNA, 25 bp, Homo sapien
caccaattcgtgtccgctcagagat

SEQ ID NO: 567055 - DNA, 25 bp, Homo sapien
tccactggtgcgaaagttacgttcc

SEQ ID NO: 567056 - DNA, 25 bp, Homo sapien
actggtgcgaaagttacgttccatt

SEQ ID NO: 567057 - DNA, 25 bp, Homo sapien
ttaaagcttctaaggtaccattatt

SEQ ID NO: 567058 - DNA, 25 bp, Homo sapien
tctgttacataaagtctttcaaata

SEQ ID NO: 567059 - DNA, 25 bp, Homo sapien
accatccaaacctcccgatgaggaa

SEQ ID NO: 567060 - DNA, 25 bp, Homo sapien
ctcccgatgaggaacacaggctcga

SEQ ID NO: 567061 - DNA, 25 bp, Homo sapien
aacacaggctcgaggatgctgaaac

SEQ ID NO: 567062 - DNA, 25 bp, Homo sapien
cagaatctcaatctgctgtttcaga

SEQ ID NO: 567063 - DNA, 25 bp, Homo sapien
agaaactccccaaaaacgctcagat

SEQ ID NO: 567064 - DNA, 25 bp, Homo sapien
aacgctcagatgctgtccagaagga

SEQ ID NO: 567065 - DNA, 25 bp, Homo sapien
tgacatgaagtctgagggacaggcc

SEQ ID NO: 567066 - DNA, 25 bp, Homo sapien
gacaggccactgtaattcagcagct

SEQ ID NO: 567067 - DNA, 25 bp, Homo sapien
cagctggaacagactattgaggatc

SEQ ID NO: 567068 - DNA, 25 bp, Homo sapien
ggatctgagaaccaaaatagctgaa

SEQ ID NO: 567069 - DNA, 25 bp, Homo sapien
ccagtggtcatcaagggcttgagaa

SEQ ID NO: 567070 - DNA, 25 bp, Homo sapien
aaatgctgtgtctttctaagggcac

SEQ ID NO: 567071 - DNA, 25 bp, Homo sapien
ttctaagggcacattatggccattt

SEQ ID NO: 567072 - DNA, 25 bp, Homo sapien
cattatggccattttccttatctcc

SEQ ID NO: 567073 - DNA, 25 bp, Homo sapien
attatggccattttccttatctccc

SEQ ID NO: 567074 - DNA, 25 bp, Homo sapien
ttatggccattttccttatctccct

SEQ ID NO: 567075 - DNA, 25 bp, Homo sapien
ttatctccctcccaaggggctgttt

SEQ ID NO: 567076 - DNA, 25 bp, Homo sapien
ttatgtatcttctaaattgtatata

SEQ ID NO: 567077 - DNA, 25 bp, Homo sapien
gtgatttttcaatacagtgtggaat

SEQ ID NO: 567078 - DNA, 25 bp, Homo sapien
gatttttcaatacagtgtggaatga

SEQ ID NO: 567079 - DNA, 25 bp, Homo sapien
atttttcaatacagtgtggaatgag

SEQ ID NO: 567080 - DNA, 25 bp, Homo sapien
tttcaatacagtgtggaatgagaat

SEQ ID NO: 567081 - DNA, 25 bp, Homo sapien
aaagccacagactaagagctgggat

SEQ ID NO: 567082 - DNA, 25 bp, Homo sapien
gggatgcatggccaccaccatgtcc

SEQ ID NO: 567083 - DNA, 25 bp, Homo sapien
gaatgcccctgaacatggacattca

SEQ ID NO: 567084 - DNA, 25 bp, Homo sapien
gacattcagtccagttcttagccta

SEQ ID NO: 567085 - DNA, 25 bp, Homo sapien
agtccagttcttagcctatgcagag

SEQ ID NO: 567086 - DNA, 25 bp, Homo sapien
tgcagagacaggattcacatcccct

SEQ ID NO: 567087 - DNA, 25 bp, Homo sapien
taggaaggagcaatacagcagtatt

SEQ ID NO: 567088 - DNA, 25 bp, Homo sapien
acagcagtatttgtaggcaattaga

SEQ ID NO: 567089 - DNA, 25 bp, Homo sapien
ctattcttctagatcaggaattggc

SEQ ID NO: 567090 - DNA, 25 bp, Homo sapien
ggcaaatcatgttctgaggtccaaa

SEQ ID NO: 567091 - DNA, 25 bp, Homo sapien
tgaggtccaaatcttaccagctgcc

SEQ ID NO: 567092 - DNA, 25 bp, Homo sapien
ttttttccccacttgaatcatgtat

SEQ ID NO: 567093 - DNA, 25 bp, Homo sapien
ttccccacttgaatcatgtatactg

SEQ ID NO: 567094 - DNA, 25 bp, Homo sapien
gaatcatgtatactgaaaacccatt

SEQ ID NO: 567095 - DNA, 25 bp, Homo sapien
catgtatactgaaaacccatttcct

SEQ ID NO: 567096 - DNA, 25 bp, Homo sapien
ccatttcctcagcaactacacaaaa

SEQ ID NO: 567097 - DNA, 25 bp, Homo sapien
ttcctcagcaactacacaaaataag

SEQ ID NO: 567098 - DNA, 25 bp, Homo sapien
gaaagggaagtgctatattccagat

SEQ ID NO: 567099 - DNA, 25 bp, Homo sapien
aagtgctatattccagatacaaatg

SEQ ID NO: 567100 - DNA, 25 bp, Homo sapien
tattccagatacaaatgactcaaag

SEQ ID NO: 567101 - DNA, 25 bp, Homo sapien
tcaaaggcagctcagttgtactggt

SEQ ID NO: 567102 - DNA, 25 bp, Homo sapien
ggcagctcagttgtactggttttga

SEQ ID NO: 567103 - DNA, 25 bp, Homo sapien
gattacaggccccttgttcagccac

SEQ ID NO: 567104 - DNA, 25 bp, Homo sapien
ttacaggccccttgttcagccactg

SEQ ID NO: 567105 - DNA, 25 bp, Homo sapien
ttgttttctaatatactttgatgta

SEQ ID NO: 567106 - DNA, 25 bp, Homo sapien
taatatactttgatgtaatcagctt

SEQ ID NO: 567107 - DNA, 25 bp, Homo sapien
gtaatcagcttgagaaagcaacaca

SEQ ID NO: 567108 - DNA, 25 bp, Homo sapien
agcttgagaaagcaacacaatttca

SEQ ID NO: 567109 - DNA, 25 bp, Homo sapien
gcaacacaatttcaaatcctatctt

SEQ ID NO: 567110 - DNA, 25 bp, Homo sapien
tatcttctagatgcaagcagtgtta

SEQ ID NO: 567111 - DNA, 25 bp, Homo sapien
tcttctagatgcaagcagtgttaaa

SEQ ID NO: 567112 - DNA, 25 bp, Homo sapien
gatgcaagcagtgttaaatttgtta

SEQ ID NO: 567113 - DNA, 25 bp, Homo sapien
gcaagcagtgttaaatttgttaata

SEQ ID NO: 567114 - DNA, 25 bp, Homo sapien
ttcaaaattatcagcaatgcatgtc

SEQ ID NO: 567115 - DNA, 25 bp, Homo sapien
tatcagcaatgcatgtcagaaagca

SEQ ID NO: 567116 - DNA, 25 bp, Homo sapien
gcatgtcagaaagcatttcaaagaa

SEQ ID NO: 567117 - DNA, 25 bp, Homo sapien
gaagagtcaaagtgcatgtagaaac

SEQ ID NO: 567118 - DNA, 25 bp, Homo sapien
gtagaaactaattgctgtatctgaa

SEQ ID NO: 567119 - DNA, 25 bp, Homo sapien
gaagaatttttcagtcttcagagaa

SEQ ID NO: 567120 - DNA, 25 bp, Homo sapien
gtcttcagagaagcaagttccccac

SEQ ID NO: 567121 - DNA, 25 bp, Homo sapien
aaagtttccccaaatcatatacctg

SEQ ID NO: 567122 - DNA, 25 bp, Homo sapien
gtttccccaaatcatatacctgaga

SEQ ID NO: 567123 - DNA, 25 bp, Homo sapien
tccccaaatcatatacctgagaaaa

SEQ ID NO: 567124 - DNA, 25 bp, Homo sapien
aaatcctccaacagcttcctacttt

SEQ ID NO: 567125 - DNA, 25 bp, Homo sapien
aggtaagtgctcttgatctcacatt

SEQ ID NO: 567126 - DNA, 25 bp, Homo sapien
ttgatctcacattcccaaaagcaca

SEQ ID NO: 567127 - DNA, 25 bp, Homo sapien
aaaagcacatttctcagaccatgag

SEQ ID NO: 567128 - DNA, 25 bp, Homo sapien
atgagtcattcctgcctctgaccat

SEQ ID NO: 567129 - DNA, 25 bp, Homo sapien
tctgaccatcctgccaaaatgcatg

SEQ ID NO: 567130 - DNA, 25 bp, Homo sapien
gaggatgatctgtatagacttcttg

SEQ ID NO: 567131 - DNA, 25 bp, Homo sapien
gacttcttgatatatcctcctacac

SEQ ID NO: 567132 - DNA, 25 bp, Homo sapien
atatcctcctacacataatccatgg

SEQ ID NO: 567133 - DNA, 25 bp, Homo sapien
taatccatggatctgacctcttaga

SEQ ID NO: 567134 - DNA, 25 bp, Homo sapien
ggatctgacctcttagatacttaaa

SEQ ID NO: 567135 - DNA, 25 bp, Homo sapien
aaaggtggacagtttacatcaaaat

SEQ ID NO: 567136 - DNA, 25 bp, Homo sapien
cgagcccctgcattggagtcagagc

SEQ ID NO: 567137 - DNA, 25 bp, Homo sapien
gagcccctgcattggagtcagagcc

SEQ ID NO: 567138 - DNA, 25 bp, Homo sapien
ctgcattggagtcagagcccctgcc

SEQ ID NO: 567139 - DNA, 25 bp, Homo sapien
ccagattgataaactggctcgtctg

SEQ ID NO: 567140 - DNA, 25 bp, Homo sapien
caggaactgactgggcactagaaaa

SEQ ID NO: 567141 - DNA, 25 bp, Homo sapien
ctgactgggcactagaaaacagctt

SEQ ID NO: 567142 - DNA, 25 bp, Homo sapien
gactgggcactagaaaacagcttca

SEQ ID NO: 567143 - DNA, 25 bp, Homo sapien
gggcactagaaaacagcttcaacat

SEQ ID NO: 567144 - DNA, 25 bp, Homo sapien
ggcactagaaaacagcttcaacatc

SEQ ID NO: 567145 - DNA, 25 bp, Homo sapien
ctagaaaacagcttcaacatcctgt

SEQ ID NO: 567146 - DNA, 25 bp, Homo sapien
agcttcaacatcctgtgatttcatc

SEQ ID NO: 567147 - DNA, 25 bp, Homo sapien
gtggcctgcatggaaacgactgtca

SEQ ID NO: 567148 - DNA, 25 bp, Homo sapien
tggcctgcatggaaacgactgtcac

SEQ ID NO: 567149 - DNA, 25 bp, Homo sapien
tgcatggaaacgactgtcaccttgt

SEQ ID NO: 567150 - DNA, 25 bp, Homo sapien
gcatggaaacgactgtcaccttgtc

SEQ ID NO: 567151 - DNA, 25 bp, Homo sapien
catggaaacgactgtcaccttgtcc

SEQ ID NO: 567152 - DNA, 25 bp, Homo sapien
atggaaacgactgtcaccttgtcca

SEQ ID NO: 567153 - DNA, 25 bp, Homo sapien
tggaaacgactgtcaccttgtccac

SEQ ID NO: 567154 - DNA, 25 bp, Homo sapien
aaacgactgtcaccttgtccaccaa

SEQ ID NO: 567155 - DNA, 25 bp, Homo sapien
tgtcaccttgtccaccaacgcggag

SEQ ID NO: 567156 - DNA, 25 bp, Homo sapien
gtcaccttgtccaccaacgcggagt

SEQ ID NO: 567157 - DNA, 25 bp, Homo sapien
ccaacgcggagtccacctccttcaa

SEQ ID NO: 567158 - DNA, 25 bp, Homo sapien
gaggaaagactactctgacaagagt

SEQ ID NO: 567159 - DNA, 25 bp, Homo sapien
ctctgacaagagttaagctagaaag

SEQ ID NO: 567160 - DNA, 25 bp, Homo sapien
aagagaatgaactagagccaagaac

SEQ ID NO: 567161 - DNA, 25 bp, Homo sapien
gaactagagccaagaacatcctata

SEQ ID NO: 567162 - DNA, 25 bp, Homo sapien
gagccaagaacatcctataaaactt

SEQ ID NO: 567163 - DNA, 25 bp, Homo sapien
gaacatcctataaaacttctataga

SEQ ID NO: 567164 - DNA, 25 bp, Homo sapien
ctatagagagatgacgcatggcagt

SEQ ID NO: 567165 - DNA, 25 bp, Homo sapien
tgaatatgaaaggactgataggacc

SEQ ID NO: 567166 - DNA, 25 bp, Homo sapien
gataggacctagtgacaaactgcat

SEQ ID NO: 567167 - DNA, 25 bp, Homo sapien
ggacctagtgacaaactgcatgtta

SEQ ID NO: 567168 - DNA, 25 bp, Homo sapien
gtgacaaactgcatgttagaagtta

SEQ ID NO: 567169 - DNA, 25 bp, Homo sapien
ggagttctggcgtttggcacaaagt

SEQ ID NO: 567170 - DNA, 25 bp, Homo sapien
agttctggcgtttggcacaaagtcc

SEQ ID NO: 567171 - DNA, 25 bp, Homo sapien
tctggcgtttggcacaaagtcccct

SEQ ID NO: 567172 - DNA, 25 bp, Homo sapien
tgcctgtttggagctcagtgctaga

SEQ ID NO: 567173 - DNA, 25 bp, Homo sapien
gctcagtgctagaccaggtcccctg

SEQ ID NO: 567174 - DNA, 25 bp, Homo sapien
tcccctgccccgagctttgtttttg

SEQ ID NO: 567175 - DNA, 25 bp, Homo sapien
ccaggctgggcccagtgaaaaggag

SEQ ID NO: 567176 - DNA, 25 bp, Homo sapien
gaggggaacaattctcacgtgtttg

SEQ ID NO: 567177 - DNA, 25 bp, Homo sapien
ctcacgtgtttggtgcttagagacc

SEQ ID NO: 567178 - DNA, 25 bp, Homo sapien
cgtgtttggtgcttagagacctgcc

SEQ ID NO: 567179 - DNA, 25 bp, Homo sapien
tgcttagagacctgcccggggcgtt

SEQ ID NO: 567180 - DNA, 25 bp, Homo sapien
aagagcagcacagacttcttaactg

SEQ ID NO: 567181 - DNA, 25 bp, Homo sapien
agagcagcacagacttcttaactga

SEQ ID NO: 567182 - DNA, 25 bp, Homo sapien
gagcagcacagacttcttaactgag

SEQ ID NO: 567183 - DNA, 25 bp, Homo sapien
agcagcacagacttcttaactgagc

SEQ ID NO: 567184 - DNA, 25 bp, Homo sapien
gcagcacagacttcttaactgagct

SEQ ID NO: 567185 - DNA, 25 bp, Homo sapien
gcacagacttcttaactgagctttc

SEQ ID NO: 567186 - DNA, 25 bp, Homo sapien
cttcttaactgagctttctgtaaac

SEQ ID NO: 567187 - DNA, 25 bp, Homo sapien
ttcttaactgagctttctgtaaaca

SEQ ID NO: 567188 - DNA, 25 bp, Homo sapien
ttaactgagctttctgtaaacagga

SEQ ID NO: 567189 - DNA, 25 bp, Homo sapien
ttccctcccttcgtctgtatgtatg

SEQ ID NO: 567190 - DNA, 25 bp, Homo sapien
tccctcccttcgtctgtatgtatgt

SEQ ID NO: 567191 - DNA, 25 bp, Homo sapien
aaagtcacaacatcctgagagtagt

SEQ ID NO: 567192 - DNA, 25 bp, Homo sapien
tagtgaggaagtggtgaccctaata

SEQ ID NO: 567193 - DNA, 25 bp, Homo sapien
gaccctaatagaagatttgacccag

SEQ ID NO: 567194 - DNA, 25 bp, Homo sapien
aggaagcgggagacattgcctcaaa

SEQ ID NO: 567195 - DNA, 25 bp, Homo sapien
ggagacattgcctcaaagtccgaaa

SEQ ID NO: 567196 - DNA, 25 bp, Homo sapien
ttgcctcaaagtccgaaagtaaatt

SEQ ID NO: 567197 - DNA, 25 bp, Homo sapien
ttcctcaaaagaaggcaatttactg

SEQ ID NO: 567198 - DNA, 25 bp, Homo sapien
gcaatttactgctaaagaggagtct

SEQ ID NO: 567199 - DNA, 25 bp, Homo sapien
ttgggactgggtttgaatcagccct

SEQ ID NO: 567200 - DNA, 25 bp, Homo sapien
tgaatcagccctgccatttactgtg

SEQ ID NO: 567201 - DNA, 25 bp, Homo sapien
tttgggcaagctgtgtaaactctca

SEQ ID NO: 567202 - DNA, 25 bp, Homo sapien
ggtgctgagctgtgttgatcaactg

SEQ ID NO: 567203 - DNA, 25 bp, Homo sapien
gtgttgatcaactgaagcccgtgac

SEQ ID NO: 567204 - DNA, 25 bp, Homo sapien
tgatcaactgaagcccgtgacgtct

SEQ ID NO: 567205 - DNA, 25 bp, Homo sapien
gtgacgtctcatccttgcagttgga

SEQ ID NO: 567206 - DNA, 25 bp, Homo sapien
gtctcatccttgcagttggagcaaa

SEQ ID NO: 567207 - DNA, 25 bp, Homo sapien
tccttgcagttggagcaaatctcaa

SEQ ID NO: 567208 - DNA, 25 bp, Homo sapien
aaaggcaaagccagtgttaaggaga

SEQ ID NO: 567209 - DNA, 25 bp, Homo sapien
gagagggaaatcagacttcatcttt

SEQ ID NO: 567210 - DNA, 25 bp, Homo sapien
cagacttcatctttcgatgggagaa

SEQ ID NO: 567211 - DNA, 25 bp, Homo sapien
gccactggcagagaatccataggtt

SEQ ID NO: 567212 - DNA, 25 bp, Homo sapien
cagagaatccataggtttgctaagg

SEQ ID NO: 567213 - DNA, 25 bp, Homo sapien
gatccaagtttgtcttcttatccat

SEQ ID NO: 567214 - DNA, 25 bp, Homo sapien
ttgtcttcttatccatcaccatgct

SEQ ID NO: 567215 - DNA, 25 bp, Homo sapien
accatgctccctgaaagcctttttg

SEQ ID NO: 567216 - DNA, 25 bp, Homo sapien
gaagtgggtgctggatttattagat

SEQ ID NO: 567217 - DNA, 25 bp, Homo sapien
atttattagatattgggttcctgga

SEQ ID NO: 567218 - DNA, 25 bp, Homo sapien
tgggttcctggattaagatgacttc

SEQ ID NO: 567219 - DNA, 25 bp, Homo sapien
gatgacttcctcacatagcttggag

SEQ ID NO: 567220 - DNA, 25 bp, Homo sapien
cacatagcttggagtctgcagtttc

SEQ ID NO: 567221 - DNA, 25 bp, Homo sapien
cattttagtgcgctgtgctttgtat

SEQ ID NO: 567222 - DNA, 25 bp, Homo sapien
gcgctgtgctttgtataagtggtct

SEQ ID NO: 567223 - DNA, 25 bp, Homo sapien
tataagtggtctttctatgggcagt

SEQ ID NO: 567224 - DNA, 25 bp, Homo sapien
aaagtcacaacatcctgagagtagt

SEQ ID NO: 567225 - DNA, 25 bp, Homo sapien
aagtcacaacatcctgagagtagtg

SEQ ID NO: 567226 - DNA, 25 bp, Homo sapien
gtcacaacatcctgagagtagtgag

SEQ ID NO: 567227 - DNA, 25 bp, Homo sapien
cacaacatcctgagagtagtgagga

SEQ ID NO: 567228 - DNA, 25 bp, Homo sapien
tagtgaggaagtggtgaccctaata

SEQ ID NO: 567229 - DNA, 25 bp, Homo sapien
tgaggaagtggtgaccctaatagaa

SEQ ID NO: 567230 - DNA, 25 bp, Homo sapien
gaagtggtgaccctaatagaagatt

SEQ ID NO: 567231 - DNA, 25 bp, Homo sapien
gtggtgaccctaatagaagatttga

SEQ ID NO: 567232 - DNA, 25 bp, Homo sapien
gaccctaatagaagatttgacccag

SEQ ID NO: 567233 - DNA, 25 bp, Homo sapien
ccctaatagaagatttgacccagat

SEQ ID NO: 567234 - DNA, 25 bp, Homo sapien
taatagaagatttgacccagatgct

SEQ ID NO: 567235 - DNA, 25 bp, Homo sapien
agcctcgtgataaactacgacccaa

SEQ ID NO: 567236 - DNA, 25 bp, Homo sapien
gtgataaactacgacccaagctggg

SEQ ID NO: 567237 - DNA, 25 bp, Homo sapien
ataatatgcgcaagctttaactgag

SEQ ID NO: 567238 - DNA, 25 bp, Homo sapien
atgcgcaagctttaactgagcagtg

SEQ ID NO: 567239 - DNA, 25 bp, Homo sapien
ttaactgagcagtgggatggtgtaa

SEQ ID NO: 567240 - DNA, 25 bp, Homo sapien
tgaggggctctacaaacttttagtt

SEQ ID NO: 567241 - DNA, 25 bp, Homo sapien
aagtcgcggcagcatccttccagtc

SEQ ID NO: 567242 - DNA, 25 bp, Homo sapien
ggcagcatccttccagtcggccagt

SEQ ID NO: 567243 - DNA, 25 bp, Homo sapien
ccttgctgcagttcatgaaaactgg

SEQ ID NO: 567244 - DNA, 25 bp, Homo sapien
gttcatgaaaactggcactattcta

SEQ ID NO: 567245 - DNA, 25 bp, Homo sapien
tattctatggcttcccccaaataac

SEQ ID NO: 567246 - DNA, 25 bp, Homo sapien
ctaggtgtctacatttagttaagtc

SEQ ID NO: 567247 - DNA, 25 bp, Homo sapien
taggtgtctacatttagttaagtct

SEQ ID NO: 567248 - DNA, 25 bp, Homo sapien
ctacatttagttaagtcttagtctg

SEQ ID NO: 567249 - DNA, 25 bp, Homo sapien
tacatttagttaagtcttagtctga

SEQ ID NO: 567250 - DNA, 25 bp, Homo sapien
acatttagttaagtcttagtctgag

SEQ ID NO: 567251 - DNA, 25 bp, Homo sapien
catttagttaagtcttagtctgagt

SEQ ID NO: 567252 - DNA, 25 bp, Homo sapien
atttagttaagtcttagtctgagtt

SEQ ID NO: 567253 - DNA, 25 bp, Homo sapien
tctttgtctatatatttgttaaaat

SEQ ID NO: 567254 - DNA, 25 bp, Homo sapien
ctttgtctatatatttgttaaaata

SEQ ID NO: 567255 - DNA, 25 bp, Homo sapien
gcgcgggcccttcagtaaaagccat

SEQ ID NO: 567256 - DNA, 25 bp, Homo sapien
taaaagccatttatccgtgtgccga

SEQ ID NO: 567257 - DNA, 25 bp, Homo sapien
aaagccatttatccgtgtgccgacc

SEQ ID NO: 567258 - DNA, 25 bp, Homo sapien
atttatccgtgtgccgaccgctgtc

SEQ ID NO: 567259 - DNA, 25 bp, Homo sapien
tcctccgagctgctagctgacaaat

SEQ ID NO: 567260 - DNA, 25 bp, Homo sapien
gagctgctagctgacaaatacaatt

SEQ ID NO: 567261 - DNA, 25 bp, Homo sapien
tgctagctgacaaatacaattctga

SEQ ID NO: 567262 - DNA, 25 bp, Homo sapien
acattagaaaatggcgcaaaatcgt

SEQ ID NO: 567263 - DNA, 25 bp, Homo sapien
ggcgcaaaatcgttaggtcccagga

SEQ ID NO: 567264 - DNA, 25 bp, Homo sapien
caaaatcgttaggtcccaggagaga

SEQ ID NO: 567265 - DNA, 25 bp, Homo sapien
atcgttaggtcccaggagagaatgt

SEQ ID NO: 567266 - DNA, 25 bp, Homo sapien
ccaggattagccagtcatatttttt

SEQ ID NO: 567267 - DNA, 25 bp, Homo sapien
caggattagccagtcatattttttc

SEQ ID NO: 567268 - DNA, 25 bp, Homo sapien
acaattgagatggtagtcttctgct

SEQ ID NO: 567269 - DNA, 25 bp, Homo sapien
caattgagatggtagtcttctgctg

SEQ ID NO: 567270 - DNA, 25 bp, Homo sapien
aattgagatggtagtcttctgctgg

SEQ ID NO: 567271 - DNA, 25 bp, Homo sapien
attgagatggtagtcttctgctggt

SEQ ID NO: 567272 - DNA, 25 bp, Homo sapien
agtcttctgctggtagtttgaagag

SEQ ID NO: 567273 - DNA, 25 bp, Homo sapien
gtcttctgctggtagtttgaagaga

SEQ ID NO: 567274 - DNA, 25 bp, Homo sapien
ttctgctggtagtttgaagagagga

SEQ ID NO: 567275 - DNA, 25 bp, Homo sapien
ctgctggtagtttgaagagaggata

SEQ ID NO: 567276 - DNA, 25 bp, Homo sapien
ctggtagtttgaagagaggatatgt

SEQ ID NO: 567277 - DNA, 25 bp, Homo sapien
gaaattatctacatacatattctga

SEQ ID NO: 567278 - DNA, 25 bp, Homo sapien
ttatctacatacatattctgatggg

SEQ ID NO: 567279 - DNA, 25 bp, Homo sapien
atctacatacatattctgatgggat

SEQ ID NO: 567280 - DNA, 25 bp, Homo sapien
ctacatacatattctgatgggattt

SEQ ID NO: 567281 - DNA, 25 bp, Homo sapien
catacatattctgatgggatttgtg

SEQ ID NO: 567282 - DNA, 25 bp, Homo sapien
acatattctgatgggatttgtgtaa

SEQ ID NO: 567283 - DNA, 25 bp, Homo sapien
acaaacccatattacacacacatac

SEQ ID NO: 567284 - DNA, 25 bp, Homo sapien
gcactcacgtgcgtagaagtagatc

SEQ ID NO: 567285 - DNA, 25 bp, Homo sapien
cactcacgtgcgtagaagtagatct

SEQ ID NO: 567286 - DNA, 25 bp, Homo sapien
actcacgtgcgtagaagtagatcta

SEQ ID NO: 567287 - DNA, 25 bp, Homo sapien
tcacgtgcgtagaagtagatctagg

SEQ ID NO: 567288 - DNA, 25 bp, Homo sapien
agaagcgaatcgaacactgtgaatc

SEQ ID NO: 567289 - DNA, 25 bp, Homo sapien
agcgaatcgaacactgtgaatcaca

SEQ ID NO: 567290 - DNA, 25 bp, Homo sapien
ctgtgaatcacagtttcagatataa

SEQ ID NO: 567291 - DNA, 25 bp, Homo sapien
gatagatacaatcacaacaatataa

SEQ ID NO: 567292 - DNA, 25 bp, Homo sapien
aatttgaatgttgtagcttgtgagc

SEQ ID NO: 567293 - DNA, 25 bp, Homo sapien
gttgtagcttgtgagctttctcaaa

SEQ ID NO: 567294 - DNA, 25 bp, Homo sapien
agcttgtgagctttctcaaatctaa

SEQ ID NO: 567295 - DNA, 25 bp, Homo sapien
ctcttaactttctttcatctagata

SEQ ID NO: 567296 - DNA, 25 bp, Homo sapien
aactttctttcatctagataaggca

SEQ ID NO: 567297 - DNA, 25 bp, Homo sapien
atctagataaggcatttccttttct

SEQ ID NO: 567298 - DNA, 25 bp, Homo sapien
tttccttttcttccaataccaagca

SEQ ID NO: 567299 - DNA, 25 bp, Homo sapien
ttttacaacagagactggcttccat

SEQ ID NO: 567300 - DNA, 25 bp, Homo sapien
tggcttccattcactgatcagacat

SEQ ID NO: 567301 - DNA, 25 bp, Homo sapien
agttgttatgatgagggtcctcagg

SEQ ID NO: 567302 - DNA, 25 bp, Homo sapien
gggtcctcaggaaagacaatacagt

SEQ ID NO: 567303 - DNA, 25 bp, Homo sapien
gacaatacagtcagccgagaaatac

SEQ ID NO: 567304 - DNA, 25 bp, Homo sapien
tacaattttctttgtctactgttgt

SEQ ID NO: 567305 - DNA, 25 bp, Homo sapien
ttcctttacacggaccattgaaata

SEQ ID NO: 567306 - DNA, 25 bp, Homo sapien
gaaatatatacttaaccaccagcaa

SEQ ID NO: 567307 - DNA, 25 bp, Homo sapien
ttaaccaccagcaaaactcctatta

SEQ ID NO: 567308 - DNA, 25 bp, Homo sapien
aagagtgaacaccaggcaaagtgat

SEQ ID NO: 567309 - DNA, 25 bp, Homo sapien
atgaatttccaggatttttgttgta

SEQ ID NO: 567310 - DNA, 25 bp, Homo sapien
ggcagccaagatcccaggaccatgt

SEQ ID NO: 567311 - DNA, 25 bp, Homo sapien
gattctttaagggagctttctcaaa

SEQ ID NO: 567312 - DNA, 25 bp, Homo sapien
gaagaggataaaggaagccccagaa

SEQ ID NO: 567313 - DNA, 25 bp, Homo sapien
taaaggaagccccagaaactccaga

SEQ ID NO: 567314 - DNA, 25 bp, Homo sapien
aaactccagagactgaaccgtaaga

SEQ ID NO: 567315 - DNA, 25 bp, Homo sapien
gactgaaccgtaagaagaccaactg

SEQ ID NO: 567316 - DNA, 25 bp, Homo sapien
gaccaactgggacaaagggcccgct

SEQ ID NO: 567317 - DNA, 25 bp, Homo sapien
acaaagggcccgcttgtcctggctc

SEQ ID NO: 567318 - DNA, 25 bp, Homo sapien
gaaaagaattgtccttatcaaaaag

SEQ ID NO: 567319 - DNA, 25 bp, Homo sapien
agattctcaggtcttaattaggaat

SEQ ID NO: 567320 - DNA, 25 bp, Homo sapien
gggaaataaacattcttatgacagt

SEQ ID NO: 567321 - DNA, 25 bp, Homo sapien
aagcttccaagaaacttgttgaact

SEQ ID NO: 567322 - DNA, 25 bp, Homo sapien
tccaagaaacttgttgaacttttga

SEQ ID NO: 567323 - DNA, 25 bp, Homo sapien
gaacttttgaaagatttccatacgc

SEQ ID NO: 567324 - DNA, 25 bp, Homo sapien
gaaagatttccatacgcttcaaagg

SEQ ID NO: 567325 - DNA, 25 bp, Homo sapien
gatttccatacgcttcaaagggaca

SEQ ID NO: 567326 - DNA, 25 bp, Homo sapien
ccatacgcttcaaagggacaaagaa

SEQ ID NO: 567327 - DNA, 25 bp, Homo sapien
ttgctttcaacaagtacaaggcctc

SEQ ID NO: 567328 - DNA, 25 bp, Homo sapien
tttcaacaagtacaaggcctctaat

SEQ ID NO: 567329 - DNA, 25 bp, Homo sapien
caacaagtacaaggcctctaatttt

SEQ ID NO: 567330 - DNA, 25 bp, Homo sapien
gttttgttctttcaaattatcattg

SEQ ID NO: 567331 - DNA, 25 bp, Homo sapien
attatcattgcaaatagtacatata

SEQ ID NO: 567332 - DNA, 25 bp, Homo sapien
gggaccacaagtttcatcactccaa

SEQ ID NO: 567333 - DNA, 25 bp, Homo sapien
atcactccaaattaaacacccacaa

SEQ ID NO: 567334 - DNA, 25 bp, Homo sapien
aacacccacaactgcaattgctggg

SEQ ID NO: 567335 - DNA, 25 bp, Homo sapien
gcaattgctgggatctatggtctat

SEQ ID NO: 567336 - DNA, 25 bp, Homo sapien
atggtctatgcatatctggttttta

SEQ ID NO: 567337 - DNA, 25 bp, Homo sapien
atgtgtacactgagtgcccacagaa

SEQ ID NO: 567338 - DNA, 25 bp, Homo sapien
gcccacagaagctagtaaggatact

SEQ ID NO: 567339 - DNA, 25 bp, Homo sapien
gagaaggttaatcagcagcaaaaaa

SEQ ID NO: 567340 - DNA, 25 bp, Homo sapien
ttgattaaccatgtctggtcttttc

SEQ ID NO: 567341 - DNA, 25 bp, Homo sapien
acaactgtcaactattttccacgag

SEQ ID NO: 567342 - DNA, 25 bp, Homo sapien
ttccacgagtggctctatgatcctc

SEQ ID NO: 567343 - DNA, 25 bp, Homo sapien
agagcttagtgccacggaagccata

SEQ ID NO: 567344 - DNA, 25 bp, Homo sapien
ggaagccatagtatgctaccaattt

SEQ ID NO: 567345 - DNA, 25 bp, Homo sapien
aagccattagagtttgagtgcagaa

SEQ ID NO: 567346 - DNA, 25 bp, Homo sapien
aatattccagctgttgtgcctatga

SEQ ID NO: 567347 - DNA, 25 bp, Homo sapien
tgttgtgcctatgattattttctcc

SEQ ID NO: 567348 - DNA, 25 bp, Homo sapien
ttctcctcttgcttggtttattgca

SEQ ID NO: 567349 - DNA, 25 bp, Homo sapien
ttggtttattgcagtcaccccttac

SEQ ID NO: 567350 - DNA, 25 bp, Homo sapien
cagtcaccccttactagatacattg

SEQ ID NO: 567351 - DNA, 25 bp, Homo sapien
gaaatcatcagctacaaggtttgtc

SEQ ID NO: 567352 - DNA, 25 bp, Homo sapien
gattgaggtggttctgtagctgcat

SEQ ID NO: 567353 - DNA, 25 bp, Homo sapien
gtagctgcatggacaattctgtatc

SEQ ID NO: 567354 - DNA, 25 bp, Homo sapien
gaaaagttgtcagatctggtgccca

SEQ ID NO: 567355 - DNA, 25 bp, Homo sapien
tctggtgcccagagaagaaaaattg

SEQ ID NO: 567356 - DNA, 25 bp, Homo sapien
gtgcccagagaagaaaaattgagtt

SEQ ID NO: 567357 - DNA, 25 bp, Homo sapien
gagtttgtagttattattgctgctt

SEQ ID NO: 567358 - DNA, 25 bp, Homo sapien
gtagttattattgctgcttggtgtt

SEQ ID NO: 567359 - DNA, 25 bp, Homo sapien
attattgctgcttggtgttaggtga

SEQ ID NO: 567360 - DNA, 25 bp, Homo sapien
attgctgcttggtgttaggtgaaga

SEQ ID NO: 567361 - DNA, 25 bp, Homo sapien
ctgcttggtgttaggtgaagatgaa

SEQ ID NO: 567362 - DNA, 25 bp, Homo sapien
gtgaagatgaataagagcgacctaa

SEQ ID NO: 567363 - DNA, 25 bp, Homo sapien
agatgaataagagcgacctaatgaa

SEQ ID NO: 567364 - DNA, 25 bp, Homo sapien
agagcgacctaatgaaagaatgagt

SEQ ID NO: 567365 - DNA, 25 bp, Homo sapien
attactgggcagaaataggattatg

SEQ ID NO: 567366 - DNA, 25 bp, Homo sapien
gctgaaactcagaagctaagtgact

SEQ ID NO: 567367 - DNA, 25 bp, Homo sapien
ctcaaggtcacagaatatggtatgt

SEQ ID NO: 567368 - DNA, 25 bp, Homo sapien
ggtcacagaatatggtatgtatcag

SEQ ID NO: 567369 - DNA, 25 bp, Homo sapien
ggtatgtatcagatttgatgcccaa

SEQ ID NO: 567370 - DNA, 25 bp, Homo sapien
gatttgatgcccaatttagtgctct

SEQ ID NO: 567371 - DNA, 25 bp, Homo sapien
tgatgcccaatttagtgctctttct

SEQ ID NO: 567372 - DNA, 25 bp, Homo sapien
atgcccaatttagtgctctttctac

SEQ ID NO: 567373 - DNA, 25 bp, Homo sapien
gcccaatttagtgctctttctactc

SEQ ID NO: 567374 - DNA, 25 bp, Homo sapien
tgctctttctactcagccagtggtt

SEQ ID NO: 567375 - DNA, 25 bp, Homo sapien
gctctttctactcagccagtggttc

SEQ ID NO: 567376 - DNA, 25 bp, Homo sapien
gtctgcaaacatggaaacctggtct

SEQ ID NO: 567377 - DNA, 25 bp, Homo sapien
agatgtccaaagtaaactgtctgtg

SEQ ID NO: 567378 - DNA, 25 bp, Homo sapien
gaatgacatttgagccctggaccta

SEQ ID NO: 567379 - DNA, 25 bp, Homo sapien
tgagccctggacctaaactccaaat

SEQ ID NO: 567380 - DNA, 25 bp, Homo sapien
taaactccaaatccaagctctttcc

SEQ ID NO: 567381 - DNA, 25 bp, Homo sapien
aagctctttcccactgtgaccttgg

SEQ ID NO: 567382 - DNA, 25 bp, Homo sapien
agaagccaataacagactcatccac

SEQ ID NO: 567383 - DNA, 25 bp, Homo sapien
gactcatccacactatgaggctgtg

SEQ ID NO: 567384 - DNA, 25 bp, Homo sapien
tgaggctgtgcataaggtcatgtat

SEQ ID NO: 567385 - DNA, 25 bp, Homo sapien
gtaaaactacttgctttgttgatca

SEQ ID NO: 567386 - DNA, 25 bp, Homo sapien
gctttgttgatcattctgtcccaga

SEQ ID NO: 567387 - DNA, 25 bp, Homo sapien
tttaaaaagccaatatgcagcctag

SEQ ID NO: 567388 - DNA, 25 bp, Homo sapien
ttaaaaagccaatatgcagcctagc

SEQ ID NO: 567389 - DNA, 25 bp, Homo sapien
taaaaagccaatatgcagcctagcg

SEQ ID NO: 567390 - DNA, 25 bp, Homo sapien
aaaaagccaatatgcagcctagcgc

SEQ ID NO: 567391 - DNA, 25 bp, Homo sapien
aaaagccaatatgcagcctagcgcg

SEQ ID NO: 567392 - DNA, 25 bp, Homo sapien
aaagccaatatgcagcctagcgcgg

SEQ ID NO: 567393 - DNA, 25 bp, Homo sapien
aagccaatatgcagcctagcgcggt

SEQ ID NO: 567394 - DNA, 25 bp, Homo sapien
agccaatatgcagcctagcgcggtg

SEQ ID NO: 567395 - DNA, 25 bp, Homo sapien
gccaatatgcagcctagcgcggtgg

SEQ ID NO: 567396 - DNA, 25 bp, Homo sapien
ccaatatgcagcctagcgcggtggc

SEQ ID NO: 567397 - DNA, 25 bp, Homo sapien
gtcattgtatgatgtcttcaggcca

SEQ ID NO: 567398 - DNA, 25 bp, Homo sapien
gtatgatgtcttcaggccattgatc

SEQ ID NO: 567399 - DNA, 25 bp, Homo sapien
gtcttcaggccattgatcattcatg

SEQ ID NO: 567400 - DNA, 25 bp, Homo sapien
aggccattgatcattcatgttattc

SEQ ID NO: 567401 - DNA, 25 bp, Homo sapien
gatcattcatgttattcacttagag

SEQ ID NO: 567402 - DNA, 25 bp, Homo sapien
atgttattcacttagagactctgtc

SEQ ID NO: 567403 - DNA, 25 bp, Homo sapien
gagactctgtcggaactttgtggga

SEQ ID NO: 567404 - DNA, 25 bp, Homo sapien
ctgtcggaactttgtgggattctta

SEQ ID NO: 567405 - DNA, 25 bp, Homo sapien
gaactttgtgggattcttaaaaatg

SEQ ID NO: 567406 - DNA, 25 bp, Homo sapien
gaagtgcttgaagatcatgtgcaga

SEQ ID NO: 567407 - DNA, 25 bp, Homo sapien
gcttgaagatcatgtgcagaacaat

SEQ ID NO: 567408 - DNA, 25 bp, Homo sapien
cactctgcccaggcaggcggatcac

SEQ ID NO: 567409 - DNA, 25 bp, Homo sapien
tcacttggtcaggagtaggagttca

SEQ ID NO: 567410 - DNA, 25 bp, Homo sapien
cacttggtcaggagtaggagttcaa

SEQ ID NO: 567411 - DNA, 25 bp, Homo sapien
acttggtcaggagtaggagttcaag

SEQ ID NO: 567412 - DNA, 25 bp, Homo sapien
cttggtcaggagtaggagttcaaga

SEQ ID NO: 567413 - DNA, 25 bp, Homo sapien
ttggtcaggagtaggagttcaagac

SEQ ID NO: 567414 - DNA, 25 bp, Homo sapien
tggtcaggagtaggagttcaagacc

SEQ ID NO: 567415 - DNA, 25 bp, Homo sapien
gcatggccagtatggtgaaatcttg

SEQ ID NO: 567416 - DNA, 25 bp, Homo sapien
catggccagtatggtgaaatcttgt

SEQ ID NO: 567417 - DNA, 25 bp, Homo sapien
atggccagtatggtgaaatcttgtc

SEQ ID NO: 567418 - DNA, 25 bp, Homo sapien
ggccagtatggtgaaatcttgtctc

SEQ ID NO: 567419 - DNA, 25 bp, Homo sapien
gcagactgtgaagtaagtggtacca

SEQ ID NO: 567420 - DNA, 25 bp, Homo sapien
gtaagtggtaccagccacaactgaa

SEQ ID NO: 567421 - DNA, 25 bp, Homo sapien
agccacaactgaatatccatctggg

SEQ ID NO: 567422 - DNA, 25 bp, Homo sapien
aaataaaattgcactcgtcttagag

SEQ ID NO: 567423 - DNA, 25 bp, Homo sapien
attgcactcgtcttagagatccaaa

SEQ ID NO: 567424 - DNA, 25 bp, Homo sapien
tagagatccaaatcaacttcagatg

SEQ ID NO: 567425 - DNA, 25 bp, Homo sapien
tcaacttcagatggattaaaacttt

SEQ ID NO: 567426 - DNA, 25 bp, Homo sapien
tcttggagacaacctgtgccatctg

SEQ ID NO: 567427 - DNA, 25 bp, Homo sapien
tggagacaacctgtgccatctggag

SEQ ID NO: 567428 - DNA, 25 bp, Homo sapien
ggagcagcccagcatgttctggaaa

SEQ ID NO: 567429 - DNA, 25 bp, Homo sapien
tctggaaaaggtagggctccccaag

SEQ ID NO: 567430 - DNA, 25 bp, Homo sapien
gcctcagggagaagtgagtgcctca

SEQ ID NO: 567431 - DNA, 25 bp, Homo sapien
gagtgcctcattcaatacatcgttc

SEQ ID NO: 567432 - DNA, 25 bp, Homo sapien
gaaaagtcattggtagcaaagctat

SEQ ID NO: 567433 - DNA, 25 bp, Homo sapien
gatgtggaaaaagccctagacgtca

SEQ ID NO: 567434 - DNA, 25 bp, Homo sapien
aagccctagacgtcattaactccag

SEQ ID NO: 567435 - DNA, 25 bp, Homo sapien
gacgtcattaactccagtgattatc

SEQ ID NO: 567436 - DNA, 25 bp, Homo sapien
tgattatcaggatgtggttcacaga

SEQ ID NO: 567437 - DNA, 25 bp, Homo sapien
aagatgcctgtgaattcacccgtgc

SEQ ID NO: 567438 - DNA, 25 bp, Homo sapien
gtgaattcacccgtgcttaattttt

SEQ ID NO: 567439 - DNA, 25 bp, Homo sapien
ttttttccctcaattatcaagatag

SEQ ID NO: 567440 - DNA, 25 bp, Homo sapien
aagtacaactcttaccatgtgggta

SEQ ID NO: 567441 - DNA, 25 bp, Homo sapien
tggcaaaaccccatcactaaaaata

SEQ ID NO: 567442 - DNA, 25 bp, Homo sapien
tagcaccactgcacttctagttgac

SEQ ID NO: 567443 - DNA, 25 bp, Homo sapien
agcaccactgcacttctagttgaca

SEQ ID NO: 567444 - DNA, 25 bp, Homo sapien
gcaccactgcacttctagttgacag

SEQ ID NO: 567445 - DNA, 25 bp, Homo sapien
caccactgcacttctagttgacaga

SEQ ID NO: 567446 - DNA, 25 bp, Homo sapien
cactgcacttctagttgacagagtg

SEQ ID NO: 567447 - DNA, 25 bp, Homo sapien
actgcacttctagttgacagagtga

SEQ ID NO: 567448 - DNA, 25 bp, Homo sapien
gcacttctagttgacagagtgagac

SEQ ID NO: 567449 - DNA, 25 bp, Homo sapien
cacttctagttgacagagtgagact

SEQ ID NO: 567450 - DNA, 25 bp, Homo sapien
gttgcaaaccatcggacaagggcat

SEQ ID NO: 567451 - DNA, 25 bp, Homo sapien
gcaaaccatcggacaagggcatgga

SEQ ID NO: 567452 - DNA, 25 bp, Homo sapien
aaaccatcggacaagggcatggagt

SEQ ID NO: 567453 - DNA, 25 bp, Homo sapien
gcacacactcacagcagagttcgca

SEQ ID NO: 567454 - DNA, 25 bp, Homo sapien
acacactcacagcagagttcgcact

SEQ ID NO: 567455 - DNA, 25 bp, Homo sapien
acactcacagcagagttcgcactgg

SEQ ID NO: 567456 - DNA, 25 bp, Homo sapien
actcacagcagagttcgcactggga

SEQ ID NO: 567457 - DNA, 25 bp, Homo sapien
ctcacagcagagttcgcactgggaa

SEQ ID NO: 567458 - DNA, 25 bp, Homo sapien
tacaaggacgaggaaagcggccccg

SEQ ID NO: 567459 - DNA, 25 bp, Homo sapien
caaggacgaggaaagcggccccgct

SEQ ID NO: 567460 - DNA, 25 bp, Homo sapien
gggcgggagtccgagcgcgcgagga

SEQ ID NO: 567461 - DNA, 25 bp, Homo sapien
cacgtgatttgcttagactgtttcc

SEQ ID NO: 567462 - DNA, 25 bp, Homo sapien
tgatttgcttagactgtttccactt

SEQ ID NO: 567463 - DNA, 25 bp, Homo sapien
gactgtttccacttatactgtgtga

SEQ ID NO: 567464 - DNA, 25 bp, Homo sapien
gtttccacttatactgtgtgacaag

SEQ ID NO: 567465 - DNA, 25 bp, Homo sapien
tactgtgtgacaagactcaatgatc

SEQ ID NO: 567466 - DNA, 25 bp, Homo sapien
gtgacaagactcaatgatcggcagt

SEQ ID NO: 567467 - DNA, 25 bp, Homo sapien
atgatcggcagtttgttcacgaccc

SEQ ID NO: 567468 - DNA, 25 bp, Homo sapien
tcggcagtttgttcacgaccctcaa

SEQ ID NO: 567469 - DNA, 25 bp, Homo sapien
agtttgttcacgaccctcaacttgg

SEQ ID NO: 567470 - DNA, 25 bp, Homo sapien
ttgttcacgaccctcaacttggcta

SEQ ID NO: 567471 - DNA, 25 bp, Homo sapien
aacttggctactccctgccttgtgt

SEQ ID NO: 567472 - DNA, 25 bp, Homo sapien
gaggcaacatcaaaaaccagcaaat

SEQ ID NO: 567473 - DNA, 25 bp, Homo sapien
ttaattttgtcccacagcgttgcta

SEQ ID NO: 567474 - DNA, 25 bp, Homo sapien
tcccacagcgttgctagggtggcat

SEQ ID NO: 567475 - DNA, 25 bp, Homo sapien
ttgctagggtggcatggctccccat

SEQ ID NO: 567476 - DNA, 25 bp, Homo sapien
gggtccatcctatacttccatggga

SEQ ID NO: 567477 - DNA, 25 bp, Homo sapien
ctatacttccatgggactccctatg

SEQ ID NO: 567478 - DNA, 25 bp, Homo sapien
atgggactccctatggctgaaggcc

SEQ ID NO: 567479 - DNA, 25 bp, Homo sapien
atggctgaaggccttatgagtcaaa

SEQ ID NO: 567480 - DNA, 25 bp, Homo sapien
gtcaaaggacttatagccaattgat

SEQ ID NO: 567481 - DNA, 25 bp, Homo sapien
ttgttctaggccaggtaagaatgga

SEQ ID NO: 567482 - DNA, 25 bp, Homo sapien
gatatggacatgcatttattacctc

SEQ ID NO: 567483 - DNA, 25 bp, Homo sapien
agcgtcctgggctccgcaggcacaa

SEQ ID NO: 567484 - DNA, 25 bp, Homo sapien
gggctccgcaggcacaatttttaaa

SEQ ID NO: 567485 - DNA, 25 bp, Homo sapien
ccgcaggcacaatttttaaaccaga

SEQ ID NO: 567486 - DNA, 25 bp, Homo sapien
ggcacaatttttaaaccagaggcga

SEQ ID NO: 567487 - DNA, 25 bp, Homo sapien
aaccagaggcgaaatccgagtcccg

SEQ ID NO: 567488 - DNA, 25 bp, Homo sapien
gggagggagcgtggccgcctagccg

SEQ ID NO: 567489 - DNA, 25 bp, Homo sapien
cgcgaggccgcctggtgagttccag

SEQ ID NO: 567490 - DNA, 25 bp, Homo sapien
cggcgctctcgggtgtcttttggcc

SEQ ID NO: 567491 - DNA, 25 bp, Homo sapien
tctcgggtgtcttttggccgcggca

SEQ ID NO: 567492 - DNA, 25 bp, Homo sapien
ttttggccgcggcaggaacggagct

SEQ ID NO: 567493 - DNA, 25 bp, Homo sapien
cggcaggaacggagctgggcgctca

SEQ ID NO: 567494 - DNA, 25 bp, Homo sapien
aggaagcgggagacattgcctcaaa

SEQ ID NO: 567495 - DNA, 25 bp, Homo sapien
gggagacattgcctcaaagtccgaa

SEQ ID NO: 567496 - DNA, 25 bp, Homo sapien
acattgcctcaaagtccgaaagtaa

SEQ ID NO: 567497 - DNA, 25 bp, Homo sapien
tcaaagtccgaaagtaaattcctca

SEQ ID NO: 567498 - DNA, 25 bp, Homo sapien
ttcctcaaaagaaggcaatttactg

SEQ ID NO: 567499 - DNA, 25 bp, Homo sapien
ggcaatttactgctaaagaggagtc

SEQ ID NO: 567500 - DNA, 25 bp, Homo sapien
actgctaaagaggagtctgaggtta

SEQ ID NO: 567501 - DNA, 25 bp, Homo sapien
ttgggactgggtttgaatcagccct

SEQ ID NO: 567502 - DNA, 25 bp, Homo sapien
gggtttgaatcagccctgccattta

SEQ ID NO: 567503 - DNA, 25 bp, Homo sapien
tgaatcagccctgccatttactgtg

SEQ ID NO: 567504 - DNA, 25 bp, Homo sapien
tttgggcaagctgtgtaaactctca

SEQ ID NO: 567505 - DNA, 25 bp, Homo sapien
aaaaccaaacagtaagcttcctatg

SEQ ID NO: 567506 - DNA, 25 bp, Homo sapien
gtaagcttcctatgacacagctcca

SEQ ID NO: 567507 - DNA, 25 bp, Homo sapien
tcctatgacacagctccagtggaag

SEQ ID NO: 567508 - DNA, 25 bp, Homo sapien
gaagaagagaaagcaccacctcatt

SEQ ID NO: 567509 - DNA, 25 bp, Homo sapien
aaagcaccacctcattactgcaagg

SEQ ID NO: 567510 - DNA, 25 bp, Homo sapien
acctcattactgcaaggtggaaaca

SEQ ID NO: 567511 - DNA, 25 bp, Homo sapien
aaacagaagtccaagagagattctt

SEQ ID NO: 567512 - DNA, 25 bp, Homo sapien
tctttgttaccacttgacatggatg

SEQ ID NO: 567513 - DNA, 25 bp, Homo sapien
gacatggatgggaatctaggcactc

SEQ ID NO: 567514 - DNA, 25 bp, Homo sapien
gggaatctaggcactccctgatgga

SEQ ID NO: 567515 - DNA, 25 bp, Homo sapien
agaaggactgcctcattatgctcac

SEQ ID NO: 567516 - DNA, 25 bp, Homo sapien
aaaatgtgcccgaggccacaaagca

SEQ ID NO: 567517 - DNA, 25 bp, Homo sapien
aagccagcttttccaaagtctaagt

SEQ ID NO: 567518 - DNA, 25 bp, Homo sapien
aaagtctaagtcttgctccttccct

SEQ ID NO: 567519 - DNA, 25 bp, Homo sapien
cttccctgtaccttgcaagctttca

SEQ ID NO: 567520 - DNA, 25 bp, Homo sapien
gctttcatccctcagtggataccag

SEQ ID NO: 567521 - DNA, 25 bp, Homo sapien
atccctcagtggataccagggctga

SEQ ID NO: 567522 - DNA, 25 bp, Homo sapien
ataccagggctgaggaaactgattt

SEQ ID NO: 567523 - DNA, 25 bp, Homo sapien
gatttgtaacacgttcctgtcacag

SEQ ID NO: 567524 - DNA, 25 bp, Homo sapien
gttcctgtcacagagttttggctct

SEQ ID NO: 567525 - DNA, 25 bp, Homo sapien
gagttttggctctacatttaagaca

SEQ ID NO: 567526 - DNA, 25 bp, Homo sapien
gacataaaacttggcctggcgcagt

SEQ ID NO: 567527 - DNA, 25 bp, Homo sapien
ggtgagtgtgtagcgggcttggtgt

SEQ ID NO: 567528 - DNA, 25 bp, Homo sapien
tgtgtagcgggcttggtgttgataa

SEQ ID NO: 567529 - DNA, 25 bp, Homo sapien
gtgtagcgggcttggtgttgataag

SEQ ID NO: 567530 - DNA, 25 bp, Homo sapien
tgtagcgggcttggtgttgataaga

SEQ ID NO: 567531 - DNA, 25 bp, Homo sapien
gtagcgggcttggtgttgataagag

SEQ ID NO: 567532 - DNA, 25 bp, Homo sapien
cgggcttggtgttgataagagttaa

SEQ ID NO: 567533 - DNA, 25 bp, Homo sapien
gggcttggtgttgataagagttaaa

SEQ ID NO: 567534 - DNA, 25 bp, Homo sapien
ggcttggtgttgataagagttaaaa

SEQ ID NO: 567535 - DNA, 25 bp, Homo sapien
agttaaaaagagcatggccaggcgc

SEQ ID NO: 567536 - DNA, 25 bp, Homo sapien
gttaaaaagagcatggccaggcgca

SEQ ID NO: 567537 - DNA, 25 bp, Homo sapien
taaaaagagcatggccaggcgcagt

SEQ ID NO: 567538 - DNA, 25 bp, Homo sapien
ctgacacactcatttgggagtcaca

SEQ ID NO: 567539 - DNA, 25 bp, Homo sapien
gggagtcacagacacattttatctt

SEQ ID NO: 567540 - DNA, 25 bp, Homo sapien
ttatcttgtgaattgttccttgtac

SEQ ID NO: 567541 - DNA, 25 bp, Homo sapien
ttccttgtactgtattctgaaccaa

SEQ ID NO: 567542 - DNA, 25 bp, Homo sapien
tactgtattctgaaccaagatctgg

SEQ ID NO: 567543 - DNA, 25 bp, Homo sapien
ttctgaaccaagatctggaagccct

SEQ ID NO: 567544 - DNA, 25 bp, Homo sapien
tggaagccctccaacattttcaaaa

SEQ ID NO: 567545 - DNA, 25 bp, Homo sapien
aagccctccaacattttcaaaacag

SEQ ID NO: 567546 - DNA, 25 bp, Homo sapien
gcagcatcaggataataaacaccca

SEQ ID NO: 567547 - DNA, 25 bp, Homo sapien
ataaacacccaaacagctgacaaaa

SEQ ID NO: 567548 - DNA, 25 bp, Homo sapien
tgacaaaaacccaactgcctctgga

SEQ ID NO: 567549 - DNA, 25 bp, Homo sapien
gttctccagagaatacaatagcaga

SEQ ID NO: 567550 - DNA, 25 bp, Homo sapien
acaatagcagatgagcaggagacta

SEQ ID NO: 567551 - DNA, 25 bp, Homo sapien
caggagactaaagatgcagcagaag

SEQ ID NO: 567552 - DNA, 25 bp, Homo sapien
gaagaatgtaaagaaccctaatcaa

SEQ ID NO: 567553 - DNA, 25 bp, Homo sapien
gaaccctaatcaaggacttgctggg

SEQ ID NO: 567554 - DNA, 25 bp, Homo sapien
ctgggtgtgcttttcagaaagttgg

SEQ ID NO: 567555 - DNA, 25 bp, Homo sapien
atgcactgcagagactattctttat

SEQ ID NO: 567556 - DNA, 25 bp, Homo sapien
ttgacatttggagtcgctctttgtg

SEQ ID NO: 567557 - DNA, 25 bp, Homo sapien
ttgtggattatatttccttgatatt

SEQ ID NO: 567558 - DNA, 25 bp, Homo sapien
tttccttgatatttttgagacttgg

SEQ ID NO: 567559 - DNA, 25 bp, Homo sapien
ttgttcagtggtttttgctcattaa

SEQ ID NO: 567560 - DNA, 25 bp, Homo sapien
ctgttgtggtgcatgcagaaacttt

SEQ ID NO: 567561 - DNA, 25 bp, Homo sapien
gtggtgcatgcagaaacttttcctg

SEQ ID NO: 567562 - DNA, 25 bp, Homo sapien
gtgcatgcagaaacttttcctgttc

SEQ ID NO: 567563 - DNA, 25 bp, Homo sapien
ttcctgttcaacacacttatatggc

SEQ ID NO: 567564 - DNA, 25 bp, Homo sapien
gttcaacacacttatatggcactat

SEQ ID NO: 567565 - DNA, 25 bp, Homo sapien
aacacacttatatggcactatatag

SEQ ID NO: 567566 - DNA, 25 bp, Homo sapien
tatggcactatatagggatatacca

SEQ ID NO: 567567 - DNA, 25 bp, Homo sapien
atagggatataccaaatagctcagg

SEQ ID NO: 567568 - DNA, 25 bp, Homo sapien
caaatagctcaggtacatagtgaat

SEQ ID NO: 567569 - DNA, 25 bp, Homo sapien
gctcaggtacatagtgaatacaact

SEQ ID NO: 567570 - DNA, 25 bp, Homo sapien
gtgaatacaactttaacacttatat

SEQ ID NO: 567571 - DNA, 25 bp, Homo sapien
atgctggttatgatgagtttccttc

SEQ ID NO: 567572 - DNA, 25 bp, Homo sapien
gctggttatgatgagtttccttcct

SEQ ID NO: 567573 - DNA, 25 bp, Homo sapien
tggttatgatgagtttccttcctag

SEQ ID NO: 567574 - DNA, 25 bp, Homo sapien
gggaaatactccacaatctttgatg

SEQ ID NO: 567575 - DNA, 25 bp, Homo sapien
gaaatactccacaatctttgatgga

SEQ ID NO: 567576 - DNA, 25 bp, Homo sapien
tactccacaatctttgatggataaa

SEQ ID NO: 567577 - DNA, 25 bp, Homo sapien
ataaaagggcattcatgttggatga

SEQ ID NO: 567578 - DNA, 25 bp, Homo sapien
ggatgaggacaacaatatcaggcaa

SEQ ID NO: 567579 - DNA, 25 bp, Homo sapien
acaatatcaggcaaatgtatcagtg

SEQ ID NO: 567580 - DNA, 25 bp, Homo sapien
atcaggcaaatgtatcagtgaaata

SEQ ID NO: 567581 - DNA, 25 bp, Homo sapien
gtgaaatacgcagaactgtgcctgg

SEQ ID NO: 567582 - DNA, 25 bp, Homo sapien
gcctgctcttcagatgcggtggaga

SEQ ID NO: 567583 - DNA, 25 bp, Homo sapien
atgcggtggagataattcctgcaga

SEQ ID NO: 567584 - DNA, 25 bp, Homo sapien
ataattcctgcagagggagtgggta

SEQ ID NO: 567585 - DNA, 25 bp, Homo sapien
gagtgggtatctcgcagctcctctg

SEQ ID NO: 567586 - DNA, 25 bp, Homo sapien
agctcctctgcaaacaatttctggt

SEQ ID NO: 567587 - DNA, 25 bp, Homo sapien
gcaaacaatttctggtcactgagga

SEQ ID NO: 567588 - DNA, 25 bp, Homo sapien
gaagacagtcagagagagactcgca

SEQ ID NO: 567589 - DNA, 25 bp, Homo sapien
agagagactcgcaatagcactgatt

SEQ ID NO: 567590 - DNA, 25 bp, Homo sapien
gcactgattgcggatggactcgcta

SEQ ID NO: 567591 - DNA, 25 bp, Homo sapien
gatggactcgctaatgaggcagaga

SEQ ID NO: 567592 - DNA, 25 bp, Homo sapien
aggctgtcctgaaaaacgctaagaa

SEQ ID NO: 567593 - DNA, 25 bp, Homo sapien
aataagagtctaatgctggatacaa

SEQ ID NO: 567594 - DNA, 25 bp, Homo sapien
gtctaatgctggatacaaactcagt

SEQ ID NO: 567595 - DNA, 25 bp, Homo sapien
atgctggatacaaactcagtttatt

SEQ ID NO: 567596 - DNA, 25 bp, Homo sapien
cactgttctagaaccatggaggaat

SEQ ID NO: 567597 - DNA, 25 bp, Homo sapien
tgttctagaaccatggaggaatgaa

SEQ ID NO: 567598 - DNA, 25 bp, Homo sapien
gaggaatgaagactcccactgaaat

SEQ ID NO: 567599 - DNA, 25 bp, Homo sapien
tgaagactcccactgaaatgaatgt

SEQ ID NO: 567600 - DNA, 25 bp, Homo sapien
aagactcccactgaaatgaatgttc

SEQ ID NO: 567601 - DNA, 25 bp, Homo sapien
atttctggtgaatatgtgttcaatc

SEQ ID NO: 567602 - DNA, 25 bp, Homo sapien
gtgaatatgtgttcaatctgttatg

SEQ ID NO: 567603 - DNA, 25 bp, Homo sapien
atttctgttccataatttcagtagg

SEQ ID NO: 567604 - DNA, 25 bp, Homo sapien
tctctgcctgcacacatttgtgggt

SEQ ID NO: 567605 - DNA, 25 bp, Homo sapien
gcctgcacacatttgtgggtacaca

SEQ ID NO: 567606 - DNA, 25 bp, Homo sapien
gtgggtacacactatacacctatgt

SEQ ID NO: 567607 - DNA, 25 bp, Homo sapien
ggtacacactatacacctatgtggg

SEQ ID NO: 567608 - DNA, 25 bp, Homo sapien
ttaccttgtgtttggtcctaggaag

SEQ ID NO: 567609 - DNA, 25 bp, Homo sapien
gtcctaggaagggatcttggtgatc

SEQ ID NO: 567610 - DNA, 25 bp, Homo sapien
gggatcttggtgatcattccagccc

SEQ ID NO: 567611 - DNA, 25 bp, Homo sapien
gctctttcacctcaatggtgaagaa

SEQ ID NO: 567612 - DNA, 25 bp, Homo sapien
gaggtccagaaaggcaaggtgactt

SEQ ID NO: 567613 - DNA, 25 bp, Homo sapien
gtgacttgtcacaggtaacacagct

SEQ ID NO: 567614 - DNA, 25 bp, Homo sapien
acaggtaacacagctggctatggag

SEQ ID NO: 567615 - DNA, 25 bp, Homo sapien
atctggacgcacacagcatgactac

SEQ ID NO: 567616 - DNA, 25 bp, Homo sapien
tggacgcacacagcatgactactag

SEQ ID NO: 567617 - DNA, 25 bp, Homo sapien
ggacgcacacagcatgactactagt

SEQ ID NO: 567618 - DNA, 25 bp, Homo sapien
gacgcacacagcatgactactagtg

SEQ ID NO: 567619 - DNA, 25 bp, Homo sapien
cgcacacagcatgactactagtgct

SEQ ID NO: 567620 - DNA, 25 bp, Homo sapien
gcatgactactagtgctgagcagcc

SEQ ID NO: 567621 - DNA, 25 bp, Homo sapien
atgactactagtgctgagcagccac

SEQ ID NO: 567622 - DNA, 25 bp, Homo sapien
gactactagtgctgagcagccaccc

SEQ ID NO: 567623 - DNA, 25 bp, Homo sapien
gagcagccacccacagagggcatat

SEQ ID NO: 567624 - DNA, 25 bp, Homo sapien
agcagccacccacagagggcatatg

SEQ ID NO: 567625 - DNA, 25 bp, Homo sapien
agccacccacagagggcatatgcac

SEQ ID NO: 567626 - DNA, 25 bp, Homo sapien
cgccatgataaccaatatacagata

SEQ ID NO: 567627 - DNA, 25 bp, Homo sapien
attggaattcctttgcataggagaa

SEQ ID NO: 567628 - DNA, 25 bp, Homo sapien
gtttagtgcttattattttccagta

SEQ ID NO: 567629 - DNA, 25 bp, Homo sapien
ttccagtaaatatgcttcaaaccat

SEQ ID NO: 567630 - DNA, 25 bp, Homo sapien
atatgcttcaaaccatgagtacact

SEQ ID NO: 567631 - DNA, 25 bp, Homo sapien
atgagtacactattaggccctacaa

SEQ ID NO: 567632 - DNA, 25 bp, Homo sapien
cactattaggccctacaactttgtt

SEQ ID NO: 567633 - DNA, 25 bp, Homo sapien
agatgatttgcttcctataactgat

SEQ ID NO: 567634 - DNA, 25 bp, Homo sapien
gatttgcttcctataactgatgttg

SEQ ID NO: 567635 - DNA, 25 bp, Homo sapien
ctataactgatgttgttttgttcgt

SEQ ID NO: 567636 - DNA, 25 bp, Homo sapien
gttcgttttgctaatatatgtatct

SEQ ID NO: 567637 - DNA, 25 bp, Homo sapien
aaatattaatctactaacacagcat

SEQ ID NO: 567638 - DNA, 25 bp, Homo sapien
attaatctactaacacagcataggt

SEQ ID NO: 567639 - DNA, 25 bp, Homo sapien
taatctactaacacagcataggttt

SEQ ID NO: 567640 - DNA, 25 bp, Homo sapien
atctactaacacagcataggtttta

SEQ ID NO: 567641 - DNA, 25 bp, Homo sapien
ctactaacacagcataggttttatg

SEQ ID NO: 567642 - DNA, 25 bp, Homo sapien
aacacagcataggttttatgattac

SEQ ID NO: 567643 - DNA, 25 bp, Homo sapien
acagcataggttttatgattactgc

SEQ ID NO: 567644 - DNA, 25 bp, Homo sapien
agcataggttttatgattactgcaa

SEQ ID NO: 567645 - DNA, 25 bp, Homo sapien
ataggttttatgattactgcaattc

SEQ ID NO: 567646 - DNA, 25 bp, Homo sapien
taggttttatgattactgcaattca

SEQ ID NO: 567647 - DNA, 25 bp, Homo sapien
actgcaattcaaaagtcataataaa

SEQ ID NO: 567648 - DNA, 25 bp, Homo sapien
aacacagttttagtgagatgtcaac

SEQ ID NO: 567649 - DNA, 25 bp, Homo sapien
ctggcttttgttggttgttggattg

SEQ ID NO: 567650 - DNA, 25 bp, Homo sapien
aatgcatcttgttctgcttctaggc

SEQ ID NO: 567651 - DNA, 25 bp, Homo sapien
atcttgttctgcttctaggctgaaa

SEQ ID NO: 567652 - DNA, 25 bp, Homo sapien
tctaggctgaaaggtcactgaggca

SEQ ID NO: 567653 - DNA, 25 bp, Homo sapien
gagctgtttgtaccttgtatcccct

SEQ ID NO: 567654 - DNA, 25 bp, Homo sapien
tgtaccttgtatcccctggaatttt

SEQ ID NO: 567655 - DNA, 25 bp, Homo sapien
aacatttgtgtactcatagggtggt

SEQ ID NO: 567656 - DNA, 25 bp, Homo sapien
ggagatagtccgcagatggtctaaa

SEQ ID NO: 567657 - DNA, 25 bp, Homo sapien
ggtctaaagaatgccatgtgatact

SEQ ID NO: 567658 - DNA, 25 bp, Homo sapien
gccatgtgatactgtgagatgccaa

SEQ ID NO: 567659 - DNA, 25 bp, Homo sapien
gctgctgtttatgatcactttgcct

SEQ ID NO: 567660 - DNA, 25 bp, Homo sapien
tgtttatgatcactttgccttgcct

SEQ ID NO: 567661 - DNA, 25 bp, Homo sapien
ttatgatcactttgccttgcctctc

SEQ ID NO: 567662 - DNA, 25 bp, Homo sapien
ttgcctctctgggagccataattca

SEQ ID NO: 567663 - DNA, 25 bp, Homo sapien
tctctgggagccataattcaccaca

SEQ ID NO: 567664 - DNA, 25 bp, Homo sapien
ctgggagccataattcaccacatac

SEQ ID NO: 567665 - DNA, 25 bp, Homo sapien
aattcaccacatactggagataggc

SEQ ID NO: 567666 - DNA, 25 bp, Homo sapien
catactggagataggctgggtgttc

SEQ ID NO: 567667 - DNA, 25 bp, Homo sapien
tggagataggctgggtgttcttttc

SEQ ID NO: 567668 - DNA, 25 bp, Homo sapien
tgtacacaaatgtgctagccccttc

SEQ ID NO: 567669 - DNA, 25 bp, Homo sapien
tacacaaatgtgctagccccttctt

SEQ ID NO: 567670 - DNA, 25 bp, Homo sapien
cctatttagggactcatgggagcag

SEQ ID NO: 567671 - DNA, 25 bp, Homo sapien
actcatgggagcagacgttgcctga

SEQ ID NO: 567672 - DNA, 25 bp, Homo sapien
agcagacgttgcctgacggtctcag

SEQ ID NO: 567673 - DNA, 25 bp, Homo sapien
gacgttgcctgacggtctcagccag

SEQ ID NO: 567674 - DNA, 25 bp, Homo sapien
agcctgaccctgtgtctgccgatgc

SEQ ID NO: 567675 - DNA, 25 bp, Homo sapien
agcacgagttgcctctcccagcttg

SEQ ID NO: 567676 - DNA, 25 bp, Homo sapien
ttgagtccgggagcatcgcccagca

SEQ ID NO: 567677 - DNA, 25 bp, Homo sapien
gggctcagtcatactcgctgcatgc

SEQ ID NO: 567678 - DNA, 25 bp, Homo sapien
agtcatactcgctgcatgctctgga

SEQ ID NO: 567679 - DNA, 25 bp, Homo sapien
gcatgctctggaagatctgcaccac

SEQ ID NO: 567680 - DNA, 25 bp, Homo sapien
tggaagatctgcaccacactccggg

SEQ ID NO: 567681 - DNA, 25 bp, Homo sapien
ggcctctacatctcttggtagttta

SEQ ID NO: 567682 - DNA, 25 bp, Homo sapien
catctcttggtagtttaaagctcta

SEQ ID NO: 567683 - DNA, 25 bp, Homo sapien
agtctcaactagcagtttctctcac

SEQ ID NO: 567684 - DNA, 25 bp, Homo sapien
gcagtttctctcactggtagatcta

SEQ ID NO: 567685 - DNA, 25 bp, Homo sapien
actattcaatgggttctgtttcttt

SEQ ID NO: 567686 - DNA, 25 bp, Homo sapien
aactgttccagttaattcacggtca

SEQ ID NO: 567687 - DNA, 25 bp, Homo sapien
tccagttaattcacggtcactatga

SEQ ID NO: 567688 - DNA, 25 bp, Homo sapien
gaaggaagtacacccaggccagtta

SEQ ID NO: 567689 - DNA, 25 bp, Homo sapien
tacacccaggccagttatcaggcaa

SEQ ID NO: 567690 - DNA, 25 bp, Homo sapien
gttatcaggcaagcttgccagacat

SEQ ID NO: 567691 - DNA, 25 bp, Homo sapien
gccagacatcaatccagcaagaaaa

SEQ ID NO: 567692 - DNA, 25 bp, Homo sapien
aagagaagcaagagccaccctgcag

SEQ ID NO: 567693 - DNA, 25 bp, Homo sapien
agagaagcaagagccaccctgcagt

SEQ ID NO: 567694 - DNA, 25 bp, Homo sapien
agaagcaagagccaccctgcagtca

SEQ ID NO: 567695 - DNA, 25 bp, Homo sapien
gaagcaagagccaccctgcagtcaa

SEQ ID NO: 567696 - DNA, 25 bp, Homo sapien
aagcaagagccaccctgcagtcaat

SEQ ID NO: 567697 - DNA, 25 bp, Homo sapien
accctgcagtcaatccccgaagaaa

SEQ ID NO: 567698 - DNA, 25 bp, Homo sapien
cctgcagtcaatccccgaagaaaac

SEQ ID NO: 567699 - DNA, 25 bp, Homo sapien
gtcaatccccgaagaaaacgaagat

SEQ ID NO: 567700 - DNA, 25 bp, Homo sapien
gaagaaaacgaagatatcacctttt

SEQ ID NO: 567701 - DNA, 25 bp, Homo sapien
aaaagcgaaaaaccagagtacattg

SEQ ID NO: 567702 - DNA, 25 bp, Homo sapien
gcgaaaaaccagagtacattggaga

SEQ ID NO: 567703 - DNA, 25 bp, Homo sapien
aacaccatccatcagcaagaggcgg

SEQ ID NO: 567704 - DNA, 25 bp, Homo sapien
cttgcttatgccacaggaacagcat

SEQ ID NO: 567705 - DNA, 25 bp, Homo sapien
ggaacagcatgcacatggcctgtac

SEQ ID NO: 567706 - DNA, 25 bp, Homo sapien
ttggctctcctcacagcaagctggt

SEQ ID NO: 567707 - DNA, 25 bp, Homo sapien
caagctggtcttgcaggatcgtgag

SEQ ID NO: 567708 - DNA, 25 bp, Homo sapien
aggatcgtgagcagtaactccctct

SEQ ID NO: 567709 - DNA, 25 bp, Homo sapien
gtaactccctctcctgtacatgtgt

SEQ ID NO: 567710 - DNA, 25 bp, Homo sapien
tgtccacagttctctgccattagaa

SEQ ID NO: 567711 - DNA, 25 bp, Homo sapien
gccattagaacttaagctcctgagg

SEQ ID NO: 567712 - DNA, 25 bp, Homo sapien
gcacaggcctgttttttcatttttg

SEQ ID NO: 567713 - DNA, 25 bp, Homo sapien
catttttgtatcttggacacagcag

SEQ ID NO: 567714 - DNA, 25 bp, Homo sapien
ggacatgacaactttgggcagcact

SEQ ID NO: 567715 - DNA, 25 bp, Homo sapien
tggacacccagatgctgactctagc

SEQ ID NO: 567716 - DNA, 25 bp, Homo sapien
gactctagccaataccctgcagagg

SEQ ID NO: 567717 - DNA, 25 bp, Homo sapien
aggctggcaggtacacctgtccctg

SEQ ID NO: 567718 - DNA, 25 bp, Homo sapien
aggcacatcactgtacctcatgtat

SEQ ID NO: 567719 - DNA, 25 bp, Homo sapien
ggcaattggtgagactaagcctgaa

SEQ ID NO: 567720 - DNA, 25 bp, Homo sapien
agcaaacacagctcaaaacttctga

SEQ ID NO: 567721 - DNA, 25 bp, Homo sapien
aaacttctgaaacatctcacaggac

SEQ ID NO: 567722 - DNA, 25 bp, Homo sapien
atctcacaggacacatggtctgaca

SEQ ID NO: 567723 - DNA, 25 bp, Homo sapien
ggtctgacaactctttaggtctgtg

SEQ ID NO: 567724 - DNA, 25 bp, Homo sapien
ggtctgtgaatttattaatgtgcca

SEQ ID NO: 567725 - DNA, 25 bp, Homo sapien
aaagcagctccttagcagtgcaggt

SEQ ID NO: 567726 - DNA, 25 bp, Homo sapien
ggaactgaaatctgactttgaccta

SEQ ID NO: 567727 - DNA, 25 bp, Homo sapien
gactttgacctatgagtctcagaca

SEQ ID NO: 567728 - DNA, 25 bp, Homo sapien
aactaagggcttactcttctgagtg

SEQ ID NO: 567729 - DNA, 25 bp, Homo sapien
ttctgagtgcccatctgaaggtacc

SEQ ID NO: 567730 - DNA, 25 bp, Homo sapien
tgaaggtacctgaacgtgtcgggtt

SEQ ID NO: 567731 - DNA, 25 bp, Homo sapien
tgtcgggtttcccactagaccatga

SEQ ID NO: 567732 - DNA, 25 bp, Homo sapien
actagaccatgatctccttggaagc

SEQ ID NO: 567733 - DNA, 25 bp, Homo sapien
atttgcagagcctagcacagcatta

SEQ ID NO: 567734 - DNA, 25 bp, Homo sapien
gcattaggcctggagtgagagtttc

SEQ ID NO: 567735 - DNA, 25 bp, Homo sapien
gagtttcctaaacacttgtctgaca

SEQ ID NO: 567736 - DNA, 25 bp, Homo sapien
tcgtctgaacccaggtgattctgca

SEQ ID NO: 567737 - DNA, 25 bp, Homo sapien
tgaacccaggtgattctgcactcta

SEQ ID NO: 567738 - DNA, 25 bp, Homo sapien
ctgcactctacttgggctctgtctc

SEQ ID NO: 567739 - DNA, 25 bp, Homo sapien
tctacttgggctctgtctcaaaaca

SEQ ID NO: 567740 - DNA, 25 bp, Homo sapien
attaatctactaacacagcataggt

SEQ ID NO: 567741 - DNA, 25 bp, Homo sapien
aatctactaacacagcataggtttt

SEQ ID NO: 567742 - DNA, 25 bp, Homo sapien
ctactaacacagcataggttttatg

SEQ ID NO: 567743 - DNA, 25 bp, Homo sapien
ataggttttatgattactgcaattc

SEQ ID NO: 567744 - DNA, 25 bp, Homo sapien
actgcaattcaaaagtcataataaa

SEQ ID NO: 567745 - DNA, 25 bp, Homo sapien
ggtgcatgcagaaacttttcctgtt

SEQ ID NO: 567746 - DNA, 25 bp, Homo sapien
gttcaacacacttatatggcactat

SEQ ID NO: 567747 - DNA, 25 bp, Homo sapien
agctatacacactaatttacatgat

SEQ ID NO: 567748 - DNA, 25 bp, Homo sapien
atgaaatggctgtgattatccccat

SEQ ID NO: 567749 - DNA, 25 bp, Homo sapien
atttatggtatgcaaccctttggtg

SEQ ID NO: 567750 - DNA, 25 bp, Homo sapien
gcaaccctttggtgaacaaccctat

SEQ ID NO: 567751 - DNA, 25 bp, Homo sapien
atattgatgttcttcctacgtctaa

SEQ ID NO: 567752 - DNA, 25 bp, Homo sapien
gatgttcttcctacgtctaagaaaa

SEQ ID NO: 567753 - DNA, 25 bp, Homo sapien
atgttatttccattcccaagatgtt

SEQ ID NO: 567754 - DNA, 25 bp, Homo sapien
atttccattcccaagatgttagtag

SEQ ID NO: 567755 - DNA, 25 bp, Homo sapien
attcccaagatgttagtagagacga

SEQ ID NO: 567756 - DNA, 25 bp, Homo sapien
gacgaagatttttcaatttgtctcc

SEQ ID NO: 567757 - DNA, 25 bp, Homo sapien
ttcaatttgtctccttgattttgtt

SEQ ID NO: 567758 - DNA, 25 bp, Homo sapien
acctgactgtcagtgtaagtctggg

SEQ ID NO: 567759 - DNA, 25 bp, Homo sapien
tgtcagtgtaagtctgggagctgcc

SEQ ID NO: 567760 - DNA, 25 bp, Homo sapien
tgtaagtctgggagctgccagatgt

SEQ ID NO: 567761 - DNA, 25 bp, Homo sapien
gctgccagatgtcctagcattgtga

SEQ ID NO: 567762 - DNA, 25 bp, Homo sapien
agatgtcctagcattgtgaccacag

SEQ ID NO: 567763 - DNA, 25 bp, Homo sapien
gtcctagcattgtgaccacaggttt

SEQ ID NO: 567764 - DNA, 25 bp, Homo sapien
agcattgtgaccacaggtttaggag

SEQ ID NO: 567765 - DNA, 25 bp, Homo sapien
tttaggagggacttctaagtgaagg

SEQ ID NO: 567766 - DNA, 25 bp, Homo sapien
ggaggagtagccctttggccaaact

SEQ ID NO: 567767 - DNA, 25 bp, Homo sapien
gagtagccctttggccaaactctgg

SEQ ID NO: 567768 - DNA, 25 bp, Homo sapien
gccaaactctggcatttaccgaaat

SEQ ID NO: 567769 - DNA, 25 bp, Homo sapien
agaagcgaatcgaacactgtgaatc

SEQ ID NO: 567770 - DNA, 25 bp, Homo sapien
agcgaatcgaacactgtgaatcaca

SEQ ID NO: 567771 - DNA, 25 bp, Homo sapien
gaagcacaaatatgatagatacaat

SEQ ID NO: 567772 - DNA, 25 bp, Homo sapien
gatagatacaatcacaacaatataa

SEQ ID NO: 567773 - DNA, 25 bp, Homo sapien
aatttgaatgttgtagcttgtgagc

SEQ ID NO: 567774 - DNA, 25 bp, Homo sapien
gttgtagcttgtgagctttctcaaa

SEQ ID NO: 567775 - DNA, 25 bp, Homo sapien
agcttgtgagctttctcaaatctaa

SEQ ID NO: 567776 - DNA, 25 bp, Homo sapien
ctcttaactttctttcatctagata

SEQ ID NO: 567777 - DNA, 25 bp, Homo sapien
aactttctttcatctagataaggca

SEQ ID NO: 567778 - DNA, 25 bp, Homo sapien
ctttcatctagataaggcatttcct

SEQ ID NO: 567779 - DNA, 25 bp, Homo sapien
atctagataaggcatttccttttct

SEQ ID NO: 567780 - DNA, 25 bp, Homo sapien
taaacacttacttgtttaagctgtt

SEQ ID NO: 567781 - DNA, 25 bp, Homo sapien
ttgttactcacagccaagtacagtc

SEQ ID NO: 567782 - DNA, 25 bp, Homo sapien
gttactcacagccaagtacagtcct

SEQ ID NO: 567783 - DNA, 25 bp, Homo sapien
actcacagccaagtacagtcctaat

SEQ ID NO: 567784 - DNA, 25 bp, Homo sapien
tcacagccaagtacagtcctaatgg

SEQ ID NO: 567785 - DNA, 25 bp, Homo sapien
agccaagtacagtcctaatggatac

SEQ ID NO: 567786 - DNA, 25 bp, Homo sapien
agtacagtcctaatggatacagcaa

SEQ ID NO: 567787 - DNA, 25 bp, Homo sapien
agtcctaatggatacagcaaatatt

SEQ ID NO: 567788 - DNA, 25 bp, Homo sapien
ggatacagcaaatattctcattaat

SEQ ID NO: 567789 - DNA, 25 bp, Homo sapien
atttgaaacttatgattactgggca

SEQ ID NO: 567790 - DNA, 25 bp, Homo sapien
tgaaacttatgattactgggcagaa

SEQ ID NO: 567791 - DNA, 25 bp, Homo sapien
gccccttcttggtgaccaggctaat

SEQ ID NO: 567792 - DNA, 25 bp, Homo sapien
tggtgaccaggctaattcctcagtg

SEQ ID NO: 567793 - DNA, 25 bp, Homo sapien
tgctgcctctcattagagggattcc

SEQ ID NO: 567794 - DNA, 25 bp, Homo sapien
gagggattccctaagcactatttgc

SEQ ID NO: 567795 - DNA, 25 bp, Homo sapien
gattccctaagcactatttgcttga

SEQ ID NO: 567796 - DNA, 25 bp, Homo sapien
agcactatttgcttgacaaattttc

SEQ ID NO: 567797 - DNA, 25 bp, Homo sapien
agaagcctttgctaattttcccaag

SEQ ID NO: 567798 - DNA, 25 bp, Homo sapien
gcctttgctaattttcccaagttgg

SEQ ID NO: 567799 - DNA, 25 bp, Homo sapien
tcccaagttggcctaagagtccact

SEQ ID NO: 567800 - DNA, 25 bp, Homo sapien
gttggcctaagagtccactgtgaac

SEQ ID NO: 567801 - DNA, 25 bp, Homo sapien
gcctaagagtccactgtgaactgca

SEQ ID NO: 567802 - DNA, 25 bp, Homo sapien
gaagaagttagagctttataactat

SEQ ID NO: 567803 - DNA, 25 bp, Homo sapien
aaagatcatatctaacctacagaaa

SEQ ID NO: 567804 - DNA, 25 bp, Homo sapien
tatctaacctacagaaatctaccta

SEQ ID NO: 567805 - DNA, 25 bp, Homo sapien
acctacagaaatctacctaattatg

SEQ ID NO: 567806 - DNA, 25 bp, Homo sapien
tttttgaagaagcacccctctttca

SEQ ID NO: 567807 - DNA, 25 bp, Homo sapien
gaagaagcacccctctttcatgtat

SEQ ID NO: 567808 - DNA, 25 bp, Homo sapien
aagcacccctctttcatgtattaaa

SEQ ID NO: 567809 - DNA, 25 bp, Homo sapien
tggaagattgtacagcataaagcta

SEQ ID NO: 567810 - DNA, 25 bp, Homo sapien
cattgtcctgaagaataggttacaa

SEQ ID NO: 567811 - DNA, 25 bp, Homo sapien
aataaactccatttggtgctgaaag

SEQ ID NO: 567812 - DNA, 25 bp, Homo sapien
actccatttggtgctgaaagttgtg

SEQ ID NO: 567813 - DNA, 25 bp, Homo sapien
gaagtcaagatcaaagctcacactg

SEQ ID NO: 567814 - DNA, 25 bp, Homo sapien
aaagctcacactgcaaatattgtgc

SEQ ID NO: 567815 - DNA, 25 bp, Homo sapien
ctttctgcttttgatgtgggccaac

SEQ ID NO: 567816 - DNA, 25 bp, Homo sapien
atgtgggccaacctccattgctggt

SEQ ID NO: 567817 - DNA, 25 bp, Homo sapien
agatactagcaatgttttcttatcc

SEQ ID NO: 567818 - DNA, 25 bp, Homo sapien
gaaggatgcctgactcctacagagt

SEQ ID NO: 567819 - DNA, 25 bp, Homo sapien
acacaaggagggtgcctgagccatt

SEQ ID NO: 567820 - DNA, 25 bp, Homo sapien
ggtgcctgagccatttctacagact

SEQ ID NO: 567821 - DNA, 25 bp, Homo sapien
caagaggttctaaccagcccaggtc

SEQ ID NO: 567822 - DNA, 25 bp, Homo sapien
gtcacttccacttttgagacctgtg

SEQ ID NO: 567823 - DNA, 25 bp, Homo sapien
gagacctgtggacacgttatgatgt

SEQ ID NO: 567824 - DNA, 25 bp, Homo sapien
ctgactcaaatcgtgagccaatata

SEQ ID NO: 567825 - DNA, 25 bp, Homo sapien
gactcaaatcgtgagccaatataaa

SEQ ID NO: 567826 - DNA, 25 bp, Homo sapien
atcgtgagccaatataaaatgtgac

SEQ ID NO: 567827 - DNA, 25 bp, Homo sapien
gagccaatataaaatgtgacatgag

SEQ ID NO: 567828 - DNA, 25 bp, Homo sapien
aatgtgacatgaggccggacacggt

SEQ ID NO: 567829 - DNA, 25 bp, Homo sapien
atcacttgagcgattcgagagtcga

SEQ ID NO: 567830 - DNA, 25 bp, Homo sapien
cacttgagcgattcgagagtcgaga

SEQ ID NO: 567831 - DNA, 25 bp, Homo sapien
gagtcgagaggctggtcgggagttc

SEQ ID NO: 567832 - DNA, 25 bp, Homo sapien
ccagcatttggatcctccacttgaa

SEQ ID NO: 567833 - DNA, 25 bp, Homo sapien
atttggatcctccacttgaacccga

SEQ ID NO: 567834 - DNA, 25 bp, Homo sapien
ttggatcctccacttgaacccgaga

SEQ ID NO: 567835 - DNA, 25 bp, Homo sapien
tggacatcgtgcacatcagcatctt

SEQ ID NO: 567836 - DNA, 25 bp, Homo sapien
atcgtgcacatcagcatcttctacc

SEQ ID NO: 567837 - DNA, 25 bp, Homo sapien
agcctcacggacacgggccgctttg

SEQ ID NO: 567838 - DNA, 25 bp, Homo sapien
tgcttcgtctaccacatgtaccggg

SEQ ID NO: 567839 - DNA, 25 bp, Homo sapien
tctaccacatgtaccgggagcgcgg

SEQ ID NO: 567840 - DNA, 25 bp, Homo sapien
acactggtttccttgggtcttctca

SEQ ID NO: 567841 - DNA, 25 bp, Homo sapien
gtcttctcaggaccgtagtgcctac

SEQ ID NO: 567842 - DNA, 25 bp, Homo sapien
agtgcctaccagacgattgactcag

SEQ ID NO: 567843 - DNA, 25 bp, Homo sapien
gattgactcagcagaggcgcccgca

SEQ ID NO: 567844 - DNA, 25 bp, Homo sapien
agaggcgcccgcagatccctttgca

SEQ ID NO: 567845 - DNA, 25 bp, Homo sapien
tcccagagggcaggagtcaagatgc

SEQ ID NO: 567846 - DNA, 25 bp, Homo sapien
cagaattggcaaatgtgggagctaa

SEQ ID NO: 567847 - DNA, 25 bp, Homo sapien
gtgggagctaaccaagtcactgtaa

SEQ ID NO: 567848 - DNA, 25 bp, Homo sapien
gagctaaccaagtcactgtaagaaa

SEQ ID NO: 567849 - DNA, 25 bp, Homo sapien
aggaccatacaactcattgtcacgc

SEQ ID NO: 567850 - DNA, 25 bp, Homo sapien
atacaactcattgtcacgccagcga

SEQ ID NO: 567851 - DNA, 25 bp, Homo sapien
aactcattgtcacgccagcgatcat

SEQ ID NO: 567852 - DNA, 25 bp, Homo sapien
attgtcacgccagcgatcatgccaa

SEQ ID NO: 567853 - DNA, 25 bp, Homo sapien
agcgatcatgccaaccaactgtcca

SEQ ID NO: 567854 - DNA, 25 bp, Homo sapien
atgccaaccaactgtccattcacat

SEQ ID NO: 567855 - DNA, 25 bp, Homo sapien
aactgtccattcacattcctggctg

SEQ ID NO: 567856 - DNA, 25 bp, Homo sapien
cattcctggctggagttacagggca

SEQ ID NO: 567857 - DNA, 25 bp, Homo sapien
actaattggagttttgacgctgttt

SEQ ID NO: 567858 - DNA, 25 bp, Homo sapien
tttgacgctgttttacatctcggta

SEQ ID NO: 567859 - DNA, 25 bp, Homo sapien
tacatctcggtaattttattttcgg

SEQ ID NO: 567860 - DNA, 25 bp, Homo sapien
aatcagcctctgtattgtgcacgtc

SEQ ID NO: 567861 - DNA, 25 bp, Homo sapien
tgcacgtcagaactgcacagagaaa

SEQ ID NO: 567862 - DNA, 25 bp, Homo sapien
gagaaaattccccagtattccaagc

SEQ ID NO: 567863 - DNA, 25 bp, Homo sapien
aattccccagtattccaagccggtg

SEQ ID NO: 567864 - DNA, 25 bp, Homo sapien
cggtgcgcccctgtgcagaagaaaa

SEQ ID NO: 567865 - DNA, 25 bp, Homo sapien
aagaaaacagatctacgtcagccag

SEQ ID NO: 567866 - DNA, 25 bp, Homo sapien
gggcaaagcctcagttccactgcct

SEQ ID NO: 567867 - DNA, 25 bp, Homo sapien
aagaggtttacattgctgcatttca

SEQ ID NO: 567868 - DNA, 25 bp, Homo sapien
accaggaaagctgagataaaccaca

SEQ ID NO: 567869 - DNA, 25 bp, Homo sapien
ggaaagctgagataaaccacaggcc

SEQ ID NO: 567870 - DNA, 25 bp, Homo sapien
aaagctgagataaaccacaggccat

SEQ ID NO: 567871 - DNA, 25 bp, Homo sapien
aagctgagataaaccacaggccatt

SEQ ID NO: 567872 - DNA, 25 bp, Homo sapien
agctgagataaaccacaggccattt

SEQ ID NO: 567873 - DNA, 25 bp, Homo sapien
gctgagataaaccacaggccatttg

SEQ ID NO: 567874 - DNA, 25 bp, Homo sapien
tgagataaaccacaggccatttgaa

SEQ ID NO: 567875 - DNA, 25 bp, Homo sapien
gagataaaccacaggccatttgaag

SEQ ID NO: 567876 - DNA, 25 bp, Homo sapien
agataaaccacaggccatttgaagg

SEQ ID NO: 567877 - DNA, 25 bp, Homo sapien
taaaccacaggccatttgaaggaac

SEQ ID NO: 567878 - DNA, 25 bp, Homo sapien
aaaccacaggccatttgaaggaact

SEQ ID NO: 567879 - DNA, 25 bp, Homo sapien
aaagaagctctgttttggtcttact

SEQ ID NO: 567880 - DNA, 25 bp, Homo sapien
agaagctctgttttggtcttacttc

SEQ ID NO: 567881 - DNA, 25 bp, Homo sapien
aagctctgttttggtcttacttcaa

SEQ ID NO: 567882 - DNA, 25 bp, Homo sapien
gctctgttttggtcttacttcaaaa

SEQ ID NO: 567883 - DNA, 25 bp, Homo sapien
ttcaaaaccacaagttctagccagg

SEQ ID NO: 567884 - DNA, 25 bp, Homo sapien
aaaaccacaagttctagccaggtgc

SEQ ID NO: 567885 - DNA, 25 bp, Homo sapien
aaccacaagttctagccaggtgcgg

SEQ ID NO: 567886 - DNA, 25 bp, Homo sapien
gagcccacgagatcaaggctatact

SEQ ID NO: 567887 - DNA, 25 bp, Homo sapien
cccacgagatcaaggctatactaag

SEQ ID NO: 567888 - DNA, 25 bp, Homo sapien
cgagatcaaggctatactaagctgt

SEQ ID NO: 567889 - DNA, 25 bp, Homo sapien
gatcaaggctatactaagctgtgat

SEQ ID NO: 567890 - DNA, 25 bp, Homo sapien
taggcccaagttttgattcctgttt

SEQ ID NO: 567891 - DNA, 25 bp, Homo sapien
attcctgttttcaccaagtcgcaag

SEQ ID NO: 567892 - DNA, 25 bp, Homo sapien
aagtcgcaagtcctaatcgtagcaa

SEQ ID NO: 567893 - DNA, 25 bp, Homo sapien
ttccttcctgcatagtgggatccaa

SEQ ID NO: 567894 - DNA, 25 bp, Homo sapien
agtgggatccaagtcaggctgtcct

SEQ ID NO: 567895 - DNA, 25 bp, Homo sapien
aagtcaggctgtccttgttagccag

SEQ ID NO: 567896 - DNA, 25 bp, Homo sapien
acgacggcaaatgtttttcaagagg

SEQ ID NO: 567897 - DNA, 25 bp, Homo sapien
gaggaagtctccagccacttgtgac

SEQ ID NO: 567898 - DNA, 25 bp, Homo sapien
gacctgggaaatccgtctgggccaa

SEQ ID NO: 567899 - DNA, 25 bp, Homo sapien
gctgagggccccagggacacacgtt

SEQ ID NO: 567900 - DNA, 25 bp, Homo sapien
gacacacgtttcctcccgtatggag

SEQ ID NO: 567901 - DNA, 25 bp, Homo sapien
cagtgagtacaacagcatgaagtct

SEQ ID NO: 567902 - DNA, 25 bp, Homo sapien
acagcatgaagtcttgctaccttgc

SEQ ID NO: 567903 - DNA, 25 bp, Homo sapien
ttgctaccttgccagatgctatcac

SEQ ID NO: 567904 - DNA, 25 bp, Homo sapien
taccttgccagatgctatcaccatg

SEQ ID NO: 567905 - DNA, 25 bp, Homo sapien
cagatgctatcaccatgcccttgga

SEQ ID NO: 567906 - DNA, 25 bp, Homo sapien
atgctatcaccatgcccttggactt

SEQ ID NO: 567907 - DNA, 25 bp, Homo sapien
ttcccaacctccaggattacttgct

SEQ ID NO: 567908 - DNA, 25 bp, Homo sapien
aacctccaggattacttgctgcagt

SEQ ID NO: 567909 - DNA, 25 bp, Homo sapien
ggatagcttgtcactgcatctgcag

SEQ ID NO: 567910 - DNA, 25 bp, Homo sapien
gatagcttgtcactgcatctgcagt

SEQ ID NO: 567911 - DNA, 25 bp, Homo sapien
ttgtcactgcatctgcagtgactca

SEQ ID NO: 567912 - DNA, 25 bp, Homo sapien
gtaagggttgaagagctcctgagac

SEQ ID NO: 567913 - DNA, 25 bp, Homo sapien
gaaagcagaggtccaggaagctcat

SEQ ID NO: 567914 - DNA, 25 bp, Homo sapien
ggaagctcattctgtgcccggaggt

SEQ ID NO: 567915 - DNA, 25 bp, Homo sapien
gtttgcacccagattctagtgtgcc

SEQ ID NO: 567916 - DNA, 25 bp, Homo sapien
ttctagtgtgccctttcagagttgg

SEQ ID NO: 567917 - DNA, 25 bp, Homo sapien
tgtgccctttcagagttgggtgctg

SEQ ID NO: 567918 - DNA, 25 bp, Homo sapien
gcctctgctctttggagtgaatgcc

SEQ ID NO: 567919 - DNA, 25 bp, Homo sapien
atgccaatggcagcatcaatttgct

SEQ ID NO: 567920 - DNA, 25 bp, Homo sapien
atgaggatgcagtaattggtttgga

SEQ ID NO: 567921 - DNA, 25 bp, Homo sapien
gagatgtttcttaaccagatgtcca

SEQ ID NO: 567922 - DNA, 25 bp, Homo sapien
taaccagatgtccatgaataaactc

SEQ ID NO: 567923 - DNA, 25 bp, Homo sapien
atcaaagaactctcaaggcttccag

SEQ ID NO: 567924 - DNA, 25 bp, Homo sapien
gaactctcaaggcttccagagttgg

SEQ ID NO: 567925 - DNA, 25 bp, Homo sapien
gcaacttcattaagtgactcaactc

SEQ ID NO: 567926 - DNA, 25 bp, Homo sapien
ttaagtgactcaactccaaatagga

SEQ ID NO: 567927 - DNA, 25 bp, Homo sapien
ggagcatttcaagagtatgtatttc

SEQ ID NO: 567928 - DNA, 25 bp, Homo sapien
atgacagtgtccttgcagtatcttt

SEQ ID NO: 567929 - DNA, 25 bp, Homo sapien
agtgtccttgcagtatcttttaggg

SEQ ID NO: 567930 - DNA, 25 bp, Homo sapien
gggctatcagaacatgatttctgct

SEQ ID NO: 567931 - DNA, 25 bp, Homo sapien
tctgctatattctatcatcggagcc

SEQ ID NO: 567932 - DNA, 25 bp, Homo sapien
tatattctatcatcggagccttaat

SEQ ID NO: 567933 - DNA, 25 bp, Homo sapien
catcggagccttaataatgttaact

SEQ ID NO: 567934 - DNA, 25 bp, Homo sapien
tgttgactgttcttggcactgctca

SEQ ID NO: 567935 - DNA, 25 bp, Homo sapien
actgttcttggcactgctcagtgta

SEQ ID NO: 567936 - DNA, 25 bp, Homo sapien
gctcagtgtagccaaagattccttg

SEQ ID NO: 567937 - DNA, 25 bp, Homo sapien
agccaaagattccttgcctacaaga

SEQ ID NO: 567938 - DNA, 25 bp, Homo sapien
gaaagtcttgctcagacaataaacc

SEQ ID NO: 567939 - DNA, 25 bp, Homo sapien
tccaccgcagaattcgagctcaata

SEQ ID NO: 567940 - DNA, 25 bp, Homo sapien
gctcaatatctcctatgtctatctg

SEQ ID NO: 567941 - DNA, 25 bp, Homo sapien
tgtctatctgtgaaagccatcatgg

SEQ ID NO: 567942 - DNA, 25 bp, Homo sapien
aagccatcatggaactcaagggcag

SEQ ID NO: 567943 - DNA, 25 bp, Homo sapien
atggtttgtattgtaatcccctgtt

SEQ ID NO: 567944 - DNA, 25 bp, Homo sapien
gtaatcccctgttttcagacacatt

SEQ ID NO: 567945 - DNA, 25 bp, Homo sapien
tttaaaaagccaatatgcagcctag

SEQ ID NO: 567946 - DNA, 25 bp, Homo sapien
ttaaaaagccaatatgcagcctagc

SEQ ID NO: 567947 - DNA, 25 bp, Homo sapien
taaaaagccaatatgcagcctagcg

SEQ ID NO: 567948 - DNA, 25 bp, Homo sapien
aaaaagccaatatgcagcctagcgc

SEQ ID NO: 567949 - DNA, 25 bp, Homo sapien
aaaagccaatatgcagcctagcgcg

SEQ ID NO: 567950 - DNA, 25 bp, Homo sapien
aaagccaatatgcagcctagcgcgg

SEQ ID NO: 567951 - DNA, 25 bp, Homo sapien
aagccaatatgcagcctagcgcggt

SEQ ID NO: 567952 - DNA, 25 bp, Homo sapien
agccaatatgcagcctagcgcggtg

SEQ ID NO: 567953 - DNA, 25 bp, Homo sapien
ccaatatgcagcctagcgcggtggc

SEQ ID NO: 567954 - DNA, 25 bp, Homo sapien
aatatgcagcctagcgcggtggctc

SEQ ID NO: 567955 - DNA, 25 bp, Homo sapien
atatgcagcctagcgcggtggctca

SEQ ID NO: 567956 - DNA, 25 bp, Homo sapien
gtgagaactaagtacctatgtggaa

SEQ ID NO: 567957 - DNA, 25 bp, Homo sapien
gggtacccaagacttaaatctcagc

SEQ ID NO: 567958 - DNA, 25 bp, Homo sapien
cctttgagatttgaaactagcttaa

SEQ ID NO: 567959 - DNA, 25 bp, Homo sapien
tgatgtgtaactctaatgcttaaag

SEQ ID NO: 567960 - DNA, 25 bp, Homo sapien
gtactgcaggatctactatctatgg

SEQ ID NO: 567961 - DNA, 25 bp, Homo sapien
ctactatctatggaggtgctacgga

SEQ ID NO: 567962 - DNA, 25 bp, Homo sapien
ggtgctacggagaggatctaaatat

SEQ ID NO: 567963 - DNA, 25 bp, Homo sapien
aactctaagataatccgtggttgtc

SEQ ID NO: 567964 - DNA, 25 bp, Homo sapien
gataatccgtggttgtcaggtaaaa

SEQ ID NO: 567965 - DNA, 25 bp, Homo sapien
gtcaggtaaaatgcactcatgtcta

SEQ ID NO: 567966 - DNA, 25 bp, Homo sapien
aatgcactcatgtctatctgacaga

SEQ ID NO: 567967 - DNA, 25 bp, Homo sapien
tgattttctcatgtggcacttctgt

SEQ ID NO: 567968 - DNA, 25 bp, Homo sapien
tcatgtggcacttctgtgtgcagga

SEQ ID NO: 567969 - DNA, 25 bp, Homo sapien
caggagatcacagcgcgggttttgt

SEQ ID NO: 567970 - DNA, 25 bp, Homo sapien
agcgcgggttttgttggctgctcat

SEQ ID NO: 567971 - DNA, 25 bp, Homo sapien
tttgttggctgctcatggacccctt

SEQ ID NO: 567972 - DNA, 25 bp, Homo sapien
caatgaggctcatacctgactgaat

SEQ ID NO: 567973 - DNA, 25 bp, Homo sapien
acctgactgaatgaaggacccttgg

SEQ ID NO: 567974 - DNA, 25 bp, Homo sapien
ggaggcccagtctcctctgagaaaa

SEQ ID NO: 567975 - DNA, 25 bp, Homo sapien
gtctcctctgagaaaagcctaacca

SEQ ID NO: 567976 - DNA, 25 bp, Homo sapien
gggatagggacatcttctcttgtct

SEQ ID NO: 567977 - DNA, 25 bp, Homo sapien
gggacatcttctcttgtctataacc

SEQ ID NO: 567978 - DNA, 25 bp, Homo sapien
ataaaaatacatcagaacgaagttg

SEQ ID NO: 567979 - DNA, 25 bp, Homo sapien
cagaacgaagttgtatttatcctag

SEQ ID NO: 567980 - DNA, 25 bp, Homo sapien
gaacgaagttgtatttatcctagaa

SEQ ID NO: 567981 - DNA, 25 bp, Homo sapien
tgtttttatatgagtatccttaaat

SEQ ID NO: 567982 - DNA, 25 bp, Homo sapien
ttaaactgtgttaagatgcatgctt

SEQ ID NO: 567983 - DNA, 25 bp, Homo sapien
aactgtgttaagatgcatgcttata

SEQ ID NO: 567984 - DNA, 25 bp, Homo sapien
gtgttaagatgcatgcttatacttg

SEQ ID NO: 567985 - DNA, 25 bp, Homo sapien
ttaagatgcatgcttatacttgttt

SEQ ID NO: 567986 - DNA, 25 bp, Homo sapien
ttgttttacttttctgactggaaga

SEQ ID NO: 567987 - DNA, 25 bp, Homo sapien
gttttacttttctgactggaagata

SEQ ID NO: 567988 - DNA, 25 bp, Homo sapien
acttttctgactggaagataaacct

SEQ ID NO: 567989 - DNA, 25 bp, Homo sapien
cgctcaagctttcatgatggcccat

SEQ ID NO: 567990 - DNA, 25 bp, Homo sapien
aagctttcatgatggcccatccgga

SEQ ID NO: 567991 - DNA, 25 bp, Homo sapien
catgatggcccatccggagccagag

SEQ ID NO: 567992 - DNA, 25 bp, Homo sapien
atccggagccagagggtgctgtgga

SEQ ID NO: 567993 - DNA, 25 bp, Homo sapien
gggaagatgcccctagtgagatcta

SEQ ID NO: 567994 - DNA, 25 bp, Homo sapien
gatgcccctagtgagatctaaaagg

SEQ ID NO: 567995 - DNA, 25 bp, Homo sapien
tggctcctgcttgtagatggatgaa

SEQ ID NO: 567996 - DNA, 25 bp, Homo sapien
gtagatggatgaaatagcaccagat

SEQ ID NO: 567997 - DNA, 25 bp, Homo sapien
tcaccctcgccatgatgatcgctgg

SEQ ID NO: 567998 - DNA, 25 bp, Homo sapien
gatgatcgctggcatccccaccgtg

SEQ ID NO: 567999 - DNA, 25 bp, Homo sapien
ggagttcgggaagaggacctgatct

SEQ ID NO: 568000 - DNA, 25 bp, Homo sapien
aagatcattgataagccctaaattc

SEQ ID NO: 568001 - DNA, 25 bp, Homo sapien
aattcttaagatatggaccttttat

SEQ ID NO: 568002 - DNA, 25 bp, Homo sapien
agttcagaatccctatacaatgtga

SEQ ID NO: 568003 - DNA, 25 bp, Homo sapien
gtggaaataatttcccagcaggaag

SEQ ID NO: 568004 - DNA, 25 bp, Homo sapien
ttcccagcaggaagagcattatatt

SEQ ID NO: 568005 - DNA, 25 bp, Homo sapien
gcattatattctctttgtaccagca

SEQ ID NO: 568006 - DNA, 25 bp, Homo sapien
aaattaatttaactcaactcacatg

SEQ ID NO: 568007 - DNA, 25 bp, Homo sapien
aattctgtgggctgtagtatgccat

SEQ ID NO: 568008 - DNA, 25 bp, Homo sapien
gctgtagtatgccatcattgtgact

SEQ ID NO: 568009 - DNA, 25 bp, Homo sapien
gccatcattgtgactgaatttgtgc

SEQ ID NO: 568010 - DNA, 25 bp, Homo sapien
gactgaatttgtgcaatggtttctt

SEQ ID NO: 568011 - DNA, 25 bp, Homo sapien
gcggcagatcatccagaggagaaaa

SEQ ID NO: 568012 - DNA, 25 bp, Homo sapien
gcagatcatccagaggagaaaaaac

SEQ ID NO: 568013 - DNA, 25 bp, Homo sapien
aaacatgtcacatgaagcactgacg

SEQ ID NO: 568014 - DNA, 25 bp, Homo sapien
catgtcacatgaagcactgacgtca

SEQ ID NO: 568015 - DNA, 25 bp, Homo sapien
tcacatgaagcactgacgtcaagcc

SEQ ID NO: 568016 - DNA, 25 bp, Homo sapien
acatgaagcactgacgtcaagccat

SEQ ID NO: 568017 - DNA, 25 bp, Homo sapien
catgaagcactgacgtcaagccata

SEQ ID NO: 568018 - DNA, 25 bp, Homo sapien
tgaagcactgacgtcaagccatagc

SEQ ID NO: 568019 - DNA, 25 bp, Homo sapien
tcagtataacctagaggaacgtaag

SEQ ID NO: 568020 - DNA, 25 bp, Homo sapien
aaagcaatggatggcttcaatatcc

SEQ ID NO: 568021 - DNA, 25 bp, Homo sapien
caatggatggcttcaatatccttgg

SEQ ID NO: 568022 - DNA, 25 bp, Homo sapien
tcctgttttccattcattgtaattt

SEQ ID NO: 568023 - DNA, 25 bp, Homo sapien
ctcagaatgctcaaaagttaaatgt

SEQ ID NO: 568024 - DNA, 25 bp, Homo sapien
gaatgtttaacacatcatttatgaa

SEQ ID NO: 568025 - DNA, 25 bp, Homo sapien
taagaacaaaagtggcagttgcctc

SEQ ID NO: 568026 - DNA, 25 bp, Homo sapien
caaaagtggcagttgcctcctactt

SEQ ID NO: 568027 - DNA, 25 bp, Homo sapien
aaagtggcagttgcctcctacttca

SEQ ID NO: 568028 - DNA, 25 bp, Homo sapien
gtggcagttgcctcctacttcagat

SEQ ID NO: 568029 - DNA, 25 bp, Homo sapien
agttgcctcctacttcagatccact

SEQ ID NO: 568030 - DNA, 25 bp, Homo sapien
ctcctacttcagatccacttttatg

SEQ ID NO: 568031 - DNA, 25 bp, Homo sapien
cctacttcagatccacttttatgtt

SEQ ID NO: 568032 - DNA, 25 bp, Homo sapien
acttcagatccacttttatgtttat

SEQ ID NO: 568033 - DNA, 25 bp, Homo sapien
atacagtggagattcgttgatatga

SEQ ID NO: 568034 - DNA, 25 bp, Homo sapien
tacagtggagattcgttgatatgaa

SEQ ID NO: 568035 - DNA, 25 bp, Homo sapien
acagtggagattcgttgatatgaac

SEQ ID NO: 568036 - DNA, 25 bp, Homo sapien
cagtggagattcgttgatatgaaca

SEQ ID NO: 568037 - DNA, 25 bp, Homo sapien
gtggagattcgttgatatgaacatt

SEQ ID NO: 568038 - DNA, 25 bp, Homo sapien
ggagattcgttgatatgaacattaa

SEQ ID NO: 568039 - DNA, 25 bp, Homo sapien
gagattcgttgatatgaacattaaa

SEQ ID NO: 568040 - DNA, 25 bp, Homo sapien
gattcgttgatatgaacattaaaca

SEQ ID NO: 568041 - DNA, 25 bp, Homo sapien
atatgaacattaaacattcaaccag

SEQ ID NO: 568042 - DNA, 25 bp, Homo sapien
tccaatgcccatctgccctggaggg

SEQ ID NO: 568043 - DNA, 25 bp, Homo sapien
tgcccatctgccctggagggctctg

SEQ ID NO: 568044 - DNA, 25 bp, Homo sapien
tcctgttttccattcattgtaattt

SEQ ID NO: 568045 - DNA, 25 bp, Homo sapien
aatacatccttcctgtttttcacag

SEQ ID NO: 568046 - DNA, 25 bp, Homo sapien
ctcagaatgctcaaaagttaaatgt

SEQ ID NO: 568047 - DNA, 25 bp, Homo sapien
gaatgtttaacacatcatttatgaa

SEQ ID NO: 568048 - DNA, 25 bp, Homo sapien
taagaacaaaagtggcagttgcctc

SEQ ID NO: 568049 - DNA, 25 bp, Homo sapien
caaaagtggcagttgcctcctactt

SEQ ID NO: 568050 - DNA, 25 bp, Homo sapien
aaagtggcagttgcctcctacttca

SEQ ID NO: 568051 - DNA, 25 bp, Homo sapien
gtggcagttgcctcctacttcagat

SEQ ID NO: 568052 - DNA, 25 bp, Homo sapien
ctcctacttcagatccacttttatg

SEQ ID NO: 568053 - DNA, 25 bp, Homo sapien
acttcagatccacttttatgtttat

SEQ ID NO: 568054 - DNA, 25 bp, Homo sapien
tttatgtttatttgtccttcagatc

SEQ ID NO: 568055 - DNA, 25 bp, Homo sapien
tccaggctggaatgcttcggtgtga

SEQ ID NO: 568056 - DNA, 25 bp, Homo sapien
atgcttcggtgtgatgacagcgcac

SEQ ID NO: 568057 - DNA, 25 bp, Homo sapien
tgatgacagcgcacgttaacctcga

SEQ ID NO: 568058 - DNA, 25 bp, Homo sapien
tgacagcgcacgttaacctcgaatt

SEQ ID NO: 568059 - DNA, 25 bp, Homo sapien
cagcgcacgttaacctcgaattcct

SEQ ID NO: 568060 - DNA, 25 bp, Homo sapien
acagctcctttgacctcagtgacag

SEQ ID NO: 568061 - DNA, 25 bp, Homo sapien
tttgacctcagtgacaggcactcac

SEQ ID NO: 568062 - DNA, 25 bp, Homo sapien
tgggctaccccattaccatgacaag

SEQ ID NO: 568063 - DNA, 25 bp, Homo sapien
gctaccccattaccatgacaagtat

SEQ ID NO: 568064 - DNA, 25 bp, Homo sapien
ttaccatgacaagtattccctctgc

SEQ ID NO: 568065 - DNA, 25 bp, Homo sapien
atgacaagtattccctctgctccag

SEQ ID NO: 568066 - DNA, 25 bp, Homo sapien
cagtctcaagtaacacgtccccgtg

SEQ ID NO: 568067 - DNA, 25 bp, Homo sapien
tgcacccgtggatcctgaggacagc

SEQ ID NO: 568068 - DNA, 25 bp, Homo sapien
gatcctgaggacagcggtagcgcct

SEQ ID NO: 568069 - DNA, 25 bp, Homo sapien
gaggacagcggtagcgccttcctca

SEQ ID NO: 568070 - DNA, 25 bp, Homo sapien
caccgcacgctgagtccagtgcgtg

SEQ ID NO: 568071 - DNA, 25 bp, Homo sapien
gagtccagtgcgtgctcctcactgt

SEQ ID NO: 568072 - DNA, 25 bp, Homo sapien
tgctcctcactgtgcacttattagt

SEQ ID NO: 568073 - DNA, 25 bp, Homo sapien
gtgcacttattagtgtctgttgagt

SEQ ID NO: 568074 - DNA, 25 bp, Homo sapien
gtgattaaatcacatcctcaggtct

SEQ ID NO: 568075 - DNA, 25 bp, Homo sapien
taaatcacatcctcaggtctgcagc

SEQ ID NO: 568076 - DNA, 25 bp, Homo sapien
acatcctcaggtctgcagcaaataa

SEQ ID NO: 568077 - DNA, 25 bp, Homo sapien
ttcttagagttattcctgttggacc

SEQ ID NO: 568078 - DNA, 25 bp, Homo sapien
tcttagagttattcctgttggaccg

SEQ ID NO: 568079 - DNA, 25 bp, Homo sapien
cttagagttattcctgttggaccgg

SEQ ID NO: 568080 - DNA, 25 bp, Homo sapien
ttagagttattcctgttggaccggg

SEQ ID NO: 568081 - DNA, 25 bp, Homo sapien
tagagttattcctgttggaccgggc

SEQ ID NO: 568082 - DNA, 25 bp, Homo sapien
agagttattcctgttggaccgggcg

SEQ ID NO: 568083 - DNA, 25 bp, Homo sapien
gagttattcctgttggaccgggcgc

SEQ ID NO: 568084 - DNA, 25 bp, Homo sapien
agttattcctgttggaccgggcgcg

SEQ ID NO: 568085 - DNA, 25 bp, Homo sapien
ttattcctgttggaccgggcgcggt

SEQ ID NO: 568086 - DNA, 25 bp, Homo sapien
gggcggcgtcttggcgcgcgcctgt

SEQ ID NO: 568087 - DNA, 25 bp, Homo sapien
tgcgatgccgccactgggcgacaga

SEQ ID NO: 568088 - DNA, 25 bp, Homo sapien
gtgcaatgcccgaggctgtggaaca

SEQ ID NO: 568089 - DNA, 25 bp, Homo sapien
aatgcccgaggctgtggaacaatca

SEQ ID NO: 568090 - DNA, 25 bp, Homo sapien
tgtggaacaatcagcccatctcttt

SEQ ID NO: 568091 - DNA, 25 bp, Homo sapien
gaacaatcagcccatctctttgtga

SEQ ID NO: 568092 - DNA, 25 bp, Homo sapien
gcccatctctttgtgacctggagca

SEQ ID NO: 568093 - DNA, 25 bp, Homo sapien
gagcagtcagagggccctcagtcac

SEQ ID NO: 568094 - DNA, 25 bp, Homo sapien
ccatttctatggaagctctgacgta

SEQ ID NO: 568095 - DNA, 25 bp, Homo sapien
ggaagctctgacgtaacttcagtgt

SEQ ID NO: 568096 - DNA, 25 bp, Homo sapien
gacgtaacttcagtgttttctacaa

SEQ ID NO: 568097 - DNA, 25 bp, Homo sapien
agtgttttctacaatactcctcctg

SEQ ID NO: 568098 - DNA, 25 bp, Homo sapien
gggaagctaagaacaagctagtttt

SEQ ID NO: 568099 - DNA, 25 bp, Homo sapien
aagaagtacacacggcaaataaatc

SEQ ID NO: 568100 - DNA, 25 bp, Homo sapien
gaaaagatgctcaaccacggtattg

SEQ ID NO: 568101 - DNA, 25 bp, Homo sapien
gtttttgccaaatctgattgtcaac

SEQ ID NO: 568102 - DNA, 25 bp, Homo sapien
gttaacattgattgctgtcgaggct

SEQ ID NO: 568103 - DNA, 25 bp, Homo sapien
gattgctgtcgaggctgtgaaaaac

SEQ ID NO: 568104 - DNA, 25 bp, Homo sapien
ggctgtgaaaaactaggcagcttca

SEQ ID NO: 568105 - DNA, 25 bp, Homo sapien
ggcagcttcataattgttggcagga

SEQ ID NO: 568106 - DNA, 25 bp, Homo sapien
ggaacaaccaactgctacaaacatt

SEQ ID NO: 568107 - DNA, 25 bp, Homo sapien
atatatttgcataccctttggccat

SEQ ID NO: 568108 - DNA, 25 bp, Homo sapien
tttggccatgccatttcacttttac

SEQ ID NO: 568109 - DNA, 25 bp, Homo sapien
tgccatttcacttttacggatctaa

SEQ ID NO: 568110 - DNA, 25 bp, Homo sapien
ccaggagctctgatacttaaccaca

SEQ ID NO: 568111 - DNA, 25 bp, Homo sapien
gatacttaaccacaatgatgctgct

SEQ ID NO: 568112 - DNA, 25 bp, Homo sapien
accacaatgatgctgctgaatttga

SEQ ID NO: 568113 - DNA, 25 bp, Homo sapien
ctgaatttgaattgggatcgtatgt

SEQ ID NO: 568114 - DNA, 25 bp, Homo sapien
gatcgtatgtagttcctcatctagg

SEQ ID NO: 568115 - DNA, 25 bp, Homo sapien
atctaggaactagtgatgagtcaaa

SEQ ID NO: 568116 - DNA, 25 bp, Homo sapien
gtaattattggtctgtttacctgac

SEQ ID NO: 568117 - DNA, 25 bp, Homo sapien
ggtctgtttacctgacattttgctt

SEQ ID NO: 568118 - DNA, 25 bp, Homo sapien
ttacctgacattttgcttcccatta

SEQ ID NO: 568119 - DNA, 25 bp, Homo sapien
gacattttgcttcccattatgtata

SEQ ID NO: 568120 - DNA, 25 bp, Homo sapien
gcttcccattatgtatatgacgtga

SEQ ID NO: 568121 - DNA, 25 bp, Homo sapien
gacctatactgaatttttggtacca

SEQ ID NO: 568122 - DNA, 25 bp, Homo sapien
ttggtaccacagtttccctcttgaa

SEQ ID NO: 568123 - DNA, 25 bp, Homo sapien
acaaaaaactgacagctctgagctg

SEQ ID NO: 568124 - DNA, 25 bp, Homo sapien
agctgtggccttaccttggaattaa

SEQ ID NO: 568125 - DNA, 25 bp, Homo sapien
catttccacctttgtaaaacatcct

SEQ ID NO: 568126 - DNA, 25 bp, Homo sapien
tttggctttccaggtcaggacctct

SEQ ID NO: 568127 - DNA, 25 bp, Homo sapien
gacctctacctgatcagtaacctat

SEQ ID NO: 568128 - DNA, 25 bp, Homo sapien
taagctgcagaatctctaccttgtc

SEQ ID NO: 568129 - DNA, 25 bp, Homo sapien
tctaccttgtctttgaaactggcac

SEQ ID NO: 568130 - DNA, 25 bp, Homo sapien
ggcacattagttgtggcacccatgt

SEQ ID NO: 568131 - DNA, 25 bp, Homo sapien
gcacccatgtgattagatagttcct

SEQ ID NO: 568132 - DNA, 25 bp, Homo sapien
gatatcagagacaagggttcaccat

SEQ ID NO: 568133 - DNA, 25 bp, Homo sapien
atatcagagacaagggttcaccatg

SEQ ID NO: 568134 - DNA, 25 bp, Homo sapien
ttgaactcctgatcgagagattcac

SEQ ID NO: 568135 - DNA, 25 bp, Homo sapien
aactcctgatcgagagattcaccca

SEQ ID NO: 568136 - DNA, 25 bp, Homo sapien
ctacacatggccaggattagtttct

SEQ ID NO: 568137 - DNA, 25 bp, Homo sapien
acacatggccaggattagtttctta

SEQ ID NO: 568138 - DNA, 25 bp, Homo sapien
catggccaggattagtttcttagaa

SEQ ID NO: 568139 - DNA, 25 bp, Homo sapien
ggccaggattagtttcttagaatgt

SEQ ID NO: 568140 - DNA, 25 bp, Homo sapien
agtttcttagaatgtgcttttaaca

SEQ ID NO: 568141 - DNA, 25 bp, Homo sapien
gtgcttttaacattgagtaaactat

SEQ ID NO: 568142 - DNA, 25 bp, Homo sapien
aatatctgccccaaaatatattttt

SEQ ID NO: 568143 - DNA, 25 bp, Homo sapien
atagcctaatttactctgcttaagc

SEQ ID NO: 568144 - DNA, 25 bp, Homo sapien
tactctgcttaagcatgatgctcag

SEQ ID NO: 568145 - DNA, 25 bp, Homo sapien
gcatgatgctcagataggagaacta

SEQ ID NO: 568146 - DNA, 25 bp, Homo sapien
gagaactaatctaccgtgtccacag

SEQ ID NO: 568147 - DNA, 25 bp, Homo sapien
taccgtgtccacagaccagtgaatt

SEQ ID NO: 568148 - DNA, 25 bp, Homo sapien
gtgtccacagaccagtgaatttact

SEQ ID NO: 568149 - DNA, 25 bp, Homo sapien
aaacagttgaggtgacgtctatggt

SEQ ID NO: 568150 - DNA, 25 bp, Homo sapien
acgtctatggtctaaggcctgcaga

SEQ ID NO: 568151 - DNA, 25 bp, Homo sapien
ggtctaaggcctgcagaaattgagc

SEQ ID NO: 568152 - DNA, 25 bp, Homo sapien
agcaatggtaaagcctcaagaggag

SEQ ID NO: 568153 - DNA, 25 bp, Homo sapien
ctcaagaggagaatgttacaggtta

SEQ ID NO: 568154 - DNA, 25 bp, Homo sapien
ttcaaccctacatggtcgatcacat

SEQ ID NO: 568155 - DNA, 25 bp, Homo sapien
tggtcgatcacatcattcacaccag

SEQ ID NO: 568156 - DNA, 25 bp, Homo sapien
atcattcacaccagagaagacatag

SEQ ID NO: 568157 - DNA, 25 bp, Homo sapien
tggaactgaagacctgatgggaaaa

SEQ ID NO: 568158 - DNA, 25 bp, Homo sapien
aaccttcaagttctatactgtactg

SEQ ID NO: 568159 - DNA, 25 bp, Homo sapien
tactgtactgtggataagcggctca

SEQ ID NO: 568160 - DNA, 25 bp, Homo sapien
taagcggctcagttcagcagagctg

SEQ ID NO: 568161 - DNA, 25 bp, Homo sapien
cagcagagctggagttgaacaactt

SEQ ID NO: 568162 - DNA, 25 bp, Homo sapien
gttcctctggtgtggtaaattgacc

SEQ ID NO: 568163 - DNA, 25 bp, Homo sapien
taaattgacctaaaggtgacctctg

SEQ ID NO: 568164 - DNA, 25 bp, Homo sapien
gtgacctctgacgatttcctgaaat

SEQ ID NO: 568165 - DNA, 25 bp, Homo sapien
ggagagtcctctccgtccctaggtt

SEQ ID NO: 568166 - DNA, 25 bp, Homo sapien
taggttcccctcaagacgccggcaa

SEQ ID NO: 568167 - DNA, 25 bp, Homo sapien
gtcccttaacgtcacaccgggtctg

SEQ ID NO: 568168 - DNA, 25 bp, Homo sapien
tcacaccgggtctgctgggagccaa

SEQ ID NO: 568169 - DNA, 25 bp, Homo sapien
accgggtctgctgggagccaaacag

SEQ ID NO: 568170 - DNA, 25 bp, Homo sapien
gctgggagccaaacagctgcggcct

SEQ ID NO: 568171 - DNA, 25 bp, Homo sapien
ggcctgatctgggagcgatagaatc

SEQ ID NO: 568172 - DNA, 25 bp, Homo sapien
gggagcgatagaatctcatcactta

SEQ ID NO: 568173 - DNA, 25 bp, Homo sapien
gaatctcatcacttagggtcactac

SEQ ID NO: 568174 - DNA, 25 bp, Homo sapien
atcacttagggtcactaccggaaat

SEQ ID NO: 568175 - DNA, 25 bp, Homo sapien
ccctccgcccatgtaaacatcataa

SEQ ID NO: 568176 - DNA, 25 bp, Homo sapien
atcctgcagtcatccctggaggatg

SEQ ID NO: 568177 - DNA, 25 bp, Homo sapien
gatgacacatgccaggaatcctcag

SEQ ID NO: 568178 - DNA, 25 bp, Homo sapien
gacacatgccaggaatcctcagaga

SEQ ID NO: 568179 - DNA, 25 bp, Homo sapien
gggctctgatttcttctggaacagt

SEQ ID NO: 568180 - DNA, 25 bp, Homo sapien
tctgatttcttctggaacagtgaaa

SEQ ID NO: 568181 - DNA, 25 bp, Homo sapien
ttctgccattctggttgtccattat

SEQ ID NO: 568182 - DNA, 25 bp, Homo sapien
gccattctggttgtccattatcttt

SEQ ID NO: 568183 - DNA, 25 bp, Homo sapien
gttgtccattatctttcctctaaaa

SEQ ID NO: 568184 - DNA, 25 bp, Homo sapien
gtccattatctttcctctaaaaatg

SEQ ID NO: 568185 - DNA, 25 bp, Homo sapien
tctaaaaatgtctctaaggccaggc

SEQ ID NO: 568186 - DNA, 25 bp, Homo sapien
aaaatgtctctaaggccaggcacag

SEQ ID NO: 568187 - DNA, 25 bp, Homo sapien
aattgaatggttgagttggttaagc

SEQ ID NO: 568188 - DNA, 25 bp, Homo sapien
gttggttaagcaaagagttatcctg

SEQ ID NO: 568189 - DNA, 25 bp, Homo sapien
aaagagttatcctgccacctaagag

SEQ ID NO: 568190 - DNA, 25 bp, Homo sapien
atcctgccacctaagagcattcatt

SEQ ID NO: 568191 - DNA, 25 bp, Homo sapien
gattatttattaccacctactttat

SEQ ID NO: 568192 - DNA, 25 bp, Homo sapien
taccacctactttatactatcttcc

SEQ ID NO: 568193 - DNA, 25 bp, Homo sapien
ggtagatttcttatatcaagggtga

SEQ ID NO: 568194 - DNA, 25 bp, Homo sapien
gagaattgaactgtgccattggcta

SEQ ID NO: 568195 - DNA, 25 bp, Homo sapien
ctgtgccattggctattcaatagct

SEQ ID NO: 568196 - DNA, 25 bp, Homo sapien
tatgttttggatgccacatcctcct

SEQ ID NO: 568197 - DNA, 25 bp, Homo sapien
tcctcctggaagcaaattttgccaa

SEQ ID NO: 568198 - DNA, 25 bp, Homo sapien
tggtcctgaattggctactagttta

SEQ ID NO: 568199 - DNA, 25 bp, Homo sapien
gaattggctactagtttaagcaaat

SEQ ID NO: 568200 - DNA, 25 bp, Homo sapien
actgtaagtcatttatgggttagtt

SEQ ID NO: 568201 - DNA, 25 bp, Homo sapien
tatgggctggatattcggtaatatc

SEQ ID NO: 568202 - DNA, 25 bp, Homo sapien
gcagattgcagaaatacagtatgat

SEQ ID NO: 568203 - DNA, 25 bp, Homo sapien
tgtacagacaaatacttagacagta

SEQ ID NO: 568204 - DNA, 25 bp, Homo sapien
gtatgcatactggtgttaacagtca

SEQ ID NO: 568205 - DNA, 25 bp, Homo sapien
aacagtcacaatttctgggtgatga

SEQ ID NO: 568206 - DNA, 25 bp, Homo sapien
gaaaatgtaacttgaaaccgctcca

SEQ ID NO: 568207 - DNA, 25 bp, Homo sapien
ttgaaaccgctccatttctacaatg

SEQ ID NO: 568208 - DNA, 25 bp, Homo sapien
tctacaatgcacatttactgtttct

SEQ ID NO: 568209 - DNA, 25 bp, Homo sapien
agtccggctggcatggaccacagcc

SEQ ID NO: 568210 - DNA, 25 bp, Homo sapien
ggctggcatggaccacagccacagc

SEQ ID NO: 568211 - DNA, 25 bp, Homo sapien
gtgcccctcacttggtggttggctt

SEQ ID NO: 568212 - DNA, 25 bp, Homo sapien
gcccctcacttggtggttggctttg

SEQ ID NO: 568213 - DNA, 25 bp, Homo sapien
ctcacttggtggttggctttggcca

SEQ ID NO: 568214 - DNA, 25 bp, Homo sapien
gggcccccagcaggaggtcgaggag

SEQ ID NO: 568215 - DNA, 25 bp, Homo sapien
ttactttcccggcttctttgtgagc

SEQ ID NO: 568216 - DNA, 25 bp, Homo sapien
actttcccggcttctttgtgagctg

SEQ ID NO: 568217 - DNA, 25 bp, Homo sapien
ttcccggcttctttgtgagctgcct

SEQ ID NO: 568218 - DNA, 25 bp, Homo sapien
cccggcttctttgtgagctgcctgg

SEQ ID NO: 568219 - DNA, 25 bp, Homo sapien
tgcagcccggccctgactggcacag

SEQ ID NO: 568220 - DNA, 25 bp, Homo sapien
gtaaaagcattctatcttaagtgag

SEQ ID NO: 568221 - DNA, 25 bp, Homo sapien
tactatttgagtttgtggcttggtt

SEQ ID NO: 568222 - DNA, 25 bp, Homo sapien
atttgagtttgtggcttggtttgaa

SEQ ID NO: 568223 - DNA, 25 bp, Homo sapien
gttcagctgaagtgacaatcaacct

SEQ ID NO: 568224 - DNA, 25 bp, Homo sapien
gtgacaatcaacctttaatcttgta

SEQ ID NO: 568225 - DNA, 25 bp, Homo sapien
aatcttgtaaagcttctgtgttaga

SEQ ID NO: 568226 - DNA, 25 bp, Homo sapien
tgtaaagcttctgtgttagatattt

SEQ ID NO: 568227 - DNA, 25 bp, Homo sapien
attttctatctctaacatgccaaac

SEQ ID NO: 568228 - DNA, 25 bp, Homo sapien
ttctatctctaacatgccaaacatg

SEQ ID NO: 568229 - DNA, 25 bp, Homo sapien
gccaaacatgcatattaaactgagt

SEQ ID NO: 568230 - DNA, 25 bp, Homo sapien
tttttgcatgcaatttctgtgccca

SEQ ID NO: 568231 - DNA, 25 bp, Homo sapien
taccctaatgaggacgcccctaaat

SEQ ID NO: 568232 - DNA, 25 bp, Homo sapien
tgaggacgcccctaaatcgggtact

SEQ ID NO: 568233 - DNA, 25 bp, Homo sapien
aatcgggtactagttgcagctctcg

SEQ ID NO: 568234 - DNA, 25 bp, Homo sapien
tagttgcagctctcgctgttcaagt

SEQ ID NO: 568235 - DNA, 25 bp, Homo sapien
tcgctgttcaagttccagacaggat

SEQ ID NO: 568236 - DNA, 25 bp, Homo sapien
acaggattctgagagtgcaaggcca

SEQ ID NO: 568237 - DNA, 25 bp, Homo sapien
gatgtgttatgggaagacttgttac

SEQ ID NO: 568238 - DNA, 25 bp, Homo sapien
gacttgttacattgtgcagaatgcc

SEQ ID NO: 568239 - DNA, 25 bp, Homo sapien
aatcatcagattaatccatgtgtga

SEQ ID NO: 568240 - DNA, 25 bp, Homo sapien
acccttttcatcagagtcatttgcc

SEQ ID NO: 568241 - DNA, 25 bp, Homo sapien
agtcatttgccctggctccatagtt

SEQ ID NO: 568242 - DNA, 25 bp, Homo sapien
ggcgtgcatagactaaacatggcca

SEQ ID NO: 568243 - DNA, 25 bp, Homo sapien
aacatggccagtccaggcactggaa

SEQ ID NO: 568244 - DNA, 25 bp, Homo sapien
ggcactggaatccaggccgtagaac

SEQ ID NO: 568245 - DNA, 25 bp, Homo sapien
tagaacggcgcccacggtcaaaagg

SEQ ID NO: 568246 - DNA, 25 bp, Homo sapien
aaaggaatgagaccctgatgcactg

SEQ ID NO: 568247 - DNA, 25 bp, Homo sapien
accctgatgcactgggcgacacaga

SEQ ID NO: 568248 - DNA, 25 bp, Homo sapien
cagacgggcgacacagacttggaga

SEQ ID NO: 568249 - DNA, 25 bp, Homo sapien
acagacttggagacatcatgctaag

SEQ ID NO: 568250 - DNA, 25 bp, Homo sapien
catcctttgccatagcggcaaggtg

SEQ ID NO: 568251 - DNA, 25 bp, Homo sapien
gcggcaaggtggaaaccctgtccat

SEQ ID NO: 568252 - DNA, 25 bp, Homo sapien
tgtccatccactgaggcgtgcatag

SEQ ID NO: 568253 - DNA, 25 bp, Homo sapien
acttgggtgacagaggttacagtga

SEQ ID NO: 568254 - DNA, 25 bp, Homo sapien
tggaaagagtagagagacagagaca

SEQ ID NO: 568255 - DNA, 25 bp, Homo sapien
gacagagacaaagaaagatacagaa

SEQ ID NO: 568256 - DNA, 25 bp, Homo sapien
aagatacagaagagagaaacagaca

SEQ ID NO: 568257 - DNA, 25 bp, Homo sapien
tacagaagagagaaacagacacaaa

SEQ ID NO: 568258 - DNA, 25 bp, Homo sapien
gaaaaagagaagcagtaactcagag

SEQ ID NO: 568259 - DNA, 25 bp, Homo sapien
agagaagcagtaactcagaggattt

SEQ ID NO: 568260 - DNA, 25 bp, Homo sapien
gagaagcagtaactcagaggattta

SEQ ID NO: 568261 - DNA, 25 bp, Homo sapien
gaagcagtaactcagaggatttaag

SEQ ID NO: 568262 - DNA, 25 bp, Homo sapien
gcagtaactcagaggatttaagtaa

SEQ ID NO: 568263 - DNA, 25 bp, Homo sapien
gtaactcagaggatttaagtaaatg

SEQ ID NO: 568264 - DNA, 25 bp, Homo sapien
caggcccagagatcccacactcatg

SEQ ID NO: 568265 - DNA, 25 bp, Homo sapien
agagatcccacactcatgccagccc

SEQ ID NO: 568266 - DNA, 25 bp, Homo sapien
atcgataggggctcattattccgtc

SEQ ID NO: 568267 - DNA, 25 bp, Homo sapien
gggctcattattccgtcctgtctcc

SEQ ID NO: 568268 - DNA, 25 bp, Homo sapien
tcattattccgtcctgtctccctag

SEQ ID NO: 568269 - DNA, 25 bp, Homo sapien
attattccgtcctgtctccctagga

SEQ ID NO: 568270 - DNA, 25 bp, Homo sapien
tattccgtcctgtctccctaggatg

SEQ ID NO: 568271 - DNA, 25 bp, Homo sapien
ttccgtcctgtctccctaggatggg

SEQ ID NO: 568272 - DNA, 25 bp, Homo sapien
gtcctgtctccctaggatggggcag

SEQ ID NO: 568273 - DNA, 25 bp, Homo sapien
ctatgccaacccatgaataaaatta

SEQ ID NO: 568274 - DNA, 25 bp, Homo sapien
tgccaacccatgaataaaattacag

SEQ ID NO: 568275 - DNA, 25 bp, Homo sapien
ttacatctttttggtaacatgccag

SEQ ID NO: 568276 - DNA, 25 bp, Homo sapien
tggtaacatgccagttgataccaca

SEQ ID NO: 568277 - DNA, 25 bp, Homo sapien
tatcaactggttgtctatgactcaa

SEQ ID NO: 568278 - DNA, 25 bp, Homo sapien
ggttgtctatgactcaaattacata

SEQ ID NO: 568279 - DNA, 25 bp, Homo sapien
tgaatccagcacataaattatttac

SEQ ID NO: 568280 - DNA, 25 bp, Homo sapien
tttactcagatttaatgccagcaac

SEQ ID NO: 568281 - DNA, 25 bp, Homo sapien
tgccagctaatctggctcatttcat

SEQ ID NO: 568282 - DNA, 25 bp, Homo sapien
attggaattttggtcatgcccattc

SEQ ID NO: 568283 - DNA, 25 bp, Homo sapien
aattttggtcatgcccattctcctt

SEQ ID NO: 568284 - DNA, 25 bp, Homo sapien
gcactaaattaactccataacgtag

SEQ ID NO: 568285 - DNA, 25 bp, Homo sapien
gcttgtgtgtgatatgcttaactgt

SEQ ID NO: 568286 - DNA, 25 bp, Homo sapien
gaacttgcttacatctatttgtgga

SEQ ID NO: 568287 - DNA, 25 bp, Homo sapien
ggtctggctctgctgctaacttcaa

SEQ ID NO: 568288 - DNA, 25 bp, Homo sapien
ggctctgctgctaacttcaagttta

SEQ ID NO: 568289 - DNA, 25 bp, Homo sapien
tacactcaattgatcaagtcccttg

SEQ ID NO: 568290 - DNA, 25 bp, Homo sapien
tcaagtcccttgatgacatggaact

SEQ ID NO: 568291 - DNA, 25 bp, Homo sapien
tgacatggaactaaagtgacttttg

SEQ ID NO: 568292 - DNA, 25 bp, Homo sapien
gacttttgaagaacatgagtacctc

SEQ ID NO: 568293 - DNA, 25 bp, Homo sapien
gattctgatctaataatgcagcctt

SEQ ID NO: 568294 - DNA, 25 bp, Homo sapien
cagccttgtgagatagtgaactctc

SEQ ID NO: 568295 - DNA, 25 bp, Homo sapien
gatagtgaactctccattcctggaa

SEQ ID NO: 568296 - DNA, 25 bp, Homo sapien
tccattcctggaagtattcaagcta

SEQ ID NO: 568297 - DNA, 25 bp, Homo sapien
agggagtgctcttggacactaaaaa

SEQ ID NO: 568298 - DNA, 25 bp, Homo sapien
aaaaaacaccttctcacttcctcat

SEQ ID NO: 568299 - DNA, 25 bp, Homo sapien
ttcctcatttgggactgtcaagcca

SEQ ID NO: 568300 - DNA, 25 bp, Homo sapien
tcatttgggactgtcaagccaagaa

SEQ ID NO: 568301 - DNA, 25 bp, Homo sapien
gccaagaatgcaaggagaggtatac

SEQ ID NO: 568302 - DNA, 25 bp, Homo sapien
gaggtatacagaaaacacctcattt

SEQ ID NO: 568303 - DNA, 25 bp, Homo sapien
aacacctcatttggagttatttact

SEQ ID NO: 568304 - DNA, 25 bp, Homo sapien
gttatttactttaactgctcagcat

SEQ ID NO: 568305 - DNA, 25 bp, Homo sapien
atttactttaactgctcagcattgt

SEQ ID NO: 568306 - DNA, 25 bp, Homo sapien
actttaactgctcagcattgtgaga

SEQ ID NO: 568307 - DNA, 25 bp, Homo sapien
taactgctcagcattgtgagaacaa

SEQ ID NO: 568308 - DNA, 25 bp, Homo sapien
tggtggatgacctcttgtttgtggt

SEQ ID NO: 568309 - DNA, 25 bp, Homo sapien
ttttaccaccacctttaatgttgag

SEQ ID NO: 568310 - DNA, 25 bp, Homo sapien
aagaccgatgagtggtatgatgctc

SEQ ID NO: 568311 - DNA, 25 bp, Homo sapien
gagtatataccgcagtgctctgagc

SEQ ID NO: 568312 - DNA, 25 bp, Homo sapien
cagtgctctgagctgctgtgtagta

SEQ ID NO: 568313 - DNA, 25 bp, Homo sapien
tgagctgctgtgtagtaccagggct

SEQ ID NO: 568314 - DNA, 25 bp, Homo sapien
ccagggctggccaatgttgaggaat

SEQ ID NO: 568315 - DNA, 25 bp, Homo sapien
atatgcagctagacgggacaacttc

SEQ ID NO: 568316 - DNA, 25 bp, Homo sapien
ggacaacttcccaggattagcactg

SEQ ID NO: 568317 - DNA, 25 bp, Homo sapien
ttcccaggattagcactgcgagatg

SEQ ID NO: 568318 - DNA, 25 bp, Homo sapien
tattctgcttcgacaagtaccctac

SEQ ID NO: 568319 - DNA, 25 bp, Homo sapien
gatctaggaagatccatgacacaca

SEQ ID NO: 568320 - DNA, 25 bp, Homo sapien
ggaagatccatgacacacatgcgag

SEQ ID NO: 568321 - DNA, 25 bp, Homo sapien
gatccatgacacacatgcgaggcag

SEQ ID NO: 568322 - DNA, 25 bp, Homo sapien
catgacacacatgcgaggcaggtga

SEQ ID NO: 568323 - DNA, 25 bp, Homo sapien
gacacacatgcgaggcaggtgaatg

SEQ ID NO: 568324 - DNA, 25 bp, Homo sapien
aggaggacttccacgtttaattctg

SEQ ID NO: 568325 - DNA, 25 bp, Homo sapien
ggaggacttccacgtttaattctga

SEQ ID NO: 568326 - DNA, 25 bp, Homo sapien
gaggacttccacgtttaattctgaa

SEQ ID NO: 568327 - DNA, 25 bp, Homo sapien
ggacttccacgtttaattctgaatg

SEQ ID NO: 568328 - DNA, 25 bp, Homo sapien
ccacgtttaattctgaatggtctat

SEQ ID NO: 568329 - DNA, 25 bp, Homo sapien
aattctgaatggtctattttatttg

SEQ ID NO: 568330 - DNA, 25 bp, Homo sapien
acactgtccaacatgagtattcaga

SEQ ID NO: 568331 - DNA, 25 bp, Homo sapien
cactgtccaacatgagtattcagac

SEQ ID NO: 568332 - DNA, 25 bp, Homo sapien
gtccaacatgagtattcagacatgc

SEQ ID NO: 568333 - DNA, 25 bp, Homo sapien
ccaacatgagtattcagacatgcag

SEQ ID NO: 568334 - DNA, 25 bp, Homo sapien
catgcagagaaatcttataccaagt

SEQ ID NO: 568335 - DNA, 25 bp, Homo sapien
gcagagaaatcttataccaagtata

SEQ ID NO: 568336 - DNA, 25 bp, Homo sapien
tataccaagtataaccaaccataaa

SEQ ID NO: 568337 - DNA, 25 bp, Homo sapien
taccaagtataaccaaccataaatg

SEQ ID NO: 568338 - DNA, 25 bp, Homo sapien
aagtataaccaaccataaatgggca

SEQ ID NO: 568339 - DNA, 25 bp, Homo sapien
gtataaccaaccataaatgggcaat

SEQ ID NO: 568340 - DNA, 25 bp, Homo sapien
ccataaatgggcaatatagcatttt

SEQ ID NO: 568341 - DNA, 25 bp, Homo sapien
aaaccatatattgtgtactgccttt

SEQ ID NO: 568342 - DNA, 25 bp, Homo sapien
gtactgccttttatgtgatatatcc

SEQ ID NO: 568343 - DNA, 25 bp, Homo sapien
gtgatatatccagaacagggaactc

SEQ ID NO: 568344 - DNA, 25 bp, Homo sapien
aacagggaactctatagagacagaa

SEQ ID NO: 568345 - DNA, 25 bp, Homo sapien
aaagtagaatagtgcctagccaggc

SEQ ID NO: 568346 - DNA, 25 bp, Homo sapien
tagaatagtgcctagccaggcctgg

SEQ ID NO: 568347 - DNA, 25 bp, Homo sapien
gagtgactgctaatagatacgtgat

SEQ ID NO: 568348 - DNA, 25 bp, Homo sapien
gatacgtgatttcttttcagtgtga

SEQ ID NO: 568349 - DNA, 25 bp, Homo sapien
tgtggtgatggttgtataactgtga

SEQ ID NO: 568350 - DNA, 25 bp, Homo sapien
ctaagaaccaaagagttgtgtactt

SEQ ID NO: 568351 - DNA, 25 bp, Homo sapien
taaatggtttaattgtatggtacac

SEQ ID NO: 568352 - DNA, 25 bp, Homo sapien
aaatctataatcacaaagtttctgc

SEQ ID NO: 568353 - DNA, 25 bp, Homo sapien
caaagtttctgcaactggactgtag

SEQ ID NO: 568354 - DNA, 25 bp, Homo sapien
gtttctgcaactggactgtagtcat

SEQ ID NO: 568355 - DNA, 25 bp, Homo sapien
ctgcaactggactgtagtcatggtt

SEQ ID NO: 568356 - DNA, 25 bp, Homo sapien
gtagtcatggttgcagaactgtata

SEQ ID NO: 568357 - DNA, 25 bp, Homo sapien
gttgcagaactgtatagatttacta

SEQ ID NO: 568358 - DNA, 25 bp, Homo sapien
gtatagatttactaggaaccatcaa

SEQ ID NO: 568359 - DNA, 25 bp, Homo sapien
gatttactaggaaccatcaaattgt

SEQ ID NO: 568360 - DNA, 25 bp, Homo sapien
actaggaaccatcaaattgttcact

SEQ ID NO: 568361 - DNA, 25 bp, Homo sapien
caaattgttcacttacaatgggtaa

SEQ ID NO: 568362 - DNA, 25 bp, Homo sapien
caatgggtaaattgtacagtacata

SEQ ID NO: 568363 - DNA, 25 bp, Homo sapien
gggtcactgccaccaagaacgtagc

SEQ ID NO: 568364 - DNA, 25 bp, Homo sapien
gccaccaagaacgtagcagagagat

SEQ ID NO: 568365 - DNA, 25 bp, Homo sapien
cagagacagcagttgggccccacct

SEQ ID NO: 568366 - DNA, 25 bp, Homo sapien
accaccacaggccaagaatggcaag

SEQ ID NO: 568367 - DNA, 25 bp, Homo sapien
caggccaagaatggcaagcacctcg

SEQ ID NO: 568368 - DNA, 25 bp, Homo sapien
cagaggtgtcttgcctcctgaacta

SEQ ID NO: 568369 - DNA, 25 bp, Homo sapien
aggtgtcttgcctcctgaactagac

SEQ ID NO: 568370 - DNA, 25 bp, Homo sapien
ttgcctcctgaactagaccagtctt

SEQ ID NO: 568371 - DNA, 25 bp, Homo sapien
gaactagaccagtcttcttgcatgt

SEQ ID NO: 568372 - DNA, 25 bp, Homo sapien
tagaccagtcttcttgcatgtctcc

SEQ ID NO: 568373 - DNA, 25 bp, Homo sapien
ccagtcttcttgcatgtctcctggg

SEQ ID NO: 568374 - DNA, 25 bp, Homo sapien
tcctggctaattgtgtggtcattgg

SEQ ID NO: 568375 - DNA, 25 bp, Homo sapien
gtggtcattggaaaactctgcaata

SEQ ID NO: 568376 - DNA, 25 bp, Homo sapien
gtgtaattgaaacgtgctctataga

SEQ ID NO: 568377 - DNA, 25 bp, Homo sapien
agatattgactctgtgttccctctt

SEQ ID NO: 568378 - DNA, 25 bp, Homo sapien
gttccctcttttacagctggacaga

SEQ ID NO: 568379 - DNA, 25 bp, Homo sapien
agtcaatgtcacgaaatgattttct

SEQ ID NO: 568380 - DNA, 25 bp, Homo sapien
attgtagatactttgtcccttgcac

SEQ ID NO: 568381 - DNA, 25 bp, Homo sapien
tgtcccttgcacttctctgaatctg

SEQ ID NO: 568382 - DNA, 25 bp, Homo sapien
ggattcttgtgattttccttccaag

SEQ ID NO: 568383 - DNA, 25 bp, Homo sapien
tgtgattttccttccaagtgtttca

SEQ ID NO: 568384 - DNA, 25 bp, Homo sapien
aagtgtttcagttgtatgacagtca

SEQ ID NO: 568385 - DNA, 25 bp, Homo sapien
acagaagcctgttacgagatataag

SEQ ID NO: 568386 - DNA, 25 bp, Homo sapien
gccctcggaaatctcactgtcggaa

SEQ ID NO: 568387 - DNA, 25 bp, Homo sapien
gaaatctcactgtcggaatccttgg

SEQ ID NO: 568388 - DNA, 25 bp, Homo sapien
ggaatccttggaaatcacaccacgc

SEQ ID NO: 568389 - DNA, 25 bp, Homo sapien
ttggaaatcacaccacgcacaactt

SEQ ID NO: 568390 - DNA, 25 bp, Homo sapien
cacgcacaacttctatttcttcata

SEQ ID NO: 568391 - DNA, 25 bp, Homo sapien
tcataatttgcaaagaaccagtgtg

SEQ ID NO: 568392 - DNA, 25 bp, Homo sapien
accagtgtgactccagtcaagaaca

SEQ ID NO: 568393 - DNA, 25 bp, Homo sapien
ctctaattttttcaagcagccacat

SEQ ID NO: 568394 - DNA, 25 bp, Homo sapien
tttcaagcagccacatggaaaacgc

SEQ ID NO: 568395 - DNA, 25 bp, Homo sapien
atgaaatcctttccattgctctttt

SEQ ID NO: 568396 - DNA, 25 bp, Homo sapien
agaagtacataagccttttcgttga

SEQ ID NO: 568397 - DNA, 25 bp, Homo sapien
aagccttttcgttgaaataacacat

SEQ ID NO: 568398 - DNA, 25 bp, Homo sapien
atgactctaaattcgtgatattcag

SEQ ID NO: 568399 - DNA, 25 bp, Homo sapien
gatattcagatgatcacactccata

SEQ ID NO: 568400 - DNA, 25 bp, Homo sapien
acactccataatactgccaccagag

SEQ ID NO: 568401 - DNA, 25 bp, Homo sapien
ccaccagagccaagttattggagtt

SEQ ID NO: 568402 - DNA, 25 bp, Homo sapien
ggagttactactttttatgatcagc

SEQ ID NO: 568403 - DNA, 25 bp, Homo sapien
tttatgatcagcacaattatttttc

SEQ ID NO: 568404 - DNA, 25 bp, Homo sapien
ttgttggtattaaaagggccacagt

SEQ ID NO: 568405 - DNA, 25 bp, Homo sapien
gggccacagtagactatttgctatt

SEQ ID NO: 568406 - DNA, 25 bp, Homo sapien
gaatgattgttggttagtacttaat

SEQ ID NO: 568407 - DNA, 25 bp, Homo sapien
tgtggtgctcggtccgcacaccaga

SEQ ID NO: 568408 - DNA, 25 bp, Homo sapien
ggtccgcacaccagagagctctcac

SEQ ID NO: 568409 - DNA, 25 bp, Homo sapien
gcgtgctgggcactctctccaactc

SEQ ID NO: 568410 - DNA, 25 bp, Homo sapien
ccccatgaacccagggcagctgtgt

SEQ ID NO: 568411 - DNA, 25 bp, Homo sapien
tgaacccagggcagctgtgtgaggt

SEQ ID NO: 568412 - DNA, 25 bp, Homo sapien
ctgtgtgaggtgtggtagacctgga

SEQ ID NO: 568413 - DNA, 25 bp, Homo sapien
gaaatgcccagctgtcaccagacct

SEQ ID NO: 568414 - DNA, 25 bp, Homo sapien
atgcccagctgtcaccagacctggg

SEQ ID NO: 568415 - DNA, 25 bp, Homo sapien
gggcagctctcctgacaaagctgtt

SEQ ID NO: 568416 - DNA, 25 bp, Homo sapien
gcagctctcctgacaaagctgtttg

SEQ ID NO: 568417 - DNA, 25 bp, Homo sapien
gaggaagcaaatgcaagctgggctg

SEQ ID NO: 568418 - DNA, 25 bp, Homo sapien
gaaattgaatcattttctaactcat

SEQ ID NO: 568419 - DNA, 25 bp, Homo sapien
tgaactctgcctttgcaatttatca

SEQ ID NO: 568420 - DNA, 25 bp, Homo sapien
gcaatttatcatcttcgtgatctta

SEQ ID NO: 568421 - DNA, 25 bp, Homo sapien
ttatcatcttcgtgatcttagacaa

SEQ ID NO: 568422 - DNA, 25 bp, Homo sapien
atcttcgtgatcttagacaatctct

SEQ ID NO: 568423 - DNA, 25 bp, Homo sapien
tcgtgatcttagacaatctcttaat

SEQ ID NO: 568424 - DNA, 25 bp, Homo sapien
gacaatctcttaatttctctaagct

SEQ ID NO: 568425 - DNA, 25 bp, Homo sapien
aatctcttaatttctctaagcttcc

SEQ ID NO: 568426 - DNA, 25 bp, Homo sapien
caaagggctgacctaaagtttacat

SEQ ID NO: 568427 - DNA, 25 bp, Homo sapien
gggctgatacatagacagtattcaa

SEQ ID NO: 568428 - DNA, 25 bp, Homo sapien
catagacagtattcaataaagcttt

SEQ ID NO: 568429 - DNA, 25 bp, Homo sapien
tttatcctcaccacacctatggaga

SEQ ID NO: 568430 - DNA, 25 bp, Homo sapien
tcaccacacctatggagatagaagt

SEQ ID NO: 568431 - DNA, 25 bp, Homo sapien
atagaagttattatccccatgcaga

SEQ ID NO: 568432 - DNA, 25 bp, Homo sapien
agttattatccccatgcagacaggg

SEQ ID NO: 568433 - DNA, 25 bp, Homo sapien
aaagccaaggctctgggttcacaga

SEQ ID NO: 568434 - DNA, 25 bp, Homo sapien
ctgggttcacagaagtacatgtact

SEQ ID NO: 568435 - DNA, 25 bp, Homo sapien
gtacttaagaggtgtgaagcaacat

SEQ ID NO: 568436 - DNA, 25 bp, Homo sapien
aagcaacatgggactactggaagga

SEQ ID NO: 568437 - DNA, 25 bp, Homo sapien
ggaaatgcaggcacctgctctcgct

SEQ ID NO: 568438 - DNA, 25 bp, Homo sapien
tgctctcgctcacttgaccatagag

SEQ ID NO: 568439 - DNA, 25 bp, Homo sapien
ttgaccatagagcaacttgggcaaa

SEQ ID NO: 568440 - DNA, 25 bp, Homo sapien
acctctcaggccaggaggttggctt

SEQ ID NO: 568441 - DNA, 25 bp, Homo sapien
ggttggcttttccaattgtgcgatt

SEQ ID NO: 568442 - DNA, 25 bp, Homo sapien
tgtgcgattaagctattctacccag

SEQ ID NO: 568443 - DNA, 25 bp, Homo sapien
tgaattcaacaaccaaaatgcattt

SEQ ID NO: 568444 - DNA, 25 bp, Homo sapien
ttgctaattgaggtgcttgctggcc

SEQ ID NO: 568445 - DNA, 25 bp, Homo sapien
tgcttgctggccaggtcatccgcgc

SEQ ID NO: 568446 - DNA, 25 bp, Homo sapien
gcgctcccttgtctaacagctggta

SEQ ID NO: 568447 - DNA, 25 bp, Homo sapien
tctaacagctggtactccccactgt

SEQ ID NO: 568448 - DNA, 25 bp, Homo sapien
tccccactgtgccacggtaaagtag

SEQ ID NO: 568449 - DNA, 25 bp, Homo sapien
ctgtgccacggtaaagtagggtagt

SEQ ID NO: 568450 - DNA, 25 bp, Homo sapien
gtagggtagtagaggcctctgctcc

SEQ ID NO: 568451 - DNA, 25 bp, Homo sapien
taactgcattctcctccgccaaaaa

SEQ ID NO: 568452 - DNA, 25 bp, Homo sapien
ctgcattctcctccgccaaaaaagt

SEQ ID NO: 568453 - DNA, 25 bp, Homo sapien
ttctcctccgccaaaaaagtgacca

SEQ ID NO: 568454 - DNA, 25 bp, Homo sapien
tctcctccgccaaaaaagtgaccaa

SEQ ID NO: 568455 - DNA, 25 bp, Homo sapien
tcctccgccaaaaaagtgaccaagc

SEQ ID NO: 568456 - DNA, 25 bp, Homo sapien
tccgccaaaaaagtgaccaagcagg

SEQ ID NO: 568457 - DNA, 25 bp, Homo sapien
gccaaaaaagtgaccaagcaggtat

SEQ ID NO: 568458 - DNA, 25 bp, Homo sapien
aagtgaccaagcaggtataagtgga

SEQ ID NO: 568459 - DNA, 25 bp, Homo sapien
caggtataagtggagaaacagccaa

SEQ ID NO: 568460 - DNA, 25 bp, Homo sapien
gtaagaggaactatggcgtgagcca

SEQ ID NO: 568461 - DNA, 25 bp, Homo sapien
aagaggaactatggcgtgagccacc

SEQ ID NO: 568462 - DNA, 25 bp, Homo sapien
atcttgtgttgaaatgtgatgccca

SEQ ID NO: 568463 - DNA, 25 bp, Homo sapien
tcttgtgttgaaatgtgatgcccag

SEQ ID NO: 568464 - DNA, 25 bp, Homo sapien
cttgtgttgaaatgtgatgcccagc

SEQ ID NO: 568465 - DNA, 25 bp, Homo sapien
ttgtgttgaaatgtgatgcccagcc

SEQ ID NO: 568466 - DNA, 25 bp, Homo sapien
tgtgttgaaatgtgatgcccagcca

SEQ ID NO: 568467 - DNA, 25 bp, Homo sapien
gtgttgaaatgtgatgcccagccag

SEQ ID NO: 568468 - DNA, 25 bp, Homo sapien
tgttgaaatgtgatgcccagccagg

SEQ ID NO: 568469 - DNA, 25 bp, Homo sapien
gttgaaatgtgatgcccagccaggc

SEQ ID NO: 568470 - DNA, 25 bp, Homo sapien
ttgaaatgtgatgcccagccaggca

SEQ ID NO: 568471 - DNA, 25 bp, Homo sapien
aaatgtgatgcccagccaggcatgg

SEQ ID NO: 568472 - DNA, 25 bp, Homo sapien
ggaagaatcgcttggactggggaag

SEQ ID NO: 568473 - DNA, 25 bp, Homo sapien
gggaccacttctgttggtgctaagc

SEQ ID NO: 568474 - DNA, 25 bp, Homo sapien
gtgctaagctttggcgagagtctcc

SEQ ID NO: 568475 - DNA, 25 bp, Homo sapien
cttaccactcgctgttagaagttgg

SEQ ID NO: 568476 - DNA, 25 bp, Homo sapien
ggccgtcacagctttctcatcgaag

SEQ ID NO: 568477 - DNA, 25 bp, Homo sapien
tcatcgaagtgccagatcccaggac

SEQ ID NO: 568478 - DNA, 25 bp, Homo sapien
atcccaggacactacaaacgcttga

SEQ ID NO: 568479 - DNA, 25 bp, Homo sapien
tagcactgtggctttctagcctggg

SEQ ID NO: 568480 - DNA, 25 bp, Homo sapien
gagtcgtgggaaaagcttgccctga

SEQ ID NO: 568481 - DNA, 25 bp, Homo sapien
aaagcttgccctgacgatggaggca

SEQ ID NO: 568482 - DNA, 25 bp, Homo sapien
ggaggcagcgaccagaaatccattc

SEQ ID NO: 568483 - DNA, 25 bp, Homo sapien
cagaaatccattcgtggctctaccc

SEQ ID NO: 568484 - DNA, 25 bp, Homo sapien
tcactctgcatggtattagttcact

SEQ ID NO: 568485 - DNA, 25 bp, Homo sapien
ttagttcactgtcatgtccatttcc

SEQ ID NO: 568486 - DNA, 25 bp, Homo sapien
atgtccatttcctctattgggatgt

SEQ ID NO: 568487 - DNA, 25 bp, Homo sapien
tcctctattgggatgtaaattgctt

SEQ ID NO: 568488 - DNA, 25 bp, Homo sapien
tgatctggcctaagacagtgcttgg

SEQ ID NO: 568489 - DNA, 25 bp, Homo sapien
gtgcttggcacatactataggctca

SEQ ID NO: 568490 - DNA, 25 bp, Homo sapien
ggcacatactataggctcatcagat

SEQ ID NO: 568491 - DNA, 25 bp, Homo sapien
taggctcatcagatgatggctgagt

SEQ ID NO: 568492 - DNA, 25 bp, Homo sapien
ggtggtcactgaaaacatacgtctg

SEQ ID NO: 568493 - DNA, 25 bp, Homo sapien
tgaaaacatacgtctgcaccctaat

SEQ ID NO: 568494 - DNA, 25 bp, Homo sapien
tacgtctgcaccctaattcctggaa

SEQ ID NO: 568495 - DNA, 25 bp, Homo sapien
tggaaaattgttgtggtgtgtggta

SEQ ID NO: 568496 - DNA, 25 bp, Homo sapien
tgtggtgtgtggtagggtttttgtt

SEQ ID NO: 568497 - DNA, 25 bp, Homo sapien
gccagcttgggcctcatcctcatgt

SEQ ID NO: 568498 - DNA, 25 bp, Homo sapien
agcttgggcctcatcctcatgtcat

SEQ ID NO: 568499 - DNA, 25 bp, Homo sapien
ttgggcctcatcctcatgtcatcct

SEQ ID NO: 568500 - DNA, 25 bp, Homo sapien
ctcatcctcatgtcatccttctagg

SEQ ID NO: 568501 - DNA, 25 bp, Homo sapien
tcaggcctgcagactgggctggtgc

SEQ ID NO: 568502 - DNA, 25 bp, Homo sapien
tgggctggtgcctcctccgcttcag

SEQ ID NO: 568503 - DNA, 25 bp, Homo sapien
ctcctccgcttcagggtatgggagt

SEQ ID NO: 568504 - DNA, 25 bp, Homo sapien
tcctccgcttcagggtatgggagtt

SEQ ID NO: 568505 - DNA, 25 bp, Homo sapien
ccgcttcagggtatgggagttggtg

SEQ ID NO: 568506 - DNA, 25 bp, Homo sapien
tgttcttccctgtggtctcatcact

SEQ ID NO: 568507 - DNA, 25 bp, Homo sapien
ttctccacatggtatctccagcaag

SEQ ID NO: 568508 - DNA, 25 bp, Homo sapien
ccagcaagctagaaggacctcttac

SEQ ID NO: 568509 - DNA, 25 bp, Homo sapien
ggacctcttacatgaaggcttagga

SEQ ID NO: 568510 - DNA, 25 bp, Homo sapien
gcttaggattccatgagaccagtgt

SEQ ID NO: 568511 - DNA, 25 bp, Homo sapien
accagtgtgaaagctacatcttctg

SEQ ID NO: 568512 - DNA, 25 bp, Homo sapien
acatcttctgaaatgctggtcccag

SEQ ID NO: 568513 - DNA, 25 bp, Homo sapien
tggtcccagaactctcatagagtca

SEQ ID NO: 568514 - DNA, 25 bp, Homo sapien
gagtcactctccagatatcttttga

SEQ ID NO: 568515 - DNA, 25 bp, Homo sapien
gcaggcacaggccagtgaagattca

SEQ ID NO: 568516 - DNA, 25 bp, Homo sapien
ggaccctgactcttcgttggagaaa

SEQ ID NO: 568517 - DNA, 25 bp, Homo sapien
acatggttcctccaagtcataagca

SEQ ID NO: 568518 - DNA, 25 bp, Homo sapien
atggttcctccaagtcataagcatc

SEQ ID NO: 568519 - DNA, 25 bp, Homo sapien
tggttcctccaagtcataagcatcc

SEQ ID NO: 568520 - DNA, 25 bp, Homo sapien
ggttcctccaagtcataagcatcca

SEQ ID NO: 568521 - DNA, 25 bp, Homo sapien
gttcctccaagtcataagcatccaa

SEQ ID NO: 568522 - DNA, 25 bp, Homo sapien
ttcctccaagtcataagcatccaag

SEQ ID NO: 568523 - DNA, 25 bp, Homo sapien
tcctccaagtcataagcatccaagt

SEQ ID NO: 568524 - DNA, 25 bp, Homo sapien
tccaagtcataagcatccaagtcaa

SEQ ID NO: 568525 - DNA, 25 bp, Homo sapien
caagtcataagcatccaagtcaaaa

SEQ ID NO: 568526 - DNA, 25 bp, Homo sapien
gtcataagcatccaagtcaaaacat

SEQ ID NO: 568527 - DNA, 25 bp, Homo sapien
ataagcatccaagtcaaaacatact

SEQ ID NO: 568528 - DNA, 25 bp, Homo sapien
ggctatgtgaccctactataaggtg

SEQ ID NO: 568529 - DNA, 25 bp, Homo sapien
aacaccaacagcttaaacttcttag

SEQ ID NO: 568530 - DNA, 25 bp, Homo sapien
agatcaaaggacatcctccaggcca

SEQ ID NO: 568531 - DNA, 25 bp, Homo sapien
atcctccaggccaaaatgtttccac

SEQ ID NO: 568532 - DNA, 25 bp, Homo sapien
tttccactggaacggtttctttgct

SEQ ID NO: 568533 - DNA, 25 bp, Homo sapien
cactggaacggtttctttgcttcct

SEQ ID NO: 568534 - DNA, 25 bp, Homo sapien
ttcctgattaaaagcttccctaata

SEQ ID NO: 568535 - DNA, 25 bp, Homo sapien
tccctaatatatttccacgtgttat

SEQ ID NO: 568536 - DNA, 25 bp, Homo sapien
atatatttccacgtgttattacata

SEQ ID NO: 568537 - DNA, 25 bp, Homo sapien
catattttcgtattcactttgatgg

SEQ ID NO: 568538 - DNA, 25 bp, Homo sapien
ggaaagcaagaatagcagccaaata

SEQ ID NO: 568539 - DNA, 25 bp, Homo sapien
ccaggaactgactgggcactagaaa

SEQ ID NO: 568540 - DNA, 25 bp, Homo sapien
caggaactgactgggcactagaaaa

SEQ ID NO: 568541 - DNA, 25 bp, Homo sapien
aactgactgggcactagaaaacagc

SEQ ID NO: 568542 - DNA, 25 bp, Homo sapien
ctgactgggcactagaaaacagctt

SEQ ID NO: 568543 - DNA, 25 bp, Homo sapien
gactgggcactagaaaacagcttca

SEQ ID NO: 568544 - DNA, 25 bp, Homo sapien
actgggcactagaaaacagcttcaa

SEQ ID NO: 568545 - DNA, 25 bp, Homo sapien
tgggcactagaaaacagcttcaaca

SEQ ID NO: 568546 - DNA, 25 bp, Homo sapien
gggcactagaaaacagcttcaacat

SEQ ID NO: 568547 - DNA, 25 bp, Homo sapien
ggcactagaaaacagcttcaacatc

SEQ ID NO: 568548 - DNA, 25 bp, Homo sapien
actagaaaacagcttcaacatcctg

SEQ ID NO: 568549 - DNA, 25 bp, Homo sapien
ctagaaaacagcttcaacatcctgt

SEQ ID NO: 568550 - DNA, 25 bp, Homo sapien
agaggcggctagagcatcacctctt

SEQ ID NO: 568551 - DNA, 25 bp, Homo sapien
tagagcatcacctcttcacgcaagt

SEQ ID NO: 568552 - DNA, 25 bp, Homo sapien
cacctcttcacgcaagtgtcttgaa

SEQ ID NO: 568553 - DNA, 25 bp, Homo sapien
ttcacgcaagtgtcttgaaactcag

SEQ ID NO: 568554 - DNA, 25 bp, Homo sapien
aagtgtcttgaaactcagcttgaag

SEQ ID NO: 568555 - DNA, 25 bp, Homo sapien
tgtcttgaaactcagcttgaagatt

SEQ ID NO: 568556 - DNA, 25 bp, Homo sapien
aagagggagtcagcccatcgggatt

SEQ ID NO: 568557 - DNA, 25 bp, Homo sapien
gggagtcagcccatcgggattaaaa

SEQ ID NO: 568558 - DNA, 25 bp, Homo sapien
cagcccatcgggattaaaaatatag

SEQ ID NO: 568559 - DNA, 25 bp, Homo sapien
ttaaaaatatagaggcagtgacaac

SEQ ID NO: 568560 - DNA, 25 bp, Homo sapien
gtgacaacacacactcggcttcagt

SEQ ID NO: 568561 - DNA, 25 bp, Homo sapien
ggttggacccaatagatagatctaa

SEQ ID NO: 568562 - DNA, 25 bp, Homo sapien
gatctaatctcagcctaactctatt

SEQ ID NO: 568563 - DNA, 25 bp, Homo sapien
tccccaatcctcctgtgagtaaaag

SEQ ID NO: 568564 - DNA, 25 bp, Homo sapien
ggaccctttaggatcgcttagaata

SEQ ID NO: 568565 - DNA, 25 bp, Homo sapien
actggaggagtattatggcgctgac

SEQ ID NO: 568566 - DNA, 25 bp, Homo sapien
ggcgctgactcatatggttacctaa

SEQ ID NO: 568567 - DNA, 25 bp, Homo sapien
tatggttacctaagatccccttatt

SEQ ID NO: 568568 - DNA, 25 bp, Homo sapien
gtatctggtacttatggctggaatt

SEQ ID NO: 568569 - DNA, 25 bp, Homo sapien
tggtggccaagctcaatcacattca

SEQ ID NO: 568570 - DNA, 25 bp, Homo sapien
taaaatttaccaggagacccggctg

SEQ ID NO: 568571 - DNA, 25 bp, Homo sapien
gacccggctgtcttggtggctagca

SEQ ID NO: 568572 - DNA, 25 bp, Homo sapien
caagcagcatgtggcagggcagcat

SEQ ID NO: 568573 - DNA, 25 bp, Homo sapien
gaaagagccacagcacagaggcctg

SEQ ID NO: 568574 - DNA, 25 bp, Homo sapien
aaagagccacagcacagaggcctgc

SEQ ID NO: 568575 - DNA, 25 bp, Homo sapien
aagagccacagcacagaggcctgct

SEQ ID NO: 568576 - DNA, 25 bp, Homo sapien
agagccacagcacagaggcctgctg

SEQ ID NO: 568577 - DNA, 25 bp, Homo sapien
ttaggtcagcggagaccacggccca

SEQ ID NO: 568578 - DNA, 25 bp, Homo sapien
taggtcagcggagaccacggcccat

SEQ ID NO: 568579 - DNA, 25 bp, Homo sapien
aggtcagcggagaccacggcccatg

SEQ ID NO: 568580 - DNA, 25 bp, Homo sapien
tcagcggagaccacggcccatggga

SEQ ID NO: 568581 - DNA, 25 bp, Homo sapien
cagcggagaccacggcccatgggac

SEQ ID NO: 568582 - DNA, 25 bp, Homo sapien
ggagaccacggcccatgggacctgg

SEQ ID NO: 568583 - DNA, 25 bp, Homo sapien
aaggaactggattgccgctgcaggc

SEQ ID NO: 568584 - DNA, 25 bp, Homo sapien
tggattgccgctgcaggctccctga

SEQ ID NO: 568585 - DNA, 25 bp, Homo sapien
aattaaacatatgtggcaaccagca

SEQ ID NO: 568586 - DNA, 25 bp, Homo sapien
tgtggcaaccagcatcaagcaaact

SEQ ID NO: 568587 - DNA, 25 bp, Homo sapien
tcaagcaaactattggcaccgtttt

SEQ ID NO: 568588 - DNA, 25 bp, Homo sapien
tggcaccgttttccaacagcgttgg

SEQ ID NO: 568589 - DNA, 25 bp, Homo sapien
aacagcgttggtatctccgtgtcac

SEQ ID NO: 568590 - DNA, 25 bp, Homo sapien
ggtatctccgtgtcacattttgtat

SEQ ID NO: 568591 - DNA, 25 bp, Homo sapien
tgcaactccctgtccacaaggaatt

SEQ ID NO: 568592 - DNA, 25 bp, Homo sapien
aattattccactacttgccatgtct

SEQ ID NO: 568593 - DNA, 25 bp, Homo sapien
attccactacttgccatgtcttaaa

SEQ ID NO: 568594 - DNA, 25 bp, Homo sapien
aatagcaggcagttggtaatggcaa

SEQ ID NO: 568595 - DNA, 25 bp, Homo sapien
agcaggcagttggtaatggcaaaac

SEQ ID NO: 568596 - DNA, 25 bp, Homo sapien
caggcagttggtaatggcaaaacca

SEQ ID NO: 568597 - DNA, 25 bp, Homo sapien
catttgaagagcacaacagttgaag

SEQ ID NO: 568598 - DNA, 25 bp, Homo sapien
aacagttgaaggagattgtcctggc

SEQ ID NO: 568599 - DNA, 25 bp, Homo sapien
gccacagaaagtagattgatgagca

SEQ ID NO: 568600 - DNA, 25 bp, Homo sapien
gatgagcatcttgggtagaatgaca

SEQ ID NO: 568601 - DNA, 25 bp, Homo sapien
gcatcttgggtagaatgacaaaggt

SEQ ID NO: 568602 - DNA, 25 bp, Homo sapien
acaaaggtgtagaaggtctcagatg

SEQ ID NO: 568603 - DNA, 25 bp, Homo sapien
aggtgtagaaggtctcagatgttga

SEQ ID NO: 568604 - DNA, 25 bp, Homo sapien
tcagatgttgagagaatgccaagga

SEQ ID NO: 568605 - DNA, 25 bp, Homo sapien
ggctgttctccaggcaggcaggtct

SEQ ID NO: 568606 - DNA, 25 bp, Homo sapien
aggtctgggttgctgcgtcactggg

SEQ ID NO: 568607 - DNA, 25 bp, Homo sapien
agtgcccacaatgaggcagggtcct

SEQ ID NO: 568608 - DNA, 25 bp, Homo sapien
tgcccacaatgaggcagggtcctgt

SEQ ID NO: 568609 - DNA, 25 bp, Homo sapien
caatgaggcagggtcctgtcccaaa

SEQ ID NO: 568610 - DNA, 25 bp, Homo sapien
tgaggcagggtcctgtcccaaacag

SEQ ID NO: 568611 - DNA, 25 bp, Homo sapien
aggcagggtcctgtcccaaacagca

SEQ ID NO: 568612 - DNA, 25 bp, Homo sapien
gcagggtcctgtcccaaacagcact

SEQ ID NO: 568613 - DNA, 25 bp, Homo sapien
acagcactaggagaatgctggagat

SEQ ID NO: 568614 - DNA, 25 bp, Homo sapien
accctccatccaatgctgggtggcg

SEQ ID NO: 568615 - DNA, 25 bp, Homo sapien
tccatccaatgctgggtggcgggca

SEQ ID NO: 568616 - DNA, 25 bp, Homo sapien
gaatcggatcaagcctctagaggag

SEQ ID NO: 568617 - DNA, 25 bp, Homo sapien
gggtcattcctggagcataaacgat

SEQ ID NO: 568618 - DNA, 25 bp, Homo sapien
gagcataaacgatccctgcagaaca

SEQ ID NO: 568619 - DNA, 25 bp, Homo sapien
gaacatgggctagaagaccccacag

SEQ ID NO: 568620 - DNA, 25 bp, Homo sapien
gaagacctggacatcaaccctattt

SEQ ID NO: 568621 - DNA, 25 bp, Homo sapien
aaccctatttcattgtgcctctgca

SEQ ID NO: 568622 - DNA, 25 bp, Homo sapien
tcccaacttttggagctgtagctgc

SEQ ID NO: 568623 - DNA, 25 bp, Homo sapien
agacttgtggtttcctgtacctgga

SEQ ID NO: 568624 - DNA, 25 bp, Homo sapien
ggaggcccaggtcattctgttaagt

SEQ ID NO: 568625 - DNA, 25 bp, Homo sapien
ttaagtcccttgtctatttcctgct

SEQ ID NO: 568626 - DNA, 25 bp, Homo sapien
ttcctgcttttatctggatgctgag

SEQ ID NO: 568627 - DNA, 25 bp, Homo sapien
tcggtcagccactccgtggacgtgg

SEQ ID NO: 568628 - DNA, 25 bp, Homo sapien
tgggccacggtgacccaccatgaag

SEQ ID NO: 568629 - DNA, 25 bp, Homo sapien
atgaagtccccactagccactcgat

SEQ ID NO: 568630 - DNA, 25 bp, Homo sapien
tcgattccctgctctgtcagagttg

SEQ ID NO: 568631 - DNA, 25 bp, Homo sapien
gctctgtcagagttgctgcacatca

SEQ ID NO: 568632 - DNA, 25 bp, Homo sapien
tcagagttgctgcacatcacaccag

SEQ ID NO: 568633 - DNA, 25 bp, Homo sapien
ctgccaagagcaggagtcaccacag

SEQ ID NO: 568634 - DNA, 25 bp, Homo sapien
aggagtcaccacaggctgaatgccc

SEQ ID NO: 568635 - DNA, 25 bp, Homo sapien
cacaggctgaatgcccacgaggagc

SEQ ID NO: 568636 - DNA, 25 bp, Homo sapien
gaggagctctgctgagactctcaag

SEQ ID NO: 568637 - DNA, 25 bp, Homo sapien
gactctcaagggagccagtgaaaga

SEQ ID NO: 568638 - DNA, 25 bp, Homo sapien
agtcatgatatcaggttagtttgcc

SEQ ID NO: 568639 - DNA, 25 bp, Homo sapien
catgatatcaggttagtttgccata

SEQ ID NO: 568640 - DNA, 25 bp, Homo sapien
gatatcaggttagtttgccatattt

SEQ ID NO: 568641 - DNA, 25 bp, Homo sapien
tcaggttagtttgccatatttttta

SEQ ID NO: 568642 - DNA, 25 bp, Homo sapien
aaaacttataatgcagactattctg

SEQ ID NO: 568643 - DNA, 25 bp, Homo sapien
acttataatgcagactattctgttt

SEQ ID NO: 568644 - DNA, 25 bp, Homo sapien
tttgttttttatttgcagaaagatt

SEQ ID NO: 568645 - DNA, 25 bp, Homo sapien
ataacttgggaatatataacctgat

SEQ ID NO: 568646 - DNA, 25 bp, Homo sapien
aaattaatactgacagtgaggccaa

SEQ ID NO: 568647 - DNA, 25 bp, Homo sapien
taatactgacagtgaggccaaaaaa

SEQ ID NO: 568648 - DNA, 25 bp, Homo sapien
atctaaatgttgctttcagcataat

SEQ ID NO: 568649 - DNA, 25 bp, Homo sapien
attggccgtcaaattagtgttgaac

SEQ ID NO: 568650 - DNA, 25 bp, Homo sapien
agaaatctgctctcctgattgtttc

SEQ ID NO: 568651 - DNA, 25 bp, Homo sapien
tctgctctcctgattgtttcatatg

SEQ ID NO: 568652 - DNA, 25 bp, Homo sapien
ctcctgattgtttcatatgtgttga

SEQ ID NO: 568653 - DNA, 25 bp, Homo sapien
ttgtgctgtactttactagaactga

SEQ ID NO: 568654 - DNA, 25 bp, Homo sapien
gctgtactttactagaactgaaatt

SEQ ID NO: 568655 - DNA, 25 bp, Homo sapien
gggtgtgatgcatgcaagaaagact

SEQ ID NO: 568656 - DNA, 25 bp, Homo sapien
gaaagactggaattcaagtccgcag

SEQ ID NO: 568657 - DNA, 25 bp, Homo sapien
aattcaagtccgcagatccaatctc

SEQ ID NO: 568658 - DNA, 25 bp, Homo sapien
ttcaagtccgcagatccaatctcaa

SEQ ID NO: 568659 - DNA, 25 bp, Homo sapien
ttggccctacacagaggattggtga

SEQ ID NO: 568660 - DNA, 25 bp, Homo sapien
ggaggcccagggagctcccgtctgt

SEQ ID NO: 568661 - DNA, 25 bp, Homo sapien
gaggcccagggagctcccgtctgtg

SEQ ID NO: 568662 - DNA, 25 bp, Homo sapien
ggcccagggagctcccgtctgtgtc

SEQ ID NO: 568663 - DNA, 25 bp, Homo sapien
agggagctcccgtctgtgtcccctt

SEQ ID NO: 568664 - DNA, 25 bp, Homo sapien
tcccgtctgtgtccccttccaaatc

SEQ ID NO: 568665 - DNA, 25 bp, Homo sapien
tgttctcgtgacagtaactctcacg

SEQ ID NO: 568666 - DNA, 25 bp, Homo sapien
gttctcgtgacagtaactctcacga

SEQ ID NO: 568667 - DNA, 25 bp, Homo sapien
tgacagtaactctcacgagatctga

SEQ ID NO: 568668 - DNA, 25 bp, Homo sapien
attataagggggagcttttcctgca

SEQ ID NO: 568669 - DNA, 25 bp, Homo sapien
tgtgacttgcttctcgtcttccacc

SEQ ID NO: 568670 - DNA, 25 bp, Homo sapien
cagccaccaaccatgtggaactgta

SEQ ID NO: 568671 - DNA, 25 bp, Homo sapien
gacctgttaactcacctgtgggcag

SEQ ID NO: 568672 - DNA, 25 bp, Homo sapien
acctgtgggcaggatgtgtagacca

SEQ ID NO: 568673 - DNA, 25 bp, Homo sapien
gatgtgtagaccatgtagcatatgt

SEQ ID NO: 568674 - DNA, 25 bp, Homo sapien
tgattgaatacacagccagtccctc

SEQ ID NO: 568675 - DNA, 25 bp, Homo sapien
gaagccactcccaggtgggtgcatc

SEQ ID NO: 568676 - DNA, 25 bp, Homo sapien
gcatcctggctgactttcctggaaa

SEQ ID NO: 568677 - DNA, 25 bp, Homo sapien
ttcctggaaagtcccgatgctacac

SEQ ID NO: 568678 - DNA, 25 bp, Homo sapien
tcccgatgctacactgacaactaca

SEQ ID NO: 568679 - DNA, 25 bp, Homo sapien
gacaactacattctctttagcaatt

SEQ ID NO: 568680 - DNA, 25 bp, Homo sapien
caattgtaggatggccagcaaggac

SEQ ID NO: 568681 - DNA, 25 bp, Homo sapien
acactgtggttatcggcggtggaaa

SEQ ID NO: 568682 - DNA, 25 bp, Homo sapien
tcagggaaggcctcgcattgtgcca

SEQ ID NO: 568683 - DNA, 25 bp, Homo sapien
gaaggcctcgcattgtgccatccag

SEQ ID NO: 568684 - DNA, 25 bp, Homo sapien
ttggccacggccagtctgaggcagt

SEQ ID NO: 568685 - DNA, 25 bp, Homo sapien
ccagtctgaggcagtgtgggctcct

SEQ ID NO: 568686 - DNA, 25 bp, Homo sapien
agtgtgggctcctgcgcctgttgtc

SEQ ID NO: 568687 - DNA, 25 bp, Homo sapien
tcctgcgcctgttgtctttgaagtc

SEQ ID NO: 568688 - DNA, 25 bp, Homo sapien
gcgcctgttgtctttgaagtccctg

SEQ ID NO: 568689 - DNA, 25 bp, Homo sapien
tttgaagtccctgcaaccagatcag

SEQ ID NO: 568690 - DNA, 25 bp, Homo sapien
tgaagtccctgcaaccagatcagct

SEQ ID NO: 568691 - DNA, 25 bp, Homo sapien
aagtccctgcaaccagatcagctct

SEQ ID NO: 568692 - DNA, 25 bp, Homo sapien
ctctctgctctctgagatcccaggg

SEQ ID NO: 568693 - DNA, 25 bp, Homo sapien
agaaggcaccaaagcaatggggttc

SEQ ID NO: 568694 - DNA, 25 bp, Homo sapien
gaaggcaccaaagcaatggggttca

SEQ ID NO: 568695 - DNA, 25 bp, Homo sapien
aaggcaccaaagcaatggggttcat

SEQ ID NO: 568696 - DNA, 25 bp, Homo sapien
aggcaccaaagcaatggggttcatc

SEQ ID NO: 568697 - DNA, 25 bp, Homo sapien
ggcaccaaagcaatggggttcatca

SEQ ID NO: 568698 - DNA, 25 bp, Homo sapien
gcaccaaagcaatggggttcatcaa

SEQ ID NO: 568699 - DNA, 25 bp, Homo sapien
caccaaagcaatggggttcatcaac

SEQ ID NO: 568700 - DNA, 25 bp, Homo sapien
accaaagcaatggggttcatcaact

SEQ ID NO: 568701 - DNA, 25 bp, Homo sapien
caaagcaatggggttcatcaactca

SEQ ID NO: 568702 - DNA, 25 bp, Homo sapien
aaagcaatggggttcatcaactcag

SEQ ID NO: 568703 - DNA, 25 bp, Homo sapien
aagcaatggggttcatcaactcagg

SEQ ID NO: 568704 - DNA, 25 bp, Homo sapien
gggaggcccagggagctcccgtctg

SEQ ID NO: 568705 - DNA, 25 bp, Homo sapien
ggaggcccagggagctcccgtctgt

SEQ ID NO: 568706 - DNA, 25 bp, Homo sapien
gaggcccagggagctcccgtctgtg

SEQ ID NO: 568707 - DNA, 25 bp, Homo sapien
aggcccagggagctcccgtctgtgt

SEQ ID NO: 568708 - DNA, 25 bp, Homo sapien
ggcccagggagctcccgtctgtgtc

SEQ ID NO: 568709 - DNA, 25 bp, Homo sapien
gcccagggagctcccgtctgtgtcc

SEQ ID NO: 568710 - DNA, 25 bp, Homo sapien
cccagggagctcccgtctgtgtccc

SEQ ID NO: 568711 - DNA, 25 bp, Homo sapien
ccagggagctcccgtctgtgtcccc

SEQ ID NO: 568712 - DNA, 25 bp, Homo sapien
tcccgtctgtgtccccttccaaatc

SEQ ID NO: 568713 - DNA, 25 bp, Homo sapien
aatcttgatttccagctaagtaagg

SEQ ID NO: 568714 - DNA, 25 bp, Homo sapien
atcttgatttccagctaagtaaggc

SEQ ID NO: 568715 - DNA, 25 bp, Homo sapien
tcttgatttccagctaagtaaggct

SEQ ID NO: 568716 - DNA, 25 bp, Homo sapien
atatggctataaaattcttcgtcta

SEQ ID NO: 568717 - DNA, 25 bp, Homo sapien
atggctataaaattcttcgtctata

SEQ ID NO: 568718 - DNA, 25 bp, Homo sapien
ggctataaaattcttcgtctataaa

SEQ ID NO: 568719 - DNA, 25 bp, Homo sapien
taaaattcttcgtctataaagtgaa

SEQ ID NO: 568720 - DNA, 25 bp, Homo sapien
gaatgtagactaggtgatattttaa

SEQ ID NO: 568721 - DNA, 25 bp, Homo sapien
tttaaaagctgcattcagttctcaa

SEQ ID NO: 568722 - DNA, 25 bp, Homo sapien
agctgcattcagttctcaaaaattt

SEQ ID NO: 568723 - DNA, 25 bp, Homo sapien
gctgcattcagttctcaaaaatttt

SEQ ID NO: 568724 - DNA, 25 bp, Homo sapien
acctggttctctgtcttgtgaggct

SEQ ID NO: 568725 - DNA, 25 bp, Homo sapien
ggttctctgtcttgtgaggctcacc

SEQ ID NO: 568726 - DNA, 25 bp, Homo sapien
tgtcttgtgaggctcacccttggaa

SEQ ID NO: 568727 - DNA, 25 bp, Homo sapien
gtgaggctcacccttggaacccagc

SEQ ID NO: 568728 - DNA, 25 bp, Homo sapien
gccatcatgctgtgacaaagccatg

SEQ ID NO: 568729 - DNA, 25 bp, Homo sapien
atgctgtgacaaagccatgtaccac

SEQ ID NO: 568730 - DNA, 25 bp, Homo sapien
gacaaagccatgtaccacatgcagg

SEQ ID NO: 568731 - DNA, 25 bp, Homo sapien
catgtaccacatgcaggtgtttcgg

SEQ ID NO: 568732 - DNA, 25 bp, Homo sapien
acagccaacatcagtcagcatcaac

SEQ ID NO: 568733 - DNA, 25 bp, Homo sapien
gcatcaaccactagacatgtaagtg

SEQ ID NO: 568734 - DNA, 25 bp, Homo sapien
tagacatgtaagtgaggaagcctcc

SEQ ID NO: 568735 - DNA, 25 bp, Homo sapien
cacatcactgcttggataatcccag

SEQ ID NO: 568736 - DNA, 25 bp, Homo sapien
acatcactgcttggataatcccagg

SEQ ID NO: 568737 - DNA, 25 bp, Homo sapien
catcactgcttggataatcccagga

SEQ ID NO: 568738 - DNA, 25 bp, Homo sapien
atcactgcttggataatcccaggaa

SEQ ID NO: 568739 - DNA, 25 bp, Homo sapien
tcactgcttggataatcccaggaaa

SEQ ID NO: 568740 - DNA, 25 bp, Homo sapien
cactgcttggataatcccaggaaaa

SEQ ID NO: 568741 - DNA, 25 bp, Homo sapien
actgcttggataatcccaggaaaat

SEQ ID NO: 568742 - DNA, 25 bp, Homo sapien
ctgcttggataatcccaggaaaatg

SEQ ID NO: 568743 - DNA, 25 bp, Homo sapien
tgcttggataatcccaggaaaatgc

SEQ ID NO: 568744 - DNA, 25 bp, Homo sapien
gcttggataatcccaggaaaatgca

SEQ ID NO: 568745 - DNA, 25 bp, Homo sapien
cttggataatcccaggaaaatgcag

SEQ ID NO: 568746 - DNA, 25 bp, Homo sapien
caaactgtagtcctagtgacaggaa

SEQ ID NO: 568747 - DNA, 25 bp, Homo sapien
gtgacaggaagtgacgaccctctct

SEQ ID NO: 568748 - DNA, 25 bp, Homo sapien
gaagtgacgaccctctctgcctaaa

SEQ ID NO: 568749 - DNA, 25 bp, Homo sapien
ccctgtgcagccatatttatcttct

SEQ ID NO: 568750 - DNA, 25 bp, Homo sapien
cagccatatttatcttctgcttccc

SEQ ID NO: 568751 - DNA, 25 bp, Homo sapien
tcttctgcttccctttgtgacctgt

SEQ ID NO: 568752 - DNA, 25 bp, Homo sapien
tgtgacctgttgctgtcacataccc

SEQ ID NO: 568753 - DNA, 25 bp, Homo sapien
tgtcacatacccctttgttctcatc

SEQ ID NO: 568754 - DNA, 25 bp, Homo sapien
acaatgccctcactaatactccatt

SEQ ID NO: 568755 - DNA, 25 bp, Homo sapien
taatactccattgcccccatagagg

SEQ ID NO: 568756 - DNA, 25 bp, Homo sapien
agaggacagccccaccgtgccaggt

SEQ ID NO: 568757 - DNA, 25 bp, Homo sapien
tccaagagcatcaggacaacaagcc

SEQ ID NO: 568758 - DNA, 25 bp, Homo sapien
ccaagagcatcaggacaacaagcct

SEQ ID NO: 568759 - DNA, 25 bp, Homo sapien
agacaagagaatcagtatccctggc

SEQ ID NO: 568760 - DNA, 25 bp, Homo sapien
gacaagagaatcagtatccctggcc

SEQ ID NO: 568761 - DNA, 25 bp, Homo sapien
acaagagaatcagtatccctggccc

SEQ ID NO: 568762 - DNA, 25 bp, Homo sapien
caagagaatcagtatccctggccca

SEQ ID NO: 568763 - DNA, 25 bp, Homo sapien
aagagaatcagtatccctggcccag

SEQ ID NO: 568764 - DNA, 25 bp, Homo sapien
agagaatcagtatccctggcccagg

SEQ ID NO: 568765 - DNA, 25 bp, Homo sapien
gagaatcagtatccctggcccaggg

SEQ ID NO: 568766 - DNA, 25 bp, Homo sapien
agaatcagtatccctggcccaggga

SEQ ID NO: 568767 - DNA, 25 bp, Homo sapien
gaatcagtatccctggcccagggag

SEQ ID NO: 568768 - DNA, 25 bp, Homo sapien
tttagcattccttttgcccctcata

SEQ ID NO: 568769 - DNA, 25 bp, Homo sapien
ttccttttgcccctcatattgaaga

SEQ ID NO: 568770 - DNA, 25 bp, Homo sapien
ttgcccctcatattgaagatctggt

SEQ ID NO: 568771 - DNA, 25 bp, Homo sapien
tgaagatctggtcatgcttcccact

SEQ ID NO: 568772 - DNA, 25 bp, Homo sapien
gtcatgcttcccactccagtgctaa

SEQ ID NO: 568773 - DNA, 25 bp, Homo sapien
ctgctgaatgtgctggatgatgatt

SEQ ID NO: 568774 - DNA, 25 bp, Homo sapien
gagtatgcaaatgctggtgattcca

SEQ ID NO: 568775 - DNA, 25 bp, Homo sapien
gtgattccaaagctgcgcagaaatt

SEQ ID NO: 568776 - DNA, 25 bp, Homo sapien
gctgcgcagaaattactgactggaa

SEQ ID NO: 568777 - DNA, 25 bp, Homo sapien
tgtggctacattctacccgctgagt

SEQ ID NO: 568778 - DNA, 25 bp, Homo sapien
ggatatctgtatcaaaccttgcttt

SEQ ID NO: 568779 - DNA, 25 bp, Homo sapien
acagttcatgagttgcattgtagca

SEQ ID NO: 568780 - DNA, 25 bp, Homo sapien
ttgtagcagacaatggacaactgta

SEQ ID NO: 568781 - DNA, 25 bp, Homo sapien
gaattgacttctatagccatctttt

SEQ ID NO: 568782 - DNA, 25 bp, Homo sapien
acttctatagccatcttttcccttt

SEQ ID NO: 568783 - DNA, 25 bp, Homo sapien
gagtagactagcaaaattccctttt

SEQ ID NO: 568784 - DNA, 25 bp, Homo sapien
gaacaaacctcatttaccagtgctt

SEQ ID NO: 568785 - DNA, 25 bp, Homo sapien
ctcatttaccagtgctttttctttg

SEQ ID NO: 568786 - DNA, 25 bp, Homo sapien
tggtgaaaaatgcaagaccttccat

SEQ ID NO: 568787 - DNA, 25 bp, Homo sapien
gaccttccatatgtccaaattctgg

SEQ ID NO: 568788 - DNA, 25 bp, Homo sapien
gcttcatggagcagcttcgtacata

SEQ ID NO: 568789 - DNA, 25 bp, Homo sapien
agcttcgtacatatcaagagggcaa

SEQ ID NO: 568790 - DNA, 25 bp, Homo sapien
gaatggtcttccttagtcagtcgtg

SEQ ID NO: 568791 - DNA, 25 bp, Homo sapien
atgctggttatgatgagtttccttc

SEQ ID NO: 568792 - DNA, 25 bp, Homo sapien
tggttatgatgagtttccttcctag

SEQ ID NO: 568793 - DNA, 25 bp, Homo sapien
gggaaatactccacaatctttgatg

SEQ ID NO: 568794 - DNA, 25 bp, Homo sapien
aatactccacaatctttgatggata

SEQ ID NO: 568795 - DNA, 25 bp, Homo sapien
ataaaagggcattcatgttggatga

SEQ ID NO: 568796 - DNA, 25 bp, Homo sapien
ggatgaggacaacaatatcaggcaa

SEQ ID NO: 568797 - DNA, 25 bp, Homo sapien
acaatatcaggcaaatgtatcagtg

SEQ ID NO: 568798 - DNA, 25 bp, Homo sapien
atcaggcaaatgtatcagtgaaata

SEQ ID NO: 568799 - DNA, 25 bp, Homo sapien
gtgaaatacgcagaactgtgcctgg

SEQ ID NO: 568800 - DNA, 25 bp, Homo sapien
atacgcagaactgtgcctggccgtt

SEQ ID NO: 568801 - DNA, 25 bp, Homo sapien
gtgtatctgaggcacctcgccctga

SEQ ID NO: 568802 - DNA, 25 bp, Homo sapien
cctcgccctgactggtaaagcaaag

SEQ ID NO: 568803 - DNA, 25 bp, Homo sapien
agaaactggataggagaaggcctgt

SEQ ID NO: 568804 - DNA, 25 bp, Homo sapien
ttgagggcatcaatggctaactgtc

SEQ ID NO: 568805 - DNA, 25 bp, Homo sapien
tcaatggctaactgtcagcagggac

SEQ ID NO: 568806 - DNA, 25 bp, Homo sapien
gtcagcagggacaacagccattatc

SEQ ID NO: 568807 - DNA, 25 bp, Homo sapien
agccattatcccatatccagtgagt

SEQ ID NO: 568808 - DNA, 25 bp, Homo sapien
atcccatatccagtgagtacaacag

SEQ ID NO: 568809 - DNA, 25 bp, Homo sapien
gctgcagttttacatccagttcact

SEQ ID NO: 568810 - DNA, 25 bp, Homo sapien
atccagttcactgatcaactatcaa

SEQ ID NO: 568811 - DNA, 25 bp, Homo sapien
tgttcggatggcacaagtcaccacc

SEQ ID NO: 568812 - DNA, 25 bp, Homo sapien
aaacgcctgcaagatctttgacctt

SEQ ID NO: 568813 - DNA, 25 bp, Homo sapien
acgcctgcaagatctttgaccttgc

SEQ ID NO: 568814 - DNA, 25 bp, Homo sapien
acatggtccagcagaggaaagccca

SEQ ID NO: 568815 - DNA, 25 bp, Homo sapien
tggtccagcagaggaaagcccagcg

SEQ ID NO: 568816 - DNA, 25 bp, Homo sapien
acgattccccatcctctgagtgata

SEQ ID NO: 568817 - DNA, 25 bp, Homo sapien
ttccccatcctctgagtgataactt

SEQ ID NO: 568818 - DNA, 25 bp, Homo sapien
gagtgataacttgttcaaacccaaa

SEQ ID NO: 568819 - DNA, 25 bp, Homo sapien
gtgataacttgttcaaacccaaaga

SEQ ID NO: 568820 - DNA, 25 bp, Homo sapien
aaacccaaagaacggtgcatttcag

SEQ ID NO: 568821 - DNA, 25 bp, Homo sapien
aagaacggtgcatttcagagaagga

SEQ ID NO: 568822 - DNA, 25 bp, Homo sapien
cagagaaggagatgcatatgcgatc

SEQ ID NO: 568823 - DNA, 25 bp, Homo sapien
gggcacagtccacgagaagctcaag

SEQ ID NO: 568824 - DNA, 25 bp, Homo sapien
gctcaagtgggcctttaatctctac

SEQ ID NO: 568825 - DNA, 25 bp, Homo sapien
tgggcctttaatctctacgacatta

SEQ ID NO: 568826 - DNA, 25 bp, Homo sapien
tacgacattaacaaggatggctaca

SEQ ID NO: 568827 - DNA, 25 bp, Homo sapien
atcaccaaagaggagatgctggcca

SEQ ID NO: 568828 - DNA, 25 bp, Homo sapien
atgacatgatgggccgccacaccta

SEQ ID NO: 568829 - DNA, 25 bp, Homo sapien
gaggttcttcgagaaaatggaccgg

SEQ ID NO: 568830 - DNA, 25 bp, Homo sapien
ggtagtgaccattgaagagttcctg

SEQ ID NO: 568831 - DNA, 25 bp, Homo sapien
gaggcctgtcagaaggatgagaaca

SEQ ID NO: 568832 - DNA, 25 bp, Homo sapien
catgagctccatgcagctgtttgag

SEQ ID NO: 568833 - DNA, 25 bp, Homo sapien
ctccatgcagctgtttgagaatgtc

SEQ ID NO: 568834 - DNA, 25 bp, Homo sapien
acattggaggacgtgttttacgagc

SEQ ID NO: 568835 - DNA, 25 bp, Homo sapien
acgtgttttacgagcgtgaggtaca

SEQ ID NO: 568836 - DNA, 25 bp, Homo sapien
gaggtacaaatgaatgtgctggcat

SEQ ID NO: 568837 - DNA, 25 bp, Homo sapien
aatgtgctggcattcaacagacagt

SEQ ID NO: 568838 - DNA, 25 bp, Homo sapien
tcaacagacagttccactacggtgt

SEQ ID NO: 568839 - DNA, 25 bp, Homo sapien
gacagttccactacggtgtgtttta

SEQ ID NO: 568840 - DNA, 25 bp, Homo sapien
tccactacggtgtgttttatgcata

SEQ ID NO: 568841 - DNA, 25 bp, Homo sapien
gaatgtatttcacagaggcatcgaa

SEQ ID NO: 568842 - DNA, 25 bp, Homo sapien
gaggcatcgaactaaaatcaacagt

SEQ ID NO: 568843 - DNA, 25 bp, Homo sapien
tacattccaattttataacccaagt

SEQ ID NO: 568844 - DNA, 25 bp, Homo sapien
cccaagtaaggttctcaaatgtaga

SEQ ID NO: 568845 - DNA, 25 bp, Homo sapien
tgcgtttgacagtttgagatgacac

SEQ ID NO: 568846 - DNA, 25 bp, Homo sapien
aagagagcctggaccttcaaagctt

SEQ ID NO: 568847 - DNA, 25 bp, Homo sapien
gagcctggaccttcaaagcttgcaa

SEQ ID NO: 568848 - DNA, 25 bp, Homo sapien
aaagcttgcaaacggcccgggctat

SEQ ID NO: 568849 - DNA, 25 bp, Homo sapien
tcttcgctactcaaagcgctggcat

SEQ ID NO: 568850 - DNA, 25 bp, Homo sapien
aaagcgctggcatcgtttcctggga

SEQ ID NO: 568851 - DNA, 25 bp, Homo sapien
atcgtttcctgggaacctgtgagaa

SEQ ID NO: 568852 - DNA, 25 bp, Homo sapien
gagaaatgccgagtctcggacccat

SEQ ID NO: 568853 - DNA, 25 bp, Homo sapien
cgaatggaaacctaggcgttacgag

SEQ ID NO: 568854 - DNA, 25 bp, Homo sapien
taggcgttacgaggccccaggttca

SEQ ID NO: 568855 - DNA, 25 bp, Homo sapien
aggccccaggttcagcgtctcacgg

SEQ ID NO: 568856 - DNA, 25 bp, Homo sapien
ttatattaaagccacttccaggcaa

SEQ ID NO: 568857 - DNA, 25 bp, Homo sapien
ccacttccaggcaaaactaatattt

SEQ ID NO: 568858 - DNA, 25 bp, Homo sapien
gatagataccagaacagtggctgct

SEQ ID NO: 568859 - DNA, 25 bp, Homo sapien
aacagtggctgcttagagtgagggc

SEQ ID NO: 568860 - DNA, 25 bp, Homo sapien
gtgagggcagggaattcaaattgaa

SEQ ID NO: 568861 - DNA, 25 bp, Homo sapien
gttttgtattttgatctggatgatg

SEQ ID NO: 568862 - DNA, 25 bp, Homo sapien
atgatggttatgtagctgcatatat

SEQ ID NO: 568863 - DNA, 25 bp, Homo sapien
gtagctgcatatatttgtcaacatt

SEQ ID NO: 568864 - DNA, 25 bp, Homo sapien
tatatttgtcaacattcctcatgct

SEQ ID NO: 568865 - DNA, 25 bp, Homo sapien
acattcctcatgctgtatgtttaga

SEQ ID NO: 568866 - DNA, 25 bp, Homo sapien
gctgtatgtttagatttgtgatttt

SEQ ID NO: 568867 - DNA, 25 bp, Homo sapien
cgtcagagccaaccttactacaaaa

SEQ ID NO: 568868 - DNA, 25 bp, Homo sapien
tgggcacaccacatggcagagatgt

SEQ ID NO: 568869 - DNA, 25 bp, Homo sapien
gagaggagcaccaacgtggccatcg

SEQ ID NO: 568870 - DNA, 25 bp, Homo sapien
gatggttggttctatgacaccggac

SEQ ID NO: 568871 - DNA, 25 bp, Homo sapien
atgacaccggacatcatggagacag

SEQ ID NO: 568872 - DNA, 25 bp, Homo sapien
gagacagtgacctttgaagcccatt

SEQ ID NO: 568873 - DNA, 25 bp, Homo sapien
gaagcccattaaataagacccagag

SEQ ID NO: 568874 - DNA, 25 bp, Homo sapien
aaaggagcccagagctcatgggagt

SEQ ID NO: 568875 - DNA, 25 bp, Homo sapien
gagctcatgggagtgtccctggaaa

SEQ ID NO: 568876 - DNA, 25 bp, Homo sapien
gaaagcctattccagcgttctttac

SEQ ID NO: 568877 - DNA, 25 bp, Homo sapien
attccagcgttctttactgccgttt

SEQ ID NO: 568878 - DNA, 25 bp, Homo sapien
atgaatcaacttcagtgagctggtg

SEQ ID NO: 568879 - DNA, 25 bp, Homo sapien
gaaaatttttagaaaggctcacgca

SEQ ID NO: 568880 - DNA, 25 bp, Homo sapien
ttagaaaggctcacgcaaggctaga

SEQ ID NO: 568881 - DNA, 25 bp, Homo sapien
tcacgcaaggctagagaaggacttt

SEQ ID NO: 568882 - DNA, 25 bp, Homo sapien
tattttccctcttacagttaaagtg

SEQ ID NO: 568883 - DNA, 25 bp, Homo sapien
tttccctaggtgcaaaacagtgatt

SEQ ID NO: 568884 - DNA, 25 bp, Homo sapien
aacagtgattacttatgtgccaaaa

SEQ ID NO: 568885 - DNA, 25 bp, Homo sapien
ggccaaaaaatgtaccacaggaagt

SEQ ID NO: 568886 - DNA, 25 bp, Homo sapien
aattgttggctataaaggctgtaat

SEQ ID NO: 568887 - DNA, 25 bp, Homo sapien
ggctgtaattaagtcctaggagatg

SEQ ID NO: 568888 - DNA, 25 bp, Homo sapien
gtcctaggagatggcattatctgaa

SEQ ID NO: 568889 - DNA, 25 bp, Homo sapien
gtagcagactttagagggaatagat

SEQ ID NO: 568890 - DNA, 25 bp, Homo sapien
atttctgatcagtcctaaggtctgt

SEQ ID NO: 568891 - DNA, 25 bp, Homo sapien
cagtcctaaggtctgttgaaattta

SEQ ID NO: 568892 - DNA, 25 bp, Homo sapien
ctaaggtctgttgaaatttatgctg

SEQ ID NO: 568893 - DNA, 25 bp, Homo sapien
atttatgctggccagcttttcctga

SEQ ID NO: 568894 - DNA, 25 bp, Homo sapien
attatggagtcatgtccaacctccc

SEQ ID NO: 568895 - DNA, 25 bp, Homo sapien
ggcttgttcagatagttgggagact

SEQ ID NO: 568896 - DNA, 25 bp, Homo sapien
gttgactcaggcaaccaattcaagt

SEQ ID NO: 568897 - DNA, 25 bp, Homo sapien
ggcaaccaattcaagttacatagat

SEQ ID NO: 568898 - DNA, 25 bp, Homo sapien
gttacatagataccatagagcctac

SEQ ID NO: 568899 - DNA, 25 bp, Homo sapien
taccatagagcctacagtaaacaat

SEQ ID NO: 568900 - DNA, 25 bp, Homo sapien
ttttcatttatggactgtttaacga

SEQ ID NO: 568901 - DNA, 25 bp, Homo sapien
tggactgtttaacgatttttctcca

SEQ ID NO: 568902 - DNA, 25 bp, Homo sapien
gaacacaatatcgagttcctcccag

SEQ ID NO: 568903 - DNA, 25 bp, Homo sapien
acacaatatcgagttcctcccagtg

SEQ ID NO: 568904 - DNA, 25 bp, Homo sapien
agttcctcccagtgcttctaattaa

SEQ ID NO: 568905 - DNA, 25 bp, Homo sapien
tcctcccagtgcttctaattaacag

SEQ ID NO: 568906 - DNA, 25 bp, Homo sapien
tcccagtgcttctaattaacagacc

SEQ ID NO: 568907 - DNA, 25 bp, Homo sapien
gtgcttctaattaacagaccactga

SEQ ID NO: 568908 - DNA, 25 bp, Homo sapien
taacagaccactgaacgatctttgt

SEQ ID NO: 568909 - DNA, 25 bp, Homo sapien
aggaaaggctagcttcaggccagaa

SEQ ID NO: 568910 - DNA, 25 bp, Homo sapien
ctctagtctttcctaatatttggcc

SEQ ID NO: 568911 - DNA, 25 bp, Homo sapien
gatacaggatcttggttgactctca

SEQ ID NO: 568912 - DNA, 25 bp, Homo sapien
ggttgactctcactgcagtagacat

SEQ ID NO: 568913 - DNA, 25 bp, Homo sapien
cattgattttgtggtgtagcagctt

SEQ ID NO: 568914 - DNA, 25 bp, Homo sapien
atagttcatgaaggtgccccactac

SEQ ID NO: 568915 - DNA, 25 bp, Homo sapien
ctcctctcctgttacaatagatcac

SEQ ID NO: 568916 - DNA, 25 bp, Homo sapien
aatagatcacccatctttgttccca

SEQ ID NO: 568917 - DNA, 25 bp, Homo sapien
tttgttcccatctgaggactcaggt

SEQ ID NO: 568918 - DNA, 25 bp, Homo sapien
gactcaggtaatggacttcatctct

SEQ ID NO: 568919 - DNA, 25 bp, Homo sapien
tcatctcttcttgtcttctcaagga

SEQ ID NO: 568920 - DNA, 25 bp, Homo sapien
tttgcatctgccattatcctttctc

SEQ ID NO: 568921 - DNA, 25 bp, Homo sapien
cctcctgtatcctcagttgttttct

SEQ ID NO: 568922 - DNA, 25 bp, Homo sapien
atgcaaatttgccactgcctatttc

SEQ ID NO: 568923 - DNA, 25 bp, Homo sapien
gccactgcctatttctaatcgtaat

SEQ ID NO: 568924 - DNA, 25 bp, Homo sapien
atcgtaatagattctgtcatttcag

SEQ ID NO: 568925 - DNA, 25 bp, Homo sapien
agattctgtcatttcaggatttatt

SEQ ID NO: 568926 - DNA, 25 bp, Homo sapien
gggactggcaggtagtttttctctc

SEQ ID NO: 568927 - DNA, 25 bp, Homo sapien
gggcttcatttctgacttttcctga

SEQ ID NO: 568928 - DNA, 25 bp, Homo sapien
gaactgatctatcttctcagctctt

SEQ ID NO: 568929 - DNA, 25 bp, Homo sapien
ttctcagctcttcaggtgtcaatta

SEQ ID NO: 568930 - DNA, 25 bp, Homo sapien
gctcttcaggtgtcaattatacaat

SEQ ID NO: 568931 - DNA, 25 bp, Homo sapien
aagcaaatttttccaggctccctgt

SEQ ID NO: 568932 - DNA, 25 bp, Homo sapien
atttttccaggctccctgttataca

SEQ ID NO: 568933 - DNA, 25 bp, Homo sapien
gactatactgaatactggaggcaac

SEQ ID NO: 568934 - DNA, 25 bp, Homo sapien
atatatgaggtctgtcattgaccaa

SEQ ID NO: 568935 - DNA, 25 bp, Homo sapien
gaccaaaatgtcgtgatgtggcaca

SEQ ID NO: 568936 - DNA, 25 bp, Homo sapien
gatgtggcacacgattgtattaaaa

SEQ ID NO: 568937 - DNA, 25 bp, Homo sapien
acagaggctggtactttggatccta

SEQ ID NO: 568938 - DNA, 25 bp, Homo sapien
ggctggtactttggatcctagaaaa

SEQ ID NO: 568939 - DNA, 25 bp, Homo sapien
ggatcctagaaaatactcattactc

SEQ ID NO: 568940 - DNA, 25 bp, Homo sapien
gaaaatactcattactctagcacta

SEQ ID NO: 568941 - DNA, 25 bp, Homo sapien
atactcattactctagcactaaatt

SEQ ID NO: 568942 - DNA, 25 bp, Homo sapien
tatttctagagttctgtgcaggttc

SEQ ID NO: 568943 - DNA, 25 bp, Homo sapien
agagttctgtgcaggttcaaattgt

SEQ ID NO: 568944 - DNA, 25 bp, Homo sapien
tgttgcctggcttcctacactattt

SEQ ID NO: 568945 - DNA, 25 bp, Homo sapien
ggcttcctacactatttcttgtgtc

SEQ ID NO: 568946 - DNA, 25 bp, Homo sapien
tcttgtgtctttttcttgtagctaa

SEQ ID NO: 568947 - DNA, 25 bp, Homo sapien
gtctttttcttgtagctaaacttga

SEQ ID NO: 568948 - DNA, 25 bp, Homo sapien
gaacattttttccttgagtaccatt

SEQ ID NO: 568949 - DNA, 25 bp, Homo sapien
gagtaccattttacaatcaactgtg

SEQ ID NO: 568950 - DNA, 25 bp, Homo sapien
ctgtgcttttatgcagtggactttc

SEQ ID NO: 568951 - DNA, 25 bp, Homo sapien
gtggactttcactgaatgtccccta

SEQ ID NO: 568952 - DNA, 25 bp, Homo sapien
ctgaatgtcccctattggaaatttt

SEQ ID NO: 568953 - DNA, 25 bp, Homo sapien
atattattgaacatcctaggaacac

SEQ ID NO: 568954 - DNA, 25 bp, Homo sapien
ataaaacttgatctctgctttcaga

SEQ ID NO: 568955 - DNA, 25 bp, Homo sapien
tggaggtaccacagttgctcacggg

SEQ ID NO: 568956 - DNA, 25 bp, Homo sapien
ttgctcacgggttcacctgtggatg

SEQ ID NO: 568957 - DNA, 25 bp, Homo sapien
gtgagtgaagccacttcagacgttt

SEQ ID NO: 568958 - DNA, 25 bp, Homo sapien
aagccacttcagacgtttgcgtgca

SEQ ID NO: 568959 - DNA, 25 bp, Homo sapien
tcagacgtttgcgtgcaggtttggt

SEQ ID NO: 568960 - DNA, 25 bp, Homo sapien
ttgctggagcctatgttaagggtac

SEQ ID NO: 568961 - DNA, 25 bp, Homo sapien
ttaagggtacgttcaactcatcagc

SEQ ID NO: 568962 - DNA, 25 bp, Homo sapien
atcagctcaactgtcttccaaatgg

SEQ ID NO: 568963 - DNA, 25 bp, Homo sapien
agctcaactgtcttccaaatggcag

SEQ ID NO: 568964 - DNA, 25 bp, Homo sapien
tccaggcgcgctgcattttcatcag

SEQ ID NO: 568965 - DNA, 25 bp, Homo sapien
ctggcagtggtgattcataatgctt

SEQ ID NO: 568966 - DNA, 25 bp, Homo sapien
ggtgagtgtgtagcgggcttggtgt

SEQ ID NO: 568967 - DNA, 25 bp, Homo sapien
gtgagtgtgtagcgggcttggtgtt

SEQ ID NO: 568968 - DNA, 25 bp, Homo sapien
tgagtgtgtagcgggcttggtgttg

SEQ ID NO: 568969 - DNA, 25 bp, Homo sapien
gagtgtgtagcgggcttggtgttga

SEQ ID NO: 568970 - DNA, 25 bp, Homo sapien
agtgtgtagcgggcttggtgttgat

SEQ ID NO: 568971 - DNA, 25 bp, Homo sapien
gtgtgtagcgggcttggtgttgata

SEQ ID NO: 568972 - DNA, 25 bp, Homo sapien
tgtgtagcgggcttggtgttgataa

SEQ ID NO: 568973 - DNA, 25 bp, Homo sapien
gtgtagcgggcttggtgttgataag

SEQ ID NO: 568974 - DNA, 25 bp, Homo sapien
agttaaaaagagcatggccaggcgc

SEQ ID NO: 568975 - DNA, 25 bp, Homo sapien
gagaagctcaagtcctccagatgca

SEQ ID NO: 568976 - DNA, 25 bp, Homo sapien
gaagctcaagtcctccagatgcatt

SEQ ID NO: 568977 - DNA, 25 bp, Homo sapien
tcaagtcctccagatgcattcaagc

SEQ ID NO: 568978 - DNA, 25 bp, Homo sapien
gtcctccagatgcattcaagccaga

SEQ ID NO: 568979 - DNA, 25 bp, Homo sapien
agatgcattcaagccagaacacaga

SEQ ID NO: 568980 - DNA, 25 bp, Homo sapien
gaagaagacatcgaagccgagggca

SEQ ID NO: 568981 - DNA, 25 bp, Homo sapien
acatcgaagccgagggcagagagct

SEQ ID NO: 568982 - DNA, 25 bp, Homo sapien
taacacttgcacctgccttgctcaa

SEQ ID NO: 568983 - DNA, 25 bp, Homo sapien
ttgcacctgccttgctcaagagcag

SEQ ID NO: 568984 - DNA, 25 bp, Homo sapien
tacctgattccctaccgtgaaaact

SEQ ID NO: 568985 - DNA, 25 bp, Homo sapien
tgattccctaccgtgaaaactctta

SEQ ID NO: 568986 - DNA, 25 bp, Homo sapien
tagtaaacaggtactggtagccctt

SEQ ID NO: 568987 - DNA, 25 bp, Homo sapien
aaacaggtactggtagcccttggct

SEQ ID NO: 568988 - DNA, 25 bp, Homo sapien
gtactggtagcccttggcttttata

SEQ ID NO: 568989 - DNA, 25 bp, Homo sapien
agcccttggcttttatatcattgac

SEQ ID NO: 568990 - DNA, 25 bp, Homo sapien
cttggcttttatatcattgactttt

SEQ ID NO: 568991 - DNA, 25 bp, Homo sapien
gacttttcaaataactggcacatgg

SEQ ID NO: 568992 - DNA, 25 bp, Homo sapien
aactggcacatggaatactatacgt

SEQ ID NO: 568993 - DNA, 25 bp, Homo sapien
tggaatactatacgtgtcacctctg

SEQ ID NO: 568994 - DNA, 25 bp, Homo sapien
gaatactatacgtgtcacctctgaa

SEQ ID NO: 568995 - DNA, 25 bp, Homo sapien
atatactggattttgacttacgaac

SEQ ID NO: 568996 - DNA, 25 bp, Homo sapien
ggattttgacttacgaacatcattt

SEQ ID NO: 568997 - DNA, 25 bp, Homo sapien
cattgtcttcggctcctgggctcag

SEQ ID NO: 568998 - DNA, 25 bp, Homo sapien
ggctcctgggctcagctagaaccat

SEQ ID NO: 568999 - DNA, 25 bp, Homo sapien
ctagaaccatcttttcccattgtcc

SEQ ID NO: 569000 - DNA, 25 bp, Homo sapien
atcttttcccattgtccctgtggtg

SEQ ID NO: 569001 - DNA, 25 bp, Homo sapien
ttcccattgtccctgtggtgctagg

SEQ ID NO: 569002 - DNA, 25 bp, Homo sapien
tggtgctagggctttcagtggttat

SEQ ID NO: 569003 - DNA, 25 bp, Homo sapien
gtgctagggctttcagtggttatta

SEQ ID NO: 569004 - DNA, 25 bp, Homo sapien
aacgtctgtgttgtatcatcttgcc

SEQ ID NO: 569005 - DNA, 25 bp, Homo sapien
gtctgtgttgtatcatcttgcctga

SEQ ID NO: 569006 - DNA, 25 bp, Homo sapien
ctgtgttgtatcatcttgcctgaat

SEQ ID NO: 569007 - DNA, 25 bp, Homo sapien
tgttgtatcatcttgcctgaatttc

SEQ ID NO: 569008 - DNA, 25 bp, Homo sapien
gtcccatgtctaccaggtgcaggat

SEQ ID NO: 569009 - DNA, 25 bp, Homo sapien
tgtctaccaggtgcaggattatctg

SEQ ID NO: 569010 - DNA, 25 bp, Homo sapien
ggattatctggatgggtcagttcaa

SEQ ID NO: 569011 - DNA, 25 bp, Homo sapien
ggatgggtcagttcaaaacaatttc

SEQ ID NO: 569012 - DNA, 25 bp, Homo sapien
aatgtgaataactcctttgttagaa

SEQ ID NO: 569013 - DNA, 25 bp, Homo sapien
tttcagtgacagaaagcctttcagt

SEQ ID NO: 569014 - DNA, 25 bp, Homo sapien
ttacatatcaacaagcctagctcct

SEQ ID NO: 569015 - DNA, 25 bp, Homo sapien
tagctcctcactagtcccagtgaat

SEQ ID NO: 569016 - DNA, 25 bp, Homo sapien
agtcccagtgaatgcttacatcaat

SEQ ID NO: 569017 - DNA, 25 bp, Homo sapien
atcaatcagctctacaatatccagt

SEQ ID NO: 569018 - DNA, 25 bp, Homo sapien
tccagtaaaggactttccaattcgc

SEQ ID NO: 569019 - DNA, 25 bp, Homo sapien
gagaacaagctcattcttgtacctt

SEQ ID NO: 569020 - DNA, 25 bp, Homo sapien
ttgtacctttcctccgtggatttgg

SEQ ID NO: 569021 - DNA, 25 bp, Homo sapien
ttcctccgtggatttggtgatcaca

SEQ ID NO: 569022 - DNA, 25 bp, Homo sapien
ttggtgatcacaacaagggacttat

SEQ ID NO: 569023 - DNA, 25 bp, Homo sapien
acaagggacttatccatcattggag

SEQ ID NO: 569024 - DNA, 25 bp, Homo sapien
atccatcattggagtggccacaatc

SEQ ID NO: 569025 - DNA, 25 bp, Homo sapien
ggagtggccacaatctgaacaagtt

SEQ ID NO: 569026 - DNA, 25 bp, Homo sapien
acaatctgaacaagttccacccact

SEQ ID NO: 569027 - DNA, 25 bp, Homo sapien
tgaacaagttccacccactgcctga

SEQ ID NO: 569028 - DNA, 25 bp, Homo sapien
agagtcctgccctgaattttagact

SEQ ID NO: 569029 - DNA, 25 bp, Homo sapien
ctgccctgaattttagactttgatc

SEQ ID NO: 569030 - DNA, 25 bp, Homo sapien
tggctctgtcttctccgtttccatc

SEQ ID NO: 569031 - DNA, 25 bp, Homo sapien
tgtcttctccgtttccatctcgcat

SEQ ID NO: 569032 - DNA, 25 bp, Homo sapien
ttctccgtttccatctcgcatcaga

SEQ ID NO: 569033 - DNA, 25 bp, Homo sapien
gacggttcttccctctatgggccta

SEQ ID NO: 569034 - DNA, 25 bp, Homo sapien
ggttcttccctctatgggcctagtc

SEQ ID NO: 569035 - DNA, 25 bp, Homo sapien
ttcttccctctatgggcctagtcct

SEQ ID NO: 569036 - DNA, 25 bp, Homo sapien
ctctatgggcctagtcctacctaga

SEQ ID NO: 569037 - DNA, 25 bp, Homo sapien
ctatgggcctagtcctacctagaca

SEQ ID NO: 569038 - DNA, 25 bp, Homo sapien
tatgggcctagtcctacctagacac

SEQ ID NO: 569039 - DNA, 25 bp, Homo sapien
atgggcctagtcctacctagacact

SEQ ID NO: 569040 - DNA, 25 bp, Homo sapien
gggcctagtcctacctagacacttt

SEQ ID NO: 569041 - DNA, 25 bp, Homo sapien
cactttctaaggaaatctctctctg

SEQ ID NO: 569042 - DNA, 25 bp, Homo sapien
aggaaatctctctctgagctaccat

SEQ ID NO: 569043 - DNA, 25 bp, Homo sapien
tctgagctaccatcctgctagggag

SEQ ID NO: 569044 - DNA, 25 bp, Homo sapien
atcctgctagggagagcctgaaagc

SEQ ID NO: 569045 - DNA, 25 bp, Homo sapien
gacttgactagctctggtcaatgaa

SEQ ID NO: 569046 - DNA, 25 bp, Homo sapien
aaatcaccagtggaaaggctaccag

SEQ ID NO: 569047 - DNA, 25 bp, Homo sapien
caaaagagagggacagtaaactgca

SEQ ID NO: 569048 - DNA, 25 bp, Homo sapien
tgcaagatgaacaactcaatgccat

SEQ ID NO: 569049 - DNA, 25 bp, Homo sapien
gatgagaaagaacagtcgagagact

SEQ ID NO: 569050 - DNA, 25 bp, Homo sapien
gtggaaacactcaaagcatcatctt

SEQ ID NO: 569051 - DNA, 25 bp, Homo sapien
actcaaagcatcatcttccactttc

SEQ ID NO: 569052 - DNA, 25 bp, Homo sapien
tggacccaccggcagctgggcacat

SEQ ID NO: 569053 - DNA, 25 bp, Homo sapien
agctgggcacatgtctcacccgaat

SEQ ID NO: 569054 - DNA, 25 bp, Homo sapien
ggcacatgtctcacccgaatatcgg

SEQ ID NO: 569055 - DNA, 25 bp, Homo sapien
atgtctcacccgaatatcggctgcc

SEQ ID NO: 569056 - DNA, 25 bp, Homo sapien
atatcggctgcctccagaccacagg

SEQ ID NO: 569057 - DNA, 25 bp, Homo sapien
ggcttgatttccaagggccacatct

SEQ ID NO: 569058 - DNA, 25 bp, Homo sapien
cttgatttccaagggccacatctct

SEQ ID NO: 569059 - DNA, 25 bp, Homo sapien
accttccaggctctgaactttgaga

SEQ ID NO: 569060 - DNA, 25 bp, Homo sapien
ggctctgaactttgagacagggctt

SEQ ID NO: 569061 - DNA, 25 bp, Homo sapien
aactttgagacagggctttagcact

SEQ ID NO: 569062 - DNA, 25 bp, Homo sapien
gacagggctttagcactgtgcagag

SEQ ID NO: 569063 - DNA, 25 bp, Homo sapien
ctgactcaaatcgtgagccaatata

SEQ ID NO: 569064 - DNA, 25 bp, Homo sapien
gactcaaatcgtgagccaatataaa

SEQ ID NO: 569065 - DNA, 25 bp, Homo sapien
atcgtgagccaatataaaatgtgac

SEQ ID NO: 569066 - DNA, 25 bp, Homo sapien
cgtgagccaatataaaatgtgacat

SEQ ID NO: 569067 - DNA, 25 bp, Homo sapien
gagccaatataaaatgtgacatgag

SEQ ID NO: 569068 - DNA, 25 bp, Homo sapien
cgattcgagagtcgagaggctggtc

SEQ ID NO: 569069 - DNA, 25 bp, Homo sapien
agtcgagaggctggtcgggagttcg

SEQ ID NO: 569070 - DNA, 25 bp, Homo sapien
ccagcatttggatcctccacttgaa

SEQ ID NO: 569071 - DNA, 25 bp, Homo sapien
atttggatcctccacttgaacccga

SEQ ID NO: 569072 - DNA, 25 bp, Homo sapien
tttggatcctccacttgaacccgag

SEQ ID NO: 569073 - DNA, 25 bp, Homo sapien
ttggatcctccacttgaacccgaga

SEQ ID NO: 569074 - DNA, 25 bp, Homo sapien
ttgtctgtagagtgcaggctcccca

SEQ ID NO: 569075 - DNA, 25 bp, Homo sapien
ctgtagagtgcaggctccccagcag

SEQ ID NO: 569076 - DNA, 25 bp, Homo sapien
gagaagcacagatgacacctcactg

SEQ ID NO: 569077 - DNA, 25 bp, Homo sapien
acagatgacacctcactgaccattc

SEQ ID NO: 569078 - DNA, 25 bp, Homo sapien
gagggcccagacacactgatggcac

SEQ ID NO: 569079 - DNA, 25 bp, Homo sapien
agacacactgatggcactggcgcaa

SEQ ID NO: 569080 - DNA, 25 bp, Homo sapien
acactgatggcactggcgcaattga

SEQ ID NO: 569081 - DNA, 25 bp, Homo sapien
tggcactggcgcaattgacatgaac

SEQ ID NO: 569082 - DNA, 25 bp, Homo sapien
tggcgcaattgacatgaaccaggca

SEQ ID NO: 569083 - DNA, 25 bp, Homo sapien
acctccgtgggcttccgtggtgcag

SEQ ID NO: 569084 - DNA, 25 bp, Homo sapien
aggatgggcctgcaactctgtccct

SEQ ID NO: 569085 - DNA, 25 bp, Homo sapien
gtttcatgaaacagtgcttatcttt

SEQ ID NO: 569086 - DNA, 25 bp, Homo sapien
aaacagtgcttatctttactaggag

SEQ ID NO: 569087 - DNA, 25 bp, Homo sapien
taggagcaatgctcccaatgctccc

SEQ ID NO: 569088 - DNA, 25 bp, Homo sapien
caatgctcccaatacttccaattaa

SEQ ID NO: 569089 - DNA, 25 bp, Homo sapien
tgctcccaatacttccaattaaatt

SEQ ID NO: 569090 - DNA, 25 bp, Homo sapien
aattcatttgatttcaagtatctaa

SEQ ID NO: 569091 - DNA, 25 bp, Homo sapien
gtatctaaattgatttcatgaccca

SEQ ID NO: 569092 - DNA, 25 bp, Homo sapien
ttgatttcatgacccacaatttgaa

SEQ ID NO: 569093 - DNA, 25 bp, Homo sapien
gagaatttgttaacactatatgtat

SEQ ID NO: 569094 - DNA, 25 bp, Homo sapien
tttgtttgtatgttctcttaatcac

SEQ ID NO: 569095 - DNA, 25 bp, Homo sapien
gttctcttaatcacctatgtattaa

SEQ ID NO: 569096 - DNA, 25 bp, Homo sapien
ctgatcgttgacttctggactgcag

SEQ ID NO: 569097 - DNA, 25 bp, Homo sapien
tgatcgttgacttctggactgcaga

SEQ ID NO: 569098 - DNA, 25 bp, Homo sapien
gatcgttgacttctggactgcagaa

SEQ ID NO: 569099 - DNA, 25 bp, Homo sapien
atcgttgacttctggactgcagaac

SEQ ID NO: 569100 - DNA, 25 bp, Homo sapien
tcgttgacttctggactgcagaact

SEQ ID NO: 569101 - DNA, 25 bp, Homo sapien
gttgacttctggactgcagaactgc

SEQ ID NO: 569102 - DNA, 25 bp, Homo sapien
tgacttctggactgcagaactgcaa

SEQ ID NO: 569103 - DNA, 25 bp, Homo sapien
acttctggactgcagaactgcaaga

SEQ ID NO: 569104 - DNA, 25 bp, Homo sapien
gcagaactgcaagataagaagtgtg

SEQ ID NO: 569105 - DNA, 25 bp, Homo sapien
aagaagtgtgtgtttagccaggcat

SEQ ID NO: 569106 - DNA, 25 bp, Homo sapien
agaagtgtgtgtttagccaggcatg

SEQ ID NO: 569107 - DNA, 25 bp, Homo sapien
tctgcagccagatgagagtgggaaa

SEQ ID NO: 569108 - DNA, 25 bp, Homo sapien
gagtgggaaacgttagcttgcaaga

SEQ ID NO: 569109 - DNA, 25 bp, Homo sapien
ggaaacgttagcttgcaagaaataa

SEQ ID NO: 569110 - DNA, 25 bp, Homo sapien
gcaagaaataaaaaccggaagctct

SEQ ID NO: 569111 - DNA, 25 bp, Homo sapien
ggaagctcttccctttcgatcgaaa

SEQ ID NO: 569112 - DNA, 25 bp, Homo sapien
tcttccctttcgatcgaaaccatga

SEQ ID NO: 569113 - DNA, 25 bp, Homo sapien
cctttcgatcgaaaccatgattaac

SEQ ID NO: 569114 - DNA, 25 bp, Homo sapien
aaaccatgattaacaaacatttgtg

SEQ ID NO: 569115 - DNA, 25 bp, Homo sapien
atttgtgaaatccaagttgttctca

SEQ ID NO: 569116 - DNA, 25 bp, Homo sapien
ccaagttgttctcaaaagatcagaa

SEQ ID NO: 569117 - DNA, 25 bp, Homo sapien
gttctcaaaagatcagaactggtat

SEQ ID NO: 569118 - DNA, 25 bp, Homo sapien
taactgcattctcctccgccaaaaa

SEQ ID NO: 569119 - DNA, 25 bp, Homo sapien
ttctcctccgccaaaaaagtgacca

SEQ ID NO: 569120 - DNA, 25 bp, Homo sapien
ctcctccgccaaaaaagtgaccaag

SEQ ID NO: 569121 - DNA, 25 bp, Homo sapien
cgccaaaaaagtgaccaagcaggta

SEQ ID NO: 569122 - DNA, 25 bp, Homo sapien
aagtgaccaagcaggtataagtgga

SEQ ID NO: 569123 - DNA, 25 bp, Homo sapien
caggtataagtggagaaacagccaa

SEQ ID NO: 569124 - DNA, 25 bp, Homo sapien
gccaaagctgaagtgtattcttttt

SEQ ID NO: 569125 - DNA, 25 bp, Homo sapien
gtttaattgtacttcagtggatgca

SEQ ID NO: 569126 - DNA, 25 bp, Homo sapien
gtaagaggaactatggcgtgagcca

SEQ ID NO: 569127 - DNA, 25 bp, Homo sapien
aagaggaactatggcgtgagccacc

SEQ ID NO: 569128 - DNA, 25 bp, Homo sapien
atttagattgttcccacctcttggc

SEQ ID NO: 569129 - DNA, 25 bp, Homo sapien
tcaagccccacagttcttaatacag

SEQ ID NO: 569130 - DNA, 25 bp, Homo sapien
gttcttaatacaggagacccaacaa

SEQ ID NO: 569131 - DNA, 25 bp, Homo sapien
gacccaacaatgagtggacaagtca

SEQ ID NO: 569132 - DNA, 25 bp, Homo sapien
ggacaagtcatggacattcatgctc

SEQ ID NO: 569133 - DNA, 25 bp, Homo sapien
atggacattcatgctcagtagctta

SEQ ID NO: 569134 - DNA, 25 bp, Homo sapien
atgctcagtagcttaagggaatatg

SEQ ID NO: 569135 - DNA, 25 bp, Homo sapien
tatgcattgtctgcaatggtgactg

SEQ ID NO: 569136 - DNA, 25 bp, Homo sapien
gactgtggagttccattcttggcat

SEQ ID NO: 569137 - DNA, 25 bp, Homo sapien
attcttggcatctactctggaccaa

SEQ ID NO: 569138 - DNA, 25 bp, Homo sapien
ggaccaaggagcatccctaattctt

SEQ ID NO: 569139 - DNA, 25 bp, Homo sapien
ggaaataccaactgaagtcaatttg

SEQ ID NO: 569140 - DNA, 25 bp, Homo sapien
actccagccttgaaaaccctgtctc

SEQ ID NO: 569141 - DNA, 25 bp, Homo sapien
acagtaacaacaaacagccattcag

SEQ ID NO: 569142 - DNA, 25 bp, Homo sapien
gtaacaacaaacagccattcagagt

SEQ ID NO: 569143 - DNA, 25 bp, Homo sapien
caacaaacagccattcagagtaaat

SEQ ID NO: 569144 - DNA, 25 bp, Homo sapien
caaacagccattcagagtaaatagt

SEQ ID NO: 569145 - DNA, 25 bp, Homo sapien
agccattcagagtaaatagtaggta

SEQ ID NO: 569146 - DNA, 25 bp, Homo sapien
atactccttattgtatacctagtat

SEQ ID NO: 569147 - DNA, 25 bp, Homo sapien
actccttattgtatacctagtataa

SEQ ID NO: 569148 - DNA, 25 bp, Homo sapien
gtatacctagtataatacagaagtt

SEQ ID NO: 569149 - DNA, 25 bp, Homo sapien
gttaagaacttggtttttcatatgt

SEQ ID NO: 569150 - DNA, 25 bp, Homo sapien
agaacttggtttttcatatgttagt

SEQ ID NO: 569151 - DNA, 25 bp, Homo sapien
ttgtgtatggtattgctgatgcagt

SEQ ID NO: 569152 - DNA, 25 bp, Homo sapien
tattgctgatgcagtttaatgctcc

SEQ ID NO: 569153 - DNA, 25 bp, Homo sapien
cagtttaatgctccattacttctaa

SEQ ID NO: 569154 - DNA, 25 bp, Homo sapien
gctccattacttctaaattttcatc

SEQ ID NO: 569155 - DNA, 25 bp, Homo sapien
tttcatcataagctagattttccag

SEQ ID NO: 569156 - DNA, 25 bp, Homo sapien
taagctagattttccagttgtggtt

SEQ ID NO: 569157 - DNA, 25 bp, Homo sapien
gaaaaacaaacattctgaagacagt

SEQ ID NO: 569158 - DNA, 25 bp, Homo sapien
gatttattccagatatcgatgatta

SEQ ID NO: 569159 - DNA, 25 bp, Homo sapien
gattaacttttgaagctcctctgtt

SEQ ID NO: 569160 - DNA, 25 bp, Homo sapien
ttgaagctcctctgttgatttgaac

SEQ ID NO: 569161 - DNA, 25 bp, Homo sapien
ttcacctcagaatagcatcaacatt

SEQ ID NO: 569162 - DNA, 25 bp, Homo sapien
aaacttggtagctgtgtacttagaa

SEQ ID NO: 569163 - DNA, 25 bp, Homo sapien
gcagagaaagcctgttttcagagag

SEQ ID NO: 569164 - DNA, 25 bp, Homo sapien
aagcaggtaagtcatctggaaggac

SEQ ID NO: 569165 - DNA, 25 bp, Homo sapien
gaaggacaagcagaagcacaatttt

SEQ ID NO: 569166 - DNA, 25 bp, Homo sapien
gaagcacaattttgggaacagttgc

SEQ ID NO: 569167 - DNA, 25 bp, Homo sapien
gaacagttgctttcagagtcctgat

SEQ ID NO: 569168 - DNA, 25 bp, Homo sapien
tttcagagtcctgatggcattccag

SEQ ID NO: 569169 - DNA, 25 bp, Homo sapien
agccccttgtcctagtgccagttca

SEQ ID NO: 569170 - DNA, 25 bp, Homo sapien
agtgccagttcaggcccaagtgttt

SEQ ID NO: 569171 - DNA, 25 bp, Homo sapien
caagtgtttggcctttgggacctat

SEQ ID NO: 569172 - DNA, 25 bp, Homo sapien
gcctttgggacctatgatacagata

SEQ ID NO: 569173 - DNA, 25 bp, Homo sapien
gaaaccattcttgtacatgtggata

SEQ ID NO: 569174 - DNA, 25 bp, Homo sapien
ggatatccagtttcttcaacaccat

SEQ ID NO: 569175 - DNA, 25 bp, Homo sapien
gtttcttcaacaccatttgttaaag

SEQ ID NO: 569176 - DNA, 25 bp, Homo sapien
ttattcagcattcctgctcatgttt

SEQ ID NO: 569177 - DNA, 25 bp, Homo sapien
cagcattcctgctcatgtttctgac

SEQ ID NO: 569178 - DNA, 25 bp, Homo sapien
gtttctgacttctattatggcttat

SEQ ID NO: 569179 - DNA, 25 bp, Homo sapien
ggcttattttggtcctgcctatagc

SEQ ID NO: 569180 - DNA, 25 bp, Homo sapien
tggtcctgcctatagcttacattat

SEQ ID NO: 569181 - DNA, 25 bp, Homo sapien
gtttcactggatatagttggctgca

SEQ ID NO: 569182 - DNA, 25 bp, Homo sapien
actggatatagttggctgcacattt

SEQ ID NO: 569183 - DNA, 25 bp, Homo sapien
ggctgcacatttaactttgttttaa

SEQ ID NO: 569184 - DNA, 25 bp, Homo sapien
tatgaacccaaccaaaaacagagag

SEQ ID NO: 569185 - DNA, 25 bp, Homo sapien
acttaccagttttccggtgtatatg

SEQ ID NO: 569186 - DNA, 25 bp, Homo sapien
tttccggtgtatatgtagccatcca

SEQ ID NO: 569187 - DNA, 25 bp, Homo sapien
atgtagccatccaggcagttctgac

SEQ ID NO: 569188 - DNA, 25 bp, Homo sapien
ggcagttctgactttgtacgctcaa

SEQ ID NO: 569189 - DNA, 25 bp, Homo sapien
gtacgctcaaggtttattgactggt

SEQ ID NO: 569190 - DNA, 25 bp, Homo sapien
ttgactggtgtagtggtagactctg

SEQ ID NO: 569191 - DNA, 25 bp, Homo sapien
tggtgtgactcacatttgcccagta

SEQ ID NO: 569192 - DNA, 25 bp, Homo sapien
ttctctccctcatcttaccaggaga

SEQ ID NO: 569193 - DNA, 25 bp, Homo sapien
ttatcaagctacttctgttgcgagg

SEQ ID NO: 569194 - DNA, 25 bp, Homo sapien
tgttgcgaggatacgccttcaacca

SEQ ID NO: 569195 - DNA, 25 bp, Homo sapien
agatgcccagggagaatcttggtct

SEQ ID NO: 569196 - DNA, 25 bp, Homo sapien
gatgcccagggagaatcttggtctg

SEQ ID NO: 569197 - DNA, 25 bp, Homo sapien
tgcccagggagaatcttggtctggt

SEQ ID NO: 569198 - DNA, 25 bp, Homo sapien
cagggagaatcttggtctggtgaat

SEQ ID NO: 569199 - DNA, 25 bp, Homo sapien
tggggccatatgttcacctgctttc

SEQ ID NO: 569200 - DNA, 25 bp, Homo sapien
acctgctttcctgtccgttggtgaa

SEQ ID NO: 569201 - DNA, 25 bp, Homo sapien
ctctacaaaagctccggttgattcg

SEQ ID NO: 569202 - DNA, 25 bp, Homo sapien
tctacaaaagctccggttgattcga

SEQ ID NO: 569203 - DNA, 25 bp, Homo sapien
caaaagctccggttgattcgaggga

SEQ ID NO: 569204 - DNA, 25 bp, Homo sapien
aaagctccggttgattcgagggaag

SEQ ID NO: 569205 - DNA, 25 bp, Homo sapien
aagctccggttgattcgagggaagt

SEQ ID NO: 569206 - DNA, 25 bp, Homo sapien
gtatttccaattctttgacgtcacg

SEQ ID NO: 569207 - DNA, 25 bp, Homo sapien
gacgtcacgaattttctgttttgga

SEQ ID NO: 569208 - DNA, 25 bp, Homo sapien
agctttgccttttccaggaggtgaa

SEQ ID NO: 569209 - DNA, 25 bp, Homo sapien
gacccttgttcagtggcagaagtac

SEQ ID NO: 569210 - DNA, 25 bp, Homo sapien
aagccttagctttgcctgagatatg

SEQ ID NO: 569211 - DNA, 25 bp, Homo sapien
gatatgacctataactgctctgatt

SEQ ID NO: 569212 - DNA, 25 bp, Homo sapien
ctgctctgatttttggaccccagaa

SEQ ID NO: 569213 - DNA, 25 bp, Homo sapien
gaaaacccttgaaagctcagcttcc

SEQ ID NO: 569214 - DNA, 25 bp, Homo sapien
agcttccttattgctgcgtggtcac

SEQ ID NO: 569215 - DNA, 25 bp, Homo sapien
tgcgtggtcaccttatcacagcact

SEQ ID NO: 569216 - DNA, 25 bp, Homo sapien
tcacagcactgcagagcctaggaaa

SEQ ID NO: 569217 - DNA, 25 bp, Homo sapien
gacatggagcgatttcagcttcact

SEQ ID NO: 569218 - DNA, 25 bp, Homo sapien
tcagcttcactatcaggatctcctg

SEQ ID NO: 569219 - DNA, 25 bp, Homo sapien
ggtgtggctgtcatgaaactcttca

SEQ ID NO: 569220 - DNA, 25 bp, Homo sapien
aaactcttcaacaaggccaaagtca

SEQ ID NO: 569221 - DNA, 25 bp, Homo sapien
aagtcaatgtcaaccttctcatctt

SEQ ID NO: 569222 - DNA, 25 bp, Homo sapien
acaagaagtttttgcggaagtgaca

SEQ ID NO: 569223 - DNA, 25 bp, Homo sapien
gaggcaaagggtgctacccaagccc

SEQ ID NO: 569224 - DNA, 25 bp, Homo sapien
ggatgctttctttaacactaactca

SEQ ID NO: 569225 - DNA, 25 bp, Homo sapien
ttaacactaactcaccactgtgctt

SEQ ID NO: 569226 - DNA, 25 bp, Homo sapien
tgcagacacccagagctcaggactg

SEQ ID NO: 569227 - DNA, 25 bp, Homo sapien
agagctcaggactgggcaaggccca

SEQ ID NO: 569228 - DNA, 25 bp, Homo sapien
attgagtttcttgaagcgcagaaca

SEQ ID NO: 569229 - DNA, 25 bp, Homo sapien
ttgagtttcttgaagcgcagaacat

SEQ ID NO: 569230 - DNA, 25 bp, Homo sapien
tgagtttcttgaagcgcagaacatt

SEQ ID NO: 569231 - DNA, 25 bp, Homo sapien
gagtttcttgaagcgcagaacatta

SEQ ID NO: 569232 - DNA, 25 bp, Homo sapien
tttcttgaagcgcagaacattattc

SEQ ID NO: 569233 - DNA, 25 bp, Homo sapien
ttcttgaagcgcagaacattattct

SEQ ID NO: 569234 - DNA, 25 bp, Homo sapien
tcttgaagcgcagaacattattcta

SEQ ID NO: 569235 - DNA, 25 bp, Homo sapien
cttgaagcgcagaacattattctac

SEQ ID NO: 569236 - DNA, 25 bp, Homo sapien
ttgaagcgcagaacattattctacc

SEQ ID NO: 569237 - DNA, 25 bp, Homo sapien
tgaagcgcagaacattattctacct

SEQ ID NO: 569238 - DNA, 25 bp, Homo sapien
gaagcgcagaacattattctaccta

SEQ ID NO: 569239 - DNA, 25 bp, Homo sapien
aacaaagataaggtgcagtttggga

SEQ ID NO: 569240 - DNA, 25 bp, Homo sapien
ttttccatgaaaattcaatcttagg

SEQ ID NO: 569241 - DNA, 25 bp, Homo sapien
gaaaattcaatcttaggaacaaatg

SEQ ID NO: 569242 - DNA, 25 bp, Homo sapien
aatattttctagtccttaagttgat

SEQ ID NO: 569243 - DNA, 25 bp, Homo sapien
tttctagtccttaagttgattttgg

SEQ ID NO: 569244 - DNA, 25 bp, Homo sapien
ccttaagttgattttggaaatgcaa

SEQ ID NO: 569245 - DNA, 25 bp, Homo sapien
ggaaatgcaaagtctttaaagagag

SEQ ID NO: 569246 - DNA, 25 bp, Homo sapien
gagagaggcacactgatagtttatt

SEQ ID NO: 569247 - DNA, 25 bp, Homo sapien
gaggcacactgatagtttattcaag

SEQ ID NO: 569248 - DNA, 25 bp, Homo sapien
ggcacactgatagtttattcaagta

SEQ ID NO: 569249 - DNA, 25 bp, Homo sapien
agtttattcaagtagctatttgctt

SEQ ID NO: 569250 - DNA, 25 bp, Homo sapien
aagctgataaagattccagaactac

SEQ ID NO: 569251 - DNA, 25 bp, Homo sapien
gaactacaaatcaaactaggccctg

SEQ ID NO: 569252 - DNA, 25 bp, Homo sapien
aaactaggccctggagtagcagtaa

SEQ ID NO: 569253 - DNA, 25 bp, Homo sapien
ctgtccactacattcctatattgat

SEQ ID NO: 569254 - DNA, 25 bp, Homo sapien
tcctatattgatgagagcagaacag

SEQ ID NO: 569255 - DNA, 25 bp, Homo sapien
agcagaacagacactcatgagagac

SEQ ID NO: 569256 - DNA, 25 bp, Homo sapien
atgagagacatgacttctgcttccc

SEQ ID NO: 569257 - DNA, 25 bp, Homo sapien
gattaccatactgatgatctccctg

SEQ ID NO: 569258 - DNA, 25 bp, Homo sapien
catactgatgatctccctggaggtt

SEQ ID NO: 569259 - DNA, 25 bp, Homo sapien
aaatatcctgaagatttggtggaaa

SEQ ID NO: 569260 - DNA, 25 bp, Homo sapien
ggtggaaatatgctttgacatttac

SEQ ID NO: 569261 - DNA, 25 bp, Homo sapien
ccattatagccatgcgtgcggttta

SEQ ID NO: 569262 - DNA, 25 bp, Homo sapien
atagccatgcgtgcggtttataact

SEQ ID NO: 569263 - DNA, 25 bp, Homo sapien
gcgtgcggtttataactcctgtatt

SEQ ID NO: 569264 - DNA, 25 bp, Homo sapien
actcctgtattaatctaggtactga

SEQ ID NO: 569265 - DNA, 25 bp, Homo sapien
atagtctcgccctggctatgctggc

SEQ ID NO: 569266 - DNA, 25 bp, Homo sapien
ggctatgctggcgatttttcactca

SEQ ID NO: 569267 - DNA, 25 bp, Homo sapien
gctggcgatttttcactcatgtaga

SEQ ID NO: 569268 - DNA, 25 bp, Homo sapien
ggcgatttttcactcatgtagaagt

SEQ ID NO: 569269 - DNA, 25 bp, Homo sapien
gggtacgtcggctacagataattgt

SEQ ID NO: 569270 - DNA, 25 bp, Homo sapien
acagataattgttggtgtcgcaaat

SEQ ID NO: 569271 - DNA, 25 bp, Homo sapien
ccgaggaaacttcggataggcgcaa

SEQ ID NO: 569272 - DNA, 25 bp, Homo sapien
gccagagagcttgcacctgagccat

SEQ ID NO: 569273 - DNA, 25 bp, Homo sapien
agagcttgcacctgagccatctcag

SEQ ID NO: 569274 - DNA, 25 bp, Homo sapien
tgagccatctcagccgtgagagtaa

SEQ ID NO: 569275 - DNA, 25 bp, Homo sapien
gtgagagtaacagtcctaggaaaat

SEQ ID NO: 569276 - DNA, 25 bp, Homo sapien
gaagacagagctattctggatggat

SEQ ID NO: 569277 - DNA, 25 bp, Homo sapien
ctttaaaacaattttgcctgtagca

SEQ ID NO: 569278 - DNA, 25 bp, Homo sapien
attttgcctgtagcaagtacatttt

SEQ ID NO: 569279 - DNA, 25 bp, Homo sapien
tggagtgtaaacattctgtgtggca

SEQ ID NO: 569280 - DNA, 25 bp, Homo sapien
ctgtgtggcaacagttaaaagctgt

SEQ ID NO: 569281 - DNA, 25 bp, Homo sapien
gtgtgtatacattgttgccactatc

SEQ ID NO: 569282 - DNA, 25 bp, Homo sapien
attgttgccactatctaaaattagg

SEQ ID NO: 569283 - DNA, 25 bp, Homo sapien
attttagatattcctgtctaggaac

SEQ ID NO: 569284 - DNA, 25 bp, Homo sapien
gatattcctgtctaggaactaaaat

SEQ ID NO: 569285 - DNA, 25 bp, Homo sapien
aattacagctgatttagaatttgct

SEQ ID NO: 569286 - DNA, 25 bp, Homo sapien
cagctgatttagaatttgcttaatt

SEQ ID NO: 569287 - DNA, 25 bp, Homo sapien
gtctgaataagatgtaatcctgtca

SEQ ID NO: 569288 - DNA, 25 bp, Homo sapien
gtaatcctgtcatgagttctctctt

SEQ ID NO: 569289 - DNA, 25 bp, Homo sapien
aatcctgtcatgagttctctcttcc

SEQ ID NO: 569290 - DNA, 25 bp, Homo sapien
ttgattatcttagttagaccccatt

SEQ ID NO: 569291 - DNA, 25 bp, Homo sapien
gattatcttagttagaccccatttt

SEQ ID NO: 569292 - DNA, 25 bp, Homo sapien
taaggaaaaaatacaccctgtatga

SEQ ID NO: 569293 - DNA, 25 bp, Homo sapien
tacaccctgtatgatacattcttag

SEQ ID NO: 569294 - DNA, 25 bp, Homo sapien
ctcctatggctggaacactggaata

SEQ ID NO: 569295 - DNA, 25 bp, Homo sapien
taaggaaagaggtcgtctgtctgga

SEQ ID NO: 569296 - DNA, 25 bp, Homo sapien
aagctcaggtccctgcatacagcag

SEQ ID NO: 569297 - DNA, 25 bp, Homo sapien
ctgcatacagcaggcgcctaattga

SEQ ID NO: 569298 - DNA, 25 bp, Homo sapien
ggcgcctaattgatgcttatagcac

SEQ ID NO: 569299 - DNA, 25 bp, Homo sapien
gtcctgggatggtcctaatttcaca

SEQ ID NO: 569300 - DNA, 25 bp, Homo sapien
taatttcacagaccctgagcggatc

SEQ ID NO: 569301 - DNA, 25 bp, Homo sapien
gcggatcaagaatgaagcgggccca

SEQ ID NO: 569302 - DNA, 25 bp, Homo sapien
caccggctgagtgcgtcttaggacg

SEQ ID NO: 569303 - DNA, 25 bp, Homo sapien
ttaggacgcagagacaagaccacgg

SEQ ID NO: 569304 - DNA, 25 bp, Homo sapien
gacaagaccacggagggcggaacct

SEQ ID NO: 569305 - DNA, 25 bp, Homo sapien
tttctccaaagacattggacacttg

SEQ ID NO: 569306 - DNA, 25 bp, Homo sapien
caaagacattggacacttggatgat

SEQ ID NO: 569307 - DNA, 25 bp, Homo sapien
agacattggacacttggatgatttg

SEQ ID NO: 569308 - DNA, 25 bp, Homo sapien
tggatgatttgctgccgctgacgtt

SEQ ID NO: 569309 - DNA, 25 bp, Homo sapien
ggatgatttgctgccgctgacgttt

SEQ ID NO: 569310 - DNA, 25 bp, Homo sapien
atttgctgccgctgacgtttttaga

SEQ ID NO: 569311 - DNA, 25 bp, Homo sapien
ttgctgccgctgacgtttttagatt

SEQ ID NO: 569312 - DNA, 25 bp, Homo sapien
gctgccgctgacgtttttagatttc

SEQ ID NO: 569313 - DNA, 25 bp, Homo sapien
tgccgctgacgtttttagatttcat

SEQ ID NO: 569314 - DNA, 25 bp, Homo sapien
cgctgacgtttttagatttcatcca

SEQ ID NO: 569315 - DNA, 25 bp, Homo sapien
ctgacgtttttagatttcatccaga

SEQ ID NO: 569316 - DNA, 25 bp, Homo sapien
aggagtaaaggtctggaccccacat

SEQ ID NO: 569317 - DNA, 25 bp, Homo sapien
taaaggtctggaccccacatgctgg

SEQ ID NO: 569318 - DNA, 25 bp, Homo sapien
gctcctggcagaagctgtcgtgcct

SEQ ID NO: 569319 - DNA, 25 bp, Homo sapien
gcagaagctgtcgtgcctgagaccc

SEQ ID NO: 569320 - DNA, 25 bp, Homo sapien
aagccacaagggaccatggctcatt

SEQ ID NO: 569321 - DNA, 25 bp, Homo sapien
gctcattcctccttgctgggtgctc

SEQ ID NO: 569322 - DNA, 25 bp, Homo sapien
gctcaggcaactcacataaatctct

SEQ ID NO: 569323 - DNA, 25 bp, Homo sapien
aatttgtttatctgtcctgtggggg

SEQ ID NO: 569324 - DNA, 25 bp, Homo sapien
cccctgtatcacagtgtggttttga

SEQ ID NO: 569325 - DNA, 25 bp, Homo sapien
agaagctgtgcttaaatccagtagc

SEQ ID NO: 569326 - DNA, 25 bp, Homo sapien
gcttaaatccagtagctgttgtcaa

SEQ ID NO: 569327 - DNA, 25 bp, Homo sapien
gggcgcgtgctgaagaaattcaaat

SEQ ID NO: 569328 - DNA, 25 bp, Homo sapien
caaaaaggagctgcctgagttcgag

SEQ ID NO: 569329 - DNA, 25 bp, Homo sapien
tgtccttgccgtgggcagccaggct

SEQ ID NO: 569330 - DNA, 25 bp, Homo sapien
aggctctgaccactgagggcatcta

SEQ ID NO: 569331 - DNA, 25 bp, Homo sapien
accactgagggcatctatgaggacg

SEQ ID NO: 569332 - DNA, 25 bp, Homo sapien
gagggcatctatgaggacgtcatcc

SEQ ID NO: 569333 - DNA, 25 bp, Homo sapien
ggcatctatgaggacgtcatccggg

SEQ ID NO: 569334 - DNA, 25 bp, Homo sapien
ttgctgcagaggattgaccaagaat

SEQ ID NO: 569335 - DNA, 25 bp, Homo sapien
gcagaggattgaccaagaattgaaa

SEQ ID NO: 569336 - DNA, 25 bp, Homo sapien
gaattgaaaaagacccttggtgcca

SEQ ID NO: 569337 - DNA, 25 bp, Homo sapien
tgaaaaagacccttggtgccaatga

SEQ ID NO: 569338 - DNA, 25 bp, Homo sapien
ttacttcagaaacatctcctttcag

SEQ ID NO: 569339 - DNA, 25 bp, Homo sapien
ttcagaaacatctcctttcagcctg

SEQ ID NO: 569340 - DNA, 25 bp, Homo sapien
agaaacatctcctttcagcctgctt

SEQ ID NO: 569341 - DNA, 25 bp, Homo sapien
ttcagcctgcttcaggaatgagctt

SEQ ID NO: 569342 - DNA, 25 bp, Homo sapien
tcaggaatgagcttgtggagccccg

SEQ ID NO: 569343 - DNA, 25 bp, Homo sapien
tggagccccggagagaaactccaaa

SEQ ID NO: 569344 - DNA, 25 bp, Homo sapien
gaaactccaaaacaatctgacgtct

SEQ ID NO: 569345 - DNA, 25 bp, Homo sapien
caaaacaatctgacgtcttctttag

SEQ ID NO: 569346 - DNA, 25 bp, Homo sapien
tgacgtcttctttagacattccaag

SEQ ID NO: 569347 - DNA, 25 bp, Homo sapien
gtcttctttagacattccaagcccc

SEQ ID NO: 569348 - DNA, 25 bp, Homo sapien
cccaaaccgatcagtgtacccatag

SEQ ID NO: 569349 - DNA, 25 bp, Homo sapien
atgacttgtgttttgcacaaggata

SEQ ID NO: 569350 - DNA, 25 bp, Homo sapien
ttgtgttttgcaagagcctatcaat

SEQ ID NO: 569351 - DNA, 25 bp, Homo sapien
gcaagagcctatcaattgtttttat

SEQ ID NO: 569352 - DNA, 25 bp, Homo sapien
aattgtttttattgctaggtcagag

SEQ ID NO: 569353 - DNA, 25 bp, Homo sapien
gctaggtcagaggttgagtatctca

SEQ ID NO: 569354 - DNA, 25 bp, Homo sapien
aggttgagtatctcagagttgagca

SEQ ID NO: 569355 - DNA, 25 bp, Homo sapien
tctcagagttgagcaggaaaaactt

SEQ ID NO: 569356 - DNA, 25 bp, Homo sapien
ggaaaaactttcatacctgcttaga

SEQ ID NO: 569357 - DNA, 25 bp, Homo sapien
aaaactttcatacctgcttagacag

SEQ ID NO: 569358 - DNA, 25 bp, Homo sapien
aactttcatacctgcttagacagca

SEQ ID NO: 569359 - DNA, 25 bp, Homo sapien
atacctgcttagacagcagttcacc

SEQ ID NO: 569360 - DNA, 25 bp, Homo sapien
aattgttattagctgatgatgtgaa

SEQ ID NO: 569361 - DNA, 25 bp, Homo sapien
gctgatgatgtgaatgtcttcctga

SEQ ID NO: 569362 - DNA, 25 bp, Homo sapien
gatgtgaatgtcttcctgaaaacct

SEQ ID NO: 569363 - DNA, 25 bp, Homo sapien
gaatgtcttcctgaaaaccttaaga

SEQ ID NO: 569364 - DNA, 25 bp, Homo sapien
tgaaaaccttaagagaaccaactgg

SEQ ID NO: 569365 - DNA, 25 bp, Homo sapien
ggaaaacaaccagaaatgagagcat

SEQ ID NO: 569366 - DNA, 25 bp, Homo sapien
gagcatggagttaggcaaccgccga

SEQ ID NO: 569367 - DNA, 25 bp, Homo sapien
ggagttaggcaaccgccgatctgct

SEQ ID NO: 569368 - DNA, 25 bp, Homo sapien
ctgctttctgtcactttgggcgagt

SEQ ID NO: 569369 - DNA, 25 bp, Homo sapien
ttctgtcactttgggcgagtttttc

SEQ ID NO: 569370 - DNA, 25 bp, Homo sapien
tttttcccgtcctgggatttcatat

SEQ ID NO: 569371 - DNA, 25 bp, Homo sapien
tggccgtaagcgatttttccggcct

SEQ ID NO: 569372 - DNA, 25 bp, Homo sapien
ttccggcctcccaaaacgttgcgat

SEQ ID NO: 569373 - DNA, 25 bp, Homo sapien
cctcccaaaacgttgcgattataag

SEQ ID NO: 569374 - DNA, 25 bp, Homo sapien
ctcccaaaacgttgcgattataagt

SEQ ID NO: 569375 - DNA, 25 bp, Homo sapien
tcccaaaacgttgcgattataagtg

SEQ ID NO: 569376 - DNA, 25 bp, Homo sapien
caaaacgttgcgattataagtgtga

SEQ ID NO: 569377 - DNA, 25 bp, Homo sapien
aaaacgttgcgattataagtgtgag

SEQ ID NO: 569378 - DNA, 25 bp, Homo sapien
ttttctttatccatttgtacattga

SEQ ID NO: 569379 - DNA, 25 bp, Homo sapien
tttatccatttgtacattgatggac

SEQ ID NO: 569380 - DNA, 25 bp, Homo sapien
atccatttgtacattgatggacact

SEQ ID NO: 569381 - DNA, 25 bp, Homo sapien
tccatttgtacattgatggacactt

SEQ ID NO: 569382 - DNA, 25 bp, Homo sapien
atctggtcctggactctttttgttt

SEQ ID NO: 569383 - DNA, 25 bp, Homo sapien
tggactctttttgtttctccacaga

SEQ ID NO: 569384 - DNA, 25 bp, Homo sapien
ggactctttttgtttctccacagac

SEQ ID NO: 569385 - DNA, 25 bp, Homo sapien
gactctttttgtttctccacagaca

SEQ ID NO: 569386 - DNA, 25 bp, Homo sapien
ttgtttctccacagacactacccaa

SEQ ID NO: 569387 - DNA, 25 bp, Homo sapien
agacactacccaaagcagtccttca

SEQ ID NO: 569388 - DNA, 25 bp, Homo sapien
cagtccttcactacagtggcagaca

SEQ ID NO: 569389 - DNA, 25 bp, Homo sapien
gtggcagacagacctgaaaattttc

SEQ ID NO: 569390 - DNA, 25 bp, Homo sapien
tttcatctgaagcagcagagtgaac

SEQ ID NO: 569391 - DNA, 25 bp, Homo sapien
gagtgaactgcagagtcagagatag

SEQ ID NO: 569392 - DNA, 25 bp, Homo sapien
actgcagagtcagagatagaatctc

SEQ ID NO: 569393 - DNA, 25 bp, Homo sapien
gtctctagattaaataggtctcata

SEQ ID NO: 569394 - DNA, 25 bp, Homo sapien
aggtctcatactttctctaaatttc

SEQ ID NO: 569395 - DNA, 25 bp, Homo sapien
actgttcatggtctttgtatataaa

SEQ ID NO: 569396 - DNA, 25 bp, Homo sapien
atataccttatcaatttggcttttg

SEQ ID NO: 569397 - DNA, 25 bp, Homo sapien
ttggcttttgaagtcatatcattac

SEQ ID NO: 569398 - DNA, 25 bp, Homo sapien
tatcattactattaacttacttcca

SEQ ID NO: 569399 - DNA, 25 bp, Homo sapien
acttccaaagtatgtttaattctga

SEQ ID NO: 569400 - DNA, 25 bp, Homo sapien
gtgtgggtaatattgaagtcttggc

SEQ ID NO: 569401 - DNA, 25 bp, Homo sapien
gaagtcttggcaaactcatgtgatt

SEQ ID NO: 569402 - DNA, 25 bp, Homo sapien
tcatgtgattagaaacccccctggt

SEQ ID NO: 569403 - DNA, 25 bp, Homo sapien
cccctggtgcaacagagtgtgtttt

SEQ ID NO: 569404 - DNA, 25 bp, Homo sapien
ggctggaccccgacacgtaggcgcc

SEQ ID NO: 569405 - DNA, 25 bp, Homo sapien
gacttccgggcctcgatttcttccg

SEQ ID NO: 569406 - DNA, 25 bp, Homo sapien
cgggcctcgatttcttccgcacaag

SEQ ID NO: 569407 - DNA, 25 bp, Homo sapien
gatttcttccgcacaagcctgaccg

SEQ ID NO: 569408 - DNA, 25 bp, Homo sapien
ttcttccgcacaagcctgaccgtgg

SEQ ID NO: 569409 - DNA, 25 bp, Homo sapien
aagcctgaccgtggatttcagggac

SEQ ID NO: 569410 - DNA, 25 bp, Homo sapien
ctgaccgtggatttcagggacacat

SEQ ID NO: 569411 - DNA, 25 bp, Homo sapien
gaccgtggatttcagggacacatac

SEQ ID NO: 569412 - DNA, 25 bp, Homo sapien
agggacacataccgcctccagcggg

SEQ ID NO: 569413 - DNA, 25 bp, Homo sapien
tgctgccttccgtgcggatcgagct

SEQ ID NO: 569414 - DNA, 25 bp, Homo sapien
gctgccttccgtgcggatcgagctt

SEQ ID NO: 569415 - DNA, 25 bp, Homo sapien
aagggctccggcttcttcgtcttca

SEQ ID NO: 569416 - DNA, 25 bp, Homo sapien
gaaagatgagttcatctgccgtgca

SEQ ID NO: 569417 - DNA, 25 bp, Homo sapien
aaagatgagttcatctgccgtgcag

SEQ ID NO: 569418 - DNA, 25 bp, Homo sapien
aagatgagttcatctgccgtgcagt

SEQ ID NO: 569419 - DNA, 25 bp, Homo sapien
agatgagttcatctgccgtgcagtc

SEQ ID NO: 569420 - DNA, 25 bp, Homo sapien
gatgagttcatctgccgtgcagtcc

SEQ ID NO: 569421 - DNA, 25 bp, Homo sapien
gtgcagtccatgaggcagcgagccc

SEQ ID NO: 569422 - DNA, 25 bp, Homo sapien
tcacagaccgtccagcgagcggtgt

SEQ ID NO: 569423 - DNA, 25 bp, Homo sapien
gagcggtgtctgtaaatcccggtaa

SEQ ID NO: 569424 - DNA, 25 bp, Homo sapien
tgcagtggctgcacaacgaggtgca

SEQ ID NO: 569425 - DNA, 25 bp, Homo sapien
tgcacaacgaggtgcagctcccgga

SEQ ID NO: 569426 - DNA, 25 bp, Homo sapien
gatgcatgctagtaaaagaagtgta

SEQ ID NO: 569427 - DNA, 25 bp, Homo sapien
tgcatgctagtaaaagaagtgtatt

SEQ ID NO: 569428 - DNA, 25 bp, Homo sapien
aagaagtgtatttgctgatatggtt

SEQ ID NO: 569429 - DNA, 25 bp, Homo sapien
atggttgaagttatgtaatcattaa

SEQ ID NO: 569430 - DNA, 25 bp, Homo sapien
ctatataagtttagagatgtggaac

SEQ ID NO: 569431 - DNA, 25 bp, Homo sapien
aaagaacaatttattcagtgctaat

SEQ ID NO: 569432 - DNA, 25 bp, Homo sapien
gaacaatttattcagtgctaatttg

SEQ ID NO: 569433 - DNA, 25 bp, Homo sapien
aatttattcagtgctaatttgttga

SEQ ID NO: 569434 - DNA, 25 bp, Homo sapien
ttcagtgctaatttgttgatacttt

SEQ ID NO: 569435 - DNA, 25 bp, Homo sapien
cagtgctaatttgttgatacttttt

SEQ ID NO: 569436 - DNA, 25 bp, Homo sapien
gtgctaatttgttgatactttttta

SEQ ID NO: 569437 - DNA, 25 bp, Homo sapien
gttacaagaagaagacacacccgtg

SEQ ID NO: 569438 - DNA, 25 bp, Homo sapien
tacaagaagaagacacacccgtgag

SEQ ID NO: 569439 - DNA, 25 bp, Homo sapien
ttatacaacccttagtcattacctg

SEQ ID NO: 569440 - DNA, 25 bp, Homo sapien
tatacaacccttagtcattacctga

SEQ ID NO: 569441 - DNA, 25 bp, Homo sapien
tacaacccttagtcattacctgacc

SEQ ID NO: 569442 - DNA, 25 bp, Homo sapien
caacccttagtcattacctgacctt

SEQ ID NO: 569443 - DNA, 25 bp, Homo sapien
acccttagtcattacctgaccttag

SEQ ID NO: 569444 - DNA, 25 bp, Homo sapien
cttagtcattacctgaccttaggaa

SEQ ID NO: 569445 - DNA, 25 bp, Homo sapien
tagtcattacctgaccttaggaaat

SEQ ID NO: 569446 - DNA, 25 bp, Homo sapien
gtcattacctgaccttaggaaattg

SEQ ID NO: 569447 - DNA, 25 bp, Homo sapien
tcattacctgaccttaggaaattgt

SEQ ID NO: 569448 - DNA, 25 bp, Homo sapien
tgctccattcctacctgcaaggctg

SEQ ID NO: 569449 - DNA, 25 bp, Homo sapien
ctgcaaggctgggttttctcagcct

SEQ ID NO: 569450 - DNA, 25 bp, Homo sapien
ggttttctcagcctgtcatttttga

SEQ ID NO: 569451 - DNA, 25 bp, Homo sapien
ctgtcatttttgatgtcacaccagg

SEQ ID NO: 569452 - DNA, 25 bp, Homo sapien
acaccaggctgtggttttcattgct

SEQ ID NO: 569453 - DNA, 25 bp, Homo sapien
ggctgtggttttcattgctttggca

SEQ ID NO: 569454 - DNA, 25 bp, Homo sapien
tggagtcgggacagacattttgctg

SEQ ID NO: 569455 - DNA, 25 bp, Homo sapien
gctttaccgggtaatatgcggtcct

SEQ ID NO: 569456 - DNA, 25 bp, Homo sapien
accgggtaatatgcggtcctggctc

SEQ ID NO: 569457 - DNA, 25 bp, Homo sapien
tggctctggcttgttccctcacaag

SEQ ID NO: 569458 - DNA, 25 bp, Homo sapien
tgttccctcacaagagtgtggctaa

SEQ ID NO: 569459 - DNA, 25 bp, Homo sapien
gaggagacggttgctaaatgtagtt

SEQ ID NO: 569460 - DNA, 25 bp, Homo sapien
gagacggttgctaaatgtagttcta

SEQ ID NO: 569461 - DNA, 25 bp, Homo sapien
gacggttgctaaatgtagttctatc

SEQ ID NO: 569462 - DNA, 25 bp, Homo sapien
cggttgctaaatgtagttctatctg

SEQ ID NO: 569463 - DNA, 25 bp, Homo sapien
gttgctaaatgtagttctatctggg

SEQ ID NO: 569464 - DNA, 25 bp, Homo sapien
aatgtagttctatctggggactcga

SEQ ID NO: 569465 - DNA, 25 bp, Homo sapien
gactcgagtggggcacaatttttaa

SEQ ID NO: 569466 - DNA, 25 bp, Homo sapien
gaactctgagttaccatctttggac

SEQ ID NO: 569467 - DNA, 25 bp, Homo sapien
gtaatccttaaatctgtgtcagtag

SEQ ID NO: 569468 - DNA, 25 bp, Homo sapien
aaacctcactaaactgctacttaag

SEQ ID NO: 569469 - DNA, 25 bp, Homo sapien
gatcacagttaatgtgagtcctgct

SEQ ID NO: 569470 - DNA, 25 bp, Homo sapien
agtaccgacaatcaccatcccaaag

SEQ ID NO: 569471 - DNA, 25 bp, Homo sapien
atcccaaagctacgaggatgcgatg

SEQ ID NO: 569472 - DNA, 25 bp, Homo sapien
ggatgcgatggtaacatgctcatca

SEQ ID NO: 569473 - DNA, 25 bp, Homo sapien
atgctcatcagccatctacttaaca

SEQ ID NO: 569474 - DNA, 25 bp, Homo sapien
atcagccatctacttaacactttgc

SEQ ID NO: 569475 - DNA, 25 bp, Homo sapien
tacttaacactttgcccaagcctag

SEQ ID NO: 569476 - DNA, 25 bp, Homo sapien
ttgcccaagcctagtcccgtttcat

SEQ ID NO: 569477 - DNA, 25 bp, Homo sapien
catcatcccagcaacttgatgagtt

SEQ ID NO: 569478 - DNA, 25 bp, Homo sapien
acatgggaccgccttcagtactttc

SEQ ID NO: 569479 - DNA, 25 bp, Homo sapien
caaaatctaccattccacttggttc

SEQ ID NO: 569480 - DNA, 25 bp, Homo sapien
cacttggttctatgtggaatgatgt

SEQ ID NO: 569481 - DNA, 25 bp, Homo sapien
cacttgtcaaagatctacgcacctc

SEQ ID NO: 569482 - DNA, 25 bp, Homo sapien
aaaaggattgctgtgggaccattta

SEQ ID NO: 569483 - DNA, 25 bp, Homo sapien
gggaccatttagatccgactaccca

SEQ ID NO: 569484 - DNA, 25 bp, Homo sapien
tagatccgactacccagctctttat

SEQ ID NO: 569485 - DNA, 25 bp, Homo sapien
ttttttctcccatcatgtcttctcc

SEQ ID NO: 569486 - DNA, 25 bp, Homo sapien
gaaaggtgctcatctctaagctgaa

SEQ ID NO: 569487 - DNA, 25 bp, Homo sapien
taagctgaacacttgtcttacttca

SEQ ID NO: 569488 - DNA, 25 bp, Homo sapien
gtggacctggtcacattgggtcttt

SEQ ID NO: 569489 - DNA, 25 bp, Homo sapien
gggtctttttaattgatactgtaca

SEQ ID NO: 569490 - DNA, 25 bp, Homo sapien
gatactgtacaatcttgttgtcact

SEQ ID NO: 569491 - DNA, 25 bp, Homo sapien
ttatttaacagtagacctcatgtct

SEQ ID NO: 569492 - DNA, 25 bp, Homo sapien
gacctgcctgcctcattgtctgaca

SEQ ID NO: 569493 - DNA, 25 bp, Homo sapien
tgcctgcctcattgtctgacagctt

SEQ ID NO: 569494 - DNA, 25 bp, Homo sapien
gcctgcctcattgtctgacagcttt

SEQ ID NO: 569495 - DNA, 25 bp, Homo sapien
tgcctcattgtctgacagctttccc

SEQ ID NO: 569496 - DNA, 25 bp, Homo sapien
cctcattgtctgacagctttcccag

SEQ ID NO: 569497 - DNA, 25 bp, Homo sapien
tcattgtctgacagctttcccagcc

SEQ ID NO: 569498 - DNA, 25 bp, Homo sapien
attgtctgacagctttcccagcctc

SEQ ID NO: 569499 - DNA, 25 bp, Homo sapien
ccctccgttttctcttatacgcatt

SEQ ID NO: 569500 - DNA, 25 bp, Homo sapien
ctccgttttctcttatacgcattcc

SEQ ID NO: 569501 - DNA, 25 bp, Homo sapien
tccgttttctcttatacgcattccc

SEQ ID NO: 569502 - DNA, 25 bp, Homo sapien
ctcttatacgcattcccccaataaa

SEQ ID NO: 569503 - DNA, 25 bp, Homo sapien
tctccagctggtgtactgcaaagcc

SEQ ID NO: 569504 - DNA, 25 bp, Homo sapien
tgcaaagccttccaagaccaagttc

SEQ ID NO: 569505 - DNA, 25 bp, Homo sapien
tgtccccagtaacacacatgagtct

SEQ ID NO: 569506 - DNA, 25 bp, Homo sapien
aacacacatgagtctctccctcaga

SEQ ID NO: 569507 - DNA, 25 bp, Homo sapien
tctccctcagaagccacagaaggat

SEQ ID NO: 569508 - DNA, 25 bp, Homo sapien
gagagagaccaacccaggattgatt

SEQ ID NO: 569509 - DNA, 25 bp, Homo sapien
aattgtgtggacataactgctctgg

SEQ ID NO: 569510 - DNA, 25 bp, Homo sapien
ataactgctctggacctcagctttg

SEQ ID NO: 569511 - DNA, 25 bp, Homo sapien
ggacctcagctttgctatctataaa

SEQ ID NO: 569512 - DNA, 25 bp, Homo sapien
gtacctggaagaggtcagcttctcc

SEQ ID NO: 569513 - DNA, 25 bp, Homo sapien
aagaggtcagcttctcctcaaagga

SEQ ID NO: 569514 - DNA, 25 bp, Homo sapien
atgatgacatctcatggacacttag

SEQ ID NO: 569515 - DNA, 25 bp, Homo sapien
tgacatctcatggacacttagaaga

SEQ ID NO: 569516 - DNA, 25 bp, Homo sapien
acttagaagatctccaggacctttg

SEQ ID NO: 569517 - DNA, 25 bp, Homo sapien
gaagatctccaggacctttggaaga

SEQ ID NO: 569518 - DNA, 25 bp, Homo sapien
cctttggaagaatgctacagatcct

SEQ ID NO: 569519 - DNA, 25 bp, Homo sapien
tggaagaatgctacagatcctaaag

SEQ ID NO: 569520 - DNA, 25 bp, Homo sapien
ttttggtcaaatatactgcagatta

SEQ ID NO: 569521 - DNA, 25 bp, Homo sapien
aatgaagataattctcctttgtaaa

SEQ ID NO: 569522 - DNA, 25 bp, Homo sapien
taattctcctttgtaaaattagcta

SEQ ID NO: 569523 - DNA, 25 bp, Homo sapien
cccttgtagggctgcgtttatctaa

SEQ ID NO: 569524 - DNA, 25 bp, Homo sapien
gggctgcgtttatctaatagtactt

SEQ ID NO: 569525 - DNA, 25 bp, Homo sapien
tcctatttcccctacagaacaaaag

SEQ ID NO: 569526 - DNA, 25 bp, Homo sapien
acaaaagccctaagcctctgaggat

SEQ ID NO: 569527 - DNA, 25 bp, Homo sapien
aagcaaatcttgtcacccttaggga

SEQ ID NO: 569528 - DNA, 25 bp, Homo sapien
gtcacccttagggactggttaagat

SEQ ID NO: 569529 - DNA, 25 bp, Homo sapien
aaaaagctctccattcacgaaatag

SEQ ID NO: 569530 - DNA, 25 bp, Homo sapien
acgaaatagcggtagaattgcatcc

SEQ ID NO: 569531 - DNA, 25 bp, Homo sapien
ctacagctgaggatagggcaacatc

SEQ ID NO: 569532 - DNA, 25 bp, Homo sapien
ggcaacatcacttaatagaccccac

SEQ ID NO: 569533 - DNA, 25 bp, Homo sapien
taatagaccccacccttaagtctca

SEQ ID NO: 569534 - DNA, 25 bp, Homo sapien
gagacacagtgcctacctaagatta

SEQ ID NO: 569535 - DNA, 25 bp, Homo sapien
aacagaaaatgccatcccttctacc

SEQ ID NO: 569536 - DNA, 25 bp, Homo sapien
acttgcaagtctcacctgggtctct

SEQ ID NO: 569537 - DNA, 25 bp, Homo sapien
aaggctacagccacaaagcacttat

SEQ ID NO: 569538 - DNA, 25 bp, Homo sapien
gcacttatatagttgggcccctttg

SEQ ID NO: 569539 - DNA, 25 bp, Homo sapien
ggcccctttgctgacacgtgacatg

SEQ ID NO: 569540 - DNA, 25 bp, Homo sapien
tgctgacacgtgacatgcaattcag

SEQ ID NO: 569541 - DNA, 25 bp, Homo sapien
atgcaattcagggatgcctcctcct

SEQ ID NO: 569542 - DNA, 25 bp, Homo sapien
agtgatgagtgcctgcagctattgt

SEQ ID NO: 569543 - DNA, 25 bp, Homo sapien
gtgcctgcagctattgtaaatgtta

SEQ ID NO: 569544 - DNA, 25 bp, Homo sapien
attaatgttggttgtacacccatgt

SEQ ID NO: 569545 - DNA, 25 bp, Homo sapien
gcagcatgactcacaatagccaaat

SEQ ID NO: 569546 - DNA, 25 bp, Homo sapien
tagaagcaatctgtattagtccgtt

SEQ ID NO: 569547 - DNA, 25 bp, Homo sapien
tttaaagtacccaatctgataagtt

SEQ ID NO: 569548 - DNA, 25 bp, Homo sapien
gtacccaatctgataagttttgtca

SEQ ID NO: 569549 - DNA, 25 bp, Homo sapien
aagttttgtcatatgcatacagcca

SEQ ID NO: 569550 - DNA, 25 bp, Homo sapien
gttttgtcatatgcatacagccatg

SEQ ID NO: 569551 - DNA, 25 bp, Homo sapien
atgcatacagccatgaaatcatcac

SEQ ID NO: 569552 - DNA, 25 bp, Homo sapien
gaaatcatcaccataagcaaggtaa

SEQ ID NO: 569553 - DNA, 25 bp, Homo sapien
tcaccataagcaaggtaatgaacat

SEQ ID NO: 569554 - DNA, 25 bp, Homo sapien
tgaacatattcatcactctcaaagt

SEQ ID NO: 569555 - DNA, 25 bp, Homo sapien
tattcatcactctcaaagtttcata

SEQ ID NO: 569556 - DNA, 25 bp, Homo sapien
actctcaaagtttcatagtacctct

SEQ ID NO: 569557 - DNA, 25 bp, Homo sapien
gtttcatagtacctctttgtgatcc

SEQ ID NO: 569558 - DNA, 25 bp, Homo sapien
atgactacggaacctgtgtccttaa

SEQ ID NO: 569559 - DNA, 25 bp, Homo sapien
cacgccgcatcgctagatgtggaag

SEQ ID NO: 569560 - DNA, 25 bp, Homo sapien
gtggaagcccctcataagctgtaaa

SEQ ID NO: 569561 - DNA, 25 bp, Homo sapien
gggcgctatggttaagagttttcat

SEQ ID NO: 569562 - DNA, 25 bp, Homo sapien
atattctgcctctcatggttaatgc

SEQ ID NO: 569563 - DNA, 25 bp, Homo sapien
tggaataaacttcacaggctagaat

SEQ ID NO: 569564 - DNA, 25 bp, Homo sapien
ggtgaggtgactacactatgtccct

SEQ ID NO: 569565 - DNA, 25 bp, Homo sapien
actatgtccctctaagatgcgatgg

SEQ ID NO: 569566 - DNA, 25 bp, Homo sapien
gatgcgatgggcaatcaagaggcct

SEQ ID NO: 569567 - DNA, 25 bp, Homo sapien
caagaggcctgaatcttctggtcct

SEQ ID NO: 569568 - DNA, 25 bp, Homo sapien
tggtcctcctgttgcattgctgaat

SEQ ID NO: 569569 - DNA, 25 bp, Homo sapien
gatcaagagttcttattgtatttat

SEQ ID NO: 569570 - DNA, 25 bp, Homo sapien
aatttcatttcccattctgttgctt

SEQ ID NO: 569571 - DNA, 25 bp, Homo sapien
atttcatttcccattctgttgcttg

SEQ ID NO: 569572 - DNA, 25 bp, Homo sapien
tttcatttcccattctgttgcttgc

SEQ ID NO: 569573 - DNA, 25 bp, Homo sapien
tcatttcccattctgttgcttgcct

SEQ ID NO: 569574 - DNA, 25 bp, Homo sapien
atttcccattctgttgcttgccttt

SEQ ID NO: 569575 - DNA, 25 bp, Homo sapien
ctaacctcagcctatatctgtctat

SEQ ID NO: 569576 - DNA, 25 bp, Homo sapien
aacctcagcctatatctgtctatct

SEQ ID NO: 569577 - DNA, 25 bp, Homo sapien
gacagagatatctatagatagctat

SEQ ID NO: 569578 - DNA, 25 bp, Homo sapien
tagatagctatggtaaattttgaaa

SEQ ID NO: 569579 - DNA, 25 bp, Homo sapien
gaaacacgttccaaatacattataa

SEQ ID NO: 569580 - DNA, 25 bp, Homo sapien
gggacgccatggaactcactcgcga

SEQ ID NO: 569581 - DNA, 25 bp, Homo sapien
gacgccatggaactcactcgcgatt

SEQ ID NO: 569582 - DNA, 25 bp, Homo sapien
acgccatggaactcactcgcgattc

SEQ ID NO: 569583 - DNA, 25 bp, Homo sapien
gccatggaactcactcgcgattcct

SEQ ID NO: 569584 - DNA, 25 bp, Homo sapien
atggaactcactcgcgattcctgct

SEQ ID NO: 569585 - DNA, 25 bp, Homo sapien
tcgcgattcctgctcacagcacgtt

SEQ ID NO: 569586 - DNA, 25 bp, Homo sapien
gcgattcctgctcacagcacgtttc

SEQ ID NO: 569587 - DNA, 25 bp, Homo sapien
attcctgctcacagcacgtttcctg

SEQ ID NO: 569588 - DNA, 25 bp, Homo sapien
aggagagcctccacgtgccgactag

SEQ ID NO: 569589 - DNA, 25 bp, Homo sapien
ggagagcctccacgtgccgactagc

SEQ ID NO: 569590 - DNA, 25 bp, Homo sapien
tccacgtgccgactagctctgtcca

SEQ ID NO: 569591 - DNA, 25 bp, Homo sapien
atcatttctgctaatctaatgtaac

SEQ ID NO: 569592 - DNA, 25 bp, Homo sapien
cctgactacttaactaaaagatcct

SEQ ID NO: 569593 - DNA, 25 bp, Homo sapien
aaaagatcctatgttcagggtcata

SEQ ID NO: 569594 - DNA, 25 bp, Homo sapien
tagcacttaatgactttctggcatg

SEQ ID NO: 569595 - DNA, 25 bp, Homo sapien
tgactttctggcatgcttttacatt

SEQ ID NO: 569596 - DNA, 25 bp, Homo sapien
gcttttacattcaaatgtctgggtg

SEQ ID NO: 569597 - DNA, 25 bp, Homo sapien
ctgggtgtaaatttaatgacttcta

SEQ ID NO: 569598 - DNA, 25 bp, Homo sapien
atgacttctacatttcgaggctaaa

SEQ ID NO: 569599 - DNA, 25 bp, Homo sapien
agaaaatttccagcaaacacaaaat

SEQ ID NO: 569600 - DNA, 25 bp, Homo sapien
gagtaaacacatatgcacctgataa

SEQ ID NO: 569601 - DNA, 25 bp, Homo sapien
cacctgataatttgttttgatgcat

SEQ ID NO: 569602 - DNA, 25 bp, Homo sapien
agtatctcccatttgactttataag

SEQ ID NO: 569603 - DNA, 25 bp, Homo sapien
gtatctcccatttgactttataaga

SEQ ID NO: 569604 - DNA, 25 bp, Homo sapien
tatctcccatttgactttataagaa

SEQ ID NO: 569605 - DNA, 25 bp, Homo sapien
atctcccatttgactttataagaaa

SEQ ID NO: 569606 - DNA, 25 bp, Homo sapien
tctcccatttgactttataagaaaa

SEQ ID NO: 569607 - DNA, 25 bp, Homo sapien
ctcccatttgactttataagaaaat

SEQ ID NO: 569608 - DNA, 25 bp, Homo sapien
tcccatttgactttataagaaaatt

SEQ ID NO: 569609 - DNA, 25 bp, Homo sapien
tgactttataagaaaatttgggccg

SEQ ID NO: 569610 - DNA, 25 bp, Homo sapien
tataagaaaatttgggccgggtgtg

SEQ ID NO: 569611 - DNA, 25 bp, Homo sapien
agggaggagaatggcatgagcctag

SEQ ID NO: 569612 - DNA, 25 bp, Homo sapien
ggaggagaatggcatgagcctagga

SEQ ID NO: 569613 - DNA, 25 bp, Homo sapien
acgttattactttattcttctctat

SEQ ID NO: 569614 - DNA, 25 bp, Homo sapien
cgttattactttattcttctctatt

SEQ ID NO: 569615 - DNA, 25 bp, Homo sapien
gttattactttattcttctctattt

SEQ ID NO: 569616 - DNA, 25 bp, Homo sapien
aaatgggagttcagtaatggcagtg

SEQ ID NO: 569617 - DNA, 25 bp, Homo sapien
aatgggagttcagtaatggcagtga

SEQ ID NO: 569618 - DNA, 25 bp, Homo sapien
atgggagttcagtaatggcagtgag

SEQ ID NO: 569619 - DNA, 25 bp, Homo sapien
tgggagttcagtaatggcagtgaga

SEQ ID NO: 569620 - DNA, 25 bp, Homo sapien
gggagttcagtaatggcagtgagag

SEQ ID NO: 569621 - DNA, 25 bp, Homo sapien
ggagttcagtaatggcagtgagagg

SEQ ID NO: 569622 - DNA, 25 bp, Homo sapien
ttcagtaatggcagtgagaggagat

SEQ ID NO: 569623 - DNA, 25 bp, Homo sapien
cagtaatggcagtgagaggagatga

SEQ ID NO: 569624 - DNA, 25 bp, Homo sapien
ggtttatggatggagtggcatggta

SEQ ID NO: 569625 - DNA, 25 bp, Homo sapien
agtggcatggtagaggttagctgaa

SEQ ID NO: 569626 - DNA, 25 bp, Homo sapien
ggtgctagagtgttgtaaatcttac

SEQ ID NO: 569627 - DNA, 25 bp, Homo sapien
gctagagtgttgtaaatcttacagt

SEQ ID NO: 569628 - DNA, 25 bp, Homo sapien
ggacaggagtgcaggcatttgacaa

SEQ ID NO: 569629 - DNA, 25 bp, Homo sapien
caggagtgcaggcatttgacaaaac

SEQ ID NO: 569630 - DNA, 25 bp, Homo sapien
gagtgcaggcatttgacaaaacaca

SEQ ID NO: 569631 - DNA, 25 bp, Homo sapien
gtgcaggcatttgacaaaacacatt

SEQ ID NO: 569632 - DNA, 25 bp, Homo sapien
gcaggcatttgacaaaacacattga

SEQ ID NO: 569633 - DNA, 25 bp, Homo sapien
ggcatttgacaaaacacattgaatt

SEQ ID NO: 569634 - DNA, 25 bp, Homo sapien
tgtatgtaaattacctgccaataaa

SEQ ID NO: 569635 - DNA, 25 bp, Homo sapien
gaatgaatgtctttgcaccaatccc

SEQ ID NO: 569636 - DNA, 25 bp, Homo sapien
atgtctttgcaccaatcccaaaggt

SEQ ID NO: 569637 - DNA, 25 bp, Homo sapien
gtctttgcaccaatcccaaaggtga

SEQ ID NO: 569638 - DNA, 25 bp, Homo sapien
ccaatcccaaaggtgatgtgactct

SEQ ID NO: 569639 - DNA, 25 bp, Homo sapien
tgactctcttgtgttacctggtctc

SEQ ID NO: 569640 - DNA, 25 bp, Homo sapien
tacctggtctctgctcacaggaaga

SEQ ID NO: 569641 - DNA, 25 bp, Homo sapien
ctggtctctgctcacaggaagaatc

SEQ ID NO: 569642 - DNA, 25 bp, Homo sapien
gtctctgctcacaggaagaatcgtg

SEQ ID NO: 569643 - DNA, 25 bp, Homo sapien
cacaggaagaatcgtgacctttcac

SEQ ID NO: 569644 - DNA, 25 bp, Homo sapien
ggaagaatcgtgacctttcacagca

SEQ ID NO: 569645 - DNA, 25 bp, Homo sapien
cacagcatatggttgatttttttct

SEQ ID NO: 569646 - DNA, 25 bp, Homo sapien
atttcatggcctccaagctcagctg

SEQ ID NO: 569647 - DNA, 25 bp, Homo sapien
ctccaagctcagctgggctgaatga

SEQ ID NO: 569648 - DNA, 25 bp, Homo sapien
tgaatgaacgctgccatccagcgct

SEQ ID NO: 569649 - DNA, 25 bp, Homo sapien
tgccatccagcgcttggctcatttt

SEQ ID NO: 569650 - DNA, 25 bp, Homo sapien
tggctcattttctgtcccattttcc

SEQ ID NO: 569651 - DNA, 25 bp, Homo sapien
cattttcctgagtgcttttgccaga

SEQ ID NO: 569652 - DNA, 25 bp, Homo sapien
tgcttttgccagacttacacttttc

SEQ ID NO: 569653 - DNA, 25 bp, Homo sapien
ttgccagacttacacttttctgaaa

SEQ ID NO: 569654 - DNA, 25 bp, Homo sapien
tgaggcccaggttgacccgtggtca

SEQ ID NO: 569655 - DNA, 25 bp, Homo sapien
tgacccgtggtcatggtcgctgtca

SEQ ID NO: 569656 - DNA, 25 bp, Homo sapien
tggtcatggtcgctgtcaccaccca

SEQ ID NO: 569657 - DNA, 25 bp, Homo sapien
gaagatatattggagtgactgctga

SEQ ID NO: 569658 - DNA, 25 bp, Homo sapien
gagtgactgctgaaattgccttttt

SEQ ID NO: 569659 - DNA, 25 bp, Homo sapien
gtgactgctgaaattgcctttttgt

SEQ ID NO: 569660 - DNA, 25 bp, Homo sapien
cagaggacagtccatttgtttcact

SEQ ID NO: 569661 - DNA, 25 bp, Homo sapien
ggacagtccatttgtttcacttctt

SEQ ID NO: 569662 - DNA, 25 bp, Homo sapien
ctgctatgagctttactgaacggct

SEQ ID NO: 569663 - DNA, 25 bp, Homo sapien
atgagctttactgaacggctgaaaa

SEQ ID NO: 569664 - DNA, 25 bp, Homo sapien
tactgaacggctgaaaaacttggaa

SEQ ID NO: 569665 - DNA, 25 bp, Homo sapien
atggacatgctgtagtcttgaacat

SEQ ID NO: 569666 - DNA, 25 bp, Homo sapien
gaaagatccagattacctgaagctg

SEQ ID NO: 569667 - DNA, 25 bp, Homo sapien
gattacctgaagctgtggttggaca

SEQ ID NO: 569668 - DNA, 25 bp, Homo sapien
gcaaccaagatatctttcaatagat

SEQ ID NO: 569669 - DNA, 25 bp, Homo sapien
ggataagcaaactgttgtacaccta

SEQ ID NO: 569670 - DNA, 25 bp, Homo sapien
aagcaaactgttgtacacctataca

SEQ ID NO: 569671 - DNA, 25 bp, Homo sapien
gttgtacacctatacagtggaatag

SEQ ID NO: 569672 - DNA, 25 bp, Homo sapien
attttaaaaatgagctacgtagcca

SEQ ID NO: 569673 - DNA, 25 bp, Homo sapien
gctacgtagccatgaaaagacccag

SEQ ID NO: 569674 - DNA, 25 bp, Homo sapien
gaaaagacccagagtgaaccttgaa

SEQ ID NO: 569675 - DNA, 25 bp, Homo sapien
agacccagagtgaaccttgaaaaca

SEQ ID NO: 569676 - DNA, 25 bp, Homo sapien
accttgaaaacatgttacaaagctg

SEQ ID NO: 569677 - DNA, 25 bp, Homo sapien
gttacaaagctgaaaaggctacgaa

SEQ ID NO: 569678 - DNA, 25 bp, Homo sapien
ggctacgaaatgtatgattccaact

SEQ ID NO: 569679 - DNA, 25 bp, Homo sapien
ttagatttcctgttactggcaggga

SEQ ID NO: 569680 - DNA, 25 bp, Homo sapien
aattttcagctctatattgtatttg

SEQ ID NO: 569681 - DNA, 25 bp, Homo sapien
tattgtatttgttttgacttaggta

SEQ ID NO: 569682 - DNA, 25 bp, Homo sapien
aagtcagttaattataggtgtgtaa

SEQ ID NO: 569683 - DNA, 25 bp, Homo sapien
ttaaaagttaaggagcagcttgaat

SEQ ID NO: 569684 - DNA, 25 bp, Homo sapien
gagtgtctgggcagcctgagcctcc

SEQ ID NO: 569685 - DNA, 25 bp, Homo sapien
agcctccgtggctgctaattgaaga

SEQ ID NO: 569686 - DNA, 25 bp, Homo sapien
ctccgtggctgctaattgaagagga

SEQ ID NO: 569687 - DNA, 25 bp, Homo sapien
cctgatgaaaaagttaggagttcct

SEQ ID NO: 569688 - DNA, 25 bp, Homo sapien
taggagttcctgaattttagtccat

SEQ ID NO: 569689 - DNA, 25 bp, Homo sapien
tctgctaccatacattgtgaatatg

SEQ ID NO: 569690 - DNA, 25 bp, Homo sapien
ttttttattactagcttcagcagac

SEQ ID NO: 569691 - DNA, 25 bp, Homo sapien
aaacttcctctgtcaaggtgttata

SEQ ID NO: 569692 - DNA, 25 bp, Homo sapien
tcctctgtcaaggtgttataaacat

SEQ ID NO: 569693 - DNA, 25 bp, Homo sapien
aatcacattttccatttccatacat

SEQ ID NO: 569694 - DNA, 25 bp, Homo sapien
cacattttccatttccatacatatc

SEQ ID NO: 569695 - DNA, 25 bp, Homo sapien
gttcatcagtaataactagttggcc

SEQ ID NO: 569696 - DNA, 25 bp, Homo sapien
ctagttggccaactgactgtggtcc

SEQ ID NO: 569697 - DNA, 25 bp, Homo sapien
actgactgtggtccatggactacac

SEQ ID NO: 569698 - DNA, 25 bp, Homo sapien
gtggtccatggactacacagtgagt

SEQ ID NO: 569699 - DNA, 25 bp, Homo sapien
gtccatggactacacagtgagtaga

SEQ ID NO: 569700 - DNA, 25 bp, Homo sapien
ggaggtatgaactgtatttctcatt

SEQ ID NO: 569701 - DNA, 25 bp, Homo sapien
acacaatggcttcctttgccaagtt

SEQ ID NO: 569702 - DNA, 25 bp, Homo sapien
caatggcttcctttgccaagttgct

SEQ ID NO: 569703 - DNA, 25 bp, Homo sapien
tttgccaagttgctgagctcttgca

SEQ ID NO: 569704 - DNA, 25 bp, Homo sapien
gccaagttgctgagctcttgcaaac

SEQ ID NO: 569705 - DNA, 25 bp, Homo sapien
aagttgctgagctcttgcaaactct

SEQ ID NO: 569706 - DNA, 25 bp, Homo sapien
gttgctgagctcttgcaaactcttc

SEQ ID NO: 569707 - DNA, 25 bp, Homo sapien
ttgcaaactcttccaactccaaata

SEQ ID NO: 569708 - DNA, 25 bp, Homo sapien
aaactcttccaactccaaatacctg

SEQ ID NO: 569709 - DNA, 25 bp, Homo sapien
tcttccaactccaaatacctggcag

SEQ ID NO: 569710 - DNA, 25 bp, Homo sapien
ttccaactccaaatacctggcagct

SEQ ID NO: 569711 - DNA, 25 bp, Homo sapien
aactccaaatacctggcagctcctg

SEQ ID NO: 569712 - DNA, 25 bp, Homo sapien
tttccatcttgacagagtctctgaa

SEQ ID NO: 569713 - DNA, 25 bp, Homo sapien
agtctctgaaggactaggtcagggt

SEQ ID NO: 569714 - DNA, 25 bp, Homo sapien
ggtcagggtaattaactatcattga

SEQ ID NO: 569715 - DNA, 25 bp, Homo sapien
aggtagattacttttcagcaacaag

SEQ ID NO: 569716 - DNA, 25 bp, Homo sapien
gattacttttcagcaacaagttcat

SEQ ID NO: 569717 - DNA, 25 bp, Homo sapien
acaagttcattcaaattttctcctg

SEQ ID NO: 569718 - DNA, 25 bp, Homo sapien
gttcattcaaattttctcctgttta

SEQ ID NO: 569719 - DNA, 25 bp, Homo sapien
ttctcctgtttagataatgcagctg

SEQ ID NO: 569720 - DNA, 25 bp, Homo sapien
gataatgcagctgactttattaggg

SEQ ID NO: 569721 - DNA, 25 bp, Homo sapien
atttcagtctgtggacaactcccta

SEQ ID NO: 569722 - DNA, 25 bp, Homo sapien
gtctgtggacaactccctaataaag

SEQ ID NO: 569723 - DNA, 25 bp, Homo sapien
gtatctcctgcaagtaagaatgttt

SEQ ID NO: 569724 - DNA, 25 bp, Homo sapien
gaatgttttcacactgagctattga

SEQ ID NO: 569725 - DNA, 25 bp, Homo sapien
gagctattgatttaaccaagcagat

SEQ ID NO: 569726 - DNA, 25 bp, Homo sapien
gcaaacttgcatcattcatgcctgt

SEQ ID NO: 569727 - DNA, 25 bp, Homo sapien
catcattcatgcctgtttcttagct

SEQ ID NO: 569728 - DNA, 25 bp, Homo sapien
attcatgcctgtttcttagctatga

SEQ ID NO: 569729 - DNA, 25 bp, Homo sapien
aattcacgtcacattaacttgccca

SEQ ID NO: 569730 - DNA, 25 bp, Homo sapien
gtcacattaacttgcccatttaaaa

SEQ ID NO: 569731 - DNA, 25 bp, Homo sapien
gtatgttcacagacttgtacaacca

SEQ ID NO: 569732 - DNA, 25 bp, Homo sapien
gtacaaccatgactacagccaattt

SEQ ID NO: 569733 - DNA, 25 bp, Homo sapien
aaccatgactacagccaatttcaga

SEQ ID NO: 569734 - DNA, 25 bp, Homo sapien
aaactgctgacattgctaccataac

SEQ ID NO: 569735 - DNA, 25 bp, Homo sapien
tgacattgctaccataacaccggat

SEQ ID NO: 569736 - DNA, 25 bp, Homo sapien
taacaccggatcaagttcgacccat

SEQ ID NO: 569737 - DNA, 25 bp, Homo sapien
ggatcaagttcgacccatagcttac

SEQ ID NO: 569738 - DNA, 25 bp, Homo sapien
agttcgacccatagcttacattgat

SEQ ID NO: 569739 - DNA, 25 bp, Homo sapien
tcgacccatagcttacattgatttt

SEQ ID NO: 569740 - DNA, 25 bp, Homo sapien
gcttttagaactgtgcgacctagtg

SEQ ID NO: 569741 - DNA, 25 bp, Homo sapien
gtgcgacctagtgtttctccaaaag

SEQ ID NO: 569742 - DNA, 25 bp, Homo sapien
ttagagctttatgaaaactggaaca

SEQ ID NO: 569743 - DNA, 25 bp, Homo sapien
tacttggaatcaaggcatctctgta

SEQ ID NO: 569744 - DNA, 25 bp, Homo sapien
tatattctaaattctgtacttcaaa

SEQ ID NO: 569745 - DNA, 25 bp, Homo sapien
actcacaatcttgcttctcaatctt

SEQ ID NO: 569746 - DNA, 25 bp, Homo sapien
ctcacaatcttgcttctcaatctta

SEQ ID NO: 569747 - DNA, 25 bp, Homo sapien
acaatcttgcttctcaatcttaatc

SEQ ID NO: 569748 - DNA, 25 bp, Homo sapien
aatcttaatctatttgtgcttggtg

SEQ ID NO: 569749 - DNA, 25 bp, Homo sapien
cttaatctatttgtgcttggtgttt

SEQ ID NO: 569750 - DNA, 25 bp, Homo sapien
atttgtgcttggtgttttatataac

SEQ ID NO: 569751 - DNA, 25 bp, Homo sapien
gtgcttggtgttttatataacatca

SEQ ID NO: 569752 - DNA, 25 bp, Homo sapien
gttttatataacatcactaacccta

SEQ ID NO: 569753 - DNA, 25 bp, Homo sapien
ataacatcactaaccctaatacttg

SEQ ID NO: 569754 - DNA, 25 bp, Homo sapien
acatcactaaccctaatacttgagt

SEQ ID NO: 569755 - DNA, 25 bp, Homo sapien
tcactaaccctaatacttgagtatt

SEQ ID NO: 569756 - DNA, 25 bp, Homo sapien
tacgagatcgaatcacatttttaag

SEQ ID NO: 569757 - DNA, 25 bp, Homo sapien
gagatcgaatcacatttttaaggga

SEQ ID NO: 569758 - DNA, 25 bp, Homo sapien
gatcgaatcacatttttaagggaaa

SEQ ID NO: 569759 - DNA, 25 bp, Homo sapien
aataggcattctcatcttagatatg

SEQ ID NO: 569760 - DNA, 25 bp, Homo sapien
ggcattctcatcttagatatgtatg

SEQ ID NO: 569761 - DNA, 25 bp, Homo sapien
ctcatcttagatatgtatgtagcat

SEQ ID NO: 569762 - DNA, 25 bp, Homo sapien
tagaatcaatttattagctgctata

SEQ ID NO: 569763 - DNA, 25 bp, Homo sapien
tattagctgctatattgtttgacat

SEQ ID NO: 569764 - DNA, 25 bp, Homo sapien
ttagctgctatattgtttgacataa

SEQ ID NO: 569765 - DNA, 25 bp, Homo sapien
agctgctatattgtttgacataaaa

SEQ ID NO: 569766 - DNA, 25 bp, Homo sapien
gtttgacataaaaggcttttgaact

SEQ ID NO: 569767 - DNA, 25 bp, Homo sapien
aggtgagaattactccgtttgctct

SEQ ID NO: 569768 - DNA, 25 bp, Homo sapien
gtgagaattactccgtttgctcttt

SEQ ID NO: 569769 - DNA, 25 bp, Homo sapien
gagaattactccgtttgctctttac

SEQ ID NO: 569770 - DNA, 25 bp, Homo sapien
gaattactccgtttgctctttacag

SEQ ID NO: 569771 - DNA, 25 bp, Homo sapien
attactccgtttgctctttacagtc

SEQ ID NO: 569772 - DNA, 25 bp, Homo sapien
tactccgtttgctctttacagtcct

SEQ ID NO: 569773 - DNA, 25 bp, Homo sapien
tccgtttgctctttacagtcctttg

SEQ ID NO: 569774 - DNA, 25 bp, Homo sapien
cgtttgctctttacagtcctttggt

SEQ ID NO: 569775 - DNA, 25 bp, Homo sapien
tttgctctttacagtcctttggttt

SEQ ID NO: 569776 - DNA, 25 bp, Homo sapien
ttgctctttacagtcctttggtttt

SEQ ID NO: 569777 - DNA, 25 bp, Homo sapien
gctctttacagtcctttggtttttg

SEQ ID NO: 569778 - DNA, 25 bp, Homo sapien
gcttctcctaaaccacgtggatctc

SEQ ID NO: 569779 - DNA, 25 bp, Homo sapien
acgtggatctccaaacggaagtcag

SEQ ID NO: 569780 - DNA, 25 bp, Homo sapien
ggagcagacgttgagctcaatcaat

SEQ ID NO: 569781 - DNA, 25 bp, Homo sapien
ctcaatcaataaacacccaccttgg

SEQ ID NO: 569782 - DNA, 25 bp, Homo sapien
taaacacccaccttgggagctgcag

SEQ ID NO: 569783 - DNA, 25 bp, Homo sapien
cttggtgactgccacgctggctgct

SEQ ID NO: 569784 - DNA, 25 bp, Homo sapien
cagagctcctcgcttacttttgggc

SEQ ID NO: 569785 - DNA, 25 bp, Homo sapien
acttttgggcatatgcctgtgaacc

SEQ ID NO: 569786 - DNA, 25 bp, Homo sapien
gaaccagatggtggcacctcctgaa

SEQ ID NO: 569787 - DNA, 25 bp, Homo sapien
ggcacctcctgaaaatcgggtctgt

SEQ ID NO: 569788 - DNA, 25 bp, Homo sapien
aaaatcgggtctgtggataatggga

SEQ ID NO: 569789 - DNA, 25 bp, Homo sapien
gtcttgctgggagataattgttgct

SEQ ID NO: 569790 - DNA, 25 bp, Homo sapien
aattgttgctaatctaagtccaagg

SEQ ID NO: 569791 - DNA, 25 bp, Homo sapien
gttgctaatctaagtccaagggata

SEQ ID NO: 569792 - DNA, 25 bp, Homo sapien
ccaagggatagtgggatgtttttca

SEQ ID NO: 569793 - DNA, 25 bp, Homo sapien
tttcaacactggcaataaaaacaaa

SEQ ID NO: 569794 - DNA, 25 bp, Homo sapien
aactctttcaaagagggagaagcaa

SEQ ID NO: 569795 - DNA, 25 bp, Homo sapien
gaagcaagatttggattctaagaat

SEQ ID NO: 569796 - DNA, 25 bp, Homo sapien
ggattctaagaattttccttgtgaa

SEQ ID NO: 569797 - DNA, 25 bp, Homo sapien
ttggttgatttcactactgtagcaa

SEQ ID NO: 569798 - DNA, 25 bp, Homo sapien
ttcactactgtagcaaagatacaag

SEQ ID NO: 569799 - DNA, 25 bp, Homo sapien
aacagtctatttcatgtcgtttggg

SEQ ID NO: 569800 - DNA, 25 bp, Homo sapien
aaccccgtgatgtcagcagagacaa

SEQ ID NO: 569801 - DNA, 25 bp, Homo sapien
gagacaacatgaggagccaagccat

SEQ ID NO: 569802 - DNA, 25 bp, Homo sapien
aagccatctactcctactttatagt

SEQ ID NO: 569803 - DNA, 25 bp, Homo sapien
aggcactccttcttgctgtggtgga

SEQ ID NO: 569804 - DNA, 25 bp, Homo sapien
tgtggtggagacctgaacttctacc

SEQ ID NO: 569805 - DNA, 25 bp, Homo sapien
aacttctaccacctatcagcagtaa

SEQ ID NO: 569806 - DNA, 25 bp, Homo sapien
agcagtaaaggccacccatccatgg

SEQ ID NO: 569807 - DNA, 25 bp, Homo sapien
gggaactgtaatgaggcacctctgg

SEQ ID NO: 569808 - DNA, 25 bp, Homo sapien
ggattcttcccaggctggtggtaat

SEQ ID NO: 569809 - DNA, 25 bp, Homo sapien
ctgaactcccattcttgcctagcag

SEQ ID NO: 569810 - DNA, 25 bp, Homo sapien
caccctttccagatatcaacagatg

SEQ ID NO: 569811 - DNA, 25 bp, Homo sapien
gcatgtggcctagggtcatccccag

SEQ ID NO: 569812 - DNA, 25 bp, Homo sapien
catgtggcctagggtcatccccagc

SEQ ID NO: 569813 - DNA, 25 bp, Homo sapien
atgtggcctagggtcatccccagcc

SEQ ID NO: 569814 - DNA, 25 bp, Homo sapien
tgtggcctagggtcatccccagccc

SEQ ID NO: 569815 - DNA, 25 bp, Homo sapien
gtggcctagggtcatccccagccca

SEQ ID NO: 569816 - DNA, 25 bp, Homo sapien
tggcctagggtcatccccagcccat

SEQ ID NO: 569817 - DNA, 25 bp, Homo sapien
ggcctagggtcatccccagcccatc

SEQ ID NO: 569818 - DNA, 25 bp, Homo sapien
agcccatccctgtgtcagccctgag

SEQ ID NO: 569819 - DNA, 25 bp, Homo sapien
gaaacactatcttctaccaggagga

SEQ ID NO: 569820 - DNA, 25 bp, Homo sapien
taatgtaaatcaccaaatcccaatg

SEQ ID NO: 569821 - DNA, 25 bp, Homo sapien
aatcccaatgccttgtgactttcat

SEQ ID NO: 569822 - DNA, 25 bp, Homo sapien
tgtgactttcataggattcctgatc

SEQ ID NO: 569823 - DNA, 25 bp, Homo sapien
ttcactttgggctttctgatgttta

SEQ ID NO: 569824 - DNA, 25 bp, Homo sapien
gggctttctgatgtttattcacacc

SEQ ID NO: 569825 - DNA, 25 bp, Homo sapien
tattcacacctttggagagttgcaa

SEQ ID NO: 569826 - DNA, 25 bp, Homo sapien
gagagttgcaacttgccacatacga

SEQ ID NO: 569827 - DNA, 25 bp, Homo sapien
gccacatacgaaattagtctcatag

SEQ ID NO: 569828 - DNA, 25 bp, Homo sapien
catagtgtagtgaacttcaacccca

SEQ ID NO: 569829 - DNA, 25 bp, Homo sapien
tagacttagtaccagaaccaaaaat

SEQ ID NO: 569830 - DNA, 25 bp, Homo sapien
gggcagacactcactgtcaccagtg

SEQ ID NO: 569831 - DNA, 25 bp, Homo sapien
aaagaaaagccacattcgctcccat

SEQ ID NO: 569832 - DNA, 25 bp, Homo sapien
attcggataccagcattgcctccag

SEQ ID NO: 569833 - DNA, 25 bp, Homo sapien
gggagctccaggtaatgaggaacac

SEQ ID NO: 569834 - DNA, 25 bp, Homo sapien
taatgaggaacaccggctgctagtt

SEQ ID NO: 569835 - DNA, 25 bp, Homo sapien
aggaacaccggctgctagttagcaa

SEQ ID NO: 569836 - DNA, 25 bp, Homo sapien
gctagttagcaagatgaccctgaat

SEQ ID NO: 569837 - DNA, 25 bp, Homo sapien
agatgaccctgaattgagagtaaga

SEQ ID NO: 569838 - DNA, 25 bp, Homo sapien
ttatggggacttttcaggtggcaga

SEQ ID NO: 569839 - DNA, 25 bp, Homo sapien
aaagagatgttctgtttctggtgat

SEQ ID NO: 569840 - DNA, 25 bp, Homo sapien
ctgtttctggtgatacaacatctta

SEQ ID NO: 569841 - DNA, 25 bp, Homo sapien
aaggtctccagcctttggtgtgaca

SEQ ID NO: 569842 - DNA, 25 bp, Homo sapien
ctccagcctttggtgtgacacatga

SEQ ID NO: 569843 - DNA, 25 bp, Homo sapien
ggtgtgacacatgagagcgaataac

SEQ ID NO: 569844 - DNA, 25 bp, Homo sapien
aggtcttgagttttttgatagttag

SEQ ID NO: 569845 - DNA, 25 bp, Homo sapien
tgatagttaggcatattttcattat

SEQ ID NO: 569846 - DNA, 25 bp, Homo sapien
tagacacatatatgtctctctatat

SEQ ID NO: 569847 - DNA, 25 bp, Homo sapien
gaaagtctcaactgttacctcaata

SEQ ID NO: 569848 - DNA, 25 bp, Homo sapien
tgttacctcaataacctttaacctg

SEQ ID NO: 569849 - DNA, 25 bp, Homo sapien
caataacctttaacctgactacaat

SEQ ID NO: 569850 - DNA, 25 bp, Homo sapien
gctgctgagggttaaaggcaaactt

SEQ ID NO: 569851 - DNA, 25 bp, Homo sapien
ggcaaacttaaggtctccagccttt

SEQ ID NO: 569852 - DNA, 25 bp, Homo sapien
cagtgtcaattctgtgtctggaact

SEQ ID NO: 569853 - DNA, 25 bp, Homo sapien
gtgtctggaacttgatcttgtagcc

SEQ ID NO: 569854 - DNA, 25 bp, Homo sapien
gtagccagaagagtagtagctgtct

SEQ ID NO: 569855 - DNA, 25 bp, Homo sapien
tagtagctgtctgcagagcttgtat

SEQ ID NO: 569856 - DNA, 25 bp, Homo sapien
ctagtaagtagagccaatgtcacag

SEQ ID NO: 569857 - DNA, 25 bp, Homo sapien
ggcaggaaatttgagttcgcaattc

SEQ ID NO: 569858 - DNA, 25 bp, Homo sapien
aggtaggacctataatcagaaaagt

SEQ ID NO: 569859 - DNA, 25 bp, Homo sapien
gttcccatcaagctccaaatatcag

SEQ ID NO: 569860 - DNA, 25 bp, Homo sapien
atatcaggagctcgacttttcttca

SEQ ID NO: 569861 - DNA, 25 bp, Homo sapien
gacttttcttcatttgctcctgctc

SEQ ID NO: 569862 - DNA, 25 bp, Homo sapien
tgctcccaggatcagtgtcaattct

SEQ ID NO: 569863 - DNA, 25 bp, Homo sapien
cagcttggtactgcctgcaaggaca

SEQ ID NO: 569864 - DNA, 25 bp, Homo sapien
gtactgcctgcaaggacaaactcct

SEQ ID NO: 569865 - DNA, 25 bp, Homo sapien
gatatgctttgatgtactcatgtac

SEQ ID NO: 569866 - DNA, 25 bp, Homo sapien
gtactcatgtactagactgttaagg

SEQ ID NO: 569867 - DNA, 25 bp, Homo sapien
tcagtagcataatcaattttgtcat

SEQ ID NO: 569868 - DNA, 25 bp, Homo sapien
ccctcacagagttgcagcttggttt

SEQ ID NO: 569869 - DNA, 25 bp, Homo sapien
gcagcttggtttagtcattacgtag

SEQ ID NO: 569870 - DNA, 25 bp, Homo sapien
cattacgtagacaagacccctatat

SEQ ID NO: 569871 - DNA, 25 bp, Homo sapien
acaaagacggtgcattctctcggaa

SEQ ID NO: 569872 - DNA, 25 bp, Homo sapien
ggtgcattctctcggaaggtcccgt

SEQ ID NO: 569873 - DNA, 25 bp, Homo sapien
aaggtcccgtgctctgtaatggagt

SEQ ID NO: 569874 - DNA, 25 bp, Homo sapien
catatgcgggcccagccacgctgca

SEQ ID NO: 569875 - DNA, 25 bp, Homo sapien
tccctgggactggaggagacgccgt

SEQ ID NO: 569876 - DNA, 25 bp, Homo sapien
tgcaccccccggagctgcggtaagg

SEQ ID NO: 569877 - DNA, 25 bp, Homo sapien
ggagctgcggtaagggcgaccctgc

SEQ ID NO: 569878 - DNA, 25 bp, Homo sapien
taagggcgaccctgcggacaggccc

SEQ ID NO: 569879 - DNA, 25 bp, Homo sapien
gggcatccaccgagaacaccttcca

SEQ ID NO: 569880 - DNA, 25 bp, Homo sapien
agaacaccttccactgcctagcact

SEQ ID NO: 569881 - DNA, 25 bp, Homo sapien
gaaatccttttccacgtggagagca

SEQ ID NO: 569882 - DNA, 25 bp, Homo sapien
atccttttccacgtggagagcatcc

SEQ ID NO: 569883 - DNA, 25 bp, Homo sapien
tggagagcatccacgcctcgttatt

SEQ ID NO: 569884 - DNA, 25 bp, Homo sapien
gagcatccacgcctcgttattaaag

SEQ ID NO: 569885 - DNA, 25 bp, Homo sapien
tggattccatcaccctgagcggtaa

SEQ ID NO: 569886 - DNA, 25 bp, Homo sapien
tcaccctgagcggtaaaccagatgg

SEQ ID NO: 569887 - DNA, 25 bp, Homo sapien
agatgggcgtcaccccagttctgca

SEQ ID NO: 569888 - DNA, 25 bp, Homo sapien
agttctgcagacacatacacaaccc

SEQ ID NO: 569889 - DNA, 25 bp, Homo sapien
tgcagagccggacccagtggctaca

SEQ ID NO: 569890 - DNA, 25 bp, Homo sapien
agtggctacacccacagcggtctgt

SEQ ID NO: 569891 - DNA, 25 bp, Homo sapien
gcggtctgtggtagagaactctctt

SEQ ID NO: 569892 - DNA, 25 bp, Homo sapien
aaatctcgagagaactggcatgagg

SEQ ID NO: 569893 - DNA, 25 bp, Homo sapien
actggcatgaggagttaggttcatc

SEQ ID NO: 569894 - DNA, 25 bp, Homo sapien
agttaggttcatcacaaatacacac

SEQ ID NO: 569895 - DNA, 25 bp, Homo sapien
tgccgttgcctctctcagaaaaaca

SEQ ID NO: 569896 - DNA, 25 bp, Homo sapien
aaatgactccagtgtgtgcttggat

SEQ ID NO: 569897 - DNA, 25 bp, Homo sapien
aatgactccagtgtgtgcttggatt

SEQ ID NO: 569898 - DNA, 25 bp, Homo sapien
atgactccagtgtgtgcttggattg

SEQ ID NO: 569899 - DNA, 25 bp, Homo sapien
tgactccagtgtgtgcttggattgg

SEQ ID NO: 569900 - DNA, 25 bp, Homo sapien
actccagtgtgtgcttggattggga

SEQ ID NO: 569901 - DNA, 25 bp, Homo sapien
cttggattgggagccctggagcaaa

SEQ ID NO: 569902 - DNA, 25 bp, Homo sapien
ccctggagcaaaggcccagctgagt

SEQ ID NO: 569903 - DNA, 25 bp, Homo sapien
gagcaaaggcccagctgagttttgc

SEQ ID NO: 569904 - DNA, 25 bp, Homo sapien
gcaaaggcccagctgagttttgctg

SEQ ID NO: 569905 - DNA, 25 bp, Homo sapien
gttttgctggaaggggacactccac

SEQ ID NO: 569906 - DNA, 25 bp, Homo sapien
acactccacggccaagagaaggaga

SEQ ID NO: 569907 - DNA, 25 bp, Homo sapien
atttatcatttcttctagtccttag

SEQ ID NO: 569908 - DNA, 25 bp, Homo sapien
tctagtccttagttactgctttctg

SEQ ID NO: 569909 - DNA, 25 bp, Homo sapien
tccttagttactgctttctgtgtct

SEQ ID NO: 569910 - DNA, 25 bp, Homo sapien
ttgtcttccctctaaatatgtttcc

SEQ ID NO: 569911 - DNA, 25 bp, Homo sapien
tccctcttattctcctgtttgcttt

SEQ ID NO: 569912 - DNA, 25 bp, Homo sapien
attctcctgtttgcttttagatgct

SEQ ID NO: 569913 - DNA, 25 bp, Homo sapien
gcttttagatgctttatggtttcca

SEQ ID NO: 569914 - DNA, 25 bp, Homo sapien
tatttttaggactacgattctttct

SEQ ID NO: 569915 - DNA, 25 bp, Homo sapien
ggactacgattctttctaaattaat

SEQ ID NO: 569916 - DNA, 25 bp, Homo sapien
gatatcaatgtgttccagcaccatt

SEQ ID NO: 569917 - DNA, 25 bp, Homo sapien
tgtgggatagactttctgtttctca

SEQ ID NO: 569918 - DNA, 25 bp, Homo sapien
tgtataagcctgatgcagggtcatg

SEQ ID NO: 569919 - DNA, 25 bp, Homo sapien
gcctgatgcagggtcatgaatgaaa

SEQ ID NO: 569920 - DNA, 25 bp, Homo sapien
tcctgcttccaagataccactcctt

SEQ ID NO: 569921 - DNA, 25 bp, Homo sapien
atctccagagatcacccctgatctg

SEQ ID NO: 569922 - DNA, 25 bp, Homo sapien
acccctgatctgactgccatgggaa

SEQ ID NO: 569923 - DNA, 25 bp, Homo sapien
gatctgactgccatgggaatctctg

SEQ ID NO: 569924 - DNA, 25 bp, Homo sapien
tctgactgccatgggaatctctgcc

SEQ ID NO: 569925 - DNA, 25 bp, Homo sapien
atctctgccccctaaatacacaata

SEQ ID NO: 569926 - DNA, 25 bp, Homo sapien
tacacaataggcttgagacccaccc

SEQ ID NO: 569927 - DNA, 25 bp, Homo sapien
acaataggcttgagacccacccatt

SEQ ID NO: 569928 - DNA, 25 bp, Homo sapien
gagacccacccatttttagagtctt

SEQ ID NO: 569929 - DNA, 25 bp, Homo sapien
aaatgactccagtgtgtgcttggat

SEQ ID NO: 569930 - DNA, 25 bp, Homo sapien
atgactccagtgtgtgcttggattg

SEQ ID NO: 569931 - DNA, 25 bp, Homo sapien
actccagtgtgtgcttggattggga

SEQ ID NO: 569932 - DNA, 25 bp, Homo sapien
cttggattgggagccctggagcaaa

SEQ ID NO: 569933 - DNA, 25 bp, Homo sapien
ccctggagcaaaggcccagctgagt

SEQ ID NO: 569934 - DNA, 25 bp, Homo sapien
gcaaaggcccagctgagttttgctg

SEQ ID NO: 569935 - DNA, 25 bp, Homo sapien
gttttgctggaaggggacactccac

SEQ ID NO: 569936 - DNA, 25 bp, Homo sapien
acactccacggccaagagaaggaga

SEQ ID NO: 569937 - DNA, 25 bp, Homo sapien
gccctgctggtgagcctgctgtgcc

SEQ ID NO: 569938 - DNA, 25 bp, Homo sapien
tgctgtgccaggtgaggcacttcca

SEQ ID NO: 569939 - DNA, 25 bp, Homo sapien
gctgcctccaccatattagagtttg

SEQ ID NO: 569940 - DNA, 25 bp, Homo sapien
aaagcagtgagtgagccccactttc

SEQ ID NO: 569941 - DNA, 25 bp, Homo sapien
agcaccttcgttgtttcctgggtag

SEQ ID NO: 569942 - DNA, 25 bp, Homo sapien
tgtttcctgggtagtctgcctgggt

SEQ ID NO: 569943 - DNA, 25 bp, Homo sapien
tgtttctcatctgtggcttctgaaa

SEQ ID NO: 569944 - DNA, 25 bp, Homo sapien
gtggcttctgaaacacttagactct

SEQ ID NO: 569945 - DNA, 25 bp, Homo sapien
gaaacacttagactctggacccagc

SEQ ID NO: 569946 - DNA, 25 bp, Homo sapien
gactctggacccagcaagagtttca

SEQ ID NO: 569947 - DNA, 25 bp, Homo sapien
aagagtttcaggaagtgggttgcta

SEQ ID NO: 569948 - DNA, 25 bp, Homo sapien
ggttgctaggcagttagacaggctt

SEQ ID NO: 569949 - DNA, 25 bp, Homo sapien
gacaggcttgttggtgaacacccgg

SEQ ID NO: 569950 - DNA, 25 bp, Homo sapien
gtgaacacccggtatgtagttccat

SEQ ID NO: 569951 - DNA, 25 bp, Homo sapien
tggtgaaactgaactgctaacgagt

SEQ ID NO: 569952 - DNA, 25 bp, Homo sapien
gtgaaactgaactgctaacgagttg

SEQ ID NO: 569953 - DNA, 25 bp, Homo sapien
gaaactgaactgctaacgagttgct

SEQ ID NO: 569954 - DNA, 25 bp, Homo sapien
aaactgaactgctaacgagttgcta

SEQ ID NO: 569955 - DNA, 25 bp, Homo sapien
aactgaactgctaacgagttgctat

SEQ ID NO: 569956 - DNA, 25 bp, Homo sapien
actgaactgctaacgagttgctatt

SEQ ID NO: 569957 - DNA, 25 bp, Homo sapien
ctgaactgctaacgagttgctattt

SEQ ID NO: 569958 - DNA, 25 bp, Homo sapien
tgaactgctaacgagttgctatttt

SEQ ID NO: 569959 - DNA, 25 bp, Homo sapien
gaactgctaacgagttgctattttt

SEQ ID NO: 569960 - DNA, 25 bp, Homo sapien
aactgctaacgagttgctatttttt

SEQ ID NO: 569961 - DNA, 25 bp, Homo sapien
ctgctaacgagttgctatttttttc

SEQ ID NO: 569962 - DNA, 25 bp, Homo sapien
gtggcagacacgcagaagtgctact

SEQ ID NO: 569963 - DNA, 25 bp, Homo sapien
tggcagacacgcagaagtgctacta

SEQ ID NO: 569964 - DNA, 25 bp, Homo sapien
gcagacacgcagaagtgctactagt

SEQ ID NO: 569965 - DNA, 25 bp, Homo sapien
agacacgcagaagtgctactagtga

SEQ ID NO: 569966 - DNA, 25 bp, Homo sapien
acacgcagaagtgctactagtgaca

SEQ ID NO: 569967 - DNA, 25 bp, Homo sapien
gctactagtgacagggctgccatcg

SEQ ID NO: 569968 - DNA, 25 bp, Homo sapien
ctactagtgacagggctgccatcgc

SEQ ID NO: 569969 - DNA, 25 bp, Homo sapien
tgccatcgctcacctgtacctattt

SEQ ID NO: 569970 - DNA, 25 bp, Homo sapien
atcgctcacctgtacctatttacac

SEQ ID NO: 569971 - DNA, 25 bp, Homo sapien
ctcacctgtacctatttacacccag

SEQ ID NO: 569972 - DNA, 25 bp, Homo sapien
taaagctgggcttctttctcatctc

SEQ ID NO: 569973 - DNA, 25 bp, Homo sapien
atgtctttgcaccaatcccaaaggt

SEQ ID NO: 569974 - DNA, 25 bp, Homo sapien
gtctttgcaccaatcccaaaggtga

SEQ ID NO: 569975 - DNA, 25 bp, Homo sapien
ctttgcaccaatcccaaaggtgatg

SEQ ID NO: 569976 - DNA, 25 bp, Homo sapien
ccaatcccaaaggtgatgtgactct

SEQ ID NO: 569977 - DNA, 25 bp, Homo sapien
tacctggtctctgctcacaggaaga

SEQ ID NO: 569978 - DNA, 25 bp, Homo sapien
ctggtctctgctcacaggaagaatc

SEQ ID NO: 569979 - DNA, 25 bp, Homo sapien
gtctctgctcacaggaagaatcgtg

SEQ ID NO: 569980 - DNA, 25 bp, Homo sapien
tgctcacaggaagaatcgtgacctt

SEQ ID NO: 569981 - DNA, 25 bp, Homo sapien
cacaggaagaatcgtgacctttcac

SEQ ID NO: 569982 - DNA, 25 bp, Homo sapien
ggaagaatcgtgacctttcacagca

SEQ ID NO: 569983 - DNA, 25 bp, Homo sapien
cacagcatatggttgatttttttct

SEQ ID NO: 569984 - DNA, 25 bp, Homo sapien
tgctgagactcgcttgcaggagctt

SEQ ID NO: 569985 - DNA, 25 bp, Homo sapien
tggaaccactgtggccagctggagt

SEQ ID NO: 569986 - DNA, 25 bp, Homo sapien
actgtggccagctggagtctgcaca

SEQ ID NO: 569987 - DNA, 25 bp, Homo sapien
ctggagtctgcacagcccgagtttc

SEQ ID NO: 569988 - DNA, 25 bp, Homo sapien
agtaactccgcccaaatgtgcacac

SEQ ID NO: 569989 - DNA, 25 bp, Homo sapien
aaatgtgcacacgagacctatgagg

SEQ ID NO: 569990 - DNA, 25 bp, Homo sapien
gcacacgagacctatgaggagacat

SEQ ID NO: 569991 - DNA, 25 bp, Homo sapien
gaggagacataactttccagaaccc

SEQ ID NO: 569992 - DNA, 25 bp, Homo sapien
gaaccttccctaatagaaacactgc

SEQ ID NO: 569993 - DNA, 25 bp, Homo sapien
aacactgcattaaagccagcgcggg

SEQ ID NO: 569994 - DNA, 25 bp, Homo sapien
gagacagacgtgaactgcgcccctg

SEQ ID NO: 569995 - DNA, 25 bp, Homo sapien
caaaaaggagctgcctgagttcgag

SEQ ID NO: 569996 - DNA, 25 bp, Homo sapien
tgtccttgccgtgggcagccaggct

SEQ ID NO: 569997 - DNA, 25 bp, Homo sapien
accactgagggcatctatgaggacg

SEQ ID NO: 569998 - DNA, 25 bp, Homo sapien
cactgagggcatctatgaggacgtc

SEQ ID NO: 569999 - DNA, 25 bp, Homo sapien
ctgagggcatctatgaggacgtcat

SEQ ID NO: 570000 - DNA, 25 bp, Homo sapien
gagggcatctatgaggacgtcatcc

SEQ ID NO: 570001 - DNA, 25 bp, Homo sapien
ggcatctatgaggacgtcatccggg

SEQ ID NO: 570002 - DNA, 25 bp, Homo sapien
ttgctgcagaggattgaccaagaat

SEQ ID NO: 570003 - DNA, 25 bp, Homo sapien
gctgcagaggattgaccaagaattg

SEQ ID NO: 570004 - DNA, 25 bp, Homo sapien
gcagaggattgaccaagaattgaaa

SEQ ID NO: 570005 - DNA, 25 bp, Homo sapien
gaattgaaaaagacccttggtgcca

SEQ ID NO: 570006 - DNA, 25 bp, Homo sapien
aaaagtcctacgacacaaggacaca

SEQ ID NO: 570007 - DNA, 25 bp, Homo sapien
caaggacacaaaaatgtacctgaag

SEQ ID NO: 570008 - DNA, 25 bp, Homo sapien
aacaattagaaagtctccaccactt

SEQ ID NO: 570009 - DNA, 25 bp, Homo sapien
tcaaaaatcccgtaagagtgttaag

SEQ ID NO: 570010 - DNA, 25 bp, Homo sapien
gaaaacttgctaatcagagtctatc

SEQ ID NO: 570011 - DNA, 25 bp, Homo sapien
gctaatcagagtctatctatctcag

SEQ ID NO: 570012 - DNA, 25 bp, Homo sapien
ctatctatctcaggacttactcctt

SEQ ID NO: 570013 - DNA, 25 bp, Homo sapien
tatctcaggacttactccttttcct

SEQ ID NO: 570014 - DNA, 25 bp, Homo sapien
caaatacctttgaatcctgctgaaa

SEQ ID NO: 570015 - DNA, 25 bp, Homo sapien
gaatcctgctgaaaagagcatggcc

SEQ ID NO: 570016 - DNA, 25 bp, Homo sapien
gagcatggccacagatagtttcctt

SEQ ID NO: 570017 - DNA, 25 bp, Homo sapien
ttcgggaagaccaagaagcaatgat

SEQ ID NO: 570018 - DNA, 25 bp, Homo sapien
gaccaagaagcaatgatgatgtctg

SEQ ID NO: 570019 - DNA, 25 bp, Homo sapien
agaagcaatgatgatgtctgttttt

SEQ ID NO: 570020 - DNA, 25 bp, Homo sapien
ctaaaactttgttcagaagtctcaa

SEQ ID NO: 570021 - DNA, 25 bp, Homo sapien
tgttcagaagtctcaatattgtagt

SEQ ID NO: 570022 - DNA, 25 bp, Homo sapien
gaagtctcaatattgtagtgtatag

SEQ ID NO: 570023 - DNA, 25 bp, Homo sapien
gtatagagatgtacactaatttagt

SEQ ID NO: 570024 - DNA, 25 bp, Homo sapien
tatgaagatgaagggctttaagcct

SEQ ID NO: 570025 - DNA, 25 bp, Homo sapien
atctcagtacctaggaactccaaag

SEQ ID NO: 570026 - DNA, 25 bp, Homo sapien
tcagtacctaggaactccaaagaac

SEQ ID NO: 570027 - DNA, 25 bp, Homo sapien
aggaactccaaagaacaaactgttg

SEQ ID NO: 570028 - DNA, 25 bp, Homo sapien
aatgagatgtgatatggcttgaaat

SEQ ID NO: 570029 - DNA, 25 bp, Homo sapien
ggaggagacactttctgacagtggg

SEQ ID NO: 570030 - DNA, 25 bp, Homo sapien
aagctgcacttttgaggggcctcat

SEQ ID NO: 570031 - DNA, 25 bp, Homo sapien
ttgaggggcctcatttaccccacct

SEQ ID NO: 570032 - DNA, 25 bp, Homo sapien
cacctctgttaaaaacttgactact

SEQ ID NO: 570033 - DNA, 25 bp, Homo sapien
gttaaaaacttgactactctcctct

SEQ ID NO: 570034 - DNA, 25 bp, Homo sapien
taaaaacttgactactctcctcttt

SEQ ID NO: 570035 - DNA, 25 bp, Homo sapien
actctcctctttaatagaaagtcac

SEQ ID NO: 570036 - DNA, 25 bp, Homo sapien
atagaaagtcaccatcatctgtagt

SEQ ID NO: 570037 - DNA, 25 bp, Homo sapien
agaaagtcaccatcatctgtagtga

SEQ ID NO: 570038 - DNA, 25 bp, Homo sapien
tttaataaagacaggatatcttcca

SEQ ID NO: 570039 - DNA, 25 bp, Homo sapien
atccaggcctggactgtccccagtt

SEQ ID NO: 570040 - DNA, 25 bp, Homo sapien
caggcctggactgtccccagttccg

SEQ ID NO: 570041 - DNA, 25 bp, Homo sapien
tcctttccacccctttctgctcacg

SEQ ID NO: 570042 - DNA, 25 bp, Homo sapien
tttccacccctttctgctcacgacc

SEQ ID NO: 570043 - DNA, 25 bp, Homo sapien
ttctgctcacgacccccatcattca

SEQ ID NO: 570044 - DNA, 25 bp, Homo sapien
ccatcattcacgctcagaacaggat

SEQ ID NO: 570045 - DNA, 25 bp, Homo sapien
catcattcacgctcagaacaggatt

SEQ ID NO: 570046 - DNA, 25 bp, Homo sapien
atcattcacgctcagaacaggattt

SEQ ID NO: 570047 - DNA, 25 bp, Homo sapien
tcattcacgctcagaacaggatttt

SEQ ID NO: 570048 - DNA, 25 bp, Homo sapien
cattcacgctcagaacaggattttg

SEQ ID NO: 570049 - DNA, 25 bp, Homo sapien
agccctgagtgctggacactgcgtt

SEQ ID NO: 570050 - DNA, 25 bp, Homo sapien
gaaagatgagttcatctgccgtgca

SEQ ID NO: 570051 - DNA, 25 bp, Homo sapien
aaagatgagttcatctgccgtgcag

SEQ ID NO: 570052 - DNA, 25 bp, Homo sapien
aagatgagttcatctgccgtgcagt

SEQ ID NO: 570053 - DNA, 25 bp, Homo sapien
agatgagttcatctgccgtgcagtc

SEQ ID NO: 570054 - DNA, 25 bp, Homo sapien
gatgagttcatctgccgtgcagtcc

SEQ ID NO: 570055 - DNA, 25 bp, Homo sapien
tgcagtggctgcacaacgaggtgca

SEQ ID NO: 570056 - DNA, 25 bp, Homo sapien
agtggctgcacaacgaggtgcagct

SEQ ID NO: 570057 - DNA, 25 bp, Homo sapien
tggctgcacaacgaggtgcagctcc

SEQ ID NO: 570058 - DNA, 25 bp, Homo sapien
ggctgcacaacgaggtgcagctccc

SEQ ID NO: 570059 - DNA, 25 bp, Homo sapien
tgcacaacgaggtgcagctcccgga

SEQ ID NO: 570060 - DNA, 25 bp, Homo sapien
gcacaacgaggtgcagctcccggac

SEQ ID NO: 570061 - DNA, 25 bp, Homo sapien
tcaggcctgtctcagagctatggag

SEQ ID NO: 570062 - DNA, 25 bp, Homo sapien
tcagagctatggaggatgcagcaaa

SEQ ID NO: 570063 - DNA, 25 bp, Homo sapien
aagggatgcctttgatctgctgtct

SEQ ID NO: 570064 - DNA, 25 bp, Homo sapien
tgatctgctgtctctggatgcacaa

SEQ ID NO: 570065 - DNA, 25 bp, Homo sapien
gtctctggatgcacaaggagctcag

SEQ ID NO: 570066 - DNA, 25 bp, Homo sapien
ggagctcagagaaacaaccaggaca

SEQ ID NO: 570067 - DNA, 25 bp, Homo sapien
caaagcatggagctctaatttaggg

SEQ ID NO: 570068 - DNA, 25 bp, Homo sapien
gggtttcagctaagcgagtcactca

SEQ ID NO: 570069 - DNA, 25 bp, Homo sapien
agctaagcgagtcactcagcaccag

SEQ ID NO: 570070 - DNA, 25 bp, Homo sapien
gcaccagcactgcacaggagggtat

SEQ ID NO: 570071 - DNA, 25 bp, Homo sapien
cactgcacaggagggtatcagagcc

SEQ ID NO: 570072 - DNA, 25 bp, Homo sapien
taaccttgaggaaaccatggatggg

SEQ ID NO: 570073 - DNA, 25 bp, Homo sapien
gcatgcttttttcttagaggttttt

SEQ ID NO: 570074 - DNA, 25 bp, Homo sapien
ttttcaaaatgtcttctgatcttag

SEQ ID NO: 570075 - DNA, 25 bp, Homo sapien
aaatgtcttctgatcttagagagtt

SEQ ID NO: 570076 - DNA, 25 bp, Homo sapien
gtcttctgatcttagagagttttaa

SEQ ID NO: 570077 - DNA, 25 bp, Homo sapien
ttatccacatatttggacttttctc

SEQ ID NO: 570078 - DNA, 25 bp, Homo sapien
atatttggacttttctctccactct

SEQ ID NO: 570079 - DNA, 25 bp, Homo sapien
atttggacttttctctccactctag

SEQ ID NO: 570080 - DNA, 25 bp, Homo sapien
tggacttttctctccactctaggtc

SEQ ID NO: 570081 - DNA, 25 bp, Homo sapien
tttctctccactctaggtccttatt

SEQ ID NO: 570082 - DNA, 25 bp, Homo sapien
ctaggtccttatttccaaatgtcta

SEQ ID NO: 570083 - DNA, 25 bp, Homo sapien
actgccccaagtggtgctttcagag

SEQ ID NO: 570084 - DNA, 25 bp, Homo sapien
gccccaagtggtgctttcagagaat

SEQ ID NO: 570085 - DNA, 25 bp, Homo sapien
ccacgtgtcccgatctgggattaga

SEQ ID NO: 570086 - DNA, 25 bp, Homo sapien
aatatgggtccattcctttctagaa

SEQ ID NO: 570087 - DNA, 25 bp, Homo sapien
atgggtccattcctttctagaaagg

SEQ ID NO: 570088 - DNA, 25 bp, Homo sapien
acaaccaagtgtctcagtttgcctt

SEQ ID NO: 570089 - DNA, 25 bp, Homo sapien
caagtgtctcagtttgccttgcggg

SEQ ID NO: 570090 - DNA, 25 bp, Homo sapien
ggctcctgggccatgggacttccag

SEQ ID NO: 570091 - DNA, 25 bp, Homo sapien
gtaaccccggactggtggtcaccat

SEQ ID NO: 570092 - DNA, 25 bp, Homo sapien
actggtggtcaccatagtatggttt

SEQ ID NO: 570093 - DNA, 25 bp, Homo sapien
gagcttttaaagagtactggtgaaa

SEQ ID NO: 570094 - DNA, 25 bp, Homo sapien
aatgctgacatttgttccgtcctta

SEQ ID NO: 570095 - DNA, 25 bp, Homo sapien
atttgttccgtccttatagattgag

SEQ ID NO: 570096 - DNA, 25 bp, Homo sapien
gattgaggatagtacggccctgaat

SEQ ID NO: 570097 - DNA, 25 bp, Homo sapien
gccctgaattttgcctttactttag

SEQ ID NO: 570098 - DNA, 25 bp, Homo sapien
ttgcctttactttagaaacctgatt

SEQ ID NO: 570099 - DNA, 25 bp, Homo sapien
gattcaacttaaccgaactctcagg

SEQ ID NO: 570100 - DNA, 25 bp, Homo sapien
ttaaccgaactctcaggaatctgat

SEQ ID NO: 570101 - DNA, 25 bp, Homo sapien
gaatctgattcctaagctgagtatc

SEQ ID NO: 570102 - DNA, 25 bp, Homo sapien
gattcctaagctgagtatcacattt

SEQ ID NO: 570103 - DNA, 25 bp, Homo sapien
gattacttactaatttgtgcatcta

SEQ ID NO: 570104 - DNA, 25 bp, Homo sapien
gtgcatctatccacctagcaaatat

SEQ ID NO: 570105 - DNA, 25 bp, Homo sapien
tggtctttatcattaactttaattc

SEQ ID NO: 570106 - DNA, 25 bp, Homo sapien
tattggccttaccataaaattattt

SEQ ID NO: 570107 - DNA, 25 bp, Homo sapien
ataagttatacctctttggcaatag

SEQ ID NO: 570108 - DNA, 25 bp, Homo sapien
atacctctttggcaatagatagatg

SEQ ID NO: 570109 - DNA, 25 bp, Homo sapien
gtatacatctacctactatgatcta

SEQ ID NO: 570110 - DNA, 25 bp, Homo sapien
tctacctactatgatctacaatttt

SEQ ID NO: 570111 - DNA, 25 bp, Homo sapien
gggctactgacttggttaccttctt

SEQ ID NO: 570112 - DNA, 25 bp, Homo sapien
acttggttaccttcttgtctcttgt

SEQ ID NO: 570113 - DNA, 25 bp, Homo sapien
tcttgtctcttgtcccaaagattta

SEQ ID NO: 570114 - DNA, 25 bp, Homo sapien
gtacctttgtatagctcttctgccc

SEQ ID NO: 570115 - DNA, 25 bp, Homo sapien
tctgccccattttgacttctgagat

SEQ ID NO: 570116 - DNA, 25 bp, Homo sapien
ggagttggagcccactctggggaaa

SEQ ID NO: 570117 - DNA, 25 bp, Homo sapien
gggaaaacatgttgagatcttgcct

SEQ ID NO: 570118 - DNA, 25 bp, Homo sapien
gaaaacatgttgagatcttgcctct

SEQ ID NO: 570119 - DNA, 25 bp, Homo sapien
aaaacatgttgagatcttgcctctg

SEQ ID NO: 570120 - DNA, 25 bp, Homo sapien
catgttgagatcttgcctctgcaaa

SEQ ID NO: 570121 - DNA, 25 bp, Homo sapien
ttgagatcttgcctctgcaaaaata

SEQ ID NO: 570122 - DNA, 25 bp, Homo sapien
taaaatcagctgagcatggtgacat

SEQ ID NO: 570123 - DNA, 25 bp, Homo sapien
actttggaggctaagttgagaggca

SEQ ID NO: 570124 - DNA, 25 bp, Homo sapien
aggatcatttgacggcccagaggtt

SEQ ID NO: 570125 - DNA, 25 bp, Homo sapien
gatcatttgacggcccagaggttga

SEQ ID NO: 570126 - DNA, 25 bp, Homo sapien
catttgacggcccagaggttgaggc

SEQ ID NO: 570127 - DNA, 25 bp, Homo sapien
tggacgatcctctcagtgcagtaga

SEQ ID NO: 570128 - DNA, 25 bp, Homo sapien
atcctctcagtgcagtagatgcgga

SEQ ID NO: 570129 - DNA, 25 bp, Homo sapien
ggaagttagcagacacttgttcgaa

SEQ ID NO: 570130 - DNA, 25 bp, Homo sapien
acttgttcgaactgtgtatttgtca

SEQ ID NO: 570131 - DNA, 25 bp, Homo sapien
gtgactcatcagttgcagtacctca

SEQ ID NO: 570132 - DNA, 25 bp, Homo sapien
gtacctcaaagctgcaagtcagatt

SEQ ID NO: 570133 - DNA, 25 bp, Homo sapien
gggacttacactgagttcctaaaat

SEQ ID NO: 570134 - DNA, 25 bp, Homo sapien
tctggtatagattttggctcccttt

SEQ ID NO: 570135 - DNA, 25 bp, Homo sapien
tatagattttggctcccttttaaag

SEQ ID NO: 570136 - DNA, 25 bp, Homo sapien
agtgaacaacctccagttccaggaa

SEQ ID NO: 570137 - DNA, 25 bp, Homo sapien
ctaaggaatcgtaccttctcagagt

SEQ ID NO: 570138 - DNA, 25 bp, Homo sapien
gaatagctccaatatggtatctaca

SEQ ID NO: 570139 - DNA, 25 bp, Homo sapien
ggtatctacactcctttcacaagac

SEQ ID NO: 570140 - DNA, 25 bp, Homo sapien
atctacactcctttcacaagactga

SEQ ID NO: 570141 - DNA, 25 bp, Homo sapien
actcctttcacaagactgaactttg

SEQ ID NO: 570142 - DNA, 25 bp, Homo sapien
caagactgaactttgtaacatgtta

SEQ ID NO: 570143 - DNA, 25 bp, Homo sapien
aacatgttaaggtacaaagccagag

SEQ ID NO: 570144 - DNA, 25 bp, Homo sapien
aaagccagaggactgtgctattcaa

SEQ ID NO: 570145 - DNA, 25 bp, Homo sapien
aggactgtgctattcaaggactact

SEQ ID NO: 570146 - DNA, 25 bp, Homo sapien
gtgctattcaaggactactgtaagt

SEQ ID NO: 570147 - DNA, 25 bp, Homo sapien
tactgtaagtctattgtttctcaaa

SEQ ID NO: 570148 - DNA, 25 bp, Homo sapien
cattttaagcacatgtaagtggttc

SEQ ID NO: 570149 - DNA, 25 bp, Homo sapien
atgtttgttgttctaaggtgctaaa

SEQ ID NO: 570150 - DNA, 25 bp, Homo sapien
ctaaggtgctaaatgttgggaaaat

SEQ ID NO: 570151 - DNA, 25 bp, Homo sapien
gttatgtggctatgttgttttgcac

SEQ ID NO: 570152 - DNA, 25 bp, Homo sapien
gttgttttgcacatgtgccacataa

SEQ ID NO: 570153 - DNA, 25 bp, Homo sapien
cacacatatgatggtgggcccataa

SEQ ID NO: 570154 - DNA, 25 bp, Homo sapien
gatggtgggcccataagattgtaat

SEQ ID NO: 570155 - DNA, 25 bp, Homo sapien
tgtaatactgtgtttctattatgca

SEQ ID NO: 570156 - DNA, 25 bp, Homo sapien
ttctattatgcattctctatttata

SEQ ID NO: 570157 - DNA, 25 bp, Homo sapien
aattgcctactgtcttcagtactgt

SEQ ID NO: 570158 - DNA, 25 bp, Homo sapien
ctgtcttcagtactgtaacatgctg

SEQ ID NO: 570159 - DNA, 25 bp, Homo sapien
agcccagaagcaatagactatacca

SEQ ID NO: 570160 - DNA, 25 bp, Homo sapien
ggaggccgaagctcgtggactacct

SEQ ID NO: 570161 - DNA, 25 bp, Homo sapien
gaggccgaagctcgtggactacctg

SEQ ID NO: 570162 - DNA, 25 bp, Homo sapien
aggccgaagctcgtggactacctga

SEQ ID NO: 570163 - DNA, 25 bp, Homo sapien
ggccgaagctcgtggactacctgag

SEQ ID NO: 570164 - DNA, 25 bp, Homo sapien
gccgaagctcgtggactacctgagg

SEQ ID NO: 570165 - DNA, 25 bp, Homo sapien
ccgaagctcgtggactacctgaggt

SEQ ID NO: 570166 - DNA, 25 bp, Homo sapien
cgaagctcgtggactacctgaggtc

SEQ ID NO: 570167 - DNA, 25 bp, Homo sapien
gaagctcgtggactacctgaggtca

SEQ ID NO: 570168 - DNA, 25 bp, Homo sapien
aagctcgtggactacctgaggtcag

SEQ ID NO: 570169 - DNA, 25 bp, Homo sapien
agctcgtggactacctgaggtcagg

SEQ ID NO: 570170 - DNA, 25 bp, Homo sapien
gctcgtggactacctgaggtcagga

SEQ ID NO: 570171 - DNA, 25 bp, Homo sapien
ttcagatcatgctatccccagaaat

SEQ ID NO: 570172 - DNA, 25 bp, Homo sapien
aggctgtgctttgatttactggtat

SEQ ID NO: 570173 - DNA, 25 bp, Homo sapien
tgctttgatttactggtatttaccc

SEQ ID NO: 570174 - DNA, 25 bp, Homo sapien
ggctgacttaaagatcccttggaaa

SEQ ID NO: 570175 - DNA, 25 bp, Homo sapien
ggaaagactcaaaactaccttcact

SEQ ID NO: 570176 - DNA, 25 bp, Homo sapien
taccttcactagtaggactcctaag

SEQ ID NO: 570177 - DNA, 25 bp, Homo sapien
tagtaggactcctaagcgctgacct

SEQ ID NO: 570178 - DNA, 25 bp, Homo sapien
ctcctaagcgctgacctatttttaa

SEQ ID NO: 570179 - DNA, 25 bp, Homo sapien
gttatcaaatcatatttcaccgtga

SEQ ID NO: 570180 - DNA, 25 bp, Homo sapien
atttcaccgtgaatattcagtggag

SEQ ID NO: 570181 - DNA, 25 bp, Homo sapien
gaatattcagtggagaacttctcta

SEQ ID NO: 570182 - DNA, 25 bp, Homo sapien
tttgcaaaagtaacatgccatattt

SEQ ID NO: 570183 - DNA, 25 bp, Homo sapien
aaaatgaacatgcttgagtcctggt

SEQ ID NO: 570184 - DNA, 25 bp, Homo sapien
acatgcttgagtcctggttgtggtc

SEQ ID NO: 570185 - DNA, 25 bp, Homo sapien
tcctggttgtggtcagtttatactg

SEQ ID NO: 570186 - DNA, 25 bp, Homo sapien
gaacatcgtttttagctgtctttag

SEQ ID NO: 570187 - DNA, 25 bp, Homo sapien
agatgttttgtcattgctgtgctta

SEQ ID NO: 570188 - DNA, 25 bp, Homo sapien
gtgttggcagtagttttgagcaatt

SEQ ID NO: 570189 - DNA, 25 bp, Homo sapien
atttggtacaatcttcgtccttcca

SEQ ID NO: 570190 - DNA, 25 bp, Homo sapien
ttcgtccttccagtcactgttagaa

SEQ ID NO: 570191 - DNA, 25 bp, Homo sapien
aatgctttattttggtcagtatact

SEQ ID NO: 570192 - DNA, 25 bp, Homo sapien
ttggtcagtatactttcctgtgata

SEQ ID NO: 570193 - DNA, 25 bp, Homo sapien
tctctcctaggtttctatacccagc

SEQ ID NO: 570194 - DNA, 25 bp, Homo sapien
ctctcctaggtttctatacccagca

SEQ ID NO: 570195 - DNA, 25 bp, Homo sapien
tctcctaggtttctatacccagcaa

SEQ ID NO: 570196 - DNA, 25 bp, Homo sapien
caaagatatttttcagacatagaaa

SEQ ID NO: 570197 - DNA, 25 bp, Homo sapien
agtaatatattatcagcaaacctgg

SEQ ID NO: 570198 - DNA, 25 bp, Homo sapien
aatatattatcagcaaacctggact

SEQ ID NO: 570199 - DNA, 25 bp, Homo sapien
atattatcagcaaacctggactatg

SEQ ID NO: 570200 - DNA, 25 bp, Homo sapien
tattatcagcaaacctggactatga

SEQ ID NO: 570201 - DNA, 25 bp, Homo sapien
attatcagcaaacctggactatgag

SEQ ID NO: 570202 - DNA, 25 bp, Homo sapien
tgagaacagtgtaaaagcctttcag

SEQ ID NO: 570203 - DNA, 25 bp, Homo sapien
gagaacagtgtaaaagcctttcagg

SEQ ID NO: 570204 - DNA, 25 bp, Homo sapien
gtacagttttgtgtggacatgcttt

SEQ ID NO: 570205 - DNA, 25 bp, Homo sapien
ttgtgtggacatgcttttctttctc

SEQ ID NO: 570206 - DNA, 25 bp, Homo sapien
tgtgtggacatgcttttctttctct

SEQ ID NO: 570207 - DNA, 25 bp, Homo sapien
tctttctcttgggtaggttcctatg

SEQ ID NO: 570208 - DNA, 25 bp, Homo sapien
ttctcttgggtaggttcctatgagt

SEQ ID NO: 570209 - DNA, 25 bp, Homo sapien
ggttcctatgagtggaatcactaga

SEQ ID NO: 570210 - DNA, 25 bp, Homo sapien
gaatcactagattgtatggtaaatg

SEQ ID NO: 570211 - DNA, 25 bp, Homo sapien
aactgtcaaactgttttctaacatg

SEQ ID NO: 570212 - DNA, 25 bp, Homo sapien
ctgttttctaacatgaacgggccat

SEQ ID NO: 570213 - DNA, 25 bp, Homo sapien
gttttctaacatgaacgggccattt

SEQ ID NO: 570214 - DNA, 25 bp, Homo sapien
tgaacgggccattttacgttcttat

SEQ ID NO: 570215 - DNA, 25 bp, Homo sapien
aacactcggttgacctttacacaca

SEQ ID NO: 570216 - DNA, 25 bp, Homo sapien
tcggttgacctttacacacacacac

SEQ ID NO: 570217 - DNA, 25 bp, Homo sapien
catatactctctctggaagccttga

SEQ ID NO: 570218 - DNA, 25 bp, Homo sapien
atactctctctggaagccttgaaca

SEQ ID NO: 570219 - DNA, 25 bp, Homo sapien
ctctctggaagccttgaacaagtag

SEQ ID NO: 570220 - DNA, 25 bp, Homo sapien
caagtagggcttgtgtttggattca

SEQ ID NO: 570221 - DNA, 25 bp, Homo sapien
gtgtttggattcagttttaccttag

SEQ ID NO: 570222 - DNA, 25 bp, Homo sapien
tttaccttagtcatgcctctttcca

SEQ ID NO: 570223 - DNA, 25 bp, Homo sapien
gtcatgcctctttccagatacaaga

SEQ ID NO: 570224 - DNA, 25 bp, Homo sapien
aaacatttaattccagatttcctgc

SEQ ID NO: 570225 - DNA, 25 bp, Homo sapien
taattccagatttcctgcttctggc

SEQ ID NO: 570226 - DNA, 25 bp, Homo sapien
ataaatctagacactatagggtaca

SEQ ID NO: 570227 - DNA, 25 bp, Homo sapien
gacactatagggtacattctgaagt

SEQ ID NO: 570228 - DNA, 25 bp, Homo sapien
agggtacattctgaagtcctagaac

SEQ ID NO: 570229 - DNA, 25 bp, Homo sapien
gtacattctgaagtcctagaacaag

SEQ ID NO: 570230 - DNA, 25 bp, Homo sapien
tctgaagtcctagaacaagcgaaac

SEQ ID NO: 570231 - DNA, 25 bp, Homo sapien
gtcctagaacaagcgaaactaagat

SEQ ID NO: 570232 - DNA, 25 bp, Homo sapien
acaagcgaaactaagatatagcagt

SEQ ID NO: 570233 - DNA, 25 bp, Homo sapien
gaaattgtatcagtagttacctggg

SEQ ID NO: 570234 - DNA, 25 bp, Homo sapien
gtatcagtagttacctgggttgagg

SEQ ID NO: 570235 - DNA, 25 bp, Homo sapien
atgggagttgactgcagagaaacac

SEQ ID NO: 570236 - DNA, 25 bp, Homo sapien
gttgactgcagagaaacacaaggga

SEQ ID NO: 570237 - DNA, 25 bp, Homo sapien
gagtggagcctcatctacgagccag

SEQ ID NO: 570238 - DNA, 25 bp, Homo sapien
tacgagccagcccacgtgaaggaga

SEQ ID NO: 570239 - DNA, 25 bp, Homo sapien
cgtgaaggagaactggatcgacccc

SEQ ID NO: 570240 - DNA, 25 bp, Homo sapien
gaactggatcgaccccctgatgagg

SEQ ID NO: 570241 - DNA, 25 bp, Homo sapien
gacagtcaagaggtacaaccgccga

SEQ ID NO: 570242 - DNA, 25 bp, Homo sapien
acaaccgccgaaaggccgaggagct

SEQ ID NO: 570243 - DNA, 25 bp, Homo sapien
tgctgagggcaaacatcgaggaact

SEQ ID NO: 570244 - DNA, 25 bp, Homo sapien
acatcgaggaactgcgctgcgccat

SEQ ID NO: 570245 - DNA, 25 bp, Homo sapien
tcatcgaggtgccatcttctcaagc

SEQ ID NO: 570246 - DNA, 25 bp, Homo sapien
tgccatcttctcaagccatcagaaa

SEQ ID NO: 570247 - DNA, 25 bp, Homo sapien
aagccatcagaaagttcctcccaac

SEQ ID NO: 570248 - DNA, 25 bp, Homo sapien
tgcctggctgtgtaatcttatgggt

SEQ ID NO: 570249 - DNA, 25 bp, Homo sapien
aatcttatgggtgaatagcgactga

SEQ ID NO: 570250 - DNA, 25 bp, Homo sapien
gggtgaatagcgactgatatgaaca

SEQ ID NO: 570251 - DNA, 25 bp, Homo sapien
tttgtaagccaaacttgcaactttg

SEQ ID NO: 570252 - DNA, 25 bp, Homo sapien
tggaaaacactgaaatccccaaaga

SEQ ID NO: 570253 - DNA, 25 bp, Homo sapien
tgtagcttttactaggaatttacct

SEQ ID NO: 570254 - DNA, 25 bp, Homo sapien
atttaccttattaacatcctacctg

SEQ ID NO: 570255 - DNA, 25 bp, Homo sapien
aacatcctacctggcacatgataag

SEQ ID NO: 570256 - DNA, 25 bp, Homo sapien
tacctggcacatgataagtgcccaa

SEQ ID NO: 570257 - DNA, 25 bp, Homo sapien
aagtgcccaatgaatgataaccaaa

SEQ ID NO: 570258 - DNA, 25 bp, Homo sapien
agtgtggttactggctctattttac

SEQ ID NO: 570259 - DNA, 25 bp, Homo sapien
cccaggctggaagtgtctatgttta

SEQ ID NO: 570260 - DNA, 25 bp, Homo sapien
gtgtctatgtttaactgcatcttat

SEQ ID NO: 570261 - DNA, 25 bp, Homo sapien
agcaacaagttttctactgggaatt

SEQ ID NO: 570262 - DNA, 25 bp, Homo sapien
tagaatggtgcatacacaatgtatt

SEQ ID NO: 570263 - DNA, 25 bp, Homo sapien
tcagatgagcatgcttgaatgtagc

SEQ ID NO: 570264 - DNA, 25 bp, Homo sapien
gcttgaatgtagcatgactgcctct

SEQ ID NO: 570265 - DNA, 25 bp, Homo sapien
atgtagcatgactgcctctttttgc

SEQ ID NO: 570266 - DNA, 25 bp, Homo sapien
ttttttgcttgttactcatctgttg

SEQ ID NO: 570267 - DNA, 25 bp, Homo sapien
gcttgttactcatctgttgacctac

SEQ ID NO: 570268 - DNA, 25 bp, Homo sapien
ttactcatctgttgacctacctggg

SEQ ID NO: 570269 - DNA, 25 bp, Homo sapien
gggaagtagcacccttgcatttcaa

SEQ ID NO: 570270 - DNA, 25 bp, Homo sapien
taacctaaatccacaatgcccatta

SEQ ID NO: 570271 - DNA, 25 bp, Homo sapien
atgcccattacagtgtactcagggt

SEQ ID NO: 570272 - DNA, 25 bp, Homo sapien
gtactcagggtgtaattccatttca

SEQ ID NO: 570273 - DNA, 25 bp, Homo sapien
gtattacagagtatcccactttcct

SEQ ID NO: 570274 - DNA, 25 bp, Homo sapien
tatcccactttcctttgatcagaga

SEQ ID NO: 570275 - DNA, 25 bp, Homo sapien
aggaagcagtttgcaatccttgtgt

SEQ ID NO: 570276 - DNA, 25 bp, Homo sapien
actccaaagcagtgatgtctcctga

SEQ ID NO: 570277 - DNA, 25 bp, Homo sapien
gaaagccccggccatttctggttgg

SEQ ID NO: 570278 - DNA, 25 bp, Homo sapien
ccatttctggttggcagtactgcct

SEQ ID NO: 570279 - DNA, 25 bp, Homo sapien
ggcagtactgcctgctgcatacctt

SEQ ID NO: 570280 - DNA, 25 bp, Homo sapien
tgcataccttccagaggtgccattc

SEQ ID NO: 570281 - DNA, 25 bp, Homo sapien
tgctgtcggcgctgctcagcgtagc

SEQ ID NO: 570282 - DNA, 25 bp, Homo sapien
tgtcggcgctgctcagcgtagccga

SEQ ID NO: 570283 - DNA, 25 bp, Homo sapien
tcagcgtagccgagctgggccacct

SEQ ID NO: 570284 - DNA, 25 bp, Homo sapien
acctgctctggaagggccgcccgcg

SEQ ID NO: 570285 - DNA, 25 bp, Homo sapien
ggagcgtgacaaccgctgcaaccgt

SEQ ID NO: 570286 - DNA, 25 bp, Homo sapien
gcgtgacaaccgctgcaaccgtgca

SEQ ID NO: 570287 - DNA, 25 bp, Homo sapien
cgctgcaaccgtgcacacgaagagg

SEQ ID NO: 570288 - DNA, 25 bp, Homo sapien
aaccgtgcacacgaagaggcgcaga

SEQ ID NO: 570289 - DNA, 25 bp, Homo sapien
gaagaggcgcagaagctgctcccgc

SEQ ID NO: 570290 - DNA, 25 bp, Homo sapien
agcggccgcggcaaggcgtcaccgg

SEQ ID NO: 570291 - DNA, 25 bp, Homo sapien
cggccgccgagatctggccatctag

SEQ ID NO: 570292 - DNA, 25 bp, Homo sapien
agagaattgattcagccatctgcgc

SEQ ID NO: 570293 - DNA, 25 bp, Homo sapien
gagaattgattcagccatctgcgcc

SEQ ID NO: 570294 - DNA, 25 bp, Homo sapien
agaattgattcagccatctgcgccc

SEQ ID NO: 570295 - DNA, 25 bp, Homo sapien
gaattgattcagccatctgcgccca

SEQ ID NO: 570296 - DNA, 25 bp, Homo sapien
aattgattcagccatctgcgcccag

SEQ ID NO: 570297 - DNA, 25 bp, Homo sapien
attgattcagccatctgcgcccagg

SEQ ID NO: 570298 - DNA, 25 bp, Homo sapien
catctgcgcccaggccacgtgtccc

SEQ ID NO: 570299 - DNA, 25 bp, Homo sapien
atctgcgcccaggccacgtgtcccg

SEQ ID NO: 570300 - DNA, 25 bp, Homo sapien
tctgcgcccaggccacgtgtcccga

SEQ ID NO: 570301 - DNA, 25 bp, Homo sapien
tttctcatctcctgtttcagatgct

SEQ ID NO: 570302 - DNA, 25 bp, Homo sapien
aagggctttcactatatctacttga

SEQ ID NO: 570303 - DNA, 25 bp, Homo sapien
tatatctacttgatgatgagccaga

SEQ ID NO: 570304 - DNA, 25 bp, Homo sapien
gggaaagccaaatcatttcggaata

SEQ ID NO: 570305 - DNA, 25 bp, Homo sapien
tttcggaatagagttttgccagtta

SEQ ID NO: 570306 - DNA, 25 bp, Homo sapien
gccagttaaacaagatcactccctt

SEQ ID NO: 570307 - DNA, 25 bp, Homo sapien
aacaagatcactcccttgatggacc

SEQ ID NO: 570308 - DNA, 25 bp, Homo sapien
ttgatggaccccttacaaatggtga

SEQ ID NO: 570309 - DNA, 25 bp, Homo sapien
tacaaatggtgatggcagagagccc

SEQ ID NO: 570310 - DNA, 25 bp, Homo sapien
gagccccggacaggaatcaagagaa

SEQ ID NO: 570311 - DNA, 25 bp, Homo sapien
gaaaactacttagtgcatcagaaga

SEQ ID NO: 570312 - DNA, 25 bp, Homo sapien
ttttatctaccctcaggtttagtct

SEQ ID NO: 570313 - DNA, 25 bp, Homo sapien
tctaccctcaggtttagtctttggg

SEQ ID NO: 570314 - DNA, 25 bp, Homo sapien
gggacctgtgaattaaacagacgaa

SEQ ID NO: 570315 - DNA, 25 bp, Homo sapien
ggacctgtgaattaaacagacgaaa

SEQ ID NO: 570316 - DNA, 25 bp, Homo sapien
aagatatattaacaagagaaggcca

SEQ ID NO: 570317 - DNA, 25 bp, Homo sapien
tattaacaagagaaggccaagcgtg

SEQ ID NO: 570318 - DNA, 25 bp, Homo sapien
tcgaggctgccgtgggctagcatca

SEQ ID NO: 570319 - DNA, 25 bp, Homo sapien
cgaggctgccgtgggctagcatcat

SEQ ID NO: 570320 - DNA, 25 bp, Homo sapien
gctgccgtgggctagcatcatgcca

SEQ ID NO: 570321 - DNA, 25 bp, Homo sapien
tgccgtgggctagcatcatgccact

SEQ ID NO: 570322 - DNA, 25 bp, Homo sapien
cgtgggctagcatcatgccactgca

SEQ ID NO: 570323 - DNA, 25 bp, Homo sapien
cctcttagatgatagactgaacctg

SEQ ID NO: 570324 - DNA, 25 bp, Homo sapien
gatgatagactgaacctgatgactt

SEQ ID NO: 570325 - DNA, 25 bp, Homo sapien
gatagactgaacctgatgactttga

SEQ ID NO: 570326 - DNA, 25 bp, Homo sapien
tagactgaacctgatgactttgagc

SEQ ID NO: 570327 - DNA, 25 bp, Homo sapien
tttcactaactctgcatgcctctat

SEQ ID NO: 570328 - DNA, 25 bp, Homo sapien
aattatactaacaatacacatgaga

SEQ ID NO: 570329 - DNA, 25 bp, Homo sapien
aaagcatagctgttaaactgacttg

SEQ ID NO: 570330 - DNA, 25 bp, Homo sapien
gcatagctgttaaactgacttgatt

SEQ ID NO: 570331 - DNA, 25 bp, Homo sapien
tttctatatcacaaaaatggcaaca

SEQ ID NO: 570332 - DNA, 25 bp, Homo sapien
aaatggcaacatcttttacataaag

SEQ ID NO: 570333 - DNA, 25 bp, Homo sapien
tggcaacatcttttacataaagaaa

SEQ ID NO: 570334 - DNA, 25 bp, Homo sapien
gaggagacggttgctaaatgtagtt

SEQ ID NO: 570335 - DNA, 25 bp, Homo sapien
ggagacggttgctaaatgtagttct

SEQ ID NO: 570336 - DNA, 25 bp, Homo sapien
gagacggttgctaaatgtagttcta

SEQ ID NO: 570337 - DNA, 25 bp, Homo sapien
gacggttgctaaatgtagttctatc

SEQ ID NO: 570338 - DNA, 25 bp, Homo sapien
acggttgctaaatgtagttctatct

SEQ ID NO: 570339 - DNA, 25 bp, Homo sapien
ggttgctaaatgtagttctatctgg

SEQ ID NO: 570340 - DNA, 25 bp, Homo sapien
gttgctaaatgtagttctatctggg

SEQ ID NO: 570341 - DNA, 25 bp, Homo sapien
aatgtagttctatctggggactcga

SEQ ID NO: 570342 - DNA, 25 bp, Homo sapien
gtagttctatctggggactcgagtg

SEQ ID NO: 570343 - DNA, 25 bp, Homo sapien
gactcgagtggggcacaatttttaa

SEQ ID NO: 570344 - DNA, 25 bp, Homo sapien
gatcacagttaatgtgagtcctgct

SEQ ID NO: 570345 - DNA, 25 bp, Homo sapien
tgctgtggacactgccggcccgagt

SEQ ID NO: 570346 - DNA, 25 bp, Homo sapien
gcccgagtcatcagtgccagaagag

SEQ ID NO: 570347 - DNA, 25 bp, Homo sapien
gaagaggacttctatgtgtccccag

SEQ ID NO: 570348 - DNA, 25 bp, Homo sapien
acttctatgtgtccccagaggatct

SEQ ID NO: 570349 - DNA, 25 bp, Homo sapien
ggagcagatcaagtctgacatggaa

SEQ ID NO: 570350 - DNA, 25 bp, Homo sapien
agtttttctccagcctacaaatgca

SEQ ID NO: 570351 - DNA, 25 bp, Homo sapien
ggatctcgaagttattgcacagact

SEQ ID NO: 570352 - DNA, 25 bp, Homo sapien
agactcttgatattgagccctcaga

SEQ ID NO: 570353 - DNA, 25 bp, Homo sapien
tattgagccctcagagagtccacag

SEQ ID NO: 570354 - DNA, 25 bp, Homo sapien
tcagttcagtcttgtctccagatgg

SEQ ID NO: 570355 - DNA, 25 bp, Homo sapien
agtcttgtctccagatggtcgtagg

SEQ ID NO: 570356 - DNA, 25 bp, Homo sapien
ctgacttccagaaaatggtggtgcc

SEQ ID NO: 570357 - DNA, 25 bp, Homo sapien
acttccagaaaatggtggtgccgat

SEQ ID NO: 570358 - DNA, 25 bp, Homo sapien
gtggtgccgatattgaacaacagtt

SEQ ID NO: 570359 - DNA, 25 bp, Homo sapien
atttacatttacagtttagtctttg

SEQ ID NO: 570360 - DNA, 25 bp, Homo sapien
tacagtttagtctttgaacaacagt

SEQ ID NO: 570361 - DNA, 25 bp, Homo sapien
gtttagtctttgaacaacagtttgg

SEQ ID NO: 570362 - DNA, 25 bp, Homo sapien
gtctttgaacaacagtttggagaaa

SEQ ID NO: 570363 - DNA, 25 bp, Homo sapien
agcacctagactccatataagagta

SEQ ID NO: 570364 - DNA, 25 bp, Homo sapien
taagagtacttgtcctatgttattt

SEQ ID NO: 570365 - DNA, 25 bp, Homo sapien
gagtacttgtcctatgttattttca

SEQ ID NO: 570366 - DNA, 25 bp, Homo sapien
acttgtcctatgttattttcataaa

SEQ ID NO: 570367 - DNA, 25 bp, Homo sapien
tgggagacaccttgagaactcttcc

SEQ ID NO: 570368 - DNA, 25 bp, Homo sapien
tgcacttaaccaagctcctggtggt

SEQ ID NO: 570369 - DNA, 25 bp, Homo sapien
tcctggtggttctgtgatcccttac

SEQ ID NO: 570370 - DNA, 25 bp, Homo sapien
gttctgtgatcccttacattttctc

SEQ ID NO: 570371 - DNA, 25 bp, Homo sapien
aggcagagagttggctgactgactt

SEQ ID NO: 570372 - DNA, 25 bp, Homo sapien
ccagcatgctggtatattatgttcc

SEQ ID NO: 570373 - DNA, 25 bp, Homo sapien
ggtatattatgttccctcagatggg

SEQ ID NO: 570374 - DNA, 25 bp, Homo sapien
gggctgtaaaatgatctgtttctgt

SEQ ID NO: 570375 - DNA, 25 bp, Homo sapien
atctgtttctgtgaggagactttcc

SEQ ID NO: 570376 - DNA, 25 bp, Homo sapien
gagactttccatggtgagattgcta

SEQ ID NO: 570377 - DNA, 25 bp, Homo sapien
agattgctagtgtctcagagaataa

SEQ ID NO: 570378 - DNA, 25 bp, Homo sapien
ctgtcccatagagcccattgtaaag

SEQ ID NO: 570379 - DNA, 25 bp, Homo sapien
gtaaaggacactcattgttgccaag

SEQ ID NO: 570380 - DNA, 25 bp, Homo sapien
tgttgccaagagtttgtgccaatgc

SEQ ID NO: 570381 - DNA, 25 bp, Homo sapien
gtgccaatgcagtatgactcaccct

SEQ ID NO: 570382 - DNA, 25 bp, Homo sapien
tatgactcacccttcactcattgaa

SEQ ID NO: 570383 - DNA, 25 bp, Homo sapien
tcactcattgaacaagctcttcctg

SEQ ID NO: 570384 - DNA, 25 bp, Homo sapien
gctcttcctgattacctagatgggc

SEQ ID NO: 570385 - DNA, 25 bp, Homo sapien
gatgggcaaaatttccctgctcatg

SEQ ID NO: 570386 - DNA, 25 bp, Homo sapien
tcatgcgaagcaggctggcgactca

SEQ ID NO: 570387 - DNA, 25 bp, Homo sapien
agcagatagccgttctgacacttct

SEQ ID NO: 570388 - DNA, 25 bp, Homo sapien
tgacacttctcttctagacagaaaa

SEQ ID NO: 570389 - DNA, 25 bp, Homo sapien
aagtagctagcatttggttttgggt

SEQ ID NO: 570390 - DNA, 25 bp, Homo sapien
ggttttgggtaccacagtgtgtcta

SEQ ID NO: 570391 - DNA, 25 bp, Homo sapien
ccacagtgtgtctaatatagtcttt

SEQ ID NO: 570392 - DNA, 25 bp, Homo sapien
ttttttatcattcaccatttctggt

SEQ ID NO: 570393 - DNA, 25 bp, Homo sapien
atcattcaccatttctggttgagta

SEQ ID NO: 570394 - DNA, 25 bp, Homo sapien
gtgactcacagttgtagtcctacct

SEQ ID NO: 570395 - DNA, 25 bp, Homo sapien
acagttgtagtcctacctattcagg

SEQ ID NO: 570396 - DNA, 25 bp, Homo sapien
cagccgaggaaggagttcaagtcca

SEQ ID NO: 570397 - DNA, 25 bp, Homo sapien
gtccagcctggacggtctctaaaaa

SEQ ID NO: 570398 - DNA, 25 bp, Homo sapien
aaaattctgaacatgcaaccccaat

SEQ ID NO: 570399 - DNA, 25 bp, Homo sapien
tctgaacatgcaaccccaatatgta

SEQ ID NO: 570400 - DNA, 25 bp, Homo sapien
acttgcctttgcactgcattgtgag

SEQ ID NO: 570401 - DNA, 25 bp, Homo sapien
gcattgtgagattcagctatgttga

SEQ ID NO: 570402 - DNA, 25 bp, Homo sapien
gattcagctatgttgatctgtttaa

SEQ ID NO: 570403 - DNA, 25 bp, Homo sapien
tgtttaactccagctgatgtatgta

SEQ ID NO: 570404 - DNA, 25 bp, Homo sapien
gatgtatgtaatgatccctgatgat

SEQ ID NO: 570405 - DNA, 25 bp, Homo sapien
gatccctgatgattattctgtcgtt

SEQ ID NO: 570406 - DNA, 25 bp, Homo sapien
ctgatgattattctgtcgtttgact

SEQ ID NO: 570407 - DNA, 25 bp, Homo sapien
tattctgtcgtttgactataccaaa

SEQ ID NO: 570408 - DNA, 25 bp, Homo sapien
ttcaggtctctgataatgagcattt

SEQ ID NO: 570409 - DNA, 25 bp, Homo sapien
gagcatttagattggtttgttttcc

SEQ ID NO: 570410 - DNA, 25 bp, Homo sapien
gttttccatttatgaatttagcaat

SEQ ID NO: 570411 - DNA, 25 bp, Homo sapien
gttcaggtgccaaagtggcccagaa

SEQ ID NO: 570412 - DNA, 25 bp, Homo sapien
gtggcccagaacttattaatggttt

SEQ ID NO: 570413 - DNA, 25 bp, Homo sapien
aagtcaattaacgtcaataagcctg

SEQ ID NO: 570414 - DNA, 25 bp, Homo sapien
aataagcctgagttttcttatctgt

SEQ ID NO: 570415 - DNA, 25 bp, Homo sapien
aaaacattgataacagagtgctgtg

SEQ ID NO: 570416 - DNA, 25 bp, Homo sapien
aacatatagtctagtgtaagcactg

SEQ ID NO: 570417 - DNA, 25 bp, Homo sapien
gataatttcacaaaagtttagcaat

SEQ ID NO: 570418 - DNA, 25 bp, Homo sapien
ggtcaacttagatgtttagtcctat

SEQ ID NO: 570419 - DNA, 25 bp, Homo sapien
agatgtttagtcctatttggttatt

SEQ ID NO: 570420 - DNA, 25 bp, Homo sapien
ttgttttcccttttatatgcagttg

SEQ ID NO: 570421 - DNA, 25 bp, Homo sapien
ttatatgcagttgtgtctgcttcct

SEQ ID NO: 570422 - DNA, 25 bp, Homo sapien
gaagtttgaggattggtctgtgtaa

SEQ ID NO: 570423 - DNA, 25 bp, Homo sapien
ggcagaagtgatgttaagtcgctta

SEQ ID NO: 570424 - DNA, 25 bp, Homo sapien
aagtcgcttatgagattagggtata

SEQ ID NO: 570425 - DNA, 25 bp, Homo sapien
aaggcttccatgcttccatcttggt

SEQ ID NO: 570426 - DNA, 25 bp, Homo sapien
ttccatcttggtctctgtctctcag

SEQ ID NO: 570427 - DNA, 25 bp, Homo sapien
cttgaaagtaaatcttccagcccca

SEQ ID NO: 570428 - DNA, 25 bp, Homo sapien
agccccagtccagtattcaaatgat

SEQ ID NO: 570429 - DNA, 25 bp, Homo sapien
gatccagcaacattgcaacttatga

SEQ ID NO: 570430 - DNA, 25 bp, Homo sapien
gagaccttgagccatccaggtaaca

SEQ ID NO: 570431 - DNA, 25 bp, Homo sapien
ggtaacatgcttccaaatcctgacc

SEQ ID NO: 570432 - DNA, 25 bp, Homo sapien
tccaaatcctgacccttaaaacctg

SEQ ID NO: 570433 - DNA, 25 bp, Homo sapien
ttatccttggttcatcccaactgct

SEQ ID NO: 570434 - DNA, 25 bp, Homo sapien
ctgatccccgtgtctgcttttctga

SEQ ID NO: 570435 - DNA, 25 bp, Homo sapien
tgtctgcttttctgagcacactctt

SEQ ID NO: 570436 - DNA, 25 bp, Homo sapien
atgtcctgcccgttcctactggttc

SEQ ID NO: 570437 - DNA, 25 bp, Homo sapien
ggttccctctgccttgcttaaaatg

SEQ ID NO: 570438 - DNA, 25 bp, Homo sapien
gtttttcaaagcctagctgaagctt

SEQ ID NO: 570439 - DNA, 25 bp, Homo sapien
tttcaaagcctagctgaagctttct

SEQ ID NO: 570440 - DNA, 25 bp, Homo sapien
agctttcttccaatttctttggtct

SEQ ID NO: 570441 - DNA, 25 bp, Homo sapien
tttggtcttctctaaacctctattg

SEQ ID NO: 570442 - DNA, 25 bp, Homo sapien
gtcttctctaaacctctattgtatg

SEQ ID NO: 570443 - DNA, 25 bp, Homo sapien
gtttaaacaacaccatctaagagat

SEQ ID NO: 570444 - DNA, 25 bp, Homo sapien
gcatataatctatctcagtgaacac

SEQ ID NO: 570445 - DNA, 25 bp, Homo sapien
gtatattctgcagttattcagtgta

SEQ ID NO: 570446 - DNA, 25 bp, Homo sapien
gcagttattcagtgtagtgttctat

SEQ ID NO: 570447 - DNA, 25 bp, Homo sapien
aaaatcatttaggtcaaggtggttg

SEQ ID NO: 570448 - DNA, 25 bp, Homo sapien
caaggtggttgatagtttgttcaaa

SEQ ID NO: 570449 - DNA, 25 bp, Homo sapien
ttgttcaaatccatctacgtcttca

SEQ ID NO: 570450 - DNA, 25 bp, Homo sapien
atccatctacgtcttcattaatttt

SEQ ID NO: 570451 - DNA, 25 bp, Homo sapien
tatttatctggctctatcaattgct

SEQ ID NO: 570452 - DNA, 25 bp, Homo sapien
atctggctctatcaattgctaaaag

SEQ ID NO: 570453 - DNA, 25 bp, Homo sapien
tctccctttgattaatgaatgttgt

SEQ ID NO: 570454 - DNA, 25 bp, Homo sapien
gaattttgaagctattcagagacaa

SEQ ID NO: 570455 - DNA, 25 bp, Homo sapien
ggagttggagcccactctggggaaa

SEQ ID NO: 570456 - DNA, 25 bp, Homo sapien
gggaaaacatgttgagatcttgcct

SEQ ID NO: 570457 - DNA, 25 bp, Homo sapien
ggaaaacatgttgagatcttgcctc

SEQ ID NO: 570458 - DNA, 25 bp, Homo sapien
gaaaacatgttgagatcttgcctct

SEQ ID NO: 570459 - DNA, 25 bp, Homo sapien
aaaacatgttgagatcttgcctctg

SEQ ID NO: 570460 - DNA, 25 bp, Homo sapien
taaaatcagctgagcatggtgacat

SEQ ID NO: 570461 - DNA, 25 bp, Homo sapien
actttggaggctaagttgagaggca

SEQ ID NO: 570462 - DNA, 25 bp, Homo sapien
ggatcatttgacggcccagaggttg

SEQ ID NO: 570463 - DNA, 25 bp, Homo sapien
gatcatttgacggcccagaggttga

SEQ ID NO: 570464 - DNA, 25 bp, Homo sapien
atcatttgacggcccagaggttgag

SEQ ID NO: 570465 - DNA, 25 bp, Homo sapien
catttgacggcccagaggttgaggc

SEQ ID NO: 570466 - DNA, 25 bp, Homo sapien
aacggcgagcccagcggtgagggca

SEQ ID NO: 570467 - DNA, 25 bp, Homo sapien
tgagggcagccggtcagtcactccg

SEQ ID NO: 570468 - DNA, 25 bp, Homo sapien
agccggtcagtcactccgtccgagg

SEQ ID NO: 570469 - DNA, 25 bp, Homo sapien
tcagtcactccgtccgagggcgcgg

SEQ ID NO: 570470 - DNA, 25 bp, Homo sapien
agccaccgagcgcatggccatcgag

SEQ ID NO: 570471 - DNA, 25 bp, Homo sapien
gaggtggcgctttaccagggctacc

SEQ ID NO: 570472 - DNA, 25 bp, Homo sapien
ggtggcgctttaccagggctaccac

SEQ ID NO: 570473 - DNA, 25 bp, Homo sapien
accagggctaccacagctatgctgt

SEQ ID NO: 570474 - DNA, 25 bp, Homo sapien
ggctaccacagctatgctgtgcgca

SEQ ID NO: 570475 - DNA, 25 bp, Homo sapien
tttgaggaccagcccgagcccgagg

SEQ ID NO: 570476 - DNA, 25 bp, Homo sapien
gagcccgaggtctccgggtccgagt

SEQ ID NO: 570477 - DNA, 25 bp, Homo sapien
aatgttggcttgttatgttacctgc

SEQ ID NO: 570478 - DNA, 25 bp, Homo sapien
ccgtagactttgacgagtttgtgat

SEQ ID NO: 570479 - DNA, 25 bp, Homo sapien
gacgagtttgtgatgatgctctccc

SEQ ID NO: 570480 - DNA, 25 bp, Homo sapien
agtttgtgatgatgctctcccgcca

SEQ ID NO: 570481 - DNA, 25 bp, Homo sapien
tgatgatgctctcccgccactgagg

SEQ ID NO: 570482 - DNA, 25 bp, Homo sapien
cgccactgaggctccaggagggaat

SEQ ID NO: 570483 - DNA, 25 bp, Homo sapien
gaggctccaggagggaatatctgtt

SEQ ID NO: 570484 - DNA, 25 bp, Homo sapien
ggagggaatatctgttgcccctgcg

SEQ ID NO: 570485 - DNA, 25 bp, Homo sapien
gggaatatctgttgcccctgcggcc

SEQ ID NO: 570486 - DNA, 25 bp, Homo sapien
agcctccaggatggagatggagacc

SEQ ID NO: 570487 - DNA, 25 bp, Homo sapien
ccagactacttctatccctgaaaac

SEQ ID NO: 570488 - DNA, 25 bp, Homo sapien
tttttcatccagtgactaccaaatg

SEQ ID NO: 570489 - DNA, 25 bp, Homo sapien
ctaccaaatggaggaattatcgtct

SEQ ID NO: 570490 - DNA, 25 bp, Homo sapien
atggaggaattatcgtcttgaaggg

SEQ ID NO: 570491 - DNA, 25 bp, Homo sapien
gggaacgtatcaatcacttaaggaa

SEQ ID NO: 570492 - DNA, 25 bp, Homo sapien
acttaaggaaactagatgggagact

SEQ ID NO: 570493 - DNA, 25 bp, Homo sapien
tggcaaaaggagaggcatagcaaat

SEQ ID NO: 570494 - DNA, 25 bp, Homo sapien
gaagaaggtgtcctagagtcactct

SEQ ID NO: 570495 - DNA, 25 bp, Homo sapien
gaaggtgtcctagagtcactcttaa

SEQ ID NO: 570496 - DNA, 25 bp, Homo sapien
gtgtcctagagtcactcttaaactt

SEQ ID NO: 570497 - DNA, 25 bp, Homo sapien
gaagtttgagatattaggttggtgc

SEQ ID NO: 570498 - DNA, 25 bp, Homo sapien
ttaccattacttttaagagcacaag

SEQ ID NO: 570499 - DNA, 25 bp, Homo sapien
tgcacatgctctcttcccttgcact

SEQ ID NO: 570500 - DNA, 25 bp, Homo sapien
gcacatgctctcttcccttgcactg

SEQ ID NO: 570501 - DNA, 25 bp, Homo sapien
cttcccttgcactgaacactgccct

SEQ ID NO: 570502 - DNA, 25 bp, Homo sapien
ttcccttgcactgaacactgccctc

SEQ ID NO: 570503 - DNA, 25 bp, Homo sapien
tcccttgcactgaacactgccctca

SEQ ID NO: 570504 - DNA, 25 bp, Homo sapien
cccttgcactgaacactgccctcac

SEQ ID NO: 570505 - DNA, 25 bp, Homo sapien
ccttgcactgaacactgccctcacc

SEQ ID NO: 570506 - DNA, 25 bp, Homo sapien
cttgcactgaacactgccctcaccc

SEQ ID NO: 570507 - DNA, 25 bp, Homo sapien
ttgcactgaacactgccctcacccc

SEQ ID NO: 570508 - DNA, 25 bp, Homo sapien
tcaccccctgcccacatcttcacgg

SEQ ID NO: 570509 - DNA, 25 bp, Homo sapien
tcttaagttgttgctctaacgccac

SEQ ID NO: 570510 - DNA, 25 bp, Homo sapien
tgggtgggccctaaacaccatcaaa

SEQ ID NO: 570511 - DNA, 25 bp, Homo sapien
gggccctaaacaccatcaaaagcat

SEQ ID NO: 570512 - DNA, 25 bp, Homo sapien
catcaaaagcatccttataagtaag

SEQ ID NO: 570513 - DNA, 25 bp, Homo sapien
aagcatccttataagtaagaggcaa

SEQ ID NO: 570514 - DNA, 25 bp, Homo sapien
gaggcaaagataggctagacacaca

SEQ ID NO: 570515 - DNA, 25 bp, Homo sapien
aagataggctagacacacagagaga

SEQ ID NO: 570516 - DNA, 25 bp, Homo sapien
gataggctagacacacagagagaag

SEQ ID NO: 570517 - DNA, 25 bp, Homo sapien
gaatgctggcagataccagaacctg

SEQ ID NO: 570518 - DNA, 25 bp, Homo sapien
gctggcagataccagaacctggaag

SEQ ID NO: 570519 - DNA, 25 bp, Homo sapien
tgacaacacatgcagttcagacatc

SEQ ID NO: 570520 - DNA, 25 bp, Homo sapien
acacatgcagttcagacatctggcc

SEQ ID NO: 570521 - DNA, 25 bp, Homo sapien
ttctcatcttgggtcctttatcaga

SEQ ID NO: 570522 - DNA, 25 bp, Homo sapien
tcttgggtcctttatcagatttact

SEQ ID NO: 570523 - DNA, 25 bp, Homo sapien
gggtcctttatcagatttactttat

SEQ ID NO: 570524 - DNA, 25 bp, Homo sapien
aaataatagcatttgcctccctcct

SEQ ID NO: 570525 - DNA, 25 bp, Homo sapien
tgcctccctcctaaagaaatgtggt

SEQ ID NO: 570526 - DNA, 25 bp, Homo sapien
atgtggtgaacaagagttggtcagc

SEQ ID NO: 570527 - DNA, 25 bp, Homo sapien
gttggtcagcaacacctagaatctg

SEQ ID NO: 570528 - DNA, 25 bp, Homo sapien
acacctagaatctggagtatctctc

SEQ ID NO: 570529 - DNA, 25 bp, Homo sapien
ggagtatctctcatgggttccataa

SEQ ID NO: 570530 - DNA, 25 bp, Homo sapien
catgggttccataaatagttggcat

SEQ ID NO: 570531 - DNA, 25 bp, Homo sapien
atgtcatcactattaaaatcttctt

SEQ ID NO: 570532 - DNA, 25 bp, Homo sapien
cacctcaactcttaccttggaaatt

SEQ ID NO: 570533 - DNA, 25 bp, Homo sapien
tcaactcttaccttggaaatttcta

SEQ ID NO: 570534 - DNA, 25 bp, Homo sapien
actcttaccttggaaatttctacat

SEQ ID NO: 570535 - DNA, 25 bp, Homo sapien
tcttaccttggaaatttctacatga

SEQ ID NO: 570536 - DNA, 25 bp, Homo sapien
gctctgaaactatagcaaacgatca

SEQ ID NO: 570537 - DNA, 25 bp, Homo sapien
gaaactatagcaaacgatcacagag

SEQ ID NO: 570538 - DNA, 25 bp, Homo sapien
actatagcaaacgatcacagagtgt

SEQ ID NO: 570539 - DNA, 25 bp, Homo sapien
tatagcaaacgatcacagagtgttg

SEQ ID NO: 570540 - DNA, 25 bp, Homo sapien
caaacgatcacagagtgttgagtgt

SEQ ID NO: 570541 - DNA, 25 bp, Homo sapien
atcacagagtgttgagtgtgagtcc

SEQ ID NO: 570542 - DNA, 25 bp, Homo sapien
gagtgttgagtgtgagtccggactg

SEQ ID NO: 570543 - DNA, 25 bp, Homo sapien
tttagtattaccagaagccctccca

SEQ ID NO: 570544 - DNA, 25 bp, Homo sapien
aagccctcccaatacggcaatatta

SEQ ID NO: 570545 - DNA, 25 bp, Homo sapien
caatacggcaatattaccttctgtg

SEQ ID NO: 570546 - DNA, 25 bp, Homo sapien
ttaccttctgtgtaatccacttgcc

SEQ ID NO: 570547 - DNA, 25 bp, Homo sapien
taatccacttgccaacagctgtttt

SEQ ID NO: 570548 - DNA, 25 bp, Homo sapien
cagctgttttctgttgaaatgggac

SEQ ID NO: 570549 - DNA, 25 bp, Homo sapien
attttgaatccaaggccaatgctgc

SEQ ID NO: 570550 - DNA, 25 bp, Homo sapien
aatgctgcctgctctgtttacaatg

SEQ ID NO: 570551 - DNA, 25 bp, Homo sapien
gcctgctctgtttacaatggtttgt

SEQ ID NO: 570552 - DNA, 25 bp, Homo sapien
gtgattctgtccaataaagcctcct

SEQ ID NO: 570553 - DNA, 25 bp, Homo sapien
tctgtccaataaagcctcctgttat

SEQ ID NO: 570554 - DNA, 25 bp, Homo sapien
ccgtagactttgacgagtttgtgat

SEQ ID NO: 570555 - DNA, 25 bp, Homo sapien
gacgagtttgtgatgatgctctccc

SEQ ID NO: 570556 - DNA, 25 bp, Homo sapien
cgagtttgtgatgatgctctcccgc

SEQ ID NO: 570557 - DNA, 25 bp, Homo sapien
agtttgtgatgatgctctcccgcca

SEQ ID NO: 570558 - DNA, 25 bp, Homo sapien
tgatgatgctctcccgccactgagg

SEQ ID NO: 570559 - DNA, 25 bp, Homo sapien
cgccactgaggctccaggagggaat

SEQ ID NO: 570560 - DNA, 25 bp, Homo sapien
gaggctccaggagggaatatctgtt

SEQ ID NO: 570561 - DNA, 25 bp, Homo sapien
gctccaggagggaatatctgttgcc

SEQ ID NO: 570562 - DNA, 25 bp, Homo sapien
aggagggaatatctgttgcccctgc

SEQ ID NO: 570563 - DNA, 25 bp, Homo sapien
gagggaatatctgttgcccctgcgg

SEQ ID NO: 570564 - DNA, 25 bp, Homo sapien
gggaatatctgttgcccctgcggcc

SEQ ID NO: 570565 - DNA, 25 bp, Homo sapien
tactgccttctatggttatttaaat

SEQ ID NO: 570566 - DNA, 25 bp, Homo sapien
taaatgtttcccacacgtgtcgtgc

SEQ ID NO: 570567 - DNA, 25 bp, Homo sapien
acgtgtcgtgcttccacaggtggat

SEQ ID NO: 570568 - DNA, 25 bp, Homo sapien
ttccacaggtggattttaagtgcct

SEQ ID NO: 570569 - DNA, 25 bp, Homo sapien
gtgccttgaaacagggtgtatgctt

SEQ ID NO: 570570 - DNA, 25 bp, Homo sapien
ccattttcatcagttagcattagct

SEQ ID NO: 570571 - DNA, 25 bp, Homo sapien
tgtgtaacaacacttccaaatttag

SEQ ID NO: 570572 - DNA, 25 bp, Homo sapien
actatttctcacgattctgtgagtt

SEQ ID NO: 570573 - DNA, 25 bp, Homo sapien
ttggctgggcagttcttctagtttg

SEQ ID NO: 570574 - DNA, 25 bp, Homo sapien
ttctagtttggactggctcgactgg

SEQ ID NO: 570575 - DNA, 25 bp, Homo sapien
gaggtaggcgaaccatagcccacag

SEQ ID NO: 570576 - DNA, 25 bp, Homo sapien
ctcagtgaatgaaggtttagtggct

SEQ ID NO: 570577 - DNA, 25 bp, Homo sapien
gtggctgaaattgaaagactacgag

SEQ ID NO: 570578 - DNA, 25 bp, Homo sapien
ttcagtgaataccttaatgttctgt

SEQ ID NO: 570579 - DNA, 25 bp, Homo sapien
taccttaatgttctgtaatttggga

SEQ ID NO: 570580 - DNA, 25 bp, Homo sapien
tgggaagtttctggcaacacagaac

SEQ ID NO: 570581 - DNA, 25 bp, Homo sapien
gcaacacagaactacatagaatcag

SEQ ID NO: 570582 - DNA, 25 bp, Homo sapien
gaactacatagaatcagtattgttt

SEQ ID NO: 570583 - DNA, 25 bp, Homo sapien
tattgttttcatggcctccagggaa

SEQ ID NO: 570584 - DNA, 25 bp, Homo sapien
tgttttcatggcctccagggaaaaa

SEQ ID NO: 570585 - DNA, 25 bp, Homo sapien
agggtgatgggattttataccaaca

SEQ ID NO: 570586 - DNA, 25 bp, Homo sapien
ggattttataccaacaactgtttca

SEQ ID NO: 570587 - DNA, 25 bp, Homo sapien
caatgcctggctaactgtctcactt

SEQ ID NO: 570588 - DNA, 25 bp, Homo sapien
aatgcctggctaactgtctcacttt

SEQ ID NO: 570589 - DNA, 25 bp, Homo sapien
tgcctggctaactgtctcactttgt

SEQ ID NO: 570590 - DNA, 25 bp, Homo sapien
cctggctaactgtctcactttgttg

SEQ ID NO: 570591 - DNA, 25 bp, Homo sapien
gtgtgatgcatcacacctgctgtct

SEQ ID NO: 570592 - DNA, 25 bp, Homo sapien
acacctgctgtcttttattatataa

SEQ ID NO: 570593 - DNA, 25 bp, Homo sapien
acctgctgtcttttattatataatt

SEQ ID NO: 570594 - DNA, 25 bp, Homo sapien
taaaagataattagtgcacccaaat

SEQ ID NO: 570595 - DNA, 25 bp, Homo sapien
gataattagtgcacccaaataagaa

SEQ ID NO: 570596 - DNA, 25 bp, Homo sapien
attagtgcacccaaataagaaggta

SEQ ID NO: 570597 - DNA, 25 bp, Homo sapien
gtgcacccaaataagaaggtatgta

SEQ ID NO: 570598 - DNA, 25 bp, Homo sapien
gcaatctggccatctgcattggacc

SEQ ID NO: 570599 - DNA, 25 bp, Homo sapien
atctgcattggacccaacatgctca

SEQ ID NO: 570600 - DNA, 25 bp, Homo sapien
tgctcaccctggagaatgaccagag

SEQ ID NO: 570601 - DNA, 25 bp, Homo sapien
accagagcctgtcatttgaagccca

SEQ ID NO: 570602 - DNA, 25 bp, Homo sapien
aacaaggtttgttctgcttactgat

SEQ ID NO: 570603 - DNA, 25 bp, Homo sapien
gcttactgatgagaaatccccaact

SEQ ID NO: 570604 - DNA, 25 bp, Homo sapien
ccaacttatgatctcaccatctgtt

SEQ ID NO: 570605 - DNA, 25 bp, Homo sapien
aatgcttcagaatgtctccaactga

SEQ ID NO: 570606 - DNA, 25 bp, Homo sapien
atgcttttgtcatagttccactctc

SEQ ID NO: 570607 - DNA, 25 bp, Homo sapien
gttccactctctcagatacatgtat

SEQ ID NO: 570608 - DNA, 25 bp, Homo sapien
aaactgaataaatccgtgtcttctg

SEQ ID NO: 570609 - DNA, 25 bp, Homo sapien
aaaaaggcagttgtcatgatgtgag

SEQ ID NO: 570610 - DNA, 25 bp, Homo sapien
agaggagagctctggattggaatcg

SEQ ID NO: 570611 - DNA, 25 bp, Homo sapien
attggaatcgagagggagtctaccc

SEQ ID NO: 570612 - DNA, 25 bp, Homo sapien
aatcgagagggagtctaccctcggc

SEQ ID NO: 570613 - DNA, 25 bp, Homo sapien
agagggagtctaccctcggccgtca

SEQ ID NO: 570614 - DNA, 25 bp, Homo sapien
taccctcggccgtcatttgttgttc

SEQ ID NO: 570615 - DNA, 25 bp, Homo sapien
tcggccgtcatttgttgttctcagt

SEQ ID NO: 570616 - DNA, 25 bp, Homo sapien
gccgtcatttgttgttctcagtcat

SEQ ID NO: 570617 - DNA, 25 bp, Homo sapien
gtcatttgttgttctcagtcattat

SEQ ID NO: 570618 - DNA, 25 bp, Homo sapien
tttgttgttctcagtcattatgacc

SEQ ID NO: 570619 - DNA, 25 bp, Homo sapien
gttgttctcagtcattatgaccaaa

SEQ ID NO: 570620 - DNA, 25 bp, Homo sapien
agaccattcctgttcaggcgttctc

SEQ ID NO: 570621 - DNA, 25 bp, Homo sapien
ctgttcaggcgttctccgaagagaa

SEQ ID NO: 570622 - DNA, 25 bp, Homo sapien
gagaacagcatagagggcacgcctt

SEQ ID NO: 570623 - DNA, 25 bp, Homo sapien
gagggcacgccttcgaaatgttact

SEQ ID NO: 570624 - DNA, 25 bp, Homo sapien
ccttcgaaatgttactgccgcttga

SEQ ID NO: 570625 - DNA, 25 bp, Homo sapien
gttactgccgcttgaaagccatgat

SEQ ID NO: 570626 - DNA, 25 bp, Homo sapien
aggctgtggcgctttctgccatgat

SEQ ID NO: 570627 - DNA, 25 bp, Homo sapien
atgatgattgcatcggcccctccaa

SEQ ID NO: 570628 - DNA, 25 bp, Homo sapien
aaactgtgcgtctcctgccttgtcg

SEQ ID NO: 570629 - DNA, 25 bp, Homo sapien
cctgccttgtcgttcggtaatgaga

SEQ ID NO: 570630 - DNA, 25 bp, Homo sapien
ttttgcgtccttttggaatcacaga

SEQ ID NO: 570631 - DNA, 25 bp, Homo sapien
tctcgaggttgatatttaaaggata

SEQ ID NO: 570632 - DNA, 25 bp, Homo sapien
aaagcaacactattttcatttgtaa

SEQ ID NO: 570633 - DNA, 25 bp, Homo sapien
gacatttaacaaacatcgctaatat

SEQ ID NO: 570634 - DNA, 25 bp, Homo sapien
aacaaacatcgctaatattttggtt

SEQ ID NO: 570635 - DNA, 25 bp, Homo sapien
gtttatattcttctggatcattcaa

SEQ ID NO: 570636 - DNA, 25 bp, Homo sapien
atattcttctggatcattcaatgcc

SEQ ID NO: 570637 - DNA, 25 bp, Homo sapien
ggatcattcaatgccaatgtgtgta

SEQ ID NO: 570638 - DNA, 25 bp, Homo sapien
agtatatgcagtctacatcatctct

SEQ ID NO: 570639 - DNA, 25 bp, Homo sapien
cagtctacatcatctcttctaatga

SEQ ID NO: 570640 - DNA, 25 bp, Homo sapien
acatcatctcttctaatgactgtaa

SEQ ID NO: 570641 - DNA, 25 bp, Homo sapien
cttctaatgactgtaagattttcca

SEQ ID NO: 570642 - DNA, 25 bp, Homo sapien
aacgaggtgttcaccatcgacgaca

SEQ ID NO: 570643 - DNA, 25 bp, Homo sapien
tgcagaccctcaagctgcggctgcg

SEQ ID NO: 570644 - DNA, 25 bp, Homo sapien
gggagacacaggacacgctgcagct

SEQ ID NO: 570645 - DNA, 25 bp, Homo sapien
ctgcagctgctggtcatgaccaagt

SEQ ID NO: 570646 - DNA, 25 bp, Homo sapien
tcatgaccaagtgccggctggagca

SEQ ID NO: 570647 - DNA, 25 bp, Homo sapien
tggagcacgagctcgccatcaaggc

SEQ ID NO: 570648 - DNA, 25 bp, Homo sapien
tcgacaaggagaagtgcatgggcat

SEQ ID NO: 570649 - DNA, 25 bp, Homo sapien
gtgcatgggcatgcgtaagaccttc

SEQ ID NO: 570650 - DNA, 25 bp, Homo sapien
tgggcatgcgtaagaccttcccctg

SEQ ID NO: 570651 - DNA, 25 bp, Homo sapien
ctcattccgcgctggcgtaaaattg

SEQ ID NO: 570652 - DNA, 25 bp, Homo sapien
ccgcgctggcgtaaaattggaaaag

SEQ ID NO: 570653 - DNA, 25 bp, Homo sapien
cgggagggtcgagccgaagtctccg

SEQ ID NO: 570654 - DNA, 25 bp, Homo sapien
gagccgaagtctccggcgggccgca

SEQ ID NO: 570655 - DNA, 25 bp, Homo sapien
gagggcgggccttggccccgagtga

SEQ ID NO: 570656 - DNA, 25 bp, Homo sapien
ttggccccgagtgaaggcgcggcgg

SEQ ID NO: 570657 - DNA, 25 bp, Homo sapien
gcggcggcccaaccggcgtgagagc

SEQ ID NO: 570658 - DNA, 25 bp, Homo sapien
tgcggcgcctgggacggttgcggtg

SEQ ID NO: 570659 - DNA, 25 bp, Homo sapien
gacggttgcggtgggtctgggcgct

SEQ ID NO: 570660 - DNA, 25 bp, Homo sapien
tgggtctgggcgctgggaagtcgtc

SEQ ID NO: 570661 - DNA, 25 bp, Homo sapien
cgctgggaagtcgtccaagatgatt

SEQ ID NO: 570662 - DNA, 25 bp, Homo sapien
gggaagtcgtccaagatgattaaaa

SEQ ID NO: 570663 - DNA, 25 bp, Homo sapien
gaagtcgtccaagatgattaaaaaa

SEQ ID NO: 570664 - DNA, 25 bp, Homo sapien
gtcatttaacaagatagtcaggata

SEQ ID NO: 570665 - DNA, 25 bp, Homo sapien
agtcaggatactaccaaccacactg

SEQ ID NO: 570666 - DNA, 25 bp, Homo sapien
gcccaccacaagaattcacctaaag

SEQ ID NO: 570667 - DNA, 25 bp, Homo sapien
attcacctaaagaagtctgttccaa

SEQ ID NO: 570668 - DNA, 25 bp, Homo sapien
gaagtctgttccaaggacactgctt

SEQ ID NO: 570669 - DNA, 25 bp, Homo sapien
agtctgttccaaggacactgcttca

SEQ ID NO: 570670 - DNA, 25 bp, Homo sapien
tgttccaaggacactgcttcactgg

SEQ ID NO: 570671 - DNA, 25 bp, Homo sapien
aaggacactgcttcactggactgca

SEQ ID NO: 570672 - DNA, 25 bp, Homo sapien
acactgcttcactggactgcaagaa

SEQ ID NO: 570673 - DNA, 25 bp, Homo sapien
ttcactggactgcaagaagaactat

SEQ ID NO: 570674 - DNA, 25 bp, Homo sapien
gaagaactatacatgattgttcaga

SEQ ID NO: 570675 - DNA, 25 bp, Homo sapien
atacccacttccatgttctgctctt

SEQ ID NO: 570676 - DNA, 25 bp, Homo sapien
ttccatgttctgctctttactgaag

SEQ ID NO: 570677 - DNA, 25 bp, Homo sapien
gttctgctctttactgaagctgaaa

SEQ ID NO: 570678 - DNA, 25 bp, Homo sapien
gaagctgaaagtctgcaaccttcat

SEQ ID NO: 570679 - DNA, 25 bp, Homo sapien
ttcattctctgactcccttacattt

SEQ ID NO: 570680 - DNA, 25 bp, Homo sapien
gactcccttacattttcttaggctt

SEQ ID NO: 570681 - DNA, 25 bp, Homo sapien
tacattttcttaggcttcttgctag

SEQ ID NO: 570682 - DNA, 25 bp, Homo sapien
gcttcttgctagcttctgccaaaaa

SEQ ID NO: 570683 - DNA, 25 bp, Homo sapien
agcttctgccaaaaagaggccctgg

SEQ ID NO: 570684 - DNA, 25 bp, Homo sapien
gaggcagaggtaaggattccatgtt

SEQ ID NO: 570685 - DNA, 25 bp, Homo sapien
aaggattccatgttaacaggtgctg

SEQ ID NO: 570686 - DNA, 25 bp, Homo sapien
ggagtcctactagtgaaggtagttt

SEQ ID NO: 570687 - DNA, 25 bp, Homo sapien
tagttttgagtctttccaagggatc

SEQ ID NO: 570688 - DNA, 25 bp, Homo sapien
tttccaagggatctttaagtcagcc

SEQ ID NO: 570689 - DNA, 25 bp, Homo sapien
agcccccatacacagcctattttgg

SEQ ID NO: 570690 - DNA, 25 bp, Homo sapien
taccagtaaatcaaagcacagccta

SEQ ID NO: 570691 - DNA, 25 bp, Homo sapien
aatcaaagcacagcctatattccac

SEQ ID NO: 570692 - DNA, 25 bp, Homo sapien
tctccactgaatattcacggtgaaa

SEQ ID NO: 570693 - DNA, 25 bp, Homo sapien
aaactgcatgaatttgtaacattag

SEQ ID NO: 570694 - DNA, 25 bp, Homo sapien
acattagtttcatgaatttgtgtca

SEQ ID NO: 570695 - DNA, 25 bp, Homo sapien
aaaaataggtcagcgcttaggagtc

SEQ ID NO: 570696 - DNA, 25 bp, Homo sapien
aggtcagcgcttaggagtcctacta

SEQ ID NO: 570697 - DNA, 25 bp, Homo sapien
aaaattgtttttagtgagataggat

SEQ ID NO: 570698 - DNA, 25 bp, Homo sapien
acctattaattttagaaccagtatg

SEQ ID NO: 570699 - DNA, 25 bp, Homo sapien
ttagaaccagtatgaggagtgaatt

SEQ ID NO: 570700 - DNA, 25 bp, Homo sapien
attggtgtgggctccacccaaccag

SEQ ID NO: 570701 - DNA, 25 bp, Homo sapien
cacccaaccagatcccaaggaaatg

SEQ ID NO: 570702 - DNA, 25 bp, Homo sapien
acccaaccagatcccaaggaaatgt

SEQ ID NO: 570703 - DNA, 25 bp, Homo sapien
accagatcccaaggaaatgttctct

SEQ ID NO: 570704 - DNA, 25 bp, Homo sapien
gatcccaaggaaatgttctcttgtg

SEQ ID NO: 570705 - DNA, 25 bp, Homo sapien
tcccaaggaaatgttctcttgtgtg

SEQ ID NO: 570706 - DNA, 25 bp, Homo sapien
tgttctcttgtgtgaggatatgact

SEQ ID NO: 570707 - DNA, 25 bp, Homo sapien
ctcttgtgtgaggatatgacttgtg

SEQ ID NO: 570708 - DNA, 25 bp, Homo sapien
caaagagaggatcctagaaacagta

SEQ ID NO: 570709 - DNA, 25 bp, Homo sapien
aaagagctctaatttacctggccac

SEQ ID NO: 570710 - DNA, 25 bp, Homo sapien
gagctctaatttacctggccacaga

SEQ ID NO: 570711 - DNA, 25 bp, Homo sapien
tctaatttacctggccacagacttc

SEQ ID NO: 570712 - DNA, 25 bp, Homo sapien
acagacttctcaatcaaaaccatga

SEQ ID NO: 570713 - DNA, 25 bp, Homo sapien
ttctcaatcaaaaccatgaaggcca

SEQ ID NO: 570714 - DNA, 25 bp, Homo sapien
gaaggccatacaagaatactgtatc

SEQ ID NO: 570715 - DNA, 25 bp, Homo sapien
agaatactgtatcaagcaaagctat

SEQ ID NO: 570716 - DNA, 25 bp, Homo sapien
tgaagaagagataaagtttttccca

SEQ ID NO: 570717 - DNA, 25 bp, Homo sapien
accactaccagatctgtattataag

SEQ ID NO: 570718 - DNA, 25 bp, Homo sapien
gtattataagaaatgctctcttgaa

SEQ ID NO: 570719 - DNA, 25 bp, Homo sapien
tgcccacatcttcacggttcttaag

SEQ ID NO: 570720 - DNA, 25 bp, Homo sapien
cacatcttcacggttcttaagttgt

SEQ ID NO: 570721 - DNA, 25 bp, Homo sapien
cacggttcttaagttgttgctctaa

SEQ ID NO: 570722 - DNA, 25 bp, Homo sapien
ttcttaagttgttgctctaacgcca

SEQ ID NO: 570723 - DNA, 25 bp, Homo sapien
taaccactctacttaaaaacagcac

SEQ ID NO: 570724 - DNA, 25 bp, Homo sapien
aaacacaaatgagggaggtactggc

SEQ ID NO: 570725 - DNA, 25 bp, Homo sapien
acacaaatgagggaggtactggctt

SEQ ID NO: 570726 - DNA, 25 bp, Homo sapien
cacaaatgagggaggtactggcttc

SEQ ID NO: 570727 - DNA, 25 bp, Homo sapien
acaaatgagggaggtactggcttct

SEQ ID NO: 570728 - DNA, 25 bp, Homo sapien
caaatgagggaggtactggcttctg

SEQ ID NO: 570729 - DNA, 25 bp, Homo sapien
aaatgagggaggtactggcttctgc

SEQ ID NO: 570730 - DNA, 25 bp, Homo sapien
taaagacatttgtgcatagctcatg

SEQ ID NO: 570731 - DNA, 25 bp, Homo sapien
gacatttgtgcatagctcatgagac

SEQ ID NO: 570732 - DNA, 25 bp, Homo sapien
tagctcatgagacaaatactgattt

SEQ ID NO: 570733 - DNA, 25 bp, Homo sapien
tagtcagatctaaatataccgcttc

SEQ ID NO: 570734 - DNA, 25 bp, Homo sapien
gatctaaatataccgcttctgtaca

SEQ ID NO: 570735 - DNA, 25 bp, Homo sapien
aatataccgcttctgtacactaatg

SEQ ID NO: 570736 - DNA, 25 bp, Homo sapien
accgcttctgtacactaatgtttat

SEQ ID NO: 570737 - DNA, 25 bp, Homo sapien
gtacactaatgtttataggtattta

SEQ ID NO: 570738 - DNA, 25 bp, Homo sapien
tatgtattattctaacatgtaggct

SEQ ID NO: 570739 - DNA, 25 bp, Homo sapien
tttacatgacttgttatcgccccaa

SEQ ID NO: 570740 - DNA, 25 bp, Homo sapien
acatgacttgttatcgccccaataa

SEQ ID NO: 570741 - DNA, 25 bp, Homo sapien
cctctctggctaaggacaggcaggt

SEQ ID NO: 570742 - DNA, 25 bp, Homo sapien
aggtgcccctctctccatcagagga

SEQ ID NO: 570743 - DNA, 25 bp, Homo sapien
tctccatcagaggacacctgtactg

SEQ ID NO: 570744 - DNA, 25 bp, Homo sapien
aggacacctgtactggagagcaaca

SEQ ID NO: 570745 - DNA, 25 bp, Homo sapien
gagagcaacacaggatggtctctgc

SEQ ID NO: 570746 - DNA, 25 bp, Homo sapien
ggtctctgccatgaactggaggcca

SEQ ID NO: 570747 - DNA, 25 bp, Homo sapien
aggccaggaatctcctcactgaaaa

SEQ ID NO: 570748 - DNA, 25 bp, Homo sapien
gtatggtaactttgcaaatggtggt

SEQ ID NO: 570749 - DNA, 25 bp, Homo sapien
ggtggttgtttcttccaagactcca

SEQ ID NO: 570750 - DNA, 25 bp, Homo sapien
agactccagccctgattgcgcaaaa

SEQ ID NO: 570751 - DNA, 25 bp, Homo sapien
gaggatatgagtagccccaacccaa

SEQ ID NO: 570752 - DNA, 25 bp, Homo sapien
aaattctgtaggtttgatagtctcc

SEQ ID NO: 570753 - DNA, 25 bp, Homo sapien
gatagtctcctcctagataaatgct

SEQ ID NO: 570754 - DNA, 25 bp, Homo sapien
gataaatgctataacatcctgtgaa

SEQ ID NO: 570755 - DNA, 25 bp, Homo sapien
aatttttcctgcctcatctgtgtta

SEQ ID NO: 570756 - DNA, 25 bp, Homo sapien
tcctgcctcatctgtgttaactaat

SEQ ID NO: 570757 - DNA, 25 bp, Homo sapien
ataaccataagcttgaacatcatga

SEQ ID NO: 570758 - DNA, 25 bp, Homo sapien
tcagtcctatagattgtattttcaa

SEQ ID NO: 570759 - DNA, 25 bp, Homo sapien
cttgctatctctctgatttattttg

SEQ ID NO: 570760 - DNA, 25 bp, Homo sapien
tctgatttattttgaggctaacctc

SEQ ID NO: 570761 - DNA, 25 bp, Homo sapien
catttctttaacttcctactctgtg

SEQ ID NO: 570762 - DNA, 25 bp, Homo sapien
ctactctgtgaacccataccacttt

SEQ ID NO: 570763 - DNA, 25 bp, Homo sapien
tcagtccactggaaagacaagttcc

SEQ ID NO: 570764 - DNA, 25 bp, Homo sapien
gaaagacaagttcctgcatcaccac

SEQ ID NO: 570765 - DNA, 25 bp, Homo sapien
attctatgcataggaagagccttta

SEQ ID NO: 570766 - DNA, 25 bp, Homo sapien
ggtgacatgattcatacagacctct

SEQ ID NO: 570767 - DNA, 25 bp, Homo sapien
ttcatacagacctcttgagctcctg

SEQ ID NO: 570768 - DNA, 25 bp, Homo sapien
tgagctcctggaaatagtagaatta

SEQ ID NO: 570769 - DNA, 25 bp, Homo sapien
aagacctgaggagatgactcgtcat

SEQ ID NO: 570770 - DNA, 25 bp, Homo sapien
atgactcgtcatctcttatgcttca

SEQ ID NO: 570771 - DNA, 25 bp, Homo sapien
tcgtcatctcttatgcttcactttt

SEQ ID NO: 570772 - DNA, 25 bp, Homo sapien
aattcagtactgattggttcagcat

SEQ ID NO: 570773 - DNA, 25 bp, Homo sapien
actgattggttcagcatatcctggg

SEQ ID NO: 570774 - DNA, 25 bp, Homo sapien
tggccgtaagcgatttttccggcct

SEQ ID NO: 570775 - DNA, 25 bp, Homo sapien
cctcccaaaacgttgcgattataag

SEQ ID NO: 570776 - DNA, 25 bp, Homo sapien
ctcccaaaacgttgcgattataagt

SEQ ID NO: 570777 - DNA, 25 bp, Homo sapien
tcccaaaacgttgcgattataagtg

SEQ ID NO: 570778 - DNA, 25 bp, Homo sapien
caaaacgttgcgattataagtgtga

SEQ ID NO: 570779 - DNA, 25 bp, Homo sapien
aaaacgttgcgattataagtgtgag

SEQ ID NO: 570780 - DNA, 25 bp, Homo sapien
ttttctttatccatttgtacattga

SEQ ID NO: 570781 - DNA, 25 bp, Homo sapien
ctttatccatttgtacattgatgga

SEQ ID NO: 570782 - DNA, 25 bp, Homo sapien
tttatccatttgtacattgatggac

SEQ ID NO: 570783 - DNA, 25 bp, Homo sapien
atccatttgtacattgatggacact

SEQ ID NO: 570784 - DNA, 25 bp, Homo sapien
tccatttgtacattgatggacactt

SEQ ID NO: 570785 - DNA, 25 bp, Homo sapien
cagaaaaattgaaagccagagaaca

SEQ ID NO: 570786 - DNA, 25 bp, Homo sapien
agaaaaattgaaagccagagaacag

SEQ ID NO: 570787 - DNA, 25 bp, Homo sapien
gaaaaattgaaagccagagaacaga

SEQ ID NO: 570788 - DNA, 25 bp, Homo sapien
aaaaattgaaagccagagaacagat

SEQ ID NO: 570789 - DNA, 25 bp, Homo sapien
aaaattgaaagccagagaacagatt

SEQ ID NO: 570790 - DNA, 25 bp, Homo sapien
aaattgaaagccagagaacagatta

SEQ ID NO: 570791 - DNA, 25 bp, Homo sapien
aattgaaagccagagaacagattaa

SEQ ID NO: 570792 - DNA, 25 bp, Homo sapien
gaacagattaagttttttgaagaag

SEQ ID NO: 570793 - DNA, 25 bp, Homo sapien
tcatggagtttcaagcctgagtgtg

SEQ ID NO: 570794 - DNA, 25 bp, Homo sapien
tcatgtgcaccaccaagcttctttt

SEQ ID NO: 570795 - DNA, 25 bp, Homo sapien
caagcttcttttgcttggcttgaag

SEQ ID NO: 570796 - DNA, 25 bp, Homo sapien
gcttggcttgaaggtctgaacatcc

SEQ ID NO: 570797 - DNA, 25 bp, Homo sapien
cttgaaggtctgaacatccactctc

SEQ ID NO: 570798 - DNA, 25 bp, Homo sapien
acatccactctcaccttcatggtag

SEQ ID NO: 570799 - DNA, 25 bp, Homo sapien
tcaccttcatggtagcccaggctat

SEQ ID NO: 570800 - DNA, 25 bp, Homo sapien
gtagcccaggctatttcatgatggt

SEQ ID NO: 570801 - DNA, 25 bp, Homo sapien
ggctatttcatgatggtgacaccct

SEQ ID NO: 570802 - DNA, 25 bp, Homo sapien
tggtgacaccctcaagatccgtaga

SEQ ID NO: 570803 - DNA, 25 bp, Homo sapien
ctcaagatccgtagaccactgtatt

SEQ ID NO: 570804 - DNA, 25 bp, Homo sapien
cgtagaccactgtattagttcgttc

SEQ ID NO: 570805 - DNA, 25 bp, Homo sapien
ttctccgttctaaggaactgctgat

SEQ ID NO: 570806 - DNA, 25 bp, Homo sapien
gttctaaggaactgctgatcttctt

SEQ ID NO: 570807 - DNA, 25 bp, Homo sapien
aaggaactgctgatcttctttctgt

SEQ ID NO: 570808 - DNA, 25 bp, Homo sapien
gaactgctgatcttctttctgtctc

SEQ ID NO: 570809 - DNA, 25 bp, Homo sapien
gtactctttttttggtctggattct

SEQ ID NO: 570810 - DNA, 25 bp, Homo sapien
tggattctttccatcaacataatta

SEQ ID NO: 570811 - DNA, 25 bp, Homo sapien
gagatttatccattttttgcatgtt

SEQ ID NO: 570812 - DNA, 25 bp, Homo sapien
atttatccattttttgcatgtttca

SEQ ID NO: 570813 - DNA, 25 bp, Homo sapien
tatgcctttttattgctcaacagta

SEQ ID NO: 570814 - DNA, 25 bp, Homo sapien
tgcctttttattgctcaacagtatt

SEQ ID NO: 570815 - DNA, 25 bp, Homo sapien
catttgcctgtagatggatatttgg

SEQ ID NO: 570816 - DNA, 25 bp, Homo sapien
agagatgtggaactatgtgaaattt

SEQ ID NO: 570817 - DNA, 25 bp, Homo sapien
attttgatcctgttaattataattt

SEQ ID NO: 570818 - DNA, 25 bp, Homo sapien
tttttagagcagtggcacgttttat

SEQ ID NO: 570819 - DNA, 25 bp, Homo sapien
agcagtggcacgttttatatctcat

SEQ ID NO: 570820 - DNA, 25 bp, Homo sapien
gcagtggcacgttttatatctcatg

SEQ ID NO: 570821 - DNA, 25 bp, Homo sapien
agtggcacgttttatatctcatgcc

SEQ ID NO: 570822 - DNA, 25 bp, Homo sapien
gcacgttttatatctcatgccagaa

SEQ ID NO: 570823 - DNA, 25 bp, Homo sapien
gttttatatctcatgccagaaacta

SEQ ID NO: 570824 - DNA, 25 bp, Homo sapien
atatctcatgccagaaactagagca

SEQ ID NO: 570825 - DNA, 25 bp, Homo sapien
tctcatgccagaaactagagcataa

SEQ ID NO: 570826 - DNA, 25 bp, Homo sapien
agagcataaaatatcaacttttcaa

SEQ ID NO: 570827 - DNA, 25 bp, Homo sapien
ggatcaaatagttgatttgtccact

SEQ ID NO: 570828 - DNA, 25 bp, Homo sapien
gatttgtccactaaagtggcagact

SEQ ID NO: 570829 - DNA, 25 bp, Homo sapien
gtggcagactatcgaatgttgacaa

SEQ ID NO: 570830 - DNA, 25 bp, Homo sapien
atgttgacaaataatctgattccgt

SEQ ID NO: 570831 - DNA, 25 bp, Homo sapien
tctgattccgtataagttgatgcat

SEQ ID NO: 570832 - DNA, 25 bp, Homo sapien
gcaaaacccatatatgaacaagcct

SEQ ID NO: 570833 - DNA, 25 bp, Homo sapien
gaacaagcctctgttaagacactac

SEQ ID NO: 570834 - DNA, 25 bp, Homo sapien
tgttaagacactacctgctaacccc

SEQ ID NO: 570835 - DNA, 25 bp, Homo sapien
acctgctaacccctcaagagaacaa

SEQ ID NO: 570836 - DNA, 25 bp, Homo sapien
aagggacttgctagataccaatgat

SEQ ID NO: 570837 - DNA, 25 bp, Homo sapien
taaggtacctactgatatgaaataa

SEQ ID NO: 570838 - DNA, 25 bp, Homo sapien
gaacaagcttcttttgtagtcaaag

SEQ ID NO: 570839 - DNA, 25 bp, Homo sapien
gaagattgtttaataatgaccctat

SEQ ID NO: 570840 - DNA, 25 bp, Homo sapien
tgaccctatacttttggaacatact

SEQ ID NO: 570841 - DNA, 25 bp, Homo sapien
ggaacatacttacaccttttctaag

SEQ ID NO: 570842 - DNA, 25 bp, Homo sapien
accttttctaagcactttcacatat

SEQ ID NO: 570843 - DNA, 25 bp, Homo sapien
gcactttcacatatgttttcttatt

SEQ ID NO: 570844 - DNA, 25 bp, Homo sapien
atttaacttcacaacatctctgagt

SEQ ID NO: 570845 - DNA, 25 bp, Homo sapien
atcttcctgaatgggatttgagacc

SEQ ID NO: 570846 - DNA, 25 bp, Homo sapien
tttgagacccaaaaagactgccttt

SEQ ID NO: 570847 - DNA, 25 bp, Homo sapien
agactgcctttttatgatccacata

SEQ ID NO: 570848 - DNA, 25 bp, Homo sapien
gatccacataccatataactttggc

SEQ ID NO: 570849 - DNA, 25 bp, Homo sapien
taggtgggcacataagattccgatc

SEQ ID NO: 570850 - DNA, 25 bp, Homo sapien
acataagattccgatcagaccccaa

SEQ ID NO: 570851 - DNA, 25 bp, Homo sapien
gaccccaaccatgctgcatgtgtaa

SEQ ID NO: 570852 - DNA, 25 bp, Homo sapien
attaaggtgttgaattacgccagaa

SEQ ID NO: 570853 - DNA, 25 bp, Homo sapien
tacgccagaagacctgaaatgcctt

SEQ ID NO: 570854 - DNA, 25 bp, Homo sapien
gaaatgccttgtacctacaacaatg

SEQ ID NO: 570855 - DNA, 25 bp, Homo sapien
ctacaacaatgcttaggcttttcta

SEQ ID NO: 570856 - DNA, 25 bp, Homo sapien
ttaggcttttctaagcctcttgcca

SEQ ID NO: 570857 - DNA, 25 bp, Homo sapien
tctaagcctcttgccacttttaaaa

SEQ ID NO: 570858 - DNA, 25 bp, Homo sapien
acttttaaaattatccttcaggcat

SEQ ID NO: 570859 - DNA, 25 bp, Homo sapien
caggcataaatatttttgacagcag

SEQ ID NO: 570860 - DNA, 25 bp, Homo sapien
aatataacacattcctgtcattaag

SEQ ID NO: 570861 - DNA, 25 bp, Homo sapien
agctgctgacttgaaatgggagttc

SEQ ID NO: 570862 - DNA, 25 bp, Homo sapien
agatgaagtaacaccgttggaggag

SEQ ID NO: 570863 - DNA, 25 bp, Homo sapien
caccgttggaggaggtcagagcaca

SEQ ID NO: 570864 - DNA, 25 bp, Homo sapien
aaacaagccacagcatttggacttt

SEQ ID NO: 570865 - DNA, 25 bp, Homo sapien
gcatttggactttattctccttatt

SEQ ID NO: 570866 - DNA, 25 bp, Homo sapien
tattctccttatttatgccatcctg

SEQ ID NO: 570867 - DNA, 25 bp, Homo sapien
tatgccatcctgtttatcagtattg

SEQ ID NO: 570868 - DNA, 25 bp, Homo sapien
ttatcagtattgatctgcagcactc

SEQ ID NO: 570869 - DNA, 25 bp, Homo sapien
gcagcactccaaggtccaagggaca

SEQ ID NO: 570870 - DNA, 25 bp, Homo sapien
ggaaatctccaacctctcagaatat

SEQ ID NO: 570871 - DNA, 25 bp, Homo sapien
atacagtcattccaatataaggttg

SEQ ID NO: 570872 - DNA, 25 bp, Homo sapien
tacagtcattccaatataaggttgt

SEQ ID NO: 570873 - DNA, 25 bp, Homo sapien
acagtcattccaatataaggttgta

SEQ ID NO: 570874 - DNA, 25 bp, Homo sapien
cagtcattccaatataaggttgtag

SEQ ID NO: 570875 - DNA, 25 bp, Homo sapien
agtcattccaatataaggttgtaga

SEQ ID NO: 570876 - DNA, 25 bp, Homo sapien
gtcattccaatataaggttgtagaa

SEQ ID NO: 570877 - DNA, 25 bp, Homo sapien
cattccaatataaggttgtagaaga

SEQ ID NO: 570878 - DNA, 25 bp, Homo sapien
ttccaatataaggttgtagaagatg

SEQ ID NO: 570879 - DNA, 25 bp, Homo sapien
ctcttcccagaattatttaagatag

SEQ ID NO: 570880 - DNA, 25 bp, Homo sapien
cttcccagaattatttaagatagaa

SEQ ID NO: 570881 - DNA, 25 bp, Homo sapien
tttaagatagaagatctaaaaccca

SEQ ID NO: 570882 - DNA, 25 bp, Homo sapien
agaaatacggctgagaactttccca

SEQ ID NO: 570883 - DNA, 25 bp, Homo sapien
agcccctgctccttaggttcaggaa

SEQ ID NO: 570884 - DNA, 25 bp, Homo sapien
aggttcaggaaccagcagctcccaa

SEQ ID NO: 570885 - DNA, 25 bp, Homo sapien
gcagctcccaagcagcatagttaaa

SEQ ID NO: 570886 - DNA, 25 bp, Homo sapien
aaaagctctacccaaacagtcacgt

SEQ ID NO: 570887 - DNA, 25 bp, Homo sapien
aacagtcacgtcttggtgaaagtac

SEQ ID NO: 570888 - DNA, 25 bp, Homo sapien
aagtacagaatctcatgacaaagag

SEQ ID NO: 570889 - DNA, 25 bp, Homo sapien
aatatcttcaaagtcctgggagaaa

SEQ ID NO: 570890 - DNA, 25 bp, Homo sapien
tcctgggagaaaatagtgatagcct

SEQ ID NO: 570891 - DNA, 25 bp, Homo sapien
gtgatagcctagaattgtgtaccca

SEQ ID NO: 570892 - DNA, 25 bp, Homo sapien
gcctagaattgtgtacccagaaaat

SEQ ID NO: 570893 - DNA, 25 bp, Homo sapien
ttctgcctgctatgacagcactaat

SEQ ID NO: 570894 - DNA, 25 bp, Homo sapien
tgtacacagtattcacttgtctccc

SEQ ID NO: 570895 - DNA, 25 bp, Homo sapien
cttgtctccctttagtagtgcatga

SEQ ID NO: 570896 - DNA, 25 bp, Homo sapien
agacagactgcccagaaatgacact

SEQ ID NO: 570897 - DNA, 25 bp, Homo sapien
ggtggtgacagttccaaatcaagct

SEQ ID NO: 570898 - DNA, 25 bp, Homo sapien
tcaagctggctcagtgcttttaagt

SEQ ID NO: 570899 - DNA, 25 bp, Homo sapien
aagcatttgtcgaagtggcagtttg

SEQ ID NO: 570900 - DNA, 25 bp, Homo sapien
gtggcagtttgaaacacagccttag

SEQ ID NO: 570901 - DNA, 25 bp, Homo sapien
aacacagccttagatctggagaatc

SEQ ID NO: 570902 - DNA, 25 bp, Homo sapien
agaatcaaactaggctcttctcacc

SEQ ID NO: 570903 - DNA, 25 bp, Homo sapien
acctctcccatcattgctggtaata

SEQ ID NO: 570904 - DNA, 25 bp, Homo sapien
atttctctcacttgtggcactggga

SEQ ID NO: 570905 - DNA, 25 bp, Homo sapien
tctctcacttgtggcactgggaaga

SEQ ID NO: 570906 - DNA, 25 bp, Homo sapien
acttgtggcactgggaagagaaaac

SEQ ID NO: 570907 - DNA, 25 bp, Homo sapien
aacattgatatagatgcttttgata

SEQ ID NO: 570908 - DNA, 25 bp, Homo sapien
gtacaagatggcatacgatcgtctc

SEQ ID NO: 570909 - DNA, 25 bp, Homo sapien
agatggcatacgatcgtctcacacc

SEQ ID NO: 570910 - DNA, 25 bp, Homo sapien
atacgatcgtctcacacctagtcaa

SEQ ID NO: 570911 - DNA, 25 bp, Homo sapien
tcgtctcacacctagtcaagtcaag

SEQ ID NO: 570912 - DNA, 25 bp, Homo sapien
gtcaagtcaagagtacacacaactg

SEQ ID NO: 570913 - DNA, 25 bp, Homo sapien
acaactgtgatagaccaccaagtac

SEQ ID NO: 570914 - DNA, 25 bp, Homo sapien
gatggaatgtcgaaaaacctttgga

SEQ ID NO: 570915 - DNA, 25 bp, Homo sapien
tgagtatttactttggcccttctgt

SEQ ID NO: 570916 - DNA, 25 bp, Homo sapien
tttggcccttctgtccattttatcc

SEQ ID NO: 570917 - DNA, 25 bp, Homo sapien
aaagcaaacagatagccttcaaggg

SEQ ID NO: 570918 - DNA, 25 bp, Homo sapien
cagatagccttcaagggacaccatt

SEQ ID NO: 570919 - DNA, 25 bp, Homo sapien
ttaagcagaatatgcctcctaagca

SEQ ID NO: 570920 - DNA, 25 bp, Homo sapien
gcctcctaagcattgaaagcctttg

SEQ ID NO: 570921 - DNA, 25 bp, Homo sapien
aagcctttgacccatctgatatcca

SEQ ID NO: 570922 - DNA, 25 bp, Homo sapien
atctgatatccaagttctggcttat

SEQ ID NO: 570923 - DNA, 25 bp, Homo sapien
attagggccttgaataactttatgt

SEQ ID NO: 570924 - DNA, 25 bp, Homo sapien
tatccccacaaattcatgttgaccc

SEQ ID NO: 570925 - DNA, 25 bp, Homo sapien
aaattcatgttgaccctctgacctc

SEQ ID NO: 570926 - DNA, 25 bp, Homo sapien
agatgtgaagagtggcttccaggtc

SEQ ID NO: 570927 - DNA, 25 bp, Homo sapien
cttctctgtcaattcattgatgtta

SEQ ID NO: 570928 - DNA, 25 bp, Homo sapien
attcattgatgttatctgtcttcag

SEQ ID NO: 570929 - DNA, 25 bp, Homo sapien
tcattgatgttatctgtcttcagga

SEQ ID NO: 570930 - DNA, 25 bp, Homo sapien
gatgttatctgtcttcaggatttca

SEQ ID NO: 570931 - DNA, 25 bp, Homo sapien
atctgtcttcaggatttcattttac

SEQ ID NO: 570932 - DNA, 25 bp, Homo sapien
ctgtcttcaggatttcattttacgc

SEQ ID NO: 570933 - DNA, 25 bp, Homo sapien
gtcttcaggatttcattttacgcct

SEQ ID NO: 570934 - DNA, 25 bp, Homo sapien
caggatttcattttacgcctatatc

SEQ ID NO: 570935 - DNA, 25 bp, Homo sapien
gatttcattttacgcctatatcaga

SEQ ID NO: 570936 - DNA, 25 bp, Homo sapien
cattttacgcctatatcagaaataa

SEQ ID NO: 570937 - DNA, 25 bp, Homo sapien
gtcatataagatttactgatccctg

SEQ ID NO: 570938 - DNA, 25 bp, Homo sapien
tactgatccctgaaaatcataagta

SEQ ID NO: 570939 - DNA, 25 bp, Homo sapien
aacaggcttcacaaaagctgataga

SEQ ID NO: 570940 - DNA, 25 bp, Homo sapien
agctgatagagtacaatcccacttt

SEQ ID NO: 570941 - DNA, 25 bp, Homo sapien
gatagagtacaatcccacttttata

SEQ ID NO: 570942 - DNA, 25 bp, Homo sapien
aaggatatatacacatcaaatgtta

SEQ ID NO: 570943 - DNA, 25 bp, Homo sapien
aatagtggctaagaatggtggcatt

SEQ ID NO: 570944 - DNA, 25 bp, Homo sapien
gaatggtggcattatgagttaatat

SEQ ID NO: 570945 - DNA, 25 bp, Homo sapien
ttttctgtatttctgaaagttgtct

SEQ ID NO: 570946 - DNA, 25 bp, Homo sapien
ctgaaagttgtctatattgaacaca

SEQ ID NO: 570947 - DNA, 25 bp, Homo sapien
tgtctatattgaacacaagtgagtt

SEQ ID NO: 570948 - DNA, 25 bp, Homo sapien
gggcacagactaggtttcctgtgag

SEQ ID NO: 570949 - DNA, 25 bp, Homo sapien
gcacagactaggtttcctgtgagct

SEQ ID NO: 570950 - DNA, 25 bp, Homo sapien
cagactaggtttcctgtgagctggt

SEQ ID NO: 570951 - DNA, 25 bp, Homo sapien
agactaggtttcctgtgagctggtc

SEQ ID NO: 570952 - DNA, 25 bp, Homo sapien
actaggtttcctgtgagctggtcgg

SEQ ID NO: 570953 - DNA, 25 bp, Homo sapien
ggcacagagtaggtttcctgtgagc

SEQ ID NO: 570954 - DNA, 25 bp, Homo sapien
acagagtaggtttcctgtgagctgg

SEQ ID NO: 570955 - DNA, 25 bp, Homo sapien
agtaggtttcctgtgagctggtcgg

SEQ ID NO: 570956 - DNA, 25 bp, Homo sapien
cccggggcacagagtaggtttcctg

SEQ ID NO: 570957 - DNA, 25 bp, Homo sapien
ggcacagagtaggtttcctgtgagt

SEQ ID NO: 570958 - DNA, 25 bp, Homo sapien
acagagtaggtttcctgtgagttgg

SEQ ID NO: 570959 - DNA, 25 bp, Homo sapien
tttgaagtaacagagacaggcagca

SEQ ID NO: 570960 - DNA, 25 bp, Homo sapien
taagagctgatagtcaagcattgaa

SEQ ID NO: 570961 - DNA, 25 bp, Homo sapien
gaaatcaagacagtggtgagatctc

SEQ ID NO: 570962 - DNA, 25 bp, Homo sapien
tgagatctcacggcaggcagaggct

SEQ ID NO: 570963 - DNA, 25 bp, Homo sapien
aagcaaggcagtgggctgatgttca

SEQ ID NO: 570964 - DNA, 25 bp, Homo sapien
tgggctgatgttcagggtcctatta

SEQ ID NO: 570965 - DNA, 25 bp, Homo sapien
acttttctgaggttaaggatggact

SEQ ID NO: 570966 - DNA, 25 bp, Homo sapien
tggactttttaagaggctcctaaga

SEQ ID NO: 570967 - DNA, 25 bp, Homo sapien
tcctaagagttacatgtccatggct

SEQ ID NO: 570968 - DNA, 25 bp, Homo sapien
acatgtccatggcttgaactttttg

SEQ ID NO: 570969 - DNA, 25 bp, Homo sapien
gaactttttgtctcaaacaacagaa

SEQ ID NO: 570970 - DNA, 25 bp, Homo sapien
atcacagccagtatagtctatttcc

SEQ ID NO: 570971 - DNA, 25 bp, Homo sapien
acagccagtatagtctatttccaaa

SEQ ID NO: 570972 - DNA, 25 bp, Homo sapien
aatgcaccaagctggataaagccgc

SEQ ID NO: 570973 - DNA, 25 bp, Homo sapien
tgcaccaagctggataaagccgctt

SEQ ID NO: 570974 - DNA, 25 bp, Homo sapien
actccaacggataaatgtgtattac

SEQ ID NO: 570975 - DNA, 25 bp, Homo sapien
caacggataaatgtgtattaccttc

SEQ ID NO: 570976 - DNA, 25 bp, Homo sapien
ggataaatgtgtattaccttcccaa

SEQ ID NO: 570977 - DNA, 25 bp, Homo sapien
ccagttgaaatgtcaaacttgacat

SEQ ID NO: 570978 - DNA, 25 bp, Homo sapien
gtcaaacttgacataaaaatgagat

SEQ ID NO: 570979 - DNA, 25 bp, Homo sapien
aaaaatgagatgttcttgcatcaat

SEQ ID NO: 570980 - DNA, 25 bp, Homo sapien
tgagatgttcttgcatcaattaata

SEQ ID NO: 570981 - DNA, 25 bp, Homo sapien
attcagcatggcattcagggttctc

SEQ ID NO: 570982 - DNA, 25 bp, Homo sapien
tcagggttctccatgagtttggcct

SEQ ID NO: 570983 - DNA, 25 bp, Homo sapien
gagtttggcctcagtttatgacttt

SEQ ID NO: 570984 - DNA, 25 bp, Homo sapien
gtttatgactttgtcctggcatgta

SEQ ID NO: 570985 - DNA, 25 bp, Homo sapien
tggtgcaacatcctaaatatttcat

SEQ ID NO: 570986 - DNA, 25 bp, Homo sapien
tcatgtatcagacccgtgtttctgg

SEQ ID NO: 570987 - DNA, 25 bp, Homo sapien
ccgtgtttctggttcttatacttgt

SEQ ID NO: 570988 - DNA, 25 bp, Homo sapien
tatacttgttcccaaagctcagacc

SEQ ID NO: 570989 - DNA, 25 bp, Homo sapien
ccgcgtgagggatgactgcttttca

SEQ ID NO: 570990 - DNA, 25 bp, Homo sapien
tgcttttcagcagtatcccatgctt

SEQ ID NO: 570991 - DNA, 25 bp, Homo sapien
tatcccatgcttccagtttgtcttt

SEQ ID NO: 570992 - DNA, 25 bp, Homo sapien
ttataaaacgttaatgcagagctgg

SEQ ID NO: 570993 - DNA, 25 bp, Homo sapien
tataaaacgttaatgcagagctggg

SEQ ID NO: 570994 - DNA, 25 bp, Homo sapien
ataaaacgttaatgcagagctgggc

SEQ ID NO: 570995 - DNA, 25 bp, Homo sapien
taaaacgttaatgcagagctgggcg

SEQ ID NO: 570996 - DNA, 25 bp, Homo sapien
aaaacgttaatgcagagctgggcgt

SEQ ID NO: 570997 - DNA, 25 bp, Homo sapien
aaacgttaatgcagagctgggcgtg

SEQ ID NO: 570998 - DNA, 25 bp, Homo sapien
aacgttaatgcagagctgggcgtgg

SEQ ID NO: 570999 - DNA, 25 bp, Homo sapien
acgttaatgcagagctgggcgtggt

SEQ ID NO: 571000 - DNA, 25 bp, Homo sapien
cgttaatgcagagctgggcgtggtg

SEQ ID NO: 571001 - DNA, 25 bp, Homo sapien
gttaatgcagagctgggcgtggtgg

SEQ ID NO: 571002 - DNA, 25 bp, Homo sapien
gggcgtggtggcagccccccgtaat

SEQ ID NO: 571003 - DNA, 25 bp, Homo sapien
gcgatcttaggtttacagacctcaa

SEQ ID NO: 571004 - DNA, 25 bp, Homo sapien
aaagtgtcactgagacttgccagga

SEQ ID NO: 571005 - DNA, 25 bp, Homo sapien
gacttgccaggatttgtcagtgatg

SEQ ID NO: 571006 - DNA, 25 bp, Homo sapien
gagatcgtgtgggttgcattattaa

SEQ ID NO: 571007 - DNA, 25 bp, Homo sapien
tattaatagcctttactgtcagtat

SEQ ID NO: 571008 - DNA, 25 bp, Homo sapien
gtattttcattcaatccgcaggtgt

SEQ ID NO: 571009 - DNA, 25 bp, Homo sapien
aatccgcaggtgtttattgaaccta

SEQ ID NO: 571010 - DNA, 25 bp, Homo sapien
aatttgtaccatactctttgctgag

SEQ ID NO: 571011 - DNA, 25 bp, Homo sapien
aagtaaagaaatggtctctgctctc

SEQ ID NO: 571012 - DNA, 25 bp, Homo sapien
ctgctctcaaggagcctgtagagga

SEQ ID NO: 571013 - DNA, 25 bp, Homo sapien
tagaggagttgtagtctttcctcct

SEQ ID NO: 571014 - DNA, 25 bp, Homo sapien
cttcctagctgctgctcgaaaaggt

SEQ ID NO: 571015 - DNA, 25 bp, Homo sapien
ctagctgctgctcgaaaaggttttg

SEQ ID NO: 571016 - DNA, 25 bp, Homo sapien
gtaagggaatggtcaagactgagaa

SEQ ID NO: 571017 - DNA, 25 bp, Homo sapien
cagggctacacgtgatgtccccaaa

SEQ ID NO: 571018 - DNA, 25 bp, Homo sapien
tacacgtgatgtccccaaactgctg

SEQ ID NO: 571019 - DNA, 25 bp, Homo sapien
tgatgtccccaaactgctgctattg

SEQ ID NO: 571020 - DNA, 25 bp, Homo sapien
tgtccccaaactgctgctattgaag

SEQ ID NO: 571021 - DNA, 25 bp, Homo sapien
agccctaaaggaaagtttgcatcta

SEQ ID NO: 571022 - DNA, 25 bp, Homo sapien
aattgctgcatggaaattgatgtac

SEQ ID NO: 571023 - DNA, 25 bp, Homo sapien
gctgcatggaaattgatgtacattc

SEQ ID NO: 571024 - DNA, 25 bp, Homo sapien
gatgtacattcaggggacggcaaaa

SEQ ID NO: 571025 - DNA, 25 bp, Homo sapien
gagaaattatagaatgccatgctta

SEQ ID NO: 571026 - DNA, 25 bp, Homo sapien
gccatgcttattatgataacctcat

SEQ ID NO: 571027 - DNA, 25 bp, Homo sapien
gataacctcatacagaaatttttac

SEQ ID NO: 571028 - DNA, 25 bp, Homo sapien
atttgtctaagcagtatttcggaag

SEQ ID NO: 571029 - DNA, 25 bp, Homo sapien
gcagtatttcggaagcactttcaac

SEQ ID NO: 571030 - DNA, 25 bp, Homo sapien
tcggaagcactttcaacagttatgt

SEQ ID NO: 571031 - DNA, 25 bp, Homo sapien
caacagttatgtaaagggtcctatt

SEQ ID NO: 571032 - DNA, 25 bp, Homo sapien
aaggacatgtataaggtttttagca

SEQ ID NO: 571033 - DNA, 25 bp, Homo sapien
agcatgaggaaattaagtctttctc

SEQ ID NO: 571034 - DNA, 25 bp, Homo sapien
gtctttctcaacctagaagtcagga

SEQ ID NO: 571035 - DNA, 25 bp, Homo sapien
aacctagaagtcaggagtttcaaga

SEQ ID NO: 571036 - DNA, 25 bp, Homo sapien
caagctatcgtatgtgctgggccag

SEQ ID NO: 571037 - DNA, 25 bp, Homo sapien
agctatcgtatgtgctgggccagcc

SEQ ID NO: 571038 - DNA, 25 bp, Homo sapien
gagctgctgaccaaggaccttcggg

SEQ ID NO: 571039 - DNA, 25 bp, Homo sapien
ggagatgacgccaccctcggtggaa

SEQ ID NO: 571040 - DNA, 25 bp, Homo sapien
atgacgccaccctcggtggaagagc

SEQ ID NO: 571041 - DNA, 25 bp, Homo sapien
ctcggtggaagagcgccggccctca

SEQ ID NO: 571042 - DNA, 25 bp, Homo sapien
ctggctcctcagtctgagcggcagc

SEQ ID NO: 571043 - DNA, 25 bp, Homo sapien
tcctcagtctgagcggcagccagga

SEQ ID NO: 571044 - DNA, 25 bp, Homo sapien
ccaggaggcagatgccctgcggaat

SEQ ID NO: 571045 - DNA, 25 bp, Homo sapien
agatgccctgcggaatgccctggtg

SEQ ID NO: 571046 - DNA, 25 bp, Homo sapien
atgccctgcggaatgccctggtgcc

SEQ ID NO: 571047 - DNA, 25 bp, Homo sapien
gttggcttgttatgttacctgccca

SEQ ID NO: 571048 - DNA, 25 bp, Homo sapien
tggcttgttatgttacctgcccacc

SEQ ID NO: 571049 - DNA, 25 bp, Homo sapien
tgttatgttacctgcccaccctcat

SEQ ID NO: 571050 - DNA, 25 bp, Homo sapien
ctgcctggagaagacctgctctcag

SEQ ID NO: 571051 - DNA, 25 bp, Homo sapien
gcctggagaagacctgctctcagct

SEQ ID NO: 571052 - DNA, 25 bp, Homo sapien
ctggagaagacctgctctcagctgc

SEQ ID NO: 571053 - DNA, 25 bp, Homo sapien
agctgcccaccgttcctcagtgtga

SEQ ID NO: 571054 - DNA, 25 bp, Homo sapien
gcccaccgttcctcagtgtgagcaa

SEQ ID NO: 571055 - DNA, 25 bp, Homo sapien
cagtgtgagcaagatttgggtctct

SEQ ID NO: 571056 - DNA, 25 bp, Homo sapien
ccagacctctgggaggtagggagtt

SEQ ID NO: 571057 - DNA, 25 bp, Homo sapien
cctggcactggcagcattcagtggg

SEQ ID NO: 571058 - DNA, 25 bp, Homo sapien
cttattagctgagagagcttgttca

SEQ ID NO: 571059 - DNA, 25 bp, Homo sapien
agctgagagagcttgttcaaataaa

SEQ ID NO: 571060 - DNA, 25 bp, Homo sapien
gagcttgttcaaataaactatcaat

SEQ ID NO: 571061 - DNA, 25 bp, Homo sapien
aactatcaatttcttcatccgcaaa

SEQ ID NO: 571062 - DNA, 25 bp, Homo sapien
atcaatttcttcatccgcaaaatgg

SEQ ID NO: 571063 - DNA, 25 bp, Homo sapien
ggttttgccaaattgccaagctttt

SEQ ID NO: 571064 - DNA, 25 bp, Homo sapien
ttttgccaaattgccaagctttttt

SEQ ID NO: 571065 - DNA, 25 bp, Homo sapien
aatgcctggcatgtactagatagat

SEQ ID NO: 571066 - DNA, 25 bp, Homo sapien
ggcatgtactagatagatgatcaca

SEQ ID NO: 571067 - DNA, 25 bp, Homo sapien
tagatgatcacaaaatacggatttt

SEQ ID NO: 571068 - DNA, 25 bp, Homo sapien
tctttttcaatgcaatcatcagttt

SEQ ID NO: 571069 - DNA, 25 bp, Homo sapien
aatttccttgaagtctctcagtagt

SEQ ID NO: 571070 - DNA, 25 bp, Homo sapien
gtctctcagtagtcatttgtgtcta

SEQ ID NO: 571071 - DNA, 25 bp, Homo sapien
gaaagctaaccaaattcgtggattt

SEQ ID NO: 571072 - DNA, 25 bp, Homo sapien
aagccttagggctgattcaggcctg

SEQ ID NO: 571073 - DNA, 25 bp, Homo sapien
gctgattcaggcctggttgtagcaa

SEQ ID NO: 571074 - DNA, 25 bp, Homo sapien
ggttgtagcaatcggctgtctcaaa

SEQ ID NO: 571075 - DNA, 25 bp, Homo sapien
caaaggcctcctgcatgtttaaata

SEQ ID NO: 571076 - DNA, 25 bp, Homo sapien
tgtttaaatagcttctctcctgttt

SEQ ID NO: 571077 - DNA, 25 bp, Homo sapien
gttttatcctgtaagctgtctcgag

SEQ ID NO: 571078 - DNA, 25 bp, Homo sapien
tgtctcgaggcccttccaatataag

SEQ ID NO: 571079 - DNA, 25 bp, Homo sapien
gaggcccttccaatataagcatgag

SEQ ID NO: 571080 - DNA, 25 bp, Homo sapien
ttttatctaccctcaggtttagtct

SEQ ID NO: 571081 - DNA, 25 bp, Homo sapien
tagtctttggggacctgtgaattaa

SEQ ID NO: 571082 - DNA, 25 bp, Homo sapien
gggacctgtgaattaaacagacgaa

SEQ ID NO: 571083 - DNA, 25 bp, Homo sapien
ggacctgtgaattaaacagacgaaa

SEQ ID NO: 571084 - DNA, 25 bp, Homo sapien
gacctgtgaattaaacagacgaaag

SEQ ID NO: 571085 - DNA, 25 bp, Homo sapien
aagatatattaacaagagaaggcca

SEQ ID NO: 571086 - DNA, 25 bp, Homo sapien
tcgaggctgccgtgggctagcatca

SEQ ID NO: 571087 - DNA, 25 bp, Homo sapien
cgaggctgccgtgggctagcatcat

SEQ ID NO: 571088 - DNA, 25 bp, Homo sapien
gctgccgtgggctagcatcatgcca

SEQ ID NO: 571089 - DNA, 25 bp, Homo sapien
ctgccgtgggctagcatcatgccac

SEQ ID NO: 571090 - DNA, 25 bp, Homo sapien
tgccgtgggctagcatcatgccact

SEQ ID NO: 571091 - DNA, 25 bp, Homo sapien
accacatgagataattgacactgaa

SEQ ID NO: 571092 - DNA, 25 bp, Homo sapien
taattgacactgaagggaaacagct

SEQ ID NO: 571093 - DNA, 25 bp, Homo sapien
ggtgctggttcaaaccagagaattc

SEQ ID NO: 571094 - DNA, 25 bp, Homo sapien
gctggttcaaaccagagaattcatg

SEQ ID NO: 571095 - DNA, 25 bp, Homo sapien
gaattcatgctgcagggaaactcaa

SEQ ID NO: 571096 - DNA, 25 bp, Homo sapien
ggaaactcaatcaatgttattgtga

SEQ ID NO: 571097 - DNA, 25 bp, Homo sapien
caatgttattgtgaaaactgggaat

SEQ ID NO: 571098 - DNA, 25 bp, Homo sapien
gaaaactgggaatgtgaatgtaata

SEQ ID NO: 571099 - DNA, 25 bp, Homo sapien
gtagaaaaacatttagccacagccc

SEQ ID NO: 571100 - DNA, 25 bp, Homo sapien
gaaaaacatttagccacagcccaaa

SEQ ID NO: 571101 - DNA, 25 bp, Homo sapien
aacatttagccacagcccaaatctt

SEQ ID NO: 571102 - DNA, 25 bp, Homo sapien
tggtagagttcctttctgggaagaa

SEQ ID NO: 571103 - DNA, 25 bp, Homo sapien
gctcatcacccggatagaggacacg

SEQ ID NO: 571104 - DNA, 25 bp, Homo sapien
aggacacggaccctgtgtggtattt

SEQ ID NO: 571105 - DNA, 25 bp, Homo sapien
gtggtattttggcattttggctcag

SEQ ID NO: 571106 - DNA, 25 bp, Homo sapien
attttggcattttggctcagagtcc

SEQ ID NO: 571107 - DNA, 25 bp, Homo sapien
ggctcagagtccaatgtaccatgtt

SEQ ID NO: 571108 - DNA, 25 bp, Homo sapien
agtccaatgtaccatgttgcccaga

SEQ ID NO: 571109 - DNA, 25 bp, Homo sapien
atgtaccatgttgcccagaatttca

SEQ ID NO: 571110 - DNA, 25 bp, Homo sapien
ggcctttacatgaatacgtcttgat

SEQ ID NO: 571111 - DNA, 25 bp, Homo sapien
tcttgatcagacattcagagattag

SEQ ID NO: 571112 - DNA, 25 bp, Homo sapien
aacagtaaaacaggctgcttagatt

SEQ ID NO: 571113 - DNA, 25 bp, Homo sapien
aatgcctggctaactgtctcacttt

SEQ ID NO: 571114 - DNA, 25 bp, Homo sapien
tgcctggctaactgtctcactttgt

SEQ ID NO: 571115 - DNA, 25 bp, Homo sapien
cctggctaactgtctcactttgttg

SEQ ID NO: 571116 - DNA, 25 bp, Homo sapien
gtgtgatgcatcacacctgctgtct

SEQ ID NO: 571117 - DNA, 25 bp, Homo sapien
acacctgctgtcttttattatataa

SEQ ID NO: 571118 - DNA, 25 bp, Homo sapien
acctgctgtcttttattatataatt

SEQ ID NO: 571119 - DNA, 25 bp, Homo sapien
attatataattttcctacctccctg

SEQ ID NO: 571120 - DNA, 25 bp, Homo sapien
tcctacctccctgaggtttatctaa

SEQ ID NO: 571121 - DNA, 25 bp, Homo sapien
taaaagataattagtgcacccaaat

SEQ ID NO: 571122 - DNA, 25 bp, Homo sapien
gataattagtgcacccaaataagaa

SEQ ID NO: 571123 - DNA, 25 bp, Homo sapien
gtgcacccaaataagaaggtatgta

SEQ ID NO: 571124 - DNA, 25 bp, Homo sapien
tttttcacataagcccagtctctta

SEQ ID NO: 571125 - DNA, 25 bp, Homo sapien
ttcacataagcccagtctcttattt

SEQ ID NO: 571126 - DNA, 25 bp, Homo sapien
taagcccagtctcttatttaaccca

SEQ ID NO: 571127 - DNA, 25 bp, Homo sapien
aagcccagtctcttatttaacccat

SEQ ID NO: 571128 - DNA, 25 bp, Homo sapien
agcccagtctcttatttaacccatc

SEQ ID NO: 571129 - DNA, 25 bp, Homo sapien
agtctcttatttaacccatccactg

SEQ ID NO: 571130 - DNA, 25 bp, Homo sapien
gtctcttatttaacccatccactga

SEQ ID NO: 571131 - DNA, 25 bp, Homo sapien
tctcttatttaacccatccactgaa

SEQ ID NO: 571132 - DNA, 25 bp, Homo sapien
tcttatttaacccatccactgaatt

SEQ ID NO: 571133 - DNA, 25 bp, Homo sapien
ttatttaacccatccactgaatttt

SEQ ID NO: 571134 - DNA, 25 bp, Homo sapien
tatttaacccatccactgaattttt

SEQ ID NO: 571135 - DNA, 25 bp, Homo sapien
gcaaacatgtctctcctataagcaa

SEQ ID NO: 571136 - DNA, 25 bp, Homo sapien
ttttcccctttattgttgacacagt

SEQ ID NO: 571137 - DNA, 25 bp, Homo sapien
gacacagtatctctttacgatggtg

SEQ ID NO: 571138 - DNA, 25 bp, Homo sapien
ttcctcttctgctatgattaagttt

SEQ ID NO: 571139 - DNA, 25 bp, Homo sapien
ttcagaacctggcagctacgtgcat

SEQ ID NO: 571140 - DNA, 25 bp, Homo sapien
ctacgtgcatgagcacagcctctga

SEQ ID NO: 571141 - DNA, 25 bp, Homo sapien
catgctgtcagatgccgggtgtgaa

SEQ ID NO: 571142 - DNA, 25 bp, Homo sapien
gaaactctggcacttgggattgata

SEQ ID NO: 571143 - DNA, 25 bp, Homo sapien
tgggattgataaggctggcaccaaa

SEQ ID NO: 571144 - DNA, 25 bp, Homo sapien
caaaaggagcgtccaccactgggtg

SEQ ID NO: 571145 - DNA, 25 bp, Homo sapien
cactgggtggattccattattgttc

SEQ ID NO: 571146 - DNA, 25 bp, Homo sapien
caactaatttcagatgtgtcagata

SEQ ID NO: 571147 - DNA, 25 bp, Homo sapien
gaatggatatggctctagtacaata

SEQ ID NO: 571148 - DNA, 25 bp, Homo sapien
tggctctagtacaatatgggataat

SEQ ID NO: 571149 - DNA, 25 bp, Homo sapien
cagatagatagatgccctgtattct

SEQ ID NO: 571150 - DNA, 25 bp, Homo sapien
atagatgccctgtattctgtgtagc

SEQ ID NO: 571151 - DNA, 25 bp, Homo sapien
gccctgtattctgtgtagcaagcat

SEQ ID NO: 571152 - DNA, 25 bp, Homo sapien
gtgtagcaagcataactagagaatc

SEQ ID NO: 571153 - DNA, 25 bp, Homo sapien
gagaatcaatgttagtgctcaaact

SEQ ID NO: 571154 - DNA, 25 bp, Homo sapien
agtgctcaaactaagaagacttttg

SEQ ID NO: 571155 - DNA, 25 bp, Homo sapien
acaaatatacatttccatccatcca

SEQ ID NO: 571156 - DNA, 25 bp, Homo sapien
atccctgttgagctccaactatgtg

SEQ ID NO: 571157 - DNA, 25 bp, Homo sapien
atctcatcttgagttatggttccta

SEQ ID NO: 571158 - DNA, 25 bp, Homo sapien
gagttatggttcctattatccccac

SEQ ID NO: 571159 - DNA, 25 bp, Homo sapien
tatggttcctattatccccacgtgt

SEQ ID NO: 571160 - DNA, 25 bp, Homo sapien
tcctattatccccacgtgttatggg

SEQ ID NO: 571161 - DNA, 25 bp, Homo sapien
aaataatcagagcagttttccccat

SEQ ID NO: 571162 - DNA, 25 bp, Homo sapien
taatcagagcagttttccccatcct

SEQ ID NO: 571163 - DNA, 25 bp, Homo sapien
agcagttttccccatcctgttctca

SEQ ID NO: 571164 - DNA, 25 bp, Homo sapien
ggcttcctgcttcactgggtactca

SEQ ID NO: 571165 - DNA, 25 bp, Homo sapien
ctgcttcactgggtactcattcttc

SEQ ID NO: 571166 - DNA, 25 bp, Homo sapien
tgtttccccatccaccataattgta

SEQ ID NO: 571167 - DNA, 25 bp, Homo sapien
tcctgtggcttccctaaccatgtgg

SEQ ID NO: 571168 - DNA, 25 bp, Homo sapien
gtggcagacacgcagaagtgctact

SEQ ID NO: 571169 - DNA, 25 bp, Homo sapien
gacacgcagaagtgctactagtgac

SEQ ID NO: 571170 - DNA, 25 bp, Homo sapien
gctactagtgacagggctgccatcg

SEQ ID NO: 571171 - DNA, 25 bp, Homo sapien
tagtgacagggctgccatcgctcac

SEQ ID NO: 571172 - DNA, 25 bp, Homo sapien
atcgctcacctgtacctatttacac

SEQ ID NO: 571173 - DNA, 25 bp, Homo sapien
ctgtacctatttacacccagaactt

SEQ ID NO: 571174 - DNA, 25 bp, Homo sapien
tatttacacccagaactttccagct

SEQ ID NO: 571175 - DNA, 25 bp, Homo sapien
gcccaactcattcttactgcacagt

SEQ ID NO: 571176 - DNA, 25 bp, Homo sapien
actgcacagttcactttatttaaca

SEQ ID NO: 571177 - DNA, 25 bp, Homo sapien
tgggccaggcatagattaagtaact

SEQ ID NO: 571178 - DNA, 25 bp, Homo sapien
taaagctgggcttctttctcatctc

SEQ ID NO: 571179 - DNA, 25 bp, Homo sapien
gaagagttagatataaggcagcaac

SEQ ID NO: 571180 - DNA, 25 bp, Homo sapien
atataaggcagcaactagaggaata

SEQ ID NO: 571181 - DNA, 25 bp, Homo sapien
taaggcagcaactagaggaatagga

SEQ ID NO: 571182 - DNA, 25 bp, Homo sapien
gaggatattgcttaagtttgccaaa

SEQ ID NO: 571183 - DNA, 25 bp, Homo sapien
gatattgcttaagtttgccaaattg

SEQ ID NO: 571184 - DNA, 25 bp, Homo sapien
gcttaagtttgccaaattgttcaat

SEQ ID NO: 571185 - DNA, 25 bp, Homo sapien
gtttgccaaattgttcaatggcttt

SEQ ID NO: 571186 - DNA, 25 bp, Homo sapien
caaattgttcaatggctttattcaa

SEQ ID NO: 571187 - DNA, 25 bp, Homo sapien
attgttcaatggctttattcaagga

SEQ ID NO: 571188 - DNA, 25 bp, Homo sapien
gttcaatggctttattcaaggaaat

SEQ ID NO: 571189 - DNA, 25 bp, Homo sapien
caatggctttattcaaggaaatttt

SEQ ID NO: 571190 - DNA, 25 bp, Homo sapien
aatgatgtgaagatctacctgtaaa

SEQ ID NO: 571191 - DNA, 25 bp, Homo sapien
tacctgtaaatagttcctctgtcgt

SEQ ID NO: 571192 - DNA, 25 bp, Homo sapien
aaatagttcctctgtcgtatgctgg

SEQ ID NO: 571193 - DNA, 25 bp, Homo sapien
ttcctctgtcgtatgctggtattta

SEQ ID NO: 571194 - DNA, 25 bp, Homo sapien
gtcgtatgctggtatttatattcta

SEQ ID NO: 571195 - DNA, 25 bp, Homo sapien
tttatattctagcatctcaacagtg

SEQ ID NO: 571196 - DNA, 25 bp, Homo sapien
tagcatctcaacagtgctgatggtc

SEQ ID NO: 571197 - DNA, 25 bp, Homo sapien
tcaacagtgctgatggtcactcatc

SEQ ID NO: 571198 - DNA, 25 bp, Homo sapien
gatggtcactcatcttggagttccc

SEQ ID NO: 571199 - DNA, 25 bp, Homo sapien
gtcactcatcttggagttccctgaa

SEQ ID NO: 571200 - DNA, 25 bp, Homo sapien
ctcatcttggagttccctgaatttt

SEQ ID NO: 571201 - DNA, 25 bp, Homo sapien
atggagttcccaaaccagttctggt

SEQ ID NO: 571202 - DNA, 25 bp, Homo sapien
accagttctggtttggagccaccca

SEQ ID NO: 571203 - DNA, 25 bp, Homo sapien
gagccacccaattcttgaatcacta

SEQ ID NO: 571204 - DNA, 25 bp, Homo sapien
attcttgaatcactatttgctcaaa

SEQ ID NO: 571205 - DNA, 25 bp, Homo sapien
tatttgctcaaataagcccattaaa

SEQ ID NO: 571206 - DNA, 25 bp, Homo sapien
tgtacctcggtttactctttagcaa

SEQ ID NO: 571207 - DNA, 25 bp, Homo sapien
tttggaatgccccagtatgacaggc

SEQ ID NO: 571208 - DNA, 25 bp, Homo sapien
tatgacaggcagtgggcacaccgct

SEQ ID NO: 571209 - DNA, 25 bp, Homo sapien
gggcacaccgctggaaatacagcat

SEQ ID NO: 571210 - DNA, 25 bp, Homo sapien
tttcttgacctcgtgggattttcat

SEQ ID NO: 571211 - DNA, 25 bp, Homo sapien
tgacctcgtgggattttcattctag

SEQ ID NO: 571212 - DNA, 25 bp, Homo sapien
tgggaggccgaagctcgtggactac

SEQ ID NO: 571213 - DNA, 25 bp, Homo sapien
gggaggccgaagctcgtggactacc

SEQ ID NO: 571214 - DNA, 25 bp, Homo sapien
ggaggccgaagctcgtggactacct

SEQ ID NO: 571215 - DNA, 25 bp, Homo sapien
gaggccgaagctcgtggactacctg

SEQ ID NO: 571216 - DNA, 25 bp, Homo sapien
aggccgaagctcgtggactacctga

SEQ ID NO: 571217 - DNA, 25 bp, Homo sapien
ggccgaagctcgtggactacctgag

SEQ ID NO: 571218 - DNA, 25 bp, Homo sapien
gccgaagctcgtggactacctgagg

SEQ ID NO: 571219 - DNA, 25 bp, Homo sapien
ccgaagctcgtggactacctgaggt

SEQ ID NO: 571220 - DNA, 25 bp, Homo sapien
cgaagctcgtggactacctgaggtc

SEQ ID NO: 571221 - DNA, 25 bp, Homo sapien
atgtgacactggaccacgagggagt

SEQ ID NO: 571222 - DNA, 25 bp, Homo sapien
gttggaagtggagtgcccttctcat

SEQ ID NO: 571223 - DNA, 25 bp, Homo sapien
gagtgcccttctcatttgaagctga

SEQ ID NO: 571224 - DNA, 25 bp, Homo sapien
taaccagctgactctgatgacctca

SEQ ID NO: 571225 - DNA, 25 bp, Homo sapien
gatgacctcagggaaagtgtctcat

SEQ ID NO: 571226 - DNA, 25 bp, Homo sapien
gtgtctcatagtgtggcatgggcca

SEQ ID NO: 571227 - DNA, 25 bp, Homo sapien
tgggccattggagaaaacgggatac

SEQ ID NO: 571228 - DNA, 25 bp, Homo sapien
gatacctttaattcctccattgtca

SEQ ID NO: 571229 - DNA, 25 bp, Homo sapien
cagaacatcggatttcggagtgctt

SEQ ID NO: 571230 - DNA, 25 bp, Homo sapien
atctattggcacatcaggactgaca

SEQ ID NO: 571231 - DNA, 25 bp, Homo sapien
aagtgggcagcagagtccaagctcg

SEQ ID NO: 571232 - DNA, 25 bp, Homo sapien
gaagcctcagagattacacagttag

SEQ ID NO: 571233 - DNA, 25 bp, Homo sapien
gttaggatgctgacacagtctagaa

SEQ ID NO: 571234 - DNA, 25 bp, Homo sapien
gctgacacagtctagaatccataat

SEQ ID NO: 571235 - DNA, 25 bp, Homo sapien
tagaatccataatgctccctacatc

SEQ ID NO: 571236 - DNA, 25 bp, Homo sapien
ctacatctcacactaacaggcaaat

SEQ ID NO: 571237 - DNA, 25 bp, Homo sapien
acaggcaaattcagatgctgggatt

SEQ ID NO: 571238 - DNA, 25 bp, Homo sapien
gattggcaatgatttaagcaccttc

SEQ ID NO: 571239 - DNA, 25 bp, Homo sapien
aagcaccttcactaaagtcttattt

SEQ ID NO: 571240 - DNA, 25 bp, Homo sapien
acagttacagtctaattgtcttgga

SEQ ID NO: 571241 - DNA, 25 bp, Homo sapien
gatatattgggttcacattctggag

SEQ ID NO: 571242 - DNA, 25 bp, Homo sapien
ctggagttctctttattttccacca

SEQ ID NO: 571243 - DNA, 25 bp, Homo sapien
gggtagttagatatctctgtataac

SEQ ID NO: 571244 - DNA, 25 bp, Homo sapien
gatatctctgtataacacctatata

SEQ ID NO: 571245 - DNA, 25 bp, Homo sapien
ataataactcctatatgatacagaa

SEQ ID NO: 571246 - DNA, 25 bp, Homo sapien
aaatgttctcattactttagaggta

SEQ ID NO: 571247 - DNA, 25 bp, Homo sapien
gttctcattactttagaggtagtta

SEQ ID NO: 571248 - DNA, 25 bp, Homo sapien
gaggtagttagatatctccatataa

SEQ ID NO: 571249 - DNA, 25 bp, Homo sapien
tagttagatatctccatataatgcc

SEQ ID NO: 571250 - DNA, 25 bp, Homo sapien
aagatggtctcattactttgggagt

SEQ ID NO: 571251 - DNA, 25 bp, Homo sapien
ggtctcattactttgggagtagtta

SEQ ID NO: 571252 - DNA, 25 bp, Homo sapien
ggagtagttataaatctccctataa

SEQ ID NO: 571253 - DNA, 25 bp, Homo sapien
ataaatctccctataatgcctgtat

SEQ ID NO: 571254 - DNA, 25 bp, Homo sapien
tcctccctcctcaagcaaacctcag

SEQ ID NO: 571255 - DNA, 25 bp, Homo sapien
cctccctcctcaagcaaacctcagt

SEQ ID NO: 571256 - DNA, 25 bp, Homo sapien
ctccctcctcaagcaaacctcagtg

SEQ ID NO: 571257 - DNA, 25 bp, Homo sapien
tccctcctcaagcaaacctcagtgc

SEQ ID NO: 571258 - DNA, 25 bp, Homo sapien
ccctcctcaagcaaacctcagtgct

SEQ ID NO: 571259 - DNA, 25 bp, Homo sapien
cctcctcaagcaaacctcagtgctg

SEQ ID NO: 571260 - DNA, 25 bp, Homo sapien
ctcctcaagcaaacctcagtgctgg

SEQ ID NO: 571261 - DNA, 25 bp, Homo sapien
tcctcaagcaaacctcagtgctggg

SEQ ID NO: 571262 - DNA, 25 bp, Homo sapien
cctcaagcaaacctcagtgctggga

SEQ ID NO: 571263 - DNA, 25 bp, Homo sapien
ctcaagcaaacctcagtgctgggat

SEQ ID NO: 571264 - DNA, 25 bp, Homo sapien
gggagctccaggtaatgaggaacac

SEQ ID NO: 571265 - DNA, 25 bp, Homo sapien
gtaatgaggaacaccggctgctagt

SEQ ID NO: 571266 - DNA, 25 bp, Homo sapien
gaggaacaccggctgctagttagca

SEQ ID NO: 571267 - DNA, 25 bp, Homo sapien
aacaccggctgctagttagcaagat

SEQ ID NO: 571268 - DNA, 25 bp, Homo sapien
gctagttagcaagatgaccctgaat

SEQ ID NO: 571269 - DNA, 25 bp, Homo sapien
gttagcaagatgaccctgaattgag

SEQ ID NO: 571270 - DNA, 25 bp, Homo sapien
agatgaccctgaattgagagtaaga

SEQ ID NO: 571271 - DNA, 25 bp, Homo sapien
ttgagagtaagagagggcttgttat

SEQ ID NO: 571272 - DNA, 25 bp, Homo sapien
ttatggggacttttcaggtggcaga

SEQ ID NO: 571273 - DNA, 25 bp, Homo sapien
gcagaaagagatgttctgtttctgg

SEQ ID NO: 571274 - DNA, 25 bp, Homo sapien
ctgtttctggtgatacaacatctta

SEQ ID NO: 571275 - DNA, 25 bp, Homo sapien
gccctgataaaactctttacctgga

SEQ ID NO: 571276 - DNA, 25 bp, Homo sapien
tcattaaatttcacaacatcctttt

SEQ ID NO: 571277 - DNA, 25 bp, Homo sapien
aaaagttcttcagatttcttgtgat

SEQ ID NO: 571278 - DNA, 25 bp, Homo sapien
ttcttgtgatttcttcaggcggtct

SEQ ID NO: 571279 - DNA, 25 bp, Homo sapien
tttcttcaggcggtcttgggactcc

SEQ ID NO: 571280 - DNA, 25 bp, Homo sapien
tagcctccgacctggaatagatctc

SEQ ID NO: 571281 - DNA, 25 bp, Homo sapien
aatagatctctcttcacacttcact

SEQ ID NO: 571282 - DNA, 25 bp, Homo sapien
ccacagagcccttcattttaacttc

SEQ ID NO: 571283 - DNA, 25 bp, Homo sapien
ttttaacttccctatccaaagcaag

SEQ ID NO: 571284 - DNA, 25 bp, Homo sapien
ttagagggcttactctgtgccaagc

SEQ ID NO: 571285 - DNA, 25 bp, Homo sapien
ctgtgccaagccctgataaaactct

SEQ ID NO: 571286 - DNA, 25 bp, Homo sapien
caaggacccgtttgaaggctgttca

SEQ ID NO: 571287 - DNA, 25 bp, Homo sapien
cgtttgaaggctgttcacgccagtc

SEQ ID NO: 571288 - DNA, 25 bp, Homo sapien
gccagtcactgcaatcaccattgag

SEQ ID NO: 571289 - DNA, 25 bp, Homo sapien
gcaatcaccattgagcacagagatg

SEQ ID NO: 571290 - DNA, 25 bp, Homo sapien
cagagatgacagttccagcaagcac

SEQ ID NO: 571291 - DNA, 25 bp, Homo sapien
gttccagcaagcactgaccttccag

SEQ ID NO: 571292 - DNA, 25 bp, Homo sapien
ttccagcccactctgcggaggagaa

SEQ ID NO: 571293 - DNA, 25 bp, Homo sapien
gaggatgttgatttgctgcagttga

SEQ ID NO: 571294 - DNA, 25 bp, Homo sapien
gctgcagttgactctgaccctaatt

SEQ ID NO: 571295 - DNA, 25 bp, Homo sapien
tgaccctaatttcccggcgctgact

SEQ ID NO: 571296 - DNA, 25 bp, Homo sapien
ggcgctgactcaaactcatcaggaa

SEQ ID NO: 571297 - DNA, 25 bp, Homo sapien
tcctttccacccctttctgctcacg

SEQ ID NO: 571298 - DNA, 25 bp, Homo sapien
cctttccacccctttctgctcacga

SEQ ID NO: 571299 - DNA, 25 bp, Homo sapien
ctttccacccctttctgctcacgac

SEQ ID NO: 571300 - DNA, 25 bp, Homo sapien
tttccacccctttctgctcacgacc

SEQ ID NO: 571301 - DNA, 25 bp, Homo sapien
ctttctgctcacgacccccatcatt

SEQ ID NO: 571302 - DNA, 25 bp, Homo sapien
ttctgctcacgacccccatcattca

SEQ ID NO: 571303 - DNA, 25 bp, Homo sapien
ccatcattcacgctcagaacaggat

SEQ ID NO: 571304 - DNA, 25 bp, Homo sapien
catcattcacgctcagaacaggatt

SEQ ID NO: 571305 - DNA, 25 bp, Homo sapien
atcattcacgctcagaacaggattt

SEQ ID NO: 571306 - DNA, 25 bp, Homo sapien
tcattcacgctcagaacaggatttt

SEQ ID NO: 571307 - DNA, 25 bp, Homo sapien
cattcacgctcagaacaggattttg

SEQ ID NO: 571308 - DNA, 25 bp, Homo sapien
aaacccaggcttagtaaatcaacat

SEQ ID NO: 571309 - DNA, 25 bp, Homo sapien
ttcagagtaatttgtcttgggaaca

SEQ ID NO: 571310 - DNA, 25 bp, Homo sapien
ggaacaaagtcctccctagagcgaa

SEQ ID NO: 571311 - DNA, 25 bp, Homo sapien
tccctagagcgaagaggcattcaca

SEQ ID NO: 571312 - DNA, 25 bp, Homo sapien
gcattcacaggagctcttggtgtta

SEQ ID NO: 571313 - DNA, 25 bp, Homo sapien
gagctcttggtgttaatgggattat

SEQ ID NO: 571314 - DNA, 25 bp, Homo sapien
tatttgatgattttgccaagcacta

SEQ ID NO: 571315 - DNA, 25 bp, Homo sapien
tttgccaagcactagggtttctttg

SEQ ID NO: 571316 - DNA, 25 bp, Homo sapien
ggtttctttgcagtttgtctttggc

SEQ ID NO: 571317 - DNA, 25 bp, Homo sapien
cagtttgtctttggctgacgttttc

SEQ ID NO: 571318 - DNA, 25 bp, Homo sapien
ctttgtggcttcaccagattttgca

SEQ ID NO: 571319 - DNA, 25 bp, Homo sapien
tctctcctaggtttctatacccagc

SEQ ID NO: 571320 - DNA, 25 bp, Homo sapien
tctcctaggtttctatacccagcaa

SEQ ID NO: 571321 - DNA, 25 bp, Homo sapien
ttctatacccagcaaaaccgtcttt

SEQ ID NO: 571322 - DNA, 25 bp, Homo sapien
atacccagcaaaaccgtctttcaag

SEQ ID NO: 571323 - DNA, 25 bp, Homo sapien
cagcaaaaccgtctttcaagaaagg

SEQ ID NO: 571324 - DNA, 25 bp, Homo sapien
caaagatatttttcagacatagaaa

SEQ ID NO: 571325 - DNA, 25 bp, Homo sapien
agtaatatattatcagcaaacctgg

SEQ ID NO: 571326 - DNA, 25 bp, Homo sapien
atattatcagcaaacctggactatg

SEQ ID NO: 571327 - DNA, 25 bp, Homo sapien
attatcagcaaacctggactatgag

SEQ ID NO: 571328 - DNA, 25 bp, Homo sapien
gagaacagtgtaaaagcctttcagg

SEQ ID NO: 571329 - DNA, 25 bp, Homo sapien
tatacaatacctgcccttattactt

SEQ ID NO: 571330 - DNA, 25 bp, Homo sapien
tttttcacataagcccagtctctta

SEQ ID NO: 571331 - DNA, 25 bp, Homo sapien
tctcttatttaacccatccactgaa

SEQ ID NO: 571332 - DNA, 25 bp, Homo sapien
tctttcttgaattttcctggttatt

SEQ ID NO: 571333 - DNA, 25 bp, Homo sapien
tcctggttatttttgattttctgtt

SEQ ID NO: 571334 - DNA, 25 bp, Homo sapien
gattttctgttgttctttgctcatt

SEQ ID NO: 571335 - DNA, 25 bp, Homo sapien
ttctgttgttctttgctcatttatt

SEQ ID NO: 571336 - DNA, 25 bp, Homo sapien
tctgttgttctttgctcatttattt

SEQ ID NO: 571337 - DNA, 25 bp, Homo sapien
tcatttatttccactctgttttatt

SEQ ID NO: 571338 - DNA, 25 bp, Homo sapien
atttccactctgttttatttacata

SEQ ID NO: 571339 - DNA, 25 bp, Homo sapien
ttccactctgttttatttacataat

SEQ ID NO: 571340 - DNA, 25 bp, Homo sapien
aattccagtatcttaatttcttaag

SEQ ID NO: 571341 - DNA, 25 bp, Homo sapien
acagagggtcccgaggcagcctcaa

SEQ ID NO: 571342 - DNA, 25 bp, Homo sapien
gaggcagcctcaatgagcagatcgc

SEQ ID NO: 571343 - DNA, 25 bp, Homo sapien
agcagatcgccctcgtgctgatgag

SEQ ID NO: 571344 - DNA, 25 bp, Homo sapien
tgtccttcagagactgcagaaactg

SEQ ID NO: 571345 - DNA, 25 bp, Homo sapien
gcaggcaaaatcatcaacatcaaca

SEQ ID NO: 571346 - DNA, 25 bp, Homo sapien
atcaacattgcagactgctcctcag

SEQ ID NO: 571347 - DNA, 25 bp, Homo sapien
acctcacagagaccatcttggtggc

SEQ ID NO: 571348 - DNA, 25 bp, Homo sapien
atcttggtggcccttcgagatgtct

SEQ ID NO: 571349 - DNA, 25 bp, Homo sapien
tcgagatgtctcctggtgtgctaac

SEQ ID NO: 571350 - DNA, 25 bp, Homo sapien
ggtgtgctaacgtttgccatcatat

SEQ ID NO: 571351 - DNA, 25 bp, Homo sapien
ccatcatatggccttttattgcaca

SEQ ID NO: 571352 - DNA, 25 bp, Homo sapien
gaagcagctctgagaacagattaat

SEQ ID NO: 571353 - DNA, 25 bp, Homo sapien
gaacagattaatgcctggatgccaa

SEQ ID NO: 571354 - DNA, 25 bp, Homo sapien
acagattaatgcctggatgccaagg

SEQ ID NO: 571355 - DNA, 25 bp, Homo sapien
aggagcaatgaagttcacccatctt

SEQ ID NO: 571356 - DNA, 25 bp, Homo sapien
gagcaatgaagttcacccatcttat

SEQ ID NO: 571357 - DNA, 25 bp, Homo sapien
gggctgagctaatctccttaaacct

SEQ ID NO: 571358 - DNA, 25 bp, Homo sapien
gagctaatctccttaaacctttgta

SEQ ID NO: 571359 - DNA, 25 bp, Homo sapien
gctaatctccttaaacctttgtaca

SEQ ID NO: 571360 - DNA, 25 bp, Homo sapien
tccttaaacctttgtacaagagcgg

SEQ ID NO: 571361 - DNA, 25 bp, Homo sapien
aatgtgctttcaaagccccacttca

SEQ ID NO: 571362 - DNA, 25 bp, Homo sapien
aaagccccacttcaaagagggagat

SEQ ID NO: 571363 - DNA, 25 bp, Homo sapien
tgggtgggccctaaacaccatcaaa

SEQ ID NO: 571364 - DNA, 25 bp, Homo sapien
gggccctaaacaccatcaaaagcat

SEQ ID NO: 571365 - DNA, 25 bp, Homo sapien
aagcatccttataagtaagaggcaa

SEQ ID NO: 571366 - DNA, 25 bp, Homo sapien
gaggcaaagataggctagacacaca

SEQ ID NO: 571367 - DNA, 25 bp, Homo sapien
gataggctagacacacagagagaag

SEQ ID NO: 571368 - DNA, 25 bp, Homo sapien
gaatgctggcagataccagaacctg

SEQ ID NO: 571369 - DNA, 25 bp, Homo sapien
gctggcagataccagaacctggaag

SEQ ID NO: 571370 - DNA, 25 bp, Homo sapien
agagtcaaggaatggcccctccctt

SEQ ID NO: 571371 - DNA, 25 bp, Homo sapien
ggcattgtggccctgacaacacatg

SEQ ID NO: 571372 - DNA, 25 bp, Homo sapien
gacaacacatgcagttcagacatct

SEQ ID NO: 571373 - DNA, 25 bp, Homo sapien
acacatgcagttcagacatctggcc

SEQ ID NO: 571374 - DNA, 25 bp, Homo sapien
gacagaagcccatggtgttaaaaac

SEQ ID NO: 571375 - DNA, 25 bp, Homo sapien
gtgttaaaaacagccacaggaatta

SEQ ID NO: 571376 - DNA, 25 bp, Homo sapien
gaattatgtagaacagtgattctca

SEQ ID NO: 571377 - DNA, 25 bp, Homo sapien
aaagtgaggtccacaaactctcggg

SEQ ID NO: 571378 - DNA, 25 bp, Homo sapien
gctcccatgacccttgtaggaggtc

SEQ ID NO: 571379 - DNA, 25 bp, Homo sapien
cttgtaggaggtccacacaagccaa

SEQ ID NO: 571380 - DNA, 25 bp, Homo sapien
atctctatatggatactaaggtgtt

SEQ ID NO: 571381 - DNA, 25 bp, Homo sapien
gttatttgttgatttcgttctcatg

SEQ ID NO: 571382 - DNA, 25 bp, Homo sapien
tgatttcgttctcatgagcacatga

SEQ ID NO: 571383 - DNA, 25 bp, Homo sapien
catgaatgcagaatggagatttccg

SEQ ID NO: 571384 - DNA, 25 bp, Homo sapien
cggaggctaccggaaaggtgatatt

SEQ ID NO: 571385 - DNA, 25 bp, Homo sapien
ggactgtggctccaactgatagtgt

SEQ ID NO: 571386 - DNA, 25 bp, Homo sapien
ggctccaactgatagtgtgactgta

SEQ ID NO: 571387 - DNA, 25 bp, Homo sapien
gactgtaacttcataagagacgctg

SEQ ID NO: 571388 - DNA, 25 bp, Homo sapien
ataagagacgctgaaccagaccacc

SEQ ID NO: 571389 - DNA, 25 bp, Homo sapien
tgaaccagaccacccaataagacac

SEQ ID NO: 571390 - DNA, 25 bp, Homo sapien
caataagacactcccagattcccta

SEQ ID NO: 571391 - DNA, 25 bp, Homo sapien
agattccctactctcaaaagttgtg

SEQ ID NO: 571392 - DNA, 25 bp, Homo sapien
tccctactctcaaaagttgtgtgaa

SEQ ID NO: 571393 - DNA, 25 bp, Homo sapien
gttgtgtgaaataatcacccccagt

SEQ ID NO: 571394 - DNA, 25 bp, Homo sapien
ccccagttgtattaaactgctaagt

SEQ ID NO: 571395 - DNA, 25 bp, Homo sapien
gtgtgttacacagcaataaatcata

SEQ ID NO: 571396 - DNA, 25 bp, Homo sapien
ttctgttgttctttgctcatttatt

SEQ ID NO: 571397 - DNA, 25 bp, Homo sapien
tctgttgttctttgctcatttattt

SEQ ID NO: 571398 - DNA, 25 bp, Homo sapien
tcatttatttccactctgttttatt

SEQ ID NO: 571399 - DNA, 25 bp, Homo sapien
catttatttccactctgttttattt

SEQ ID NO: 571400 - DNA, 25 bp, Homo sapien
ttatttccactctgttttatttaca

SEQ ID NO: 571401 - DNA, 25 bp, Homo sapien
tatttccactctgttttatttacat

SEQ ID NO: 571402 - DNA, 25 bp, Homo sapien
atttccactctgttttatttacata

SEQ ID NO: 571403 - DNA, 25 bp, Homo sapien
ttccactctgttttatttacataat

SEQ ID NO: 571404 - DNA, 25 bp, Homo sapien
ataattccagtatcttaatttctta

SEQ ID NO: 571405 - DNA, 25 bp, Homo sapien
taattccagtatcttaatttcttaa

SEQ ID NO: 571406 - DNA, 25 bp, Homo sapien
aattccagtatcttaatttcttaag

SEQ ID NO: 571407 - DNA, 25 bp, Homo sapien
aaaccctcatctgagtagcaagatt

SEQ ID NO: 571408 - DNA, 25 bp, Homo sapien
gatgactaagccattaacagcatgc

SEQ ID NO: 571409 - DNA, 25 bp, Homo sapien
gccattaacagcatgcattcatatt

SEQ ID NO: 571410 - DNA, 25 bp, Homo sapien
aattttattgactcctgccatcagc

SEQ ID NO: 571411 - DNA, 25 bp, Homo sapien
cagcttttgtagatcgtttgggtgg

SEQ ID NO: 571412 - DNA, 25 bp, Homo sapien
ggttgtgatttttactgggaggact

SEQ ID NO: 571413 - DNA, 25 bp, Homo sapien
gtatataattctttctgggactgct

SEQ ID NO: 571414 - DNA, 25 bp, Homo sapien
aattctttctgggactgcttaaatg

SEQ ID NO: 571415 - DNA, 25 bp, Homo sapien
ctgggactgcttaaatgttattgtt

SEQ ID NO: 571416 - DNA, 25 bp, Homo sapien
ctttggtcaaagagatgtgcttaaa

SEQ ID NO: 571417 - DNA, 25 bp, Homo sapien
aaattcttattccttcacaataaat

SEQ ID NO: 571418 - DNA, 25 bp, Homo sapien
atcacgaaaattcttggacttgcaa

SEQ ID NO: 571419 - DNA, 25 bp, Homo sapien
aagcctactaacaaaataagtgcta

SEQ ID NO: 571420 - DNA, 25 bp, Homo sapien
gtttcttttgaaataaggcattcta

SEQ ID NO: 571421 - DNA, 25 bp, Homo sapien
taaggcattctaattatctcagtat

SEQ ID NO: 571422 - DNA, 25 bp, Homo sapien
aattatctcagtatgtctgccaacc

SEQ ID NO: 571423 - DNA, 25 bp, Homo sapien
tctcagtatgtctgccaaccaaata

SEQ ID NO: 571424 - DNA, 25 bp, Homo sapien
atgtctgccaaccaaataatgggaa

SEQ ID NO: 571425 - DNA, 25 bp, Homo sapien
taaaaacactcttacatccatggcc

SEQ ID NO: 571426 - DNA, 25 bp, Homo sapien
acactcttacatccatggcctaaat

SEQ ID NO: 571427 - DNA, 25 bp, Homo sapien
acatccatggcctaaatactataga

SEQ ID NO: 571428 - DNA, 25 bp, Homo sapien
gcatttcctctatacaagggtgctt

SEQ ID NO: 571429 - DNA, 25 bp, Homo sapien
ttccacaactggatatatctactgt

SEQ ID NO: 571430 - DNA, 25 bp, Homo sapien
ggatatatctactgtaactggtgaa

SEQ ID NO: 571431 - DNA, 25 bp, Homo sapien
ctactgtaactggtgaaacaggaat

SEQ ID NO: 571432 - DNA, 25 bp, Homo sapien
aaatgatggcatactttgtagctgg

SEQ ID NO: 571433 - DNA, 25 bp, Homo sapien
gatggcatactttgtagctggtaaa

SEQ ID NO: 571434 - DNA, 25 bp, Homo sapien
ggcatactttgtagctggtaaacag

SEQ ID NO: 571435 - DNA, 25 bp, Homo sapien
ctttgtagctggtaaacaggactat

SEQ ID NO: 571436 - DNA, 25 bp, Homo sapien
gctggtaaacaggactatgaattga

SEQ ID NO: 571437 - DNA, 25 bp, Homo sapien
gaattgaaatgttggcatactttaa

SEQ ID NO: 571438 - DNA, 25 bp, Homo sapien
taaagttttataactaggtagctga

SEQ ID NO: 571439 - DNA, 25 bp, Homo sapien
aggtagctgaaaatatatcaatcca

SEQ ID NO: 571440 - DNA, 25 bp, Homo sapien
gacgcagccccgcaagaccaagggc

SEQ ID NO: 571441 - DNA, 25 bp, Homo sapien
ccgtgcagtccatgaggcagcgagc

SEQ ID NO: 571442 - DNA, 25 bp, Homo sapien
gtgcagtccatgaggcagcgagccc

SEQ ID NO: 571443 - DNA, 25 bp, Homo sapien
agtccatgaggcagcgagcccctca

SEQ ID NO: 571444 - DNA, 25 bp, Homo sapien
catgaggcagcgagcccctcacaga

SEQ ID NO: 571445 - DNA, 25 bp, Homo sapien
tcacagaccgtccagcgagcggtgt

SEQ ID NO: 571446 - DNA, 25 bp, Homo sapien
gaccgtccagcgagcggtgtctgta

SEQ ID NO: 571447 - DNA, 25 bp, Homo sapien
gtccagcgagcggtgtctgtaaatc

SEQ ID NO: 571448 - DNA, 25 bp, Homo sapien
gcgagcggtgtctgtaaatcccggt

SEQ ID NO: 571449 - DNA, 25 bp, Homo sapien
gagcggtgtctgtaaatcccggtaa

SEQ ID NO: 571450 - DNA, 25 bp, Homo sapien
ggtgtctgtaaatcccggtaaatga

SEQ ID NO: 571451 - DNA, 25 bp, Homo sapien
taacagcgtgaagttgctcaatttg

SEQ ID NO: 571452 - DNA, 25 bp, Homo sapien
tgctcaatttgagaatccatttcct

SEQ ID NO: 571453 - DNA, 25 bp, Homo sapien
tgtgcttacaacagatgcagggctt

SEQ ID NO: 571454 - DNA, 25 bp, Homo sapien
gatgcagggcttgttcaatgtatca

SEQ ID NO: 571455 - DNA, 25 bp, Homo sapien
gcttgttcaatgtatcataggccgt

SEQ ID NO: 571456 - DNA, 25 bp, Homo sapien
tcaatgtatcataggccgtggaaat

SEQ ID NO: 571457 - DNA, 25 bp, Homo sapien
tcataggccgtggaaatatcggaaa

SEQ ID NO: 571458 - DNA, 25 bp, Homo sapien
atatcggaaagaactgaccaggtca

SEQ ID NO: 571459 - DNA, 25 bp, Homo sapien
actgaccaggtcaaagcaacaccaa

SEQ ID NO: 571460 - DNA, 25 bp, Homo sapien
gcaacaccaaactgatgtcattgag

SEQ ID NO: 571461 - DNA, 25 bp, Homo sapien
gtcattgagtggagtttgccttttt

SEQ ID NO: 571462 - DNA, 25 bp, Homo sapien
ttggaacagtgtgccattcttgtgc

SEQ ID NO: 571463 - DNA, 25 bp, Homo sapien
gtgccattcttgtgcactgatggag

SEQ ID NO: 571464 - DNA, 25 bp, Homo sapien
gtgtgatttgaggaattggttcccc

SEQ ID NO: 571465 - DNA, 25 bp, Homo sapien
cagagccttattgaccctcaaatac

SEQ ID NO: 571466 - DNA, 25 bp, Homo sapien
acttcccttacccatgttatcattt

SEQ ID NO: 571467 - DNA, 25 bp, Homo sapien
tatcatttcctttctatcctaaaat

SEQ ID NO: 571468 - DNA, 25 bp, Homo sapien
taaaattgctacctttgctgccaga

SEQ ID NO: 571469 - DNA, 25 bp, Homo sapien
acctttgctgccagatcttttcctt

SEQ ID NO: 571470 - DNA, 25 bp, Homo sapien
ttattaactcatttcttcaacagat

SEQ ID NO: 571471 - DNA, 25 bp, Homo sapien
aacagatacttattgggcatttact

SEQ ID NO: 571472 - DNA, 25 bp, Homo sapien
gcatttactgtatgccaagtattgt

SEQ ID NO: 571473 - DNA, 25 bp, Homo sapien
agggtctcaaatgaactctgagtta

SEQ ID NO: 571474 - DNA, 25 bp, Homo sapien
ggtctcaaatgaactctgagttacc

SEQ ID NO: 571475 - DNA, 25 bp, Homo sapien
atgaactctgagttaccatctttgg

SEQ ID NO: 571476 - DNA, 25 bp, Homo sapien
tgaactctgagttaccatctttgga

SEQ ID NO: 571477 - DNA, 25 bp, Homo sapien
gaactctgagttaccatctttggac

SEQ ID NO: 571478 - DNA, 25 bp, Homo sapien
ttaatataaagctgtaatccttaaa

SEQ ID NO: 571479 - DNA, 25 bp, Homo sapien
tactatgtcactttaattggatgaa

SEQ ID NO: 571480 - DNA, 25 bp, Homo sapien
aattggatgaatgcgttaatgaaaa

SEQ ID NO: 571481 - DNA, 25 bp, Homo sapien
tgaatgcgttaatgaaaagtttgtt

SEQ ID NO: 571482 - DNA, 25 bp, Homo sapien
aatgtgagtcctgcttaatttggaa

SEQ ID NO: 571483 - DNA, 25 bp, Homo sapien
gtgagtcctgcttaatttggaaagc

SEQ ID NO: 571484 - DNA, 25 bp, Homo sapien
ttggcttccttccaagatgacctgg

SEQ ID NO: 571485 - DNA, 25 bp, Homo sapien
tggcttccttccaagatgacctgga

SEQ ID NO: 571486 - DNA, 25 bp, Homo sapien
gcttccttccaagatgacctggaca

SEQ ID NO: 571487 - DNA, 25 bp, Homo sapien
ttccttccaagatgacctggacatg

SEQ ID NO: 571488 - DNA, 25 bp, Homo sapien
tccttccaagatgacctggacatgg

SEQ ID NO: 571489 - DNA, 25 bp, Homo sapien
tgacctggacatggactccagtgaa

SEQ ID NO: 571490 - DNA, 25 bp, Homo sapien
tgaaggcagcagccccaatgcatct

SEQ ID NO: 571491 - DNA, 25 bp, Homo sapien
ccaatgcatctccacatgacaggga

SEQ ID NO: 571492 - DNA, 25 bp, Homo sapien
aatgcatctccacatgacagggagg

SEQ ID NO: 571493 - DNA, 25 bp, Homo sapien
tgcatctccacatgacagggaggaa

SEQ ID NO: 571494 - DNA, 25 bp, Homo sapien
tctccacatgacagggaggaagctt

SEQ ID NO: 571495 - DNA, 25 bp, Homo sapien
cagacttagttttctgcagtctcaa

SEQ ID NO: 571496 - DNA, 25 bp, Homo sapien
agtctcaaacccgatgttgcaccaa

SEQ ID NO: 571497 - DNA, 25 bp, Homo sapien
gttgcaccaagaaaccacctaatct

SEQ ID NO: 571498 - DNA, 25 bp, Homo sapien
tgactggttcagtgcgcatatgtga

SEQ ID NO: 571499 - DNA, 25 bp, Homo sapien
aagggtaacactgtactcacgcttt

SEQ ID NO: 571500 - DNA, 25 bp, Homo sapien
gtactcacgctttgcatatttaaat

SEQ ID NO: 571501 - DNA, 25 bp, Homo sapien
tagaccattgtcacttcgtcagaag

SEQ ID NO: 571502 - DNA, 25 bp, Homo sapien
tcagaagtcgcgtcctgcccagttg

SEQ ID NO: 571503 - DNA, 25 bp, Homo sapien
agttgcgcgagactccaacgggcct

SEQ ID NO: 571504 - DNA, 25 bp, Homo sapien
ttcttgcgacgctcgggtctgggtc

SEQ ID NO: 571505 - DNA, 25 bp, Homo sapien
gtccgggtccggacgtgcaacagaa

SEQ ID NO: 571506 - DNA, 25 bp, Homo sapien
ctttgggctgatgcgagcactacct

SEQ ID NO: 571507 - DNA, 25 bp, Homo sapien
ggctgatgcgagcactacctcagaa

SEQ ID NO: 571508 - DNA, 25 bp, Homo sapien
gatgcgagcactacctcagaatgac

SEQ ID NO: 571509 - DNA, 25 bp, Homo sapien
gcactacctcagaatgacgaccatt

SEQ ID NO: 571510 - DNA, 25 bp, Homo sapien
tacctcagaatgacgaccattacgt

SEQ ID NO: 571511 - DNA, 25 bp, Homo sapien
acgaccattacgtcatgcaggaaca

SEQ ID NO: 571512 - DNA, 25 bp, Homo sapien
ccattacgtcatgcaggaacatcgc

SEQ ID NO: 571513 - DNA, 25 bp, Homo sapien
gctgcccgcaatctgctgttggcta

SEQ ID NO: 571514 - DNA, 25 bp, Homo sapien
gcaatctgctgttggctacccgcga

SEQ ID NO: 571515 - DNA, 25 bp, Homo sapien
tgctgttggctacccgcgacctggt

SEQ ID NO: 571516 - DNA, 25 bp, Homo sapien
tacccgcgacctggtcaagatcggg

SEQ ID NO: 571517 - DNA, 25 bp, Homo sapien
tcattctgatgatagtttacaagtc

SEQ ID NO: 571518 - DNA, 25 bp, Homo sapien
attacctgatttaaagcaagtctta

SEQ ID NO: 571519 - DNA, 25 bp, Homo sapien
caagtcttaaagtacctgaatgcaa

SEQ ID NO: 571520 - DNA, 25 bp, Homo sapien
cctgaatgcaaactgattactttta

SEQ ID NO: 571521 - DNA, 25 bp, Homo sapien
acttttaaaggtctacttgactctg

SEQ ID NO: 571522 - DNA, 25 bp, Homo sapien
ctacttgactctgtcttacaggaaa

SEQ ID NO: 571523 - DNA, 25 bp, Homo sapien
ttgactctgtcttacaggaaagtga

SEQ ID NO: 571524 - DNA, 25 bp, Homo sapien
atatagctttaaaaactgtgactgc

SEQ ID NO: 571525 - DNA, 25 bp, Homo sapien
aaaaactgtgactgctttaattgtg

SEQ ID NO: 571526 - DNA, 25 bp, Homo sapien
gctttaattgtgatactcgcagaaa

SEQ ID NO: 571527 - DNA, 25 bp, Homo sapien
gtgatactcgcagaaacatgtaaac

SEQ ID NO: 571528 - DNA, 25 bp, Homo sapien
aactggacagactaagggccacttt

SEQ ID NO: 571529 - DNA, 25 bp, Homo sapien
gactaagggccactttcctaatgga

SEQ ID NO: 571530 - DNA, 25 bp, Homo sapien
gggccactttcctaatggatgggtc

SEQ ID NO: 571531 - DNA, 25 bp, Homo sapien
ctaatggatgggtcttcttggttca

SEQ ID NO: 571532 - DNA, 25 bp, Homo sapien
ttcttggttcatctcatgctcccaa

SEQ ID NO: 571533 - DNA, 25 bp, Homo sapien
ttcatctcatgctcccaacagagct

SEQ ID NO: 571534 - DNA, 25 bp, Homo sapien
atgggaacgcgccatgccaggagag

SEQ ID NO: 571535 - DNA, 25 bp, Homo sapien
gccatgccaggagagccctcttgat

SEQ ID NO: 571536 - DNA, 25 bp, Homo sapien
aggagagccctcttgatccagcctc

SEQ ID NO: 571537 - DNA, 25 bp, Homo sapien
gccaaacaggccctagagttacact

SEQ ID NO: 571538 - DNA, 25 bp, Homo sapien
acaggccctagagttacactggagg

SEQ ID NO: 571539 - DNA, 25 bp, Homo sapien
gggcacatgtgggaaagaccatgaa

SEQ ID NO: 571540 - DNA, 25 bp, Homo sapien
aagaccatgaatgcccatgtctccg

SEQ ID NO: 571541 - DNA, 25 bp, Homo sapien
tgaatgcccatgtctccgactagtt

SEQ ID NO: 571542 - DNA, 25 bp, Homo sapien
tccgactagtttccccatcagaagt

SEQ ID NO: 571543 - DNA, 25 bp, Homo sapien
gactagtttccccatcagaagtgtt

SEQ ID NO: 571544 - DNA, 25 bp, Homo sapien
ctagtttccccatcagaagtgttgt

SEQ ID NO: 571545 - DNA, 25 bp, Homo sapien
gtttccccatcagaagtgttgttgc

SEQ ID NO: 571546 - DNA, 25 bp, Homo sapien
ttccccatcagaagtgttgttgcac

SEQ ID NO: 571547 - DNA, 25 bp, Homo sapien
ccatcagaagtgttgttgcaccaat

SEQ ID NO: 571548 - DNA, 25 bp, Homo sapien
aagtgttgttgcaccaatcatcctc

SEQ ID NO: 571549 - DNA, 25 bp, Homo sapien
tgttgttgcaccaatcatcctcctc

SEQ ID NO: 571550 - DNA, 25 bp, Homo sapien
acagatgcgtacatgaaaaccggga

SEQ ID NO: 571551 - DNA, 25 bp, Homo sapien
aaaccgggaagacacaggacagtat

SEQ ID NO: 571552 - DNA, 25 bp, Homo sapien
ggacagtatgtagaagaaccggctt

SEQ ID NO: 571553 - DNA, 25 bp, Homo sapien
tagaagaaccggcttttcctataag

SEQ ID NO: 571554 - DNA, 25 bp, Homo sapien
accggcttttcctataagaaggatg

SEQ ID NO: 571555 - DNA, 25 bp, Homo sapien
ggaagcatatacaagaaactcatga

SEQ ID NO: 571556 - DNA, 25 bp, Homo sapien
aactcatgaaagtgaacactcgtgt

SEQ ID NO: 571557 - DNA, 25 bp, Homo sapien
tgaacactcgtgtctgaatatgccg

SEQ ID NO: 571558 - DNA, 25 bp, Homo sapien
gtgtctgaatatgccgaggaagctg

SEQ ID NO: 571559 - DNA, 25 bp, Homo sapien
gtgctcttctgagtacactattttt

SEQ ID NO: 571560 - DNA, 25 bp, Homo sapien
taagtaataaatgaattgccagccc

SEQ ID NO: 571561 - DNA, 25 bp, Homo sapien
gaaatctctcagaaactaggacaga

SEQ ID NO: 571562 - DNA, 25 bp, Homo sapien
taaatagatgggactgaagacagaa

SEQ ID NO: 571563 - DNA, 25 bp, Homo sapien
atttccccaaactcaaaacatgagt

SEQ ID NO: 571564 - DNA, 25 bp, Homo sapien
tgagtttgcaggttgaaaaggtccc

SEQ ID NO: 571565 - DNA, 25 bp, Homo sapien
ggttgaaaaggtcccctgagtgctt

SEQ ID NO: 571566 - DNA, 25 bp, Homo sapien
aaaggtcccctgagtgcttagcatg

SEQ ID NO: 571567 - DNA, 25 bp, Homo sapien
tgagtgcttagcatgctggctgaaa

SEQ ID NO: 571568 - DNA, 25 bp, Homo sapien
gctggctgaaaatagacctgcacca

SEQ ID NO: 571569 - DNA, 25 bp, Homo sapien
atagacctgcaccaaggcctagcat

SEQ ID NO: 571570 - DNA, 25 bp, Homo sapien
gcaccaaggcctagcatcatgaaat

SEQ ID NO: 571571 - DNA, 25 bp, Homo sapien
gcatcatgaaatactgagactctga

SEQ ID NO: 571572 - DNA, 25 bp, Homo sapien
ttaccagttttgctacagattttta

SEQ ID NO: 571573 - DNA, 25 bp, Homo sapien
tatgaacttagttccccagtcacca

SEQ ID NO: 571574 - DNA, 25 bp, Homo sapien
aaacaactgaattcctattcacttt

SEQ ID NO: 571575 - DNA, 25 bp, Homo sapien
tattcacttttactccacgagtgac

SEQ ID NO: 571576 - DNA, 25 bp, Homo sapien
ccacgagtgactttacaatacattg

SEQ ID NO: 571577 - DNA, 25 bp, Homo sapien
actgtaaaatgcctttccacttatt

SEQ ID NO: 571578 - DNA, 25 bp, Homo sapien
gtaaaatgcctttccacttatttct

SEQ ID NO: 571579 - DNA, 25 bp, Homo sapien
tccacttatttcttatactatgttg

SEQ ID NO: 571580 - DNA, 25 bp, Homo sapien
cttatactatgttgtctctcagata

SEQ ID NO: 571581 - DNA, 25 bp, Homo sapien
actatgttgtctctcagataataca

SEQ ID NO: 571582 - DNA, 25 bp, Homo sapien
gatgcaattttggataatgttttaa

SEQ ID NO: 571583 - DNA, 25 bp, Homo sapien
agctacagacccgaggtacaaatac

SEQ ID NO: 571584 - DNA, 25 bp, Homo sapien
acaaagtgagcagatggtcttggaa

SEQ ID NO: 571585 - DNA, 25 bp, Homo sapien
gtcttggaaacaggtcagaagcctt

SEQ ID NO: 571586 - DNA, 25 bp, Homo sapien
tatgatcatgcatgagccaggagga

SEQ ID NO: 571587 - DNA, 25 bp, Homo sapien
tttgcgccggttccctgagcttaga

SEQ ID NO: 571588 - DNA, 25 bp, Homo sapien
gccggttccctgagcttagaagagt

SEQ ID NO: 571589 - DNA, 25 bp, Homo sapien
ggttccctgagcttagaagagttaa

SEQ ID NO: 571590 - DNA, 25 bp, Homo sapien
gaagagttaagttcgcagagctgtg

SEQ ID NO: 571591 - DNA, 25 bp, Homo sapien
ggagtgcctcaaagaaccagctggt

SEQ ID NO: 571592 - DNA, 25 bp, Homo sapien
gaaccagctggtacatgcacagtcc

SEQ ID NO: 571593 - DNA, 25 bp, Homo sapien
gtacatgcacagtcctggccttctt

SEQ ID NO: 571594 - DNA, 25 bp, Homo sapien
ttttataaagaaccctgcctgagcc

SEQ ID NO: 571595 - DNA, 25 bp, Homo sapien
tttataaagaaccctgcctgagccg

SEQ ID NO: 571596 - DNA, 25 bp, Homo sapien
ttataaagaaccctgcctgagccgg

SEQ ID NO: 571597 - DNA, 25 bp, Homo sapien
tataaagaaccctgcctgagccggg

SEQ ID NO: 571598 - DNA, 25 bp, Homo sapien
ataaagaaccctgcctgagccgggc

SEQ ID NO: 571599 - DNA, 25 bp, Homo sapien
taaagaaccctgcctgagccgggcg

SEQ ID NO: 571600 - DNA, 25 bp, Homo sapien
aaagaaccctgcctgagccgggcgc

SEQ ID NO: 571601 - DNA, 25 bp, Homo sapien
aagaaccctgcctgagccgggcgcg

SEQ ID NO: 571602 - DNA, 25 bp, Homo sapien
agaaccctgcctgagccgggcgcgg

SEQ ID NO: 571603 - DNA, 25 bp, Homo sapien
gaaccctgcctgagccgggcgcggt

SEQ ID NO: 571604 - DNA, 25 bp, Homo sapien
aaccctgcctgagccgggcgcggtg

SEQ ID NO: 571605 - DNA, 25 bp, Homo sapien
ttttctttcatgacaacacattcca

SEQ ID NO: 571606 - DNA, 25 bp, Homo sapien
aaatgaatcatgcttatgtactaag

SEQ ID NO: 571607 - DNA, 25 bp, Homo sapien
gagagacttaagttataggtgacct

SEQ ID NO: 571608 - DNA, 25 bp, Homo sapien
gttataggtgaccttagagacctaa

SEQ ID NO: 571609 - DNA, 25 bp, Homo sapien
gagacctaaggtgagagacttgaca

SEQ ID NO: 571610 - DNA, 25 bp, Homo sapien
gagacttgacacatggaaggagtaa

SEQ ID NO: 571611 - DNA, 25 bp, Homo sapien
gtaacattagggtctacctctacct

SEQ ID NO: 571612 - DNA, 25 bp, Homo sapien
ggtctacctctacctcaatttagtt

SEQ ID NO: 571613 - DNA, 25 bp, Homo sapien
tacctcaatttagttagcgatttac

SEQ ID NO: 571614 - DNA, 25 bp, Homo sapien
gcgatttactacaatttcagagctt

SEQ ID NO: 571615 - DNA, 25 bp, Homo sapien
actacaatttcagagctttaacaaa

SEQ ID NO: 571616 - DNA, 25 bp, Homo sapien
gtctttgccagcactcctcaggtga

SEQ ID NO: 571617 - DNA, 25 bp, Homo sapien
agcactcctcaggtgagcccgggat

SEQ ID NO: 571618 - DNA, 25 bp, Homo sapien
gcccgggatggctatctgaaatgtc

SEQ ID NO: 571619 - DNA, 25 bp, Homo sapien
aatagagtcccttccccaaacatct

SEQ ID NO: 571620 - DNA, 25 bp, Homo sapien
ggccactaaatctttagacttgcct

SEQ ID NO: 571621 - DNA, 25 bp, Homo sapien
tatagatccttccatatcatcccca

SEQ ID NO: 571622 - DNA, 25 bp, Homo sapien
agtcctgttcctctgggcaatagct

SEQ ID NO: 571623 - DNA, 25 bp, Homo sapien
ctctgggcaatagctctagggaaaa

SEQ ID NO: 571624 - DNA, 25 bp, Homo sapien
tagactgctgtgcaaaattcagagc

SEQ ID NO: 571625 - DNA, 25 bp, Homo sapien
agaggattcttagccagtctgtgaa

SEQ ID NO: 571626 - DNA, 25 bp, Homo sapien
agtctgtgaaagtgggcctcctctg

SEQ ID NO: 571627 - DNA, 25 bp, Homo sapien
ttactctcagtccagtaagtttgac

SEQ ID NO: 571628 - DNA, 25 bp, Homo sapien
gtaagtttgactacagagcactcat

SEQ ID NO: 571629 - DNA, 25 bp, Homo sapien
gactacagagcactcattatcattg

SEQ ID NO: 571630 - DNA, 25 bp, Homo sapien
gagcactcattatcattgtgattat

SEQ ID NO: 571631 - DNA, 25 bp, Homo sapien
cattgtgattattatgttcccgcat

SEQ ID NO: 571632 - DNA, 25 bp, Homo sapien
atgttcccgcatattttgtcgttct

SEQ ID NO: 571633 - DNA, 25 bp, Homo sapien
tcccgcatattttgtcgttcttagt

SEQ ID NO: 571634 - DNA, 25 bp, Homo sapien
catattttgtcgttcttagttaggc

SEQ ID NO: 571635 - DNA, 25 bp, Homo sapien
gtcgttcttagttaggcatactcct

SEQ ID NO: 571636 - DNA, 25 bp, Homo sapien
taggcatactcctttaacactattg

SEQ ID NO: 571637 - DNA, 25 bp, Homo sapien
gcatactcctttaacactattgtaa

SEQ ID NO: 571638 - DNA, 25 bp, Homo sapien
caaagatggatttgagctctggatc

SEQ ID NO: 571639 - DNA, 25 bp, Homo sapien
aagatggatttgagctctggatctg

SEQ ID NO: 571640 - DNA, 25 bp, Homo sapien
agctctggatctgaaccaacgaaca

SEQ ID NO: 571641 - DNA, 25 bp, Homo sapien
gctctggatctgaaccaacgaacac

SEQ ID NO: 571642 - DNA, 25 bp, Homo sapien
ggatctgaaccaacgaacacacaat

SEQ ID NO: 571643 - DNA, 25 bp, Homo sapien
atctgaaccaacgaacacacaatga

SEQ ID NO: 571644 - DNA, 25 bp, Homo sapien
gaaccaacgaacacacaatgaccta

SEQ ID NO: 571645 - DNA, 25 bp, Homo sapien
accaacgaacacacaatgacctatg

SEQ ID NO: 571646 - DNA, 25 bp, Homo sapien
aacgaacacacaatgacctatgaat

SEQ ID NO: 571647 - DNA, 25 bp, Homo sapien
gaacacacaatgacctatgaatttt

SEQ ID NO: 571648 - DNA, 25 bp, Homo sapien
aacacacaatgacctatgaattttt

SEQ ID NO: 571649 - DNA, 25 bp, Homo sapien
agcccagaacacaacaagaatagag

SEQ ID NO: 571650 - DNA, 25 bp, Homo sapien
atagagttgatgagccctcttctcc

SEQ ID NO: 571651 - DNA, 25 bp, Homo sapien
gatgagccctcttctcctcaacaaa

SEQ ID NO: 571652 - DNA, 25 bp, Homo sapien
aaacacctgtgatgagaacattgag

SEQ ID NO: 571653 - DNA, 25 bp, Homo sapien
gcaagggaacaggtggccaaaaata

SEQ ID NO: 571654 - DNA, 25 bp, Homo sapien
gccaaaaataccctcatagccttga

SEQ ID NO: 571655 - DNA, 25 bp, Homo sapien
atagccttgagaaagtccatcttga

SEQ ID NO: 571656 - DNA, 25 bp, Homo sapien
gtccatcttgatgttatccagtgaa

SEQ ID NO: 571657 - DNA, 25 bp, Homo sapien
gaaacttaatggcaacgcaggagcc

SEQ ID NO: 571658 - DNA, 25 bp, Homo sapien
gtagaaggctaacaccaattccaaa

SEQ ID NO: 571659 - DNA, 25 bp, Homo sapien
ggctaacaccaattccaaacaatag

SEQ ID NO: 571660 - DNA, 25 bp, Homo sapien
ttttataaagaaccctgcctgagcc

SEQ ID NO: 571661 - DNA, 25 bp, Homo sapien
tttataaagaaccctgcctgagccg

SEQ ID NO: 571662 - DNA, 25 bp, Homo sapien
ttataaagaaccctgcctgagccgg

SEQ ID NO: 571663 - DNA, 25 bp, Homo sapien
tataaagaaccctgcctgagccggg

SEQ ID NO: 571664 - DNA, 25 bp, Homo sapien
ataaagaaccctgcctgagccgggc

SEQ ID NO: 571665 - DNA, 25 bp, Homo sapien
taaagaaccctgcctgagccgggcg

SEQ ID NO: 571666 - DNA, 25 bp, Homo sapien
aaagaaccctgcctgagccgggcgc

SEQ ID NO: 571667 - DNA, 25 bp, Homo sapien
aagaaccctgcctgagccgggcgcg

SEQ ID NO: 571668 - DNA, 25 bp, Homo sapien
agaaccctgcctgagccgggcgcgg

SEQ ID NO: 571669 - DNA, 25 bp, Homo sapien
gaaccctgcctgagccgggcgcggt

SEQ ID NO: 571670 - DNA, 25 bp, Homo sapien
tggttatgggatccctttctgtgca

SEQ ID NO: 571671 - DNA, 25 bp, Homo sapien
tatgggatccctttctgtgcagagc

SEQ ID NO: 571672 - DNA, 25 bp, Homo sapien
atccctttctgtgcagagccatgct

SEQ ID NO: 571673 - DNA, 25 bp, Homo sapien
agccatgctcccgtgtcactgtgtg

SEQ ID NO: 571674 - DNA, 25 bp, Homo sapien
gtcactgtgtgtcaccttcaagctg

SEQ ID NO: 571675 - DNA, 25 bp, Homo sapien
accttcaagctgtccccgtgtgtat

SEQ ID NO: 571676 - DNA, 25 bp, Homo sapien
aagctgtccccgtgtgtatgcctgt

SEQ ID NO: 571677 - DNA, 25 bp, Homo sapien
tgtgggtttgccatcgaaggaaaac

SEQ ID NO: 571678 - DNA, 25 bp, Homo sapien
ttgccatcgaaggaaaacctttatt

SEQ ID NO: 571679 - DNA, 25 bp, Homo sapien
attttggctgctaacatttggaaac

SEQ ID NO: 571680 - DNA, 25 bp, Homo sapien
atttcaactcctctaaatttgtctt

SEQ ID NO: 571681 - DNA, 25 bp, Homo sapien
gttgagggccctcgatgtgatacct

SEQ ID NO: 571682 - DNA, 25 bp, Homo sapien
gatgtgatacctgccgctctggttt

SEQ ID NO: 571683 - DNA, 25 bp, Homo sapien
tctggtttctactcattccctattt

SEQ ID NO: 571684 - DNA, 25 bp, Homo sapien
tttctactcattccctatttgccaa

SEQ ID NO: 571685 - DNA, 25 bp, Homo sapien
tgtttctacaccaagttcagaagat

SEQ ID NO: 571686 - DNA, 25 bp, Homo sapien
aagttcagaagatccagtagctgga

SEQ ID NO: 571687 - DNA, 25 bp, Homo sapien
aaaagggtgtgactgtaatctggaa

SEQ ID NO: 571688 - DNA, 25 bp, Homo sapien
gtaatctggaaggtgttctccctga

SEQ ID NO: 571689 - DNA, 25 bp, Homo sapien
gttctccctgaaatatgtgatgccc

SEQ ID NO: 571690 - DNA, 25 bp, Homo sapien
atatgtgatgcccacggacggtgcc

SEQ ID NO: 571691 - DNA, 25 bp, Homo sapien
tgatgcccacggacggtgcctgtgc

SEQ ID NO: 571692 - DNA, 25 bp, Homo sapien
gatgcttcgatgcaaggagtccagt

SEQ ID NO: 571693 - DNA, 25 bp, Homo sapien
aggagtccagtcaggagctctctca

SEQ ID NO: 571694 - DNA, 25 bp, Homo sapien
tctctcagtggcctccttcttggtc

SEQ ID NO: 571695 - DNA, 25 bp, Homo sapien
tcttggtcccgtttcgttgggtcat

SEQ ID NO: 571696 - DNA, 25 bp, Homo sapien
tcgttgggtcattgcctgaaatgca

SEQ ID NO: 571697 - DNA, 25 bp, Homo sapien
tgcaaagacaacacttacccaggat

SEQ ID NO: 571698 - DNA, 25 bp, Homo sapien
cacttacccaggatgtttccccaag

SEQ ID NO: 571699 - DNA, 25 bp, Homo sapien
atgtttccccaaggccagctacaag

SEQ ID NO: 571700 - DNA, 25 bp, Homo sapien
ttcttgggccttcactaccaaggga

SEQ ID NO: 571701 - DNA, 25 bp, Homo sapien
gactctcttcatcttctgattggga

SEQ ID NO: 571702 - DNA, 25 bp, Homo sapien
ctgattgggattgtgtccagtcctc

SEQ ID NO: 571703 - DNA, 25 bp, Homo sapien
tggagcccagtgtacatatgccgtc

SEQ ID NO: 571704 - DNA, 25 bp, Homo sapien
tgccgtctccgcgtgattagagatt

SEQ ID NO: 571705 - DNA, 25 bp, Homo sapien
attagagattgctgctgcacgtgcc

SEQ ID NO: 571706 - DNA, 25 bp, Homo sapien
tgcacgtgcccaatcccgtggcggg

SEQ ID NO: 571707 - DNA, 25 bp, Homo sapien
gggtggtgttccagctgcaaccatg

SEQ ID NO: 571708 - DNA, 25 bp, Homo sapien
gttccagctgcaaccatgcagatga

SEQ ID NO: 571709 - DNA, 25 bp, Homo sapien
gaagactataccctaggagatggag

SEQ ID NO: 571710 - DNA, 25 bp, Homo sapien
ttcctgaataaccacgtggagccaa

SEQ ID NO: 571711 - DNA, 25 bp, Homo sapien
acgtggagccaagcagcttacttat

SEQ ID NO: 571712 - DNA, 25 bp, Homo sapien
gttgcccacctccagattgaactgt

SEQ ID NO: 571713 - DNA, 25 bp, Homo sapien
gaactgtctgcaaacaaatctttac

SEQ ID NO: 571714 - DNA, 25 bp, Homo sapien
actgaaacattctgctgactcctgc

SEQ ID NO: 571715 - DNA, 25 bp, Homo sapien
tgactcctgctctataacttgttgg

SEQ ID NO: 571716 - DNA, 25 bp, Homo sapien
tataacttgttggatctgccagatc

SEQ ID NO: 571717 - DNA, 25 bp, Homo sapien
gatctgccagatcatatcaccgaag

SEQ ID NO: 571718 - DNA, 25 bp, Homo sapien
atatcaccgaagtggtaaggctgtt

SEQ ID NO: 571719 - DNA, 25 bp, Homo sapien
ggtaaggctgtttctacaacagcgt

SEQ ID NO: 571720 - DNA, 25 bp, Homo sapien
gtttctacaacagcgtacaactgct

SEQ ID NO: 571721 - DNA, 25 bp, Homo sapien
gcgtacaactgctgctaagctgact

SEQ ID NO: 571722 - DNA, 25 bp, Homo sapien
tgctaagctgacttcggctctagac

SEQ ID NO: 571723 - DNA, 25 bp, Homo sapien
cttcggctctagacccactcaaaat

SEQ ID NO: 571724 - DNA, 25 bp, Homo sapien
gacccactcaaaattggcagtgttc

SEQ ID NO: 571725 - DNA, 25 bp, Homo sapien
caatcctacttctgggtatacatca

SEQ ID NO: 571726 - DNA, 25 bp, Homo sapien
gaaatgaaaccgttgtcttgaagac

SEQ ID NO: 571727 - DNA, 25 bp, Homo sapien
gaaaccgttgtcttgaagacatgtc

SEQ ID NO: 571728 - DNA, 25 bp, Homo sapien
gaagacatgtctacacttccatgtt

SEQ ID NO: 571729 - DNA, 25 bp, Homo sapien
atgtctacacttccatgttcattgt

SEQ ID NO: 571730 - DNA, 25 bp, Homo sapien
ctacacttccatgttcattgtagca

SEQ ID NO: 571731 - DNA, 25 bp, Homo sapien
aaacaacctaagtgtcctctgatga

SEQ ID NO: 571732 - DNA, 25 bp, Homo sapien
cctaagtgtcctctgatgaatgaat

SEQ ID NO: 571733 - DNA, 25 bp, Homo sapien
aagtgtcctctgatgaatgaatgga

SEQ ID NO: 571734 - DNA, 25 bp, Homo sapien
agaggaaatgtttatacacacacac

SEQ ID NO: 571735 - DNA, 25 bp, Homo sapien
acacacccagaggaaaattcagctt

SEQ ID NO: 571736 - DNA, 25 bp, Homo sapien
ggcagcctctgactaaaatatctcc

SEQ ID NO: 571737 - DNA, 25 bp, Homo sapien
ctgactaaaatatctccatctcctc

SEQ ID NO: 571738 - DNA, 25 bp, Homo sapien
tctctgagcagcgtagacacccaat

SEQ ID NO: 571739 - DNA, 25 bp, Homo sapien
gcagcgtagacacccaattctgttg

SEQ ID NO: 571740 - DNA, 25 bp, Homo sapien
ggaaaataatatgggctctttccct

SEQ ID NO: 571741 - DNA, 25 bp, Homo sapien
ttggattaaattcccatcgagctat

SEQ ID NO: 571742 - DNA, 25 bp, Homo sapien
atcgagctatttcccaaggctttag

SEQ ID NO: 571743 - DNA, 25 bp, Homo sapien
ttcccaaggctttaggccttccagt

SEQ ID NO: 571744 - DNA, 25 bp, Homo sapien
gaattcacttggacactcacttcag

SEQ ID NO: 571745 - DNA, 25 bp, Homo sapien
ggacactcacttcagcaacatgatt

SEQ ID NO: 571746 - DNA, 25 bp, Homo sapien
tctgcacagaagtgaccagcaggtc

SEQ ID NO: 571747 - DNA, 25 bp, Homo sapien
tcacctttatactcataccaaatta

SEQ ID NO: 571748 - DNA, 25 bp, Homo sapien
tcagaaatggtattgcctgtaacat

SEQ ID NO: 571749 - DNA, 25 bp, Homo sapien
ggtattgcctgtaacattgttcctg

SEQ ID NO: 571750 - DNA, 25 bp, Homo sapien
attgcctgtaacattgttcctgttt

SEQ ID NO: 571751 - DNA, 25 bp, Homo sapien
tgcctgtaacattgttcctgttttt

SEQ ID NO: 571752 - DNA, 25 bp, Homo sapien
cctgtaacattgttcctgtttttga

SEQ ID NO: 571753 - DNA, 25 bp, Homo sapien
gattgctgggtactttattgtctgt

SEQ ID NO: 571754 - DNA, 25 bp, Homo sapien
tgctgggtactttattgtctgtttg

SEQ ID NO: 571755 - DNA, 25 bp, Homo sapien
tgggtactttattgtctgtttggat

SEQ ID NO: 571756 - DNA, 25 bp, Homo sapien
gtctgtttggattccatatactttt

SEQ ID NO: 571757 - DNA, 25 bp, Homo sapien
ctgtagattaaattgagcagtaaag

SEQ ID NO: 571758 - DNA, 25 bp, Homo sapien
gccttcctggtcctaaaatatggag

SEQ ID NO: 571759 - DNA, 25 bp, Homo sapien
ccttcctggtcctaaaatatggaga

SEQ ID NO: 571760 - DNA, 25 bp, Homo sapien
cttcctggtcctaaaatatggagaa

SEQ ID NO: 571761 - DNA, 25 bp, Homo sapien
ttcctggtcctaaaatatggagaat

SEQ ID NO: 571762 - DNA, 25 bp, Homo sapien
tcctggtcctaaaatatggagaata

SEQ ID NO: 571763 - DNA, 25 bp, Homo sapien
cctggtcctaaaatatggagaatag

SEQ ID NO: 571764 - DNA, 25 bp, Homo sapien
ctggtcctaaaatatggagaataga

SEQ ID NO: 571765 - DNA, 25 bp, Homo sapien
tggtcctaaaatatggagaatagaa

SEQ ID NO: 571766 - DNA, 25 bp, Homo sapien
gaatagaaaatagaattggaggcca

SEQ ID NO: 571767 - DNA, 25 bp, Homo sapien
tagaaaatagaattggaggccaggc

SEQ ID NO: 571768 - DNA, 25 bp, Homo sapien
gaaaatagaattggaggccaggcgc

SEQ ID NO: 571769 - DNA, 25 bp, Homo sapien
tgtaactggactaagggcaatgagg

SEQ ID NO: 571770 - DNA, 25 bp, Homo sapien
gtaactggactaagggcaatgagga

SEQ ID NO: 571771 - DNA, 25 bp, Homo sapien
gaggtgtcaactacatcaagctgca

SEQ ID NO: 571772 - DNA, 25 bp, Homo sapien
aggtgtcaactacatcaagctgcat

SEQ ID NO: 571773 - DNA, 25 bp, Homo sapien
ggtgtcaactacatcaagctgcata

SEQ ID NO: 571774 - DNA, 25 bp, Homo sapien
gtgtcaactacatcaagctgcatag

SEQ ID NO: 571775 - DNA, 25 bp, Homo sapien
tgtcaactacatcaagctgcataga

SEQ ID NO: 571776 - DNA, 25 bp, Homo sapien
gtcaactacatcaagctgcatagag

SEQ ID NO: 571777 - DNA, 25 bp, Homo sapien
caactacatcaagctgcatagagag

SEQ ID NO: 571778 - DNA, 25 bp, Homo sapien
actacatcaagctgcatagagagat

SEQ ID NO: 571779 - DNA, 25 bp, Homo sapien
catcaagctgcatagagagatggaa

SEQ ID NO: 571780 - DNA, 25 bp, Homo sapien
ggcccttggcagatacaaggatttt

SEQ ID NO: 571781 - DNA, 25 bp, Homo sapien
gattttgagatgagctcgtcctgga

SEQ ID NO: 571782 - DNA, 25 bp, Homo sapien
gagatgagctcgtcctggagtatct

SEQ ID NO: 571783 - DNA, 25 bp, Homo sapien
atgagctcgtcctggagtatctgtg

SEQ ID NO: 571784 - DNA, 25 bp, Homo sapien
agctcgtcctggagtatctgtgtgg

SEQ ID NO: 571785 - DNA, 25 bp, Homo sapien
cctggagtatctgtgtgggccctaa

SEQ ID NO: 571786 - DNA, 25 bp, Homo sapien
gagtatctgtgtgggccctaaatgc

SEQ ID NO: 571787 - DNA, 25 bp, Homo sapien
gccacgtgaggttggaggccagcag

SEQ ID NO: 571788 - DNA, 25 bp, Homo sapien
cagcaggggttacacagccacaggc

SEQ ID NO: 571789 - DNA, 25 bp, Homo sapien
cagccacaggccaaggagggccaga

SEQ ID NO: 571790 - DNA, 25 bp, Homo sapien
aggagggccagagccaccagaagct

SEQ ID NO: 571791 - DNA, 25 bp, Homo sapien
ggctgattactgttgatagaatatt

SEQ ID NO: 571792 - DNA, 25 bp, Homo sapien
ggcaaggaaatcatctaaacccata

SEQ ID NO: 571793 - DNA, 25 bp, Homo sapien
ggaaatcatctaaacccataaccat

SEQ ID NO: 571794 - DNA, 25 bp, Homo sapien
atcatctaaacccataaccatagtt

SEQ ID NO: 571795 - DNA, 25 bp, Homo sapien
cccataaccatagtttaaatgtaca

SEQ ID NO: 571796 - DNA, 25 bp, Homo sapien
ttaaatgtacataaacccaagctga

SEQ ID NO: 571797 - DNA, 25 bp, Homo sapien
aatgtacataaacccaagctgaaaa

SEQ ID NO: 571798 - DNA, 25 bp, Homo sapien
aacccatgagaaatgtcatatatct

SEQ ID NO: 571799 - DNA, 25 bp, Homo sapien
gagaaatgtcatatatcttagaaaa

SEQ ID NO: 571800 - DNA, 25 bp, Homo sapien
atagttgtgtgtatctttctgagga

SEQ ID NO: 571801 - DNA, 25 bp, Homo sapien
tagttgtgtgtatctttctgaggaa

SEQ ID NO: 571802 - DNA, 25 bp, Homo sapien
gattcacacttcagggaaagaccac

SEQ ID NO: 571803 - DNA, 25 bp, Homo sapien
aagaccacttggtgggctgagccaa

SEQ ID NO: 571804 - DNA, 25 bp, Homo sapien
ggctgagccaaagtcagttactgac

SEQ ID NO: 571805 - DNA, 25 bp, Homo sapien
agttactgaccctcagattgtgcca

SEQ ID NO: 571806 - DNA, 25 bp, Homo sapien
gattgtgccagggttgtgtgtttat

SEQ ID NO: 571807 - DNA, 25 bp, Homo sapien
gagtgtgattttgtccacttttgat

SEQ ID NO: 571808 - DNA, 25 bp, Homo sapien
gatatggaaggtgagtccgacctca

SEQ ID NO: 571809 - DNA, 25 bp, Homo sapien
gagtccgacctcacatcgagagaag

SEQ ID NO: 571810 - DNA, 25 bp, Homo sapien
acatcgagagaagccacaacagtga

SEQ ID NO: 571811 - DNA, 25 bp, Homo sapien
acaacagtgaccaacccttacagag

SEQ ID NO: 571812 - DNA, 25 bp, Homo sapien
aatgtccactgcagctcagaagaga

SEQ ID NO: 571813 - DNA, 25 bp, Homo sapien
atgcataggctgtgattattaggaa

SEQ ID NO: 571814 - DNA, 25 bp, Homo sapien
aaagcactggctggcagcttagata

SEQ ID NO: 571815 - DNA, 25 bp, Homo sapien
ctggctggcagcttagataaacaag

SEQ ID NO: 571816 - DNA, 25 bp, Homo sapien
gaaagtcttagcattgactgtttca

SEQ ID NO: 571817 - DNA, 25 bp, Homo sapien
gactgtttcaggcaacttagccgta

SEQ ID NO: 571818 - DNA, 25 bp, Homo sapien
gcaacttagccgtaacctcaatgct

SEQ ID NO: 571819 - DNA, 25 bp, Homo sapien
gccgtaacctcaatgctaaaaaaca

SEQ ID NO: 571820 - DNA, 25 bp, Homo sapien
acacatagaggagcgttaccaatat

SEQ ID NO: 571821 - DNA, 25 bp, Homo sapien
accaatatttatcaagcttcccctt

SEQ ID NO: 571822 - DNA, 25 bp, Homo sapien
aagcttcccctttatgtctgacatt

SEQ ID NO: 571823 - DNA, 25 bp, Homo sapien
gacattttcaagtggattgactcat

SEQ ID NO: 571824 - DNA, 25 bp, Homo sapien
aatgtggctaggcaatcagcatctc

SEQ ID NO: 571825 - DNA, 25 bp, Homo sapien
ggctaggcaatcagcatctcatcac

SEQ ID NO: 571826 - DNA, 25 bp, Homo sapien
atcacaacccggcaggcaggaactc

SEQ ID NO: 571827 - DNA, 25 bp, Homo sapien
agtgttctctaaggtcttgctgaat

SEQ ID NO: 571828 - DNA, 25 bp, Homo sapien
gtcttgctgaatatggatggtatcc

SEQ ID NO: 571829 - DNA, 25 bp, Homo sapien
gagagaactctattgatgtgtgata

SEQ ID NO: 571830 - DNA, 25 bp, Homo sapien
agcagcattgttgctgttctgctca

SEQ ID NO: 571831 - DNA, 25 bp, Homo sapien
ttgctgttctgctcagtactttgat

SEQ ID NO: 571832 - DNA, 25 bp, Homo sapien
gctcagtactttgatgatcccttgt

SEQ ID NO: 571833 - DNA, 25 bp, Homo sapien
gatgatcccttgtgatctcacaatg

SEQ ID NO: 571834 - DNA, 25 bp, Homo sapien
ggaagtcattttttacattacatct

SEQ ID NO: 571835 - DNA, 25 bp, Homo sapien
ggaggagtctccaagtgactttgaa

SEQ ID NO: 571836 - DNA, 25 bp, Homo sapien
aggtgtcatacatccctcacagatg

SEQ ID NO: 571837 - DNA, 25 bp, Homo sapien
tcatacatccctcacagatggtcag

SEQ ID NO: 571838 - DNA, 25 bp, Homo sapien
aatatctaaagagtttttgccaaag

SEQ ID NO: 571839 - DNA, 25 bp, Homo sapien
aaagagatagggtcctgaatgggca

SEQ ID NO: 571840 - DNA, 25 bp, Homo sapien
gttaatgagacatcctttgctacaa

SEQ ID NO: 571841 - DNA, 25 bp, Homo sapien
atcctttgctacaagatgatggtga

SEQ ID NO: 571842 - DNA, 25 bp, Homo sapien
aggttatatttacaagggatcactc

SEQ ID NO: 571843 - DNA, 25 bp, Homo sapien
agggatcactccaattactacatgt

SEQ ID NO: 571844 - DNA, 25 bp, Homo sapien
attactacatgtccgtcttttctaa

SEQ ID NO: 571845 - DNA, 25 bp, Homo sapien
tagactttattgtgctctattaaaa

SEQ ID NO: 571846 - DNA, 25 bp, Homo sapien
gacttcagtcagtaattgatacagc

SEQ ID NO: 571847 - DNA, 25 bp, Homo sapien
atttcattctaacatttcaaagctg

SEQ ID NO: 571848 - DNA, 25 bp, Homo sapien
aaagctgtctcacagaatttctgag

SEQ ID NO: 571849 - DNA, 25 bp, Homo sapien
aagtgttcccaatcactgatttcat

SEQ ID NO: 571850 - DNA, 25 bp, Homo sapien
cgcgtcaatattacttcagcacctt

SEQ ID NO: 571851 - DNA, 25 bp, Homo sapien
attacttcagcacctttaatgagga

SEQ ID NO: 571852 - DNA, 25 bp, Homo sapien
atcattgaaacacactcatcatctt

SEQ ID NO: 571853 - DNA, 25 bp, Homo sapien
ggctagagagatttatgttactcag

SEQ ID NO: 571854 - DNA, 25 bp, Homo sapien
gttactcagaggttttgcagctggt

SEQ ID NO: 571855 - DNA, 25 bp, Homo sapien
actcagaggttttgcagctggtgtg

SEQ ID NO: 571856 - DNA, 25 bp, Homo sapien
cagtgggtggcaatagtgaatttgc

SEQ ID NO: 571857 - DNA, 25 bp, Homo sapien
aactaatagtacctctcagtaagaa

SEQ ID NO: 571858 - DNA, 25 bp, Homo sapien
ggaaacatctgtttatactttgctt

SEQ ID NO: 571859 - DNA, 25 bp, Homo sapien
ctttgcttttacaagtacatcattg

SEQ ID NO: 571860 - DNA, 25 bp, Homo sapien
gaaatatcagacctgtcatctatat

SEQ ID NO: 571861 - DNA, 25 bp, Homo sapien
gacctgtcatctatattgagtcagc

SEQ ID NO: 571862 - DNA, 25 bp, Homo sapien
ttgagtcagcatttgaaccaagtaa

SEQ ID NO: 571863 - DNA, 25 bp, Homo sapien
agtaaatgttttcactgtcttaaca

SEQ ID NO: 571864 - DNA, 25 bp, Homo sapien
actgtcttaacatctatttctgtag

SEQ ID NO: 571865 - DNA, 25 bp, Homo sapien
aacaggatcctgactaagatagcaa

SEQ ID NO: 571866 - DNA, 25 bp, Homo sapien
gtgtttccagagattctgctacatg

SEQ ID NO: 571867 - DNA, 25 bp, Homo sapien
catgtattatctgaaatgttctcca

SEQ ID NO: 571868 - DNA, 25 bp, Homo sapien
ttaggtaaaatatcgttgcttgtta

SEQ ID NO: 571869 - DNA, 25 bp, Homo sapien
aatatcgttgcttgttaattgcata

SEQ ID NO: 571870 - DNA, 25 bp, Homo sapien
aattgcataaagtcatctagtttct

SEQ ID NO: 571871 - DNA, 25 bp, Homo sapien
aagtcatctagtttctttagtgaga

SEQ ID NO: 571872 - DNA, 25 bp, Homo sapien
ttttctgcattgtactgaacgttgt

SEQ ID NO: 571873 - DNA, 25 bp, Homo sapien
tctgcattgtactgaacgttgtttc

SEQ ID NO: 571874 - DNA, 25 bp, Homo sapien
cattgtactgaacgttgtttccctt

SEQ ID NO: 571875 - DNA, 25 bp, Homo sapien
gcaggatgaaaacttatttgttacc

SEQ ID NO: 571876 - DNA, 25 bp, Homo sapien
tatttgttaccttcaaatgaaccaa

SEQ ID NO: 571877 - DNA, 25 bp, Homo sapien
tcaaatgaaccaactctaatgtatt

SEQ ID NO: 571878 - DNA, 25 bp, Homo sapien
gaaccaactctaatgtattcatacc

SEQ ID NO: 571879 - DNA, 25 bp, Homo sapien
agctagcccacagcaaccaaagaga

SEQ ID NO: 571880 - DNA, 25 bp, Homo sapien
tagcccacagcaaccaaagagactt

SEQ ID NO: 571881 - DNA, 25 bp, Homo sapien
cacagcaaccaaagagacttcctct

SEQ ID NO: 571882 - DNA, 25 bp, Homo sapien
acagcccaggctgttgatacctcag

SEQ ID NO: 571883 - DNA, 25 bp, Homo sapien
agcccaggctgttgatacctcagag

SEQ ID NO: 571884 - DNA, 25 bp, Homo sapien
caggctgttgatacctcagagcctt

SEQ ID NO: 571885 - DNA, 25 bp, Homo sapien
ggctgttgatacctcagagccttct

SEQ ID NO: 571886 - DNA, 25 bp, Homo sapien
tgttgatacctcagagccttctctt

SEQ ID NO: 571887 - DNA, 25 bp, Homo sapien
ttgatacctcagagccttctcttta

SEQ ID NO: 571888 - DNA, 25 bp, Homo sapien
tgatacctcagagccttctctttac

SEQ ID NO: 571889 - DNA, 25 bp, Homo sapien
tacctcagagccttctctttactct

SEQ ID NO: 571890 - DNA, 25 bp, Homo sapien
ttgagggagtacctgtcctgtcacc

SEQ ID NO: 571891 - DNA, 25 bp, Homo sapien
agagctggttccctgcacagagtgc

SEQ ID NO: 571892 - DNA, 25 bp, Homo sapien
ttccctgcacagagtgctactcata

SEQ ID NO: 571893 - DNA, 25 bp, Homo sapien
agagtgctactcatacccactgctt

SEQ ID NO: 571894 - DNA, 25 bp, Homo sapien
ataatcagttgttatctccctggtc

SEQ ID NO: 571895 - DNA, 25 bp, Homo sapien
gttgttatctccctggtctgacatg

SEQ ID NO: 571896 - DNA, 25 bp, Homo sapien
ctggtctgacatgcctcacaagaaa

SEQ ID NO: 571897 - DNA, 25 bp, Homo sapien
acaagaaaaacagtggcagcccatg

SEQ ID NO: 571898 - DNA, 25 bp, Homo sapien
tggcagcccatgttgtaagcacaca

SEQ ID NO: 571899 - DNA, 25 bp, Homo sapien
atgttgtaagcacacatccatctcc

SEQ ID NO: 571900 - DNA, 25 bp, Homo sapien
atctcccctgtgagctgaaattggg

SEQ ID NO: 571901 - DNA, 25 bp, Homo sapien
gtgtttggtagggaatccctgccct

SEQ ID NO: 571902 - DNA, 25 bp, Homo sapien
ctgccctggctgatcattatgtctg

SEQ ID NO: 571903 - DNA, 25 bp, Homo sapien
tgatcattatgtctgccttggctgt

SEQ ID NO: 571904 - DNA, 25 bp, Homo sapien
tgccttggctgtacatgtgatcttg

SEQ ID NO: 571905 - DNA, 25 bp, Homo sapien
gtacatgtgatcttggtggcatttc

SEQ ID NO: 571906 - DNA, 25 bp, Homo sapien
gtggcatttctggactatcacccag

SEQ ID NO: 571907 - DNA, 25 bp, Homo sapien
ggttaagactggttaagaccgcaga

SEQ ID NO: 571908 - DNA, 25 bp, Homo sapien
taagaccgcagagtcagaccgcttg

SEQ ID NO: 571909 - DNA, 25 bp, Homo sapien
agtcagaccgcttggagttgaatcc

SEQ ID NO: 571910 - DNA, 25 bp, Homo sapien
accaccgcattctagctgtgtgact

SEQ ID NO: 571911 - DNA, 25 bp, Homo sapien
gaaagtcccttagcctctatgaaat

SEQ ID NO: 571912 - DNA, 25 bp, Homo sapien
ggattggaattctgcatttcccacc

SEQ ID NO: 571913 - DNA, 25 bp, Homo sapien
tgcttcctccaatactcagctaagg

SEQ ID NO: 571914 - DNA, 25 bp, Homo sapien
atactcagctaaggcattacctcct

SEQ ID NO: 571915 - DNA, 25 bp, Homo sapien
cagctaaggcattacctcctcctag

SEQ ID NO: 571916 - DNA, 25 bp, Homo sapien
gggtttgtctgtcctgctagactga

SEQ ID NO: 571917 - DNA, 25 bp, Homo sapien
tgtctgtcctgctagactgaacgta

SEQ ID NO: 571918 - DNA, 25 bp, Homo sapien
aactaatgagggtatctgcatggaa

SEQ ID NO: 571919 - DNA, 25 bp, Homo sapien
gagggtatctgcatggaaagaaaca

SEQ ID NO: 571920 - DNA, 25 bp, Homo sapien
aagaaacagacccttctaagtgctg

SEQ ID NO: 571921 - DNA, 25 bp, Homo sapien
cagacccttctaagtgctgtgttaa

SEQ ID NO: 571922 - DNA, 25 bp, Homo sapien
aaccagatgagagcattagagcagc

SEQ ID NO: 571923 - DNA, 25 bp, Homo sapien
aaagagactgtccttgttcaatagc

SEQ ID NO: 571924 - DNA, 25 bp, Homo sapien
gactgtccttgttcaatagcactct

SEQ ID NO: 571925 - DNA, 25 bp, Homo sapien
tcaatagcactctattttttagtgt

SEQ ID NO: 571926 - DNA, 25 bp, Homo sapien
gaaatatctcttaaaacttagtgtg

SEQ ID NO: 571927 - DNA, 25 bp, Homo sapien
acttagtgtgtctttcacatgttga

SEQ ID NO: 571928 - DNA, 25 bp, Homo sapien
gtgtctttcacatgttgagatttaa

SEQ ID NO: 571929 - DNA, 25 bp, Homo sapien
ttcattctagtttatgaccctgtgg

SEQ ID NO: 571930 - DNA, 25 bp, Homo sapien
cagtgtgtgtgtggagcaatgttaa

SEQ ID NO: 571931 - DNA, 25 bp, Homo sapien
aattttttatatgctccatatccta

SEQ ID NO: 571932 - DNA, 25 bp, Homo sapien
atgctccatatcctaatttaatttg

SEQ ID NO: 571933 - DNA, 25 bp, Homo sapien
attagtaccaaattaatgctctaca

SEQ ID NO: 571934 - DNA, 25 bp, Homo sapien
gtatattcttttctactcttcatgt

SEQ ID NO: 571935 - DNA, 25 bp, Homo sapien
tttctactcttcatgtatggactag

SEQ ID NO: 571936 - DNA, 25 bp, Homo sapien
aaatggctgagacccacaggaacaa

SEQ ID NO: 571937 - DNA, 25 bp, Homo sapien
acaggacaggagttagatgcagaga

SEQ ID NO: 571938 - DNA, 25 bp, Homo sapien
gctaacggtagcatatgagtcacag

SEQ ID NO: 571939 - DNA, 25 bp, Homo sapien
tcacagacagaacattggcaccttt

SEQ ID NO: 571940 - DNA, 25 bp, Homo sapien
cattggcacctttgtttaagaaact

SEQ ID NO: 571941 - DNA, 25 bp, Homo sapien
gttaatgtcacatctgcctttggag

SEQ ID NO: 571942 - DNA, 25 bp, Homo sapien
gtcacatctgcctttggagattaca

SEQ ID NO: 571943 - DNA, 25 bp, Homo sapien
aaatgaaatggctacctttctactg

SEQ ID NO: 571944 - DNA, 25 bp, Homo sapien
tttctactggaaccctgaccagaag

SEQ ID NO: 571945 - DNA, 25 bp, Homo sapien
gcagacagtgggatctactgctgcc

SEQ ID NO: 571946 - DNA, 25 bp, Homo sapien
cagacagtgggatctactgctgccg

SEQ ID NO: 571947 - DNA, 25 bp, Homo sapien
gacagtgggatctactgctgccgga

SEQ ID NO: 571948 - DNA, 25 bp, Homo sapien
acagtgggatctactgctgccggat

SEQ ID NO: 571949 - DNA, 25 bp, Homo sapien
cagtgggatctactgctgccggatc

SEQ ID NO: 571950 - DNA, 25 bp, Homo sapien
tgggatctactgctgccggatccaa

SEQ ID NO: 571951 - DNA, 25 bp, Homo sapien
ggatctactgctgccggatccaaat

SEQ ID NO: 571952 - DNA, 25 bp, Homo sapien
tactgctgccggatccaaatcccag

SEQ ID NO: 571953 - DNA, 25 bp, Homo sapien
tgctgccggatccaaatcccaggca

SEQ ID NO: 571954 - DNA, 25 bp, Homo sapien
ccaaatcccaggcataatgaatgat

SEQ ID NO: 571955 - DNA, 25 bp, Homo sapien
aaatcccaggcataatgaatgatga

SEQ ID NO: 571956 - DNA, 25 bp, Homo sapien
gtttgtcctggactatcttttaagg

SEQ ID NO: 571957 - DNA, 25 bp, Homo sapien
gtcctggactatcttttaaggcata

SEQ ID NO: 571958 - DNA, 25 bp, Homo sapien
gtcttcacgggagcaaagagcacac

SEQ ID NO: 571959 - DNA, 25 bp, Homo sapien
gcaaagagcacacatgcttactgcc

SEQ ID NO: 571960 - DNA, 25 bp, Homo sapien
cttactgcccagataatgtttctct

SEQ ID NO: 571961 - DNA, 25 bp, Homo sapien
tgcttcctgctcattactaaagatt

SEQ ID NO: 571962 - DNA, 25 bp, Homo sapien
gattcatgtttcttaagctcagtgt

SEQ ID NO: 571963 - DNA, 25 bp, Homo sapien
gtttcttaagctcagtgtctctttc

SEQ ID NO: 571964 - DNA, 25 bp, Homo sapien
tttcctgtggactacaacccactaa

SEQ ID NO: 571965 - DNA, 25 bp, Homo sapien
ggactacaacccactaaatgtgcat

SEQ ID NO: 571966 - DNA, 25 bp, Homo sapien
aatgtgcatgtatcatctgtccctc

SEQ ID NO: 571967 - DNA, 25 bp, Homo sapien
tcaaggatccccttgccaaaacctc

SEQ ID NO: 571968 - DNA, 25 bp, Homo sapien
ttgccaaaacctcggggagcagctg

SEQ ID NO: 571969 - DNA, 25 bp, Homo sapien
gggagcagctgtgccaccaaaaagg

SEQ ID NO: 571970 - DNA, 25 bp, Homo sapien
agctgtgccaccaaaaaggcctcca

SEQ ID NO: 571971 - DNA, 25 bp, Homo sapien
tgtgccaccaaaaaggcctccagat

SEQ ID NO: 571972 - DNA, 25 bp, Homo sapien
gtgccaccaaaaaggcctccagatg

SEQ ID NO: 571973 - DNA, 25 bp, Homo sapien
tgccaccaaaaaggcctccagatga

SEQ ID NO: 571974 - DNA, 25 bp, Homo sapien
caccaaaaaggcctccagatgatgg

SEQ ID NO: 571975 - DNA, 25 bp, Homo sapien
caaaaaggcctccagatgatggaca

SEQ ID NO: 571976 - DNA, 25 bp, Homo sapien
aaaaggcctccagatgatggacaag

SEQ ID NO: 571977 - DNA, 25 bp, Homo sapien
tgatggacaagtggttggctctgtg

SEQ ID NO: 571978 - DNA, 25 bp, Homo sapien
gaactggacacatatgttgcacaat

SEQ ID NO: 571979 - DNA, 25 bp, Homo sapien
ggtgattcagagcaatatagcctat

SEQ ID NO: 571980 - DNA, 25 bp, Homo sapien
atagcctatgctgttttatgatatg

SEQ ID NO: 571981 - DNA, 25 bp, Homo sapien
ggtgctggagtgtagcatccacaaa

SEQ ID NO: 571982 - DNA, 25 bp, Homo sapien
aaattagtcccatatttgccaggag

SEQ ID NO: 571983 - DNA, 25 bp, Homo sapien
agtcccatatttgccaggagacagt

SEQ ID NO: 571984 - DNA, 25 bp, Homo sapien
gccaggagacagttgggtacataaa

SEQ ID NO: 571985 - DNA, 25 bp, Homo sapien
tttcttgattcatgggtctattcgg

SEQ ID NO: 571986 - DNA, 25 bp, Homo sapien
gattcatgggtctattcggactgta

SEQ ID NO: 571987 - DNA, 25 bp, Homo sapien
ttcggactgtagattgctctgccat

SEQ ID NO: 571988 - DNA, 25 bp, Homo sapien
actgtagattgctctgccattctga

SEQ ID NO: 571989 - DNA, 25 bp, Homo sapien
tgtggtaccaagattagcaaatgac

SEQ ID NO: 571990 - DNA, 25 bp, Homo sapien
gcaaatgaccttcatatccactgat

SEQ ID NO: 571991 - DNA, 25 bp, Homo sapien
atttcctgatgtccatgtctatatg

SEQ ID NO: 571992 - DNA, 25 bp, Homo sapien
gtccatgtctatatgtttacaagca

SEQ ID NO: 571993 - DNA, 25 bp, Homo sapien
gtttacaagcaatatggagcaccat

SEQ ID NO: 571994 - DNA, 25 bp, Homo sapien
ggagcaccattctttaaatactgtt

SEQ ID NO: 571995 - DNA, 25 bp, Homo sapien
atagtctaaccactaggcgtgtccc

SEQ ID NO: 571996 - DNA, 25 bp, Homo sapien
ggcgtgtccctgttatcagcaaaga

SEQ ID NO: 571997 - DNA, 25 bp, Homo sapien
gatgcttcattcatgtactatgtat

SEQ ID NO: 571998 - DNA, 25 bp, Homo sapien
aagtacattcactctgtttcacgta

SEQ ID NO: 571999 - DNA, 25 bp, Homo sapien
gtttcacgtatgtggatgccagtta

SEQ ID NO: 572000 - DNA, 25 bp, Homo sapien
gaaattaagagttgttcagtatgca

SEQ ID NO: 572001 - DNA, 25 bp, Homo sapien
tgttcagtatgcaaaacttggaaag

SEQ ID NO: 572002 - DNA, 25 bp, Homo sapien
aaatgtcacccatagtctcaccaga

SEQ ID NO: 572003 - DNA, 25 bp, Homo sapien
tgtcacccatagtctcaccagagac

SEQ ID NO: 572004 - DNA, 25 bp, Homo sapien
ttcttcttcacataatttgccggtg

SEQ ID NO: 572005 - DNA, 25 bp, Homo sapien
atttgccggtgttctttttacagag

SEQ ID NO: 572006 - DNA, 25 bp, Homo sapien
gccggtgttctttttacagagcaat

SEQ ID NO: 572007 - DNA, 25 bp, Homo sapien
gttctttttacagagcaattatctt

SEQ ID NO: 572008 - DNA, 25 bp, Homo sapien
tgccttttccaccttatcgttccat

SEQ ID NO: 572009 - DNA, 25 bp, Homo sapien
ttatcgttccatcactttattccag

SEQ ID NO: 572010 - DNA, 25 bp, Homo sapien
cactttattccagcacttctctgtg

SEQ ID NO: 572011 - DNA, 25 bp, Homo sapien
tctgcagtaggaaggaaagaggcta

SEQ ID NO: 572012 - DNA, 25 bp, Homo sapien
gaaggaaagaggctaatctccaaag

SEQ ID NO: 572013 - DNA, 25 bp, Homo sapien
gaaagaggctaatctccaaagagaa

SEQ ID NO: 572014 - DNA, 25 bp, Homo sapien
agagagggccacacaacagatggac

SEQ ID NO: 572015 - DNA, 25 bp, Homo sapien
gagggccacacaacagatggacaga

SEQ ID NO: 572016 - DNA, 25 bp, Homo sapien
aggaagagcgctggctctttttggt

SEQ ID NO: 572017 - DNA, 25 bp, Homo sapien
agagcgctggctctttttggtccct

SEQ ID NO: 572018 - DNA, 25 bp, Homo sapien
agcgctggctctttttggtccctgg

SEQ ID NO: 572019 - DNA, 25 bp, Homo sapien
gctggctctttttggtccctggttt

SEQ ID NO: 572020 - DNA, 25 bp, Homo sapien
agggaccgaagccagtcaatttcac

SEQ ID NO: 572021 - DNA, 25 bp, Homo sapien
gggaccgaagccagtcaatttcacc

SEQ ID NO: 572022 - DNA, 25 bp, Homo sapien
ttttctttgcccagccagataagca

SEQ ID NO: 572023 - DNA, 25 bp, Homo sapien
gcccagccagataagcaggacttta

SEQ ID NO: 572024 - DNA, 25 bp, Homo sapien
tatgtcagctctctccaagggcact

SEQ ID NO: 572025 - DNA, 25 bp, Homo sapien
agctctctccaagggcactgggaat

SEQ ID NO: 572026 - DNA, 25 bp, Homo sapien
tccaagggcactgggaattttcctg

SEQ ID NO: 572027 - DNA, 25 bp, Homo sapien
attttcctgaggtgtaatcgcttct

SEQ ID NO: 572028 - DNA, 25 bp, Homo sapien
gaggtgtaatcgcttctcactgtat

SEQ ID NO: 572029 - DNA, 25 bp, Homo sapien
taatcgcttctcactgtatgttctg

SEQ ID NO: 572030 - DNA, 25 bp, Homo sapien
gcttctcactgtatgttctggaaca

SEQ ID NO: 572031 - DNA, 25 bp, Homo sapien
tctggaacataaagctagcaatgaa

SEQ ID NO: 572032 - DNA, 25 bp, Homo sapien
aagctagcaatgaaggtatttcttt

SEQ ID NO: 572033 - DNA, 25 bp, Homo sapien
ggatcaaaaagacctgggttccaat

SEQ ID NO: 572034 - DNA, 25 bp, Homo sapien
aagacctgggttccaatctttgcac

SEQ ID NO: 572035 - DNA, 25 bp, Homo sapien
ggttccaatctttgcacttccattt

SEQ ID NO: 572036 - DNA, 25 bp, Homo sapien
gtgctttgtaagcttcagtcttatt

SEQ ID NO: 572037 - DNA, 25 bp, Homo sapien
gcttcagtcttatttatagtgtggg

SEQ ID NO: 572038 - DNA, 25 bp, Homo sapien
atggttctacctcagaagttaatag

SEQ ID NO: 572039 - DNA, 25 bp, Homo sapien
atgcatgtaaattgctcagcagcgt

SEQ ID NO: 572040 - DNA, 25 bp, Homo sapien
gctcagcagcgtgcctagcataaag

SEQ ID NO: 572041 - DNA, 25 bp, Homo sapien
gcgtgcctagcataaagtaattact

SEQ ID NO: 572042 - DNA, 25 bp, Homo sapien
tagaaagccaatcatctcagccatg

SEQ ID NO: 572043 - DNA, 25 bp, Homo sapien
atctcagccatgattatctcagaaa

SEQ ID NO: 572044 - DNA, 25 bp, Homo sapien
tgcaacccagtcctctttgcagcat

SEQ ID NO: 572045 - DNA, 25 bp, Homo sapien
agtcctctttgcagcatcccaaact

SEQ ID NO: 572046 - DNA, 25 bp, Homo sapien
aaactccctctctcataataatcca

SEQ ID NO: 572047 - DNA, 25 bp, Homo sapien
aactccctctctcataataatccag

SEQ ID NO: 572048 - DNA, 25 bp, Homo sapien
actccctctctcataataatccagg

SEQ ID NO: 572049 - DNA, 25 bp, Homo sapien
ctccctctctcataataatccagga

SEQ ID NO: 572050 - DNA, 25 bp, Homo sapien
tccctctctcataataatccaggat

SEQ ID NO: 572051 - DNA, 25 bp, Homo sapien
ccctctctcataataatccaggata

SEQ ID NO: 572052 - DNA, 25 bp, Homo sapien
cctctctcataataatccaggataa

SEQ ID NO: 572053 - DNA, 25 bp, Homo sapien
aatccaggataatagtcatttccca

SEQ ID NO: 572054 - DNA, 25 bp, Homo sapien
ccaggataatagtcatttcccattt

SEQ ID NO: 572055 - DNA, 25 bp, Homo sapien
tacaagaaatcctagatggccaaag

SEQ ID NO: 572056 - DNA, 25 bp, Homo sapien
gaaatcctagatggccaaagaaggc

SEQ ID NO: 572057 - DNA, 25 bp, Homo sapien
ggagtggagctaagcacaggaaaat

SEQ ID NO: 572058 - DNA, 25 bp, Homo sapien
cacaggaaaatgcaacgacttacaa

SEQ ID NO: 572059 - DNA, 25 bp, Homo sapien
ggaaaatgcaacgacttacaaataa

SEQ ID NO: 572060 - DNA, 25 bp, Homo sapien
gaaaatcacaatgttttagctaatt

SEQ ID NO: 572061 - DNA, 25 bp, Homo sapien
gaacaaaaatgatctctagcaaatg

SEQ ID NO: 572062 - DNA, 25 bp, Homo sapien
gatctctagcaaatgatgccaactg

SEQ ID NO: 572063 - DNA, 25 bp, Homo sapien
atgccaactggcaccaaattctttt

SEQ ID NO: 572064 - DNA, 25 bp, Homo sapien
caactggcaccaaattctttttgaa

SEQ ID NO: 572065 - DNA, 25 bp, Homo sapien
tgaatcttaaacatatatgcacacg

SEQ ID NO: 572066 - DNA, 25 bp, Homo sapien
gtgtgtcgagaaggctcattccatt

SEQ ID NO: 572067 - DNA, 25 bp, Homo sapien
gctcattccatttggacccagccaa

SEQ ID NO: 572068 - DNA, 25 bp, Homo sapien
ggacccagccaatctcaagggttgt

SEQ ID NO: 572069 - DNA, 25 bp, Homo sapien
caagggttgtaccagctgtttctgt

SEQ ID NO: 572070 - DNA, 25 bp, Homo sapien
ggagtaaataatcaatgtcacagct

SEQ ID NO: 572071 - DNA, 25 bp, Homo sapien
atgtcacagctcacataagcgaagg

SEQ ID NO: 572072 - DNA, 25 bp, Homo sapien
ttgtggatatgctgggctggcacct

SEQ ID NO: 572073 - DNA, 25 bp, Homo sapien
gacagcagacagagtggacatccct

SEQ ID NO: 572074 - DNA, 25 bp, Homo sapien
gacagagtggacatccctgtctctt

SEQ ID NO: 572075 - DNA, 25 bp, Homo sapien
tgtctctttcaacccaggcagcaac

SEQ ID NO: 572076 - DNA, 25 bp, Homo sapien
gcaacagtatggtggcggatctcca

SEQ ID NO: 572077 - DNA, 25 bp, Homo sapien
aagattctatgtttccagacatgtt

SEQ ID NO: 572078 - DNA, 25 bp, Homo sapien
ttgcaagaattattggagcacctaa

SEQ ID NO: 572079 - DNA, 25 bp, Homo sapien
atcaaaatagtgtcattgtttccct

SEQ ID NO: 572080 - DNA, 25 bp, Homo sapien
gttatactattgcatgtctctagct

SEQ ID NO: 572081 - DNA, 25 bp, Homo sapien
gtctctagctttattggattcttcc

SEQ ID NO: 572082 - DNA, 25 bp, Homo sapien
ttacatttttggttgtgtggccctc

SEQ ID NO: 572083 - DNA, 25 bp, Homo sapien
ttgtgtggccctcgttgccctattg

SEQ ID NO: 572084 - DNA, 25 bp, Homo sapien
ttgccctattgcacttttgataatg

SEQ ID NO: 572085 - DNA, 25 bp, Homo sapien
gataatgttgcctgtgacaagtagt

SEQ ID NO: 572086 - DNA, 25 bp, Homo sapien
tgcctgtgacaagtagttatttttc

SEQ ID NO: 572087 - DNA, 25 bp, Homo sapien
agttatttttcattaccacattcaa

SEQ ID NO: 572088 - DNA, 25 bp, Homo sapien
acgctttgggttgctgtatggtagt

SEQ ID NO: 572089 - DNA, 25 bp, Homo sapien
gctttgggttgctgtatggtagtat

SEQ ID NO: 572090 - DNA, 25 bp, Homo sapien
ctttgggttgctgtatggtagtatg

SEQ ID NO: 572091 - DNA, 25 bp, Homo sapien
tgggttgctgtatggtagtatgcta

SEQ ID NO: 572092 - DNA, 25 bp, Homo sapien
gggttgctgtatggtagtatgctaa

SEQ ID NO: 572093 - DNA, 25 bp, Homo sapien
ggttgctgtatggtagtatgctaaa

SEQ ID NO: 572094 - DNA, 25 bp, Homo sapien
gttgctgtatggtagtatgctaaag

SEQ ID NO: 572095 - DNA, 25 bp, Homo sapien
gctgtatggtagtatgctaaaggac

SEQ ID NO: 572096 - DNA, 25 bp, Homo sapien
gtatggtagtatgctaaaggacagc

SEQ ID NO: 572097 - DNA, 25 bp, Homo sapien
atggtagtatgctaaaggacagcaa

SEQ ID NO: 572098 - DNA, 25 bp, Homo sapien
agtatgctaaaggacagcaagaatc

SEQ ID NO: 572099 - DNA, 25 bp, Homo sapien
gaatacggtcgtgtctgttaaacta

SEQ ID NO: 572100 - DNA, 25 bp, Homo sapien
tacggtcgtgtctgttaaactaatt

SEQ ID NO: 572101 - DNA, 25 bp, Homo sapien
gtgtctgttaaactaattgtagctg

SEQ ID NO: 572102 - DNA, 25 bp, Homo sapien
aattttacaacatttcagcttcaaa

SEQ ID NO: 572103 - DNA, 25 bp, Homo sapien
cagcttcaaatagaatggcttcaat

SEQ ID NO: 572104 - DNA, 25 bp, Homo sapien
gggaaatgttatccttcctaggaga

SEQ ID NO: 572105 - DNA, 25 bp, Homo sapien
atttatgggattcctggatcttttt

SEQ ID NO: 572106 - DNA, 25 bp, Homo sapien
tcctggatcttttttgtgtctgatt

SEQ ID NO: 572107 - DNA, 25 bp, Homo sapien
tctgattgttaaggtcttgacagcc

SEQ ID NO: 572108 - DNA, 25 bp, Homo sapien
ggtcttgacagcctttcaattgagg

SEQ ID NO: 572109 - DNA, 25 bp, Homo sapien
tcaattgaggaatacggtcgtgtct

SEQ ID NO: 572110 - DNA, 25 bp, Homo sapien
ggcaggaagaagctctttatctttc

SEQ ID NO: 572111 - DNA, 25 bp, Homo sapien
ctttatctttcaactgtatggagct

SEQ ID NO: 572112 - DNA, 25 bp, Homo sapien
tttcaactgtatggagcttgttaac

SEQ ID NO: 572113 - DNA, 25 bp, Homo sapien
gagcttgttaacaagcctctgaggt

SEQ ID NO: 572114 - DNA, 25 bp, Homo sapien
gggggtatacatttcacacattctt

SEQ ID NO: 572115 - DNA, 25 bp, Homo sapien
cacattcttttgcaagttttaggtt

SEQ ID NO: 572116 - DNA, 25 bp, Homo sapien
ttaggttctgcaaccaagggccaga

SEQ ID NO: 572117 - DNA, 25 bp, Homo sapien
gcaaccaagggccagaaatcttttc

SEQ ID NO: 572118 - DNA, 25 bp, Homo sapien
cttccagatgctagtgttaggagtt

SEQ ID NO: 572119 - DNA, 25 bp, Homo sapien
tactgtcaatgtatattgcaaggtg

SEQ ID NO: 572120 - DNA, 25 bp, Homo sapien
ttgcaaggtgaattcaaatgcatcc

SEQ ID NO: 572121 - DNA, 25 bp, Homo sapien
cagtcaccgaccttccctgagattg

SEQ ID NO: 572122 - DNA, 25 bp, Homo sapien
gtcaccgaccttccctgagattgct

SEQ ID NO: 572123 - DNA, 25 bp, Homo sapien
gaccttccctgagattgctacctgg

SEQ ID NO: 572124 - DNA, 25 bp, Homo sapien
accttccctgagattgctacctgga

SEQ ID NO: 572125 - DNA, 25 bp, Homo sapien
ccttccctgagattgctacctggaa

SEQ ID NO: 572126 - DNA, 25 bp, Homo sapien
ttccctgagattgctacctggaagc

SEQ ID NO: 572127 - DNA, 25 bp, Homo sapien
tccctgagattgctacctggaagct

SEQ ID NO: 572128 - DNA, 25 bp, Homo sapien
gagattgctacctggaagctctttc

SEQ ID NO: 572129 - DNA, 25 bp, Homo sapien
agattgctacctggaagctctttct

SEQ ID NO: 572130 - DNA, 25 bp, Homo sapien
gattgctacctggaagctctttcta

SEQ ID NO: 572131 - DNA, 25 bp, Homo sapien
attgctacctggaagctctttctat

SEQ ID NO: 572132 - DNA, 25 bp, Homo sapien
tggactaatttgcttgacacatggc

SEQ ID NO: 572133 - DNA, 25 bp, Homo sapien
cttgacacatggcagaggatggctc

SEQ ID NO: 572134 - DNA, 25 bp, Homo sapien
gaggatggctcacttataccttcac

SEQ ID NO: 572135 - DNA, 25 bp, Homo sapien
ggctcacttataccttcactttgga

SEQ ID NO: 572136 - DNA, 25 bp, Homo sapien
ttcactttggaaacaaccttctctt

SEQ ID NO: 572137 - DNA, 25 bp, Homo sapien
acaaccttctcttagatcaggatca

SEQ ID NO: 572138 - DNA, 25 bp, Homo sapien
gatcattgagatcactggcaacatt

SEQ ID NO: 572139 - DNA, 25 bp, Homo sapien
gatcactggcaacattatagtagac

SEQ ID NO: 572140 - DNA, 25 bp, Homo sapien
gttaaatacgcagacttccaggaat

SEQ ID NO: 572141 - DNA, 25 bp, Homo sapien
gacttccaggaattttaccagttag

SEQ ID NO: 572142 - DNA, 25 bp, Homo sapien
ttttaccagttagtgagtacttgtg

SEQ ID NO: 572143 - DNA, 25 bp, Homo sapien
cagtcaccgaccttccctgagattg

SEQ ID NO: 572144 - DNA, 25 bp, Homo sapien
gaccttccctgagattgctacctgg

SEQ ID NO: 572145 - DNA, 25 bp, Homo sapien
ccttccctgagattgctacctggaa

SEQ ID NO: 572146 - DNA, 25 bp, Homo sapien
tccctgagattgctacctggaagct

SEQ ID NO: 572147 - DNA, 25 bp, Homo sapien
gagattgctacctggaagctctttc

SEQ ID NO: 572148 - DNA, 25 bp, Homo sapien
gattgctacctggaagctctttcta

SEQ ID NO: 572149 - DNA, 25 bp, Homo sapien
attgctacctggaagctctttctat

SEQ ID NO: 572150 - DNA, 25 bp, Homo sapien
tgctacctggaagctctttctatta

SEQ ID NO: 572151 - DNA, 25 bp, Homo sapien
acctggaagctctttctattacact

SEQ ID NO: 572152 - DNA, 25 bp, Homo sapien
ggtggccatgttcctaccaggtaaa

SEQ ID NO: 572153 - DNA, 25 bp, Homo sapien
gtgagttactcctgcattctttcca

SEQ ID NO: 572154 - DNA, 25 bp, Homo sapien
gggaacttcaacactttgttttgca

SEQ ID NO: 572155 - DNA, 25 bp, Homo sapien
aacactttgttttgcaggctctgcg

SEQ ID NO: 572156 - DNA, 25 bp, Homo sapien
aggcctggctcatgtggcgcttcat

SEQ ID NO: 572157 - DNA, 25 bp, Homo sapien
cactggcgggaatactggaatgagc

SEQ ID NO: 572158 - DNA, 25 bp, Homo sapien
agtgcaaagcggagagtcccagcca

SEQ ID NO: 572159 - DNA, 25 bp, Homo sapien
taccagccaggctcatcaagaggga

SEQ ID NO: 572160 - DNA, 25 bp, Homo sapien
ggctcatcaagagggaatctggtta

SEQ ID NO: 572161 - DNA, 25 bp, Homo sapien
cattggctttggactggctcgcatg

SEQ ID NO: 572162 - DNA, 25 bp, Homo sapien
tttggactggctcgcatggaaaacc

SEQ ID NO: 572163 - DNA, 25 bp, Homo sapien
gaaaaccaggcatttgatcccgaga

SEQ ID NO: 572164 - DNA, 25 bp, Homo sapien
accaggcatttgatcccgagaaagg

SEQ ID NO: 572165 - DNA, 25 bp, Homo sapien
atggaggccaccggtaggagtctat

SEQ ID NO: 572166 - DNA, 25 bp, Homo sapien
aggagtctatggtgtgaaaccctac

SEQ ID NO: 572167 - DNA, 25 bp, Homo sapien
ggtgtgaaaccctacagcattgctc

SEQ ID NO: 572168 - DNA, 25 bp, Homo sapien
gcattgctccgtagagtacgtgcaa

SEQ ID NO: 572169 - DNA, 25 bp, Homo sapien
tacgtgcaagttccttgaccctggg

SEQ ID NO: 572170 - DNA, 25 bp, Homo sapien
ttgaccctgggaaatgtctacaaat

SEQ ID NO: 572171 - DNA, 25 bp, Homo sapien
aatgtctatttctactgagttctgg

SEQ ID NO: 572172 - DNA, 25 bp, Homo sapien
ggaagggcaaaaatcatcccctatt

SEQ ID NO: 572173 - DNA, 25 bp, Homo sapien
tcatcccctattttacttatttcca

SEQ ID NO: 572174 - DNA, 25 bp, Homo sapien
gcattttcttagcatcattgcccac

SEQ ID NO: 572175 - DNA, 25 bp, Homo sapien
gcatcattgcccacagtgttgatat

SEQ ID NO: 572176 - DNA, 25 bp, Homo sapien
agaaacaaaatctacctatagttat

SEQ ID NO: 572177 - DNA, 25 bp, Homo sapien
aaatctacctatagttatatggata

SEQ ID NO: 572178 - DNA, 25 bp, Homo sapien
gcacaaaggaacacagtataacatt

SEQ ID NO: 572179 - DNA, 25 bp, Homo sapien
ggaacacagtataacatttgtataa

SEQ ID NO: 572180 - DNA, 25 bp, Homo sapien
gatcttgcaaagaacagtactgtgt

SEQ ID NO: 572181 - DNA, 25 bp, Homo sapien
agaacagtactgtgtattggtcatg

SEQ ID NO: 572182 - DNA, 25 bp, Homo sapien
cagtactgtgtattggtcatggatc

SEQ ID NO: 572183 - DNA, 25 bp, Homo sapien
gtactgtgtattggtcatggatcca

SEQ ID NO: 572184 - DNA, 25 bp, Homo sapien
ctgtgtattggtcatggatccatat

SEQ ID NO: 572185 - DNA, 25 bp, Homo sapien
ggatccatatatgacttggttgcct

SEQ ID NO: 572186 - DNA, 25 bp, Homo sapien
atccatatatgacttggttgccttt

SEQ ID NO: 572187 - DNA, 25 bp, Homo sapien
ccccatgtcctaagcattaaggtgt

SEQ ID NO: 572188 - DNA, 25 bp, Homo sapien
gtcctaagcattaaggtgtccacaa

SEQ ID NO: 572189 - DNA, 25 bp, Homo sapien
ttaaggtgtccacaaagattccttt

SEQ ID NO: 572190 - DNA, 25 bp, Homo sapien
acgacctcttcaaatactggcccat

SEQ ID NO: 572191 - DNA, 25 bp, Homo sapien
aaatactggcccatcatcctgttgt

SEQ ID NO: 572192 - DNA, 25 bp, Homo sapien
tggcccatcatcctgttgttcttta

SEQ ID NO: 572193 - DNA, 25 bp, Homo sapien
ccatcatcctgttgttctttacagc

SEQ ID NO: 572194 - DNA, 25 bp, Homo sapien
atcctgttgttctttacagcacttt

SEQ ID NO: 572195 - DNA, 25 bp, Homo sapien
acagcacttttgactttatcttctt

SEQ ID NO: 572196 - DNA, 25 bp, Homo sapien
gactttatcttcttaattcctggag

SEQ ID NO: 572197 - DNA, 25 bp, Homo sapien
atcttcttaattcctggagggcagg

SEQ ID NO: 572198 - DNA, 25 bp, Homo sapien
tctttcttaaggtggctacgtttag

SEQ ID NO: 572199 - DNA, 25 bp, Homo sapien
ctacgtttaggacatgagccagggt

SEQ ID NO: 572200 - DNA, 25 bp, Homo sapien
agccagggttgccagtgtcacccat

SEQ ID NO: 572201 - DNA, 25 bp, Homo sapien
gtcacccatcacatgtaccatatga

SEQ ID NO: 572202 - DNA, 25 bp, Homo sapien
gatggtggagcctaatgacattgtt

SEQ ID NO: 572203 - DNA, 25 bp, Homo sapien
gaagcgtatccagaattccggctga

SEQ ID NO: 572204 - DNA, 25 bp, Homo sapien
gaattccggctgagtatctgtacta

SEQ ID NO: 572205 - DNA, 25 bp, Homo sapien
atctgtactagtcaatgttctccaa

SEQ ID NO: 572206 - DNA, 25 bp, Homo sapien
tacacaggcataactcagagatact

SEQ ID NO: 572207 - DNA, 25 bp, Homo sapien
actgtaggtttggttgcaggccacc

SEQ ID NO: 572208 - DNA, 25 bp, Homo sapien
gcaggccacctcaataaaacaaata

SEQ ID NO: 572209 - DNA, 25 bp, Homo sapien
atgaggttggcatttataccttccc

SEQ ID NO: 572210 - DNA, 25 bp, Homo sapien
tgaggttggcatttataccttccct

SEQ ID NO: 572211 - DNA, 25 bp, Homo sapien
gaggttggcatttataccttccctt

SEQ ID NO: 572212 - DNA, 25 bp, Homo sapien
aggttggcatttataccttcccttg

SEQ ID NO: 572213 - DNA, 25 bp, Homo sapien
ggttggcatttataccttcccttga

SEQ ID NO: 572214 - DNA, 25 bp, Homo sapien
gttggcatttataccttcccttgaa

SEQ ID NO: 572215 - DNA, 25 bp, Homo sapien
tggcatttataccttcccttgaaga

SEQ ID NO: 572216 - DNA, 25 bp, Homo sapien
gcatttataccttcccttgaagagg

SEQ ID NO: 572217 - DNA, 25 bp, Homo sapien
aaaatcactctttcgtctgggtgcg

SEQ ID NO: 572218 - DNA, 25 bp, Homo sapien
gtgggagtgctgtagtccagtactc

SEQ ID NO: 572219 - DNA, 25 bp, Homo sapien
tgggagtgctgtagtccagtactca

SEQ ID NO: 572220 - DNA, 25 bp, Homo sapien
gaatctcagtgagcacttcttcttt

SEQ ID NO: 572221 - DNA, 25 bp, Homo sapien
aaacttcttagacaataggcctgat

SEQ ID NO: 572222 - DNA, 25 bp, Homo sapien
aattatctcaccagatgactgggta

SEQ ID NO: 572223 - DNA, 25 bp, Homo sapien
gtgacctaagatacactttcttcag

SEQ ID NO: 572224 - DNA, 25 bp, Homo sapien
cactttcttcagtttctgggtagga

SEQ ID NO: 572225 - DNA, 25 bp, Homo sapien
tagtgactggtttcccctgggatac

SEQ ID NO: 572226 - DNA, 25 bp, Homo sapien
tttcccctgggatacatagataact

SEQ ID NO: 572227 - DNA, 25 bp, Homo sapien
acatagataactctcctgctgcagt

SEQ ID NO: 572228 - DNA, 25 bp, Homo sapien
gctgcagtccttaccaactgccaaa

SEQ ID NO: 572229 - DNA, 25 bp, Homo sapien
cacccatctctagcttcagtaagtt

SEQ ID NO: 572230 - DNA, 25 bp, Homo sapien
tcagtaagtttgagtctcctcccag

SEQ ID NO: 572231 - DNA, 25 bp, Homo sapien
acgcccagccaccttttctatgttt

SEQ ID NO: 572232 - DNA, 25 bp, Homo sapien
ttagatacataaacactcaccactg

SEQ ID NO: 572233 - DNA, 25 bp, Homo sapien
taaacactcaccactgtgtcacagt

SEQ ID NO: 572234 - DNA, 25 bp, Homo sapien
gtgtcacagtcacctacagtattca

SEQ ID NO: 572235 - DNA, 25 bp, Homo sapien
gtcacagtcacctacagtattcagt

SEQ ID NO: 572236 - DNA, 25 bp, Homo sapien
agcatatgctgtacaggcttgtagc

SEQ ID NO: 572237 - DNA, 25 bp, Homo sapien
tagcctaggtgtgtacaccatctag

SEQ ID NO: 572238 - DNA, 25 bp, Homo sapien
cctaggtgtgtacaccatctaggtt

SEQ ID NO: 572239 - DNA, 25 bp, Homo sapien
caccatctaggtttttctaactaca

SEQ ID NO: 572240 - DNA, 25 bp, Homo sapien
gtttttctaactacactctatgatg

SEQ ID NO: 572241 - DNA, 25 bp, Homo sapien
gttcacacaataaaattgcccaacg

SEQ ID NO: 572242 - DNA, 25 bp, Homo sapien
aacttttcatcaatttaatccacct

SEQ ID NO: 572243 - DNA, 25 bp, Homo sapien
taatccaccttgactttggttacaa

SEQ ID NO: 572244 - DNA, 25 bp, Homo sapien
gaaccaagacaactctgtaagacaa

SEQ ID NO: 572245 - DNA, 25 bp, Homo sapien
aaacattcatgtatcaccagcagac

SEQ ID NO: 572246 - DNA, 25 bp, Homo sapien
ttcatgtatcaccagcagaccacca

SEQ ID NO: 572247 - DNA, 25 bp, Homo sapien
gaccaccacctgtatgccggaagga

SEQ ID NO: 572248 - DNA, 25 bp, Homo sapien
gtatgccggaaggaatctgctctgc

SEQ ID NO: 572249 - DNA, 25 bp, Homo sapien
atctgctctgcattaaaaagtactt

SEQ ID NO: 572250 - DNA, 25 bp, Homo sapien
ataaatgtaccctggaaggcctaga

SEQ ID NO: 572251 - DNA, 25 bp, Homo sapien
gaaggcctagaaactggctttcaat

SEQ ID NO: 572252 - DNA, 25 bp, Homo sapien
caataaatagtgacaatctggagac

SEQ ID NO: 572253 - DNA, 25 bp, Homo sapien
gacaagctttgcgatgagacggcaa

SEQ ID NO: 572254 - DNA, 25 bp, Homo sapien
acaagctttgcgatgagacggcaac

SEQ ID NO: 572255 - DNA, 25 bp, Homo sapien
caagctttgcgatgagacggcaacc

SEQ ID NO: 572256 - DNA, 25 bp, Homo sapien
aagctttgcgatgagacggcaaccc

SEQ ID NO: 572257 - DNA, 25 bp, Homo sapien
agctttgcgatgagacggcaacccc

SEQ ID NO: 572258 - DNA, 25 bp, Homo sapien
gctttgcgatgagacggcaacccca

SEQ ID NO: 572259 - DNA, 25 bp, Homo sapien
ctttgcgatgagacggcaaccccag

SEQ ID NO: 572260 - DNA, 25 bp, Homo sapien
tttgcgatgagacggcaaccccagc

SEQ ID NO: 572261 - DNA, 25 bp, Homo sapien
gcgatgagacggcaaccccagcttc

SEQ ID NO: 572262 - DNA, 25 bp, Homo sapien
gatgagacggcaaccccagcttccg

SEQ ID NO: 572263 - DNA, 25 bp, Homo sapien
atgagacggcaaccccagcttccgg

SEQ ID NO: 572264 - DNA, 25 bp, Homo sapien
ccacccaacactttcagaatgtcag

SEQ ID NO: 572265 - DNA, 25 bp, Homo sapien
aacactttcagaatgtcagtctgag

SEQ ID NO: 572266 - DNA, 25 bp, Homo sapien
ctgggagctttagactcgggccgca

SEQ ID NO: 572267 - DNA, 25 bp, Homo sapien
gactcgggccgcaggttttatggta

SEQ ID NO: 572268 - DNA, 25 bp, Homo sapien
tcgggccgcaggttttatggtaaag

SEQ ID NO: 572269 - DNA, 25 bp, Homo sapien
gccgcaggttttatggtaaagtgct

SEQ ID NO: 572270 - DNA, 25 bp, Homo sapien
ggtaaagtgctgttccagtaacctt

SEQ ID NO: 572271 - DNA, 25 bp, Homo sapien
aagtgctgttccagtaaccttgtca

SEQ ID NO: 572272 - DNA, 25 bp, Homo sapien
gttccagtaaccttgtcaccaaaag

SEQ ID NO: 572273 - DNA, 25 bp, Homo sapien
gtaaccttgtcaccaaaaggtgcaa

SEQ ID NO: 572274 - DNA, 25 bp, Homo sapien
gtccggaggcaaagctgtgaaatct

SEQ ID NO: 572275 - DNA, 25 bp, Homo sapien
gtgccctccgcatggcagccaaaga

SEQ ID NO: 572276 - DNA, 25 bp, Homo sapien
gtgttgctaatcacatgagagcagt

SEQ ID NO: 572277 - DNA, 25 bp, Homo sapien
gctaatcacatgagagcagtagaaa

SEQ ID NO: 572278 - DNA, 25 bp, Homo sapien
gcagtagaaaatacgcttcacaagg

SEQ ID NO: 572279 - DNA, 25 bp, Homo sapien
gaaaatacgcttcacaaggtcagag

SEQ ID NO: 572280 - DNA, 25 bp, Homo sapien
atacgcttcacaaggtcagagatca

SEQ ID NO: 572281 - DNA, 25 bp, Homo sapien
ggtcagagatcagatctcgctgtca

SEQ ID NO: 572282 - DNA, 25 bp, Homo sapien
gcgtcgactggaggagaacatccat

SEQ ID NO: 572283 - DNA, 25 bp, Homo sapien
atccatgatgcagagagtgccctcc

SEQ ID NO: 572284 - DNA, 25 bp, Homo sapien
atgatgcagagagtgccctccgcat

SEQ ID NO: 572285 - DNA, 25 bp, Homo sapien
gatgcagagagtgccctccgcatgg

SEQ ID NO: 572286 - DNA, 25 bp, Homo sapien
ccgattccttctggtatgcttctgt

SEQ ID NO: 572287 - DNA, 25 bp, Homo sapien
ttctggtatgcttctgttttgccca

SEQ ID NO: 572288 - DNA, 25 bp, Homo sapien
ttttgcccattgaattttagaagca

SEQ ID NO: 572289 - DNA, 25 bp, Homo sapien
aagcattttgctgatatctatattt

SEQ ID NO: 572290 - DNA, 25 bp, Homo sapien
ggctggggttgtattactcctataa

SEQ ID NO: 572291 - DNA, 25 bp, Homo sapien
actcctataatctgtgaagaattgc

SEQ ID NO: 572292 - DNA, 25 bp, Homo sapien
gaagaattgccagtttaatgtttat

SEQ ID NO: 572293 - DNA, 25 bp, Homo sapien
tattcttcccatctagaacctgact

SEQ ID NO: 572294 - DNA, 25 bp, Homo sapien
tagaacctgacttgcctcttcattt

SEQ ID NO: 572295 - DNA, 25 bp, Homo sapien
gacttgcctcttcatttgtttgagc

SEQ ID NO: 572296 - DNA, 25 bp, Homo sapien
gtttgagcattttttgatatggcct

SEQ ID NO: 572297 - DNA, 25 bp, Homo sapien
ctatagacttgacagcacttcctat

SEQ ID NO: 572298 - DNA, 25 bp, Homo sapien
tagacttgacagcacttcctataga

SEQ ID NO: 572299 - DNA, 25 bp, Homo sapien
gacttgacagcacttcctatagaca

SEQ ID NO: 572300 - DNA, 25 bp, Homo sapien
cttgacagcacttcctatagacatt

SEQ ID NO: 572301 - DNA, 25 bp, Homo sapien
tgacagcacttcctatagacattct

SEQ ID NO: 572302 - DNA, 25 bp, Homo sapien
acagcacttcctatagacattctat

SEQ ID NO: 572303 - DNA, 25 bp, Homo sapien
tagacattctataaaccgttattaa

SEQ ID NO: 572304 - DNA, 25 bp, Homo sapien
atagtaaatctgttctctcagttaa

SEQ ID NO: 572305 - DNA, 25 bp, Homo sapien
gtaaatctgttctctcagttaagga

SEQ ID NO: 572306 - DNA, 25 bp, Homo sapien
ctctcagttaaggatatgaatgatc

SEQ ID NO: 572307 - DNA, 25 bp, Homo sapien
taaggatatgaatgatcctcagaag

SEQ ID NO: 572308 - DNA, 25 bp, Homo sapien
tagcaccagtctttttgctaaccat

SEQ ID NO: 572309 - DNA, 25 bp, Homo sapien
ccatgatgcctttgtgtaagtgaga

SEQ ID NO: 572310 - DNA, 25 bp, Homo sapien
aaagacatcctacctggaccaatta

SEQ ID NO: 572311 - DNA, 25 bp, Homo sapien
ctacctggaccaattaactatgcaa

SEQ ID NO: 572312 - DNA, 25 bp, Homo sapien
gaccaattaactatgcaaagatgct

SEQ ID NO: 572313 - DNA, 25 bp, Homo sapien
caaagatgctgttttttactgggct

SEQ ID NO: 572314 - DNA, 25 bp, Homo sapien
tttttactgggctggaaccacagta

SEQ ID NO: 572315 - DNA, 25 bp, Homo sapien
ggaaccacagtaggacatatctttg

SEQ ID NO: 572316 - DNA, 25 bp, Homo sapien
taggacatatctttgcctacccctg

SEQ ID NO: 572317 - DNA, 25 bp, Homo sapien
tttgcctacccctgtgctgggaacc

SEQ ID NO: 572318 - DNA, 25 bp, Homo sapien
gaacccacttaaaatgcacaaactg

SEQ ID NO: 572319 - DNA, 25 bp, Homo sapien
gagggcggcctattccccacagtgt

SEQ ID NO: 572320 - DNA, 25 bp, Homo sapien
ataattcgctttctcatccgtgaaa

SEQ ID NO: 572321 - DNA, 25 bp, Homo sapien
aaagtcggactaactcatctccaca

SEQ ID NO: 572322 - DNA, 25 bp, Homo sapien
acttccaactctaacaacctgtgtt

SEQ ID NO: 572323 - DNA, 25 bp, Homo sapien
aacaacctgtgttaggaaatcaaag

SEQ ID NO: 572324 - DNA, 25 bp, Homo sapien
tcaaaggtaaggactctgaccacaa

SEQ ID NO: 572325 - DNA, 25 bp, Homo sapien
gaagcaaaacccgagactcacggaa

SEQ ID NO: 572326 - DNA, 25 bp, Homo sapien
gagactcacggaacgacgccaccat

SEQ ID NO: 572327 - DNA, 25 bp, Homo sapien
acggaacgacgccaccattgcagtt

SEQ ID NO: 572328 - DNA, 25 bp, Homo sapien
ttcttttctggtctgttctgctctt

SEQ ID NO: 572329 - DNA, 25 bp, Homo sapien
gtctgttctgctcttttggtttaaa

SEQ ID NO: 572330 - DNA, 25 bp, Homo sapien
ctcattctatgagcaccgagagata

SEQ ID NO: 572331 - DNA, 25 bp, Homo sapien
tgagcaccgagagataaacgttatc

SEQ ID NO: 572332 - DNA, 25 bp, Homo sapien
tggtgtatcttcatgaaactactaa

SEQ ID NO: 572333 - DNA, 25 bp, Homo sapien
catgaaactactaacccaaacccag

SEQ ID NO: 572334 - DNA, 25 bp, Homo sapien
agaacacagccatctcgctactaaa

SEQ ID NO: 572335 - DNA, 25 bp, Homo sapien
gccatctcgctactaaagtctcaga

SEQ ID NO: 572336 - DNA, 25 bp, Homo sapien
gagatattgagcttggacttcgacc

SEQ ID NO: 572337 - DNA, 25 bp, Homo sapien
ttggacttcgaccatgggttctgga

SEQ ID NO: 572338 - DNA, 25 bp, Homo sapien
agtccattcaattcccagccttggc

SEQ ID NO: 572339 - DNA, 25 bp, Homo sapien
ttggccattcctggctgtgtaattt

SEQ ID NO: 572340 - DNA, 25 bp, Homo sapien
gaaattacctaaacactctgagttt

SEQ ID NO: 572341 - DNA, 25 bp, Homo sapien
gacaatgaggatccagtcgtgtgcc

SEQ ID NO: 572342 - DNA, 25 bp, Homo sapien
gatccagtcgtgtgcctggacaaga

SEQ ID NO: 572343 - DNA, 25 bp, Homo sapien
ggacaagaaaccagtgatcatcatt

SEQ ID NO: 572344 - DNA, 25 bp, Homo sapien
tcattttcgatgagcccatggacat

SEQ ID NO: 572345 - DNA, 25 bp, Homo sapien
ggacatccggtctgcctataagaga

SEQ ID NO: 572346 - DNA, 25 bp, Homo sapien
agagactttcaactatctttgagga

SEQ ID NO: 572347 - DNA, 25 bp, Homo sapien
agccactgacaatattgccttcatg

SEQ ID NO: 572348 - DNA, 25 bp, Homo sapien
gacaatattgccttcatgattaccg

SEQ ID NO: 572349 - DNA, 25 bp, Homo sapien
atgattaccgaaaccactgtccagg

SEQ ID NO: 572350 - DNA, 25 bp, Homo sapien
gaggtgcatgatattgttagccaaa

SEQ ID NO: 572351 - DNA, 25 bp, Homo sapien
cagacggttaatatcgatgccagaa

SEQ ID NO: 572352 - DNA, 25 bp, Homo sapien
cagctatgaacaagacaaacagtcc

SEQ ID NO: 572353 - DNA, 25 bp, Homo sapien
tcccaagagccgtcacttcagaagg

SEQ ID NO: 572354 - DNA, 25 bp, Homo sapien
agagccgtcacttcagaagggcaga

SEQ ID NO: 572355 - DNA, 25 bp, Homo sapien
gaagggcagacatgacacgcaaaca

SEQ ID NO: 572356 - DNA, 25 bp, Homo sapien
gggaaacagtgccacctttctgaga

SEQ ID NO: 572357 - DNA, 25 bp, Homo sapien
cagtgccacctttctgagaccgttt

SEQ ID NO: 572358 - DNA, 25 bp, Homo sapien
tgataacaccagtccctcagggtgg

SEQ ID NO: 572359 - DNA, 25 bp, Homo sapien
aacaccagtccctcagggtggaggt

SEQ ID NO: 572360 - DNA, 25 bp, Homo sapien
ggtgaagactaagaggttgctttga

SEQ ID NO: 572361 - DNA, 25 bp, Homo sapien
accacctagaacctggcacatacta

SEQ ID NO: 572362 - DNA, 25 bp, Homo sapien
gcacatactaagctctcaataaaag

SEQ ID NO: 572363 - DNA, 25 bp, Homo sapien
gaaatgaaaccgttgtcttgaagac

SEQ ID NO: 572364 - DNA, 25 bp, Homo sapien
gaaaccgttgtcttgaagacatgtc

SEQ ID NO: 572365 - DNA, 25 bp, Homo sapien
tgtcttgaagacatgtctacacttc

SEQ ID NO: 572366 - DNA, 25 bp, Homo sapien
gaagacatgtctacacttccatgtt

SEQ ID NO: 572367 - DNA, 25 bp, Homo sapien
atgtctacacttccatgttcattgt

SEQ ID NO: 572368 - DNA, 25 bp, Homo sapien
ctacacttccatgttcattgtagca

SEQ ID NO: 572369 - DNA, 25 bp, Homo sapien
aaacaacctaagtgtcctctgatga

SEQ ID NO: 572370 - DNA, 25 bp, Homo sapien
acaacctaagtgtcctctgatgaat

SEQ ID NO: 572371 - DNA, 25 bp, Homo sapien
cctaagtgtcctctgatgaatgaat

SEQ ID NO: 572372 - DNA, 25 bp, Homo sapien
aagtgtcctctgatgaatgaatgga

SEQ ID NO: 572373 - DNA, 25 bp, Homo sapien
agaggaaatgtttatacacacacac

SEQ ID NO: 572374 - DNA, 25 bp, Homo sapien
gaggtcatagtgttgaactgttgtt

SEQ ID NO: 572375 - DNA, 25 bp, Homo sapien
aactgttgttgcgaatacttctctc

SEQ ID NO: 572376 - DNA, 25 bp, Homo sapien
gttgcgaatacttctctcgtagaca

SEQ ID NO: 572377 - DNA, 25 bp, Homo sapien
tctctcgtagacaccctgagaagtg

SEQ ID NO: 572378 - DNA, 25 bp, Homo sapien
gatagtgagttcatgctaaagctac

SEQ ID NO: 572379 - DNA, 25 bp, Homo sapien
gctaaagctacagtctaactttcta

SEQ ID NO: 572380 - DNA, 25 bp, Homo sapien
attctgtgaattccatgtccagaag

SEQ ID NO: 572381 - DNA, 25 bp, Homo sapien
gagttcagggttatcaatgcggtat

SEQ ID NO: 572382 - DNA, 25 bp, Homo sapien
gttatcaatgcggtattttctcaaa

SEQ ID NO: 572383 - DNA, 25 bp, Homo sapien
aaatagaaccactctgttctccaag

SEQ ID NO: 572384 - DNA, 25 bp, Homo sapien
tatagaagcccaggaaatattctgt

SEQ ID NO: 572385 - DNA, 25 bp, Homo sapien
cactattttccagtagggtaggaca

SEQ ID NO: 572386 - DNA, 25 bp, Homo sapien
acatagtccctatagctttatttaa

SEQ ID NO: 572387 - DNA, 25 bp, Homo sapien
atcaggaacattctcctaacttgga

SEQ ID NO: 572388 - DNA, 25 bp, Homo sapien
tctcctaacttggattttcttggga

SEQ ID NO: 572389 - DNA, 25 bp, Homo sapien
tttcttgggaaatgcactaaacagg

SEQ ID NO: 572390 - DNA, 25 bp, Homo sapien
tattcctgaaaacctagtgaccttc

SEQ ID NO: 572391 - DNA, 25 bp, Homo sapien
gtgaccttcacaggaacatggcggg

SEQ ID NO: 572392 - DNA, 25 bp, Homo sapien
aacatggcgggacctgtgacactaa

SEQ ID NO: 572393 - DNA, 25 bp, Homo sapien
gacctgtgacactaagtaagcttca

SEQ ID NO: 572394 - DNA, 25 bp, Homo sapien
tgaaaactgttcacggtcgtaaccg

SEQ ID NO: 572395 - DNA, 25 bp, Homo sapien
gtcgtaaccgtagaagtgttgccaa

SEQ ID NO: 572396 - DNA, 25 bp, Homo sapien
cgatgccatggcactgggaaatcat

SEQ ID NO: 572397 - DNA, 25 bp, Homo sapien
tggaaggactgatcgagccactcct

SEQ ID NO: 572398 - DNA, 25 bp, Homo sapien
ctcaaagaggccaaatttccaattc

SEQ ID NO: 572399 - DNA, 25 bp, Homo sapien
caaatttccaattctgagtgcaaac

SEQ ID NO: 572400 - DNA, 25 bp, Homo sapien
gggccactagcatctcaaatatcag

SEQ ID NO: 572401 - DNA, 25 bp, Homo sapien
agcatctcaaatatcaggactttat

SEQ ID NO: 572402 - DNA, 25 bp, Homo sapien
tatttgccatataaagttcttcctg

SEQ ID NO: 572403 - DNA, 25 bp, Homo sapien
ttgtgggaatcgttggatacacttc

SEQ ID NO: 572404 - DNA, 25 bp, Homo sapien
tggatacacttccaaagaaacccct

SEQ ID NO: 572405 - DNA, 25 bp, Homo sapien
caaatccagggacaaatttagtgtt

SEQ ID NO: 572406 - DNA, 25 bp, Homo sapien
tcactgcattacaacctgaagtaga

SEQ ID NO: 572407 - DNA, 25 bp, Homo sapien
tcttcctaagtatagagattgggtc

SEQ ID NO: 572408 - DNA, 25 bp, Homo sapien
ttcctaagtatagagattgggtctt

SEQ ID NO: 572409 - DNA, 25 bp, Homo sapien
ctgaagtgccgggattggaggccca

SEQ ID NO: 572410 - DNA, 25 bp, Homo sapien
tgccgggattggaggcccaagccac

SEQ ID NO: 572411 - DNA, 25 bp, Homo sapien
gccgggattggaggcccaagccact

SEQ ID NO: 572412 - DNA, 25 bp, Homo sapien
aattgtatagtcaaaatggctcaca

SEQ ID NO: 572413 - DNA, 25 bp, Homo sapien
ttgtatagtcaaaatggctcacata

SEQ ID NO: 572414 - DNA, 25 bp, Homo sapien
gtatagtcaaaatggctcacatatt

SEQ ID NO: 572415 - DNA, 25 bp, Homo sapien
tatagtcaaaatggctcacatatta

SEQ ID NO: 572416 - DNA, 25 bp, Homo sapien
tagtcaaaatggctcacatattaaa

SEQ ID NO: 572417 - DNA, 25 bp, Homo sapien
gtcaaaatggctcacatattaaata

SEQ ID NO: 572418 - DNA, 25 bp, Homo sapien
agcttcagtagcatggtaaggtgca

SEQ ID NO: 572419 - DNA, 25 bp, Homo sapien
atggtaaggtgcagagaaccttcct

SEQ ID NO: 572420 - DNA, 25 bp, Homo sapien
tcctgcttccattgggttcttcctt

SEQ ID NO: 572421 - DNA, 25 bp, Homo sapien
cattgggttcttcctttagtccagg

SEQ ID NO: 572422 - DNA, 25 bp, Homo sapien
gggttcttcctttagtccaggccat

SEQ ID NO: 572423 - DNA, 25 bp, Homo sapien
ttagtccaggccatcccatgtaagg

SEQ ID NO: 572424 - DNA, 25 bp, Homo sapien
ccatgtaaggcctgctctcgggtgg

SEQ ID NO: 572425 - DNA, 25 bp, Homo sapien
taaggcctgctctcgggtggcaatt

SEQ ID NO: 572426 - DNA, 25 bp, Homo sapien
agtgggcgctgctgctacagactca

SEQ ID NO: 572427 - DNA, 25 bp, Homo sapien
gctgctgctacagactcatctgaac

SEQ ID NO: 572428 - DNA, 25 bp, Homo sapien
gctacagactcatctgaacacacct

SEQ ID NO: 572429 - DNA, 25 bp, Homo sapien
ctttcctctgttgtctcaagacatt

SEQ ID NO: 572430 - DNA, 25 bp, Homo sapien
ctctgttgtctcaagacattttcca

SEQ ID NO: 572431 - DNA, 25 bp, Homo sapien
gacattttccaagtaccagacagga

SEQ ID NO: 572432 - DNA, 25 bp, Homo sapien
gacaggacaaaatggcttagatgta

SEQ ID NO: 572433 - DNA, 25 bp, Homo sapien
tagatgtaagcctctctactttgcc

SEQ ID NO: 572434 - DNA, 25 bp, Homo sapien
gtaagcctctctactttgccgcagg

SEQ ID NO: 572435 - DNA, 25 bp, Homo sapien
agtgctctctgttgtcccacctagg

SEQ ID NO: 572436 - DNA, 25 bp, Homo sapien
tgttgtcccacctaggctcctgctg

SEQ ID NO: 572437 - DNA, 25 bp, Homo sapien
cctgatgtctgcagattcacttggt

SEQ ID NO: 572438 - DNA, 25 bp, Homo sapien
atgtctgcagattcacttggtcaag

SEQ ID NO: 572439 - DNA, 25 bp, Homo sapien
gcagattcacttggtcaagaggagt

SEQ ID NO: 572440 - DNA, 25 bp, Homo sapien
ttcggaaggacctgttgcagctgct

SEQ ID NO: 572441 - DNA, 25 bp, Homo sapien
ggagccttgccaaagtcaactgttc

SEQ ID NO: 572442 - DNA, 25 bp, Homo sapien
caaaccggcccaagaagagagagat

SEQ ID NO: 572443 - DNA, 25 bp, Homo sapien
gagagagatctacaaccctaagtct

SEQ ID NO: 572444 - DNA, 25 bp, Homo sapien
tacaaccctaagtctgtggtcctgg

SEQ ID NO: 572445 - DNA, 25 bp, Homo sapien
gtggtcctggatttgtgcagcatca

SEQ ID NO: 572446 - DNA, 25 bp, Homo sapien
tgtgcagcatcaacaagacgactaa

SEQ ID NO: 572447 - DNA, 25 bp, Homo sapien
ttatcctatttttatggcaccccag

SEQ ID NO: 572448 - DNA, 25 bp, Homo sapien
ccccattgaggattgtccaagccat

SEQ ID NO: 572449 - DNA, 25 bp, Homo sapien
gattgtccaagccatcaaagcacct

SEQ ID NO: 572450 - DNA, 25 bp, Homo sapien
atccgagaactcttggcttagtgta

SEQ ID NO: 572451 - DNA, 25 bp, Homo sapien
gcctgctgactcgtcagagttgctc

SEQ ID NO: 572452 - DNA, 25 bp, Homo sapien
tgctgactcgtcagagttgctcatg

SEQ ID NO: 572453 - DNA, 25 bp, Homo sapien
gctgactcgtcagagttgctcatgg

SEQ ID NO: 572454 - DNA, 25 bp, Homo sapien
ctgactcgtcagagttgctcatgga

SEQ ID NO: 572455 - DNA, 25 bp, Homo sapien
gactcgtcagagttgctcatggagg

SEQ ID NO: 572456 - DNA, 25 bp, Homo sapien
actcgtcagagttgctcatggaggt

SEQ ID NO: 572457 - DNA, 25 bp, Homo sapien
ctcgtcagagttgctcatggaggtg

SEQ ID NO: 572458 - DNA, 25 bp, Homo sapien
cgtcagagttgctcatggaggtgca

SEQ ID NO: 572459 - DNA, 25 bp, Homo sapien
tcagagttgctcatggaggtgcacg

SEQ ID NO: 572460 - DNA, 25 bp, Homo sapien
agttgctcatggaggtgcacggaaa

SEQ ID NO: 572461 - DNA, 25 bp, Homo sapien
ttgctcatggaggtgcacggaaatg

SEQ ID NO: 572462 - DNA, 25 bp, Homo sapien
gtaaaatcttgtacacatcttagct

SEQ ID NO: 572463 - DNA, 25 bp, Homo sapien
aaaatcttgtacacatcttagctgc

SEQ ID NO: 572464 - DNA, 25 bp, Homo sapien
aaatcttgtacacatcttagctgca

SEQ ID NO: 572465 - DNA, 25 bp, Homo sapien
aatcttgtacacatcttagctgcaa

SEQ ID NO: 572466 - DNA, 25 bp, Homo sapien
atcttgtacacatcttagctgcaat

SEQ ID NO: 572467 - DNA, 25 bp, Homo sapien
tcttgtacacatcttagctgcaatg

SEQ ID NO: 572468 - DNA, 25 bp, Homo sapien
ttgtacacatcttagctgcaatgta

SEQ ID NO: 572469 - DNA, 25 bp, Homo sapien
gtacacatcttagctgcaatgtatg

SEQ ID NO: 572470 - DNA, 25 bp, Homo sapien
tacacatcttagctgcaatgtatgt

SEQ ID NO: 572471 - DNA, 25 bp, Homo sapien
gctgcaatgtatgttgaaggaaatt

SEQ ID NO: 572472 - DNA, 25 bp, Homo sapien
gaacaaatagagttgttctttttct

SEQ ID NO: 572473 - DNA, 25 bp, Homo sapien
gaagtgtctcctgaagttgcttctt

SEQ ID NO: 572474 - DNA, 25 bp, Homo sapien
ctgaagttgcttctttccaatccag

SEQ ID NO: 572475 - DNA, 25 bp, Homo sapien
gcttctttccaatccagctaacaaa

SEQ ID NO: 572476 - DNA, 25 bp, Homo sapien
atgcagtattctgaatggaggtacc

SEQ ID NO: 572477 - DNA, 25 bp, Homo sapien
tggaggtaccagagatcacgtcatc

SEQ ID NO: 572478 - DNA, 25 bp, Homo sapien
agatcacgtcatcttcagctttctg

SEQ ID NO: 572479 - DNA, 25 bp, Homo sapien
gtcatcttcagctttctgctgcaga

SEQ ID NO: 572480 - DNA, 25 bp, Homo sapien
tctgctgcagatccacatgaagaat

SEQ ID NO: 572481 - DNA, 25 bp, Homo sapien
gaagaatcacacatatccttaatgt

SEQ ID NO: 572482 - DNA, 25 bp, Homo sapien
aaatgtgaagtctggctttgaagag

SEQ ID NO: 572483 - DNA, 25 bp, Homo sapien
actgtgcatcagtctcactaatgga

SEQ ID NO: 572484 - DNA, 25 bp, Homo sapien
ggtagttaggttctgtgaattttct

SEQ ID NO: 572485 - DNA, 25 bp, Homo sapien
gtgaattttctgtgcacactgaatt

SEQ ID NO: 572486 - DNA, 25 bp, Homo sapien
aattttctgtgcacactgaattagt

SEQ ID NO: 572487 - DNA, 25 bp, Homo sapien
gtgaatgctgaatgattgttgctag

SEQ ID NO: 572488 - DNA, 25 bp, Homo sapien
ggaaatacagcgttagcttctgtga

SEQ ID NO: 572489 - DNA, 25 bp, Homo sapien
acagcgttagcttctgtgagcctct

SEQ ID NO: 572490 - DNA, 25 bp, Homo sapien
ttctgtgagcctctgatccaaacat

SEQ ID NO: 572491 - DNA, 25 bp, Homo sapien
gtgagcctctgatccaaacattttt

SEQ ID NO: 572492 - DNA, 25 bp, Homo sapien
aaacatttttatcaaccagtcaaca

SEQ ID NO: 572493 - DNA, 25 bp, Homo sapien
atttttatcaaccagtcaacacata

SEQ ID NO: 572494 - DNA, 25 bp, Homo sapien
ttatcagtgtttcttgaataattat

SEQ ID NO: 572495 - DNA, 25 bp, Homo sapien
agcagtgggaaatagccctgcccaa

SEQ ID NO: 572496 - DNA, 25 bp, Homo sapien
ggaaatagccctgcccaacaactgg

SEQ ID NO: 572497 - DNA, 25 bp, Homo sapien
caacaactggcagcggtacccaagg

SEQ ID NO: 572498 - DNA, 25 bp, Homo sapien
aactggcagcggtacccaaggacaa

SEQ ID NO: 572499 - DNA, 25 bp, Homo sapien
acagggaggaagcttgttccccaca

SEQ ID NO: 572500 - DNA, 25 bp, Homo sapien
aggaagcttgttccccacaacagga

SEQ ID NO: 572501 - DNA, 25 bp, Homo sapien
agcttgttccccacaacaggaacct

SEQ ID NO: 572502 - DNA, 25 bp, Homo sapien
gttccccacaacaggaacctcaggg

SEQ ID NO: 572503 - DNA, 25 bp, Homo sapien
tgattgatgccccaacgttggagga

SEQ ID NO: 572504 - DNA, 25 bp, Homo sapien
ttgatgccccaacgttggaggatga

SEQ ID NO: 572505 - DNA, 25 bp, Homo sapien
ccccaacgttggaggatgagcccca

SEQ ID NO: 572506 - DNA, 25 bp, Homo sapien
actttttcatctaaagcctttacag

SEQ ID NO: 572507 - DNA, 25 bp, Homo sapien
tgagcattaagaacaccccctctat

SEQ ID NO: 572508 - DNA, 25 bp, Homo sapien
cctctatttccatcttgaggctaga

SEQ ID NO: 572509 - DNA, 25 bp, Homo sapien
agcctcctagacctagagtaccatt

SEQ ID NO: 572510 - DNA, 25 bp, Homo sapien
tagagtaccattgagctcctcacat

SEQ ID NO: 572511 - DNA, 25 bp, Homo sapien
taccattgagctcctcacatcagga

SEQ ID NO: 572512 - DNA, 25 bp, Homo sapien
gtattatttcaaagtacctcctagt

SEQ ID NO: 572513 - DNA, 25 bp, Homo sapien
tcaaagtacctcctagtatcttccc

SEQ ID NO: 572514 - DNA, 25 bp, Homo sapien
gtatcttccccatcattagactgga

SEQ ID NO: 572515 - DNA, 25 bp, Homo sapien
cattagactggacatcgggattgct

SEQ ID NO: 572516 - DNA, 25 bp, Homo sapien
ggacatcgggattgctactttataa

SEQ ID NO: 572517 - DNA, 25 bp, Homo sapien
tctgcagctcggcttacccagggct

SEQ ID NO: 572518 - DNA, 25 bp, Homo sapien
agccactctcctttactgcagagag

SEQ ID NO: 572519 - DNA, 25 bp, Homo sapien
gctgggagctgcgtcagacctgcct

SEQ ID NO: 572520 - DNA, 25 bp, Homo sapien
ctgcctccacgtgcctgtgggaaga

SEQ ID NO: 572521 - DNA, 25 bp, Homo sapien
gagacgtcggagtctgatcgcagac

SEQ ID NO: 572522 - DNA, 25 bp, Homo sapien
gtctgatcgcagacacaagaagatc

SEQ ID NO: 572523 - DNA, 25 bp, Homo sapien
caagaagatcagtcacccaaaaaga

SEQ ID NO: 572524 - DNA, 25 bp, Homo sapien
atatactcgaacttccgacccttca

SEQ ID NO: 572525 - DNA, 25 bp, Homo sapien
gacccttcatcttcctttcagaaca

SEQ ID NO: 572526 - DNA, 25 bp, Homo sapien
cttcctttcagaacacactcacatt

SEQ ID NO: 572527 - DNA, 25 bp, Homo sapien
ttttctataggaaaacagcctcata

SEQ ID NO: 572528 - DNA, 25 bp, Homo sapien
aacatctcattgtttactcaccctt

SEQ ID NO: 572529 - DNA, 25 bp, Homo sapien
tgtttactcacccttcatgtactca

SEQ ID NO: 572530 - DNA, 25 bp, Homo sapien
atgtactcacctcccattataatgt

SEQ ID NO: 572531 - DNA, 25 bp, Homo sapien
agatagcctttattttacctcacgg

SEQ ID NO: 572532 - DNA, 25 bp, Homo sapien
tttacctcacggcatgtccataaag

SEQ ID NO: 572533 - DNA, 25 bp, Homo sapien
agaatctgtcttaactacctactta

SEQ ID NO: 572534 - DNA, 25 bp, Homo sapien
tacctacttacaccaaggcatcagc

SEQ ID NO: 572535 - DNA, 25 bp, Homo sapien
ccaaggcatcagcaattcatttatt

SEQ ID NO: 572536 - DNA, 25 bp, Homo sapien
ttattcattcatccgttattgtatg

SEQ ID NO: 572537 - DNA, 25 bp, Homo sapien
ccgttattgtatgaagtattggcta

SEQ ID NO: 572538 - DNA, 25 bp, Homo sapien
gagtaagcattcacaccgttgcttc

SEQ ID NO: 572539 - DNA, 25 bp, Homo sapien
ttttttgaatcggtatctgctgcaa

SEQ ID NO: 572540 - DNA, 25 bp, Homo sapien
ttgaatcggtatctgctgcaataag

SEQ ID NO: 572541 - DNA, 25 bp, Homo sapien
gtatctgctgcaataagtcatatcc

SEQ ID NO: 572542 - DNA, 25 bp, Homo sapien
gctgcaataagtcatatccattcaa

SEQ ID NO: 572543 - DNA, 25 bp, Homo sapien
gtcatatccattcaaataaggccag

SEQ ID NO: 572544 - DNA, 25 bp, Homo sapien
atatccattcaaataaggccagtta

SEQ ID NO: 572545 - DNA, 25 bp, Homo sapien
aggccagttataaactgttgtttga

SEQ ID NO: 572546 - DNA, 25 bp, Homo sapien
gttgtttgataacttggatcttcca

SEQ ID NO: 572547 - DNA, 25 bp, Homo sapien
gataacttggatcttccaacaatgc

SEQ ID NO: 572548 - DNA, 25 bp, Homo sapien
ttccaacaatgccaccgctctgagg

SEQ ID NO: 572549 - DNA, 25 bp, Homo sapien
aatgccaccgctctgaggattgggt

SEQ ID NO: 572550 - DNA, 25 bp, Homo sapien
ttctcctaaggacttaaggttatat

SEQ ID NO: 572551 - DNA, 25 bp, Homo sapien
aaggttatatgatgcctatgtgaat

SEQ ID NO: 572552 - DNA, 25 bp, Homo sapien
gtgaatagaaattcctcccataact

SEQ ID NO: 572553 - DNA, 25 bp, Homo sapien
ttctacattttctaaacagctcatc

SEQ ID NO: 572554 - DNA, 25 bp, Homo sapien
acagctcatcacaaactactttttc

SEQ ID NO: 572555 - DNA, 25 bp, Homo sapien
gttatcaaaattattgtttcttgct

SEQ ID NO: 572556 - DNA, 25 bp, Homo sapien
gtttcttgcttttgtctaagtacat

SEQ ID NO: 572557 - DNA, 25 bp, Homo sapien
cttgcttttgtctaagtacattctt

SEQ ID NO: 572558 - DNA, 25 bp, Homo sapien
aagtacattcttagaagctggaaat

SEQ ID NO: 572559 - DNA, 25 bp, Homo sapien
tagaagctggaaattttgacatctt

SEQ ID NO: 572560 - DNA, 25 bp, Homo sapien
ttgacatcttttggattctgaccag

SEQ ID NO: 572561 - DNA, 25 bp, Homo sapien
gaggtattctactgcccagaggaat

SEQ ID NO: 572562 - DNA, 25 bp, Homo sapien
gaggaattacccagcctttagcaag

SEQ ID NO: 572563 - DNA, 25 bp, Homo sapien
aaggcgaagtcagcctcaactggca

SEQ ID NO: 572564 - DNA, 25 bp, Homo sapien
ctcaactggcaggaggtttgtttta

SEQ ID NO: 572565 - DNA, 25 bp, Homo sapien
aaggatctgggcttacaaatgatgg

SEQ ID NO: 572566 - DNA, 25 bp, Homo sapien
atagcaactaacttgtttccccagc

SEQ ID NO: 572567 - DNA, 25 bp, Homo sapien
gtttccccagcacaactgaaaggat

SEQ ID NO: 572568 - DNA, 25 bp, Homo sapien
aacaatttaatgtaccctggtcatg

SEQ ID NO: 572569 - DNA, 25 bp, Homo sapien
cctggtcatgcagttactttccttt

SEQ ID NO: 572570 - DNA, 25 bp, Homo sapien
tactttcctttatccttactaacag

SEQ ID NO: 572571 - DNA, 25 bp, Homo sapien
agtgcttgtcaagatggttctggaa

SEQ ID NO: 572572 - DNA, 25 bp, Homo sapien
gcataaatgttaacctgagttctct

SEQ ID NO: 572573 - DNA, 25 bp, Homo sapien
taaatgttaacctgagttctctagc

SEQ ID NO: 572574 - DNA, 25 bp, Homo sapien
aatgttaacctgagttctctagctc

SEQ ID NO: 572575 - DNA, 25 bp, Homo sapien
atgttaacctgagttctctagctct

SEQ ID NO: 572576 - DNA, 25 bp, Homo sapien
tgttaacctgagttctctagctctg

SEQ ID NO: 572577 - DNA, 25 bp, Homo sapien
ggaaaacaagcttgagataccaaaa

SEQ ID NO: 572578 - DNA, 25 bp, Homo sapien
aaacaagcttgagataccaaaattg

SEQ ID NO: 572579 - DNA, 25 bp, Homo sapien
aaattgaaaagacagctcatcaaaa

SEQ ID NO: 572580 - DNA, 25 bp, Homo sapien
atgaaatactcaaatctcttgcccc

SEQ ID NO: 572581 - DNA, 25 bp, Homo sapien
ctcctgctaggagcataaatgttaa

SEQ ID NO: 572582 - DNA, 25 bp, Homo sapien
ggagcataaatgttaacctgagttc

SEQ ID NO: 572583 - DNA, 25 bp, Homo sapien
tttagaacaaggcatgtccccaatt

SEQ ID NO: 572584 - DNA, 25 bp, Homo sapien
ggcatgtccccaattaccatggcaa

SEQ ID NO: 572585 - DNA, 25 bp, Homo sapien
acagaccccagagtcttgtggttct

SEQ ID NO: 572586 - DNA, 25 bp, Homo sapien
gtcttgtggttctctaactccagaa

SEQ ID NO: 572587 - DNA, 25 bp, Homo sapien
ttcagctagctctcctgagcaggga

SEQ ID NO: 572588 - DNA, 25 bp, Homo sapien
gggacgctccccagaaccaacagaa

SEQ ID NO: 572589 - DNA, 25 bp, Homo sapien
agaaccaacagaaatcagtgccaag

SEQ ID NO: 572590 - DNA, 25 bp, Homo sapien
gccaagcatgcgatattcagagtct

SEQ ID NO: 572591 - DNA, 25 bp, Homo sapien
cagaccggcagtcatcatggcagtt

SEQ ID NO: 572592 - DNA, 25 bp, Homo sapien
cagtttcagcgttcaaacagcaata

SEQ ID NO: 572593 - DNA, 25 bp, Homo sapien
acagcaatagctcaagtgtgataac

SEQ ID NO: 572594 - DNA, 25 bp, Homo sapien
gggctaaggcagacaaaccctatag

SEQ ID NO: 572595 - DNA, 25 bp, Homo sapien
gagggtgtcttggtcaaattttcat

SEQ ID NO: 572596 - DNA, 25 bp, Homo sapien
atttgtgaaaagtaccacaggtgct

SEQ ID NO: 572597 - DNA, 25 bp, Homo sapien
gtaccacaggtgctatgtcaaggct

SEQ ID NO: 572598 - DNA, 25 bp, Homo sapien
gtcaaggctggattataggatttca

SEQ ID NO: 572599 - DNA, 25 bp, Homo sapien
ggtgaggcaaggataacagtagaat

SEQ ID NO: 572600 - DNA, 25 bp, Homo sapien
aatagttttttatgtgccaagcatc

SEQ ID NO: 572601 - DNA, 25 bp, Homo sapien
gtgccaagcatcattctaaatgtct

SEQ ID NO: 572602 - DNA, 25 bp, Homo sapien
atgtcttacatatactaactcactt

SEQ ID NO: 572603 - DNA, 25 bp, Homo sapien
acagcaaccctgtgaagtaaatggt

SEQ ID NO: 572604 - DNA, 25 bp, Homo sapien
tgaagtaaatggtactattatcccc

SEQ ID NO: 572605 - DNA, 25 bp, Homo sapien
aggtaataacacatgcaaagggatg

SEQ ID NO: 572606 - DNA, 25 bp, Homo sapien
ggtaataacacatgcaaagggatgt

SEQ ID NO: 572607 - DNA, 25 bp, Homo sapien
gtaataacacatgcaaagggatgtg

SEQ ID NO: 572608 - DNA, 25 bp, Homo sapien
aacacatgcaaagggatgtgtagca

SEQ ID NO: 572609 - DNA, 25 bp, Homo sapien
acatgcaaagggatgtgtagcaatc

SEQ ID NO: 572610 - DNA, 25 bp, Homo sapien
catgcaaagggatgtgtagcaatca

SEQ ID NO: 572611 - DNA, 25 bp, Homo sapien
atgcaaagggatgtgtagcaatcaa

SEQ ID NO: 572612 - DNA, 25 bp, Homo sapien
gtgtagcaatcaaagggaaatgtta

SEQ ID NO: 572613 - DNA, 25 bp, Homo sapien
tgtagcaatcaaagggaaatgttat

SEQ ID NO: 572614 - DNA, 25 bp, Homo sapien
gtagcaatcaaagggaaatgttatc

SEQ ID NO: 572615 - DNA, 25 bp, Homo sapien
agcaatcaaagggaaatgttatcct

SEQ ID NO: 572616 - DNA, 25 bp, Homo sapien
taatctcaacgctttgggaggggag

SEQ ID NO: 572617 - DNA, 25 bp, Homo sapien
caacacaatgaaaccgtgtatctac

SEQ ID NO: 572618 - DNA, 25 bp, Homo sapien
aacacaatgaaaccgtgtatctact

SEQ ID NO: 572619 - DNA, 25 bp, Homo sapien
acaatgaaaccgtgtatctactaaa

SEQ ID NO: 572620 - DNA, 25 bp, Homo sapien
caatgaaaccgtgtatctactaaaa

SEQ ID NO: 572621 - DNA, 25 bp, Homo sapien
atcacaccaccgtactccggtctga

SEQ ID NO: 572622 - DNA, 25 bp, Homo sapien
tcacaccaccgtactccggtctgag

SEQ ID NO: 572623 - DNA, 25 bp, Homo sapien
acaccaccgtactccggtctgagcg

SEQ ID NO: 572624 - DNA, 25 bp, Homo sapien
caccaccgtactccggtctgagcga

SEQ ID NO: 572625 - DNA, 25 bp, Homo sapien
accaccgtactccggtctgagcgac

SEQ ID NO: 572626 - DNA, 25 bp, Homo sapien
gtactccggtctgagcgacagagca

SEQ ID NO: 572627 - DNA, 25 bp, Homo sapien
gctgaacaaagcagggaggcccacg

SEQ ID NO: 572628 - DNA, 25 bp, Homo sapien
ggaggcccacggttagacaccaggc

SEQ ID NO: 572629 - DNA, 25 bp, Homo sapien
tagacaccaggcagaactgcccagg

SEQ ID NO: 572630 - DNA, 25 bp, Homo sapien
actgcccaggagagacacagggaca

SEQ ID NO: 572631 - DNA, 25 bp, Homo sapien
gacacagggacaatcagaccagcgt

SEQ ID NO: 572632 - DNA, 25 bp, Homo sapien
atcagaccagcgtcctcgaggttag

SEQ ID NO: 572633 - DNA, 25 bp, Homo sapien
agcgtcctcgaggttagcctgaggc

SEQ ID NO: 572634 - DNA, 25 bp, Homo sapien
ggtggttcctgtttgtcccaccact

SEQ ID NO: 572635 - DNA, 25 bp, Homo sapien
gtttgtcccaccacttaactgggag

SEQ ID NO: 572636 - DNA, 25 bp, Homo sapien
cacttaactgggagacactgtttta

SEQ ID NO: 572637 - DNA, 25 bp, Homo sapien
ttaaaacacaccgtggcttccttca

SEQ ID NO: 572638 - DNA, 25 bp, Homo sapien
ggtagtctttaattcctggcctcaa

SEQ ID NO: 572639 - DNA, 25 bp, Homo sapien
actgcacccagccaatgggtgtaat

SEQ ID NO: 572640 - DNA, 25 bp, Homo sapien
ccagccaatgggtgtaatttcatag

SEQ ID NO: 572641 - DNA, 25 bp, Homo sapien
gccaatgggtgtaatttcataggaa

SEQ ID NO: 572642 - DNA, 25 bp, Homo sapien
attctttttgtcagaatgtactgaa

SEQ ID NO: 572643 - DNA, 25 bp, Homo sapien
ttttgtcagaatgtactgaattgta

SEQ ID NO: 572644 - DNA, 25 bp, Homo sapien
ctgaattgtaatattaatacctgaa

SEQ ID NO: 572645 - DNA, 25 bp, Homo sapien
tacctgaaaatttgttagttcactt

SEQ ID NO: 572646 - DNA, 25 bp, Homo sapien
tcacttcttttccacgttcttcttt

SEQ ID NO: 572647 - DNA, 25 bp, Homo sapien
gttcttctttcccaacatataacca

SEQ ID NO: 572648 - DNA, 25 bp, Homo sapien
cttctttcccaacatataaccacaa

SEQ ID NO: 572649 - DNA, 25 bp, Homo sapien
aacattcagctttattttcggcttg

SEQ ID NO: 572650 - DNA, 25 bp, Homo sapien
ttcggcttgtgaaattcctgtcctt

SEQ ID NO: 572651 - DNA, 25 bp, Homo sapien
ttgtgaaattcctgtccttcattcc

SEQ ID NO: 572652 - DNA, 25 bp, Homo sapien
gtccttcattcccaacaggtgcaat

SEQ ID NO: 572653 - DNA, 25 bp, Homo sapien
aacaggtgcaatcgcctcatttaga

SEQ ID NO: 572654 - DNA, 25 bp, Homo sapien
gcaatcgcctcatttagatattggg

SEQ ID NO: 572655 - DNA, 25 bp, Homo sapien
atatagcttcctttagggatctgga

SEQ ID NO: 572656 - DNA, 25 bp, Homo sapien
cttcctttagggatctggatgctac

SEQ ID NO: 572657 - DNA, 25 bp, Homo sapien
aaaaagccctcctgtgagatgccga

SEQ ID NO: 572658 - DNA, 25 bp, Homo sapien
cctcctgtgagatgccgagacttaa

SEQ ID NO: 572659 - DNA, 25 bp, Homo sapien
gtgagatgccgagacttaatagaaa

SEQ ID NO: 572660 - DNA, 25 bp, Homo sapien
atacaaaattagccacatgtgatgg

SEQ ID NO: 572661 - DNA, 25 bp, Homo sapien
aattagccacatgtgatggcgcacg

SEQ ID NO: 572662 - DNA, 25 bp, Homo sapien
attagccacatgtgatggcgcacgc

SEQ ID NO: 572663 - DNA, 25 bp, Homo sapien
ttagccacatgtgatggcgcacgcc

SEQ ID NO: 572664 - DNA, 25 bp, Homo sapien
tagccacatgtgatggcgcacgcct

SEQ ID NO: 572665 - DNA, 25 bp, Homo sapien
agccacatgtgatggcgcacgcctg

SEQ ID NO: 572666 - DNA, 25 bp, Homo sapien
gccacatgtgatggcgcacgcctgt

SEQ ID NO: 572667 - DNA, 25 bp, Homo sapien
ccacatgtgatggcgcacgcctgta

SEQ ID NO: 572668 - DNA, 25 bp, Homo sapien
ttaccatgccctaaaagtgagatgt

SEQ ID NO: 572669 - DNA, 25 bp, Homo sapien
gagtctgttattctttatgttaagc

SEQ ID NO: 572670 - DNA, 25 bp, Homo sapien
agcattttggcttctgttgtactcc

SEQ ID NO: 572671 - DNA, 25 bp, Homo sapien
ggcttctgttgtactcctaaatcac

SEQ ID NO: 572672 - DNA, 25 bp, Homo sapien
tcctaaatcactactgagagcagag

SEQ ID NO: 572673 - DNA, 25 bp, Homo sapien
tgtgtgctgcctgtgacgcatcccg

SEQ ID NO: 572674 - DNA, 25 bp, Homo sapien
gacgcatcccgttgtcaccggagtg

SEQ ID NO: 572675 - DNA, 25 bp, Homo sapien
tgtcaccggagtgccgtggccctaa

SEQ ID NO: 572676 - DNA, 25 bp, Homo sapien
agtgccgtggccctaaggaatgaca

SEQ ID NO: 572677 - DNA, 25 bp, Homo sapien
atgacagcattaaggcatggacgtt

SEQ ID NO: 572678 - DNA, 25 bp, Homo sapien
gaattgttcacggtgttgtatttta

SEQ ID NO: 572679 - DNA, 25 bp, Homo sapien
aatggttgttttagagttatgtttg

SEQ ID NO: 572680 - DNA, 25 bp, Homo sapien
gttatgtttgtaaattacctggcac

SEQ ID NO: 572681 - DNA, 25 bp, Homo sapien
gtttgtaaattacctggcacatgta

SEQ ID NO: 572682 - DNA, 25 bp, Homo sapien
atactttgagccatttcctactgta

SEQ ID NO: 572683 - DNA, 25 bp, Homo sapien
actttgagccatttcctactgtaga

SEQ ID NO: 572684 - DNA, 25 bp, Homo sapien
tttgagccatttcctactgtagact

SEQ ID NO: 572685 - DNA, 25 bp, Homo sapien
gccatttcctactgtagactctagc

SEQ ID NO: 572686 - DNA, 25 bp, Homo sapien
ttcctactgtagactctagcacaca

SEQ ID NO: 572687 - DNA, 25 bp, Homo sapien
gtagactctagcacacattttcaag

SEQ ID NO: 572688 - DNA, 25 bp, Homo sapien
tagactctagcacacattttcaagg

SEQ ID NO: 572689 - DNA, 25 bp, Homo sapien
gataataaggctgtaggatattttt

SEQ ID NO: 572690 - DNA, 25 bp, Homo sapien
ctttacacctgtcttcttatcctca

SEQ ID NO: 572691 - DNA, 25 bp, Homo sapien
tacacctgtcttcttatcctcacat

SEQ ID NO: 572692 - DNA, 25 bp, Homo sapien
ctcacatctgttttcacaccttcat

SEQ ID NO: 572693 - DNA, 25 bp, Homo sapien
atctgttttcacaccttcatccctg

SEQ ID NO: 572694 - DNA, 25 bp, Homo sapien
ctgtcttcctcatgttcacacttgt

SEQ ID NO: 572695 - DNA, 25 bp, Homo sapien
tcttcctcatgttcacacttgtctt

SEQ ID NO: 572696 - DNA, 25 bp, Homo sapien
atgttcacacttgtcttccccatgt

SEQ ID NO: 572697 - DNA, 25 bp, Homo sapien
cttccccatgttcatagctgccttt

SEQ ID NO: 572698 - DNA, 25 bp, Homo sapien
atgttcatagctgcctttcttacca

SEQ ID NO: 572699 - DNA, 25 bp, Homo sapien
tcatagctgcctttcttaccatttt

SEQ ID NO: 572700 - DNA, 25 bp, Homo sapien
accattttggtttgaagggcagtct

SEQ ID NO: 572701 - DNA, 25 bp, Homo sapien
ggtttgtgaccataatggcatctat

SEQ ID NO: 572702 - DNA, 25 bp, Homo sapien
ggagtaagcaaacaacatctcctgg

SEQ ID NO: 572703 - DNA, 25 bp, Homo sapien
gcgtgaatccaactgcttggtggaa

SEQ ID NO: 572704 - DNA, 25 bp, Homo sapien
tggtggaacgaagcaatcaagtcag

SEQ ID NO: 572705 - DNA, 25 bp, Homo sapien
tcaagtcagcttactgagagttcaa

SEQ ID NO: 572706 - DNA, 25 bp, Homo sapien
gttcaaaagaggcacttcccggatg

SEQ ID NO: 572707 - DNA, 25 bp, Homo sapien
ttcccggatgcctatcagtccttta

SEQ ID NO: 572708 - DNA, 25 bp, Homo sapien
agtcctttactgataccacaaccaa

SEQ ID NO: 572709 - DNA, 25 bp, Homo sapien
tgataccacaaccaaagagcctgtt

SEQ ID NO: 572710 - DNA, 25 bp, Homo sapien
gagcctgttcccaacagtggcagga

SEQ ID NO: 572711 - DNA, 25 bp, Homo sapien
atcacttgacaattggtttgtgacc

SEQ ID NO: 572712 - DNA, 25 bp, Homo sapien
gatgttgactccatctcttatttaa

SEQ ID NO: 572713 - DNA, 25 bp, Homo sapien
tatatatgtaaacggctttattgag

SEQ ID NO: 572714 - DNA, 25 bp, Homo sapien
tagtatactcacagacatgtgccag

SEQ ID NO: 572715 - DNA, 25 bp, Homo sapien
tgtgccagcatcactgcaatcaact

SEQ ID NO: 572716 - DNA, 25 bp, Homo sapien
gtgccagcatcactgcaatcaactt

SEQ ID NO: 572717 - DNA, 25 bp, Homo sapien
gccagcatcactgcaatcaacttta

SEQ ID NO: 572718 - DNA, 25 bp, Homo sapien
cagcatcactgcaatcaactttaga

SEQ ID NO: 572719 - DNA, 25 bp, Homo sapien
gcatcactgcaatcaactttagaaa

SEQ ID NO: 572720 - DNA, 25 bp, Homo sapien
actgcaatcaactttagaaaccctt

SEQ ID NO: 572721 - DNA, 25 bp, Homo sapien
tgcaatcaactttagaaacccttta

SEQ ID NO: 572722 - DNA, 25 bp, Homo sapien
accctttaccaaataacatcctatg

SEQ ID NO: 572723 - DNA, 25 bp, Homo sapien
tggcgctgataccagtccttgactt

SEQ ID NO: 572724 - DNA, 25 bp, Homo sapien
ataccagtccttgactttgtccctg

SEQ ID NO: 572725 - DNA, 25 bp, Homo sapien
gaaatggcgtctgttcttagcatac

SEQ ID NO: 572726 - DNA, 25 bp, Homo sapien
gcgtctgttcttagcataccatggt

SEQ ID NO: 572727 - DNA, 25 bp, Homo sapien
gcataccatggtgcatcactcaagt

SEQ ID NO: 572728 - DNA, 25 bp, Homo sapien
ggtgcatcactcaagttactcttca

SEQ ID NO: 572729 - DNA, 25 bp, Homo sapien
tcaagttactcttcaagttaccact

SEQ ID NO: 572730 - DNA, 25 bp, Homo sapien
gaaagcactcgaaaacctataatta

SEQ ID NO: 572731 - DNA, 25 bp, Homo sapien
tttccaagaatttttgactacagtt

SEQ ID NO: 572732 - DNA, 25 bp, Homo sapien
gactacagtttaagacatatccttc

SEQ ID NO: 572733 - DNA, 25 bp, Homo sapien
gtttaagacatatccttcattttga

SEQ ID NO: 572734 - DNA, 25 bp, Homo sapien
tcactcatactcaagctgcctcttt

SEQ ID NO: 572735 - DNA, 25 bp, Homo sapien
cactcatactcaagctgcctctttg

SEQ ID NO: 572736 - DNA, 25 bp, Homo sapien
atatgtggctctcacagcctggtct

SEQ ID NO: 572737 - DNA, 25 bp, Homo sapien
gctctcacagcctggtctgctataa

SEQ ID NO: 572738 - DNA, 25 bp, Homo sapien
ctcacagcctggtctgctataaaca

SEQ ID NO: 572739 - DNA, 25 bp, Homo sapien
cacagcctggtctgctataaacaaa

SEQ ID NO: 572740 - DNA, 25 bp, Homo sapien
gcctggtctgctataaacaaagttg

SEQ ID NO: 572741 - DNA, 25 bp, Homo sapien
gctataaacaaagttggtggcctga

SEQ ID NO: 572742 - DNA, 25 bp, Homo sapien
aaacaaagttggtggcctgaatgac

SEQ ID NO: 572743 - DNA, 25 bp, Homo sapien
tggcctgaatgacaagaattgcaca

SEQ ID NO: 572744 - DNA, 25 bp, Homo sapien
tgaatgacaagaattgcacaggaaa

SEQ ID NO: 572745 - DNA, 25 bp, Homo sapien
ggcttccctgctggtagggctcaga

SEQ ID NO: 572746 - DNA, 25 bp, Homo sapien
tagggctcagagacgttactgttat

SEQ ID NO: 572747 - DNA, 25 bp, Homo sapien
ttatttaactccaaacccatcaccg

SEQ ID NO: 572748 - DNA, 25 bp, Homo sapien
accggcgcctgagatgcaggcttgt

SEQ ID NO: 572749 - DNA, 25 bp, Homo sapien
ctgtcagggaggacgtgagcacttc

SEQ ID NO: 572750 - DNA, 25 bp, Homo sapien
tgagcacttcactttcaaggaccgg

SEQ ID NO: 572751 - DNA, 25 bp, Homo sapien
aaggaccggttctgaccctggagca

SEQ ID NO: 572752 - DNA, 25 bp, Homo sapien
ctggcgctgagtcccgtgttactca

SEQ ID NO: 572753 - DNA, 25 bp, Homo sapien
gtgttactcacctcaacgtgtttta

SEQ ID NO: 572754 - DNA, 25 bp, Homo sapien
tcaacgtgttttaacgctgtttcct

SEQ ID NO: 572755 - DNA, 25 bp, Homo sapien
acctcttcgacaaacgaccttcaat

SEQ ID NO: 572756 - DNA, 25 bp, Homo sapien
atgaggttggcatttataccttccc

SEQ ID NO: 572757 - DNA, 25 bp, Homo sapien
tgaggttggcatttataccttccct

SEQ ID NO: 572758 - DNA, 25 bp, Homo sapien
gaggttggcatttataccttccctt

SEQ ID NO: 572759 - DNA, 25 bp, Homo sapien
aggttggcatttataccttcccttg

SEQ ID NO: 572760 - DNA, 25 bp, Homo sapien
ggttggcatttataccttcccttga

SEQ ID NO: 572761 - DNA, 25 bp, Homo sapien
gttggcatttataccttcccttgaa

SEQ ID NO: 572762 - DNA, 25 bp, Homo sapien
atggtgggagtgctgtagtccagta

SEQ ID NO: 572763 - DNA, 25 bp, Homo sapien
tggtgggagtgctgtagtccagtac

SEQ ID NO: 572764 - DNA, 25 bp, Homo sapien
ggtgggagtgctgtagtccagtact

SEQ ID NO: 572765 - DNA, 25 bp, Homo sapien
gtgggagtgctgtagtccagtactc

SEQ ID NO: 572766 - DNA, 25 bp, Homo sapien
tgggagtgctgtagtccagtactca

SEQ ID NO: 572767 - DNA, 25 bp, Homo sapien
cattgttttttctccactgtattac

SEQ ID NO: 572768 - DNA, 25 bp, Homo sapien
gttttttctccactgtattacactg

SEQ ID NO: 572769 - DNA, 25 bp, Homo sapien
ttttctccactgtattacactgctc

SEQ ID NO: 572770 - DNA, 25 bp, Homo sapien
actgtattacactgctcccctttgc

SEQ ID NO: 572771 - DNA, 25 bp, Homo sapien
ctgtattcaccacggccattgtctg

SEQ ID NO: 572772 - DNA, 25 bp, Homo sapien
attcaccacggccattgtctgttat

SEQ ID NO: 572773 - DNA, 25 bp, Homo sapien
cacggccattgtctgttattgcata

SEQ ID NO: 572774 - DNA, 25 bp, Homo sapien
ggccattgtctgttattgcataatc

SEQ ID NO: 572775 - DNA, 25 bp, Homo sapien
ttgcataatcatagtattccagcca

SEQ ID NO: 572776 - DNA, 25 bp, Homo sapien
taatcatagtattccagccatgccc

SEQ ID NO: 572777 - DNA, 25 bp, Homo sapien
cagccatgcccccataattgttttt

SEQ ID NO: 572778 - DNA, 25 bp, Homo sapien
cagcgtacttgcttactttcaggat

SEQ ID NO: 572779 - DNA, 25 bp, Homo sapien
tactttcaggattgcgagacgtctt

SEQ ID NO: 572780 - DNA, 25 bp, Homo sapien
gattgcgagacgtctttaacccttg

SEQ ID NO: 572781 - DNA, 25 bp, Homo sapien
ttcctgctcatttcccgcaagatag

SEQ ID NO: 572782 - DNA, 25 bp, Homo sapien
ccgcaagatagcactgatagggtat

SEQ ID NO: 572783 - DNA, 25 bp, Homo sapien
gcatccttattggtgctcagggcta

SEQ ID NO: 572784 - DNA, 25 bp, Homo sapien
cagggctaggcgtgcattgctgcta

SEQ ID NO: 572785 - DNA, 25 bp, Homo sapien
ggcttgagtggtttttagaggtctt

SEQ ID NO: 572786 - DNA, 25 bp, Homo sapien
ttagaggtcttgagtggctcactct

SEQ ID NO: 572787 - DNA, 25 bp, Homo sapien
tccaatcagcgctttctagagacag

SEQ ID NO: 572788 - DNA, 25 bp, Homo sapien
tagagacagcgtggtcagcgtactt

SEQ ID NO: 572789 - DNA, 25 bp, Homo sapien
gagaatatacaaaggcccagaggcc

SEQ ID NO: 572790 - DNA, 25 bp, Homo sapien
acagggtacctttggggacattgca

SEQ ID NO: 572791 - DNA, 25 bp, Homo sapien
ggacattgcatgtaattgaccacat

SEQ ID NO: 572792 - DNA, 25 bp, Homo sapien
tgtaattgaccacattcggagtttg

SEQ ID NO: 572793 - DNA, 25 bp, Homo sapien
ccacattcggagtttggatttggaa

SEQ ID NO: 572794 - DNA, 25 bp, Homo sapien
gacaagtagtaagcacgtcagcctt

SEQ ID NO: 572795 - DNA, 25 bp, Homo sapien
aagtagtaagcacgtcagccttcca

SEQ ID NO: 572796 - DNA, 25 bp, Homo sapien
agtaagcacgtcagccttccaggtg

SEQ ID NO: 572797 - DNA, 25 bp, Homo sapien
ttccaggtgcgctcctttccgatga

SEQ ID NO: 572798 - DNA, 25 bp, Homo sapien
tcctttccgatgagcactggcttat

SEQ ID NO: 572799 - DNA, 25 bp, Homo sapien
tccgatgagcactggcttatccacg

SEQ ID NO: 572800 - DNA, 25 bp, Homo sapien
ctttcgttccaatgctagctttgga

SEQ ID NO: 572801 - DNA, 25 bp, Homo sapien
ttcgttccaatgctagctttggaat

SEQ ID NO: 572802 - DNA, 25 bp, Homo sapien
caatgctagctttggaatcctggcc

SEQ ID NO: 572803 - DNA, 25 bp, Homo sapien
aatgctagctttggaatcctggcct

SEQ ID NO: 572804 - DNA, 25 bp, Homo sapien
atgctagctttggaatcctggcctc

SEQ ID NO: 572805 - DNA, 25 bp, Homo sapien
tggcctccatcccttaaaagctttg

SEQ ID NO: 572806 - DNA, 25 bp, Homo sapien
ggcctccatcccttaaaagctttgt

SEQ ID NO: 572807 - DNA, 25 bp, Homo sapien
gcctccatcccttaaaagctttgtg

SEQ ID NO: 572808 - DNA, 25 bp, Homo sapien
aaaagctttgtgatcttaggtaagt

SEQ ID NO: 572809 - DNA, 25 bp, Homo sapien
actttgagccatttcctactgtaga

SEQ ID NO: 572810 - DNA, 25 bp, Homo sapien
gtagactctagcacacattttcaag

SEQ ID NO: 572811 - DNA, 25 bp, Homo sapien
cattttgggaagacacaaaggctct

SEQ ID NO: 572812 - DNA, 25 bp, Homo sapien
cttgaaatgagagccaccaatgttt

SEQ ID NO: 572813 - DNA, 25 bp, Homo sapien
gaaatgagagccaccaatgtttgtt

SEQ ID NO: 572814 - DNA, 25 bp, Homo sapien
atgagagccaccaatgtttgtttta

SEQ ID NO: 572815 - DNA, 25 bp, Homo sapien
gagagccaccaatgtttgttttaga

SEQ ID NO: 572816 - DNA, 25 bp, Homo sapien
gagccaccaatgtttgttttagatg

SEQ ID NO: 572817 - DNA, 25 bp, Homo sapien
gccaccaatgtttgttttagatgct

SEQ ID NO: 572818 - DNA, 25 bp, Homo sapien
tgcttataaagcttacctcatggag

SEQ ID NO: 572819 - DNA, 25 bp, Homo sapien
ataaagcttacctcatggagctgtt

SEQ ID NO: 572820 - DNA, 25 bp, Homo sapien
gcttacctcatggagctgttaacat

SEQ ID NO: 572821 - DNA, 25 bp, Homo sapien
cctcatggagctgttaacatagcaa

SEQ ID NO: 572822 - DNA, 25 bp, Homo sapien
tctttccctgtttttgataaccttg

SEQ ID NO: 572823 - DNA, 25 bp, Homo sapien
gtttttgataaccttgatagcttca

SEQ ID NO: 572824 - DNA, 25 bp, Homo sapien
tagcttcaaggagtgctgatcaggt

SEQ ID NO: 572825 - DNA, 25 bp, Homo sapien
tgatcaggtaattggcagaatgccc

SEQ ID NO: 572826 - DNA, 25 bp, Homo sapien
gcagaatgcccctctagtggaattt

SEQ ID NO: 572827 - DNA, 25 bp, Homo sapien
atgcccctctagtggaatttattcc

SEQ ID NO: 572828 - DNA, 25 bp, Homo sapien
aatttattccatattgctttttaat

SEQ ID NO: 572829 - DNA, 25 bp, Homo sapien
cccatattttcctatgatgttttga

SEQ ID NO: 572830 - DNA, 25 bp, Homo sapien
gttttgaagggaaagaccaagtcat

SEQ ID NO: 572831 - DNA, 25 bp, Homo sapien
gaccaagtcatctgtgtatctccaa

SEQ ID NO: 572832 - DNA, 25 bp, Homo sapien
gtatctccaacacttagcattcaat

SEQ ID NO: 572833 - DNA, 25 bp, Homo sapien
actcttttgtgggaaaacagcctgt

SEQ ID NO: 572834 - DNA, 25 bp, Homo sapien
gttgcatagcaagagtgatccatct

SEQ ID NO: 572835 - DNA, 25 bp, Homo sapien
gtaaaactgccatgatgaccaatgt

SEQ ID NO: 572836 - DNA, 25 bp, Homo sapien
gatgaccaatgtttgacgcctacaa

SEQ ID NO: 572837 - DNA, 25 bp, Homo sapien
gcctacaattcaaggtggtccagta

SEQ ID NO: 572838 - DNA, 25 bp, Homo sapien
tggtccagtagcacagataagccct

SEQ ID NO: 572839 - DNA, 25 bp, Homo sapien
tccccgtggtcatgagtttctaaag

SEQ ID NO: 572840 - DNA, 25 bp, Homo sapien
gatgatgagcttcctgtgtctttac

SEQ ID NO: 572841 - DNA, 25 bp, Homo sapien
gcttcctgtgtctttaccctaaaag

SEQ ID NO: 572842 - DNA, 25 bp, Homo sapien
ttgtgagaatccaccatctcttggc

SEQ ID NO: 572843 - DNA, 25 bp, Homo sapien
tggcctacctagacatcgtttctgt

SEQ ID NO: 572844 - DNA, 25 bp, Homo sapien
aaaagaaaggtattcagatcagcct

SEQ ID NO: 572845 - DNA, 25 bp, Homo sapien
aaagaaaggtattcagatcagcctc

SEQ ID NO: 572846 - DNA, 25 bp, Homo sapien
aagaaaggtattcagatcagcctca

SEQ ID NO: 572847 - DNA, 25 bp, Homo sapien
agaaaggtattcagatcagcctcaa

SEQ ID NO: 572848 - DNA, 25 bp, Homo sapien
gaaaggtattcagatcagcctcaac

SEQ ID NO: 572849 - DNA, 25 bp, Homo sapien
aaaggtattcagatcagcctcaact

SEQ ID NO: 572850 - DNA, 25 bp, Homo sapien
aaggtattcagatcagcctcaactc

SEQ ID NO: 572851 - DNA, 25 bp, Homo sapien
aggtattcagatcagcctcaactca

SEQ ID NO: 572852 - DNA, 25 bp, Homo sapien
ggtattcagatcagcctcaactcac

SEQ ID NO: 572853 - DNA, 25 bp, Homo sapien
gtattcagatcagcctcaactcact

SEQ ID NO: 572854 - DNA, 25 bp, Homo sapien
tattcagatcagcctcaactcactg

SEQ ID NO: 572855 - DNA, 25 bp, Homo sapien
aagaggagttccttctatgcctgct

SEQ ID NO: 572856 - DNA, 25 bp, Homo sapien
agttccttctatgcctgctgtgttt

SEQ ID NO: 572857 - DNA, 25 bp, Homo sapien
ccttctatgcctgctgtgtttttca

SEQ ID NO: 572858 - DNA, 25 bp, Homo sapien
gtgtttttcagccatagcacagaac

SEQ ID NO: 572859 - DNA, 25 bp, Homo sapien
ttcagccatagcacagaactgtttt

SEQ ID NO: 572860 - DNA, 25 bp, Homo sapien
gggagcatgctcatgcgctaaatca

SEQ ID NO: 572861 - DNA, 25 bp, Homo sapien
atgctcatgcgctaaatcagtggtc

SEQ ID NO: 572862 - DNA, 25 bp, Homo sapien
atgcgctaaatcagtggtctctcac

SEQ ID NO: 572863 - DNA, 25 bp, Homo sapien
aaatcagtggtctctcactcaggga

SEQ ID NO: 572864 - DNA, 25 bp, Homo sapien
gtggtctctcactcagggaggaaga

SEQ ID NO: 572865 - DNA, 25 bp, Homo sapien
gagaggccaacatttgctgagggct

SEQ ID NO: 572866 - DNA, 25 bp, Homo sapien
ggatggttttgctattattggttgg

SEQ ID NO: 572867 - DNA, 25 bp, Homo sapien
gctattattggttggtgggcccttt

SEQ ID NO: 572868 - DNA, 25 bp, Homo sapien
ttattggttggtgggccctttgcct

SEQ ID NO: 572869 - DNA, 25 bp, Homo sapien
gcctgtggaatgtatttcactcatt

SEQ ID NO: 572870 - DNA, 25 bp, Homo sapien
tcattctctcctgcacgctgttagg

SEQ ID NO: 572871 - DNA, 25 bp, Homo sapien
tgcacgctgttaggcagttctttca

SEQ ID NO: 572872 - DNA, 25 bp, Homo sapien
tgttaggcagttctttcacctgcat

SEQ ID NO: 572873 - DNA, 25 bp, Homo sapien
aggcagttctttcacctgcatgctt

SEQ ID NO: 572874 - DNA, 25 bp, Homo sapien
ttttgtctacctcatagtccctctc

SEQ ID NO: 572875 - DNA, 25 bp, Homo sapien
gtttacatatgtatcttgagttctt

SEQ ID NO: 572876 - DNA, 25 bp, Homo sapien
tatgtatcttgagttcttcataggg

SEQ ID NO: 572877 - DNA, 25 bp, Homo sapien
ttagagctgtatgaggccgggtgca

SEQ ID NO: 572878 - DNA, 25 bp, Homo sapien
gagttccagtcctgaatcacttata

SEQ ID NO: 572879 - DNA, 25 bp, Homo sapien
gtcctgaatcacttatagactacta

SEQ ID NO: 572880 - DNA, 25 bp, Homo sapien
acttatagactactatatgtcttcc

SEQ ID NO: 572881 - DNA, 25 bp, Homo sapien
tgtcttcctgaattgcagtcttctt

SEQ ID NO: 572882 - DNA, 25 bp, Homo sapien
gaattgcagtcttcttatctgcaaa

SEQ ID NO: 572883 - DNA, 25 bp, Homo sapien
agaacaatagaatttactgtcccta

SEQ ID NO: 572884 - DNA, 25 bp, Homo sapien
agaatttactgtccctagcacatgg

SEQ ID NO: 572885 - DNA, 25 bp, Homo sapien
gagagattgtacatgcagaacttga

SEQ ID NO: 572886 - DNA, 25 bp, Homo sapien
tacatgcagaacttgatgcgtggca

SEQ ID NO: 572887 - DNA, 25 bp, Homo sapien
gatgcgtggcattagagctgtatga

SEQ ID NO: 572888 - DNA, 25 bp, Homo sapien
gcacagagagaaccagtcacagcat

SEQ ID NO: 572889 - DNA, 25 bp, Homo sapien
gaaccagtcacagcatgatggaaga

SEQ ID NO: 572890 - DNA, 25 bp, Homo sapien
gaaacctggaactaaagcctcacta

SEQ ID NO: 572891 - DNA, 25 bp, Homo sapien
ggaactaaagcctcactacttctct

SEQ ID NO: 572892 - DNA, 25 bp, Homo sapien
aaagcctcactacttctctttcctg

SEQ ID NO: 572893 - DNA, 25 bp, Homo sapien
agatcccaaatccacagcttacagg

SEQ ID NO: 572894 - DNA, 25 bp, Homo sapien
caaatccacagcttacaggaagttt

SEQ ID NO: 572895 - DNA, 25 bp, Homo sapien
accaatgttatttctaagtgagcac

SEQ ID NO: 572896 - DNA, 25 bp, Homo sapien
cagaatgtacggtccaagccagtga

SEQ ID NO: 572897 - DNA, 25 bp, Homo sapien
tacggtccaagccagtgataagaat

SEQ ID NO: 572898 - DNA, 25 bp, Homo sapien
tgataagaattctccctgtagcctg

SEQ ID NO: 572899 - DNA, 25 bp, Homo sapien
aatattagcgtgattttacggcaaa

SEQ ID NO: 572900 - DNA, 25 bp, Homo sapien
gtaaaactgagtctcaccgtactcc

SEQ ID NO: 572901 - DNA, 25 bp, Homo sapien
tctcaccgtactcctgactataaaa

SEQ ID NO: 572902 - DNA, 25 bp, Homo sapien
gactataaaagttttcagcttaacg

SEQ ID NO: 572903 - DNA, 25 bp, Homo sapien
cagcttaacgtatactattgacact

SEQ ID NO: 572904 - DNA, 25 bp, Homo sapien
gacactaattttgtattaatctgga

SEQ ID NO: 572905 - DNA, 25 bp, Homo sapien
gaaacttaaaatggcaatccagtgt

SEQ ID NO: 572906 - DNA, 25 bp, Homo sapien
aatccagtgttgactattccccaat

SEQ ID NO: 572907 - DNA, 25 bp, Homo sapien
gactattccccaatttaagccagat

SEQ ID NO: 572908 - DNA, 25 bp, Homo sapien
aagccagattgctcaaatgaattct

SEQ ID NO: 572909 - DNA, 25 bp, Homo sapien
gacttaagtgattctctttgataaa

SEQ ID NO: 572910 - DNA, 25 bp, Homo sapien
ctttatttccatttgttcacacacg

SEQ ID NO: 572911 - DNA, 25 bp, Homo sapien
atttccatttgttcacacacgcttt

SEQ ID NO: 572912 - DNA, 25 bp, Homo sapien
ttccatttgttcacacacgctttta

SEQ ID NO: 572913 - DNA, 25 bp, Homo sapien
ccatttgttcacacacgcttttaaa

SEQ ID NO: 572914 - DNA, 25 bp, Homo sapien
tgttcacacacgcttttaaaattca

SEQ ID NO: 572915 - DNA, 25 bp, Homo sapien
tcacacacgcttttaaaattcatat

SEQ ID NO: 572916 - DNA, 25 bp, Homo sapien
agagcacgaatagccaagacaatca

SEQ ID NO: 572917 - DNA, 25 bp, Homo sapien
gcacgaatagccaagacaatcataa

SEQ ID NO: 572918 - DNA, 25 bp, Homo sapien
gaatagccaagacaatcataagcaa

SEQ ID NO: 572919 - DNA, 25 bp, Homo sapien
gaactcagaaataagaccgcacatg

SEQ ID NO: 572920 - DNA, 25 bp, Homo sapien
gaccgcacatgtacaaccatctgat

SEQ ID NO: 572921 - DNA, 25 bp, Homo sapien
atacgaaacgtagaaactgacagga

SEQ ID NO: 572922 - DNA, 25 bp, Homo sapien
gaaactgacaggaaatgaccaagta

SEQ ID NO: 572923 - DNA, 25 bp, Homo sapien
gaatcagcttaaatcctggcactgc

SEQ ID NO: 572924 - DNA, 25 bp, Homo sapien
tcagcttaaatcctggcactgcgtt

SEQ ID NO: 572925 - DNA, 25 bp, Homo sapien
agcttaaatcctggcactgcgttca

SEQ ID NO: 572926 - DNA, 25 bp, Homo sapien
cttaaatcctggcactgcgttcaag

SEQ ID NO: 572927 - DNA, 25 bp, Homo sapien
caaggaatgttgctaaaacggctaa

SEQ ID NO: 572928 - DNA, 25 bp, Homo sapien
atgttgctaaaacggctaaaaccag

SEQ ID NO: 572929 - DNA, 25 bp, Homo sapien
acggctaaaaccaggaactcagaat

SEQ ID NO: 572930 - DNA, 25 bp, Homo sapien
ggaactcagaatatcgttctacaat

SEQ ID NO: 572931 - DNA, 25 bp, Homo sapien
gaatatcgttctacaatagaaccta

SEQ ID NO: 572932 - DNA, 25 bp, Homo sapien
gtactacacgtagtcagaagcgagt

SEQ ID NO: 572933 - DNA, 25 bp, Homo sapien
acgtagtcagaagcgagtgtccttt

SEQ ID NO: 572934 - DNA, 25 bp, Homo sapien
gtcagaagcgagtgtccttttcttt

SEQ ID NO: 572935 - DNA, 25 bp, Homo sapien
cagaagcgagtgtccttttcttttg

SEQ ID NO: 572936 - DNA, 25 bp, Homo sapien
caccctaagagaaattttagcttat

SEQ ID NO: 572937 - DNA, 25 bp, Homo sapien
gaaaatctggtatttgcaatgatct

SEQ ID NO: 572938 - DNA, 25 bp, Homo sapien
ggtatttgcaatgatctgtgccttc

SEQ ID NO: 572939 - DNA, 25 bp, Homo sapien
ttgcaatgatctgtgccttcttttt

SEQ ID NO: 572940 - DNA, 25 bp, Homo sapien
ctttttaccaccctcttgattggag

SEQ ID NO: 572941 - DNA, 25 bp, Homo sapien
ttttaccaccctcttgattggagct

SEQ ID NO: 572942 - DNA, 25 bp, Homo sapien
ttgtgatgcagctaccatgattcaa

SEQ ID NO: 572943 - DNA, 25 bp, Homo sapien
gtgattgatcacatgagccgcatcg

SEQ ID NO: 572944 - DNA, 25 bp, Homo sapien
tgattgatcacatgagccgcatcgc

SEQ ID NO: 572945 - DNA, 25 bp, Homo sapien
ttgatcacatgagccgcatcgccat

SEQ ID NO: 572946 - DNA, 25 bp, Homo sapien
acatgagccgcatcgccatgtatga

SEQ ID NO: 572947 - DNA, 25 bp, Homo sapien
gagccgcatcgccatgtatgagcta

SEQ ID NO: 572948 - DNA, 25 bp, Homo sapien
gccgcatcgccatgtatgagctatt

SEQ ID NO: 572949 - DNA, 25 bp, Homo sapien
acattcagctcaagggacacatggc

SEQ ID NO: 572950 - DNA, 25 bp, Homo sapien
ttcagctcaagggacacatggcccg

SEQ ID NO: 572951 - DNA, 25 bp, Homo sapien
agctcaagggacacatggcccgatt

SEQ ID NO: 572952 - DNA, 25 bp, Homo sapien
tcaagggacacatggcccgattcct

SEQ ID NO: 572953 - DNA, 25 bp, Homo sapien
caagggacacatggcccgattcctt

SEQ ID NO: 572954 - DNA, 25 bp, Homo sapien
caggaggattgggttgctcaaatct

SEQ ID NO: 572955 - DNA, 25 bp, Homo sapien
gttgctcaaatcttacacatttcaa

SEQ ID NO: 572956 - DNA, 25 bp, Homo sapien
aaatgtttatcttcaggcctggcca

SEQ ID NO: 572957 - DNA, 25 bp, Homo sapien
tggcccctggaaggtagcctctgag

SEQ ID NO: 572958 - DNA, 25 bp, Homo sapien
ggtagcctctgagcccttggaatat

SEQ ID NO: 572959 - DNA, 25 bp, Homo sapien
ggaatattcttcctcatatgagttt

SEQ ID NO: 572960 - DNA, 25 bp, Homo sapien
tatgagtttctgtatgcccgaagcc

SEQ ID NO: 572961 - DNA, 25 bp, Homo sapien
gaagccctgaaccatgctgtattta

SEQ ID NO: 572962 - DNA, 25 bp, Homo sapien
ttttgtatgattaagcccttgggct

SEQ ID NO: 572963 - DNA, 25 bp, Homo sapien
aagcccttgggctacactgtaccag

SEQ ID NO: 572964 - DNA, 25 bp, Homo sapien
ggctacactgtaccagtttgactgg

SEQ ID NO: 572965 - DNA, 25 bp, Homo sapien
ggacattccagggtgctcttggagg

SEQ ID NO: 572966 - DNA, 25 bp, Homo sapien
ggtgctcttggaggtactcaagaat

SEQ ID NO: 572967 - DNA, 25 bp, Homo sapien
gtgctcttggaggtactcaagaatt

SEQ ID NO: 572968 - DNA, 25 bp, Homo sapien
ttggaggtactcaagaattgtcttc

SEQ ID NO: 572969 - DNA, 25 bp, Homo sapien
ggaggtactcaagaattgtcttcag

SEQ ID NO: 572970 - DNA, 25 bp, Homo sapien
aggtactcaagaattgtcttcaggg

SEQ ID NO: 572971 - DNA, 25 bp, Homo sapien
tcaagaattgtcttcagggacgagc

SEQ ID NO: 572972 - DNA, 25 bp, Homo sapien
aagaattgtcttcagggacgagcga

SEQ ID NO: 572973 - DNA, 25 bp, Homo sapien
agaattgtcttcagggacgagcgag

SEQ ID NO: 572974 - DNA, 25 bp, Homo sapien
gtcttcagggacgagcgaggtggct

SEQ ID NO: 572975 - DNA, 25 bp, Homo sapien
cttcagggacgagcgaggtggctca

SEQ ID NO: 572976 - DNA, 25 bp, Homo sapien
ctcagccagtttcctacaggagcat

SEQ ID NO: 572977 - DNA, 25 bp, Homo sapien
tggcaaggcttgaggcatgaagaaa

SEQ ID NO: 572978 - DNA, 25 bp, Homo sapien
gaaagtgcactttcactgttgcagt

SEQ ID NO: 572979 - DNA, 25 bp, Homo sapien
ctttcactgttgcagtagtcttaga

SEQ ID NO: 572980 - DNA, 25 bp, Homo sapien
atatttctgcatggtgacacggttc

SEQ ID NO: 572981 - DNA, 25 bp, Homo sapien
gacacggttcttactagaaccccag

SEQ ID NO: 572982 - DNA, 25 bp, Homo sapien
ttactagaaccccagaacatctcca

SEQ ID NO: 572983 - DNA, 25 bp, Homo sapien
agaacatctccatggtatgacctac

SEQ ID NO: 572984 - DNA, 25 bp, Homo sapien
atggtatgacctaccacatttcctc

SEQ ID NO: 572985 - DNA, 25 bp, Homo sapien
taataaggctacacagtatctggaa

SEQ ID NO: 572986 - DNA, 25 bp, Homo sapien
gtatctggaatttcttgctcattaa

SEQ ID NO: 572987 - DNA, 25 bp, Homo sapien
ttaccagttttgctacagattttta

SEQ ID NO: 572988 - DNA, 25 bp, Homo sapien
tatgaacttagttccccagtcacca

SEQ ID NO: 572989 - DNA, 25 bp, Homo sapien
agtcaccagggccacagatgtttga

SEQ ID NO: 572990 - DNA, 25 bp, Homo sapien
aaacaactgaattcctattcacttt

SEQ ID NO: 572991 - DNA, 25 bp, Homo sapien
tattcacttttactccacgagtgac

SEQ ID NO: 572992 - DNA, 25 bp, Homo sapien
ccacgagtgactttacaatacattg

SEQ ID NO: 572993 - DNA, 25 bp, Homo sapien
actgtaaaatgcctttccacttatt

SEQ ID NO: 572994 - DNA, 25 bp, Homo sapien
atgcctttccacttatttcttatac

SEQ ID NO: 572995 - DNA, 25 bp, Homo sapien
cttatactatgttgtctctcagata

SEQ ID NO: 572996 - DNA, 25 bp, Homo sapien
actatgttgtctctcagataataca

SEQ ID NO: 572997 - DNA, 25 bp, Homo sapien
gatgcaattttggataatgttttaa

SEQ ID NO: 572998 - DNA, 25 bp, Homo sapien
gtcttctgagtgataagaggcacca

SEQ ID NO: 572999 - DNA, 25 bp, Homo sapien
ttgaccagactccatagccctgtgg

SEQ ID NO: 573000 - DNA, 25 bp, Homo sapien
agccctgtgggaatgaacacgtgga

SEQ ID NO: 573001 - DNA, 25 bp, Homo sapien
tgtgatgcagtctgatccccttgca

SEQ ID NO: 573002 - DNA, 25 bp, Homo sapien
tgatccccttgcaagtctggcttgg

SEQ ID NO: 573003 - DNA, 25 bp, Homo sapien
tctggcttgggcatgcacagctcaa

SEQ ID NO: 573004 - DNA, 25 bp, Homo sapien
gcatgcacagctcaacttagattta

SEQ ID NO: 573005 - DNA, 25 bp, Homo sapien
aataagaccaaaacctatgtgcagg

SEQ ID NO: 573006 - DNA, 25 bp, Homo sapien
cctatgtgcaggtatgctggaacac

SEQ ID NO: 573007 - DNA, 25 bp, Homo sapien
gtatgctggaacacatgcattgcat

SEQ ID NO: 573008 - DNA, 25 bp, Homo sapien
catgcattgcattggcatttacaat

SEQ ID NO: 573009 - DNA, 25 bp, Homo sapien
tctgcctaccttcctgagagtggtt

SEQ ID NO: 573010 - DNA, 25 bp, Homo sapien
taccttcctgagagtggttggtgac

SEQ ID NO: 573011 - DNA, 25 bp, Homo sapien
gggctagaaacctcgaggcgactgt

SEQ ID NO: 573012 - DNA, 25 bp, Homo sapien
aaacctcgaggcgactgtgcttgag

SEQ ID NO: 573013 - DNA, 25 bp, Homo sapien
actgtgcttgagtcctctcttgctc

SEQ ID NO: 573014 - DNA, 25 bp, Homo sapien
ttgagtcctctcttgctctttacat

SEQ ID NO: 573015 - DNA, 25 bp, Homo sapien
ttgctctttacatcccaaatcccat

SEQ ID NO: 573016 - DNA, 25 bp, Homo sapien
aaatcccatcaattgtcacgccttg

SEQ ID NO: 573017 - DNA, 25 bp, Homo sapien
catcaattgtcacgccttgtgcctt

SEQ ID NO: 573018 - DNA, 25 bp, Homo sapien
ccttccgcctctcaaatattcagaa

SEQ ID NO: 573019 - DNA, 25 bp, Homo sapien
aaagcagatgtatgctgggcacggt

SEQ ID NO: 573020 - DNA, 25 bp, Homo sapien
ggtcatcaaaccaggtgagtggaca

SEQ ID NO: 573021 - DNA, 25 bp, Homo sapien
gtgagtggacatttgcatgccatct

SEQ ID NO: 573022 - DNA, 25 bp, Homo sapien
ggacatttgcatgccatctttatga

SEQ ID NO: 573023 - DNA, 25 bp, Homo sapien
ggtactgattgttctcatctctgac

SEQ ID NO: 573024 - DNA, 25 bp, Homo sapien
ttctcatctctgacttccctaatta

SEQ ID NO: 573025 - DNA, 25 bp, Homo sapien
acttccctaattatagccctggagg

SEQ ID NO: 573026 - DNA, 25 bp, Homo sapien
gaggagggccactaagacctaaagt

SEQ ID NO: 573027 - DNA, 25 bp, Homo sapien
taaagtttaacaggccccattggtg

SEQ ID NO: 573028 - DNA, 25 bp, Homo sapien
gccccattggtgatgctcagtgata

SEQ ID NO: 573029 - DNA, 25 bp, Homo sapien
tatttaacaccttctctctgtttta

SEQ ID NO: 573030 - DNA, 25 bp, Homo sapien
ctgttttaaaactcatgggtgtgcc

SEQ ID NO: 573031 - DNA, 25 bp, Homo sapien
atctctatgagtatgacttatttgg

SEQ ID NO: 573032 - DNA, 25 bp, Homo sapien
agaacataattttgactgtcataat

SEQ ID NO: 573033 - DNA, 25 bp, Homo sapien
gtcataataatgtgaaatgccttat

SEQ ID NO: 573034 - DNA, 25 bp, Homo sapien
atgccttatgagaaaggagcattgt

SEQ ID NO: 573035 - DNA, 25 bp, Homo sapien
gtgaatataatgaacctgtgaaatc

SEQ ID NO: 573036 - DNA, 25 bp, Homo sapien
ctgtgaaatcatatggtaatagctc

SEQ ID NO: 573037 - DNA, 25 bp, Homo sapien
tggtaatagctcatcccattttgtc

SEQ ID NO: 573038 - DNA, 25 bp, Homo sapien
aggcttcaatcagactttggacctc

SEQ ID NO: 573039 - DNA, 25 bp, Homo sapien
aatcagactttggacctcatcagac

SEQ ID NO: 573040 - DNA, 25 bp, Homo sapien
gactttggacctcatcagacatctg

SEQ ID NO: 573041 - DNA, 25 bp, Homo sapien
ggacctcatcagacatctgagaatt

SEQ ID NO: 573042 - DNA, 25 bp, Homo sapien
acaggtgcccctggcgatgcgaagt

SEQ ID NO: 573043 - DNA, 25 bp, Homo sapien
tgcccctggcgatgcgaagtcggaa

SEQ ID NO: 573044 - DNA, 25 bp, Homo sapien
gaagtggtgcctttgtccggcatga

SEQ ID NO: 573045 - DNA, 25 bp, Homo sapien
tttgtccggcatgatggttcgccac

SEQ ID NO: 573046 - DNA, 25 bp, Homo sapien
tcagaacttgcctcacgtggccagc

SEQ ID NO: 573047 - DNA, 25 bp, Homo sapien
aggaagcaacctccactctgcagat

SEQ ID NO: 573048 - DNA, 25 bp, Homo sapien
acctccactctgcagatgtcgcagg

SEQ ID NO: 573049 - DNA, 25 bp, Homo sapien
agtccccacagatacccatgaatgg

SEQ ID NO: 573050 - DNA, 25 bp, Homo sapien
acccatgaatgggtctgccatgcag

SEQ ID NO: 573051 - DNA, 25 bp, Homo sapien
tctgccatgcagagcttgttcattg

SEQ ID NO: 573052 - DNA, 25 bp, Homo sapien
cattgaagaaatccacagtgtgagt

SEQ ID NO: 573053 - DNA, 25 bp, Homo sapien
aagatttattgtctcctcttctaca

SEQ ID NO: 573054 - DNA, 25 bp, Homo sapien
atttattgtctcctcttctacaagg

SEQ ID NO: 573055 - DNA, 25 bp, Homo sapien
tattgtctcctcttctacaaggata

SEQ ID NO: 573056 - DNA, 25 bp, Homo sapien
gtctcctcttctacaaggatataca

SEQ ID NO: 573057 - DNA, 25 bp, Homo sapien
acttttcctccagcacatgtcatgt

SEQ ID NO: 573058 - DNA, 25 bp, Homo sapien
ttttcctccagcacatgtcatgtag

SEQ ID NO: 573059 - DNA, 25 bp, Homo sapien
tttcctccagcacatgtcatgtagt

SEQ ID NO: 573060 - DNA, 25 bp, Homo sapien
ctccagcacatgtcatgtagtcaat

SEQ ID NO: 573061 - DNA, 25 bp, Homo sapien
gcacatgtcatgtagtcaattaata

SEQ ID NO: 573062 - DNA, 25 bp, Homo sapien
aattattgcattaggttttggtatc

SEQ ID NO: 573063 - DNA, 25 bp, Homo sapien
attgcattaggttttggtatcaaga

SEQ ID NO: 573064 - DNA, 25 bp, Homo sapien
gacacaaaagggtacattctatatg

SEQ ID NO: 573065 - DNA, 25 bp, Homo sapien
catggtaataaggacagtggctgtc

SEQ ID NO: 573066 - DNA, 25 bp, Homo sapien
cagtggctgtccttgttaggagtta

SEQ ID NO: 573067 - DNA, 25 bp, Homo sapien
gggagctttctggaaacactgtaca

SEQ ID NO: 573068 - DNA, 25 bp, Homo sapien
ggaaacactgtacatcttgctcttg

SEQ ID NO: 573069 - DNA, 25 bp, Homo sapien
cactgtacatcttgctcttgagagt

SEQ ID NO: 573070 - DNA, 25 bp, Homo sapien
gctcttgagagtgcacgtatataca

SEQ ID NO: 573071 - DNA, 25 bp, Homo sapien
gtgcacgtatatacatcaagtgttt

SEQ ID NO: 573072 - DNA, 25 bp, Homo sapien
caagtgtttatcaagctgtgtggtt

SEQ ID NO: 573073 - DNA, 25 bp, Homo sapien
ggttaagatttgcacacttgtatat

SEQ ID NO: 573074 - DNA, 25 bp, Homo sapien
gcacacttgtatatgttatacctcg

SEQ ID NO: 573075 - DNA, 25 bp, Homo sapien
aaaagccacatgctctaagcagggt

SEQ ID NO: 573076 - DNA, 25 bp, Homo sapien
taagcagggttttgcttggctccat

SEQ ID NO: 573077 - DNA, 25 bp, Homo sapien
ttggctccatgtccaaggcatcatc

SEQ ID NO: 573078 - DNA, 25 bp, Homo sapien
aaggcatcatcctcgtttattcttc

SEQ ID NO: 573079 - DNA, 25 bp, Homo sapien
tttattcttcccaccaattttatat

SEQ ID NO: 573080 - DNA, 25 bp, Homo sapien
tattctggctgatctttggtttcaa

SEQ ID NO: 573081 - DNA, 25 bp, Homo sapien
ttggtttcaaaagtccggtggcctg

SEQ ID NO: 573082 - DNA, 25 bp, Homo sapien
aggaagttgctgtcgtctgaggtac

SEQ ID NO: 573083 - DNA, 25 bp, Homo sapien
gctgtcgtctgaggtactgtcgtac

SEQ ID NO: 573084 - DNA, 25 bp, Homo sapien
tactgtcgtacttgtagtcctggtc

SEQ ID NO: 573085 - DNA, 25 bp, Homo sapien
aggacagggacctctgccaccaggc

SEQ ID NO: 573086 - DNA, 25 bp, Homo sapien
ttcaatgtatacaacaaggtccaga

SEQ ID NO: 573087 - DNA, 25 bp, Homo sapien
gtatacaacaaggtccagataactc

SEQ ID NO: 573088 - DNA, 25 bp, Homo sapien
acaacaaggtccagataactctcac

SEQ ID NO: 573089 - DNA, 25 bp, Homo sapien
acaaggtccagataactctcacctc

SEQ ID NO: 573090 - DNA, 25 bp, Homo sapien
aaggtccagataactctcacctcac

SEQ ID NO: 573091 - DNA, 25 bp, Homo sapien
ggtccagataactctcacctcacat

SEQ ID NO: 573092 - DNA, 25 bp, Homo sapien
tccagataactctcacctcacatga

SEQ ID NO: 573093 - DNA, 25 bp, Homo sapien
agataactctcacctcacatgactg

SEQ ID NO: 573094 - DNA, 25 bp, Homo sapien
tgactgtggtgaactgaccaaaaaa

SEQ ID NO: 573095 - DNA, 25 bp, Homo sapien
actgaccaaaaaagatgtgaagctg

SEQ ID NO: 573096 - DNA, 25 bp, Homo sapien
gctggccaagtttattgaaaaagca

SEQ ID NO: 573097 - DNA, 25 bp, Homo sapien
ttttttggacaggaacattgaagat

SEQ ID NO: 573098 - DNA, 25 bp, Homo sapien
aacattgaagatggcatgagctatc

SEQ ID NO: 573099 - DNA, 25 bp, Homo sapien
atggcatgagctatccagtggagac

SEQ ID NO: 573100 - DNA, 25 bp, Homo sapien
gagctatccagtggagacacacatc

SEQ ID NO: 573101 - DNA, 25 bp, Homo sapien
atccagtggagacacacatccatat

SEQ ID NO: 573102 - DNA, 25 bp, Homo sapien
gcatgacatgtcttaaaaagccatt

SEQ ID NO: 573103 - DNA, 25 bp, Homo sapien
agccatttatgtagtgtgtaggtgt

SEQ ID NO: 573104 - DNA, 25 bp, Homo sapien
tagtgtgtaggtgtgagtctatgaa

SEQ ID NO: 573105 - DNA, 25 bp, Homo sapien
ttggaaatgaatgtatgcctccttt

SEQ ID NO: 573106 - DNA, 25 bp, Homo sapien
aaatgaatgtatgcctcctttcact

SEQ ID NO: 573107 - DNA, 25 bp, Homo sapien
ttgttgtttagtattccttaggaag

SEQ ID NO: 573108 - DNA, 25 bp, Homo sapien
ttacataaatatgaccagtgttcac

SEQ ID NO: 573109 - DNA, 25 bp, Homo sapien
cagtgttcacatttatcaaggccaa

SEQ ID NO: 573110 - DNA, 25 bp, Homo sapien
caaggccaatgaatattaaggtgat

SEQ ID NO: 573111 - DNA, 25 bp, Homo sapien
gttatttaagcctgacccaaataat

SEQ ID NO: 573112 - DNA, 25 bp, Homo sapien
aaactttttattctatcatgcctat

SEQ ID NO: 573113 - DNA, 25 bp, Homo sapien
tatcatgcctatagacagcttcata

SEQ ID NO: 573114 - DNA, 25 bp, Homo sapien
tagacagcttcatatattaaccatt

SEQ ID NO: 573115 - DNA, 25 bp, Homo sapien
tatattaaccatttctgctttcgtg

SEQ ID NO: 573116 - DNA, 25 bp, Homo sapien
atttctgctttcgtggtcctttgag

SEQ ID NO: 573117 - DNA, 25 bp, Homo sapien
tttcgtggtcctttgagaatggtat

SEQ ID NO: 573118 - DNA, 25 bp, Homo sapien
atggtatcttagtatgtaagtgcaa

SEQ ID NO: 573119 - DNA, 25 bp, Homo sapien
gaatggtgatttccatacgatttct

SEQ ID NO: 573120 - DNA, 25 bp, Homo sapien
ggtgatttccatacgatttctttat

SEQ ID NO: 573121 - DNA, 25 bp, Homo sapien
gatttccatacgatttctttatgca

SEQ ID NO: 573122 - DNA, 25 bp, Homo sapien
ttccatacgatttctttatgcaaga

SEQ ID NO: 573123 - DNA, 25 bp, Homo sapien
tcactcaaagtatgtatagctagcc

SEQ ID NO: 573124 - DNA, 25 bp, Homo sapien
caaagtatgtatagctagccagata

SEQ ID NO: 573125 - DNA, 25 bp, Homo sapien
gtatgtatagctagccagatactga

SEQ ID NO: 573126 - DNA, 25 bp, Homo sapien
gtatagctagccagatactgaacaa

SEQ ID NO: 573127 - DNA, 25 bp, Homo sapien
atagctagccagatactgaacaagt

SEQ ID NO: 573128 - DNA, 25 bp, Homo sapien
gatactgaacaagttagtgcaatga

SEQ ID NO: 573129 - DNA, 25 bp, Homo sapien
gaacaagttagtgcaatgaagtaat

SEQ ID NO: 573130 - DNA, 25 bp, Homo sapien
gtggttcataatctttccatgggag

SEQ ID NO: 573131 - DNA, 25 bp, Homo sapien
ttccatgggagccaaatcctcggtg

SEQ ID NO: 573132 - DNA, 25 bp, Homo sapien
aatcctcggtgctgtgactctttta

SEQ ID NO: 573133 - DNA, 25 bp, Homo sapien
aaaagttaattagcttgcacctcaa

SEQ ID NO: 573134 - DNA, 25 bp, Homo sapien
tgcacctcaataatccagtctccat

SEQ ID NO: 573135 - DNA, 25 bp, Homo sapien
gtctccatcactgatggtcatcgtg

SEQ ID NO: 573136 - DNA, 25 bp, Homo sapien
ggtcatcgtggaatctgcgtacaga

SEQ ID NO: 573137 - DNA, 25 bp, Homo sapien
gtttttctaggcactgtgaacacag

SEQ ID NO: 573138 - DNA, 25 bp, Homo sapien
gaacacagcagtcaacgaagtcaaa

SEQ ID NO: 573139 - DNA, 25 bp, Homo sapien
aaacctgtgctcttaagggacatga

SEQ ID NO: 573140 - DNA, 25 bp, Homo sapien
aagctagtcaaatatctccagaagt

SEQ ID NO: 573141 - DNA, 25 bp, Homo sapien
atcacatttgattgatgtctgttac

SEQ ID NO: 573142 - DNA, 25 bp, Homo sapien
cacatttgattgatgtctgttacat

SEQ ID NO: 573143 - DNA, 25 bp, Homo sapien
atttgattgatgtctgttacatgga

SEQ ID NO: 573144 - DNA, 25 bp, Homo sapien
gattgatgtctgttacatggatttt

SEQ ID NO: 573145 - DNA, 25 bp, Homo sapien
gatgtctgttacatggatttttaaa

SEQ ID NO: 573146 - DNA, 25 bp, Homo sapien
tcaacttaagttagataatatgtac

SEQ ID NO: 573147 - DNA, 25 bp, Homo sapien
taatatgtactatattctctcctaa

SEQ ID NO: 573148 - DNA, 25 bp, Homo sapien
atatgtactatattctctcctaata

SEQ ID NO: 573149 - DNA, 25 bp, Homo sapien
atgtactatattctctcctaatata

SEQ ID NO: 573150 - DNA, 25 bp, Homo sapien
gtactatattctctcctaatataaa

SEQ ID NO: 573151 - DNA, 25 bp, Homo sapien
ttctctcctaatataaatgtttatg

SEQ ID NO: 573152 - DNA, 25 bp, Homo sapien
ctttcaggtatcatataattaggtc

SEQ ID NO: 573153 - DNA, 25 bp, Homo sapien
tctatcatctctggcgttttcagtt

SEQ ID NO: 573154 - DNA, 25 bp, Homo sapien
atcatctctggcgttttcagttaca

SEQ ID NO: 573155 - DNA, 25 bp, Homo sapien
catctctggcgttttcagttacatc

SEQ ID NO: 573156 - DNA, 25 bp, Homo sapien
tctctggcgttttcagttacatctt

SEQ ID NO: 573157 - DNA, 25 bp, Homo sapien
ttcagttacatctttcacttgtcac

SEQ ID NO: 573158 - DNA, 25 bp, Homo sapien
cagttacatctttcacttgtcactg

SEQ ID NO: 573159 - DNA, 25 bp, Homo sapien
aatggtattacactgcctgagctgc

SEQ ID NO: 573160 - DNA, 25 bp, Homo sapien
tagcttcctgcttctgacatgttct

SEQ ID NO: 573161 - DNA, 25 bp, Homo sapien
catgttcttggttggcagtgttgct

SEQ ID NO: 573162 - DNA, 25 bp, Homo sapien
cagtgttgctgtgtcatgtccaagt

SEQ ID NO: 573163 - DNA, 25 bp, Homo sapien
caggcttagtgagcagccaatccag

SEQ ID NO: 573164 - DNA, 25 bp, Homo sapien
aggcttagtgagcagccaatccaga

SEQ ID NO: 573165 - DNA, 25 bp, Homo sapien
cagccaatccagagggaaccatact

SEQ ID NO: 573166 - DNA, 25 bp, Homo sapien
agccaatccagagggaaccatactc

SEQ ID NO: 573167 - DNA, 25 bp, Homo sapien
ccaatccagagggaaccatactcag

SEQ ID NO: 573168 - DNA, 25 bp, Homo sapien
aatccagagggaaccatactcagcc

SEQ ID NO: 573169 - DNA, 25 bp, Homo sapien
atccagagggaaccatactcagccc

SEQ ID NO: 573170 - DNA, 25 bp, Homo sapien
cagagggaaccatactcagccctag

SEQ ID NO: 573171 - DNA, 25 bp, Homo sapien
agagggaaccatactcagccctagg

SEQ ID NO: 573172 - DNA, 25 bp, Homo sapien
gagggaaccatactcagccctaggg

SEQ ID NO: 573173 - DNA, 25 bp, Homo sapien
ggaaccatactcagccctaggggct

SEQ ID NO: 573174 - DNA, 25 bp, Homo sapien
gccgtaactagagctttccttggac

SEQ ID NO: 573175 - DNA, 25 bp, Homo sapien
ttccttggacaagagactcgtttca

SEQ ID NO: 573176 - DNA, 25 bp, Homo sapien
ttttccctgataagagaccctgacc

SEQ ID NO: 573177 - DNA, 25 bp, Homo sapien
gagaccctgaccatagacgggttct

SEQ ID NO: 573178 - DNA, 25 bp, Homo sapien
atagacgggttctggctggtttaca

SEQ ID NO: 573179 - DNA, 25 bp, Homo sapien
tggctggtttacagagattgcaccc

SEQ ID NO: 573180 - DNA, 25 bp, Homo sapien
accctcatgtgccttcatgtcctga

SEQ ID NO: 573181 - DNA, 25 bp, Homo sapien
cttcatgtcctgaaagtactttttg

SEQ ID NO: 573182 - DNA, 25 bp, Homo sapien
gaggtataccacctaattgtaatac

SEQ ID NO: 573183 - DNA, 25 bp, Homo sapien
gtaatacgcttacatgctgccttca

SEQ ID NO: 573184 - DNA, 25 bp, Homo sapien
atgcatgtttatccagcacacgtgt

SEQ ID NO: 573185 - DNA, 25 bp, Homo sapien
atatatcaaagttggtctcatcttg

SEQ ID NO: 573186 - DNA, 25 bp, Homo sapien
atgtcagctcttccgcagtgattga

SEQ ID NO: 573187 - DNA, 25 bp, Homo sapien
tcagctcttccgcagtgattgaagc

SEQ ID NO: 573188 - DNA, 25 bp, Homo sapien
cagctcttccgcagtgattgaagct

SEQ ID NO: 573189 - DNA, 25 bp, Homo sapien
agctcttccgcagtgattgaagctt

SEQ ID NO: 573190 - DNA, 25 bp, Homo sapien
gctcttccgcagtgattgaagcttt

SEQ ID NO: 573191 - DNA, 25 bp, Homo sapien
tcttccgcagtgattgaagctttga

SEQ ID NO: 573192 - DNA, 25 bp, Homo sapien
ttccgcagtgattgaagctttgata

SEQ ID NO: 573193 - DNA, 25 bp, Homo sapien
tccgcagtgattgaagctttgataa

SEQ ID NO: 573194 - DNA, 25 bp, Homo sapien
cgcagtgattgaagctttgataaat

SEQ ID NO: 573195 - DNA, 25 bp, Homo sapien
gtgattgaagctttgataaatgaaa

SEQ ID NO: 573196 - DNA, 25 bp, Homo sapien
actgcacccagccaatgggtgtaat

SEQ ID NO: 573197 - DNA, 25 bp, Homo sapien
tgcacccagccaatgggtgtaattt

SEQ ID NO: 573198 - DNA, 25 bp, Homo sapien
ccagccaatgggtgtaatttcatag

SEQ ID NO: 573199 - DNA, 25 bp, Homo sapien
cagccaatgggtgtaatttcatagg

SEQ ID NO: 573200 - DNA, 25 bp, Homo sapien
gccaatgggtgtaatttcataggaa

SEQ ID NO: 573201 - DNA, 25 bp, Homo sapien
ccaatgggtgtaatttcataggaaa

SEQ ID NO: 573202 - DNA, 25 bp, Homo sapien
attctttttgtcagaatgtactgaa

SEQ ID NO: 573203 - DNA, 25 bp, Homo sapien
ttttgtcagaatgtactgaattgta

SEQ ID NO: 573204 - DNA, 25 bp, Homo sapien
ctgaattgtaatattaatacctgaa

SEQ ID NO: 573205 - DNA, 25 bp, Homo sapien
tacctgaaaatttgttagttcactt

SEQ ID NO: 573206 - DNA, 25 bp, Homo sapien
tcacttcttttccacgttcttcttt

SEQ ID NO: 573207 - DNA, 25 bp, Homo sapien
gagcaagcggctcagccagatttca

SEQ ID NO: 573208 - DNA, 25 bp, Homo sapien
gatgaacatgaacctttagctacta

SEQ ID NO: 573209 - DNA, 25 bp, Homo sapien
tttagctactagcaccatccattca

SEQ ID NO: 573210 - DNA, 25 bp, Homo sapien
ccattcactatactacactttattg

SEQ ID NO: 573211 - DNA, 25 bp, Homo sapien
agaattggaaacttcctgcgttaat

SEQ ID NO: 573212 - DNA, 25 bp, Homo sapien
acttcctgcgttaattcatctggta

SEQ ID NO: 573213 - DNA, 25 bp, Homo sapien
tcatctggtaagattctcagtcact

SEQ ID NO: 573214 - DNA, 25 bp, Homo sapien
gtcactggacaatcaaagccatgtt

SEQ ID NO: 573215 - DNA, 25 bp, Homo sapien
agccatgttagttacgtgcttcatt

SEQ ID NO: 573216 - DNA, 25 bp, Homo sapien
gcttcattaagactgccttgctttt

SEQ ID NO: 573217 - DNA, 25 bp, Homo sapien
aacaagttcataacaccattccaag

SEQ ID NO: 573218 - DNA, 25 bp, Homo sapien
gggacagtgattatcaaaccttcta

SEQ ID NO: 573219 - DNA, 25 bp, Homo sapien
tcaaaccttctaaactgatccatag

SEQ ID NO: 573220 - DNA, 25 bp, Homo sapien
catttaacattgtggtctagtgacc

SEQ ID NO: 573221 - DNA, 25 bp, Homo sapien
tgtggtctagtgaccatagacaaag

SEQ ID NO: 573222 - DNA, 25 bp, Homo sapien
agacaaagataactctacaagtaca

SEQ ID NO: 573223 - DNA, 25 bp, Homo sapien
taaaacaagcttcacaaaccatatt

SEQ ID NO: 573224 - DNA, 25 bp, Homo sapien
accatatttattacctttactgaat

SEQ ID NO: 573225 - DNA, 25 bp, Homo sapien
tactgaatatgataaaccccccctc

SEQ ID NO: 573226 - DNA, 25 bp, Homo sapien
cccctccagaagtcaggctagaaaa

SEQ ID NO: 573227 - DNA, 25 bp, Homo sapien
ggctagaaaagcttgtggaaccctt

SEQ ID NO: 573228 - DNA, 25 bp, Homo sapien
cttgtggaacccttctcggaatatt

SEQ ID NO: 573229 - DNA, 25 bp, Homo sapien
ctttcgttccaatgctagctttgga

SEQ ID NO: 573230 - DNA, 25 bp, Homo sapien
tttcgttccaatgctagctttggaa

SEQ ID NO: 573231 - DNA, 25 bp, Homo sapien
ttcgttccaatgctagctttggaat

SEQ ID NO: 573232 - DNA, 25 bp, Homo sapien
gttccaatgctagctttggaatcct

SEQ ID NO: 573233 - DNA, 25 bp, Homo sapien
caatgctagctttggaatcctggcc

SEQ ID NO: 573234 - DNA, 25 bp, Homo sapien
aatgctagctttggaatcctggcct

SEQ ID NO: 573235 - DNA, 25 bp, Homo sapien
atgctagctttggaatcctggcctc

SEQ ID NO: 573236 - DNA, 25 bp, Homo sapien
tggcctccatcccttaaaagctttg

SEQ ID NO: 573237 - DNA, 25 bp, Homo sapien
ggcctccatcccttaaaagctttgt

SEQ ID NO: 573238 - DNA, 25 bp, Homo sapien
gcctccatcccttaaaagctttgtg

SEQ ID NO: 573239 - DNA, 25 bp, Homo sapien
aaaagctttgtgatcttaggtaagt

SEQ ID NO: 573240 - DNA, 25 bp, Homo sapien
attctgttttgcctgtcttatttat

SEQ ID NO: 573241 - DNA, 25 bp, Homo sapien
ctgttttgcctgtcttatttattct

SEQ ID NO: 573242 - DNA, 25 bp, Homo sapien
attctcatttgtgattatttagatc

SEQ ID NO: 573243 - DNA, 25 bp, Homo sapien
gtgattatttagatcttaagaccaa

SEQ ID NO: 573244 - DNA, 25 bp, Homo sapien
tagatcttaagaccaaactttcttg

SEQ ID NO: 573245 - DNA, 25 bp, Homo sapien
tcttaagaccaaactttcttggtat

SEQ ID NO: 573246 - DNA, 25 bp, Homo sapien
gaaggtatgattttactgctagaga

SEQ ID NO: 573247 - DNA, 25 bp, Homo sapien
gattttactgctagagaagtttgtc

SEQ ID NO: 573248 - DNA, 25 bp, Homo sapien
tttactgctagagaagtttgtctct

SEQ ID NO: 573249 - DNA, 25 bp, Homo sapien
taatttttatactgctgtagcataa

SEQ ID NO: 573250 - DNA, 25 bp, Homo sapien
actgctgtagcataatttctaaatt

SEQ ID NO: 573251 - DNA, 25 bp, Homo sapien
gtatatgctgagaggccatttcaaa

SEQ ID NO: 573252 - DNA, 25 bp, Homo sapien
gagaggccatttcaaagtctttcat

SEQ ID NO: 573253 - DNA, 25 bp, Homo sapien
aagtctttcatagaaggctgtgctt

SEQ ID NO: 573254 - DNA, 25 bp, Homo sapien
gtgcttgggcaagtagaacttttca

SEQ ID NO: 573255 - DNA, 25 bp, Homo sapien
acttttcatcatacagtcccagaga

SEQ ID NO: 573256 - DNA, 25 bp, Homo sapien
gaaactgtgttctctagtctttcat

SEQ ID NO: 573257 - DNA, 25 bp, Homo sapien
ttctctagtctttcattcgggaaca

SEQ ID NO: 573258 - DNA, 25 bp, Homo sapien
aaatggtgtcgtaccaaatggctaa

SEQ ID NO: 573259 - DNA, 25 bp, Homo sapien
atggctaaaaagatcccaggcttac

SEQ ID NO: 573260 - DNA, 25 bp, Homo sapien
aagatcccaggcttactctgagaaa

SEQ ID NO: 573261 - DNA, 25 bp, Homo sapien
atctctctcttctgaattaaacttg

SEQ ID NO: 573262 - DNA, 25 bp, Homo sapien
aaagccctttctatactgagagcat

SEQ ID NO: 573263 - DNA, 25 bp, Homo sapien
tatactgagagcatggcagagcagt

SEQ ID NO: 573264 - DNA, 25 bp, Homo sapien
gaggtctgaattcatctactccatc

SEQ ID NO: 573265 - DNA, 25 bp, Homo sapien
tctactccatccctgggtggttgta

SEQ ID NO: 573266 - DNA, 25 bp, Homo sapien
atccctgggtggttgtaggcatgtc

SEQ ID NO: 573267 - DNA, 25 bp, Homo sapien
tgggtggttgtaggcatgtcacctt

SEQ ID NO: 573268 - DNA, 25 bp, Homo sapien
tcaccttggccatctgtttctaaag

SEQ ID NO: 573269 - DNA, 25 bp, Homo sapien
aagtctgaggcagcacaatggtcca

SEQ ID NO: 573270 - DNA, 25 bp, Homo sapien
gcagcacaatggtccaggtagatat

SEQ ID NO: 573271 - DNA, 25 bp, Homo sapien
agatattaattattgtgcccacaga

SEQ ID NO: 573272 - DNA, 25 bp, Homo sapien
tgtgcccacagagaattgtttgaac

SEQ ID NO: 573273 - DNA, 25 bp, Homo sapien
tttgaatctctgaacaaccattgtc

SEQ ID NO: 573274 - DNA, 25 bp, Homo sapien
caaccattgtcagttgtgaatgatg

SEQ ID NO: 573275 - DNA, 25 bp, Homo sapien
ttttggcatcaagtctcataacccc

SEQ ID NO: 573276 - DNA, 25 bp, Homo sapien
ggcatcaagtctcataaccccaact

SEQ ID NO: 573277 - DNA, 25 bp, Homo sapien
agaactgttgcttatctgtcttcct

SEQ ID NO: 573278 - DNA, 25 bp, Homo sapien
tgttgcttatctgtcttccttaagt

SEQ ID NO: 573279 - DNA, 25 bp, Homo sapien
ttgtttgtcttcacttttcccccag

SEQ ID NO: 573280 - DNA, 25 bp, Homo sapien
tttcccccaggtctgttgagctgta

SEQ ID NO: 573281 - DNA, 25 bp, Homo sapien
ctgttgagctgtatgagattcattc

SEQ ID NO: 573282 - DNA, 25 bp, Homo sapien
gagattcattcatacttcatttatt

SEQ ID NO: 573283 - DNA, 25 bp, Homo sapien
gttgaacacttacatgtaccagaca

SEQ ID NO: 573284 - DNA, 25 bp, Homo sapien
tgaaggaagacatctgctctgcatc

SEQ ID NO: 573285 - DNA, 25 bp, Homo sapien
agacatctgctctgcatctcatagg

SEQ ID NO: 573286 - DNA, 25 bp, Homo sapien
acatctgctctgcatctcataggga

SEQ ID NO: 573287 - DNA, 25 bp, Homo sapien
atctgctctgcatctcatagggagt

SEQ ID NO: 573288 - DNA, 25 bp, Homo sapien
ctgctctgcatctcatagggagtaa

SEQ ID NO: 573289 - DNA, 25 bp, Homo sapien
gctctgcatctcatagggagtaaaa

SEQ ID NO: 573290 - DNA, 25 bp, Homo sapien
ctcatagggagtaaaatggcacagt

SEQ ID NO: 573291 - DNA, 25 bp, Homo sapien
aatggcacagttgaaactcaagcat

SEQ ID NO: 573292 - DNA, 25 bp, Homo sapien
ggcacagttgaaactcaagcattgt

SEQ ID NO: 573293 - DNA, 25 bp, Homo sapien
gttgaaactcaagcattgtcttgta

SEQ ID NO: 573294 - DNA, 25 bp, Homo sapien
aagcattgtcttgtaaatctaaatt

SEQ ID NO: 573295 - DNA, 25 bp, Homo sapien
ttgaatataactcctgtcttaaaat

SEQ ID NO: 573296 - DNA, 25 bp, Homo sapien
tgaatataactcctgtcttaaaatc

SEQ ID NO: 573297 - DNA, 25 bp, Homo sapien
ctgcagaatattgaatttttccagc

SEQ ID NO: 573298 - DNA, 25 bp, Homo sapien
tttttacttttgcttagcttataga

SEQ ID NO: 573299 - DNA, 25 bp, Homo sapien
ttacttttgcttagcttatagatgc

SEQ ID NO: 573300 - DNA, 25 bp, Homo sapien
acttttgcttagcttatagatgcta

SEQ ID NO: 573301 - DNA, 25 bp, Homo sapien
tttgcttagcttatagatgctaaag

SEQ ID NO: 573302 - DNA, 25 bp, Homo sapien
gatgctaaaggatactgtcatttgc

SEQ ID NO: 573303 - DNA, 25 bp, Homo sapien
gctaaaggatactgtcatttgcatt

SEQ ID NO: 573304 - DNA, 25 bp, Homo sapien
taaaggatactgtcatttgcatttt

SEQ ID NO: 573305 - DNA, 25 bp, Homo sapien
aaggatactgtcatttgcattttta

SEQ ID NO: 573306 - DNA, 25 bp, Homo sapien
agagggacacattaggccaaagaat

SEQ ID NO: 573307 - DNA, 25 bp, Homo sapien
gggtacaggctgacatgaaaaaaca

SEQ ID NO: 573308 - DNA, 25 bp, Homo sapien
aaaacaccgacagatacactccagt

SEQ ID NO: 573309 - DNA, 25 bp, Homo sapien
gacagatacactccagtatgcagac

SEQ ID NO: 573310 - DNA, 25 bp, Homo sapien
gacccatctgaccttcacaagaaac

SEQ ID NO: 573311 - DNA, 25 bp, Homo sapien
ctgaccttcacaagaaacagactgt

SEQ ID NO: 573312 - DNA, 25 bp, Homo sapien
aacagactgtgaaagcaagcaaggc

SEQ ID NO: 573313 - DNA, 25 bp, Homo sapien
gaaagcaagcaaggctcaggctgtg

SEQ ID NO: 573314 - DNA, 25 bp, Homo sapien
gcagagtctgtatagctacgcacat

SEQ ID NO: 573315 - DNA, 25 bp, Homo sapien
atagctacgcacattacaccagctg

SEQ ID NO: 573316 - DNA, 25 bp, Homo sapien
gctgcttccagcaatttcatctgat

SEQ ID NO: 573317 - DNA, 25 bp, Homo sapien
gtcatttcttaccagtttaggctta

SEQ ID NO: 573318 - DNA, 25 bp, Homo sapien
tcatttcttaccagtttaggcttat

SEQ ID NO: 573319 - DNA, 25 bp, Homo sapien
catttcttaccagtttaggcttatg

SEQ ID NO: 573320 - DNA, 25 bp, Homo sapien
tttcttaccagtttaggcttatggg

SEQ ID NO: 573321 - DNA, 25 bp, Homo sapien
tcttaccagtttaggcttatgggac

SEQ ID NO: 573322 - DNA, 25 bp, Homo sapien
taccagtttaggcttatgggaccaa

SEQ ID NO: 573323 - DNA, 25 bp, Homo sapien
ccagtttaggcttatgggaccaaag

SEQ ID NO: 573324 - DNA, 25 bp, Homo sapien
gtttaggcttatgggaccaaagcag

SEQ ID NO: 573325 - DNA, 25 bp, Homo sapien
taggcttatgggaccaaagcagaaa

SEQ ID NO: 573326 - DNA, 25 bp, Homo sapien
cttatgggaccaaagcagaaattca

SEQ ID NO: 573327 - DNA, 25 bp, Homo sapien
tatgggaccaaagcagaaattcaag

SEQ ID NO: 573328 - DNA, 25 bp, Homo sapien
tacaatggcctcctggatgcacaaa

SEQ ID NO: 573329 - DNA, 25 bp, Homo sapien
ggatgcacaaaagaccctgaagggc

SEQ ID NO: 573330 - DNA, 25 bp, Homo sapien
gtttggtcaagtttactcaaccaga

SEQ ID NO: 573331 - DNA, 25 bp, Homo sapien
gaccaccttgataccaacaatgctg

SEQ ID NO: 573332 - DNA, 25 bp, Homo sapien
agagcatttggcaagagcagggcca

SEQ ID NO: 573333 - DNA, 25 bp, Homo sapien
acaatgccaaattccttggaaaggt

SEQ ID NO: 573334 - DNA, 25 bp, Homo sapien
ggtagacttcctatgatactttcat

SEQ ID NO: 573335 - DNA, 25 bp, Homo sapien
gatactttcatggattggcaaattt

SEQ ID NO: 573336 - DNA, 25 bp, Homo sapien
agacttggcaataaagtggcactta

SEQ ID NO: 573337 - DNA, 25 bp, Homo sapien
gtggcacttaggcactatattattg

SEQ ID NO: 573338 - DNA, 25 bp, Homo sapien
attattgatatctacaatggcctcc

SEQ ID NO: 573339 - DNA, 25 bp, Homo sapien
atgtaagacccctctgagccgccag

SEQ ID NO: 573340 - DNA, 25 bp, Homo sapien
agcctgactgctctcagtgcaaaga

SEQ ID NO: 573341 - DNA, 25 bp, Homo sapien
actgctctcagtgcaaagacccaga

SEQ ID NO: 573342 - DNA, 25 bp, Homo sapien
ctcagtgcaaagacccagaacccag

SEQ ID NO: 573343 - DNA, 25 bp, Homo sapien
gtgcacacacacttcttgtgcatat

SEQ ID NO: 573344 - DNA, 25 bp, Homo sapien
gaatgctggaatcagatttttccat

SEQ ID NO: 573345 - DNA, 25 bp, Homo sapien
gaatcagatttttccattctgaatg

SEQ ID NO: 573346 - DNA, 25 bp, Homo sapien
atgtgtttaaataacatggccaagg

SEQ ID NO: 573347 - DNA, 25 bp, Homo sapien
atggccaaggataatttctttctgt

SEQ ID NO: 573348 - DNA, 25 bp, Homo sapien
gtagtataagatatgtgacttccaa

SEQ ID NO: 573349 - DNA, 25 bp, Homo sapien
tgacttccaaataaacataaaccat

SEQ ID NO: 573350 - DNA, 25 bp, Homo sapien
tgagttgatcaaagatgctcccacc

SEQ ID NO: 573351 - DNA, 25 bp, Homo sapien
tggagaaatacagtgggtgtcaact

SEQ ID NO: 573352 - DNA, 25 bp, Homo sapien
ggtgtcaactgaaaagactgatggt

SEQ ID NO: 573353 - DNA, 25 bp, Homo sapien
acttgacctcaataaagcccttcag

SEQ ID NO: 573354 - DNA, 25 bp, Homo sapien
tcaataaagcccttcagcatgccgg

SEQ ID NO: 573355 - DNA, 25 bp, Homo sapien
agcatgccggcaaacacatggagga

SEQ ID NO: 573356 - DNA, 25 bp, Homo sapien
cattgtggcctcctacacggcacta

SEQ ID NO: 573357 - DNA, 25 bp, Homo sapien
acacggcactacttcttgggtgtct

SEQ ID NO: 573358 - DNA, 25 bp, Homo sapien
ttgggtgtctctgccaggaaagtcc

SEQ ID NO: 573359 - DNA, 25 bp, Homo sapien
gaaagtccaatcaatgtaaccactg

SEQ ID NO: 573360 - DNA, 25 bp, Homo sapien
atgtaaccactgtgcgggaatatct

SEQ ID NO: 573361 - DNA, 25 bp, Homo sapien
agagacatgcggaacattagactgc

SEQ ID NO: 573362 - DNA, 25 bp, Homo sapien
cggaacattagactgcagagcacat

SEQ ID NO: 573363 - DNA, 25 bp, Homo sapien
gactgcagagcacatagatcatgag

SEQ ID NO: 573364 - DNA, 25 bp, Homo sapien
acatagatcatgagacacacggttt

SEQ ID NO: 573365 - DNA, 25 bp, Homo sapien
tgagacacacggtttaaatttaggt

SEQ ID NO: 573366 - DNA, 25 bp, Homo sapien
gtaggtatgagctcaatttgtgaat

SEQ ID NO: 573367 - DNA, 25 bp, Homo sapien
tgagctcaatttgtgaattcatttt

SEQ ID NO: 573368 - DNA, 25 bp, Homo sapien
gaatcagatctagcttacttttagt

SEQ ID NO: 573369 - DNA, 25 bp, Homo sapien
gatctagcttacttttagttcttat

SEQ ID NO: 573370 - DNA, 25 bp, Homo sapien
gcttacttttagttcttattcatgt

SEQ ID NO: 573371 - DNA, 25 bp, Homo sapien
catgtttaagagttagtcctggcca

SEQ ID NO: 573372 - DNA, 25 bp, Homo sapien
atatatcaaagttggtctcatcttg

SEQ ID NO: 573373 - DNA, 25 bp, Homo sapien
atgtcagctcttccgcagtgattga

SEQ ID NO: 573374 - DNA, 25 bp, Homo sapien
tcttcctaagtatagagattgggtc

SEQ ID NO: 573375 - DNA, 25 bp, Homo sapien
ttcctaagtatagagattgggtctt

SEQ ID NO: 573376 - DNA, 25 bp, Homo sapien
tgccgggattggaggcccaagccac

SEQ ID NO: 573377 - DNA, 25 bp, Homo sapien
gccgggattggaggcccaagccact

SEQ ID NO: 573378 - DNA, 25 bp, Homo sapien
tgtgcctggccctttataaattatg

SEQ ID NO: 573379 - DNA, 25 bp, Homo sapien
aattgtatagtcaaaatggctcaca

SEQ ID NO: 573380 - DNA, 25 bp, Homo sapien
ttgtatagtcaaaatggctcacata

SEQ ID NO: 573381 - DNA, 25 bp, Homo sapien
gtatagtcaaaatggctcacatatt

SEQ ID NO: 573382 - DNA, 25 bp, Homo sapien
gtcaaaatggctcacatattaaata

SEQ ID NO: 573383 - DNA, 25 bp, Homo sapien
actctccctgcatcagggtctgagt

SEQ ID NO: 573384 - DNA, 25 bp, Homo sapien
tgcatcagggtctgagtgcctggca

SEQ ID NO: 573385 - DNA, 25 bp, Homo sapien
atgatcaaggttagtgcgcccagcc

SEQ ID NO: 573386 - DNA, 25 bp, Homo sapien
gatcaaggttagtgcgcccagcccc

SEQ ID NO: 573387 - DNA, 25 bp, Homo sapien
gaaggagacttcaaccttttgaaga

SEQ ID NO: 573388 - DNA, 25 bp, Homo sapien
tcaaccttttgaagaggaagtcagt

SEQ ID NO: 573389 - DNA, 25 bp, Homo sapien
aggaagtcagttcacttatgtcagg

SEQ ID NO: 573390 - DNA, 25 bp, Homo sapien
gtcagttcacttatgtcagggtagg

SEQ ID NO: 573391 - DNA, 25 bp, Homo sapien
ttcacttatgtcagggtagggagag

SEQ ID NO: 573392 - DNA, 25 bp, Homo sapien
gggagagtaggaattacgtattctt

SEQ ID NO: 573393 - DNA, 25 bp, Homo sapien
gaattacgtattctttgagactgaa

SEQ ID NO: 573394 - DNA, 25 bp, Homo sapien
ttgtctcgttctgaaagcttggaaa

SEQ ID NO: 573395 - DNA, 25 bp, Homo sapien
gtctcgttctgaaagcttggaaagc

SEQ ID NO: 573396 - DNA, 25 bp, Homo sapien
gcttggaaagctacatcgaagatga

SEQ ID NO: 573397 - DNA, 25 bp, Homo sapien
ttcagctttgatttgacctgtaccc

SEQ ID NO: 573398 - DNA, 25 bp, Homo sapien
agctttgatttgacctgtacccctg

SEQ ID NO: 573399 - DNA, 25 bp, Homo sapien
gattgcactggcaacatttgggtct

SEQ ID NO: 573400 - DNA, 25 bp, Homo sapien
actggcaacatttgggtctcagcaa

SEQ ID NO: 573401 - DNA, 25 bp, Homo sapien
gaaaaacatctttgtaagatccatt

SEQ ID NO: 573402 - DNA, 25 bp, Homo sapien
tctttgtaagatccattcattgaaa

SEQ ID NO: 573403 - DNA, 25 bp, Homo sapien
atctttgtaagatcacctgctaaat

SEQ ID NO: 573404 - DNA, 25 bp, Homo sapien
tttgtaagatcacctgctaaatatg

SEQ ID NO: 573405 - DNA, 25 bp, Homo sapien
taccactgcaacttgctcaaacttc

SEQ ID NO: 573406 - DNA, 25 bp, Homo sapien
actgcaacttgctcaaacttccggc

SEQ ID NO: 573407 - DNA, 25 bp, Homo sapien
tgcaacttgctcaaacttccggcca

SEQ ID NO: 573408 - DNA, 25 bp, Homo sapien
aacttgctcaaacttccggccaagt

SEQ ID NO: 573409 - DNA, 25 bp, Homo sapien
ttgctcaaacttccggccaagtcgg

SEQ ID NO: 573410 - DNA, 25 bp, Homo sapien
tgcgtctgtatgctgcctctcctaa

SEQ ID NO: 573411 - DNA, 25 bp, Homo sapien
tctgtatgctgcctctcctaattca

SEQ ID NO: 573412 - DNA, 25 bp, Homo sapien
tgtatgctgcctctcctaattcatt

SEQ ID NO: 573413 - DNA, 25 bp, Homo sapien
tatgctgcctctcctaattcattat

SEQ ID NO: 573414 - DNA, 25 bp, Homo sapien
gttaacacttatgtttcaaaaacag

SEQ ID NO: 573415 - DNA, 25 bp, Homo sapien
tgtttcaaaaacagtcatctttatt

SEQ ID NO: 573416 - DNA, 25 bp, Homo sapien
gccaatatcgtcaggtagttttacc

SEQ ID NO: 573417 - DNA, 25 bp, Homo sapien
aacccacttttggatggacgctatt

SEQ ID NO: 573418 - DNA, 25 bp, Homo sapien
cacttttggatggacgctatttcag

SEQ ID NO: 573419 - DNA, 25 bp, Homo sapien
gatggacgctatttcagttaagcaa

SEQ ID NO: 573420 - DNA, 25 bp, Homo sapien
gctatttcagttaagcaagtcactg

SEQ ID NO: 573421 - DNA, 25 bp, Homo sapien
aagtcactgacttagtttataccaa

SEQ ID NO: 573422 - DNA, 25 bp, Homo sapien
gtcactgacttagtttataccaaat

SEQ ID NO: 573423 - DNA, 25 bp, Homo sapien
ccaaatattgtgctttctttgtaag

SEQ ID NO: 573424 - DNA, 25 bp, Homo sapien
gtgctttctttgtaagataacggtt

SEQ ID NO: 573425 - DNA, 25 bp, Homo sapien
ataacggtttacatagacatcctgg

SEQ ID NO: 573426 - DNA, 25 bp, Homo sapien
gtttacatagacatcctggatctgg

SEQ ID NO: 573427 - DNA, 25 bp, Homo sapien
aagatggcacagatagccccatgag

SEQ ID NO: 573428 - DNA, 25 bp, Homo sapien
agccccatgaggaaggcacatcgtt

SEQ ID NO: 573429 - DNA, 25 bp, Homo sapien
gaggaaggcacatcgttatccattt

SEQ ID NO: 573430 - DNA, 25 bp, Homo sapien
aggcacatcgttatccattttacag

SEQ ID NO: 573431 - DNA, 25 bp, Homo sapien
atcgttatccattttacaggcggtg

SEQ ID NO: 573432 - DNA, 25 bp, Homo sapien
tatccattttacaggcggtggctga

SEQ ID NO: 573433 - DNA, 25 bp, Homo sapien
tttacaggcggtggctgagtcttag

SEQ ID NO: 573434 - DNA, 25 bp, Homo sapien
ggaagcagtccagtgaaaccagaac

SEQ ID NO: 573435 - DNA, 25 bp, Homo sapien
gaaaccagaactcaagccacatata

SEQ ID NO: 573436 - DNA, 25 bp, Homo sapien
attcctagtagccagttattaagag

SEQ ID NO: 573437 - DNA, 25 bp, Homo sapien
catgtcatcgatgtaagtaaatcat

SEQ ID NO: 573438 - DNA, 25 bp, Homo sapien
gagtttgagtctgtaatgcactatg

SEQ ID NO: 573439 - DNA, 25 bp, Homo sapien
gtttgagtctgtaatgcactatgat

SEQ ID NO: 573440 - DNA, 25 bp, Homo sapien
gagtctgtaatgcactatgattgtg

SEQ ID NO: 573441 - DNA, 25 bp, Homo sapien
atacccatgataatatacccaatat

SEQ ID NO: 573442 - DNA, 25 bp, Homo sapien
tatacccaatatacccttgttaaag

SEQ ID NO: 573443 - DNA, 25 bp, Homo sapien
caatatacccttgttaaagaagcaa

SEQ ID NO: 573444 - DNA, 25 bp, Homo sapien
gtttcaggaaatctatattatatgc

SEQ ID NO: 573445 - DNA, 25 bp, Homo sapien
ttatatgcattcaaaaagacctgga

SEQ ID NO: 573446 - DNA, 25 bp, Homo sapien
atatgcattcaaaaagacctggaca

SEQ ID NO: 573447 - DNA, 25 bp, Homo sapien
acctggacaaataaagaccaatctt

SEQ ID NO: 573448 - DNA, 25 bp, Homo sapien
gacaaataaagaccaatcttaacag

SEQ ID NO: 573449 - DNA, 25 bp, Homo sapien
tgatttcatcctgaccgaaggcgac

SEQ ID NO: 573450 - DNA, 25 bp, Homo sapien
atttcatcctgaccgaaggcgacct

SEQ ID NO: 573451 - DNA, 25 bp, Homo sapien
ttcatcctgaccgaaggcgacctga

SEQ ID NO: 573452 - DNA, 25 bp, Homo sapien
atcctgaccgaaggcgacctgacat

SEQ ID NO: 573453 - DNA, 25 bp, Homo sapien
cgaaggcgacctgacattgacctac

SEQ ID NO: 573454 - DNA, 25 bp, Homo sapien
gactgcaaatggctcctcaagttcg

SEQ ID NO: 573455 - DNA, 25 bp, Homo sapien
ctgcaaatggctcctcaagttcgca

SEQ ID NO: 573456 - DNA, 25 bp, Homo sapien
gcaaatggctcctcaagttcgcaca

SEQ ID NO: 573457 - DNA, 25 bp, Homo sapien
aatggctcctcaagttcgcacaccg

SEQ ID NO: 573458 - DNA, 25 bp, Homo sapien
aagtgctggagcgagacctgggaat

SEQ ID NO: 573459 - DNA, 25 bp, Homo sapien
cccctggaagataatgcttgacttt

SEQ ID NO: 573460 - DNA, 25 bp, Homo sapien
actggagtttataatagttcgtact

SEQ ID NO: 573461 - DNA, 25 bp, Homo sapien
taatagttcgtactttatagcattg

SEQ ID NO: 573462 - DNA, 25 bp, Homo sapien
taacaactagaactactctcaaagt

SEQ ID NO: 573463 - DNA, 25 bp, Homo sapien
aatacaaatgctattttctgtttct

SEQ ID NO: 573464 - DNA, 25 bp, Homo sapien
taattttcctgttaactactcaaca

SEQ ID NO: 573465 - DNA, 25 bp, Homo sapien
aactactcaacatttaggtgactgt

SEQ ID NO: 573466 - DNA, 25 bp, Homo sapien
aggtgactgttatagctgcagaagc

SEQ ID NO: 573467 - DNA, 25 bp, Homo sapien
atagctgcagaagcacagtacgctt

SEQ ID NO: 573468 - DNA, 25 bp, Homo sapien
agcacagtacgcttagagctttagg

SEQ ID NO: 573469 - DNA, 25 bp, Homo sapien
cttagagctttaggaagtgtcacta

SEQ ID NO: 573470 - DNA, 25 bp, Homo sapien
ctatgatatctctaattaaatgtct

SEQ ID NO: 573471 - DNA, 25 bp, Homo sapien
aagatttattgtctcctcttctaca

SEQ ID NO: 573472 - DNA, 25 bp, Homo sapien
atttattgtctcctcttctacaagg

SEQ ID NO: 573473 - DNA, 25 bp, Homo sapien
tattgtctcctcttctacaaggata

SEQ ID NO: 573474 - DNA, 25 bp, Homo sapien
gtctcctcttctacaaggatataca

SEQ ID NO: 573475 - DNA, 25 bp, Homo sapien
aaggatatacattcaacaaggaaag

SEQ ID NO: 573476 - DNA, 25 bp, Homo sapien
agagattctttgttcaccacttttc

SEQ ID NO: 573477 - DNA, 25 bp, Homo sapien
acttttcctccagcacatgtcatgt

SEQ ID NO: 573478 - DNA, 25 bp, Homo sapien
tttcctccagcacatgtcatgtagt

SEQ ID NO: 573479 - DNA, 25 bp, Homo sapien
gcacatgtcatgtagtcaattaata

SEQ ID NO: 573480 - DNA, 25 bp, Homo sapien
aattattgcattaggttttggtatc

SEQ ID NO: 573481 - DNA, 25 bp, Homo sapien
attgcattaggttttggtatcaaga

SEQ ID NO: 573482 - DNA, 25 bp, Homo sapien
tgttccaccctttcacatttatttt

SEQ ID NO: 573483 - DNA, 25 bp, Homo sapien
catttattttcattccgtccccttg

SEQ ID NO: 573484 - DNA, 25 bp, Homo sapien
tttgctcttccatcctgtcagtcct

SEQ ID NO: 573485 - DNA, 25 bp, Homo sapien
cccttctcagtaacctgggcatgaa

SEQ ID NO: 573486 - DNA, 25 bp, Homo sapien
ggagggacttactttctagcactgg

SEQ ID NO: 573487 - DNA, 25 bp, Homo sapien
tctagcactggcaaaggtctttttt

SEQ ID NO: 573488 - DNA, 25 bp, Homo sapien
gtcttttttctttgcgtctgtccca

SEQ ID NO: 573489 - DNA, 25 bp, Homo sapien
ttgcgtctgtcccaggcattaataa

SEQ ID NO: 573490 - DNA, 25 bp, Homo sapien
taaagttggctctattttgctttgt

SEQ ID NO: 573491 - DNA, 25 bp, Homo sapien
gctttgtttaacgatgcttttagtc

SEQ ID NO: 573492 - DNA, 25 bp, Homo sapien
gatgcttttagtcgcgtgtacaagt

SEQ ID NO: 573493 - DNA, 25 bp, Homo sapien
aagcagcaaaggaacagggcagcac

SEQ ID NO: 573494 - DNA, 25 bp, Homo sapien
gaacagggcagcacccagtgtaact

SEQ ID NO: 573495 - DNA, 25 bp, Homo sapien
aaggtaattcatgccacacaagacg

SEQ ID NO: 573496 - DNA, 25 bp, Homo sapien
ttcatgccacacaagacgcattagg

SEQ ID NO: 573497 - DNA, 25 bp, Homo sapien
agacgcattaggtgaacctggtggt

SEQ ID NO: 573498 - DNA, 25 bp, Homo sapien
gaaaactatccccagaatcagccac

SEQ ID NO: 573499 - DNA, 25 bp, Homo sapien
cacctcagcccctagtattttttct

SEQ ID NO: 573500 - DNA, 25 bp, Homo sapien
gtattttttctatcaatgccttgta

SEQ ID NO: 573501 - DNA, 25 bp, Homo sapien
atcaatgccttgtatcagcctcaaa

SEQ ID NO: 573502 - DNA, 25 bp, Homo sapien
cttgtatcagcctcaaagcagcctg

SEQ ID NO: 573503 - DNA, 25 bp, Homo sapien
ctcaaagcagcctgttcaagttaac

SEQ ID NO: 573504 - DNA, 25 bp, Homo sapien
cagccgcaggcgcaacttttttgag

SEQ ID NO: 573505 - DNA, 25 bp, Homo sapien
agccgcaggcgcaacttttttgagt

SEQ ID NO: 573506 - DNA, 25 bp, Homo sapien
gccgcaggcgcaacttttttgagtt

SEQ ID NO: 573507 - DNA, 25 bp, Homo sapien
ccgcaggcgcaacttttttgagttt

SEQ ID NO: 573508 - DNA, 25 bp, Homo sapien
cgcaggcgcaacttttttgagtttt

SEQ ID NO: 573509 - DNA, 25 bp, Homo sapien
gcaggcgcaacttttttgagttttc

SEQ ID NO: 573510 - DNA, 25 bp, Homo sapien
gtaaacatacaaagccattacaggg

SEQ ID NO: 573511 - DNA, 25 bp, Homo sapien
aacatacaaagccattacagggcat

SEQ ID NO: 573512 - DNA, 25 bp, Homo sapien
atacaaagccattacagggcatggt

SEQ ID NO: 573513 - DNA, 25 bp, Homo sapien
tacaaagccattacagggcatggtg

SEQ ID NO: 573514 - DNA, 25 bp, Homo sapien
caaagccattacagggcatggtggg

SEQ ID NO: 573515 - DNA, 25 bp, Homo sapien
tgtccttcctgaaagtcagccactg

SEQ ID NO: 573516 - DNA, 25 bp, Homo sapien
ccttcctgaaagtcagccactgggc

SEQ ID NO: 573517 - DNA, 25 bp, Homo sapien
gggtgtcacagtcagagccctgctc

SEQ ID NO: 573518 - DNA, 25 bp, Homo sapien
gggcagtcactggaaactcagaaga

SEQ ID NO: 573519 - DNA, 25 bp, Homo sapien
gacaatgaaagtttcccattcaagg

SEQ ID NO: 573520 - DNA, 25 bp, Homo sapien
ggaggcatccagctgttagttctgc

SEQ ID NO: 573521 - DNA, 25 bp, Homo sapien
atccagctgttagttctgccagcaa

SEQ ID NO: 573522 - DNA, 25 bp, Homo sapien
gttctgccagcaaaaatgccagcca

SEQ ID NO: 573523 - DNA, 25 bp, Homo sapien
agccagagagctaaactgccagcaa

SEQ ID NO: 573524 - DNA, 25 bp, Homo sapien
gagagctaaactgccagcaaaagat

SEQ ID NO: 573525 - DNA, 25 bp, Homo sapien
ttggaggccattaagagcaggcact

SEQ ID NO: 573526 - DNA, 25 bp, Homo sapien
aaagtacgccaatgtgaatttccat

SEQ ID NO: 573527 - DNA, 25 bp, Homo sapien
ttttcaatggaagtcctccgctgat

SEQ ID NO: 573528 - DNA, 25 bp, Homo sapien
aagtcctccgctgattcctagaagg

SEQ ID NO: 573529 - DNA, 25 bp, Homo sapien
ttcctagaaggctgtgagaccacac

SEQ ID NO: 573530 - DNA, 25 bp, Homo sapien
gagaccacactagggcattgtttcc

SEQ ID NO: 573531 - DNA, 25 bp, Homo sapien
gcagtgggagagcagactcatctca

SEQ ID NO: 573532 - DNA, 25 bp, Homo sapien
actcatctcagaacacagcacaggg

SEQ ID NO: 573533 - DNA, 25 bp, Homo sapien
agggacactggcttgttgggtctct

SEQ ID NO: 573534 - DNA, 25 bp, Homo sapien
ttggctgctcagtgctttggtagca

SEQ ID NO: 573535 - DNA, 25 bp, Homo sapien
ttggcctttgggaactttgctccaa

SEQ ID NO: 573536 - DNA, 25 bp, Homo sapien
gaactttgctccaactggtgtgtct

SEQ ID NO: 573537 - DNA, 25 bp, Homo sapien
tggctttgtcgccggattgcagagc

SEQ ID NO: 573538 - DNA, 25 bp, Homo sapien
ggctttgtcgccggattgcagagct

SEQ ID NO: 573539 - DNA, 25 bp, Homo sapien
gctttgtcgccggattgcagagctg

SEQ ID NO: 573540 - DNA, 25 bp, Homo sapien
ctttgtcgccggattgcagagctga

SEQ ID NO: 573541 - DNA, 25 bp, Homo sapien
tttgtcgccggattgcagagctgaa

SEQ ID NO: 573542 - DNA, 25 bp, Homo sapien
tgcagagctgaagggagccctgtgg

SEQ ID NO: 573543 - DNA, 25 bp, Homo sapien
gcagagctgaagggagccctgtgga

SEQ ID NO: 573544 - DNA, 25 bp, Homo sapien
cctgtggatgacaaacaccaggggc

SEQ ID NO: 573545 - DNA, 25 bp, Homo sapien
ctgtggatgacaaacaccaggggcc

SEQ ID NO: 573546 - DNA, 25 bp, Homo sapien
tctccagaccctacgtggggggagg

SEQ ID NO: 573547 - DNA, 25 bp, Homo sapien
tggaaggctgcggttggctgaaggc

SEQ ID NO: 573548 - DNA, 25 bp, Homo sapien
cggttggctgaaggccgactcctgt

SEQ ID NO: 573549 - DNA, 25 bp, Homo sapien
aaggccgactcctgtgattgacgga

SEQ ID NO: 573550 - DNA, 25 bp, Homo sapien
aggccgactcctgtgattgacggaa

SEQ ID NO: 573551 - DNA, 25 bp, Homo sapien
ggccgactcctgtgattgacggaaa

SEQ ID NO: 573552 - DNA, 25 bp, Homo sapien
gccgactcctgtgattgacggaaag

SEQ ID NO: 573553 - DNA, 25 bp, Homo sapien
ccgactcctgtgattgacggaaagg

SEQ ID NO: 573554 - DNA, 25 bp, Homo sapien
cgactcctgtgattgacggaaagga

SEQ ID NO: 573555 - DNA, 25 bp, Homo sapien
gactcctgtgattgacggaaaggaa

SEQ ID NO: 573556 - DNA, 25 bp, Homo sapien
tgtgattgacggaaaggaaacagcc

SEQ ID NO: 573557 - DNA, 25 bp, Homo sapien
tagttgcctacttaaagctaaaaat

SEQ ID NO: 573558 - DNA, 25 bp, Homo sapien
tgcacttttctttaatgagcctgta

SEQ ID NO: 573559 - DNA, 25 bp, Homo sapien
ctttaatgagcctgtacaaactgta

SEQ ID NO: 573560 - DNA, 25 bp, Homo sapien
gtacaaactgtacattaatttcatt

SEQ ID NO: 573561 - DNA, 25 bp, Homo sapien
gctatttaaggagtaatgcagaact

SEQ ID NO: 573562 - DNA, 25 bp, Homo sapien
tatcatggttgatcaatgttgcttg

SEQ ID NO: 573563 - DNA, 25 bp, Homo sapien
caatgttgcttgattacagagttag

SEQ ID NO: 573564 - DNA, 25 bp, Homo sapien
gattacagagttagatcagcctcat

SEQ ID NO: 573565 - DNA, 25 bp, Homo sapien
agttagatcagcctcattttcaaat

SEQ ID NO: 573566 - DNA, 25 bp, Homo sapien
gatcagcctcattttcaaatgatgt

SEQ ID NO: 573567 - DNA, 25 bp, Homo sapien
aatgatgttcctttgtattcaacga

SEQ ID NO: 573568 - DNA, 25 bp, Homo sapien
gtattcaacgaatgtgccaaaaaat

SEQ ID NO: 573569 - DNA, 25 bp, Homo sapien
tcctcattgcctgtgtacctcagcc

SEQ ID NO: 573570 - DNA, 25 bp, Homo sapien
agcccatctttaatgtcctctgaat

SEQ ID NO: 573571 - DNA, 25 bp, Homo sapien
gcccatctttaatgtcctctgaatc

SEQ ID NO: 573572 - DNA, 25 bp, Homo sapien
ccatctttaatgtcctctgaatcta

SEQ ID NO: 573573 - DNA, 25 bp, Homo sapien
catctttaatgtcctctgaatctac

SEQ ID NO: 573574 - DNA, 25 bp, Homo sapien
tctttaatgtcctctgaatctacag

SEQ ID NO: 573575 - DNA, 25 bp, Homo sapien
ttaatgtcctctgaatctacagccc

SEQ ID NO: 573576 - DNA, 25 bp, Homo sapien
gaatctacagccccaaagagctcca

SEQ ID NO: 573577 - DNA, 25 bp, Homo sapien
gtgtccatccccacaaagaaccgca

SEQ ID NO: 573578 - DNA, 25 bp, Homo sapien
acaaagaaccgcattggccccacat

SEQ ID NO: 573579 - DNA, 25 bp, Homo sapien
aaagaaccgcattggccccacatac

SEQ ID NO: 573580 - DNA, 25 bp, Homo sapien
gcagataaggtgttattgaaagatc

SEQ ID NO: 573581 - DNA, 25 bp, Homo sapien
tcagcttgtgtctttctggagagaa

SEQ ID NO: 573582 - DNA, 25 bp, Homo sapien
tctggagagaagaattaagcacttt

SEQ ID NO: 573583 - DNA, 25 bp, Homo sapien
tttatgactcatatgactaaatagt

SEQ ID NO: 573584 - DNA, 25 bp, Homo sapien
ccaacttcttaatggaacatatagc

SEQ ID NO: 573585 - DNA, 25 bp, Homo sapien
tggaacatatagcagtatcattgac

SEQ ID NO: 573586 - DNA, 25 bp, Homo sapien
aacatatagcagtatcattgactta

SEQ ID NO: 573587 - DNA, 25 bp, Homo sapien
tattctgagttattaatcctcaatt

SEQ ID NO: 573588 - DNA, 25 bp, Homo sapien
tgagttattaatcctcaattttcct

SEQ ID NO: 573589 - DNA, 25 bp, Homo sapien
ttcctttttaacctgagattatatt

SEQ ID NO: 573590 - DNA, 25 bp, Homo sapien
acctgagattatattaaagccttaa

SEQ ID NO: 573591 - DNA, 25 bp, Homo sapien
atggtgtgttttctgttccttcaat

SEQ ID NO: 573592 - DNA, 25 bp, Homo sapien
gttttctgttccttcaattcactag

SEQ ID NO: 573593 - DNA, 25 bp, Homo sapien
tcactagaatgggagttgcagtcaa

SEQ ID NO: 573594 - DNA, 25 bp, Homo sapien
aggttccaaagcctgtgggctctgc

SEQ ID NO: 573595 - DNA, 25 bp, Homo sapien
gtgtttccatgaatccgggaagcaa

SEQ ID NO: 573596 - DNA, 25 bp, Homo sapien
tgtctggagtcgaggtgccctgtct

SEQ ID NO: 573597 - DNA, 25 bp, Homo sapien
tgttggtgtccctgggaaactgctt

SEQ ID NO: 573598 - DNA, 25 bp, Homo sapien
gaaactgcttggttatagccaggct

SEQ ID NO: 573599 - DNA, 25 bp, Homo sapien
atagccaggctctgtggactacaca

SEQ ID NO: 573600 - DNA, 25 bp, Homo sapien
accaggcattgtgggtggtgtttca

SEQ ID NO: 573601 - DNA, 25 bp, Homo sapien
tggtgtttcacaggcgctggctaaa

SEQ ID NO: 573602 - DNA, 25 bp, Homo sapien
acgcccagccaccttttctatgttt

SEQ ID NO: 573603 - DNA, 25 bp, Homo sapien
ttagatacataaacactcaccactg

SEQ ID NO: 573604 - DNA, 25 bp, Homo sapien
gatacataaacactcaccactgtgt

SEQ ID NO: 573605 - DNA, 25 bp, Homo sapien
taaacactcaccactgtgtcacagt

SEQ ID NO: 573606 - DNA, 25 bp, Homo sapien
aacactcaccactgtgtcacagtca

SEQ ID NO: 573607 - DNA, 25 bp, Homo sapien
gtgtcacagtcacctacagtattca

SEQ ID NO: 573608 - DNA, 25 bp, Homo sapien
gtcacagtcacctacagtattcagt

SEQ ID NO: 573609 - DNA, 25 bp, Homo sapien
tagcctaggtgtgtacaccatctag

SEQ ID NO: 573610 - DNA, 25 bp, Homo sapien
cctaggtgtgtacaccatctaggtt

SEQ ID NO: 573611 - DNA, 25 bp, Homo sapien
gtttttctaactacactctatgatg

SEQ ID NO: 573612 - DNA, 25 bp, Homo sapien
gttcacacaataaaattgcccaacg

SEQ ID NO: 573613 - DNA, 25 bp, Homo sapien
attgcaacctgctgcttgtaacaca

SEQ ID NO: 573614 - DNA, 25 bp, Homo sapien
agcaccttctgtctattgggcctag

SEQ ID NO: 573615 - DNA, 25 bp, Homo sapien
gaggtcacagggtctttaaacttct

SEQ ID NO: 573616 - DNA, 25 bp, Homo sapien
tttgcagcatactataataagcccc

SEQ ID NO: 573617 - DNA, 25 bp, Homo sapien
taataagcccccgtgtatctgtcac

SEQ ID NO: 573618 - DNA, 25 bp, Homo sapien
actcatggccagtctagtttcatct

SEQ ID NO: 573619 - DNA, 25 bp, Homo sapien
cagtctagtttcatctgtacccctc

SEQ ID NO: 573620 - DNA, 25 bp, Homo sapien
atctgtacccctcctgattaatttc

SEQ ID NO: 573621 - DNA, 25 bp, Homo sapien
tttcatccatcaatatttcagtgtg

SEQ ID NO: 573622 - DNA, 25 bp, Homo sapien
cataatcacataacacgttcagcta

SEQ ID NO: 573623 - DNA, 25 bp, Homo sapien
acacgttcagctattaacatcatca

SEQ ID NO: 573624 - DNA, 25 bp, Homo sapien
tatatatgtaaacggctttattgag

SEQ ID NO: 573625 - DNA, 25 bp, Homo sapien
tgtgccagcatcactgcaatcaact

SEQ ID NO: 573626 - DNA, 25 bp, Homo sapien
gtgccagcatcactgcaatcaactt

SEQ ID NO: 573627 - DNA, 25 bp, Homo sapien
tgccagcatcactgcaatcaacttt

SEQ ID NO: 573628 - DNA, 25 bp, Homo sapien
gccagcatcactgcaatcaacttta

SEQ ID NO: 573629 - DNA, 25 bp, Homo sapien
cagcatcactgcaatcaactttaga

SEQ ID NO: 573630 - DNA, 25 bp, Homo sapien
agcatcactgcaatcaactttagaa

SEQ ID NO: 573631 - DNA, 25 bp, Homo sapien
gcatcactgcaatcaactttagaaa

SEQ ID NO: 573632 - DNA, 25 bp, Homo sapien
atcactgcaatcaactttagaaacc

SEQ ID NO: 573633 - DNA, 25 bp, Homo sapien
actgcaatcaactttagaaaccctt

SEQ ID NO: 573634 - DNA, 25 bp, Homo sapien
tgcaatcaactttagaaacccttta

SEQ ID NO: 573635 - DNA, 25 bp, Homo sapien
gaaactatgagctgtgtcacctgac

SEQ ID NO: 573636 - DNA, 25 bp, Homo sapien
ctgtgtcacctgactggttttggag

SEQ ID NO: 573637 - DNA, 25 bp, Homo sapien
aggttctgtccactgctatggagca

SEQ ID NO: 573638 - DNA, 25 bp, Homo sapien
gagcagagttttcccattttcagaa

SEQ ID NO: 573639 - DNA, 25 bp, Homo sapien
gtagcagagggaattcgctcagaag

SEQ ID NO: 573640 - DNA, 25 bp, Homo sapien
aacgtatatgaagtggaggagccca

SEQ ID NO: 573641 - DNA, 25 bp, Homo sapien
tattgctatgtcagcagcaggcagc

SEQ ID NO: 573642 - DNA, 25 bp, Homo sapien
ggcagcaaccctcacaacctttggg

SEQ ID NO: 573643 - DNA, 25 bp, Homo sapien
aacctttgggttgtcgctttgcaat

SEQ ID NO: 573644 - DNA, 25 bp, Homo sapien
gtcgctttgcaatgccatagatcca

SEQ ID NO: 573645 - DNA, 25 bp, Homo sapien
ccatagatccaaccaccttattttt

SEQ ID NO: 573646 - DNA, 25 bp, Homo sapien
atgattgcaaggatgcaggcgcaga

SEQ ID NO: 573647 - DNA, 25 bp, Homo sapien
aggcgcagatgcagatgcagatgca

SEQ ID NO: 573648 - DNA, 25 bp, Homo sapien
ctctcgggcaccacgtgtaaggtga

SEQ ID NO: 573649 - DNA, 25 bp, Homo sapien
accacgtgtaaggtgatgtgcacat

SEQ ID NO: 573650 - DNA, 25 bp, Homo sapien
atgtgcacatatcaagaagtcagag

SEQ ID NO: 573651 - DNA, 25 bp, Homo sapien
aaacattccagatgcatgatccagc

SEQ ID NO: 573652 - DNA, 25 bp, Homo sapien
agatgcatgatccagctgtgtgttt

SEQ ID NO: 573653 - DNA, 25 bp, Homo sapien
gctgtgtgttttcaatccttgggag

SEQ ID NO: 573654 - DNA, 25 bp, Homo sapien
ttgggagggtgccatccacatttta

SEQ ID NO: 573655 - DNA, 25 bp, Homo sapien
acattttaacagtacctgtgcctga

SEQ ID NO: 573656 - DNA, 25 bp, Homo sapien
gtacctgtgcctgagaatttaattt

SEQ ID NO: 573657 - DNA, 25 bp, Homo sapien
tttctttcaggtatcatataattag

SEQ ID NO: 573658 - DNA, 25 bp, Homo sapien
tttcaggtatcatataattaggtct

SEQ ID NO: 573659 - DNA, 25 bp, Homo sapien
tctatcatctctggcgttttcagtt

SEQ ID NO: 573660 - DNA, 25 bp, Homo sapien
atcatctctggcgttttcagttaca

SEQ ID NO: 573661 - DNA, 25 bp, Homo sapien
tcatctctggcgttttcagttacat

SEQ ID NO: 573662 - DNA, 25 bp, Homo sapien
catctctggcgttttcagttacatc

SEQ ID NO: 573663 - DNA, 25 bp, Homo sapien
atctctggcgttttcagttacatct

SEQ ID NO: 573664 - DNA, 25 bp, Homo sapien
tctctggcgttttcagttacatctt

SEQ ID NO: 573665 - DNA, 25 bp, Homo sapien
ttcagttacatctttcacttgtcac

SEQ ID NO: 573666 - DNA, 25 bp, Homo sapien
tcagttacatctttcacttgtcact

SEQ ID NO: 573667 - DNA, 25 bp, Homo sapien
cagttacatctttcacttgtcactg

SEQ ID NO: 573668 - DNA, 25 bp, Homo sapien
ctggtgtgcaaggaagactacgaga

SEQ ID NO: 573669 - DNA, 25 bp, Homo sapien
aaggaagactacgagacagccaagc

SEQ ID NO: 573670 - DNA, 25 bp, Homo sapien
gacagccaagcagaacgatgactca

SEQ ID NO: 573671 - DNA, 25 bp, Homo sapien
acgatgactcagaggctggagctaa

SEQ ID NO: 573672 - DNA, 25 bp, Homo sapien
caagcagctggagacattaaagaat

SEQ ID NO: 573673 - DNA, 25 bp, Homo sapien
taaagaatgcatacaagaactcccc

SEQ ID NO: 573674 - DNA, 25 bp, Homo sapien
gcacgtgagggagcagctgtcctca

SEQ ID NO: 573675 - DNA, 25 bp, Homo sapien
gagcagctgtcctcagagacaggcc

SEQ ID NO: 573676 - DNA, 25 bp, Homo sapien
acaggcctggacatgagggtcgtac

SEQ ID NO: 573677 - DNA, 25 bp, Homo sapien
tgagggtcgtacaggtttggtttca

SEQ ID NO: 573678 - DNA, 25 bp, Homo sapien
gaagggccaaagagaaacgcctgaa

SEQ ID NO: 573679 - DNA, 25 bp, Homo sapien
gtcatggcagagtagctggcttcga

SEQ ID NO: 573680 - DNA, 25 bp, Homo sapien
tggcttcgaagtacagtctttgcag

SEQ ID NO: 573681 - DNA, 25 bp, Homo sapien
gcaggatgcaggaaatcagcttggt

SEQ ID NO: 573682 - DNA, 25 bp, Homo sapien
agcttggtatggaggatacatctct

SEQ ID NO: 573683 - DNA, 25 bp, Homo sapien
atacatctctgagctctggaatgct

SEQ ID NO: 573684 - DNA, 25 bp, Homo sapien
ctggaatgctcacccagaacacaaa

SEQ ID NO: 573685 - DNA, 25 bp, Homo sapien
atgtaccaattctagaaggtgttga

SEQ ID NO: 573686 - DNA, 25 bp, Homo sapien
tggccatctctcagggaatcaccct

SEQ ID NO: 573687 - DNA, 25 bp, Homo sapien
ggaatcaccctaccttccttggagt

SEQ ID NO: 573688 - DNA, 25 bp, Homo sapien
aaaggaaaactccacgctactggct

SEQ ID NO: 573689 - DNA, 25 bp, Homo sapien
aggcctgggccagttacccaagaag

SEQ ID NO: 573690 - DNA, 25 bp, Homo sapien
gtaccaggtggagaagcttgacttt

SEQ ID NO: 573691 - DNA, 25 bp, Homo sapien
gaagcttgacttttctatccttgat

SEQ ID NO: 573692 - DNA, 25 bp, Homo sapien
ttgacttttctatccttgatcattt

SEQ ID NO: 573693 - DNA, 25 bp, Homo sapien
attttattccctcccaagaagtcag

SEQ ID NO: 573694 - DNA, 25 bp, Homo sapien
ttccctcccaagaagtcagtcacag

SEQ ID NO: 573695 - DNA, 25 bp, Homo sapien
gacggtctgaggaagtacctcggtc

SEQ ID NO: 573696 - DNA, 25 bp, Homo sapien
ggaagtacctcggtcactacaatat

SEQ ID NO: 573697 - DNA, 25 bp, Homo sapien
cggtcactacaatatttttgcacat

SEQ ID NO: 573698 - DNA, 25 bp, Homo sapien
gggaggaaagagacacaaacgtatt

SEQ ID NO: 573699 - DNA, 25 bp, Homo sapien
aacgtatttaacacagatttgctgg

SEQ ID NO: 573700 - DNA, 25 bp, Homo sapien
gtatgagtgagtgcattttgatttt

SEQ ID NO: 573701 - DNA, 25 bp, Homo sapien
ttactgtcctccgaggaccttgatc

SEQ ID NO: 573702 - DNA, 25 bp, Homo sapien
ttgatctcccttatccaaccagtaa

SEQ ID NO: 573703 - DNA, 25 bp, Homo sapien
aaccagtaacagtctcagggcccag

SEQ ID NO: 573704 - DNA, 25 bp, Homo sapien
tattgtgcctttgcaagaaagaaag

SEQ ID NO: 573705 - DNA, 25 bp, Homo sapien
gagactagaatcatcctaatttata

SEQ ID NO: 573706 - DNA, 25 bp, Homo sapien
catgtgcttctgatgacaaaaggct

SEQ ID NO: 573707 - DNA, 25 bp, Homo sapien
gatgacaaaaggctgatccaactca

SEQ ID NO: 573708 - DNA, 25 bp, Homo sapien
tgatccaactcagatgggttcaagc

SEQ ID NO: 573709 - DNA, 25 bp, Homo sapien
aaattccatggagtggctggcttca

SEQ ID NO: 573710 - DNA, 25 bp, Homo sapien
catggagtggctggcttcaggttca

SEQ ID NO: 573711 - DNA, 25 bp, Homo sapien
gggctcattgaattttcacaaaaaa

SEQ ID NO: 573712 - DNA, 25 bp, Homo sapien
tattgtctacataggttttattatt

SEQ ID NO: 573713 - DNA, 25 bp, Homo sapien
tgctttgctcaattttctttccatg

SEQ ID NO: 573714 - DNA, 25 bp, Homo sapien
tttatttctttcatatgccctgatg

SEQ ID NO: 573715 - DNA, 25 bp, Homo sapien
tttctttcatatgccctgatgtctt

SEQ ID NO: 573716 - DNA, 25 bp, Homo sapien
gacaaatctttcatttataccttct

SEQ ID NO: 573717 - DNA, 25 bp, Homo sapien
ataccttctgatttttgttgtgcct

SEQ ID NO: 573718 - DNA, 25 bp, Homo sapien
tctgatttttgttgtgcctttgttt

SEQ ID NO: 573719 - DNA, 25 bp, Homo sapien
gtttcatcttgatttggaaggcctt

SEQ ID NO: 573720 - DNA, 25 bp, Homo sapien
ttggaaggccttgcatgattatgaa

SEQ ID NO: 573721 - DNA, 25 bp, Homo sapien
ggccttgcatgattatgaagtacta

SEQ ID NO: 573722 - DNA, 25 bp, Homo sapien
gaagtactaagtttcatttaggaat

SEQ ID NO: 573723 - DNA, 25 bp, Homo sapien
aacacctaagattatagaatcccag

SEQ ID NO: 573724 - DNA, 25 bp, Homo sapien
ttatagaatcccagaggcctcctca

SEQ ID NO: 573725 - DNA, 25 bp, Homo sapien
agaggcctcctcattaggtgatcca

SEQ ID NO: 573726 - DNA, 25 bp, Homo sapien
ggcctcctcattaggtgatccagga

SEQ ID NO: 573727 - DNA, 25 bp, Homo sapien
cctcattaggtgatccaggagtatt

SEQ ID NO: 573728 - DNA, 25 bp, Homo sapien
caggagtatttgtttgatgatcggc

SEQ ID NO: 573729 - DNA, 25 bp, Homo sapien
tgatgatcggcattttgttcactgc

SEQ ID NO: 573730 - DNA, 25 bp, Homo sapien
attttgttcactgctaatagggtaa

SEQ ID NO: 573731 - DNA, 25 bp, Homo sapien
tgttcactgctaatagggtaataca

SEQ ID NO: 573732 - DNA, 25 bp, Homo sapien
atagggtaatacagaggtcacagag

SEQ ID NO: 573733 - DNA, 25 bp, Homo sapien
cagaggtcacagagtatggaaatgg

SEQ ID NO: 573734 - DNA, 25 bp, Homo sapien
cactgggcaagaatgacatgaaggc

SEQ ID NO: 573735 - DNA, 25 bp, Homo sapien
attggcctgcagatggcccttgacc

SEQ ID NO: 573736 - DNA, 25 bp, Homo sapien
tgcagatggcccttgacctcctggc

SEQ ID NO: 573737 - DNA, 25 bp, Homo sapien
gaaagactccatcacggggctgcag

SEQ ID NO: 573738 - DNA, 25 bp, Homo sapien
gcctgggcggcctgactggagcaag

SEQ ID NO: 573739 - DNA, 25 bp, Homo sapien
aagggcaaggtgcaggtcttcttct

SEQ ID NO: 573740 - DNA, 25 bp, Homo sapien
aaggtgcaggtcttcttctgtggct

SEQ ID NO: 573741 - DNA, 25 bp, Homo sapien
tggctccccagctctggccaaggtg

SEQ ID NO: 573742 - DNA, 25 bp, Homo sapien
ggccattgtgagaagttcggcttca

SEQ ID NO: 573743 - DNA, 25 bp, Homo sapien
agttcggcttcagatttttccaaga

SEQ ID NO: 573744 - DNA, 25 bp, Homo sapien
ccaagagaatttctagcctcacctc

SEQ ID NO: 573745 - DNA, 25 bp, Homo sapien
gccaggacctatttttattgtagac

SEQ ID NO: 573746 - DNA, 25 bp, Homo sapien
gaaagctagtactattcctgcaaaa

SEQ ID NO: 573747 - DNA, 25 bp, Homo sapien
aaatgccaaagccaagatgcgatga

SEQ ID NO: 573748 - DNA, 25 bp, Homo sapien
gtgaaatttcactacagatttgttg

SEQ ID NO: 573749 - DNA, 25 bp, Homo sapien
ctacagatttgttgatggaagggcc

SEQ ID NO: 573750 - DNA, 25 bp, Homo sapien
ggtcctgcttttgtatggcaaagtc

SEQ ID NO: 573751 - DNA, 25 bp, Homo sapien
caaagtcacatatagcaagtattct

SEQ ID NO: 573752 - DNA, 25 bp, Homo sapien
gcaagtattcttttctacactgttc

SEQ ID NO: 573753 - DNA, 25 bp, Homo sapien
ggaattccctttgcaaagaccatgt

SEQ ID NO: 573754 - DNA, 25 bp, Homo sapien
ccctttgcaaagaccatgtatccca

SEQ ID NO: 573755 - DNA, 25 bp, Homo sapien
catgtatcccaattcttgcctagat

SEQ ID NO: 573756 - DNA, 25 bp, Homo sapien
tgagcacaggaaaaatcacaaagca

SEQ ID NO: 573757 - DNA, 25 bp, Homo sapien
aagagataatcctttcagtggcatg

SEQ ID NO: 573758 - DNA, 25 bp, Homo sapien
gataatcctttcagtggcatgaaca

SEQ ID NO: 573759 - DNA, 25 bp, Homo sapien
cagtggcatgaacaccatagtttgt

SEQ ID NO: 573760 - DNA, 25 bp, Homo sapien
gaacaccatagtttgtgacatcact

SEQ ID NO: 573761 - DNA, 25 bp, Homo sapien
gtgacatcactggtcattaatgatt

SEQ ID NO: 573762 - DNA, 25 bp, Homo sapien
gaagcagtgtctcaactatgtttct

SEQ ID NO: 573763 - DNA, 25 bp, Homo sapien
gtgtctcaactatgtttctgttaca

SEQ ID NO: 573764 - DNA, 25 bp, Homo sapien
tcctaacttcaatgtcaaatccaag

SEQ ID NO: 573765 - DNA, 25 bp, Homo sapien
ttcaatgtcaaatccaagagcctga

SEQ ID NO: 573766 - DNA, 25 bp, Homo sapien
gtcaaatccaagagcctgaaaataa

SEQ ID NO: 573767 - DNA, 25 bp, Homo sapien
catgtattgatggtgagtagagaac

SEQ ID NO: 573768 - DNA, 25 bp, Homo sapien
caatgacacaatctctagagagaca

SEQ ID NO: 573769 - DNA, 25 bp, Homo sapien
tctagagagacataggtgttcggcc

SEQ ID NO: 573770 - DNA, 25 bp, Homo sapien
agagacataggtgttcggcctggct

SEQ ID NO: 573771 - DNA, 25 bp, Homo sapien
gacataggtgttcggcctggctcaa

SEQ ID NO: 573772 - DNA, 25 bp, Homo sapien
taggtgttcggcctggctcaatcac

SEQ ID NO: 573773 - DNA, 25 bp, Homo sapien
tgttcggcctggctcaatcactagc

SEQ ID NO: 573774 - DNA, 25 bp, Homo sapien
gcctggctcaatcactagccttata

SEQ ID NO: 573775 - DNA, 25 bp, Homo sapien
gctcaatcactagccttatagtctc

SEQ ID NO: 573776 - DNA, 25 bp, Homo sapien
atcactagccttatagtctcacagg

SEQ ID NO: 573777 - DNA, 25 bp, Homo sapien
tagctaattattaccacatcatgga

SEQ ID NO: 573778 - DNA, 25 bp, Homo sapien
tggccatggaaaaccgttcggcatt

SEQ ID NO: 573779 - DNA, 25 bp, Homo sapien
tcttggaaacggaagcatgtaccct

SEQ ID NO: 573780 - DNA, 25 bp, Homo sapien
aagcatgtaccctgtgccccagcga

SEQ ID NO: 573781 - DNA, 25 bp, Homo sapien
cagcgatgccactctgtgcatattt

SEQ ID NO: 573782 - DNA, 25 bp, Homo sapien
atatgtctccagaaagattggtaca

SEQ ID NO: 573783 - DNA, 25 bp, Homo sapien
ggtacataagtgttcttagcagttt

SEQ ID NO: 573784 - DNA, 25 bp, Homo sapien
ttagcagttttcttcacgagagccc

SEQ ID NO: 573785 - DNA, 25 bp, Homo sapien
gcccgcacgtccatcaacaggagga

SEQ ID NO: 573786 - DNA, 25 bp, Homo sapien
aaataaccatagatccacgcgcaac

SEQ ID NO: 573787 - DNA, 25 bp, Homo sapien
cacgcgcaaccgagtactgtttaga

SEQ ID NO: 573788 - DNA, 25 bp, Homo sapien
aaatgaaaaggagcggtcgcctggt

SEQ ID NO: 573789 - DNA, 25 bp, Homo sapien
ttgtgccgcagtccttcccgggaaa

SEQ ID NO: 573790 - DNA, 25 bp, Homo sapien
tgtgccgcagtccttcccgggaaac

SEQ ID NO: 573791 - DNA, 25 bp, Homo sapien
tgccgcagtccttcccgggaaacct

SEQ ID NO: 573792 - DNA, 25 bp, Homo sapien
gccgcagtccttcccgggaaacctg

SEQ ID NO: 573793 - DNA, 25 bp, Homo sapien
tgcccggagttcccgcccccagaca

SEQ ID NO: 573794 - DNA, 25 bp, Homo sapien
gcccggagttcccgcccccagacag

SEQ ID NO: 573795 - DNA, 25 bp, Homo sapien
ccccagacagaaccctgggttgctg

SEQ ID NO: 573796 - DNA, 25 bp, Homo sapien
cccagacagaaccctgggttgctgg

SEQ ID NO: 573797 - DNA, 25 bp, Homo sapien
cagacagaaccctgggttgctgggc

SEQ ID NO: 573798 - DNA, 25 bp, Homo sapien
agacagaaccctgggttgctgggca

SEQ ID NO: 573799 - DNA, 25 bp, Homo sapien
gacagaaccctgggttgctgggcaa

SEQ ID NO: 573800 - DNA, 25 bp, Homo sapien
gatattcattaaatttgtagaccaa

SEQ ID NO: 573801 - DNA, 25 bp, Homo sapien
atttgtagaccaatatagtctttca

SEQ ID NO: 573802 - DNA, 25 bp, Homo sapien
tagtgaacacaatatgtatctctgt

SEQ ID NO: 573803 - DNA, 25 bp, Homo sapien
caatatgtatctctgttttttaaga

SEQ ID NO: 573804 - DNA, 25 bp, Homo sapien
cttcagtgtggaggcgttgcacatc

SEQ ID NO: 573805 - DNA, 25 bp, Homo sapien
gaggcgttgcacatcttttgctaaa

SEQ ID NO: 573806 - DNA, 25 bp, Homo sapien
cacatcttttgctaaatctatttca

SEQ ID NO: 573807 - DNA, 25 bp, Homo sapien
tctatttcaagatatttcatgtttt

SEQ ID NO: 573808 - DNA, 25 bp, Homo sapien
ttcatgttttgatcttaccgtaaat

SEQ ID NO: 573809 - DNA, 25 bp, Homo sapien
agtttttgctgcttgtatatagaag

SEQ ID NO: 573810 - DNA, 25 bp, Homo sapien
tgatttttgtttgttaactggtatc

SEQ ID NO: 573811 - DNA, 25 bp, Homo sapien
agaaaggatcgtgtgctgcatctcc

SEQ ID NO: 573812 - DNA, 25 bp, Homo sapien
gaaaggatcgtgtgctgcatctcct

SEQ ID NO: 573813 - DNA, 25 bp, Homo sapien
tccttggcgcctcattgctgtaatt

SEQ ID NO: 573814 - DNA, 25 bp, Homo sapien
cttggcgcctcattgctgtaatttt

SEQ ID NO: 573815 - DNA, 25 bp, Homo sapien
tggcgcctcattgctgtaattttgg

SEQ ID NO: 573816 - DNA, 25 bp, Homo sapien
tgctgtaattttgggaatcctatgc

SEQ ID NO: 573817 - DNA, 25 bp, Homo sapien
aattttgggaatcctatgcttggta

SEQ ID NO: 573818 - DNA, 25 bp, Homo sapien
ttgggaatcctatgcttggtaatac

SEQ ID NO: 573819 - DNA, 25 bp, Homo sapien
gggaatcctatgcttggtaatactg

SEQ ID NO: 573820 - DNA, 25 bp, Homo sapien
taatactggtgatagctgtggtcct

SEQ ID NO: 573821 - DNA, 25 bp, Homo sapien
atactggtgatagctgtggtcctgg

SEQ ID NO: 573822 - DNA, 25 bp, Homo sapien
aaaacctcctgaggcatttcttgcc

SEQ ID NO: 573823 - DNA, 25 bp, Homo sapien
tgaggcatttcttgcccagctgggt

SEQ ID NO: 573824 - DNA, 25 bp, Homo sapien
tgcccagctgggtccaacacttgtt

SEQ ID NO: 573825 - DNA, 25 bp, Homo sapien
taagtattaaatgctgccacatgtc

SEQ ID NO: 573826 - DNA, 25 bp, Homo sapien
tgccacatgtcaggccttatgctaa

SEQ ID NO: 573827 - DNA, 25 bp, Homo sapien
gggtgagtaattccatggtgcacta

SEQ ID NO: 573828 - DNA, 25 bp, Homo sapien
gtgcactagatatgcagggctgcta

SEQ ID NO: 573829 - DNA, 25 bp, Homo sapien
agggctgctaatctcaaggagcttc

SEQ ID NO: 573830 - DNA, 25 bp, Homo sapien
ggtgggcatttcaaccaactcagtc

SEQ ID NO: 573831 - DNA, 25 bp, Homo sapien
aaccaactcagtcaaggaacccatg

SEQ ID NO: 573832 - DNA, 25 bp, Homo sapien
aagtcatttcaactcttacctcatc

SEQ ID NO: 573833 - DNA, 25 bp, Homo sapien
cccttgtggtgggtcttactgaggc

SEQ ID NO: 573834 - DNA, 25 bp, Homo sapien
tcttactgaggctccaggcccaaga

SEQ ID NO: 573835 - DNA, 25 bp, Homo sapien
gcccaagaggcagcgctgtggccat

SEQ ID NO: 573836 - DNA, 25 bp, Homo sapien
agcgctgtggccatgtgacaatcag

SEQ ID NO: 573837 - DNA, 25 bp, Homo sapien
gacaatcagagttcaggcaggcgac

SEQ ID NO: 573838 - DNA, 25 bp, Homo sapien
ttcaggcaggcgactgagacagcaa

SEQ ID NO: 573839 - DNA, 25 bp, Homo sapien
gaggaactgtcagggattccctccc

SEQ ID NO: 573840 - DNA, 25 bp, Homo sapien
tcagggattccctcccttctcgtaa

SEQ ID NO: 573841 - DNA, 25 bp, Homo sapien
tcgtaactcctacctctttagagat

SEQ ID NO: 573842 - DNA, 25 bp, Homo sapien
tacctctttagagatcaggaaatgg

SEQ ID NO: 573843 - DNA, 25 bp, Homo sapien
gaggaaagcagtcaacccagagcaa

SEQ ID NO: 573844 - DNA, 25 bp, Homo sapien
gtaaaagtttaagaagtactgctct

SEQ ID NO: 573845 - DNA, 25 bp, Homo sapien
gaagtactgctctaaataattttat

SEQ ID NO: 573846 - DNA, 25 bp, Homo sapien
aaatatgccttattagatgaggaaa

SEQ ID NO: 573847 - DNA, 25 bp, Homo sapien
atttttatacaagccttttgctgta

SEQ ID NO: 573848 - DNA, 25 bp, Homo sapien
atacaagccttttgctgtagaacaa

SEQ ID NO: 573849 - DNA, 25 bp, Homo sapien
aagccttttgctgtagaacaatggg

SEQ ID NO: 573850 - DNA, 25 bp, Homo sapien
ccttttgctgtagaacaatgggaca

SEQ ID NO: 573851 - DNA, 25 bp, Homo sapien
ggtagctcacaaaataagggaacat

SEQ ID NO: 573852 - DNA, 25 bp, Homo sapien
attcttctgtacaggtccagataga

SEQ ID NO: 573853 - DNA, 25 bp, Homo sapien
tcttctgtacaggtccagatagatg

SEQ ID NO: 573854 - DNA, 25 bp, Homo sapien
ccagatagatgagctatgtttcctt

SEQ ID NO: 573855 - DNA, 25 bp, Homo sapien
ctttccttttccattgggtgagctg

SEQ ID NO: 573856 - DNA, 25 bp, Homo sapien
tttccattgggtgagctgcttcctt

SEQ ID NO: 573857 - DNA, 25 bp, Homo sapien
tgagctgcttccttcagcttcttct

SEQ ID NO: 573858 - DNA, 25 bp, Homo sapien
cttcttctcaaagctgatacacaca

SEQ ID NO: 573859 - DNA, 25 bp, Homo sapien
caaagctgatacacacaaggagaca

SEQ ID NO: 573860 - DNA, 25 bp, Homo sapien
cacacaaggagacaactatcccatg

SEQ ID NO: 573861 - DNA, 25 bp, Homo sapien
ttcctgacatgggactactccagtc

SEQ ID NO: 573862 - DNA, 25 bp, Homo sapien
gacatgggactactccagtcccttt

SEQ ID NO: 573863 - DNA, 25 bp, Homo sapien
ctggacagctctgctagagaagcag

SEQ ID NO: 573864 - DNA, 25 bp, Homo sapien
cagggagaggctccaatgactttcc

SEQ ID NO: 573865 - DNA, 25 bp, Homo sapien
aatgactttcccgacctggctttgc

SEQ ID NO: 573866 - DNA, 25 bp, Homo sapien
ctggagcccccctcggagtttggcg

SEQ ID NO: 573867 - DNA, 25 bp, Homo sapien
tcggagtttggcgacctccagttct

SEQ ID NO: 573868 - DNA, 25 bp, Homo sapien
agtttggcgacctccagttctgcct

SEQ ID NO: 573869 - DNA, 25 bp, Homo sapien
ttggcgacctccagttctgcctcag

SEQ ID NO: 573870 - DNA, 25 bp, Homo sapien
tgcctcagctacaacgactacctga

SEQ ID NO: 573871 - DNA, 25 bp, Homo sapien
tcagctacaacgactacctgagccg

SEQ ID NO: 573872 - DNA, 25 bp, Homo sapien
acctgagccgcctgacggtggttgt

SEQ ID NO: 573873 - DNA, 25 bp, Homo sapien
tgacggtggttgtgctgcgtgccaa

SEQ ID NO: 573874 - DNA, 25 bp, Homo sapien
gttgtgctgcgtgccaagggcctcc

SEQ ID NO: 573875 - DNA, 25 bp, Homo sapien
gtgccaagggcctccggctccagga

SEQ ID NO: 573876 - DNA, 25 bp, Homo sapien
ccggctccaggaggacagaggcatt

SEQ ID NO: 573877 - DNA, 25 bp, Homo sapien
tacatcctctttccacgttatgcta

SEQ ID NO: 573878 - DNA, 25 bp, Homo sapien
tcctctttccacgttatgctatttt

SEQ ID NO: 573879 - DNA, 25 bp, Homo sapien
ttccacgttatgctattttacttca

SEQ ID NO: 573880 - DNA, 25 bp, Homo sapien
aacagaacagtacctaattatgatt

SEQ ID NO: 573881 - DNA, 25 bp, Homo sapien
cagtacctaattatgatttcaagta

SEQ ID NO: 573882 - DNA, 25 bp, Homo sapien
gtatatatattttaaccgtatctta

SEQ ID NO: 573883 - DNA, 25 bp, Homo sapien
aaccgtatcttaatttgtaaacatg

SEQ ID NO: 573884 - DNA, 25 bp, Homo sapien
aaaaataatgtctccagtctagtct

SEQ ID NO: 573885 - DNA, 25 bp, Homo sapien
ataatgtctccagtctagtctatac

SEQ ID NO: 573886 - DNA, 25 bp, Homo sapien
gtctccagtctagtctatactgctt

SEQ ID NO: 573887 - DNA, 25 bp, Homo sapien
tccagtctagtctatactgctttct

SEQ ID NO: 573888 - DNA, 25 bp, Homo sapien
agagctgacacccatgttagcagaa

SEQ ID NO: 573889 - DNA, 25 bp, Homo sapien
acacccatgttagcagaagttagtg

SEQ ID NO: 573890 - DNA, 25 bp, Homo sapien
gaagttagtggaacccagttctgtt

SEQ ID NO: 573891 - DNA, 25 bp, Homo sapien
gtggaacccagttctgttaactcta

SEQ ID NO: 573892 - DNA, 25 bp, Homo sapien
acccagttctgttaactctaaccat

SEQ ID NO: 573893 - DNA, 25 bp, Homo sapien
gttctgttaactctaaccattctct

SEQ ID NO: 573894 - DNA, 25 bp, Homo sapien
tctaaccattctctaatccaaaagt

SEQ ID NO: 573895 - DNA, 25 bp, Homo sapien
tatttagaagctcctcagatgattc

SEQ ID NO: 573896 - DNA, 25 bp, Homo sapien
gaagctcctcagatgattctagttt

SEQ ID NO: 573897 - DNA, 25 bp, Homo sapien
agctcctcagatgattctagttttc

SEQ ID NO: 573898 - DNA, 25 bp, Homo sapien
cagatgattctagttttcagccatg

SEQ ID NO: 573899 - DNA, 25 bp, Homo sapien
agttctaatatatcttcaggccttt

SEQ ID NO: 573900 - DNA, 25 bp, Homo sapien
ctaatatatcttcaggcctttgctc

SEQ ID NO: 573901 - DNA, 25 bp, Homo sapien
ttcaggcctttgctcaactggcgtt

SEQ ID NO: 573902 - DNA, 25 bp, Homo sapien
cctttgctcaactggcgttctctct

SEQ ID NO: 573903 - DNA, 25 bp, Homo sapien
caccccactctgtaacctagtttat

SEQ ID NO: 573904 - DNA, 25 bp, Homo sapien
tatccgtaatacttataatccctaa

SEQ ID NO: 573905 - DNA, 25 bp, Homo sapien
tgtgtctcctcccattagaatgtaa

SEQ ID NO: 573906 - DNA, 25 bp, Homo sapien
gctccttaagtttaagcactttttg

SEQ ID NO: 573907 - DNA, 25 bp, Homo sapien
tttgttcactgtatccctaacacct

SEQ ID NO: 573908 - DNA, 25 bp, Homo sapien
tcactgtatccctaacacctagaat

SEQ ID NO: 573909 - DNA, 25 bp, Homo sapien
acctagaatagtgcttgtcacacag

SEQ ID NO: 573910 - DNA, 25 bp, Homo sapien
gatatgtagcttatgtttcacctta

SEQ ID NO: 573911 - DNA, 25 bp, Homo sapien
gtttcaccttaaatgtttctgcctg

SEQ ID NO: 573912 - DNA, 25 bp, Homo sapien
tcaccttaaatgtttctgcctggct

SEQ ID NO: 573913 - DNA, 25 bp, Homo sapien
tctgcctggctattattaactggag

SEQ ID NO: 573914 - DNA, 25 bp, Homo sapien
ctggctattattaactggagtgcaa

SEQ ID NO: 573915 - DNA, 25 bp, Homo sapien
ctttatggtaaaatctatgttcagt

SEQ ID NO: 573916 - DNA, 25 bp, Homo sapien
aatctatgttcagtgaaatgcacaa

SEQ ID NO: 573917 - DNA, 25 bp, Homo sapien
tgcacaagacttaggtatgccatta

SEQ ID NO: 573918 - DNA, 25 bp, Homo sapien
gtatgccattaataggttttgacga

SEQ ID NO: 573919 - DNA, 25 bp, Homo sapien
gttttgacgaatagacaaaccttgt

SEQ ID NO: 573920 - DNA, 25 bp, Homo sapien
caaaccttgtgtctgaaactgtaat

SEQ ID NO: 573921 - DNA, 25 bp, Homo sapien
ttctgctcgccctccatgggttgta

SEQ ID NO: 573922 - DNA, 25 bp, Homo sapien
tgcctaaccagtcccagttggatga

SEQ ID NO: 573923 - DNA, 25 bp, Homo sapien
tcacctgtcttctgcatgggtctcg

SEQ ID NO: 573924 - DNA, 25 bp, Homo sapien
tgtcttctgcatgggtctcgctggg

SEQ ID NO: 573925 - DNA, 25 bp, Homo sapien
gtttatttggccctcttgaccctgt

SEQ ID NO: 573926 - DNA, 25 bp, Homo sapien
atttcatccaaatagctgctatctt

SEQ ID NO: 573927 - DNA, 25 bp, Homo sapien
ttttttgtacatctttgcctaaatt

SEQ ID NO: 573928 - DNA, 25 bp, Homo sapien
gtacatctttgcctaaattataata

SEQ ID NO: 573929 - DNA, 25 bp, Homo sapien
gaacaacgatctaaatttgcatagc

SEQ ID NO: 573930 - DNA, 25 bp, Homo sapien
atttgcatagcaagtggaccctata

SEQ ID NO: 573931 - DNA, 25 bp, Homo sapien
gcaagtggaccctatatttggaatt

SEQ ID NO: 573932 - DNA, 25 bp, Homo sapien
gaagacagcatcatacgctgccgaa

SEQ ID NO: 573933 - DNA, 25 bp, Homo sapien
gcatcatacgctgccgaaatcgtaa

SEQ ID NO: 573934 - DNA, 25 bp, Homo sapien
aatcgtaaacggtgctgtgttccta

SEQ ID NO: 573935 - DNA, 25 bp, Homo sapien
tgctgtgttcctagtcgttatttaa

SEQ ID NO: 573936 - DNA, 25 bp, Homo sapien
gtcgttatttaacaatccaaccagt

SEQ ID NO: 573937 - DNA, 25 bp, Homo sapien
acaatccaaccagtaacaattcatg

SEQ ID NO: 573938 - DNA, 25 bp, Homo sapien
aattcatggaatccttggctggacc

SEQ ID NO: 573939 - DNA, 25 bp, Homo sapien
ttggctggaccactcctcagatgtc

SEQ ID NO: 573940 - DNA, 25 bp, Homo sapien
gatgtccacaacagctccaaaaatg

SEQ ID NO: 573941 - DNA, 25 bp, Homo sapien
tgtttcaggttgcttagggtccaca

SEQ ID NO: 573942 - DNA, 25 bp, Homo sapien
atggatggacactgccggttgttgt

SEQ ID NO: 573943 - DNA, 25 bp, Homo sapien
catttacatgctcttctttattgtt

SEQ ID NO: 573944 - DNA, 25 bp, Homo sapien
ttacatgctcttctttattgttggc

SEQ ID NO: 573945 - DNA, 25 bp, Homo sapien
acatgctcttctttattgttggcag

SEQ ID NO: 573946 - DNA, 25 bp, Homo sapien
atgctcttctttattgttggcagta

SEQ ID NO: 573947 - DNA, 25 bp, Homo sapien
gctcttctttattgttggcagtaaa

SEQ ID NO: 573948 - DNA, 25 bp, Homo sapien
tcttctttattgttggcagtaaaaa

SEQ ID NO: 573949 - DNA, 25 bp, Homo sapien
aaataagtcttttgtaagcagtgta

SEQ ID NO: 573950 - DNA, 25 bp, Homo sapien
gtcttttgtaagcagtgtatatcag

SEQ ID NO: 573951 - DNA, 25 bp, Homo sapien
ttgtaagcagtgtatatcagaatgt

SEQ ID NO: 573952 - DNA, 25 bp, Homo sapien
gttttacctggaaatgatgggatag

SEQ ID NO: 573953 - DNA, 25 bp, Homo sapien
ccaataaaatgagggaaccagacat

SEQ ID NO: 573954 - DNA, 25 bp, Homo sapien
tccccgcgaggcaaggacagcctct

SEQ ID NO: 573955 - DNA, 25 bp, Homo sapien
acggtatgggcttgcctaggcctca

SEQ ID NO: 573956 - DNA, 25 bp, Homo sapien
tatgggcttgcctaggcctcagtgt

SEQ ID NO: 573957 - DNA, 25 bp, Homo sapien
gcttgcctaggcctcagtgtcttaa

SEQ ID NO: 573958 - DNA, 25 bp, Homo sapien
taaggcagtgactacccctgctcag

SEQ ID NO: 573959 - DNA, 25 bp, Homo sapien
aggcagtgactacccctgctcagaa

SEQ ID NO: 573960 - DNA, 25 bp, Homo sapien
agtgactacccctgctcagaatgca

SEQ ID NO: 573961 - DNA, 25 bp, Homo sapien
tgactacccctgctcagaatgcaag

SEQ ID NO: 573962 - DNA, 25 bp, Homo sapien
actacccctgctcagaatgcaaggg

SEQ ID NO: 573963 - DNA, 25 bp, Homo sapien
gagaatctaaatgtagtcctttgaa

SEQ ID NO: 573964 - DNA, 25 bp, Homo sapien
aaatgtagtcctttgaaaatgtcac

SEQ ID NO: 573965 - DNA, 25 bp, Homo sapien
aggctacccagaagacacgtgtatg

SEQ ID NO: 573966 - DNA, 25 bp, Homo sapien
cagaagacacgtgtatgtgccattt

SEQ ID NO: 573967 - DNA, 25 bp, Homo sapien
cacccacagacatattccattcaaa

SEQ ID NO: 573968 - DNA, 25 bp, Homo sapien
gttcctagaatttcctatattgtgg

SEQ ID NO: 573969 - DNA, 25 bp, Homo sapien
gaatttcctatattgtggtgttttc

SEQ ID NO: 573970 - DNA, 25 bp, Homo sapien
ctggattttaagtactatctagtgc

SEQ ID NO: 573971 - DNA, 25 bp, Homo sapien
gctagggatgtcacttaggctgctt

SEQ ID NO: 573972 - DNA, 25 bp, Homo sapien
ggatgtcacttaggctgcttttggc

SEQ ID NO: 573973 - DNA, 25 bp, Homo sapien
tttggctgcaagtaatcaattacct

SEQ ID NO: 573974 - DNA, 25 bp, Homo sapien
aattacctcaatcaggatctcagca

SEQ ID NO: 573975 - DNA, 25 bp, Homo sapien
gaaacagcagactcagattaggatt

SEQ ID NO: 573976 - DNA, 25 bp, Homo sapien
aggctggaggacttagagtttgacc

SEQ ID NO: 573977 - DNA, 25 bp, Homo sapien
aggacttagagtttgaccatgagca

SEQ ID NO: 573978 - DNA, 25 bp, Homo sapien
gagtttgaccatgagcagtcccgac

SEQ ID NO: 573979 - DNA, 25 bp, Homo sapien
ttgaccatgagcagtcccgacgcag

SEQ ID NO: 573980 - DNA, 25 bp, Homo sapien
ggaaagagcaagatcggcagcccta

SEQ ID NO: 573981 - DNA, 25 bp, Homo sapien
aaagagcaagatcggcagccctaaa

SEQ ID NO: 573982 - DNA, 25 bp, Homo sapien
gtaccgccacagtgctcacaactag

SEQ ID NO: 573983 - DNA, 25 bp, Homo sapien
acagtgctcacaactagccgggagg

SEQ ID NO: 573984 - DNA, 25 bp, Homo sapien
gtgctcacaactagccgggaggcaa

SEQ ID NO: 573985 - DNA, 25 bp, Homo sapien
tgcccaactgtcagtcctgacacag

SEQ ID NO: 573986 - DNA, 25 bp, Homo sapien
aactgtcagtcctgacacagctctc

SEQ ID NO: 573987 - DNA, 25 bp, Homo sapien
gtgatgcttttcctaactccctatt

SEQ ID NO: 573988 - DNA, 25 bp, Homo sapien
ctaactccctattcagccagtgaag

SEQ ID NO: 573989 - DNA, 25 bp, Homo sapien
tattcagccagtgaagtgctccctg

SEQ ID NO: 573990 - DNA, 25 bp, Homo sapien
gaagtgctccctgcgttcccatgtg

SEQ ID NO: 573991 - DNA, 25 bp, Homo sapien
gagctgttttaatttatccgttaat

SEQ ID NO: 573992 - DNA, 25 bp, Homo sapien
atccgttaatgtacatgtcttcccc

SEQ ID NO: 573993 - DNA, 25 bp, Homo sapien
taatgtacatgtcttccccactaga

SEQ ID NO: 573994 - DNA, 25 bp, Homo sapien
cccactagacttttgctccttaaag

SEQ ID NO: 573995 - DNA, 25 bp, Homo sapien
tgctccttaaagtatctccttcatc

SEQ ID NO: 573996 - DNA, 25 bp, Homo sapien
tgctttgcataacctaacagagttc

SEQ ID NO: 573997 - DNA, 25 bp, Homo sapien
gagttcaacacataggagtgtctta

SEQ ID NO: 573998 - DNA, 25 bp, Homo sapien
gaggagggcgaatcaaatccatcat

SEQ ID NO: 573999 - DNA, 25 bp, Homo sapien
ggagggcgaatcaaatccatcatct

SEQ ID NO: 574000 - DNA, 25 bp, Homo sapien
ttacgccagacttcagccctgcggg

SEQ ID NO: 574001 - DNA, 25 bp, Homo sapien
agacttcagccctgcgggagctgct

SEQ ID NO: 574002 - DNA, 25 bp, Homo sapien
ccccgtgtggagaacgtgacagatg

SEQ ID NO: 574003 - DNA, 25 bp, Homo sapien
tgaaggttgggctgacagacacacg

SEQ ID NO: 574004 - DNA, 25 bp, Homo sapien
ggttgggctgacagacacacggcct

SEQ ID NO: 574005 - DNA, 25 bp, Homo sapien
ccacagcatcgagccaagtcattta

SEQ ID NO: 574006 - DNA, 25 bp, Homo sapien
gcatcgagccaagtcatttaaaaag

SEQ ID NO: 574007 - DNA, 25 bp, Homo sapien
ttaaaaaggatttaggccactgcct

SEQ ID NO: 574008 - DNA, 25 bp, Homo sapien
gatttaggccactgcctttttctga

SEQ ID NO: 574009 - DNA, 25 bp, Homo sapien
gtttggtgtccccacagacgagttt

SEQ ID NO: 574010 - DNA, 25 bp, Homo sapien
acagacgagtttgccgtgagcattc

SEQ ID NO: 574011 - DNA, 25 bp, Homo sapien
gagcattcctggatgtggcaacctc

SEQ ID NO: 574012 - DNA, 25 bp, Homo sapien
tgtggcaacctcagtctcaagaaga

SEQ ID NO: 574013 - DNA, 25 bp, Homo sapien
tcccatgcagagacagatccaggta

SEQ ID NO: 574014 - DNA, 25 bp, Homo sapien
gatccaggtaagaaaccagctcatg

SEQ ID NO: 574015 - DNA, 25 bp, Homo sapien
aaccagctcatgtgtgacaaactca

SEQ ID NO: 574016 - DNA, 25 bp, Homo sapien
aaactcaccatctcaccatgaaggt

SEQ ID NO: 574017 - DNA, 25 bp, Homo sapien
actcttgaaagctcctgtgcacctt

SEQ ID NO: 574018 - DNA, 25 bp, Homo sapien
cctgtgcaccttggaactgctgaga

SEQ ID NO: 574019 - DNA, 25 bp, Homo sapien
caagggacaggcttcctgtttctaa

SEQ ID NO: 574020 - DNA, 25 bp, Homo sapien
tacccaaccaaggctttgccttttg

SEQ ID NO: 574021 - DNA, 25 bp, Homo sapien
actatggtgccacctacttgggttt

SEQ ID NO: 574022 - DNA, 25 bp, Homo sapien
tatggtgccacctacttgggtttcc

SEQ ID NO: 574023 - DNA, 25 bp, Homo sapien
tggtgccacctacttgggtttccca

SEQ ID NO: 574024 - DNA, 25 bp, Homo sapien
cttgggtttcccacagttggtagtg

SEQ ID NO: 574025 - DNA, 25 bp, Homo sapien
ttgggtttcccacagttggtagtgc

SEQ ID NO: 574026 - DNA, 25 bp, Homo sapien
gggtttcccacagttggtagtgcca

SEQ ID NO: 574027 - DNA, 25 bp, Homo sapien
gtttcccacagttggtagtgccagg

SEQ ID NO: 574028 - DNA, 25 bp, Homo sapien
ttcccacagttggtagtgccaggca

SEQ ID NO: 574029 - DNA, 25 bp, Homo sapien
tcccacagttggtagtgccaggcag

SEQ ID NO: 574030 - DNA, 25 bp, Homo sapien
cacagttggtagtgccaggcaggaa

SEQ ID NO: 574031 - DNA, 25 bp, Homo sapien
ttgcaggagggctgggaatcctctt

SEQ ID NO: 574032 - DNA, 25 bp, Homo sapien
gggaatcctctttagagcacttaat

SEQ ID NO: 574033 - DNA, 25 bp, Homo sapien
gagcacttaatcctatttatcccct

SEQ ID NO: 574034 - DNA, 25 bp, Homo sapien
tatttatcccctggaatgtgcgtgc

SEQ ID NO: 574035 - DNA, 25 bp, Homo sapien
cctggaatgtgcgtgctggccagta

SEQ ID NO: 574036 - DNA, 25 bp, Homo sapien
aatgtggcattactggcccacagag

SEQ ID NO: 574037 - DNA, 25 bp, Homo sapien
aggttttgagccaatcagctctgag

SEQ ID NO: 574038 - DNA, 25 bp, Homo sapien
atcagctctgagactgggttagaat

SEQ ID NO: 574039 - DNA, 25 bp, Homo sapien
gaatgtaacagctttaacttgggat

SEQ ID NO: 574040 - DNA, 25 bp, Homo sapien
aaatgacgtaaccacagcgtgtact

SEQ ID NO: 574041 - DNA, 25 bp, Homo sapien
taaccacagcgtgtactatgaaagc

SEQ ID NO: 574042 - DNA, 25 bp, Homo sapien
ggtaggtaactctttgtattcacag

SEQ ID NO: 574043 - DNA, 25 bp, Homo sapien
gtaactctttgtattcacagcatca

SEQ ID NO: 574044 - DNA, 25 bp, Homo sapien
attcacagcatcaaaaagtttttcc

SEQ ID NO: 574045 - DNA, 25 bp, Homo sapien
caaatatctgtgtctctttctgaag

SEQ ID NO: 574046 - DNA, 25 bp, Homo sapien
gaagaaatacatccagctgatcaat

SEQ ID NO: 574047 - DNA, 25 bp, Homo sapien
cagctgatcaatacataatgccttt

SEQ ID NO: 574048 - DNA, 25 bp, Homo sapien
acataatgcctttaactctttttca

SEQ ID NO: 574049 - DNA, 25 bp, Homo sapien
ttgtctttctttaccaaagccagaa

SEQ ID NO: 574050 - DNA, 25 bp, Homo sapien
ccagaacatattttgctagggcgga

SEQ ID NO: 574051 - DNA, 25 bp, Homo sapien
ctagggcggatggatctgcatcaca

SEQ ID NO: 574052 - DNA, 25 bp, Homo sapien
tgcatcacagatgggctcgagagtc

SEQ ID NO: 574053 - DNA, 25 bp, Homo sapien
gatagaatagaccagcagggcaatc

SEQ ID NO: 574054 - DNA, 25 bp, Homo sapien
agcagggcaatctaagccccattcc

SEQ ID NO: 574055 - DNA, 25 bp, Homo sapien
cattccctgtctctttacattggtt

SEQ ID NO: 574056 - DNA, 25 bp, Homo sapien
gtctctttacattggttcttggtcc

SEQ ID NO: 574057 - DNA, 25 bp, Homo sapien
ttacattggttcttggtccccgtga

SEQ ID NO: 574058 - DNA, 25 bp, Homo sapien
tcttggtccccgtgactcatccaaa

SEQ ID NO: 574059 - DNA, 25 bp, Homo sapien
caaactcccttatattcctatctgg

SEQ ID NO: 574060 - DNA, 25 bp, Homo sapien
ttcctatctggaatgcgaaagctgg

SEQ ID NO: 574061 - DNA, 25 bp, Homo sapien
aagctggaaatacaagtgctctgta

SEQ ID NO: 574062 - DNA, 25 bp, Homo sapien
caagtgctctgtaatcacaggcagt

SEQ ID NO: 574063 - DNA, 25 bp, Homo sapien
gctctgtaatcacaggcagtggttt

SEQ ID NO: 574064 - DNA, 25 bp, Homo sapien
gaggaatctgatgaaccaactttag

SEQ ID NO: 574065 - DNA, 25 bp, Homo sapien
gaaccaactttagagaacctgcctg

SEQ ID NO: 574066 - DNA, 25 bp, Homo sapien
aactttagagaacctgcctgagtct

SEQ ID NO: 574067 - DNA, 25 bp, Homo sapien
tgagtctcagcctattccttccatg

SEQ ID NO: 574068 - DNA, 25 bp, Homo sapien
ttccatggacctccacgaacttgaa

SEQ ID NO: 574069 - DNA, 25 bp, Homo sapien
atggacctccacgaacttgaatcaa

SEQ ID NO: 574070 - DNA, 25 bp, Homo sapien
gacctccacgaacttgaatcaattg

SEQ ID NO: 574071 - DNA, 25 bp, Homo sapien
gaatcaattgtagaggatgccacat

SEQ ID NO: 574072 - DNA, 25 bp, Homo sapien
gtagaggatgccacatctgaccttg

SEQ ID NO: 574073 - DNA, 25 bp, Homo sapien
aggatgccacatctgaccttggata

SEQ ID NO: 574074 - DNA, 25 bp, Homo sapien
gccacatctgaccttggataccatg

SEQ ID NO: 574075 - DNA, 25 bp, Homo sapien
atgcagatttttaccctgggcttcc

SEQ ID NO: 574076 - DNA, 25 bp, Homo sapien
tgggcttccctctacagtgtggaac

SEQ ID NO: 574077 - DNA, 25 bp, Homo sapien
tccctctacagtgtggaactcaggt

SEQ ID NO: 574078 - DNA, 25 bp, Homo sapien
gaaatgacatgagtttgcagcggat

SEQ ID NO: 574079 - DNA, 25 bp, Homo sapien
agtttgcagcggatggtgaactgaa

SEQ ID NO: 574080 - DNA, 25 bp, Homo sapien
tgaactgaagaaaccataggaggct

SEQ ID NO: 574081 - DNA, 25 bp, Homo sapien
ctgaatttcagttggaagcttggag

SEQ ID NO: 574082 - DNA, 25 bp, Homo sapien
aaggaagtgtaagccttcatcccgt

SEQ ID NO: 574083 - DNA, 25 bp, Homo sapien
ttcatcccgtctggtggttggcgat

SEQ ID NO: 574084 - DNA, 25 bp, Homo sapien
tggtggttggcgatcacacaccgct

SEQ ID NO: 574085 - DNA, 25 bp, Homo sapien
acaccgctctgtgctgaggctaatg

SEQ ID NO: 574086 - DNA, 25 bp, Homo sapien
tggtggcatgttagaaatacatctt

SEQ ID NO: 574087 - DNA, 25 bp, Homo sapien
atgggggaagaatgccctatgtttc

SEQ ID NO: 574088 - DNA, 25 bp, Homo sapien
aacaaagacagttttccaatctgat

SEQ ID NO: 574089 - DNA, 25 bp, Homo sapien
agacagttttccaatctgatataaa

SEQ ID NO: 574090 - DNA, 25 bp, Homo sapien
gaatatgggcttatatgtggttttt

SEQ ID NO: 574091 - DNA, 25 bp, Homo sapien
gaattacagtaaatctcccaggcct

SEQ ID NO: 574092 - DNA, 25 bp, Homo sapien
aatctcccaggccttcagatttcta

SEQ ID NO: 574093 - DNA, 25 bp, Homo sapien
gaatatgtttttaaccctgagatca

SEQ ID NO: 574094 - DNA, 25 bp, Homo sapien
ttaaccctgagatcaagtttagtag

SEQ ID NO: 574095 - DNA, 25 bp, Homo sapien
gtttagtaggcaggacttgatctca

SEQ ID NO: 574096 - DNA, 25 bp, Homo sapien
ggacttgatctcaagtggtcacaaa

SEQ ID NO: 574097 - DNA, 25 bp, Homo sapien
aaatgcctcctcttcactatcacat

SEQ ID NO: 574098 - DNA, 25 bp, Homo sapien
tcctcttcactatcacattacttgt

SEQ ID NO: 574099 - DNA, 25 bp, Homo sapien
actatcacattacttgtttgtctta

SEQ ID NO: 574100 - DNA, 25 bp, Homo sapien
gtttgtcttattttccactcaatac

SEQ ID NO: 574101 - DNA, 25 bp, Homo sapien
attttccactcaatacttaccagta

SEQ ID NO: 574102 - DNA, 25 bp, Homo sapien
atacttaccagtatctgaatttttt

SEQ ID NO: 574103 - DNA, 25 bp, Homo sapien
ggcaccagactgactaggttgctat

SEQ ID NO: 574104 - DNA, 25 bp, Homo sapien
gttgctatcagttttgttgcttaat

SEQ ID NO: 574105 - DNA, 25 bp, Homo sapien
gttttgttgcttaatagttgtgtaa

SEQ ID NO: 574106 - DNA, 25 bp, Homo sapien
gttacttttctgtgtctcagctttt

SEQ ID NO: 574107 - DNA, 25 bp, Homo sapien
atctacttaatagggctatcatggg

SEQ ID NO: 574108 - DNA, 25 bp, Homo sapien
tgttttttccacttgtcaactcatg

SEQ ID NO: 574109 - DNA, 25 bp, Homo sapien
gttttttccacttgtcaactcatga

SEQ ID NO: 574110 - DNA, 25 bp, Homo sapien
ttttttccacttgtcaactcatgaa

SEQ ID NO: 574111 - DNA, 25 bp, Homo sapien
tttttccacttgtcaactcatgaac

SEQ ID NO: 574112 - DNA, 25 bp, Homo sapien
ttttccacttgtcaactcatgaaca

SEQ ID NO: 574113 - DNA, 25 bp, Homo sapien
ttccacttgtcaactcatgaacacc

SEQ ID NO: 574114 - DNA, 25 bp, Homo sapien
tccacttgtcaactcatgaacacct

SEQ ID NO: 574115 - DNA, 25 bp, Homo sapien
cacttgtcaactcatgaacacctca

SEQ ID NO: 574116 - DNA, 25 bp, Homo sapien
cttgtcaactcatgaacacctcaac

SEQ ID NO: 574117 - DNA, 25 bp, Homo sapien
tgtcaactcatgaacacctcaacct

SEQ ID NO: 574118 - DNA, 25 bp, Homo sapien
gtcaactcatgaacacctcaacctt

SEQ ID NO: 574119 - DNA, 25 bp, Homo sapien
gagacttgccatgaattgaaatggg

SEQ ID NO: 574120 - DNA, 25 bp, Homo sapien
aaatgggagaatttgctatttttgt

SEQ ID NO: 574121 - DNA, 25 bp, Homo sapien
atatatccaggaaaacagcctactt

SEQ ID NO: 574122 - DNA, 25 bp, Homo sapien
tatccaggaaaacagcctacttatg

SEQ ID NO: 574123 - DNA, 25 bp, Homo sapien
tccaggaaaacagcctacttatgaa

SEQ ID NO: 574124 - DNA, 25 bp, Homo sapien
ggaaaacagcctacttatgaaaaga

SEQ ID NO: 574125 - DNA, 25 bp, Homo sapien
gaaaacagcctacttatgaaaagat

SEQ ID NO: 574126 - DNA, 25 bp, Homo sapien
aacagcctacttatgaaaagatatt

SEQ ID NO: 574127 - DNA, 25 bp, Homo sapien
ttggtgaatatttaactgatctgag

SEQ ID NO: 574128 - DNA, 25 bp, Homo sapien
gaatatttaactgatctgagtgatg

SEQ ID NO: 574129 - DNA, 25 bp, Homo sapien
tttaactgatctgagtgatgaatga

SEQ ID NO: 574130 - DNA, 25 bp, Homo sapien
ctaatcagctgctagggctgctaca

SEQ ID NO: 574131 - DNA, 25 bp, Homo sapien
aatcagctgctagggctgctacaat

SEQ ID NO: 574132 - DNA, 25 bp, Homo sapien
agctgctagggctgctacaataaaa

SEQ ID NO: 574133 - DNA, 25 bp, Homo sapien
ctgctagggctgctacaataaaagc

SEQ ID NO: 574134 - DNA, 25 bp, Homo sapien
tagggctgctacaataaaagcaggc

SEQ ID NO: 574135 - DNA, 25 bp, Homo sapien
gaacatgaaggactagaccagttga

SEQ ID NO: 574136 - DNA, 25 bp, Homo sapien
aaggactagaccagttgattcttct

SEQ ID NO: 574137 - DNA, 25 bp, Homo sapien
gactagaccagttgattcttctggc

SEQ ID NO: 574138 - DNA, 25 bp, Homo sapien
tagaccagttgattcttctggcctc

SEQ ID NO: 574139 - DNA, 25 bp, Homo sapien
accagttgattcttctggcctccat

SEQ ID NO: 574140 - DNA, 25 bp, Homo sapien
gcttcctgcccttgagtattaaact

SEQ ID NO: 574141 - DNA, 25 bp, Homo sapien
ggagtgacatttacatgctcttctt

SEQ ID NO: 574142 - DNA, 25 bp, Homo sapien
gacatttacatgctcttctttattg

SEQ ID NO: 574143 - DNA, 25 bp, Homo sapien
gctcttctttattgttggcagtaaa

SEQ ID NO: 574144 - DNA, 25 bp, Homo sapien
gtcttttgtaagcagtgtatatcag

SEQ ID NO: 574145 - DNA, 25 bp, Homo sapien
gtacaagtgttttacctggaaatga

SEQ ID NO: 574146 - DNA, 25 bp, Homo sapien
ccacatggatgatatcaccccattt

SEQ ID NO: 574147 - DNA, 25 bp, Homo sapien
cacatggatgatatcaccccatttt

SEQ ID NO: 574148 - DNA, 25 bp, Homo sapien
acatggatgatatcaccccatttta

SEQ ID NO: 574149 - DNA, 25 bp, Homo sapien
aagtattcaacaagaatttgtgtga

SEQ ID NO: 574150 - DNA, 25 bp, Homo sapien
caacaagaatttgtgtgaaatgcat

SEQ ID NO: 574151 - DNA, 25 bp, Homo sapien
tgagggaaccagacatacagtaaaa

SEQ ID NO: 574152 - DNA, 25 bp, Homo sapien
ggcacctgcgaggacactcacccac

SEQ ID NO: 574153 - DNA, 25 bp, Homo sapien
tttacaggggcggtcacaggctcag

SEQ ID NO: 574154 - DNA, 25 bp, Homo sapien
ggcggtcacaggctcagtcaggtga

SEQ ID NO: 574155 - DNA, 25 bp, Homo sapien
agggctgactcagccgtgtgtccag

SEQ ID NO: 574156 - DNA, 25 bp, Homo sapien
tgactcagccgtgtgtccaggccag

SEQ ID NO: 574157 - DNA, 25 bp, Homo sapien
actcagccgtgtgtccaggccagat

SEQ ID NO: 574158 - DNA, 25 bp, Homo sapien
agccgtgtgtccaggccagatggtt

SEQ ID NO: 574159 - DNA, 25 bp, Homo sapien
gtgtgtccaggccagatggttcttt

SEQ ID NO: 574160 - DNA, 25 bp, Homo sapien
gtgtccaggccagatggttctttct

SEQ ID NO: 574161 - DNA, 25 bp, Homo sapien
gtccaggccagatggttctttcttt

SEQ ID NO: 574162 - DNA, 25 bp, Homo sapien
tccaggccagatggttctttctttc

SEQ ID NO: 574163 - DNA, 25 bp, Homo sapien
atagattcttcatctccacgatcac

SEQ ID NO: 574164 - DNA, 25 bp, Homo sapien
ttcttcatctccacgatcacaaata

SEQ ID NO: 574165 - DNA, 25 bp, Homo sapien
tcatctccacgatcacaaatatttt

SEQ ID NO: 574166 - DNA, 25 bp, Homo sapien
acaaatattttctcctaggatttct

SEQ ID NO: 574167 - DNA, 25 bp, Homo sapien
ctagaaatattactgctttaggttg

SEQ ID NO: 574168 - DNA, 25 bp, Homo sapien
actgctttaggttgtatatcaggtc

SEQ ID NO: 574169 - DNA, 25 bp, Homo sapien
ggttgtatatcaggtctaggttcta

SEQ ID NO: 574170 - DNA, 25 bp, Homo sapien
tatcaggtctaggttctactttttt

SEQ ID NO: 574171 - DNA, 25 bp, Homo sapien
gcctcaacctactggactcaaagga

SEQ ID NO: 574172 - DNA, 25 bp, Homo sapien
tgggatagggaccaaagttcatttt

SEQ ID NO: 574173 - DNA, 25 bp, Homo sapien
tgtatacatatccaaatgttccagc

SEQ ID NO: 574174 - DNA, 25 bp, Homo sapien
ggaaatacattattcctctggaaac

SEQ ID NO: 574175 - DNA, 25 bp, Homo sapien
attcctctggaaactctcacatggt

SEQ ID NO: 574176 - DNA, 25 bp, Homo sapien
ctcacatggttttaattcttttctc

SEQ ID NO: 574177 - DNA, 25 bp, Homo sapien
tcttttctctgggaacactgtccct

SEQ ID NO: 574178 - DNA, 25 bp, Homo sapien
tctctgggaacactgtccctctggg

SEQ ID NO: 574179 - DNA, 25 bp, Homo sapien
gacagagacatgtgccttcagaaca

SEQ ID NO: 574180 - DNA, 25 bp, Homo sapien
gagtggtcacacttaggtcttgcca

SEQ ID NO: 574181 - DNA, 25 bp, Homo sapien
ggtcacacttaggtcttgccataag

SEQ ID NO: 574182 - DNA, 25 bp, Homo sapien
ggtcttgccataagtagcacctaat

SEQ ID NO: 574183 - DNA, 25 bp, Homo sapien
gattaggactgcagtagatgcattt

SEQ ID NO: 574184 - DNA, 25 bp, Homo sapien
gcagtagatgcattttaagtgaatc

SEQ ID NO: 574185 - DNA, 25 bp, Homo sapien
tattccggagattctatgctacaga

SEQ ID NO: 574186 - DNA, 25 bp, Homo sapien
ggtgaagaatgcataccgattacat

SEQ ID NO: 574187 - DNA, 25 bp, Homo sapien
cataccgattacattggcaagggag

SEQ ID NO: 574188 - DNA, 25 bp, Homo sapien
agcctggtgctagcacttttgcttc

SEQ ID NO: 574189 - DNA, 25 bp, Homo sapien
ctagcacttttgcttctttggtctt

SEQ ID NO: 574190 - DNA, 25 bp, Homo sapien
ggtctttcaataatgtctttcccct

SEQ ID NO: 574191 - DNA, 25 bp, Homo sapien
ttccccttgattatacatgatatat

SEQ ID NO: 574192 - DNA, 25 bp, Homo sapien
aagaataatattaccactcagaaat

SEQ ID NO: 574193 - DNA, 25 bp, Homo sapien
tggatgaaaagacttccgcctgcct

SEQ ID NO: 574194 - DNA, 25 bp, Homo sapien
cccggaatcgccatgagctgctatt

SEQ ID NO: 574195 - DNA, 25 bp, Homo sapien
atgagctgctattccggagattcta

SEQ ID NO: 574196 - DNA, 25 bp, Homo sapien
tgggtctacaaggagcatgactccc

SEQ ID NO: 574197 - DNA, 25 bp, Homo sapien
ctaccccaccattcagatgtggaga

SEQ ID NO: 574198 - DNA, 25 bp, Homo sapien
gaagtaggccttggctgcttaccca

SEQ ID NO: 574199 - DNA, 25 bp, Homo sapien
tcatttcctgttcagccactcttta

SEQ ID NO: 574200 - DNA, 25 bp, Homo sapien
agccactctttaagcaatcactgag

SEQ ID NO: 574201 - DNA, 25 bp, Homo sapien
atgctcagagatagctcagacctgt

SEQ ID NO: 574202 - DNA, 25 bp, Homo sapien
aggtggttgtgctttgcttgcctgt

SEQ ID NO: 574203 - DNA, 25 bp, Homo sapien
ttgcttgcctgtaggagccccacat

SEQ ID NO: 574204 - DNA, 25 bp, Homo sapien
acatgccctttacagttctgggctg

SEQ ID NO: 574205 - DNA, 25 bp, Homo sapien
agttctgggctgtctatgacttacg

SEQ ID NO: 574206 - DNA, 25 bp, Homo sapien
tatgacttacgatatcacctcttct

SEQ ID NO: 574207 - DNA, 25 bp, Homo sapien
ttcctctgtagacagacagcaagtt

SEQ ID NO: 574208 - DNA, 25 bp, Homo sapien
cagacagcaagtttcttatcccaga

SEQ ID NO: 574209 - DNA, 25 bp, Homo sapien
gtttcttatcccagaaccctgtaga

SEQ ID NO: 574210 - DNA, 25 bp, Homo sapien
gaaccctgtagatagaccatctgtg

SEQ ID NO: 574211 - DNA, 25 bp, Homo sapien
tagaccatctgtgaaagttataatc

SEQ ID NO: 574212 - DNA, 25 bp, Homo sapien
gatgacacagtcacattgacaatga

SEQ ID NO: 574213 - DNA, 25 bp, Homo sapien
gacaatgaggcttttagtcatacag

SEQ ID NO: 574214 - DNA, 25 bp, Homo sapien
gtactctattgtgcaaacctcctag

SEQ ID NO: 574215 - DNA, 25 bp, Homo sapien
gtgcaaacctcctagtaattgagaa

SEQ ID NO: 574216 - DNA, 25 bp, Homo sapien
gaataaacttaatcttgggctacaa

SEQ ID NO: 574217 - DNA, 25 bp, Homo sapien
caagtaggtacaaagtattcccagt

SEQ ID NO: 574218 - DNA, 25 bp, Homo sapien
cacccagctgaggtagaggccagac

SEQ ID NO: 574219 - DNA, 25 bp, Homo sapien
cagctgaggtagaggccagactcct

SEQ ID NO: 574220 - DNA, 25 bp, Homo sapien
gagggtcaaagcactcgtggtcaat

SEQ ID NO: 574221 - DNA, 25 bp, Homo sapien
aagcactcgtggtcaattttgaatc

SEQ ID NO: 574222 - DNA, 25 bp, Homo sapien
ctatcttaaaatactgaggtgtgga

SEQ ID NO: 574223 - DNA, 25 bp, Homo sapien
acaggatcaggagcgatagagagca

SEQ ID NO: 574224 - DNA, 25 bp, Homo sapien
agagagcaggccctcagtgttgtac

SEQ ID NO: 574225 - DNA, 25 bp, Homo sapien
caggccctcagtgttgtactatttg

SEQ ID NO: 574226 - DNA, 25 bp, Homo sapien
agtgttgtactatttgtctcggtcc

SEQ ID NO: 574227 - DNA, 25 bp, Homo sapien
atttgtctcggtccttgtgtctaag

SEQ ID NO: 574228 - DNA, 25 bp, Homo sapien
cttgtgtctaaggagcaatgcagaa

SEQ ID NO: 574229 - DNA, 25 bp, Homo sapien
ccacatggatgatatcaccccattt

SEQ ID NO: 574230 - DNA, 25 bp, Homo sapien
cacatggatgatatcaccccatttt

SEQ ID NO: 574231 - DNA, 25 bp, Homo sapien
acatggatgatatcaccccatttta

SEQ ID NO: 574232 - DNA, 25 bp, Homo sapien
aagtattcaacaagaatttgtgtga

SEQ ID NO: 574233 - DNA, 25 bp, Homo sapien
agtattcaacaagaatttgtgtgaa

SEQ ID NO: 574234 - DNA, 25 bp, Homo sapien
gtattcaacaagaatttgtgtgaaa

SEQ ID NO: 574235 - DNA, 25 bp, Homo sapien
tattcaacaagaatttgtgtgaaat

SEQ ID NO: 574236 - DNA, 25 bp, Homo sapien
attcaacaagaatttgtgtgaaatg

SEQ ID NO: 574237 - DNA, 25 bp, Homo sapien
ttcaacaagaatttgtgtgaaatgc

SEQ ID NO: 574238 - DNA, 25 bp, Homo sapien
tcaacaagaatttgtgtgaaatgca

SEQ ID NO: 574239 - DNA, 25 bp, Homo sapien
caacaagaatttgtgtgaaatgcat

SEQ ID NO: 574240 - DNA, 25 bp, Homo sapien
actgtaacttgtgctgtttgcatag

SEQ ID NO: 574241 - DNA, 25 bp, Homo sapien
gtgctgtttgcataggtatactcta

SEQ ID NO: 574242 - DNA, 25 bp, Homo sapien
gtatactctatcttgtgctatctgc

SEQ ID NO: 574243 - DNA, 25 bp, Homo sapien
gtgctatctgcataaaatatccaag

SEQ ID NO: 574244 - DNA, 25 bp, Homo sapien
gtgattttacatccgtgcatagaaa

SEQ ID NO: 574245 - DNA, 25 bp, Homo sapien
catctgaactcaaatcaatctgttg

SEQ ID NO: 574246 - DNA, 25 bp, Homo sapien
atcaatctgttgatactgactagat

SEQ ID NO: 574247 - DNA, 25 bp, Homo sapien
ctgactagattggtgacgtgtttat

SEQ ID NO: 574248 - DNA, 25 bp, Homo sapien
gtgataatgcacgttcctgtacaag

SEQ ID NO: 574249 - DNA, 25 bp, Homo sapien
gcacgttcctgtacaagcattataa

SEQ ID NO: 574250 - DNA, 25 bp, Homo sapien
acaacagtgtcctatgcaatgcagt

SEQ ID NO: 574251 - DNA, 25 bp, Homo sapien
tctccactaatgtaaatgccacttt

SEQ ID NO: 574252 - DNA, 25 bp, Homo sapien
atattgtggtctacttccagacttg

SEQ ID NO: 574253 - DNA, 25 bp, Homo sapien
agacttgctcttctgctccattcat

SEQ ID NO: 574254 - DNA, 25 bp, Homo sapien
gctccattcatctttctatttctga

SEQ ID NO: 574255 - DNA, 25 bp, Homo sapien
aatacactttaagatctggcagagt

SEQ ID NO: 574256 - DNA, 25 bp, Homo sapien
cagagtttgtctcccgcatttctct

SEQ ID NO: 574257 - DNA, 25 bp, Homo sapien
ttgatttccctgcatgatctttgga

SEQ ID NO: 574258 - DNA, 25 bp, Homo sapien
gatctttggaatcagcttgtcaaga

SEQ ID NO: 574259 - DNA, 25 bp, Homo sapien
gtcaagatccaaaataatcctgttg

SEQ ID NO: 574260 - DNA, 25 bp, Homo sapien
aatcctgttggtatgtttgtttgta

SEQ ID NO: 574261 - DNA, 25 bp, Homo sapien
gtatgtttgtttgtatcccattaaa

SEQ ID NO: 574262 - DNA, 25 bp, Homo sapien
ttaacggtactgctcattgccagtt

SEQ ID NO: 574263 - DNA, 25 bp, Homo sapien
taacggtactgctcattgccagttt

SEQ ID NO: 574264 - DNA, 25 bp, Homo sapien
aacggtactgctcattgccagtttt

SEQ ID NO: 574265 - DNA, 25 bp, Homo sapien
acggtactgctcattgccagtttta

SEQ ID NO: 574266 - DNA, 25 bp, Homo sapien
cggtactgctcattgccagttttat

SEQ ID NO: 574267 - DNA, 25 bp, Homo sapien
ggtactgctcattgccagttttatt

SEQ ID NO: 574268 - DNA, 25 bp, Homo sapien
tttatttgggataatagatgcggct

SEQ ID NO: 574269 - DNA, 25 bp, Homo sapien
tatttgggataatagatgcggctgc

SEQ ID NO: 574270 - DNA, 25 bp, Homo sapien
atttgggataatagatgcggctgcc

SEQ ID NO: 574271 - DNA, 25 bp, Homo sapien
tttgggataatagatgcggctgccc

SEQ ID NO: 574272 - DNA, 25 bp, Homo sapien
ttgggataatagatgcggctgccct

SEQ ID NO: 574273 - DNA, 25 bp, Homo sapien
gtggcgctttgcttgccaccgagcc

SEQ ID NO: 574274 - DNA, 25 bp, Homo sapien
gagccctgcgtcttgagaactctga

SEQ ID NO: 574275 - DNA, 25 bp, Homo sapien
gccctgcgtcttgagaactctgaac

SEQ ID NO: 574276 - DNA, 25 bp, Homo sapien
tgcgtcttgagaactctgaacggtt

SEQ ID NO: 574277 - DNA, 25 bp, Homo sapien
gtcttgagaactctgaacggtttgt

SEQ ID NO: 574278 - DNA, 25 bp, Homo sapien
aactctgaacggtttgttgtagtca

SEQ ID NO: 574279 - DNA, 25 bp, Homo sapien
gaacggtttgttgtagtcaagacac

SEQ ID NO: 574280 - DNA, 25 bp, Homo sapien
gtttgttgtagtcaagacactcgga

SEQ ID NO: 574281 - DNA, 25 bp, Homo sapien
tgtagtcaagacactcggagatcct

SEQ ID NO: 574282 - DNA, 25 bp, Homo sapien
agtcaagacactcggagatcctaga

SEQ ID NO: 574283 - DNA, 25 bp, Homo sapien
gacactcggagatcctagagacgcg

SEQ ID NO: 574284 - DNA, 25 bp, Homo sapien
ggtgcgagttcctcctgcatatgaa

SEQ ID NO: 574285 - DNA, 25 bp, Homo sapien
agctgagcacgtgtgacattgccgt

SEQ ID NO: 574286 - DNA, 25 bp, Homo sapien
actcacattcctatcctggaaacat

SEQ ID NO: 574287 - DNA, 25 bp, Homo sapien
ctatcctggaaacatactgctgcac

SEQ ID NO: 574288 - DNA, 25 bp, Homo sapien
acatactgctgcactgacttttctc

SEQ ID NO: 574289 - DNA, 25 bp, Homo sapien
actgacttttctccgtgtgacccca

SEQ ID NO: 574290 - DNA, 25 bp, Homo sapien
gtgtgaccccacaattgacatggct

SEQ ID NO: 574291 - DNA, 25 bp, Homo sapien
aattgacatggctcctccatcccag

SEQ ID NO: 574292 - DNA, 25 bp, Homo sapien
gaaatagatgtctgcactcctggct

SEQ ID NO: 574293 - DNA, 25 bp, Homo sapien
gccgcctgtccagttcggaggagaa

SEQ ID NO: 574294 - DNA, 25 bp, Homo sapien
ggaggagaactagctgctgccttgc

SEQ ID NO: 574295 - DNA, 25 bp, Homo sapien
agctgactatctgacatgagctgaa

SEQ ID NO: 574296 - DNA, 25 bp, Homo sapien
gctgactatctgacatgagctgaaa

SEQ ID NO: 574297 - DNA, 25 bp, Homo sapien
ctgactatctgacatgagctgaaaa

SEQ ID NO: 574298 - DNA, 25 bp, Homo sapien
aatgaagtgatttagaacacatgtc

SEQ ID NO: 574299 - DNA, 25 bp, Homo sapien
atgaagtgatttagaacacatgtca

SEQ ID NO: 574300 - DNA, 25 bp, Homo sapien
tgaagtgatttagaacacatgtcac

SEQ ID NO: 574301 - DNA, 25 bp, Homo sapien
gaagtgatttagaacacatgtcacg

SEQ ID NO: 574302 - DNA, 25 bp, Homo sapien
aagtgatttagaacacatgtcacgc

SEQ ID NO: 574303 - DNA, 25 bp, Homo sapien
agtgatttagaacacatgtcacgca

SEQ ID NO: 574304 - DNA, 25 bp, Homo sapien
gtgatttagaacacatgtcacgcac

SEQ ID NO: 574305 - DNA, 25 bp, Homo sapien
tgatttagaacacatgtcacgcact

SEQ ID NO: 574306 - DNA, 25 bp, Homo sapien
gagaaagaatcctaagtggttgaat

SEQ ID NO: 574307 - DNA, 25 bp, Homo sapien
gaatgggaaactgattctcctcttg

SEQ ID NO: 574308 - DNA, 25 bp, Homo sapien
gaaactgattctcctcttgagcaca

SEQ ID NO: 574309 - DNA, 25 bp, Homo sapien
tcctcttgagcacaccttagattca

SEQ ID NO: 574310 - DNA, 25 bp, Homo sapien
tgagcacaccttagattcaaataat

SEQ ID NO: 574311 - DNA, 25 bp, Homo sapien
gattggagaagatcattccatacaa

SEQ ID NO: 574312 - DNA, 25 bp, Homo sapien
gatcattccatacaaaaatcttctg

SEQ ID NO: 574313 - DNA, 25 bp, Homo sapien
aaatcttctgacctgcagagtttct

SEQ ID NO: 574314 - DNA, 25 bp, Homo sapien
tgacctgcagagtttctacaaaaag

SEQ ID NO: 574315 - DNA, 25 bp, Homo sapien
attttgcaaattatactgtgggaaa

SEQ ID NO: 574316 - DNA, 25 bp, Homo sapien
aacaagcgtattgcggatgatctta

SEQ ID NO: 574317 - DNA, 25 bp, Homo sapien
gcatggcctgttaaagctgccttaa

SEQ ID NO: 574318 - DNA, 25 bp, Homo sapien
catggcctgttaaagctgccttaag

SEQ ID NO: 574319 - DNA, 25 bp, Homo sapien
atggcctgttaaagctgccttaaga

SEQ ID NO: 574320 - DNA, 25 bp, Homo sapien
tggcctgttaaagctgccttaagaa

SEQ ID NO: 574321 - DNA, 25 bp, Homo sapien
ggcctgttaaagctgccttaagaaa

SEQ ID NO: 574322 - DNA, 25 bp, Homo sapien
gcctgttaaagctgccttaagaaaa

SEQ ID NO: 574323 - DNA, 25 bp, Homo sapien
cctgttaaagctgccttaagaaaat

SEQ ID NO: 574324 - DNA, 25 bp, Homo sapien
agctgccttaagaaaatatgttgcc

SEQ ID NO: 574325 - DNA, 25 bp, Homo sapien
gctgccttaagaaaatatgttgcct

SEQ ID NO: 574326 - DNA, 25 bp, Homo sapien
ctgccttaagaaaatatgttgcctg

SEQ ID NO: 574327 - DNA, 25 bp, Homo sapien
gccttaagaaaatatgttgcctggg

SEQ ID NO: 574328 - DNA, 25 bp, Homo sapien
tacctcctgcatccgggaacttacc

SEQ ID NO: 574329 - DNA, 25 bp, Homo sapien
tgcatccgggaacttaccctccagg

SEQ ID NO: 574330 - DNA, 25 bp, Homo sapien
catccgggaacttaccctccaggcg

SEQ ID NO: 574331 - DNA, 25 bp, Homo sapien
gtgtcccatctcttctcagaagaat

SEQ ID NO: 574332 - DNA, 25 bp, Homo sapien
tgtcccatctcttctcagaagaatt

SEQ ID NO: 574333 - DNA, 25 bp, Homo sapien
gtcccatctcttctcagaagaatta

SEQ ID NO: 574334 - DNA, 25 bp, Homo sapien
tcccatctcttctcagaagaattag

SEQ ID NO: 574335 - DNA, 25 bp, Homo sapien
cccatctcttctcagaagaattagc

SEQ ID NO: 574336 - DNA, 25 bp, Homo sapien
catctcttctcagaagaattagcca

SEQ ID NO: 574337 - DNA, 25 bp, Homo sapien
atctcttctcagaagaattagccat

SEQ ID NO: 574338 - DNA, 25 bp, Homo sapien
cttctcagaagaattagccatgttt

SEQ ID NO: 574339 - DNA, 25 bp, Homo sapien
gtggcagagcctggcaccattgccg

SEQ ID NO: 574340 - DNA, 25 bp, Homo sapien
tcatcggtgccgtctccagctacat

SEQ ID NO: 574341 - DNA, 25 bp, Homo sapien
gctacatctcctaccagcagaagaa

SEQ ID NO: 574342 - DNA, 25 bp, Homo sapien
aagaagttctgcttcagcattcagc

SEQ ID NO: 574343 - DNA, 25 bp, Homo sapien
gggtctcaacgcagactacgtgaag

SEQ ID NO: 574344 - DNA, 25 bp, Homo sapien
gcagactacgtgaagggagagaacc

SEQ ID NO: 574345 - DNA, 25 bp, Homo sapien
gtatgtgaggaaccccaagtgaaat

SEQ ID NO: 574346 - DNA, 25 bp, Homo sapien
agtgaaatactccacgttgcacacg

SEQ ID NO: 574347 - DNA, 25 bp, Homo sapien
aaatactccacgttgcacacgcagt

SEQ ID NO: 574348 - DNA, 25 bp, Homo sapien
gaaccagcccggatctgagggccct

SEQ ID NO: 574349 - DNA, 25 bp, Homo sapien
agcccggatctgagggccctgtcca

SEQ ID NO: 574350 - DNA, 25 bp, Homo sapien
catttggtgcaactccacccttctg

SEQ ID NO: 574351 - DNA, 25 bp, Homo sapien
atttggtgcaactccacccttctgc

SEQ ID NO: 574352 - DNA, 25 bp, Homo sapien
tttggtgcaactccacccttctgca

SEQ ID NO: 574353 - DNA, 25 bp, Homo sapien
ttggtgcaactccacccttctgcag

SEQ ID NO: 574354 - DNA, 25 bp, Homo sapien
tggtgcaactccacccttctgcaga

SEQ ID NO: 574355 - DNA, 25 bp, Homo sapien
ctctgtaccttttctggcttccccg

SEQ ID NO: 574356 - DNA, 25 bp, Homo sapien
tgtaccttttctggcttccccgcca

SEQ ID NO: 574357 - DNA, 25 bp, Homo sapien
ttttctggcttccccgccacaataa

SEQ ID NO: 574358 - DNA, 25 bp, Homo sapien
tttctggcttccccgccacaataaa

SEQ ID NO: 574359 - DNA, 25 bp, Homo sapien
ttctggcttccccgccacaataaaa

SEQ ID NO: 574360 - DNA, 25 bp, Homo sapien
tggcttccccgccacaataaaacct

SEQ ID NO: 574361 - DNA, 25 bp, Homo sapien
gagagggctttagggatcaaatttt

SEQ ID NO: 574362 - DNA, 25 bp, Homo sapien
ttcagtgccctgcaacatcttagga

SEQ ID NO: 574363 - DNA, 25 bp, Homo sapien
gtgccctgcaacatcttaggattta

SEQ ID NO: 574364 - DNA, 25 bp, Homo sapien
agaacttctatttagagactggttg

SEQ ID NO: 574365 - DNA, 25 bp, Homo sapien
agagactggttgtatagttattcaa

SEQ ID NO: 574366 - DNA, 25 bp, Homo sapien
gttattcaactttcttaactctgta

SEQ ID NO: 574367 - DNA, 25 bp, Homo sapien
acaaacaaaatcctgggccagactt

SEQ ID NO: 574368 - DNA, 25 bp, Homo sapien
gaacaaaaactcttcgtcatttgga

SEQ ID NO: 574369 - DNA, 25 bp, Homo sapien
ggaagaaaatggctcacctacgaca

SEQ ID NO: 574370 - DNA, 25 bp, Homo sapien
tggctcacctacgacacattttaat

SEQ ID NO: 574371 - DNA, 25 bp, Homo sapien
gcacacttgagaaatatgtcccttt

SEQ ID NO: 574372 - DNA, 25 bp, Homo sapien
aattcgaggttgtggattgttgcaa

SEQ ID NO: 574373 - DNA, 25 bp, Homo sapien
aatctttggagactagttggctaga

SEQ ID NO: 574374 - DNA, 25 bp, Homo sapien
gaaggtcaaattaagtgcccgtcaa

SEQ ID NO: 574375 - DNA, 25 bp, Homo sapien
agtgcccgtcaacctagatttttag

SEQ ID NO: 574376 - DNA, 25 bp, Homo sapien
gttaatgacttactgatctggtttt

SEQ ID NO: 574377 - DNA, 25 bp, Homo sapien
gatctggttttgtcagcataaacac

SEQ ID NO: 574378 - DNA, 25 bp, Homo sapien
ttcattttgggacccttcccataat

SEQ ID NO: 574379 - DNA, 25 bp, Homo sapien
agtctcactttgctcttagtaataa

SEQ ID NO: 574380 - DNA, 25 bp, Homo sapien
tagtaataaatcagggttattccct

SEQ ID NO: 574381 - DNA, 25 bp, Homo sapien
ccttcctgctttctgacaggttaat

SEQ ID NO: 574382 - DNA, 25 bp, Homo sapien
tctaaagaagagctcctgggaataa

SEQ ID NO: 574383 - DNA, 25 bp, Homo sapien
aatcattagagactagagacagcag

SEQ ID NO: 574384 - DNA, 25 bp, Homo sapien
cattagagactagagacagcagatt

SEQ ID NO: 574385 - DNA, 25 bp, Homo sapien
agagacagcagattagtggatgcca

SEQ ID NO: 574386 - DNA, 25 bp, Homo sapien
agacagcagattagtggatgccagg

SEQ ID NO: 574387 - DNA, 25 bp, Homo sapien
gaaaaatttctggaactagattgta

SEQ ID NO: 574388 - DNA, 25 bp, Homo sapien
aatttctggaactagattgtagtga

SEQ ID NO: 574389 - DNA, 25 bp, Homo sapien
atggttgcacaacaccgtaagtgta

SEQ ID NO: 574390 - DNA, 25 bp, Homo sapien
ggttgcacaacaccgtaagtgtaat

SEQ ID NO: 574391 - DNA, 25 bp, Homo sapien
tgcacaacaccgtaagtgtaataat

SEQ ID NO: 574392 - DNA, 25 bp, Homo sapien
acaccgtaagtgtaataatgtcact

SEQ ID NO: 574393 - DNA, 25 bp, Homo sapien
gtaataatgtcactgaattatacac

SEQ ID NO: 574394 - DNA, 25 bp, Homo sapien
cacttggggcccagaagcttcagga

SEQ ID NO: 574395 - DNA, 25 bp, Homo sapien
tcaggaaaggtgcacaaggtcactg

SEQ ID NO: 574396 - DNA, 25 bp, Homo sapien
aggtcactgggtcccagtactccca

SEQ ID NO: 574397 - DNA, 25 bp, Homo sapien
agtactcccaacaggaaggtctggt

SEQ ID NO: 574398 - DNA, 25 bp, Homo sapien
aacaggaaggtctggtccagggaca

SEQ ID NO: 574399 - DNA, 25 bp, Homo sapien
ttagccacacgcaccagaagttctg

SEQ ID NO: 574400 - DNA, 25 bp, Homo sapien
acgcaccagaagttctgcagtgccc

SEQ ID NO: 574401 - DNA, 25 bp, Homo sapien
cagtgggcatagcagtccccaagaa

SEQ ID NO: 574402 - DNA, 25 bp, Homo sapien
atagcagtccccaagaatgacccag

SEQ ID NO: 574403 - DNA, 25 bp, Homo sapien
ccccaagaatgacccagcactgaag

SEQ ID NO: 574404 - DNA, 25 bp, Homo sapien
gcactgaagctgagccaaagaactt

SEQ ID NO: 574405 - DNA, 25 bp, Homo sapien
accttggataccatggagactgtaa

SEQ ID NO: 574406 - DNA, 25 bp, Homo sapien
ccttggataccatggagactgtaat

SEQ ID NO: 574407 - DNA, 25 bp, Homo sapien
ttggataccatggagactgtaatct

SEQ ID NO: 574408 - DNA, 25 bp, Homo sapien
ggataccatggagactgtaatctaa

SEQ ID NO: 574409 - DNA, 25 bp, Homo sapien
gataccatggagactgtaatctaat

SEQ ID NO: 574410 - DNA, 25 bp, Homo sapien
accatggagactgtaatctaatttc

SEQ ID NO: 574411 - DNA, 25 bp, Homo sapien
ggagactgtaatctaatttcactag

SEQ ID NO: 574412 - DNA, 25 bp, Homo sapien
gactgtaatctaatttcactagacg

SEQ ID NO: 574413 - DNA, 25 bp, Homo sapien
tgtaatctaatttcactagacgaat

SEQ ID NO: 574414 - DNA, 25 bp, Homo sapien
taatttcactagacgaatactggaa

SEQ ID NO: 574415 - DNA, 25 bp, Homo sapien
cactagacgaatactggaaaaatga

SEQ ID NO: 574416 - DNA, 25 bp, Homo sapien
aacccacaattgttgatgaggagta

SEQ ID NO: 574417 - DNA, 25 bp, Homo sapien
gagtagcagtagaatatcaaggaca

SEQ ID NO: 574418 - DNA, 25 bp, Homo sapien
caaggacaggtgatgagacaacaag

SEQ ID NO: 574419 - DNA, 25 bp, Homo sapien
gacaacaagtctatcccgcaaaggg

SEQ ID NO: 574420 - DNA, 25 bp, Homo sapien
gtctatcccgcaaagggcagggaat

SEQ ID NO: 574421 - DNA, 25 bp, Homo sapien
tagagggtacactggaaagaatttg

SEQ ID NO: 574422 - DNA, 25 bp, Homo sapien
aaagctgactacaagttggtctatt

SEQ ID NO: 574423 - DNA, 25 bp, Homo sapien
attttttattaccaccatgagccag

SEQ ID NO: 574424 - DNA, 25 bp, Homo sapien
tttattaccaccatgagccagcaat

SEQ ID NO: 574425 - DNA, 25 bp, Homo sapien
ttaccaccatgagccagcaattcta

SEQ ID NO: 574426 - DNA, 25 bp, Homo sapien
gagccagcaattctaaataatatca

SEQ ID NO: 574427 - DNA, 25 bp, Homo sapien
tttatgttgatcattggcagttacc

SEQ ID NO: 574428 - DNA, 25 bp, Homo sapien
ttatgttgatcattggcagttacca

SEQ ID NO: 574429 - DNA, 25 bp, Homo sapien
ttgatcattggcagttaccaagctg

SEQ ID NO: 574430 - DNA, 25 bp, Homo sapien
gatcattggcagttaccaagctgac

SEQ ID NO: 574431 - DNA, 25 bp, Homo sapien
tcattggcagttaccaagctgacta

SEQ ID NO: 574432 - DNA, 25 bp, Homo sapien
attggcagttaccaagctgactatc

SEQ ID NO: 574433 - DNA, 25 bp, Homo sapien
tggcagttaccaagctgactatctg

SEQ ID NO: 574434 - DNA, 25 bp, Homo sapien
ggcagttaccaagctgactatctga

SEQ ID NO: 574435 - DNA, 25 bp, Homo sapien
gcagttaccaagctgactatctgac

SEQ ID NO: 574436 - DNA, 25 bp, Homo sapien
gactatctgacatgagctgaaaacc

SEQ ID NO: 574437 - DNA, 25 bp, Homo sapien
gatttagaacacatgtcacgcactc

SEQ ID NO: 574438 - DNA, 25 bp, Homo sapien
aaaatctacatttgcctacttttgg

SEQ ID NO: 574439 - DNA, 25 bp, Homo sapien
tacatttgcctacttttggctctgt

SEQ ID NO: 574440 - DNA, 25 bp, Homo sapien
atttgcctacttttggctctgtcat

SEQ ID NO: 574441 - DNA, 25 bp, Homo sapien
gcctacttttggctctgtcatcaag

SEQ ID NO: 574442 - DNA, 25 bp, Homo sapien
cttttggctctgtcatcaagtaggg

SEQ ID NO: 574443 - DNA, 25 bp, Homo sapien
ttggctctgtcatcaagtagggtga

SEQ ID NO: 574444 - DNA, 25 bp, Homo sapien
gctctgtcatcaagtagggtgatac

SEQ ID NO: 574445 - DNA, 25 bp, Homo sapien
gtagggtgatacaaaatgtatgcca

SEQ ID NO: 574446 - DNA, 25 bp, Homo sapien
caaaatgtatgccaagaaaagtctg

SEQ ID NO: 574447 - DNA, 25 bp, Homo sapien
ttttttcttacttgtctgacacagt

SEQ ID NO: 574448 - DNA, 25 bp, Homo sapien
acttgtctgacacagtgacaggatc

SEQ ID NO: 574449 - DNA, 25 bp, Homo sapien
gaaaaatgagagctttagaaaaatc

SEQ ID NO: 574450 - DNA, 25 bp, Homo sapien
ttagaaaaatcttgacagggtgcgg

SEQ ID NO: 574451 - DNA, 25 bp, Homo sapien
tagaaaaatcttgacagggtgcggt

SEQ ID NO: 574452 - DNA, 25 bp, Homo sapien
agaaaaatcttgacagggtgcggtg

SEQ ID NO: 574453 - DNA, 25 bp, Homo sapien
ggtttgaaggcagcctggacaatat

SEQ ID NO: 574454 - DNA, 25 bp, Homo sapien
tgaaaccaccgtctcttctaaaagt

SEQ ID NO: 574455 - DNA, 25 bp, Homo sapien
aagtacaaaatgagcaaggtgtggt

SEQ ID NO: 574456 - DNA, 25 bp, Homo sapien
actgacgcaggggagtcatttgaac

SEQ ID NO: 574457 - DNA, 25 bp, Homo sapien
aggcgaaggttccagcgggccgaga

SEQ ID NO: 574458 - DNA, 25 bp, Homo sapien
gaaggttccagcgggccgagatcac

SEQ ID NO: 574459 - DNA, 25 bp, Homo sapien
gttccagcgggccgagatcacacca

SEQ ID NO: 574460 - DNA, 25 bp, Homo sapien
gctccagatactcacagatacgagg

SEQ ID NO: 574461 - DNA, 25 bp, Homo sapien
gatactcacagatacgaggttttcc

SEQ ID NO: 574462 - DNA, 25 bp, Homo sapien
actcacagatacgaggttttccgct

SEQ ID NO: 574463 - DNA, 25 bp, Homo sapien
tcacagatacgaggttttccgcttg

SEQ ID NO: 574464 - DNA, 25 bp, Homo sapien
acagatacgaggttttccgcttgaa

SEQ ID NO: 574465 - DNA, 25 bp, Homo sapien
agatacgaggttttccgcttgaagt

SEQ ID NO: 574466 - DNA, 25 bp, Homo sapien
ttccgcttgaagtgggagaatatgt

SEQ ID NO: 574467 - DNA, 25 bp, Homo sapien
gaagtgggagaatatgtgcattctt

SEQ ID NO: 574468 - DNA, 25 bp, Homo sapien
ttttcaatgatcacaagactctaac

SEQ ID NO: 574469 - DNA, 25 bp, Homo sapien
ttcaatgatcacaagactctaacaa

SEQ ID NO: 574470 - DNA, 25 bp, Homo sapien
aagtggataactatattattcataa

SEQ ID NO: 574471 - DNA, 25 bp, Homo sapien
cgttctgcagacacttgtccagcgt

SEQ ID NO: 574472 - DNA, 25 bp, Homo sapien
gttctgcagacacttgtccagcgtc

SEQ ID NO: 574473 - DNA, 25 bp, Homo sapien
ttctgcagacacttgtccagcgtcc

SEQ ID NO: 574474 - DNA, 25 bp, Homo sapien
agacacttgtccagcgtcccgctga

SEQ ID NO: 574475 - DNA, 25 bp, Homo sapien
gtggctagtttgtgtggccctgccc

SEQ ID NO: 574476 - DNA, 25 bp, Homo sapien
gctagtttgtgtggccctgcccctg

SEQ ID NO: 574477 - DNA, 25 bp, Homo sapien
cagggtggtctgcatggaacttctt

SEQ ID NO: 574478 - DNA, 25 bp, Homo sapien
gggtggtctgcatggaacttctttc

SEQ ID NO: 574479 - DNA, 25 bp, Homo sapien
tctgcatggaacttctttcccggag

SEQ ID NO: 574480 - DNA, 25 bp, Homo sapien
gcatggaacttctttcccggagttc

SEQ ID NO: 574481 - DNA, 25 bp, Homo sapien
atttggtgcaactccacccttctgc

SEQ ID NO: 574482 - DNA, 25 bp, Homo sapien
atactccactcttcctatcttttca

SEQ ID NO: 574483 - DNA, 25 bp, Homo sapien
cctatcttttcattgggaccttctg

SEQ ID NO: 574484 - DNA, 25 bp, Homo sapien
tatcttttcattgggaccttctgct

SEQ ID NO: 574485 - DNA, 25 bp, Homo sapien
tttcattgggaccttctgctctgca

SEQ ID NO: 574486 - DNA, 25 bp, Homo sapien
tctcctcaaaatctaagtctatgga

SEQ ID NO: 574487 - DNA, 25 bp, Homo sapien
ctaagtctatggacaaatcagatga

SEQ ID NO: 574488 - DNA, 25 bp, Homo sapien
gatgaagaactccagtttcccaaag

SEQ ID NO: 574489 - DNA, 25 bp, Homo sapien
tttcccaaagagttgatggaggact

SEQ ID NO: 574490 - DNA, 25 bp, Homo sapien
gaggactggagcaccatggaggtgt

SEQ ID NO: 574491 - DNA, 25 bp, Homo sapien
gtggactgcaagaagttcatttcgg

SEQ ID NO: 574492 - DNA, 25 bp, Homo sapien
gactgcaagaagttcatttcggaaa

SEQ ID NO: 574493 - DNA, 25 bp, Homo sapien
aatgggatggaataagactttggaa

SEQ ID NO: 574494 - DNA, 25 bp, Homo sapien
ggaataagactttggaagcatacat

SEQ ID NO: 574495 - DNA, 25 bp, Homo sapien
ggtagataatacacaacatcatata

SEQ ID NO: 574496 - DNA, 25 bp, Homo sapien
acacaacatcatataaaccagtggg

SEQ ID NO: 574497 - DNA, 25 bp, Homo sapien
gggaaaatacaacagacaatacata

SEQ ID NO: 574498 - DNA, 25 bp, Homo sapien
gacaatacatagtgttggctattca

SEQ ID NO: 574499 - DNA, 25 bp, Homo sapien
tagtgttggctattcatttggtaaa

SEQ ID NO: 574500 - DNA, 25 bp, Homo sapien
ttggctattcatttggtaaaacata

SEQ ID NO: 574501 - DNA, 25 bp, Homo sapien
aaattaaatctctagttcgcatcat

SEQ ID NO: 574502 - DNA, 25 bp, Homo sapien
aaatctctagttcgcatcattaaca

SEQ ID NO: 574503 - DNA, 25 bp, Homo sapien
ctctagttcgcatcattaacaaaat

SEQ ID NO: 574504 - DNA, 25 bp, Homo sapien
tttatgttgatcattggcagttacc

SEQ ID NO: 574505 - DNA, 25 bp, Homo sapien
ttatgttgatcattggcagttacca

SEQ ID NO: 574506 - DNA, 25 bp, Homo sapien
tatgttgatcattggcagttaccaa

SEQ ID NO: 574507 - DNA, 25 bp, Homo sapien
ttgatcattggcagttaccaagctg

SEQ ID NO: 574508 - DNA, 25 bp, Homo sapien
gatcattggcagttaccaagctgac

SEQ ID NO: 574509 - DNA, 25 bp, Homo sapien
atcattggcagttaccaagctgact

SEQ ID NO: 574510 - DNA, 25 bp, Homo sapien
tcattggcagttaccaagctgacta

SEQ ID NO: 574511 - DNA, 25 bp, Homo sapien
attggcagttaccaagctgactatc

SEQ ID NO: 574512 - DNA, 25 bp, Homo sapien
tggcagttaccaagctgactatctg

SEQ ID NO: 574513 - DNA, 25 bp, Homo sapien
ggcagttaccaagctgactatctga

SEQ ID NO: 574514 - DNA, 25 bp, Homo sapien
gcagttaccaagctgactatctgac

SEQ ID NO: 574515 - DNA, 25 bp, Homo sapien
ttttctttcctagcattatgtggct

SEQ ID NO: 574516 - DNA, 25 bp, Homo sapien
ttctttcctagcattatgtggctaa

SEQ ID NO: 574517 - DNA, 25 bp, Homo sapien
ctttcctagcattatgtggctaaat

SEQ ID NO: 574518 - DNA, 25 bp, Homo sapien
tcctagcattatgtggctaaatatt

SEQ ID NO: 574519 - DNA, 25 bp, Homo sapien
aaaactatgtcatatggaccttcaa

SEQ ID NO: 574520 - DNA, 25 bp, Homo sapien
aactatgtcatatggaccttcaaga

SEQ ID NO: 574521 - DNA, 25 bp, Homo sapien
atgtcatatggaccttcaagattga

SEQ ID NO: 574522 - DNA, 25 bp, Homo sapien
gtcatatggaccttcaagattgata

SEQ ID NO: 574523 - DNA, 25 bp, Homo sapien
ggaccttcaagattgatagatattc

SEQ ID NO: 574524 - DNA, 25 bp, Homo sapien
gattgatagatattctgtttctagg

SEQ ID NO: 574525 - DNA, 25 bp, Homo sapien
tctgtttctaggtttcatgaaaata

SEQ ID NO: 574526 - DNA, 25 bp, Homo sapien
aggcaggctgagtgggtgggccacc

SEQ ID NO: 574527 - DNA, 25 bp, Homo sapien
tgggccacctcctgcggcaggtagc

SEQ ID NO: 574528 - DNA, 25 bp, Homo sapien
tcctgcggcaggtagcatggccaag

SEQ ID NO: 574529 - DNA, 25 bp, Homo sapien
cctgcggcaggtagcatggccaaga

SEQ ID NO: 574530 - DNA, 25 bp, Homo sapien
gggtgtcagcagccagaggtacctg

SEQ ID NO: 574531 - DNA, 25 bp, Homo sapien
ggtacctgactgtgtcactttgagg

SEQ ID NO: 574532 - DNA, 25 bp, Homo sapien
acctgactgtgtcactttgagggcc

SEQ ID NO: 574533 - DNA, 25 bp, Homo sapien
gactgtgtcactttgagggcctgtc

SEQ ID NO: 574534 - DNA, 25 bp, Homo sapien
cccctcctagtatgaatttatgtat

SEQ ID NO: 574535 - DNA, 25 bp, Homo sapien
gtctacttgggagatggaaaccaca

SEQ ID NO: 574536 - DNA, 25 bp, Homo sapien
atagcatgaatttaatgtgcagaat

SEQ ID NO: 574537 - DNA, 25 bp, Homo sapien
tgctgggagcgagcccagtatagct

SEQ ID NO: 574538 - DNA, 25 bp, Homo sapien
gggagcgagcccagtatagctccca

SEQ ID NO: 574539 - DNA, 25 bp, Homo sapien
tcgcgtcgcggaatccttgcccttg

SEQ ID NO: 574540 - DNA, 25 bp, Homo sapien
gtcgcggaatccttgcccttggcac

SEQ ID NO: 574541 - DNA, 25 bp, Homo sapien
gaatccttgcccttggcactactta

SEQ ID NO: 574542 - DNA, 25 bp, Homo sapien
ttgcccttggcactacttacatctc

SEQ ID NO: 574543 - DNA, 25 bp, Homo sapien
ttggcactacttacatctctccggg

SEQ ID NO: 574544 - DNA, 25 bp, Homo sapien
ggcactacttacatctctccgggtc

SEQ ID NO: 574545 - DNA, 25 bp, Homo sapien
gggtcccacaacaccttagcgccca

SEQ ID NO: 574546 - DNA, 25 bp, Homo sapien
agcgcccacctgcttcaaagccaag

SEQ ID NO: 574547 - DNA, 25 bp, Homo sapien
ctggtctctgtggtgctgggagcga

SEQ ID NO: 574548 - DNA, 25 bp, Homo sapien
aaaacctagttaaagacatatatgc

SEQ ID NO: 574549 - DNA, 25 bp, Homo sapien
aagacatatatgctgatattttcag

SEQ ID NO: 574550 - DNA, 25 bp, Homo sapien
ttcagggttacctctcttgatgtct

SEQ ID NO: 574551 - DNA, 25 bp, Homo sapien
agggttacctctcttgatgtctgca

SEQ ID NO: 574552 - DNA, 25 bp, Homo sapien
gggttacctctcttgatgtctgcaa

SEQ ID NO: 574553 - DNA, 25 bp, Homo sapien
ggttacctctcttgatgtctgcaac

SEQ ID NO: 574554 - DNA, 25 bp, Homo sapien
acttactttgaaatgcttcaaaagg

SEQ ID NO: 574555 - DNA, 25 bp, Homo sapien
gagagaaatggatcgatgtgtaaat

SEQ ID NO: 574556 - DNA, 25 bp, Homo sapien
aaatggatcgatgtgtaaataaaac

SEQ ID NO: 574557 - DNA, 25 bp, Homo sapien
tctatctaaatgttaaagcttaatt

SEQ ID NO: 574558 - DNA, 25 bp, Homo sapien
gaatgtaggagtgttgaatgttaaa

SEQ ID NO: 574559 - DNA, 25 bp, Homo sapien
gagagcggtccctggacaaaaggaa

SEQ ID NO: 574560 - DNA, 25 bp, Homo sapien
aaggaacagagaggacagagccagc

SEQ ID NO: 574561 - DNA, 25 bp, Homo sapien
acagagccagccaccgagaaaggga

SEQ ID NO: 574562 - DNA, 25 bp, Homo sapien
gagccagccaccgagaaagggaaga

SEQ ID NO: 574563 - DNA, 25 bp, Homo sapien
aagggaagaggcgaatctgaaacag

SEQ ID NO: 574564 - DNA, 25 bp, Homo sapien
acaggatgccggcagaagttccaga

SEQ ID NO: 574565 - DNA, 25 bp, Homo sapien
atgccggcagaagttccagacatcc

SEQ ID NO: 574566 - DNA, 25 bp, Homo sapien
ccccggagcagagaaggcgacctta

SEQ ID NO: 574567 - DNA, 25 bp, Homo sapien
cagagaaggcgaccttacaaagaat

SEQ ID NO: 574568 - DNA, 25 bp, Homo sapien
aaagaatgtagcaccgacctcagta

SEQ ID NO: 574569 - DNA, 25 bp, Homo sapien
atgtagcaccgacctcagtatctga

SEQ ID NO: 574570 - DNA, 25 bp, Homo sapien
atcagttttatgttggttatcccag

SEQ ID NO: 574571 - DNA, 25 bp, Homo sapien
ttggttatcccagtggattttcact

SEQ ID NO: 574572 - DNA, 25 bp, Homo sapien
tattcctacaagaaaatgtccatag

SEQ ID NO: 574573 - DNA, 25 bp, Homo sapien
gtaagtgattccacgtgtgactgcc

SEQ ID NO: 574574 - DNA, 25 bp, Homo sapien
attccacgtgtgactgcccaagggt

SEQ ID NO: 574575 - DNA, 25 bp, Homo sapien
gtgtgactgcccaagggtggtttta

SEQ ID NO: 574576 - DNA, 25 bp, Homo sapien
aaagctctaacaattctgatgcctg

SEQ ID NO: 574577 - DNA, 25 bp, Homo sapien
ctaacaattctgatgcctgagttca

SEQ ID NO: 574578 - DNA, 25 bp, Homo sapien
ataatctcatagctgatcgggccct

SEQ ID NO: 574579 - DNA, 25 bp, Homo sapien
gctgatcgggcccttggaactcata

SEQ ID NO: 574580 - DNA, 25 bp, Homo sapien
ggcccttggaactcatacccctggg

SEQ ID NO: 574581 - DNA, 25 bp, Homo sapien
tctctatgtattgaaggcctatttt

SEQ ID NO: 574582 - DNA, 25 bp, Homo sapien
ggcctattttcattatggtcctgag

SEQ ID NO: 574583 - DNA, 25 bp, Homo sapien
tctaggctcccaaacatacttattt

SEQ ID NO: 574584 - DNA, 25 bp, Homo sapien
atttgtcaagtaaagctcctatcct

SEQ ID NO: 574585 - DNA, 25 bp, Homo sapien
aagctcctatcctatcattactaat

SEQ ID NO: 574586 - DNA, 25 bp, Homo sapien
attctaatctgaaggccttgagtct

SEQ ID NO: 574587 - DNA, 25 bp, Homo sapien
tgagtctggcaggagctttgtgttt

SEQ ID NO: 574588 - DNA, 25 bp, Homo sapien
tttgctgagcctctaggtcctaaat

SEQ ID NO: 574589 - DNA, 25 bp, Homo sapien
aaatggatttacttattgctctgtg

SEQ ID NO: 574590 - DNA, 25 bp, Homo sapien
gtgtatatagctcctttgcttcatt

SEQ ID NO: 574591 - DNA, 25 bp, Homo sapien
tgcttcatttctgcttctctatgta

SEQ ID NO: 574592 - DNA, 25 bp, Homo sapien
ttgtcccatctgttccaagctattt

SEQ ID NO: 574593 - DNA, 25 bp, Homo sapien
tgttccaagctatttgtccatgtaa

SEQ ID NO: 574594 - DNA, 25 bp, Homo sapien
actgtcaacgttccaagccactgac

SEQ ID NO: 574595 - DNA, 25 bp, Homo sapien
gttccaagccactgactgacagggt

SEQ ID NO: 574596 - DNA, 25 bp, Homo sapien
gaggaacggtgaatctttggcagac

SEQ ID NO: 574597 - DNA, 25 bp, Homo sapien
acggtgaatctttggcagactctgt

SEQ ID NO: 574598 - DNA, 25 bp, Homo sapien
ttggcagactctgtgtgtgcccatg

SEQ ID NO: 574599 - DNA, 25 bp, Homo sapien
gtgtgcccatggaagagacagtgac

SEQ ID NO: 574600 - DNA, 25 bp, Homo sapien
aaaaaatgtagcacaagccttatga

SEQ ID NO: 574601 - DNA, 25 bp, Homo sapien
tttttacttttcactccatgggatt

SEQ ID NO: 574602 - DNA, 25 bp, Homo sapien
cttttcactccatgggattcccata

SEQ ID NO: 574603 - DNA, 25 bp, Homo sapien
atcactgtttttgtcaaggatggtt

SEQ ID NO: 574604 - DNA, 25 bp, Homo sapien
aataaaacctgtggtgcacatttct

SEQ ID NO: 574605 - DNA, 25 bp, Homo sapien
tggtgcacatttctacccaggtttt

SEQ ID NO: 574606 - DNA, 25 bp, Homo sapien
ctacccaggttttgctagagcagtg

SEQ ID NO: 574607 - DNA, 25 bp, Homo sapien
gaaggtgtatttttgctgctttacg

SEQ ID NO: 574608 - DNA, 25 bp, Homo sapien
gtatttttgctgctttacgagcaga

SEQ ID NO: 574609 - DNA, 25 bp, Homo sapien
gggtaactgcatgtaacaatcatca

SEQ ID NO: 574610 - DNA, 25 bp, Homo sapien
atcatcagatagtactctttcccct

SEQ ID NO: 574611 - DNA, 25 bp, Homo sapien
gtaccaaacatttgcattctcagaa

SEQ ID NO: 574612 - DNA, 25 bp, Homo sapien
gaacatcaaacaaaaatgccctggt

SEQ ID NO: 574613 - DNA, 25 bp, Homo sapien
acaaaaatgccctggtggcaaagct

SEQ ID NO: 574614 - DNA, 25 bp, Homo sapien
ccaccccaactgatctcttgacctt

SEQ ID NO: 574615 - DNA, 25 bp, Homo sapien
attcttcttctggacgagtctcagg

SEQ ID NO: 574616 - DNA, 25 bp, Homo sapien
ttcttcttctggacgagtctcagga

SEQ ID NO: 574617 - DNA, 25 bp, Homo sapien
cttcttctggacgagtctcaggagt

SEQ ID NO: 574618 - DNA, 25 bp, Homo sapien
tcttctggacgagtctcaggagttc

SEQ ID NO: 574619 - DNA, 25 bp, Homo sapien
ttctggacgagtctcaggagttccc

SEQ ID NO: 574620 - DNA, 25 bp, Homo sapien
tctggacgagtctcaggagttcccc

SEQ ID NO: 574621 - DNA, 25 bp, Homo sapien
tggacgagtctcaggagttccccac

SEQ ID NO: 574622 - DNA, 25 bp, Homo sapien
acgagtctcaggagttccccaccga

SEQ ID NO: 574623 - DNA, 25 bp, Homo sapien
agtctcaggagttccccaccgagca

SEQ ID NO: 574624 - DNA, 25 bp, Homo sapien
tgccagcaaaagataaccaccttta

SEQ ID NO: 574625 - DNA, 25 bp, Homo sapien
tttcttgcttttggtatattttgtg

SEQ ID NO: 574626 - DNA, 25 bp, Homo sapien
ttggtatattttgtgcttctttttc

SEQ ID NO: 574627 - DNA, 25 bp, Homo sapien
ctaggttctagaggtggaagcatac

SEQ ID NO: 574628 - DNA, 25 bp, Homo sapien
ggaagcatacgttattgatttgaga

SEQ ID NO: 574629 - DNA, 25 bp, Homo sapien
ctttcctcttttctaatgtgagcat

SEQ ID NO: 574630 - DNA, 25 bp, Homo sapien
gagcattttagttacatttagttcc

SEQ ID NO: 574631 - DNA, 25 bp, Homo sapien
tagttacatttagttccctcctagg

SEQ ID NO: 574632 - DNA, 25 bp, Homo sapien
tccctcctaggactactttaattgg

SEQ ID NO: 574633 - DNA, 25 bp, Homo sapien
caactgtatttgtggatttatttat

SEQ ID NO: 574634 - DNA, 25 bp, Homo sapien
ttatttttcctttcagttctattag

SEQ ID NO: 574635 - DNA, 25 bp, Homo sapien
ctttcagttctattagttttagctt

SEQ ID NO: 574636 - DNA, 25 bp, Homo sapien
gtgctaatgtgctaaccattgctcg

SEQ ID NO: 574637 - DNA, 25 bp, Homo sapien
gtgctaaccattgctcggatctaag

SEQ ID NO: 574638 - DNA, 25 bp, Homo sapien
attgctcggatctaagtaagtgtca

SEQ ID NO: 574639 - DNA, 25 bp, Homo sapien
gtaagtgtcatagtacagcagctga

SEQ ID NO: 574640 - DNA, 25 bp, Homo sapien
tacagcagctgatagtgtggcacct

SEQ ID NO: 574641 - DNA, 25 bp, Homo sapien
gtgtggcacctgaacattacatctt

SEQ ID NO: 574642 - DNA, 25 bp, Homo sapien
aatgcatatgttagtgattgtttac

SEQ ID NO: 574643 - DNA, 25 bp, Homo sapien
gattgtttactgtgataaagtgcaa

SEQ ID NO: 574644 - DNA, 25 bp, Homo sapien
cttcaagagtgatcctgcagaggaa

SEQ ID NO: 574645 - DNA, 25 bp, Homo sapien
gaattacctcatgtcactggtcact

SEQ ID NO: 574646 - DNA, 25 bp, Homo sapien
gtcactggtcacttctcaattaaaa

SEQ ID NO: 574647 - DNA, 25 bp, Homo sapien
gagcatgagcttcagagtcaaacag

SEQ ID NO: 574648 - DNA, 25 bp, Homo sapien
gcatgagcttcagagtcaaacagat

SEQ ID NO: 574649 - DNA, 25 bp, Homo sapien
tgagcttcagagtcaaacagatgtt

SEQ ID NO: 574650 - DNA, 25 bp, Homo sapien
gcttcagagtcaaacagatgttgga

SEQ ID NO: 574651 - DNA, 25 bp, Homo sapien
caaacagatgttggagaaattctta

SEQ ID NO: 574652 - DNA, 25 bp, Homo sapien
gttaaatggagataaccttacctat

SEQ ID NO: 574653 - DNA, 25 bp, Homo sapien
ccttacctatcttgcaaagttgttt

SEQ ID NO: 574654 - DNA, 25 bp, Homo sapien
ttacctatcttgcaaagttgttttg

SEQ ID NO: 574655 - DNA, 25 bp, Homo sapien
aaagttgttttgcatttgacgctta

SEQ ID NO: 574656 - DNA, 25 bp, Homo sapien
gttgttttgcatttgacgcttatta

SEQ ID NO: 574657 - DNA, 25 bp, Homo sapien
gttttgcatttgacgcttattattt

SEQ ID NO: 574658 - DNA, 25 bp, Homo sapien
aatatacatctatttggaataccag

SEQ ID NO: 574659 - DNA, 25 bp, Homo sapien
acatctatttggaataccagaagga

SEQ ID NO: 574660 - DNA, 25 bp, Homo sapien
atttgaagtaacactgtcagaggat

SEQ ID NO: 574661 - DNA, 25 bp, Homo sapien
gtaacactgtcagaggattttccca

SEQ ID NO: 574662 - DNA, 25 bp, Homo sapien
taacactgtcagaggattttcccaa

SEQ ID NO: 574663 - DNA, 25 bp, Homo sapien
acactgtcagaggattttcccaaat

SEQ ID NO: 574664 - DNA, 25 bp, Homo sapien
actgtcagaggattttcccaaatta

SEQ ID NO: 574665 - DNA, 25 bp, Homo sapien
tgtcagaggattttcccaaattaac

SEQ ID NO: 574666 - DNA, 25 bp, Homo sapien
cagcaaatcacaagtcaagaagtag

SEQ ID NO: 574667 - DNA, 25 bp, Homo sapien
gcaaatcacaagtcaagaagtagag

SEQ ID NO: 574668 - DNA, 25 bp, Homo sapien
attatacacaaacttcagaaaacca

SEQ ID NO: 574669 - DNA, 25 bp, Homo sapien
aaagactgactaggtccaaggttga

SEQ ID NO: 574670 - DNA, 25 bp, Homo sapien
actgactaggtccaaggttgaggca

SEQ ID NO: 574671 - DNA, 25 bp, Homo sapien
gactaggtccaaggttgaggcacat

SEQ ID NO: 574672 - DNA, 25 bp, Homo sapien
taggtccaaggttgaggcacatagt

SEQ ID NO: 574673 - DNA, 25 bp, Homo sapien
gaggcacatagtggttaagcacatt

SEQ ID NO: 574674 - DNA, 25 bp, Homo sapien
gtggttaagcacattgtcagctccg

SEQ ID NO: 574675 - DNA, 25 bp, Homo sapien
ggttaagcacattgtcagctccgga

SEQ ID NO: 574676 - DNA, 25 bp, Homo sapien
ttaagcacattgtcagctccggact

SEQ ID NO: 574677 - DNA, 25 bp, Homo sapien
aagcacattgtcagctccggactct

SEQ ID NO: 574678 - DNA, 25 bp, Homo sapien
acattgtcagctccggactctgcct

SEQ ID NO: 574679 - DNA, 25 bp, Homo sapien
gttatttagctgttatttagccttt

SEQ ID NO: 574680 - DNA, 25 bp, Homo sapien
tagccatgttttgtgaattccaggt

SEQ ID NO: 574681 - DNA, 25 bp, Homo sapien
tgttttgtgaattccaggtgccatc

SEQ ID NO: 574682 - DNA, 25 bp, Homo sapien
gccatcttcaaaaacacccttggat

SEQ ID NO: 574683 - DNA, 25 bp, Homo sapien
aaacacccttggattctagccaatc

SEQ ID NO: 574684 - DNA, 25 bp, Homo sapien
acacccttggattctagccaatcac

SEQ ID NO: 574685 - DNA, 25 bp, Homo sapien
caatcaccaaaatggcagagacggc

SEQ ID NO: 574686 - DNA, 25 bp, Homo sapien
aaatggcagagacggccacctgaga

SEQ ID NO: 574687 - DNA, 25 bp, Homo sapien
gagacggccacctgagaccaattag

SEQ ID NO: 574688 - DNA, 25 bp, Homo sapien
ggccacctgagaccaattagaatat

SEQ ID NO: 574689 - DNA, 25 bp, Homo sapien
gaccaattagaatatccacaccagt

SEQ ID NO: 574690 - DNA, 25 bp, Homo sapien
ttagaatatccacaccagtggaaga

SEQ ID NO: 574691 - DNA, 25 bp, Homo sapien
aacaagtgtcttcccaacctgataa

SEQ ID NO: 574692 - DNA, 25 bp, Homo sapien
caagtgtcttcccaacctgataatt

SEQ ID NO: 574693 - DNA, 25 bp, Homo sapien
aagtgtcttcccaacctgataattc

SEQ ID NO: 574694 - DNA, 25 bp, Homo sapien
gtgtcttcccaacctgataattcat

SEQ ID NO: 574695 - DNA, 25 bp, Homo sapien
gtcttcccaacctgataattcattt

SEQ ID NO: 574696 - DNA, 25 bp, Homo sapien
cttcccaacctgataattcattttg

SEQ ID NO: 574697 - DNA, 25 bp, Homo sapien
aattcattttggataggcctttctc

SEQ ID NO: 574698 - DNA, 25 bp, Homo sapien
tcattttggataggcctttctcggc

SEQ ID NO: 574699 - DNA, 25 bp, Homo sapien
tttggataggcctttctcggcccca

SEQ ID NO: 574700 - DNA, 25 bp, Homo sapien
tggataggcctttctcggccccaga

SEQ ID NO: 574701 - DNA, 25 bp, Homo sapien
ataggcctttctcggccccagactg

SEQ ID NO: 574702 - DNA, 25 bp, Homo sapien
gcctagtgatggtcctgcttttgta

SEQ ID NO: 574703 - DNA, 25 bp, Homo sapien
tctacactgttcgttgtgtaaggaa

SEQ ID NO: 574704 - DNA, 25 bp, Homo sapien
ctacactgttcgttgtgtaaggaat

SEQ ID NO: 574705 - DNA, 25 bp, Homo sapien
tacactgttcgttgtgtaaggaatt

SEQ ID NO: 574706 - DNA, 25 bp, Homo sapien
acactgttcgttgtgtaaggaattc

SEQ ID NO: 574707 - DNA, 25 bp, Homo sapien
cactgttcgttgtgtaaggaattcc

SEQ ID NO: 574708 - DNA, 25 bp, Homo sapien
ctgttcgttgtgtaaggaattccct

SEQ ID NO: 574709 - DNA, 25 bp, Homo sapien
tgttcgttgtgtaaggaattccctt

SEQ ID NO: 574710 - DNA, 25 bp, Homo sapien
ttcgttgtgtaaggaattccctttg

SEQ ID NO: 574711 - DNA, 25 bp, Homo sapien
tcgttgtgtaaggaattccctttgc

SEQ ID NO: 574712 - DNA, 25 bp, Homo sapien
cgttgtgtaaggaattccctttgca

SEQ ID NO: 574713 - DNA, 25 bp, Homo sapien
cacttttctagaacatattatggtt

SEQ ID NO: 574714 - DNA, 25 bp, Homo sapien
aacatattatggttcatggcattcc

SEQ ID NO: 574715 - DNA, 25 bp, Homo sapien
catattatggttcatggcattccaa

SEQ ID NO: 574716 - DNA, 25 bp, Homo sapien
atattatggttcatggcattccaaa

SEQ ID NO: 574717 - DNA, 25 bp, Homo sapien
attatggttcatggcattccaaaat

SEQ ID NO: 574718 - DNA, 25 bp, Homo sapien
tatggttcatggcattccaaaatga

SEQ ID NO: 574719 - DNA, 25 bp, Homo sapien
ggttcatggcattccaaaatgaagt

SEQ ID NO: 574720 - DNA, 25 bp, Homo sapien
gcattccaaaatgaagtaagggccg

SEQ ID NO: 574721 - DNA, 25 bp, Homo sapien
tccaaaatgaagtaagggccgggcg

SEQ ID NO: 574722 - DNA, 25 bp, Homo sapien
gagaatcacttgatgcagtgagccg

SEQ ID NO: 574723 - DNA, 25 bp, Homo sapien
agaatcacttgatgcagtgagccga

SEQ ID NO: 574724 - DNA, 25 bp, Homo sapien
gtgatccatagtacacagtcatgtg

SEQ ID NO: 574725 - DNA, 25 bp, Homo sapien
agtacacagtcatgtgggagactca

SEQ ID NO: 574726 - DNA, 25 bp, Homo sapien
gagactcaagagaaagctccttcct

SEQ ID NO: 574727 - DNA, 25 bp, Homo sapien
ctcaagagaaagctccttcctggtg

SEQ ID NO: 574728 - DNA, 25 bp, Homo sapien
ggcagaggtgctccctaaattctca

SEQ ID NO: 574729 - DNA, 25 bp, Homo sapien
agaggtgctccctaaattctcattc

SEQ ID NO: 574730 - DNA, 25 bp, Homo sapien
tcattccctttgagatcaacagcaa

SEQ ID NO: 574731 - DNA, 25 bp, Homo sapien
tcatgctaaatctgtgacaatcttt

SEQ ID NO: 574732 - DNA, 25 bp, Homo sapien
cccacattccagtgccgggaaatta

SEQ ID NO: 574733 - DNA, 25 bp, Homo sapien
ccagtgccgggaaattagcaattta

SEQ ID NO: 574734 - DNA, 25 bp, Homo sapien
aatctctctttgaactgtattgtgg

SEQ ID NO: 574735 - DNA, 25 bp, Homo sapien
aagcgccgggacgtgctgcatatgc

SEQ ID NO: 574736 - DNA, 25 bp, Homo sapien
ggacgtgctgcatatgcccggtttc

SEQ ID NO: 574737 - DNA, 25 bp, Homo sapien
gcatatgcccggtttcctggcgggt

SEQ ID NO: 574738 - DNA, 25 bp, Homo sapien
tggcgggtccgtgtgacatgtccaa

SEQ ID NO: 574739 - DNA, 25 bp, Homo sapien
gtgtgacatgtccaagtccgtctcg

SEQ ID NO: 574740 - DNA, 25 bp, Homo sapien
acatgtccaagtccgtctcgctgct

SEQ ID NO: 574741 - DNA, 25 bp, Homo sapien
tcgctgctctccaagcaccgaggga

SEQ ID NO: 574742 - DNA, 25 bp, Homo sapien
tctccaagcaccgagggaccaagaa

SEQ ID NO: 574743 - DNA, 25 bp, Homo sapien
cgagggaccaagaagacgccgtcca

SEQ ID NO: 574744 - DNA, 25 bp, Homo sapien
gtgccagtcgccctgtccaaagagt

SEQ ID NO: 574745 - DNA, 25 bp, Homo sapien
gggactgctcaatacagatacggtg

SEQ ID NO: 574746 - DNA, 25 bp, Homo sapien
tgtcttagcagcacggaagccacgc

SEQ ID NO: 574747 - DNA, 25 bp, Homo sapien
tccttccccccaatgtttgtgcaaa

SEQ ID NO: 574748 - DNA, 25 bp, Homo sapien
gaatgagggctcagtcagaactaca

SEQ ID NO: 574749 - DNA, 25 bp, Homo sapien
gagggctcagtcagaactacaacta

SEQ ID NO: 574750 - DNA, 25 bp, Homo sapien
ggctcagtcagaactacaactacaa

SEQ ID NO: 574751 - DNA, 25 bp, Homo sapien
ttttcttgtctgctcagatttttgg

SEQ ID NO: 574752 - DNA, 25 bp, Homo sapien
gtctgctcagatttttgggttaagg

SEQ ID NO: 574753 - DNA, 25 bp, Homo sapien
gggttaaggttcatgccagctacat

SEQ ID NO: 574754 - DNA, 25 bp, Homo sapien
aaggttcatgccagctacattcttt

SEQ ID NO: 574755 - DNA, 25 bp, Homo sapien
gttcatgccagctacattctttgca

SEQ ID NO: 574756 - DNA, 25 bp, Homo sapien
atgccagctacattctttgcataat

SEQ ID NO: 574757 - DNA, 25 bp, Homo sapien
cctcccaggaattccctgctaagtg

SEQ ID NO: 574758 - DNA, 25 bp, Homo sapien
ctcccaggaattccctgctaagtgc

SEQ ID NO: 574759 - DNA, 25 bp, Homo sapien
tcccaggaattccctgctaagtgcc

SEQ ID NO: 574760 - DNA, 25 bp, Homo sapien
cccaggaattccctgctaagtgcca

SEQ ID NO: 574761 - DNA, 25 bp, Homo sapien
ccaggaattccctgctaagtgccac

SEQ ID NO: 574762 - DNA, 25 bp, Homo sapien
caggaattccctgctaagtgccaca

SEQ ID NO: 574763 - DNA, 25 bp, Homo sapien
aggaattccctgctaagtgccacag

SEQ ID NO: 574764 - DNA, 25 bp, Homo sapien
ggaattccctgctaagtgccacagt

SEQ ID NO: 574765 - DNA, 25 bp, Homo sapien
gaattccctgctaagtgccacagtc

SEQ ID NO: 574766 - DNA, 25 bp, Homo sapien
aattccctgctaagtgccacagtca

SEQ ID NO: 574767 - DNA, 25 bp, Homo sapien
ttcaacttctgctggactgctccct

SEQ ID NO: 574768 - DNA, 25 bp, Homo sapien
ctgctggactgctccctacaggcgg

SEQ ID NO: 574769 - DNA, 25 bp, Homo sapien
gggcaacaattacccacagattgtg

SEQ ID NO: 574770 - DNA, 25 bp, Homo sapien
tacccacagattgtgttggctccag

SEQ ID NO: 574771 - DNA, 25 bp, Homo sapien
agctccagcttattggggctgcgtt

SEQ ID NO: 574772 - DNA, 25 bp, Homo sapien
tgcgttctctcttcggcgtctctaa

SEQ ID NO: 574773 - DNA, 25 bp, Homo sapien
tctcttcggcgtctctaaggccgag

SEQ ID NO: 574774 - DNA, 25 bp, Homo sapien
cggcgtctctaaggccgagcagttt

SEQ ID NO: 574775 - DNA, 25 bp, Homo sapien
ggccgagcagtttcctagctgcgct

SEQ ID NO: 574776 - DNA, 25 bp, Homo sapien
gagcagtttcctagctgcgctcacg

SEQ ID NO: 574777 - DNA, 25 bp, Homo sapien
agtttcctagctgcgctcacgcaaa

SEQ ID NO: 574778 - DNA, 25 bp, Homo sapien
tcctgaacttttgtcttgaggctag

SEQ ID NO: 574779 - DNA, 25 bp, Homo sapien
tgttttttccacttgtcaactcatg

SEQ ID NO: 574780 - DNA, 25 bp, Homo sapien
gttttttccacttgtcaactcatga

SEQ ID NO: 574781 - DNA, 25 bp, Homo sapien
tttttccacttgtcaactcatgaac

SEQ ID NO: 574782 - DNA, 25 bp, Homo sapien
ttccacttgtcaactcatgaacacc

SEQ ID NO: 574783 - DNA, 25 bp, Homo sapien
tccacttgtcaactcatgaacacct

SEQ ID NO: 574784 - DNA, 25 bp, Homo sapien
cacttgtcaactcatgaacacctca

SEQ ID NO: 574785 - DNA, 25 bp, Homo sapien
cttgtcaactcatgaacacctcaac

SEQ ID NO: 574786 - DNA, 25 bp, Homo sapien
tgtcaactcatgaacacctcaacct

SEQ ID NO: 574787 - DNA, 25 bp, Homo sapien
gtcaactcatgaacacctcaacctt

SEQ ID NO: 574788 - DNA, 25 bp, Homo sapien
agccaaactcatggcttggagtggt

SEQ ID NO: 574789 - DNA, 25 bp, Homo sapien
ctggtgtgggcgtctctgtgtacaa

SEQ ID NO: 574790 - DNA, 25 bp, Homo sapien
tgggcgtctctgtgtacaaaaggaa

SEQ ID NO: 574791 - DNA, 25 bp, Homo sapien
gcattcagagcaccccatggagact

SEQ ID NO: 574792 - DNA, 25 bp, Homo sapien
agagcaccccatggagactttgctc

SEQ ID NO: 574793 - DNA, 25 bp, Homo sapien
tccctctgcttcttcaaatgggcag

SEQ ID NO: 574794 - DNA, 25 bp, Homo sapien
aaatgggcagcctgaattcactgtc

SEQ ID NO: 574795 - DNA, 25 bp, Homo sapien
ggcagcctgaattcactgtcagtgc

SEQ ID NO: 574796 - DNA, 25 bp, Homo sapien
cactgtcagtgcatgttccaaactt

SEQ ID NO: 574797 - DNA, 25 bp, Homo sapien
gtgcatgttccaaacttcagtatat

SEQ ID NO: 574798 - DNA, 25 bp, Homo sapien
cctcactttaaggatatgaattctc

SEQ ID NO: 574799 - DNA, 25 bp, Homo sapien
ttctcaaaattagatattctccagt

SEQ ID NO: 574800 - DNA, 25 bp, Homo sapien
tttaaatgttgttgcttggagataa

SEQ ID NO: 574801 - DNA, 25 bp, Homo sapien
aaatgttgttgcttggagataaaaa

SEQ ID NO: 574802 - DNA, 25 bp, Homo sapien
gagataaaaattacataagggactt

SEQ ID NO: 574803 - DNA, 25 bp, Homo sapien
gactatttcccctgagtggccgtgt

SEQ ID NO: 574804 - DNA, 25 bp, Homo sapien
ctatttcccctgagtggccgtgttg

SEQ ID NO: 574805 - DNA, 25 bp, Homo sapien
atttcccctgagtggccgtgttgtc

SEQ ID NO: 574806 - DNA, 25 bp, Homo sapien
ccctgagtggccgtgttgtcccagt

SEQ ID NO: 574807 - DNA, 25 bp, Homo sapien
agtgccctggttcagtgtctcctga

SEQ ID NO: 574808 - DNA, 25 bp, Homo sapien
gccctggttcagtgtctcctgagtg

SEQ ID NO: 574809 - DNA, 25 bp, Homo sapien
ctggttcagtgtctcctgagtggat

SEQ ID NO: 574810 - DNA, 25 bp, Homo sapien
ggatgacaggtcttcattctctatc

SEQ ID NO: 574811 - DNA, 25 bp, Homo sapien
agttcactgaactcttctatgtaaa

SEQ ID NO: 574812 - DNA, 25 bp, Homo sapien
ctgagcttctgggaaatggcctgcg

SEQ ID NO: 574813 - DNA, 25 bp, Homo sapien
gcctgcgggccagggactgtcatca

SEQ ID NO: 574814 - DNA, 25 bp, Homo sapien
ggactgtcatcaccccgcgtggaag

SEQ ID NO: 574815 - DNA, 25 bp, Homo sapien
ttgccctagcagagtcatacggaat

SEQ ID NO: 574816 - DNA, 25 bp, Homo sapien
ggaaaactcaacttctgttcgactt

SEQ ID NO: 574817 - DNA, 25 bp, Homo sapien
ttctgttcgacttgtggatcttcac

SEQ ID NO: 574818 - DNA, 25 bp, Homo sapien
gtggatcttcacactcagaaacaaa

SEQ ID NO: 574819 - DNA, 25 bp, Homo sapien
taaacgtggcatgatcttgataact

SEQ ID NO: 574820 - DNA, 25 bp, Homo sapien
actgttgaatctggatgagggcatg

SEQ ID NO: 574821 - DNA, 25 bp, Homo sapien
tgagggcatgtggagttcactgaac

SEQ ID NO: 574822 - DNA, 25 bp, Homo sapien
ggttctcgaccagggccggtgttgc

SEQ ID NO: 574823 - DNA, 25 bp, Homo sapien
gtcatgatgcgggagttgctactgt

SEQ ID NO: 574824 - DNA, 25 bp, Homo sapien
tcatgatgcgggagttgctactgtt

SEQ ID NO: 574825 - DNA, 25 bp, Homo sapien
atgatgcgggagttgctactgttgc

SEQ ID NO: 574826 - DNA, 25 bp, Homo sapien
tgggtagacacgagggtgctcctca

SEQ ID NO: 574827 - DNA, 25 bp, Homo sapien
gggtagacacgagggtgctcctcaa

SEQ ID NO: 574828 - DNA, 25 bp, Homo sapien
gtagacacgagggtgctcctcaaca

SEQ ID NO: 574829 - DNA, 25 bp, Homo sapien
agacacgagggtgctcctcaacatc

SEQ ID NO: 574830 - DNA, 25 bp, Homo sapien
acgagggtgctcctcaacatcctac

SEQ ID NO: 574831 - DNA, 25 bp, Homo sapien
gagggtgctcctcaacatcctacct

SEQ ID NO: 574832 - DNA, 25 bp, Homo sapien
ggtgctcctcaacatcctacctgaa

SEQ ID NO: 574833 - DNA, 25 bp, Homo sapien
caaattttgccaattgctggaccaa

SEQ ID NO: 574834 - DNA, 25 bp, Homo sapien
tgctggaccaatggcaaacattagt

SEQ ID NO: 574835 - DNA, 25 bp, Homo sapien
atatgttagcactgaccatccttaa

SEQ ID NO: 574836 - DNA, 25 bp, Homo sapien
gttagcactgaccatccttaaaaaa

SEQ ID NO: 574837 - DNA, 25 bp, Homo sapien
ttagttttaattgtcagcctctggc

SEQ ID NO: 574838 - DNA, 25 bp, Homo sapien
gcattggtgcagttttgtttctgtt

SEQ ID NO: 574839 - DNA, 25 bp, Homo sapien
aagtttcttctcaaaatggatttca

SEQ ID NO: 574840 - DNA, 25 bp, Homo sapien
atttcatataatttcggagcacgga

SEQ ID NO: 574841 - DNA, 25 bp, Homo sapien
aatttcggagcacggaagcacacac

SEQ ID NO: 574842 - DNA, 25 bp, Homo sapien
ggaagcacacacaagctctttatga

SEQ ID NO: 574843 - DNA, 25 bp, Homo sapien
tatgaattctgctctccatcagaaa

SEQ ID NO: 574844 - DNA, 25 bp, Homo sapien
ggccaggagagccacttggtccacc

SEQ ID NO: 574845 - DNA, 25 bp, Homo sapien
ttccctgacgtgcatcttcaacgaa

SEQ ID NO: 574846 - DNA, 25 bp, Homo sapien
cctgacgtgcatcttcaacgaagac

SEQ ID NO: 574847 - DNA, 25 bp, Homo sapien
caacgaagacttttacgctggctct

SEQ ID NO: 574848 - DNA, 25 bp, Homo sapien
acgaagacttttacgctggctctgg

SEQ ID NO: 574849 - DNA, 25 bp, Homo sapien
gacttttacgctggctctgggcttg

SEQ ID NO: 574850 - DNA, 25 bp, Homo sapien
ttacgctggctctgggcttgtccta

SEQ ID NO: 574851 - DNA, 25 bp, Homo sapien
tggctctgggcttgtcctagcagat

SEQ ID NO: 574852 - DNA, 25 bp, Homo sapien
gctctgggcttgtcctagcagatgg

SEQ ID NO: 574853 - DNA, 25 bp, Homo sapien
gtggacaaactctagttgtcacaaa

SEQ ID NO: 574854 - DNA, 25 bp, Homo sapien
ctagttgtcacaaaaagggagctga

SEQ ID NO: 574855 - DNA, 25 bp, Homo sapien
acgtggccgtgggtcagttcctcgc

SEQ ID NO: 574856 - DNA, 25 bp, Homo sapien
agttcctcgctggaggagacccttc

SEQ ID NO: 574857 - DNA, 25 bp, Homo sapien
agccaaacccttgaggcctgggaag

SEQ ID NO: 574858 - DNA, 25 bp, Homo sapien
acccttgaggcctgggaaggtctct

SEQ ID NO: 574859 - DNA, 25 bp, Homo sapien
ctctccctgtggttcctggacagaa

SEQ ID NO: 574860 - DNA, 25 bp, Homo sapien
tccctgtggttcctggacagaacat

SEQ ID NO: 574861 - DNA, 25 bp, Homo sapien
ggttcctggacagaacattccgtca

SEQ ID NO: 574862 - DNA, 25 bp, Homo sapien
gaacattccgtcaccacgaaacgaa

SEQ ID NO: 574863 - DNA, 25 bp, Homo sapien
ttccgtcaccacgaaacgaagtttg

SEQ ID NO: 574864 - DNA, 25 bp, Homo sapien
tgggaaaacccagccgggcatggga

SEQ ID NO: 574865 - DNA, 25 bp, Homo sapien
agagtcgccccacatgccaggccag

SEQ ID NO: 574866 - DNA, 25 bp, Homo sapien
aacacaatcaaatttgagggtgact

SEQ ID NO: 574867 - DNA, 25 bp, Homo sapien
aatttgagggtgactttgatttcga

SEQ ID NO: 574868 - DNA, 25 bp, Homo sapien
ggtgactttgatttcgagagtgcaa

SEQ ID NO: 574869 - DNA, 25 bp, Homo sapien
gatttcgagagtgcaaatgcccagt

SEQ ID NO: 574870 - DNA, 25 bp, Homo sapien
tcgagagtgcaaatgcccagttcaa

SEQ ID NO: 574871 - DNA, 25 bp, Homo sapien
agtgcaaatgcccagttcaaccgag

SEQ ID NO: 574872 - DNA, 25 bp, Homo sapien
gcaaatgcccagttcaaccgagagg

SEQ ID NO: 574873 - DNA, 25 bp, Homo sapien
aaatgcccagttcaaccgagaggag

SEQ ID NO: 574874 - DNA, 25 bp, Homo sapien
cccagttcaaccgagaggagcttga

SEQ ID NO: 574875 - DNA, 25 bp, Homo sapien
gttcaaccgagaggagcttgacaaa

SEQ ID NO: 574876 - DNA, 25 bp, Homo sapien
accgagaggagcttgacaaagaatt

SEQ ID NO: 574877 - DNA, 25 bp, Homo sapien
taagcaagatggaacccctctgagt

SEQ ID NO: 574878 - DNA, 25 bp, Homo sapien
tggaacccctctgagttggtgggta

SEQ ID NO: 574879 - DNA, 25 bp, Homo sapien
ggttcttcgcctgatcttcaaaaat

SEQ ID NO: 574880 - DNA, 25 bp, Homo sapien
gaatggtgatttccatacgatttct

SEQ ID NO: 574881 - DNA, 25 bp, Homo sapien
ggtgatttccatacgatttctttat

SEQ ID NO: 574882 - DNA, 25 bp, Homo sapien
ttccatacgatttctttatgcaaga

SEQ ID NO: 574883 - DNA, 25 bp, Homo sapien
tcactcaaagtatgtatagctagcc

SEQ ID NO: 574884 - DNA, 25 bp, Homo sapien
caaagtatgtatagctagccagata

SEQ ID NO: 574885 - DNA, 25 bp, Homo sapien
atagctagccagatactgaacaagt

SEQ ID NO: 574886 - DNA, 25 bp, Homo sapien
gatactgaacaagttagtgcaatga

SEQ ID NO: 574887 - DNA, 25 bp, Homo sapien
gaacaagttagtgcaatgaagtaat

SEQ ID NO: 574888 - DNA, 25 bp, Homo sapien
cttttgtctgactaattaaatgaaa

SEQ ID NO: 574889 - DNA, 25 bp, Homo sapien
atgctccttaactaaagtgactacc

SEQ ID NO: 574890 - DNA, 25 bp, Homo sapien
gctccttaactaaagtgactaccag

SEQ ID NO: 574891 - DNA, 25 bp, Homo sapien
ttaactaaagtgactaccagacttc

SEQ ID NO: 574892 - DNA, 25 bp, Homo sapien
aaagtgactaccagacttcacacaa

SEQ ID NO: 574893 - DNA, 25 bp, Homo sapien
tgactaccagacttcacacaatctt

SEQ ID NO: 574894 - DNA, 25 bp, Homo sapien
gactaccagacttcacacaatcttg

SEQ ID NO: 574895 - DNA, 25 bp, Homo sapien
taccagacttcacacaatcttgcct

SEQ ID NO: 574896 - DNA, 25 bp, Homo sapien
agacttcacacaatcttgccttttt

SEQ ID NO: 574897 - DNA, 25 bp, Homo sapien
gacttcacacaatcttgcctttttg

SEQ ID NO: 574898 - DNA, 25 bp, Homo sapien
ttcacacaatcttgcctttttgagt

SEQ ID NO: 574899 - DNA, 25 bp, Homo sapien
attcttaacagggtttgtctccctg

SEQ ID NO: 574900 - DNA, 25 bp, Homo sapien
ttgtctccctggaaacttcccgaag

SEQ ID NO: 574901 - DNA, 25 bp, Homo sapien
tgtctccctggaaacttcccgaagc

SEQ ID NO: 574902 - DNA, 25 bp, Homo sapien
tctccctggaaacttcccgaagcct

SEQ ID NO: 574903 - DNA, 25 bp, Homo sapien
tccctggaaacttcccgaagcctca

SEQ ID NO: 574904 - DNA, 25 bp, Homo sapien
tggaaacttcccgaagcctcaccct

SEQ ID NO: 574905 - DNA, 25 bp, Homo sapien
cctcccaggaattccctgctaagtg

SEQ ID NO: 574906 - DNA, 25 bp, Homo sapien
caggaattccctgctaagtgccaca

SEQ ID NO: 574907 - DNA, 25 bp, Homo sapien
aggaattccctgctaagtgccacag

SEQ ID NO: 574908 - DNA, 25 bp, Homo sapien
ggaattccctgctaagtgccacagt

SEQ ID NO: 574909 - DNA, 25 bp, Homo sapien
aattccctgctaagtgccacagtca

SEQ ID NO: 574910 - DNA, 25 bp, Homo sapien
tcacctgtcttctgcatgggtctcg

SEQ ID NO: 574911 - DNA, 25 bp, Homo sapien
tgtcttctgcatgggtctcgctggg

SEQ ID NO: 574912 - DNA, 25 bp, Homo sapien
gtttatttggccctcttgaccctgt

SEQ ID NO: 574913 - DNA, 25 bp, Homo sapien
ttttatttcatccaaatagctgcta

SEQ ID NO: 574914 - DNA, 25 bp, Homo sapien
atttcatccaaatagctgctatctt

SEQ ID NO: 574915 - DNA, 25 bp, Homo sapien
ttttttgtacatctttgcctaaatt

SEQ ID NO: 574916 - DNA, 25 bp, Homo sapien
gtacatctttgcctaaattataata

SEQ ID NO: 574917 - DNA, 25 bp, Homo sapien
gaacaacgatctaaatttgcatagc

SEQ ID NO: 574918 - DNA, 25 bp, Homo sapien
atttgcatagcaagtggaccctata

SEQ ID NO: 574919 - DNA, 25 bp, Homo sapien
gcatagcaagtggaccctatatttg

SEQ ID NO: 574920 - DNA, 25 bp, Homo sapien
gcaagtggaccctatatttggaatt

SEQ ID NO: 574921 - DNA, 25 bp, Homo sapien
tgcctcttacaaaacatctgactgg

SEQ ID NO: 574922 - DNA, 25 bp, Homo sapien
gggacaggtcgtaaaattcgcacag

SEQ ID NO: 574923 - DNA, 25 bp, Homo sapien
aattcgcacaggtctggactttact

SEQ ID NO: 574924 - DNA, 25 bp, Homo sapien
gcacaggtctggactttactaaatt

SEQ ID NO: 574925 - DNA, 25 bp, Homo sapien
cctccgatcaggactccaacaggaa

SEQ ID NO: 574926 - DNA, 25 bp, Homo sapien
ataagggcacctgtgatgcaggcac

SEQ ID NO: 574927 - DNA, 25 bp, Homo sapien
acctgtgatgcaggcaccaggacag

SEQ ID NO: 574928 - DNA, 25 bp, Homo sapien
aggacagcttccagcatatgagcct

SEQ ID NO: 574929 - DNA, 25 bp, Homo sapien
gcttccagcatatgagcctcttcta

SEQ ID NO: 574930 - DNA, 25 bp, Homo sapien
gagcctcttctaaggaaaacctaga

SEQ ID NO: 574931 - DNA, 25 bp, Homo sapien
aagtactgacccattgacacaaagg

SEQ ID NO: 574932 - DNA, 25 bp, Homo sapien
acttaattacccagtgcccagttgt

SEQ ID NO: 574933 - DNA, 25 bp, Homo sapien
cttaattacccagtgcccagttgtg

SEQ ID NO: 574934 - DNA, 25 bp, Homo sapien
tcaaggctcagaacttggctcgcat

SEQ ID NO: 574935 - DNA, 25 bp, Homo sapien
aggctcagaacttggctcgcattgg

SEQ ID NO: 574936 - DNA, 25 bp, Homo sapien
cagaacttggctcgcattggtagct

SEQ ID NO: 574937 - DNA, 25 bp, Homo sapien
acttggctcgcattggtagctggag

SEQ ID NO: 574938 - DNA, 25 bp, Homo sapien
aggtggtagaatttgtatgctctta

SEQ ID NO: 574939 - DNA, 25 bp, Homo sapien
tagaatttgtatgctcttagagccc

SEQ ID NO: 574940 - DNA, 25 bp, Homo sapien
tatgctcttagagcccaacagccaa

SEQ ID NO: 574941 - DNA, 25 bp, Homo sapien
gagcccaacagccaaggcagggtca

SEQ ID NO: 574942 - DNA, 25 bp, Homo sapien
acagccaaggcagggtcaagaagat

SEQ ID NO: 574943 - DNA, 25 bp, Homo sapien
tggaggtcctgctggatgctaagca

SEQ ID NO: 574944 - DNA, 25 bp, Homo sapien
ggaggtcctgctggatgctaagcac

SEQ ID NO: 574945 - DNA, 25 bp, Homo sapien
gaggtcctgctggatgctaagcacc

SEQ ID NO: 574946 - DNA, 25 bp, Homo sapien
ggtcctgctggatgctaagcaccga

SEQ ID NO: 574947 - DNA, 25 bp, Homo sapien
gtcctgctggatgctaagcaccgaa

SEQ ID NO: 574948 - DNA, 25 bp, Homo sapien
tcctgctggatgctaagcaccgaaa

SEQ ID NO: 574949 - DNA, 25 bp, Homo sapien
tgctggatgctaagcaccgaaacct

SEQ ID NO: 574950 - DNA, 25 bp, Homo sapien
tggatgctaagcaccgaaacctcaa

SEQ ID NO: 574951 - DNA, 25 bp, Homo sapien
ggatgctaagcaccgaaacctcaac

SEQ ID NO: 574952 - DNA, 25 bp, Homo sapien
gctaagcaccgaaacctcaacccgg

SEQ ID NO: 574953 - DNA, 25 bp, Homo sapien
ctcaacccggaacaagaccagaaca

SEQ ID NO: 574954 - DNA, 25 bp, Homo sapien
gctgctgtctctaaccaccaagtat

SEQ ID NO: 574955 - DNA, 25 bp, Homo sapien
tgctgtctctaaccaccaagtattt

SEQ ID NO: 574956 - DNA, 25 bp, Homo sapien
gctgtctctaaccaccaagtatttt

SEQ ID NO: 574957 - DNA, 25 bp, Homo sapien
ctgtctctaaccaccaagtattttc

SEQ ID NO: 574958 - DNA, 25 bp, Homo sapien
gtctctaaccaccaagtattttctg

SEQ ID NO: 574959 - DNA, 25 bp, Homo sapien
ctctaaccaccaagtattttctgct

SEQ ID NO: 574960 - DNA, 25 bp, Homo sapien
taaccaccaagtattttctgcttaa

SEQ ID NO: 574961 - DNA, 25 bp, Homo sapien
gttctcagcagctactggtcccagc

SEQ ID NO: 574962 - DNA, 25 bp, Homo sapien
tctcagcagctactggtcccagcat

SEQ ID NO: 574963 - DNA, 25 bp, Homo sapien
aggagagctgggaatttcccttcgt

SEQ ID NO: 574964 - DNA, 25 bp, Homo sapien
agagctgggaatttcccttcgtcca

SEQ ID NO: 574965 - DNA, 25 bp, Homo sapien
ctctgcccacaacctttgaaaaggt

SEQ ID NO: 574966 - DNA, 25 bp, Homo sapien
ttgaaaaggtctcgctgttcttccc

SEQ ID NO: 574967 - DNA, 25 bp, Homo sapien
ctgttcttcccacggagagagaggt

SEQ ID NO: 574968 - DNA, 25 bp, Homo sapien
ttcttcccacggagagagaggtgca

SEQ ID NO: 574969 - DNA, 25 bp, Homo sapien
agaggtgcaaggcttgctcagcctc

SEQ ID NO: 574970 - DNA, 25 bp, Homo sapien
gtgcaaggcttgctcagcctcacac

SEQ ID NO: 574971 - DNA, 25 bp, Homo sapien
cagccaatccgtggcaaaggatggc

SEQ ID NO: 574972 - DNA, 25 bp, Homo sapien
gatggcgggaattcaggtggcccca

SEQ ID NO: 574973 - DNA, 25 bp, Homo sapien
aattactaaagtgctcctggttaca

SEQ ID NO: 574974 - DNA, 25 bp, Homo sapien
tgctcctggttacacaataatacgt

SEQ ID NO: 574975 - DNA, 25 bp, Homo sapien
acacaataatacgtctttactgaaa

SEQ ID NO: 574976 - DNA, 25 bp, Homo sapien
catagtcttacttgcagagggcata

SEQ ID NO: 574977 - DNA, 25 bp, Homo sapien
catagtgctgatgggacaagtgaca

SEQ ID NO: 574978 - DNA, 25 bp, Homo sapien
gggtatgagccccatgtaaactaaa

SEQ ID NO: 574979 - DNA, 25 bp, Homo sapien
ctttcctttaggtgttggctacagt

SEQ ID NO: 574980 - DNA, 25 bp, Homo sapien
tggctacagttatcccaaacttgga

SEQ ID NO: 574981 - DNA, 25 bp, Homo sapien
tgaggtcttgtatatgcatgccatt

SEQ ID NO: 574982 - DNA, 25 bp, Homo sapien
gcatgccattggtcacataccatca

SEQ ID NO: 574983 - DNA, 25 bp, Homo sapien
aacatcctacttataacagctcatt

SEQ ID NO: 574984 - DNA, 25 bp, Homo sapien
tttattgtctggctctttcagaccc

SEQ ID NO: 574985 - DNA, 25 bp, Homo sapien
ttcagaccccagcaactgcaattct

SEQ ID NO: 574986 - DNA, 25 bp, Homo sapien
gcaactgcaattctgacttaataat

SEQ ID NO: 574987 - DNA, 25 bp, Homo sapien
gtatttaaattactacactgtattc

SEQ ID NO: 574988 - DNA, 25 bp, Homo sapien
tacactgtattcatacctggagaat

SEQ ID NO: 574989 - DNA, 25 bp, Homo sapien
cctggagaatatcattatgtgactt

SEQ ID NO: 574990 - DNA, 25 bp, Homo sapien
tttatactgctaccttttaaagtca

SEQ ID NO: 574991 - DNA, 25 bp, Homo sapien
atactgctaccttttaaagtcacta

SEQ ID NO: 574992 - DNA, 25 bp, Homo sapien
gtcactaaaatcttttaaatggtga

SEQ ID NO: 574993 - DNA, 25 bp, Homo sapien
atggtgaatgtctaagagtcagtct

SEQ ID NO: 574994 - DNA, 25 bp, Homo sapien
aatgtctaagagtcagtcttcaggt

SEQ ID NO: 574995 - DNA, 25 bp, Homo sapien
aagagtcagtcttcaggtatacctg

SEQ ID NO: 574996 - DNA, 25 bp, Homo sapien
gtcagtcttcaggtatacctgacaa

SEQ ID NO: 574997 - DNA, 25 bp, Homo sapien
ggatgagaaatgagcttttgtagaa

SEQ ID NO: 574998 - DNA, 25 bp, Homo sapien
aagaaactgccctcttattctccaa

SEQ ID NO: 574999 - DNA, 25 bp, Homo sapien
gccctcttattctccaaagtggttt

SEQ ID NO: 575000 - DNA, 25 bp, Homo sapien
gagagttacagttgcttcacatgtc

SEQ ID NO: 575001 - DNA, 25 bp, Homo sapien
tacagttgcttcacatgtctgtcaa

SEQ ID NO: 575002 - DNA, 25 bp, Homo sapien
gttgcttcacatgtctgtcaacatt

SEQ ID NO: 575003 - DNA, 25 bp, Homo sapien
catgtctgtcaacatttacactgtc

SEQ ID NO: 575004 - DNA, 25 bp, Homo sapien
atattagccattttagcatatatga

SEQ ID NO: 575005 - DNA, 25 bp, Homo sapien
ttccctgattaatgagttgagcact

SEQ ID NO: 575006 - DNA, 25 bp, Homo sapien
gattaatgagttgagcactttttca

SEQ ID NO: 575007 - DNA, 25 bp, Homo sapien
gtatatctttcaagaagtgtctttc

SEQ ID NO: 575008 - DNA, 25 bp, Homo sapien
gtctttttattgtaggtgttattct

SEQ ID NO: 575009 - DNA, 25 bp, Homo sapien
ccgttctgcagacacttgtccagcg

SEQ ID NO: 575010 - DNA, 25 bp, Homo sapien
cgttctgcagacacttgtccagcgt

SEQ ID NO: 575011 - DNA, 25 bp, Homo sapien
gttctgcagacacttgtccagcgtc

SEQ ID NO: 575012 - DNA, 25 bp, Homo sapien
ttctgcagacacttgtccagcgtcc

SEQ ID NO: 575013 - DNA, 25 bp, Homo sapien
tctgcagacacttgtccagcgtccc

SEQ ID NO: 575014 - DNA, 25 bp, Homo sapien
ctgcagacacttgtccagcgtcccg

SEQ ID NO: 575015 - DNA, 25 bp, Homo sapien
tgcagacacttgtccagcgtcccgc

SEQ ID NO: 575016 - DNA, 25 bp, Homo sapien
agacacttgtccagcgtcccgctga

SEQ ID NO: 575017 - DNA, 25 bp, Homo sapien
gacacttgtccagcgtcccgctgag

SEQ ID NO: 575018 - DNA, 25 bp, Homo sapien
cacttgtccagcgtcccgctgagct

SEQ ID NO: 575019 - DNA, 25 bp, Homo sapien
gtggctagtttgtgtggccctgccc

SEQ ID NO: 575020 - DNA, 25 bp, Homo sapien
cctcaggtagtccgccttcctcggc

SEQ ID NO: 575021 - DNA, 25 bp, Homo sapien
tcctataaataaagtgggtaatccg

SEQ ID NO: 575022 - DNA, 25 bp, Homo sapien
gtgggtaatccggttataatatgtt

SEQ ID NO: 575023 - DNA, 25 bp, Homo sapien
tgggtaatccggttataatatgttt

SEQ ID NO: 575024 - DNA, 25 bp, Homo sapien
taatccggttataatatgtttttca

SEQ ID NO: 575025 - DNA, 25 bp, Homo sapien
tgtttttcacaggaattaataaatc

SEQ ID NO: 575026 - DNA, 25 bp, Homo sapien
gtttttcacaggaattaataaatct

SEQ ID NO: 575027 - DNA, 25 bp, Homo sapien
tttttcacaggaattaataaatcta

SEQ ID NO: 575028 - DNA, 25 bp, Homo sapien
ttttcacaggaattaataaatctat

SEQ ID NO: 575029 - DNA, 25 bp, Homo sapien
tttcacaggaattaataaatctatt

SEQ ID NO: 575030 - DNA, 25 bp, Homo sapien
ttcacaggaattaataaatctattt

SEQ ID NO: 575031 - DNA, 25 bp, Homo sapien
tgtgtttttcttagatgacattaac

SEQ ID NO: 575032 - DNA, 25 bp, Homo sapien
ttttcttagatgacattaactttag

SEQ ID NO: 575033 - DNA, 25 bp, Homo sapien
aactttagaatatagactgggtgct

SEQ ID NO: 575034 - DNA, 25 bp, Homo sapien
tagaatatagactgggtgctgtgac

SEQ ID NO: 575035 - DNA, 25 bp, Homo sapien
aatatagactgggtgctgtgaccca

SEQ ID NO: 575036 - DNA, 25 bp, Homo sapien
tatagactgggtgctgtgacccacg

SEQ ID NO: 575037 - DNA, 25 bp, Homo sapien
atagactgggtgctgtgacccacgc

SEQ ID NO: 575038 - DNA, 25 bp, Homo sapien
ccaacacgtaaggagaccgaggcag

SEQ ID NO: 575039 - DNA, 25 bp, Homo sapien
gcaggcgaatcacttaggcccagca

SEQ ID NO: 575040 - DNA, 25 bp, Homo sapien
aggcgaatcacttaggcccagcagt

SEQ ID NO: 575041 - DNA, 25 bp, Homo sapien
ggcgaatcacttaggcccagcagtt

SEQ ID NO: 575042 - DNA, 25 bp, Homo sapien
gaaaagctaatgaatgtgctttctc

SEQ ID NO: 575043 - DNA, 25 bp, Homo sapien
tttctctctgtggtccagaatctgg

SEQ ID NO: 575044 - DNA, 25 bp, Homo sapien
tgtggtccagaatctggcctcccaa

SEQ ID NO: 575045 - DNA, 25 bp, Homo sapien
agaatctggcctcccaaagaaccca

SEQ ID NO: 575046 - DNA, 25 bp, Homo sapien
gtattttcttctaatgaggatttgg

SEQ ID NO: 575047 - DNA, 25 bp, Homo sapien
gaggatttggaagtcggtgaccaac

SEQ ID NO: 575048 - DNA, 25 bp, Homo sapien
tcggtgaccaacagactagcctaat

SEQ ID NO: 575049 - DNA, 25 bp, Homo sapien
gtgaccaacagactagcctaatttc

SEQ ID NO: 575050 - DNA, 25 bp, Homo sapien
gactagcctaatttctacaacagaa

SEQ ID NO: 575051 - DNA, 25 bp, Homo sapien
atagcagtgaacaacagtttggtgt

SEQ ID NO: 575052 - DNA, 25 bp, Homo sapien
tgactttttagatgttgaattggaa

SEQ ID NO: 575053 - DNA, 25 bp, Homo sapien
aaacatgctaggaactgcttttggc

SEQ ID NO: 575054 - DNA, 25 bp, Homo sapien
ggaactgcttttggcactgggagta

SEQ ID NO: 575055 - DNA, 25 bp, Homo sapien
gcttttggcactgggagtagacaca

SEQ ID NO: 575056 - DNA, 25 bp, Homo sapien
gagtagacacatgaacaagaccaac

SEQ ID NO: 575057 - DNA, 25 bp, Homo sapien
caagaccaacagtgtaatttccttc

SEQ ID NO: 575058 - DNA, 25 bp, Homo sapien
gtaatttccttcaagttacttacat

SEQ ID NO: 575059 - DNA, 25 bp, Homo sapien
agttacttacattcctataatagag

SEQ ID NO: 575060 - DNA, 25 bp, Homo sapien
cttcagactgtgagagttattaaaa

SEQ ID NO: 575061 - DNA, 25 bp, Homo sapien
aagctggattaggtgtggagaataa

SEQ ID NO: 575062 - DNA, 25 bp, Homo sapien
ctacttgagataagggagacctctt

SEQ ID NO: 575063 - DNA, 25 bp, Homo sapien
gataagggagacctctttgaaagga

SEQ ID NO: 575064 - DNA, 25 bp, Homo sapien
gcattgtcatgatgtcactcctgga

SEQ ID NO: 575065 - DNA, 25 bp, Homo sapien
cctggaggttgttctattaagcatt

SEQ ID NO: 575066 - DNA, 25 bp, Homo sapien
gcattagtgatttatacttccggat

SEQ ID NO: 575067 - DNA, 25 bp, Homo sapien
atacttccggataaccagtggcaca

SEQ ID NO: 575068 - DNA, 25 bp, Homo sapien
accagtggcacagatgtactcttta

SEQ ID NO: 575069 - DNA, 25 bp, Homo sapien
gatgtactctttacatagctgatgt

SEQ ID NO: 575070 - DNA, 25 bp, Homo sapien
gcatataaatctccctttacaccat

SEQ ID NO: 575071 - DNA, 25 bp, Homo sapien
tctccctttacaccatctatatagt

SEQ ID NO: 575072 - DNA, 25 bp, Homo sapien
gagactgtgagtcagcctggatctt

SEQ ID NO: 575073 - DNA, 25 bp, Homo sapien
gtcagcctggatcttgtctaaacac

SEQ ID NO: 575074 - DNA, 25 bp, Homo sapien
gtctaaacacccaagagcattgtca

SEQ ID NO: 575075 - DNA, 25 bp, Homo sapien
gctctaacctggacatgtcagaagc

SEQ ID NO: 575076 - DNA, 25 bp, Homo sapien
ggacatgtcagaagccaactacaaa

SEQ ID NO: 575077 - DNA, 25 bp, Homo sapien
aagagagtctctacgcatggtgcaa

SEQ ID NO: 575078 - DNA, 25 bp, Homo sapien
acgcatggtgcaatcataccaactt

SEQ ID NO: 575079 - DNA, 25 bp, Homo sapien
ataccaacttctagcacaggccaaa

SEQ ID NO: 575080 - DNA, 25 bp, Homo sapien
agcacaggccaaaccaatgggaaat

SEQ ID NO: 575081 - DNA, 25 bp, Homo sapien
gaagaatattaaccaagcacctttt

SEQ ID NO: 575082 - DNA, 25 bp, Homo sapien
caccttttatggacccttgcattca

SEQ ID NO: 575083 - DNA, 25 bp, Homo sapien
tggacccttgcattcactgataact

SEQ ID NO: 575084 - DNA, 25 bp, Homo sapien
cactgataactttctggcagcatct

SEQ ID NO: 575085 - DNA, 25 bp, Homo sapien
ggcagcatctactttttagtgtaac

SEQ ID NO: 575086 - DNA, 25 bp, Homo sapien
tgctcagctgcctcagaagagtatc

SEQ ID NO: 575087 - DNA, 25 bp, Homo sapien
gcctcagaagagtatcctggagcgg

SEQ ID NO: 575088 - DNA, 25 bp, Homo sapien
cttcttggtcacactgctcatctat

SEQ ID NO: 575089 - DNA, 25 bp, Homo sapien
gtcacactgctcatctatcgtatga

SEQ ID NO: 575090 - DNA, 25 bp, Homo sapien
gaaaaaggatgagggcagctacacg

SEQ ID NO: 575091 - DNA, 25 bp, Homo sapien
gctacacgctggaggaacccaagca

SEQ ID NO: 575092 - DNA, 25 bp, Homo sapien
ggaacccaagcaggcgagcgtcaca

SEQ ID NO: 575093 - DNA, 25 bp, Homo sapien
gcgagcgtcacataccagaagcctg

SEQ ID NO: 575094 - DNA, 25 bp, Homo sapien
cacataccagaagcctgacaagcag

SEQ ID NO: 575095 - DNA, 25 bp, Homo sapien
gacaagcaggaggagttctatgcct

SEQ ID NO: 575096 - DNA, 25 bp, Homo sapien
gagttctatgcctagtggagccaca

SEQ ID NO: 575097 - DNA, 25 bp, Homo sapien
gactgacagcgcaggtcctaaaact

SEQ ID NO: 575098 - DNA, 25 bp, Homo sapien
cagcgcaggtcctaaaactgaaggc

SEQ ID NO: 575099 - DNA, 25 bp, Homo sapien
acttggttaagggaggctgaattct

SEQ ID NO: 575100 - DNA, 25 bp, Homo sapien
gctgaattcttggagctgaagggaa

SEQ ID NO: 575101 - DNA, 25 bp, Homo sapien
ttcattccaacggaaggaatcctgt

SEQ ID NO: 575102 - DNA, 25 bp, Homo sapien
ggaatcctgtagtttcaggcatagt

SEQ ID NO: 575103 - DNA, 25 bp, Homo sapien
gaaaactttgctgcatcacctttgc

SEQ ID NO: 575104 - DNA, 25 bp, Homo sapien
gcatcacctttgcaactttgccaaa

SEQ ID NO: 575105 - DNA, 25 bp, Homo sapien
ctttgccaaagctcagagttcactt

SEQ ID NO: 575106 - DNA, 25 bp, Homo sapien
gccaaagctcagagttcacttttta

SEQ ID NO: 575107 - DNA, 25 bp, Homo sapien
aaatgatgtgtatgcagagttttaa

SEQ ID NO: 575108 - DNA, 25 bp, Homo sapien
gatgatagaagtggtctttcctctt

SEQ ID NO: 575109 - DNA, 25 bp, Homo sapien
ccacattaagaggagggctgcagct

SEQ ID NO: 575110 - DNA, 25 bp, Homo sapien
gctgcagctactgtggtagcctgga

SEQ ID NO: 575111 - DNA, 25 bp, Homo sapien
gtagcctggaatcttccaaaagcct

SEQ ID NO: 575112 - DNA, 25 bp, Homo sapien
gaagatcaatacttcctcttgccat

SEQ ID NO: 575113 - DNA, 25 bp, Homo sapien
ctcttgccatttgtgttcggttgtc

SEQ ID NO: 575114 - DNA, 25 bp, Homo sapien
gtgttcggttgtctgactgatgtta

SEQ ID NO: 575115 - DNA, 25 bp, Homo sapien
gactgatgttaagcccaactgtgag

SEQ ID NO: 575116 - DNA, 25 bp, Homo sapien
agacctcctgggaacttagtagcct

SEQ ID NO: 575117 - DNA, 25 bp, Homo sapien
gtagcctcttaactcataatctcag

SEQ ID NO: 575118 - DNA, 25 bp, Homo sapien
cctttggttccgtcacaggagcaaa

SEQ ID NO: 575119 - DNA, 25 bp, Homo sapien
atgatgtgtgaggttgaatttcctg

SEQ ID NO: 575120 - DNA, 25 bp, Homo sapien
tgatgtgtgaggttgaatttcctgc

SEQ ID NO: 575121 - DNA, 25 bp, Homo sapien
gatgtgtgaggttgaatttcctgcc

SEQ ID NO: 575122 - DNA, 25 bp, Homo sapien
atgtgtgaggttgaatttcctgccc

SEQ ID NO: 575123 - DNA, 25 bp, Homo sapien
tgtgtgaggttgaatttcctgccct

SEQ ID NO: 575124 - DNA, 25 bp, Homo sapien
gtgtgaggttgaatttcctgccctc

SEQ ID NO: 575125 - DNA, 25 bp, Homo sapien
tgtgaggttgaatttcctgccctca

SEQ ID NO: 575126 - DNA, 25 bp, Homo sapien
gtgaggttgaatttcctgccctcaa

SEQ ID NO: 575127 - DNA, 25 bp, Homo sapien
tgaggttgaatttcctgccctcaac

SEQ ID NO: 575128 - DNA, 25 bp, Homo sapien
gaggttgaatttcctgccctcaacc

SEQ ID NO: 575129 - DNA, 25 bp, Homo sapien
ggttgaatttcctgccctcaaccca

SEQ ID NO: 575130 - DNA, 25 bp, Homo sapien
ggaggtgcccattcagatggctgaa

SEQ ID NO: 575131 - DNA, 25 bp, Homo sapien
tgcccattcagatggctgaagggct

SEQ ID NO: 575132 - DNA, 25 bp, Homo sapien
cagatggctgaagggcttcaaattt

SEQ ID NO: 575133 - DNA, 25 bp, Homo sapien
gcagttttcccctgggtatctgtgt

SEQ ID NO: 575134 - DNA, 25 bp, Homo sapien
tttcccctgggtatctgtgtcattt

SEQ ID NO: 575135 - DNA, 25 bp, Homo sapien
cctgggtatctgtgtcatttctgaa

SEQ ID NO: 575136 - DNA, 25 bp, Homo sapien
atttctgaaggttccagtgtcacgc

SEQ ID NO: 575137 - DNA, 25 bp, Homo sapien
gaaggttccagtgtcacgcaagact

SEQ ID NO: 575138 - DNA, 25 bp, Homo sapien
ggttccagtgtcacgcaagactttg

SEQ ID NO: 575139 - DNA, 25 bp, Homo sapien
cagtgtcacgcaagactttgatttt

SEQ ID NO: 575140 - DNA, 25 bp, Homo sapien
gtcacgcaagactttgatttttaaa

SEQ ID NO: 575141 - DNA, 25 bp, Homo sapien
aaaagtggatcccattttcccatct

SEQ ID NO: 575142 - DNA, 25 bp, Homo sapien
aagtggatcccattttcccatcttc

SEQ ID NO: 575143 - DNA, 25 bp, Homo sapien
attttcccatcttctatgcctacgt

SEQ ID NO: 575144 - DNA, 25 bp, Homo sapien
tttcccatcttctatgcctacgtgg

SEQ ID NO: 575145 - DNA, 25 bp, Homo sapien
atcttctatgcctacgtggctgaca

SEQ ID NO: 575146 - DNA, 25 bp, Homo sapien
cttctatgcctacgtggctgacaaa

SEQ ID NO: 575147 - DNA, 25 bp, Homo sapien
tctatgcctacgtggctgacaaatc

SEQ ID NO: 575148 - DNA, 25 bp, Homo sapien
atgcctacgtggctgacaaatctcc

SEQ ID NO: 575149 - DNA, 25 bp, Homo sapien
tacgtggctgacaaatctcccgaat

SEQ ID NO: 575150 - DNA, 25 bp, Homo sapien
acgtggctgacaaatctcccgaatc

SEQ ID NO: 575151 - DNA, 25 bp, Homo sapien
tggctgacaaatctcccgaatccca

SEQ ID NO: 575152 - DNA, 25 bp, Homo sapien
agtgagccagtcatgcatgggccga

SEQ ID NO: 575153 - DNA, 25 bp, Homo sapien
atgcatgggccgagaaccaggtttg

SEQ ID NO: 575154 - DNA, 25 bp, Homo sapien
gtttggcatattgtagctgctcagt

SEQ ID NO: 575155 - DNA, 25 bp, Homo sapien
gctgctcagtggacgttagctgtta

SEQ ID NO: 575156 - DNA, 25 bp, Homo sapien
gacgttagctgttatgattggacca

SEQ ID NO: 575157 - DNA, 25 bp, Homo sapien
atgattggaccacaacgtgcttccg

SEQ ID NO: 575158 - DNA, 25 bp, Homo sapien
acgtgcttccgtttcaattctgtgg

SEQ ID NO: 575159 - DNA, 25 bp, Homo sapien
tccgtttcaattctgtgggcctttt

SEQ ID NO: 575160 - DNA, 25 bp, Homo sapien
aacaacaggaccagcgatggctctc

SEQ ID NO: 575161 - DNA, 25 bp, Homo sapien
tctggaagtcacctggctggaccaa

SEQ ID NO: 575162 - DNA, 25 bp, Homo sapien
aagccctctccgtgttctctgtcag

SEQ ID NO: 575163 - DNA, 25 bp, Homo sapien
agggacggtgcctttgctcatgtgt

SEQ ID NO: 575164 - DNA, 25 bp, Homo sapien
gctcatgtgtagcagcactgggcaa

SEQ ID NO: 575165 - DNA, 25 bp, Homo sapien
gcagcactgggcaagggacaacacc

SEQ ID NO: 575166 - DNA, 25 bp, Homo sapien
agggacaacaccaggccccgctttg

SEQ ID NO: 575167 - DNA, 25 bp, Homo sapien
ccgctttggttctggtgtttattca

SEQ ID NO: 575168 - DNA, 25 bp, Homo sapien
ggttctggtgtttattcaactaaag

SEQ ID NO: 575169 - DNA, 25 bp, Homo sapien
gtgaaccacttgttacttataaaat

SEQ ID NO: 575170 - DNA, 25 bp, Homo sapien
aaatgcacacccagatttccctatt

SEQ ID NO: 575171 - DNA, 25 bp, Homo sapien
ttccctattgggttgttacctcagt

SEQ ID NO: 575172 - DNA, 25 bp, Homo sapien
tgggttgttacctcagtgcagttga

SEQ ID NO: 575173 - DNA, 25 bp, Homo sapien
taacattctgctgtgcaatatggat

SEQ ID NO: 575174 - DNA, 25 bp, Homo sapien
tgtgaacacgtacagcatatctata

SEQ ID NO: 575175 - DNA, 25 bp, Homo sapien
gcatatctatacaaaattctgctat

SEQ ID NO: 575176 - DNA, 25 bp, Homo sapien
gcctttgtttaattatgcttttcct

SEQ ID NO: 575177 - DNA, 25 bp, Homo sapien
gcttttcctctaaatagcaacttaa

SEQ ID NO: 575178 - DNA, 25 bp, Homo sapien
atttgctagactttgaatcatcgct

SEQ ID NO: 575179 - DNA, 25 bp, Homo sapien
gaatcatcgctatatcaagtatcta

SEQ ID NO: 575180 - DNA, 25 bp, Homo sapien
ttgggagggtgaatcagtacactgt

SEQ ID NO: 575181 - DNA, 25 bp, Homo sapien
atcagtacactgtgaccaaggtcct

SEQ ID NO: 575182 - DNA, 25 bp, Homo sapien
gtgaccaaggtcctcaaattggaat

SEQ ID NO: 575183 - DNA, 25 bp, Homo sapien
aaatgttcctgaaagcaccacagct

SEQ ID NO: 575184 - DNA, 25 bp, Homo sapien
gcaccacagctactcaagaagatca

SEQ ID NO: 575185 - DNA, 25 bp, Homo sapien
ctgggagctggctacctccgagctg

SEQ ID NO: 575186 - DNA, 25 bp, Homo sapien
ggtggtatccggcatctctgccaag

SEQ ID NO: 575187 - DNA, 25 bp, Homo sapien
gcatctctgccaaggatggcttcat

SEQ ID NO: 575188 - DNA, 25 bp, Homo sapien
tctctgccaaggatggcttcatctc

SEQ ID NO: 575189 - DNA, 25 bp, Homo sapien
tgtctacctgtaccgaaagtggaag

SEQ ID NO: 575190 - DNA, 25 bp, Homo sapien
gtaccgaaagtggaaggcgacccag

SEQ ID NO: 575191 - DNA, 25 bp, Homo sapien
cgacccaggttgaggaagtgagatc

SEQ ID NO: 575192 - DNA, 25 bp, Homo sapien
ggttgaggaagtgagatccagcccc

SEQ ID NO: 575193 - DNA, 25 bp, Homo sapien
tccatgtggccttagctgggcccat

SEQ ID NO: 575194 - DNA, 25 bp, Homo sapien
ctcagaaatgccctgcctattaaat

SEQ ID NO: 575195 - DNA, 25 bp, Homo sapien
aaatgccctgcctattaaatgagct

SEQ ID NO: 575196 - DNA, 25 bp, Homo sapien
ggttctcgaccagggccggtgttgc

SEQ ID NO: 575197 - DNA, 25 bp, Homo sapien
gtcatgatgcgggagttgctactgt

SEQ ID NO: 575198 - DNA, 25 bp, Homo sapien
atgatgcgggagttgctactgttgc

SEQ ID NO: 575199 - DNA, 25 bp, Homo sapien
gggtagacacgagggtgctcctcaa

SEQ ID NO: 575200 - DNA, 25 bp, Homo sapien
gtagacacgagggtgctcctcaaca

SEQ ID NO: 575201 - DNA, 25 bp, Homo sapien
agacacgagggtgctcctcaacatc

SEQ ID NO: 575202 - DNA, 25 bp, Homo sapien
acgagggtgctcctcaacatcctac

SEQ ID NO: 575203 - DNA, 25 bp, Homo sapien
gagggtgctcctcaacatcctacct

SEQ ID NO: 575204 - DNA, 25 bp, Homo sapien
ggtgctcctcaacatcctacctgaa

SEQ ID NO: 575205 - DNA, 25 bp, Homo sapien
aaggaagaatgatccggccccaaat

SEQ ID NO: 575206 - DNA, 25 bp, Homo sapien
tgggctggtcagcaacaaccccttt

SEQ ID NO: 575207 - DNA, 25 bp, Homo sapien
ctatatctggaaaacataagctctc

SEQ ID NO: 575208 - DNA, 25 bp, Homo sapien
gtgtcacatgactttccttagctac

SEQ ID NO: 575209 - DNA, 25 bp, Homo sapien
ccttagctacacaggagtccaggaa

SEQ ID NO: 575210 - DNA, 25 bp, Homo sapien
tttggcttttctaaacactcctcct

SEQ ID NO: 575211 - DNA, 25 bp, Homo sapien
aacactcctcctctgaacaaaatta

SEQ ID NO: 575212 - DNA, 25 bp, Homo sapien
aaaattacacttctgttactgagga

SEQ ID NO: 575213 - DNA, 25 bp, Homo sapien
gagaagcaactagcagtacctgtta

SEQ ID NO: 575214 - DNA, 25 bp, Homo sapien
agcagtacctgttatgtgggatttc

SEQ ID NO: 575215 - DNA, 25 bp, Homo sapien
gtgggatttccagcactcacaaatg

SEQ ID NO: 575216 - DNA, 25 bp, Homo sapien
atttccagcactcacaaatggttgc

SEQ ID NO: 575217 - DNA, 25 bp, Homo sapien
acattcctatcccaggcaggcagga

SEQ ID NO: 575218 - DNA, 25 bp, Homo sapien
aatagcaaagacaacctgggaagga

SEQ ID NO: 575219 - DNA, 25 bp, Homo sapien
gaaaggtctttgtgggataatccat

SEQ ID NO: 575220 - DNA, 25 bp, Homo sapien
gtgggataatccatatgtttaattt

SEQ ID NO: 575221 - DNA, 25 bp, Homo sapien
ttattcaacttcatcaatcacttta

SEQ ID NO: 575222 - DNA, 25 bp, Homo sapien
ttttttctaactcctggagacttat

SEQ ID NO: 575223 - DNA, 25 bp, Homo sapien
aactcctggagacttattttactgc

SEQ ID NO: 575224 - DNA, 25 bp, Homo sapien
ggagacttattttactgcttcatta

SEQ ID NO: 575225 - DNA, 25 bp, Homo sapien
gacttattttactgcttcattaggt

SEQ ID NO: 575226 - DNA, 25 bp, Homo sapien
attttactgcttcattaggttgaaa

SEQ ID NO: 575227 - DNA, 25 bp, Homo sapien
tctaggtagggttttattatcccag

SEQ ID NO: 575228 - DNA, 25 bp, Homo sapien
ttttattatcccagggactacctcg

SEQ ID NO: 575229 - DNA, 25 bp, Homo sapien
aattatgtgactttttgaaacggtg

SEQ ID NO: 575230 - DNA, 25 bp, Homo sapien
gactttttgaaacggtgagtccact

SEQ ID NO: 575231 - DNA, 25 bp, Homo sapien
gaaacggtgagtccacttacacaga

SEQ ID NO: 575232 - DNA, 25 bp, Homo sapien
aacggtgagtccacttacacagaac

SEQ ID NO: 575233 - DNA, 25 bp, Homo sapien
gagtccacttacacagaacaggctt

SEQ ID NO: 575234 - DNA, 25 bp, Homo sapien
tccacttacacagaacaggctttaa

SEQ ID NO: 575235 - DNA, 25 bp, Homo sapien
tcccagcatgagaaagtcctcctaa

SEQ ID NO: 575236 - DNA, 25 bp, Homo sapien
gagaaagtcctcctaaacattgcct

SEQ ID NO: 575237 - DNA, 25 bp, Homo sapien
aaagtcctcctaaacattgcctgca

SEQ ID NO: 575238 - DNA, 25 bp, Homo sapien
atgtcgctgccactagagaactgga

SEQ ID NO: 575239 - DNA, 25 bp, Homo sapien
ctgccactagagaactggagagcat

SEQ ID NO: 575240 - DNA, 25 bp, Homo sapien
tagcctatctcatccttatcatgca

SEQ ID NO: 575241 - DNA, 25 bp, Homo sapien
agcctatctcatccttatcatgcag

SEQ ID NO: 575242 - DNA, 25 bp, Homo sapien
gcctatctcatccttatcatgcagc

SEQ ID NO: 575243 - DNA, 25 bp, Homo sapien
tatctcatccttatcatgcagcctc

SEQ ID NO: 575244 - DNA, 25 bp, Homo sapien
atccttatcatgcagcctcctacaa

SEQ ID NO: 575245 - DNA, 25 bp, Homo sapien
tcctacaagggcaggcactcctggg

SEQ ID NO: 575246 - DNA, 25 bp, Homo sapien
gagctggctgggagcacctctgtgg

SEQ ID NO: 575247 - DNA, 25 bp, Homo sapien
acctctgtgggtcccatctgacccc

SEQ ID NO: 575248 - DNA, 25 bp, Homo sapien
atctgacccctgtgccagggtctgg

SEQ ID NO: 575249 - DNA, 25 bp, Homo sapien
gacccctgtgccagggtctgggcca

SEQ ID NO: 575250 - DNA, 25 bp, Homo sapien
tgtgccagggtctgggccagcccct

SEQ ID NO: 575251 - DNA, 25 bp, Homo sapien
cttctgcatgtcatcaattgtaaga

SEQ ID NO: 575252 - DNA, 25 bp, Homo sapien
ttggagttgtctttgcagtaatggt

SEQ ID NO: 575253 - DNA, 25 bp, Homo sapien
gtctttgcagtaatggtggccctca

SEQ ID NO: 575254 - DNA, 25 bp, Homo sapien
ttgcagtaatggtggccctcagtcc

SEQ ID NO: 575255 - DNA, 25 bp, Homo sapien
cctcctagccagagatagttacagc

SEQ ID NO: 575256 - DNA, 25 bp, Homo sapien
agcaaaattgtcattgcccacatgt

SEQ ID NO: 575257 - DNA, 25 bp, Homo sapien
gcacagagatactcccattttcttt

SEQ ID NO: 575258 - DNA, 25 bp, Homo sapien
ctcatgtactgagtttagttatgca

SEQ ID NO: 575259 - DNA, 25 bp, Homo sapien
agtttagttatgcaagatgtcttca

SEQ ID NO: 575260 - DNA, 25 bp, Homo sapien
tgcaagatgtcttcaaaccagaaaa

SEQ ID NO: 575261 - DNA, 25 bp, Homo sapien
gttagataatggattcacagagttt

SEQ ID NO: 575262 - DNA, 25 bp, Homo sapien
agggtccacatttcattaaaactca

SEQ ID NO: 575263 - DNA, 25 bp, Homo sapien
gggtccacatttcattaaaactcac

SEQ ID NO: 575264 - DNA, 25 bp, Homo sapien
ggtccacatttcattaaaactcaca

SEQ ID NO: 575265 - DNA, 25 bp, Homo sapien
gtccacatttcattaaaactcacaa

SEQ ID NO: 575266 - DNA, 25 bp, Homo sapien
tccacatttcattaaaactcacaaa

SEQ ID NO: 575267 - DNA, 25 bp, Homo sapien
ccacatttcattaaaactcacaaat

SEQ ID NO: 575268 - DNA, 25 bp, Homo sapien
cacatttcattaaaactcacaaatt

SEQ ID NO: 575269 - DNA, 25 bp, Homo sapien
aaccagtgatatcagtagagtgttg

SEQ ID NO: 575270 - DNA, 25 bp, Homo sapien
accagtgatatcagtagagtgttgg

SEQ ID NO: 575271 - DNA, 25 bp, Homo sapien
ccagtgatatcagtagagtgttgga

SEQ ID NO: 575272 - DNA, 25 bp, Homo sapien
cagtgatatcagtagagtgttggat

SEQ ID NO: 575273 - DNA, 25 bp, Homo sapien
gccatatgaatgtacaaggtgtggt

SEQ ID NO: 575274 - DNA, 25 bp, Homo sapien
gaatgtacaaggtgtggtaaagcct

SEQ ID NO: 575275 - DNA, 25 bp, Homo sapien
taaagcctttgggtggtgcagttcc

SEQ ID NO: 575276 - DNA, 25 bp, Homo sapien
aagcctttgggtggtgcagttccct

SEQ ID NO: 575277 - DNA, 25 bp, Homo sapien
tttgggtggtgcagttccctccgaa

SEQ ID NO: 575278 - DNA, 25 bp, Homo sapien
tgggtggtgcagttccctccgaaga

SEQ ID NO: 575279 - DNA, 25 bp, Homo sapien
tggtgcagttccctccgaagacatg

SEQ ID NO: 575280 - DNA, 25 bp, Homo sapien
tttttcaaattaccttagacttcat

SEQ ID NO: 575281 - DNA, 25 bp, Homo sapien
agaactcatttggccgggcgtagcc

SEQ ID NO: 575282 - DNA, 25 bp, Homo sapien
atttggccgggcgtagccagtgctt

SEQ ID NO: 575283 - DNA, 25 bp, Homo sapien
ccgggcgtagccagtgctttggcag

SEQ ID NO: 575284 - DNA, 25 bp, Homo sapien
gcagcacaattggaagcctcacatt

SEQ ID NO: 575285 - DNA, 25 bp, Homo sapien
agcctcacattctcatagacgggtt

SEQ ID NO: 575286 - DNA, 25 bp, Homo sapien
gcagaaaggctcacataaggcctga

SEQ ID NO: 575287 - DNA, 25 bp, Homo sapien
taaggcctgagcgtgaggtttcctg

SEQ ID NO: 575288 - DNA, 25 bp, Homo sapien
tgagcgtgaggtttcctgcccagca

SEQ ID NO: 575289 - DNA, 25 bp, Homo sapien
ccacggcgcggcaggtgcagaaacc

SEQ ID NO: 575290 - DNA, 25 bp, Homo sapien
aaaccgtgctgggattgaggcccta

SEQ ID NO: 575291 - DNA, 25 bp, Homo sapien
attgaggccctagaggctgactaca

SEQ ID NO: 575292 - DNA, 25 bp, Homo sapien
ctagaggctgactacaggtcttggg

SEQ ID NO: 575293 - DNA, 25 bp, Homo sapien
cacacagctgaagatgagccaagta

SEQ ID NO: 575294 - DNA, 25 bp, Homo sapien
tgagccaagtatattagtcagggtt

SEQ ID NO: 575295 - DNA, 25 bp, Homo sapien
aaatcccgacatctagccaaggaat

SEQ ID NO: 575296 - DNA, 25 bp, Homo sapien
atcccgacatctagccaaggaatgt

SEQ ID NO: 575297 - DNA, 25 bp, Homo sapien
tcactcaccgaaaggtcgatagatt

SEQ ID NO: 575298 - DNA, 25 bp, Homo sapien
aggtcgatagattgaggctactctc

SEQ ID NO: 575299 - DNA, 25 bp, Homo sapien
atagattgaggctactctcaggcaa

SEQ ID NO: 575300 - DNA, 25 bp, Homo sapien
gattgaggctactctcaggcaagtg

SEQ ID NO: 575301 - DNA, 25 bp, Homo sapien
ttgaggctactctcaggcaagtgag

SEQ ID NO: 575302 - DNA, 25 bp, Homo sapien
gcaagtgagctttaattaccatgtt

SEQ ID NO: 575303 - DNA, 25 bp, Homo sapien
agtgagctttaattaccatgttaaa

SEQ ID NO: 575304 - DNA, 25 bp, Homo sapien
ccacgggcaaatctagttattaaat

SEQ ID NO: 575305 - DNA, 25 bp, Homo sapien
tattaaatagtcattctgagcacca

SEQ ID NO: 575306 - DNA, 25 bp, Homo sapien
agcctgaattcatgctgtccctgaa

SEQ ID NO: 575307 - DNA, 25 bp, Homo sapien
gggcagggctccttctgagcttctc

SEQ ID NO: 575308 - DNA, 25 bp, Homo sapien
ttctgagcttctctgggtttcccca

SEQ ID NO: 575309 - DNA, 25 bp, Homo sapien
aaggacaactgttccggcttgctgg

SEQ ID NO: 575310 - DNA, 25 bp, Homo sapien
aactgttccggcttgctgggaccat

SEQ ID NO: 575311 - DNA, 25 bp, Homo sapien
ttgctgggaccatcctggtgttagc

SEQ ID NO: 575312 - DNA, 25 bp, Homo sapien
accatcctggtgttagccctcagag

SEQ ID NO: 575313 - DNA, 25 bp, Homo sapien
gagtcctgcaccctgaaaagcttct

SEQ ID NO: 575314 - DNA, 25 bp, Homo sapien
gaaaagcttctcttatagggacaac

SEQ ID NO: 575315 - DNA, 25 bp, Homo sapien
tagggacaactactcaccctacatg

SEQ ID NO: 575316 - DNA, 25 bp, Homo sapien
aaccccatgggtagcctgaattcat

SEQ ID NO: 575317 - DNA, 25 bp, Homo sapien
agattcacacagatgcagcaaagga

SEQ ID NO: 575318 - DNA, 25 bp, Homo sapien
aaaggagaacacctgctactgtggt

SEQ ID NO: 575319 - DNA, 25 bp, Homo sapien
acctgctactgtggtgcagtggcaa

SEQ ID NO: 575320 - DNA, 25 bp, Homo sapien
agggatggagcctcttcaaggtcat

SEQ ID NO: 575321 - DNA, 25 bp, Homo sapien
tcaaggtcatgccactcccgctttg

SEQ ID NO: 575322 - DNA, 25 bp, Homo sapien
caggaactattactaagtcccctgc

SEQ ID NO: 575323 - DNA, 25 bp, Homo sapien
gaaggtcctgggtcacttgcagcag

SEQ ID NO: 575324 - DNA, 25 bp, Homo sapien
gcagcagtctttctgccagtacatc

SEQ ID NO: 575325 - DNA, 25 bp, Homo sapien
gtacatcagtctcagattcatccca

SEQ ID NO: 575326 - DNA, 25 bp, Homo sapien
attctctttttgtctccgacaactt

SEQ ID NO: 575327 - DNA, 25 bp, Homo sapien
gtctccgacaacttgggtgaacagc

SEQ ID NO: 575328 - DNA, 25 bp, Homo sapien
caaataaaggcaatatagtttcact

SEQ ID NO: 575329 - DNA, 25 bp, Homo sapien
tcactggaactgaaatgttgccttc

SEQ ID NO: 575330 - DNA, 25 bp, Homo sapien
aatgttgccttccaattctactaca

SEQ ID NO: 575331 - DNA, 25 bp, Homo sapien
tgttgccttccaattctactacaga

SEQ ID NO: 575332 - DNA, 25 bp, Homo sapien
gcacctggtcaggatggactcacta

SEQ ID NO: 575333 - DNA, 25 bp, Homo sapien
gtcaggatggactcactaaaggatt

SEQ ID NO: 575334 - DNA, 25 bp, Homo sapien
tcaacaaatattgctgctacattaa

SEQ ID NO: 575335 - DNA, 25 bp, Homo sapien
tattgctgctacattaactgattcg

SEQ ID NO: 575336 - DNA, 25 bp, Homo sapien
gctacattaactgattcgcaacaaa

SEQ ID NO: 575337 - DNA, 25 bp, Homo sapien
ttaactgattcgcaacaaagaaaga

SEQ ID NO: 575338 - DNA, 25 bp, Homo sapien
gaaaatatcatccagttgattttat

SEQ ID NO: 575339 - DNA, 25 bp, Homo sapien
atagattcttcatctccacgatcac

SEQ ID NO: 575340 - DNA, 25 bp, Homo sapien
agattcttcatctccacgatcacaa

SEQ ID NO: 575341 - DNA, 25 bp, Homo sapien
attcttcatctccacgatcacaaat

SEQ ID NO: 575342 - DNA, 25 bp, Homo sapien
ttcttcatctccacgatcacaaata

SEQ ID NO: 575343 - DNA, 25 bp, Homo sapien
tcatctccacgatcacaaatatttt

SEQ ID NO: 575344 - DNA, 25 bp, Homo sapien
ttctagaaatattactgctttaggt

SEQ ID NO: 575345 - DNA, 25 bp, Homo sapien
gaaatattactgctttaggttgtat

SEQ ID NO: 575346 - DNA, 25 bp, Homo sapien
actgctttaggttgtatatcaggtc

SEQ ID NO: 575347 - DNA, 25 bp, Homo sapien
ggttgtatatcaggtctaggttcta

SEQ ID NO: 575348 - DNA, 25 bp, Homo sapien
gtatatcaggtctaggttctacttt

SEQ ID NO: 575349 - DNA, 25 bp, Homo sapien
tatcaggtctaggttctactttttt

SEQ ID NO: 575350 - DNA, 25 bp, Homo sapien
tatccatttcttttgtgcctgttga

SEQ ID NO: 575351 - DNA, 25 bp, Homo sapien
ttgtgcctgttgaagttctgcttgt

SEQ ID NO: 575352 - DNA, 25 bp, Homo sapien
ttgaagttctgcttgtcccaccagg

SEQ ID NO: 575353 - DNA, 25 bp, Homo sapien
accaggctcagatcagatacctcga

SEQ ID NO: 575354 - DNA, 25 bp, Homo sapien
gatcagatacctcgaaggagccttt

SEQ ID NO: 575355 - DNA, 25 bp, Homo sapien
gaaggagccttttataatttcctct

SEQ ID NO: 575356 - DNA, 25 bp, Homo sapien
ttagaatggatttaccttccacttg

SEQ ID NO: 575357 - DNA, 25 bp, Homo sapien
catcctcttgcttgtatacctctct

SEQ ID NO: 575358 - DNA, 25 bp, Homo sapien
acctctctctcctggttactgtaaa

SEQ ID NO: 575359 - DNA, 25 bp, Homo sapien
tggttactgtaaactctgaagggca

SEQ ID NO: 575360 - DNA, 25 bp, Homo sapien
gggcagcacttaaggaattctctct

SEQ ID NO: 575361 - DNA, 25 bp, Homo sapien
gaactttgtaattttgtctatttga

SEQ ID NO: 575362 - DNA, 25 bp, Homo sapien
atgaccataaagatccatgatgtgg

SEQ ID NO: 575363 - DNA, 25 bp, Homo sapien
gaagttcatattttcctgtgagact

SEQ ID NO: 575364 - DNA, 25 bp, Homo sapien
tttcctgtgagactataaggctagt

SEQ ID NO: 575365 - DNA, 25 bp, Homo sapien
aaggctagtgattgagccaggccga

SEQ ID NO: 575366 - DNA, 25 bp, Homo sapien
gtgattgagccaggccgaacaccta

SEQ ID NO: 575367 - DNA, 25 bp, Homo sapien
cgaacacctatgtctctctagagat

SEQ ID NO: 575368 - DNA, 25 bp, Homo sapien
gtctctctagagattgtgtcattgt

SEQ ID NO: 575369 - DNA, 25 bp, Homo sapien
ttgtgtcattgttctctactcacca

SEQ ID NO: 575370 - DNA, 25 bp, Homo sapien
gttctctactcaccatcaatacatg

SEQ ID NO: 575371 - DNA, 25 bp, Homo sapien
gactccttgaaaaatagttaatcct

SEQ ID NO: 575372 - DNA, 25 bp, Homo sapien
ggacatggtctgagttagaaccact

SEQ ID NO: 575373 - DNA, 25 bp, Homo sapien
gtctgagttagaaccacttgttttg

SEQ ID NO: 575374 - DNA, 25 bp, Homo sapien
gggaagtattcatgggtaacctctt

SEQ ID NO: 575375 - DNA, 25 bp, Homo sapien
gtattcatgggtaacctctttgagg

SEQ ID NO: 575376 - DNA, 25 bp, Homo sapien
ggtaacctctttgaggtctctttat

SEQ ID NO: 575377 - DNA, 25 bp, Homo sapien
ctctttatctgtgtttcctttttag

SEQ ID NO: 575378 - DNA, 25 bp, Homo sapien
ttcctttttagttgcgcatagccta

SEQ ID NO: 575379 - DNA, 25 bp, Homo sapien
tagttgcgcatagcctaattctaag

SEQ ID NO: 575380 - DNA, 25 bp, Homo sapien
gcgcatagcctaattctaaggtttt

SEQ ID NO: 575381 - DNA, 25 bp, Homo sapien
tagcctaattctaaggttttggtat

SEQ ID NO: 575382 - DNA, 25 bp, Homo sapien
aaaaaggtttctatagtgaaagctg

SEQ ID NO: 575383 - DNA, 25 bp, Homo sapien
ttaagatcttcttcctctccagctg

SEQ ID NO: 575384 - DNA, 25 bp, Homo sapien
atcttcttcctctccagctggacgt

SEQ ID NO: 575385 - DNA, 25 bp, Homo sapien
agctggacgtcccagagcagtgctc

SEQ ID NO: 575386 - DNA, 25 bp, Homo sapien
gacgtcccagagcagtgctcacaga

SEQ ID NO: 575387 - DNA, 25 bp, Homo sapien
agcagtgctcacagagttctctcca

SEQ ID NO: 575388 - DNA, 25 bp, Homo sapien
tttctcagcatcctctaacatccca

SEQ ID NO: 575389 - DNA, 25 bp, Homo sapien
tctaacatcccatctttctctgtta

SEQ ID NO: 575390 - DNA, 25 bp, Homo sapien
aacatcccatctttctctgttattt

SEQ ID NO: 575391 - DNA, 25 bp, Homo sapien
aacacactatagttattatctaaat

SEQ ID NO: 575392 - DNA, 25 bp, Homo sapien
tctaaataataagcatctgttggcc

SEQ ID NO: 575393 - DNA, 25 bp, Homo sapien
taagcatctgttggccaggagcggt

SEQ ID NO: 575394 - DNA, 25 bp, Homo sapien
gacaattttctgtttgaacttcaca

SEQ ID NO: 575395 - DNA, 25 bp, Homo sapien
ctgtttgaacttcacaggactttca

SEQ ID NO: 575396 - DNA, 25 bp, Homo sapien
aggactttcagcttcttgggttggg

SEQ ID NO: 575397 - DNA, 25 bp, Homo sapien
tcagcttcttgggttgggacacatt

SEQ ID NO: 575398 - DNA, 25 bp, Homo sapien
gggacacattgtctatttgttgcgt

SEQ ID NO: 575399 - DNA, 25 bp, Homo sapien
gtggacagcaaagatcaaaaccctt

SEQ ID NO: 575400 - DNA, 25 bp, Homo sapien
gctcccctgaacagtattccaggat

SEQ ID NO: 575401 - DNA, 25 bp, Homo sapien
attccttcaccaattgaagttcaag

SEQ ID NO: 575402 - DNA, 25 bp, Homo sapien
gaagttcaagtttggtcctctgagc

SEQ ID NO: 575403 - DNA, 25 bp, Homo sapien
tggtcctctgagcaaaaagtttaga

SEQ ID NO: 575404 - DNA, 25 bp, Homo sapien
aagtttagagaagttcctttatgcg

SEQ ID NO: 575405 - DNA, 25 bp, Homo sapien
tatcccttctgtcctttagttcatg

SEQ ID NO: 575406 - DNA, 25 bp, Homo sapien
tgtcctttagttcatgctctgctca

SEQ ID NO: 575407 - DNA, 25 bp, Homo sapien
atgctctgctcattgcacaggttag

SEQ ID NO: 575408 - DNA, 25 bp, Homo sapien
taaactggtagtaacattgcttcct

SEQ ID NO: 575409 - DNA, 25 bp, Homo sapien
gtaacattgcttcctaatcatgtgt

SEQ ID NO: 575410 - DNA, 25 bp, Homo sapien
cctaatcatgtgttgagaagtcgtg

SEQ ID NO: 575411 - DNA, 25 bp, Homo sapien
gaagtcgtgaagatcagttagatga

SEQ ID NO: 575412 - DNA, 25 bp, Homo sapien
aactttttagatacgagctttgtca

SEQ ID NO: 575413 - DNA, 25 bp, Homo sapien
gtcaaagtacaaaattgatccctat

SEQ ID NO: 575414 - DNA, 25 bp, Homo sapien
aaatctatgacacagcacagccaag

SEQ ID NO: 575415 - DNA, 25 bp, Homo sapien
gccaaggccaactactgtggattct

SEQ ID NO: 575416 - DNA, 25 bp, Homo sapien
ttaagatcttcttcctctccagctg

SEQ ID NO: 575417 - DNA, 25 bp, Homo sapien
taagatcttcttcctctccagctgg

SEQ ID NO: 575418 - DNA, 25 bp, Homo sapien
aagatcttcttcctctccagctgga

SEQ ID NO: 575419 - DNA, 25 bp, Homo sapien
agatcttcttcctctccagctggac

SEQ ID NO: 575420 - DNA, 25 bp, Homo sapien
atcttcttcctctccagctggacgt

SEQ ID NO: 575421 - DNA, 25 bp, Homo sapien
tctccagctggacgtcccagagcag

SEQ ID NO: 575422 - DNA, 25 bp, Homo sapien
tccagctggacgtcccagagcagtg

SEQ ID NO: 575423 - DNA, 25 bp, Homo sapien
tttctcagcatcctctaacatccca

SEQ ID NO: 575424 - DNA, 25 bp, Homo sapien
agcatcctctaacatcccatctttc

SEQ ID NO: 575425 - DNA, 25 bp, Homo sapien
aacacactatagttattatctaaat

SEQ ID NO: 575426 - DNA, 25 bp, Homo sapien
tctaaataataagcatctgttggcc

SEQ ID NO: 575427 - DNA, 25 bp, Homo sapien
accgcaccaagtatccccaaggtgg

SEQ ID NO: 575428 - DNA, 25 bp, Homo sapien
caagtatccccaaggtggccttctc

SEQ ID NO: 575429 - DNA, 25 bp, Homo sapien
aggtggccttctccagaactcttac

SEQ ID NO: 575430 - DNA, 25 bp, Homo sapien
agaactcttactgattcccttgttt

SEQ ID NO: 575431 - DNA, 25 bp, Homo sapien
actcttactgattcccttgttttgg

SEQ ID NO: 575432 - DNA, 25 bp, Homo sapien
tactgattcccttgttttggaactc

SEQ ID NO: 575433 - DNA, 25 bp, Homo sapien
ttgttttggaactctcgggcactta

SEQ ID NO: 575434 - DNA, 25 bp, Homo sapien
gaactctcgggcacttacattaaat

SEQ ID NO: 575435 - DNA, 25 bp, Homo sapien
ggcacttacattaaatctgctttgt

SEQ ID NO: 575436 - DNA, 25 bp, Homo sapien
aaatctgctttgttagtttgctcat

SEQ ID NO: 575437 - DNA, 25 bp, Homo sapien
atctgctttgttagtttgctcatac

SEQ ID NO: 575438 - DNA, 25 bp, Homo sapien
aatattgtggattgtcgtccttgcc

SEQ ID NO: 575439 - DNA, 25 bp, Homo sapien
attgtcgtccttgccggttatatgt

SEQ ID NO: 575440 - DNA, 25 bp, Homo sapien
tccttgccggttatatgtgctgtgc

SEQ ID NO: 575441 - DNA, 25 bp, Homo sapien
gccggttatatgtgctgtgcatgct

SEQ ID NO: 575442 - DNA, 25 bp, Homo sapien
tatgtgctgtgcatgctttcttact

SEQ ID NO: 575443 - DNA, 25 bp, Homo sapien
gctgtgcatgctttcttactttaac

SEQ ID NO: 575444 - DNA, 25 bp, Homo sapien
gtgcatgctttcttactttaacctt

SEQ ID NO: 575445 - DNA, 25 bp, Homo sapien
gcatgctttcttactttaaccttta

SEQ ID NO: 575446 - DNA, 25 bp, Homo sapien
atgatggtagatattctcaatttta

SEQ ID NO: 575447 - DNA, 25 bp, Homo sapien
taatgccttcaaatttaatgctgtt

SEQ ID NO: 575448 - DNA, 25 bp, Homo sapien
tctctcctctcctaagagtaaagat

SEQ ID NO: 575449 - DNA, 25 bp, Homo sapien
gaaagtatctgcatctaccttaaaa

SEQ ID NO: 575450 - DNA, 25 bp, Homo sapien
gatgcagatgcttcaaaagctgttg

SEQ ID NO: 575451 - DNA, 25 bp, Homo sapien
aattgttacttcaacttctgctgga

SEQ ID NO: 575452 - DNA, 25 bp, Homo sapien
ttcaacttctgctggactgctccct

SEQ ID NO: 575453 - DNA, 25 bp, Homo sapien
ctgctggactgctccctacaggcgg

SEQ ID NO: 575454 - DNA, 25 bp, Homo sapien
gggcaacaattacccacagattgtg

SEQ ID NO: 575455 - DNA, 25 bp, Homo sapien
tacccacagattgtgttggctccag

SEQ ID NO: 575456 - DNA, 25 bp, Homo sapien
tgcgttctctcttcggcgtctctaa

SEQ ID NO: 575457 - DNA, 25 bp, Homo sapien
cggcgtctctaaggccgagcagttt

SEQ ID NO: 575458 - DNA, 25 bp, Homo sapien
ggccgagcagtttcctagctgcgct

SEQ ID NO: 575459 - DNA, 25 bp, Homo sapien
agtttcctagctgcgctcacgcaaa

SEQ ID NO: 575460 - DNA, 25 bp, Homo sapien
ggagattttcaaaccaggctgccat

SEQ ID NO: 575461 - DNA, 25 bp, Homo sapien
ccactcaccaccctaagtttgaata

SEQ ID NO: 575462 - DNA, 25 bp, Homo sapien
ttgaatatggactttggagctgggc

SEQ ID NO: 575463 - DNA, 25 bp, Homo sapien
ggactttggagctgggcagcccttt

SEQ ID NO: 575464 - DNA, 25 bp, Homo sapien
tgggcagcccttttgtgaccatgag

SEQ ID NO: 575465 - DNA, 25 bp, Homo sapien
gcccttttgtgaccatgaggcaaca

SEQ ID NO: 575466 - DNA, 25 bp, Homo sapien
gaagatgcaagccacatgctaagac

SEQ ID NO: 575467 - DNA, 25 bp, Homo sapien
gcatgtatgacatttcaagctctca

SEQ ID NO: 575468 - DNA, 25 bp, Homo sapien
aagctctcagatcagcccttgatgg

SEQ ID NO: 575469 - DNA, 25 bp, Homo sapien
cagatcagcccttgatggccaccat

SEQ ID NO: 575470 - DNA, 25 bp, Homo sapien
ggccaccatccatatttattgacat

SEQ ID NO: 575471 - DNA, 25 bp, Homo sapien
cacctggccccgacattggagcagg

SEQ ID NO: 575472 - DNA, 25 bp, Homo sapien
gacattggagcaggcccttctgctg

SEQ ID NO: 575473 - DNA, 25 bp, Homo sapien
ttctgctgtgaccaggctctctgga

SEQ ID NO: 575474 - DNA, 25 bp, Homo sapien
tgtgaccaggctctctggaccagcc

SEQ ID NO: 575475 - DNA, 25 bp, Homo sapien
cacctgacccgaggaacttgcgtgt

SEQ ID NO: 575476 - DNA, 25 bp, Homo sapien
ggaacttgcgtgtccctgaacttag

SEQ ID NO: 575477 - DNA, 25 bp, Homo sapien
cttgggctgctgacaggtgtttgtt

SEQ ID NO: 575478 - DNA, 25 bp, Homo sapien
gtttgttgagtccttgagcacacgg

SEQ ID NO: 575479 - DNA, 25 bp, Homo sapien
ttgagtccttgagcacacgggtgaa

SEQ ID NO: 575480 - DNA, 25 bp, Homo sapien
ctggcaggcggaagatggatcaaat

SEQ ID NO: 575481 - DNA, 25 bp, Homo sapien
atggatcaaattggtgcctgcgctg

SEQ ID NO: 575482 - DNA, 25 bp, Homo sapien
tggctggtttcaaagctgtggaatt

SEQ ID NO: 575483 - DNA, 25 bp, Homo sapien
ggctggtttcaaagctgtggaattc

SEQ ID NO: 575484 - DNA, 25 bp, Homo sapien
gctggtttcaaagctgtggaattca

SEQ ID NO: 575485 - DNA, 25 bp, Homo sapien
ctggtttcaaagctgtggaattcaa

SEQ ID NO: 575486 - DNA, 25 bp, Homo sapien
tggtttcaaagctgtggaattcaaa

SEQ ID NO: 575487 - DNA, 25 bp, Homo sapien
ggtttcaaagctgtggaattcaaag

SEQ ID NO: 575488 - DNA, 25 bp, Homo sapien
gtttcaaagctgtggaattcaaagg

SEQ ID NO: 575489 - DNA, 25 bp, Homo sapien
gaagaaaacaagcggagctgaagaa

SEQ ID NO: 575490 - DNA, 25 bp, Homo sapien
aagaaaacaagcggagctgaagaag

SEQ ID NO: 575491 - DNA, 25 bp, Homo sapien
agaaaacaagcggagctgaagaaga

SEQ ID NO: 575492 - DNA, 25 bp, Homo sapien
agagttgctgggttgaagacgtcat

SEQ ID NO: 575493 - DNA, 25 bp, Homo sapien
gacgtcatgcgtattaaattttgtt

SEQ ID NO: 575494 - DNA, 25 bp, Homo sapien
ttagctgtcgtcaaagaaccttcca

SEQ ID NO: 575495 - DNA, 25 bp, Homo sapien
acctgtttacagttccagcagcaaa

SEQ ID NO: 575496 - DNA, 25 bp, Homo sapien
gcaaagataaactgcgcatttcccc

SEQ ID NO: 575497 - DNA, 25 bp, Homo sapien
gccccaaccatctttacaaatacag

SEQ ID NO: 575498 - DNA, 25 bp, Homo sapien
actttatttgtactattccttgcca

SEQ ID NO: 575499 - DNA, 25 bp, Homo sapien
ttccttgccaatctgataagcaaac

SEQ ID NO: 575500 - DNA, 25 bp, Homo sapien
ttcagtgttgttttagtttgcgttc

SEQ ID NO: 575501 - DNA, 25 bp, Homo sapien
tttagtttgcgttcttattgtaagg

SEQ ID NO: 575502 - DNA, 25 bp, Homo sapien
gtaaggagtttgagcaccaaggaac

SEQ ID NO: 575503 - DNA, 25 bp, Homo sapien
tgaaaacactcatacagattagggt

SEQ ID NO: 575504 - DNA, 25 bp, Homo sapien
cactcatacagattagggtttttat

SEQ ID NO: 575505 - DNA, 25 bp, Homo sapien
gccgtgtcattgcaagagctggtaa

SEQ ID NO: 575506 - DNA, 25 bp, Homo sapien
tgtcattgcaagagctggtaagaat

SEQ ID NO: 575507 - DNA, 25 bp, Homo sapien
cattgcaagagctggtaagaatact

SEQ ID NO: 575508 - DNA, 25 bp, Homo sapien
caagagctggtaagaatactggtct

SEQ ID NO: 575509 - DNA, 25 bp, Homo sapien
gagctggtaagaatactggtcttgt

SEQ ID NO: 575510 - DNA, 25 bp, Homo sapien
gtaagaatactggtcttgtttccaa

SEQ ID NO: 575511 - DNA, 25 bp, Homo sapien
aagaatactggtcttgtttccaact

SEQ ID NO: 575512 - DNA, 25 bp, Homo sapien
gaatactggtcttgtttccaactga

SEQ ID NO: 575513 - DNA, 25 bp, Homo sapien
atactggtcttgtttccaactgatg

SEQ ID NO: 575514 - DNA, 25 bp, Homo sapien
agaggcattgtcagtgtgtttgtca

SEQ ID NO: 575515 - DNA, 25 bp, Homo sapien
gtcagtgtgtttgtcaaagtgtctc

SEQ ID NO: 575516 - DNA, 25 bp, Homo sapien
tttgtcaaagtgtctctgatgaacc

SEQ ID NO: 575517 - DNA, 25 bp, Homo sapien
agacttcagctgtgctgggctccat

SEQ ID NO: 575518 - DNA, 25 bp, Homo sapien
ttcagctgtgctgggctccatcaac

SEQ ID NO: 575519 - DNA, 25 bp, Homo sapien
gctccatcaaccctgtgtacaatga

SEQ ID NO: 575520 - DNA, 25 bp, Homo sapien
aaccctgtgtacaatgagaccttca

SEQ ID NO: 575521 - DNA, 25 bp, Homo sapien
tgtgtacaatgagaccttcagcttc

SEQ ID NO: 575522 - DNA, 25 bp, Homo sapien
atgagaccttcagcttcaaggccga

SEQ ID NO: 575523 - DNA, 25 bp, Homo sapien
agaccttcagcttcaaggccgatgc

SEQ ID NO: 575524 - DNA, 25 bp, Homo sapien
aaggccgatgccaccgagctggata

SEQ ID NO: 575525 - DNA, 25 bp, Homo sapien
ggaaaaggccacagttatcacagcg

SEQ ID NO: 575526 - DNA, 25 bp, Homo sapien
gaaaaggccacagttatcacagcga

SEQ ID NO: 575527 - DNA, 25 bp, Homo sapien
aaaaggccacagttatcacagcgaa

SEQ ID NO: 575528 - DNA, 25 bp, Homo sapien
aaaggccacagttatcacagcgaag

SEQ ID NO: 575529 - DNA, 25 bp, Homo sapien
aaggccacagttatcacagcgaaga

SEQ ID NO: 575530 - DNA, 25 bp, Homo sapien
aggccacagttatcacagcgaagaa

SEQ ID NO: 575531 - DNA, 25 bp, Homo sapien
ggccacagttatcacagcgaagaac

SEQ ID NO: 575532 - DNA, 25 bp, Homo sapien
gccacagttatcacagcgaagaaca

SEQ ID NO: 575533 - DNA, 25 bp, Homo sapien
cacagttatcacagcgaagaacaag

SEQ ID NO: 575534 - DNA, 25 bp, Homo sapien
agttatcacagcgaagaacaagaga

SEQ ID NO: 575535 - DNA, 25 bp, Homo sapien
ttatcacagcgaagaacaagagaaa

SEQ ID NO: 575536 - DNA, 25 bp, Homo sapien
tctgccattctagttcattgagcat

SEQ ID NO: 575537 - DNA, 25 bp, Homo sapien
gccattctagttcattgagcatttt

SEQ ID NO: 575538 - DNA, 25 bp, Homo sapien
cattctagttcattgagcattttaa

SEQ ID NO: 575539 - DNA, 25 bp, Homo sapien
aagattgattaactcaagaccagca

SEQ ID NO: 575540 - DNA, 25 bp, Homo sapien
gtattcaactactctaattattgca

SEQ ID NO: 575541 - DNA, 25 bp, Homo sapien
ctactctaattattgcaacactttt

SEQ ID NO: 575542 - DNA, 25 bp, Homo sapien
atcatgtcactgcatattgcatgaa

SEQ ID NO: 575543 - DNA, 25 bp, Homo sapien
ctgcatattgcatgaaattctgact

SEQ ID NO: 575544 - DNA, 25 bp, Homo sapien
atattgcatgaaattctgactatca

SEQ ID NO: 575545 - DNA, 25 bp, Homo sapien
tctgactatcatgtttggaatttta

SEQ ID NO: 575546 - DNA, 25 bp, Homo sapien
gactatcatgtttggaattttatta

SEQ ID NO: 575547 - DNA, 25 bp, Homo sapien
cccagcaaggtcagtaggtctccaa

SEQ ID NO: 575548 - DNA, 25 bp, Homo sapien
agcaaggtcagtaggtctccaagga

SEQ ID NO: 575549 - DNA, 25 bp, Homo sapien
taggtctccaaggacttgtgtcccc

SEQ ID NO: 575550 - DNA, 25 bp, Homo sapien
aggtctccaaggacttgtgtccccg

SEQ ID NO: 575551 - DNA, 25 bp, Homo sapien
tccaaggacttgtgtccccgctgct

SEQ ID NO: 575552 - DNA, 25 bp, Homo sapien
tgctgctcatctgatcactgagaag

SEQ ID NO: 575553 - DNA, 25 bp, Homo sapien
gctgctcatctgatcactgagaaga

SEQ ID NO: 575554 - DNA, 25 bp, Homo sapien
gctcatctgatcactgagaagagga

SEQ ID NO: 575555 - DNA, 25 bp, Homo sapien
aggcctgtgtgggaacacacggtca

SEQ ID NO: 575556 - DNA, 25 bp, Homo sapien
tgtgggaacacacggtcattctagg

SEQ ID NO: 575557 - DNA, 25 bp, Homo sapien
aacacacggtcattctaggggcctt

SEQ ID NO: 575558 - DNA, 25 bp, Homo sapien
gcctggacacgtacacgcacgtgaa

SEQ ID NO: 575559 - DNA, 25 bp, Homo sapien
gacacgtacacgcacgtgaacggct

SEQ ID NO: 575560 - DNA, 25 bp, Homo sapien
acgtacacgcacgtgaacggctggg

SEQ ID NO: 575561 - DNA, 25 bp, Homo sapien
ccaacggcgcgtactcgctggtgca

SEQ ID NO: 575562 - DNA, 25 bp, Homo sapien
gacatggccggcctgcagtacagcc

SEQ ID NO: 575563 - DNA, 25 bp, Homo sapien
ggcctgcagtacagcccaatgatgc

SEQ ID NO: 575564 - DNA, 25 bp, Homo sapien
agtacagcccaatgatgccgcccgg

SEQ ID NO: 575565 - DNA, 25 bp, Homo sapien
cggcgctcagagctacatgaacgtc

SEQ ID NO: 575566 - DNA, 25 bp, Homo sapien
gctcagagctacatgaacgtcgctg

SEQ ID NO: 575567 - DNA, 25 bp, Homo sapien
agagctacatgaacgtcgctgccgc

SEQ ID NO: 575568 - DNA, 25 bp, Homo sapien
gctacatgaacgtcgctgccgcggc

SEQ ID NO: 575569 - DNA, 25 bp, Homo sapien
acagcaaatacatcctacgacggcc

SEQ ID NO: 575570 - DNA, 25 bp, Homo sapien
tacgacggccctgtgcaatatttgg

SEQ ID NO: 575571 - DNA, 25 bp, Homo sapien
ttgggacaatactcttcttcagctt

SEQ ID NO: 575572 - DNA, 25 bp, Homo sapien
caagaatatgtctctcttcagtatt

SEQ ID NO: 575573 - DNA, 25 bp, Homo sapien
ttcattcctgccttgtaaaaattca

SEQ ID NO: 575574 - DNA, 25 bp, Homo sapien
acagaccctgagttaattgggttga

SEQ ID NO: 575575 - DNA, 25 bp, Homo sapien
gaaaatttggaccttcactgactta

SEQ ID NO: 575576 - DNA, 25 bp, Homo sapien
ggaccttcactgacttatgcagggc

SEQ ID NO: 575577 - DNA, 25 bp, Homo sapien
ctgacttatgcagggcgtatatttt

SEQ ID NO: 575578 - DNA, 25 bp, Homo sapien
gcgtatattttgttgagcccttcct

SEQ ID NO: 575579 - DNA, 25 bp, Homo sapien
tgagcccttcctcctttgcaaaatt

SEQ ID NO: 575580 - DNA, 25 bp, Homo sapien
ggagtgcactgaaagcatgtccagt

SEQ ID NO: 575581 - DNA, 25 bp, Homo sapien
atgtccagtgctactccttctcata

SEQ ID NO: 575582 - DNA, 25 bp, Homo sapien
ccacggctcactgaatcagctttag

SEQ ID NO: 575583 - DNA, 25 bp, Homo sapien
tgagggcttcccttgtggcctggat

SEQ ID NO: 575584 - DNA, 25 bp, Homo sapien
aggttccccagtaggagtgcatatc

SEQ ID NO: 575585 - DNA, 25 bp, Homo sapien
ggagtgcatatcctagaggtagttt

SEQ ID NO: 575586 - DNA, 25 bp, Homo sapien
agaggtagtttatcctcctctcaca

SEQ ID NO: 575587 - DNA, 25 bp, Homo sapien
ggacttagagttttccatctgcctc

SEQ ID NO: 575588 - DNA, 25 bp, Homo sapien
ttttccatctgcctcgtagtaagtt

SEQ ID NO: 575589 - DNA, 25 bp, Homo sapien
ctgcctcgtagtaagtttctgggtt

SEQ ID NO: 575590 - DNA, 25 bp, Homo sapien
agtggtagaggcatgctcacagtgc

SEQ ID NO: 575591 - DNA, 25 bp, Homo sapien
aatgcctataattggtttgggtcac

SEQ ID NO: 575592 - DNA, 25 bp, Homo sapien
tggtttgggtcacaatgtacatatt

SEQ ID NO: 575593 - DNA, 25 bp, Homo sapien
taagtatcaacttccaggtacacaa

SEQ ID NO: 575594 - DNA, 25 bp, Homo sapien
gtatcaacttccaggtacacaatga

SEQ ID NO: 575595 - DNA, 25 bp, Homo sapien
tccaggtacacaatgaagttttaaa

SEQ ID NO: 575596 - DNA, 25 bp, Homo sapien
tgtttatctgtgacatatgaagaac

SEQ ID NO: 575597 - DNA, 25 bp, Homo sapien
gaagaacaaagcaatctaaactgat

SEQ ID NO: 575598 - DNA, 25 bp, Homo sapien
gcaatctaaactgatgtaagcaggc

SEQ ID NO: 575599 - DNA, 25 bp, Homo sapien
gtaagcaggctgtcataaggtacat

SEQ ID NO: 575600 - DNA, 25 bp, Homo sapien
caggctgtcataaggtacatgctga

SEQ ID NO: 575601 - DNA, 25 bp, Homo sapien
cataaggtacatgctgaggaattta

SEQ ID NO: 575602 - DNA, 25 bp, Homo sapien
cactatgggtagcaagtaaccactt

SEQ ID NO: 575603 - DNA, 25 bp, Homo sapien
gggtagcaagtaaccacttacaaat

SEQ ID NO: 575604 - DNA, 25 bp, Homo sapien
aatgtaatatacactccttttctgt

SEQ ID NO: 575605 - DNA, 25 bp, Homo sapien
ctgtgtgtcaagtccttatttttag

SEQ ID NO: 575606 - DNA, 25 bp, Homo sapien
agtccttatttttaggtgcatattg

SEQ ID NO: 575607 - DNA, 25 bp, Homo sapien
tatttattttatgctgttacagtta

SEQ ID NO: 575608 - DNA, 25 bp, Homo sapien
gacatactgaatcaacttgccttcc

SEQ ID NO: 575609 - DNA, 25 bp, Homo sapien
ttgccttccaatttagtgtgtaata

SEQ ID NO: 575610 - DNA, 25 bp, Homo sapien
tatggtaagcatttatacttttaga

SEQ ID NO: 575611 - DNA, 25 bp, Homo sapien
gtcttatttttatttggatgcctgt

SEQ ID NO: 575612 - DNA, 25 bp, Homo sapien
atttggatgcctgtctaccaaaaaa

SEQ ID NO: 575613 - DNA, 25 bp, Homo sapien
gccacatcaagggaaaggacacact

SEQ ID NO: 575614 - DNA, 25 bp, Homo sapien
gaaaggacacactcgtttgcagatc

SEQ ID NO: 575615 - DNA, 25 bp, Homo sapien
acacactcgtttgcagatcattctg

SEQ ID NO: 575616 - DNA, 25 bp, Homo sapien
aatagatgacagagagccccttgct

SEQ ID NO: 575617 - DNA, 25 bp, Homo sapien
gagagccccttgctaatgcaatcaa

SEQ ID NO: 575618 - DNA, 25 bp, Homo sapien
gcaatcaaaagtgactctgcagtaa

SEQ ID NO: 575619 - DNA, 25 bp, Homo sapien
gactctgcagtaattggaggtctga

SEQ ID NO: 575620 - DNA, 25 bp, Homo sapien
ggaggtctgatagctgttgtgattt

SEQ ID NO: 575621 - DNA, 25 bp, Homo sapien
atcactgccatagctgttcgcattt

SEQ ID NO: 575622 - DNA, 25 bp, Homo sapien
agctgttcgcatttatcagcagaaa

SEQ ID NO: 575623 - DNA, 25 bp, Homo sapien
tagacagtgctgaggctgttctgaa

SEQ ID NO: 575624 - DNA, 25 bp, Homo sapien
ggtgatgggccatgtgaaagccaat

SEQ ID NO: 575625 - DNA, 25 bp, Homo sapien
gaaagccaataggtcacatgctgct

SEQ ID NO: 575626 - DNA, 25 bp, Homo sapien
aggtcacatgctgctaatgggtcaa

SEQ ID NO: 575627 - DNA, 25 bp, Homo sapien
acatgctgctaatgggtcaactaaa

SEQ ID NO: 575628 - DNA, 25 bp, Homo sapien
atgggtcaactaaagtgaggactga

SEQ ID NO: 575629 - DNA, 25 bp, Homo sapien
atgtggagctcattggtgaccctca

SEQ ID NO: 575630 - DNA, 25 bp, Homo sapien
gtggagctcattggtgaccctcata

SEQ ID NO: 575631 - DNA, 25 bp, Homo sapien
tggtgaccctcataagagctgtgtt

SEQ ID NO: 575632 - DNA, 25 bp, Homo sapien
cctcataagagctgtgttggtggaa

SEQ ID NO: 575633 - DNA, 25 bp, Homo sapien
gcatgtaaacaactctttcacggaa

SEQ ID NO: 575634 - DNA, 25 bp, Homo sapien
acaactctttcacggaactttgtat

SEQ ID NO: 575635 - DNA, 25 bp, Homo sapien
tcaggaagtgggtattaattctcac

SEQ ID NO: 575636 - DNA, 25 bp, Homo sapien
attaagcaccagagtttaagtagct

SEQ ID NO: 575637 - DNA, 25 bp, Homo sapien
ccactgaaagagattcaactgtgtg

SEQ ID NO: 575638 - DNA, 25 bp, Homo sapien
gaaagagattcaactgtgtggaacc

SEQ ID NO: 575639 - DNA, 25 bp, Homo sapien
aagagattcaactgtgtggaaccta

SEQ ID NO: 575640 - DNA, 25 bp, Homo sapien
agagattcaactgtgtggaacctat

SEQ ID NO: 575641 - DNA, 25 bp, Homo sapien
gagattcaactgtgtggaacctatg

SEQ ID NO: 575642 - DNA, 25 bp, Homo sapien
gattcaactgtgtggaacctatgcc

SEQ ID NO: 575643 - DNA, 25 bp, Homo sapien
attcaactgtgtggaacctatgccg

SEQ ID NO: 575644 - DNA, 25 bp, Homo sapien
ggagaattgctttctgccattgtta

SEQ ID NO: 575645 - DNA, 25 bp, Homo sapien
gagaattgctttctgccattgttat

SEQ ID NO: 575646 - DNA, 25 bp, Homo sapien
ttgacctcaggtagtccgccttcct

SEQ ID NO: 575647 - DNA, 25 bp, Homo sapien
atgcccggccagcttcttaatgaaa

SEQ ID NO: 575648 - DNA, 25 bp, Homo sapien
gcccggccagcttcttaatgaaata

SEQ ID NO: 575649 - DNA, 25 bp, Homo sapien
ccggccagcttcttaatgaaatatt

SEQ ID NO: 575650 - DNA, 25 bp, Homo sapien
tcctataaataaagtgggtaatccg

SEQ ID NO: 575651 - DNA, 25 bp, Homo sapien
gtgggtaatccggttataatatgtt

SEQ ID NO: 575652 - DNA, 25 bp, Homo sapien
tgggtaatccggttataatatgttt

SEQ ID NO: 575653 - DNA, 25 bp, Homo sapien
taatccggttataatatgtttttca

SEQ ID NO: 575654 - DNA, 25 bp, Homo sapien
tccggttataatatgtttttcacag

SEQ ID NO: 575655 - DNA, 25 bp, Homo sapien
gtttttcacaggaattaataaatct

SEQ ID NO: 575656 - DNA, 25 bp, Homo sapien
ttcacaggaattaataaatctattt

SEQ ID NO: 575657 - DNA, 25 bp, Homo sapien
gttgaacaaataactctgccagaga

SEQ ID NO: 575658 - DNA, 25 bp, Homo sapien
aactctgccagagatacaacacatg

SEQ ID NO: 575659 - DNA, 25 bp, Homo sapien
gccagagatacaacacatgctaaat

SEQ ID NO: 575660 - DNA, 25 bp, Homo sapien
tattttgtattaatgccactacatt

SEQ ID NO: 575661 - DNA, 25 bp, Homo sapien
atgccactacattatagtttccatt

SEQ ID NO: 575662 - DNA, 25 bp, Homo sapien
tatagtttccattatgagccaccaa

SEQ ID NO: 575663 - DNA, 25 bp, Homo sapien
aaattaatttgctatctgctttgcc

SEQ ID NO: 575664 - DNA, 25 bp, Homo sapien
ttaatttgctatctgctttgcccac

SEQ ID NO: 575665 - DNA, 25 bp, Homo sapien
atttgctatctgctttgcccacaat

SEQ ID NO: 575666 - DNA, 25 bp, Homo sapien
gctatctgctttgcccacaatgtaa

SEQ ID NO: 575667 - DNA, 25 bp, Homo sapien
tctgctttgcccacaatgtaaaata

SEQ ID NO: 575668 - DNA, 25 bp, Homo sapien
ggattattgactttgaatgccacag

SEQ ID NO: 575669 - DNA, 25 bp, Homo sapien
tgaatgccacagaccaactacttta

SEQ ID NO: 575670 - DNA, 25 bp, Homo sapien
tgccacagaccaactactttacata

SEQ ID NO: 575671 - DNA, 25 bp, Homo sapien
gtgctttgggtcactggcaaaagtt

SEQ ID NO: 575672 - DNA, 25 bp, Homo sapien
ccagaaacctttttgttcacgtctg

SEQ ID NO: 575673 - DNA, 25 bp, Homo sapien
acctttttgttcacgtctgaaattg

SEQ ID NO: 575674 - DNA, 25 bp, Homo sapien
ttagtatgtttcctgccttgataag

SEQ ID NO: 575675 - DNA, 25 bp, Homo sapien
gtttcctgccttgataagttcacct

SEQ ID NO: 575676 - DNA, 25 bp, Homo sapien
gccttgataagttcacctatattga

SEQ ID NO: 575677 - DNA, 25 bp, Homo sapien
tttgaataccagtgttcaccatgtt

SEQ ID NO: 575678 - DNA, 25 bp, Homo sapien
accagtgttcaccatgttataaagt

SEQ ID NO: 575679 - DNA, 25 bp, Homo sapien
atcgtcagtaacctgtgtaccttct

SEQ ID NO: 575680 - DNA, 25 bp, Homo sapien
gtcagtaacctgtgtaccttctcaa

SEQ ID NO: 575681 - DNA, 25 bp, Homo sapien
cagtaacctgtgtaccttctcaaaa

SEQ ID NO: 575682 - DNA, 25 bp, Homo sapien
taacctgtgtaccttctcaaaacct

SEQ ID NO: 575683 - DNA, 25 bp, Homo sapien
cctgtgtaccttctcaaaacctatg

SEQ ID NO: 575684 - DNA, 25 bp, Homo sapien
gtgtaccttctcaaaacctatgtct

SEQ ID NO: 575685 - DNA, 25 bp, Homo sapien
gtaccttctcaaaacctatgtctgt

SEQ ID NO: 575686 - DNA, 25 bp, Homo sapien
accttctcaaaacctatgtctgttg

SEQ ID NO: 575687 - DNA, 25 bp, Homo sapien
tctcaaaacctatgtctgttgcact

SEQ ID NO: 575688 - DNA, 25 bp, Homo sapien
caaaacctatgtctgttgcactgag

SEQ ID NO: 575689 - DNA, 25 bp, Homo sapien
aatccaacactaacaaatgttcttt

SEQ ID NO: 575690 - DNA, 25 bp, Homo sapien
aatttggggtcctatacacttgaga

SEQ ID NO: 575691 - DNA, 25 bp, Homo sapien
ggggtcctatacacttgagacatgc

SEQ ID NO: 575692 - DNA, 25 bp, Homo sapien
cccttacaagaataccacattttga

SEQ ID NO: 575693 - DNA, 25 bp, Homo sapien
aagaatattgcggagaggttggaaa

SEQ ID NO: 575694 - DNA, 25 bp, Homo sapien
gaaagcaggatttaacctctagttc

SEQ ID NO: 575695 - DNA, 25 bp, Homo sapien
gcaggatttaacctctagttctctt

SEQ ID NO: 575696 - DNA, 25 bp, Homo sapien
ggatttaacctctagttctcttgtt

SEQ ID NO: 575697 - DNA, 25 bp, Homo sapien
tttaacctctagttctcttgttctc

SEQ ID NO: 575698 - DNA, 25 bp, Homo sapien
tgttctcagagaacagcaggttgat

SEQ ID NO: 575699 - DNA, 25 bp, Homo sapien
gcaggttgatagtagattatgtctc

SEQ ID NO: 575700 - DNA, 25 bp, Homo sapien
atagtagattatgtctctaggtaga

SEQ ID NO: 575701 - DNA, 25 bp, Homo sapien
tctttggcatggcttccatggtggc

SEQ ID NO: 575702 - DNA, 25 bp, Homo sapien
atggcttccatggtggctttctggc

SEQ ID NO: 575703 - DNA, 25 bp, Homo sapien
atggtggctttctggctgtccgcct

SEQ ID NO: 575704 - DNA, 25 bp, Homo sapien
tggacctctgcacacagctcttcca

SEQ ID NO: 575705 - DNA, 25 bp, Homo sapien
tggccttcacctacctcaacagtgt

SEQ ID NO: 575706 - DNA, 25 bp, Homo sapien
tcacctacctcaacagtgtcctgga

SEQ ID NO: 575707 - DNA, 25 bp, Homo sapien
tctactgcttctctagccccaactt

SEQ ID NO: 575708 - DNA, 25 bp, Homo sapien
agagccgggccttgctgggcctcac

SEQ ID NO: 575709 - DNA, 25 bp, Homo sapien
caccatccggaaccgtggtctgggc

SEQ ID NO: 575710 - DNA, 25 bp, Homo sapien
gtggtggccgtctacaccatctgct

SEQ ID NO: 575711 - DNA, 25 bp, Homo sapien
ggccgtctacaccatctgcttcttg

SEQ ID NO: 575712 - DNA, 25 bp, Homo sapien
gaagttgcctcaatgaaagtgccta

SEQ ID NO: 575713 - DNA, 25 bp, Homo sapien
ttgcctcaatgaaagtgcctagagc

SEQ ID NO: 575714 - DNA, 25 bp, Homo sapien
agtgcctagagcaggcatgtgtgtt

SEQ ID NO: 575715 - DNA, 25 bp, Homo sapien
caggcatgtgtgttgtggcagtcaa

SEQ ID NO: 575716 - DNA, 25 bp, Homo sapien
gtgttgtggcagtcaatggtcttct

SEQ ID NO: 575717 - DNA, 25 bp, Homo sapien
gtcaatggtcttctgtatgtttctg

SEQ ID NO: 575718 - DNA, 25 bp, Homo sapien
ggtcttctgtatgtttctggaggtc

SEQ ID NO: 575719 - DNA, 25 bp, Homo sapien
tgtatgtttctggaggtcgatcttc

SEQ ID NO: 575720 - DNA, 25 bp, Homo sapien
tggaggtcgatcttccagccatgat

SEQ ID NO: 575721 - DNA, 25 bp, Homo sapien
gtcgatcttccagccatgatttttt

SEQ ID NO: 575722 - DNA, 25 bp, Homo sapien
tccagccatgattttttggctccag

SEQ ID NO: 575723 - DNA, 25 bp, Homo sapien
tacatggttttccaagaagggttga

SEQ ID NO: 575724 - DNA, 25 bp, Homo sapien
agggttgaacctgccacagggttgt

SEQ ID NO: 575725 - DNA, 25 bp, Homo sapien
gggttgtgctactgtaatgtctcca

SEQ ID NO: 575726 - DNA, 25 bp, Homo sapien
taatgtctccatgcgtcacttggac

SEQ ID NO: 575727 - DNA, 25 bp, Homo sapien
cgtcacttggactaaatctctctaa

SEQ ID NO: 575728 - DNA, 25 bp, Homo sapien
ggactaaatctctctaattccattg

SEQ ID NO: 575729 - DNA, 25 bp, Homo sapien
taattccattgattagagtcacaaa

SEQ ID NO: 575730 - DNA, 25 bp, Homo sapien
tatgttaagttccaatatttttctg

SEQ ID NO: 575731 - DNA, 25 bp, Homo sapien
ttttctgacttgattggaacctgct

SEQ ID NO: 575732 - DNA, 25 bp, Homo sapien
ggaacctgcttctctgtgaggctat

SEQ ID NO: 575733 - DNA, 25 bp, Homo sapien
gcttctctgtgaggctatttttgta

SEQ ID NO: 575734 - DNA, 25 bp, Homo sapien
tgggtgcccgccatgtcaaatggct

SEQ ID NO: 575735 - DNA, 25 bp, Homo sapien
aggaaagttacagccactggcaacg

SEQ ID NO: 575736 - DNA, 25 bp, Homo sapien
acagccactggcaacggcgggatta

SEQ ID NO: 575737 - DNA, 25 bp, Homo sapien
cggcgggattacaaaggcttctctc

SEQ ID NO: 575738 - DNA, 25 bp, Homo sapien
acaaaggcttctctccatctgtgga

SEQ ID NO: 575739 - DNA, 25 bp, Homo sapien
tccatctgtggactgggagactgta

SEQ ID NO: 575740 - DNA, 25 bp, Homo sapien
gactgtagattttgactctgctcca

SEQ ID NO: 575741 - DNA, 25 bp, Homo sapien
tagattttgactctgctccatccat

SEQ ID NO: 575742 - DNA, 25 bp, Homo sapien
gctccatccattcaggaacttcctg

SEQ ID NO: 575743 - DNA, 25 bp, Homo sapien
aggaacttcctgtccagtccgccat

SEQ ID NO: 575744 - DNA, 25 bp, Homo sapien
gaggtgaccatcaagggctatgcat

SEQ ID NO: 575745 - DNA, 25 bp, Homo sapien
caggcctgtaactgtgaccagtacc

SEQ ID NO: 575746 - DNA, 25 bp, Homo sapien
ggcctgtaactgtgaccagtaccta

SEQ ID NO: 575747 - DNA, 25 bp, Homo sapien
gcctgtaactgtgaccagtacctaa

SEQ ID NO: 575748 - DNA, 25 bp, Homo sapien
gtaactgtgaccagtacctaaaggt

SEQ ID NO: 575749 - DNA, 25 bp, Homo sapien
gtgaccagtacctaaaggtctccag

SEQ ID NO: 575750 - DNA, 25 bp, Homo sapien
taaaggtctccagggacatgatgaa

SEQ ID NO: 575751 - DNA, 25 bp, Homo sapien
ccagggacatgatgaagcagctcat

SEQ ID NO: 575752 - DNA, 25 bp, Homo sapien
gggacatgatgaagcagctcatgtg

SEQ ID NO: 575753 - DNA, 25 bp, Homo sapien
agctcatgtggctcagcagtcacca

SEQ ID NO: 575754 - DNA, 25 bp, Homo sapien
tcatgtggctcagcagtcaccagga

SEQ ID NO: 575755 - DNA, 25 bp, Homo sapien
atgtggctcagcagtcaccaggagg

SEQ ID NO: 575756 - DNA, 25 bp, Homo sapien
aaaccacagaagacgatcttgagga

SEQ ID NO: 575757 - DNA, 25 bp, Homo sapien
gacgatcttgaggaagtcaaccact

SEQ ID NO: 575758 - DNA, 25 bp, Homo sapien
ggaagtcaaccactacaaccgtgtg

SEQ ID NO: 575759 - DNA, 25 bp, Homo sapien
cactacaaccgtgtgatgtatgcca

SEQ ID NO: 575760 - DNA, 25 bp, Homo sapien
agtaatgagcactttctactcaagc

SEQ ID NO: 575761 - DNA, 25 bp, Homo sapien
aagcccaaatatattaatcctgcat

SEQ ID NO: 575762 - DNA, 25 bp, Homo sapien
aatcctgcattcagcaaagtggcat

SEQ ID NO: 575763 - DNA, 25 bp, Homo sapien
gtggcataaaaatcacctggtaagt

SEQ ID NO: 575764 - DNA, 25 bp, Homo sapien
tcacctggtaagtatgcagcacatt

SEQ ID NO: 575765 - DNA, 25 bp, Homo sapien
gcagcacattgcttatatcctgggt

SEQ ID NO: 575766 - DNA, 25 bp, Homo sapien
atatcctgggtatgcattattttaa

SEQ ID NO: 575767 - DNA, 25 bp, Homo sapien
gacttctgaaatagagctggctccc

SEQ ID NO: 575768 - DNA, 25 bp, Homo sapien
tctgaaatagagctggctccctggg

SEQ ID NO: 575769 - DNA, 25 bp, Homo sapien
gtggcatcctcatgtttgcacactt

SEQ ID NO: 575770 - DNA, 25 bp, Homo sapien
tcatgtttgcacactttccccaggc

SEQ ID NO: 575771 - DNA, 25 bp, Homo sapien
gggcaaggacctctcatggacactg

SEQ ID NO: 575772 - DNA, 25 bp, Homo sapien
caaggacctctcatggacactggcc

SEQ ID NO: 575773 - DNA, 25 bp, Homo sapien
gatgaattctgttataacctatggg

SEQ ID NO: 575774 - DNA, 25 bp, Homo sapien
ggatatgagtcctgggcattattta

SEQ ID NO: 575775 - DNA, 25 bp, Homo sapien
ggcattatttatccaggacccatcc

SEQ ID NO: 575776 - DNA, 25 bp, Homo sapien
atttatccaggacccatcctcttgg

SEQ ID NO: 575777 - DNA, 25 bp, Homo sapien
gacccatcctcttgggtgggttttg

SEQ ID NO: 575778 - DNA, 25 bp, Homo sapien
gcaatgggacccatcgcggaaccat

SEQ ID NO: 575779 - DNA, 25 bp, Homo sapien
atcgcggaaccatcggcacatatac

SEQ ID NO: 575780 - DNA, 25 bp, Homo sapien
ggaaccatcggcacatataccaagt

SEQ ID NO: 575781 - DNA, 25 bp, Homo sapien
atcggcacatataccaagtcctcct

SEQ ID NO: 575782 - DNA, 25 bp, Homo sapien
atataccaagtcctcctctcatgac

SEQ ID NO: 575783 - DNA, 25 bp, Homo sapien
aagtcctcctctcatgactcaaagt

SEQ ID NO: 575784 - DNA, 25 bp, Homo sapien
tcctctcatgactcaaagtccactg

SEQ ID NO: 575785 - DNA, 25 bp, Homo sapien
aaagtccactgcagcctaggagggt

SEQ ID NO: 575786 - DNA, 25 bp, Homo sapien
tccactgcagcctaggagggtgttt

SEQ ID NO: 575787 - DNA, 25 bp, Homo sapien
actgcagcctaggagggtgtttccc

SEQ ID NO: 575788 - DNA, 25 bp, Homo sapien
cagcctaggagggtgtttcccagaa

SEQ ID NO: 575789 - DNA, 25 bp, Homo sapien
ctcacaataaaccagtgtaaaagag

SEQ ID NO: 575790 - DNA, 25 bp, Homo sapien
caataaaccagtgtaaaagagaata

SEQ ID NO: 575791 - DNA, 25 bp, Homo sapien
ctgtaatctcaaaactttagaagtc

SEQ ID NO: 575792 - DNA, 25 bp, Homo sapien
tgtaatctcaaaactttagaagtcc

SEQ ID NO: 575793 - DNA, 25 bp, Homo sapien
gtaatctcaaaactttagaagtcca

SEQ ID NO: 575794 - DNA, 25 bp, Homo sapien
taatctcaaaactttagaagtccaa

SEQ ID NO: 575795 - DNA, 25 bp, Homo sapien
ccagccagagcaatgtgatgaaaca

SEQ ID NO: 575796 - DNA, 25 bp, Homo sapien
cagccagagcaatgtgatgaaacac

SEQ ID NO: 575797 - DNA, 25 bp, Homo sapien
agccagagcaatgtgatgaaacaca

SEQ ID NO: 575798 - DNA, 25 bp, Homo sapien
gccagagcaatgtgatgaaacacat

SEQ ID NO: 575799 - DNA, 25 bp, Homo sapien
gagcaatgtgatgaaacacatctct

SEQ ID NO: 575800 - DNA, 25 bp, Homo sapien
acccaagcagccaaagcagtgtcga

SEQ ID NO: 575801 - DNA, 25 bp, Homo sapien
gcagccaaagcagtgtcgacctgga

SEQ ID NO: 575802 - DNA, 25 bp, Homo sapien
agtgtcgacctggacttgaactaaa

SEQ ID NO: 575803 - DNA, 25 bp, Homo sapien
gtcgacctggacttgaactaaagga

SEQ ID NO: 575804 - DNA, 25 bp, Homo sapien
actaaaggaagggcctctgctgact

SEQ ID NO: 575805 - DNA, 25 bp, Homo sapien
tgactcctaccagagcatccgtcca

SEQ ID NO: 575806 - DNA, 25 bp, Homo sapien
gggccccacttctctggatcagaga

SEQ ID NO: 575807 - DNA, 25 bp, Homo sapien
ggatcagagaccctgcctctgtttg

SEQ ID NO: 575808 - DNA, 25 bp, Homo sapien
tgtttgaccccgcactgactgaata

SEQ ID NO: 575809 - DNA, 25 bp, Homo sapien
gaccccgcactgactgaataaagct

SEQ ID NO: 575810 - DNA, 25 bp, Homo sapien
ccgcactgactgaataaagctcctc

SEQ ID NO: 575811 - DNA, 25 bp, Homo sapien
gggctgcgttctgacacctgttgga

SEQ ID NO: 575812 - DNA, 25 bp, Homo sapien
gcgttctgacacctgttggacagta

SEQ ID NO: 575813 - DNA, 25 bp, Homo sapien
gttctgacacctgttggacagtaaa

SEQ ID NO: 575814 - DNA, 25 bp, Homo sapien
gacacctgttggacagtaaatccca

SEQ ID NO: 575815 - DNA, 25 bp, Homo sapien
caggagggtcctaaggataacttca

SEQ ID NO: 575816 - DNA, 25 bp, Homo sapien
aggagggtcctaaggataacttcag

SEQ ID NO: 575817 - DNA, 25 bp, Homo sapien
ggagggtcctaaggataacttcagg

SEQ ID NO: 575818 - DNA, 25 bp, Homo sapien
gagggtcctaaggataacttcagga

SEQ ID NO: 575819 - DNA, 25 bp, Homo sapien
aactgtgtggaacctatgccgcgga

SEQ ID NO: 575820 - DNA, 25 bp, Homo sapien
tatgccgcggagaattgctttctgc

SEQ ID NO: 575821 - DNA, 25 bp, Homo sapien
tgctttctgccattgttattgtcca

SEQ ID NO: 575822 - DNA, 25 bp, Homo sapien
gcccagctgtcccttaacatttgaa

SEQ ID NO: 575823 - DNA, 25 bp, Homo sapien
gtgtatatcacctcatttagctatt

SEQ ID NO: 575824 - DNA, 25 bp, Homo sapien
tcacctcatttagctattctgtttc

SEQ ID NO: 575825 - DNA, 25 bp, Homo sapien
aattcacaaatgcacacggaaatgt

SEQ ID NO: 575826 - DNA, 25 bp, Homo sapien
tgaagatacttgtcacagcgttggt

SEQ ID NO: 575827 - DNA, 25 bp, Homo sapien
acttgtcacagcgttggttgtaata

SEQ ID NO: 575828 - DNA, 25 bp, Homo sapien
cagcgttggttgtaataatatggaa

SEQ ID NO: 575829 - DNA, 25 bp, Homo sapien
ggaattaggtcaaatatttatcagt

SEQ ID NO: 575830 - DNA, 25 bp, Homo sapien
aaagactaagtcatattgtgcatat

SEQ ID NO: 575831 - DNA, 25 bp, Homo sapien
aagtcatattgtgcatatactgaaa

SEQ ID NO: 575832 - DNA, 25 bp, Homo sapien
tgtgataaacctaaatttactgccc

SEQ ID NO: 575833 - DNA, 25 bp, Homo sapien
ttcactccttcgatgctaactcatc

SEQ ID NO: 575834 - DNA, 25 bp, Homo sapien
actccttcgatgctaactcatcaac

SEQ ID NO: 575835 - DNA, 25 bp, Homo sapien
ttcgatgctaactcatcaacttgta

SEQ ID NO: 575836 - DNA, 25 bp, Homo sapien
gctaactcatcaacttgtactcttg

SEQ ID NO: 575837 - DNA, 25 bp, Homo sapien
acatctttccttcatggctggatct

SEQ ID NO: 575838 - DNA, 25 bp, Homo sapien
acacaagtctccattttactctggc

SEQ ID NO: 575839 - DNA, 25 bp, Homo sapien
acaagtctccattttactctggctc

SEQ ID NO: 575840 - DNA, 25 bp, Homo sapien
aagtctccattttactctggctctt

SEQ ID NO: 575841 - DNA, 25 bp, Homo sapien
tctccattttactctggctcttctc

SEQ ID NO: 575842 - DNA, 25 bp, Homo sapien
ttcccaccacaattgcccactgact

SEQ ID NO: 575843 - DNA, 25 bp, Homo sapien
ctacacttctctgtctaccttctgc

SEQ ID NO: 575844 - DNA, 25 bp, Homo sapien
aacaaaaaaactagcagtcacacct

SEQ ID NO: 575845 - DNA, 25 bp, Homo sapien
acaaaaaaactagcagtcacaccta

SEQ ID NO: 575846 - DNA, 25 bp, Homo sapien
aaaaaactagcagtcacacctagcc

SEQ ID NO: 575847 - DNA, 25 bp, Homo sapien
aaaaactagcagtcacacctagcct

SEQ ID NO: 575848 - DNA, 25 bp, Homo sapien
aaaactagcagtcacacctagccta

SEQ ID NO: 575849 - DNA, 25 bp, Homo sapien
aaactagcagtcacacctagcctat

SEQ ID NO: 575850 - DNA, 25 bp, Homo sapien
aactagcagtcacacctagcctatc

SEQ ID NO: 575851 - DNA, 25 bp, Homo sapien
actagcagtcacacctagcctatct

SEQ ID NO: 575852 - DNA, 25 bp, Homo sapien
tagcagtcacacctagcctatctca

SEQ ID NO: 575853 - DNA, 25 bp, Homo sapien
agcagtcacacctagcctatctcat

SEQ ID NO: 575854 - DNA, 25 bp, Homo sapien
gcagtcacacctagcctatctcatc

SEQ ID NO: 575855 - DNA, 25 bp, Homo sapien
gatgctctgagcttatgatcacaca

SEQ ID NO: 575856 - DNA, 25 bp, Homo sapien
tatgatcacacagagccagtccatc

SEQ ID NO: 575857 - DNA, 25 bp, Homo sapien
atcctcatttcctggtggcatctgt

SEQ ID NO: 575858 - DNA, 25 bp, Homo sapien
tggtggcatctgttcatttaccttt

SEQ ID NO: 575859 - DNA, 25 bp, Homo sapien
atttacctttgtggactgtagctga

SEQ ID NO: 575860 - DNA, 25 bp, Homo sapien
tgatggcacagtgcgggttccctac

SEQ ID NO: 575861 - DNA, 25 bp, Homo sapien
tccaagggacctttggaggccatgc

SEQ ID NO: 575862 - DNA, 25 bp, Homo sapien
gaggccatgcttagacacattcctg

SEQ ID NO: 575863 - DNA, 25 bp, Homo sapien
gacacattcctgtacctgagaacaa

SEQ ID NO: 575864 - DNA, 25 bp, Homo sapien
gaacaaccacataggcaggaccaga

SEQ ID NO: 575865 - DNA, 25 bp, Homo sapien
agatccacatcgtgcagtcgtgtca

SEQ ID NO: 575866 - DNA, 25 bp, Homo sapien
tctgggctccgtgcgatctttcata

SEQ ID NO: 575867 - DNA, 25 bp, Homo sapien
tgcgatctttcatagcgcagctcca

SEQ ID NO: 575868 - DNA, 25 bp, Homo sapien
cctcgcagacgagactggcattcaa

SEQ ID NO: 575869 - DNA, 25 bp, Homo sapien
gcagacgagactggcattcaaacca

SEQ ID NO: 575870 - DNA, 25 bp, Homo sapien
gactggcattcaaaccaggaattct

SEQ ID NO: 575871 - DNA, 25 bp, Homo sapien
gggctctgtgtgcaggaatacaatc

SEQ ID NO: 575872 - DNA, 25 bp, Homo sapien
gaatacaatcacctcaagctcgtgt

SEQ ID NO: 575873 - DNA, 25 bp, Homo sapien
aatcacctcaagctcgtgtaagaag

SEQ ID NO: 575874 - DNA, 25 bp, Homo sapien
cgtgtaagaagaagagagctccagt

SEQ ID NO: 575875 - DNA, 25 bp, Homo sapien
acaaagctttcaggaccggcattta

SEQ ID NO: 575876 - DNA, 25 bp, Homo sapien
ttcaggaccggcatttaaaatcaac

SEQ ID NO: 575877 - DNA, 25 bp, Homo sapien
gacactctacagaaaaaccgacagc

SEQ ID NO: 575878 - DNA, 25 bp, Homo sapien
acactctacagaaaaaccgacagcc

SEQ ID NO: 575879 - DNA, 25 bp, Homo sapien
ttcccagtcctcaaacccacgaagt

SEQ ID NO: 575880 - DNA, 25 bp, Homo sapien
tcccagtcctcaaacccacgaagtg

SEQ ID NO: 575881 - DNA, 25 bp, Homo sapien
ccagtcctcaaacccacgaagtggg

SEQ ID NO: 575882 - DNA, 25 bp, Homo sapien
agtcctcaaacccacgaagtgggct

SEQ ID NO: 575883 - DNA, 25 bp, Homo sapien
gtcctcaaacccacgaagtgggctg

SEQ ID NO: 575884 - DNA, 25 bp, Homo sapien
tcctcaaacccacgaagtgggctgg

SEQ ID NO: 575885 - DNA, 25 bp, Homo sapien
cctcaaacccacgaagtgggctggg

SEQ ID NO: 575886 - DNA, 25 bp, Homo sapien
ctcaaacccacgaagtgggctgggc

SEQ ID NO: 575887 - DNA, 25 bp, Homo sapien
tcaaacccacgaagtgggctgggcg

SEQ ID NO: 575888 - DNA, 25 bp, Homo sapien
gtcccctaagggacctcagactggg

SEQ ID NO: 575889 - DNA, 25 bp, Homo sapien
cagactgggctgatggaaggtctca

SEQ ID NO: 575890 - DNA, 25 bp, Homo sapien
gaaggtctcaagcaggccatgtgaa

SEQ ID NO: 575891 - DNA, 25 bp, Homo sapien
aatcctataaggtcagcagagctct

SEQ ID NO: 575892 - DNA, 25 bp, Homo sapien
gttcttgggcctgtttttatgatcc

SEQ ID NO: 575893 - DNA, 25 bp, Homo sapien
ttttatgatcctccctctacatgta

SEQ ID NO: 575894 - DNA, 25 bp, Homo sapien
tctacatgtagctcacacttccctg

SEQ ID NO: 575895 - DNA, 25 bp, Homo sapien
tgcttctgtgcaggcaccaggtgag

SEQ ID NO: 575896 - DNA, 25 bp, Homo sapien
tcctgccactcttgaggctgtcaga

SEQ ID NO: 575897 - DNA, 25 bp, Homo sapien
gaggctgtcagatattacctgtgct

SEQ ID NO: 575898 - DNA, 25 bp, Homo sapien
ctgcattctcaagctccaaattgtc

SEQ ID NO: 575899 - DNA, 25 bp, Homo sapien
atacccagactgttactacaacctc

SEQ ID NO: 575900 - DNA, 25 bp, Homo sapien
tacccagactgttactacaacctcg

SEQ ID NO: 575901 - DNA, 25 bp, Homo sapien
acccagactgttactacaacctcgg

SEQ ID NO: 575902 - DNA, 25 bp, Homo sapien
cagactgttactacaacctcgggcg

SEQ ID NO: 575903 - DNA, 25 bp, Homo sapien
agactgttactacaacctcgggcgt

SEQ ID NO: 575904 - DNA, 25 bp, Homo sapien
gactgttactacaacctcgggcgtc

SEQ ID NO: 575905 - DNA, 25 bp, Homo sapien
actgttactacaacctcgggcgtct

SEQ ID NO: 575906 - DNA, 25 bp, Homo sapien
tgttactacaacctcgggcgtctgg

SEQ ID NO: 575907 - DNA, 25 bp, Homo sapien
gttactacaacctcgggcgtctggt

SEQ ID NO: 575908 - DNA, 25 bp, Homo sapien
acaacctcgggcgtctggtaagcgc

SEQ ID NO: 575909 - DNA, 25 bp, Homo sapien
caacctcgggcgtctggtaagcgcg

SEQ ID NO: 575910 - DNA, 25 bp, Homo sapien
atatctacatcttctcacaaagatt

SEQ ID NO: 575911 - DNA, 25 bp, Homo sapien
tatctacatcttctcacaaagattc

SEQ ID NO: 575912 - DNA, 25 bp, Homo sapien
atctacatcttctcacaaagattct

SEQ ID NO: 575913 - DNA, 25 bp, Homo sapien
tctacatcttctcacaaagattctc

SEQ ID NO: 575914 - DNA, 25 bp, Homo sapien
ctacatcttctcacaaagattctct

SEQ ID NO: 575915 - DNA, 25 bp, Homo sapien
tacatcttctcacaaagattctctt

SEQ ID NO: 575916 - DNA, 25 bp, Homo sapien
acatcttctcacaaagattctctta

SEQ ID NO: 575917 - DNA, 25 bp, Homo sapien
catcttctcacaaagattctcttaa

SEQ ID NO: 575918 - DNA, 25 bp, Homo sapien
tcacaaagattctcttaagaaatgc

SEQ ID NO: 575919 - DNA, 25 bp, Homo sapien
acaaagattctcttaagaaatgcag

SEQ ID NO: 575920 - DNA, 25 bp, Homo sapien
caaagattctcttaagaaatgcaga

SEQ ID NO: 575921 - DNA, 25 bp, Homo sapien
gtaaactccacagggactgttctat

SEQ ID NO: 575922 - DNA, 25 bp, Homo sapien
tccacagggactgttctatagcagt

SEQ ID NO: 575923 - DNA, 25 bp, Homo sapien
ctgttctatagcagtcatcatttgt

SEQ ID NO: 575924 - DNA, 25 bp, Homo sapien
tcatttgtctttgaacgtacccaag

SEQ ID NO: 575925 - DNA, 25 bp, Homo sapien
gtctttgaacgtacccaaggtcaca

SEQ ID NO: 575926 - DNA, 25 bp, Homo sapien
ggtcacatagctgggatttgaactg

SEQ ID NO: 575927 - DNA, 25 bp, Homo sapien
gatttgaactgagccgtgcagctgg

SEQ ID NO: 575928 - DNA, 25 bp, Homo sapien
tttgaaccaggccttctgatttcaa

SEQ ID NO: 575929 - DNA, 25 bp, Homo sapien
tctgatttcaaggtccgagctctgt

SEQ ID NO: 575930 - DNA, 25 bp, Homo sapien
tcaaggtccgagctctgtcctctgt

SEQ ID NO: 575931 - DNA, 25 bp, Homo sapien
ctctgtcagtcatgcgtccactttc

SEQ ID NO: 575932 - DNA, 25 bp, Homo sapien
cagcccttgaataggttggtcctca

SEQ ID NO: 575933 - DNA, 25 bp, Homo sapien
ttgaataggttggtcctcatcattg

SEQ ID NO: 575934 - DNA, 25 bp, Homo sapien
agggaggattttgcactcctctgct

SEQ ID NO: 575935 - DNA, 25 bp, Homo sapien
tccctgccttgattgagcttgagtg

SEQ ID NO: 575936 - DNA, 25 bp, Homo sapien
tgtggaataaattgtccgtctcttc

SEQ ID NO: 575937 - DNA, 25 bp, Homo sapien
gcagcagcagtttcggctcagtaga

SEQ ID NO: 575938 - DNA, 25 bp, Homo sapien
gtttcggctcagtagaagaatctcc

SEQ ID NO: 575939 - DNA, 25 bp, Homo sapien
gtagaagaatctccaagggcacaga

SEQ ID NO: 575940 - DNA, 25 bp, Homo sapien
caagggcacagacgatcacagacac

SEQ ID NO: 575941 - DNA, 25 bp, Homo sapien
cacccaggagggagtcctggatcct

SEQ ID NO: 575942 - DNA, 25 bp, Homo sapien
tggcaccaagttctgtccattcatc

SEQ ID NO: 575943 - DNA, 25 bp, Homo sapien
acagccgtggaaggactggcccttg

SEQ ID NO: 575944 - DNA, 25 bp, Homo sapien
ttggcagctctgcatcatcgtcgtc

SEQ ID NO: 575945 - DNA, 25 bp, Homo sapien
tctgcatcatcgtcgtcagagccac

SEQ ID NO: 575946 - DNA, 25 bp, Homo sapien
atcgtcgtcagagccaccgcagatt

SEQ ID NO: 575947 - DNA, 25 bp, Homo sapien
tcgtcagagccaccgcagattatca

SEQ ID NO: 575948 - DNA, 25 bp, Homo sapien
tgcccgacagaagatggtccagaag

SEQ ID NO: 575949 - DNA, 25 bp, Homo sapien
acagaagatggtccagaagctggcc

SEQ ID NO: 575950 - DNA, 25 bp, Homo sapien
caggcttgggcctggaacaggacag

SEQ ID NO: 575951 - DNA, 25 bp, Homo sapien
ttcagagctgatgtgttcacctggg

SEQ ID NO: 575952 - DNA, 25 bp, Homo sapien
gagctgatgtgttcacctgggcaga

SEQ ID NO: 575953 - DNA, 25 bp, Homo sapien
gatgtgttcacctgggcagatcccc

SEQ ID NO: 575954 - DNA, 25 bp, Homo sapien
gggacgctctgcactatctctgaga

SEQ ID NO: 575955 - DNA, 25 bp, Homo sapien
gctctgcactatctctgagagggtg

SEQ ID NO: 575956 - DNA, 25 bp, Homo sapien
atctctgagagggtggagacacagc

SEQ ID NO: 575957 - DNA, 25 bp, Homo sapien
accatcggcagcctgctcactgtgg

SEQ ID NO: 575958 - DNA, 25 bp, Homo sapien
tcggcagcctgctcactgtggccat

SEQ ID NO: 575959 - DNA, 25 bp, Homo sapien
cctgatgcctttccaagttccagag

SEQ ID NO: 575960 - DNA, 25 bp, Homo sapien
aagttccagagctgcctgttggcaa

SEQ ID NO: 575961 - DNA, 25 bp, Homo sapien
agagctgcctgttggcaatgagaca

SEQ ID NO: 575962 - DNA, 25 bp, Homo sapien
aatgagacaggcctactggccgcga

SEQ ID NO: 575963 - DNA, 25 bp, Homo sapien
tactggccgcgagcagcaagacaag

SEQ ID NO: 575964 - DNA, 25 bp, Homo sapien
ccgcgagcagcaagacaagagccct

SEQ ID NO: 575965 - DNA, 25 bp, Homo sapien
agaaacaagtactgaaaaagctaag

SEQ ID NO: 575966 - DNA, 25 bp, Homo sapien
gaaacaagtactgaaaaagctaagt

SEQ ID NO: 575967 - DNA, 25 bp, Homo sapien
acaagtactgaaaaagctaagtaat

SEQ ID NO: 575968 - DNA, 25 bp, Homo sapien
caagtactgaaaaagctaagtaatt

SEQ ID NO: 575969 - DNA, 25 bp, Homo sapien
gtactgaaaaagctaagtaatttgc

SEQ ID NO: 575970 - DNA, 25 bp, Homo sapien
tactgaaaaagctaagtaatttgcc

SEQ ID NO: 575971 - DNA, 25 bp, Homo sapien
ctgaaaaagctaagtaatttgccca

SEQ ID NO: 575972 - DNA, 25 bp, Homo sapien
tgaaaaagctaagtaatttgcccaa

SEQ ID NO: 575973 - DNA, 25 bp, Homo sapien
gaaaaagctaagtaatttgcccaat

SEQ ID NO: 575974 - DNA, 25 bp, Homo sapien
agctaagtaatttgcccaattttat

SEQ ID NO: 575975 - DNA, 25 bp, Homo sapien
gctaagtaatttgcccaattttata

SEQ ID NO: 575976 - DNA, 25 bp, Homo sapien
tcaccgcgcgcatggaaatgctcat

SEQ ID NO: 575977 - DNA, 25 bp, Homo sapien
aatgctcatcgaggagctctacgcc

SEQ ID NO: 575978 - DNA, 25 bp, Homo sapien
tctacgccttcatgccggccaggag

SEQ ID NO: 575979 - DNA, 25 bp, Homo sapien
ttcatgccggccaggagccaggacc

SEQ ID NO: 575980 - DNA, 25 bp, Homo sapien
aggaccccaagaagcctagcagggt

SEQ ID NO: 575981 - DNA, 25 bp, Homo sapien
gccttgcaccgggacgccgagtttg

SEQ ID NO: 575982 - DNA, 25 bp, Homo sapien
gacgccgagtttgggacaccgaaca

SEQ ID NO: 575983 - DNA, 25 bp, Homo sapien
ggacaccgaacactgggcaaaagag

SEQ ID NO: 575984 - DNA, 25 bp, Homo sapien
ccagccagttcgtacctattgaaaa

SEQ ID NO: 575985 - DNA, 25 bp, Homo sapien
gaaaagcagcgttagcagccttcct

SEQ ID NO: 575986 - DNA, 25 bp, Homo sapien
agcagccttcctaaactcagagttt

SEQ ID NO: 575987 - DNA, 25 bp, Homo sapien
tcattttctcactgcctgggaacct

SEQ ID NO: 575988 - DNA, 25 bp, Homo sapien
gggtcagcccaaagctgtcacaaaa

SEQ ID NO: 575989 - DNA, 25 bp, Homo sapien
aagctgtcacaaaatcagatatttc

SEQ ID NO: 575990 - DNA, 25 bp, Homo sapien
tcagatatttccctttattccagat

SEQ ID NO: 575991 - DNA, 25 bp, Homo sapien
gatatttccctttattccagatttc

SEQ ID NO: 575992 - DNA, 25 bp, Homo sapien
agatttcctggacactttcacccaa

SEQ ID NO: 575993 - DNA, 25 bp, Homo sapien
gacactttcacccaattataaacac

SEQ ID NO: 575994 - DNA, 25 bp, Homo sapien
ttcagccccaatcacgtgggaggaa

SEQ ID NO: 575995 - DNA, 25 bp, Homo sapien
atcacgtgggaggaagtgtaacttc

SEQ ID NO: 575996 - DNA, 25 bp, Homo sapien
attctcaagcagttactttcacggt

SEQ ID NO: 575997 - DNA, 25 bp, Homo sapien
aagcagttactttcacggtcagaac

SEQ ID NO: 575998 - DNA, 25 bp, Homo sapien
aactgtagtgcaagtagtgtgcaac

SEQ ID NO: 575999 - DNA, 25 bp, Homo sapien
tagtgtgcaacgtcagcctgtcaga

SEQ ID NO: 576000 - DNA, 25 bp, Homo sapien
aacgtcagcctgtcagaactgtagg

SEQ ID NO: 576001 - DNA, 25 bp, Homo sapien
gaactgtaggcacaagattccaacc

SEQ ID NO: 576002 - DNA, 25 bp, Homo sapien
acaagattccaaccagtgagagctg

SEQ ID NO: 576003 - DNA, 25 bp, Homo sapien
gtgagagctgtatgggctaagccca

SEQ ID NO: 576004 - DNA, 25 bp, Homo sapien
tgggctaagcccagcaaagttatgg

SEQ ID NO: 576005 - DNA, 25 bp, Homo sapien
ggacagggctgccagaggtcttggg

SEQ ID NO: 576006 - DNA, 25 bp, Homo sapien
ctgccccagtgtatccaggaagtag

SEQ ID NO: 576007 - DNA, 25 bp, Homo sapien
gtcgaaggagattattcaccagctt

SEQ ID NO: 576008 - DNA, 25 bp, Homo sapien
gattattcaccagctttaagactta

SEQ ID NO: 576009 - DNA, 25 bp, Homo sapien
tcctccctgaacctagacagtttca

SEQ ID NO: 576010 - DNA, 25 bp, Homo sapien
atccccaccccatatgggagatgct

SEQ ID NO: 576011 - DNA, 25 bp, Homo sapien
tgggagatgcttgcccatgtgtttc

SEQ ID NO: 576012 - DNA, 25 bp, Homo sapien
gtttcatcaatcagaagtcctcctc

SEQ ID NO: 576013 - DNA, 25 bp, Homo sapien
cctccccagcacattcggatttaaa

SEQ ID NO: 576014 - DNA, 25 bp, Homo sapien
gtctctccggctttctgtgctttaa

SEQ ID NO: 576015 - DNA, 25 bp, Homo sapien
aaatgttagtttaccagaccgatag

SEQ ID NO: 576016 - DNA, 25 bp, Homo sapien
gtttaccagaccgatagtggtcctt

SEQ ID NO: 576017 - DNA, 25 bp, Homo sapien
gaccgatagtggtccttaggacaga

SEQ ID NO: 576018 - DNA, 25 bp, Homo sapien
ccttaggacagattttagaccagta

SEQ ID NO: 576019 - DNA, 25 bp, Homo sapien
gaccagtaaacttatctttggtgag

SEQ ID NO: 576020 - DNA, 25 bp, Homo sapien
gagttagaggccagcctggcgaaac

SEQ ID NO: 576021 - DNA, 25 bp, Homo sapien
agttagaggccagcctggcgaaacc

SEQ ID NO: 576022 - DNA, 25 bp, Homo sapien
gttagaggccagcctggcgaaaccc

SEQ ID NO: 576023 - DNA, 25 bp, Homo sapien
ttagaggccagcctggcgaaacccc

SEQ ID NO: 576024 - DNA, 25 bp, Homo sapien
tagaggccagcctggcgaaacccca

SEQ ID NO: 576025 - DNA, 25 bp, Homo sapien
agaggccagcctggcgaaaccccat

SEQ ID NO: 576026 - DNA, 25 bp, Homo sapien
gaggccagcctggcgaaaccccatc

SEQ ID NO: 576027 - DNA, 25 bp, Homo sapien
acaaaatccaggcgtggtggcacac

SEQ ID NO: 576028 - DNA, 25 bp, Homo sapien
tcagataggaaggatggatatgtct

SEQ ID NO: 576029 - DNA, 25 bp, Homo sapien
gatatgtctttatctacagcagaag

SEQ ID NO: 576030 - DNA, 25 bp, Homo sapien
acagcagaagttagttaccctttca

SEQ ID NO: 576031 - DNA, 25 bp, Homo sapien
agttagttaccctttcatgaggtga

SEQ ID NO: 576032 - DNA, 25 bp, Homo sapien
gttaccctttcatgaggtgattagt

SEQ ID NO: 576033 - DNA, 25 bp, Homo sapien
atgaggtgattagtttacttctagg

SEQ ID NO: 576034 - DNA, 25 bp, Homo sapien
agagaggactttgaacttggtgttg

SEQ ID NO: 576035 - DNA, 25 bp, Homo sapien
ggactttgaacttggtgttgtcaca

SEQ ID NO: 576036 - DNA, 25 bp, Homo sapien
aacttggtgttgtcacaggagctgc

SEQ ID NO: 576037 - DNA, 25 bp, Homo sapien
gtgttgtcacaggagctgctctcat

SEQ ID NO: 576038 - DNA, 25 bp, Homo sapien
acaggagctgctctcatggacaaga

SEQ ID NO: 576039 - DNA, 25 bp, Homo sapien
tcccggccgtcgtctttttgcacgg

SEQ ID NO: 576040 - DNA, 25 bp, Homo sapien
ggccgtcgtctttttgcacgggctc

SEQ ID NO: 576041 - DNA, 25 bp, Homo sapien
gtcgtctttttgcacgggctcttcg

SEQ ID NO: 576042 - DNA, 25 bp, Homo sapien
ttttgcacgggctcttcggcagcaa

SEQ ID NO: 576043 - DNA, 25 bp, Homo sapien
ttgcacgggctcttcggcagcaaaa

SEQ ID NO: 576044 - DNA, 25 bp, Homo sapien
gcacgggctcttcggcagcaaaact

SEQ ID NO: 576045 - DNA, 25 bp, Homo sapien
cgggctcttcggcagcaaaactaac

SEQ ID NO: 576046 - DNA, 25 bp, Homo sapien
ggctcttcggcagcaaaactaactt

SEQ ID NO: 576047 - DNA, 25 bp, Homo sapien
tcttcggcagcaaaactaacttcaa

SEQ ID NO: 576048 - DNA, 25 bp, Homo sapien
ttcggcagcaaaactaacttcaact

SEQ ID NO: 576049 - DNA, 25 bp, Homo sapien
ggcagcaaaactaacttcaactcca

SEQ ID NO: 576050 - DNA, 25 bp, Homo sapien
taattgatattctttttgcccctct

SEQ ID NO: 576051 - DNA, 25 bp, Homo sapien
ctctgcttttttcttcgaagtccac

SEQ ID NO: 576052 - DNA, 25 bp, Homo sapien
tcgaagtccacctgccaaagaagaa

SEQ ID NO: 576053 - DNA, 25 bp, Homo sapien
tggctattctcatggatcacaactg

SEQ ID NO: 576054 - DNA, 25 bp, Homo sapien
catggatcacaactgccctattaaa

SEQ ID NO: 576055 - DNA, 25 bp, Homo sapien
aatatccagtcatatccgataggtg

SEQ ID NO: 576056 - DNA, 25 bp, Homo sapien
aagtgactgagatgagatcctcaaa

SEQ ID NO: 576057 - DNA, 25 bp, Homo sapien
gtttccagtgacacaactcatccag

SEQ ID NO: 576058 - DNA, 25 bp, Homo sapien
acaactcatccagaactgtcttagt

SEQ ID NO: 576059 - DNA, 25 bp, Homo sapien
aactgtcttagtcataccatccatc

SEQ ID NO: 576060 - DNA, 25 bp, Homo sapien
taccatccatccctggtgaaagagt

SEQ ID NO: 576061 - DNA, 25 bp, Homo sapien
tctctcagcttcaattgcctaatct

SEQ ID NO: 576062 - DNA, 25 bp, Homo sapien
aatgttgagcaagtgcctgaccctt

SEQ ID NO: 576063 - DNA, 25 bp, Homo sapien
ttcctgagcaacagttccttcatct

SEQ ID NO: 576064 - DNA, 25 bp, Homo sapien
gggtactttaatcaatctcatcatt

SEQ ID NO: 576065 - DNA, 25 bp, Homo sapien
caaaaggtacttcaagtgatcagta

SEQ ID NO: 576066 - DNA, 25 bp, Homo sapien
atggatcctcggtaagtggtagctc

SEQ ID NO: 576067 - DNA, 25 bp, Homo sapien
tttcccttaagtttcagcccaacag

SEQ ID NO: 576068 - DNA, 25 bp, Homo sapien
aagtttcagcccaacagatctcttt

SEQ ID NO: 576069 - DNA, 25 bp, Homo sapien
agatctctttcgtcagctgttatca

SEQ ID NO: 576070 - DNA, 25 bp, Homo sapien
tttcgtcagctgttatcattgtaaa

SEQ ID NO: 576071 - DNA, 25 bp, Homo sapien
ggcaaataaactggcctccaattat

SEQ ID NO: 576072 - DNA, 25 bp, Homo sapien
aaaacaaccaagcaaagtctgagaa

SEQ ID NO: 576073 - DNA, 25 bp, Homo sapien
aactgtcacagcctagaggaacctg

SEQ ID NO: 576074 - DNA, 25 bp, Homo sapien
gtcacagcctagaggaacctggaga

SEQ ID NO: 576075 - DNA, 25 bp, Homo sapien
acagcctagaggaacctggagacag

SEQ ID NO: 576076 - DNA, 25 bp, Homo sapien
aggaacctggagacagctgatccct

SEQ ID NO: 576077 - DNA, 25 bp, Homo sapien
gaacctggagacagctgatccctaa

SEQ ID NO: 576078 - DNA, 25 bp, Homo sapien
acctggagacagctgatccctaaat

SEQ ID NO: 576079 - DNA, 25 bp, Homo sapien
ctggagacagctgatccctaaatgt

SEQ ID NO: 576080 - DNA, 25 bp, Homo sapien
gagacagctgatccctaaatgtcac

SEQ ID NO: 576081 - DNA, 25 bp, Homo sapien
acagctgatccctaaatgtcacgtg

SEQ ID NO: 576082 - DNA, 25 bp, Homo sapien
cagctgatccctaaatgtcacgtgg

SEQ ID NO: 576083 - DNA, 25 bp, Homo sapien
gctgtgccagactaaattaaaccta

SEQ ID NO: 576084 - DNA, 25 bp, Homo sapien
gccagactaaattaaacctaaacag

SEQ ID NO: 576085 - DNA, 25 bp, Homo sapien
ggaatagctcttgactcagaaacag

SEQ ID NO: 576086 - DNA, 25 bp, Homo sapien
atagctcttgactcagaaacaggca

SEQ ID NO: 576087 - DNA, 25 bp, Homo sapien
tgagaaacagccgtgactgatcaaa

SEQ ID NO: 576088 - DNA, 25 bp, Homo sapien
aacagccgtgactgatcaaagcaga

SEQ ID NO: 576089 - DNA, 25 bp, Homo sapien
cgtgactgatcaaagcagagaggtt

SEQ ID NO: 576090 - DNA, 25 bp, Homo sapien
ttaaaaaccctagttcactagagat

SEQ ID NO: 576091 - DNA, 25 bp, Homo sapien
cctagttcactagagataactgctc

SEQ ID NO: 576092 - DNA, 25 bp, Homo sapien
ataactgctctagtggggcttcaaa

SEQ ID NO: 576093 - DNA, 25 bp, Homo sapien
gggatgtttgcttctctgtggagga

SEQ ID NO: 576094 - DNA, 25 bp, Homo sapien
gttttttgctgctgtaacttaccag

SEQ ID NO: 576095 - DNA, 25 bp, Homo sapien
cagtgttatgcttacaagacttcat

SEQ ID NO: 576096 - DNA, 25 bp, Homo sapien
gatagtacctgcagaatagtttttg

SEQ ID NO: 576097 - DNA, 25 bp, Homo sapien
gaatagtttttgaatacacccacat

SEQ ID NO: 576098 - DNA, 25 bp, Homo sapien
acacccacattttgtacgtttccat

SEQ ID NO: 576099 - DNA, 25 bp, Homo sapien
ttgtacgtttccatgtaagctgaca

SEQ ID NO: 576100 - DNA, 25 bp, Homo sapien
gtaagctgacatagtgttctgccat

SEQ ID NO: 576101 - DNA, 25 bp, Homo sapien
atagtgttctgccatgtaatgttta

SEQ ID NO: 576102 - DNA, 25 bp, Homo sapien
atgtaatgtttatagctgctgatgt

SEQ ID NO: 576103 - DNA, 25 bp, Homo sapien
tagctgctgatgtatgcacatttgg

SEQ ID NO: 576104 - DNA, 25 bp, Homo sapien
gggtatatctatttctgaagaggta

SEQ ID NO: 576105 - DNA, 25 bp, Homo sapien
gaagcagccacttgtcagctgcgat

SEQ ID NO: 576106 - DNA, 25 bp, Homo sapien
agccacttgtcagctgcgatgaatc

SEQ ID NO: 576107 - DNA, 25 bp, Homo sapien
ttgtcagctgcgatgaatccaatga

SEQ ID NO: 576108 - DNA, 25 bp, Homo sapien
agctgcgatgaatccaatgataatt

SEQ ID NO: 576109 - DNA, 25 bp, Homo sapien
aatacttgatatttgcccatcacat

SEQ ID NO: 576110 - DNA, 25 bp, Homo sapien
tatttgcccatcacatttctcattt

SEQ ID NO: 576111 - DNA, 25 bp, Homo sapien
aagtgctcataaaattgtatctcat

SEQ ID NO: 576112 - DNA, 25 bp, Homo sapien
actgccggcacaacagaattccaag

SEQ ID NO: 576113 - DNA, 25 bp, Homo sapien
tccaaggaaggattacgggctaagt

SEQ ID NO: 576114 - DNA, 25 bp, Homo sapien
ctggaggctgctttaaagcctagga

SEQ ID NO: 576115 - DNA, 25 bp, Homo sapien
tgtttaactttttctcatggaaatg

SEQ ID NO: 576116 - DNA, 25 bp, Homo sapien
accggaggaaatggaagcgttatct

SEQ ID NO: 576117 - DNA, 25 bp, Homo sapien
aagcgttatctcctgataggcctgg

SEQ ID NO: 576118 - DNA, 25 bp, Homo sapien
gtgtgactggaggtctagctgcacc

SEQ ID NO: 576119 - DNA, 25 bp, Homo sapien
tggaggtctagctgcaccccttgtt

SEQ ID NO: 576120 - DNA, 25 bp, Homo sapien
tgcaccccttgttgccgctggagca

SEQ ID NO: 576121 - DNA, 25 bp, Homo sapien
cgctggagcagcgacgattattggc

SEQ ID NO: 576122 - DNA, 25 bp, Homo sapien
ggctctgggctcagcagccggcata

SEQ ID NO: 576123 - DNA, 25 bp, Homo sapien
tcagcagccggcatagccatcatga

SEQ ID NO: 576124 - DNA, 25 bp, Homo sapien
ttcagtgccccgtgggctgccctgg

SEQ ID NO: 576125 - DNA, 25 bp, Homo sapien
tggcccacagccgtgagcagtactg

SEQ ID NO: 576126 - DNA, 25 bp, Homo sapien
cacagccgtgagcagtactgcctgg

SEQ ID NO: 576127 - DNA, 25 bp, Homo sapien
gagttgcccatgatttcatctaatt

SEQ ID NO: 576128 - DNA, 25 bp, Homo sapien
gatttcatctaatttttggattcag

SEQ ID NO: 576129 - DNA, 25 bp, Homo sapien
catctaatttttggattcagaatgt

SEQ ID NO: 576130 - DNA, 25 bp, Homo sapien
ttttatgaataatatgcagagatgc

SEQ ID NO: 576131 - DNA, 25 bp, Homo sapien
aagccagaatgggtcagttgtagct

SEQ ID NO: 576132 - DNA, 25 bp, Homo sapien
gaatgggtcagttgtagctgctgca

SEQ ID NO: 576133 - DNA, 25 bp, Homo sapien
atgggtcagttgtagctgctgcaaa

SEQ ID NO: 576134 - DNA, 25 bp, Homo sapien
gggtcagttgtagctgctgcaaagt

SEQ ID NO: 576135 - DNA, 25 bp, Homo sapien
gtcagttgtagctgctgcaaagttc

SEQ ID NO: 576136 - DNA, 25 bp, Homo sapien
tcagttgtagctgctgcaaagttct

SEQ ID NO: 576137 - DNA, 25 bp, Homo sapien
ctgcaaagttctgtagctgatggtc

SEQ ID NO: 576138 - DNA, 25 bp, Homo sapien
cagtgcaggatgcagtagatgccct

SEQ ID NO: 576139 - DNA, 25 bp, Homo sapien
gtagatgccctgatgcagaaggctt

SEQ ID NO: 576140 - DNA, 25 bp, Homo sapien
aaggctttcaactcctcgtccttca

SEQ ID NO: 576141 - DNA, 25 bp, Homo sapien
tcgtgcacatgggtctgctcaagag

SEQ ID NO: 576142 - DNA, 25 bp, Homo sapien
gcacatgggtctgctcaagagtgaa

SEQ ID NO: 576143 - DNA, 25 bp, Homo sapien
aaggtcaaggccattgccaacctgt

SEQ ID NO: 576144 - DNA, 25 bp, Homo sapien
tgatggcgctgaaccacatggtgca

SEQ ID NO: 576145 - DNA, 25 bp, Homo sapien
gaaccacatggtgcagcaggactat

SEQ ID NO: 576146 - DNA, 25 bp, Homo sapien
tggtgcagcaggactatttccccaa

SEQ ID NO: 576147 - DNA, 25 bp, Homo sapien
tggcgttcgtgaccaagcccaacag

SEQ ID NO: 576148 - DNA, 25 bp, Homo sapien
tgctgcagacgctgtacaaggtcta

SEQ ID NO: 576149 - DNA, 25 bp, Homo sapien
caaaccagacaagccagacgacaag

SEQ ID NO: 576150 - DNA, 25 bp, Homo sapien
acgacaagccagacgactcgggcaa

SEQ ID NO: 576151 - DNA, 25 bp, Homo sapien
gggcaaagacccaaagccagacttc

SEQ ID NO: 576152 - DNA, 25 bp, Homo sapien
agcctcctgggcacagagatcattg

SEQ ID NO: 576153 - DNA, 25 bp, Homo sapien
agaatgcagtcgagttcatcctccg

SEQ ID NO: 576154 - DNA, 25 bp, Homo sapien
ccatgtccaggagcacgtaagcact

SEQ ID NO: 576155 - DNA, 25 bp, Homo sapien
gttgctttttgtccaattctctgtt

SEQ ID NO: 576156 - DNA, 25 bp, Homo sapien
aattctctgttgataatgaccacac

SEQ ID NO: 576157 - DNA, 25 bp, Homo sapien
aatgaccacacaatgacctcatggc

SEQ ID NO: 576158 - DNA, 25 bp, Homo sapien
ttagtacttcgcctgacagttgtcc

SEQ ID NO: 576159 - DNA, 25 bp, Homo sapien
tgtcctgggactgcttgtcttattc

SEQ ID NO: 576160 - DNA, 25 bp, Homo sapien
ggtaaactctcaatgcattctgtta

SEQ ID NO: 576161 - DNA, 25 bp, Homo sapien
gttacctcaaaagtctctcccagaa

SEQ ID NO: 576162 - DNA, 25 bp, Homo sapien
ctcccagaacactcatatctagtct

SEQ ID NO: 576163 - DNA, 25 bp, Homo sapien
atctagtctatccttgtacagccaa

SEQ ID NO: 576164 - DNA, 25 bp, Homo sapien
gtacagccaagagaaagtcctagtt

SEQ ID NO: 576165 - DNA, 25 bp, Homo sapien
tctggatgacaagctcataaggagc

SEQ ID NO: 576166 - DNA, 25 bp, Homo sapien
aaggagctgcggtaggcagttacca

SEQ ID NO: 576167 - DNA, 25 bp, Homo sapien
ggtaggcagttaccaaggctgtcac

SEQ ID NO: 576168 - DNA, 25 bp, Homo sapien
gagaaaaacaattcatcgccttggt

SEQ ID NO: 576169 - DNA, 25 bp, Homo sapien
aattcatcgccttggttgcagggtc

SEQ ID NO: 576170 - DNA, 25 bp, Homo sapien
ggttgcagggtctaccatctatata

SEQ ID NO: 576171 - DNA, 25 bp, Homo sapien
tgggctggtatctcagaaagtgcct

SEQ ID NO: 576172 - DNA, 25 bp, Homo sapien
tggtatctcagaaagtgcctgacac

SEQ ID NO: 576173 - DNA, 25 bp, Homo sapien
tatctcagaaagtgcctgacacact

SEQ ID NO: 576174 - DNA, 25 bp, Homo sapien
agctgagtttcctatgggaacaatt

SEQ ID NO: 576175 - DNA, 25 bp, Homo sapien
tcctatgggaacaattgaagtaaac

SEQ ID NO: 576176 - DNA, 25 bp, Homo sapien
tttgttctggtcctttttggtcgag

SEQ ID NO: 576177 - DNA, 25 bp, Homo sapien
ttctggtcctttttggtcgaggagt

SEQ ID NO: 576178 - DNA, 25 bp, Homo sapien
ttttggtcgaggagtaacaatacaa

SEQ ID NO: 576179 - DNA, 25 bp, Homo sapien
caaatggattttgggagtgactcaa

SEQ ID NO: 576180 - DNA, 25 bp, Homo sapien
gaagaatgcacaagaatggatcaca

SEQ ID NO: 576181 - DNA, 25 bp, Homo sapien
tgcacaagaatggatcacaagatgg

SEQ ID NO: 576182 - DNA, 25 bp, Homo sapien
tttcctctgataccttattatcaca

SEQ ID NO: 576183 - DNA, 25 bp, Homo sapien
taccttattatcacaaatttctttt

SEQ ID NO: 576184 - DNA, 25 bp, Homo sapien
atttcttttctcaaagccagagaat

SEQ ID NO: 576185 - DNA, 25 bp, Homo sapien
gccagagaataagctgcttttcttt

SEQ ID NO: 576186 - DNA, 25 bp, Homo sapien
gcttttctttgagttgcttaaaatg

SEQ ID NO: 576187 - DNA, 25 bp, Homo sapien
tctttgagttgcttaaaatggattt

SEQ ID NO: 576188 - DNA, 25 bp, Homo sapien
gattttatttggctccttatgacac

SEQ ID NO: 576189 - DNA, 25 bp, Homo sapien
ttttatttggctccttatgacactt

SEQ ID NO: 576190 - DNA, 25 bp, Homo sapien
tataatgtcaggtggttttaatcta

SEQ ID NO: 576191 - DNA, 25 bp, Homo sapien
tgtcaggtggttttaatctaagtta

SEQ ID NO: 576192 - DNA, 25 bp, Homo sapien
atctaagttaattaggtccttggtg

SEQ ID NO: 576193 - DNA, 25 bp, Homo sapien
ccgctcctggcccacaagaatgttt

SEQ ID NO: 576194 - DNA, 25 bp, Homo sapien
cctggatctagaggcacaactgaga

SEQ ID NO: 576195 - DNA, 25 bp, Homo sapien
aaaggtggtctttgaatgctagtgc

SEQ ID NO: 576196 - DNA, 25 bp, Homo sapien
ggtggtctttgaatgctagtgcact

SEQ ID NO: 576197 - DNA, 25 bp, Homo sapien
gtctttgaatgctagtgcactgcct

SEQ ID NO: 576198 - DNA, 25 bp, Homo sapien
ttgaatgctagtgcactgccttttg

SEQ ID NO: 576199 - DNA, 25 bp, Homo sapien
gaatgctagtgcactgccttttgca

SEQ ID NO: 576200 - DNA, 25 bp, Homo sapien
atgctagtgcactgccttttgcagg

SEQ ID NO: 576201 - DNA, 25 bp, Homo sapien
tagtgcactgccttttgcaggttgc

SEQ ID NO: 576202 - DNA, 25 bp, Homo sapien
actgccttttgcaggttgctggttt

SEQ ID NO: 576203 - DNA, 25 bp, Homo sapien
cttttgcaggttgctggtttctcga

SEQ ID NO: 576204 - DNA, 25 bp, Homo sapien
ttcggagagaaattgctaaagccct

SEQ ID NO: 576205 - DNA, 25 bp, Homo sapien
aaagctttacgatgcactcactcac

SEQ ID NO: 576206 - DNA, 25 bp, Homo sapien
gcactcactcaccattcagatggaa

SEQ ID NO: 576207 - DNA, 25 bp, Homo sapien
tggaatctccagttgaccaggaccc

SEQ ID NO: 576208 - DNA, 25 bp, Homo sapien
gactgccttttctgtgaagacccct

SEQ ID NO: 576209 - DNA, 25 bp, Homo sapien
catcttactcatggaaggtgtgcca

SEQ ID NO: 576210 - DNA, 25 bp, Homo sapien
ggtgtgccaaagagcctgaattaca

SEQ ID NO: 576211 - DNA, 25 bp, Homo sapien
tgtctgtgcacagcctgcacatctg

SEQ ID NO: 576212 - DNA, 25 bp, Homo sapien
tgcacatctggtctctaacaatgaa

SEQ ID NO: 576213 - DNA, 25 bp, Homo sapien
aagtaattctctcagctcatgttgc

SEQ ID NO: 576214 - DNA, 25 bp, Homo sapien
agctcatgttgctacagcagccagc

SEQ ID NO: 576215 - DNA, 25 bp, Homo sapien
attttttgacacattcccagtacca

SEQ ID NO: 576216 - DNA, 25 bp, Homo sapien
ttcccagtaccatcagtgtctttat

SEQ ID NO: 576217 - DNA, 25 bp, Homo sapien
tcagtgtctttatggctgttccagg

SEQ ID NO: 576218 - DNA, 25 bp, Homo sapien
ctgttccaggctacattaatgttca

SEQ ID NO: 576219 - DNA, 25 bp, Homo sapien
attaatgttcaattctatattctct

SEQ ID NO: 576220 - DNA, 25 bp, Homo sapien
aaatcataactcacctttgtctcat

SEQ ID NO: 576221 - DNA, 25 bp, Homo sapien
ggagaatttctggtattgtggtaat

SEQ ID NO: 576222 - DNA, 25 bp, Homo sapien
gaaggtttaacactacaaaggtatg

SEQ ID NO: 576223 - DNA, 25 bp, Homo sapien
gtatgtcaagtcaggttgtttctca

SEQ ID NO: 576224 - DNA, 25 bp, Homo sapien
ttgggaggttatacttcatggtaga

SEQ ID NO: 576225 - DNA, 25 bp, Homo sapien
ggataaggctcaaacgggaaattgt

SEQ ID NO: 576226 - DNA, 25 bp, Homo sapien
actcaagaccagtttcagatgatag

SEQ ID NO: 576227 - DNA, 25 bp, Homo sapien
gatgatagtcatctccctaaaagaa

SEQ ID NO: 576228 - DNA, 25 bp, Homo sapien
gtcatctccctaaaagaagagttct

SEQ ID NO: 576229 - DNA, 25 bp, Homo sapien
gaagagttctattccagagccgacg

SEQ ID NO: 576230 - DNA, 25 bp, Homo sapien
gagttctattccagagccgacgcgc

SEQ ID NO: 576231 - DNA, 25 bp, Homo sapien
tatcctgagtacgatgactgcatgt

SEQ ID NO: 576232 - DNA, 25 bp, Homo sapien
gatgactgcatgttcagccgagttt

SEQ ID NO: 576233 - DNA, 25 bp, Homo sapien
tgttcagccgagttttgaccctaga

SEQ ID NO: 576234 - DNA, 25 bp, Homo sapien
gagttttgaccctagatctttctca

SEQ ID NO: 576235 - DNA, 25 bp, Homo sapien
agatctttctcagtatccagacact

SEQ ID NO: 576236 - DNA, 25 bp, Homo sapien
gaaagcagcaagagacacggagagt

SEQ ID NO: 576237 - DNA, 25 bp, Homo sapien
gccaaagggccccagtctagcttat

SEQ ID NO: 576238 - DNA, 25 bp, Homo sapien
aaagggccccagtctagcttatcag

SEQ ID NO: 576239 - DNA, 25 bp, Homo sapien
aagggccccagtctagcttatcaga

SEQ ID NO: 576240 - DNA, 25 bp, Homo sapien
agggccccagtctagcttatcagag

SEQ ID NO: 576241 - DNA, 25 bp, Homo sapien
ggccccagtctagcttatcagaggt

SEQ ID NO: 576242 - DNA, 25 bp, Homo sapien
gccccagtctagcttatcagaggtt

SEQ ID NO: 576243 - DNA, 25 bp, Homo sapien
cccagtctagcttatcagaggttat

SEQ ID NO: 576244 - DNA, 25 bp, Homo sapien
gtctagcttatcagaggttatttcc

SEQ ID NO: 576245 - DNA, 25 bp, Homo sapien
ctagcttatcagaggttatttccag

SEQ ID NO: 576246 - DNA, 25 bp, Homo sapien
gcttatcagaggttatttccagaaa

SEQ ID NO: 576247 - DNA, 25 bp, Homo sapien
ctcctccctccagggacttctgaca

SEQ ID NO: 576248 - DNA, 25 bp, Homo sapien
ctttcattattttagcaactatcaa

SEQ ID NO: 576249 - DNA, 25 bp, Homo sapien
agtattagaaatgcctactcttcag

SEQ ID NO: 576250 - DNA, 25 bp, Homo sapien
attagaaatgcctactcttcagaga

SEQ ID NO: 576251 - DNA, 25 bp, Homo sapien
tagaaatgcctactcttcagagatg

SEQ ID NO: 576252 - DNA, 25 bp, Homo sapien
gaaatgcctactcttcagagatgta

SEQ ID NO: 576253 - DNA, 25 bp, Homo sapien
aatgcctactcttcagagatgtaat

SEQ ID NO: 576254 - DNA, 25 bp, Homo sapien
gcctactcttcagagatgtaatggg

SEQ ID NO: 576255 - DNA, 25 bp, Homo sapien
agatgaaagatggtattacacagtc

SEQ ID NO: 576256 - DNA, 25 bp, Homo sapien
acagtcaataattcaatgcttccca

SEQ ID NO: 576257 - DNA, 25 bp, Homo sapien
gtcaataattcaatgcttcccacat

SEQ ID NO: 576258 - DNA, 25 bp, Homo sapien
caataattcaatgcttcccacatta

SEQ ID NO: 576259 - DNA, 25 bp, Homo sapien
ggacacgttgaattctgttgcttta

SEQ ID NO: 576260 - DNA, 25 bp, Homo sapien
cgttgaattctgttgctttaaatgt

SEQ ID NO: 576261 - DNA, 25 bp, Homo sapien
aaaatttgccattagtaacactgag

SEQ ID NO: 576262 - DNA, 25 bp, Homo sapien
tagtaacactgagtacattcacagt

SEQ ID NO: 576263 - DNA, 25 bp, Homo sapien
tgcaaccatcagcactgtctagcgc

SEQ ID NO: 576264 - DNA, 25 bp, Homo sapien
atcagcactgtctagcgccagaact

SEQ ID NO: 576265 - DNA, 25 bp, Homo sapien
ctgtctagcgccagaactttttcat

SEQ ID NO: 576266 - DNA, 25 bp, Homo sapien
ggaaaccccgtatccatgaaggact

SEQ ID NO: 576267 - DNA, 25 bp, Homo sapien
tatccatgaaggactcactccccat

SEQ ID NO: 576268 - DNA, 25 bp, Homo sapien
ttggcagccaccagaatgctttctg

SEQ ID NO: 576269 - DNA, 25 bp, Homo sapien
gccaccagaatgctttctgtctcca

SEQ ID NO: 576270 - DNA, 25 bp, Homo sapien
tgctgcaggtctccttcaagaccag

SEQ ID NO: 576271 - DNA, 25 bp, Homo sapien
gcaggtctccttcaagaccagcaaa

SEQ ID NO: 576272 - DNA, 25 bp, Homo sapien
cggctggtgcatcttcgtgtacaac

SEQ ID NO: 576273 - DNA, 25 bp, Homo sapien
gtgcatcttcgtgtacaacctgtca

SEQ ID NO: 576274 - DNA, 25 bp, Homo sapien
ttcgtgtacaacctgtcaccggagg

SEQ ID NO: 576275 - DNA, 25 bp, Homo sapien
tgtacaacctgtcaccggaggcaga

SEQ ID NO: 576276 - DNA, 25 bp, Homo sapien
cagacgagagcgtgctgtggcagct

SEQ ID NO: 576277 - DNA, 25 bp, Homo sapien
gggcagtcaccaacgtcaaggtcat

SEQ ID NO: 576278 - DNA, 25 bp, Homo sapien
ccaacgtcaaggtcatccgtgattt

SEQ ID NO: 576279 - DNA, 25 bp, Homo sapien
tcaaggtcatccgtgatttcaccac

SEQ ID NO: 576280 - DNA, 25 bp, Homo sapien
agtgcaagggtttcggcttcgtgac

SEQ ID NO: 576281 - DNA, 25 bp, Homo sapien
aggccgaaagccaggcaccaggcag

SEQ ID NO: 576282 - DNA, 25 bp, Homo sapien
ggcaccaggcagagacatcacaaag

SEQ ID NO: 576283 - DNA, 25 bp, Homo sapien
accaggcagagacatcacaaagatt

SEQ ID NO: 576284 - DNA, 25 bp, Homo sapien
ggcagagacatcacaaagattggtg

SEQ ID NO: 576285 - DNA, 25 bp, Homo sapien
ggatcagtcagcctcggaacccctt

SEQ ID NO: 576286 - DNA, 25 bp, Homo sapien
agtcagcctcggaaccccttggaag

SEQ ID NO: 576287 - DNA, 25 bp, Homo sapien
tcagcctcggaaccccttggaagag

SEQ ID NO: 576288 - DNA, 25 bp, Homo sapien
tcggaaccccttggaagagctcagg

SEQ ID NO: 576289 - DNA, 25 bp, Homo sapien
gaaccccttggaagagctcaggcct

SEQ ID NO: 576290 - DNA, 25 bp, Homo sapien
accccttggaagagctcaggcctag

SEQ ID NO: 576291 - DNA, 25 bp, Homo sapien
tggaagagctcaggcctagccctag

SEQ ID NO: 576292 - DNA, 25 bp, Homo sapien
tgcaacagtgtcaagagatgggaac

SEQ ID NO: 576293 - DNA, 25 bp, Homo sapien
cagtgtcaagagatgggaacttaaa

SEQ ID NO: 576294 - DNA, 25 bp, Homo sapien
ggaacttaaaagatgactaggtcat

SEQ ID NO: 576295 - DNA, 25 bp, Homo sapien
ctgccttcatcagtggattagtgct

SEQ ID NO: 576296 - DNA, 25 bp, Homo sapien
gccttcatcagtggattagtgctgt

SEQ ID NO: 576297 - DNA, 25 bp, Homo sapien
cagtggattagtgctgttatcacca

SEQ ID NO: 576298 - DNA, 25 bp, Homo sapien
tggattagtgctgttatcaccagag

SEQ ID NO: 576299 - DNA, 25 bp, Homo sapien
gttatcaccagagtgggttagttat

SEQ ID NO: 576300 - DNA, 25 bp, Homo sapien
caccagagtgggttagttattgtgg

SEQ ID NO: 576301 - DNA, 25 bp, Homo sapien
tgtgggagtgggtttctgagaagaa

SEQ ID NO: 576302 - DNA, 25 bp, Homo sapien
gaaggatgagtttggccccctttct

SEQ ID NO: 576303 - DNA, 25 bp, Homo sapien
gtatcagtaccctcagtaaatcaga

SEQ ID NO: 576304 - DNA, 25 bp, Homo sapien
atcagtaccctcagtaaatcagagt

SEQ ID NO: 576305 - DNA, 25 bp, Homo sapien
agtaccctcagtaaatcagagttgc

SEQ ID NO: 576306 - DNA, 25 bp, Homo sapien
taccctcagtaaatcagagttgctg

SEQ ID NO: 576307 - DNA, 25 bp, Homo sapien
aaatcagagttgctgtgacctgggc

SEQ ID NO: 576308 - DNA, 25 bp, Homo sapien
aatcagagttgctgtgacctgggct

SEQ ID NO: 576309 - DNA, 25 bp, Homo sapien
tgacctgggctttgatgtaagggta

SEQ ID NO: 576310 - DNA, 25 bp, Homo sapien
cctgggctttgatgtaagggtagca

SEQ ID NO: 576311 - DNA, 25 bp, Homo sapien
gtaagggtagcagaatgatttagaa

SEQ ID NO: 576312 - DNA, 25 bp, Homo sapien
aacagcattagattaaaagccagag

SEQ ID NO: 576313 - DNA, 25 bp, Homo sapien
cagcattagattaaaagccagagac

SEQ ID NO: 576314 - DNA, 25 bp, Homo sapien
ggcagcccgaagtggctgcggagct

SEQ ID NO: 576315 - DNA, 25 bp, Homo sapien
gcagcccgaagtggctgcggagctt

SEQ ID NO: 576316 - DNA, 25 bp, Homo sapien
cagcccgaagtggctgcggagcttt

SEQ ID NO: 576317 - DNA, 25 bp, Homo sapien
agcccgaagtggctgcggagctttt

SEQ ID NO: 576318 - DNA, 25 bp, Homo sapien
gcccgaagtggctgcggagcttttg

SEQ ID NO: 576319 - DNA, 25 bp, Homo sapien
cccgaagtggctgcggagcttttgt

SEQ ID NO: 576320 - DNA, 25 bp, Homo sapien
ccgaagtggctgcggagcttttgtt

SEQ ID NO: 576321 - DNA, 25 bp, Homo sapien
cgaagtggctgcggagcttttgttt

SEQ ID NO: 576322 - DNA, 25 bp, Homo sapien
gaagtggctgcggagcttttgtttt

SEQ ID NO: 576323 - DNA, 25 bp, Homo sapien
aagtggctgcggagcttttgttttt

SEQ ID NO: 576324 - DNA, 25 bp, Homo sapien
agtggctgcggagcttttgtttttc

SEQ ID NO: 576325 - DNA, 25 bp, Homo sapien
tttttcctgctagtgcaaaaggtag

SEQ ID NO: 576326 - DNA, 25 bp, Homo sapien
ttcctgctagtgcaaaaggtagatg

SEQ ID NO: 576327 - DNA, 25 bp, Homo sapien
caaaaggtagatgagtaggaagatt

SEQ ID NO: 576328 - DNA, 25 bp, Homo sapien
gaagattaggactcctgagttgccc

SEQ ID NO: 576329 - DNA, 25 bp, Homo sapien
agattaggactcctgagttgcccat

SEQ ID NO: 576330 - DNA, 25 bp, Homo sapien
attaggactcctgagttgcccatga

SEQ ID NO: 576331 - DNA, 25 bp, Homo sapien
ttaggactcctgagttgcccatgat

SEQ ID NO: 576332 - DNA, 25 bp, Homo sapien
taggactcctgagttgcccatgatt

SEQ ID NO: 576333 - DNA, 25 bp, Homo sapien
atgggtcagttgtagctgctgcaaa

SEQ ID NO: 576334 - DNA, 25 bp, Homo sapien
gcaaagttctgtagctgatggtcat

SEQ ID NO: 576335 - DNA, 25 bp, Homo sapien
tgattgtggtgcacctgatgctggc

SEQ ID NO: 576336 - DNA, 25 bp, Homo sapien
tgcggatcccggtaacattgcgcgg

SEQ ID NO: 576337 - DNA, 25 bp, Homo sapien
gatcccggtaacattgcgcggcagg

SEQ ID NO: 576338 - DNA, 25 bp, Homo sapien
gtaacattgcgcggcaggccccagg

SEQ ID NO: 576339 - DNA, 25 bp, Homo sapien
tcagcttcgcggactgtctgggccg

SEQ ID NO: 576340 - DNA, 25 bp, Homo sapien
gggtctcaaccttgacttcagggcc

SEQ ID NO: 576341 - DNA, 25 bp, Homo sapien
tctcaaccttgacttcagggccggg

SEQ ID NO: 576342 - DNA, 25 bp, Homo sapien
caaccttgacttcagggccgggccg

SEQ ID NO: 576343 - DNA, 25 bp, Homo sapien
tggggcagacccttagtgatgttca

SEQ ID NO: 576344 - DNA, 25 bp, Homo sapien
tcgcgcgccaattgttaagtctttc

SEQ ID NO: 576345 - DNA, 25 bp, Homo sapien
gcgcgccaattgttaagtctttcat

SEQ ID NO: 576346 - DNA, 25 bp, Homo sapien
gcgccaattgttaagtctttcattg

SEQ ID NO: 576347 - DNA, 25 bp, Homo sapien
agcagccttgggatactaatgagga

SEQ ID NO: 576348 - DNA, 25 bp, Homo sapien
actaatgaggatgcaactggcttat

SEQ ID NO: 576349 - DNA, 25 bp, Homo sapien
gcaactggcttattggtatgaaata

SEQ ID NO: 576350 - DNA, 25 bp, Homo sapien
gggcaagcaggcaaagagtactatc

SEQ ID NO: 576351 - DNA, 25 bp, Homo sapien
agagtactatccacatggcaggcag

SEQ ID NO: 576352 - DNA, 25 bp, Homo sapien
atccacatggcaggcaggtggcttt

SEQ ID NO: 576353 - DNA, 25 bp, Homo sapien
ttgtgtctggaaagctttgcctagc

SEQ ID NO: 576354 - DNA, 25 bp, Homo sapien
gaaagctttgcctagccagtacagc

SEQ ID NO: 576355 - DNA, 25 bp, Homo sapien
gcctagccagtacagctgtgagcag

SEQ ID NO: 576356 - DNA, 25 bp, Homo sapien
gagcagaggctggttataaatttga

SEQ ID NO: 576357 - DNA, 25 bp, Homo sapien
ataaatttgaactccctcagcccat

SEQ ID NO: 576358 - DNA, 25 bp, Homo sapien
tagtggcagagcagtctccctcggt

SEQ ID NO: 576359 - DNA, 25 bp, Homo sapien
caccatgatcagtgtcacggacaca

SEQ ID NO: 576360 - DNA, 25 bp, Homo sapien
gtgtcacggacacatcccagcatag

SEQ ID NO: 576361 - DNA, 25 bp, Homo sapien
atagccccagttctcaaccgcatgg

SEQ ID NO: 576362 - DNA, 25 bp, Homo sapien
aaccgcatggcagggaccgtccagg

SEQ ID NO: 576363 - DNA, 25 bp, Homo sapien
accgtccaggagttggtgaggaaca

SEQ ID NO: 576364 - DNA, 25 bp, Homo sapien
aagggagcaggagacctcactcttt

SEQ ID NO: 576365 - DNA, 25 bp, Homo sapien
aggagacctcactctttcctttgaa

SEQ ID NO: 576366 - DNA, 25 bp, Homo sapien
aaagctccagataatcctacactag

SEQ ID NO: 576367 - DNA, 25 bp, Homo sapien
aatcctacactagaggtgcatatgg

SEQ ID NO: 576368 - DNA, 25 bp, Homo sapien
tctggcttcttgagggaaactggag

SEQ ID NO: 576369 - DNA, 25 bp, Homo sapien
aagccaggagcaatgacgtgtgcct

SEQ ID NO: 576370 - DNA, 25 bp, Homo sapien
gccaggagcaatgacgtgtgcctat

SEQ ID NO: 576371 - DNA, 25 bp, Homo sapien
ggagcaatgacgtgtgcctatagtc

SEQ ID NO: 576372 - DNA, 25 bp, Homo sapien
gcaatgacgtgtgcctatagtcgca

SEQ ID NO: 576373 - DNA, 25 bp, Homo sapien
atgacgtgtgcctatagtcgcagct

SEQ ID NO: 576374 - DNA, 25 bp, Homo sapien
aaggaaactgtactacatctagtta

SEQ ID NO: 576375 - DNA, 25 bp, Homo sapien
gaaactgtactacatctagttaatc

SEQ ID NO: 576376 - DNA, 25 bp, Homo sapien
ctacatctagttaatcataggtttg

SEQ ID NO: 576377 - DNA, 25 bp, Homo sapien
gatatgtagttacgtattttttcta

SEQ ID NO: 576378 - DNA, 25 bp, Homo sapien
gttacgtattttttctaatgtgcat

SEQ ID NO: 576379 - DNA, 25 bp, Homo sapien
acgtattttttctaatgtgcattaa

SEQ ID NO: 576380 - DNA, 25 bp, Homo sapien
tcctacgtgctaacatcttctagtc

SEQ ID NO: 576381 - DNA, 25 bp, Homo sapien
catcttctagtcaaacaactctcct

SEQ ID NO: 576382 - DNA, 25 bp, Homo sapien
ctctccttttcaaagggaccaggca

SEQ ID NO: 576383 - DNA, 25 bp, Homo sapien
acagtttctgcttatccctgagtag

SEQ ID NO: 576384 - DNA, 25 bp, Homo sapien
gcttatccctgagtagcagtgttca

SEQ ID NO: 576385 - DNA, 25 bp, Homo sapien
gtagcagtgttcagtttcctgccag

SEQ ID NO: 576386 - DNA, 25 bp, Homo sapien
acctcctcctgtgggaactgagaag

SEQ ID NO: 576387 - DNA, 25 bp, Homo sapien
tcgatactacaaagcccctgcttgt

SEQ ID NO: 576388 - DNA, 25 bp, Homo sapien
tagtgcaactcccatgtggtcctgt

SEQ ID NO: 576389 - DNA, 25 bp, Homo sapien
tggtcctgtggagcatatggtatct

SEQ ID NO: 576390 - DNA, 25 bp, Homo sapien
agcatatggtatcttcctcttctgg

SEQ ID NO: 576391 - DNA, 25 bp, Homo sapien
ttatgaaaatgtgtaaccaaccagt

SEQ ID NO: 576392 - DNA, 25 bp, Homo sapien
accaaccagtaatatctagccacag

SEQ ID NO: 576393 - DNA, 25 bp, Homo sapien
ctagccacaggcaaattttataaaa

SEQ ID NO: 576394 - DNA, 25 bp, Homo sapien
aactgagattacttttatagggtca

SEQ ID NO: 576395 - DNA, 25 bp, Homo sapien
gggtcagttacatgctaaggaggaa

SEQ ID NO: 576396 - DNA, 25 bp, Homo sapien
ttaccagaggctgtaaccttcttaa

SEQ ID NO: 576397 - DNA, 25 bp, Homo sapien
gaggctgtaaccttcttaatttaag

SEQ ID NO: 576398 - DNA, 25 bp, Homo sapien
attctacctattagcttagtattag

SEQ ID NO: 576399 - DNA, 25 bp, Homo sapien
gaaattcttgtcacatacaggcact

SEQ ID NO: 576400 - DNA, 25 bp, Homo sapien
tacaggcactattcactgcagtgaa

SEQ ID NO: 576401 - DNA, 25 bp, Homo sapien
gaagtatatcttttcagaaagttgc

SEQ ID NO: 576402 - DNA, 25 bp, Homo sapien
cgacaggtgtaaactggcctcggca

SEQ ID NO: 576403 - DNA, 25 bp, Homo sapien
ggcctcggcaggaagctcactattt

SEQ ID NO: 576404 - DNA, 25 bp, Homo sapien
ggaagccaatccagtacgtcaggga

SEQ ID NO: 576405 - DNA, 25 bp, Homo sapien
gaatcaaggcagaggccgaactctt

SEQ ID NO: 576406 - DNA, 25 bp, Homo sapien
gccgaactctttgctcaaggtgtaa

SEQ ID NO: 576407 - DNA, 25 bp, Homo sapien
ctttggtgaggcgtgtcatctgaga

SEQ ID NO: 576408 - DNA, 25 bp, Homo sapien
atatagtagaactgtcctcggacac

SEQ ID NO: 576409 - DNA, 25 bp, Homo sapien
gcagggccctcaaggccagaatgtg

SEQ ID NO: 576410 - DNA, 25 bp, Homo sapien
gggcccaggctatgttgccaacata

SEQ ID NO: 576411 - DNA, 25 bp, Homo sapien
aacatagactgggttgactctggag

SEQ ID NO: 576412 - DNA, 25 bp, Homo sapien
gactctggagaacttgctgaaactt

SEQ ID NO: 576413 - DNA, 25 bp, Homo sapien
atttgccaaatgtgttctcctctgg

SEQ ID NO: 576414 - DNA, 25 bp, Homo sapien
ggtggctcactttgagtggctcaca

SEQ ID NO: 576415 - DNA, 25 bp, Homo sapien
agtggctcacatgccttctatagaa

SEQ ID NO: 576416 - DNA, 25 bp, Homo sapien
gaggtccagtaatatcttatgaatc

SEQ ID NO: 576417 - DNA, 25 bp, Homo sapien
aatctcatgggtcctttcctttaat

SEQ ID NO: 576418 - DNA, 25 bp, Homo sapien
taggtgtttcattataggagcgcat

SEQ ID NO: 576419 - DNA, 25 bp, Homo sapien
ggagcgcatctttaattagacagta

SEQ ID NO: 576420 - DNA, 25 bp, Homo sapien
ataacttatttgtctggaggacgtt

SEQ ID NO: 576421 - DNA, 25 bp, Homo sapien
tggaggacgttggttcagtatcttc

SEQ ID NO: 576422 - DNA, 25 bp, Homo sapien
gttggttcagtatcttcgtaaatca

SEQ ID NO: 576423 - DNA, 25 bp, Homo sapien
gtaaaccacagcttagtagatctag

SEQ ID NO: 576424 - DNA, 25 bp, Homo sapien
ttgttcctttactcttccatataaa

SEQ ID NO: 576425 - DNA, 25 bp, Homo sapien
gtttattcaaccatcaggttccagg

SEQ ID NO: 576426 - DNA, 25 bp, Homo sapien
tcaaccatcaggttccaggaaaaag

SEQ ID NO: 576427 - DNA, 25 bp, Homo sapien
gttagtattttcattggacttacat

SEQ ID NO: 576428 - DNA, 25 bp, Homo sapien
gtattttcattggacttacatggaa

SEQ ID NO: 576429 - DNA, 25 bp, Homo sapien
tttcattggacttacatggaatttg

SEQ ID NO: 576430 - DNA, 25 bp, Homo sapien
ggacttacatggaatttgtagattt

SEQ ID NO: 576431 - DNA, 25 bp, Homo sapien
tttatgagtcttcctattcataaaa

SEQ ID NO: 576432 - DNA, 25 bp, Homo sapien
aatagtatgtctccatttacttatg

SEQ ID NO: 576433 - DNA, 25 bp, Homo sapien
gtatgtctccatttacttatgtctt

SEQ ID NO: 576434 - DNA, 25 bp, Homo sapien
tatgtctttaagtgtatttcagtaa

SEQ ID NO: 576435 - DNA, 25 bp, Homo sapien
agacaggatgtctgaggtcagaagt

SEQ ID NO: 576436 - DNA, 25 bp, Homo sapien
ggtgaccaaaccagttaagactgat

SEQ ID NO: 576437 - DNA, 25 bp, Homo sapien
gactgatgagattcaagatccagct

SEQ ID NO: 576438 - DNA, 25 bp, Homo sapien
gagattcaagatccagctcacttcg

SEQ ID NO: 576439 - DNA, 25 bp, Homo sapien
aagatccagctcacttcgcctttga

SEQ ID NO: 576440 - DNA, 25 bp, Homo sapien
tccagctcacttcgcctttgaagaa

SEQ ID NO: 576441 - DNA, 25 bp, Homo sapien
agctcacttcgcctttgaagaacct

SEQ ID NO: 576442 - DNA, 25 bp, Homo sapien
ttcgcctttgaagaacctccaactt

SEQ ID NO: 576443 - DNA, 25 bp, Homo sapien
gcctttgaagaacctccaacttcat

SEQ ID NO: 576444 - DNA, 25 bp, Homo sapien
tgccatgacagtttataatcaccat

SEQ ID NO: 576445 - DNA, 25 bp, Homo sapien
atgacagtttataatcaccatgaca

SEQ ID NO: 576446 - DNA, 25 bp, Homo sapien
ctgcgctgggtatgtggcatattaa

SEQ ID NO: 576447 - DNA, 25 bp, Homo sapien
gagataggacttccctttaagtaca

SEQ ID NO: 576448 - DNA, 25 bp, Homo sapien
ggacttccctttaagtacatcattg

SEQ ID NO: 576449 - DNA, 25 bp, Homo sapien
ttccctttaagtacatcattgtcta

SEQ ID NO: 576450 - DNA, 25 bp, Homo sapien
cattgtctaatgatcacacaccaaa

SEQ ID NO: 576451 - DNA, 25 bp, Homo sapien
gatcacacaccaaataattgtacta

SEQ ID NO: 576452 - DNA, 25 bp, Homo sapien
gtactataccatgataagtctagga

SEQ ID NO: 576453 - DNA, 25 bp, Homo sapien
aagtctaggaatggagatgaacaca

SEQ ID NO: 576454 - DNA, 25 bp, Homo sapien
gatgaacacaaggtttgtcatttat

SEQ ID NO: 576455 - DNA, 25 bp, Homo sapien
agaccaaaaagtgtttttctatatg

SEQ ID NO: 576456 - DNA, 25 bp, Homo sapien
ttcattacttaacaattattaggag

SEQ ID NO: 576457 - DNA, 25 bp, Homo sapien
cagtttcttcaatcgtaaagtgaga

SEQ ID NO: 576458 - DNA, 25 bp, Homo sapien
gtgagaattgtgatgagtcattgca

SEQ ID NO: 576459 - DNA, 25 bp, Homo sapien
ttgtgatgagtcattgcagagtgac

SEQ ID NO: 576460 - DNA, 25 bp, Homo sapien
tgcagagtgactgatcagaatgtaa

SEQ ID NO: 576461 - DNA, 25 bp, Homo sapien
gactgatcagaatgtaaaggaacca

SEQ ID NO: 576462 - DNA, 25 bp, Homo sapien
gtaaaggaaccagaatgctgcccaa

SEQ ID NO: 576463 - DNA, 25 bp, Homo sapien
aaccagaatgctgcccaacttaatt

SEQ ID NO: 576464 - DNA, 25 bp, Homo sapien
gaatgctgcccaacttaatttggaa

SEQ ID NO: 576465 - DNA, 25 bp, Homo sapien
gctgcccaacttaatttggaactca

SEQ ID NO: 576466 - DNA, 25 bp, Homo sapien
caacttaatttggaactcatagagc

SEQ ID NO: 576467 - DNA, 25 bp, Homo sapien
taatttggaactcatagagcattaa

SEQ ID NO: 576468 - DNA, 25 bp, Homo sapien
gaaaaacagaccgggtgccatggtg

SEQ ID NO: 576469 - DNA, 25 bp, Homo sapien
aaaaacagaccgggtgccatggtgc

SEQ ID NO: 576470 - DNA, 25 bp, Homo sapien
aaaacagaccgggtgccatggtgca

SEQ ID NO: 576471 - DNA, 25 bp, Homo sapien
aaacagaccgggtgccatggtgcac

SEQ ID NO: 576472 - DNA, 25 bp, Homo sapien
aacagaccgggtgccatggtgcacg

SEQ ID NO: 576473 - DNA, 25 bp, Homo sapien
acagaccgggtgccatggtgcacgc

SEQ ID NO: 576474 - DNA, 25 bp, Homo sapien
cagaccgggtgccatggtgcacgcc

SEQ ID NO: 576475 - DNA, 25 bp, Homo sapien
gccaaagtgagcggatcacttcagc

SEQ ID NO: 576476 - DNA, 25 bp, Homo sapien
ccaaagtgagcggatcacttcagct

SEQ ID NO: 576477 - DNA, 25 bp, Homo sapien
caaagtgagcggatcacttcagctc

SEQ ID NO: 576478 - DNA, 25 bp, Homo sapien
ctcttgtattcttaaattatctcta

SEQ ID NO: 576479 - DNA, 25 bp, Homo sapien
tcttgtattcttaaattatctctaa

SEQ ID NO: 576480 - DNA, 25 bp, Homo sapien
cttgtattcttaaattatctctaaa

SEQ ID NO: 576481 - DNA, 25 bp, Homo sapien
ttgtattcttaaattatctctaaat

SEQ ID NO: 576482 - DNA, 25 bp, Homo sapien
tgtattcttaaattatctctaaatt

SEQ ID NO: 576483 - DNA, 25 bp, Homo sapien
tatctctaaattataatacctaatg

SEQ ID NO: 576484 - DNA, 25 bp, Homo sapien
tctctaaattataatacctaatgca

SEQ ID NO: 576485 - DNA, 25 bp, Homo sapien
taaattataatacctaatgcaatgt

SEQ ID NO: 576486 - DNA, 25 bp, Homo sapien
gtaaaagctatgtaaggctgggcat

SEQ ID NO: 576487 - DNA, 25 bp, Homo sapien
taaaagctatgtaaggctgggcatg

SEQ ID NO: 576488 - DNA, 25 bp, Homo sapien
aaaagctatgtaaggctgggcatgg

SEQ ID NO: 576489 - DNA, 25 bp, Homo sapien
ctgaggtgcaaagcagttaagcaac

SEQ ID NO: 576490 - DNA, 25 bp, Homo sapien
gtccaagatctagaccaggtactca

SEQ ID NO: 576491 - DNA, 25 bp, Homo sapien
tccaagatctagaccaggtactcaa

SEQ ID NO: 576492 - DNA, 25 bp, Homo sapien
aagatctagaccaggtactcaacca

SEQ ID NO: 576493 - DNA, 25 bp, Homo sapien
agatctagaccaggtactcaaccac

SEQ ID NO: 576494 - DNA, 25 bp, Homo sapien
aactgtccccaacccatgcgattca

SEQ ID NO: 576495 - DNA, 25 bp, Homo sapien
atgcgattcatcctttccctgaagg

SEQ ID NO: 576496 - DNA, 25 bp, Homo sapien
tgcgattcatcctttccctgaaggc

SEQ ID NO: 576497 - DNA, 25 bp, Homo sapien
ccctgaaggcttgtgtggtgctgcc

SEQ ID NO: 576498 - DNA, 25 bp, Homo sapien
ctgaaggcttgtgtggtgctgcctt

SEQ ID NO: 576499 - DNA, 25 bp, Homo sapien
tgaaggcttgtgtggtgctgccttt

SEQ ID NO: 576500 - DNA, 25 bp, Homo sapien
tgacagggcgcttcaccactgggct

SEQ ID NO: 576501 - DNA, 25 bp, Homo sapien
aaaacactggcagaccgggcgcagt

SEQ ID NO: 576502 - DNA, 25 bp, Homo sapien
aaaacaaccaagcaaagtctgagaa

SEQ ID NO: 576503 - DNA, 25 bp, Homo sapien
aactgtcacagcctagaggaacctg

SEQ ID NO: 576504 - DNA, 25 bp, Homo sapien
gtcacagcctagaggaacctggaga

SEQ ID NO: 576505 - DNA, 25 bp, Homo sapien
ggaacctggagacagctgatcccta

SEQ ID NO: 576506 - DNA, 25 bp, Homo sapien
aacctggagacagctgatccctaaa

SEQ ID NO: 576507 - DNA, 25 bp, Homo sapien
ctggagacagctgatccctaaatgt

SEQ ID NO: 576508 - DNA, 25 bp, Homo sapien
gagacagctgatccctaaatgtcac

SEQ ID NO: 576509 - DNA, 25 bp, Homo sapien
cagctgatccctaaatgtcacgtgg

SEQ ID NO: 576510 - DNA, 25 bp, Homo sapien
taaatgtcacgtgggatcctgggtg

SEQ ID NO: 576511 - DNA, 25 bp, Homo sapien
tatccccaatccttaagcaatcact

SEQ ID NO: 576512 - DNA, 25 bp, Homo sapien
tctgtcactatcagttaatttgaat

SEQ ID NO: 576513 - DNA, 25 bp, Homo sapien
aaatcattcgacatgtatgctcttt

SEQ ID NO: 576514 - DNA, 25 bp, Homo sapien
catgtatgctctttttctgttcacc

SEQ ID NO: 576515 - DNA, 25 bp, Homo sapien
tctttttctgttcacccggtacaat

SEQ ID NO: 576516 - DNA, 25 bp, Homo sapien
gttcacccggtacaatttgagattt

SEQ ID NO: 576517 - DNA, 25 bp, Homo sapien
tttagccatgtttttgcatgtgtca

SEQ ID NO: 576518 - DNA, 25 bp, Homo sapien
ttttttgttgctcagtactaatcca

SEQ ID NO: 576519 - DNA, 25 bp, Homo sapien
gttgctcagtactaatccattttat

SEQ ID NO: 576520 - DNA, 25 bp, Homo sapien
agagaaatgtattaatgcaatccca

SEQ ID NO: 576521 - DNA, 25 bp, Homo sapien
gcaatcccatattaataggcatttg

SEQ ID NO: 576522 - DNA, 25 bp, Homo sapien
ccatatacgttacttgacatgtgaa

SEQ ID NO: 576523 - DNA, 25 bp, Homo sapien
atttggctgaccttgaaaactacag

SEQ ID NO: 576524 - DNA, 25 bp, Homo sapien
gaaaactacagctgtttagtcactt

SEQ ID NO: 576525 - DNA, 25 bp, Homo sapien
actacagctgtttagtcactttgaa

SEQ ID NO: 576526 - DNA, 25 bp, Homo sapien
gaaaacaatgcaatacaagtgattt

SEQ ID NO: 576527 - DNA, 25 bp, Homo sapien
atacaagtgatttactaggcttcag

SEQ ID NO: 576528 - DNA, 25 bp, Homo sapien
agtgatttactaggcttcagtttta

SEQ ID NO: 576529 - DNA, 25 bp, Homo sapien
tatgctgactggtggaaattctaac

SEQ ID NO: 576530 - DNA, 25 bp, Homo sapien
ctggtggaaattctaacccttcaga

SEQ ID NO: 576531 - DNA, 25 bp, Homo sapien
gcaatggaaatgtaccatcctgggt

SEQ ID NO: 576532 - DNA, 25 bp, Homo sapien
accatcctgggtattaatgtcatta

SEQ ID NO: 576533 - DNA, 25 bp, Homo sapien
cagcaggctggactcggtgcaggga

SEQ ID NO: 576534 - DNA, 25 bp, Homo sapien
ggactcggtgcagggaccatggctt

SEQ ID NO: 576535 - DNA, 25 bp, Homo sapien
agggaccatggcttggcgtggccag

SEQ ID NO: 576536 - DNA, 25 bp, Homo sapien
cttggcgtggccaggttggagtggc

SEQ ID NO: 576537 - DNA, 25 bp, Homo sapien
tggagtggcccctgggactgaaagc

SEQ ID NO: 576538 - DNA, 25 bp, Homo sapien
gggacgtcctgtggcgggtaccctg

SEQ ID NO: 576539 - DNA, 25 bp, Homo sapien
tcctgtggcgggtaccctgctgggt

SEQ ID NO: 576540 - DNA, 25 bp, Homo sapien
gggtaccctgctgggtcctgggtgg

SEQ ID NO: 576541 - DNA, 25 bp, Homo sapien
ggaacattccagaccacctaggagt

SEQ ID NO: 576542 - DNA, 25 bp, Homo sapien
aaaaaacatctgacctgcgtgcaaa

SEQ ID NO: 576543 - DNA, 25 bp, Homo sapien
tgcgtgcaaagctcaagcccagagg

SEQ ID NO: 576544 - DNA, 25 bp, Homo sapien
tgcagtggcactgtatccggaattg

SEQ ID NO: 576545 - DNA, 25 bp, Homo sapien
cagtggcactgtatccggaattggg

SEQ ID NO: 576546 - DNA, 25 bp, Homo sapien
ctgggaacatgtttacatggacttt

SEQ ID NO: 576547 - DNA, 25 bp, Homo sapien
acatgtttacatggactttgttcac

SEQ ID NO: 576548 - DNA, 25 bp, Homo sapien
gtttacatggactttgttcactttt

SEQ ID NO: 576549 - DNA, 25 bp, Homo sapien
ttacatggactttgttcacttttta

SEQ ID NO: 576550 - DNA, 25 bp, Homo sapien
caaactgagggtaacttactagatc

SEQ ID NO: 576551 - DNA, 25 bp, Homo sapien
gagggtaacttactagatctgtgaa

SEQ ID NO: 576552 - DNA, 25 bp, Homo sapien
gggtaacttactagatctgtgaact

SEQ ID NO: 576553 - DNA, 25 bp, Homo sapien
gtaacttactagatctgtgaactaa

SEQ ID NO: 576554 - DNA, 25 bp, Homo sapien
cttactagatctgtgaactaaagaa

SEQ ID NO: 576555 - DNA, 25 bp, Homo sapien
gtcatcattttatcttcatcactat

SEQ ID NO: 576556 - DNA, 25 bp, Homo sapien
tatcttcatcactatcatcaccttc

SEQ ID NO: 576557 - DNA, 25 bp, Homo sapien
atcaccttcactgcttgtttatcat

SEQ ID NO: 576558 - DNA, 25 bp, Homo sapien
ccttcactgcttgtttatcatcatc

SEQ ID NO: 576559 - DNA, 25 bp, Homo sapien
tcactgcttgtttatcatcatcttt

SEQ ID NO: 576560 - DNA, 25 bp, Homo sapien
ttcctcattatctttccatcatctt

SEQ ID NO: 576561 - DNA, 25 bp, Homo sapien
cctcattatctttccatcatcttta

SEQ ID NO: 576562 - DNA, 25 bp, Homo sapien
attatctttccatcatctttagcaa

SEQ ID NO: 576563 - DNA, 25 bp, Homo sapien
tatctttccatcatctttagcaaca

SEQ ID NO: 576564 - DNA, 25 bp, Homo sapien
ttccatcatctttagcaacaacttt

SEQ ID NO: 576565 - DNA, 25 bp, Homo sapien
tcatctttagcaacaactttgtcaa

SEQ ID NO: 576566 - DNA, 25 bp, Homo sapien
tttacccaattatatcctgttagga

SEQ ID NO: 576567 - DNA, 25 bp, Homo sapien
tatcctgttaggaaggaggacagat

SEQ ID NO: 576568 - DNA, 25 bp, Homo sapien
gaggacagattcttacagatcctgt

SEQ ID NO: 576569 - DNA, 25 bp, Homo sapien
cagattcttacagatcctgtttaca

SEQ ID NO: 576570 - DNA, 25 bp, Homo sapien
tcctgtttacagaactaatgatcgt

SEQ ID NO: 576571 - DNA, 25 bp, Homo sapien
gaaaagggtctcagcaaaggtactt

SEQ ID NO: 576572 - DNA, 25 bp, Homo sapien
aagggtctcagcaaaggtactttga

SEQ ID NO: 576573 - DNA, 25 bp, Homo sapien
gaagagtttttagctattattccta

SEQ ID NO: 576574 - DNA, 25 bp, Homo sapien
agctattattcctagtagttttgta

SEQ ID NO: 576575 - DNA, 25 bp, Homo sapien
tagttttgtagataaggccaattac

SEQ ID NO: 576576 - DNA, 25 bp, Homo sapien
tttcatatctatgttaggtttttat

SEQ ID NO: 576577 - DNA, 25 bp, Homo sapien
actttttctagtattttgtctatct

SEQ ID NO: 576578 - DNA, 25 bp, Homo sapien
gtattttgtctatcttacgtcaaag

SEQ ID NO: 576579 - DNA, 25 bp, Homo sapien
ttgtctatcttacgtcaaagattta

SEQ ID NO: 576580 - DNA, 25 bp, Homo sapien
atatctttgacctcctgtactaaat

SEQ ID NO: 576581 - DNA, 25 bp, Homo sapien
tctttgacctcctgtactaaatacc

SEQ ID NO: 576582 - DNA, 25 bp, Homo sapien
tgacctcctgtactaaataccacgc

SEQ ID NO: 576583 - DNA, 25 bp, Homo sapien
tgtactaaataccacgccacatcag

SEQ ID NO: 576584 - DNA, 25 bp, Homo sapien
aaataccacgccacatcagttttag

SEQ ID NO: 576585 - DNA, 25 bp, Homo sapien
taccacgccacatcagttttagttg

SEQ ID NO: 576586 - DNA, 25 bp, Homo sapien
gccacatcagttttagttgcctttc

SEQ ID NO: 576587 - DNA, 25 bp, Homo sapien
acatcagttttagttgcctttcttt

SEQ ID NO: 576588 - DNA, 25 bp, Homo sapien
tgggcaacatacagatgtctacaaa

SEQ ID NO: 576589 - DNA, 25 bp, Homo sapien
gggcaacatacagatgtctacaaaa

SEQ ID NO: 576590 - DNA, 25 bp, Homo sapien
caacatacagatgtctacaaaaata

SEQ ID NO: 576591 - DNA, 25 bp, Homo sapien
aacatacagatgtctacaaaaataa

SEQ ID NO: 576592 - DNA, 25 bp, Homo sapien
acatacagatgtctacaaaaataaa

SEQ ID NO: 576593 - DNA, 25 bp, Homo sapien
catacagatgtctacaaaaataaaa

SEQ ID NO: 576594 - DNA, 25 bp, Homo sapien
gcacctgtagtcccaactgctaggg

SEQ ID NO: 576595 - DNA, 25 bp, Homo sapien
cacctgtagtcccaactgctaggga

SEQ ID NO: 576596 - DNA, 25 bp, Homo sapien
acctgtagtcccaactgctagggag

SEQ ID NO: 576597 - DNA, 25 bp, Homo sapien
gtctgggcaacctggcaaaaccaaa

SEQ ID NO: 576598 - DNA, 25 bp, Homo sapien
tctgggcaacctggcaaaaccaaaa

SEQ ID NO: 576599 - DNA, 25 bp, Homo sapien
cagcctctgcaaccatgactgacgg

SEQ ID NO: 576600 - DNA, 25 bp, Homo sapien
tgcaaccatgactgacggctgccct

SEQ ID NO: 576601 - DNA, 25 bp, Homo sapien
gtccagcaccgcttgtcctagggaa

SEQ ID NO: 576602 - DNA, 25 bp, Homo sapien
cagcaccgcttgtcctagggaagtc

SEQ ID NO: 576603 - DNA, 25 bp, Homo sapien
ctagggaagtcctgcgtggagtctt

SEQ ID NO: 576604 - DNA, 25 bp, Homo sapien
ggaagtcctgcgtggagtcttgcct

SEQ ID NO: 576605 - DNA, 25 bp, Homo sapien
agtcctgcgtggagtcttgcctcaa

SEQ ID NO: 576606 - DNA, 25 bp, Homo sapien
gcgtggagtcttgcctcaatctgct

SEQ ID NO: 576607 - DNA, 25 bp, Homo sapien
tcaatctgctgccgtccaagcctgg

SEQ ID NO: 576608 - DNA, 25 bp, Homo sapien
cgacctccccacaataaaatgtgat

SEQ ID NO: 576609 - DNA, 25 bp, Homo sapien
aaaatgtgattggatcgtgtggtac

SEQ ID NO: 576610 - DNA, 25 bp, Homo sapien
agtttcgctctagttgcccacacta

SEQ ID NO: 576611 - DNA, 25 bp, Homo sapien
tttcgctctagttgcccacactaga

SEQ ID NO: 576612 - DNA, 25 bp, Homo sapien
tctagttgcccacactagagtgcaa

SEQ ID NO: 576613 - DNA, 25 bp, Homo sapien
cagccattccaggatttttctagag

SEQ ID NO: 576614 - DNA, 25 bp, Homo sapien
gccattccaggatttttctagagcc

SEQ ID NO: 576615 - DNA, 25 bp, Homo sapien
cattccaggatttttctagagcctg

SEQ ID NO: 576616 - DNA, 25 bp, Homo sapien
aggatttttctagagcctggcaaga

SEQ ID NO: 576617 - DNA, 25 bp, Homo sapien
ggatttttctagagcctggcaagag

SEQ ID NO: 576618 - DNA, 25 bp, Homo sapien
gatttttctagagcctggcaagagc

SEQ ID NO: 576619 - DNA, 25 bp, Homo sapien
tttctagagcctggcaagagctcct

SEQ ID NO: 576620 - DNA, 25 bp, Homo sapien
tctagagcctggcaagagctcctga

SEQ ID NO: 576621 - DNA, 25 bp, Homo sapien
gtggaggcctccttgaggcctgact

SEQ ID NO: 576622 - DNA, 25 bp, Homo sapien
ctccttgaggcctgactgggtgggt

SEQ ID NO: 576623 - DNA, 25 bp, Homo sapien
actgggtgggtcttgtgtgggctgc

SEQ ID NO: 576624 - DNA, 25 bp, Homo sapien
caggtgtgcactgggcctgcttgtg

SEQ ID NO: 576625 - DNA, 25 bp, Homo sapien
actgggcctgcttgtggccaggcca

SEQ ID NO: 576626 - DNA, 25 bp, Homo sapien
tttgcctgtggtcgtccgcacctgc

SEQ ID NO: 576627 - DNA, 25 bp, Homo sapien
tgccaccggcctactttgtcctaga

SEQ ID NO: 576628 - DNA, 25 bp, Homo sapien
tactttgtcctagacctcccttttg

SEQ ID NO: 576629 - DNA, 25 bp, Homo sapien
acctcccttttgcaaaagtgctcag

SEQ ID NO: 576630 - DNA, 25 bp, Homo sapien
cccttttgcaaaagtgctcagaaat

SEQ ID NO: 576631 - DNA, 25 bp, Homo sapien
tgcaaaagtgctcagaaatataaat

SEQ ID NO: 576632 - DNA, 25 bp, Homo sapien
ctcaggttcgaacaaaagcaaaggc

SEQ ID NO: 576633 - DNA, 25 bp, Homo sapien
aaaggctgagagtgcagctctccat

SEQ ID NO: 576634 - DNA, 25 bp, Homo sapien
gagagtgcagctctccatgctggac

SEQ ID NO: 576635 - DNA, 25 bp, Homo sapien
tctccatgctggactccgcaaagag

SEQ ID NO: 576636 - DNA, 25 bp, Homo sapien
ccatgctggactccgcaaagagcag

SEQ ID NO: 576637 - DNA, 25 bp, Homo sapien
gagtccctggaaagggccctgcagc

SEQ ID NO: 576638 - DNA, 25 bp, Homo sapien
ctgacaaaaatctgtgatgagctga

SEQ ID NO: 576639 - DNA, 25 bp, Homo sapien
gatgagctgattgcaaagctgggaa

SEQ ID NO: 576640 - DNA, 25 bp, Homo sapien
gctcaacagatctgcatttggctgc

SEQ ID NO: 576641 - DNA, 25 bp, Homo sapien
ttgtgaccacaattatcttgcctta

SEQ ID NO: 576642 - DNA, 25 bp, Homo sapien
tgccttatccaggaataattgcccc

SEQ ID NO: 576643 - DNA, 25 bp, Homo sapien
aggcctcatctccacttgccaggag

SEQ ID NO: 576644 - DNA, 25 bp, Homo sapien
accacccttggagacacggcttgtt

SEQ ID NO: 576645 - DNA, 25 bp, Homo sapien
acccttggagacacggcttgttcca

SEQ ID NO: 576646 - DNA, 25 bp, Homo sapien
cccttggagacacggcttgttccag

SEQ ID NO: 576647 - DNA, 25 bp, Homo sapien
ttggagacacggcttgttccagatg

SEQ ID NO: 576648 - DNA, 25 bp, Homo sapien
tggagacacggcttgttccagatga

SEQ ID NO: 576649 - DNA, 25 bp, Homo sapien
ggagacacggcttgttccagatgag

SEQ ID NO: 576650 - DNA, 25 bp, Homo sapien
gagacacggcttgttccagatgagg

SEQ ID NO: 576651 - DNA, 25 bp, Homo sapien
agacacggcttgttccagatgagga

SEQ ID NO: 576652 - DNA, 25 bp, Homo sapien
gacacggcttgttccagatgaggaa

SEQ ID NO: 576653 - DNA, 25 bp, Homo sapien
acacggcttgttccagatgaggaaa

SEQ ID NO: 576654 - DNA, 25 bp, Homo sapien
accactcctgactaatttttctgta

SEQ ID NO: 576655 - DNA, 25 bp, Homo sapien
gggttcaggccatctgcctgtctgg

SEQ ID NO: 576656 - DNA, 25 bp, Homo sapien
ctgcctgtctggtcttcccagagag

SEQ ID NO: 576657 - DNA, 25 bp, Homo sapien
cctgtctggtcttcccagagagctg

SEQ ID NO: 576658 - DNA, 25 bp, Homo sapien
caccacacctgtcttgttgaatttt

SEQ ID NO: 576659 - DNA, 25 bp, Homo sapien
ataaacagtcatacaatttgcaaaa

SEQ ID NO: 576660 - DNA, 25 bp, Homo sapien
tttagttccttgtgtggttcctaag

SEQ ID NO: 576661 - DNA, 25 bp, Homo sapien
tagttccttgtgtggttcctaaggc

SEQ ID NO: 576662 - DNA, 25 bp, Homo sapien
ttgtgtggttcctaaggcctccaat

SEQ ID NO: 576663 - DNA, 25 bp, Homo sapien
tgtggttcctaaggcctccaataaa

SEQ ID NO: 576664 - DNA, 25 bp, Homo sapien
aggcctccaataaaacaaagtgaca

SEQ ID NO: 576665 - DNA, 25 bp, Homo sapien
ctgggcgcgctgcacaaggcgctca

SEQ ID NO: 576666 - DNA, 25 bp, Homo sapien
gcgctgcgcgctgggaagcgcgaga

SEQ ID NO: 576667 - DNA, 25 bp, Homo sapien
aagcgcgagaagtcgctggtggccc

SEQ ID NO: 576668 - DNA, 25 bp, Homo sapien
cgcgagaagtcgctggtggcccagc

SEQ ID NO: 576669 - DNA, 25 bp, Homo sapien
ctggccgcggcgcagcttgagctgc

SEQ ID NO: 576670 - DNA, 25 bp, Homo sapien
gcttgagctgcagatgaccgcgctg

SEQ ID NO: 576671 - DNA, 25 bp, Homo sapien
ttgagctgcagatgaccgcgctgcg

SEQ ID NO: 576672 - DNA, 25 bp, Homo sapien
agctgcagatgaccgcgctgcgcta

SEQ ID NO: 576673 - DNA, 25 bp, Homo sapien
agatgaccgcgctgcgctaccagaa

SEQ ID NO: 576674 - DNA, 25 bp, Homo sapien
gaccgcgctgcgctaccagaagaaa

SEQ ID NO: 576675 - DNA, 25 bp, Homo sapien
accgcgctgcgctaccagaagaaat

SEQ ID NO: 576676 - DNA, 25 bp, Homo sapien
aaaatcgtcttaagctctaaggtgg

SEQ ID NO: 576677 - DNA, 25 bp, Homo sapien
agctctaaggtggtctcagtattgc

SEQ ID NO: 576678 - DNA, 25 bp, Homo sapien
aggtggtctcagtattgcaatatca

SEQ ID NO: 576679 - DNA, 25 bp, Homo sapien
ttgtttttatttgccggctgaggat

SEQ ID NO: 576680 - DNA, 25 bp, Homo sapien
gccggctgaggattctgtcacaatg

SEQ ID NO: 576681 - DNA, 25 bp, Homo sapien
aactgtttatatagaccccattgga

SEQ ID NO: 576682 - DNA, 25 bp, Homo sapien
aaagcaaaacgctctcactgagatc

SEQ ID NO: 576683 - DNA, 25 bp, Homo sapien
ctgagatcagggatcccaaattcat

SEQ ID NO: 576684 - DNA, 25 bp, Homo sapien
gggatcccaaattcatgggacttat

SEQ ID NO: 576685 - DNA, 25 bp, Homo sapien
gacaattaatgctgatttgggtaca

SEQ ID NO: 576686 - DNA, 25 bp, Homo sapien
gaattatgtgtgtgaatgtcatcta

SEQ ID NO: 576687 - DNA, 25 bp, Homo sapien
attatagtcctagttctttcgctta

SEQ ID NO: 576688 - DNA, 25 bp, Homo sapien
atagtcctagttctttcgcttacta

SEQ ID NO: 576689 - DNA, 25 bp, Homo sapien
agttctttcgcttactagagatttg

SEQ ID NO: 576690 - DNA, 25 bp, Homo sapien
ctagagatttgaccttgaaaagctt

SEQ ID NO: 576691 - DNA, 25 bp, Homo sapien
ttgaccttgaaaagcttaatttgtt

SEQ ID NO: 576692 - DNA, 25 bp, Homo sapien
gtttaaatcccgtttcctcatctga

SEQ ID NO: 576693 - DNA, 25 bp, Homo sapien
gaagactgatgatatctgtcctaac

SEQ ID NO: 576694 - DNA, 25 bp, Homo sapien
atgatatctgtcctaactccatctt

SEQ ID NO: 576695 - DNA, 25 bp, Homo sapien
ctgtcctaactccatcttgtgatga

SEQ ID NO: 576696 - DNA, 25 bp, Homo sapien
aactccatcttgtgatgatccaatg

SEQ ID NO: 576697 - DNA, 25 bp, Homo sapien
gatccaatggaataaagtgctgtca

SEQ ID NO: 576698 - DNA, 25 bp, Homo sapien
aacaaagcagggacacacaccacat

SEQ ID NO: 576699 - DNA, 25 bp, Homo sapien
aaagcagggacacacaccacatgga

SEQ ID NO: 576700 - DNA, 25 bp, Homo sapien
gcagggacacacaccacatggacaa

SEQ ID NO: 576701 - DNA, 25 bp, Homo sapien
gggacacacaccacatggacaaacc

SEQ ID NO: 576702 - DNA, 25 bp, Homo sapien
acaccacatggacaaacccagcaaa

SEQ ID NO: 576703 - DNA, 25 bp, Homo sapien
accacatggacaaacccagcaaacg

SEQ ID NO: 576704 - DNA, 25 bp, Homo sapien
taccgcgagggaaatcacctagaca

SEQ ID NO: 576705 - DNA, 25 bp, Homo sapien
atcacctagacacagaaggccactt

SEQ ID NO: 576706 - DNA, 25 bp, Homo sapien
gaaggccacttgtccgatgacgcca

SEQ ID NO: 576707 - DNA, 25 bp, Homo sapien
cacttgtccgatgacgccatttata

SEQ ID NO: 576708 - DNA, 25 bp, Homo sapien
acttgtccgatgacgccatttatat

SEQ ID NO: 576709 - DNA, 25 bp, Homo sapien
tttttcctgctagtgcaaaaggtag

SEQ ID NO: 576710 - DNA, 25 bp, Homo sapien
ttttcctgctagtgcaaaaggtaga

SEQ ID NO: 576711 - DNA, 25 bp, Homo sapien
ttcctgctagtgcaaaaggtagatg

SEQ ID NO: 576712 - DNA, 25 bp, Homo sapien
caaaaggtagatgagtaggaagatt

SEQ ID NO: 576713 - DNA, 25 bp, Homo sapien
gaagattaggactcctgagttgccc

SEQ ID NO: 576714 - DNA, 25 bp, Homo sapien
aagattaggactcctgagttgccca

SEQ ID NO: 576715 - DNA, 25 bp, Homo sapien
agattaggactcctgagttgcccat

SEQ ID NO: 576716 - DNA, 25 bp, Homo sapien
gattaggactcctgagttgcccatg

SEQ ID NO: 576717 - DNA, 25 bp, Homo sapien
attaggactcctgagttgcccatga

SEQ ID NO: 576718 - DNA, 25 bp, Homo sapien
ttaggactcctgagttgcccatgat

SEQ ID NO: 576719 - DNA, 25 bp, Homo sapien
taggactcctgagttgcccatgatt

SEQ ID NO: 576720 - DNA, 25 bp, Homo sapien
aggatcactgagcaaaaccacaaat

SEQ ID NO: 576721 - DNA, 25 bp, Homo sapien
gatcactgagcaaaaccacaaatat

SEQ ID NO: 576722 - DNA, 25 bp, Homo sapien
aattggaaacgaagccattgtgaaa

SEQ ID NO: 576723 - DNA, 25 bp, Homo sapien
cattctaggatctaaattgttttat

SEQ ID NO: 576724 - DNA, 25 bp, Homo sapien
gggagaagacccaagtatcagatgc

SEQ ID NO: 576725 - DNA, 25 bp, Homo sapien
gagaagacccaagtatcagatgcag

SEQ ID NO: 576726 - DNA, 25 bp, Homo sapien
gaagacccaagtatcagatgcagga

SEQ ID NO: 576727 - DNA, 25 bp, Homo sapien
gacccaagtatcagatgcaggagga

SEQ ID NO: 576728 - DNA, 25 bp, Homo sapien
aagtatcagatgcaggaggagcctt

SEQ ID NO: 576729 - DNA, 25 bp, Homo sapien
atcagatgcaggaggagcctttgcc

SEQ ID NO: 576730 - DNA, 25 bp, Homo sapien
gatgcaggaggagcctttgccacag

SEQ ID NO: 576731 - DNA, 25 bp, Homo sapien
ctgatggattaaaagtgtgtgcacc

SEQ ID NO: 576732 - DNA, 25 bp, Homo sapien
aaaagtgtgtgcacctcccctcttg

SEQ ID NO: 576733 - DNA, 25 bp, Homo sapien
aagtgtgtgcacctcccctcttgca

SEQ ID NO: 576734 - DNA, 25 bp, Homo sapien
ttgcactttctctccagtcaccatg

SEQ ID NO: 576735 - DNA, 25 bp, Homo sapien
tgcactttctctccagtcaccatgt

SEQ ID NO: 576736 - DNA, 25 bp, Homo sapien
ttcttattaagcctgtggaattgtg

SEQ ID NO: 576737 - DNA, 25 bp, Homo sapien
ttattaagcctgtggaattgtgagt

SEQ ID NO: 576738 - DNA, 25 bp, Homo sapien
agtcaattaagcctttttattcata

SEQ ID NO: 576739 - DNA, 25 bp, Homo sapien
gtctcaggtagatctttatagagtg

SEQ ID NO: 576740 - DNA, 25 bp, Homo sapien
caggtagatctttatagagtgtgaa

SEQ ID NO: 576741 - DNA, 25 bp, Homo sapien
gtagatctttatagagtgtgaaaac

SEQ ID NO: 576742 - DNA, 25 bp, Homo sapien
cagacagcccgccccaaagaaaaat

SEQ ID NO: 576743 - DNA, 25 bp, Homo sapien
aagtcaagggcctaccaaggcaatt

SEQ ID NO: 576744 - DNA, 25 bp, Homo sapien
caagggcctaccaaggcaattggat

SEQ ID NO: 576745 - DNA, 25 bp, Homo sapien
aagtcacccgcttggctctcttcaa

SEQ ID NO: 576746 - DNA, 25 bp, Homo sapien
ttggctctcttcaagtgcactttgc

SEQ ID NO: 576747 - DNA, 25 bp, Homo sapien
tttgcttccttttgttcttgctcta

SEQ ID NO: 576748 - DNA, 25 bp, Homo sapien
tcttgctctaaaacttttactcctg

SEQ ID NO: 576749 - DNA, 25 bp, Homo sapien
tctaaaacttttactcctgctataa

SEQ ID NO: 576750 - DNA, 25 bp, Homo sapien
ctgctataaaacttgccttggacta

SEQ ID NO: 576751 - DNA, 25 bp, Homo sapien
gccttggactatcatgctaccttac

SEQ ID NO: 576752 - DNA, 25 bp, Homo sapien
tggactatcatgctaccttacgcct

SEQ ID NO: 576753 - DNA, 25 bp, Homo sapien
gaaggttagatttgcacagtctact

SEQ ID NO: 576754 - DNA, 25 bp, Homo sapien
atttgcacagtctactgggtaggta

SEQ ID NO: 576755 - DNA, 25 bp, Homo sapien
ggtgttaagaggtgtttcacttgct

SEQ ID NO: 576756 - DNA, 25 bp, Homo sapien
cacttgctgagatttcctgtacatt

SEQ ID NO: 576757 - DNA, 25 bp, Homo sapien
gagatttcctgtacattgcaaacaa

SEQ ID NO: 576758 - DNA, 25 bp, Homo sapien
tacagaatgcaaaccctcaaagctg

SEQ ID NO: 576759 - DNA, 25 bp, Homo sapien
gtgtttgtcctgtatttacagttgt

SEQ ID NO: 576760 - DNA, 25 bp, Homo sapien
gttgtttttgactatgcaggagcta

SEQ ID NO: 576761 - DNA, 25 bp, Homo sapien
gactatgcaggagctatcagtgcta

SEQ ID NO: 576762 - DNA, 25 bp, Homo sapien
tatcagtgctagagtgagcatgctt

SEQ ID NO: 576763 - DNA, 25 bp, Homo sapien
gtgagcatgcttcaaaactgtacat

SEQ ID NO: 576764 - DNA, 25 bp, Homo sapien
cagcaggctggactcggtgcaggga

SEQ ID NO: 576765 - DNA, 25 bp, Homo sapien
aggctggactcggtgcagggaccat

SEQ ID NO: 576766 - DNA, 25 bp, Homo sapien
tggactcggtgcagggaccatggct

SEQ ID NO: 576767 - DNA, 25 bp, Homo sapien
actcggtgcagggaccatggcttgg

SEQ ID NO: 576768 - DNA, 25 bp, Homo sapien
ggtgcagggaccatggcttggcgtg

SEQ ID NO: 576769 - DNA, 25 bp, Homo sapien
agggaccatggcttggcgtggccag

SEQ ID NO: 576770 - DNA, 25 bp, Homo sapien
atggcttggcgtggccaggttggag

SEQ ID NO: 576771 - DNA, 25 bp, Homo sapien
cttggcgtggccaggttggagtggc

SEQ ID NO: 576772 - DNA, 25 bp, Homo sapien
tggagtggcccctgggactgaaagc

SEQ ID NO: 576773 - DNA, 25 bp, Homo sapien
gggacgtcctgtggcgggtaccctg

SEQ ID NO: 576774 - DNA, 25 bp, Homo sapien
tcctgtggcgggtaccctgctgggt

SEQ ID NO: 576775 - DNA, 25 bp, Homo sapien
atgctgcaagtgaggtaagatctga

SEQ ID NO: 576776 - DNA, 25 bp, Homo sapien
gcaagtgaggtaagatctgaaatct

SEQ ID NO: 576777 - DNA, 25 bp, Homo sapien
ttgtaatgccaactgcaagtaatta

SEQ ID NO: 576778 - DNA, 25 bp, Homo sapien
tgccaactgcaagtaattacaatat

SEQ ID NO: 576779 - DNA, 25 bp, Homo sapien
gtgaacagtgttcttgctttgtacc

SEQ ID NO: 576780 - DNA, 25 bp, Homo sapien
aacagtgttcttgctttgtacctgg

SEQ ID NO: 576781 - DNA, 25 bp, Homo sapien
agtgttcttgctttgtacctggaga

SEQ ID NO: 576782 - DNA, 25 bp, Homo sapien
gttcttgctttgtacctggagagct

SEQ ID NO: 576783 - DNA, 25 bp, Homo sapien
tgctttgtacctggagagctctttc

SEQ ID NO: 576784 - DNA, 25 bp, Homo sapien
gagctctttctcaaatgtgttagga

SEQ ID NO: 576785 - DNA, 25 bp, Homo sapien
gctctttctcaaatgtgttaggaat

SEQ ID NO: 576786 - DNA, 25 bp, Homo sapien
tgggccagcaggaggccaagctcta

SEQ ID NO: 576787 - DNA, 25 bp, Homo sapien
gccaagctctacgggaagaagcgca

SEQ ID NO: 576788 - DNA, 25 bp, Homo sapien
ggcactgtggttgctgagccccagc

SEQ ID NO: 576789 - DNA, 25 bp, Homo sapien
gtgtcctcctatgcctacacgaagg

SEQ ID NO: 576790 - DNA, 25 bp, Homo sapien
tatgcctacacgaaggtcactggcc

SEQ ID NO: 576791 - DNA, 25 bp, Homo sapien
ctacagccgctggatctaggtgcca

SEQ ID NO: 576792 - DNA, 25 bp, Homo sapien
acagccgctggatctaggtgccagg

SEQ ID NO: 576793 - DNA, 25 bp, Homo sapien
tgccagggagccagcgtacctcagc

SEQ ID NO: 576794 - DNA, 25 bp, Homo sapien
agggagccagcgtacctcagcgtcg

SEQ ID NO: 576795 - DNA, 25 bp, Homo sapien
gcccgagctgtctctgtggtgcttt

SEQ ID NO: 576796 - DNA, 25 bp, Homo sapien
tctctgtggtgcttttgccctcata

SEQ ID NO: 576797 - DNA, 25 bp, Homo sapien
ttttaagcgggtccattgttatgat

SEQ ID NO: 576798 - DNA, 25 bp, Homo sapien
tttattccaatataagcacttgcaa

SEQ ID NO: 576799 - DNA, 25 bp, Homo sapien
gagtttactgaagaacttctacatc

SEQ ID NO: 576800 - DNA, 25 bp, Homo sapien
gaacttctacatcttggagtacaaa

SEQ ID NO: 576801 - DNA, 25 bp, Homo sapien
ttgtttttctcccatcattttcggc

SEQ ID NO: 576802 - DNA, 25 bp, Homo sapien
tctcccatcattttcggcagtgttt

SEQ ID NO: 576803 - DNA, 25 bp, Homo sapien
attttcggcagtgttttcttgcatt

SEQ ID NO: 576804 - DNA, 25 bp, Homo sapien
catttctccttgcaagccttttaaa

SEQ ID NO: 576805 - DNA, 25 bp, Homo sapien
gcaagccttttaaacaatatcatct

SEQ ID NO: 576806 - DNA, 25 bp, Homo sapien
atcatctacaattttctgcttgctt

SEQ ID NO: 576807 - DNA, 25 bp, Homo sapien
aattttctgcttgcttatgattatc

SEQ ID NO: 576808 - DNA, 25 bp, Homo sapien
ctgtttgctgtgcacagttttcgtc

SEQ ID NO: 576809 - DNA, 25 bp, Homo sapien
ttgctgtgcacagttttcgtcctgc

SEQ ID NO: 576810 - DNA, 25 bp, Homo sapien
tgtgcacagttttcgtcctgcccca

SEQ ID NO: 576811 - DNA, 25 bp, Homo sapien
acagttttcgtcctgccccattctt

SEQ ID NO: 576812 - DNA, 25 bp, Homo sapien
ccattctttgttttagatgaagtgg

SEQ ID NO: 576813 - DNA, 25 bp, Homo sapien
tgaagtggatgcagccctagacaat

SEQ ID NO: 576814 - DNA, 25 bp, Homo sapien
gtggatgcagccctagacaatacta

SEQ ID NO: 576815 - DNA, 25 bp, Homo sapien
gatgcagccctagacaatactaaca

SEQ ID NO: 576816 - DNA, 25 bp, Homo sapien
gcagccctagacaatactaacatag

SEQ ID NO: 576817 - DNA, 25 bp, Homo sapien
tagacaatactaacataggcaaagt

SEQ ID NO: 576818 - DNA, 25 bp, Homo sapien
gtaagtagttacatcaaagagcaaa

SEQ ID NO: 576819 - DNA, 25 bp, Homo sapien
atagttctctttaagccaggagcaa

SEQ ID NO: 576820 - DNA, 25 bp, Homo sapien
gccaggagcaatgacgtgtgcctat

SEQ ID NO: 576821 - DNA, 25 bp, Homo sapien
ggagcaatgacgtgtgcctatagtc

SEQ ID NO: 576822 - DNA, 25 bp, Homo sapien
gcaatgacgtgtgcctatagtcgca

SEQ ID NO: 576823 - DNA, 25 bp, Homo sapien
atgacgtgtgcctatagtcgcagct

SEQ ID NO: 576824 - DNA, 25 bp, Homo sapien
atagtcgcagctactagggaagttg

SEQ ID NO: 576825 - DNA, 25 bp, Homo sapien
aaggaaactgtactacatctagtta

SEQ ID NO: 576826 - DNA, 25 bp, Homo sapien
ctacatctagttaatcataggtttg

SEQ ID NO: 576827 - DNA, 25 bp, Homo sapien
ataggtttgatatgtagttacgtat

SEQ ID NO: 576828 - DNA, 25 bp, Homo sapien
agttacgtattttttctaatgtgca

SEQ ID NO: 576829 - DNA, 25 bp, Homo sapien
acgtattttttctaatgtgcattaa

SEQ ID NO: 576830 - DNA, 25 bp, Homo sapien
gacagttaccttgaaatgctacggg

SEQ ID NO: 576831 - DNA, 25 bp, Homo sapien
acagttaccttgaaatgctacggga

SEQ ID NO: 576832 - DNA, 25 bp, Homo sapien
cagttaccttgaaatgctacgggaa

SEQ ID NO: 576833 - DNA, 25 bp, Homo sapien
agttaccttgaaatgctacgggaag

SEQ ID NO: 576834 - DNA, 25 bp, Homo sapien
gttaccttgaaatgctacgggaagg

SEQ ID NO: 576835 - DNA, 25 bp, Homo sapien
ttaccttgaaatgctacgggaagga

SEQ ID NO: 576836 - DNA, 25 bp, Homo sapien
taccttgaaatgctacgggaaggat

SEQ ID NO: 576837 - DNA, 25 bp, Homo sapien
accttgaaatgctacgggaaggatg

SEQ ID NO: 576838 - DNA, 25 bp, Homo sapien
ccttgaaatgctacgggaaggatga

SEQ ID NO: 576839 - DNA, 25 bp, Homo sapien
ttgaaatgctacgggaaggatgagc

SEQ ID NO: 576840 - DNA, 25 bp, Homo sapien
tgaaatgctacgggaaggatgagca

SEQ ID NO: 576841 - DNA, 25 bp, Homo sapien
gagaagacattttaatcagaagcta

SEQ ID NO: 576842 - DNA, 25 bp, Homo sapien
gggcatatgtatcactgattgtgtc

SEQ ID NO: 576843 - DNA, 25 bp, Homo sapien
actgattgtgtctcaagtactctga

SEQ ID NO: 576844 - DNA, 25 bp, Homo sapien
gtgtctcaagtactctgactgatct

SEQ ID NO: 576845 - DNA, 25 bp, Homo sapien
tcaagtactctgactgatctggaag

SEQ ID NO: 576846 - DNA, 25 bp, Homo sapien
gactgatctggaagattattccatt

SEQ ID NO: 576847 - DNA, 25 bp, Homo sapien
ggatgtaaacagacaccaacatttt

SEQ ID NO: 576848 - DNA, 25 bp, Homo sapien
gacaccaacattttctcaggatgag

SEQ ID NO: 576849 - DNA, 25 bp, Homo sapien
ctcaggatgaggcaacttcactttg

SEQ ID NO: 576850 - DNA, 25 bp, Homo sapien
ggcaacttcactttgaaggttccac

SEQ ID NO: 576851 - DNA, 25 bp, Homo sapien
caaatctggcatttatttattagat

SEQ ID NO: 576852 - DNA, 25 bp, Homo sapien
gggatgaccgggagctcaccacctc

SEQ ID NO: 576853 - DNA, 25 bp, Homo sapien
tatggcagcccattcttctgtgctc

SEQ ID NO: 576854 - DNA, 25 bp, Homo sapien
gaaattcctggagtctccttcctgg

SEQ ID NO: 576855 - DNA, 25 bp, Homo sapien
ttcctggcattctccgagattgcca

SEQ ID NO: 576856 - DNA, 25 bp, Homo sapien
cagcccttcagagacgtggtcacaa

SEQ ID NO: 576857 - DNA, 25 bp, Homo sapien
tcagagacgtggtcacaaccctggg

SEQ ID NO: 576858 - DNA, 25 bp, Homo sapien
agagtggccccaggttcttcatctg

SEQ ID NO: 576859 - DNA, 25 bp, Homo sapien
aggttcttcatctgggcctcctagg

SEQ ID NO: 576860 - DNA, 25 bp, Homo sapien
ctgggcctcctaggtctggaaactg

SEQ ID NO: 576861 - DNA, 25 bp, Homo sapien
tccacagggtgtatccccaggctct

SEQ ID NO: 576862 - DNA, 25 bp, Homo sapien
acctttgacctgctgtccctacaag

SEQ ID NO: 576863 - DNA, 25 bp, Homo sapien
gtcatcttaagtgtttgttctctgc

SEQ ID NO: 576864 - DNA, 25 bp, Homo sapien
tgttctctgccccattcagtggact

SEQ ID NO: 576865 - DNA, 25 bp, Homo sapien
gccccattcagtggactgttgactt

SEQ ID NO: 576866 - DNA, 25 bp, Homo sapien
actgttgacttcagtccctgcaagt

SEQ ID NO: 576867 - DNA, 25 bp, Homo sapien
acttcagtccctgcaagtgctttag

SEQ ID NO: 576868 - DNA, 25 bp, Homo sapien
ctgcaagtgctttagcccgagtggg

SEQ ID NO: 576869 - DNA, 25 bp, Homo sapien
ttctcagagcactgccacgagttaa

SEQ ID NO: 576870 - DNA, 25 bp, Homo sapien
gagcactgccacgagttaagtgtgt

SEQ ID NO: 576871 - DNA, 25 bp, Homo sapien
acgagttaagtgtgtatttagccaa

SEQ ID NO: 576872 - DNA, 25 bp, Homo sapien
ggaaaaattgcagtcacccaaaatt

SEQ ID NO: 576873 - DNA, 25 bp, Homo sapien
gcagtcacccaaaattttaccaatc

SEQ ID NO: 576874 - DNA, 25 bp, Homo sapien
ctcgccagcgctgctgcaagaagga

SEQ ID NO: 576875 - DNA, 25 bp, Homo sapien
gctgcaagaaggaccccggagaccc

SEQ ID NO: 576876 - DNA, 25 bp, Homo sapien
ctgcaagaaggaccccggagacccg

SEQ ID NO: 576877 - DNA, 25 bp, Homo sapien
tgcaagaaggaccccggagacccgg

SEQ ID NO: 576878 - DNA, 25 bp, Homo sapien
tccgggcgggcagctacgtgcctgg

SEQ ID NO: 576879 - DNA, 25 bp, Homo sapien
ccgggcgggcagctacgtgcctggg

SEQ ID NO: 576880 - DNA, 25 bp, Homo sapien
gcagctacgtgcctggggcgcccgg

SEQ ID NO: 576881 - DNA, 25 bp, Homo sapien
gggacgcggcgagactgtcggcggg

SEQ ID NO: 576882 - DNA, 25 bp, Homo sapien
ggacttggacgcccggctctgtcct

SEQ ID NO: 576883 - DNA, 25 bp, Homo sapien
gacttggacgcccggctctgtcctg

SEQ ID NO: 576884 - DNA, 25 bp, Homo sapien
cctgtgtgcgctgcagcgttgcggg

SEQ ID NO: 576885 - DNA, 25 bp, Homo sapien
aaatgatttctcaacaagaccagcc

SEQ ID NO: 576886 - DNA, 25 bp, Homo sapien
acttcagtacctcgtttctggatga

SEQ ID NO: 576887 - DNA, 25 bp, Homo sapien
gggatttgcactagaaaccgccttg

SEQ ID NO: 576888 - DNA, 25 bp, Homo sapien
aaccgccttgcagaagttgtcatca

SEQ ID NO: 576889 - DNA, 25 bp, Homo sapien
ttgttgatgggcagcaggtctccgt

SEQ ID NO: 576890 - DNA, 25 bp, Homo sapien
aggtctccgtgcacatctgcatagc

SEQ ID NO: 576891 - DNA, 25 bp, Homo sapien
tctgcatagccaatagttacatcac

SEQ ID NO: 576892 - DNA, 25 bp, Homo sapien
gtgggtgtgcacaaccagcttgtag

SEQ ID NO: 576893 - DNA, 25 bp, Homo sapien
tcaaacttcccaggcttatgacggt

SEQ ID NO: 576894 - DNA, 25 bp, Homo sapien
cagagagaaccttcggaattccgcc

SEQ ID NO: 576895 - DNA, 25 bp, Homo sapien
tccgccccaaactacaatgcaagag

SEQ ID NO: 576896 - DNA, 25 bp, Homo sapien
ctttttaggcagatatcttcgaaga

SEQ ID NO: 576897 - DNA, 25 bp, Homo sapien
ggaacattcgcaataatgacctagt

SEQ ID NO: 576898 - DNA, 25 bp, Homo sapien
gattggattccgaagacgtggcatc

SEQ ID NO: 576899 - DNA, 25 bp, Homo sapien
gacgtggcatcatctcaacagtttt

SEQ ID NO: 576900 - DNA, 25 bp, Homo sapien
ggaaacacacagttcttctgacgtt

SEQ ID NO: 576901 - DNA, 25 bp, Homo sapien
acagttcttctgacgttaccattgg

SEQ ID NO: 576902 - DNA, 25 bp, Homo sapien
tgacgttaccattggtccccgacta

SEQ ID NO: 576903 - DNA, 25 bp, Homo sapien
gtatggttcatggatctctggaact

SEQ ID NO: 576904 - DNA, 25 bp, Homo sapien
tctggaactattctttagtacctta

SEQ ID NO: 576905 - DNA, 25 bp, Homo sapien
tttagtaccttatattctggaggca

SEQ ID NO: 576906 - DNA, 25 bp, Homo sapien
gagggtcttcagatgtatgggaaac

SEQ ID NO: 576907 - DNA, 25 bp, Homo sapien
aactacgcgtttctccatgcaacag

SEQ ID NO: 576908 - DNA, 25 bp, Homo sapien
gtttctccatgcaacagacctgctg

SEQ ID NO: 576909 - DNA, 25 bp, Homo sapien
aacagacctgctgccggcgtgtgat

SEQ ID NO: 576910 - DNA, 25 bp, Homo sapien
gcgtgtgatggagaaaggcccactt

SEQ ID NO: 576911 - DNA, 25 bp, Homo sapien
aaaggcccactttggcgtttctgca

SEQ ID NO: 576912 - DNA, 25 bp, Homo sapien
ggcgtttctgcaagatgttatgaac

SEQ ID NO: 576913 - DNA, 25 bp, Homo sapien
gaaaagtttcgatagatcaaccaaa

SEQ ID NO: 576914 - DNA, 25 bp, Homo sapien
gatttccattatcctaatgagcttc

SEQ ID NO: 576915 - DNA, 25 bp, Homo sapien
ttgggaattggcagaccaaccacaa

SEQ ID NO: 576916 - DNA, 25 bp, Homo sapien
tggaggaaattttgatgcattgcca

SEQ ID NO: 576917 - DNA, 25 bp, Homo sapien
gatgcattgccaaacaactctaaaa

SEQ ID NO: 576918 - DNA, 25 bp, Homo sapien
aatgatgggtgaacactttgaccta

SEQ ID NO: 576919 - DNA, 25 bp, Homo sapien
acactttgacctatgtttgttaaca

SEQ ID NO: 576920 - DNA, 25 bp, Homo sapien
acctttgggtcatggctttctgaag

SEQ ID NO: 576921 - DNA, 25 bp, Homo sapien
ggctttctgaagagactggtcccgg

SEQ ID NO: 576922 - DNA, 25 bp, Homo sapien
gaagagactggtcccggatgtcctt

SEQ ID NO: 576923 - DNA, 25 bp, Homo sapien
tggtcccggatgtccttgggatgta

SEQ ID NO: 576924 - DNA, 25 bp, Homo sapien
gggatgtagggagcccatagctcac

SEQ ID NO: 576925 - DNA, 25 bp, Homo sapien
gagcccatagctcactggaggcatt

SEQ ID NO: 576926 - DNA, 25 bp, Homo sapien
atagctcactggaggcattcaagga

SEQ ID NO: 576927 - DNA, 25 bp, Homo sapien
gcattcaaggaaccagccaggcagc

SEQ ID NO: 576928 - DNA, 25 bp, Homo sapien
ccccagagcaagtcgtgtttaggag

SEQ ID NO: 576929 - DNA, 25 bp, Homo sapien
aatttgcaagggaaccagtcaacag

SEQ ID NO: 576930 - DNA, 25 bp, Homo sapien
accagtcaacagatttttcaagcct

SEQ ID NO: 576931 - DNA, 25 bp, Homo sapien
caacagatttttcaagccttataag

SEQ ID NO: 576932 - DNA, 25 bp, Homo sapien
tttcaagccttataagtttatctgc

SEQ ID NO: 576933 - DNA, 25 bp, Homo sapien
gtttccattttggagccattttctt

SEQ ID NO: 576934 - DNA, 25 bp, Homo sapien
gaggagttctgtttgagccatacaa

SEQ ID NO: 576935 - DNA, 25 bp, Homo sapien
agttctgtttgagccatacaagcaa

SEQ ID NO: 576936 - DNA, 25 bp, Homo sapien
gagccatacaagcaatatatccttt

SEQ ID NO: 576937 - DNA, 25 bp, Homo sapien
aatgtatccggaatcttaggtgttc

SEQ ID NO: 576938 - DNA, 25 bp, Homo sapien
gaatcttaggtgttcattgctccaa

SEQ ID NO: 576939 - DNA, 25 bp, Homo sapien
atcttaggtgttcattgctccaagc

SEQ ID NO: 576940 - DNA, 25 bp, Homo sapien
gccctgtgcgccaggtacaagcagt

SEQ ID NO: 576941 - DNA, 25 bp, Homo sapien
cctgtgcgccaggtacaagcagtca

SEQ ID NO: 576942 - DNA, 25 bp, Homo sapien
ggtacaagcagtcagttctcggcag

SEQ ID NO: 576943 - DNA, 25 bp, Homo sapien
tacaagcagtcagttctcggcaggg

SEQ ID NO: 576944 - DNA, 25 bp, Homo sapien
ttgtgtccctctaccctgctttgga

SEQ ID NO: 576945 - DNA, 25 bp, Homo sapien
gtccctctaccctgctttggagtgc

SEQ ID NO: 576946 - DNA, 25 bp, Homo sapien
agtgccgggccctcattcagcagat

SEQ ID NO: 576947 - DNA, 25 bp, Homo sapien
gtctgaatgactgggatgatgatga

SEQ ID NO: 576948 - DNA, 25 bp, Homo sapien
gatgagatcctagcttcggtgctgg

SEQ ID NO: 576949 - DNA, 25 bp, Homo sapien
ggtgctggcagtgtcccaacaggaa

SEQ ID NO: 576950 - DNA, 25 bp, Homo sapien
tgctggcagtgtcccaacaggaata

SEQ ID NO: 576951 - DNA, 25 bp, Homo sapien
aggaggtgtagtgccctgtagcttt

SEQ ID NO: 576952 - DNA, 25 bp, Homo sapien
aggtgtagtgccctgtagcttttcc

SEQ ID NO: 576953 - DNA, 25 bp, Homo sapien
tgttctctctgcagatttctaccac

SEQ ID NO: 576954 - DNA, 25 bp, Homo sapien
tggagggatgccacggctactgctc

SEQ ID NO: 576955 - DNA, 25 bp, Homo sapien
tgccacggctactgctcttcaaggg

SEQ ID NO: 576956 - DNA, 25 bp, Homo sapien
ctgagttcgattccctgcaccgggt

SEQ ID NO: 576957 - DNA, 25 bp, Homo sapien
ggtggtccacgatttcctataacta

SEQ ID NO: 576958 - DNA, 25 bp, Homo sapien
tttcctataactaactccagcttgc

SEQ ID NO: 576959 - DNA, 25 bp, Homo sapien
cctataactaactccagcttgcggg

SEQ ID NO: 576960 - DNA, 25 bp, Homo sapien
ggaatctagcctctctagagcccta

SEQ ID NO: 576961 - DNA, 25 bp, Homo sapien
agagccctagccctctgacgaggag

SEQ ID NO: 576962 - DNA, 25 bp, Homo sapien
actgcacccagcaaatctgtactta

SEQ ID NO: 576963 - DNA, 25 bp, Homo sapien
gtctctatgatcctgactaccctat

SEQ ID NO: 576964 - DNA, 25 bp, Homo sapien
atcctgactaccctatctcatataa

SEQ ID NO: 576965 - DNA, 25 bp, Homo sapien
ctgactaccctatctcatataagtg

SEQ ID NO: 576966 - DNA, 25 bp, Homo sapien
tcactgagtataatgttctcacagt

SEQ ID NO: 576967 - DNA, 25 bp, Homo sapien
gttctcacagttcatccatgttata

SEQ ID NO: 576968 - DNA, 25 bp, Homo sapien
gtcagaatttcttaaggctaatatt

SEQ ID NO: 576969 - DNA, 25 bp, Homo sapien
aatttcttaaggctaatattccatt

SEQ ID NO: 576970 - DNA, 25 bp, Homo sapien
ccattgtatgcatgtgccacatttc

SEQ ID NO: 576971 - DNA, 25 bp, Homo sapien
gtatgcatgtgccacatttcgcttt

SEQ ID NO: 576972 - DNA, 25 bp, Homo sapien
atgtgccacatttcgctttcagtag

SEQ ID NO: 576973 - DNA, 25 bp, Homo sapien
agatggcatcttgctatgtcgtcca

SEQ ID NO: 576974 - DNA, 25 bp, Homo sapien
atggcatcttgctatgtcgtccagg

SEQ ID NO: 576975 - DNA, 25 bp, Homo sapien
ctcctgcttcaacatacagctacag

SEQ ID NO: 576976 - DNA, 25 bp, Homo sapien
ttcaacatacagctacaggtacccc

SEQ ID NO: 576977 - DNA, 25 bp, Homo sapien
tttttaataaggattcatggctcag

SEQ ID NO: 576978 - DNA, 25 bp, Homo sapien
taataaggattcatggctcagaggg

SEQ ID NO: 576979 - DNA, 25 bp, Homo sapien
agagggattttctgatggttttgct

SEQ ID NO: 576980 - DNA, 25 bp, Homo sapien
gaagaccaagtttatataactaggt

SEQ ID NO: 576981 - DNA, 25 bp, Homo sapien
taactaggtatctgtataatgcaac

SEQ ID NO: 576982 - DNA, 25 bp, Homo sapien
aggtatctgtataatgcaacaacat

SEQ ID NO: 576983 - DNA, 25 bp, Homo sapien
taatgcaacaacattggaacacaat

SEQ ID NO: 576984 - DNA, 25 bp, Homo sapien
gcagacatcaagctcaaggcaatgg

SEQ ID NO: 576985 - DNA, 25 bp, Homo sapien
gacatcaagctcaaggcaatgggct

SEQ ID NO: 576986 - DNA, 25 bp, Homo sapien
aagctcaaggcaatgggctaccctc

SEQ ID NO: 576987 - DNA, 25 bp, Homo sapien
gctcaaggcaatgggctaccctcat

SEQ ID NO: 576988 - DNA, 25 bp, Homo sapien
aaggcaatgggctaccctcatttca

SEQ ID NO: 576989 - DNA, 25 bp, Homo sapien
ctaccctcatttcacacgttgtgat

SEQ ID NO: 576990 - DNA, 25 bp, Homo sapien
accctcatttcacacgttgtgatga

SEQ ID NO: 576991 - DNA, 25 bp, Homo sapien
cacacgttgtgatgaagctgaggct

SEQ ID NO: 576992 - DNA, 25 bp, Homo sapien
cacgttgtgatgaagctgaggctgc

SEQ ID NO: 576993 - DNA, 25 bp, Homo sapien
catgaggccccgaggctcgagctcg

SEQ ID NO: 576994 - DNA, 25 bp, Homo sapien
caggggtacacagagctaaggccaa

SEQ ID NO: 576995 - DNA, 25 bp, Homo sapien
tcaactttctggtgcaggagcgccg

SEQ ID NO: 576996 - DNA, 25 bp, Homo sapien
caactttctggtgcaggagcgccgg

SEQ ID NO: 576997 - DNA, 25 bp, Homo sapien
actttctggtgcaggagcgccggcc

SEQ ID NO: 576998 - DNA, 25 bp, Homo sapien
ttctggtgcaggagcgccggccctc

SEQ ID NO: 576999 - DNA, 25 bp, Homo sapien
gagcgccggccctccaaggacgtgg

SEQ ID NO: 577000 - DNA, 25 bp, Homo sapien
cctccaaggacgtgggcgcagccat

SEQ ID NO: 577001 - DNA, 25 bp, Homo sapien
aggacgtgggcgcagccatcctggg

SEQ ID NO: 577002 - DNA, 25 bp, Homo sapien
tgagcgccatctgggtccgccctcg

SEQ ID NO: 577003 - DNA, 25 bp, Homo sapien
cctcgccagcgctgctgcaagaagg

SEQ ID NO: 577004 - DNA, 25 bp, Homo sapien
gctgcaagaaggaccccggagaccc

SEQ ID NO: 577005 - DNA, 25 bp, Homo sapien
tctgtcctgtgtgcgctgcagcgtt

SEQ ID NO: 577006 - DNA, 25 bp, Homo sapien
ttctggtgcaggagcgccggccctc

SEQ ID NO: 577007 - DNA, 25 bp, Homo sapien
tctggtgcaggagcgccggccctcc

SEQ ID NO: 577008 - DNA, 25 bp, Homo sapien
ggagcgccggccctccaaggacgtg

SEQ ID NO: 577009 - DNA, 25 bp, Homo sapien
gagcgccggccctccaaggacgtgg

SEQ ID NO: 577010 - DNA, 25 bp, Homo sapien
agcgccggccctccaaggacgtggg

SEQ ID NO: 577011 - DNA, 25 bp, Homo sapien
cctccaaggacgtgggcgcagccat

SEQ ID NO: 577012 - DNA, 25 bp, Homo sapien
ctccaaggacgtgggcgcagccatc

SEQ ID NO: 577013 - DNA, 25 bp, Homo sapien
aggacgtgggcgcagccatcctggg

SEQ ID NO: 577014 - DNA, 25 bp, Homo sapien
gggcgcagccatcctggggctgtac

SEQ ID NO: 577015 - DNA, 25 bp, Homo sapien
tgagcgccatctgggtccgccctcg

SEQ ID NO: 577016 - DNA, 25 bp, Homo sapien
cgccatctgggtccgccctcgccag

SEQ ID NO: 577017 - DNA, 25 bp, Homo sapien
gttctagttgcctcagatatctcaa

SEQ ID NO: 577018 - DNA, 25 bp, Homo sapien
ctagttgcctcagatatctcaaaat

SEQ ID NO: 577019 - DNA, 25 bp, Homo sapien
gtatttatactcatcactgcttcaa

SEQ ID NO: 577020 - DNA, 25 bp, Homo sapien
ttatactcatcactgcttcaaaatg

SEQ ID NO: 577021 - DNA, 25 bp, Homo sapien
tactcatcactgcttcaaaatgaaa

SEQ ID NO: 577022 - DNA, 25 bp, Homo sapien
gaaaatagttattaggcccaccact

SEQ ID NO: 577023 - DNA, 25 bp, Homo sapien
gttattaggcccaccactaagagtt

SEQ ID NO: 577024 - DNA, 25 bp, Homo sapien
taggcccaccactaagagttgatat

SEQ ID NO: 577025 - DNA, 25 bp, Homo sapien
ggcccaccactaagagttgatatat

SEQ ID NO: 577026 - DNA, 25 bp, Homo sapien
gtgttaataaatggcacgtcttatt

SEQ ID NO: 577027 - DNA, 25 bp, Homo sapien
tggcacgtcttattatatattacag

SEQ ID NO: 577028 - DNA, 25 bp, Homo sapien
ggtgcttaatctgatttctcaactg

SEQ ID NO: 577029 - DNA, 25 bp, Homo sapien
gaaatattcccccttgacatagaag

SEQ ID NO: 577030 - DNA, 25 bp, Homo sapien
acatagaagcaggtcacagggtcac

SEQ ID NO: 577031 - DNA, 25 bp, Homo sapien
acccagatcgcatcttcttagctgt

SEQ ID NO: 577032 - DNA, 25 bp, Homo sapien
atcttcttagctgtgccccagagaa

SEQ ID NO: 577033 - DNA, 25 bp, Homo sapien
gtgccccagagaatgaggtcgagat

SEQ ID NO: 577034 - DNA, 25 bp, Homo sapien
gaaatattttcaaggcaggtgctgc

SEQ ID NO: 577035 - DNA, 25 bp, Homo sapien
ttcaaggcaggtgctgcttttcatg

SEQ ID NO: 577036 - DNA, 25 bp, Homo sapien
aaggcatgccacttcagagctagaa

SEQ ID NO: 577037 - DNA, 25 bp, Homo sapien
gagctagaacattctgttgcacata

SEQ ID NO: 577038 - DNA, 25 bp, Homo sapien
ttctgttgcacataaattagctgta

SEQ ID NO: 577039 - DNA, 25 bp, Homo sapien
gcaacaatatgctcacttcttccat

SEQ ID NO: 577040 - DNA, 25 bp, Homo sapien
caatatgctcacttcttccatgata

SEQ ID NO: 577041 - DNA, 25 bp, Homo sapien
gctcacttcttccatgatatgtttt

SEQ ID NO: 577042 - DNA, 25 bp, Homo sapien
agtttccatagccactcacaagttt

SEQ ID NO: 577043 - DNA, 25 bp, Homo sapien
cactcacaagtttttctctacctaa

SEQ ID NO: 577044 - DNA, 25 bp, Homo sapien
gtttttctctacctaactgaagttg

SEQ ID NO: 577045 - DNA, 25 bp, Homo sapien
tctacctaactgaagttgccctctt

SEQ ID NO: 577046 - DNA, 25 bp, Homo sapien
ttgccctcttctgctggtcattagg

SEQ ID NO: 577047 - DNA, 25 bp, Homo sapien
ttcagcctcttgttttgaaggcagg

SEQ ID NO: 577048 - DNA, 25 bp, Homo sapien
ctcttgttttgaaggcaggctttta

SEQ ID NO: 577049 - DNA, 25 bp, Homo sapien
gttctctcttttacatatgtacact

SEQ ID NO: 577050 - DNA, 25 bp, Homo sapien
tagcagatccggacagggccctctg

SEQ ID NO: 577051 - DNA, 25 bp, Homo sapien
agcagatccggacagggccctctgt

SEQ ID NO: 577052 - DNA, 25 bp, Homo sapien
gcagatccggacagggccctctgtc

SEQ ID NO: 577053 - DNA, 25 bp, Homo sapien
cagatccggacagggccctctgtcc

SEQ ID NO: 577054 - DNA, 25 bp, Homo sapien
ccccacgaccttctgtacggatttg

SEQ ID NO: 577055 - DNA, 25 bp, Homo sapien
cccacgaccttctgtacggatttgc

SEQ ID NO: 577056 - DNA, 25 bp, Homo sapien
ccacgaccttctgtacggatttgct

SEQ ID NO: 577057 - DNA, 25 bp, Homo sapien
cacgaccttctgtacggatttgctc

SEQ ID NO: 577058 - DNA, 25 bp, Homo sapien
acgaccttctgtacggatttgctct

SEQ ID NO: 577059 - DNA, 25 bp, Homo sapien
cgaccttctgtacggatttgctctc

SEQ ID NO: 577060 - DNA, 25 bp, Homo sapien
accttctgtacggatttgctctccg

SEQ ID NO: 577061 - DNA, 25 bp, Homo sapien
tgtgcaaatcatacgactaacccat

SEQ ID NO: 577062 - DNA, 25 bp, Homo sapien
atacgactaacccatcatgtccttt

SEQ ID NO: 577063 - DNA, 25 bp, Homo sapien
catcatgtcctttctgtgtcaggaa

SEQ ID NO: 577064 - DNA, 25 bp, Homo sapien
gtcctttctgtgtcaggaagaacat

SEQ ID NO: 577065 - DNA, 25 bp, Homo sapien
ggatctttgaaatcctaccctctgt

SEQ ID NO: 577066 - DNA, 25 bp, Homo sapien
gaaatcctaccctctgtgtaaatca

SEQ ID NO: 577067 - DNA, 25 bp, Homo sapien
ttttctcttgttagtactgatttat

SEQ ID NO: 577068 - DNA, 25 bp, Homo sapien
actgatttatttactctttctggtg

SEQ ID NO: 577069 - DNA, 25 bp, Homo sapien
tggtgtatctgctctttcccttaaa

SEQ ID NO: 577070 - DNA, 25 bp, Homo sapien
gacaatgaagttcccaaatgctctt

SEQ ID NO: 577071 - DNA, 25 bp, Homo sapien
aatgattctcacaccaaatgtgtgc

SEQ ID NO: 577072 - DNA, 25 bp, Homo sapien
atggagagctgcctgttattctgag

SEQ ID NO: 577073 - DNA, 25 bp, Homo sapien
agagctgcctgttattctgagccaa

SEQ ID NO: 577074 - DNA, 25 bp, Homo sapien
agctgcctgttattctgagccaact

SEQ ID NO: 577075 - DNA, 25 bp, Homo sapien
tgcctgttattctgagccaacttct

SEQ ID NO: 577076 - DNA, 25 bp, Homo sapien
cctgttattctgagccaacttctgg

SEQ ID NO: 577077 - DNA, 25 bp, Homo sapien
gttattctgagccaacttctggcaa

SEQ ID NO: 577078 - DNA, 25 bp, Homo sapien
attctgagccaacttctggcaagat

SEQ ID NO: 577079 - DNA, 25 bp, Homo sapien
acttctggcaagatgctgggtgaat

SEQ ID NO: 577080 - DNA, 25 bp, Homo sapien
ttctggcaagatgctgggtgaatcg

SEQ ID NO: 577081 - DNA, 25 bp, Homo sapien
agaatgccagcaaacaaaccacaca

SEQ ID NO: 577082 - DNA, 25 bp, Homo sapien
ccacacacaactgtggtaagccagg

SEQ ID NO: 577083 - DNA, 25 bp, Homo sapien
aagcacgcgtccaccacctcctgct

SEQ ID NO: 577084 - DNA, 25 bp, Homo sapien
agcacgcgtccaccacctcctgctg

SEQ ID NO: 577085 - DNA, 25 bp, Homo sapien
tcctgctgccagtacgacctctgca

SEQ ID NO: 577086 - DNA, 25 bp, Homo sapien
cctgctgccagtacgacctctgcaa

SEQ ID NO: 577087 - DNA, 25 bp, Homo sapien
ctgctgccagtacgacctctgcaac

SEQ ID NO: 577088 - DNA, 25 bp, Homo sapien
gctgccagtacgacctctgcaacgg

SEQ ID NO: 577089 - DNA, 25 bp, Homo sapien
tgccagtacgacctctgcaacggca

SEQ ID NO: 577090 - DNA, 25 bp, Homo sapien
gccagtacgacctctgcaacggcac

SEQ ID NO: 577091 - DNA, 25 bp, Homo sapien
ccagtacgacctctgcaacggcacc

SEQ ID NO: 577092 - DNA, 25 bp, Homo sapien
cagtacgacctctgcaacggcaccg

SEQ ID NO: 577093 - DNA, 25 bp, Homo sapien
agtacgacctctgcaacggcaccgg

SEQ ID NO: 577094 - DNA, 25 bp, Homo sapien
cctagggaagacatttggtgctggt

SEQ ID NO: 577095 - DNA, 25 bp, Homo sapien
tagggaagacatttggtgctggttt

SEQ ID NO: 577096 - DNA, 25 bp, Homo sapien
gggaagacatttggtgctggtttct

SEQ ID NO: 577097 - DNA, 25 bp, Homo sapien
ggaagacatttggtgctggtttctt

SEQ ID NO: 577098 - DNA, 25 bp, Homo sapien
gaagacatttggtgctggtttcttg

SEQ ID NO: 577099 - DNA, 25 bp, Homo sapien
gtctttgggtaggacaagcatcaag

SEQ ID NO: 577100 - DNA, 25 bp, Homo sapien
tctttgggtaggacaagcatcaagt

SEQ ID NO: 577101 - DNA, 25 bp, Homo sapien
tttgggtaggacaagcatcaagtgt

SEQ ID NO: 577102 - DNA, 25 bp, Homo sapien
tgggtaggacaagcatcaagtgtaa

SEQ ID NO: 577103 - DNA, 25 bp, Homo sapien
gtaggacaagcatcaagtgtaagaa

SEQ ID NO: 577104 - DNA, 25 bp, Homo sapien
ggacaagcatcaagtgtaagaaata

SEQ ID NO: 577105 - DNA, 25 bp, Homo sapien
gacagtaaatcacacaacaggtttc

SEQ ID NO: 577106 - DNA, 25 bp, Homo sapien
atcacacaacaggtttctactctct

SEQ ID NO: 577107 - DNA, 25 bp, Homo sapien
acacaacaggtttctactctctttt

SEQ ID NO: 577108 - DNA, 25 bp, Homo sapien
caacaggtttctactctcttttaat

SEQ ID NO: 577109 - DNA, 25 bp, Homo sapien
acaggtttctactctcttttaatat

SEQ ID NO: 577110 - DNA, 25 bp, Homo sapien
caggtttctactctcttttaatatt

SEQ ID NO: 577111 - DNA, 25 bp, Homo sapien
aaaattttatagtctgaaagcaggt

SEQ ID NO: 577112 - DNA, 25 bp, Homo sapien
aaagcaggttaacagctgtctatgt

SEQ ID NO: 577113 - DNA, 25 bp, Homo sapien
caggttaacagctgtctatgtatgt

SEQ ID NO: 577114 - DNA, 25 bp, Homo sapien
gataacagatttgcatatgtctata

SEQ ID NO: 577115 - DNA, 25 bp, Homo sapien
agatttgcatatgtctatatttctt

SEQ ID NO: 577116 - DNA, 25 bp, Homo sapien
gcctcggaagtttggtgacagaaaa

SEQ ID NO: 577117 - DNA, 25 bp, Homo sapien
tggtgacagaaaacgacgtgacctt

SEQ ID NO: 577118 - DNA, 25 bp, Homo sapien
cagaaaacgacgtgaccttggcggg

SEQ ID NO: 577119 - DNA, 25 bp, Homo sapien
gggcagcagtgacgccttctttcct

SEQ ID NO: 577120 - DNA, 25 bp, Homo sapien
tacaaccccgacactcttcacggaa

SEQ ID NO: 577121 - DNA, 25 bp, Homo sapien
ttcacggaacccctgtgtctgctag

SEQ ID NO: 577122 - DNA, 25 bp, Homo sapien
gaacccctgtgtctgctaggcactg

SEQ ID NO: 577123 - DNA, 25 bp, Homo sapien
tgtctgctaggcactgggtaggcac

SEQ ID NO: 577124 - DNA, 25 bp, Homo sapien
gctaggcactgggtaggcactattt

SEQ ID NO: 577125 - DNA, 25 bp, Homo sapien
gcactgggtaggcactatttgtata

SEQ ID NO: 577126 - DNA, 25 bp, Homo sapien
ctgggtaggcactatttgtataaat

SEQ ID NO: 577127 - DNA, 25 bp, Homo sapien
gtggtggacctttcagcagccacat

SEQ ID NO: 577128 - DNA, 25 bp, Homo sapien
ggacctttcagcagccacatagata

SEQ ID NO: 577129 - DNA, 25 bp, Homo sapien
gtgaaccgacacagtgtgttatcat

SEQ ID NO: 577130 - DNA, 25 bp, Homo sapien
cacagtgtgttatcatagaggagac

SEQ ID NO: 577131 - DNA, 25 bp, Homo sapien
tgtggttatgtatcttatctttcta

SEQ ID NO: 577132 - DNA, 25 bp, Homo sapien
ttatagagagactgttggaaccatg

SEQ ID NO: 577133 - DNA, 25 bp, Homo sapien
agaaggatgtttctgtgttcttgat

SEQ ID NO: 577134 - DNA, 25 bp, Homo sapien
gttctgcaaaactgctaagccatga

SEQ ID NO: 577135 - DNA, 25 bp, Homo sapien
ctgctaagccatgaacagttttctt

SEQ ID NO: 577136 - DNA, 25 bp, Homo sapien
tgaacagttttcttagctacttaga

SEQ ID NO: 577137 - DNA, 25 bp, Homo sapien
ttagctacttagaatggttatacat

SEQ ID NO: 577138 - DNA, 25 bp, Homo sapien
atggaagctcagaagggagaatcac

SEQ ID NO: 577139 - DNA, 25 bp, Homo sapien
aagggagaatcacacatggcttcca

SEQ ID NO: 577140 - DNA, 25 bp, Homo sapien
ggagaatcacacatggcttccaact

SEQ ID NO: 577141 - DNA, 25 bp, Homo sapien
aatcacacatggcttccaacttaag

SEQ ID NO: 577142 - DNA, 25 bp, Homo sapien
acatggcttccaacttaagagcgcc

SEQ ID NO: 577143 - DNA, 25 bp, Homo sapien
tggcttccaacttaagagcgcctat

SEQ ID NO: 577144 - DNA, 25 bp, Homo sapien
gcttccaacttaagagcgcctatga

SEQ ID NO: 577145 - DNA, 25 bp, Homo sapien
tccaacttaagagcgcctatgaaaa

SEQ ID NO: 577146 - DNA, 25 bp, Homo sapien
agagcgcctatgaaaataacttgat

SEQ ID NO: 577147 - DNA, 25 bp, Homo sapien
gaaaataacttgatgccttacacca

SEQ ID NO: 577148 - DNA, 25 bp, Homo sapien
aacttgatgccttacaccaattaca

SEQ ID NO: 577149 - DNA, 25 bp, Homo sapien
gaaattcaccgaatacagcgcgcgc

SEQ ID NO: 577150 - DNA, 25 bp, Homo sapien
aattcaccgaatacagcgcgcgcct

SEQ ID NO: 577151 - DNA, 25 bp, Homo sapien
gcggcaagggcgaagaaaccaaaag

SEQ ID NO: 577152 - DNA, 25 bp, Homo sapien
gaaaccaaaagtctgactcttgtcc

SEQ ID NO: 577153 - DNA, 25 bp, Homo sapien
aaccaaaagtctgactcttgtcctg

SEQ ID NO: 577154 - DNA, 25 bp, Homo sapien
actcttgtcctgcatcgggactccg

SEQ ID NO: 577155 - DNA, 25 bp, Homo sapien
tcttgtcctgcatcgggactccggc

SEQ ID NO: 577156 - DNA, 25 bp, Homo sapien
tccctgggattcaatattattggtg

SEQ ID NO: 577157 - DNA, 25 bp, Homo sapien
caatattattggtggccggccgagt

SEQ ID NO: 577158 - DNA, 25 bp, Homo sapien
aatattattggtggccggccgagtg

SEQ ID NO: 577159 - DNA, 25 bp, Homo sapien
tggccggccgagtgtggataaccac

SEQ ID NO: 577160 - DNA, 25 bp, Homo sapien
gggaggagcacatgcgactttattt

SEQ ID NO: 577161 - DNA, 25 bp, Homo sapien
ggagcacatgcgactttattttctt

SEQ ID NO: 577162 - DNA, 25 bp, Homo sapien
gagcacatgcgactttattttcttt

SEQ ID NO: 577163 - DNA, 25 bp, Homo sapien
aaagaatatccaagttgggcgcagt

SEQ ID NO: 577164 - DNA, 25 bp, Homo sapien
agaatatccaagttgggcgcagtgg

SEQ ID NO: 577165 - DNA, 25 bp, Homo sapien
aaaccaaatcttagttgcgcccgtg

SEQ ID NO: 577166 - DNA, 25 bp, Homo sapien
aaccaaatcttagttgcgcccgtgg

SEQ ID NO: 577167 - DNA, 25 bp, Homo sapien
caaatcttagttgcgcccgtggtcc

SEQ ID NO: 577168 - DNA, 25 bp, Homo sapien
tgcttggcaggcttatgcagaagga

SEQ ID NO: 577169 - DNA, 25 bp, Homo sapien
gcaggcttatgcagaaggattgctt

SEQ ID NO: 577170 - DNA, 25 bp, Homo sapien
gctggcgtgaactgggattttgcca

SEQ ID NO: 577171 - DNA, 25 bp, Homo sapien
ctgtcttcatatcagctcttaatgt

SEQ ID NO: 577172 - DNA, 25 bp, Homo sapien
tgtcttcatatcagctcttaatgta

SEQ ID NO: 577173 - DNA, 25 bp, Homo sapien
gtcttcatatcagctcttaatgtat

SEQ ID NO: 577174 - DNA, 25 bp, Homo sapien
tcttcatatcagctcttaatgtatt

SEQ ID NO: 577175 - DNA, 25 bp, Homo sapien
cttcatatcagctcttaatgtattt

SEQ ID NO: 577176 - DNA, 25 bp, Homo sapien
ttcatatcagctcttaatgtatttt

SEQ ID NO: 577177 - DNA, 25 bp, Homo sapien
tcatatcagctcttaatgtatttta

SEQ ID NO: 577178 - DNA, 25 bp, Homo sapien
tttttatcaattgtgtctttttctt

SEQ ID NO: 577179 - DNA, 25 bp, Homo sapien
ttttatcaattgtgtctttttcttt

SEQ ID NO: 577180 - DNA, 25 bp, Homo sapien
gcgggggagctgtttctattttatt

SEQ ID NO: 577181 - DNA, 25 bp, Homo sapien
tatttattgatcaatctctctgcgg

SEQ ID NO: 577182 - DNA, 25 bp, Homo sapien
atttattgatcaatctctctgcggg

SEQ ID NO: 577183 - DNA, 25 bp, Homo sapien
ttgatcaatctctctgcggggtggg

SEQ ID NO: 577184 - DNA, 25 bp, Homo sapien
ttagcagatccggacagggccctct

SEQ ID NO: 577185 - DNA, 25 bp, Homo sapien
acgaccttctgtacggatttgctct

SEQ ID NO: 577186 - DNA, 25 bp, Homo sapien
ttctgtacggatttgctctccggaa

SEQ ID NO: 577187 - DNA, 25 bp, Homo sapien
tttgctctccggaaggaattctggt

SEQ ID NO: 577188 - DNA, 25 bp, Homo sapien
cggaaggaattctggtttcgcgtga

SEQ ID NO: 577189 - DNA, 25 bp, Homo sapien
tggtttcgcgtgatcctgcctgcgt

SEQ ID NO: 577190 - DNA, 25 bp, Homo sapien
gtgtctctgattccgccggcggcaa

SEQ ID NO: 577191 - DNA, 25 bp, Homo sapien
agacttggaaagagcctgcaaaatg

SEQ ID NO: 577192 - DNA, 25 bp, Homo sapien
atggaggagccctgaggcctaagtc

SEQ ID NO: 577193 - DNA, 25 bp, Homo sapien
gaggcctaagtctcatgagtgtcaa

SEQ ID NO: 577194 - DNA, 25 bp, Homo sapien
gagtgtcaatgcttacctgtatcta

SEQ ID NO: 577195 - DNA, 25 bp, Homo sapien
tacctgtatctagacactggcatcc

SEQ ID NO: 577196 - DNA, 25 bp, Homo sapien
ataaggccaagattgattgttttcc

SEQ ID NO: 577197 - DNA, 25 bp, Homo sapien
cttttctacctaccctatatctaat

SEQ ID NO: 577198 - DNA, 25 bp, Homo sapien
gaaccctaaattcaacaatctgtga

SEQ ID NO: 577199 - DNA, 25 bp, Homo sapien
gaagaatttttgcactaacatgtta

SEQ ID NO: 577200 - DNA, 25 bp, Homo sapien
aaactcaacattgcttgctaagact

SEQ ID NO: 577201 - DNA, 25 bp, Homo sapien
gactattgcaataaactcctctatg

SEQ ID NO: 577202 - DNA, 25 bp, Homo sapien
tgcgctgcccggctatggttgccta

SEQ ID NO: 577203 - DNA, 25 bp, Homo sapien
ccggctatggttgcctactgcatga

SEQ ID NO: 577204 - DNA, 25 bp, Homo sapien
tatggttgcctactgcatgaccacg

SEQ ID NO: 577205 - DNA, 25 bp, Homo sapien
ggttgcctactgcatgaccacgcgc

SEQ ID NO: 577206 - DNA, 25 bp, Homo sapien
tgccccgctgcttcgagactgtgta

SEQ ID NO: 577207 - DNA, 25 bp, Homo sapien
ccgctgcttcgagactgtgtatgat

SEQ ID NO: 577208 - DNA, 25 bp, Homo sapien
gcttcgagactgtgtatgatggcta

SEQ ID NO: 577209 - DNA, 25 bp, Homo sapien
agactgtgtatgatggctactccaa

SEQ ID NO: 577210 - DNA, 25 bp, Homo sapien
gtgtatgatggctactccaagcacg

SEQ ID NO: 577211 - DNA, 25 bp, Homo sapien
tatgatggctactccaagcacgcgt

SEQ ID NO: 577212 - DNA, 25 bp, Homo sapien
gatggctactccaagcacgcgtcca

SEQ ID NO: 577213 - DNA, 25 bp, Homo sapien
tgtctgaagtcactcttgcctccgg

SEQ ID NO: 577214 - DNA, 25 bp, Homo sapien
ctgtgtgcatgagggcccatcgctg

SEQ ID NO: 577215 - DNA, 25 bp, Homo sapien
gcccatcgctggtgcccgggttgca

SEQ ID NO: 577216 - DNA, 25 bp, Homo sapien
cccaggcgagggttgacgcttatga

SEQ ID NO: 577217 - DNA, 25 bp, Homo sapien
tgacgcttatgagaggagacctgct

SEQ ID NO: 577218 - DNA, 25 bp, Homo sapien
ttatgagaggagacctgctgggtac

SEQ ID NO: 577219 - DNA, 25 bp, Homo sapien
ttctcagtgactcctgacgagctgc

SEQ ID NO: 577220 - DNA, 25 bp, Homo sapien
agtgactcctgacgagctgctcatt

SEQ ID NO: 577221 - DNA, 25 bp, Homo sapien
tgacgagctgctcatttacacacac

SEQ ID NO: 577222 - DNA, 25 bp, Homo sapien
cacagtctggattgcgaaacctacc

SEQ ID NO: 577223 - DNA, 25 bp, Homo sapien
gtctggattgcgaaacctaccgcac

SEQ ID NO: 577224 - DNA, 25 bp, Homo sapien
gcaccgttttacattcctaacattc

SEQ ID NO: 577225 - DNA, 25 bp, Homo sapien
gatttgtcctcattctaatccatag

SEQ ID NO: 577226 - DNA, 25 bp, Homo sapien
ggcaacatttctaacaggtttctag

SEQ ID NO: 577227 - DNA, 25 bp, Homo sapien
ggtttctaggtgattttgttgttgc

SEQ ID NO: 577228 - DNA, 25 bp, Homo sapien
ttgttgttgctgatgtagggactac

SEQ ID NO: 577229 - DNA, 25 bp, Homo sapien
ttgagaactgtcctatcccattttt

SEQ ID NO: 577230 - DNA, 25 bp, Homo sapien
ataccccttgtttctatgttctatc

SEQ ID NO: 577231 - DNA, 25 bp, Homo sapien
atgttctatcctgtgagccttttca

SEQ ID NO: 577232 - DNA, 25 bp, Homo sapien
tcctgtgagccttttcattttgtta

SEQ ID NO: 577233 - DNA, 25 bp, Homo sapien
agtgtttacaaccaggaaatagctt

SEQ ID NO: 577234 - DNA, 25 bp, Homo sapien
gaaatagcttgtcatctttgataca

SEQ ID NO: 577235 - DNA, 25 bp, Homo sapien
ggcgggggagctgtttctattttat

SEQ ID NO: 577236 - DNA, 25 bp, Homo sapien
gcgggggagctgtttctattttatt

SEQ ID NO: 577237 - DNA, 25 bp, Homo sapien
ttatttattgatcaatctctctgcg

SEQ ID NO: 577238 - DNA, 25 bp, Homo sapien
tatttattgatcaatctctctgcgg

SEQ ID NO: 577239 - DNA, 25 bp, Homo sapien
atttattgatcaatctctctgcggg

SEQ ID NO: 577240 - DNA, 25 bp, Homo sapien
tttattgatcaatctctctgcgggg

SEQ ID NO: 577241 - DNA, 25 bp, Homo sapien
ttattgatcaatctctctgcggggt

SEQ ID NO: 577242 - DNA, 25 bp, Homo sapien
tattgatcaatctctctgcggggtg

SEQ ID NO: 577243 - DNA, 25 bp, Homo sapien
attgatcaatctctctgcggggtgg

SEQ ID NO: 577244 - DNA, 25 bp, Homo sapien
ttgatcaatctctctgcggggtggg

SEQ ID NO: 577245 - DNA, 25 bp, Homo sapien
gatcaatctctctgcggggtggggt

SEQ ID NO: 577246 - DNA, 25 bp, Homo sapien
ggatgtagaacaatgctgccagaac

SEQ ID NO: 577247 - DNA, 25 bp, Homo sapien
tgccagaacatattccctgaggttt

SEQ ID NO: 577248 - DNA, 25 bp, Homo sapien
tgtgctccctttttgatgggtccta

SEQ ID NO: 577249 - DNA, 25 bp, Homo sapien
atgggtcctagtgggcctctgtgct

SEQ ID NO: 577250 - DNA, 25 bp, Homo sapien
gtcgtgaccgacttttcttcaatga

SEQ ID NO: 577251 - DNA, 25 bp, Homo sapien
tcttcaatgatccagtggaggctgc

SEQ ID NO: 577252 - DNA, 25 bp, Homo sapien
tggaggctgcaatgtattttgctta

SEQ ID NO: 577253 - DNA, 25 bp, Homo sapien
acagctggtttataattttggcctc

SEQ ID NO: 577254 - DNA, 25 bp, Homo sapien
aattttggcctcagacagtaattac

SEQ ID NO: 577255 - DNA, 25 bp, Homo sapien
gcatattcattttatctacacactt

SEQ ID NO: 577256 - DNA, 25 bp, Homo sapien
ttatctacacacttaaccatcaatt

SEQ ID NO: 577257 - DNA, 25 bp, Homo sapien
ttggagagctaacaccatcaaaggt

SEQ ID NO: 577258 - DNA, 25 bp, Homo sapien
gccaaaatctacattgagactgctt

SEQ ID NO: 577259 - DNA, 25 bp, Homo sapien
gagactgctttgagaagtttctagc

SEQ ID NO: 577260 - DNA, 25 bp, Homo sapien
tggaattgacactccagccaatgat

SEQ ID NO: 577261 - DNA, 25 bp, Homo sapien
attgcagacagaaattccagtgatt

SEQ ID NO: 577262 - DNA, 25 bp, Homo sapien
agtgatttctactgcacagctctgg

SEQ ID NO: 577263 - DNA, 25 bp, Homo sapien
actgcacagctctggacatctcttt

SEQ ID NO: 577264 - DNA, 25 bp, Homo sapien
ctcttttcctagtattattccctga

SEQ ID NO: 577265 - DNA, 25 bp, Homo sapien
ttggccactgatttcaattctgcag

SEQ ID NO: 577266 - DNA, 25 bp, Homo sapien
aattctgcagtatttacaacatcaa

SEQ ID NO: 577267 - DNA, 25 bp, Homo sapien
tcaacaactcatggaatacttgggt

SEQ ID NO: 577268 - DNA, 25 bp, Homo sapien
aagctgtcatgcgttgtaagctact

SEQ ID NO: 577269 - DNA, 25 bp, Homo sapien
gtcatgcgttgtaagctactacagg

SEQ ID NO: 577270 - DNA, 25 bp, Homo sapien
gttgtaagctactacaggagggaga

SEQ ID NO: 577271 - DNA, 25 bp, Homo sapien
ggaacgggattcagctacagtatct

SEQ ID NO: 577272 - DNA, 25 bp, Homo sapien
agctacagtatctgatctactttga

SEQ ID NO: 577273 - DNA, 25 bp, Homo sapien
gtatctgatctactttgacttttag

SEQ ID NO: 577274 - DNA, 25 bp, Homo sapien
tctactttgacttttaggagacagc

SEQ ID NO: 577275 - DNA, 25 bp, Homo sapien
gagacagccctgtagcctagtagtt

SEQ ID NO: 577276 - DNA, 25 bp, Homo sapien
agacagccctgtagcctagtagttc

SEQ ID NO: 577277 - DNA, 25 bp, Homo sapien
gcctagtagttcaaagcgcagcttc

SEQ ID NO: 577278 - DNA, 25 bp, Homo sapien
tagtagttcaaagcgcagcttctgg

SEQ ID NO: 577279 - DNA, 25 bp, Homo sapien
tacccacctgagctccgattcatgt

SEQ ID NO: 577280 - DNA, 25 bp, Homo sapien
acctgagctccgattcatgtactac

SEQ ID NO: 577281 - DNA, 25 bp, Homo sapien
tgagctccgattcatgtactacgtc

SEQ ID NO: 577282 - DNA, 25 bp, Homo sapien
gctccgattcatgtactacgtcgat

SEQ ID NO: 577283 - DNA, 25 bp, Homo sapien
gattcatgtactacgtcgatggcag

SEQ ID NO: 577284 - DNA, 25 bp, Homo sapien
ttcatgtactacgtcgatggcaggg

SEQ ID NO: 577285 - DNA, 25 bp, Homo sapien
ggccctgatggtggctttcgtcaag

SEQ ID NO: 577286 - DNA, 25 bp, Homo sapien
cctgatggtggctttcgtcaagtca

SEQ ID NO: 577287 - DNA, 25 bp, Homo sapien
tgatggtggctttcgtcaagtcaaa

SEQ ID NO: 577288 - DNA, 25 bp, Homo sapien
atggtggctttcgtcaagtcaaaga

SEQ ID NO: 577289 - DNA, 25 bp, Homo sapien
tggctttcgtcaagtcaaagaagct

SEQ ID NO: 577290 - DNA, 25 bp, Homo sapien
gacatcatgtagttcacactggaaa

SEQ ID NO: 577291 - DNA, 25 bp, Homo sapien
tcacactggaaaaaggccacgtatg

SEQ ID NO: 577292 - DNA, 25 bp, Homo sapien
aggccacgtatgtgccttgaatgta

SEQ ID NO: 577293 - DNA, 25 bp, Homo sapien
gtatgtgccttgaatgtagccaaaa

SEQ ID NO: 577294 - DNA, 25 bp, Homo sapien
gtagccaaaatgatgaacaacaccc

SEQ ID NO: 577295 - DNA, 25 bp, Homo sapien
gaacaacacccagaaatctgtgatt

SEQ ID NO: 577296 - DNA, 25 bp, Homo sapien
atttagcactgagaactagtattat

SEQ ID NO: 577297 - DNA, 25 bp, Homo sapien
gaagtacatgccacataaaatttgc

SEQ ID NO: 577298 - DNA, 25 bp, Homo sapien
ttgaagtacattaacattgttgagc

SEQ ID NO: 577299 - DNA, 25 bp, Homo sapien
attgttgagcaaagaatatcctgaa

SEQ ID NO: 577300 - DNA, 25 bp, Homo sapien
gaatatcctgaactctttatcttgt

SEQ ID NO: 577301 - DNA, 25 bp, Homo sapien
cgggcttcttatgtatctacgacaa

SEQ ID NO: 577302 - DNA, 25 bp, Homo sapien
atctacgacaatgttctggtcccaa

SEQ ID NO: 577303 - DNA, 25 bp, Homo sapien
caatgttctggtcccaaagaaacta

SEQ ID NO: 577304 - DNA, 25 bp, Homo sapien
aactaaggctcattcatcaggttaa

SEQ ID NO: 577305 - DNA, 25 bp, Homo sapien
tattccatgcattagtacactttag

SEQ ID NO: 577306 - DNA, 25 bp, Homo sapien
gtacactttagtctcttggcagtag

SEQ ID NO: 577307 - DNA, 25 bp, Homo sapien
gtagaaacattagtacatccctgaa

SEQ ID NO: 577308 - DNA, 25 bp, Homo sapien
gtacatccctgaaactgagcacatt

SEQ ID NO: 577309 - DNA, 25 bp, Homo sapien
tgaaactgagcacatttctgaccat

SEQ ID NO: 577310 - DNA, 25 bp, Homo sapien
agaaagctgcaaagatcttccctta

SEQ ID NO: 577311 - DNA, 25 bp, Homo sapien
gttattcttaacatgtttctatcta

SEQ ID NO: 577312 - DNA, 25 bp, Homo sapien
gataggccgttatgagaatttacag

SEQ ID NO: 577313 - DNA, 25 bp, Homo sapien
ggccgttatgagaatttacagagct

SEQ ID NO: 577314 - DNA, 25 bp, Homo sapien
gaatttacagagctaacacatgcaa

SEQ ID NO: 577315 - DNA, 25 bp, Homo sapien
gctaacacatgcaaagtccttagaa

SEQ ID NO: 577316 - DNA, 25 bp, Homo sapien
acacatgcaaagtccttagaacaga

SEQ ID NO: 577317 - DNA, 25 bp, Homo sapien
gcaaagtccttagaacagaaacaac

SEQ ID NO: 577318 - DNA, 25 bp, Homo sapien
gtggctacaattttaccccactcct

SEQ ID NO: 577319 - DNA, 25 bp, Homo sapien
tcggttagtcctgtcaacccagaac

SEQ ID NO: 577320 - DNA, 25 bp, Homo sapien
aaggcaggttctcaccactgctggt

SEQ ID NO: 577321 - DNA, 25 bp, Homo sapien
tttacatccgtctgcttaactcctt

SEQ ID NO: 577322 - DNA, 25 bp, Homo sapien
gcttaactccttcccagctactgtg

SEQ ID NO: 577323 - DNA, 25 bp, Homo sapien
aagaaatatccttgagcaatagaag

SEQ ID NO: 577324 - DNA, 25 bp, Homo sapien
tatccttgagcaatagaagggaagt

SEQ ID NO: 577325 - DNA, 25 bp, Homo sapien
aagggaagtgggatccgagcctgta

SEQ ID NO: 577326 - DNA, 25 bp, Homo sapien
aagtgggatccgagcctgtagaagg

SEQ ID NO: 577327 - DNA, 25 bp, Homo sapien
tcagttttttcctcaccgtttgcct

SEQ ID NO: 577328 - DNA, 25 bp, Homo sapien
gttttttcctcaccgtttgcctgct

SEQ ID NO: 577329 - DNA, 25 bp, Homo sapien
ttttcctcaccgtttgcctgcttga

SEQ ID NO: 577330 - DNA, 25 bp, Homo sapien
gtcaccacgtcatctttccaggatt

SEQ ID NO: 577331 - DNA, 25 bp, Homo sapien
tcaccacgtcatctttccaggatta

SEQ ID NO: 577332 - DNA, 25 bp, Homo sapien
ccttgaccagtaaaaagctctgtaa

SEQ ID NO: 577333 - DNA, 25 bp, Homo sapien
ttgaccagtaaaaagctctgtaata

SEQ ID NO: 577334 - DNA, 25 bp, Homo sapien
aatcttcttaatatagctggacatg

SEQ ID NO: 577335 - DNA, 25 bp, Homo sapien
tcttcttaatatagctggacatggt

SEQ ID NO: 577336 - DNA, 25 bp, Homo sapien
tggtgcatgcttgtatttcccacta

SEQ ID NO: 577337 - DNA, 25 bp, Homo sapien
ggtgcatgcttgtatttcccactac

SEQ ID NO: 577338 - DNA, 25 bp, Homo sapien
gtgcatgcttgtatttcccactact

SEQ ID NO: 577339 - DNA, 25 bp, Homo sapien
tgcatgcttgtatttcccactactt

SEQ ID NO: 577340 - DNA, 25 bp, Homo sapien
gcatgcttgtatttcccactacttg

SEQ ID NO: 577341 - DNA, 25 bp, Homo sapien
catgcttgtatttcccactacttgg

SEQ ID NO: 577342 - DNA, 25 bp, Homo sapien
atgcttgtatttcccactacttggg

SEQ ID NO: 577343 - DNA, 25 bp, Homo sapien
tgagctatgatggtatcactatact

SEQ ID NO: 577344 - DNA, 25 bp, Homo sapien
gctatgatggtatcactatactaac

SEQ ID NO: 577345 - DNA, 25 bp, Homo sapien
tcgctaacaacctaccaaaacaggg

SEQ ID NO: 577346 - DNA, 25 bp, Homo sapien
aaaacagggaggctgcattgctctt

SEQ ID NO: 577347 - DNA, 25 bp, Homo sapien
gctcttgaactctgagtatctctgg

SEQ ID NO: 577348 - DNA, 25 bp, Homo sapien
ataaaggtgtcaggcgagcttgctc

SEQ ID NO: 577349 - DNA, 25 bp, Homo sapien
aaggtgtcaggcgagcttgctctac

SEQ ID NO: 577350 - DNA, 25 bp, Homo sapien
agcttgctctaccacatgaatcatg

SEQ ID NO: 577351 - DNA, 25 bp, Homo sapien
aaatagtctttgaagcctgtctcta

SEQ ID NO: 577352 - DNA, 25 bp, Homo sapien
ttgaagcctgtctctattctatgga

SEQ ID NO: 577353 - DNA, 25 bp, Homo sapien
gtctctattctatggagggtctgac

SEQ ID NO: 577354 - DNA, 25 bp, Homo sapien
tttcctttcccagcttacaaatcat

SEQ ID NO: 577355 - DNA, 25 bp, Homo sapien
tacaaatcattccatctacaggccc

SEQ ID NO: 577356 - DNA, 25 bp, Homo sapien
gtgccaaaactacctgctgaatgaa

SEQ ID NO: 577357 - DNA, 25 bp, Homo sapien
gtgcaccccaggtagtgaaggcatt

SEQ ID NO: 577358 - DNA, 25 bp, Homo sapien
attgtttctgtggtgtacttgcttc

SEQ ID NO: 577359 - DNA, 25 bp, Homo sapien
tgtacttgcttcctcgtgtgtaaag

SEQ ID NO: 577360 - DNA, 25 bp, Homo sapien
ttcctcgtgtgtaaagtccgtttct

SEQ ID NO: 577361 - DNA, 25 bp, Homo sapien
agtccgtttctttctgtaggtcaca

SEQ ID NO: 577362 - DNA, 25 bp, Homo sapien
gagagccatggctacaacttgagca

SEQ ID NO: 577363 - DNA, 25 bp, Homo sapien
aacttgagcaagtcaaacacgctgt

SEQ ID NO: 577364 - DNA, 25 bp, Homo sapien
aacacgctgtgattcaggccaggga

SEQ ID NO: 577365 - DNA, 25 bp, Homo sapien
gtacgaactagctcagggcttctgg

SEQ ID NO: 577366 - DNA, 25 bp, Homo sapien
gcttctggaactgtgtgcggctgaa

SEQ ID NO: 577367 - DNA, 25 bp, Homo sapien
gattagactttaacacaagtttcta

SEQ ID NO: 577368 - DNA, 25 bp, Homo sapien
gtttctaaaaagacatcctccctgg

SEQ ID NO: 577369 - DNA, 25 bp, Homo sapien
acatcctccctggagatcttttaaa

SEQ ID NO: 577370 - DNA, 25 bp, Homo sapien
aatagggtaaattccatctcacgcc

SEQ ID NO: 577371 - DNA, 25 bp, Homo sapien
actcctgcctagatgacatatccgg

SEQ ID NO: 577372 - DNA, 25 bp, Homo sapien
gcctagatgacatatccgggcatag

SEQ ID NO: 577373 - DNA, 25 bp, Homo sapien
atatccgggcatagatcactgatgt

SEQ ID NO: 577374 - DNA, 25 bp, Homo sapien
gggcatagatcactgatgtattcaa

SEQ ID NO: 577375 - DNA, 25 bp, Homo sapien
atgtattcaattagatcaaggcttc

SEQ ID NO: 577376 - DNA, 25 bp, Homo sapien
caattagatcaaggcttcttacaag

SEQ ID NO: 577377 - DNA, 25 bp, Homo sapien
ggcttcttacaagtgatggaaacat

SEQ ID NO: 577378 - DNA, 25 bp, Homo sapien
aatgcacaattcaagtacacatacg

SEQ ID NO: 577379 - DNA, 25 bp, Homo sapien
gtacacatacgtgggaaaccatctg

SEQ ID NO: 577380 - DNA, 25 bp, Homo sapien
tacaatttcatctagccggcaattc

SEQ ID NO: 577381 - DNA, 25 bp, Homo sapien
tcatctagccggcaattctccaact

SEQ ID NO: 577382 - DNA, 25 bp, Homo sapien
aattctccaactcattcacatgcat

SEQ ID NO: 577383 - DNA, 25 bp, Homo sapien
tcacatgcatctcatgacatcgttg

SEQ ID NO: 577384 - DNA, 25 bp, Homo sapien
gacatcgttgtcagaagccttgcta

SEQ ID NO: 577385 - DNA, 25 bp, Homo sapien
tcgttgtcagaagccttgctagagt

SEQ ID NO: 577386 - DNA, 25 bp, Homo sapien
aagccttgctagagtgaacgtgcac

SEQ ID NO: 577387 - DNA, 25 bp, Homo sapien
gagtgaacgtgcacttcatcaaaca

SEQ ID NO: 577388 - DNA, 25 bp, Homo sapien
gaacgtgcacttcatcaaacacacc

SEQ ID NO: 577389 - DNA, 25 bp, Homo sapien
gccatgtatgttgcagctgccaaat

SEQ ID NO: 577390 - DNA, 25 bp, Homo sapien
gctgccaaattttgtagacaagagt

SEQ ID NO: 577391 - DNA, 25 bp, Homo sapien
tagacaagagtcagtttccaacatt

SEQ ID NO: 577392 - DNA, 25 bp, Homo sapien
tttcctttctgaaatctcccagtgg

SEQ ID NO: 577393 - DNA, 25 bp, Homo sapien
ctttctgaaatctcccagtggcttc

SEQ ID NO: 577394 - DNA, 25 bp, Homo sapien
cagtggcttctggtggacgcgtcac

SEQ ID NO: 577395 - DNA, 25 bp, Homo sapien
tggtggacgcgtcaccttggttttt

SEQ ID NO: 577396 - DNA, 25 bp, Homo sapien
tattcaacagcttagtgaactctgc

SEQ ID NO: 577397 - DNA, 25 bp, Homo sapien
agcttagtgaactctgcagcgccag

SEQ ID NO: 577398 - DNA, 25 bp, Homo sapien
ttagtgaactctgcagcgccagctc

SEQ ID NO: 577399 - DNA, 25 bp, Homo sapien
gtaaaactccgtcccgtggtccatg

SEQ ID NO: 577400 - DNA, 25 bp, Homo sapien
tgctttagccactaacgtccagaca

SEQ ID NO: 577401 - DNA, 25 bp, Homo sapien
tagccactaacgtccagacattctt

SEQ ID NO: 577402 - DNA, 25 bp, Homo sapien
agacattcttctcttaaccccaaag

SEQ ID NO: 577403 - DNA, 25 bp, Homo sapien
gggttcagttcctgctgttgcagcc

SEQ ID NO: 577404 - DNA, 25 bp, Homo sapien
agttcctgctgttgcagcccaaggg

SEQ ID NO: 577405 - DNA, 25 bp, Homo sapien
gggctccataagagccccttgtcct

SEQ ID NO: 577406 - DNA, 25 bp, Homo sapien
aggctgcgcactggcagctgttcag

SEQ ID NO: 577407 - DNA, 25 bp, Homo sapien
actggcagctgttcagtcccggctg

SEQ ID NO: 577408 - DNA, 25 bp, Homo sapien
agtcccggctggctttaattgttgt

SEQ ID NO: 577409 - DNA, 25 bp, Homo sapien
ggctggctttaattgttgtcgttta

SEQ ID NO: 577410 - DNA, 25 bp, Homo sapien
gacataaactctattttggttgtga

SEQ ID NO: 577411 - DNA, 25 bp, Homo sapien
aatacttattaatgtcttcaaccta

SEQ ID NO: 577412 - DNA, 25 bp, Homo sapien
gtcttcaacctaataatacaattgg

SEQ ID NO: 577413 - DNA, 25 bp, Homo sapien
gtgtcatgtatgaatgcttagctga

SEQ ID NO: 577414 - DNA, 25 bp, Homo sapien
gacaatgacttatcaaggaggtcct

SEQ ID NO: 577415 - DNA, 25 bp, Homo sapien
caaggaggtcctacccatttgtggt

SEQ ID NO: 577416 - DNA, 25 bp, Homo sapien
tacccatttgtggtagggatatttc

SEQ ID NO: 577417 - DNA, 25 bp, Homo sapien
gggatatttcccttacagttgtgat

SEQ ID NO: 577418 - DNA, 25 bp, Homo sapien
acaagggattgtttctatagagaga

SEQ ID NO: 577419 - DNA, 25 bp, Homo sapien
gatgaacagcaacaacagtgacaat

SEQ ID NO: 577420 - DNA, 25 bp, Homo sapien
aaaactgacttttgaacttgagtat

SEQ ID NO: 577421 - DNA, 25 bp, Homo sapien
tgaacttgagtatatccaatagata

SEQ ID NO: 577422 - DNA, 25 bp, Homo sapien
ttattggagaacatgcagtacaggt

SEQ ID NO: 577423 - DNA, 25 bp, Homo sapien
atgcagtacaggttgtggcttacac

SEQ ID NO: 577424 - DNA, 25 bp, Homo sapien
agtacaggttgtggcttacactgaa

SEQ ID NO: 577425 - DNA, 25 bp, Homo sapien
aaagctaacatttaacttacacatt

SEQ ID NO: 577426 - DNA, 25 bp, Homo sapien
taatgaatactataagacacgactt

SEQ ID NO: 577427 - DNA, 25 bp, Homo sapien
gacacgacttacagacatcttttag

SEQ ID NO: 577428 - DNA, 25 bp, Homo sapien
cgacttacagacatcttttagatta

SEQ ID NO: 577429 - DNA, 25 bp, Homo sapien
tatagtttggttagacattgtcata

SEQ ID NO: 577430 - DNA, 25 bp, Homo sapien
accttactttattcagacttcactg

SEQ ID NO: 577431 - DNA, 25 bp, Homo sapien
tgtggtgtcagccaactttatccct

SEQ ID NO: 577432 - DNA, 25 bp, Homo sapien
tgtcagccaactttatccctcaaat

SEQ ID NO: 577433 - DNA, 25 bp, Homo sapien
ggaaccagtcaacgctgaagacgca

SEQ ID NO: 577434 - DNA, 25 bp, Homo sapien
agacgcacatgcgaagccacacggg

SEQ ID NO: 577435 - DNA, 25 bp, Homo sapien
gaaaccgtacgaatgcgatcactgt

SEQ ID NO: 577436 - DNA, 25 bp, Homo sapien
gcataggctccaacctgaatgtgca

SEQ ID NO: 577437 - DNA, 25 bp, Homo sapien
tgaatgtgcacaggcggatccacac

SEQ ID NO: 577438 - DNA, 25 bp, Homo sapien
ctacgaatgccttgtctgcgggaaa

SEQ ID NO: 577439 - DNA, 25 bp, Homo sapien
aatgccttgtctgcgggaaagcctt

SEQ ID NO: 577440 - DNA, 25 bp, Homo sapien
gggaaagccttcagcgaccactcat

SEQ ID NO: 577441 - DNA, 25 bp, Homo sapien
aggagccacgtgaaaactcaccggg

SEQ ID NO: 577442 - DNA, 25 bp, Homo sapien
agagaagctctttgtgtcatccgtg

SEQ ID NO: 577443 - DNA, 25 bp, Homo sapien
gctctttgtgtcatccgtgtggaaa

SEQ ID NO: 577444 - DNA, 25 bp, Homo sapien
caattaaaacaggtattgtctcatc

SEQ ID NO: 577445 - DNA, 25 bp, Homo sapien
aattaaaacaggtattgtctcatcg

SEQ ID NO: 577446 - DNA, 25 bp, Homo sapien
attaaaacaggtattgtctcatcga

SEQ ID NO: 577447 - DNA, 25 bp, Homo sapien
ttaaaacaggtattgtctcatcgaa

SEQ ID NO: 577448 - DNA, 25 bp, Homo sapien
taaaacaggtattgtctcatcgaaa

SEQ ID NO: 577449 - DNA, 25 bp, Homo sapien
aaaacaggtattgtctcatcgaaaa

SEQ ID NO: 577450 - DNA, 25 bp, Homo sapien
aaacaggtattgtctcatcgaaaat

SEQ ID NO: 577451 - DNA, 25 bp, Homo sapien
aacaggtattgtctcatcgaaaata

SEQ ID NO: 577452 - DNA, 25 bp, Homo sapien
acaggtattgtctcatcgaaaataa

SEQ ID NO: 577453 - DNA, 25 bp, Homo sapien
caggtattgtctcatcgaaaataat

SEQ ID NO: 577454 - DNA, 25 bp, Homo sapien
aggtattgtctcatcgaaaataata

SEQ ID NO: 577455 - DNA, 25 bp, Homo sapien
gagtgacccggctatacaaggatca

SEQ ID NO: 577456 - DNA, 25 bp, Homo sapien
aaggatcagaaaggactccagcacc

SEQ ID NO: 577457 - DNA, 25 bp, Homo sapien
agcagtaccatcaggcttggaggag

SEQ ID NO: 577458 - DNA, 25 bp, Homo sapien
tgtaagatctgcatggactcaccca

SEQ ID NO: 577459 - DNA, 25 bp, Homo sapien
tggactcacccattgactgtgttct

SEQ ID NO: 577460 - DNA, 25 bp, Homo sapien
gagtgtggccacatggtaacctgta

SEQ ID NO: 577461 - DNA, 25 bp, Homo sapien
gtaacctgtaccaagtgtggcaagc

SEQ ID NO: 577462 - DNA, 25 bp, Homo sapien
tggcaagcgcatgaatgaatgtccc

SEQ ID NO: 577463 - DNA, 25 bp, Homo sapien
tgccggcagtatgtaatccgagctg

SEQ ID NO: 577464 - DNA, 25 bp, Homo sapien
taatccgagctgtgcatgtcttccg

SEQ ID NO: 577465 - DNA, 25 bp, Homo sapien
ttgtcaactacaagggctgctgtga

SEQ ID NO: 577466 - DNA, 25 bp, Homo sapien
taaaaggcttgaaacatgtatctgt

SEQ ID NO: 577467 - DNA, 25 bp, Homo sapien
ggcttgaaacatgtatctgttaaca

SEQ ID NO: 577468 - DNA, 25 bp, Homo sapien
tgaatgcataacaaaatagccaaac

SEQ ID NO: 577469 - DNA, 25 bp, Homo sapien
aatagccaaaccaaacattgctttg

SEQ ID NO: 577470 - DNA, 25 bp, Homo sapien
aaacattgctttgaattgctgcaca

SEQ ID NO: 577471 - DNA, 25 bp, Homo sapien
cattgctttgaattgctgcacaaat

SEQ ID NO: 577472 - DNA, 25 bp, Homo sapien
attgctgcacaaataactgattata

SEQ ID NO: 577473 - DNA, 25 bp, Homo sapien
ttataactgttatgacctagaaaaa

SEQ ID NO: 577474 - DNA, 25 bp, Homo sapien
tctttttggcaagatgtgagttgct

SEQ ID NO: 577475 - DNA, 25 bp, Homo sapien
gttgctgtagaattataccagttct

SEQ ID NO: 577476 - DNA, 25 bp, Homo sapien
tataccagttctttggttctacttt

SEQ ID NO: 577477 - DNA, 25 bp, Homo sapien
gtttgtattttctagcttgttataa

SEQ ID NO: 577478 - DNA, 25 bp, Homo sapien
gagatagtcattgttgtatattatt

SEQ ID NO: 577479 - DNA, 25 bp, Homo sapien
ataactgatcatattactgtatttg

SEQ ID NO: 577480 - DNA, 25 bp, Homo sapien
ggaatacaaccttattatctacaaa

SEQ ID NO: 577481 - DNA, 25 bp, Homo sapien
aattatgattgttttgccttttcca

SEQ ID NO: 577482 - DNA, 25 bp, Homo sapien
tatgattgttttgccttttccaatg

SEQ ID NO: 577483 - DNA, 25 bp, Homo sapien
ttgccttttccaatgttcataactg

SEQ ID NO: 577484 - DNA, 25 bp, Homo sapien
ttttccaatgttcataactgttttt

SEQ ID NO: 577485 - DNA, 25 bp, Homo sapien
atattcttgtctgattgctttgttc

SEQ ID NO: 577486 - DNA, 25 bp, Homo sapien
ttgtctgattgctttgttcagcact

SEQ ID NO: 577487 - DNA, 25 bp, Homo sapien
tttgttcagcacttctagaataaag

SEQ ID NO: 577488 - DNA, 25 bp, Homo sapien
atcacctgggtactcagccaggaat

SEQ ID NO: 577489 - DNA, 25 bp, Homo sapien
tgggtactcagccaggaatacgtta

SEQ ID NO: 577490 - DNA, 25 bp, Homo sapien
gggtactcagccaggaatacgttac

SEQ ID NO: 577491 - DNA, 25 bp, Homo sapien
ggtactcagccaggaatacgttaca

SEQ ID NO: 577492 - DNA, 25 bp, Homo sapien
gtactcagccaggaatacgttacaa

SEQ ID NO: 577493 - DNA, 25 bp, Homo sapien
actcagccaggaatacgttacaacc

SEQ ID NO: 577494 - DNA, 25 bp, Homo sapien
tcagccaggaatacgttacaacccc

SEQ ID NO: 577495 - DNA, 25 bp, Homo sapien
aggaatacgttacaacccctgcagg

SEQ ID NO: 577496 - DNA, 25 bp, Homo sapien
ggaatacgttacaacccctgcaggg

SEQ ID NO: 577497 - DNA, 25 bp, Homo sapien
tgcaggctgcagagtcacctcacct

SEQ ID NO: 577498 - DNA, 25 bp, Homo sapien
aggctgcagagtcacctcacctcag

SEQ ID NO: 577499 - DNA, 25 bp, Homo sapien
cagcctttgggcaggtgtagaaatt

SEQ ID NO: 577500 - DNA, 25 bp, Homo sapien
attatttcagatacaagcatgtaac

SEQ ID NO: 577501 - DNA, 25 bp, Homo sapien
atttcagatacaagcatgtaacaaa

SEQ ID NO: 577502 - DNA, 25 bp, Homo sapien
tacaagcatgtaacaaaaaaggtgt

SEQ ID NO: 577503 - DNA, 25 bp, Homo sapien
aaaatgtctaggctaagtatgcacc

SEQ ID NO: 577504 - DNA, 25 bp, Homo sapien
aaatgtctaggctaagtatgcacct

SEQ ID NO: 577505 - DNA, 25 bp, Homo sapien
aatgtctaggctaagtatgcaccta

SEQ ID NO: 577506 - DNA, 25 bp, Homo sapien
atgtctaggctaagtatgcacctaa

SEQ ID NO: 577507 - DNA, 25 bp, Homo sapien
tgtctaggctaagtatgcacctaaa

SEQ ID NO: 577508 - DNA, 25 bp, Homo sapien
gtctaggctaagtatgcacctaaat

SEQ ID NO: 577509 - DNA, 25 bp, Homo sapien
ctaggctaagtatgcacctaaatat

SEQ ID NO: 577510 - DNA, 25 bp, Homo sapien
ttggatcataggagcggatttcccc

SEQ ID NO: 577511 - DNA, 25 bp, Homo sapien
ctgatggattaaaagtgtgtgcacc

SEQ ID NO: 577512 - DNA, 25 bp, Homo sapien
aaaagtgtgtgcacctcccctcttg

SEQ ID NO: 577513 - DNA, 25 bp, Homo sapien
ttgcactttctctccagtcaccatg

SEQ ID NO: 577514 - DNA, 25 bp, Homo sapien
tccagtcaccatgtgaagttccttg

SEQ ID NO: 577515 - DNA, 25 bp, Homo sapien
gcctcccagtcatgcttcttattaa

SEQ ID NO: 577516 - DNA, 25 bp, Homo sapien
ttcttattaagcctgtggaattgtg

SEQ ID NO: 577517 - DNA, 25 bp, Homo sapien
ttattaagcctgtggaattgtgagt

SEQ ID NO: 577518 - DNA, 25 bp, Homo sapien
agtcaattaagcctttttattcata

SEQ ID NO: 577519 - DNA, 25 bp, Homo sapien
gtctcaggtagatctttatagagtg

SEQ ID NO: 577520 - DNA, 25 bp, Homo sapien
caggtagatctttatagagtgtgaa

SEQ ID NO: 577521 - DNA, 25 bp, Homo sapien
gttgagggtgtccagcgcccttagg

SEQ ID NO: 577522 - DNA, 25 bp, Homo sapien
ttgagggtgtccagcgcccttaggt

SEQ ID NO: 577523 - DNA, 25 bp, Homo sapien
tgagggtgtccagcgcccttaggtc

SEQ ID NO: 577524 - DNA, 25 bp, Homo sapien
gagggtgtccagcgcccttaggtca

SEQ ID NO: 577525 - DNA, 25 bp, Homo sapien
agggtgtccagcgcccttaggtcat

SEQ ID NO: 577526 - DNA, 25 bp, Homo sapien
gggtgtccagcgcccttaggtcatt

SEQ ID NO: 577527 - DNA, 25 bp, Homo sapien
ggtgtccagcgcccttaggtcattt

SEQ ID NO: 577528 - DNA, 25 bp, Homo sapien
gtgtccagcgcccttaggtcatttt

SEQ ID NO: 577529 - DNA, 25 bp, Homo sapien
tgtccagcgcccttaggtcattttc

SEQ ID NO: 577530 - DNA, 25 bp, Homo sapien
gtccagcgcccttaggtcattttct

SEQ ID NO: 577531 - DNA, 25 bp, Homo sapien
tcccttttctggattctcaagcagt

SEQ ID NO: 577532 - DNA, 25 bp, Homo sapien
tatcctcgggagaggccgggactcc

SEQ ID NO: 577533 - DNA, 25 bp, Homo sapien
taggcccacagaatttttgctccag

SEQ ID NO: 577534 - DNA, 25 bp, Homo sapien
acagaatttttgctccagtgaagtt

SEQ ID NO: 577535 - DNA, 25 bp, Homo sapien
ccagtgaagttggataagcactccg

SEQ ID NO: 577536 - DNA, 25 bp, Homo sapien
gcaaaaaccagagttctcggcttat

SEQ ID NO: 577537 - DNA, 25 bp, Homo sapien
gagttctcggcttataaacacttca

SEQ ID NO: 577538 - DNA, 25 bp, Homo sapien
aacacttcaataaactctggtgaca

SEQ ID NO: 577539 - DNA, 25 bp, Homo sapien
cttcaataaactctggtgacattct

SEQ ID NO: 577540 - DNA, 25 bp, Homo sapien
ctcgcggcagtcactgcagggacaa

SEQ ID NO: 577541 - DNA, 25 bp, Homo sapien
caaaggcggcctgcgcagacttgga

SEQ ID NO: 577542 - DNA, 25 bp, Homo sapien
tgggcggctttaccggccaaagacg

SEQ ID NO: 577543 - DNA, 25 bp, Homo sapien
gttacactttctctatttgtataca

SEQ ID NO: 577544 - DNA, 25 bp, Homo sapien
gtatacattggtttttacctctcaa

SEQ ID NO: 577545 - DNA, 25 bp, Homo sapien
ggtttttacctctcaagctgtaata

SEQ ID NO: 577546 - DNA, 25 bp, Homo sapien
gctgtaatatacatttcacaaggtc

SEQ ID NO: 577547 - DNA, 25 bp, Homo sapien
atttcacaaggtcatggtcctagta

SEQ ID NO: 577548 - DNA, 25 bp, Homo sapien
ggtcatggtcctagtacttctttta

SEQ ID NO: 577549 - DNA, 25 bp, Homo sapien
tagtacttcttttactcgtccatgt

SEQ ID NO: 577550 - DNA, 25 bp, Homo sapien
acttcttttactcgtccatgttgtt

SEQ ID NO: 577551 - DNA, 25 bp, Homo sapien
agaaattgggcacatgtcataggtt

SEQ ID NO: 577552 - DNA, 25 bp, Homo sapien
gttaattgagtagcacagattgtga

SEQ ID NO: 577553 - DNA, 25 bp, Homo sapien
cagattgtgagttcagaaagtgaca

SEQ ID NO: 577554 - DNA, 25 bp, Homo sapien
tgtgagccagctccgagaactttgc

SEQ ID NO: 577555 - DNA, 25 bp, Homo sapien
agaactttgccgtctgtggctcagg

SEQ ID NO: 577556 - DNA, 25 bp, Homo sapien
gtggctcaggccagagacgcacaca

SEQ ID NO: 577557 - DNA, 25 bp, Homo sapien
aaatcttggagctggtagtgctgga

SEQ ID NO: 577558 - DNA, 25 bp, Homo sapien
agtttgttgccatcctacccaaaga

SEQ ID NO: 577559 - DNA, 25 bp, Homo sapien
gccatcctacccaaagagctacaga

SEQ ID NO: 577560 - DNA, 25 bp, Homo sapien
gagctacagacttgggttcgagatc

SEQ ID NO: 577561 - DNA, 25 bp, Homo sapien
gggttcgagatcatcatccagagaa

SEQ ID NO: 577562 - DNA, 25 bp, Homo sapien
tgatgaccctggacaaccggtttct

SEQ ID NO: 577563 - DNA, 25 bp, Homo sapien
tggacaaccggtttctctccgtcga

SEQ ID NO: 577564 - DNA, 25 bp, Homo sapien
tctctccgtcgacgaaaacgggaag

SEQ ID NO: 577565 - DNA, 25 bp, Homo sapien
tagggagcacaggtatgtgtcagaa

SEQ ID NO: 577566 - DNA, 25 bp, Homo sapien
aacatgaggcttgagtgtcctccat

SEQ ID NO: 577567 - DNA, 25 bp, Homo sapien
ggcttgagtgtcctccatttattca

SEQ ID NO: 577568 - DNA, 25 bp, Homo sapien
tgccagggccttatttgggctggtt

SEQ ID NO: 577569 - DNA, 25 bp, Homo sapien
ggattcagtaatgggaatacaccaa

SEQ ID NO: 577570 - DNA, 25 bp, Homo sapien
accaagaacaagacagacgtgctgc

SEQ ID NO: 577571 - DNA, 25 bp, Homo sapien
agacagacgtgctgccagacatact

SEQ ID NO: 577572 - DNA, 25 bp, Homo sapien
gacgtgctgccagacatactggaac

SEQ ID NO: 577573 - DNA, 25 bp, Homo sapien
gacatactggaactcacggtttagt

SEQ ID NO: 577574 - DNA, 25 bp, Homo sapien
ctcacggtttagttgggaaagactg

SEQ ID NO: 577575 - DNA, 25 bp, Homo sapien
gactgacaggaaataattatccatg

SEQ ID NO: 577576 - DNA, 25 bp, Homo sapien
gtttttagagattggtgacgtattc

SEQ ID NO: 577577 - DNA, 25 bp, Homo sapien
agcttctgcccattgttgccgcagc

SEQ ID NO: 577578 - DNA, 25 bp, Homo sapien
tctgcccattgttgccgcagcacgt

SEQ ID NO: 577579 - DNA, 25 bp, Homo sapien
cagagcttccgacgtctcaagagaa

SEQ ID NO: 577580 - DNA, 25 bp, Homo sapien
gagcttccgacgtctcaagagaagt

SEQ ID NO: 577581 - DNA, 25 bp, Homo sapien
gcttccgacgtctcaagagaagtgg

SEQ ID NO: 577582 - DNA, 25 bp, Homo sapien
acgtctcaagagaagtgggaagtga

SEQ ID NO: 577583 - DNA, 25 bp, Homo sapien
gtgggaagtgagatttatgcatgaa

SEQ ID NO: 577584 - DNA, 25 bp, Homo sapien
tatgcatgaaagaaaccgcttggtt

SEQ ID NO: 577585 - DNA, 25 bp, Homo sapien
gaaaccgcttggtttttagagattg

SEQ ID NO: 577586 - DNA, 25 bp, Homo sapien
cgcttggtttttagagattggtgac

SEQ ID NO: 577587 - DNA, 25 bp, Homo sapien
cagagctggaatggattacccaagt

SEQ ID NO: 577588 - DNA, 25 bp, Homo sapien
gaatggattacccaagtggcttaag

SEQ ID NO: 577589 - DNA, 25 bp, Homo sapien
ttacccaagtggcttaagcaagata

SEQ ID NO: 577590 - DNA, 25 bp, Homo sapien
aaggaagaatgcaccctcgactggg

SEQ ID NO: 577591 - DNA, 25 bp, Homo sapien
tcgactggggactcaaatggactga

SEQ ID NO: 577592 - DNA, 25 bp, Homo sapien
aatggactgatctgagttgttgact

SEQ ID NO: 577593 - DNA, 25 bp, Homo sapien
gttgttgactattgattggctttgg

SEQ ID NO: 577594 - DNA, 25 bp, Homo sapien
gagattatagtatctctgcaatctg

SEQ ID NO: 577595 - DNA, 25 bp, Homo sapien
atctctgcaatctgattactgtacg

SEQ ID NO: 577596 - DNA, 25 bp, Homo sapien
ctgattactgtacgaatttctgcat

SEQ ID NO: 577597 - DNA, 25 bp, Homo sapien
attactgtacgaatttctgcattct

SEQ ID NO: 577598 - DNA, 25 bp, Homo sapien
gtgggaaccctaatttccacagaat

SEQ ID NO: 577599 - DNA, 25 bp, Homo sapien
cttccttaagtgaaagttatgctgc

SEQ ID NO: 577600 - DNA, 25 bp, Homo sapien
ttaagtgaaagttatgctgcatcga

SEQ ID NO: 577601 - DNA, 25 bp, Homo sapien
ttatgctgcatcgaattgtaactga

SEQ ID NO: 577602 - DNA, 25 bp, Homo sapien
gctgcatcgaattgtaactgaaagt

SEQ ID NO: 577603 - DNA, 25 bp, Homo sapien
gtaactgaaagtatagatccaacaa

SEQ ID NO: 577604 - DNA, 25 bp, Homo sapien
agatccaacaaatagagactgggtt

SEQ ID NO: 577605 - DNA, 25 bp, Homo sapien
ctgggttctagagagttctggtcta

SEQ ID NO: 577606 - DNA, 25 bp, Homo sapien
gagttctggtctatagaaacccaaa

SEQ ID NO: 577607 - DNA, 25 bp, Homo sapien
aaaactaaaatctctcataactcaa

SEQ ID NO: 577608 - DNA, 25 bp, Homo sapien
aaatctctcataactcaagtatgga

SEQ ID NO: 577609 - DNA, 25 bp, Homo sapien
catttctgacctgggtcacttcatc

SEQ ID NO: 577610 - DNA, 25 bp, Homo sapien
gggtcacttcatccctccttaggca

SEQ ID NO: 577611 - DNA, 25 bp, Homo sapien
ccccactcctgagaggttatcatat

SEQ ID NO: 577612 - DNA, 25 bp, Homo sapien
cactcctgagaggttatcatattga

SEQ ID NO: 577613 - DNA, 25 bp, Homo sapien
atcatattgatgctggtttggacac

SEQ ID NO: 577614 - DNA, 25 bp, Homo sapien
attgatgctggtttggacacccaat

SEQ ID NO: 577615 - DNA, 25 bp, Homo sapien
gctggtttggacacccaattggcat

SEQ ID NO: 577616 - DNA, 25 bp, Homo sapien
ggacacccaattggcatagcacact

SEQ ID NO: 577617 - DNA, 25 bp, Homo sapien
tggcatagcacactactgcccagaa

SEQ ID NO: 577618 - DNA, 25 bp, Homo sapien
gtggctattcataggtgctatccca

SEQ ID NO: 577619 - DNA, 25 bp, Homo sapien
tcataggtgctatcccactactgat

SEQ ID NO: 577620 - DNA, 25 bp, Homo sapien
agaattgatcacatcatgaaaggtg

SEQ ID NO: 577621 - DNA, 25 bp, Homo sapien
gatcacatcatgaaaggtgaaatca

SEQ ID NO: 577622 - DNA, 25 bp, Homo sapien
gaaatcattacggaattgcttaaat

SEQ ID NO: 577623 - DNA, 25 bp, Homo sapien
aatcattacggaattgcttaaatat

SEQ ID NO: 577624 - DNA, 25 bp, Homo sapien
gaagggaaaaaagaatcctcatcat

SEQ ID NO: 577625 - DNA, 25 bp, Homo sapien
aaagaatcctcatcattaatgcaag

SEQ ID NO: 577626 - DNA, 25 bp, Homo sapien
gaatcctcatcattaatgcaagtgg

SEQ ID NO: 577627 - DNA, 25 bp, Homo sapien
tcctcatcattaatgcaagtggaag

SEQ ID NO: 577628 - DNA, 25 bp, Homo sapien
caagtggaaggaaactcttcaccaa

SEQ ID NO: 577629 - DNA, 25 bp, Homo sapien
actcttcaccaaagaattgatcaca

SEQ ID NO: 577630 - DNA, 25 bp, Homo sapien
ttcaccaaagaattgatcacatcat

SEQ ID NO: 577631 - DNA, 25 bp, Homo sapien
agtggccttctccttaattttggct

SEQ ID NO: 577632 - DNA, 25 bp, Homo sapien
tttggcttggcttctgatccttttc

SEQ ID NO: 577633 - DNA, 25 bp, Homo sapien
gatccttttcccaactagaagtctt

SEQ ID NO: 577634 - DNA, 25 bp, Homo sapien
gaagtcttaagccacttttcgctga

SEQ ID NO: 577635 - DNA, 25 bp, Homo sapien
tcgctgaaaatgaaatccctccctt

SEQ ID NO: 577636 - DNA, 25 bp, Homo sapien
tcccttatccatggtagttttaaat

SEQ ID NO: 577637 - DNA, 25 bp, Homo sapien
agatttaggcaaagagcctgtgctc

SEQ ID NO: 577638 - DNA, 25 bp, Homo sapien
ggccagactgctgttgaagttcctg

SEQ ID NO: 577639 - DNA, 25 bp, Homo sapien
gaagttcctggagagcaaatgttaa

SEQ ID NO: 577640 - DNA, 25 bp, Homo sapien
gacagagcacttaagagctttcagg

SEQ ID NO: 577641 - DNA, 25 bp, Homo sapien
aagatgcgcactgcagtcggctggc

SEQ ID NO: 577642 - DNA, 25 bp, Homo sapien
gctgtcaaggcctacttgtgggaca

SEQ ID NO: 577643 - DNA, 25 bp, Homo sapien
gcctacttgtgggacaacaaccagg

SEQ ID NO: 577644 - DNA, 25 bp, Homo sapien
acaaccaggtggttgtgcagtggct

SEQ ID NO: 577645 - DNA, 25 bp, Homo sapien
tggctggaacagcactggcaggcag

SEQ ID NO: 577646 - DNA, 25 bp, Homo sapien
atcacgtacctgaagcacgactctg

SEQ ID NO: 577647 - DNA, 25 bp, Homo sapien
acctgaagcacgactctgtcctcaa

SEQ ID NO: 577648 - DNA, 25 bp, Homo sapien
aagaccatccgaggcctggttgaag

SEQ ID NO: 577649 - DNA, 25 bp, Homo sapien
catccgaggcctggttgaagaaaac

SEQ ID NO: 577650 - DNA, 25 bp, Homo sapien
gtgatatacctgagccagcacatca

SEQ ID NO: 577651 - DNA, 25 bp, Homo sapien
ctgagcgggcgcaggtcgttcacct

SEQ ID NO: 577652 - DNA, 25 bp, Homo sapien
tcgttcacctgctgtctaccatgga

SEQ ID NO: 577653 - DNA, 25 bp, Homo sapien
tttcttggagccttaatttgattaa

SEQ ID NO: 577654 - DNA, 25 bp, Homo sapien
atttgattaacacttcaggagcagt

SEQ ID NO: 577655 - DNA, 25 bp, Homo sapien
agcagtggcagagtgtacagaaagc

SEQ ID NO: 577656 - DNA, 25 bp, Homo sapien
gtacagaaagcaaggcaccaccacc

SEQ ID NO: 577657 - DNA, 25 bp, Homo sapien
cccctgaatggagcctgggtcacag

SEQ ID NO: 577658 - DNA, 25 bp, Homo sapien
agcagatttggacttggaggaccct

SEQ ID NO: 577659 - DNA, 25 bp, Homo sapien
ttggacttggaggaccctgggtgtc

SEQ ID NO: 577660 - DNA, 25 bp, Homo sapien
gggcctccaaaacagatctgagcat

SEQ ID NO: 577661 - DNA, 25 bp, Homo sapien
aaacagatctgagcatcagaaggag

SEQ ID NO: 577662 - DNA, 25 bp, Homo sapien
ggagcaagaactgtgtctcacctgc

SEQ ID NO: 577663 - DNA, 25 bp, Homo sapien
agaactgtgtctcacctgcccagca

SEQ ID NO: 577664 - DNA, 25 bp, Homo sapien
aacagtaaagtctcattgcaaagca

SEQ ID NO: 577665 - DNA, 25 bp, Homo sapien
ggtgggcttaggcttaaactagatt

SEQ ID NO: 577666 - DNA, 25 bp, Homo sapien
actagattatctgctttcatatact

SEQ ID NO: 577667 - DNA, 25 bp, Homo sapien
ttactgaatattttagatctcttgg

SEQ ID NO: 577668 - DNA, 25 bp, Homo sapien
agatctcttgggttacttaaatatg

SEQ ID NO: 577669 - DNA, 25 bp, Homo sapien
attgcattgcaaatcccagtgttta

SEQ ID NO: 577670 - DNA, 25 bp, Homo sapien
atcccagtgtttactgtatatgcaa

SEQ ID NO: 577671 - DNA, 25 bp, Homo sapien
gtatatgcaattgatttatcctgtt

SEQ ID NO: 577672 - DNA, 25 bp, Homo sapien
tatcctgtttgtgcttaatataagt

SEQ ID NO: 577673 - DNA, 25 bp, Homo sapien
gtgttcctgagatgttaacatttca

SEQ ID NO: 577674 - DNA, 25 bp, Homo sapien
catttcaatattctctgattcctat

SEQ ID NO: 577675 - DNA, 25 bp, Homo sapien
gtcaccttggtgcactttcttcgga

SEQ ID NO: 577676 - DNA, 25 bp, Homo sapien
cttggtgcactttcttcggatgaag

SEQ ID NO: 577677 - DNA, 25 bp, Homo sapien
gcactttcttcggatgaagagttta

SEQ ID NO: 577678 - DNA, 25 bp, Homo sapien
tgtgtatatattgccaccaaattat

SEQ ID NO: 577679 - DNA, 25 bp, Homo sapien
aaattatttatagttctgcgggtgt

SEQ ID NO: 577680 - DNA, 25 bp, Homo sapien
tagttctgcgggtgtgttttttaat

SEQ ID NO: 577681 - DNA, 25 bp, Homo sapien
actctgacttttctggtgcaacagt

SEQ ID NO: 577682 - DNA, 25 bp, Homo sapien
gtgcaacagtggagaatcttaccat

SEQ ID NO: 577683 - DNA, 25 bp, Homo sapien
gtggagaatcttaccattggatttc

SEQ ID NO: 577684 - DNA, 25 bp, Homo sapien
ttaccattggatttctttaacttgt

SEQ ID NO: 577685 - DNA, 25 bp, Homo sapien
aggacccttgcctcagcctcgggaa

SEQ ID NO: 577686 - DNA, 25 bp, Homo sapien
gggttcaggccatctgcctgtctgg

SEQ ID NO: 577687 - DNA, 25 bp, Homo sapien
aggccatctgcctgtctggtcttcc

SEQ ID NO: 577688 - DNA, 25 bp, Homo sapien
ctgcctgtctggtcttcccagagag

SEQ ID NO: 577689 - DNA, 25 bp, Homo sapien
cctgtctggtcttcccagagagctg

SEQ ID NO: 577690 - DNA, 25 bp, Homo sapien
aattttctataaacagtcatacaat

SEQ ID NO: 577691 - DNA, 25 bp, Homo sapien
taaacagtcatacaatttgcaaaag

SEQ ID NO: 577692 - DNA, 25 bp, Homo sapien
tttagttccttgtgtggttcctaag

SEQ ID NO: 577693 - DNA, 25 bp, Homo sapien
tagttccttgtgtggttcctaaggc

SEQ ID NO: 577694 - DNA, 25 bp, Homo sapien
cttgtgtggttcctaaggcctccaa

SEQ ID NO: 577695 - DNA, 25 bp, Homo sapien
tgtgtggttcctaaggcctccaata

SEQ ID NO: 577696 - DNA, 25 bp, Homo sapien
tgtggttcctaaggcctccaataaa

SEQ ID NO: 577697 - DNA, 25 bp, Homo sapien
aagaaggaatcctgctccaagcatg

SEQ ID NO: 577698 - DNA, 25 bp, Homo sapien
tgctccaagcatgcatctggtactt

SEQ ID NO: 577699 - DNA, 25 bp, Homo sapien
agcatgcatctggtacttccttcca

SEQ ID NO: 577700 - DNA, 25 bp, Homo sapien
acagcccagcttccgtatggtggac

SEQ ID NO: 577701 - DNA, 25 bp, Homo sapien
agcttccgtatggtggactcaggca

SEQ ID NO: 577702 - DNA, 25 bp, Homo sapien
tatggtggactcaggcatccagcca

SEQ ID NO: 577703 - DNA, 25 bp, Homo sapien
tgcctactaccgctacattgagaag

SEQ ID NO: 577704 - DNA, 25 bp, Homo sapien
taccgctacattgagaagccacctg

SEQ ID NO: 577705 - DNA, 25 bp, Homo sapien
aacggcgagtagatgggcacagttt

SEQ ID NO: 577706 - DNA, 25 bp, Homo sapien
ggcacagtttggtgtctgcagatac

SEQ ID NO: 577707 - DNA, 25 bp, Homo sapien
ttggtgtctgcagatacctttgagc

SEQ ID NO: 577708 - DNA, 25 bp, Homo sapien
gatgtgtggcatgagagtcgttatt

SEQ ID NO: 577709 - DNA, 25 bp, Homo sapien
gagtcgttattgcaactgttagttg

SEQ ID NO: 577710 - DNA, 25 bp, Homo sapien
ggaccaagatatatgtcacagtctt

SEQ ID NO: 577711 - DNA, 25 bp, Homo sapien
cagtcttacctgtgggtagggagca

SEQ ID NO: 577712 - DNA, 25 bp, Homo sapien
agggagcaaacaggagagtcacatc

SEQ ID NO: 577713 - DNA, 25 bp, Homo sapien
cacatcacctgtattctgggccagg

SEQ ID NO: 577714 - DNA, 25 bp, Homo sapien
tatgtcacaatcttccctgacacaa

SEQ ID NO: 577715 - DNA, 25 bp, Homo sapien
acatgggatcttacccttttctcta

SEQ ID NO: 577716 - DNA, 25 bp, Homo sapien
cttttctctaatcccagctaaaact

SEQ ID NO: 577717 - DNA, 25 bp, Homo sapien
gctaaaactgacagtatcctttcta

SEQ ID NO: 577718 - DNA, 25 bp, Homo sapien
gtatcctttctattggctgatgtgt

SEQ ID NO: 577719 - DNA, 25 bp, Homo sapien
ttcctgaggacccacaagtatgatc

SEQ ID NO: 577720 - DNA, 25 bp, Homo sapien
ggacccacaagtatgatcctgcttg

SEQ ID NO: 577721 - DNA, 25 bp, Homo sapien
atgatcctgcttggaagtaccgctt

SEQ ID NO: 577722 - DNA, 25 bp, Homo sapien
ggaagtaccgctttggtgacctcag

SEQ ID NO: 577723 - DNA, 25 bp, Homo sapien
ttggtgacctcagcgtgacctacga

SEQ ID NO: 577724 - DNA, 25 bp, Homo sapien
gacctacgagcccatggcctacatg

SEQ ID NO: 577725 - DNA, 25 bp, Homo sapien
atggcctacatggatgctgcctact

SEQ ID NO: 577726 - DNA, 25 bp, Homo sapien
gatgctgcctactttggtgagatca

SEQ ID NO: 577727 - DNA, 25 bp, Homo sapien
ggtgagatcagcatcgggactccac

SEQ ID NO: 577728 - DNA, 25 bp, Homo sapien
ttcctggtcctttttgacaccggct

SEQ ID NO: 577729 - DNA, 25 bp, Homo sapien
agccttctttttctggactctggac

SEQ ID NO: 577730 - DNA, 25 bp, Homo sapien
ctggagctgccctgtctttcattga

SEQ ID NO: 577731 - DNA, 25 bp, Homo sapien
ctgtctttcattgagccttagcatt

SEQ ID NO: 577732 - DNA, 25 bp, Homo sapien
attgagccttagcatttccctctca

SEQ ID NO: 577733 - DNA, 25 bp, Homo sapien
ttagcatttccctctcaggcttcct

SEQ ID NO: 577734 - DNA, 25 bp, Homo sapien
aggcttcctctcaagctcaaggaac

SEQ ID NO: 577735 - DNA, 25 bp, Homo sapien
actcacccccagataagaagctggt

SEQ ID NO: 577736 - DNA, 25 bp, Homo sapien
tgtctctctcatttcagaaacggac

SEQ ID NO: 577737 - DNA, 25 bp, Homo sapien
gctgataccaaccaactggcctgta

SEQ ID NO: 577738 - DNA, 25 bp, Homo sapien
aaccaactggcctgtatctatctat

SEQ ID NO: 577739 - DNA, 25 bp, Homo sapien
gtatctatctatctggatttgactt

SEQ ID NO: 577740 - DNA, 25 bp, Homo sapien
atctatctggatttgacttgaattt

SEQ ID NO: 577741 - DNA, 25 bp, Homo sapien
aaaaagctcctggaggactcctgaa

SEQ ID NO: 577742 - DNA, 25 bp, Homo sapien
gcagcagtggctcatggtttacatt

SEQ ID NO: 577743 - DNA, 25 bp, Homo sapien
gtggctcatggtttacattggaaag

SEQ ID NO: 577744 - DNA, 25 bp, Homo sapien
ttttacttggtattttgacaaacat

SEQ ID NO: 577745 - DNA, 25 bp, Homo sapien
gtatttgaagcacactaaacatcta

SEQ ID NO: 577746 - DNA, 25 bp, Homo sapien
aacatctagtattgccgttttctac

SEQ ID NO: 577747 - DNA, 25 bp, Homo sapien
agtattgccgttttctacttggctt

SEQ ID NO: 577748 - DNA, 25 bp, Homo sapien
gccgttttctacttggctttagcaa

SEQ ID NO: 577749 - DNA, 25 bp, Homo sapien
aagtgaataaactgttccactttct

SEQ ID NO: 577750 - DNA, 25 bp, Homo sapien
atgagtaaccgggtgctttgcttct

SEQ ID NO: 577751 - DNA, 25 bp, Homo sapien
gtgctttgcttctgtgattcttggc

SEQ ID NO: 577752 - DNA, 25 bp, Homo sapien
aactctcagattatgactcttcaga

SEQ ID NO: 577753 - DNA, 25 bp, Homo sapien
tcttcagaggaagcaattcgtacgc

SEQ ID NO: 577754 - DNA, 25 bp, Homo sapien
attcgtacgcttgatcagatttctg

SEQ ID NO: 577755 - DNA, 25 bp, Homo sapien
tctcaaaagcttggcctatcggaac

SEQ ID NO: 577756 - DNA, 25 bp, Homo sapien
ggcctatcggaacaaaggttcattt

SEQ ID NO: 577757 - DNA, 25 bp, Homo sapien
agattatggaagaccttctctcttc

SEQ ID NO: 577758 - DNA, 25 bp, Homo sapien
ttcttaccctgacctagctgaagtt

SEQ ID NO: 577759 - DNA, 25 bp, Homo sapien
accctgacctagctgaagttcatgc

SEQ ID NO: 577760 - DNA, 25 bp, Homo sapien
tgcccttgaggctttgattcatttc

SEQ ID NO: 577761 - DNA, 25 bp, Homo sapien
gaggctttgattcatttcaccaaaa

SEQ ID NO: 577762 - DNA, 25 bp, Homo sapien
gagaaagataccgaagttgcagaat

SEQ ID NO: 577763 - DNA, 25 bp, Homo sapien
cctgtggtcctagccactagaggct

SEQ ID NO: 577764 - DNA, 25 bp, Homo sapien
agccttggcgacaaaccaagaccct

SEQ ID NO: 577765 - DNA, 25 bp, Homo sapien
gacactctacagaaaaaccgacagc

SEQ ID NO: 577766 - DNA, 25 bp, Homo sapien
acactctacagaaaaaccgacagcc

SEQ ID NO: 577767 - DNA, 25 bp, Homo sapien
ccagtcctcaaacccacgaagtggg

SEQ ID NO: 577768 - DNA, 25 bp, Homo sapien
agtcctcaaacccacgaagtgggct

SEQ ID NO: 577769 - DNA, 25 bp, Homo sapien
gtcctcaaacccacgaagtgggctg

SEQ ID NO: 577770 - DNA, 25 bp, Homo sapien
tcctcaaacccacgaagtgggctgg

SEQ ID NO: 577771 - DNA, 25 bp, Homo sapien
cctcaaacccacgaagtgggctggg

SEQ ID NO: 577772 - DNA, 25 bp, Homo sapien
ctcaaacccacgaagtgggctgggc

SEQ ID NO: 577773 - DNA, 25 bp, Homo sapien
tcaaacccacgaagtgggctgggcg

SEQ ID NO: 577774 - DNA, 25 bp, Homo sapien
aacgggactgggaaaatggcagcaa

SEQ ID NO: 577775 - DNA, 25 bp, Homo sapien
gagtacacaggtccacggctgtaca

SEQ ID NO: 577776 - DNA, 25 bp, Homo sapien
ggtccacggctgtacaaagaaccca

SEQ ID NO: 577777 - DNA, 25 bp, Homo sapien
gtacaaagaacccagcgccaagtcc

SEQ ID NO: 577778 - DNA, 25 bp, Homo sapien
gcgccaagtccaacaagttcatcat

SEQ ID NO: 577779 - DNA, 25 bp, Homo sapien
aagttcatcatccacaatgccctat

SEQ ID NO: 577780 - DNA, 25 bp, Homo sapien
aatgccctatcacactgctgcctgg

SEQ ID NO: 577781 - DNA, 25 bp, Homo sapien
cgggcaaggtgaacgaaccgcagaa

SEQ ID NO: 577782 - DNA, 25 bp, Homo sapien
aacgaaccgcagaagaatcgcattc

SEQ ID NO: 577783 - DNA, 25 bp, Homo sapien
gaaaagcaaggccaaccacttcctg

SEQ ID NO: 577784 - DNA, 25 bp, Homo sapien
ttcctgatcctctttcgcgactcga

SEQ ID NO: 577785 - DNA, 25 bp, Homo sapien
ggttgttggtttgacagttgtcaga

SEQ ID NO: 577786 - DNA, 25 bp, Homo sapien
ttgacagttgtcagagcatgttgca

SEQ ID NO: 577787 - DNA, 25 bp, Homo sapien
agagcatgttgcagctgtatgaggt

SEQ ID NO: 577788 - DNA, 25 bp, Homo sapien
agctgtatgaggtgggtatctgtac

SEQ ID NO: 577789 - DNA, 25 bp, Homo sapien
gtatctgtacatatggatgtcccat

SEQ ID NO: 577790 - DNA, 25 bp, Homo sapien
atggatgtcccatattctccagcat

SEQ ID NO: 577791 - DNA, 25 bp, Homo sapien
tgtcccatattctccagcattgcat

SEQ ID NO: 577792 - DNA, 25 bp, Homo sapien
gcattgcataggaatagctggtgtc

SEQ ID NO: 577793 - DNA, 25 bp, Homo sapien
ggaatagctggtgtctagatcctgc

SEQ ID NO: 577794 - DNA, 25 bp, Homo sapien
aggagctatgtgtcctgaatttaaa

SEQ ID NO: 577795 - DNA, 25 bp, Homo sapien
agacatacaacaacagtgcattagt

SEQ ID NO: 577796 - DNA, 25 bp, Homo sapien
tttttagagattggtgacgtattca

SEQ ID NO: 577797 - DNA, 25 bp, Homo sapien
aaaacagaccgggtgccatggtgca

SEQ ID NO: 577798 - DNA, 25 bp, Homo sapien
aaacagaccgggtgccatggtgcac

SEQ ID NO: 577799 - DNA, 25 bp, Homo sapien
aacagaccgggtgccatggtgcacg

SEQ ID NO: 577800 - DNA, 25 bp, Homo sapien
agaccgggtgccatggtgcacgcct

SEQ ID NO: 577801 - DNA, 25 bp, Homo sapien
caaagtgagcggatcacttcagctc

SEQ ID NO: 577802 - DNA, 25 bp, Homo sapien
aagtgagcggatcacttcagctcag

SEQ ID NO: 577803 - DNA, 25 bp, Homo sapien
gccaacacagtgaggccctgtatca

SEQ ID NO: 577804 - DNA, 25 bp, Homo sapien
attgttgccgcagcacgtaacacct

SEQ ID NO: 577805 - DNA, 25 bp, Homo sapien
cagagcttccgacgtctcaagagaa

SEQ ID NO: 577806 - DNA, 25 bp, Homo sapien
tatgcatgaaagaaaccgcttggtt

SEQ ID NO: 577807 - DNA, 25 bp, Homo sapien
gctaaatgacagaaacatggatatt

SEQ ID NO: 577808 - DNA, 25 bp, Homo sapien
gacatgttgaaaaacacagtctctt

SEQ ID NO: 577809 - DNA, 25 bp, Homo sapien
gttgaaaaacacagtctcttgaaga

SEQ ID NO: 577810 - DNA, 25 bp, Homo sapien
gaaaaacacagtctcttgaagatat

SEQ ID NO: 577811 - DNA, 25 bp, Homo sapien
gtctcttgaagatatactggaatac

SEQ ID NO: 577812 - DNA, 25 bp, Homo sapien
gatatactggaatacattatttttg

SEQ ID NO: 577813 - DNA, 25 bp, Homo sapien
gtcttaaaagcataaataggtaact

SEQ ID NO: 577814 - DNA, 25 bp, Homo sapien
aaagtcatgagaaatcacactcaag

SEQ ID NO: 577815 - DNA, 25 bp, Homo sapien
gagaaatcacactcaagcattatca

SEQ ID NO: 577816 - DNA, 25 bp, Homo sapien
gaaatcacactcaagcattatcaag

SEQ ID NO: 577817 - DNA, 25 bp, Homo sapien
actcaagcattatcaagtgaagaaa

SEQ ID NO: 577818 - DNA, 25 bp, Homo sapien
gtaagaaagaactggctgccatctt

SEQ ID NO: 577819 - DNA, 25 bp, Homo sapien
tggctgccatctttttcagtcattt

SEQ ID NO: 577820 - DNA, 25 bp, Homo sapien
ggctgccatctttttcagtcatttt

SEQ ID NO: 577821 - DNA, 25 bp, Homo sapien
gctgccatctttttcagtcatttta

SEQ ID NO: 577822 - DNA, 25 bp, Homo sapien
gtcattttaaaatatggcacgtttt

SEQ ID NO: 577823 - DNA, 25 bp, Homo sapien
aaaatatggcacgttttactgctac

SEQ ID NO: 577824 - DNA, 25 bp, Homo sapien
atatggcacgttttactgctacttc

SEQ ID NO: 577825 - DNA, 25 bp, Homo sapien
atggcacgttttactgctacttcag

SEQ ID NO: 577826 - DNA, 25 bp, Homo sapien
ggcacgttttactgctacttcagta

SEQ ID NO: 577827 - DNA, 25 bp, Homo sapien
gcacgttttactgctacttcagtaa

SEQ ID NO: 577828 - DNA, 25 bp, Homo sapien
gttttactgctacttcagtaagaat

SEQ ID NO: 577829 - DNA, 25 bp, Homo sapien
ttttctatagatttagtgactccaa

SEQ ID NO: 577830 - DNA, 25 bp, Homo sapien
gtgactccaaatgataaggtctcaa

SEQ ID NO: 577831 - DNA, 25 bp, Homo sapien
gataaggtctcaagctcataataat

SEQ ID NO: 577832 - DNA, 25 bp, Homo sapien
gctcataataatttatcccttgggt

SEQ ID NO: 577833 - DNA, 25 bp, Homo sapien
taatttatcccttgggtaacacaca

SEQ ID NO: 577834 - DNA, 25 bp, Homo sapien
tgggtaacacacaaggcttggtggt

SEQ ID NO: 577835 - DNA, 25 bp, Homo sapien
aaggcttggtggtatttcagtaata

SEQ ID NO: 577836 - DNA, 25 bp, Homo sapien
gtaatattcatgacaacagcagctg

SEQ ID NO: 577837 - DNA, 25 bp, Homo sapien
acaacagcagctgtcgtgctaataa

SEQ ID NO: 577838 - DNA, 25 bp, Homo sapien
gcagctgtcgtgctaataaggactg

SEQ ID NO: 577839 - DNA, 25 bp, Homo sapien
taaggactgatgtcaccagagcact

SEQ ID NO: 577840 - DNA, 25 bp, Homo sapien
gtaatttctacctgtaattccagcc

SEQ ID NO: 577841 - DNA, 25 bp, Homo sapien
taatttctacctgtaattccagccc

SEQ ID NO: 577842 - DNA, 25 bp, Homo sapien
aatttctacctgtaattccagccct

SEQ ID NO: 577843 - DNA, 25 bp, Homo sapien
atttctacctgtaattccagccctt

SEQ ID NO: 577844 - DNA, 25 bp, Homo sapien
tttctacctgtaattccagcccttt

SEQ ID NO: 577845 - DNA, 25 bp, Homo sapien
ttctacctgtaattccagccctttg

SEQ ID NO: 577846 - DNA, 25 bp, Homo sapien
ttagccaagcttggtggtgcgtgcc

SEQ ID NO: 577847 - DNA, 25 bp, Homo sapien
tagccaagcttggtggtgcgtgcct

SEQ ID NO: 577848 - DNA, 25 bp, Homo sapien
gaagtatctggaaaagtcttagaaa

SEQ ID NO: 577849 - DNA, 25 bp, Homo sapien
aaacagaatgaaagtgccactgatg

SEQ ID NO: 577850 - DNA, 25 bp, Homo sapien
gattgttaagatcaacgaacttcat

SEQ ID NO: 577851 - DNA, 25 bp, Homo sapien
gatcaacgaacttcatgaaaaagga

SEQ ID NO: 577852 - DNA, 25 bp, Homo sapien
actttgtatttatgccttgaagggt

SEQ ID NO: 577853 - DNA, 25 bp, Homo sapien
atgccttgaagggtgagactattga

SEQ ID NO: 577854 - DNA, 25 bp, Homo sapien
ggtgagactattgaaggagccttat

SEQ ID NO: 577855 - DNA, 25 bp, Homo sapien
ccttatgcaaggatggccgttttcg

SEQ ID NO: 577856 - DNA, 25 bp, Homo sapien
aaggatggccgttttcggtctgaca

SEQ ID NO: 577857 - DNA, 25 bp, Homo sapien
gccgttttcggtctgacataggtga

SEQ ID NO: 577858 - DNA, 25 bp, Homo sapien
cggtctgacataggtgaatttgaat

SEQ ID NO: 577859 - DNA, 25 bp, Homo sapien
cttctgggaccacattttacgacca

SEQ ID NO: 577860 - DNA, 25 bp, Homo sapien
tgggaccacattttacgaccaccta

SEQ ID NO: 577861 - DNA, 25 bp, Homo sapien
gggaccacattttacgaccacctag

SEQ ID NO: 577862 - DNA, 25 bp, Homo sapien
acattttacgaccacctagctgagt

SEQ ID NO: 577863 - DNA, 25 bp, Homo sapien
attttacgaccacctagctgagtga

SEQ ID NO: 577864 - DNA, 25 bp, Homo sapien
tttacgaccacctagctgagtgata

SEQ ID NO: 577865 - DNA, 25 bp, Homo sapien
acgaccacctagctgagtgataaat

SEQ ID NO: 577866 - DNA, 25 bp, Homo sapien
accacctagctgagtgataaatcac

SEQ ID NO: 577867 - DNA, 25 bp, Homo sapien
gtaagtttgaggaaatgtctattga

SEQ ID NO: 577868 - DNA, 25 bp, Homo sapien
tgtctattgaattagattcggcaac

SEQ ID NO: 577869 - DNA, 25 bp, Homo sapien
ctattgaattagattcggcaacaca

SEQ ID NO: 577870 - DNA, 25 bp, Homo sapien
aagccagtctcataaggacaaatat

SEQ ID NO: 577871 - DNA, 25 bp, Homo sapien
gcaaatattgctaagattctatcta

SEQ ID NO: 577872 - DNA, 25 bp, Homo sapien
attctatctatatgagctacctgtc

SEQ ID NO: 577873 - DNA, 25 bp, Homo sapien
tatgagctacctgtcaaactcacag

SEQ ID NO: 577874 - DNA, 25 bp, Homo sapien
gactcaggaagtagaatcacggtta

SEQ ID NO: 577875 - DNA, 25 bp, Homo sapien
gaatcacggttaacagaggcttggg

SEQ ID NO: 577876 - DNA, 25 bp, Homo sapien
aactgagagttggtgtttactgaat

SEQ ID NO: 577877 - DNA, 25 bp, Homo sapien
gtgatggcgatggttgcatagcaat

SEQ ID NO: 577878 - DNA, 25 bp, Homo sapien
tgcatagcaatgtcaaaccacttca

SEQ ID NO: 577879 - DNA, 25 bp, Homo sapien
aaccacttcacaatactgcactgta

SEQ ID NO: 577880 - DNA, 25 bp, Homo sapien
ttcacaatactgcactgtagagtta

SEQ ID NO: 577881 - DNA, 25 bp, Homo sapien
gagaaaggaatcttgccaaaagggc

SEQ ID NO: 577882 - DNA, 25 bp, Homo sapien
caaaagggcataaaggatcgaggat

SEQ ID NO: 577883 - DNA, 25 bp, Homo sapien
gatcgaggatgagccacaacacttt

SEQ ID NO: 577884 - DNA, 25 bp, Homo sapien
gagccacaacactttgctcacattg

SEQ ID NO: 577885 - DNA, 25 bp, Homo sapien
actttgctcacattgccctagggag

SEQ ID NO: 577886 - DNA, 25 bp, Homo sapien
tgccctagggagctgacctgttcag

SEQ ID NO: 577887 - DNA, 25 bp, Homo sapien
tgttcagcacccagtgatgacctct

SEQ ID NO: 577888 - DNA, 25 bp, Homo sapien
agtgatgacctctgcttgatgccag

SEQ ID NO: 577889 - DNA, 25 bp, Homo sapien
ccagccagcagcatgtagaggttca

SEQ ID NO: 577890 - DNA, 25 bp, Homo sapien
gaggcctccagcattctgctggaga

SEQ ID NO: 577891 - DNA, 25 bp, Homo sapien
gatgttgagggctgcattgaaatac

SEQ ID NO: 577892 - DNA, 25 bp, Homo sapien
gtcctctccatgtgccagatgcagc

SEQ ID NO: 577893 - DNA, 25 bp, Homo sapien
cagatgcagcccagcatgacactgc

SEQ ID NO: 577894 - DNA, 25 bp, Homo sapien
atgacactgccctcagctcaaaaac

SEQ ID NO: 577895 - DNA, 25 bp, Homo sapien
tgccctcagctcaaaaacagcacag

SEQ ID NO: 577896 - DNA, 25 bp, Homo sapien
caggaaaaaactgccagtgacttca

SEQ ID NO: 577897 - DNA, 25 bp, Homo sapien
gacttcaccaggatttgagaacggt

SEQ ID NO: 577898 - DNA, 25 bp, Homo sapien
gagaacggtccgtacgttcacacta

SEQ ID NO: 577899 - DNA, 25 bp, Homo sapien
gtacgttcacactaagctgagacag

SEQ ID NO: 577900 - DNA, 25 bp, Homo sapien
gagacagcgcaggttagaagatagc

SEQ ID NO: 577901 - DNA, 25 bp, Homo sapien
gtattcacacttcagatacgaccat

SEQ ID NO: 577902 - DNA, 25 bp, Homo sapien
agatacgaccatcacggccacatgg

SEQ ID NO: 577903 - DNA, 25 bp, Homo sapien
gaccccagtgtcttcagattgtgct

SEQ ID NO: 577904 - DNA, 25 bp, Homo sapien
aaaagcttaacactgctccattccc

SEQ ID NO: 577905 - DNA, 25 bp, Homo sapien
tgctccattcccgagagacagatag

SEQ ID NO: 577906 - DNA, 25 bp, Homo sapien
ccgagagacagatagggcttatttc

SEQ ID NO: 577907 - DNA, 25 bp, Homo sapien
tttcactggagcacacagaagcctg

SEQ ID NO: 577908 - DNA, 25 bp, Homo sapien
cacagaagcctgttgtggttcctgg

SEQ ID NO: 577909 - DNA, 25 bp, Homo sapien
tggttcctggcggtcagtgaaaaac

SEQ ID NO: 577910 - DNA, 25 bp, Homo sapien
cagtgaaaaacaaccactcccttct

SEQ ID NO: 577911 - DNA, 25 bp, Homo sapien
actcccttctgtccaagtgtgtgaa

SEQ ID NO: 577912 - DNA, 25 bp, Homo sapien
gtacaggaccgtataaaacaccacg

SEQ ID NO: 577913 - DNA, 25 bp, Homo sapien
taaaacaccacgacgggctctgaat

SEQ ID NO: 577914 - DNA, 25 bp, Homo sapien
ctattgagaaaatctggcatttgca

SEQ ID NO: 577915 - DNA, 25 bp, Homo sapien
aaaagggcagagtttaaatatgagc

SEQ ID NO: 577916 - DNA, 25 bp, Homo sapien
ctttccaatcaacaatacctctttt

SEQ ID NO: 577917 - DNA, 25 bp, Homo sapien
ccaatcaacaatacctcttttaaga

SEQ ID NO: 577918 - DNA, 25 bp, Homo sapien
gaaaaccaactaacagctgtttgca

SEQ ID NO: 577919 - DNA, 25 bp, Homo sapien
acaaaagttgttgctacttctcaga

SEQ ID NO: 577920 - DNA, 25 bp, Homo sapien
ttgagacacactgcatgctgtagac

SEQ ID NO: 577921 - DNA, 25 bp, Homo sapien
gtgtaactgttatcacatcttgctt

SEQ ID NO: 577922 - DNA, 25 bp, Homo sapien
aactgttatcacatcttgcttgaga

SEQ ID NO: 577923 - DNA, 25 bp, Homo sapien
atcttgcttgagatgtcattggcag

SEQ ID NO: 577924 - DNA, 25 bp, Homo sapien
ttgcttgagatgtcattggcagaat

SEQ ID NO: 577925 - DNA, 25 bp, Homo sapien
acctcccagagtgtctcccaggcta

SEQ ID NO: 577926 - DNA, 25 bp, Homo sapien
caggctagagtgaagatttcagctc

SEQ ID NO: 577927 - DNA, 25 bp, Homo sapien
gtgaagatttcagctcaatgcagcc

SEQ ID NO: 577928 - DNA, 25 bp, Homo sapien
tgggctcaagcgaaccttctggcct

SEQ ID NO: 577929 - DNA, 25 bp, Homo sapien
tactcaggctgtagaatcattttaa

SEQ ID NO: 577930 - DNA, 25 bp, Homo sapien
taatagctgcataatttccatgatg

SEQ ID NO: 577931 - DNA, 25 bp, Homo sapien
ataatttccatgatgcacaccgtgt

SEQ ID NO: 577932 - DNA, 25 bp, Homo sapien
atttccatgatgcacaccgtgttta

SEQ ID NO: 577933 - DNA, 25 bp, Homo sapien
ccatgatgcacaccgtgtttactaa

SEQ ID NO: 577934 - DNA, 25 bp, Homo sapien
tgcacaccgtgtttactaattataa

SEQ ID NO: 577935 - DNA, 25 bp, Homo sapien
taattataactcctatggttttgtc

SEQ ID NO: 577936 - DNA, 25 bp, Homo sapien
cctgtcctgccgtccgcgggtgtgt

SEQ ID NO: 577937 - DNA, 25 bp, Homo sapien
gggcacctctggaatctgaccctgt

SEQ ID NO: 577938 - DNA, 25 bp, Homo sapien
tggaatctgaccctgtgggccaaag

SEQ ID NO: 577939 - DNA, 25 bp, Homo sapien
atctgaccctgtgggccaaagaagc

SEQ ID NO: 577940 - DNA, 25 bp, Homo sapien
actgtagtttctgcagacccccatg

SEQ ID NO: 577941 - DNA, 25 bp, Homo sapien
ccccatgcggttcattgtgcattgt

SEQ ID NO: 577942 - DNA, 25 bp, Homo sapien
gcggttcattgtgcattgtttggtt

SEQ ID NO: 577943 - DNA, 25 bp, Homo sapien
aggatgtatgtgttgctagtttttt

SEQ ID NO: 577944 - DNA, 25 bp, Homo sapien
gaaaccctggattaatgtaaatagc

SEQ ID NO: 577945 - DNA, 25 bp, Homo sapien
gggaacggattctaatgtcacgtat

SEQ ID NO: 577946 - DNA, 25 bp, Homo sapien
ccgtgtggactatttcaaggtgctg

SEQ ID NO: 577947 - DNA, 25 bp, Homo sapien
agaagaatgttcacactgtttgcaa

SEQ ID NO: 577948 - DNA, 25 bp, Homo sapien
tgttcacactgtttgcaattatcct

SEQ ID NO: 577949 - DNA, 25 bp, Homo sapien
gcaattatcctatttttggtgatag

SEQ ID NO: 577950 - DNA, 25 bp, Homo sapien
ttggtgatagtgttgtgctggatat

SEQ ID NO: 577951 - DNA, 25 bp, Homo sapien
atgattgggcatataatgtgtgaga

SEQ ID NO: 577952 - DNA, 25 bp, Homo sapien
gatagtataattctgttagccccaa

SEQ ID NO: 577953 - DNA, 25 bp, Homo sapien
ctgttagccccaatatccttgagaa

SEQ ID NO: 577954 - DNA, 25 bp, Homo sapien
tagccccaatatccttgagaagtag

SEQ ID NO: 577955 - DNA, 25 bp, Homo sapien
gaagtaggatgttcaaacttaggag

SEQ ID NO: 577956 - DNA, 25 bp, Homo sapien
gatattgtatggcttaagtccgcaa

SEQ ID NO: 577957 - DNA, 25 bp, Homo sapien
cttaagtccgcaataaaaagcctgt

SEQ ID NO: 577958 - DNA, 25 bp, Homo sapien
ttcacctgagatcacaagcccatgg

SEQ ID NO: 577959 - DNA, 25 bp, Homo sapien
aagcccatggatgctgtgacatctg

SEQ ID NO: 577960 - DNA, 25 bp, Homo sapien
gtgacatctgggagcttcatcagtg

SEQ ID NO: 577961 - DNA, 25 bp, Homo sapien
ggagcttcatcagtggtctggctaa

SEQ ID NO: 577962 - DNA, 25 bp, Homo sapien
gtggtctggctaaagctgatacttt

SEQ ID NO: 577963 - DNA, 25 bp, Homo sapien
agctgatactttcacagtcaccatc

SEQ ID NO: 577964 - DNA, 25 bp, Homo sapien
agtcaccatcttcacctttggactg

SEQ ID NO: 577965 - DNA, 25 bp, Homo sapien
catttttcttctggcagatgactgt

SEQ ID NO: 577966 - DNA, 25 bp, Homo sapien
cagatgactgtattccttataggac

SEQ ID NO: 577967 - DNA, 25 bp, Homo sapien
taggacaggcaaggtttcattcatc

SEQ ID NO: 577968 - DNA, 25 bp, Homo sapien
aaggtttcattcatctgttctcagt

SEQ ID NO: 577969 - DNA, 25 bp, Homo sapien
agttgtccaatttcccatacagttt

SEQ ID NO: 577970 - DNA, 25 bp, Homo sapien
gtccaatttcccatacagttttgag

SEQ ID NO: 577971 - DNA, 25 bp, Homo sapien
tttcccatacagttttgaggcacat

SEQ ID NO: 577972 - DNA, 25 bp, Homo sapien
ttttgaggcacatggattcccttaa

SEQ ID NO: 577973 - DNA, 25 bp, Homo sapien
tgaggcacatggattcccttaaatc

SEQ ID NO: 577974 - DNA, 25 bp, Homo sapien
atggattcccttaaatccaactgta

SEQ ID NO: 577975 - DNA, 25 bp, Homo sapien
ttaaatccaactgtaaactccatga

SEQ ID NO: 577976 - DNA, 25 bp, Homo sapien
ctgtaaactccatgataacctgcta

SEQ ID NO: 577977 - DNA, 25 bp, Homo sapien
aaactccatgataacctgctacaaa

SEQ ID NO: 577978 - DNA, 25 bp, Homo sapien
acctgctacaaatagtgagtacttc

SEQ ID NO: 577979 - DNA, 25 bp, Homo sapien
gtgagtacttctagtacatttagta

SEQ ID NO: 577980 - DNA, 25 bp, Homo sapien
tgcaaaacctttgagactattgaga

SEQ ID NO: 577981 - DNA, 25 bp, Homo sapien
gcaaaacctttgagactattgagat

SEQ ID NO: 577982 - DNA, 25 bp, Homo sapien
aaacctttgagactattgagatatt

SEQ ID NO: 577983 - DNA, 25 bp, Homo sapien
ataattttcaaattctactgaacac

SEQ ID NO: 577984 - DNA, 25 bp, Homo sapien
tttcaaattctactgaacacttcaa

SEQ ID NO: 577985 - DNA, 25 bp, Homo sapien
aaattctactgaacacttcaatagt

SEQ ID NO: 577986 - DNA, 25 bp, Homo sapien
tctactgaacacttcaatagtcctt

SEQ ID NO: 577987 - DNA, 25 bp, Homo sapien
ctactgaacacttcaatagtcctta

SEQ ID NO: 577988 - DNA, 25 bp, Homo sapien
tgaacacttcaatagtccttataaa

SEQ ID NO: 577989 - DNA, 25 bp, Homo sapien
gaacacttcaatagtccttataaat

SEQ ID NO: 577990 - DNA, 25 bp, Homo sapien
cacttcaatagtccttataaatgtc

SEQ ID NO: 577991 - DNA, 25 bp, Homo sapien
tacgccacctttgtcaagatgctgc

SEQ ID NO: 577992 - DNA, 25 bp, Homo sapien
acctttgtcaagatgctgccagata

SEQ ID NO: 577993 - DNA, 25 bp, Homo sapien
gccagataaggactgccgctatgcc

SEQ ID NO: 577994 - DNA, 25 bp, Homo sapien
gctatgccctctatgatgcaaccta

SEQ ID NO: 577995 - DNA, 25 bp, Homo sapien
ctatgatgcaacctatgagaccaag

SEQ ID NO: 577996 - DNA, 25 bp, Homo sapien
gatctggtgtttatcttctgggccc

SEQ ID NO: 577997 - DNA, 25 bp, Homo sapien
gagtctgcgccccttaagagcaaaa

SEQ ID NO: 577998 - DNA, 25 bp, Homo sapien
tgatttatgccagctccaaggacgc

SEQ ID NO: 577999 - DNA, 25 bp, Homo sapien
gaagctgacagggatcaagcatgaa

SEQ ID NO: 578000 - DNA, 25 bp, Homo sapien
caagcaaactgctacgaggaggtca

SEQ ID NO: 578001 - DNA, 25 bp, Homo sapien
catctccctggagggcaagcctttg

SEQ ID NO: 578002 - DNA, 25 bp, Homo sapien
cttctgggaccacattttacgacca

SEQ ID NO: 578003 - DNA, 25 bp, Homo sapien
gggaccacattttacgaccacctag

SEQ ID NO: 578004 - DNA, 25 bp, Homo sapien
acattttacgaccacctagctgagt

SEQ ID NO: 578005 - DNA, 25 bp, Homo sapien
ttttacgaccacctagctgagtgat

SEQ ID NO: 578006 - DNA, 25 bp, Homo sapien
tacgaccacctagctgagtgataaa

SEQ ID NO: 578007 - DNA, 25 bp, Homo sapien
gaccacctagctgagtgataaatca

SEQ ID NO: 578008 - DNA, 25 bp, Homo sapien
gtaagtttgaggaaatgtctattga

SEQ ID NO: 578009 - DNA, 25 bp, Homo sapien
gtctattgaattagattcggcaaca

SEQ ID NO: 578010 - DNA, 25 bp, Homo sapien
tagattcggcaacacaccagtgcaa

SEQ ID NO: 578011 - DNA, 25 bp, Homo sapien
gaagccatgcaatgccagtgactct

SEQ ID NO: 578012 - DNA, 25 bp, Homo sapien
atgcaatgccagtgactctcagtgt

SEQ ID NO: 578013 - DNA, 25 bp, Homo sapien
gatggaagccaagactgttgatacc

SEQ ID NO: 578014 - DNA, 25 bp, Homo sapien
gaagccaagactgttgataccagtt

SEQ ID NO: 578015 - DNA, 25 bp, Homo sapien
agactgttgataccagttggagagc

SEQ ID NO: 578016 - DNA, 25 bp, Homo sapien
agaactacccgcagccactgaaagc

SEQ ID NO: 578017 - DNA, 25 bp, Homo sapien
tacccgcagccactgaaagctagga

SEQ ID NO: 578018 - DNA, 25 bp, Homo sapien
aaagctaggagagaggcataggact

SEQ ID NO: 578019 - DNA, 25 bp, Homo sapien
aaacctgcccgtgccttgatttcag

SEQ ID NO: 578020 - DNA, 25 bp, Homo sapien
cctgcccgtgccttgatttcagact

SEQ ID NO: 578021 - DNA, 25 bp, Homo sapien
actttgtttttagcaagcaactttg

SEQ ID NO: 578022 - DNA, 25 bp, Homo sapien
gtttttagcaagcaactttgcagtg

SEQ ID NO: 578023 - DNA, 25 bp, Homo sapien
caagcaactttgcagtgtaattaag

SEQ ID NO: 578024 - DNA, 25 bp, Homo sapien
gaggagtatgctctgcttacagcaa

SEQ ID NO: 578025 - DNA, 25 bp, Homo sapien
cagcaattgttatcctgtctccaga

SEQ ID NO: 578026 - DNA, 25 bp, Homo sapien
gaagcttcaggagccacttcttgat

SEQ ID NO: 578027 - DNA, 25 bp, Homo sapien
ggagccacttcttgatgtgctacaa

SEQ ID NO: 578028 - DNA, 25 bp, Homo sapien
gttgtgtaagattcaccagcctgaa

SEQ ID NO: 578029 - DNA, 25 bp, Homo sapien
tgaaaatcctcaacactttgcctgt

SEQ ID NO: 578030 - DNA, 25 bp, Homo sapien
tgtctcctgggtcgcctgactgaat

SEQ ID NO: 578031 - DNA, 25 bp, Homo sapien
ggtcgcctgactgaattacggacat

SEQ ID NO: 578032 - DNA, 25 bp, Homo sapien
ttacggacattcaatcatcaccacg

SEQ ID NO: 578033 - DNA, 25 bp, Homo sapien
tcaccacgctgagatgctgatgtca

SEQ ID NO: 578034 - DNA, 25 bp, Homo sapien
tgtcatggagagtaaacgaccacaa

SEQ ID NO: 578035 - DNA, 25 bp, Homo sapien
ggagctgctgtctttggctgttcaa

SEQ ID NO: 578036 - DNA, 25 bp, Homo sapien
tgctgtctttggctgttcaaataca

SEQ ID NO: 578037 - DNA, 25 bp, Homo sapien
aatacagccagactttgccgctgcg

SEQ ID NO: 578038 - DNA, 25 bp, Homo sapien
gccgctgcgtggatgaatctaggca

SEQ ID NO: 578039 - DNA, 25 bp, Homo sapien
cagaatagcctgaaacggtttgaag

SEQ ID NO: 578040 - DNA, 25 bp, Homo sapien
gcagcagagcaaagttaccggacag

SEQ ID NO: 578041 - DNA, 25 bp, Homo sapien
gttaccggacagcaattaaacacag

SEQ ID NO: 578042 - DNA, 25 bp, Homo sapien
atacccagactgttactacaacctc

SEQ ID NO: 578043 - DNA, 25 bp, Homo sapien
agactgttactacaacctcgggcgt

SEQ ID NO: 578044 - DNA, 25 bp, Homo sapien
tgttactacaacctcgggcgtctgg

SEQ ID NO: 578045 - DNA, 25 bp, Homo sapien
acaacctcgggcgtctggtaagcgc

SEQ ID NO: 578046 - DNA, 25 bp, Homo sapien
caaaaacccgtgagtcattgtgaca

SEQ ID NO: 578047 - DNA, 25 bp, Homo sapien
taaaggtgctaccatgccaaaccat

SEQ ID NO: 578048 - DNA, 25 bp, Homo sapien
gccaaaccatactgctcagctacag

SEQ ID NO: 578049 - DNA, 25 bp, Homo sapien
gccactttcttttgccaggcaggca

SEQ ID NO: 578050 - DNA, 25 bp, Homo sapien
tgccaggcaggcatgaagaggacca

SEQ ID NO: 578051 - DNA, 25 bp, Homo sapien
gaaaggcacggtacaggcctgcata

SEQ ID NO: 578052 - DNA, 25 bp, Homo sapien
ggtacaggcctgcataatattacag

SEQ ID NO: 578053 - DNA, 25 bp, Homo sapien
atatttctcttccttattatgggtt

SEQ ID NO: 578054 - DNA, 25 bp, Homo sapien
gacaagggcttaaaaactggtggct

SEQ ID NO: 578055 - DNA, 25 bp, Homo sapien
actggtggcttaatgtcctgctatg

SEQ ID NO: 578056 - DNA, 25 bp, Homo sapien
aatgtcctgctatgactcacagata

SEQ ID NO: 578057 - DNA, 25 bp, Homo sapien
gattaagctattctgttccagtcct

SEQ ID NO: 578058 - DNA, 25 bp, Homo sapien
attctgttccagtcctcagagaaat

SEQ ID NO: 578059 - DNA, 25 bp, Homo sapien
cagtcctcagagaaataatcacttt

SEQ ID NO: 578060 - DNA, 25 bp, Homo sapien
gaaataatcactttcttaaactttg

SEQ ID NO: 578061 - DNA, 25 bp, Homo sapien
gagtttgtcctgttcgggtgaagtt

SEQ ID NO: 578062 - DNA, 25 bp, Homo sapien
gtcctgttcgggtgaagttacagta

SEQ ID NO: 578063 - DNA, 25 bp, Homo sapien
ttgtgtttgctcacaacagagctac

SEQ ID NO: 578064 - DNA, 25 bp, Homo sapien
aaatgcgtttttgctttagtgcatt

SEQ ID NO: 578065 - DNA, 25 bp, Homo sapien
gctttagtgcattgtgtgtgcaagc

SEQ ID NO: 578066 - DNA, 25 bp, Homo sapien
gtgcaagcatgaagtagaaacactt

SEQ ID NO: 578067 - DNA, 25 bp, Homo sapien
tttttctgggtacagtacatgggta

SEQ ID NO: 578068 - DNA, 25 bp, Homo sapien
gagcgaggtcctgtctcaagaaaca

SEQ ID NO: 578069 - DNA, 25 bp, Homo sapien
acaaaaaccatgtttgggaatacat

SEQ ID NO: 578070 - DNA, 25 bp, Homo sapien
aaccatgtttgggaatacatgtgaa

SEQ ID NO: 578071 - DNA, 25 bp, Homo sapien
gtttgggaatacatgtgaagagcga

SEQ ID NO: 578072 - DNA, 25 bp, Homo sapien
gaatacatgtgaagagcgagggctc

SEQ ID NO: 578073 - DNA, 25 bp, Homo sapien
aatacatgtgaagagcgagggctct

SEQ ID NO: 578074 - DNA, 25 bp, Homo sapien
tacatgtgaagagcgagggctctgc

SEQ ID NO: 578075 - DNA, 25 bp, Homo sapien
catgtgaagagcgagggctctgcca

SEQ ID NO: 578076 - DNA, 25 bp, Homo sapien
atgtgaagagcgagggctctgccaa

SEQ ID NO: 578077 - DNA, 25 bp, Homo sapien
tgtgaagagcgagggctctgccaat

SEQ ID NO: 578078 - DNA, 25 bp, Homo sapien
aagagcgagggctctgccaatcatt

SEQ ID NO: 578079 - DNA, 25 bp, Homo sapien
aattaaggttacacgaagtcacagt

SEQ ID NO: 578080 - DNA, 25 bp, Homo sapien
ttaaggttacacgaagtcacagtgg

SEQ ID NO: 578081 - DNA, 25 bp, Homo sapien
gtcacagtggagaatctgatctgct

SEQ ID NO: 578082 - DNA, 25 bp, Homo sapien
aatctgatctgctaagactggtgtc

SEQ ID NO: 578083 - DNA, 25 bp, Homo sapien
actggtgtccttatagggagagacc

SEQ ID NO: 578084 - DNA, 25 bp, Homo sapien
ttcctccctgtgcacacaaacaaga

SEQ ID NO: 578085 - DNA, 25 bp, Homo sapien
gaggagaagcctcacaatgaacccc

SEQ ID NO: 578086 - DNA, 25 bp, Homo sapien
accctgctggcacctatgtcttcga

SEQ ID NO: 578087 - DNA, 25 bp, Homo sapien
tgctggcacctatgtcttcgacttc

SEQ ID NO: 578088 - DNA, 25 bp, Homo sapien
tggcacctatgtcttcgacttccag

SEQ ID NO: 578089 - DNA, 25 bp, Homo sapien
ggcacctatgtcttcgacttccagc

SEQ ID NO: 578090 - DNA, 25 bp, Homo sapien
atttgtatgttcaagacctcactct

SEQ ID NO: 578091 - DNA, 25 bp, Homo sapien
gacctcactctaatgtggctgtatt

SEQ ID NO: 578092 - DNA, 25 bp, Homo sapien
gggcctctaaggaagtaactaagat

SEQ ID NO: 578093 - DNA, 25 bp, Homo sapien
ggcactgattcaacaggattagtgt

SEQ ID NO: 578094 - DNA, 25 bp, Homo sapien
gattagtgttcttatgaggacagac

SEQ ID NO: 578095 - DNA, 25 bp, Homo sapien
gaggacagacaccagagttctccct

SEQ ID NO: 578096 - DNA, 25 bp, Homo sapien
ttcccacacgcatgcactgaggaaa

SEQ ID NO: 578097 - DNA, 25 bp, Homo sapien
acagcaaggaggctgccgtccacaa

SEQ ID NO: 578098 - DNA, 25 bp, Homo sapien
ggctgccgtccacaagctgagaaga

SEQ ID NO: 578099 - DNA, 25 bp, Homo sapien
aagagagccctcacaagagatggaa

SEQ ID NO: 578100 - DNA, 25 bp, Homo sapien
gagatggaattgactggagcctcag

SEQ ID NO: 578101 - DNA, 25 bp, Homo sapien
tgctgatttctctttaagtgggtcc

SEQ ID NO: 578102 - DNA, 25 bp, Homo sapien
gatttctctttaagtgggtcctatt

SEQ ID NO: 578103 - DNA, 25 bp, Homo sapien
ctctttaagtgggtcctatttgcat

SEQ ID NO: 578104 - DNA, 25 bp, Homo sapien
taagtgggtcctatttgcataacga

SEQ ID NO: 578105 - DNA, 25 bp, Homo sapien
gtgggtcctatttgcataacgagag

SEQ ID NO: 578106 - DNA, 25 bp, Homo sapien
ggtcctatttgcataacgagagagt

SEQ ID NO: 578107 - DNA, 25 bp, Homo sapien
cctatttgcataacgagagagtggg

SEQ ID NO: 578108 - DNA, 25 bp, Homo sapien
aatgcttatgcccaaggagagttct

SEQ ID NO: 578109 - DNA, 25 bp, Homo sapien
gcttatgcccaaggagagttctgga

SEQ ID NO: 578110 - DNA, 25 bp, Homo sapien
caaggagagttctggagggttcaaa

SEQ ID NO: 578111 - DNA, 25 bp, Homo sapien
agttctggagggttcaaaggatgaa

SEQ ID NO: 578112 - DNA, 25 bp, Homo sapien
cacactgtcagggaaatgtatgtct

SEQ ID NO: 578113 - DNA, 25 bp, Homo sapien
gaaatgtatgtctccttaggcttaa

SEQ ID NO: 578114 - DNA, 25 bp, Homo sapien
gtatgtctccttaggcttaaaagca

SEQ ID NO: 578115 - DNA, 25 bp, Homo sapien
tttttcattgctcacgacacggagc

SEQ ID NO: 578116 - DNA, 25 bp, Homo sapien
accatggcctgtgttcttttaagtc

SEQ ID NO: 578117 - DNA, 25 bp, Homo sapien
ggcctgtgttcttttaagtcatgta

SEQ ID NO: 578118 - DNA, 25 bp, Homo sapien
gtaaaactagtttctgctgagaaca

SEQ ID NO: 578119 - DNA, 25 bp, Homo sapien
caaatgtttcaccttgtgctgagga

SEQ ID NO: 578120 - DNA, 25 bp, Homo sapien
tgtgctgaggaatttggaactaatc

SEQ ID NO: 578121 - DNA, 25 bp, Homo sapien
ggaactaatcttctcagatcggtgt

SEQ ID NO: 578122 - DNA, 25 bp, Homo sapien
atcttctcagatcggtgttgctgga

SEQ ID NO: 578123 - DNA, 25 bp, Homo sapien
agtgttctctcttaaatgtgtttca

SEQ ID NO: 578124 - DNA, 25 bp, Homo sapien
tgttctctcttaaatgtgtttcaat

SEQ ID NO: 578125 - DNA, 25 bp, Homo sapien
gtgtttcaatatggtggacatttat

SEQ ID NO: 578126 - DNA, 25 bp, Homo sapien
attgagcacttgtgttgggcgtttc

SEQ ID NO: 578127 - DNA, 25 bp, Homo sapien
gagcacttgtgttgggcgtttcaac

SEQ ID NO: 578128 - DNA, 25 bp, Homo sapien
cttgtgttgggcgtttcaacaggag

SEQ ID NO: 578129 - DNA, 25 bp, Homo sapien
actggtacgaaaagtagcttgttct

SEQ ID NO: 578130 - DNA, 25 bp, Homo sapien
agtagcttgttctagttcatatatc

SEQ ID NO: 578131 - DNA, 25 bp, Homo sapien
gttctagttcatatatcatttgcac

SEQ ID NO: 578132 - DNA, 25 bp, Homo sapien
gttcatatatcatttgcactttgct

SEQ ID NO: 578133 - DNA, 25 bp, Homo sapien
tttgcactttgcttaacttgtataa

SEQ ID NO: 578134 - DNA, 25 bp, Homo sapien
ctgtcattcccccaggtataggaag

SEQ ID NO: 578135 - DNA, 25 bp, Homo sapien
ccccaggtataggaaggtacactgt

SEQ ID NO: 578136 - DNA, 25 bp, Homo sapien
ggtataggaaggtacactgtgtctt

SEQ ID NO: 578137 - DNA, 25 bp, Homo sapien
gaaggtacactgtgtcttccgattc

SEQ ID NO: 578138 - DNA, 25 bp, Homo sapien
aggtacactgtgtcttccgattctt

SEQ ID NO: 578139 - DNA, 25 bp, Homo sapien
ggtacactgtgtcttccgattcttg

SEQ ID NO: 578140 - DNA, 25 bp, Homo sapien
tacactgtgtcttccgattcttgga

SEQ ID NO: 578141 - DNA, 25 bp, Homo sapien
acactgtgtcttccgattcttggag

SEQ ID NO: 578142 - DNA, 25 bp, Homo sapien
actgtgtcttccgattcttggagcc

SEQ ID NO: 578143 - DNA, 25 bp, Homo sapien
tgtgtcttccgattcttggagccag

SEQ ID NO: 578144 - DNA, 25 bp, Homo sapien
agctctgctgtccagacctcctgaa

SEQ ID NO: 578145 - DNA, 25 bp, Homo sapien
agtccctgtgcttgtcagagtcatt

SEQ ID NO: 578146 - DNA, 25 bp, Homo sapien
tgtgcttgtcagagtcattattatg

SEQ ID NO: 578147 - DNA, 25 bp, Homo sapien
gattaatatcaattacgatgccaaa

SEQ ID NO: 578148 - DNA, 25 bp, Homo sapien
aattacgatgccaaaaattgctggg

SEQ ID NO: 578149 - DNA, 25 bp, Homo sapien
tgctgggcaaactttgaagacctca

SEQ ID NO: 578150 - DNA, 25 bp, Homo sapien
gaagacctcaacttgttacaatgac

SEQ ID NO: 578151 - DNA, 25 bp, Homo sapien
caacttgttacaatgacgatgatga

SEQ ID NO: 578152 - DNA, 25 bp, Homo sapien
gattcttggcggttacacaatcctt

SEQ ID NO: 578153 - DNA, 25 bp, Homo sapien
tcttggcggttacacaatccttcct

SEQ ID NO: 578154 - DNA, 25 bp, Homo sapien
gaggcagctaggaggcccagcaggg

SEQ ID NO: 578155 - DNA, 25 bp, Homo sapien
ggtagtctgtgccaactccaggcag

SEQ ID NO: 578156 - DNA, 25 bp, Homo sapien
atcagttcagagagcgattagattg

SEQ ID NO: 578157 - DNA, 25 bp, Homo sapien
agcgattagattggactgtgtgttt

SEQ ID NO: 578158 - DNA, 25 bp, Homo sapien
gaggaatccacagaggtgaagcatc

SEQ ID NO: 578159 - DNA, 25 bp, Homo sapien
aatccacagaggtgaagcatcaggg

SEQ ID NO: 578160 - DNA, 25 bp, Homo sapien
gggcacttgctgtcagtgcagcctg

SEQ ID NO: 578161 - DNA, 25 bp, Homo sapien
gctcctggctgaggtcgtgcttgct

SEQ ID NO: 578162 - DNA, 25 bp, Homo sapien
tgaggtcgtgcttgctgggtctcca

SEQ ID NO: 578163 - DNA, 25 bp, Homo sapien
tgggtctccactggaagctgctctt

SEQ ID NO: 578164 - DNA, 25 bp, Homo sapien
ccatgcacaccacagcctttatgtt

SEQ ID NO: 578165 - DNA, 25 bp, Homo sapien
accacagcctttatgttcctttgtt

SEQ ID NO: 578166 - DNA, 25 bp, Homo sapien
cacagcctttatgttcctttgttga

SEQ ID NO: 578167 - DNA, 25 bp, Homo sapien
aagactcctgcatgtgctgtgtttt

SEQ ID NO: 578168 - DNA, 25 bp, Homo sapien
tgttttaggaatattcaccccagca

SEQ ID NO: 578169 - DNA, 25 bp, Homo sapien
aatcttcttaatatagctggacatg

SEQ ID NO: 578170 - DNA, 25 bp, Homo sapien
tcttcttaatatagctggacatggt

SEQ ID NO: 578171 - DNA, 25 bp, Homo sapien
tggtgcatgcttgtatttcccacta

SEQ ID NO: 578172 - DNA, 25 bp, Homo sapien
ggtgcatgcttgtatttcccactac

SEQ ID NO: 578173 - DNA, 25 bp, Homo sapien
tgcatgcttgtatttcccactactt

SEQ ID NO: 578174 - DNA, 25 bp, Homo sapien
gcatgcttgtatttcccactacttg

SEQ ID NO: 578175 - DNA, 25 bp, Homo sapien
atgcttgtatttcccactacttggg

SEQ ID NO: 578176 - DNA, 25 bp, Homo sapien
tgagctatgatggtatcactatact

SEQ ID NO: 578177 - DNA, 25 bp, Homo sapien
gctatgatggtatcactatactaac

SEQ ID NO: 578178 - DNA, 25 bp, Homo sapien
tctgagcgcaggaagacgcagaaca

SEQ ID NO: 578179 - DNA, 25 bp, Homo sapien
agaacaacagaaatagccgcccctc

SEQ ID NO: 578180 - DNA, 25 bp, Homo sapien
gtgcctgttggcctatcatagatct

SEQ ID NO: 578181 - DNA, 25 bp, Homo sapien
cctgttggcctatcatagatctcta

SEQ ID NO: 578182 - DNA, 25 bp, Homo sapien
ttccactgattactctctctgacga

SEQ ID NO: 578183 - DNA, 25 bp, Homo sapien
attactctctctgacgagtccatca

SEQ ID NO: 578184 - DNA, 25 bp, Homo sapien
gagtccatcacctgcaacttaaatg

SEQ ID NO: 578185 - DNA, 25 bp, Homo sapien
gaacaagcttacatcccattttgag

SEQ ID NO: 578186 - DNA, 25 bp, Homo sapien
aagcttacatcccattttgagtgaa

SEQ ID NO: 578187 - DNA, 25 bp, Homo sapien
tcccattttgagtgaagattttgag

SEQ ID NO: 578188 - DNA, 25 bp, Homo sapien
acacctgttcatttctacttaaatt

SEQ ID NO: 578189 - DNA, 25 bp, Homo sapien
ggctctgaggacagttgggaatctt

SEQ ID NO: 578190 - DNA, 25 bp, Homo sapien
ggaatcttccctgaggcaggttcaa

SEQ ID NO: 578191 - DNA, 25 bp, Homo sapien
gcaggttcaaggacagagctctgac

SEQ ID NO: 578192 - DNA, 25 bp, Homo sapien
gcccagggctgctttgggtgcctat

SEQ ID NO: 578193 - DNA, 25 bp, Homo sapien
gctgctttgggtgcctatgaactcg

SEQ ID NO: 578194 - DNA, 25 bp, Homo sapien
ctatgaactcggcttctggctcaga

SEQ ID NO: 578195 - DNA, 25 bp, Homo sapien
ttctggctcagagcagttccctgca

SEQ ID NO: 578196 - DNA, 25 bp, Homo sapien
tctgtcctctggaacccgtgggcag

SEQ ID NO: 578197 - DNA, 25 bp, Homo sapien
acgctggcttgctgagcttagggca

SEQ ID NO: 578198 - DNA, 25 bp, Homo sapien
ttgctgagcttagggcagaccccga

SEQ ID NO: 578199 - DNA, 25 bp, Homo sapien
gcagaccccgacttcagaatttata

SEQ ID NO: 578200 - DNA, 25 bp, Homo sapien
acgtcccgcagagccacggctgcgc

SEQ ID NO: 578201 - DNA, 25 bp, Homo sapien
gtcccgcagagccacggctgcgccc

SEQ ID NO: 578202 - DNA, 25 bp, Homo sapien
tcccgcagagccacggctgcgcccc

SEQ ID NO: 578203 - DNA, 25 bp, Homo sapien
cccgcagagccacggctgcgccccc

SEQ ID NO: 578204 - DNA, 25 bp, Homo sapien
gcagagccacggctgcgcccccacc

SEQ ID NO: 578205 - DNA, 25 bp, Homo sapien
ttcaccacgccctccgcatgctgca

SEQ ID NO: 578206 - DNA, 25 bp, Homo sapien
tcaccacgccctccgcatgctgcag

SEQ ID NO: 578207 - DNA, 25 bp, Homo sapien
caccacgccctccgcatgctgcaga

SEQ ID NO: 578208 - DNA, 25 bp, Homo sapien
accacgccctccgcatgctgcagag

SEQ ID NO: 578209 - DNA, 25 bp, Homo sapien
ccacgccctccgcatgctgcagagt

SEQ ID NO: 578210 - DNA, 25 bp, Homo sapien
cacgccctccgcatgctgcagagta

SEQ ID NO: 578211 - DNA, 25 bp, Homo sapien
tgaaatgtgcccatcgagtcctagc

SEQ ID NO: 578212 - DNA, 25 bp, Homo sapien
atcgagtcctagcaccttttaccat

SEQ ID NO: 578213 - DNA, 25 bp, Homo sapien
aaatgtgctttgaagtcctctcacc

SEQ ID NO: 578214 - DNA, 25 bp, Homo sapien
atgtgctttgaagtcctctcaccct

SEQ ID NO: 578215 - DNA, 25 bp, Homo sapien
tgctttgaagtcctctcaccctgag

SEQ ID NO: 578216 - DNA, 25 bp, Homo sapien
tttgaagtcctctcaccctgaggct

SEQ ID NO: 578217 - DNA, 25 bp, Homo sapien
gaagtcctctcaccctgaggcttgc

SEQ ID NO: 578218 - DNA, 25 bp, Homo sapien
ttgcccgccttctgctggtgaaaga

SEQ ID NO: 578219 - DNA, 25 bp, Homo sapien
tgcccgccttctgctggtgaaagaa

SEQ ID NO: 578220 - DNA, 25 bp, Homo sapien
gcccgccttctgctggtgaaagaag

SEQ ID NO: 578221 - DNA, 25 bp, Homo sapien
ccgccttctgctggtgaaagaagct

SEQ ID NO: 578222 - DNA, 25 bp, Homo sapien
tcttaaaaaataccaaagcaggccg

SEQ ID NO: 578223 - DNA, 25 bp, Homo sapien
aaaataccaaagcaggccgggcgcg

SEQ ID NO: 578224 - DNA, 25 bp, Homo sapien
aaataccaaagcaggccgggcgcgg

SEQ ID NO: 578225 - DNA, 25 bp, Homo sapien
aataccaaagcaggccgggcgcggt

SEQ ID NO: 578226 - DNA, 25 bp, Homo sapien
ataccaaagcaggccgggcgcggtc

SEQ ID NO: 578227 - DNA, 25 bp, Homo sapien
taccaaagcaggccgggcgcggtct

SEQ ID NO: 578228 - DNA, 25 bp, Homo sapien
accaaagcaggccgggcgcggtctc

SEQ ID NO: 578229 - DNA, 25 bp, Homo sapien
ccaaagcaggccgggcgcggtctca

SEQ ID NO: 578230 - DNA, 25 bp, Homo sapien
caaagcaggccgggcgcggtctcac

SEQ ID NO: 578231 - DNA, 25 bp, Homo sapien
aaagcaggccgggcgcggtctcacg

SEQ ID NO: 578232 - DNA, 25 bp, Homo sapien
aagcaggccgggcgcggtctcacgc

SEQ ID NO: 578233 - DNA, 25 bp, Homo sapien
tggcatgcgagtagggctcaagcac

SEQ ID NO: 578234 - DNA, 25 bp, Homo sapien
ggcatgcgagtagggctcaagcacc

SEQ ID NO: 578235 - DNA, 25 bp, Homo sapien
gcatgcgagtagggctcaagcacct

SEQ ID NO: 578236 - DNA, 25 bp, Homo sapien
ggaaccaaatgccttacttgacagg

SEQ ID NO: 578237 - DNA, 25 bp, Homo sapien
gaaccaaatgccttacttgacagga

SEQ ID NO: 578238 - DNA, 25 bp, Homo sapien
aaccaaatgccttacttgacaggat

SEQ ID NO: 578239 - DNA, 25 bp, Homo sapien
accaaatgccttacttgacaggatc

SEQ ID NO: 578240 - DNA, 25 bp, Homo sapien
caaatgccttacttgacaggatcac

SEQ ID NO: 578241 - DNA, 25 bp, Homo sapien
aaatgccttacttgacaggatcaca

SEQ ID NO: 578242 - DNA, 25 bp, Homo sapien
aatgccttacttgacaggatcacag

SEQ ID NO: 578243 - DNA, 25 bp, Homo sapien
atgccttacttgacaggatcacaga

SEQ ID NO: 578244 - DNA, 25 bp, Homo sapien
ctaattcctgctcatttccttagag

SEQ ID NO: 578245 - DNA, 25 bp, Homo sapien
gggagggacacaaatgaaactttag

SEQ ID NO: 578246 - DNA, 25 bp, Homo sapien
ttagagttttgcagagacatctgag

SEQ ID NO: 578247 - DNA, 25 bp, Homo sapien
gagacatctgagtggcaaaatggta

SEQ ID NO: 578248 - DNA, 25 bp, Homo sapien
gtggcaaaatggtaacaactttcac

SEQ ID NO: 578249 - DNA, 25 bp, Homo sapien
gagatgcctaagtggaagtcagtgt

SEQ ID NO: 578250 - DNA, 25 bp, Homo sapien
agtcagtgtagctcttccaaacttc

SEQ ID NO: 578251 - DNA, 25 bp, Homo sapien
gtgtagctcttccaaacttcaagaa

SEQ ID NO: 578252 - DNA, 25 bp, Homo sapien
cttccaaacttcaagaacggcactt

SEQ ID NO: 578253 - DNA, 25 bp, Homo sapien
cttcaagaacggcacttggagaaaa

SEQ ID NO: 578254 - DNA, 25 bp, Homo sapien
accatgtggtttctgttaataagat

SEQ ID NO: 578255 - DNA, 25 bp, Homo sapien
tccttcccaaactcaaacaaggtgt

SEQ ID NO: 578256 - DNA, 25 bp, Homo sapien
tcccaaactcaaacaaggtgttcct

SEQ ID NO: 578257 - DNA, 25 bp, Homo sapien
gtgttcctaaaattggaccaccatg

SEQ ID NO: 578258 - DNA, 25 bp, Homo sapien
ttcctaaaattggaccaccatggag

SEQ ID NO: 578259 - DNA, 25 bp, Homo sapien
aactgatgaggttaggaaatgcccc

SEQ ID NO: 578260 - DNA, 25 bp, Homo sapien
ggaaatgccccccacaaagtaatgg

SEQ ID NO: 578261 - DNA, 25 bp, Homo sapien
gtaatggcttctggagggactgctc

SEQ ID NO: 578262 - DNA, 25 bp, Homo sapien
aatggcttctggagggactgctcag

SEQ ID NO: 578263 - DNA, 25 bp, Homo sapien
gcttctggagggactgctcagtctg

SEQ ID NO: 578264 - DNA, 25 bp, Homo sapien
gggccactgtatgcagctgggactt

SEQ ID NO: 578265 - DNA, 25 bp, Homo sapien
ggccactgtatgcagctgggacttt

SEQ ID NO: 578266 - DNA, 25 bp, Homo sapien
tctaaccctctcctcccattttaca

SEQ ID NO: 578267 - DNA, 25 bp, Homo sapien
ggcgtctgggttactccgtgggtct

SEQ ID NO: 578268 - DNA, 25 bp, Homo sapien
cgtctgggttactccgtgggtctgg

SEQ ID NO: 578269 - DNA, 25 bp, Homo sapien
gggacggtgtctggctctacccctg

SEQ ID NO: 578270 - DNA, 25 bp, Homo sapien
acggtgtctggctctacccctgtgg

SEQ ID NO: 578271 - DNA, 25 bp, Homo sapien
gggctcccctgtatcacaggacatc

SEQ ID NO: 578272 - DNA, 25 bp, Homo sapien
aactgcgcaatgtagttaggtgctc

SEQ ID NO: 578273 - DNA, 25 bp, Homo sapien
actgcgcaatgtagttaggtgctca

SEQ ID NO: 578274 - DNA, 25 bp, Homo sapien
ctgcgcaatgtagttaggtgctcaa

SEQ ID NO: 578275 - DNA, 25 bp, Homo sapien
tgcgcaatgtagttaggtgctcaat

SEQ ID NO: 578276 - DNA, 25 bp, Homo sapien
gcgcaatgtagttaggtgctcaata

SEQ ID NO: 578277 - DNA, 25 bp, Homo sapien
aaaagccacatattcttggtgatat

SEQ ID NO: 578278 - DNA, 25 bp, Homo sapien
agaaggaaactactattctcctaat

SEQ ID NO: 578279 - DNA, 25 bp, Homo sapien
gaaattggactagaaagctctactg

SEQ ID NO: 578280 - DNA, 25 bp, Homo sapien
gtgtgggcatcaacattgccaagag

SEQ ID NO: 578281 - DNA, 25 bp, Homo sapien
gatgagaagctcaaggatctgtgta

SEQ ID NO: 578282 - DNA, 25 bp, Homo sapien
gatctgtgtaatgatttcccaagcc

SEQ ID NO: 578283 - DNA, 25 bp, Homo sapien
atgatttcccaagccatttggaatg

SEQ ID NO: 578284 - DNA, 25 bp, Homo sapien
catttggaatgtacttcagggtcta

SEQ ID NO: 578285 - DNA, 25 bp, Homo sapien
gatggcttctggagatagctcaacc

SEQ ID NO: 578286 - DNA, 25 bp, Homo sapien
ggagatagctcaaccgaacaagtaa

SEQ ID NO: 578287 - DNA, 25 bp, Homo sapien
gaaccatgtgagaataatcccatac

SEQ ID NO: 578288 - DNA, 25 bp, Homo sapien
aaaggagcagcacaggcccagaacc

SEQ ID NO: 578289 - DNA, 25 bp, Homo sapien
ctccgctccttgctgagcgacatgg

SEQ ID NO: 578290 - DNA, 25 bp, Homo sapien
ttgctgagcgacatggcggctcccc

SEQ ID NO: 578291 - DNA, 25 bp, Homo sapien
tacgaaacagcctagcagcccttat

SEQ ID NO: 578292 - DNA, 25 bp, Homo sapien
gaaacagcctagcagcccttatgaa

SEQ ID NO: 578293 - DNA, 25 bp, Homo sapien
aacagcctagcagcccttatgaaga

SEQ ID NO: 578294 - DNA, 25 bp, Homo sapien
agcctagcagcccttatgaagacaa

SEQ ID NO: 578295 - DNA, 25 bp, Homo sapien
agcagcccttatgaagacaaagata

SEQ ID NO: 578296 - DNA, 25 bp, Homo sapien
gaaggagaaatctgcaactcgacct

SEQ ID NO: 578297 - DNA, 25 bp, Homo sapien
gagaaatctgcaactcgacctagcc

SEQ ID NO: 578298 - DNA, 25 bp, Homo sapien
gacctagcccctctccggaaaggag

SEQ ID NO: 578299 - DNA, 25 bp, Homo sapien
gagggagcgtggctcggaccgctag

SEQ ID NO: 578300 - DNA, 25 bp, Homo sapien
gtggcgggaggcacgcgggccggca

SEQ ID NO: 578301 - DNA, 25 bp, Homo sapien
gaaggccaggccgttggcgcgggac

SEQ ID NO: 578302 - DNA, 25 bp, Homo sapien
ccagggaaccgcaggcgtcccggag

SEQ ID NO: 578303 - DNA, 25 bp, Homo sapien
aggtgtgtaggacctggagtcggca

SEQ ID NO: 578304 - DNA, 25 bp, Homo sapien
agagtgatgatttctgccccttttg

SEQ ID NO: 578305 - DNA, 25 bp, Homo sapien
agtgatgatttctgccccttttgtc

SEQ ID NO: 578306 - DNA, 25 bp, Homo sapien
gatttctgccccttttgtcagcaga

SEQ ID NO: 578307 - DNA, 25 bp, Homo sapien
tctgccccttttgtcagcagaggag

SEQ ID NO: 578308 - DNA, 25 bp, Homo sapien
cagaggaggccgtggcgaggcggtt

SEQ ID NO: 578309 - DNA, 25 bp, Homo sapien
gtggcgaggcggttgtcagtcccgg

SEQ ID NO: 578310 - DNA, 25 bp, Homo sapien
gtggttaggcacagatttttggaat

SEQ ID NO: 578311 - DNA, 25 bp, Homo sapien
tttttggaatcctttcagtcagttt

SEQ ID NO: 578312 - DNA, 25 bp, Homo sapien
gaatcctttcagtcagttttttata

SEQ ID NO: 578313 - DNA, 25 bp, Homo sapien
atactaacttgatatgtgacatgag

SEQ ID NO: 578314 - DNA, 25 bp, Homo sapien
aattgtgtaagctttacttgctgtt

SEQ ID NO: 578315 - DNA, 25 bp, Homo sapien
aagctttacttgctgttgtttcttc

SEQ ID NO: 578316 - DNA, 25 bp, Homo sapien
tgctgttgtttcttcagtgtaaaat

SEQ ID NO: 578317 - DNA, 25 bp, Homo sapien
gtttcttcagtgtaaaatgtcttag

SEQ ID NO: 578318 - DNA, 25 bp, Homo sapien
ggatatgtatcttgtcccttttaca

SEQ ID NO: 578319 - DNA, 25 bp, Homo sapien
atcattcagtaagaactagctgcag

SEQ ID NO: 578320 - DNA, 25 bp, Homo sapien
gaactagctgcagacatatatatgt

SEQ ID NO: 578321 - DNA, 25 bp, Homo sapien
ctttattcggaaccttcctttgctg

SEQ ID NO: 578322 - DNA, 25 bp, Homo sapien
ttcggaaccttcctttgctgttctg

SEQ ID NO: 578323 - DNA, 25 bp, Homo sapien
gggccgctattgtaaaagcctgggc

SEQ ID NO: 578324 - DNA, 25 bp, Homo sapien
gctattgtaaaagcctgggctccct

SEQ ID NO: 578325 - DNA, 25 bp, Homo sapien
tgggctccctctagtagcttgcgcc

SEQ ID NO: 578326 - DNA, 25 bp, Homo sapien
gggttggctctctctattatcagct

SEQ ID NO: 578327 - DNA, 25 bp, Homo sapien
ggctctctctattatcagctttgaa

SEQ ID NO: 578328 - DNA, 25 bp, Homo sapien
cagctttgaaaacttatcctggttt

SEQ ID NO: 578329 - DNA, 25 bp, Homo sapien
ttttcctgaacatttgcttgaaata

SEQ ID NO: 578330 - DNA, 25 bp, Homo sapien
gcttgaaatattttgttagggcctc

SEQ ID NO: 578331 - DNA, 25 bp, Homo sapien
tagggcctcaaagacgatacctgtc

SEQ ID NO: 578332 - DNA, 25 bp, Homo sapien
ctactctgtgccaagtatgcattac

SEQ ID NO: 578333 - DNA, 25 bp, Homo sapien
tgtgccaagtatgcattaccgcgtg

SEQ ID NO: 578334 - DNA, 25 bp, Homo sapien
aagtatgcattaccgcgtggcttgc

SEQ ID NO: 578335 - DNA, 25 bp, Homo sapien
ttttaacagtgtaatgggaggatct

SEQ ID NO: 578336 - DNA, 25 bp, Homo sapien
ggatctgaaaggttggacccgggag

SEQ ID NO: 578337 - DNA, 25 bp, Homo sapien
ggtagctgccgatgtgtcttgagat

SEQ ID NO: 578338 - DNA, 25 bp, Homo sapien
agctgccgatgtgtcttgagattgt

SEQ ID NO: 578339 - DNA, 25 bp, Homo sapien
tttggaccaaggaggaccgtccagt

SEQ ID NO: 578340 - DNA, 25 bp, Homo sapien
ggaccgtccagtgggtagtgaggat

SEQ ID NO: 578341 - DNA, 25 bp, Homo sapien
aagtgtttgtcttaaatacgccaat

SEQ ID NO: 578342 - DNA, 25 bp, Homo sapien
atacgccaatgtagttttccttctt

SEQ ID NO: 578343 - DNA, 25 bp, Homo sapien
gtgacaactgtgaggcatgtctgca

SEQ ID NO: 578344 - DNA, 25 bp, Homo sapien
aggcatgtctgcagggcttctgtgc

SEQ ID NO: 578345 - DNA, 25 bp, Homo sapien
tgtgctgggcccatacaggttacaa

SEQ ID NO: 578346 - DNA, 25 bp, Homo sapien
agaccccaagagtacactccattta

SEQ ID NO: 578347 - DNA, 25 bp, Homo sapien
ggaggtagttaagccctgggcctca

SEQ ID NO: 578348 - DNA, 25 bp, Homo sapien
cctgggcctcaggagagaatgtcta

SEQ ID NO: 578349 - DNA, 25 bp, Homo sapien
agaatgtctattcctacgcatgcca

SEQ ID NO: 578350 - DNA, 25 bp, Homo sapien
acgcatgccaaaaccacatctgtag

SEQ ID NO: 578351 - DNA, 25 bp, Homo sapien
accacatctgtaggaacttaagcat

SEQ ID NO: 578352 - DNA, 25 bp, Homo sapien
tctgctgttgtgtcattctcattgt

SEQ ID NO: 578353 - DNA, 25 bp, Homo sapien
aaaactgctatatgagccttggaaa

SEQ ID NO: 578354 - DNA, 25 bp, Homo sapien
gaaactttatagagcaaggaccagt

SEQ ID NO: 578355 - DNA, 25 bp, Homo sapien
tagagcaaggaccagtaagtttacc

SEQ ID NO: 578356 - DNA, 25 bp, Homo sapien
taatcacctaagaacctccgtgcta

SEQ ID NO: 578357 - DNA, 25 bp, Homo sapien
acctaagaacctccgtgctacaaga

SEQ ID NO: 578358 - DNA, 25 bp, Homo sapien
gaacctccgtgctacaagaaggagt

SEQ ID NO: 578359 - DNA, 25 bp, Homo sapien
caagaaggagtttgggtttgaccat

SEQ ID NO: 578360 - DNA, 25 bp, Homo sapien
gggtttgaccattaggagaaacaat

SEQ ID NO: 578361 - DNA, 25 bp, Homo sapien
gaaacaattacaaagctgaagcagc

SEQ ID NO: 578362 - DNA, 25 bp, Homo sapien
gaagcagcatgctaaactgcatttc

SEQ ID NO: 578363 - DNA, 25 bp, Homo sapien
gcatttcacaaataccactttggca

SEQ ID NO: 578364 - DNA, 25 bp, Homo sapien
actttggcagcatcaaggatcgatt

SEQ ID NO: 578365 - DNA, 25 bp, Homo sapien
ggccccaggagataagtactaactt

SEQ ID NO: 578366 - DNA, 25 bp, Homo sapien
cccatttcctagaggcttgggaaat

SEQ ID NO: 578367 - DNA, 25 bp, Homo sapien
aaattaagtaactcgcactggtcac

SEQ ID NO: 578368 - DNA, 25 bp, Homo sapien
tcgcactggtcacacatctgtaagt

SEQ ID NO: 578369 - DNA, 25 bp, Homo sapien
atctgtctgtcttgagtctatcgtg

SEQ ID NO: 578370 - DNA, 25 bp, Homo sapien
agtctatcgtgctcttattgctata

SEQ ID NO: 578371 - DNA, 25 bp, Homo sapien
ttattgctatactgaattcccattc

SEQ ID NO: 578372 - DNA, 25 bp, Homo sapien
gaattcccattcatgttaggtaact

SEQ ID NO: 578373 - DNA, 25 bp, Homo sapien
ggccagaatctccatgcactttgta

SEQ ID NO: 578374 - DNA, 25 bp, Homo sapien
tgcactttgtagaccacatttcctg

SEQ ID NO: 578375 - DNA, 25 bp, Homo sapien
gtagaccacatttcctgttatgaaa

SEQ ID NO: 578376 - DNA, 25 bp, Homo sapien
ttgctagattcagcatgctaatatt

SEQ ID NO: 578377 - DNA, 25 bp, Homo sapien
ctgcttttggtattagaacttcata

SEQ ID NO: 578378 - DNA, 25 bp, Homo sapien
agttgggatatgttccttttgcttc

SEQ ID NO: 578379 - DNA, 25 bp, Homo sapien
ggatatgttccttttgcttctgttt

SEQ ID NO: 578380 - DNA, 25 bp, Homo sapien
gcttctgttttctggtagcaattgt

SEQ ID NO: 578381 - DNA, 25 bp, Homo sapien
ctgttttctggtagcaattgtaaat

SEQ ID NO: 578382 - DNA, 25 bp, Homo sapien
taaataattggtatcttttcctcct

SEQ ID NO: 578383 - DNA, 25 bp, Homo sapien
aatgtttcatacaattcgctagtga

SEQ ID NO: 578384 - DNA, 25 bp, Homo sapien
ttcgctagtgaaacaatctaggcct

SEQ ID NO: 578385 - DNA, 25 bp, Homo sapien
acaatctaggcctgttgctttcttt

SEQ ID NO: 578386 - DNA, 25 bp, Homo sapien
tctttcttggaaggttgttaattat

SEQ ID NO: 578387 - DNA, 25 bp, Homo sapien
ctcttgtaacactgagattcttggt

SEQ ID NO: 578388 - DNA, 25 bp, Homo sapien
gattcttggtggtattattgcatta

SEQ ID NO: 578389 - DNA, 25 bp, Homo sapien
taaagttgactaatgtacctcccac

SEQ ID NO: 578390 - DNA, 25 bp, Homo sapien
tacctcccaccaaccgtaagagata

SEQ ID NO: 578391 - DNA, 25 bp, Homo sapien
ggaattgttattatcctgtgatatt

SEQ ID NO: 578392 - DNA, 25 bp, Homo sapien
aatacatagttgatcttctccccgt

SEQ ID NO: 578393 - DNA, 25 bp, Homo sapien
agttgatcttctccccgtttcctga

SEQ ID NO: 578394 - DNA, 25 bp, Homo sapien
aagtgatgtctttttatatgctgat

SEQ ID NO: 578395 - DNA, 25 bp, Homo sapien
ctgatgagttgactgatgcctggca

SEQ ID NO: 578396 - DNA, 25 bp, Homo sapien
cacagcaggattagaaggatggcaa

SEQ ID NO: 578397 - DNA, 25 bp, Homo sapien
aaggatggcaatttcagctccaccc

SEQ ID NO: 578398 - DNA, 25 bp, Homo sapien
ggaatgggttgtcagctcccaccgc

SEQ ID NO: 578399 - DNA, 25 bp, Homo sapien
tctggccaattggtgactcctgcag

SEQ ID NO: 578400 - DNA, 25 bp, Homo sapien
ggtgactcctgcagatatccggaga

SEQ ID NO: 578401 - DNA, 25 bp, Homo sapien
gcagatatccggagacaggccagga

SEQ ID NO: 578402 - DNA, 25 bp, Homo sapien
tggccaaggccttgcaggcagacag

SEQ ID NO: 578403 - DNA, 25 bp, Homo sapien
ccttgcaggcagacaggctggccag

SEQ ID NO: 578404 - DNA, 25 bp, Homo sapien
gatgaagcgcagtcctgggctttcg

SEQ ID NO: 578405 - DNA, 25 bp, Homo sapien
gcagtcctgggctttcggtcccttt

SEQ ID NO: 578406 - DNA, 25 bp, Homo sapien
ctttcttttaatgcccatcctcatt

SEQ ID NO: 578407 - DNA, 25 bp, Homo sapien
atcctcattcctactctgaattgtc

SEQ ID NO: 578408 - DNA, 25 bp, Homo sapien
tctgaattgtcacacttttcccttc

SEQ ID NO: 578409 - DNA, 25 bp, Homo sapien
taatcagttactatgctccagggtt

SEQ ID NO: 578410 - DNA, 25 bp, Homo sapien
tcagttactatgctccagggttgtg

SEQ ID NO: 578411 - DNA, 25 bp, Homo sapien
tatgctccagggttgtgttcagtgc

SEQ ID NO: 578412 - DNA, 25 bp, Homo sapien
tccagggttgtgttcagtgcatcat

SEQ ID NO: 578413 - DNA, 25 bp, Homo sapien
gttgtgttcagtgcatcattcctat

SEQ ID NO: 578414 - DNA, 25 bp, Homo sapien
gttcagtgcatcattcctattaccg

SEQ ID NO: 578415 - DNA, 25 bp, Homo sapien
catcattcctattaccgcactaaat

SEQ ID NO: 578416 - DNA, 25 bp, Homo sapien
tattaccgcactaaattatcacagc

SEQ ID NO: 578417 - DNA, 25 bp, Homo sapien
gcactaaattatcacagcgtcagaa

SEQ ID NO: 578418 - DNA, 25 bp, Homo sapien
acagcgtcagaacaaggcctccgtt

SEQ ID NO: 578419 - DNA, 25 bp, Homo sapien
tcagaacaaggcctccgttttacgg

SEQ ID NO: 578420 - DNA, 25 bp, Homo sapien
tcctgagctcagattctcgtgcctc

SEQ ID NO: 578421 - DNA, 25 bp, Homo sapien
cctgagctcagattctcgtgcctca

SEQ ID NO: 578422 - DNA, 25 bp, Homo sapien
ccgcggctggcccatgcttaaacat

SEQ ID NO: 578423 - DNA, 25 bp, Homo sapien
cgcggctggcccatgcttaaacatt

SEQ ID NO: 578424 - DNA, 25 bp, Homo sapien
gcggctggcccatgcttaaacattt

SEQ ID NO: 578425 - DNA, 25 bp, Homo sapien
cggctggcccatgcttaaacatttt

SEQ ID NO: 578426 - DNA, 25 bp, Homo sapien
ggctggcccatgcttaaacattttt

SEQ ID NO: 578427 - DNA, 25 bp, Homo sapien
gctggcccatgcttaaacattttta

SEQ ID NO: 578428 - DNA, 25 bp, Homo sapien
tggcccatgcttaaacatttttaac

SEQ ID NO: 578429 - DNA, 25 bp, Homo sapien
ggcccatgcttaaacatttttaaca

SEQ ID NO: 578430 - DNA, 25 bp, Homo sapien
catttttaacaccttccaaccatgt

SEQ ID NO: 578431 - DNA, 25 bp, Homo sapien
attgcgtgcctgaaatatacccaaa

SEQ ID NO: 578432 - DNA, 25 bp, Homo sapien
acccaaatggatataaatgtcaact

SEQ ID NO: 578433 - DNA, 25 bp, Homo sapien
ggagatatagatttggaatgcacca

SEQ ID NO: 578434 - DNA, 25 bp, Homo sapien
tatagatttggaatgcaccaacaat

SEQ ID NO: 578435 - DNA, 25 bp, Homo sapien
aacaatgcagatggtaatcctggca

SEQ ID NO: 578436 - DNA, 25 bp, Homo sapien
tgcagatggtaatcctggcatgcga

SEQ ID NO: 578437 - DNA, 25 bp, Homo sapien
gatggtaatcctggcatgcgagtag

SEQ ID NO: 578438 - DNA, 25 bp, Homo sapien
tgaacagagtaacaggactatattt

SEQ ID NO: 578439 - DNA, 25 bp, Homo sapien
aaggatgaacttactggaaacagga

SEQ ID NO: 578440 - DNA, 25 bp, Homo sapien
ttactggaaacaggattgcgtgcct

SEQ ID NO: 578441 - DNA, 25 bp, Homo sapien
ggattgcgtgcctgaaatataccca

SEQ ID NO: 578442 - DNA, 25 bp, Homo sapien
atgctgcagagtatctagtgcccct

SEQ ID NO: 578443 - DNA, 25 bp, Homo sapien
tgcagagtatctagtgcccctgagg

SEQ ID NO: 578444 - DNA, 25 bp, Homo sapien
cagagtatctagtgcccctgagggt

SEQ ID NO: 578445 - DNA, 25 bp, Homo sapien
agtatctagtgcccctgagggtcag

SEQ ID NO: 578446 - DNA, 25 bp, Homo sapien
agagtggacccctgcatggtagtgc

SEQ ID NO: 578447 - DNA, 25 bp, Homo sapien
gtggacccctgcatggtagtgccag

SEQ ID NO: 578448 - DNA, 25 bp, Homo sapien
acccctgcatggtagtgccagggac

SEQ ID NO: 578449 - DNA, 25 bp, Homo sapien
ccaggctccatttccattcctgtgg

SEQ ID NO: 578450 - DNA, 25 bp, Homo sapien
tgttcaacccagactttgctgggat

SEQ ID NO: 578451 - DNA, 25 bp, Homo sapien
tcaacccagactttgctgggatctc

SEQ ID NO: 578452 - DNA, 25 bp, Homo sapien
cccagactttgctgggatctcttcc

SEQ ID NO: 578453 - DNA, 25 bp, Homo sapien
agtacccttagtaaatatgcaggtg

SEQ ID NO: 578454 - DNA, 25 bp, Homo sapien
tctctgcctagatcttcaggaacta

SEQ ID NO: 578455 - DNA, 25 bp, Homo sapien
tcttcaggaactagtacattggcag

SEQ ID NO: 578456 - DNA, 25 bp, Homo sapien
gcagttttcagtaagactcctctct

SEQ ID NO: 578457 - DNA, 25 bp, Homo sapien
tttcagtaagactcctctctgtcac

SEQ ID NO: 578458 - DNA, 25 bp, Homo sapien
ctctctgtcactgccatacgaaaaa

SEQ ID NO: 578459 - DNA, 25 bp, Homo sapien
tttgtagtgggaaaagttggcctca

SEQ ID NO: 578460 - DNA, 25 bp, Homo sapien
gttggcctcataattggccctggat

SEQ ID NO: 578461 - DNA, 25 bp, Homo sapien
tttcggtagtgtgtcttaaccttct

SEQ ID NO: 578462 - DNA, 25 bp, Homo sapien
gtcttaaccttctgacagctgctgt

SEQ ID NO: 578463 - DNA, 25 bp, Homo sapien
gctgctgtgacgaagctagaaagct

SEQ ID NO: 578464 - DNA, 25 bp, Homo sapien
agcaggcgctgcagcggtacctgaa

SEQ ID NO: 578465 - DNA, 25 bp, Homo sapien
tgcagcggtacctgaagacccggga

SEQ ID NO: 578466 - DNA, 25 bp, Homo sapien
ggtcctggttactgggtgaagattc

SEQ ID NO: 578467 - DNA, 25 bp, Homo sapien
tacagatggaggaatcctggatcca

SEQ ID NO: 578468 - DNA, 25 bp, Homo sapien
tcctggatccagatgatgtcttggc

SEQ ID NO: 578469 - DNA, 25 bp, Homo sapien
tgatgtcttggcagatgttgttgaa

SEQ ID NO: 578470 - DNA, 25 bp, Homo sapien
agaacaagaaccactccacaagatt

SEQ ID NO: 578471 - DNA, 25 bp, Homo sapien
ctccacaagattgagagccccagtg

SEQ ID NO: 578472 - DNA, 25 bp, Homo sapien
ggaaaccctgcagatcggcagagcc

SEQ ID NO: 578473 - DNA, 25 bp, Homo sapien
ggcagagcccagatgcttttgagac

SEQ ID NO: 578474 - DNA, 25 bp, Homo sapien
tttgagacagaagtggccgcccaac

SEQ ID NO: 578475 - DNA, 25 bp, Homo sapien
attcagttgcttcctccagtcttac

SEQ ID NO: 578476 - DNA, 25 bp, Homo sapien
tggcccttcttctgtaagctcattg

SEQ ID NO: 578477 - DNA, 25 bp, Homo sapien
aaggagcatctttacaggccagcat

SEQ ID NO: 578478 - DNA, 25 bp, Homo sapien
tacaggccagcatgtcaggtagact

SEQ ID NO: 578479 - DNA, 25 bp, Homo sapien
ggtagactatcctgaaaattttata

SEQ ID NO: 578480 - DNA, 25 bp, Homo sapien
attttataacattttcgggaagcag

SEQ ID NO: 578481 - DNA, 25 bp, Homo sapien
gatattaatgccaactccagaacta

SEQ ID NO: 578482 - DNA, 25 bp, Homo sapien
gatttgcatacgtgtctgagcctgt

SEQ ID NO: 578483 - DNA, 25 bp, Homo sapien
gagcctgtatccagagaaatgtatc

SEQ ID NO: 578484 - DNA, 25 bp, Homo sapien
gaactatctatgtgtcaacaagtca

SEQ ID NO: 578485 - DNA, 25 bp, Homo sapien
gacaccaggacacagttaattcagt

SEQ ID NO: 578486 - DNA, 25 bp, Homo sapien
aatattaactaacagagtgggagat

SEQ ID NO: 578487 - DNA, 25 bp, Homo sapien
ttcatgctatttcacacaaaatata

SEQ ID NO: 578488 - DNA, 25 bp, Homo sapien
ttccatttctttcagttcttactgg

SEQ ID NO: 578489 - DNA, 25 bp, Homo sapien
ccatttctttcagttcttactggta

SEQ ID NO: 578490 - DNA, 25 bp, Homo sapien
tttcagttcttactggtagctccca

SEQ ID NO: 578491 - DNA, 25 bp, Homo sapien
tcagttcttactggtagctcccaag

SEQ ID NO: 578492 - DNA, 25 bp, Homo sapien
agttcttactggtagctcccaagag

SEQ ID NO: 578493 - DNA, 25 bp, Homo sapien
ttcttactggtagctcccaagagct

SEQ ID NO: 578494 - DNA, 25 bp, Homo sapien
ttactggtagctcccaagagctctc

SEQ ID NO: 578495 - DNA, 25 bp, Homo sapien
tggtagctcccaagagctctctgat

SEQ ID NO: 578496 - DNA, 25 bp, Homo sapien
acaaattggagattgtcctaagtaa

SEQ ID NO: 578497 - DNA, 25 bp, Homo sapien
gcaacgccactaacagcagtctcat

SEQ ID NO: 578498 - DNA, 25 bp, Homo sapien
agcagtctcattaagcactggtgcg

SEQ ID NO: 578499 - DNA, 25 bp, Homo sapien
tcattaagcactggtgcggcaccac

SEQ ID NO: 578500 - DNA, 25 bp, Homo sapien
ttaagcactggtgcggcaccacggg

SEQ ID NO: 578501 - DNA, 25 bp, Homo sapien
agccgacccaggagaacagcagctg

SEQ ID NO: 578502 - DNA, 25 bp, Homo sapien
ttcggcccgtgcacagagaagaaca

SEQ ID NO: 578503 - DNA, 25 bp, Homo sapien
agaacagcacagccccggcggacag

SEQ ID NO: 578504 - DNA, 25 bp, Homo sapien
acctgtttgcgggcacggagctcac

SEQ ID NO: 578505 - DNA, 25 bp, Homo sapien
cggacctggccgtgggctgcatcct

SEQ ID NO: 578506 - DNA, 25 bp, Homo sapien
gctccctgctggtgctctgcggctg

SEQ ID NO: 578507 - DNA, 25 bp, Homo sapien
ggactccgacatgatcatgagcagt

SEQ ID NO: 578508 - DNA, 25 bp, Homo sapien
gggaactctaagttgaaatacactt

SEQ ID NO: 578509 - DNA, 25 bp, Homo sapien
gaaatacactttctcagttcacaat

SEQ ID NO: 578510 - DNA, 25 bp, Homo sapien
actttctcagttcacaatgttatcc

SEQ ID NO: 578511 - DNA, 25 bp, Homo sapien
aatgttatccattctgacctttatc

SEQ ID NO: 578512 - DNA, 25 bp, Homo sapien
acctttatcagacacaggcacagag

SEQ ID NO: 578513 - DNA, 25 bp, Homo sapien
agacacaggcacagaggacctcaga

SEQ ID NO: 578514 - DNA, 25 bp, Homo sapien
gaggacctcagagatattcccagca

SEQ ID NO: 578515 - DNA, 25 bp, Homo sapien
agagatattcccagcagtctcaata

SEQ ID NO: 578516 - DNA, 25 bp, Homo sapien
cagcagtctcaatatccatggtaat

SEQ ID NO: 578517 - DNA, 25 bp, Homo sapien
gtctcaatatccatggtaatgctaa

SEQ ID NO: 578518 - DNA, 25 bp, Homo sapien
aatgctaataaactactattctggc

SEQ ID NO: 578519 - DNA, 25 bp, Homo sapien
ttggcagctgacttgtacgtttcct

SEQ ID NO: 578520 - DNA, 25 bp, Homo sapien
agctgacttgtacgtttcctctagg

SEQ ID NO: 578521 - DNA, 25 bp, Homo sapien
gacttgtacgtttcctctaggctat

SEQ ID NO: 578522 - DNA, 25 bp, Homo sapien
gtacgtttcctctaggctattgtta

SEQ ID NO: 578523 - DNA, 25 bp, Homo sapien
gtttcctctaggctattgttataca

SEQ ID NO: 578524 - DNA, 25 bp, Homo sapien
tcctctaggctattgttatacacat

SEQ ID NO: 578525 - DNA, 25 bp, Homo sapien
atacacatttataaagagcactttc

SEQ ID NO: 578526 - DNA, 25 bp, Homo sapien
gagcactttcaggaatggaaattca

SEQ ID NO: 578527 - DNA, 25 bp, Homo sapien
caaagttgctctaggtgtttgcatc

SEQ ID NO: 578528 - DNA, 25 bp, Homo sapien
gctctaggtgtttgcatcttttccc

SEQ ID NO: 578529 - DNA, 25 bp, Homo sapien
ggtgtttgcatcttttcccttttct

SEQ ID NO: 578530 - DNA, 25 bp, Homo sapien
tgacagatgttcctgagggccacag

SEQ ID NO: 578531 - DNA, 25 bp, Homo sapien
acctgacggaaggttggtggcattt

SEQ ID NO: 578532 - DNA, 25 bp, Homo sapien
gactgggaataaccgagggcctcgt

SEQ ID NO: 578533 - DNA, 25 bp, Homo sapien
ggtggcactgccctctcaacgctga

SEQ ID NO: 578534 - DNA, 25 bp, Homo sapien
gctgacctgtcagctggttcaggaa

SEQ ID NO: 578535 - DNA, 25 bp, Homo sapien
tcagctggttcaggaaggcctttct

SEQ ID NO: 578536 - DNA, 25 bp, Homo sapien
tctgaggccagcacagactctatca

SEQ ID NO: 578537 - DNA, 25 bp, Homo sapien
agcacagactctatcacaccatgga

SEQ ID NO: 578538 - DNA, 25 bp, Homo sapien
tatcacaccatggaccttcaaggga

SEQ ID NO: 578539 - DNA, 25 bp, Homo sapien
ggaccttcaagggatagctctcttg

SEQ ID NO: 578540 - DNA, 25 bp, Homo sapien
aagggatagctctcttggcaaaaca

SEQ ID NO: 578541 - DNA, 25 bp, Homo sapien
cagtgtgagtcagcattgcagaccc

SEQ ID NO: 578542 - DNA, 25 bp, Homo sapien
agtgtgagtcagcattgcagaccca

SEQ ID NO: 578543 - DNA, 25 bp, Homo sapien
gtgtgagtcagcattgcagacccac

SEQ ID NO: 578544 - DNA, 25 bp, Homo sapien
tgtgagtcagcattgcagacccact

SEQ ID NO: 578545 - DNA, 25 bp, Homo sapien
gtgagtcagcattgcagacccactt

SEQ ID NO: 578546 - DNA, 25 bp, Homo sapien
tgagtcagcattgcagacccacttc

SEQ ID NO: 578547 - DNA, 25 bp, Homo sapien
gagtcagcattgcagacccacttct

SEQ ID NO: 578548 - DNA, 25 bp, Homo sapien
agtcagcattgcagacccacttctg

SEQ ID NO: 578549 - DNA, 25 bp, Homo sapien
gtcagcattgcagacccacttctgg

SEQ ID NO: 578550 - DNA, 25 bp, Homo sapien
gtttgaaacaacgtccaaatctggg

SEQ ID NO: 578551 - DNA, 25 bp, Homo sapien
ggtgagtcccagtcaacagctgtga

SEQ ID NO: 578552 - DNA, 25 bp, Homo sapien
aacagctgtgagaacacccactttg

SEQ ID NO: 578553 - DNA, 25 bp, Homo sapien
gaacacccactttgcagattaggat

SEQ ID NO: 578554 - DNA, 25 bp, Homo sapien
gattctggagataacatgtggacat

SEQ ID NO: 578555 - DNA, 25 bp, Homo sapien
gttacgggacatgcttgtgtacaga

SEQ ID NO: 578556 - DNA, 25 bp, Homo sapien
catgcttgtgtacagagtacctgct

SEQ ID NO: 578557 - DNA, 25 bp, Homo sapien
gagtacctgctagtataaaatgtct

SEQ ID NO: 578558 - DNA, 25 bp, Homo sapien
aaatgtctaatgtagctgcttttat

SEQ ID NO: 578559 - DNA, 25 bp, Homo sapien
aaaagaagtgctggccatttccaat

SEQ ID NO: 578560 - DNA, 25 bp, Homo sapien
agctgggctttgttgggccagtttc

SEQ ID NO: 578561 - DNA, 25 bp, Homo sapien
tgacagtcctcccactaaggaattc

SEQ ID NO: 578562 - DNA, 25 bp, Homo sapien
agtcctcccactaaggaattcctgg

SEQ ID NO: 578563 - DNA, 25 bp, Homo sapien
tcctcccactaaggaattcctggtg

SEQ ID NO: 578564 - DNA, 25 bp, Homo sapien
tcccactaaggaattcctggtgact

SEQ ID NO: 578565 - DNA, 25 bp, Homo sapien
taaggaattcctggtgactggaagg

SEQ ID NO: 578566 - DNA, 25 bp, Homo sapien
agagtgccttggctccctcctgtcg

SEQ ID NO: 578567 - DNA, 25 bp, Homo sapien
tcagggcccggctggtagctgggtt

SEQ ID NO: 578568 - DNA, 25 bp, Homo sapien
tgtccccgactcctgtggagcctgg

SEQ ID NO: 578569 - DNA, 25 bp, Homo sapien
ggcaccccccgaatggacaatcttt

SEQ ID NO: 578570 - DNA, 25 bp, Homo sapien
gcaggcctagtttgactctgacagt

SEQ ID NO: 578571 - DNA, 25 bp, Homo sapien
gcctagtttgactctgacagtcctc

SEQ ID NO: 578572 - DNA, 25 bp, Homo sapien
agtgttaaagtatacattaaagtgc

SEQ ID NO: 578573 - DNA, 25 bp, Homo sapien
gtgttaaagtatacattaaagtgct

SEQ ID NO: 578574 - DNA, 25 bp, Homo sapien
tgttaaagtatacattaaagtgctt

SEQ ID NO: 578575 - DNA, 25 bp, Homo sapien
gttaaagtatacattaaagtgctta

SEQ ID NO: 578576 - DNA, 25 bp, Homo sapien
ttaaagtatacattaaagtgcttat

SEQ ID NO: 578577 - DNA, 25 bp, Homo sapien
taaagtatacattaaagtgcttatt

SEQ ID NO: 578578 - DNA, 25 bp, Homo sapien
aaagtatacattaaagtgcttattt

SEQ ID NO: 578579 - DNA, 25 bp, Homo sapien
aagtatacattaaagtgcttattta

SEQ ID NO: 578580 - DNA, 25 bp, Homo sapien
agtatacattaaagtgcttatttaa

SEQ ID NO: 578581 - DNA, 25 bp, Homo sapien
gtatacattaaagtgcttatttaaa

SEQ ID NO: 578582 - DNA, 25 bp, Homo sapien
aattcagatgttaacctcaattttt

SEQ ID NO: 578583 - DNA, 25 bp, Homo sapien
caaatacaaagctatgtcctaagat

SEQ ID NO: 578584 - DNA, 25 bp, Homo sapien
acaaagctatgtcctaagataattc

SEQ ID NO: 578585 - DNA, 25 bp, Homo sapien
gatatttatattcaacgtctagtat

SEQ ID NO: 578586 - DNA, 25 bp, Homo sapien
tagtataagaatatgacaatgcccc

SEQ ID NO: 578587 - DNA, 25 bp, Homo sapien
tgacaatgccccccacttactagag

SEQ ID NO: 578588 - DNA, 25 bp, Homo sapien
gtaagatgaggctagtaactgtttc

SEQ ID NO: 578589 - DNA, 25 bp, Homo sapien
gatgaggctagtaactgtttctcct

SEQ ID NO: 578590 - DNA, 25 bp, Homo sapien
agggttattataagatcatatgagt

SEQ ID NO: 578591 - DNA, 25 bp, Homo sapien
tgagtaaaatacatagcaccgtatt

SEQ ID NO: 578592 - DNA, 25 bp, Homo sapien
tacatagcaccgtatttagaatata

SEQ ID NO: 578593 - DNA, 25 bp, Homo sapien
tagcaccgtatttagaatatagtaa

SEQ ID NO: 578594 - DNA, 25 bp, Homo sapien
gacaaccaagagacactcatccaga

SEQ ID NO: 578595 - DNA, 25 bp, Homo sapien
atccagaccccatttgggttcgaat

SEQ ID NO: 578596 - DNA, 25 bp, Homo sapien
catttgggttcgaatgcatccctta

SEQ ID NO: 578597 - DNA, 25 bp, Homo sapien
aatgcatcccttatcctgtgtccag

SEQ ID NO: 578598 - DNA, 25 bp, Homo sapien
atttgggtgccctccatggccagga

SEQ ID NO: 578599 - DNA, 25 bp, Homo sapien
aaattgccaagagcgagagcggccg

SEQ ID NO: 578600 - DNA, 25 bp, Homo sapien
agagcggccgggtcctgcagatctc

SEQ ID NO: 578601 - DNA, 25 bp, Homo sapien
ctgcagatctcagcgggcgtcagat

SEQ ID NO: 578602 - DNA, 25 bp, Homo sapien
tcagcgggcgtcagatacgtgcagc

SEQ ID NO: 578603 - DNA, 25 bp, Homo sapien
tcagatacgtgcagctgtcagccta

SEQ ID NO: 578604 - DNA, 25 bp, Homo sapien
gcagctgtcagcctactctgaggtc

SEQ ID NO: 578605 - DNA, 25 bp, Homo sapien
aagggctttcagaagctgacctgcc

SEQ ID NO: 578606 - DNA, 25 bp, Homo sapien
ggctttcagaagctgacctgcccaa

SEQ ID NO: 578607 - DNA, 25 bp, Homo sapien
ctgcccaacccctggatttcaggca

SEQ ID NO: 578608 - DNA, 25 bp, Homo sapien
tggagagggccaaggatttgtcact

SEQ ID NO: 578609 - DNA, 25 bp, Homo sapien
gggccaaggatttgtcactgagcaa

SEQ ID NO: 578610 - DNA, 25 bp, Homo sapien
caaggatttgtcactgagcaaggag

SEQ ID NO: 578611 - DNA, 25 bp, Homo sapien
tgaagccaggtgtccaggcacccag

SEQ ID NO: 578612 - DNA, 25 bp, Homo sapien
agcacctcctgccaattcatacaga

SEQ ID NO: 578613 - DNA, 25 bp, Homo sapien
acctcctgccaattcatacagaatt

SEQ ID NO: 578614 - DNA, 25 bp, Homo sapien
atacagaattcaattccccacctgg

SEQ ID NO: 578615 - DNA, 25 bp, Homo sapien
ttcaattccccacctggaagggctt

SEQ ID NO: 578616 - DNA, 25 bp, Homo sapien
tttaaggtaccagccccatatcaca

SEQ ID NO: 578617 - DNA, 25 bp, Homo sapien
agccccatatcacatacctgtatgt

SEQ ID NO: 578618 - DNA, 25 bp, Homo sapien
tacctgtatgtcagcccataatagg

SEQ ID NO: 578619 - DNA, 25 bp, Homo sapien
gtatgtcagcccataataggcctta

SEQ ID NO: 578620 - DNA, 25 bp, Homo sapien
gtcagcccataataggccttacctt

SEQ ID NO: 578621 - DNA, 25 bp, Homo sapien
ataggccttaccttagaagccaaag

SEQ ID NO: 578622 - DNA, 25 bp, Homo sapien
ggccttaccttagaagccaaagatc

SEQ ID NO: 578623 - DNA, 25 bp, Homo sapien
gaagccaaagatccataactacaca

SEQ ID NO: 578624 - DNA, 25 bp, Homo sapien
gccaaagatccataactacacagta

SEQ ID NO: 578625 - DNA, 25 bp, Homo sapien
gatccataactacacagtattcatg

SEQ ID NO: 578626 - DNA, 25 bp, Homo sapien
aactacacagtattcatgttgtata

SEQ ID NO: 578627 - DNA, 25 bp, Homo sapien
tgttttggtttctcacgactggctg

SEQ ID NO: 578628 - DNA, 25 bp, Homo sapien
gtttctcacgactggctgttgttca

SEQ ID NO: 578629 - DNA, 25 bp, Homo sapien
gctgttgttcatcatgtgacttgtt

SEQ ID NO: 578630 - DNA, 25 bp, Homo sapien
gtgacttgtttaggcacacgattac

SEQ ID NO: 578631 - DNA, 25 bp, Homo sapien
gcacacgattacaacactctgtcta

SEQ ID NO: 578632 - DNA, 25 bp, Homo sapien
actctgtctagaggtttgctgccag

SEQ ID NO: 578633 - DNA, 25 bp, Homo sapien
tgccagaaacctatagctgactctt

SEQ ID NO: 578634 - DNA, 25 bp, Homo sapien
ctcttcctgggaatcaatttttgat

SEQ ID NO: 578635 - DNA, 25 bp, Homo sapien
tttgatttccctgttattgatctga

SEQ ID NO: 578636 - DNA, 25 bp, Homo sapien
tattgatctgataacactctcccca

SEQ ID NO: 578637 - DNA, 25 bp, Homo sapien
agatatgcaagccttctaattgaaa

SEQ ID NO: 578638 - DNA, 25 bp, Homo sapien
gtggtcacgtgtttgctatctgcct

SEQ ID NO: 578639 - DNA, 25 bp, Homo sapien
ggtcacgtgtttgctatctgcctcc

SEQ ID NO: 578640 - DNA, 25 bp, Homo sapien
gtgtttgctatctgcctccctaatg

SEQ ID NO: 578641 - DNA, 25 bp, Homo sapien
tttgctatctgcctccctaatgtct

SEQ ID NO: 578642 - DNA, 25 bp, Homo sapien
gtctttgagaacattagctccctga

SEQ ID NO: 578643 - DNA, 25 bp, Homo sapien
tttgagaacattagctccctgaggg

SEQ ID NO: 578644 - DNA, 25 bp, Homo sapien
cctgagggcagaaatctccttcact

SEQ ID NO: 578645 - DNA, 25 bp, Homo sapien
gagggcagaaatctccttcactgac

SEQ ID NO: 578646 - DNA, 25 bp, Homo sapien
gggcagaaatctccttcactgacat

SEQ ID NO: 578647 - DNA, 25 bp, Homo sapien
agaaatctccttcactgacatatcc

SEQ ID NO: 578648 - DNA, 25 bp, Homo sapien
gaaatctccttcactgacatatccc

SEQ ID NO: 578649 - DNA, 25 bp, Homo sapien
gtgtgttaccatgctgactgtgact

SEQ ID NO: 578650 - DNA, 25 bp, Homo sapien
atgctgactgtgacttagggccctg

SEQ ID NO: 578651 - DNA, 25 bp, Homo sapien
tagggccctggtagtttctgtagca

SEQ ID NO: 578652 - DNA, 25 bp, Homo sapien
gttgagaatgctagagtcgatgact

SEQ ID NO: 578653 - DNA, 25 bp, Homo sapien
gactctgtttttcaccttgccgtgt

SEQ ID NO: 578654 - DNA, 25 bp, Homo sapien
ttgccgtgtccaggcaggccagaga

SEQ ID NO: 578655 - DNA, 25 bp, Homo sapien
aatgagtactcaagacacctggccc

SEQ ID NO: 578656 - DNA, 25 bp, Homo sapien
cacctggcccaaacattcatgaaga

SEQ ID NO: 578657 - DNA, 25 bp, Homo sapien
tcctcctttgcatgatcctgtaagg

SEQ ID NO: 578658 - DNA, 25 bp, Homo sapien
agctagcagctgtggatactccgaa

SEQ ID NO: 578659 - DNA, 25 bp, Homo sapien
gtggatactccgaacagaccagtga

SEQ ID NO: 578660 - DNA, 25 bp, Homo sapien
gcttttctggaaggaaataaccagg

SEQ ID NO: 578661 - DNA, 25 bp, Homo sapien
taaccaggaatgcaaagagcttatc

SEQ ID NO: 578662 - DNA, 25 bp, Homo sapien
gaatgcaaagagcttatcacctcat

SEQ ID NO: 578663 - DNA, 25 bp, Homo sapien
gcaaagagcttatcacctcattatt

SEQ ID NO: 578664 - DNA, 25 bp, Homo sapien
agagcttatcacctcattatttaca

SEQ ID NO: 578665 - DNA, 25 bp, Homo sapien
gcttatcacctcattatttacaaca

SEQ ID NO: 578666 - DNA, 25 bp, Homo sapien
tatcacctcattatttacaacagtg

SEQ ID NO: 578667 - DNA, 25 bp, Homo sapien
aaagtaagcctaaatcgggtgatag

SEQ ID NO: 578668 - DNA, 25 bp, Homo sapien
gcctaaatcgggtgatagttaatca

SEQ ID NO: 578669 - DNA, 25 bp, Homo sapien
atcaaattatagtagacacctctag

SEQ ID NO: 578670 - DNA, 25 bp, Homo sapien
tagtagacacctctagacatatttt

SEQ ID NO: 578671 - DNA, 25 bp, Homo sapien
actgatacagatgcttagagctaat

SEQ ID NO: 578672 - DNA, 25 bp, Homo sapien
gcttagagctaattttcaagttttt

SEQ ID NO: 578673 - DNA, 25 bp, Homo sapien
tgaagtttctttagagttcttccat

SEQ ID NO: 578674 - DNA, 25 bp, Homo sapien
aagatgttctattaagatggccata

SEQ ID NO: 578675 - DNA, 25 bp, Homo sapien
ttaagatggccatatattgactata

SEQ ID NO: 578676 - DNA, 25 bp, Homo sapien
attgactatattttcacattgacag

SEQ ID NO: 578677 - DNA, 25 bp, Homo sapien
ttttcacattgacagattccattta

SEQ ID NO: 578678 - DNA, 25 bp, Homo sapien
aatggcaaccataagtatactttag

SEQ ID NO: 578679 - DNA, 25 bp, Homo sapien
gtatactttagcatttacaacagat

SEQ ID NO: 578680 - DNA, 25 bp, Homo sapien
acaacagatatgtgcttcattgtta

SEQ ID NO: 578681 - DNA, 25 bp, Homo sapien
ttactttaataaattgacctgcttt

SEQ ID NO: 578682 - DNA, 25 bp, Homo sapien
tacatgccccggaccccggtagatg

SEQ ID NO: 578683 - DNA, 25 bp, Homo sapien
ggaccccggtagatggctccctgtt

SEQ ID NO: 578684 - DNA, 25 bp, Homo sapien
ccggtagatggctccctgttgtttg

SEQ ID NO: 578685 - DNA, 25 bp, Homo sapien
gagcctggaaggtggttatgccttt

SEQ ID NO: 578686 - DNA, 25 bp, Homo sapien
gaaggtggttatgccttttggatgc

SEQ ID NO: 578687 - DNA, 25 bp, Homo sapien
ccttttggatgcaggagaggagcaa

SEQ ID NO: 578688 - DNA, 25 bp, Homo sapien
tccctgggttctggttggagatgaa

SEQ ID NO: 578689 - DNA, 25 bp, Homo sapien
agaagcatcaggtctaagatcagct

SEQ ID NO: 578690 - DNA, 25 bp, Homo sapien
catcaggtctaagatcagcttctct

SEQ ID NO: 578691 - DNA, 25 bp, Homo sapien
ggtctaagatcagcttctcttggaa

SEQ ID NO: 578692 - DNA, 25 bp, Homo sapien
taagatcagcttctcttggaagcag

SEQ ID NO: 578693 - DNA, 25 bp, Homo sapien
caagctcacagcactgaggcgctgg

SEQ ID NO: 578694 - DNA, 25 bp, Homo sapien
tagccccgtcaatcttggtggcatg

SEQ ID NO: 578695 - DNA, 25 bp, Homo sapien
gtcaatcttggtggcatggactccc

SEQ ID NO: 578696 - DNA, 25 bp, Homo sapien
ggcatggactccctcctaaagcttt

SEQ ID NO: 578697 - DNA, 25 bp, Homo sapien
taaagctttctcaggaggccccatt

SEQ ID NO: 578698 - DNA, 25 bp, Homo sapien
caagaattcaggaggagcccactca

SEQ ID NO: 578699 - DNA, 25 bp, Homo sapien
ctcagagctgtcatggacaattgga

SEQ ID NO: 578700 - DNA, 25 bp, Homo sapien
ttggagagaaaaaccgggacattct

SEQ ID NO: 578701 - DNA, 25 bp, Homo sapien
ctccccaaccaggatattttgtatg

SEQ ID NO: 578702 - DNA, 25 bp, Homo sapien
ttgcacttactgctgcgttcccttc

SEQ ID NO: 578703 - DNA, 25 bp, Homo sapien
gcgttcccttcatctaaaagctcta

SEQ ID NO: 578704 - DNA, 25 bp, Homo sapien
gctccggcaacgccagcatacgagg

SEQ ID NO: 578705 - DNA, 25 bp, Homo sapien
ggaggcgcggcgagccaatcctcac

SEQ ID NO: 578706 - DNA, 25 bp, Homo sapien
ggcgagccaatcctcactttaaaag

SEQ ID NO: 578707 - DNA, 25 bp, Homo sapien
cactttaaaagctttcctgtcctcg

SEQ ID NO: 578708 - DNA, 25 bp, Homo sapien
aaagctttcctgtcctcgaagcgag

SEQ ID NO: 578709 - DNA, 25 bp, Homo sapien
agctttcctgtcctcgaagcgaggg

SEQ ID NO: 578710 - DNA, 25 bp, Homo sapien
ggcaagacgcactggccccagacga

SEQ ID NO: 578711 - DNA, 25 bp, Homo sapien
tggccccagacgaccggtccgtgaa

SEQ ID NO: 578712 - DNA, 25 bp, Homo sapien
gacgaccggtccgtgaaatgaccct

SEQ ID NO: 578713 - DNA, 25 bp, Homo sapien
tccgtgaaatgacccttccgagcga

SEQ ID NO: 578714 - DNA, 25 bp, Homo sapien
gaaatgacccttccgagcgacccgg

SEQ ID NO: 578715 - DNA, 25 bp, Homo sapien
tgaagaggccctgaaactacgtaga

SEQ ID NO: 578716 - DNA, 25 bp, Homo sapien
agaggccctgaaactacgtagagag

SEQ ID NO: 578717 - DNA, 25 bp, Homo sapien
aactacgtagagagggagaggcacc

SEQ ID NO: 578718 - DNA, 25 bp, Homo sapien
tgctgaaccctgtcttcttgacatc

SEQ ID NO: 578719 - DNA, 25 bp, Homo sapien
ctgtcttcttgacatccaccaagat

SEQ ID NO: 578720 - DNA, 25 bp, Homo sapien
tgacatccaccaagataccagacat

SEQ ID NO: 578721 - DNA, 25 bp, Homo sapien
gagtgaaattttggatccaccagac

SEQ ID NO: 578722 - DNA, 25 bp, Homo sapien
aattttggatccaccagaccagcca

SEQ ID NO: 578723 - DNA, 25 bp, Homo sapien
aaatgccagtgagcgacttggtaac

SEQ ID NO: 578724 - DNA, 25 bp, Homo sapien
gagcgacttggtaacctgaactgat

SEQ ID NO: 578725 - DNA, 25 bp, Homo sapien
gtaacctgaactgatgccatgtaga

SEQ ID NO: 578726 - DNA, 25 bp, Homo sapien
ggtactgctgcctttttctgttcca

SEQ ID NO: 578727 - DNA, 25 bp, Homo sapien
gtactgctgcctttttctgttccac

SEQ ID NO: 578728 - DNA, 25 bp, Homo sapien
tactgctgcctttttctgttccaca

SEQ ID NO: 578729 - DNA, 25 bp, Homo sapien
actgctgcctttttctgttccacac

SEQ ID NO: 578730 - DNA, 25 bp, Homo sapien
tgctgcctttttctgttccacactg

SEQ ID NO: 578731 - DNA, 25 bp, Homo sapien
gctgcctttttctgttccacactgt

SEQ ID NO: 578732 - DNA, 25 bp, Homo sapien
tgcctttttctgttccacactgtca

SEQ ID NO: 578733 - DNA, 25 bp, Homo sapien
gcctttttctgttccacactgtcag

SEQ ID NO: 578734 - DNA, 25 bp, Homo sapien
ctttttctgttccacactgtcaggg

SEQ ID NO: 578735 - DNA, 25 bp, Homo sapien
tttttctgttccacactgtcaggga

SEQ ID NO: 578736 - DNA, 25 bp, Homo sapien
ttttctgttccacactgtcagggaa

SEQ ID NO: 578737 - DNA, 25 bp, Homo sapien
cagaggacacaggaaaacacacaca

SEQ ID NO: 578738 - DNA, 25 bp, Homo sapien
acacccgggagtccttgcaaatggt

SEQ ID NO: 578739 - DNA, 25 bp, Homo sapien
ggagtccttgcaaatggtcccaggc

SEQ ID NO: 578740 - DNA, 25 bp, Homo sapien
caaatggtcccaggcttcatgagaa

SEQ ID NO: 578741 - DNA, 25 bp, Homo sapien
atggtcccaggcttcatgagaagtc

SEQ ID NO: 578742 - DNA, 25 bp, Homo sapien
gcttcatgagaagtccgtgctggtg

SEQ ID NO: 578743 - DNA, 25 bp, Homo sapien
tgagaagtccgtgctggtgacagtt

SEQ ID NO: 578744 - DNA, 25 bp, Homo sapien
aagtccgtgctggtgacagttggaa

SEQ ID NO: 578745 - DNA, 25 bp, Homo sapien
tccgtgctggtgacagttggaacgt

SEQ ID NO: 578746 - DNA, 25 bp, Homo sapien
ggaacgtgttactctggggatagcc

SEQ ID NO: 578747 - DNA, 25 bp, Homo sapien
actctggggatagcctaatcactac

SEQ ID NO: 578748 - DNA, 25 bp, Homo sapien
tttctttgtccagtgggagagttaa

SEQ ID NO: 578749 - DNA, 25 bp, Homo sapien
tctttgtccagtgggagagttaagg

SEQ ID NO: 578750 - DNA, 25 bp, Homo sapien
tatggactgaactctgtccccctca

SEQ ID NO: 578751 - DNA, 25 bp, Homo sapien
aagccccaaccttcaacatgactat

SEQ ID NO: 578752 - DNA, 25 bp, Homo sapien
gccccaaccttcaacatgactatat

SEQ ID NO: 578753 - DNA, 25 bp, Homo sapien
ccaaccttcaacatgactatatttg

SEQ ID NO: 578754 - DNA, 25 bp, Homo sapien
gactatatttgaaaacagtcccttt

SEQ ID NO: 578755 - DNA, 25 bp, Homo sapien
gagatcataagagtggggcccttgt

SEQ ID NO: 578756 - DNA, 25 bp, Homo sapien
gggcccttgttcgatagaactggtg

SEQ ID NO: 578757 - DNA, 25 bp, Homo sapien
ggcccttgttcgatagaactggtgt

SEQ ID NO: 578758 - DNA, 25 bp, Homo sapien
cccttgttcgatagaactggtgtcc

SEQ ID NO: 578759 - DNA, 25 bp, Homo sapien
aattaaggttacacgaagtcacagt

SEQ ID NO: 578760 - DNA, 25 bp, Homo sapien
ttaaggttacacgaagtcacagtgg

SEQ ID NO: 578761 - DNA, 25 bp, Homo sapien
gtcacagtggagaatctgatctgct

SEQ ID NO: 578762 - DNA, 25 bp, Homo sapien
tcacagtggagaatctgatctgcta

SEQ ID NO: 578763 - DNA, 25 bp, Homo sapien
aatctgatctgctaagactggtgtc

SEQ ID NO: 578764 - DNA, 25 bp, Homo sapien
gaggagaagcctcacaatgaacccc

SEQ ID NO: 578765 - DNA, 25 bp, Homo sapien
accctgctggcacctatgtcttcga

SEQ ID NO: 578766 - DNA, 25 bp, Homo sapien
ctgctggcacctatgtcttcgactt

SEQ ID NO: 578767 - DNA, 25 bp, Homo sapien
tgctggcacctatgtcttcgacttc

SEQ ID NO: 578768 - DNA, 25 bp, Homo sapien
tggcacctatgtcttcgacttccag

SEQ ID NO: 578769 - DNA, 25 bp, Homo sapien
ggcacctatgtcttcgacttccagc

SEQ ID NO: 578770 - DNA, 25 bp, Homo sapien
tacccatccaagcattagtggccca

SEQ ID NO: 578771 - DNA, 25 bp, Homo sapien
atccaagcattagtggcccatcaac

SEQ ID NO: 578772 - DNA, 25 bp, Homo sapien
ttagtggcccatcaacataatacct

SEQ ID NO: 578773 - DNA, 25 bp, Homo sapien
ggcccatcaacataatacctagaga

SEQ ID NO: 578774 - DNA, 25 bp, Homo sapien
taatacctagagatacacaataaaa

SEQ ID NO: 578775 - DNA, 25 bp, Homo sapien
taatattttgccaattttcagctat

SEQ ID NO: 578776 - DNA, 25 bp, Homo sapien
gtgtatttgtccaggtaagtggata

SEQ ID NO: 578777 - DNA, 25 bp, Homo sapien
tatgtaacagttcgtaagcttttaa

SEQ ID NO: 578778 - DNA, 25 bp, Homo sapien
atacagagatttgtagtcctgccct

SEQ ID NO: 578779 - DNA, 25 bp, Homo sapien
agagatttgtagtcctgccctaggc

SEQ ID NO: 578780 - DNA, 25 bp, Homo sapien
agatttgtagtcctgccctaggccc

SEQ ID NO: 578781 - DNA, 25 bp, Homo sapien
tgagtgttccttcccttgtctgagt

SEQ ID NO: 578782 - DNA, 25 bp, Homo sapien
gatgtgcttatcatgttgtcttacg

SEQ ID NO: 578783 - DNA, 25 bp, Homo sapien
gcttatcatgttgtcttacgtatca

SEQ ID NO: 578784 - DNA, 25 bp, Homo sapien
tttgttgtcatatctgtccccttca

SEQ ID NO: 578785 - DNA, 25 bp, Homo sapien
ccttcaccatactgtgagctccaaa

SEQ ID NO: 578786 - DNA, 25 bp, Homo sapien
gtgatctttatacttcttatgctta

SEQ ID NO: 578787 - DNA, 25 bp, Homo sapien
tatacttcttatgcttagtacacaa

SEQ ID NO: 578788 - DNA, 25 bp, Homo sapien
tgcttagtacacaactagacatata

SEQ ID NO: 578789 - DNA, 25 bp, Homo sapien
tgaatacattggaagtgtttcattc

SEQ ID NO: 578790 - DNA, 25 bp, Homo sapien
aaaatactcatccattattctttgg

SEQ ID NO: 578791 - DNA, 25 bp, Homo sapien
ccattattctttggatagtagcata

SEQ ID NO: 578792 - DNA, 25 bp, Homo sapien
ggaggtggtggtatcctaatgcaaa

SEQ ID NO: 578793 - DNA, 25 bp, Homo sapien
gtggtggtatcctaatgcaaatgct

SEQ ID NO: 578794 - DNA, 25 bp, Homo sapien
ggtggtatcctaatgcaaatgctgc

SEQ ID NO: 578795 - DNA, 25 bp, Homo sapien
ggtatcctaatgcaaatgctgccct

SEQ ID NO: 578796 - DNA, 25 bp, Homo sapien
tatcctaatgcaaatgctgccctcc

SEQ ID NO: 578797 - DNA, 25 bp, Homo sapien
ccccacctctacaatcttgagttta

SEQ ID NO: 578798 - DNA, 25 bp, Homo sapien
cccacctctacaatcttgagtttac

SEQ ID NO: 578799 - DNA, 25 bp, Homo sapien
acctctacaatcttgagtttactga

SEQ ID NO: 578800 - DNA, 25 bp, Homo sapien
tacaatcttgagtttactgagacag

SEQ ID NO: 578801 - DNA, 25 bp, Homo sapien
aatcttgagtttactgagacagacg

SEQ ID NO: 578802 - DNA, 25 bp, Homo sapien
cttgagtttactgagacagacgcca

SEQ ID NO: 578803 - DNA, 25 bp, Homo sapien
gagcctcattatattcctattggac

SEQ ID NO: 578804 - DNA, 25 bp, Homo sapien
tatattcctattggacagtgccagt

SEQ ID NO: 578805 - DNA, 25 bp, Homo sapien
gtgccagtccaatacaacctaattt

SEQ ID NO: 578806 - DNA, 25 bp, Homo sapien
aaggactatattcagtctcttcctg

SEQ ID NO: 578807 - DNA, 25 bp, Homo sapien
agtctcttcctgatacagccttcct

SEQ ID NO: 578808 - DNA, 25 bp, Homo sapien
ctggtttcagctgtgtcaggtagtt

SEQ ID NO: 578809 - DNA, 25 bp, Homo sapien
cagctgtgtcaggtagtttagtaac

SEQ ID NO: 578810 - DNA, 25 bp, Homo sapien
tcagtactggttaggtaactccccg

SEQ ID NO: 578811 - DNA, 25 bp, Homo sapien
ccaccaaatatcagtgcccttttaa

SEQ ID NO: 578812 - DNA, 25 bp, Homo sapien
agtgcccttttaagcatataagaca

SEQ ID NO: 578813 - DNA, 25 bp, Homo sapien
gacaaagttcactgcatagactaca

SEQ ID NO: 578814 - DNA, 25 bp, Homo sapien
agaaggtcccaggtccacagggcct

SEQ ID NO: 578815 - DNA, 25 bp, Homo sapien
agggcctgcgcaacactgggtgcca

SEQ ID NO: 578816 - DNA, 25 bp, Homo sapien
ggagtggctgacaagcggacaccca

SEQ ID NO: 578817 - DNA, 25 bp, Homo sapien
tgacaagcggacacccaccagggtg

SEQ ID NO: 578818 - DNA, 25 bp, Homo sapien
accagggtgccactcgcttgtgcct

SEQ ID NO: 578819 - DNA, 25 bp, Homo sapien
gaagcaaatgtgctcgcttgacccg

SEQ ID NO: 578820 - DNA, 25 bp, Homo sapien
ttgacccgtctgatgtgctgccgtg

SEQ ID NO: 578821 - DNA, 25 bp, Homo sapien
atgtgctgccgtgggcacttgactg

SEQ ID NO: 578822 - DNA, 25 bp, Homo sapien
taggctaacccaaagtgacacatgc

SEQ ID NO: 578823 - DNA, 25 bp, Homo sapien
atgcctggcgggatgttcagtctct

SEQ ID NO: 578824 - DNA, 25 bp, Homo sapien
ttcagtctctgtaaacccatatggt

SEQ ID NO: 578825 - DNA, 25 bp, Homo sapien
caataggtgatttagttaggaggtg

SEQ ID NO: 578826 - DNA, 25 bp, Homo sapien
ttaggaggtgatccctgttttccca

SEQ ID NO: 578827 - DNA, 25 bp, Homo sapien
tcccattctctggttgatgtttggc

SEQ ID NO: 578828 - DNA, 25 bp, Homo sapien
ttctctggttgatgtttggcatgtc

SEQ ID NO: 578829 - DNA, 25 bp, Homo sapien
ctggttgatgtttggcatgtctgta

SEQ ID NO: 578830 - DNA, 25 bp, Homo sapien
ttgatgtttggcatgtctgtaagca

SEQ ID NO: 578831 - DNA, 25 bp, Homo sapien
ggtttttatatatagtattccatac

SEQ ID NO: 578832 - DNA, 25 bp, Homo sapien
tagtattccatacagtaactcagta

SEQ ID NO: 578833 - DNA, 25 bp, Homo sapien
cagtaactcagtatggcagcttaga

SEQ ID NO: 578834 - DNA, 25 bp, Homo sapien
gtaactcagtatggcagcttagaat

SEQ ID NO: 578835 - DNA, 25 bp, Homo sapien
ggcagcttagaatttttaccttcat

SEQ ID NO: 578836 - DNA, 25 bp, Homo sapien
tgaaagttgaaaatgaagcccagtg

SEQ ID NO: 578837 - DNA, 25 bp, Homo sapien
agtgcggtgtgctgttgtctcagct

SEQ ID NO: 578838 - DNA, 25 bp, Homo sapien
gtgcggtgtgctgttgtctcagcta

SEQ ID NO: 578839 - DNA, 25 bp, Homo sapien
aataaacttagcaagtatcaggctt

SEQ ID NO: 578840 - DNA, 25 bp, Homo sapien
taaacttagcaagtatcaggcttaa

SEQ ID NO: 578841 - DNA, 25 bp, Homo sapien
aaacttagcaagtatcaggcttaat

SEQ ID NO: 578842 - DNA, 25 bp, Homo sapien
aacttagcaagtatcaggcttaatt

SEQ ID NO: 578843 - DNA, 25 bp, Homo sapien
acttagcaagtatcaggcttaattt

SEQ ID NO: 578844 - DNA, 25 bp, Homo sapien
cttagcaagtatcaggcttaattta

SEQ ID NO: 578845 - DNA, 25 bp, Homo sapien
tagcaagtatcaggcttaatttaaa

SEQ ID NO: 578846 - DNA, 25 bp, Homo sapien
gcaagtatcaggcttaatttaaaaa

SEQ ID NO: 578847 - DNA, 25 bp, Homo sapien
aagaaagaaataggcctacagtggc

SEQ ID NO: 578848 - DNA, 25 bp, Homo sapien
ggacaacataggaacacctcctctc

SEQ ID NO: 578849 - DNA, 25 bp, Homo sapien
gacaacataggaacacctcctctct

SEQ ID NO: 578850 - DNA, 25 bp, Homo sapien
aacataggaacacctcctctctaca

SEQ ID NO: 578851 - DNA, 25 bp, Homo sapien
ataggaacacctcctctctacagaa

SEQ ID NO: 578852 - DNA, 25 bp, Homo sapien
aggaacacctcctctctacagaaaa

SEQ ID NO: 578853 - DNA, 25 bp, Homo sapien
gaacacctcctctctacagaaaaga

SEQ ID NO: 578854 - DNA, 25 bp, Homo sapien
acacctcctctctacagaaaagatt

SEQ ID NO: 578855 - DNA, 25 bp, Homo sapien
acctcctctctacagaaaagattaa

SEQ ID NO: 578856 - DNA, 25 bp, Homo sapien
gtgggaggatccttcgagctaggag

SEQ ID NO: 578857 - DNA, 25 bp, Homo sapien
gtgagccatgtcataccgctgcact

SEQ ID NO: 578858 - DNA, 25 bp, Homo sapien
tagggcagtgagttgcaccaggtcc

SEQ ID NO: 578859 - DNA, 25 bp, Homo sapien
aggtccccaggctaggcagtcaatt

SEQ ID NO: 578860 - DNA, 25 bp, Homo sapien
agtcaattgaagtcgggctccagcc

SEQ ID NO: 578861 - DNA, 25 bp, Homo sapien
ctggctttttgctttatcacagcaa

SEQ ID NO: 578862 - DNA, 25 bp, Homo sapien
gactcagtaagagagtggccgtact

SEQ ID NO: 578863 - DNA, 25 bp, Homo sapien
tggccgtactgagcctcattagtaa

SEQ ID NO: 578864 - DNA, 25 bp, Homo sapien
agcagtgagacactacttcacaccc

SEQ ID NO: 578865 - DNA, 25 bp, Homo sapien
ttcacacccaccaggttgtcagaac

SEQ ID NO: 578866 - DNA, 25 bp, Homo sapien
gggcaaccagtactacttgcataca

SEQ ID NO: 578867 - DNA, 25 bp, Homo sapien
gtactacttgcatacactgttgcta

SEQ ID NO: 578868 - DNA, 25 bp, Homo sapien
acactgttgctaggagtgccagtca

SEQ ID NO: 578869 - DNA, 25 bp, Homo sapien
atgaatctgcttttctggaaggaaa

SEQ ID NO: 578870 - DNA, 25 bp, Homo sapien
taaccaggaatgcaaagagcttatc

SEQ ID NO: 578871 - DNA, 25 bp, Homo sapien
gaatgcaaagagcttatcacctcat

SEQ ID NO: 578872 - DNA, 25 bp, Homo sapien
gcaaagagcttatcacctcattatt

SEQ ID NO: 578873 - DNA, 25 bp, Homo sapien
agcttatcacctcattatttacaac

SEQ ID NO: 578874 - DNA, 25 bp, Homo sapien
ttatcacctcattatttacaacagt

SEQ ID NO: 578875 - DNA, 25 bp, Homo sapien
aaagtaagcctaaatcgggtgatag

SEQ ID NO: 578876 - DNA, 25 bp, Homo sapien
gcctaaatcgggtgatagttaatca

SEQ ID NO: 578877 - DNA, 25 bp, Homo sapien
atcaaattatagtagacacctctag

SEQ ID NO: 578878 - DNA, 25 bp, Homo sapien
aaaagatgcctactgttgcgctcag

SEQ ID NO: 578879 - DNA, 25 bp, Homo sapien
tagtagacacctctagacatatttt

SEQ ID NO: 578880 - DNA, 25 bp, Homo sapien
gggtgtatgacaatacattcaagct

SEQ ID NO: 578881 - DNA, 25 bp, Homo sapien
gtatgacaatacattcaagcttatg

SEQ ID NO: 578882 - DNA, 25 bp, Homo sapien
tacattcaagcttatgtacaaggca

SEQ ID NO: 578883 - DNA, 25 bp, Homo sapien
gtgtatgttgtttgtgcatgaaact

SEQ ID NO: 578884 - DNA, 25 bp, Homo sapien
gtttgtgcatgaaactgtaattcct

SEQ ID NO: 578885 - DNA, 25 bp, Homo sapien
gtgcatgaaactgtaattccttgac

SEQ ID NO: 578886 - DNA, 25 bp, Homo sapien
atgaaactgtaattccttgaccctg

SEQ ID NO: 578887 - DNA, 25 bp, Homo sapien
tgaaactgtaattccttgaccctga

SEQ ID NO: 578888 - DNA, 25 bp, Homo sapien
gaaactgtaattccttgaccctgaa

SEQ ID NO: 578889 - DNA, 25 bp, Homo sapien
attccttgaccctgaaaataggaca

SEQ ID NO: 578890 - DNA, 25 bp, Homo sapien
tgtgcctcatgacccgaccccaaat

SEQ ID NO: 578891 - DNA, 25 bp, Homo sapien
tggctaccctcagatacaatgatgg

SEQ ID NO: 578892 - DNA, 25 bp, Homo sapien
tcagatacaatgatggtaaccccat

SEQ ID NO: 578893 - DNA, 25 bp, Homo sapien
gatggtaaccccatgagtgctgtta

SEQ ID NO: 578894 - DNA, 25 bp, Homo sapien
taaccccatgagtgctgttaaagca

SEQ ID NO: 578895 - DNA, 25 bp, Homo sapien
gcaatttgacttattgtagacaggt

SEQ ID NO: 578896 - DNA, 25 bp, Homo sapien
gacaggttaacacatgagatgcgtt

SEQ ID NO: 578897 - DNA, 25 bp, Homo sapien
ataataggcagcattcaaagagcaa

SEQ ID NO: 578898 - DNA, 25 bp, Homo sapien
attcaaagagcaaatcgtggtcttt

SEQ ID NO: 578899 - DNA, 25 bp, Homo sapien
attttgtatttgagctgtccagtta

SEQ ID NO: 578900 - DNA, 25 bp, Homo sapien
gagctgtccagttattacaattaga

SEQ ID NO: 578901 - DNA, 25 bp, Homo sapien
atggtttccaaaaagcaactgcata

SEQ ID NO: 578902 - DNA, 25 bp, Homo sapien
cctatgactaaagtgaccccttgat

SEQ ID NO: 578903 - DNA, 25 bp, Homo sapien
atgactaaagtgaccccttgatccc

SEQ ID NO: 578904 - DNA, 25 bp, Homo sapien
tgactaaagtgaccccttgatcccc

SEQ ID NO: 578905 - DNA, 25 bp, Homo sapien
ctcccaaagcagtctccatatcata

SEQ ID NO: 578906 - DNA, 25 bp, Homo sapien
cccaaagcagtctccatatcataac

SEQ ID NO: 578907 - DNA, 25 bp, Homo sapien
agcagtctccatatcataactgtca

SEQ ID NO: 578908 - DNA, 25 bp, Homo sapien
gtctccatatcataactgtcaattg

SEQ ID NO: 578909 - DNA, 25 bp, Homo sapien
ccatatcataactgtcaattgtaaa

SEQ ID NO: 578910 - DNA, 25 bp, Homo sapien
gtattttatatattctccctaatag

SEQ ID NO: 578911 - DNA, 25 bp, Homo sapien
ttttatatattctccctaataggta

SEQ ID NO: 578912 - DNA, 25 bp, Homo sapien
atattctccctaataggtaactctg

SEQ ID NO: 578913 - DNA, 25 bp, Homo sapien
gctctccactcagtccttttaaaaa

SEQ ID NO: 578914 - DNA, 25 bp, Homo sapien
cagtccttttaaaaacgcgaggcag

SEQ ID NO: 578915 - DNA, 25 bp, Homo sapien
aggcaggatgaagaacgctattgaa

SEQ ID NO: 578916 - DNA, 25 bp, Homo sapien
taaaatgatcccacctgcaatttgg

SEQ ID NO: 578917 - DNA, 25 bp, Homo sapien
tgatcccacctgcaatttggatttt

SEQ ID NO: 578918 - DNA, 25 bp, Homo sapien
tcgggatcggtgtaaaattctacat

SEQ ID NO: 578919 - DNA, 25 bp, Homo sapien
aattctacatgcatacacgtatttg

SEQ ID NO: 578920 - DNA, 25 bp, Homo sapien
gcatacacgtatttgcacaagaata

SEQ ID NO: 578921 - DNA, 25 bp, Homo sapien
gaatatttatagcaacgtggttttt

SEQ ID NO: 578922 - DNA, 25 bp, Homo sapien
aaagctcaatacatccatactacga

SEQ ID NO: 578923 - DNA, 25 bp, Homo sapien
atactacgaatcactgaagagctgc

SEQ ID NO: 578924 - DNA, 25 bp, Homo sapien
taaagtagcctatttctaggtggtt

SEQ ID NO: 578925 - DNA, 25 bp, Homo sapien
cctatttctaggtggttaggcttga

SEQ ID NO: 578926 - DNA, 25 bp, Homo sapien
gtggttaggcttgaaaagatagact

SEQ ID NO: 578927 - DNA, 25 bp, Homo sapien
ttgtatttacttctaagaccgatgc

SEQ ID NO: 578928 - DNA, 25 bp, Homo sapien
ctaagaccgatgctgttttagctta

SEQ ID NO: 578929 - DNA, 25 bp, Homo sapien
gaccgatgctgttttagcttaactt

SEQ ID NO: 578930 - DNA, 25 bp, Homo sapien
gatgctgttttagcttaacttttaa

SEQ ID NO: 578931 - DNA, 25 bp, Homo sapien
gtaatattttacacgatcttgaagt

SEQ ID NO: 578932 - DNA, 25 bp, Homo sapien
tattttacacgatcttgaagttctt

SEQ ID NO: 578933 - DNA, 25 bp, Homo sapien
ggcttggaatgtatgattcttacta

SEQ ID NO: 578934 - DNA, 25 bp, Homo sapien
gtatgattcttactaatagatgttt

SEQ ID NO: 578935 - DNA, 25 bp, Homo sapien
aatgttttctatgaatcacttgcaa

SEQ ID NO: 578936 - DNA, 25 bp, Homo sapien
gttttctatgaatcacttgcaattt

SEQ ID NO: 578937 - DNA, 25 bp, Homo sapien
ctatgaatcacttgcaatttgatat

SEQ ID NO: 578938 - DNA, 25 bp, Homo sapien
aaatttacattataccacttctggg

SEQ ID NO: 578939 - DNA, 25 bp, Homo sapien
atttacattataccacttctgggca

SEQ ID NO: 578940 - DNA, 25 bp, Homo sapien
ttacattataccacttctgggcact

SEQ ID NO: 578941 - DNA, 25 bp, Homo sapien
acattataccacttctgggcactgg

SEQ ID NO: 578942 - DNA, 25 bp, Homo sapien
ggcactggggacaaagctttcaatt

SEQ ID NO: 578943 - DNA, 25 bp, Homo sapien
tttgatgtaattgactatgctgtga

SEQ ID NO: 578944 - DNA, 25 bp, Homo sapien
tgatgtaattgactatgctgtgatt

SEQ ID NO: 578945 - DNA, 25 bp, Homo sapien
gattctttggatgctagatgacgag

SEQ ID NO: 578946 - DNA, 25 bp, Homo sapien
tcaagatatgaatgacggacttcaa

SEQ ID NO: 578947 - DNA, 25 bp, Homo sapien
gacggacttcaaaattctttagcag

SEQ ID NO: 578948 - DNA, 25 bp, Homo sapien
aaattctttagcagaccttgaaaat

SEQ ID NO: 578949 - DNA, 25 bp, Homo sapien
ctttagcagaccttgaaaattttat

SEQ ID NO: 578950 - DNA, 25 bp, Homo sapien
ttattaactctttatcacctaagta

SEQ ID NO: 578951 - DNA, 25 bp, Homo sapien
ctctttatcacctaagtaactatgt

SEQ ID NO: 578952 - DNA, 25 bp, Homo sapien
gagtaatagcttttcctgatacatt

SEQ ID NO: 578953 - DNA, 25 bp, Homo sapien
agcttttcctgatacattttattat

SEQ ID NO: 578954 - DNA, 25 bp, Homo sapien
gtaaaggagttgtaccacaccactt

SEQ ID NO: 578955 - DNA, 25 bp, Homo sapien
gagttgtaccacaccacttaaacat

SEQ ID NO: 578956 - DNA, 25 bp, Homo sapien
gttgtaccacaccacttaaacataa

SEQ ID NO: 578957 - DNA, 25 bp, Homo sapien
caaactgagaccctggaagaaaaga

SEQ ID NO: 578958 - DNA, 25 bp, Homo sapien
tcttactggaagtcaacgttgccac

SEQ ID NO: 578959 - DNA, 25 bp, Homo sapien
gaagtcaacgttgccacgacaggat

SEQ ID NO: 578960 - DNA, 25 bp, Homo sapien
aacgttgccacgacaggattaaagc

SEQ ID NO: 578961 - DNA, 25 bp, Homo sapien
aagaaacattatgggcctcctatct

SEQ ID NO: 578962 - DNA, 25 bp, Homo sapien
tcctatctcgtccttaatgttcaaa

SEQ ID NO: 578963 - DNA, 25 bp, Homo sapien
atgttcaaaacgcagggtatagcaa

SEQ ID NO: 578964 - DNA, 25 bp, Homo sapien
gaagaggtcgtcctcactcgtgaac

SEQ ID NO: 578965 - DNA, 25 bp, Homo sapien
tcactcgtgaactcagcatcgggtt

SEQ ID NO: 578966 - DNA, 25 bp, Homo sapien
actcagcatcgggttctacgtttat

SEQ ID NO: 578967 - DNA, 25 bp, Homo sapien
atcgggttctacgtttattctgctt

SEQ ID NO: 578968 - DNA, 25 bp, Homo sapien
accgcgcctacctgacgctgctctt

SEQ ID NO: 578969 - DNA, 25 bp, Homo sapien
tgacgctgctcttcgccaccagcat

SEQ ID NO: 578970 - DNA, 25 bp, Homo sapien
gctgctcttcgccaccagcatcgcg

SEQ ID NO: 578971 - DNA, 25 bp, Homo sapien
atcgggctgctctacgcgcgcctgg

SEQ ID NO: 578972 - DNA, 25 bp, Homo sapien
tcgggctgctctacgcgcgcctggc

SEQ ID NO: 578973 - DNA, 25 bp, Homo sapien
tcgcagcgcgcctccttcaagcggg

SEQ ID NO: 578974 - DNA, 25 bp, Homo sapien
agcgcgcctccttcaagcgggcccg

SEQ ID NO: 578975 - DNA, 25 bp, Homo sapien
gcgcctccttcaagcgggcccggcg

SEQ ID NO: 578976 - DNA, 25 bp, Homo sapien
tgggcatcgtgctgctcttctgggc

SEQ ID NO: 578977 - DNA, 25 bp, Homo sapien
gggcatcgtgctgctcttctgggcc

SEQ ID NO: 578978 - DNA, 25 bp, Homo sapien
agctgctcgcccagtaccaccaggc

SEQ ID NO: 578979 - DNA, 25 bp, Homo sapien
gccctgactgggacactctgcagga

SEQ ID NO: 578980 - DNA, 25 bp, Homo sapien
ccctgactgggacactctgcaggat

SEQ ID NO: 578981 - DNA, 25 bp, Homo sapien
cctgactgggacactctgcaggatg

SEQ ID NO: 578982 - DNA, 25 bp, Homo sapien
ctctgcaggatgtcaagcagtgccc

SEQ ID NO: 578983 - DNA, 25 bp, Homo sapien
tctgcaggatgtcaagcagtgcccc

SEQ ID NO: 578984 - DNA, 25 bp, Homo sapien
gcaggatgtcaagcagtgcccccaa

SEQ ID NO: 578985 - DNA, 25 bp, Homo sapien
ggatgtcaagcagtgcccccaaaag

SEQ ID NO: 578986 - DNA, 25 bp, Homo sapien
ccaaaagctgtcaaggccgtcctag

SEQ ID NO: 578987 - DNA, 25 bp, Homo sapien
caaaagctgtcaaggccgtcctaga

SEQ ID NO: 578988 - DNA, 25 bp, Homo sapien
aaaagctgtcaaggccgtcctagac

SEQ ID NO: 578989 - DNA, 25 bp, Homo sapien
aagctgtcaaggccgtcctagacca

SEQ ID NO: 578990 - DNA, 25 bp, Homo sapien
ctcctgactttacagctgctgaatt

SEQ ID NO: 578991 - DNA, 25 bp, Homo sapien
tggtagctaacaggaggctccatcc

SEQ ID NO: 578992 - DNA, 25 bp, Homo sapien
ggatcctgcccctgtccgtgagatt

SEQ ID NO: 578993 - DNA, 25 bp, Homo sapien
ccgtgagattcagccttgattaact

SEQ ID NO: 578994 - DNA, 25 bp, Homo sapien
gccttgattaactgtgttcccatgc

SEQ ID NO: 578995 - DNA, 25 bp, Homo sapien
tgtgttcccatgctggtcgtgagca

SEQ ID NO: 578996 - DNA, 25 bp, Homo sapien
tggtcgtgagcagggcaccatccta

SEQ ID NO: 578997 - DNA, 25 bp, Homo sapien
accatcctaggtccttctttatact

SEQ ID NO: 578998 - DNA, 25 bp, Homo sapien
tctccagccaaaatgggttgaaccg

SEQ ID NO: 578999 - DNA, 25 bp, Homo sapien
gggttgaaccgaggaacaaggacat

SEQ ID NO: 579000 - DNA, 25 bp, Homo sapien
agtgcaagtctctgctctgccatta

SEQ ID NO: 579001 - DNA, 25 bp, Homo sapien
tccatctaaatgacacctgaagcgc

SEQ ID NO: 579002 - DNA, 25 bp, Homo sapien
atctaaatgacacctgaagcgcgga

SEQ ID NO: 579003 - DNA, 25 bp, Homo sapien
ctaaatgacacctgaagcgcggatt

SEQ ID NO: 579004 - DNA, 25 bp, Homo sapien
taaatgacacctgaagcgcggattg

SEQ ID NO: 579005 - DNA, 25 bp, Homo sapien
aaatgacacctgaagcgcggattgt

SEQ ID NO: 579006 - DNA, 25 bp, Homo sapien
aatgacacctgaagcgcggattgta

SEQ ID NO: 579007 - DNA, 25 bp, Homo sapien
atgacacctgaagcgcggattgtag

SEQ ID NO: 579008 - DNA, 25 bp, Homo sapien
acctgaagcgcggattgtagatgaa

SEQ ID NO: 579009 - DNA, 25 bp, Homo sapien
gaagcgcggattgtagatgaagaaa

SEQ ID NO: 579010 - DNA, 25 bp, Homo sapien
cgcggattgtagatgaagaaactca

SEQ ID NO: 579011 - DNA, 25 bp, Homo sapien
gcgggaactgcttctcctgggccgc

SEQ ID NO: 579012 - DNA, 25 bp, Homo sapien
caaatgaccttactttcagaaagaa

SEQ ID NO: 579013 - DNA, 25 bp, Homo sapien
gggctaagctataagggattgtcct

SEQ ID NO: 579014 - DNA, 25 bp, Homo sapien
ggattgtccttctccctaaaatgct

SEQ ID NO: 579015 - DNA, 25 bp, Homo sapien
ggcccaggctgaggtctgtgactcc

SEQ ID NO: 579016 - DNA, 25 bp, Homo sapien
aggtctgtgactccagttggctaca

SEQ ID NO: 579017 - DNA, 25 bp, Homo sapien
gctacacagtgccagaaaggaatct

SEQ ID NO: 579018 - DNA, 25 bp, Homo sapien
aatctgtcatctcaggaaagcccct

SEQ ID NO: 579019 - DNA, 25 bp, Homo sapien
aagcccctcaaagatggcgaggcat

SEQ ID NO: 579020 - DNA, 25 bp, Homo sapien
tggttacagggcaagaggccaccct

SEQ ID NO: 579021 - DNA, 25 bp, Homo sapien
ccacccctgacttgctggaacttgt

SEQ ID NO: 579022 - DNA, 25 bp, Homo sapien
tgtgactgtcaaagctccattaata

SEQ ID NO: 579023 - DNA, 25 bp, Homo sapien
tcccaagctcaaagcatcgtggaga

SEQ ID NO: 579024 - DNA, 25 bp, Homo sapien
gcatcgtggagacagctgcttcaaa

SEQ ID NO: 579025 - DNA, 25 bp, Homo sapien
gacagctgcttcaaaacagtgttct

SEQ ID NO: 579026 - DNA, 25 bp, Homo sapien
aacagtgttctactgactttgcaga

SEQ ID NO: 579027 - DNA, 25 bp, Homo sapien
tgactttgcagacctatgccacaga

SEQ ID NO: 579028 - DNA, 25 bp, Homo sapien
gcagacctatgccacagacttaaaa

SEQ ID NO: 579029 - DNA, 25 bp, Homo sapien
gaagtctatgcgaaactcagctgga

SEQ ID NO: 579030 - DNA, 25 bp, Homo sapien
gagggaacagcaagccttacaggtt

SEQ ID NO: 579031 - DNA, 25 bp, Homo sapien
ttacaggttcgctatggtcagaaga

SEQ ID NO: 579032 - DNA, 25 bp, Homo sapien
gacaagttagcagtttccctgttcc

SEQ ID NO: 579033 - DNA, 25 bp, Homo sapien
attctaagctaatactcattgatgt

SEQ ID NO: 579034 - DNA, 25 bp, Homo sapien
ggattaaagcctgaaatgttgcctt

SEQ ID NO: 579035 - DNA, 25 bp, Homo sapien
aagcctgaaatgttgcctttgaaac

SEQ ID NO: 579036 - DNA, 25 bp, Homo sapien
gatacatccttaaaagcatgggcag

SEQ ID NO: 579037 - DNA, 25 bp, Homo sapien
catccttaaaagcatgggcagcaaa

SEQ ID NO: 579038 - DNA, 25 bp, Homo sapien
aaaaacagccagacaactatcaggg

SEQ ID NO: 579039 - DNA, 25 bp, Homo sapien
agatagtcacataggttcttttcta

SEQ ID NO: 579040 - DNA, 25 bp, Homo sapien
tttccctaagcattggccgggttga

SEQ ID NO: 579041 - DNA, 25 bp, Homo sapien
agcattggccgggttgagaaataaa

SEQ ID NO: 579042 - DNA, 25 bp, Homo sapien
taaagcttggcattcttgggagaca

SEQ ID NO: 579043 - DNA, 25 bp, Homo sapien
gcttggcattcttgggagacaatac

SEQ ID NO: 579044 - DNA, 25 bp, Homo sapien
ggcattcttgggagacaatacatgt

SEQ ID NO: 579045 - DNA, 25 bp, Homo sapien
atcttagaggacttgccactggaga

SEQ ID NO: 579046 - DNA, 25 bp, Homo sapien
aggacttgccactggagaactcagt

SEQ ID NO: 579047 - DNA, 25 bp, Homo sapien
actcagtggtgagagaccttggaaa

SEQ ID NO: 579048 - DNA, 25 bp, Homo sapien
atgtggctgcacataagtgtttctg

SEQ ID NO: 579049 - DNA, 25 bp, Homo sapien
agtgtttctgactagctaaggctac

SEQ ID NO: 579050 - DNA, 25 bp, Homo sapien
aggctacttcagacttttcactttc

SEQ ID NO: 579051 - DNA, 25 bp, Homo sapien
ttttccttccctgaattagatgcta

SEQ ID NO: 579052 - DNA, 25 bp, Homo sapien
atgctatgtcataaacttggtggtt

SEQ ID NO: 579053 - DNA, 25 bp, Homo sapien
atgcctgagaatgcgtttgtctgaa

SEQ ID NO: 579054 - DNA, 25 bp, Homo sapien
tgaaacgattttggcacttcccttt

SEQ ID NO: 579055 - DNA, 25 bp, Homo sapien
tggcacttccctttaatatgcttcc

SEQ ID NO: 579056 - DNA, 25 bp, Homo sapien
acttttcaagcccaccgataatcaa

SEQ ID NO: 579057 - DNA, 25 bp, Homo sapien
ttttcaagcccaccgataatcaaga

SEQ ID NO: 579058 - DNA, 25 bp, Homo sapien
ttcaagcccaccgataatcaagaaa

SEQ ID NO: 579059 - DNA, 25 bp, Homo sapien
aagcccaccgataatcaagaaactt

SEQ ID NO: 579060 - DNA, 25 bp, Homo sapien
gcccaccgataatcaagaaacttag

SEQ ID NO: 579061 - DNA, 25 bp, Homo sapien
atttcaaattgttccgagtaactat

SEQ ID NO: 579062 - DNA, 25 bp, Homo sapien
caaattgttccgagtaactatgttt

SEQ ID NO: 579063 - DNA, 25 bp, Homo sapien
gttccgagtaactatgtttttctat

SEQ ID NO: 579064 - DNA, 25 bp, Homo sapien
ctatgtttttctattggagacaaaa

SEQ ID NO: 579065 - DNA, 25 bp, Homo sapien
ggagacaaaatgaacatcgtaacgt

SEQ ID NO: 579066 - DNA, 25 bp, Homo sapien
gaacatcgtaacgtcaaagtaccaa

SEQ ID NO: 579067 - DNA, 25 bp, Homo sapien
gggctcgtctctcgaggttgcctct

SEQ ID NO: 579068 - DNA, 25 bp, Homo sapien
tgcctctggcgcgagtgaaggcctt

SEQ ID NO: 579069 - DNA, 25 bp, Homo sapien
aaggccttggtgaaggcagatcccg

SEQ ID NO: 579070 - DNA, 25 bp, Homo sapien
aggcagatcccgacgtgacgctagc

SEQ ID NO: 579071 - DNA, 25 bp, Homo sapien
atcccgacgtgacgctagcgggaca

SEQ ID NO: 579072 - DNA, 25 bp, Homo sapien
ctagcgggacaggaagccatcttca

SEQ ID NO: 579073 - DNA, 25 bp, Homo sapien
gaagccatcttcattctggcacgag

SEQ ID NO: 579074 - DNA, 25 bp, Homo sapien
ttcattctggcacgagccgcggaac

SEQ ID NO: 579075 - DNA, 25 bp, Homo sapien
cacgagccgcggaactgtttgtgga

SEQ ID NO: 579076 - DNA, 25 bp, Homo sapien
actgtttgtggagaccattgcaaaa

SEQ ID NO: 579077 - DNA, 25 bp, Homo sapien
gaatttgcttttctggaaggtactt

SEQ ID NO: 579078 - DNA, 25 bp, Homo sapien
caaagatggagaggtattcctaacc

SEQ ID NO: 579079 - DNA, 25 bp, Homo sapien
tggagaggtattcctaaccccctgg

SEQ ID NO: 579080 - DNA, 25 bp, Homo sapien
ccctgggttcctaatttctcacaga

SEQ ID NO: 579081 - DNA, 25 bp, Homo sapien
gggttcctaatttctcacagatttc

SEQ ID NO: 579082 - DNA, 25 bp, Homo sapien
agatttctcatttcagcactagctg

SEQ ID NO: 579083 - DNA, 25 bp, Homo sapien
agcactagctgaggtctggctatca

SEQ ID NO: 579084 - DNA, 25 bp, Homo sapien
gaggtctggctatcagcctgtcaca

SEQ ID NO: 579085 - DNA, 25 bp, Homo sapien
tggctatcagcctgtcacagagtta

SEQ ID NO: 579086 - DNA, 25 bp, Homo sapien
cagcctgtcacagagttaggagtat

SEQ ID NO: 579087 - DNA, 25 bp, Homo sapien
cagagttaggagtatgtcatcacag

SEQ ID NO: 579088 - DNA, 25 bp, Homo sapien
taggagtatgtcatcacagtgattt

SEQ ID NO: 579089 - DNA, 25 bp, Homo sapien
cctgctctcagtgggtaaggacaac

SEQ ID NO: 579090 - DNA, 25 bp, Homo sapien
gctctcagtgggtaaggacaaccat

SEQ ID NO: 579091 - DNA, 25 bp, Homo sapien
tctcagtgggtaaggacaaccatcc

SEQ ID NO: 579092 - DNA, 25 bp, Homo sapien
gtgggtaaggacaaccatcctgtga

SEQ ID NO: 579093 - DNA, 25 bp, Homo sapien
gtaaggacaaccatcctgtgaagtt

SEQ ID NO: 579094 - DNA, 25 bp, Homo sapien
ggacaaccatcctgtgaagttgtga

SEQ ID NO: 579095 - DNA, 25 bp, Homo sapien
caaccatcctgtgaagttgtgagga

SEQ ID NO: 579096 - DNA, 25 bp, Homo sapien
catcctgtgaagttgtgaggagcct

SEQ ID NO: 579097 - DNA, 25 bp, Homo sapien
ctgtgaagttgtgaggagcctgtta

SEQ ID NO: 579098 - DNA, 25 bp, Homo sapien
gtgaggagcctgttatgggttaaat

SEQ ID NO: 579099 - DNA, 25 bp, Homo sapien
ggagcctgttatgggttaaattgtg

SEQ ID NO: 579100 - DNA, 25 bp, Homo sapien
cagccaatgcaccacccatgaaaat

SEQ ID NO: 579101 - DNA, 25 bp, Homo sapien
caatgcaccacccatgaaaatctac

SEQ ID NO: 579102 - DNA, 25 bp, Homo sapien
gcaccacccatgaaaatctacattg

SEQ ID NO: 579103 - DNA, 25 bp, Homo sapien
cacccatgaaaatctacattggaat

SEQ ID NO: 579104 - DNA, 25 bp, Homo sapien
aaatctacattggaattttgatcag

SEQ ID NO: 579105 - DNA, 25 bp, Homo sapien
ggaattttgatcagtcatattgata

SEQ ID NO: 579106 - DNA, 25 bp, Homo sapien
aattaagaaggattgccacatttgt

SEQ ID NO: 579107 - DNA, 25 bp, Homo sapien
agaaggattgccacatttgtaggat

SEQ ID NO: 579108 - DNA, 25 bp, Homo sapien
acatttgtaggattgtcttctagtc

SEQ ID NO: 579109 - DNA, 25 bp, Homo sapien
gtcaagaagagatacctacccatgt

SEQ ID NO: 579110 - DNA, 25 bp, Homo sapien
gaagagatacctacccatgtaccag

SEQ ID NO: 579111 - DNA, 25 bp, Homo sapien
acacatcaagcaaaccaagtcagag

SEQ ID NO: 579112 - DNA, 25 bp, Homo sapien
tttaaactatctcctatttatcttt

SEQ ID NO: 579113 - DNA, 25 bp, Homo sapien
ctatttatctacagaacttgcgtgt

SEQ ID NO: 579114 - DNA, 25 bp, Homo sapien
aacttgcgtgtataattcttgtgta

SEQ ID NO: 579115 - DNA, 25 bp, Homo sapien
gtataattcttgtgtacatccttaa

SEQ ID NO: 579116 - DNA, 25 bp, Homo sapien
tcttgtgtacatccttaaatttaat

SEQ ID NO: 579117 - DNA, 25 bp, Homo sapien
tttccaaatcagaaccatgttgaag

SEQ ID NO: 579118 - DNA, 25 bp, Homo sapien
gaaccatgttgaagatacaagcgta

SEQ ID NO: 579119 - DNA, 25 bp, Homo sapien
aagcgtaaattgttaggctgctatt

SEQ ID NO: 579120 - DNA, 25 bp, Homo sapien
attgttaggctgctattttctagaa

SEQ ID NO: 579121 - DNA, 25 bp, Homo sapien
gaaaatgctgtaccttgacttttta

SEQ ID NO: 579122 - DNA, 25 bp, Homo sapien
cagtggacttgagctgggatggtct

SEQ ID NO: 579123 - DNA, 25 bp, Homo sapien
gatcctgatgccaggttacagggct

SEQ ID NO: 579124 - DNA, 25 bp, Homo sapien
cctgatgccaggttacagggctgag

SEQ ID NO: 579125 - DNA, 25 bp, Homo sapien
ttctcatcacctatcctggaactga

SEQ ID NO: 579126 - DNA, 25 bp, Homo sapien
acctatcctggaactgaatgcaatt

SEQ ID NO: 579127 - DNA, 25 bp, Homo sapien
ggaactgaatgcaattacttaaact

SEQ ID NO: 579128 - DNA, 25 bp, Homo sapien
tacttaaactcagtctcagcttcct

SEQ ID NO: 579129 - DNA, 25 bp, Homo sapien
cttaaactcagtctcagcttcctca

SEQ ID NO: 579130 - DNA, 25 bp, Homo sapien
gggaataatctgtccttcacagagg

SEQ ID NO: 579131 - DNA, 25 bp, Homo sapien
ccttcacagaggattatggtcattt

SEQ ID NO: 579132 - DNA, 25 bp, Homo sapien
tgagacaagatacataaagcacttt

SEQ ID NO: 579133 - DNA, 25 bp, Homo sapien
tgggctctgacctctgtacccacac

SEQ ID NO: 579134 - DNA, 25 bp, Homo sapien
ccaccatgtaaagtgctgggaagag

SEQ ID NO: 579135 - DNA, 25 bp, Homo sapien
tcacggcaagttgagggtccaggct

SEQ ID NO: 579136 - DNA, 25 bp, Homo sapien
cacggcaagttgagggtccaggctt

SEQ ID NO: 579137 - DNA, 25 bp, Homo sapien
tgacctagcagctaatctctgcggg

SEQ ID NO: 579138 - DNA, 25 bp, Homo sapien
gggcactgcggctacatggtgactc

SEQ ID NO: 579139 - DNA, 25 bp, Homo sapien
cactgcggctacatggtgactccag

SEQ ID NO: 579140 - DNA, 25 bp, Homo sapien
ggaactgatggattaaagtggaacc

SEQ ID NO: 579141 - DNA, 25 bp, Homo sapien
aagtggaaccaagcgaattgatttt

SEQ ID NO: 579142 - DNA, 25 bp, Homo sapien
gaaccaagcgaattgatttttctac

SEQ ID NO: 579143 - DNA, 25 bp, Homo sapien
agcgaattgatttttctactagttc

SEQ ID NO: 579144 - DNA, 25 bp, Homo sapien
tgatgtgcccacaagaagggaactt

SEQ ID NO: 579145 - DNA, 25 bp, Homo sapien
gaacttgccgaaaacttaggtgtga

SEQ ID NO: 579146 - DNA, 25 bp, Homo sapien
aaagggccagatgtaggcgacatca

SEQ ID NO: 579147 - DNA, 25 bp, Homo sapien
gagagaattaatgctcgccaatgaa

SEQ ID NO: 579148 - DNA, 25 bp, Homo sapien
tgctcgccaatgaactacgtgctga

SEQ ID NO: 579149 - DNA, 25 bp, Homo sapien
tacgtgctgacccagacgactgtgt

SEQ ID NO: 579150 - DNA, 25 bp, Homo sapien
gactgtgtctacatcgtcgtggact

SEQ ID NO: 579151 - DNA, 25 bp, Homo sapien
acatcgtcgtggactagccctagaa

SEQ ID NO: 579152 - DNA, 25 bp, Homo sapien
tagaatgccatccttcttcaggagc

SEQ ID NO: 579153 - DNA, 25 bp, Homo sapien
ttctggtgccactgacacctgggct

SEQ ID NO: 579154 - DNA, 25 bp, Homo sapien
atctcctctgcacttatgttatcaa

SEQ ID NO: 579155 - DNA, 25 bp, Homo sapien
tttaaatattaacagggctattctg

SEQ ID NO: 579156 - DNA, 25 bp, Homo sapien
ctattattataggttctttcactca

SEQ ID NO: 579157 - DNA, 25 bp, Homo sapien
ggttctttcactcatttatctggtc

SEQ ID NO: 579158 - DNA, 25 bp, Homo sapien
ttcactcatttatctggtcttactg

SEQ ID NO: 579159 - DNA, 25 bp, Homo sapien
atctggtcttactgatctgtacata

SEQ ID NO: 579160 - DNA, 25 bp, Homo sapien
actgatctgtacatattcgttataa

SEQ ID NO: 579161 - DNA, 25 bp, Homo sapien
gtaatagtgttaattgaggaccacc

SEQ ID NO: 579162 - DNA, 25 bp, Homo sapien
ggaaatactggtttccccatgccct

SEQ ID NO: 579163 - DNA, 25 bp, Homo sapien
tttccccatgcccttgatacaggtg

SEQ ID NO: 579164 - DNA, 25 bp, Homo sapien
catgcccttgatacaggtgggtgtt

SEQ ID NO: 579165 - DNA, 25 bp, Homo sapien
tgatacaggtgggtgttaattctct

SEQ ID NO: 579166 - DNA, 25 bp, Homo sapien
caaatacaaagctatgtcctaagat

SEQ ID NO: 579167 - DNA, 25 bp, Homo sapien
acaaagctatgtcctaagataattc

SEQ ID NO: 579168 - DNA, 25 bp, Homo sapien
gatatttatattcaacgtctagtat

SEQ ID NO: 579169 - DNA, 25 bp, Homo sapien
tagtataagaatatgacaatgcccc

SEQ ID NO: 579170 - DNA, 25 bp, Homo sapien
tatgaccttggatcagttgcttaaa

SEQ ID NO: 579171 - DNA, 25 bp, Homo sapien
gttgcttaaactttctccagctcag

SEQ ID NO: 579172 - DNA, 25 bp, Homo sapien
cttaaactttctccagctcagtttc

SEQ ID NO: 579173 - DNA, 25 bp, Homo sapien
gtaagatgaggctagtaactgtttc

SEQ ID NO: 579174 - DNA, 25 bp, Homo sapien
gatgaggctagtaactgtttctcct

SEQ ID NO: 579175 - DNA, 25 bp, Homo sapien
tgagtaaaatacatagcaccgtatt

SEQ ID NO: 579176 - DNA, 25 bp, Homo sapien
tacatagcaccgtatttagaatata

SEQ ID NO: 579177 - DNA, 25 bp, Homo sapien
gaagacacctctatggcaagatgat

SEQ ID NO: 579178 - DNA, 25 bp, Homo sapien
gatgatgatatccattcccagcaca

SEQ ID NO: 579179 - DNA, 25 bp, Homo sapien
gatatccattcccagcacaaaggag

SEQ ID NO: 579180 - DNA, 25 bp, Homo sapien
gtgcagcagttgagcagcttttcct

SEQ ID NO: 579181 - DNA, 25 bp, Homo sapien
tttcctttcttcctgaactatacct

SEQ ID NO: 579182 - DNA, 25 bp, Homo sapien
gaactataccttacagtgtggtttt

SEQ ID NO: 579183 - DNA, 25 bp, Homo sapien
aaaggattattgagcatcatgccat

SEQ ID NO: 579184 - DNA, 25 bp, Homo sapien
tgagcatcatgccatttcatcatcc

SEQ ID NO: 579185 - DNA, 25 bp, Homo sapien
tcatcatccccaagttcattggtag

SEQ ID NO: 579186 - DNA, 25 bp, Homo sapien
gaagttatcaagagttgtctgtatt

SEQ ID NO: 579187 - DNA, 25 bp, Homo sapien
tgtctgagacagttgagcaattaca

SEQ ID NO: 579188 - DNA, 25 bp, Homo sapien
ggtgcagcacatttcccaagggaaa

SEQ ID NO: 579189 - DNA, 25 bp, Homo sapien
gcacatttcccaagggaaagaccca

SEQ ID NO: 579190 - DNA, 25 bp, Homo sapien
caacagctcccttgatcagatggta

SEQ ID NO: 579191 - DNA, 25 bp, Homo sapien
acagctcccttgatcagatggtact

SEQ ID NO: 579192 - DNA, 25 bp, Homo sapien
gctcccttgatcagatggtactaga

SEQ ID NO: 579193 - DNA, 25 bp, Homo sapien
atcagatggtactagaggcccagct

SEQ ID NO: 579194 - DNA, 25 bp, Homo sapien
gatggtactagaggcccagctccgt

SEQ ID NO: 579195 - DNA, 25 bp, Homo sapien
ctgagaaccaaggacgcctggctta

SEQ ID NO: 579196 - DNA, 25 bp, Homo sapien
aaccaaggacgcctggcttacagtg

SEQ ID NO: 579197 - DNA, 25 bp, Homo sapien
gagatgtggcaatgtgattcctttt

SEQ ID NO: 579198 - DNA, 25 bp, Homo sapien
gtgattccttttgtaatctgattat

SEQ ID NO: 579199 - DNA, 25 bp, Homo sapien
gcagaatttagtcagataattttgc

SEQ ID NO: 579200 - DNA, 25 bp, Homo sapien
agtatgttgtatatgatgctgtgat

SEQ ID NO: 579201 - DNA, 25 bp, Homo sapien
aaacctggtggtatggaagcatgta

SEQ ID NO: 579202 - DNA, 25 bp, Homo sapien
ggtggtatggaagcatgtactcaaa

SEQ ID NO: 579203 - DNA, 25 bp, Homo sapien
ggaagcatgtactcaaaatatagac

SEQ ID NO: 579204 - DNA, 25 bp, Homo sapien
aaatatagacgtgcacgatggtggt

SEQ ID NO: 579205 - DNA, 25 bp, Homo sapien
tgcacgatggtggtgtggcttaccc

SEQ ID NO: 579206 - DNA, 25 bp, Homo sapien
cacgatggtggtgtggcttacccag

SEQ ID NO: 579207 - DNA, 25 bp, Homo sapien
tgtggcttacccaggatggaaacac

SEQ ID NO: 579208 - DNA, 25 bp, Homo sapien
tacttgcattcccactgcctttcat

SEQ ID NO: 579209 - DNA, 25 bp, Homo sapien
ttgcattcccactgcctttcatggg

SEQ ID NO: 579210 - DNA, 25 bp, Homo sapien
gatgcaatggcaatagctggcaatt

SEQ ID NO: 579211 - DNA, 25 bp, Homo sapien
aatagctggcaattcgcacatggcg

SEQ ID NO: 579212 - DNA, 25 bp, Homo sapien
ggcaattcgcacatggcgtcaaaca

SEQ ID NO: 579213 - DNA, 25 bp, Homo sapien
acaccactgccacagaagcttttta

SEQ ID NO: 579214 - DNA, 25 bp, Homo sapien
gctttttagctacaagccacgctat

SEQ ID NO: 579215 - DNA, 25 bp, Homo sapien
gccacgctatgcaacctttaagcaa

SEQ ID NO: 579216 - DNA, 25 bp, Homo sapien
gtaaaaacataccttcaactgcaga

SEQ ID NO: 579217 - DNA, 25 bp, Homo sapien
gcagaactcagttttatgacacctt

SEQ ID NO: 579218 - DNA, 25 bp, Homo sapien
atggacccaaatcgccttttccagg

SEQ ID NO: 579219 - DNA, 25 bp, Homo sapien
tctttttctgctggcattgcaagaa

SEQ ID NO: 579220 - DNA, 25 bp, Homo sapien
gctggcattgcaagaacgtaactaa

SEQ ID NO: 579221 - DNA, 25 bp, Homo sapien
tctggctccattctctggagccctg

SEQ ID NO: 579222 - DNA, 25 bp, Homo sapien
caccaaagaggcctactgctacgag

SEQ ID NO: 579223 - DNA, 25 bp, Homo sapien
aaagaggcctactgctacgagaacc

SEQ ID NO: 579224 - DNA, 25 bp, Homo sapien
gaggcctactgctacgagaaccctg

SEQ ID NO: 579225 - DNA, 25 bp, Homo sapien
atcttggcctcccagcagttgtgac

SEQ ID NO: 579226 - DNA, 25 bp, Homo sapien
ctcccagcagttgtgacgggcagtt

SEQ ID NO: 579227 - DNA, 25 bp, Homo sapien
ccagcagttgtgacgggcagttgct

SEQ ID NO: 579228 - DNA, 25 bp, Homo sapien
acgggcagttgctgcgcagaccgcc

SEQ ID NO: 579229 - DNA, 25 bp, Homo sapien
tgcttccccttctgtgcaaataaac

SEQ ID NO: 579230 - DNA, 25 bp, Homo sapien
cttccccttctgtgcaaataaacca

SEQ ID NO: 579231 - DNA, 25 bp, Homo sapien
ttctgtgcaaataaaccaggctgtt

SEQ ID NO: 579232 - DNA, 25 bp, Homo sapien
tgttccctgggatgccttagacggg

SEQ ID NO: 579233 - DNA, 25 bp, Homo sapien
ttaggtacatcgtgagcaaggagcc

SEQ ID NO: 579234 - DNA, 25 bp, Homo sapien
gagcaaggagcctgcattcccaggg

SEQ ID NO: 579235 - DNA, 25 bp, Homo sapien
ggcagggacagcatgtaaggtctta

SEQ ID NO: 579236 - DNA, 25 bp, Homo sapien
taaggtcttagtccagctctgtgat

SEQ ID NO: 579237 - DNA, 25 bp, Homo sapien
aggcaaagcctctatgtgtgaaaca

SEQ ID NO: 579238 - DNA, 25 bp, Homo sapien
agaacaagagcactccatccatgtg

SEQ ID NO: 579239 - DNA, 25 bp, Homo sapien
tccatgtgcggatgactgtcaaggt

SEQ ID NO: 579240 - DNA, 25 bp, Homo sapien
ctgagacctacagtgatctggaaaa

SEQ ID NO: 579241 - DNA, 25 bp, Homo sapien
tggaaaattaaagctctctggccgc

SEQ ID NO: 579242 - DNA, 25 bp, Homo sapien
tttcctctcaggacatacttctgga

SEQ ID NO: 579243 - DNA, 25 bp, Homo sapien
atcgtctggtgatgggtctggcctc

SEQ ID NO: 579244 - DNA, 25 bp, Homo sapien
aggcagcgaccctgttccagagggc

SEQ ID NO: 579245 - DNA, 25 bp, Homo sapien
gttccagagggcttctgcgagtcct

SEQ ID NO: 579246 - DNA, 25 bp, Homo sapien
acggacggaatgtgtgtgcagctca

SEQ ID NO: 579247 - DNA, 25 bp, Homo sapien
gaatgtgtgtgcagctcagccttca

SEQ ID NO: 579248 - DNA, 25 bp, Homo sapien
ttcagagcgtgcattccccagccag

SEQ ID NO: 579249 - DNA, 25 bp, Homo sapien
agccaggaggcgaccactcagagga

SEQ ID NO: 579250 - DNA, 25 bp, Homo sapien
gaggcgaccactcagaggaactctg

SEQ ID NO: 579251 - DNA, 25 bp, Homo sapien
tctgggaaacccacttttgtgcaaa

SEQ ID NO: 579252 - DNA, 25 bp, Homo sapien
acccacttttgtgcaaatgctgttt

SEQ ID NO: 579253 - DNA, 25 bp, Homo sapien
aacacaaaggctagtgaaccgttca

SEQ ID NO: 579254 - DNA, 25 bp, Homo sapien
cctctgtcttccagccatgcattgt

SEQ ID NO: 579255 - DNA, 25 bp, Homo sapien
ttccttccacactccttattgtcaa

SEQ ID NO: 579256 - DNA, 25 bp, Homo sapien
ccacactccttattgtcaaagccta

SEQ ID NO: 579257 - DNA, 25 bp, Homo sapien
ttgtcaaagcctaacatggagccag

SEQ ID NO: 579258 - DNA, 25 bp, Homo sapien
caaagcctaacatggagccagctgg

SEQ ID NO: 579259 - DNA, 25 bp, Homo sapien
aagtgtggcctgtagagttcagccc

SEQ ID NO: 579260 - DNA, 25 bp, Homo sapien
tggcctgtagagttcagccccagta

SEQ ID NO: 579261 - DNA, 25 bp, Homo sapien
agagttcagccccagtattacaaag

SEQ ID NO: 579262 - DNA, 25 bp, Homo sapien
gttcagccccagtattacaaagcag

SEQ ID NO: 579263 - DNA, 25 bp, Homo sapien
gccccagtattacaaagcaggatga

SEQ ID NO: 579264 - DNA, 25 bp, Homo sapien
gaaattgggattggagctgaaagac

SEQ ID NO: 579265 - DNA, 25 bp, Homo sapien
ttctggcttttaaagtgattattca

SEQ ID NO: 579266 - DNA, 25 bp, Homo sapien
atgaatttgtcaattttcacttttt

SEQ ID NO: 579267 - DNA, 25 bp, Homo sapien
gtgcattagtgggaatatgtctatg

SEQ ID NO: 579268 - DNA, 25 bp, Homo sapien
aaccaatatttgtcaatctccatag

SEQ ID NO: 579269 - DNA, 25 bp, Homo sapien
tgtcaatctccatagaacagttttc

SEQ ID NO: 579270 - DNA, 25 bp, Homo sapien
gaacagttttcaatctggattagat

SEQ ID NO: 579271 - DNA, 25 bp, Homo sapien
caatctggattagattacacgtata

SEQ ID NO: 579272 - DNA, 25 bp, Homo sapien
gcttcatattttcattacacattgg

SEQ ID NO: 579273 - DNA, 25 bp, Homo sapien
tacacattggtgaacatctcccttc

SEQ ID NO: 579274 - DNA, 25 bp, Homo sapien
tggtgaacatctcccttcgtggaac

SEQ ID NO: 579275 - DNA, 25 bp, Homo sapien
gggtaatcatatcactaattttgta

SEQ ID NO: 579276 - DNA, 25 bp, Homo sapien
ttgcagaaaacagggtgctcagctt

SEQ ID NO: 579277 - DNA, 25 bp, Homo sapien
aaaacagggtgctcagcttagacga

SEQ ID NO: 579278 - DNA, 25 bp, Homo sapien
aacagggtgctcagcttagacgaga

SEQ ID NO: 579279 - DNA, 25 bp, Homo sapien
ggtgctcagcttagacgagagaaga

SEQ ID NO: 579280 - DNA, 25 bp, Homo sapien
agtcccagaagtgaccagaggacat

SEQ ID NO: 579281 - DNA, 25 bp, Homo sapien
tgaccagaggacatgcacttgcttt

SEQ ID NO: 579282 - DNA, 25 bp, Homo sapien
accagaggacatgcacttgctttgc

SEQ ID NO: 579283 - DNA, 25 bp, Homo sapien
cagaggacatgcacttgctttgcat

SEQ ID NO: 579284 - DNA, 25 bp, Homo sapien
ggacatgcacttgctttgcatggat

SEQ ID NO: 579285 - DNA, 25 bp, Homo sapien
tgcacttgctttgcatggatcaaga

SEQ ID NO: 579286 - DNA, 25 bp, Homo sapien
cacttgctttgcatggatcaagaaa

SEQ ID NO: 579287 - DNA, 25 bp, Homo sapien
tctcatgtgtccttgtactcttcct

SEQ ID NO: 579288 - DNA, 25 bp, Homo sapien
tcatgtgtccttgtactcttccttc

SEQ ID NO: 579289 - DNA, 25 bp, Homo sapien
atgtgtccttgtactcttccttcat

SEQ ID NO: 579290 - DNA, 25 bp, Homo sapien
gtgtccttgtactcttccttcataa

SEQ ID NO: 579291 - DNA, 25 bp, Homo sapien
gtccttgtactcttccttcataacg

SEQ ID NO: 579292 - DNA, 25 bp, Homo sapien
ttgtactcttccttcataacgctta

SEQ ID NO: 579293 - DNA, 25 bp, Homo sapien
tgtactcttccttcataacgcttat

SEQ ID NO: 579294 - DNA, 25 bp, Homo sapien
gtactcttccttcataacgcttatt

SEQ ID NO: 579295 - DNA, 25 bp, Homo sapien
actcttccttcataacgcttattac

SEQ ID NO: 579296 - DNA, 25 bp, Homo sapien
tcttccttcataacgcttattacag

SEQ ID NO: 579297 - DNA, 25 bp, Homo sapien
ccttcataacgcttattacagttga

SEQ ID NO: 579298 - DNA, 25 bp, Homo sapien
gcagtgatgggcagctgaccactcc

SEQ ID NO: 579299 - DNA, 25 bp, Homo sapien
agtgatgggcagctgaccactccct

SEQ ID NO: 579300 - DNA, 25 bp, Homo sapien
atgggcagctgaccactccctcaga

SEQ ID NO: 579301 - DNA, 25 bp, Homo sapien
gaccactccctcagacaggagctgg

SEQ ID NO: 579302 - DNA, 25 bp, Homo sapien
aactctctaccacatgtcacagctg

SEQ ID NO: 579303 - DNA, 25 bp, Homo sapien
actctctaccacatgtcacagctgg

SEQ ID NO: 579304 - DNA, 25 bp, Homo sapien
gggaaatagctggaccatgcacgat

SEQ ID NO: 579305 - DNA, 25 bp, Homo sapien
atagctggaccatgcacgattgtaa

SEQ ID NO: 579306 - DNA, 25 bp, Homo sapien
tagctggaccatgcacgattgtaaa

SEQ ID NO: 579307 - DNA, 25 bp, Homo sapien
gctggaccatgcacgattgtaaaga

SEQ ID NO: 579308 - DNA, 25 bp, Homo sapien
gaccatgcacgattgtaaagaagac

SEQ ID NO: 579309 - DNA, 25 bp, Homo sapien
ggagggttacgcacttacgtcagaa

SEQ ID NO: 579310 - DNA, 25 bp, Homo sapien
gaagagtagctctgttgagtctata

SEQ ID NO: 579311 - DNA, 25 bp, Homo sapien
gtctatagagatttggccccaggat

SEQ ID NO: 579312 - DNA, 25 bp, Homo sapien
gataagggtagcaccttctcttgtc

SEQ ID NO: 579313 - DNA, 25 bp, Homo sapien
ttctcttgtccactgtctatgatca

SEQ ID NO: 579314 - DNA, 25 bp, Homo sapien
gatcaaggtggccagaccaaccctg

SEQ ID NO: 579315 - DNA, 25 bp, Homo sapien
gggctagaacatggtagaccctact

SEQ ID NO: 579316 - DNA, 25 bp, Homo sapien
gaccctactggtgacatctgaaaat

SEQ ID NO: 579317 - DNA, 25 bp, Homo sapien
aaatggtttggctttacgtagatga

SEQ ID NO: 579318 - DNA, 25 bp, Homo sapien
atgtgcaaagaccttgcccattctg

SEQ ID NO: 579319 - DNA, 25 bp, Homo sapien
gcccattctgtctcactttttaaga

SEQ ID NO: 579320 - DNA, 25 bp, Homo sapien
agatcctggctagatctgcctctgt

SEQ ID NO: 579321 - DNA, 25 bp, Homo sapien
ggctagatctgcctctgttttgctg

SEQ ID NO: 579322 - DNA, 25 bp, Homo sapien
tgttttgctggtcaaaacctcttcc

SEQ ID NO: 579323 - DNA, 25 bp, Homo sapien
tttgctggtcaaaacctcttcccca

SEQ ID NO: 579324 - DNA, 25 bp, Homo sapien
ccacaagccagattgtttctgagga

SEQ ID NO: 579325 - DNA, 25 bp, Homo sapien
agagattggagtcctggtctcccta

SEQ ID NO: 579326 - DNA, 25 bp, Homo sapien
gagtcctggtctccctaagggaata

SEQ ID NO: 579327 - DNA, 25 bp, Homo sapien
tggtctccctaagggaatagccctc

SEQ ID NO: 579328 - DNA, 25 bp, Homo sapien
taagggaatagccctccacctgtgg

SEQ ID NO: 579329 - DNA, 25 bp, Homo sapien
ccccattgcattcagtttatctgta

SEQ ID NO: 579330 - DNA, 25 bp, Homo sapien
ggccttcattcgattgcatttccca

SEQ ID NO: 579331 - DNA, 25 bp, Homo sapien
aatattaactaacagagtgggagat

SEQ ID NO: 579332 - DNA, 25 bp, Homo sapien
ttcatgctatttcacacaaaatata

SEQ ID NO: 579333 - DNA, 25 bp, Homo sapien
actgcatcaccagattccatttctt

SEQ ID NO: 579334 - DNA, 25 bp, Homo sapien
ttccatttctttcagttcttactgg

SEQ ID NO: 579335 - DNA, 25 bp, Homo sapien
tcagttcttactggtagctcccaag

SEQ ID NO: 579336 - DNA, 25 bp, Homo sapien
agttcttactggtagctcccaagag

SEQ ID NO: 579337 - DNA, 25 bp, Homo sapien
ttcttactggtagctcccaagagct

SEQ ID NO: 579338 - DNA, 25 bp, Homo sapien
tggtagctcccaagagctctctgat

SEQ ID NO: 579339 - DNA, 25 bp, Homo sapien
acaaattggagattgtcctaagtaa

SEQ ID NO: 579340 - DNA, 25 bp, Homo sapien
cttcttttcaatactgctacacagg

SEQ ID NO: 579341 - DNA, 25 bp, Homo sapien
gctacacaggttatgcatttatgat

SEQ ID NO: 579342 - DNA, 25 bp, Homo sapien
tggaggccaaccaggttgctttata

SEQ ID NO: 579343 - DNA, 25 bp, Homo sapien
gccaaccaggttgctttatacttcg

SEQ ID NO: 579344 - DNA, 25 bp, Homo sapien
ccaggttgctttatacttcggtcaa

SEQ ID NO: 579345 - DNA, 25 bp, Homo sapien
ggttgctttatacttcggtcaaatg

SEQ ID NO: 579346 - DNA, 25 bp, Homo sapien
atacttcggtcaaatgatgctggaa

SEQ ID NO: 579347 - DNA, 25 bp, Homo sapien
cggtcaaatgatgctggaaggatat

SEQ ID NO: 579348 - DNA, 25 bp, Homo sapien
ggaaaggtacaagaagtctatctgt

SEQ ID NO: 579349 - DNA, 25 bp, Homo sapien
gaagtctatctgtggagcatactgt

SEQ ID NO: 579350 - DNA, 25 bp, Homo sapien
gagcatactgtattccaaccatcgg

SEQ ID NO: 579351 - DNA, 25 bp, Homo sapien
catactgtattccaaccatcggttg

SEQ ID NO: 579352 - DNA, 25 bp, Homo sapien
caaccatcggttgtgaggaaaatct

SEQ ID NO: 579353 - DNA, 25 bp, Homo sapien
acagttgataattttttagtgctta

SEQ ID NO: 579354 - DNA, 25 bp, Homo sapien
ggaccagtagtgttttgctctctct

SEQ ID NO: 579355 - DNA, 25 bp, Homo sapien
gaccagtagtgttttgctctctctt

SEQ ID NO: 579356 - DNA, 25 bp, Homo sapien
accagtagtgttttgctctctcttg

SEQ ID NO: 579357 - DNA, 25 bp, Homo sapien
ttgctctctcttgcaatctcagtgg

SEQ ID NO: 579358 - DNA, 25 bp, Homo sapien
tgctctctcttgcaatctcagtggt

SEQ ID NO: 579359 - DNA, 25 bp, Homo sapien
tctcttgcaatctcagtggttggca

SEQ ID NO: 579360 - DNA, 25 bp, Homo sapien
tcttgcaatctcagtggttggcagg

SEQ ID NO: 579361 - DNA, 25 bp, Homo sapien
aatgaatcagtgaactacatgcttt

SEQ ID NO: 579362 - DNA, 25 bp, Homo sapien
ggaagatgtttgttggactaagaga

SEQ ID NO: 579363 - DNA, 25 bp, Homo sapien
gatgtttgttggactaagagattag

SEQ ID NO: 579364 - DNA, 25 bp, Homo sapien
agacattactttgaggcatgaaaat

SEQ ID NO: 579365 - DNA, 25 bp, Homo sapien
ctgtgtctgtttctgcaatatatgt

SEQ ID NO: 579366 - DNA, 25 bp, Homo sapien
ggattttcacatggaacaagtaaaa

SEQ ID NO: 579367 - DNA, 25 bp, Homo sapien
gttcttgactgaatatgttggctgt

SEQ ID NO: 579368 - DNA, 25 bp, Homo sapien
ttgacattagaaacagctccttact

SEQ ID NO: 579369 - DNA, 25 bp, Homo sapien
accaatggatctcagctcttaagtg

SEQ ID NO: 579370 - DNA, 25 bp, Homo sapien
ggatctcagctcttaagtggatttc

SEQ ID NO: 579371 - DNA, 25 bp, Homo sapien
agctcttaagtggatttctagtgac

SEQ ID NO: 579372 - DNA, 25 bp, Homo sapien
ttctagtgactatgatacttgcatg

SEQ ID NO: 579373 - DNA, 25 bp, Homo sapien
tgatacttgcatgaagttcagggat

SEQ ID NO: 579374 - DNA, 25 bp, Homo sapien
agttcagggattggaatctatcact

SEQ ID NO: 579375 - DNA, 25 bp, Homo sapien
gaaaatgaccagatacaacaagaat

SEQ ID NO: 579376 - DNA, 25 bp, Homo sapien
aacaagaatttaacatggcagccaa

SEQ ID NO: 579377 - DNA, 25 bp, Homo sapien
ttaaataagatacccaaatgcagaa

SEQ ID NO: 579378 - DNA, 25 bp, Homo sapien
gcagaaagaaaagcacagtcgtcat

SEQ ID NO: 579379 - DNA, 25 bp, Homo sapien
gtcgtcatgcaaaatagtcactact

SEQ ID NO: 579380 - DNA, 25 bp, Homo sapien
atagtcactactcattcaaaaactc

SEQ ID NO: 579381 - DNA, 25 bp, Homo sapien
tctatagttgtctgagtcgttatgc

SEQ ID NO: 579382 - DNA, 25 bp, Homo sapien
gtcgttatgctcaaaatatccaata

SEQ ID NO: 579383 - DNA, 25 bp, Homo sapien
gaattgtaacagaaacatggcttta

SEQ ID NO: 579384 - DNA, 25 bp, Homo sapien
atggctttaccagtatgaccctcaa

SEQ ID NO: 579385 - DNA, 25 bp, Homo sapien
accagtatgaccctcaagacaaaat

SEQ ID NO: 579386 - DNA, 25 bp, Homo sapien
tgaaagacattgtgctgctgatccc

SEQ ID NO: 579387 - DNA, 25 bp, Homo sapien
gaaagacattgtgctgctgatccca

SEQ ID NO: 579388 - DNA, 25 bp, Homo sapien
aaagacattgtgctgctgatcccac

SEQ ID NO: 579389 - DNA, 25 bp, Homo sapien
aagacattgtgctgctgatcccacc

SEQ ID NO: 579390 - DNA, 25 bp, Homo sapien
agacattgtgctgctgatcccacct

SEQ ID NO: 579391 - DNA, 25 bp, Homo sapien
acattgtgctgctgatcccacctcc

SEQ ID NO: 579392 - DNA, 25 bp, Homo sapien
cattgtgctgctgatcccacctcct

SEQ ID NO: 579393 - DNA, 25 bp, Homo sapien
attgtgctgctgatcccacctcctg

SEQ ID NO: 579394 - DNA, 25 bp, Homo sapien
aaatcagtgtttatcagcagactgt

SEQ ID NO: 579395 - DNA, 25 bp, Homo sapien
cagtgtttatcagcagactgtaaag

SEQ ID NO: 579396 - DNA, 25 bp, Homo sapien
gactgtaaaggcaagtaggctctgt

SEQ ID NO: 579397 - DNA, 25 bp, Homo sapien
taaaggcaagtaggctctgtggatt

SEQ ID NO: 579398 - DNA, 25 bp, Homo sapien
aggcaagtaggctctgtggattaga

SEQ ID NO: 579399 - DNA, 25 bp, Homo sapien
tgtaaattccctccaacctgtacaa

SEQ ID NO: 579400 - DNA, 25 bp, Homo sapien
ctccctcaaatctgagtagccaagt

SEQ ID NO: 579401 - DNA, 25 bp, Homo sapien
ctgagtagccaagtatctagctttg

SEQ ID NO: 579402 - DNA, 25 bp, Homo sapien
gctttgtgtaattagacagcttcaa

SEQ ID NO: 579403 - DNA, 25 bp, Homo sapien
gacagcttcaagtatgtattttaaa

SEQ ID NO: 579404 - DNA, 25 bp, Homo sapien
ctgagttggaaatgatgcttagatt

SEQ ID NO: 579405 - DNA, 25 bp, Homo sapien
cttgaattattttacgccgtgaaag

SEQ ID NO: 579406 - DNA, 25 bp, Homo sapien
aatctgaagtactgtgtttctccgc

SEQ ID NO: 579407 - DNA, 25 bp, Homo sapien
tgaagtactgtgtttctccgctaga

SEQ ID NO: 579408 - DNA, 25 bp, Homo sapien
tactgtgtttctccgctagagggca

SEQ ID NO: 579409 - DNA, 25 bp, Homo sapien
gtgtttctccgctagagggcagact

SEQ ID NO: 579410 - DNA, 25 bp, Homo sapien
ttctccgctagagggcagactgcta

SEQ ID NO: 579411 - DNA, 25 bp, Homo sapien
agggcagactgctaatgaaatttca

SEQ ID NO: 579412 - DNA, 25 bp, Homo sapien
gactgctaatgaaatttcaggaccc

SEQ ID NO: 579413 - DNA, 25 bp, Homo sapien
aatttcaggaccctcactgactgca

SEQ ID NO: 579414 - DNA, 25 bp, Homo sapien
aggaccctcactgactgcagtagca

SEQ ID NO: 579415 - DNA, 25 bp, Homo sapien
accctcactgactgcagtagcagga

SEQ ID NO: 579416 - DNA, 25 bp, Homo sapien
ggaagctagaagttcaaaacgaggt

SEQ ID NO: 579417 - DNA, 25 bp, Homo sapien
aagttcaaaacgaggtgttggcagc

SEQ ID NO: 579418 - DNA, 25 bp, Homo sapien
gttcaaaacgaggtgttggcagcac

SEQ ID NO: 579419 - DNA, 25 bp, Homo sapien
caaaacgaggtgttggcagcaccat

SEQ ID NO: 579420 - DNA, 25 bp, Homo sapien
aaacgaggtgttggcagcaccatgc

SEQ ID NO: 579421 - DNA, 25 bp, Homo sapien
acgaggtgttggcagcaccatgctc

SEQ ID NO: 579422 - DNA, 25 bp, Homo sapien
gaggtgttggcagcaccatgctctc

SEQ ID NO: 579423 - DNA, 25 bp, Homo sapien
aggtgttggcagcaccatgctctct

SEQ ID NO: 579424 - DNA, 25 bp, Homo sapien
ggtgttggcagcaccatgctctctc

SEQ ID NO: 579425 - DNA, 25 bp, Homo sapien
aagatgctaggaagaatctgctcca

SEQ ID NO: 579426 - DNA, 25 bp, Homo sapien
gatgctaggaagaatctgctccatg

SEQ ID NO: 579427 - DNA, 25 bp, Homo sapien
gacctaggaaatgggacaatctact

SEQ ID NO: 579428 - DNA, 25 bp, Homo sapien
gggacaatctactaccaagaaccag

SEQ ID NO: 579429 - DNA, 25 bp, Homo sapien
aatctactaccaagaaccagctcca

SEQ ID NO: 579430 - DNA, 25 bp, Homo sapien
actaccaagaaccagctccaagaag

SEQ ID NO: 579431 - DNA, 25 bp, Homo sapien
aaacatctctgggaaacagtaccaa

SEQ ID NO: 579432 - DNA, 25 bp, Homo sapien
ggaaacagtaccaaaaggagtcact

SEQ ID NO: 579433 - DNA, 25 bp, Homo sapien
taccaaaaggagtcactgaattgtc

SEQ ID NO: 579434 - DNA, 25 bp, Homo sapien
ttggaggagtccaggatagctcttc

SEQ ID NO: 579435 - DNA, 25 bp, Homo sapien
attacatctatgagccttatgtgtg

SEQ ID NO: 579436 - DNA, 25 bp, Homo sapien
cttatgtgtggctttctccgatata

SEQ ID NO: 579437 - DNA, 25 bp, Homo sapien
ttatgtgtggctttctccgatatag

SEQ ID NO: 579438 - DNA, 25 bp, Homo sapien
atcattcatatgtagagttctcctg

SEQ ID NO: 579439 - DNA, 25 bp, Homo sapien
tgtagagttctcctgcagtatgtag

SEQ ID NO: 579440 - DNA, 25 bp, Homo sapien
gttctcctgcagtatgtagaaggtg

SEQ ID NO: 579441 - DNA, 25 bp, Homo sapien
gaaggtggacattgtcattttcaaa

SEQ ID NO: 579442 - DNA, 25 bp, Homo sapien
gtaattatggcctatctacctgact

SEQ ID NO: 579443 - DNA, 25 bp, Homo sapien
atggcctatctacctgactgtgcag

SEQ ID NO: 579444 - DNA, 25 bp, Homo sapien
atctacctgactgtgcagctatcaa

SEQ ID NO: 579445 - DNA, 25 bp, Homo sapien
gactgtgcagctatcaataataatt

SEQ ID NO: 579446 - DNA, 25 bp, Homo sapien
agaccatataacagggaaaagcatt

SEQ ID NO: 579447 - DNA, 25 bp, Homo sapien
cagtgatgtctactgtgtgaacata

SEQ ID NO: 579448 - DNA, 25 bp, Homo sapien
gtctactgtgtgaacatatactaga

SEQ ID NO: 579449 - DNA, 25 bp, Homo sapien
caccactgagttgcagcagtattaa

SEQ ID NO: 579450 - DNA, 25 bp, Homo sapien
gtcatactttatacagcatgcctag

SEQ ID NO: 579451 - DNA, 25 bp, Homo sapien
tttatacagcatgcctagtgcctgc

SEQ ID NO: 579452 - DNA, 25 bp, Homo sapien
tagtgcctgccccagtgcagatgct

SEQ ID NO: 579453 - DNA, 25 bp, Homo sapien
ggaaatatcgtccttacttaggagc

SEQ ID NO: 579454 - DNA, 25 bp, Homo sapien
tacttaggagcactcctgtcaatga

SEQ ID NO: 579455 - DNA, 25 bp, Homo sapien
attttgtgattagtgcttgctcctg

SEQ ID NO: 579456 - DNA, 25 bp, Homo sapien
tgattagtgcttgctcctgtccctg

SEQ ID NO: 579457 - DNA, 25 bp, Homo sapien
catgagcaagtgtcctccctttctc

SEQ ID NO: 579458 - DNA, 25 bp, Homo sapien
cctcctgcattgttgaggacacgtt

SEQ ID NO: 579459 - DNA, 25 bp, Homo sapien
gaggacacgtttcttgatacaaatt

SEQ ID NO: 579460 - DNA, 25 bp, Homo sapien
gacggtgacactggaatattagagc

SEQ ID NO: 579461 - DNA, 25 bp, Homo sapien
atattagagcaacaccatcatcagg

SEQ ID NO: 579462 - DNA, 25 bp, Homo sapien
tcaggaaagccttgacagacagccc

SEQ ID NO: 579463 - DNA, 25 bp, Homo sapien
acagacagccctttacaactctgga

SEQ ID NO: 579464 - DNA, 25 bp, Homo sapien
caactctggacacacttaagaagat

SEQ ID NO: 579465 - DNA, 25 bp, Homo sapien
gtgtcagccacaaaccaaaaaatac

SEQ ID NO: 579466 - DNA, 25 bp, Homo sapien
ggccaggccatgttaaagcatttac

SEQ ID NO: 579467 - DNA, 25 bp, Homo sapien
tacacatgtgcctgagtattttcta

SEQ ID NO: 579468 - DNA, 25 bp, Homo sapien
gtattttctaatacaccttccagtg

SEQ ID NO: 579469 - DNA, 25 bp, Homo sapien
tacaccttccagtgatttggagttg

SEQ ID NO: 579470 - DNA, 25 bp, Homo sapien
ggagttgttgcattttgactatgtt

SEQ ID NO: 579471 - DNA, 25 bp, Homo sapien
ggattaaagcctgaaatgttgcctt

SEQ ID NO: 579472 - DNA, 25 bp, Homo sapien
gatacatccttaaaagcatgggcag

SEQ ID NO: 579473 - DNA, 25 bp, Homo sapien
catccttaaaagcatgggcagcaaa

SEQ ID NO: 579474 - DNA, 25 bp, Homo sapien
gcaaaaacagccagacaactatcag

SEQ ID NO: 579475 - DNA, 25 bp, Homo sapien
aaaaacagccagacaactatcaggg

SEQ ID NO: 579476 - DNA, 25 bp, Homo sapien
tttccctaagcattggccgggttga

SEQ ID NO: 579477 - DNA, 25 bp, Homo sapien
tccctaagcattggccgggttgaga

SEQ ID NO: 579478 - DNA, 25 bp, Homo sapien
agcattggccgggttgagaaataaa

SEQ ID NO: 579479 - DNA, 25 bp, Homo sapien
taaagcttggcattcttgggagaca

SEQ ID NO: 579480 - DNA, 25 bp, Homo sapien
gcttggcattcttgggagacaatac

SEQ ID NO: 579481 - DNA, 25 bp, Homo sapien
ggcattcttgggagacaatacatgt

SEQ ID NO: 579482 - DNA, 25 bp, Homo sapien
agccccaggtcctgatgttacttgt

SEQ ID NO: 579483 - DNA, 25 bp, Homo sapien
aggtcctgatgttacttgtgccagc

SEQ ID NO: 579484 - DNA, 25 bp, Homo sapien
gatgttacttgtgccagcctggcca

SEQ ID NO: 579485 - DNA, 25 bp, Homo sapien
agtgcccggcctccagaagctgctg

SEQ ID NO: 579486 - DNA, 25 bp, Homo sapien
gttaacagggtcaaggccccagagc

SEQ ID NO: 579487 - DNA, 25 bp, Homo sapien
attgcggcaactgacagatgctccc

SEQ ID NO: 579488 - DNA, 25 bp, Homo sapien
gcaacctctgacagccacgtgtact

SEQ ID NO: 579489 - DNA, 25 bp, Homo sapien
cacgtgtactctcctgctttagaac

SEQ ID NO: 579490 - DNA, 25 bp, Homo sapien
tgctttagaacaaggacctttccct

SEQ ID NO: 579491 - DNA, 25 bp, Homo sapien
ctttcccttttgtgcatgaatacgc

SEQ ID NO: 579492 - DNA, 25 bp, Homo sapien
ttttgtgcatgaatacgctctcagc

SEQ ID NO: 579493 - DNA, 25 bp, Homo sapien
cttgccctcaaggaagagacactcg

SEQ ID NO: 579494 - DNA, 25 bp, Homo sapien
gagacactcgaccaaacaggcaact

SEQ ID NO: 579495 - DNA, 25 bp, Homo sapien
aactggaaacaggatggcttcgtgg

SEQ ID NO: 579496 - DNA, 25 bp, Homo sapien
gcttcgtgggcgtgtgtgacttaca

SEQ ID NO: 579497 - DNA, 25 bp, Homo sapien
gtgacttacacagggctgtgcactc

SEQ ID NO: 579498 - DNA, 25 bp, Homo sapien
gggctgtgcactcagaagaatcccg

SEQ ID NO: 579499 - DNA, 25 bp, Homo sapien
aagaatcccgtgactgacttaggct

SEQ ID NO: 579500 - DNA, 25 bp, Homo sapien
gtgactgacttaggctctgcagctg

SEQ ID NO: 579501 - DNA, 25 bp, Homo sapien
acttaggctctgcagctgccatctt

SEQ ID NO: 579502 - DNA, 25 bp, Homo sapien
acaaattatgtgaccggctctgatt

SEQ ID NO: 579503 - DNA, 25 bp, Homo sapien
gaaggctgaagaaactccacagaga

SEQ ID NO: 579504 - DNA, 25 bp, Homo sapien
aattttatctcagtcttgaagccaa

SEQ ID NO: 579505 - DNA, 25 bp, Homo sapien
ttgaagccaattcagtaggtgcatt

SEQ ID NO: 579506 - DNA, 25 bp, Homo sapien
gcattggaatcaagcctggctacct

SEQ ID NO: 579507 - DNA, 25 bp, Homo sapien
tggctacctgcatgctgttcctttt

SEQ ID NO: 579508 - DNA, 25 bp, Homo sapien
agccattttgctaagagacacagtc

SEQ ID NO: 579509 - DNA, 25 bp, Homo sapien
gagttcactttctttggactctgcc

SEQ ID NO: 579510 - DNA, 25 bp, Homo sapien
ggactctgcctatattttcttacct

SEQ ID NO: 579511 - DNA, 25 bp, Homo sapien
ttttcttacctgaacttttgcaagt

SEQ ID NO: 579512 - DNA, 25 bp, Homo sapien
ttgcaagttttcaggtaaacctcag

SEQ ID NO: 579513 - DNA, 25 bp, Homo sapien
gtaaacctcagctcaggactgctat

SEQ ID NO: 579514 - DNA, 25 bp, Homo sapien
ctcaggactgctatttagctcctct

SEQ ID NO: 579515 - DNA, 25 bp, Homo sapien
actttagtaaaggtcatcgagggct

SEQ ID NO: 579516 - DNA, 25 bp, Homo sapien
atcgagggcttctttgcattttaca

SEQ ID NO: 579517 - DNA, 25 bp, Homo sapien
ctgccaggtttgtccatactagtgt

SEQ ID NO: 579518 - DNA, 25 bp, Homo sapien
catactagtgttacggttttcttct

SEQ ID NO: 579519 - DNA, 25 bp, Homo sapien
ttcttcttgtagctcaatagtattt

SEQ ID NO: 579520 - DNA, 25 bp, Homo sapien
gtggagatactttgaagctctgtaa

SEQ ID NO: 579521 - DNA, 25 bp, Homo sapien
gtaaatatctggttactcctcaaaa

SEQ ID NO: 579522 - DNA, 25 bp, Homo sapien
tactcctcaaaacccactagattta

SEQ ID NO: 579523 - DNA, 25 bp, Homo sapien
aaacccactagatttagcatttcat

SEQ ID NO: 579524 - DNA, 25 bp, Homo sapien
ttcatggatgacttgtgtttgaaca

SEQ ID NO: 579525 - DNA, 25 bp, Homo sapien
agtattactgtgatggttgccagat

SEQ ID NO: 579526 - DNA, 25 bp, Homo sapien
gcagagtcattagcccttaggggaa

SEQ ID NO: 579527 - DNA, 25 bp, Homo sapien
gagtcattagcccttaggggaaatc

SEQ ID NO: 579528 - DNA, 25 bp, Homo sapien
agcccttaggggaaatcagatgatt

SEQ ID NO: 579529 - DNA, 25 bp, Homo sapien
atgattcaaaatataaatgcgggcc

SEQ ID NO: 579530 - DNA, 25 bp, Homo sapien
tgattcaaaatataaatgcgggccg

SEQ ID NO: 579531 - DNA, 25 bp, Homo sapien
gattcaaaatataaatgcgggccgg

SEQ ID NO: 579532 - DNA, 25 bp, Homo sapien
attcaaaatataaatgcgggccggg

SEQ ID NO: 579533 - DNA, 25 bp, Homo sapien
ttcaaaatataaatgcgggccgggc

SEQ ID NO: 579534 - DNA, 25 bp, Homo sapien
tcaaaatataaatgcgggccgggcc

SEQ ID NO: 579535 - DNA, 25 bp, Homo sapien
atataaatgcgggccgggcccggtg

SEQ ID NO: 579536 - DNA, 25 bp, Homo sapien
gagctgggattgatccactgcattc

SEQ ID NO: 579537 - DNA, 25 bp, Homo sapien
gaatgttgaaatagtcacagcccat

SEQ ID NO: 579538 - DNA, 25 bp, Homo sapien
gttgaaatagtcacagcccatggaa

SEQ ID NO: 579539 - DNA, 25 bp, Homo sapien
gaaatagtcacagcccatggaatca

SEQ ID NO: 579540 - DNA, 25 bp, Homo sapien
gtcacagcccatggaatcaatgttt

SEQ ID NO: 579541 - DNA, 25 bp, Homo sapien
acagcccatggaatcaatgttttgg

SEQ ID NO: 579542 - DNA, 25 bp, Homo sapien
catggaatcaatgttttgggtaaga

SEQ ID NO: 579543 - DNA, 25 bp, Homo sapien
ttcactgcatgaaaaatactctaat

SEQ ID NO: 579544 - DNA, 25 bp, Homo sapien
aaatttcatgtatttccagcctaaa

SEQ ID NO: 579545 - DNA, 25 bp, Homo sapien
atttcatgtatttccagcctaaaaa

SEQ ID NO: 579546 - DNA, 25 bp, Homo sapien
tttccagcctaaaaataacatctat

SEQ ID NO: 579547 - DNA, 25 bp, Homo sapien
tctattatagattttcctcatttta

SEQ ID NO: 579548 - DNA, 25 bp, Homo sapien
agggatgctgataataccttgctca

SEQ ID NO: 579549 - DNA, 25 bp, Homo sapien
gatgctgataataccttgctcaggg

SEQ ID NO: 579550 - DNA, 25 bp, Homo sapien
gggttgtccaaagctgtgttgtgca

SEQ ID NO: 579551 - DNA, 25 bp, Homo sapien
gtgttgtgcagtatggcagccacca

SEQ ID NO: 579552 - DNA, 25 bp, Homo sapien
gtgcagtatggcagccaccaccata

SEQ ID NO: 579553 - DNA, 25 bp, Homo sapien
aacacttgcaatgtgctgcttggaa

SEQ ID NO: 579554 - DNA, 25 bp, Homo sapien
gctgcttggaattgagatgcgctgc

SEQ ID NO: 579555 - DNA, 25 bp, Homo sapien
cttggaattgagatgcgctgcaaac

SEQ ID NO: 579556 - DNA, 25 bp, Homo sapien
atgcgctgcaaacgcaaagtacgtg

SEQ ID NO: 579557 - DNA, 25 bp, Homo sapien
aaaagaacgcaaaacatctcattaa

SEQ ID NO: 579558 - DNA, 25 bp, Homo sapien
atttttgtattgattccatattgaa

SEQ ID NO: 579559 - DNA, 25 bp, Homo sapien
gcagagtcattagcccttaggggaa

SEQ ID NO: 579560 - DNA, 25 bp, Homo sapien
cagagtcattagcccttaggggaaa

SEQ ID NO: 579561 - DNA, 25 bp, Homo sapien
agagtcattagcccttaggggaaat

SEQ ID NO: 579562 - DNA, 25 bp, Homo sapien
gagtcattagcccttaggggaaatc

SEQ ID NO: 579563 - DNA, 25 bp, Homo sapien
agtcattagcccttaggggaaatca

SEQ ID NO: 579564 - DNA, 25 bp, Homo sapien
gtcattagcccttaggggaaatcag

SEQ ID NO: 579565 - DNA, 25 bp, Homo sapien
tcattagcccttaggggaaatcaga

SEQ ID NO: 579566 - DNA, 25 bp, Homo sapien
cattagcccttaggggaaatcagat

SEQ ID NO: 579567 - DNA, 25 bp, Homo sapien
cccttaggggaaatcagatgattca

SEQ ID NO: 579568 - DNA, 25 bp, Homo sapien
acatatttttaattgtcgtaaagca

SEQ ID NO: 579569 - DNA, 25 bp, Homo sapien
attgtcgtaaagcatacataacatg

SEQ ID NO: 579570 - DNA, 25 bp, Homo sapien
gtcgtaaagcatacataacatgaaa

SEQ ID NO: 579571 - DNA, 25 bp, Homo sapien
ccattttaaccatgtttaagttcag

SEQ ID NO: 579572 - DNA, 25 bp, Homo sapien
accatgtttaagttcagtggcactc

SEQ ID NO: 579573 - DNA, 25 bp, Homo sapien
ctgtaccaaaaacaaacatgtaagc

SEQ ID NO: 579574 - DNA, 25 bp, Homo sapien
acatgtaagcaaacaaaaccctctg

SEQ ID NO: 579575 - DNA, 25 bp, Homo sapien
aaaaccctctgtgatgatctgacaa

SEQ ID NO: 579576 - DNA, 25 bp, Homo sapien
aaaccctctgtgatgatctgacaaa

SEQ ID NO: 579577 - DNA, 25 bp, Homo sapien
aaccctctgtgatgatctgacaaaa

SEQ ID NO: 579578 - DNA, 25 bp, Homo sapien
ccctctgtgatgatctgacaaaaaa

SEQ ID NO: 579579 - DNA, 25 bp, Homo sapien
aataagccagggattgtggcatgca

SEQ ID NO: 579580 - DNA, 25 bp, Homo sapien
ataagccagggattgtggcatgcac

SEQ ID NO: 579581 - DNA, 25 bp, Homo sapien
ggatggcttgcgctcaggaggcaga

SEQ ID NO: 579582 - DNA, 25 bp, Homo sapien
cagaggttacaggttacagtgagca

SEQ ID NO: 579583 - DNA, 25 bp, Homo sapien
agaggttacaggttacagtgagcaa

SEQ ID NO: 579584 - DNA, 25 bp, Homo sapien
gaggttacaggttacagtgagcaaa

SEQ ID NO: 579585 - DNA, 25 bp, Homo sapien
aggttacaggttacagtgagcaaag

SEQ ID NO: 579586 - DNA, 25 bp, Homo sapien
ggttacaggttacagtgagcaaaga

SEQ ID NO: 579587 - DNA, 25 bp, Homo sapien
gttacaggttacagtgagcaaagat

SEQ ID NO: 579588 - DNA, 25 bp, Homo sapien
ttacaggttacagtgagcaaagatt

SEQ ID NO: 579589 - DNA, 25 bp, Homo sapien
tacaggttacagtgagcaaagattg

SEQ ID NO: 579590 - DNA, 25 bp, Homo sapien
tctcatgtgtccttgtactcttcct

SEQ ID NO: 579591 - DNA, 25 bp, Homo sapien
atgtgtccttgtactcttccttcat

SEQ ID NO: 579592 - DNA, 25 bp, Homo sapien
gtgtccttgtactcttccttcataa

SEQ ID NO: 579593 - DNA, 25 bp, Homo sapien
gtccttgtactcttccttcataacg

SEQ ID NO: 579594 - DNA, 25 bp, Homo sapien
ttgtactcttccttcataacgctta

SEQ ID NO: 579595 - DNA, 25 bp, Homo sapien
gtactcttccttcataacgcttatt

SEQ ID NO: 579596 - DNA, 25 bp, Homo sapien
actcttccttcataacgcttattac

SEQ ID NO: 579597 - DNA, 25 bp, Homo sapien
tcttccttcataacgcttattacag

SEQ ID NO: 579598 - DNA, 25 bp, Homo sapien
ccttcataacgcttattacagttga

SEQ ID NO: 579599 - DNA, 25 bp, Homo sapien
aggaccagtagtgttttgctctctc

SEQ ID NO: 579600 - DNA, 25 bp, Homo sapien
gaactacatgctttggtctttacta

SEQ ID NO: 579601 - DNA, 25 bp, Homo sapien
tcaggtcgccaagcttcatgttcat

SEQ ID NO: 579602 - DNA, 25 bp, Homo sapien
gaagacttttgtcaagttcccacct

SEQ ID NO: 579603 - DNA, 25 bp, Homo sapien
cctgctgatggtaatcaccgtgtgt

SEQ ID NO: 579604 - DNA, 25 bp, Homo sapien
atcaccgtgtgtttgcagtaagttg

SEQ ID NO: 579605 - DNA, 25 bp, Homo sapien
acttcagttgtggacatatcggtta

SEQ ID NO: 579606 - DNA, 25 bp, Homo sapien
tatcggttatgtttcctcatcagct

SEQ ID NO: 579607 - DNA, 25 bp, Homo sapien
tcagcttggcttgcctcccaaaaga

SEQ ID NO: 579608 - DNA, 25 bp, Homo sapien
gaccccttaggagtctaatggctga

SEQ ID NO: 579609 - DNA, 25 bp, Homo sapien
taatggctgattgcctgcagagaat

SEQ ID NO: 579610 - DNA, 25 bp, Homo sapien
gaatcgttcaggatgatggtcacaa

SEQ ID NO: 579611 - DNA, 25 bp, Homo sapien
aaagcctgcatggatctggtcattt

SEQ ID NO: 579612 - DNA, 25 bp, Homo sapien
aacaaggcactctttatttggtcac

SEQ ID NO: 579613 - DNA, 25 bp, Homo sapien
ggcactctttatttggtcacgtttg

SEQ ID NO: 579614 - DNA, 25 bp, Homo sapien
gtcacgtttgacctaaactgtattg

SEQ ID NO: 579615 - DNA, 25 bp, Homo sapien
tgacctaaactgtattgccctggag

SEQ ID NO: 579616 - DNA, 25 bp, Homo sapien
ctaaactgtattgccctggagtaag

SEQ ID NO: 579617 - DNA, 25 bp, Homo sapien
tttcctcctgtcctataatatgctt

SEQ ID NO: 579618 - DNA, 25 bp, Homo sapien
ctcctgtcctataatatgcttttct

SEQ ID NO: 579619 - DNA, 25 bp, Homo sapien
atgcttttctttatatggtcacgtt

SEQ ID NO: 579620 - DNA, 25 bp, Homo sapien
ttatatggtcacgtttgtcctgcac

SEQ ID NO: 579621 - DNA, 25 bp, Homo sapien
gtttgtcctgcacagtagaacccta

SEQ ID NO: 579622 - DNA, 25 bp, Homo sapien
gtcctgcacagtagaaccctaaagt

SEQ ID NO: 579623 - DNA, 25 bp, Homo sapien
gtaactgaggctgcaccactgcgct

SEQ ID NO: 579624 - DNA, 25 bp, Homo sapien
ttcttaaagcaatcagtaggaattt

SEQ ID NO: 579625 - DNA, 25 bp, Homo sapien
tttattgaatgtttcctgggtccct

SEQ ID NO: 579626 - DNA, 25 bp, Homo sapien
ttgaatgtttcctgggtccctgtct

SEQ ID NO: 579627 - DNA, 25 bp, Homo sapien
gtccctgtcttgcagtaactaatca

SEQ ID NO: 579628 - DNA, 25 bp, Homo sapien
tgtcttgcagtaactaatcatttag

SEQ ID NO: 579629 - DNA, 25 bp, Homo sapien
aatcatttagatcaatgcttttcaa

SEQ ID NO: 579630 - DNA, 25 bp, Homo sapien
agcagcagtctgtaaattgttacca

SEQ ID NO: 579631 - DNA, 25 bp, Homo sapien
aaattgttaccagtttgcatgagaa

SEQ ID NO: 579632 - DNA, 25 bp, Homo sapien
accagtttgcatgagaaaggagcta

SEQ ID NO: 579633 - DNA, 25 bp, Homo sapien
gaagtaaatcagtgcactgcttcct

SEQ ID NO: 579634 - DNA, 25 bp, Homo sapien
atgtcttccatctccttcaattaaa

SEQ ID NO: 579635 - DNA, 25 bp, Homo sapien
acatatttttaattgtcgtaaagca

SEQ ID NO: 579636 - DNA, 25 bp, Homo sapien
ttgtcgtaaagcatacataacatga

SEQ ID NO: 579637 - DNA, 25 bp, Homo sapien
ccattttaaccatgtttaagttcag

SEQ ID NO: 579638 - DNA, 25 bp, Homo sapien
accatgtttaagttcagtggcactc

SEQ ID NO: 579639 - DNA, 25 bp, Homo sapien
tccagaactttttcacctttctgta

SEQ ID NO: 579640 - DNA, 25 bp, Homo sapien
ctgtaccaaaaacaaacatgtaagc

SEQ ID NO: 579641 - DNA, 25 bp, Homo sapien
acatgtaagcaaacaaaaccctctg

SEQ ID NO: 579642 - DNA, 25 bp, Homo sapien
aaaaccctctgtgatgatctgacaa

SEQ ID NO: 579643 - DNA, 25 bp, Homo sapien
aaccctctgtgatgatctgacaaaa

SEQ ID NO: 579644 - DNA, 25 bp, Homo sapien
ccctctgtgatgatctgacaaaaaa

SEQ ID NO: 579645 - DNA, 25 bp, Homo sapien
gaacgtgatttcagttgtttctaga

SEQ ID NO: 579646 - DNA, 25 bp, Homo sapien
cactttaaatgaggagaaggctttt

SEQ ID NO: 579647 - DNA, 25 bp, Homo sapien
atctggagagttcagattccctgtc

SEQ ID NO: 579648 - DNA, 25 bp, Homo sapien
ctctcctctttcaacctttaatgta

SEQ ID NO: 579649 - DNA, 25 bp, Homo sapien
aatccttttgattcagccactgtgt

SEQ ID NO: 579650 - DNA, 25 bp, Homo sapien
gattcagccactgtgtattgataat

SEQ ID NO: 579651 - DNA, 25 bp, Homo sapien
cactgtgtattgataatggcttatt

SEQ ID NO: 579652 - DNA, 25 bp, Homo sapien
gataatggcttatttattacaatca

SEQ ID NO: 579653 - DNA, 25 bp, Homo sapien
agatatgtagatactttgtcatctt

SEQ ID NO: 579654 - DNA, 25 bp, Homo sapien
tttgtcatcttttcttattatagaa

SEQ ID NO: 579655 - DNA, 25 bp, Homo sapien
aagaatttttattcagaacgcagat

SEQ ID NO: 579656 - DNA, 25 bp, Homo sapien
ttgagacacactaaactgtctggta

SEQ ID NO: 579657 - DNA, 25 bp, Homo sapien
acactaaactgtctggtaaaggagg

SEQ ID NO: 579658 - DNA, 25 bp, Homo sapien
tttggggagcacctgcctagtccaa

SEQ ID NO: 579659 - DNA, 25 bp, Homo sapien
agattaggaaagcatctatcatctc

SEQ ID NO: 579660 - DNA, 25 bp, Homo sapien
acttcacctccctgactataataac

SEQ ID NO: 579661 - DNA, 25 bp, Homo sapien
cacctccctgactataataacaaag

SEQ ID NO: 579662 - DNA, 25 bp, Homo sapien
aataacaaaggctattagagcacaa

SEQ ID NO: 579663 - DNA, 25 bp, Homo sapien
aaaactattgctactcggtcttcac

SEQ ID NO: 579664 - DNA, 25 bp, Homo sapien
aactattgctactcggtcttcacta

SEQ ID NO: 579665 - DNA, 25 bp, Homo sapien
attgctactcggtcttcactaatta

SEQ ID NO: 579666 - DNA, 25 bp, Homo sapien
gctactcggtcttcactaattaaaa

SEQ ID NO: 579667 - DNA, 25 bp, Homo sapien
attatgcatgtgtggtctgtctcta

SEQ ID NO: 579668 - DNA, 25 bp, Homo sapien
aaatatatttcctatagtacccagc

SEQ ID NO: 579669 - DNA, 25 bp, Homo sapien
atatatttcctatagtacccagcac

SEQ ID NO: 579670 - DNA, 25 bp, Homo sapien
atatttcctatagtacccagcacag

SEQ ID NO: 579671 - DNA, 25 bp, Homo sapien
tacccagcacagtgacttgcaccaa

SEQ ID NO: 579672 - DNA, 25 bp, Homo sapien
ccagcacagtgacttgcaccaaaca

SEQ ID NO: 579673 - DNA, 25 bp, Homo sapien
gcacagtgacttgcaccaaacaggt

SEQ ID NO: 579674 - DNA, 25 bp, Homo sapien
cagtgacttgcaccaaacaggtgtt

SEQ ID NO: 579675 - DNA, 25 bp, Homo sapien
gtgacttgcaccaaacaggtgttgc

SEQ ID NO: 579676 - DNA, 25 bp, Homo sapien
gacttgcaccaaacaggtgttgcaa

SEQ ID NO: 579677 - DNA, 25 bp, Homo sapien
tgcaccaaacaggtgttgcaaaaat

SEQ ID NO: 579678 - DNA, 25 bp, Homo sapien
tgacttcagcaagccggggatcaag

SEQ ID NO: 579679 - DNA, 25 bp, Homo sapien
gccggggatcaagagggccaccatc

SEQ ID NO: 579680 - DNA, 25 bp, Homo sapien
gggccaccatcaaagggcaaatcca

SEQ ID NO: 579681 - DNA, 25 bp, Homo sapien
tgcagggaagcaaggaagactcagt

SEQ ID NO: 579682 - DNA, 25 bp, Homo sapien
agcaaggaagactcagtgccgccag

SEQ ID NO: 579683 - DNA, 25 bp, Homo sapien
aaggaagactcagtgccgccaggaa

SEQ ID NO: 579684 - DNA, 25 bp, Homo sapien
ggaagactcagtgccgccaggaaaa

SEQ ID NO: 579685 - DNA, 25 bp, Homo sapien
actcagtgccgccaggaaaagagaa

SEQ ID NO: 579686 - DNA, 25 bp, Homo sapien
agagaaagagaatccattattggtg

SEQ ID NO: 579687 - DNA, 25 bp, Homo sapien
gaatccattattggtgaaaatccat

SEQ ID NO: 579688 - DNA, 25 bp, Homo sapien
aaatccattttaagctgtcagcccc

SEQ ID NO: 579689 - DNA, 25 bp, Homo sapien
ctggtacatgggtaggtatctcttc

SEQ ID NO: 579690 - DNA, 25 bp, Homo sapien
catgggtaggtatctcttcttgact

SEQ ID NO: 579691 - DNA, 25 bp, Homo sapien
ggtaggtatctcttcttgactagaa

SEQ ID NO: 579692 - DNA, 25 bp, Homo sapien
cttgactagaagacaatcctacaaa

SEQ ID NO: 579693 - DNA, 25 bp, Homo sapien
atcctacaaatgtggcaatccttct

SEQ ID NO: 579694 - DNA, 25 bp, Homo sapien
acaaatgtggcaatccttcttaatt

SEQ ID NO: 579695 - DNA, 25 bp, Homo sapien
gtggcaatccttcttaatttaatct

SEQ ID NO: 579696 - DNA, 25 bp, Homo sapien
gcaatccttcttaatttaatctgtc

SEQ ID NO: 579697 - DNA, 25 bp, Homo sapien
atgactgatcaaaattccaatgtag

SEQ ID NO: 579698 - DNA, 25 bp, Homo sapien
atgtagattttcatgggtggtgcat

SEQ ID NO: 579699 - DNA, 25 bp, Homo sapien
attttcatgggtggtgcattggctg

SEQ ID NO: 579700 - DNA, 25 bp, Homo sapien
gatggcaattatcttcacctgatgg

SEQ ID NO: 579701 - DNA, 25 bp, Homo sapien
aattatcttcacctgatggagtaga

SEQ ID NO: 579702 - DNA, 25 bp, Homo sapien
gatttaccaaaatcgcgagcatcca

SEQ ID NO: 579703 - DNA, 25 bp, Homo sapien
gcatccaaaagaacctgtggtgtga

SEQ ID NO: 579704 - DNA, 25 bp, Homo sapien
gaacctgtggtgtgaatgatgatga

SEQ ID NO: 579705 - DNA, 25 bp, Homo sapien
atgatgaaagtccaagcaaaatttt

SEQ ID NO: 579706 - DNA, 25 bp, Homo sapien
tttttatggtgggagaatctccaca

SEQ ID NO: 579707 - DNA, 25 bp, Homo sapien
agaatctccacaagtgtcttccaga

SEQ ID NO: 579708 - DNA, 25 bp, Homo sapien
ccacaagtgtcttccagacttcaga

SEQ ID NO: 579709 - DNA, 25 bp, Homo sapien
gaataatttaattcccaggcaactt

SEQ ID NO: 579710 - DNA, 25 bp, Homo sapien
attcccaggcaacttttcaagccca

SEQ ID NO: 579711 - DNA, 25 bp, Homo sapien
aacctcataattctggcaaggaaat

SEQ ID NO: 579712 - DNA, 25 bp, Homo sapien
taagaatctcgaacatcaggtatga

SEQ ID NO: 579713 - DNA, 25 bp, Homo sapien
gatgaatccaaggagactcacacca

SEQ ID NO: 579714 - DNA, 25 bp, Homo sapien
ggagactcacaccaaaccatattgt

SEQ ID NO: 579715 - DNA, 25 bp, Homo sapien
taaagacaatcttcagagcagcaag

SEQ ID NO: 579716 - DNA, 25 bp, Homo sapien
agcagcaagggaatagtctcttctt

SEQ ID NO: 579717 - DNA, 25 bp, Homo sapien
gggaatagtctcttcttacatacaa

SEQ ID NO: 579718 - DNA, 25 bp, Homo sapien
aaatgatccacggaagactgtcagc

SEQ ID NO: 579719 - DNA, 25 bp, Homo sapien
aagactgtcagcagacttcaccaga

SEQ ID NO: 579720 - DNA, 25 bp, Homo sapien
acttcaccagaaaactttcacgcca

SEQ ID NO: 579721 - DNA, 25 bp, Homo sapien
aactttcacgccagaaggcagtcgt

SEQ ID NO: 579722 - DNA, 25 bp, Homo sapien
gcccgtctgggcagaaaccatgtgg

SEQ ID NO: 579723 - DNA, 25 bp, Homo sapien
ccgtctgggcagaaaccatgtggaa

SEQ ID NO: 579724 - DNA, 25 bp, Homo sapien
gtctgggcagaaaccatgtggaaga

SEQ ID NO: 579725 - DNA, 25 bp, Homo sapien
tgggcagaaaccatgtggaagagct

SEQ ID NO: 579726 - DNA, 25 bp, Homo sapien
tgctgcgctgcctcggggcacacat

SEQ ID NO: 579727 - DNA, 25 bp, Homo sapien
ggcgactggaggaagccaggcgagt

SEQ ID NO: 579728 - DNA, 25 bp, Homo sapien
ggttccagtgagagaaaccaaccac

SEQ ID NO: 579729 - DNA, 25 bp, Homo sapien
gagaaaccaaccacaggcacccaag

SEQ ID NO: 579730 - DNA, 25 bp, Homo sapien
ggcacccaagcactaccagacaaag

SEQ ID NO: 579731 - DNA, 25 bp, Homo sapien
aagcactaccagacaaagcgtatta

SEQ ID NO: 579732 - DNA, 25 bp, Homo sapien
gacaaagcgtattaaacagaacact

SEQ ID NO: 579733 - DNA, 25 bp, Homo sapien
tatttttagctggttttgtccattt

SEQ ID NO: 579734 - DNA, 25 bp, Homo sapien
ttgtccattttcctaacaaagcagg

SEQ ID NO: 579735 - DNA, 25 bp, Homo sapien
ggtttctttttagtctgtctgttat

SEQ ID NO: 579736 - DNA, 25 bp, Homo sapien
tatataaacttgaagcctgactcca

SEQ ID NO: 579737 - DNA, 25 bp, Homo sapien
aagcctgactccattctatttgcct

SEQ ID NO: 579738 - DNA, 25 bp, Homo sapien
tctatttgcctggagttagtatact

SEQ ID NO: 579739 - DNA, 25 bp, Homo sapien
gagttagtatactttcttagggtga

SEQ ID NO: 579740 - DNA, 25 bp, Homo sapien
tcttagggtgaaaggaaggcagctt

SEQ ID NO: 579741 - DNA, 25 bp, Homo sapien
ggcagcttgtattgagccttttaaa

SEQ ID NO: 579742 - DNA, 25 bp, Homo sapien
tattgaatgcttgcaaattgctaac

SEQ ID NO: 579743 - DNA, 25 bp, Homo sapien
ttgctaacattcttttgtgtaaaat

SEQ ID NO: 579744 - DNA, 25 bp, Homo sapien
gaatttgtaataaggagtgctgaac

SEQ ID NO: 579745 - DNA, 25 bp, Homo sapien
aataaggagtgctgaacacagcctc

SEQ ID NO: 579746 - DNA, 25 bp, Homo sapien
acacagcctcctaagaatgtggttt

SEQ ID NO: 579747 - DNA, 25 bp, Homo sapien
gtttgagtgcttttagatgttataa

SEQ ID NO: 579748 - DNA, 25 bp, Homo sapien
tagatgttataaacaaggccatatg

SEQ ID NO: 579749 - DNA, 25 bp, Homo sapien
caaatagccaccttgtagatgtttc

SEQ ID NO: 579750 - DNA, 25 bp, Homo sapien
atagccaccttgtagatgtttcttg

SEQ ID NO: 579751 - DNA, 25 bp, Homo sapien
gccaccttgtagatgtttcttgttt

SEQ ID NO: 579752 - DNA, 25 bp, Homo sapien
ccttgtagatgtttcttgtttgtct

SEQ ID NO: 579753 - DNA, 25 bp, Homo sapien
ttgtttgtctaaattgtagttcaac

SEQ ID NO: 579754 - DNA, 25 bp, Homo sapien
taaattgtagttcaactagccttct

SEQ ID NO: 579755 - DNA, 25 bp, Homo sapien
ccactgtcctgttttccagagctgc

SEQ ID NO: 579756 - DNA, 25 bp, Homo sapien
agcaggtgcacaaggttccaacttt

SEQ ID NO: 579757 - DNA, 25 bp, Homo sapien
gcaggtgcacaaggttccaacttta

SEQ ID NO: 579758 - DNA, 25 bp, Homo sapien
caggtgcacaaggttccaactttac

SEQ ID NO: 579759 - DNA, 25 bp, Homo sapien
ggtgcacaaggttccaactttacca

SEQ ID NO: 579760 - DNA, 25 bp, Homo sapien
gtgcacaaggttccaactttaccac

SEQ ID NO: 579761 - DNA, 25 bp, Homo sapien
tgcacaaggttccaactttaccaca

SEQ ID NO: 579762 - DNA, 25 bp, Homo sapien
gcacaaggttccaactttaccacat

SEQ ID NO: 579763 - DNA, 25 bp, Homo sapien
cacaaggttccaactttaccacatc

SEQ ID NO: 579764 - DNA, 25 bp, Homo sapien
ttatgtactttactgttgtatctac

SEQ ID NO: 579765 - DNA, 25 bp, Homo sapien
gtactttactgttgtatctacaaag

SEQ ID NO: 579766 - DNA, 25 bp, Homo sapien
gttattttacagaagttttacagct

SEQ ID NO: 579767 - DNA, 25 bp, Homo sapien
aagtagagagtataatgatgcttac

SEQ ID NO: 579768 - DNA, 25 bp, Homo sapien
aatgggaagttgttcacagatgcaa

SEQ ID NO: 579769 - DNA, 25 bp, Homo sapien
tgttcacagatgcaaagattcagtt

SEQ ID NO: 579770 - DNA, 25 bp, Homo sapien
gatgcaaagattcagttaaaccgga

SEQ ID NO: 579771 - DNA, 25 bp, Homo sapien
tcagttaaaccggagaaatgcgttt

SEQ ID NO: 579772 - DNA, 25 bp, Homo sapien
ccggagaaatgcgttttgaaatcta

SEQ ID NO: 579773 - DNA, 25 bp, Homo sapien
ttgaaatctattgcacagcaggatg

SEQ ID NO: 579774 - DNA, 25 bp, Homo sapien
aaatctattgcacagcaggatgact

SEQ ID NO: 579775 - DNA, 25 bp, Homo sapien
ttacacctaggcctcttgactgaaa

SEQ ID NO: 579776 - DNA, 25 bp, Homo sapien
tacacctaggcctcttgactgaaag

SEQ ID NO: 579777 - DNA, 25 bp, Homo sapien
acacctaggcctcttgactgaaagt

SEQ ID NO: 579778 - DNA, 25 bp, Homo sapien
acctaggcctcttgactgaaagttg

SEQ ID NO: 579779 - DNA, 25 bp, Homo sapien
ctaggcctcttgactgaaagttgaa

SEQ ID NO: 579780 - DNA, 25 bp, Homo sapien
aggcctcttgactgaaagttgaacc

SEQ ID NO: 579781 - DNA, 25 bp, Homo sapien
gcctcttgactgaaagttgaaccca

SEQ ID NO: 579782 - DNA, 25 bp, Homo sapien
ttgactgaaagttgaacccagggtt

SEQ ID NO: 579783 - DNA, 25 bp, Homo sapien
gaaaaaggaacagaggcctctggga

SEQ ID NO: 579784 - DNA, 25 bp, Homo sapien
tcgcttgagcagagatgttgaggct

SEQ ID NO: 579785 - DNA, 25 bp, Homo sapien
cttgagcagagatgttgaggctgta

SEQ ID NO: 579786 - DNA, 25 bp, Homo sapien
acatgtatgctcatatattcataga

SEQ ID NO: 579787 - DNA, 25 bp, Homo sapien
agaatatttatggagggatcacaag

SEQ ID NO: 579788 - DNA, 25 bp, Homo sapien
atggagggatcacaagaaactggaa

SEQ ID NO: 579789 - DNA, 25 bp, Homo sapien
agtggctgcttctggttaaaattat

SEQ ID NO: 579790 - DNA, 25 bp, Homo sapien
aaattataaggtcatgggtcatggg

SEQ ID NO: 579791 - DNA, 25 bp, Homo sapien
ttactgtgtcctcttttataccttt

SEQ ID NO: 579792 - DNA, 25 bp, Homo sapien
tgtgtcctcttttataccttttgat

SEQ ID NO: 579793 - DNA, 25 bp, Homo sapien
ataccttttgatgtgcacctattta

SEQ ID NO: 579794 - DNA, 25 bp, Homo sapien
ttgatgtgcacctatttaaatataa

SEQ ID NO: 579795 - DNA, 25 bp, Homo sapien
taacatggaaagatggctgtaatat

SEQ ID NO: 579796 - DNA, 25 bp, Homo sapien
tattgcctaaaaaccagcttactga

SEQ ID NO: 579797 - DNA, 25 bp, Homo sapien
ttaccatgcaagaaggattgtgaaa

SEQ ID NO: 579798 - DNA, 25 bp, Homo sapien
atttccttgtgtccctggagttttg

SEQ ID NO: 579799 - DNA, 25 bp, Homo sapien
ctggagttttgtctgaacataggtg

SEQ ID NO: 579800 - DNA, 25 bp, Homo sapien
gaacataggtgatgtctgggtctat

SEQ ID NO: 579801 - DNA, 25 bp, Homo sapien
gtctgggtctattttgcattctaaa

SEQ ID NO: 579802 - DNA, 25 bp, Homo sapien
ggtctattttgcattctaaaggaca

SEQ ID NO: 579803 - DNA, 25 bp, Homo sapien
gtgtgaaatacataagtgggcaaaa

SEQ ID NO: 579804 - DNA, 25 bp, Homo sapien
atgacctaatcatgtatcctacagt

SEQ ID NO: 579805 - DNA, 25 bp, Homo sapien
aatcatgtatcctacagtaaagtta

SEQ ID NO: 579806 - DNA, 25 bp, Homo sapien
aattcagatagataccttattttgc

SEQ ID NO: 579807 - DNA, 25 bp, Homo sapien
tagataccttattttgcatatgttt

SEQ ID NO: 579808 - DNA, 25 bp, Homo sapien
gcggacggaacacctgaggtcaaga

SEQ ID NO: 579809 - DNA, 25 bp, Homo sapien
cggacggaacacctgaggtcaagag

SEQ ID NO: 579810 - DNA, 25 bp, Homo sapien
ggacggaacacctgaggtcaagagt

SEQ ID NO: 579811 - DNA, 25 bp, Homo sapien
gacggaacacctgaggtcaagagtt

SEQ ID NO: 579812 - DNA, 25 bp, Homo sapien
gaggagggggatccgagccgagatc

SEQ ID NO: 579813 - DNA, 25 bp, Homo sapien
aggagggggatccgagccgagatcg

SEQ ID NO: 579814 - DNA, 25 bp, Homo sapien
ggagggggatccgagccgagatcgc

SEQ ID NO: 579815 - DNA, 25 bp, Homo sapien
gagggggatccgagccgagatcgcg

SEQ ID NO: 579816 - DNA, 25 bp, Homo sapien
agggggatccgagccgagatcgcgc

SEQ ID NO: 579817 - DNA, 25 bp, Homo sapien
ggaccccggtagatggctccctgtt

SEQ ID NO: 579818 - DNA, 25 bp, Homo sapien
accccggtagatggctccctgttgt

SEQ ID NO: 579819 - DNA, 25 bp, Homo sapien
ccggtagatggctccctgttgtttg

SEQ ID NO: 579820 - DNA, 25 bp, Homo sapien
gagcctggaaggtggttatgccttt

SEQ ID NO: 579821 - DNA, 25 bp, Homo sapien
gcctggaaggtggttatgccttttg

SEQ ID NO: 579822 - DNA, 25 bp, Homo sapien
gaaggtggttatgccttttggatgc

SEQ ID NO: 579823 - DNA, 25 bp, Homo sapien
gccttttggatgcaggagaggagca

SEQ ID NO: 579824 - DNA, 25 bp, Homo sapien
tccctgggttctggttggagatgaa

SEQ ID NO: 579825 - DNA, 25 bp, Homo sapien
agaagcatcaggtctaagatcagct

SEQ ID NO: 579826 - DNA, 25 bp, Homo sapien
gcatcaggtctaagatcagcttctc

SEQ ID NO: 579827 - DNA, 25 bp, Homo sapien
catcaggtctaagatcagcttctct

SEQ ID NO: 579828 - DNA, 25 bp, Homo sapien
caaggtgctagattgatatgcatat

SEQ ID NO: 579829 - DNA, 25 bp, Homo sapien
atttttgcacaaatatgttcacaat

SEQ ID NO: 579830 - DNA, 25 bp, Homo sapien
tgttcacaatttgtttataacagca

SEQ ID NO: 579831 - DNA, 25 bp, Homo sapien
taaatagcaatagggaacgtaagtt

SEQ ID NO: 579832 - DNA, 25 bp, Homo sapien
ggaacgtaagttaatcatgctgtat

SEQ ID NO: 579833 - DNA, 25 bp, Homo sapien
gtaagttaatcatgctgtatccata

SEQ ID NO: 579834 - DNA, 25 bp, Homo sapien
aatcatgctgtatccatattacgta

SEQ ID NO: 579835 - DNA, 25 bp, Homo sapien
tgctgtatccatattacgtagtgtt

SEQ ID NO: 579836 - DNA, 25 bp, Homo sapien
gtatccatattacgtagtgttatat

SEQ ID NO: 579837 - DNA, 25 bp, Homo sapien
ataatttccgaatagtatgtacaat

SEQ ID NO: 579838 - DNA, 25 bp, Homo sapien
gataattgtgtaaaaagctgtaaac

SEQ ID NO: 579839 - DNA, 25 bp, Homo sapien
agactgaactgctcggcccgtggag

SEQ ID NO: 579840 - DNA, 25 bp, Homo sapien
cccgtggagtcctgtgtgatgttgt

SEQ ID NO: 579841 - DNA, 25 bp, Homo sapien
gacctcaacagggattggcattttg

SEQ ID NO: 579842 - DNA, 25 bp, Homo sapien
agggattggcattttgaagctgttg

SEQ ID NO: 579843 - DNA, 25 bp, Homo sapien
tcctttctagctcaacggcagctaa

SEQ ID NO: 579844 - DNA, 25 bp, Homo sapien
agctcaacggcagctaaagccactg

SEQ ID NO: 579845 - DNA, 25 bp, Homo sapien
agctaaagccactgcatacaatgca

SEQ ID NO: 579846 - DNA, 25 bp, Homo sapien
tgcaaggactggctcctgtttggcc

SEQ ID NO: 579847 - DNA, 25 bp, Homo sapien
cccctggtgaaatgagaaccctgtg

SEQ ID NO: 579848 - DNA, 25 bp, Homo sapien
atgagaaccctgtgggtcggaacaa

SEQ ID NO: 579849 - DNA, 25 bp, Homo sapien
ctgtgggtcggaacaaagtttggat

SEQ ID NO: 579850 - DNA, 25 bp, Homo sapien
aagggagcttccctattatccaggg

SEQ ID NO: 579851 - DNA, 25 bp, Homo sapien
tatgcaccctcccaaagggagctat

SEQ ID NO: 579852 - DNA, 25 bp, Homo sapien
acagagctcagggtggcagatctcc

SEQ ID NO: 579853 - DNA, 25 bp, Homo sapien
gctcagggtggcagatctccggtat

SEQ ID NO: 579854 - DNA, 25 bp, Homo sapien
ggtggcagatctccggtatcctcag

SEQ ID NO: 579855 - DNA, 25 bp, Homo sapien
agatctccggtatcctcagcactac

SEQ ID NO: 579856 - DNA, 25 bp, Homo sapien
cagcacaaaggaccctttcgacaag

SEQ ID NO: 579857 - DNA, 25 bp, Homo sapien
gaatgccagcctatcaggaaacagg

SEQ ID NO: 579858 - DNA, 25 bp, Homo sapien
gaacccaggattcccggcagaagaa

SEQ ID NO: 579859 - DNA, 25 bp, Homo sapien
agaagaaccccatgactgcagccgt

SEQ ID NO: 579860 - DNA, 25 bp, Homo sapien
gaaccccatgactgcagccgtatag

SEQ ID NO: 579861 - DNA, 25 bp, Homo sapien
tttctttccctgtcaagttgttgtc

SEQ ID NO: 579862 - DNA, 25 bp, Homo sapien
tctttccctgtcaagttgttgtcat

SEQ ID NO: 579863 - DNA, 25 bp, Homo sapien
tccctgtcaagttgttgtcataata

SEQ ID NO: 579864 - DNA, 25 bp, Homo sapien
gctccacacggagtacctgaacata

SEQ ID NO: 579865 - DNA, 25 bp, Homo sapien
cacacggagtacctgaacataacaa

SEQ ID NO: 579866 - DNA, 25 bp, Homo sapien
ggagtacctgaacataacaagtgta

SEQ ID NO: 579867 - DNA, 25 bp, Homo sapien
aacaagtgtagctactggaccttct

SEQ ID NO: 579868 - DNA, 25 bp, Homo sapien
aagtgtagctactggaccttctttt

SEQ ID NO: 579869 - DNA, 25 bp, Homo sapien
tgtagctactggaccttctttttgg

SEQ ID NO: 579870 - DNA, 25 bp, Homo sapien
tagctactggaccttctttttggtt

SEQ ID NO: 579871 - DNA, 25 bp, Homo sapien
acgtgaattaagaattagctctcta

SEQ ID NO: 579872 - DNA, 25 bp, Homo sapien
aattagtaattttaatggccacaga

SEQ ID NO: 579873 - DNA, 25 bp, Homo sapien
aatggccacagaaacatatagggac

SEQ ID NO: 579874 - DNA, 25 bp, Homo sapien
cacagaaacatatagggacagaagc

SEQ ID NO: 579875 - DNA, 25 bp, Homo sapien
gaagccaaaagccatgagctatctt

SEQ ID NO: 579876 - DNA, 25 bp, Homo sapien
aaagccatgagctatcttcattagt

SEQ ID NO: 579877 - DNA, 25 bp, Homo sapien
gccatgagctatcttcattagtcaa

SEQ ID NO: 579878 - DNA, 25 bp, Homo sapien
gagctatcttcattagtcaatactg

SEQ ID NO: 579879 - DNA, 25 bp, Homo sapien
atcttcattagtcaatactgagtaa

SEQ ID NO: 579880 - DNA, 25 bp, Homo sapien
atactgagtaatttcttaggcagat

SEQ ID NO: 579881 - DNA, 25 bp, Homo sapien
aggcagatggaaaagattctccgct

SEQ ID NO: 579882 - DNA, 25 bp, Homo sapien
cagatggaaaagattctccgctgta

SEQ ID NO: 579883 - DNA, 25 bp, Homo sapien
attatgcatgtgtggtctgtctcta

SEQ ID NO: 579884 - DNA, 25 bp, Homo sapien
atatttcctatagtacccagcacag

SEQ ID NO: 579885 - DNA, 25 bp, Homo sapien
tacccagcacagtgacttgcaccaa

SEQ ID NO: 579886 - DNA, 25 bp, Homo sapien
gacttgcaccaaacaggtgttgcaa

SEQ ID NO: 579887 - DNA, 25 bp, Homo sapien
tgaaagttgaaaatgaagcccagtg

SEQ ID NO: 579888 - DNA, 25 bp, Homo sapien
agtgcggtgtgctgttgtctcagct

SEQ ID NO: 579889 - DNA, 25 bp, Homo sapien
gtgcggtgtgctgttgtctcagcta

SEQ ID NO: 579890 - DNA, 25 bp, Homo sapien
aataaacttagcaagtatcaggctt

SEQ ID NO: 579891 - DNA, 25 bp, Homo sapien
aaacttagcaagtatcaggcttaat

SEQ ID NO: 579892 - DNA, 25 bp, Homo sapien
cttagcaagtatcaggcttaattta

SEQ ID NO: 579893 - DNA, 25 bp, Homo sapien
gcaagtatcaggcttaatttaaaaa

SEQ ID NO: 579894 - DNA, 25 bp, Homo sapien
cggtttcagtggcagacgtcactgt

SEQ ID NO: 579895 - DNA, 25 bp, Homo sapien
agacgtcactgtccaactcgtgcag

SEQ ID NO: 579896 - DNA, 25 bp, Homo sapien
gtcactgtccaactcgtgcagttaa

SEQ ID NO: 579897 - DNA, 25 bp, Homo sapien
ctgtccaactcgtgcagttaatctc

SEQ ID NO: 579898 - DNA, 25 bp, Homo sapien
gtccaactcgtgcagttaatctcta

SEQ ID NO: 579899 - DNA, 25 bp, Homo sapien
ccaactcgtgcagttaatctctata

SEQ ID NO: 579900 - DNA, 25 bp, Homo sapien
actcgtgcagttaatctctatatat

SEQ ID NO: 579901 - DNA, 25 bp, Homo sapien
cgtgcagttaatctctatatattga

SEQ ID NO: 579902 - DNA, 25 bp, Homo sapien
atatattgaaagctactccattttg

SEQ ID NO: 579903 - DNA, 25 bp, Homo sapien
gctactccattttgtagggatattt

SEQ ID NO: 579904 - DNA, 25 bp, Homo sapien
ctccattttgtagggatattttaat

SEQ ID NO: 579905 - DNA, 25 bp, Homo sapien
atatgtcaaagctctaatcctcaat

SEQ ID NO: 579906 - DNA, 25 bp, Homo sapien
tgtcaaagctctaatcctcaatatg

SEQ ID NO: 579907 - DNA, 25 bp, Homo sapien
gctctaatcctcaatatgatgatct

SEQ ID NO: 579908 - DNA, 25 bp, Homo sapien
gatgatctccagagatggaactttg

SEQ ID NO: 579909 - DNA, 25 bp, Homo sapien
taaggagaggccagagtgctcactt

SEQ ID NO: 579910 - DNA, 25 bp, Homo sapien
gagaggccagagtgctcacttgttc

SEQ ID NO: 579911 - DNA, 25 bp, Homo sapien
cagagtgctcacttgttcgcatatg

SEQ ID NO: 579912 - DNA, 25 bp, Homo sapien
agtgctcacttgttcgcatatgctc

SEQ ID NO: 579913 - DNA, 25 bp, Homo sapien
tcacttgttcgcatatgctcttgta

SEQ ID NO: 579914 - DNA, 25 bp, Homo sapien
gttcgcatatgctcttgtattctct

SEQ ID NO: 579915 - DNA, 25 bp, Homo sapien
gcatatgctcttgtattctctctct

SEQ ID NO: 579916 - DNA, 25 bp, Homo sapien
tgaccaaaagtgcttataaccagat

SEQ ID NO: 579917 - DNA, 25 bp, Homo sapien
tattctccttccatataggactgtg

SEQ ID NO: 579918 - DNA, 25 bp, Homo sapien
taggactgtgggatcttcctgctaa

SEQ ID NO: 579919 - DNA, 25 bp, Homo sapien
gatcttcctgctaaatcctcagttg

SEQ ID NO: 579920 - DNA, 25 bp, Homo sapien
aatcctcagttgctttgaagagctg

SEQ ID NO: 579921 - DNA, 25 bp, Homo sapien
gtgaataatcctctcagatagcctg

SEQ ID NO: 579922 - DNA, 25 bp, Homo sapien
gatagcctgagaattcaattttggc

SEQ ID NO: 579923 - DNA, 25 bp, Homo sapien
accattgcaataggtaatcttcgat

SEQ ID NO: 579924 - DNA, 25 bp, Homo sapien
gtaatcttcgataacatagccatat

SEQ ID NO: 579925 - DNA, 25 bp, Homo sapien
gactctttctcactttaagtctcac

SEQ ID NO: 579926 - DNA, 25 bp, Homo sapien
tttaagtctcactgtctataacgca

SEQ ID NO: 579927 - DNA, 25 bp, Homo sapien
tctagagggtcctaaaaatatgggc

SEQ ID NO: 579928 - DNA, 25 bp, Homo sapien
aatatgggcagttggtgatgagtcc

SEQ ID NO: 579929 - DNA, 25 bp, Homo sapien
ggtgatgagtccatattccttctta

SEQ ID NO: 579930 - DNA, 25 bp, Homo sapien
tgagtccatattccttcttatcact

SEQ ID NO: 579931 - DNA, 25 bp, Homo sapien
ttatcactcccacactggatccaaa

SEQ ID NO: 579932 - DNA, 25 bp, Homo sapien
gatccaaatacagtggtcgttttca

SEQ ID NO: 579933 - DNA, 25 bp, Homo sapien
acagtggtcgttttcaaagtgcata

SEQ ID NO: 579934 - DNA, 25 bp, Homo sapien
ttcaaagtgcatatcacacagtgtt

SEQ ID NO: 579935 - DNA, 25 bp, Homo sapien
ttgaatccataatgggcagtggccc

SEQ ID NO: 579936 - DNA, 25 bp, Homo sapien
ggcccattatgggtttgtgaaatta

SEQ ID NO: 579937 - DNA, 25 bp, Homo sapien
attaatttaatgattgtgaccagta

SEQ ID NO: 579938 - DNA, 25 bp, Homo sapien
caaaaggtgggctactgaatgtcag

SEQ ID NO: 579939 - DNA, 25 bp, Homo sapien
aaggacccagctttgcggttgttga

SEQ ID NO: 579940 - DNA, 25 bp, Homo sapien
tttgcggttgttgaagtgcagcact

SEQ ID NO: 579941 - DNA, 25 bp, Homo sapien
tacgctccagcttgtgacctgggcc

SEQ ID NO: 579942 - DNA, 25 bp, Homo sapien
agcttgtgacctgggcccctctgaa

SEQ ID NO: 579943 - DNA, 25 bp, Homo sapien
ctgaagcctgtcacagaaacccgat

SEQ ID NO: 579944 - DNA, 25 bp, Homo sapien
agaaacccgatccagcgtaccaagt

SEQ ID NO: 579945 - DNA, 25 bp, Homo sapien
gtaccaagtctctggcacttgtttc

SEQ ID NO: 579946 - DNA, 25 bp, Homo sapien
gaacactgttttggaaatcttggcc

SEQ ID NO: 579947 - DNA, 25 bp, Homo sapien
tttggaaatcttggccagtctgagt

SEQ ID NO: 579948 - DNA, 25 bp, Homo sapien
cagtctgagtggttccagcagggaa

SEQ ID NO: 579949 - DNA, 25 bp, Homo sapien
agcaggagctcctgttccattacct

SEQ ID NO: 579950 - DNA, 25 bp, Homo sapien
agctcctgttccattacctgcagct

SEQ ID NO: 579951 - DNA, 25 bp, Homo sapien
tcccaggcagccgtcatcgatgaga

SEQ ID NO: 579952 - DNA, 25 bp, Homo sapien
ttgtggacaccacatttgaggctgg

SEQ ID NO: 579953 - DNA, 25 bp, Homo sapien
gacaccacatttgaggctggagaag

SEQ ID NO: 579954 - DNA, 25 bp, Homo sapien
agaggacttcaggaattgaccccag

SEQ ID NO: 579955 - DNA, 25 bp, Homo sapien
ttcaggaattgaccccaggaggaca

SEQ ID NO: 579956 - DNA, 25 bp, Homo sapien
caggaggacaccagatacagacttc

SEQ ID NO: 579957 - DNA, 25 bp, Homo sapien
ggacaccagatacagacttcagccc

SEQ ID NO: 579958 - DNA, 25 bp, Homo sapien
ggacgggtccccagatctgctggaa

SEQ ID NO: 579959 - DNA, 25 bp, Homo sapien
gggtccccagatctgctggaatgat

SEQ ID NO: 579960 - DNA, 25 bp, Homo sapien
gccttggataggctgatattttcta

SEQ ID NO: 579961 - DNA, 25 bp, Homo sapien
ctagtagatatcagagactccggtt

SEQ ID NO: 579962 - DNA, 25 bp, Homo sapien
gagactccggttgatagcaccacaa

SEQ ID NO: 579963 - DNA, 25 bp, Homo sapien
tgatagcaccacaatggcttttctc

SEQ ID NO: 579964 - DNA, 25 bp, Homo sapien
gttttacgtattatcaagccaacag

SEQ ID NO: 579965 - DNA, 25 bp, Homo sapien
ctggattcaccacttttgtttcatt

SEQ ID NO: 579966 - DNA, 25 bp, Homo sapien
gtgtgtgttggagacatatgacatt

SEQ ID NO: 579967 - DNA, 25 bp, Homo sapien
atatgacattttacctcgaaaccag

SEQ ID NO: 579968 - DNA, 25 bp, Homo sapien
attttacctcgaaaccaggcatctc

SEQ ID NO: 579969 - DNA, 25 bp, Homo sapien
aaaccaggcatctcctaggaaaaag

SEQ ID NO: 579970 - DNA, 25 bp, Homo sapien
ggaaaaagagcagcctcccatataa

SEQ ID NO: 579971 - DNA, 25 bp, Homo sapien
ccacgggaggtggtgactcagtccc

SEQ ID NO: 579972 - DNA, 25 bp, Homo sapien
agcctccagatagcctccttttaaa

SEQ ID NO: 579973 - DNA, 25 bp, Homo sapien
gatagcctccttttaaattcaagat

SEQ ID NO: 579974 - DNA, 25 bp, Homo sapien
aatgtcaagaaaaccctcctcccag

SEQ ID NO: 579975 - DNA, 25 bp, Homo sapien
aaaccctcctcccagaacagatggg

SEQ ID NO: 579976 - DNA, 25 bp, Homo sapien
gggtaggctatcaggcagaagccat

SEQ ID NO: 579977 - DNA, 25 bp, Homo sapien
aggcagaagccataaacctggagaa

SEQ ID NO: 579978 - DNA, 25 bp, Homo sapien
aaacctggagaaacgctgcgggctg

SEQ ID NO: 579979 - DNA, 25 bp, Homo sapien
agaggcctgggctacaagtttgcct

SEQ ID NO: 579980 - DNA, 25 bp, Homo sapien
aagtttgcctgtcactgctgtggct

SEQ ID NO: 579981 - DNA, 25 bp, Homo sapien
cctgagcaggtccttgtctctctct

SEQ ID NO: 579982 - DNA, 25 bp, Homo sapien
aaatgtgctttgaagtcctctcacc

SEQ ID NO: 579983 - DNA, 25 bp, Homo sapien
aatgtgctttgaagtcctctcaccc

SEQ ID NO: 579984 - DNA, 25 bp, Homo sapien
tgtgctttgaagtcctctcaccctg

SEQ ID NO: 579985 - DNA, 25 bp, Homo sapien
tgctttgaagtcctctcaccctgag

SEQ ID NO: 579986 - DNA, 25 bp, Homo sapien
tttgaagtcctctcaccctgaggct

SEQ ID NO: 579987 - DNA, 25 bp, Homo sapien
tgaagtcctctcaccctgaggcttg

SEQ ID NO: 579988 - DNA, 25 bp, Homo sapien
gaagtcctctcaccctgaggcttgc

SEQ ID NO: 579989 - DNA, 25 bp, Homo sapien
ttgcccgccttctgctggtgaaaga

SEQ ID NO: 579990 - DNA, 25 bp, Homo sapien
tgcccgccttctgctggtgaaagaa

SEQ ID NO: 579991 - DNA, 25 bp, Homo sapien
gcccgccttctgctggtgaaagaag

SEQ ID NO: 579992 - DNA, 25 bp, Homo sapien
ccgccttctgctggtgaaagaagct

SEQ ID NO: 579993 - DNA, 25 bp, Homo sapien
aagaaagaaataggcctacagtggc

SEQ ID NO: 579994 - DNA, 25 bp, Homo sapien
taggcctacagtggctctcacttgt

SEQ ID NO: 579995 - DNA, 25 bp, Homo sapien
ggacaacataggaacacctcctctc

SEQ ID NO: 579996 - DNA, 25 bp, Homo sapien
aacataggaacacctcctctctaca

SEQ ID NO: 579997 - DNA, 25 bp, Homo sapien
taggaacacctcctctctacagaaa

SEQ ID NO: 579998 - DNA, 25 bp, Homo sapien
gaacacctcctctctacagaaaaga

SEQ ID NO: 579999 - DNA, 25 bp, Homo sapien
acacctcctctctacagaaaagatt

SEQ ID NO: 580000 - DNA, 25 bp, Homo sapien
acctcctctctacagaaaagattaa

SEQ ID NO: 580001 - DNA, 25 bp, Homo sapien
aggatccttcgagctaggaggtcga

SEQ ID NO: 580002 - DNA, 25 bp, Homo sapien
atccttcgagctaggaggtcgaggc

SEQ ID NO: 580003 - DNA, 25 bp, Homo sapien
gtgagccatgtcataccgctgcact

SEQ ID NO: 580004 - DNA, 25 bp, Homo sapien
cattttttaccctgggttgtgcaga

SEQ ID NO: 580005 - DNA, 25 bp, Homo sapien
ttaccctgggttgtgcagaaacttt

SEQ ID NO: 580006 - DNA, 25 bp, Homo sapien
ttatttcatttcttccataccagga

SEQ ID NO: 580007 - DNA, 25 bp, Homo sapien
tcttccataccaggacatttatttc

SEQ ID NO: 580008 - DNA, 25 bp, Homo sapien
atttcctattcagtgacaatcttga

SEQ ID NO: 580009 - DNA, 25 bp, Homo sapien
gacaatcttgatgtcttcatccttc

SEQ ID NO: 580010 - DNA, 25 bp, Homo sapien
ttgatgtcttcatccttcaaactgc

SEQ ID NO: 580011 - DNA, 25 bp, Homo sapien
actgctctctaacatagtttcaaaa

SEQ ID NO: 580012 - DNA, 25 bp, Homo sapien
gaatatgttcattacctttactgta

SEQ ID NO: 580013 - DNA, 25 bp, Homo sapien
cattacctttactgtagtgatgatt

SEQ ID NO: 580014 - DNA, 25 bp, Homo sapien
gtagtgatgatttcctatggcaaaa

SEQ ID NO: 580015 - DNA, 25 bp, Homo sapien
taacaattggttttcagggcccagt

SEQ ID NO: 580016 - DNA, 25 bp, Homo sapien
caattggttttcagggcccagtcca

SEQ ID NO: 580017 - DNA, 25 bp, Homo sapien
gttttcagggcccagtccaagcctg

SEQ ID NO: 580018 - DNA, 25 bp, Homo sapien
gaaacctcagagttaaatccctatt

SEQ ID NO: 580019 - DNA, 25 bp, Homo sapien
agagttaaatccctattctccacac

SEQ ID NO: 580020 - DNA, 25 bp, Homo sapien
gtcccagccagcatcatctctttgg

SEQ ID NO: 580021 - DNA, 25 bp, Homo sapien
tcatttttcagccacagtgattctt

SEQ ID NO: 580022 - DNA, 25 bp, Homo sapien
tttcagccacagtgattctttggaa

SEQ ID NO: 580023 - DNA, 25 bp, Homo sapien
agccacagtgattctttggaaaagt

SEQ ID NO: 580024 - DNA, 25 bp, Homo sapien
gtcaaatcatatcacttctctgctt

SEQ ID NO: 580025 - DNA, 25 bp, Homo sapien
cttcttccccaacacagctgcatgg

SEQ ID NO: 580026 - DNA, 25 bp, Homo sapien
ttccccacaaggattgtttacaaat

SEQ ID NO: 580027 - DNA, 25 bp, Homo sapien
agttgcttttgacttactacacttc

SEQ ID NO: 580028 - DNA, 25 bp, Homo sapien
aatgccaagggaacattttgttaat

SEQ ID NO: 580029 - DNA, 25 bp, Homo sapien
tttagctacatcaagctgaatgctg

SEQ ID NO: 580030 - DNA, 25 bp, Homo sapien
ctgaatgctgcagctaaggcgaggc

SEQ ID NO: 580031 - DNA, 25 bp, Homo sapien
tgcagctaaggcgaggcaggattta

SEQ ID NO: 580032 - DNA, 25 bp, Homo sapien
cgaggcaggatttagctttcgctac

SEQ ID NO: 580033 - DNA, 25 bp, Homo sapien
ggatttagctttcgctacgtcttga

SEQ ID NO: 580034 - DNA, 25 bp, Homo sapien
gctttcgctacgtcttgaggagtta

SEQ ID NO: 580035 - DNA, 25 bp, Homo sapien
tcgctacgtcttgaggagttataat

SEQ ID NO: 580036 - DNA, 25 bp, Homo sapien
tttcttctcagctattgctctggta

SEQ ID NO: 580037 - DNA, 25 bp, Homo sapien
gtatcacttcatatcagaagagttt

SEQ ID NO: 580038 - DNA, 25 bp, Homo sapien
tcagaagagttttcgtttggaggga

SEQ ID NO: 580039 - DNA, 25 bp, Homo sapien
aaatgtgttctgtgtcgtgaagcat

SEQ ID NO: 580040 - DNA, 25 bp, Homo sapien
gtgtcgtgaagcatgtttttccaag

SEQ ID NO: 580041 - DNA, 25 bp, Homo sapien
gaagcatgtttttccaaggagttct

SEQ ID NO: 580042 - DNA, 25 bp, Homo sapien
ttttccaaggagttctaatctaaat

SEQ ID NO: 580043 - DNA, 25 bp, Homo sapien
aaatgcaccagtatattgaattgat

SEQ ID NO: 580044 - DNA, 25 bp, Homo sapien
gataacttgatatatttggtcctaa

SEQ ID NO: 580045 - DNA, 25 bp, Homo sapien
gatatatttggtcctaaagtgtttt

SEQ ID NO: 580046 - DNA, 25 bp, Homo sapien
taaagtgtttttgtagccagttctt

SEQ ID NO: 580047 - DNA, 25 bp, Homo sapien
tcttaaaatttagtttcatcatcag

SEQ ID NO: 580048 - DNA, 25 bp, Homo sapien
gggatcgcaaagtatgttgattaac

SEQ ID NO: 580049 - DNA, 25 bp, Homo sapien
ggtaacataacctctgggaagttct

SEQ ID NO: 580050 - DNA, 25 bp, Homo sapien
gggaagttcttatacttctcaaggt

SEQ ID NO: 580051 - DNA, 25 bp, Homo sapien
gttcttatacttctcaaggtacaat

SEQ ID NO: 580052 - DNA, 25 bp, Homo sapien
ggtacaatattcctgagacctccct

SEQ ID NO: 580053 - DNA, 25 bp, Homo sapien
agacctcccttgcttgataatcatt

SEQ ID NO: 580054 - DNA, 25 bp, Homo sapien
gataatcattagacgtattacggat

SEQ ID NO: 580055 - DNA, 25 bp, Homo sapien
gacgtattacggattttcagacata

SEQ ID NO: 580056 - DNA, 25 bp, Homo sapien
ttcagacatacggaagtggatttgt

SEQ ID NO: 580057 - DNA, 25 bp, Homo sapien
gggacacccaaacaatagcatctgg

SEQ ID NO: 580058 - DNA, 25 bp, Homo sapien
acccaaacaatagcatctggtgtca

SEQ ID NO: 580059 - DNA, 25 bp, Homo sapien
cgctctcggcgtccccgcgggacaa

SEQ ID NO: 580060 - DNA, 25 bp, Homo sapien
agcgcgtccaactccttgctgtaca

SEQ ID NO: 580061 - DNA, 25 bp, Homo sapien
gtccaactccttgctgtacactggg

SEQ ID NO: 580062 - DNA, 25 bp, Homo sapien
ccttgctgtacactggggacctgga

SEQ ID NO: 580063 - DNA, 25 bp, Homo sapien
gacctggaggcgctgcagaggttgc

SEQ ID NO: 580064 - DNA, 25 bp, Homo sapien
ttgcaggcgggcaacgtcgtgctcc

SEQ ID NO: 580065 - DNA, 25 bp, Homo sapien
aggcgggcaacgtcgtgctcccgct

SEQ ID NO: 580066 - DNA, 25 bp, Homo sapien
tcgtgctcccgctggtgcacagggt

SEQ ID NO: 580067 - DNA, 25 bp, Homo sapien
gcacggccgcgcagagggtctacac

SEQ ID NO: 580068 - DNA, 25 bp, Homo sapien
agagggtctacaccacgggcaccat

SEQ ID NO: 580069 - DNA, 25 bp, Homo sapien
gagggtctacaccacgggcaccatc

SEQ ID NO: 580070 - DNA, 25 bp, Homo sapien
agatcctggctagatctgcctctgt

SEQ ID NO: 580071 - DNA, 25 bp, Homo sapien
ggctagatctgcctctgttttgctg

SEQ ID NO: 580072 - DNA, 25 bp, Homo sapien
tgttttgctggtcaaaacctcttcc

SEQ ID NO: 580073 - DNA, 25 bp, Homo sapien
tttgctggtcaaaacctcttcccca

SEQ ID NO: 580074 - DNA, 25 bp, Homo sapien
ccacaagccagattgtttctgagga

SEQ ID NO: 580075 - DNA, 25 bp, Homo sapien
acaagccagattgtttctgaggaga

SEQ ID NO: 580076 - DNA, 25 bp, Homo sapien
gagagattggagtcctggtctccct

SEQ ID NO: 580077 - DNA, 25 bp, Homo sapien
agattggagtcctggtctccctaag

SEQ ID NO: 580078 - DNA, 25 bp, Homo sapien
gagtcctggtctccctaagggaata

SEQ ID NO: 580079 - DNA, 25 bp, Homo sapien
tggtctccctaagggaatagccctc

SEQ ID NO: 580080 - DNA, 25 bp, Homo sapien
taagggaatagccctccacctgtgg

SEQ ID NO: 580081 - DNA, 25 bp, Homo sapien
tctgagctcaaactacttaggattc

SEQ ID NO: 580082 - DNA, 25 bp, Homo sapien
tacttaggattcttcaggacactga

SEQ ID NO: 580083 - DNA, 25 bp, Homo sapien
aagcctctggaggaatagactgaag

SEQ ID NO: 580084 - DNA, 25 bp, Homo sapien
gaatagactgaaggcatcccctggg

SEQ ID NO: 580085 - DNA, 25 bp, Homo sapien
cagccgtgttccaaagcgggatggc

SEQ ID NO: 580086 - DNA, 25 bp, Homo sapien
tccaaagcgggatggctggtatcct

SEQ ID NO: 580087 - DNA, 25 bp, Homo sapien
tatcctgagggcagcaacgtttcac

SEQ ID NO: 580088 - DNA, 25 bp, Homo sapien
gcagcaacgtttcacataagggcaa

SEQ ID NO: 580089 - DNA, 25 bp, Homo sapien
tctgagcttagggattccattttct

SEQ ID NO: 580090 - DNA, 25 bp, Homo sapien
tagggattccattttctttgttcac

SEQ ID NO: 580091 - DNA, 25 bp, Homo sapien
attccattttctttgttcacctcta

SEQ ID NO: 580092 - DNA, 25 bp, Homo sapien
gcagtgcctgtgaggtatcagtgtc

SEQ ID NO: 580093 - DNA, 25 bp, Homo sapien
gtgcctgtgaggtatcagtgtcatt

SEQ ID NO: 580094 - DNA, 25 bp, Homo sapien
cctgtgaggtatcagtgtcatttga

SEQ ID NO: 580095 - DNA, 25 bp, Homo sapien
actgtggacttcagtagagaggagt

SEQ ID NO: 580096 - DNA, 25 bp, Homo sapien
cagcaactggactctactcaaagac

SEQ ID NO: 580097 - DNA, 25 bp, Homo sapien
aactggactctactcaaagacgcct

SEQ ID NO: 580098 - DNA, 25 bp, Homo sapien
tggactctactcaaagacgcctgta

SEQ ID NO: 580099 - DNA, 25 bp, Homo sapien
tctactcaaagacgcctgtaccagg

SEQ ID NO: 580100 - DNA, 25 bp, Homo sapien
caaagacgcctgtaccaggatgtaa

SEQ ID NO: 580101 - DNA, 25 bp, Homo sapien
gacgcctgtaccaggatgtaatgtt

SEQ ID NO: 580102 - DNA, 25 bp, Homo sapien
gcctgtaccaggatgtaatgttgga

SEQ ID NO: 580103 - DNA, 25 bp, Homo sapien
gcttcaagctcagccaaaagaatct

SEQ ID NO: 580104 - DNA, 25 bp, Homo sapien
aaaagaatctcgatggtttccacaa

SEQ ID NO: 580105 - DNA, 25 bp, Homo sapien
tttccacaaaaaatcttgggccttg

SEQ ID NO: 580106 - DNA, 25 bp, Homo sapien
aaatcttgggccttggatcaactgc

SEQ ID NO: 580107 - DNA, 25 bp, Homo sapien
cttgaaccaatcctggtggccccag

SEQ ID NO: 580108 - DNA, 25 bp, Homo sapien
caggctgattggcagacctgaatca

SEQ ID NO: 580109 - DNA, 25 bp, Homo sapien
tgaatcacctatcccatgcccagaa

SEQ ID NO: 580110 - DNA, 25 bp, Homo sapien
tatcccatgcccagaactttggctt

SEQ ID NO: 580111 - DNA, 25 bp, Homo sapien
agaactttggcttgaccaggctcat

SEQ ID NO: 580112 - DNA, 25 bp, Homo sapien
tgaccaggctcatccaaaacaaggg

SEQ ID NO: 580113 - DNA, 25 bp, Homo sapien
taaaacatcacctgatactttggtt

SEQ ID NO: 580114 - DNA, 25 bp, Homo sapien
ctggaccagacaaacggcactggga

SEQ ID NO: 580115 - DNA, 25 bp, Homo sapien
ggcactgggaaagcaggagcccaaa

SEQ ID NO: 580116 - DNA, 25 bp, Homo sapien
ccaaaggaaggctggaattcaggga

SEQ ID NO: 580117 - DNA, 25 bp, Homo sapien
gaattcagggaagagccacgtgcca

SEQ ID NO: 580118 - DNA, 25 bp, Homo sapien
attcagggaagagccacgtgccagg

SEQ ID NO: 580119 - DNA, 25 bp, Homo sapien
tgccaggctgtgacgaaggcgacaa

SEQ ID NO: 580120 - DNA, 25 bp, Homo sapien
gggaggcatccaaactctatgtgct

SEQ ID NO: 580121 - DNA, 25 bp, Homo sapien
catccaaactctatgtgctgtcttt

SEQ ID NO: 580122 - DNA, 25 bp, Homo sapien
aactctatgtgctgtctttgcacta

SEQ ID NO: 580123 - DNA, 25 bp, Homo sapien
ctttgcactactctgtaaatctaac

SEQ ID NO: 580124 - DNA, 25 bp, Homo sapien
aaatctaacattattcggaagtgaa

SEQ ID NO: 580125 - DNA, 25 bp, Homo sapien
ttgcccagccgcaaacagcttttat

SEQ ID NO: 580126 - DNA, 25 bp, Homo sapien
aacagcttttatggttgaactcact

SEQ ID NO: 580127 - DNA, 25 bp, Homo sapien
ctcactgatgagcagcttgggcttt

SEQ ID NO: 580128 - DNA, 25 bp, Homo sapien
ttgggctttggcagcagacacatct

SEQ ID NO: 580129 - DNA, 25 bp, Homo sapien
tggatttgagtcctaacactctccc

SEQ ID NO: 580130 - DNA, 25 bp, Homo sapien
tcccagctccgtagtcttaggaaag

SEQ ID NO: 580131 - DNA, 25 bp, Homo sapien
ggaaagttgcctgacctgagactca

SEQ ID NO: 580132 - DNA, 25 bp, Homo sapien
gattctgacttacaaagtgttgctt

SEQ ID NO: 580133 - DNA, 25 bp, Homo sapien
tgcttgtaacaatccagggagctct

SEQ ID NO: 580134 - DNA, 25 bp, Homo sapien
ggagctctgtctgtcaagtgcataa

SEQ ID NO: 580135 - DNA, 25 bp, Homo sapien
gtgcataacatgtacctggtgcatg

SEQ ID NO: 580136 - DNA, 25 bp, Homo sapien
atgggaaacacgattttgcatggtt

SEQ ID NO: 580137 - DNA, 25 bp, Homo sapien
gcatggttttaagatcccttcacga

SEQ ID NO: 580138 - DNA, 25 bp, Homo sapien
aagatcccttcacgagatactaatt

SEQ ID NO: 580139 - DNA, 25 bp, Homo sapien
tatagtgaataagcctgacagaaac

SEQ ID NO: 580140 - DNA, 25 bp, Homo sapien
tcaagttaacatcaccactaataag

SEQ ID NO: 580141 - DNA, 25 bp, Homo sapien
catactgataccatgtaccttccaa

SEQ ID NO: 580142 - DNA, 25 bp, Homo sapien
gtaccttccaatatgatgcactgag

SEQ ID NO: 580143 - DNA, 25 bp, Homo sapien
attgtcacttctgtggtgttgtcag

SEQ ID NO: 580144 - DNA, 25 bp, Homo sapien
gttgtcagaaatgtgcaatctcagt

SEQ ID NO: 580145 - DNA, 25 bp, Homo sapien
gcaatctcagtgcaatcaggagaaa

SEQ ID NO: 580146 - DNA, 25 bp, Homo sapien
gacaagcccaaactgagagacactc

SEQ ID NO: 580147 - DNA, 25 bp, Homo sapien
cagacccacttctgggtgtgtggtg

SEQ ID NO: 580148 - DNA, 25 bp, Homo sapien
acttctgggtgtgtggtgcgacttt

SEQ ID NO: 580149 - DNA, 25 bp, Homo sapien
gtgcgactttgcaagggctgtgata

SEQ ID NO: 580150 - DNA, 25 bp, Homo sapien
gctgtgatagactcaccttgcactt

SEQ ID NO: 580151 - DNA, 25 bp, Homo sapien
tgatagactcaccttgcacttactg

SEQ ID NO: 580152 - DNA, 25 bp, Homo sapien
actcaccttgcacttactgtgttta

SEQ ID NO: 580153 - DNA, 25 bp, Homo sapien
caccttgcacttactgtgtttatga

SEQ ID NO: 580154 - DNA, 25 bp, Homo sapien
gcacttactgtgtttatgaatgtct

SEQ ID NO: 580155 - DNA, 25 bp, Homo sapien
actgtgtttatgaatgtctgttaga

SEQ ID NO: 580156 - DNA, 25 bp, Homo sapien
aatgccattacttaatcggtctccg

SEQ ID NO: 580157 - DNA, 25 bp, Homo sapien
ccattacttaatcggtctccgctgg

SEQ ID NO: 580158 - DNA, 25 bp, Homo sapien
gagactaacattgacattggtggac

SEQ ID NO: 580159 - DNA, 25 bp, Homo sapien
cattgacattggtggactttgagta

SEQ ID NO: 580160 - DNA, 25 bp, Homo sapien
gtaaagcaggttgcctgcgtgccat

SEQ ID NO: 580161 - DNA, 25 bp, Homo sapien
aaagcaggttgcctgcgtgccataa

SEQ ID NO: 580162 - DNA, 25 bp, Homo sapien
catccaatcagttgcgggatttaac

SEQ ID NO: 580163 - DNA, 25 bp, Homo sapien
atcagttgcgggatttaacagagca

SEQ ID NO: 580164 - DNA, 25 bp, Homo sapien
gactgaggtcccctgagaaaatagg

SEQ ID NO: 580165 - DNA, 25 bp, Homo sapien
ggtcccctgagaaaataggattcca

SEQ ID NO: 580166 - DNA, 25 bp, Homo sapien
aataggattccaccagcagacagcc

SEQ ID NO: 580167 - DNA, 25 bp, Homo sapien
gcagacagccttcagccttgaactg

SEQ ID NO: 580168 - DNA, 25 bp, Homo sapien
agccttgaactgcagcgtcacctct

SEQ ID NO: 580169 - DNA, 25 bp, Homo sapien
tccaggaactgaactccctttacca

SEQ ID NO: 580170 - DNA, 25 bp, Homo sapien
ccaggaactgaactccctttaccat

SEQ ID NO: 580171 - DNA, 25 bp, Homo sapien
aggaactgaactccctttaccatca

SEQ ID NO: 580172 - DNA, 25 bp, Homo sapien
gaactgaactccctttaccatcaaa

SEQ ID NO: 580173 - DNA, 25 bp, Homo sapien
atcaaaatctgaggcaataactgct

SEQ ID NO: 580174 - DNA, 25 bp, Homo sapien
aaatctgaggcaataactgctttag

SEQ ID NO: 580175 - DNA, 25 bp, Homo sapien
atctgaggcaataactgctttagat

SEQ ID NO: 580176 - DNA, 25 bp, Homo sapien
aggcaataactgctttagatactct

SEQ ID NO: 580177 - DNA, 25 bp, Homo sapien
ggcaataactgctttagatactctg

SEQ ID NO: 580178 - DNA, 25 bp, Homo sapien
gcaataactgctttagatactctga

SEQ ID NO: 580179 - DNA, 25 bp, Homo sapien
caataactgctttagatactctgaa

SEQ ID NO: 580180 - DNA, 25 bp, Homo sapien
gaaaagctgcttaaacagcaagtga

SEQ ID NO: 580181 - DNA, 25 bp, Homo sapien
cagcaagtgaaagaaggctctcccc

SEQ ID NO: 580182 - DNA, 25 bp, Homo sapien
ttgaaggatccttgagactcttttg

SEQ ID NO: 580183 - DNA, 25 bp, Homo sapien
agactcttttggattgctgcttgga

SEQ ID NO: 580184 - DNA, 25 bp, Homo sapien
gagaacattcctgtaacttgtccct

SEQ ID NO: 580185 - DNA, 25 bp, Homo sapien
aacattcctgtaacttgtccctgct

SEQ ID NO: 580186 - DNA, 25 bp, Homo sapien
tgtccctgctccttgaactataaaa

SEQ ID NO: 580187 - DNA, 25 bp, Homo sapien
caaagaattcttaatggacagctat

SEQ ID NO: 580188 - DNA, 25 bp, Homo sapien
aatggacagctatacttggccccaa

SEQ ID NO: 580189 - DNA, 25 bp, Homo sapien
acagctatacttggccccaaggttt

SEQ ID NO: 580190 - DNA, 25 bp, Homo sapien
aaggtttcaacctcacactgaagaa

SEQ ID NO: 580191 - DNA, 25 bp, Homo sapien
tgccccacaaccatttttacttact

SEQ ID NO: 580192 - DNA, 25 bp, Homo sapien
gccccacaaccatttttacttactg

SEQ ID NO: 580193 - DNA, 25 bp, Homo sapien
cccacaaccatttttacttactgat

SEQ ID NO: 580194 - DNA, 25 bp, Homo sapien
ccacaaccatttttacttactgatg

SEQ ID NO: 580195 - DNA, 25 bp, Homo sapien
cacaaccatttttacttactgatgt

SEQ ID NO: 580196 - DNA, 25 bp, Homo sapien
acaaccatttttacttactgatgta

SEQ ID NO: 580197 - DNA, 25 bp, Homo sapien
caaccatttttacttactgatgtaa

SEQ ID NO: 580198 - DNA, 25 bp, Homo sapien
accatttttacttactgatgtaaat

SEQ ID NO: 580199 - DNA, 25 bp, Homo sapien
actgatgtaaatactttttaggata

SEQ ID NO: 580200 - DNA, 25 bp, Homo sapien
ctgatgtaaatactttttaggataa

SEQ ID NO: 580201 - DNA, 25 bp, Homo sapien
tgatgtaaatactttttaggataaa

SEQ ID NO: 580202 - DNA, 25 bp, Homo sapien
ttctgagatccagtgatcagcccat

SEQ ID NO: 580203 - DNA, 25 bp, Homo sapien
agatccagtgatcagcccatcttaa

SEQ ID NO: 580204 - DNA, 25 bp, Homo sapien
tgatcagcccatcttaacctctcaa

SEQ ID NO: 580205 - DNA, 25 bp, Homo sapien
ccatcttaacctctcaaagtcctga

SEQ ID NO: 580206 - DNA, 25 bp, Homo sapien
aagttactacttttattgtgattgt

SEQ ID NO: 580207 - DNA, 25 bp, Homo sapien
ttgttttatgtgttcctcagtggta

SEQ ID NO: 580208 - DNA, 25 bp, Homo sapien
gtgttcctcagtggtattttttata

SEQ ID NO: 580209 - DNA, 25 bp, Homo sapien
tttatatgttggtttattgccttaa

SEQ ID NO: 580210 - DNA, 25 bp, Homo sapien
tggtttattgccttaaatttcattt

SEQ ID NO: 580211 - DNA, 25 bp, Homo sapien
gtagtgatgtgcttcaattattttt

SEQ ID NO: 580212 - DNA, 25 bp, Homo sapien
atcttgttttgcatagtttctataa

SEQ ID NO: 580213 - DNA, 25 bp, Homo sapien
gtaaaacaataataccagcttggaa

SEQ ID NO: 580214 - DNA, 25 bp, Homo sapien
tggaagacaagcaagaatccagtcc

SEQ ID NO: 580215 - DNA, 25 bp, Homo sapien
cctcccacatggatgtgtgagatta

SEQ ID NO: 580216 - DNA, 25 bp, Homo sapien
ccagcgggagacatcaaatgacgta

SEQ ID NO: 580217 - DNA, 25 bp, Homo sapien
tgacgtagaaagagaacagtgtccc

SEQ ID NO: 580218 - DNA, 25 bp, Homo sapien
cattcagtggcccaaagaaagtgga

SEQ ID NO: 580219 - DNA, 25 bp, Homo sapien
gtggagacagtgacatcatgatcaa

SEQ ID NO: 580220 - DNA, 25 bp, Homo sapien
gacatcatgatcaaacatgctcaga

SEQ ID NO: 580221 - DNA, 25 bp, Homo sapien
agtcctattcaatgactcacttctt

SEQ ID NO: 580222 - DNA, 25 bp, Homo sapien
aatgactcacttcttcacctaataa

SEQ ID NO: 580223 - DNA, 25 bp, Homo sapien
ttcacctaataaatgctgattgcat

SEQ ID NO: 580224 - DNA, 25 bp, Homo sapien
gttaaggtcactccaaaactgacat

SEQ ID NO: 580225 - DNA, 25 bp, Homo sapien
ggtcactccaaaactgacattctct

SEQ ID NO: 580226 - DNA, 25 bp, Homo sapien
atgtttgcttccactaaaacccatc

SEQ ID NO: 580227 - DNA, 25 bp, Homo sapien
gcttccactaaaacccatctggtga

SEQ ID NO: 580228 - DNA, 25 bp, Homo sapien
ggtgatggaactgtgcataccttca

SEQ ID NO: 580229 - DNA, 25 bp, Homo sapien
ggaactgtgcataccttcatcaagt

SEQ ID NO: 580230 - DNA, 25 bp, Homo sapien
ctgtgcataccttcatcaagtattt

SEQ ID NO: 580231 - DNA, 25 bp, Homo sapien
agacagaattagttttggatcccag

SEQ ID NO: 580232 - DNA, 25 bp, Homo sapien
ccagtctgtcaccagttacttgttt

SEQ ID NO: 580233 - DNA, 25 bp, Homo sapien
acaactctgagaaatatttacttaa

SEQ ID NO: 580234 - DNA, 25 bp, Homo sapien
gtattttgcagacattttgtgataa

SEQ ID NO: 580235 - DNA, 25 bp, Homo sapien
ccttctgactccagatgtgtgtgga

SEQ ID NO: 580236 - DNA, 25 bp, Homo sapien
ggttccccacgcattaagcaaataa

SEQ ID NO: 580237 - DNA, 25 bp, Homo sapien
aattcacttcttacactacctggag

SEQ ID NO: 580238 - DNA, 25 bp, Homo sapien
accataggttgaaggctcagtgcca

SEQ ID NO: 580239 - DNA, 25 bp, Homo sapien
gctcagtgccacaagatggctccca

SEQ ID NO: 580240 - DNA, 25 bp, Homo sapien
gatggctcccacttcagatgacaat

SEQ ID NO: 580241 - DNA, 25 bp, Homo sapien
cagatgacaatcagaagccccagat

SEQ ID NO: 580242 - DNA, 25 bp, Homo sapien
gtgaccaagggtcctaaccaactag

SEQ ID NO: 580243 - DNA, 25 bp, Homo sapien
ctagctataagttagggttcccata

SEQ ID NO: 580244 - DNA, 25 bp, Homo sapien
ataaccccttcttgagctccattag

SEQ ID NO: 580245 - DNA, 25 bp, Homo sapien
tagagagcctcacagaactcggaaa

SEQ ID NO: 580246 - DNA, 25 bp, Homo sapien
aggccctcaacctctagcagagtgc

SEQ ID NO: 580247 - DNA, 25 bp, Homo sapien
ggccctcaacctctagcagagtgcc

SEQ ID NO: 580248 - DNA, 25 bp, Homo sapien
gccctcaacctctagcagagtgcct

SEQ ID NO: 580249 - DNA, 25 bp, Homo sapien
ccctcaacctctagcagagtgcctt

SEQ ID NO: 580250 - DNA, 25 bp, Homo sapien
cctcaacctctagcagagtgccttg

SEQ ID NO: 580251 - DNA, 25 bp, Homo sapien
ctcaacctctagcagagtgccttgg

SEQ ID NO: 580252 - DNA, 25 bp, Homo sapien
tcaacctctagcagagtgccttggc

SEQ ID NO: 580253 - DNA, 25 bp, Homo sapien
caacctctagcagagtgccttggct

SEQ ID NO: 580254 - DNA, 25 bp, Homo sapien
aacctctagcagagtgccttggctc

SEQ ID NO: 580255 - DNA, 25 bp, Homo sapien
agctctcccttgctgtgctaggaga

SEQ ID NO: 580256 - DNA, 25 bp, Homo sapien
ttgctgtgctaggagagaacccact

SEQ ID NO: 580257 - DNA, 25 bp, Homo sapien
ctgtgctaggagagaacccactggg

SEQ ID NO: 580258 - DNA, 25 bp, Homo sapien
actgggagggtcttggcatctccaa

SEQ ID NO: 580259 - DNA, 25 bp, Homo sapien
tgggagggtcttggcatctccaagt

SEQ ID NO: 580260 - DNA, 25 bp, Homo sapien
cctcctgctgagacactgggtggct

SEQ ID NO: 580261 - DNA, 25 bp, Homo sapien
tcctgctgagacactgggtggctgt

SEQ ID NO: 580262 - DNA, 25 bp, Homo sapien
tggctgtggagggagctcagccctc

SEQ ID NO: 580263 - DNA, 25 bp, Homo sapien
ccgagctcatatctacagagcagca

SEQ ID NO: 580264 - DNA, 25 bp, Homo sapien
aggacaggacaacccagcctcccgg

SEQ ID NO: 580265 - DNA, 25 bp, Homo sapien
gaggacttggcatggctgaggacac

SEQ ID NO: 580266 - DNA, 25 bp, Homo sapien
tacatagtacaatgccagcctggac

SEQ ID NO: 580267 - DNA, 25 bp, Homo sapien
gccagcctggactctagttttaatc

SEQ ID NO: 580268 - DNA, 25 bp, Homo sapien
tacatagggtttaatttagcagcat

SEQ ID NO: 580269 - DNA, 25 bp, Homo sapien
gcagcataatctttttagtcttttg

SEQ ID NO: 580270 - DNA, 25 bp, Homo sapien
gtcttttgaatgatgaggtaacctc

SEQ ID NO: 580271 - DNA, 25 bp, Homo sapien
aacctcataggtattttggcccatt

SEQ ID NO: 580272 - DNA, 25 bp, Homo sapien
aactgactatttagactgactcctt

SEQ ID NO: 580273 - DNA, 25 bp, Homo sapien
tagactgactcctttagatctcctg

SEQ ID NO: 580274 - DNA, 25 bp, Homo sapien
ctttagatctcctgggatgctgacc

SEQ ID NO: 580275 - DNA, 25 bp, Homo sapien
gatgctgacctcttggctttccaat

SEQ ID NO: 580276 - DNA, 25 bp, Homo sapien
ggctttccaattcatgagactattg

SEQ ID NO: 580277 - DNA, 25 bp, Homo sapien
gtcaagaaagggattccgaggccaa

SEQ ID NO: 580278 - DNA, 25 bp, Homo sapien
gaaagggattccgaggccaataagc

SEQ ID NO: 580279 - DNA, 25 bp, Homo sapien
gccaataagccctcctttctcttgg

SEQ ID NO: 580280 - DNA, 25 bp, Homo sapien
cattttgggaatgccatctctgctg

SEQ ID NO: 580281 - DNA, 25 bp, Homo sapien
ctgctccgtggtcccgcagagagct

SEQ ID NO: 580282 - DNA, 25 bp, Homo sapien
gtgccttcactgtttcagtcaggga

SEQ ID NO: 580283 - DNA, 25 bp, Homo sapien
tcactgtttcagtcagggacttgcc

SEQ ID NO: 580284 - DNA, 25 bp, Homo sapien
gtttcagtcagggacttgccagcta

SEQ ID NO: 580285 - DNA, 25 bp, Homo sapien
agtcagggacttgccagctatggaa

SEQ ID NO: 580286 - DNA, 25 bp, Homo sapien
gacttgccagctatggaatgccatt

SEQ ID NO: 580287 - DNA, 25 bp, Homo sapien
ctatggaatgccattaaggtcacct

SEQ ID NO: 580288 - DNA, 25 bp, Homo sapien
tgttcctaggcaaccaatcatctgt

SEQ ID NO: 580289 - DNA, 25 bp, Homo sapien
caaccaatcatctgttttctgtcag

SEQ ID NO: 580290 - DNA, 25 bp, Homo sapien
aatcatctgttttctgtcagattaa

SEQ ID NO: 580291 - DNA, 25 bp, Homo sapien
gaagcagacagcatgtactcttttt

SEQ ID NO: 580292 - DNA, 25 bp, Homo sapien
ggttcatctatattggtgcacgtat

SEQ ID NO: 580293 - DNA, 25 bp, Homo sapien
gtgcacgtatcaacaattcattctt

SEQ ID NO: 580294 - DNA, 25 bp, Homo sapien
caattcattcttttctattcctgag

SEQ ID NO: 580295 - DNA, 25 bp, Homo sapien
cattcttttctattcctgagtacta

SEQ ID NO: 580296 - DNA, 25 bp, Homo sapien
ctattcctgagtactattccattat

SEQ ID NO: 580297 - DNA, 25 bp, Homo sapien
actattccattatataggtgtacta

SEQ ID NO: 580298 - DNA, 25 bp, Homo sapien
ggacattgagttgtttacagttttt

SEQ ID NO: 580299 - DNA, 25 bp, Homo sapien
cctgggttgtggctgaggtgcgaag

SEQ ID NO: 580300 - DNA, 25 bp, Homo sapien
aggtgcgaagactcagcaggcagtc

SEQ ID NO: 580301 - DNA, 25 bp, Homo sapien
gtgcgaagactcagcaggcagtcca

SEQ ID NO: 580302 - DNA, 25 bp, Homo sapien
gaagactcagcaggcagtccaccag

SEQ ID NO: 580303 - DNA, 25 bp, Homo sapien
gactcagcaggcagtccaccagaaa

SEQ ID NO: 580304 - DNA, 25 bp, Homo sapien
tcagcaggcagtccaccagaaagga

SEQ ID NO: 580305 - DNA, 25 bp, Homo sapien
agcaggcagtccaccagaaaggaac

SEQ ID NO: 580306 - DNA, 25 bp, Homo sapien
ggcagtccaccagaaaggaacctgt

SEQ ID NO: 580307 - DNA, 25 bp, Homo sapien
gcagtccaccagaaaggaacctgta

SEQ ID NO: 580308 - DNA, 25 bp, Homo sapien
aagcaagtccggctttgcgtttcac

SEQ ID NO: 580309 - DNA, 25 bp, Homo sapien
caagtccggctttgcgtttcaccct

SEQ ID NO: 580310 - DNA, 25 bp, Homo sapien
cactctgtggggccgaggcaggcag

SEQ ID NO: 580311 - DNA, 25 bp, Homo sapien
actctgtggggccgaggcaggcaga

SEQ ID NO: 580312 - DNA, 25 bp, Homo sapien
ctctgtggggccgaggcaggcagat

SEQ ID NO: 580313 - DNA, 25 bp, Homo sapien
tctgtggggccgaggcaggcagatc

SEQ ID NO: 580314 - DNA, 25 bp, Homo sapien
ctgtggggccgaggcaggcagatcg

SEQ ID NO: 580315 - DNA, 25 bp, Homo sapien
tgtggggccgaggcaggcagatcgc

SEQ ID NO: 580316 - DNA, 25 bp, Homo sapien
gtggggccgaggcaggcagatcgct

SEQ ID NO: 580317 - DNA, 25 bp, Homo sapien
tggggccgaggcaggcagatcgctt

SEQ ID NO: 580318 - DNA, 25 bp, Homo sapien
ccaccacacgtcaatgtcattttca

SEQ ID NO: 580319 - DNA, 25 bp, Homo sapien
gctacaggaagcacacatctgcagt

SEQ ID NO: 580320 - DNA, 25 bp, Homo sapien
agtgtgtcacctcccgaggctgaca

SEQ ID NO: 580321 - DNA, 25 bp, Homo sapien
aggctgacagatctactcagtattt

SEQ ID NO: 580322 - DNA, 25 bp, Homo sapien
taatcccatgatttgcctaaaacca

SEQ ID NO: 580323 - DNA, 25 bp, Homo sapien
aaagcctgctgtgacagagttgtgt

SEQ ID NO: 580324 - DNA, 25 bp, Homo sapien
agaaacgcagaatttccccgagctt

SEQ ID NO: 580325 - DNA, 25 bp, Homo sapien
gagcttccgctttgcaggaatctct

SEQ ID NO: 580326 - DNA, 25 bp, Homo sapien
aggaatctctgttccgttactcact

SEQ ID NO: 580327 - DNA, 25 bp, Homo sapien
tctgttccgttactcactattttga

SEQ ID NO: 580328 - DNA, 25 bp, Homo sapien
tattttgagagagccctgcttcttc

SEQ ID NO: 580329 - DNA, 25 bp, Homo sapien
ccggcgagggagaggccggacctga

SEQ ID NO: 580330 - DNA, 25 bp, Homo sapien
gcgctcgcgacgaggaggatccgga

SEQ ID NO: 580331 - DNA, 25 bp, Homo sapien
tcgcgacgaggaggatccggagccg

SEQ ID NO: 580332 - DNA, 25 bp, Homo sapien
ggaggatccggagccgccggtggct

SEQ ID NO: 580333 - DNA, 25 bp, Homo sapien
ttccctcgagacccgccaagaaata

SEQ ID NO: 580334 - DNA, 25 bp, Homo sapien
ctcgagacccgccaagaaataaagg

SEQ ID NO: 580335 - DNA, 25 bp, Homo sapien
gagacccgccaagaaataaaggcga

SEQ ID NO: 580336 - DNA, 25 bp, Homo sapien
aataaaggcgatgatttccgaccaa

SEQ ID NO: 580337 - DNA, 25 bp, Homo sapien
ataaaggcgatgatttccgaccaaa

SEQ ID NO: 580338 - DNA, 25 bp, Homo sapien
taaaggcgatgatttccgaccaaaa

SEQ ID NO: 580339 - DNA, 25 bp, Homo sapien
ggtggagcggcagctgcactcgccg

SEQ ID NO: 580340 - DNA, 25 bp, Homo sapien
gcacttgaaatgaggctagttcgtt

SEQ ID NO: 580341 - DNA, 25 bp, Homo sapien
tgaggctagttcgtttaggaggcac

SEQ ID NO: 580342 - DNA, 25 bp, Homo sapien
aggctagttcgtttaggaggcactg

SEQ ID NO: 580343 - DNA, 25 bp, Homo sapien
tgcaaaatacgcacgggtgtcagtt

SEQ ID NO: 580344 - DNA, 25 bp, Homo sapien
aaatacgcacgggtgtcagttcgac

SEQ ID NO: 580345 - DNA, 25 bp, Homo sapien
tacgcacgggtgtcagttcgacgaa

SEQ ID NO: 580346 - DNA, 25 bp, Homo sapien
gcacgggtgtcagttcgacgaatgt

SEQ ID NO: 580347 - DNA, 25 bp, Homo sapien
acgggtgtcagttcgacgaatgtga

SEQ ID NO: 580348 - DNA, 25 bp, Homo sapien
agttcgacgaatgtgaaatacctca

SEQ ID NO: 580349 - DNA, 25 bp, Homo sapien
gacgaatgtgaaatacctcactgat

SEQ ID NO: 580350 - DNA, 25 bp, Homo sapien
taaagaaaatgtaagccgggcacgg

SEQ ID NO: 580351 - DNA, 25 bp, Homo sapien
gaagcctttcaaacaggaactaggg

SEQ ID NO: 580352 - DNA, 25 bp, Homo sapien
caccaggaccttgtggactgacagt

SEQ ID NO: 580353 - DNA, 25 bp, Homo sapien
accttgtggactgacagtggaggct

SEQ ID NO: 580354 - DNA, 25 bp, Homo sapien
agatgccttcaggacagacagcatt

SEQ ID NO: 580355 - DNA, 25 bp, Homo sapien
tcaggacagacagcattcgggaaca

SEQ ID NO: 580356 - DNA, 25 bp, Homo sapien
attcgggaacagataccagctcctt

SEQ ID NO: 580357 - DNA, 25 bp, Homo sapien
agataccagctccttacagtcttgg

SEQ ID NO: 580358 - DNA, 25 bp, Homo sapien
ctccttacagtcttggcctccagat

SEQ ID NO: 580359 - DNA, 25 bp, Homo sapien
tggcctccagattagacatggccct

SEQ ID NO: 580360 - DNA, 25 bp, Homo sapien
acctggaattaccagacagcaattc

SEQ ID NO: 580361 - DNA, 25 bp, Homo sapien
ggaatgggagcacaacatgtaaatt

SEQ ID NO: 580362 - DNA, 25 bp, Homo sapien
atattaggccttagtcaatctcaga

SEQ ID NO: 580363 - DNA, 25 bp, Homo sapien
gtcaatctcagatagcttcaccaat

SEQ ID NO: 580364 - DNA, 25 bp, Homo sapien
tagcttcaccaattcagctccttaa

SEQ ID NO: 580365 - DNA, 25 bp, Homo sapien
gctccttaaaaggttgcttatgaag

SEQ ID NO: 580366 - DNA, 25 bp, Homo sapien
gaagtgtgaattgtagtggtagcta

SEQ ID NO: 580367 - DNA, 25 bp, Homo sapien
gtggtagctactgtttcatggtggt

SEQ ID NO: 580368 - DNA, 25 bp, Homo sapien
catggtggtaaatattcgttttgac

SEQ ID NO: 580369 - DNA, 25 bp, Homo sapien
tcgttttgactttatgtacattttc

SEQ ID NO: 580370 - DNA, 25 bp, Homo sapien
ttctattaaacattggagtcatcct

SEQ ID NO: 580371 - DNA, 25 bp, Homo sapien
gagtcatcctgatagacatctttgt

SEQ ID NO: 580372 - DNA, 25 bp, Homo sapien
tcaaaacaacatgtgggacaggcgt

SEQ ID NO: 580373 - DNA, 25 bp, Homo sapien
gatcaggtcatgagaactctgccct

SEQ ID NO: 580374 - DNA, 25 bp, Homo sapien
aactctgccctcgtgaatgggttaa

SEQ ID NO: 580375 - DNA, 25 bp, Homo sapien
gggttaatacccttatcgcagtagt

SEQ ID NO: 580376 - DNA, 25 bp, Homo sapien
ttcctcctttcaccatgggataaca

SEQ ID NO: 580377 - DNA, 25 bp, Homo sapien
gagaaatacatgtcttttccttata

SEQ ID NO: 580378 - DNA, 25 bp, Homo sapien
tgttatagcggcagaaaatggacta

SEQ ID NO: 580379 - DNA, 25 bp, Homo sapien
aatggactaagacggcattttgcat

SEQ ID NO: 580380 - DNA, 25 bp, Homo sapien
ggactaagacggcattttgcataca

SEQ ID NO: 580381 - DNA, 25 bp, Homo sapien
gactaagacggcattttgcatacat

SEQ ID NO: 580382 - DNA, 25 bp, Homo sapien
ctaagacggcattttgcatacatta

SEQ ID NO: 580383 - DNA, 25 bp, Homo sapien
agacggcattttgcatacattatct

SEQ ID NO: 580384 - DNA, 25 bp, Homo sapien
gggtgcacagaacagtgaacggttg

SEQ ID NO: 580385 - DNA, 25 bp, Homo sapien
ggtgcacagaacagtgaacggttgg

SEQ ID NO: 580386 - DNA, 25 bp, Homo sapien
gtgcacagaacagtgaacggttggc

SEQ ID NO: 580387 - DNA, 25 bp, Homo sapien
tgcacagaacagtgaacggttggcc

SEQ ID NO: 580388 - DNA, 25 bp, Homo sapien
gcacagaacagtgaacggttggccg

SEQ ID NO: 580389 - DNA, 25 bp, Homo sapien
cacagaacagtgaacggttggccgg

SEQ ID NO: 580390 - DNA, 25 bp, Homo sapien
acagaacagtgaacggttggccggg

SEQ ID NO: 580391 - DNA, 25 bp, Homo sapien
cagaacagtgaacggttggccgggt

SEQ ID NO: 580392 - DNA, 25 bp, Homo sapien
gaacagtgaacggttggccgggtgc

SEQ ID NO: 580393 - DNA, 25 bp, Homo sapien
aacagtgaacggttggccgggtgca

SEQ ID NO: 580394 - DNA, 25 bp, Homo sapien
acagtgaacggttggccgggtgcag

SEQ ID NO: 580395 - DNA, 25 bp, Homo sapien
gaggatctaaagaacttccgccccg

SEQ ID NO: 580396 - DNA, 25 bp, Homo sapien
gccccgccaaaaagatcctggtgaa

SEQ ID NO: 580397 - DNA, 25 bp, Homo sapien
gaaaacctggacttgcggattcgac

SEQ ID NO: 580398 - DNA, 25 bp, Homo sapien
tggacttgcggattcgaccccatgt

SEQ ID NO: 580399 - DNA, 25 bp, Homo sapien
accccatgtcctcctgaaggtgctg

SEQ ID NO: 580400 - DNA, 25 bp, Homo sapien
tgcaggatctgaggatttgggaact

SEQ ID NO: 580401 - DNA, 25 bp, Homo sapien
gaggatttgggaactgtgctcccct

SEQ ID NO: 580402 - DNA, 25 bp, Homo sapien
tttgggaactgtgctcccctgacat

SEQ ID NO: 580403 - DNA, 25 bp, Homo sapien
ccctgacatcgctgtggctattgag

SEQ ID NO: 580404 - DNA, 25 bp, Homo sapien
ctgtggctattgagtttgtgcgaga

SEQ ID NO: 580405 - DNA, 25 bp, Homo sapien
gtttgtgcgagaacacatcatccat

SEQ ID NO: 580406 - DNA, 25 bp, Homo sapien
ttttgctcaaaagaactcaactaaa

SEQ ID NO: 580407 - DNA, 25 bp, Homo sapien
ctaaagaattcaaacgctgtatgga

SEQ ID NO: 580408 - DNA, 25 bp, Homo sapien
acctcaattcctttttctatgtgcg

SEQ ID NO: 580409 - DNA, 25 bp, Homo sapien
aattcctttttctatgtgcgttcct

SEQ ID NO: 580410 - DNA, 25 bp, Homo sapien
ttttctatgtgcgttcctgccaaaa

SEQ ID NO: 580411 - DNA, 25 bp, Homo sapien
ctatgtgcgttcctgccaaaatcat

SEQ ID NO: 580412 - DNA, 25 bp, Homo sapien
aagggcactggcctgaggaacctgt

SEQ ID NO: 580413 - DNA, 25 bp, Homo sapien
atgctagccctaccatcaccttgtt

SEQ ID NO: 580414 - DNA, 25 bp, Homo sapien
taccatcaccttgttctctgtgagg

SEQ ID NO: 580415 - DNA, 25 bp, Homo sapien
gtggaggaacctgctgaatgacaag

SEQ ID NO: 580416 - DNA, 25 bp, Homo sapien
gaacctgctgaatgacaagtaactt

SEQ ID NO: 580417 - DNA, 25 bp, Homo sapien
gcccacagtggattgggaggccctt

SEQ ID NO: 580418 - DNA, 25 bp, Homo sapien
ttgggaggcccttgaagaatcccct

SEQ ID NO: 580419 - DNA, 25 bp, Homo sapien
gatcaggaagtcagaggcgtagtct

SEQ ID NO: 580420 - DNA, 25 bp, Homo sapien
gtagtctaggaaatctagcccctga

SEQ ID NO: 580421 - DNA, 25 bp, Homo sapien
aatctagcccctgataggagtttca

SEQ ID NO: 580422 - DNA, 25 bp, Homo sapien
tagcccctgataggagtttcagaaa

SEQ ID NO: 580423 - DNA, 25 bp, Homo sapien
ggacccaaaggctttgcatttccag

SEQ ID NO: 580424 - DNA, 25 bp, Homo sapien
caaaggctttgcatttccaggttaa

SEQ ID NO: 580425 - DNA, 25 bp, Homo sapien
aagtccaccagaaagtccgcccaag

SEQ ID NO: 580426 - DNA, 25 bp, Homo sapien
gaaagtccgcccaagaatggaaatt

SEQ ID NO: 580427 - DNA, 25 bp, Homo sapien
ggaaattacccaaaccacaatgcat

SEQ ID NO: 580428 - DNA, 25 bp, Homo sapien
tggtggatccagagttagtcttgct

SEQ ID NO: 580429 - DNA, 25 bp, Homo sapien
agagttagtcttgctgcccagctgc

SEQ ID NO: 580430 - DNA, 25 bp, Homo sapien
gccactccctagacacaattttaaa

SEQ ID NO: 580431 - DNA, 25 bp, Homo sapien
aaattgtcagatatacctttagtaa

SEQ ID NO: 580432 - DNA, 25 bp, Homo sapien
tcaaagctcatttgtcggtgaaaat

SEQ ID NO: 580433 - DNA, 25 bp, Homo sapien
ttgtcggtgaaaatgctgtgctaag

SEQ ID NO: 580434 - DNA, 25 bp, Homo sapien
aatgctgtgctaagcctggcagaag

SEQ ID NO: 580435 - DNA, 25 bp, Homo sapien
ggcagaagtctgctcccacactcag

SEQ ID NO: 580436 - DNA, 25 bp, Homo sapien
tcccacactcagaatcaccataaat

SEQ ID NO: 580437 - DNA, 25 bp, Homo sapien
accataaatgtgcaacatcaccaga

SEQ ID NO: 580438 - DNA, 25 bp, Homo sapien
gtacacgacacctggcctggtggat

SEQ ID NO: 580439 - DNA, 25 bp, Homo sapien
tggcattcactcctaggcactgctg

SEQ ID NO: 580440 - DNA, 25 bp, Homo sapien
taggcactgctgactcagtctgtcc

SEQ ID NO: 580441 - DNA, 25 bp, Homo sapien
ctgactcagtctgtcctggtggtgc

SEQ ID NO: 580442 - DNA, 25 bp, Homo sapien
tgctgggaggccgaaacccgtcatg

SEQ ID NO: 580443 - DNA, 25 bp, Homo sapien
ggccgaaacccgtcatgcatgtaaa

SEQ ID NO: 580444 - DNA, 25 bp, Homo sapien
gagtaggaaaagtattcctggacct

SEQ ID NO: 580445 - DNA, 25 bp, Homo sapien
tggttgaatctttggccaaattgga

SEQ ID NO: 580446 - DNA, 25 bp, Homo sapien
tggccaaattggaactgcaaactct

SEQ ID NO: 580447 - DNA, 25 bp, Homo sapien
tgcaaactctgtattatctcccctt

SEQ ID NO: 580448 - DNA, 25 bp, Homo sapien
gaaattctatggaaaattcgagcaa

SEQ ID NO: 580449 - DNA, 25 bp, Homo sapien
gcaaataaatatgcatttcccagtg

SEQ ID NO: 580450 - DNA, 25 bp, Homo sapien
ttttgtctcgcaaaaagcctttgct

SEQ ID NO: 580451 - DNA, 25 bp, Homo sapien
gctctcatctcagcttagaatgtcc

SEQ ID NO: 580452 - DNA, 25 bp, Homo sapien
ttagaatgtccatccatcacagtta

SEQ ID NO: 580453 - DNA, 25 bp, Homo sapien
ggccagcacggacctccagaatgtg

SEQ ID NO: 580454 - DNA, 25 bp, Homo sapien
tgtgcaatgagctttgtaggcaatt

SEQ ID NO: 580455 - DNA, 25 bp, Homo sapien
gtaggcaattaccactttctccaag

SEQ ID NO: 580456 - DNA, 25 bp, Homo sapien
cactttctccaagggctctgtagga

SEQ ID NO: 580457 - DNA, 25 bp, Homo sapien
ggaacggtagcattgtggtctaaaa

SEQ ID NO: 580458 - DNA, 25 bp, Homo sapien
ggtctaaaagctgcattctgccaca

SEQ ID NO: 580459 - DNA, 25 bp, Homo sapien
attctgccacagatcaacatgatga

SEQ ID NO: 580460 - DNA, 25 bp, Homo sapien
ttatttatctgtatcaccggccatg

SEQ ID NO: 580461 - DNA, 25 bp, Homo sapien
tagatccaagtagtgttaagtagtc

SEQ ID NO: 580462 - DNA, 25 bp, Homo sapien
ccaagtagtgttaagtagtcataat

SEQ ID NO: 580463 - DNA, 25 bp, Homo sapien
gtagtcataatttttggatggcttt

SEQ ID NO: 580464 - DNA, 25 bp, Homo sapien
gatggcttttcaattgatgtcctaa

SEQ ID NO: 580465 - DNA, 25 bp, Homo sapien
ttttcaattgatgtcctaagactag

SEQ ID NO: 580466 - DNA, 25 bp, Homo sapien
attgatgtcctaagactagaagggt

SEQ ID NO: 580467 - DNA, 25 bp, Homo sapien
gactagaagggtaagcagccttttc

SEQ ID NO: 580468 - DNA, 25 bp, Homo sapien
gaagggtaagcagccttttctaata

SEQ ID NO: 580469 - DNA, 25 bp, Homo sapien
gggtaagcagccttttctaatattt

SEQ ID NO: 580470 - DNA, 25 bp, Homo sapien
gtaagcagccttttctaatatttct

SEQ ID NO: 580471 - DNA, 25 bp, Homo sapien
tcttttgctttacaaaggtgataga

SEQ ID NO: 580472 - DNA, 25 bp, Homo sapien
ggctgcatgatggcctcgtaatggc

SEQ ID NO: 580473 - DNA, 25 bp, Homo sapien
tgtggtgacgccctctgcgtcttct

SEQ ID NO: 580474 - DNA, 25 bp, Homo sapien
aacagagcagcacattatgcctgga

SEQ ID NO: 580475 - DNA, 25 bp, Homo sapien
gagcagcacattatgcctggataag

SEQ ID NO: 580476 - DNA, 25 bp, Homo sapien
gcacattatgcctggataagactca

SEQ ID NO: 580477 - DNA, 25 bp, Homo sapien
ggataagactcaaagagcagcttaa

SEQ ID NO: 580478 - DNA, 25 bp, Homo sapien
gagcagcttaatatcaggttctctg

SEQ ID NO: 580479 - DNA, 25 bp, Homo sapien
gcagcttaatatcaggttctctggg

SEQ ID NO: 580480 - DNA, 25 bp, Homo sapien
gggctgtaatcatcggttcaggatg

SEQ ID NO: 580481 - DNA, 25 bp, Homo sapien
aatcatcggttcaggatggagcaga

SEQ ID NO: 580482 - DNA, 25 bp, Homo sapien
agcagacacagccgcagcaaggcct

SEQ ID NO: 580483 - DNA, 25 bp, Homo sapien
ggtctgcctactcccacagtaaaat

SEQ ID NO: 580484 - DNA, 25 bp, Homo sapien
acagtaaaatgctgtccaacctccc

SEQ ID NO: 580485 - DNA, 25 bp, Homo sapien
tccctttcaaaattacctccgctgg

SEQ ID NO: 580486 - DNA, 25 bp, Homo sapien
aaagttttagcaaggcagccccatg

SEQ ID NO: 580487 - DNA, 25 bp, Homo sapien
aaggcagccccatggtatctaggga

SEQ ID NO: 580488 - DNA, 25 bp, Homo sapien
ggaggtctgaaggatggttatcttt

SEQ ID NO: 580489 - DNA, 25 bp, Homo sapien
gggcgcagttatggatcattgctat

SEQ ID NO: 580490 - DNA, 25 bp, Homo sapien
tggatcattgctattttcttctcta

SEQ ID NO: 580491 - DNA, 25 bp, Homo sapien
tgctattttcttctctatacttgaa

SEQ ID NO: 580492 - DNA, 25 bp, Homo sapien
atatgcttctttttaggcctcttct

SEQ ID NO: 580493 - DNA, 25 bp, Homo sapien
ttctcagcacactgttccaaccaaa

SEQ ID NO: 580494 - DNA, 25 bp, Homo sapien
tgagttcccagacccttcccaagat

SEQ ID NO: 580495 - DNA, 25 bp, Homo sapien
ttcccagacccttcccaagatggaa

SEQ ID NO: 580496 - DNA, 25 bp, Homo sapien
gatggaaccaataacattcacagca

SEQ ID NO: 580497 - DNA, 25 bp, Homo sapien
ggaaccaataacattcacagcaagg

SEQ ID NO: 580498 - DNA, 25 bp, Homo sapien
attcacagcaaggaaacatctgctt

SEQ ID NO: 580499 - DNA, 25 bp, Homo sapien
acatctgctttctaacgaggtctcg

SEQ ID NO: 580500 - DNA, 25 bp, Homo sapien
catctgctttctaacgaggtctcgg

SEQ ID NO: 580501 - DNA, 25 bp, Homo sapien
gtgcgaagactcagcaggcagtcca

SEQ ID NO: 580502 - DNA, 25 bp, Homo sapien
ggcagtccaccagaaaggaacctgt

SEQ ID NO: 580503 - DNA, 25 bp, Homo sapien
aagcaagtccggctttgcgtttcac

SEQ ID NO: 580504 - DNA, 25 bp, Homo sapien
tctggactgagatgtgaacctgagc

SEQ ID NO: 580505 - DNA, 25 bp, Homo sapien
ccttcccaagatggaaccaataaca

SEQ ID NO: 580506 - DNA, 25 bp, Homo sapien
agatggaaccaataacattcacagc

SEQ ID NO: 580507 - DNA, 25 bp, Homo sapien
gatggaaccaataacattcacagca

SEQ ID NO: 580508 - DNA, 25 bp, Homo sapien
atggaaccaataacattcacagcaa

SEQ ID NO: 580509 - DNA, 25 bp, Homo sapien
tggaaccaataacattcacagcaag

SEQ ID NO: 580510 - DNA, 25 bp, Homo sapien
ggaaccaataacattcacagcaagg

SEQ ID NO: 580511 - DNA, 25 bp, Homo sapien
gaaccaataacattcacagcaagga

SEQ ID NO: 580512 - DNA, 25 bp, Homo sapien
accaataacattcacagcaaggaaa

SEQ ID NO: 580513 - DNA, 25 bp, Homo sapien
taacattcacagcaaggaaacatct

SEQ ID NO: 580514 - DNA, 25 bp, Homo sapien
acattcacagcaaggaaacatctgc

SEQ ID NO: 580515 - DNA, 25 bp, Homo sapien
attcacagcaaggaaacatctgctt

SEQ ID NO: 580516 - DNA, 25 bp, Homo sapien
aaacttacagtcacagcggaaggca

SEQ ID NO: 580517 - DNA, 25 bp, Homo sapien
aggaagcaggcagcggcttcgtggc

SEQ ID NO: 580518 - DNA, 25 bp, Homo sapien
agcaggcagcggcttcgtggcagga

SEQ ID NO: 580519 - DNA, 25 bp, Homo sapien
gcaggcagcggcttcgtggcaggag

SEQ ID NO: 580520 - DNA, 25 bp, Homo sapien
aggcagcggcttcgtggcaggagca

SEQ ID NO: 580521 - DNA, 25 bp, Homo sapien
ggcagcggcttcgtggcaggagcag

SEQ ID NO: 580522 - DNA, 25 bp, Homo sapien
gcagcggcttcgtggcaggagcagg

SEQ ID NO: 580523 - DNA, 25 bp, Homo sapien
cagcggcttcgtggcaggagcagga

SEQ ID NO: 580524 - DNA, 25 bp, Homo sapien
gcaagggggaattctgcgccctgat

SEQ ID NO: 580525 - DNA, 25 bp, Homo sapien
tcctcctccaacagtggggattaca

SEQ ID NO: 580526 - DNA, 25 bp, Homo sapien
tagttgccctgctaacttttttaat

SEQ ID NO: 580527 - DNA, 25 bp, Homo sapien
aattcaaaaattgccctgagctgag

SEQ ID NO: 580528 - DNA, 25 bp, Homo sapien
attgccctgagctgagataatgtct

SEQ ID NO: 580529 - DNA, 25 bp, Homo sapien
agataatgtctctcaggtctaccac

SEQ ID NO: 580530 - DNA, 25 bp, Homo sapien
cacccatttttatagtggatttaag

SEQ ID NO: 580531 - DNA, 25 bp, Homo sapien
tagtggatttaagcataggtgttat

SEQ ID NO: 580532 - DNA, 25 bp, Homo sapien
atccttataatggtatgtgtccctt

SEQ ID NO: 580533 - DNA, 25 bp, Homo sapien
gtatgtgtcccttaccaaaatgaag

SEQ ID NO: 580534 - DNA, 25 bp, Homo sapien
gtgtcccttaccaaaatgaagcttt

SEQ ID NO: 580535 - DNA, 25 bp, Homo sapien
gaagcttttagagaaactgacatat

SEQ ID NO: 580536 - DNA, 25 bp, Homo sapien
tgacatattagtgattcagttgaaa

SEQ ID NO: 580537 - DNA, 25 bp, Homo sapien
tttgctggttatagaaatcgtgttc

SEQ ID NO: 580538 - DNA, 25 bp, Homo sapien
tattctgtgcgcaggcggcagaagc

SEQ ID NO: 580539 - DNA, 25 bp, Homo sapien
cgcaggcggcagaagccaagtgaca

SEQ ID NO: 580540 - DNA, 25 bp, Homo sapien
gccaagtgacagagctgactcgcgg

SEQ ID NO: 580541 - DNA, 25 bp, Homo sapien
aagcagtttaaacgcagaagctgcc

SEQ ID NO: 580542 - DNA, 25 bp, Homo sapien
gaatttggagagagcatcatgtcag

SEQ ID NO: 580543 - DNA, 25 bp, Homo sapien
tcagagaacaggtcacgggaagagc

SEQ ID NO: 580544 - DNA, 25 bp, Homo sapien
aagtgggcagtcagtctagcttttc

SEQ ID NO: 580545 - DNA, 25 bp, Homo sapien
agtcagtctagcttttcgggcagca

SEQ ID NO: 580546 - DNA, 25 bp, Homo sapien
gcttttcgggcagcatggaaatcat

SEQ ID NO: 580547 - DNA, 25 bp, Homo sapien
gaaatcattgaggtctcctgagaag

SEQ ID NO: 580548 - DNA, 25 bp, Homo sapien
gacacttgtgacttctatagacaat

SEQ ID NO: 580549 - DNA, 25 bp, Homo sapien
ggagggtgcctggatccctgagtca

SEQ ID NO: 580550 - DNA, 25 bp, Homo sapien
gatccctgagtcaccacttgaagca

SEQ ID NO: 580551 - DNA, 25 bp, Homo sapien
ccctgagtcaccacttgaagcaaaa

SEQ ID NO: 580552 - DNA, 25 bp, Homo sapien
gagtcaccacttgaagcaaaaaggt

SEQ ID NO: 580553 - DNA, 25 bp, Homo sapien
aaaaggtcaagagtagccacctgac

SEQ ID NO: 580554 - DNA, 25 bp, Homo sapien
tcaagagtagccacctgacccatat

SEQ ID NO: 580555 - DNA, 25 bp, Homo sapien
agagtagccacctgacccatatcag

SEQ ID NO: 580556 - DNA, 25 bp, Homo sapien
agccacctgacccatatcaggctat

SEQ ID NO: 580557 - DNA, 25 bp, Homo sapien
tgacccatatcaggctatgaaatga

SEQ ID NO: 580558 - DNA, 25 bp, Homo sapien
gaaaatgacacgaggctttggaacc

SEQ ID NO: 580559 - DNA, 25 bp, Homo sapien
aatgacacgaggctttggaaccaag

SEQ ID NO: 580560 - DNA, 25 bp, Homo sapien
cagggctccactgtgcttttccaaa

SEQ ID NO: 580561 - DNA, 25 bp, Homo sapien
tccactgtgcttttccaaactctca

SEQ ID NO: 580562 - DNA, 25 bp, Homo sapien
aggcgtcctgtgcagcacgccactg

SEQ ID NO: 580563 - DNA, 25 bp, Homo sapien
agctcctgcttggtcagtgttccta

SEQ ID NO: 580564 - DNA, 25 bp, Homo sapien
tcctgcttggtcagtgttcctagtt

SEQ ID NO: 580565 - DNA, 25 bp, Homo sapien
gagtgtcagaaattgaacaacccaa

SEQ ID NO: 580566 - DNA, 25 bp, Homo sapien
attgaacaacccaattagctggtat

SEQ ID NO: 580567 - DNA, 25 bp, Homo sapien
caacccaattagctggtatttcatt

SEQ ID NO: 580568 - DNA, 25 bp, Homo sapien
cccaattagctggtatttcatttgt

SEQ ID NO: 580569 - DNA, 25 bp, Homo sapien
caacctatgaatggaggagtagcct

SEQ ID NO: 580570 - DNA, 25 bp, Homo sapien
tggaggagtagccttaattcccttg

SEQ ID NO: 580571 - DNA, 25 bp, Homo sapien
gaatggcctggtgccatccttttgg

SEQ ID NO: 580572 - DNA, 25 bp, Homo sapien
ggcctggtgccatccttttggtaat

SEQ ID NO: 580573 - DNA, 25 bp, Homo sapien
gtgagttctcactgtattagatcct

SEQ ID NO: 580574 - DNA, 25 bp, Homo sapien
gttctcactgtattagatcctgttg

SEQ ID NO: 580575 - DNA, 25 bp, Homo sapien
cactgtattagatcctgttgaaaat

SEQ ID NO: 580576 - DNA, 25 bp, Homo sapien
tcactatgtgatgcctgctcccctt

SEQ ID NO: 580577 - DNA, 25 bp, Homo sapien
atgagtggaagcacctataccccaa

SEQ ID NO: 580578 - DNA, 25 bp, Homo sapien
agtggaagcacctataccccaaagc

SEQ ID NO: 580579 - DNA, 25 bp, Homo sapien
agccctcaccagaaggaggtgccgg

SEQ ID NO: 580580 - DNA, 25 bp, Homo sapien
gtgccggcacctgtacagcttgtaa

SEQ ID NO: 580581 - DNA, 25 bp, Homo sapien
cagcttgtaagaaccatgactcaaa

SEQ ID NO: 580582 - DNA, 25 bp, Homo sapien
gcagctgatggaagtcctattggca

SEQ ID NO: 580583 - DNA, 25 bp, Homo sapien
aagtcctattggcagacagccttct

SEQ ID NO: 580584 - DNA, 25 bp, Homo sapien
ttcaggacttgcctcagttgcagag

SEQ ID NO: 580585 - DNA, 25 bp, Homo sapien
gggactcacaaccaatggctgatcc

SEQ ID NO: 580586 - DNA, 25 bp, Homo sapien
tggctgatccagaagaatccataaa

SEQ ID NO: 580587 - DNA, 25 bp, Homo sapien
gaagaatccataaagcccgtatcat

SEQ ID NO: 580588 - DNA, 25 bp, Homo sapien
cccgtatcatttcagcccaatttag

SEQ ID NO: 580589 - DNA, 25 bp, Homo sapien
gcccaatttaggacagctttgttga

SEQ ID NO: 580590 - DNA, 25 bp, Homo sapien
gctttgttgagccattagacctaca

SEQ ID NO: 580591 - DNA, 25 bp, Homo sapien
attagacctacatgcagcccaacct

SEQ ID NO: 580592 - DNA, 25 bp, Homo sapien
tttccttccacggtgtctgttccaa

SEQ ID NO: 580593 - DNA, 25 bp, Homo sapien
agagaccttggatggtttagaagcc

SEQ ID NO: 580594 - DNA, 25 bp, Homo sapien
gatggtttagaagccatgtgtagaa

SEQ ID NO: 580595 - DNA, 25 bp, Homo sapien
gtagaagatggcaaccttcccttag

SEQ ID NO: 580596 - DNA, 25 bp, Homo sapien
gaagatggcaaccttcccttagcat

SEQ ID NO: 580597 - DNA, 25 bp, Homo sapien
gatggcaaccttcccttagcatgga

SEQ ID NO: 580598 - DNA, 25 bp, Homo sapien
aaccttcccttagcatggatccttg

SEQ ID NO: 580599 - DNA, 25 bp, Homo sapien
cttcccttagcatggatccttgaat

SEQ ID NO: 580600 - DNA, 25 bp, Homo sapien
ccttagcatggatccttgaatgact

SEQ ID NO: 580601 - DNA, 25 bp, Homo sapien
agcatggatccttgaatgactgtgg

SEQ ID NO: 580602 - DNA, 25 bp, Homo sapien
atgactgtggagtgcaatgccttct

SEQ ID NO: 580603 - DNA, 25 bp, Homo sapien
gtggagtgcaatgccttctaccaat

SEQ ID NO: 580604 - DNA, 25 bp, Homo sapien
gggagccagggctgtcttcgtattc

SEQ ID NO: 580605 - DNA, 25 bp, Homo sapien
agccagggctgtcttcgtattccca

SEQ ID NO: 580606 - DNA, 25 bp, Homo sapien
agggctgtcttcgtattcccattag

SEQ ID NO: 580607 - DNA, 25 bp, Homo sapien
ggctgtcttcgtattcccattagac

SEQ ID NO: 580608 - DNA, 25 bp, Homo sapien
ctgtcttcgtattcccattagacca

SEQ ID NO: 580609 - DNA, 25 bp, Homo sapien
catcggctatcgttagtgctagtgg

SEQ ID NO: 580610 - DNA, 25 bp, Homo sapien
tcggctatcgttagtgctagtggat

SEQ ID NO: 580611 - DNA, 25 bp, Homo sapien
ggctatcgttagtgctagtggattt

SEQ ID NO: 580612 - DNA, 25 bp, Homo sapien
tcgttagtgctagtggattttacat

SEQ ID NO: 580613 - DNA, 25 bp, Homo sapien
tgctagtggattttacatgtggccc

SEQ ID NO: 580614 - DNA, 25 bp, Homo sapien
caaaagattggatacgcatcagaca

SEQ ID NO: 580615 - DNA, 25 bp, Homo sapien
aaaaatattcatgtgcattgattac

SEQ ID NO: 580616 - DNA, 25 bp, Homo sapien
aaaatattcatgtgcattgattaca

SEQ ID NO: 580617 - DNA, 25 bp, Homo sapien
aaatattcatgtgcattgattacac

SEQ ID NO: 580618 - DNA, 25 bp, Homo sapien
aatattcatgtgcattgattacaca

SEQ ID NO: 580619 - DNA, 25 bp, Homo sapien
atattcatgtgcattgattacacaa

SEQ ID NO: 580620 - DNA, 25 bp, Homo sapien
tattcatgtgcattgattacacaat

SEQ ID NO: 580621 - DNA, 25 bp, Homo sapien
attcatgtgcattgattacacaata

SEQ ID NO: 580622 - DNA, 25 bp, Homo sapien
ttcatgtgcattgattacacaataa

SEQ ID NO: 580623 - DNA, 25 bp, Homo sapien
tcatgtgcattgattacacaataaa

SEQ ID NO: 580624 - DNA, 25 bp, Homo sapien
catgtgcattgattacacaataaac

SEQ ID NO: 580625 - DNA, 25 bp, Homo sapien
caagtaaatacgtgggaaaactgag

SEQ ID NO: 580626 - DNA, 25 bp, Homo sapien
tccccttaacttttgctacttctga

SEQ ID NO: 580627 - DNA, 25 bp, Homo sapien
ctgaccattttccacttatgttatt

SEQ ID NO: 580628 - DNA, 25 bp, Homo sapien
ttccacttatgttattatgcttctg

SEQ ID NO: 580629 - DNA, 25 bp, Homo sapien
tatgcttctgtatccatctgtctgc

SEQ ID NO: 580630 - DNA, 25 bp, Homo sapien
atctgtctgcctatgtctagctatc

SEQ ID NO: 580631 - DNA, 25 bp, Homo sapien
tgcctatgtctagctatccatcatc

SEQ ID NO: 580632 - DNA, 25 bp, Homo sapien
agctatccatcatctatcaatcaat

SEQ ID NO: 580633 - DNA, 25 bp, Homo sapien
atcttgcaatggaggaattaactgt

SEQ ID NO: 580634 - DNA, 25 bp, Homo sapien
gcttctctcatattcctattaacat

SEQ ID NO: 580635 - DNA, 25 bp, Homo sapien
aacatattggaaacgctcagctaaa

SEQ ID NO: 580636 - DNA, 25 bp, Homo sapien
gtctaatgctttgggcagatattga

SEQ ID NO: 580637 - DNA, 25 bp, Homo sapien
ataggtcagctctttgatgcatcgc

SEQ ID NO: 580638 - DNA, 25 bp, Homo sapien
ttgatgcatcgctcaagtctgcggg

SEQ ID NO: 580639 - DNA, 25 bp, Homo sapien
tgggcctctgcactgcgacggattt

SEQ ID NO: 580640 - DNA, 25 bp, Homo sapien
gcgacggatttcatcctccagttca

SEQ ID NO: 580641 - DNA, 25 bp, Homo sapien
ccagttcacgaacctgcaaccaaaa

SEQ ID NO: 580642 - DNA, 25 bp, Homo sapien
gcaaccaaaacgtgacctcagacca

SEQ ID NO: 580643 - DNA, 25 bp, Homo sapien
ccaagtctggcattctatttgctga

SEQ ID NO: 580644 - DNA, 25 bp, Homo sapien
tgtcaagggaacatgcacacactgt

SEQ ID NO: 580645 - DNA, 25 bp, Homo sapien
cacacactgtttttggtgcttaaac

SEQ ID NO: 580646 - DNA, 25 bp, Homo sapien
ggtgcttaaacaggacagtgtctct

SEQ ID NO: 580647 - DNA, 25 bp, Homo sapien
ggaaaactctctcgccaaaagtaag

SEQ ID NO: 580648 - DNA, 25 bp, Homo sapien
taattcccctctaggctgttctttt

SEQ ID NO: 580649 - DNA, 25 bp, Homo sapien
gggtacattctgcacctttgtatcg

SEQ ID NO: 580650 - DNA, 25 bp, Homo sapien
attctgcacctttgtatcgcctgca

SEQ ID NO: 580651 - DNA, 25 bp, Homo sapien
gtccgctaggcgctggatgcattta

SEQ ID NO: 580652 - DNA, 25 bp, Homo sapien
taggcgctggatgcatttactacac

SEQ ID NO: 580653 - DNA, 25 bp, Homo sapien
tgcatttactacacctctgggaggg

SEQ ID NO: 580654 - DNA, 25 bp, Homo sapien
tacacctctgggagggttcctgagg

SEQ ID NO: 580655 - DNA, 25 bp, Homo sapien
gaaccggttagtccttgtcaacaag

SEQ ID NO: 580656 - DNA, 25 bp, Homo sapien
ggcggagacaggcatgcaaaataaa

SEQ ID NO: 580657 - DNA, 25 bp, Homo sapien
gggtgattttaatcggtcatcctcc

SEQ ID NO: 580658 - DNA, 25 bp, Homo sapien
taatcggtcatcctccggcctaatt

SEQ ID NO: 580659 - DNA, 25 bp, Homo sapien
aacaggactggcttgtgaaggccat

SEQ ID NO: 580660 - DNA, 25 bp, Homo sapien
aaggccatgagggaggaacactcag

SEQ ID NO: 580661 - DNA, 25 bp, Homo sapien
ggaacactcagactgaaagggctga

SEQ ID NO: 580662 - DNA, 25 bp, Homo sapien
gactgaaagggctgagaaatccaga

SEQ ID NO: 580663 - DNA, 25 bp, Homo sapien
aaatccagagtgtgctgatccagca

SEQ ID NO: 580664 - DNA, 25 bp, Homo sapien
tgctgatccagcaaggaacgaatgg

SEQ ID NO: 580665 - DNA, 25 bp, Homo sapien
tggactgaacaaaactcagcctgct

SEQ ID NO: 580666 - DNA, 25 bp, Homo sapien
atgggtctgtgctgaaggcccaaca

SEQ ID NO: 580667 - DNA, 25 bp, Homo sapien
gaaggcccaacaggatcatctcatt

SEQ ID NO: 580668 - DNA, 25 bp, Homo sapien
gcccaacaggatcatctcattgcat

SEQ ID NO: 580669 - DNA, 25 bp, Homo sapien
ggatcatctcattgcatgattttct

SEQ ID NO: 580670 - DNA, 25 bp, Homo sapien
ataatgacacacttatttttaatta

SEQ ID NO: 580671 - DNA, 25 bp, Homo sapien
tacctatgtacgataaaaagactgc

SEQ ID NO: 580672 - DNA, 25 bp, Homo sapien
ctatgtacgataaaaagactgccaa

SEQ ID NO: 580673 - DNA, 25 bp, Homo sapien
atgtacgataaaaagactgccaatc

SEQ ID NO: 580674 - DNA, 25 bp, Homo sapien
gggatcaagaatataatttgcccca

SEQ ID NO: 580675 - DNA, 25 bp, Homo sapien
ggatcaagaatataatttgccccaa

SEQ ID NO: 580676 - DNA, 25 bp, Homo sapien
gatcaagaatataatttgccccaaa

SEQ ID NO: 580677 - DNA, 25 bp, Homo sapien
tcaagaatataatttgccccaaata

SEQ ID NO: 580678 - DNA, 25 bp, Homo sapien
gaatataatttgccccaaataactt

SEQ ID NO: 580679 - DNA, 25 bp, Homo sapien
tacatataatttcaagatctaacct

SEQ ID NO: 580680 - DNA, 25 bp, Homo sapien
tttcaagatctaaccttaaaaatgg

SEQ ID NO: 580681 - DNA, 25 bp, Homo sapien
atgattacatagactgtggttgcta

SEQ ID NO: 580682 - DNA, 25 bp, Homo sapien
acagctgttctctctgaaacggaaa

SEQ ID NO: 580683 - DNA, 25 bp, Homo sapien
gaaacggaaacatatttgttgtcta

SEQ ID NO: 580684 - DNA, 25 bp, Homo sapien
ttgtattcgttatgcttagtcttcc

SEQ ID NO: 580685 - DNA, 25 bp, Homo sapien
ttcgttatgcttagtcttccatata

SEQ ID NO: 580686 - DNA, 25 bp, Homo sapien
agttcgtggtaaaataggtctgatt

SEQ ID NO: 580687 - DNA, 25 bp, Homo sapien
aggtctgattgaggaagctatggct

SEQ ID NO: 580688 - DNA, 25 bp, Homo sapien
ggaagctatggctgactataaccaa

SEQ ID NO: 580689 - DNA, 25 bp, Homo sapien
ggctgactataaccaagcacttgat

SEQ ID NO: 580690 - DNA, 25 bp, Homo sapien
tgatcttgaagactatgcctcagtt

SEQ ID NO: 580691 - DNA, 25 bp, Homo sapien
ctatgcctcagttatatgattacat

SEQ ID NO: 580692 - DNA, 25 bp, Homo sapien
gggctgcgctagctgggctggcatt

SEQ ID NO: 580693 - DNA, 25 bp, Homo sapien
agagccatctcctgaacccacaaat

SEQ ID NO: 580694 - DNA, 25 bp, Homo sapien
ccatctcctgaacccacaaattatt

SEQ ID NO: 580695 - DNA, 25 bp, Homo sapien
gaacccacaaattattcttacagaa

SEQ ID NO: 580696 - DNA, 25 bp, Homo sapien
ttcttacagaaagatagttatccag

SEQ ID NO: 580697 - DNA, 25 bp, Homo sapien
acctctcctaaacacagcagggctt

SEQ ID NO: 580698 - DNA, 25 bp, Homo sapien
tctcctaaacacagcagggctttgg

SEQ ID NO: 580699 - DNA, 25 bp, Homo sapien
agggctttggagtctggcccatgct

SEQ ID NO: 580700 - DNA, 25 bp, Homo sapien
gctttggagtctggcccatgctcct

SEQ ID NO: 580701 - DNA, 25 bp, Homo sapien
tgctgcctctgtctatttcaatata

SEQ ID NO: 580702 - DNA, 25 bp, Homo sapien
gcctctgtctatttcaatatagaac

SEQ ID NO: 580703 - DNA, 25 bp, Homo sapien
gggtagcaagttcaccacagtgtta

SEQ ID NO: 580704 - DNA, 25 bp, Homo sapien
gcaagttcaccacagtgttaatggg

SEQ ID NO: 580705 - DNA, 25 bp, Homo sapien
caaggtattcttcccccaggcctag

SEQ ID NO: 580706 - DNA, 25 bp, Homo sapien
ccccaggcctaggtatagggctatt

SEQ ID NO: 580707 - DNA, 25 bp, Homo sapien
aggtatagggctattactcctctct

SEQ ID NO: 580708 - DNA, 25 bp, Homo sapien
gtatagggctattactcctctctgc

SEQ ID NO: 580709 - DNA, 25 bp, Homo sapien
atagggctattactcctctctgctc

SEQ ID NO: 580710 - DNA, 25 bp, Homo sapien
tctctgctccaggtgtagacataca

SEQ ID NO: 580711 - DNA, 25 bp, Homo sapien
tctgctccaggtgtagacatacatt

SEQ ID NO: 580712 - DNA, 25 bp, Homo sapien
gctccaggtgtagacatacatttac

SEQ ID NO: 580713 - DNA, 25 bp, Homo sapien
aggtgtagacatacatttacatttt

SEQ ID NO: 580714 - DNA, 25 bp, Homo sapien
agagtgcccatgcagtaacagcgca

SEQ ID NO: 580715 - DNA, 25 bp, Homo sapien
gtaatctggaacagcgccctgagca

SEQ ID NO: 580716 - DNA, 25 bp, Homo sapien
gccctgagcacatggtcaagatgaa

SEQ ID NO: 580717 - DNA, 25 bp, Homo sapien
gatgaacatcgccagtcatgagaca

SEQ ID NO: 580718 - DNA, 25 bp, Homo sapien
gagacaaaccgacatggagaatctg

SEQ ID NO: 580719 - DNA, 25 bp, Homo sapien
gaatctgctgatgtcgtgcactgag

SEQ ID NO: 580720 - DNA, 25 bp, Homo sapien
aagaacagcatgtctgctatgcagt

SEQ ID NO: 580721 - DNA, 25 bp, Homo sapien
gtctgctatgcagtagtcctgccaa

SEQ ID NO: 580722 - DNA, 25 bp, Homo sapien
ctgccaaaaatgttatacctacctg

SEQ ID NO: 580723 - DNA, 25 bp, Homo sapien
atacctacctgaatctaatcacaag

SEQ ID NO: 580724 - DNA, 25 bp, Homo sapien
aatcacaaggaagccattcgacaaa

SEQ ID NO: 580725 - DNA, 25 bp, Homo sapien
ttaaaatcaaaagctcgagtttcat

SEQ ID NO: 580726 - DNA, 25 bp, Homo sapien
atcaaaagctcgagtttcattgttt

SEQ ID NO: 580727 - DNA, 25 bp, Homo sapien
caaaagctcgagtttcattgttttt

SEQ ID NO: 580728 - DNA, 25 bp, Homo sapien
ttttgaggcagtcttacactgtttc

SEQ ID NO: 580729 - DNA, 25 bp, Homo sapien
tttgaggcagtcttacactgtttcc

SEQ ID NO: 580730 - DNA, 25 bp, Homo sapien
ttgaggcagtcttacactgtttccc

SEQ ID NO: 580731 - DNA, 25 bp, Homo sapien
tgaggcagtcttacactgtttccca

SEQ ID NO: 580732 - DNA, 25 bp, Homo sapien
gaggcagtcttacactgtttcccag

SEQ ID NO: 580733 - DNA, 25 bp, Homo sapien
ggcttgaactcctgatcccaagtaa

SEQ ID NO: 580734 - DNA, 25 bp, Homo sapien
tgaactcctgatcccaagtaatcca

SEQ ID NO: 580735 - DNA, 25 bp, Homo sapien
aactcctgatcccaagtaatccatc

SEQ ID NO: 580736 - DNA, 25 bp, Homo sapien
cagaacctttaatatgccaatgtgt

SEQ ID NO: 580737 - DNA, 25 bp, Homo sapien
caatgtgtgtggcaaacttacaaga

SEQ ID NO: 580738 - DNA, 25 bp, Homo sapien
tggcaaacttacaagaagggagcta

SEQ ID NO: 580739 - DNA, 25 bp, Homo sapien
aagggagctaagtatccagcctctc

SEQ ID NO: 580740 - DNA, 25 bp, Homo sapien
gagctaagtatccagcctctcccaa

SEQ ID NO: 580741 - DNA, 25 bp, Homo sapien
ctctcccaaacctctttgaacaaag

SEQ ID NO: 580742 - DNA, 25 bp, Homo sapien
caaacctctttgaacaaagcttctg

SEQ ID NO: 580743 - DNA, 25 bp, Homo sapien
acaggcacatcaggctgcagaatgc

SEQ ID NO: 580744 - DNA, 25 bp, Homo sapien
acatcaggctgcagaatgcgcttta

SEQ ID NO: 580745 - DNA, 25 bp, Homo sapien
caggctgcagaatgcgctttagaaa

SEQ ID NO: 580746 - DNA, 25 bp, Homo sapien
gaaagcattgttttagtccaggcac

SEQ ID NO: 580747 - DNA, 25 bp, Homo sapien
tttccttcactgttagaaatgtgtt

SEQ ID NO: 580748 - DNA, 25 bp, Homo sapien
agaaatgtgtttggccctataaggg

SEQ ID NO: 580749 - DNA, 25 bp, Homo sapien
ttggccctataagggagagccccaa

SEQ ID NO: 580750 - DNA, 25 bp, Homo sapien
gccccaacaagaacttcctagtaat

SEQ ID NO: 580751 - DNA, 25 bp, Homo sapien
aagaacttcctagtaattgtcacag

SEQ ID NO: 580752 - DNA, 25 bp, Homo sapien
gaacttcctagtaattgtcacagat

SEQ ID NO: 580753 - DNA, 25 bp, Homo sapien
acttcctagtaattgtcacagatgg

SEQ ID NO: 580754 - DNA, 25 bp, Homo sapien
gtaattgtcacagatgggcagtcct

SEQ ID NO: 580755 - DNA, 25 bp, Homo sapien
attgtcacagatgggcagtcctatg

SEQ ID NO: 580756 - DNA, 25 bp, Homo sapien
tcacagatgggcagtcctatgatga

SEQ ID NO: 580757 - DNA, 25 bp, Homo sapien
acagatgggcagtcctatgatgatg

SEQ ID NO: 580758 - DNA, 25 bp, Homo sapien
tacaaatgtgtgacatatacaccca

SEQ ID NO: 580759 - DNA, 25 bp, Homo sapien
agaagtcacagttatgaaagaacaa

SEQ ID NO: 580760 - DNA, 25 bp, Homo sapien
ttttcatgtaagattgagcattttg

SEQ ID NO: 580761 - DNA, 25 bp, Homo sapien
gcattggtttttagtgtcatgtgca

SEQ ID NO: 580762 - DNA, 25 bp, Homo sapien
tttttagtgtcatgtgcactctgcc

SEQ ID NO: 580763 - DNA, 25 bp, Homo sapien
ctataaatggtgatattgtcctgaa

SEQ ID NO: 580764 - DNA, 25 bp, Homo sapien
tattgtcctgaaaggaagccacttc

SEQ ID NO: 580765 - DNA, 25 bp, Homo sapien
ttttcaaagatttcttccgcggcag

SEQ ID NO: 580766 - DNA, 25 bp, Homo sapien
caaagatttcttccgcggcagggat

SEQ ID NO: 580767 - DNA, 25 bp, Homo sapien
tttcttccgcggcagggatctagga

SEQ ID NO: 580768 - DNA, 25 bp, Homo sapien
tcttccgcggcagggatctaggagt

SEQ ID NO: 580769 - DNA, 25 bp, Homo sapien
aaaaaatacagccatgagtggtggt

SEQ ID NO: 580770 - DNA, 25 bp, Homo sapien
aaaaatacagccatgagtggtggtg

SEQ ID NO: 580771 - DNA, 25 bp, Homo sapien
aaaatacagccatgagtggtggtgc

SEQ ID NO: 580772 - DNA, 25 bp, Homo sapien
aaatacagccatgagtggtggtgcg

SEQ ID NO: 580773 - DNA, 25 bp, Homo sapien
aatacagccatgagtggtggtgcgc

SEQ ID NO: 580774 - DNA, 25 bp, Homo sapien
atacagccatgagtggtggtgcgca

SEQ ID NO: 580775 - DNA, 25 bp, Homo sapien
tacagccatgagtggtggtgcgcac

SEQ ID NO: 580776 - DNA, 25 bp, Homo sapien
acagccatgagtggtggtgcgcacc

SEQ ID NO: 580777 - DNA, 25 bp, Homo sapien
gttacagctacttggcacgttgagg

SEQ ID NO: 580778 - DNA, 25 bp, Homo sapien
ttacagctacttggcacgttgaggc

SEQ ID NO: 580779 - DNA, 25 bp, Homo sapien
tacagctacttggcacgttgaggca

SEQ ID NO: 580780 - DNA, 25 bp, Homo sapien
gcacatgatgcagcaaaataagttt

SEQ ID NO: 580781 - DNA, 25 bp, Homo sapien
agtttaaaagggaatctgtggcatt

SEQ ID NO: 580782 - DNA, 25 bp, Homo sapien
aagggaatctgtggcattcaaccga

SEQ ID NO: 580783 - DNA, 25 bp, Homo sapien
gggaatctgtggcattcaaccgata

SEQ ID NO: 580784 - DNA, 25 bp, Homo sapien
gaatctgtggcattcaaccgataaa

SEQ ID NO: 580785 - DNA, 25 bp, Homo sapien
atctgtggcattcaaccgataaaca

SEQ ID NO: 580786 - DNA, 25 bp, Homo sapien
ggcattcaaccgataaacagaagat

SEQ ID NO: 580787 - DNA, 25 bp, Homo sapien
aaccgataaacagaagatcactaag

SEQ ID NO: 580788 - DNA, 25 bp, Homo sapien
aagctactcttggagctcacttccc

SEQ ID NO: 580789 - DNA, 25 bp, Homo sapien
ccaacaagagcaccacattcctaac

SEQ ID NO: 580790 - DNA, 25 bp, Homo sapien
gagcaccacattcctaacccctaag

SEQ ID NO: 580791 - DNA, 25 bp, Homo sapien
ttaaaatacagaaaagaggctgggc

SEQ ID NO: 580792 - DNA, 25 bp, Homo sapien
aatacagaaaagaggctgggcgcgg

SEQ ID NO: 580793 - DNA, 25 bp, Homo sapien
atacagaaaagaggctgggcgcggt

SEQ ID NO: 580794 - DNA, 25 bp, Homo sapien
tacagaaaagaggctgggcgcggtg

SEQ ID NO: 580795 - DNA, 25 bp, Homo sapien
ccgaggtgggtgagtcacttgaggt

SEQ ID NO: 580796 - DNA, 25 bp, Homo sapien
aatcgcttgaaagtggaaggcggag

SEQ ID NO: 580797 - DNA, 25 bp, Homo sapien
atcgcttgaaagtggaaggcggagg

SEQ ID NO: 580798 - DNA, 25 bp, Homo sapien
tcgcttgaaagtggaaggcggaggt

SEQ ID NO: 580799 - DNA, 25 bp, Homo sapien
cgcttgaaagtggaaggcggaggtt

SEQ ID NO: 580800 - DNA, 25 bp, Homo sapien
gcttgaaagtggaaggcggaggttg

SEQ ID NO: 580801 - DNA, 25 bp, Homo sapien
cttgaaagtggaaggcggaggttgc

SEQ ID NO: 580802 - DNA, 25 bp, Homo sapien
ctttccctgggcaacttagggcaag

SEQ ID NO: 580803 - DNA, 25 bp, Homo sapien
ctgggcaacttagggcaagctcaaa

SEQ ID NO: 580804 - DNA, 25 bp, Homo sapien
ttagggcaagctcaaatcccactgc

SEQ ID NO: 580805 - DNA, 25 bp, Homo sapien
agggcaagctcaaatcccactgcta

SEQ ID NO: 580806 - DNA, 25 bp, Homo sapien
cacagctggtgctcttttgcaagtg

SEQ ID NO: 580807 - DNA, 25 bp, Homo sapien
gctggagaccaaccagcacagtcca

SEQ ID NO: 580808 - DNA, 25 bp, Homo sapien
aaatagaactgttcccaggaaggag

SEQ ID NO: 580809 - DNA, 25 bp, Homo sapien
aaatgcctgcatgagctcagctgtt

SEQ ID NO: 580810 - DNA, 25 bp, Homo sapien
tgagctcagctgttaccactgcgta

SEQ ID NO: 580811 - DNA, 25 bp, Homo sapien
tcagctgttaccactgcgtaccaca

SEQ ID NO: 580812 - DNA, 25 bp, Homo sapien
ccctgaccagtcagaggtcttgagt

SEQ ID NO: 580813 - DNA, 25 bp, Homo sapien
gggtcagctcctcccattagccatg

SEQ ID NO: 580814 - DNA, 25 bp, Homo sapien
ctcccattagccatgctgtccagca

SEQ ID NO: 580815 - DNA, 25 bp, Homo sapien
ccgctggtgcttgctgtgagactga

SEQ ID NO: 580816 - DNA, 25 bp, Homo sapien
ctggtgcttgctgtgagactgagct

SEQ ID NO: 580817 - DNA, 25 bp, Homo sapien
ctgggctctgagtgtaaactacatg

SEQ ID NO: 580818 - DNA, 25 bp, Homo sapien
ggctctgagtgtaaactacatggta

SEQ ID NO: 580819 - DNA, 25 bp, Homo sapien
ctacatggtaggttgtgaaggatgc

SEQ ID NO: 580820 - DNA, 25 bp, Homo sapien
gaaggatgcaaatatcgaatcaatc

SEQ ID NO: 580821 - DNA, 25 bp, Homo sapien
tatcgaatcaatcattttttattgc

SEQ ID NO: 580822 - DNA, 25 bp, Homo sapien
aatgacaatatcttggatgtatcag

SEQ ID NO: 580823 - DNA, 25 bp, Homo sapien
atatcttggatgtatcagattaaac

SEQ ID NO: 580824 - DNA, 25 bp, Homo sapien
aaagacagacacagctttgcactgc

SEQ ID NO: 580825 - DNA, 25 bp, Homo sapien
tttgcactgcactcgtggcttatct

SEQ ID NO: 580826 - DNA, 25 bp, Homo sapien
ggcttatctcaccatggacgccaaa

SEQ ID NO: 580827 - DNA, 25 bp, Homo sapien
catggacgccaaattcaaacctgtt

SEQ ID NO: 580828 - DNA, 25 bp, Homo sapien
attcaaacctgttggcgactcatca

SEQ ID NO: 580829 - DNA, 25 bp, Homo sapien
tcatcacactggactgacggcacaa

SEQ ID NO: 580830 - DNA, 25 bp, Homo sapien
ctgacggcacaaaggttcttgggaa

SEQ ID NO: 580831 - DNA, 25 bp, Homo sapien
gaatcatgttcagcatcaagtagga

SEQ ID NO: 580832 - DNA, 25 bp, Homo sapien
gtcacaagtacttgcagacaagcca

SEQ ID NO: 580833 - DNA, 25 bp, Homo sapien
gaaaaatagaatcagcacctagtgt

SEQ ID NO: 580834 - DNA, 25 bp, Homo sapien
gcacctagtgtaaattaacttcaga

SEQ ID NO: 580835 - DNA, 25 bp, Homo sapien
actttttcaagttattcatctcatt

SEQ ID NO: 580836 - DNA, 25 bp, Homo sapien
taaaaaatctacctcgataacattt

SEQ ID NO: 580837 - DNA, 25 bp, Homo sapien
aagaatatctttgttccactgaata

SEQ ID NO: 580838 - DNA, 25 bp, Homo sapien
tttgttccactgaatagcttgtcaa

SEQ ID NO: 580839 - DNA, 25 bp, Homo sapien
gcttgtcaaataatacattagcagt

SEQ ID NO: 580840 - DNA, 25 bp, Homo sapien
cattagcagtacaatttcctcataa

SEQ ID NO: 580841 - DNA, 25 bp, Homo sapien
atttcctcataattcttagacttgt

SEQ ID NO: 580842 - DNA, 25 bp, Homo sapien
aattcttagacttgtttgattaaat

SEQ ID NO: 580843 - DNA, 25 bp, Homo sapien
aaatttatagatttcctactctcaa

SEQ ID NO: 580844 - DNA, 25 bp, Homo sapien
tatagatttcctactctcaactaat

SEQ ID NO: 580845 - DNA, 25 bp, Homo sapien
agatttcctactctcaactaataaa

SEQ ID NO: 580846 - DNA, 25 bp, Homo sapien
gagccagaaggtacaaggatgaatt

SEQ ID NO: 580847 - DNA, 25 bp, Homo sapien
attaagaagcttgttaggcgagtta

SEQ ID NO: 580848 - DNA, 25 bp, Homo sapien
agcttgttaggcgagttaaagacat

SEQ ID NO: 580849 - DNA, 25 bp, Homo sapien
gttaggcgagttaaagacatttcaa

SEQ ID NO: 580850 - DNA, 25 bp, Homo sapien
ggcgagttaaagacatttcaagaaa

SEQ ID NO: 580851 - DNA, 25 bp, Homo sapien
aggagtattagagtctttattgaaa

SEQ ID NO: 580852 - DNA, 25 bp, Homo sapien
gacaatgtctgtcatcgaattagag

SEQ ID NO: 580853 - DNA, 25 bp, Homo sapien
gtctgtcatcgaattagagtttaaa

SEQ ID NO: 580854 - DNA, 25 bp, Homo sapien
gagtttaaatatcagatgctgtctc

SEQ ID NO: 580855 - DNA, 25 bp, Homo sapien
aatatcagatgctgtctcagaactc

SEQ ID NO: 580856 - DNA, 25 bp, Homo sapien
aagagatgatagctctaaaatggta

SEQ ID NO: 580857 - DNA, 25 bp, Homo sapien
agctgtgaaccctggaacgttcgta

SEQ ID NO: 580858 - DNA, 25 bp, Homo sapien
tggaacgttcgtattctgcagctgc

SEQ ID NO: 580859 - DNA, 25 bp, Homo sapien
gtattctgcagctgccagtgtaaac

SEQ ID NO: 580860 - DNA, 25 bp, Homo sapien
tggtacaggcctcttgaagaacagt

SEQ ID NO: 580861 - DNA, 25 bp, Homo sapien
aaaggcactctgaaagcatccacgc

SEQ ID NO: 580862 - DNA, 25 bp, Homo sapien
cagggctctgattttccttctggga

SEQ ID NO: 580863 - DNA, 25 bp, Homo sapien
ttttccttctgggaaccaagcctag

SEQ ID NO: 580864 - DNA, 25 bp, Homo sapien
gggaaccaagcctaggagaatgatt

SEQ ID NO: 580865 - DNA, 25 bp, Homo sapien
aggagaatgattcaagctgcagaaa

SEQ ID NO: 580866 - DNA, 25 bp, Homo sapien
acctttctccactaagatgtttgct

SEQ ID NO: 580867 - DNA, 25 bp, Homo sapien
agcacaccagagaaacaatctaaag

SEQ ID NO: 580868 - DNA, 25 bp, Homo sapien
tgcggaaatcacaggctagatttta

SEQ ID NO: 580869 - DNA, 25 bp, Homo sapien
tcacaggctagattttagatttttt

SEQ ID NO: 580870 - DNA, 25 bp, Homo sapien
gattttttacttttcagcacgtgac

SEQ ID NO: 580871 - DNA, 25 bp, Homo sapien
cttttcagcacgtgacttaaagttc

SEQ ID NO: 580872 - DNA, 25 bp, Homo sapien
gaaagggctgataatcttgtgctaa

SEQ ID NO: 580873 - DNA, 25 bp, Homo sapien
aatcttgtgctaaatcactgatgga

SEQ ID NO: 580874 - DNA, 25 bp, Homo sapien
tccatctctcagtcaatccaagtgt

SEQ ID NO: 580875 - DNA, 25 bp, Homo sapien
tctctcagtcaatccaagtgtccat

SEQ ID NO: 580876 - DNA, 25 bp, Homo sapien
aaacgagatcacgtcctttctagga

SEQ ID NO: 580877 - DNA, 25 bp, Homo sapien
gatcacgtcctttctaggaacatgg

SEQ ID NO: 580878 - DNA, 25 bp, Homo sapien
cgtcctttctaggaacatggatgga

SEQ ID NO: 580879 - DNA, 25 bp, Homo sapien
gacttaatggcacagtaagagacca

SEQ ID NO: 580880 - DNA, 25 bp, Homo sapien
gaccaagttacgatttcaacccaga

SEQ ID NO: 580881 - DNA, 25 bp, Homo sapien
gaaatacttgattccaaagccccaa

SEQ ID NO: 580882 - DNA, 25 bp, Homo sapien
aaagccccaactctactgcatgata

SEQ ID NO: 580883 - DNA, 25 bp, Homo sapien
ccaactctactgcatgatatactaa

SEQ ID NO: 580884 - DNA, 25 bp, Homo sapien
tactaagcactattatatctctact

SEQ ID NO: 580885 - DNA, 25 bp, Homo sapien
ctacttctgagtagaatgctccaag

SEQ ID NO: 580886 - DNA, 25 bp, Homo sapien
gaatgctccaagattttgctgggac

SEQ ID NO: 580887 - DNA, 25 bp, Homo sapien
ctccaagattttgctgggacaggaa

SEQ ID NO: 580888 - DNA, 25 bp, Homo sapien
catacatacatacacttccatatta

SEQ ID NO: 580889 - DNA, 25 bp, Homo sapien
tacacttccatattattttggtgac

SEQ ID NO: 580890 - DNA, 25 bp, Homo sapien
gaacattcaaatgctcttgtttgag

SEQ ID NO: 580891 - DNA, 25 bp, Homo sapien
aatcaggaacagacggtgcagccct

SEQ ID NO: 580892 - DNA, 25 bp, Homo sapien
gaacagacggtgcagccctagttag

SEQ ID NO: 580893 - DNA, 25 bp, Homo sapien
ggtgcagccctagttagcctctgag

SEQ ID NO: 580894 - DNA, 25 bp, Homo sapien
aacaggcccacaggtgccttgcaga

SEQ ID NO: 580895 - DNA, 25 bp, Homo sapien
ccttgcagagctgatgttggcgtca

SEQ ID NO: 580896 - DNA, 25 bp, Homo sapien
gatgttggcgtcagaaactccgctc

SEQ ID NO: 580897 - DNA, 25 bp, Homo sapien
actctgcctgcttggaggtgttcgc

SEQ ID NO: 580898 - DNA, 25 bp, Homo sapien
gaggtgttcgctggctcgctcagac

SEQ ID NO: 580899 - DNA, 25 bp, Homo sapien
tggctcgctcagactgacctcagca

SEQ ID NO: 580900 - DNA, 25 bp, Homo sapien
atgaacatgggttctttctgtcccc

SEQ ID NO: 580901 - DNA, 25 bp, Homo sapien
tcatgaggactttcctctttctctt

SEQ ID NO: 580902 - DNA, 25 bp, Homo sapien
atgaggactttcctctttctctttg

SEQ ID NO: 580903 - DNA, 25 bp, Homo sapien
tgaggactttcctctttctctttgc

SEQ ID NO: 580904 - DNA, 25 bp, Homo sapien
aggactttcctctttctctttgccg

SEQ ID NO: 580905 - DNA, 25 bp, Homo sapien
gactttcctctttctctttgccgtg

SEQ ID NO: 580906 - DNA, 25 bp, Homo sapien
tttcctctttctctttgccgtgctc

SEQ ID NO: 580907 - DNA, 25 bp, Homo sapien
tcctctttctctttgccgtgctctt

SEQ ID NO: 580908 - DNA, 25 bp, Homo sapien
ttctctttgccgtgctcttctttct

SEQ ID NO: 580909 - DNA, 25 bp, Homo sapien
tctctttgccgtgctcttctttctg

SEQ ID NO: 580910 - DNA, 25 bp, Homo sapien
tttgccgtgctcttctttctgaccc

SEQ ID NO: 580911 - DNA, 25 bp, Homo sapien
tttctgaccccagccaagaatgcat

SEQ ID NO: 580912 - DNA, 25 bp, Homo sapien
gatgaatttctgtgactgccagtca

SEQ ID NO: 580913 - DNA, 25 bp, Homo sapien
gactgccagtcagatcttaacaggt

SEQ ID NO: 580914 - DNA, 25 bp, Homo sapien
aacaggtttctgttgagccagaatc

SEQ ID NO: 580915 - DNA, 25 bp, Homo sapien
aatctgtttcagatccaagatggag

SEQ ID NO: 580916 - DNA, 25 bp, Homo sapien
ggaacactatggaaacttcccaggt

SEQ ID NO: 580917 - DNA, 25 bp, Homo sapien
tttcagagcagttgtttcaaacaca

SEQ ID NO: 580918 - DNA, 25 bp, Homo sapien
agttgtttcaaacacatcattgtcc

SEQ ID NO: 580919 - DNA, 25 bp, Homo sapien
tagaaggttgtgaattggctttttc

SEQ ID NO: 580920 - DNA, 25 bp, Homo sapien
gaattggctttttcacaaagcatga

SEQ ID NO: 580921 - DNA, 25 bp, Homo sapien
agcatgattatcttcctggctgatc

SEQ ID NO: 580922 - DNA, 25 bp, Homo sapien
atgattatcttcctggctgatccag

SEQ ID NO: 580923 - DNA, 25 bp, Homo sapien
cggtgccctgggagtcccataacag

SEQ ID NO: 580924 - DNA, 25 bp, Homo sapien
ctgggagtcccataacagctcagag

SEQ ID NO: 580925 - DNA, 25 bp, Homo sapien
ggagtcccataacagctcagagacc

SEQ ID NO: 580926 - DNA, 25 bp, Homo sapien
tggtccagacctatgtgctccaggg

SEQ ID NO: 580927 - DNA, 25 bp, Homo sapien
gggacccaagagcagtttccaccca

SEQ ID NO: 580928 - DNA, 25 bp, Homo sapien
atcccagtctggcaccagcgatcag

SEQ ID NO: 580929 - DNA, 25 bp, Homo sapien
ctcccaggcgatctgcatactttaa

SEQ ID NO: 580930 - DNA, 25 bp, Homo sapien
ggcgatctgcatactttaaggacca

SEQ ID NO: 580931 - DNA, 25 bp, Homo sapien
ttaaggaccagatcatgctccatcc

SEQ ID NO: 580932 - DNA, 25 bp, Homo sapien
cacccaatggccttttgtgcttgtt

SEQ ID NO: 580933 - DNA, 25 bp, Homo sapien
gtgcttgtttcctataacttcagta

SEQ ID NO: 580934 - DNA, 25 bp, Homo sapien
ccatctagtttagtcaagacagctg

SEQ ID NO: 580935 - DNA, 25 bp, Homo sapien
tctagtttagtcaagacagctgtgt

SEQ ID NO: 580936 - DNA, 25 bp, Homo sapien
tttagtcaagacagctgtgtaacaa

SEQ ID NO: 580937 - DNA, 25 bp, Homo sapien
gtcaagacagctgtgtaacaaacgt

SEQ ID NO: 580938 - DNA, 25 bp, Homo sapien
gacagctgtgtaacaaacgtagcct

SEQ ID NO: 580939 - DNA, 25 bp, Homo sapien
agctgtgtaacaaacgtagccttga

SEQ ID NO: 580940 - DNA, 25 bp, Homo sapien
tgtaacaaacgtagccttgaggcct

SEQ ID NO: 580941 - DNA, 25 bp, Homo sapien
gtaacaaacgtagccttgaggcctg

SEQ ID NO: 580942 - DNA, 25 bp, Homo sapien
acaaacgtagccttgaggcctggca

SEQ ID NO: 580943 - DNA, 25 bp, Homo sapien
aaacgtagccttgaggcctggcacg

SEQ ID NO: 580944 - DNA, 25 bp, Homo sapien
aacgtagccttgaggcctggcacgg

SEQ ID NO: 580945 - DNA, 25 bp, Homo sapien
taccgcggggaactcttgcctcgtt

SEQ ID NO: 580946 - DNA, 25 bp, Homo sapien
ccctgatctgcaacgggtacttgca

SEQ ID NO: 580947 - DNA, 25 bp, Homo sapien
ttgtgtctttcggaaaagccccgtg

SEQ ID NO: 580948 - DNA, 25 bp, Homo sapien
tgtgtctttcggaaaagccccgtgt

SEQ ID NO: 580949 - DNA, 25 bp, Homo sapien
gccaagttggcgtgccaggtgtcta

SEQ ID NO: 580950 - DNA, 25 bp, Homo sapien
aagttggcgtgccaggtgtctacac

SEQ ID NO: 580951 - DNA, 25 bp, Homo sapien
gttggcgtgccaggtgtctacacca

SEQ ID NO: 580952 - DNA, 25 bp, Homo sapien
tggcgtgccaggtgtctacaccaac

SEQ ID NO: 580953 - DNA, 25 bp, Homo sapien
ctgcaaattcactgagtggatagag

SEQ ID NO: 580954 - DNA, 25 bp, Homo sapien
atagagaaaaccgtccaggccagtt

SEQ ID NO: 580955 - DNA, 25 bp, Homo sapien
tagagaaaaccgtccaggccagtta

SEQ ID NO: 580956 - DNA, 25 bp, Homo sapien
agagctaggaggacagaggccccca

SEQ ID NO: 580957 - DNA, 25 bp, Homo sapien
atctccacctccagtgacttttaaa

SEQ ID NO: 580958 - DNA, 25 bp, Homo sapien
gtgacttttaaagccgcttcgtgcc

SEQ ID NO: 580959 - DNA, 25 bp, Homo sapien
ttcgtgcctttcctgtaacgttgga

SEQ ID NO: 580960 - DNA, 25 bp, Homo sapien
tttcctgtaacgttggatcctcctt

SEQ ID NO: 580961 - DNA, 25 bp, Homo sapien
ctgtaacgttggatcctccttttct

SEQ ID NO: 580962 - DNA, 25 bp, Homo sapien
ctgctgtctcaaggccccaagttaa

SEQ ID NO: 580963 - DNA, 25 bp, Homo sapien
taaagggttaaagccgctggagctt

SEQ ID NO: 580964 - DNA, 25 bp, Homo sapien
ttgtggaatggaagggatcatgccc

SEQ ID NO: 580965 - DNA, 25 bp, Homo sapien
gggatcatgccctttgtggagtctt

SEQ ID NO: 580966 - DNA, 25 bp, Homo sapien
tcatgccctttgtggagtctttttt

SEQ ID NO: 580967 - DNA, 25 bp, Homo sapien
gggcatatgacatggcctctctgag

SEQ ID NO: 580968 - DNA, 25 bp, Homo sapien
ctgagccatagttccctcatctatc

SEQ ID NO: 580969 - DNA, 25 bp, Homo sapien
ccctcatctatcttacgttgcagta

SEQ ID NO: 580970 - DNA, 25 bp, Homo sapien
tacgttgcagtattggtgtgaggat

SEQ ID NO: 580971 - DNA, 25 bp, Homo sapien
gcaaagcttacataatgaccctcaa

SEQ ID NO: 580972 - DNA, 25 bp, Homo sapien
tgaccctcaatatttggaggacatt

SEQ ID NO: 580973 - DNA, 25 bp, Homo sapien
gggaaaatacgatgcttttcacatc

SEQ ID NO: 580974 - DNA, 25 bp, Homo sapien
gcttttcacatcatcgataatctgg

SEQ ID NO: 580975 - DNA, 25 bp, Homo sapien
aatctggatctttaactcctattaa

SEQ ID NO: 580976 - DNA, 25 bp, Homo sapien
ttgagtaggttaaaatgcgctgcct

SEQ ID NO: 580977 - DNA, 25 bp, Homo sapien
tgcgctgcctaaaacactactggtt

SEQ ID NO: 580978 - DNA, 25 bp, Homo sapien
caatttatagagttgagatcccttt

SEQ ID NO: 580979 - DNA, 25 bp, Homo sapien
tatagagttgagatcccttttattc

SEQ ID NO: 580980 - DNA, 25 bp, Homo sapien
tagagttgagatcccttttattctc

SEQ ID NO: 580981 - DNA, 25 bp, Homo sapien
tttcataggcaaggactaccatgaa

SEQ ID NO: 580982 - DNA, 25 bp, Homo sapien
ataggcaaggactaccatgaatttg

SEQ ID NO: 580983 - DNA, 25 bp, Homo sapien
agtttatttttaatatctctctaca

SEQ ID NO: 580984 - DNA, 25 bp, Homo sapien
tttaatatctctctacatgttgtat

SEQ ID NO: 580985 - DNA, 25 bp, Homo sapien
aatatctctctacatgttgtatgta

SEQ ID NO: 580986 - DNA, 25 bp, Homo sapien
gcatatcattcttttactcattatt

SEQ ID NO: 580987 - DNA, 25 bp, Homo sapien
tatcattcttttactcattatttaa

SEQ ID NO: 580988 - DNA, 25 bp, Homo sapien
tcttttactcattatttaattccat

SEQ ID NO: 580989 - DNA, 25 bp, Homo sapien
aatgcaacaaacttaaagggacatg

SEQ ID NO: 580990 - DNA, 25 bp, Homo sapien
ggacatgcaagaacaattgcgggaa

SEQ ID NO: 580991 - DNA, 25 bp, Homo sapien
gaagaacttattgctctctgccaga

SEQ ID NO: 580992 - DNA, 25 bp, Homo sapien
gaacttattgctctctgccagaagt

SEQ ID NO: 580993 - DNA, 25 bp, Homo sapien
tctgaaatgctgtcggaccatccag

SEQ ID NO: 580994 - DNA, 25 bp, Homo sapien
ggaccatccagccatgtgggagcat

SEQ ID NO: 580995 - DNA, 25 bp, Homo sapien
ccagccatgtgggagcattatagat

SEQ ID NO: 580996 - DNA, 25 bp, Homo sapien
aatgcagaagatttaggtttccaga

SEQ ID NO: 580997 - DNA, 25 bp, Homo sapien
gcatacataacctagcttcttttta

SEQ ID NO: 580998 - DNA, 25 bp, Homo sapien
ctttttactcttgcctctgctgtag

SEQ ID NO: 580999 - DNA, 25 bp, Homo sapien
ctgctgtaggcagacactttaataa

SEQ ID NO: 581000 - DNA, 25 bp, Homo sapien
ctcctgtggacgcttgtgtgctgcc

SEQ ID NO: 581001 - DNA, 25 bp, Homo sapien
tggacgcttgtgtgctgccctggca

SEQ ID NO: 581002 - DNA, 25 bp, Homo sapien
ttgtgtgctgccctggcaccggcca

SEQ ID NO: 581003 - DNA, 25 bp, Homo sapien
gcaccggccactgtgttttgcataa

SEQ ID NO: 581004 - DNA, 25 bp, Homo sapien
cggccactgtgttttgcataaagga

SEQ ID NO: 581005 - DNA, 25 bp, Homo sapien
ctgtgttttgcataaaggagaggct

SEQ ID NO: 581006 - DNA, 25 bp, Homo sapien
atgttggccaaaggaatgaagcctt

SEQ ID NO: 581007 - DNA, 25 bp, Homo sapien
aggaatgaagccttgagagtccagg

SEQ ID NO: 581008 - DNA, 25 bp, Homo sapien
cttgagagtccaggctttctatttc

SEQ ID NO: 581009 - DNA, 25 bp, Homo sapien
gagagggaacattaactttctgaag

SEQ ID NO: 581010 - DNA, 25 bp, Homo sapien
atattgagttaacaccatggtctta

SEQ ID NO: 581011 - DNA, 25 bp, Homo sapien
ttagaatcggaattgctgtattatc

SEQ ID NO: 581012 - DNA, 25 bp, Homo sapien
gaatcggaattgctgtattatcaaa

SEQ ID NO: 581013 - DNA, 25 bp, Homo sapien
tcggaattgctgtattatcaaaaac

SEQ ID NO: 581014 - DNA, 25 bp, Homo sapien
tgctgtattatcaaaaacatccagt

SEQ ID NO: 581015 - DNA, 25 bp, Homo sapien
atcaaaaacatccagttttccataa

SEQ ID NO: 581016 - DNA, 25 bp, Homo sapien
attataagacacactaagaagcaga

SEQ ID NO: 581017 - DNA, 25 bp, Homo sapien
taagacacactaagaagcagaaaag

SEQ ID NO: 581018 - DNA, 25 bp, Homo sapien
gcagaaaagtgtgaaccatactcaa

SEQ ID NO: 581019 - DNA, 25 bp, Homo sapien
gaaaagtgtgaaccatactcaaggg

SEQ ID NO: 581020 - DNA, 25 bp, Homo sapien
aaagtgtgaaccatactcaagggag

SEQ ID NO: 581021 - DNA, 25 bp, Homo sapien
agtgtgaaccatactcaagggagaa

SEQ ID NO: 581022 - DNA, 25 bp, Homo sapien
ttgtttgcccctgtttagcacatgt

SEQ ID NO: 581023 - DNA, 25 bp, Homo sapien
gtttgcccctgtttagcacatgtca

SEQ ID NO: 581024 - DNA, 25 bp, Homo sapien
ttgcccctgtttagcacatgtcact

SEQ ID NO: 581025 - DNA, 25 bp, Homo sapien
cctgtttagcacatgtcactctgtt

SEQ ID NO: 581026 - DNA, 25 bp, Homo sapien
gtttagcacatgtcactctgttgga

SEQ ID NO: 581027 - DNA, 25 bp, Homo sapien
ttagcacatgtcactctgttggaat

SEQ ID NO: 581028 - DNA, 25 bp, Homo sapien
gcacatgtcactctgttggaatttc

SEQ ID NO: 581029 - DNA, 25 bp, Homo sapien
catgtcactctgttggaatttcctg

SEQ ID NO: 581030 - DNA, 25 bp, Homo sapien
tacaaaatataacttcctatgggta

SEQ ID NO: 581031 - DNA, 25 bp, Homo sapien
ataacttcctatgggtaaggactat

SEQ ID NO: 581032 - DNA, 25 bp, Homo sapien
ggtaaggactatgtcttgtttactc

SEQ ID NO: 581033 - DNA, 25 bp, Homo sapien
agaataatcttgtgtctctctacca

SEQ ID NO: 581034 - DNA, 25 bp, Homo sapien
aaaatacagccatgagtggtggtgc

SEQ ID NO: 581035 - DNA, 25 bp, Homo sapien
aaatacagccatgagtggtggtgcg

SEQ ID NO: 581036 - DNA, 25 bp, Homo sapien
aatacagccatgagtggtggtgcgc

SEQ ID NO: 581037 - DNA, 25 bp, Homo sapien
atacagccatgagtggtggtgcgca

SEQ ID NO: 581038 - DNA, 25 bp, Homo sapien
tacagccatgagtggtggtgcgcac

SEQ ID NO: 581039 - DNA, 25 bp, Homo sapien
acagccatgagtggtggtgcgcacc

SEQ ID NO: 581040 - DNA, 25 bp, Homo sapien
gttacagctacttggcacgttgagg

SEQ ID NO: 581041 - DNA, 25 bp, Homo sapien
ttacagctacttggcacgttgaggc

SEQ ID NO: 581042 - DNA, 25 bp, Homo sapien
tacagctacttggcacgttgaggca

SEQ ID NO: 581043 - DNA, 25 bp, Homo sapien
tacttggcacgttgaggcaggaaga

SEQ ID NO: 581044 - DNA, 25 bp, Homo sapien
accaacttccaaatccaacatcagt

SEQ ID NO: 581045 - DNA, 25 bp, Homo sapien
aaatccaacatcagtaagtcaatac

SEQ ID NO: 581046 - DNA, 25 bp, Homo sapien
gtcaatacaattttatcactcttat

SEQ ID NO: 581047 - DNA, 25 bp, Homo sapien
atcactcttatctatttaacacatc

SEQ ID NO: 581048 - DNA, 25 bp, Homo sapien
cctacgaaaaaaaaatctgctcttg

SEQ ID NO: 581049 - DNA, 25 bp, Homo sapien
gctcttgaaaatgatgtcagctcca

SEQ ID NO: 581050 - DNA, 25 bp, Homo sapien
gtcagctccatcacatttggcaaag

SEQ ID NO: 581051 - DNA, 25 bp, Homo sapien
aggagtaagttatcaggccttattt

SEQ ID NO: 581052 - DNA, 25 bp, Homo sapien
gttatcaggccttatttaattgatt

SEQ ID NO: 581053 - DNA, 25 bp, Homo sapien
attatttgcatgaaactactcatta

SEQ ID NO: 581054 - DNA, 25 bp, Homo sapien
gaaactactcattaatttagatcta

SEQ ID NO: 581055 - DNA, 25 bp, Homo sapien
ttcccctctgtctctgtgggaggac

SEQ ID NO: 581056 - DNA, 25 bp, Homo sapien
ctctgtgggaggacgttgccattca

SEQ ID NO: 581057 - DNA, 25 bp, Homo sapien
aagtagagggatccccattgggtca

SEQ ID NO: 581058 - DNA, 25 bp, Homo sapien
atccccattgggtcagaatcataaa

SEQ ID NO: 581059 - DNA, 25 bp, Homo sapien
taggtgtcctccgaaacattttcgc

SEQ ID NO: 581060 - DNA, 25 bp, Homo sapien
cattttcgccgataacagatgagga

SEQ ID NO: 581061 - DNA, 25 bp, Homo sapien
agaggcccagacaggttcatcaact

SEQ ID NO: 581062 - DNA, 25 bp, Homo sapien
aggttcatcaactggctcaaggtca

SEQ ID NO: 581063 - DNA, 25 bp, Homo sapien
tcatcaactggctcaaggtcacaca

SEQ ID NO: 581064 - DNA, 25 bp, Homo sapien
tgtgccgctccataaatgctacttg

SEQ ID NO: 581065 - DNA, 25 bp, Homo sapien
ccataaatgctacttgttcccctct

SEQ ID NO: 581066 - DNA, 25 bp, Homo sapien
agatttctgcttggctgcttaccaa

SEQ ID NO: 581067 - DNA, 25 bp, Homo sapien
ggctgcttaccaagattggcaacaa

SEQ ID NO: 581068 - DNA, 25 bp, Homo sapien
tgaagggcatccagatagaaatctt

SEQ ID NO: 581069 - DNA, 25 bp, Homo sapien
tttcaaagcttacaatacagagatg

SEQ ID NO: 581070 - DNA, 25 bp, Homo sapien
tacagagatgatacctgattctatt

SEQ ID NO: 581071 - DNA, 25 bp, Homo sapien
gatgatacctgattctattggagca

SEQ ID NO: 581072 - DNA, 25 bp, Homo sapien
tacctgattctattggagcaggttt

SEQ ID NO: 581073 - DNA, 25 bp, Homo sapien
caggtttgatcatctaggcagaaat

SEQ ID NO: 581074 - DNA, 25 bp, Homo sapien
tgatcatctaggcagaaattaggat

SEQ ID NO: 581075 - DNA, 25 bp, Homo sapien
ggagatccaataatacaaccttata

SEQ ID NO: 581076 - DNA, 25 bp, Homo sapien
ccaataatacaaccttatagtcacc

SEQ ID NO: 581077 - DNA, 25 bp, Homo sapien
tcatcattatcatcaccatagtgaa

SEQ ID NO: 581078 - DNA, 25 bp, Homo sapien
tcaccatagtgaacatgtaatgctt

SEQ ID NO: 581079 - DNA, 25 bp, Homo sapien
tgtaatgcttacctagtgccagatg

SEQ ID NO: 581080 - DNA, 25 bp, Homo sapien
ttacctagtgccagatgctgtctag

SEQ ID NO: 581081 - DNA, 25 bp, Homo sapien
tgctgtctaggcattttacatgtgt

SEQ ID NO: 581082 - DNA, 25 bp, Homo sapien
aggcattttacatgtgttactggta

SEQ ID NO: 581083 - DNA, 25 bp, Homo sapien
aaggtggttgctattatccccatgt

SEQ ID NO: 581084 - DNA, 25 bp, Homo sapien
cataaagaagttgcaccgctggtaa

SEQ ID NO: 581085 - DNA, 25 bp, Homo sapien
gcaccgctggtaattggctgggatt

SEQ ID NO: 581086 - DNA, 25 bp, Homo sapien
aattggctgggatttgaacttaagc

SEQ ID NO: 581087 - DNA, 25 bp, Homo sapien
gaacttaagcagtctaaccttagag

SEQ ID NO: 581088 - DNA, 25 bp, Homo sapien
gttatttgctatttgaaaactgtag

SEQ ID NO: 581089 - DNA, 25 bp, Homo sapien
gtctattaaaagatacgtggagata

SEQ ID NO: 581090 - DNA, 25 bp, Homo sapien
aaattatacctaaagcagacgtcca

SEQ ID NO: 581091 - DNA, 25 bp, Homo sapien
tacctaaagcagacgtccaacaaat

SEQ ID NO: 581092 - DNA, 25 bp, Homo sapien
gcagacgtccaacaaattctgtaca

SEQ ID NO: 581093 - DNA, 25 bp, Homo sapien
aattctgtacatgctgctttacatc

SEQ ID NO: 581094 - DNA, 25 bp, Homo sapien
ctgtacatgctgctttacatctttg

SEQ ID NO: 581095 - DNA, 25 bp, Homo sapien
gctttacatctttgcaacaaacctc

SEQ ID NO: 581096 - DNA, 25 bp, Homo sapien
gcaacaaacctcttaactagcagca

SEQ ID NO: 581097 - DNA, 25 bp, Homo sapien
aaacctcttaactagcagcattatt

SEQ ID NO: 581098 - DNA, 25 bp, Homo sapien
tcttaactagcagcattatttctat

SEQ ID NO: 581099 - DNA, 25 bp, Homo sapien
tgtaaacatgcttcgttaatttttt

SEQ ID NO: 581100 - DNA, 25 bp, Homo sapien
gctgttctaaaccacctgggctcaa

SEQ ID NO: 581101 - DNA, 25 bp, Homo sapien
agcctgtttttctgttcactataaa

SEQ ID NO: 581102 - DNA, 25 bp, Homo sapien
cctgtttttctgttcactataaaat

SEQ ID NO: 581103 - DNA, 25 bp, Homo sapien
aggacagttgagtttgcttgaaaat

SEQ ID NO: 581104 - DNA, 25 bp, Homo sapien
cagttgagtttgcttgaaaatgtaa

SEQ ID NO: 581105 - DNA, 25 bp, Homo sapien
gtaaatattttaattctgtgcttat

SEQ ID NO: 581106 - DNA, 25 bp, Homo sapien
gtgcttataatttctttcaactttg

SEQ ID NO: 581107 - DNA, 25 bp, Homo sapien
ttcaactttgttagatttatgcttc

SEQ ID NO: 581108 - DNA, 25 bp, Homo sapien
agatttatgcttctgtaacactttt

SEQ ID NO: 581109 - DNA, 25 bp, Homo sapien
tatgcttctgtaacacttttacaga

SEQ ID NO: 581110 - DNA, 25 bp, Homo sapien
gtcctttgtgtgtgaaaagtcctac

SEQ ID NO: 581111 - DNA, 25 bp, Homo sapien
aagtcctactattccgtgcgtcaga

SEQ ID NO: 581112 - DNA, 25 bp, Homo sapien
gtcagacttcctcacagaactgttg

SEQ ID NO: 581113 - DNA, 25 bp, Homo sapien
actgttgactggttttggttcttag

SEQ ID NO: 581114 - DNA, 25 bp, Homo sapien
gtactattgagatctttcgcgtcga

SEQ ID NO: 581115 - DNA, 25 bp, Homo sapien
ccttagcggcggcagactggaataa

SEQ ID NO: 581116 - DNA, 25 bp, Homo sapien
tggaataacaccttacacctttctg

SEQ ID NO: 581117 - DNA, 25 bp, Homo sapien
ctttctggcctgcatttctgtagac

SEQ ID NO: 581118 - DNA, 25 bp, Homo sapien
tttctgtagacttcactctcaaggg

SEQ ID NO: 581119 - DNA, 25 bp, Homo sapien
ttacgttttgacttttgcacaccat

SEQ ID NO: 581120 - DNA, 25 bp, Homo sapien
cacaccatatgcactagggattctg

SEQ ID NO: 581121 - DNA, 25 bp, Homo sapien
catagaactaaagtgaccaaccatc

SEQ ID NO: 581122 - DNA, 25 bp, Homo sapien
atagaactaaagtgaccaaccatct

SEQ ID NO: 581123 - DNA, 25 bp, Homo sapien
tagaactaaagtgaccaaccatctt

SEQ ID NO: 581124 - DNA, 25 bp, Homo sapien
agaactaaagtgaccaaccatctta

SEQ ID NO: 581125 - DNA, 25 bp, Homo sapien
gaactaaagtgaccaaccatcttag

SEQ ID NO: 581126 - DNA, 25 bp, Homo sapien
aactaaagtgaccaaccatcttagt

SEQ ID NO: 581127 - DNA, 25 bp, Homo sapien
actaaagtgaccaaccatcttagtt

SEQ ID NO: 581128 - DNA, 25 bp, Homo sapien
ctaaagtgaccaaccatcttagttt

SEQ ID NO: 581129 - DNA, 25 bp, Homo sapien
taaagtgaccaaccatcttagtttg

SEQ ID NO: 581130 - DNA, 25 bp, Homo sapien
aaagtgaccaaccatcttagtttgc

SEQ ID NO: 581131 - DNA, 25 bp, Homo sapien
ggagctgctgtcctttgactacagc

SEQ ID NO: 581132 - DNA, 25 bp, Homo sapien
tcctttgactacagcgtgcctgaga

SEQ ID NO: 581133 - DNA, 25 bp, Homo sapien
gtgcctgagatcctggacaccgtgt

SEQ ID NO: 581134 - DNA, 25 bp, Homo sapien
ggacaccgtgtccaacgttgactac

SEQ ID NO: 581135 - DNA, 25 bp, Homo sapien
gtgtccaacgttgactacttcttca

SEQ ID NO: 581136 - DNA, 25 bp, Homo sapien
acttcttcaacttcaaggcgctcga

SEQ ID NO: 581137 - DNA, 25 bp, Homo sapien
cttcaacttcaaggcgctcgacgag

SEQ ID NO: 581138 - DNA, 25 bp, Homo sapien
aagagaaaggcctcgacggccaaga

SEQ ID NO: 581139 - DNA, 25 bp, Homo sapien
gcctcgacggccaagaagggaaagc

SEQ ID NO: 581140 - DNA, 25 bp, Homo sapien
ggaggacctgggagccaccccgcat

SEQ ID NO: 581141 - DNA, 25 bp, Homo sapien
caccccgcattaaagcacatttgac

SEQ ID NO: 581142 - DNA, 25 bp, Homo sapien
gggtgaactaaattgtttgcagtat

SEQ ID NO: 581143 - DNA, 25 bp, Homo sapien
agtaaagccaacactttagcggctg

SEQ ID NO: 581144 - DNA, 25 bp, Homo sapien
ctttagcggctgatggaatccacca

SEQ ID NO: 581145 - DNA, 25 bp, Homo sapien
ggaatccaccaggaacactttgtta

SEQ ID NO: 581146 - DNA, 25 bp, Homo sapien
ctttgttataggtggaaattcttca

SEQ ID NO: 581147 - DNA, 25 bp, Homo sapien
ggctttgcaggaaacaggcgtaaag

SEQ ID NO: 581148 - DNA, 25 bp, Homo sapien
attgcagcaatctctctaccaattg

SEQ ID NO: 581149 - DNA, 25 bp, Homo sapien
gcaatctctctaccaattgtttgaa

SEQ ID NO: 581150 - DNA, 25 bp, Homo sapien
aattgtttgaacctcttctgggaca

SEQ ID NO: 581151 - DNA, 25 bp, Homo sapien
aacctcttctgggacaatctggtaa

SEQ ID NO: 581152 - DNA, 25 bp, Homo sapien
gatattaaactacatcctaagccac

SEQ ID NO: 581153 - DNA, 25 bp, Homo sapien
gacttcagcaaatgtggctcacaca

SEQ ID NO: 581154 - DNA, 25 bp, Homo sapien
cttcagcaaatgtggctcacacagt

SEQ ID NO: 581155 - DNA, 25 bp, Homo sapien
acacagtgccgggacatgccgggac

SEQ ID NO: 581156 - DNA, 25 bp, Homo sapien
gaaggtggccgttcagcccgagctc

SEQ ID NO: 581157 - DNA, 25 bp, Homo sapien
tcagcccgagctcctgaaacggaat

SEQ ID NO: 581158 - DNA, 25 bp, Homo sapien
agcccgagctcctgaaacggaatcc

SEQ ID NO: 581159 - DNA, 25 bp, Homo sapien
tggctggagagggacacccctgatt

SEQ ID NO: 581160 - DNA, 25 bp, Homo sapien
gagggacacccctgattaccttaag

SEQ ID NO: 581161 - DNA, 25 bp, Homo sapien
ctgattaccttaaggcccaggcaat

SEQ ID NO: 581162 - DNA, 25 bp, Homo sapien
taaggcccaggcaataaagcagggt

SEQ ID NO: 581163 - DNA, 25 bp, Homo sapien
caggcaataaagcagggtgatcttc

SEQ ID NO: 581164 - DNA, 25 bp, Homo sapien
tgaaatgtcaaacccttaggccttg

SEQ ID NO: 581165 - DNA, 25 bp, Homo sapien
gtcaaacccttaggccttgacttgg

SEQ ID NO: 581166 - DNA, 25 bp, Homo sapien
aaatcatagcttttgtctttgaggt

SEQ ID NO: 581167 - DNA, 25 bp, Homo sapien
atagcttttgtctttgaggttcatc

SEQ ID NO: 581168 - DNA, 25 bp, Homo sapien
gcttttgtctttgaggttcatcagt

SEQ ID NO: 581169 - DNA, 25 bp, Homo sapien
gtctttgaggttcatcagttatagt

SEQ ID NO: 581170 - DNA, 25 bp, Homo sapien
ggaaggagacctattttcactgtgc

SEQ ID NO: 581171 - DNA, 25 bp, Homo sapien
aggagacctattttcactgtgcacc

SEQ ID NO: 581172 - DNA, 25 bp, Homo sapien
tattttcactgtgcaccctgttgga

SEQ ID NO: 581173 - DNA, 25 bp, Homo sapien
tgtgcaccctgttggactgttgaaa

SEQ ID NO: 581174 - DNA, 25 bp, Homo sapien
gcaccctgttggactgttgaaatta

SEQ ID NO: 581175 - DNA, 25 bp, Homo sapien
tgctagtactccaactctaatagaa

SEQ ID NO: 581176 - DNA, 25 bp, Homo sapien
gctagtactccaactctaatagaat

SEQ ID NO: 581177 - DNA, 25 bp, Homo sapien
ctagtactccaactctaatagaatt

SEQ ID NO: 581178 - DNA, 25 bp, Homo sapien
tagtactccaactctaatagaatta

SEQ ID NO: 581179 - DNA, 25 bp, Homo sapien
agtactccaactctaatagaattat

SEQ ID NO: 581180 - DNA, 25 bp, Homo sapien
gtactccaactctaatagaattatt

SEQ ID NO: 581181 - DNA, 25 bp, Homo sapien
tactccaactctaatagaattattc

SEQ ID NO: 581182 - DNA, 25 bp, Homo sapien
actccaactctaatagaattattct

SEQ ID NO: 581183 - DNA, 25 bp, Homo sapien
ctccaactctaatagaattattcta

SEQ ID NO: 581184 - DNA, 25 bp, Homo sapien
tccaactctaatagaattattctat

SEQ ID NO: 581185 - DNA, 25 bp, Homo sapien
ggcgcaggtgggtgcacagaacagt

SEQ ID NO: 581186 - DNA, 25 bp, Homo sapien
tgggtgcacagaacagtgaacggtt

SEQ ID NO: 581187 - DNA, 25 bp, Homo sapien
gtgcacagaacagtgaacggttggc

SEQ ID NO: 581188 - DNA, 25 bp, Homo sapien
tgcacagaacagtgaacggttggcc

SEQ ID NO: 581189 - DNA, 25 bp, Homo sapien
gcacagaacagtgaacggttggccg

SEQ ID NO: 581190 - DNA, 25 bp, Homo sapien
cacagaacagtgaacggttggccgg

SEQ ID NO: 581191 - DNA, 25 bp, Homo sapien
acagaacagtgaacggttggccggg

SEQ ID NO: 581192 - DNA, 25 bp, Homo sapien
cagaacagtgaacggttggccgggt

SEQ ID NO: 581193 - DNA, 25 bp, Homo sapien
gaacagtgaacggttggccgggtgc

SEQ ID NO: 581194 - DNA, 25 bp, Homo sapien
aacagtgaacggttggccgggtgca

SEQ ID NO: 581195 - DNA, 25 bp, Homo sapien
acagtgaacggttggccgggtgcag

SEQ ID NO: 581196 - DNA, 25 bp, Homo sapien
cttcatccacaatggcatcatggtt

SEQ ID NO: 581197 - DNA, 25 bp, Homo sapien
ttcatccacaatggcatcatggttc

SEQ ID NO: 581198 - DNA, 25 bp, Homo sapien
tccacaatggcatcatggttctccc

SEQ ID NO: 581199 - DNA, 25 bp, Homo sapien
gttctcccacggcagacctgcggcc

SEQ ID NO: 581200 - DNA, 25 bp, Homo sapien
acacacaccatcttctacaacgagt

SEQ ID NO: 581201 - DNA, 25 bp, Homo sapien
cacacaccatcttctacaacgagta

SEQ ID NO: 581202 - DNA, 25 bp, Homo sapien
ttctacaacgagtaccctggcggct

SEQ ID NO: 581203 - DNA, 25 bp, Homo sapien
acaacgagtaccctggcggctccag

SEQ ID NO: 581204 - DNA, 25 bp, Homo sapien
aacgagtaccctggcggctccagtg

SEQ ID NO: 581205 - DNA, 25 bp, Homo sapien
taccctggcggctccagtgagctgg

SEQ ID NO: 581206 - DNA, 25 bp, Homo sapien
tcaacgggggcgagctcttcctcac

SEQ ID NO: 581207 - DNA, 25 bp, Homo sapien
ctccagcctgcctgacaaagaggga

SEQ ID NO: 581208 - DNA, 25 bp, Homo sapien
tccagcctgcctgacaaagagggac

SEQ ID NO: 581209 - DNA, 25 bp, Homo sapien
ccagcctgcctgacaaagagggacc

SEQ ID NO: 581210 - DNA, 25 bp, Homo sapien
tacataaatgtttaacttcacttag

SEQ ID NO: 581211 - DNA, 25 bp, Homo sapien
cataaatgtttaacttcacttagag

SEQ ID NO: 581212 - DNA, 25 bp, Homo sapien
ataaatgtttaacttcacttagaga

SEQ ID NO: 581213 - DNA, 25 bp, Homo sapien
aatgtttaacttcacttagagaaat

SEQ ID NO: 581214 - DNA, 25 bp, Homo sapien
atgtttaacttcacttagagaaatg

SEQ ID NO: 581215 - DNA, 25 bp, Homo sapien
tgtttaacttcacttagagaaatgc

SEQ ID NO: 581216 - DNA, 25 bp, Homo sapien
gattaaaattacactgggccaggca

SEQ ID NO: 581217 - DNA, 25 bp, Homo sapien
gaggtaggtggattgtttaagccca

SEQ ID NO: 581218 - DNA, 25 bp, Homo sapien
gggaatctaacccacactgtggctc

SEQ ID NO: 581219 - DNA, 25 bp, Homo sapien
aatgtgccttctgtaaggccatagt

SEQ ID NO: 581220 - DNA, 25 bp, Homo sapien
aagattagcctaaagcatcctggaa

SEQ ID NO: 581221 - DNA, 25 bp, Homo sapien
ttggtgacttgccagcttttgcagc

SEQ ID NO: 581222 - DNA, 25 bp, Homo sapien
ttcttttctcacttctgcttatact

SEQ ID NO: 581223 - DNA, 25 bp, Homo sapien
ctgcttatacttttgctggtggatt

SEQ ID NO: 581224 - DNA, 25 bp, Homo sapien
ctggtggattcctttaattcataaa

SEQ ID NO: 581225 - DNA, 25 bp, Homo sapien
ataaagacatacctactctgcctgg

SEQ ID NO: 581226 - DNA, 25 bp, Homo sapien
ctctgcctgggtcttgaggagttca

SEQ ID NO: 581227 - DNA, 25 bp, Homo sapien
gaggagttcaatgtatgtctatttc

SEQ ID NO: 581228 - DNA, 25 bp, Homo sapien
tgtctatttctcttgattcacttgt

SEQ ID NO: 581229 - DNA, 25 bp, Homo sapien
aggccctgtctctggtggtttttag

SEQ ID NO: 581230 - DNA, 25 bp, Homo sapien
ggtttttaggattggaggacatcat

SEQ ID NO: 581231 - DNA, 25 bp, Homo sapien
catcatgaagatggaggccttgtaa

SEQ ID NO: 581232 - DNA, 25 bp, Homo sapien
atggaggccttgtaattgggattag

SEQ ID NO: 581233 - DNA, 25 bp, Homo sapien
tagtttcctgataggaatccctaga

SEQ ID NO: 581234 - DNA, 25 bp, Homo sapien
aatccctagagagctagctttgccc

SEQ ID NO: 581235 - DNA, 25 bp, Homo sapien
tagctttgcccttcaccatgagagg

SEQ ID NO: 581236 - DNA, 25 bp, Homo sapien
aagatagctatctttgaaccgggaa

SEQ ID NO: 581237 - DNA, 25 bp, Homo sapien
tctttgaaccgggaagcaggccctt

SEQ ID NO: 581238 - DNA, 25 bp, Homo sapien
cttaccagacatggactatgccagt

SEQ ID NO: 581239 - DNA, 25 bp, Homo sapien
atggactatgccagtgccttgatat

SEQ ID NO: 581240 - DNA, 25 bp, Homo sapien
tggccaagggcaagctgggcctgga

SEQ ID NO: 581241 - DNA, 25 bp, Homo sapien
acagttcggcctcctacttcactga

SEQ ID NO: 581242 - DNA, 25 bp, Homo sapien
tcctacttcactgagtgggagttgg

SEQ ID NO: 581243 - DNA, 25 bp, Homo sapien
agtgggagttggtggctgccaaggc

SEQ ID NO: 581244 - DNA, 25 bp, Homo sapien
gctgccaaggccaactcatggctgg

SEQ ID NO: 581245 - DNA, 25 bp, Homo sapien
tgcccgccagctgtttgtgcttctg

SEQ ID NO: 581246 - DNA, 25 bp, Homo sapien
gccagctgtttgtgcttctgcggca

SEQ ID NO: 581247 - DNA, 25 bp, Homo sapien
tgcttctgcggcactgggatgagaa

SEQ ID NO: 581248 - DNA, 25 bp, Homo sapien
tgcggcactgggatgagaatctcga

SEQ ID NO: 581249 - DNA, 25 bp, Homo sapien
gaatctcgagttcaatatgctctgc

SEQ ID NO: 581250 - DNA, 25 bp, Homo sapien
gttcaatatgctctgctataacccg

SEQ ID NO: 581251 - DNA, 25 bp, Homo sapien
agtgatttttattctgcccattaac

SEQ ID NO: 581252 - DNA, 25 bp, Homo sapien
attctgcccattaacagtgctttga

SEQ ID NO: 581253 - DNA, 25 bp, Homo sapien
ttgaacccaattctctatactctga

SEQ ID NO: 581254 - DNA, 25 bp, Homo sapien
tctatactctgaccacaagaccatt

SEQ ID NO: 581255 - DNA, 25 bp, Homo sapien
gattcatcggttttggtataactac

SEQ ID NO: 581256 - DNA, 25 bp, Homo sapien
ggtcagaaaacatatgctccatcat

SEQ ID NO: 581257 - DNA, 25 bp, Homo sapien
atatgctccatcattcatctgggtg

SEQ ID NO: 581258 - DNA, 25 bp, Homo sapien
aggagatgccacctgagttaatgaa

SEQ ID NO: 581259 - DNA, 25 bp, Homo sapien
aatgaagccggaccttttcacatac

SEQ ID NO: 581260 - DNA, 25 bp, Homo sapien
atacccctgtgaaatgtcactgatt

SEQ ID NO: 581261 - DNA, 25 bp, Homo sapien
caacgagactcaattcctattcatg

SEQ ID NO: 581262 - DNA, 25 bp, Homo sapien
gacaccctctctaaacatgtgttca

SEQ ID NO: 581263 - DNA, 25 bp, Homo sapien
catgtgttcaatcatactcatttct

SEQ ID NO: 581264 - DNA, 25 bp, Homo sapien
tcatttctaagctatcacactcaag

SEQ ID NO: 581265 - DNA, 25 bp, Homo sapien
gatctgtggaatatgccaatatcta

SEQ ID NO: 581266 - DNA, 25 bp, Homo sapien
attttagcaactgtcttgtagttcc

SEQ ID NO: 581267 - DNA, 25 bp, Homo sapien
ccttcccacagacctaactaatagt

SEQ ID NO: 581268 - DNA, 25 bp, Homo sapien
atagtcctgtgagtaaagcaaaacc

SEQ ID NO: 581269 - DNA, 25 bp, Homo sapien
gagttagtctatgaggagtttccaa

SEQ ID NO: 581270 - DNA, 25 bp, Homo sapien
aggagtttccaacaacatgcagcta

SEQ ID NO: 581271 - DNA, 25 bp, Homo sapien
ggaaaagccccattggaatagacct

SEQ ID NO: 581272 - DNA, 25 bp, Homo sapien
gaatagacctccaccaataataata

SEQ ID NO: 581273 - DNA, 25 bp, Homo sapien
ctgtgaagaagaaacattccaggaa

SEQ ID NO: 581274 - DNA, 25 bp, Homo sapien
aacattccaggaacgagtggctctc

SEQ ID NO: 581275 - DNA, 25 bp, Homo sapien
acattccaggaacgagtggctctcg

SEQ ID NO: 581276 - DNA, 25 bp, Homo sapien
ttccaggaacgagtggctctcggat

SEQ ID NO: 581277 - DNA, 25 bp, Homo sapien
ggaacgagtggctctcggatgttac

SEQ ID NO: 581278 - DNA, 25 bp, Homo sapien
aacgagtggctctcggatgttacca

SEQ ID NO: 581279 - DNA, 25 bp, Homo sapien
gagtggctctcggatgttaccatct

SEQ ID NO: 581280 - DNA, 25 bp, Homo sapien
gtggctctcggatgttaccatctag

SEQ ID NO: 581281 - DNA, 25 bp, Homo sapien
ggctctcggatgttaccatctagag

SEQ ID NO: 581282 - DNA, 25 bp, Homo sapien
ctctcggatgttaccatctagagaa

SEQ ID NO: 581283 - DNA, 25 bp, Homo sapien
tcggatgttaccatctagagaagag

SEQ ID NO: 581284 - DNA, 25 bp, Homo sapien
tcacacagtgcccttccaatttgta

SEQ ID NO: 581285 - DNA, 25 bp, Homo sapien
acagtgcccttccaatttgtattta

SEQ ID NO: 581286 - DNA, 25 bp, Homo sapien
ctgaccttggacatgtgtaccagga

SEQ ID NO: 581287 - DNA, 25 bp, Homo sapien
catgtgtaccaggatgtaaggcaat

SEQ ID NO: 581288 - DNA, 25 bp, Homo sapien
gatgtaaggcaataaacctattcac

SEQ ID NO: 581289 - DNA, 25 bp, Homo sapien
aaaagggcctggtcctctatgaaga

SEQ ID NO: 581290 - DNA, 25 bp, Homo sapien
gcctggtcctctatgaagatttcct

SEQ ID NO: 581291 - DNA, 25 bp, Homo sapien
tgaagatttcctgaaggctacttac

SEQ ID NO: 581292 - DNA, 25 bp, Homo sapien
ttttgcttaacttcaaatttctgaa

SEQ ID NO: 581293 - DNA, 25 bp, Homo sapien
ttaaatgttaatctgtgcctactgt

SEQ ID NO: 581294 - DNA, 25 bp, Homo sapien
ctgtgcctactgtactacttgaaca

SEQ ID NO: 581295 - DNA, 25 bp, Homo sapien
tgtgagaagcgacccagcatagatc

SEQ ID NO: 581296 - DNA, 25 bp, Homo sapien
gagaagcgacccagcatagatctat

SEQ ID NO: 581297 - DNA, 25 bp, Homo sapien
gaagcgacccagcatagatctatgc

SEQ ID NO: 581298 - DNA, 25 bp, Homo sapien
gcatagatctatgcatccaccactg

SEQ ID NO: 581299 - DNA, 25 bp, Homo sapien
atagatctatgcatccaccactgtt

SEQ ID NO: 581300 - DNA, 25 bp, Homo sapien
gcatccaccactgttcatatttcca

SEQ ID NO: 581301 - DNA, 25 bp, Homo sapien
acaaataagatatgctgttcagcct

SEQ ID NO: 581302 - DNA, 25 bp, Homo sapien
aagatatgctgttcagccttctgtg

SEQ ID NO: 581303 - DNA, 25 bp, Homo sapien
gatatgctgttcagccttctgtggg

SEQ ID NO: 581304 - DNA, 25 bp, Homo sapien
gctgttcagccttctgtgggaacat

SEQ ID NO: 581305 - DNA, 25 bp, Homo sapien
ctgttcagccttctgtgggaacatt

SEQ ID NO: 581306 - DNA, 25 bp, Homo sapien
acagtggtgcacacgtgtagttccg

SEQ ID NO: 581307 - DNA, 25 bp, Homo sapien
agtggtgcacacgtgtagttccggc

SEQ ID NO: 581308 - DNA, 25 bp, Homo sapien
gcacacgtgtagttccggctacttt

SEQ ID NO: 581309 - DNA, 25 bp, Homo sapien
cacacgtgtagttccggctactttt

SEQ ID NO: 581310 - DNA, 25 bp, Homo sapien
acacgtgtagttccggctacttttg

SEQ ID NO: 581311 - DNA, 25 bp, Homo sapien
gtagttccggctacttttggaggct

SEQ ID NO: 581312 - DNA, 25 bp, Homo sapien
ccatggttttgccactgtatttcag

SEQ ID NO: 581313 - DNA, 25 bp, Homo sapien
catggttttgccactgtatttcagc

SEQ ID NO: 581314 - DNA, 25 bp, Homo sapien
ccactgtatttcagcctgcatgaca

SEQ ID NO: 581315 - DNA, 25 bp, Homo sapien
aatccaaaatttaacaattagctgg

SEQ ID NO: 581316 - DNA, 25 bp, Homo sapien
caaaatttaacaattagctggacgt

SEQ ID NO: 581317 - DNA, 25 bp, Homo sapien
tggtgaatcctgtggtcaacagctc

SEQ ID NO: 581318 - DNA, 25 bp, Homo sapien
ggtcaacagctcaccatgaggttca

SEQ ID NO: 581319 - DNA, 25 bp, Homo sapien
atgaggttcacccatggtcagcagg

SEQ ID NO: 581320 - DNA, 25 bp, Homo sapien
ccatggtcagcaggtagtcgagtgt

SEQ ID NO: 581321 - DNA, 25 bp, Homo sapien
agtgtggcagacatgcttcgcccta

SEQ ID NO: 581322 - DNA, 25 bp, Homo sapien
ttcgccctatttctgggtccatttt

SEQ ID NO: 581323 - DNA, 25 bp, Homo sapien
ttgccttcatttgctcgactttgaa

SEQ ID NO: 581324 - DNA, 25 bp, Homo sapien
atgcatcgtaataagctgtctggga

SEQ ID NO: 581325 - DNA, 25 bp, Homo sapien
gaatgctttctgattgttccaatgt

SEQ ID NO: 581326 - DNA, 25 bp, Homo sapien
gttccaatgtatatccaccatctag

SEQ ID NO: 581327 - DNA, 25 bp, Homo sapien
ccaccatctagtttggattgttcaa

SEQ ID NO: 581328 - DNA, 25 bp, Homo sapien
ctccagcctgcctgacaaagaggga

SEQ ID NO: 581329 - DNA, 25 bp, Homo sapien
tccagcctgcctgacaaagagggac

SEQ ID NO: 581330 - DNA, 25 bp, Homo sapien
ccagcctgcctgacaaagagggacc

SEQ ID NO: 581331 - DNA, 25 bp, Homo sapien
tacataaatgtttaacttcacttag

SEQ ID NO: 581332 - DNA, 25 bp, Homo sapien
acataaatgtttaacttcacttaga

SEQ ID NO: 581333 - DNA, 25 bp, Homo sapien
cataaatgtttaacttcacttagag

SEQ ID NO: 581334 - DNA, 25 bp, Homo sapien
ataaatgtttaacttcacttagaga

SEQ ID NO: 581335 - DNA, 25 bp, Homo sapien
aatgtttaacttcacttagagaaat

SEQ ID NO: 581336 - DNA, 25 bp, Homo sapien
atgtttaacttcacttagagaaatg

SEQ ID NO: 581337 - DNA, 25 bp, Homo sapien
tgtttaacttcacttagagaaatgc

SEQ ID NO: 581338 - DNA, 25 bp, Homo sapien
gagatggccttaattttggtacaca

SEQ ID NO: 581339 - DNA, 25 bp, Homo sapien
attttggtacacagattggcttcat

SEQ ID NO: 581340 - DNA, 25 bp, Homo sapien
ggtacacagattggcttcatatcaa

SEQ ID NO: 581341 - DNA, 25 bp, Homo sapien
gaatgagatacttgactggattttt

SEQ ID NO: 581342 - DNA, 25 bp, Homo sapien
gactggatttttgtataactgcttc

SEQ ID NO: 581343 - DNA, 25 bp, Homo sapien
atttttgtataactgcttcctgcct

SEQ ID NO: 581344 - DNA, 25 bp, Homo sapien
tgcctccttccaaactgactgcaag

SEQ ID NO: 581345 - DNA, 25 bp, Homo sapien
ccttccaaactgactgcaagagaga

SEQ ID NO: 581346 - DNA, 25 bp, Homo sapien
gcaagagagaaatttagctgtttga

SEQ ID NO: 581347 - DNA, 25 bp, Homo sapien
aatggataattcatcttttgggtat

SEQ ID NO: 581348 - DNA, 25 bp, Homo sapien
ttactattattcaaagccaaatgat

SEQ ID NO: 581349 - DNA, 25 bp, Homo sapien
agaatgaagggcatccagatagaaa

SEQ ID NO: 581350 - DNA, 25 bp, Homo sapien
tgaagggcatccagatagaaatctt

SEQ ID NO: 581351 - DNA, 25 bp, Homo sapien
tttcaaagcttacaatacagagatg

SEQ ID NO: 581352 - DNA, 25 bp, Homo sapien
tacagagatgatacctgattctatt

SEQ ID NO: 581353 - DNA, 25 bp, Homo sapien
gatgatacctgattctattggagca

SEQ ID NO: 581354 - DNA, 25 bp, Homo sapien
tacctgattctattggagcaggttt

SEQ ID NO: 581355 - DNA, 25 bp, Homo sapien
caggtttgatcatctaggcagaaat

SEQ ID NO: 581356 - DNA, 25 bp, Homo sapien
ggtttgatcatctaggcagaaatta

SEQ ID NO: 581357 - DNA, 25 bp, Homo sapien
tgatcatctaggcagaaattaggat

SEQ ID NO: 581358 - DNA, 25 bp, Homo sapien
ggagatccaataatacaaccttata

SEQ ID NO: 581359 - DNA, 25 bp, Homo sapien
ccaataatacaaccttatagtcacc

SEQ ID NO: 581360 - DNA, 25 bp, Homo sapien
agcatgatgtgtatcctcaggcctc

SEQ ID NO: 581361 - DNA, 25 bp, Homo sapien
gccctgggaccaccacatgaggaag

SEQ ID NO: 581362 - DNA, 25 bp, Homo sapien
aggaaggcagctggcccctggaata

SEQ ID NO: 581363 - DNA, 25 bp, Homo sapien
tggcccctggaataagcatgtggag

SEQ ID NO: 581364 - DNA, 25 bp, Homo sapien
ggaggacactcagaaggatgcccat

SEQ ID NO: 581365 - DNA, 25 bp, Homo sapien
aaggatgcccatctgctctgagtgt

SEQ ID NO: 581366 - DNA, 25 bp, Homo sapien
tcctaattctgcctgaccttggtta

SEQ ID NO: 581367 - DNA, 25 bp, Homo sapien
accttggttacttcctctggacaat

SEQ ID NO: 581368 - DNA, 25 bp, Homo sapien
tggacaatcgcctttacctatctac

SEQ ID NO: 581369 - DNA, 25 bp, Homo sapien
tatctaccaggttttgaggaattac

SEQ ID NO: 581370 - DNA, 25 bp, Homo sapien
aggaattacacacagctcaggtata

SEQ ID NO: 581371 - DNA, 25 bp, Homo sapien
tgaggcaccaccacagtcagcatcg

SEQ ID NO: 581372 - DNA, 25 bp, Homo sapien
accaccacagtcagcatcgacaggg

SEQ ID NO: 581373 - DNA, 25 bp, Homo sapien
gtcagcatcgacaggggcacagcag

SEQ ID NO: 581374 - DNA, 25 bp, Homo sapien
cacagcagtggcagtttgggacctc

SEQ ID NO: 581375 - DNA, 25 bp, Homo sapien
agcagtggcagtttgggacctccct

SEQ ID NO: 581376 - DNA, 25 bp, Homo sapien
cagtggcagtttgggacctccctgt

SEQ ID NO: 581377 - DNA, 25 bp, Homo sapien
tggcagtttgggacctccctgtgcc

SEQ ID NO: 581378 - DNA, 25 bp, Homo sapien
aggttaccacaggacctgggcttcg

SEQ ID NO: 581379 - DNA, 25 bp, Homo sapien
ttaccacaggacctgggcttcgtct

SEQ ID NO: 581380 - DNA, 25 bp, Homo sapien
ccaggcctggtagatgagatggctt

SEQ ID NO: 581381 - DNA, 25 bp, Homo sapien
cctggtagatgagatggcttgtctc

SEQ ID NO: 581382 - DNA, 25 bp, Homo sapien
tggaactttctctttcactccaact

SEQ ID NO: 581383 - DNA, 25 bp, Homo sapien
tttcactccaactttcttactacat

SEQ ID NO: 581384 - DNA, 25 bp, Homo sapien
actacatccatcttttctgtggcgg

SEQ ID NO: 581385 - DNA, 25 bp, Homo sapien
aggagtgccactatgctgacttctt

SEQ ID NO: 581386 - DNA, 25 bp, Homo sapien
cactatgctgacttcttattccttt

SEQ ID NO: 581387 - DNA, 25 bp, Homo sapien
cataacagtcttcaaagcacagctc

SEQ ID NO: 581388 - DNA, 25 bp, Homo sapien
gcacagctcatctaaagaatgccta

SEQ ID NO: 581389 - DNA, 25 bp, Homo sapien
gaatgcctacttcttttccaaataa

SEQ ID NO: 581390 - DNA, 25 bp, Homo sapien
gatttatcgcctattatgcagtaac

SEQ ID NO: 581391 - DNA, 25 bp, Homo sapien
aaagactgtatttcccatagacgtt

SEQ ID NO: 581392 - DNA, 25 bp, Homo sapien
atttcccatagacgtttacagcaac

SEQ ID NO: 581393 - DNA, 25 bp, Homo sapien
caatatgaactagctgaggaagacc

SEQ ID NO: 581394 - DNA, 25 bp, Homo sapien
tatgaactagctgaggaagacctta

SEQ ID NO: 581395 - DNA, 25 bp, Homo sapien
gaactagctgaggaagaccttaata

SEQ ID NO: 581396 - DNA, 25 bp, Homo sapien
gaggaagaccttaataaagccctgt

SEQ ID NO: 581397 - DNA, 25 bp, Homo sapien
ggaagaccttaataaagccctgtct

SEQ ID NO: 581398 - DNA, 25 bp, Homo sapien
gaccttaataaagccctgtctttga

SEQ ID NO: 581399 - DNA, 25 bp, Homo sapien
aataaagccctgtctttgaagccta

SEQ ID NO: 581400 - DNA, 25 bp, Homo sapien
taaagccctgtctttgaagcctaat

SEQ ID NO: 581401 - DNA, 25 bp, Homo sapien
aaagccctgtctttgaagcctaatg

SEQ ID NO: 581402 - DNA, 25 bp, Homo sapien
aagccctgtctttgaagcctaatga

SEQ ID NO: 581403 - DNA, 25 bp, Homo sapien
agccctgtctttgaagcctaatgat

SEQ ID NO: 581404 - DNA, 25 bp, Homo sapien
cagccatcttgtggatatgagggaa

SEQ ID NO: 581405 - DNA, 25 bp, Homo sapien
gccatcttgtggatatgagggaaga

SEQ ID NO: 581406 - DNA, 25 bp, Homo sapien
tgagggaagagccaaatagactaca

SEQ ID NO: 581407 - DNA, 25 bp, Homo sapien
gggaagagccaaatagactacaaat

SEQ ID NO: 581408 - DNA, 25 bp, Homo sapien
gagccaaatagactacaaatcggtt

SEQ ID NO: 581409 - DNA, 25 bp, Homo sapien
gccaaatagactacaaatcggttaa

SEQ ID NO: 581410 - DNA, 25 bp, Homo sapien
atagactacaaatcggttaaaacag

SEQ ID NO: 581411 - DNA, 25 bp, Homo sapien
gaatgaaccagctatggaattgtct

SEQ ID NO: 581412 - DNA, 25 bp, Homo sapien
atgaaccagctatggaattgtctgt

SEQ ID NO: 581413 - DNA, 25 bp, Homo sapien
gaaccagctatggaattgtctgtgt

SEQ ID NO: 581414 - DNA, 25 bp, Homo sapien
accagctatggaattgtctgtgtgt

SEQ ID NO: 581415 - DNA, 25 bp, Homo sapien
gcccagctggacacattggatgctg

SEQ ID NO: 581416 - DNA, 25 bp, Homo sapien
gacacattggatgctgtgctccaga

SEQ ID NO: 581417 - DNA, 25 bp, Homo sapien
cattggatgctgtgctccagaggag

SEQ ID NO: 581418 - DNA, 25 bp, Homo sapien
gctccagaggaggaactgcactcac

SEQ ID NO: 581419 - DNA, 25 bp, Homo sapien
ggaggaactgcactcacctatcgct

SEQ ID NO: 581420 - DNA, 25 bp, Homo sapien
acctatcgctctcctttgtatggga

SEQ ID NO: 581421 - DNA, 25 bp, Homo sapien
atcgctctcctttgtatgggacaag

SEQ ID NO: 581422 - DNA, 25 bp, Homo sapien
tcctttgtatgggacaagtgggaca

SEQ ID NO: 581423 - DNA, 25 bp, Homo sapien
tccaggcagccttaactatcgagga

SEQ ID NO: 581424 - DNA, 25 bp, Homo sapien
cttaactatcgaggaatggcaggaa

SEQ ID NO: 581425 - DNA, 25 bp, Homo sapien
tcgaggaatggcaggaaattctgtc

SEQ ID NO: 581426 - DNA, 25 bp, Homo sapien
agtattgtcttaacctccattatcg

SEQ ID NO: 581427 - DNA, 25 bp, Homo sapien
gtcttaacctccattatcgtttatt

SEQ ID NO: 581428 - DNA, 25 bp, Homo sapien
tatcgtttattctttgacccatcta

SEQ ID NO: 581429 - DNA, 25 bp, Homo sapien
ctttgacccatctattatttggaat

SEQ ID NO: 581430 - DNA, 25 bp, Homo sapien
gacttatagtgaaatgcatacatct

SEQ ID NO: 581431 - DNA, 25 bp, Homo sapien
gcatacatctgaagtgtacagttgg

SEQ ID NO: 581432 - DNA, 25 bp, Homo sapien
tgagtttgacagatgcatacatgca

SEQ ID NO: 581433 - DNA, 25 bp, Homo sapien
tgcatacatgcatgtaaccaccacc

SEQ ID NO: 581434 - DNA, 25 bp, Homo sapien
tctctggaaggttcctgcatgttat

SEQ ID NO: 581435 - DNA, 25 bp, Homo sapien
ggttcctgcatgttatatggctatt

SEQ ID NO: 581436 - DNA, 25 bp, Homo sapien
ttatatggctatttcttagttgcct

SEQ ID NO: 581437 - DNA, 25 bp, Homo sapien
aatcatgccagttctaccacttttg

SEQ ID NO: 581438 - DNA, 25 bp, Homo sapien
gctccaagagagtcagtgtagctga

SEQ ID NO: 581439 - DNA, 25 bp, Homo sapien
tcacctatctagtccatatgtctgc

SEQ ID NO: 581440 - DNA, 25 bp, Homo sapien
tagtccatatgtctgcaggaattat

SEQ ID NO: 581441 - DNA, 25 bp, Homo sapien
ggacaactcaccatgcaatcaatct

SEQ ID NO: 581442 - DNA, 25 bp, Homo sapien
tcctgttccctgaccggcatggttt

SEQ ID NO: 581443 - DNA, 25 bp, Homo sapien
ctgaccggcatggtttctacttcct

SEQ ID NO: 581444 - DNA, 25 bp, Homo sapien
tctacttcctgtcagcacaactagg

SEQ ID NO: 581445 - DNA, 25 bp, Homo sapien
gcacaactaggacgtctggtttctg

SEQ ID NO: 581446 - DNA, 25 bp, Homo sapien
taggacgtctggtttctgctgggct

SEQ ID NO: 581447 - DNA, 25 bp, Homo sapien
ctgccctctcatgggaagcctttaa

SEQ ID NO: 581448 - DNA, 25 bp, Homo sapien
ataaacaccttggactttgctttga

SEQ ID NO: 581449 - DNA, 25 bp, Homo sapien
ttgaaatcccagaagggctacccct

SEQ ID NO: 581450 - DNA, 25 bp, Homo sapien
aatactactccccagggctatggca

SEQ ID NO: 581451 - DNA, 25 bp, Homo sapien
ggctatggcattttccctaggacta

SEQ ID NO: 581452 - DNA, 25 bp, Homo sapien
gggatcaccccgaagtacatataaa

SEQ ID NO: 581453 - DNA, 25 bp, Homo sapien
tcacatgctagactaactgctgaac

SEQ ID NO: 581454 - DNA, 25 bp, Homo sapien
taactgctgaactgcccatgcacag

SEQ ID NO: 581455 - DNA, 25 bp, Homo sapien
gaagtgccacagattccagcagaga

SEQ ID NO: 581456 - DNA, 25 bp, Homo sapien
agagatttcagtagctgcctgctgt

SEQ ID NO: 581457 - DNA, 25 bp, Homo sapien
agtcttgtcaagttagaggcgattc

SEQ ID NO: 581458 - DNA, 25 bp, Homo sapien
ggcgattcgataaacaccttggact

SEQ ID NO: 581459 - DNA, 25 bp, Homo sapien
atgcccgaggtccagtactcgaact

SEQ ID NO: 581460 - DNA, 25 bp, Homo sapien
gaggtccagtactcgaactacctgt

SEQ ID NO: 581461 - DNA, 25 bp, Homo sapien
ggtccagtactcgaactacctgttg

SEQ ID NO: 581462 - DNA, 25 bp, Homo sapien
agtactcgaactacctgttgcgcaa

SEQ ID NO: 581463 - DNA, 25 bp, Homo sapien
tcgaactacctgttgcgcaagcaga

SEQ ID NO: 581464 - DNA, 25 bp, Homo sapien
gaactacctgttgcgcaagcagaag

SEQ ID NO: 581465 - DNA, 25 bp, Homo sapien
cctgttgcgcaagcagaagcgccgg

SEQ ID NO: 581466 - DNA, 25 bp, Homo sapien
tcaaggtccctgagctccgcaggcc

SEQ ID NO: 581467 - DNA, 25 bp, Homo sapien
aggcctccaggagtatgggtcctgc

SEQ ID NO: 581468 - DNA, 25 bp, Homo sapien
caggagtatgggtcctgccctgccc

SEQ ID NO: 581469 - DNA, 25 bp, Homo sapien
cccatgagagccctttcttttcaat

SEQ ID NO: 581470 - DNA, 25 bp, Homo sapien
caccaccaagctcttagagggtgat

SEQ ID NO: 581471 - DNA, 25 bp, Homo sapien
tcttagagggtgatgactgtagctt

SEQ ID NO: 581472 - DNA, 25 bp, Homo sapien
gggtgatgactgtagcttaaaattt

SEQ ID NO: 581473 - DNA, 25 bp, Homo sapien
gtgactattgtgatcattgttaact

SEQ ID NO: 581474 - DNA, 25 bp, Homo sapien
tattgtgatcattgttaactttcat

SEQ ID NO: 581475 - DNA, 25 bp, Homo sapien
atttttgacaatgagtgggtttact

SEQ ID NO: 581476 - DNA, 25 bp, Homo sapien
ttgacaatgagtgggtttactacat

SEQ ID NO: 581477 - DNA, 25 bp, Homo sapien
gtttactgcatatgaaacatcccaa

SEQ ID NO: 581478 - DNA, 25 bp, Homo sapien
tatgaaacatcccaacacaaaaaag

SEQ ID NO: 581479 - DNA, 25 bp, Homo sapien
agggattaattgacgtttctgtaat

SEQ ID NO: 581480 - DNA, 25 bp, Homo sapien
taaaactagtttttgcatttaagct

SEQ ID NO: 581481 - DNA, 25 bp, Homo sapien
gttgaggtgaggttataccgaagta

SEQ ID NO: 581482 - DNA, 25 bp, Homo sapien
ataccgaagtagaatgtggccttaa

SEQ ID NO: 581483 - DNA, 25 bp, Homo sapien
gtagaatgtggccttaatccaatat

SEQ ID NO: 581484 - DNA, 25 bp, Homo sapien
atgtggccttaatccaatataactg

SEQ ID NO: 581485 - DNA, 25 bp, Homo sapien
caatataactggtgtcctaagaatt

SEQ ID NO: 581486 - DNA, 25 bp, Homo sapien
aactggtgtcctaagaattggagaa

SEQ ID NO: 581487 - DNA, 25 bp, Homo sapien
attggagaagagactcagacacatg

SEQ ID NO: 581488 - DNA, 25 bp, Homo sapien
tgatgtatcaacaagccagcaaatg

SEQ ID NO: 581489 - DNA, 25 bp, Homo sapien
aatgccagggattgctgggaacatc

SEQ ID NO: 581490 - DNA, 25 bp, Homo sapien
tcttccctagagctgtgggagagaa

SEQ ID NO: 581491 - DNA, 25 bp, Homo sapien
gagaacatgattctgctgacacctt

SEQ ID NO: 581492 - DNA, 25 bp, Homo sapien
gggagatctcaaaccatggacgtgg

SEQ ID NO: 581493 - DNA, 25 bp, Homo sapien
atggacgtggagctgtggtttgaca

SEQ ID NO: 581494 - DNA, 25 bp, Homo sapien
ggtttgacagcgctggctctgcttc

SEQ ID NO: 581495 - DNA, 25 bp, Homo sapien
tccccacacacttacatggcaaagg

SEQ ID NO: 581496 - DNA, 25 bp, Homo sapien
aagtctgctactatcgtgggttgat

SEQ ID NO: 581497 - DNA, 25 bp, Homo sapien
ctactatcgtgggttgatgaggatt

SEQ ID NO: 581498 - DNA, 25 bp, Homo sapien
gattgtgggcaaacaggctctcttg

SEQ ID NO: 581499 - DNA, 25 bp, Homo sapien
gtttaaactggtgtctccactttgg

SEQ ID NO: 581500 - DNA, 25 bp, Homo sapien
tggtgtctccactttggccatatga

SEQ ID NO: 581501 - DNA, 25 bp, Homo sapien
cactttggccatatgacggtatcta

SEQ ID NO: 581502 - DNA, 25 bp, Homo sapien
ggccatatgacggtatctaagaaat

SEQ ID NO: 581503 - DNA, 25 bp, Homo sapien
atttctatatatttgcaatgaacaa

SEQ ID NO: 581504 - DNA, 25 bp, Homo sapien
atgaacaattcaaaatggagtttta

SEQ ID NO: 581505 - DNA, 25 bp, Homo sapien
tgaacaattcaaaatggagttttaa

SEQ ID NO: 581506 - DNA, 25 bp, Homo sapien
tttttatttatgatagtctccaaaa

SEQ ID NO: 581507 - DNA, 25 bp, Homo sapien
ttttatttatgatagtctccaaaat

SEQ ID NO: 581508 - DNA, 25 bp, Homo sapien
tttatttatgatagtctccaaaata

SEQ ID NO: 581509 - DNA, 25 bp, Homo sapien
ttatttatgatagtctccaaaatac

SEQ ID NO: 581510 - DNA, 25 bp, Homo sapien
tatttatgatagtctccaaaatact

SEQ ID NO: 581511 - DNA, 25 bp, Homo sapien
atgtgggcaccgtctgtgacccggc

SEQ ID NO: 581512 - DNA, 25 bp, Homo sapien
gatgatgggctccagtcagccttca

SEQ ID NO: 581513 - DNA, 25 bp, Homo sapien
cactgctgctcatgaactgggtaaa

SEQ ID NO: 581514 - DNA, 25 bp, Homo sapien
gggtagcaagttcaccacagtgtta

SEQ ID NO: 581515 - DNA, 25 bp, Homo sapien
gcaagttcaccacagtgttaatggg

SEQ ID NO: 581516 - DNA, 25 bp, Homo sapien
ccccaggcctaggtatagggctatt

SEQ ID NO: 581517 - DNA, 25 bp, Homo sapien
ggtatagggctattactcctctctg

SEQ ID NO: 581518 - DNA, 25 bp, Homo sapien
atagggctattactcctctctgctc

SEQ ID NO: 581519 - DNA, 25 bp, Homo sapien
tctctgctccaggtgtagacataca

SEQ ID NO: 581520 - DNA, 25 bp, Homo sapien
gctccaggtgtagacatacatttac

SEQ ID NO: 581521 - DNA, 25 bp, Homo sapien
aggtgtagacatacatttacatttt

SEQ ID NO: 581522 - DNA, 25 bp, Homo sapien
ttttctagtaggtgtagtccttcct

SEQ ID NO: 581523 - DNA, 25 bp, Homo sapien
ttctagtaggtgtagtccttcctta

SEQ ID NO: 581524 - DNA, 25 bp, Homo sapien
ctagtaggtgtagtccttccttaat

SEQ ID NO: 581525 - DNA, 25 bp, Homo sapien
tagtaggtgtagtccttccttaatt

SEQ ID NO: 581526 - DNA, 25 bp, Homo sapien
taggtgtagtccttccttaatttca

SEQ ID NO: 581527 - DNA, 25 bp, Homo sapien
aaatgctttatagtttagggcagtg

SEQ ID NO: 581528 - DNA, 25 bp, Homo sapien
gctttatagtttagggcagtggaag

SEQ ID NO: 581529 - DNA, 25 bp, Homo sapien
ggaaggctggcatcaaaatattttg

SEQ ID NO: 581530 - DNA, 25 bp, Homo sapien
gaaggctggcatcaaaatattttga

SEQ ID NO: 581531 - DNA, 25 bp, Homo sapien
aagatgacaatgtaaaggctcagtt

SEQ ID NO: 581532 - DNA, 25 bp, Homo sapien
caatgtaaaggctcagttgtggcag

SEQ ID NO: 581533 - DNA, 25 bp, Homo sapien
tacctgagggtgcctccaaatgtat

SEQ ID NO: 581534 - DNA, 25 bp, Homo sapien
acctgagggtgcctccaaatgtata

SEQ ID NO: 581535 - DNA, 25 bp, Homo sapien
ctccaaatgtatatcatttcactcc

SEQ ID NO: 581536 - DNA, 25 bp, Homo sapien
tccaaatgtatatcatttcactccc

SEQ ID NO: 581537 - DNA, 25 bp, Homo sapien
ccaaatgtatatcatttcactcccc

SEQ ID NO: 581538 - DNA, 25 bp, Homo sapien
caaatgtatatcatttcactcccct

SEQ ID NO: 581539 - DNA, 25 bp, Homo sapien
aaatgtatatcatttcactcccctc

SEQ ID NO: 581540 - DNA, 25 bp, Homo sapien
aatgtatatcatttcactcccctcc

SEQ ID NO: 581541 - DNA, 25 bp, Homo sapien
atgtatatcatttcactcccctccc

SEQ ID NO: 581542 - DNA, 25 bp, Homo sapien
tgtatatcatttcactcccctcccc

SEQ ID NO: 581543 - DNA, 25 bp, Homo sapien
gtatatcatttcactcccctcccct

SEQ ID NO: 581544 - DNA, 25 bp, Homo sapien
gatgaggagcctttggactggcaat

SEQ ID NO: 581545 - DNA, 25 bp, Homo sapien
gactggcaattaaatgctgcagcct

SEQ ID NO: 581546 - DNA, 25 bp, Homo sapien
aatgctgcagcctagaagggacaca

SEQ ID NO: 581547 - DNA, 25 bp, Homo sapien
gaagggacacactcatttcctttca

SEQ ID NO: 581548 - DNA, 25 bp, Homo sapien
acactcatttcctttcacaatctat

SEQ ID NO: 581549 - DNA, 25 bp, Homo sapien
tagtcaaaagtgatggtccccaaaa

SEQ ID NO: 581550 - DNA, 25 bp, Homo sapien
ggctgagcactagaagattctgcca

SEQ ID NO: 581551 - DNA, 25 bp, Homo sapien
ctagaagattctgccacagtccctg

SEQ ID NO: 581552 - DNA, 25 bp, Homo sapien
acagtccctgctatggatgagtcct

SEQ ID NO: 581553 - DNA, 25 bp, Homo sapien
gctatggatgagtcctcctcccctt

SEQ ID NO: 581554 - DNA, 25 bp, Homo sapien
gaaaggaagccctccgcaattccat

SEQ ID NO: 581555 - DNA, 25 bp, Homo sapien
tcaacaagaagaacgctctcatccg

SEQ ID NO: 581556 - DNA, 25 bp, Homo sapien
gaagaacgctctcatccggaggcag

SEQ ID NO: 581557 - DNA, 25 bp, Homo sapien
tgcagctgctgtgagtgctggcccc

SEQ ID NO: 581558 - DNA, 25 bp, Homo sapien
agctactttggttagagttcttcac

SEQ ID NO: 581559 - DNA, 25 bp, Homo sapien
ttggttagagttcttcactactttc

SEQ ID NO: 581560 - DNA, 25 bp, Homo sapien
cttcactactttcttattcctacag

SEQ ID NO: 581561 - DNA, 25 bp, Homo sapien
attcctacagagatctttttgacaa

SEQ ID NO: 581562 - DNA, 25 bp, Homo sapien
ttttgacaaacgattcctcttccat

SEQ ID NO: 581563 - DNA, 25 bp, Homo sapien
tgacaaacgattcctcttccatctt

SEQ ID NO: 581564 - DNA, 25 bp, Homo sapien
tcctcttccatcttactgtttttgt

SEQ ID NO: 581565 - DNA, 25 bp, Homo sapien
ttccatcttactgtttttgtcctaa

SEQ ID NO: 581566 - DNA, 25 bp, Homo sapien
tcagtttcccacctgcagatgggtg

SEQ ID NO: 581567 - DNA, 25 bp, Homo sapien
cacccacagggttgtaccacacgga

SEQ ID NO: 581568 - DNA, 25 bp, Homo sapien
acagggttgtaccacacggacgctt

SEQ ID NO: 581569 - DNA, 25 bp, Homo sapien
ggttgtaccacacggacgcttctct

SEQ ID NO: 581570 - DNA, 25 bp, Homo sapien
cgctgcagccttcgctttaacagtg

SEQ ID NO: 581571 - DNA, 25 bp, Homo sapien
gcagccttcgctttaacagtgcaac

SEQ ID NO: 581572 - DNA, 25 bp, Homo sapien
gccttcgctttaacagtgcaaccct

SEQ ID NO: 581573 - DNA, 25 bp, Homo sapien
aggcaggctgcacccatctcacaga

SEQ ID NO: 581574 - DNA, 25 bp, Homo sapien
gaaactgaggccgaggctgcacaga

SEQ ID NO: 581575 - DNA, 25 bp, Homo sapien
gctgcacagaggagcctccgggact

SEQ ID NO: 581576 - DNA, 25 bp, Homo sapien
aggtcaccgtgaagacggccgccgc

SEQ ID NO: 581577 - DNA, 25 bp, Homo sapien
gtgctcctcaatcctgtgagtgctc

SEQ ID NO: 581578 - DNA, 25 bp, Homo sapien
tgctcctcaatcctgtgagtgctcc

SEQ ID NO: 581579 - DNA, 25 bp, Homo sapien
gctcctcaatcctgtgagtgctcca

SEQ ID NO: 581580 - DNA, 25 bp, Homo sapien
tcctcaatcctgtgagtgctccaca

SEQ ID NO: 581581 - DNA, 25 bp, Homo sapien
ctcaatcctgtgagtgctccacagc

SEQ ID NO: 581582 - DNA, 25 bp, Homo sapien
atcctgtgagtgctccacagcccat

SEQ ID NO: 581583 - DNA, 25 bp, Homo sapien
tgtgagtgctccacagcccatggct

SEQ ID NO: 581584 - DNA, 25 bp, Homo sapien
gtgagtgctccacagcccatggctg

SEQ ID NO: 581585 - DNA, 25 bp, Homo sapien
tgagtgctccacagcccatggctgc

SEQ ID NO: 581586 - DNA, 25 bp, Homo sapien
agtgctccacagcccatggctgctg

SEQ ID NO: 581587 - DNA, 25 bp, Homo sapien
gagaggcatgagtgagtgcctggca

SEQ ID NO: 581588 - DNA, 25 bp, Homo sapien
tgcattagccattagtcagagttgt

SEQ ID NO: 581589 - DNA, 25 bp, Homo sapien
tagccattagtcagagttgtttttt

SEQ ID NO: 581590 - DNA, 25 bp, Homo sapien
gaaaaagttgtaatgccttggaagt

SEQ ID NO: 581591 - DNA, 25 bp, Homo sapien
gtaatgccttggaagttattctctt

SEQ ID NO: 581592 - DNA, 25 bp, Homo sapien
ttctcttttctatagattgtgttca

SEQ ID NO: 581593 - DNA, 25 bp, Homo sapien
gatgtgtatacttgcaataaggttt

SEQ ID NO: 581594 - DNA, 25 bp, Homo sapien
caataaggtttatgttaaggtggct

SEQ ID NO: 581595 - DNA, 25 bp, Homo sapien
ggtggctttaacaattggttgctat

SEQ ID NO: 581596 - DNA, 25 bp, Homo sapien
tttccttctttagtcaatatgactt

SEQ ID NO: 581597 - DNA, 25 bp, Homo sapien
gactttgatgtcattaactgctaag

SEQ ID NO: 581598 - DNA, 25 bp, Homo sapien
attaactgctaagtgttattttcta

SEQ ID NO: 581599 - DNA, 25 bp, Homo sapien
cacccacagggttgtaccacacgga

SEQ ID NO: 581600 - DNA, 25 bp, Homo sapien
acagggttgtaccacacggacgctt

SEQ ID NO: 581601 - DNA, 25 bp, Homo sapien
agggttgtaccacacggacgcttct

SEQ ID NO: 581602 - DNA, 25 bp, Homo sapien
ggttgtaccacacggacgcttctct

SEQ ID NO: 581603 - DNA, 25 bp, Homo sapien
cgctgcagccttcgctttaacagtg

SEQ ID NO: 581604 - DNA, 25 bp, Homo sapien
gcagccttcgctttaacagtgcaac

SEQ ID NO: 581605 - DNA, 25 bp, Homo sapien
gccttcgctttaacagtgcaaccct

SEQ ID NO: 581606 - DNA, 25 bp, Homo sapien
aggcaggctgcacccatctcacaga

SEQ ID NO: 581607 - DNA, 25 bp, Homo sapien
ccgaggctgcacagaggagcctccg

SEQ ID NO: 581608 - DNA, 25 bp, Homo sapien
aggtcaccgtgaagacggccgccgc

SEQ ID NO: 581609 - DNA, 25 bp, Homo sapien
tcaccgtgaagacggccgccgcgtt

SEQ ID NO: 581610 - DNA, 25 bp, Homo sapien
aatgaaactggagtactaacgtaca

SEQ ID NO: 581611 - DNA, 25 bp, Homo sapien
tgaaactggagtactaacgtacagt

SEQ ID NO: 581612 - DNA, 25 bp, Homo sapien
gaaactggagtactaacgtacagtt

SEQ ID NO: 581613 - DNA, 25 bp, Homo sapien
tggagtactaacgtacagtttaaag

SEQ ID NO: 581614 - DNA, 25 bp, Homo sapien
tgagttcatgcatgtgttaaattgc

SEQ ID NO: 581615 - DNA, 25 bp, Homo sapien
gagttcatgcatgtgttaaattgct

SEQ ID NO: 581616 - DNA, 25 bp, Homo sapien
agttcatgcatgtgttaaattgctt

SEQ ID NO: 581617 - DNA, 25 bp, Homo sapien
gttcatgcatgtgttaaattgcttt

SEQ ID NO: 581618 - DNA, 25 bp, Homo sapien
tcatgcatgtgttaaattgctttac

SEQ ID NO: 581619 - DNA, 25 bp, Homo sapien
taaattgctttactgtagtaatcat

SEQ ID NO: 581620 - DNA, 25 bp, Homo sapien
aaattgctttactgtagtaatcatt

SEQ ID NO: 581621 - DNA, 25 bp, Homo sapien
tacctccctacagacagagccacaa

SEQ ID NO: 581622 - DNA, 25 bp, Homo sapien
tggcaaagcaaccttctgatgtaag

SEQ ID NO: 581623 - DNA, 25 bp, Homo sapien
gcaaagcaaccttctgatgtaagtt

SEQ ID NO: 581624 - DNA, 25 bp, Homo sapien
agcaaccttctgatgtaagttctga

SEQ ID NO: 581625 - DNA, 25 bp, Homo sapien
aaccttctgatgtaagttctgagtg

SEQ ID NO: 581626 - DNA, 25 bp, Homo sapien
tctgatgtaagttctgagtgtgacc

SEQ ID NO: 581627 - DNA, 25 bp, Homo sapien
atgtaagttctgagtgtgaccgaga

SEQ ID NO: 581628 - DNA, 25 bp, Homo sapien
agttctgagtgtgaccgagaaggta

SEQ ID NO: 581629 - DNA, 25 bp, Homo sapien
gaccgagaaggtagacaattgcagc

SEQ ID NO: 581630 - DNA, 25 bp, Homo sapien
aaggtagacaattgcagcctgcgga

SEQ ID NO: 581631 - DNA, 25 bp, Homo sapien
tagacaattgcagcctgcggagagg

SEQ ID NO: 581632 - DNA, 25 bp, Homo sapien
tacacaatgtagtgaataccaggag

SEQ ID NO: 581633 - DNA, 25 bp, Homo sapien
gagctagtgtagaagctgcctacca

SEQ ID NO: 581634 - DNA, 25 bp, Homo sapien
tagaagctgcctaccacagtgagta

SEQ ID NO: 581635 - DNA, 25 bp, Homo sapien
gctgcctaccacagtgagtagtatt

SEQ ID NO: 581636 - DNA, 25 bp, Homo sapien
ttacatgaatataccagaatgtctg

SEQ ID NO: 581637 - DNA, 25 bp, Homo sapien
agaatgtctgaatccacccaactgg

SEQ ID NO: 581638 - DNA, 25 bp, Homo sapien
tgtctgaatccacccaactgggcat

SEQ ID NO: 581639 - DNA, 25 bp, Homo sapien
acccaactgggcatagacgtttgtg

SEQ ID NO: 581640 - DNA, 25 bp, Homo sapien
gggcatagacgtttgtgttcattca

SEQ ID NO: 581641 - DNA, 25 bp, Homo sapien
gacgtttgtgttcattcaagataca

SEQ ID NO: 581642 - DNA, 25 bp, Homo sapien
gttcattcaagatacagactattat

SEQ ID NO: 581643 - DNA, 25 bp, Homo sapien
ggcagcagtcacactgcagtcccag

SEQ ID NO: 581644 - DNA, 25 bp, Homo sapien
ggggttcatcaagggccagtacaga

SEQ ID NO: 581645 - DNA, 25 bp, Homo sapien
tggagatcttgctggactcagggcc

SEQ ID NO: 581646 - DNA, 25 bp, Homo sapien
gagatcttgctggactcagggcctt

SEQ ID NO: 581647 - DNA, 25 bp, Homo sapien
agatcttgctggactcagggccttg

SEQ ID NO: 581648 - DNA, 25 bp, Homo sapien
atcttgctggactcagggccttgca

SEQ ID NO: 581649 - DNA, 25 bp, Homo sapien
ttgctggactcagggccttgcattg

SEQ ID NO: 581650 - DNA, 25 bp, Homo sapien
tggactcagggccttgcattgtgac

SEQ ID NO: 581651 - DNA, 25 bp, Homo sapien
gactcagggccttgcattgtgacag

SEQ ID NO: 581652 - DNA, 25 bp, Homo sapien
actcagggccttgcattgtgacaga

SEQ ID NO: 581653 - DNA, 25 bp, Homo sapien
ctcagggccttgcattgtgacagag

SEQ ID NO: 581654 - DNA, 25 bp, Homo sapien
gcactgccgagtggctgtcctttga

SEQ ID NO: 581655 - DNA, 25 bp, Homo sapien
tgtcctttgatgtcactgacactgt

SEQ ID NO: 581656 - DNA, 25 bp, Homo sapien
gtcactgacactgtgcgtgagtggc

SEQ ID NO: 581657 - DNA, 25 bp, Homo sapien
gaagagagtccaacttaggtctaga

SEQ ID NO: 581658 - DNA, 25 bp, Homo sapien
ttaggtctagaaatcagcattcact

SEQ ID NO: 581659 - DNA, 25 bp, Homo sapien
tttcagcccaatggagatatcctgg

SEQ ID NO: 581660 - DNA, 25 bp, Homo sapien
agatatcctggaaaacattcacgag

SEQ ID NO: 581661 - DNA, 25 bp, Homo sapien
aatcaaattcaaaggcgtggacaat

SEQ ID NO: 581662 - DNA, 25 bp, Homo sapien
gacaatgaggatgaccatggccgtg

SEQ ID NO: 581663 - DNA, 25 bp, Homo sapien
agaaggatcaccacaaccctcatct

SEQ ID NO: 581664 - DNA, 25 bp, Homo sapien
caaccctcatctaatcctcatgatg

SEQ ID NO: 581665 - DNA, 25 bp, Homo sapien
ggaaagctctctatgtactgatatg

SEQ ID NO: 581666 - DNA, 25 bp, Homo sapien
gctctctatgtactgatatgatctt

SEQ ID NO: 581667 - DNA, 25 bp, Homo sapien
atgttgtatgcttacatttgtgtaa

SEQ ID NO: 581668 - DNA, 25 bp, Homo sapien
taaaaatccgttgccctatacaaga

SEQ ID NO: 581669 - DNA, 25 bp, Homo sapien
gccctatacaagacatatctccgga

SEQ ID NO: 581670 - DNA, 25 bp, Homo sapien
gacatatctccggaaggatacctaa

SEQ ID NO: 581671 - DNA, 25 bp, Homo sapien
gaaactttaacactcatttcccctg

SEQ ID NO: 581672 - DNA, 25 bp, Homo sapien
ttaacactcatttcccctgtgaaag

SEQ ID NO: 581673 - DNA, 25 bp, Homo sapien
aaagcatttctcctcatctaaagca

SEQ ID NO: 581674 - DNA, 25 bp, Homo sapien
gcatttctcctcatctaaagcagag

SEQ ID NO: 581675 - DNA, 25 bp, Homo sapien
gcatcttttgaatttggaactatat

SEQ ID NO: 581676 - DNA, 25 bp, Homo sapien
gggcatgatagtgagaacccatatc

SEQ ID NO: 581677 - DNA, 25 bp, Homo sapien
tgatagtgagaacccatatctaaaa

SEQ ID NO: 581678 - DNA, 25 bp, Homo sapien
tggcatgcacctatatagtctgagc

SEQ ID NO: 581679 - DNA, 25 bp, Homo sapien
gcatgcacctatatagtctgagcta

SEQ ID NO: 581680 - DNA, 25 bp, Homo sapien
tgcacctatatagtctgagctacgt

SEQ ID NO: 581681 - DNA, 25 bp, Homo sapien
acctatatagtctgagctacgtggg

SEQ ID NO: 581682 - DNA, 25 bp, Homo sapien
tatatagtctgagctacgtgggagg

SEQ ID NO: 581683 - DNA, 25 bp, Homo sapien
gtgagctgttattgaggtgctgcac

SEQ ID NO: 581684 - DNA, 25 bp, Homo sapien
gagctgttattgaggtgctgcactc

SEQ ID NO: 581685 - DNA, 25 bp, Homo sapien
gctgttattgaggtgctgcactcta

SEQ ID NO: 581686 - DNA, 25 bp, Homo sapien
gttattgaggtgctgcactctagcc

SEQ ID NO: 581687 - DNA, 25 bp, Homo sapien
catccaatttgcagttcagttcagt

SEQ ID NO: 581688 - DNA, 25 bp, Homo sapien
gttcagttcagttaattatgccatt

SEQ ID NO: 581689 - DNA, 25 bp, Homo sapien
attatgccattgtagaccttccgtt

SEQ ID NO: 581690 - DNA, 25 bp, Homo sapien
agaccttccgtttgaggcttgcaaa

SEQ ID NO: 581691 - DNA, 25 bp, Homo sapien
atattatccataaagcagccaccat

SEQ ID NO: 581692 - DNA, 25 bp, Homo sapien
ttgaagccattcaccggagatgtca

SEQ ID NO: 581693 - DNA, 25 bp, Homo sapien
gagatgtcagcgtctgttggactcc

SEQ ID NO: 581694 - DNA, 25 bp, Homo sapien
tggactccgctcacatcgagacaag

SEQ ID NO: 581695 - DNA, 25 bp, Homo sapien
tgtcagaacagccactgcttctcca

SEQ ID NO: 581696 - DNA, 25 bp, Homo sapien
tctccacatttgatcctggctcgga

SEQ ID NO: 581697 - DNA, 25 bp, Homo sapien
ggagcaatgcctgtctatatcttta

SEQ ID NO: 581698 - DNA, 25 bp, Homo sapien
gattaagacaacaatgaacttaaga

SEQ ID NO: 581699 - DNA, 25 bp, Homo sapien
attaagacaacaatgaacttaagac

SEQ ID NO: 581700 - DNA, 25 bp, Homo sapien
ttaagacaacaatgaacttaagacc

SEQ ID NO: 581701 - DNA, 25 bp, Homo sapien
taagacaacaatgaacttaagaccc

SEQ ID NO: 581702 - DNA, 25 bp, Homo sapien
aagacaacaatgaacttaagaccca

SEQ ID NO: 581703 - DNA, 25 bp, Homo sapien
gaacttaagacccagccactgctgg

SEQ ID NO: 581704 - DNA, 25 bp, Homo sapien
cactgctggagaatatctgcctgtg

SEQ ID NO: 581705 - DNA, 25 bp, Homo sapien
actgctggagaatatctgcctgtga

SEQ ID NO: 581706 - DNA, 25 bp, Homo sapien
atgtgtttttcgtgtgtatttcaaa

SEQ ID NO: 581707 - DNA, 25 bp, Homo sapien
gaataatttgtcctgtcctgaggtt

SEQ ID NO: 581708 - DNA, 25 bp, Homo sapien
tagcttttaggaaagcagggcctta

SEQ ID NO: 581709 - DNA, 25 bp, Homo sapien
cagggccttaggaggaaagtcgtct

SEQ ID NO: 581710 - DNA, 25 bp, Homo sapien
agtcgtcttttagactgtgtcctca

SEQ ID NO: 581711 - DNA, 25 bp, Homo sapien
gactgtgtcctcaggatagattata

SEQ ID NO: 581712 - DNA, 25 bp, Homo sapien
taggatagagaaaaccctgggttgt

SEQ ID NO: 581713 - DNA, 25 bp, Homo sapien
cctgggttgtgtaccttttgagcta

SEQ ID NO: 581714 - DNA, 25 bp, Homo sapien
ggttgtgtaccttttgagctaaaat

SEQ ID NO: 581715 - DNA, 25 bp, Homo sapien
agtcataattcatgctatgtattag

SEQ ID NO: 581716 - DNA, 25 bp, Homo sapien
ctatgtattagtcagcttttgctgt

SEQ ID NO: 581717 - DNA, 25 bp, Homo sapien
gcagcagaggaagatcttgtctcga

SEQ ID NO: 581718 - DNA, 25 bp, Homo sapien
aaggcagtaggcgaatataattcaa

SEQ ID NO: 581719 - DNA, 25 bp, Homo sapien
aaactttgtggagtcatctaatgcc

SEQ ID NO: 581720 - DNA, 25 bp, Homo sapien
tgtggagtcatctaatgccagggac

SEQ ID NO: 581721 - DNA, 25 bp, Homo sapien
gagtcatctaatgccagggacatag

SEQ ID NO: 581722 - DNA, 25 bp, Homo sapien
tgccagggacataggtggaccgcac

SEQ ID NO: 581723 - DNA, 25 bp, Homo sapien
ggtggaccgcacctaatgatgatga

SEQ ID NO: 581724 - DNA, 25 bp, Homo sapien
ggaccgcacctaatgatgatgaaaa

SEQ ID NO: 581725 - DNA, 25 bp, Homo sapien
taagactattaatgaagcagttcac

SEQ ID NO: 581726 - DNA, 25 bp, Homo sapien
gaagcagttcacatcagccttttga

SEQ ID NO: 581727 - DNA, 25 bp, Homo sapien
gcagttcacatcagccttttgatac

SEQ ID NO: 581728 - DNA, 25 bp, Homo sapien
gtgtcacaaggtcaagtaactagta

SEQ ID NO: 581729 - DNA, 25 bp, Homo sapien
ggcaggccaagatagaaatctgttt

SEQ ID NO: 581730 - DNA, 25 bp, Homo sapien
cttaatgactaagaagcgtgcgcag

SEQ ID NO: 581731 - DNA, 25 bp, Homo sapien
gagatccatttgtaccaatagcatg

SEQ ID NO: 581732 - DNA, 25 bp, Homo sapien
agcatggaagattgactttgtttca

SEQ ID NO: 581733 - DNA, 25 bp, Homo sapien
gactttgtttcagggaatcgcgttt

SEQ ID NO: 581734 - DNA, 25 bp, Homo sapien
tcagggaatcgcgttttttcataaa

SEQ ID NO: 581735 - DNA, 25 bp, Homo sapien
gggattaacccacctcacatatttt

SEQ ID NO: 581736 - DNA, 25 bp, Homo sapien
ccacctcacatattttctccaaagt

SEQ ID NO: 581737 - DNA, 25 bp, Homo sapien
taagaatagactgaacctgggctcc

SEQ ID NO: 581738 - DNA, 25 bp, Homo sapien
tccccactgcacaagataaaaaact

SEQ ID NO: 581739 - DNA, 25 bp, Homo sapien
aagggttcataaaaatatcttcaga

SEQ ID NO: 581740 - DNA, 25 bp, Homo sapien
atcttcagaagtttaatacattcag

SEQ ID NO: 581741 - DNA, 25 bp, Homo sapien
gaatatatccaattagcattagtgg

SEQ ID NO: 581742 - DNA, 25 bp, Homo sapien
agcattagtggatttctaatttcac

SEQ ID NO: 581743 - DNA, 25 bp, Homo sapien
ctaatttcacttgacacattcatca

SEQ ID NO: 581744 - DNA, 25 bp, Homo sapien
attttgcttttgaagtagtgttctg

SEQ ID NO: 581745 - DNA, 25 bp, Homo sapien
tagtgttctgtttaaactggcgctc

SEQ ID NO: 581746 - DNA, 25 bp, Homo sapien
ttctgtttaaactggcgctctggtc

SEQ ID NO: 581747 - DNA, 25 bp, Homo sapien
aaactggcgctctggtctgatggaa

SEQ ID NO: 581748 - DNA, 25 bp, Homo sapien
ctggcgctctggtctgatggaactg

SEQ ID NO: 581749 - DNA, 25 bp, Homo sapien
tctggtctgatggaactgtgtattt

SEQ ID NO: 581750 - DNA, 25 bp, Homo sapien
ccggcctcctaggaagcagcggcag

SEQ ID NO: 581751 - DNA, 25 bp, Homo sapien
agcggcagcttcaaggcctgcagcg

SEQ ID NO: 581752 - DNA, 25 bp, Homo sapien
aaggcctgcagcgtggcgggctcct

SEQ ID NO: 581753 - DNA, 25 bp, Homo sapien
tggcgcgcagcgactcagagaacgt

SEQ ID NO: 581754 - DNA, 25 bp, Homo sapien
cgcgcagcgactcagagaacgtcta

SEQ ID NO: 581755 - DNA, 25 bp, Homo sapien
gcagcgactcagagaacgtctacga

SEQ ID NO: 581756 - DNA, 25 bp, Homo sapien
gactcagagaacgtctacgaggtca

SEQ ID NO: 581757 - DNA, 25 bp, Homo sapien
gagaacgtctacgaggtcatccagg

SEQ ID NO: 581758 - DNA, 25 bp, Homo sapien
cgaggtcatccaggacttgcacgtc

SEQ ID NO: 581759 - DNA, 25 bp, Homo sapien
ggtcatccaggacttgcacgtcccg

SEQ ID NO: 581760 - DNA, 25 bp, Homo sapien
ggaggagagcgcagagcaggtacct

SEQ ID NO: 581761 - DNA, 25 bp, Homo sapien
gaactcccatgtatccatcatccag

SEQ ID NO: 581762 - DNA, 25 bp, Homo sapien
tatccatcatccagcctcaatagtg

SEQ ID NO: 581763 - DNA, 25 bp, Homo sapien
tccagcctcaatagtgatcaaccca

SEQ ID NO: 581764 - DNA, 25 bp, Homo sapien
tagtgatcaacccatagcatattgt

SEQ ID NO: 581765 - DNA, 25 bp, Homo sapien
tgtggttcatgttgacactcatcca

SEQ ID NO: 581766 - DNA, 25 bp, Homo sapien
atgttgacactcatccacctctttc

SEQ ID NO: 581767 - DNA, 25 bp, Homo sapien
ttgagacgaatgagatcctgggatt

SEQ ID NO: 581768 - DNA, 25 bp, Homo sapien
gagatcctgggatttcgtgaaaata

SEQ ID NO: 581769 - DNA, 25 bp, Homo sapien
aagatttcccaaagcatgatcccca

SEQ ID NO: 581770 - DNA, 25 bp, Homo sapien
aagcatgatccccagaaacctagtc

SEQ ID NO: 581771 - DNA, 25 bp, Homo sapien
tccccagaaacctagtcctgcaaaa

SEQ ID NO: 581772 - DNA, 25 bp, Homo sapien
ctttcactttatttttgccattctt

SEQ ID NO: 581773 - DNA, 25 bp, Homo sapien
ttcactttatttttgccattcttca

SEQ ID NO: 581774 - DNA, 25 bp, Homo sapien
gccattcttcaagaagttgctgtat

SEQ ID NO: 581775 - DNA, 25 bp, Homo sapien
agttgctgtatatttcagtctggtt

SEQ ID NO: 581776 - DNA, 25 bp, Homo sapien
tatttcagtctggttataccttcaa

SEQ ID NO: 581777 - DNA, 25 bp, Homo sapien
cagtctggttataccttcaattgat

SEQ ID NO: 581778 - DNA, 25 bp, Homo sapien
ctggttataccttcaattgatcaat

SEQ ID NO: 581779 - DNA, 25 bp, Homo sapien
cttcaattataggaaaggcatcttc

SEQ ID NO: 581780 - DNA, 25 bp, Homo sapien
ataggaaaggcatcttctataattt

SEQ ID NO: 581781 - DNA, 25 bp, Homo sapien
agccttggattatacttaaaaattg

SEQ ID NO: 581782 - DNA, 25 bp, Homo sapien
atattaaacatatctgattctgaag

SEQ ID NO: 581783 - DNA, 25 bp, Homo sapien
ccccaagctgatctggtggtgcatc

SEQ ID NO: 581784 - DNA, 25 bp, Homo sapien
cccaagctgatctggtggtgcatcc

SEQ ID NO: 581785 - DNA, 25 bp, Homo sapien
ccaagctgatctggtggtgcatcca

SEQ ID NO: 581786 - DNA, 25 bp, Homo sapien
caagctgatctggtggtgcatccac

SEQ ID NO: 581787 - DNA, 25 bp, Homo sapien
aagctgatctggtggtgcatccacg

SEQ ID NO: 581788 - DNA, 25 bp, Homo sapien
agctgatctggtggtgcatccacgc

SEQ ID NO: 581789 - DNA, 25 bp, Homo sapien
gctgatctggtggtgcatccacgca

SEQ ID NO: 581790 - DNA, 25 bp, Homo sapien
ctgatctggtggtgcatccacgcac

SEQ ID NO: 581791 - DNA, 25 bp, Homo sapien
gccaggagccattggaggtcactct

SEQ ID NO: 581792 - DNA, 25 bp, Homo sapien
tggaggtcactctgcttcacgtgga

SEQ ID NO: 581793 - DNA, 25 bp, Homo sapien
ttcacgtggactgggcatgcccctg

SEQ ID NO: 581794 - DNA, 25 bp, Homo sapien
aacgtgaccgtgagcgagatgccgc

SEQ ID NO: 581795 - DNA, 25 bp, Homo sapien
gcgagatgccgctcatcatcatggg

SEQ ID NO: 581796 - DNA, 25 bp, Homo sapien
tgctgcgccccgatagctttgtggg

SEQ ID NO: 581797 - DNA, 25 bp, Homo sapien
cgatagctttgtgggcgcatcgagt

SEQ ID NO: 581798 - DNA, 25 bp, Homo sapien
agtgcccgccgggtcaggaagcttc

SEQ ID NO: 581799 - DNA, 25 bp, Homo sapien
ggaagcttcgtgaggtcatgcacaa

SEQ ID NO: 581800 - DNA, 25 bp, Homo sapien
aagacctgtgacgtcctcaaggagt

SEQ ID NO: 581801 - DNA, 25 bp, Homo sapien
caaggagtttcttggcttgcactga

SEQ ID NO: 581802 - DNA, 25 bp, Homo sapien
ccagcagatacttcatcgtcatcat

SEQ ID NO: 581803 - DNA, 25 bp, Homo sapien
tcatcatcatcatcggaaagggaga

SEQ ID NO: 581804 - DNA, 25 bp, Homo sapien
gaaagggagaactcaccgccgccaa

SEQ ID NO: 581805 - DNA, 25 bp, Homo sapien
agcaaggatgactgacagccacagg

SEQ ID NO: 581806 - DNA, 25 bp, Homo sapien
cacaggcccctttgagtgactccag

SEQ ID NO: 581807 - DNA, 25 bp, Homo sapien
ttgagtgactccagcacaggctacc

SEQ ID NO: 581808 - DNA, 25 bp, Homo sapien
tccagcacaggctacctagcatgta

SEQ ID NO: 581809 - DNA, 25 bp, Homo sapien
aggctacctagcatgtaggtttcgg

SEQ ID NO: 581810 - DNA, 25 bp, Homo sapien
ggctcagcaggcctgtcagactggg

SEQ ID NO: 581811 - DNA, 25 bp, Homo sapien
aagccctggctggactcagcacagt

SEQ ID NO: 581812 - DNA, 25 bp, Homo sapien
aacactttccgttttcatgcagaat

SEQ ID NO: 581813 - DNA, 25 bp, Homo sapien
gaattcccttctattcctaattggc

SEQ ID NO: 581814 - DNA, 25 bp, Homo sapien
attcccttctattcctaattggctg

SEQ ID NO: 581815 - DNA, 25 bp, Homo sapien
attcctaattggctgagaggtttat

SEQ ID NO: 581816 - DNA, 25 bp, Homo sapien
ggctgagaggtttattttcctttca

SEQ ID NO: 581817 - DNA, 25 bp, Homo sapien
tattttcctttcatgaataggtatt

SEQ ID NO: 581818 - DNA, 25 bp, Homo sapien
tgagatggtgatatgggttttgtct

SEQ ID NO: 581819 - DNA, 25 bp, Homo sapien
gttttgtcttatagcctgttagtat

SEQ ID NO: 581820 - DNA, 25 bp, Homo sapien
gtcttatagcctgttagtatagtaa

SEQ ID NO: 581821 - DNA, 25 bp, Homo sapien
actaacttggtcatggtgcattatt

SEQ ID NO: 581822 - DNA, 25 bp, Homo sapien
ggtgcattattgtttgtatttacta

SEQ ID NO: 581823 - DNA, 25 bp, Homo sapien
tgtatttactactgtattcattttg

SEQ ID NO: 581824 - DNA, 25 bp, Homo sapien
ttttatgaaccatattttttgctgt

SEQ ID NO: 581825 - DNA, 25 bp, Homo sapien
ttgtttaaattttagcatgctttgc

SEQ ID NO: 581826 - DNA, 25 bp, Homo sapien
aaattttagcatgctttgctttgtg

SEQ ID NO: 581827 - DNA, 25 bp, Homo sapien
aattttagcatgctttgctttgtgt

SEQ ID NO: 581828 - DNA, 25 bp, Homo sapien
gcatgctttgctttgtgtatactga

SEQ ID NO: 581829 - DNA, 25 bp, Homo sapien
catgctttgctttgtgtatactgaa

SEQ ID NO: 581830 - DNA, 25 bp, Homo sapien
atgctttgctttgtgtatactgaat

SEQ ID NO: 581831 - DNA, 25 bp, Homo sapien
tgctttgctttgtgtatactgaatt

SEQ ID NO: 581832 - DNA, 25 bp, Homo sapien
gctttgctttgtgtatactgaattt

SEQ ID NO: 581833 - DNA, 25 bp, Homo sapien
ctttgctttgtgtatactgaatttt

SEQ ID NO: 581834 - DNA, 25 bp, Homo sapien
gctttgtgtatactgaatttttgca

SEQ ID NO: 581835 - DNA, 25 bp, Homo sapien
cccctctccaattcatgtgttgaag

SEQ ID NO: 581836 - DNA, 25 bp, Homo sapien
aattcatgtgttgaagccctcgtct

SEQ ID NO: 581837 - DNA, 25 bp, Homo sapien
agccctcgtctccatgtgatggtaa

SEQ ID NO: 581838 - DNA, 25 bp, Homo sapien
gaggtcatgagggttgacccaccat

SEQ ID NO: 581839 - DNA, 25 bp, Homo sapien
gggttgacccaccatgatgggatta

SEQ ID NO: 581840 - DNA, 25 bp, Homo sapien
gcccttatgagaagaggccagaact

SEQ ID NO: 581841 - DNA, 25 bp, Homo sapien
aggccagaacttggttatcctcttc

SEQ ID NO: 581842 - DNA, 25 bp, Homo sapien
cttggttatcctcttccaatgtgag

SEQ ID NO: 581843 - DNA, 25 bp, Homo sapien
gtggctgtctgcaagctagctagag

SEQ ID NO: 581844 - DNA, 25 bp, Homo sapien
tgcaagctagctagagagccctcac

SEQ ID NO: 581845 - DNA, 25 bp, Homo sapien
catctagcctccagactgtaaacaa

SEQ ID NO: 581846 - DNA, 25 bp, Homo sapien
tagatccaagtagtgttaagtagtc

SEQ ID NO: 581847 - DNA, 25 bp, Homo sapien
gatccaagtagtgttaagtagtcat

SEQ ID NO: 581848 - DNA, 25 bp, Homo sapien
ccaagtagtgttaagtagtcataat

SEQ ID NO: 581849 - DNA, 25 bp, Homo sapien
ttttcaattgatgtcctaagactag

SEQ ID NO: 581850 - DNA, 25 bp, Homo sapien
attgatgtcctaagactagaagggt

SEQ ID NO: 581851 - DNA, 25 bp, Homo sapien
gactagaagggtaagcagccttttc

SEQ ID NO: 581852 - DNA, 25 bp, Homo sapien
gaagggtaagcagccttttctaata

SEQ ID NO: 581853 - DNA, 25 bp, Homo sapien
agggtaagcagccttttctaatatt

SEQ ID NO: 581854 - DNA, 25 bp, Homo sapien
gggtaagcagccttttctaatattt

SEQ ID NO: 581855 - DNA, 25 bp, Homo sapien
gtaagcagccttttctaatatttct

SEQ ID NO: 581856 - DNA, 25 bp, Homo sapien
tcttttgctttacaaaggtgataga

SEQ ID NO: 581857 - DNA, 25 bp, Homo sapien
atttgctcatacagcttgaacgttg

SEQ ID NO: 581858 - DNA, 25 bp, Homo sapien
acagcttgaacgttgtatttgcaaa

SEQ ID NO: 581859 - DNA, 25 bp, Homo sapien
gtatttgcaaaattaagccttcgat

SEQ ID NO: 581860 - DNA, 25 bp, Homo sapien
attaagccttcgatttttataaatg

SEQ ID NO: 581861 - DNA, 25 bp, Homo sapien
aagattcctcagaacagtgtcgcaa

SEQ ID NO: 581862 - DNA, 25 bp, Homo sapien
ctcagaacagtgtcgcaagatcttt

SEQ ID NO: 581863 - DNA, 25 bp, Homo sapien
gtcgcaagatctttatttcctctga

SEQ ID NO: 581864 - DNA, 25 bp, Homo sapien
tataatgtgctaactttttaatggc

SEQ ID NO: 581865 - DNA, 25 bp, Homo sapien
atggcaaggcactttcatttgtttt

SEQ ID NO: 581866 - DNA, 25 bp, Homo sapien
caggaatattataagctgttttctt

SEQ ID NO: 581867 - DNA, 25 bp, Homo sapien
ttaattttgcttcttacctaatata

SEQ ID NO: 581868 - DNA, 25 bp, Homo sapien
acatcagatatcgagcaaatggttt

SEQ ID NO: 581869 - DNA, 25 bp, Homo sapien
tggtttgagttacatctagcagcac

SEQ ID NO: 581870 - DNA, 25 bp, Homo sapien
tagcagcactaaaacttattcaact

SEQ ID NO: 581871 - DNA, 25 bp, Homo sapien
acttattcaactttggccaaataca

SEQ ID NO: 581872 - DNA, 25 bp, Homo sapien
tggccaaatacaaatgcgaaattag

SEQ ID NO: 581873 - DNA, 25 bp, Homo sapien
aaaagacagctatagtcaagagctt

SEQ ID NO: 581874 - DNA, 25 bp, Homo sapien
caagagcttgtgttttgtatcggta

SEQ ID NO: 581875 - DNA, 25 bp, Homo sapien
gcttgtgttttgtatcggtatttga

SEQ ID NO: 581876 - DNA, 25 bp, Homo sapien
tatttgatttttagtgggcagatgg

SEQ ID NO: 581877 - DNA, 25 bp, Homo sapien
tattctatagaagagactgcggaca

SEQ ID NO: 581878 - DNA, 25 bp, Homo sapien
gagactgcggacaattagtattcaa

SEQ ID NO: 581879 - DNA, 25 bp, Homo sapien
ctttctgtccagttgtgagcagcca

SEQ ID NO: 581880 - DNA, 25 bp, Homo sapien
tgtccagttgtgagcagccaccaac

SEQ ID NO: 581881 - DNA, 25 bp, Homo sapien
ttgtgagcagccaccaactatgatg

SEQ ID NO: 581882 - DNA, 25 bp, Homo sapien
tgagcagccaccaactatgatgccc

SEQ ID NO: 581883 - DNA, 25 bp, Homo sapien
ttccagcaggctttgctttcacatc

SEQ ID NO: 581884 - DNA, 25 bp, Homo sapien
gcaggctttgctttcacatcacaaa

SEQ ID NO: 581885 - DNA, 25 bp, Homo sapien
tttcacatcacaaagcatcatcctg

SEQ ID NO: 581886 - DNA, 25 bp, Homo sapien
agcatcatcctgagaaacaattaca

SEQ ID NO: 581887 - DNA, 25 bp, Homo sapien
tacagttctttttagagttctggtt

SEQ ID NO: 581888 - DNA, 25 bp, Homo sapien
ggttccttcataggtacctattgtc

SEQ ID NO: 581889 - DNA, 25 bp, Homo sapien
aggtacctattgtcctaataaatgg

SEQ ID NO: 581890 - DNA, 25 bp, Homo sapien
tatttgccattttgacagtcttctg

SEQ ID NO: 581891 - DNA, 25 bp, Homo sapien
agtcttctgatttctgtatagccct

SEQ ID NO: 581892 - DNA, 25 bp, Homo sapien
gatttctgtatagcccttatgactt

SEQ ID NO: 581893 - DNA, 25 bp, Homo sapien
agcccttatgacttttactatccaa

SEQ ID NO: 581894 - DNA, 25 bp, Homo sapien
tatccaacttagtacagttacgttt

SEQ ID NO: 581895 - DNA, 25 bp, Homo sapien
agttacgtttcactgaatgacaggg

SEQ ID NO: 581896 - DNA, 25 bp, Homo sapien
acagggattttgtcattatggaaac

SEQ ID NO: 581897 - DNA, 25 bp, Homo sapien
tggaaacatcatacagtacatctat

SEQ ID NO: 581898 - DNA, 25 bp, Homo sapien
gtacatctatcaaacctagctgcaa

SEQ ID NO: 581899 - DNA, 25 bp, Homo sapien
aacctagctgcaatagcctactata

SEQ ID NO: 581900 - DNA, 25 bp, Homo sapien
gcctactatacacctaagctaaata

SEQ ID NO: 581901 - DNA, 25 bp, Homo sapien
ttgagcccaggagctacgatcgcac

SEQ ID NO: 581902 - DNA, 25 bp, Homo sapien
tgcattctagccttagtgatacagt

SEQ ID NO: 581903 - DNA, 25 bp, Homo sapien
tagccttagtgatacagtgagacct

SEQ ID NO: 581904 - DNA, 25 bp, Homo sapien
gataatgccaaaacctgggtatctt

SEQ ID NO: 581905 - DNA, 25 bp, Homo sapien
atgccaaaacctgggtatcttcctg

SEQ ID NO: 581906 - DNA, 25 bp, Homo sapien
tgggtatcttcctggatttgtgaat

SEQ ID NO: 581907 - DNA, 25 bp, Homo sapien
cttcctggatttgtgaatgacgtac

SEQ ID NO: 581908 - DNA, 25 bp, Homo sapien
gtgaatgacgtacaggtattcattt

SEQ ID NO: 581909 - DNA, 25 bp, Homo sapien
attggtacacattctgtatgctgct

SEQ ID NO: 581910 - DNA, 25 bp, Homo sapien
cattctgtatgctgctgttttcaag

SEQ ID NO: 581911 - DNA, 25 bp, Homo sapien
tttcaagttggcaaattaagcatat

SEQ ID NO: 581912 - DNA, 25 bp, Homo sapien
gtgtccttatgagaagcaaggaaga

SEQ ID NO: 581913 - DNA, 25 bp, Homo sapien
caaggaagagacataaggagaacat

SEQ ID NO: 581914 - DNA, 25 bp, Homo sapien
cataaggagaacatggtgtgacaat

SEQ ID NO: 581915 - DNA, 25 bp, Homo sapien
ggtgtgacaattgagacagagattg

SEQ ID NO: 581916 - DNA, 25 bp, Homo sapien
caagaaatgtcaagggccgtgagcc

SEQ ID NO: 581917 - DNA, 25 bp, Homo sapien
taagagaaaggcatgggactgaccc

SEQ ID NO: 581918 - DNA, 25 bp, Homo sapien
agaaaggcatgggactgaccctccc

SEQ ID NO: 581919 - DNA, 25 bp, Homo sapien
gcatgggactgaccctcccctagag

SEQ ID NO: 581920 - DNA, 25 bp, Homo sapien
cccctagagccatcagaaagagcct

SEQ ID NO: 581921 - DNA, 25 bp, Homo sapien
atcagaaagagcctgaccctggcgg

SEQ ID NO: 581922 - DNA, 25 bp, Homo sapien
cagaaagagcctgaccctggcggca

SEQ ID NO: 581923 - DNA, 25 bp, Homo sapien
taccacattttgcacattcaacaga

SEQ ID NO: 581924 - DNA, 25 bp, Homo sapien
gtttcatctctataaccttgttcct

SEQ ID NO: 581925 - DNA, 25 bp, Homo sapien
tataaccttgttcctggtataccaa

SEQ ID NO: 581926 - DNA, 25 bp, Homo sapien
tggtataccaacaatggaacacttt

SEQ ID NO: 581927 - DNA, 25 bp, Homo sapien
gttttactgttatcttgtctatgaa

SEQ ID NO: 581928 - DNA, 25 bp, Homo sapien
gaatttgacaagttttggtttgaag

SEQ ID NO: 581929 - DNA, 25 bp, Homo sapien
gaaccagaaagcattatgtatttca

SEQ ID NO: 581930 - DNA, 25 bp, Homo sapien
aaaggacttttactggattgtaatg

SEQ ID NO: 581931 - DNA, 25 bp, Homo sapien
ggattgtaatgtagcacttacttta

SEQ ID NO: 581932 - DNA, 25 bp, Homo sapien
taaatcatccactgtatcttctatt

SEQ ID NO: 581933 - DNA, 25 bp, Homo sapien
atcttctatttctaccacattttgc

SEQ ID NO: 581934 - DNA, 25 bp, Homo sapien
gggtaactgaaactgcataaagcaa

SEQ ID NO: 581935 - DNA, 25 bp, Homo sapien
aactgaaactgcataaagcaaaact

SEQ ID NO: 581936 - DNA, 25 bp, Homo sapien
tgaaactgcataaagcaaaactggc

SEQ ID NO: 581937 - DNA, 25 bp, Homo sapien
gaaactgcataaagcaaaactggct

SEQ ID NO: 581938 - DNA, 25 bp, Homo sapien
aaactgcataaagcaaaactggctg

SEQ ID NO: 581939 - DNA, 25 bp, Homo sapien
aactgcataaagcaaaactggctgg

SEQ ID NO: 581940 - DNA, 25 bp, Homo sapien
actgcataaagcaaaactggctggg

SEQ ID NO: 581941 - DNA, 25 bp, Homo sapien
ctgcataaagcaaaactggctgggt

SEQ ID NO: 581942 - DNA, 25 bp, Homo sapien
tgcataaagcaaaactggctgggtg

SEQ ID NO: 581943 - DNA, 25 bp, Homo sapien
gcataaagcaaaactggctgggtgc

SEQ ID NO: 581944 - DNA, 25 bp, Homo sapien
gactttggcaggctgaggtgtgcag

SEQ ID NO: 581945 - DNA, 25 bp, Homo sapien
ttttctccatataccatctgaatac

SEQ ID NO: 581946 - DNA, 25 bp, Homo sapien
tttctccatataccatctgaatact

SEQ ID NO: 581947 - DNA, 25 bp, Homo sapien
tctccatataccatctgaatactaa

SEQ ID NO: 581948 - DNA, 25 bp, Homo sapien
tccatataccatctgaatactaatg

SEQ ID NO: 581949 - DNA, 25 bp, Homo sapien
tttctgaatgagactgatatccata

SEQ ID NO: 581950 - DNA, 25 bp, Homo sapien
ctgaatgagactgatatccataaaa

SEQ ID NO: 581951 - DNA, 25 bp, Homo sapien
gagactgatatccataaaaatgatc

SEQ ID NO: 581952 - DNA, 25 bp, Homo sapien
tttccttgtatactctaactccctg

SEQ ID NO: 581953 - DNA, 25 bp, Homo sapien
ttccttgtatactctaactccctgc

SEQ ID NO: 581954 - DNA, 25 bp, Homo sapien
tccttgtatactctaactccctgct

SEQ ID NO: 581955 - DNA, 25 bp, Homo sapien
tctaactccctgctttctgggcgct

SEQ ID NO: 581956 - DNA, 25 bp, Homo sapien
attactgtttacaaaggcgtggtgt

SEQ ID NO: 581957 - DNA, 25 bp, Homo sapien
aggcgtggtgtgaccttaggattta

SEQ ID NO: 581958 - DNA, 25 bp, Homo sapien
gggagcccaagctttcgatgggtct

SEQ ID NO: 581959 - DNA, 25 bp, Homo sapien
ccaagctttcgatgggtctccaaat

SEQ ID NO: 581960 - DNA, 25 bp, Homo sapien
tcgatgggtctccaaattgtttttt

SEQ ID NO: 581961 - DNA, 25 bp, Homo sapien
aatacatactgagcattgtcactac

SEQ ID NO: 581962 - DNA, 25 bp, Homo sapien
gcattgtcactacaaatccatctga

SEQ ID NO: 581963 - DNA, 25 bp, Homo sapien
aatggatttgtcactactcactcaa

SEQ ID NO: 581964 - DNA, 25 bp, Homo sapien
actcactcaaatccactgagcgagt

SEQ ID NO: 581965 - DNA, 25 bp, Homo sapien
cactgagcgagttggatagaagccc

SEQ ID NO: 581966 - DNA, 25 bp, Homo sapien
agttggatagaagcccgcatggcgt

SEQ ID NO: 581967 - DNA, 25 bp, Homo sapien
aattgctgtgtaatagtccatagtc

SEQ ID NO: 581968 - DNA, 25 bp, Homo sapien
gctgtgtaatagtccatagtctgaa

SEQ ID NO: 581969 - DNA, 25 bp, Homo sapien
gtccatagtctgaatataccacaat

SEQ ID NO: 581970 - DNA, 25 bp, Homo sapien
aaacatttgagttctgtcctccagg

SEQ ID NO: 581971 - DNA, 25 bp, Homo sapien
acatttgagttctgtcctccaggtt

SEQ ID NO: 581972 - DNA, 25 bp, Homo sapien
tgacagaatttccttcctcatcaag

SEQ ID NO: 581973 - DNA, 25 bp, Homo sapien
cagaatttccttcctcatcaaggct

SEQ ID NO: 581974 - DNA, 25 bp, Homo sapien
cttcctcatcaaggctgaatagtat

SEQ ID NO: 581975 - DNA, 25 bp, Homo sapien
ctattgtgaataatcctgcaggttt

SEQ ID NO: 581976 - DNA, 25 bp, Homo sapien
ataatcctgcaggttttattgttat

SEQ ID NO: 581977 - DNA, 25 bp, Homo sapien
aaagctgctgtgaatgttcttgtta

SEQ ID NO: 581978 - DNA, 25 bp, Homo sapien
ccgtcaggttgcacaggtgcatgca

SEQ ID NO: 581979 - DNA, 25 bp, Homo sapien
ggtgcatgcaagagcattcttagga

SEQ ID NO: 581980 - DNA, 25 bp, Homo sapien
tgaaaaacttttgacttgtacgtgt

SEQ ID NO: 581981 - DNA, 25 bp, Homo sapien
gacttgtacgtgttagccttcatga

SEQ ID NO: 581982 - DNA, 25 bp, Homo sapien
gttagccttcatgaaattgcagtac

SEQ ID NO: 581983 - DNA, 25 bp, Homo sapien
tgcagtacagagatgggtccccaaa

SEQ ID NO: 581984 - DNA, 25 bp, Homo sapien
ccccaaagtggagtgtatttacagc

SEQ ID NO: 581985 - DNA, 25 bp, Homo sapien
gttaaattagagacatgcacacaca

SEQ ID NO: 581986 - DNA, 25 bp, Homo sapien
atacaagtcccgttctgtagctctg

SEQ ID NO: 581987 - DNA, 25 bp, Homo sapien
agctctggccctttgaatatgttta

SEQ ID NO: 581988 - DNA, 25 bp, Homo sapien
tgtttaggaagagttgcttcccatt

SEQ ID NO: 581989 - DNA, 25 bp, Homo sapien
gtggttaactgaatgtattctctct

SEQ ID NO: 581990 - DNA, 25 bp, Homo sapien
ggttaactgaatgtattctctctgt

SEQ ID NO: 581991 - DNA, 25 bp, Homo sapien
ctctgtaaatttcaacaagttgctc

SEQ ID NO: 581992 - DNA, 25 bp, Homo sapien
caacaagttgctcataaaattttcc

SEQ ID NO: 581993 - DNA, 25 bp, Homo sapien
gaatacactgtcctttatttagaga

SEQ ID NO: 581994 - DNA, 25 bp, Homo sapien
atacactgtcctttatttagagagt

SEQ ID NO: 581995 - DNA, 25 bp, Homo sapien
actgtcctttatttagagagtgtat

SEQ ID NO: 581996 - DNA, 25 bp, Homo sapien
gtcctttatttagagagtgtatgtt

SEQ ID NO: 581997 - DNA, 25 bp, Homo sapien
gtgtatgtttggaaaatcatcctgt

SEQ ID NO: 581998 - DNA, 25 bp, Homo sapien
gtatgtttggaaaatcatcctgttt

SEQ ID NO: 581999 - DNA, 25 bp, Homo sapien
atgtttggaaaatcatcctgtttat

SEQ ID NO: 582000 - DNA, 25 bp, Homo sapien
cacaaactatgatctctgcagcatt

SEQ ID NO: 582001 - DNA, 25 bp, Homo sapien
tttttcttggaacctctacgctctt

SEQ ID NO: 582002 - DNA, 25 bp, Homo sapien
ctctacgctcttggtttgggttgga

SEQ ID NO: 582003 - DNA, 25 bp, Homo sapien
ggagtcatcagatacctgggttatt

SEQ ID NO: 582004 - DNA, 25 bp, Homo sapien
ggcctcactgccaaaagttcttcgg

SEQ ID NO: 582005 - DNA, 25 bp, Homo sapien
ttcggttttgtgcttgtgctggtat

SEQ ID NO: 582006 - DNA, 25 bp, Homo sapien
gatttatctgggttacacattctgt

SEQ ID NO: 582007 - DNA, 25 bp, Homo sapien
tacacattctgtggctggattgtct

SEQ ID NO: 582008 - DNA, 25 bp, Homo sapien
gtcttaggaccataccatgacaagt

SEQ ID NO: 582009 - DNA, 25 bp, Homo sapien
ctgagtgtctgttttctctggtcaa

SEQ ID NO: 582010 - DNA, 25 bp, Homo sapien
tgttttctctggtcaacggtgatga

SEQ ID NO: 582011 - DNA, 25 bp, Homo sapien
aaatggactaagacggcattttgca

SEQ ID NO: 582012 - DNA, 25 bp, Homo sapien
aatggactaagacggcattttgcat

SEQ ID NO: 582013 - DNA, 25 bp, Homo sapien
atggactaagacggcattttgcata

SEQ ID NO: 582014 - DNA, 25 bp, Homo sapien
tggactaagacggcattttgcatac

SEQ ID NO: 582015 - DNA, 25 bp, Homo sapien
ggactaagacggcattttgcataca

SEQ ID NO: 582016 - DNA, 25 bp, Homo sapien
gactaagacggcattttgcatacat

SEQ ID NO: 582017 - DNA, 25 bp, Homo sapien
actaagacggcattttgcatacatt

SEQ ID NO: 582018 - DNA, 25 bp, Homo sapien
ctaagacggcattttgcatacatta

SEQ ID NO: 582019 - DNA, 25 bp, Homo sapien
taagacggcattttgcatacattat

SEQ ID NO: 582020 - DNA, 25 bp, Homo sapien
aagacggcattttgcatacattatc

SEQ ID NO: 582021 - DNA, 25 bp, Homo sapien
agacggcattttgcatacattatct

SEQ ID NO: 582022 - DNA, 25 bp, Homo sapien
gccaaagtcaagtgaatttctatat

SEQ ID NO: 582023 - DNA, 25 bp, Homo sapien
atttctatatatttgcaatgaacaa

SEQ ID NO: 582024 - DNA, 25 bp, Homo sapien
tgaacaattcaaaatggagttttaa

SEQ ID NO: 582025 - DNA, 25 bp, Homo sapien
tttttatttatgatagtctccaaaa

SEQ ID NO: 582026 - DNA, 25 bp, Homo sapien
ttttatttatgatagtctccaaaat

SEQ ID NO: 582027 - DNA, 25 bp, Homo sapien
tatttatgatagtctccaaaatact

SEQ ID NO: 582028 - DNA, 25 bp, Homo sapien
atgatagtctccaaaatacttttta

SEQ ID NO: 582029 - DNA, 25 bp, Homo sapien
gatagtctccaaaatactttttaag

SEQ ID NO: 582030 - DNA, 25 bp, Homo sapien
tccctcctcggcctgtaattatttc

SEQ ID NO: 582031 - DNA, 25 bp, Homo sapien
tcggcctgtaattatttcttaaaca

SEQ ID NO: 582032 - DNA, 25 bp, Homo sapien
tgtaattatttcttaaacagggcac

SEQ ID NO: 582033 - DNA, 25 bp, Homo sapien
ggatgtggtttgtctcctccaaaat

SEQ ID NO: 582034 - DNA, 25 bp, Homo sapien
atgcatgtagaaacttggtccccaa

SEQ ID NO: 582035 - DNA, 25 bp, Homo sapien
ggagggattaatgcctttctcacag

SEQ ID NO: 582036 - DNA, 25 bp, Homo sapien
tgcctttctcacaggagtgggttaa

SEQ ID NO: 582037 - DNA, 25 bp, Homo sapien
gagtgggttaattctcacagaagtg

SEQ ID NO: 582038 - DNA, 25 bp, Homo sapien
gagttattgagagcagttcattaca

SEQ ID NO: 582039 - DNA, 25 bp, Homo sapien
aaaagtgagtttggcttcctcggct

SEQ ID NO: 582040 - DNA, 25 bp, Homo sapien
ttgcttcctcggctttctcttgctt

SEQ ID NO: 582041 - DNA, 25 bp, Homo sapien
tcaccctacgatgcattctgctgtg

SEQ ID NO: 582042 - DNA, 25 bp, Homo sapien
gatgcattctgctgtgttacaacac

SEQ ID NO: 582043 - DNA, 25 bp, Homo sapien
gtgttacaacacagcacgaggccct

SEQ ID NO: 582044 - DNA, 25 bp, Homo sapien
agagcggtcatgaggcctgcccaag

SEQ ID NO: 582045 - DNA, 25 bp, Homo sapien
gcctgcccaagagtgaggttggtaa

SEQ ID NO: 582046 - DNA, 25 bp, Homo sapien
agggtggcggtccattcccttgtca

SEQ ID NO: 582047 - DNA, 25 bp, Homo sapien
ttgtcacccacgcagaggcagtgtc

SEQ ID NO: 582048 - DNA, 25 bp, Homo sapien
gagtctctgggaagggcctgacaca

SEQ ID NO: 582049 - DNA, 25 bp, Homo sapien
gtggtctgaccattcaagactcagt

SEQ ID NO: 582050 - DNA, 25 bp, Homo sapien
aagactcagtctgcgtcatcagaga

SEQ ID NO: 582051 - DNA, 25 bp, Homo sapien
tgcgtcatcagagaccaggctctta

SEQ ID NO: 582052 - DNA, 25 bp, Homo sapien
gagaccaggctcttagaaaccaact

SEQ ID NO: 582053 - DNA, 25 bp, Homo sapien
tagaaaccaactccatcctgatgtg

SEQ ID NO: 582054 - DNA, 25 bp, Homo sapien
tgatgtgcataacagcctcccaagg

SEQ ID NO: 582055 - DNA, 25 bp, Homo sapien
tttgctaccagatccccgcttttca

SEQ ID NO: 582056 - DNA, 25 bp, Homo sapien
agatccccgcttttcatctttatga

SEQ ID NO: 582057 - DNA, 25 bp, Homo sapien
gatccccgcttttcatctttatgag

SEQ ID NO: 582058 - DNA, 25 bp, Homo sapien
tctttatgagaagatcctccctgct

SEQ ID NO: 582059 - DNA, 25 bp, Homo sapien
tttatgagaagatcctccctgctgt

SEQ ID NO: 582060 - DNA, 25 bp, Homo sapien
tatgagaagatcctccctgctgtct

SEQ ID NO: 582061 - DNA, 25 bp, Homo sapien
agaagatcctccctgctgtctcgat

SEQ ID NO: 582062 - DNA, 25 bp, Homo sapien
tgctgtctcgatcctccagtgggta

SEQ ID NO: 582063 - DNA, 25 bp, Homo sapien
ctgtctcgatcctccagtgggtatt

SEQ ID NO: 582064 - DNA, 25 bp, Homo sapien
atttctcttttgacacagacaggag

SEQ ID NO: 582065 - DNA, 25 bp, Homo sapien
ctcttttgacacagacaggagccca

SEQ ID NO: 582066 - DNA, 25 bp, Homo sapien
tgtattaatgtttctaattctttac

SEQ ID NO: 582067 - DNA, 25 bp, Homo sapien
tactccttcccttttacagaattat

SEQ ID NO: 582068 - DNA, 25 bp, Homo sapien
ttacagaattataactggacatctt

SEQ ID NO: 582069 - DNA, 25 bp, Homo sapien
tggacatcttttgccaggtgacttt

SEQ ID NO: 582070 - DNA, 25 bp, Homo sapien
cttttcagtgccttccactatagta

SEQ ID NO: 582071 - DNA, 25 bp, Homo sapien
agtgccttccactatagtagatgga

SEQ ID NO: 582072 - DNA, 25 bp, Homo sapien
tggaatatacttccccactccattg

SEQ ID NO: 582073 - DNA, 25 bp, Homo sapien
aatatacttccccactccattgagt

SEQ ID NO: 582074 - DNA, 25 bp, Homo sapien
cccactccattgagtccattttttg

SEQ ID NO: 582075 - DNA, 25 bp, Homo sapien
ttgttggctaacctgtagttttaag

SEQ ID NO: 582076 - DNA, 25 bp, Homo sapien
ttggctaacctgtagttttaagatt

SEQ ID NO: 582077 - DNA, 25 bp, Homo sapien
agcagtgtaagcagtacgggtgatt

SEQ ID NO: 582078 - DNA, 25 bp, Homo sapien
gtacgggtgattcttaagcccacat

SEQ ID NO: 582079 - DNA, 25 bp, Homo sapien
tcttaagcccacattgtttgacttc

SEQ ID NO: 582080 - DNA, 25 bp, Homo sapien
gtttgacttccgagacatatcagaa

SEQ ID NO: 582081 - DNA, 25 bp, Homo sapien
agacctatttccagtggcctatgca

SEQ ID NO: 582082 - DNA, 25 bp, Homo sapien
gcctatgcagaagagctaccctgct

SEQ ID NO: 582083 - DNA, 25 bp, Homo sapien
taccctgcttgaatggaaacccctt

SEQ ID NO: 582084 - DNA, 25 bp, Homo sapien
tggaaaccccttaagatacactatt

SEQ ID NO: 582085 - DNA, 25 bp, Homo sapien
acctaagtgcttagcctggcttatg

SEQ ID NO: 582086 - DNA, 25 bp, Homo sapien
ctggcttatggaggaggcaatgcaa

SEQ ID NO: 582087 - DNA, 25 bp, Homo sapien
ggaggcaatgcaatctaccacaaga

SEQ ID NO: 582088 - DNA, 25 bp, Homo sapien
aattaatattagaacctgggtacag

SEQ ID NO: 582089 - DNA, 25 bp, Homo sapien
aacctgggtacaggacagattctga

SEQ ID NO: 582090 - DNA, 25 bp, Homo sapien
gtgaatagtattacataaagcttgg

SEQ ID NO: 582091 - DNA, 25 bp, Homo sapien
taaagcttggtaggaaaatcgcact

SEQ ID NO: 582092 - DNA, 25 bp, Homo sapien
gtaggaaaatcgcactagttcacca

SEQ ID NO: 582093 - DNA, 25 bp, Homo sapien
ggaaaatcgcactagttcaccagta

SEQ ID NO: 582094 - DNA, 25 bp, Homo sapien
aaatcgcactagttcaccagtaatg

SEQ ID NO: 582095 - DNA, 25 bp, Homo sapien
atcgcactagttcaccagtaatgga

SEQ ID NO: 582096 - DNA, 25 bp, Homo sapien
gcactagttcaccagtaatggatcc

SEQ ID NO: 582097 - DNA, 25 bp, Homo sapien
tttacctgaaaaagagttcacgaag

SEQ ID NO: 582098 - DNA, 25 bp, Homo sapien
gagttcacgaagttagttattaagc

SEQ ID NO: 582099 - DNA, 25 bp, Homo sapien
ttcccacttccaacacccacagaag

SEQ ID NO: 582100 - DNA, 25 bp, Homo sapien
ttccaacacccacagaagctgccac

SEQ ID NO: 582101 - DNA, 25 bp, Homo sapien
gctgccacccaagggcccctgtgtc

SEQ ID NO: 582102 - DNA, 25 bp, Homo sapien
gggcccctgtgtccccgcatggccc

SEQ ID NO: 582103 - DNA, 25 bp, Homo sapien
ggcccacctcagcagtatgatgcag

SEQ ID NO: 582104 - DNA, 25 bp, Homo sapien
gcccacctcagcagtatgatgcagc

SEQ ID NO: 582105 - DNA, 25 bp, Homo sapien
ccacctcagcagtatgatgcagcac

SEQ ID NO: 582106 - DNA, 25 bp, Homo sapien
cacctcagcagtatgatgcagcact

SEQ ID NO: 582107 - DNA, 25 bp, Homo sapien
acctcagcagtatgatgcagcactg

SEQ ID NO: 582108 - DNA, 25 bp, Homo sapien
cctcagcagtatgatgcagcactgg

SEQ ID NO: 582109 - DNA, 25 bp, Homo sapien
ctcagcagtatgatgcagcactggg

SEQ ID NO: 582110 - DNA, 25 bp, Homo sapien
ttttttacactgttctatctcacgt

SEQ ID NO: 582111 - DNA, 25 bp, Homo sapien
tttacactgttctatctcacgttga

SEQ ID NO: 582112 - DNA, 25 bp, Homo sapien
tacactgttctatctcacgttgaag

SEQ ID NO: 582113 - DNA, 25 bp, Homo sapien
cactgttctatctcacgttgaagtc

SEQ ID NO: 582114 - DNA, 25 bp, Homo sapien
ctgttctatctcacgttgaagtctt

SEQ ID NO: 582115 - DNA, 25 bp, Homo sapien
gttctatctcacgttgaagtcttcc

SEQ ID NO: 582116 - DNA, 25 bp, Homo sapien
tctatctcacgttgaagtcttcctg

SEQ ID NO: 582117 - DNA, 25 bp, Homo sapien
ctatctcacgttgaagtcttcctgg

SEQ ID NO: 582118 - DNA, 25 bp, Homo sapien
ggcattcaggctagggagaccccaa

SEQ ID NO: 582119 - DNA, 25 bp, Homo sapien
attcaggctagggagaccccaagtc

SEQ ID NO: 582120 - DNA, 25 bp, Homo sapien
caggctagggagaccccaagtcagg

SEQ ID NO: 582121 - DNA, 25 bp, Homo sapien
gtgtgtatggacatctatctgtaat

SEQ ID NO: 582122 - DNA, 25 bp, Homo sapien
aatgcaaagcagttgcgtaatgcaa

SEQ ID NO: 582123 - DNA, 25 bp, Homo sapien
gtgtatggatgtctatctatctgta

SEQ ID NO: 582124 - DNA, 25 bp, Homo sapien
ctatctgtaatgtaaagttcccaag

SEQ ID NO: 582125 - DNA, 25 bp, Homo sapien
gtaaagttcccaagtattgtgtata

SEQ ID NO: 582126 - DNA, 25 bp, Homo sapien
gatgtacgggtgattcctggtgaaa

SEQ ID NO: 582127 - DNA, 25 bp, Homo sapien
aaagcagggaccgtgggcctcatat

SEQ ID NO: 582128 - DNA, 25 bp, Homo sapien
cgtgggcctcatattgagacacatt

SEQ ID NO: 582129 - DNA, 25 bp, Homo sapien
gagacacatttcacgctgtttagat

SEQ ID NO: 582130 - DNA, 25 bp, Homo sapien
cacgctgtttagattgtaatggcaa

SEQ ID NO: 582131 - DNA, 25 bp, Homo sapien
gtaatggcaattatgtatgactttt

SEQ ID NO: 582132 - DNA, 25 bp, Homo sapien
cacacctggcctaacttcaaggtat

SEQ ID NO: 582133 - DNA, 25 bp, Homo sapien
gcctaacttcaaggtatcaaagaca

SEQ ID NO: 582134 - DNA, 25 bp, Homo sapien
aaattaacaatgtctgatgcataca

SEQ ID NO: 582135 - DNA, 25 bp, Homo sapien
gtctgatgcatacataggactgctt

SEQ ID NO: 582136 - DNA, 25 bp, Homo sapien
aggactgctttgtaatcttctacac

SEQ ID NO: 582137 - DNA, 25 bp, Homo sapien
gtaatcttctacactaatgatttgt

SEQ ID NO: 582138 - DNA, 25 bp, Homo sapien
ggtttcagaatccatttataactct

SEQ ID NO: 582139 - DNA, 25 bp, Homo sapien
tgaaaaatttctgccagcttttatt

SEQ ID NO: 582140 - DNA, 25 bp, Homo sapien
ttatgtgggttatatttatgactac

SEQ ID NO: 582141 - DNA, 25 bp, Homo sapien
ttatgactacttctcatttgtaaaa

SEQ ID NO: 582142 - DNA, 25 bp, Homo sapien
aaagatcttgcatatttgtattaat

SEQ ID NO: 582143 - DNA, 25 bp, Homo sapien
gtttggctgcatgatggcctcgtaa

SEQ ID NO: 582144 - DNA, 25 bp, Homo sapien
tgtggtgacgccctctgcgtcttct

SEQ ID NO: 582145 - DNA, 25 bp, Homo sapien
aacagagcagcacattatgcctgga

SEQ ID NO: 582146 - DNA, 25 bp, Homo sapien
gagcagcacattatgcctggataag

SEQ ID NO: 582147 - DNA, 25 bp, Homo sapien
gcacattatgcctggataagactca

SEQ ID NO: 582148 - DNA, 25 bp, Homo sapien
ggataagactcaaagagcagcttaa

SEQ ID NO: 582149 - DNA, 25 bp, Homo sapien
gagcagcttaatatcaggttctctg

SEQ ID NO: 582150 - DNA, 25 bp, Homo sapien
gcagcttaatatcaggttctctggg

SEQ ID NO: 582151 - DNA, 25 bp, Homo sapien
gggctgtaatcatcggttcaggatg

SEQ ID NO: 582152 - DNA, 25 bp, Homo sapien
aatcatcggttcaggatggagcaga

SEQ ID NO: 582153 - DNA, 25 bp, Homo sapien
ggagcagacacagccgcagcaaggc

SEQ ID NO: 582154 - DNA, 25 bp, Homo sapien
gactgtccccacctctgacagtgga

SEQ ID NO: 582155 - DNA, 25 bp, Homo sapien
acctctgacagtggactctcttggg

SEQ ID NO: 582156 - DNA, 25 bp, Homo sapien
gactctcttgggtctctcaaaaggc

SEQ ID NO: 582157 - DNA, 25 bp, Homo sapien
ttgggtctctcaaaaggctcctcct

SEQ ID NO: 582158 - DNA, 25 bp, Homo sapien
gcgagcaggatgagatagtgcctat

SEQ ID NO: 582159 - DNA, 25 bp, Homo sapien
agtgcctatgagtgatctttggaga

SEQ ID NO: 582160 - DNA, 25 bp, Homo sapien
agatggaggtgctatggccacctgt

SEQ ID NO: 582161 - DNA, 25 bp, Homo sapien
tggccactgtcaacttccttgctca

SEQ ID NO: 582162 - DNA, 25 bp, Homo sapien
tgtcaacttccttgctcacactgag

SEQ ID NO: 582163 - DNA, 25 bp, Homo sapien
cttgctcacactgaggttctgtgat

SEQ ID NO: 582164 - DNA, 25 bp, Homo sapien
ctcctctgagcatttccatggataa

SEQ ID NO: 582165 - DNA, 25 bp, Homo sapien
aaacggtctgtaacacaggacacta

SEQ ID NO: 582166 - DNA, 25 bp, Homo sapien
ggacactatgctaggaatgcagact

SEQ ID NO: 582167 - DNA, 25 bp, Homo sapien
gaatgcagacttccttgataagtga

SEQ ID NO: 582168 - DNA, 25 bp, Homo sapien
gacttccttgataagtgaggacaca

SEQ ID NO: 582169 - DNA, 25 bp, Homo sapien
gttaatagcatttagcgttgtatat

SEQ ID NO: 582170 - DNA, 25 bp, Homo sapien
gcatttagcgttgtatataggagaa

SEQ ID NO: 582171 - DNA, 25 bp, Homo sapien
ggagaaagctccaaattagtgtttt

SEQ ID NO: 582172 - DNA, 25 bp, Homo sapien
tcttcaaaattgtaagtagccttaa

SEQ ID NO: 582173 - DNA, 25 bp, Homo sapien
gtagccttaaattgtagatttgtga

SEQ ID NO: 582174 - DNA, 25 bp, Homo sapien
tttatctttaatctgcacaatagtt

SEQ ID NO: 582175 - DNA, 25 bp, Homo sapien
gcacaatagttttcattgttaccaa

SEQ ID NO: 582176 - DNA, 25 bp, Homo sapien
ctagtcttattgtatatatgtactg

SEQ ID NO: 582177 - DNA, 25 bp, Homo sapien
gtactgaaagtacctttgacactgt

SEQ ID NO: 582178 - DNA, 25 bp, Homo sapien
gaaagtacctttgacactgtactta

SEQ ID NO: 582179 - DNA, 25 bp, Homo sapien
tacctttgacactgtacttaattgg

SEQ ID NO: 582180 - DNA, 25 bp, Homo sapien
ctttgacactgtacttaattggatt

SEQ ID NO: 582181 - DNA, 25 bp, Homo sapien
ttgacactgtacttaattggattta

SEQ ID NO: 582182 - DNA, 25 bp, Homo sapien
aaaggtaagattcatgactattgtt

SEQ ID NO: 582183 - DNA, 25 bp, Homo sapien
ctattgtttgatgtaacttatttat

SEQ ID NO: 582184 - DNA, 25 bp, Homo sapien
aacttatttattttacatcctgata

SEQ ID NO: 582185 - DNA, 25 bp, Homo sapien
tagcacaaaatgcatgtctatgagg

SEQ ID NO: 582186 - DNA, 25 bp, Homo sapien
aaatgcatgtctatgaggaaaaact

SEQ ID NO: 582187 - DNA, 25 bp, Homo sapien
catgagcctcagtgtagccctagtt

SEQ ID NO: 582188 - DNA, 25 bp, Homo sapien
agtgtagccctagttcctgggatca

SEQ ID NO: 582189 - DNA, 25 bp, Homo sapien
tagttcctgggatcagcaccaacag

SEQ ID NO: 582190 - DNA, 25 bp, Homo sapien
atcaggagctggatacagagtccct

SEQ ID NO: 582191 - DNA, 25 bp, Homo sapien
gatacagagtccctgataatcccag

SEQ ID NO: 582192 - DNA, 25 bp, Homo sapien
cctgataatcccagccacagaatat

SEQ ID NO: 582193 - DNA, 25 bp, Homo sapien
gaatatttcaaactcaccgacatgt

SEQ ID NO: 582194 - DNA, 25 bp, Homo sapien
actcaccgacatgtcctctaaatat

SEQ ID NO: 582195 - DNA, 25 bp, Homo sapien
atgaaaaggcttccactcttgcacc

SEQ ID NO: 582196 - DNA, 25 bp, Homo sapien
ccactcttgcacctgtcttgctatt

SEQ ID NO: 582197 - DNA, 25 bp, Homo sapien
tttacagatgtgttctaaaagctat

SEQ ID NO: 582198 - DNA, 25 bp, Homo sapien
actcagcagcaataatttaatctac

SEQ ID NO: 582199 - DNA, 25 bp, Homo sapien
ctcagcagcaataatttaatctact

SEQ ID NO: 582200 - DNA, 25 bp, Homo sapien
tcagcagcaataatttaatctacta

SEQ ID NO: 582201 - DNA, 25 bp, Homo sapien
cagcagcaataatttaatctactaa

SEQ ID NO: 582202 - DNA, 25 bp, Homo sapien
agcagcaataatttaatctactaat

SEQ ID NO: 582203 - DNA, 25 bp, Homo sapien
gcagcaataatttaatctactaatt

SEQ ID NO: 582204 - DNA, 25 bp, Homo sapien
cagcaataatttaatctactaatta

SEQ ID NO: 582205 - DNA, 25 bp, Homo sapien
aaaatacctttattggccgggcatg

SEQ ID NO: 582206 - DNA, 25 bp, Homo sapien
aaatacctttattggccgggcatgg

SEQ ID NO: 582207 - DNA, 25 bp, Homo sapien
aatacctttattggccgggcatggt

SEQ ID NO: 582208 - DNA, 25 bp, Homo sapien
ctggaatagagagagccaagaaggg

SEQ ID NO: 582209 - DNA, 25 bp, Homo sapien
tggaatagagagagccaagaagggc

SEQ ID NO: 582210 - DNA, 25 bp, Homo sapien
ggaatagagagagccaagaagggct

SEQ ID NO: 582211 - DNA, 25 bp, Homo sapien
gaatagagagagccaagaagggctg

SEQ ID NO: 582212 - DNA, 25 bp, Homo sapien
gagagagccaagaagggctgggtgc

SEQ ID NO: 582213 - DNA, 25 bp, Homo sapien
agagagccaagaagggctgggtgca

SEQ ID NO: 582214 - DNA, 25 bp, Homo sapien
gagagccaagaagggctgggtgcag

SEQ ID NO: 582215 - DNA, 25 bp, Homo sapien
agagccaagaagggctgggtgcagt

SEQ ID NO: 582216 - DNA, 25 bp, Homo sapien
gagccaagaagggctgggtgcagtg

SEQ ID NO: 582217 - DNA, 25 bp, Homo sapien
agccaagaagggctgggtgcagtgg

SEQ ID NO: 582218 - DNA, 25 bp, Homo sapien
gccaagaagggctgggtgcagtggc

SEQ ID NO: 582219 - DNA, 25 bp, Homo sapien
caaggtaaaatctgaatcctgtttt

SEQ ID NO: 582220 - DNA, 25 bp, Homo sapien
aatcctgttttttgagtagttgaag

SEQ ID NO: 582221 - DNA, 25 bp, Homo sapien
agctactttaagaatccttggagtt

SEQ ID NO: 582222 - DNA, 25 bp, Homo sapien
gaatccttggagttttttctttgtg

SEQ ID NO: 582223 - DNA, 25 bp, Homo sapien
ttttctttgtggaaacaagttctag

SEQ ID NO: 582224 - DNA, 25 bp, Homo sapien
aaacaagttctagggcaccctgata

SEQ ID NO: 582225 - DNA, 25 bp, Homo sapien
gggcaccctgataatctttttctaa

SEQ ID NO: 582226 - DNA, 25 bp, Homo sapien
aataatcctgtgtagtttcatgtta

SEQ ID NO: 582227 - DNA, 25 bp, Homo sapien
atcctgtgtagtttcatgttatatt

SEQ ID NO: 582228 - DNA, 25 bp, Homo sapien
gtaatcatttgagctcttagtaaat

SEQ ID NO: 582229 - DNA, 25 bp, Homo sapien
atgtgaactgtaattttgatttcta

SEQ ID NO: 582230 - DNA, 25 bp, Homo sapien
aatcagcatggtgtttctaggttga

SEQ ID NO: 582231 - DNA, 25 bp, Homo sapien
gtttctaggttgactcctaggcctt

SEQ ID NO: 582232 - DNA, 25 bp, Homo sapien
actcctaggccttctcaaaccagtt

SEQ ID NO: 582233 - DNA, 25 bp, Homo sapien
ctcaaaccagttcaaaccagagttt

SEQ ID NO: 582234 - DNA, 25 bp, Homo sapien
aaaccagagtttaatgcgagaggct

SEQ ID NO: 582235 - DNA, 25 bp, Homo sapien
aatgcgagaggctcagcagatttct

SEQ ID NO: 582236 - DNA, 25 bp, Homo sapien
gcagatttctgctttgttgtgagtc

SEQ ID NO: 582237 - DNA, 25 bp, Homo sapien
tttctgctttgttgtgagtcactaa

SEQ ID NO: 582238 - DNA, 25 bp, Homo sapien
taaaacgtgatgacctcagcagcca

SEQ ID NO: 582239 - DNA, 25 bp, Homo sapien
tcagcagccataaaccaaaggtaat

SEQ ID NO: 582240 - DNA, 25 bp, Homo sapien
aaccaaaggtaatgagtatcccaca

SEQ ID NO: 582241 - DNA, 25 bp, Homo sapien
gaagcaaactgaacccaaggaaaga

SEQ ID NO: 582242 - DNA, 25 bp, Homo sapien
aagcaaactgaacccaaggaaagat

SEQ ID NO: 582243 - DNA, 25 bp, Homo sapien
gcaaactgaacccaaggaaagattg

SEQ ID NO: 582244 - DNA, 25 bp, Homo sapien
caaactgaacccaaggaaagattgg

SEQ ID NO: 582245 - DNA, 25 bp, Homo sapien
aactgaacccaaggaaagattggtg

SEQ ID NO: 582246 - DNA, 25 bp, Homo sapien
actgaacccaaggaaagattggtga

SEQ ID NO: 582247 - DNA, 25 bp, Homo sapien
ctgaacccaaggaaagattggtgat

SEQ ID NO: 582248 - DNA, 25 bp, Homo sapien
gaacccaaggaaagattggtgatac

SEQ ID NO: 582249 - DNA, 25 bp, Homo sapien
aacccaaggaaagattggtgatact

SEQ ID NO: 582250 - DNA, 25 bp, Homo sapien
acccaaggaaagattggtgatactt

SEQ ID NO: 582251 - DNA, 25 bp, Homo sapien
cccaaggaaagattggtgatacttt

SEQ ID NO: 582252 - DNA, 25 bp, Homo sapien
gctttcttagggtaagtcccacgag

SEQ ID NO: 582253 - DNA, 25 bp, Homo sapien
tagggtaagtcccacgagccagcct

SEQ ID NO: 582254 - DNA, 25 bp, Homo sapien
gagccagcctgtctcaacagggaag

SEQ ID NO: 582255 - DNA, 25 bp, Homo sapien
ggaccacattgccaacttttaccaa

SEQ ID NO: 582256 - DNA, 25 bp, Homo sapien
ttgccaacttttaccaagagagacg

SEQ ID NO: 582257 - DNA, 25 bp, Homo sapien
caagagagacggttatttttacaat

SEQ ID NO: 582258 - DNA, 25 bp, Homo sapien
tttttacaataaggcctccatgtcc

SEQ ID NO: 582259 - DNA, 25 bp, Homo sapien
tcccctacccagtttgccataatta

SEQ ID NO: 582260 - DNA, 25 bp, Homo sapien
tgccataattaaaacttgggctact

SEQ ID NO: 582261 - DNA, 25 bp, Homo sapien
acttgggctactttgtttctattga

SEQ ID NO: 582262 - DNA, 25 bp, Homo sapien
gtttctattgagtaattcctcctcc

SEQ ID NO: 582263 - DNA, 25 bp, Homo sapien
gggttactatccagcaggtgtatca

SEQ ID NO: 582264 - DNA, 25 bp, Homo sapien
aggtgtatcacatttttcccataat

SEQ ID NO: 582265 - DNA, 25 bp, Homo sapien
tattccatctgtccttagccaaaat

SEQ ID NO: 582266 - DNA, 25 bp, Homo sapien
ctgtccttagccaaaatgaatgttt

SEQ ID NO: 582267 - DNA, 25 bp, Homo sapien
gaatgtttaactttgctggtcacat

SEQ ID NO: 582268 - DNA, 25 bp, Homo sapien
tgctggtcacatacaagttttgtcg

SEQ ID NO: 582269 - DNA, 25 bp, Homo sapien
agttttgtcgcatattcttcttcct

SEQ ID NO: 582270 - DNA, 25 bp, Homo sapien
ttcattttcatctcgcaacccttta

SEQ ID NO: 582271 - DNA, 25 bp, Homo sapien
tttcatctcgcaaccctttaaaaat

SEQ ID NO: 582272 - DNA, 25 bp, Homo sapien
attcttaagtagcaagccatacaaa

SEQ ID NO: 582273 - DNA, 25 bp, Homo sapien
caaaaacaaatcgtggactagaagt

SEQ ID NO: 582274 - DNA, 25 bp, Homo sapien
atattcggggagcaggtccggagcg

SEQ ID NO: 582275 - DNA, 25 bp, Homo sapien
tattcggggagcaggtccggagcgc

SEQ ID NO: 582276 - DNA, 25 bp, Homo sapien
attcggggagcaggtccggagcgcc

SEQ ID NO: 582277 - DNA, 25 bp, Homo sapien
aggccggacctgagctcccccgcgc

SEQ ID NO: 582278 - DNA, 25 bp, Homo sapien
agctcccccgcgctcgcgacgagga

SEQ ID NO: 582279 - DNA, 25 bp, Homo sapien
gctcccccgcgctcgcgacgaggag

SEQ ID NO: 582280 - DNA, 25 bp, Homo sapien
ttccctcgagacccgccaagaaata

SEQ ID NO: 582281 - DNA, 25 bp, Homo sapien
tccctcgagacccgccaagaaataa

SEQ ID NO: 582282 - DNA, 25 bp, Homo sapien
gagacccgccaagaaataaaggcga

SEQ ID NO: 582283 - DNA, 25 bp, Homo sapien
agacccgccaagaaataaaggcgat

SEQ ID NO: 582284 - DNA, 25 bp, Homo sapien
gacccgccaagaaataaaggcgatg

SEQ ID NO: 582285 - DNA, 25 bp, Homo sapien
aggaccagtatgcttggactgaagg

SEQ ID NO: 582286 - DNA, 25 bp, Homo sapien
ggaccagtatgcttggactgaaggg

SEQ ID NO: 582287 - DNA, 25 bp, Homo sapien
gaccagtatgcttggactgaagggg

SEQ ID NO: 582288 - DNA, 25 bp, Homo sapien
accagtatgcttggactgaaggggt

SEQ ID NO: 582289 - DNA, 25 bp, Homo sapien
gtatgcttggactgaaggggttctc

SEQ ID NO: 582290 - DNA, 25 bp, Homo sapien
atgcttggactgaaggggttctcac

SEQ ID NO: 582291 - DNA, 25 bp, Homo sapien
tgcttggactgaaggggttctcaca

SEQ ID NO: 582292 - DNA, 25 bp, Homo sapien
gcttggactgaaggggttctcacag

SEQ ID NO: 582293 - DNA, 25 bp, Homo sapien
aaaacattatgagtttctttttgct

SEQ ID NO: 582294 - DNA, 25 bp, Homo sapien
aaacattatgagtttctttttgcta

SEQ ID NO: 582295 - DNA, 25 bp, Homo sapien
tattgaagagattccaggagagttc

SEQ ID NO: 582296 - DNA, 25 bp, Homo sapien
cccaggatgatttagctgaagatga

SEQ ID NO: 582297 - DNA, 25 bp, Homo sapien
aaaagaatctctgaagtctgccaaa

SEQ ID NO: 582298 - DNA, 25 bp, Homo sapien
gaatctctgaagtctgccaaaatgt

SEQ ID NO: 582299 - DNA, 25 bp, Homo sapien
gaagtctgccaaaatgtaccttgag

SEQ ID NO: 582300 - DNA, 25 bp, Homo sapien
gtaccttgagacagacccttctgga

SEQ ID NO: 582301 - DNA, 25 bp, Homo sapien
gagacagacccttctggaagagaca

SEQ ID NO: 582302 - DNA, 25 bp, Homo sapien
tctggaagagacaagaggacaccaa

SEQ ID NO: 582303 - DNA, 25 bp, Homo sapien
tgtcatcataaaacagggccatgag

SEQ ID NO: 582304 - DNA, 25 bp, Homo sapien
tgagccacccacattcacaggctgg

SEQ ID NO: 582305 - DNA, 25 bp, Homo sapien
gcaagtggtaaattggtatttgtaa

SEQ ID NO: 582306 - DNA, 25 bp, Homo sapien
gagaatccagaggtcagacattcct

SEQ ID NO: 582307 - DNA, 25 bp, Homo sapien
gaatccagaggtcagacattccttt

SEQ ID NO: 582308 - DNA, 25 bp, Homo sapien
tccagaggtcagacattccttttag

SEQ ID NO: 582309 - DNA, 25 bp, Homo sapien
gaggtcagacattccttttagtaag

SEQ ID NO: 582310 - DNA, 25 bp, Homo sapien
gacattccttttagtaaggactcca

SEQ ID NO: 582311 - DNA, 25 bp, Homo sapien
gtaaggactccaatatggtttctca

SEQ ID NO: 582312 - DNA, 25 bp, Homo sapien
ggactccaatatggtttctcaccta

SEQ ID NO: 582313 - DNA, 25 bp, Homo sapien
tccaatatggtttctcacctactca

SEQ ID NO: 582314 - DNA, 25 bp, Homo sapien
aatatggtttctcacctactcactc

SEQ ID NO: 582315 - DNA, 25 bp, Homo sapien
tcacctactcactccaacaaaattg

SEQ ID NO: 582316 - DNA, 25 bp, Homo sapien
actccaacaaaattgctcttctcaa

SEQ ID NO: 582317 - DNA, 25 bp, Homo sapien
aactgctgcaggtaaccgaacattc

SEQ ID NO: 582318 - DNA, 25 bp, Homo sapien
gcaggtaaccgaacattcttttata

SEQ ID NO: 582319 - DNA, 25 bp, Homo sapien
tagtctctcatattccttttgcatt

SEQ ID NO: 582320 - DNA, 25 bp, Homo sapien
atctaacctaatctgacttgaaaaa

SEQ ID NO: 582321 - DNA, 25 bp, Homo sapien
atctgacttgaaaaactatatcttg

SEQ ID NO: 582322 - DNA, 25 bp, Homo sapien
tatatcttgaaacctgacttctagt

SEQ ID NO: 582323 - DNA, 25 bp, Homo sapien
gaaacctgacttctagtatgtaaaa

SEQ ID NO: 582324 - DNA, 25 bp, Homo sapien
tcaacagatcagcaaactggccatt

SEQ ID NO: 582325 - DNA, 25 bp, Homo sapien
gcaaactggccatttagatatctaa

SEQ ID NO: 582326 - DNA, 25 bp, Homo sapien
ttagatatctaattccaatgagaga

SEQ ID NO: 582327 - DNA, 25 bp, Homo sapien
ggaaattgcatgatttttatctttc

SEQ ID NO: 582328 - DNA, 25 bp, Homo sapien
agagatgatcaggtcatgagaactc

SEQ ID NO: 582329 - DNA, 25 bp, Homo sapien
gagatgatcaggtcatgagaactct

SEQ ID NO: 582330 - DNA, 25 bp, Homo sapien
agatgatcaggtcatgagaactctg

SEQ ID NO: 582331 - DNA, 25 bp, Homo sapien
gatgatcaggtcatgagaactctgc

SEQ ID NO: 582332 - DNA, 25 bp, Homo sapien
ttaatacccttatcgcagtagtgga

SEQ ID NO: 582333 - DNA, 25 bp, Homo sapien
taatacccttatcgcagtagtggac

SEQ ID NO: 582334 - DNA, 25 bp, Homo sapien
atacccttatcgcagtagtggaccc

SEQ ID NO: 582335 - DNA, 25 bp, Homo sapien
tacccttatcgcagtagtggacccc

SEQ ID NO: 582336 - DNA, 25 bp, Homo sapien
ctttcaccatgggataacacagcaa

SEQ ID NO: 582337 - DNA, 25 bp, Homo sapien
tttcaccatgggataacacagcaag

SEQ ID NO: 582338 - DNA, 25 bp, Homo sapien
ttcaccatgggataacacagcaaga

SEQ ID NO: 582339 - DNA, 25 bp, Homo sapien
taatggacattcacacttagcatgt

SEQ ID NO: 582340 - DNA, 25 bp, Homo sapien
attcacacttagcatgtctcaaaga

SEQ ID NO: 582341 - DNA, 25 bp, Homo sapien
ttagcatgtctcaaagaaatctcat

SEQ ID NO: 582342 - DNA, 25 bp, Homo sapien
gaaatctcatgtaaaccatggccat

SEQ ID NO: 582343 - DNA, 25 bp, Homo sapien
tcctgttctaccttaactttctgag

SEQ ID NO: 582344 - DNA, 25 bp, Homo sapien
gttctaccttaactttctgagtcta

SEQ ID NO: 582345 - DNA, 25 bp, Homo sapien
taactttctgagtctatggaatgat

SEQ ID NO: 582346 - DNA, 25 bp, Homo sapien
gataatttcacatctcataaacttg

SEQ ID NO: 582347 - DNA, 25 bp, Homo sapien
atctcataaacttgactgatgtaag

SEQ ID NO: 582348 - DNA, 25 bp, Homo sapien
gtgtaactcttttttcaagatgtga

SEQ ID NO: 582349 - DNA, 25 bp, Homo sapien
aatcattaggtcagtcatttgtaaa

SEQ ID NO: 582350 - DNA, 25 bp, Homo sapien
gaaagtcacacatttaacatctgga

SEQ ID NO: 582351 - DNA, 25 bp, Homo sapien
ctggattcacagtcataggtcttaa

SEQ ID NO: 582352 - DNA, 25 bp, Homo sapien
aggtcttaaaccatgatagcttgtg

SEQ ID NO: 582353 - DNA, 25 bp, Homo sapien
atagcttgtgcttctgaggtgcact

SEQ ID NO: 582354 - DNA, 25 bp, Homo sapien
ggtgcactgaattcatgcgtggctt

SEQ ID NO: 582355 - DNA, 25 bp, Homo sapien
gaattcatgcgtggctttcctagac

SEQ ID NO: 582356 - DNA, 25 bp, Homo sapien
atggaaccttcacgtgtcaggctat

SEQ ID NO: 582357 - DNA, 25 bp, Homo sapien
cttcacgtgtcaggctatgtagagc

SEQ ID NO: 582358 - DNA, 25 bp, Homo sapien
ctatgtagagccctgaatctcaaag

SEQ ID NO: 582359 - DNA, 25 bp, Homo sapien
agagcttggtcccagcaggtctcat

SEQ ID NO: 582360 - DNA, 25 bp, Homo sapien
gtcccagcaggtctcattattttgt

SEQ ID NO: 582361 - DNA, 25 bp, Homo sapien
aaagtacaactacaagtctgcacct

SEQ ID NO: 582362 - DNA, 25 bp, Homo sapien
agtacaactacaagtctgcaccttc

SEQ ID NO: 582363 - DNA, 25 bp, Homo sapien
gtacaactacaagtctgcaccttca

SEQ ID NO: 582364 - DNA, 25 bp, Homo sapien
tacaactacaagtctgcaccttcaa

SEQ ID NO: 582365 - DNA, 25 bp, Homo sapien
acaactacaagtctgcaccttcaac

SEQ ID NO: 582366 - DNA, 25 bp, Homo sapien
caactacaagtctgcaccttcaact

SEQ ID NO: 582367 - DNA, 25 bp, Homo sapien
tgcaccttcaactctcattctgaaa

SEQ ID NO: 582368 - DNA, 25 bp, Homo sapien
gcaccttcaactctcattctgaaaa

SEQ ID NO: 582369 - DNA, 25 bp, Homo sapien
accttcaactctcattctgaaaatt

SEQ ID NO: 582370 - DNA, 25 bp, Homo sapien
tcaactctcattctgaaaattcctg

SEQ ID NO: 582371 - DNA, 25 bp, Homo sapien
aactctcattctgaaaattcctgaa

SEQ ID NO: 582372 - DNA, 25 bp, Homo sapien
taattagacctgaattttaaaaatg

SEQ ID NO: 582373 - DNA, 25 bp, Homo sapien
ccccagcatttaaaaattgaacaat

SEQ ID NO: 582374 - DNA, 25 bp, Homo sapien
aaaattgaacaattagcccaacttg

SEQ ID NO: 582375 - DNA, 25 bp, Homo sapien
aaattgaacaattagcccaacttgt

SEQ ID NO: 582376 - DNA, 25 bp, Homo sapien
aattgaacaattagcccaacttgtt

SEQ ID NO: 582377 - DNA, 25 bp, Homo sapien
attgaacaattagcccaacttgtta

SEQ ID NO: 582378 - DNA, 25 bp, Homo sapien
ttgaacaattagcccaacttgttaa

SEQ ID NO: 582379 - DNA, 25 bp, Homo sapien
tgaacaattagcccaacttgttaaa

SEQ ID NO: 582380 - DNA, 25 bp, Homo sapien
tctactaaaaataggaacccaggag

SEQ ID NO: 582381 - DNA, 25 bp, Homo sapien
gtaagccaagactacgccacttcac

SEQ ID NO: 582382 - DNA, 25 bp, Homo sapien
taagccaagactacgccacttcact

SEQ ID NO: 582383 - DNA, 25 bp, Homo sapien
gaggaagcaggcagcggcttcgtgg

SEQ ID NO: 582384 - DNA, 25 bp, Homo sapien
aggaagcaggcagcggcttcgtggc

SEQ ID NO: 582385 - DNA, 25 bp, Homo sapien
ggaagcaggcagcggcttcgtggca

SEQ ID NO: 582386 - DNA, 25 bp, Homo sapien
gaagcaggcagcggcttcgtggcag

SEQ ID NO: 582387 - DNA, 25 bp, Homo sapien
aagcaggcagcggcttcgtggcagg

SEQ ID NO: 582388 - DNA, 25 bp, Homo sapien
agcaggcagcggcttcgtggcagga

SEQ ID NO: 582389 - DNA, 25 bp, Homo sapien
gcaggcagcggcttcgtggcaggag

SEQ ID NO: 582390 - DNA, 25 bp, Homo sapien
caggcagcggcttcgtggcaggagc

SEQ ID NO: 582391 - DNA, 25 bp, Homo sapien
aggcagcggcttcgtggcaggagca

SEQ ID NO: 582392 - DNA, 25 bp, Homo sapien
ggcagcggcttcgtggcaggagcag

SEQ ID NO: 582393 - DNA, 25 bp, Homo sapien
gcagcggcttcgtggcaggagcagg

SEQ ID NO: 582394 - DNA, 25 bp, Homo sapien
ctttccctgggcaacttagggcaag

SEQ ID NO: 582395 - DNA, 25 bp, Homo sapien
ctgggcaacttagggcaagctcaaa

SEQ ID NO: 582396 - DNA, 25 bp, Homo sapien
ttagggcaagctcaaatcccactgc

SEQ ID NO: 582397 - DNA, 25 bp, Homo sapien
agggcaagctcaaatcccactgcta

SEQ ID NO: 582398 - DNA, 25 bp, Homo sapien
tcctagctggagaccaaccagcaca

SEQ ID NO: 582399 - DNA, 25 bp, Homo sapien
gctggagaccaaccagcacagtcca

SEQ ID NO: 582400 - DNA, 25 bp, Homo sapien
gaaaatgcctgcatgagctcagctg

SEQ ID NO: 582401 - DNA, 25 bp, Homo sapien
aatgcctgcatgagctcagctgtta

SEQ ID NO: 582402 - DNA, 25 bp, Homo sapien
tgagctcagctgttaccactgcgta

SEQ ID NO: 582403 - DNA, 25 bp, Homo sapien
tcagctgttaccactgcgtaccaca

SEQ ID NO: 582404 - DNA, 25 bp, Homo sapien
ccctgaccagtcagaggtcttgagt

SEQ ID NO: 582405 - DNA, 25 bp, Homo sapien
aagcatagcaataagtatactggca

SEQ ID NO: 582406 - DNA, 25 bp, Homo sapien
gtatactggcatctttcactttgat

SEQ ID NO: 582407 - DNA, 25 bp, Homo sapien
ggcatctttcactttgattatattc

SEQ ID NO: 582408 - DNA, 25 bp, Homo sapien
gggctatcacagattgcacagtttg

SEQ ID NO: 582409 - DNA, 25 bp, Homo sapien
gaacattgggaatgcctccagtatt

SEQ ID NO: 582410 - DNA, 25 bp, Homo sapien
tccagtatttgggatctgatggcac

SEQ ID NO: 582411 - DNA, 25 bp, Homo sapien
ttgggatctgatggcaccaggcagt

SEQ ID NO: 582412 - DNA, 25 bp, Homo sapien
accaggcagtagtaattctccgtga

SEQ ID NO: 582413 - DNA, 25 bp, Homo sapien
attctccgtgaaagctgaatttttt

SEQ ID NO: 582414 - DNA, 25 bp, Homo sapien
tgcaatggcgggacctaggctcact

SEQ ID NO: 582415 - DNA, 25 bp, Homo sapien
gatctgcagttcttttaagcatagc

SEQ ID NO: 582416 - DNA, 25 bp, Homo sapien
gcacccagcctatggtacaccttta

SEQ ID NO: 582417 - DNA, 25 bp, Homo sapien
agcctatggtacacctttactgagg

SEQ ID NO: 582418 - DNA, 25 bp, Homo sapien
tatggtacacctttactgaggaaac

SEQ ID NO: 582419 - DNA, 25 bp, Homo sapien
tacacctttactgaggaaacaattc

SEQ ID NO: 582420 - DNA, 25 bp, Homo sapien
acaattcaggaacatcactcttagt

SEQ ID NO: 582421 - DNA, 25 bp, Homo sapien
aggaacatcactcttagtaaggcaa

SEQ ID NO: 582422 - DNA, 25 bp, Homo sapien
cactcttagtaaggcaattgttgat

SEQ ID NO: 582423 - DNA, 25 bp, Homo sapien
gtaaggcaattgttgattataagtc

SEQ ID NO: 582424 - DNA, 25 bp, Homo sapien
aacaccatcatgtacaaattcaggg

SEQ ID NO: 582425 - DNA, 25 bp, Homo sapien
tttgctaatacttgtttccaatttt

SEQ ID NO: 582426 - DNA, 25 bp, Homo sapien
ttaaacttttcaagtgttgcactgt

SEQ ID NO: 582427 - DNA, 25 bp, Homo sapien
tcatggctctctctggttgtattta

SEQ ID NO: 582428 - DNA, 25 bp, Homo sapien
ggctctctctggttgtatttagatc

SEQ ID NO: 582429 - DNA, 25 bp, Homo sapien
ctggttgtatttagatcgggtgtca

SEQ ID NO: 582430 - DNA, 25 bp, Homo sapien
tcgggtgtcagaggacgaccaatct

SEQ ID NO: 582431 - DNA, 25 bp, Homo sapien
gaggacgaccaatcttagggaattt

SEQ ID NO: 582432 - DNA, 25 bp, Homo sapien
tagggaatttccagaccaatgagca

SEQ ID NO: 582433 - DNA, 25 bp, Homo sapien
tcctttccgacgcaaatctgtgtga

SEQ ID NO: 582434 - DNA, 25 bp, Homo sapien
caaatctgtgtgactattagggctt

SEQ ID NO: 582435 - DNA, 25 bp, Homo sapien
gtgtgactattagggcttggtctta

SEQ ID NO: 582436 - DNA, 25 bp, Homo sapien
aacccaattgagtgatttgcaaacc

SEQ ID NO: 582437 - DNA, 25 bp, Homo sapien
tgagtgatttgcaaacccagatatt

SEQ ID NO: 582438 - DNA, 25 bp, Homo sapien
ccgatgacatggactcaggaatctt

SEQ ID NO: 582439 - DNA, 25 bp, Homo sapien
tacgtggactctttccatccgtaca

SEQ ID NO: 582440 - DNA, 25 bp, Homo sapien
tttccatccgtacattgtcgtgcac

SEQ ID NO: 582441 - DNA, 25 bp, Homo sapien
attgtcgtgcacatgccactcatca

SEQ ID NO: 582442 - DNA, 25 bp, Homo sapien
gcgtgcccagatcctcgcagggcaa

SEQ ID NO: 582443 - DNA, 25 bp, Homo sapien
gggcaacaccctgtgataattccag

SEQ ID NO: 582444 - DNA, 25 bp, Homo sapien
gataattccaggtgattctctacat

SEQ ID NO: 582445 - DNA, 25 bp, Homo sapien
caggtgattctctacatctgcagct

SEQ ID NO: 582446 - DNA, 25 bp, Homo sapien
acatctgcagcttgaggttagcctc

SEQ ID NO: 582447 - DNA, 25 bp, Homo sapien
gaggttagcctcatatcacattaca

SEQ ID NO: 582448 - DNA, 25 bp, Homo sapien
atatcacattacattctcactagaa

SEQ ID NO: 582449 - DNA, 25 bp, Homo sapien
ccccggaagtggcacgaggtcagag

SEQ ID NO: 582450 - DNA, 25 bp, Homo sapien
cgaggtcagaggtgtgggatggcca

SEQ ID NO: 582451 - DNA, 25 bp, Homo sapien
gatggccagggaacgagcagctttc

SEQ ID NO: 582452 - DNA, 25 bp, Homo sapien
agggaacgagcagctttctggaagt

SEQ ID NO: 582453 - DNA, 25 bp, Homo sapien
aggcccacgtgaggagtgaacatgt

SEQ ID NO: 582454 - DNA, 25 bp, Homo sapien
gaggagtgaacatgtggctggagat

SEQ ID NO: 582455 - DNA, 25 bp, Homo sapien
gagatgaggacccagagtgatcccc

SEQ ID NO: 582456 - DNA, 25 bp, Homo sapien
ggacccagagtgatccccccaggtg

SEQ ID NO: 582457 - DNA, 25 bp, Homo sapien
ttaggaacagggaaagcccagatct

SEQ ID NO: 582458 - DNA, 25 bp, Homo sapien
ccagatctgagaagggaggcacatc

SEQ ID NO: 582459 - DNA, 25 bp, Homo sapien
tctgagaagggaggcacatcctgag

SEQ ID NO: 582460 - DNA, 25 bp, Homo sapien
tgagttctgaagtagagtgttggaa

SEQ ID NO: 582461 - DNA, 25 bp, Homo sapien
tgcagttcatactgaatgaccactt

SEQ ID NO: 582462 - DNA, 25 bp, Homo sapien
tactgaatgaccacttgatatgact

SEQ ID NO: 582463 - DNA, 25 bp, Homo sapien
gaatgaccacttgatatgactaatt

SEQ ID NO: 582464 - DNA, 25 bp, Homo sapien
tgaccacttgatatgactaattcag

SEQ ID NO: 582465 - DNA, 25 bp, Homo sapien
aagctatgaatgttactatcacggc

SEQ ID NO: 582466 - DNA, 25 bp, Homo sapien
gaatgttactatcacggcttttcct

SEQ ID NO: 582467 - DNA, 25 bp, Homo sapien
atgttactatcacggcttttcctta

SEQ ID NO: 582468 - DNA, 25 bp, Homo sapien
tactatcacggcttttccttatttt

SEQ ID NO: 582469 - DNA, 25 bp, Homo sapien
atgccaaaaatgtgcctcattaaga

SEQ ID NO: 582470 - DNA, 25 bp, Homo sapien
gtatagcttaagatcaaaacagtca

SEQ ID NO: 582471 - DNA, 25 bp, Homo sapien
agattgccagacagcgcgcagtggc

SEQ ID NO: 582472 - DNA, 25 bp, Homo sapien
aaagcagcagcttttgagcactggg

SEQ ID NO: 582473 - DNA, 25 bp, Homo sapien
gcttttgagcactgggcgggtacaa

SEQ ID NO: 582474 - DNA, 25 bp, Homo sapien
cactgggcgggtacaaggttacgat

SEQ ID NO: 582475 - DNA, 25 bp, Homo sapien
gtacaaggttacgatgggtattttg

SEQ ID NO: 582476 - DNA, 25 bp, Homo sapien
gttttgtctgttgagcagtatttag

SEQ ID NO: 582477 - DNA, 25 bp, Homo sapien
tgacagtgccaataatattcacttt

SEQ ID NO: 582478 - DNA, 25 bp, Homo sapien
attcactttatgagacagagcgaaa

SEQ ID NO: 582479 - DNA, 25 bp, Homo sapien
agcgaaataggcaggaggtaacaaa

SEQ ID NO: 582480 - DNA, 25 bp, Homo sapien
tttgcgtcaccaaagactgcctgtt

SEQ ID NO: 582481 - DNA, 25 bp, Homo sapien
ttgcgtcaccaaagactgcctgttt

SEQ ID NO: 582482 - DNA, 25 bp, Homo sapien
gcatggccagatttgacgctagaag

SEQ ID NO: 582483 - DNA, 25 bp, Homo sapien
aagactctagattaagaagggcttt

SEQ ID NO: 582484 - DNA, 25 bp, Homo sapien
gaagggctttgtattctatactaag

SEQ ID NO: 582485 - DNA, 25 bp, Homo sapien
tctatactaaggaatatcagctcta

SEQ ID NO: 582486 - DNA, 25 bp, Homo sapien
agctctatgccaagagtttttaagg

SEQ ID NO: 582487 - DNA, 25 bp, Homo sapien
gggtaccatatgccctcctaggaaa

SEQ ID NO: 582488 - DNA, 25 bp, Homo sapien
aatatcaagccttatgagggtgaga

SEQ ID NO: 582489 - DNA, 25 bp, Homo sapien
cctcttctccaaggagttcagatat

SEQ ID NO: 582490 - DNA, 25 bp, Homo sapien
aaggagttcagatatggtccctccc

SEQ ID NO: 582491 - DNA, 25 bp, Homo sapien
gaatggtttagggatcagatttttg

SEQ ID NO: 582492 - DNA, 25 bp, Homo sapien
ttgtttttatctgcatggccagatt

SEQ ID NO: 582493 - DNA, 25 bp, Homo sapien
caagcaccaagtttagttagctaaa

SEQ ID NO: 582494 - DNA, 25 bp, Homo sapien
gaatagcctacataatatccacagc

SEQ ID NO: 582495 - DNA, 25 bp, Homo sapien
gcctacataatatccacagccagac

SEQ ID NO: 582496 - DNA, 25 bp, Homo sapien
ataatatccacagccagactatagt

SEQ ID NO: 582497 - DNA, 25 bp, Homo sapien
cacagccagactatagtggaaatat

SEQ ID NO: 582498 - DNA, 25 bp, Homo sapien
gaaatatgtgatccctagactcagc

SEQ ID NO: 582499 - DNA, 25 bp, Homo sapien
atatgtgatccctagactcagcttc

SEQ ID NO: 582500 - DNA, 25 bp, Homo sapien
atgtgatccctagactcagcttctg

SEQ ID NO: 582501 - DNA, 25 bp, Homo sapien
tgatccctagactcagcttctggtg

SEQ ID NO: 582502 - DNA, 25 bp, Homo sapien
tagactcagcttctggtgtcccagt

SEQ ID NO: 582503 - DNA, 25 bp, Homo sapien
tcagcttctggtgtcccagtcattt

SEQ ID NO: 582504 - DNA, 25 bp, Homo sapien
tccagtgacagttggcatttctata

SEQ ID NO: 582505 - DNA, 25 bp, Homo sapien
gtgacagttggcatttctataaacc

SEQ ID NO: 582506 - DNA, 25 bp, Homo sapien
gttggcatttctataaaccagaatt

SEQ ID NO: 582507 - DNA, 25 bp, Homo sapien
accagaattgtacctctgcttacag

SEQ ID NO: 582508 - DNA, 25 bp, Homo sapien
agaattgtacctctgcttacagctc

SEQ ID NO: 582509 - DNA, 25 bp, Homo sapien
aattgtacctctgcttacagctctg

SEQ ID NO: 582510 - DNA, 25 bp, Homo sapien
gtacctctgcttacagctctgtgga

SEQ ID NO: 582511 - DNA, 25 bp, Homo sapien
ctctgcttacagctctgtggatgaa

SEQ ID NO: 582512 - DNA, 25 bp, Homo sapien
cttacagctctgtggatgaagatca

SEQ ID NO: 582513 - DNA, 25 bp, Homo sapien
cagctctgtggatgaagatcaggga

SEQ ID NO: 582514 - DNA, 25 bp, Homo sapien
ggaacagtttcaagttggtgagagt

SEQ ID NO: 582515 - DNA, 25 bp, Homo sapien
gtctatttctccttatagttccacc

SEQ ID NO: 582516 - DNA, 25 bp, Homo sapien
ctccttatagttccacctgtatttg

SEQ ID NO: 582517 - DNA, 25 bp, Homo sapien
agttccacctgtatttgatttatgt

SEQ ID NO: 582518 - DNA, 25 bp, Homo sapien
tattgaaaatctgtggttggttcca

SEQ ID NO: 582519 - DNA, 25 bp, Homo sapien
tggttggttccacataagatcttaa

SEQ ID NO: 582520 - DNA, 25 bp, Homo sapien
gatcttaactgttacgtctttttgg

SEQ ID NO: 582521 - DNA, 25 bp, Homo sapien
actgttacgtctttttggataaatg

SEQ ID NO: 582522 - DNA, 25 bp, Homo sapien
tttaatctgtagtactacctctgtt

SEQ ID NO: 582523 - DNA, 25 bp, Homo sapien
tactacctctgttattacatctgta

SEQ ID NO: 582524 - DNA, 25 bp, Homo sapien
acatctgtagtactacgtctgttat

SEQ ID NO: 582525 - DNA, 25 bp, Homo sapien
tatcacatctgttattatttgcttg

SEQ ID NO: 582526 - DNA, 25 bp, Homo sapien
gggtgctttgtctatgcttgttatg

SEQ ID NO: 582527 - DNA, 25 bp, Homo sapien
ttgtctatgcttgttatgacttagc

SEQ ID NO: 582528 - DNA, 25 bp, Homo sapien
aaattttgccacttaagggcactca

SEQ ID NO: 582529 - DNA, 25 bp, Homo sapien
tttgccacttaagggcactcaaata

SEQ ID NO: 582530 - DNA, 25 bp, Homo sapien
ggcactcaaatagtgtaacacccct

SEQ ID NO: 582531 - DNA, 25 bp, Homo sapien
tcaaatagtgtaacaccccttttat

SEQ ID NO: 582532 - DNA, 25 bp, Homo sapien
atagcggtaaacgacctagcgcaga

SEQ ID NO: 582533 - DNA, 25 bp, Homo sapien
gtaaacgacctagcgcagagatcct

SEQ ID NO: 582534 - DNA, 25 bp, Homo sapien
gacctagcgcagagatcctaaacat

SEQ ID NO: 582535 - DNA, 25 bp, Homo sapien
gcgcagagatcctaaacattacatt

SEQ ID NO: 582536 - DNA, 25 bp, Homo sapien
gagatcctaaacattacattcagag

SEQ ID NO: 582537 - DNA, 25 bp, Homo sapien
tgaaacttaagtgttctgtttttat

SEQ ID NO: 582538 - DNA, 25 bp, Homo sapien
gttctgtttttatcaggactatttt

SEQ ID NO: 582539 - DNA, 25 bp, Homo sapien
ataaaattgacattagcctatatta

SEQ ID NO: 582540 - DNA, 25 bp, Homo sapien
ctaacaatgttagtataatagtcct

SEQ ID NO: 582541 - DNA, 25 bp, Homo sapien
aatagtcctaataagtgatttcaag

SEQ ID NO: 582542 - DNA, 25 bp, Homo sapien
gtatattatttattggaatcctgtg

SEQ ID NO: 582543 - DNA, 25 bp, Homo sapien
tatttattggaatcctgtgggaata

SEQ ID NO: 582544 - DNA, 25 bp, Homo sapien
aatcctgtgggaataaactggcact

SEQ ID NO: 582545 - DNA, 25 bp, Homo sapien
ggaataaactggcactgttgatatt

SEQ ID NO: 582546 - DNA, 25 bp, Homo sapien
aaactggcactgttgatattttata

SEQ ID NO: 582547 - DNA, 25 bp, Homo sapien
ctggcactgttgatattttataata

SEQ ID NO: 582548 - DNA, 25 bp, Homo sapien
cacttttatgttcacagtcttttcc

SEQ ID NO: 582549 - DNA, 25 bp, Homo sapien
gtcttttcctttaggctcatgatgg

SEQ ID NO: 582550 - DNA, 25 bp, Homo sapien
atcagaggcatgagtgtgtttaacc

SEQ ID NO: 582551 - DNA, 25 bp, Homo sapien
atgagtgtgtttaacctaagagcct

SEQ ID NO: 582552 - DNA, 25 bp, Homo sapien
acctaagagccttaatggcttgaat

SEQ ID NO: 582553 - DNA, 25 bp, Homo sapien
aatggcttgaatcagaagcacttta

SEQ ID NO: 582554 - DNA, 25 bp, Homo sapien
tcagtgtcagcctttcatacatcat

SEQ ID NO: 582555 - DNA, 25 bp, Homo sapien
gtcagcctttcatacatcattttaa

SEQ ID NO: 582556 - DNA, 25 bp, Homo sapien
tcacttaatctctctacatgtcaat

SEQ ID NO: 582557 - DNA, 25 bp, Homo sapien
ctacatgtcaatttcttcagctata

SEQ ID NO: 582558 - DNA, 25 bp, Homo sapien
attatactgactaattgggctgttt

SEQ ID NO: 582559 - DNA, 25 bp, Homo sapien
tggagtaacgttggctttcatattc

SEQ ID NO: 582560 - DNA, 25 bp, Homo sapien
tgatctggaaaaccttgttgaactt

SEQ ID NO: 582561 - DNA, 25 bp, Homo sapien
gttgaacttttgctaccaactccac

SEQ ID NO: 582562 - DNA, 25 bp, Homo sapien
tttgctaccaactccactcagtgat

SEQ ID NO: 582563 - DNA, 25 bp, Homo sapien
atgttgactcttccagttcattcta

SEQ ID NO: 582564 - DNA, 25 bp, Homo sapien
gttcattctatggtggtgaggtcct

SEQ ID NO: 582565 - DNA, 25 bp, Homo sapien
ggagaagaagacactgacactgaga

SEQ ID NO: 582566 - DNA, 25 bp, Homo sapien
tttcagcagaggcactagccaagcc

SEQ ID NO: 582567 - DNA, 25 bp, Homo sapien
ggcactagccaagcctattactgaa

SEQ ID NO: 582568 - DNA, 25 bp, Homo sapien
gaaagcctggcccaaggagataata

SEQ ID NO: 582569 - DNA, 25 bp, Homo sapien
ataataccatcaaattctcagaaga

SEQ ID NO: 582570 - DNA, 25 bp, Homo sapien
ctgcgcccggccgaagtgtttgaaa

SEQ ID NO: 582571 - DNA, 25 bp, Homo sapien
cgcccggccgaagtgtttgaaatct

SEQ ID NO: 582572 - DNA, 25 bp, Homo sapien
gtttgaaatctttaagcatcctggt

SEQ ID NO: 582573 - DNA, 25 bp, Homo sapien
agcatcctggtaaatattgagtttt

SEQ ID NO: 582574 - DNA, 25 bp, Homo sapien
gttgcatgattgacatcgcttccac

SEQ ID NO: 582575 - DNA, 25 bp, Homo sapien
attgacatcgcttccacccatgttt

SEQ ID NO: 582576 - DNA, 25 bp, Homo sapien
tccacccatgtttcagagcatctga

SEQ ID NO: 582577 - DNA, 25 bp, Homo sapien
gagcatctgatttgtcagaccctca

SEQ ID NO: 582578 - DNA, 25 bp, Homo sapien
tgatttgtcagaccctcaccaaaaa

SEQ ID NO: 582579 - DNA, 25 bp, Homo sapien
gtcagaccctcaccaaaaatgggct

SEQ ID NO: 582580 - DNA, 25 bp, Homo sapien
ctcaccaaaaatgggcttttatcaa

SEQ ID NO: 582581 - DNA, 25 bp, Homo sapien
ggaacagcatgaggcttccaacctg

SEQ ID NO: 582582 - DNA, 25 bp, Homo sapien
aacagcatgaggcttccaacctgca

SEQ ID NO: 582583 - DNA, 25 bp, Homo sapien
acagcatgaggcttccaacctgcat

SEQ ID NO: 582584 - DNA, 25 bp, Homo sapien
agcatgaggcttccaacctgcatca

SEQ ID NO: 582585 - DNA, 25 bp, Homo sapien
atgaggcttccaacctgcatcagta

SEQ ID NO: 582586 - DNA, 25 bp, Homo sapien
tgaggcttccaacctgcatcagtag

SEQ ID NO: 582587 - DNA, 25 bp, Homo sapien
aggcttccaacctgcatcagtagaa

SEQ ID NO: 582588 - DNA, 25 bp, Homo sapien
ggcttccaacctgcatcagtagaaa

SEQ ID NO: 582589 - DNA, 25 bp, Homo sapien
ttccaacctgcatcagtagaaaatg

SEQ ID NO: 582590 - DNA, 25 bp, Homo sapien
aacctgcatcagtagaaaatgacac

SEQ ID NO: 582591 - DNA, 25 bp, Homo sapien
agtagaaaatgacactggccaggtg

SEQ ID NO: 582592 - DNA, 25 bp, Homo sapien
aatgagctcgctttgaaaaccagtc

SEQ ID NO: 582593 - DNA, 25 bp, Homo sapien
ctcgctttgaaaaccagtcactcgg

SEQ ID NO: 582594 - DNA, 25 bp, Homo sapien
gaaaaccagtcactcggaaagggat

SEQ ID NO: 582595 - DNA, 25 bp, Homo sapien
cagtcactcggaaagggatggcatt

SEQ ID NO: 582596 - DNA, 25 bp, Homo sapien
cactcggaaagggatggcattttta

SEQ ID NO: 582597 - DNA, 25 bp, Homo sapien
ggcatttttatgcaacttggattga

SEQ ID NO: 582598 - DNA, 25 bp, Homo sapien
caacttggattgaaatggttttgct

SEQ ID NO: 582599 - DNA, 25 bp, Homo sapien
tggttttgctttagtattctactct

SEQ ID NO: 582600 - DNA, 25 bp, Homo sapien
gctttagtattctactctaattaga

SEQ ID NO: 582601 - DNA, 25 bp, Homo sapien
gaaagaatacaccacaggccgaaat

SEQ ID NO: 582602 - DNA, 25 bp, Homo sapien
gaatacaccacaggccgaaatagtt

SEQ ID NO: 582603 - DNA, 25 bp, Homo sapien
aaatctcaagggaaatgaatacaaa

SEQ ID NO: 582604 - DNA, 25 bp, Homo sapien
aacataaaaaattgtgggacacagc

SEQ ID NO: 582605 - DNA, 25 bp, Homo sapien
gagggaaatttagatttatgcacta

SEQ ID NO: 582606 - DNA, 25 bp, Homo sapien
aatttagatttatgcactaagtgca

SEQ ID NO: 582607 - DNA, 25 bp, Homo sapien
agaggaaaagtctcaaatccgtaat

SEQ ID NO: 582608 - DNA, 25 bp, Homo sapien
ggaaaagtctcaaatccgtaatcta

SEQ ID NO: 582609 - DNA, 25 bp, Homo sapien
gtctcaaatccgtaatctaagctat

SEQ ID NO: 582610 - DNA, 25 bp, Homo sapien
tcaaatccgtaatctaagctattag

SEQ ID NO: 582611 - DNA, 25 bp, Homo sapien
ctaagctattagagaacctagaaaa

SEQ ID NO: 582612 - DNA, 25 bp, Homo sapien
aacagtagagaatatcaatgaaaca

SEQ ID NO: 582613 - DNA, 25 bp, Homo sapien
tgaaacaaagaacttgtcctttaat

SEQ ID NO: 582614 - DNA, 25 bp, Homo sapien
gggaggctgaggccacttaggccag

SEQ ID NO: 582615 - DNA, 25 bp, Homo sapien
ggaggctgaggccacttaggccaga

SEQ ID NO: 582616 - DNA, 25 bp, Homo sapien
gaggctgaggccacttaggccagaa

SEQ ID NO: 582617 - DNA, 25 bp, Homo sapien
aggctgaggccacttaggccagaag

SEQ ID NO: 582618 - DNA, 25 bp, Homo sapien
ggctgaggccacttaggccagaagt

SEQ ID NO: 582619 - DNA, 25 bp, Homo sapien
gctgaggccacttaggccagaagtt

SEQ ID NO: 582620 - DNA, 25 bp, Homo sapien
ctgaggccacttaggccagaagttc

SEQ ID NO: 582621 - DNA, 25 bp, Homo sapien
tgaggccacttaggccagaagttca

SEQ ID NO: 582622 - DNA, 25 bp, Homo sapien
gaggccacttaggccagaagttcaa

SEQ ID NO: 582623 - DNA, 25 bp, Homo sapien
cttgtcaaaaatcaggctggagtgc

SEQ ID NO: 582624 - DNA, 25 bp, Homo sapien
ggcctgatcaagtttaagactgcat

SEQ ID NO: 582625 - DNA, 25 bp, Homo sapien
gcctgatcaagtttaagactgcatt

SEQ ID NO: 582626 - DNA, 25 bp, Homo sapien
ctgatcaagtttaagactgcattgc

SEQ ID NO: 582627 - DNA, 25 bp, Homo sapien
gatcaagtttaagactgcattgcac

SEQ ID NO: 582628 - DNA, 25 bp, Homo sapien
tcaagtttaagactgcattgcacca

SEQ ID NO: 582629 - DNA, 25 bp, Homo sapien
caagtttaagactgcattgcaccac

SEQ ID NO: 582630 - DNA, 25 bp, Homo sapien
aagtttaagactgcattgcaccaca

SEQ ID NO: 582631 - DNA, 25 bp, Homo sapien
agtttaagactgcattgcaccacag

SEQ ID NO: 582632 - DNA, 25 bp, Homo sapien
gtttaagactgcattgcaccacagc

SEQ ID NO: 582633 - DNA, 25 bp, Homo sapien
tttaagactgcattgcaccacagca

SEQ ID NO: 582634 - DNA, 25 bp, Homo sapien
ggagttgggcttaagaagtccaaga

SEQ ID NO: 582635 - DNA, 25 bp, Homo sapien
gagttgggcttaagaagtccaagat

SEQ ID NO: 582636 - DNA, 25 bp, Homo sapien
gggcttaagaagtccaagatgaggc

SEQ ID NO: 582637 - DNA, 25 bp, Homo sapien
ggcttaagaagtccaagatgaggct

SEQ ID NO: 582638 - DNA, 25 bp, Homo sapien
gcttaagaagtccaagatgaggctg

SEQ ID NO: 582639 - DNA, 25 bp, Homo sapien
cttaagaagtccaagatgaggctgg

SEQ ID NO: 582640 - DNA, 25 bp, Homo sapien
ttaagaagtccaagatgaggctggg

SEQ ID NO: 582641 - DNA, 25 bp, Homo sapien
taagaagtccaagatgaggctgggc

SEQ ID NO: 582642 - DNA, 25 bp, Homo sapien
aagaagtccaagatgaggctgggcg

SEQ ID NO: 582643 - DNA, 25 bp, Homo sapien
agaagtccaagatgaggctgggcgt

SEQ ID NO: 582644 - DNA, 25 bp, Homo sapien
gaagtccaagatgaggctgggcgtg

SEQ ID NO: 582645 - DNA, 25 bp, Homo sapien
atgtaacgcatgtggaaattccttt

SEQ ID NO: 582646 - DNA, 25 bp, Homo sapien
ggaaattcctttcgaaattccatgt

SEQ ID NO: 582647 - DNA, 25 bp, Homo sapien
tcctttcgaaattccatgtgctttc

SEQ ID NO: 582648 - DNA, 25 bp, Homo sapien
atgtgctttcatgatcgcttaaaaa

SEQ ID NO: 582649 - DNA, 25 bp, Homo sapien
gatcgcttaaaaactctcaccaaaa

SEQ ID NO: 582650 - DNA, 25 bp, Homo sapien
agccttcacttgtcattcagatctt

SEQ ID NO: 582651 - DNA, 25 bp, Homo sapien
tcacttgtcattcagatcttactaa

SEQ ID NO: 582652 - DNA, 25 bp, Homo sapien
atcttactaatcatgtgcgaattca

SEQ ID NO: 582653 - DNA, 25 bp, Homo sapien
aggccttccgtacatcctcaggacg

SEQ ID NO: 582654 - DNA, 25 bp, Homo sapien
acatcctcaggacgtattcaacatt

SEQ ID NO: 582655 - DNA, 25 bp, Homo sapien
ctcaggacgtattcaacatttaaga

SEQ ID NO: 582656 - DNA, 25 bp, Homo sapien
tccctctgtgccctaaagaggaagc

SEQ ID NO: 582657 - DNA, 25 bp, Homo sapien
cctaaagaggaagcaacactgccaa

SEQ ID NO: 582658 - DNA, 25 bp, Homo sapien
gaactcattctaaaagctgagcctt

SEQ ID NO: 582659 - DNA, 25 bp, Homo sapien
agctgagccttggaattctgtttga

SEQ ID NO: 582660 - DNA, 25 bp, Homo sapien
aattctgtttgaaatcacctacgga

SEQ ID NO: 582661 - DNA, 25 bp, Homo sapien
atcacctacggaaaacacacctgag

SEQ ID NO: 582662 - DNA, 25 bp, Homo sapien
gaaaattcctaaactctctctggga

SEQ ID NO: 582663 - DNA, 25 bp, Homo sapien
acatgttggaattttcgtggctcct

SEQ ID NO: 582664 - DNA, 25 bp, Homo sapien
gaattttcgtggctcctgccgtgac

SEQ ID NO: 582665 - DNA, 25 bp, Homo sapien
cctgccgtgacgaatgcctgaagaa

SEQ ID NO: 582666 - DNA, 25 bp, Homo sapien
gcaatcaccatggactaggagagaa

SEQ ID NO: 582667 - DNA, 25 bp, Homo sapien
cgttggccatgttacttaatctctc

SEQ ID NO: 582668 - DNA, 25 bp, Homo sapien
atctctctaatcctattttctcatc

SEQ ID NO: 582669 - DNA, 25 bp, Homo sapien
gaaagaatgcctaaatgcccagcta

SEQ ID NO: 582670 - DNA, 25 bp, Homo sapien
atgcccagctaatgtcagtgacact

SEQ ID NO: 582671 - DNA, 25 bp, Homo sapien
gtcagtgacacttcccattatcttg

SEQ ID NO: 582672 - DNA, 25 bp, Homo sapien
acacttcccattatcttgtcacagg

SEQ ID NO: 582673 - DNA, 25 bp, Homo sapien
ttgtcacagggtctgttatcactgt

SEQ ID NO: 582674 - DNA, 25 bp, Homo sapien
cccgagggctttgggcttgcagaaa

SEQ ID NO: 582675 - DNA, 25 bp, Homo sapien
agaagaggaggcagttcccttcttc

SEQ ID NO: 582676 - DNA, 25 bp, Homo sapien
ccaggatctcagttctttatcttag

SEQ ID NO: 582677 - DNA, 25 bp, Homo sapien
tactagctctgtgacgttggccatg

SEQ ID NO: 582678 - DNA, 25 bp, Homo sapien
gcgtgagcacgctgcacggcctaac

SEQ ID NO: 582679 - DNA, 25 bp, Homo sapien
cacggcctaaccaatctctttatat

SEQ ID NO: 582680 - DNA, 25 bp, Homo sapien
atattggttatttagattctcagtg

SEQ ID NO: 582681 - DNA, 25 bp, Homo sapien
tgctgaacacttaatgcctttgtgt

SEQ ID NO: 582682 - DNA, 25 bp, Homo sapien
tgaacacttaatgcctttgtgtctt

SEQ ID NO: 582683 - DNA, 25 bp, Homo sapien
gtgtcttgggctatattttgaatta

SEQ ID NO: 582684 - DNA, 25 bp, Homo sapien
gaattattctcatagatttctagaa

SEQ ID NO: 582685 - DNA, 25 bp, Homo sapien
ctagaagaggaattactgggcaaat

SEQ ID NO: 582686 - DNA, 25 bp, Homo sapien
attactgggcaaatagggacactta

SEQ ID NO: 582687 - DNA, 25 bp, Homo sapien
aatagcttttacaaaccatcttctg

SEQ ID NO: 582688 - DNA, 25 bp, Homo sapien
acaaaccatcttctgttctcattga

SEQ ID NO: 582689 - DNA, 25 bp, Homo sapien
tatcactgtagcaaagtgggtggta

SEQ ID NO: 582690 - DNA, 25 bp, Homo sapien
atcactgtagcaaagtgggtggtat

SEQ ID NO: 582691 - DNA, 25 bp, Homo sapien
tcactgtagcaaagtgggtggtatc

SEQ ID NO: 582692 - DNA, 25 bp, Homo sapien
cactgtagcaaagtgggtggtatca

SEQ ID NO: 582693 - DNA, 25 bp, Homo sapien
actgtagcaaagtgggtggtatcat

SEQ ID NO: 582694 - DNA, 25 bp, Homo sapien
ctgtagcaaagtgggtggtatcatt

SEQ ID NO: 582695 - DNA, 25 bp, Homo sapien
tgtagcaaagtgggtggtatcattg

SEQ ID NO: 582696 - DNA, 25 bp, Homo sapien
aagtgggtggtatcattgcctgccc

SEQ ID NO: 582697 - DNA, 25 bp, Homo sapien
agtgggtggtatcattgcctgccca

SEQ ID NO: 582698 - DNA, 25 bp, Homo sapien
ggaagtgtgtgcctcctcactacaa

SEQ ID NO: 582699 - DNA, 25 bp, Homo sapien
gtgcctcctcactacaaggaagcag

SEQ ID NO: 582700 - DNA, 25 bp, Homo sapien
atggatcctctcagggcccaacagc

SEQ ID NO: 582701 - DNA, 25 bp, Homo sapien
gaagcagagctctccaagggcgagt

SEQ ID NO: 582702 - DNA, 25 bp, Homo sapien
agtctgtgtgcctggaccgatgtgt

SEQ ID NO: 582703 - DNA, 25 bp, Homo sapien
gaccgatgtgtctctaagtacctgg

SEQ ID NO: 582704 - DNA, 25 bp, Homo sapien
agtacctggacatccatgagcggat

SEQ ID NO: 582705 - DNA, 25 bp, Homo sapien
gacagagttgtctatgcaggatgaa

SEQ ID NO: 582706 - DNA, 25 bp, Homo sapien
gagatgatggccgatatgtacaaca

SEQ ID NO: 582707 - DNA, 25 bp, Homo sapien
atgtacaacagaatgaccagtgcct

SEQ ID NO: 582708 - DNA, 25 bp, Homo sapien
accagtgcctgccaccggaagtgtg

SEQ ID NO: 582709 - DNA, 25 bp, Homo sapien
actttcaaaattacacagtcacagg

SEQ ID NO: 582710 - DNA, 25 bp, Homo sapien
tttcaaaattacacagtcacaggat

SEQ ID NO: 582711 - DNA, 25 bp, Homo sapien
ttcaaaattacacagtcacaggata

SEQ ID NO: 582712 - DNA, 25 bp, Homo sapien
caaaattacacagtcacaggataac

SEQ ID NO: 582713 - DNA, 25 bp, Homo sapien
aaattacacagtcacaggataacag

SEQ ID NO: 582714 - DNA, 25 bp, Homo sapien
aattacacagtcacaggataacagt

SEQ ID NO: 582715 - DNA, 25 bp, Homo sapien
attacacagtcacaggataacagtg

SEQ ID NO: 582716 - DNA, 25 bp, Homo sapien
tacacagtcacaggataacagtgag

SEQ ID NO: 582717 - DNA, 25 bp, Homo sapien
cacagtcacaggataacagtgagat

SEQ ID NO: 582718 - DNA, 25 bp, Homo sapien
agtcacaggataacagtgagatcca

SEQ ID NO: 582719 - DNA, 25 bp, Homo sapien
tcacaggataacagtgagatccact

SEQ ID NO: 582720 - DNA, 25 bp, Homo sapien
tcccatcagatcagcagcggtatta

SEQ ID NO: 582721 - DNA, 25 bp, Homo sapien
cccatcagatcagcagcggtattag

SEQ ID NO: 582722 - DNA, 25 bp, Homo sapien
ccatcagatcagcagcggtattaga

SEQ ID NO: 582723 - DNA, 25 bp, Homo sapien
catcagatcagcagcggtattagat

SEQ ID NO: 582724 - DNA, 25 bp, Homo sapien
tagattctcaaagaagcgtaagccc

SEQ ID NO: 582725 - DNA, 25 bp, Homo sapien
agattctcaaagaagcgtaagccct

SEQ ID NO: 582726 - DNA, 25 bp, Homo sapien
gattctcaaagaagcgtaagcccta

SEQ ID NO: 582727 - DNA, 25 bp, Homo sapien
attctcaaagaagcgtaagccctat

SEQ ID NO: 582728 - DNA, 25 bp, Homo sapien
ttctcaaagaagcgtaagccctatt

SEQ ID NO: 582729 - DNA, 25 bp, Homo sapien
cgagggatacaggttgcgagctcct

SEQ ID NO: 582730 - DNA, 25 bp, Homo sapien
ccagatggggccgtccagttgtagg

SEQ ID NO: 582731 - DNA, 25 bp, Homo sapien
gaataaatactcacagccgaagctc

SEQ ID NO: 582732 - DNA, 25 bp, Homo sapien
atactcacagccgaagctcttcaaa

SEQ ID NO: 582733 - DNA, 25 bp, Homo sapien
aagctcttcaaaagacttcaccgag

SEQ ID NO: 582734 - DNA, 25 bp, Homo sapien
caaaagacttcaccgagtacagagg

SEQ ID NO: 582735 - DNA, 25 bp, Homo sapien
gggagtttggatcccgctgcaggac

SEQ ID NO: 582736 - DNA, 25 bp, Homo sapien
ctgcaggacttccacttggtttgtg

SEQ ID NO: 582737 - DNA, 25 bp, Homo sapien
ttccacttggtttgtgttatcaaca

SEQ ID NO: 582738 - DNA, 25 bp, Homo sapien
gtgttatcaacaaggttgcttctga

SEQ ID NO: 582739 - DNA, 25 bp, Homo sapien
aggttgcttctgatcagcttgttga

SEQ ID NO: 582740 - DNA, 25 bp, Homo sapien
gcttctgatcagcttgttgagtaag

SEQ ID NO: 582741 - DNA, 25 bp, Homo sapien
tgagtaaggactgggcagctctgtc

SEQ ID NO: 582742 - DNA, 25 bp, Homo sapien
gaccctggaaccttctgtagctaag

SEQ ID NO: 582743 - DNA, 25 bp, Homo sapien
accctggaaccttctgtagctaaga

SEQ ID NO: 582744 - DNA, 25 bp, Homo sapien
ccctggaaccttctgtagctaagag

SEQ ID NO: 582745 - DNA, 25 bp, Homo sapien
cctggaaccttctgtagctaagagg

SEQ ID NO: 582746 - DNA, 25 bp, Homo sapien
tggaaccttctgtagctaagaggga

SEQ ID NO: 582747 - DNA, 25 bp, Homo sapien
ggaaccttctgtagctaagagggaa

SEQ ID NO: 582748 - DNA, 25 bp, Homo sapien
gaaccttctgtagctaagagggaat

SEQ ID NO: 582749 - DNA, 25 bp, Homo sapien
aaccttctgtagctaagagggaatc

SEQ ID NO: 582750 - DNA, 25 bp, Homo sapien
ccttctgtagctaagagggaatcct

SEQ ID NO: 582751 - DNA, 25 bp, Homo sapien
ttctgtagctaagagggaatcctgg

SEQ ID NO: 582752 - DNA, 25 bp, Homo sapien
ctgtagctaagagggaatcctggcc

SEQ ID NO: 582753 - DNA, 25 bp, Homo sapien
cccaggctgcgtgactgaggccaga

SEQ ID NO: 582754 - DNA, 25 bp, Homo sapien
gccagagggcccgtggagaaccact

SEQ ID NO: 582755 - DNA, 25 bp, Homo sapien
ccgtggagaaccactggagaggcca

SEQ ID NO: 582756 - DNA, 25 bp, Homo sapien
gagaggccagtgactgcacgagaac

SEQ ID NO: 582757 - DNA, 25 bp, Homo sapien
gtgactgcacgagaacgccaggcaa

SEQ ID NO: 582758 - DNA, 25 bp, Homo sapien
gcacgagaacgccaggcaacttact

SEQ ID NO: 582759 - DNA, 25 bp, Homo sapien
aggcaacttactaactctagtcagg

SEQ ID NO: 582760 - DNA, 25 bp, Homo sapien
tactaactctagtcaggcggctcag

SEQ ID NO: 582761 - DNA, 25 bp, Homo sapien
taactctagtcaggcggctcagaat

SEQ ID NO: 582762 - DNA, 25 bp, Homo sapien
agtcaggcggctcagaatctggcca

SEQ ID NO: 582763 - DNA, 25 bp, Homo sapien
aggcggctcagaatctggccacttc

SEQ ID NO: 582764 - DNA, 25 bp, Homo sapien
cccaccctgagttttgcaggtagga

SEQ ID NO: 582765 - DNA, 25 bp, Homo sapien
ccaccctgagttttgcaggtaggag

SEQ ID NO: 582766 - DNA, 25 bp, Homo sapien
gacaggatgaccagagagttgccac

SEQ ID NO: 582767 - DNA, 25 bp, Homo sapien
gagttgccactgagctgcagagctc

SEQ ID NO: 582768 - DNA, 25 bp, Homo sapien
gagctgcagagctccccagggacag

SEQ ID NO: 582769 - DNA, 25 bp, Homo sapien
cacctggtgctgacatggacgggca

SEQ ID NO: 582770 - DNA, 25 bp, Homo sapien
acatggacgggcaggtgtgaacacc

SEQ ID NO: 582771 - DNA, 25 bp, Homo sapien
gtgtgaacaccgaagggcccagcgc

SEQ ID NO: 582772 - DNA, 25 bp, Homo sapien
gtgaacaccgaagggcccagcgcag

SEQ ID NO: 582773 - DNA, 25 bp, Homo sapien
ggcccagcgcagctactggcagtaa

SEQ ID NO: 582774 - DNA, 25 bp, Homo sapien
cccagcgcagctactggcagtaaca

SEQ ID NO: 582775 - DNA, 25 bp, Homo sapien
ggtttcatgaaggacaatatctagc

SEQ ID NO: 582776 - DNA, 25 bp, Homo sapien
ggacaatatctagcatgagagtgac

SEQ ID NO: 582777 - DNA, 25 bp, Homo sapien
aatatctagcatgagagtgacaggg

SEQ ID NO: 582778 - DNA, 25 bp, Homo sapien
gggactgggtcctagcagaaatgat

SEQ ID NO: 582779 - DNA, 25 bp, Homo sapien
actgggtcctagcagaaatgatgga

SEQ ID NO: 582780 - DNA, 25 bp, Homo sapien
aacaggagtttggatgaatgggcat

SEQ ID NO: 582781 - DNA, 25 bp, Homo sapien
ggaggtgaaactagagcatgctgat

SEQ ID NO: 582782 - DNA, 25 bp, Homo sapien
actaaatgcactaactgtccacttt

SEQ ID NO: 582783 - DNA, 25 bp, Homo sapien
aatgcactaactgtccactttaaaa

SEQ ID NO: 582784 - DNA, 25 bp, Homo sapien
gcactaactgtccactttaaaatgt

SEQ ID NO: 582785 - DNA, 25 bp, Homo sapien
gtttagtaatatgtcgattttacct

SEQ ID NO: 582786 - DNA, 25 bp, Homo sapien
aagctggcctagcatggtggctcac

SEQ ID NO: 582787 - DNA, 25 bp, Homo sapien
gaggctgaggccacttaggccagaa

SEQ ID NO: 582788 - DNA, 25 bp, Homo sapien
aggctgaggccacttaggccagaag

SEQ ID NO: 582789 - DNA, 25 bp, Homo sapien
ggctgaggccacttaggccagaagt

SEQ ID NO: 582790 - DNA, 25 bp, Homo sapien
gctgaggccacttaggccagaagtt

SEQ ID NO: 582791 - DNA, 25 bp, Homo sapien
ctgaggccacttaggccagaagttc

SEQ ID NO: 582792 - DNA, 25 bp, Homo sapien
tgaggccacttaggccagaagttca

SEQ ID NO: 582793 - DNA, 25 bp, Homo sapien
gaggccacttaggccagaagttcaa

SEQ ID NO: 582794 - DNA, 25 bp, Homo sapien
gcctgggaacaaggtaaaacctcat

SEQ ID NO: 582795 - DNA, 25 bp, Homo sapien
ctgggaacaaggtaaaacctcatct

SEQ ID NO: 582796 - DNA, 25 bp, Homo sapien
tgggaacaaggtaaaacctcatctc

SEQ ID NO: 582797 - DNA, 25 bp, Homo sapien
ttttgattcccatgtatcacatgaa

SEQ ID NO: 582798 - DNA, 25 bp, Homo sapien
tttgattcccatgtatcacatgaat

SEQ ID NO: 582799 - DNA, 25 bp, Homo sapien
ttgattcccatgtatcacatgaatt

SEQ ID NO: 582800 - DNA, 25 bp, Homo sapien
tgattcccatgtatcacatgaatta

SEQ ID NO: 582801 - DNA, 25 bp, Homo sapien
gattcccatgtatcacatgaattac

SEQ ID NO: 582802 - DNA, 25 bp, Homo sapien
attcccatgtatcacatgaattaca

SEQ ID NO: 582803 - DNA, 25 bp, Homo sapien
ttcccatgtatcacatgaattacac

SEQ ID NO: 582804 - DNA, 25 bp, Homo sapien
tcccatgtatcacatgaattacact

SEQ ID NO: 582805 - DNA, 25 bp, Homo sapien
cccatgtatcacatgaattacactt

SEQ ID NO: 582806 - DNA, 25 bp, Homo sapien
ccatgtatcacatgaattacacttc

SEQ ID NO: 582807 - DNA, 25 bp, Homo sapien
ttgtttaccctcttaatttatccat

SEQ ID NO: 582808 - DNA, 25 bp, Homo sapien
ttaccctcttaatttatccatttgt

SEQ ID NO: 582809 - DNA, 25 bp, Homo sapien
ttaaagtgctctattacccttactt

SEQ ID NO: 582810 - DNA, 25 bp, Homo sapien
tgctctattacccttactttaaaag

SEQ ID NO: 582811 - DNA, 25 bp, Homo sapien
tactttaaaagtcctgtctaccata

SEQ ID NO: 582812 - DNA, 25 bp, Homo sapien
aaagtcctgtctaccatatatttaa

SEQ ID NO: 582813 - DNA, 25 bp, Homo sapien
aatgaagaaactctgaacttgcttt

SEQ ID NO: 582814 - DNA, 25 bp, Homo sapien
catattatatgcctaagattggaga

SEQ ID NO: 582815 - DNA, 25 bp, Homo sapien
ttataacctgattttctcatggcag

SEQ ID NO: 582816 - DNA, 25 bp, Homo sapien
ataacctgattttctcatggcagtg

SEQ ID NO: 582817 - DNA, 25 bp, Homo sapien
tattctgtaagtttttcaaaacagt

SEQ ID NO: 582818 - DNA, 25 bp, Homo sapien
tcccatcagatcagcagcggtatta

SEQ ID NO: 582819 - DNA, 25 bp, Homo sapien
cccatcagatcagcagcggtattag

SEQ ID NO: 582820 - DNA, 25 bp, Homo sapien
ccatcagatcagcagcggtattaga

SEQ ID NO: 582821 - DNA, 25 bp, Homo sapien
catcagatcagcagcggtattagat

SEQ ID NO: 582822 - DNA, 25 bp, Homo sapien
gcagcggtattagattctcaaagaa

SEQ ID NO: 582823 - DNA, 25 bp, Homo sapien
gattctcaaagaagcgtaagcccta

SEQ ID NO: 582824 - DNA, 25 bp, Homo sapien
attctcaaagaagcgtaagccctat

SEQ ID NO: 582825 - DNA, 25 bp, Homo sapien
aactgcacatgcgagggatacaggt

SEQ ID NO: 582826 - DNA, 25 bp, Homo sapien
cgagggatacaggttgcgagctcct

SEQ ID NO: 582827 - DNA, 25 bp, Homo sapien
gatacaggttgcgagctccttatga

SEQ ID NO: 582828 - DNA, 25 bp, Homo sapien
ccagatggggccgtccagttgtagg

SEQ ID NO: 582829 - DNA, 25 bp, Homo sapien
gagctgcagagctccccagggacag

SEQ ID NO: 582830 - DNA, 25 bp, Homo sapien
ctggtgctgacatggacgggcaggt

SEQ ID NO: 582831 - DNA, 25 bp, Homo sapien
gtgctgacatggacgggcaggtgtg

SEQ ID NO: 582832 - DNA, 25 bp, Homo sapien
gcaggtgtgaacaccgaagggccca

SEQ ID NO: 582833 - DNA, 25 bp, Homo sapien
gtgtgaacaccgaagggcccagcgc

SEQ ID NO: 582834 - DNA, 25 bp, Homo sapien
tgtgaacaccgaagggcccagcgca

SEQ ID NO: 582835 - DNA, 25 bp, Homo sapien
gtgaacaccgaagggcccagcgcag

SEQ ID NO: 582836 - DNA, 25 bp, Homo sapien
accgaagggcccagcgcagctactg

SEQ ID NO: 582837 - DNA, 25 bp, Homo sapien
agggcccagcgcagctactggcagt

SEQ ID NO: 582838 - DNA, 25 bp, Homo sapien
ggcccagcgcagctactggcagtaa

SEQ ID NO: 582839 - DNA, 25 bp, Homo sapien
cccagcgcagctactggcagtaaca

SEQ ID NO: 582840 - DNA, 25 bp, Homo sapien
aggacaatagccgagcccttattca

SEQ ID NO: 582841 - DNA, 25 bp, Homo sapien
tagccgagcccttattcaaagaatg

SEQ ID NO: 582842 - DNA, 25 bp, Homo sapien
atcacagatgacctatttgtatgga

SEQ ID NO: 582843 - DNA, 25 bp, Homo sapien
gtatggaatgttctgaatcgcgaag

SEQ ID NO: 582844 - DNA, 25 bp, Homo sapien
gaagtaaacatcatttgctgcgaga

SEQ ID NO: 582845 - DNA, 25 bp, Homo sapien
acatcatttgctgcgagaaggtgga

SEQ ID NO: 582846 - DNA, 25 bp, Homo sapien
gcaggatgctgctagagggatcatt

SEQ ID NO: 582847 - DNA, 25 bp, Homo sapien
gctgctagagggatcattcacatga

SEQ ID NO: 582848 - DNA, 25 bp, Homo sapien
agggttcagagtcctgtaacctctt

SEQ ID NO: 582849 - DNA, 25 bp, Homo sapien
ggagtggaactatcctctatttcag

SEQ ID NO: 582850 - DNA, 25 bp, Homo sapien
cctctatttcaggacttgaatggac

SEQ ID NO: 582851 - DNA, 25 bp, Homo sapien
aggcatcctgagattcatttataaa

SEQ ID NO: 582852 - DNA, 25 bp, Homo sapien
ttataaaatgccgtgattcaggtct

SEQ ID NO: 582853 - DNA, 25 bp, Homo sapien
aaatgccgtgattcaggtctcaggg

SEQ ID NO: 582854 - DNA, 25 bp, Homo sapien
gtgattcaggtctcagggcactgtc

SEQ ID NO: 582855 - DNA, 25 bp, Homo sapien
gattcaggtctcagggcactgtcgc

SEQ ID NO: 582856 - DNA, 25 bp, Homo sapien
aggtctcagggcactgtcgccccta

SEQ ID NO: 582857 - DNA, 25 bp, Homo sapien
tgtcgcccctactcactttgatgaa

SEQ ID NO: 582858 - DNA, 25 bp, Homo sapien
cccctactcactttgatgaagccag

SEQ ID NO: 582859 - DNA, 25 bp, Homo sapien
actcactttgatgaagccagtgctg

SEQ ID NO: 582860 - DNA, 25 bp, Homo sapien
ttgatgaagccagtgctgggttgct

SEQ ID NO: 582861 - DNA, 25 bp, Homo sapien
ccagtgctgggttgctgctgaggtg

SEQ ID NO: 582862 - DNA, 25 bp, Homo sapien
tctttttgaagagggatgttgttac

SEQ ID NO: 582863 - DNA, 25 bp, Homo sapien
gttgttacttttgaagcaattagtc

SEQ ID NO: 582864 - DNA, 25 bp, Homo sapien
attttgtagctctgatcttttcccc

SEQ ID NO: 582865 - DNA, 25 bp, Homo sapien
cctgcacccgacaggacagaaaggt

SEQ ID NO: 582866 - DNA, 25 bp, Homo sapien
acagtgagttctttgtagatcttat

SEQ ID NO: 582867 - DNA, 25 bp, Homo sapien
gtagatcttatacatgcacaacata

SEQ ID NO: 582868 - DNA, 25 bp, Homo sapien
caatgggctatttcattcctggtaa

SEQ ID NO: 582869 - DNA, 25 bp, Homo sapien
gggctatttcattcctggtaaaaca

SEQ ID NO: 582870 - DNA, 25 bp, Homo sapien
attcctggtaaaacagcagctggtt

SEQ ID NO: 582871 - DNA, 25 bp, Homo sapien
aaacagcagctggttagccactact

SEQ ID NO: 582872 - DNA, 25 bp, Homo sapien
agctggttagccactactggtgact

SEQ ID NO: 582873 - DNA, 25 bp, Homo sapien
gtttcttttaataatgtcacgagca

SEQ ID NO: 582874 - DNA, 25 bp, Homo sapien
taatgtcacgagcaccaatgagctt

SEQ ID NO: 582875 - DNA, 25 bp, Homo sapien
gagcaccaatgagcttactacccaa

SEQ ID NO: 582876 - DNA, 25 bp, Homo sapien
gagcttactacccaacttcaaaact

SEQ ID NO: 582877 - DNA, 25 bp, Homo sapien
actaggactctaacaataacttctg

SEQ ID NO: 582878 - DNA, 25 bp, Homo sapien
ataacttctgtcatatctcatcctg

SEQ ID NO: 582879 - DNA, 25 bp, Homo sapien
tctgtcatatctcatcctgtaacgc

SEQ ID NO: 582880 - DNA, 25 bp, Homo sapien
gctccttccgccaagataattatca

SEQ ID NO: 582881 - DNA, 25 bp, Homo sapien
ctcatttcttatgtgatggtaaaaa

SEQ ID NO: 582882 - DNA, 25 bp, Homo sapien
atgtgatggtaaaaatgcctttatt

SEQ ID NO: 582883 - DNA, 25 bp, Homo sapien
gcatagaaaggacatcaagctgtat

SEQ ID NO: 582884 - DNA, 25 bp, Homo sapien
tgcagggcagtgttcctggttccta

SEQ ID NO: 582885 - DNA, 25 bp, Homo sapien
ggcagtgttcctggttcctatcttg

SEQ ID NO: 582886 - DNA, 25 bp, Homo sapien
gcaggtgaagcctctgaacgggagc

SEQ ID NO: 582887 - DNA, 25 bp, Homo sapien
ggagccagacagagaaaacgccctc

SEQ ID NO: 582888 - DNA, 25 bp, Homo sapien
gaaaacgccctctgcaggatcttaa

SEQ ID NO: 582889 - DNA, 25 bp, Homo sapien
gccctctgcaggatcttaacagtag

SEQ ID NO: 582890 - DNA, 25 bp, Homo sapien
ggatcttaacagtagtctggacgaa

SEQ ID NO: 582891 - DNA, 25 bp, Homo sapien
tagtctggacgaagatacactgaat

SEQ ID NO: 582892 - DNA, 25 bp, Homo sapien
aaattgcaaatgatccaaagctgga

SEQ ID NO: 582893 - DNA, 25 bp, Homo sapien
aatgatccaaagctggaagacctga

SEQ ID NO: 582894 - DNA, 25 bp, Homo sapien
gatgttgggctgaatataaatcatt

SEQ ID NO: 582895 - DNA, 25 bp, Homo sapien
aaatcctgatgagaatttgtctctg

SEQ ID NO: 582896 - DNA, 25 bp, Homo sapien
gtctctgtttttttgcaggagtcag

SEQ ID NO: 582897 - DNA, 25 bp, Homo sapien
ggtgagaaagtttatgcctctgcac

SEQ ID NO: 582898 - DNA, 25 bp, Homo sapien
aagtttatgcctctgcacgagtttt

SEQ ID NO: 582899 - DNA, 25 bp, Homo sapien
tctgcacgagttttcactgctgggc

SEQ ID NO: 582900 - DNA, 25 bp, Homo sapien
agttttcactgctgggcctgggttg

SEQ ID NO: 582901 - DNA, 25 bp, Homo sapien
aagggcactgacaaatggatctcgt

SEQ ID NO: 582902 - DNA, 25 bp, Homo sapien
gatctcgtgtatttgttttccattg

SEQ ID NO: 582903 - DNA, 25 bp, Homo sapien
gttttccattgagtttccttgacat

SEQ ID NO: 582904 - DNA, 25 bp, Homo sapien
tgagtttccttgacatgctaatgag

SEQ ID NO: 582905 - DNA, 25 bp, Homo sapien
gacatgctaatgagaattccatatt

SEQ ID NO: 582906 - DNA, 25 bp, Homo sapien
atatgggccacataactataatgta

SEQ ID NO: 582907 - DNA, 25 bp, Homo sapien
atggattttcataagagcagctgtt

SEQ ID NO: 582908 - DNA, 25 bp, Homo sapien
gagcagctgttgtttcactaaggtt

SEQ ID NO: 582909 - DNA, 25 bp, Homo sapien
gctgttgtttcactaaggtttacat

SEQ ID NO: 582910 - DNA, 25 bp, Homo sapien
ttaggtcctagttttctgtttggag

SEQ ID NO: 582911 - DNA, 25 bp, Homo sapien
ctagttttctgtttggaggtgtatt

SEQ ID NO: 582912 - DNA, 25 bp, Homo sapien
aggtgtattaatgagttccttggtt

SEQ ID NO: 582913 - DNA, 25 bp, Homo sapien
ggttaatttattcccattctctata

SEQ ID NO: 582914 - DNA, 25 bp, Homo sapien
ttattcccattctctatatttctga

SEQ ID NO: 582915 - DNA, 25 bp, Homo sapien
tctgattcttaattgtatgatgtgg

SEQ ID NO: 582916 - DNA, 25 bp, Homo sapien
attcattgttttgacgtgataggaa

SEQ ID NO: 582917 - DNA, 25 bp, Homo sapien
aagacagttctgtgctggcagcatt

SEQ ID NO: 582918 - DNA, 25 bp, Homo sapien
gctggcagcatttgaagcacagaag

SEQ ID NO: 582919 - DNA, 25 bp, Homo sapien
gatgaaggaagaggcgccactgcta

SEQ ID NO: 582920 - DNA, 25 bp, Homo sapien
aggaagaggcgccactgctaaccaa

SEQ ID NO: 582921 - DNA, 25 bp, Homo sapien
ggcgccactgctaaccaaccaaggt

SEQ ID NO: 582922 - DNA, 25 bp, Homo sapien
aaggtccccatctgccctggatggt

SEQ ID NO: 582923 - DNA, 25 bp, Homo sapien
atctgccctggatggtatctctaaa

SEQ ID NO: 582924 - DNA, 25 bp, Homo sapien
ggtatctctaaaagccacctaaaga

SEQ ID NO: 582925 - DNA, 25 bp, Homo sapien
gcaaaattctctactgaaacgccag

SEQ ID NO: 582926 - DNA, 25 bp, Homo sapien
ttctctactgaaacgccaggtacga

SEQ ID NO: 582927 - DNA, 25 bp, Homo sapien
tactgaaacgccaggtacgaaggga

SEQ ID NO: 582928 - DNA, 25 bp, Homo sapien
atgtatttacagagaactcattaaa

SEQ ID NO: 582929 - DNA, 25 bp, Homo sapien
tttacagagaactcattaaaatcag

SEQ ID NO: 582930 - DNA, 25 bp, Homo sapien
gggccaagtatgttaaaatgtattg

SEQ ID NO: 582931 - DNA, 25 bp, Homo sapien
attggataattttcctatgatacta

SEQ ID NO: 582932 - DNA, 25 bp, Homo sapien
ataattttcctatgatactatctta

SEQ ID NO: 582933 - DNA, 25 bp, Homo sapien
aattttcctatgatactatcttaag

SEQ ID NO: 582934 - DNA, 25 bp, Homo sapien
ctatcttaagtatgtatttgtttgc

SEQ ID NO: 582935 - DNA, 25 bp, Homo sapien
tttcttttgaaaggattgtatcata

SEQ ID NO: 582936 - DNA, 25 bp, Homo sapien
ggattgtatcataaaagtggatgtt

SEQ ID NO: 582937 - DNA, 25 bp, Homo sapien
aagtggatgttgaatctctttataa

SEQ ID NO: 582938 - DNA, 25 bp, Homo sapien
ggatgttgaatctctttataaagat

SEQ ID NO: 582939 - DNA, 25 bp, Homo sapien
ccccggaagtggcacgaggtcagag

SEQ ID NO: 582940 - DNA, 25 bp, Homo sapien
cgaggtcagaggtgtgggatggcca

SEQ ID NO: 582941 - DNA, 25 bp, Homo sapien
gatggccagggaacgagcagctttc

SEQ ID NO: 582942 - DNA, 25 bp, Homo sapien
aggcccacgtgaggagtgaacatgt

SEQ ID NO: 582943 - DNA, 25 bp, Homo sapien
ccacgtgaggagtgaacatgtggct

SEQ ID NO: 582944 - DNA, 25 bp, Homo sapien
gaggagtgaacatgtggctggagat

SEQ ID NO: 582945 - DNA, 25 bp, Homo sapien
gaggacccagagtgatccccccagg

SEQ ID NO: 582946 - DNA, 25 bp, Homo sapien
ggacccagagtgatccccccaggtg

SEQ ID NO: 582947 - DNA, 25 bp, Homo sapien
cttaggaacagggaaagcccagatc

SEQ ID NO: 582948 - DNA, 25 bp, Homo sapien
taggaacagggaaagcccagatctg

SEQ ID NO: 582949 - DNA, 25 bp, Homo sapien
tgagaagggaggcacatcctgaggg

SEQ ID NO: 582950 - DNA, 25 bp, Homo sapien
gggacataatcactgcgtaatcttc

SEQ ID NO: 582951 - DNA, 25 bp, Homo sapien
taatcactgcgtaatcttccctctt

SEQ ID NO: 582952 - DNA, 25 bp, Homo sapien
tcaaattcctgcacggacctgggac

SEQ ID NO: 582953 - DNA, 25 bp, Homo sapien
gacctgggacttggaggatagcaaa

SEQ ID NO: 582954 - DNA, 25 bp, Homo sapien
tcctctgcctggtaatgactccaga

SEQ ID NO: 582955 - DNA, 25 bp, Homo sapien
ggtaatgactccagaacaacaactg

SEQ ID NO: 582956 - DNA, 25 bp, Homo sapien
gaaacttgaagtcgacaatctggtt

SEQ ID NO: 582957 - DNA, 25 bp, Homo sapien
aagcgggtgttggattttctcagat

SEQ ID NO: 582958 - DNA, 25 bp, Homo sapien
ggattttctcagatgcctttacacg

SEQ ID NO: 582959 - DNA, 25 bp, Homo sapien
gcctttacacgctgatgggactgga

SEQ ID NO: 582960 - DNA, 25 bp, Homo sapien
ttcagcacgagcacactgcatctct

SEQ ID NO: 582961 - DNA, 25 bp, Homo sapien
atgatattctgctctcgcaagactt

SEQ ID NO: 582962 - DNA, 25 bp, Homo sapien
gcaagacttcagtgaacatccctga

SEQ ID NO: 582963 - DNA, 25 bp, Homo sapien
ggccatttcaagcatgggcgagttt

SEQ ID NO: 582964 - DNA, 25 bp, Homo sapien
accaaggagttgaattgctgcgtct

SEQ ID NO: 582965 - DNA, 25 bp, Homo sapien
aattgctgcgtctgagggcatgtgc

SEQ ID NO: 582966 - DNA, 25 bp, Homo sapien
ttttggagatgatacagactgccct

SEQ ID NO: 582967 - DNA, 25 bp, Homo sapien
acagacagggaaccaattttcactc

SEQ ID NO: 582968 - DNA, 25 bp, Homo sapien
ttcactcccggcaataatgtctaga

SEQ ID NO: 582969 - DNA, 25 bp, Homo sapien
atgtctagaacgtgagccattcgtg

SEQ ID NO: 582970 - DNA, 25 bp, Homo sapien
gccattcgtgtgatgaccgaggtta

SEQ ID NO: 582971 - DNA, 25 bp, Homo sapien
gaggttactgtatattgagcattca

SEQ ID NO: 582972 - DNA, 25 bp, Homo sapien
gctgcaagaaccatcttttctatga

SEQ ID NO: 582973 - DNA, 25 bp, Homo sapien
gttacattttctgaaacgtagcaaa

SEQ ID NO: 582974 - DNA, 25 bp, Homo sapien
caaaagattctttggtggcctctgt

SEQ ID NO: 582975 - DNA, 25 bp, Homo sapien
gtggcctctgtttcttgttcccttt

SEQ ID NO: 582976 - DNA, 25 bp, Homo sapien
ttgttccctttctagatgtgtgctt

SEQ ID NO: 582977 - DNA, 25 bp, Homo sapien
agatgtgtgcttttctcagctgttt

SEQ ID NO: 582978 - DNA, 25 bp, Homo sapien
tttgggaccaaagggattgttgacg

SEQ ID NO: 582979 - DNA, 25 bp, Homo sapien
ggattgttgacgttttcccagcaat

SEQ ID NO: 582980 - DNA, 25 bp, Homo sapien
gttttcccagcaatcttaatctcat

SEQ ID NO: 582981 - DNA, 25 bp, Homo sapien
ttaatctcatgactatgttcttctc

SEQ ID NO: 582982 - DNA, 25 bp, Homo sapien
tgttcttctcccaaacaaggattga

SEQ ID NO: 582983 - DNA, 25 bp, Homo sapien
aggtgtgtaaggacatttactttct

SEQ ID NO: 582984 - DNA, 25 bp, Homo sapien
ggacatttactttctaaagctaagt

SEQ ID NO: 582985 - DNA, 25 bp, Homo sapien
aaagctaagtcataacaagcataga

SEQ ID NO: 582986 - DNA, 25 bp, Homo sapien
caagcatagacaaagcaccccaaat

SEQ ID NO: 582987 - DNA, 25 bp, Homo sapien
gcaccccaaatgtttctctgaatgt

SEQ ID NO: 582988 - DNA, 25 bp, Homo sapien
aatgtaatgtttaggatctctgcgc

SEQ ID NO: 582989 - DNA, 25 bp, Homo sapien
atgtttaggatctctgcgctaggtc

SEQ ID NO: 582990 - DNA, 25 bp, Homo sapien
aggatctctgcgctaggtcgtttac

SEQ ID NO: 582991 - DNA, 25 bp, Homo sapien
gctaggtcgtttaccgctatttatt

SEQ ID NO: 582992 - DNA, 25 bp, Homo sapien
ggtgttacactatttgagtgccctt

SEQ ID NO: 582993 - DNA, 25 bp, Homo sapien
gagtgcccttaagtggcaaaattta

SEQ ID NO: 582994 - DNA, 25 bp, Homo sapien
gtagctctaagtgctgggccaggca

SEQ ID NO: 582995 - DNA, 25 bp, Homo sapien
ccaggcaccccaggtttagatgaaa

SEQ ID NO: 582996 - DNA, 25 bp, Homo sapien
atgtgtttacatcagaccgaggtta

SEQ ID NO: 582997 - DNA, 25 bp, Homo sapien
cagaccgaggttatacttacatttt

SEQ ID NO: 582998 - DNA, 25 bp, Homo sapien
gggactcagcaagggctgctcttta

SEQ ID NO: 582999 - DNA, 25 bp, Homo sapien
gctgctctttattaatgggctggtc

SEQ ID NO: 583000 - DNA, 25 bp, Homo sapien
gggctggtcgttgctgtttttaaga

SEQ ID NO: 583001 - DNA, 25 bp, Homo sapien
gagtgtcattaaccctaacatacgg

SEQ ID NO: 583002 - DNA, 25 bp, Homo sapien
atacgggctccttgtgtaattgaac

SEQ ID NO: 583003 - DNA, 25 bp, Homo sapien
tgattatgatcccaactgccatctc

SEQ ID NO: 583004 - DNA, 25 bp, Homo sapien
tctccaggcacttcttggaacacaa

SEQ ID NO: 583005 - DNA, 25 bp, Homo sapien
gcagtgggcacgtattcctctggga

SEQ ID NO: 583006 - DNA, 25 bp, Homo sapien
cagtgggcacgtattcctctgggac

SEQ ID NO: 583007 - DNA, 25 bp, Homo sapien
agtgggcacgtattcctctgggacg

SEQ ID NO: 583008 - DNA, 25 bp, Homo sapien
gaggcaagcaacacttgctcggact

SEQ ID NO: 583009 - DNA, 25 bp, Homo sapien
gcaagcaacacttgctcggactgta

SEQ ID NO: 583010 - DNA, 25 bp, Homo sapien
aagcaacacttgctcggactgtatg

SEQ ID NO: 583011 - DNA, 25 bp, Homo sapien
gcaacacttgctcggactgtatgac

SEQ ID NO: 583012 - DNA, 25 bp, Homo sapien
aacacttgctcggactgtatgacac

SEQ ID NO: 583013 - DNA, 25 bp, Homo sapien
acacttgctcggactgtatgacacc

SEQ ID NO: 583014 - DNA, 25 bp, Homo sapien
acttgctcggactgtatgacaccgc

SEQ ID NO: 583015 - DNA, 25 bp, Homo sapien
ttgctcggactgtatgacaccgcgg

SEQ ID NO: 583016 - DNA, 25 bp, Homo sapien
cagggcttgcttttacctacccact

SEQ ID NO: 583017 - DNA, 25 bp, Homo sapien
ccactcctagctctttaactgtagg

SEQ ID NO: 583018 - DNA, 25 bp, Homo sapien
tctgtttgaggcatagagcaactgc

SEQ ID NO: 583019 - DNA, 25 bp, Homo sapien
gagcaactgcattgagggacatttt

SEQ ID NO: 583020 - DNA, 25 bp, Homo sapien
ggacattttgatcccaaggcatatt

SEQ ID NO: 583021 - DNA, 25 bp, Homo sapien
gatcccaaggcatatttctcctaga

SEQ ID NO: 583022 - DNA, 25 bp, Homo sapien
atttctcctagaccctacagcactg

SEQ ID NO: 583023 - DNA, 25 bp, Homo sapien
agcactgccattggccatggccatg

SEQ ID NO: 583024 - DNA, 25 bp, Homo sapien
catggccatggcaacatgctcagtt

SEQ ID NO: 583025 - DNA, 25 bp, Homo sapien
agtcagcattatctctgagtccacc

SEQ ID NO: 583026 - DNA, 25 bp, Homo sapien
tctctgagtccaccagaagttgtgc

SEQ ID NO: 583027 - DNA, 25 bp, Homo sapien
aatggagtgtcatctaatggaccag

SEQ ID NO: 583028 - DNA, 25 bp, Homo sapien
atgcttcttccagttcatttttcag

SEQ ID NO: 583029 - DNA, 25 bp, Homo sapien
ttcagccatcagttcaagagccaat

SEQ ID NO: 583030 - DNA, 25 bp, Homo sapien
gttcaagagccaatgcctttttaaa

SEQ ID NO: 583031 - DNA, 25 bp, Homo sapien
gtttttaatggctcaactgtctgat

SEQ ID NO: 583032 - DNA, 25 bp, Homo sapien
atggctcaactgtctgatgtaattg

SEQ ID NO: 583033 - DNA, 25 bp, Homo sapien
tgaaggtttgcactgagaaattagc

SEQ ID NO: 583034 - DNA, 25 bp, Homo sapien
gaaattagcattcaggccttacccc

SEQ ID NO: 583035 - DNA, 25 bp, Homo sapien
aacatatgttcggactgcttccctt

SEQ ID NO: 583036 - DNA, 25 bp, Homo sapien
tgcttcccttcaccaatgtgaacaa

SEQ ID NO: 583037 - DNA, 25 bp, Homo sapien
aagccactttgcaacacttgacttc

SEQ ID NO: 583038 - DNA, 25 bp, Homo sapien
aagggaccacctcttgtcataaaca

SEQ ID NO: 583039 - DNA, 25 bp, Homo sapien
gcacatgaacaagtgaccacgggtt

SEQ ID NO: 583040 - DNA, 25 bp, Homo sapien
gaccacgggtttaacttgtacacag

SEQ ID NO: 583041 - DNA, 25 bp, Homo sapien
ggtttaacttgtacacaggtattat

SEQ ID NO: 583042 - DNA, 25 bp, Homo sapien
ttatgaaaacaacaagtctgcattt

SEQ ID NO: 583043 - DNA, 25 bp, Homo sapien
aatgaacgggactgttcccagagcc

SEQ ID NO: 583044 - DNA, 25 bp, Homo sapien
actgttcccagagcctgctgcttgg

SEQ ID NO: 583045 - DNA, 25 bp, Homo sapien
ggaagctagggaataaggaactcaa

SEQ ID NO: 583046 - DNA, 25 bp, Homo sapien
gagtcgtgaccttgggtcaaaggta

SEQ ID NO: 583047 - DNA, 25 bp, Homo sapien
aaaggtaggctgaccgatgctggca

SEQ ID NO: 583048 - DNA, 25 bp, Homo sapien
taggctgaccgatgctggcagaaga

SEQ ID NO: 583049 - DNA, 25 bp, Homo sapien
agaagctcaacgaagtgatctgcaa

SEQ ID NO: 583050 - DNA, 25 bp, Homo sapien
caacgaagtgatctgcaaataattt

SEQ ID NO: 583051 - DNA, 25 bp, Homo sapien
aatttttagcactggaagattagcc

SEQ ID NO: 583052 - DNA, 25 bp, Homo sapien
aagattagccatttgccattgggtc

SEQ ID NO: 583053 - DNA, 25 bp, Homo sapien
gccatttgccattgggtcttttcaa

SEQ ID NO: 583054 - DNA, 25 bp, Homo sapien
ttgggtcttttcaatgcaagcagga

SEQ ID NO: 583055 - DNA, 25 bp, Homo sapien
caatgcaagcaggagtgttagagta

SEQ ID NO: 583056 - DNA, 25 bp, Homo sapien
gttaaaaacaccataaagcccatga

SEQ ID NO: 583057 - DNA, 25 bp, Homo sapien
accataaagcccatgagaacacaga

SEQ ID NO: 583058 - DNA, 25 bp, Homo sapien
gaatgctctccagccatacagtttc

SEQ ID NO: 583059 - DNA, 25 bp, Homo sapien
tgctctccagccatacagtttcagc

SEQ ID NO: 583060 - DNA, 25 bp, Homo sapien
tattttctgagaagacagcgttttc

SEQ ID NO: 583061 - DNA, 25 bp, Homo sapien
ttcttctatatttctttccgagccc

SEQ ID NO: 583062 - DNA, 25 bp, Homo sapien
atttctttccgagccctcacgagaa

SEQ ID NO: 583063 - DNA, 25 bp, Homo sapien
gagccctcacgagaattggctttta

SEQ ID NO: 583064 - DNA, 25 bp, Homo sapien
aaattttttccacagtaatctagca

SEQ ID NO: 583065 - DNA, 25 bp, Homo sapien
aaaacctcatcaatctctgccaatc

SEQ ID NO: 583066 - DNA, 25 bp, Homo sapien
atcaatctctgccaatcactgagcc

SEQ ID NO: 583067 - DNA, 25 bp, Homo sapien
tttataataacagcactcccacttc

SEQ ID NO: 583068 - DNA, 25 bp, Homo sapien
actcccacttctcatgatcaatttc

SEQ ID NO: 583069 - DNA, 25 bp, Homo sapien
atgatcaatttccatcttcagcagt

SEQ ID NO: 583070 - DNA, 25 bp, Homo sapien
gctttaataaagttccataacctga

SEQ ID NO: 583071 - DNA, 25 bp, Homo sapien
aaatggctggtttgtaagatccttg

SEQ ID NO: 583072 - DNA, 25 bp, Homo sapien
tggtttgtaagatccttgaggtcag

SEQ ID NO: 583073 - DNA, 25 bp, Homo sapien
gaggtcagggattatttttatcttg

SEQ ID NO: 583074 - DNA, 25 bp, Homo sapien
cagggattatttttatcttgttctc

SEQ ID NO: 583075 - DNA, 25 bp, Homo sapien
tatcttgttctcttttgtaatccca

SEQ ID NO: 583076 - DNA, 25 bp, Homo sapien
tgttctcttttgtaatcccagtgcc

SEQ ID NO: 583077 - DNA, 25 bp, Homo sapien
cttttgtaatcccagtgcctagtac

SEQ ID NO: 583078 - DNA, 25 bp, Homo sapien
tgtaatcccagtgcctagtacaatg

SEQ ID NO: 583079 - DNA, 25 bp, Homo sapien
tgcctgactcaatcaatgtgaatga

SEQ ID NO: 583080 - DNA, 25 bp, Homo sapien
aatgaatcaatggtcaaactaatga

SEQ ID NO: 583081 - DNA, 25 bp, Homo sapien
ctgaatgaaaatgatgaggcacttt

SEQ ID NO: 583082 - DNA, 25 bp, Homo sapien
gattacaggaggcccccaccacacc

SEQ ID NO: 583083 - DNA, 25 bp, Homo sapien
attacaggaggcccccaccacacct

SEQ ID NO: 583084 - DNA, 25 bp, Homo sapien
acaggaggcccccaccacacctggc

SEQ ID NO: 583085 - DNA, 25 bp, Homo sapien
caggaggcccccaccacacctggct

SEQ ID NO: 583086 - DNA, 25 bp, Homo sapien
gacctcgggtgatcctcacacctcg

SEQ ID NO: 583087 - DNA, 25 bp, Homo sapien
acctcgggtgatcctcacacctcgg

SEQ ID NO: 583088 - DNA, 25 bp, Homo sapien
cctcgggtgatcctcacacctcggc

SEQ ID NO: 583089 - DNA, 25 bp, Homo sapien
tcgggtgatcctcacacctcggcct

SEQ ID NO: 583090 - DNA, 25 bp, Homo sapien
gatcctcacacctcggcctctcaaa

SEQ ID NO: 583091 - DNA, 25 bp, Homo sapien
ctctcaaagtactgggattgcaggt

SEQ ID NO: 583092 - DNA, 25 bp, Homo sapien
tctcaaagtactgggattgcaggtg

SEQ ID NO: 583093 - DNA, 25 bp, Homo sapien
agttaaccttgcaactccacaaaca

SEQ ID NO: 583094 - DNA, 25 bp, Homo sapien
caaacagaccactttacacacttgc

SEQ ID NO: 583095 - DNA, 25 bp, Homo sapien
ttttgcttgcccctcctctgaaatg

SEQ ID NO: 583096 - DNA, 25 bp, Homo sapien
aatgctctctacaggtgattaagtg

SEQ ID NO: 583097 - DNA, 25 bp, Homo sapien
tgattaagtggcttttccctttact

SEQ ID NO: 583098 - DNA, 25 bp, Homo sapien
ctttacttaggtgtctactcaggta

SEQ ID NO: 583099 - DNA, 25 bp, Homo sapien
ttacttaaaatgtccctctgcccca

SEQ ID NO: 583100 - DNA, 25 bp, Homo sapien
ccaccctgaggcttttaacttgcat

SEQ ID NO: 583101 - DNA, 25 bp, Homo sapien
gcttttaacttgcatagccctcatc

SEQ ID NO: 583102 - DNA, 25 bp, Homo sapien
tagccctcatcatcacctgacataa

SEQ ID NO: 583103 - DNA, 25 bp, Homo sapien
tatctgtgtccctccactaggatgt

SEQ ID NO: 583104 - DNA, 25 bp, Homo sapien
tggagcagcgcatgcgagcctgtta

SEQ ID NO: 583105 - DNA, 25 bp, Homo sapien
atgcgagcctgttactacagcctgg

SEQ ID NO: 583106 - DNA, 25 bp, Homo sapien
gagcctgttactacagcctggccag

SEQ ID NO: 583107 - DNA, 25 bp, Homo sapien
atgtgggaggccttgtcctacggcc

SEQ ID NO: 583108 - DNA, 25 bp, Homo sapien
gaggccttgtcctacggccagaagc

SEQ ID NO: 583109 - DNA, 25 bp, Homo sapien
aaagggccggaggtcatggccttca

SEQ ID NO: 583110 - DNA, 25 bp, Homo sapien
ggccggaggtcatggccttcatcga

SEQ ID NO: 583111 - DNA, 25 bp, Homo sapien
acccgaactgtacgcactcatgagt

SEQ ID NO: 583112 - DNA, 25 bp, Homo sapien
cactcatgagtgactgctggatcta

SEQ ID NO: 583113 - DNA, 25 bp, Homo sapien
catgagtgactgctggatctacaag

SEQ ID NO: 583114 - DNA, 25 bp, Homo sapien
actgctggatctacaagtgggagga

SEQ ID NO: 583115 - DNA, 25 bp, Homo sapien
gtgtgtctgacaccatgcctttgca

SEQ ID NO: 583116 - DNA, 25 bp, Homo sapien
tgcctttgcacctttccatgaaatg

SEQ ID NO: 583117 - DNA, 25 bp, Homo sapien
gaaatgacactcactggtctttgca

SEQ ID NO: 583118 - DNA, 25 bp, Homo sapien
actggtctttgcatcgtgggcataa

SEQ ID NO: 583119 - DNA, 25 bp, Homo sapien
cgtgggcataaaatgttcacctttt

SEQ ID NO: 583120 - DNA, 25 bp, Homo sapien
gatgagtacacccagaatgctaatt

SEQ ID NO: 583121 - DNA, 25 bp, Homo sapien
taatttttctgtccatcgtgtacgc

SEQ ID NO: 583122 - DNA, 25 bp, Homo sapien
gtacgctattctagtgcttgtggcc

SEQ ID NO: 583123 - DNA, 25 bp, Homo sapien
ttgtggcccagtactgtctatgagt

SEQ ID NO: 583124 - DNA, 25 bp, Homo sapien
actgtctatgagttgtcgtgctcct

SEQ ID NO: 583125 - DNA, 25 bp, Homo sapien
ccccacaagtcgtccagtagaaatg

SEQ ID NO: 583126 - DNA, 25 bp, Homo sapien
agttgtctttgtggagagggtctta

SEQ ID NO: 583127 - DNA, 25 bp, Homo sapien
gggtcttagacaaaaatcttccttg

SEQ ID NO: 583128 - DNA, 25 bp, Homo sapien
agtccaaattcttacagtatgctat

SEQ ID NO: 583129 - DNA, 25 bp, Homo sapien
tacagtatgctatttcaggatttct

SEQ ID NO: 583130 - DNA, 25 bp, Homo sapien
gtatgctatttcaggatttctgata

SEQ ID NO: 583131 - DNA, 25 bp, Homo sapien
ttatatctcttattaacacttcccc

SEQ ID NO: 583132 - DNA, 25 bp, Homo sapien
tcttattaacacttcccccaagaag

SEQ ID NO: 583133 - DNA, 25 bp, Homo sapien
ccccaagaagggttgtgctgttatt

SEQ ID NO: 583134 - DNA, 25 bp, Homo sapien
agaagggttgtgctgttatttattt

SEQ ID NO: 583135 - DNA, 25 bp, Homo sapien
ttacctctaatctaatttcatacca

SEQ ID NO: 583136 - DNA, 25 bp, Homo sapien
atttcataccaaatacctgatcaat

SEQ ID NO: 583137 - DNA, 25 bp, Homo sapien
aaagctacacagacagagagtgcat

SEQ ID NO: 583138 - DNA, 25 bp, Homo sapien
gtgcatgggctgaagaatactctga

SEQ ID NO: 583139 - DNA, 25 bp, Homo sapien
agaaagggtctcacaagcgctcagc

SEQ ID NO: 583140 - DNA, 25 bp, Homo sapien
tctcacaagcgctcagcatcttggg

SEQ ID NO: 583141 - DNA, 25 bp, Homo sapien
gtacagatcaacttaaggaggtcag

SEQ ID NO: 583142 - DNA, 25 bp, Homo sapien
aaaatggttctaagatagtgggtgt

SEQ ID NO: 583143 - DNA, 25 bp, Homo sapien
gtgtggaaatatgatccttttgttg

SEQ ID NO: 583144 - DNA, 25 bp, Homo sapien
ggctatttccttgatattatgggca

SEQ ID NO: 583145 - DNA, 25 bp, Homo sapien
tatttccttgatattatgggcagca

SEQ ID NO: 583146 - DNA, 25 bp, Homo sapien
atgggcagcaaggatttgtcgtttt

SEQ ID NO: 583147 - DNA, 25 bp, Homo sapien
caaggatttgtcgttttccattgat

SEQ ID NO: 583148 - DNA, 25 bp, Homo sapien
catcctgttttaaccacaaggagca

SEQ ID NO: 583149 - DNA, 25 bp, Homo sapien
taaccacaaggagcagaaagatctg

SEQ ID NO: 583150 - DNA, 25 bp, Homo sapien
agaattttatcagaagaacttcaac

SEQ ID NO: 583151 - DNA, 25 bp, Homo sapien
ataaaattcaccataaacttaactg

SEQ ID NO: 583152 - DNA, 25 bp, Homo sapien
gtagttgaattacctgttcaatatt

SEQ ID NO: 583153 - DNA, 25 bp, Homo sapien
gaattacctgttcaatattgtatga

SEQ ID NO: 583154 - DNA, 25 bp, Homo sapien
atgtgttcacagtaaaccttttgca

SEQ ID NO: 583155 - DNA, 25 bp, Homo sapien
gttcacagtaaaccttttgcaaatg

SEQ ID NO: 583156 - DNA, 25 bp, Homo sapien
acagtaaaccttttgcaaatgtcac

SEQ ID NO: 583157 - DNA, 25 bp, Homo sapien
aatgtcacaggaatgtgtggaagcc

SEQ ID NO: 583158 - DNA, 25 bp, Homo sapien
tcacaggaatgtgtggaagccaaat

SEQ ID NO: 583159 - DNA, 25 bp, Homo sapien
gacagaagcttgtaatcagccacat

SEQ ID NO: 583160 - DNA, 25 bp, Homo sapien
cttgtaatcagccacattggaggat

SEQ ID NO: 583161 - DNA, 25 bp, Homo sapien
ggaaggcctgtcatctgttttgaaa

SEQ ID NO: 583162 - DNA, 25 bp, Homo sapien
atctgttttgaaacgtgttacgaca

SEQ ID NO: 583163 - DNA, 25 bp, Homo sapien
gtgttacgacaagatgttacatttc

SEQ ID NO: 583164 - DNA, 25 bp, Homo sapien
tacatttctggaaacctgggtgcag

SEQ ID NO: 583165 - DNA, 25 bp, Homo sapien
gaagttgctggagggtccttcgtca

SEQ ID NO: 583166 - DNA, 25 bp, Homo sapien
gggtccttcgtcaggagacagtata

SEQ ID NO: 583167 - DNA, 25 bp, Homo sapien
agtgcaataattattcagtctcttt

SEQ ID NO: 583168 - DNA, 25 bp, Homo sapien
ctttctcagtattaagccaatgtac

SEQ ID NO: 583169 - DNA, 25 bp, Homo sapien
aataattacacatctgcttctatag

SEQ ID NO: 583170 - DNA, 25 bp, Homo sapien
aacggcatcactagatcaagatttg

SEQ ID NO: 583171 - DNA, 25 bp, Homo sapien
actagatcaagatttggcctcccgt

SEQ ID NO: 583172 - DNA, 25 bp, Homo sapien
agatcaagatttggcctcccgtggc

SEQ ID NO: 583173 - DNA, 25 bp, Homo sapien
aattcctcaattgagaggtgcctta

SEQ ID NO: 583174 - DNA, 25 bp, Homo sapien
gaaataagatttctcaggcccagtg

SEQ ID NO: 583175 - DNA, 25 bp, Homo sapien
tcaggcccagtgagtagtagttgtt

SEQ ID NO: 583176 - DNA, 25 bp, Homo sapien
agtagtagttgttggttggtacgca

SEQ ID NO: 583177 - DNA, 25 bp, Homo sapien
ttgttggttggtacgcagaggattc

SEQ ID NO: 583178 - DNA, 25 bp, Homo sapien
gtacgcagaggattccaaatgacat

SEQ ID NO: 583179 - DNA, 25 bp, Homo sapien
aaatcttctcattagtccaggtaca

SEQ ID NO: 583180 - DNA, 25 bp, Homo sapien
agtggctcatacctggacagccagc

SEQ ID NO: 583181 - DNA, 25 bp, Homo sapien
gctcattaaaggtcactgctgcttc

SEQ ID NO: 583182 - DNA, 25 bp, Homo sapien
aaggtcactgctgcttcaaaggact

SEQ ID NO: 583183 - DNA, 25 bp, Homo sapien
tggatgccattcataaccacagatg

SEQ ID NO: 583184 - DNA, 25 bp, Homo sapien
atcagctatttatccaaattacagg

SEQ ID NO: 583185 - DNA, 25 bp, Homo sapien
atagttttaagtttgatggtctcca

SEQ ID NO: 583186 - DNA, 25 bp, Homo sapien
gatggtctccattcaggcaagtgtg

SEQ ID NO: 583187 - DNA, 25 bp, Homo sapien
tctccattcaggcaagtgtgtttca

SEQ ID NO: 583188 - DNA, 25 bp, Homo sapien
gtgtgtttcagcaaatctctagaaa

SEQ ID NO: 583189 - DNA, 25 bp, Homo sapien
aggctgttctggaagttctagacat

SEQ ID NO: 583190 - DNA, 25 bp, Homo sapien
aagttctagacatggcaataaggca

SEQ ID NO: 583191 - DNA, 25 bp, Homo sapien
aaagagattaaatgcatacagacct

SEQ ID NO: 583192 - DNA, 25 bp, Homo sapien
aaagctacacagacagagagtgcat

SEQ ID NO: 583193 - DNA, 25 bp, Homo sapien
agctacacagacagagagtgcatgg

SEQ ID NO: 583194 - DNA, 25 bp, Homo sapien
tacacagacagagagtgcatgggct

SEQ ID NO: 583195 - DNA, 25 bp, Homo sapien
cacagacagagagtgcatgggctga

SEQ ID NO: 583196 - DNA, 25 bp, Homo sapien
acagacagagagtgcatgggctgaa

SEQ ID NO: 583197 - DNA, 25 bp, Homo sapien
acagagagtgcatgggctgaagaat

SEQ ID NO: 583198 - DNA, 25 bp, Homo sapien
gtgcatgggctgaagaatactctga

SEQ ID NO: 583199 - DNA, 25 bp, Homo sapien
aagaaagggtctcacaagcgctcag

SEQ ID NO: 583200 - DNA, 25 bp, Homo sapien
agaaagggtctcacaagcgctcagc

SEQ ID NO: 583201 - DNA, 25 bp, Homo sapien
gaaagggtctcacaagcgctcagca

SEQ ID NO: 583202 - DNA, 25 bp, Homo sapien
atcttggggcagtacagatcaactt

SEQ ID NO: 583203 - DNA, 25 bp, Homo sapien
ctaacttggtctagaatatgacact

SEQ ID NO: 583204 - DNA, 25 bp, Homo sapien
gaatatgacacttattgtggtggat

SEQ ID NO: 583205 - DNA, 25 bp, Homo sapien
gacacttattgtggtggatagccaa

SEQ ID NO: 583206 - DNA, 25 bp, Homo sapien
cttattgtggtggatagccaagcac

SEQ ID NO: 583207 - DNA, 25 bp, Homo sapien
ttgtggtggatagccaagcacattg

SEQ ID NO: 583208 - DNA, 25 bp, Homo sapien
ctgacatttcttctacaggtataat

SEQ ID NO: 583209 - DNA, 25 bp, Homo sapien
caggtataataattcatcatgcatt

SEQ ID NO: 583210 - DNA, 25 bp, Homo sapien
tttacaggttacatgaaacattgaa

SEQ ID NO: 583211 - DNA, 25 bp, Homo sapien
gaaagacttgttacagagggccatg

SEQ ID NO: 583212 - DNA, 25 bp, Homo sapien
agacttgttacagagggccatgata

SEQ ID NO: 583213 - DNA, 25 bp, Homo sapien
acagagggccatgatatttttcaaa

SEQ ID NO: 583214 - DNA, 25 bp, Homo sapien
atgagacatcattctcctactttcc

SEQ ID NO: 583215 - DNA, 25 bp, Homo sapien
tcctactttcctttatttcttcaca

SEQ ID NO: 583216 - DNA, 25 bp, Homo sapien
tatttcttcacacatgacttcctaa

SEQ ID NO: 583217 - DNA, 25 bp, Homo sapien
atgacttcctaattaggcctttgaa

SEQ ID NO: 583218 - DNA, 25 bp, Homo sapien
ataactgatttataagctactctag

SEQ ID NO: 583219 - DNA, 25 bp, Homo sapien
aagctactctagttactgtgtctgg

SEQ ID NO: 583220 - DNA, 25 bp, Homo sapien
gttactgtgtctggacttccttaga

SEQ ID NO: 583221 - DNA, 25 bp, Homo sapien
gtctggacttccttagaatgaattt

SEQ ID NO: 583222 - DNA, 25 bp, Homo sapien
atgaatttctgttggctgtgctttt

SEQ ID NO: 583223 - DNA, 25 bp, Homo sapien
ctgtgctttttcttgcgtataggct

SEQ ID NO: 583224 - DNA, 25 bp, Homo sapien
ttcttgcgtataggctgtacttttt

SEQ ID NO: 583225 - DNA, 25 bp, Homo sapien
agcgcctcagtgtcacgacggacag

SEQ ID NO: 583226 - DNA, 25 bp, Homo sapien
agcctgtgaactgcctgaacgtcac

SEQ ID NO: 583227 - DNA, 25 bp, Homo sapien
tgcttcagcttccatggcaaacacg

SEQ ID NO: 583228 - DNA, 25 bp, Homo sapien
ggcaaacacgttccagaagagattg

SEQ ID NO: 583229 - DNA, 25 bp, Homo sapien
gagattggcctgaattatgttctga

SEQ ID NO: 583230 - DNA, 25 bp, Homo sapien
attatgttctgatggctgacgtggc

SEQ ID NO: 583231 - DNA, 25 bp, Homo sapien
agatgcccagggtctactttgtgct

SEQ ID NO: 583232 - DNA, 25 bp, Homo sapien
tactttgtgctgctgggagagacca

SEQ ID NO: 583233 - DNA, 25 bp, Homo sapien
gaagctgcagctgacttacatggag

SEQ ID NO: 583234 - DNA, 25 bp, Homo sapien
gagacgtgtcgtcactatgtggccc

SEQ ID NO: 583235 - DNA, 25 bp, Homo sapien
cactatgtggcccatgtgaagcgga

SEQ ID NO: 583236 - DNA, 25 bp, Homo sapien
atggtaaccattaaacaattgcatt

SEQ ID NO: 583237 - DNA, 25 bp, Homo sapien
tgttgcaatacatttcagaaggagc

SEQ ID NO: 583238 - DNA, 25 bp, Homo sapien
gaaggagcgttcactctgcagggaa

SEQ ID NO: 583239 - DNA, 25 bp, Homo sapien
tctgcagggaataaggtacctcctt

SEQ ID NO: 583240 - DNA, 25 bp, Homo sapien
aggtacctcctttagcaccttagtg

SEQ ID NO: 583241 - DNA, 25 bp, Homo sapien
gcaccttagtgcaattcattgtggt

SEQ ID NO: 583242 - DNA, 25 bp, Homo sapien
tcattgtggtgctatttgtttttac

SEQ ID NO: 583243 - DNA, 25 bp, Homo sapien
gtttgttactaatcttcctttcata

SEQ ID NO: 583244 - DNA, 25 bp, Homo sapien
aatcttcctttcatagaacctctat

SEQ ID NO: 583245 - DNA, 25 bp, Homo sapien
gtttgagtccttgttatggtcatca

SEQ ID NO: 583246 - DNA, 25 bp, Homo sapien
gatattcctcttccaaatctcagca

SEQ ID NO: 583247 - DNA, 25 bp, Homo sapien
cgccgtcaatttcttcaacatcgac

SEQ ID NO: 583248 - DNA, 25 bp, Homo sapien
agctgcggccgcatccacttggcat

SEQ ID NO: 583249 - DNA, 25 bp, Homo sapien
ggattgagcagaacccagaccctga

SEQ ID NO: 583250 - DNA, 25 bp, Homo sapien
agcagaacccagaccctgagtcctt

SEQ ID NO: 583251 - DNA, 25 bp, Homo sapien
gagtccttgggccagctcttggcta

SEQ ID NO: 583252 - DNA, 25 bp, Homo sapien
gccagctcttggctaagaccaggag

SEQ ID NO: 583253 - DNA, 25 bp, Homo sapien
agaccaggaggctgcaagtctccta

SEQ ID NO: 583254 - DNA, 25 bp, Homo sapien
tgcaagtctcctagaagccctctga

SEQ ID NO: 583255 - DNA, 25 bp, Homo sapien
tcctagaagccctctgagctccaga

SEQ ID NO: 583256 - DNA, 25 bp, Homo sapien
ttacctgcagggatcatagctgact

SEQ ID NO: 583257 - DNA, 25 bp, Homo sapien
ctgcagggatcatagctgactcaga

SEQ ID NO: 583258 - DNA, 25 bp, Homo sapien
tacaacacacgagctacaaactaca

SEQ ID NO: 583259 - DNA, 25 bp, Homo sapien
gctacaaactacaatgctggagaca

SEQ ID NO: 583260 - DNA, 25 bp, Homo sapien
ggatatttcagatcaatagccgcta

SEQ ID NO: 583261 - DNA, 25 bp, Homo sapien
caatagccgctactggtgtaatgat

SEQ ID NO: 583262 - DNA, 25 bp, Homo sapien
tggcaaaaccccaggagcagttaat

SEQ ID NO: 583263 - DNA, 25 bp, Homo sapien
ggagcagttaatgcctgtcatttat

SEQ ID NO: 583264 - DNA, 25 bp, Homo sapien
atgcctgtcatttatcctgcagtgc

SEQ ID NO: 583265 - DNA, 25 bp, Homo sapien
gctttgctgcaagataacatcgctg

SEQ ID NO: 583266 - DNA, 25 bp, Homo sapien
agcttgtgcaaagagggttgtccgt

SEQ ID NO: 583267 - DNA, 25 bp, Homo sapien
gagggttgtccgtgatccacaaggc

SEQ ID NO: 583268 - DNA, 25 bp, Homo sapien
cagagatgtccgtcagtatgttcaa

SEQ ID NO: 583269 - DNA, 25 bp, Homo sapien
tagttcaaatctgaggaaacctttc

SEQ ID NO: 583270 - DNA, 25 bp, Homo sapien
aaatctgaggaaacctttcttcttg

SEQ ID NO: 583271 - DNA, 25 bp, Homo sapien
gaggaaacctttcttcttgtacatt

SEQ ID NO: 583272 - DNA, 25 bp, Homo sapien
ttaaaattatgcttcccacctagag

SEQ ID NO: 583273 - DNA, 25 bp, Homo sapien
aaaattatgcttcccacctagagaa

SEQ ID NO: 583274 - DNA, 25 bp, Homo sapien
aattatgcttcccacctagagaata

SEQ ID NO: 583275 - DNA, 25 bp, Homo sapien
tatgcttcccacctagagaatactt

SEQ ID NO: 583276 - DNA, 25 bp, Homo sapien
gcttcccacctagagaatactttga

SEQ ID NO: 583277 - DNA, 25 bp, Homo sapien
gaatactttgacacacggaacgctt

SEQ ID NO: 583278 - DNA, 25 bp, Homo sapien
aatactttgacacacggaacgcttt

SEQ ID NO: 583279 - DNA, 25 bp, Homo sapien
acgctttggggagccagggtctaca

SEQ ID NO: 583280 - DNA, 25 bp, Homo sapien
tgggagccaagcaggcaatgcaact

SEQ ID NO: 583281 - DNA, 25 bp, Homo sapien
agcaggcaatgcaactgtatgaaat

SEQ ID NO: 583282 - DNA, 25 bp, Homo sapien
taagcaatgggcagtgaagaggacc

SEQ ID NO: 583283 - DNA, 25 bp, Homo sapien
gtgactgctgccacactggaatgga

SEQ ID NO: 583284 - DNA, 25 bp, Homo sapien
tgctgccacactggaatggaggcat

SEQ ID NO: 583285 - DNA, 25 bp, Homo sapien
gcatcactgccaggtcttctggttt

SEQ ID NO: 583286 - DNA, 25 bp, Homo sapien
aactggagctctggatttttaagag

SEQ ID NO: 583287 - DNA, 25 bp, Homo sapien
aattgcataaccgaaaacgctctgt

SEQ ID NO: 583288 - DNA, 25 bp, Homo sapien
gaaaacgctctgtggtcaacctact

SEQ ID NO: 583289 - DNA, 25 bp, Homo sapien
gctctgtggtcaacctactattttg

SEQ ID NO: 583290 - DNA, 25 bp, Homo sapien
ggtcaacctactattttgaaagctg

SEQ ID NO: 583291 - DNA, 25 bp, Homo sapien
tgctgggaatcacggcccttccttt

SEQ ID NO: 583292 - DNA, 25 bp, Homo sapien
ttcctttcctcagatcgccttgcgg

SEQ ID NO: 583293 - DNA, 25 bp, Homo sapien
cgccttgcggcctggcactggagct

SEQ ID NO: 583294 - DNA, 25 bp, Homo sapien
agctggtgctgacagggacgctggc

SEQ ID NO: 583295 - DNA, 25 bp, Homo sapien
acgctggccaacagggtggtatttt

SEQ ID NO: 583296 - DNA, 25 bp, Homo sapien
gtggtatttttcacccgggtgatct

SEQ ID NO: 583297 - DNA, 25 bp, Homo sapien
agggctggtcttagataggaatgca

SEQ ID NO: 583298 - DNA, 25 bp, Homo sapien
gtcttagataggaatgcagcccaga

SEQ ID NO: 583299 - DNA, 25 bp, Homo sapien
gaagggaccaagcacttgcccatcc

SEQ ID NO: 583300 - DNA, 25 bp, Homo sapien
ttgcccatcctcactggctttcaaa

SEQ ID NO: 583301 - DNA, 25 bp, Homo sapien
catcctcactggctttcaaaaaata

SEQ ID NO: 583302 - DNA, 25 bp, Homo sapien
aagcatggccatgagaggtggatac

SEQ ID NO: 583303 - DNA, 25 bp, Homo sapien
ggtggatacatagtggcagcatctt

SEQ ID NO: 583304 - DNA, 25 bp, Homo sapien
gatacatagtggcagcatctttaaa

SEQ ID NO: 583305 - DNA, 25 bp, Homo sapien
gtaaacaacagtcaagtggctattc

SEQ ID NO: 583306 - DNA, 25 bp, Homo sapien
gtggctattcaagaatgctccgggt

SEQ ID NO: 583307 - DNA, 25 bp, Homo sapien
tattcaagaatgctccgggttccac

SEQ ID NO: 583308 - DNA, 25 bp, Homo sapien
aatgctccgggttccactgaaaatt

SEQ ID NO: 583309 - DNA, 25 bp, Homo sapien
gtttaacataaactctctgctcaat

SEQ ID NO: 583310 - DNA, 25 bp, Homo sapien
aactctctgctcaattttttagtca

SEQ ID NO: 583311 - DNA, 25 bp, Homo sapien
ctctgctcaattttttagtcagtga

SEQ ID NO: 583312 - DNA, 25 bp, Homo sapien
ttttagtcagtgagaaaggcaaact

SEQ ID NO: 583313 - DNA, 25 bp, Homo sapien
accatgccctcgtatcctaattttt

SEQ ID NO: 583314 - DNA, 25 bp, Homo sapien
catgccctcgtatcctaatttttat

SEQ ID NO: 583315 - DNA, 25 bp, Homo sapien
atgccctcgtatcctaatttttatg

SEQ ID NO: 583316 - DNA, 25 bp, Homo sapien
gccctcgtatcctaatttttatgat

SEQ ID NO: 583317 - DNA, 25 bp, Homo sapien
gtatcctaatttttatgatctaatg

SEQ ID NO: 583318 - DNA, 25 bp, Homo sapien
atgatctaatgggtagtagtgggtt

SEQ ID NO: 583319 - DNA, 25 bp, Homo sapien
gtagtagtgggttgagctgaaaaat

SEQ ID NO: 583320 - DNA, 25 bp, Homo sapien
agctgaaaaattgttatgctttaaa

SEQ ID NO: 583321 - DNA, 25 bp, Homo sapien
attcaagaactgtaagtcattggag

SEQ ID NO: 583322 - DNA, 25 bp, Homo sapien
gaactgtaagtcattggagatcaaa

SEQ ID NO: 583323 - DNA, 25 bp, Homo sapien
tggagatcaaaatacactactttta

SEQ ID NO: 583324 - DNA, 25 bp, Homo sapien
ttttggagaaaaatacgctagattt

SEQ ID NO: 583325 - DNA, 25 bp, Homo sapien
tacgctagattttaaatgttagagc

SEQ ID NO: 583326 - DNA, 25 bp, Homo sapien
ccggagacttattgcagaaatagat

SEQ ID NO: 583327 - DNA, 25 bp, Homo sapien
gaagcaaatcaagactactattcaa

SEQ ID NO: 583328 - DNA, 25 bp, Homo sapien
aatcaagactactattcaaaaatgt

SEQ ID NO: 583329 - DNA, 25 bp, Homo sapien
attatttctaatgtcaagtctccta

SEQ ID NO: 583330 - DNA, 25 bp, Homo sapien
tatttctaatgtcaagtctcctatt

SEQ ID NO: 583331 - DNA, 25 bp, Homo sapien
tttctaatgtcaagtctcctattaa

SEQ ID NO: 583332 - DNA, 25 bp, Homo sapien
tctaatgtcaagtctcctattaaat

SEQ ID NO: 583333 - DNA, 25 bp, Homo sapien
taatgtcaagtctcctattaaatag

SEQ ID NO: 583334 - DNA, 25 bp, Homo sapien
atgtcaagtctcctattaaatagaa

SEQ ID NO: 583335 - DNA, 25 bp, Homo sapien
tgttttccccgtttgttcataaatg

SEQ ID NO: 583336 - DNA, 25 bp, Homo sapien
tccccgtttgttcataaatgcggtc

SEQ ID NO: 583337 - DNA, 25 bp, Homo sapien
aaatgcggtcggttatacttcttag

SEQ ID NO: 583338 - DNA, 25 bp, Homo sapien
ggttatacttcttaggtgacaggtt

SEQ ID NO: 583339 - DNA, 25 bp, Homo sapien
acaggttattgtccagtactttaat

SEQ ID NO: 583340 - DNA, 25 bp, Homo sapien
tgtataatggctgtacaggtagacc

SEQ ID NO: 583341 - DNA, 25 bp, Homo sapien
caggtagaccataattcagtccttt

SEQ ID NO: 583342 - DNA, 25 bp, Homo sapien
gaccataattcagtcctttagattt

SEQ ID NO: 583343 - DNA, 25 bp, Homo sapien
atgtgtagttcttcattgttgggtt

SEQ ID NO: 583344 - DNA, 25 bp, Homo sapien
ttcattgttgggttgattccccaaa

SEQ ID NO: 583345 - DNA, 25 bp, Homo sapien
aaaccttgacagatgtatcgatgga

SEQ ID NO: 583346 - DNA, 25 bp, Homo sapien
ttctgaatttatttcacctggagga

SEQ ID NO: 583347 - DNA, 25 bp, Homo sapien
ttcacctggaggaaaccacctgttt

SEQ ID NO: 583348 - DNA, 25 bp, Homo sapien
cacctggaggaaaccacctgtttgg

SEQ ID NO: 583349 - DNA, 25 bp, Homo sapien
tggcccttcagtttcccctaacttg

SEQ ID NO: 583350 - DNA, 25 bp, Homo sapien
ttcccctaacttggactcctaagag

SEQ ID NO: 583351 - DNA, 25 bp, Homo sapien
cttggactcctaagagatttggatt

SEQ ID NO: 583352 - DNA, 25 bp, Homo sapien
gggtggtgatatgacctttaagttt

SEQ ID NO: 583353 - DNA, 25 bp, Homo sapien
gtgatatgacctttaagtttacaag

SEQ ID NO: 583354 - DNA, 25 bp, Homo sapien
gaagaagacttactccacttgccaa

SEQ ID NO: 583355 - DNA, 25 bp, Homo sapien
tcttacttaacattgtgctagatgc

SEQ ID NO: 583356 - DNA, 25 bp, Homo sapien
aaaataaatactctctctgacccct

SEQ ID NO: 583357 - DNA, 25 bp, Homo sapien
ttaggtaagaagtttcctgttactg

SEQ ID NO: 583358 - DNA, 25 bp, Homo sapien
taagaagtttcctgttactgagaac

SEQ ID NO: 583359 - DNA, 25 bp, Homo sapien
gaagtttcctgttactgagaactca

SEQ ID NO: 583360 - DNA, 25 bp, Homo sapien
gtttcctgttactgagaactcaaag

SEQ ID NO: 583361 - DNA, 25 bp, Homo sapien
tcctgttactgagaactcaaagggt

SEQ ID NO: 583362 - DNA, 25 bp, Homo sapien
actcaaagggttacaagttgctgcc

SEQ ID NO: 583363 - DNA, 25 bp, Homo sapien
aaagggttacaagttgctgccacct

SEQ ID NO: 583364 - DNA, 25 bp, Homo sapien
agggttacaagttgctgccacctta

SEQ ID NO: 583365 - DNA, 25 bp, Homo sapien
ggttacaagttgctgccaccttatc

SEQ ID NO: 583366 - DNA, 25 bp, Homo sapien
gctgccaccttatcttagagttatt

SEQ ID NO: 583367 - DNA, 25 bp, Homo sapien
gccaccttatcttagagttattcaa

SEQ ID NO: 583368 - DNA, 25 bp, Homo sapien
ggcgactatgcctctgtgaggacag

SEQ ID NO: 583369 - DNA, 25 bp, Homo sapien
tatgcctctgtgaggacagcattgc

SEQ ID NO: 583370 - DNA, 25 bp, Homo sapien
gacagcattgctggcagctagggct

SEQ ID NO: 583371 - DNA, 25 bp, Homo sapien
agctagggctgtggacaggacccga

SEQ ID NO: 583372 - DNA, 25 bp, Homo sapien
aggacccgagtctactacaggctac

SEQ ID NO: 583373 - DNA, 25 bp, Homo sapien
gagtctactacaggctaccccaggg

SEQ ID NO: 583374 - DNA, 25 bp, Homo sapien
taccccagggctaccacaaggactt

SEQ ID NO: 583375 - DNA, 25 bp, Homo sapien
acaaggacttgctggctcatgttgg

SEQ ID NO: 583376 - DNA, 25 bp, Homo sapien
gacttgctggctcatgttggtagaa

SEQ ID NO: 583377 - DNA, 25 bp, Homo sapien
gttggtagaaactgagcacccaggg

SEQ ID NO: 583378 - DNA, 25 bp, Homo sapien
acctcagggcggaggcttcccacgg

SEQ ID NO: 583379 - DNA, 25 bp, Homo sapien
ggagaagggtgtccccaccagccca

SEQ ID NO: 583380 - DNA, 25 bp, Homo sapien
accagcccatacagcgtgtgtgtgg

SEQ ID NO: 583381 - DNA, 25 bp, Homo sapien
gggccttgacctccgtgatgtctac

SEQ ID NO: 583382 - DNA, 25 bp, Homo sapien
ttgacctccgtgatgtctactgtgc

SEQ ID NO: 583383 - DNA, 25 bp, Homo sapien
cgtgatgtctactgtgcctcaggat

SEQ ID NO: 583384 - DNA, 25 bp, Homo sapien
tgtgcctcaggataaggacccgcca

SEQ ID NO: 583385 - DNA, 25 bp, Homo sapien
tcaggataaggacccgccatgccct

SEQ ID NO: 583386 - DNA, 25 bp, Homo sapien
gccatgccctggctagacagtgtgt

SEQ ID NO: 583387 - DNA, 25 bp, Homo sapien
tgccctggctagacagtgtgtggtt

SEQ ID NO: 583388 - DNA, 25 bp, Homo sapien
gtgtgtggttagtaggaatctctca

SEQ ID NO: 583389 - DNA, 25 bp, Homo sapien
ggttagtaggaatctctcattgttc

SEQ ID NO: 583390 - DNA, 25 bp, Homo sapien
atagagcatctatcccttgttcatt

SEQ ID NO: 583391 - DNA, 25 bp, Homo sapien
ttcaggttcctgcttaagtatcttt

SEQ ID NO: 583392 - DNA, 25 bp, Homo sapien
gcttaagtatcttttccccagggag

SEQ ID NO: 583393 - DNA, 25 bp, Homo sapien
cagggagacctctgattgcctcatt

SEQ ID NO: 583394 - DNA, 25 bp, Homo sapien
ttgcctcattgtacactaggtgtct

SEQ ID NO: 583395 - DNA, 25 bp, Homo sapien
gtctggatacattctctatatagtt

SEQ ID NO: 583396 - DNA, 25 bp, Homo sapien
atttatctcgtgtctttcatctctg

SEQ ID NO: 583397 - DNA, 25 bp, Homo sapien
gtgtctttcatctctgtaaactggc

SEQ ID NO: 583398 - DNA, 25 bp, Homo sapien
gagatcaggtctcttttatgtacca

SEQ ID NO: 583399 - DNA, 25 bp, Homo sapien
ttttatgtaccaccgtattcctagc

SEQ ID NO: 583400 - DNA, 25 bp, Homo sapien
gcacgttcctgatatatagtagata

SEQ ID NO: 583401 - DNA, 25 bp, Homo sapien
tctgaggttcaagaatttaggagca

SEQ ID NO: 583402 - DNA, 25 bp, Homo sapien
gaatttaggagcaatttacctgagt

SEQ ID NO: 583403 - DNA, 25 bp, Homo sapien
ggagcaatttacctgagtgattcta

SEQ ID NO: 583404 - DNA, 25 bp, Homo sapien
gcaatttacctgagtgattctatct

SEQ ID NO: 583405 - DNA, 25 bp, Homo sapien
tacctgagtgattctatcttagatt

SEQ ID NO: 583406 - DNA, 25 bp, Homo sapien
tagattctcttataaggctatattt

SEQ ID NO: 583407 - DNA, 25 bp, Homo sapien
aggctatatttaagattttggttat

SEQ ID NO: 583408 - DNA, 25 bp, Homo sapien
tttggttatagttgcagtgatccga

SEQ ID NO: 583409 - DNA, 25 bp, Homo sapien
gcagtgatccgaaggcttcactgga

SEQ ID NO: 583410 - DNA, 25 bp, Homo sapien
tggagcaggaggacaagcttctaag

SEQ ID NO: 583411 - DNA, 25 bp, Homo sapien
gacaagcttctaagatgactcactt

SEQ ID NO: 583412 - DNA, 25 bp, Homo sapien
ctccagtttatgatgccattaaatt

SEQ ID NO: 583413 - DNA, 25 bp, Homo sapien
taaaagccagatctctaaccagaat

SEQ ID NO: 583414 - DNA, 25 bp, Homo sapien
aagccagatctctaaccagaattgc

SEQ ID NO: 583415 - DNA, 25 bp, Homo sapien
gccagatctctaaccagaattgctg

SEQ ID NO: 583416 - DNA, 25 bp, Homo sapien
gatctctaaccagaattgctgtaaa

SEQ ID NO: 583417 - DNA, 25 bp, Homo sapien
gaattgctgtaaatcaacatatgag

SEQ ID NO: 583418 - DNA, 25 bp, Homo sapien
atactactgtagaggatgagactga

SEQ ID NO: 583419 - DNA, 25 bp, Homo sapien
ctactgtagaggatgagactgaaac

SEQ ID NO: 583420 - DNA, 25 bp, Homo sapien
aatgaagttcaaggatttctctttg

SEQ ID NO: 583421 - DNA, 25 bp, Homo sapien
gaagttcaaggatttctctttggga

SEQ ID NO: 583422 - DNA, 25 bp, Homo sapien
tcaaggatttctctttgggaaacta

SEQ ID NO: 583423 - DNA, 25 bp, Homo sapien
gatgcctgctgctgtaagcctgtgc

SEQ ID NO: 583424 - DNA, 25 bp, Homo sapien
gctgtaagcctgtgccagcaacaca

SEQ ID NO: 583425 - DNA, 25 bp, Homo sapien
tctgtgcctccatcggaaacatgaa

SEQ ID NO: 583426 - DNA, 25 bp, Homo sapien
ttgtaatgggctccatatttaggcc

SEQ ID NO: 583427 - DNA, 25 bp, Homo sapien
tatttaggcccagcagccttagatg

SEQ ID NO: 583428 - DNA, 25 bp, Homo sapien
cagccttagatgtctggccaatagg

SEQ ID NO: 583429 - DNA, 25 bp, Homo sapien
gatgtctggccaataggaaagctat

SEQ ID NO: 583430 - DNA, 25 bp, Homo sapien
ggaaagctatgtccttcctgcacaa

SEQ ID NO: 583431 - DNA, 25 bp, Homo sapien
ctatgtccttcctgcacaatttcag

SEQ ID NO: 583432 - DNA, 25 bp, Homo sapien
agccctaagaatctgtgactctccc

SEQ ID NO: 583433 - DNA, 25 bp, Homo sapien
tcaccctggtataccaggcaaccag

SEQ ID NO: 583434 - DNA, 25 bp, Homo sapien
gctgagtctcagaaacacttggccc

SEQ ID NO: 583435 - DNA, 25 bp, Homo sapien
gagtctcagaaacacttggcccaac

SEQ ID NO: 583436 - DNA, 25 bp, Homo sapien
tctcagaaacacttggcccaacata

SEQ ID NO: 583437 - DNA, 25 bp, Homo sapien
aacacttggcccaacatagccctgt

SEQ ID NO: 583438 - DNA, 25 bp, Homo sapien
taacctccactagctccaaaatccc

SEQ ID NO: 583439 - DNA, 25 bp, Homo sapien
aaccaaggttaggtgactgaggact

SEQ ID NO: 583440 - DNA, 25 bp, Homo sapien
gactgaggactggagctgtttggtt

SEQ ID NO: 583441 - DNA, 25 bp, Homo sapien
ttggttttctcgcattttccaccaa

SEQ ID NO: 583442 - DNA, 25 bp, Homo sapien
ttttctcgcattttccaccaaactg

SEQ ID NO: 583443 - DNA, 25 bp, Homo sapien
ttctcgcattttccaccaaactgga

SEQ ID NO: 583444 - DNA, 25 bp, Homo sapien
gcattttccaccaaactggaagctg

SEQ ID NO: 583445 - DNA, 25 bp, Homo sapien
ttccagaatttcttccgaggtagta

SEQ ID NO: 583446 - DNA, 25 bp, Homo sapien
tccagaatttcttccgaggtagtat

SEQ ID NO: 583447 - DNA, 25 bp, Homo sapien
ccagaatttcttccgaggtagtatg

SEQ ID NO: 583448 - DNA, 25 bp, Homo sapien
gaatttcttccgaggtagtatggtt

SEQ ID NO: 583449 - DNA, 25 bp, Homo sapien
ttcttccgaggtagtatggttttct

SEQ ID NO: 583450 - DNA, 25 bp, Homo sapien
tcttccgaggtagtatggttttctt

SEQ ID NO: 583451 - DNA, 25 bp, Homo sapien
ttccgaggtagtatggttttcttca

SEQ ID NO: 583452 - DNA, 25 bp, Homo sapien
tccgaggtagtatggttttcttcat

SEQ ID NO: 583453 - DNA, 25 bp, Homo sapien
cgaggtagtatggttttcttcatag

SEQ ID NO: 583454 - DNA, 25 bp, Homo sapien
ggtagtatggttttcttcataggat

SEQ ID NO: 583455 - DNA, 25 bp, Homo sapien
gtatggttttcttcataggataaag

SEQ ID NO: 583456 - DNA, 25 bp, Homo sapien
gaaacccagccaggacgtgccgcca

SEQ ID NO: 583457 - DNA, 25 bp, Homo sapien
caggcccagccttagccaggacgag

SEQ ID NO: 583458 - DNA, 25 bp, Homo sapien
ccagccttagccaggacgaggtgaa

SEQ ID NO: 583459 - DNA, 25 bp, Homo sapien
agccttagccaggacgaggtgaaag

SEQ ID NO: 583460 - DNA, 25 bp, Homo sapien
cttagccaggacgaggtgaaagctg

SEQ ID NO: 583461 - DNA, 25 bp, Homo sapien
gacgaggtgaaagctgagaccatcc

SEQ ID NO: 583462 - DNA, 25 bp, Homo sapien
gtgaaagctgagaccatccgcagcc

SEQ ID NO: 583463 - DNA, 25 bp, Homo sapien
gaaagctgagaccatccgcagcctg

SEQ ID NO: 583464 - DNA, 25 bp, Homo sapien
aaagctgagaccatccgcagcctga

SEQ ID NO: 583465 - DNA, 25 bp, Homo sapien
agctgagaccatccgcagcctgagg

SEQ ID NO: 583466 - DNA, 25 bp, Homo sapien
gaagtctttcgccagcctcttctcc

SEQ ID NO: 583467 - DNA, 25 bp, Homo sapien
gttatctttgagaaagcagcttatt

SEQ ID NO: 583468 - DNA, 25 bp, Homo sapien
aatagtctttgtaattcaaactaag

SEQ ID NO: 583469 - DNA, 25 bp, Homo sapien
gtatagtagttagcagtgtattcac

SEQ ID NO: 583470 - DNA, 25 bp, Homo sapien
tagttagcagtgtattcacaatcag

SEQ ID NO: 583471 - DNA, 25 bp, Homo sapien
gcactctaatgccaagtgttgaaat

SEQ ID NO: 583472 - DNA, 25 bp, Homo sapien
ctgaacgtatcatgtagtgtccttt

SEQ ID NO: 583473 - DNA, 25 bp, Homo sapien
acgtatcatgtagtgtcctttgttt

SEQ ID NO: 583474 - DNA, 25 bp, Homo sapien
tcatgtagtgtcctttgtttataac

SEQ ID NO: 583475 - DNA, 25 bp, Homo sapien
gtagtgtcctttgtttataacataa

SEQ ID NO: 583476 - DNA, 25 bp, Homo sapien
caaaatagttaactttccagctgtt

SEQ ID NO: 583477 - DNA, 25 bp, Homo sapien
gttaactttccagctgtttaatttg

SEQ ID NO: 583478 - DNA, 25 bp, Homo sapien
caacatggatggcacgtctgtgtta

SEQ ID NO: 583479 - DNA, 25 bp, Homo sapien
agaactggtacgatgttggaacttt

SEQ ID NO: 583480 - DNA, 25 bp, Homo sapien
gaaagagagtctccttctgacacca

SEQ ID NO: 583481 - DNA, 25 bp, Homo sapien
gacaccatgtgattcctatgacaag

SEQ ID NO: 583482 - DNA, 25 bp, Homo sapien
aaaatctcctaagatgctgccaacc

SEQ ID NO: 583483 - DNA, 25 bp, Homo sapien
atgctgccaaccaaatgactgcctt

SEQ ID NO: 583484 - DNA, 25 bp, Homo sapien
aatgactgccttgagattcttctgc

SEQ ID NO: 583485 - DNA, 25 bp, Homo sapien
tgagattcttctgccagcctaatga

SEQ ID NO: 583486 - DNA, 25 bp, Homo sapien
agcctaatgattcccgagcctagga

SEQ ID NO: 583487 - DNA, 25 bp, Homo sapien
gagcctaggaatccctgctatgggt

SEQ ID NO: 583488 - DNA, 25 bp, Homo sapien
ccctgctatgggtgctggtagttgt

SEQ ID NO: 583489 - DNA, 25 bp, Homo sapien
tttgcaacggcagatgagtatcatc

SEQ ID NO: 583490 - DNA, 25 bp, Homo sapien
atgagtatcatctgggaaatctgtc

SEQ ID NO: 583491 - DNA, 25 bp, Homo sapien
gtatcatctgggaaatctgtctcaa

SEQ ID NO: 583492 - DNA, 25 bp, Homo sapien
atcatctgggaaatctgtctcaaga

SEQ ID NO: 583493 - DNA, 25 bp, Homo sapien
ggaaatctgtctcaagatctggcct

SEQ ID NO: 583494 - DNA, 25 bp, Homo sapien
aaatctgtctcaagatctggcctcc

SEQ ID NO: 583495 - DNA, 25 bp, Homo sapien
aagatctggcctcccacggatatgt

SEQ ID NO: 583496 - DNA, 25 bp, Homo sapien
tctggcctcccacggatatgttgaa

SEQ ID NO: 583497 - DNA, 25 bp, Homo sapien
tggcctcccacggatatgttgaagt

SEQ ID NO: 583498 - DNA, 25 bp, Homo sapien
gcctcccacggatatgttgaagtaa

SEQ ID NO: 583499 - DNA, 25 bp, Homo sapien
gttgaagtaacaagcttgcctagag

SEQ ID NO: 583500 - DNA, 25 bp, Homo sapien
ggtggtttgaaacaactccggagca

SEQ ID NO: 583501 - DNA, 25 bp, Homo sapien
tggtttgaaacaactccggagcaca

SEQ ID NO: 583502 - DNA, 25 bp, Homo sapien
tttgaaacaactccggagcacactc

SEQ ID NO: 583503 - DNA, 25 bp, Homo sapien
actccggagcacactccagaggaaa

SEQ ID NO: 583504 - DNA, 25 bp, Homo sapien
gagcacactccagaggaaaacagga

SEQ ID NO: 583505 - DNA, 25 bp, Homo sapien
acaggaagggtgacatgtttggaca

SEQ ID NO: 583506 - DNA, 25 bp, Homo sapien
aagggtgacatgtttggacaccaga

SEQ ID NO: 583507 - DNA, 25 bp, Homo sapien
gtgacatgtttggacaccagaaaag

SEQ ID NO: 583508 - DNA, 25 bp, Homo sapien
ggaagagtcctcactaagagggtga

SEQ ID NO: 583509 - DNA, 25 bp, Homo sapien
gtcctcactaagagggtgacttggt

SEQ ID NO: 583510 - DNA, 25 bp, Homo sapien
ctcactaagagggtgacttggttaa

SEQ ID NO: 583511 - DNA, 25 bp, Homo sapien
tttagtgggaatatgtgggcatgaa

SEQ ID NO: 583512 - DNA, 25 bp, Homo sapien
ttagtgggaatatgtgggcatgaaa

SEQ ID NO: 583513 - DNA, 25 bp, Homo sapien
tagtgggaatatgtgggcatgaaaa

SEQ ID NO: 583514 - DNA, 25 bp, Homo sapien
agtgggaatatgtgggcatgaaaat

SEQ ID NO: 583515 - DNA, 25 bp, Homo sapien
gtgggaatatgtgggcatgaaaatt

SEQ ID NO: 583516 - DNA, 25 bp, Homo sapien
tgggaatatgtgggcatgaaaatta

SEQ ID NO: 583517 - DNA, 25 bp, Homo sapien
gggaatatgtgggcatgaaaattag

SEQ ID NO: 583518 - DNA, 25 bp, Homo sapien
ggaatatgtgggcatgaaaattaga

SEQ ID NO: 583519 - DNA, 25 bp, Homo sapien
acatttcgaatagactttgcccttg

SEQ ID NO: 583520 - DNA, 25 bp, Homo sapien
ttcgaatagactttgcccttgcaat

SEQ ID NO: 583521 - DNA, 25 bp, Homo sapien
gactttgcccttgcaattttaagct

SEQ ID NO: 583522 - DNA, 25 bp, Homo sapien
gcccttgcaattttaagctatgcca

SEQ ID NO: 583523 - DNA, 25 bp, Homo sapien
gcaattttaagctatgccatattca

SEQ ID NO: 583524 - DNA, 25 bp, Homo sapien
gctatgccatattcagattaatttt

SEQ ID NO: 583525 - DNA, 25 bp, Homo sapien
aattttgtgagtgatatctgcatat

SEQ ID NO: 583526 - DNA, 25 bp, Homo sapien
gcatatgtttctgtacagtgtgaaa

SEQ ID NO: 583527 - DNA, 25 bp, Homo sapien
agtgtgaaatgactgaccctgtagt

SEQ ID NO: 583528 - DNA, 25 bp, Homo sapien
atgactgaccctgtagtatagtacg

SEQ ID NO: 583529 - DNA, 25 bp, Homo sapien
gaccctgtagtatagtacgtgatag

SEQ ID NO: 583530 - DNA, 25 bp, Homo sapien
ttaattgccagtgtaacattattga

SEQ ID NO: 583531 - DNA, 25 bp, Homo sapien
ggagtgagtgagttcccattctagt

SEQ ID NO: 583532 - DNA, 25 bp, Homo sapien
agtgagttcccattctagtgggact

SEQ ID NO: 583533 - DNA, 25 bp, Homo sapien
gttcccattctagtgggactggatt

SEQ ID NO: 583534 - DNA, 25 bp, Homo sapien
gactggattagttaccatacagtgg

SEQ ID NO: 583535 - DNA, 25 bp, Homo sapien
gttaccatacagtggttgttataaa

SEQ ID NO: 583536 - DNA, 25 bp, Homo sapien
ataaagtgaggctgcttctggtgtt

SEQ ID NO: 583537 - DNA, 25 bp, Homo sapien
ctgcttctggtgttttatctgtttg

SEQ ID NO: 583538 - DNA, 25 bp, Homo sapien
gcttctggtgttttatctgtttgca

SEQ ID NO: 583539 - DNA, 25 bp, Homo sapien
ttatctgtttgcaggcacttccttc

SEQ ID NO: 583540 - DNA, 25 bp, Homo sapien
aggttaggatgcagcatgaggccct

SEQ ID NO: 583541 - DNA, 25 bp, Homo sapien
gcaaggtcatctaaaacttgaagtt

SEQ ID NO: 583542 - DNA, 25 bp, Homo sapien
aacttgaagtttcacaaagtgtggt

SEQ ID NO: 583543 - DNA, 25 bp, Homo sapien
tcacaaagtgtggtttcatatgact

SEQ ID NO: 583544 - DNA, 25 bp, Homo sapien
gtgtggtttcatatgacttggaata

SEQ ID NO: 583545 - DNA, 25 bp, Homo sapien
gacttggaataatctgaaaaactat

SEQ ID NO: 583546 - DNA, 25 bp, Homo sapien
aactattcagtggttacgaaagagc

SEQ ID NO: 583547 - DNA, 25 bp, Homo sapien
ggttacgaaagagcacagcacataa

SEQ ID NO: 583548 - DNA, 25 bp, Homo sapien
gcacagcacataaaaaccaaatttg

SEQ ID NO: 583549 - DNA, 25 bp, Homo sapien
accaaatttgattagttcaagtcgg

SEQ ID NO: 583550 - DNA, 25 bp, Homo sapien
tagttcaagtcggtgtttatgtttt

SEQ ID NO: 583551 - DNA, 25 bp, Homo sapien
gtcggtgtttatgttttgctttggg

SEQ ID NO: 583552 - DNA, 25 bp, Homo sapien
ttatgtttgcagttaaatcttcaat

SEQ ID NO: 583553 - DNA, 25 bp, Homo sapien
gttattttatcattgcaaagtggca

SEQ ID NO: 583554 - DNA, 25 bp, Homo sapien
caaagtggcagtgtcagggtttcct

SEQ ID NO: 583555 - DNA, 25 bp, Homo sapien
ggcagtgtcagggtttcctttattg

SEQ ID NO: 583556 - DNA, 25 bp, Homo sapien
gggtttcctttattgacttatccag

SEQ ID NO: 583557 - DNA, 25 bp, Homo sapien
ttattgacttatccagcaggcattc

SEQ ID NO: 583558 - DNA, 25 bp, Homo sapien
gcaggcattcagctatatcaactct

SEQ ID NO: 583559 - DNA, 25 bp, Homo sapien
ggcattcagctatatcaactctaca

SEQ ID NO: 583560 - DNA, 25 bp, Homo sapien
gctatatcaactctacatatgaagt

SEQ ID NO: 583561 - DNA, 25 bp, Homo sapien
aaatgtgacgttgtcaggcctctga

SEQ ID NO: 583562 - DNA, 25 bp, Homo sapien
atgtcctctgtaacctgcacgtaca

SEQ ID NO: 583563 - DNA, 25 bp, Homo sapien
aaagctgcaatgtgtcaggatgttc

SEQ ID NO: 583564 - DNA, 25 bp, Homo sapien
gtcaggatgttcattccagcaatat

SEQ ID NO: 583565 - DNA, 25 bp, Homo sapien
gttcattccagcaatatttatagta

SEQ ID NO: 583566 - DNA, 25 bp, Homo sapien
aattacagtatatccactggatgga

SEQ ID NO: 583567 - DNA, 25 bp, Homo sapien
ccactggatggaatagtatgaagcc

SEQ ID NO: 583568 - DNA, 25 bp, Homo sapien
tgaagccatttaggacagattgtga

SEQ ID NO: 583569 - DNA, 25 bp, Homo sapien
taggacagattgtgaaaaccctgtg

SEQ ID NO: 583570 - DNA, 25 bp, Homo sapien
gggaatgtttgctaagttatatgaa

SEQ ID NO: 583571 - DNA, 25 bp, Homo sapien
atagcataacatacattccccaggg

SEQ ID NO: 583572 - DNA, 25 bp, Homo sapien
attccccagggatatagtcagcaaa

SEQ ID NO: 583573 - DNA, 25 bp, Homo sapien
ggatatagtcagcaaagtctagaat

SEQ ID NO: 583574 - DNA, 25 bp, Homo sapien
aattatcaatatttgtttctggatg

SEQ ID NO: 583575 - DNA, 25 bp, Homo sapien
atcaatatttgtttctggatggtga

SEQ ID NO: 583576 - DNA, 25 bp, Homo sapien
gagacttaaaacatttcctgcctct

SEQ ID NO: 583577 - DNA, 25 bp, Homo sapien
agacttaaaacatttcctgcctctt

SEQ ID NO: 583578 - DNA, 25 bp, Homo sapien
tttactgtacattccaacttttttg

SEQ ID NO: 583579 - DNA, 25 bp, Homo sapien
ttactgtacattccaacttttttga

SEQ ID NO: 583580 - DNA, 25 bp, Homo sapien
tactgtacattccaacttttttgaa

SEQ ID NO: 583581 - DNA, 25 bp, Homo sapien
taattaagtagaagtcggccagtgc

SEQ ID NO: 583582 - DNA, 25 bp, Homo sapien
aattaagtagaagtcggccagtgcg

SEQ ID NO: 583583 - DNA, 25 bp, Homo sapien
attaagtagaagtcggccagtgcgg

SEQ ID NO: 583584 - DNA, 25 bp, Homo sapien
ttaagtagaagtcggccagtgcggt

SEQ ID NO: 583585 - DNA, 25 bp, Homo sapien
tccacctgcttctaaaatgcccaga

SEQ ID NO: 583586 - DNA, 25 bp, Homo sapien
tgcccagaagacaactggaccagtt

SEQ ID NO: 583587 - DNA, 25 bp, Homo sapien
gaccagtttggtattagaagtagga

SEQ ID NO: 583588 - DNA, 25 bp, Homo sapien
agtaggaggctggacgacttcaccc

SEQ ID NO: 583589 - DNA, 25 bp, Homo sapien
aggcctaattgaggttggtggattc

SEQ ID NO: 583590 - DNA, 25 bp, Homo sapien
tcagctgcacccattttctggaggt

SEQ ID NO: 583591 - DNA, 25 bp, Homo sapien
tttctggaggttttgctgcccacaa

SEQ ID NO: 583592 - DNA, 25 bp, Homo sapien
ggaggttttgctgcccacaacacca

SEQ ID NO: 583593 - DNA, 25 bp, Homo sapien
agtatttcacaacttcctggtcgct

SEQ ID NO: 583594 - DNA, 25 bp, Homo sapien
acaacttcctggtcgctgagaatat

SEQ ID NO: 583595 - DNA, 25 bp, Homo sapien
tcctggtcgctgagaatatttattc

SEQ ID NO: 583596 - DNA, 25 bp, Homo sapien
tgcccatatcagaatagaggccttt

SEQ ID NO: 583597 - DNA, 25 bp, Homo sapien
aatagaggcctttgtatgctagagt

SEQ ID NO: 583598 - DNA, 25 bp, Homo sapien
ggcctttgtatgctagagtttccaa

SEQ ID NO: 583599 - DNA, 25 bp, Homo sapien
tatgctagagtttccaataccaaat

SEQ ID NO: 583600 - DNA, 25 bp, Homo sapien
gagtttccaataccaaataatggca

SEQ ID NO: 583601 - DNA, 25 bp, Homo sapien
caaattttgagtagggctctctccc

SEQ ID NO: 583602 - DNA, 25 bp, Homo sapien
gattcttgggatcttatcgtttgtg

SEQ ID NO: 583603 - DNA, 25 bp, Homo sapien
gggaggaatctggaaactgtattat

SEQ ID NO: 583604 - DNA, 25 bp, Homo sapien
gaaactgtattataatagacaccct

SEQ ID NO: 583605 - DNA, 25 bp, Homo sapien
aatagacacccttttatctgatatt

SEQ ID NO: 583606 - DNA, 25 bp, Homo sapien
gacacccttttatctgatattattg

SEQ ID NO: 583607 - DNA, 25 bp, Homo sapien
gcgctcttgatgctctttcgaaaat

SEQ ID NO: 583608 - DNA, 25 bp, Homo sapien
ttagtggatgtttatgctgtttgac

SEQ ID NO: 583609 - DNA, 25 bp, Homo sapien
cttttctcctgtgtaccaaggtatt

SEQ ID NO: 583610 - DNA, 25 bp, Homo sapien
ttctcctgtgtaccaaggtattgct

SEQ ID NO: 583611 - DNA, 25 bp, Homo sapien
tcctgtgtaccaaggtattgctttt

SEQ ID NO: 583612 - DNA, 25 bp, Homo sapien
gtgtaccaaggtattgcttttattt

SEQ ID NO: 583613 - DNA, 25 bp, Homo sapien
aggtattgcttttatttacacgaca

SEQ ID NO: 583614 - DNA, 25 bp, Homo sapien
attgcttttatttacacgacagcga

SEQ ID NO: 583615 - DNA, 25 bp, Homo sapien
gcttttatttacacgacagcgactc

SEQ ID NO: 583616 - DNA, 25 bp, Homo sapien
tttatttacacgacagcgactcaaa

SEQ ID NO: 583617 - DNA, 25 bp, Homo sapien
atttacacgacagcgactcaaaagg

SEQ ID NO: 583618 - DNA, 25 bp, Homo sapien
tgacctctcagaatgcagcttgccc

SEQ ID NO: 583619 - DNA, 25 bp, Homo sapien
tgatatagctcatccctcattgggt

SEQ ID NO: 583620 - DNA, 25 bp, Homo sapien
atagctcatccctcattgggtgcat

SEQ ID NO: 583621 - DNA, 25 bp, Homo sapien
accctggttctgatgaagtaaatag

SEQ ID NO: 583622 - DNA, 25 bp, Homo sapien
ggacacatatgtcaccgtggagcct

SEQ ID NO: 583623 - DNA, 25 bp, Homo sapien
atatgtcaccgtggagcctcatgag

SEQ ID NO: 583624 - DNA, 25 bp, Homo sapien
ggagcctcatgagtctctttagata

SEQ ID NO: 583625 - DNA, 25 bp, Homo sapien
gaaaattgcaaaactctccagagac

SEQ ID NO: 583626 - DNA, 25 bp, Homo sapien
ctctccagagacaataccttcctaa

SEQ ID NO: 583627 - DNA, 25 bp, Homo sapien
ttctttgacacctcattgcactgat

SEQ ID NO: 583628 - DNA, 25 bp, Homo sapien
tttgacacctcattgcactgattaa

SEQ ID NO: 583629 - DNA, 25 bp, Homo sapien
ctcttgtcagagaatatggtttatt

SEQ ID NO: 583630 - DNA, 25 bp, Homo sapien
gaatatggtttattttagtcgtttg

SEQ ID NO: 583631 - DNA, 25 bp, Homo sapien
taagatctgcttaatggcaaaatgt

SEQ ID NO: 583632 - DNA, 25 bp, Homo sapien
ggcaaaatgtatggtcagtttttgt

SEQ ID NO: 583633 - DNA, 25 bp, Homo sapien
atgttgccagtaagcttgcgaatca

SEQ ID NO: 583634 - DNA, 25 bp, Homo sapien
agcttgcgaatcatatgtactctag

SEQ ID NO: 583635 - DNA, 25 bp, Homo sapien
gcgaatcatatgtactctagttttg

SEQ ID NO: 583636 - DNA, 25 bp, Homo sapien
atatgtactctagttttgaaatcca

SEQ ID NO: 583637 - DNA, 25 bp, Homo sapien
gaaatccattgctcagtggatgttc

SEQ ID NO: 583638 - DNA, 25 bp, Homo sapien
tcagtggatgttcattaggccaatt

SEQ ID NO: 583639 - DNA, 25 bp, Homo sapien
taggccaatttgtataatcatgttg

SEQ ID NO: 583640 - DNA, 25 bp, Homo sapien
agcaatggccagagcatttctcacc

SEQ ID NO: 583641 - DNA, 25 bp, Homo sapien
tcaccagttctgtgagatagcacat

SEQ ID NO: 583642 - DNA, 25 bp, Homo sapien
ttgggcaaaacttttgggaagcaat

SEQ ID NO: 583643 - DNA, 25 bp, Homo sapien
gaagcaatgcatcctacatgggctg

SEQ ID NO: 583644 - DNA, 25 bp, Homo sapien
tgcatcctacatgggctgatattca

SEQ ID NO: 583645 - DNA, 25 bp, Homo sapien
attcagcctgagctgttctcaagag

SEQ ID NO: 583646 - DNA, 25 bp, Homo sapien
tctcaagaggagagtggtactggca

SEQ ID NO: 583647 - DNA, 25 bp, Homo sapien
ggtactggcagtttatggctgaaat

SEQ ID NO: 583648 - DNA, 25 bp, Homo sapien
tggctgaaatccattctgattggtt

SEQ ID NO: 583649 - DNA, 25 bp, Homo sapien
aaacattttgagtatcactcttgca

SEQ ID NO: 583650 - DNA, 25 bp, Homo sapien
atcactcttgcatactgttactatt

SEQ ID NO: 583651 - DNA, 25 bp, Homo sapien
ggccagagtcagcacaacacccaga

SEQ ID NO: 583652 - DNA, 25 bp, Homo sapien
gagtcagcacaacacccagatgacg

SEQ ID NO: 583653 - DNA, 25 bp, Homo sapien
agatgacgccactacacggcctgcg

SEQ ID NO: 583654 - DNA, 25 bp, Homo sapien
acggcctgcgggagctccggcttct

SEQ ID NO: 583655 - DNA, 25 bp, Homo sapien
tgctcagtagctgcgaatgcatcct

SEQ ID NO: 583656 - DNA, 25 bp, Homo sapien
gtagctgcgaatgcatcctaggcgc

SEQ ID NO: 583657 - DNA, 25 bp, Homo sapien
tgcgaatgcatcctaggcgcgtcct

SEQ ID NO: 583658 - DNA, 25 bp, Homo sapien
gtcctcctctgatccccgtgtaaga

SEQ ID NO: 583659 - DNA, 25 bp, Homo sapien
atccccgtgtaagactgccctggtg

SEQ ID NO: 583660 - DNA, 25 bp, Homo sapien
ccctggtgtcggcacttaggaatgt

SEQ ID NO: 583661 - DNA, 25 bp, Homo sapien
gtgtcggcacttaggaatgtgtaaa

SEQ ID NO: 583662 - DNA, 25 bp, Homo sapien
tccacaactgttgctacaagacgat

SEQ ID NO: 583663 - DNA, 25 bp, Homo sapien
acaagacgattaagtggcttcctga

SEQ ID NO: 583664 - DNA, 25 bp, Homo sapien
tggcttcctgaggacacttgcagac

SEQ ID NO: 583665 - DNA, 25 bp, Homo sapien
ttgcagaccggctggagggcaccaa

SEQ ID NO: 583666 - DNA, 25 bp, Homo sapien
ggagggcaccaaagaactgctttcc

SEQ ID NO: 583667 - DNA, 25 bp, Homo sapien
tgctttcctcagacatgaagaagga

SEQ ID NO: 583668 - DNA, 25 bp, Homo sapien
gaaagttaccgaggctggacagtgt

SEQ ID NO: 583669 - DNA, 25 bp, Homo sapien
atttccttttggataccatctcggg

SEQ ID NO: 583670 - DNA, 25 bp, Homo sapien
ttgatactgcaaaggaagacgtgga

SEQ ID NO: 583671 - DNA, 25 bp, Homo sapien
aagacgtggagttacggaccggcat

SEQ ID NO: 583672 - DNA, 25 bp, Homo sapien
tggagttacggaccggcataccccg

SEQ ID NO: 583673 - DNA, 25 bp, Homo sapien
tcttgaactttgaccgtctttacct

SEQ ID NO: 583674 - DNA, 25 bp, Homo sapien
tgaccgtctttacctaaagattagg

SEQ ID NO: 583675 - DNA, 25 bp, Homo sapien
gatttctctgctctacaaatgtttt

SEQ ID NO: 583676 - DNA, 25 bp, Homo sapien
aatgttttaactgcctctttgaagg

SEQ ID NO: 583677 - DNA, 25 bp, Homo sapien
atggtagcgtttgaaatcatcacag

SEQ ID NO: 583678 - DNA, 25 bp, Homo sapien
gacatgttacataccttttccttga

SEQ ID NO: 583679 - DNA, 25 bp, Homo sapien
taccttttccttgagtatacgctcc

SEQ ID NO: 583680 - DNA, 25 bp, Homo sapien
tatacgctccccaaaattgtttcac

SEQ ID NO: 583681 - DNA, 25 bp, Homo sapien
taattttatgtttttggcctgctat

SEQ ID NO: 583682 - DNA, 25 bp, Homo sapien
ttttggcctgctatttatatcttgg

SEQ ID NO: 583683 - DNA, 25 bp, Homo sapien
tttatatcttggctttctgaacata

SEQ ID NO: 583684 - DNA, 25 bp, Homo sapien
aagttctgttttctattgctaatat

SEQ ID NO: 583685 - DNA, 25 bp, Homo sapien
gaccatcataacatttttcagcttc

SEQ ID NO: 583686 - DNA, 25 bp, Homo sapien
acatttttcagcttcgatttggaca

SEQ ID NO: 583687 - DNA, 25 bp, Homo sapien
cagcttcgatttggacaagtcttat

SEQ ID NO: 583688 - DNA, 25 bp, Homo sapien
tggacaagtcttataaactctattg

SEQ ID NO: 583689 - DNA, 25 bp, Homo sapien
taaactctattgtgactatatggaa

SEQ ID NO: 583690 - DNA, 25 bp, Homo sapien
aaagtggtgggctttaattcagaag

SEQ ID NO: 583691 - DNA, 25 bp, Homo sapien
aattcagaagctccttttcttaagt

SEQ ID NO: 583692 - DNA, 25 bp, Homo sapien
gtctttgaaactgctttattgtgct

SEQ ID NO: 583693 - DNA, 25 bp, Homo sapien
ttgtgctttgggatatatgataggc

SEQ ID NO: 583694 - DNA, 25 bp, Homo sapien
aatttcatagacttgaacccatcaa

SEQ ID NO: 583695 - DNA, 25 bp, Homo sapien
gatagaaatccttcatctctagccc

SEQ ID NO: 583696 - DNA, 25 bp, Homo sapien
tagaaatccttcatctctagcccct

SEQ ID NO: 583697 - DNA, 25 bp, Homo sapien
cgccccatcctgacatagtaggtgg

SEQ ID NO: 583698 - DNA, 25 bp, Homo sapien
ctgacatagtaggtggctcggcaat

SEQ ID NO: 583699 - DNA, 25 bp, Homo sapien
catagtaggtggctcggcaatgata

SEQ ID NO: 583700 - DNA, 25 bp, Homo sapien
caatgatagctggagggaccacgca

SEQ ID NO: 583701 - DNA, 25 bp, Homo sapien
ggaccacgcagtaaaacccatctgt

SEQ ID NO: 583702 - DNA, 25 bp, Homo sapien
gcagtaaaacccatctgtggaaaca

SEQ ID NO: 583703 - DNA, 25 bp, Homo sapien
gtggaaacacatgtattcagagcaa

SEQ ID NO: 583704 - DNA, 25 bp, Homo sapien
cacatgtattcagagcaactttttt

SEQ ID NO: 583705 - DNA, 25 bp, Homo sapien
tcagagcaactttttttggcctgaa

SEQ ID NO: 583706 - DNA, 25 bp, Homo sapien
ctgtctggaatcaccctgtcaaaag

SEQ ID NO: 583707 - DNA, 25 bp, Homo sapien
gtactgatttataaccttgctactc

SEQ ID NO: 583708 - DNA, 25 bp, Homo sapien
ataaccttgctactcacatttctta

SEQ ID NO: 583709 - DNA, 25 bp, Homo sapien
ttggctcctgcatctttgaagtaca

SEQ ID NO: 583710 - DNA, 25 bp, Homo sapien
gaaaatgaactaatatggcagctcc

SEQ ID NO: 583711 - DNA, 25 bp, Homo sapien
tggcagctccaatatgcagctaatc

SEQ ID NO: 583712 - DNA, 25 bp, Homo sapien
agctaatcctgccaatgatgtctcc

SEQ ID NO: 583713 - DNA, 25 bp, Homo sapien
gatgtctcccctggaagtgtttgag

SEQ ID NO: 583714 - DNA, 25 bp, Homo sapien
gtaaacatttgttccattcacgagt

SEQ ID NO: 583715 - DNA, 25 bp, Homo sapien
gttccattcacgagtagcacattaa

SEQ ID NO: 583716 - DNA, 25 bp, Homo sapien
gcacattaatgcctaattctggaaa

SEQ ID NO: 583717 - DNA, 25 bp, Homo sapien
aacttccagcagttgaatttggcgg

SEQ ID NO: 583718 - DNA, 25 bp, Homo sapien
aatttggcgggaaatcgtgtgagca

SEQ ID NO: 583719 - DNA, 25 bp, Homo sapien
tgatggatggcttgccttcatgggt

SEQ ID NO: 583720 - DNA, 25 bp, Homo sapien
ggcttgccttcatgggtgtatttga

SEQ ID NO: 583721 - DNA, 25 bp, Homo sapien
aatttctacctgatccagcattagt

SEQ ID NO: 583722 - DNA, 25 bp, Homo sapien
gcattagtcagaaaacttagccaag

SEQ ID NO: 583723 - DNA, 25 bp, Homo sapien
cttagccaagtgttatccaagttaa

SEQ ID NO: 583724 - DNA, 25 bp, Homo sapien
gttatccaagttaacttttctgcaa

SEQ ID NO: 583725 - DNA, 25 bp, Homo sapien
aagctaggcttgttgggtggcaatt

SEQ ID NO: 583726 - DNA, 25 bp, Homo sapien
gatctcagtgttattacaggtgctt

SEQ ID NO: 583727 - DNA, 25 bp, Homo sapien
ggtgcttttaaactagtaactgctt

SEQ ID NO: 583728 - DNA, 25 bp, Homo sapien
atgttttagttttgtgcacccattg

SEQ ID NO: 583729 - DNA, 25 bp, Homo sapien
gttttagttttgtgcacccattggc

SEQ ID NO: 583730 - DNA, 25 bp, Homo sapien
tttagttttgtgcacccattggcaa

SEQ ID NO: 583731 - DNA, 25 bp, Homo sapien
tagttttgtgcacccattggcaaaa

SEQ ID NO: 583732 - DNA, 25 bp, Homo sapien
tttgtgcacccattggcaaaacagg

SEQ ID NO: 583733 - DNA, 25 bp, Homo sapien
tgtgcacccattggcaaaacaggaa

SEQ ID NO: 583734 - DNA, 25 bp, Homo sapien
gaaagtttccagataggtattgtat

SEQ ID NO: 583735 - DNA, 25 bp, Homo sapien
ataggtattgtatcattgagaatgc

SEQ ID NO: 583736 - DNA, 25 bp, Homo sapien
aggattgcttaagcacaagaggtca

SEQ ID NO: 583737 - DNA, 25 bp, Homo sapien
gaggtcaaggcttcacaagaccctg

SEQ ID NO: 583738 - DNA, 25 bp, Homo sapien
aggtcaaggcttcacaagaccctgt

SEQ ID NO: 583739 - DNA, 25 bp, Homo sapien
ctcgtgtcgtcctgtctctggtgct

SEQ ID NO: 583740 - DNA, 25 bp, Homo sapien
gctgcatccagcacggtggcgaaca

SEQ ID NO: 583741 - DNA, 25 bp, Homo sapien
ggtggcgaacagcagaactaatctt

SEQ ID NO: 583742 - DNA, 25 bp, Homo sapien
atcttttgcaagttatcacagtgga

SEQ ID NO: 583743 - DNA, 25 bp, Homo sapien
tcacagtggagtggagttccgctct

SEQ ID NO: 583744 - DNA, 25 bp, Homo sapien
gtggagttccgctctgtttgctttt

SEQ ID NO: 583745 - DNA, 25 bp, Homo sapien
tggccacagcatacctagcctagtg

SEQ ID NO: 583746 - DNA, 25 bp, Homo sapien
tagcctagtgcttggcacctcaggc

SEQ ID NO: 583747 - DNA, 25 bp, Homo sapien
gcacctcaggcacacaataaatatt

SEQ ID NO: 583748 - DNA, 25 bp, Homo sapien
tctctggtatgtcttgagtgtacta

SEQ ID NO: 583749 - DNA, 25 bp, Homo sapien
gagtgtactagtcttctgttttttc

SEQ ID NO: 583750 - DNA, 25 bp, Homo sapien
tgagatccactgctaaagggtaaag

SEQ ID NO: 583751 - DNA, 25 bp, Homo sapien
tccactgctaaagggtaaagggtca

SEQ ID NO: 583752 - DNA, 25 bp, Homo sapien
gtcagaggctgaagagtactgtgta

SEQ ID NO: 583753 - DNA, 25 bp, Homo sapien
gagtactgtgtaatgtctgcatgag

SEQ ID NO: 583754 - DNA, 25 bp, Homo sapien
gtgtaatgtctgcatgagatttgtt

SEQ ID NO: 583755 - DNA, 25 bp, Homo sapien
aaagtctgaattggcatggtatttt

SEQ ID NO: 583756 - DNA, 25 bp, Homo sapien
atggtattttgaatgctgctggaac

SEQ ID NO: 583757 - DNA, 25 bp, Homo sapien
gaatgctgctggaactgtaataaag

SEQ ID NO: 583758 - DNA, 25 bp, Homo sapien
atagaatttgcccaacaccctttgt

SEQ ID NO: 583759 - DNA, 25 bp, Homo sapien
ccaacaccctttgtgctacagatta

SEQ ID NO: 583760 - DNA, 25 bp, Homo sapien
caccctttgtgctacagattactat

SEQ ID NO: 583761 - DNA, 25 bp, Homo sapien
acaagaggaagtatctgctgtcatt

SEQ ID NO: 583762 - DNA, 25 bp, Homo sapien
ctgctgtcattattcagcgtgctta

SEQ ID NO: 583763 - DNA, 25 bp, Homo sapien
tattcagcgtgcttacagacgccac

SEQ ID NO: 583764 - DNA, 25 bp, Homo sapien
agacgccaccttttaaagcgaactg

SEQ ID NO: 583765 - DNA, 25 bp, Homo sapien
aagcgaactgtaaaacaagcttcct

SEQ ID NO: 583766 - DNA, 25 bp, Homo sapien
ggtggggctaatcttcttataaaag

SEQ ID NO: 583767 - DNA, 25 bp, Homo sapien
gaaaaaactgatctgaccatgtcca

SEQ ID NO: 583768 - DNA, 25 bp, Homo sapien
gatctgaccatgtccactgcagctt

SEQ ID NO: 583769 - DNA, 25 bp, Homo sapien
actgcagcttgtccaccttcctatg

SEQ ID NO: 583770 - DNA, 25 bp, Homo sapien
accttcctatgaccgggtgacaaag

SEQ ID NO: 583771 - DNA, 25 bp, Homo sapien
cctatgaccgggtgacaaagccaat

SEQ ID NO: 583772 - DNA, 25 bp, Homo sapien
ctattgggtgtgacagatatgttct

SEQ ID NO: 583773 - DNA, 25 bp, Homo sapien
gggtgtgacagatatgttctttttt

SEQ ID NO: 583774 - DNA, 25 bp, Homo sapien
gtttcacaggtgtttacaagtgtca

SEQ ID NO: 583775 - DNA, 25 bp, Homo sapien
ttcacaggtgtttacaagtgtcaaa

SEQ ID NO: 583776 - DNA, 25 bp, Homo sapien
tatgtacagtgtatgtcattgcatg

SEQ ID NO: 583777 - DNA, 25 bp, Homo sapien
gtacagtgtatgtcattgcatgtca

SEQ ID NO: 583778 - DNA, 25 bp, Homo sapien
cagtgtatgtcattgcatgtcattt

SEQ ID NO: 583779 - DNA, 25 bp, Homo sapien
atgtcattgcatgtcatttaggtca

SEQ ID NO: 583780 - DNA, 25 bp, Homo sapien
gtcattgcatgtcatttaggtcatt

SEQ ID NO: 583781 - DNA, 25 bp, Homo sapien
cattgcatgtcatttaggtcattgt

SEQ ID NO: 583782 - DNA, 25 bp, Homo sapien
aatgtatgtcatttataactcaata

SEQ ID NO: 583783 - DNA, 25 bp, Homo sapien
tctagaacactgtgaacttcatggc

SEQ ID NO: 583784 - DNA, 25 bp, Homo sapien
gaatacagtcacatatgagtctagg

SEQ ID NO: 583785 - DNA, 25 bp, Homo sapien
gtcacatatgagtctaggcagttaa

SEQ ID NO: 583786 - DNA, 25 bp, Homo sapien
tgagtctaggcagttaaaagctttg

SEQ ID NO: 583787 - DNA, 25 bp, Homo sapien
tagtaatagctgatagtggcattta

SEQ ID NO: 583788 - DNA, 25 bp, Homo sapien
gtggcatttatcaaatggctttgtt

SEQ ID NO: 583789 - DNA, 25 bp, Homo sapien
ttgttatgtaaatttgcatcgcttt

SEQ ID NO: 583790 - DNA, 25 bp, Homo sapien
atttgcatcgctttatttacccttt

SEQ ID NO: 583791 - DNA, 25 bp, Homo sapien
catcgctttatttaccctttggcat

SEQ ID NO: 583792 - DNA, 25 bp, Homo sapien
tatttaccctttggcatctttatat

SEQ ID NO: 583793 - DNA, 25 bp, Homo sapien
gttgaactttgtacacttatgcatt

SEQ ID NO: 583794 - DNA, 25 bp, Homo sapien
cataatattaatggtatcctcttag

SEQ ID NO: 583795 - DNA, 25 bp, Homo sapien
aatggtatcctcttagactctcaat

SEQ ID NO: 583796 - DNA, 25 bp, Homo sapien
gtatcctcttagactctcaatagtg

SEQ ID NO: 583797 - DNA, 25 bp, Homo sapien
gactctcaatagtgtccggtttgga

SEQ ID NO: 583798 - DNA, 25 bp, Homo sapien
gtgtccggtttggatgacaaattct

SEQ ID NO: 583799 - DNA, 25 bp, Homo sapien
gacaaattctgtggtctttttagcc

SEQ ID NO: 583800 - DNA, 25 bp, Homo sapien
ctgtggtctttttagccaactgcta

SEQ ID NO: 583801 - DNA, 25 bp, Homo sapien
gtctttttagccaactgctactgaa

SEQ ID NO: 583802 - DNA, 25 bp, Homo sapien
aaatatggcctcaaatttcttggtt

SEQ ID NO: 583803 - DNA, 25 bp, Homo sapien
atggcctcaaatttcttggttagtt

SEQ ID NO: 583804 - DNA, 25 bp, Homo sapien
ttcttggttagtttccactagaaag

SEQ ID NO: 583805 - DNA, 25 bp, Homo sapien
taaatccaacgggagtggtgtcctg

SEQ ID NO: 583806 - DNA, 25 bp, Homo sapien
aaatccaacgggagtggtgtcctga

SEQ ID NO: 583807 - DNA, 25 bp, Homo sapien
aatccaacgggagtggtgtcctgag

SEQ ID NO: 583808 - DNA, 25 bp, Homo sapien
aacgggagtggtgtcctgaggagaa

SEQ ID NO: 583809 - DNA, 25 bp, Homo sapien
gtgtgccctgtgacaccgaggcaga

SEQ ID NO: 583810 - DNA, 25 bp, Homo sapien
gcgcaggacgccatgcattgccagc

SEQ ID NO: 583811 - DNA, 25 bp, Homo sapien
gcaggacgccatgcattgccagcag

SEQ ID NO: 583812 - DNA, 25 bp, Homo sapien
caggacgccatgcattgccagcagg

SEQ ID NO: 583813 - DNA, 25 bp, Homo sapien
aggacgccatgcattgccagcaggc

SEQ ID NO: 583814 - DNA, 25 bp, Homo sapien
acgccatgcattgccagcaggcgga

SEQ ID NO: 583815 - DNA, 25 bp, Homo sapien
catgcattgccagcaggcggaagct

SEQ ID NO: 583816 - DNA, 25 bp, Homo sapien
aagaagatgaggctgtagacaaaaa

SEQ ID NO: 583817 - DNA, 25 bp, Homo sapien
ggctgtagacaaaaagccaactcta

SEQ ID NO: 583818 - DNA, 25 bp, Homo sapien
agacaaaaagccaactctactcagt

SEQ ID NO: 583819 - DNA, 25 bp, Homo sapien
caaaaagccaactctactcagtgcc

SEQ ID NO: 583820 - DNA, 25 bp, Homo sapien
aaaaagccaactctactcagtgccc

SEQ ID NO: 583821 - DNA, 25 bp, Homo sapien
aaagccaactctactcagtgcccag

SEQ ID NO: 583822 - DNA, 25 bp, Homo sapien
cctgaccttctccatgaggacagat

SEQ ID NO: 583823 - DNA, 25 bp, Homo sapien
ctgaccttctccatgaggacagatt

SEQ ID NO: 583824 - DNA, 25 bp, Homo sapien
gaccttctccatgaggacagattac

SEQ ID NO: 583825 - DNA, 25 bp, Homo sapien
acagtatctgcaggaagagggttcc

SEQ ID NO: 583826 - DNA, 25 bp, Homo sapien
aggaagagggttccggtgtgatgca

SEQ ID NO: 583827 - DNA, 25 bp, Homo sapien
catcatatgggtatctaaacttaat

SEQ ID NO: 583828 - DNA, 25 bp, Homo sapien
taatttacccaataagttgatgctt

SEQ ID NO: 583829 - DNA, 25 bp, Homo sapien
tctattttagttgtggctttgctct

SEQ ID NO: 583830 - DNA, 25 bp, Homo sapien
gtggctttgctctaagaatgggtaa

SEQ ID NO: 583831 - DNA, 25 bp, Homo sapien
gtaatagttgtactacagactgcta

SEQ ID NO: 583832 - DNA, 25 bp, Homo sapien
cagactgctataaatttcttgtgat

SEQ ID NO: 583833 - DNA, 25 bp, Homo sapien
aaatttcttgtgatactcttttaga

SEQ ID NO: 583834 - DNA, 25 bp, Homo sapien
actcttttagagctcaaaatatctc

SEQ ID NO: 583835 - DNA, 25 bp, Homo sapien
atatctctgagctttagacatggta

SEQ ID NO: 583836 - DNA, 25 bp, Homo sapien
tcagtccagtggaaatacaccattc

SEQ ID NO: 583837 - DNA, 25 bp, Homo sapien
acaccattcaattagtcaggtctgg

SEQ ID NO: 583838 - DNA, 25 bp, Homo sapien
acctggcctgacctgcaacttttat

SEQ ID NO: 583839 - DNA, 25 bp, Homo sapien
tggcctgacctgcaacttttatgat

SEQ ID NO: 583840 - DNA, 25 bp, Homo sapien
ggcctgacctgcaacttttatgatc

SEQ ID NO: 583841 - DNA, 25 bp, Homo sapien
gcctgacctgcaacttttatgatct

SEQ ID NO: 583842 - DNA, 25 bp, Homo sapien
cctgacctgcaacttttatgatctc

SEQ ID NO: 583843 - DNA, 25 bp, Homo sapien
tgacctgcaacttttatgatctctg

SEQ ID NO: 583844 - DNA, 25 bp, Homo sapien
gacctgcaacttttatgatctctgg

SEQ ID NO: 583845 - DNA, 25 bp, Homo sapien
ctgcaacttttatgatctctggtaa

SEQ ID NO: 583846 - DNA, 25 bp, Homo sapien
gcaacttttatgatctctggtaaaa

SEQ ID NO: 583847 - DNA, 25 bp, Homo sapien
tttatgatctctggtaaaacatgag

SEQ ID NO: 583848 - DNA, 25 bp, Homo sapien
ctctggtaaaacatgagaaatactt

SEQ ID NO: 583849 - DNA, 25 bp, Homo sapien
ggattcccccagaacaagtgatgaa

SEQ ID NO: 583850 - DNA, 25 bp, Homo sapien
tctttaccgccagcttcagaagtca

SEQ ID NO: 583851 - DNA, 25 bp, Homo sapien
cagcttcagaagtcacgtgccatca

SEQ ID NO: 583852 - DNA, 25 bp, Homo sapien
tcagaagtcacgtgccatcacatct

SEQ ID NO: 583853 - DNA, 25 bp, Homo sapien
cagccctattcagggtaggagtcca

SEQ ID NO: 583854 - DNA, 25 bp, Homo sapien
gagtccaaggacacgaacgccaagg

SEQ ID NO: 583855 - DNA, 25 bp, Homo sapien
gaacgccaaggagtaaggatcactg

SEQ ID NO: 583856 - DNA, 25 bp, Homo sapien
gggctcatcttagagtcggctatga

SEQ ID NO: 583857 - DNA, 25 bp, Homo sapien
gtcggctatgacagctgttaataca

SEQ ID NO: 583858 - DNA, 25 bp, Homo sapien
aatacagccagctatcattgcccat

SEQ ID NO: 583859 - DNA, 25 bp, Homo sapien
ccagctatcattgcccatttgtagg

SEQ ID NO: 583860 - DNA, 25 bp, Homo sapien
tgctgattcaggtgggcccaaaata

SEQ ID NO: 583861 - DNA, 25 bp, Homo sapien
aggtgggcccaaaatatcaccacaa

SEQ ID NO: 583862 - DNA, 25 bp, Homo sapien
aaatatcaccacaagggtcctcata

SEQ ID NO: 583863 - DNA, 25 bp, Homo sapien
tcaccacaagggtcctcataagaaa

SEQ ID NO: 583864 - DNA, 25 bp, Homo sapien
tcataagaaagaggccagaaggtca

SEQ ID NO: 583865 - DNA, 25 bp, Homo sapien
gaatgccgcagccttcagatgccag

SEQ ID NO: 583866 - DNA, 25 bp, Homo sapien
gccgcagccttcagatgccagaaag

SEQ ID NO: 583867 - DNA, 25 bp, Homo sapien
gaaaggaatggattcccctgcctgg

SEQ ID NO: 583868 - DNA, 25 bp, Homo sapien
aaggaatggattcccctgcctggag

SEQ ID NO: 583869 - DNA, 25 bp, Homo sapien
acgccttgacttgagcccattgaaa

SEQ ID NO: 583870 - DNA, 25 bp, Homo sapien
gccttgacttgagcccattgaaact

SEQ ID NO: 583871 - DNA, 25 bp, Homo sapien
gctctttaaagccaaaagtcataca

SEQ ID NO: 583872 - DNA, 25 bp, Homo sapien
aagccaaaagtcatacagctcatga

SEQ ID NO: 583873 - DNA, 25 bp, Homo sapien
gccaaaagtcatacagctcatgaga

SEQ ID NO: 583874 - DNA, 25 bp, Homo sapien
aaagtcatacagctcatgagaagag

SEQ ID NO: 583875 - DNA, 25 bp, Homo sapien
gaagagagaagtcactttgtgctca

SEQ ID NO: 583876 - DNA, 25 bp, Homo sapien
gagagaagtcactttgtgctcaggt

SEQ ID NO: 583877 - DNA, 25 bp, Homo sapien
agagaagtcactttgtgctcaggtg

SEQ ID NO: 583878 - DNA, 25 bp, Homo sapien
gagaagtcactttgtgctcaggtga

SEQ ID NO: 583879 - DNA, 25 bp, Homo sapien
gaagtcactttgtgctcaggtgaac

SEQ ID NO: 583880 - DNA, 25 bp, Homo sapien
aagtcactttgtgctcaggtgaaca

SEQ ID NO: 583881 - DNA, 25 bp, Homo sapien
agtcactttgtgctcaggtgaacag

SEQ ID NO: 583882 - DNA, 25 bp, Homo sapien
agaggatggtggacatgccagccaa

SEQ ID NO: 583883 - DNA, 25 bp, Homo sapien
gatggtggacatgccagccaacaac

SEQ ID NO: 583884 - DNA, 25 bp, Homo sapien
gtggacatgccagccaacaacaaat

SEQ ID NO: 583885 - DNA, 25 bp, Homo sapien
gccaacaacaaatgcctgatcttcc

SEQ ID NO: 583886 - DNA, 25 bp, Homo sapien
aacaaatgcctgatcttccggaaaa

SEQ ID NO: 583887 - DNA, 25 bp, Homo sapien
aaatgcctgatcttccggaaaaact

SEQ ID NO: 583888 - DNA, 25 bp, Homo sapien
atgcctgatcttccggaaaaactaa

SEQ ID NO: 583889 - DNA, 25 bp, Homo sapien
tccctaggccggaccttgtggacga

SEQ ID NO: 583890 - DNA, 25 bp, Homo sapien
taggccggaccttgtggacgacagc

SEQ ID NO: 583891 - DNA, 25 bp, Homo sapien
ggccggaccttgtggacgacagccc

SEQ ID NO: 583892 - DNA, 25 bp, Homo sapien
agaataaagcatgtcctgctgccgg

SEQ ID NO: 583893 - DNA, 25 bp, Homo sapien
agcacattccttttgcaggtctgag

SEQ ID NO: 583894 - DNA, 25 bp, Homo sapien
aggtctgagctaagcccctgaaagc

SEQ ID NO: 583895 - DNA, 25 bp, Homo sapien
tcataaaaggactgttcccgcggcc

SEQ ID NO: 583896 - DNA, 25 bp, Homo sapien
aaggtgcctgttgttcacacttaag

SEQ ID NO: 583897 - DNA, 25 bp, Homo sapien
gtttataaagctactggccccagat

SEQ ID NO: 583898 - DNA, 25 bp, Homo sapien
aggagcaccaaagctgaggctggct

SEQ ID NO: 583899 - DNA, 25 bp, Homo sapien
gaggctggctcagagatctccagag

SEQ ID NO: 583900 - DNA, 25 bp, Homo sapien
tggcccacattgcacatggaaaccc

SEQ ID NO: 583901 - DNA, 25 bp, Homo sapien
aacccaaaggcatatatctgcgtat

SEQ ID NO: 583902 - DNA, 25 bp, Homo sapien
atctgcgtatgtgtggtacttagtc

SEQ ID NO: 583903 - DNA, 25 bp, Homo sapien
ggtacttagtcacatctttgtcaac

SEQ ID NO: 583904 - DNA, 25 bp, Homo sapien
gattttccggagtaaacaagagcct

SEQ ID NO: 583905 - DNA, 25 bp, Homo sapien
gagtaaacaagagcctagagccctt

SEQ ID NO: 583906 - DNA, 25 bp, Homo sapien
aaacaagagcctagagccctttgct

SEQ ID NO: 583907 - DNA, 25 bp, Homo sapien
tagagccctttgctcaatgctggat

SEQ ID NO: 583908 - DNA, 25 bp, Homo sapien
gctcaatgctggatttaatacgtat

SEQ ID NO: 583909 - DNA, 25 bp, Homo sapien
ccctttgatttttgatcttcgcgac

SEQ ID NO: 583910 - DNA, 25 bp, Homo sapien
tttgatttttgatcttcgcgacagt

SEQ ID NO: 583911 - DNA, 25 bp, Homo sapien
atcgttgttgccgtcgttttctctc

SEQ ID NO: 583912 - DNA, 25 bp, Homo sapien
ccgcgtggctccttgacctgcgagg

SEQ ID NO: 583913 - DNA, 25 bp, Homo sapien
gagaggacaccgaagccgggagctc

SEQ ID NO: 583914 - DNA, 25 bp, Homo sapien
cgggagctcgcagggaccatgtatc

SEQ ID NO: 583915 - DNA, 25 bp, Homo sapien
acttcctttttctcagaggtcaatg

SEQ ID NO: 583916 - DNA, 25 bp, Homo sapien
aggtcaatgcctgatgccaggtcca

SEQ ID NO: 583917 - DNA, 25 bp, Homo sapien
gatgccaggtccactcactgaaatt

SEQ ID NO: 583918 - DNA, 25 bp, Homo sapien
agactggaatttgttgccttggagc

SEQ ID NO: 583919 - DNA, 25 bp, Homo sapien
gttgccttggagcatgtatatacat

SEQ ID NO: 583920 - DNA, 25 bp, Homo sapien
atacattctcttgttattctcctcc

SEQ ID NO: 583921 - DNA, 25 bp, Homo sapien
agttcctcatcaggaccttctgttg

SEQ ID NO: 583922 - DNA, 25 bp, Homo sapien
aggaccttctgttgcttctaatagt

SEQ ID NO: 583923 - DNA, 25 bp, Homo sapien
tgcttctaatagttaacctctttaa

SEQ ID NO: 583924 - DNA, 25 bp, Homo sapien
taaatagcacagtttccctcttctg

SEQ ID NO: 583925 - DNA, 25 bp, Homo sapien
gttgcagtagggttctgatggcatt

SEQ ID NO: 583926 - DNA, 25 bp, Homo sapien
ttcacctggaggaaaccacctgttt

SEQ ID NO: 583927 - DNA, 25 bp, Homo sapien
cacctggaggaaaccacctgtttgg

SEQ ID NO: 583928 - DNA, 25 bp, Homo sapien
tggcccttcagtttcccctaacttg

SEQ ID NO: 583929 - DNA, 25 bp, Homo sapien
ttcccctaacttggactcctaagag

SEQ ID NO: 583930 - DNA, 25 bp, Homo sapien
cttggactcctaagagatttggatt

SEQ ID NO: 583931 - DNA, 25 bp, Homo sapien
gggtggtgatatgacctttaagttt

SEQ ID NO: 583932 - DNA, 25 bp, Homo sapien
gtgatatgacctttaagtttacaag

SEQ ID NO: 583933 - DNA, 25 bp, Homo sapien
gaagaagacttactccacttgccaa

SEQ ID NO: 583934 - DNA, 25 bp, Homo sapien
agaagacttactccacttgccaacc

SEQ ID NO: 583935 - DNA, 25 bp, Homo sapien
ttttcttacttaacattgtgctaga

SEQ ID NO: 583936 - DNA, 25 bp, Homo sapien
tcttacttaacattgtgctagatgc

SEQ ID NO: 583937 - DNA, 25 bp, Homo sapien
ctttccctgaagatctaaggatata

SEQ ID NO: 583938 - DNA, 25 bp, Homo sapien
tttccctgaagatctaaggatataa

SEQ ID NO: 583939 - DNA, 25 bp, Homo sapien
ttccctgaagatctaaggatataac

SEQ ID NO: 583940 - DNA, 25 bp, Homo sapien
tccctgaagatctaaggatataacc

SEQ ID NO: 583941 - DNA, 25 bp, Homo sapien
ccctgaagatctaaggatataacca

SEQ ID NO: 583942 - DNA, 25 bp, Homo sapien
tgaagatctaaggatataaccagct

SEQ ID NO: 583943 - DNA, 25 bp, Homo sapien
gaagatctaaggatataaccagctt

SEQ ID NO: 583944 - DNA, 25 bp, Homo sapien
aagatctaaggatataaccagcttc

SEQ ID NO: 583945 - DNA, 25 bp, Homo sapien
agatctaaggatataaccagcttca

SEQ ID NO: 583946 - DNA, 25 bp, Homo sapien
gatctaaggatataaccagcttcat

SEQ ID NO: 583947 - DNA, 25 bp, Homo sapien
atctaaggatataaccagcttcatc

SEQ ID NO: 583948 - DNA, 25 bp, Homo sapien
ccatttggtttttgttcatatgatc

SEQ ID NO: 583949 - DNA, 25 bp, Homo sapien
ttgttcatatgatctatttttctcc

SEQ ID NO: 583950 - DNA, 25 bp, Homo sapien
tatttttctcctgagactttctatt

SEQ ID NO: 583951 - DNA, 25 bp, Homo sapien
catttgcttcatattcattaaatgc

SEQ ID NO: 583952 - DNA, 25 bp, Homo sapien
ggagaaattttatcatagcagcttt

SEQ ID NO: 583953 - DNA, 25 bp, Homo sapien
tatatcattgtcttagcctattcag

SEQ ID NO: 583954 - DNA, 25 bp, Homo sapien
tatcattgtcttagcctattcaggc

SEQ ID NO: 583955 - DNA, 25 bp, Homo sapien
gtcttagcctattcaggctgccatc

SEQ ID NO: 583956 - DNA, 25 bp, Homo sapien
gcctattcaggctgccatcacaaaa

SEQ ID NO: 583957 - DNA, 25 bp, Homo sapien
aggctgccatcacaaaacaccacag

SEQ ID NO: 583958 - DNA, 25 bp, Homo sapien
ggaggctggaaagtatacactatca

SEQ ID NO: 583959 - DNA, 25 bp, Homo sapien
agagatagggtatcgtcacgttgcc

SEQ ID NO: 583960 - DNA, 25 bp, Homo sapien
tagggtatcgtcacgttgcccaggc

SEQ ID NO: 583961 - DNA, 25 bp, Homo sapien
ctttctacgctcaagtcttttggag

SEQ ID NO: 583962 - DNA, 25 bp, Homo sapien
tacgctcaagtcttttggagaagtt

SEQ ID NO: 583963 - DNA, 25 bp, Homo sapien
cttttggagaagtttgagatgtgac

SEQ ID NO: 583964 - DNA, 25 bp, Homo sapien
acagcagcaggcatcagaggctagc

SEQ ID NO: 583965 - DNA, 25 bp, Homo sapien
aggcatcagaggctagcagctctcc

SEQ ID NO: 583966 - DNA, 25 bp, Homo sapien
agctctcccccaccatgaagaattt

SEQ ID NO: 583967 - DNA, 25 bp, Homo sapien
aatttttcccattcagattccagct

SEQ ID NO: 583968 - DNA, 25 bp, Homo sapien
tttttcccattcagattccagcttc

SEQ ID NO: 583969 - DNA, 25 bp, Homo sapien
gcatggagaagctggctttgctcag

SEQ ID NO: 583970 - DNA, 25 bp, Homo sapien
ttccggtgtgatgcatcaggaatgt

SEQ ID NO: 583971 - DNA, 25 bp, Homo sapien
agtcctgtgagctctcggtggctca

SEQ ID NO: 583972 - DNA, 25 bp, Homo sapien
agctctcggtggctcagaagcccag

SEQ ID NO: 583973 - DNA, 25 bp, Homo sapien
tcttctcctgcagtgacatccttgg

SEQ ID NO: 583974 - DNA, 25 bp, Homo sapien
tctcctgcagtgacatccttggcat

SEQ ID NO: 583975 - DNA, 25 bp, Homo sapien
accactctgctttggcagtttccta

SEQ ID NO: 583976 - DNA, 25 bp, Homo sapien
actctgctttggcagtttcctaagc

SEQ ID NO: 583977 - DNA, 25 bp, Homo sapien
ttggcagtttcctaagctgtgtctg

SEQ ID NO: 583978 - DNA, 25 bp, Homo sapien
agctgtgtctgccagaccttctcaa

SEQ ID NO: 583979 - DNA, 25 bp, Homo sapien
accttctcaaggtctaggaagcaga

SEQ ID NO: 583980 - DNA, 25 bp, Homo sapien
aggtctaggaagcagaagcctccca

SEQ ID NO: 583981 - DNA, 25 bp, Homo sapien
cgactgatgtaccttgcacacattt

SEQ ID NO: 583982 - DNA, 25 bp, Homo sapien
gatgtaccttgcacacatttcacac

SEQ ID NO: 583983 - DNA, 25 bp, Homo sapien
catttcacaccctcctttttctgtt

SEQ ID NO: 583984 - DNA, 25 bp, Homo sapien
tttttctgtttcatgctccctttct

SEQ ID NO: 583985 - DNA, 25 bp, Homo sapien
tccctcaagccagctctgaatgtgt

SEQ ID NO: 583986 - DNA, 25 bp, Homo sapien
ctgaatgtgtgagcctttgtgccat

SEQ ID NO: 583987 - DNA, 25 bp, Homo sapien
atgtgtgagcctttgtgccatttct

SEQ ID NO: 583988 - DNA, 25 bp, Homo sapien
gtgccatttctgaatttacaaatcc

SEQ ID NO: 583989 - DNA, 25 bp, Homo sapien
aaggcactcatcatggactctcttt

SEQ ID NO: 583990 - DNA, 25 bp, Homo sapien
catggactctctttctagatctttg

SEQ ID NO: 583991 - DNA, 25 bp, Homo sapien
ctagatctttgttgccagttatgga

SEQ ID NO: 583992 - DNA, 25 bp, Homo sapien
gattgcccaccctgatgccttatgg

SEQ ID NO: 583993 - DNA, 25 bp, Homo sapien
accctgatgccttatgggaagctga

SEQ ID NO: 583994 - DNA, 25 bp, Homo sapien
aatacttgttgggtggaccaggcct

SEQ ID NO: 583995 - DNA, 25 bp, Homo sapien
gaccaggcctgccagaatcagggtt

SEQ ID NO: 583996 - DNA, 25 bp, Homo sapien
cagaatcagggtttgctggctatgc

SEQ ID NO: 583997 - DNA, 25 bp, Homo sapien
tatgctctgccttacttcacgtggt

SEQ ID NO: 583998 - DNA, 25 bp, Homo sapien
ttcacgtggtcacaatcccatgaga

SEQ ID NO: 583999 - DNA, 25 bp, Homo sapien
aatcccatgagatccacgctgttaa

SEQ ID NO: 584000 - DNA, 25 bp, Homo sapien
gagatccacgctgttaactccactg

SEQ ID NO: 584001 - DNA, 25 bp, Homo sapien
aagacactgggacctagggcaaaca

SEQ ID NO: 584002 - DNA, 25 bp, Homo sapien
ggacctagggcaaacagaacattga

SEQ ID NO: 584003 - DNA, 25 bp, Homo sapien
ggcatgagccacctgaaaataaaga

SEQ ID NO: 584004 - DNA, 25 bp, Homo sapien
aaataaagaatagcacactcagtga

SEQ ID NO: 584005 - DNA, 25 bp, Homo sapien
ataattatttcccatgaatccactt

SEQ ID NO: 584006 - DNA, 25 bp, Homo sapien
tgaatccacttctgcattttccttc

SEQ ID NO: 584007 - DNA, 25 bp, Homo sapien
cttttggatttctacttatgcaaga

SEQ ID NO: 584008 - DNA, 25 bp, Homo sapien
gatttctacttatgcaagattggga

SEQ ID NO: 584009 - DNA, 25 bp, Homo sapien
gattgggaattcaaattaaccacca

SEQ ID NO: 584010 - DNA, 25 bp, Homo sapien
aaattaaccaccactgtctttctat

SEQ ID NO: 584011 - DNA, 25 bp, Homo sapien
ccactgtctttctatactttttgcc

SEQ ID NO: 584012 - DNA, 25 bp, Homo sapien
ttttgcctttgtagcctcaactatc

SEQ ID NO: 584013 - DNA, 25 bp, Homo sapien
gcctttgtagcctcaactatcagaa

SEQ ID NO: 584014 - DNA, 25 bp, Homo sapien
tcttacccccagttgctttgagctt

SEQ ID NO: 584015 - DNA, 25 bp, Homo sapien
gagcttgatggtcatgagttcttca

SEQ ID NO: 584016 - DNA, 25 bp, Homo sapien
cttgatggtcatgagttcttcagaa

SEQ ID NO: 584017 - DNA, 25 bp, Homo sapien
ggtcatgagttcttcagaaaccttg

SEQ ID NO: 584018 - DNA, 25 bp, Homo sapien
ttcagaaaccttgccctttttgata

SEQ ID NO: 584019 - DNA, 25 bp, Homo sapien
accttgccctttttgataacttgtg

SEQ ID NO: 584020 - DNA, 25 bp, Homo sapien
gccctttttgataacttgtgcattg

SEQ ID NO: 584021 - DNA, 25 bp, Homo sapien
aacttgtgcattgagaggacatcca

SEQ ID NO: 584022 - DNA, 25 bp, Homo sapien
ttgtgcattgagaggacatccagat

SEQ ID NO: 584023 - DNA, 25 bp, Homo sapien
gagaggacatccagataagctgtga

SEQ ID NO: 584024 - DNA, 25 bp, Homo sapien
ggacatccagataagctgtgaaaat

SEQ ID NO: 584025 - DNA, 25 bp, Homo sapien
ttagactccttgttccttaagttgg

SEQ ID NO: 584026 - DNA, 25 bp, Homo sapien
gttccttaagttggttatgtgttag

SEQ ID NO: 584027 - DNA, 25 bp, Homo sapien
gtgttaggtgaccttgctagttccc

SEQ ID NO: 584028 - DNA, 25 bp, Homo sapien
gtgaccttgctagttccctaatttt

SEQ ID NO: 584029 - DNA, 25 bp, Homo sapien
ccaagtttccattttctcaccaata

SEQ ID NO: 584030 - DNA, 25 bp, Homo sapien
ctcaccaataaatcgagactaatta

SEQ ID NO: 584031 - DNA, 25 bp, Homo sapien
gaaaatctacacaaggcttttagca

SEQ ID NO: 584032 - DNA, 25 bp, Homo sapien
aaggcttttagcacactgcctgaca

SEQ ID NO: 584033 - DNA, 25 bp, Homo sapien
ttttagcacactgcctgacacatag

SEQ ID NO: 584034 - DNA, 25 bp, Homo sapien
gaaagtgttttctaaatgctagcta

SEQ ID NO: 584035 - DNA, 25 bp, Homo sapien
ggcataattctgtcatagatccaaa

SEQ ID NO: 584036 - DNA, 25 bp, Homo sapien
tgggagctggatgtggacaactctt

SEQ ID NO: 584037 - DNA, 25 bp, Homo sapien
agctggatgtggacaactcttgtga

SEQ ID NO: 584038 - DNA, 25 bp, Homo sapien
gtggacaactcttgtgactgggctc

SEQ ID NO: 584039 - DNA, 25 bp, Homo sapien
caactcttgtgactgggctctggga

SEQ ID NO: 584040 - DNA, 25 bp, Homo sapien
actgggctctgggagtctgtaacaa

SEQ ID NO: 584041 - DNA, 25 bp, Homo sapien
gggctctgggagtctgtaacaactc

SEQ ID NO: 584042 - DNA, 25 bp, Homo sapien
agtctgtaacaactcctggataagg

SEQ ID NO: 584043 - DNA, 25 bp, Homo sapien
cctggataaggaagaatagcacaat

SEQ ID NO: 584044 - DNA, 25 bp, Homo sapien
aggaagaatagcacaatggttaact

SEQ ID NO: 584045 - DNA, 25 bp, Homo sapien
gttaactctgaggacatatttcttc

SEQ ID NO: 584046 - DNA, 25 bp, Homo sapien
ctctgaggacatatttcttcttttg

SEQ ID NO: 584047 - DNA, 25 bp, Homo sapien
agactctgaaaataggtcactacca

SEQ ID NO: 584048 - DNA, 25 bp, Homo sapien
taggtcactaccaaatgctttccag

SEQ ID NO: 584049 - DNA, 25 bp, Homo sapien
actaccaaatgctttccagcctttt

SEQ ID NO: 584050 - DNA, 25 bp, Homo sapien
gccttttgaccactgtcactttgaa

SEQ ID NO: 584051 - DNA, 25 bp, Homo sapien
aatcaatggaccagcaaagtggcat

SEQ ID NO: 584052 - DNA, 25 bp, Homo sapien
tgattactcctcatgttacctttca

SEQ ID NO: 584053 - DNA, 25 bp, Homo sapien
atgttacctttcaattcctctttct

SEQ ID NO: 584054 - DNA, 25 bp, Homo sapien
atttgactccccaccggccatgaga

SEQ ID NO: 584055 - DNA, 25 bp, Homo sapien
ggccatgagactaaggctgaccttt

SEQ ID NO: 584056 - DNA, 25 bp, Homo sapien
taaggctgacctttcataaacccac

SEQ ID NO: 584057 - DNA, 25 bp, Homo sapien
agctcaatgtgcatactgtatttat

SEQ ID NO: 584058 - DNA, 25 bp, Homo sapien
atctgaagcagagaaagactggctg

SEQ ID NO: 584059 - DNA, 25 bp, Homo sapien
agactggctgaaagacgaacccaca

SEQ ID NO: 584060 - DNA, 25 bp, Homo sapien
ggctgaaagacgaacccacagagaa

SEQ ID NO: 584061 - DNA, 25 bp, Homo sapien
cccggctcgggcagaaaagctggca

SEQ ID NO: 584062 - DNA, 25 bp, Homo sapien
gaaagtcaacagattgagtttttct

SEQ ID NO: 584063 - DNA, 25 bp, Homo sapien
ttcttttaggaggaaaccattggct

SEQ ID NO: 584064 - DNA, 25 bp, Homo sapien
gaggaaaccattggcttctggttag

SEQ ID NO: 584065 - DNA, 25 bp, Homo sapien
gttctaagaagggaaactggcgtgt

SEQ ID NO: 584066 - DNA, 25 bp, Homo sapien
gtgtgagtaggcagcagtttcagtc

SEQ ID NO: 584067 - DNA, 25 bp, Homo sapien
gagtaggcagcagtttcagtctatt

SEQ ID NO: 584068 - DNA, 25 bp, Homo sapien
cctgctgtagctcttgggctctcac

SEQ ID NO: 584069 - DNA, 25 bp, Homo sapien
accagctgaccaaggtatcctacta

SEQ ID NO: 584070 - DNA, 25 bp, Homo sapien
aaggtatcctactacaaccaggcca

SEQ ID NO: 584071 - DNA, 25 bp, Homo sapien
ggccaccccaggtgttctcaactat

SEQ ID NO: 584072 - DNA, 25 bp, Homo sapien
ttctcaactatgtgaccaccaacgt

SEQ ID NO: 584073 - DNA, 25 bp, Homo sapien
aactatgtgaccaccaacgtggccg

SEQ ID NO: 584074 - DNA, 25 bp, Homo sapien
atgtgaccaccaacgtggccggcct

SEQ ID NO: 584075 - DNA, 25 bp, Homo sapien
ctacaccaccttcaaggcttgtgag

SEQ ID NO: 584076 - DNA, 25 bp, Homo sapien
acaccaccttcaaggcttgtgagca

SEQ ID NO: 584077 - DNA, 25 bp, Homo sapien
gagcagtttctcttggacaaccgga

SEQ ID NO: 584078 - DNA, 25 bp, Homo sapien
gtttctcttggacaaccggaatgat

SEQ ID NO: 584079 - DNA, 25 bp, Homo sapien
tggacaaccggaatgatctggcccc

SEQ ID NO: 584080 - DNA, 25 bp, Homo sapien
tagtattcctttctattgttgcttt

SEQ ID NO: 584081 - DNA, 25 bp, Homo sapien
aaaacagcgagtacaacatttaagt

SEQ ID NO: 584082 - DNA, 25 bp, Homo sapien
gtaactgcatatttgtagatgttca

SEQ ID NO: 584083 - DNA, 25 bp, Homo sapien
attagctacaattgtttctactcaa

SEQ ID NO: 584084 - DNA, 25 bp, Homo sapien
ggtactgagatatctaaagccataa

SEQ ID NO: 584085 - DNA, 25 bp, Homo sapien
gcatttcattgttttcagcctaaga

SEQ ID NO: 584086 - DNA, 25 bp, Homo sapien
agcctaagaattactgagcaatact

SEQ ID NO: 584087 - DNA, 25 bp, Homo sapien
gagcaatacttcaattatccttctt

SEQ ID NO: 584088 - DNA, 25 bp, Homo sapien
tatctgttgatctcagttatgtctt

SEQ ID NO: 584089 - DNA, 25 bp, Homo sapien
gttatgtcttaatttacactgtatc

SEQ ID NO: 584090 - DNA, 25 bp, Homo sapien
gtatctatatattccactatctcaa

SEQ ID NO: 584091 - DNA, 25 bp, Homo sapien
aagggcattgagatcctaaaattga

SEQ ID NO: 584092 - DNA, 25 bp, Homo sapien
gtagatagatatagctgtgggataa

SEQ ID NO: 584093 - DNA, 25 bp, Homo sapien
atagctgtgggataaagaacttctg

SEQ ID NO: 584094 - DNA, 25 bp, Homo sapien
gaacttctgctgaatgatgatttgc

SEQ ID NO: 584095 - DNA, 25 bp, Homo sapien
gatgatttgcaaaagtatgtcttca

SEQ ID NO: 584096 - DNA, 25 bp, Homo sapien
gtcttcagtatagtactgagtacta

SEQ ID NO: 584097 - DNA, 25 bp, Homo sapien
gggcaaataactctgtatttaatct

SEQ ID NO: 584098 - DNA, 25 bp, Homo sapien
gtatttaatcttatgaccttgtata

SEQ ID NO: 584099 - DNA, 25 bp, Homo sapien
gaccttgtataaaatcttgccctaa

SEQ ID NO: 584100 - DNA, 25 bp, Homo sapien
tgtataaaatcttgccctaaactaa

SEQ ID NO: 584101 - DNA, 25 bp, Homo sapien
acaaaatttggtgctatgttaatat

SEQ ID NO: 584102 - DNA, 25 bp, Homo sapien
aagcccctccagatggtgctgttgc

SEQ ID NO: 584103 - DNA, 25 bp, Homo sapien
cctccagatggtgctgttgccgaat

SEQ ID NO: 584104 - DNA, 25 bp, Homo sapien
gcaacagtcaaagaagggaacttcc

SEQ ID NO: 584105 - DNA, 25 bp, Homo sapien
ggatgtcacatgtacttcagtttga

SEQ ID NO: 584106 - DNA, 25 bp, Homo sapien
gtcacatgtacttcagtttgaggat

SEQ ID NO: 584107 - DNA, 25 bp, Homo sapien
gtacttcagtttgaggataaaagca

SEQ ID NO: 584108 - DNA, 25 bp, Homo sapien
aaagatgcaagcatgcaagactcag

SEQ ID NO: 584109 - DNA, 25 bp, Homo sapien
catgcaagactcagatacatttgaa

SEQ ID NO: 584110 - DNA, 25 bp, Homo sapien
ttgaaatctatgatcctcggaatcc

SEQ ID NO: 584111 - DNA, 25 bp, Homo sapien
aatctatgatcctcggaatccagtg

SEQ ID NO: 584112 - DNA, 25 bp, Homo sapien
atgatcctcggaatccagtgaataa

SEQ ID NO: 584113 - DNA, 25 bp, Homo sapien
ggctgagatggttgagaatcacaat

SEQ ID NO: 584114 - DNA, 25 bp, Homo sapien
gagaatcacaattactacttggatg

SEQ ID NO: 584115 - DNA, 25 bp, Homo sapien
attactacttggatgaatttgcaaa

SEQ ID NO: 584116 - DNA, 25 bp, Homo sapien
gaatttgcaaatctgttagacgaac

SEQ ID NO: 584117 - DNA, 25 bp, Homo sapien
atctgttagacgaacttctgatgaa

SEQ ID NO: 584118 - DNA, 25 bp, Homo sapien
agattaatggtttgtccgacagcct

SEQ ID NO: 584119 - DNA, 25 bp, Homo sapien
atggtttgtccgacagcctacaact

SEQ ID NO: 584120 - DNA, 25 bp, Homo sapien
ggcaaggacagaagagagtccctta

SEQ ID NO: 584121 - DNA, 25 bp, Homo sapien
gagagtcccttagtggacatttcta

SEQ ID NO: 584122 - DNA, 25 bp, Homo sapien
ggacatttctagttaccaagctgct

SEQ ID NO: 584123 - DNA, 25 bp, Homo sapien
acatttctagttaccaagctgctga

SEQ ID NO: 584124 - DNA, 25 bp, Homo sapien
atgcgggccgtttcgctgttgctaa

SEQ ID NO: 584125 - DNA, 25 bp, Homo sapien
tgcgggccgtttcgctgttgctaaa

SEQ ID NO: 584126 - DNA, 25 bp, Homo sapien
gccgtttcgctgttgctaaaaacca

SEQ ID NO: 584127 - DNA, 25 bp, Homo sapien
gtttcgctgttgctaaaaaccaacg

SEQ ID NO: 584128 - DNA, 25 bp, Homo sapien
gctgttgctaaaaaccaacgcccag

SEQ ID NO: 584129 - DNA, 25 bp, Homo sapien
ctgttgctaaaaaccaacgcccagg

SEQ ID NO: 584130 - DNA, 25 bp, Homo sapien
aaactgttttttggaagcagcgatg

SEQ ID NO: 584131 - DNA, 25 bp, Homo sapien
actgttttttggaagcagcgatgaa

SEQ ID NO: 584132 - DNA, 25 bp, Homo sapien
aagcagcgatgaacgggatagtgca

SEQ ID NO: 584133 - DNA, 25 bp, Homo sapien
agcgatgaacgggatagtgcatgac

SEQ ID NO: 584134 - DNA, 25 bp, Homo sapien
ggatagtgcatgacgtggacgtgct

SEQ ID NO: 584135 - DNA, 25 bp, Homo sapien
cccgtgcccacatcaaggagtattt

SEQ ID NO: 584136 - DNA, 25 bp, Homo sapien
gtgcccacatcaaggagtatttcta

SEQ ID NO: 584137 - DNA, 25 bp, Homo sapien
aggagtatttctacaccagtggcaa

SEQ ID NO: 584138 - DNA, 25 bp, Homo sapien
agtggcaagtgctccaacccagcag

SEQ ID NO: 584139 - DNA, 25 bp, Homo sapien
agtgctccaacccagcagtcgtctt

SEQ ID NO: 584140 - DNA, 25 bp, Homo sapien
agcagtcgtctttgtcacccgaaag

SEQ ID NO: 584141 - DNA, 25 bp, Homo sapien
cagtcgtctttgtcacccgaaagaa

SEQ ID NO: 584142 - DNA, 25 bp, Homo sapien
tttgtcacccgaaagaaccgccaag

SEQ ID NO: 584143 - DNA, 25 bp, Homo sapien
aaagaaccgccaagtgtgtgccaac

SEQ ID NO: 584144 - DNA, 25 bp, Homo sapien
caagtgtgtgccaacccagagaaga

SEQ ID NO: 584145 - DNA, 25 bp, Homo sapien
gaagaaatgggttcgggagtacatc

SEQ ID NO: 584146 - DNA, 25 bp, Homo sapien
gaatgtttctcatcctgttttaacc

SEQ ID NO: 584147 - DNA, 25 bp, Homo sapien
catcctgttttaaccacaaggagca

SEQ ID NO: 584148 - DNA, 25 bp, Homo sapien
taaccacaaggagcagaaagatctg

SEQ ID NO: 584149 - DNA, 25 bp, Homo sapien
agaattttatcagaagaacttcaac

SEQ ID NO: 584150 - DNA, 25 bp, Homo sapien
ataaaattcaccataaacttaactg

SEQ ID NO: 584151 - DNA, 25 bp, Homo sapien
gtagttgaattacctgttcaatatt

SEQ ID NO: 584152 - DNA, 25 bp, Homo sapien
gaattacctgttcaatattgtatga

SEQ ID NO: 584153 - DNA, 25 bp, Homo sapien
atgtgttcacagtaaaccttttgca

SEQ ID NO: 584154 - DNA, 25 bp, Homo sapien
acagtaaaccttttgcaaatgtcac

SEQ ID NO: 584155 - DNA, 25 bp, Homo sapien
atgtcacaggaatgtgtggaagcca

SEQ ID NO: 584156 - DNA, 25 bp, Homo sapien
atgtgtggaagccaaatgaattccc

SEQ ID NO: 584157 - DNA, 25 bp, Homo sapien
tcttccagcattggtgtgtcctcca

SEQ ID NO: 584158 - DNA, 25 bp, Homo sapien
cttccagcattggtgtgtcctccag

SEQ ID NO: 584159 - DNA, 25 bp, Homo sapien
tccaaaacctgtttgttccagtgga

SEQ ID NO: 584160 - DNA, 25 bp, Homo sapien
caaaacctgtttgttccagtggaca

SEQ ID NO: 584161 - DNA, 25 bp, Homo sapien
aaacctgtttgttccagtggacaca

SEQ ID NO: 584162 - DNA, 25 bp, Homo sapien
acctgtttgttccagtggacacaga

SEQ ID NO: 584163 - DNA, 25 bp, Homo sapien
ctgtttgttccagtggacacagagt

SEQ ID NO: 584164 - DNA, 25 bp, Homo sapien
ttgttccagtggacacagagtagga

SEQ ID NO: 584165 - DNA, 25 bp, Homo sapien
cagtggacacagagtaggaaatgct

SEQ ID NO: 584166 - DNA, 25 bp, Homo sapien
agagtaggaaatgctgactcgttca

SEQ ID NO: 584167 - DNA, 25 bp, Homo sapien
agtgcccttgggtccttgcgggtgt

SEQ ID NO: 584168 - DNA, 25 bp, Homo sapien
aaaacttcaggctttcatgacctac

SEQ ID NO: 584169 - DNA, 25 bp, Homo sapien
aggctttcatgacctacagctcaga

SEQ ID NO: 584170 - DNA, 25 bp, Homo sapien
atttctactcctgcaggatttctgg

SEQ ID NO: 584171 - DNA, 25 bp, Homo sapien
ctggaagcaaatccttatgtgactt

SEQ ID NO: 584172 - DNA, 25 bp, Homo sapien
tgtgactttgatagcactgaagaaa

SEQ ID NO: 584173 - DNA, 25 bp, Homo sapien
ttttaaactcggctttggatcatgc

SEQ ID NO: 584174 - DNA, 25 bp, Homo sapien
tcggctttggatcatgccctaagga

SEQ ID NO: 584175 - DNA, 25 bp, Homo sapien
gccctaaggacagcaaccattttga

SEQ ID NO: 584176 - DNA, 25 bp, Homo sapien
aaacgattgcagaagaccttgctaa

SEQ ID NO: 584177 - DNA, 25 bp, Homo sapien
aagaccttgctaaagcacagaggtg

SEQ ID NO: 584178 - DNA, 25 bp, Homo sapien
cacagaggtggaggaatcgactgaa

SEQ ID NO: 584179 - DNA, 25 bp, Homo sapien
gaagttgaacacagaacccaaagat

SEQ ID NO: 584180 - DNA, 25 bp, Homo sapien
agatgtgagttgatctgtatcattc

SEQ ID NO: 584181 - DNA, 25 bp, Homo sapien
gagttgatctgtatcattctgcttc

SEQ ID NO: 584182 - DNA, 25 bp, Homo sapien
gatctgtatcattctgcttctgtaa

SEQ ID NO: 584183 - DNA, 25 bp, Homo sapien
ctgtatcattctgcttctgtaagtg

SEQ ID NO: 584184 - DNA, 25 bp, Homo sapien
tcattctgcttctgtaagtgtaggc

SEQ ID NO: 584185 - DNA, 25 bp, Homo sapien
gcttctgtaagtgtaggcataaata

SEQ ID NO: 584186 - DNA, 25 bp, Homo sapien
ggcataaataaggtgtcgtggtaat

SEQ ID NO: 584187 - DNA, 25 bp, Homo sapien
taaggtgtcgtggtaatgacttttt

SEQ ID NO: 584188 - DNA, 25 bp, Homo sapien
gtggtaatgactttttagttctctt

SEQ ID NO: 584189 - DNA, 25 bp, Homo sapien
gatggagaaacactctgttacccag

SEQ ID NO: 584190 - DNA, 25 bp, Homo sapien
ggctgctcagccagcaggtgtgaac

SEQ ID NO: 584191 - DNA, 25 bp, Homo sapien
gggttcctgcctcccaagtcacaga

SEQ ID NO: 584192 - DNA, 25 bp, Homo sapien
tcctgcctcccaagtcacagaggga

SEQ ID NO: 584193 - DNA, 25 bp, Homo sapien
tgaggcactggaagacctgcttctc

SEQ ID NO: 584194 - DNA, 25 bp, Homo sapien
aggcactggaagacctgcttctctc

SEQ ID NO: 584195 - DNA, 25 bp, Homo sapien
tccacaggactccacaggaatctgg

SEQ ID NO: 584196 - DNA, 25 bp, Homo sapien
tgaaacttgggccttggttccctgc

SEQ ID NO: 584197 - DNA, 25 bp, Homo sapien
tgggccttggttccctgccctgtag

SEQ ID NO: 584198 - DNA, 25 bp, Homo sapien
tgccctgtagccctgataggttcac

SEQ ID NO: 584199 - DNA, 25 bp, Homo sapien
cctgataggttcacacatgaaggga

SEQ ID NO: 584200 - DNA, 25 bp, Homo sapien
catgaagggaaggttctcaatgcat

SEQ ID NO: 584201 - DNA, 25 bp, Homo sapien
gaggtttcaaaactcaacaattgca

SEQ ID NO: 584202 - DNA, 25 bp, Homo sapien
aattgcagtggcatgctttactctt

SEQ ID NO: 584203 - DNA, 25 bp, Homo sapien
tggcatgctttactcttctaacttt

SEQ ID NO: 584204 - DNA, 25 bp, Homo sapien
gctttactcttctaacttttgctaa

SEQ ID NO: 584205 - DNA, 25 bp, Homo sapien
taacttttgctaaattttctatggg

SEQ ID NO: 584206 - DNA, 25 bp, Homo sapien
gggactgatagctaacctcgactat

SEQ ID NO: 584207 - DNA, 25 bp, Homo sapien
aacctcgactatgggcatgcactat

SEQ ID NO: 584208 - DNA, 25 bp, Homo sapien
tatgggcatgcactatatcacacat

SEQ ID NO: 584209 - DNA, 25 bp, Homo sapien
acacatgcatgacattcaacccact

SEQ ID NO: 584210 - DNA, 25 bp, Homo sapien
attcaacccactcaactctaagagg

SEQ ID NO: 584211 - DNA, 25 bp, Homo sapien
ggtaggtcttattactatcatctct

SEQ ID NO: 584212 - DNA, 25 bp, Homo sapien
tccacaactgtgagaggtaagtttc

SEQ ID NO: 584213 - DNA, 25 bp, Homo sapien
acaactgtgagaggtaagtttctgt

SEQ ID NO: 584214 - DNA, 25 bp, Homo sapien
tggcagcccaagcaaacaccaacat

SEQ ID NO: 584215 - DNA, 25 bp, Homo sapien
cagcccaagcaaacaccaacatttg

SEQ ID NO: 584216 - DNA, 25 bp, Homo sapien
accaacatttgccaattttgattta

SEQ ID NO: 584217 - DNA, 25 bp, Homo sapien
caacatttgccaattttgatttatt

SEQ ID NO: 584218 - DNA, 25 bp, Homo sapien
atctttacaaagtatcatatgtctc

SEQ ID NO: 584219 - DNA, 25 bp, Homo sapien
gtatcatatgtctcattatttcatg

SEQ ID NO: 584220 - DNA, 25 bp, Homo sapien
atcatatgtctcattatttcatgca

SEQ ID NO: 584221 - DNA, 25 bp, Homo sapien
tatgtctcattatttcatgcagaaa

SEQ ID NO: 584222 - DNA, 25 bp, Homo sapien
tcatgcagaaattggtgaccaaatc

SEQ ID NO: 584223 - DNA, 25 bp, Homo sapien
agctctcttctgcatttccattatg

SEQ ID NO: 584224 - DNA, 25 bp, Homo sapien
gctctcttctgcatttccattatgg

SEQ ID NO: 584225 - DNA, 25 bp, Homo sapien
tctcttctgcatttccattatgggt

SEQ ID NO: 584226 - DNA, 25 bp, Homo sapien
ctcttctgcatttccattatgggtg

SEQ ID NO: 584227 - DNA, 25 bp, Homo sapien
tcttctgcatttccattatgggtgt

SEQ ID NO: 584228 - DNA, 25 bp, Homo sapien
ttctgcatttccattatgggtgttg

SEQ ID NO: 584229 - DNA, 25 bp, Homo sapien
ctgcatttccattatgggtgttgat

SEQ ID NO: 584230 - DNA, 25 bp, Homo sapien
gcatttccattatgggtgttgatat

SEQ ID NO: 584231 - DNA, 25 bp, Homo sapien
cattatgggtgttgatatggtttgg

SEQ ID NO: 584232 - DNA, 25 bp, Homo sapien
tcgtaggaggtctgatggttgtata

SEQ ID NO: 584233 - DNA, 25 bp, Homo sapien
ttgcctgcccccacataagacatgc

SEQ ID NO: 584234 - DNA, 25 bp, Homo sapien
tgggtcatccttgtaaccgttggac

SEQ ID NO: 584235 - DNA, 25 bp, Homo sapien
cgttggacgacataacaccacgctt

SEQ ID NO: 584236 - DNA, 25 bp, Homo sapien
atatttaacggatggctgcagagcc

SEQ ID NO: 584237 - DNA, 25 bp, Homo sapien
gagccagctgggaaacacgcggatt

SEQ ID NO: 584238 - DNA, 25 bp, Homo sapien
taatgctccagaaggcacgagactg

SEQ ID NO: 584239 - DNA, 25 bp, Homo sapien
agcgggctgggcttctagcggagac

SEQ ID NO: 584240 - DNA, 25 bp, Homo sapien
ggagaccgcagagggagacatatct

SEQ ID NO: 584241 - DNA, 25 bp, Homo sapien
gggcaataacgtgggtttctctttg

SEQ ID NO: 584242 - DNA, 25 bp, Homo sapien
taacgtgggtttctctttgtatttg

SEQ ID NO: 584243 - DNA, 25 bp, Homo sapien
gtttattttgtaactttgctacttg

SEQ ID NO: 584244 - DNA, 25 bp, Homo sapien
aactttgctacttgaagaccaatta

SEQ ID NO: 584245 - DNA, 25 bp, Homo sapien
tttcctttctgtttcgtattctgta

SEQ ID NO: 584246 - DNA, 25 bp, Homo sapien
ttcctttctgtttcgtattctgtat

SEQ ID NO: 584247 - DNA, 25 bp, Homo sapien
cctttctgtttcgtattctgtattc

SEQ ID NO: 584248 - DNA, 25 bp, Homo sapien
ctgtttcgtattctgtattcagcac

SEQ ID NO: 584249 - DNA, 25 bp, Homo sapien
tttcgtattctgtattcagcacatg

SEQ ID NO: 584250 - DNA, 25 bp, Homo sapien
tcagcacatgttatctatctatcta

SEQ ID NO: 584251 - DNA, 25 bp, Homo sapien
tatataactataaccacacgccgtg

SEQ ID NO: 584252 - DNA, 25 bp, Homo sapien
ataactataaccacacgccgtgtag

SEQ ID NO: 584253 - DNA, 25 bp, Homo sapien
actataaccacacgccgtgtagaca

SEQ ID NO: 584254 - DNA, 25 bp, Homo sapien
gctgccacacactacaggagtcaat

SEQ ID NO: 584255 - DNA, 25 bp, Homo sapien
gccacacactacaggagtcaataaa

SEQ ID NO: 584256 - DNA, 25 bp, Homo sapien
taaatccaacgggagtggtgtcctg

SEQ ID NO: 584257 - DNA, 25 bp, Homo sapien
aatccaacgggagtggtgtcctgag

SEQ ID NO: 584258 - DNA, 25 bp, Homo sapien
gtgtcctgaggagaagagccacctt

SEQ ID NO: 584259 - DNA, 25 bp, Homo sapien
gtgtgccctgtgacaccgaggcaga

SEQ ID NO: 584260 - DNA, 25 bp, Homo sapien
gcaggacgccatgcattgccagcag

SEQ ID NO: 584261 - DNA, 25 bp, Homo sapien
aggacgccatgcattgccagcaggc

SEQ ID NO: 584262 - DNA, 25 bp, Homo sapien
acgccatgcattgccagcaggcgga

SEQ ID NO: 584263 - DNA, 25 bp, Homo sapien
catgcattgccagcaggcggaagct

SEQ ID NO: 584264 - DNA, 25 bp, Homo sapien
ggagggaaagatccatcccaacaag

SEQ ID NO: 584265 - DNA, 25 bp, Homo sapien
aagatccatcccaacaagctcagag

SEQ ID NO: 584266 - DNA, 25 bp, Homo sapien
aagctcagagcagcactcgttttga

SEQ ID NO: 584267 - DNA, 25 bp, Homo sapien
ttaatattggtgtgcctctcttctt

SEQ ID NO: 584268 - DNA, 25 bp, Homo sapien
gcctctcttcttccataaaagtact

SEQ ID NO: 584269 - DNA, 25 bp, Homo sapien
aaactacatatctcagcctttgcag

SEQ ID NO: 584270 - DNA, 25 bp, Homo sapien
gcctttgcagttaggtaaagccatt

SEQ ID NO: 584271 - DNA, 25 bp, Homo sapien
atatatgcacttctaggcctggttt

SEQ ID NO: 584272 - DNA, 25 bp, Homo sapien
cttctaggcctggtttctgaaactt

SEQ ID NO: 584273 - DNA, 25 bp, Homo sapien
gaaacttcttccatgatcctctgtg

SEQ ID NO: 584274 - DNA, 25 bp, Homo sapien
ggaagacttggaagccacaaactga

SEQ ID NO: 584275 - DNA, 25 bp, Homo sapien
ggaagccaagtctctgaatgtctct

SEQ ID NO: 584276 - DNA, 25 bp, Homo sapien
gagctgcacttaggacagacactgt

SEQ ID NO: 584277 - DNA, 25 bp, Homo sapien
atcaatattttgtgtcagaggtcta

SEQ ID NO: 584278 - DNA, 25 bp, Homo sapien
ttcagatgtagccatttacctggct

SEQ ID NO: 584279 - DNA, 25 bp, Homo sapien
tcagatgtagccatttacctggctc

SEQ ID NO: 584280 - DNA, 25 bp, Homo sapien
cagatgtagccatttacctggctct

SEQ ID NO: 584281 - DNA, 25 bp, Homo sapien
agatgtagccatttacctggctctc

SEQ ID NO: 584282 - DNA, 25 bp, Homo sapien
gatgtagccatttacctggctctca

SEQ ID NO: 584283 - DNA, 25 bp, Homo sapien
atgtagccatttacctggctctcaa

SEQ ID NO: 584284 - DNA, 25 bp, Homo sapien
tgtagccatttacctggctctcaag

SEQ ID NO: 584285 - DNA, 25 bp, Homo sapien
gtagccatttacctggctctcaagt

SEQ ID NO: 584286 - DNA, 25 bp, Homo sapien
tagccatttacctggctctcaagtt

SEQ ID NO: 584287 - DNA, 25 bp, Homo sapien
atagtgtgggcagagaccattaggt

SEQ ID NO: 584288 - DNA, 25 bp, Homo sapien
gaccattaggtgagacgcttgatat

SEQ ID NO: 584289 - DNA, 25 bp, Homo sapien
ggtgagacgcttgatatgagataca

SEQ ID NO: 584290 - DNA, 25 bp, Homo sapien
atgagatacaacctcaacaggtgga

SEQ ID NO: 584291 - DNA, 25 bp, Homo sapien
gagaggacacagaagctgacgtcag

SEQ ID NO: 584292 - DNA, 25 bp, Homo sapien
tgacgtcagggtgtctcagtttgaa

SEQ ID NO: 584293 - DNA, 25 bp, Homo sapien
agtttgaaaccagtggccaccctgt

SEQ ID NO: 584294 - DNA, 25 bp, Homo sapien
ccatgtggtcccatcatgggcctct

SEQ ID NO: 584295 - DNA, 25 bp, Homo sapien
tctagggtctgggataagaggttaa

SEQ ID NO: 584296 - DNA, 25 bp, Homo sapien
tgaatatctcataccctaagcaggg

SEQ ID NO: 584297 - DNA, 25 bp, Homo sapien
ggtggtccctgcactttagcaaaaa

SEQ ID NO: 584298 - DNA, 25 bp, Homo sapien
ctcacttctctcagaaccatctttt

SEQ ID NO: 584299 - DNA, 25 bp, Homo sapien
ttctctcagaaccatcttttcgtgc

SEQ ID NO: 584300 - DNA, 25 bp, Homo sapien
agaaccatcttttcgtgcctcttga

SEQ ID NO: 584301 - DNA, 25 bp, Homo sapien
atcttttcgtgcctcttgaaggtga

SEQ ID NO: 584302 - DNA, 25 bp, Homo sapien
tttcgtgcctcttgaaggtgattcc

SEQ ID NO: 584303 - DNA, 25 bp, Homo sapien
cgtgcctcttgaaggtgattccaga

SEQ ID NO: 584304 - DNA, 25 bp, Homo sapien
cttgaaggtgattccagagactctg

SEQ ID NO: 584305 - DNA, 25 bp, Homo sapien
ttccagagactctgtgctctcgtta

SEQ ID NO: 584306 - DNA, 25 bp, Homo sapien
cagagactctgtgctctcgttaaaa

SEQ ID NO: 584307 - DNA, 25 bp, Homo sapien
gactctgtgctctcgttaaaagctc

SEQ ID NO: 584308 - DNA, 25 bp, Homo sapien
gtgctctcgttaaaagctcaaacca

SEQ ID NO: 584309 - DNA, 25 bp, Homo sapien
ggagcttgtgtctgtaccactttga

SEQ ID NO: 584310 - DNA, 25 bp, Homo sapien
gacaacatgccttacaaacacttaa

SEQ ID NO: 584311 - DNA, 25 bp, Homo sapien
ttagagttggcctatttgtcagact

SEQ ID NO: 584312 - DNA, 25 bp, Homo sapien
tatttgtcagactttcctaatttga

SEQ ID NO: 584313 - DNA, 25 bp, Homo sapien
tttgtcagactttcctaatttgaag

SEQ ID NO: 584314 - DNA, 25 bp, Homo sapien
gtcagactttcctaatttgaagacc

SEQ ID NO: 584315 - DNA, 25 bp, Homo sapien
cagactttcctaatttgaagacctc

SEQ ID NO: 584316 - DNA, 25 bp, Homo sapien
tgaagacctccaacttccaaattaa

SEQ ID NO: 584317 - DNA, 25 bp, Homo sapien
gacctccaacttccaaattaattct

SEQ ID NO: 584318 - DNA, 25 bp, Homo sapien
tccaacttccaaattaattctctcc

SEQ ID NO: 584319 - DNA, 25 bp, Homo sapien
aattaattctctcccttgagaaaga

SEQ ID NO: 584320 - DNA, 25 bp, Homo sapien
caaattgatcataaaacctttagga

SEQ ID NO: 584321 - DNA, 25 bp, Homo sapien
aatgccattttattgtgtaagctct

SEQ ID NO: 584322 - DNA, 25 bp, Homo sapien
tgccattttattgtgtaagctcttg

SEQ ID NO: 584323 - DNA, 25 bp, Homo sapien
ttttattgtgtaagctcttgggcat

SEQ ID NO: 584324 - DNA, 25 bp, Homo sapien
tattgtgtaagctcttgggcattat

SEQ ID NO: 584325 - DNA, 25 bp, Homo sapien
ttgtgtaagctcttgggcattatac

SEQ ID NO: 584326 - DNA, 25 bp, Homo sapien
gtgtaagctcttgggcattatacaa

SEQ ID NO: 584327 - DNA, 25 bp, Homo sapien
aagctcttgggcattatacaacaaa

SEQ ID NO: 584328 - DNA, 25 bp, Homo sapien
gctcttgggcattatacaacaaata

SEQ ID NO: 584329 - DNA, 25 bp, Homo sapien
gggcattatacaacaaataatctag

SEQ ID NO: 584330 - DNA, 25 bp, Homo sapien
ggtattaataatttaggtgtcatat

SEQ ID NO: 584331 - DNA, 25 bp, Homo sapien
gagagagagagcacctttcttccgt

SEQ ID NO: 584332 - DNA, 25 bp, Homo sapien
agagagcacctttcttccgtctgtt

SEQ ID NO: 584333 - DNA, 25 bp, Homo sapien
tttcttccgtctgttcactctgcgg

SEQ ID NO: 584334 - DNA, 25 bp, Homo sapien
tctgttcactctgcggcctctggaa

SEQ ID NO: 584335 - DNA, 25 bp, Homo sapien
ttctctctcagaagaagccttctct

SEQ ID NO: 584336 - DNA, 25 bp, Homo sapien
tcctgcctgtaggtgtcccagaagt

SEQ ID NO: 584337 - DNA, 25 bp, Homo sapien
tgtcccagaagtgagaaggcagcct

SEQ ID NO: 584338 - DNA, 25 bp, Homo sapien
aaggcagccttcgaagtcctgggca

SEQ ID NO: 584339 - DNA, 25 bp, Homo sapien
cttcgaagtcctgggcattgggtga

SEQ ID NO: 584340 - DNA, 25 bp, Homo sapien
ggctccagtgtgaagggtgccctgg

SEQ ID NO: 584341 - DNA, 25 bp, Homo sapien
aggtggagagcattaaactgtctgc

SEQ ID NO: 584342 - DNA, 25 bp, Homo sapien
tggtttaaggtgaggctttgtttat

SEQ ID NO: 584343 - DNA, 25 bp, Homo sapien
ttaaggtgaggctttgtttattcct

SEQ ID NO: 584344 - DNA, 25 bp, Homo sapien
taaggtgaggctttgtttattccta

SEQ ID NO: 584345 - DNA, 25 bp, Homo sapien
attcctaatatgtgaataatactga

SEQ ID NO: 584346 - DNA, 25 bp, Homo sapien
gtgaaaaatgtgagtcccagcactt

SEQ ID NO: 584347 - DNA, 25 bp, Homo sapien
tgaaaaatgtgagtcccagcacttt

SEQ ID NO: 584348 - DNA, 25 bp, Homo sapien
gaaaaatgtgagtcccagcactttg

SEQ ID NO: 584349 - DNA, 25 bp, Homo sapien
agccgagatcagatcacgacactgc

SEQ ID NO: 584350 - DNA, 25 bp, Homo sapien
gtttttcttccagggtagtttgcat

SEQ ID NO: 584351 - DNA, 25 bp, Homo sapien
gggtagtttgcattgtctcacttag

SEQ ID NO: 584352 - DNA, 25 bp, Homo sapien
ttgcattgtctcacttagtctccat

SEQ ID NO: 584353 - DNA, 25 bp, Homo sapien
tcctgcaacttccacatctatgagg

SEQ ID NO: 584354 - DNA, 25 bp, Homo sapien
ccacatctatgaggaccaaacaata

SEQ ID NO: 584355 - DNA, 25 bp, Homo sapien
atcttcacagaaaaggccatcaagc

SEQ ID NO: 584356 - DNA, 25 bp, Homo sapien
aaaggccatcaagcaatcagtataa

SEQ ID NO: 584357 - DNA, 25 bp, Homo sapien
gaaagattcaatcaggtcttctacc

SEQ ID NO: 584358 - DNA, 25 bp, Homo sapien
ggtcttctaccttaagactttcagg

SEQ ID NO: 584359 - DNA, 25 bp, Homo sapien
tttcaggcaggaaagtggctcagga

SEQ ID NO: 584360 - DNA, 25 bp, Homo sapien
agcaaagatattcactcatcatcca

SEQ ID NO: 584361 - DNA, 25 bp, Homo sapien
gcagctctttgccaagcccgattgt

SEQ ID NO: 584362 - DNA, 25 bp, Homo sapien
tttgccaagcccgattgtccaggat

SEQ ID NO: 584363 - DNA, 25 bp, Homo sapien
caagcccgattgtccaggatgtgtt

SEQ ID NO: 584364 - DNA, 25 bp, Homo sapien
gattgtccaggatgtgttgagcaaa

SEQ ID NO: 584365 - DNA, 25 bp, Homo sapien
gatgtgttgagcaaagactcctgtg

SEQ ID NO: 584366 - DNA, 25 bp, Homo sapien
ctgtgacccaaacgctggcagccag

SEQ ID NO: 584367 - DNA, 25 bp, Homo sapien
gctggcagccagttgacatttgacc

SEQ ID NO: 584368 - DNA, 25 bp, Homo sapien
ggcagccagttgacatttgaccctg

SEQ ID NO: 584369 - DNA, 25 bp, Homo sapien
gcaggaagtgccagctgtcacagca

SEQ ID NO: 584370 - DNA, 25 bp, Homo sapien
gaagtgccagctgtcacagcaatca

SEQ ID NO: 584371 - DNA, 25 bp, Homo sapien
tgtcacagcaatcacagtgccctgt

SEQ ID NO: 584372 - DNA, 25 bp, Homo sapien
aacagtataggattgagccctgtca

SEQ ID NO: 584373 - DNA, 25 bp, Homo sapien
gtataggattgagccctgtcactga

SEQ ID NO: 584374 - DNA, 25 bp, Homo sapien
taggattgagccctgtcactgagtc

SEQ ID NO: 584375 - DNA, 25 bp, Homo sapien
gattgagccctgtcactgagtcttc

SEQ ID NO: 584376 - DNA, 25 bp, Homo sapien
tgagccctgtcactgagtcttccat

SEQ ID NO: 584377 - DNA, 25 bp, Homo sapien
cctgtcactgagtcttccattcctt

SEQ ID NO: 584378 - DNA, 25 bp, Homo sapien
tctgcgcttaagacaagaatttttt

SEQ ID NO: 584379 - DNA, 25 bp, Homo sapien
ttttcctcctagttgttggttaatg

SEQ ID NO: 584380 - DNA, 25 bp, Homo sapien
ctcctagttgttggttaatgtctgc

SEQ ID NO: 584381 - DNA, 25 bp, Homo sapien
gttgttggttaatgtctgcaaatgt

SEQ ID NO: 584382 - DNA, 25 bp, Homo sapien
atgtctgcaaatgtgagagcatgtt

SEQ ID NO: 584383 - DNA, 25 bp, Homo sapien
tcctaaatatcattctatacaaaag

SEQ ID NO: 584384 - DNA, 25 bp, Homo sapien
aacggtaaggattaagacaatcact

SEQ ID NO: 584385 - DNA, 25 bp, Homo sapien
aggattaagacaatcactgatagct

SEQ ID NO: 584386 - DNA, 25 bp, Homo sapien
gtttatggctgtatgatttattctc

SEQ ID NO: 584387 - DNA, 25 bp, Homo sapien
ggctgtatgatttattctctaattc

SEQ ID NO: 584388 - DNA, 25 bp, Homo sapien
gtatgatttattctctaattctaac

SEQ ID NO: 584389 - DNA, 25 bp, Homo sapien
attctctaattctaacatagtctag

SEQ ID NO: 584390 - DNA, 25 bp, Homo sapien
aattctaacatagtctagttgtcaa

SEQ ID NO: 584391 - DNA, 25 bp, Homo sapien
aacatagtctagttgtcaaaaggaa

SEQ ID NO: 584392 - DNA, 25 bp, Homo sapien
gtaatctttttatgattgttgaatc

SEQ ID NO: 584393 - DNA, 25 bp, Homo sapien
cagtgaataaatgagatgtgcttta

SEQ ID NO: 584394 - DNA, 25 bp, Homo sapien
ccatgcacctctactttgagtcaga

SEQ ID NO: 584395 - DNA, 25 bp, Homo sapien
aaatggattcattgcaggctcagtt

SEQ ID NO: 584396 - DNA, 25 bp, Homo sapien
gcaggctcagttgtttgtattatgt

SEQ ID NO: 584397 - DNA, 25 bp, Homo sapien
gaactgaacgtaaccaagcaccaag

SEQ ID NO: 584398 - DNA, 25 bp, Homo sapien
agcaccaagagagccctaaagacac

SEQ ID NO: 584399 - DNA, 25 bp, Homo sapien
gccctaaagacacagtagacctcct

SEQ ID NO: 584400 - DNA, 25 bp, Homo sapien
agacctcctgtagaagggctctgat

SEQ ID NO: 584401 - DNA, 25 bp, Homo sapien
gggctctgatggaccttcaaacatt

SEQ ID NO: 584402 - DNA, 25 bp, Homo sapien
cttcaaacattgcttctccaacttt

SEQ ID NO: 584403 - DNA, 25 bp, Homo sapien
gcttctccaactttatggtgcacac

SEQ ID NO: 584404 - DNA, 25 bp, Homo sapien
ggtgcacacaaatcacctgtgcatg

SEQ ID NO: 584405 - DNA, 25 bp, Homo sapien
tggtgccaggttgggccgacttcct

SEQ ID NO: 584406 - DNA, 25 bp, Homo sapien
ccaggttgggccgacttcctgaggt

SEQ ID NO: 584407 - DNA, 25 bp, Homo sapien
cccactcccaaaggtcttgagtttg

SEQ ID NO: 584408 - DNA, 25 bp, Homo sapien
actcccaaaggtcttgagtttgcca

SEQ ID NO: 584409 - DNA, 25 bp, Homo sapien
caaaggtcttgagtttgccagcccc

SEQ ID NO: 584410 - DNA, 25 bp, Homo sapien
gagaagggatgcctgcctcccagaa

SEQ ID NO: 584411 - DNA, 25 bp, Homo sapien
agggatgcctgcctcccagaacgta

SEQ ID NO: 584412 - DNA, 25 bp, Homo sapien
ccaggcctgctaaggaccaggctgg

SEQ ID NO: 584413 - DNA, 25 bp, Homo sapien
ctgggaacaccaggcttggatgtgg

SEQ ID NO: 584414 - DNA, 25 bp, Homo sapien
gctgggctgccggagtttctttttc

SEQ ID NO: 584415 - DNA, 25 bp, Homo sapien
gctgccggagtttctttttcttatc

SEQ ID NO: 584416 - DNA, 25 bp, Homo sapien
aagatgactcacttacatgccactg

SEQ ID NO: 584417 - DNA, 25 bp, Homo sapien
tgactcacttacatgccactgcagg

SEQ ID NO: 584418 - DNA, 25 bp, Homo sapien
ttacatgccactgcaggagtcctca

SEQ ID NO: 584419 - DNA, 25 bp, Homo sapien
actgcaggagtcctcagtgtttcac

SEQ ID NO: 584420 - DNA, 25 bp, Homo sapien
cagtgtttcactggcttttagcaga

SEQ ID NO: 584421 - DNA, 25 bp, Homo sapien
cactggcttttagcagagtgcttca

SEQ ID NO: 584422 - DNA, 25 bp, Homo sapien
agcagagtgcttcattccattgcca

SEQ ID NO: 584423 - DNA, 25 bp, Homo sapien
tgcttcattccattgccacatagac

SEQ ID NO: 584424 - DNA, 25 bp, Homo sapien
ttttggtgttacttaagtgccctca

SEQ ID NO: 584425 - DNA, 25 bp, Homo sapien
tgttacttaagtgccctcacaacgt

SEQ ID NO: 584426 - DNA, 25 bp, Homo sapien
aagtgccctcacaacgtggcagctt

SEQ ID NO: 584427 - DNA, 25 bp, Homo sapien
agcttgtataaaggaaggcccgctt

SEQ ID NO: 584428 - DNA, 25 bp, Homo sapien
ggaaggcccgctttgggtactatga

SEQ ID NO: 584429 - DNA, 25 bp, Homo sapien
gcccgctttgggtactatgaggtac

SEQ ID NO: 584430 - DNA, 25 bp, Homo sapien
tatgaggtacctttctcactcagag

SEQ ID NO: 584431 - DNA, 25 bp, Homo sapien
tttctcactcagaggcatgctgtga

SEQ ID NO: 584432 - DNA, 25 bp, Homo sapien
aaatctaccacgtatttcaagtgta

SEQ ID NO: 584433 - DNA, 25 bp, Homo sapien
atatgaattttcctggtagagagtt

SEQ ID NO: 584434 - DNA, 25 bp, Homo sapien
tttttctcttaacccttcattgatg

SEQ ID NO: 584435 - DNA, 25 bp, Homo sapien
gaccaaacaattttgttgtctgtaa

SEQ ID NO: 584436 - DNA, 25 bp, Homo sapien
tactcggttttgtagggtgtcagtc

SEQ ID NO: 584437 - DNA, 25 bp, Homo sapien
gggtgtcagtccttaagaaaatgtt

SEQ ID NO: 584438 - DNA, 25 bp, Homo sapien
aattgagtgtgagctttccttgttt

SEQ ID NO: 584439 - DNA, 25 bp, Homo sapien
gtgagctttccttgtttagttttgt

SEQ ID NO: 584440 - DNA, 25 bp, Homo sapien
cttgtttagttttgttcgagtggct

SEQ ID NO: 584441 - DNA, 25 bp, Homo sapien
gttcgagtggctaaatcaacttgtc

SEQ ID NO: 584442 - DNA, 25 bp, Homo sapien
gtggctaaatcaacttgtctgtggt

SEQ ID NO: 584443 - DNA, 25 bp, Homo sapien
tcaacttgtctgtggttgttaagaa

SEQ ID NO: 584444 - DNA, 25 bp, Homo sapien
gttaagaaaaacagtagtcccagct

SEQ ID NO: 584445 - DNA, 25 bp, Homo sapien
tagtcccagctggtcacggtgctca

SEQ ID NO: 584446 - DNA, 25 bp, Homo sapien
agctggtcacggtgctcagcctgta

SEQ ID NO: 584447 - DNA, 25 bp, Homo sapien
ggcaaagcaaattttgtctccattt

SEQ ID NO: 584448 - DNA, 25 bp, Homo sapien
ttgctcacagtcacaaagcttgtaa

SEQ ID NO: 584449 - DNA, 25 bp, Homo sapien
agcactcctacctaggtactttaag

SEQ ID NO: 584450 - DNA, 25 bp, Homo sapien
atcattgagtggatactccctctgc

SEQ ID NO: 584451 - DNA, 25 bp, Homo sapien
ggatactccctctgctgggtaaaat

SEQ ID NO: 584452 - DNA, 25 bp, Homo sapien
atactttgccacaatatcagctgaa

SEQ ID NO: 584453 - DNA, 25 bp, Homo sapien
tggcagaagtagttatcccctcttt

SEQ ID NO: 584454 - DNA, 25 bp, Homo sapien
tctttcgtgctgtcatcacacttga

SEQ ID NO: 584455 - DNA, 25 bp, Homo sapien
atcacacttgatgcatgcctacttt

SEQ ID NO: 584456 - DNA, 25 bp, Homo sapien
gatgcatgcctactttataatactt

SEQ ID NO: 584457 - DNA, 25 bp, Homo sapien
acttatgccattgtctctgttattg

SEQ ID NO: 584458 - DNA, 25 bp, Homo sapien
gtctctgttattgggtttctgtctt

SEQ ID NO: 584459 - DNA, 25 bp, Homo sapien
gggtttctgtcttctactgtgaaag

SEQ ID NO: 584460 - DNA, 25 bp, Homo sapien
ttagtggatgtttatgctgtttgac

SEQ ID NO: 584461 - DNA, 25 bp, Homo sapien
cttttctcctgtgtaccaaggtatt

SEQ ID NO: 584462 - DNA, 25 bp, Homo sapien
ttctcctgtgtaccaaggtattgct

SEQ ID NO: 584463 - DNA, 25 bp, Homo sapien
tcctgtgtaccaaggtattgctttt

SEQ ID NO: 584464 - DNA, 25 bp, Homo sapien
gtgtaccaaggtattgcttttattt

SEQ ID NO: 584465 - DNA, 25 bp, Homo sapien
ccaaggtattgcttttatttacacg

SEQ ID NO: 584466 - DNA, 25 bp, Homo sapien
aggtattgcttttatttacacgaca

SEQ ID NO: 584467 - DNA, 25 bp, Homo sapien
attgcttttatttacacgacagcga

SEQ ID NO: 584468 - DNA, 25 bp, Homo sapien
gcttttatttacacgacagcgactc

SEQ ID NO: 584469 - DNA, 25 bp, Homo sapien
tttatttacacgacagcgactcaaa

SEQ ID NO: 584470 - DNA, 25 bp, Homo sapien
atttacacgacagcgactcaaaagg

SEQ ID NO: 584471 - DNA, 25 bp, Homo sapien
gatttcatccagaaagagtttaaga

SEQ ID NO: 584472 - DNA, 25 bp, Homo sapien
agtttaagaaaatctcagctcagga

SEQ ID NO: 584473 - DNA, 25 bp, Homo sapien
gccagaacagaaaagatcaatagct

SEQ ID NO: 584474 - DNA, 25 bp, Homo sapien
gatcaatagctttagccacatggaa

SEQ ID NO: 584475 - DNA, 25 bp, Homo sapien
aatagctttagccacatggaagtgt

SEQ ID NO: 584476 - DNA, 25 bp, Homo sapien
gccacatggaagtgtgaacatcctg

SEQ ID NO: 584477 - DNA, 25 bp, Homo sapien
taatttaataactagggacacctgt

SEQ ID NO: 584478 - DNA, 25 bp, Homo sapien
ctgtggcacagactcccactaaaga

SEQ ID NO: 584479 - DNA, 25 bp, Homo sapien
ggcacagactcccactaaagaagta

SEQ ID NO: 584480 - DNA, 25 bp, Homo sapien
cacagactcccactaaagaagtagg

SEQ ID NO: 584481 - DNA, 25 bp, Homo sapien
aaagaagtaggggtgcatggctcat

SEQ ID NO: 584482 - DNA, 25 bp, Homo sapien
ctaggcaaggttttcataacaacaa

SEQ ID NO: 584483 - DNA, 25 bp, Homo sapien
acaacaataaatttggccacccagg

SEQ ID NO: 584484 - DNA, 25 bp, Homo sapien
ataaatttggccacccagggtctgt

SEQ ID NO: 584485 - DNA, 25 bp, Homo sapien
ggccacccagggtctgtgaagtcac

SEQ ID NO: 584486 - DNA, 25 bp, Homo sapien
ccagggtctgtgaagtcacctgtag

SEQ ID NO: 584487 - DNA, 25 bp, Homo sapien
gaagtcacctgtagggtagccttac

SEQ ID NO: 584488 - DNA, 25 bp, Homo sapien
gagtgtccagcaggctcgagtgacc

SEQ ID NO: 584489 - DNA, 25 bp, Homo sapien
cagcaggctcgagtgaccttgggca

SEQ ID NO: 584490 - DNA, 25 bp, Homo sapien
tgaccttgggcatgcagtgttgctc

SEQ ID NO: 584491 - DNA, 25 bp, Homo sapien
gggcatgcagtgttgctcttaatta

SEQ ID NO: 584492 - DNA, 25 bp, Homo sapien
agatggtttctggtttaaagtacat

SEQ ID NO: 584493 - DNA, 25 bp, Homo sapien
tcacgacccgtgctgacgactggat

SEQ ID NO: 584494 - DNA, 25 bp, Homo sapien
acccgtgctgacgactggatgcaag

SEQ ID NO: 584495 - DNA, 25 bp, Homo sapien
aaaggaaccaagaatgtgagacaag

SEQ ID NO: 584496 - DNA, 25 bp, Homo sapien
atgtgagacaagaggacttgctggt

SEQ ID NO: 584497 - DNA, 25 bp, Homo sapien
agcaggtgcctgattgatagtgacg

SEQ ID NO: 584498 - DNA, 25 bp, Homo sapien
gcctgattgatagtgacggttcccc

SEQ ID NO: 584499 - DNA, 25 bp, Homo sapien
tgatagtgacggttccccaaaggct

SEQ ID NO: 584500 - DNA, 25 bp, Homo sapien
gacggttccccaaaggctgctggag

SEQ ID NO: 584501 - DNA, 25 bp, Homo sapien
aaaggctgctggagtcacctctggg

SEQ ID NO: 584502 - DNA, 25 bp, Homo sapien
gctggagtcacctctgggattctgc

SEQ ID NO: 584503 - DNA, 25 bp, Homo sapien
gtgcttggtagaggacacgaaggct

SEQ ID NO: 584504 - DNA, 25 bp, Homo sapien
ataatagaacatcagattctgggcc

SEQ ID NO: 584505 - DNA, 25 bp, Homo sapien
aatagaacatcagattctgggccag

SEQ ID NO: 584506 - DNA, 25 bp, Homo sapien
atagaacatcagattctgggccagg

SEQ ID NO: 584507 - DNA, 25 bp, Homo sapien
tagaacatcagattctgggccaggt

SEQ ID NO: 584508 - DNA, 25 bp, Homo sapien
agaacatcagattctgggccaggta

SEQ ID NO: 584509 - DNA, 25 bp, Homo sapien
gaacatcagattctgggccaggtac

SEQ ID NO: 584510 - DNA, 25 bp, Homo sapien
aacatcagattctgggccaggtacg

SEQ ID NO: 584511 - DNA, 25 bp, Homo sapien
acatcagattctgggccaggtacga

SEQ ID NO: 584512 - DNA, 25 bp, Homo sapien
agattctgggccaggtacgatggct

SEQ ID NO: 584513 - DNA, 25 bp, Homo sapien
gattctgggccaggtacgatggctc

SEQ ID NO: 584514 - DNA, 25 bp, Homo sapien
attctgggccaggtacgatggctca

SEQ ID NO: 584515 - DNA, 25 bp, Homo sapien
gatacccaacttaaaccaaaggcat

SEQ ID NO: 584516 - DNA, 25 bp, Homo sapien
accaaaggcatgtctatcatgtgga

SEQ ID NO: 584517 - DNA, 25 bp, Homo sapien
atgtctatcatgtggatgcagtaac

SEQ ID NO: 584518 - DNA, 25 bp, Homo sapien
atgtggatgcagtaacatttacatt

SEQ ID NO: 584519 - DNA, 25 bp, Homo sapien
aaagcagactgttacaaataagtta

SEQ ID NO: 584520 - DNA, 25 bp, Homo sapien
ctgatatgattgataggttctgttt

SEQ ID NO: 584521 - DNA, 25 bp, Homo sapien
gttctgttttttcttgaagcctatg

SEQ ID NO: 584522 - DNA, 25 bp, Homo sapien
ttcttgaagcctatgtatttggtaa

SEQ ID NO: 584523 - DNA, 25 bp, Homo sapien
gtaaaatataatgtacctagattgt

SEQ ID NO: 584524 - DNA, 25 bp, Homo sapien
ctagattgtaggagatgacagacat

SEQ ID NO: 584525 - DNA, 25 bp, Homo sapien
aataaatctcaggtgctataacatg

SEQ ID NO: 584526 - DNA, 25 bp, Homo sapien
aattatcaatatttgtttctggatg

SEQ ID NO: 584527 - DNA, 25 bp, Homo sapien
atcaatatttgtttctggatggtga

SEQ ID NO: 584528 - DNA, 25 bp, Homo sapien
ttgtttctggatggtgagacttaaa

SEQ ID NO: 584529 - DNA, 25 bp, Homo sapien
gagacttaaaacatttcctgcctct

SEQ ID NO: 584530 - DNA, 25 bp, Homo sapien
agacttaaaacatttcctgcctctt

SEQ ID NO: 584531 - DNA, 25 bp, Homo sapien
atttcctgcctcttttgttttactg

SEQ ID NO: 584532 - DNA, 25 bp, Homo sapien
tttactgtacattccaacttttttg

SEQ ID NO: 584533 - DNA, 25 bp, Homo sapien
tactgtacattccaacttttttgaa

SEQ ID NO: 584534 - DNA, 25 bp, Homo sapien
taattaagtagaagtcggccagtgc

SEQ ID NO: 584535 - DNA, 25 bp, Homo sapien
aattaagtagaagtcggccagtgcg

SEQ ID NO: 584536 - DNA, 25 bp, Homo sapien
attaagtagaagtcggccagtgcgg

SEQ ID NO: 584537 - DNA, 25 bp, Homo sapien
tttttccctatgactgtgtatgttt

SEQ ID NO: 584538 - DNA, 25 bp, Homo sapien
aaacagtaccatcacatacatacgt

SEQ ID NO: 584539 - DNA, 25 bp, Homo sapien
gtaccatcacatacatacgtataga

SEQ ID NO: 584540 - DNA, 25 bp, Homo sapien
gagatggatacatacattctgtggt

SEQ ID NO: 584541 - DNA, 25 bp, Homo sapien
acattctgtggtatggttctgtgac

SEQ ID NO: 584542 - DNA, 25 bp, Homo sapien
gtggtatggttctgtgacctgcctt

SEQ ID NO: 584543 - DNA, 25 bp, Homo sapien
atggttctgtgacctgcctttttgt

SEQ ID NO: 584544 - DNA, 25 bp, Homo sapien
ctgcctttttgtacttgtatcgtga

SEQ ID NO: 584545 - DNA, 25 bp, Homo sapien
gtacttgtatcgtgaatgtctctcc

SEQ ID NO: 584546 - DNA, 25 bp, Homo sapien
ttgtatcgtgaatgtctctccctgg

SEQ ID NO: 584547 - DNA, 25 bp, Homo sapien
tccctggcattaaatattctatcac

SEQ ID NO: 584548 - DNA, 25 bp, Homo sapien
ccatacagtttcagcagtaaacaat

SEQ ID NO: 584549 - DNA, 25 bp, Homo sapien
tttcagcagtaaacaatggcgggtt

SEQ ID NO: 584550 - DNA, 25 bp, Homo sapien
aacaatggcgggttgctgacacact

SEQ ID NO: 584551 - DNA, 25 bp, Homo sapien
caatggcgggttgctgacacactgg

SEQ ID NO: 584552 - DNA, 25 bp, Homo sapien
gagaaccgggcttgaggtgaataca

SEQ ID NO: 584553 - DNA, 25 bp, Homo sapien
ccgggcttgaggtgaatacattatc

SEQ ID NO: 584554 - DNA, 25 bp, Homo sapien
gcttgaggtgaatacattatctata

SEQ ID NO: 584555 - DNA, 25 bp, Homo sapien
tatctatatgaaaagcagggcatgc

SEQ ID NO: 584556 - DNA, 25 bp, Homo sapien
agggcatgctgtgaatccagcacaa

SEQ ID NO: 584557 - DNA, 25 bp, Homo sapien
gctgtgaatccagcacaaggaaatg

SEQ ID NO: 584558 - DNA, 25 bp, Homo sapien
aaggaaatgagcagacaattcctcc

SEQ ID NO: 584559 - DNA, 25 bp, Homo sapien
tatttgtcagactttcctaatttga

SEQ ID NO: 584560 - DNA, 25 bp, Homo sapien
atttgtcagactttcctaatttgaa

SEQ ID NO: 584561 - DNA, 25 bp, Homo sapien
tttgtcagactttcctaatttgaag

SEQ ID NO: 584562 - DNA, 25 bp, Homo sapien
tgtcagactttcctaatttgaagac

SEQ ID NO: 584563 - DNA, 25 bp, Homo sapien
gtcagactttcctaatttgaagacc

SEQ ID NO: 584564 - DNA, 25 bp, Homo sapien
cagactttcctaatttgaagacctc

SEQ ID NO: 584565 - DNA, 25 bp, Homo sapien
tgaagacctccaacttccaaattaa

SEQ ID NO: 584566 - DNA, 25 bp, Homo sapien
gaagacctccaacttccaaattaat

SEQ ID NO: 584567 - DNA, 25 bp, Homo sapien
gacctccaacttccaaattaattct

SEQ ID NO: 584568 - DNA, 25 bp, Homo sapien
cctccaacttccaaattaattctct

SEQ ID NO: 584569 - DNA, 25 bp, Homo sapien
tccaacttccaaattaattctctcc

SEQ ID NO: 584570 - DNA, 25 bp, Homo sapien
aaactttacagctctcttctgcatt

SEQ ID NO: 584571 - DNA, 25 bp, Homo sapien
agctctcttctgcatttccattatg

SEQ ID NO: 584572 - DNA, 25 bp, Homo sapien
tctcttctgcatttccattatgggt

SEQ ID NO: 584573 - DNA, 25 bp, Homo sapien
tcttctgcatttccattatgggtgt

SEQ ID NO: 584574 - DNA, 25 bp, Homo sapien
tctgcatttccattatgggtgttga

SEQ ID NO: 584575 - DNA, 25 bp, Homo sapien
gcatttccattatgggtgttgatat

SEQ ID NO: 584576 - DNA, 25 bp, Homo sapien
cattatgggtgttgatatggtttgg

SEQ ID NO: 584577 - DNA, 25 bp, Homo sapien
gggtttttcccatgacagtgagtaa

SEQ ID NO: 584578 - DNA, 25 bp, Homo sapien
tcgtaggaggtctgatggttgtata

SEQ ID NO: 584579 - DNA, 25 bp, Homo sapien
ataagacatgccttcgctcctcctt

SEQ ID NO: 584580 - DNA, 25 bp, Homo sapien
tcgctcctcctttgctttctgcgat

SEQ ID NO: 584581 - DNA, 25 bp, Homo sapien
gagaaggagcccctgctcttccatg

SEQ ID NO: 584582 - DNA, 25 bp, Homo sapien
ttccatgtcttcagcaacggtggcg

SEQ ID NO: 584583 - DNA, 25 bp, Homo sapien
atgtcttcagcaacggtggcgtcat

SEQ ID NO: 584584 - DNA, 25 bp, Homo sapien
agcaacggtggcgtcatgctgtacc

SEQ ID NO: 584585 - DNA, 25 bp, Homo sapien
catgctgtaccgctacgtgctggag

SEQ ID NO: 584586 - DNA, 25 bp, Homo sapien
gtaccgctacgtgctggagctcctg

SEQ ID NO: 584587 - DNA, 25 bp, Homo sapien
accatctttgacagcgctcctggtg

SEQ ID NO: 584588 - DNA, 25 bp, Homo sapien
ttgacagcgctcctggtgacagcaa

SEQ ID NO: 584589 - DNA, 25 bp, Homo sapien
gctcctggtgacagcaacctggtag

SEQ ID NO: 584590 - DNA, 25 bp, Homo sapien
ttgccctggtggtcgtcctgttcca

SEQ ID NO: 584591 - DNA, 25 bp, Homo sapien
tggtggtcgtcctgttccacgtcct

SEQ ID NO: 584592 - DNA, 25 bp, Homo sapien
ttcaagcagggcttccgcagggtcc

SEQ ID NO: 584593 - DNA, 25 bp, Homo sapien
tcaagcagggcttccgcagggtcct

SEQ ID NO: 584594 - DNA, 25 bp, Homo sapien
cagggcttccgcagggtcctgctgc

SEQ ID NO: 584595 - DNA, 25 bp, Homo sapien
gtcagccagatcacgcagcctggca

SEQ ID NO: 584596 - DNA, 25 bp, Homo sapien
agatcacgcagcctggcaccagcgg

SEQ ID NO: 584597 - DNA, 25 bp, Homo sapien
tcctaccccaagaggcttccactgg

SEQ ID NO: 584598 - DNA, 25 bp, Homo sapien
gggagaagtccagcacgatgcgcat

SEQ ID NO: 584599 - DNA, 25 bp, Homo sapien
agaagtccagcacgatgcgcatcag

SEQ ID NO: 584600 - DNA, 25 bp, Homo sapien
agtccagcacgatgcgcatcagcta

SEQ ID NO: 584601 - DNA, 25 bp, Homo sapien
agcacgatgcgcatcagctacctgt

SEQ ID NO: 584602 - DNA, 25 bp, Homo sapien
cacgatgcgcatcagctacctgtag

SEQ ID NO: 584603 - DNA, 25 bp, Homo sapien
gtcctacatctctaatgatacacag

SEQ ID NO: 584604 - DNA, 25 bp, Homo sapien
ggagggacactacttccagctttaa

SEQ ID NO: 584605 - DNA, 25 bp, Homo sapien
ccagctttaaccatatgcatgacaa

SEQ ID NO: 584606 - DNA, 25 bp, Homo sapien
gacaaggagatccagtgaccatctg

SEQ ID NO: 584607 - DNA, 25 bp, Homo sapien
ggaagcaggcattccatctccggag

SEQ ID NO: 584608 - DNA, 25 bp, Homo sapien
ggagtgcaggaaatgctcagaacca

SEQ ID NO: 584609 - DNA, 25 bp, Homo sapien
ccaggaaacctgcaaccacttagtt

SEQ ID NO: 584610 - DNA, 25 bp, Homo sapien
tgcaaccacttagttccagtggctt

SEQ ID NO: 584611 - DNA, 25 bp, Homo sapien
gctaggattccgtttattcctttgt

SEQ ID NO: 584612 - DNA, 25 bp, Homo sapien
ataatgcagggtgctctcatgtgga

SEQ ID NO: 584613 - DNA, 25 bp, Homo sapien
ctctcatgtggagctaaggaaacaa

SEQ ID NO: 584614 - DNA, 25 bp, Homo sapien
tggctcctgtacacatcacatgggc

SEQ ID NO: 584615 - DNA, 25 bp, Homo sapien
tcacatgggcccctgtcatcaacag

SEQ ID NO: 584616 - DNA, 25 bp, Homo sapien
gttattatgcatgtccctttttcta

SEQ ID NO: 584617 - DNA, 25 bp, Homo sapien
tgcatgtccctttttctaaagtaag

SEQ ID NO: 584618 - DNA, 25 bp, Homo sapien
ggtattcataacagtttttccaaag

SEQ ID NO: 584619 - DNA, 25 bp, Homo sapien
gttctttcctgccagatagaaattg

SEQ ID NO: 584620 - DNA, 25 bp, Homo sapien
gccagatagaaattgtgcacagcac

SEQ ID NO: 584621 - DNA, 25 bp, Homo sapien
gcacagcacagcatcaagtaattcg

SEQ ID NO: 584622 - DNA, 25 bp, Homo sapien
gtaattcgttagatgcttgttaaat

SEQ ID NO: 584623 - DNA, 25 bp, Homo sapien
gtgaacaaagttaacgaatgccctg

SEQ ID NO: 584624 - DNA, 25 bp, Homo sapien
ctgttatttttgtaggccacataat

SEQ ID NO: 584625 - DNA, 25 bp, Homo sapien
caggctccctcgttgggtttctctt

SEQ ID NO: 584626 - DNA, 25 bp, Homo sapien
tcgttgggtttctctttctccccag

SEQ ID NO: 584627 - DNA, 25 bp, Homo sapien
tttctccccaggctctgtttgttgt

SEQ ID NO: 584628 - DNA, 25 bp, Homo sapien
agggctcagtccttagactgcttct

SEQ ID NO: 584629 - DNA, 25 bp, Homo sapien
tctcggtctttctccactacttcaa

SEQ ID NO: 584630 - DNA, 25 bp, Homo sapien
ttcaatgatcccaccagccaaatgg

SEQ ID NO: 584631 - DNA, 25 bp, Homo sapien
agccaaatggctcttaagacccact

SEQ ID NO: 584632 - DNA, 25 bp, Homo sapien
aatggctcttaagacccactatgtg

SEQ ID NO: 584633 - DNA, 25 bp, Homo sapien
gacccactatgtgctggtgattctt

SEQ ID NO: 584634 - DNA, 25 bp, Homo sapien
gctggtgattcttgtgttagttatc

SEQ ID NO: 584635 - DNA, 25 bp, Homo sapien
taacaaatgaccttaacagctttta

SEQ ID NO: 584636 - DNA, 25 bp, Homo sapien
gagcgggagatacaggaagtgaaag

SEQ ID NO: 584637 - DNA, 25 bp, Homo sapien
agatgagattaatcagagcctgaga

SEQ ID NO: 584638 - DNA, 25 bp, Homo sapien
atgagattaatcagagcctgagatt

SEQ ID NO: 584639 - DNA, 25 bp, Homo sapien
gagattaatcagagcctgagatttg

SEQ ID NO: 584640 - DNA, 25 bp, Homo sapien
agattaatcagagcctgagatttga

SEQ ID NO: 584641 - DNA, 25 bp, Homo sapien
attaatcagagcctgagatttgagg

SEQ ID NO: 584642 - DNA, 25 bp, Homo sapien
taatcagagcctgagatttgaggat

SEQ ID NO: 584643 - DNA, 25 bp, Homo sapien
aatcagagcctgagatttgaggata

SEQ ID NO: 584644 - DNA, 25 bp, Homo sapien
atcagagcctgagatttgaggatag

SEQ ID NO: 584645 - DNA, 25 bp, Homo sapien
tcagagcctgagatttgaggataga

SEQ ID NO: 584646 - DNA, 25 bp, Homo sapien
agagcctgagatttgaggatagaga

SEQ ID NO: 584647 - DNA, 25 bp, Homo sapien
cagccagtgaggagaggcaagatgg

SEQ ID NO: 584648 - DNA, 25 bp, Homo sapien
caagatggggttaagcttcgcacat

SEQ ID NO: 584649 - DNA, 25 bp, Homo sapien
aagatggggttaagcttcgcacatt

SEQ ID NO: 584650 - DNA, 25 bp, Homo sapien
agatggggttaagcttcgcacattg

SEQ ID NO: 584651 - DNA, 25 bp, Homo sapien
ggttaagcttcgcacattgagggct

SEQ ID NO: 584652 - DNA, 25 bp, Homo sapien
gttaagcttcgcacattgagggctg

SEQ ID NO: 584653 - DNA, 25 bp, Homo sapien
ttaagcttcgcacattgagggctgg

SEQ ID NO: 584654 - DNA, 25 bp, Homo sapien
taagcttcgcacattgagggctggg

SEQ ID NO: 584655 - DNA, 25 bp, Homo sapien
aagcttcgcacattgagggctgggc

SEQ ID NO: 584656 - DNA, 25 bp, Homo sapien
agcttcgcacattgagggctgggca

SEQ ID NO: 584657 - DNA, 25 bp, Homo sapien
gcttcgcacattgagggctgggcac

SEQ ID NO: 584658 - DNA, 25 bp, Homo sapien
agcctgagccaggagacgtcttcct

SEQ ID NO: 584659 - DNA, 25 bp, Homo sapien
gagccaggagacgtcttcctgttca

SEQ ID NO: 584660 - DNA, 25 bp, Homo sapien
aggagacgtcttcctgttcaggctg

SEQ ID NO: 584661 - DNA, 25 bp, Homo sapien
agacgtcttcctgttcaggctgatt

SEQ ID NO: 584662 - DNA, 25 bp, Homo sapien
tccactttgagggtgagtgcctcca

SEQ ID NO: 584663 - DNA, 25 bp, Homo sapien
agggtgagtgcctccagcagaaaca

SEQ ID NO: 584664 - DNA, 25 bp, Homo sapien
tgagtgcctccagcagaaacacagg

SEQ ID NO: 584665 - DNA, 25 bp, Homo sapien
tccagcagaaacacaggcccaagtc

SEQ ID NO: 584666 - DNA, 25 bp, Homo sapien
agaaacacaggcccaagtctgcgga

SEQ ID NO: 584667 - DNA, 25 bp, Homo sapien
cccaccagtgagctggctactcggg

SEQ ID NO: 584668 - DNA, 25 bp, Homo sapien
ataaagactgaagtcccaggctggg

SEQ ID NO: 584669 - DNA, 25 bp, Homo sapien
acaggctggattagtgtctctcctt

SEQ ID NO: 584670 - DNA, 25 bp, Homo sapien
tccttacctttcacacagacacaga

SEQ ID NO: 584671 - DNA, 25 bp, Homo sapien
acagacacagaaatctctctcctag

SEQ ID NO: 584672 - DNA, 25 bp, Homo sapien
agaaatctctctcctagagcctccg

SEQ ID NO: 584673 - DNA, 25 bp, Homo sapien
agcctccgctctatcttgataacaa

SEQ ID NO: 584674 - DNA, 25 bp, Homo sapien
tcttgataacaatccattcagcaca

SEQ ID NO: 584675 - DNA, 25 bp, Homo sapien
ggcaacagtcataatcccaaagtga

SEQ ID NO: 584676 - DNA, 25 bp, Homo sapien
gtgatctcaatcttgcaactcttgg

SEQ ID NO: 584677 - DNA, 25 bp, Homo sapien
atcttgcaactcttggcacagaagt

SEQ ID NO: 584678 - DNA, 25 bp, Homo sapien
aattcaacactaacatctggctcca

SEQ ID NO: 584679 - DNA, 25 bp, Homo sapien
tcttcccaaaatcctatctccattt

SEQ ID NO: 584680 - DNA, 25 bp, Homo sapien
gactggagacttcagggcttgtcac

SEQ ID NO: 584681 - DNA, 25 bp, Homo sapien
acttcagggcttgtcactttcagag

SEQ ID NO: 584682 - DNA, 25 bp, Homo sapien
gggcttgtcactttcagagtgtgga

SEQ ID NO: 584683 - DNA, 25 bp, Homo sapien
actttcagagtgtggaggtcaggat

SEQ ID NO: 584684 - DNA, 25 bp, Homo sapien
atggctgcgggcaatgaagccttag

SEQ ID NO: 584685 - DNA, 25 bp, Homo sapien
caatgaagccttagtaaaacggtga

SEQ ID NO: 584686 - DNA, 25 bp, Homo sapien
gaaaagtactcccagacggacgcgg

SEQ ID NO: 584687 - DNA, 25 bp, Homo sapien
acggacgcgggcacccgtcatgctt

SEQ ID NO: 584688 - DNA, 25 bp, Homo sapien
acccgtcatgcttttgctgagagtt

SEQ ID NO: 584689 - DNA, 25 bp, Homo sapien
gggcattaaccttgagctaatgtta

SEQ ID NO: 584690 - DNA, 25 bp, Homo sapien
aaaaatcaagctcttggccaggcat

SEQ ID NO: 584691 - DNA, 25 bp, Homo sapien
acagtgagcccgagcaacacttggg

SEQ ID NO: 584692 - DNA, 25 bp, Homo sapien
gtgagcccgagcaacacttgggcaa

SEQ ID NO: 584693 - DNA, 25 bp, Homo sapien
cgagcaacacttgggcaaaggcacc

SEQ ID NO: 584694 - DNA, 25 bp, Homo sapien
cccttgctgctgcacatctggttca

SEQ ID NO: 584695 - DNA, 25 bp, Homo sapien
tgctgcacatctggttcacccatgg

SEQ ID NO: 584696 - DNA, 25 bp, Homo sapien
gcacatctggttcacccatggcagg

SEQ ID NO: 584697 - DNA, 25 bp, Homo sapien
ggcatggaatccaggccagtagcac

SEQ ID NO: 584698 - DNA, 25 bp, Homo sapien
tggaatccaggccagtagcacaagc

SEQ ID NO: 584699 - DNA, 25 bp, Homo sapien
ccaagtgggtggaacaaacacagtg

SEQ ID NO: 584700 - DNA, 25 bp, Homo sapien
ggtggaacaaacacagtgagcccga

SEQ ID NO: 584701 - DNA, 25 bp, Homo sapien
acaaacacagtgagcccgagcaaca

SEQ ID NO: 584702 - DNA, 25 bp, Homo sapien
aattcaaatgttctgcgccaagctc

SEQ ID NO: 584703 - DNA, 25 bp, Homo sapien
aatgttctgcgccaagctcctatca

SEQ ID NO: 584704 - DNA, 25 bp, Homo sapien
aagctcctatcatgccaattgtaca

SEQ ID NO: 584705 - DNA, 25 bp, Homo sapien
gccaattgtacatgtttgtgcgtat

SEQ ID NO: 584706 - DNA, 25 bp, Homo sapien
catgtttgtgcgtatgtagggtagc

SEQ ID NO: 584707 - DNA, 25 bp, Homo sapien
gtgtaatcatccctaaaattcattt

SEQ ID NO: 584708 - DNA, 25 bp, Homo sapien
tattcctgccaatattttgtataac

SEQ ID NO: 584709 - DNA, 25 bp, Homo sapien
gtataacatagaagtctgccccaga

SEQ ID NO: 584710 - DNA, 25 bp, Homo sapien
gaagtctgccccagagtgtaaataa

SEQ ID NO: 584711 - DNA, 25 bp, Homo sapien
taatgaggaaggtcacagatctaaa

SEQ ID NO: 584712 - DNA, 25 bp, Homo sapien
acagatctaaatatactatcttggt

SEQ ID NO: 584713 - DNA, 25 bp, Homo sapien
aaggcctcgggatccccgcatgcag

SEQ ID NO: 584714 - DNA, 25 bp, Homo sapien
gggatccccgcatgcagtctacttc

SEQ ID NO: 584715 - DNA, 25 bp, Homo sapien
atgcagtctacttcctgctcctgct

SEQ ID NO: 584716 - DNA, 25 bp, Homo sapien
tgactctcctgatccagagctgagg

SEQ ID NO: 584717 - DNA, 25 bp, Homo sapien
gaatgtggcccagccggctggaacc

SEQ ID NO: 584718 - DNA, 25 bp, Homo sapien
ggcccagccggctggaacctcaagg

SEQ ID NO: 584719 - DNA, 25 bp, Homo sapien
acccaccgagattgcagcggctctg

SEQ ID NO: 584720 - DNA, 25 bp, Homo sapien
cagcggctctggctaattgggcctc

SEQ ID NO: 584721 - DNA, 25 bp, Homo sapien
gtgcccgggctattttgaacccagg

SEQ ID NO: 584722 - DNA, 25 bp, Homo sapien
gggctattttgaacccaggaatcct

SEQ ID NO: 584723 - DNA, 25 bp, Homo sapien
gaggagcggacaataaaggtgtaaa

SEQ ID NO: 584724 - DNA, 25 bp, Homo sapien
ctttaaaagcagatttttggaagca

SEQ ID NO: 584725 - DNA, 25 bp, Homo sapien
gcagatttttggaagcattgtaatt

SEQ ID NO: 584726 - DNA, 25 bp, Homo sapien
cagatttttggaagcattgtaatta

SEQ ID NO: 584727 - DNA, 25 bp, Homo sapien
tttgagatcagactgaccaaaacgg

SEQ ID NO: 584728 - DNA, 25 bp, Homo sapien
ttgagatcagactgaccaaaacgga

SEQ ID NO: 584729 - DNA, 25 bp, Homo sapien
tgagatcagactgaccaaaacggag

SEQ ID NO: 584730 - DNA, 25 bp, Homo sapien
gagatcagactgaccaaaacggaga

SEQ ID NO: 584731 - DNA, 25 bp, Homo sapien
agatcagactgaccaaaacggagaa

SEQ ID NO: 584732 - DNA, 25 bp, Homo sapien
gatcagactgaccaaaacggagaaa

SEQ ID NO: 584733 - DNA, 25 bp, Homo sapien
gaaaatataaaattggccatgcatg

SEQ ID NO: 584734 - DNA, 25 bp, Homo sapien
gttgtggtgagtcgagatcattgca

SEQ ID NO: 584735 - DNA, 25 bp, Homo sapien
agaaaaaatcgccaacaaaatgtga

SEQ ID NO: 584736 - DNA, 25 bp, Homo sapien
aaaatgctcagtttaattagttaag

SEQ ID NO: 584737 - DNA, 25 bp, Homo sapien
aaatgctcagtttaattagttaaga

SEQ ID NO: 584738 - DNA, 25 bp, Homo sapien
aatgctcagtttaattagttaagaa

SEQ ID NO: 584739 - DNA, 25 bp, Homo sapien
gctcagtttaattagttaagaattc

SEQ ID NO: 584740 - DNA, 25 bp, Homo sapien
agttaagaattcaactacattcaaa

SEQ ID NO: 584741 - DNA, 25 bp, Homo sapien
gttaagaattcaactacattcaaat

SEQ ID NO: 584742 - DNA, 25 bp, Homo sapien
aagaattcaactacattcaaatgaa

SEQ ID NO: 584743 - DNA, 25 bp, Homo sapien
gaattcaactacattcaaatgaaaa

SEQ ID NO: 584744 - DNA, 25 bp, Homo sapien
aaataaaagccatttgtcatcctta

SEQ ID NO: 584745 - DNA, 25 bp, Homo sapien
aataaaagccatttgtcatccttag

SEQ ID NO: 584746 - DNA, 25 bp, Homo sapien
actaagatttgtccctgctcatgga

SEQ ID NO: 584747 - DNA, 25 bp, Homo sapien
taagatttgtccctgctcatggaca

SEQ ID NO: 584748 - DNA, 25 bp, Homo sapien
aagatttgtccctgctcatggacat

SEQ ID NO: 584749 - DNA, 25 bp, Homo sapien
agatttgtccctgctcatggacatt

SEQ ID NO: 584750 - DNA, 25 bp, Homo sapien
gatttgtccctgctcatggacatta

SEQ ID NO: 584751 - DNA, 25 bp, Homo sapien
atttgtccctgctcatggacattaa

SEQ ID NO: 584752 - DNA, 25 bp, Homo sapien
ttgtccctgctcatggacattaaaa

SEQ ID NO: 584753 - DNA, 25 bp, Homo sapien
gtccctgctcatggacattaaaaaa

SEQ ID NO: 584754 - DNA, 25 bp, Homo sapien
aaagacagcaggattaagcggaatc

SEQ ID NO: 584755 - DNA, 25 bp, Homo sapien
gacagcaggattaagcggaatcaca

SEQ ID NO: 584756 - DNA, 25 bp, Homo sapien
cagcaggattaagcggaatcacagt

SEQ ID NO: 584757 - DNA, 25 bp, Homo sapien
aaaccttgagttctggattgcctgt

SEQ ID NO: 584758 - DNA, 25 bp, Homo sapien
cttgagttctggattgcctgtgagg

SEQ ID NO: 584759 - DNA, 25 bp, Homo sapien
acaagaagatcaagtcccctgccaa

SEQ ID NO: 584760 - DNA, 25 bp, Homo sapien
atcaagtcccctgccaagatggctg

SEQ ID NO: 584761 - DNA, 25 bp, Homo sapien
gaattcattcaaacggaggctccta

SEQ ID NO: 584762 - DNA, 25 bp, Homo sapien
aacggaggctcctaaagaggtgaat

SEQ ID NO: 584763 - DNA, 25 bp, Homo sapien
attgaccacttcactaaggacatca

SEQ ID NO: 584764 - DNA, 25 bp, Homo sapien
tttgacatggcccagaaaagaatcc

SEQ ID NO: 584765 - DNA, 25 bp, Homo sapien
aaaagaatccatgccctgatggaaa

SEQ ID NO: 584766 - DNA, 25 bp, Homo sapien
tggaaaaggattctctgcctcgctt

SEQ ID NO: 584767 - DNA, 25 bp, Homo sapien
gctttgtgcgctctgagttttatca

SEQ ID NO: 584768 - DNA, 25 bp, Homo sapien
ttgttaatgtgcacacagcaagttg

SEQ ID NO: 584769 - DNA, 25 bp, Homo sapien
gggttccctgtcgaagaggccaaag

SEQ ID NO: 584770 - DNA, 25 bp, Homo sapien
ttccctgtcgaagaggccaaagagt

SEQ ID NO: 584771 - DNA, 25 bp, Homo sapien
ctagagggtgtggagctgcaggtgc

SEQ ID NO: 584772 - DNA, 25 bp, Homo sapien
ggtgcacagtacagctggcacctgg

SEQ ID NO: 584773 - DNA, 25 bp, Homo sapien
gcagaggtggttcattatcaagcaa

SEQ ID NO: 584774 - DNA, 25 bp, Homo sapien
gaggtggttcattatcaagcaaagg

SEQ ID NO: 584775 - DNA, 25 bp, Homo sapien
caagcaaaggatgaaacaaggcact

SEQ ID NO: 584776 - DNA, 25 bp, Homo sapien
tgaaacaaggcacttggagcccctt

SEQ ID NO: 584777 - DNA, 25 bp, Homo sapien
acttggagccccttcacaactggaa

SEQ ID NO: 584778 - DNA, 25 bp, Homo sapien
tcacaactggaacctccactgcagg

SEQ ID NO: 584779 - DNA, 25 bp, Homo sapien
gaacttaacccaaatacacacagag

SEQ ID NO: 584780 - DNA, 25 bp, Homo sapien
agagagcaccatgaagccctggatt

SEQ ID NO: 584781 - DNA, 25 bp, Homo sapien
atgaagccctggattcttctactcg

SEQ ID NO: 584782 - DNA, 25 bp, Homo sapien
ggattcttctactcgtcatgttcat

SEQ ID NO: 584783 - DNA, 25 bp, Homo sapien
tcgtcatgttcatctctggagttgt

SEQ ID NO: 584784 - DNA, 25 bp, Homo sapien
tctggagttgtgatgcttctgcctg

SEQ ID NO: 584785 - DNA, 25 bp, Homo sapien
tgcctgtgctgggaagcttctggaa

SEQ ID NO: 584786 - DNA, 25 bp, Homo sapien
gaagcttctggaacaaagatccctt

SEQ ID NO: 584787 - DNA, 25 bp, Homo sapien
aagatccctttctagatatgataag

SEQ ID NO: 584788 - DNA, 25 bp, Homo sapien
aaactgagcagtgctgggtacagcc

SEQ ID NO: 584789 - DNA, 25 bp, Homo sapien
gctgggtacagcctccatataagta

SEQ ID NO: 584790 - DNA, 25 bp, Homo sapien
ggctgtgtcccacccaattttcacc

SEQ ID NO: 584791 - DNA, 25 bp, Homo sapien
gctgtgtcccacccaattttcacct

SEQ ID NO: 584792 - DNA, 25 bp, Homo sapien
ctgtgtcccacccaattttcacctt

SEQ ID NO: 584793 - DNA, 25 bp, Homo sapien
tgtgtcccacccaattttcaccttg

SEQ ID NO: 584794 - DNA, 25 bp, Homo sapien
gtgtcccacccaattttcaccttga

SEQ ID NO: 584795 - DNA, 25 bp, Homo sapien
tgtcccacccaattttcaccttgaa

SEQ ID NO: 584796 - DNA, 25 bp, Homo sapien
attttcaccttgaattatataatca

SEQ ID NO: 584797 - DNA, 25 bp, Homo sapien
ttttcaccttgaattatataatcac

SEQ ID NO: 584798 - DNA, 25 bp, Homo sapien
tttcaccttgaattatataatcacc

SEQ ID NO: 584799 - DNA, 25 bp, Homo sapien
ttcaccttgaattatataatcacca

SEQ ID NO: 584800 - DNA, 25 bp, Homo sapien
gtgtctcctacacacctgccatgag

SEQ ID NO: 584801 - DNA, 25 bp, Homo sapien
gtctcctacacacctgccatgagga

SEQ ID NO: 584802 - DNA, 25 bp, Homo sapien
tcctacacacctgccatgaggatga

SEQ ID NO: 584803 - DNA, 25 bp, Homo sapien
tacacacctgccatgaggatgacca

SEQ ID NO: 584804 - DNA, 25 bp, Homo sapien
tgaggatgaccagcaccgactactc

SEQ ID NO: 584805 - DNA, 25 bp, Homo sapien
gaggatgaccagcaccgactactcc

SEQ ID NO: 584806 - DNA, 25 bp, Homo sapien
gtgcttgtggaatggatagacgtca

SEQ ID NO: 584807 - DNA, 25 bp, Homo sapien
gcttgtggaatggatagacgtcaga

SEQ ID NO: 584808 - DNA, 25 bp, Homo sapien
ttgtggaatggatagacgtcagaac

SEQ ID NO: 584809 - DNA, 25 bp, Homo sapien
tggaatggatagacgtcagaacaca

SEQ ID NO: 584810 - DNA, 25 bp, Homo sapien
aatggatagacgtcagaacacatac

SEQ ID NO: 584811 - DNA, 25 bp, Homo sapien
agacgtcatgctcttttaagcaatc

SEQ ID NO: 584812 - DNA, 25 bp, Homo sapien
ttttaagcaatcagctctcaggtga

SEQ ID NO: 584813 - DNA, 25 bp, Homo sapien
agctctcaggtgaactaatagagtg

SEQ ID NO: 584814 - DNA, 25 bp, Homo sapien
gggagggcatcaagctatttataat

SEQ ID NO: 584815 - DNA, 25 bp, Homo sapien
caagctatttataatggatccatcc

SEQ ID NO: 584816 - DNA, 25 bp, Homo sapien
tggatccatcctcatgacacaaaca

SEQ ID NO: 584817 - DNA, 25 bp, Homo sapien
tatctcccacctctaacactggaga

SEQ ID NO: 584818 - DNA, 25 bp, Homo sapien
ctaacactggagatgacacttgaac

SEQ ID NO: 584819 - DNA, 25 bp, Homo sapien
aactatatcatatggtttgcagata

SEQ ID NO: 584820 - DNA, 25 bp, Homo sapien
gcagatattttcttccatccttgag

SEQ ID NO: 584821 - DNA, 25 bp, Homo sapien
ttcttccatccttgagttatctttt

SEQ ID NO: 584822 - DNA, 25 bp, Homo sapien
atgagatctcattcactatcacaga

SEQ ID NO: 584823 - DNA, 25 bp, Homo sapien
gatctcattcactatcacagaacag

SEQ ID NO: 584824 - DNA, 25 bp, Homo sapien
acacagccaaatatcaatgggccat

SEQ ID NO: 584825 - DNA, 25 bp, Homo sapien
gaaatagaaagctcacctgtggcct

SEQ ID NO: 584826 - DNA, 25 bp, Homo sapien
tagaaagctcacctgtggcctcata

SEQ ID NO: 584827 - DNA, 25 bp, Homo sapien
aaagctcacctgtggcctcatattt

SEQ ID NO: 584828 - DNA, 25 bp, Homo sapien
ctcacctgtggcctcatattttgct

SEQ ID NO: 584829 - DNA, 25 bp, Homo sapien
tattttgcttacattctccagtgaa

SEQ ID NO: 584830 - DNA, 25 bp, Homo sapien
ttgcttacattctccagtgaagttt

SEQ ID NO: 584831 - DNA, 25 bp, Homo sapien
tacattctccagtgaagtttagtgt

SEQ ID NO: 584832 - DNA, 25 bp, Homo sapien
cagtgaagtttagtgtggattttga

SEQ ID NO: 584833 - DNA, 25 bp, Homo sapien
cccacttcccagtcaggatgtttga

SEQ ID NO: 584834 - DNA, 25 bp, Homo sapien
ccagtcaggatgtttgagtgtgtct

SEQ ID NO: 584835 - DNA, 25 bp, Homo sapien
gtgtgtctgactatgttctttccca

SEQ ID NO: 584836 - DNA, 25 bp, Homo sapien
gtgtctgactatgttctttcccatg

SEQ ID NO: 584837 - DNA, 25 bp, Homo sapien
tgttctttcccatgtgagcagaaga

SEQ ID NO: 584838 - DNA, 25 bp, Homo sapien
tgagcagaagaggtgcacgccactt

SEQ ID NO: 584839 - DNA, 25 bp, Homo sapien
agaagaggtgcacgccacttccaag

SEQ ID NO: 584840 - DNA, 25 bp, Homo sapien
agaggtgcacgccacttccaagtgg

SEQ ID NO: 584841 - DNA, 25 bp, Homo sapien
ttccaagtggccataagacctccca

SEQ ID NO: 584842 - DNA, 25 bp, Homo sapien
agtggccataagacctcccagatgt

SEQ ID NO: 584843 - DNA, 25 bp, Homo sapien
acctcccagatgttctcctctgtgt

SEQ ID NO: 584844 - DNA, 25 bp, Homo sapien
aatttcctccttgatgtctcatcag

SEQ ID NO: 584845 - DNA, 25 bp, Homo sapien
atcagaattggagccgcttttcctc

SEQ ID NO: 584846 - DNA, 25 bp, Homo sapien
ttcctctgcaatactggtatgtggg

SEQ ID NO: 584847 - DNA, 25 bp, Homo sapien
gagtctggtgtcaggaatcccttgc

SEQ ID NO: 584848 - DNA, 25 bp, Homo sapien
aatcccttgcccttcaaagagacag

SEQ ID NO: 584849 - DNA, 25 bp, Homo sapien
agacagtgtgctgctatctggctgc

SEQ ID NO: 584850 - DNA, 25 bp, Homo sapien
tggctgcttccatgagctgcaaagt

SEQ ID NO: 584851 - DNA, 25 bp, Homo sapien
gagctgcaaagtgggtaaaacatct

SEQ ID NO: 584852 - DNA, 25 bp, Homo sapien
aaaacatcttcagttgggtggatag

SEQ ID NO: 584853 - DNA, 25 bp, Homo sapien
gactgtcattgactgatatgcgcaa

SEQ ID NO: 584854 - DNA, 25 bp, Homo sapien
gatatgcgcaacctaattacttcct

SEQ ID NO: 584855 - DNA, 25 bp, Homo sapien
gtgatctacattagcacaaaatgca

SEQ ID NO: 584856 - DNA, 25 bp, Homo sapien
tgcaactgattatctaggatctgtg

SEQ ID NO: 584857 - DNA, 25 bp, Homo sapien
aggatctgtgtattacttaagctca

SEQ ID NO: 584858 - DNA, 25 bp, Homo sapien
tacttaagctcacccttaacagttt

SEQ ID NO: 584859 - DNA, 25 bp, Homo sapien
acagttttaccttccttctcctctg

SEQ ID NO: 584860 - DNA, 25 bp, Homo sapien
ccttctcctctgtattcttacagaa

SEQ ID NO: 584861 - DNA, 25 bp, Homo sapien
atggtctcataatttcctttatgac

SEQ ID NO: 584862 - DNA, 25 bp, Homo sapien
tttcctttatgacagacatctcaga

SEQ ID NO: 584863 - DNA, 25 bp, Homo sapien
aaaatcacccaaagccaatcattag

SEQ ID NO: 584864 - DNA, 25 bp, Homo sapien
ccaaagccaatcattagtgccaaga

SEQ ID NO: 584865 - DNA, 25 bp, Homo sapien
tagtgccaagataaccctttaacgg

SEQ ID NO: 584866 - DNA, 25 bp, Homo sapien
ggcagctccatctgtgttgactcct

SEQ ID NO: 584867 - DNA, 25 bp, Homo sapien
agctccatctgtgttgactcctgaa

SEQ ID NO: 584868 - DNA, 25 bp, Homo sapien
tccatctgtgttgactcctgaagcc

SEQ ID NO: 584869 - DNA, 25 bp, Homo sapien
atctgtgttgactcctgaagcccct

SEQ ID NO: 584870 - DNA, 25 bp, Homo sapien
tgtgttgactcctgaagcccctcat

SEQ ID NO: 584871 - DNA, 25 bp, Homo sapien
tgaagcccctcatcttggctaatcc

SEQ ID NO: 584872 - DNA, 25 bp, Homo sapien
tcatcttggctaatccggacaggct

SEQ ID NO: 584873 - DNA, 25 bp, Homo sapien
atcttggctaatccggacaggcttg

SEQ ID NO: 584874 - DNA, 25 bp, Homo sapien
tggctaatccggacaggcttgctgg

SEQ ID NO: 584875 - DNA, 25 bp, Homo sapien
catctccccttggagactttgggat

SEQ ID NO: 584876 - DNA, 25 bp, Homo sapien
gatgtggctggatgtccaagtggcc

SEQ ID NO: 584877 - DNA, 25 bp, Homo sapien
actaagatttgtccctgctcatgga

SEQ ID NO: 584878 - DNA, 25 bp, Homo sapien
taagcggaatcacagtgtcctgccc

SEQ ID NO: 584879 - DNA, 25 bp, Homo sapien
gaaaacaaacaaggccatacacttt

SEQ ID NO: 584880 - DNA, 25 bp, Homo sapien
aacaaacaaggccatacactttgaa

SEQ ID NO: 584881 - DNA, 25 bp, Homo sapien
aaacaaggccatacactttgaaaat

SEQ ID NO: 584882 - DNA, 25 bp, Homo sapien
acaaggccatacactttgaaaattt

SEQ ID NO: 584883 - DNA, 25 bp, Homo sapien
aaggccatacactttgaaaatttgt

SEQ ID NO: 584884 - DNA, 25 bp, Homo sapien
ggccatacactttgaaaatttgtag

SEQ ID NO: 584885 - DNA, 25 bp, Homo sapien
atacactttgaaaatttgtagccaa

SEQ ID NO: 584886 - DNA, 25 bp, Homo sapien
ttgaaaatttgtagccaaagaccag

SEQ ID NO: 584887 - DNA, 25 bp, Homo sapien
atttgtagccaaagaccaggtgtag

SEQ ID NO: 584888 - DNA, 25 bp, Homo sapien
aagctgcttctgtctgtgagtttcc

SEQ ID NO: 584889 - DNA, 25 bp, Homo sapien
ttctgtctgtgagtttccatggtgt

SEQ ID NO: 584890 - DNA, 25 bp, Homo sapien
agtttccatggtgttgacgttccac

SEQ ID NO: 584891 - DNA, 25 bp, Homo sapien
tgacgttccactgccacattagtgt

SEQ ID NO: 584892 - DNA, 25 bp, Homo sapien
ggttgtcccgggtgcacctcgaagt

SEQ ID NO: 584893 - DNA, 25 bp, Homo sapien
gtgcacctcgaagtgccgggtccgt

SEQ ID NO: 584894 - DNA, 25 bp, Homo sapien
gaagtgccgggtccgtcacccatcg

SEQ ID NO: 584895 - DNA, 25 bp, Homo sapien
actgacttcctctcgtagacttgca

SEQ ID NO: 584896 - DNA, 25 bp, Homo sapien
tctcgtagacttgcagctgtgttca

SEQ ID NO: 584897 - DNA, 25 bp, Homo sapien
gcagctgtgttcaccataacatttc

SEQ ID NO: 584898 - DNA, 25 bp, Homo sapien
ccataacatttcttgtctgtagtgt

SEQ ID NO: 584899 - DNA, 25 bp, Homo sapien
caggattctgaatcacagctgcaca

SEQ ID NO: 584900 - DNA, 25 bp, Homo sapien
gattctgaatcacagctgcacactc

SEQ ID NO: 584901 - DNA, 25 bp, Homo sapien
ctgaatcacagctgcacactctggg

SEQ ID NO: 584902 - DNA, 25 bp, Homo sapien
ctgccatgtggctttctaggaagaa

SEQ ID NO: 584903 - DNA, 25 bp, Homo sapien
ggaagaaaaagcacctgcctgattc

SEQ ID NO: 584904 - DNA, 25 bp, Homo sapien
gaaaaagcacctgcctgattcccaa

SEQ ID NO: 584905 - DNA, 25 bp, Homo sapien
agccccaagggaccacagcttcgga

SEQ ID NO: 584906 - DNA, 25 bp, Homo sapien
ccaagggaccacagcttcggaaagg

SEQ ID NO: 584907 - DNA, 25 bp, Homo sapien
accacagcttcggaaagggatgtgg

SEQ ID NO: 584908 - DNA, 25 bp, Homo sapien
gacttgaggctaagctgctgtgtga

SEQ ID NO: 584909 - DNA, 25 bp, Homo sapien
ttgaggctaagctgctgtgtgaccc

SEQ ID NO: 584910 - DNA, 25 bp, Homo sapien
cacgcccagctactaaatggcttat

SEQ ID NO: 584911 - DNA, 25 bp, Homo sapien
gcccagctactaaatggcttatttc

SEQ ID NO: 584912 - DNA, 25 bp, Homo sapien
ggcttatttctaaggtccactcagt

SEQ ID NO: 584913 - DNA, 25 bp, Homo sapien
tatttctaaggtccactcagtatat

SEQ ID NO: 584914 - DNA, 25 bp, Homo sapien
ggtccactcagtatatagcagcttt

SEQ ID NO: 584915 - DNA, 25 bp, Homo sapien
ccactcagtatatagcagcttttat

SEQ ID NO: 584916 - DNA, 25 bp, Homo sapien
atattggctttccatgaatttgtac

SEQ ID NO: 584917 - DNA, 25 bp, Homo sapien
ggctttccatgaatttgtacatcaa

SEQ ID NO: 584918 - DNA, 25 bp, Homo sapien
tgaaaaatcatggtttctctcataa

SEQ ID NO: 584919 - DNA, 25 bp, Homo sapien
agtctggaactactaggctcaagtg

SEQ ID NO: 584920 - DNA, 25 bp, Homo sapien
cactttggcatcccaaaaccctggg

SEQ ID NO: 584921 - DNA, 25 bp, Homo sapien
cttgacctcctaggcccaaggtgtc

SEQ ID NO: 584922 - DNA, 25 bp, Homo sapien
aggcacataccattaaactcagcta

SEQ ID NO: 584923 - DNA, 25 bp, Homo sapien
gcacataccattaaactcagctaag

SEQ ID NO: 584924 - DNA, 25 bp, Homo sapien
ggactcaagagactccctgccgtgg

SEQ ID NO: 584925 - DNA, 25 bp, Homo sapien
gactcaagagactccctgccgtggc

SEQ ID NO: 584926 - DNA, 25 bp, Homo sapien
aggcatgatcatggccctgcttatg

SEQ ID NO: 584927 - DNA, 25 bp, Homo sapien
atgatcatggccctgcttatgcagg

SEQ ID NO: 584928 - DNA, 25 bp, Homo sapien
tgatcatggccctgcttatgcaggt

SEQ ID NO: 584929 - DNA, 25 bp, Homo sapien
gatcatggccctgcttatgcaggtg

SEQ ID NO: 584930 - DNA, 25 bp, Homo sapien
atcatggccctgcttatgcaggtgc

SEQ ID NO: 584931 - DNA, 25 bp, Homo sapien
tcatggccctgcttatgcaggtgca

SEQ ID NO: 584932 - DNA, 25 bp, Homo sapien
gggattcaaggaacaaacactgtga

SEQ ID NO: 584933 - DNA, 25 bp, Homo sapien
aacactgtgatgtactattggtgga

SEQ ID NO: 584934 - DNA, 25 bp, Homo sapien
gtgatttgccaatatgccttatcat

SEQ ID NO: 584935 - DNA, 25 bp, Homo sapien
tatgccttatcattttgcatgatct

SEQ ID NO: 584936 - DNA, 25 bp, Homo sapien
gcatgatctttgtcctagtaactct

SEQ ID NO: 584937 - DNA, 25 bp, Homo sapien
gatctttgtcctagtaactctattt

SEQ ID NO: 584938 - DNA, 25 bp, Homo sapien
aactctatttctatggatttactct

SEQ ID NO: 584939 - DNA, 25 bp, Homo sapien
tttctatggatttactctaagtttg

SEQ ID NO: 584940 - DNA, 25 bp, Homo sapien
gatgtgtgcaaagattttagctcta

SEQ ID NO: 584941 - DNA, 25 bp, Homo sapien
ttagctctaagaatgtttgtcagtg

SEQ ID NO: 584942 - DNA, 25 bp, Homo sapien
tgtttgtcagtgttctaataatagc

SEQ ID NO: 584943 - DNA, 25 bp, Homo sapien
gagcgactaggagctgagccttcta

SEQ ID NO: 584944 - DNA, 25 bp, Homo sapien
aggagctgagccttctacctcgacg

SEQ ID NO: 584945 - DNA, 25 bp, Homo sapien
tacctcgacggtgcactgcagagag

SEQ ID NO: 584946 - DNA, 25 bp, Homo sapien
gagagccaatcagacgtcgcagagc

SEQ ID NO: 584947 - DNA, 25 bp, Homo sapien
agagccccgacgacactatgcttgc

SEQ ID NO: 584948 - DNA, 25 bp, Homo sapien
tatgcttgcgcccacgccgagcagg

SEQ ID NO: 584949 - DNA, 25 bp, Homo sapien
gccgagcaggcgtgcggaactttta

SEQ ID NO: 584950 - DNA, 25 bp, Homo sapien
caggcgtgcggaacttttagcaaaa

SEQ ID NO: 584951 - DNA, 25 bp, Homo sapien
gcaaaaggcggcaagcgggacttct

SEQ ID NO: 584952 - DNA, 25 bp, Homo sapien
atttcctcctttggcctgtggctta

SEQ ID NO: 584953 - DNA, 25 bp, Homo sapien
ttattccccgccagtgatctgtttc

SEQ ID NO: 584954 - DNA, 25 bp, Homo sapien
agaccctccagccacctgtctgctc

SEQ ID NO: 584955 - DNA, 25 bp, Homo sapien
tgtctgctctgcctctcatgcctct

SEQ ID NO: 584956 - DNA, 25 bp, Homo sapien
atgcctctcaggcttccggcatgga

SEQ ID NO: 584957 - DNA, 25 bp, Homo sapien
tgcctctcaggcttccggcatggac

SEQ ID NO: 584958 - DNA, 25 bp, Homo sapien
tctcaggcttccggcatggaccgtg

SEQ ID NO: 584959 - DNA, 25 bp, Homo sapien
tcaggcttccggcatggaccgtgga

SEQ ID NO: 584960 - DNA, 25 bp, Homo sapien
aggcttccggcatggaccgtggaga

SEQ ID NO: 584961 - DNA, 25 bp, Homo sapien
gcttccggcatggaccgtggagatg

SEQ ID NO: 584962 - DNA, 25 bp, Homo sapien
ttccggcatggaccgtggagatggc

SEQ ID NO: 584963 - DNA, 25 bp, Homo sapien
ccggcatggaccgtggagatggctg

SEQ ID NO: 584964 - DNA, 25 bp, Homo sapien
cggcatggaccgtggagatggctgg

SEQ ID NO: 584965 - DNA, 25 bp, Homo sapien
aattgataagccttaccgtcatcca

SEQ ID NO: 584966 - DNA, 25 bp, Homo sapien
taagccttaccgtcatccatcatca

SEQ ID NO: 584967 - DNA, 25 bp, Homo sapien
atcacaacactctgaaagtgactgc

SEQ ID NO: 584968 - DNA, 25 bp, Homo sapien
gtgactgctgaccactcaaaggcta

SEQ ID NO: 584969 - DNA, 25 bp, Homo sapien
ctgctgaccactcaaaggctaccag

SEQ ID NO: 584970 - DNA, 25 bp, Homo sapien
aggctaccagccattgatatcttct

SEQ ID NO: 584971 - DNA, 25 bp, Homo sapien
agccattgatatcttctcagtggag

SEQ ID NO: 584972 - DNA, 25 bp, Homo sapien
ttctcagtggagttctagcacccct

SEQ ID NO: 584973 - DNA, 25 bp, Homo sapien
gttctagcacccctgtggaataaca

SEQ ID NO: 584974 - DNA, 25 bp, Homo sapien
gtggaataacagcactgtcccattt

SEQ ID NO: 584975 - DNA, 25 bp, Homo sapien
aataacagcactgtcccattttctc

SEQ ID NO: 584976 - DNA, 25 bp, Homo sapien
cacagaacgcctccatgggaattat

SEQ ID NO: 584977 - DNA, 25 bp, Homo sapien
gcctccatgggaattatcagcgaag

SEQ ID NO: 584978 - DNA, 25 bp, Homo sapien
agcgaagtaatcatctcactctcct

SEQ ID NO: 584979 - DNA, 25 bp, Homo sapien
agtaatcatctcactctcctaactt

SEQ ID NO: 584980 - DNA, 25 bp, Homo sapien
atctcactctcctaacttcaggaga

SEQ ID NO: 584981 - DNA, 25 bp, Homo sapien
acttcaggagaaaatatgagtcagc

SEQ ID NO: 584982 - DNA, 25 bp, Homo sapien
gtcagcaaagactaaattggtttaa

SEQ ID NO: 584983 - DNA, 25 bp, Homo sapien
gaaaagtcggatgaattcacgctat

SEQ ID NO: 584984 - DNA, 25 bp, Homo sapien
gatgaattcacgctataaatcaata

SEQ ID NO: 584985 - DNA, 25 bp, Homo sapien
gacctttaaaggtaagacacagcaa

SEQ ID NO: 584986 - DNA, 25 bp, Homo sapien
aggtaagacacagcaagcattttgg

SEQ ID NO: 584987 - DNA, 25 bp, Homo sapien
acacagggacctttgacattcaggg

SEQ ID NO: 584988 - DNA, 25 bp, Homo sapien
tgtgcagaaagctttgtactgggat

SEQ ID NO: 584989 - DNA, 25 bp, Homo sapien
ttctctgttgtctttcttgggagcc

SEQ ID NO: 584990 - DNA, 25 bp, Homo sapien
tctctgttgtctttcttgggagccc

SEQ ID NO: 584991 - DNA, 25 bp, Homo sapien
tctgttgtctttcttgggagccctt

SEQ ID NO: 584992 - DNA, 25 bp, Homo sapien
tcttgggagcccttccattatttga

SEQ ID NO: 584993 - DNA, 25 bp, Homo sapien
ttgggagcccttccattatttgact

SEQ ID NO: 584994 - DNA, 25 bp, Homo sapien
tgggagcccttccattatttgactg

SEQ ID NO: 584995 - DNA, 25 bp, Homo sapien
gggagcccttccattatttgactga

SEQ ID NO: 584996 - DNA, 25 bp, Homo sapien
gactgagactgaagccttgttgact

SEQ ID NO: 584997 - DNA, 25 bp, Homo sapien
gaagccttgttgactcacaaataaa

SEQ ID NO: 584998 - DNA, 25 bp, Homo sapien
gtgttttaaatcatcacgccctggc

SEQ ID NO: 584999 - DNA, 25 bp, Homo sapien
tttaaatcatcacgccctggcttat

SEQ ID NO: 585000 - DNA, 25 bp, Homo sapien
tggcttatccctggtcgagccagga

SEQ ID NO: 585001 - DNA, 25 bp, Homo sapien
gtgcttcagtgggtctgtcaccctc

SEQ ID NO: 585002 - DNA, 25 bp, Homo sapien
cctctctccttgaagcatgttgctt

SEQ ID NO: 585003 - DNA, 25 bp, Homo sapien
tttatttacttttactctcaccctg

SEQ ID NO: 585004 - DNA, 25 bp, Homo sapien
gggccacttcaaagccaaggtacag

SEQ ID NO: 585005 - DNA, 25 bp, Homo sapien
caaagccaaggtacagggtgataac

SEQ ID NO: 585006 - DNA, 25 bp, Homo sapien
gggtgataacttgtggtccagcatc

SEQ ID NO: 585007 - DNA, 25 bp, Homo sapien
tggtccagcatcagttttctccact

SEQ ID NO: 585008 - DNA, 25 bp, Homo sapien
gcatcagttttctccacttctttct

SEQ ID NO: 585009 - DNA, 25 bp, Homo sapien
ttgtgtatgtattaccacagggctt

SEQ ID NO: 585010 - DNA, 25 bp, Homo sapien
aagattttagttaatgtcattttca

SEQ ID NO: 585011 - DNA, 25 bp, Homo sapien
tgtcattttcatgaaagacagtcat

SEQ ID NO: 585012 - DNA, 25 bp, Homo sapien
gaagccaagagctctatctatgttt

SEQ ID NO: 585013 - DNA, 25 bp, Homo sapien
gccaagagctctatctatgttttgt

SEQ ID NO: 585014 - DNA, 25 bp, Homo sapien
atctatgttttgttcaaatagccga

SEQ ID NO: 585015 - DNA, 25 bp, Homo sapien
gttttgttcaaatagccgagtaatc

SEQ ID NO: 585016 - DNA, 25 bp, Homo sapien
agccgagtaatctactatcttggca

SEQ ID NO: 585017 - DNA, 25 bp, Homo sapien
gagtaatctactatcttggcagtaa

SEQ ID NO: 585018 - DNA, 25 bp, Homo sapien
actatcttggcagtaattacttctg

SEQ ID NO: 585019 - DNA, 25 bp, Homo sapien
ttggcagtaattacttctgctgcat

SEQ ID NO: 585020 - DNA, 25 bp, Homo sapien
ttttttctagtggtagcacctcagt

SEQ ID NO: 585021 - DNA, 25 bp, Homo sapien
agtggtagcacctcagttaactttt

SEQ ID NO: 585022 - DNA, 25 bp, Homo sapien
tagagaattaactcatctgcaattg

SEQ ID NO: 585023 - DNA, 25 bp, Homo sapien
actcatctgcaattgtatagagctt

SEQ ID NO: 585024 - DNA, 25 bp, Homo sapien
gtatagagctttggtgagattgtca

SEQ ID NO: 585025 - DNA, 25 bp, Homo sapien
gagattgtcagctacttcccttaac

SEQ ID NO: 585026 - DNA, 25 bp, Homo sapien
tgtcagctacttcccttaacttttt

SEQ ID NO: 585027 - DNA, 25 bp, Homo sapien
atgagacccaaactaagctaattag

SEQ ID NO: 585028 - DNA, 25 bp, Homo sapien
gaagctaaagtgttccctgtgtctt

SEQ ID NO: 585029 - DNA, 25 bp, Homo sapien
tttctgaatctggttcatcagcctt

SEQ ID NO: 585030 - DNA, 25 bp, Homo sapien
gaatctggttcatcagccttctctg

SEQ ID NO: 585031 - DNA, 25 bp, Homo sapien
agggtcgtagtatgaacacgtgttg

SEQ ID NO: 585032 - DNA, 25 bp, Homo sapien
ggaggtaagacaaagcagtctgcat

SEQ ID NO: 585033 - DNA, 25 bp, Homo sapien
ggaaagaacactggcttcccagccc

SEQ ID NO: 585034 - DNA, 25 bp, Homo sapien
gacagtgggcccaaggctcccaggc

SEQ ID NO: 585035 - DNA, 25 bp, Homo sapien
gggcccaaggctcccaggcatctgt

SEQ ID NO: 585036 - DNA, 25 bp, Homo sapien
atcacagagtggcagcatgcactct

SEQ ID NO: 585037 - DNA, 25 bp, Homo sapien
gtggcagcatgcactctgtcatagc

SEQ ID NO: 585038 - DNA, 25 bp, Homo sapien
tgtcatagccctccttcagagctgg

SEQ ID NO: 585039 - DNA, 25 bp, Homo sapien
agcagcccccctgataattactgat

SEQ ID NO: 585040 - DNA, 25 bp, Homo sapien
aattactgatcagcctcaggtggaa

SEQ ID NO: 585041 - DNA, 25 bp, Homo sapien
gtggaaaggcaatgtaccctcccat

SEQ ID NO: 585042 - DNA, 25 bp, Homo sapien
gtcataatcaaaccctgtggctgcc

SEQ ID NO: 585043 - DNA, 25 bp, Homo sapien
gcctccttcttactggagggcatag

SEQ ID NO: 585044 - DNA, 25 bp, Homo sapien
cctccttcttactggagggcataga

SEQ ID NO: 585045 - DNA, 25 bp, Homo sapien
ctccttcttactggagggcatagag

SEQ ID NO: 585046 - DNA, 25 bp, Homo sapien
tccttcttactggagggcatagagg

SEQ ID NO: 585047 - DNA, 25 bp, Homo sapien
ccttcttactggagggcatagagga

SEQ ID NO: 585048 - DNA, 25 bp, Homo sapien
gagggcatagaggaatgcagatttt

SEQ ID NO: 585049 - DNA, 25 bp, Homo sapien
gagacagagtgtcgctgcaatgccc

SEQ ID NO: 585050 - DNA, 25 bp, Homo sapien
agacagagtgtcgctgcaatgccca

SEQ ID NO: 585051 - DNA, 25 bp, Homo sapien
acagagtgtcgctgcaatgcccagg

SEQ ID NO: 585052 - DNA, 25 bp, Homo sapien
tgtcgctgcaatgcccaggctgaag

SEQ ID NO: 585053 - DNA, 25 bp, Homo sapien
tctaacttcgggatgcggaagtgag

SEQ ID NO: 585054 - DNA, 25 bp, Homo sapien
ctaacttcgggatgcggaagtgagg

SEQ ID NO: 585055 - DNA, 25 bp, Homo sapien
taacttcgggatgcggaagtgaggg

SEQ ID NO: 585056 - DNA, 25 bp, Homo sapien
cttcgggatgcggaagtgagggaaa

SEQ ID NO: 585057 - DNA, 25 bp, Homo sapien
tcgggatgcggaagtgagggaaagt

SEQ ID NO: 585058 - DNA, 25 bp, Homo sapien
cgggatgcggaagtgagggaaagtc

SEQ ID NO: 585059 - DNA, 25 bp, Homo sapien
ggatgcggaagtgagggaaagtccc

SEQ ID NO: 585060 - DNA, 25 bp, Homo sapien
gatgcggaagtgagggaaagtccca

SEQ ID NO: 585061 - DNA, 25 bp, Homo sapien
atgcggaagtgagggaaagtcccag

SEQ ID NO: 585062 - DNA, 25 bp, Homo sapien
gcggaagtgagggaaagtcccagtg

SEQ ID NO: 585063 - DNA, 25 bp, Homo sapien
cggaagtgagggaaagtcccagtgt

SEQ ID NO: 585064 - DNA, 25 bp, Homo sapien
aacgaggaatccgacattcaatgaa

SEQ ID NO: 585065 - DNA, 25 bp, Homo sapien
acttcaactaagtgtactcagtgca

SEQ ID NO: 585066 - DNA, 25 bp, Homo sapien
tactcagtgcagaatctctgcggga

SEQ ID NO: 585067 - DNA, 25 bp, Homo sapien
ttcttgggtggagtaaccctgcctt

SEQ ID NO: 585068 - DNA, 25 bp, Homo sapien
tggagtaaccctgcctttgaaagat

SEQ ID NO: 585069 - DNA, 25 bp, Homo sapien
tttcaacttgagcaaagagacggtt

SEQ ID NO: 585070 - DNA, 25 bp, Homo sapien
gacggttaaatggtatcagctgact

SEQ ID NO: 585071 - DNA, 25 bp, Homo sapien
tggtatcagctgactgcggcaacat

SEQ ID NO: 585072 - DNA, 25 bp, Homo sapien
gactgcggcaacatacttgtaaact

SEQ ID NO: 585073 - DNA, 25 bp, Homo sapien
gagctttggaagcatgaacagttat

SEQ ID NO: 585074 - DNA, 25 bp, Homo sapien
acagttataaacgtgcatgcataca

SEQ ID NO: 585075 - DNA, 25 bp, Homo sapien
gcctttcattatctttgagctccta

SEQ ID NO: 585076 - DNA, 25 bp, Homo sapien
tgagctcctatatagaacacttata

SEQ ID NO: 585077 - DNA, 25 bp, Homo sapien
gaatgtaaaaagttcttgtctatag

SEQ ID NO: 585078 - DNA, 25 bp, Homo sapien
tgtgttcagtgaatagcaattgatt

SEQ ID NO: 585079 - DNA, 25 bp, Homo sapien
gcaattgattattgtcccatggata

SEQ ID NO: 585080 - DNA, 25 bp, Homo sapien
ttgtcccatggatattaaccaattt

SEQ ID NO: 585081 - DNA, 25 bp, Homo sapien
ttttacattcatttcagcattcctg

SEQ ID NO: 585082 - DNA, 25 bp, Homo sapien
tcagcattcctgattcaacgataaa

SEQ ID NO: 585083 - DNA, 25 bp, Homo sapien
gtgtagtacattgaattctcctata

SEQ ID NO: 585084 - DNA, 25 bp, Homo sapien
ttctcctatatagcatcttactggt

SEQ ID NO: 585085 - DNA, 25 bp, Homo sapien
ctggttcccttatgagttaattaag

SEQ ID NO: 585086 - DNA, 25 bp, Homo sapien
caccccagaggaaacagacgacgtt

SEQ ID NO: 585087 - DNA, 25 bp, Homo sapien
ctccatgagtgtggcaccctgggca

SEQ ID NO: 585088 - DNA, 25 bp, Homo sapien
ggaaggctgcgggtcatcgtgggaa

SEQ ID NO: 585089 - DNA, 25 bp, Homo sapien
aacacttcgtggcaaattgagatca

SEQ ID NO: 585090 - DNA, 25 bp, Homo sapien
attgagatcaatgagcgcccaaaaa

SEQ ID NO: 585091 - DNA, 25 bp, Homo sapien
tgagatcaatgagcgcccaaaaagg

SEQ ID NO: 585092 - DNA, 25 bp, Homo sapien
caatgagcgcccaaaaaggaaactg

SEQ ID NO: 585093 - DNA, 25 bp, Homo sapien
gaaactgatggagcaatatttctgc

SEQ ID NO: 585094 - DNA, 25 bp, Homo sapien
gatggagcaatatttctgctctacc

SEQ ID NO: 585095 - DNA, 25 bp, Homo sapien
gcaatatttctgctctaccaaagag

SEQ ID NO: 585096 - DNA, 25 bp, Homo sapien
aatatttctgctctaccaaagaggg

SEQ ID NO: 585097 - DNA, 25 bp, Homo sapien
gagaatggaaggtcactgtgaagcc

SEQ ID NO: 585098 - DNA, 25 bp, Homo sapien
ggtcactgtgaagccgaatgtctta

SEQ ID NO: 585099 - DNA, 25 bp, Homo sapien
ctgtgaagccgaatgtcttaccttt

SEQ ID NO: 585100 - DNA, 25 bp, Homo sapien
gaagccgaatgtcttacctttgaag

SEQ ID NO: 585101 - DNA, 25 bp, Homo sapien
tttattttggctgctctcattcttc

SEQ ID NO: 585102 - DNA, 25 bp, Homo sapien
attttggctgctctcattcttcttg

SEQ ID NO: 585103 - DNA, 25 bp, Homo sapien
gctctcattcttcttgctcaaattt

SEQ ID NO: 585104 - DNA, 25 bp, Homo sapien
cattcttcttgctcaaattttccaa

SEQ ID NO: 585105 - DNA, 25 bp, Homo sapien
gctcaaattttccaagccaggacag

SEQ ID NO: 585106 - DNA, 25 bp, Homo sapien
aagccaggacagcaattcatagagc

SEQ ID NO: 585107 - DNA, 25 bp, Homo sapien
ggacagcaattcatagagcactaat

SEQ ID NO: 585108 - DNA, 25 bp, Homo sapien
atttaactctatggaatacacttgg

SEQ ID NO: 585109 - DNA, 25 bp, Homo sapien
ctctatggaatacacttggatttta

SEQ ID NO: 585110 - DNA, 25 bp, Homo sapien
tggaaacagatccattggaacaatt

SEQ ID NO: 585111 - DNA, 25 bp, Homo sapien
tggaacaattatggctaagcacaac

SEQ ID NO: 585112 - DNA, 25 bp, Homo sapien
atggctaagcacaacctattcaggt

SEQ ID NO: 585113 - DNA, 25 bp, Homo sapien
gttttgatttggcactgtaattagc

SEQ ID NO: 585114 - DNA, 25 bp, Homo sapien
gtattttaaactttgtgactgctgt

SEQ ID NO: 585115 - DNA, 25 bp, Homo sapien
ttaaactttgtgactgctgtgaaca

SEQ ID NO: 585116 - DNA, 25 bp, Homo sapien
taatataatttggtgcttgttgctt

SEQ ID NO: 585117 - DNA, 25 bp, Homo sapien
aatttggtgcttgttgcttttatca

SEQ ID NO: 585118 - DNA, 25 bp, Homo sapien
gcttttatcaaatattggtgtctaa

SEQ ID NO: 585119 - DNA, 25 bp, Homo sapien
ggcttgaagggacccgccatgcctc

SEQ ID NO: 585120 - DNA, 25 bp, Homo sapien
atgctgcgtggttccaggtgatcta

SEQ ID NO: 585121 - DNA, 25 bp, Homo sapien
aggtgatctattgctttctcgagtt

SEQ ID NO: 585122 - DNA, 25 bp, Homo sapien
ggtgtaagtgacactgcctagccta

SEQ ID NO: 585123 - DNA, 25 bp, Homo sapien
ctgcctagcctaactctcttaaaaa

SEQ ID NO: 585124 - DNA, 25 bp, Homo sapien
ttaaaaatcatagccctactcctgc

SEQ ID NO: 585125 - DNA, 25 bp, Homo sapien
tgcctccccaaatcagatacgacag

SEQ ID NO: 585126 - DNA, 25 bp, Homo sapien
gatacgacaggcataggctctgact

SEQ ID NO: 585127 - DNA, 25 bp, Homo sapien
ggctctgactgttccttaagtctta

SEQ ID NO: 585128 - DNA, 25 bp, Homo sapien
aagtcttagtggcaatactccctga

SEQ ID NO: 585129 - DNA, 25 bp, Homo sapien
aatactccctgaccagttttgcggg

SEQ ID NO: 585130 - DNA, 25 bp, Homo sapien
gcctgtttgtttgtctgcaaggaga

SEQ ID NO: 585131 - DNA, 25 bp, Homo sapien
gggagggtgaccataaccttagcaa

SEQ ID NO: 585132 - DNA, 25 bp, Homo sapien
gtgaccataaccttagcaacctgaa

SEQ ID NO: 585133 - DNA, 25 bp, Homo sapien
ataaccttagcaacctgaagccaag

SEQ ID NO: 585134 - DNA, 25 bp, Homo sapien
caacctgaagccaagggtgaaccct

SEQ ID NO: 585135 - DNA, 25 bp, Homo sapien
aagggtgaacccttgctcagatctt

SEQ ID NO: 585136 - DNA, 25 bp, Homo sapien
gaacccttgctcagatcttgcattt

SEQ ID NO: 585137 - DNA, 25 bp, Homo sapien
ccttgctcagatcttgcattttaag

SEQ ID NO: 585138 - DNA, 25 bp, Homo sapien
tgcattttaagagtaaccaaagggt

SEQ ID NO: 585139 - DNA, 25 bp, Homo sapien
caaagggttctgaaacatattccct

SEQ ID NO: 585140 - DNA, 25 bp, Homo sapien
attccctttttaaatctctgctgtg

SEQ ID NO: 585141 - DNA, 25 bp, Homo sapien
aaacacgtgtcttctgtggagctct

SEQ ID NO: 585142 - DNA, 25 bp, Homo sapien
gagctctgagaacaggactccagca

SEQ ID NO: 585143 - DNA, 25 bp, Homo sapien
tgtggtcttcaagcatttccaagat

SEQ ID NO: 585144 - DNA, 25 bp, Homo sapien
aagcatttccaagatctgtgacatt

SEQ ID NO: 585145 - DNA, 25 bp, Homo sapien
gacagatttgggtctccatgagcag

SEQ ID NO: 585146 - DNA, 25 bp, Homo sapien
gagcagagagtattctttcccttag

SEQ ID NO: 585147 - DNA, 25 bp, Homo sapien
tctttcccttagttctgggtagcat

SEQ ID NO: 585148 - DNA, 25 bp, Homo sapien
agcatagtgcccaaggaaacctaat

SEQ ID NO: 585149 - DNA, 25 bp, Homo sapien
acctaatcagtacagtgggaaacca

SEQ ID NO: 585150 - DNA, 25 bp, Homo sapien
aatcattacccataagcaatcctat

SEQ ID NO: 585151 - DNA, 25 bp, Homo sapien
gcaatcctatggactctctgaggtt

SEQ ID NO: 585152 - DNA, 25 bp, Homo sapien
aagtccttcttatcttctaactcca

SEQ ID NO: 585153 - DNA, 25 bp, Homo sapien
tatcttctaactccattaagctaat

SEQ ID NO: 585154 - DNA, 25 bp, Homo sapien
taagctaattttaccatgccaatca

SEQ ID NO: 585155 - DNA, 25 bp, Homo sapien
atgccaatcaaacctagttgttgtt

SEQ ID NO: 585156 - DNA, 25 bp, Homo sapien
acctagttgttgtttgtctaggaat

SEQ ID NO: 585157 - DNA, 25 bp, Homo sapien
gggagacaatatattcactgtttta

SEQ ID NO: 585158 - DNA, 25 bp, Homo sapien
gttttaattagtggcagtagaccta

SEQ ID NO: 585159 - DNA, 25 bp, Homo sapien
gtggcagtagacctaatccaattat

SEQ ID NO: 585160 - DNA, 25 bp, Homo sapien
aagtggcttgccctgacataaatca

SEQ ID NO: 585161 - DNA, 25 bp, Homo sapien
gcttgccctgacataaatcactagt

SEQ ID NO: 585162 - DNA, 25 bp, Homo sapien
ataaatcactagttattgaaggcaa

SEQ ID NO: 585163 - DNA, 25 bp, Homo sapien
ctgggaagggccttcaacgaagtag

SEQ ID NO: 585164 - DNA, 25 bp, Homo sapien
gaagggccttcaacgaagtaggaag

SEQ ID NO: 585165 - DNA, 25 bp, Homo sapien
ggccttcaacgaagtaggaagaaca

SEQ ID NO: 585166 - DNA, 25 bp, Homo sapien
gaacagttgtaaaatggagactcga

SEQ ID NO: 585167 - DNA, 25 bp, Homo sapien
aacagttgtaaaatggagactcgaa

SEQ ID NO: 585168 - DNA, 25 bp, Homo sapien
cagttgtaaaatggagactcgaagt

SEQ ID NO: 585169 - DNA, 25 bp, Homo sapien
gtaaaatggagactcgaagtgaaaa

SEQ ID NO: 585170 - DNA, 25 bp, Homo sapien
aggttgggagcaaggacctttggca

SEQ ID NO: 585171 - DNA, 25 bp, Homo sapien
tatcaagacattacattatataagg

SEQ ID NO: 585172 - DNA, 25 bp, Homo sapien
gacattacattatataaggtctaag

SEQ ID NO: 585173 - DNA, 25 bp, Homo sapien
cattacattatataaggtctaagaa

SEQ ID NO: 585174 - DNA, 25 bp, Homo sapien
aagtcatgatgaactcttgccgtga

SEQ ID NO: 585175 - DNA, 25 bp, Homo sapien
atgatgaactcttgccgtgatggaa

SEQ ID NO: 585176 - DNA, 25 bp, Homo sapien
gaactcttgccgtgatggaaaaaag

SEQ ID NO: 585177 - DNA, 25 bp, Homo sapien
ggatatagaagacctcaacaacatt

SEQ ID NO: 585178 - DNA, 25 bp, Homo sapien
agaagacctcaacaacattattaat

SEQ ID NO: 585179 - DNA, 25 bp, Homo sapien
aacatcattaaaacatacaccaaga

SEQ ID NO: 585180 - DNA, 25 bp, Homo sapien
tacaccaagatggatcatactctgg

SEQ ID NO: 585181 - DNA, 25 bp, Homo sapien
ggatcatactctgggccatgtaatt

SEQ ID NO: 585182 - DNA, 25 bp, Homo sapien
gggccatgtaattcactgcaccaat

SEQ ID NO: 585183 - DNA, 25 bp, Homo sapien
gtaattcactgcaccaatttaaaag

SEQ ID NO: 585184 - DNA, 25 bp, Homo sapien
aagtatattctcatatcacaacaaa

SEQ ID NO: 585185 - DNA, 25 bp, Homo sapien
tcaaggtgggtccttcctataggga

SEQ ID NO: 585186 - DNA, 25 bp, Homo sapien
tagggaggttgatgtcagcccttca

SEQ ID NO: 585187 - DNA, 25 bp, Homo sapien
agcccttcagggaggtctcagtttt

SEQ ID NO: 585188 - DNA, 25 bp, Homo sapien
atcccttcattataattccttccac

SEQ ID NO: 585189 - DNA, 25 bp, Homo sapien
ataagtttcttgagcaatgcagcaa

SEQ ID NO: 585190 - DNA, 25 bp, Homo sapien
tgcagcaatatccagcaattttaga

SEQ ID NO: 585191 - DNA, 25 bp, Homo sapien
gatagacatttaccttttgacctag

SEQ ID NO: 585192 - DNA, 25 bp, Homo sapien
aaatctcacttctacgaatccatcc

SEQ ID NO: 585193 - DNA, 25 bp, Homo sapien
gaatccatcctaaagacacactctc

SEQ ID NO: 585194 - DNA, 25 bp, Homo sapien
ctaaagacacactctcagctggatg

SEQ ID NO: 585195 - DNA, 25 bp, Homo sapien
ggtcgctcatgcctgcgatcctaac

SEQ ID NO: 585196 - DNA, 25 bp, Homo sapien
tgctgacagtcctggtgagtccccg

SEQ ID NO: 585197 - DNA, 25 bp, Homo sapien
tgacagtcctggtgagtccccgctt

SEQ ID NO: 585198 - DNA, 25 bp, Homo sapien
ctgagctctccagggccgactgtgg

SEQ ID NO: 585199 - DNA, 25 bp, Homo sapien
agggccgactgtggtgaggcaccca

SEQ ID NO: 585200 - DNA, 25 bp, Homo sapien
gggattttgtccaagggacctcagc

SEQ ID NO: 585201 - DNA, 25 bp, Homo sapien
ttgtccaagggacctcagcaatcag

SEQ ID NO: 585202 - DNA, 25 bp, Homo sapien
caagggacctcagcaatcagggaag

SEQ ID NO: 585203 - DNA, 25 bp, Homo sapien
cagcaatcagggaaggaggcacccc

SEQ ID NO: 585204 - DNA, 25 bp, Homo sapien
cccaaatccctgagctgtgtttgtt

SEQ ID NO: 585205 - DNA, 25 bp, Homo sapien
aaatccctgagctgtgtttgttggt

SEQ ID NO: 585206 - DNA, 25 bp, Homo sapien
atccctgagctgtgtttgttggtgt

SEQ ID NO: 585207 - DNA, 25 bp, Homo sapien
gatatcttactcttggaacattcat

SEQ ID NO: 585208 - DNA, 25 bp, Homo sapien
attcatgcctttgctgccgagaaga

SEQ ID NO: 585209 - DNA, 25 bp, Homo sapien
gaactcagagacattgtacttgact

SEQ ID NO: 585210 - DNA, 25 bp, Homo sapien
gtacttgactgtcctgatggcagta

SEQ ID NO: 585211 - DNA, 25 bp, Homo sapien
atggcagtacaatcccttaccaata

SEQ ID NO: 585212 - DNA, 25 bp, Homo sapien
atatcacgacctgctcttgtttaga

SEQ ID NO: 585213 - DNA, 25 bp, Homo sapien
gctcttgtttagacatatgccaact

SEQ ID NO: 585214 - DNA, 25 bp, Homo sapien
tgccaactatatacgaccttcatgt

SEQ ID NO: 585215 - DNA, 25 bp, Homo sapien
cgaccttcatgtacagttaatgctg

SEQ ID NO: 585216 - DNA, 25 bp, Homo sapien
tgacatcaccttcccagttttaaca

SEQ ID NO: 585217 - DNA, 25 bp, Homo sapien
taacaggcctggtatttattttata

SEQ ID NO: 585218 - DNA, 25 bp, Homo sapien
ttttccctgttatggcctctctggg

SEQ ID NO: 585219 - DNA, 25 bp, Homo sapien
tttccctgttatggcctctctgggt

SEQ ID NO: 585220 - DNA, 25 bp, Homo sapien
ttccctgttatggcctctctgggtt

SEQ ID NO: 585221 - DNA, 25 bp, Homo sapien
gcctctctgggtttccaaaattcta

SEQ ID NO: 585222 - DNA, 25 bp, Homo sapien
cctctctgggtttccaaaattctat

SEQ ID NO: 585223 - DNA, 25 bp, Homo sapien
ctctctgggtttccaaaattctatc

SEQ ID NO: 585224 - DNA, 25 bp, Homo sapien
tctctgggtttccaaaattctatct

SEQ ID NO: 585225 - DNA, 25 bp, Homo sapien
ctctgggtttccaaaattctatctc

SEQ ID NO: 585226 - DNA, 25 bp, Homo sapien
tctgggtttccaaaattctatctct

SEQ ID NO: 585227 - DNA, 25 bp, Homo sapien
ctgggtttccaaaattctatctctt

SEQ ID NO: 585228 - DNA, 25 bp, Homo sapien
tgaaatgattttcaaacctaacttt

SEQ ID NO: 585229 - DNA, 25 bp, Homo sapien
gacattcatcttgtttgttgcctgt

SEQ ID NO: 585230 - DNA, 25 bp, Homo sapien
gaatagaggccttgtatgtcccgtt

SEQ ID NO: 585231 - DNA, 25 bp, Homo sapien
atgtcccgtttgttgttgtgtccta

SEQ ID NO: 585232 - DNA, 25 bp, Homo sapien
ttaggacctagaacggagcacgctt

SEQ ID NO: 585233 - DNA, 25 bp, Homo sapien
tggtagggcctctgtaagtatttgt

SEQ ID NO: 585234 - DNA, 25 bp, Homo sapien
gaatggacccattacaaaggcccca

SEQ ID NO: 585235 - DNA, 25 bp, Homo sapien
aggacccgagcgcagattgtcacag

SEQ ID NO: 585236 - DNA, 25 bp, Homo sapien
attgtcacagttcttgtgccggcat

SEQ ID NO: 585237 - DNA, 25 bp, Homo sapien
gtgccggcatgtattgagtgccaca

SEQ ID NO: 585238 - DNA, 25 bp, Homo sapien
gtgccacaggtggactctggagaca

SEQ ID NO: 585239 - DNA, 25 bp, Homo sapien
ggagacacaatctttgtcctcaaaa

SEQ ID NO: 585240 - DNA, 25 bp, Homo sapien
gagtaaaatcctgtgcgtgaggcca

SEQ ID NO: 585241 - DNA, 25 bp, Homo sapien
aaaatcctgtgcgtgaggccaaagg

SEQ ID NO: 585242 - DNA, 25 bp, Homo sapien
tcctgtgcgtgaggccaaaggaaat

SEQ ID NO: 585243 - DNA, 25 bp, Homo sapien
ggaaattggacactcttgtccctca

SEQ ID NO: 585244 - DNA, 25 bp, Homo sapien
actcttgtccctcacatggaggagg

SEQ ID NO: 585245 - DNA, 25 bp, Homo sapien
cttgtccctcacatggaggagggca

SEQ ID NO: 585246 - DNA, 25 bp, Homo sapien
gtaaaaacaggcacactctaaataa

SEQ ID NO: 585247 - DNA, 25 bp, Homo sapien
ggcacactctaaataagtcatccca

SEQ ID NO: 585248 - DNA, 25 bp, Homo sapien
aagtcatcccacttttgcgaatctg

SEQ ID NO: 585249 - DNA, 25 bp, Homo sapien
catcccacttttgcgaatctgttct

SEQ ID NO: 585250 - DNA, 25 bp, Homo sapien
acttttgcgaatctgttctgtggaa

SEQ ID NO: 585251 - DNA, 25 bp, Homo sapien
aaggagtcttcgtcactgtagggtc

SEQ ID NO: 585252 - DNA, 25 bp, Homo sapien
gtcactgtagggtctcattcacaat

SEQ ID NO: 585253 - DNA, 25 bp, Homo sapien
gggtctcattcacaatatggaggag

SEQ ID NO: 585254 - DNA, 25 bp, Homo sapien
tttggtataaattttgcctcataaa

SEQ ID NO: 585255 - DNA, 25 bp, Homo sapien
ttgcctcataaaaattctccacgtt

SEQ ID NO: 585256 - DNA, 25 bp, Homo sapien
aaattctccacgttgttttgtactg

SEQ ID NO: 585257 - DNA, 25 bp, Homo sapien
ctccacgttgttttgtactgtatga

SEQ ID NO: 585258 - DNA, 25 bp, Homo sapien
actgtatgagggtagcgagaaatta

SEQ ID NO: 585259 - DNA, 25 bp, Homo sapien
gatggttaacaatcaagctggagaa

SEQ ID NO: 585260 - DNA, 25 bp, Homo sapien
atatcctcaatttttcacatggaaa

SEQ ID NO: 585261 - DNA, 25 bp, Homo sapien
aaactacaactccttccaaatatat

SEQ ID NO: 585262 - DNA, 25 bp, Homo sapien
aggtaccgccataggagcctggcct

SEQ ID NO: 585263 - DNA, 25 bp, Homo sapien
tggccttggctgcatttgtgcacaa

SEQ ID NO: 585264 - DNA, 25 bp, Homo sapien
gcatttgtgcacaaggagcaggcaa

SEQ ID NO: 585265 - DNA, 25 bp, Homo sapien
agcaggcttacattggaatgggtgc

SEQ ID NO: 585266 - DNA, 25 bp, Homo sapien
ggaggcctcttttctcggtaagatc

SEQ ID NO: 585267 - DNA, 25 bp, Homo sapien
ttttctcggtaagatctctccacag

SEQ ID NO: 585268 - DNA, 25 bp, Homo sapien
tcggtaagatctctccacagctgcc

SEQ ID NO: 585269 - DNA, 25 bp, Homo sapien
tgccaccaaccatcacagaggacag

SEQ ID NO: 585270 - DNA, 25 bp, Homo sapien
tgagtattgtcattggagggccgat

SEQ ID NO: 585271 - DNA, 25 bp, Homo sapien
tggagggccgatgtgaatctctctg

SEQ ID NO: 585272 - DNA, 25 bp, Homo sapien
gatggaggctaggtctgatataaac

SEQ ID NO: 585273 - DNA, 25 bp, Homo sapien
cccagttctgacattcacagcatga

SEQ ID NO: 585274 - DNA, 25 bp, Homo sapien
gttctgacattcacagcatgaccta

SEQ ID NO: 585275 - DNA, 25 bp, Homo sapien
tgacattcacagcatgacctagagc

SEQ ID NO: 585276 - DNA, 25 bp, Homo sapien
acattcacagcatgacctagagcat

SEQ ID NO: 585277 - DNA, 25 bp, Homo sapien
atgacctagagcatgcggattcccc

SEQ ID NO: 585278 - DNA, 25 bp, Homo sapien
tgacctagagcatgcggattcccct

SEQ ID NO: 585279 - DNA, 25 bp, Homo sapien
tagagcatgcggattcccctctctg

SEQ ID NO: 585280 - DNA, 25 bp, Homo sapien
agcatgcggattcccctctctgagt

SEQ ID NO: 585281 - DNA, 25 bp, Homo sapien
agtcactggtttctcacctgcaaaa

SEQ ID NO: 585282 - DNA, 25 bp, Homo sapien
cactggtttctcacctgcaaaagaa

SEQ ID NO: 585283 - DNA, 25 bp, Homo sapien
tttctcacctgcaaaagaaagcggg

SEQ ID NO: 585284 - DNA, 25 bp, Homo sapien
tagaaacttctgtctaacaccatca

SEQ ID NO: 585285 - DNA, 25 bp, Homo sapien
taacaccatcacaaataggttcatg

SEQ ID NO: 585286 - DNA, 25 bp, Homo sapien
ataggttcatggtcagcctaaacat

SEQ ID NO: 585287 - DNA, 25 bp, Homo sapien
gcctaaacatgtatactgtgcattt

SEQ ID NO: 585288 - DNA, 25 bp, Homo sapien
tactgtgcattttatgggtgacttt

SEQ ID NO: 585289 - DNA, 25 bp, Homo sapien
atgggtgactttgaaagatctgttc

SEQ ID NO: 585290 - DNA, 25 bp, Homo sapien
aaagatctgttcaattatttttcag

SEQ ID NO: 585291 - DNA, 25 bp, Homo sapien
gaaaaaccattattgtacagaggta

SEQ ID NO: 585292 - DNA, 25 bp, Homo sapien
gagactatgaaacggcaatactttt

SEQ ID NO: 585293 - DNA, 25 bp, Homo sapien
aatatatgttcactgtgcagaggga

SEQ ID NO: 585294 - DNA, 25 bp, Homo sapien
gtgcagagggattgtaccttgtaca

SEQ ID NO: 585295 - DNA, 25 bp, Homo sapien
acagtaaatttacatgacatcaaat

SEQ ID NO: 585296 - DNA, 25 bp, Homo sapien
gaaaacttcaagcatactgactcgt

SEQ ID NO: 585297 - DNA, 25 bp, Homo sapien
aaacttcaagcatactgactcgtgt

SEQ ID NO: 585298 - DNA, 25 bp, Homo sapien
acttcaagcatactgactcgtgtta

SEQ ID NO: 585299 - DNA, 25 bp, Homo sapien
caagcatactgactcgtgttagaaa

SEQ ID NO: 585300 - DNA, 25 bp, Homo sapien
gcatactgactcgtgttagaaaaat

SEQ ID NO: 585301 - DNA, 25 bp, Homo sapien
cttacttattttcagatacctccat

SEQ ID NO: 585302 - DNA, 25 bp, Homo sapien
acttattttcagatacctccattct

SEQ ID NO: 585303 - DNA, 25 bp, Homo sapien
taacaaactgccctatctcagagac

SEQ ID NO: 585304 - DNA, 25 bp, Homo sapien
ctatctcagagacccatcataaaaa

SEQ ID NO: 585305 - DNA, 25 bp, Homo sapien
gagacccatcataaaaaatgacttg

SEQ ID NO: 585306 - DNA, 25 bp, Homo sapien
ggaactatttatatcccacctctag

SEQ ID NO: 585307 - DNA, 25 bp, Homo sapien
tatttatatcccacctctagccact

SEQ ID NO: 585308 - DNA, 25 bp, Homo sapien
gtccccctcaaagttgtggtaagat

SEQ ID NO: 585309 - DNA, 25 bp, Homo sapien
gggaaaagatactgagcaacctgtt

SEQ ID NO: 585310 - DNA, 25 bp, Homo sapien
gatactgagcaacctgttttattac

SEQ ID NO: 585311 - DNA, 25 bp, Homo sapien
gagcaacctgttttattacagtctg

SEQ ID NO: 585312 - DNA, 25 bp, Homo sapien
attacagtctggttctcatgctaaa

SEQ ID NO: 585313 - DNA, 25 bp, Homo sapien
gttctcatgctaaaacagggttgct

SEQ ID NO: 585314 - DNA, 25 bp, Homo sapien
gctaaaacagggttgctagtgttaa

SEQ ID NO: 585315 - DNA, 25 bp, Homo sapien
ggtgtttctggtttgcgacagattt

SEQ ID NO: 585316 - DNA, 25 bp, Homo sapien
ggtttgcgacagatttctttattta

SEQ ID NO: 585317 - DNA, 25 bp, Homo sapien
tcaccctccagacaaaaagctgagc

SEQ ID NO: 585318 - DNA, 25 bp, Homo sapien
aaaatgaaacgcttcgcctggcaat

SEQ ID NO: 585319 - DNA, 25 bp, Homo sapien
gcttcgcctggcaatgaggtatatc

SEQ ID NO: 585320 - DNA, 25 bp, Homo sapien
gcaaagcctgcaacaaacgggagtg

SEQ ID NO: 585321 - DNA, 25 bp, Homo sapien
caacaaacgggagtggctgctcagg

SEQ ID NO: 585322 - DNA, 25 bp, Homo sapien
ggacagaactctgcttgagaactac

SEQ ID NO: 585323 - DNA, 25 bp, Homo sapien
ttgagaactaccaggttccttcacc

SEQ ID NO: 585324 - DNA, 25 bp, Homo sapien
tggtccaagccaccacattccttag

SEQ ID NO: 585325 - DNA, 25 bp, Homo sapien
gcagcagaatgtcaacagcgccttt

SEQ ID NO: 585326 - DNA, 25 bp, Homo sapien
agcgcctttgccaagctgaggaagc

SEQ ID NO: 585327 - DNA, 25 bp, Homo sapien
aagctgaggaagctcatccccactc

SEQ ID NO: 585328 - DNA, 25 bp, Homo sapien
gggtgaacttacgtgctcgctgaca

SEQ ID NO: 585329 - DNA, 25 bp, Homo sapien
gaacttacgtgctcgctgacaatgt

SEQ ID NO: 585330 - DNA, 25 bp, Homo sapien
cgtgctcgctgacaatgtccttaaa

SEQ ID NO: 585331 - DNA, 25 bp, Homo sapien
caatgtccttaaagtcctggcatcc

SEQ ID NO: 585332 - DNA, 25 bp, Homo sapien
ggcaagcgaaggtaacccccagtgg

SEQ ID NO: 585333 - DNA, 25 bp, Homo sapien
gctctggaagtatggaggcccctct

SEQ ID NO: 585334 - DNA, 25 bp, Homo sapien
tggaagtatggaggcccctctcctt

SEQ ID NO: 585335 - DNA, 25 bp, Homo sapien
ccagcgaggcagaactcacaggcaa

SEQ ID NO: 585336 - DNA, 25 bp, Homo sapien
gaactcacaggcaacacctggtttc

SEQ ID NO: 585337 - DNA, 25 bp, Homo sapien
acctggtttctgcacagatgcagct

SEQ ID NO: 585338 - DNA, 25 bp, Homo sapien
gaacctagaggaaagcatggacagc

SEQ ID NO: 585339 - DNA, 25 bp, Homo sapien
ttataccgatagaccaaaacagcat

SEQ ID NO: 585340 - DNA, 25 bp, Homo sapien
aacagcatgtgtaagaggcagtatc

SEQ ID NO: 585341 - DNA, 25 bp, Homo sapien
aggcagtatctgcactaattctcaa

SEQ ID NO: 585342 - DNA, 25 bp, Homo sapien
actaattctcaacatgctaaacatt

SEQ ID NO: 585343 - DNA, 25 bp, Homo sapien
gtgagaatattcctcgtcacagcaa

SEQ ID NO: 585344 - DNA, 25 bp, Homo sapien
gtcacagcaaaaacactttcctttc

SEQ ID NO: 585345 - DNA, 25 bp, Homo sapien
tttcctttctactgacaaccagtcc

SEQ ID NO: 585346 - DNA, 25 bp, Homo sapien
agtcctccacatcacagcatttaga

SEQ ID NO: 585347 - DNA, 25 bp, Homo sapien
gtttgtatcagtttcatgtctaagt

SEQ ID NO: 585348 - DNA, 25 bp, Homo sapien
aatgcaaacgtactagaccagtgga

SEQ ID NO: 585349 - DNA, 25 bp, Homo sapien
gaccagtggagaatttgacaccttt

SEQ ID NO: 585350 - DNA, 25 bp, Homo sapien
gaactcagacttccaatacattcat

SEQ ID NO: 585351 - DNA, 25 bp, Homo sapien
atacattcatacatgctagagctga

SEQ ID NO: 585352 - DNA, 25 bp, Homo sapien
gagctgaaagtaagcagggaatttc

SEQ ID NO: 585353 - DNA, 25 bp, Homo sapien
gggaatttcagctctaaacacattt

SEQ ID NO: 585354 - DNA, 25 bp, Homo sapien
tcagctctaaacacatttttgagac

SEQ ID NO: 585355 - DNA, 25 bp, Homo sapien
acacatttttgagacagttatctgt

SEQ ID NO: 585356 - DNA, 25 bp, Homo sapien
gtttgttactgtgaatgctataata

SEQ ID NO: 585357 - DNA, 25 bp, Homo sapien
gagttgcataaaaatcttgcattca

SEQ ID NO: 585358 - DNA, 25 bp, Homo sapien
aaaatcttgcattcatcattcaaaa

SEQ ID NO: 585359 - DNA, 25 bp, Homo sapien
atactaaatttcacatgagactcaa

SEQ ID NO: 585360 - DNA, 25 bp, Homo sapien
gaatgatggaactcagacttccaat

SEQ ID NO: 585361 - DNA, 25 bp, Homo sapien
agcattctgatgtaacgacttccat

SEQ ID NO: 585362 - DNA, 25 bp, Homo sapien
gtaacgacttccatctggtcaaagg

SEQ ID NO: 585363 - DNA, 25 bp, Homo sapien
gaaattcagaacctctatctccttt

SEQ ID NO: 585364 - DNA, 25 bp, Homo sapien
gaattctacttcagtgcaaaggtaa

SEQ ID NO: 585365 - DNA, 25 bp, Homo sapien
gcaaaggtaactggcttaggagaat

SEQ ID NO: 585366 - DNA, 25 bp, Homo sapien
gacaatacattctgaaaagcgacta

SEQ ID NO: 585367 - DNA, 25 bp, Homo sapien
agcgactataacatccacttttcca

SEQ ID NO: 585368 - DNA, 25 bp, Homo sapien
ggtagggaatttgtcacgatcttct

SEQ ID NO: 585369 - DNA, 25 bp, Homo sapien
atttgtcacgatcttcttaatggaa

SEQ ID NO: 585370 - DNA, 25 bp, Homo sapien
atggaagcggctctaatcggagcaa

SEQ ID NO: 585371 - DNA, 25 bp, Homo sapien
agatgacaggattacttggaggtga

SEQ ID NO: 585372 - DNA, 25 bp, Homo sapien
atccgtatgtgtccttattatgagg

SEQ ID NO: 585373 - DNA, 25 bp, Homo sapien
gtgtccttattatgaggaatggcct

SEQ ID NO: 585374 - DNA, 25 bp, Homo sapien
gaggaatggcctactttatccatat

SEQ ID NO: 585375 - DNA, 25 bp, Homo sapien
ggcctactttatccatatatgagct

SEQ ID NO: 585376 - DNA, 25 bp, Homo sapien
tatatgagctaattgcactccttaa

SEQ ID NO: 585377 - DNA, 25 bp, Homo sapien
gagctaattgcactccttaaatgga

SEQ ID NO: 585378 - DNA, 25 bp, Homo sapien
gctaattgcactccttaaatggaaa

SEQ ID NO: 585379 - DNA, 25 bp, Homo sapien
aaaaatttcctccaggtcatgtgat

SEQ ID NO: 585380 - DNA, 25 bp, Homo sapien
ccaggtcatgtgatagtggaaagtg

SEQ ID NO: 585381 - DNA, 25 bp, Homo sapien
ttgtgggttatattaactctggatg

SEQ ID NO: 585382 - DNA, 25 bp, Homo sapien
ctctggatgctgtaacatttataga

SEQ ID NO: 585383 - DNA, 25 bp, Homo sapien
ggcgtctttgggatctggcctacaa

SEQ ID NO: 585384 - DNA, 25 bp, Homo sapien
tctttgggatctggcctacaatggg

SEQ ID NO: 585385 - DNA, 25 bp, Homo sapien
gcatagcaggaatattagtggtagg

SEQ ID NO: 585386 - DNA, 25 bp, Homo sapien
ttagtggtaggttgttgctgtctgt

SEQ ID NO: 585387 - DNA, 25 bp, Homo sapien
ggtgctgccacatgtgcatgggtcc

SEQ ID NO: 585388 - DNA, 25 bp, Homo sapien
catgtgcatgggtccccaccaagag

SEQ ID NO: 585389 - DNA, 25 bp, Homo sapien
accaagaggattccctggcctagag

SEQ ID NO: 585390 - DNA, 25 bp, Homo sapien
gaacatggctgtgtgcaggcaagca

SEQ ID NO: 585391 - DNA, 25 bp, Homo sapien
gggcacaagtgcacagtcccatatc

SEQ ID NO: 585392 - DNA, 25 bp, Homo sapien
acaagtgcacagtcccatatcttat

SEQ ID NO: 585393 - DNA, 25 bp, Homo sapien
gtgcacagtcccatatcttatataa

SEQ ID NO: 585394 - DNA, 25 bp, Homo sapien
ttctctgttgtctttcttgggagcc

SEQ ID NO: 585395 - DNA, 25 bp, Homo sapien
tctctgttgtctttcttgggagccc

SEQ ID NO: 585396 - DNA, 25 bp, Homo sapien
ctctgttgtctttcttgggagccct

SEQ ID NO: 585397 - DNA, 25 bp, Homo sapien
tctgttgtctttcttgggagccctt

SEQ ID NO: 585398 - DNA, 25 bp, Homo sapien
tcttgggagcccttccattatttga

SEQ ID NO: 585399 - DNA, 25 bp, Homo sapien
cttgggagcccttccattatttgac

SEQ ID NO: 585400 - DNA, 25 bp, Homo sapien
ttgggagcccttccattatttgact

SEQ ID NO: 585401 - DNA, 25 bp, Homo sapien
tgggagcccttccattatttgactg

SEQ ID NO: 585402 - DNA, 25 bp, Homo sapien
gggagcccttccattatttgactga

SEQ ID NO: 585403 - DNA, 25 bp, Homo sapien
aatatgttagataatttccaaccta

SEQ ID NO: 585404 - DNA, 25 bp, Homo sapien
tccaacctatggtaggaatgtccct

SEQ ID NO: 585405 - DNA, 25 bp, Homo sapien
taggaatgtccctagtttatttgac

SEQ ID NO: 585406 - DNA, 25 bp, Homo sapien
ttatttgacctttatgtggtaaaca

SEQ ID NO: 585407 - DNA, 25 bp, Homo sapien
gtggtaaacattcattgtcttttaa

SEQ ID NO: 585408 - DNA, 25 bp, Homo sapien
aagtcttgtgtattacaatgatacg

SEQ ID NO: 585409 - DNA, 25 bp, Homo sapien
acaatgatacgttatttctaatttt

SEQ ID NO: 585410 - DNA, 25 bp, Homo sapien
ttctaatttttatctcccctccatt

SEQ ID NO: 585411 - DNA, 25 bp, Homo sapien
tatctcccctccatttgtattaatt

SEQ ID NO: 585412 - DNA, 25 bp, Homo sapien
atttataggctgaaatgtagagcat

SEQ ID NO: 585413 - DNA, 25 bp, Homo sapien
attgggatgcatatattggttggaa

SEQ ID NO: 585414 - DNA, 25 bp, Homo sapien
ggacctggcaagaactgcactgtca

SEQ ID NO: 585415 - DNA, 25 bp, Homo sapien
agaactgcactgtcaaggctgcaag

SEQ ID NO: 585416 - DNA, 25 bp, Homo sapien
gcaagaggctcctgacggcttctga

SEQ ID NO: 585417 - DNA, 25 bp, Homo sapien
tcctgacggcttctgacatgtacag

SEQ ID NO: 585418 - DNA, 25 bp, Homo sapien
aaatggaagcagaggcaagaggtct

SEQ ID NO: 585419 - DNA, 25 bp, Homo sapien
aaatgtcaatggaaagcagctagca

SEQ ID NO: 585420 - DNA, 25 bp, Homo sapien
aaagcagctagcatgaagaccccac

SEQ ID NO: 585421 - DNA, 25 bp, Homo sapien
gctagcatgaagaccccacagtgtt

SEQ ID NO: 585422 - DNA, 25 bp, Homo sapien
agctgagatgctcccaatatggttg

SEQ ID NO: 585423 - DNA, 25 bp, Homo sapien
tggttgggacatttgtcccctccaa

SEQ ID NO: 585424 - DNA, 25 bp, Homo sapien
tgtgagaatttgatcccccattttg

SEQ ID NO: 585425 - DNA, 25 bp, Homo sapien
gaaatcactctcttgcttgacttcc

SEQ ID NO: 585426 - DNA, 25 bp, Homo sapien
actcttttactggtctccctagcag

SEQ ID NO: 585427 - DNA, 25 bp, Homo sapien
gtctccctagcagcattcagtggtg

SEQ ID NO: 585428 - DNA, 25 bp, Homo sapien
ttcagtggtgtgctgacactggcta

SEQ ID NO: 585429 - DNA, 25 bp, Homo sapien
agctgattgttagcaactcttccca

SEQ ID NO: 585430 - DNA, 25 bp, Homo sapien
aactccatattcagagatatcctgt

SEQ ID NO: 585431 - DNA, 25 bp, Homo sapien
gatatcctgttggtagctttaaact

SEQ ID NO: 585432 - DNA, 25 bp, Homo sapien
gtagctttaaactggtcatggtgga

SEQ ID NO: 585433 - DNA, 25 bp, Homo sapien
ggtcatggtggaagtactcactata

SEQ ID NO: 585434 - DNA, 25 bp, Homo sapien
tttccataaagccagttgttactca

SEQ ID NO: 585435 - DNA, 25 bp, Homo sapien
gttactcatttactatcacaccact

SEQ ID NO: 585436 - DNA, 25 bp, Homo sapien
gaaaacaaacaaggccatacacttt

SEQ ID NO: 585437 - DNA, 25 bp, Homo sapien
aacaaacaaggccatacactttgaa

SEQ ID NO: 585438 - DNA, 25 bp, Homo sapien
acaaacaaggccatacactttgaaa

SEQ ID NO: 585439 - DNA, 25 bp, Homo sapien
aaacaaggccatacactttgaaaat

SEQ ID NO: 585440 - DNA, 25 bp, Homo sapien
aacaaggccatacactttgaaaatt

SEQ ID NO: 585441 - DNA, 25 bp, Homo sapien
acaaggccatacactttgaaaattt

SEQ ID NO: 585442 - DNA, 25 bp, Homo sapien
caaggccatacactttgaaaatttg

SEQ ID NO: 585443 - DNA, 25 bp, Homo sapien
aaggccatacactttgaaaatttgt

SEQ ID NO: 585444 - DNA, 25 bp, Homo sapien
ggccatacactttgaaaatttgtag

SEQ ID NO: 585445 - DNA, 25 bp, Homo sapien
atacactttgaaaatttgtagccaa

SEQ ID NO: 585446 - DNA, 25 bp, Homo sapien
ttgaaaatttgtagccaaagaccag

SEQ ID NO: 585447 - DNA, 25 bp, Homo sapien
acggcatcagactaaaggcaaacaa

SEQ ID NO: 585448 - DNA, 25 bp, Homo sapien
caaggactctgtataaagtaccggt

SEQ ID NO: 585449 - DNA, 25 bp, Homo sapien
gactctgtataaagtaccggtggca

SEQ ID NO: 585450 - DNA, 25 bp, Homo sapien
tctgtataaagtaccggtggcatgt

SEQ ID NO: 585451 - DNA, 25 bp, Homo sapien
ataaagtaccggtggcatgtgtatt

SEQ ID NO: 585452 - DNA, 25 bp, Homo sapien
aagtaccggtggcatgtgtattagt

SEQ ID NO: 585453 - DNA, 25 bp, Homo sapien
taccggtggcatgtgtattagtgga

SEQ ID NO: 585454 - DNA, 25 bp, Homo sapien
catgtgtattagtggagatgcagcc

SEQ ID NO: 585455 - DNA, 25 bp, Homo sapien
ttctataatttcttaagtgctttga

SEQ ID NO: 585456 - DNA, 25 bp, Homo sapien
ttcttaagtgctttgaatgttcaag

SEQ ID NO: 585457 - DNA, 25 bp, Homo sapien
tgttcaagtagaaagtctaacatta

SEQ ID NO: 585458 - DNA, 25 bp, Homo sapien
tatcacagagccaagtgactgaaca

SEQ ID NO: 585459 - DNA, 25 bp, Homo sapien
aagtgactgaacacgcattcccaac

SEQ ID NO: 585460 - DNA, 25 bp, Homo sapien
acacgcattcccaactatatatcta

SEQ ID NO: 585461 - DNA, 25 bp, Homo sapien
gcattcccaactatatatctacaga

SEQ ID NO: 585462 - DNA, 25 bp, Homo sapien
tatatctacagatgcattccatttt

SEQ ID NO: 585463 - DNA, 25 bp, Homo sapien
gcattccattttaactcttcttgag

SEQ ID NO: 585464 - DNA, 25 bp, Homo sapien
aactcttcttgagctaaaacgtcaa

SEQ ID NO: 585465 - DNA, 25 bp, Homo sapien
gtatctctaacattccaaattactg

SEQ ID NO: 585466 - DNA, 25 bp, Homo sapien
gctatgtgttaatatttcacttgct

SEQ ID NO: 585467 - DNA, 25 bp, Homo sapien
ttcacttgcttgtattagaaaggca

SEQ ID NO: 585468 - DNA, 25 bp, Homo sapien
gtaagactttggtatgtgtgacata

SEQ ID NO: 585469 - DNA, 25 bp, Homo sapien
gattttgatccgatttcaaatccag

SEQ ID NO: 585470 - DNA, 25 bp, Homo sapien
gatccgatttcaaatccagaggaat

SEQ ID NO: 585471 - DNA, 25 bp, Homo sapien
gaatgtgatagtgatccccggatct

SEQ ID NO: 585472 - DNA, 25 bp, Homo sapien
gatctatcaccccaagtcacattaa

SEQ ID NO: 585473 - DNA, 25 bp, Homo sapien
gtcacattaaagagaatatccaggt

SEQ ID NO: 585474 - DNA, 25 bp, Homo sapien
gaatatccaggtgtttgattttgaa

SEQ ID NO: 585475 - DNA, 25 bp, Homo sapien
gattttgaattaacacagcacgata

SEQ ID NO: 585476 - DNA, 25 bp, Homo sapien
taacacagcacgatatggataacat

SEQ ID NO: 585477 - DNA, 25 bp, Homo sapien
tggataacatcctcagcctaaacag

SEQ ID NO: 585478 - DNA, 25 bp, Homo sapien
taaacaggaatctccgactggccat

SEQ ID NO: 585479 - DNA, 25 bp, Homo sapien
aggaatctccgactggccatgttcc

SEQ ID NO: 585480 - DNA, 25 bp, Homo sapien
ttggtcgggcgcggtggcgcacgct

SEQ ID NO: 585481 - DNA, 25 bp, Homo sapien
tggtcgggcgcggtggcgcacgctt

SEQ ID NO: 585482 - DNA, 25 bp, Homo sapien
gaccagctggccaatacggtgaaac

SEQ ID NO: 585483 - DNA, 25 bp, Homo sapien
accagctggccaatacggtgaaacc

SEQ ID NO: 585484 - DNA, 25 bp, Homo sapien
tagccaggtgtagaggtgtgcatct

SEQ ID NO: 585485 - DNA, 25 bp, Homo sapien
caggtgtagaggtgtgcatctgtaa

SEQ ID NO: 585486 - DNA, 25 bp, Homo sapien
aggtgtagaggtgtgcatctgtaat

SEQ ID NO: 585487 - DNA, 25 bp, Homo sapien
ggtgtagaggtgtgcatctgtaatc

SEQ ID NO: 585488 - DNA, 25 bp, Homo sapien
gtgtagaggtgtgcatctgtaatcc

SEQ ID NO: 585489 - DNA, 25 bp, Homo sapien
tgtagaggtgtgcatctgtaatccc

SEQ ID NO: 585490 - DNA, 25 bp, Homo sapien
gtagaggtgtgcatctgtaatccca

SEQ ID NO: 585491 - DNA, 25 bp, Homo sapien
agaccacctgacagtttcctgtgaa

SEQ ID NO: 585492 - DNA, 25 bp, Homo sapien
ctgtgaacaagccaaagtacccttc

SEQ ID NO: 585493 - DNA, 25 bp, Homo sapien
gtacccttcagaggactggttctag

SEQ ID NO: 585494 - DNA, 25 bp, Homo sapien
atggaggtagattcccaggactgac

SEQ ID NO: 585495 - DNA, 25 bp, Homo sapien
ggactgacaaacacatgccttttct

SEQ ID NO: 585496 - DNA, 25 bp, Homo sapien
aaacacatgccttttctaacagagc

SEQ ID NO: 585497 - DNA, 25 bp, Homo sapien
tgaacggcagctgttagtttcagga

SEQ ID NO: 585498 - DNA, 25 bp, Homo sapien
ggagtcatttagctccaaacagcag

SEQ ID NO: 585499 - DNA, 25 bp, Homo sapien
gcacggacacaaacacgcaggcctg

SEQ ID NO: 585500 - DNA, 25 bp, Homo sapien
acgcaggcctgtttgaagtgtcttt

SEQ ID NO: 585501 - DNA, 25 bp, Homo sapien
aagtgtcttttcaaaccattactct

SEQ ID NO: 585502 - DNA, 25 bp, Homo sapien
tggcctcagaggctatactcttata

SEQ ID NO: 585503 - DNA, 25 bp, Homo sapien
gcctcagaggctatactcttataat

SEQ ID NO: 585504 - DNA, 25 bp, Homo sapien
gaggctatactcttataattttgtt

SEQ ID NO: 585505 - DNA, 25 bp, Homo sapien
gacagggaaagggttagacaacttg

SEQ ID NO: 585506 - DNA, 25 bp, Homo sapien
agacaacttgaaacattgaccctgt

SEQ ID NO: 585507 - DNA, 25 bp, Homo sapien
acaacttgaaacattgaccctgtat

SEQ ID NO: 585508 - DNA, 25 bp, Homo sapien
acttgaaacattgaccctgtataaa

SEQ ID NO: 585509 - DNA, 25 bp, Homo sapien
aacattgaccctgtataaaaatgca

SEQ ID NO: 585510 - DNA, 25 bp, Homo sapien
aaatgcaaaattctcaatgtgtatt

SEQ ID NO: 585511 - DNA, 25 bp, Homo sapien
cttagaggccaaaagtagtaaacat

SEQ ID NO: 585512 - DNA, 25 bp, Homo sapien
ggccaaaagtagtaaacatgcagat

SEQ ID NO: 585513 - DNA, 25 bp, Homo sapien
gcaaagacgtgcctgctacgctttc

SEQ ID NO: 585514 - DNA, 25 bp, Homo sapien
ttccaccatcattgaaagtttccta

SEQ ID NO: 585515 - DNA, 25 bp, Homo sapien
ggcctctccagaagccgaatagata

SEQ ID NO: 585516 - DNA, 25 bp, Homo sapien
gcctctccagaagccgaatagatac

SEQ ID NO: 585517 - DNA, 25 bp, Homo sapien
tctccagaagccgaatagataccag

SEQ ID NO: 585518 - DNA, 25 bp, Homo sapien
ccagaagccgaatagataccagcat

SEQ ID NO: 585519 - DNA, 25 bp, Homo sapien
gaagccgaatagataccagcatcat

SEQ ID NO: 585520 - DNA, 25 bp, Homo sapien
aagccgaatagataccagcatcatg

SEQ ID NO: 585521 - DNA, 25 bp, Homo sapien
gccgaatagataccagcatcatgct

SEQ ID NO: 585522 - DNA, 25 bp, Homo sapien
ccgaatagataccagcatcatgctt

SEQ ID NO: 585523 - DNA, 25 bp, Homo sapien
cgaatagataccagcatcatgcttc

SEQ ID NO: 585524 - DNA, 25 bp, Homo sapien
aaaactaaagttatcattgtgctga

SEQ ID NO: 585525 - DNA, 25 bp, Homo sapien
aaactaaagttatcattgtgctgaa

SEQ ID NO: 585526 - DNA, 25 bp, Homo sapien
aactaaagttatcattgtgctgaac

SEQ ID NO: 585527 - DNA, 25 bp, Homo sapien
actaaagttatcattgtgctgaact

SEQ ID NO: 585528 - DNA, 25 bp, Homo sapien
ctaaagttatcattgtgctgaactg

SEQ ID NO: 585529 - DNA, 25 bp, Homo sapien
tatcattgtgctgaactgttagaaa

SEQ ID NO: 585530 - DNA, 25 bp, Homo sapien
atcattgtgctgaactgttagaaat

SEQ ID NO: 585531 - DNA, 25 bp, Homo sapien
tcattgtgctgaactgttagaaatg

SEQ ID NO: 585532 - DNA, 25 bp, Homo sapien
attgtgctgaactgttagaaatgag

SEQ ID NO: 585533 - DNA, 25 bp, Homo sapien
gtgctgaactgttagaaatgaggtt

SEQ ID NO: 585534 - DNA, 25 bp, Homo sapien
gctgaactgttagaaatgaggttag

SEQ ID NO: 585535 - DNA, 25 bp, Homo sapien
tataaatcacacaccttttctctgc

SEQ ID NO: 585536 - DNA, 25 bp, Homo sapien
ggagatttccaactaacatcccaag

SEQ ID NO: 585537 - DNA, 25 bp, Homo sapien
aacatcccaagtgtatgtctcttcc

SEQ ID NO: 585538 - DNA, 25 bp, Homo sapien
accacacaggttgttatttacacag

SEQ ID NO: 585539 - DNA, 25 bp, Homo sapien
gttatttacacagatggcttcccac

SEQ ID NO: 585540 - DNA, 25 bp, Homo sapien
atggcttcccacagtcagacttatt

SEQ ID NO: 585541 - DNA, 25 bp, Homo sapien
tatttttacctgtacaccatcttcc

SEQ ID NO: 585542 - DNA, 25 bp, Homo sapien
ttttcttcccttacaatcatccagg

SEQ ID NO: 585543 - DNA, 25 bp, Homo sapien
tccttgctccaatgatgtaattaca

SEQ ID NO: 585544 - DNA, 25 bp, Homo sapien
gaaaagtcatgtcctgcttacaaag

SEQ ID NO: 585545 - DNA, 25 bp, Homo sapien
ggccacttgatatagaaacatactt

SEQ ID NO: 585546 - DNA, 25 bp, Homo sapien
gctgaactaaaatatctctgtgaca

SEQ ID NO: 585547 - DNA, 25 bp, Homo sapien
ctgtgacattttgctggtgactcca

SEQ ID NO: 585548 - DNA, 25 bp, Homo sapien
ccctgtgagatctgagtggctcagg

SEQ ID NO: 585549 - DNA, 25 bp, Homo sapien
gagtggctcaggaatcaaattctcc

SEQ ID NO: 585550 - DNA, 25 bp, Homo sapien
atcaaattctcccacaaacctgagg

SEQ ID NO: 585551 - DNA, 25 bp, Homo sapien
ggaagccttttattcttaatgccaa

SEQ ID NO: 585552 - DNA, 25 bp, Homo sapien
ttaatgccaacaggatgccccatgc

SEQ ID NO: 585553 - DNA, 25 bp, Homo sapien
atgccccatgcccagaatgtcaaat

SEQ ID NO: 585554 - DNA, 25 bp, Homo sapien
gtcaaatctgaacaccaatggaatg

SEQ ID NO: 585555 - DNA, 25 bp, Homo sapien
gaattgttgttctctaggcagatta

SEQ ID NO: 585556 - DNA, 25 bp, Homo sapien
ggcagattagttgtgcttcaaatac

SEQ ID NO: 585557 - DNA, 25 bp, Homo sapien
gattctagtcaaggtatcccttatc

SEQ ID NO: 585558 - DNA, 25 bp, Homo sapien
tcaaggtatcccttatcgggtaaag

SEQ ID NO: 585559 - DNA, 25 bp, Homo sapien
tttactcctattcctggtttgaaat

SEQ ID NO: 585560 - DNA, 25 bp, Homo sapien
gtttgaaattttcagcgtgaatgga

SEQ ID NO: 585561 - DNA, 25 bp, Homo sapien
cagcgtgaatggatgttgaagttta

SEQ ID NO: 585562 - DNA, 25 bp, Homo sapien
tttcttcattattgggatgagcatc

SEQ ID NO: 585563 - DNA, 25 bp, Homo sapien
gggatgagcatctaatttattttaa

SEQ ID NO: 585564 - DNA, 25 bp, Homo sapien
tatttctagtattaaaccacccttg

SEQ ID NO: 585565 - DNA, 25 bp, Homo sapien
ttaaaccacccttgtatgcttgcgt

SEQ ID NO: 585566 - DNA, 25 bp, Homo sapien
cacccttgtatgcttgcgtttaata

SEQ ID NO: 585567 - DNA, 25 bp, Homo sapien
atgcttgcgtttaatacagtttatg

SEQ ID NO: 585568 - DNA, 25 bp, Homo sapien
ttcttcaccgattacttcttttact

SEQ ID NO: 585569 - DNA, 25 bp, Homo sapien
ttcttttacttctatcgacgctgtg

SEQ ID NO: 585570 - DNA, 25 bp, Homo sapien
ttacttctatcgacgctgtgcctaa

SEQ ID NO: 585571 - DNA, 25 bp, Homo sapien
gacgctgtgcctaatttgttcaagt

SEQ ID NO: 585572 - DNA, 25 bp, Homo sapien
aacagaaacgaacatcctcttgcaa

SEQ ID NO: 585573 - DNA, 25 bp, Homo sapien
acgaacatcctcttgcaacttcttt

SEQ ID NO: 585574 - DNA, 25 bp, Homo sapien
aacatttacgtttattgctgaagga

SEQ ID NO: 585575 - DNA, 25 bp, Homo sapien
gaaggactttttcaggctttagctt

SEQ ID NO: 585576 - DNA, 25 bp, Homo sapien
tcaggctttagcttccaacagtttt

SEQ ID NO: 585577 - DNA, 25 bp, Homo sapien
gcttccaacagttttgagacattaa

SEQ ID NO: 585578 - DNA, 25 bp, Homo sapien
gtagccccattttctgacagcatgt

SEQ ID NO: 585579 - DNA, 25 bp, Homo sapien
actatcacctcttcattcttgtgtt

SEQ ID NO: 585580 - DNA, 25 bp, Homo sapien
acctcttcattcttgtgttcctcgt

SEQ ID NO: 585581 - DNA, 25 bp, Homo sapien
tcttcattcttgtgttcctcgttcc

SEQ ID NO: 585582 - DNA, 25 bp, Homo sapien
attcttgtgttcctcgttccccact

SEQ ID NO: 585583 - DNA, 25 bp, Homo sapien
ttccactaacaatctccctggactc

SEQ ID NO: 585584 - DNA, 25 bp, Homo sapien
gactcctcctccatactgtatgtgc

SEQ ID NO: 585585 - DNA, 25 bp, Homo sapien
tccatactgtatgtgcatgcattca

SEQ ID NO: 585586 - DNA, 25 bp, Homo sapien
actgtatgtgcatgcattcacacac

SEQ ID NO: 585587 - DNA, 25 bp, Homo sapien
acacatatgtacatgcacatagatg

SEQ ID NO: 585588 - DNA, 25 bp, Homo sapien
cacatagatgagatgaatctgcatt

SEQ ID NO: 585589 - DNA, 25 bp, Homo sapien
aaattaaatcacatttagtgctgta

SEQ ID NO: 585590 - DNA, 25 bp, Homo sapien
attgagatcaatgagcgcccaaaaa

SEQ ID NO: 585591 - DNA, 25 bp, Homo sapien
tgagatcaatgagcgcccaaaaagg

SEQ ID NO: 585592 - DNA, 25 bp, Homo sapien
tcaatgagcgcccaaaaaggaaact

SEQ ID NO: 585593 - DNA, 25 bp, Homo sapien
caatgagcgcccaaaaaggaaactg

SEQ ID NO: 585594 - DNA, 25 bp, Homo sapien
gaaactgatggagcaatatttctgc

SEQ ID NO: 585595 - DNA, 25 bp, Homo sapien
gatggagcaatatttctgctctacc

SEQ ID NO: 585596 - DNA, 25 bp, Homo sapien
tggagcaatatttctgctctaccaa

SEQ ID NO: 585597 - DNA, 25 bp, Homo sapien
ggagcaatatttctgctctaccaaa

SEQ ID NO: 585598 - DNA, 25 bp, Homo sapien
agcaatatttctgctctaccaaaga

SEQ ID NO: 585599 - DNA, 25 bp, Homo sapien
gcaatatttctgctctaccaaagag

SEQ ID NO: 585600 - DNA, 25 bp, Homo sapien
aatatttctgctctaccaaagaggg

SEQ ID NO: 585601 - DNA, 25 bp, Homo sapien
gatgactattagatgccatgccata

SEQ ID NO: 585602 - DNA, 25 bp, Homo sapien
attagatgccatgccataaccaact

SEQ ID NO: 585603 - DNA, 25 bp, Homo sapien
cataaccaactcttctccagtagat

SEQ ID NO: 585604 - DNA, 25 bp, Homo sapien
ggaggaccaggcctgatactgaata

SEQ ID NO: 585605 - DNA, 25 bp, Homo sapien
gatactgaatattggaactgttggc

SEQ ID NO: 585606 - DNA, 25 bp, Homo sapien
gaaagttcgtgactgcttgagttat

SEQ ID NO: 585607 - DNA, 25 bp, Homo sapien
agttgcatggctgttatgtctcaaa

SEQ ID NO: 585608 - DNA, 25 bp, Homo sapien
ggctgttatgtctcaaatactatat

SEQ ID NO: 585609 - DNA, 25 bp, Homo sapien
tataattatccctagttactggtat

SEQ ID NO: 585610 - DNA, 25 bp, Homo sapien
gttactggtatctttagcatatttg

SEQ ID NO: 585611 - DNA, 25 bp, Homo sapien
gaaaccatccatatgtgacctaaag

SEQ ID NO: 585612 - DNA, 25 bp, Homo sapien
attatataatcaccatgcatcaaag

SEQ ID NO: 585613 - DNA, 25 bp, Homo sapien
atcaccatgcatcaaaggtagggcc

SEQ ID NO: 585614 - DNA, 25 bp, Homo sapien
cccataccccactcatggtagtaaa

SEQ ID NO: 585615 - DNA, 25 bp, Homo sapien
accccactcatggtagtaaatacat

SEQ ID NO: 585616 - DNA, 25 bp, Homo sapien
tataaatgaaagttcccctggacaa

SEQ ID NO: 585617 - DNA, 25 bp, Homo sapien
gaaagttcccctggacaagttctct

SEQ ID NO: 585618 - DNA, 25 bp, Homo sapien
agttcccctggacaagttctcttgc

SEQ ID NO: 585619 - DNA, 25 bp, Homo sapien
atgtaagatgtacctttgctactca

SEQ ID NO: 585620 - DNA, 25 bp, Homo sapien
agatgtacctttgctactcattcac

SEQ ID NO: 585621 - DNA, 25 bp, Homo sapien
atgtacctttgctactcattcacct

SEQ ID NO: 585622 - DNA, 25 bp, Homo sapien
ttgctactcattcaccttctgtcat

SEQ ID NO: 585623 - DNA, 25 bp, Homo sapien
agattcatgcagaagcccggcttcc

SEQ ID NO: 585624 - DNA, 25 bp, Homo sapien
aagcccggcttcctgcgtcatctgt

SEQ ID NO: 585625 - DNA, 25 bp, Homo sapien
gcttcctgcgtcatctgtgtggcca

SEQ ID NO: 585626 - DNA, 25 bp, Homo sapien
atctgtgtggccactcgcaggagaa

SEQ ID NO: 585627 - DNA, 25 bp, Homo sapien
tgtggccactcgcaggagaagcact

SEQ ID NO: 585628 - DNA, 25 bp, Homo sapien
ggccactcgcaggagaagcactatc

SEQ ID NO: 585629 - DNA, 25 bp, Homo sapien
aggagaagcactatccttgcagccc

SEQ ID NO: 585630 - DNA, 25 bp, Homo sapien
agaagcactatccttgcagcccttg

SEQ ID NO: 585631 - DNA, 25 bp, Homo sapien
actatccttgcagcccttgtggttc

SEQ ID NO: 585632 - DNA, 25 bp, Homo sapien
ttgcagcccttgtggttcccatgat

SEQ ID NO: 585633 - DNA, 25 bp, Homo sapien
cagcccttgtggttcccatgatcag

SEQ ID NO: 585634 - DNA, 25 bp, Homo sapien
atggtgcgcatggtacgggcggcca

SEQ ID NO: 585635 - DNA, 25 bp, Homo sapien
gtacgggcggccacgctcatccagg

SEQ ID NO: 585636 - DNA, 25 bp, Homo sapien
tcatccaggccctatggaagggcta

SEQ ID NO: 585637 - DNA, 25 bp, Homo sapien
tatggaagggctatctggtgcgctc

SEQ ID NO: 585638 - DNA, 25 bp, Homo sapien
gaagggctatctggtgcgctccctg

SEQ ID NO: 585639 - DNA, 25 bp, Homo sapien
tgacccttatcttcccagagaccag

SEQ ID NO: 585640 - DNA, 25 bp, Homo sapien
ttatcttcccagagaccaggccagg

SEQ ID NO: 585641 - DNA, 25 bp, Homo sapien
agaccaggccaggaaggcccgagat

SEQ ID NO: 585642 - DNA, 25 bp, Homo sapien
ccgagatggagagcactaaattcac

SEQ ID NO: 585643 - DNA, 25 bp, Homo sapien
ctaaattcacggctttcatgttttt

SEQ ID NO: 585644 - DNA, 25 bp, Homo sapien
aattcacggctttcatgtttttatt

SEQ ID NO: 585645 - DNA, 25 bp, Homo sapien
aatccagaagtcagaagtggaccat

SEQ ID NO: 585646 - DNA, 25 bp, Homo sapien
gaagtggaccatgttgatcaggatc

SEQ ID NO: 585647 - DNA, 25 bp, Homo sapien
gaccatgttgatcaggatcctacac

SEQ ID NO: 585648 - DNA, 25 bp, Homo sapien
tacaccttccagttcactggtgaat

SEQ ID NO: 585649 - DNA, 25 bp, Homo sapien
tggtgaataacttcatattcctgaa

SEQ ID NO: 585650 - DNA, 25 bp, Homo sapien
tcctgaagttaagaagcctgccctg

SEQ ID NO: 585651 - DNA, 25 bp, Homo sapien
tgaagttaagaagcctgccctgatg

SEQ ID NO: 585652 - DNA, 25 bp, Homo sapien
tgccctgatgctcatgcagttactt

SEQ ID NO: 585653 - DNA, 25 bp, Homo sapien
gcagttactttgagcaatgaccaaa

SEQ ID NO: 585654 - DNA, 25 bp, Homo sapien
ttgagcaatgaccaaacagagagag

SEQ ID NO: 585655 - DNA, 25 bp, Homo sapien
gaaggtaagtagtattgttttcatt

SEQ ID NO: 585656 - DNA, 25 bp, Homo sapien
tcaggcggccgctaagctcagagtg

SEQ ID NO: 585657 - DNA, 25 bp, Homo sapien
cggccgctaagctcagagtggaaag

SEQ ID NO: 585658 - DNA, 25 bp, Homo sapien
aaaggagaggtctatagctcctcca

SEQ ID NO: 585659 - DNA, 25 bp, Homo sapien
ggagaggtctatagctcctccagat

SEQ ID NO: 585660 - DNA, 25 bp, Homo sapien
aggtctatagctcctccagattcta

SEQ ID NO: 585661 - DNA, 25 bp, Homo sapien
tctatagctcctccagattctaggt

SEQ ID NO: 585662 - DNA, 25 bp, Homo sapien
atagctcctccagattctaggtatt

SEQ ID NO: 585663 - DNA, 25 bp, Homo sapien
gctcctccagattctaggtattaat

SEQ ID NO: 585664 - DNA, 25 bp, Homo sapien
ctccagattctaggtattaatttac

SEQ ID NO: 585665 - DNA, 25 bp, Homo sapien
atttactaagatattcctaagccag

SEQ ID NO: 585666 - DNA, 25 bp, Homo sapien
agatattcctaagccagaaaacaga

SEQ ID NO: 585667 - DNA, 25 bp, Homo sapien
agtgcgaggtgctgacaagaaatag

SEQ ID NO: 585668 - DNA, 25 bp, Homo sapien
tgcgaggtgctgacaagaaatagga

SEQ ID NO: 585669 - DNA, 25 bp, Homo sapien
tgctgacaagaaataggagaggcga

SEQ ID NO: 585670 - DNA, 25 bp, Homo sapien
gagaggcgagaagtacggcttcatc

SEQ ID NO: 585671 - DNA, 25 bp, Homo sapien
gaggcgagaagtacggcttcatcac

SEQ ID NO: 585672 - DNA, 25 bp, Homo sapien
aggcgagaagtacggcttcatcacc

SEQ ID NO: 585673 - DNA, 25 bp, Homo sapien
accggtgttctgagcacgcggccct

SEQ ID NO: 585674 - DNA, 25 bp, Homo sapien
ggtgttctgagcacgcggccctctc

SEQ ID NO: 585675 - DNA, 25 bp, Homo sapien
agcacgcggccctctctttgacaaa

SEQ ID NO: 585676 - DNA, 25 bp, Homo sapien
ccttccagctgagctacggagggct

SEQ ID NO: 585677 - DNA, 25 bp, Homo sapien
ttccagctgagctacggagggctcc

SEQ ID NO: 585678 - DNA, 25 bp, Homo sapien
gacacatgcagtgtattcaaactgt

SEQ ID NO: 585679 - DNA, 25 bp, Homo sapien
catgcagtgtattcaaactgtggaa

SEQ ID NO: 585680 - DNA, 25 bp, Homo sapien
gtattcaaactgtggaaatcagaga

SEQ ID NO: 585681 - DNA, 25 bp, Homo sapien
aaaaccatgaagatggccggaggaa

SEQ ID NO: 585682 - DNA, 25 bp, Homo sapien
gaggaaaaagatacgttaaatacag

SEQ ID NO: 585683 - DNA, 25 bp, Homo sapien
ttttgtattgcccagtgtggtgaca

SEQ ID NO: 585684 - DNA, 25 bp, Homo sapien
ttgtattgcccagtgtggtgacacg

SEQ ID NO: 585685 - DNA, 25 bp, Homo sapien
tattgcccagtgtggtgacacgagc

SEQ ID NO: 585686 - DNA, 25 bp, Homo sapien
gtcctgtgggcggagaattacccag

SEQ ID NO: 585687 - DNA, 25 bp, Homo sapien
cctgtgggcggagaattacccaggt

SEQ ID NO: 585688 - DNA, 25 bp, Homo sapien
ggcggagaattacccaggtgccgag

SEQ ID NO: 585689 - DNA, 25 bp, Homo sapien
cctgcctgaattcttaattagtctt

SEQ ID NO: 585690 - DNA, 25 bp, Homo sapien
gaattcttaattagtcttcaaggaa

SEQ ID NO: 585691 - DNA, 25 bp, Homo sapien
agagttcagcagtccacagcacact

SEQ ID NO: 585692 - DNA, 25 bp, Homo sapien
agcacactcaccatgtctccaaagg

SEQ ID NO: 585693 - DNA, 25 bp, Homo sapien
tcaccatgtctccaaaggcgttcat

SEQ ID NO: 585694 - DNA, 25 bp, Homo sapien
tctccaaaggcgttcatggctgttg

SEQ ID NO: 585695 - DNA, 25 bp, Homo sapien
caaaggcgttcatggctgttgtgaa

SEQ ID NO: 585696 - DNA, 25 bp, Homo sapien
tggctgttgtgaagctgtgtttccc

SEQ ID NO: 585697 - DNA, 25 bp, Homo sapien
catccttcttcattctaaagacaaa

SEQ ID NO: 585698 - DNA, 25 bp, Homo sapien
gacaaacatgtaactgatgctcttt

SEQ ID NO: 585699 - DNA, 25 bp, Homo sapien
catgtaactgatgctctttatttct

SEQ ID NO: 585700 - DNA, 25 bp, Homo sapien
attacttttatgatagtcctttgac

SEQ ID NO: 585701 - DNA, 25 bp, Homo sapien
tatgatagtcctttgacgttttgac

SEQ ID NO: 585702 - DNA, 25 bp, Homo sapien
gatagtcctttgacgttttgactaa

SEQ ID NO: 585703 - DNA, 25 bp, Homo sapien
tgacgttttgactaataaatcctat

SEQ ID NO: 585704 - DNA, 25 bp, Homo sapien
gataataacttcatccattttgacc

SEQ ID NO: 585705 - DNA, 25 bp, Homo sapien
acttcatccattttgacccaaacgg

SEQ ID NO: 585706 - DNA, 25 bp, Homo sapien
attttgacccaaacggactgccacg

SEQ ID NO: 585707 - DNA, 25 bp, Homo sapien
ttgacccaaacggactgccacgtta

SEQ ID NO: 585708 - DNA, 25 bp, Homo sapien
aacggactgccacgttactggaaca

SEQ ID NO: 585709 - DNA, 25 bp, Homo sapien
cgttactggaacactgtgaaaacat

SEQ ID NO: 585710 - DNA, 25 bp, Homo sapien
tgaaaacataccagtaccacactat

SEQ ID NO: 585711 - DNA, 25 bp, Homo sapien
tagaagtgatggtgtgcttattccc

SEQ ID NO: 585712 - DNA, 25 bp, Homo sapien
agtgatggtgtgcttattcccagcc

SEQ ID NO: 585713 - DNA, 25 bp, Homo sapien
gatggtgtgcttattcccagcctgg

SEQ ID NO: 585714 - DNA, 25 bp, Homo sapien
ggtgtgcttattcccagcctgggcc

SEQ ID NO: 585715 - DNA, 25 bp, Homo sapien
ctgggccttaaaaggctttgcctat

SEQ ID NO: 585716 - DNA, 25 bp, Homo sapien
aaaggctttgcctatttccacttgc

SEQ ID NO: 585717 - DNA, 25 bp, Homo sapien
tttgcctatttccacttgccttctt

SEQ ID NO: 585718 - DNA, 25 bp, Homo sapien
gcctatttccacttgccttcttgta

SEQ ID NO: 585719 - DNA, 25 bp, Homo sapien
tcttgtacttctgctattgtcataa

SEQ ID NO: 585720 - DNA, 25 bp, Homo sapien
gtacttctgctattgtcataagaaa

SEQ ID NO: 585721 - DNA, 25 bp, Homo sapien
ggtcacccaccggtctgaagaggag

SEQ ID NO: 585722 - DNA, 25 bp, Homo sapien
gaatggaatattgtacagtcatgaa

SEQ ID NO: 585723 - DNA, 25 bp, Homo sapien
gtgtgtgtgatactgaaccatctct

SEQ ID NO: 585724 - DNA, 25 bp, Homo sapien
gtgatactgaaccatctctaaggta

SEQ ID NO: 585725 - DNA, 25 bp, Homo sapien
gaaccatctctaaggtataatgttg

SEQ ID NO: 585726 - DNA, 25 bp, Homo sapien
aacagcaaggtgtagagtagggcaa

SEQ ID NO: 585727 - DNA, 25 bp, Homo sapien
gtagggcaagtagtatgctgctatt

SEQ ID NO: 585728 - DNA, 25 bp, Homo sapien
gtagtatgctgctatttgtttaaaa

SEQ ID NO: 585729 - DNA, 25 bp, Homo sapien
gcaaaaactgtctctgcaaaggttt

SEQ ID NO: 585730 - DNA, 25 bp, Homo sapien
aactgtctctgcaaaggtttataag

SEQ ID NO: 585731 - DNA, 25 bp, Homo sapien
aagaattgccaatataggatgagag

SEQ ID NO: 585732 - DNA, 25 bp, Homo sapien
gcttttttcatgtgtgtataatgta

SEQ ID NO: 585733 - DNA, 25 bp, Homo sapien
ggatcaaatgaatccagaatttaat

SEQ ID NO: 585734 - DNA, 25 bp, Homo sapien
aatttaattttttcacatctgttga

SEQ ID NO: 585735 - DNA, 25 bp, Homo sapien
catctgttgatcattgtccagccac

SEQ ID NO: 585736 - DNA, 25 bp, Homo sapien
gtccagccacacaagataacctcaa

SEQ ID NO: 585737 - DNA, 25 bp, Homo sapien
gataacctcaacaaagatagcatgc

SEQ ID NO: 585738 - DNA, 25 bp, Homo sapien
aaagatagcatgctactggctagca

SEQ ID NO: 585739 - DNA, 25 bp, Homo sapien
gctactggctagcattttaactccc

SEQ ID NO: 585740 - DNA, 25 bp, Homo sapien
tggctagcattttaactcccagcgt

SEQ ID NO: 585741 - DNA, 25 bp, Homo sapien
tagcattttaactcccagcgttgaa

SEQ ID NO: 585742 - DNA, 25 bp, Homo sapien
ttttaactcccagcgttgaagcaga

SEQ ID NO: 585743 - DNA, 25 bp, Homo sapien
aactcccagcgttgaagcagataag

SEQ ID NO: 585744 - DNA, 25 bp, Homo sapien
gggcgtctttgggatctggcctaca

SEQ ID NO: 585745 - DNA, 25 bp, Homo sapien
gcgtctttgggatctggcctacaat

SEQ ID NO: 585746 - DNA, 25 bp, Homo sapien
tctttgggatctggcctacaatggg

SEQ ID NO: 585747 - DNA, 25 bp, Homo sapien
gcatagcaggaatattagtggtagg

SEQ ID NO: 585748 - DNA, 25 bp, Homo sapien
ttagtggtaggttgttgctgtctgt

SEQ ID NO: 585749 - DNA, 25 bp, Homo sapien
ggtgctgccacatgtgcatgggtcc

SEQ ID NO: 585750 - DNA, 25 bp, Homo sapien
acatgtgcatgggtccccaccaaga

SEQ ID NO: 585751 - DNA, 25 bp, Homo sapien
cccaccaagaggattccctggccta

SEQ ID NO: 585752 - DNA, 25 bp, Homo sapien
gggcacaagtgcacagtcccatatc

SEQ ID NO: 585753 - DNA, 25 bp, Homo sapien
acaagtgcacagtcccatatcttat

SEQ ID NO: 585754 - DNA, 25 bp, Homo sapien
gtgcacagtcccatatcttatataa

SEQ ID NO: 585755 - DNA, 25 bp, Homo sapien
tggagttttgcagtattgcccagtc

SEQ ID NO: 585756 - DNA, 25 bp, Homo sapien
gagttttgcagtattgcccagtctg

SEQ ID NO: 585757 - DNA, 25 bp, Homo sapien
cgaactctgggctcgagcggtccac

SEQ ID NO: 585758 - DNA, 25 bp, Homo sapien
agccccacattgtgctttttccatg

SEQ ID NO: 585759 - DNA, 25 bp, Homo sapien
ccacattgtgctttttccatgacgt

SEQ ID NO: 585760 - DNA, 25 bp, Homo sapien
cattgtgctttttccatgacgttag

SEQ ID NO: 585761 - DNA, 25 bp, Homo sapien
gctttttccatgacgttagcactga

SEQ ID NO: 585762 - DNA, 25 bp, Homo sapien
tccatgacgttagcactgaataaat

SEQ ID NO: 585763 - DNA, 25 bp, Homo sapien
tgttttagaaacattaacctagcaa

SEQ ID NO: 585764 - DNA, 25 bp, Homo sapien
gaaacattaacctagcaaaagtata

SEQ ID NO: 585765 - DNA, 25 bp, Homo sapien
gatagtcttggtgttgggtagtaaa

SEQ ID NO: 585766 - DNA, 25 bp, Homo sapien
tcctctgtgggatgactaaacactt

SEQ ID NO: 585767 - DNA, 25 bp, Homo sapien
ggagatgaccactaccactgcaggg

SEQ ID NO: 585768 - DNA, 25 bp, Homo sapien
gctctcctcttgctttagtttgcta

SEQ ID NO: 585769 - DNA, 25 bp, Homo sapien
tagtttgctaactgactcttgctgg

SEQ ID NO: 585770 - DNA, 25 bp, Homo sapien
actgactcttgctggctagaatttt

SEQ ID NO: 585771 - DNA, 25 bp, Homo sapien
gtcactgctggcaagctcatgcttt

SEQ ID NO: 585772 - DNA, 25 bp, Homo sapien
gctcatgctttgtgctgtgctgctt

SEQ ID NO: 585773 - DNA, 25 bp, Homo sapien
gctgtgctgctttgtactgcgttca

SEQ ID NO: 585774 - DNA, 25 bp, Homo sapien
ttgtactgcgttcactgagccttac

SEQ ID NO: 585775 - DNA, 25 bp, Homo sapien
gagccttaccaagcttctgttatag

SEQ ID NO: 585776 - DNA, 25 bp, Homo sapien
gatgtgctcagctaagttggaattt

SEQ ID NO: 585777 - DNA, 25 bp, Homo sapien
tagaagtgatggtgtgcttattccc

SEQ ID NO: 585778 - DNA, 25 bp, Homo sapien
agtgatggtgtgcttattcccagcc

SEQ ID NO: 585779 - DNA, 25 bp, Homo sapien
tgatggtgtgcttattcccagcctg

SEQ ID NO: 585780 - DNA, 25 bp, Homo sapien
atggtgtgcttattcccagcctggg

SEQ ID NO: 585781 - DNA, 25 bp, Homo sapien
ggtgtgcttattcccagcctgggcc

SEQ ID NO: 585782 - DNA, 25 bp, Homo sapien
ctgggccttaaaaggctttgcctat

SEQ ID NO: 585783 - DNA, 25 bp, Homo sapien
tttgcctatttccacttgccttctt

SEQ ID NO: 585784 - DNA, 25 bp, Homo sapien
gcctatttccacttgccttcttgta

SEQ ID NO: 585785 - DNA, 25 bp, Homo sapien
tcttgtacttctgctattgtcataa

SEQ ID NO: 585786 - DNA, 25 bp, Homo sapien
ttgtacttctgctattgtcataaga

SEQ ID NO: 585787 - DNA, 25 bp, Homo sapien
gtacttctgctattgtcataagaaa

SEQ ID NO: 585788 - DNA, 25 bp, Homo sapien
aatatgagcccctgcctgacacatg

SEQ ID NO: 585789 - DNA, 25 bp, Homo sapien
gacacatgcagtgtattcaaactgt

SEQ ID NO: 585790 - DNA, 25 bp, Homo sapien
gtattcaaactgtggaaatcagaga

SEQ ID NO: 585791 - DNA, 25 bp, Homo sapien
aaaaccatgaagatggccggaggaa

SEQ ID NO: 585792 - DNA, 25 bp, Homo sapien
gatggccggaggaaaaagatacgtt

SEQ ID NO: 585793 - DNA, 25 bp, Homo sapien
acaaaggtaagaattccagcctggg

SEQ ID NO: 585794 - DNA, 25 bp, Homo sapien
tttgtattgcccagtgtggtgacac

SEQ ID NO: 585795 - DNA, 25 bp, Homo sapien
tattgcccagtgtggtgacacgagc

SEQ ID NO: 585796 - DNA, 25 bp, Homo sapien
cctgtagtcctgtgggcggagaatt

SEQ ID NO: 585797 - DNA, 25 bp, Homo sapien
gtcctgtgggcggagaattacccag

SEQ ID NO: 585798 - DNA, 25 bp, Homo sapien
ggcggagaattacccaggtgccgag

SEQ ID NO: 585799 - DNA, 25 bp, Homo sapien
tagctgctgcagatacagtttgcct

SEQ ID NO: 585800 - DNA, 25 bp, Homo sapien
acagtttgcctttagagatatggac

SEQ ID NO: 585801 - DNA, 25 bp, Homo sapien
tttagagatatggacaggagccctg

SEQ ID NO: 585802 - DNA, 25 bp, Homo sapien
gccctggataacaagacacgtagtg

SEQ ID NO: 585803 - DNA, 25 bp, Homo sapien
gacacgtagtgagggaaaacatctt

SEQ ID NO: 585804 - DNA, 25 bp, Homo sapien
agggaaaacatcttgattggtatca

SEQ ID NO: 585805 - DNA, 25 bp, Homo sapien
gagtcctgactaaactatttactaa

SEQ ID NO: 585806 - DNA, 25 bp, Homo sapien
atattagcaaattttctgagcttca

SEQ ID NO: 585807 - DNA, 25 bp, Homo sapien
gagcttcagattcctcattctaaag

SEQ ID NO: 585808 - DNA, 25 bp, Homo sapien
ccagccctattcacgatgtaacaag

SEQ ID NO: 585809 - DNA, 25 bp, Homo sapien
aattggaatgaagactatacgtgct

SEQ ID NO: 585810 - DNA, 25 bp, Homo sapien
ggagcctgtatatgagagccttgaa

SEQ ID NO: 585811 - DNA, 25 bp, Homo sapien
gagccttgaagagtttcacgtcttt

SEQ ID NO: 585812 - DNA, 25 bp, Homo sapien
tcacgtctttgtccttgctcatgtg

SEQ ID NO: 585813 - DNA, 25 bp, Homo sapien
tgctcatgtgcttaggaggcccata

SEQ ID NO: 585814 - DNA, 25 bp, Homo sapien
aggcccatagtcgtcgtggcagaca

SEQ ID NO: 585815 - DNA, 25 bp, Homo sapien
gtggcagacaccatgctgagggact

SEQ ID NO: 585816 - DNA, 25 bp, Homo sapien
agcatttgcccctattccctttgga

SEQ ID NO: 585817 - DNA, 25 bp, Homo sapien
tccctttggaggaatctatctgcct

SEQ ID NO: 585818 - DNA, 25 bp, Homo sapien
aagcttgcctcaagtgaaccccgaa

SEQ ID NO: 585819 - DNA, 25 bp, Homo sapien
gaaccccgaatgcatctaggtacca

SEQ ID NO: 585820 - DNA, 25 bp, Homo sapien
taggtaccaatggagccaactgtgg

SEQ ID NO: 585821 - DNA, 25 bp, Homo sapien
tcctaggcccaaggtgtccccctgc

SEQ ID NO: 585822 - DNA, 25 bp, Homo sapien
ggactcaagagactccctgccgtgg

SEQ ID NO: 585823 - DNA, 25 bp, Homo sapien
gactcaagagactccctgccgtggc

SEQ ID NO: 585824 - DNA, 25 bp, Homo sapien
aggcatgatcatggccctgcttatg

SEQ ID NO: 585825 - DNA, 25 bp, Homo sapien
ggcatgatcatggccctgcttatgc

SEQ ID NO: 585826 - DNA, 25 bp, Homo sapien
gcatgatcatggccctgcttatgca

SEQ ID NO: 585827 - DNA, 25 bp, Homo sapien
atgatcatggccctgcttatgcagg

SEQ ID NO: 585828 - DNA, 25 bp, Homo sapien
tgatcatggccctgcttatgcaggt

SEQ ID NO: 585829 - DNA, 25 bp, Homo sapien
gatcatggccctgcttatgcaggtg

SEQ ID NO: 585830 - DNA, 25 bp, Homo sapien
atcatggccctgcttatgcaggtgc

SEQ ID NO: 585831 - DNA, 25 bp, Homo sapien
tcatggccctgcttatgcaggtgca

SEQ ID NO: 585832 - DNA, 25 bp, Homo sapien
tagatctttagtgtcacattgactt

SEQ ID NO: 585833 - DNA, 25 bp, Homo sapien
cattgacttatctgggacatcgctt

SEQ ID NO: 585834 - DNA, 25 bp, Homo sapien
gacttatctgggacatcgctttttt

SEQ ID NO: 585835 - DNA, 25 bp, Homo sapien
gacatcgctttttttaatcctcaca

SEQ ID NO: 585836 - DNA, 25 bp, Homo sapien
tcctcacatgagatttggctaagtt

SEQ ID NO: 585837 - DNA, 25 bp, Homo sapien
gagatttggctaagtttatttttca

SEQ ID NO: 585838 - DNA, 25 bp, Homo sapien
atttttcacaatctgttaatctcac

SEQ ID NO: 585839 - DNA, 25 bp, Homo sapien
gttaatctcacaaaaactaaagctg

SEQ ID NO: 585840 - DNA, 25 bp, Homo sapien
gttaagcacagtttaaacccattct

SEQ ID NO: 585841 - DNA, 25 bp, Homo sapien
acccattctgcagggtaagaaattc

SEQ ID NO: 585842 - DNA, 25 bp, Homo sapien
attcatctgtaaggcaatctatttg

SEQ ID NO: 585843 - DNA, 25 bp, Homo sapien
aagcaaacccttctagacagccggg

SEQ ID NO: 585844 - DNA, 25 bp, Homo sapien
gggagtgttcctcgacatgtttctc

SEQ ID NO: 585845 - DNA, 25 bp, Homo sapien
tcgacatgtttctccagtgacacct

SEQ ID NO: 585846 - DNA, 25 bp, Homo sapien
ctcccagagaagttcctatatatgc

SEQ ID NO: 585847 - DNA, 25 bp, Homo sapien
aacagatttgcagtaccaacctatg

SEQ ID NO: 585848 - DNA, 25 bp, Homo sapien
agtaccaacctatgcagccaagcaa

SEQ ID NO: 585849 - DNA, 25 bp, Homo sapien
atgcagccaagcaacctcagcagtt

SEQ ID NO: 585850 - DNA, 25 bp, Homo sapien
acaaccgaaagtatcatctcaggga

SEQ ID NO: 585851 - DNA, 25 bp, Homo sapien
ggaaacttaattcctgcccgtcctg

SEQ ID NO: 585852 - DNA, 25 bp, Homo sapien
gctcctgcacctcctttatatagtt

SEQ ID NO: 585853 - DNA, 25 bp, Homo sapien
atatagttccctcacttgatttttt

SEQ ID NO: 585854 - DNA, 25 bp, Homo sapien
gaattctctacacaccagtaacggg

SEQ ID NO: 585855 - DNA, 25 bp, Homo sapien
tacacaccagtaacgggatttcaat

SEQ ID NO: 585856 - DNA, 25 bp, Homo sapien
atttcaattccgatggactctgccg

SEQ ID NO: 585857 - DNA, 25 bp, Homo sapien
gggtgcgaagagacgctacgttcct

SEQ ID NO: 585858 - DNA, 25 bp, Homo sapien
gctacgttcctttccgatggaggaa

SEQ ID NO: 585859 - DNA, 25 bp, Homo sapien
gaggaaggcagacctgccgtcacac

SEQ ID NO: 585860 - DNA, 25 bp, Homo sapien
tgccgtcacacgtgtgcttgcacga

SEQ ID NO: 585861 - DNA, 25 bp, Homo sapien
tgtgcttgcacgagtgcgtgtacct

SEQ ID NO: 585862 - DNA, 25 bp, Homo sapien
tgcgtgtacctggtgcgggactcac

SEQ ID NO: 585863 - DNA, 25 bp, Homo sapien
ggtgctgcggtgactttgtagccaa

SEQ ID NO: 585864 - DNA, 25 bp, Homo sapien
ctgcggtgactttgtagccaacttt

SEQ ID NO: 585865 - DNA, 25 bp, Homo sapien
atcagtacggtttgatagcataggt

SEQ ID NO: 585866 - DNA, 25 bp, Homo sapien
tagcataggtggattgagccatcat

SEQ ID NO: 585867 - DNA, 25 bp, Homo sapien
gattgagccatcatattcatgcgct

SEQ ID NO: 585868 - DNA, 25 bp, Homo sapien
gccatcatattcatgcgctaaagga

SEQ ID NO: 585869 - DNA, 25 bp, Homo sapien
catgcgctaaaggaaatggtagtat

SEQ ID NO: 585870 - DNA, 25 bp, Homo sapien
tcccacttttatatccagaaatttt

SEQ ID NO: 585871 - DNA, 25 bp, Homo sapien
tgttttatggccctcctggcacagg

SEQ ID NO: 585872 - DNA, 25 bp, Homo sapien
ttatggccctcctggcacaggtaaa

SEQ ID NO: 585873 - DNA, 25 bp, Homo sapien
acaggtaaaaccttggttgccagag

SEQ ID NO: 585874 - DNA, 25 bp, Homo sapien
aaaaccttggttgccagagcattag

SEQ ID NO: 585875 - DNA, 25 bp, Homo sapien
attagctaatgaatgcagccaagga

SEQ ID NO: 585876 - DNA, 25 bp, Homo sapien
aaaaggcataaataagagtactgac

SEQ ID NO: 585877 - DNA, 25 bp, Homo sapien
aaggcataaataagagtactgacca

SEQ ID NO: 585878 - DNA, 25 bp, Homo sapien
aggcataaataagagtactgaccag

SEQ ID NO: 585879 - DNA, 25 bp, Homo sapien
ggcataaataagagtactgaccagg

SEQ ID NO: 585880 - DNA, 25 bp, Homo sapien
gcataaataagagtactgaccaggc

SEQ ID NO: 585881 - DNA, 25 bp, Homo sapien
cataaataagagtactgaccaggcg

SEQ ID NO: 585882 - DNA, 25 bp, Homo sapien
ataaataagagtactgaccaggcgc

SEQ ID NO: 585883 - DNA, 25 bp, Homo sapien
taaataagagtactgaccaggcgcg

SEQ ID NO: 585884 - DNA, 25 bp, Homo sapien
aaataagagtactgaccaggcgcgg

SEQ ID NO: 585885 - DNA, 25 bp, Homo sapien
aataagagtactgaccaggcgcggt

SEQ ID NO: 585886 - DNA, 25 bp, Homo sapien
ataagagtactgaccaggcgcggtg

SEQ ID NO: 585887 - DNA, 25 bp, Homo sapien
gtctctcccaagagtgctaccctag

SEQ ID NO: 585888 - DNA, 25 bp, Homo sapien
aagagtgctaccctagaccagcctg

SEQ ID NO: 585889 - DNA, 25 bp, Homo sapien
agaccagcctgcctcagattctgtt

SEQ ID NO: 585890 - DNA, 25 bp, Homo sapien
cctcagattctgtttcggcctagaa

SEQ ID NO: 585891 - DNA, 25 bp, Homo sapien
ttctgtttcggcctagaagggccaa

SEQ ID NO: 585892 - DNA, 25 bp, Homo sapien
gtcatcttccttgggttttagcaca

SEQ ID NO: 585893 - DNA, 25 bp, Homo sapien
tgggttttagcacattatcacacac

SEQ ID NO: 585894 - DNA, 25 bp, Homo sapien
gcacattatcacacacacattaggt

SEQ ID NO: 585895 - DNA, 25 bp, Homo sapien
ttagcacattattagaactcgcaaa

SEQ ID NO: 585896 - DNA, 25 bp, Homo sapien
gaactcgcaaatcccttatttgata

SEQ ID NO: 585897 - DNA, 25 bp, Homo sapien
ttcatttggatgtgttcttgtggaa

SEQ ID NO: 585898 - DNA, 25 bp, Homo sapien
ctctttgacaaagggcgctgccctg

SEQ ID NO: 585899 - DNA, 25 bp, Homo sapien
tctttgacaaagggcgctgccctga

SEQ ID NO: 585900 - DNA, 25 bp, Homo sapien
ctttgacaaagggcgctgccctgag

SEQ ID NO: 585901 - DNA, 25 bp, Homo sapien
ttgacaaagggcgctgccctgagga

SEQ ID NO: 585902 - DNA, 25 bp, Homo sapien
tgacaaagggcgctgccctgaggaa

SEQ ID NO: 585903 - DNA, 25 bp, Homo sapien
gacaaagggcgctgccctgaggaag

SEQ ID NO: 585904 - DNA, 25 bp, Homo sapien
acaaagggcgctgccctgaggaagc

SEQ ID NO: 585905 - DNA, 25 bp, Homo sapien
aagggcgctgccctgaggaagcgca

SEQ ID NO: 585906 - DNA, 25 bp, Homo sapien
agggcgctgccctgaggaagcgcaa

SEQ ID NO: 585907 - DNA, 25 bp, Homo sapien
tgccctgaggaagcgcaacgagccc

SEQ ID NO: 585908 - DNA, 25 bp, Homo sapien
gccctgaggaagcgcaacgagccct

SEQ ID NO: 585909 - DNA, 25 bp, Homo sapien
aatccccgctctcggcagagaattc

SEQ ID NO: 585910 - DNA, 25 bp, Homo sapien
gagaattccacgtgatctggccatg

SEQ ID NO: 585911 - DNA, 25 bp, Homo sapien
acgtgatctggccatgtgtgttact

SEQ ID NO: 585912 - DNA, 25 bp, Homo sapien
gatctggccatgtgtgttactccaa

SEQ ID NO: 585913 - DNA, 25 bp, Homo sapien
catgtgtgttactccaagtggccag

SEQ ID NO: 585914 - DNA, 25 bp, Homo sapien
ccaagtggccagttttactgctcaa

SEQ ID NO: 585915 - DNA, 25 bp, Homo sapien
gtggccagttttactgctcaatgtg

SEQ ID NO: 585916 - DNA, 25 bp, Homo sapien
ctggcgaagagatggaattccggca

SEQ ID NO: 585917 - DNA, 25 bp, Homo sapien
gaattccggcagcatttagagagca

SEQ ID NO: 585918 - DNA, 25 bp, Homo sapien
gagcaagcaacataagagcaaggtg

SEQ ID NO: 585919 - DNA, 25 bp, Homo sapien
agcaaggtgtctgaacagcggtaca

SEQ ID NO: 585920 - DNA, 25 bp, Homo sapien
taaaaccagggttaaagctgctgtc

SEQ ID NO: 585921 - DNA, 25 bp, Homo sapien
aaaccagggttaaagctgctgtctt

SEQ ID NO: 585922 - DNA, 25 bp, Homo sapien
aaagctgctgtcttggccagagccc

SEQ ID NO: 585923 - DNA, 25 bp, Homo sapien
aagctgctgtcttggccagagccct

SEQ ID NO: 585924 - DNA, 25 bp, Homo sapien
gaaaattggaagcaaggaacagcaa

SEQ ID NO: 585925 - DNA, 25 bp, Homo sapien
tcagcccaggcaggtgtctctatca

SEQ ID NO: 585926 - DNA, 25 bp, Homo sapien
agcccaggcaggtgtctctatcagg

SEQ ID NO: 585927 - DNA, 25 bp, Homo sapien
ccaggcaggtgtctctatcaggtga

SEQ ID NO: 585928 - DNA, 25 bp, Homo sapien
gcaggtgtctctatcaggtgagaga

SEQ ID NO: 585929 - DNA, 25 bp, Homo sapien
aggtgtctctatcaggtgagagaaa

SEQ ID NO: 585930 - DNA, 25 bp, Homo sapien
gagagaaaaatgtcagactcaataa

SEQ ID NO: 585931 - DNA, 25 bp, Homo sapien
aagaacatcttcgtttcactcatca

SEQ ID NO: 585932 - DNA, 25 bp, Homo sapien
tcaatgaagctctctactggatagg

SEQ ID NO: 585933 - DNA, 25 bp, Homo sapien
tactggataggaaggccgccgtcca

SEQ ID NO: 585934 - DNA, 25 bp, Homo sapien
cgtccatctccagccataggtttaa

SEQ ID NO: 585935 - DNA, 25 bp, Homo sapien
agaacctcagaattgctgcagccat

SEQ ID NO: 585936 - DNA, 25 bp, Homo sapien
ctgcagccatcttgctaccaaggca

SEQ ID NO: 585937 - DNA, 25 bp, Homo sapien
agtcggtatgctaaggaaggcagct

SEQ ID NO: 585938 - DNA, 25 bp, Homo sapien
aaaatcttgggttcctgttgacatt

SEQ ID NO: 585939 - DNA, 25 bp, Homo sapien
tgttgacattgctctgtccctgaaa

SEQ ID NO: 585940 - DNA, 25 bp, Homo sapien
tgtccctgaaatcttctacctctga

SEQ ID NO: 585941 - DNA, 25 bp, Homo sapien
tctacctctgaatttcttgttatga

SEQ ID NO: 585942 - DNA, 25 bp, Homo sapien
ctgcgggacagacccagcaatacat

SEQ ID NO: 585943 - DNA, 25 bp, Homo sapien
gacccagcaatacatgccctgaaga

SEQ ID NO: 585944 - DNA, 25 bp, Homo sapien
tctggatccccaggaatgctggtgc

SEQ ID NO: 585945 - DNA, 25 bp, Homo sapien
tggtgctgacaccagggtttaccac

SEQ ID NO: 585946 - DNA, 25 bp, Homo sapien
tgacaccagggtttaccaccagctg

SEQ ID NO: 585947 - DNA, 25 bp, Homo sapien
accaccagctggtaaaactagggca

SEQ ID NO: 585948 - DNA, 25 bp, Homo sapien
cccttccaagccttttgtgaggatt

SEQ ID NO: 585949 - DNA, 25 bp, Homo sapien
tgtgaggatttacagatgcagagct

SEQ ID NO: 585950 - DNA, 25 bp, Homo sapien
tgcagagctgtggtatggagccctt

SEQ ID NO: 585951 - DNA, 25 bp, Homo sapien
gctgtggtatggagcccttcgtaaa

SEQ ID NO: 585952 - DNA, 25 bp, Homo sapien
ggagcccttcgtaaagtatcaagtc

SEQ ID NO: 585953 - DNA, 25 bp, Homo sapien
cacccagcctctcagaaagtgcatt

SEQ ID NO: 585954 - DNA, 25 bp, Homo sapien
acccagcctctcagaaagtgcattt

SEQ ID NO: 585955 - DNA, 25 bp, Homo sapien
cccagcctctcagaaagtgcatttt

SEQ ID NO: 585956 - DNA, 25 bp, Homo sapien
ccagcctctcagaaagtgcattttt

SEQ ID NO: 585957 - DNA, 25 bp, Homo sapien
ggcaggatcctgtaaacccagctga

SEQ ID NO: 585958 - DNA, 25 bp, Homo sapien
gcaggatcctgtaaacccagctgag

SEQ ID NO: 585959 - DNA, 25 bp, Homo sapien
caggatcctgtaaacccagctgagg

SEQ ID NO: 585960 - DNA, 25 bp, Homo sapien
aggatcctgtaaacccagctgaggc

SEQ ID NO: 585961 - DNA, 25 bp, Homo sapien
ggatcctgtaaacccagctgaggca

SEQ ID NO: 585962 - DNA, 25 bp, Homo sapien
atcctgtaaacccagctgaggcaca

SEQ ID NO: 585963 - DNA, 25 bp, Homo sapien
ctgtaaacccagctgaggcacaaga

SEQ ID NO: 585964 - DNA, 25 bp, Homo sapien
cggcatgcaccttgtttccatgttg

SEQ ID NO: 585965 - DNA, 25 bp, Homo sapien
ttgtttccatgttgtcatcctccca

SEQ ID NO: 585966 - DNA, 25 bp, Homo sapien
atgttgtcatcctcccatggcttcc

SEQ ID NO: 585967 - DNA, 25 bp, Homo sapien
gaagtgtttcccaatcctttgacca

SEQ ID NO: 585968 - DNA, 25 bp, Homo sapien
gtttcccaatcctttgaccattcct

SEQ ID NO: 585969 - DNA, 25 bp, Homo sapien
aggcggttgcaggactttgagctgg

SEQ ID NO: 585970 - DNA, 25 bp, Homo sapien
actttgagctggaaattgaatttga

SEQ ID NO: 585971 - DNA, 25 bp, Homo sapien
gagtttaaactccacgttaagctgt

SEQ ID NO: 585972 - DNA, 25 bp, Homo sapien
aaactccacgttaagctgtcagcat

SEQ ID NO: 585973 - DNA, 25 bp, Homo sapien
actccacgttaagctgtcagcatac

SEQ ID NO: 585974 - DNA, 25 bp, Homo sapien
gtcagcatacacaaacacccaaatt

SEQ ID NO: 585975 - DNA, 25 bp, Homo sapien
ggtgtgacagctcatgcctcagaag

SEQ ID NO: 585976 - DNA, 25 bp, Homo sapien
tcatgcctcagaagtcgagggttca

SEQ ID NO: 585977 - DNA, 25 bp, Homo sapien
ctcagaagtcgagggttcagtgtgc

SEQ ID NO: 585978 - DNA, 25 bp, Homo sapien
tcagtgtgctgtgattgcaccaatg

SEQ ID NO: 585979 - DNA, 25 bp, Homo sapien
taccgtaatgtaaactatgggcttt

SEQ ID NO: 585980 - DNA, 25 bp, Homo sapien
aactatgggctttgggttattatca

SEQ ID NO: 585981 - DNA, 25 bp, Homo sapien
ggctttgggttattatcatgtgtca

SEQ ID NO: 585982 - DNA, 25 bp, Homo sapien
gggttattatcatgtgtcaatgtag

SEQ ID NO: 585983 - DNA, 25 bp, Homo sapien
ccactccggtggaggatgttgataa

SEQ ID NO: 585984 - DNA, 25 bp, Homo sapien
ataatgagggaggttatgcatgtgt

SEQ ID NO: 585985 - DNA, 25 bp, Homo sapien
aaaatctctgtcaactcctcttaat

SEQ ID NO: 585986 - DNA, 25 bp, Homo sapien
ctgagctcttggaggtgcccaggaa

SEQ ID NO: 585987 - DNA, 25 bp, Homo sapien
gagctcttggaggtgcccaggaacc

SEQ ID NO: 585988 - DNA, 25 bp, Homo sapien
gctcttggaggtgcccaggaaccct

SEQ ID NO: 585989 - DNA, 25 bp, Homo sapien
acagggcctggccatatagccagct

SEQ ID NO: 585990 - DNA, 25 bp, Homo sapien
ggcctggccatatagccagctccaa

SEQ ID NO: 585991 - DNA, 25 bp, Homo sapien
atatagccagctccaacccaaagcc

SEQ ID NO: 585992 - DNA, 25 bp, Homo sapien
ctggtctctcctcaaaagaatttta

SEQ ID NO: 585993 - DNA, 25 bp, Homo sapien
gtctctcctcaaaagaattttacat

SEQ ID NO: 585994 - DNA, 25 bp, Homo sapien
aatagctttcatttacatagtgctt

SEQ ID NO: 585995 - DNA, 25 bp, Homo sapien
actatgtgcgatgtactaatttaag

SEQ ID NO: 585996 - DNA, 25 bp, Homo sapien
tggacacaacacaaaactcaaaagg

SEQ ID NO: 585997 - DNA, 25 bp, Homo sapien
acgaagctgcgcaacttctgctaat

SEQ ID NO: 585998 - DNA, 25 bp, Homo sapien
gcgcaacttctgctaatgctgcaac

SEQ ID NO: 585999 - DNA, 25 bp, Homo sapien
aatgctgcaaccctggcaagacgaa

SEQ ID NO: 586000 - DNA, 25 bp, Homo sapien
ttcctctgttgggatccgatccttg

SEQ ID NO: 586001 - DNA, 25 bp, Homo sapien
atccgatccttgttcgctcttgcaa

SEQ ID NO: 586002 - DNA, 25 bp, Homo sapien
ttgcaatcccgcagcccggagtttt

SEQ ID NO: 586003 - DNA, 25 bp, Homo sapien
ttttgccccgtgcattaaaacatgt

SEQ ID NO: 586004 - DNA, 25 bp, Homo sapien
acatgttctctttcatttgcagatt

SEQ ID NO: 586005 - DNA, 25 bp, Homo sapien
agctgatggctgtatagtgaccacg

SEQ ID NO: 586006 - DNA, 25 bp, Homo sapien
gtatagtgaccacggactgcgtcct

SEQ ID NO: 586007 - DNA, 25 bp, Homo sapien
ggactgcgtcctcctcacgaagctg

SEQ ID NO: 586008 - DNA, 25 bp, Homo sapien
cagcttagctgatttggactttggc

SEQ ID NO: 586009 - DNA, 25 bp, Homo sapien
ggactttggctgtgaaaacattatc

SEQ ID NO: 586010 - DNA, 25 bp, Homo sapien
ggctgtgaaaacattatcctcagtg

SEQ ID NO: 586011 - DNA, 25 bp, Homo sapien
tatcctcagtgtttaaaaggttgga

SEQ ID NO: 586012 - DNA, 25 bp, Homo sapien
gttggaaaattctactgggtctttg

SEQ ID NO: 586013 - DNA, 25 bp, Homo sapien
tactgggtctttggcccaacctgga

SEQ ID NO: 586014 - DNA, 25 bp, Homo sapien
ttggcccaacctggaattaaatcct

SEQ ID NO: 586015 - DNA, 25 bp, Homo sapien
ttaaatcctgatgcttagaacctca

SEQ ID NO: 586016 - DNA, 25 bp, Homo sapien
cctgatgcttagaacctcaaagtct

SEQ ID NO: 586017 - DNA, 25 bp, Homo sapien
aatcttctattgtcactttacagag

SEQ ID NO: 586018 - DNA, 25 bp, Homo sapien
ctattgtcactttacagagctattg

SEQ ID NO: 586019 - DNA, 25 bp, Homo sapien
aaggttaagctaggtgggctcagaa

SEQ ID NO: 586020 - DNA, 25 bp, Homo sapien
aggtgggctcagaaatctagaatcc

SEQ ID NO: 586021 - DNA, 25 bp, Homo sapien
atctagaatccatagttgtcctgtg

SEQ ID NO: 586022 - DNA, 25 bp, Homo sapien
gaatccatagttgtcctgtgaggac

SEQ ID NO: 586023 - DNA, 25 bp, Homo sapien
agttgtcctgtgaggacctgaagaa

SEQ ID NO: 586024 - DNA, 25 bp, Homo sapien
caaatgatttccctagaacgattcc

SEQ ID NO: 586025 - DNA, 25 bp, Homo sapien
ctgatccagatcttgctccaaaaag

SEQ ID NO: 586026 - DNA, 25 bp, Homo sapien
cagatcttgctccaaaaagcctttt

SEQ ID NO: 586027 - DNA, 25 bp, Homo sapien
aaaagccttttgactttgatagact

SEQ ID NO: 586028 - DNA, 25 bp, Homo sapien
actttgatagacttgctgaatctga

SEQ ID NO: 586029 - DNA, 25 bp, Homo sapien
gacttcagaagtttcagtacacctt

SEQ ID NO: 586030 - DNA, 25 bp, Homo sapien
tgaggaggatcatctgtcagtagcc

SEQ ID NO: 586031 - DNA, 25 bp, Homo sapien
gaggatcatctgtcagtagcctgtt

SEQ ID NO: 586032 - DNA, 25 bp, Homo sapien
gatcatctgtcagtagcctgttcac

SEQ ID NO: 586033 - DNA, 25 bp, Homo sapien
gtcagtagcctgttcacccattagt

SEQ ID NO: 586034 - DNA, 25 bp, Homo sapien
gtagcctgttcacccattagtctta

SEQ ID NO: 586035 - DNA, 25 bp, Homo sapien
cctgttcacccattagtcttactaa

SEQ ID NO: 586036 - DNA, 25 bp, Homo sapien
gtcttactaagccatttctcattta

SEQ ID NO: 586037 - DNA, 25 bp, Homo sapien
gtcgtttgaaatactgaatcctcta

SEQ ID NO: 586038 - DNA, 25 bp, Homo sapien
ttgaaatactgaatcctctaggaca

SEQ ID NO: 586039 - DNA, 25 bp, Homo sapien
gaatcctctaggacaagatatggtt

SEQ ID NO: 586040 - DNA, 25 bp, Homo sapien
tctaggacaagatatggttatacaa

SEQ ID NO: 586041 - DNA, 25 bp, Homo sapien
gcctctgcaagctgtggctggtagt

SEQ ID NO: 586042 - DNA, 25 bp, Homo sapien
tgtggctggtagtggactacctgct

SEQ ID NO: 586043 - DNA, 25 bp, Homo sapien
gtagtggactacctgctgtgcacct

SEQ ID NO: 586044 - DNA, 25 bp, Homo sapien
gtggactacctgctgtgcacctcct

SEQ ID NO: 586045 - DNA, 25 bp, Homo sapien
aacatcgtgctcatcagctacgacc

SEQ ID NO: 586046 - DNA, 25 bp, Homo sapien
atcgtgctcatcagctacgaccgct

SEQ ID NO: 586047 - DNA, 25 bp, Homo sapien
gcttcctgtcggtcacccgagcggt

SEQ ID NO: 586048 - DNA, 25 bp, Homo sapien
tgtcggtcacccgagcggtctcata

SEQ ID NO: 586049 - DNA, 25 bp, Homo sapien
agcggtctcataccgggcccagcag

SEQ ID NO: 586050 - DNA, 25 bp, Homo sapien
agcagggtgacacgcggcgggcagt

SEQ ID NO: 586051 - DNA, 25 bp, Homo sapien
cagtgcggaagatgctgctggtgtg

SEQ ID NO: 586052 - DNA, 25 bp, Homo sapien
aagagctctatttgccttattcaga

SEQ ID NO: 586053 - DNA, 25 bp, Homo sapien
gccttattcagatttttgctatcag

SEQ ID NO: 586054 - DNA, 25 bp, Homo sapien
tttttgctatcagtgttgtatatac

SEQ ID NO: 586055 - DNA, 25 bp, Homo sapien
aatttcttcattcagcatccaactc

SEQ ID NO: 586056 - DNA, 25 bp, Homo sapien
attcagcatccaactcttctgactc

SEQ ID NO: 586057 - DNA, 25 bp, Homo sapien
ttctgactcccttacctgggacgtt

SEQ ID NO: 586058 - DNA, 25 bp, Homo sapien
tgggacgttccccagctgtcgccgt

SEQ ID NO: 586059 - DNA, 25 bp, Homo sapien
tcagtcttcctcagatgccagtttg

SEQ ID NO: 586060 - DNA, 25 bp, Homo sapien
atgccagtttgttgaggtgtttctc

SEQ ID NO: 586061 - DNA, 25 bp, Homo sapien
tttctctttccctgatgcctcttgt

SEQ ID NO: 586062 - DNA, 25 bp, Homo sapien
ctgatgcctcttgtgccaacaaata

SEQ ID NO: 586063 - DNA, 25 bp, Homo sapien
ggaatttatctaaaccatctgatgc

SEQ ID NO: 586064 - DNA, 25 bp, Homo sapien
accatctgatgctgctaaggctgag

SEQ ID NO: 586065 - DNA, 25 bp, Homo sapien
ctaaggctgagcataacatgagtaa

SEQ ID NO: 586066 - DNA, 25 bp, Homo sapien
atgtcaaccgaagatcctcgacaag

SEQ ID NO: 586067 - DNA, 25 bp, Homo sapien
gtcagaaatccacccaaatttggga

SEQ ID NO: 586068 - DNA, 25 bp, Homo sapien
atttgggacgcatcataaagccttg

SEQ ID NO: 586069 - DNA, 25 bp, Homo sapien
caggaaattcgaaactctctgcttc

SEQ ID NO: 586070 - DNA, 25 bp, Homo sapien
aactctctgcttccatttgcaaatg

SEQ ID NO: 586071 - DNA, 25 bp, Homo sapien
gaaacaaattcttctcggagtactt

SEQ ID NO: 586072 - DNA, 25 bp, Homo sapien
gttaatccacaaatgcttcaagact

SEQ ID NO: 586073 - DNA, 25 bp, Homo sapien
ttcaagacttgcaagctgctggatt

SEQ ID NO: 586074 - DNA, 25 bp, Homo sapien
ggtgtgacaatctaaatagcgtggt

SEQ ID NO: 586075 - DNA, 25 bp, Homo sapien
taaatagcgtggtcatgacctcatg

SEQ ID NO: 586076 - DNA, 25 bp, Homo sapien
gagcattccatgcagagggaatcac

SEQ ID NO: 586077 - DNA, 25 bp, Homo sapien
gggaatcacaactacaaaggccttg

SEQ ID NO: 586078 - DNA, 25 bp, Homo sapien
ggccttggcttaagagaatgcctga

SEQ ID NO: 586079 - DNA, 25 bp, Homo sapien
gaatgcctgagtgttctagaaatga

SEQ ID NO: 586080 - DNA, 25 bp, Homo sapien
agggaggccagcatgcagaggacga

SEQ ID NO: 586081 - DNA, 25 bp, Homo sapien
gagagcactggacaggccagccggg

SEQ ID NO: 586082 - DNA, 25 bp, Homo sapien
cacgtggtgccttgtgggctgctat

SEQ ID NO: 586083 - DNA, 25 bp, Homo sapien
ggacatggactgttactctgagtaa

SEQ ID NO: 586084 - DNA, 25 bp, Homo sapien
tactctgagtaagaacatgaaccac

SEQ ID NO: 586085 - DNA, 25 bp, Homo sapien
tcttttgggtgtgttagacctggga

SEQ ID NO: 586086 - DNA, 25 bp, Homo sapien
ctgggaaacaatctgtcttctcctt

SEQ ID NO: 586087 - DNA, 25 bp, Homo sapien
acaatctgtcttctcctttcacgtg

SEQ ID NO: 586088 - DNA, 25 bp, Homo sapien
aaagcaggactccaatcttccccgg

SEQ ID NO: 586089 - DNA, 25 bp, Homo sapien
gggcctttctgattgggagtcttaa

SEQ ID NO: 586090 - DNA, 25 bp, Homo sapien
accctgttccctgggaaaggcatgc

SEQ ID NO: 586091 - DNA, 25 bp, Homo sapien
gctgacaaaaccctacaggacggtt

SEQ ID NO: 586092 - DNA, 25 bp, Homo sapien
gagacagggttagttcaactcgtgt

SEQ ID NO: 586093 - DNA, 25 bp, Homo sapien
tcaactcgtgtgtgtccccagaggg

SEQ ID NO: 586094 - DNA, 25 bp, Homo sapien
accacagggatgaatgggagttcca

SEQ ID NO: 586095 - DNA, 25 bp, Homo sapien
aacctgcacattgcttcatctggat

SEQ ID NO: 586096 - DNA, 25 bp, Homo sapien
ttgggcacctggtttgggtcctgca

SEQ ID NO: 586097 - DNA, 25 bp, Homo sapien
ggccctgggctctgaacctgtgaac

SEQ ID NO: 586098 - DNA, 25 bp, Homo sapien
tgaacctgtgaacccttgctgtgtt

SEQ ID NO: 586099 - DNA, 25 bp, Homo sapien
cttgctgtgttacgaaactttcctt

SEQ ID NO: 586100 - DNA, 25 bp, Homo sapien
tacgaaactttccttcctctgaggg

SEQ ID NO: 586101 - DNA, 25 bp, Homo sapien
tgagggccttgaaccctctcctttt

SEQ ID NO: 586102 - DNA, 25 bp, Homo sapien
tgttttaaaactgaatggcacgaaa

SEQ ID NO: 586103 - DNA, 25 bp, Homo sapien
gaatggcacgaaattgttttcctca

SEQ ID NO: 586104 - DNA, 25 bp, Homo sapien
aattgttttcctcaactcggagatt

SEQ ID NO: 586105 - DNA, 25 bp, Homo sapien
ttcctcaactcggagattcctgtat

SEQ ID NO: 586106 - DNA, 25 bp, Homo sapien
actcggagattcctgtatggagaga

SEQ ID NO: 586107 - DNA, 25 bp, Homo sapien
tttggacaaggccaaagagcattgg

SEQ ID NO: 586108 - DNA, 25 bp, Homo sapien
ttggacaaggccaaagagcattggg

SEQ ID NO: 586109 - DNA, 25 bp, Homo sapien
tggacaaggccaaagagcattgggc

SEQ ID NO: 586110 - DNA, 25 bp, Homo sapien
gccaaagagcattgggctgctggaa

SEQ ID NO: 586111 - DNA, 25 bp, Homo sapien
ccaaagagcattgggctgctggaag

SEQ ID NO: 586112 - DNA, 25 bp, Homo sapien
caaagagcattgggctgctggaagc

SEQ ID NO: 586113 - DNA, 25 bp, Homo sapien
aaagagcattgggctgctggaagct

SEQ ID NO: 586114 - DNA, 25 bp, Homo sapien
aagagcattgggctgctggaagctg

SEQ ID NO: 586115 - DNA, 25 bp, Homo sapien
agagcattgggctgctggaagctgg

SEQ ID NO: 586116 - DNA, 25 bp, Homo sapien
gagcattgggctgctggaagctggg

SEQ ID NO: 586117 - DNA, 25 bp, Homo sapien
tgctggaagctggggcatcggcgca

SEQ ID NO: 586118 - DNA, 25 bp, Homo sapien
tttgaaggatgtgccaccaaaggct

SEQ ID NO: 586119 - DNA, 25 bp, Homo sapien
gatgtgccaccaaaggcttcccaaa

SEQ ID NO: 586120 - DNA, 25 bp, Homo sapien
cagaacacgaggagaaggcatctta

SEQ ID NO: 586121 - DNA, 25 bp, Homo sapien
aggcatcttaataaggcacctccca

SEQ ID NO: 586122 - DNA, 25 bp, Homo sapien
cacggcacttccaagaagtctgtga

SEQ ID NO: 586123 - DNA, 25 bp, Homo sapien
aagaacagagcaagtgtgacgggca

SEQ ID NO: 586124 - DNA, 25 bp, Homo sapien
gcagggctgtgaacctctgagtgct

SEQ ID NO: 586125 - DNA, 25 bp, Homo sapien
ggctgtgaacctctgagtgcttcag

SEQ ID NO: 586126 - DNA, 25 bp, Homo sapien
gaacctctgagtgcttcagatgtaa

SEQ ID NO: 586127 - DNA, 25 bp, Homo sapien
aaaagtgtggaagacgtcgggctgt

SEQ ID NO: 586128 - DNA, 25 bp, Homo sapien
gtcgggctgtgagtgtcacgcagca

SEQ ID NO: 586129 - DNA, 25 bp, Homo sapien
gtctttgtaagttgctcactgcctt

SEQ ID NO: 586130 - DNA, 25 bp, Homo sapien
cctgtgcccagattccaattcagaa

SEQ ID NO: 586131 - DNA, 25 bp, Homo sapien
agaagaggcggttcctgctaggccc

SEQ ID NO: 586132 - DNA, 25 bp, Homo sapien
taggcccgggcccaagtatgaagcc

SEQ ID NO: 586133 - DNA, 25 bp, Homo sapien
gtatgaagccatgcgcagaaacagc

SEQ ID NO: 586134 - DNA, 25 bp, Homo sapien
gccatgcgcagaaacagcttactga

SEQ ID NO: 586135 - DNA, 25 bp, Homo sapien
gtcttcctcaataccttgctcaagg

SEQ ID NO: 586136 - DNA, 25 bp, Homo sapien
caaggcccttcgagaatgtttacgt

SEQ ID NO: 586137 - DNA, 25 bp, Homo sapien
ttacgttttcaaagatcgcaagtat

SEQ ID NO: 586138 - DNA, 25 bp, Homo sapien
cgagcgagcgtgagacccaacccgt

SEQ ID NO: 586139 - DNA, 25 bp, Homo sapien
agacccaacccgtgagggagactcg

SEQ ID NO: 586140 - DNA, 25 bp, Homo sapien
gtaattgggattcccgcaactgcaa

SEQ ID NO: 586141 - DNA, 25 bp, Homo sapien
ttgggattcccgcaactgcaaatcc

SEQ ID NO: 586142 - DNA, 25 bp, Homo sapien
ttccccgagcgctggccgacagtag

SEQ ID NO: 586143 - DNA, 25 bp, Homo sapien
gctggccgacagtagggcggaccga

SEQ ID NO: 586144 - DNA, 25 bp, Homo sapien
cggaccgacgctgagcaagggatta

SEQ ID NO: 586145 - DNA, 25 bp, Homo sapien
ccgacgctgagcaagggattacatc

SEQ ID NO: 586146 - DNA, 25 bp, Homo sapien
ggattacatcccaagatttacaggt

SEQ ID NO: 586147 - DNA, 25 bp, Homo sapien
catcccaagatttacaggtgtgcag

SEQ ID NO: 586148 - DNA, 25 bp, Homo sapien
ccaagatttacaggtgtgcagaacg

SEQ ID NO: 586149 - DNA, 25 bp, Homo sapien
ctgggagggatggattctatgtttt

SEQ ID NO: 586150 - DNA, 25 bp, Homo sapien
gattctatgttttaagggcccactt

SEQ ID NO: 586151 - DNA, 25 bp, Homo sapien
tgggcctctttaacatcaaaagatg

SEQ ID NO: 586152 - DNA, 25 bp, Homo sapien
ttgcaaaaaagactgggaagggcct

SEQ ID NO: 586153 - DNA, 25 bp, Homo sapien
ctgggaagggccttcaacgaagtag

SEQ ID NO: 586154 - DNA, 25 bp, Homo sapien
gaagggccttcaacgaagtaggaag

SEQ ID NO: 586155 - DNA, 25 bp, Homo sapien
ggccttcaacgaagtaggaagaaca

SEQ ID NO: 586156 - DNA, 25 bp, Homo sapien
gaacagttgtaaaatggagactcga

SEQ ID NO: 586157 - DNA, 25 bp, Homo sapien
cagttgtaaaatggagactcgaagt

SEQ ID NO: 586158 - DNA, 25 bp, Homo sapien
atggagactcgaagtgaaaaaggtt

SEQ ID NO: 586159 - DNA, 25 bp, Homo sapien
aggttgggagcaaggacctttggca

SEQ ID NO: 586160 - DNA, 25 bp, Homo sapien
aggacctttggcaagtgctataata

SEQ ID NO: 586161 - DNA, 25 bp, Homo sapien
gacattacattatataaggtctaag

SEQ ID NO: 586162 - DNA, 25 bp, Homo sapien
aacaagatgtgtttggacaaggtcc

SEQ ID NO: 586163 - DNA, 25 bp, Homo sapien
aagtgctgcctcaaaacattcatcc

SEQ ID NO: 586164 - DNA, 25 bp, Homo sapien
aacattcatcccatgcgcaaggcat

SEQ ID NO: 586165 - DNA, 25 bp, Homo sapien
caaggcatgccccagtaagcttcca

SEQ ID NO: 586166 - DNA, 25 bp, Homo sapien
taagcttccaccgtagttccgtgag

SEQ ID NO: 586167 - DNA, 25 bp, Homo sapien
gttccgtgagcatcaatatatcttt

SEQ ID NO: 586168 - DNA, 25 bp, Homo sapien
atatatcttttcttggtcttttaat

SEQ ID NO: 586169 - DNA, 25 bp, Homo sapien
actacagtatgcttgtatgcttctt

SEQ ID NO: 586170 - DNA, 25 bp, Homo sapien
gtatgcttcttttaactcctggata

SEQ ID NO: 586171 - DNA, 25 bp, Homo sapien
aaacctgtgcctattttggagttca

SEQ ID NO: 586172 - DNA, 25 bp, Homo sapien
ttggagttcacagacttacaaatcc

SEQ ID NO: 586173 - DNA, 25 bp, Homo sapien
actcgcacttgctaccaacctggat

SEQ ID NO: 586174 - DNA, 25 bp, Homo sapien
ctggatcccggatccaagggagatt

SEQ ID NO: 586175 - DNA, 25 bp, Homo sapien
tgtgagcaagcgtggccactgtgca

SEQ ID NO: 586176 - DNA, 25 bp, Homo sapien
gtggccactgtgcagtcacacacac

SEQ ID NO: 586177 - DNA, 25 bp, Homo sapien
gtgcagtcacacacacaagctgctg

SEQ ID NO: 586178 - DNA, 25 bp, Homo sapien
ggtgccagcacaggctctccatgag

SEQ ID NO: 586179 - DNA, 25 bp, Homo sapien
acaggctctccatgaggtggctgga

SEQ ID NO: 586180 - DNA, 25 bp, Homo sapien
gtggctggaccaggcacacaacaaa

SEQ ID NO: 586181 - DNA, 25 bp, Homo sapien
tggaccaggcgcatcacaagcagct

SEQ ID NO: 586182 - DNA, 25 bp, Homo sapien
acaagcagcttccaacagtggcact

SEQ ID NO: 586183 - DNA, 25 bp, Homo sapien
caacagtggcactggcgaatgcagt

SEQ ID NO: 586184 - DNA, 25 bp, Homo sapien
gagaactcaaaagttcctttgtcta

SEQ ID NO: 586185 - DNA, 25 bp, Homo sapien
tcaaaagttcctttgtctacctcca

SEQ ID NO: 586186 - DNA, 25 bp, Homo sapien
gcccttaactacatttgactttaag

SEQ ID NO: 586187 - DNA, 25 bp, Homo sapien
gctaaattacaccattcatacttat

SEQ ID NO: 586188 - DNA, 25 bp, Homo sapien
attacaccattcatacttattgttc

SEQ ID NO: 586189 - DNA, 25 bp, Homo sapien
caccattcatacttattgttctttc

SEQ ID NO: 586190 - DNA, 25 bp, Homo sapien
ccattcatacttattgttctttcaa

SEQ ID NO: 586191 - DNA, 25 bp, Homo sapien
atacttattgttctttcaatagcaa

SEQ ID NO: 586192 - DNA, 25 bp, Homo sapien
gcaaaatgtactgaaagctctccag

SEQ ID NO: 586193 - DNA, 25 bp, Homo sapien
aatgtactgaaagctctccagtccc

SEQ ID NO: 586194 - DNA, 25 bp, Homo sapien
atgtactgaaagctctccagtcccc

SEQ ID NO: 586195 - DNA, 25 bp, Homo sapien
acagtcagttcaaagcaccatttat

SEQ ID NO: 586196 - DNA, 25 bp, Homo sapien
tattgatggtttactgtatgccaga

SEQ ID NO: 586197 - DNA, 25 bp, Homo sapien
gtattaccctacttaatcctcaaca

SEQ ID NO: 586198 - DNA, 25 bp, Homo sapien
ccctacttaatcctcaacacaattt

SEQ ID NO: 586199 - DNA, 25 bp, Homo sapien
gttattgttagcctgaaactggcat

SEQ ID NO: 586200 - DNA, 25 bp, Homo sapien
tccttttatggtgctgtctttgaaa

SEQ ID NO: 586201 - DNA, 25 bp, Homo sapien
ggtgctgtctttgaaaagtctcaga

SEQ ID NO: 586202 - DNA, 25 bp, Homo sapien
aagtctcagatgtgtaacatgtcct

SEQ ID NO: 586203 - DNA, 25 bp, Homo sapien
atgtgtaacatgtcctagaagtaga

SEQ ID NO: 586204 - DNA, 25 bp, Homo sapien
aggaagactgcaactgtaactcact

SEQ ID NO: 586205 - DNA, 25 bp, Homo sapien
caactgtaactcacttccctctgag

SEQ ID NO: 586206 - DNA, 25 bp, Homo sapien
aaggccagacaaaagagctgtcagc

SEQ ID NO: 586207 - DNA, 25 bp, Homo sapien
agagctgtcagccagttactacaga

SEQ ID NO: 586208 - DNA, 25 bp, Homo sapien
gtcagccagttactacagacactca

SEQ ID NO: 586209 - DNA, 25 bp, Homo sapien
gccagttactacagacactcaatgc

SEQ ID NO: 586210 - DNA, 25 bp, Homo sapien
agacactcaatgcagacaccttcag

SEQ ID NO: 586211 - DNA, 25 bp, Homo sapien
acactcaatgcagacaccttcagag

SEQ ID NO: 586212 - DNA, 25 bp, Homo sapien
gagtattgggaaaagacttgccttc

SEQ ID NO: 586213 - DNA, 25 bp, Homo sapien
ttgggaaaagacttgccttctgcca

SEQ ID NO: 586214 - DNA, 25 bp, Homo sapien
gggaaaagacttgccttctgccaga

SEQ ID NO: 586215 - DNA, 25 bp, Homo sapien
aaaagacttgccttctgccagaact

SEQ ID NO: 586216 - DNA, 25 bp, Homo sapien
aagacttgccttctgccagaactta

SEQ ID NO: 586217 - DNA, 25 bp, Homo sapien
atgtgcatgccgtgcgggcagactc

SEQ ID NO: 586218 - DNA, 25 bp, Homo sapien
cacacagcagacacggacctatgga

SEQ ID NO: 586219 - DNA, 25 bp, Homo sapien
acggacctatggactatggatggat

SEQ ID NO: 586220 - DNA, 25 bp, Homo sapien
atgcggacgatggaaccgttcagta

SEQ ID NO: 586221 - DNA, 25 bp, Homo sapien
aagaacccaaggttgagtgcaactg

SEQ ID NO: 586222 - DNA, 25 bp, Homo sapien
tcatctccttggcagggacactaaa

SEQ ID NO: 586223 - DNA, 25 bp, Homo sapien
aaagggctgtcttcagtgctttaat

SEQ ID NO: 586224 - DNA, 25 bp, Homo sapien
tctaatgcaataaatcgccaggatt

SEQ ID NO: 586225 - DNA, 25 bp, Homo sapien
attgcagccaaccagatactccgga

SEQ ID NO: 586226 - DNA, 25 bp, Homo sapien
agcggcatggagtagcagcctcccg

SEQ ID NO: 586227 - DNA, 25 bp, Homo sapien
tgtgttgcagctcaccgcgcatgtg

SEQ ID NO: 586228 - DNA, 25 bp, Homo sapien
cttgaatcaagtagatgttggcagc

SEQ ID NO: 586229 - DNA, 25 bp, Homo sapien
tatgttctaaaagtttgtggtcaag

SEQ ID NO: 586230 - DNA, 25 bp, Homo sapien
ggaagtgctgcagaagtaagtttat

SEQ ID NO: 586231 - DNA, 25 bp, Homo sapien
tgctgcagaagtaagtttatttaac

SEQ ID NO: 586232 - DNA, 25 bp, Homo sapien
tttaactactgagcaacatccttgg

SEQ ID NO: 586233 - DNA, 25 bp, Homo sapien
taactactgagcaacatccttggaa

SEQ ID NO: 586234 - DNA, 25 bp, Homo sapien
actactgagcaacatccttggaaat

SEQ ID NO: 586235 - DNA, 25 bp, Homo sapien
gagcaacatccttggaaatttcatt

SEQ ID NO: 586236 - DNA, 25 bp, Homo sapien
atgcagaaatacattggatcctatt

SEQ ID NO: 586237 - DNA, 25 bp, Homo sapien
aatacattggatcctattgaattga

SEQ ID NO: 586238 - DNA, 25 bp, Homo sapien
ggatcctattgaattgatttattga

SEQ ID NO: 586239 - DNA, 25 bp, Homo sapien
aagcccagcttctcatacaaatgtc

SEQ ID NO: 586240 - DNA, 25 bp, Homo sapien
agcccagcttctcatacaaatgtct

SEQ ID NO: 586241 - DNA, 25 bp, Homo sapien
gcccagcttctcatacaaatgtcta

SEQ ID NO: 586242 - DNA, 25 bp, Homo sapien
cccagcttctcatacaaatgtctac

SEQ ID NO: 586243 - DNA, 25 bp, Homo sapien
ccagcttctcatacaaatgtctact

SEQ ID NO: 586244 - DNA, 25 bp, Homo sapien
cagcttctcatacaaatgtctactc

SEQ ID NO: 586245 - DNA, 25 bp, Homo sapien
gcttctcatacaaatgtctactcct

SEQ ID NO: 586246 - DNA, 25 bp, Homo sapien
cttctcatacaaatgtctactcctt

SEQ ID NO: 586247 - DNA, 25 bp, Homo sapien
tccttcatttagcttcaattcccac

SEQ ID NO: 586248 - DNA, 25 bp, Homo sapien
ccttcatttagcttcaattcccact

SEQ ID NO: 586249 - DNA, 25 bp, Homo sapien
cttcatttagcttcaattcccactt

SEQ ID NO: 586250 - DNA, 25 bp, Homo sapien
aagagtctatgaagaacccaacgga

SEQ ID NO: 586251 - DNA, 25 bp, Homo sapien
aacccaacggaagtttgtggcacat

SEQ ID NO: 586252 - DNA, 25 bp, Homo sapien
tgtggcacatccctaccctcaaatt

SEQ ID NO: 586253 - DNA, 25 bp, Homo sapien
atccctaccctcaaattcacagtga

SEQ ID NO: 586254 - DNA, 25 bp, Homo sapien
acagtgagggtggaatgacagtaac

SEQ ID NO: 586255 - DNA, 25 bp, Homo sapien
tgaaaatattcacatgagacaggaa

SEQ ID NO: 586256 - DNA, 25 bp, Homo sapien
gaatatccagtgtacaatgagagtg

SEQ ID NO: 586257 - DNA, 25 bp, Homo sapien
acacacaacccacgcacaaatattt

SEQ ID NO: 586258 - DNA, 25 bp, Homo sapien
acaacccacgcacaaatatttttgg

SEQ ID NO: 586259 - DNA, 25 bp, Homo sapien
tttataatcttctaagtgctccgaa

SEQ ID NO: 586260 - DNA, 25 bp, Homo sapien
cttctaagtgctccgaagaacatgt

SEQ ID NO: 586261 - DNA, 25 bp, Homo sapien
ggaagtgctgcagaagtaagtttat

SEQ ID NO: 586262 - DNA, 25 bp, Homo sapien
agtgctgcagaagtaagtttattta

SEQ ID NO: 586263 - DNA, 25 bp, Homo sapien
gtaagtttatttaactactgagcaa

SEQ ID NO: 586264 - DNA, 25 bp, Homo sapien
tttaactactgagcaacatccttgg

SEQ ID NO: 586265 - DNA, 25 bp, Homo sapien
taactactgagcaacatccttggaa

SEQ ID NO: 586266 - DNA, 25 bp, Homo sapien
actactgagcaacatccttggaaat

SEQ ID NO: 586267 - DNA, 25 bp, Homo sapien
atgcagaaatacattggatcctatt

SEQ ID NO: 586268 - DNA, 25 bp, Homo sapien
gcagaaatacattggatcctattga

SEQ ID NO: 586269 - DNA, 25 bp, Homo sapien
aatacattggatcctattgaattga

SEQ ID NO: 586270 - DNA, 25 bp, Homo sapien
cattggatcctattgaattgattta

SEQ ID NO: 586271 - DNA, 25 bp, Homo sapien
ggatcctattgaattgatttattga

SEQ ID NO: 586272 - DNA, 25 bp, Homo sapien
tctggaaagttcatctacttagaag

SEQ ID NO: 586273 - DNA, 25 bp, Homo sapien
gttcatctacttagaagatggcaca

SEQ ID NO: 586274 - DNA, 25 bp, Homo sapien
agatggcacaggctctgccgtgtcc

SEQ ID NO: 586275 - DNA, 25 bp, Homo sapien
tggcacaggctctgccgtgtccttg

SEQ ID NO: 586276 - DNA, 25 bp, Homo sapien
gtgaaagactctttttaccagaggt

SEQ ID NO: 586277 - DNA, 25 bp, Homo sapien
ttaccagaggtttcctcttaggtgt

SEQ ID NO: 586278 - DNA, 25 bp, Homo sapien
cagaggtttcctcttaggtgttagg

SEQ ID NO: 586279 - DNA, 25 bp, Homo sapien
gaggtttcctcttaggtgttaggag

SEQ ID NO: 586280 - DNA, 25 bp, Homo sapien
gaccaacatcgtgaaatgccgtctt

SEQ ID NO: 586281 - DNA, 25 bp, Homo sapien
aacatcgtgaaatgccgtctttaca

SEQ ID NO: 586282 - DNA, 25 bp, Homo sapien
tcgtgaaatgccgtctttacaaaaa

SEQ ID NO: 586283 - DNA, 25 bp, Homo sapien
gaagattcttttataaggtggataa

SEQ ID NO: 586284 - DNA, 25 bp, Homo sapien
aggtggataatttactagaaatcta

SEQ ID NO: 586285 - DNA, 25 bp, Homo sapien
gaaatctagaaacccaaaacattgt

SEQ ID NO: 586286 - DNA, 25 bp, Homo sapien
ctagaaacccaaaacattgtgaaat

SEQ ID NO: 586287 - DNA, 25 bp, Homo sapien
atatttctttggatttaattactgt

SEQ ID NO: 586288 - DNA, 25 bp, Homo sapien
aaatctaattgttgagactctcccc

SEQ ID NO: 586289 - DNA, 25 bp, Homo sapien
aattgttgagactctccccatgtaa

SEQ ID NO: 586290 - DNA, 25 bp, Homo sapien
tgttgagactctccccatgtaaatt

SEQ ID NO: 586291 - DNA, 25 bp, Homo sapien
tgagactctccccatgtaaattgtt

SEQ ID NO: 586292 - DNA, 25 bp, Homo sapien
ttcatttgttactcatattacagct

SEQ ID NO: 586293 - DNA, 25 bp, Homo sapien
tttgttactcatattacagctataa

SEQ ID NO: 586294 - DNA, 25 bp, Homo sapien
tcatgcctcagaagtcgagggttca

SEQ ID NO: 586295 - DNA, 25 bp, Homo sapien
atgcctcagaagtcgagggttcagt

SEQ ID NO: 586296 - DNA, 25 bp, Homo sapien
ctcagaagtcgagggttcagtgtgc

SEQ ID NO: 586297 - DNA, 25 bp, Homo sapien
gaagtcgagggttcagtgtgctgtg

SEQ ID NO: 586298 - DNA, 25 bp, Homo sapien
gtgtaccgtaatgtaaactatgggc

SEQ ID NO: 586299 - DNA, 25 bp, Homo sapien
taccgtaatgtaaactatgggcttt

SEQ ID NO: 586300 - DNA, 25 bp, Homo sapien
aactatgggctttgggttattatca

SEQ ID NO: 586301 - DNA, 25 bp, Homo sapien
gggctttgggttattatcatgtgtc

SEQ ID NO: 586302 - DNA, 25 bp, Homo sapien
gctttgggttattatcatgtgtcaa

SEQ ID NO: 586303 - DNA, 25 bp, Homo sapien
ggttattatcatgtgtcaatgtagg

SEQ ID NO: 586304 - DNA, 25 bp, Homo sapien
ataatgagggaggttatgcatgtgt

SEQ ID NO: 586305 - DNA, 25 bp, Homo sapien
cttaaagctctgaaaggctgaggtg

SEQ ID NO: 586306 - DNA, 25 bp, Homo sapien
atggctttagggaaacactgactct

SEQ ID NO: 586307 - DNA, 25 bp, Homo sapien
aacactgactcttttcgttaagcat

SEQ ID NO: 586308 - DNA, 25 bp, Homo sapien
tttcgttaagcatagcagcattctt

SEQ ID NO: 586309 - DNA, 25 bp, Homo sapien
attcttagattattccttgggcctt

SEQ ID NO: 586310 - DNA, 25 bp, Homo sapien
tttgttcaccatcggttcttggatc

SEQ ID NO: 586311 - DNA, 25 bp, Homo sapien
ggttcttggatcttgttcctttcaa

SEQ ID NO: 586312 - DNA, 25 bp, Homo sapien
gttcctttcaagattggtccttaat

SEQ ID NO: 586313 - DNA, 25 bp, Homo sapien
tcaagattggtccttaatgcatttt

SEQ ID NO: 586314 - DNA, 25 bp, Homo sapien
ggatatcaatatcttagtatgctgt

SEQ ID NO: 586315 - DNA, 25 bp, Homo sapien
atgctgtattctgtatgttagctca

SEQ ID NO: 586316 - DNA, 25 bp, Homo sapien
agcacaatgcaggcaaaaagccagt

SEQ ID NO: 586317 - DNA, 25 bp, Homo sapien
gcaaaaagccagtgttaacggagca

SEQ ID NO: 586318 - DNA, 25 bp, Homo sapien
caaaaagccagtgttaacggagcaa

SEQ ID NO: 586319 - DNA, 25 bp, Homo sapien
aaaaagccagtgttaacggagcaag

SEQ ID NO: 586320 - DNA, 25 bp, Homo sapien
aaaagccagtgttaacggagcaaga

SEQ ID NO: 586321 - DNA, 25 bp, Homo sapien
aaagccagtgttaacggagcaagaa

SEQ ID NO: 586322 - DNA, 25 bp, Homo sapien
aagccagtgttaacggagcaagaaa

SEQ ID NO: 586323 - DNA, 25 bp, Homo sapien
agccagtgttaacggagcaagaaac

SEQ ID NO: 586324 - DNA, 25 bp, Homo sapien
gatctgatttctggttatgcctata

SEQ ID NO: 586325 - DNA, 25 bp, Homo sapien
tatccctatagatcattttcttctg

SEQ ID NO: 586326 - DNA, 25 bp, Homo sapien
atgctcctaaacaagtaagccttag

SEQ ID NO: 586327 - DNA, 25 bp, Homo sapien
aagccttagattgtattaatcctga

SEQ ID NO: 586328 - DNA, 25 bp, Homo sapien
aatcctgaggattgataccatttcc

SEQ ID NO: 586329 - DNA, 25 bp, Homo sapien
gataccatttcctcaacactttgtg

SEQ ID NO: 586330 - DNA, 25 bp, Homo sapien
tttcctcaacactttgtggagtatg

SEQ ID NO: 586331 - DNA, 25 bp, Homo sapien
ggagtatgattgacaccagtttttt

SEQ ID NO: 586332 - DNA, 25 bp, Homo sapien
ttgactgcaggtttaacttggctta

SEQ ID NO: 586333 - DNA, 25 bp, Homo sapien
acttggcttatcacttttcgtattg

SEQ ID NO: 586334 - DNA, 25 bp, Homo sapien
tttcgtattgctcagtatgtccaag

SEQ ID NO: 586335 - DNA, 25 bp, Homo sapien
ccataaataaactgctgaggccaaa

SEQ ID NO: 586336 - DNA, 25 bp, Homo sapien
ataaactgctgaggccaaataaaca

SEQ ID NO: 586337 - DNA, 25 bp, Homo sapien
gccaaataaacaactgcattcctat

SEQ ID NO: 586338 - DNA, 25 bp, Homo sapien
aacaactgcattcctataatcgctg

SEQ ID NO: 586339 - DNA, 25 bp, Homo sapien
ctgcattcctataatcgctgccaaa

SEQ ID NO: 586340 - DNA, 25 bp, Homo sapien
cctataatcgctgccaaaaacactg

SEQ ID NO: 586341 - DNA, 25 bp, Homo sapien
aaaacactgcatacatcctcaaaca

SEQ ID NO: 586342 - DNA, 25 bp, Homo sapien
acactgcatacatcctcaaacattg

SEQ ID NO: 586343 - DNA, 25 bp, Homo sapien
gggcaggtttcaactctaattgtta

SEQ ID NO: 586344 - DNA, 25 bp, Homo sapien
actctaattgttacgtggctgcctc

SEQ ID NO: 586345 - DNA, 25 bp, Homo sapien
acgtggctgcctccaacagaatatt

SEQ ID NO: 586346 - DNA, 25 bp, Homo sapien
attgggttggcatttggcttgtcac

SEQ ID NO: 586347 - DNA, 25 bp, Homo sapien
ggcatttggcttgtcaccaggtatt

SEQ ID NO: 586348 - DNA, 25 bp, Homo sapien
caccaggtatttgggatgctcgcag

SEQ ID NO: 586349 - DNA, 25 bp, Homo sapien
ggagaaatacaaaccatcaccttaa

SEQ ID NO: 586350 - DNA, 25 bp, Homo sapien
gaatttcttcctttgtgtgatattt

SEQ ID NO: 586351 - DNA, 25 bp, Homo sapien
attaatattaatgggcctcttaact

SEQ ID NO: 586352 - DNA, 25 bp, Homo sapien
ggcctcttaactgtagctaagatat

SEQ ID NO: 586353 - DNA, 25 bp, Homo sapien
gagtatctttctctcaagatggtca

SEQ ID NO: 586354 - DNA, 25 bp, Homo sapien
gaggctgattaaaaacactttgact

SEQ ID NO: 586355 - DNA, 25 bp, Homo sapien
acactttgacttcgtcagacagaag

SEQ ID NO: 586356 - DNA, 25 bp, Homo sapien
aagggagtattgtatcttgcatgtc

SEQ ID NO: 586357 - DNA, 25 bp, Homo sapien
tcggaattaatttgaaacacatcac

SEQ ID NO: 586358 - DNA, 25 bp, Homo sapien
gaaacacatcacaacataacttgag

SEQ ID NO: 586359 - DNA, 25 bp, Homo sapien
taaatgtttaaaggctgcaaggatt

SEQ ID NO: 586360 - DNA, 25 bp, Homo sapien
ggattgcattataaaagctgtttgt

SEQ ID NO: 586361 - DNA, 25 bp, Homo sapien
gctgtttgttggctttctaagtctt

SEQ ID NO: 586362 - DNA, 25 bp, Homo sapien
ggctttctaagtcttttattcctgt

SEQ ID NO: 586363 - DNA, 25 bp, Homo sapien
tcctgtattgggaataatcagattt

SEQ ID NO: 586364 - DNA, 25 bp, Homo sapien
tattattgtatgcatttcctggttg

SEQ ID NO: 586365 - DNA, 25 bp, Homo sapien
ctggttggaagtttactgggagact

SEQ ID NO: 586366 - DNA, 25 bp, Homo sapien
gaagtttactgggagactgaatgta

SEQ ID NO: 586367 - DNA, 25 bp, Homo sapien
actgggagactgaatgtaatattaa

SEQ ID NO: 586368 - DNA, 25 bp, Homo sapien
aataagaaatatagacaagtggccg

SEQ ID NO: 586369 - DNA, 25 bp, Homo sapien
ataagaaatatagacaagtggccgg

SEQ ID NO: 586370 - DNA, 25 bp, Homo sapien
taagaaatatagacaagtggccggg

SEQ ID NO: 586371 - DNA, 25 bp, Homo sapien
agaaatatagacaagtggccgggca

SEQ ID NO: 586372 - DNA, 25 bp, Homo sapien
gaaatatagacaagtggccgggcac

SEQ ID NO: 586373 - DNA, 25 bp, Homo sapien
aaatatagacaagtggccgggcaca

SEQ ID NO: 586374 - DNA, 25 bp, Homo sapien
aatatagacaagtggccgggcacag

SEQ ID NO: 586375 - DNA, 25 bp, Homo sapien
atatagacaagtggccgggcacagt

SEQ ID NO: 586376 - DNA, 25 bp, Homo sapien
tatagacaagtggccgggcacagtg

SEQ ID NO: 586377 - DNA, 25 bp, Homo sapien
atagacaagtggccgggcacagtgg

SEQ ID NO: 586378 - DNA, 25 bp, Homo sapien
tagacaagtggccgggcacagtggc

SEQ ID NO: 586379 - DNA, 25 bp, Homo sapien
ttttccctgttatggcctctctggg

SEQ ID NO: 586380 - DNA, 25 bp, Homo sapien
tttccctgttatggcctctctgggt

SEQ ID NO: 586381 - DNA, 25 bp, Homo sapien
gcctctctgggtttccaaaattcta

SEQ ID NO: 586382 - DNA, 25 bp, Homo sapien
cctctctgggtttccaaaattctat

SEQ ID NO: 586383 - DNA, 25 bp, Homo sapien
ctctctgggtttccaaaattctatc

SEQ ID NO: 586384 - DNA, 25 bp, Homo sapien
tctgggtttccaaaattctatctct

SEQ ID NO: 586385 - DNA, 25 bp, Homo sapien
ctgggtttccaaaattctatctctt

SEQ ID NO: 586386 - DNA, 25 bp, Homo sapien
ccaaaattctatctcttttttctct

SEQ ID NO: 586387 - DNA, 25 bp, Homo sapien
tgaaatgattttcaaacctaacttt

SEQ ID NO: 586388 - DNA, 25 bp, Homo sapien
ttcaaacctaactttacccatgtag

SEQ ID NO: 586389 - DNA, 25 bp, Homo sapien
cctaactttacccatgtagccatga

SEQ ID NO: 586390 - DNA, 25 bp, Homo sapien
gtctgggacgagctgccccatgtca

SEQ ID NO: 586391 - DNA, 25 bp, Homo sapien
agctgccccatgtcacacgtctatg

SEQ ID NO: 586392 - DNA, 25 bp, Homo sapien
atgtcacacgtctatgtgcatgtgc

SEQ ID NO: 586393 - DNA, 25 bp, Homo sapien
tcacacgtctatgtgcatgtgcaca

SEQ ID NO: 586394 - DNA, 25 bp, Homo sapien
acctcactagactctccgggagatg

SEQ ID NO: 586395 - DNA, 25 bp, Homo sapien
ctgggagagcccacgattggtgatt

SEQ ID NO: 586396 - DNA, 25 bp, Homo sapien
ccacgattggtgatttgggtgtgtt

SEQ ID NO: 586397 - DNA, 25 bp, Homo sapien
agtgcctgtgggatttgtcccggtc

SEQ ID NO: 586398 - DNA, 25 bp, Homo sapien
ggatttgtcccggtcagagcctcag

SEQ ID NO: 586399 - DNA, 25 bp, Homo sapien
atttgtcccggtcagagcctcaggg

SEQ ID NO: 586400 - DNA, 25 bp, Homo sapien
agcttcccaggcaataacagccgtg

SEQ ID NO: 586401 - DNA, 25 bp, Homo sapien
ataaaaatagatggagtggctgggc

SEQ ID NO: 586402 - DNA, 25 bp, Homo sapien
taaaaatagatggagtggctgggca

SEQ ID NO: 586403 - DNA, 25 bp, Homo sapien
aaaaatagatggagtggctgggcat

SEQ ID NO: 586404 - DNA, 25 bp, Homo sapien
aaaatagatggagtggctgggcatg

SEQ ID NO: 586405 - DNA, 25 bp, Homo sapien
aaatagatggagtggctgggcatgg

SEQ ID NO: 586406 - DNA, 25 bp, Homo sapien
aatagatggagtggctgggcatggg

SEQ ID NO: 586407 - DNA, 25 bp, Homo sapien
gatggagtggctgggcatgggggct

SEQ ID NO: 586408 - DNA, 25 bp, Homo sapien
atggagtggctgggcatgggggctc

SEQ ID NO: 586409 - DNA, 25 bp, Homo sapien
ggagtggctgggcatgggggctcac

SEQ ID NO: 586410 - DNA, 25 bp, Homo sapien
gatgcaggagagttgtttgaaccca

SEQ ID NO: 586411 - DNA, 25 bp, Homo sapien
gtggacattacagtgagcccagatt

SEQ ID NO: 586412 - DNA, 25 bp, Homo sapien
ttgtttcctagttacctccagctga

SEQ ID NO: 586413 - DNA, 25 bp, Homo sapien
tttcctagttacctccagctgacca

SEQ ID NO: 586414 - DNA, 25 bp, Homo sapien
tccagctgaccatactaccagagtg

SEQ ID NO: 586415 - DNA, 25 bp, Homo sapien
gaccatactaccagagtgaggcagt

SEQ ID NO: 586416 - DNA, 25 bp, Homo sapien
actaccagagtgaggcagtacttca

SEQ ID NO: 586417 - DNA, 25 bp, Homo sapien
gaggcagtacttcacatcctgggag

SEQ ID NO: 586418 - DNA, 25 bp, Homo sapien
gcagtacttcacatcctgggagata

SEQ ID NO: 586419 - DNA, 25 bp, Homo sapien
acatcctgggagatatgccctcgga

SEQ ID NO: 586420 - DNA, 25 bp, Homo sapien
ggagatatgccctcggaacccatga

SEQ ID NO: 586421 - DNA, 25 bp, Homo sapien
atgccctcggaacccatgaatgtta

SEQ ID NO: 586422 - DNA, 25 bp, Homo sapien
ccctcggaacccatgaatgttattt

SEQ ID NO: 586423 - DNA, 25 bp, Homo sapien
aatggtgttatggataggtacgaaa

SEQ ID NO: 586424 - DNA, 25 bp, Homo sapien
atatgcttctgaaacatttagcagg

SEQ ID NO: 586425 - DNA, 25 bp, Homo sapien
aagtgctgtgatatctgcaaatcgc

SEQ ID NO: 586426 - DNA, 25 bp, Homo sapien
tgtgatatctgcaaatcgctttcaa

SEQ ID NO: 586427 - DNA, 25 bp, Homo sapien
aatcgctttcaaatggcatagcaaa

SEQ ID NO: 586428 - DNA, 25 bp, Homo sapien
gggaaacgtggcacatgttcatgat

SEQ ID NO: 586429 - DNA, 25 bp, Homo sapien
gcacatgttcatgattgatcagtct

SEQ ID NO: 586430 - DNA, 25 bp, Homo sapien
gattgatcagtctacatgaaggata

SEQ ID NO: 586431 - DNA, 25 bp, Homo sapien
tagaggatcattctttcagtttttc

SEQ ID NO: 586432 - DNA, 25 bp, Homo sapien
ggcaaaaatgtcactggtacctggt

SEQ ID NO: 586433 - DNA, 25 bp, Homo sapien
aaatgtcactggtacctggtaccaa

SEQ ID NO: 586434 - DNA, 25 bp, Homo sapien
aaaaggcataaataagagtactgac

SEQ ID NO: 586435 - DNA, 25 bp, Homo sapien
aaaggcataaataagagtactgacc

SEQ ID NO: 586436 - DNA, 25 bp, Homo sapien
aaggcataaataagagtactgacca

SEQ ID NO: 586437 - DNA, 25 bp, Homo sapien
aggcataaataagagtactgaccag

SEQ ID NO: 586438 - DNA, 25 bp, Homo sapien
ggcataaataagagtactgaccagg

SEQ ID NO: 586439 - DNA, 25 bp, Homo sapien
gcataaataagagtactgaccaggc

SEQ ID NO: 586440 - DNA, 25 bp, Homo sapien
cataaataagagtactgaccaggcg

SEQ ID NO: 586441 - DNA, 25 bp, Homo sapien
ataaataagagtactgaccaggcgc

SEQ ID NO: 586442 - DNA, 25 bp, Homo sapien
taaataagagtactgaccaggcgcg

SEQ ID NO: 586443 - DNA, 25 bp, Homo sapien
aaataagagtactgaccaggcgcgg

SEQ ID NO: 586444 - DNA, 25 bp, Homo sapien
aataagagtactgaccaggcgcggt

SEQ ID NO: 586445 - DNA, 25 bp, Homo sapien
ataaattttcctggtatagtgtcct

SEQ ID NO: 586446 - DNA, 25 bp, Homo sapien
aattttcctggtatagtgtccttct

SEQ ID NO: 586447 - DNA, 25 bp, Homo sapien
attttcctggtatagtgtccttctc

SEQ ID NO: 586448 - DNA, 25 bp, Homo sapien
ttcctggtatagtgtccttctctag

SEQ ID NO: 586449 - DNA, 25 bp, Homo sapien
ttctctagacctcatgtcctacagt

SEQ ID NO: 586450 - DNA, 25 bp, Homo sapien
ctctagacctcatgtcctacagtct

SEQ ID NO: 586451 - DNA, 25 bp, Homo sapien
atgtcctacagtctctgtgaaactg

SEQ ID NO: 586452 - DNA, 25 bp, Homo sapien
tacagtctctgtgaaactgggccaa

SEQ ID NO: 586453 - DNA, 25 bp, Homo sapien
agtctctgtgaaactgggccaaaga

SEQ ID NO: 586454 - DNA, 25 bp, Homo sapien
gaaactgggccaaagatagaatttt

SEQ ID NO: 586455 - DNA, 25 bp, Homo sapien
aacctatgacctcacacaaatctgt

SEQ ID NO: 586456 - DNA, 25 bp, Homo sapien
aaaagtggagtcatgaaaaacagtt

SEQ ID NO: 586457 - DNA, 25 bp, Homo sapien
agtggagtcatgaaaaacagttgag

SEQ ID NO: 586458 - DNA, 25 bp, Homo sapien
ggagtcatgaaaaacagttgaggct

SEQ ID NO: 586459 - DNA, 25 bp, Homo sapien
gagtcatgaaaaacagttgaggctg

SEQ ID NO: 586460 - DNA, 25 bp, Homo sapien
gtcatgaaaaacagttgaggctggg

SEQ ID NO: 586461 - DNA, 25 bp, Homo sapien
catgaaaaacagttgaggctgggta

SEQ ID NO: 586462 - DNA, 25 bp, Homo sapien
aggctgggtagagtgactcgcacct

SEQ ID NO: 586463 - DNA, 25 bp, Homo sapien
gctgggtagagtgactcgcacctgt

SEQ ID NO: 586464 - DNA, 25 bp, Homo sapien
gcactttgggattactcccaggctg

SEQ ID NO: 586465 - DNA, 25 bp, Homo sapien
cactttgggattactcccaggctga

SEQ ID NO: 586466 - DNA, 25 bp, Homo sapien
actttgggattactcccaggctgag

SEQ ID NO: 586467 - DNA, 25 bp, Homo sapien
gaattgttacagtgaatatgtctta

SEQ ID NO: 586468 - DNA, 25 bp, Homo sapien
tgtcttaatacaggccagagtcatt

SEQ ID NO: 586469 - DNA, 25 bp, Homo sapien
tacaggccagagtcatttaggtaaa

SEQ ID NO: 586470 - DNA, 25 bp, Homo sapien
attacctcatatctattctttgcag

SEQ ID NO: 586471 - DNA, 25 bp, Homo sapien
catatctattctttgcagtatcact

SEQ ID NO: 586472 - DNA, 25 bp, Homo sapien
gcagtatcacttaaaggtgtttatt

SEQ ID NO: 586473 - DNA, 25 bp, Homo sapien
aaggtgtttatttagcggcaaagat

SEQ ID NO: 586474 - DNA, 25 bp, Homo sapien
ttgccccatggctatttacggtatg

SEQ ID NO: 586475 - DNA, 25 bp, Homo sapien
ccccatggctatttacggtatgaaa

SEQ ID NO: 586476 - DNA, 25 bp, Homo sapien
tgccattctggctgtaaactattgc

SEQ ID NO: 586477 - DNA, 25 bp, Homo sapien
ggctgtaaactattgcaggttatca

SEQ ID NO: 586478 - DNA, 25 bp, Homo sapien
accgggcgctggagcagtcacagag

SEQ ID NO: 586479 - DNA, 25 bp, Homo sapien
accagcaccagtccctcaagaggaa

SEQ ID NO: 586480 - DNA, 25 bp, Homo sapien
agcaccagtccctcaagaggaaact

SEQ ID NO: 586481 - DNA, 25 bp, Homo sapien
caccagtccctcaagaggaaactca

SEQ ID NO: 586482 - DNA, 25 bp, Homo sapien
cccctaagcctggagggatacgtca

SEQ ID NO: 586483 - DNA, 25 bp, Homo sapien
aagcctggagggatacgtcagctca

SEQ ID NO: 586484 - DNA, 25 bp, Homo sapien
gcctggagggatacgtcagctcagc

SEQ ID NO: 586485 - DNA, 25 bp, Homo sapien
tggagggatacgtcagctcagcgcc

SEQ ID NO: 586486 - DNA, 25 bp, Homo sapien
gagggatacgtcagctcagcgccac

SEQ ID NO: 586487 - DNA, 25 bp, Homo sapien
ggatacgtcagctcagcgccactga

SEQ ID NO: 586488 - DNA, 25 bp, Homo sapien
atacgtcagctcagcgccactgaca

SEQ ID NO: 586489 - DNA, 25 bp, Homo sapien
tcgcttgaaccaggcagtcggaact

SEQ ID NO: 586490 - DNA, 25 bp, Homo sapien
gcttgaaccaggcagtcggaacttg

SEQ ID NO: 586491 - DNA, 25 bp, Homo sapien
cttgaaccaggcagtcggaacttgt

SEQ ID NO: 586492 - DNA, 25 bp, Homo sapien
ttgaaccaggcagtcggaacttgta

SEQ ID NO: 586493 - DNA, 25 bp, Homo sapien
tgaaccaggcagtcggaacttgtag

SEQ ID NO: 586494 - DNA, 25 bp, Homo sapien
gaaccaggcagtcggaacttgtagt

SEQ ID NO: 586495 - DNA, 25 bp, Homo sapien
accaggcagtcggaacttgtagtga

SEQ ID NO: 586496 - DNA, 25 bp, Homo sapien
ccaggcagtcggaacttgtagtgag

SEQ ID NO: 586497 - DNA, 25 bp, Homo sapien
caggcagtcggaacttgtagtgagc

SEQ ID NO: 586498 - DNA, 25 bp, Homo sapien
ggcagtcggaacttgtagtgagcca

SEQ ID NO: 586499 - DNA, 25 bp, Homo sapien
gcagtcggaacttgtagtgagccaa

SEQ ID NO: 586500 - DNA, 25 bp, Homo sapien
tgcccggacgagaacaccatctagt

SEQ ID NO: 586501 - DNA, 25 bp, Homo sapien
aacaccatctagtgtcttcacacaa

SEQ ID NO: 586502 - DNA, 25 bp, Homo sapien
ttcacacaacacacccacatttggt

SEQ ID NO: 586503 - DNA, 25 bp, Homo sapien
cacccacatttggtggtttctgttt

SEQ ID NO: 586504 - DNA, 25 bp, Homo sapien
tttctgtttcccatgaagatgaaag

SEQ ID NO: 586505 - DNA, 25 bp, Homo sapien
gggattccctgagccctgataggag

SEQ ID NO: 586506 - DNA, 25 bp, Homo sapien
ttcaactgggcgaggaagggaccat

SEQ ID NO: 586507 - DNA, 25 bp, Homo sapien
gaagggaccatcaggccaacccatg

SEQ ID NO: 586508 - DNA, 25 bp, Homo sapien
aggccaacccatgtaggtggaccca

SEQ ID NO: 586509 - DNA, 25 bp, Homo sapien
gtaggtggacccactcagctctcag

SEQ ID NO: 586510 - DNA, 25 bp, Homo sapien
agggctctggttttgttctctagaa

SEQ ID NO: 586511 - DNA, 25 bp, Homo sapien
ctagcaatctcttttgcctgtggat

SEQ ID NO: 586512 - DNA, 25 bp, Homo sapien
tagcaatctcttttgcctgtggatt

SEQ ID NO: 586513 - DNA, 25 bp, Homo sapien
agcaatctcttttgcctgtggatta

SEQ ID NO: 586514 - DNA, 25 bp, Homo sapien
gtttaacagtattgtttcaatgggt

SEQ ID NO: 586515 - DNA, 25 bp, Homo sapien
tattgtttcaatgggtaaaatgtac

SEQ ID NO: 586516 - DNA, 25 bp, Homo sapien
tgtttacctatttatggcatatata

SEQ ID NO: 586517 - DNA, 25 bp, Homo sapien
atacaggcatacaatttgtaatcac

SEQ ID NO: 586518 - DNA, 25 bp, Homo sapien
aggcatacaatttgtaatcacatca

SEQ ID NO: 586519 - DNA, 25 bp, Homo sapien
gagtaaatgaggtattcattaccta

SEQ ID NO: 586520 - DNA, 25 bp, Homo sapien
gaggtattcattacctaatgcattt

SEQ ID NO: 586521 - DNA, 25 bp, Homo sapien
ggtattcattacctaatgcattttt

SEQ ID NO: 586522 - DNA, 25 bp, Homo sapien
gggcaaagagccctaggaccccaca

SEQ ID NO: 586523 - DNA, 25 bp, Homo sapien
ggcaaagagccctaggaccccacag

SEQ ID NO: 586524 - DNA, 25 bp, Homo sapien
gcaaagagccctaggaccccacaga

SEQ ID NO: 586525 - DNA, 25 bp, Homo sapien
caaagagccctaggaccccacagaa

SEQ ID NO: 586526 - DNA, 25 bp, Homo sapien
aaagagccctaggaccccacagaag

SEQ ID NO: 586527 - DNA, 25 bp, Homo sapien
aagagccctaggaccccacagaaga

SEQ ID NO: 586528 - DNA, 25 bp, Homo sapien
agagccctaggaccccacagaagag

SEQ ID NO: 586529 - DNA, 25 bp, Homo sapien
gagccctaggaccccacagaagagc

SEQ ID NO: 586530 - DNA, 25 bp, Homo sapien
agccctaggaccccacagaagagcc

SEQ ID NO: 586531 - DNA, 25 bp, Homo sapien
cacagaagagcccctccctctccat

SEQ ID NO: 586532 - DNA, 25 bp, Homo sapien
acagaagagcccctccctctccatt

SEQ ID NO: 586533 - DNA, 25 bp, Homo sapien
tgcagtatgtctggtccagccacaa

SEQ ID NO: 586534 - DNA, 25 bp, Homo sapien
gcagtatgtctggtccagccacaac

SEQ ID NO: 586535 - DNA, 25 bp, Homo sapien
agtatgtctggtccagccacaacct

SEQ ID NO: 586536 - DNA, 25 bp, Homo sapien
tatgtctggtccagccacaacctca

SEQ ID NO: 586537 - DNA, 25 bp, Homo sapien
tggtccagccacaacctcacatgga

SEQ ID NO: 586538 - DNA, 25 bp, Homo sapien
ggtccagccacaacctcacatggag

SEQ ID NO: 586539 - DNA, 25 bp, Homo sapien
agccacaacctcacatggagccggt

SEQ ID NO: 586540 - DNA, 25 bp, Homo sapien
gccacaacctcacatggagccggtg

SEQ ID NO: 586541 - DNA, 25 bp, Homo sapien
aacctcacatggagccggtgcctgg

SEQ ID NO: 586542 - DNA, 25 bp, Homo sapien
acctcacatggagccggtgcctgga

SEQ ID NO: 586543 - DNA, 25 bp, Homo sapien
ctgtctgctgcagccggcatgcctg

SEQ ID NO: 586544 - DNA, 25 bp, Homo sapien
gtttgtagaacttcaaaggacctag

SEQ ID NO: 586545 - DNA, 25 bp, Homo sapien
aaggacctagagtagccaaacaact

SEQ ID NO: 586546 - DNA, 25 bp, Homo sapien
gagtagccaaacaacttcacaaaag

SEQ ID NO: 586547 - DNA, 25 bp, Homo sapien
agaagaaccaagttagacgactaat

SEQ ID NO: 586548 - DNA, 25 bp, Homo sapien
gacgactaatattactagattttta

SEQ ID NO: 586549 - DNA, 25 bp, Homo sapien
ggagttattctaaagcaacagtaat

SEQ ID NO: 586550 - DNA, 25 bp, Homo sapien
cagtgtggtattgacatgaaggata

SEQ ID NO: 586551 - DNA, 25 bp, Homo sapien
aggatataccaatagatcaatgata

SEQ ID NO: 586552 - DNA, 25 bp, Homo sapien
caatgatataggatttgtgtccaga

SEQ ID NO: 586553 - DNA, 25 bp, Homo sapien
ttgtgtccagaatgtaaagtacttt

SEQ ID NO: 586554 - DNA, 25 bp, Homo sapien
gtaaagtactttcaaaactcagcaa

SEQ ID NO: 586555 - DNA, 25 bp, Homo sapien
agcctgggttatactgtgtacatgt

SEQ ID NO: 586556 - DNA, 25 bp, Homo sapien
aaaaaggcccaggaaaccatgcact

SEQ ID NO: 586557 - DNA, 25 bp, Homo sapien
gaaaccatgcactgagttcctatat

SEQ ID NO: 586558 - DNA, 25 bp, Homo sapien
gcactgagttcctatatttcatttt

SEQ ID NO: 586559 - DNA, 25 bp, Homo sapien
taaatgctccagctacacccaagga

SEQ ID NO: 586560 - DNA, 25 bp, Homo sapien
tgtaattctaacaccgcaggcagcc

SEQ ID NO: 586561 - DNA, 25 bp, Homo sapien
gcagcccctgctgacgagatacaga

SEQ ID NO: 586562 - DNA, 25 bp, Homo sapien
gatacagaggagtaacgacagttaa

SEQ ID NO: 586563 - DNA, 25 bp, Homo sapien
taatagtaaacgaagcgaagccccg

SEQ ID NO: 586564 - DNA, 25 bp, Homo sapien
aggtgtagcgagcatgtccacgaca

SEQ ID NO: 586565 - DNA, 25 bp, Homo sapien
atgtccacgacagccagtcactgat

SEQ ID NO: 586566 - DNA, 25 bp, Homo sapien
gaattattctcatttaccagacatt

SEQ ID NO: 586567 - DNA, 25 bp, Homo sapien
ttgcccgaaaaatgccttttctaca

SEQ ID NO: 586568 - DNA, 25 bp, Homo sapien
aatcacaatctgtttggaagtttgc

SEQ ID NO: 586569 - DNA, 25 bp, Homo sapien
ggaagtttgctttgctcaatgtcat

SEQ ID NO: 586570 - DNA, 25 bp, Homo sapien
gctcaatgtcataagttggtttaca

SEQ ID NO: 586571 - DNA, 25 bp, Homo sapien
ggtttacaattcaatcgaatgccct

SEQ ID NO: 586572 - DNA, 25 bp, Homo sapien
aattcaatcgaatgccctggtttgt

SEQ ID NO: 586573 - DNA, 25 bp, Homo sapien
aatcgaatgccctggtttgtcacag

SEQ ID NO: 586574 - DNA, 25 bp, Homo sapien
tgccctggtttgtcacaggagctca

SEQ ID NO: 586575 - DNA, 25 bp, Homo sapien
acaggagctcaccaataagcaaaac

SEQ ID NO: 586576 - DNA, 25 bp, Homo sapien
caataagcaaaacagccaagccttt

SEQ ID NO: 586577 - DNA, 25 bp, Homo sapien
cagtcaagttcacctcaaaagcaga

SEQ ID NO: 586578 - DNA, 25 bp, Homo sapien
agttcacctcaaaagcagactagct

SEQ ID NO: 586579 - DNA, 25 bp, Homo sapien
aaaagcagactagctcaggaacaaa

SEQ ID NO: 586580 - DNA, 25 bp, Homo sapien
tgactcaatagcaagatccccgtgt

SEQ ID NO: 586581 - DNA, 25 bp, Homo sapien
gatccccgtgtaaatctcccaaagg

SEQ ID NO: 586582 - DNA, 25 bp, Homo sapien
taaatctcccaaagggtataccaat

SEQ ID NO: 586583 - DNA, 25 bp, Homo sapien
aagtacaaacagcaaagcattctca

SEQ ID NO: 586584 - DNA, 25 bp, Homo sapien
ttctcattttcggtcacattccaga

SEQ ID NO: 586585 - DNA, 25 bp, Homo sapien
cggtcacattccagatctcgaagtt

SEQ ID NO: 586586 - DNA, 25 bp, Homo sapien
gatctcgaagttatcgtcataaaaa

SEQ ID NO: 586587 - DNA, 25 bp, Homo sapien
aaacagttggtgaacagcaacagaa

SEQ ID NO: 586588 - DNA, 25 bp, Homo sapien
ctcatgcccgccagtgcacagggaa

SEQ ID NO: 586589 - DNA, 25 bp, Homo sapien
tcatgcccgccagtgcacagggaag

SEQ ID NO: 586590 - DNA, 25 bp, Homo sapien
catgcccgccagtgcacagggaagg

SEQ ID NO: 586591 - DNA, 25 bp, Homo sapien
cccgccagtgcacagggaagggctt

SEQ ID NO: 586592 - DNA, 25 bp, Homo sapien
ggccagcgctgttgaggggtcccct

SEQ ID NO: 586593 - DNA, 25 bp, Homo sapien
gggtcccctctggaatgcactgaat

SEQ ID NO: 586594 - DNA, 25 bp, Homo sapien
ggtcccctctggaatgcactgaata

SEQ ID NO: 586595 - DNA, 25 bp, Homo sapien
gtcccctctggaatgcactgaataa

SEQ ID NO: 586596 - DNA, 25 bp, Homo sapien
cctctggaatgcactgaataaagca

SEQ ID NO: 586597 - DNA, 25 bp, Homo sapien
tggaatgcactgaataaagcacgtg

SEQ ID NO: 586598 - DNA, 25 bp, Homo sapien
atgcactgaataaagcacgtgcaag

SEQ ID NO: 586599 - DNA, 25 bp, Homo sapien
tatgattttaacaacgacgactaca

SEQ ID NO: 586600 - DNA, 25 bp, Homo sapien
aacaacgacgactacatttgtgcgt

SEQ ID NO: 586601 - DNA, 25 bp, Homo sapien
gactacatttgtgcgtgggacctgg

SEQ ID NO: 586602 - DNA, 25 bp, Homo sapien
acatttgtgcgtgggacctggagca

SEQ ID NO: 586603 - DNA, 25 bp, Homo sapien
agtgccgaggaggtgagcctggtat

SEQ ID NO: 586604 - DNA, 25 bp, Homo sapien
agaacatgatcctccgggcaccaga

SEQ ID NO: 586605 - DNA, 25 bp, Homo sapien
agcaccttccacatccgaatctgat

SEQ ID NO: 586606 - DNA, 25 bp, Homo sapien
ttccacatccgaatctgatggcacc

SEQ ID NO: 586607 - DNA, 25 bp, Homo sapien
atccgaatctgatggcaccacagag

SEQ ID NO: 586608 - DNA, 25 bp, Homo sapien
gatggcaccacagaggagccgagct

SEQ ID NO: 586609 - DNA, 25 bp, Homo sapien
acccgctgtggactctggtttctga

SEQ ID NO: 586610 - DNA, 25 bp, Homo sapien
aggaggctgaatttggaggatccct

SEQ ID NO: 586611 - DNA, 25 bp, Homo sapien
tgaggctgcattgaggtataatttt

SEQ ID NO: 586612 - DNA, 25 bp, Homo sapien
gaggctgcattgaggtataattttg

SEQ ID NO: 586613 - DNA, 25 bp, Homo sapien
ggctgcattgaggtataattttgcc

SEQ ID NO: 586614 - DNA, 25 bp, Homo sapien
gctgcattgaggtataattttgcca

SEQ ID NO: 586615 - DNA, 25 bp, Homo sapien
ttgaggtataattttgccactgtat

SEQ ID NO: 586616 - DNA, 25 bp, Homo sapien
tgaggtataattttgccactgtatt

SEQ ID NO: 586617 - DNA, 25 bp, Homo sapien
gaggtataattttgccactgtattt

SEQ ID NO: 586618 - DNA, 25 bp, Homo sapien
aggtataattttgccactgtatttc

SEQ ID NO: 586619 - DNA, 25 bp, Homo sapien
gtataattttgccactgtatttcag

SEQ ID NO: 586620 - DNA, 25 bp, Homo sapien
tataattttgccactgtatttcagc

SEQ ID NO: 586621 - DNA, 25 bp, Homo sapien
ttgatgacctttcttgaattagcat

SEQ ID NO: 586622 - DNA, 25 bp, Homo sapien
atgacctttcttgaattagcatttt

SEQ ID NO: 586623 - DNA, 25 bp, Homo sapien
aagatgaggcatgatttagagggtt

SEQ ID NO: 586624 - DNA, 25 bp, Homo sapien
gaggcatgatttagagggttttctt

SEQ ID NO: 586625 - DNA, 25 bp, Homo sapien
gcatgatttagagggttttcttggt

SEQ ID NO: 586626 - DNA, 25 bp, Homo sapien
gtaataatggcatcaatatacataa

SEQ ID NO: 586627 - DNA, 25 bp, Homo sapien
taaactatacacttaatgatacatg

SEQ ID NO: 586628 - DNA, 25 bp, Homo sapien
tgatacatgtttccaattatccttt

SEQ ID NO: 586629 - DNA, 25 bp, Homo sapien
tccaattatcctttttcaatgagaa

SEQ ID NO: 586630 - DNA, 25 bp, Homo sapien
agaagctcgtctactagggaaaaat

SEQ ID NO: 586631 - DNA, 25 bp, Homo sapien
gaagctcgtctactagggaaaaata

SEQ ID NO: 586632 - DNA, 25 bp, Homo sapien
gtggccccactgtttgtcagttaca

SEQ ID NO: 586633 - DNA, 25 bp, Homo sapien
ccccactgtttgtcagttacactgt

SEQ ID NO: 586634 - DNA, 25 bp, Homo sapien
gttacactgtggaggtgagcgtcac

SEQ ID NO: 586635 - DNA, 25 bp, Homo sapien
cactgtggaggtgagcgtcacaaac

SEQ ID NO: 586636 - DNA, 25 bp, Homo sapien
cgtcacaaacgcagggtggagtttt

SEQ ID NO: 586637 - DNA, 25 bp, Homo sapien
aacgcagggtggagttttcccgcag

SEQ ID NO: 586638 - DNA, 25 bp, Homo sapien
gagttttcccgcagctgtgtgacgt

SEQ ID NO: 586639 - DNA, 25 bp, Homo sapien
ttcccgcagctgtgtgacgtgaggt

SEQ ID NO: 586640 - DNA, 25 bp, Homo sapien
gtaacatttatgctctaatatcaac

SEQ ID NO: 586641 - DNA, 25 bp, Homo sapien
tgctctaatatcaacgtaacataaa

SEQ ID NO: 586642 - DNA, 25 bp, Homo sapien
gttacaatatgttaacacatcatgg

SEQ ID NO: 586643 - DNA, 25 bp, Homo sapien
gaatcagtaggttctgtgtaaggca

SEQ ID NO: 586644 - DNA, 25 bp, Homo sapien
gagtaggctttgtaatgcaggtgaa

SEQ ID NO: 586645 - DNA, 25 bp, Homo sapien
tgcaggtgaatctcatccaatcagt

SEQ ID NO: 586646 - DNA, 25 bp, Homo sapien
ggaaggaattctgccctaagaccgc

SEQ ID NO: 586647 - DNA, 25 bp, Homo sapien
tctgccctaagaccgcaacatagaa

SEQ ID NO: 586648 - DNA, 25 bp, Homo sapien
gaaatcctgcttggaaattcaagga

SEQ ID NO: 586649 - DNA, 25 bp, Homo sapien
gggactaaagactgcaagatcaact

SEQ ID NO: 586650 - DNA, 25 bp, Homo sapien
gatcaactcttagcagaacttccag

SEQ ID NO: 586651 - DNA, 25 bp, Homo sapien
agaacttccaggctgactgcttgct

SEQ ID NO: 586652 - DNA, 25 bp, Homo sapien
caggctgactgcttgctttatggat

SEQ ID NO: 586653 - DNA, 25 bp, Homo sapien
actgcttgctttatggattttggac

SEQ ID NO: 586654 - DNA, 25 bp, Homo sapien
aacctccttgcctgtgtaggcatat

SEQ ID NO: 586655 - DNA, 25 bp, Homo sapien
gcctgtgtaggcatatttcttctga

SEQ ID NO: 586656 - DNA, 25 bp, Homo sapien
ggcatatttcttctgaacctgacca

SEQ ID NO: 586657 - DNA, 25 bp, Homo sapien
ttctgaacctgaccacacaagtaca

SEQ ID NO: 586658 - DNA, 25 bp, Homo sapien
acacaagtacaacattttggtaact

SEQ ID NO: 586659 - DNA, 25 bp, Homo sapien
cagtatttttgtaatcttagccata

SEQ ID NO: 586660 - DNA, 25 bp, Homo sapien
gtaatcttagccatagtcctatgag

SEQ ID NO: 586661 - DNA, 25 bp, Homo sapien
gtacataagagcaaacaattcagga

SEQ ID NO: 586662 - DNA, 25 bp, Homo sapien
gaatgatgtgaaataactggcagca

SEQ ID NO: 586663 - DNA, 25 bp, Homo sapien
ggtatatgttttgcttctggatttt

SEQ ID NO: 586664 - DNA, 25 bp, Homo sapien
gaaattgtgctaatcatgtttacaa

SEQ ID NO: 586665 - DNA, 25 bp, Homo sapien
aaagccatgtttcagttcctattgc

SEQ ID NO: 586666 - DNA, 25 bp, Homo sapien
gtttcagttcctattgcagttcttc

SEQ ID NO: 586667 - DNA, 25 bp, Homo sapien
agttcctattgcagttcttcgaata

SEQ ID NO: 586668 - DNA, 25 bp, Homo sapien
gttcttcgaataagtgcttcaggat

SEQ ID NO: 586669 - DNA, 25 bp, Homo sapien
caggatcttgatcgtacttgtctag

SEQ ID NO: 586670 - DNA, 25 bp, Homo sapien
cttgatcgtacttgtctagactttc

SEQ ID NO: 586671 - DNA, 25 bp, Homo sapien
gtctagactttctatccaaagctct

SEQ ID NO: 586672 - DNA, 25 bp, Homo sapien
ctttctatccaaagctctgctcttg

SEQ ID NO: 586673 - DNA, 25 bp, Homo sapien
gctgatctgggtgcaaagggtttta

SEQ ID NO: 586674 - DNA, 25 bp, Homo sapien
ggtgcaaagggttttaacagccatt

SEQ ID NO: 586675 - DNA, 25 bp, Homo sapien
agggttttaacagccattgagtgga

SEQ ID NO: 586676 - DNA, 25 bp, Homo sapien
gtcattttctgatcactgggctcgc

SEQ ID NO: 586677 - DNA, 25 bp, Homo sapien
tcactgggctcgctgaacttgaaaa

SEQ ID NO: 586678 - DNA, 25 bp, Homo sapien
agtaaagacatcatgttttctcctt

SEQ ID NO: 586679 - DNA, 25 bp, Homo sapien
tcattcctctctctatttccttttt

SEQ ID NO: 586680 - DNA, 25 bp, Homo sapien
tttcctttttctcatcaactgtctc

SEQ ID NO: 586681 - DNA, 25 bp, Homo sapien
caactgtctccttagaggtctcagg

SEQ ID NO: 586682 - DNA, 25 bp, Homo sapien
gtgggatctggccatcactatcaac

SEQ ID NO: 586683 - DNA, 25 bp, Homo sapien
acctgtcctagctgacttctgaagg

SEQ ID NO: 586684 - DNA, 25 bp, Homo sapien
gacatagctgtacagctgctcagca

SEQ ID NO: 586685 - DNA, 25 bp, Homo sapien
gcagcaaagccgcaggttacttaga

SEQ ID NO: 586686 - DNA, 25 bp, Homo sapien
aggttacttagacacctcttctcct

SEQ ID NO: 586687 - DNA, 25 bp, Homo sapien
gcaagagtgtttggcagacgttttt

SEQ ID NO: 586688 - DNA, 25 bp, Homo sapien
cagacgttttttggatgtgctacag

SEQ ID NO: 586689 - DNA, 25 bp, Homo sapien
ttggatgtgctacaggctttcctcc

SEQ ID NO: 586690 - DNA, 25 bp, Homo sapien
ttcctcccttgttgcttatttttat

SEQ ID NO: 586691 - DNA, 25 bp, Homo sapien
ttattgacaaacatccctaatgtgt

SEQ ID NO: 586692 - DNA, 25 bp, Homo sapien
taacttttgaggacagttacttctg

SEQ ID NO: 586693 - DNA, 25 bp, Homo sapien
gacagttacttctgtgataaactct

SEQ ID NO: 586694 - DNA, 25 bp, Homo sapien
gataaactcttcaagtaagaccgtt

SEQ ID NO: 586695 - DNA, 25 bp, Homo sapien
aagaccgttataagatagatttgga

SEQ ID NO: 586696 - DNA, 25 bp, Homo sapien
aattaaagccccagttgcatttcag

SEQ ID NO: 586697 - DNA, 25 bp, Homo sapien
gccccagttgcatttcagtaactca

SEQ ID NO: 586698 - DNA, 25 bp, Homo sapien
acactggagtagagtaggcccctaa

SEQ ID NO: 586699 - DNA, 25 bp, Homo sapien
aggcccctaatgcaatatcactggt

SEQ ID NO: 586700 - DNA, 25 bp, Homo sapien
ggtgtccttgtaagatagttatatg

SEQ ID NO: 586701 - DNA, 25 bp, Homo sapien
tagttatatgtctgcctggttctgt

SEQ ID NO: 586702 - DNA, 25 bp, Homo sapien
aaatgggtatatgaagactgggaca

SEQ ID NO: 586703 - DNA, 25 bp, Homo sapien
gagaatgccatgtgaccacggaggc

SEQ ID NO: 586704 - DNA, 25 bp, Homo sapien
gagctgcagtgacaagccaaggaca

SEQ ID NO: 586705 - DNA, 25 bp, Homo sapien
aggacatcaaggacggcaggccact

SEQ ID NO: 586706 - DNA, 25 bp, Homo sapien
gcaggccactgccaaaagccaggga

SEQ ID NO: 586707 - DNA, 25 bp, Homo sapien
gctcctgagacctggttttcagagg

SEQ ID NO: 586708 - DNA, 25 bp, Homo sapien
acctggttttcagagggagcacagc

SEQ ID NO: 586709 - DNA, 25 bp, Homo sapien
tttccattgtggtattaagtttaat

SEQ ID NO: 586710 - DNA, 25 bp, Homo sapien
ttccattgtggtattaagtttaata

SEQ ID NO: 586711 - DNA, 25 bp, Homo sapien
gatcacgagataacatgtaattaat

SEQ ID NO: 586712 - DNA, 25 bp, Homo sapien
attctcagtgaatgacatgtcatga

SEQ ID NO: 586713 - DNA, 25 bp, Homo sapien
ttctcagtgaatgacatgtcatgaa

SEQ ID NO: 586714 - DNA, 25 bp, Homo sapien
tctcagtgaatgacatgtcatgaaa

SEQ ID NO: 586715 - DNA, 25 bp, Homo sapien
gaatgacatgtcatgaaatcatcag

SEQ ID NO: 586716 - DNA, 25 bp, Homo sapien
atgacatgtcatgaaatcatcagaa

SEQ ID NO: 586717 - DNA, 25 bp, Homo sapien
atgaggatatgggaaaagctttatg

SEQ ID NO: 586718 - DNA, 25 bp, Homo sapien
gaggatatgggaaaagctttatgaa

SEQ ID NO: 586719 - DNA, 25 bp, Homo sapien
ggatatgggaaaagctttatgaaag

SEQ ID NO: 586720 - DNA, 25 bp, Homo sapien
ggaagaagaggttttctctgacaag

SEQ ID NO: 586721 - DNA, 25 bp, Homo sapien
gaagaggttttctctgacaagagcc

SEQ ID NO: 586722 - DNA, 25 bp, Homo sapien
agaggttttctctgacaagagccta

SEQ ID NO: 586723 - DNA, 25 bp, Homo sapien
ttcccttggtgaatttggaaacttg

SEQ ID NO: 586724 - DNA, 25 bp, Homo sapien
tcccttggtgaatttggaaacttga

SEQ ID NO: 586725 - DNA, 25 bp, Homo sapien
acagcaggctccatgttcttctggc

SEQ ID NO: 586726 - DNA, 25 bp, Homo sapien
agcaggctccatgttcttctggcct

SEQ ID NO: 586727 - DNA, 25 bp, Homo sapien
caggctccatgttcttctggcctca

SEQ ID NO: 586728 - DNA, 25 bp, Homo sapien
tggcctcactgtactgtgtaaggaa

SEQ ID NO: 586729 - DNA, 25 bp, Homo sapien
ggcctcactgtactgtgtaaggaaa

SEQ ID NO: 586730 - DNA, 25 bp, Homo sapien
gcctcactgtactgtgtaaggaaag

SEQ ID NO: 586731 - DNA, 25 bp, Homo sapien
gagtcagtaactctttttcttgata

SEQ ID NO: 586732 - DNA, 25 bp, Homo sapien
agtcagtaactctttttcttgataa

SEQ ID NO: 586733 - DNA, 25 bp, Homo sapien
ttgataaaaactaccatgtcagcca

SEQ ID NO: 586734 - DNA, 25 bp, Homo sapien
tgataaaaactaccatgtcagccaa

SEQ ID NO: 586735 - DNA, 25 bp, Homo sapien
gataaaaactaccatgtcagccaag

SEQ ID NO: 586736 - DNA, 25 bp, Homo sapien
ataaaaactaccatgtcagccaagc

SEQ ID NO: 586737 - DNA, 25 bp, Homo sapien
taaaaactaccatgtcagccaagca

SEQ ID NO: 586738 - DNA, 25 bp, Homo sapien
aaactaccatgtcagccaagcacgg

SEQ ID NO: 586739 - DNA, 25 bp, Homo sapien
taccatgtcagccaagcacggtggt

SEQ ID NO: 586740 - DNA, 25 bp, Homo sapien
atgtcagccaagcacggtggttcac

SEQ ID NO: 586741 - DNA, 25 bp, Homo sapien
gggctgatttcttgagcccatgagc

SEQ ID NO: 586742 - DNA, 25 bp, Homo sapien
cgcaccgtggctggagtcctgagca

SEQ ID NO: 586743 - DNA, 25 bp, Homo sapien
ctgagcagcaccttctggacagggg

SEQ ID NO: 586744 - DNA, 25 bp, Homo sapien
ctggcactggttgggtacctgatac

SEQ ID NO: 586745 - DNA, 25 bp, Homo sapien
cactggttgggtacctgatacggga

SEQ ID NO: 586746 - DNA, 25 bp, Homo sapien
tacctgatacgggactggcgatggc

SEQ ID NO: 586747 - DNA, 25 bp, Homo sapien
tgatacgggactggcgatggcttct

SEQ ID NO: 586748 - DNA, 25 bp, Homo sapien
acgggactggcgatggcttctgcta

SEQ ID NO: 586749 - DNA, 25 bp, Homo sapien
tggcgatggcttctgctagctgtca

SEQ ID NO: 586750 - DNA, 25 bp, Homo sapien
atggcttctgctagctgtcaccctg

SEQ ID NO: 586751 - DNA, 25 bp, Homo sapien
tctgctagctgtcaccctgccttgt

SEQ ID NO: 586752 - DNA, 25 bp, Homo sapien
agcaccgcaccgtggctggagtcct

SEQ ID NO: 586753 - DNA, 25 bp, Homo sapien
agcctcctgtagagcccactcgtgg

SEQ ID NO: 586754 - DNA, 25 bp, Homo sapien
tagagcccactcgtgggtgcacctt

SEQ ID NO: 586755 - DNA, 25 bp, Homo sapien
gtgggtgcaccttcctcagaggaga

SEQ ID NO: 586756 - DNA, 25 bp, Homo sapien
gggtgcaccttcctcagaggagaca

SEQ ID NO: 586757 - DNA, 25 bp, Homo sapien
cccctaccctttatgtcatagaatg

SEQ ID NO: 586758 - DNA, 25 bp, Homo sapien
gtcatagaatgctgtcactgagcct

SEQ ID NO: 586759 - DNA, 25 bp, Homo sapien
agaatgctgtcactgagccttccta

SEQ ID NO: 586760 - DNA, 25 bp, Homo sapien
tgtcactgagccttcctaactatac

SEQ ID NO: 586761 - DNA, 25 bp, Homo sapien
actgagccttcctaactatacatac

SEQ ID NO: 586762 - DNA, 25 bp, Homo sapien
gagccttcctaactatacatacaat

SEQ ID NO: 586763 - DNA, 25 bp, Homo sapien
gaactgctaagcatggatttgcatt

SEQ ID NO: 586764 - DNA, 25 bp, Homo sapien
cttccacttggcatgcttttgcttc

SEQ ID NO: 586765 - DNA, 25 bp, Homo sapien
ttttgcttctgacctaaggctcctg

SEQ ID NO: 586766 - DNA, 25 bp, Homo sapien
ggagggctgttcttgtgctactgcc

SEQ ID NO: 586767 - DNA, 25 bp, Homo sapien
ttttgtgcccacctatagaaagact

SEQ ID NO: 586768 - DNA, 25 bp, Homo sapien
gaaagactgaagtacctgggttatc

SEQ ID NO: 586769 - DNA, 25 bp, Homo sapien
tatcaacgagggtggctcttagcca

SEQ ID NO: 586770 - DNA, 25 bp, Homo sapien
agaatggaagcccagataccctgcc

SEQ ID NO: 586771 - DNA, 25 bp, Homo sapien
ggcagggacatctcagaggcattgt

SEQ ID NO: 586772 - DNA, 25 bp, Homo sapien
attgtttacagttgagagctcccct

SEQ ID NO: 586773 - DNA, 25 bp, Homo sapien
agagctccccttcaggtcaggctga

SEQ ID NO: 586774 - DNA, 25 bp, Homo sapien
aactgtctgagatccttgcatggct

SEQ ID NO: 586775 - DNA, 25 bp, Homo sapien
aaaagtggagtcatgaaaaacagtt

SEQ ID NO: 586776 - DNA, 25 bp, Homo sapien
aaagtggagtcatgaaaaacagttg

SEQ ID NO: 586777 - DNA, 25 bp, Homo sapien
agtggagtcatgaaaaacagttgag

SEQ ID NO: 586778 - DNA, 25 bp, Homo sapien
tggagtcatgaaaaacagttgaggc

SEQ ID NO: 586779 - DNA, 25 bp, Homo sapien
ggagtcatgaaaaacagttgaggct

SEQ ID NO: 586780 - DNA, 25 bp, Homo sapien
gagtcatgaaaaacagttgaggctg

SEQ ID NO: 586781 - DNA, 25 bp, Homo sapien
gtcatgaaaaacagttgaggctggg

SEQ ID NO: 586782 - DNA, 25 bp, Homo sapien
aggctgggtagagtgactcgcacct

SEQ ID NO: 586783 - DNA, 25 bp, Homo sapien
gctgggtagagtgactcgcacctgt

SEQ ID NO: 586784 - DNA, 25 bp, Homo sapien
gcactttgggattactcccaggctg

SEQ ID NO: 586785 - DNA, 25 bp, Homo sapien
cactttgggattactcccaggctga

SEQ ID NO: 586786 - DNA, 25 bp, Homo sapien
gagatgccctaaagaggactgagtg

SEQ ID NO: 586787 - DNA, 25 bp, Homo sapien
gagcagagtatgtggatacccggaa

SEQ ID NO: 586788 - DNA, 25 bp, Homo sapien
gtggatacccggaaacacacacaca

SEQ ID NO: 586789 - DNA, 25 bp, Homo sapien
tcgtcgtcatcatcttgctgagtca

SEQ ID NO: 586790 - DNA, 25 bp, Homo sapien
catcatcttgctgagtcatcatcat

SEQ ID NO: 586791 - DNA, 25 bp, Homo sapien
gtcgtcgtcatcatcttgctgagtg

SEQ ID NO: 586792 - DNA, 25 bp, Homo sapien
atcatcttgctgagtgtctcttgaa

SEQ ID NO: 586793 - DNA, 25 bp, Homo sapien
gagtgtctcttgaagtacaggctgt

SEQ ID NO: 586794 - DNA, 25 bp, Homo sapien
gtctcttgaagtacaggctgtgaca

SEQ ID NO: 586795 - DNA, 25 bp, Homo sapien
gtgacaggttgtgggccattttcct

SEQ ID NO: 586796 - DNA, 25 bp, Homo sapien
ggttgtgggccattttcctgaactc

SEQ ID NO: 586797 - DNA, 25 bp, Homo sapien
atcctttttatattacaatatgcca

SEQ ID NO: 586798 - DNA, 25 bp, Homo sapien
tacaatatgccaatatattccaata

SEQ ID NO: 586799 - DNA, 25 bp, Homo sapien
gccaatatattccaatatagtggta

SEQ ID NO: 586800 - DNA, 25 bp, Homo sapien
aagattctagataacttcttcatag

SEQ ID NO: 586801 - DNA, 25 bp, Homo sapien
gataacttcttcatagagttcgcaa

SEQ ID NO: 586802 - DNA, 25 bp, Homo sapien
taacttcttcatagagttcgcaaaa

SEQ ID NO: 586803 - DNA, 25 bp, Homo sapien
cttcttcatagagttcgcaaaatat

SEQ ID NO: 586804 - DNA, 25 bp, Homo sapien
tagagttcgcaaaatataggtcaaa

SEQ ID NO: 586805 - DNA, 25 bp, Homo sapien
gagttcgcaaaatataggtcaaatt

SEQ ID NO: 586806 - DNA, 25 bp, Homo sapien
ataggtcaaatttatggttatcatt

SEQ ID NO: 586807 - DNA, 25 bp, Homo sapien
ggtcaaatttatggttatcattatt

SEQ ID NO: 586808 - DNA, 25 bp, Homo sapien
tttttcatacatattttgccctaaa

SEQ ID NO: 586809 - DNA, 25 bp, Homo sapien
tctgtttggactatgcaaatattgc

SEQ ID NO: 586810 - DNA, 25 bp, Homo sapien
gctaagctgagccacttattttgaa

SEQ ID NO: 586811 - DNA, 25 bp, Homo sapien
gagccacttattttgaatatgccca

SEQ ID NO: 586812 - DNA, 25 bp, Homo sapien
gaatatgcccatgtgagctaaataa

SEQ ID NO: 586813 - DNA, 25 bp, Homo sapien
aattagggtttttcacatgatactg

SEQ ID NO: 586814 - DNA, 25 bp, Homo sapien
ttttcacatgatactgattctgcat

SEQ ID NO: 586815 - DNA, 25 bp, Homo sapien
gaatcataagaaatgctgcacatat

SEQ ID NO: 586816 - DNA, 25 bp, Homo sapien
gaaatgctgcacatataataatggc

SEQ ID NO: 586817 - DNA, 25 bp, Homo sapien
atggcaatactttatgtttttatag

SEQ ID NO: 586818 - DNA, 25 bp, Homo sapien
agtatttttacatatgcaattgaga

SEQ ID NO: 586819 - DNA, 25 bp, Homo sapien
accacgggggcgtcctgtagctatg

SEQ ID NO: 586820 - DNA, 25 bp, Homo sapien
ggcgtcctgtagctatgccagcggg

SEQ ID NO: 586821 - DNA, 25 bp, Homo sapien
ggccagccgggcatcctgaccgatg

SEQ ID NO: 586822 - DNA, 25 bp, Homo sapien
agccgggcatcctgaccgatgggca

SEQ ID NO: 586823 - DNA, 25 bp, Homo sapien
gatgggcaccctctcccagggcagg

SEQ ID NO: 586824 - DNA, 25 bp, Homo sapien
ggaatgtcactgttggacaattatt

SEQ ID NO: 586825 - DNA, 25 bp, Homo sapien
gcaatgatactaaacaactctctga

SEQ ID NO: 586826 - DNA, 25 bp, Homo sapien
aacaactctctgaaatttctcaagc

SEQ ID NO: 586827 - DNA, 25 bp, Homo sapien
ctctgaaatttctcaagcaccaaga

SEQ ID NO: 586828 - DNA, 25 bp, Homo sapien
tcaagcaccaagagaaacatcattt

SEQ ID NO: 586829 - DNA, 25 bp, Homo sapien
aacatcattttagcaaaggccagga

SEQ ID NO: 586830 - DNA, 25 bp, Homo sapien
atttgcttttattgcggcgcatggc

SEQ ID NO: 586831 - DNA, 25 bp, Homo sapien
ttattgcggcgcatggcatgtcaaa

SEQ ID NO: 586832 - DNA, 25 bp, Homo sapien
gcgcatggcatgtcaaagattcaaa

SEQ ID NO: 586833 - DNA, 25 bp, Homo sapien
tgtcaaagattcaaaatgccagctc

SEQ ID NO: 586834 - DNA, 25 bp, Homo sapien
aatgccagctcttcataagtcacag

SEQ ID NO: 586835 - DNA, 25 bp, Homo sapien
gccagctcttcataagtcacagttg

SEQ ID NO: 586836 - DNA, 25 bp, Homo sapien
gtcagaattttctcttgttttcaac

SEQ ID NO: 586837 - DNA, 25 bp, Homo sapien
tttcatgtaggttctccttgatcat

SEQ ID NO: 586838 - DNA, 25 bp, Homo sapien
ggttctccttgatcatttacttttt

SEQ ID NO: 586839 - DNA, 25 bp, Homo sapien
tatggtaattttcaactttgtacct

SEQ ID NO: 586840 - DNA, 25 bp, Homo sapien
gtaccttttatgaccatgtattgtt

SEQ ID NO: 586841 - DNA, 25 bp, Homo sapien
gaccatgtgtagattgcgtggaccc

SEQ ID NO: 586842 - DNA, 25 bp, Homo sapien
tgtagattgcgtggaccccgacaaa

SEQ ID NO: 586843 - DNA, 25 bp, Homo sapien
ggaccccgacaaagggaaggctgct

SEQ ID NO: 586844 - DNA, 25 bp, Homo sapien
caagtgtgttgggaattgcatgcca

SEQ ID NO: 586845 - DNA, 25 bp, Homo sapien
gttgggaattgcatgccatctccac

SEQ ID NO: 586846 - DNA, 25 bp, Homo sapien
tgagcctgacctttctgagtgacat

SEQ ID NO: 586847 - DNA, 25 bp, Homo sapien
ctttctgagtgacatgggtgtgcca

SEQ ID NO: 586848 - DNA, 25 bp, Homo sapien
tgacatgggtgtgccaggctagact

SEQ ID NO: 586849 - DNA, 25 bp, Homo sapien
gctagactaggaggttccggtgtct

SEQ ID NO: 586850 - DNA, 25 bp, Homo sapien
ccggtgtctggaaaagcactttaca

SEQ ID NO: 586851 - DNA, 25 bp, Homo sapien
ccaaataagcatctgtgtaacctcc

SEQ ID NO: 586852 - DNA, 25 bp, Homo sapien
gattattaggattagcgtactttta

SEQ ID NO: 586853 - DNA, 25 bp, Homo sapien
cttttatatatctttagtggctgag

SEQ ID NO: 586854 - DNA, 25 bp, Homo sapien
gaagatagtgtagccctgtgtcgct

SEQ ID NO: 586855 - DNA, 25 bp, Homo sapien
atagtgtagccctgtgtcgcttaac

SEQ ID NO: 586856 - DNA, 25 bp, Homo sapien
tgtagccctgtgtcgcttaacaaca

SEQ ID NO: 586857 - DNA, 25 bp, Homo sapien
taacaacagggatacactttaagaa

SEQ ID NO: 586858 - DNA, 25 bp, Homo sapien
acactttaagaaatgtcgttaggca

SEQ ID NO: 586859 - DNA, 25 bp, Homo sapien
atgtcgttaggcaattttgtcattg

SEQ ID NO: 586860 - DNA, 25 bp, Homo sapien
cagtgagatggctagtttatggaaa

SEQ ID NO: 586861 - DNA, 25 bp, Homo sapien
agatttgttaagcagtaccctcaga

SEQ ID NO: 586862 - DNA, 25 bp, Homo sapien
gcagtaccctcagattaaagattat

SEQ ID NO: 586863 - DNA, 25 bp, Homo sapien
tgacgttacatgtctatacaagatt

SEQ ID NO: 586864 - DNA, 25 bp, Homo sapien
ttagaaagctccagacgagactagt

SEQ ID NO: 586865 - DNA, 25 bp, Homo sapien
acgagactagtagagctgtcactgt

SEQ ID NO: 586866 - DNA, 25 bp, Homo sapien
agagctgtcactgtccttcggcagg

SEQ ID NO: 586867 - DNA, 25 bp, Homo sapien
gtcactgtccttcggcaggtgtgta

SEQ ID NO: 586868 - DNA, 25 bp, Homo sapien
ttcggcaggtgtgtagcctgtctgt

SEQ ID NO: 586869 - DNA, 25 bp, Homo sapien
gggacaaaattgtactcacctcatg

SEQ ID NO: 586870 - DNA, 25 bp, Homo sapien
tactcacctcatgaactcttactga

SEQ ID NO: 586871 - DNA, 25 bp, Homo sapien
ggcacgagagccgtatttatctcac

SEQ ID NO: 586872 - DNA, 25 bp, Homo sapien
gagccgtatttatctcaccctggag

SEQ ID NO: 586873 - DNA, 25 bp, Homo sapien
accctggagctgcttaaatctgcaa

SEQ ID NO: 586874 - DNA, 25 bp, Homo sapien
ataagacatcagtcagtacatgtga

SEQ ID NO: 586875 - DNA, 25 bp, Homo sapien
gacatcagtcagtacatgtgaggtg

SEQ ID NO: 586876 - DNA, 25 bp, Homo sapien
cagtcagtacatgtgaggtgtgcat

SEQ ID NO: 586877 - DNA, 25 bp, Homo sapien
gtacatgtgaggtgtgcattggatt

SEQ ID NO: 586878 - DNA, 25 bp, Homo sapien
gtgaggtgtgcattggattgatcca

SEQ ID NO: 586879 - DNA, 25 bp, Homo sapien
gaggtgtgcattggattgatccaga

SEQ ID NO: 586880 - DNA, 25 bp, Homo sapien
gattgatccagaaagtcaggacgac

SEQ ID NO: 586881 - DNA, 25 bp, Homo sapien
gatccagaaagtcaggacgactcca

SEQ ID NO: 586882 - DNA, 25 bp, Homo sapien
gaaagtcaggacgactccaagtgga

SEQ ID NO: 586883 - DNA, 25 bp, Homo sapien
agtcaggacgactccaagtggaaag

SEQ ID NO: 586884 - DNA, 25 bp, Homo sapien
tccaagtggaaaggcctccagagac

SEQ ID NO: 586885 - DNA, 25 bp, Homo sapien
gtttcctgtacctaacaatttgcat

SEQ ID NO: 586886 - DNA, 25 bp, Homo sapien
tttgcatatggcacagaatgcctgt

SEQ ID NO: 586887 - DNA, 25 bp, Homo sapien
ttttcacagagcattttcaccagta

SEQ ID NO: 586888 - DNA, 25 bp, Homo sapien
cagagcattttcaccagtaaacatt

SEQ ID NO: 586889 - DNA, 25 bp, Homo sapien
ctcagagattggatgtttgaaacac

SEQ ID NO: 586890 - DNA, 25 bp, Homo sapien
aagtgagaagctctatgaaagtcat

SEQ ID NO: 586891 - DNA, 25 bp, Homo sapien
gaaagtcatgaatgtgatacaactc

SEQ ID NO: 586892 - DNA, 25 bp, Homo sapien
gatacaactctatggcattttcaga

SEQ ID NO: 586893 - DNA, 25 bp, Homo sapien
aagagtacacatattctaaacatgg

SEQ ID NO: 586894 - DNA, 25 bp, Homo sapien
taaacatggaatgcacttcacacat

SEQ ID NO: 586895 - DNA, 25 bp, Homo sapien
ggaatgcacttcacacataatatgt

SEQ ID NO: 586896 - DNA, 25 bp, Homo sapien
tagcaacctggccaagaaagaccca

SEQ ID NO: 586897 - DNA, 25 bp, Homo sapien
gaaagacccaatgtcgagtgaacat

SEQ ID NO: 586898 - DNA, 25 bp, Homo sapien
gaacataaagaacacagggaggcca

SEQ ID NO: 586899 - DNA, 25 bp, Homo sapien
cctctctctaccatcaaaaatacca

SEQ ID NO: 586900 - DNA, 25 bp, Homo sapien
aattaacagggcatggaggtgctca

SEQ ID NO: 586901 - DNA, 25 bp, Homo sapien
attaacagggcatggaggtgctcaa

SEQ ID NO: 586902 - DNA, 25 bp, Homo sapien
taacagggcatggaggtgctcaaga

SEQ ID NO: 586903 - DNA, 25 bp, Homo sapien
gcatggaggtgctcaagaggctgaa

SEQ ID NO: 586904 - DNA, 25 bp, Homo sapien
caagaggctgaagcggaaaaatcac

SEQ ID NO: 586905 - DNA, 25 bp, Homo sapien
gctgaagcggaaaaatcacctgagc

SEQ ID NO: 586906 - DNA, 25 bp, Homo sapien
ctgaagcggaaaaatcacctgagcc

SEQ ID NO: 586907 - DNA, 25 bp, Homo sapien
tgtgcatgtaggcatctatgtaagt

SEQ ID NO: 586908 - DNA, 25 bp, Homo sapien
gcatgtaggcatctatgtaagtggt

SEQ ID NO: 586909 - DNA, 25 bp, Homo sapien
atgtaggcatctatgtaagtggtta

SEQ ID NO: 586910 - DNA, 25 bp, Homo sapien
taggcatctatgtaagtggttaagt

SEQ ID NO: 586911 - DNA, 25 bp, Homo sapien
ggcatctatgtaagtggttaagtga

SEQ ID NO: 586912 - DNA, 25 bp, Homo sapien
gtggttaagtgagaattcaaaccca

SEQ ID NO: 586913 - DNA, 25 bp, Homo sapien
gaattcaaacccaggtggtatgact

SEQ ID NO: 586914 - DNA, 25 bp, Homo sapien
attcaaacccaggtggtatgactcc

SEQ ID NO: 586915 - DNA, 25 bp, Homo sapien
ttcaaacccaggtggtatgactcca

SEQ ID NO: 586916 - DNA, 25 bp, Homo sapien
tcaaacccaggtggtatgactccag

SEQ ID NO: 586917 - DNA, 25 bp, Homo sapien
caaacccaggtggtatgactccaga

SEQ ID NO: 586918 - DNA, 25 bp, Homo sapien
aatcttgttgcctgaactattttac

SEQ ID NO: 586919 - DNA, 25 bp, Homo sapien
gttgcctgaactattttacacttaa

SEQ ID NO: 586920 - DNA, 25 bp, Homo sapien
tgcctgaactattttacacttaagg

SEQ ID NO: 586921 - DNA, 25 bp, Homo sapien
taaggagccagatcttttagtgagg

SEQ ID NO: 586922 - DNA, 25 bp, Homo sapien
gccagatcttttagtgaggctatcc

SEQ ID NO: 586923 - DNA, 25 bp, Homo sapien
agatcttttagtgaggctatcctga

SEQ ID NO: 586924 - DNA, 25 bp, Homo sapien
atcttttagtgaggctatcctgaca

SEQ ID NO: 586925 - DNA, 25 bp, Homo sapien
gacttgacctaaactctgtattatt

SEQ ID NO: 586926 - DNA, 25 bp, Homo sapien
cttgacctaaactctgtattattgg

SEQ ID NO: 586927 - DNA, 25 bp, Homo sapien
aaactctgtattattggtcataaca

SEQ ID NO: 586928 - DNA, 25 bp, Homo sapien
attggccaatttagtccaatggaca

SEQ ID NO: 586929 - DNA, 25 bp, Homo sapien
ccgtctcagtaggtggcagctctat

SEQ ID NO: 586930 - DNA, 25 bp, Homo sapien
gtggcagctctatttgtccggttac

SEQ ID NO: 586931 - DNA, 25 bp, Homo sapien
tatttgtccggttactgagaccaaa

SEQ ID NO: 586932 - DNA, 25 bp, Homo sapien
tgagaccaaatattagagtcctcct

SEQ ID NO: 586933 - DNA, 25 bp, Homo sapien
tagagtcctccttaatttcctctct

SEQ ID NO: 586934 - DNA, 25 bp, Homo sapien
aaatcctgttgacagcctgggcaat

SEQ ID NO: 586935 - DNA, 25 bp, Homo sapien
gcaatatggcaagaatccatctcac

SEQ ID NO: 586936 - DNA, 25 bp, Homo sapien
tagcacactgatgtggcacaggcaa

SEQ ID NO: 586937 - DNA, 25 bp, Homo sapien
aggcaaggaatatggctgaggcacc

SEQ ID NO: 586938 - DNA, 25 bp, Homo sapien
tgaggcaccaatttgctgctactgc

SEQ ID NO: 586939 - DNA, 25 bp, Homo sapien
gctgctactgctgtctaacaggcat

SEQ ID NO: 586940 - DNA, 25 bp, Homo sapien
aaaccctgagtatgaacttaaggct

SEQ ID NO: 586941 - DNA, 25 bp, Homo sapien
acttaaggctgtctttctggagcat

SEQ ID NO: 586942 - DNA, 25 bp, Homo sapien
tgagaattgccagaatgtgctgtct

SEQ ID NO: 586943 - DNA, 25 bp, Homo sapien
aatgtgctgtctgcccgtggttacc

SEQ ID NO: 586944 - DNA, 25 bp, Homo sapien
tgctgactccggtgggaacacatgt

SEQ ID NO: 586945 - DNA, 25 bp, Homo sapien
gactccggtgggaacacatgttaaa

SEQ ID NO: 586946 - DNA, 25 bp, Homo sapien
gaattctggaatgtatctcgagtga

SEQ ID NO: 586947 - DNA, 25 bp, Homo sapien
atctcgagtgatcagagccctgggt

SEQ ID NO: 586948 - DNA, 25 bp, Homo sapien
cctgggtggtaaaccaaaggctctg

SEQ ID NO: 586949 - DNA, 25 bp, Homo sapien
cccttccagttgaaggtcatgtctg

SEQ ID NO: 586950 - DNA, 25 bp, Homo sapien
ttgaaggtcatgtctggaagaggta

SEQ ID NO: 586951 - DNA, 25 bp, Homo sapien
gatcaagatccacacaggacagccc

SEQ ID NO: 586952 - DNA, 25 bp, Homo sapien
caggctttgggcttcaattggagag

SEQ ID NO: 586953 - DNA, 25 bp, Homo sapien
gagatgtcagggatggttccaaagt

SEQ ID NO: 586954 - DNA, 25 bp, Homo sapien
ggttccaaagtgaagaggtctccat

SEQ ID NO: 586955 - DNA, 25 bp, Homo sapien
ggtctccatggcaacaggacaccag

SEQ ID NO: 586956 - DNA, 25 bp, Homo sapien
atggcaacaggacaccagcaagtgt

SEQ ID NO: 586957 - DNA, 25 bp, Homo sapien
ccagcaagtgtgtgggagtcgcact

SEQ ID NO: 586958 - DNA, 25 bp, Homo sapien
agtcgcactggtgtgacggccagaa

SEQ ID NO: 586959 - DNA, 25 bp, Homo sapien
ggtgtgacggccagaactggactca

SEQ ID NO: 586960 - DNA, 25 bp, Homo sapien
gaactggactcagatttcagcccca

SEQ ID NO: 586961 - DNA, 25 bp, Homo sapien
ccatccccaatgaagagcttgagtt

SEQ ID NO: 586962 - DNA, 25 bp, Homo sapien
tgtcattttgacagtgttcatagca

SEQ ID NO: 586963 - DNA, 25 bp, Homo sapien
ttcccgtccataagaaacaacttct

SEQ ID NO: 586964 - DNA, 25 bp, Homo sapien
aagttttcttatgagattgcaggaa

SEQ ID NO: 586965 - DNA, 25 bp, Homo sapien
attgagtcacatcttcagactcccc

SEQ ID NO: 586966 - DNA, 25 bp, Homo sapien
tgtttccaccacatcggcagttatt

SEQ ID NO: 586967 - DNA, 25 bp, Homo sapien
tcggcagttatttcctccattgaag

SEQ ID NO: 586968 - DNA, 25 bp, Homo sapien
tccattgaagtctggaatccctcaa

SEQ ID NO: 586969 - DNA, 25 bp, Homo sapien
ctggaatccctcaaagtcatctgtg

SEQ ID NO: 586970 - DNA, 25 bp, Homo sapien
tcaaagtcatctgtgagggctggaa

SEQ ID NO: 586971 - DNA, 25 bp, Homo sapien
gggctggaatcatctttcaaactcc

SEQ ID NO: 586972 - DNA, 25 bp, Homo sapien
atctttcaaactcctattcatgttg

SEQ ID NO: 586973 - DNA, 25 bp, Homo sapien
ttggcaattttcctggctacaatct

SEQ ID NO: 586974 - DNA, 25 bp, Homo sapien
caattttcctggctacaatctcaga

SEQ ID NO: 586975 - DNA, 25 bp, Homo sapien
tgaaaacgaactactttgtttacag

SEQ ID NO: 586976 - DNA, 25 bp, Homo sapien
gtatttaatccatcttatttgcaat

SEQ ID NO: 586977 - DNA, 25 bp, Homo sapien
tttactcttcaggacataataatgt

SEQ ID NO: 586978 - DNA, 25 bp, Homo sapien
ttaatgtgtgtacccagcagtgctc

SEQ ID NO: 586979 - DNA, 25 bp, Homo sapien
ccagcagtgctctcttgaaggaacc

SEQ ID NO: 586980 - DNA, 25 bp, Homo sapien
tgctctcttgaaggaaccaggacca

SEQ ID NO: 586981 - DNA, 25 bp, Homo sapien
atccagagaggtggcgtttcgcaca

SEQ ID NO: 586982 - DNA, 25 bp, Homo sapien
gcgtttcgcacattccatagatttt

SEQ ID NO: 586983 - DNA, 25 bp, Homo sapien
gcacattccatagattttgttggta

SEQ ID NO: 586984 - DNA, 25 bp, Homo sapien
ttgttgaatgaatttagcaccaaag

SEQ ID NO: 586985 - DNA, 25 bp, Homo sapien
tgttgaatgaatttagcaccaaagg

SEQ ID NO: 586986 - DNA, 25 bp, Homo sapien
gttgaatgaatttagcaccaaaggt

SEQ ID NO: 586987 - DNA, 25 bp, Homo sapien
ttgaatgaatttagcaccaaaggtg

SEQ ID NO: 586988 - DNA, 25 bp, Homo sapien
tgaatgaatttagcaccaaaggtga

SEQ ID NO: 586989 - DNA, 25 bp, Homo sapien
gaatgaatttagcaccaaaggtgaa

SEQ ID NO: 586990 - DNA, 25 bp, Homo sapien
aatttagcaccaaaggtgaagagct

SEQ ID NO: 586991 - DNA, 25 bp, Homo sapien
tttagcaccaaaggtgaagagctga

SEQ ID NO: 586992 - DNA, 25 bp, Homo sapien
ggtgaagagctgataaaagacattt

SEQ ID NO: 586993 - DNA, 25 bp, Homo sapien
gtgaagagctgataaaagacatttt

SEQ ID NO: 586994 - DNA, 25 bp, Homo sapien
gaagagctgataaaagacatttttt

SEQ ID NO: 586995 - DNA, 25 bp, Homo sapien
gaaacatgacagttactgcttcaac

SEQ ID NO: 586996 - DNA, 25 bp, Homo sapien
actgcttcaaccacgtgatcaaagt

SEQ ID NO: 586997 - DNA, 25 bp, Homo sapien
tgatcaaagttagcaccacccagta

SEQ ID NO: 586998 - DNA, 25 bp, Homo sapien
caaagttagcaccacccagtaaggg

SEQ ID NO: 586999 - DNA, 25 bp, Homo sapien
tagcaccacccagtaagggaacaca

SEQ ID NO: 587000 - DNA, 25 bp, Homo sapien
gggaacacacatatatgccttctga

SEQ ID NO: 587001 - DNA, 25 bp, Homo sapien
atgccttctgataggatccattgag

SEQ ID NO: 587002 - DNA, 25 bp, Homo sapien
ggatccattgaggagacacatcact

SEQ ID NO: 587003 - DNA, 25 bp, Homo sapien
aggagacacatcacttcgtagctct

SEQ ID NO: 587004 - DNA, 25 bp, Homo sapien
cacatcacttcgtagctcttaacaa

SEQ ID NO: 587005 - DNA, 25 bp, Homo sapien
cacttcgtagctcttaacaagtctg

SEQ ID NO: 587006 - DNA, 25 bp, Homo sapien
tgggacaggtctgcccatccttaat

SEQ ID NO: 587007 - DNA, 25 bp, Homo sapien
caggtctgcccatccttaattacta

SEQ ID NO: 587008 - DNA, 25 bp, Homo sapien
tattggctggagttactgactggtt

SEQ ID NO: 587009 - DNA, 25 bp, Homo sapien
actgactggtttttaggtcactgaa

SEQ ID NO: 587010 - DNA, 25 bp, Homo sapien
gtcactgaagcaccaagattcctgt

SEQ ID NO: 587011 - DNA, 25 bp, Homo sapien
aagcaccaagattcctgtacagagc

SEQ ID NO: 587012 - DNA, 25 bp, Homo sapien
ttcctgtacagagctactgagcaaa

SEQ ID NO: 587013 - DNA, 25 bp, Homo sapien
gagctactgagcaaagtacttgttc

SEQ ID NO: 587014 - DNA, 25 bp, Homo sapien
acttgttcacaattttcagtctaac

SEQ ID NO: 587015 - DNA, 25 bp, Homo sapien
gagaactctaagtctttagcataga

SEQ ID NO: 587016 - DNA, 25 bp, Homo sapien
gttaatgttgtgtcataagaaccaa

SEQ ID NO: 587017 - DNA, 25 bp, Homo sapien
aaacatattttctctgcctagaatt

SEQ ID NO: 587018 - DNA, 25 bp, Homo sapien
gcctagaatttacccctgagcatct

SEQ ID NO: 587019 - DNA, 25 bp, Homo sapien
gagcatcttctgtataaagctaggt

SEQ ID NO: 587020 - DNA, 25 bp, Homo sapien
aagctaggtctctaagctctgagat

SEQ ID NO: 587021 - DNA, 25 bp, Homo sapien
aattctgtctgaaacatccaagtgt

SEQ ID NO: 587022 - DNA, 25 bp, Homo sapien
aaatcatgcacttagtttgcaagat

SEQ ID NO: 587023 - DNA, 25 bp, Homo sapien
aacattttagatgctgacagtacca

SEQ ID NO: 587024 - DNA, 25 bp, Homo sapien
gatgctgacagtaccaaaagccaag

SEQ ID NO: 587025 - DNA, 25 bp, Homo sapien
aagccaagtttctagtctcttaaca

SEQ ID NO: 587026 - DNA, 25 bp, Homo sapien
gtctcttaacagtctatggaacctt

SEQ ID NO: 587027 - DNA, 25 bp, Homo sapien
gtctatggaaccttgttttttgatt

SEQ ID NO: 587028 - DNA, 25 bp, Homo sapien
gatttgtaatttcctcaaatagaca

SEQ ID NO: 587029 - DNA, 25 bp, Homo sapien
ttgtaatttcctcaaatagacattc

SEQ ID NO: 587030 - DNA, 25 bp, Homo sapien
gtaatttcctcaaatagacattcac

SEQ ID NO: 587031 - DNA, 25 bp, Homo sapien
aatttcctcaaatagacattcactt

SEQ ID NO: 587032 - DNA, 25 bp, Homo sapien
atttcctcaaatagacattcacttt

SEQ ID NO: 587033 - DNA, 25 bp, Homo sapien
tttcctcaaatagacattcacttta

SEQ ID NO: 587034 - DNA, 25 bp, Homo sapien
ttcctcaaatagacattcactttag

SEQ ID NO: 587035 - DNA, 25 bp, Homo sapien
cctcaaatagacattcactttagat

SEQ ID NO: 587036 - DNA, 25 bp, Homo sapien
caaatagacattcactttagatgac

SEQ ID NO: 587037 - DNA, 25 bp, Homo sapien
aaatagacattcactttagatgact

SEQ ID NO: 587038 - DNA, 25 bp, Homo sapien
aatagacattcactttagatgacta

SEQ ID NO: 587039 - DNA, 25 bp, Homo sapien
tctcttatgttcattaagggttgtg

SEQ ID NO: 587040 - DNA, 25 bp, Homo sapien
ttcattaagggttgtgaaccgacta

SEQ ID NO: 587041 - DNA, 25 bp, Homo sapien
tgtgaaccgactaaaggcttttcca

SEQ ID NO: 587042 - DNA, 25 bp, Homo sapien
gtttattaagggttgcggattgtct

SEQ ID NO: 587043 - DNA, 25 bp, Homo sapien
aagggttgcggattgtctaaaggct

SEQ ID NO: 587044 - DNA, 25 bp, Homo sapien
gttgcggattgtctaaaggctttgc

SEQ ID NO: 587045 - DNA, 25 bp, Homo sapien
tctcttatgttcattcagaactgag

SEQ ID NO: 587046 - DNA, 25 bp, Homo sapien
gttcattcagaactgaggacctact

SEQ ID NO: 587047 - DNA, 25 bp, Homo sapien
cattcagaactgaggacctactaaa

SEQ ID NO: 587048 - DNA, 25 bp, Homo sapien
gaactgaggacctactaaaggcttt

SEQ ID NO: 587049 - DNA, 25 bp, Homo sapien
actgaggacctactaaaggctttgc

SEQ ID NO: 587050 - DNA, 25 bp, Homo sapien
ttccagcagtttctccaccgcggct

SEQ ID NO: 587051 - DNA, 25 bp, Homo sapien
ttcgtatcaccaatggctcggacac

SEQ ID NO: 587052 - DNA, 25 bp, Homo sapien
tatcaccaatggctcggacacgcgg

SEQ ID NO: 587053 - DNA, 25 bp, Homo sapien
tcaccaatggctcggacacgcgggc

SEQ ID NO: 587054 - DNA, 25 bp, Homo sapien
aatggctcggacacgcgggcgccac

SEQ ID NO: 587055 - DNA, 25 bp, Homo sapien
ctctcttgcccttgtcgttgttctt

SEQ ID NO: 587056 - DNA, 25 bp, Homo sapien
ttgcccttgtcgttgttcttccttt

SEQ ID NO: 587057 - DNA, 25 bp, Homo sapien
gcccttgtcgttgttcttccttttg

SEQ ID NO: 587058 - DNA, 25 bp, Homo sapien
gaccctcgctgaggtgcgaggacac

SEQ ID NO: 587059 - DNA, 25 bp, Homo sapien
tgactctgaactcgcagcttcaggg

SEQ ID NO: 587060 - DNA, 25 bp, Homo sapien
tctgaactcgcagcttcagggaaac

SEQ ID NO: 587061 - DNA, 25 bp, Homo sapien
cagcagctgcttgagtatctggttc

SEQ ID NO: 587062 - DNA, 25 bp, Homo sapien
gagtatctggttcatgtgctccatc

SEQ ID NO: 587063 - DNA, 25 bp, Homo sapien
gttcatgtgctccatctttactgag

SEQ ID NO: 587064 - DNA, 25 bp, Homo sapien
ttactgagcactgaggctggtagac

SEQ ID NO: 587065 - DNA, 25 bp, Homo sapien
aggctggtagactggatgcaacttc

SEQ ID NO: 587066 - DNA, 25 bp, Homo sapien
agtcgagttaagtcctgaacgattt

SEQ ID NO: 587067 - DNA, 25 bp, Homo sapien
tgaacgatttcagccacaaatgcca

SEQ ID NO: 587068 - DNA, 25 bp, Homo sapien
atgccagtccattatctgaacccaa

SEQ ID NO: 587069 - DNA, 25 bp, Homo sapien
taacaataccttcatcaactctcat

SEQ ID NO: 587070 - DNA, 25 bp, Homo sapien
ttctctgtcctgacggagaaggcca

SEQ ID NO: 587071 - DNA, 25 bp, Homo sapien
gagaaggccatgacccatcctgaaa

SEQ ID NO: 587072 - DNA, 25 bp, Homo sapien
gttatagtggtcgaaatggacccat

SEQ ID NO: 587073 - DNA, 25 bp, Homo sapien
aaatggacccatgaagaagctaaca

SEQ ID NO: 587074 - DNA, 25 bp, Homo sapien
gaagaagctaacaactggtcagagg

SEQ ID NO: 587075 - DNA, 25 bp, Homo sapien
actggtcagagggtgtctgttgtta

SEQ ID NO: 587076 - DNA, 25 bp, Homo sapien
taagctggttgggaaaactttgact

SEQ ID NO: 587077 - DNA, 25 bp, Homo sapien
ttgacttgacataactcaaaccctg

SEQ ID NO: 587078 - DNA, 25 bp, Homo sapien
tcaaaccctgatctttatcctaagc

SEQ ID NO: 587079 - DNA, 25 bp, Homo sapien
tatcctaagcggtagcgacttgtag

SEQ ID NO: 587080 - DNA, 25 bp, Homo sapien
aggattagttgctttgtacagttgt

SEQ ID NO: 587081 - DNA, 25 bp, Homo sapien
gtacagttgtgatggtctctctgct

SEQ ID NO: 587082 - DNA, 25 bp, Homo sapien
gttgtgatggtctctctgctcagca

SEQ ID NO: 587083 - DNA, 25 bp, Homo sapien
aaaaaacctggaactgagactgaat

SEQ ID NO: 587084 - DNA, 25 bp, Homo sapien
aacctggaactgagactgaatttgg

SEQ ID NO: 587085 - DNA, 25 bp, Homo sapien
tcattaagtgtttggcatgtggtta

SEQ ID NO: 587086 - DNA, 25 bp, Homo sapien
ggcatgtggttaatactttctcttt

SEQ ID NO: 587087 - DNA, 25 bp, Homo sapien
gttaatactttctctttagtcacaa

SEQ ID NO: 587088 - DNA, 25 bp, Homo sapien
gtgccaagatatgcatcactaactg

SEQ ID NO: 587089 - DNA, 25 bp, Homo sapien
atatgcatcactaactgttctatga

SEQ ID NO: 587090 - DNA, 25 bp, Homo sapien
ctgttctatgaaatttgtctacttc

SEQ ID NO: 587091 - DNA, 25 bp, Homo sapien
aaagtcacagagaaagcagtgtact

SEQ ID NO: 587092 - DNA, 25 bp, Homo sapien
agcagtgtactttatgacagtatat

SEQ ID NO: 587093 - DNA, 25 bp, Homo sapien
gacagtatatttatctttttatcat

SEQ ID NO: 587094 - DNA, 25 bp, Homo sapien
cactaggcaggccttcatcatctag

SEQ ID NO: 587095 - DNA, 25 bp, Homo sapien
cttcatcatctagctgggatgtgta

SEQ ID NO: 587096 - DNA, 25 bp, Homo sapien
ttcatcatctagctgggatgtgtag

SEQ ID NO: 587097 - DNA, 25 bp, Homo sapien
aggtgacgtcatagtgtgacattag

SEQ ID NO: 587098 - DNA, 25 bp, Homo sapien
catagtgtgacattaggagtttgta

SEQ ID NO: 587099 - DNA, 25 bp, Homo sapien
aggagtttgtatgtgacttgagcat

SEQ ID NO: 587100 - DNA, 25 bp, Homo sapien
gagtttgtatgtgacttgagcatga

SEQ ID NO: 587101 - DNA, 25 bp, Homo sapien
tgtatgtgacttgagcatgatgctt

SEQ ID NO: 587102 - DNA, 25 bp, Homo sapien
tatgtgacttgagcatgatgcttaa

SEQ ID NO: 587103 - DNA, 25 bp, Homo sapien
ttttttggtggcaggttaaatgact

SEQ ID NO: 587104 - DNA, 25 bp, Homo sapien
tttggtggcaggttaaatgactgaa

SEQ ID NO: 587105 - DNA, 25 bp, Homo sapien
gacgccctcaggtactcctgggaaa

SEQ ID NO: 587106 - DNA, 25 bp, Homo sapien
tgggaaaaggaggtacacagccatc

SEQ ID NO: 587107 - DNA, 25 bp, Homo sapien
actgccccagtaagctggaggctgc

SEQ ID NO: 587108 - DNA, 25 bp, Homo sapien
aggctgctccagaactcagcagtgt

SEQ ID NO: 587109 - DNA, 25 bp, Homo sapien
tctaagctgcactctctttctggcc

SEQ ID NO: 587110 - DNA, 25 bp, Homo sapien
tttctggcccttttgtctggctgat

SEQ ID NO: 587111 - DNA, 25 bp, Homo sapien
ttgtctggctgattctgtcctcaaa

SEQ ID NO: 587112 - DNA, 25 bp, Homo sapien
tggctgattctgtcctcaaataaag

SEQ ID NO: 587113 - DNA, 25 bp, Homo sapien
aaataaagcccttcactcagccaga

SEQ ID NO: 587114 - DNA, 25 bp, Homo sapien
agacctctccacagctcaaagcatt

SEQ ID NO: 587115 - DNA, 25 bp, Homo sapien
caaagcattgccctaagaatcagaa

SEQ ID NO: 587116 - DNA, 25 bp, Homo sapien
gtcacagatattttagcttctttcc

SEQ ID NO: 587117 - DNA, 25 bp, Homo sapien
aaacttatcatgcatttgcttacct

SEQ ID NO: 587118 - DNA, 25 bp, Homo sapien
tatcatgcatttgcttacctaaaat

SEQ ID NO: 587119 - DNA, 25 bp, Homo sapien
atgcatttgcttacctaaaatttaa

SEQ ID NO: 587120 - DNA, 25 bp, Homo sapien
gtttcaaattagttctctatatgag

SEQ ID NO: 587121 - DNA, 25 bp, Homo sapien
ctatatgagatacttaatcgagcat

SEQ ID NO: 587122 - DNA, 25 bp, Homo sapien
gagatacttaatcgagcatatatat

SEQ ID NO: 587123 - DNA, 25 bp, Homo sapien
cattgatcaaactgatatgctacag

SEQ ID NO: 587124 - DNA, 25 bp, Homo sapien
gatcaaactgatatgctacaggaga

SEQ ID NO: 587125 - DNA, 25 bp, Homo sapien
caaactgatatgctacaggagaatg

SEQ ID NO: 587126 - DNA, 25 bp, Homo sapien
gcaaatggctgtatgcattgaataa

SEQ ID NO: 587127 - DNA, 25 bp, Homo sapien
atcctagaccccaggatgaccctgg

SEQ ID NO: 587128 - DNA, 25 bp, Homo sapien
aaggaagccattgcatagaaaaatc

SEQ ID NO: 587129 - DNA, 25 bp, Homo sapien
aaggagtctaggtgtctggtactgt

SEQ ID NO: 587130 - DNA, 25 bp, Homo sapien
gtctggtactgtagaacatcctgtc

SEQ ID NO: 587131 - DNA, 25 bp, Homo sapien
gaacatcctgtcagtcgtgatctga

SEQ ID NO: 587132 - DNA, 25 bp, Homo sapien
gtgatctgacacctttgtactttca

SEQ ID NO: 587133 - DNA, 25 bp, Homo sapien
gacacctttgtactttcaggtgaga

SEQ ID NO: 587134 - DNA, 25 bp, Homo sapien
ttcaggtgagaaatagtctctccct

SEQ ID NO: 587135 - DNA, 25 bp, Homo sapien
aagtcactgttattgtaagttttct

SEQ ID NO: 587136 - DNA, 25 bp, Homo sapien
gtaagttttctagcactaacatcga

SEQ ID NO: 587137 - DNA, 25 bp, Homo sapien
acatcgaacctaataatgatccaag

SEQ ID NO: 587138 - DNA, 25 bp, Homo sapien
aaccagcaaccaatgaagacccact

SEQ ID NO: 587139 - DNA, 25 bp, Homo sapien
agacccactgtcttctaaatagcac

SEQ ID NO: 587140 - DNA, 25 bp, Homo sapien
tgtcttctaaatagcacccagttta

SEQ ID NO: 587141 - DNA, 25 bp, Homo sapien
aaatagcacccagtttaaaacagat

SEQ ID NO: 587142 - DNA, 25 bp, Homo sapien
acagattctaaatccacatggtcag

SEQ ID NO: 587143 - DNA, 25 bp, Homo sapien
aaatccacatggtcagcaattaact

SEQ ID NO: 587144 - DNA, 25 bp, Homo sapien
tggtcagcaattaactcacatctaa

SEQ ID NO: 587145 - DNA, 25 bp, Homo sapien
gactccgaaagttaatttctcaaga

SEQ ID NO: 587146 - DNA, 25 bp, Homo sapien
atttctcaagatagctatactggtc

SEQ ID NO: 587147 - DNA, 25 bp, Homo sapien
agatagctatactggtctaaaaact

SEQ ID NO: 587148 - DNA, 25 bp, Homo sapien
gtttcgttagatactaaaaccagca

SEQ ID NO: 587149 - DNA, 25 bp, Homo sapien
tgtgtcatttcagcctattcagtgc

SEQ ID NO: 587150 - DNA, 25 bp, Homo sapien
tattcagtgcattctgcagcacctg

SEQ ID NO: 587151 - DNA, 25 bp, Homo sapien
gcagcacctgctagaatatttatcc

SEQ ID NO: 587152 - DNA, 25 bp, Homo sapien
agaatatttatcctccttctctttc

SEQ ID NO: 587153 - DNA, 25 bp, Homo sapien
ttctctttccacttaagtcctacat

SEQ ID NO: 587154 - DNA, 25 bp, Homo sapien
acataaaggctactggagggttcca

SEQ ID NO: 587155 - DNA, 25 bp, Homo sapien
gagggttccatgttgaagcaggttt

SEQ ID NO: 587156 - DNA, 25 bp, Homo sapien
gcaaaactcagcctccatggatgtg

SEQ ID NO: 587157 - DNA, 25 bp, Homo sapien
catggatgtgtctttctgcagcatt

SEQ ID NO: 587158 - DNA, 25 bp, Homo sapien
gtctttctgcagcattcctttgtgc

SEQ ID NO: 587159 - DNA, 25 bp, Homo sapien
ctttgtgcctctcattatcacctaa

SEQ ID NO: 587160 - DNA, 25 bp, Homo sapien
ggctgctttgcaggcaccaaaattc

SEQ ID NO: 587161 - DNA, 25 bp, Homo sapien
gctttgcaggcaccaaaattcaccc

SEQ ID NO: 587162 - DNA, 25 bp, Homo sapien
ttgcaggcaccaaaattcaccctct

SEQ ID NO: 587163 - DNA, 25 bp, Homo sapien
tctcctactcctggaaaagcccagc

SEQ ID NO: 587164 - DNA, 25 bp, Homo sapien
tcacagttagaaatcatacaggcct

SEQ ID NO: 587165 - DNA, 25 bp, Homo sapien
atcatacaggcctaaagtcccagct

SEQ ID NO: 587166 - DNA, 25 bp, Homo sapien
gaaatgactaatgaacttgactcca

SEQ ID NO: 587167 - DNA, 25 bp, Homo sapien
atgactaatgaacttgactccatga

SEQ ID NO: 587168 - DNA, 25 bp, Homo sapien
gactaatgaacttgactccatgaaa

SEQ ID NO: 587169 - DNA, 25 bp, Homo sapien
aatgaacttgactccatgaaattga

SEQ ID NO: 587170 - DNA, 25 bp, Homo sapien
aacttgactccatgaaattgaaact

SEQ ID NO: 587171 - DNA, 25 bp, Homo sapien
ctatgagcctgtaagtcattaaggg

SEQ ID NO: 587172 - DNA, 25 bp, Homo sapien
gggtacatcttcaaatgacatgcta

SEQ ID NO: 587173 - DNA, 25 bp, Homo sapien
ggtacatcttcaaatgacatgctat

SEQ ID NO: 587174 - DNA, 25 bp, Homo sapien
gtacatcttcaaatgacatgctatc

SEQ ID NO: 587175 - DNA, 25 bp, Homo sapien
acatcttcaaatgacatgctatcac

SEQ ID NO: 587176 - DNA, 25 bp, Homo sapien
atcttcaaatgacatgctatcacta

SEQ ID NO: 587177 - DNA, 25 bp, Homo sapien
tcttcaaatgacatgctatcactaa

SEQ ID NO: 587178 - DNA, 25 bp, Homo sapien
ttcaaatgacatgctatcactaacc

SEQ ID NO: 587179 - DNA, 25 bp, Homo sapien
tcaaatgacatgctatcactaacca

SEQ ID NO: 587180 - DNA, 25 bp, Homo sapien
caaatgacatgctatcactaaccat

SEQ ID NO: 587181 - DNA, 25 bp, Homo sapien
aaatgacatgctatcactaaccatg

SEQ ID NO: 587182 - DNA, 25 bp, Homo sapien
gatagagtcacagatacagaaagta

SEQ ID NO: 587183 - DNA, 25 bp, Homo sapien
gggaagcgggagatttttcttgact

SEQ ID NO: 587184 - DNA, 25 bp, Homo sapien
ggaagcgggagatttttcttgactg

SEQ ID NO: 587185 - DNA, 25 bp, Homo sapien
acattttataggcttcagggagaga

SEQ ID NO: 587186 - DNA, 25 bp, Homo sapien
tccggagttcccgagctgctgagga

SEQ ID NO: 587187 - DNA, 25 bp, Homo sapien
gagttcccgagctgctgaggagtct

SEQ ID NO: 587188 - DNA, 25 bp, Homo sapien
ttcccgagctgctgaggagtctgga

SEQ ID NO: 587189 - DNA, 25 bp, Homo sapien
cccgagctgctgaggagtctggatt

SEQ ID NO: 587190 - DNA, 25 bp, Homo sapien
ctgaggagtctggattgtgtctgtc

SEQ ID NO: 587191 - DNA, 25 bp, Homo sapien
cccagtgtcagatgaaagggcgctg

SEQ ID NO: 587192 - DNA, 25 bp, Homo sapien
aaagggcgctgaggctcttggccgc

SEQ ID NO: 587193 - DNA, 25 bp, Homo sapien
aaaagattcatgtccttagattaga

SEQ ID NO: 587194 - DNA, 25 bp, Homo sapien
gattcatgtccttagattagattgt

SEQ ID NO: 587195 - DNA, 25 bp, Homo sapien
gattagattgtaagcccactgggca

SEQ ID NO: 587196 - DNA, 25 bp, Homo sapien
gattgtaagcccactgggcaggtac

SEQ ID NO: 587197 - DNA, 25 bp, Homo sapien
agcccactgggcaggtactgtgtct

SEQ ID NO: 587198 - DNA, 25 bp, Homo sapien
ccactgggcaggtactgtgtctaat

SEQ ID NO: 587199 - DNA, 25 bp, Homo sapien
gggcaggtactgtgtctaatgtttt

SEQ ID NO: 587200 - DNA, 25 bp, Homo sapien
gcaggtactgtgtctaatgttttgt

SEQ ID NO: 587201 - DNA, 25 bp, Homo sapien
actgtgtctaatgttttgtgtggca

SEQ ID NO: 587202 - DNA, 25 bp, Homo sapien
tgtctaatgttttgtgtggcacctg

SEQ ID NO: 587203 - DNA, 25 bp, Homo sapien
taatgttttgtgtggcacctgtcac

SEQ ID NO: 587204 - DNA, 25 bp, Homo sapien
ggaaagccaggcaatgtcggaccca

SEQ ID NO: 587205 - DNA, 25 bp, Homo sapien
aaagccaggcaatgtcggacccagg

SEQ ID NO: 587206 - DNA, 25 bp, Homo sapien
aggcaatgtcggacccaggcggcac

SEQ ID NO: 587207 - DNA, 25 bp, Homo sapien
cggcaccgggtctgggaggtgggca

SEQ ID NO: 587208 - DNA, 25 bp, Homo sapien
ggcaggcaggagtggtcaccacttc

SEQ ID NO: 587209 - DNA, 25 bp, Homo sapien
aggcaggagtggtcaccacttcagg

SEQ ID NO: 587210 - DNA, 25 bp, Homo sapien
tccgggcatcatgaaaaacaaaagc

SEQ ID NO: 587211 - DNA, 25 bp, Homo sapien
ctccctgctggctcacattgactgg

SEQ ID NO: 587212 - DNA, 25 bp, Homo sapien
ggctcacattgactggcagccagac

SEQ ID NO: 587213 - DNA, 25 bp, Homo sapien
tgactggcagccagacctgaaaggg

SEQ ID NO: 587214 - DNA, 25 bp, Homo sapien
ggaatccgaggtgacccccagggct

SEQ ID NO: 587215 - DNA, 25 bp, Homo sapien
tagtttttccacgtcattatttcac

SEQ ID NO: 587216 - DNA, 25 bp, Homo sapien
gtttttccacgtcattatttcactt

SEQ ID NO: 587217 - DNA, 25 bp, Homo sapien
tttccacgtcattatttcacttccc

SEQ ID NO: 587218 - DNA, 25 bp, Homo sapien
cattatttcacttcccccaggtgtt

SEQ ID NO: 587219 - DNA, 25 bp, Homo sapien
actgtccttttttattatagcattc

SEQ ID NO: 587220 - DNA, 25 bp, Homo sapien
gtattttattgtctattcctacacc

SEQ ID NO: 587221 - DNA, 25 bp, Homo sapien
attcctacacctttttgatgaaatg

SEQ ID NO: 587222 - DNA, 25 bp, Homo sapien
atttatctttttgttgcgtagttgt

SEQ ID NO: 587223 - DNA, 25 bp, Homo sapien
tgttgcgtagttgtaagtgtatttc

SEQ ID NO: 587224 - DNA, 25 bp, Homo sapien
gtaagtgtatttcatattctggata

SEQ ID NO: 587225 - DNA, 25 bp, Homo sapien
ttctggatatgagtcctgtattaaa

SEQ ID NO: 587226 - DNA, 25 bp, Homo sapien
tccttaaggaaatccttgttgggag

SEQ ID NO: 587227 - DNA, 25 bp, Homo sapien
gaagcacaaggcagtgtagatccag

SEQ ID NO: 587228 - DNA, 25 bp, Homo sapien
caaggcagtgtagatccaggtgtct

SEQ ID NO: 587229 - DNA, 25 bp, Homo sapien
gtgtagatccaggtgtctgtttttt

SEQ ID NO: 587230 - DNA, 25 bp, Homo sapien
caaaggaacgtatccctctgtggtt

SEQ ID NO: 587231 - DNA, 25 bp, Homo sapien
actgagttcagtcctactctgcttt

SEQ ID NO: 587232 - DNA, 25 bp, Homo sapien
agtcctactctgctttggtacatca

SEQ ID NO: 587233 - DNA, 25 bp, Homo sapien
ctactctgctttggtacatcacagc

SEQ ID NO: 587234 - DNA, 25 bp, Homo sapien
gctttggtacatcacagcaattaga

SEQ ID NO: 587235 - DNA, 25 bp, Homo sapien
gagatgcgccagcaagtaatgcttt

SEQ ID NO: 587236 - DNA, 25 bp, Homo sapien
gcaagtaatgctttactccaaggga

SEQ ID NO: 587237 - DNA, 25 bp, Homo sapien
agcgaagctgcacagtctgtctcta

SEQ ID NO: 587238 - DNA, 25 bp, Homo sapien
ctgtctctaaatcaaacgcggttac

SEQ ID NO: 587239 - DNA, 25 bp, Homo sapien
acgcggttaccatcaaagcctcaga

SEQ ID NO: 587240 - DNA, 25 bp, Homo sapien
gactctatgtctcaaccgcaaaagg

SEQ ID NO: 587241 - DNA, 25 bp, Homo sapien
caactcgggagtttgtcaattcttt

SEQ ID NO: 587242 - DNA, 25 bp, Homo sapien
taacgaaatctggatccttcctcgc

SEQ ID NO: 587243 - DNA, 25 bp, Homo sapien
tgcctcccctgacaggagaatgact

SEQ ID NO: 587244 - DNA, 25 bp, Homo sapien
tgtaaaaggatcctgtcgtccccga

SEQ ID NO: 587245 - DNA, 25 bp, Homo sapien
gtcgtccccgaaagtcagcaccaag

SEQ ID NO: 587246 - DNA, 25 bp, Homo sapien
gcaccaagcacttcacaaattgtca

SEQ ID NO: 587247 - DNA, 25 bp, Homo sapien
aaatctcaaaagcttacacgcgcgg

SEQ ID NO: 587248 - DNA, 25 bp, Homo sapien
tagccagttgtcatggcatgtgcct

SEQ ID NO: 587249 - DNA, 25 bp, Homo sapien
agccagttgtcatggcatgtgcctg

SEQ ID NO: 587250 - DNA, 25 bp, Homo sapien
gtatatgtatagtgtatgcatgcac

SEQ ID NO: 587251 - DNA, 25 bp, Homo sapien
atgtatagtgtatgcatgcacagaa

SEQ ID NO: 587252 - DNA, 25 bp, Homo sapien
tagtgtatgcatgcacagaatactt

SEQ ID NO: 587253 - DNA, 25 bp, Homo sapien
gtgtatgcatgcacagaatacttta

SEQ ID NO: 587254 - DNA, 25 bp, Homo sapien
tatgcatgcacagaatactttacag

SEQ ID NO: 587255 - DNA, 25 bp, Homo sapien
gcatgcacagaatactttacagcaa

SEQ ID NO: 587256 - DNA, 25 bp, Homo sapien
gcacagaatactttacagcaataag

SEQ ID NO: 587257 - DNA, 25 bp, Homo sapien
cagcaataagaatgagtgttctgca

SEQ ID NO: 587258 - DNA, 25 bp, Homo sapien
gaatgagtgttctgcaaatatacac

SEQ ID NO: 587259 - DNA, 25 bp, Homo sapien
tttatgccatatttgtactatgcag

SEQ ID NO: 587260 - DNA, 25 bp, Homo sapien
gccatatttgtactatgcagaaatt

SEQ ID NO: 587261 - DNA, 25 bp, Homo sapien
tgcagaaattgccaccattaacatc

SEQ ID NO: 587262 - DNA, 25 bp, Homo sapien
gaaattgccaccattaacatcttat

SEQ ID NO: 587263 - DNA, 25 bp, Homo sapien
attgccaccattaacatcttattgt

SEQ ID NO: 587264 - DNA, 25 bp, Homo sapien
taacatcttattgtatattcctcca

SEQ ID NO: 587265 - DNA, 25 bp, Homo sapien
tgaaagcaagttatgtatgctattt

SEQ ID NO: 587266 - DNA, 25 bp, Homo sapien
tatgctattttgtaattttctcttt

SEQ ID NO: 587267 - DNA, 25 bp, Homo sapien
ttttctcttttaacattatctctac

SEQ ID NO: 587268 - DNA, 25 bp, Homo sapien
tttaacattatctctaccttttcat

SEQ ID NO: 587269 - DNA, 25 bp, Homo sapien
catgtcagtacattttcatttcatc

SEQ ID NO: 587270 - DNA, 25 bp, Homo sapien
aaatctcagagacttacctgctcac

SEQ ID NO: 587271 - DNA, 25 bp, Homo sapien
tctcagagacttacctgctcacatc

SEQ ID NO: 587272 - DNA, 25 bp, Homo sapien
ccttctaaaggtctctttcctgcag

SEQ ID NO: 587273 - DNA, 25 bp, Homo sapien
tctctttcctgcagcgatacaggtt

SEQ ID NO: 587274 - DNA, 25 bp, Homo sapien
tttcctgcagcgatacaggttcctt

SEQ ID NO: 587275 - DNA, 25 bp, Homo sapien
tgcagcgatacaggttccttggtct

SEQ ID NO: 587276 - DNA, 25 bp, Homo sapien
agcgatacaggttccttggtctctt

SEQ ID NO: 587277 - DNA, 25 bp, Homo sapien
gatacaggttccttggtctctttcc

SEQ ID NO: 587278 - DNA, 25 bp, Homo sapien
tgctgtcccctactacgggtccaat

SEQ ID NO: 587279 - DNA, 25 bp, Homo sapien
tacgggtccaatccagcccacagct

SEQ ID NO: 587280 - DNA, 25 bp, Homo sapien
gaatgcttttcgcttttttaaagcg

SEQ ID NO: 587281 - DNA, 25 bp, Homo sapien
tgcattgtacctgtagccattccat

SEQ ID NO: 587282 - DNA, 25 bp, Homo sapien
attgtacctgtagccattccattgt

SEQ ID NO: 587283 - DNA, 25 bp, Homo sapien
tgtacctgtagccattccattgtga

SEQ ID NO: 587284 - DNA, 25 bp, Homo sapien
gtacctgtagccattccattgtgaa

SEQ ID NO: 587285 - DNA, 25 bp, Homo sapien
acctgtagccattccattgtgaata

SEQ ID NO: 587286 - DNA, 25 bp, Homo sapien
gtagccattccattgtgaataacac

SEQ ID NO: 587287 - DNA, 25 bp, Homo sapien
ggaaatatttttctcgcatttggaa

SEQ ID NO: 587288 - DNA, 25 bp, Homo sapien
ttttctcgcatttggaaattattct

SEQ ID NO: 587289 - DNA, 25 bp, Homo sapien
attcagcaaagaagttgttcatgtc

SEQ ID NO: 587290 - DNA, 25 bp, Homo sapien
gcaaagaagttgttcatgtcattaa

SEQ ID NO: 587291 - DNA, 25 bp, Homo sapien
gttgttcatgtcattaacaagttca

SEQ ID NO: 587292 - DNA, 25 bp, Homo sapien
tagctgggactttaggcctgtatga

SEQ ID NO: 587293 - DNA, 25 bp, Homo sapien
agctgggactttaggcctgtatgat

SEQ ID NO: 587294 - DNA, 25 bp, Homo sapien
gctgggactttaggcctgtatgatt

SEQ ID NO: 587295 - DNA, 25 bp, Homo sapien
gactttaggcctgtatgatttctaa

SEQ ID NO: 587296 - DNA, 25 bp, Homo sapien
ctttaggcctgtatgatttctaact

SEQ ID NO: 587297 - DNA, 25 bp, Homo sapien
aggcctgtatgatttctaactgtga

SEQ ID NO: 587298 - DNA, 25 bp, Homo sapien
ggcctgtatgatttctaactgtgat

SEQ ID NO: 587299 - DNA, 25 bp, Homo sapien
gcctgtatgatttctaactgtgatg

SEQ ID NO: 587300 - DNA, 25 bp, Homo sapien
gtatgatttctaactgtgatgtgat

SEQ ID NO: 587301 - DNA, 25 bp, Homo sapien
gatcccctcccctggctctgtgagg

SEQ ID NO: 587302 - DNA, 25 bp, Homo sapien
gagagggtgaattttggtgcctgca

SEQ ID NO: 587303 - DNA, 25 bp, Homo sapien
gtagagttctctaaagggtcttgat

SEQ ID NO: 587304 - DNA, 25 bp, Homo sapien
aagggtcttgatattagtgggacat

SEQ ID NO: 587305 - DNA, 25 bp, Homo sapien
agtgggacataattagttctaaact

SEQ ID NO: 587306 - DNA, 25 bp, Homo sapien
gcaagatccaaaagaatcaaactgt

SEQ ID NO: 587307 - DNA, 25 bp, Homo sapien
agtcacttaactatagtccagaaaa

SEQ ID NO: 587308 - DNA, 25 bp, Homo sapien
ggtaaaattcacaaagtctgccaca

SEQ ID NO: 587309 - DNA, 25 bp, Homo sapien
ttcacaaagtctgccacaaagtctg

SEQ ID NO: 587310 - DNA, 25 bp, Homo sapien
gtctgccacaaagtctggcatccag

SEQ ID NO: 587311 - DNA, 25 bp, Homo sapien
aagtctggcatccagttgagaacta

SEQ ID NO: 587312 - DNA, 25 bp, Homo sapien
ccagttgagaactaccagacataca

SEQ ID NO: 587313 - DNA, 25 bp, Homo sapien
gagaactaccagacatacaaaaaag

SEQ ID NO: 587314 - DNA, 25 bp, Homo sapien
gagcatcgcctgaactcaggaggcg

SEQ ID NO: 587315 - DNA, 25 bp, Homo sapien
agcatcgcctgaactcaggaggcgg

SEQ ID NO: 587316 - DNA, 25 bp, Homo sapien
gcatcgcctgaactcaggaggcgga

SEQ ID NO: 587317 - DNA, 25 bp, Homo sapien
ttaaacatgtctaatttggccgggc

SEQ ID NO: 587318 - DNA, 25 bp, Homo sapien
taaacatgtctaatttggccgggcg

SEQ ID NO: 587319 - DNA, 25 bp, Homo sapien
aaacatgtctaatttggccgggcgc

SEQ ID NO: 587320 - DNA, 25 bp, Homo sapien
aacatgtctaatttggccgggcgca

SEQ ID NO: 587321 - DNA, 25 bp, Homo sapien
acatgtctaatttggccgggcgcag

SEQ ID NO: 587322 - DNA, 25 bp, Homo sapien
catgtctaatttggccgggcgcagt

SEQ ID NO: 587323 - DNA, 25 bp, Homo sapien
atgtctaatttggccgggcgcagtg

SEQ ID NO: 587324 - DNA, 25 bp, Homo sapien
tgtctaatttggccgggcgcagtgg

SEQ ID NO: 587325 - DNA, 25 bp, Homo sapien
tttctttgctcttttgaactccact

SEQ ID NO: 587326 - DNA, 25 bp, Homo sapien
gctcttttgaactccactgagacac

SEQ ID NO: 587327 - DNA, 25 bp, Homo sapien
tgaacagaaagacagggagccctta

SEQ ID NO: 587328 - DNA, 25 bp, Homo sapien
ggagcccttatgctacctgaagagt

SEQ ID NO: 587329 - DNA, 25 bp, Homo sapien
agaagtttccagtgccaatacctct

SEQ ID NO: 587330 - DNA, 25 bp, Homo sapien
agtgccaatacctctgcatttccat

SEQ ID NO: 587331 - DNA, 25 bp, Homo sapien
gcatttccatttaccatgtgacctg

SEQ ID NO: 587332 - DNA, 25 bp, Homo sapien
tttaccatgtgacctgaaaagcaat

SEQ ID NO: 587333 - DNA, 25 bp, Homo sapien
atgcaacacgccaaagtggttgtct

SEQ ID NO: 587334 - DNA, 25 bp, Homo sapien
tggttgtctttctaagtgggaaaat

SEQ ID NO: 587335 - DNA, 25 bp, Homo sapien
gataggcaacttaagtttttgtctt

SEQ ID NO: 587336 - DNA, 25 bp, Homo sapien
tggtctgcggatcccaaggctacct

SEQ ID NO: 587337 - DNA, 25 bp, Homo sapien
tgcccaacgtcactctcttagagga

SEQ ID NO: 587338 - DNA, 25 bp, Homo sapien
acgtcactctcttagaggagctgct

SEQ ID NO: 587339 - DNA, 25 bp, Homo sapien
gagctgctcagcaaataccagcaca

SEQ ID NO: 587340 - DNA, 25 bp, Homo sapien
aaataccagcacaacgagtctcact

SEQ ID NO: 587341 - DNA, 25 bp, Homo sapien
gacgaactggagaagtctgctgcag

SEQ ID NO: 587342 - DNA, 25 bp, Homo sapien
aagtctgctgcagcgtgggccagtc

SEQ ID NO: 587343 - DNA, 25 bp, Homo sapien
cagcgtgggccagtcagtgcatctg

SEQ ID NO: 587344 - DNA, 25 bp, Homo sapien
agtgcatctgggagcacgggcccac

SEQ ID NO: 587345 - DNA, 25 bp, Homo sapien
agcacgggcccaccagtctgctggt

SEQ ID NO: 587346 - DNA, 25 bp, Homo sapien
tgctggtgtccatcgggcagaacct

SEQ ID NO: 587347 - DNA, 25 bp, Homo sapien
ttcaccctagtctcaggcacaggag

SEQ ID NO: 587348 - DNA, 25 bp, Homo sapien
accctagtctcaggcacaggagcag

SEQ ID NO: 587349 - DNA, 25 bp, Homo sapien
agaagactggcgtgtgccccgagct

SEQ ID NO: 587350 - DNA, 25 bp, Homo sapien
caggctgaccagaactgcacgcaag

SEQ ID NO: 587351 - DNA, 25 bp, Homo sapien
aactgcacgcaagagtgcgtctcgg

SEQ ID NO: 587352 - DNA, 25 bp, Homo sapien
caagagtgcgtctcggacagcgaat

SEQ ID NO: 587353 - DNA, 25 bp, Homo sapien
agtgcgtctcggacagcgaatgcgc

SEQ ID NO: 587354 - DNA, 25 bp, Homo sapien
agcgaatgcgccgacaacctcaagt

SEQ ID NO: 587355 - DNA, 25 bp, Homo sapien
gcgccgacaacctcaagtgctgcag

SEQ ID NO: 587356 - DNA, 25 bp, Homo sapien
tgcagcgcgggctgtgccaccttct

SEQ ID NO: 587357 - DNA, 25 bp, Homo sapien
gctgctgttcggcttcaccctagtc

SEQ ID NO: 587358 - DNA, 25 bp, Homo sapien
tcttaggcctcctcatcagaaacat

SEQ ID NO: 587359 - DNA, 25 bp, Homo sapien
ggcctcctcatcagaaacatccaat

SEQ ID NO: 587360 - DNA, 25 bp, Homo sapien
tccaatcaatcacagaatccatcgt

SEQ ID NO: 587361 - DNA, 25 bp, Homo sapien
aatccatcgttaacagaaccacctc

SEQ ID NO: 587362 - DNA, 25 bp, Homo sapien
tccactccactgatggctctaaaca

SEQ ID NO: 587363 - DNA, 25 bp, Homo sapien
ggctctaaacaagtatcaacccgta

SEQ ID NO: 587364 - DNA, 25 bp, Homo sapien
tcaacccgtaccaaacagagaagaa

SEQ ID NO: 587365 - DNA, 25 bp, Homo sapien
aagaactgacttgtaatgaggaatt

SEQ ID NO: 587366 - DNA, 25 bp, Homo sapien
gaattaaatgatagtgatgccttct

SEQ ID NO: 587367 - DNA, 25 bp, Homo sapien
gtgatgccttctattgaattccatt

SEQ ID NO: 587368 - DNA, 25 bp, Homo sapien
tgaattccatttacaggaggcatca

SEQ ID NO: 587369 - DNA, 25 bp, Homo sapien
tatgaatcagaataatgtccttcat

SEQ ID NO: 587370 - DNA, 25 bp, Homo sapien
aatttgtttaattgaagtcatctac

SEQ ID NO: 587371 - DNA, 25 bp, Homo sapien
agtcatctacttctaacaggacaga

SEQ ID NO: 587372 - DNA, 25 bp, Homo sapien
aacaggacagatacacaactatttg

SEQ ID NO: 587373 - DNA, 25 bp, Homo sapien
gacagatacacaactatttgaggtt

SEQ ID NO: 587374 - DNA, 25 bp, Homo sapien
acaaattacatctttgataagggaa

SEQ ID NO: 587375 - DNA, 25 bp, Homo sapien
gggaaatggtttcgtgacatgtaca

SEQ ID NO: 587376 - DNA, 25 bp, Homo sapien
aatggtttcgtgacatgtacacagt

SEQ ID NO: 587377 - DNA, 25 bp, Homo sapien
gtttcgtgacatgtacacagttgct

SEQ ID NO: 587378 - DNA, 25 bp, Homo sapien
gtgacatgtacacagttgctattaa

SEQ ID NO: 587379 - DNA, 25 bp, Homo sapien
aaaatgtaactctatatattctata

SEQ ID NO: 587380 - DNA, 25 bp, Homo sapien
tcttttccgcgacagtctcactcgt

SEQ ID NO: 587381 - DNA, 25 bp, Homo sapien
cttttccgcgacagtctcactcgtg

SEQ ID NO: 587382 - DNA, 25 bp, Homo sapien
ttttccgcgacagtctcactcgtgt

SEQ ID NO: 587383 - DNA, 25 bp, Homo sapien
tttccgcgacagtctcactcgtgtt

SEQ ID NO: 587384 - DNA, 25 bp, Homo sapien
gtctcactcgtgttgccccggctgg

SEQ ID NO: 587385 - DNA, 25 bp, Homo sapien
ctgacctcagttgagccgccggcct

SEQ ID NO: 587386 - DNA, 25 bp, Homo sapien
tgacctcagttgagccgccggcctc

SEQ ID NO: 587387 - DNA, 25 bp, Homo sapien
gacctcagttgagccgccggcctcg

SEQ ID NO: 587388 - DNA, 25 bp, Homo sapien
acctcagttgagccgccggcctcgg

SEQ ID NO: 587389 - DNA, 25 bp, Homo sapien
cctcagttgagccgccggcctcggc

SEQ ID NO: 587390 - DNA, 25 bp, Homo sapien
ctcagttgagccgccggcctcggcc

SEQ ID NO: 587391 - DNA, 25 bp, Homo sapien
gggtagtgaaagactccttaagcca

SEQ ID NO: 587392 - DNA, 25 bp, Homo sapien
ggtagtgaaagactccttaagccac

SEQ ID NO: 587393 - DNA, 25 bp, Homo sapien
gtagtgaaagactccttaagccaca

SEQ ID NO: 587394 - DNA, 25 bp, Homo sapien
tagtgaaagactccttaagccacaa

SEQ ID NO: 587395 - DNA, 25 bp, Homo sapien
agtgaaagactccttaagccacaaa

SEQ ID NO: 587396 - DNA, 25 bp, Homo sapien
gtgaaagactccttaagccacaaaa

SEQ ID NO: 587397 - DNA, 25 bp, Homo sapien
tgaaagactccttaagccacaaaaa

SEQ ID NO: 587398 - DNA, 25 bp, Homo sapien
gaaagactccttaagccacaaaaag

SEQ ID NO: 587399 - DNA, 25 bp, Homo sapien
aaagaaatgatgaacatacttgacc

SEQ ID NO: 587400 - DNA, 25 bp, Homo sapien
tgaaaattagaacctaaatccataa

SEQ ID NO: 587401 - DNA, 25 bp, Homo sapien
taaatccataaaccttaagaaagtg

SEQ ID NO: 587402 - DNA, 25 bp, Homo sapien
tttattttaaacatccagaacgtag

SEQ ID NO: 587403 - DNA, 25 bp, Homo sapien
ttaaacatccagaacgtagaagacg

SEQ ID NO: 587404 - DNA, 25 bp, Homo sapien
atccagaacgtagaagacgtagctt

SEQ ID NO: 587405 - DNA, 25 bp, Homo sapien
acgtagaagacgtagctttcaaaat

SEQ ID NO: 587406 - DNA, 25 bp, Homo sapien
gtagaagacgtagctttcaaaatac

SEQ ID NO: 587407 - DNA, 25 bp, Homo sapien
tgaccaatttaacaaaaggcaacaa

SEQ ID NO: 587408 - DNA, 25 bp, Homo sapien
taaagttatctattgtgatcacaag

SEQ ID NO: 587409 - DNA, 25 bp, Homo sapien
gttatctattgtgatcacaagacaa

SEQ ID NO: 587410 - DNA, 25 bp, Homo sapien
acaagacaagaacctgtgttattta

SEQ ID NO: 587411 - DNA, 25 bp, Homo sapien
gaacctgtgttatttataatagatg

SEQ ID NO: 587412 - DNA, 25 bp, Homo sapien
ggaaacagctaatatataacagata

SEQ ID NO: 587413 - DNA, 25 bp, Homo sapien
agcaagggctagtaaggattattct

SEQ ID NO: 587414 - DNA, 25 bp, Homo sapien
ggattattctggcttccgaggcaat

SEQ ID NO: 587415 - DNA, 25 bp, Homo sapien
ttccgaggcaatataatccccaggg

SEQ ID NO: 587416 - DNA, 25 bp, Homo sapien
gaacagagacgccagtttagccata

SEQ ID NO: 587417 - DNA, 25 bp, Homo sapien
tagccatagggctatacctcaggga

SEQ ID NO: 587418 - DNA, 25 bp, Homo sapien
tatacctcagggagtgactcgacgt

SEQ ID NO: 587419 - DNA, 25 bp, Homo sapien
gagtgactcgacgtaatggcaaaga

SEQ ID NO: 587420 - DNA, 25 bp, Homo sapien
tgtgccacccagatcaccaaagtaa

SEQ ID NO: 587421 - DNA, 25 bp, Homo sapien
ctattcaaaaacttcactctcttcc

SEQ ID NO: 587422 - DNA, 25 bp, Homo sapien
cactctcttcccattaaacttgaac

SEQ ID NO: 587423 - DNA, 25 bp, Homo sapien
aacttgaactgtggctatattgaac

SEQ ID NO: 587424 - DNA, 25 bp, Homo sapien
tgatgtgaggtacctagactagtga

SEQ ID NO: 587425 - DNA, 25 bp, Homo sapien
acaaagattacgttttgtcacaggg

SEQ ID NO: 587426 - DNA, 25 bp, Homo sapien
ggcacagagattagtgtgggatcat

SEQ ID NO: 587427 - DNA, 25 bp, Homo sapien
gatcatgaaaaagttccggaggtgc

SEQ ID NO: 587428 - DNA, 25 bp, Homo sapien
aaaagttccggaggtgcatagtggt

SEQ ID NO: 587429 - DNA, 25 bp, Homo sapien
aggtgcatagtggtgactggtacat

SEQ ID NO: 587430 - DNA, 25 bp, Homo sapien
atagtggtgactggtacatacaacg

SEQ ID NO: 587431 - DNA, 25 bp, Homo sapien
gtggtgactggtacatacaacgaat

SEQ ID NO: 587432 - DNA, 25 bp, Homo sapien
gactggtacatacaacgaatgtatt

SEQ ID NO: 587433 - DNA, 25 bp, Homo sapien
taatgcctttaaactgtaacttcaa

SEQ ID NO: 587434 - DNA, 25 bp, Homo sapien
gcctttaaactgtaacttcaaaatg

SEQ ID NO: 587435 - DNA, 25 bp, Homo sapien
tgcccaaggtcactccgagagtaag

SEQ ID NO: 587436 - DNA, 25 bp, Homo sapien
aaggtcactccgagagtaagtggta

SEQ ID NO: 587437 - DNA, 25 bp, Homo sapien
ctccgagagtaagtggtagaaccaa

SEQ ID NO: 587438 - DNA, 25 bp, Homo sapien
caaaattcaaaccaaatatgtcagg

SEQ ID NO: 587439 - DNA, 25 bp, Homo sapien
atatgtcaggttccagagtgcaaac

SEQ ID NO: 587440 - DNA, 25 bp, Homo sapien
atgtcaggttccagagtgcaaactt

SEQ ID NO: 587441 - DNA, 25 bp, Homo sapien
gtcaggttccagagtgcaaactttt

SEQ ID NO: 587442 - DNA, 25 bp, Homo sapien
caggttccagagtgcaaacttttca

SEQ ID NO: 587443 - DNA, 25 bp, Homo sapien
gttccagagtgcaaacttttcacca

SEQ ID NO: 587444 - DNA, 25 bp, Homo sapien
agagtgcaaacttttcaccactgta

SEQ ID NO: 587445 - DNA, 25 bp, Homo sapien
agtgcaaacttttcaccactgtaat

SEQ ID NO: 587446 - DNA, 25 bp, Homo sapien
catgatattatcgtctgctccagac

SEQ ID NO: 587447 - DNA, 25 bp, Homo sapien
acagcctttccctagtttataccat

SEQ ID NO: 587448 - DNA, 25 bp, Homo sapien
ttccctagtttataccattaacatt

SEQ ID NO: 587449 - DNA, 25 bp, Homo sapien
atttggtattagtaggaggtcatta

SEQ ID NO: 587450 - DNA, 25 bp, Homo sapien
ggaggtcattacaattttacaggaa

SEQ ID NO: 587451 - DNA, 25 bp, Homo sapien
tttacaggaatgtctaattgagata

SEQ ID NO: 587452 - DNA, 25 bp, Homo sapien
taattcactcttttatgttaatact

SEQ ID NO: 587453 - DNA, 25 bp, Homo sapien
ttttctacctagcatcacataagat

SEQ ID NO: 587454 - DNA, 25 bp, Homo sapien
taaatgacttaatcctcctcatcca

SEQ ID NO: 587455 - DNA, 25 bp, Homo sapien
ttaatcctcctcatccatattcatt

SEQ ID NO: 587456 - DNA, 25 bp, Homo sapien
atcctcctcatccatattcattttg

SEQ ID NO: 587457 - DNA, 25 bp, Homo sapien
gtaacactacctaataagagctttt

SEQ ID NO: 587458 - DNA, 25 bp, Homo sapien
ggatctttaatgacttgctactgtg

SEQ ID NO: 587459 - DNA, 25 bp, Homo sapien
tgacttgctactgtgggaaccaaca

SEQ ID NO: 587460 - DNA, 25 bp, Homo sapien
aacagctccttcaccagtggagaca

SEQ ID NO: 587461 - DNA, 25 bp, Homo sapien
gacattcgagaatatttcctatggc

SEQ ID NO: 587462 - DNA, 25 bp, Homo sapien
ggcattgggctttcagtagccagtc

SEQ ID NO: 587463 - DNA, 25 bp, Homo sapien
gtagccagtcagctcattaatactt

SEQ ID NO: 587464 - DNA, 25 bp, Homo sapien
aaatctgcagttcactatgatgagg

SEQ ID NO: 587465 - DNA, 25 bp, Homo sapien
ggagactttgcagtatttttccact

SEQ ID NO: 587466 - DNA, 25 bp, Homo sapien
gtatttttccactgttgatcccaac

SEQ ID NO: 587467 - DNA, 25 bp, Homo sapien
tgttgatcccaactatcgttctcgc

SEQ ID NO: 587468 - DNA, 25 bp, Homo sapien
accatgtccagcctaaggtcttctt

SEQ ID NO: 587469 - DNA, 25 bp, Homo sapien
tgtccagcctaaggtcttcttttta

SEQ ID NO: 587470 - DNA, 25 bp, Homo sapien
actttgactatattatgatttccag

SEQ ID NO: 587471 - DNA, 25 bp, Homo sapien
tagattttaattaccctttgtcagt

SEQ ID NO: 587472 - DNA, 25 bp, Homo sapien
ttgtcagtcaaatacagatccctat

SEQ ID NO: 587473 - DNA, 25 bp, Homo sapien
acagatccctattcttaagcatatt

SEQ ID NO: 587474 - DNA, 25 bp, Homo sapien
taaaggaccctaagtgtgaccagac

SEQ ID NO: 587475 - DNA, 25 bp, Homo sapien
gaccctaagtgtgaccagaccatat

SEQ ID NO: 587476 - DNA, 25 bp, Homo sapien
tgttgccggcactggtcttcaattc

SEQ ID NO: 587477 - DNA, 25 bp, Homo sapien
gcactggtcttcaattctgggctca

SEQ ID NO: 587478 - DNA, 25 bp, Homo sapien
tggtcttcaattctgggctcagaca

SEQ ID NO: 587479 - DNA, 25 bp, Homo sapien
ttttaggcccacagttatatacttg

SEQ ID NO: 587480 - DNA, 25 bp, Homo sapien
agttatatacttgggctgaatcagt

SEQ ID NO: 587481 - DNA, 25 bp, Homo sapien
ggctgaatcagtgtgcatcctaggt

SEQ ID NO: 587482 - DNA, 25 bp, Homo sapien
gaatcagtgtgcatcctaggtatta

SEQ ID NO: 587483 - DNA, 25 bp, Homo sapien
gtgtgcatcctaggtattatttttt

SEQ ID NO: 587484 - DNA, 25 bp, Homo sapien
gggaacgtaaacatcctccaggtca

SEQ ID NO: 587485 - DNA, 25 bp, Homo sapien
acgtaaacatcctccaggtcaaaat

SEQ ID NO: 587486 - DNA, 25 bp, Homo sapien
agcaaatcataaattccctgctcag

SEQ ID NO: 587487 - DNA, 25 bp, Homo sapien
gctcaggacccgcagtgggataaaa

SEQ ID NO: 587488 - DNA, 25 bp, Homo sapien
ataaaataatgctgcccaccgaaat

SEQ ID NO: 587489 - DNA, 25 bp, Homo sapien
atgctgcccaccgaaataatataag

SEQ ID NO: 587490 - DNA, 25 bp, Homo sapien
tattatctgttagtatcccaatgag

SEQ ID NO: 587491 - DNA, 25 bp, Homo sapien
gtatcccaatgagaaggtggcccaa

SEQ ID NO: 587492 - DNA, 25 bp, Homo sapien
acgcaatatttagtactgttttctt

SEQ ID NO: 587493 - DNA, 25 bp, Homo sapien
gttttctttctagggaacagcagtt

SEQ ID NO: 587494 - DNA, 25 bp, Homo sapien
gaggaagctataacccttgattaaa

SEQ ID NO: 587495 - DNA, 25 bp, Homo sapien
agcttgttttttgcctatggattta

SEQ ID NO: 587496 - DNA, 25 bp, Homo sapien
ggatttatccatatgttctggtctg

SEQ ID NO: 587497 - DNA, 25 bp, Homo sapien
catatgttctggtctgtgggagcca

SEQ ID NO: 587498 - DNA, 25 bp, Homo sapien
gtgggagccaggaataattgagaaa

SEQ ID NO: 587499 - DNA, 25 bp, Homo sapien
gggacttatacaacccagtattagt

SEQ ID NO: 587500 - DNA, 25 bp, Homo sapien
atacaacccagtattagttttgagc

SEQ ID NO: 587501 - DNA, 25 bp, Homo sapien
gtaatgcaacaaaaacttctcagag

SEQ ID NO: 587502 - DNA, 25 bp, Homo sapien
tcagagttaaaagccagagttccta

SEQ ID NO: 587503 - DNA, 25 bp, Homo sapien
caaagggttctgtctagtgggcaga

SEQ ID NO: 587504 - DNA, 25 bp, Homo sapien
aattcatccagcgaaggtctcctaa

SEQ ID NO: 587505 - DNA, 25 bp, Homo sapien
ggtctcctaactacagagggtcaca

SEQ ID NO: 587506 - DNA, 25 bp, Homo sapien
gtcacatctggatctgatggcacct

SEQ ID NO: 587507 - DNA, 25 bp, Homo sapien
gatggcacctacagaacttggactc

SEQ ID NO: 587508 - DNA, 25 bp, Homo sapien
gaacttggactctgagcgacaatca

SEQ ID NO: 587509 - DNA, 25 bp, Homo sapien
caggttttcccaacctacatctaca

SEQ ID NO: 587510 - DNA, 25 bp, Homo sapien
aatgggtctgattcgcaagttttca

SEQ ID NO: 587511 - DNA, 25 bp, Homo sapien
gaagccaaccttaatcagactgtga

SEQ ID NO: 587512 - DNA, 25 bp, Homo sapien
ggagtgaagaagttcaaacctgatt

SEQ ID NO: 587513 - DNA, 25 bp, Homo sapien
aaacctgattgtactctcaagaaca

SEQ ID NO: 587514 - DNA, 25 bp, Homo sapien
gattgtactctcaagaacagtagag

SEQ ID NO: 587515 - DNA, 25 bp, Homo sapien
gtaaaggacatttgagaagagattc

SEQ ID NO: 587516 - DNA, 25 bp, Homo sapien
gaagagattcatgaaacaggccaaa

SEQ ID NO: 587517 - DNA, 25 bp, Homo sapien
aacaggccaaatggtaggtttgcta

SEQ ID NO: 587518 - DNA, 25 bp, Homo sapien
aatggtaggtttgctagttcgcagg

SEQ ID NO: 587519 - DNA, 25 bp, Homo sapien
attaatttagaaagagcttctctgg

SEQ ID NO: 587520 - DNA, 25 bp, Homo sapien
gaaaataaatcactggctgggtgca

SEQ ID NO: 587521 - DNA, 25 bp, Homo sapien
tgtaattctagctattcaggcagga

SEQ ID NO: 587522 - DNA, 25 bp, Homo sapien
aattctagctattcaggcaggagga

SEQ ID NO: 587523 - DNA, 25 bp, Homo sapien
ctcagttgaaggtaagctccttaaa

SEQ ID NO: 587524 - DNA, 25 bp, Homo sapien
tcagttgaaggtaagctccttaaaa

SEQ ID NO: 587525 - DNA, 25 bp, Homo sapien
tgaaggtaagctccttaaaaaatgt

SEQ ID NO: 587526 - DNA, 25 bp, Homo sapien
aatgttcctattcttgggccgggtg

SEQ ID NO: 587527 - DNA, 25 bp, Homo sapien
atgttcctattcttgggccgggtgt

SEQ ID NO: 587528 - DNA, 25 bp, Homo sapien
tgttcctattcttgggccgggtgtg

SEQ ID NO: 587529 - DNA, 25 bp, Homo sapien
gttcctattcttgggccgggtgtgg

SEQ ID NO: 587530 - DNA, 25 bp, Homo sapien
gccattgagggcagatagcttgagt

SEQ ID NO: 587531 - DNA, 25 bp, Homo sapien
cattgagggcagatagcttgagtcc

SEQ ID NO: 587532 - DNA, 25 bp, Homo sapien
gagaacagcctgagcaacaatggca

SEQ ID NO: 587533 - DNA, 25 bp, Homo sapien
gaggatcttttgagtccgggaggca

SEQ ID NO: 587534 - DNA, 25 bp, Homo sapien
aatacacttgtgtaagttcacttgg

SEQ ID NO: 587535 - DNA, 25 bp, Homo sapien
tacacttgtgtaagttcacttgggc

SEQ ID NO: 587536 - DNA, 25 bp, Homo sapien
cacttgtgtaagttcacttgggcat

SEQ ID NO: 587537 - DNA, 25 bp, Homo sapien
acttgtgtaagttcacttgggcatt

SEQ ID NO: 587538 - DNA, 25 bp, Homo sapien
gcatttttagccctattttgacgat

SEQ ID NO: 587539 - DNA, 25 bp, Homo sapien
catttttagccctattttgacgata

SEQ ID NO: 587540 - DNA, 25 bp, Homo sapien
tttttagccctattttgacgatata

SEQ ID NO: 587541 - DNA, 25 bp, Homo sapien
attttgacgatatatgtacagcctt

SEQ ID NO: 587542 - DNA, 25 bp, Homo sapien
tttgacgatatatgtacagcctttt

SEQ ID NO: 587543 - DNA, 25 bp, Homo sapien
ttgacgatatatgtacagcctttta

SEQ ID NO: 587544 - DNA, 25 bp, Homo sapien
gacgatatatgtacagccttttaaa

SEQ ID NO: 587545 - DNA, 25 bp, Homo sapien
attataccctttttgtctaatcaca

SEQ ID NO: 587546 - DNA, 25 bp, Homo sapien
tcacatttctacacagttgtcctta

SEQ ID NO: 587547 - DNA, 25 bp, Homo sapien
gttgtccttataccaatcatgtcta

SEQ ID NO: 587548 - DNA, 25 bp, Homo sapien
ttataccaatcatgtctatccgatg

SEQ ID NO: 587549 - DNA, 25 bp, Homo sapien
tgtctatccgatgaagtctccataa

SEQ ID NO: 587550 - DNA, 25 bp, Homo sapien
tgaacaagaactcatccacgtgccc

SEQ ID NO: 587551 - DNA, 25 bp, Homo sapien
aagaactcatccacgtgcccagagg

SEQ ID NO: 587552 - DNA, 25 bp, Homo sapien
gtgcccagagggtgttgtaccccaa

SEQ ID NO: 587553 - DNA, 25 bp, Homo sapien
ggtgttgtaccccaactcataagaa

SEQ ID NO: 587554 - DNA, 25 bp, Homo sapien
aactcataagaatggaagctcctgt

SEQ ID NO: 587555 - DNA, 25 bp, Homo sapien
atacttccagacctcgcctgtataa

SEQ ID NO: 587556 - DNA, 25 bp, Homo sapien
tccagtgcggcagagcctcgtgcaa

SEQ ID NO: 587557 - DNA, 25 bp, Homo sapien
agagcctcgtgcaagcaggagagaa

SEQ ID NO: 587558 - DNA, 25 bp, Homo sapien
agaaaggctgtatcttaatttctgc

SEQ ID NO: 587559 - DNA, 25 bp, Homo sapien
tatcttaatttctgcaccccggacc

SEQ ID NO: 587560 - DNA, 25 bp, Homo sapien
aggccagtgttgtttccagcctcag

SEQ ID NO: 587561 - DNA, 25 bp, Homo sapien
agtgttgtttccagcctcaggccac

SEQ ID NO: 587562 - DNA, 25 bp, Homo sapien
ttttaaacgagcaatccttggctgc

SEQ ID NO: 587563 - DNA, 25 bp, Homo sapien
taaacgagcaatccttggctgcttc

SEQ ID NO: 587564 - DNA, 25 bp, Homo sapien
acgagcaatccttggctgcttcctt

SEQ ID NO: 587565 - DNA, 25 bp, Homo sapien
tccttttcttaactctttcagtact

SEQ ID NO: 587566 - DNA, 25 bp, Homo sapien
ttcttaactctttcagtactgagag

SEQ ID NO: 587567 - DNA, 25 bp, Homo sapien
gtcaggagagcaaaatatgccaggc

SEQ ID NO: 587568 - DNA, 25 bp, Homo sapien
atatgccaggcaaaagctcccggga

SEQ ID NO: 587569 - DNA, 25 bp, Homo sapien
atgccaggcaaaagctcccgggaaa

SEQ ID NO: 587570 - DNA, 25 bp, Homo sapien
cgggatgtggagcagcgagggcaaa

SEQ ID NO: 587571 - DNA, 25 bp, Homo sapien
aaagacggtgaacacagccctccag

SEQ ID NO: 587572 - DNA, 25 bp, Homo sapien
gaacacagccctccagctgtctgag

SEQ ID NO: 587573 - DNA, 25 bp, Homo sapien
gggatgatcatacctgcctcacaag

SEQ ID NO: 587574 - DNA, 25 bp, Homo sapien
cctgcctcacaagaatgttgagaca

SEQ ID NO: 587575 - DNA, 25 bp, Homo sapien
cacagagacgttctggagccccttt

SEQ ID NO: 587576 - DNA, 25 bp, Homo sapien
tttcccccgagaccggcattcatga

SEQ ID NO: 587577 - DNA, 25 bp, Homo sapien
gggcacccaggagagtctggcggtg

SEQ ID NO: 587578 - DNA, 25 bp, Homo sapien
cctcaaatgcgctttcctagatgtt

SEQ ID NO: 587579 - DNA, 25 bp, Homo sapien
atgcgctttcctagatgttacagag

SEQ ID NO: 587580 - DNA, 25 bp, Homo sapien
gaggaccatgtgtgaaccttttctg

SEQ ID NO: 587581 - DNA, 25 bp, Homo sapien
aaccttttctggcaggaagctctgg

SEQ ID NO: 587582 - DNA, 25 bp, Homo sapien
gaagctctggtgttcttgtttagtc

SEQ ID NO: 587583 - DNA, 25 bp, Homo sapien
tcttgtttagtctcgcattgccaga

SEQ ID NO: 587584 - DNA, 25 bp, Homo sapien
taggcagctctgaagggtagatagt

SEQ ID NO: 587585 - DNA, 25 bp, Homo sapien
ggcggcccactacactaaaggataa

SEQ ID NO: 587586 - DNA, 25 bp, Homo sapien
gatagccaagagcacagttcataaa

SEQ ID NO: 587587 - DNA, 25 bp, Homo sapien
gagaatgctttcattaagtgcttaa

SEQ ID NO: 587588 - DNA, 25 bp, Homo sapien
ataacagacttgtgcctcaatgctc

SEQ ID NO: 587589 - DNA, 25 bp, Homo sapien
actgtgttgtttcctgaggttgaat

SEQ ID NO: 587590 - DNA, 25 bp, Homo sapien
gtgttgtttcctgaggttgaatcct

SEQ ID NO: 587591 - DNA, 25 bp, Homo sapien
gttgtttcctgaggttgaatcctat

SEQ ID NO: 587592 - DNA, 25 bp, Homo sapien
tgtttcctgaggttgaatcctattc

SEQ ID NO: 587593 - DNA, 25 bp, Homo sapien
gtttcctgaggttgaatcctattca

SEQ ID NO: 587594 - DNA, 25 bp, Homo sapien
tcctgaggttgaatcctattcaaag

SEQ ID NO: 587595 - DNA, 25 bp, Homo sapien
gaggttgaatcctattcaaagatta

SEQ ID NO: 587596 - DNA, 25 bp, Homo sapien
ctgtaagttttagaacttgtgtcaa

SEQ ID NO: 587597 - DNA, 25 bp, Homo sapien
gttttagaacttgtgtcaaaatgtt

SEQ ID NO: 587598 - DNA, 25 bp, Homo sapien
aatgttcccttatgtggtggcatgc

SEQ ID NO: 587599 - DNA, 25 bp, Homo sapien
atgttcccttatgtggtggcatgcg

SEQ ID NO: 587600 - DNA, 25 bp, Homo sapien
gattgatcccaaagcttagaacgaa

SEQ ID NO: 587601 - DNA, 25 bp, Homo sapien
gatcccaaagcttagaacgaatacc

SEQ ID NO: 587602 - DNA, 25 bp, Homo sapien
gaacgaataccaagataatagcaaa

SEQ ID NO: 587603 - DNA, 25 bp, Homo sapien
agagtcagtctgcaaaaaccggaaa

SEQ ID NO: 587604 - DNA, 25 bp, Homo sapien
gttgttttttccacaatgcctaatt

SEQ ID NO: 587605 - DNA, 25 bp, Homo sapien
aactcagaaaacatggcccaataag

SEQ ID NO: 587606 - DNA, 25 bp, Homo sapien
aacatggcccaataagtggaagaaa

SEQ ID NO: 587607 - DNA, 25 bp, Homo sapien
acataagcttcaggcaaactagaca

SEQ ID NO: 587608 - DNA, 25 bp, Homo sapien
agcttcaggcaaactagacagattt

SEQ ID NO: 587609 - DNA, 25 bp, Homo sapien
gactgtctaaaatattctcaaaaac

SEQ ID NO: 587610 - DNA, 25 bp, Homo sapien
caaaaactcatgaaacacgggtaga

SEQ ID NO: 587611 - DNA, 25 bp, Homo sapien
gaactgagtgagagataatgctgct

SEQ ID NO: 587612 - DNA, 25 bp, Homo sapien
taatgctgctagagtaaacaagtca

SEQ ID NO: 587613 - DNA, 25 bp, Homo sapien
acaagtcagatctgagctccatgca

SEQ ID NO: 587614 - DNA, 25 bp, Homo sapien
aagtcagatctgagctccatgcagg

SEQ ID NO: 587615 - DNA, 25 bp, Homo sapien
gtcagatctgagctccatgcaggaa

SEQ ID NO: 587616 - DNA, 25 bp, Homo sapien
gctccatgcaggaactaatttgcat

SEQ ID NO: 587617 - DNA, 25 bp, Homo sapien
tctcatccacccacttgtttcttct

SEQ ID NO: 587618 - DNA, 25 bp, Homo sapien
tcttctcttggtgttttatgtggaa

SEQ ID NO: 587619 - DNA, 25 bp, Homo sapien
atgtggaagcacattgttggttctc

SEQ ID NO: 587620 - DNA, 25 bp, Homo sapien
cattgttggttctcattacgtattt

SEQ ID NO: 587621 - DNA, 25 bp, Homo sapien
tgttggttctcattacgtatttgct

SEQ ID NO: 587622 - DNA, 25 bp, Homo sapien
gcactgttccactggcacctaaaga

SEQ ID NO: 587623 - DNA, 25 bp, Homo sapien
tggcacctaaagacacggaggctct

SEQ ID NO: 587624 - DNA, 25 bp, Homo sapien
gcacctaaagacacggaggctctgg

SEQ ID NO: 587625 - DNA, 25 bp, Homo sapien
ctaaagacacggaggctctgggaga

SEQ ID NO: 587626 - DNA, 25 bp, Homo sapien
aggctctgggagatttctggcccta

SEQ ID NO: 587627 - DNA, 25 bp, Homo sapien
gctctgggagatttctggccctagg

SEQ ID NO: 587628 - DNA, 25 bp, Homo sapien
tctgggagatttctggccctaggcc

SEQ ID NO: 587629 - DNA, 25 bp, Homo sapien
tgggagatttctggccctaggccac

SEQ ID NO: 587630 - DNA, 25 bp, Homo sapien
agatttctggccctaggccacgaag

SEQ ID NO: 587631 - DNA, 25 bp, Homo sapien
atttctggccctaggccacgaaggc

SEQ ID NO: 587632 - DNA, 25 bp, Homo sapien
ctaggccacgaaggcccacttggga

SEQ ID NO: 587633 - DNA, 25 bp, Homo sapien
tttattgcaggtgctatgcagtcat

SEQ ID NO: 587634 - DNA, 25 bp, Homo sapien
ggtgctatgcagtcatatacgttat

SEQ ID NO: 587635 - DNA, 25 bp, Homo sapien
catatacgttatacactgcagaggt

SEQ ID NO: 587636 - DNA, 25 bp, Homo sapien
gaggtaatgcactggttgttgttct

SEQ ID NO: 587637 - DNA, 25 bp, Homo sapien
ttttatattacttctcagcagtatg

SEQ ID NO: 587638 - DNA, 25 bp, Homo sapien
taagatgaaatgcttccctccactg

SEQ ID NO: 587639 - DNA, 25 bp, Homo sapien
ccctccactgtttatgtactcatgt

SEQ ID NO: 587640 - DNA, 25 bp, Homo sapien
gtactcatgtattttgtataatcat

SEQ ID NO: 587641 - DNA, 25 bp, Homo sapien
agtccatattacttaccaatagaag

SEQ ID NO: 587642 - DNA, 25 bp, Homo sapien
ttgaatttcaattgccccacttatg

SEQ ID NO: 587643 - DNA, 25 bp, Homo sapien
cacttatgctgccatcctttttgca

SEQ ID NO: 587644 - DNA, 25 bp, Homo sapien
gatgtttcctataatgaacttactt

SEQ ID NO: 587645 - DNA, 25 bp, Homo sapien
tgtttcctataatgaacttactttt

SEQ ID NO: 587646 - DNA, 25 bp, Homo sapien
atgaacttacttttattccaaatga

SEQ ID NO: 587647 - DNA, 25 bp, Homo sapien
tgaacttacttttattccaaatgaa

SEQ ID NO: 587648 - DNA, 25 bp, Homo sapien
actcaaattatttctttgttcattg

SEQ ID NO: 587649 - DNA, 25 bp, Homo sapien
aattatttctttgttcattgtccaa

SEQ ID NO: 587650 - DNA, 25 bp, Homo sapien
attatttctttgttcattgtccaaa

SEQ ID NO: 587651 - DNA, 25 bp, Homo sapien
ttatttctttgttcattgtccaaaa

SEQ ID NO: 587652 - DNA, 25 bp, Homo sapien
atttctttgttcattgtccaaaata

SEQ ID NO: 587653 - DNA, 25 bp, Homo sapien
tctttgttcattgtccaaaataaac

SEQ ID NO: 587654 - DNA, 25 bp, Homo sapien
tgttcattgtccaaaataaactaca

SEQ ID NO: 587655 - DNA, 25 bp, Homo sapien
aattgcctaacgacatttcttaaag

SEQ ID NO: 587656 - DNA, 25 bp, Homo sapien
catttcttaaagtgtatccctgttg

SEQ ID NO: 587657 - DNA, 25 bp, Homo sapien
tcttaaagtgtatccctgttgttaa

SEQ ID NO: 587658 - DNA, 25 bp, Homo sapien
cacagggctacactatcttctcagc

SEQ ID NO: 587659 - DNA, 25 bp, Homo sapien
tacactatcttctcagccactaaag

SEQ ID NO: 587660 - DNA, 25 bp, Homo sapien
agtacgctaatcctaataatcttta

SEQ ID NO: 587661 - DNA, 25 bp, Homo sapien
taatctttaatctgagggtactgct

SEQ ID NO: 587662 - DNA, 25 bp, Homo sapien
agggtactgcttaacaaatctcaaa

SEQ ID NO: 587663 - DNA, 25 bp, Homo sapien
gtttccataaactagccatctcact

SEQ ID NO: 587664 - DNA, 25 bp, Homo sapien
taaactagccatctcactgctttaa

SEQ ID NO: 587665 - DNA, 25 bp, Homo sapien
ctagccatctcactgctttaaagta

SEQ ID NO: 587666 - DNA, 25 bp, Homo sapien
ctgtctggttcgctgcctccttcgt

SEQ ID NO: 587667 - DNA, 25 bp, Homo sapien
tggttcgctgcctccttcgtcggga

SEQ ID NO: 587668 - DNA, 25 bp, Homo sapien
tccttcgtcgggagccagctgaacg

SEQ ID NO: 587669 - DNA, 25 bp, Homo sapien
tcgggagccagctgaacggctcaca

SEQ ID NO: 587670 - DNA, 25 bp, Homo sapien
gggagccagctgaacggctcacagc

SEQ ID NO: 587671 - DNA, 25 bp, Homo sapien
gagccagctgaacggctcacagcca

SEQ ID NO: 587672 - DNA, 25 bp, Homo sapien
agctgaacggctcacagccacaggc

SEQ ID NO: 587673 - DNA, 25 bp, Homo sapien
tgaacggctcacagccacaggcatc

SEQ ID NO: 587674 - DNA, 25 bp, Homo sapien
tcctgcacccctggctgcgacagga

SEQ ID NO: 587675 - DNA, 25 bp, Homo sapien
gctgcgacaggacccgatgccctta

SEQ ID NO: 587676 - DNA, 25 bp, Homo sapien
aacccgatcccatctctgggaggct

SEQ ID NO: 587677 - DNA, 25 bp, Homo sapien
taatgttgtaaatgaactttctctg

SEQ ID NO: 587678 - DNA, 25 bp, Homo sapien
attctagcaaatggtcaaacccagg

SEQ ID NO: 587679 - DNA, 25 bp, Homo sapien
gcaaatggtcaaacccaggagggaa

SEQ ID NO: 587680 - DNA, 25 bp, Homo sapien
agggaatggtatgaacctctggttt

SEQ ID NO: 587681 - DNA, 25 bp, Homo sapien
gaacctctggtttacagccattggt

SEQ ID NO: 587682 - DNA, 25 bp, Homo sapien
gccattggtaagaagcacacatgac

SEQ ID NO: 587683 - DNA, 25 bp, Homo sapien
acacatgacaacctggactttccat

SEQ ID NO: 587684 - DNA, 25 bp, Homo sapien
ttccatcaacatttgaagcgggagc

SEQ ID NO: 587685 - DNA, 25 bp, Homo sapien
catttgaagcgggagcagtcttgtg

SEQ ID NO: 587686 - DNA, 25 bp, Homo sapien
gcagtcttgtgggatcaagctctta

SEQ ID NO: 587687 - DNA, 25 bp, Homo sapien
tgggatcaagctcttaacctgtggg

SEQ ID NO: 587688 - DNA, 25 bp, Homo sapien
gaacaagtgtgcatgtaatgaccca

SEQ ID NO: 587689 - DNA, 25 bp, Homo sapien
gtaatgacccacatggattgccttg

SEQ ID NO: 587690 - DNA, 25 bp, Homo sapien
cacatggattgccttgaagccgttt

SEQ ID NO: 587691 - DNA, 25 bp, Homo sapien
cagcaaagcatgtctagggtctcac

SEQ ID NO: 587692 - DNA, 25 bp, Homo sapien
gggtctcacaataacagcaggtctc

SEQ ID NO: 587693 - DNA, 25 bp, Homo sapien
ttctgaatgttacaactcgtcccat

SEQ ID NO: 587694 - DNA, 25 bp, Homo sapien
acaactcgtcccatttaaggctaga

SEQ ID NO: 587695 - DNA, 25 bp, Homo sapien
aaatctatcacagatcctttggaac

SEQ ID NO: 587696 - DNA, 25 bp, Homo sapien
gatcctttggaacatcgatggcaag

SEQ ID NO: 587697 - DNA, 25 bp, Homo sapien
aagggcttcactcgtttcatggaaa

SEQ ID NO: 587698 - DNA, 25 bp, Homo sapien
agctcagaacagtttgtcgacttgg

SEQ ID NO: 587699 - DNA, 25 bp, Homo sapien
atataaggtttcaattgcattatga

SEQ ID NO: 587700 - DNA, 25 bp, Homo sapien
gcattatgaaaaactctacggtctg

SEQ ID NO: 587701 - DNA, 25 bp, Homo sapien
tatgaaaaactctacggtctgaact

SEQ ID NO: 587702 - DNA, 25 bp, Homo sapien
tgaaaaactctacggtctgaacttc

SEQ ID NO: 587703 - DNA, 25 bp, Homo sapien
aaaactctacggtctgaacttcgtg

SEQ ID NO: 587704 - DNA, 25 bp, Homo sapien
aactctacggtctgaacttcgtggc

SEQ ID NO: 587705 - DNA, 25 bp, Homo sapien
actctacggtctgaacttcgtggcc

SEQ ID NO: 587706 - DNA, 25 bp, Homo sapien
tctacggtctgaacttcgtggccag

SEQ ID NO: 587707 - DNA, 25 bp, Homo sapien
tacggtctgaacttcgtggccaggc

SEQ ID NO: 587708 - DNA, 25 bp, Homo sapien
acggtctgaacttcgtggccaggca

SEQ ID NO: 587709 - DNA, 25 bp, Homo sapien
ggtctgaacttcgtggccaggcaca

SEQ ID NO: 587710 - DNA, 25 bp, Homo sapien
ggactcctctaatgccccagggagg

SEQ ID NO: 587711 - DNA, 25 bp, Homo sapien
tgatattttatcactgtcagaaaca

SEQ ID NO: 587712 - DNA, 25 bp, Homo sapien
ggagaacatgagatcagctacatac

SEQ ID NO: 587713 - DNA, 25 bp, Homo sapien
gaacatgagatcagctacatacatt

SEQ ID NO: 587714 - DNA, 25 bp, Homo sapien
gagatcagctacatacattgtgaaa

SEQ ID NO: 587715 - DNA, 25 bp, Homo sapien
cagtttcatttttctgtgacagtat

SEQ ID NO: 587716 - DNA, 25 bp, Homo sapien
tttctgtgacagtattgggtaaatc

SEQ ID NO: 587717 - DNA, 25 bp, Homo sapien
tattgggtaaatcaccctttcctct

SEQ ID NO: 587718 - DNA, 25 bp, Homo sapien
ttgggtaaatcaccctttcctctca

SEQ ID NO: 587719 - DNA, 25 bp, Homo sapien
ctttcctctcaccatcaaaacagaa

SEQ ID NO: 587720 - DNA, 25 bp, Homo sapien
tcctctcaccatcaaaacagaaaag

SEQ ID NO: 587721 - DNA, 25 bp, Homo sapien
aattgatatatacctattggagatc

SEQ ID NO: 587722 - DNA, 25 bp, Homo sapien
tttatctgtctctgcttatgatggc

SEQ ID NO: 587723 - DNA, 25 bp, Homo sapien
atctgtctctgcttatgatggcaat

SEQ ID NO: 587724 - DNA, 25 bp, Homo sapien
gtctctgcttatgatggcaatgtat

SEQ ID NO: 587725 - DNA, 25 bp, Homo sapien
gcttatgatggcaatgtatctgtac

SEQ ID NO: 587726 - DNA, 25 bp, Homo sapien
atggcaatgtatctgtaccaggtga

SEQ ID NO: 587727 - DNA, 25 bp, Homo sapien
gcaatgtatctgtaccaggtgatct

SEQ ID NO: 587728 - DNA, 25 bp, Homo sapien
atgtatctgtaccaggtgatctctg

SEQ ID NO: 587729 - DNA, 25 bp, Homo sapien
ctgcaatgcaaggacatagcactgg

SEQ ID NO: 587730 - DNA, 25 bp, Homo sapien
gcaaggacatagcactgggatatag

SEQ ID NO: 587731 - DNA, 25 bp, Homo sapien
catagcactgggatataggagttct

SEQ ID NO: 587732 - DNA, 25 bp, Homo sapien
gtttggagtctataaacttgtaata

SEQ ID NO: 587733 - DNA, 25 bp, Homo sapien
aataaatgtggcctgtaagaactac

SEQ ID NO: 587734 - DNA, 25 bp, Homo sapien
gtggcctgtaagaactacaaatact

SEQ ID NO: 587735 - DNA, 25 bp, Homo sapien
acaaatactggaaagctctgaggat

SEQ ID NO: 587736 - DNA, 25 bp, Homo sapien
aaagctctgaggatgtaatttctaa

SEQ ID NO: 587737 - DNA, 25 bp, Homo sapien
aacttggcaaggagaaggcttcaat

SEQ ID NO: 587738 - DNA, 25 bp, Homo sapien
agacattggacgtcattgaaggcct

SEQ ID NO: 587739 - DNA, 25 bp, Homo sapien
tggacgtcattgaaggcctggtgat

SEQ ID NO: 587740 - DNA, 25 bp, Homo sapien
aaggcctggtgatgtggttttagtc

SEQ ID NO: 587741 - DNA, 25 bp, Homo sapien
tgtggttttagtccatgtgccaaga

SEQ ID NO: 587742 - DNA, 25 bp, Homo sapien
atatattagttagggccgggtgcag

SEQ ID NO: 587743 - DNA, 25 bp, Homo sapien
gaaataaaataattggctgggtgtg

SEQ ID NO: 587744 - DNA, 25 bp, Homo sapien
tccagaccaccctaggcaatatagc

SEQ ID NO: 587745 - DNA, 25 bp, Homo sapien
cagaccaccctaggcaatatagcaa

SEQ ID NO: 587746 - DNA, 25 bp, Homo sapien
aaaaaattagcaggcatgcacctgt

SEQ ID NO: 587747 - DNA, 25 bp, Homo sapien
aaaattagcaggcatgcacctgtag

SEQ ID NO: 587748 - DNA, 25 bp, Homo sapien
gagaccaggagttccaggttacagt

SEQ ID NO: 587749 - DNA, 25 bp, Homo sapien
actctgtcctgggtgatcgagtgag

SEQ ID NO: 587750 - DNA, 25 bp, Homo sapien
ctctgtcctgggtgatcgagtgaga

SEQ ID NO: 587751 - DNA, 25 bp, Homo sapien
tctgtcctgggtgatcgagtgagac

SEQ ID NO: 587752 - DNA, 25 bp, Homo sapien
ctgtcctgggtgatcgagtgagacc

SEQ ID NO: 587753 - DNA, 25 bp, Homo sapien
tgtcctgggtgatcgagtgagaccc

SEQ ID NO: 587754 - DNA, 25 bp, Homo sapien
gtccgactcaattatttctactggg

SEQ ID NO: 587755 - DNA, 25 bp, Homo sapien
ttctactgggaatgactgaaaggta

SEQ ID NO: 587756 - DNA, 25 bp, Homo sapien
aaggaatcgttaatgaatctggaga

SEQ ID NO: 587757 - DNA, 25 bp, Homo sapien
ggagatgacagaggcatgctttatt

SEQ ID NO: 587758 - DNA, 25 bp, Homo sapien
gacagaggcatgctttatttaattt

SEQ ID NO: 587759 - DNA, 25 bp, Homo sapien
ttttctgctggttattgccaagtat

SEQ ID NO: 587760 - DNA, 25 bp, Homo sapien
atgactttctttaaatccgaaggcg

SEQ ID NO: 587761 - DNA, 25 bp, Homo sapien
atccgaaggcgaacgaattgattct

SEQ ID NO: 587762 - DNA, 25 bp, Homo sapien
ctgacaattatggatttgtccttca

SEQ ID NO: 587763 - DNA, 25 bp, Homo sapien
tgtccttcaatcttgcaaatgccca

SEQ ID NO: 587764 - DNA, 25 bp, Homo sapien
cttgcaaatgcccaattaaaagatt

SEQ ID NO: 587765 - DNA, 25 bp, Homo sapien
tgttttccatctcgctgatccaaag

SEQ ID NO: 587766 - DNA, 25 bp, Homo sapien
tttccatctcgctgatccaaagtaa

SEQ ID NO: 587767 - DNA, 25 bp, Homo sapien
tcgctgatccaaagtaaacgctccc

SEQ ID NO: 587768 - DNA, 25 bp, Homo sapien
tgatccaaagtaaacgctcccaggg

SEQ ID NO: 587769 - DNA, 25 bp, Homo sapien
ttttcccaggaagggtctgtttctg

SEQ ID NO: 587770 - DNA, 25 bp, Homo sapien
tggtggctttcagtcgtgtctgtgc

SEQ ID NO: 587771 - DNA, 25 bp, Homo sapien
cagtcgtgtctgtgcgtccccggga

SEQ ID NO: 587772 - DNA, 25 bp, Homo sapien
gaggtgcactttgcgctgctggctt

SEQ ID NO: 587773 - DNA, 25 bp, Homo sapien
actttgcgctgctggcttgctttac

SEQ ID NO: 587774 - DNA, 25 bp, Homo sapien
ctgctggcttgctttactctgagag

SEQ ID NO: 587775 - DNA, 25 bp, Homo sapien
ctggcttgctttactctgagagtgg

SEQ ID NO: 587776 - DNA, 25 bp, Homo sapien
caagtccataaacagagcccaatct

SEQ ID NO: 587777 - DNA, 25 bp, Homo sapien
agagcccaatctgaaggtcattccc

SEQ ID NO: 587778 - DNA, 25 bp, Homo sapien
ctgaaggtcattccccaaaaataag

SEQ ID NO: 587779 - DNA, 25 bp, Homo sapien
ataaggcagttcattcaagatctct

SEQ ID NO: 587780 - DNA, 25 bp, Homo sapien
caagatctctgaaatggttctcttc

SEQ ID NO: 587781 - DNA, 25 bp, Homo sapien
ggttctcttcaaattccagctgtga

SEQ ID NO: 587782 - DNA, 25 bp, Homo sapien
tccagctgtgacctgacaaacattt

SEQ ID NO: 587783 - DNA, 25 bp, Homo sapien
gtgacctgacaaacatttctgacat

SEQ ID NO: 587784 - DNA, 25 bp, Homo sapien
atttctgacattattcactttacct

SEQ ID NO: 587785 - DNA, 25 bp, Homo sapien
cactttacctagatccttgacttca

SEQ ID NO: 587786 - DNA, 25 bp, Homo sapien
cttcattaaaggcatacaacggaga

SEQ ID NO: 587787 - DNA, 25 bp, Homo sapien
gtaggtggcctcaaagacagagctt

SEQ ID NO: 587788 - DNA, 25 bp, Homo sapien
ggtggcctcaaagacagagcttggc

SEQ ID NO: 587789 - DNA, 25 bp, Homo sapien
cctcccgtgggcagctatgaagtca

SEQ ID NO: 587790 - DNA, 25 bp, Homo sapien
ccgtgggcagctatgaagtcacagg

SEQ ID NO: 587791 - DNA, 25 bp, Homo sapien
gggccgttaccatggagactcgaag

SEQ ID NO: 587792 - DNA, 25 bp, Homo sapien
gttaccatggagactcgaagcccat

SEQ ID NO: 587793 - DNA, 25 bp, Homo sapien
tggagactcgaagcccattcagaga

SEQ ID NO: 587794 - DNA, 25 bp, Homo sapien
aatagggtggaatctgcgagtcgcc

SEQ ID NO: 587795 - DNA, 25 bp, Homo sapien
ggtggaatctgcgagtcgccctcat

SEQ ID NO: 587796 - DNA, 25 bp, Homo sapien
ggaatctgcgagtcgccctcatctc

SEQ ID NO: 587797 - DNA, 25 bp, Homo sapien
atctcccagggcaccactttggagc

SEQ ID NO: 587798 - DNA, 25 bp, Homo sapien
tagtttttccacgtcattatttcac

SEQ ID NO: 587799 - DNA, 25 bp, Homo sapien
tttccacgtcattatttcacttccc

SEQ ID NO: 587800 - DNA, 25 bp, Homo sapien
actgtccttttttattatagcattc

SEQ ID NO: 587801 - DNA, 25 bp, Homo sapien
agttttgatttgcatgtccctgctg

SEQ ID NO: 587802 - DNA, 25 bp, Homo sapien
gtccctgctgactgatgatgctgac

SEQ ID NO: 587803 - DNA, 25 bp, Homo sapien
gatgctgaccatcttttcatgtatt

SEQ ID NO: 587804 - DNA, 25 bp, Homo sapien
gtattttattgtctattcctacacc

SEQ ID NO: 587805 - DNA, 25 bp, Homo sapien
attcctacacctttttgatgaaatg

SEQ ID NO: 587806 - DNA, 25 bp, Homo sapien
ttatctttttgttgcgtagttgtaa

SEQ ID NO: 587807 - DNA, 25 bp, Homo sapien
gtaagtgtatttcatattctggata

SEQ ID NO: 587808 - DNA, 25 bp, Homo sapien
ttctggatatgagtcctgtattaaa

SEQ ID NO: 587809 - DNA, 25 bp, Homo sapien
ccggtttacttaatcaggacatggg

SEQ ID NO: 587810 - DNA, 25 bp, Homo sapien
acttaatcaggacatgggcctaaga

SEQ ID NO: 587811 - DNA, 25 bp, Homo sapien
tttcccttcatgataacatccatag

SEQ ID NO: 587812 - DNA, 25 bp, Homo sapien
taacatccatagacaacttattaga

SEQ ID NO: 587813 - DNA, 25 bp, Homo sapien
tagaagggactagagtttttgcaaa

SEQ ID NO: 587814 - DNA, 25 bp, Homo sapien
gtttttgcaaatttccctgctggat

SEQ ID NO: 587815 - DNA, 25 bp, Homo sapien
gggcctatagctatacttagtatat

SEQ ID NO: 587816 - DNA, 25 bp, Homo sapien
gtatatgcctaaacatggtaattgg

SEQ ID NO: 587817 - DNA, 25 bp, Homo sapien
tgctgtatatttgcctaaatggact

SEQ ID NO: 587818 - DNA, 25 bp, Homo sapien
attgtcatagataatcctgtaccaa

SEQ ID NO: 587819 - DNA, 25 bp, Homo sapien
taatcatgttgtctaatggtactct

SEQ ID NO: 587820 - DNA, 25 bp, Homo sapien
atctatacttcctttgtgtgagaga

SEQ ID NO: 587821 - DNA, 25 bp, Homo sapien
atacttcctttgtgtgagagaaaat

SEQ ID NO: 587822 - DNA, 25 bp, Homo sapien
tttggaaagctttataagtccatat

SEQ ID NO: 587823 - DNA, 25 bp, Homo sapien
tatttcattagcgttaagtacattc

SEQ ID NO: 587824 - DNA, 25 bp, Homo sapien
tcacatagttatgcaaaagatctgt

SEQ ID NO: 587825 - DNA, 25 bp, Homo sapien
gcaaaagatctgtagaacttctatg

SEQ ID NO: 587826 - DNA, 25 bp, Homo sapien
gatctgtagaacttctatgtcttgc

SEQ ID NO: 587827 - DNA, 25 bp, Homo sapien
gtagaacttctatgtcttgcaaaac

SEQ ID NO: 587828 - DNA, 25 bp, Homo sapien
gaacttctatgtcttgcaaaactaa

SEQ ID NO: 587829 - DNA, 25 bp, Homo sapien
ctatgtcttgcaaaactaacattaa

SEQ ID NO: 587830 - DNA, 25 bp, Homo sapien
gtcttttaagacaattgcccatttt

SEQ ID NO: 587831 - DNA, 25 bp, Homo sapien
accttactgaattacaaactgataa

SEQ ID NO: 587832 - DNA, 25 bp, Homo sapien
aactgataagcacacagagaaccag

SEQ ID NO: 587833 - DNA, 25 bp, Homo sapien
accagagtggatatgaaggtgtcac

SEQ ID NO: 587834 - DNA, 25 bp, Homo sapien
gtgtcactattgaacctggagctga

SEQ ID NO: 587835 - DNA, 25 bp, Homo sapien
cactattgaacctggagctgatctt

SEQ ID NO: 587836 - DNA, 25 bp, Homo sapien
gagctgatcttttgtatgatgtacc

SEQ ID NO: 587837 - DNA, 25 bp, Homo sapien
tttgtatgatgtaccttcctcacag

SEQ ID NO: 587838 - DNA, 25 bp, Homo sapien
atgtaccttcctcacaggctatata

SEQ ID NO: 587839 - DNA, 25 bp, Homo sapien
ttcctcacaggctatatactttgaa

SEQ ID NO: 587840 - DNA, 25 bp, Homo sapien
actttgaaaatttgcagaactcttc

SEQ ID NO: 587841 - DNA, 25 bp, Homo sapien
gcagaactcttcaaatgatttgggt

SEQ ID NO: 587842 - DNA, 25 bp, Homo sapien
acagcttgtttcgtatggccccaga

SEQ ID NO: 587843 - DNA, 25 bp, Homo sapien
agcttgtttcgtatggccccagaac

SEQ ID NO: 587844 - DNA, 25 bp, Homo sapien
cttgtttcgtatggccccagaacta

SEQ ID NO: 587845 - DNA, 25 bp, Homo sapien
ttcgtatggccccagaactaagaat

SEQ ID NO: 587846 - DNA, 25 bp, Homo sapien
gtatggccccagaactaagaatgct

SEQ ID NO: 587847 - DNA, 25 bp, Homo sapien
atggccccagaactaagaatgcttt

SEQ ID NO: 587848 - DNA, 25 bp, Homo sapien
ggccccagaactaagaatgcttttc

SEQ ID NO: 587849 - DNA, 25 bp, Homo sapien
ccagaactaagaatgcttttcgctt

SEQ ID NO: 587850 - DNA, 25 bp, Homo sapien
atatgtgtttgaagaattacgtgtc

SEQ ID NO: 587851 - DNA, 25 bp, Homo sapien
gaagaattacgtgtcttgcaaatgt

SEQ ID NO: 587852 - DNA, 25 bp, Homo sapien
agaattacgtgtcttgcaaatgtat

SEQ ID NO: 587853 - DNA, 25 bp, Homo sapien
aattcagacccgtttcacagtgagc

SEQ ID NO: 587854 - DNA, 25 bp, Homo sapien
gtgagcccaaggagccaaagcaaga

SEQ ID NO: 587855 - DNA, 25 bp, Homo sapien
aagagagggaacctgaagcagcccc

SEQ ID NO: 587856 - DNA, 25 bp, Homo sapien
agccccagaatccaactcagagtta

SEQ ID NO: 587857 - DNA, 25 bp, Homo sapien
agagcacagctctaacctgacagcc

SEQ ID NO: 587858 - DNA, 25 bp, Homo sapien
gagcgaggagctcattgcccagtat

SEQ ID NO: 587859 - DNA, 25 bp, Homo sapien
gagctcattgcccagtatgaccaaa

SEQ ID NO: 587860 - DNA, 25 bp, Homo sapien
ttaaagagctggattccggcgccga

SEQ ID NO: 587861 - DNA, 25 bp, Homo sapien
cgccgagggcttgatggaacagaat

SEQ ID NO: 587862 - DNA, 25 bp, Homo sapien
ggaacagaattaccccacacctgat

SEQ ID NO: 587863 - DNA, 25 bp, Homo sapien
tgatcccttgcttctcactaaggag

SEQ ID NO: 587864 - DNA, 25 bp, Homo sapien
aagtcctggttgtaagaagtgggat

SEQ ID NO: 587865 - DNA, 25 bp, Homo sapien
gaagtgggatacttgtgctccagaa

SEQ ID NO: 587866 - DNA, 25 bp, Homo sapien
gtgggatacttgtgctccagaagtt

SEQ ID NO: 587867 - DNA, 25 bp, Homo sapien
ggatacttgtgctccagaagttatt

SEQ ID NO: 587868 - DNA, 25 bp, Homo sapien
cttgtgctccagaagttattttaca

SEQ ID NO: 587869 - DNA, 25 bp, Homo sapien
tgctccagaagttattttacatgct

SEQ ID NO: 587870 - DNA, 25 bp, Homo sapien
tattttacatgctgtgggaggcaag

SEQ ID NO: 587871 - DNA, 25 bp, Homo sapien
ctgtgggaggcaagttaaccgatat

SEQ ID NO: 587872 - DNA, 25 bp, Homo sapien
gggaggcaagttaaccgatatccat

SEQ ID NO: 587873 - DNA, 25 bp, Homo sapien
ggcaagttaaccgatatccatggga

SEQ ID NO: 587874 - DNA, 25 bp, Homo sapien
agttaaccgatatccatgggaatgt

SEQ ID NO: 587875 - DNA, 25 bp, Homo sapien
ctttctaaggctgacaacccaaggg

SEQ ID NO: 587876 - DNA, 25 bp, Homo sapien
ttaagccaggcctgcacagtggtga

SEQ ID NO: 587877 - DNA, 25 bp, Homo sapien
aggcctgcacagtggtgacctaagt

SEQ ID NO: 587878 - DNA, 25 bp, Homo sapien
agtggtgacctaagtcactgcaggg

SEQ ID NO: 587879 - DNA, 25 bp, Homo sapien
gtgcagagctgtgacataagcaggt

SEQ ID NO: 587880 - DNA, 25 bp, Homo sapien
agcaggtgactttccctatcagaac

SEQ ID NO: 587881 - DNA, 25 bp, Homo sapien
aggtgactttccctatcagaacttt

SEQ ID NO: 587882 - DNA, 25 bp, Homo sapien
gactttccctatcagaactttcagt

SEQ ID NO: 587883 - DNA, 25 bp, Homo sapien
gaactttcagttaagtcacttccat

SEQ ID NO: 587884 - DNA, 25 bp, Homo sapien
tcagttaagtcacttccatggaaga

SEQ ID NO: 587885 - DNA, 25 bp, Homo sapien
ctatgaagagcctctgtaacagtac

SEQ ID NO: 587886 - DNA, 25 bp, Homo sapien
tgtttgttttgcacatttctcatac

SEQ ID NO: 587887 - DNA, 25 bp, Homo sapien
tttgcacatttctcataccacaggt

SEQ ID NO: 587888 - DNA, 25 bp, Homo sapien
ataccacaggtattgaagcccctgg

SEQ ID NO: 587889 - DNA, 25 bp, Homo sapien
tattgaagcccctgggtgataattt

SEQ ID NO: 587890 - DNA, 25 bp, Homo sapien
taaggcagtctgtaacaaactctat

SEQ ID NO: 587891 - DNA, 25 bp, Homo sapien
aacaaactctatcaaagcaggcctg

SEQ ID NO: 587892 - DNA, 25 bp, Homo sapien
aaagcaggcctgactgaccaggtgt

SEQ ID NO: 587893 - DNA, 25 bp, Homo sapien
tgactgaccaggtgtctcatcatgc

SEQ ID NO: 587894 - DNA, 25 bp, Homo sapien
ccaggtgtctcatcatgccagatta

SEQ ID NO: 587895 - DNA, 25 bp, Homo sapien
gtgtctcatcatgccagattaaaga

SEQ ID NO: 587896 - DNA, 25 bp, Homo sapien
ttaaagacagactgacagttcatct

SEQ ID NO: 587897 - DNA, 25 bp, Homo sapien
agcgctttgtggattgtggtctgat

SEQ ID NO: 587898 - DNA, 25 bp, Homo sapien
tggtctgatctcacagtcgtgttga

SEQ ID NO: 587899 - DNA, 25 bp, Homo sapien
tcacagtcgtgttgagatttcctgc

SEQ ID NO: 587900 - DNA, 25 bp, Homo sapien
tctaggcacattctggtcccagtga

SEQ ID NO: 587901 - DNA, 25 bp, Homo sapien
ggtcccagtgacagaagactctcct

SEQ ID NO: 587902 - DNA, 25 bp, Homo sapien
ctgccactcgcaggaaagcaatggg

SEQ ID NO: 587903 - DNA, 25 bp, Homo sapien
caatgggcatgtggccgaacttctc

SEQ ID NO: 587904 - DNA, 25 bp, Homo sapien
tccatctcctgcatgttgctttaac

SEQ ID NO: 587905 - DNA, 25 bp, Homo sapien
gttgctttaacaggctcgttcatgt

SEQ ID NO: 587906 - DNA, 25 bp, Homo sapien
ggctcgttcatgttttactaagcat

SEQ ID NO: 587907 - DNA, 25 bp, Homo sapien
actaagcatcaagagcgtgggcaga

SEQ ID NO: 587908 - DNA, 25 bp, Homo sapien
acactcctcttaggtgactaataaa

SEQ ID NO: 587909 - DNA, 25 bp, Homo sapien
gtgactaataaagaggcccaaggcc

SEQ ID NO: 587910 - DNA, 25 bp, Homo sapien
taaagaggcccaaggccagtttctg

SEQ ID NO: 587911 - DNA, 25 bp, Homo sapien
agtttctgccttaatcatttctggc

SEQ ID NO: 587912 - DNA, 25 bp, Homo sapien
ggccagtgggatacttaattctgca

SEQ ID NO: 587913 - DNA, 25 bp, Homo sapien
gggatacttaattctgcagtctcta

SEQ ID NO: 587914 - DNA, 25 bp, Homo sapien
attctgcagtctctatagacctcgc

SEQ ID NO: 587915 - DNA, 25 bp, Homo sapien
tggacagagcagtccttccagacca

SEQ ID NO: 587916 - DNA, 25 bp, Homo sapien
gtccttccagaccattctagatgag

SEQ ID NO: 587917 - DNA, 25 bp, Homo sapien
tagatgagagtcaacactgagcctc

SEQ ID NO: 587918 - DNA, 25 bp, Homo sapien
aggctccattccaagtaaacatctg

SEQ ID NO: 587919 - DNA, 25 bp, Homo sapien
gcaattgcaagaaaggcgttgaaca

SEQ ID NO: 587920 - DNA, 25 bp, Homo sapien
aaaagtaccttaagaaggcacatat

SEQ ID NO: 587921 - DNA, 25 bp, Homo sapien
gaaggcacatatataatagagatca

SEQ ID NO: 587922 - DNA, 25 bp, Homo sapien
aaagccatggctattaagacagatg

SEQ ID NO: 587923 - DNA, 25 bp, Homo sapien
accttaaggaagcacatatatagag

SEQ ID NO: 587924 - DNA, 25 bp, Homo sapien
agcacatatatagagctcaggctgt

SEQ ID NO: 587925 - DNA, 25 bp, Homo sapien
gagctcaggctgtcagatacaactg

SEQ ID NO: 587926 - DNA, 25 bp, Homo sapien
ggctgtcagatacaactgcattaga

SEQ ID NO: 587927 - DNA, 25 bp, Homo sapien
gataaacaaccagtgtacaacgtag

SEQ ID NO: 587928 - DNA, 25 bp, Homo sapien
caaccagtgtacaacgtagaggtta

SEQ ID NO: 587929 - DNA, 25 bp, Homo sapien
taaaaatgctgatttcccagaggtg

SEQ ID NO: 587930 - DNA, 25 bp, Homo sapien
aacaggttttgaaagcaagtttgat

SEQ ID NO: 587931 - DNA, 25 bp, Homo sapien
cttcttcaacaagctattatttcag

SEQ ID NO: 587932 - DNA, 25 bp, Homo sapien
gctattatttcagctctaactctgg

SEQ ID NO: 587933 - DNA, 25 bp, Homo sapien
attatttcagctctaactctggtca

SEQ ID NO: 587934 - DNA, 25 bp, Homo sapien
atttcagctctaactctggtcatat

SEQ ID NO: 587935 - DNA, 25 bp, Homo sapien
ttcagctctaactctggtcatatac

SEQ ID NO: 587936 - DNA, 25 bp, Homo sapien
gctctaactctggtcatatacttgt

SEQ ID NO: 587937 - DNA, 25 bp, Homo sapien
taactctggtcatatacttgttttt

SEQ ID NO: 587938 - DNA, 25 bp, Homo sapien
gcttctttttctggcaacatattca

SEQ ID NO: 587939 - DNA, 25 bp, Homo sapien
gaatttaaatattcactaggcttta

SEQ ID NO: 587940 - DNA, 25 bp, Homo sapien
tttaaatattcactaggctttatgg

SEQ ID NO: 587941 - DNA, 25 bp, Homo sapien
cccaaatcataccaacactgaaaag

SEQ ID NO: 587942 - DNA, 25 bp, Homo sapien
gaagagacaataagaagcattcttt

SEQ ID NO: 587943 - DNA, 25 bp, Homo sapien
gaagcattctttctttcaacatcac

SEQ ID NO: 587944 - DNA, 25 bp, Homo sapien
agcattctttctttcaacatcacag

SEQ ID NO: 587945 - DNA, 25 bp, Homo sapien
acatcacagacattggcaactctag

SEQ ID NO: 587946 - DNA, 25 bp, Homo sapien
atcacagacattggcaactctagga

SEQ ID NO: 587947 - DNA, 25 bp, Homo sapien
acagacattggcaactctaggatgt

SEQ ID NO: 587948 - DNA, 25 bp, Homo sapien
cattggcaactctaggatgtctata

SEQ ID NO: 587949 - DNA, 25 bp, Homo sapien
ttggcaactctaggatgtctataca

SEQ ID NO: 587950 - DNA, 25 bp, Homo sapien
ggcaactctaggatgtctatacaga

SEQ ID NO: 587951 - DNA, 25 bp, Homo sapien
ctaggatgtctatacagagggataa

SEQ ID NO: 587952 - DNA, 25 bp, Homo sapien
ttagatgtgagttaattgctgacca

SEQ ID NO: 587953 - DNA, 25 bp, Homo sapien
tcttgagaaattaactttcggagtc

SEQ ID NO: 587954 - DNA, 25 bp, Homo sapien
gtgagttaattgctgaccatgtgga

SEQ ID NO: 587955 - DNA, 25 bp, Homo sapien
agttaattgctgaccatgtggattt

SEQ ID NO: 587956 - DNA, 25 bp, Homo sapien
tgctgaccatgtggatttagaatct

SEQ ID NO: 587957 - DNA, 25 bp, Homo sapien
gaccatgtggatttagaatctgttt

SEQ ID NO: 587958 - DNA, 25 bp, Homo sapien
gaatctgttttaaactgggtgctat

SEQ ID NO: 587959 - DNA, 25 bp, Homo sapien
taaactgggtgctatttagaagaca

SEQ ID NO: 587960 - DNA, 25 bp, Homo sapien
gtgctatttagaagacagtgggtct

SEQ ID NO: 587961 - DNA, 25 bp, Homo sapien
gtcttcattggttgctggttttagt

SEQ ID NO: 587962 - DNA, 25 bp, Homo sapien
cattggttgctggttttagtatcta

SEQ ID NO: 587963 - DNA, 25 bp, Homo sapien
gctttgaagtaagacgtaacgggat

SEQ ID NO: 587964 - DNA, 25 bp, Homo sapien
gatgaacgggatgttttctaaactt

SEQ ID NO: 587965 - DNA, 25 bp, Homo sapien
acttggtgaaacgtataaatctaca

SEQ ID NO: 587966 - DNA, 25 bp, Homo sapien
aattcataaagctccagaaagccca

SEQ ID NO: 587967 - DNA, 25 bp, Homo sapien
aagctccagaaagcccaaccaggat

SEQ ID NO: 587968 - DNA, 25 bp, Homo sapien
tccagaaagcccaaccaggatgtgt

SEQ ID NO: 587969 - DNA, 25 bp, Homo sapien
aaagcccaaccaggatgtgtgtcca

SEQ ID NO: 587970 - DNA, 25 bp, Homo sapien
tccagaaatccctgtctaggcttgt

SEQ ID NO: 587971 - DNA, 25 bp, Homo sapien
gaaatccctgtctaggcttgtcatt

SEQ ID NO: 587972 - DNA, 25 bp, Homo sapien
ccctgtctaggcttgtcattgtcaa

SEQ ID NO: 587973 - DNA, 25 bp, Homo sapien
tgtctaggcttgtcattgtcaaact

SEQ ID NO: 587974 - DNA, 25 bp, Homo sapien
gggtggaccacttgacgtccgtagt

SEQ ID NO: 587975 - DNA, 25 bp, Homo sapien
ggtggaccacttgacgtccgtagtt

SEQ ID NO: 587976 - DNA, 25 bp, Homo sapien
gtggaccacttgacgtccgtagttc

SEQ ID NO: 587977 - DNA, 25 bp, Homo sapien
tggaccacttgacgtccgtagttcg

SEQ ID NO: 587978 - DNA, 25 bp, Homo sapien
ggaccacttgacgtccgtagttcga

SEQ ID NO: 587979 - DNA, 25 bp, Homo sapien
gaccacttgacgtccgtagttcgag

SEQ ID NO: 587980 - DNA, 25 bp, Homo sapien
accacttgacgtccgtagttcgaga

SEQ ID NO: 587981 - DNA, 25 bp, Homo sapien
ccacttgacgtccgtagttcgagac

SEQ ID NO: 587982 - DNA, 25 bp, Homo sapien
cacttgacgtccgtagttcgagacc

SEQ ID NO: 587983 - DNA, 25 bp, Homo sapien
acttgacgtccgtagttcgagacca

SEQ ID NO: 587984 - DNA, 25 bp, Homo sapien
cttgacgtccgtagttcgagaccag

SEQ ID NO: 587985 - DNA, 25 bp, Homo sapien
ttattagaaattattggccaggtac

SEQ ID NO: 587986 - DNA, 25 bp, Homo sapien
tattagaaattattggccaggtacg

SEQ ID NO: 587987 - DNA, 25 bp, Homo sapien
attagaaattattggccaggtacgg

SEQ ID NO: 587988 - DNA, 25 bp, Homo sapien
ttagaaattattggccaggtacggt

SEQ ID NO: 587989 - DNA, 25 bp, Homo sapien
tagaaattattggccaggtacggtg

SEQ ID NO: 587990 - DNA, 25 bp, Homo sapien
agaaattattggccaggtacggtgg

SEQ ID NO: 587991 - DNA, 25 bp, Homo sapien
tggagaccgccctggacaatatggt

SEQ ID NO: 587992 - DNA, 25 bp, Homo sapien
ccgccctggacaatatggtgaagcc

SEQ ID NO: 587993 - DNA, 25 bp, Homo sapien
taaaaacgcacagaaaaattagcca

SEQ ID NO: 587994 - DNA, 25 bp, Homo sapien
aaaaacgcacagaaaaattagccag

SEQ ID NO: 587995 - DNA, 25 bp, Homo sapien
tgggcaatggagagaggctctgtct

SEQ ID NO: 587996 - DNA, 25 bp, Homo sapien
agagggcctaatgagaaaatgctgc

SEQ ID NO: 587997 - DNA, 25 bp, Homo sapien
atgctgcctgatttttaacaggtgc

SEQ ID NO: 587998 - DNA, 25 bp, Homo sapien
ctgatttttaacaggtgcagttcag

SEQ ID NO: 587999 - DNA, 25 bp, Homo sapien
attattgattccaacatttcgctag

SEQ ID NO: 588000 - DNA, 25 bp, Homo sapien
attgattccaacatttcgctagatg

SEQ ID NO: 588001 - DNA, 25 bp, Homo sapien
tccaacatttcgctagatgaagagc

SEQ ID NO: 588002 - DNA, 25 bp, Homo sapien
gctagatgaagagcacctatgttct

SEQ ID NO: 588003 - DNA, 25 bp, Homo sapien
gattttgttgtatcacgctgagccg

SEQ ID NO: 588004 - DNA, 25 bp, Homo sapien
ttttgttgtatcacgctgagccgtt

SEQ ID NO: 588005 - DNA, 25 bp, Homo sapien
tgttgtatcacgctgagccgtttct

SEQ ID NO: 588006 - DNA, 25 bp, Homo sapien
gtatcacgctgagccgtttctggag

SEQ ID NO: 588007 - DNA, 25 bp, Homo sapien
atgctgcaaccttaccactttttgt

SEQ ID NO: 588008 - DNA, 25 bp, Homo sapien
taccactttttgttggcctagctta

SEQ ID NO: 588009 - DNA, 25 bp, Homo sapien
gttggcctagcttaatccaagtata

SEQ ID NO: 588010 - DNA, 25 bp, Homo sapien
gggataatactcttcacgctttgtt

SEQ ID NO: 588011 - DNA, 25 bp, Homo sapien
cttcacgctttgttatagttattgt

SEQ ID NO: 588012 - DNA, 25 bp, Homo sapien
atctcagtgatcagcttctcacagg

SEQ ID NO: 588013 - DNA, 25 bp, Homo sapien
tcagcttctcacaggaagggatcat

SEQ ID NO: 588014 - DNA, 25 bp, Homo sapien
aagggatcatattcacgttggtttg

SEQ ID NO: 588015 - DNA, 25 bp, Homo sapien
atttatgactgtgatttgtccagga

SEQ ID NO: 588016 - DNA, 25 bp, Homo sapien
ttgtccaggaatcatcacagcgctc

SEQ ID NO: 588017 - DNA, 25 bp, Homo sapien
cacagcgctccattttgaattatag

SEQ ID NO: 588018 - DNA, 25 bp, Homo sapien
atctctactggaaatgcaaaggtta

SEQ ID NO: 588019 - DNA, 25 bp, Homo sapien
ctactggaaatgcaaaggttagccg

SEQ ID NO: 588020 - DNA, 25 bp, Homo sapien
ctactcgggagactaggcagagaat

SEQ ID NO: 588021 - DNA, 25 bp, Homo sapien
tactcgggagactaggcagagaatt

SEQ ID NO: 588022 - DNA, 25 bp, Homo sapien
tcgggagactaggcagagaattggt

SEQ ID NO: 588023 - DNA, 25 bp, Homo sapien
cgggagactaggcagagaattggtt

SEQ ID NO: 588024 - DNA, 25 bp, Homo sapien
gggagactaggcagagaattggttg

SEQ ID NO: 588025 - DNA, 25 bp, Homo sapien
ggagactaggcagagaattggttga

SEQ ID NO: 588026 - DNA, 25 bp, Homo sapien
gagactaggcagagaattggttgaa

SEQ ID NO: 588027 - DNA, 25 bp, Homo sapien
agactaggcagagaattggttgaac

SEQ ID NO: 588028 - DNA, 25 bp, Homo sapien
tggagttagcgaaaaattatcagcc

SEQ ID NO: 588029 - DNA, 25 bp, Homo sapien
aattatcagccacggagagcattgt

SEQ ID NO: 588030 - DNA, 25 bp, Homo sapien
gaagtattgccattgactcttgaat

SEQ ID NO: 588031 - DNA, 25 bp, Homo sapien
attgccattgactcttgaattggag

SEQ ID NO: 588032 - DNA, 25 bp, Homo sapien
gaattggagattctcgaaaatcccc

SEQ ID NO: 588033 - DNA, 25 bp, Homo sapien
aaactggagtgtatcccagctccca

SEQ ID NO: 588034 - DNA, 25 bp, Homo sapien
tgctgccactactgttagttctccg

SEQ ID NO: 588035 - DNA, 25 bp, Homo sapien
actactgttagttctccgagtgctg

SEQ ID NO: 588036 - DNA, 25 bp, Homo sapien
tagttctccgagtgctgccatcaca

SEQ ID NO: 588037 - DNA, 25 bp, Homo sapien
tgccatcacagtccagagagtccta

SEQ ID NO: 588038 - DNA, 25 bp, Homo sapien
catcacagtccagagagtcctagag

SEQ ID NO: 588039 - DNA, 25 bp, Homo sapien
gatgggaatgaactgagttttttcc

SEQ ID NO: 588040 - DNA, 25 bp, Homo sapien
aatgaactgagttttttcccccatg

SEQ ID NO: 588041 - DNA, 25 bp, Homo sapien
tgaactgagttttttcccccatgga

SEQ ID NO: 588042 - DNA, 25 bp, Homo sapien
ttcccccatggaattttgaagctta

SEQ ID NO: 588043 - DNA, 25 bp, Homo sapien
ttgaagcttaacctgacaaaaattc

SEQ ID NO: 588044 - DNA, 25 bp, Homo sapien
gagaataatttcactcatccttgtt

SEQ ID NO: 588045 - DNA, 25 bp, Homo sapien
gaataatttcactcatccttgtttt

SEQ ID NO: 588046 - DNA, 25 bp, Homo sapien
aataatttcactcatccttgttttt

SEQ ID NO: 588047 - DNA, 25 bp, Homo sapien
tttgaataatccacaacaacttact

SEQ ID NO: 588048 - DNA, 25 bp, Homo sapien
gaataatccacaacaacttactcaa

SEQ ID NO: 588049 - DNA, 25 bp, Homo sapien
aatccacaacaacttactcaaatta

SEQ ID NO: 588050 - DNA, 25 bp, Homo sapien
aatgttatgattgctgaacagggca

SEQ ID NO: 588051 - DNA, 25 bp, Homo sapien
agcctcctcttgctgaaggaaaatt

SEQ ID NO: 588052 - DNA, 25 bp, Homo sapien
tgaaggaaaattcccagtgctgcct

SEQ ID NO: 588053 - DNA, 25 bp, Homo sapien
gagtgctttgagttcagactgacaa

SEQ ID NO: 588054 - DNA, 25 bp, Homo sapien
acaacagagtgggtctagcttctat

SEQ ID NO: 588055 - DNA, 25 bp, Homo sapien
gtctagcttctatgctttccatgaa

SEQ ID NO: 588056 - DNA, 25 bp, Homo sapien
tttccatgaagatctcccacaaatg

SEQ ID NO: 588057 - DNA, 25 bp, Homo sapien
atgaagatctcccacaaatgtcatc

SEQ ID NO: 588058 - DNA, 25 bp, Homo sapien
atgtcatccatgctcatgagatgga

SEQ ID NO: 588059 - DNA, 25 bp, Homo sapien
gctcatgagatggatcaacttgtat

SEQ ID NO: 588060 - DNA, 25 bp, Homo sapien
gggactcactgccttcaggcagtcc

SEQ ID NO: 588061 - DNA, 25 bp, Homo sapien
gtactgaatgtaatgtcccctatag

SEQ ID NO: 588062 - DNA, 25 bp, Homo sapien
tgtaatgtcccctataggtttagaa

SEQ ID NO: 588063 - DNA, 25 bp, Homo sapien
tcagtaatcaacatctttcacctat

SEQ ID NO: 588064 - DNA, 25 bp, Homo sapien
ttcacctatgtgattacaccttcat

SEQ ID NO: 588065 - DNA, 25 bp, Homo sapien
gattacaccttcataagcaaagcta

SEQ ID NO: 588066 - DNA, 25 bp, Homo sapien
gcaaagctagattccagctgataca

SEQ ID NO: 588067 - DNA, 25 bp, Homo sapien
gctgatacagcataacatctttcca

SEQ ID NO: 588068 - DNA, 25 bp, Homo sapien
gcataacatctttccattaaccaac

SEQ ID NO: 588069 - DNA, 25 bp, Homo sapien
aaccaggaaatagttagctctgctg

SEQ ID NO: 588070 - DNA, 25 bp, Homo sapien
gttagctctgctgtatgacaaaaag

SEQ ID NO: 588071 - DNA, 25 bp, Homo sapien
gaaactgaactgcattaacaatgtt

SEQ ID NO: 588072 - DNA, 25 bp, Homo sapien
tacaccacgtcccaaactggatttt

SEQ ID NO: 588073 - DNA, 25 bp, Homo sapien
actggattttccattcgactataat

SEQ ID NO: 588074 - DNA, 25 bp, Homo sapien
cattcgactataattcctcccaata

SEQ ID NO: 588075 - DNA, 25 bp, Homo sapien
ataattcctcccaataagggctcaa

SEQ ID NO: 588076 - DNA, 25 bp, Homo sapien
taagggctcaaaacgttgtctaagg

SEQ ID NO: 588077 - DNA, 25 bp, Homo sapien
aagtcgattggttgttgcccagggc

SEQ ID NO: 588078 - DNA, 25 bp, Homo sapien
cagagtttccttttgagatgatgag

SEQ ID NO: 588079 - DNA, 25 bp, Homo sapien
gagaatgtcctgaagctggtcatgc

SEQ ID NO: 588080 - DNA, 25 bp, Homo sapien
aagctggtcatgctgatggttgcac

SEQ ID NO: 588081 - DNA, 25 bp, Homo sapien
gctgatggttgcacgtatctatgaa

SEQ ID NO: 588082 - DNA, 25 bp, Homo sapien
gcatgtgaattaaacctcaagtcgt

SEQ ID NO: 588083 - DNA, 25 bp, Homo sapien
aatcagcctcgagagggactgcact

SEQ ID NO: 588084 - DNA, 25 bp, Homo sapien
gctggagacagagtcagagcagtca

SEQ ID NO: 588085 - DNA, 25 bp, Homo sapien
cagtcaagggtgggagcttccagcc

SEQ ID NO: 588086 - DNA, 25 bp, Homo sapien
tctagtgaagacagagtgcacctga

SEQ ID NO: 588087 - DNA, 25 bp, Homo sapien
gaagacagagtgcacctgacactgc

SEQ ID NO: 588088 - DNA, 25 bp, Homo sapien
tgacactgccatcacatcgtcagta

SEQ ID NO: 588089 - DNA, 25 bp, Homo sapien
tgccatcacatcgtcagtatcactg

SEQ ID NO: 588090 - DNA, 25 bp, Homo sapien
atcacatcgtcagtatcactgcctg

SEQ ID NO: 588091 - DNA, 25 bp, Homo sapien
tcgtcagtatcactgcctgtctctg

SEQ ID NO: 588092 - DNA, 25 bp, Homo sapien
tgtctctgccaccaaactaagatca

SEQ ID NO: 588093 - DNA, 25 bp, Homo sapien
tctgccaccaaactaagatcaaagg

SEQ ID NO: 588094 - DNA, 25 bp, Homo sapien
agccagtcataaaaggtcacctact

SEQ ID NO: 588095 - DNA, 25 bp, Homo sapien
aggtcacctactgttattcctttca

SEQ ID NO: 588096 - DNA, 25 bp, Homo sapien
gtcacctactgttattcctttcata

SEQ ID NO: 588097 - DNA, 25 bp, Homo sapien
cacctactgttattcctttcatagg

SEQ ID NO: 588098 - DNA, 25 bp, Homo sapien
aaatatccagataggcaagtccata

SEQ ID NO: 588099 - DNA, 25 bp, Homo sapien
tatccagataggcaagtccatagag

SEQ ID NO: 588100 - DNA, 25 bp, Homo sapien
tccagataggcaagtccatagagac

SEQ ID NO: 588101 - DNA, 25 bp, Homo sapien
caaggagaatgagagtgaccgctaa

SEQ ID NO: 588102 - DNA, 25 bp, Homo sapien
agtgaccgctaatgggtgtggcatt

SEQ ID NO: 588103 - DNA, 25 bp, Homo sapien
accgctaatgggtgtggcatttctt

SEQ ID NO: 588104 - DNA, 25 bp, Homo sapien
gtgtggcatttctttgtgaggtaat

SEQ ID NO: 588105 - DNA, 25 bp, Homo sapien
caagaggctgtatatgtagccagct

SEQ ID NO: 588106 - DNA, 25 bp, Homo sapien
gctgtatatgtagccagctgggttt

SEQ ID NO: 588107 - DNA, 25 bp, Homo sapien
gggcacctcatgagtatcccatagc

SEQ ID NO: 588108 - DNA, 25 bp, Homo sapien
catgagtatcccatagcacaaacgg

SEQ ID NO: 588109 - DNA, 25 bp, Homo sapien
gtatcccatagcacaaacgggcaaa

SEQ ID NO: 588110 - DNA, 25 bp, Homo sapien
ttaactaaaagacaaaactccacat

SEQ ID NO: 588111 - DNA, 25 bp, Homo sapien
aactccacataaacctgagtccttc

SEQ ID NO: 588112 - DNA, 25 bp, Homo sapien
cataaacctgagtccttccaaccaa

SEQ ID NO: 588113 - DNA, 25 bp, Homo sapien
tgagtccttccaaccaacccggaga

SEQ ID NO: 588114 - DNA, 25 bp, Homo sapien
ggagacttacccaaatctaatctaa

SEQ ID NO: 588115 - DNA, 25 bp, Homo sapien
gaaaaaatcactatgagcctgtaag

SEQ ID NO: 588116 - DNA, 25 bp, Homo sapien
tcattaactcatttcacctcagtga

SEQ ID NO: 588117 - DNA, 25 bp, Homo sapien
cctcagtgaattctggagcctggct

SEQ ID NO: 588118 - DNA, 25 bp, Homo sapien
ctgtttttgtgcctcctctttgcca

SEQ ID NO: 588119 - DNA, 25 bp, Homo sapien
cctctttgccagtggatcatcagaa

SEQ ID NO: 588120 - DNA, 25 bp, Homo sapien
tggatcatcagaacaaccccttttg

SEQ ID NO: 588121 - DNA, 25 bp, Homo sapien
cagaacaaccccttttgtagcagtt

SEQ ID NO: 588122 - DNA, 25 bp, Homo sapien
aagtggtgaatccatgccttggcat

SEQ ID NO: 588123 - DNA, 25 bp, Homo sapien
gccttggcattcctggattattcca

SEQ ID NO: 588124 - DNA, 25 bp, Homo sapien
ggattattccatgtcatgtcagatc

SEQ ID NO: 588125 - DNA, 25 bp, Homo sapien
gacacatgtcatgtgatgcattcta

SEQ ID NO: 588126 - DNA, 25 bp, Homo sapien
gatgcattctatgctgagcaccatc

SEQ ID NO: 588127 - DNA, 25 bp, Homo sapien
ccttgaccaagaaatagcacttatg

SEQ ID NO: 588128 - DNA, 25 bp, Homo sapien
aatagcacttatgggaactctacag

SEQ ID NO: 588129 - DNA, 25 bp, Homo sapien
acttatgggaactctacagatggat

SEQ ID NO: 588130 - DNA, 25 bp, Homo sapien
gatggatttctacacatctgaagtg

SEQ ID NO: 588131 - DNA, 25 bp, Homo sapien
atctgaagtgatgcattggccacac

SEQ ID NO: 588132 - DNA, 25 bp, Homo sapien
agtccatccctacaggacttgttta

SEQ ID NO: 588133 - DNA, 25 bp, Homo sapien
tccctacaggacttgtttaataaat

SEQ ID NO: 588134 - DNA, 25 bp, Homo sapien
gaattatccatactttacatctatt

SEQ ID NO: 588135 - DNA, 25 bp, Homo sapien
aaaaatgaatacttgggccaggctc

SEQ ID NO: 588136 - DNA, 25 bp, Homo sapien
gaatacttgggccaggctcacatct

SEQ ID NO: 588137 - DNA, 25 bp, Homo sapien
atacttgggccaggctcacatctgt

SEQ ID NO: 588138 - DNA, 25 bp, Homo sapien
taaaagtggcagttttccctgcact

SEQ ID NO: 588139 - DNA, 25 bp, Homo sapien
aaaagtggcagttttccctgcactc

SEQ ID NO: 588140 - DNA, 25 bp, Homo sapien
ttcccctttgcctttcgtcacaatt

SEQ ID NO: 588141 - DNA, 25 bp, Homo sapien
cctttgcctttcgtcacaattgtaa

SEQ ID NO: 588142 - DNA, 25 bp, Homo sapien
gcctttcgtcacaattgtaagttcc

SEQ ID NO: 588143 - DNA, 25 bp, Homo sapien
tttcgtcacaattgtaagttccccg

SEQ ID NO: 588144 - DNA, 25 bp, Homo sapien
gtaagttccccgaggttcgtcatga

SEQ ID NO: 588145 - DNA, 25 bp, Homo sapien
aagttccccgaggttcgtcatgatt

SEQ ID NO: 588146 - DNA, 25 bp, Homo sapien
ttccccgaggttcgtcatgattgta

SEQ ID NO: 588147 - DNA, 25 bp, Homo sapien
ccccgaggttcgtcatgattgtaag

SEQ ID NO: 588148 - DNA, 25 bp, Homo sapien
cccgaggttcgtcatgattgtaagt

SEQ ID NO: 588149 - DNA, 25 bp, Homo sapien
aatgaggttgttgcagatataatta

SEQ ID NO: 588150 - DNA, 25 bp, Homo sapien
ggtcttattggcatagggtggcccc

SEQ ID NO: 588151 - DNA, 25 bp, Homo sapien
cccctaattcgattgttgtacatat

SEQ ID NO: 588152 - DNA, 25 bp, Homo sapien
aatctgaacacaaagacatgcacat

SEQ ID NO: 588153 - DNA, 25 bp, Homo sapien
gacatgcacataggctaagtaccat

SEQ ID NO: 588154 - DNA, 25 bp, Homo sapien
ataggctaagtaccatgtgaagatg

SEQ ID NO: 588155 - DNA, 25 bp, Homo sapien
agcagaggccaagggacaccaagga

SEQ ID NO: 588156 - DNA, 25 bp, Homo sapien
agcaaaccatcagaagctgggagcg

SEQ ID NO: 588157 - DNA, 25 bp, Homo sapien
gagcggcaaggaacagatcctcccc

SEQ ID NO: 588158 - DNA, 25 bp, Homo sapien
aggaaccaattctgccaaaatctag

SEQ ID NO: 588159 - DNA, 25 bp, Homo sapien
attctgccaaaatctaggacttcta

SEQ ID NO: 588160 - DNA, 25 bp, Homo sapien
aaattgggagatgtccaatgtggac

SEQ ID NO: 588161 - DNA, 25 bp, Homo sapien
caatgtggacactgggtaatgggtt

SEQ ID NO: 588162 - DNA, 25 bp, Homo sapien
gacactgggtaatgggtttattcca

SEQ ID NO: 588163 - DNA, 25 bp, Homo sapien
tcacattgtaacttgtaacacgaac

SEQ ID NO: 588164 - DNA, 25 bp, Homo sapien
taacacgaacacaacaagaacagag

SEQ ID NO: 588165 - DNA, 25 bp, Homo sapien
gtaaacattcaatataccgttccat

SEQ ID NO: 588166 - DNA, 25 bp, Homo sapien
caatataccgttccatatggtgaat

SEQ ID NO: 588167 - DNA, 25 bp, Homo sapien
accgttccatatggtgaatgttcaa

SEQ ID NO: 588168 - DNA, 25 bp, Homo sapien
ataagctaagacctagttactaata

SEQ ID NO: 588169 - DNA, 25 bp, Homo sapien
tacattataaatgctgtcgtgaaaa

SEQ ID NO: 588170 - DNA, 25 bp, Homo sapien
gaaaatggaggttattgtcttaagt

SEQ ID NO: 588171 - DNA, 25 bp, Homo sapien
gaatatctgaggtgacaatgtgtga

SEQ ID NO: 588172 - DNA, 25 bp, Homo sapien
ctgaggtgacaatgtgtgataaaaa

SEQ ID NO: 588173 - DNA, 25 bp, Homo sapien
tgaggtgacaatgtgtgataaaaac

SEQ ID NO: 588174 - DNA, 25 bp, Homo sapien
gaggtgacaatgtgtgataaaaact

SEQ ID NO: 588175 - DNA, 25 bp, Homo sapien
gtgacaatgtgtgataaaaactaga

SEQ ID NO: 588176 - DNA, 25 bp, Homo sapien
tgacaatgtgtgataaaaactagag

SEQ ID NO: 588177 - DNA, 25 bp, Homo sapien
acaatgtgtgataaaaactagagct

SEQ ID NO: 588178 - DNA, 25 bp, Homo sapien
caatgtgtgataaaaactagagcta

SEQ ID NO: 588179 - DNA, 25 bp, Homo sapien
aaactagagctagtgggccaggcgc

SEQ ID NO: 588180 - DNA, 25 bp, Homo sapien
aactagagctagtgggccaggcgcg

SEQ ID NO: 588181 - DNA, 25 bp, Homo sapien
actagagctagtgggccaggcgcgg

SEQ ID NO: 588182 - DNA, 25 bp, Homo sapien
gttgaattgtaattcctgatgttgg

SEQ ID NO: 588183 - DNA, 25 bp, Homo sapien
ggaagggacatggagggaggtgatt

SEQ ID NO: 588184 - DNA, 25 bp, Homo sapien
gaatggtttcccctatgctgttctt

SEQ ID NO: 588185 - DNA, 25 bp, Homo sapien
ttataagtgtttggctcctccccca

SEQ ID NO: 588186 - DNA, 25 bp, Homo sapien
tgccaccatgtaaagaaggtgcttg

SEQ ID NO: 588187 - DNA, 25 bp, Homo sapien
agaaggtgcttgctttcccttcgtc

SEQ ID NO: 588188 - DNA, 25 bp, Homo sapien
gaaggtgcttgctttcccttcgtct

SEQ ID NO: 588189 - DNA, 25 bp, Homo sapien
aaggtgcttgctttcccttcgtctt

SEQ ID NO: 588190 - DNA, 25 bp, Homo sapien
tgcttgctttcccttcgtcttctgc

SEQ ID NO: 588191 - DNA, 25 bp, Homo sapien
ttgctttcccttcgtcttctgccat

SEQ ID NO: 588192 - DNA, 25 bp, Homo sapien
cttccagtcatgcttcctgttaagc

SEQ ID NO: 588193 - DNA, 25 bp, Homo sapien
atgtgttaacatgcaagggtttatt

SEQ ID NO: 588194 - DNA, 25 bp, Homo sapien
gatatctcacataataaacactgtt

SEQ ID NO: 588195 - DNA, 25 bp, Homo sapien
gggtcctcagtgatttttaagagag

SEQ ID NO: 588196 - DNA, 25 bp, Homo sapien
gtgaacagagtgtgtgagttgtact

SEQ ID NO: 588197 - DNA, 25 bp, Homo sapien
tgagttgtactcaggcactgcgtta

SEQ ID NO: 588198 - DNA, 25 bp, Homo sapien
ttgtactcaggcactgcgttacgta

SEQ ID NO: 588199 - DNA, 25 bp, Homo sapien
ctcaggcactgcgttacgtatggca

SEQ ID NO: 588200 - DNA, 25 bp, Homo sapien
tgcgttacgtatggcaggtgctcat

SEQ ID NO: 588201 - DNA, 25 bp, Homo sapien
caggtgctcatgtatgcttgtgaca

SEQ ID NO: 588202 - DNA, 25 bp, Homo sapien
gctcatgtatgcttgtgacactcat

SEQ ID NO: 588203 - DNA, 25 bp, Homo sapien
atgtatgcttgtgacactcatgagt

SEQ ID NO: 588204 - DNA, 25 bp, Homo sapien
aggcctcaagggacttatagtttat

SEQ ID NO: 588205 - DNA, 25 bp, Homo sapien
gcctcaagggacttatagtttattt

SEQ ID NO: 588206 - DNA, 25 bp, Homo sapien
aaatattttataagcaacagatgtg

SEQ ID NO: 588207 - DNA, 25 bp, Homo sapien
gcaacagatgtgtaaggcactctaa

SEQ ID NO: 588208 - DNA, 25 bp, Homo sapien
gatgtgtaaggcactctaatattta

SEQ ID NO: 588209 - DNA, 25 bp, Homo sapien
gtgtaaggcactctaatatttaaag

SEQ ID NO: 588210 - DNA, 25 bp, Homo sapien
gtaagagtctgctttatatgaatat

SEQ ID NO: 588211 - DNA, 25 bp, Homo sapien
ggtgaaacatttacttaaactattg

SEQ ID NO: 588212 - DNA, 25 bp, Homo sapien
atttacttaaactattgcaatgcat

SEQ ID NO: 588213 - DNA, 25 bp, Homo sapien
gcaatgcattattaaaagatgacga

SEQ ID NO: 588214 - DNA, 25 bp, Homo sapien
gatgacgataaccacaaaagatgta

SEQ ID NO: 588215 - DNA, 25 bp, Homo sapien
gaaaatgtagttatccctaggagca

SEQ ID NO: 588216 - DNA, 25 bp, Homo sapien
ttatccctaggagcaatagcaccaa

SEQ ID NO: 588217 - DNA, 25 bp, Homo sapien
gcaatagcaccaattaactctcacc

SEQ ID NO: 588218 - DNA, 25 bp, Homo sapien
aattaactctcacccgtggaggaag

SEQ ID NO: 588219 - DNA, 25 bp, Homo sapien
cccgtggaggaagaattggttattg

SEQ ID NO: 588220 - DNA, 25 bp, Homo sapien
aattggttattggagagaccctaag

SEQ ID NO: 588221 - DNA, 25 bp, Homo sapien
tggttattggagagaccctaaggga

SEQ ID NO: 588222 - DNA, 25 bp, Homo sapien
agattttcagagagactgaatacct

SEQ ID NO: 588223 - DNA, 25 bp, Homo sapien
ctataattgtgctgtgtagtgtgga

SEQ ID NO: 588224 - DNA, 25 bp, Homo sapien
ggcaaaaagctccaaaatctagtat

SEQ ID NO: 588225 - DNA, 25 bp, Homo sapien
aagctccaaaatctagtataacata

SEQ ID NO: 588226 - DNA, 25 bp, Homo sapien
atttctataatatctggtgtctgga

SEQ ID NO: 588227 - DNA, 25 bp, Homo sapien
atatctggtgtctggagtattgaaa

SEQ ID NO: 588228 - DNA, 25 bp, Homo sapien
accattttacctggctatccacagt

SEQ ID NO: 588229 - DNA, 25 bp, Homo sapien
tccacagtcttctcaggagtgtcaa

SEQ ID NO: 588230 - DNA, 25 bp, Homo sapien
cttctcaggagtgtcaagagtacct

SEQ ID NO: 588231 - DNA, 25 bp, Homo sapien
gaatattgatcagctacagtagtct

SEQ ID NO: 588232 - DNA, 25 bp, Homo sapien
ttcctacttatccttctctaatatc

SEQ ID NO: 588233 - DNA, 25 bp, Homo sapien
atccttctctaatatcttgcatgta

SEQ ID NO: 588234 - DNA, 25 bp, Homo sapien
tttacctggccttttgtagacgtct

SEQ ID NO: 588235 - DNA, 25 bp, Homo sapien
ggccttttgtagacgtctgacgatt

SEQ ID NO: 588236 - DNA, 25 bp, Homo sapien
gacgtctgacgattagtttttgaaa

SEQ ID NO: 588237 - DNA, 25 bp, Homo sapien
agcttcctttccaactggagtcagc

SEQ ID NO: 588238 - DNA, 25 bp, Homo sapien
gctacaggatgagattcgggccaat

SEQ ID NO: 588239 - DNA, 25 bp, Homo sapien
gagattcgggccaatgacatttaag

SEQ ID NO: 588240 - DNA, 25 bp, Homo sapien
gaaaaacttcttgttgcacttccaa

SEQ ID NO: 588241 - DNA, 25 bp, Homo sapien
ttgcacttccaatgatccattttaa

SEQ ID NO: 588242 - DNA, 25 bp, Homo sapien
atcagcatatgctttctgcctcgag

SEQ ID NO: 588243 - DNA, 25 bp, Homo sapien
tttctgcctcgagtccagggtttct

SEQ ID NO: 588244 - DNA, 25 bp, Homo sapien
cagggtttctcaacactttgggcca

SEQ ID NO: 588245 - DNA, 25 bp, Homo sapien
gtttctcaacactttgggccagata

SEQ ID NO: 588246 - DNA, 25 bp, Homo sapien
tagcagcatctttggcttctacaaa

SEQ ID NO: 588247 - DNA, 25 bp, Homo sapien
ttagataccaggagcaacccatgcc

SEQ ID NO: 588248 - DNA, 25 bp, Homo sapien
gagttacaaggtcctgaaaaccaca

SEQ ID NO: 588249 - DNA, 25 bp, Homo sapien
tgtgttacatcctttaatagataaa

SEQ ID NO: 588250 - DNA, 25 bp, Homo sapien
aaaatttcgctgtttacactgtgcc

SEQ ID NO: 588251 - DNA, 25 bp, Homo sapien
aatttcgctgtttacactgtgcctt

SEQ ID NO: 588252 - DNA, 25 bp, Homo sapien
tcgctgtttacactgtgccttggtc

SEQ ID NO: 588253 - DNA, 25 bp, Homo sapien
tgtgccttggtccagtaaccctgca

SEQ ID NO: 588254 - DNA, 25 bp, Homo sapien
ttggtccagtaaccctgcactgcac

SEQ ID NO: 588255 - DNA, 25 bp, Homo sapien
agtaaccctgcactgcacatataca

SEQ ID NO: 588256 - DNA, 25 bp, Homo sapien
ccctgcactgcacatatacacttta

SEQ ID NO: 588257 - DNA, 25 bp, Homo sapien
tgcactgcacatatacactttaaat

SEQ ID NO: 588258 - DNA, 25 bp, Homo sapien
tgccttggggaaccacttcggtatt

SEQ ID NO: 588259 - DNA, 25 bp, Homo sapien
gtgaatgatttaactccgtctgtat

SEQ ID NO: 588260 - DNA, 25 bp, Homo sapien
gatttaactccgtctgtatttaaca

SEQ ID NO: 588261 - DNA, 25 bp, Homo sapien
tgtaacatgttagggctctggcatc

SEQ ID NO: 588262 - DNA, 25 bp, Homo sapien
tctggcatcagttttcctggacgaa

SEQ ID NO: 588263 - DNA, 25 bp, Homo sapien
ttcctggacgaaatcatgactctgc

SEQ ID NO: 588264 - DNA, 25 bp, Homo sapien
gccatttattagttgtacagccttg

SEQ ID NO: 588265 - DNA, 25 bp, Homo sapien
gttgtacagccttgactcagtttgt

SEQ ID NO: 588266 - DNA, 25 bp, Homo sapien
gtacagccttgactcagtttgttca

SEQ ID NO: 588267 - DNA, 25 bp, Homo sapien
gccttgactcagtttgttcatttgt

SEQ ID NO: 588268 - DNA, 25 bp, Homo sapien
atgcttggagcatagcgtgtactca

SEQ ID NO: 588269 - DNA, 25 bp, Homo sapien
tggagcatagcgtgtactcaataaa

SEQ ID NO: 588270 - DNA, 25 bp, Homo sapien
taaagcagcagtggaattgagaaat

SEQ ID NO: 588271 - DNA, 25 bp, Homo sapien
gaatgattaagaagttctggaggtc

SEQ ID NO: 588272 - DNA, 25 bp, Homo sapien
agttctggaggtcagtgtgcatata

SEQ ID NO: 588273 - DNA, 25 bp, Homo sapien
ttctggaggtcagtgtgcatatacc

SEQ ID NO: 588274 - DNA, 25 bp, Homo sapien
ggaggtcagtgtgcatatacctaat

SEQ ID NO: 588275 - DNA, 25 bp, Homo sapien
ggtcagtgtgcatatacctaatact

SEQ ID NO: 588276 - DNA, 25 bp, Homo sapien
gcatatacctaatactactgaacca

SEQ ID NO: 588277 - DNA, 25 bp, Homo sapien
atactactgaaccatacaaactaaa

SEQ ID NO: 588278 - DNA, 25 bp, Homo sapien
acaaactaaaaatggctaaggcgat

SEQ ID NO: 588279 - DNA, 25 bp, Homo sapien
aatggctaaggcgattgcttttatg

SEQ ID NO: 588280 - DNA, 25 bp, Homo sapien
tggctaaggcgattgcttttatgtg

SEQ ID NO: 588281 - DNA, 25 bp, Homo sapien
aaacagccctagcagcaaaggccct

SEQ ID NO: 588282 - DNA, 25 bp, Homo sapien
cccttgagcagcgcggtgtgaaact

SEQ ID NO: 588283 - DNA, 25 bp, Homo sapien
gggcttggccgaaggacttttatct

SEQ ID NO: 588284 - DNA, 25 bp, Homo sapien
tggccgaaggacttttatctgtctt

SEQ ID NO: 588285 - DNA, 25 bp, Homo sapien
ggacttttatctgtcttggtcaccc

SEQ ID NO: 588286 - DNA, 25 bp, Homo sapien
ggcagcgctcagaggagcctccagt

SEQ ID NO: 588287 - DNA, 25 bp, Homo sapien
tcagaggagcctccagttactttcc

SEQ ID NO: 588288 - DNA, 25 bp, Homo sapien
agttactttcctcacatctcccaaa

SEQ ID NO: 588289 - DNA, 25 bp, Homo sapien
acatctcccaaactctctcttaatt

SEQ ID NO: 588290 - DNA, 25 bp, Homo sapien
aaactctctcttaattgcgataatt

SEQ ID NO: 588291 - DNA, 25 bp, Homo sapien
aattgcgataattcacagaacataa

SEQ ID NO: 588292 - DNA, 25 bp, Homo sapien
cagccagtgaggagaggcaagatgg

SEQ ID NO: 588293 - DNA, 25 bp, Homo sapien
caagatggggttaagcttcgcacat

SEQ ID NO: 588294 - DNA, 25 bp, Homo sapien
aagatggggttaagcttcgcacatt

SEQ ID NO: 588295 - DNA, 25 bp, Homo sapien
ggttaagcttcgcacattgagggct

SEQ ID NO: 588296 - DNA, 25 bp, Homo sapien
gttaagcttcgcacattgagggctg

SEQ ID NO: 588297 - DNA, 25 bp, Homo sapien
ttaagcttcgcacattgagggctgg

SEQ ID NO: 588298 - DNA, 25 bp, Homo sapien
taagcttcgcacattgagggctggg

SEQ ID NO: 588299 - DNA, 25 bp, Homo sapien
aagcttcgcacattgagggctgggc

SEQ ID NO: 588300 - DNA, 25 bp, Homo sapien
agcttcgcacattgagggctgggca

SEQ ID NO: 588301 - DNA, 25 bp, Homo sapien
gcttcgcacattgagggctgggcac

SEQ ID NO: 588302 - DNA, 25 bp, Homo sapien
cttcgcacattgagggctgggcaca

SEQ ID NO: 588303 - DNA, 25 bp, Homo sapien
agcgaccaggctctgtccccgagaa

SEQ ID NO: 588304 - DNA, 25 bp, Homo sapien
tctgtccccgagaagctacggccga

SEQ ID NO: 588305 - DNA, 25 bp, Homo sapien
aagctacggccgacctgggtctggt

SEQ ID NO: 588306 - DNA, 25 bp, Homo sapien
ggtgcacagagtgatgttaactttt

SEQ ID NO: 588307 - DNA, 25 bp, Homo sapien
gatgttaactttttcccgtgtgtag

SEQ ID NO: 588308 - DNA, 25 bp, Homo sapien
ctttttcccgtgtgtagatatgtac

SEQ ID NO: 588309 - DNA, 25 bp, Homo sapien
gatatgtacagccaaagggtcgtgt

SEQ ID NO: 588310 - DNA, 25 bp, Homo sapien
caaagggtcgtgtaaatgttctgca

SEQ ID NO: 588311 - DNA, 25 bp, Homo sapien
gttctgcaaaagtgggtctatacag

SEQ ID NO: 588312 - DNA, 25 bp, Homo sapien
aaagtctggagggatggaaccttca

SEQ ID NO: 588313 - DNA, 25 bp, Homo sapien
agctttttgttgtttcaggcattat

SEQ ID NO: 588314 - DNA, 25 bp, Homo sapien
ttgttgaatgaatttagcaccaaag

SEQ ID NO: 588315 - DNA, 25 bp, Homo sapien
tgttgaatgaatttagcaccaaagg

SEQ ID NO: 588316 - DNA, 25 bp, Homo sapien
gttgaatgaatttagcaccaaaggt

SEQ ID NO: 588317 - DNA, 25 bp, Homo sapien
ttgaatgaatttagcaccaaaggtg

SEQ ID NO: 588318 - DNA, 25 bp, Homo sapien
tgaatgaatttagcaccaaaggtga

SEQ ID NO: 588319 - DNA, 25 bp, Homo sapien
gaatgaatttagcaccaaaggtgaa

SEQ ID NO: 588320 - DNA, 25 bp, Homo sapien
aatttagcaccaaaggtgaagagct

SEQ ID NO: 588321 - DNA, 25 bp, Homo sapien
tttagcaccaaaggtgaagagctga

SEQ ID NO: 588322 - DNA, 25 bp, Homo sapien
ggtgaagagctgataaaagacattt

SEQ ID NO: 588323 - DNA, 25 bp, Homo sapien
gtgaagagctgataaaagacatttt

SEQ ID NO: 588324 - DNA, 25 bp, Homo sapien
gaagagctgataaaagacatttttt

SEQ ID NO: 588325 - DNA, 25 bp, Homo sapien
gaagttaaagtattcatagctggaa

SEQ ID NO: 588326 - DNA, 25 bp, Homo sapien
taaagtattcatagctggaacagac

SEQ ID NO: 588327 - DNA, 25 bp, Homo sapien
acatttatcatttgacaacatatga

SEQ ID NO: 588328 - DNA, 25 bp, Homo sapien
aattgtgcattgtaagtctcatgtt

SEQ ID NO: 588329 - DNA, 25 bp, Homo sapien
atgttatgtttcttggatatattcc

SEQ ID NO: 588330 - DNA, 25 bp, Homo sapien
ggatatattccatggcattttgtgc

SEQ ID NO: 588331 - DNA, 25 bp, Homo sapien
gatatattccatggcattttgtgct

SEQ ID NO: 588332 - DNA, 25 bp, Homo sapien
ttgtgcttctctcttttatgggaaa

SEQ ID NO: 588333 - DNA, 25 bp, Homo sapien
gaaagcttacaattaacttaccagg

SEQ ID NO: 588334 - DNA, 25 bp, Homo sapien
aaaagatactttatggcagccaaat

SEQ ID NO: 588335 - DNA, 25 bp, Homo sapien
gatactttatggcagccaaatacaa

SEQ ID NO: 588336 - DNA, 25 bp, Homo sapien
tctttttcatcagggtgttcaacct

SEQ ID NO: 588337 - DNA, 25 bp, Homo sapien
caaggagtgggtgcaggatccctct

SEQ ID NO: 588338 - DNA, 25 bp, Homo sapien
ggatccctctgtttctgtttgagca

SEQ ID NO: 588339 - DNA, 25 bp, Homo sapien
ttctgtttgagcagtggcactccct

SEQ ID NO: 588340 - DNA, 25 bp, Homo sapien
ggcctctggaatggtaaatctgcac

SEQ ID NO: 588341 - DNA, 25 bp, Homo sapien
aaatctgcaccattgctagcttggc

SEQ ID NO: 588342 - DNA, 25 bp, Homo sapien
accattgctagcttggctgtttgcg

SEQ ID NO: 588343 - DNA, 25 bp, Homo sapien
gggctgactagaatccactgtcata

SEQ ID NO: 588344 - DNA, 25 bp, Homo sapien
atccactgtcatacactacttgttc

SEQ ID NO: 588345 - DNA, 25 bp, Homo sapien
cagttcaatatttcttgtgctttaa

SEQ ID NO: 588346 - DNA, 25 bp, Homo sapien
gggataagatgattcctgcacttaa

SEQ ID NO: 588347 - DNA, 25 bp, Homo sapien
gcacagtggcacaccacggaggcct

SEQ ID NO: 588348 - DNA, 25 bp, Homo sapien
tgtaccacaccaatgctgaagtcaa

SEQ ID NO: 588349 - DNA, 25 bp, Homo sapien
accaatgctgaagtcaagctgcagg

SEQ ID NO: 588350 - DNA, 25 bp, Homo sapien
ggccggagctcctggaggtgttcag

SEQ ID NO: 588351 - DNA, 25 bp, Homo sapien
gttcagcacggagttccagatgcgc

SEQ ID NO: 588352 - DNA, 25 bp, Homo sapien
ggagttccagatgcgccttctctgg

SEQ ID NO: 588353 - DNA, 25 bp, Homo sapien
gggcagtcagggtgccagcagcagc

SEQ ID NO: 588354 - DNA, 25 bp, Homo sapien
aggcccggcgctatgagaagttcga

SEQ ID NO: 588355 - DNA, 25 bp, Homo sapien
agaagttcgacaaggtcctcactgc

SEQ ID NO: 588356 - DNA, 25 bp, Homo sapien
agctggaacctgctgtccgctccag

SEQ ID NO: 588357 - DNA, 25 bp, Homo sapien
tgctgtccgctccagcgagctgtga

SEQ ID NO: 588358 - DNA, 25 bp, Homo sapien
ctgagattaagggaagctcgtccat

SEQ ID NO: 588359 - DNA, 25 bp, Homo sapien
gattaagggaagctcgtccatagaa

SEQ ID NO: 588360 - DNA, 25 bp, Homo sapien
aagggaagctcgtccatagaagcac

SEQ ID NO: 588361 - DNA, 25 bp, Homo sapien
gggaagctcgtccatagaagcactt

SEQ ID NO: 588362 - DNA, 25 bp, Homo sapien
gaagctcgtccatagaagcacttag

SEQ ID NO: 588363 - DNA, 25 bp, Homo sapien
gctcgtccatagaagcacttagcgt

SEQ ID NO: 588364 - DNA, 25 bp, Homo sapien
aagcacttagcgttgtgcctggcac

SEQ ID NO: 588365 - DNA, 25 bp, Homo sapien
gcacttagcgttgtgcctggcacat

SEQ ID NO: 588366 - DNA, 25 bp, Homo sapien
gcctggcacatagtgtatggtggat

SEQ ID NO: 588367 - DNA, 25 bp, Homo sapien
ctggcacatagtgtatggtggataa

SEQ ID NO: 588368 - DNA, 25 bp, Homo sapien
agagacaaggtccttggctgggcat

SEQ ID NO: 588369 - DNA, 25 bp, Homo sapien
gaggcaccgtgcctgtcccatgttg

SEQ ID NO: 588370 - DNA, 25 bp, Homo sapien
gtgcctgtcccatgttgtacttaat

SEQ ID NO: 588371 - DNA, 25 bp, Homo sapien
gcctgtcccatgttgtacttaatag

SEQ ID NO: 588372 - DNA, 25 bp, Homo sapien
ctgtcccatgttgtacttaatagat

SEQ ID NO: 588373 - DNA, 25 bp, Homo sapien
gtcccatgttgtacttaatagatat

SEQ ID NO: 588374 - DNA, 25 bp, Homo sapien
gttgtacttaatagatatttaccat

SEQ ID NO: 588375 - DNA, 25 bp, Homo sapien
tgtggctttaatacaccctttcaat

SEQ ID NO: 588376 - DNA, 25 bp, Homo sapien
ggctttaatacaccctttcaattct

SEQ ID NO: 588377 - DNA, 25 bp, Homo sapien
tttaatacaccctttcaattctcag

SEQ ID NO: 588378 - DNA, 25 bp, Homo sapien
aatacaccctttcaattctcaggga

SEQ ID NO: 588379 - DNA, 25 bp, Homo sapien
cagggagtgttttggtgatacaggc

SEQ ID NO: 588380 - DNA, 25 bp, Homo sapien
ctttattataagactgggatcggta

SEQ ID NO: 588381 - DNA, 25 bp, Homo sapien
gggatcggtagttaatttcctacag

SEQ ID NO: 588382 - DNA, 25 bp, Homo sapien
gaaattcagggcatgtaaatcagtg

SEQ ID NO: 588383 - DNA, 25 bp, Homo sapien
aggacaagagaaacaccagccctgt

SEQ ID NO: 588384 - DNA, 25 bp, Homo sapien
agagaaacaccagccctgtctgcag

SEQ ID NO: 588385 - DNA, 25 bp, Homo sapien
tgcaactcccttccagctgatgttg

SEQ ID NO: 588386 - DNA, 25 bp, Homo sapien
agctgatgttgttccaccatgggtc

SEQ ID NO: 588387 - DNA, 25 bp, Homo sapien
catgggtccagtgtgaccagatctt

SEQ ID NO: 588388 - DNA, 25 bp, Homo sapien
gtgaccagatcttacaatgttcaaa

SEQ ID NO: 588389 - DNA, 25 bp, Homo sapien
caaaagaggagtctaggtttttctg

SEQ ID NO: 588390 - DNA, 25 bp, Homo sapien
ggtttttctgtgaaatctccaaata

SEQ ID NO: 588391 - DNA, 25 bp, Homo sapien
gtttacaaatcagggtagtgaacat

SEQ ID NO: 588392 - DNA, 25 bp, Homo sapien
atttcatttcttcaggttctttgta

SEQ ID NO: 588393 - DNA, 25 bp, Homo sapien
tcaggttctttgtaagtacttttct

SEQ ID NO: 588394 - DNA, 25 bp, Homo sapien
gtacttttctaattctaatgctggg

SEQ ID NO: 588395 - DNA, 25 bp, Homo sapien
taatgctgggtagtggtgaaacctt

SEQ ID NO: 588396 - DNA, 25 bp, Homo sapien
tgaaaccttggtgaatggaaaatga

SEQ ID NO: 588397 - DNA, 25 bp, Homo sapien
ggaaaatgagtatcagctcccatgt

SEQ ID NO: 588398 - DNA, 25 bp, Homo sapien
agctcccatgtttagactgctcaac

SEQ ID NO: 588399 - DNA, 25 bp, Homo sapien
gtttagactgctcaactgggtgagt

SEQ ID NO: 588400 - DNA, 25 bp, Homo sapien
gctcaactgggtgagtaagtcacaa

SEQ ID NO: 588401 - DNA, 25 bp, Homo sapien
taagtgttaggtaatctgaaatgac

SEQ ID NO: 588402 - DNA, 25 bp, Homo sapien
ggagggatttgcaggtgatcttcct

SEQ ID NO: 588403 - DNA, 25 bp, Homo sapien
ttcctgggcctcctgagagcagctc

SEQ ID NO: 588404 - DNA, 25 bp, Homo sapien
tgagagcagctcaggtgcccaagat

SEQ ID NO: 588405 - DNA, 25 bp, Homo sapien
agagcagctcaggtgcccaagatgg

SEQ ID NO: 588406 - DNA, 25 bp, Homo sapien
tgcccaagatggactcaggcaggca

SEQ ID NO: 588407 - DNA, 25 bp, Homo sapien
ggcagctctgctgtatgtgaagccc

SEQ ID NO: 588408 - DNA, 25 bp, Homo sapien
agctctgctgtatgtgaagcccagt

SEQ ID NO: 588409 - DNA, 25 bp, Homo sapien
ctctgctgtatgtgaagcccagtga

SEQ ID NO: 588410 - DNA, 25 bp, Homo sapien
catgctgcaggtacaagttaatctc

SEQ ID NO: 588411 - DNA, 25 bp, Homo sapien
tacaagttaatctccctgtatcgcc

SEQ ID NO: 588412 - DNA, 25 bp, Homo sapien
agttaatctccctgtatcgcctctg

SEQ ID NO: 588413 - DNA, 25 bp, Homo sapien
aattatggcatagcgatacagtgta

SEQ ID NO: 588414 - DNA, 25 bp, Homo sapien
gctctaacaggtgctgatacatact

SEQ ID NO: 588415 - DNA, 25 bp, Homo sapien
aacaggtgctgatacatactagtct

SEQ ID NO: 588416 - DNA, 25 bp, Homo sapien
ggtgctgatacatactagtctgtaa

SEQ ID NO: 588417 - DNA, 25 bp, Homo sapien
actagtctgtaagatatattgacaa

SEQ ID NO: 588418 - DNA, 25 bp, Homo sapien
gtgtgtacacataagcttaatccag

SEQ ID NO: 588419 - DNA, 25 bp, Homo sapien
gcttaatccagcttagtctatctct

SEQ ID NO: 588420 - DNA, 25 bp, Homo sapien
ggttgcccctgggaaagagaattga

SEQ ID NO: 588421 - DNA, 25 bp, Homo sapien
gagggagggatttatttttcactat

SEQ ID NO: 588422 - DNA, 25 bp, Homo sapien
gagggatttatttttcactatatat

SEQ ID NO: 588423 - DNA, 25 bp, Homo sapien
cactatatatttctatgctatttcc

SEQ ID NO: 588424 - DNA, 25 bp, Homo sapien
tgaaaatcatgacagaaagaccggt

SEQ ID NO: 588425 - DNA, 25 bp, Homo sapien
gaaaatcatgacagaaagaccggtg

SEQ ID NO: 588426 - DNA, 25 bp, Homo sapien
aaaatcatgacagaaagaccggtgc

SEQ ID NO: 588427 - DNA, 25 bp, Homo sapien
aaatcatgacagaaagaccggtgca

SEQ ID NO: 588428 - DNA, 25 bp, Homo sapien
aatcatgacagaaagaccggtgcag

SEQ ID NO: 588429 - DNA, 25 bp, Homo sapien
atcatgacagaaagaccggtgcagt

SEQ ID NO: 588430 - DNA, 25 bp, Homo sapien
tcatgacagaaagaccggtgcagtg

SEQ ID NO: 588431 - DNA, 25 bp, Homo sapien
catgacagaaagaccggtgcagtgg

SEQ ID NO: 588432 - DNA, 25 bp, Homo sapien
atgacagaaagaccggtgcagtggc

SEQ ID NO: 588433 - DNA, 25 bp, Homo sapien
gacagaaagaccggtgcagtggctc

SEQ ID NO: 588434 - DNA, 25 bp, Homo sapien
ttgggagcctaaggcaggtgatcgc

SEQ ID NO: 588435 - DNA, 25 bp, Homo sapien
aaaagagcaatagtagtttcattca

SEQ ID NO: 588436 - DNA, 25 bp, Homo sapien
gagcaatagtagtttcattcagaaa

SEQ ID NO: 588437 - DNA, 25 bp, Homo sapien
gcaatagtagtttcattcagaaaga

SEQ ID NO: 588438 - DNA, 25 bp, Homo sapien
atagtagtttcattcagaaagacag

SEQ ID NO: 588439 - DNA, 25 bp, Homo sapien
aaaaatacaaacgtggcaggcgcgt

SEQ ID NO: 588440 - DNA, 25 bp, Homo sapien
aaaatacaaacgtggcaggcgcgtg

SEQ ID NO: 588441 - DNA, 25 bp, Homo sapien
aaatacaaacgtggcaggcgcgtgt

SEQ ID NO: 588442 - DNA, 25 bp, Homo sapien
atacaaacgtggcaggcgcgtgtaa

SEQ ID NO: 588443 - DNA, 25 bp, Homo sapien
tacaaacgtggcaggcgcgtgtaat

SEQ ID NO: 588444 - DNA, 25 bp, Homo sapien
acaaacgtggcaggcgcgtgtaatc

SEQ ID NO: 588445 - DNA, 25 bp, Homo sapien
acgtggcaggcgcgtgtaatcccat

SEQ ID NO: 588446 - DNA, 25 bp, Homo sapien
gaatccctcatatgaatctcctgga

SEQ ID NO: 588447 - DNA, 25 bp, Homo sapien
tctcctggaggattatataataggc

SEQ ID NO: 588448 - DNA, 25 bp, Homo sapien
taataggcagatctcccagccattt

SEQ ID NO: 588449 - DNA, 25 bp, Homo sapien
gaattggtatccttgaaaaatttca

SEQ ID NO: 588450 - DNA, 25 bp, Homo sapien
gaaaaatttcacctaaccactcaat

SEQ ID NO: 588451 - DNA, 25 bp, Homo sapien
acctaaccactcaatatggtagcca

SEQ ID NO: 588452 - DNA, 25 bp, Homo sapien
tggtagccactagtcctgggtggct

SEQ ID NO: 588453 - DNA, 25 bp, Homo sapien
actagtcctgggtggctattgagca

SEQ ID NO: 588454 - DNA, 25 bp, Homo sapien
gctattgagcacctgaaatttgcct

SEQ ID NO: 588455 - DNA, 25 bp, Homo sapien
cacctgaaatttgcctagtctgaat

SEQ ID NO: 588456 - DNA, 25 bp, Homo sapien
gaataaagcacactgtatttcaaag

SEQ ID NO: 588457 - DNA, 25 bp, Homo sapien
gggtggaccacttgacgtccgtagt

SEQ ID NO: 588458 - DNA, 25 bp, Homo sapien
ggtggaccacttgacgtccgtagtt

SEQ ID NO: 588459 - DNA, 25 bp, Homo sapien
gtggaccacttgacgtccgtagttc

SEQ ID NO: 588460 - DNA, 25 bp, Homo sapien
tggaccacttgacgtccgtagttcg

SEQ ID NO: 588461 - DNA, 25 bp, Homo sapien
ggaccacttgacgtccgtagttcga

SEQ ID NO: 588462 - DNA, 25 bp, Homo sapien
gaccacttgacgtccgtagttcgag

SEQ ID NO: 588463 - DNA, 25 bp, Homo sapien
accacttgacgtccgtagttcgaga

SEQ ID NO: 588464 - DNA, 25 bp, Homo sapien
ccacttgacgtccgtagttcgagac

SEQ ID NO: 588465 - DNA, 25 bp, Homo sapien
taggaagctcatcctgcacccagag

SEQ ID NO: 588466 - DNA, 25 bp, Homo sapien
tgagatgctcccaaactttacttat

SEQ ID NO: 588467 - DNA, 25 bp, Homo sapien
atgctcccaaactttacttatctaa

SEQ ID NO: 588468 - DNA, 25 bp, Homo sapien
acttatctaagtggccatatcattg

SEQ ID NO: 588469 - DNA, 25 bp, Homo sapien
taagtggccatatcattggcatcat

SEQ ID NO: 588470 - DNA, 25 bp, Homo sapien
ccatatcattggcatcattcagact

SEQ ID NO: 588471 - DNA, 25 bp, Homo sapien
atcattggcatcattcagacttaca

SEQ ID NO: 588472 - DNA, 25 bp, Homo sapien
tcagacttacaatgtgtgcactcag

SEQ ID NO: 588473 - DNA, 25 bp, Homo sapien
acaatgtgtgcactcagagctgaga

SEQ ID NO: 588474 - DNA, 25 bp, Homo sapien
ctcagagctgagaacattaagtatt

SEQ ID NO: 588475 - DNA, 25 bp, Homo sapien
gaacattaagtattgattgctcttt

SEQ ID NO: 588476 - DNA, 25 bp, Homo sapien
aatgcgagtctgctggcccaggtca

SEQ ID NO: 588477 - DNA, 25 bp, Homo sapien
tgcgagtctgctggcccaggtcatg

SEQ ID NO: 588478 - DNA, 25 bp, Homo sapien
gagtctgctggcccaggtcatgaat

SEQ ID NO: 588479 - DNA, 25 bp, Homo sapien
ggtcatgaatgacaggcacagctcc

SEQ ID NO: 588480 - DNA, 25 bp, Homo sapien
aaatcatcacaagggtccatgacct

SEQ ID NO: 588481 - DNA, 25 bp, Homo sapien
tcatcacaagggtccatgacctatt

SEQ ID NO: 588482 - DNA, 25 bp, Homo sapien
cacaagggtccatgacctattttca

SEQ ID NO: 588483 - DNA, 25 bp, Homo sapien
gaggctgagtggaagcaatttatag

SEQ ID NO: 588484 - DNA, 25 bp, Homo sapien
caatttatagggtgcaagcggcagc

SEQ ID NO: 588485 - DNA, 25 bp, Homo sapien
tatagggtgcaagcggcagcactgt

SEQ ID NO: 588486 - DNA, 25 bp, Homo sapien
tgcaagcggcagcactgtaagaaag

SEQ ID NO: 588487 - DNA, 25 bp, Homo sapien
ttaactgcatccgtggtaatcttcc

SEQ ID NO: 588488 - DNA, 25 bp, Homo sapien
tgcatccgtggtaatcttcccttaa

SEQ ID NO: 588489 - DNA, 25 bp, Homo sapien
taatcttcccttaaccaactgtcag

SEQ ID NO: 588490 - DNA, 25 bp, Homo sapien
ttcccttaaccaactgtcagtcttt

SEQ ID NO: 588491 - DNA, 25 bp, Homo sapien
caactgtcagtctttcctatgggaa

SEQ ID NO: 588492 - DNA, 25 bp, Homo sapien
gtcagtctttcctatgggaacaggc

SEQ ID NO: 588493 - DNA, 25 bp, Homo sapien
ttcctatgggaacaggcaaaccttt

SEQ ID NO: 588494 - DNA, 25 bp, Homo sapien
ggaacaggcaaacctttatgtacca

SEQ ID NO: 588495 - DNA, 25 bp, Homo sapien
ggcaaacctttatgtaccaaatgtg

SEQ ID NO: 588496 - DNA, 25 bp, Homo sapien
acctttatgtaccaaatgtgtcttt

SEQ ID NO: 588497 - DNA, 25 bp, Homo sapien
atgtaccaaatgtgtctttaagaaa

SEQ ID NO: 588498 - DNA, 25 bp, Homo sapien
aaggtcctaggatagcaggtctgaa

SEQ ID NO: 588499 - DNA, 25 bp, Homo sapien
cttcctttcccatgagtaggaacta

SEQ ID NO: 588500 - DNA, 25 bp, Homo sapien
gtaggaactaaatctcggaggaaag

SEQ ID NO: 588501 - DNA, 25 bp, Homo sapien
aagggacttgccaggatcccatact

SEQ ID NO: 588502 - DNA, 25 bp, Homo sapien
gatcccatactgagagaccttcctt

SEQ ID NO: 588503 - DNA, 25 bp, Homo sapien
ttcacttaatttcccgtccttcctg

SEQ ID NO: 588504 - DNA, 25 bp, Homo sapien
tctcatcccagctgtacatggtcag

SEQ ID NO: 588505 - DNA, 25 bp, Homo sapien
gtacatggtcagcattcaaagcctt

SEQ ID NO: 588506 - DNA, 25 bp, Homo sapien
attcaaagccttcttcaaatccttc

SEQ ID NO: 588507 - DNA, 25 bp, Homo sapien
ttcaaatccttcctatgcctcaaag

SEQ ID NO: 588508 - DNA, 25 bp, Homo sapien
atgcctcaaagtcaagttttcccac

SEQ ID NO: 588509 - DNA, 25 bp, Homo sapien
acagcagaatcaaggcctggtgaga

SEQ ID NO: 588510 - DNA, 25 bp, Homo sapien
agaatcaaggcctggtgagaagctg

SEQ ID NO: 588511 - DNA, 25 bp, Homo sapien
aaaagacaaggctggttacatgtct

SEQ ID NO: 588512 - DNA, 25 bp, Homo sapien
gagagaattcaacagcatgcaagat

SEQ ID NO: 588513 - DNA, 25 bp, Homo sapien
tcaacagcatgcaagatcgagtaat

SEQ ID NO: 588514 - DNA, 25 bp, Homo sapien
gatcgagtaatgctcttagccgaca

SEQ ID NO: 588515 - DNA, 25 bp, Homo sapien
gagtaatgctcttagccgacagctc

SEQ ID NO: 588516 - DNA, 25 bp, Homo sapien
gtaatgctcttagccgacagctctg

SEQ ID NO: 588517 - DNA, 25 bp, Homo sapien
tgctcttagccgacagctctgaaga

SEQ ID NO: 588518 - DNA, 25 bp, Homo sapien
tcttagccgacagctctgaagatga

SEQ ID NO: 588519 - DNA, 25 bp, Homo sapien
agccgacagctctgaagatgaattt

SEQ ID NO: 588520 - DNA, 25 bp, Homo sapien
aacagaagtttccacattcacgaat

SEQ ID NO: 588521 - DNA, 25 bp, Homo sapien
agaagtttccacattcacgaatgat

SEQ ID NO: 588522 - DNA, 25 bp, Homo sapien
aatatttttcacatggagtgagcag

SEQ ID NO: 588523 - DNA, 25 bp, Homo sapien
tggagctttgaagaggctgcctggt

SEQ ID NO: 588524 - DNA, 25 bp, Homo sapien
cctgatggagcttggctgttaggcc

SEQ ID NO: 588525 - DNA, 25 bp, Homo sapien
gtatctaaggttggcttaatcctgt

SEQ ID NO: 588526 - DNA, 25 bp, Homo sapien
ggttggcttaatcctgtctaaaatc

SEQ ID NO: 588527 - DNA, 25 bp, Homo sapien
ggcttaatcctgtctaaaatcaagg

SEQ ID NO: 588528 - DNA, 25 bp, Homo sapien
aaatcaaggtattggactagaacaa

SEQ ID NO: 588529 - DNA, 25 bp, Homo sapien
gaacaatgaggtttgcagcttttta

SEQ ID NO: 588530 - DNA, 25 bp, Homo sapien
gaggtttgcagctttttagcataga

SEQ ID NO: 588531 - DNA, 25 bp, Homo sapien
agtttcaatttcatggagtcaagtt

SEQ ID NO: 588532 - DNA, 25 bp, Homo sapien
gtttcaatttcatggagtcaagttc

SEQ ID NO: 588533 - DNA, 25 bp, Homo sapien
tttcaatttcatggagtcaagttca

SEQ ID NO: 588534 - DNA, 25 bp, Homo sapien
ttcaatttcatggagtcaagttcat

SEQ ID NO: 588535 - DNA, 25 bp, Homo sapien
caatttcatggagtcaagttcatta

SEQ ID NO: 588536 - DNA, 25 bp, Homo sapien
aatttcatggagtcaagttcattag

SEQ ID NO: 588537 - DNA, 25 bp, Homo sapien
tttcatggagtcaagttcattagtc

SEQ ID NO: 588538 - DNA, 25 bp, Homo sapien
tcatggagtcaagttcattagtcat

SEQ ID NO: 588539 - DNA, 25 bp, Homo sapien
catggagtcaagttcattagtcatt

SEQ ID NO: 588540 - DNA, 25 bp, Homo sapien
tggagtcaagttcattagtcatttc

SEQ ID NO: 588541 - DNA, 25 bp, Homo sapien
cattagtcatttcctgtattttttt

SEQ ID NO: 588542 - DNA, 25 bp, Homo sapien
aactgactgtggacaatacattggt

SEQ ID NO: 588543 - DNA, 25 bp, Homo sapien
gacaatacattggtagaactcacta

SEQ ID NO: 588544 - DNA, 25 bp, Homo sapien
tcactacctttgagccagccagaat

SEQ ID NO: 588545 - DNA, 25 bp, Homo sapien
tgagccagccagaatctttttatta

SEQ ID NO: 588546 - DNA, 25 bp, Homo sapien
cactggatattcaggttttgcctct

SEQ ID NO: 588547 - DNA, 25 bp, Homo sapien
caggttttgcctctgtaaattttct

SEQ ID NO: 588548 - DNA, 25 bp, Homo sapien
agttcattcaatctttgttttcaga

SEQ ID NO: 588549 - DNA, 25 bp, Homo sapien
tcagatgtgctttccacaatcaggt

SEQ ID NO: 588550 - DNA, 25 bp, Homo sapien
caatcaggttacaaattctctgcca

SEQ ID NO: 588551 - DNA, 25 bp, Homo sapien
attctctgccactaatgatcattac

SEQ ID NO: 588552 - DNA, 25 bp, Homo sapien
gatcattacaattcctcttctcagc

SEQ ID NO: 588553 - DNA, 25 bp, Homo sapien
aaatattttattcacaaaggtcaat

SEQ ID NO: 588554 - DNA, 25 bp, Homo sapien
attcacaaaggtcaataacatggca

SEQ ID NO: 588555 - DNA, 25 bp, Homo sapien
caaaggtcaataacatggcaagata

SEQ ID NO: 588556 - DNA, 25 bp, Homo sapien
gtatagttttgtctgaatgagcgag

SEQ ID NO: 588557 - DNA, 25 bp, Homo sapien
agttttgtctgaatgagcgagaaaa

SEQ ID NO: 588558 - DNA, 25 bp, Homo sapien
gtggatgtactgtttgtatatattg

SEQ ID NO: 588559 - DNA, 25 bp, Homo sapien
aacagagatatgtgcatgaaatcaa

SEQ ID NO: 588560 - DNA, 25 bp, Homo sapien
caaagcattagtggctatggtctgt

SEQ ID NO: 588561 - DNA, 25 bp, Homo sapien
ggctatggtctgtaaaatgaaacaa

SEQ ID NO: 588562 - DNA, 25 bp, Homo sapien
tttatttcactataagagtacttta

SEQ ID NO: 588563 - DNA, 25 bp, Homo sapien
ctaaagcatgactaaactgcaaaaa

SEQ ID NO: 588564 - DNA, 25 bp, Homo sapien
aaggctggacggtggaggacctgct

SEQ ID NO: 588565 - DNA, 25 bp, Homo sapien
cccctgtggaaaggtctatatgacg

SEQ ID NO: 588566 - DNA, 25 bp, Homo sapien
tgtggaaaggtctatatgacgggcc

SEQ ID NO: 588567 - DNA, 25 bp, Homo sapien
tgaggccccagaactcgtctgtgaa

SEQ ID NO: 588568 - DNA, 25 bp, Homo sapien
agaactcgtctgtgaaccacctttt

SEQ ID NO: 588569 - DNA, 25 bp, Homo sapien
ctcgtctgtgaaccaccttttccag

SEQ ID NO: 588570 - DNA, 25 bp, Homo sapien
gggccaccactgtcacactgtggaa

SEQ ID NO: 588571 - DNA, 25 bp, Homo sapien
gccaccactgtcacactgtggaata

SEQ ID NO: 588572 - DNA, 25 bp, Homo sapien
cactgtcacactgtggaatacaaga

SEQ ID NO: 588573 - DNA, 25 bp, Homo sapien
gtggaatacaagacagtgaactctg

SEQ ID NO: 588574 - DNA, 25 bp, Homo sapien
acaagacagtgaactctgtctgcct

SEQ ID NO: 588575 - DNA, 25 bp, Homo sapien
ggaacacttccaaagggcttgacac

SEQ ID NO: 588576 - DNA, 25 bp, Homo sapien
aagggcttgacaccaggccaatggc

SEQ ID NO: 588577 - DNA, 25 bp, Homo sapien
ggccttcttagaacactgtcatcat

SEQ ID NO: 588578 - DNA, 25 bp, Homo sapien
cagaagtcatgtaactgtggctgcc

SEQ ID NO: 588579 - DNA, 25 bp, Homo sapien
ggctgcctcttttcaatggaaacag

SEQ ID NO: 588580 - DNA, 25 bp, Homo sapien
gagcgaaatacaacctggtcagcta

SEQ ID NO: 588581 - DNA, 25 bp, Homo sapien
agctaaatcgtgctgaccttaaaaa

SEQ ID NO: 588582 - DNA, 25 bp, Homo sapien
aaaaacactgcatcctcttaggcaa

SEQ ID NO: 588583 - DNA, 25 bp, Homo sapien
ctcttaggcaaccactttggcttat

SEQ ID NO: 588584 - DNA, 25 bp, Homo sapien
aaccacatgtacaatattcctgcta

SEQ ID NO: 588585 - DNA, 25 bp, Homo sapien
tcctgctacttcaaacatgactttt

SEQ ID NO: 588586 - DNA, 25 bp, Homo sapien
ttttggagtagttctcataattcat

SEQ ID NO: 588587 - DNA, 25 bp, Homo sapien
ataattcattggtagggaactatcc

SEQ ID NO: 588588 - DNA, 25 bp, Homo sapien
agggaactatccagtatttatattc

SEQ ID NO: 588589 - DNA, 25 bp, Homo sapien
gattaattttgaggcttggtattcc

SEQ ID NO: 588590 - DNA, 25 bp, Homo sapien
gaggcttggtattcctaaaagattt

SEQ ID NO: 588591 - DNA, 25 bp, Homo sapien
cctaaaagatttggatgtgtgtatt

SEQ ID NO: 588592 - DNA, 25 bp, Homo sapien
gtgtgtatttctttaacttgacgta

SEQ ID NO: 588593 - DNA, 25 bp, Homo sapien
aacttgacgtaaacatgtatcacaa

SEQ ID NO: 588594 - DNA, 25 bp, Homo sapien
cacaaacatatcttttaattccaat

SEQ ID NO: 588595 - DNA, 25 bp, Homo sapien
gattggaaccaaatgttaattaggg

SEQ ID NO: 588596 - DNA, 25 bp, Homo sapien
tgttaattagggtaagttgtctttg

SEQ ID NO: 588597 - DNA, 25 bp, Homo sapien
acccaggacagttggtggaaccaat

SEQ ID NO: 588598 - DNA, 25 bp, Homo sapien
tggaaccaatggtgccacttcagtt

SEQ ID NO: 588599 - DNA, 25 bp, Homo sapien
aatggtgccacttcagttgccgcca

SEQ ID NO: 588600 - DNA, 25 bp, Homo sapien
attgcaacctcagctgatacaacca

SEQ ID NO: 588601 - DNA, 25 bp, Homo sapien
aagtgattgcaaacaggctggattt

SEQ ID NO: 588602 - DNA, 25 bp, Homo sapien
aaacaggctggatttggacaaaaag

SEQ ID NO: 588603 - DNA, 25 bp, Homo sapien
aaagcaaatctagacatgcatgttt

SEQ ID NO: 588604 - DNA, 25 bp, Homo sapien
gacatgcatgtttcagggttcagta

SEQ ID NO: 588605 - DNA, 25 bp, Homo sapien
ttcagggttcagtagtatacttcat

SEQ ID NO: 588606 - DNA, 25 bp, Homo sapien
gtatacttcatgtttcatacagata

SEQ ID NO: 588607 - DNA, 25 bp, Homo sapien
cattttctctttgaactagatggta

SEQ ID NO: 588608 - DNA, 25 bp, Homo sapien
atggcctcatttgccgactgagatc

SEQ ID NO: 588609 - DNA, 25 bp, Homo sapien
gcctcatttgccgactgagatcatg

SEQ ID NO: 588610 - DNA, 25 bp, Homo sapien
tcatttgccgactgagatcatgctc

SEQ ID NO: 588611 - DNA, 25 bp, Homo sapien
catttgccgactgagatcatgctca

SEQ ID NO: 588612 - DNA, 25 bp, Homo sapien
gagatcatgctcaagattagggatg

SEQ ID NO: 588613 - DNA, 25 bp, Homo sapien
tcatgctcaagattagggatgcacc

SEQ ID NO: 588614 - DNA, 25 bp, Homo sapien
ctcaagattagggatgcaccgggca

SEQ ID NO: 588615 - DNA, 25 bp, Homo sapien
tcaagattagggatgcaccgggcac

SEQ ID NO: 588616 - DNA, 25 bp, Homo sapien
caagattagggatgcaccgggcacg

SEQ ID NO: 588617 - DNA, 25 bp, Homo sapien
agattagggatgcaccgggcacgga

SEQ ID NO: 588618 - DNA, 25 bp, Homo sapien
gctgaggcaggcagtgaaaccctgt

SEQ ID NO: 588619 - DNA, 25 bp, Homo sapien
gattccaacaatttatactcaaggc

SEQ ID NO: 588620 - DNA, 25 bp, Homo sapien
aatttatactcaaggctttgtgctg

SEQ ID NO: 588621 - DNA, 25 bp, Homo sapien
gctttgtgctgagttgtcgtttgaa

SEQ ID NO: 588622 - DNA, 25 bp, Homo sapien
gtcgtttgaaccaagcatgatgtta

SEQ ID NO: 588623 - DNA, 25 bp, Homo sapien
gttatcaagcacaaagcacgtggca

SEQ ID NO: 588624 - DNA, 25 bp, Homo sapien
cgtggcaaaggaaagatgctcccat

SEQ ID NO: 588625 - DNA, 25 bp, Homo sapien
tgctcccatctcattctgaaaacaa

SEQ ID NO: 588626 - DNA, 25 bp, Homo sapien
aaatactgataaccaagcccaccct

SEQ ID NO: 588627 - DNA, 25 bp, Homo sapien
gctgggaccaacttcaaacaattta

SEQ ID NO: 588628 - DNA, 25 bp, Homo sapien
tagaggtatatttaggtttccctct

SEQ ID NO: 588629 - DNA, 25 bp, Homo sapien
ccctctctcttacttctgtgaaaga

SEQ ID NO: 588630 - DNA, 25 bp, Homo sapien
agatgaattttgaattggactgggt

SEQ ID NO: 588631 - DNA, 25 bp, Homo sapien
gatgaattttgaattggactgggtt

SEQ ID NO: 588632 - DNA, 25 bp, Homo sapien
atgaattttgaattggactgggttt

SEQ ID NO: 588633 - DNA, 25 bp, Homo sapien
tgaattttgaattggactgggtttt

SEQ ID NO: 588634 - DNA, 25 bp, Homo sapien
tttgaattggactgggttttaattg

SEQ ID NO: 588635 - DNA, 25 bp, Homo sapien
ttgaattggactgggttttaattgg

SEQ ID NO: 588636 - DNA, 25 bp, Homo sapien
tgaattggactgggttttaattggg

SEQ ID NO: 588637 - DNA, 25 bp, Homo sapien
ttggactgggttttaattgggatat

SEQ ID NO: 588638 - DNA, 25 bp, Homo sapien
tggactgggttttaattgggatatt

SEQ ID NO: 588639 - DNA, 25 bp, Homo sapien
gactgggttttaattgggatattca

SEQ ID NO: 588640 - DNA, 25 bp, Homo sapien
tgggttttaattgggatattcaacg

SEQ ID NO: 588641 - DNA, 25 bp, Homo sapien
ggaactctccaagttgcggcaagaa

SEQ ID NO: 588642 - DNA, 25 bp, Homo sapien
aatatattcctctcataaccaaccc

SEQ ID NO: 588643 - DNA, 25 bp, Homo sapien
tggaaggactactattaccactaaa

SEQ ID NO: 588644 - DNA, 25 bp, Homo sapien
ttaccactaaaaagtacaggacaca

SEQ ID NO: 588645 - DNA, 25 bp, Homo sapien
ggacacaatatccaatcctaggcct

SEQ ID NO: 588646 - DNA, 25 bp, Homo sapien
aatcctaggcctcctatatgatgac

SEQ ID NO: 588647 - DNA, 25 bp, Homo sapien
ggcctcctatatgatgactacgaat

SEQ ID NO: 588648 - DNA, 25 bp, Homo sapien
gatgactacgaatatataccaccag

SEQ ID NO: 588649 - DNA, 25 bp, Homo sapien
ataccaccaggtagtgaaacacaga

SEQ ID NO: 588650 - DNA, 25 bp, Homo sapien
accaggtagtgaaacacagactatt

SEQ ID NO: 588651 - DNA, 25 bp, Homo sapien
acagactattgtgattgagaaaaca

SEQ ID NO: 588652 - DNA, 25 bp, Homo sapien
ttatttgcttaatgggtccagagct

SEQ ID NO: 588653 - DNA, 25 bp, Homo sapien
gagcttgcagctggtttgtgtatgt

SEQ ID NO: 588654 - DNA, 25 bp, Homo sapien
atgttggagcttgtgcatgtgtgtt

SEQ ID NO: 588655 - DNA, 25 bp, Homo sapien
tttaaaaaccgtgtgtgactgtgtg

SEQ ID NO: 588656 - DNA, 25 bp, Homo sapien
gtgtattttgttgtggatgtgtccg

SEQ ID NO: 588657 - DNA, 25 bp, Homo sapien
ggatgtgtccgtctgagtatctatt

SEQ ID NO: 588658 - DNA, 25 bp, Homo sapien
tgtccgtctgagtatctattttgat

SEQ ID NO: 588659 - DNA, 25 bp, Homo sapien
ggaaggcctgagttatacgtccagt

SEQ ID NO: 588660 - DNA, 25 bp, Homo sapien
gagttatacgtccagttttccagtg

SEQ ID NO: 588661 - DNA, 25 bp, Homo sapien
acgtccagttttccagtgactagca

SEQ ID NO: 588662 - DNA, 25 bp, Homo sapien
ccagttttccagtgactagcaatta

SEQ ID NO: 588663 - DNA, 25 bp, Homo sapien
tcttaaaacgcctagatgacgtgtc

SEQ ID NO: 588664 - DNA, 25 bp, Homo sapien
ttaaaacgcctagatgacgtgtcca

SEQ ID NO: 588665 - DNA, 25 bp, Homo sapien
taaaacgcctagatgacgtgtccaa

SEQ ID NO: 588666 - DNA, 25 bp, Homo sapien
aaaacgcctagatgacgtgtccaac

SEQ ID NO: 588667 - DNA, 25 bp, Homo sapien
aaacgcctagatgacgtgtccaacg

SEQ ID NO: 588668 - DNA, 25 bp, Homo sapien
aacgcctagatgacgtgtccaacga

SEQ ID NO: 588669 - DNA, 25 bp, Homo sapien
acgcctagatgacgtgtccaacgat

SEQ ID NO: 588670 - DNA, 25 bp, Homo sapien
gcctagatgacgtgtccaacgatgt

SEQ ID NO: 588671 - DNA, 25 bp, Homo sapien
cctagatgacgtgtccaacgatgtg

SEQ ID NO: 588672 - DNA, 25 bp, Homo sapien
acgtgtccaacgatgtgaggatggc

SEQ ID NO: 588673 - DNA, 25 bp, Homo sapien
cgtgtccaacgatgtgaggatggca

SEQ ID NO: 588674 - DNA, 25 bp, Homo sapien
ctcaagggacaaaaataggcaagtg

SEQ ID NO: 588675 - DNA, 25 bp, Homo sapien
aagatgccaaattctactagagatc

SEQ ID NO: 588676 - DNA, 25 bp, Homo sapien
actagagatcactgtaaggtatcca

SEQ ID NO: 588677 - DNA, 25 bp, Homo sapien
gtaaggtatccaaaagtgctcactc

SEQ ID NO: 588678 - DNA, 25 bp, Homo sapien
ggtatccaaaagtgctcactcccta

SEQ ID NO: 588679 - DNA, 25 bp, Homo sapien
aaagtgctcactccctacagcctag

SEQ ID NO: 588680 - DNA, 25 bp, Homo sapien
tacagcctagcatttcacagaaaag

SEQ ID NO: 588681 - DNA, 25 bp, Homo sapien
gtttttcagatgtttcagagatgca

SEQ ID NO: 588682 - DNA, 25 bp, Homo sapien
ttcagagatgcacaaagtaaggcct

SEQ ID NO: 588683 - DNA, 25 bp, Homo sapien
aagggagtgctttgtgatctagtaa

SEQ ID NO: 588684 - DNA, 25 bp, Homo sapien
ctttgtgatctagtaaagctggaat

SEQ ID NO: 588685 - DNA, 25 bp, Homo sapien
ttcagaactattaggaaagaacttt

SEQ ID NO: 588686 - DNA, 25 bp, Homo sapien
taccatgtgacattaagaagtgtgc

SEQ ID NO: 588687 - DNA, 25 bp, Homo sapien
ccatgtgacattaagaagtgtgcgc

SEQ ID NO: 588688 - DNA, 25 bp, Homo sapien
gtgacattaagaagtgtgcgcaaac

SEQ ID NO: 588689 - DNA, 25 bp, Homo sapien
gacattaagaagtgtgcgcaaactt

SEQ ID NO: 588690 - DNA, 25 bp, Homo sapien
aagaagtgtgcgcaaacttaagtga

SEQ ID NO: 588691 - DNA, 25 bp, Homo sapien
gaagtgtgcgcaaacttaagtgaat

SEQ ID NO: 588692 - DNA, 25 bp, Homo sapien
gtgtgcgcaaacttaagtgaatgta

SEQ ID NO: 588693 - DNA, 25 bp, Homo sapien
gtgcgcaaacttaagtgaatgtatt

SEQ ID NO: 588694 - DNA, 25 bp, Homo sapien
gaatgtattaatttactgtgatctt

SEQ ID NO: 588695 - DNA, 25 bp, Homo sapien
tactgtgatcttggtcgggtgcggt

SEQ ID NO: 588696 - DNA, 25 bp, Homo sapien
tggtatgactccagagttagtattt

SEQ ID NO: 588697 - DNA, 25 bp, Homo sapien
tgactccagagttagtatttttaac

SEQ ID NO: 588698 - DNA, 25 bp, Homo sapien
taaccccaaagtccgctcttaacag

SEQ ID NO: 588699 - DNA, 25 bp, Homo sapien
tccgctcttaacagctacactaact

SEQ ID NO: 588700 - DNA, 25 bp, Homo sapien
ttaacagctacactaactgcctctc

SEQ ID NO: 588701 - DNA, 25 bp, Homo sapien
gctacactaactgcctctcaagagg

SEQ ID NO: 588702 - DNA, 25 bp, Homo sapien
actaactgcctctcaagaggtcgta

SEQ ID NO: 588703 - DNA, 25 bp, Homo sapien
gcctctcaagaggtcgtagagctta

SEQ ID NO: 588704 - DNA, 25 bp, Homo sapien
tcgtagagcttatagactgacacag

SEQ ID NO: 588705 - DNA, 25 bp, Homo sapien
gcttatagactgacacagctggtgt

SEQ ID NO: 588706 - DNA, 25 bp, Homo sapien
ttatagactgacacagctggtgtgt

SEQ ID NO: 588707 - DNA, 25 bp, Homo sapien
gtgttcctggtcctcgttgcaatcg

SEQ ID NO: 588708 - DNA, 25 bp, Homo sapien
cgttgcaatcgcctttgcagtcaac

SEQ ID NO: 588709 - DNA, 25 bp, Homo sapien
agtcaaccacttctggtgccaggag

SEQ ID NO: 588710 - DNA, 25 bp, Homo sapien
tgcacacatgatcctgaccgtcgga

SEQ ID NO: 588711 - DNA, 25 bp, Homo sapien
cctgaccgtcggaaacaaggcagat

SEQ ID NO: 588712 - DNA, 25 bp, Homo sapien
aaggtactcttcgatggcggccagt

SEQ ID NO: 588713 - DNA, 25 bp, Homo sapien
ggccagtttcaggtccagtgagcat

SEQ ID NO: 588714 - DNA, 25 bp, Homo sapien
gaatgcctatgagaatgtgcccgag

SEQ ID NO: 588715 - DNA, 25 bp, Homo sapien
gaggaaggcaaggtccgcagcaccc

SEQ ID NO: 588716 - DNA, 25 bp, Homo sapien
ctgccagctgtcagcaaggcctggg

SEQ ID NO: 588717 - DNA, 25 bp, Homo sapien
ttcagccctggatgcagggccttat

SEQ ID NO: 588718 - DNA, 25 bp, Homo sapien
gggacacacctgctgtatgatccag

SEQ ID NO: 588719 - DNA, 25 bp, Homo sapien
ctgtatgatccagccgttcgtcttt

SEQ ID NO: 588720 - DNA, 25 bp, Homo sapien
cagccgttcgtctttacctgggaga

SEQ ID NO: 588721 - DNA, 25 bp, Homo sapien
ttacctgggagaaatggcaccacct

SEQ ID NO: 588722 - DNA, 25 bp, Homo sapien
tgaacataacttcttacactcccat

SEQ ID NO: 588723 - DNA, 25 bp, Homo sapien
ataacttcttacactcccatgagtc

SEQ ID NO: 588724 - DNA, 25 bp, Homo sapien
gagtcctcctggacaggtgctgtga

SEQ ID NO: 588725 - DNA, 25 bp, Homo sapien
aggtgctgtgacctcgtgcagcctt

SEQ ID NO: 588726 - DNA, 25 bp, Homo sapien
ctgtgggcacagagccccttgagat

SEQ ID NO: 588727 - DNA, 25 bp, Homo sapien
gagccccttgagatgggtttcccta

SEQ ID NO: 588728 - DNA, 25 bp, Homo sapien
tgagatgggtttccctatgcagccc

SEQ ID NO: 588729 - DNA, 25 bp, Homo sapien
ttagaatattctaattcagctgggt

SEQ ID NO: 588730 - DNA, 25 bp, Homo sapien
agaatattctaattcagctgggttt

SEQ ID NO: 588731 - DNA, 25 bp, Homo sapien
aatattctaattcagctgggtttgg

SEQ ID NO: 588732 - DNA, 25 bp, Homo sapien
atattctaattcagctgggtttggt

SEQ ID NO: 588733 - DNA, 25 bp, Homo sapien
tattctaattcagctgggtttggtg

SEQ ID NO: 588734 - DNA, 25 bp, Homo sapien
attctaattcagctgggtttggtgg

SEQ ID NO: 588735 - DNA, 25 bp, Homo sapien
aaattagtcaatgatggtggcctgt

SEQ ID NO: 588736 - DNA, 25 bp, Homo sapien
aattagtcaatgatggtggcctgtg

SEQ ID NO: 588737 - DNA, 25 bp, Homo sapien
attagtcaatgatggtggcctgtgt

SEQ ID NO: 588738 - DNA, 25 bp, Homo sapien
ttagtcaatgatggtggcctgtgtc

SEQ ID NO: 588739 - DNA, 25 bp, Homo sapien
tagtcaatgatggtggcctgtgtct

SEQ ID NO: 588740 - DNA, 25 bp, Homo sapien
gacattaagtaaatcacaaaaggac

SEQ ID NO: 588741 - DNA, 25 bp, Homo sapien
aggacaatactatatgaatccactg

SEQ ID NO: 588742 - DNA, 25 bp, Homo sapien
ggacaatactatatgaatccactga

SEQ ID NO: 588743 - DNA, 25 bp, Homo sapien
gacaatactatatgaatccactgat

SEQ ID NO: 588744 - DNA, 25 bp, Homo sapien
acaatactatatgaatccactgatg

SEQ ID NO: 588745 - DNA, 25 bp, Homo sapien
caatactatatgaatccactgatgt

SEQ ID NO: 588746 - DNA, 25 bp, Homo sapien
aatactatatgaatccactgatgtg

SEQ ID NO: 588747 - DNA, 25 bp, Homo sapien
atactatatgaatccactgatgtga

SEQ ID NO: 588748 - DNA, 25 bp, Homo sapien
tactatatgaatccactgatgtgag

SEQ ID NO: 588749 - DNA, 25 bp, Homo sapien
actatatgaatccactgatgtgagg

SEQ ID NO: 588750 - DNA, 25 bp, Homo sapien
ctatatgaatccactgatgtgaggt

SEQ ID NO: 588751 - DNA, 25 bp, Homo sapien
ctttgggcaacatgaaattcttgac

SEQ ID NO: 588752 - DNA, 25 bp, Homo sapien
gggcaacatgaaattcttgactaca

SEQ ID NO: 588753 - DNA, 25 bp, Homo sapien
aacatgaaattcttgactacacgat

SEQ ID NO: 588754 - DNA, 25 bp, Homo sapien
gaaattcttgactacacgataatgt

SEQ ID NO: 588755 - DNA, 25 bp, Homo sapien
gactacacgataatgttgattttga

SEQ ID NO: 588756 - DNA, 25 bp, Homo sapien
atttactagaaatggcctgtgtttt

SEQ ID NO: 588757 - DNA, 25 bp, Homo sapien
gaaatggcctgtgttttaactgtgt

SEQ ID NO: 588758 - DNA, 25 bp, Homo sapien
tataaatgaggttcaggccggttgc

SEQ ID NO: 588759 - DNA, 25 bp, Homo sapien
aaatgaggttcaggccggttgcagt

SEQ ID NO: 588760 - DNA, 25 bp, Homo sapien
atcccagtgctttgcaaggcctagg

SEQ ID NO: 588761 - DNA, 25 bp, Homo sapien
tcccagtgctttgcaaggcctaggc

SEQ ID NO: 588762 - DNA, 25 bp, Homo sapien
tattactccccgtactttgctgcat

SEQ ID NO: 588763 - DNA, 25 bp, Homo sapien
atgctgcatttcattccctatcttg

SEQ ID NO: 588764 - DNA, 25 bp, Homo sapien
gcatttcattccctatcttggttaa

SEQ ID NO: 588765 - DNA, 25 bp, Homo sapien
ctatcttggttaatggtcccatcaa

SEQ ID NO: 588766 - DNA, 25 bp, Homo sapien
aagtctggttagttttctctgccga

SEQ ID NO: 588767 - DNA, 25 bp, Homo sapien
tttctctgccgaaagtggacaactt

SEQ ID NO: 588768 - DNA, 25 bp, Homo sapien
tcccttcttgcccactgaaacaatt

SEQ ID NO: 588769 - DNA, 25 bp, Homo sapien
tgaaacaattgcaccagcctcctaa

SEQ ID NO: 588770 - DNA, 25 bp, Homo sapien
agcctcctaattgatctcttagcta

SEQ ID NO: 588771 - DNA, 25 bp, Homo sapien
atctcttagctatcgtcttccacat

SEQ ID NO: 588772 - DNA, 25 bp, Homo sapien
ttccacatcactgctagagggactg

SEQ ID NO: 588773 - DNA, 25 bp, Homo sapien
atgtaccacatattctttattcaat

SEQ ID NO: 588774 - DNA, 25 bp, Homo sapien
tttattcaatagaccactgatggac

SEQ ID NO: 588775 - DNA, 25 bp, Homo sapien
atggacacataggttggttcatgac

SEQ ID NO: 588776 - DNA, 25 bp, Homo sapien
ttggttcatgactttgctattgtta

SEQ ID NO: 588777 - DNA, 25 bp, Homo sapien
gactttgctattgttaatggtatta

SEQ ID NO: 588778 - DNA, 25 bp, Homo sapien
ggtattacaacaaacataggaatgc

SEQ ID NO: 588779 - DNA, 25 bp, Homo sapien
ttttcttttccatgtacatatccat

SEQ ID NO: 588780 - DNA, 25 bp, Homo sapien
tacatatccatttgtctcaggacta

SEQ ID NO: 588781 - DNA, 25 bp, Homo sapien
atttgtctcaggactatttagtgaa

SEQ ID NO: 588782 - DNA, 25 bp, Homo sapien
gtgaaaagattgtccattctccatt

SEQ ID NO: 588783 - DNA, 25 bp, Homo sapien
ttgtccattctccattggatttcct

SEQ ID NO: 588784 - DNA, 25 bp, Homo sapien
gaaaacagttccaacgaagcattag

SEQ ID NO: 588785 - DNA, 25 bp, Homo sapien
aggccagatactcgaaaattacata

SEQ ID NO: 588786 - DNA, 25 bp, Homo sapien
gatactcgaaaattacatacctgtg

SEQ ID NO: 588787 - DNA, 25 bp, Homo sapien
gaaaattacatacctgtgtggctag

SEQ ID NO: 588788 - DNA, 25 bp, Homo sapien
tacatacctgtgtggctagtagtct

SEQ ID NO: 588789 - DNA, 25 bp, Homo sapien
atacctgtgtggctagtagtctgtg

SEQ ID NO: 588790 - DNA, 25 bp, Homo sapien
tgtggctagtagtctgtgggacact

SEQ ID NO: 588791 - DNA, 25 bp, Homo sapien
gctagtagtctgtgggacactcaaa

SEQ ID NO: 588792 - DNA, 25 bp, Homo sapien
tctgtgggacactcaaataagctaa

SEQ ID NO: 588793 - DNA, 25 bp, Homo sapien
tgtgggacactcaaataagctaaag

SEQ ID NO: 588794 - DNA, 25 bp, Homo sapien
ataagctaaagtttttggccaggca

SEQ ID NO: 588795 - DNA, 25 bp, Homo sapien
agtggtcttaggaagctgactctaa

SEQ ID NO: 588796 - DNA, 25 bp, Homo sapien
ggaagctgactctaacatgaaaatt

SEQ ID NO: 588797 - DNA, 25 bp, Homo sapien
tagagttggatcttttgctgacata

SEQ ID NO: 588798 - DNA, 25 bp, Homo sapien
agagcatatgatacatttgtctatc

SEQ ID NO: 588799 - DNA, 25 bp, Homo sapien
ttgtctatcataaacatgtcatttc

SEQ ID NO: 588800 - DNA, 25 bp, Homo sapien
aacatgtcatttcaaaaaaccctca

SEQ ID NO: 588801 - DNA, 25 bp, Homo sapien
accctcaaagttgccttgtagaaca

SEQ ID NO: 588802 - DNA, 25 bp, Homo sapien
gttgccttgtagaacataattttaa

SEQ ID NO: 588803 - DNA, 25 bp, Homo sapien
tcagttattcagtcttcttaatatc

SEQ ID NO: 588804 - DNA, 25 bp, Homo sapien
cagtcttcttaatatctgaaccgaa

SEQ ID NO: 588805 - DNA, 25 bp, Homo sapien
aaccgaaattaatcttccattctgc

SEQ ID NO: 588806 - DNA, 25 bp, Homo sapien
gactacagatgcgtgtcaccagagg

SEQ ID NO: 588807 - DNA, 25 bp, Homo sapien
tcaccagaggtgactgttctatttt

SEQ ID NO: 588808 - DNA, 25 bp, Homo sapien
tgttctattttgtggaacagcccac

SEQ ID NO: 588809 - DNA, 25 bp, Homo sapien
agccctctccattgttgggctgaat

SEQ ID NO: 588810 - DNA, 25 bp, Homo sapien
tgaatctgtcgtgatccctagggca

SEQ ID NO: 588811 - DNA, 25 bp, Homo sapien
gatccctagggcagcctggagaaag

SEQ ID NO: 588812 - DNA, 25 bp, Homo sapien
aagcatgcagagtgcacacgtggtg

SEQ ID NO: 588813 - DNA, 25 bp, Homo sapien
acacgtggtgagcacaaagctttcg

SEQ ID NO: 588814 - DNA, 25 bp, Homo sapien
gttgaagacgtctgacagccatctc

SEQ ID NO: 588815 - DNA, 25 bp, Homo sapien
gccatctcatcccacagaaggttta

SEQ ID NO: 588816 - DNA, 25 bp, Homo sapien
aaatgcaatcctttagtccacagtt

SEQ ID NO: 588817 - DNA, 25 bp, Homo sapien
tagaatattctaattcagctgggtt

SEQ ID NO: 588818 - DNA, 25 bp, Homo sapien
aatattctaattcagctgggtttgg

SEQ ID NO: 588819 - DNA, 25 bp, Homo sapien
atattctaattcagctgggtttggt

SEQ ID NO: 588820 - DNA, 25 bp, Homo sapien
tattctaattcagctgggtttggtg

SEQ ID NO: 588821 - DNA, 25 bp, Homo sapien
attctaattcagctgggtttggtgg

SEQ ID NO: 588822 - DNA, 25 bp, Homo sapien
aaattagtcaatgatggtggcctgt

SEQ ID NO: 588823 - DNA, 25 bp, Homo sapien
aattagtcaatgatggtggcctgtg

SEQ ID NO: 588824 - DNA, 25 bp, Homo sapien
attagtcaatgatggtggcctgtgt

SEQ ID NO: 588825 - DNA, 25 bp, Homo sapien
ttagtcaatgatggtggcctgtgtc

SEQ ID NO: 588826 - DNA, 25 bp, Homo sapien
tagtcaatgatggtggcctgtgtct

SEQ ID NO: 588827 - DNA, 25 bp, Homo sapien
gtcaatgatggtggcctgtgtctgt

SEQ ID NO: 588828 - DNA, 25 bp, Homo sapien
gagaatccatttatgatatctgtca

SEQ ID NO: 588829 - DNA, 25 bp, Homo sapien
gatatctgtcatggacggaatgttt

SEQ ID NO: 588830 - DNA, 25 bp, Homo sapien
gttgctgacactagtgtaagcacct

SEQ ID NO: 588831 - DNA, 25 bp, Homo sapien
gacactagtgtaagcacctttcctt

SEQ ID NO: 588832 - DNA, 25 bp, Homo sapien
tagtgtaagcacctttccttacctg

SEQ ID NO: 588833 - DNA, 25 bp, Homo sapien
acctttccttacctgcgaatgtgta

SEQ ID NO: 588834 - DNA, 25 bp, Homo sapien
cttacctgcgaatgtgtaggatgct

SEQ ID NO: 588835 - DNA, 25 bp, Homo sapien
gtaggatgctgatgtctgcgaatct

SEQ ID NO: 588836 - DNA, 25 bp, Homo sapien
gatgctgatgtctgcgaatctgaga

SEQ ID NO: 588837 - DNA, 25 bp, Homo sapien
gatgtctgcgaatctgagaatccat

SEQ ID NO: 588838 - DNA, 25 bp, Homo sapien
gtctgcgaatctgagaatccattta

SEQ ID NO: 588839 - DNA, 25 bp, Homo sapien
tggccaagaaagacccaatgtcgag

SEQ ID NO: 588840 - DNA, 25 bp, Homo sapien
ggccaagaaagacccaatgtcgagt

SEQ ID NO: 588841 - DNA, 25 bp, Homo sapien
ccaagaaagacccaatgtcgagtga

SEQ ID NO: 588842 - DNA, 25 bp, Homo sapien
aagaaagacccaatgtcgagtgaac

SEQ ID NO: 588843 - DNA, 25 bp, Homo sapien
gaaagacccaatgtcgagtgaacat

SEQ ID NO: 588844 - DNA, 25 bp, Homo sapien
aaagacccaatgtcgagtgaacata

SEQ ID NO: 588845 - DNA, 25 bp, Homo sapien
aagacccaatgtcgagtgaacataa

SEQ ID NO: 588846 - DNA, 25 bp, Homo sapien
agacccaatgtcgagtgaacataaa

SEQ ID NO: 588847 - DNA, 25 bp, Homo sapien
gacccaatgtcgagtgaacataaag

SEQ ID NO: 588848 - DNA, 25 bp, Homo sapien
cccaatgtcgagtgaacataaagaa

SEQ ID NO: 588849 - DNA, 25 bp, Homo sapien
gtcgagtgaacataaagaacacagg

SEQ ID NO: 588850 - DNA, 25 bp, Homo sapien
aacagactcaggtcctacaaggaag

SEQ ID NO: 588851 - DNA, 25 bp, Homo sapien
aggaggagttcttacatctgctttc

SEQ ID NO: 588852 - DNA, 25 bp, Homo sapien
ggagttcttacatctgctttcaagc

SEQ ID NO: 588853 - DNA, 25 bp, Homo sapien
acatctgctttcaagctacagctgt

SEQ ID NO: 588854 - DNA, 25 bp, Homo sapien
acagctgtaacatcaacttttctca

SEQ ID NO: 588855 - DNA, 25 bp, Homo sapien
aacttttctcagagtctccagccta

SEQ ID NO: 588856 - DNA, 25 bp, Homo sapien
tgaagagttctgatttgccaacccc

SEQ ID NO: 588857 - DNA, 25 bp, Homo sapien
ccccatattgagttagccagtttct

SEQ ID NO: 588858 - DNA, 25 bp, Homo sapien
tgagttagccagtttcttcagataa

SEQ ID NO: 588859 - DNA, 25 bp, Homo sapien
acacacatcttctgttgattctgtt

SEQ ID NO: 588860 - DNA, 25 bp, Homo sapien
gttgtactacaaacttcccagaagt

SEQ ID NO: 588861 - DNA, 25 bp, Homo sapien
tctgcctttctcaagatgatctaca

SEQ ID NO: 588862 - DNA, 25 bp, Homo sapien
gatgatctacagttattcttcccat

SEQ ID NO: 588863 - DNA, 25 bp, Homo sapien
ttcttcccatagtgtgagcagcatt

SEQ ID NO: 588864 - DNA, 25 bp, Homo sapien
gtgagcagcattgccctgagtcctg

SEQ ID NO: 588865 - DNA, 25 bp, Homo sapien
cactggactccatgagcggcaatgt

SEQ ID NO: 588866 - DNA, 25 bp, Homo sapien
tgaccaatcccagctctagtggcaa

SEQ ID NO: 588867 - DNA, 25 bp, Homo sapien
ctagtggcaagtctgcaacctggca

SEQ ID NO: 588868 - DNA, 25 bp, Homo sapien
gatcttcaggcacaagcatttgcac

SEQ ID NO: 588869 - DNA, 25 bp, Homo sapien
gtgtatctaaaactttgcctcgaaa

SEQ ID NO: 588870 - DNA, 25 bp, Homo sapien
aagccttaggagatgccacattcca

SEQ ID NO: 588871 - DNA, 25 bp, Homo sapien
aaaatgtttccagggtctttgcatc

SEQ ID NO: 588872 - DNA, 25 bp, Homo sapien
aatatggtctggtcacacttagggt

SEQ ID NO: 588873 - DNA, 25 bp, Homo sapien
tctggtcacacttagggtcctttaa

SEQ ID NO: 588874 - DNA, 25 bp, Homo sapien
tagggtcctttaaaataatgagata

SEQ ID NO: 588875 - DNA, 25 bp, Homo sapien
gaatagggatctgtatttgactgac

SEQ ID NO: 588876 - DNA, 25 bp, Homo sapien
tagggatctgtatttgactgacaaa

SEQ ID NO: 588877 - DNA, 25 bp, Homo sapien
gactgacaaagggtaattaaaatct

SEQ ID NO: 588878 - DNA, 25 bp, Homo sapien
tctctatttaccaaataccctatct

SEQ ID NO: 588879 - DNA, 25 bp, Homo sapien
aataccctatctttaatgcattttt

SEQ ID NO: 588880 - DNA, 25 bp, Homo sapien
tttttgtaaatctctggaaatcata

SEQ ID NO: 588881 - DNA, 25 bp, Homo sapien
aagaagaccttaggctggacatggt

SEQ ID NO: 588882 - DNA, 25 bp, Homo sapien
agaattgaagaccagtgccggcaac

SEQ ID NO: 588883 - DNA, 25 bp, Homo sapien
taacatctcagattcctgtttttgt

SEQ ID NO: 588884 - DNA, 25 bp, Homo sapien
gtttgtatgcaaaactaccatctga

SEQ ID NO: 588885 - DNA, 25 bp, Homo sapien
taccatctgattgcctaagcctgta

SEQ ID NO: 588886 - DNA, 25 bp, Homo sapien
gcctaagcctgtagtaattattgtt

SEQ ID NO: 588887 - DNA, 25 bp, Homo sapien
tttaatatttgacatttcctgcatt

SEQ ID NO: 588888 - DNA, 25 bp, Homo sapien
tgacatttcctgcatttccaccaag

SEQ ID NO: 588889 - DNA, 25 bp, Homo sapien
gcatttccaccaagtgctttatgac

SEQ ID NO: 588890 - DNA, 25 bp, Homo sapien
gctttatgactttagttactttcta

SEQ ID NO: 588891 - DNA, 25 bp, Homo sapien
ctttctacctagtaagtttgagact

SEQ ID NO: 588892 - DNA, 25 bp, Homo sapien
agtttgagacttgtggaagccaatt

SEQ ID NO: 588893 - DNA, 25 bp, Homo sapien
gggagttcttcaaaagctgtgtgta

SEQ ID NO: 588894 - DNA, 25 bp, Homo sapien
atcttttccaggctatagattttag

SEQ ID NO: 588895 - DNA, 25 bp, Homo sapien
gaatgttttttctcaaagtagtgca

SEQ ID NO: 588896 - DNA, 25 bp, Homo sapien
agaggataacataacgaacccccat

SEQ ID NO: 588897 - DNA, 25 bp, Homo sapien
atcaccaagcctcaacagttataag

SEQ ID NO: 588898 - DNA, 25 bp, Homo sapien
gttataagcattttgcccatcccag

SEQ ID NO: 588899 - DNA, 25 bp, Homo sapien
cattttgcccatcccagacatgatg

SEQ ID NO: 588900 - DNA, 25 bp, Homo sapien
atcccagacatgatgccttttattc

SEQ ID NO: 588901 - DNA, 25 bp, Homo sapien
gatgccttttattcacatgtccttt

SEQ ID NO: 588902 - DNA, 25 bp, Homo sapien
catgtcctttagtgttcatttccaa

SEQ ID NO: 588903 - DNA, 25 bp, Homo sapien
gttcatttccaactgataaggcata

SEQ ID NO: 588904 - DNA, 25 bp, Homo sapien
atcttcatgctattataacatctcc

SEQ ID NO: 588905 - DNA, 25 bp, Homo sapien
aaaacctacattactatcttaatgc

SEQ ID NO: 588906 - DNA, 25 bp, Homo sapien
tacttgataacatttcacacctatt

SEQ ID NO: 588907 - DNA, 25 bp, Homo sapien
gataacatttcacacctattcaggg

SEQ ID NO: 588908 - DNA, 25 bp, Homo sapien
aacatttcacacctattcagggtaa

SEQ ID NO: 588909 - DNA, 25 bp, Homo sapien
ttcacacctattcagggtaaaaatt

SEQ ID NO: 588910 - DNA, 25 bp, Homo sapien
ggctgcaatcatcatatttaatggt

SEQ ID NO: 588911 - DNA, 25 bp, Homo sapien
catatttaatggtgaagtgtgttca

SEQ ID NO: 588912 - DNA, 25 bp, Homo sapien
gatcaggaacaagcattaatgttga

SEQ ID NO: 588913 - DNA, 25 bp, Homo sapien
tatcactcttatttagcattatcct

SEQ ID NO: 588914 - DNA, 25 bp, Homo sapien
tttagcattatcctagaataactag

SEQ ID NO: 588915 - DNA, 25 bp, Homo sapien
gaataactagctaacctgttaaggt

SEQ ID NO: 588916 - DNA, 25 bp, Homo sapien
tatttacaccattgcaattggcaaa

SEQ ID NO: 588917 - DNA, 25 bp, Homo sapien
caccattgcaattggcaaatgctgt

SEQ ID NO: 588918 - DNA, 25 bp, Homo sapien
tggcaaatgctgtaaatcaaggctt

SEQ ID NO: 588919 - DNA, 25 bp, Homo sapien
aatcaaggcttgacttatggttctg

SEQ ID NO: 588920 - DNA, 25 bp, Homo sapien
aggcttgacttatggttctgttgat

SEQ ID NO: 588921 - DNA, 25 bp, Homo sapien
cttatggttctgttgattattcttc

SEQ ID NO: 588922 - DNA, 25 bp, Homo sapien
gtgcgtgtctcttcctgactctgag

SEQ ID NO: 588923 - DNA, 25 bp, Homo sapien
tgtctcttcctgactctgagctcga

SEQ ID NO: 588924 - DNA, 25 bp, Homo sapien
ctgactctgagctcgacaccgtcag

SEQ ID NO: 588925 - DNA, 25 bp, Homo sapien
tggaaatgggccacggtgtgaatat

SEQ ID NO: 588926 - DNA, 25 bp, Homo sapien
tgggccacggtgtgaatatttacac

SEQ ID NO: 588927 - DNA, 25 bp, Homo sapien
gctgtgtcccgagcacacgtgctga

SEQ ID NO: 588928 - DNA, 25 bp, Homo sapien
gccgccctgtagttcttggctgggt

SEQ ID NO: 588929 - DNA, 25 bp, Homo sapien
cttggctgggtctggaggtgtctgt

SEQ ID NO: 588930 - DNA, 25 bp, Homo sapien
gaggtgtctgtggagcaccctgccc

SEQ ID NO: 588931 - DNA, 25 bp, Homo sapien
gctgaacatgggaaacaacctgaaa

SEQ ID NO: 588932 - DNA, 25 bp, Homo sapien
aacctgaaaagcaggcaggcctccc

SEQ ID NO: 588933 - DNA, 25 bp, Homo sapien
gaaaagcaggcaggcctcccggtca

SEQ ID NO: 588934 - DNA, 25 bp, Homo sapien
tgctgtgctggcttcccatgaccac

SEQ ID NO: 588935 - DNA, 25 bp, Homo sapien
acctcctcctgctgaaatattactg

SEQ ID NO: 588936 - DNA, 25 bp, Homo sapien
gaaatattactgcttgaatctggag

SEQ ID NO: 588937 - DNA, 25 bp, Homo sapien
atctggagcagattgcgggtttata

SEQ ID NO: 588938 - DNA, 25 bp, Homo sapien
ttacctttcatggtagcatgtcagt

SEQ ID NO: 588939 - DNA, 25 bp, Homo sapien
gcatgtcagtaggttatgtctaaca

SEQ ID NO: 588940 - DNA, 25 bp, Homo sapien
catggacaaaatcaggttatagcaa

SEQ ID NO: 588941 - DNA, 25 bp, Homo sapien
ggttatagcaaattagcacgttact

SEQ ID NO: 588942 - DNA, 25 bp, Homo sapien
gttagtataacaacacacccaaaat

SEQ ID NO: 588943 - DNA, 25 bp, Homo sapien
aggtgtgagggattgactccttcca

SEQ ID NO: 588944 - DNA, 25 bp, Homo sapien
gggattgactccttccatctttttg

SEQ ID NO: 588945 - DNA, 25 bp, Homo sapien
ttttggctctgccactcctagggta

SEQ ID NO: 588946 - DNA, 25 bp, Homo sapien
gccactcctagggtattgccattat

SEQ ID NO: 588947 - DNA, 25 bp, Homo sapien
gggtattgccattatccatgttgtt

SEQ ID NO: 588948 - DNA, 25 bp, Homo sapien
tatccatgttgttagacatggcccc

SEQ ID NO: 588949 - DNA, 25 bp, Homo sapien
gaaagccgcatttttaggaagcacc

SEQ ID NO: 588950 - DNA, 25 bp, Homo sapien
ttttaggaagcaccgcagatactgg

SEQ ID NO: 588951 - DNA, 25 bp, Homo sapien
agatactggtgctccacgagactca

SEQ ID NO: 588952 - DNA, 25 bp, Homo sapien
cacgagactcactggttggttagaa

SEQ ID NO: 588953 - DNA, 25 bp, Homo sapien
gattctggagtcatgaagcctggtt

SEQ ID NO: 588954 - DNA, 25 bp, Homo sapien
aagcctggttaagttcagtatttgc

SEQ ID NO: 588955 - DNA, 25 bp, Homo sapien
cagtatttgctttgccacttatcca

SEQ ID NO: 588956 - DNA, 25 bp, Homo sapien
gccacttatccactgtaaatccttg

SEQ ID NO: 588957 - DNA, 25 bp, Homo sapien
ggccaagttatttagcatctcttaa

SEQ ID NO: 588958 - DNA, 25 bp, Homo sapien
tcttcctctggcttgtatcttgtga

SEQ ID NO: 588959 - DNA, 25 bp, Homo sapien
gcttgtatcttgtgagaactaacca

SEQ ID NO: 588960 - DNA, 25 bp, Homo sapien
gatagagtcacagatacagaaagta

SEQ ID NO: 588961 - DNA, 25 bp, Homo sapien
gggaagcgggagatttttcttgact

SEQ ID NO: 588962 - DNA, 25 bp, Homo sapien
gcgggagatttttcttgactgcccc

SEQ ID NO: 588963 - DNA, 25 bp, Homo sapien
acattttataggcttcagggagaga

SEQ ID NO: 588964 - DNA, 25 bp, Homo sapien
tccggagttcccgagctgctgagga

SEQ ID NO: 588965 - DNA, 25 bp, Homo sapien
cccgagctgctgaggagtctggatt

SEQ ID NO: 588966 - DNA, 25 bp, Homo sapien
ctgaggagtctggattgtgtctgtc

SEQ ID NO: 588967 - DNA, 25 bp, Homo sapien
tgtctgtccccagtgtcagatgaaa

SEQ ID NO: 588968 - DNA, 25 bp, Homo sapien
cccagtgtcagatgaaagggcgctg

SEQ ID NO: 588969 - DNA, 25 bp, Homo sapien
aaagggcgctgaggctcttggccgc

SEQ ID NO: 588970 - DNA, 25 bp, Homo sapien
ttggccgctgtctccagcgcgatgt

SEQ ID NO: 588971 - DNA, 25 bp, Homo sapien
aagtgaccttcgtttggataaggct

SEQ ID NO: 588972 - DNA, 25 bp, Homo sapien
gaggcccgaagtccgctagagcaca

SEQ ID NO: 588973 - DNA, 25 bp, Homo sapien
agagcacagtcccatccaggctgat

SEQ ID NO: 588974 - DNA, 25 bp, Homo sapien
gtcccatccaggctgatgccaagca

SEQ ID NO: 588975 - DNA, 25 bp, Homo sapien
cgagcaggccttacagaccacactg

SEQ ID NO: 588976 - DNA, 25 bp, Homo sapien
ggccttacagaccacactgcaggaa

SEQ ID NO: 588977 - DNA, 25 bp, Homo sapien
cacactgcaggaagtcaaacacgaa

SEQ ID NO: 588978 - DNA, 25 bp, Homo sapien
ggaagtcaaacacgaactcaaagag

SEQ ID NO: 588979 - DNA, 25 bp, Homo sapien
actcaaagaggacatccagctgctc

SEQ ID NO: 588980 - DNA, 25 bp, Homo sapien
gctcagctgcagaatgactgcccta

SEQ ID NO: 588981 - DNA, 25 bp, Homo sapien
gactgccctagaaaagcaggtggca

SEQ ID NO: 588982 - DNA, 25 bp, Homo sapien
agaagctattccaggccctcctatg

SEQ ID NO: 588983 - DNA, 25 bp, Homo sapien
tccaggccctcctatgactgatggg

SEQ ID NO: 588984 - DNA, 25 bp, Homo sapien
ggaatccgggaatgcatgttctgga

SEQ ID NO: 588985 - DNA, 25 bp, Homo sapien
ccgggaatgcatgttctggaaaact

SEQ ID NO: 588986 - DNA, 25 bp, Homo sapien
tctggaaaactcaccccactagagt

SEQ ID NO: 588987 - DNA, 25 bp, Homo sapien
tcaccccactagagtgagatcacat

SEQ ID NO: 588988 - DNA, 25 bp, Homo sapien
tagagtgagatcacatcagtgggtt

SEQ ID NO: 588989 - DNA, 25 bp, Homo sapien
tccctccatcgtgttaacagtttga

SEQ ID NO: 588990 - DNA, 25 bp, Homo sapien
tgttaacagtttgaaatcctggcct

SEQ ID NO: 588991 - DNA, 25 bp, Homo sapien
tcctgccaggcctaagtaaaacttg

SEQ ID NO: 588992 - DNA, 25 bp, Homo sapien
ggcctaagtaaaacttgctgttcat

SEQ ID NO: 588993 - DNA, 25 bp, Homo sapien
tcctgcttccatgatagaaggatat

SEQ ID NO: 588994 - DNA, 25 bp, Homo sapien
tgaaacattcgcaactactgctctc

SEQ ID NO: 588995 - DNA, 25 bp, Homo sapien
attctttactcactggcctcatggt

SEQ ID NO: 588996 - DNA, 25 bp, Homo sapien
ctcactggcctcatggtagagtaac

SEQ ID NO: 588997 - DNA, 25 bp, Homo sapien
acaaatatgcagctttcgaaaccca

SEQ ID NO: 588998 - DNA, 25 bp, Homo sapien
gcagctttcgaaacccatggcagag

SEQ ID NO: 588999 - DNA, 25 bp, Homo sapien
acccatggcagagacaatagtttga

SEQ ID NO: 589000 - DNA, 25 bp, Homo sapien
gagagtctcaaaatcttgcctttcg

SEQ ID NO: 589001 - DNA, 25 bp, Homo sapien
aaaatcttgcctttcgagaatccga

SEQ ID NO: 589002 - DNA, 25 bp, Homo sapien
gagaatccgagtcctgacacacaga

SEQ ID NO: 589003 - DNA, 25 bp, Homo sapien
aggactagtgtatggtttgttaagc

SEQ ID NO: 589004 - DNA, 25 bp, Homo sapien
gtactaaggaacaacattccctttg

SEQ ID NO: 589005 - DNA, 25 bp, Homo sapien
taaggaacaacattccctttgaaag

SEQ ID NO: 589006 - DNA, 25 bp, Homo sapien
gaaaggacattatttgcctgttgta

SEQ ID NO: 589007 - DNA, 25 bp, Homo sapien
aaggacattatttgcctgttgtatt

SEQ ID NO: 589008 - DNA, 25 bp, Homo sapien
aggacattatttgcctgttgtattt

SEQ ID NO: 589009 - DNA, 25 bp, Homo sapien
gttgtatttaacttcacagtgcctt

SEQ ID NO: 589010 - DNA, 25 bp, Homo sapien
ttgtatttaacttcacagtgccttg

SEQ ID NO: 589011 - DNA, 25 bp, Homo sapien
cagtgccttgcaaagagttgtttaa

SEQ ID NO: 589012 - DNA, 25 bp, Homo sapien
gtgccttgcaaagagttgtttaact

SEQ ID NO: 589013 - DNA, 25 bp, Homo sapien
tgccttgcaaagagttgtttaactt

SEQ ID NO: 589014 - DNA, 25 bp, Homo sapien
atgcctaaaccctggtggccattgt

SEQ ID NO: 589015 - DNA, 25 bp, Homo sapien
agataagacccaaagctcggctcct

SEQ ID NO: 589016 - DNA, 25 bp, Homo sapien
gctcctaccaggaaaggcataccta

SEQ ID NO: 589017 - DNA, 25 bp, Homo sapien
atacctaacccgtttcctactgctg

SEQ ID NO: 589018 - DNA, 25 bp, Homo sapien
tttcctactgctgccctataagctt

SEQ ID NO: 589019 - DNA, 25 bp, Homo sapien
gagggcaattaacagctacatcaag

SEQ ID NO: 589020 - DNA, 25 bp, Homo sapien
ctacatcaaggcttgtacccagtgt

SEQ ID NO: 589021 - DNA, 25 bp, Homo sapien
gggcgtggttgtacaccgagacttc

SEQ ID NO: 589022 - DNA, 25 bp, Homo sapien
ttgtacaccgagacttctgttcact

SEQ ID NO: 589023 - DNA, 25 bp, Homo sapien
gagacttctgttcactttccttact

SEQ ID NO: 589024 - DNA, 25 bp, Homo sapien
tgttcactttccttactgctgaatt

SEQ ID NO: 589025 - DNA, 25 bp, Homo sapien
actttccttactgctgaattagaga

SEQ ID NO: 589026 - DNA, 25 bp, Homo sapien
tagggattcgccattggtaactcgg

SEQ ID NO: 589027 - DNA, 25 bp, Homo sapien
gggtaactcggctctcttccactgc

SEQ ID NO: 589028 - DNA, 25 bp, Homo sapien
tctcttccactgctgacgtatgtag

SEQ ID NO: 589029 - DNA, 25 bp, Homo sapien
acgtatgtagcaagtcctgtcttcg

SEQ ID NO: 589030 - DNA, 25 bp, Homo sapien
agcaagtcctgtcttcgggttggca

SEQ ID NO: 589031 - DNA, 25 bp, Homo sapien
gactgacaccacatgcgcagagaga

SEQ ID NO: 589032 - DNA, 25 bp, Homo sapien
gaagtgactcatgacatcaccctcg

SEQ ID NO: 589033 - DNA, 25 bp, Homo sapien
atcaccctcgtctctgaaagacaag

SEQ ID NO: 589034 - DNA, 25 bp, Homo sapien
acaagatgttggtctcctcaggtgc

SEQ ID NO: 589035 - DNA, 25 bp, Homo sapien
agcccctgcaatgcagaccaggatg

SEQ ID NO: 589036 - DNA, 25 bp, Homo sapien
ggaagaggcctacagcattttttat

SEQ ID NO: 589037 - DNA, 25 bp, Homo sapien
tctttctatgcagacataggtatac

SEQ ID NO: 589038 - DNA, 25 bp, Homo sapien
gtaaaattataatgctagtctcttt

SEQ ID NO: 589039 - DNA, 25 bp, Homo sapien
aatgctagtctctttatttccctac

SEQ ID NO: 589040 - DNA, 25 bp, Homo sapien
tgctagtctctttatttccctacac

SEQ ID NO: 589041 - DNA, 25 bp, Homo sapien
agtctctttatttccctacacaata

SEQ ID NO: 589042 - DNA, 25 bp, Homo sapien
ctttatttccctacacaataccttg

SEQ ID NO: 589043 - DNA, 25 bp, Homo sapien
tatttccctacacaataccttgaca

SEQ ID NO: 589044 - DNA, 25 bp, Homo sapien
ttccctacacaataccttgacaaat

SEQ ID NO: 589045 - DNA, 25 bp, Homo sapien
caataccttgacaaattatgacaat

SEQ ID NO: 589046 - DNA, 25 bp, Homo sapien
tgacaatataataggtaccagactt

SEQ ID NO: 589047 - DNA, 25 bp, Homo sapien
ataggtaccagacttgttaaattat

SEQ ID NO: 589048 - DNA, 25 bp, Homo sapien
ctctgttagaaggagcggaggctgt

SEQ ID NO: 589049 - DNA, 25 bp, Homo sapien
ctgttagaaggagcggaggctgtgc

SEQ ID NO: 589050 - DNA, 25 bp, Homo sapien
ttagaaggagcggaggctgtgctcg

SEQ ID NO: 589051 - DNA, 25 bp, Homo sapien
agaaggagcggaggctgtgctcggt

SEQ ID NO: 589052 - DNA, 25 bp, Homo sapien
aggagcggaggctgtgctcggtggc

SEQ ID NO: 589053 - DNA, 25 bp, Homo sapien
ggagcggaggctgtgctcggtggct

SEQ ID NO: 589054 - DNA, 25 bp, Homo sapien
tgaccaacacggaaaaatcatgtct

SEQ ID NO: 589055 - DNA, 25 bp, Homo sapien
gaccaacacggaaaaatcatgtctc

SEQ ID NO: 589056 - DNA, 25 bp, Homo sapien
accaacacggaaaaatcatgtctct

SEQ ID NO: 589057 - DNA, 25 bp, Homo sapien
ccaacacggaaaaatcatgtctcta

SEQ ID NO: 589058 - DNA, 25 bp, Homo sapien
caacacggaaaaatcatgtctctac

SEQ ID NO: 589059 - DNA, 25 bp, Homo sapien
cccctcggagccaaatgaggcagga

SEQ ID NO: 589060 - DNA, 25 bp, Homo sapien
ccctcggagccaaatgaggcaggaa

SEQ ID NO: 589061 - DNA, 25 bp, Homo sapien
cctcggagccaaatgaggcaggaat

SEQ ID NO: 589062 - DNA, 25 bp, Homo sapien
atagagagccgcctttctcggaact

SEQ ID NO: 589063 - DNA, 25 bp, Homo sapien
tagagagccgcctttctcggaactg

SEQ ID NO: 589064 - DNA, 25 bp, Homo sapien
agagagccgcctttctcggaactga

SEQ ID NO: 589065 - DNA, 25 bp, Homo sapien
gagagccgcctttctcggaactgaa

SEQ ID NO: 589066 - DNA, 25 bp, Homo sapien
cctttctcggaactgaactgaactc

SEQ ID NO: 589067 - DNA, 25 bp, Homo sapien
ctttctcggaactgaactgaactct

SEQ ID NO: 589068 - DNA, 25 bp, Homo sapien
tttctcggaactgaactgaactctt

SEQ ID NO: 589069 - DNA, 25 bp, Homo sapien
tcacccactcctggcccaagacagg

SEQ ID NO: 589070 - DNA, 25 bp, Homo sapien
cacagatgagtttcacatgtttttg

SEQ ID NO: 589071 - DNA, 25 bp, Homo sapien
ttctgttcctatacaagtttgcctt

SEQ ID NO: 589072 - DNA, 25 bp, Homo sapien
tgccttttttgaattccatataagt

SEQ ID NO: 589073 - DNA, 25 bp, Homo sapien
gggattctacaatgtgttatctcaa

SEQ ID NO: 589074 - DNA, 25 bp, Homo sapien
gcatatatgcggttttgtgtatctg

SEQ ID NO: 589075 - DNA, 25 bp, Homo sapien
gtatctgtagatggttcttttttat

SEQ ID NO: 589076 - DNA, 25 bp, Homo sapien
tgcagaataatgttccagggtatgg

SEQ ID NO: 589077 - DNA, 25 bp, Homo sapien
tccagggtatggatgtaccaaagct

SEQ ID NO: 589078 - DNA, 25 bp, Homo sapien
taccaaagcttgttcatccattcac

SEQ ID NO: 589079 - DNA, 25 bp, Homo sapien
gttcatccattcaccagctgaggga

SEQ ID NO: 589080 - DNA, 25 bp, Homo sapien
agctgagggatatttggactgtttc

SEQ ID NO: 589081 - DNA, 25 bp, Homo sapien
aagctagtaggcaagacccctcagt

SEQ ID NO: 589082 - DNA, 25 bp, Homo sapien
ctcagtgtatacctttaaacccata

SEQ ID NO: 589083 - DNA, 25 bp, Homo sapien
actttctctagttttggagcttctg

SEQ ID NO: 589084 - DNA, 25 bp, Homo sapien
gagcttctgtatttcctatagtttt

SEQ ID NO: 589085 - DNA, 25 bp, Homo sapien
cctatagttttctgactgtccattt

SEQ ID NO: 589086 - DNA, 25 bp, Homo sapien
tgtccattttatccatcttagaagt

SEQ ID NO: 589087 - DNA, 25 bp, Homo sapien
aagtattcacatcccttctatgcag

SEQ ID NO: 589088 - DNA, 25 bp, Homo sapien
gcaggatttctgcatagttttaaat

SEQ ID NO: 589089 - DNA, 25 bp, Homo sapien
aatactttcattgcctaagggtttg

SEQ ID NO: 589090 - DNA, 25 bp, Homo sapien
taagggtttgggtgtgtcagctttt

SEQ ID NO: 589091 - DNA, 25 bp, Homo sapien
tacttatcagaccactgaggccaag

SEQ ID NO: 589092 - DNA, 25 bp, Homo sapien
tcgctgggctctaaggtactgtggg

SEQ ID NO: 589093 - DNA, 25 bp, Homo sapien
ggacctgggacaagcaggccgccct

SEQ ID NO: 589094 - DNA, 25 bp, Homo sapien
aggccgccctcggactaggttagca

SEQ ID NO: 589095 - DNA, 25 bp, Homo sapien
gccctcggactaggttagcatcctg

SEQ ID NO: 589096 - DNA, 25 bp, Homo sapien
ggactaggttagcatcctgcccgag

SEQ ID NO: 589097 - DNA, 25 bp, Homo sapien
aggttagcatcctgcccgagggcag

SEQ ID NO: 589098 - DNA, 25 bp, Homo sapien
gggcgggattctctctctaagtata

SEQ ID NO: 589099 - DNA, 25 bp, Homo sapien
agtatattatatggcaggagctact

SEQ ID NO: 589100 - DNA, 25 bp, Homo sapien
atggcaggagctactgagaacataa

SEQ ID NO: 589101 - DNA, 25 bp, Homo sapien
gaacataaaatcttggcgagtcatt

SEQ ID NO: 589102 - DNA, 25 bp, Homo sapien
atcttggcgagtcattaaacttatg

SEQ ID NO: 589103 - DNA, 25 bp, Homo sapien
caccttctgcatgaatctgcgaaaa

SEQ ID NO: 589104 - DNA, 25 bp, Homo sapien
atctgcgaaaaacaaatctgcccca

SEQ ID NO: 589105 - DNA, 25 bp, Homo sapien
acttgccctcactttctcaataagg

SEQ ID NO: 589106 - DNA, 25 bp, Homo sapien
ctcactttctcaataaggtccactc

SEQ ID NO: 589107 - DNA, 25 bp, Homo sapien
aataaggtccactcagacccttgac

SEQ ID NO: 589108 - DNA, 25 bp, Homo sapien
tccactcagacccttgactttaatg

SEQ ID NO: 589109 - DNA, 25 bp, Homo sapien
tcagacccttgactttaatgttaac

SEQ ID NO: 589110 - DNA, 25 bp, Homo sapien
agcacatagcactgaccaccttcta

SEQ ID NO: 589111 - DNA, 25 bp, Homo sapien
tgaccaccttctaacacactatgtt

SEQ ID NO: 589112 - DNA, 25 bp, Homo sapien
aacacactatgttagttcctcactt

SEQ ID NO: 589113 - DNA, 25 bp, Homo sapien
acactatgttagttcctcacttatc

SEQ ID NO: 589114 - DNA, 25 bp, Homo sapien
tgacaccagggagatcctccatagc

SEQ ID NO: 589115 - DNA, 25 bp, Homo sapien
cagggagatcctccatagctggctt

SEQ ID NO: 589116 - DNA, 25 bp, Homo sapien
agatcctccatagctggctttgagg

SEQ ID NO: 589117 - DNA, 25 bp, Homo sapien
gggaccacagccatgagcggcctct

SEQ ID NO: 589118 - DNA, 25 bp, Homo sapien
gccatgagcggcctctaagagctga

SEQ ID NO: 589119 - DNA, 25 bp, Homo sapien
agcggcctctaagagctgagagaca

SEQ ID NO: 589120 - DNA, 25 bp, Homo sapien
tctaagagctgagagacagccggca

SEQ ID NO: 589121 - DNA, 25 bp, Homo sapien
agacagccggcagggaatcggaacc

SEQ ID NO: 589122 - DNA, 25 bp, Homo sapien
agccggcagggaatcggaaccctca

SEQ ID NO: 589123 - DNA, 25 bp, Homo sapien
ggcagggaatcggaaccctcagacc

SEQ ID NO: 589124 - DNA, 25 bp, Homo sapien
gacccacagccgcaaggcactggat

SEQ ID NO: 589125 - DNA, 25 bp, Homo sapien
gaacacagcaaatttgtccagactt

SEQ ID NO: 589126 - DNA, 25 bp, Homo sapien
tctatcagggcatgtcagaccaaca

SEQ ID NO: 589127 - DNA, 25 bp, Homo sapien
tatcagggcatgtcagaccaacaga

SEQ ID NO: 589128 - DNA, 25 bp, Homo sapien
cagggcatgtcagaccaacagaggg

SEQ ID NO: 589129 - DNA, 25 bp, Homo sapien
caagctgccaataatgtctgcaaaa

SEQ ID NO: 589130 - DNA, 25 bp, Homo sapien
gctgccaataatgtctgcaaaaagt

SEQ ID NO: 589131 - DNA, 25 bp, Homo sapien
gtgaattcttccaacaactacgtga

SEQ ID NO: 589132 - DNA, 25 bp, Homo sapien
ccttgaacctagaatgagactgcag

SEQ ID NO: 589133 - DNA, 25 bp, Homo sapien
gaacctagaatgagactgcagcagc

SEQ ID NO: 589134 - DNA, 25 bp, Homo sapien
acctagaatgagactgcagcagccc

SEQ ID NO: 589135 - DNA, 25 bp, Homo sapien
cagcttcgtggaccctgagcagaga

SEQ ID NO: 589136 - DNA, 25 bp, Homo sapien
cgtgggatgtgggtgggatctggga

SEQ ID NO: 589137 - DNA, 25 bp, Homo sapien
gtgggatgtgggtgggatctgggat

SEQ ID NO: 589138 - DNA, 25 bp, Homo sapien
gtccctttgttgtgagacctcaaac

SEQ ID NO: 589139 - DNA, 25 bp, Homo sapien
tccctttgttgtgagacctcaaacc

SEQ ID NO: 589140 - DNA, 25 bp, Homo sapien
atagcagtaccatttcacagtagcc

SEQ ID NO: 589141 - DNA, 25 bp, Homo sapien
tagcagtaccatttcacagtagcca

SEQ ID NO: 589142 - DNA, 25 bp, Homo sapien
agcagtaccatttcacagtagccaa

SEQ ID NO: 589143 - DNA, 25 bp, Homo sapien
gcagtaccatttcacagtagccaaa

SEQ ID NO: 589144 - DNA, 25 bp, Homo sapien
cagtaccatttcacagtagccaaaa

SEQ ID NO: 589145 - DNA, 25 bp, Homo sapien
cacagtagccaaaagagaagcaatc

SEQ ID NO: 589146 - DNA, 25 bp, Homo sapien
acagtagccaaaagagaagcaatcc

SEQ ID NO: 589147 - DNA, 25 bp, Homo sapien
aataatgctgtatatggtggtgtac

SEQ ID NO: 589148 - DNA, 25 bp, Homo sapien
gtggtgtacacttgcagtcccagag

SEQ ID NO: 589149 - DNA, 25 bp, Homo sapien
ggtgtacacttgcagtcccagagta

SEQ ID NO: 589150 - DNA, 25 bp, Homo sapien
tgtacacttgcagtcccagagtatt

SEQ ID NO: 589151 - DNA, 25 bp, Homo sapien
tacacttgcagtcccagagtattcg

SEQ ID NO: 589152 - DNA, 25 bp, Homo sapien
acttgcagtcccagagtattcgaga

SEQ ID NO: 589153 - DNA, 25 bp, Homo sapien
tgcagtcccagagtattcgagaggc

SEQ ID NO: 589154 - DNA, 25 bp, Homo sapien
ttggaggatcacacgagccctggag

SEQ ID NO: 589155 - DNA, 25 bp, Homo sapien
gctagggtgcacaattcatggggaa

SEQ ID NO: 589156 - DNA, 25 bp, Homo sapien
agagaagagggctttcatttaaaga

SEQ ID NO: 589157 - DNA, 25 bp, Homo sapien
ttaaagagcataccaggcttggcat

SEQ ID NO: 589158 - DNA, 25 bp, Homo sapien
acccttcactgctgggcttctaagg

SEQ ID NO: 589159 - DNA, 25 bp, Homo sapien
tcactgctgggcttctaagggcatt

SEQ ID NO: 589160 - DNA, 25 bp, Homo sapien
gctgggcttctaagggcattggcca

SEQ ID NO: 589161 - DNA, 25 bp, Homo sapien
gcttctaagggcattggccagatga

SEQ ID NO: 589162 - DNA, 25 bp, Homo sapien
ggccagatgaacaagcacacgcaga

SEQ ID NO: 589163 - DNA, 25 bp, Homo sapien
tgaacaagcacacgcagaactgaat

SEQ ID NO: 589164 - DNA, 25 bp, Homo sapien
agcacacgcagaactgaattggccc

SEQ ID NO: 589165 - DNA, 25 bp, Homo sapien
tgaattggccctgatggcctgcaag

SEQ ID NO: 589166 - DNA, 25 bp, Homo sapien
attggccctgatggcctgcaaggga

SEQ ID NO: 589167 - DNA, 25 bp, Homo sapien
tctgcatggccgatgtttgaattaa

SEQ ID NO: 589168 - DNA, 25 bp, Homo sapien
gcatggccgatgtttgaattaaaat

SEQ ID NO: 589169 - DNA, 25 bp, Homo sapien
ccctcagtaagtgggctggtggtga

SEQ ID NO: 589170 - DNA, 25 bp, Homo sapien
gctggtggtgattgtcacattaagt

SEQ ID NO: 589171 - DNA, 25 bp, Homo sapien
gggatacatgtttgtaactcctttg

SEQ ID NO: 589172 - DNA, 25 bp, Homo sapien
tacatgtttgtaactcctttgagga

SEQ ID NO: 589173 - DNA, 25 bp, Homo sapien
gtttgtaactcctttgaggatttgt

SEQ ID NO: 589174 - DNA, 25 bp, Homo sapien
atctctgtcctctttttgtcaagtc

SEQ ID NO: 589175 - DNA, 25 bp, Homo sapien
tgtcaagtcagatcttacaattcaa

SEQ ID NO: 589176 - DNA, 25 bp, Homo sapien
gtcagatcttacaattcaaagacag

SEQ ID NO: 589177 - DNA, 25 bp, Homo sapien
tcaaagacagaaatgctacctaact

SEQ ID NO: 589178 - DNA, 25 bp, Homo sapien
tgctacctaacttctataacatatc

SEQ ID NO: 589179 - DNA, 25 bp, Homo sapien
atagggtaaattgggcaggagaatc

SEQ ID NO: 589180 - DNA, 25 bp, Homo sapien
ttgtagtgctgtatatccaaatatt

SEQ ID NO: 589181 - DNA, 25 bp, Homo sapien
agtgctgtatatccaaatattaggg

SEQ ID NO: 589182 - DNA, 25 bp, Homo sapien
gggcaaacaattaaggtagacatga

SEQ ID NO: 589183 - DNA, 25 bp, Homo sapien
gacatgatgatcttatctacttttg

SEQ ID NO: 589184 - DNA, 25 bp, Homo sapien
tgatgatcttatctacttttgtagg

SEQ ID NO: 589185 - DNA, 25 bp, Homo sapien
gatcttatctacttttgtaggtaaa

SEQ ID NO: 589186 - DNA, 25 bp, Homo sapien
gaatttgaaaggatgccaagcaagg

SEQ ID NO: 589187 - DNA, 25 bp, Homo sapien
caagcaaggatttatggcatattaa

SEQ ID NO: 589188 - DNA, 25 bp, Homo sapien
tatggcatattaaggcagatcaagc

SEQ ID NO: 589189 - DNA, 25 bp, Homo sapien
tattaaggcagatcaagccaggaat

SEQ ID NO: 589190 - DNA, 25 bp, Homo sapien
tcaagccaggaatggtggttcacac

SEQ ID NO: 589191 - DNA, 25 bp, Homo sapien
gcagatgtgattcagtttaggattt

SEQ ID NO: 589192 - DNA, 25 bp, Homo sapien
gtcatcataaggttcttataagagg

SEQ ID NO: 589193 - DNA, 25 bp, Homo sapien
gagtgagtagtaagagatgcaacag

SEQ ID NO: 589194 - DNA, 25 bp, Homo sapien
gatgcaacagtggaagcaagaggtt

SEQ ID NO: 589195 - DNA, 25 bp, Homo sapien
gcccaggagtgctgacagacatcag

SEQ ID NO: 589196 - DNA, 25 bp, Homo sapien
gtgctgacagacatcagaagctgga

SEQ ID NO: 589197 - DNA, 25 bp, Homo sapien
gaagggacaaggaatggtttctcct

SEQ ID NO: 589198 - DNA, 25 bp, Homo sapien
cttgattttagccttggaagactca

SEQ ID NO: 589199 - DNA, 25 bp, Homo sapien
gattttagccttggaagactcattt

SEQ ID NO: 589200 - DNA, 25 bp, Homo sapien
ttagccttggaagactcattttgga

SEQ ID NO: 589201 - DNA, 25 bp, Homo sapien
ttggacttctgaccttgaacgttgt

SEQ ID NO: 589202 - DNA, 25 bp, Homo sapien
ggcacgcaaacgagcgacattggcg

SEQ ID NO: 589203 - DNA, 25 bp, Homo sapien
aacgagcgacattggcgtgtccagc

SEQ ID NO: 589204 - DNA, 25 bp, Homo sapien
tgtccagccggcaggtcagaggata

SEQ ID NO: 589205 - DNA, 25 bp, Homo sapien
gtctccggagccagcctggcttttt

SEQ ID NO: 589206 - DNA, 25 bp, Homo sapien
ttttttcatttctgcctcaactact

SEQ ID NO: 589207 - DNA, 25 bp, Homo sapien
tgcctcaactacttaccaggtgtca

SEQ ID NO: 589208 - DNA, 25 bp, Homo sapien
tacttaccaggtgtcagcccttgga

SEQ ID NO: 589209 - DNA, 25 bp, Homo sapien
agcccttggacacttttccctgtgc

SEQ ID NO: 589210 - DNA, 25 bp, Homo sapien
agtggaatgataataggacctgcct

SEQ ID NO: 589211 - DNA, 25 bp, Homo sapien
ggctgtcctggaacaagcgagtgct

SEQ ID NO: 589212 - DNA, 25 bp, Homo sapien
aagcgagtgcttggtagtaagtgca

SEQ ID NO: 589213 - DNA, 25 bp, Homo sapien
ttttccttgactgcgaacacgggca

SEQ ID NO: 589214 - DNA, 25 bp, Homo sapien
gaacacgggcagatatcattctaca

SEQ ID NO: 589215 - DNA, 25 bp, Homo sapien
aatgtgaccgagatgtccctcattt

SEQ ID NO: 589216 - DNA, 25 bp, Homo sapien
attgcgccttccaaggagctctcag

SEQ ID NO: 589217 - DNA, 25 bp, Homo sapien
aaggagctctcaggcctgtgttttc

SEQ ID NO: 589218 - DNA, 25 bp, Homo sapien
ttttccctctgtatcccaaatggag

SEQ ID NO: 589219 - DNA, 25 bp, Homo sapien
atggagacacaagtccagactccct

SEQ ID NO: 589220 - DNA, 25 bp, Homo sapien
ccatcttacaacatggtccttcttg

SEQ ID NO: 589221 - DNA, 25 bp, Homo sapien
gtccttcttgtgatgctactgttag

SEQ ID NO: 589222 - DNA, 25 bp, Homo sapien
gttagcccttaatcttctgtgtgta

SEQ ID NO: 589223 - DNA, 25 bp, Homo sapien
aaatccaagaccacgagacaccaga

SEQ ID NO: 589224 - DNA, 25 bp, Homo sapien
ggacttcaggtgcacgccacaatgc

SEQ ID NO: 589225 - DNA, 25 bp, Homo sapien
gacttcaggtgcacgccacaatgcc

SEQ ID NO: 589226 - DNA, 25 bp, Homo sapien
acttcaggtgcacgccacaatgcct

SEQ ID NO: 589227 - DNA, 25 bp, Homo sapien
ttcaggtgcacgccacaatgcctaa

SEQ ID NO: 589228 - DNA, 25 bp, Homo sapien
caggtgcacgccacaatgcctaatt

SEQ ID NO: 589229 - DNA, 25 bp, Homo sapien
ctcccaaatagcctcttcaagacaa

SEQ ID NO: 589230 - DNA, 25 bp, Homo sapien
tcccaaatagcctcttcaagacaac

SEQ ID NO: 589231 - DNA, 25 bp, Homo sapien
ccaaatagcctcttcaagacaacta

SEQ ID NO: 589232 - DNA, 25 bp, Homo sapien
aatagcctcttcaagacaactaccc

SEQ ID NO: 589233 - DNA, 25 bp, Homo sapien
ctcttcaagacaactaccccataag

SEQ ID NO: 589234 - DNA, 25 bp, Homo sapien
tcttcaagacaactaccccataagg

SEQ ID NO: 589235 - DNA, 25 bp, Homo sapien
gctacccaaggacttgtttgcaatg

SEQ ID NO: 589236 - DNA, 25 bp, Homo sapien
gtttgcaatgcagaatcacagcccc

SEQ ID NO: 589237 - DNA, 25 bp, Homo sapien
agctggttctgattcggtggccaga

SEQ ID NO: 589238 - DNA, 25 bp, Homo sapien
gtggccagagaaaccgcatgtgtgc

SEQ ID NO: 589239 - DNA, 25 bp, Homo sapien
gggccacacatacagcctggactgg

SEQ ID NO: 589240 - DNA, 25 bp, Homo sapien
tggactggcttatgtcaggcccatc

SEQ ID NO: 589241 - DNA, 25 bp, Homo sapien
catcctggttgtcaccatgaggaca

SEQ ID NO: 589242 - DNA, 25 bp, Homo sapien
atgtcacttccagtacttcgtgtta

SEQ ID NO: 589243 - DNA, 25 bp, Homo sapien
gtggccaagtggtcaatagctttca

SEQ ID NO: 589244 - DNA, 25 bp, Homo sapien
atctttgtgtaactgaatcttgtgc

SEQ ID NO: 589245 - DNA, 25 bp, Homo sapien
aatcttgtgcttcatttccttctgg

SEQ ID NO: 589246 - DNA, 25 bp, Homo sapien
tcctaattgccatcatgttcgcatg

SEQ ID NO: 589247 - DNA, 25 bp, Homo sapien
atcatgttcgcatgctcagggcgag

SEQ ID NO: 589248 - DNA, 25 bp, Homo sapien
tcagggcgagacctgctgtcttatc

SEQ ID NO: 589249 - DNA, 25 bp, Homo sapien
gaaagacattccttcgaagcactgg

SEQ ID NO: 589250 - DNA, 25 bp, Homo sapien
cgaagcactggactgtggacagaca

SEQ ID NO: 589251 - DNA, 25 bp, Homo sapien
tggacagacacacgagctcctggtt

SEQ ID NO: 589252 - DNA, 25 bp, Homo sapien
agacacacgagctcctggttaagcc

SEQ ID NO: 589253 - DNA, 25 bp, Homo sapien
accagctcctgtccgataagttaaa

SEQ ID NO: 589254 - DNA, 25 bp, Homo sapien
agattcattgaaaccgctattgctg

SEQ ID NO: 589255 - DNA, 25 bp, Homo sapien
gctattgctgtagattacgcctgtg

SEQ ID NO: 589256 - DNA, 25 bp, Homo sapien
tttcgccctgaatatctgcttctca

SEQ ID NO: 589257 - DNA, 25 bp, Homo sapien
ctttttgttttatgcttctcgatga

SEQ ID NO: 589258 - DNA, 25 bp, Homo sapien
gttttatgcttctcgatgatccttt

SEQ ID NO: 589259 - DNA, 25 bp, Homo sapien
tgcttctcgatgatccttttgtttt

SEQ ID NO: 589260 - DNA, 25 bp, Homo sapien
ttggctttcctcactcattctcata

SEQ ID NO: 589261 - DNA, 25 bp, Homo sapien
gaggaacacctacaaattataaact

SEQ ID NO: 589262 - DNA, 25 bp, Homo sapien
aatttgaaactgtctctgattaggg

SEQ ID NO: 589263 - DNA, 25 bp, Homo sapien
ttattctcttcatactagggtacac

SEQ ID NO: 589264 - DNA, 25 bp, Homo sapien
ttctcttcatactagggtacacagt

SEQ ID NO: 589265 - DNA, 25 bp, Homo sapien
acacagtaagagcttagtactcact

SEQ ID NO: 589266 - DNA, 25 bp, Homo sapien
gagcttagtactcactaaacattca

SEQ ID NO: 589267 - DNA, 25 bp, Homo sapien
taaacattcacattattaccaactg

SEQ ID NO: 589268 - DNA, 25 bp, Homo sapien
aggccagcgattcccggccttagga

SEQ ID NO: 589269 - DNA, 25 bp, Homo sapien
ttaggacctcctgcgctagggagca

SEQ ID NO: 589270 - DNA, 25 bp, Homo sapien
gagcacgggcgtcttcttccatttg

SEQ ID NO: 589271 - DNA, 25 bp, Homo sapien
ttccatttgccttccccgagcgtgt

SEQ ID NO: 589272 - DNA, 25 bp, Homo sapien
ttccccgagcgtgttggcacaagct

SEQ ID NO: 589273 - DNA, 25 bp, Homo sapien
tgttggcacaagctgcccgcggttt

SEQ ID NO: 589274 - DNA, 25 bp, Homo sapien
ttccagctctgtcttctctgtttta

SEQ ID NO: 589275 - DNA, 25 bp, Homo sapien
ttctctgttttacccagatgatgca

SEQ ID NO: 589276 - DNA, 25 bp, Homo sapien
gatgatgcaactgtggacttctcca

SEQ ID NO: 589277 - DNA, 25 bp, Homo sapien
aactgtggacttctccatctgttta

SEQ ID NO: 589278 - DNA, 25 bp, Homo sapien
ggacttctccatctgtttataggtt

SEQ ID NO: 589279 - DNA, 25 bp, Homo sapien
cagttcctcttttctgtagatacag

SEQ ID NO: 589280 - DNA, 25 bp, Homo sapien
gttagattactttcccaggttctct

SEQ ID NO: 589281 - DNA, 25 bp, Homo sapien
ccaggttctcttgcagttaggtttg

SEQ ID NO: 589282 - DNA, 25 bp, Homo sapien
gcagttaggtttggtcatctgacta

SEQ ID NO: 589283 - DNA, 25 bp, Homo sapien
ggtcatctgactaagttctagccaa

SEQ ID NO: 589284 - DNA, 25 bp, Homo sapien
caaagtaatataggccagtcccatg

SEQ ID NO: 589285 - DNA, 25 bp, Homo sapien
ggccagtcccatgaaaaacatctag

SEQ ID NO: 589286 - DNA, 25 bp, Homo sapien
catctagggcaatttagcatgttct

SEQ ID NO: 589287 - DNA, 25 bp, Homo sapien
tttctttctccatccactggctgaa

SEQ ID NO: 589288 - DNA, 25 bp, Homo sapien
gcttagaagaggacagagccacaag

SEQ ID NO: 589289 - DNA, 25 bp, Homo sapien
gtgaagtagaggtccctcccaactt

SEQ ID NO: 589290 - DNA, 25 bp, Homo sapien
agaaatgcctcaaatgagcatgtgc

SEQ ID NO: 589291 - DNA, 25 bp, Homo sapien
acaacttcagtaaacatgctgtgca

SEQ ID NO: 589292 - DNA, 25 bp, Homo sapien
gtaaacatgctgtgcatgtggcccc

SEQ ID NO: 589293 - DNA, 25 bp, Homo sapien
gcaggccaccacacaagtggacagc

SEQ ID NO: 589294 - DNA, 25 bp, Homo sapien
gaaacagaagccctggaactgtgct

SEQ ID NO: 589295 - DNA, 25 bp, Homo sapien
gaagccctggaactgtgctagcata

SEQ ID NO: 589296 - DNA, 25 bp, Homo sapien
tgtgctagcatataaaaccccaagt

SEQ ID NO: 589297 - DNA, 25 bp, Homo sapien
aaaccccaagtcaagggctgaatgg

SEQ ID NO: 589298 - DNA, 25 bp, Homo sapien
gggctgaatggcacacttggatctc

SEQ ID NO: 589299 - DNA, 25 bp, Homo sapien
gctgaatggcacacttggatctctc

SEQ ID NO: 589300 - DNA, 25 bp, Homo sapien
gtgtatttacttccatttgttcctg

SEQ ID NO: 589301 - DNA, 25 bp, Homo sapien
ctattccatcccgagtccttcttcc

SEQ ID NO: 589302 - DNA, 25 bp, Homo sapien
tcctattccattccgggtccttctc

SEQ ID NO: 589303 - DNA, 25 bp, Homo sapien
tccctcaccatcttctaccttttca

SEQ ID NO: 589304 - DNA, 25 bp, Homo sapien
ttcccctctgcgcactattttcttt

SEQ ID NO: 589305 - DNA, 25 bp, Homo sapien
ctctgcgcactattttctttggtgt

SEQ ID NO: 589306 - DNA, 25 bp, Homo sapien
ctgcgcactattttctttggtgttg

SEQ ID NO: 589307 - DNA, 25 bp, Homo sapien
tgcgcactattttctttggtgttgt

SEQ ID NO: 589308 - DNA, 25 bp, Homo sapien
tttggtgttgttcatttttacctgt

SEQ ID NO: 589309 - DNA, 25 bp, Homo sapien
tcatttttacctgtttcccgaatgt

SEQ ID NO: 589310 - DNA, 25 bp, Homo sapien
tacctgtttcccgaatgttccattc

SEQ ID NO: 589311 - DNA, 25 bp, Homo sapien
gtttcccgaatgttccattcccttg

SEQ ID NO: 589312 - DNA, 25 bp, Homo sapien
gcccctgcagtgagaggtagccatt

SEQ ID NO: 589313 - DNA, 25 bp, Homo sapien
agaggtagccattggagccggcgca

SEQ ID NO: 589314 - DNA, 25 bp, Homo sapien
gagccggcgcaggccaatggactct

SEQ ID NO: 589315 - DNA, 25 bp, Homo sapien
tggactctgcactggagtgacacat

SEQ ID NO: 589316 - DNA, 25 bp, Homo sapien
ctgcactggagtgacacatgctgct

SEQ ID NO: 589317 - DNA, 25 bp, Homo sapien
tggagtgacacatgctgcttccagg

SEQ ID NO: 589318 - DNA, 25 bp, Homo sapien
gtgacacatgctgcttccaggcctg

SEQ ID NO: 589319 - DNA, 25 bp, Homo sapien
gaagccccaggttagcaatggcaga

SEQ ID NO: 589320 - DNA, 25 bp, Homo sapien
tagcaatggcagattgggaggcatc

SEQ ID NO: 589321 - DNA, 25 bp, Homo sapien
gcatcatggatttggactttccgtt

SEQ ID NO: 589322 - DNA, 25 bp, Homo sapien
tggatttggactttccgttattgag

SEQ ID NO: 589323 - DNA, 25 bp, Homo sapien
ggattgcaggctggccttacctggt

SEQ ID NO: 589324 - DNA, 25 bp, Homo sapien
aggctggccttacctggtatggttt

SEQ ID NO: 589325 - DNA, 25 bp, Homo sapien
gttcatgttgatgcctggagtttca

SEQ ID NO: 589326 - DNA, 25 bp, Homo sapien
taattccctcccattcgttgctgag

SEQ ID NO: 589327 - DNA, 25 bp, Homo sapien
tcccattcgttgctgagtagcactg

SEQ ID NO: 589328 - DNA, 25 bp, Homo sapien
gctgagtagcactgcaacacatgca

SEQ ID NO: 589329 - DNA, 25 bp, Homo sapien
caacacatgcaggcagctatttggg

SEQ ID NO: 589330 - DNA, 25 bp, Homo sapien
gggatcttttcacctgttgatgggt

SEQ ID NO: 589331 - DNA, 25 bp, Homo sapien
cctgttgatgggtgtctggactgtt

SEQ ID NO: 589332 - DNA, 25 bp, Homo sapien
ttgatgggtgtctggactgtttcca

SEQ ID NO: 589333 - DNA, 25 bp, Homo sapien
tttttggctgttacaaatgaagcct

SEQ ID NO: 589334 - DNA, 25 bp, Homo sapien
tcaagccaccttcaagcttcaggga

SEQ ID NO: 589335 - DNA, 25 bp, Homo sapien
caggctgccggttctaggtggagtc

SEQ ID NO: 589336 - DNA, 25 bp, Homo sapien
ccagagtgagaacttatgatgcttt

SEQ ID NO: 589337 - DNA, 25 bp, Homo sapien
acttatgatgctttttccaggcctg

SEQ ID NO: 589338 - DNA, 25 bp, Homo sapien
atgctttttccaggcctgcccatgg

SEQ ID NO: 589339 - DNA, 25 bp, Homo sapien
tgcccatggccactcatggaccaaa

SEQ ID NO: 589340 - DNA, 25 bp, Homo sapien
ctcatggaccaaatggcacacactt

SEQ ID NO: 589341 - DNA, 25 bp, Homo sapien
ataaaaatcctggactcagccagat

SEQ ID NO: 589342 - DNA, 25 bp, Homo sapien
aatcctggactcagccagattcaca

SEQ ID NO: 589343 - DNA, 25 bp, Homo sapien
cagattcacacagacttagggacta

SEQ ID NO: 589344 - DNA, 25 bp, Homo sapien
cacagacttagggactaccagctgc

SEQ ID NO: 589345 - DNA, 25 bp, Homo sapien
tcagttctctgaaaccatggtcata

SEQ ID NO: 589346 - DNA, 25 bp, Homo sapien
tggtcatatactactccacgtgtga

SEQ ID NO: 589347 - DNA, 25 bp, Homo sapien
tactccacgtgtgaacttgcacaag

SEQ ID NO: 589348 - DNA, 25 bp, Homo sapien
ctcttaggtctacttccatgatcac

SEQ ID NO: 589349 - DNA, 25 bp, Homo sapien
tacttccatgatcaccgcagcggct

SEQ ID NO: 589350 - DNA, 25 bp, Homo sapien
cgcagcggctgacagtccatattaa

SEQ ID NO: 589351 - DNA, 25 bp, Homo sapien
caaatgcatcttcctatagtttcaa

SEQ ID NO: 589352 - DNA, 25 bp, Homo sapien
atagtttcaagcctgtctggtccgt

SEQ ID NO: 589353 - DNA, 25 bp, Homo sapien
tgaagatgtctgaatgtcctctcca

SEQ ID NO: 589354 - DNA, 25 bp, Homo sapien
gaatgtcctctccatattgtgcaag

SEQ ID NO: 589355 - DNA, 25 bp, Homo sapien
tccatattgtgcaagaggtacagcc

SEQ ID NO: 589356 - DNA, 25 bp, Homo sapien
aagcctcaggccagaaatgcagggc

SEQ ID NO: 589357 - DNA, 25 bp, Homo sapien
caggccagaaatgcagggctgtgcc

SEQ ID NO: 589358 - DNA, 25 bp, Homo sapien
tgggtaggctgctgacagcttctct

SEQ ID NO: 589359 - DNA, 25 bp, Homo sapien
taggctgctgacagcttctctgctt

SEQ ID NO: 589360 - DNA, 25 bp, Homo sapien
ttctctgctacgctgctacactgac

SEQ ID NO: 589361 - DNA, 25 bp, Homo sapien
gccacatccctgatttcatctgatt

SEQ ID NO: 589362 - DNA, 25 bp, Homo sapien
aagaagccaaacaaagcactgaagg

SEQ ID NO: 589363 - DNA, 25 bp, Homo sapien
aacaaagcactgaaggagccgcccc

SEQ ID NO: 589364 - DNA, 25 bp, Homo sapien
cagtgagttcttagcagtgttaagc

SEQ ID NO: 589365 - DNA, 25 bp, Homo sapien
gcagtgttaagctcatagtgtgtcc

SEQ ID NO: 589366 - DNA, 25 bp, Homo sapien
aagctcatagtgtgtcctagtggaa

SEQ ID NO: 589367 - DNA, 25 bp, Homo sapien
atcttctctgatgattaccaaggat

SEQ ID NO: 589368 - DNA, 25 bp, Homo sapien
ttctctgatgattaccaaggatggg

SEQ ID NO: 589369 - DNA, 25 bp, Homo sapien
ctctgatgattaccaaggatgggaa

SEQ ID NO: 589370 - DNA, 25 bp, Homo sapien
taagaattagtagttgatagcacaa

SEQ ID NO: 589371 - DNA, 25 bp, Homo sapien
ggattatttataacaaaggctgaag

SEQ ID NO: 589372 - DNA, 25 bp, Homo sapien
acaaaggctgaaggcttgaggtgat

SEQ ID NO: 589373 - DNA, 25 bp, Homo sapien
ggctgaaggcttgaggtgataaata

SEQ ID NO: 589374 - DNA, 25 bp, Homo sapien
tgaaggcttgaggtgataaataccc

SEQ ID NO: 589375 - DNA, 25 bp, Homo sapien
catacctgtatcaaaataccttgta

SEQ ID NO: 589376 - DNA, 25 bp, Homo sapien
gtatcaaaataccttgtatacccca

SEQ ID NO: 589377 - DNA, 25 bp, Homo sapien
atcaaaataccttgtataccccata

SEQ ID NO: 589378 - DNA, 25 bp, Homo sapien
ccgggatcgcacctttgcactctag

SEQ ID NO: 589379 - DNA, 25 bp, Homo sapien
aatgtgtaagcaaaaactcagttgt

SEQ ID NO: 589380 - DNA, 25 bp, Homo sapien
tgtgtaagcaaaaactcagttgtat

SEQ ID NO: 589381 - DNA, 25 bp, Homo sapien
gtaagaaaacccaattctccctgag

SEQ ID NO: 589382 - DNA, 25 bp, Homo sapien
taagaaaacccaattctccctgaga

SEQ ID NO: 589383 - DNA, 25 bp, Homo sapien
gaaaacccaattctccctgagaaag

SEQ ID NO: 589384 - DNA, 25 bp, Homo sapien
agctgaagtcctttaaaaattgact

SEQ ID NO: 589385 - DNA, 25 bp, Homo sapien
gctgaagtcctttaaaaattgactg

SEQ ID NO: 589386 - DNA, 25 bp, Homo sapien
ctgaagtcctttaaaaattgactgc

SEQ ID NO: 589387 - DNA, 25 bp, Homo sapien
aaattgactgcctgtttttctgtgg

SEQ ID NO: 589388 - DNA, 25 bp, Homo sapien
gtttttctgtggctagtgagcctta

SEQ ID NO: 589389 - DNA, 25 bp, Homo sapien
ggaaatcatgtttgtttcactgctt

SEQ ID NO: 589390 - DNA, 25 bp, Homo sapien
tcatgtttgtttcactgctttgttt

SEQ ID NO: 589391 - DNA, 25 bp, Homo sapien
ttttttagctgttgccttgtcactg

SEQ ID NO: 589392 - DNA, 25 bp, Homo sapien
ttagctgttgccttgtcactgtcac

SEQ ID NO: 589393 - DNA, 25 bp, Homo sapien
gttgccttgtcactgtcacagctaa

SEQ ID NO: 589394 - DNA, 25 bp, Homo sapien
gccttgtcactgtcacagctaacaa

SEQ ID NO: 589395 - DNA, 25 bp, Homo sapien
agctaacaagacttactacatactt

SEQ ID NO: 589396 - DNA, 25 bp, Homo sapien
gggctgtcctctgtatactgacatt

SEQ ID NO: 589397 - DNA, 25 bp, Homo sapien
gctgtcctctgtatactgacattaa

SEQ ID NO: 589398 - DNA, 25 bp, Homo sapien
gtcctctgtatactgacattaaata

SEQ ID NO: 589399 - DNA, 25 bp, Homo sapien
cattaaataaacgtgtgtgagtgaa

SEQ ID NO: 589400 - DNA, 25 bp, Homo sapien
gcttgcccacaagcatggctaattt

SEQ ID NO: 589401 - DNA, 25 bp, Homo sapien
acagaatcttgctatatggcccagg

SEQ ID NO: 589402 - DNA, 25 bp, Homo sapien
ggactcaagtaatccccccaactgg

SEQ ID NO: 589403 - DNA, 25 bp, Homo sapien
gtatgagccaccgagccaggatgtt

SEQ ID NO: 589404 - DNA, 25 bp, Homo sapien
gagccaccgagccaggatgttttat

SEQ ID NO: 589405 - DNA, 25 bp, Homo sapien
gtaggttaaaatgaccacttttgtg

SEQ ID NO: 589406 - DNA, 25 bp, Homo sapien
tgaccacttttgtgggtcaaaaagt

SEQ ID NO: 589407 - DNA, 25 bp, Homo sapien
agcaatatttggcatttggacctga

SEQ ID NO: 589408 - DNA, 25 bp, Homo sapien
tttggacctgagctcaatttgactc

SEQ ID NO: 589409 - DNA, 25 bp, Homo sapien
ggacctgagctcaatttgactcaga

SEQ ID NO: 589410 - DNA, 25 bp, Homo sapien
gagctcaatttgactcagaatatta

SEQ ID NO: 589411 - DNA, 25 bp, Homo sapien
gggaaagtacaaatacctattatgt

SEQ ID NO: 589412 - DNA, 25 bp, Homo sapien
aaagtacaaatacctattatgttgg

SEQ ID NO: 589413 - DNA, 25 bp, Homo sapien
ttgggaataagaaagacctgcatat

SEQ ID NO: 589414 - DNA, 25 bp, Homo sapien
ggaataagaaagacctgcatatgga

SEQ ID NO: 589415 - DNA, 25 bp, Homo sapien
ataagaaagacctgcatatggaaag

SEQ ID NO: 589416 - DNA, 25 bp, Homo sapien
aaagacctgcatatggaaagggtga

SEQ ID NO: 589417 - DNA, 25 bp, Homo sapien
gacctgcatatggaaagggtgatca

SEQ ID NO: 589418 - DNA, 25 bp, Homo sapien
cctgcatatggaaagggtgatcagt

SEQ ID NO: 589419 - DNA, 25 bp, Homo sapien
aagaagggaaagctttggcagaatc

SEQ ID NO: 589420 - DNA, 25 bp, Homo sapien
gaagggaaagctttggcagaatctt

SEQ ID NO: 589421 - DNA, 25 bp, Homo sapien
agggaaagctttggcagaatcttgg

SEQ ID NO: 589422 - DNA, 25 bp, Homo sapien
gttttatgggtattttaagctctct

SEQ ID NO: 589423 - DNA, 25 bp, Homo sapien
gggtattttaagctctctgacagac

SEQ ID NO: 589424 - DNA, 25 bp, Homo sapien
aagctctctgacagacaagacttct

SEQ ID NO: 589425 - DNA, 25 bp, Homo sapien
gtcattgaatctaactttgggtcag

SEQ ID NO: 589426 - DNA, 25 bp, Homo sapien
ctaactttgggtcagttaacagagt

SEQ ID NO: 589427 - DNA, 25 bp, Homo sapien
gtcttaaaagtctgttcatattcct

SEQ ID NO: 589428 - DNA, 25 bp, Homo sapien
aagtctgttcatattcctgaaatag

SEQ ID NO: 589429 - DNA, 25 bp, Homo sapien
ttttgttgactccttagggactaag

SEQ ID NO: 589430 - DNA, 25 bp, Homo sapien
gtagctaattcatcattgtcttgtc

SEQ ID NO: 589431 - DNA, 25 bp, Homo sapien
atcattgtcttgtctccaaatcctg

SEQ ID NO: 589432 - DNA, 25 bp, Homo sapien
ttgtctccaaatcctggcacacagt

SEQ ID NO: 589433 - DNA, 25 bp, Homo sapien
caggtacaattggccatgatgccct

SEQ ID NO: 589434 - DNA, 25 bp, Homo sapien
ggtacaattggccatgatgccctct

SEQ ID NO: 589435 - DNA, 25 bp, Homo sapien
gtacaattggccatgatgccctctg

SEQ ID NO: 589436 - DNA, 25 bp, Homo sapien
tacaattggccatgatgccctctgc

SEQ ID NO: 589437 - DNA, 25 bp, Homo sapien
acaattggccatgatgccctctgca

SEQ ID NO: 589438 - DNA, 25 bp, Homo sapien
caattggccatgatgccctctgcat

SEQ ID NO: 589439 - DNA, 25 bp, Homo sapien
aattggccatgatgccctctgcatg

SEQ ID NO: 589440 - DNA, 25 bp, Homo sapien
attggccatgatgccctctgcatgg

SEQ ID NO: 589441 - DNA, 25 bp, Homo sapien
ttggccatgatgccctctgcatggt

SEQ ID NO: 589442 - DNA, 25 bp, Homo sapien
tggccatgatgccctctgcatggtc

SEQ ID NO: 589443 - DNA, 25 bp, Homo sapien
ggccatgatgccctctgcatggtca

SEQ ID NO: 589444 - DNA, 25 bp, Homo sapien
gcaggcatcactgaagctacttgat

SEQ ID NO: 589445 - DNA, 25 bp, Homo sapien
tttgatatctactatccactctcca

SEQ ID NO: 589446 - DNA, 25 bp, Homo sapien
cactctccaaactgggtatgttcaa

SEQ ID NO: 589447 - DNA, 25 bp, Homo sapien
gggtatgttcaaattccacattatt

SEQ ID NO: 589448 - DNA, 25 bp, Homo sapien
aattccacattattgtcttcatttt

SEQ ID NO: 589449 - DNA, 25 bp, Homo sapien
gtcttcatttttgctcataaaactt

SEQ ID NO: 589450 - DNA, 25 bp, Homo sapien
cctctttctctttctatgtgattta

SEQ ID NO: 589451 - DNA, 25 bp, Homo sapien
gatttaaatgagcactgaggaattc

SEQ ID NO: 589452 - DNA, 25 bp, Homo sapien
gaggaattcagttagctcaggaaaa

SEQ ID NO: 589453 - DNA, 25 bp, Homo sapien
aaataatttgttcctcagagatgat

SEQ ID NO: 589454 - DNA, 25 bp, Homo sapien
cagagatgattcttgagtgtagaaa

SEQ ID NO: 589455 - DNA, 25 bp, Homo sapien
agctctgccatttaccaactttgac

SEQ ID NO: 589456 - DNA, 25 bp, Homo sapien
gctctgccatttaccaactttgaca

SEQ ID NO: 589457 - DNA, 25 bp, Homo sapien
tctgccatttaccaactttgacact

SEQ ID NO: 589458 - DNA, 25 bp, Homo sapien
ctgccatttaccaactttgacactt

SEQ ID NO: 589459 - DNA, 25 bp, Homo sapien
gccatttaccaactttgacactttg

SEQ ID NO: 589460 - DNA, 25 bp, Homo sapien
ttaccaactttgacactttggacaa

SEQ ID NO: 589461 - DNA, 25 bp, Homo sapien
aactttgacactttggacaacgtct

SEQ ID NO: 589462 - DNA, 25 bp, Homo sapien
tttgacactttggacaacgtctcat

SEQ ID NO: 589463 - DNA, 25 bp, Homo sapien
gacactttggacaacgtctcattct

SEQ ID NO: 589464 - DNA, 25 bp, Homo sapien
cactttggacaacgtctcattctgt

SEQ ID NO: 589465 - DNA, 25 bp, Homo sapien
ctttggacaacgtctcattctgtca

SEQ ID NO: 589466 - DNA, 25 bp, Homo sapien
ctaccctaaataatcaatcggcctt

SEQ ID NO: 589467 - DNA, 25 bp, Homo sapien
atcaatcggccttgtgatatcctgc

SEQ ID NO: 589468 - DNA, 25 bp, Homo sapien
aatcggccttgtgatatcctgccat

SEQ ID NO: 589469 - DNA, 25 bp, Homo sapien
cggccttgtgatatcctgccatgtg

SEQ ID NO: 589470 - DNA, 25 bp, Homo sapien
tatcctgccatgtgaactccctcca

SEQ ID NO: 589471 - DNA, 25 bp, Homo sapien
tgcccgaaaagactgccccaactgt

SEQ ID NO: 589472 - DNA, 25 bp, Homo sapien
agcccgctcgcaccggagtgaataa

SEQ ID NO: 589473 - DNA, 25 bp, Homo sapien
ccgctcgcaccggagtgaataaaca

SEQ ID NO: 589474 - DNA, 25 bp, Homo sapien
aaatggcctcgttggcatcagcggt

SEQ ID NO: 589475 - DNA, 25 bp, Homo sapien
tcgttggcatcagcggtggagattt

SEQ ID NO: 589476 - DNA, 25 bp, Homo sapien
atcagcggtggagatttgcgccaag

SEQ ID NO: 589477 - DNA, 25 bp, Homo sapien
gggacattctgcaacccaaaacagt

SEQ ID NO: 589478 - DNA, 25 bp, Homo sapien
gcaacccaaaacagtcagaaccctt

SEQ ID NO: 589479 - DNA, 25 bp, Homo sapien
aaatcctctggctaagtacccacct

SEQ ID NO: 589480 - DNA, 25 bp, Homo sapien
taagtacccacctatcatcaagctg

SEQ ID NO: 589481 - DNA, 25 bp, Homo sapien
tacccacctatcatcaagctgctgt

SEQ ID NO: 589482 - DNA, 25 bp, Homo sapien
gctgttgttggctctgaagtggtaa

SEQ ID NO: 589483 - DNA, 25 bp, Homo sapien
gagataaatctccaatttccagatg

SEQ ID NO: 589484 - DNA, 25 bp, Homo sapien
agcttatttgattttcttgcatcta

SEQ ID NO: 589485 - DNA, 25 bp, Homo sapien
agtattcagtgatcttgtgtgccaa

SEQ ID NO: 589486 - DNA, 25 bp, Homo sapien
gtgccaagcactatctgaagtacct

SEQ ID NO: 589487 - DNA, 25 bp, Homo sapien
gcactatctgaagtaccttacatac

SEQ ID NO: 589488 - DNA, 25 bp, Homo sapien
aaacgagatgttcctgcccagtaaa

SEQ ID NO: 589489 - DNA, 25 bp, Homo sapien
gcccagtaaaacttcgccacgtgga

SEQ ID NO: 589490 - DNA, 25 bp, Homo sapien
taaacggccccaccgtcaagatttg

SEQ ID NO: 589491 - DNA, 25 bp, Homo sapien
gtcaagatttgtgcggtagatgcaa

SEQ ID NO: 589492 - DNA, 25 bp, Homo sapien
aaaggcaaacgcctgtcctgtgaca

SEQ ID NO: 589493 - DNA, 25 bp, Homo sapien
ctgtgacagcactttcagcttcaaa

SEQ ID NO: 589494 - DNA, 25 bp, Homo sapien
tcagtgttgctgtgcatgcgctgat

SEQ ID NO: 589495 - DNA, 25 bp, Homo sapien
ctgtgcatgcgctgatggagtagac

SEQ ID NO: 589496 - DNA, 25 bp, Homo sapien
tagacgagtgagcttttccgtgcct

SEQ ID NO: 589497 - DNA, 25 bp, Homo sapien
ctcccttctcaaaatacttcatgaa

SEQ ID NO: 589498 - DNA, 25 bp, Homo sapien
aatacttcatgaaaggcagtgtgtt

SEQ ID NO: 589499 - DNA, 25 bp, Homo sapien
ctctgacatcagattgtgggcacta

SEQ ID NO: 589500 - DNA, 25 bp, Homo sapien
agattgtgggcactagatcccgctt

SEQ ID NO: 589501 - DNA, 25 bp, Homo sapien
tgtgggcactagatcccgcttggtg

SEQ ID NO: 589502 - DNA, 25 bp, Homo sapien
ggtgaaccgggtgcgtcagaaccca

SEQ ID NO: 589503 - DNA, 25 bp, Homo sapien
accgggtgcgtcagaacccagggat

SEQ ID NO: 589504 - DNA, 25 bp, Homo sapien
ggtgcgtcagaacccagggattaaa

SEQ ID NO: 589505 - DNA, 25 bp, Homo sapien
gaacccagggattaaatagctttcg

SEQ ID NO: 589506 - DNA, 25 bp, Homo sapien
aatagctttcgaaatccatcggctt

SEQ ID NO: 589507 - DNA, 25 bp, Homo sapien
agctttcgaaatccatcggcttgtc

SEQ ID NO: 589508 - DNA, 25 bp, Homo sapien
ttcgaaatccatcggcttgtccttg

SEQ ID NO: 589509 - DNA, 25 bp, Homo sapien
aatccatcggcttgtccttgaccag

SEQ ID NO: 589510 - DNA, 25 bp, Homo sapien
agcaacggaaccacctctgagactg

SEQ ID NO: 589511 - DNA, 25 bp, Homo sapien
acggaaccacctctgagactgaaga

SEQ ID NO: 589512 - DNA, 25 bp, Homo sapien
gaaataataagtgggagtccttgga

SEQ ID NO: 589513 - DNA, 25 bp, Homo sapien
gagtccttggaccacatcctaacct

SEQ ID NO: 589514 - DNA, 25 bp, Homo sapien
atcctaacctgagacaatgccgagc

SEQ ID NO: 589515 - DNA, 25 bp, Homo sapien
gagacaatgccgagcctgagacaaa

SEQ ID NO: 589516 - DNA, 25 bp, Homo sapien
tgccgagcctgagacaaacccgtga

SEQ ID NO: 589517 - DNA, 25 bp, Homo sapien
gagacaaacccgtgactcagacttg

SEQ ID NO: 589518 - DNA, 25 bp, Homo sapien
tcagacttgccaccgggtctaatta

SEQ ID NO: 589519 - DNA, 25 bp, Homo sapien
gccaccgggtctaattagccctatt

SEQ ID NO: 589520 - DNA, 25 bp, Homo sapien
gaaaccctatggtgtttgtacattt

SEQ ID NO: 589521 - DNA, 25 bp, Homo sapien
ggaggtcctgatgggagaacccatc

SEQ ID NO: 589522 - DNA, 25 bp, Homo sapien
aggtcctgatgggagaacccatcaa

SEQ ID NO: 589523 - DNA, 25 bp, Homo sapien
gactggatgctgctatggtaatctg

SEQ ID NO: 589524 - DNA, 25 bp, Homo sapien
actggatgctgctatggtaatctgc

SEQ ID NO: 589525 - DNA, 25 bp, Homo sapien
ctggatgctgctatggtaatctgcc

SEQ ID NO: 589526 - DNA, 25 bp, Homo sapien
tggatgctgctatggtaatctgcct

SEQ ID NO: 589527 - DNA, 25 bp, Homo sapien
ggatgctgctatggtaatctgcctc

SEQ ID NO: 589528 - DNA, 25 bp, Homo sapien
gatgctgctatggtaatctgcctca

SEQ ID NO: 589529 - DNA, 25 bp, Homo sapien
atgctgctatggtaatctgcctcag

SEQ ID NO: 589530 - DNA, 25 bp, Homo sapien
tgctgctatggtaatctgcctcagg

SEQ ID NO: 589531 - DNA, 25 bp, Homo sapien
gctgctatggtaatctgcctcagga

SEQ ID NO: 589532 - DNA, 25 bp, Homo sapien
ttctcggctgcactaaagctggcac

SEQ ID NO: 589533 - DNA, 25 bp, Homo sapien
tcggctgcactaaagctggcactcc

SEQ ID NO: 589534 - DNA, 25 bp, Homo sapien
ccagccgttctcatgcaaaatacct

SEQ ID NO: 589535 - DNA, 25 bp, Homo sapien
gccgttctcatgcaaaatacctgtg

SEQ ID NO: 589536 - DNA, 25 bp, Homo sapien
gttctcatgcaaaatacctgtgtca

SEQ ID NO: 589537 - DNA, 25 bp, Homo sapien
tacctgtgtcagaatactcctttca

SEQ ID NO: 589538 - DNA, 25 bp, Homo sapien
tgtgtcagaatactcctttcatcca

SEQ ID NO: 589539 - DNA, 25 bp, Homo sapien
tttttataggcccatatgctctatc

SEQ ID NO: 589540 - DNA, 25 bp, Homo sapien
tataggcccatatgctctatctcaa

SEQ ID NO: 589541 - DNA, 25 bp, Homo sapien
ggcccatatgctctatctcaagaaa

SEQ ID NO: 589542 - DNA, 25 bp, Homo sapien
atatgctctatctcaagaaacaaga

SEQ ID NO: 589543 - DNA, 25 bp, Homo sapien
aaattaacagagaaccattcgaaat

SEQ ID NO: 589544 - DNA, 25 bp, Homo sapien
gaaccattcgaaattaagacatcaa

SEQ ID NO: 589545 - DNA, 25 bp, Homo sapien
aatgcagtatttattaactacctac

SEQ ID NO: 589546 - DNA, 25 bp, Homo sapien
ttaactacctactatatactaggat

SEQ ID NO: 589547 - DNA, 25 bp, Homo sapien
tatactaggattacattaagcactg

SEQ ID NO: 589548 - DNA, 25 bp, Homo sapien
attacattaagcactgaggatctaa

SEQ ID NO: 589549 - DNA, 25 bp, Homo sapien
taagcactgaggatctaaaattaat

SEQ ID NO: 589550 - DNA, 25 bp, Homo sapien
aatagactgaggttagggactctga

SEQ ID NO: 589551 - DNA, 25 bp, Homo sapien
gggactctgagggagacaacacaaa

SEQ ID NO: 589552 - DNA, 25 bp, Homo sapien
ctctgagggagacaacacaaacatt

SEQ ID NO: 589553 - DNA, 25 bp, Homo sapien
taaaacgttacaggaacagctacag

SEQ ID NO: 589554 - DNA, 25 bp, Homo sapien
aatatgtttatgtaaatgcgctaaa

SEQ ID NO: 589555 - DNA, 25 bp, Homo sapien
agttctttaagaatatatgccaaaa

SEQ ID NO: 589556 - DNA, 25 bp, Homo sapien
aaatattgacaatggttatcccctg

SEQ ID NO: 589557 - DNA, 25 bp, Homo sapien
atattgacaatggttatcccctgag

SEQ ID NO: 589558 - DNA, 25 bp, Homo sapien
ttgacaatggttatcccctgagtga

SEQ ID NO: 589559 - DNA, 25 bp, Homo sapien
gacaatggttatcccctgagtgatt

SEQ ID NO: 589560 - DNA, 25 bp, Homo sapien
aatggttatcccctgagtgattttt

SEQ ID NO: 589561 - DNA, 25 bp, Homo sapien
ggttatcccctgagtgatttttatt

SEQ ID NO: 589562 - DNA, 25 bp, Homo sapien
catccttaggattttctgtattttc

SEQ ID NO: 589563 - DNA, 25 bp, Homo sapien
gtttcacattttgaacatgtatact

SEQ ID NO: 589564 - DNA, 25 bp, Homo sapien
tgaacatgtatacttttacaagaaa

SEQ ID NO: 589565 - DNA, 25 bp, Homo sapien
gcacctggccagttattcatatttt

SEQ ID NO: 589566 - DNA, 25 bp, Homo sapien
ttgtttttagaatccattttcatca

SEQ ID NO: 589567 - DNA, 25 bp, Homo sapien
tgtgacatagttgttaagagcccaa

SEQ ID NO: 589568 - DNA, 25 bp, Homo sapien
taagagcccaacttctggagccaaa

SEQ ID NO: 589569 - DNA, 25 bp, Homo sapien
ctggagccaaaccacctggactcaa

SEQ ID NO: 589570 - DNA, 25 bp, Homo sapien
tggactcaaatctcagctgtataat

SEQ ID NO: 589571 - DNA, 25 bp, Homo sapien
ttatgcataccttagatgagttatt

SEQ ID NO: 589572 - DNA, 25 bp, Homo sapien
gagttatttagcttctaatccttga

SEQ ID NO: 589573 - DNA, 25 bp, Homo sapien
gaacacagtaacagaacctaccatg

SEQ ID NO: 589574 - DNA, 25 bp, Homo sapien
taccatgtagggttcttgtaagcct

SEQ ID NO: 589575 - DNA, 25 bp, Homo sapien
ttgtaagcctgagctattacatgta

SEQ ID NO: 589576 - DNA, 25 bp, Homo sapien
tgccctttgcagcaaggtcacccag

SEQ ID NO: 589577 - DNA, 25 bp, Homo sapien
acccagctgcctgataaggagtcca

SEQ ID NO: 589578 - DNA, 25 bp, Homo sapien
cccagctgcctgataaggagtccag

SEQ ID NO: 589579 - DNA, 25 bp, Homo sapien
ccagggacgggcagcaagcgggact

SEQ ID NO: 589580 - DNA, 25 bp, Homo sapien
aaagcgccgggcacgccgcgtggca

SEQ ID NO: 589581 - DNA, 25 bp, Homo sapien
cttcctggctgggtatgaacaccag

SEQ ID NO: 589582 - DNA, 25 bp, Homo sapien
gggtatgaacaccagccgcgcccgc

SEQ ID NO: 589583 - DNA, 25 bp, Homo sapien
ggcttcctctcgttcaggtcgcctg

SEQ ID NO: 589584 - DNA, 25 bp, Homo sapien
ttcctctcgttcaggtcgcctggcg

SEQ ID NO: 589585 - DNA, 25 bp, Homo sapien
gttcaggtcgcctggcgcggccgtg

SEQ ID NO: 589586 - DNA, 25 bp, Homo sapien
tacggcagcggcacaccgggacctt

SEQ ID NO: 589587 - DNA, 25 bp, Homo sapien
gatttgtgtgcattaaagccagact

SEQ ID NO: 589588 - DNA, 25 bp, Homo sapien
atttgtgtgcattaaagccagactg

SEQ ID NO: 589589 - DNA, 25 bp, Homo sapien
tttgtgtgcattaaagccagactgg

SEQ ID NO: 589590 - DNA, 25 bp, Homo sapien
ttgtgtgcattaaagccagactggg

SEQ ID NO: 589591 - DNA, 25 bp, Homo sapien
tgtgtgcattaaagccagactgggc

SEQ ID NO: 589592 - DNA, 25 bp, Homo sapien
gtgtgcattaaagccagactgggca

SEQ ID NO: 589593 - DNA, 25 bp, Homo sapien
tgcattaaagccagactgggcaggg

SEQ ID NO: 589594 - DNA, 25 bp, Homo sapien
gcattaaagccagactgggcagggc

SEQ ID NO: 589595 - DNA, 25 bp, Homo sapien
cattaaagccagactgggcagggca

SEQ ID NO: 589596 - DNA, 25 bp, Homo sapien
attaaagccagactgggcagggcac

SEQ ID NO: 589597 - DNA, 25 bp, Homo sapien
ttaaagccagactgggcagggcaca

SEQ ID NO: 589598 - DNA, 25 bp, Homo sapien
gggacccactggaatgcaacatctg

SEQ ID NO: 589599 - DNA, 25 bp, Homo sapien
tggaatgcaacatctgtggctacag

SEQ ID NO: 589600 - DNA, 25 bp, Homo sapien
gtggctacagaagccaggaccgtta

SEQ ID NO: 589601 - DNA, 25 bp, Homo sapien
agccaggaccgttatgagttttcat

SEQ ID NO: 589602 - DNA, 25 bp, Homo sapien
gagttttcatcacacattgttcgag

SEQ ID NO: 589603 - DNA, 25 bp, Homo sapien
gggagcacacattccactaggcctt

SEQ ID NO: 589604 - DNA, 25 bp, Homo sapien
ttccactaggccttttcattccaaa

SEQ ID NO: 589605 - DNA, 25 bp, Homo sapien
gggacccctatgaagtaaagaactg

SEQ ID NO: 589606 - DNA, 25 bp, Homo sapien
aatcccacctttcctcaaatgttga

SEQ ID NO: 589607 - DNA, 25 bp, Homo sapien
cttattttgtggaggcagtgtcatt

SEQ ID NO: 589608 - DNA, 25 bp, Homo sapien
gtcatttgctctgcctaattacgat

SEQ ID NO: 589609 - DNA, 25 bp, Homo sapien
tatggcttagccatgtggttcgttg

SEQ ID NO: 589610 - DNA, 25 bp, Homo sapien
atggcttagccatgtggttcgttgt

SEQ ID NO: 589611 - DNA, 25 bp, Homo sapien
tggcttagccatgtggttcgttgtc

SEQ ID NO: 589612 - DNA, 25 bp, Homo sapien
gcttagccatgtggttcgttgtcca

SEQ ID NO: 589613 - DNA, 25 bp, Homo sapien
ttagccatgtggttcgttgtccaca

SEQ ID NO: 589614 - DNA, 25 bp, Homo sapien
tagccatgtggttcgttgtccacat

SEQ ID NO: 589615 - DNA, 25 bp, Homo sapien
agccatgtggttcgttgtccacatc

SEQ ID NO: 589616 - DNA, 25 bp, Homo sapien
atgtggttcgttgtccacatccaca

SEQ ID NO: 589617 - DNA, 25 bp, Homo sapien
gtggttcgttgtccacatccacatg

SEQ ID NO: 589618 - DNA, 25 bp, Homo sapien
ggttcgttgtccacatccacatgta

SEQ ID NO: 589619 - DNA, 25 bp, Homo sapien
gttcgttgtccacatccacatgtac

SEQ ID NO: 589620 - DNA, 25 bp, Homo sapien
cagggctgagaatatcatgtggttc

SEQ ID NO: 589621 - DNA, 25 bp, Homo sapien
aatatcatgtggttcagtcttctga

SEQ ID NO: 589622 - DNA, 25 bp, Homo sapien
gtggttcagtcttctgaaggaagtt

SEQ ID NO: 589623 - DNA, 25 bp, Homo sapien
aagcatagtgcctttgaacatgaag

SEQ ID NO: 589624 - DNA, 25 bp, Homo sapien
acatgaagactatcctcaaggccag

SEQ ID NO: 589625 - DNA, 25 bp, Homo sapien
tatcctcaaggccagaaatcctaca

SEQ ID NO: 589626 - DNA, 25 bp, Homo sapien
gattccagagaattgctctcctcat

SEQ ID NO: 589627 - DNA, 25 bp, Homo sapien
ctgttttaagtcacttcattgaaga

SEQ ID NO: 589628 - DNA, 25 bp, Homo sapien
tatgccactgaataaagctacttaa

SEQ ID NO: 589629 - DNA, 25 bp, Homo sapien
gggatattaatcctaggctacataa

SEQ ID NO: 589630 - DNA, 25 bp, Homo sapien
ggctacataattaataggtcatcaa

SEQ ID NO: 589631 - DNA, 25 bp, Homo sapien
gtaggttaaaatgaccacttttgtg

SEQ ID NO: 589632 - DNA, 25 bp, Homo sapien
taggttaaaatgaccacttttgtgg

SEQ ID NO: 589633 - DNA, 25 bp, Homo sapien
taaaatgaccacttttgtgggtcaa

SEQ ID NO: 589634 - DNA, 25 bp, Homo sapien
tgaccacttttgtgggtcaaaaagt

SEQ ID NO: 589635 - DNA, 25 bp, Homo sapien
gtgggtcaaaaagtggatgaatatc

SEQ ID NO: 589636 - DNA, 25 bp, Homo sapien
tttggacctgagctcaatttgactc

SEQ ID NO: 589637 - DNA, 25 bp, Homo sapien
ttggacctgagctcaatttgactca

SEQ ID NO: 589638 - DNA, 25 bp, Homo sapien
ggacctgagctcaatttgactcaga

SEQ ID NO: 589639 - DNA, 25 bp, Homo sapien
gacctgagctcaatttgactcagaa

SEQ ID NO: 589640 - DNA, 25 bp, Homo sapien
gagctcaatttgactcagaatatta

SEQ ID NO: 589641 - DNA, 25 bp, Homo sapien
gctcaatttgactcagaatattaaa

SEQ ID NO: 589642 - DNA, 25 bp, Homo sapien
ataaccagtaatgaccatggtgaag

SEQ ID NO: 589643 - DNA, 25 bp, Homo sapien
ccagtaatgaccatggtgaagataa

SEQ ID NO: 589644 - DNA, 25 bp, Homo sapien
aaagatattcatgaacagaacagta

SEQ ID NO: 589645 - DNA, 25 bp, Homo sapien
ggagggaaccggtaacatgattgat

SEQ ID NO: 589646 - DNA, 25 bp, Homo sapien
gatggcagcattttggccagctatg

SEQ ID NO: 589647 - DNA, 25 bp, Homo sapien
cagcattttggccagctatgggaac

SEQ ID NO: 589648 - DNA, 25 bp, Homo sapien
cattttggccagctatgggaacgtc

SEQ ID NO: 589649 - DNA, 25 bp, Homo sapien
tttggccagctatgggaacgtcatc

SEQ ID NO: 589650 - DNA, 25 bp, Homo sapien
gccagctatgggaacgtcatcgtta

SEQ ID NO: 589651 - DNA, 25 bp, Homo sapien
gctatgggaacgtcatcgttatcac

SEQ ID NO: 589652 - DNA, 25 bp, Homo sapien
tgggaacgtcatcgttatcaccatt

SEQ ID NO: 589653 - DNA, 25 bp, Homo sapien
cagggtctatcctcagagttcgaca

SEQ ID NO: 589654 - DNA, 25 bp, Homo sapien
gggtctatcctcagagttcgacagt

SEQ ID NO: 589655 - DNA, 25 bp, Homo sapien
gtctatcctcagagttcgacagtga

SEQ ID NO: 589656 - DNA, 25 bp, Homo sapien
ctatcctcagagttcgacagtgacg

SEQ ID NO: 589657 - DNA, 25 bp, Homo sapien
atcctcagagttcgacagtgacgac

SEQ ID NO: 589658 - DNA, 25 bp, Homo sapien
cctcagagttcgacagtgacgactg

SEQ ID NO: 589659 - DNA, 25 bp, Homo sapien
cagagttcgacagtgacgactgaag

SEQ ID NO: 589660 - DNA, 25 bp, Homo sapien
aagatctggcataggggtactggtc

SEQ ID NO: 589661 - DNA, 25 bp, Homo sapien
gggtactggtctctaataaacatca

SEQ ID NO: 589662 - DNA, 25 bp, Homo sapien
tggtctctaataaacatcagctgct

SEQ ID NO: 589663 - DNA, 25 bp, Homo sapien
gtctctaataaacatcagctgctgc

SEQ ID NO: 589664 - DNA, 25 bp, Homo sapien
accagcctgatgaaaccccatgtct

SEQ ID NO: 589665 - DNA, 25 bp, Homo sapien
caggcatggtagtgagcccctgtaa

SEQ ID NO: 589666 - DNA, 25 bp, Homo sapien
gcatggtagtgagcccctgtaattc

SEQ ID NO: 589667 - DNA, 25 bp, Homo sapien
catggtagtgagcccctgtaattcc

SEQ ID NO: 589668 - DNA, 25 bp, Homo sapien
atggtagtgagcccctgtaattcca

SEQ ID NO: 589669 - DNA, 25 bp, Homo sapien
tggtagtgagcccctgtaattccag

SEQ ID NO: 589670 - DNA, 25 bp, Homo sapien
tccagcctggataacgaggaaaact

SEQ ID NO: 589671 - DNA, 25 bp, Homo sapien
ccagcctggataacgaggaaaactc

SEQ ID NO: 589672 - DNA, 25 bp, Homo sapien
gcctggataacgaggaaaactctgt

SEQ ID NO: 589673 - DNA, 25 bp, Homo sapien
cctggataacgaggaaaactctgtc

SEQ ID NO: 589674 - DNA, 25 bp, Homo sapien
tggataacgaggaaaactctgtctc

SEQ ID NO: 589675 - DNA, 25 bp, Homo sapien
ctggcagggacgttgctcaggaccc

SEQ ID NO: 589676 - DNA, 25 bp, Homo sapien
ggcagggacgttgctcaggacccct

SEQ ID NO: 589677 - DNA, 25 bp, Homo sapien
tgcactgccaaatggcctgggcaat

SEQ ID NO: 589678 - DNA, 25 bp, Homo sapien
gccaaatggcctgggcaatacgggc

SEQ ID NO: 589679 - DNA, 25 bp, Homo sapien
aatggcctgggcaatacgggcccac

SEQ ID NO: 589680 - DNA, 25 bp, Homo sapien
caatacgggcccacgtgggcgtcgt

SEQ ID NO: 589681 - DNA, 25 bp, Homo sapien
agcagtgtcttgcccacactcagtt

SEQ ID NO: 589682 - DNA, 25 bp, Homo sapien
agaaggaagcagcacagggagaccc

SEQ ID NO: 589683 - DNA, 25 bp, Homo sapien
cacagggagacccgctttgtgatct

SEQ ID NO: 589684 - DNA, 25 bp, Homo sapien
gatctgcatgtgtgacactgattct

SEQ ID NO: 589685 - DNA, 25 bp, Homo sapien
ctgcatgtgtgacactgattctttg

SEQ ID NO: 589686 - DNA, 25 bp, Homo sapien
atgttaactatagccaccatgatgt

SEQ ID NO: 589687 - DNA, 25 bp, Homo sapien
actatagccaccatgatgtattgaa

SEQ ID NO: 589688 - DNA, 25 bp, Homo sapien
gccaccatgatgtattgaagaccag

SEQ ID NO: 589689 - DNA, 25 bp, Homo sapien
ccatgatgtattgaagaccaggtct

SEQ ID NO: 589690 - DNA, 25 bp, Homo sapien
tattgaagaccaggtcttattcttt

SEQ ID NO: 589691 - DNA, 25 bp, Homo sapien
ttattctttttatctaactgtacat

SEQ ID NO: 589692 - DNA, 25 bp, Homo sapien
tttttatctaactgtacatttgtac

SEQ ID NO: 589693 - DNA, 25 bp, Homo sapien
gtacccattaacctaatgctcatag

SEQ ID NO: 589694 - DNA, 25 bp, Homo sapien
atgctcatagcatcaagaaaagatc

SEQ ID NO: 589695 - DNA, 25 bp, Homo sapien
atcccaattatgctgatttgattat

SEQ ID NO: 589696 - DNA, 25 bp, Homo sapien
gtactcccaaaatatgcacatctaa

SEQ ID NO: 589697 - DNA, 25 bp, Homo sapien
atggtagttatacatgtcggaatgg

SEQ ID NO: 589698 - DNA, 25 bp, Homo sapien
gaactatggaatttatcttactttg

SEQ ID NO: 589699 - DNA, 25 bp, Homo sapien
ggaatttatcttactttgaagctta

SEQ ID NO: 589700 - DNA, 25 bp, Homo sapien
aatattccttgtatttagccacatg

SEQ ID NO: 589701 - DNA, 25 bp, Homo sapien
tttagccacatgtatttttaaggtg

SEQ ID NO: 589702 - DNA, 25 bp, Homo sapien
ggaatattctcatagtccatacttt

SEQ ID NO: 589703 - DNA, 25 bp, Homo sapien
gttgatgtttgatgaaccagataat

SEQ ID NO: 589704 - DNA, 25 bp, Homo sapien
gaaccagataatgtctactcacttt

SEQ ID NO: 589705 - DNA, 25 bp, Homo sapien
gtgaattatgtgagccaaccctgga

SEQ ID NO: 589706 - DNA, 25 bp, Homo sapien
gtgagccaaccctggaaagtatttc

SEQ ID NO: 589707 - DNA, 25 bp, Homo sapien
gaaagtatttccgtattgagttttg

SEQ ID NO: 589708 - DNA, 25 bp, Homo sapien
gattcggacttaaagccaccgctaa

SEQ ID NO: 589709 - DNA, 25 bp, Homo sapien
aagccaccgctaaaatcaattggaa

SEQ ID NO: 589710 - DNA, 25 bp, Homo sapien
ggaagcaatttctaacatcatttca

SEQ ID NO: 589711 - DNA, 25 bp, Homo sapien
taacatcatttcatgagcctcaggg

SEQ ID NO: 589712 - DNA, 25 bp, Homo sapien
tgcaagttagcagtaaaggtcccct

SEQ ID NO: 589713 - DNA, 25 bp, Homo sapien
ggtcccctgacaaaaagaaatagca

SEQ ID NO: 589714 - DNA, 25 bp, Homo sapien
gcatcaactctagaaatgaatctca

SEQ ID NO: 589715 - DNA, 25 bp, Homo sapien
agacacactgaagatcactctgcgt

SEQ ID NO: 589716 - DNA, 25 bp, Homo sapien
gatcactctgcgtcactgaagaaag

SEQ ID NO: 589717 - DNA, 25 bp, Homo sapien
gattttgaaagccttctcttgtgaa

SEQ ID NO: 589718 - DNA, 25 bp, Homo sapien
gccttctcttgtgaaacactcattg

SEQ ID NO: 589719 - DNA, 25 bp, Homo sapien
cagtaggatggcttgacgtctcatt

SEQ ID NO: 589720 - DNA, 25 bp, Homo sapien
taggatggcttgacgtctcatttgc

SEQ ID NO: 589721 - DNA, 25 bp, Homo sapien
atggcttgacgtctcatttgcttga

SEQ ID NO: 589722 - DNA, 25 bp, Homo sapien
tgacgtctcatttgcttgatgacac

SEQ ID NO: 589723 - DNA, 25 bp, Homo sapien
tcatttgcttgatgacacttgccaa

SEQ ID NO: 589724 - DNA, 25 bp, Homo sapien
gacacttgccaagccagagaactgt

SEQ ID NO: 589725 - DNA, 25 bp, Homo sapien
atgactaaggagatgcagggcttca

SEQ ID NO: 589726 - DNA, 25 bp, Homo sapien
agatgcagggcttcatatgttgaga

SEQ ID NO: 589727 - DNA, 25 bp, Homo sapien
gcagggcttcatatgttgagaaaat

SEQ ID NO: 589728 - DNA, 25 bp, Homo sapien
gaaaatattttcgtgcattatgtca

SEQ ID NO: 589729 - DNA, 25 bp, Homo sapien
tttcgtgcattatgtcattgaattc

SEQ ID NO: 589730 - DNA, 25 bp, Homo sapien
cagtttttaaagcaccttaacaatg

SEQ ID NO: 589731 - DNA, 25 bp, Homo sapien
atgaacacgcattggatgaccgaag

SEQ ID NO: 589732 - DNA, 25 bp, Homo sapien
attggatgaccgaagcactgctcag

SEQ ID NO: 589733 - DNA, 25 bp, Homo sapien
gatgaccgaagcactgctcagtgtc

SEQ ID NO: 589734 - DNA, 25 bp, Homo sapien
gaagcactgctcagtgtcgagtgca

SEQ ID NO: 589735 - DNA, 25 bp, Homo sapien
ctgctcagtgtcgagtgcaaatgca

SEQ ID NO: 589736 - DNA, 25 bp, Homo sapien
tgcaaatgcaggtggtgcaacagtt

SEQ ID NO: 589737 - DNA, 25 bp, Homo sapien
ggtgcaacagttagaaatacagctt

SEQ ID NO: 589738 - DNA, 25 bp, Homo sapien
gaaatacagctttctaaagaacgcg

SEQ ID NO: 589739 - DNA, 25 bp, Homo sapien
tctaaagaacgcgaacgtcttcaag

SEQ ID NO: 589740 - DNA, 25 bp, Homo sapien
caatgatgacccacttgcacatgcg

SEQ ID NO: 589741 - DNA, 25 bp, Homo sapien
agataaacacatagaggccagctta

SEQ ID NO: 589742 - DNA, 25 bp, Homo sapien
cagcttaaaatatatggcccagata

SEQ ID NO: 589743 - DNA, 25 bp, Homo sapien
atggcccagatacatctaacagcag

SEQ ID NO: 589744 - DNA, 25 bp, Homo sapien
gttgtgtaacaaacgtttggactgt

SEQ ID NO: 589745 - DNA, 25 bp, Homo sapien
caaacgtttggactgtgcttaatag

SEQ ID NO: 589746 - DNA, 25 bp, Homo sapien
ttggactgtgcttaatagactaggg

SEQ ID NO: 589747 - DNA, 25 bp, Homo sapien
gggttttcaatttcttcagcagacc

SEQ ID NO: 589748 - DNA, 25 bp, Homo sapien
tcaatttcttcagcagaccctacag

SEQ ID NO: 589749 - DNA, 25 bp, Homo sapien
agaaagatttgcatcttctaccact

SEQ ID NO: 589750 - DNA, 25 bp, Homo sapien
tgctaaatagcagtgacgcctctga

SEQ ID NO: 589751 - DNA, 25 bp, Homo sapien
aaatagcagtgacgcctctgagata

SEQ ID NO: 589752 - DNA, 25 bp, Homo sapien
gaatgggtttaggttgacacttagc

SEQ ID NO: 589753 - DNA, 25 bp, Homo sapien
taggttgacacttagcagctgccac

SEQ ID NO: 589754 - DNA, 25 bp, Homo sapien
gacacttagcagctgccactatatg

SEQ ID NO: 589755 - DNA, 25 bp, Homo sapien
agctgccactatatgtggctatagt

SEQ ID NO: 589756 - DNA, 25 bp, Homo sapien
gtggctatagtatgtatcattggaa

SEQ ID NO: 589757 - DNA, 25 bp, Homo sapien
tagatgtttaactttagggacaaat

SEQ ID NO: 589758 - DNA, 25 bp, Homo sapien
tttttaccaacctcaactatcatta

SEQ ID NO: 589759 - DNA, 25 bp, Homo sapien
ctatcattaatttcagtgaacccta

SEQ ID NO: 589760 - DNA, 25 bp, Homo sapien
gtgaaccctaaatggtatccaacaa

SEQ ID NO: 589761 - DNA, 25 bp, Homo sapien
atatctttctagaccattcaccgtc

SEQ ID NO: 589762 - DNA, 25 bp, Homo sapien
accgtctctgcctcatagatgatca

SEQ ID NO: 589763 - DNA, 25 bp, Homo sapien
tttacggtccctagttttgtatgag

SEQ ID NO: 589764 - DNA, 25 bp, Homo sapien
ttacggtccctagttttgtatgagc

SEQ ID NO: 589765 - DNA, 25 bp, Homo sapien
tacggtccctagttttgtatgagcc

SEQ ID NO: 589766 - DNA, 25 bp, Homo sapien
acggtccctagttttgtatgagcct

SEQ ID NO: 589767 - DNA, 25 bp, Homo sapien
cggtccctagttttgtatgagcctc

SEQ ID NO: 589768 - DNA, 25 bp, Homo sapien
catcttgatcctaagagccacctct

SEQ ID NO: 589769 - DNA, 25 bp, Homo sapien
atcttgatcctaagagccacctctc

SEQ ID NO: 589770 - DNA, 25 bp, Homo sapien
tctgatctctgcattactcctcctc

SEQ ID NO: 589771 - DNA, 25 bp, Homo sapien
agtgccccctagacttcctcatctc

SEQ ID NO: 589772 - DNA, 25 bp, Homo sapien
caggatgaccacagccatcagccag

SEQ ID NO: 589773 - DNA, 25 bp, Homo sapien
gatgaccacagccatcagccagcag

SEQ ID NO: 589774 - DNA, 25 bp, Homo sapien
tacagagcaagtatccagtcccgtg

SEQ ID NO: 589775 - DNA, 25 bp, Homo sapien
agagcaagtatccagtcccgtgtca

SEQ ID NO: 589776 - DNA, 25 bp, Homo sapien
tatccagtcccgtgtcatgttcaat

SEQ ID NO: 589777 - DNA, 25 bp, Homo sapien
cagtcccgtgtcatgttcaatctct

SEQ ID NO: 589778 - DNA, 25 bp, Homo sapien
catgttcaatctctgcagggttatt

SEQ ID NO: 589779 - DNA, 25 bp, Homo sapien
atctctgcagggttattctgccaag

SEQ ID NO: 589780 - DNA, 25 bp, Homo sapien
ggagaacagctccttaatcagaaga

SEQ ID NO: 589781 - DNA, 25 bp, Homo sapien
acagctccttaatcagaagagacta

SEQ ID NO: 589782 - DNA, 25 bp, Homo sapien
agcagtattttaatcttaagccaac

SEQ ID NO: 589783 - DNA, 25 bp, Homo sapien
tcttaagccaactatagttctggat

SEQ ID NO: 589784 - DNA, 25 bp, Homo sapien
ctatagttctggattgctaaaattt

SEQ ID NO: 589785 - DNA, 25 bp, Homo sapien
atggtgcagacccatgggatccaaa

SEQ ID NO: 589786 - DNA, 25 bp, Homo sapien
ggcatttctgggaaggatgtctctt

SEQ ID NO: 589787 - DNA, 25 bp, Homo sapien
ggatgtctcttcttctgatttctga

SEQ ID NO: 589788 - DNA, 25 bp, Homo sapien
cttcttctgatttctgagtgagggt

SEQ ID NO: 589789 - DNA, 25 bp, Homo sapien
ttcttcatcagacgccatggctctt

SEQ ID NO: 589790 - DNA, 25 bp, Homo sapien
catggctcttacacgagtgatgcct

SEQ ID NO: 589791 - DNA, 25 bp, Homo sapien
agtgatgcctagagcagacacagcc

SEQ ID NO: 589792 - DNA, 25 bp, Homo sapien
gaggccaaggctgacaatgggacaa

SEQ ID NO: 589793 - DNA, 25 bp, Homo sapien
taagccttcctctgaccaagcactg

SEQ ID NO: 589794 - DNA, 25 bp, Homo sapien
gcactgtcctaaccaattctgattg

SEQ ID NO: 589795 - DNA, 25 bp, Homo sapien
gattggttcacttctagttacatga

SEQ ID NO: 589796 - DNA, 25 bp, Homo sapien
tggtgaaaccttttctaaatataca

SEQ ID NO: 589797 - DNA, 25 bp, Homo sapien
tgggtgtggtggtgaatgtctatag

SEQ ID NO: 589798 - DNA, 25 bp, Homo sapien
gggtgtggtggtgaatgtctatagt

SEQ ID NO: 589799 - DNA, 25 bp, Homo sapien
gtgtggtggtgaatgtctatagtcc

SEQ ID NO: 589800 - DNA, 25 bp, Homo sapien
tgtggtggtgaatgtctatagtccc

SEQ ID NO: 589801 - DNA, 25 bp, Homo sapien
gtggtggtgaatgtctatagtccca

SEQ ID NO: 589802 - DNA, 25 bp, Homo sapien
gtagaattgcttgaactgcaaggca

SEQ ID NO: 589803 - DNA, 25 bp, Homo sapien
tagaattgcttgaactgcaaggcag

SEQ ID NO: 589804 - DNA, 25 bp, Homo sapien
agaattgcttgaactgcaaggcaga

SEQ ID NO: 589805 - DNA, 25 bp, Homo sapien
attgcttgaactgcaaggcagaggt

SEQ ID NO: 589806 - DNA, 25 bp, Homo sapien
cttgaactgcaaggcagaggttgca

SEQ ID NO: 589807 - DNA, 25 bp, Homo sapien
agagaggcagctgggttaaaatcct

SEQ ID NO: 589808 - DNA, 25 bp, Homo sapien
gggttaaaatcctggctcagccatt

SEQ ID NO: 589809 - DNA, 25 bp, Homo sapien
tggctcagccatttgttgactgtgt

SEQ ID NO: 589810 - DNA, 25 bp, Homo sapien
gttgactgtgtccttttgaccaagc

SEQ ID NO: 589811 - DNA, 25 bp, Homo sapien
tgtgtccttttgaccaagctacagt

SEQ ID NO: 589812 - DNA, 25 bp, Homo sapien
gctacagtcattgcagtactgctga

SEQ ID NO: 589813 - DNA, 25 bp, Homo sapien
ggtggtggtgtcatcgactaatgat

SEQ ID NO: 589814 - DNA, 25 bp, Homo sapien
gactaatgatgatgtgatcccaaat

SEQ ID NO: 589815 - DNA, 25 bp, Homo sapien
tcttcccaaagcaatcagtgtccag

SEQ ID NO: 589816 - DNA, 25 bp, Homo sapien
aagcaatcagtgtccagatctggga

SEQ ID NO: 589817 - DNA, 25 bp, Homo sapien
tccagatctgggactttaagttgta

SEQ ID NO: 589818 - DNA, 25 bp, Homo sapien
gagctgtgcccatgaactctttttt

SEQ ID NO: 589819 - DNA, 25 bp, Homo sapien
cattgtaattatattcacgatgatt

SEQ ID NO: 589820 - DNA, 25 bp, Homo sapien
tgtaattatattcacgatgatttcc

SEQ ID NO: 589821 - DNA, 25 bp, Homo sapien
tttccactcgcgctctctcagttgg

SEQ ID NO: 589822 - DNA, 25 bp, Homo sapien
cactcgcgctctctcagttggatgt

SEQ ID NO: 589823 - DNA, 25 bp, Homo sapien
actcgcgctctctcagttggatgtc

SEQ ID NO: 589824 - DNA, 25 bp, Homo sapien
ctcgcgctctctcagttggatgtct

SEQ ID NO: 589825 - DNA, 25 bp, Homo sapien
tcgcgctctctcagttggatgtctt

SEQ ID NO: 589826 - DNA, 25 bp, Homo sapien
cgcgctctctcagttggatgtcttt

SEQ ID NO: 589827 - DNA, 25 bp, Homo sapien
gcgctctctcagttggatgtctttt

SEQ ID NO: 589828 - DNA, 25 bp, Homo sapien
cgctctctcagttggatgtctttta

SEQ ID NO: 589829 - DNA, 25 bp, Homo sapien
aatatagtaatcacattttatctca

SEQ ID NO: 589830 - DNA, 25 bp, Homo sapien
tatagtaatcacattttatctcatt

SEQ ID NO: 589831 - DNA, 25 bp, Homo sapien
atagtaatcacattttatctcatta

SEQ ID NO: 589832 - DNA, 25 bp, Homo sapien
agtaatcacattttatctcattatc

SEQ ID NO: 589833 - DNA, 25 bp, Homo sapien
gtaatcacattttatctcattatcc

SEQ ID NO: 589834 - DNA, 25 bp, Homo sapien
aatcacattttatctcattatccag

SEQ ID NO: 589835 - DNA, 25 bp, Homo sapien
atcacattttatctcattatccaga

SEQ ID NO: 589836 - DNA, 25 bp, Homo sapien
tcacattttatctcattatccagat

SEQ ID NO: 589837 - DNA, 25 bp, Homo sapien
acattttatctcattatccagataa

SEQ ID NO: 589838 - DNA, 25 bp, Homo sapien
tatctcattatccagataatcactg

SEQ ID NO: 589839 - DNA, 25 bp, Homo sapien
ctcattatccagataatcactgttt

SEQ ID NO: 589840 - DNA, 25 bp, Homo sapien
gtttaccactggctcctctgtaccc

SEQ ID NO: 589841 - DNA, 25 bp, Homo sapien
tctgtaccctccttgcgaacagtct

SEQ ID NO: 589842 - DNA, 25 bp, Homo sapien
ctgtaccctccttgcgaacagtctt

SEQ ID NO: 589843 - DNA, 25 bp, Homo sapien
cctccttgcgaacagtcttcttcct

SEQ ID NO: 589844 - DNA, 25 bp, Homo sapien
cagttctgtccgtgaaatctcagaa

SEQ ID NO: 589845 - DNA, 25 bp, Homo sapien
agttctgtccgtgaaatctcagaag

SEQ ID NO: 589846 - DNA, 25 bp, Homo sapien
gttctgtccgtgaaatctcagaagg

SEQ ID NO: 589847 - DNA, 25 bp, Homo sapien
tctgtccgtgaaatctcagaaggct

SEQ ID NO: 589848 - DNA, 25 bp, Homo sapien
atctcagaaggctcgggagttgcgc

SEQ ID NO: 589849 - DNA, 25 bp, Homo sapien
cagaaggctcgggagttgcgctgat

SEQ ID NO: 589850 - DNA, 25 bp, Homo sapien
gaaggctcgggagttgcgctgatgt

SEQ ID NO: 589851 - DNA, 25 bp, Homo sapien
tgcaggtgccgcctcttgtactgac

SEQ ID NO: 589852 - DNA, 25 bp, Homo sapien
aggtgccgcctcttgtactgacttg

SEQ ID NO: 589853 - DNA, 25 bp, Homo sapien
cctcttgtactgacttgcaccagag

SEQ ID NO: 589854 - DNA, 25 bp, Homo sapien
cagaggcagtttggctcccagctgc

SEQ ID NO: 589855 - DNA, 25 bp, Homo sapien
aggcagtttggctcccagctgcctg

SEQ ID NO: 589856 - DNA, 25 bp, Homo sapien
cctgggaacacgtgcggagtttgtc

SEQ ID NO: 589857 - DNA, 25 bp, Homo sapien
ggaacacgtgcggagtttgtcagaa

SEQ ID NO: 589858 - DNA, 25 bp, Homo sapien
acacgtgcggagtttgtcagaagca

SEQ ID NO: 589859 - DNA, 25 bp, Homo sapien
cagaagcaggaagacttggtgtggc

SEQ ID NO: 589860 - DNA, 25 bp, Homo sapien
ttggtgtggcgggaaccaaatcaca

SEQ ID NO: 589861 - DNA, 25 bp, Homo sapien
ggcgggaaccaaatcacagacacac

SEQ ID NO: 589862 - DNA, 25 bp, Homo sapien
ggtgagcgtaaactaggatctagcc

SEQ ID NO: 589863 - DNA, 25 bp, Homo sapien
aactaggatctagccggttccaggc

SEQ ID NO: 589864 - DNA, 25 bp, Homo sapien
tagccggttccaggcgtggagaatc

SEQ ID NO: 589865 - DNA, 25 bp, Homo sapien
ggagaatcaaatgtggtcctagatc

SEQ ID NO: 589866 - DNA, 25 bp, Homo sapien
ggtcctagatctgtaagttgcgaaa

SEQ ID NO: 589867 - DNA, 25 bp, Homo sapien
gcttttgggagcgtcagagctttct

SEQ ID NO: 589868 - DNA, 25 bp, Homo sapien
agcgtcagagctttctcactccggt

SEQ ID NO: 589869 - DNA, 25 bp, Homo sapien
gccgccttgaggctggcagatttat

SEQ ID NO: 589870 - DNA, 25 bp, Homo sapien
gaggctggcagatttataccacaca

SEQ ID NO: 589871 - DNA, 25 bp, Homo sapien
tggatggagacctaaacaaaacagt

SEQ ID NO: 589872 - DNA, 25 bp, Homo sapien
taaacaaaacagtcccggccgctgc

SEQ ID NO: 589873 - DNA, 25 bp, Homo sapien
agtgacgcaaaatgcccttcaatgg

SEQ ID NO: 589874 - DNA, 25 bp, Homo sapien
aaatgcccttcaatggcgagaagca

SEQ ID NO: 589875 - DNA, 25 bp, Homo sapien
acgcacgccaagtcttcagagggcc

SEQ ID NO: 589876 - DNA, 25 bp, Homo sapien
cgccaagtcttcagagggcctggat

SEQ ID NO: 589877 - DNA, 25 bp, Homo sapien
gagggcctggatgggtgtgactcca

SEQ ID NO: 589878 - DNA, 25 bp, Homo sapien
tgactccaaggagctaatcgtcccg

SEQ ID NO: 589879 - DNA, 25 bp, Homo sapien
aaggagctaatcgtcccgtgcaggt

SEQ ID NO: 589880 - DNA, 25 bp, Homo sapien
gctaatcgtcccgtgcaggtgctac

SEQ ID NO: 589881 - DNA, 25 bp, Homo sapien
atcgtcccgtgcaggtgctaccttt

SEQ ID NO: 589882 - DNA, 25 bp, Homo sapien
tgctacctttttacccacacttaag

SEQ ID NO: 589883 - DNA, 25 bp, Homo sapien
ttttacccacacttaagtgacgcaa

SEQ ID NO: 589884 - DNA, 25 bp, Homo sapien
aaccaggcaggtaggcggagaaact

SEQ ID NO: 589885 - DNA, 25 bp, Homo sapien
accaggcaggtaggcggagaaactc

SEQ ID NO: 589886 - DNA, 25 bp, Homo sapien
gcaggtaggcggagaaactccgtcc

SEQ ID NO: 589887 - DNA, 25 bp, Homo sapien
gtaggcggagaaactccgtcccgca

SEQ ID NO: 589888 - DNA, 25 bp, Homo sapien
aggcggagaaactccgtcccgcagc

SEQ ID NO: 589889 - DNA, 25 bp, Homo sapien
gagaaactccgtcccgcagcgtcct

SEQ ID NO: 589890 - DNA, 25 bp, Homo sapien
gacccatccagggatcagagctctg

SEQ ID NO: 589891 - DNA, 25 bp, Homo sapien
acccatccagggatcagagctctgc

SEQ ID NO: 589892 - DNA, 25 bp, Homo sapien
ccatccagggatcagagctctgccg

SEQ ID NO: 589893 - DNA, 25 bp, Homo sapien
atccagggatcagagctctgccggg

SEQ ID NO: 589894 - DNA, 25 bp, Homo sapien
gggacgtgctgtgggcctttaggca

SEQ ID NO: 589895 - DNA, 25 bp, Homo sapien
tgctattgcttcttcttctgttaaa

SEQ ID NO: 589896 - DNA, 25 bp, Homo sapien
aaaactcactctacattcattgcta

SEQ ID NO: 589897 - DNA, 25 bp, Homo sapien
ctcactctacattcattgctaggag

SEQ ID NO: 589898 - DNA, 25 bp, Homo sapien
attgctaggagagaacagcctgctc

SEQ ID NO: 589899 - DNA, 25 bp, Homo sapien
cattccagcctttttatctatatcc

SEQ ID NO: 589900 - DNA, 25 bp, Homo sapien
tatctatatccacttaacattaaac

SEQ ID NO: 589901 - DNA, 25 bp, Homo sapien
aaacatacagagtttctactctatt

SEQ ID NO: 589902 - DNA, 25 bp, Homo sapien
gagtttctactctatttagtgattg

SEQ ID NO: 589903 - DNA, 25 bp, Homo sapien
actctatttagtgattgtcacctgc

SEQ ID NO: 589904 - DNA, 25 bp, Homo sapien
gattgtcacctgcactttaaactta

SEQ ID NO: 589905 - DNA, 25 bp, Homo sapien
aaacttaatggttctttatgagcat

SEQ ID NO: 589906 - DNA, 25 bp, Homo sapien
cataagcctaaaattagccatgcag

SEQ ID NO: 589907 - DNA, 25 bp, Homo sapien
tagccatgcaggtacattaattaat

SEQ ID NO: 589908 - DNA, 25 bp, Homo sapien
taattaattaaccactagacaagca

SEQ ID NO: 589909 - DNA, 25 bp, Homo sapien
aaccactagacaagcagaattatta

SEQ ID NO: 589910 - DNA, 25 bp, Homo sapien
agaattattaatgtaggtaatgccc

SEQ ID NO: 589911 - DNA, 25 bp, Homo sapien
ggaattgattctgacctgtggcact

SEQ ID NO: 589912 - DNA, 25 bp, Homo sapien
attgattctgacctgtggcactggg

SEQ ID NO: 589913 - DNA, 25 bp, Homo sapien
tacaagcccgtctgcaatgttgttt

SEQ ID NO: 589914 - DNA, 25 bp, Homo sapien
caagcccgtctgcaatgttgtttga

SEQ ID NO: 589915 - DNA, 25 bp, Homo sapien
agcccgtctgcaatgttgtttgagt

SEQ ID NO: 589916 - DNA, 25 bp, Homo sapien
cccgtctgcaatgttgtttgagttg

SEQ ID NO: 589917 - DNA, 25 bp, Homo sapien
aagtgacgcaaaatgcccttcaatg

SEQ ID NO: 589918 - DNA, 25 bp, Homo sapien
gtgacgcaaaatgcccttcaatggc

SEQ ID NO: 589919 - DNA, 25 bp, Homo sapien
acgcaaaatgcccttcaatggcgag

SEQ ID NO: 589920 - DNA, 25 bp, Homo sapien
gcaaaatgcccttcaatggcgagaa

SEQ ID NO: 589921 - DNA, 25 bp, Homo sapien
aaatgcccttcaatggcgagaagca

SEQ ID NO: 589922 - DNA, 25 bp, Homo sapien
tgctacctttttacccacacttaag

SEQ ID NO: 589923 - DNA, 25 bp, Homo sapien
tttttacccacacttaagtgacgca

SEQ ID NO: 589924 - DNA, 25 bp, Homo sapien
tttacccacacttaagtgacgcaaa

SEQ ID NO: 589925 - DNA, 25 bp, Homo sapien
cacacttaagtgacgcaaaatgccc

SEQ ID NO: 589926 - DNA, 25 bp, Homo sapien
acttaagtgacgcaaaatgcccttc

SEQ ID NO: 589927 - DNA, 25 bp, Homo sapien
ttaagtgacgcaaaatgcccttcaa

SEQ ID NO: 589928 - DNA, 25 bp, Homo sapien
atgttacaagtatcagagaattcag

SEQ ID NO: 589929 - DNA, 25 bp, Homo sapien
gagaattcaggatttgccatgggct

SEQ ID NO: 589930 - DNA, 25 bp, Homo sapien
tttgccatgggctgcgaaaatagag

SEQ ID NO: 589931 - DNA, 25 bp, Homo sapien
gtagaagactgttctaattaccggg

SEQ ID NO: 589932 - DNA, 25 bp, Homo sapien
aggttctcagtgacaactctctagt

SEQ ID NO: 589933 - DNA, 25 bp, Homo sapien
cagtgacaactctctagtagacaaa

SEQ ID NO: 589934 - DNA, 25 bp, Homo sapien
aatgaaattaacaagaccagcctgt

SEQ ID NO: 589935 - DNA, 25 bp, Homo sapien
aagaccagcctgttatttagcagat

SEQ ID NO: 589936 - DNA, 25 bp, Homo sapien
gcctgttatttagcagatagggcct

SEQ ID NO: 589937 - DNA, 25 bp, Homo sapien
ctgggaggacagaatttaacattga

SEQ ID NO: 589938 - DNA, 25 bp, Homo sapien
gtttcatgaaagatcgtataagcaa

SEQ ID NO: 589939 - DNA, 25 bp, Homo sapien
ggcccatgggaataatgtgtcagct

SEQ ID NO: 589940 - DNA, 25 bp, Homo sapien
cagctgtctgactgcctgtcagaca

SEQ ID NO: 589941 - DNA, 25 bp, Homo sapien
acactctgcagaaggatgtctggat

SEQ ID NO: 589942 - DNA, 25 bp, Homo sapien
tgtctggattgggtatcaggctgaa

SEQ ID NO: 589943 - DNA, 25 bp, Homo sapien
gctgaagtaaatactctctgaggct

SEQ ID NO: 589944 - DNA, 25 bp, Homo sapien
tctctgaggctccatttagtgttgt

SEQ ID NO: 589945 - DNA, 25 bp, Homo sapien
catttagtgttgtgggcctgccatt

SEQ ID NO: 589946 - DNA, 25 bp, Homo sapien
tgccattctgtgttgtggtggccaa

SEQ ID NO: 589947 - DNA, 25 bp, Homo sapien
gaagaggactgattcgaggtacaca

SEQ ID NO: 589948 - DNA, 25 bp, Homo sapien
gtaaacctcctttttgtgcaacaga

SEQ ID NO: 589949 - DNA, 25 bp, Homo sapien
gggtagactctaatgagcacttctg

SEQ ID NO: 589950 - DNA, 25 bp, Homo sapien
gaatctttttgcctagattgcccaa

SEQ ID NO: 589951 - DNA, 25 bp, Homo sapien
tttgcctagattgcccaacaagaga

SEQ ID NO: 589952 - DNA, 25 bp, Homo sapien
caagagaaattgtagtgtcactggt

SEQ ID NO: 589953 - DNA, 25 bp, Homo sapien
tcactggtattgatgacctggaaca

SEQ ID NO: 589954 - DNA, 25 bp, Homo sapien
ggaacagattccagcagacacaact

SEQ ID NO: 589955 - DNA, 25 bp, Homo sapien
taaatcacttagaaactcagccggt

SEQ ID NO: 589956 - DNA, 25 bp, Homo sapien
aactcagccggtctctagcaaagat

SEQ ID NO: 589957 - DNA, 25 bp, Homo sapien
ggtctctagcaaagattcaggcatt

SEQ ID NO: 589958 - DNA, 25 bp, Homo sapien
tcaggcattggatctgttgcaggta

SEQ ID NO: 589959 - DNA, 25 bp, Homo sapien
gtaaactgaacctaagtccttctca

SEQ ID NO: 589960 - DNA, 25 bp, Homo sapien
aatcttcctgtatatcctgatgaga

SEQ ID NO: 589961 - DNA, 25 bp, Homo sapien
ctccagggctcgtgtgatcctccaa

SEQ ID NO: 589962 - DNA, 25 bp, Homo sapien
cagcctctcgaatactctgggactg

SEQ ID NO: 589963 - DNA, 25 bp, Homo sapien
cctctcgaatactctgggactgcaa

SEQ ID NO: 589964 - DNA, 25 bp, Homo sapien
ctcgaatactctgggactgcaagtg

SEQ ID NO: 589965 - DNA, 25 bp, Homo sapien
gactgcaagtgtacaccaccatata

SEQ ID NO: 589966 - DNA, 25 bp, Homo sapien
aagtgtacaccaccatatacagcat

SEQ ID NO: 589967 - DNA, 25 bp, Homo sapien
gtacaccaccatatacagcattatt

SEQ ID NO: 589968 - DNA, 25 bp, Homo sapien
atacagcattattttttgtgttgtg

SEQ ID NO: 589969 - DNA, 25 bp, Homo sapien
agagatggggtgtctcaccaccttg

SEQ ID NO: 589970 - DNA, 25 bp, Homo sapien
gctctttaaatgaaagccctcttct

SEQ ID NO: 589971 - DNA, 25 bp, Homo sapien
ctttaaatgaaagccctcttctctt

SEQ ID NO: 589972 - DNA, 25 bp, Homo sapien
tatgtttttagaggaattcgttcat

SEQ ID NO: 589973 - DNA, 25 bp, Homo sapien
gaggaattcgttcattagatctgcc

SEQ ID NO: 589974 - DNA, 25 bp, Homo sapien
ggaattcgttcattagatctgcctt

SEQ ID NO: 589975 - DNA, 25 bp, Homo sapien
gaattcgttcattagatctgccttt

SEQ ID NO: 589976 - DNA, 25 bp, Homo sapien
attcgttcattagatctgccttttc

SEQ ID NO: 589977 - DNA, 25 bp, Homo sapien
ttcgttcattagatctgccttttca

SEQ ID NO: 589978 - DNA, 25 bp, Homo sapien
tcgttcattagatctgccttttcaa

SEQ ID NO: 589979 - DNA, 25 bp, Homo sapien
cgttcattagatctgccttttcaaa

SEQ ID NO: 589980 - DNA, 25 bp, Homo sapien
gttcattagatctgccttttcaaat

SEQ ID NO: 589981 - DNA, 25 bp, Homo sapien
attagatctgccttttcaaatgtat

SEQ ID NO: 589982 - DNA, 25 bp, Homo sapien
ttagatctgccttttcaaatgtatt

SEQ ID NO: 589983 - DNA, 25 bp, Homo sapien
tttagatctaccctcttgttgccca

SEQ ID NO: 589984 - DNA, 25 bp, Homo sapien
agtctcccgagtgtcttctgtcttt

SEQ ID NO: 589985 - DNA, 25 bp, Homo sapien
gtttttcatgcccaagtgagattaa

SEQ ID NO: 589986 - DNA, 25 bp, Homo sapien
catgcccaagtgagattaattgttt

SEQ ID NO: 589987 - DNA, 25 bp, Homo sapien
aacaacatagatttaccgcaagacc

SEQ ID NO: 589988 - DNA, 25 bp, Homo sapien
gatttaccgcaagacctattgatat

SEQ ID NO: 589989 - DNA, 25 bp, Homo sapien
accgcaagacctattgatatattat

SEQ ID NO: 589990 - DNA, 25 bp, Homo sapien
gtatacccagggtgggtgtgacaca

SEQ ID NO: 589991 - DNA, 25 bp, Homo sapien
ggtgtgacacagaccaaaagaggct

SEQ ID NO: 589992 - DNA, 25 bp, Homo sapien
gaccaaaagaggctgtgtgttctgt

SEQ ID NO: 589993 - DNA, 25 bp, Homo sapien
aggctgtgtgttctgttgttgataa

SEQ ID NO: 589994 - DNA, 25 bp, Homo sapien
tacccctggtaacccatttatggag

SEQ ID NO: 589995 - DNA, 25 bp, Homo sapien
aacccatttatggaggctgccacag

SEQ ID NO: 589996 - DNA, 25 bp, Homo sapien
catttatggaggctgccacagaaat

SEQ ID NO: 589997 - DNA, 25 bp, Homo sapien
ggaggctgccacagaaatgctagtt

SEQ ID NO: 589998 - DNA, 25 bp, Homo sapien
gctgccacagaaatgctagttggaa

SEQ ID NO: 589999 - DNA, 25 bp, Homo sapien
ttggaaattttcctccttcagtcta

SEQ ID NO: 590000 - DNA, 25 bp, Homo sapien
aaattttcctccttcagtctatcat

SEQ ID NO: 590001 - DNA, 25 bp, Homo sapien
ttttcctccttcagtctatcatgaa

SEQ ID NO: 590002 - DNA, 25 bp, Homo sapien
ttcctccttcagtctatcatgaatt

SEQ ID NO: 590003 - DNA, 25 bp, Homo sapien
cttttgagatgaagtcgcccgggct

SEQ ID NO: 590004 - DNA, 25 bp, Homo sapien
tttgagatgaagtcgcccgggctgc

SEQ ID NO: 590005 - DNA, 25 bp, Homo sapien
acccaatgaggtttagagtttctct

SEQ ID NO: 590006 - DNA, 25 bp, Homo sapien
ttctctagtttttctaggttcgtga

SEQ ID NO: 590007 - DNA, 25 bp, Homo sapien
aggttcgtgaagagaatgatgtcat

SEQ ID NO: 590008 - DNA, 25 bp, Homo sapien
gaatgatgtcatggaaatactcaaa

SEQ ID NO: 590009 - DNA, 25 bp, Homo sapien
aagaagcagtgcagaaggtaggttc

SEQ ID NO: 590010 - DNA, 25 bp, Homo sapien
gagggaactttcatctgcaggtgct

SEQ ID NO: 590011 - DNA, 25 bp, Homo sapien
gaactttcatctgcaggtgctactg

SEQ ID NO: 590012 - DNA, 25 bp, Homo sapien
tgtggcccaacctgacagtgaggca

SEQ ID NO: 590013 - DNA, 25 bp, Homo sapien
acctggaggtgtacgccgccgtgaa

SEQ ID NO: 590014 - DNA, 25 bp, Homo sapien
tgccatcacacggtacacagaggag

SEQ ID NO: 590015 - DNA, 25 bp, Homo sapien
atcacacggtacacagaggagccac

SEQ ID NO: 590016 - DNA, 25 bp, Homo sapien
gagtgaggcagcacctctcctgacc

SEQ ID NO: 590017 - DNA, 25 bp, Homo sapien
tttgaagccaccctattcacctgtg

SEQ ID NO: 590018 - DNA, 25 bp, Homo sapien
ttcacctgtgctcccacaaagtatg

SEQ ID NO: 590019 - DNA, 25 bp, Homo sapien
caaagtatgaggcaggtctcagaga

SEQ ID NO: 590020 - DNA, 25 bp, Homo sapien
aggtctcagagagcgagtcacccca

SEQ ID NO: 590021 - DNA, 25 bp, Homo sapien
ttccaaggatcaccaagataaagta

SEQ ID NO: 590022 - DNA, 25 bp, Homo sapien
taggtgggtgcagacttgctgaact

SEQ ID NO: 590023 - DNA, 25 bp, Homo sapien
cagacttgctgaactgccttgaaga

SEQ ID NO: 590024 - DNA, 25 bp, Homo sapien
aagagacacggtctttctttgccac

SEQ ID NO: 590025 - DNA, 25 bp, Homo sapien
tgcaatggtgcaatcgtaactcaag

SEQ ID NO: 590026 - DNA, 25 bp, Homo sapien
gtgcaatcgtaactcaagaagcctt

SEQ ID NO: 590027 - DNA, 25 bp, Homo sapien
gcaccctttaaataggaaatgcctt

SEQ ID NO: 590028 - DNA, 25 bp, Homo sapien
taggaaatgccttccagctacttgg

SEQ ID NO: 590029 - DNA, 25 bp, Homo sapien
ttgggcagtgcgatacttgtttagt

SEQ ID NO: 590030 - DNA, 25 bp, Homo sapien
acttgtttagttgtaggcccaggag

SEQ ID NO: 590031 - DNA, 25 bp, Homo sapien
gttgtaggcccaggagcctcatgca

SEQ ID NO: 590032 - DNA, 25 bp, Homo sapien
aaattcttatcagaggttcccattt

SEQ ID NO: 590033 - DNA, 25 bp, Homo sapien
ttgttgttgggctgacatgtattac

SEQ ID NO: 590034 - DNA, 25 bp, Homo sapien
gcatttctttataagcccccatggc

SEQ ID NO: 590035 - DNA, 25 bp, Homo sapien
catggctcctcttttcagtagatta

SEQ ID NO: 590036 - DNA, 25 bp, Homo sapien
ggctcctcttttcagtagattaatt

SEQ ID NO: 590037 - DNA, 25 bp, Homo sapien
ttatgttattactcaaagggaaatg

SEQ ID NO: 590038 - DNA, 25 bp, Homo sapien
tgccctgtgggtaaggcacatctca

SEQ ID NO: 590039 - DNA, 25 bp, Homo sapien
gcacatctcagaagggacaggtcca

SEQ ID NO: 590040 - DNA, 25 bp, Homo sapien
agaagggacaggtccaggccctctc

SEQ ID NO: 590041 - DNA, 25 bp, Homo sapien
ctggcctggagcttctggcaaggct

SEQ ID NO: 590042 - DNA, 25 bp, Homo sapien
ttctggcaaggcttttcttctctga

SEQ ID NO: 590043 - DNA, 25 bp, Homo sapien
aaggcttttcttctctgagcctcac

SEQ ID NO: 590044 - DNA, 25 bp, Homo sapien
agcctcactttcctcttttgaaggt

SEQ ID NO: 590045 - DNA, 25 bp, Homo sapien
cactttcctcttttgaaggtggcaa

SEQ ID NO: 590046 - DNA, 25 bp, Homo sapien
gtggcaatagtaactgaacctgcat

SEQ ID NO: 590047 - DNA, 25 bp, Homo sapien
aacctgcatcacagaatggccttga

SEQ ID NO: 590048 - DNA, 25 bp, Homo sapien
atggccttgagggttagatggaaca

SEQ ID NO: 590049 - DNA, 25 bp, Homo sapien
ggtggttgctgcttccagtttccct

SEQ ID NO: 590050 - DNA, 25 bp, Homo sapien
tccagtttcccttcagacttagctg

SEQ ID NO: 590051 - DNA, 25 bp, Homo sapien
agtttcccttcagacttagctgtgt

SEQ ID NO: 590052 - DNA, 25 bp, Homo sapien
ttcccttcagacttagctgtgtgaa

SEQ ID NO: 590053 - DNA, 25 bp, Homo sapien
tcagacttagctgtgtgaaccccac

SEQ ID NO: 590054 - DNA, 25 bp, Homo sapien
tatcctttggccttagttttcccat

SEQ ID NO: 590055 - DNA, 25 bp, Homo sapien
tcctttggccttagttttcccatct

SEQ ID NO: 590056 - DNA, 25 bp, Homo sapien
catctgtaaaactcagaaacgcagt

SEQ ID NO: 590057 - DNA, 25 bp, Homo sapien
tcagaaacgcagttggaaagtcctt

SEQ ID NO: 590058 - DNA, 25 bp, Homo sapien
aacgcagttggaaagtccttattca

SEQ ID NO: 590059 - DNA, 25 bp, Homo sapien
gttggaaagtccttattcatttagt

SEQ ID NO: 590060 - DNA, 25 bp, Homo sapien
tgtgtctgtatttatccttccacca

SEQ ID NO: 590061 - DNA, 25 bp, Homo sapien
caccagtggctgtgattggtcctgt

SEQ ID NO: 590062 - DNA, 25 bp, Homo sapien
tcaagtaaggcccttgggagtagct

SEQ ID NO: 590063 - DNA, 25 bp, Homo sapien
aatggacgatggtggcgtccacctt

SEQ ID NO: 590064 - DNA, 25 bp, Homo sapien
caccttggacatggcacatacttct

SEQ ID NO: 590065 - DNA, 25 bp, Homo sapien
acatggcacatacttctggtcgggt

SEQ ID NO: 590066 - DNA, 25 bp, Homo sapien
ttctggtcgggtatccacgtggctg

SEQ ID NO: 590067 - DNA, 25 bp, Homo sapien
cctcatggctcatcagtgctgagtt

SEQ ID NO: 590068 - DNA, 25 bp, Homo sapien
agtgctgagtttcattgccttcttc

SEQ ID NO: 590069 - DNA, 25 bp, Homo sapien
gccttcttcgtaatgcaatactaat

SEQ ID NO: 590070 - DNA, 25 bp, Homo sapien
aggcatgtatctgccgtacactaga

SEQ ID NO: 590071 - DNA, 25 bp, Homo sapien
ggcttcatggcagcagatcagagct

SEQ ID NO: 590072 - DNA, 25 bp, Homo sapien
gagctgtgacattttctacatctag

SEQ ID NO: 590073 - DNA, 25 bp, Homo sapien
ttctacatctagacatgctaccaga

SEQ ID NO: 590074 - DNA, 25 bp, Homo sapien
gggaaccattagaggtgcaatctac

SEQ ID NO: 590075 - DNA, 25 bp, Homo sapien
gaggtgcaatctacattgggcatct

SEQ ID NO: 590076 - DNA, 25 bp, Homo sapien
tctacattgggcatctggtcattca

SEQ ID NO: 590077 - DNA, 25 bp, Homo sapien
ggcatctggtcattcaatctgtttt

SEQ ID NO: 590078 - DNA, 25 bp, Homo sapien
gttatttttgcctttcaatgtaatc

SEQ ID NO: 590079 - DNA, 25 bp, Homo sapien
taaattttttgatatccatgtaggg

SEQ ID NO: 590080 - DNA, 25 bp, Homo sapien
ccatatttttggaagtagcggtcat

SEQ ID NO: 590081 - DNA, 25 bp, Homo sapien
gtagcggtcattagcaaagtaacta

SEQ ID NO: 590082 - DNA, 25 bp, Homo sapien
aaattctttactgttgcaataatta

SEQ ID NO: 590083 - DNA, 25 bp, Homo sapien
aattctttactgttgcaataattaa

SEQ ID NO: 590084 - DNA, 25 bp, Homo sapien
atgaaactttagtatcagtattgtt

SEQ ID NO: 590085 - DNA, 25 bp, Homo sapien
tgaaactttagtatcagtattgttt

SEQ ID NO: 590086 - DNA, 25 bp, Homo sapien
gaaactttagtatcagtattgtttt

SEQ ID NO: 590087 - DNA, 25 bp, Homo sapien
aactttagtatcagtattgttttat

SEQ ID NO: 590088 - DNA, 25 bp, Homo sapien
actttagtatcagtattgttttata

SEQ ID NO: 590089 - DNA, 25 bp, Homo sapien
ctttagtatcagtattgttttataa

SEQ ID NO: 590090 - DNA, 25 bp, Homo sapien
tttagtatcagtattgttttataat

SEQ ID NO: 590091 - DNA, 25 bp, Homo sapien
ttagtatcagtattgttttataatt

SEQ ID NO: 590092 - DNA, 25 bp, Homo sapien
gagtgtaaggttttcaggttctcag

SEQ ID NO: 590093 - DNA, 25 bp, Homo sapien
tttcaggttctcagatcgcaaggat

SEQ ID NO: 590094 - DNA, 25 bp, Homo sapien
caggttctcagatcgcaaggattta

SEQ ID NO: 590095 - DNA, 25 bp, Homo sapien
ttctcagatcgcaaggatttagtgt

SEQ ID NO: 590096 - DNA, 25 bp, Homo sapien
tcgcaaggatttagtgtgaaccaaa

SEQ ID NO: 590097 - DNA, 25 bp, Homo sapien
gtgtgaaccaaaaagtctgcaacct

SEQ ID NO: 590098 - DNA, 25 bp, Homo sapien
tgaaccaaaaagtctgcaacctgaa

SEQ ID NO: 590099 - DNA, 25 bp, Homo sapien
gtctgcaacctgaagtatgagattt

SEQ ID NO: 590100 - DNA, 25 bp, Homo sapien
agttgatcttctcctagagttcaaa

SEQ ID NO: 590101 - DNA, 25 bp, Homo sapien
ttctcctagagttcaaattgctttc

SEQ ID NO: 590102 - DNA, 25 bp, Homo sapien
cctagagttcaaattgctttcattg

SEQ ID NO: 590103 - DNA, 25 bp, Homo sapien
taaaactcactctacattcattgct

SEQ ID NO: 590104 - DNA, 25 bp, Homo sapien
aactcactctacattcattgctagg

SEQ ID NO: 590105 - DNA, 25 bp, Homo sapien
tcactctacattcattgctaggaga

SEQ ID NO: 590106 - DNA, 25 bp, Homo sapien
attgctaggagagaacagcctgctc

SEQ ID NO: 590107 - DNA, 25 bp, Homo sapien
cattccagcctttttatctatatcc

SEQ ID NO: 590108 - DNA, 25 bp, Homo sapien
tatctatatccacttaacattaaac

SEQ ID NO: 590109 - DNA, 25 bp, Homo sapien
aaacatacagagtttctactctatt

SEQ ID NO: 590110 - DNA, 25 bp, Homo sapien
gagtttctactctatttagtgattg

SEQ ID NO: 590111 - DNA, 25 bp, Homo sapien
actctatttagtgattgtcacctgc

SEQ ID NO: 590112 - DNA, 25 bp, Homo sapien
gattgtcacctgcactttaaactta

SEQ ID NO: 590113 - DNA, 25 bp, Homo sapien
aaacttaatggttctttatgagcat

SEQ ID NO: 590114 - DNA, 25 bp, Homo sapien
tatctgaatttgcacctactctgta

SEQ ID NO: 590115 - DNA, 25 bp, Homo sapien
tctgaatttgcacctactctgtaac

SEQ ID NO: 590116 - DNA, 25 bp, Homo sapien
cctactctgtaacctaactgcgatt

SEQ ID NO: 590117 - DNA, 25 bp, Homo sapien
ctgtaacctaactgcgatttataaa

SEQ ID NO: 590118 - DNA, 25 bp, Homo sapien
atctcttctaatttggcacttgata

SEQ ID NO: 590119 - DNA, 25 bp, Homo sapien
acttgataggtgctttgactttaaa

SEQ ID NO: 590120 - DNA, 25 bp, Homo sapien
aagtgtatttttctgtcacgaatat

SEQ ID NO: 590121 - DNA, 25 bp, Homo sapien
ttttctgtcacgaatatcttgtcat

SEQ ID NO: 590122 - DNA, 25 bp, Homo sapien
gtcacgaatatcttgtcattctaaa

SEQ ID NO: 590123 - DNA, 25 bp, Homo sapien
aatggattgatgaaacttcttcact

SEQ ID NO: 590124 - DNA, 25 bp, Homo sapien
agaatttgtttctgtgtatctgaat

SEQ ID NO: 590125 - DNA, 25 bp, Homo sapien
aattgctttcattgactccgaatgt

SEQ ID NO: 590126 - DNA, 25 bp, Homo sapien
cattgactccgaatgttccaccaaa

SEQ ID NO: 590127 - DNA, 25 bp, Homo sapien
aatgcaaaggaacctaagggcagat

SEQ ID NO: 590128 - DNA, 25 bp, Homo sapien
gagtattagaataagtccaccaaaa

SEQ ID NO: 590129 - DNA, 25 bp, Homo sapien
gtccaccaaaagcaatgttctcaaa

SEQ ID NO: 590130 - DNA, 25 bp, Homo sapien
aatgttctcaaagcaccagtgcttc

SEQ ID NO: 590131 - DNA, 25 bp, Homo sapien
aagcaccagtgcttcaagctggcaa

SEQ ID NO: 590132 - DNA, 25 bp, Homo sapien
gtgcttcaagctggcaacgcagcaa

SEQ ID NO: 590133 - DNA, 25 bp, Homo sapien
tggcaacgcagcaaggtggctaaga

SEQ ID NO: 590134 - DNA, 25 bp, Homo sapien
gtggctaagaaatgggttttgaact

SEQ ID NO: 590135 - DNA, 25 bp, Homo sapien
gttttgaactacacagacctggatg

SEQ ID NO: 590136 - DNA, 25 bp, Homo sapien
tagtcttggagtttagttttggagt

SEQ ID NO: 590137 - DNA, 25 bp, Homo sapien
gtttagttttggagttagccttgca

SEQ ID NO: 590138 - DNA, 25 bp, Homo sapien
ttggagttagccttgcatatccctt

SEQ ID NO: 590139 - DNA, 25 bp, Homo sapien
ttagccttgcatatcccttctgtat

SEQ ID NO: 590140 - DNA, 25 bp, Homo sapien
ccttgcatatcccttctgtatcctg

SEQ ID NO: 590141 - DNA, 25 bp, Homo sapien
cgccgacccgagagcagctgagctg

SEQ ID NO: 590142 - DNA, 25 bp, Homo sapien
agctgagctgcgctggctctgggca

SEQ ID NO: 590143 - DNA, 25 bp, Homo sapien
ctctgggcagggagtgtgccttaat

SEQ ID NO: 590144 - DNA, 25 bp, Homo sapien
ggagtgtgccttaatgggaagcaca

SEQ ID NO: 590145 - DNA, 25 bp, Homo sapien
cagctccagcttttgaacttgggca

SEQ ID NO: 590146 - DNA, 25 bp, Homo sapien
ggcaattgtttaacctaacctgcaa

SEQ ID NO: 590147 - DNA, 25 bp, Homo sapien
cccagcatttggaagaccaagacag

SEQ ID NO: 590148 - DNA, 25 bp, Homo sapien
ccagcatttggaagaccaagacagg

SEQ ID NO: 590149 - DNA, 25 bp, Homo sapien
cagcatttggaagaccaagacaggc

SEQ ID NO: 590150 - DNA, 25 bp, Homo sapien
agcatttggaagaccaagacaggca

SEQ ID NO: 590151 - DNA, 25 bp, Homo sapien
ttcgagatcattctggccaacgggg

SEQ ID NO: 590152 - DNA, 25 bp, Homo sapien
tcgagatcattctggccaacggggc

SEQ ID NO: 590153 - DNA, 25 bp, Homo sapien
cgagatcattctggccaacggggcg

SEQ ID NO: 590154 - DNA, 25 bp, Homo sapien
gagatcattctggccaacggggcga

SEQ ID NO: 590155 - DNA, 25 bp, Homo sapien
agatcattctggccaacggggcgaa

SEQ ID NO: 590156 - DNA, 25 bp, Homo sapien
tgaagggcgtcagggaaccaacaac

SEQ ID NO: 590157 - DNA, 25 bp, Homo sapien
gtcagggaaccaacaacgcagcttg

SEQ ID NO: 590158 - DNA, 25 bp, Homo sapien
gaaccaacaacgcagcttgtgtgga

SEQ ID NO: 590159 - DNA, 25 bp, Homo sapien
aacgcagcttgtgtggaacacccgt

SEQ ID NO: 590160 - DNA, 25 bp, Homo sapien
ttgtgtggaacacccgtgtccctgc

SEQ ID NO: 590161 - DNA, 25 bp, Homo sapien
gtccctgccgggagtctggctttgt

SEQ ID NO: 590162 - DNA, 25 bp, Homo sapien
gggagtctggctttgtggcccatcc

SEQ ID NO: 590163 - DNA, 25 bp, Homo sapien
gtctggctttgtggcccatcccagg

SEQ ID NO: 590164 - DNA, 25 bp, Homo sapien
ccccagtaacaaccctgggcaggag

SEQ ID NO: 590165 - DNA, 25 bp, Homo sapien
gtgggcgtgctggtgcacaactata

SEQ ID NO: 590166 - DNA, 25 bp, Homo sapien
agctggttgcgccacttcacgccag

SEQ ID NO: 590167 - DNA, 25 bp, Homo sapien
cattgtgacagaattaggcccgcaa

SEQ ID NO: 590168 - DNA, 25 bp, Homo sapien
attaggcccgcaaatccaattgtca

SEQ ID NO: 590169 - DNA, 25 bp, Homo sapien
attgtcacctaaactgcatgcatcc

SEQ ID NO: 590170 - DNA, 25 bp, Homo sapien
aaactgcatgcatcccagattctgc

SEQ ID NO: 590171 - DNA, 25 bp, Homo sapien
gattctgccagatacatcacagtga

SEQ ID NO: 590172 - DNA, 25 bp, Homo sapien
gtgacattctgcatcgtgttcattt

SEQ ID NO: 590173 - DNA, 25 bp, Homo sapien
gtgttcatttatattcaggagccaa

SEQ ID NO: 590174 - DNA, 25 bp, Homo sapien
gaaagatctggctatttcccatctc

SEQ ID NO: 590175 - DNA, 25 bp, Homo sapien
ctcccactacacagttaccatggta

SEQ ID NO: 590176 - DNA, 25 bp, Homo sapien
ctgatgatatcacaaggtccttctt

SEQ ID NO: 590177 - DNA, 25 bp, Homo sapien
aggtccttcttcaggttacctggct

SEQ ID NO: 590178 - DNA, 25 bp, Homo sapien
taaccagaaatgcatactgagacat

SEQ ID NO: 590179 - DNA, 25 bp, Homo sapien
ggaagcatcctctatatccaatggt

SEQ ID NO: 590180 - DNA, 25 bp, Homo sapien
tatatccaatggtatttcatgacac

SEQ ID NO: 590181 - DNA, 25 bp, Homo sapien
cactgaatacattttgatacaactc

SEQ ID NO: 590182 - DNA, 25 bp, Homo sapien
gagatgcatccattgataatcccat

SEQ ID NO: 590183 - DNA, 25 bp, Homo sapien
attgataatcccatttccacagcag

SEQ ID NO: 590184 - DNA, 25 bp, Homo sapien
ataatcccatttccacagcagagtt

SEQ ID NO: 590185 - DNA, 25 bp, Homo sapien
atttccacagcagagttaaggatgt

SEQ ID NO: 590186 - DNA, 25 bp, Homo sapien
ggatgtggaacatactgtactgaga

SEQ ID NO: 590187 - DNA, 25 bp, Homo sapien
aaggcaaggtatacaacagtttcag

SEQ ID NO: 590188 - DNA, 25 bp, Homo sapien
atacaacagtttcagtgtggactga

SEQ ID NO: 590189 - DNA, 25 bp, Homo sapien
catgtacgtagaagggactgcagtt

SEQ ID NO: 590190 - DNA, 25 bp, Homo sapien
ggttttgaagatcccatgctacaga

SEQ ID NO: 590191 - DNA, 25 bp, Homo sapien
gaagatcccatgctacagacagatg

SEQ ID NO: 590192 - DNA, 25 bp, Homo sapien
gctacagacagatgacactcctatt

SEQ ID NO: 590193 - DNA, 25 bp, Homo sapien
cactcctattaaacgctgtctgcaa

SEQ ID NO: 590194 - DNA, 25 bp, Homo sapien
ctgtctgcaaaccaaatggccatac

SEQ ID NO: 590195 - DNA, 25 bp, Homo sapien
atggccatacattgagttactctgg

SEQ ID NO: 590196 - DNA, 25 bp, Homo sapien
ttgagttactctggaccacagatcg

SEQ ID NO: 590197 - DNA, 25 bp, Homo sapien
gatcgctctccttcactaaattaat

SEQ ID NO: 590198 - DNA, 25 bp, Homo sapien
gctggattaagctaaacactggtat

SEQ ID NO: 590199 - DNA, 25 bp, Homo sapien
gctaaacactggtatcactgattaa

SEQ ID NO: 590200 - DNA, 25 bp, Homo sapien
gcaccacactgcaaggctttgcaaa

SEQ ID NO: 590201 - DNA, 25 bp, Homo sapien
ggctttgcaaactttccttccaaag

SEQ ID NO: 590202 - DNA, 25 bp, Homo sapien
gaaggagaccctctggccatctgag

SEQ ID NO: 590203 - DNA, 25 bp, Homo sapien
ccatctgaggctcggtctgaagcaa

SEQ ID NO: 590204 - DNA, 25 bp, Homo sapien
aagcaacagcctcagagcgcaatct

SEQ ID NO: 590205 - DNA, 25 bp, Homo sapien
gagcgcaatctcaggcatgcaggaa

SEQ ID NO: 590206 - DNA, 25 bp, Homo sapien
gtgcaggaaggccacgtgccacata

SEQ ID NO: 590207 - DNA, 25 bp, Homo sapien
gtgccacatacgttatctcacttaa

SEQ ID NO: 590208 - DNA, 25 bp, Homo sapien
atctcacttaatctcattagcagga

SEQ ID NO: 590209 - DNA, 25 bp, Homo sapien
attcctgagcagtttagcccttaat

SEQ ID NO: 590210 - DNA, 25 bp, Homo sapien
gcagtttagcccttaataaagccag

SEQ ID NO: 590211 - DNA, 25 bp, Homo sapien
gaaattggaactcatatactgctag

SEQ ID NO: 590212 - DNA, 25 bp, Homo sapien
attggaactcatatactgctagtta

SEQ ID NO: 590213 - DNA, 25 bp, Homo sapien
taaacatagagttgctgtacagcaa

SEQ ID NO: 590214 - DNA, 25 bp, Homo sapien
tgtacagcaactctatccctaatat

SEQ ID NO: 590215 - DNA, 25 bp, Homo sapien
actctatccctaatatccacacaag

SEQ ID NO: 590216 - DNA, 25 bp, Homo sapien
tatccctaatatccacacaaggtaa

SEQ ID NO: 590217 - DNA, 25 bp, Homo sapien
atatccacacaaggtaaatgaaaac

SEQ ID NO: 590218 - DNA, 25 bp, Homo sapien
acatatgtccatatactaacttgta

SEQ ID NO: 590219 - DNA, 25 bp, Homo sapien
gtccatatactaacttgtacataaa

SEQ ID NO: 590220 - DNA, 25 bp, Homo sapien
aaatgtccattgacaaataagtgga

SEQ ID NO: 590221 - DNA, 25 bp, Homo sapien
aatgtggtatgcctatataatggaa

SEQ ID NO: 590222 - DNA, 25 bp, Homo sapien
ttttactattttaatgacaggtata

SEQ ID NO: 590223 - DNA, 25 bp, Homo sapien
gacaggtatagctgaatattatcca

SEQ ID NO: 590224 - DNA, 25 bp, Homo sapien
ggtatagctgaatattatccatgat

SEQ ID NO: 590225 - DNA, 25 bp, Homo sapien
agctgaatattatccatgatgggtt

SEQ ID NO: 590226 - DNA, 25 bp, Homo sapien
gaatattatccatgatgggttctta

SEQ ID NO: 590227 - DNA, 25 bp, Homo sapien
attatccatgatgggttcttaaaat

SEQ ID NO: 590228 - DNA, 25 bp, Homo sapien
tgatgggttcttaaaatgagttggg

SEQ ID NO: 590229 - DNA, 25 bp, Homo sapien
aagagacttttttcttccttgaatg

SEQ ID NO: 590230 - DNA, 25 bp, Homo sapien
tcataggtgaagccatgtgggccaa

SEQ ID NO: 590231 - DNA, 25 bp, Homo sapien
agttttggcaagctatgtttttaga

SEQ ID NO: 590232 - DNA, 25 bp, Homo sapien
gaattcgttcattagatctgccttt

SEQ ID NO: 590233 - DNA, 25 bp, Homo sapien
gttgcaaacgaacctaaaagtgagt

SEQ ID NO: 590234 - DNA, 25 bp, Homo sapien
aaagtgagtggtgccctttacagag

SEQ ID NO: 590235 - DNA, 25 bp, Homo sapien
taactttgaaagtagctgaggttca

SEQ ID NO: 590236 - DNA, 25 bp, Homo sapien
tgaggttcagttgaaatcagacttt

SEQ ID NO: 590237 - DNA, 25 bp, Homo sapien
gaaatcagactttgctgcacagaaa

SEQ ID NO: 590238 - DNA, 25 bp, Homo sapien
gctgcacagaaactgagtaatttat

SEQ ID NO: 590239 - DNA, 25 bp, Homo sapien
gttttcaccaccatataagattttg

SEQ ID NO: 590240 - DNA, 25 bp, Homo sapien
gattttggttctacttgctatatgc

SEQ ID NO: 590241 - DNA, 25 bp, Homo sapien
cttgctatatgcctcctttgtaaaa

SEQ ID NO: 590242 - DNA, 25 bp, Homo sapien
aaacaccgaggcttactgtagtaga

SEQ ID NO: 590243 - DNA, 25 bp, Homo sapien
aactttagttttgatgatgcacaaa

SEQ ID NO: 590244 - DNA, 25 bp, Homo sapien
tgcagcagcaacaactacaagagtt

SEQ ID NO: 590245 - DNA, 25 bp, Homo sapien
gcagcagcaacaactacaagagttt

SEQ ID NO: 590246 - DNA, 25 bp, Homo sapien
cagcagcaacaactacaagagtttt

SEQ ID NO: 590247 - DNA, 25 bp, Homo sapien
cagcatcctggaaagcaagcgaaag

SEQ ID NO: 590248 - DNA, 25 bp, Homo sapien
agcatcctggaaagcaagcgaaaga

SEQ ID NO: 590249 - DNA, 25 bp, Homo sapien
gcatcctggaaagcaagcgaaagag

SEQ ID NO: 590250 - DNA, 25 bp, Homo sapien
catcctggaaagcaagcgaaagagc

SEQ ID NO: 590251 - DNA, 25 bp, Homo sapien
atcctggaaagcaagcgaaagagca

SEQ ID NO: 590252 - DNA, 25 bp, Homo sapien
ggaaagcaagcgaaagagcagcagc

SEQ ID NO: 590253 - DNA, 25 bp, Homo sapien
gaaagcaagcgaaagagcagcagca

SEQ ID NO: 590254 - DNA, 25 bp, Homo sapien
aaagcaagcgaaagagcagcagcag

SEQ ID NO: 590255 - DNA, 25 bp, Homo sapien
ttggtttgtgctggcggctctgcta

SEQ ID NO: 590256 - DNA, 25 bp, Homo sapien
ggctctgctagcctacaggattctt

SEQ ID NO: 590257 - DNA, 25 bp, Homo sapien
gcctacaggattctttggtgtgtca

SEQ ID NO: 590258 - DNA, 25 bp, Homo sapien
tggtgtgtcaaagcagaactgtctg

SEQ ID NO: 590259 - DNA, 25 bp, Homo sapien
ggagatcatcttgatttctgaagca

SEQ ID NO: 590260 - DNA, 25 bp, Homo sapien
tttctgaagcagcacccaggcatct

SEQ ID NO: 590261 - DNA, 25 bp, Homo sapien
aggcatctcacacatgtgacctggg

SEQ ID NO: 590262 - DNA, 25 bp, Homo sapien
gggcaacaatctacatacacttcaa

SEQ ID NO: 590263 - DNA, 25 bp, Homo sapien
aggacacagggccatcctgcaaaat

SEQ ID NO: 590264 - DNA, 25 bp, Homo sapien
aagctgaagtcaacggaccctacca

SEQ ID NO: 590265 - DNA, 25 bp, Homo sapien
gaccctaccattctgactctagaag

SEQ ID NO: 590266 - DNA, 25 bp, Homo sapien
cactctccaaactgggtatgttcaa

SEQ ID NO: 590267 - DNA, 25 bp, Homo sapien
gggtatgttcaaattccacattatt

SEQ ID NO: 590268 - DNA, 25 bp, Homo sapien
aattccacattattgtcttcatttt

SEQ ID NO: 590269 - DNA, 25 bp, Homo sapien
gtcttcatttttgctcataaaactt

SEQ ID NO: 590270 - DNA, 25 bp, Homo sapien
tcatttttgctcataaaacttgctt

SEQ ID NO: 590271 - DNA, 25 bp, Homo sapien
cctctttctctttctatgtgattta

SEQ ID NO: 590272 - DNA, 25 bp, Homo sapien
ctttctctttctatgtgatttaaat

SEQ ID NO: 590273 - DNA, 25 bp, Homo sapien
gatttaaatgagcactgaggaattc

SEQ ID NO: 590274 - DNA, 25 bp, Homo sapien
gaggaattcagttagctcaggaaaa

SEQ ID NO: 590275 - DNA, 25 bp, Homo sapien
aaataatttgttcctcagagatgat

SEQ ID NO: 590276 - DNA, 25 bp, Homo sapien
cagagatgattcttgagtgtagaaa

SEQ ID NO: 590277 - DNA, 25 bp, Homo sapien
gggtgatgtctgtgtacctgtttat

SEQ ID NO: 590278 - DNA, 25 bp, Homo sapien
acctgtttatgaagcggtacaccgc

SEQ ID NO: 590279 - DNA, 25 bp, Homo sapien
accgcggaggacatgtacaggcccc

SEQ ID NO: 590280 - DNA, 25 bp, Homo sapien
gaggacatgtacaggccccaccctg

SEQ ID NO: 590281 - DNA, 25 bp, Homo sapien
tgagcaactgctccgattactcagg

SEQ ID NO: 590282 - DNA, 25 bp, Homo sapien
aactgctccgattactcaggccagt

SEQ ID NO: 590283 - DNA, 25 bp, Homo sapien
gattactcaggccagttcctacacc

SEQ ID NO: 590284 - DNA, 25 bp, Homo sapien
agttcctacacccagacgcctgggt

SEQ ID NO: 590285 - DNA, 25 bp, Homo sapien
gcctccctgcagatgaacagcaact

SEQ ID NO: 590286 - DNA, 25 bp, Homo sapien
aagtgccccgactatgatcagatgt

SEQ ID NO: 590287 - DNA, 25 bp, Homo sapien
cccgactatgatcagatgtcctctt

SEQ ID NO: 590288 - DNA, 25 bp, Homo sapien
gggaaggctcactaagagggcacca

SEQ ID NO: 590289 - DNA, 25 bp, Homo sapien
ggaaggctcactaagagggcaccaa

SEQ ID NO: 590290 - DNA, 25 bp, Homo sapien
gaaggctcactaagagggcaccaag

SEQ ID NO: 590291 - DNA, 25 bp, Homo sapien
aaggctcactaagagggcaccaagt

SEQ ID NO: 590292 - DNA, 25 bp, Homo sapien
aggctcactaagagggcaccaagtg

SEQ ID NO: 590293 - DNA, 25 bp, Homo sapien
ggctcactaagagggcaccaagtgg

SEQ ID NO: 590294 - DNA, 25 bp, Homo sapien
gctcactaagagggcaccaagtggg

SEQ ID NO: 590295 - DNA, 25 bp, Homo sapien
cactaagagggcaccaagtggggca

SEQ ID NO: 590296 - DNA, 25 bp, Homo sapien
actaagagggcaccaagtggggcaa

SEQ ID NO: 590297 - DNA, 25 bp, Homo sapien
acggagcgctgcttcgtcttctgag

SEQ ID NO: 590298 - DNA, 25 bp, Homo sapien
cggagcgctgcttcgtcttctgagg

SEQ ID NO: 590299 - DNA, 25 bp, Homo sapien
ggagcgctgcttcgtcttctgaggg

SEQ ID NO: 590300 - DNA, 25 bp, Homo sapien
gagcgctgcttcgtcttctgagggc

SEQ ID NO: 590301 - DNA, 25 bp, Homo sapien
agcgctgcttcgtcttctgagggcc

SEQ ID NO: 590302 - DNA, 25 bp, Homo sapien
agatgatccgggaccaccttccacc

SEQ ID NO: 590303 - DNA, 25 bp, Homo sapien
gatgatccgggaccaccttccaccc

SEQ ID NO: 590304 - DNA, 25 bp, Homo sapien
cacgccctgttcacgctcacccagt

SEQ ID NO: 590305 - DNA, 25 bp, Homo sapien
gccctgttcacgctcacccagtcac

SEQ ID NO: 590306 - DNA, 25 bp, Homo sapien
cctgttcacgctcacccagtcacct

SEQ ID NO: 590307 - DNA, 25 bp, Homo sapien
tgttcacgctcacccagtcacctcc

SEQ ID NO: 590308 - DNA, 25 bp, Homo sapien
agcctcgtcacaacacagcctggta

SEQ ID NO: 590309 - DNA, 25 bp, Homo sapien
tcgtcacaacacagcctggtagttg

SEQ ID NO: 590310 - DNA, 25 bp, Homo sapien
acacagcctggtagttggagggtct

SEQ ID NO: 590311 - DNA, 25 bp, Homo sapien
gagggtctgagcctttgttacaacc

SEQ ID NO: 590312 - DNA, 25 bp, Homo sapien
tgagcctttgttacaaccgccctga

SEQ ID NO: 590313 - DNA, 25 bp, Homo sapien
ctgacttagccgcaggactatgcac

SEQ ID NO: 590314 - DNA, 25 bp, Homo sapien
agccgcaggactatgcacctggtgg

SEQ ID NO: 590315 - DNA, 25 bp, Homo sapien
accccaaggctctagatgggcacgt

SEQ ID NO: 590316 - DNA, 25 bp, Homo sapien
aaggctctagatgggcacgtgcatt

SEQ ID NO: 590317 - DNA, 25 bp, Homo sapien
gatgggcacgtgcattgttcaaatg

SEQ ID NO: 590318 - DNA, 25 bp, Homo sapien
tgttcaaatgccgtcataccttggg

SEQ ID NO: 590319 - DNA, 25 bp, Homo sapien
ctccagggctcgtgtgatcctccaa

SEQ ID NO: 590320 - DNA, 25 bp, Homo sapien
agcctctcgaatactctgggactgc

SEQ ID NO: 590321 - DNA, 25 bp, Homo sapien
tctcgaatactctgggactgcaagt

SEQ ID NO: 590322 - DNA, 25 bp, Homo sapien
gactgcaagtgtacaccaccatata

SEQ ID NO: 590323 - DNA, 25 bp, Homo sapien
gtgtacaccaccatatacagcatta

SEQ ID NO: 590324 - DNA, 25 bp, Homo sapien
atacagcattattttttgtgttgtg

SEQ ID NO: 590325 - DNA, 25 bp, Homo sapien
agagatggggtgtctcaccaccttg

SEQ ID NO: 590326 - DNA, 25 bp, Homo sapien
aattacagcctctcaaaggtctggg

SEQ ID NO: 590327 - DNA, 25 bp, Homo sapien
atgccaagcctggtatgctctttaa

SEQ ID NO: 590328 - DNA, 25 bp, Homo sapien
ctttaaatgaaagccctcttctctt

SEQ ID NO: 590329 - DNA, 25 bp, Homo sapien
ttttccccatgaattgtgcacccta

SEQ ID NO: 590330 - DNA, 25 bp, Homo sapien
gaaagctacatgtgtgtctgtccca

SEQ ID NO: 590331 - DNA, 25 bp, Homo sapien
gctacatgtgtgtctgtcccatagg

SEQ ID NO: 590332 - DNA, 25 bp, Homo sapien
catgtgtgtctgtcccatagggaag

SEQ ID NO: 590333 - DNA, 25 bp, Homo sapien
ggaaggagtcatccctgtctcttca

SEQ ID NO: 590334 - DNA, 25 bp, Homo sapien
ctgtctcttcagtgtggcatgttca

SEQ ID NO: 590335 - DNA, 25 bp, Homo sapien
tgtctcttcagtgtggcatgttcag

SEQ ID NO: 590336 - DNA, 25 bp, Homo sapien
gaggaaggaaagtaaccagcgtcat

SEQ ID NO: 590337 - DNA, 25 bp, Homo sapien
aagtaaccagcgtcattctcaattt

SEQ ID NO: 590338 - DNA, 25 bp, Homo sapien
gcgtcattctcaatttacggaaact

SEQ ID NO: 590339 - DNA, 25 bp, Homo sapien
aagaagaaagctttgcgactcatga

SEQ ID NO: 590340 - DNA, 25 bp, Homo sapien
gaaagctttgcgactcatgagaatg

SEQ ID NO: 590341 - DNA, 25 bp, Homo sapien
acagacacgctcttcttccttaagc

SEQ ID NO: 590342 - DNA, 25 bp, Homo sapien
taagcccaggcatacacagacacag

SEQ ID NO: 590343 - DNA, 25 bp, Homo sapien
aagacacacaccagtgtgcacactg

SEQ ID NO: 590344 - DNA, 25 bp, Homo sapien
agtgtgcacactgctctggaatcca

SEQ ID NO: 590345 - DNA, 25 bp, Homo sapien
ggaatccacaggttctataaatatc

SEQ ID NO: 590346 - DNA, 25 bp, Homo sapien
atgcgctggtctgtgatggttacgg

SEQ ID NO: 590347 - DNA, 25 bp, Homo sapien
ggttacggtgatggtgattcctcct

SEQ ID NO: 590348 - DNA, 25 bp, Homo sapien
gtgattcctccttccggaggatggc

SEQ ID NO: 590349 - DNA, 25 bp, Homo sapien
ggcggaggcttcgatgaccatttac

SEQ ID NO: 590350 - DNA, 25 bp, Homo sapien
ggaggcttcgatgaccatttacatt

SEQ ID NO: 590351 - DNA, 25 bp, Homo sapien
acattttacgagtacttattttgag

SEQ ID NO: 590352 - DNA, 25 bp, Homo sapien
acttctgtcaccttacatggatctg

SEQ ID NO: 590353 - DNA, 25 bp, Homo sapien
tgtcaccttacatggatctgttaac

SEQ ID NO: 590354 - DNA, 25 bp, Homo sapien
ggataggttaagcaatgacctgtat

SEQ ID NO: 590355 - DNA, 25 bp, Homo sapien
tgacctgtattatgatagccagttc

SEQ ID NO: 590356 - DNA, 25 bp, Homo sapien
tagccagttcatgatgtctatatag

SEQ ID NO: 590357 - DNA, 25 bp, Homo sapien
atagtaatctcttaggacatggtaa

SEQ ID NO: 590358 - DNA, 25 bp, Homo sapien
ttatgatcatcattagttttgcccc

SEQ ID NO: 590359 - DNA, 25 bp, Homo sapien
ccccatgtgtcaggttcttcattta

SEQ ID NO: 590360 - DNA, 25 bp, Homo sapien
attcttatacttactacgtgctagg

SEQ ID NO: 590361 - DNA, 25 bp, Homo sapien
tatacttactacgtgctaggcacag

SEQ ID NO: 590362 - DNA, 25 bp, Homo sapien
ggcacagtgcgaagagagataatat

SEQ ID NO: 590363 - DNA, 25 bp, Homo sapien
ggcccaggcctgtagtctcagcgct

SEQ ID NO: 590364 - DNA, 25 bp, Homo sapien
gcccaggcctgtagtctcagcgctt

SEQ ID NO: 590365 - DNA, 25 bp, Homo sapien
ccaggcctgtagtctcagcgctttg

SEQ ID NO: 590366 - DNA, 25 bp, Homo sapien
gggccctgtctctgctgagagtaca

SEQ ID NO: 590367 - DNA, 25 bp, Homo sapien
ctgctgagagtacaaaaattggccg

SEQ ID NO: 590368 - DNA, 25 bp, Homo sapien
agtgagctgaaatcaggccaatgcc

SEQ ID NO: 590369 - DNA, 25 bp, Homo sapien
gtgagctgaaatcaggccaatgccc

SEQ ID NO: 590370 - DNA, 25 bp, Homo sapien
tgagctgaaatcaggccaatgccct

SEQ ID NO: 590371 - DNA, 25 bp, Homo sapien
gagctgaaatcaggccaatgccctc

SEQ ID NO: 590372 - DNA, 25 bp, Homo sapien
ctgaaatcaggccaatgccctccag

SEQ ID NO: 590373 - DNA, 25 bp, Homo sapien
tgaaatcaggccaatgccctccagt

SEQ ID NO: 590374 - DNA, 25 bp, Homo sapien
gacctcatttctgctaagcactttg

SEQ ID NO: 590375 - DNA, 25 bp, Homo sapien
tttgttccagttacacagacctgct

SEQ ID NO: 590376 - DNA, 25 bp, Homo sapien
ctgcttctgtaacaccaaggcatct

SEQ ID NO: 590377 - DNA, 25 bp, Homo sapien
accaaggcatcttcttgccctgagg

SEQ ID NO: 590378 - DNA, 25 bp, Homo sapien
gaggcccttacactgtgtatagttt

SEQ ID NO: 590379 - DNA, 25 bp, Homo sapien
tttctatctgcaaagatctttccac

SEQ ID NO: 590380 - DNA, 25 bp, Homo sapien
agatctttccaccaaatacctgcat

SEQ ID NO: 590381 - DNA, 25 bp, Homo sapien
atacctgcatggctagatcttccac

SEQ ID NO: 590382 - DNA, 25 bp, Homo sapien
agatcttccacttctgtccaatctt

SEQ ID NO: 590383 - DNA, 25 bp, Homo sapien
tttcaaagaagcctaccctaatcat

SEQ ID NO: 590384 - DNA, 25 bp, Homo sapien
gcctaccctaatcatctcatttaaa

SEQ ID NO: 590385 - DNA, 25 bp, Homo sapien
gaatgccatgcattttgtagaggct

SEQ ID NO: 590386 - DNA, 25 bp, Homo sapien
atggcataggagtcaatgcctctct

SEQ ID NO: 590387 - DNA, 25 bp, Homo sapien
atgcctctctggtgggctactttaa

SEQ ID NO: 590388 - DNA, 25 bp, Homo sapien
ttctccataacttttatgtccctat

SEQ ID NO: 590389 - DNA, 25 bp, Homo sapien
tgtccctatattttgtgttgtggta

SEQ ID NO: 590390 - DNA, 25 bp, Homo sapien
atttgtgagaggtactttgcattta

SEQ ID NO: 590391 - DNA, 25 bp, Homo sapien
tactttgcatttataccttcaggag

SEQ ID NO: 590392 - DNA, 25 bp, Homo sapien
ccttcaggagacttggttcagcatc

SEQ ID NO: 590393 - DNA, 25 bp, Homo sapien
gacttggttcagcatctagttaatt

SEQ ID NO: 590394 - DNA, 25 bp, Homo sapien
ttaatatatgccatgccaccctttt

SEQ ID NO: 590395 - DNA, 25 bp, Homo sapien
tgtctccctgtatcatattctatgc

SEQ ID NO: 590396 - DNA, 25 bp, Homo sapien
gctccaccaagaagctaggtggttt

SEQ ID NO: 590397 - DNA, 25 bp, Homo sapien
ctccaccaagaagctaggtggtttc

SEQ ID NO: 590398 - DNA, 25 bp, Homo sapien
agctaggtggtttccaggcccctgc

SEQ ID NO: 590399 - DNA, 25 bp, Homo sapien
gaagcctcaggacccaacaggtggc

SEQ ID NO: 590400 - DNA, 25 bp, Homo sapien
agcctcaggacccaacaggtggcag

SEQ ID NO: 590401 - DNA, 25 bp, Homo sapien
gcctcaggacccaacaggtggcagg

SEQ ID NO: 590402 - DNA, 25 bp, Homo sapien
cctcaggacccaacaggtggcaggc

SEQ ID NO: 590403 - DNA, 25 bp, Homo sapien
ctcaggacccaacaggtggcaggca

SEQ ID NO: 590404 - DNA, 25 bp, Homo sapien
tcaggacccaacaggtggcaggcag

SEQ ID NO: 590405 - DNA, 25 bp, Homo sapien
caggacccaacaggtggcaggcagt

SEQ ID NO: 590406 - DNA, 25 bp, Homo sapien
ggcaggcagtggacagggtgcccgc

SEQ ID NO: 590407 - DNA, 25 bp, Homo sapien
cagtgtagagctatgtgtgtccaca

SEQ ID NO: 590408 - DNA, 25 bp, Homo sapien
tgtgtgtccacaccagtcgtgaaag

SEQ ID NO: 590409 - DNA, 25 bp, Homo sapien
caaacgtgaatttaccatctggctg

SEQ ID NO: 590410 - DNA, 25 bp, Homo sapien
aatcattgtctggaggacctagaga

SEQ ID NO: 590411 - DNA, 25 bp, Homo sapien
aagtgttgcataacttccgggctct

SEQ ID NO: 590412 - DNA, 25 bp, Homo sapien
gggctctcacttacgaatgaccttg

SEQ ID NO: 590413 - DNA, 25 bp, Homo sapien
tacgaatgaccttgaagctgctgct

SEQ ID NO: 590414 - DNA, 25 bp, Homo sapien
ggatggcaatgacttgtcccttctc

SEQ ID NO: 590415 - DNA, 25 bp, Homo sapien
gaaatgcaaactgccacacgagtcc

SEQ ID NO: 590416 - DNA, 25 bp, Homo sapien
acacgagtccctgctgtgacttggg

SEQ ID NO: 590417 - DNA, 25 bp, Homo sapien
acttgggtgccatcagtgtagagct

SEQ ID NO: 590418 - DNA, 25 bp, Homo sapien
aaaaattagtattgcctgatgctat

SEQ ID NO: 590419 - DNA, 25 bp, Homo sapien
tgcctgatgctattgaaaccctcga

SEQ ID NO: 590420 - DNA, 25 bp, Homo sapien
tgatgctattgaaaccctcgacgat

SEQ ID NO: 590421 - DNA, 25 bp, Homo sapien
atgctattgaaaccctcgacgatct

SEQ ID NO: 590422 - DNA, 25 bp, Homo sapien
attgaaaccctcgacgatctcagaa

SEQ ID NO: 590423 - DNA, 25 bp, Homo sapien
gaaaccctcgacgatctcagaaagg

SEQ ID NO: 590424 - DNA, 25 bp, Homo sapien
aaccctcgacgatctcagaaaggag

SEQ ID NO: 590425 - DNA, 25 bp, Homo sapien
agtgtttctgacctgtggaatactc

SEQ ID NO: 590426 - DNA, 25 bp, Homo sapien
tgtggaatactctgtctagtttgaa

SEQ ID NO: 590427 - DNA, 25 bp, Homo sapien
aggatgaatttctagctgcattgga

SEQ ID NO: 590428 - DNA, 25 bp, Homo sapien
gaatttctagctgcattggaactag

SEQ ID NO: 590429 - DNA, 25 bp, Homo sapien
tatcaggactgcactctcttctcgg

SEQ ID NO: 590430 - DNA, 25 bp, Homo sapien
catcactcagccagagtcttcagga

SEQ ID NO: 590431 - DNA, 25 bp, Homo sapien
atcactcagccagagtcttcaggac

SEQ ID NO: 590432 - DNA, 25 bp, Homo sapien
tcactcagccagagtcttcaggaca

SEQ ID NO: 590433 - DNA, 25 bp, Homo sapien
actcagccagagtcttcaggacaga

SEQ ID NO: 590434 - DNA, 25 bp, Homo sapien
tcagccagagtcttcaggacagact

SEQ ID NO: 590435 - DNA, 25 bp, Homo sapien
agagtcttcaggacagactccgcat

SEQ ID NO: 590436 - DNA, 25 bp, Homo sapien
gagtcttcaggacagactccgcatg

SEQ ID NO: 590437 - DNA, 25 bp, Homo sapien
acagactccgcatgggacttgtcca

SEQ ID NO: 590438 - DNA, 25 bp, Homo sapien
catgattaaactattggcagattat

SEQ ID NO: 590439 - DNA, 25 bp, Homo sapien
actattggcagattattgctgtgtt

SEQ ID NO: 590440 - DNA, 25 bp, Homo sapien
gaggagccgctggtgctgatgtgtg

SEQ ID NO: 590441 - DNA, 25 bp, Homo sapien
acggagcgctgcttcgtcttctgag

SEQ ID NO: 590442 - DNA, 25 bp, Homo sapien
gagcgctgcttcgtcttctgagggc

SEQ ID NO: 590443 - DNA, 25 bp, Homo sapien
gcttcgtcttctgagggccgggcac

SEQ ID NO: 590444 - DNA, 25 bp, Homo sapien
accgcccccgtgaggagatgatccg

SEQ ID NO: 590445 - DNA, 25 bp, Homo sapien
gtgaggagatgatccgggaccacct

SEQ ID NO: 590446 - DNA, 25 bp, Homo sapien
tgaggagatgatccgggaccacctt

SEQ ID NO: 590447 - DNA, 25 bp, Homo sapien
ctggtgctgatgtgcgcaccccacg

SEQ ID NO: 590448 - DNA, 25 bp, Homo sapien
tggtgctgatgtgcgcaccccacgc

SEQ ID NO: 590449 - DNA, 25 bp, Homo sapien
ggtgctgatgtgcgcaccccacgcc

SEQ ID NO: 590450 - DNA, 25 bp, Homo sapien
gtgctgatgtgcgcaccccacgccc

SEQ ID NO: 590451 - DNA, 25 bp, Homo sapien
ggagaaataagggactcattcaatt

SEQ ID NO: 590452 - DNA, 25 bp, Homo sapien
gggactcattcaattgtaagttttt

SEQ ID NO: 590453 - DNA, 25 bp, Homo sapien
taagagttcatctttttggtaaaat

SEQ ID NO: 590454 - DNA, 25 bp, Homo sapien
aaatgaacacccaagcatgtttgta

SEQ ID NO: 590455 - DNA, 25 bp, Homo sapien
cacccaagcatgtttgtatgcaatt

SEQ ID NO: 590456 - DNA, 25 bp, Homo sapien
gtatgcaattaacgtttgtttcaag

SEQ ID NO: 590457 - DNA, 25 bp, Homo sapien
aacgtttgtttcaagactctgaaga

SEQ ID NO: 590458 - DNA, 25 bp, Homo sapien
gactctgaagagctggcaacaattt

SEQ ID NO: 590459 - DNA, 25 bp, Homo sapien
gagctggcaacaatttgggcaagga

SEQ ID NO: 590460 - DNA, 25 bp, Homo sapien
gtgtctatttctctcaatttgtcta

SEQ ID NO: 590461 - DNA, 25 bp, Homo sapien
ctctcaatttgtctactgtatgaat

SEQ ID NO: 590462 - DNA, 25 bp, Homo sapien
catccaggggcatgtcacttcagtg

SEQ ID NO: 590463 - DNA, 25 bp, Homo sapien
gagtggaaatgcatgtacaccccta

SEQ ID NO: 590464 - DNA, 25 bp, Homo sapien
tggaaatgcatgtacacccctaaga

SEQ ID NO: 590465 - DNA, 25 bp, Homo sapien
gaaatgcatgtacacccctaagatg

SEQ ID NO: 590466 - DNA, 25 bp, Homo sapien
aatgcatgtacacccctaagatgcc

SEQ ID NO: 590467 - DNA, 25 bp, Homo sapien
atgtacacccctaagatgcccatcg

SEQ ID NO: 590468 - DNA, 25 bp, Homo sapien
atcgcgcagccctgcaacatttttg

SEQ ID NO: 590469 - DNA, 25 bp, Homo sapien
tgcaacatttttgactgccctaaat

SEQ ID NO: 590470 - DNA, 25 bp, Homo sapien
acatttttgactgccctaaatggct

SEQ ID NO: 590471 - DNA, 25 bp, Homo sapien
ttgactgccctaaatggctggcaca

SEQ ID NO: 590472 - DNA, 25 bp, Homo sapien
actgccctaaatggctggcacagga

SEQ ID NO: 590473 - DNA, 25 bp, Homo sapien
gtggctccggaatggacactgacat

SEQ ID NO: 590474 - DNA, 25 bp, Homo sapien
acatctaggagacagtccttgccca

SEQ ID NO: 590475 - DNA, 25 bp, Homo sapien
ttgccttcgttgtcactaaagccag

SEQ ID NO: 590476 - DNA, 25 bp, Homo sapien
gctacaaccatctttatgccaacaa

SEQ ID NO: 590477 - DNA, 25 bp, Homo sapien
aagtgtgtagcctgttccaaaccca

SEQ ID NO: 590478 - DNA, 25 bp, Homo sapien
gttccaaacccattagtggtctcac

SEQ ID NO: 590479 - DNA, 25 bp, Homo sapien
tagtggtctcacaggtgccaagttt

SEQ ID NO: 590480 - DNA, 25 bp, Homo sapien
ggtgccaagtttatctgctttcaag

SEQ ID NO: 590481 - DNA, 25 bp, Homo sapien
catagcgaatgctttaactgcggga

SEQ ID NO: 590482 - DNA, 25 bp, Homo sapien
ctctgtctccttggtgggtaaaggc

SEQ ID NO: 590483 - DNA, 25 bp, Homo sapien
gtgggtaaaggcttcctgacccaga

SEQ ID NO: 590484 - DNA, 25 bp, Homo sapien
tgcacggcctatcgcagaaggacaa

SEQ ID NO: 590485 - DNA, 25 bp, Homo sapien
aaggacaagctcttcatgatgcact

SEQ ID NO: 590486 - DNA, 25 bp, Homo sapien
tcatgatgcactgcgtggaggtcct

SEQ ID NO: 590487 - DNA, 25 bp, Homo sapien
cgtggaggtcctgcatcagtttgac

SEQ ID NO: 590488 - DNA, 25 bp, Homo sapien
atcagtttgaccaggtgatgccggg

SEQ ID NO: 590489 - DNA, 25 bp, Homo sapien
gggtcagcatgctcatccgagggct

SEQ ID NO: 590490 - DNA, 25 bp, Homo sapien
atgctcatccgagggcttcctgatg

SEQ ID NO: 590491 - DNA, 25 bp, Homo sapien
agggcttcctgatgtgacggactgt

SEQ ID NO: 590492 - DNA, 25 bp, Homo sapien
tgacggactgtgaagaggcagccct

SEQ ID NO: 590493 - DNA, 25 bp, Homo sapien
ctggatgacctctgtgccgcggaaa

SEQ ID NO: 590494 - DNA, 25 bp, Homo sapien
tctgtgccgcggaaaccgatgtgga

SEQ ID NO: 590495 - DNA, 25 bp, Homo sapien
gagataaagcatgctctggtcctaa

SEQ ID NO: 590496 - DNA, 25 bp, Homo sapien
atgctctggtcctaaatggcagcag

SEQ ID NO: 590497 - DNA, 25 bp, Homo sapien
agaatcttcccaaagtgagagtcag

SEQ ID NO: 590498 - DNA, 25 bp, Homo sapien
tgagagtcaggccacaatacctccc

SEQ ID NO: 590499 - DNA, 25 bp, Homo sapien
cgtctgtgcctgtgtatgttggaga

SEQ ID NO: 590500 - DNA, 25 bp, Homo sapien
agaaggagctttttcatcccaagtg

SEQ ID NO: 590501 - DNA, 25 bp, Homo sapien
gagaggttacatcctctgactgctt

SEQ ID NO: 590502 - DNA, 25 bp, Homo sapien
ctctcctgctgtgaaggccaagtat

SEQ ID NO: 590503 - DNA, 25 bp, Homo sapien
ttcacagaatccctaagctccataa

SEQ ID NO: 590504 - DNA, 25 bp, Homo sapien
gaatccctaagctccataaatcagt

SEQ ID NO: 590505 - DNA, 25 bp, Homo sapien
catcccttgcagctgtaatgaaagc

SEQ ID NO: 590506 - DNA, 25 bp, Homo sapien
cttcagatgcagacaactcattcct

SEQ ID NO: 590507 - DNA, 25 bp, Homo sapien
atgcagacaactcattcctgaatct

SEQ ID NO: 590508 - DNA, 25 bp, Homo sapien
caagatgtcaggatatctgcagggt

SEQ ID NO: 590509 - DNA, 25 bp, Homo sapien
gtcaggatatctgcagggtcaagca

SEQ ID NO: 590510 - DNA, 25 bp, Homo sapien
ctgcagggtcaagcaaagcattttt

SEQ ID NO: 590511 - DNA, 25 bp, Homo sapien
aagcatttttttcacgatggtaata

SEQ ID NO: 590512 - DNA, 25 bp, Homo sapien
aaagagatttctctagcccgctggt

SEQ ID NO: 590513 - DNA, 25 bp, Homo sapien
ttctctagcccgctggtctaaggat

SEQ ID NO: 590514 - DNA, 25 bp, Homo sapien
ctagcccgctggtctaaggatcaga

SEQ ID NO: 590515 - DNA, 25 bp, Homo sapien
cccgctggtctaaggatcagacaga

SEQ ID NO: 590516 - DNA, 25 bp, Homo sapien
gacagagggtggaggtgcttgataa

SEQ ID NO: 590517 - DNA, 25 bp, Homo sapien
acccaatgaggtttagagtttctct

SEQ ID NO: 590518 - DNA, 25 bp, Homo sapien
ttctctagtttttctaggttcgtga

SEQ ID NO: 590519 - DNA, 25 bp, Homo sapien
ctagtttttctaggttcgtgaagag

SEQ ID NO: 590520 - DNA, 25 bp, Homo sapien
aggttcgtgaagagaatgatgtcat

SEQ ID NO: 590521 - DNA, 25 bp, Homo sapien
gaatgatgtcatggaaatactcaaa

SEQ ID NO: 590522 - DNA, 25 bp, Homo sapien
aagaagcagtgcagaaggtaggttc

SEQ ID NO: 590523 - DNA, 25 bp, Homo sapien
gagggaactttcatctgcaggtgct

SEQ ID NO: 590524 - DNA, 25 bp, Homo sapien
gggaactttcatctgcaggtgctac

SEQ ID NO: 590525 - DNA, 25 bp, Homo sapien
gaactttcatctgcaggtgctactg

SEQ ID NO: 590526 - DNA, 25 bp, Homo sapien
tgccatcacacggtacacagaggag

SEQ ID NO: 590527 - DNA, 25 bp, Homo sapien
atcacacggtacacagaggagccac

SEQ ID NO: 590528 - DNA, 25 bp, Homo sapien
ataaataaatatggctgggcgcgat

SEQ ID NO: 590529 - DNA, 25 bp, Homo sapien
cccagcatttggaagaccaagacag

SEQ ID NO: 590530 - DNA, 25 bp, Homo sapien
ccagcatttggaagaccaagacagg

SEQ ID NO: 590531 - DNA, 25 bp, Homo sapien
cagcatttggaagaccaagacaggc

SEQ ID NO: 590532 - DNA, 25 bp, Homo sapien
agcatttggaagaccaagacaggca

SEQ ID NO: 590533 - DNA, 25 bp, Homo sapien
gcatttggaagaccaagacaggcag

SEQ ID NO: 590534 - DNA, 25 bp, Homo sapien
gttcgagatcattctggccaacggg

SEQ ID NO: 590535 - DNA, 25 bp, Homo sapien
ttcgagatcattctggccaacgggg

SEQ ID NO: 590536 - DNA, 25 bp, Homo sapien
tcgagatcattctggccaacggggc

SEQ ID NO: 590537 - DNA, 25 bp, Homo sapien
cgagatcattctggccaacggggcg

SEQ ID NO: 590538 - DNA, 25 bp, Homo sapien
agatcattctggccaacggggcgaa

SEQ ID NO: 590539 - DNA, 25 bp, Homo sapien
tcccatccaagttcatgtatcttct

SEQ ID NO: 590540 - DNA, 25 bp, Homo sapien
gtatcttctgaattctatccgtgaa

SEQ ID NO: 590541 - DNA, 25 bp, Homo sapien
ctatccgtgaatcccttagaggtct

SEQ ID NO: 590542 - DNA, 25 bp, Homo sapien
atcccttagaggtctgtgaattgta

SEQ ID NO: 590543 - DNA, 25 bp, Homo sapien
gttaagaacccctgccctagctaat

SEQ ID NO: 590544 - DNA, 25 bp, Homo sapien
tgccctagctaatcagatccaccaa

SEQ ID NO: 590545 - DNA, 25 bp, Homo sapien
agctaatcagatccaccaatgtttc

SEQ ID NO: 590546 - DNA, 25 bp, Homo sapien
ccaccaatgtttcaaataggactat

SEQ ID NO: 590547 - DNA, 25 bp, Homo sapien
taacttattcaaaggccaatgatac

SEQ ID NO: 590548 - DNA, 25 bp, Homo sapien
ggccaatgatacttcgcataattca

SEQ ID NO: 590549 - DNA, 25 bp, Homo sapien
atagattatatcttactcctaaata

SEQ ID NO: 590550 - DNA, 25 bp, Homo sapien
cttccgctggatggcacagtacatt

SEQ ID NO: 590551 - DNA, 25 bp, Homo sapien
cgctggatggcacagtacattgatt

SEQ ID NO: 590552 - DNA, 25 bp, Homo sapien
ggatggcacagtacattgattaaca

SEQ ID NO: 590553 - DNA, 25 bp, Homo sapien
ggcacagtacattgattaacacaaa

SEQ ID NO: 590554 - DNA, 25 bp, Homo sapien
aacacaaactcacattggttccagg

SEQ ID NO: 590555 - DNA, 25 bp, Homo sapien
caaactcacattggttccaggtctc

SEQ ID NO: 590556 - DNA, 25 bp, Homo sapien
actcacattggttccaggtctcaac

SEQ ID NO: 590557 - DNA, 25 bp, Homo sapien
cagagatttgattgctcaacatgca

SEQ ID NO: 590558 - DNA, 25 bp, Homo sapien
gctcaacatgcataacttgaattca

SEQ ID NO: 590559 - DNA, 25 bp, Homo sapien
gaattcaatagacttttgctggtta

SEQ ID NO: 590560 - DNA, 25 bp, Homo sapien
ttcaatagacttttgctggttataa

SEQ ID NO: 590561 - DNA, 25 bp, Homo sapien
gagcttgaataacctccaggatttg

SEQ ID NO: 590562 - DNA, 25 bp, Homo sapien
gatttggctcataatccaggcctct

SEQ ID NO: 590563 - DNA, 25 bp, Homo sapien
acgtgtgcctgattgatgctccaaa

SEQ ID NO: 590564 - DNA, 25 bp, Homo sapien
gatgctccaaattggcttccacggg

SEQ ID NO: 590565 - DNA, 25 bp, Homo sapien
aaaccttggctgttccagaaactga

SEQ ID NO: 590566 - DNA, 25 bp, Homo sapien
gaattgcttacacactttcttccag

SEQ ID NO: 590567 - DNA, 25 bp, Homo sapien
tacacactttcttccagcgtagcat

SEQ ID NO: 590568 - DNA, 25 bp, Homo sapien
cagcgtagcatctcttcaaacacaa

SEQ ID NO: 590569 - DNA, 25 bp, Homo sapien
tcaaacacaatgctcttccccttga

SEQ ID NO: 590570 - DNA, 25 bp, Homo sapien
tctcagtatgaaactctatgtcttc

SEQ ID NO: 590571 - DNA, 25 bp, Homo sapien
gttgccttaataaagtgctctgtgg

SEQ ID NO: 590572 - DNA, 25 bp, Homo sapien
ggtcattggtgattgaacacaaact

SEQ ID NO: 590573 - DNA, 25 bp, Homo sapien
ttcctctctaattacatggttggtt

SEQ ID NO: 590574 - DNA, 25 bp, Homo sapien
ctctctaattacatggttggttcct

SEQ ID NO: 590575 - DNA, 25 bp, Homo sapien
tggttcctctggcaacaagctccca

SEQ ID NO: 590576 - DNA, 25 bp, Homo sapien
ccaagagtcacctcattagggtaaa

SEQ ID NO: 590577 - DNA, 25 bp, Homo sapien
gagtcacctcattagggtaaacaaa

SEQ ID NO: 590578 - DNA, 25 bp, Homo sapien
gttgttatgaaatcagacaccccta

SEQ ID NO: 590579 - DNA, 25 bp, Homo sapien
tgaaatcagacacccctatcaggaa

SEQ ID NO: 590580 - DNA, 25 bp, Homo sapien
cccctatcaggaaattccaaagatt

SEQ ID NO: 590581 - DNA, 25 bp, Homo sapien
caaagatttaaggagttctgtccct

SEQ ID NO: 590582 - DNA, 25 bp, Homo sapien
gggacaaagaccagatgtatttttt

SEQ ID NO: 590583 - DNA, 25 bp, Homo sapien
tgcctggctgcacattgcaatcact

SEQ ID NO: 590584 - DNA, 25 bp, Homo sapien
gcaatcacttgggaagcctctaaaa

SEQ ID NO: 590585 - DNA, 25 bp, Homo sapien
ggaagcctctaaaaatactgatgcc

SEQ ID NO: 590586 - DNA, 25 bp, Homo sapien
ggctctaccccaagccagttaaaat

SEQ ID NO: 590587 - DNA, 25 bp, Homo sapien
accccaagccagttaaaatctccag

SEQ ID NO: 590588 - DNA, 25 bp, Homo sapien
agatttataatcgaggaggtcctgg

SEQ ID NO: 590589 - DNA, 25 bp, Homo sapien
gtcctggatgaccttggcaaaagca

SEQ ID NO: 590590 - DNA, 25 bp, Homo sapien
tggcaaaagcaaccccaatggcatg

SEQ ID NO: 590591 - DNA, 25 bp, Homo sapien
atgtttaccaagatgatgccagtat

SEQ ID NO: 590592 - DNA, 25 bp, Homo sapien
atgatgccagtatagctagtgagat

SEQ ID NO: 590593 - DNA, 25 bp, Homo sapien
tagctagtgagatgcagcaccccat

SEQ ID NO: 590594 - DNA, 25 bp, Homo sapien
agcactttgggggattgaagcgggc

SEQ ID NO: 590595 - DNA, 25 bp, Homo sapien
gcactttgggggattgaagcgggcg

SEQ ID NO: 590596 - DNA, 25 bp, Homo sapien
ctttgggggattgaagcgggcggat

SEQ ID NO: 590597 - DNA, 25 bp, Homo sapien
tttgggggattgaagcgggcggatc

SEQ ID NO: 590598 - DNA, 25 bp, Homo sapien
ttgggggattgaagcgggcggatca

SEQ ID NO: 590599 - DNA, 25 bp, Homo sapien
atcacctgagtgagcctgaggaggt

SEQ ID NO: 590600 - DNA, 25 bp, Homo sapien
tcacctgagtgagcctgaggaggtc

SEQ ID NO: 590601 - DNA, 25 bp, Homo sapien
cacctgagtgagcctgaggaggtca

SEQ ID NO: 590602 - DNA, 25 bp, Homo sapien
ggctgcggtgaaccatgatcacgcc

SEQ ID NO: 590603 - DNA, 25 bp, Homo sapien
gctgcggtgaaccatgatcacgcca

SEQ ID NO: 590604 - DNA, 25 bp, Homo sapien
ctgcggtgaaccatgatcacgccac

SEQ ID NO: 590605 - DNA, 25 bp, Homo sapien
gaagactgcccaatgtccttagtga

SEQ ID NO: 590606 - DNA, 25 bp, Homo sapien
caacagctaatcacagtccagaatt

SEQ ID NO: 590607 - DNA, 25 bp, Homo sapien
agaagagcctttatctgaagatctg

SEQ ID NO: 590608 - DNA, 25 bp, Homo sapien
gaactgacttgtgaaacctcagcgt

SEQ ID NO: 590609 - DNA, 25 bp, Homo sapien
aaacctcagcgtgaagggacatatc

SEQ ID NO: 590610 - DNA, 25 bp, Homo sapien
ggacatatcactgaccttcataacc

SEQ ID NO: 590611 - DNA, 25 bp, Homo sapien
ataaccactccacaaccatgaatat

SEQ ID NO: 590612 - DNA, 25 bp, Homo sapien
ggagacagccctaaaggaacttact

SEQ ID NO: 590613 - DNA, 25 bp, Homo sapien
aggaacttactaagccagccctttg

SEQ ID NO: 590614 - DNA, 25 bp, Homo sapien
aagccagccctttgggattcagtac

SEQ ID NO: 590615 - DNA, 25 bp, Homo sapien
ctttgggattcagtaccaacaggca

SEQ ID NO: 590616 - DNA, 25 bp, Homo sapien
tgttgattagggaaagttctttaca

SEQ ID NO: 590617 - DNA, 25 bp, Homo sapien
gattagggaaagttctttacataag

SEQ ID NO: 590618 - DNA, 25 bp, Homo sapien
gttctttacataagaattcctgcaa

SEQ ID NO: 590619 - DNA, 25 bp, Homo sapien
tctttacataagaattcctgcaagt

SEQ ID NO: 590620 - DNA, 25 bp, Homo sapien
ctttacataagaattcctgcaagta

SEQ ID NO: 590621 - DNA, 25 bp, Homo sapien
acataagaattcctgcaagtaagtg

SEQ ID NO: 590622 - DNA, 25 bp, Homo sapien
cataagaattcctgcaagtaagtga

SEQ ID NO: 590623 - DNA, 25 bp, Homo sapien
ataagaattcctgcaagtaagtgag

SEQ ID NO: 590624 - DNA, 25 bp, Homo sapien
tcctgcaagtaagtgagtaaagaat

SEQ ID NO: 590625 - DNA, 25 bp, Homo sapien
gacagtttaagaattgtcccagcct

SEQ ID NO: 590626 - DNA, 25 bp, Homo sapien
acagtttaagaattgtcccagcctg

SEQ ID NO: 590627 - DNA, 25 bp, Homo sapien
ggctgggctccgatcttccgtgtct

SEQ ID NO: 590628 - DNA, 25 bp, Homo sapien
ttccgtgtctcttatcagtggcgtt

SEQ ID NO: 590629 - DNA, 25 bp, Homo sapien
ttatcagtggcgtttctcacgtctg

SEQ ID NO: 590630 - DNA, 25 bp, Homo sapien
tctcacgtctgcgtctcagatctaa

SEQ ID NO: 590631 - DNA, 25 bp, Homo sapien
gtctcagatctaacgtggtttcaca

SEQ ID NO: 590632 - DNA, 25 bp, Homo sapien
tggtttcacatcaatccgctttcat

SEQ ID NO: 590633 - DNA, 25 bp, Homo sapien
catgggattttggtctctgtccagt

SEQ ID NO: 590634 - DNA, 25 bp, Homo sapien
tctctgtccagtgacttcgtggtaa

SEQ ID NO: 590635 - DNA, 25 bp, Homo sapien
gacttcgtggtaaatgtaactcagt

SEQ ID NO: 590636 - DNA, 25 bp, Homo sapien
gtaactcagtgtttgcttgcgactt

SEQ ID NO: 590637 - DNA, 25 bp, Homo sapien
gtttgcttgcgacttatttataaat

SEQ ID NO: 590638 - DNA, 25 bp, Homo sapien
ctattccaggaatcaaacagttatg

SEQ ID NO: 590639 - DNA, 25 bp, Homo sapien
tcaaacagttatgttccagtgcctt

SEQ ID NO: 590640 - DNA, 25 bp, Homo sapien
taatctcatcagaattctccctata

SEQ ID NO: 590641 - DNA, 25 bp, Homo sapien
gaattctccctataaactgtttcct

SEQ ID NO: 590642 - DNA, 25 bp, Homo sapien
tctccctataaactgtttcctcaaa

SEQ ID NO: 590643 - DNA, 25 bp, Homo sapien
gaagtgagaatttcctaattgataa

SEQ ID NO: 590644 - DNA, 25 bp, Homo sapien
ataatatggcatttactttggagaa

SEQ ID NO: 590645 - DNA, 25 bp, Homo sapien
ctttggagaaggaactagtcaccct

SEQ ID NO: 590646 - DNA, 25 bp, Homo sapien
gagaaggaactagtcacccttagtt

SEQ ID NO: 590647 - DNA, 25 bp, Homo sapien
ttttatgcagaggtgtgaagtgagc

SEQ ID NO: 590648 - DNA, 25 bp, Homo sapien
aagagtagtgtcgtcgcggctgctt

SEQ ID NO: 590649 - DNA, 25 bp, Homo sapien
gaaattgttttcaaagagaagggca

SEQ ID NO: 590650 - DNA, 25 bp, Homo sapien
agaagggcagctgcttagagtgaac

SEQ ID NO: 590651 - DNA, 25 bp, Homo sapien
ggcagctgcttagagtgaacatgtc

SEQ ID NO: 590652 - DNA, 25 bp, Homo sapien
gctgcttagagtgaacatgtctatg

SEQ ID NO: 590653 - DNA, 25 bp, Homo sapien
gagtgaacatgtctatggactttaa

SEQ ID NO: 590654 - DNA, 25 bp, Homo sapien
taaaaagaccccacgcaatttgact

SEQ ID NO: 590655 - DNA, 25 bp, Homo sapien
aaagaccccacgcaatttgactttg

SEQ ID NO: 590656 - DNA, 25 bp, Homo sapien
agaccccacgcaatttgactttgtg

SEQ ID NO: 590657 - DNA, 25 bp, Homo sapien
cacgcaatttgactttgtggcaata

SEQ ID NO: 590658 - DNA, 25 bp, Homo sapien
cgcaatttgactttgtggcaataga

SEQ ID NO: 590659 - DNA, 25 bp, Homo sapien
gttcatattaattgaggatttccct

SEQ ID NO: 590660 - DNA, 25 bp, Homo sapien
gttttcactctatattgtagctctc

SEQ ID NO: 590661 - DNA, 25 bp, Homo sapien
atattgtagctctctttggtatcag

SEQ ID NO: 590662 - DNA, 25 bp, Homo sapien
tttggtatcagaaatggtcaggcag

SEQ ID NO: 590663 - DNA, 25 bp, Homo sapien
aatggtcaggcaggagtactcgttt

SEQ ID NO: 590664 - DNA, 25 bp, Homo sapien
gagtactcgtttttcccattggaag

SEQ ID NO: 590665 - DNA, 25 bp, Homo sapien
gccaatgtttggcaattatatcaac

SEQ ID NO: 590666 - DNA, 25 bp, Homo sapien
ttacattgttaattgaaccaagctc

SEQ ID NO: 590667 - DNA, 25 bp, Homo sapien
gaaccaagctcaaggtctttttcat

SEQ ID NO: 590668 - DNA, 25 bp, Homo sapien
gtctttttcattccttacagtcaca

SEQ ID NO: 590669 - DNA, 25 bp, Homo sapien
ttcattccttacagtcacatatcag

SEQ ID NO: 590670 - DNA, 25 bp, Homo sapien
agtcacatatcagacaagtttttga

SEQ ID NO: 590671 - DNA, 25 bp, Homo sapien
tatgtatctttctcccaaaagacac

SEQ ID NO: 590672 - DNA, 25 bp, Homo sapien
atgtatctttctcccaaaagacaca

SEQ ID NO: 590673 - DNA, 25 bp, Homo sapien
ctttctcccaaaagacacacataca

SEQ ID NO: 590674 - DNA, 25 bp, Homo sapien
tttctcccaaaagacacacatacaa

SEQ ID NO: 590675 - DNA, 25 bp, Homo sapien
ttctcccaaaagacacacatacaaa

SEQ ID NO: 590676 - DNA, 25 bp, Homo sapien
tctcccaaaagacacacatacaaaa

SEQ ID NO: 590677 - DNA, 25 bp, Homo sapien
taatgtgataaataatgtccttcat

SEQ ID NO: 590678 - DNA, 25 bp, Homo sapien
taaataatgtccttcataaagtgaa

SEQ ID NO: 590679 - DNA, 25 bp, Homo sapien
aagtgaaggatggaaatcatacaaa

SEQ ID NO: 590680 - DNA, 25 bp, Homo sapien
agtgaaggatggaaatcatacaaaa

SEQ ID NO: 590681 - DNA, 25 bp, Homo sapien
aatcatacaaaaatgcaaaacagct

SEQ ID NO: 590682 - DNA, 25 bp, Homo sapien
ggatctttagcaagtccaaggatga

SEQ ID NO: 590683 - DNA, 25 bp, Homo sapien
gggcatatttatgaaccacaaaaac

SEQ ID NO: 590684 - DNA, 25 bp, Homo sapien
aagggaggtgatctacagctgtcat

SEQ ID NO: 590685 - DNA, 25 bp, Homo sapien
ggaggtgatctacagctgtcattag

SEQ ID NO: 590686 - DNA, 25 bp, Homo sapien
ctacagctgtcattagattattgaa

SEQ ID NO: 590687 - DNA, 25 bp, Homo sapien
gattattgaaggagcctatgatcca

SEQ ID NO: 590688 - DNA, 25 bp, Homo sapien
ggagcctatgatccaaaaataatat

SEQ ID NO: 590689 - DNA, 25 bp, Homo sapien
aacttcaaacagatattttcagagt

SEQ ID NO: 590690 - DNA, 25 bp, Homo sapien
aatatgcacaaggatgttcatcatg

SEQ ID NO: 590691 - DNA, 25 bp, Homo sapien
aaggatgttcatcatggcatagaga

SEQ ID NO: 590692 - DNA, 25 bp, Homo sapien
tcatcatggcatagagagagtggaa

SEQ ID NO: 590693 - DNA, 25 bp, Homo sapien
gctggacatcatggcacacgcctat

SEQ ID NO: 590694 - DNA, 25 bp, Homo sapien
ctagctactagggcagctgagacac

SEQ ID NO: 590695 - DNA, 25 bp, Homo sapien
tagctactagggcagctgagacaca

SEQ ID NO: 590696 - DNA, 25 bp, Homo sapien
agctactagggcagctgagacacaa

SEQ ID NO: 590697 - DNA, 25 bp, Homo sapien
gctactagggcagctgagacacaag

SEQ ID NO: 590698 - DNA, 25 bp, Homo sapien
ctactagggcagctgagacacaaga

SEQ ID NO: 590699 - DNA, 25 bp, Homo sapien
tactagggcagctgagacacaagaa

SEQ ID NO: 590700 - DNA, 25 bp, Homo sapien
tgtgctactgcactctagattgggt

SEQ ID NO: 590701 - DNA, 25 bp, Homo sapien
gtgctactgcactctagattgggtg

SEQ ID NO: 590702 - DNA, 25 bp, Homo sapien
tctagattgggtgacagagccttct

SEQ ID NO: 590703 - DNA, 25 bp, Homo sapien
ctagattgggtgacagagccttctc

SEQ ID NO: 590704 - DNA, 25 bp, Homo sapien
ggcactccatgtccctgcccctgct

SEQ ID NO: 590705 - DNA, 25 bp, Homo sapien
gcccctgctgcagggtctatcctca

SEQ ID NO: 590706 - DNA, 25 bp, Homo sapien
ctgaagcaaaagattccgggggcaa

SEQ ID NO: 590707 - DNA, 25 bp, Homo sapien
gaagcaaaagattccgggggcaaag

SEQ ID NO: 590708 - DNA, 25 bp, Homo sapien
atactgtcagagaactggctcttca

SEQ ID NO: 590709 - DNA, 25 bp, Homo sapien
tactgtcagagaactggctcttcag

SEQ ID NO: 590710 - DNA, 25 bp, Homo sapien
actgtcagagaactggctcttcagc

SEQ ID NO: 590711 - DNA, 25 bp, Homo sapien
ctgtcagagaactggctcttcagcc

SEQ ID NO: 590712 - DNA, 25 bp, Homo sapien
tgtcagagaactggctcttcagccc

SEQ ID NO: 590713 - DNA, 25 bp, Homo sapien
accccgacgggcactccatgtccct

SEQ ID NO: 590714 - DNA, 25 bp, Homo sapien
cgacgggcactccatgtccctgccc

SEQ ID NO: 590715 - DNA, 25 bp, Homo sapien
gagacttttattctctagctccgca

SEQ ID NO: 590716 - DNA, 25 bp, Homo sapien
tagctccgcagcatttgcaaagttt

SEQ ID NO: 590717 - DNA, 25 bp, Homo sapien
tcagcctattatccatctgtaccat

SEQ ID NO: 590718 - DNA, 25 bp, Homo sapien
attaccttccaccattcagaatcac

SEQ ID NO: 590719 - DNA, 25 bp, Homo sapien
aatcacgttgggaacactagccaag

SEQ ID NO: 590720 - DNA, 25 bp, Homo sapien
gccaagatgatattgctaccattct

SEQ ID NO: 590721 - DNA, 25 bp, Homo sapien
taccattctatctaaagtgccactg

SEQ ID NO: 590722 - DNA, 25 bp, Homo sapien
gtgccactggagaacaactacctga

SEQ ID NO: 590723 - DNA, 25 bp, Homo sapien
aatttaccaagatctgtttcaggac

SEQ ID NO: 590724 - DNA, 25 bp, Homo sapien
tgtttcaggactgccatttctacca

SEQ ID NO: 590725 - DNA, 25 bp, Homo sapien
catttctaccactagacccttggac

SEQ ID NO: 590726 - DNA, 25 bp, Homo sapien
ggtcctgagcatgagatcttctgtt

SEQ ID NO: 590727 - DNA, 25 bp, Homo sapien
tgttcccatggaggcagagtgtccc

SEQ ID NO: 590728 - DNA, 25 bp, Homo sapien
cccagtaagcggatgtgttcaccaa

SEQ ID NO: 590729 - DNA, 25 bp, Homo sapien
aaagcactctgagccttgttgttta

SEQ ID NO: 590730 - DNA, 25 bp, Homo sapien
gggttttgtggagatcccattacat

SEQ ID NO: 590731 - DNA, 25 bp, Homo sapien
gtggagatcccattacatagtcatg

SEQ ID NO: 590732 - DNA, 25 bp, Homo sapien
gattaaacaattggccataagggat

SEQ ID NO: 590733 - DNA, 25 bp, Homo sapien
ggattgaactcaaatttccagcccc

SEQ ID NO: 590734 - DNA, 25 bp, Homo sapien
tggttcctcaggcaaccagttgcta

SEQ ID NO: 590735 - DNA, 25 bp, Homo sapien
gcaaccagttgctataccttagctg

SEQ ID NO: 590736 - DNA, 25 bp, Homo sapien
accttagctgtctatggaccatgca

SEQ ID NO: 590737 - DNA, 25 bp, Homo sapien
ctgctgacctcacagatcaacgtat

SEQ ID NO: 590738 - DNA, 25 bp, Homo sapien
gacctcacagatcaacgtattaaca

SEQ ID NO: 590739 - DNA, 25 bp, Homo sapien
tcacagatcaacgtattaacaagac

SEQ ID NO: 590740 - DNA, 25 bp, Homo sapien
ttaacaagactaaccatgatggatg

SEQ ID NO: 590741 - DNA, 25 bp, Homo sapien
aaccatgatggatggactgctccag

SEQ ID NO: 590742 - DNA, 25 bp, Homo sapien
atgatggatggactgctccagtccc

SEQ ID NO: 590743 - DNA, 25 bp, Homo sapien
ccactgccaagtacaatgacctctt

SEQ ID NO: 590744 - DNA, 25 bp, Homo sapien
agtacaatgacctcttcctctgaaa

SEQ ID NO: 590745 - DNA, 25 bp, Homo sapien
tgacctcttcctctgaaacatcagt

SEQ ID NO: 590746 - DNA, 25 bp, Homo sapien
tctgaaacatcagtgttaccctcat

SEQ ID NO: 590747 - DNA, 25 bp, Homo sapien
ctgtccccagcatgtgactggtcac

SEQ ID NO: 590748 - DNA, 25 bp, Homo sapien
tgctctgccgcccaggctggggttc

SEQ ID NO: 590749 - DNA, 25 bp, Homo sapien
ctctgccgcccaggctggggttcag

SEQ ID NO: 590750 - DNA, 25 bp, Homo sapien
tctgccgcccaggctggggttcagt

SEQ ID NO: 590751 - DNA, 25 bp, Homo sapien
gggttcagtggtgcagtctccgctc

SEQ ID NO: 590752 - DNA, 25 bp, Homo sapien
ggttcagtggtgcagtctccgctca

SEQ ID NO: 590753 - DNA, 25 bp, Homo sapien
gttcagtggtgcagtctccgctcac

SEQ ID NO: 590754 - DNA, 25 bp, Homo sapien
ttcagtggtgcagtctccgctcact

SEQ ID NO: 590755 - DNA, 25 bp, Homo sapien
tgtattttttggtgcagatagggtt

SEQ ID NO: 590756 - DNA, 25 bp, Homo sapien
gtattttttggtgcagatagggttt

SEQ ID NO: 590757 - DNA, 25 bp, Homo sapien
attttttggtgcagatagggtttca

SEQ ID NO: 590758 - DNA, 25 bp, Homo sapien
ttttttggtgcagatagggtttcac

SEQ ID NO: 590759 - DNA, 25 bp, Homo sapien
cttaaccatttatatttggcttatg

SEQ ID NO: 590760 - DNA, 25 bp, Homo sapien
atttggcttatgacatttaacccct

SEQ ID NO: 590761 - DNA, 25 bp, Homo sapien
ggcttatgacatttaacccctaagg

SEQ ID NO: 590762 - DNA, 25 bp, Homo sapien
tatgacatttaacccctaaggagtt

SEQ ID NO: 590763 - DNA, 25 bp, Homo sapien
ctaaggagttgtttttctcacttgt

SEQ ID NO: 590764 - DNA, 25 bp, Homo sapien
ggagttgtttttctcacttgttatt

SEQ ID NO: 590765 - DNA, 25 bp, Homo sapien
gttgtttttctcacttgttattatc

SEQ ID NO: 590766 - DNA, 25 bp, Homo sapien
ttctcacttgttattatcaaaccta

SEQ ID NO: 590767 - DNA, 25 bp, Homo sapien
ggttgtgacaataactgagggaact

SEQ ID NO: 590768 - DNA, 25 bp, Homo sapien
caataactgagggaactgatgttct

SEQ ID NO: 590769 - DNA, 25 bp, Homo sapien
ggaactgatgttctgaataaatgat

SEQ ID NO: 590770 - DNA, 25 bp, Homo sapien
gagctgtgcccatgaactctttttt

SEQ ID NO: 590771 - DNA, 25 bp, Homo sapien
ggtgattctaaagtcagccaggatt

SEQ ID NO: 590772 - DNA, 25 bp, Homo sapien
cactgttgcttttgttcaaggtaac

SEQ ID NO: 590773 - DNA, 25 bp, Homo sapien
cattgtaattatattcacgatgatt

SEQ ID NO: 590774 - DNA, 25 bp, Homo sapien
tgtaattatattcacgatgatttcc

SEQ ID NO: 590775 - DNA, 25 bp, Homo sapien
tattcacgatgatttccactcgcgc

SEQ ID NO: 590776 - DNA, 25 bp, Homo sapien
cactcgcgctctctcagttggatgt

SEQ ID NO: 590777 - DNA, 25 bp, Homo sapien
actcgcgctctctcagttggatgtc

SEQ ID NO: 590778 - DNA, 25 bp, Homo sapien
tcgcgctctctcagttggatgtctt

SEQ ID NO: 590779 - DNA, 25 bp, Homo sapien
gcgctctctcagttggatgtctttt

SEQ ID NO: 590780 - DNA, 25 bp, Homo sapien
cgctctctcagttggatgtctttta

SEQ ID NO: 590781 - DNA, 25 bp, Homo sapien
tggactcagcccctaggtgatatta

SEQ ID NO: 590782 - DNA, 25 bp, Homo sapien
gatattaccctattcttctgcttta

SEQ ID NO: 590783 - DNA, 25 bp, Homo sapien
tattcttctgctttagcgctgctca

SEQ ID NO: 590784 - DNA, 25 bp, Homo sapien
gaattgtaacgtatcaccgggcctt

SEQ ID NO: 590785 - DNA, 25 bp, Homo sapien
ccttatatccaggtgatgtgaatct

SEQ ID NO: 590786 - DNA, 25 bp, Homo sapien
ctgagccctacacccaaatatgtga

SEQ ID NO: 590787 - DNA, 25 bp, Homo sapien
aaatatgtgactcccttgtctgtgt

SEQ ID NO: 590788 - DNA, 25 bp, Homo sapien
gtctggcccatatcagccattgtga

SEQ ID NO: 590789 - DNA, 25 bp, Homo sapien
gccattgtgacatgttgcttggtct

SEQ ID NO: 590790 - DNA, 25 bp, Homo sapien
tgcttggtctaacacccgagttata

SEQ ID NO: 590791 - DNA, 25 bp, Homo sapien
agttatataactcttgtgccctggc

SEQ ID NO: 590792 - DNA, 25 bp, Homo sapien
ctttggtgttctagcatgacttaga

SEQ ID NO: 590793 - DNA, 25 bp, Homo sapien
atgacttagaaggtgtgcacttatt

SEQ ID NO: 590794 - DNA, 25 bp, Homo sapien
gaaggtgtgcacttattttgaaagt

SEQ ID NO: 590795 - DNA, 25 bp, Homo sapien
acttattttgaaagtgcagtgggca

SEQ ID NO: 590796 - DNA, 25 bp, Homo sapien
gcagtgggcatatttgacaattcag

SEQ ID NO: 590797 - DNA, 25 bp, Homo sapien
gtctccatttgaaaggacaacctat

SEQ ID NO: 590798 - DNA, 25 bp, Homo sapien
aggacaacctattagcgtgctagaa

SEQ ID NO: 590799 - DNA, 25 bp, Homo sapien
attagcgtgctagaacataaatgta

SEQ ID NO: 590800 - DNA, 25 bp, Homo sapien
gaactcgtaagaaaatctagattgc

SEQ ID NO: 590801 - DNA, 25 bp, Homo sapien
tattcaaatgcttaggtacattcaa

SEQ ID NO: 590802 - DNA, 25 bp, Homo sapien
gtacattcaatttgttgacttgcca

SEQ ID NO: 590803 - DNA, 25 bp, Homo sapien
aagggaagatgcacatcagcttcag

SEQ ID NO: 590804 - DNA, 25 bp, Homo sapien
gatgcacatcagcttcaggatattt

SEQ ID NO: 590805 - DNA, 25 bp, Homo sapien
caggatatttagatatgtctgggaa

SEQ ID NO: 590806 - DNA, 25 bp, Homo sapien
ggaacggtatacacgaggatgtttc

SEQ ID NO: 590807 - DNA, 25 bp, Homo sapien
acgaggatgtttcaactgtttctga

SEQ ID NO: 590808 - DNA, 25 bp, Homo sapien
ggatgtttcaactgtttctgaaata

SEQ ID NO: 590809 - DNA, 25 bp, Homo sapien
acaagcaaaattttcgtatctgttt

SEQ ID NO: 590810 - DNA, 25 bp, Homo sapien
tcgtatctgtttaatctgtgggtga

SEQ ID NO: 590811 - DNA, 25 bp, Homo sapien
aatctgtgggtgatatttacatggg

SEQ ID NO: 590812 - DNA, 25 bp, Homo sapien
tttacatgggtgtttatattctctg

SEQ ID NO: 590813 - DNA, 25 bp, Homo sapien
aactaaaaacacaagagggtctcat

SEQ ID NO: 590814 - DNA, 25 bp, Homo sapien
gaagagagttatatctatgtctgtg

SEQ ID NO: 590815 - DNA, 25 bp, Homo sapien
gttatatctatgtctgtggtgggca

SEQ ID NO: 590816 - DNA, 25 bp, Homo sapien
tatatctatgtctgtggtgggcatg

SEQ ID NO: 590817 - DNA, 25 bp, Homo sapien
tatctatgtctgtggtgggcatggt

SEQ ID NO: 590818 - DNA, 25 bp, Homo sapien
atcctgactactcagatgtctgagg

SEQ ID NO: 590819 - DNA, 25 bp, Homo sapien
ctgactactcagatgtctgaggcac

SEQ ID NO: 590820 - DNA, 25 bp, Homo sapien
aggcacgagaatcacgggatgaatc

SEQ ID NO: 590821 - DNA, 25 bp, Homo sapien
agaatcacgggatgaatcacgggat

SEQ ID NO: 590822 - DNA, 25 bp, Homo sapien
tcacgggatgaatcacgggatggct

SEQ ID NO: 590823 - DNA, 25 bp, Homo sapien
gatgaatcacgggatggctgaatat

SEQ ID NO: 590824 - DNA, 25 bp, Homo sapien
tgaatcacgggatggctgaatatgg

SEQ ID NO: 590825 - DNA, 25 bp, Homo sapien
tagatgcttgtcttacaggtaagga

SEQ ID NO: 590826 - DNA, 25 bp, Homo sapien
aggaatgatcttaggcttgtctgta

SEQ ID NO: 590827 - DNA, 25 bp, Homo sapien
taggcttgtctgtatatgtgcataa

SEQ ID NO: 590828 - DNA, 25 bp, Homo sapien
gaagctagaatggttgacttataaa

SEQ ID NO: 590829 - DNA, 25 bp, Homo sapien
aaaccttaacatggagatttatatt

SEQ ID NO: 590830 - DNA, 25 bp, Homo sapien
agcagttttatatttgcatggcatt

SEQ ID NO: 590831 - DNA, 25 bp, Homo sapien
tttgcatggcatttaattcgatcat

SEQ ID NO: 590832 - DNA, 25 bp, Homo sapien
tggcatttaattcgatcattgttta

SEQ ID NO: 590833 - DNA, 25 bp, Homo sapien
tcaagttttgctgcctataaataat

SEQ ID NO: 590834 - DNA, 25 bp, Homo sapien
tttgctgcctataaataatactgta

SEQ ID NO: 590835 - DNA, 25 bp, Homo sapien
tattatctttaatcatgagtacttc

SEQ ID NO: 590836 - DNA, 25 bp, Homo sapien
ggcgaagttgccacactggtttaag

SEQ ID NO: 590837 - DNA, 25 bp, Homo sapien
gaagttgccacactggtttaagaaa

SEQ ID NO: 590838 - DNA, 25 bp, Homo sapien
tcactctctcttgctaatgcaggtc

SEQ ID NO: 590839 - DNA, 25 bp, Homo sapien
gctaatgcaggtctcatcaggaaaa

SEQ ID NO: 590840 - DNA, 25 bp, Homo sapien
aagaggtttttctacgtatctgtct

SEQ ID NO: 590841 - DNA, 25 bp, Homo sapien
tttctacgtatctgtcttttcccct

SEQ ID NO: 590842 - DNA, 25 bp, Homo sapien
gaaagtgcaggttagataatactac

SEQ ID NO: 590843 - DNA, 25 bp, Homo sapien
gataatactacatttgagccatcta

SEQ ID NO: 590844 - DNA, 25 bp, Homo sapien
gagccatctagtaactcaagcgaca

SEQ ID NO: 590845 - DNA, 25 bp, Homo sapien
gtaactcaagcgacaataggaaaca

SEQ ID NO: 590846 - DNA, 25 bp, Homo sapien
gaaacaggttccgataggatattta

SEQ ID NO: 590847 - DNA, 25 bp, Homo sapien
gtggataaagccctcccatagagag

SEQ ID NO: 590848 - DNA, 25 bp, Homo sapien
agccctcccatagagagtgtaacgt

SEQ ID NO: 590849 - DNA, 25 bp, Homo sapien
taatatttgggtgccctttcagggt

SEQ ID NO: 590850 - DNA, 25 bp, Homo sapien
tcagggttaggtcccactttgttca

SEQ ID NO: 590851 - DNA, 25 bp, Homo sapien
gtcccactttgttcaaggaatgctg

SEQ ID NO: 590852 - DNA, 25 bp, Homo sapien
tgctgtatgcatgggtagattatta

SEQ ID NO: 590853 - DNA, 25 bp, Homo sapien
gattattaataagatggtggcccca

SEQ ID NO: 590854 - DNA, 25 bp, Homo sapien
tggtggccccagtaaatgttggtgt

SEQ ID NO: 590855 - DNA, 25 bp, Homo sapien
gtgggaagagctgcttgctgtaaat

SEQ ID NO: 590856 - DNA, 25 bp, Homo sapien
tgctgtaaatagtggctcctctgct

SEQ ID NO: 590857 - DNA, 25 bp, Homo sapien
cagcagttttgtgaagtcagttgac

SEQ ID NO: 590858 - DNA, 25 bp, Homo sapien
gcattacacaaggtgctcaagctac

SEQ ID NO: 590859 - DNA, 25 bp, Homo sapien
aaggtgctcaagctacaatggcaaa

SEQ ID NO: 590860 - DNA, 25 bp, Homo sapien
gctcaagctacaatggcaaaccaag

SEQ ID NO: 590861 - DNA, 25 bp, Homo sapien
aagctacaatggcaaaccaaggaga

SEQ ID NO: 590862 - DNA, 25 bp, Homo sapien
tataggttaatttttcagttgtggt

SEQ ID NO: 590863 - DNA, 25 bp, Homo sapien
ttaatttttcagttgtggtacacct

SEQ ID NO: 590864 - DNA, 25 bp, Homo sapien
ttttcagttgtggtacaccttgaat

SEQ ID NO: 590865 - DNA, 25 bp, Homo sapien
gttgtggtacaccttgaattttaca

SEQ ID NO: 590866 - DNA, 25 bp, Homo sapien
tctttctcttacacaggcaaagcaa

SEQ ID NO: 590867 - DNA, 25 bp, Homo sapien
ttctcttacacaggcaaagcaaatt

SEQ ID NO: 590868 - DNA, 25 bp, Homo sapien
gaattggagcactgaatataacatc

SEQ ID NO: 590869 - DNA, 25 bp, Homo sapien
gagacacagagtaatacagggcaat

SEQ ID NO: 590870 - DNA, 25 bp, Homo sapien
gggcaataatgcctacatgtctgct

SEQ ID NO: 590871 - DNA, 25 bp, Homo sapien
acatgtctgcttcttgtaagaccaa

SEQ ID NO: 590872 - DNA, 25 bp, Homo sapien
gcttcttgtaagaccaatgaaccta

SEQ ID NO: 590873 - DNA, 25 bp, Homo sapien
atgaacctaatgagcttttaccaag

SEQ ID NO: 590874 - DNA, 25 bp, Homo sapien
atgagcttttaccaagacaaggaaa

SEQ ID NO: 590875 - DNA, 25 bp, Homo sapien
gcagacataattacagatgttgcaa

SEQ ID NO: 590876 - DNA, 25 bp, Homo sapien
gaacaactttatgctagtcagacaa

SEQ ID NO: 590877 - DNA, 25 bp, Homo sapien
ttaacagcttacagtagcccaagca

SEQ ID NO: 590878 - DNA, 25 bp, Homo sapien
ttacagtagcccaagcaggtgcagg

SEQ ID NO: 590879 - DNA, 25 bp, Homo sapien
tagcccaagcaggtgcagggaaaat

SEQ ID NO: 590880 - DNA, 25 bp, Homo sapien
cggccaccgcccccgtgaggagatg

SEQ ID NO: 590881 - DNA, 25 bp, Homo sapien
ggccaccgcccccgtgaggagatga

SEQ ID NO: 590882 - DNA, 25 bp, Homo sapien
gccaccgcccccgtgaggagatgat

SEQ ID NO: 590883 - DNA, 25 bp, Homo sapien
ccaccgcccccgtgaggagatgatc

SEQ ID NO: 590884 - DNA, 25 bp, Homo sapien
caccgcccccgtgaggagatgatcc

SEQ ID NO: 590885 - DNA, 25 bp, Homo sapien
accgcccccgtgaggagatgatccg

SEQ ID NO: 590886 - DNA, 25 bp, Homo sapien
gctggtgctgatgtgcgcaccccac

SEQ ID NO: 590887 - DNA, 25 bp, Homo sapien
ctggtgctgatgtgcgcaccccacg

SEQ ID NO: 590888 - DNA, 25 bp, Homo sapien
tggtgctgatgtgcgcaccccacgc

SEQ ID NO: 590889 - DNA, 25 bp, Homo sapien
ggtgctgatgtgcgcaccccacgcc

SEQ ID NO: 590890 - DNA, 25 bp, Homo sapien
gtgctgatgtgcgcaccccacgccc

SEQ ID NO: 590891 - DNA, 25 bp, Homo sapien
tgcatagtacgctgtcccaaagggt

SEQ ID NO: 590892 - DNA, 25 bp, Homo sapien
atagtacgctgtcccaaagggtcaa

SEQ ID NO: 590893 - DNA, 25 bp, Homo sapien
gggtcaagggtcaaggtagtctcca

SEQ ID NO: 590894 - DNA, 25 bp, Homo sapien
gtagtctccagaagtcctcatccat

SEQ ID NO: 590895 - DNA, 25 bp, Homo sapien
gaagtcctcatccatccctctaaga

SEQ ID NO: 590896 - DNA, 25 bp, Homo sapien
gaccaaaggcctgtaaactctatgt

SEQ ID NO: 590897 - DNA, 25 bp, Homo sapien
aggcctgtaaactctatgttgctgc

SEQ ID NO: 590898 - DNA, 25 bp, Homo sapien
tatgttgctgccagccacaatggct

SEQ ID NO: 590899 - DNA, 25 bp, Homo sapien
ttgctgccagccacaatggctcacg

SEQ ID NO: 590900 - DNA, 25 bp, Homo sapien
agtgagtgattattgtgccattgca

SEQ ID NO: 590901 - DNA, 25 bp, Homo sapien
ataaactatgttatttagccattga

SEQ ID NO: 590902 - DNA, 25 bp, Homo sapien
tccccgagagccagtgtaccagtct

SEQ ID NO: 590903 - DNA, 25 bp, Homo sapien
gagccagtgtaccagtctccccaga

SEQ ID NO: 590904 - DNA, 25 bp, Homo sapien
gctgtgtgcttggacgatgtcccaa

SEQ ID NO: 590905 - DNA, 25 bp, Homo sapien
ggacgatgtcccaagaacagccggc

SEQ ID NO: 590906 - DNA, 25 bp, Homo sapien
gtcccaagaacagccggctacagtg

SEQ ID NO: 590907 - DNA, 25 bp, Homo sapien
ggctacagtgggtcgcttcttcgtg

SEQ ID NO: 590908 - DNA, 25 bp, Homo sapien
gtcgcttcttcgtggagcgaggtat

SEQ ID NO: 590909 - DNA, 25 bp, Homo sapien
gagcgaggtatggattagaagtcac

SEQ ID NO: 590910 - DNA, 25 bp, Homo sapien
ttagaagtcactgctgggtcaggag

SEQ ID NO: 590911 - DNA, 25 bp, Homo sapien
aggcgcctgtagtctgatctactgg

SEQ ID NO: 590912 - DNA, 25 bp, Homo sapien
ctactggggctgttcttgggacatc

SEQ ID NO: 590913 - DNA, 25 bp, Homo sapien
ccttttaaaatctgaactcatcatg

SEQ ID NO: 590914 - DNA, 25 bp, Homo sapien
ctgaactcatcatgtaaaatgtaga

SEQ ID NO: 590915 - DNA, 25 bp, Homo sapien
aatgtagagttagtaggttcggtgt

SEQ ID NO: 590916 - DNA, 25 bp, Homo sapien
tagtaggttcggtgtggtagtttct

SEQ ID NO: 590917 - DNA, 25 bp, Homo sapien
taggttcggtgtggtagtttctgcc

SEQ ID NO: 590918 - DNA, 25 bp, Homo sapien
aggttcggtgtggtagtttctgcct

SEQ ID NO: 590919 - DNA, 25 bp, Homo sapien
aaatctagccaagtatagttgtgca

SEQ ID NO: 590920 - DNA, 25 bp, Homo sapien
atctagccaagtatagttgtgcatt

SEQ ID NO: 590921 - DNA, 25 bp, Homo sapien
ctagccaagtatagttgtgcatttc

SEQ ID NO: 590922 - DNA, 25 bp, Homo sapien
agccaagtatagttgtgcatttctg

SEQ ID NO: 590923 - DNA, 25 bp, Homo sapien
ccaagtatagttgtgcatttctgta

SEQ ID NO: 590924 - DNA, 25 bp, Homo sapien
ggattgtggagtgccttggccccaa

SEQ ID NO: 590925 - DNA, 25 bp, Homo sapien
tcccagttctgatacatatgaggaa

SEQ ID NO: 590926 - DNA, 25 bp, Homo sapien
gaagattctgagttgttgctccaga

SEQ ID NO: 590927 - DNA, 25 bp, Homo sapien
gttgctccagatacgaaatgatgtg

SEQ ID NO: 590928 - DNA, 25 bp, Homo sapien
gcttgactcactgggtattagtcct

SEQ ID NO: 590929 - DNA, 25 bp, Homo sapien
tcactgggtattagtcctgacctgc

SEQ ID NO: 590930 - DNA, 25 bp, Homo sapien
actttgtcaggtactgcttctccga

SEQ ID NO: 590931 - DNA, 25 bp, Homo sapien
tgcttctccgagatggccccagtgt

SEQ ID NO: 590932 - DNA, 25 bp, Homo sapien
ggaaattgtgaaggccctgtctcag

SEQ ID NO: 590933 - DNA, 25 bp, Homo sapien
tgtgaaggccctgtctcagcgggac

SEQ ID NO: 590934 - DNA, 25 bp, Homo sapien
cttcttcttcttcgatggcatgaag

SEQ ID NO: 590935 - DNA, 25 bp, Homo sapien
ctctgttagaaggagcggaggctgt

SEQ ID NO: 590936 - DNA, 25 bp, Homo sapien
agaaggagcggaggctgtgctcggt

SEQ ID NO: 590937 - DNA, 25 bp, Homo sapien
aggagcggaggctgtgctcggtggc

SEQ ID NO: 590938 - DNA, 25 bp, Homo sapien
ggagcggaggctgtgctcggtggct

SEQ ID NO: 590939 - DNA, 25 bp, Homo sapien
gcggaggctgtgctcggtggctcac

SEQ ID NO: 590940 - DNA, 25 bp, Homo sapien
tgaccaacacggaaaaatcatgtct

SEQ ID NO: 590941 - DNA, 25 bp, Homo sapien
gaccaacacggaaaaatcatgtctc

SEQ ID NO: 590942 - DNA, 25 bp, Homo sapien
accaacacggaaaaatcatgtctct

SEQ ID NO: 590943 - DNA, 25 bp, Homo sapien
ccaacacggaaaaatcatgtctcta

SEQ ID NO: 590944 - DNA, 25 bp, Homo sapien
caacacggaaaaatcatgtctctac

SEQ ID NO: 590945 - DNA, 25 bp, Homo sapien
acggaaaaatcatgtctctactaaa

SEQ ID NO: 590946 - DNA, 25 bp, Homo sapien
agaagtctcttatgcccttttggta

SEQ ID NO: 590947 - DNA, 25 bp, Homo sapien
tgcccttttggtaatccatttcttc

SEQ ID NO: 590948 - DNA, 25 bp, Homo sapien
ctggcaactactgattcattctttg

SEQ ID NO: 590949 - DNA, 25 bp, Homo sapien
tgattcattctttgtccctctagtt

SEQ ID NO: 590950 - DNA, 25 bp, Homo sapien
gtccctctagttttgccttttgtgg

SEQ ID NO: 590951 - DNA, 25 bp, Homo sapien
aagtggtttgagtttggcagtcatt

SEQ ID NO: 590952 - DNA, 25 bp, Homo sapien
ggcagtcattgcatgcatatacctt

SEQ ID NO: 590953 - DNA, 25 bp, Homo sapien
gcatgcatataccttgaatttactt

SEQ ID NO: 590954 - DNA, 25 bp, Homo sapien
gaatttactttgtttatactctcat

SEQ ID NO: 590955 - DNA, 25 bp, Homo sapien
ggattctgattggttctggttgcag

SEQ ID NO: 590956 - DNA, 25 bp, Homo sapien
ctggttgcagtattacaaattccaa

SEQ ID NO: 590957 - DNA, 25 bp, Homo sapien
gtgatgatgatgctttagtaactgg

SEQ ID NO: 590958 - DNA, 25 bp, Homo sapien
aagagctcagccgatgggaacagga

SEQ ID NO: 590959 - DNA, 25 bp, Homo sapien
taatatccctcaggttcaagccagt

SEQ ID NO: 590960 - DNA, 25 bp, Homo sapien
tcaagccagtcaacccgcagaagtg

SEQ ID NO: 590961 - DNA, 25 bp, Homo sapien
gaatatgtactaccagaacacttac

SEQ ID NO: 590962 - DNA, 25 bp, Homo sapien
gaacacttaccagacaatgccttac

SEQ ID NO: 590963 - DNA, 25 bp, Homo sapien
aatgccttacggctcatcctatggc

SEQ ID NO: 590964 - DNA, 25 bp, Homo sapien
ggcattccttatagttatacggcct

SEQ ID NO: 590965 - DNA, 25 bp, Homo sapien
atacggcctatggatcatcagatgc

SEQ ID NO: 590966 - DNA, 25 bp, Homo sapien
gatgacgatgagaaacgccggatag

SEQ ID NO: 590967 - DNA, 25 bp, Homo sapien
gaaacgccggatagttttttctgtg

SEQ ID NO: 590968 - DNA, 25 bp, Homo sapien
taagcagagaacctagctgagccac

SEQ ID NO: 590969 - DNA, 25 bp, Homo sapien
agagaacctagctgagccactcctg

SEQ ID NO: 590970 - DNA, 25 bp, Homo sapien
agaacctagctgagccactcctgac

SEQ ID NO: 590971 - DNA, 25 bp, Homo sapien
tagctgagccactcctgacctacaa

SEQ ID NO: 590972 - DNA, 25 bp, Homo sapien
tgagccactcctgacctacaaagtt

SEQ ID NO: 590973 - DNA, 25 bp, Homo sapien
agccactcctgacctacaaagttgt

SEQ ID NO: 590974 - DNA, 25 bp, Homo sapien
gccactcctgacctacaaagttgtg

SEQ ID NO: 590975 - DNA, 25 bp, Homo sapien
cactcctgacctacaaagttgtgac

SEQ ID NO: 590976 - DNA, 25 bp, Homo sapien
ctcctgacctacaaagttgtgactt

SEQ ID NO: 590977 - DNA, 25 bp, Homo sapien
cctgacctacaaagttgtgacttaa

SEQ ID NO: 590978 - DNA, 25 bp, Homo sapien
gacctacaaagttgtgacttaataa

SEQ ID NO: 590979 - DNA, 25 bp, Homo sapien
ttaaacattgatggtgggcgtcact

SEQ ID NO: 590980 - DNA, 25 bp, Homo sapien
atggtgggcgtcactgttcagaaga

SEQ ID NO: 590981 - DNA, 25 bp, Homo sapien
gggcatctttacctaatgtgcgtgc

SEQ ID NO: 590982 - DNA, 25 bp, Homo sapien
gtgcgtgcaaatctcaacagtctta

SEQ ID NO: 590983 - DNA, 25 bp, Homo sapien
aacagtcttagagctgaaagggccc

SEQ ID NO: 590984 - DNA, 25 bp, Homo sapien
gagatcatctattcatctggtctaa

SEQ ID NO: 590985 - DNA, 25 bp, Homo sapien
attcatctggtctaatcctgttgga

SEQ ID NO: 590986 - DNA, 25 bp, Homo sapien
aatcctgttggaatggtgaatctca

SEQ ID NO: 590987 - DNA, 25 bp, Homo sapien
gaatctcatattagaactgcgggta

SEQ ID NO: 590988 - DNA, 25 bp, Homo sapien
gttagtcatttggacaggcttgata

SEQ ID NO: 590989 - DNA, 25 bp, Homo sapien
gtcaacctgccattaaaagcagagt

SEQ ID NO: 590990 - DNA, 25 bp, Homo sapien
gtgagaccccagctgtacaaaattt

SEQ ID NO: 590991 - DNA, 25 bp, Homo sapien
tgagaccccagctgtacaaaattta

SEQ ID NO: 590992 - DNA, 25 bp, Homo sapien
gagaccccagctgtacaaaatttat

SEQ ID NO: 590993 - DNA, 25 bp, Homo sapien
agaccccagctgtacaaaatttatt

SEQ ID NO: 590994 - DNA, 25 bp, Homo sapien
gaccccagctgtacaaaatttattt

SEQ ID NO: 590995 - DNA, 25 bp, Homo sapien
tgtagtggctcatgcacttgggagt

SEQ ID NO: 590996 - DNA, 25 bp, Homo sapien
gtagtggctcatgcacttgggagtc

SEQ ID NO: 590997 - DNA, 25 bp, Homo sapien
tagtggctcatgcacttgggagtct

SEQ ID NO: 590998 - DNA, 25 bp, Homo sapien
agtggctcatgcacttgggagtctg

SEQ ID NO: 590999 - DNA, 25 bp, Homo sapien
gtggctcatgcacttgggagtctga

SEQ ID NO: 591000 - DNA, 25 bp, Homo sapien
tgagtgggggtatcccttgagacca

SEQ ID NO: 591001 - DNA, 25 bp, Homo sapien
gaggcatgtgggagcggcacccgct

SEQ ID NO: 591002 - DNA, 25 bp, Homo sapien
tttgtgccccagcagacaagcctgg

SEQ ID NO: 591003 - DNA, 25 bp, Homo sapien
cagcagacaagcctggtgcaggcca

SEQ ID NO: 591004 - DNA, 25 bp, Homo sapien
cagcctgctggtggccaacctgctg

SEQ ID NO: 591005 - DNA, 25 bp, Homo sapien
tgctggcccacatgaactactcctt

SEQ ID NO: 591006 - DNA, 25 bp, Homo sapien
atgaactactccttctggatcgagg

SEQ ID NO: 591007 - DNA, 25 bp, Homo sapien
tactccttctggatcgaggccgtca

SEQ ID NO: 591008 - DNA, 25 bp, Homo sapien
atcgaggccgtcaatggcgtgtccg

SEQ ID NO: 591009 - DNA, 25 bp, Homo sapien
gtcaatggcgtgtccgacctgagcc

SEQ ID NO: 591010 - DNA, 25 bp, Homo sapien
cgccgggccgctgtggtcaacatca

SEQ ID NO: 591011 - DNA, 25 bp, Homo sapien
ggtcaacatcaccacgaaccaggca

SEQ ID NO: 591012 - DNA, 25 bp, Homo sapien
caacaatttcccgacgtgagcgagg

SEQ ID NO: 591013 - DNA, 25 bp, Homo sapien
aacaatttcccgacgtgagcgagga

SEQ ID NO: 591014 - DNA, 25 bp, Homo sapien
acaatttcccgacgtgagcgaggac

SEQ ID NO: 591015 - DNA, 25 bp, Homo sapien
caatttcccgacgtgagcgaggacc

SEQ ID NO: 591016 - DNA, 25 bp, Homo sapien
aatttcccgacgtgagcgaggacca

SEQ ID NO: 591017 - DNA, 25 bp, Homo sapien
atttcccgacgtgagcgaggaccac

SEQ ID NO: 591018 - DNA, 25 bp, Homo sapien
tttcccgacgtgagcgaggaccacg

SEQ ID NO: 591019 - DNA, 25 bp, Homo sapien
ttcccgacgtgagcgaggaccacgt

SEQ ID NO: 591020 - DNA, 25 bp, Homo sapien
ccgacgtgagcgaggaccacgtctc

SEQ ID NO: 591021 - DNA, 25 bp, Homo sapien
gacttgtcccgggagcagcacctgg

SEQ ID NO: 591022 - DNA, 25 bp, Homo sapien
gcgagccgccgcgtcctcttcagcc

SEQ ID NO: 591023 - DNA, 25 bp, Homo sapien
cattttgaatattgaacgtggatag

SEQ ID NO: 591024 - DNA, 25 bp, Homo sapien
attgaacgtggatagatgtatttaa

SEQ ID NO: 591025 - DNA, 25 bp, Homo sapien
tatatcattctttatttttctacta

SEQ ID NO: 591026 - DNA, 25 bp, Homo sapien
aatgatgaatctacagtatctcagg

SEQ ID NO: 591027 - DNA, 25 bp, Homo sapien
gatgaatctacagtatctcagggcc

SEQ ID NO: 591028 - DNA, 25 bp, Homo sapien
atgaatctacagtatctcagggcct

SEQ ID NO: 591029 - DNA, 25 bp, Homo sapien
gaatctacagtatctcagggcctta

SEQ ID NO: 591030 - DNA, 25 bp, Homo sapien
atctacagtatctcagggccttatt

SEQ ID NO: 591031 - DNA, 25 bp, Homo sapien
tacagtatctcagggccttattttc

SEQ ID NO: 591032 - DNA, 25 bp, Homo sapien
atctcagggccttattttcaatatc

SEQ ID NO: 591033 - DNA, 25 bp, Homo sapien
ttttcaatatcttaactggattttt

SEQ ID NO: 591034 - DNA, 25 bp, Homo sapien
tggtgttgtggccatgccttcctcc

SEQ ID NO: 591035 - DNA, 25 bp, Homo sapien
gaaagctacatgtgtgtctgtccca

SEQ ID NO: 591036 - DNA, 25 bp, Homo sapien
acatgtgtgtctgtcccataggaag

SEQ ID NO: 591037 - DNA, 25 bp, Homo sapien
ggaaggagtcatccctgtctcttca

SEQ ID NO: 591038 - DNA, 25 bp, Homo sapien
tcaagttggcatttcagaggaagga

SEQ ID NO: 591039 - DNA, 25 bp, Homo sapien
gaggaaggaaagtaaccagcgtcat

SEQ ID NO: 591040 - DNA, 25 bp, Homo sapien
aagtaaccagcgtcattctcaattt

SEQ ID NO: 591041 - DNA, 25 bp, Homo sapien
gcgtcattctcaatttccggaaact

SEQ ID NO: 591042 - DNA, 25 bp, Homo sapien
gaaagctttgtgactcatgagaatg

SEQ ID NO: 591043 - DNA, 25 bp, Homo sapien
atgtaggtacaatccatttgtgtag

SEQ ID NO: 591044 - DNA, 25 bp, Homo sapien
ccatttgtgtagaggatcttttctc

SEQ ID NO: 591045 - DNA, 25 bp, Homo sapien
gtcttcagacaataacttaaccaat

SEQ ID NO: 591046 - DNA, 25 bp, Homo sapien
aaatcgactccacctatgagctgga

SEQ ID NO: 591047 - DNA, 25 bp, Homo sapien
acctatgagctggaagtccttccca

SEQ ID NO: 591048 - DNA, 25 bp, Homo sapien
cttcaagctgtcctgcttttctgta

SEQ ID NO: 591049 - DNA, 25 bp, Homo sapien
gtcctgcttttctgtactgaaccaa

SEQ ID NO: 591050 - DNA, 25 bp, Homo sapien
actgaaccaatatacatcttacgtg

SEQ ID NO: 591051 - DNA, 25 bp, Homo sapien
acgtgtattcattgatgtctgcctg

SEQ ID NO: 591052 - DNA, 25 bp, Homo sapien
ataaaatcagctgtaattcaaccac

SEQ ID NO: 591053 - DNA, 25 bp, Homo sapien
taattcaaccaccttcggcacatct

SEQ ID NO: 591054 - DNA, 25 bp, Homo sapien
ctcctgatgctgtggcatgtcttta

SEQ ID NO: 591055 - DNA, 25 bp, Homo sapien
gctgtggcatgtctttaaccttggc

SEQ ID NO: 591056 - DNA, 25 bp, Homo sapien
ggctaaggctgagtggacccaacgt

SEQ ID NO: 591057 - DNA, 25 bp, Homo sapien
taaggctgagtggacccaacgtggt

SEQ ID NO: 591058 - DNA, 25 bp, Homo sapien
ttctgagaccagtgtttgatgtaaa

SEQ ID NO: 591059 - DNA, 25 bp, Homo sapien
aaatggcaccacagttccaagaaat

SEQ ID NO: 591060 - DNA, 25 bp, Homo sapien
caagaaatctccacctttacccagg

SEQ ID NO: 591061 - DNA, 25 bp, Homo sapien
tttacccaggaattttcgtgaacat

SEQ ID NO: 591062 - DNA, 25 bp, Homo sapien
tcgtgaacattccactccttggtta

SEQ ID NO: 591063 - DNA, 25 bp, Homo sapien
catcaagatgaaaccccagaaccca

SEQ ID NO: 591064 - DNA, 25 bp, Homo sapien
atgaaaccccagaacccattattct

SEQ ID NO: 591065 - DNA, 25 bp, Homo sapien
cattattctctcttgggtatgccca

SEQ ID NO: 591066 - DNA, 25 bp, Homo sapien
aagctcccctttcttgagagtgtac

SEQ ID NO: 591067 - DNA, 25 bp, Homo sapien
ctctgacatcagattgtgggcacta

SEQ ID NO: 591068 - DNA, 25 bp, Homo sapien
agattgtgggcactagatcccgctt

SEQ ID NO: 591069 - DNA, 25 bp, Homo sapien
tgtgggcactagatcccgcttggtg

SEQ ID NO: 591070 - DNA, 25 bp, Homo sapien
tagatcccgcttggtggtgaaccgg

SEQ ID NO: 591071 - DNA, 25 bp, Homo sapien
ggtgaaccgggtgcgtcagaaccca

SEQ ID NO: 591072 - DNA, 25 bp, Homo sapien
gggtgcgtcagaacccagggattaa

SEQ ID NO: 591073 - DNA, 25 bp, Homo sapien
gaacccagggattaaatagctttcg

SEQ ID NO: 591074 - DNA, 25 bp, Homo sapien
atagctttcgaaatccatcggcttg

SEQ ID NO: 591075 - DNA, 25 bp, Homo sapien
tttcgaaatccatcggcttgtcctt

SEQ ID NO: 591076 - DNA, 25 bp, Homo sapien
aaatccatcggcttgtccttgacca

SEQ ID NO: 591077 - DNA, 25 bp, Homo sapien
gcttgtccttgaccagccagagggc

SEQ ID NO: 591078 - DNA, 25 bp, Homo sapien
aacgtctgccgcgttgatttttggg

SEQ ID NO: 591079 - DNA, 25 bp, Homo sapien
gccgcgttgatttttgggtgtctaa

SEQ ID NO: 591080 - DNA, 25 bp, Homo sapien
cgcgttgatttttgggtgtctaagt

SEQ ID NO: 591081 - DNA, 25 bp, Homo sapien
gatttttgggtgtctaagtgtaccg

SEQ ID NO: 591082 - DNA, 25 bp, Homo sapien
tagtatcacattgagagtcacccac

SEQ ID NO: 591083 - DNA, 25 bp, Homo sapien
tatcacattgagagtcacccactgt

SEQ ID NO: 591084 - DNA, 25 bp, Homo sapien
acattgagagtcacccactgtgggt

SEQ ID NO: 591085 - DNA, 25 bp, Homo sapien
acccactgtgggtggattcacccat

SEQ ID NO: 591086 - DNA, 25 bp, Homo sapien
tgtgggtggattcacccattcccgt

SEQ ID NO: 591087 - DNA, 25 bp, Homo sapien
ggattcacccattcccgtcatggtg

SEQ ID NO: 591088 - DNA, 25 bp, Homo sapien
acccattcccgtcatggtgcctggg

SEQ ID NO: 591089 - DNA, 25 bp, Homo sapien
gatttgtgtgcattaaagccagact

SEQ ID NO: 591090 - DNA, 25 bp, Homo sapien
atttgtgtgcattaaagccagactg

SEQ ID NO: 591091 - DNA, 25 bp, Homo sapien
tttgtgtgcattaaagccagactgg

SEQ ID NO: 591092 - DNA, 25 bp, Homo sapien
ttgtgtgcattaaagccagactggg

SEQ ID NO: 591093 - DNA, 25 bp, Homo sapien
tgtgtgcattaaagccagactgggc

SEQ ID NO: 591094 - DNA, 25 bp, Homo sapien
gtgtgcattaaagccagactgggca

SEQ ID NO: 591095 - DNA, 25 bp, Homo sapien
tgtgcattaaagccagactgggcag

SEQ ID NO: 591096 - DNA, 25 bp, Homo sapien
tgcattaaagccagactgggcaggg

SEQ ID NO: 591097 - DNA, 25 bp, Homo sapien
gcattaaagccagactgggcagggc

SEQ ID NO: 591098 - DNA, 25 bp, Homo sapien
cattaaagccagactgggcagggca

SEQ ID NO: 591099 - DNA, 25 bp, Homo sapien
attaaagccagactgggcagggcac

SEQ ID NO: 591100 - DNA, 25 bp, Homo sapien
atggtcactcccctcctggtctata

SEQ ID NO: 591101 - DNA, 25 bp, Homo sapien
gtggtcactcccctcctggtctata

SEQ ID NO: 591102 - DNA, 25 bp, Homo sapien
cctcctggtctatacccgtgggatt

SEQ ID NO: 591103 - DNA, 25 bp, Homo sapien
tcctggtctatacccgtgggattct

SEQ ID NO: 591104 - DNA, 25 bp, Homo sapien
tggtctatacccgtgggattctcct

SEQ ID NO: 591105 - DNA, 25 bp, Homo sapien
atacccgtgggattctcctccatca

SEQ ID NO: 591106 - DNA, 25 bp, Homo sapien
atcaggagatggtcactctccctcc

SEQ ID NO: 591107 - DNA, 25 bp, Homo sapien
aggagatggtcactctccctcctgg

SEQ ID NO: 591108 - DNA, 25 bp, Homo sapien
ctcctggtctatacccgtggggctg

SEQ ID NO: 591109 - DNA, 25 bp, Homo sapien
atcaggagatggtcactcccctcct

SEQ ID NO: 591110 - DNA, 25 bp, Homo sapien
aggagatggtcactcccctcctggt

SEQ ID NO: 591111 - DNA, 25 bp, Homo sapien
tttctccagtgaatccaacacactc

SEQ ID NO: 591112 - DNA, 25 bp, Homo sapien
gtgaatccaacacactctcagtgag

SEQ ID NO: 591113 - DNA, 25 bp, Homo sapien
atccaacacactctcagtgagacag

SEQ ID NO: 591114 - DNA, 25 bp, Homo sapien
gggttctcggagaaactccagccgg

SEQ ID NO: 591115 - DNA, 25 bp, Homo sapien
tgctcgctgggcatgtacactggag

SEQ ID NO: 591116 - DNA, 25 bp, Homo sapien
atgtacactggagtggagccacaga

SEQ ID NO: 591117 - DNA, 25 bp, Homo sapien
gccacagaagttcacggtgtttgca

SEQ ID NO: 591118 - DNA, 25 bp, Homo sapien
aagttcacggtgtttgcagcaggga

SEQ ID NO: 591119 - DNA, 25 bp, Homo sapien
gaatttattttgtgaggcgggaagc

SEQ ID NO: 591120 - DNA, 25 bp, Homo sapien
tttgtgaggcgggaagcctatactg

SEQ ID NO: 591121 - DNA, 25 bp, Homo sapien
tatactggggagactcttgctctgc

SEQ ID NO: 591122 - DNA, 25 bp, Homo sapien
atcctattccattccgggtccttct

SEQ ID NO: 591123 - DNA, 25 bp, Homo sapien
accatcttctaccttttcagccttt

SEQ ID NO: 591124 - DNA, 25 bp, Homo sapien
ttcccctctgcgcactattttcttt

SEQ ID NO: 591125 - DNA, 25 bp, Homo sapien
ctctgcgcactattttctttggtgt

SEQ ID NO: 591126 - DNA, 25 bp, Homo sapien
ctgcgcactattttctttggtgttg

SEQ ID NO: 591127 - DNA, 25 bp, Homo sapien
tgcgcactattttctttggtgttgt

SEQ ID NO: 591128 - DNA, 25 bp, Homo sapien
actattttctttggtgttgttcatt

SEQ ID NO: 591129 - DNA, 25 bp, Homo sapien
tttggtgttgttcatttttacctgt

SEQ ID NO: 591130 - DNA, 25 bp, Homo sapien
tcatttttacctgtttcccgaatgt

SEQ ID NO: 591131 - DNA, 25 bp, Homo sapien
tacctgtttcccgaatgttccattc

SEQ ID NO: 591132 - DNA, 25 bp, Homo sapien
gtttcccgaatgttccattcccttg

SEQ ID NO: 591133 - DNA, 25 bp, Homo sapien
gaacacaagagaattttctctctga

SEQ ID NO: 591134 - DNA, 25 bp, Homo sapien
ttctctctgagccacaagtcatgaa

SEQ ID NO: 591135 - DNA, 25 bp, Homo sapien
gaaatatttggctacccttgagtaa

SEQ ID NO: 591136 - DNA, 25 bp, Homo sapien
gctacccttgagtaactgatgtgtt

SEQ ID NO: 591137 - DNA, 25 bp, Homo sapien
tgttttctctttataggcaatgtga

SEQ ID NO: 591138 - DNA, 25 bp, Homo sapien
aatgtgaattatataactgcctgtt

SEQ ID NO: 591139 - DNA, 25 bp, Homo sapien
ttcacttttcactttgccaagaagc

SEQ ID NO: 591140 - DNA, 25 bp, Homo sapien
ttgccaagaagctctgagtaaattt

SEQ ID NO: 591141 - DNA, 25 bp, Homo sapien
gagtaaatttgttggctcagcgttt

SEQ ID NO: 591142 - DNA, 25 bp, Homo sapien
gctcagcgtttgtaagtgggtgaat

SEQ ID NO: 591143 - DNA, 25 bp, Homo sapien
atctgtattctgttgctttgaaatt

SEQ ID NO: 591144 - DNA, 25 bp, Homo sapien
tggtgttgtggccatgccttcctcc

SEQ ID NO: 591145 - DNA, 25 bp, Homo sapien
gtgttgtggccatgccttcctccac

SEQ ID NO: 591146 - DNA, 25 bp, Homo sapien
gaaagctacatgtgtgtctgtccca

SEQ ID NO: 591147 - DNA, 25 bp, Homo sapien
aaagctacatgtgtgtctgtcccat

SEQ ID NO: 591148 - DNA, 25 bp, Homo sapien
aagctacatgtgtgtctgtcccata

SEQ ID NO: 591149 - DNA, 25 bp, Homo sapien
gctacatgtgtgtctgtcccatagg

SEQ ID NO: 591150 - DNA, 25 bp, Homo sapien
ggaaggagtcatccctgtctcttca

SEQ ID NO: 591151 - DNA, 25 bp, Homo sapien
gaggaaggaaagtaaccagcgtcat

SEQ ID NO: 591152 - DNA, 25 bp, Homo sapien
gaaggaaagtaaccagcgtcattct

SEQ ID NO: 591153 - DNA, 25 bp, Homo sapien
ggaaagtaaccagcgtcattctcaa

SEQ ID NO: 591154 - DNA, 25 bp, Homo sapien
aagtaaccagcgtcattctcaattt

SEQ ID NO: 591155 - DNA, 25 bp, Homo sapien
ctctcttctctagggatttcatgca

SEQ ID NO: 591156 - DNA, 25 bp, Homo sapien
cctgacagccagtggaagttgcctg

SEQ ID NO: 591157 - DNA, 25 bp, Homo sapien
gacagccagtggaagttgcctgatt

SEQ ID NO: 591158 - DNA, 25 bp, Homo sapien
gccagtggaagttgcctgatttgaa

SEQ ID NO: 591159 - DNA, 25 bp, Homo sapien
agttgcctgatttgaagaggcccag

SEQ ID NO: 591160 - DNA, 25 bp, Homo sapien
aggcccagggccgaagatacccagt

SEQ ID NO: 591161 - DNA, 25 bp, Homo sapien
gggccgaagatacccagtcatgtgt

SEQ ID NO: 591162 - DNA, 25 bp, Homo sapien
atacccagtcatgtgtggaagcagc

SEQ ID NO: 591163 - DNA, 25 bp, Homo sapien
gtggaagcagcttcaatgccatttt

SEQ ID NO: 591164 - DNA, 25 bp, Homo sapien
gaagcagcttcaatgccattttgtg

SEQ ID NO: 591165 - DNA, 25 bp, Homo sapien
ccattttgtgagaggttgagggccc

SEQ ID NO: 591166 - DNA, 25 bp, Homo sapien
gcacagttcagaaggcaagtcctca

SEQ ID NO: 591167 - DNA, 25 bp, Homo sapien
ttgcctgagtttcctcatcagggct

SEQ ID NO: 591168 - DNA, 25 bp, Homo sapien
tgagtttcctcatcagggctgtcat

SEQ ID NO: 591169 - DNA, 25 bp, Homo sapien
gtttcctcatcagggctgtcattca

SEQ ID NO: 591170 - DNA, 25 bp, Homo sapien
cctcatcagggctgtcattcagtga

SEQ ID NO: 591171 - DNA, 25 bp, Homo sapien
tcatcagggctgtcattcagtgatg

SEQ ID NO: 591172 - DNA, 25 bp, Homo sapien
gggtctgaagaatactgccttctat

SEQ ID NO: 591173 - DNA, 25 bp, Homo sapien
gaagaatactgccttctatctgtct

SEQ ID NO: 591174 - DNA, 25 bp, Homo sapien
agaatactgccttctatctgtcttc

SEQ ID NO: 591175 - DNA, 25 bp, Homo sapien
aatactgccttctatctgtcttctg

SEQ ID NO: 591176 - DNA, 25 bp, Homo sapien
tactgccttctatctgtcttctgtt

SEQ ID NO: 591177 - DNA, 25 bp, Homo sapien
aaacagttttgcctcagcccttcgt

SEQ ID NO: 591178 - DNA, 25 bp, Homo sapien
tgcctcagcccttcgtgtaagttgg

SEQ ID NO: 591179 - DNA, 25 bp, Homo sapien
ccttcgtgtaagttggctatttcct

SEQ ID NO: 591180 - DNA, 25 bp, Homo sapien
ggctatttccttggtataggtacaa

SEQ ID NO: 591181 - DNA, 25 bp, Homo sapien
tccttggtataggtacaaaacgtat

SEQ ID NO: 591182 - DNA, 25 bp, Homo sapien
gtacaaaacgtattactgcttgtct

SEQ ID NO: 591183 - DNA, 25 bp, Homo sapien
catatttgtttgatgtcttccatca

SEQ ID NO: 591184 - DNA, 25 bp, Homo sapien
gatgtcttccatcattttagattgt

SEQ ID NO: 591185 - DNA, 25 bp, Homo sapien
agattgtaattctgtgaggcaaagc

SEQ ID NO: 591186 - DNA, 25 bp, Homo sapien
gtgaggcaaagcatcatgtctgtgt

SEQ ID NO: 591187 - DNA, 25 bp, Homo sapien
gatgtttgacagatagtagataccc

SEQ ID NO: 591188 - DNA, 25 bp, Homo sapien
cattttgaatattgaacgtggatag

SEQ ID NO: 591189 - DNA, 25 bp, Homo sapien
attgaacgtggatagatgtatttaa

SEQ ID NO: 591190 - DNA, 25 bp, Homo sapien
aatgatgaatctacagtatctcagg

SEQ ID NO: 591191 - DNA, 25 bp, Homo sapien
atgatgaatctacagtatctcaggg

SEQ ID NO: 591192 - DNA, 25 bp, Homo sapien
tgatgaatctacagtatctcagggc

SEQ ID NO: 591193 - DNA, 25 bp, Homo sapien
gatgaatctacagtatctcagggcc

SEQ ID NO: 591194 - DNA, 25 bp, Homo sapien
atgaatctacagtatctcagggcct

SEQ ID NO: 591195 - DNA, 25 bp, Homo sapien
tgaatctacagtatctcagggcctt

SEQ ID NO: 591196 - DNA, 25 bp, Homo sapien
gaatctacagtatctcagggcctta

SEQ ID NO: 591197 - DNA, 25 bp, Homo sapien
ttttcaatatcttaactggattttt

SEQ ID NO: 591198 - DNA, 25 bp, Homo sapien
caatatcttaactggatttttaata

SEQ ID NO: 591199 - DNA, 25 bp, Homo sapien
ttttactattttaatgacaggtata

SEQ ID NO: 591200 - DNA, 25 bp, Homo sapien
gacaggtatagctgaatattatcca

SEQ ID NO: 591201 - DNA, 25 bp, Homo sapien
caggtatagctgaatattatccatg

SEQ ID NO: 591202 - DNA, 25 bp, Homo sapien
ggtatagctgaatattatccatgat

SEQ ID NO: 591203 - DNA, 25 bp, Homo sapien
atagctgaatattatccatgatggg

SEQ ID NO: 591204 - DNA, 25 bp, Homo sapien
agctgaatattatccatgatgggtt

SEQ ID NO: 591205 - DNA, 25 bp, Homo sapien
gctgaatattatccatgatgggttc

SEQ ID NO: 591206 - DNA, 25 bp, Homo sapien
gaatattatccatgatgggttctta

SEQ ID NO: 591207 - DNA, 25 bp, Homo sapien
atattatccatgatgggttcttaaa

SEQ ID NO: 591208 - DNA, 25 bp, Homo sapien
attatccatgatgggttcttaaaat

SEQ ID NO: 591209 - DNA, 25 bp, Homo sapien
tgatgggttcttaaaatgagttggg

SEQ ID NO: 591210 - DNA, 25 bp, Homo sapien
tgtgtccctgcctggaggacgccct

SEQ ID NO: 591211 - DNA, 25 bp, Homo sapien
gtgtaagggaaatggctgtgcttta

SEQ ID NO: 591212 - DNA, 25 bp, Homo sapien
agtgggtttggagtgcaagcacaca

SEQ ID NO: 591213 - DNA, 25 bp, Homo sapien
gcacacaaccttgctcgttatgtaa

SEQ ID NO: 591214 - DNA, 25 bp, Homo sapien
ttgctcgttatgtaaccacaccaca

SEQ ID NO: 591215 - DNA, 25 bp, Homo sapien
gtaaccacaccacatgaggcccatt

SEQ ID NO: 591216 - DNA, 25 bp, Homo sapien
attaggtaacaactcacatgagctc

SEQ ID NO: 591217 - DNA, 25 bp, Homo sapien
aactcacatgagctcgtgtttggct

SEQ ID NO: 591218 - DNA, 25 bp, Homo sapien
atgagctcgtgtttggctcagagcc

SEQ ID NO: 591219 - DNA, 25 bp, Homo sapien
aaggtataccttgctgatgctgcac

SEQ ID NO: 591220 - DNA, 25 bp, Homo sapien
tataccttgctgatgctgcacatat

SEQ ID NO: 591221 - DNA, 25 bp, Homo sapien
gcttcctttgagaacaagtttgagt

SEQ ID NO: 591222 - DNA, 25 bp, Homo sapien
aaagctgttttatttgattcactgt

SEQ ID NO: 591223 - DNA, 25 bp, Homo sapien
gctgttttatttgattcactgtgaa

SEQ ID NO: 591224 - DNA, 25 bp, Homo sapien
aaaagtgaaaacacagcacatttca

SEQ ID NO: 591225 - DNA, 25 bp, Homo sapien
gcacatttcaagtgtaatccccttt

SEQ ID NO: 591226 - DNA, 25 bp, Homo sapien
ttcaagtgtaatcccctttggaatt

SEQ ID NO: 591227 - DNA, 25 bp, Homo sapien
aagtcttagtatatgtctttgtgac

SEQ ID NO: 591228 - DNA, 25 bp, Homo sapien
gtctttgtgacagaaaaacatagat

SEQ ID NO: 591229 - DNA, 25 bp, Homo sapien
atgggacaggtaaatgaaatgttcc

SEQ ID NO: 591230 - DNA, 25 bp, Homo sapien
gaaatgttcctagttgcatagctgt

SEQ ID NO: 591231 - DNA, 25 bp, Homo sapien
gttcctagttgcatagctgttaacc

SEQ ID NO: 591232 - DNA, 25 bp, Homo sapien
aaatgatggagctccgaatgtgctt

SEQ ID NO: 591233 - DNA, 25 bp, Homo sapien
gatggagctccgaatgtgcttaagt

SEQ ID NO: 591234 - DNA, 25 bp, Homo sapien
agctccgaatgtgcttaagtggaaa

SEQ ID NO: 591235 - DNA, 25 bp, Homo sapien
aattatagaatatgggatcccgtgt

SEQ ID NO: 591236 - DNA, 25 bp, Homo sapien
atagaatatgggatcccgtgtgtgt

SEQ ID NO: 591237 - DNA, 25 bp, Homo sapien
gcttatgtattgacagaacacttct

SEQ ID NO: 591238 - DNA, 25 bp, Homo sapien
gaacacttctagaatgatacccaaa

SEQ ID NO: 591239 - DNA, 25 bp, Homo sapien
gaatgatacccaaactcctggagtg

SEQ ID NO: 591240 - DNA, 25 bp, Homo sapien
atacccaaactcctggagtgggagt

SEQ ID NO: 591241 - DNA, 25 bp, Homo sapien
gccttctacgtacacactgttctac

SEQ ID NO: 591242 - DNA, 25 bp, Homo sapien
tctacgtacacactgttctactgtt

SEQ ID NO: 591243 - DNA, 25 bp, Homo sapien
gtgaacgggacaatgcagaactgca

SEQ ID NO: 591244 - DNA, 25 bp, Homo sapien
tttgccaacgccattcttcagcaga

SEQ ID NO: 591245 - DNA, 25 bp, Homo sapien
acgccattcttcagcagatagcaga

SEQ ID NO: 591246 - DNA, 25 bp, Homo sapien
agatagcagaccattgtcccgacat

SEQ ID NO: 591247 - DNA, 25 bp, Homo sapien
ttgtcccgacatcctagagcaagtg

SEQ ID NO: 591248 - DNA, 25 bp, Homo sapien
agagcaagtggtcaacgccctggaa

SEQ ID NO: 591249 - DNA, 25 bp, Homo sapien
tgaggtagtcaacccaggagccaag

SEQ ID NO: 591250 - DNA, 25 bp, Homo sapien
gaactacgaggaacaggtgcccgga

SEQ ID NO: 591251 - DNA, 25 bp, Homo sapien
aaacactacaaacttcatcccaact

SEQ ID NO: 591252 - DNA, 25 bp, Homo sapien
tcatcccaacttgctcacttgaaga

SEQ ID NO: 591253 - DNA, 25 bp, Homo sapien
ttgaagaagtgtgattccagcaccg

SEQ ID NO: 591254 - DNA, 25 bp, Homo sapien
gggattatgatcgggtgcagtggct

SEQ ID NO: 591255 - DNA, 25 bp, Homo sapien
ggattatgatcgggtgcagtggctc

SEQ ID NO: 591256 - DNA, 25 bp, Homo sapien
ttggggaggccaaggcgagtggatt

SEQ ID NO: 591257 - DNA, 25 bp, Homo sapien
gaggccaaggcgagtggattgcttg

SEQ ID NO: 591258 - DNA, 25 bp, Homo sapien
aggccaaggcgagtggattgcttga

SEQ ID NO: 591259 - DNA, 25 bp, Homo sapien
ccaaggcgagtggattgcttgagcc

SEQ ID NO: 591260 - DNA, 25 bp, Homo sapien
caaggcgagtggattgcttgagccc

SEQ ID NO: 591261 - DNA, 25 bp, Homo sapien
gcagtgaactgtgatcacgcccctg

SEQ ID NO: 591262 - DNA, 25 bp, Homo sapien
ggtgacaaagcaagatactgtctca

SEQ ID NO: 591263 - DNA, 25 bp, Homo sapien
gtgacaaagcaagatactgtctcaa

SEQ ID NO: 591264 - DNA, 25 bp, Homo sapien
tgacaaagcaagatactgtctcaaa

SEQ ID NO: 591265 - DNA, 25 bp, Homo sapien
tccaagtcagagtgtacaagttcaa

SEQ ID NO: 591266 - DNA, 25 bp, Homo sapien
gaaccatggcagtagctgaccttta

SEQ ID NO: 591267 - DNA, 25 bp, Homo sapien
gtagctgacctttattgaatctgtg

SEQ ID NO: 591268 - DNA, 25 bp, Homo sapien
ttattgaatctgtgttaagctctgc

SEQ ID NO: 591269 - DNA, 25 bp, Homo sapien
agctctgctctaagttctttatctg

SEQ ID NO: 591270 - DNA, 25 bp, Homo sapien
ttatctgcattagcctttcacaagc

SEQ ID NO: 591271 - DNA, 25 bp, Homo sapien
caagctcactctgtacctataggta

SEQ ID NO: 591272 - DNA, 25 bp, Homo sapien
taggtaggcaccgttatatcccatt

SEQ ID NO: 591273 - DNA, 25 bp, Homo sapien
gcaccgttatatcccattctatgga

SEQ ID NO: 591274 - DNA, 25 bp, Homo sapien
gtaaatgccggctagtcaggacaca

SEQ ID NO: 591275 - DNA, 25 bp, Homo sapien
agtatgtgcccactgaggcacgctg

SEQ ID NO: 591276 - DNA, 25 bp, Homo sapien
ggcccaaccaaaccatcctggtgga

SEQ ID NO: 591277 - DNA, 25 bp, Homo sapien
acgtggcccggaacgcggcgaccat

SEQ ID NO: 591278 - DNA, 25 bp, Homo sapien
ggaacgcggcgaccatcacagtgac

SEQ ID NO: 591279 - DNA, 25 bp, Homo sapien
tgggcggtgctgttcgacgggcaga

SEQ ID NO: 591280 - DNA, 25 bp, Homo sapien
gggcagagcggctgcatctgttacc

SEQ ID NO: 591281 - DNA, 25 bp, Homo sapien
gctgcatctgttaccgccctgagga

SEQ ID NO: 591282 - DNA, 25 bp, Homo sapien
gttaccgccctgaggagcaccaggt

SEQ ID NO: 591283 - DNA, 25 bp, Homo sapien
ctgaggagcaccaggtctgcttcct

SEQ ID NO: 591284 - DNA, 25 bp, Homo sapien
ttcctccgcctgatggaggacagtg

SEQ ID NO: 591285 - DNA, 25 bp, Homo sapien
agaccctgcggctgctggtggatac

SEQ ID NO: 591286 - DNA, 25 bp, Homo sapien
tggtggatacctccaaggtccaaga

SEQ ID NO: 591287 - DNA, 25 bp, Homo sapien
aaaaacttaggaaggcctagcacag

SEQ ID NO: 591288 - DNA, 25 bp, Homo sapien
aaaacttaggaaggcctagcacagt

SEQ ID NO: 591289 - DNA, 25 bp, Homo sapien
aaacttaggaaggcctagcacagtg

SEQ ID NO: 591290 - DNA, 25 bp, Homo sapien
acttaggaaggcctagcacagtggc

SEQ ID NO: 591291 - DNA, 25 bp, Homo sapien
cttaggaaggcctagcacagtggct

SEQ ID NO: 591292 - DNA, 25 bp, Homo sapien
gctgggcctggtggtaggtgtccgt

SEQ ID NO: 591293 - DNA, 25 bp, Homo sapien
ctgggcctggtggtaggtgtccgta

SEQ ID NO: 591294 - DNA, 25 bp, Homo sapien
tgggcctggtggtaggtgtccgtaa

SEQ ID NO: 591295 - DNA, 25 bp, Homo sapien
gggcctggtggtaggtgtccgtaat

SEQ ID NO: 591296 - DNA, 25 bp, Homo sapien
ggcctggtggtaggtgtccgtaatc

SEQ ID NO: 591297 - DNA, 25 bp, Homo sapien
gcctggtggtaggtgtccgtaatcc

SEQ ID NO: 591298 - DNA, 25 bp, Homo sapien
agggcttttccagggccaagaatat

SEQ ID NO: 591299 - DNA, 25 bp, Homo sapien
ccagggccaagaatatactagggat

SEQ ID NO: 591300 - DNA, 25 bp, Homo sapien
gtagttgggaggagtatctctcttt

SEQ ID NO: 591301 - DNA, 25 bp, Homo sapien
gagtatctctctttgccgagggaaa

SEQ ID NO: 591302 - DNA, 25 bp, Homo sapien
gtgtaaggaacacatgtctggaaat

SEQ ID NO: 591303 - DNA, 25 bp, Homo sapien
acacatgtctggaaattaggaggcg

SEQ ID NO: 591304 - DNA, 25 bp, Homo sapien
tgccaccagcttatgacctaaggaa

SEQ ID NO: 591305 - DNA, 25 bp, Homo sapien
gaatgtctaactcaagttttcctta

SEQ ID NO: 591306 - DNA, 25 bp, Homo sapien
gttttccttaagacgatacactcat

SEQ ID NO: 591307 - DNA, 25 bp, Homo sapien
ttaagacgatacactcattttgctt

SEQ ID NO: 591308 - DNA, 25 bp, Homo sapien
taaaaatagactcttctccctgcta

SEQ ID NO: 591309 - DNA, 25 bp, Homo sapien
gaagtctgtgttcatatgaggaaga

SEQ ID NO: 591310 - DNA, 25 bp, Homo sapien
aagagaagaccaagccctgggactt

SEQ ID NO: 591311 - DNA, 25 bp, Homo sapien
tgggactttggctgaattcctccgt

SEQ ID NO: 591312 - DNA, 25 bp, Homo sapien
ggctggacggcagtgatctcctgtt

SEQ ID NO: 591313 - DNA, 25 bp, Homo sapien
tgtgtaaacaaagattccagggcgt

SEQ ID NO: 591314 - DNA, 25 bp, Homo sapien
agattccagggcgtggttttgcact

SEQ ID NO: 591315 - DNA, 25 bp, Homo sapien
gcgtggttttgcactcctgttgtac

SEQ ID NO: 591316 - DNA, 25 bp, Homo sapien
ggatagtcattcacgttctgagata

SEQ ID NO: 591317 - DNA, 25 bp, Homo sapien
gttctgagatatgcgctctctctat

SEQ ID NO: 591318 - DNA, 25 bp, Homo sapien
ctctctctattgttctcgtacacaa

SEQ ID NO: 591319 - DNA, 25 bp, Homo sapien
tctcgtacacaaagggatagtctct

SEQ ID NO: 591320 - DNA, 25 bp, Homo sapien
gctgggattccagattgtactttcg

SEQ ID NO: 591321 - DNA, 25 bp, Homo sapien
attccagattgtactttcggtgtca

SEQ ID NO: 591322 - DNA, 25 bp, Homo sapien
attgtactttcggtgtcatgactaa

SEQ ID NO: 591323 - DNA, 25 bp, Homo sapien
cggtgtcatgactaagaactctttg

SEQ ID NO: 591324 - DNA, 25 bp, Homo sapien
taagaactctttgctgacccctgga

SEQ ID NO: 591325 - DNA, 25 bp, Homo sapien
ctttgctgacccctggatcctgaag

SEQ ID NO: 591326 - DNA, 25 bp, Homo sapien
tttctttcactgtaggcttgtctct

SEQ ID NO: 591327 - DNA, 25 bp, Homo sapien
ttcactgtaggcttgtctctgtata

SEQ ID NO: 591328 - DNA, 25 bp, Homo sapien
tgtaggcttgtctctgtataaattc

SEQ ID NO: 591329 - DNA, 25 bp, Homo sapien
aatatggcaatatgtatctttgatt

SEQ ID NO: 591330 - DNA, 25 bp, Homo sapien
ttgattttcaaatgaacaagctcat

SEQ ID NO: 591331 - DNA, 25 bp, Homo sapien
tttatactgaacctctgacttgatt

SEQ ID NO: 591332 - DNA, 25 bp, Homo sapien
tatactgaacctctgacttgatttt

SEQ ID NO: 591333 - DNA, 25 bp, Homo sapien
atactgaacctctgacttgatttta

SEQ ID NO: 591334 - DNA, 25 bp, Homo sapien
actgaacctctgacttgattttatc

SEQ ID NO: 591335 - DNA, 25 bp, Homo sapien
tattcagtgggctccttaaggtgag

SEQ ID NO: 591336 - DNA, 25 bp, Homo sapien
cagtgggctccttaaggtgagttct

SEQ ID NO: 591337 - DNA, 25 bp, Homo sapien
agtgggctccttaaggtgagttctt

SEQ ID NO: 591338 - DNA, 25 bp, Homo sapien
gtgggctccttaaggtgagttcttg

SEQ ID NO: 591339 - DNA, 25 bp, Homo sapien
gggctccttaaggtgagttcttgaa

SEQ ID NO: 591340 - DNA, 25 bp, Homo sapien
ggctccttaaggtgagttcttgaag

SEQ ID NO: 591341 - DNA, 25 bp, Homo sapien
ccttaaggtgagttcttgaaggctt

SEQ ID NO: 591342 - DNA, 25 bp, Homo sapien
tgtgagggccaaggtctggccacgc

SEQ ID NO: 591343 - DNA, 25 bp, Homo sapien
acgctggccagtacccatgtccggg

SEQ ID NO: 591344 - DNA, 25 bp, Homo sapien
cagtacccatgtccgggcctgaatg

SEQ ID NO: 591345 - DNA, 25 bp, Homo sapien
catgtccgggcctgaatgcacagcc

SEQ ID NO: 591346 - DNA, 25 bp, Homo sapien
cactaaccagctctctctcttttga

SEQ ID NO: 591347 - DNA, 25 bp, Homo sapien
ctctcttttgactttcagaccagtt

SEQ ID NO: 591348 - DNA, 25 bp, Homo sapien
ttttgactttcagaccagttgttaa

SEQ ID NO: 591349 - DNA, 25 bp, Homo sapien
cagttgttaaattgcccgcctccgc

SEQ ID NO: 591350 - DNA, 25 bp, Homo sapien
gggtgtgtaatgtccagtccccagc

SEQ ID NO: 591351 - DNA, 25 bp, Homo sapien
ctgccatacctagactgtgtgtttc

SEQ ID NO: 591352 - DNA, 25 bp, Homo sapien
gaaagagaagtgaacatccagcccc

SEQ ID NO: 591353 - DNA, 25 bp, Homo sapien
catgcgctgaaaactttacgtaaac

SEQ ID NO: 591354 - DNA, 25 bp, Homo sapien
ctttcaacactatcgcaagggtgat

SEQ ID NO: 591355 - DNA, 25 bp, Homo sapien
atcgcaagggtgattaggtgctgat

SEQ ID NO: 591356 - DNA, 25 bp, Homo sapien
cctcatgaatggattgtcattgttg

SEQ ID NO: 591357 - DNA, 25 bp, Homo sapien
cattgttgagggagtgggttcctga

SEQ ID NO: 591358 - DNA, 25 bp, Homo sapien
agagaatgggtacagcctttccctc

SEQ ID NO: 591359 - DNA, 25 bp, Homo sapien
atgggtacagcctttccctctttct

SEQ ID NO: 591360 - DNA, 25 bp, Homo sapien
gtgctcttgtccttctgccataaga

SEQ ID NO: 591361 - DNA, 25 bp, Homo sapien
tcttgtccttctgccataagatcat

SEQ ID NO: 591362 - DNA, 25 bp, Homo sapien
gtccttctgccataagatcatggag

SEQ ID NO: 591363 - DNA, 25 bp, Homo sapien
ttctgccataagatcatggagcaag

SEQ ID NO: 591364 - DNA, 25 bp, Homo sapien
atatccttttactttcgtatatgca

SEQ ID NO: 591365 - DNA, 25 bp, Homo sapien
actttcgtatatgcatggaacatca

SEQ ID NO: 591366 - DNA, 25 bp, Homo sapien
ggaacatcaaatcactaaatagttg

SEQ ID NO: 591367 - DNA, 25 bp, Homo sapien
actccaaagtcaactaggtaaagtg

SEQ ID NO: 591368 - DNA, 25 bp, Homo sapien
gtcaactaggtaaagtggctcagga

SEQ ID NO: 591369 - DNA, 25 bp, Homo sapien
gtggctcaggatgtgctttaataac

SEQ ID NO: 591370 - DNA, 25 bp, Homo sapien
ggatgtgctttaataacctctaatg

SEQ ID NO: 591371 - DNA, 25 bp, Homo sapien
gtgctttaataacctctaatgccta

SEQ ID NO: 591372 - DNA, 25 bp, Homo sapien
ataacctctaatgcctaaacaaaca

SEQ ID NO: 591373 - DNA, 25 bp, Homo sapien
gacagaaatacggatatggtgacct

SEQ ID NO: 591374 - DNA, 25 bp, Homo sapien
gaaatacggatatggtgacctataa

SEQ ID NO: 591375 - DNA, 25 bp, Homo sapien
accagaatgggccacatggaaattg

SEQ ID NO: 591376 - DNA, 25 bp, Homo sapien
catggaaattgggatggcggttctt

SEQ ID NO: 591377 - DNA, 25 bp, Homo sapien
gatggcggttcttgttaagctcccc

SEQ ID NO: 591378 - DNA, 25 bp, Homo sapien
gttcttgttaagctcccctatgccg

SEQ ID NO: 591379 - DNA, 25 bp, Homo sapien
tatgccgcccagcaggaaaccagtc

SEQ ID NO: 591380 - DNA, 25 bp, Homo sapien
ccagcaggaaaccagtcaccgtgtc

SEQ ID NO: 591381 - DNA, 25 bp, Homo sapien
ggaaaccagtcaccgtgtcctcgtc

SEQ ID NO: 591382 - DNA, 25 bp, Homo sapien
gtctccgatcactgcgatgagctta

SEQ ID NO: 591383 - DNA, 25 bp, Homo sapien
cgatcactgcgatgagcttacccct

SEQ ID NO: 591384 - DNA, 25 bp, Homo sapien
gcagccgggcagagctcaccctaga

SEQ ID NO: 591385 - DNA, 25 bp, Homo sapien
agagctcaccctagagcaccagaag

SEQ ID NO: 591386 - DNA, 25 bp, Homo sapien
gccagcactaacttggcaagcatgt

SEQ ID NO: 591387 - DNA, 25 bp, Homo sapien
ccagcactaacttggcaagcatgtt

SEQ ID NO: 591388 - DNA, 25 bp, Homo sapien
gagctcctaagccagagccatgcag

SEQ ID NO: 591389 - DNA, 25 bp, Homo sapien
agctcctaagccagagccatgcaga

SEQ ID NO: 591390 - DNA, 25 bp, Homo sapien
ctcctaagccagagccatgcagatg

SEQ ID NO: 591391 - DNA, 25 bp, Homo sapien
tcctaagccagagccatgcagatgg

SEQ ID NO: 591392 - DNA, 25 bp, Homo sapien
ctaagccagagccatgcagatggat

SEQ ID NO: 591393 - DNA, 25 bp, Homo sapien
aagccagagccatgcagatggattc

SEQ ID NO: 591394 - DNA, 25 bp, Homo sapien
gccagagccatgcagatggattctt

SEQ ID NO: 591395 - DNA, 25 bp, Homo sapien
gagccatgcagatggattcttggcc

SEQ ID NO: 591396 - DNA, 25 bp, Homo sapien
gccatgcagatggattcttggcccc

SEQ ID NO: 591397 - DNA, 25 bp, Homo sapien
ggtagacaaggatcgtgccccatgg

SEQ ID NO: 591398 - DNA, 25 bp, Homo sapien
gatcgtgccccatggctgatgggcc

SEQ ID NO: 591399 - DNA, 25 bp, Homo sapien
ccctgtgcacagaaagagcctaagt

SEQ ID NO: 591400 - DNA, 25 bp, Homo sapien
aaagagcctaagtgcagagaagcca

SEQ ID NO: 591401 - DNA, 25 bp, Homo sapien
aatgtgatggccacagacaccctca

SEQ ID NO: 591402 - DNA, 25 bp, Homo sapien
agacaccctcatggcacagacatgg

SEQ ID NO: 591403 - DNA, 25 bp, Homo sapien
acagacatggccagcctctgacgtt

SEQ ID NO: 591404 - DNA, 25 bp, Homo sapien
tctgacgttcctctgcatcagagta

SEQ ID NO: 591405 - DNA, 25 bp, Homo sapien
gcatcagagtagttctgtcctcgaa

SEQ ID NO: 591406 - DNA, 25 bp, Homo sapien
agtagttctgtcctcgaagccccag

SEQ ID NO: 591407 - DNA, 25 bp, Homo sapien
gagatgtcagatcccgtttaataaa

SEQ ID NO: 591408 - DNA, 25 bp, Homo sapien
ccagttgttaaattgcccgcctccg

SEQ ID NO: 591409 - DNA, 25 bp, Homo sapien
ttaaattgcccgcctccgccaaggg

SEQ ID NO: 591410 - DNA, 25 bp, Homo sapien
ccaagggccccctgggtgtgtaatg

SEQ ID NO: 591411 - DNA, 25 bp, Homo sapien
ctgggtgtgtaatgtccagtcccca

SEQ ID NO: 591412 - DNA, 25 bp, Homo sapien
gggtgtgtaatgtccagtccccagc

SEQ ID NO: 591413 - DNA, 25 bp, Homo sapien
tgtcccctgccatacctagactgtg

SEQ ID NO: 591414 - DNA, 25 bp, Homo sapien
cctgccatacctagactgtgtgttt

SEQ ID NO: 591415 - DNA, 25 bp, Homo sapien
ctgccatacctagactgtgtgtttc

SEQ ID NO: 591416 - DNA, 25 bp, Homo sapien
gccatacctagactgtgtgtttcat

SEQ ID NO: 591417 - DNA, 25 bp, Homo sapien
catacctagactgtgtgtttcatat

SEQ ID NO: 591418 - DNA, 25 bp, Homo sapien
gaaagagaagtgaacatccagcccc

SEQ ID NO: 591419 - DNA, 25 bp, Homo sapien
tgaagaagcatcctatagtctccag

SEQ ID NO: 591420 - DNA, 25 bp, Homo sapien
gaagcatcctatagtctccaggaga

SEQ ID NO: 591421 - DNA, 25 bp, Homo sapien
gtctccaggagaatctgccttctga

SEQ ID NO: 591422 - DNA, 25 bp, Homo sapien
gagaatctgccttctgatgagagct

SEQ ID NO: 591423 - DNA, 25 bp, Homo sapien
ctgatgagagctgtctttctcttga

SEQ ID NO: 591424 - DNA, 25 bp, Homo sapien
gagagctgtctttctcttgatgatc

SEQ ID NO: 591425 - DNA, 25 bp, Homo sapien
tgatgatcttgccaaaaggatagag

SEQ ID NO: 591426 - DNA, 25 bp, Homo sapien
aaaggatagagattgcagaggtaaa

SEQ ID NO: 591427 - DNA, 25 bp, Homo sapien
gtaagttttcccttgtctcaaacat

SEQ ID NO: 591428 - DNA, 25 bp, Homo sapien
gttttcccttgtctcaaacatgagg

SEQ ID NO: 591429 - DNA, 25 bp, Homo sapien
catgagggaaaattctagttaacgt

SEQ ID NO: 591430 - DNA, 25 bp, Homo sapien
ataaaggtcttcatcattgtcgttt

SEQ ID NO: 591431 - DNA, 25 bp, Homo sapien
aaggtcttcatcattgtcgttttca

SEQ ID NO: 591432 - DNA, 25 bp, Homo sapien
ggtcttcatcattgtcgttttcata

SEQ ID NO: 591433 - DNA, 25 bp, Homo sapien
catcattgtcgttttcatattgaat

SEQ ID NO: 591434 - DNA, 25 bp, Homo sapien
gtcgttttcatattgaataggctga

SEQ ID NO: 591435 - DNA, 25 bp, Homo sapien
aaattagagtgtaagtgaacccgca

SEQ ID NO: 591436 - DNA, 25 bp, Homo sapien
tagagtgtaagtgaacccgcacagt

SEQ ID NO: 591437 - DNA, 25 bp, Homo sapien
agtgtaagtgaacccgcacagttca

SEQ ID NO: 591438 - DNA, 25 bp, Homo sapien
aactgtagtttaaatctgagtgtca

SEQ ID NO: 591439 - DNA, 25 bp, Homo sapien
gtagtttaaatctgagtgtcaactc

SEQ ID NO: 591440 - DNA, 25 bp, Homo sapien
caataaattggtagaggcttcctgg

SEQ ID NO: 591441 - DNA, 25 bp, Homo sapien
ggaagattaagttgtagtgttctat

SEQ ID NO: 591442 - DNA, 25 bp, Homo sapien
attaagttgtagtgttctatagctc

SEQ ID NO: 591443 - DNA, 25 bp, Homo sapien
ttaagttgtagtgttctatagctct

SEQ ID NO: 591444 - DNA, 25 bp, Homo sapien
actaattaccctaatctgatcactg

SEQ ID NO: 591445 - DNA, 25 bp, Homo sapien
aattaccctaatctgatcactgtat

SEQ ID NO: 591446 - DNA, 25 bp, Homo sapien
attaccctaatctgatcactgtata

SEQ ID NO: 591447 - DNA, 25 bp, Homo sapien
ttaccctaatctgatcactgtatat

SEQ ID NO: 591448 - DNA, 25 bp, Homo sapien
taccctaatctgatcactgtatatt

SEQ ID NO: 591449 - DNA, 25 bp, Homo sapien
accctaatctgatcactgtatattt

SEQ ID NO: 591450 - DNA, 25 bp, Homo sapien
ccctaatctgatcactgtatatttt

SEQ ID NO: 591451 - DNA, 25 bp, Homo sapien
tgtgtattgcaatgtcactatgtac

SEQ ID NO: 591452 - DNA, 25 bp, Homo sapien
agcattttatacctagtctgagcga

SEQ ID NO: 591453 - DNA, 25 bp, Homo sapien
tacctagtctgagcgagaatctgag

SEQ ID NO: 591454 - DNA, 25 bp, Homo sapien
aatctgagagtgatctttcctatag

SEQ ID NO: 591455 - DNA, 25 bp, Homo sapien
gagagtgatctttcctatagtatag

SEQ ID NO: 591456 - DNA, 25 bp, Homo sapien
gtagggtacatggatcttttcacaa

SEQ ID NO: 591457 - DNA, 25 bp, Homo sapien
ggatcttttcacaataagctgctgc

SEQ ID NO: 591458 - DNA, 25 bp, Homo sapien
ataagctgctgctcggaggcatttg

SEQ ID NO: 591459 - DNA, 25 bp, Homo sapien
gaggcatttgtcacttctgagtttg

SEQ ID NO: 591460 - DNA, 25 bp, Homo sapien
gcttccagtgaagtgaggtattaac

SEQ ID NO: 591461 - DNA, 25 bp, Homo sapien
cactgaatagatttggatatactcc

SEQ ID NO: 591462 - DNA, 25 bp, Homo sapien
gatatactcctggtcacagtccgtt

SEQ ID NO: 591463 - DNA, 25 bp, Homo sapien
tgtgcatggccccagctgccatatt

SEQ ID NO: 591464 - DNA, 25 bp, Homo sapien
atggccccagctgccatattttcaa

SEQ ID NO: 591465 - DNA, 25 bp, Homo sapien
ccagctgccatattttcaaagatgt

SEQ ID NO: 591466 - DNA, 25 bp, Homo sapien
gctgccatattttcaaagatgtagt

SEQ ID NO: 591467 - DNA, 25 bp, Homo sapien
gtcttcaaaagttctactcaaagat

SEQ ID NO: 591468 - DNA, 25 bp, Homo sapien
aaagttctactcaaagatgcactgc

SEQ ID NO: 591469 - DNA, 25 bp, Homo sapien
ggattttcctagaaactctaatgtg

SEQ ID NO: 591470 - DNA, 25 bp, Homo sapien
tagaaactctaatgtgtccaccagg

SEQ ID NO: 591471 - DNA, 25 bp, Homo sapien
ctcatctctaggttgaatttatcca

SEQ ID NO: 591472 - DNA, 25 bp, Homo sapien
ggttgaatttatccaaggtattatt

SEQ ID NO: 591473 - DNA, 25 bp, Homo sapien
atgtaataaacaccatgttttgtta

SEQ ID NO: 591474 - DNA, 25 bp, Homo sapien
cttcagaagtgaactatgggctgct

SEQ ID NO: 591475 - DNA, 25 bp, Homo sapien
gctgctgggagcaactagtgacttt

SEQ ID NO: 591476 - DNA, 25 bp, Homo sapien
aactagtgactttgattcccatgga

SEQ ID NO: 591477 - DNA, 25 bp, Homo sapien
tagtgactttgattcccatggaggg

SEQ ID NO: 591478 - DNA, 25 bp, Homo sapien
gtttctttaaggatgctgacctgga

SEQ ID NO: 591479 - DNA, 25 bp, Homo sapien
ctttaaggatgctgacctggaggcc

SEQ ID NO: 591480 - DNA, 25 bp, Homo sapien
cagggtgaaggcttcagctcactgt

SEQ ID NO: 591481 - DNA, 25 bp, Homo sapien
aaggcttcagctcactgttgtagtg

SEQ ID NO: 591482 - DNA, 25 bp, Homo sapien
ttgtagtgacgttttgtgtagatct

SEQ ID NO: 591483 - DNA, 25 bp, Homo sapien
gtgtagatctttataagcttttgag

SEQ ID NO: 591484 - DNA, 25 bp, Homo sapien
gaatgtgaaatagcaccatcaaaat

SEQ ID NO: 591485 - DNA, 25 bp, Homo sapien
gattgcatcttaactgccttgcttg

SEQ ID NO: 591486 - DNA, 25 bp, Homo sapien
taactgccttgcttgcagtttcttt

SEQ ID NO: 591487 - DNA, 25 bp, Homo sapien
tgtcatcatgacttccagttacctt

SEQ ID NO: 591488 - DNA, 25 bp, Homo sapien
taccttctgggaccggttgtcaaat

SEQ ID NO: 591489 - DNA, 25 bp, Homo sapien
acggaggctcactcagattgttgct

SEQ ID NO: 591490 - DNA, 25 bp, Homo sapien
gattgttgctgcaccacaatggaaa

SEQ ID NO: 591491 - DNA, 25 bp, Homo sapien
gaaatgccagtatgaagccgctgat

SEQ ID NO: 591492 - DNA, 25 bp, Homo sapien
gccgctgatgttaggaaggctccag

SEQ ID NO: 591493 - DNA, 25 bp, Homo sapien
gctccaggttgtgcaattccataga

SEQ ID NO: 591494 - DNA, 25 bp, Homo sapien
atttccaaccatactggagtcgcgt

SEQ ID NO: 591495 - DNA, 25 bp, Homo sapien
ggagtcgcgtatatacatattcaag

SEQ ID NO: 591496 - DNA, 25 bp, Homo sapien
taggtttagggagaaactgttcctg

SEQ ID NO: 591497 - DNA, 25 bp, Homo sapien
attatctttcttccaccctgtattc

SEQ ID NO: 591498 - DNA, 25 bp, Homo sapien
tttcttccaccctgtattcactctt

SEQ ID NO: 591499 - DNA, 25 bp, Homo sapien
ttcactcttcatcctcagtgtttat

SEQ ID NO: 591500 - DNA, 25 bp, Homo sapien
tttattcagaaactgtgtggcacaa

SEQ ID NO: 591501 - DNA, 25 bp, Homo sapien
tgtggcacaaataaaaacaccttgg

SEQ ID NO: 591502 - DNA, 25 bp, Homo sapien
aaatagaaatacttgcccaccaaag

SEQ ID NO: 591503 - DNA, 25 bp, Homo sapien
ttgcccaccaaagatccacagaaat

SEQ ID NO: 591504 - DNA, 25 bp, Homo sapien
ttgacttaccgttcctgtcctcaac

SEQ ID NO: 591505 - DNA, 25 bp, Homo sapien
gttcctgtcctcaacatatgtatag

SEQ ID NO: 591506 - DNA, 25 bp, Homo sapien
atgtatagcttacctatttctgcac

SEQ ID NO: 591507 - DNA, 25 bp, Homo sapien
gataacgacatggaggaattctaca

SEQ ID NO: 591508 - DNA, 25 bp, Homo sapien
gaattctacatctgaatgccctctg

SEQ ID NO: 591509 - DNA, 25 bp, Homo sapien
atctgaatgccctctgctcttgttc

SEQ ID NO: 591510 - DNA, 25 bp, Homo sapien
tctgctcttgttctcgaaacacaca

SEQ ID NO: 591511 - DNA, 25 bp, Homo sapien
tgttctcgaaacacacaaactcaga

SEQ ID NO: 591512 - DNA, 25 bp, Homo sapien
tggccactgagcacaccacattctt

SEQ ID NO: 591513 - DNA, 25 bp, Homo sapien
accacattcttcatgatccatttcc

SEQ ID NO: 591514 - DNA, 25 bp, Homo sapien
ttcttcatgatccatttcccaggag

SEQ ID NO: 591515 - DNA, 25 bp, Homo sapien
tgatccatttcccaggagcccgtag

SEQ ID NO: 591516 - DNA, 25 bp, Homo sapien
aggagcccgtagcacatttgcctac

SEQ ID NO: 591517 - DNA, 25 bp, Homo sapien
aataaattctcaacaaacttgtcat

SEQ ID NO: 591518 - DNA, 25 bp, Homo sapien
agcaactttgactacttcctgtctt

SEQ ID NO: 591519 - DNA, 25 bp, Homo sapien
gcaactttgactacttcctgtctta

SEQ ID NO: 591520 - DNA, 25 bp, Homo sapien
caactttgactacttcctgtcttag

SEQ ID NO: 591521 - DNA, 25 bp, Homo sapien
cttcctgtcttagtaatagaccaat

SEQ ID NO: 591522 - DNA, 25 bp, Homo sapien
agtaatagaccaatacatggctcta

SEQ ID NO: 591523 - DNA, 25 bp, Homo sapien
agaccaatacatggctctatttagc

SEQ ID NO: 591524 - DNA, 25 bp, Homo sapien
accaatacatggctctatttagcaa

SEQ ID NO: 591525 - DNA, 25 bp, Homo sapien
aatacatggctctatttagcaaagt

SEQ ID NO: 591526 - DNA, 25 bp, Homo sapien
tacatggctctatttagcaaagttt

SEQ ID NO: 591527 - DNA, 25 bp, Homo sapien
catggctctatttagcaaagttttt

SEQ ID NO: 591528 - DNA, 25 bp, Homo sapien
ggctctatttagcaaagtttttata

SEQ ID NO: 591529 - DNA, 25 bp, Homo sapien
tttttagagcttcagttttatggga

SEQ ID NO: 591530 - DNA, 25 bp, Homo sapien
ggaaaagttcaatctctattttggt

SEQ ID NO: 591531 - DNA, 25 bp, Homo sapien
ttggtccacaaggatcaagtgctta

SEQ ID NO: 591532 - DNA, 25 bp, Homo sapien
caagtgcttatgaaccagaccaaaa

SEQ ID NO: 591533 - DNA, 25 bp, Homo sapien
gacatcttccttaacaaccatagcc

SEQ ID NO: 591534 - DNA, 25 bp, Homo sapien
atagcctctacttttcagccagttt

SEQ ID NO: 591535 - DNA, 25 bp, Homo sapien
cagccagtttgcatttgtcaattct

SEQ ID NO: 591536 - DNA, 25 bp, Homo sapien
attcttctttctcctgatgttttaa

SEQ ID NO: 591537 - DNA, 25 bp, Homo sapien
tatgtggtcttgtattccttccttt

SEQ ID NO: 591538 - DNA, 25 bp, Homo sapien
attccttccttttgagtatgggagc

SEQ ID NO: 591539 - DNA, 25 bp, Homo sapien
agtatgggagctctctggcttttcc

SEQ ID NO: 591540 - DNA, 25 bp, Homo sapien
ttttaattatccagcctccagcaaa

SEQ ID NO: 591541 - DNA, 25 bp, Homo sapien
gctgatagctaccatagtttgccaa

SEQ ID NO: 591542 - DNA, 25 bp, Homo sapien
attgtttttggactctacaggaata

SEQ ID NO: 591543 - DNA, 25 bp, Homo sapien
ggactctacaggaatagaacccttc

SEQ ID NO: 591544 - DNA, 25 bp, Homo sapien
aaggttgttttctaggcattttcag

SEQ ID NO: 591545 - DNA, 25 bp, Homo sapien
gttttctaggcattttcagtgttac

SEQ ID NO: 591546 - DNA, 25 bp, Homo sapien
gtgttactgatatcccaggaactgt

SEQ ID NO: 591547 - DNA, 25 bp, Homo sapien
aggaactgtcagatcaccacccggc

SEQ ID NO: 591548 - DNA, 25 bp, Homo sapien
caccacccggcacatttttcatttt

SEQ ID NO: 591549 - DNA, 25 bp, Homo sapien
tttttatctgcacttgtcttacatg

SEQ ID NO: 591550 - DNA, 25 bp, Homo sapien
cttgtcttacatgcgaaatattttc

SEQ ID NO: 591551 - DNA, 25 bp, Homo sapien
ccattcaggaatacatacggcaact

SEQ ID NO: 591552 - DNA, 25 bp, Homo sapien
catacggcaactgcctcctaatttt

SEQ ID NO: 591553 - DNA, 25 bp, Homo sapien
tcctaattttccctacagagatgat

SEQ ID NO: 591554 - DNA, 25 bp, Homo sapien
gatgtcatgtcagtgaatcctacct

SEQ ID NO: 591555 - DNA, 25 bp, Homo sapien
gaatcctacctgtttggtccttatt

SEQ ID NO: 591556 - DNA, 25 bp, Homo sapien
ggtccttattattcttctgtttatt

SEQ ID NO: 591557 - DNA, 25 bp, Homo sapien
ttacttgattagctgtgtttggaac

SEQ ID NO: 591558 - DNA, 25 bp, Homo sapien
ggaactgctaccgatacatcaatgg

SEQ ID NO: 591559 - DNA, 25 bp, Homo sapien
gaactcctctgatgtcctggtttat

SEQ ID NO: 591560 - DNA, 25 bp, Homo sapien
gcaatgacactacggtgctgctacc

SEQ ID NO: 591561 - DNA, 25 bp, Homo sapien
tgccactgtgaatggtgctgccaag

SEQ ID NO: 591562 - DNA, 25 bp, Homo sapien
aaatgcagataaaggctacctctga

SEQ ID NO: 591563 - DNA, 25 bp, Homo sapien
taaaggctacctctgaattctcaat

SEQ ID NO: 591564 - DNA, 25 bp, Homo sapien
aaaggctacctctgaattctcaata

SEQ ID NO: 591565 - DNA, 25 bp, Homo sapien
aggctacctctgaattctcaataga

SEQ ID NO: 591566 - DNA, 25 bp, Homo sapien
gaattctcaatagattcatcatgtt

SEQ ID NO: 591567 - DNA, 25 bp, Homo sapien
aatagattcatcatgtttgctctta

SEQ ID NO: 591568 - DNA, 25 bp, Homo sapien
gattcatcatgtttgctcttaagtg

SEQ ID NO: 591569 - DNA, 25 bp, Homo sapien
tcatcatgtttgctcttaagtgtag

SEQ ID NO: 591570 - DNA, 25 bp, Homo sapien
gtttgctcttaagtgtagctgtcca

SEQ ID NO: 591571 - DNA, 25 bp, Homo sapien
tgctcttaagtgtagctgtccacac

SEQ ID NO: 591572 - DNA, 25 bp, Homo sapien
ctcttaagtgtagctgtccacactg

SEQ ID NO: 591573 - DNA, 25 bp, Homo sapien
tttttcattcactccacttattttt

SEQ ID NO: 591574 - DNA, 25 bp, Homo sapien
cattcactccacttatttttatatt

SEQ ID NO: 591575 - DNA, 25 bp, Homo sapien
tccattttattgcatttatctattg

SEQ ID NO: 591576 - DNA, 25 bp, Homo sapien
gatatacttcattctttttgattgc

SEQ ID NO: 591577 - DNA, 25 bp, Homo sapien
acttcattctttttgattgctaaat

SEQ ID NO: 591578 - DNA, 25 bp, Homo sapien
ttttgattgctaaatactattgcgg

SEQ ID NO: 591579 - DNA, 25 bp, Homo sapien
tactattgcggtatacaaccacact

SEQ ID NO: 591580 - DNA, 25 bp, Homo sapien
ggtatacaaccacactaaacatttt

SEQ ID NO: 591581 - DNA, 25 bp, Homo sapien
attttattatccatccatttgtcga

SEQ ID NO: 591582 - DNA, 25 bp, Homo sapien
ccatttgtcgatggacattttggtt

SEQ ID NO: 591583 - DNA, 25 bp, Homo sapien
ctcatttggggctcttgtaaataaa

SEQ ID NO: 591584 - DNA, 25 bp, Homo sapien
ggttgacatttgggtcattctttgt

SEQ ID NO: 591585 - DNA, 25 bp, Homo sapien
atgtgcatcctcaggcatttactgg

SEQ ID NO: 591586 - DNA, 25 bp, Homo sapien
gcatcctcaggcatttactggcata

SEQ ID NO: 591587 - DNA, 25 bp, Homo sapien
gcatttactggcatagctggtctcc

SEQ ID NO: 591588 - DNA, 25 bp, Homo sapien
tggcatagctggtctccccacagat

SEQ ID NO: 591589 - DNA, 25 bp, Homo sapien
tccccacagatgctcccagttgtga

SEQ ID NO: 591590 - DNA, 25 bp, Homo sapien
taaaatgccccggttgagaaattct

SEQ ID NO: 591591 - DNA, 25 bp, Homo sapien
gagaaattctactctccatttttat

SEQ ID NO: 591592 - DNA, 25 bp, Homo sapien
attctactctccatttttattacag

SEQ ID NO: 591593 - DNA, 25 bp, Homo sapien
actctccatttttattacagttatt

SEQ ID NO: 591594 - DNA, 25 bp, Homo sapien
ttgttattgtaaatggactctttaa

SEQ ID NO: 591595 - DNA, 25 bp, Homo sapien
ggaagaactgtgtagcaccattgat

SEQ ID NO: 591596 - DNA, 25 bp, Homo sapien
gtagcaccattgatcacaatgtaac

SEQ ID NO: 591597 - DNA, 25 bp, Homo sapien
ttccatgctgcattaagggtgtctc

SEQ ID NO: 591598 - DNA, 25 bp, Homo sapien
atgctgcattaagggtgtctctctc

SEQ ID NO: 591599 - DNA, 25 bp, Homo sapien
gtgtgtgacaagcacctcgtgaacc

SEQ ID NO: 591600 - DNA, 25 bp, Homo sapien
gtgacaagcacctcgtgaaccacta

SEQ ID NO: 591601 - DNA, 25 bp, Homo sapien
tcgtgaaccactactactgcaagcg

SEQ ID NO: 591602 - DNA, 25 bp, Homo sapien
gtgaaccactactactgcaagcgcc

SEQ ID NO: 591603 - DNA, 25 bp, Homo sapien
tgcaagcgccccatctatgagttca

SEQ ID NO: 591604 - DNA, 25 bp, Homo sapien
aagcgccccatctatgagttcaaga

SEQ ID NO: 591605 - DNA, 25 bp, Homo sapien
gccccatctatgagttcaagatcac

SEQ ID NO: 591606 - DNA, 25 bp, Homo sapien
tgaatcactccaaacccgcatttac

SEQ ID NO: 591607 - DNA, 25 bp, Homo sapien
gatataagctttgatgcctcttcaa

SEQ ID NO: 591608 - DNA, 25 bp, Homo sapien
gatgcctcttcaattcttaggacat

SEQ ID NO: 591609 - DNA, 25 bp, Homo sapien
atgaatgttgccacagcattttatt

SEQ ID NO: 591610 - DNA, 25 bp, Homo sapien
gcattttattacctagcttcatatg

SEQ ID NO: 591611 - DNA, 25 bp, Homo sapien
gaaactgcccaaatgcctagaacat

SEQ ID NO: 591612 - DNA, 25 bp, Homo sapien
tagaacatcacataaggcactaaat

SEQ ID NO: 591613 - DNA, 25 bp, Homo sapien
ggcactaaatgcctcatgttttact

SEQ ID NO: 591614 - DNA, 25 bp, Homo sapien
atgcctcatgttttactgacgggaa

SEQ ID NO: 591615 - DNA, 25 bp, Homo sapien
catgttttactgacgggaattgaat

SEQ ID NO: 591616 - DNA, 25 bp, Homo sapien
gaattgtacattttgctgagtagtt

SEQ ID NO: 591617 - DNA, 25 bp, Homo sapien
gggctcacaccaagtaaccgatggg

SEQ ID NO: 591618 - DNA, 25 bp, Homo sapien
ggacattgtgtaaccgcgccctgag

SEQ ID NO: 591619 - DNA, 25 bp, Homo sapien
tttcattttcaatcactctctcctt

SEQ ID NO: 591620 - DNA, 25 bp, Homo sapien
tttcaatcactctctcctttggttg

SEQ ID NO: 591621 - DNA, 25 bp, Homo sapien
tctcctttggttgcttcattctttt

SEQ ID NO: 591622 - DNA, 25 bp, Homo sapien
tttttggctttctttgtgctttttg

SEQ ID NO: 591623 - DNA, 25 bp, Homo sapien
gtcccattctttgttcaaaatgtca

SEQ ID NO: 591624 - DNA, 25 bp, Homo sapien
accggtaacactcccatgatcagga

SEQ ID NO: 591625 - DNA, 25 bp, Homo sapien
atgatcaggacccaaggctacacac

SEQ ID NO: 591626 - DNA, 25 bp, Homo sapien
aggctacacacagcggaggtgctta

SEQ ID NO: 591627 - DNA, 25 bp, Homo sapien
ggaggtgcttaacgcacatcccagg

SEQ ID NO: 591628 - DNA, 25 bp, Homo sapien
caatttgatggtatctgctttctaa

SEQ ID NO: 591629 - DNA, 25 bp, Homo sapien
gatggtatctgctttctaacaattt

SEQ ID NO: 591630 - DNA, 25 bp, Homo sapien
ggtatctgctttctaacaatttttt

SEQ ID NO: 591631 - DNA, 25 bp, Homo sapien
gctttctaacaattttttactggct

SEQ ID NO: 591632 - DNA, 25 bp, Homo sapien
ctaacaattttttactggctcttca

SEQ ID NO: 591633 - DNA, 25 bp, Homo sapien
acaattttttactggctcttcatca

SEQ ID NO: 591634 - DNA, 25 bp, Homo sapien
attttttactggctcttcatcagta

SEQ ID NO: 591635 - DNA, 25 bp, Homo sapien
actggctcttcatcagtatatgtga

SEQ ID NO: 591636 - DNA, 25 bp, Homo sapien
ggctcttcatcagtatatgtgataa

SEQ ID NO: 591637 - DNA, 25 bp, Homo sapien
gtgataaaacaaaatcctcttcttt

SEQ ID NO: 591638 - DNA, 25 bp, Homo sapien
aacaaaatcctcttctttcatttgt

SEQ ID NO: 591639 - DNA, 25 bp, Homo sapien
aaaacactcccactgtgattcacat

SEQ ID NO: 591640 - DNA, 25 bp, Homo sapien
actcccactgtgattcacattattt

SEQ ID NO: 591641 - DNA, 25 bp, Homo sapien
cacattattttatagcacaaccaat

SEQ ID NO: 591642 - DNA, 25 bp, Homo sapien
cttttcatttcagtggtaaacagct

SEQ ID NO: 591643 - DNA, 25 bp, Homo sapien
ttgtttaaagcaatggtacccaatc

SEQ ID NO: 591644 - DNA, 25 bp, Homo sapien
aatggtacccaatcttaagcatgtg

SEQ ID NO: 591645 - DNA, 25 bp, Homo sapien
taagcatgtgtaaaggtctccctgg

SEQ ID NO: 591646 - DNA, 25 bp, Homo sapien
atgtgtaaaggtctccctgggtctg

SEQ ID NO: 591647 - DNA, 25 bp, Homo sapien
actaaatatgttgcgtgtacctgtg

SEQ ID NO: 591648 - DNA, 25 bp, Homo sapien
atatgttgcgtgtacctgtgtgtgt

SEQ ID NO: 591649 - DNA, 25 bp, Homo sapien
tatgaagtttgctcacaaaacactc

SEQ ID NO: 591650 - DNA, 25 bp, Homo sapien
gataaagagccgtttcactgtccca

SEQ ID NO: 591651 - DNA, 25 bp, Homo sapien
actgtcccaataatcctctgtgttt

SEQ ID NO: 591652 - DNA, 25 bp, Homo sapien
aataatcctctgtgtttcgcctact

SEQ ID NO: 591653 - DNA, 25 bp, Homo sapien
tgtgtttcgcctactcctctaaact

SEQ ID NO: 591654 - DNA, 25 bp, Homo sapien
actcctctaaactcctggctatttt

SEQ ID NO: 591655 - DNA, 25 bp, Homo sapien
ttttgtctccataattttgcctctg

SEQ ID NO: 591656 - DNA, 25 bp, Homo sapien
tttgcctctgaaccataaagtatgc

SEQ ID NO: 591657 - DNA, 25 bp, Homo sapien
gccttttcagattgatttgtttcac

SEQ ID NO: 591658 - DNA, 25 bp, Homo sapien
tcttttcgtagcttgctagctcttt

SEQ ID NO: 591659 - DNA, 25 bp, Homo sapien
aatatgctattgtctggaagtacca

SEQ ID NO: 591660 - DNA, 25 bp, Homo sapien
actgaaggacaccttaattgcttcc

SEQ ID NO: 591661 - DNA, 25 bp, Homo sapien
gggaaagatgattctgtattattca

SEQ ID NO: 591662 - DNA, 25 bp, Homo sapien
gatgattctgtattattcagtagca

SEQ ID NO: 591663 - DNA, 25 bp, Homo sapien
attctgtattattcagtagcataga

SEQ ID NO: 591664 - DNA, 25 bp, Homo sapien
tctgtattattcagtagcatagaca

SEQ ID NO: 591665 - DNA, 25 bp, Homo sapien
gtattattcagtagcatagacattt

SEQ ID NO: 591666 - DNA, 25 bp, Homo sapien
tattcagtagcatagacattttgca

SEQ ID NO: 591667 - DNA, 25 bp, Homo sapien
ggcactaatgttgattgaaatcaaa

SEQ ID NO: 591668 - DNA, 25 bp, Homo sapien
tgcattctggaagcctccatcgcag

SEQ ID NO: 591669 - DNA, 25 bp, Homo sapien
cattctggaagcctccatcgcaggg

SEQ ID NO: 591670 - DNA, 25 bp, Homo sapien
ctcggcagggtatgtgagctttgtt

SEQ ID NO: 591671 - DNA, 25 bp, Homo sapien
ggacagagaggcatggcccacaggc

SEQ ID NO: 591672 - DNA, 25 bp, Homo sapien
gtaccggttgaaagtgtctctacct

SEQ ID NO: 591673 - DNA, 25 bp, Homo sapien
tcgatctgtcccaagcattcatgtt

SEQ ID NO: 591674 - DNA, 25 bp, Homo sapien
ccctcaccagctgtagtaagttgat

SEQ ID NO: 591675 - DNA, 25 bp, Homo sapien
gttgataatcctaaaaagccttggc

SEQ ID NO: 591676 - DNA, 25 bp, Homo sapien
aaagccttggctattcatcagacat

SEQ ID NO: 591677 - DNA, 25 bp, Homo sapien
gccttggctattcatcagacatttg

SEQ ID NO: 591678 - DNA, 25 bp, Homo sapien
cagacatttgttaagcacagtggac

SEQ ID NO: 591679 - DNA, 25 bp, Homo sapien
agcacagtggacagacatttcttaa

SEQ ID NO: 591680 - DNA, 25 bp, Homo sapien
gtggacagacatttcttaagcattg

SEQ ID NO: 591681 - DNA, 25 bp, Homo sapien
gcattgtgctagatattaaggatac

SEQ ID NO: 591682 - DNA, 25 bp, Homo sapien
atataaagagtccagtctctacaaa

SEQ ID NO: 591683 - DNA, 25 bp, Homo sapien
ggagggtttaatagtattcttagct

SEQ ID NO: 591684 - DNA, 25 bp, Homo sapien
ggtttaatagtattcttagctgaag

SEQ ID NO: 591685 - DNA, 25 bp, Homo sapien
tcagaagacaatatccataccaaag

SEQ ID NO: 591686 - DNA, 25 bp, Homo sapien
aagacaatatccataccaaagcaca

SEQ ID NO: 591687 - DNA, 25 bp, Homo sapien
agcacagagagacaaaaggatggaa

SEQ ID NO: 591688 - DNA, 25 bp, Homo sapien
gtaagagacaaatgggacactgtta

SEQ ID NO: 591689 - DNA, 25 bp, Homo sapien
gagacaaatgggacactgttaaaag

SEQ ID NO: 591690 - DNA, 25 bp, Homo sapien
caaatgggacactgttaaaagtcta

SEQ ID NO: 591691 - DNA, 25 bp, Homo sapien
tgggacactgttaaaagtctaaaat

SEQ ID NO: 591692 - DNA, 25 bp, Homo sapien
acttataattggaatctcggagagg

SEQ ID NO: 591693 - DNA, 25 bp, Homo sapien
ttataattggaatctcggagaggag

SEQ ID NO: 591694 - DNA, 25 bp, Homo sapien
gttggactcagaatccaggcagtca

SEQ ID NO: 591695 - DNA, 25 bp, Homo sapien
gcctgcaaagcccttttaactgttg

SEQ ID NO: 591696 - DNA, 25 bp, Homo sapien
tttaactgttgcaccacactgccta

SEQ ID NO: 591697 - DNA, 25 bp, Homo sapien
tgaggcagtgtacccagctcattgc

SEQ ID NO: 591698 - DNA, 25 bp, Homo sapien
gttcctggtctctgatagcacatgg

SEQ ID NO: 591699 - DNA, 25 bp, Homo sapien
tagcacatggctagcttgtcaaaga

SEQ ID NO: 591700 - DNA, 25 bp, Homo sapien
gtcaaagaatcccttctgtgccaaa

SEQ ID NO: 591701 - DNA, 25 bp, Homo sapien
gaatcccttctgtgccaaatgtaca

SEQ ID NO: 591702 - DNA, 25 bp, Homo sapien
gtgtatgggctaatatgtctcccct

SEQ ID NO: 591703 - DNA, 25 bp, Homo sapien
aatatgtctcccctcctatgtttac

SEQ ID NO: 591704 - DNA, 25 bp, Homo sapien
cctcctatgtttacgttggtttatg

SEQ ID NO: 591705 - DNA, 25 bp, Homo sapien
aaacaacaaagctagaggtatcaca

SEQ ID NO: 591706 - DNA, 25 bp, Homo sapien
gaggtatcacattgcttgacttcac

SEQ ID NO: 591707 - DNA, 25 bp, Homo sapien
ggtatcacattgcttgacttcacaa

SEQ ID NO: 591708 - DNA, 25 bp, Homo sapien
gcttgacttcacaatatatcataaa

SEQ ID NO: 591709 - DNA, 25 bp, Homo sapien
gaatagagatcttggaaataaatcc

SEQ ID NO: 591710 - DNA, 25 bp, Homo sapien
aaatccacacatttatggtcaattg

SEQ ID NO: 591711 - DNA, 25 bp, Homo sapien
tccacacatttatggtcaattgatt

SEQ ID NO: 591712 - DNA, 25 bp, Homo sapien
gattttccacagagggtaagaatac

SEQ ID NO: 591713 - DNA, 25 bp, Homo sapien
ttccacagagggtaagaatacacaa

SEQ ID NO: 591714 - DNA, 25 bp, Homo sapien
gttgggacaactgcatatttctgtg

SEQ ID NO: 591715 - DNA, 25 bp, Homo sapien
gacaactgcatatttctgtgcagaa

SEQ ID NO: 591716 - DNA, 25 bp, Homo sapien
gctgggtttgttggcgtacacctgt

SEQ ID NO: 591717 - DNA, 25 bp, Homo sapien
gggtttgttggcgtacacctgtgat

SEQ ID NO: 591718 - DNA, 25 bp, Homo sapien
ggtttgttggcgtacacctgtgatc

SEQ ID NO: 591719 - DNA, 25 bp, Homo sapien
gtttgttggcgtacacctgtgatcc

SEQ ID NO: 591720 - DNA, 25 bp, Homo sapien
tttgttggcgtacacctgtgatccc

SEQ ID NO: 591721 - DNA, 25 bp, Homo sapien
tgtgatcccagttacaggcgaggca

SEQ ID NO: 591722 - DNA, 25 bp, Homo sapien
gtgatcccagttacaggcgaggcag

SEQ ID NO: 591723 - DNA, 25 bp, Homo sapien
tgatcccagttacaggcgaggcaga

SEQ ID NO: 591724 - DNA, 25 bp, Homo sapien
gatcccagttacaggcgaggcagaa

SEQ ID NO: 591725 - DNA, 25 bp, Homo sapien
atcccagttacaggcgaggcagaag

SEQ ID NO: 591726 - DNA, 25 bp, Homo sapien
ccagttacaggcgaggcagaagcag

SEQ ID NO: 591727 - DNA, 25 bp, Homo sapien
gtggagcagcacatcagcagggact

SEQ ID NO: 591728 - DNA, 25 bp, Homo sapien
gcagcacatcagcagggactggtct

SEQ ID NO: 591729 - DNA, 25 bp, Homo sapien
atcagcagggactggtctagaccct

SEQ ID NO: 591730 - DNA, 25 bp, Homo sapien
cagggactggtctagaccctccctt

SEQ ID NO: 591731 - DNA, 25 bp, Homo sapien
cctttcctgtcacttagctggagct

SEQ ID NO: 591732 - DNA, 25 bp, Homo sapien
gtcacttagctggagctaagctcca

SEQ ID NO: 591733 - DNA, 25 bp, Homo sapien
ttcccactggctcctagtagaaata

SEQ ID NO: 591734 - DNA, 25 bp, Homo sapien
ctggctcctagtagaaatagtttct

SEQ ID NO: 591735 - DNA, 25 bp, Homo sapien
gtttctgtactttagcagaacagga

SEQ ID NO: 591736 - DNA, 25 bp, Homo sapien
ggatatttgttcattaaaggtggct

SEQ ID NO: 591737 - DNA, 25 bp, Homo sapien
aaaggtggcttggtcttacagctgg

SEQ ID NO: 591738 - DNA, 25 bp, Homo sapien
ttcggaccctgcataacctcgtgat

SEQ ID NO: 591739 - DNA, 25 bp, Homo sapien
ataacctcgtgatccagtacgcggg

SEQ ID NO: 591740 - DNA, 25 bp, Homo sapien
atgaggtggcggtgcctctgtgccg

SEQ ID NO: 591741 - DNA, 25 bp, Homo sapien
ctctgtgccgccaggccttggagga

SEQ ID NO: 591742 - DNA, 25 bp, Homo sapien
gacctggagcgcagctcgggccact

SEQ ID NO: 591743 - DNA, 25 bp, Homo sapien
tcctggcgctggtgtaccgggacca

SEQ ID NO: 591744 - DNA, 25 bp, Homo sapien
gaagccacagaccttctccatgatg

SEQ ID NO: 591745 - DNA, 25 bp, Homo sapien
gatccgggagcagacgctgggccct

SEQ ID NO: 591746 - DNA, 25 bp, Homo sapien
gtggccgccacgctcaacaacttgg

SEQ ID NO: 591747 - DNA, 25 bp, Homo sapien
aacaacttggctgtcctctatggga

SEQ ID NO: 591748 - DNA, 25 bp, Homo sapien
acttggctgtcctctatgggaagcg

SEQ ID NO: 591749 - DNA, 25 bp, Homo sapien
gtttcaggtttctatttaacatgta

SEQ ID NO: 591750 - DNA, 25 bp, Homo sapien
taccaaatgtaccagaaagggttat

SEQ ID NO: 591751 - DNA, 25 bp, Homo sapien
caaatgtaccagaaagggttatgtt

SEQ ID NO: 591752 - DNA, 25 bp, Homo sapien
gtctaattcaatagttatctaaaag

SEQ ID NO: 591753 - DNA, 25 bp, Homo sapien
caatagttatctaaaagttggttca

SEQ ID NO: 591754 - DNA, 25 bp, Homo sapien
aaggttattcataaaacaatgtagt

SEQ ID NO: 591755 - DNA, 25 bp, Homo sapien
acaatgtagtaaggaatcattaggc

SEQ ID NO: 591756 - DNA, 25 bp, Homo sapien
gaatcattaggcaaaaaatgtggga

SEQ ID NO: 591757 - DNA, 25 bp, Homo sapien
aaagaattggagacgtttggctaat

SEQ ID NO: 591758 - DNA, 25 bp, Homo sapien
ttggagacgtttggctaattaaaca

SEQ ID NO: 591759 - DNA, 25 bp, Homo sapien
gagacgtttggctaattaaacattt

SEQ ID NO: 591760 - DNA, 25 bp, Homo sapien
ccgctggagacgaggactcctcaga

SEQ ID NO: 591761 - DNA, 25 bp, Homo sapien
acgaggactcctcagacagccctga

SEQ ID NO: 591762 - DNA, 25 bp, Homo sapien
ggtgaaggccgaggatccgcatcca

SEQ ID NO: 591763 - DNA, 25 bp, Homo sapien
gaaggccgaggatccgcatccagcg

SEQ ID NO: 591764 - DNA, 25 bp, Homo sapien
gttggaggcttgtctggaccagaga

SEQ ID NO: 591765 - DNA, 25 bp, Homo sapien
gaccagagagtgtttcctttgagct

SEQ ID NO: 591766 - DNA, 25 bp, Homo sapien
gtgtttcctttgagctctgctccaa

SEQ ID NO: 591767 - DNA, 25 bp, Homo sapien
tcttcctccacctgccttaaaaggg

SEQ ID NO: 591768 - DNA, 25 bp, Homo sapien
gccactagcctgaatcggccaaatc

SEQ ID NO: 591769 - DNA, 25 bp, Homo sapien
gaatcggccaaatcgcctagctcag

SEQ ID NO: 591770 - DNA, 25 bp, Homo sapien
aaatcgcctagctcagcgtcgctat

SEQ ID NO: 591771 - DNA, 25 bp, Homo sapien
ttctcttctgtgttctgcctctttc

SEQ ID NO: 591772 - DNA, 25 bp, Homo sapien
gttctgcctctttctgtccaacgat

SEQ ID NO: 591773 - DNA, 25 bp, Homo sapien
tgtccaacgatccttcccgcaaagg

SEQ ID NO: 591774 - DNA, 25 bp, Homo sapien
ccttcccgcaaaggataacttgctg

SEQ ID NO: 591775 - DNA, 25 bp, Homo sapien
ataacttgctgaggcagaagtccca

SEQ ID NO: 591776 - DNA, 25 bp, Homo sapien
agggctgggcatttgtatctttaag

SEQ ID NO: 591777 - DNA, 25 bp, Homo sapien
gcatttgtatctttaagtgctgcag

SEQ ID NO: 591778 - DNA, 25 bp, Homo sapien
tgcaggcatttctgttacacaccag

SEQ ID NO: 591779 - DNA, 25 bp, Homo sapien
accagagtatgagaatcagtgccta

SEQ ID NO: 591780 - DNA, 25 bp, Homo sapien
tcagtgcctaaaagacagaccgtat

SEQ ID NO: 591781 - DNA, 25 bp, Homo sapien
aagacagaccgtattcaaactgcag

SEQ ID NO: 591782 - DNA, 25 bp, Homo sapien
tcatgtgcaggttttgaaaatgtac

SEQ ID NO: 591783 - DNA, 25 bp, Homo sapien
taatgttgtaattcatgccagggac

SEQ ID NO: 591784 - DNA, 25 bp, Homo sapien
gttgtaattcatgccagggactgac

SEQ ID NO: 591785 - DNA, 25 bp, Homo sapien
gtaattcatgccagggactgacaaa

SEQ ID NO: 591786 - DNA, 25 bp, Homo sapien
tgccagggactgacaaaagacttga

SEQ ID NO: 591787 - DNA, 25 bp, Homo sapien
caaaagacttgagacaggatggtta

SEQ ID NO: 591788 - DNA, 25 bp, Homo sapien
tcttgtcagctaaggtcacattgtg

SEQ ID NO: 591789 - DNA, 25 bp, Homo sapien
ttgtcagctaaggtcacattgtgcc

SEQ ID NO: 591790 - DNA, 25 bp, Homo sapien
tcttcctggactattgaaatcaagc

SEQ ID NO: 591791 - DNA, 25 bp, Homo sapien
tcctggactattgaaatcaagctta

SEQ ID NO: 591792 - DNA, 25 bp, Homo sapien
tggattaagtgatatttctatagcg

SEQ ID NO: 591793 - DNA, 25 bp, Homo sapien
aacggtcaccgaaaatgtgaagagg

SEQ ID NO: 591794 - DNA, 25 bp, Homo sapien
gaaactgtcaccacgataaatagtc

SEQ ID NO: 591795 - DNA, 25 bp, Homo sapien
ctgtcaccacgataaatagtcacca

SEQ ID NO: 591796 - DNA, 25 bp, Homo sapien
gtcaccacgataaatagtcaccaca

SEQ ID NO: 591797 - DNA, 25 bp, Homo sapien
accacgataaatagtcaccacagaa

SEQ ID NO: 591798 - DNA, 25 bp, Homo sapien
cgataaatagtcaccacagaacaaa

SEQ ID NO: 591799 - DNA, 25 bp, Homo sapien
accacagaacaaataggcatttttt

SEQ ID NO: 591800 - DNA, 25 bp, Homo sapien
tctgatccatccaaaaagcccggca

SEQ ID NO: 591801 - DNA, 25 bp, Homo sapien
tgatccatccaaaaagcccggcatc

SEQ ID NO: 591802 - DNA, 25 bp, Homo sapien
gatccatccaaaaagcccggcatca

SEQ ID NO: 591803 - DNA, 25 bp, Homo sapien
tgggaagcctattaaatatgttaga

SEQ ID NO: 591804 - DNA, 25 bp, Homo sapien
actgtgcccagtccatcatctattg

SEQ ID NO: 591805 - DNA, 25 bp, Homo sapien
tgtgcccagtccatcatctattgtc

SEQ ID NO: 591806 - DNA, 25 bp, Homo sapien
tgcccagtccatcatctattgtctg

SEQ ID NO: 591807 - DNA, 25 bp, Homo sapien
cccagtccatcatctattgtctgta

SEQ ID NO: 591808 - DNA, 25 bp, Homo sapien
cagtccatcatctattgtctgtaat

SEQ ID NO: 591809 - DNA, 25 bp, Homo sapien
gtccatcatctattgtctgtaataa

SEQ ID NO: 591810 - DNA, 25 bp, Homo sapien
ccatcatctattgtctgtaataatt

SEQ ID NO: 591811 - DNA, 25 bp, Homo sapien
aataatttagaaatctggcaccagg

SEQ ID NO: 591812 - DNA, 25 bp, Homo sapien
tctggcaccaggattatgaaattca

SEQ ID NO: 591813 - DNA, 25 bp, Homo sapien
ggcaccaggattatgaaattcacta

SEQ ID NO: 591814 - DNA, 25 bp, Homo sapien
aggattatgaaattcactatacagt

SEQ ID NO: 591815 - DNA, 25 bp, Homo sapien
gcaaattaaagctacggaccttctt

SEQ ID NO: 591816 - DNA, 25 bp, Homo sapien
aaatgcagttccatttgccacagct

SEQ ID NO: 591817 - DNA, 25 bp, Homo sapien
atttgccacagctggagattgctac

SEQ ID NO: 591818 - DNA, 25 bp, Homo sapien
gagattgctacagtgctttcagatg

SEQ ID NO: 591819 - DNA, 25 bp, Homo sapien
atccagcacagcaaagtggctcact

SEQ ID NO: 591820 - DNA, 25 bp, Homo sapien
gttatacctctgtcagcatacgaag

SEQ ID NO: 591821 - DNA, 25 bp, Homo sapien
ggatggaactagatttttcggcaaa

SEQ ID NO: 591822 - DNA, 25 bp, Homo sapien
tttcggcaaatgtggagggtactgt

SEQ ID NO: 591823 - DNA, 25 bp, Homo sapien
gggtactgtggaaagtgtcttcctc

SEQ ID NO: 591824 - DNA, 25 bp, Homo sapien
agtgtcttcctcacatgactactgg

SEQ ID NO: 591825 - DNA, 25 bp, Homo sapien
tgactactggtctcccaattcaagt

SEQ ID NO: 591826 - DNA, 25 bp, Homo sapien
gactggagctagagcaaggttaacc

SEQ ID NO: 591827 - DNA, 25 bp, Homo sapien
gcaaggttaaccacatatgctctgg

SEQ ID NO: 591828 - DNA, 25 bp, Homo sapien
agggaggtggtgacatttataagta

SEQ ID NO: 591829 - DNA, 25 bp, Homo sapien
aagtattcatcttttatttacaaat

SEQ ID NO: 591830 - DNA, 25 bp, Homo sapien
tttcacgcacatttgtagtctactg

SEQ ID NO: 591831 - DNA, 25 bp, Homo sapien
tgtagtctactgtaagcaacatagt

SEQ ID NO: 591832 - DNA, 25 bp, Homo sapien
agcaacatagtgtcttctaccatct

SEQ ID NO: 591833 - DNA, 25 bp, Homo sapien
atagtgtcttctaccatctttttcc

SEQ ID NO: 591834 - DNA, 25 bp, Homo sapien
ttcctcttaagggtcaacactacta

SEQ ID NO: 591835 - DNA, 25 bp, Homo sapien
gggtcaacactactattctatttca

SEQ ID NO: 591836 - DNA, 25 bp, Homo sapien
gaattcatgtggtgggtcattgtag

SEQ ID NO: 591837 - DNA, 25 bp, Homo sapien
ttcagacgagattacctgtttggca

SEQ ID NO: 591838 - DNA, 25 bp, Homo sapien
tttgcacatgctggcacacaccatg

SEQ ID NO: 591839 - DNA, 25 bp, Homo sapien
atgctggcacacaccatggtgggaa

SEQ ID NO: 591840 - DNA, 25 bp, Homo sapien
aattaagtgctgttgccatgcaatt

SEQ ID NO: 591841 - DNA, 25 bp, Homo sapien
gctgttgccatgcaattctaatgga

SEQ ID NO: 591842 - DNA, 25 bp, Homo sapien
catccttcgccttgagtttgagtat

SEQ ID NO: 591843 - DNA, 25 bp, Homo sapien
gtttgagtatggcagctcttctgga

SEQ ID NO: 591844 - DNA, 25 bp, Homo sapien
agtatggcagctcttctggatccca

SEQ ID NO: 591845 - DNA, 25 bp, Homo sapien
agcaaatcattgagcctgagtggtc

SEQ ID NO: 591846 - DNA, 25 bp, Homo sapien
agtggtcctggagaccagtggcaca

SEQ ID NO: 591847 - DNA, 25 bp, Homo sapien
cagtggcacacctttgttcaagata

SEQ ID NO: 591848 - DNA, 25 bp, Homo sapien
ggacatcatccacgttcagaaaggt

SEQ ID NO: 591849 - DNA, 25 bp, Homo sapien
aagcctggcccttagagcaggtgat

SEQ ID NO: 591850 - DNA, 25 bp, Homo sapien
atggagtgtattgtgcaggctgaaa

SEQ ID NO: 591851 - DNA, 25 bp, Homo sapien
gggcgactttgacagcagtaccact

SEQ ID NO: 591852 - DNA, 25 bp, Homo sapien
gtaccactgtgggtttcagactcat

SEQ ID NO: 591853 - DNA, 25 bp, Homo sapien
gtttcagactcatattctacaggtg

SEQ ID NO: 591854 - DNA, 25 bp, Homo sapien
tgggtcttttccctagagtgtaagt

SEQ ID NO: 591855 - DNA, 25 bp, Homo sapien
agttggattgctcgacaggcagctt

SEQ ID NO: 591856 - DNA, 25 bp, Homo sapien
ttcctcctcgagtatcttgcattag

SEQ ID NO: 591857 - DNA, 25 bp, Homo sapien
gagtactctttctcgaaggttcaaa

SEQ ID NO: 591858 - DNA, 25 bp, Homo sapien
gagtacctttgatgacagtgctatc

SEQ ID NO: 591859 - DNA, 25 bp, Homo sapien
ggttcttgctcaggcagagcgctga

SEQ ID NO: 591860 - DNA, 25 bp, Homo sapien
ggcagagcgctgaggaccagactat

SEQ ID NO: 591861 - DNA, 25 bp, Homo sapien
agaagtgtcgtttgcagctggcgca

SEQ ID NO: 591862 - DNA, 25 bp, Homo sapien
gtcgtttgcagctggcgcagagaca

SEQ ID NO: 591863 - DNA, 25 bp, Homo sapien
gctggcgcagagacaagaatcatca

SEQ ID NO: 591864 - DNA, 25 bp, Homo sapien
atctagggcaggttgatgaggaaca

SEQ ID NO: 591865 - DNA, 25 bp, Homo sapien
ggaacaggacatttccatggtcata

SEQ ID NO: 591866 - DNA, 25 bp, Homo sapien
caggacatttccatggtcataaaat

SEQ ID NO: 591867 - DNA, 25 bp, Homo sapien
ggtcataaaatgattgcccacagat

SEQ ID NO: 591868 - DNA, 25 bp, Homo sapien
aaatgattgcccacagattgcttct

SEQ ID NO: 591869 - DNA, 25 bp, Homo sapien
tgcttctttcttacagaggagggaa

SEQ ID NO: 591870 - DNA, 25 bp, Homo sapien
atgtttacagggtatactgtgatgt

SEQ ID NO: 591871 - DNA, 25 bp, Homo sapien
cagggtatactgtgatgttatgata

SEQ ID NO: 591872 - DNA, 25 bp, Homo sapien
ctgtgatgttatgatacatgtattc

SEQ ID NO: 591873 - DNA, 25 bp, Homo sapien
acatgtattcatagtgggatgatta

SEQ ID NO: 591874 - DNA, 25 bp, Homo sapien
catagtgggatgattaaattaagct

SEQ ID NO: 591875 - DNA, 25 bp, Homo sapien
catactgatttcattgtagtgaaaa

SEQ ID NO: 591876 - DNA, 25 bp, Homo sapien
taattttagtcaccattatgtgtgt

SEQ ID NO: 591877 - DNA, 25 bp, Homo sapien
gtcaccattatgtgtgtttaatgct

SEQ ID NO: 591878 - DNA, 25 bp, Homo sapien
cattatgtgtgtttaatgcttttca

SEQ ID NO: 591879 - DNA, 25 bp, Homo sapien
ttaatgcttttcaactaacaaagaa

SEQ ID NO: 591880 - DNA, 25 bp, Homo sapien
gtacttttttacatgaattgaatat

SEQ ID NO: 591881 - DNA, 25 bp, Homo sapien
attgcaatatcctcccaggagggtg

SEQ ID NO: 591882 - DNA, 25 bp, Homo sapien
aactcagagagaaccctgtccaaca

SEQ ID NO: 591883 - DNA, 25 bp, Homo sapien
tccaacaacatcactgttcccaaga

SEQ ID NO: 591884 - DNA, 25 bp, Homo sapien
tgttcccaagatagagcgcgccaac

SEQ ID NO: 591885 - DNA, 25 bp, Homo sapien
gcgccaacagctactcggcagagga

SEQ ID NO: 591886 - DNA, 25 bp, Homo sapien
ggcagaggagccaagtgcgccatat

SEQ ID NO: 591887 - DNA, 25 bp, Homo sapien
tgcgccatatgcacacaccaggaag

SEQ ID NO: 591888 - DNA, 25 bp, Homo sapien
acaccaggaagagcttctccatcag

SEQ ID NO: 591889 - DNA, 25 bp, Homo sapien
gcttctccatcagtgacaaactcga

SEQ ID NO: 591890 - DNA, 25 bp, Homo sapien
aaactcgacaggcagcggaacacag

SEQ ID NO: 591891 - DNA, 25 bp, Homo sapien
tgtccagaacatcggctttccaaag

SEQ ID NO: 591892 - DNA, 25 bp, Homo sapien
tcaatagttctgatggttttataca

SEQ ID NO: 591893 - DNA, 25 bp, Homo sapien
aacctgtttcacttgcttctctcat

SEQ ID NO: 591894 - DNA, 25 bp, Homo sapien
ctcatatctgctgccaagtaagatg

SEQ ID NO: 591895 - DNA, 25 bp, Homo sapien
atatctgctgccaagtaagatgtgc

SEQ ID NO: 591896 - DNA, 25 bp, Homo sapien
gcctccccagcaatgtggaatgtga

SEQ ID NO: 591897 - DNA, 25 bp, Homo sapien
atagctcctataattcccatacgtt

SEQ ID NO: 591898 - DNA, 25 bp, Homo sapien
tagctcctataattcccatacgttg

SEQ ID NO: 591899 - DNA, 25 bp, Homo sapien
gctcctataattcccatacgttgtg

SEQ ID NO: 591900 - DNA, 25 bp, Homo sapien
tcctataattcccatacgttgtgag

SEQ ID NO: 591901 - DNA, 25 bp, Homo sapien
tataattcccatacgttgtgagagg

SEQ ID NO: 591902 - DNA, 25 bp, Homo sapien
attcccatacgttgtgagagggacc

SEQ ID NO: 591903 - DNA, 25 bp, Homo sapien
gggaatagttagtaatgacagggat

SEQ ID NO: 591904 - DNA, 25 bp, Homo sapien
tagttagtaatgacagggatagttg

SEQ ID NO: 591905 - DNA, 25 bp, Homo sapien
gaaacggacacatttcctgatcttg

SEQ ID NO: 591906 - DNA, 25 bp, Homo sapien
aaacggacacatttcctgatcttgg

SEQ ID NO: 591907 - DNA, 25 bp, Homo sapien
aacggacacatttcctgatcttgga

SEQ ID NO: 591908 - DNA, 25 bp, Homo sapien
acggacacatttcctgatcttggag

SEQ ID NO: 591909 - DNA, 25 bp, Homo sapien
tcctgatcttggagggttcataggg

SEQ ID NO: 591910 - DNA, 25 bp, Homo sapien
cctgatcttggagggttcatagggt

SEQ ID NO: 591911 - DNA, 25 bp, Homo sapien
atcttggagggttcatagggtagaa

SEQ ID NO: 591912 - DNA, 25 bp, Homo sapien
gttcatagggtagaagatggtagat

SEQ ID NO: 591913 - DNA, 25 bp, Homo sapien
aagatggtagatgacagctgggtgt

SEQ ID NO: 591914 - DNA, 25 bp, Homo sapien
tagccaggtgtgttgatgcagccct

SEQ ID NO: 591915 - DNA, 25 bp, Homo sapien
agccaggtgtgttgatgcagccctg

SEQ ID NO: 591916 - DNA, 25 bp, Homo sapien
gagatgggagaatcggttaaagccg

SEQ ID NO: 591917 - DNA, 25 bp, Homo sapien
agatgggagaatcggttaaagccgg

SEQ ID NO: 591918 - DNA, 25 bp, Homo sapien
tgggagaatcggttaaagccgggat

SEQ ID NO: 591919 - DNA, 25 bp, Homo sapien
gggagaatcggttaaagccgggatg

SEQ ID NO: 591920 - DNA, 25 bp, Homo sapien
ggagaatcggttaaagccgggatgt

SEQ ID NO: 591921 - DNA, 25 bp, Homo sapien
gagaatcggttaaagccgggatgtg

SEQ ID NO: 591922 - DNA, 25 bp, Homo sapien
agaatcggttaaagccgggatgtgg

SEQ ID NO: 591923 - DNA, 25 bp, Homo sapien
gaatcggttaaagccgggatgtgga

SEQ ID NO: 591924 - DNA, 25 bp, Homo sapien
tcggttaaagccgggatgtggaggt

SEQ ID NO: 591925 - DNA, 25 bp, Homo sapien
aaatggtacttaaactctgacatac

SEQ ID NO: 591926 - DNA, 25 bp, Homo sapien
ggtacttaaactctgacatacttga

SEQ ID NO: 591927 - DNA, 25 bp, Homo sapien
acttaaactctgacatacttgaaaa

SEQ ID NO: 591928 - DNA, 25 bp, Homo sapien
atacttgaaaaatgtgttgggccag

SEQ ID NO: 591929 - DNA, 25 bp, Homo sapien
cttgaaaaatgtgttgggccaggcg

SEQ ID NO: 591930 - DNA, 25 bp, Homo sapien
atcccttgagtctaggagatcagct

SEQ ID NO: 591931 - DNA, 25 bp, Homo sapien
tcccttgagtctaggagatcagctg

SEQ ID NO: 591932 - DNA, 25 bp, Homo sapien
cttgagtctaggagatcagctggct

SEQ ID NO: 591933 - DNA, 25 bp, Homo sapien
gagtctaggagatcagctggctaac

SEQ ID NO: 591934 - DNA, 25 bp, Homo sapien
gtctaggagatcagctggctaacat

SEQ ID NO: 591935 - DNA, 25 bp, Homo sapien
agtggaccgggattgcgctactgca

SEQ ID NO: 591936 - DNA, 25 bp, Homo sapien
ttggatcccttagaacatagtgtgc

SEQ ID NO: 591937 - DNA, 25 bp, Homo sapien
tagtgtgcatcacatcttccattct

SEQ ID NO: 591938 - DNA, 25 bp, Homo sapien
ccccatgctggctatattcctatat

SEQ ID NO: 591939 - DNA, 25 bp, Homo sapien
ggctatattcctatattcgtactca

SEQ ID NO: 591940 - DNA, 25 bp, Homo sapien
ttcgtactcagatcatagacacttg

SEQ ID NO: 591941 - DNA, 25 bp, Homo sapien
agacacttgtttgctacccataaaa

SEQ ID NO: 591942 - DNA, 25 bp, Homo sapien
ccatttaccatcagcacatattatt

SEQ ID NO: 591943 - DNA, 25 bp, Homo sapien
attcttctactcattttcaatttgc

SEQ ID NO: 591944 - DNA, 25 bp, Homo sapien
aatttgcttcactatgatggtgtca

SEQ ID NO: 591945 - DNA, 25 bp, Homo sapien
tgtcacatgctgattccagataaga

SEQ ID NO: 591946 - DNA, 25 bp, Homo sapien
attccagataagagcaagtgatttt

SEQ ID NO: 591947 - DNA, 25 bp, Homo sapien
gtaaaaagtcttatcctgctccata

SEQ ID NO: 591948 - DNA, 25 bp, Homo sapien
tatcctgctccatactggattttga

SEQ ID NO: 591949 - DNA, 25 bp, Homo sapien
gctccatactggattttgaaatatt

SEQ ID NO: 591950 - DNA, 25 bp, Homo sapien
aaattatctgatctctaataaccaa

SEQ ID NO: 591951 - DNA, 25 bp, Homo sapien
gatctctaataaccaaatctgtgtt

SEQ ID NO: 591952 - DNA, 25 bp, Homo sapien
tctaataaccaaatctgtgttctca

SEQ ID NO: 591953 - DNA, 25 bp, Homo sapien
gatttagattttcatagtaaactgc

SEQ ID NO: 591954 - DNA, 25 bp, Homo sapien
catagtaaactgcatttatctggaa

SEQ ID NO: 591955 - DNA, 25 bp, Homo sapien
aataaaaacctactctctctctctc

SEQ ID NO: 591956 - DNA, 25 bp, Homo sapien
tctctctctaaataacagttcctta

SEQ ID NO: 591957 - DNA, 25 bp, Homo sapien
ttccttacctaagacaaaatactca

SEQ ID NO: 591958 - DNA, 25 bp, Homo sapien
tatctcagagaccagcctcagggac

SEQ ID NO: 591959 - DNA, 25 bp, Homo sapien
tcagagaccagcctcagggaccttc

SEQ ID NO: 591960 - DNA, 25 bp, Homo sapien
tcagggaccttcacagtgcctggca

SEQ ID NO: 591961 - DNA, 25 bp, Homo sapien
tggcacagaacctcactcatgactg

SEQ ID NO: 591962 - DNA, 25 bp, Homo sapien
ctcatgactgttgctcaggaacgag

SEQ ID NO: 591963 - DNA, 25 bp, Homo sapien
gttgctcaggaacgagctgccctcc

SEQ ID NO: 591964 - DNA, 25 bp, Homo sapien
gcctgtcctggctgagatctttgag

SEQ ID NO: 591965 - DNA, 25 bp, Homo sapien
tgtcctggctgagatctttgagatc

SEQ ID NO: 591966 - DNA, 25 bp, Homo sapien
catggagaaagtccagccctggaga

SEQ ID NO: 591967 - DNA, 25 bp, Homo sapien
cagaaacccgcctgtacaggattaa

SEQ ID NO: 591968 - DNA, 25 bp, Homo sapien
aacccgcctgtacaggattaagaag

SEQ ID NO: 591969 - DNA, 25 bp, Homo sapien
acatattttacaatagttgaaggta

SEQ ID NO: 591970 - DNA, 25 bp, Homo sapien
tacatagtatgtgttgtgggtacat

SEQ ID NO: 591971 - DNA, 25 bp, Homo sapien
ggtacatcgtatgtgttgtgggtac

SEQ ID NO: 591972 - DNA, 25 bp, Homo sapien
tacatcgtatgtgttgtgggtacat

SEQ ID NO: 591973 - DNA, 25 bp, Homo sapien
tcccctcaagcgtttatccttcaag

SEQ ID NO: 591974 - DNA, 25 bp, Homo sapien
ccctcaagcgtttatccttcaagtt

SEQ ID NO: 591975 - DNA, 25 bp, Homo sapien
ctcaagcgtttatccttcaagttat

SEQ ID NO: 591976 - DNA, 25 bp, Homo sapien
caagcgtttatccttcaagttataa

SEQ ID NO: 591977 - DNA, 25 bp, Homo sapien
aaattcaattacagtcttagttatg

SEQ ID NO: 591978 - DNA, 25 bp, Homo sapien
tcaattacagtcttagttatgtcaa

SEQ ID NO: 591979 - DNA, 25 bp, Homo sapien
ttacagtcttagttatgtcaaaatg

SEQ ID NO: 591980 - DNA, 25 bp, Homo sapien
gagaggcactgtatggtcacaacaa

SEQ ID NO: 591981 - DNA, 25 bp, Homo sapien
gtcacaacaagctgggatggcctct

SEQ ID NO: 591982 - DNA, 25 bp, Homo sapien
acaagctgggatggcctcttaggaa

SEQ ID NO: 591983 - DNA, 25 bp, Homo sapien
tcttaggaaggctacgtctcacggc

SEQ ID NO: 591984 - DNA, 25 bp, Homo sapien
ctggccatgccgaagcatgatctgt

SEQ ID NO: 591985 - DNA, 25 bp, Homo sapien
atgatctgtgagctccgtttctaca

SEQ ID NO: 591986 - DNA, 25 bp, Homo sapien
agctccgtttctacagctgttgctt

SEQ ID NO: 591987 - DNA, 25 bp, Homo sapien
agctgttgcttttctcagatgagaa

SEQ ID NO: 591988 - DNA, 25 bp, Homo sapien
gaaactggtctgtactcagggccat

SEQ ID NO: 591989 - DNA, 25 bp, Homo sapien
gtactcagggccatattgcacaaaa

SEQ ID NO: 591990 - DNA, 25 bp, Homo sapien
attatgtattaaaggctgggtgcag

SEQ ID NO: 591991 - DNA, 25 bp, Homo sapien
catgtcccagaacccgtgaatgtga

SEQ ID NO: 591992 - DNA, 25 bp, Homo sapien
tcccagaacccgtgaatgtgacctt

SEQ ID NO: 591993 - DNA, 25 bp, Homo sapien
gtaatcaagttaaggatctcaggat

SEQ ID NO: 591994 - DNA, 25 bp, Homo sapien
ggatctcaggatccttgattatctg

SEQ ID NO: 591995 - DNA, 25 bp, Homo sapien
ggatccttgattatctgatgggcct

SEQ ID NO: 591996 - DNA, 25 bp, Homo sapien
aatgcaagagaaggccactgaagac

SEQ ID NO: 591997 - DNA, 25 bp, Homo sapien
gattgcagtgatgcagccataagcc

SEQ ID NO: 591998 - DNA, 25 bp, Homo sapien
aggaatgcccggaaatgtcagaagc

SEQ ID NO: 591999 - DNA, 25 bp, Homo sapien
gaaagagcagattctcccttcaagc

SEQ ID NO: 592000 - DNA, 25 bp, Homo sapien
gctgacatcttgacatcaaacctct

SEQ ID NO: 592001 - DNA, 25 bp, Homo sapien
atcttgacatcaaacctctagcctc

SEQ ID NO: 592002 - DNA, 25 bp, Homo sapien
taatggtagagaaagcagcaaagct

SEQ ID NO: 592003 - DNA, 25 bp, Homo sapien
aaagctggctgggtatgtacatgtg

SEQ ID NO: 592004 - DNA, 25 bp, Homo sapien
gctgggtatgtacatgtgattctgt

SEQ ID NO: 592005 - DNA, 25 bp, Homo sapien
atgtgattctgttgaaactgatttc

SEQ ID NO: 592006 - DNA, 25 bp, Homo sapien
ttcaggtatggattgataggctaat

SEQ ID NO: 592007 - DNA, 25 bp, Homo sapien
attgttgggttgctagtcagatctc

SEQ ID NO: 592008 - DNA, 25 bp, Homo sapien
ttgggttgctagtcagatctcagga

SEQ ID NO: 592009 - DNA, 25 bp, Homo sapien
agatctcaggaaagtatttccttcc

SEQ ID NO: 592010 - DNA, 25 bp, Homo sapien
ttccctctaacctgacctaagtgtg

SEQ ID NO: 592011 - DNA, 25 bp, Homo sapien
tctaacctgacctaagtgtgtctta

SEQ ID NO: 592012 - DNA, 25 bp, Homo sapien
gtgtgtcttagaatgttaactaact

SEQ ID NO: 592013 - DNA, 25 bp, Homo sapien
ttgtttctgtcatggctttagctta

SEQ ID NO: 592014 - DNA, 25 bp, Homo sapien
tgtttctgtcatggctttagcttaa

SEQ ID NO: 592015 - DNA, 25 bp, Homo sapien
gtttctgtcatggctttagcttaaa

SEQ ID NO: 592016 - DNA, 25 bp, Homo sapien
tttctgtcatggctttagcttaaag

SEQ ID NO: 592017 - DNA, 25 bp, Homo sapien
ttctgtcatggctttagcttaaagc

SEQ ID NO: 592018 - DNA, 25 bp, Homo sapien
tctgtcatggctttagcttaaagct

SEQ ID NO: 592019 - DNA, 25 bp, Homo sapien
ctgtcatggctttagcttaaagctt

SEQ ID NO: 592020 - DNA, 25 bp, Homo sapien
tgtcatggctttagcttaaagctta

SEQ ID NO: 592021 - DNA, 25 bp, Homo sapien
gtcatggctttagcttaaagcttaa

SEQ ID NO: 592022 - DNA, 25 bp, Homo sapien
tcatggctttagcttaaagcttaaa

SEQ ID NO: 592023 - DNA, 25 bp, Homo sapien
catggctttagcttaaagcttaaaa

SEQ ID NO: 592024 - DNA, 25 bp, Homo sapien
tcagtctgggcaacacgatgaaact

SEQ ID NO: 592025 - DNA, 25 bp, Homo sapien
tctgggcaacacgatgaaactccgt

SEQ ID NO: 592026 - DNA, 25 bp, Homo sapien
ggcaacacgatgaaactccgtctct

SEQ ID NO: 592027 - DNA, 25 bp, Homo sapien
attatccaggcatggtggcgtacgc

SEQ ID NO: 592028 - DNA, 25 bp, Homo sapien
ttatccaggcatggtggcgtacgcc

SEQ ID NO: 592029 - DNA, 25 bp, Homo sapien
catgccacatcactccaacctgggc

SEQ ID NO: 592030 - DNA, 25 bp, Homo sapien
acctgggcaacagaacaagaaccca

SEQ ID NO: 592031 - DNA, 25 bp, Homo sapien
cctgggcaacagaacaagaacccat

SEQ ID NO: 592032 - DNA, 25 bp, Homo sapien
acagaacaagaacccatctcaaaca

SEQ ID NO: 592033 - DNA, 25 bp, Homo sapien
cagaacaagaacccatctcaaacaa

SEQ ID NO: 592034 - DNA, 25 bp, Homo sapien
agaacaagaacccatctcaaacaaa

SEQ ID NO: 592035 - DNA, 25 bp, Homo sapien
aggttctccgccctttggcctctga

SEQ ID NO: 592036 - DNA, 25 bp, Homo sapien
cgccctttggcctctgactgaattc

SEQ ID NO: 592037 - DNA, 25 bp, Homo sapien
tttggcctctgactgaattccacca

SEQ ID NO: 592038 - DNA, 25 bp, Homo sapien
ttggcctctgactgaattccaccac

SEQ ID NO: 592039 - DNA, 25 bp, Homo sapien
tctgactgaattccaccaccagctt

SEQ ID NO: 592040 - DNA, 25 bp, Homo sapien
tgaattccaccaccagcttttcagg

SEQ ID NO: 592041 - DNA, 25 bp, Homo sapien
aattccaccaccagcttttcagggt

SEQ ID NO: 592042 - DNA, 25 bp, Homo sapien
ttccaccaccagcttttcagggtct

SEQ ID NO: 592043 - DNA, 25 bp, Homo sapien
atctctatcctattgattctgtgtc

SEQ ID NO: 592044 - DNA, 25 bp, Homo sapien
gattctgtgtctctgaggaacccta

SEQ ID NO: 592045 - DNA, 25 bp, Homo sapien
gaggaaccctaatacacctccagaa

SEQ ID NO: 592046 - DNA, 25 bp, Homo sapien
tgcttactttccacatgagatgctt

SEQ ID NO: 592047 - DNA, 25 bp, Homo sapien
tccacatgagatgctttgtaccggg

SEQ ID NO: 592048 - DNA, 25 bp, Homo sapien
ctgtgagcaggcctcacgatggctt

SEQ ID NO: 592049 - DNA, 25 bp, Homo sapien
aggcctcacgatggcttgggagcac

SEQ ID NO: 592050 - DNA, 25 bp, Homo sapien
ggcttgggagcactcgttctcccaa

SEQ ID NO: 592051 - DNA, 25 bp, Homo sapien
gttctcccaaggtctgagtcttcat

SEQ ID NO: 592052 - DNA, 25 bp, Homo sapien
caaggtctgagtcttcatccagccc

SEQ ID NO: 592053 - DNA, 25 bp, Homo sapien
gttcctcggccagttaacaagaaga

SEQ ID NO: 592054 - DNA, 25 bp, Homo sapien
accagtctctcctgtttgagactgt

SEQ ID NO: 592055 - DNA, 25 bp, Homo sapien
cgttatcatactgaggtgttagatc

SEQ ID NO: 592056 - DNA, 25 bp, Homo sapien
aacatgtgaggttgaaagagcacca

SEQ ID NO: 592057 - DNA, 25 bp, Homo sapien
gccacagttaaagactgcctacctt

SEQ ID NO: 592058 - DNA, 25 bp, Homo sapien
cagtctcaaccatccaaactaataa

SEQ ID NO: 592059 - DNA, 25 bp, Homo sapien
agtctcaaccatccaaactaataag

SEQ ID NO: 592060 - DNA, 25 bp, Homo sapien
gtctcaaccatccaaactaataagc

SEQ ID NO: 592061 - DNA, 25 bp, Homo sapien
tctcaaccatccaaactaataagct

SEQ ID NO: 592062 - DNA, 25 bp, Homo sapien
ctcaaccatccaaactaataagctg

SEQ ID NO: 592063 - DNA, 25 bp, Homo sapien
tcaaccatccaaactaataagctga

SEQ ID NO: 592064 - DNA, 25 bp, Homo sapien
caaccatccaaactaataagctgaa

SEQ ID NO: 592065 - DNA, 25 bp, Homo sapien
aaccatccaaactaataagctgaat

SEQ ID NO: 592066 - DNA, 25 bp, Homo sapien
accatccaaactaataagctgaatt

SEQ ID NO: 592067 - DNA, 25 bp, Homo sapien
tccaaactaataagctgaattaact

SEQ ID NO: 592068 - DNA, 25 bp, Homo sapien
aaaggagcttcctttgttcatccat

SEQ ID NO: 592069 - DNA, 25 bp, Homo sapien
aggagcttcctttgttcatccattt

SEQ ID NO: 592070 - DNA, 25 bp, Homo sapien
agcttcctttgttcatccatttcac

SEQ ID NO: 592071 - DNA, 25 bp, Homo sapien
aggattttgctcttctacagcaatg

SEQ ID NO: 592072 - DNA, 25 bp, Homo sapien
gctcttctacagcaatgatagccat

SEQ ID NO: 592073 - DNA, 25 bp, Homo sapien
tacagcaatgatagccattctcact

SEQ ID NO: 592074 - DNA, 25 bp, Homo sapien
aatgatagccattctcactcaccag

SEQ ID NO: 592075 - DNA, 25 bp, Homo sapien
gatagccattctcactcaccagttt

SEQ ID NO: 592076 - DNA, 25 bp, Homo sapien
ttctcactcaccagtttcctgaaat

SEQ ID NO: 592077 - DNA, 25 bp, Homo sapien
tcctgaaatcatgggtatttttgct

SEQ ID NO: 592078 - DNA, 25 bp, Homo sapien
tcatgggtatttttgctaaagctgt

SEQ ID NO: 592079 - DNA, 25 bp, Homo sapien
tttctaagcaaccaagaagagcagt

SEQ ID NO: 592080 - DNA, 25 bp, Homo sapien
gaagagcagtgaagccagatcctgt

SEQ ID NO: 592081 - DNA, 25 bp, Homo sapien
agccagatcctgttagaaatatatg

SEQ ID NO: 592082 - DNA, 25 bp, Homo sapien
aatgagttgctctacaaaggtccaa

SEQ ID NO: 592083 - DNA, 25 bp, Homo sapien
gctctacaaaggtccaacttcgttg

SEQ ID NO: 592084 - DNA, 25 bp, Homo sapien
ccaacttcgttgtcctttgttctgt

SEQ ID NO: 592085 - DNA, 25 bp, Homo sapien
ttgttctgtaaactgcccttcccgc

SEQ ID NO: 592086 - DNA, 25 bp, Homo sapien
tgcccttcccgcagaaactgtcttt

SEQ ID NO: 592087 - DNA, 25 bp, Homo sapien
aactgcccttcactatcactgtaat

SEQ ID NO: 592088 - DNA, 25 bp, Homo sapien
tatcactgtaatccatacccctact

SEQ ID NO: 592089 - DNA, 25 bp, Homo sapien
atacccctactctatttgaaactgc

SEQ ID NO: 592090 - DNA, 25 bp, Homo sapien
ccccggatggtcaggattgttttga

SEQ ID NO: 592091 - DNA, 25 bp, Homo sapien
tgttttgactattctgggtccttga

SEQ ID NO: 592092 - DNA, 25 bp, Homo sapien
tttccatgtgaatggtaacatcaat

SEQ ID NO: 592093 - DNA, 25 bp, Homo sapien
ttaatttccacaaagaagcaaggtg

SEQ ID NO: 592094 - DNA, 25 bp, Homo sapien
gggaatactgtccacttaacaatat

SEQ ID NO: 592095 - DNA, 25 bp, Homo sapien
accagcaacctcttcagtagtgtct

SEQ ID NO: 592096 - DNA, 25 bp, Homo sapien
agtagtgtctctcagccccttggaa

SEQ ID NO: 592097 - DNA, 25 bp, Homo sapien
tctctcagccccttggaaaatgttg

SEQ ID NO: 592098 - DNA, 25 bp, Homo sapien
gccccttggaaaatgttgagagctt

SEQ ID NO: 592099 - DNA, 25 bp, Homo sapien
aaatgttgagagcttctttggtttc

SEQ ID NO: 592100 - DNA, 25 bp, Homo sapien
aaggagtaaactgagatgaactgtc

SEQ ID NO: 592101 - DNA, 25 bp, Homo sapien
acaggccacagaactctactagtcc

SEQ ID NO: 592102 - DNA, 25 bp, Homo sapien
tctactagtcctcagccctggaggt

SEQ ID NO: 592103 - DNA, 25 bp, Homo sapien
gggactctcctctaactggctgttc

SEQ ID NO: 592104 - DNA, 25 bp, Homo sapien
taactggctgttcgttatgcctgag

SEQ ID NO: 592105 - DNA, 25 bp, Homo sapien
gctgttcgttatgcctgagagtaag

SEQ ID NO: 592106 - DNA, 25 bp, Homo sapien
gcatctcttttaactctcctttggt

SEQ ID NO: 592107 - DNA, 25 bp, Homo sapien
ttaactctcctttggtctaatgatg

SEQ ID NO: 592108 - DNA, 25 bp, Homo sapien
atcagtacccatgttggatctaaat

SEQ ID NO: 592109 - DNA, 25 bp, Homo sapien
cccatgttggatctaaatttcttaa

SEQ ID NO: 592110 - DNA, 25 bp, Homo sapien
taatttctaaagtctactgtaacca

SEQ ID NO: 592111 - DNA, 25 bp, Homo sapien
gtagtaatataccagttgtttatac

SEQ ID NO: 592112 - DNA, 25 bp, Homo sapien
acatgactctggcatttattctagc

SEQ ID NO: 592113 - DNA, 25 bp, Homo sapien
gactctggcatttattctagcctat

SEQ ID NO: 592114 - DNA, 25 bp, Homo sapien
tagattttcttctccacagggtggc

SEQ ID NO: 592115 - DNA, 25 bp, Homo sapien
cagggtggcctctaaggcctttgga

SEQ ID NO: 592116 - DNA, 25 bp, Homo sapien
gcctctaaggcctttggattttggg

SEQ ID NO: 592117 - DNA, 25 bp, Homo sapien
gaccgatccagtgagggtcaggatt

SEQ ID NO: 592118 - DNA, 25 bp, Homo sapien
cagtgagggtcaggattctggccca

SEQ ID NO: 592119 - DNA, 25 bp, Homo sapien
aaagtagtgactgagttgagactgg

SEQ ID NO: 592120 - DNA, 25 bp, Homo sapien
agactgggagcttgacagccacagt

SEQ ID NO: 592121 - DNA, 25 bp, Homo sapien
gggagcttgacagccacagtgtttg

SEQ ID NO: 592122 - DNA, 25 bp, Homo sapien
cagtgtttgccaagcaatggttgga

SEQ ID NO: 592123 - DNA, 25 bp, Homo sapien
ggctcattgcaaccttgaattcctg

SEQ ID NO: 592124 - DNA, 25 bp, Homo sapien
gctcattgcaaccttgaattcctgg

SEQ ID NO: 592125 - DNA, 25 bp, Homo sapien
ctcattgcaaccttgaattcctggg

SEQ ID NO: 592126 - DNA, 25 bp, Homo sapien
cattgcaaccttgaattcctgggca

SEQ ID NO: 592127 - DNA, 25 bp, Homo sapien
attgcaaccttgaattcctgggcac

SEQ ID NO: 592128 - DNA, 25 bp, Homo sapien
ttgcaaccttgaattcctgggcaca

SEQ ID NO: 592129 - DNA, 25 bp, Homo sapien
caaccttgaattcctgggcacaagt

SEQ ID NO: 592130 - DNA, 25 bp, Homo sapien
aaccttgaattcctgggcacaagtg

SEQ ID NO: 592131 - DNA, 25 bp, Homo sapien
ccttagcctccccagtagagctggg

SEQ ID NO: 592132 - DNA, 25 bp, Homo sapien
gatgggggggcaggtctcactatgt

SEQ ID NO: 592133 - DNA, 25 bp, Homo sapien
atgggggggcaggtctcactatgtt

SEQ ID NO: 592134 - DNA, 25 bp, Homo sapien
aagcaggtcatctgggatgatacta

SEQ ID NO: 592135 - DNA, 25 bp, Homo sapien
atactagaggcagcgcagtatagac

SEQ ID NO: 592136 - DNA, 25 bp, Homo sapien
aacagcaccggcagggtctggacct

SEQ ID NO: 592137 - DNA, 25 bp, Homo sapien
tggacctcagcgctgccacagatga

SEQ ID NO: 592138 - DNA, 25 bp, Homo sapien
cagcgctgccacagatgagtcatgt

SEQ ID NO: 592139 - DNA, 25 bp, Homo sapien
gccacagatgagtcatgtgtcttta

SEQ ID NO: 592140 - DNA, 25 bp, Homo sapien
tgtctttagacacgttccatgaact

SEQ ID NO: 592141 - DNA, 25 bp, Homo sapien
agacacgttccatgaactgtaaaat

SEQ ID NO: 592142 - DNA, 25 bp, Homo sapien
gtaagtgttacataagtgtatgcta

SEQ ID NO: 592143 - DNA, 25 bp, Homo sapien
cctttccagtcatactttgtatttc

SEQ ID NO: 592144 - DNA, 25 bp, Homo sapien
gtatttcttttccttactgcactgg

SEQ ID NO: 592145 - DNA, 25 bp, Homo sapien
gatggtacagagcacttctgcttat

SEQ ID NO: 592146 - DNA, 25 bp, Homo sapien
cagagcacttctgcttatatcccat

SEQ ID NO: 592147 - DNA, 25 bp, Homo sapien
gtcacataaccatctctagctgcaa

SEQ ID NO: 592148 - DNA, 25 bp, Homo sapien
accatctctagctgcaagagagtct

SEQ ID NO: 592149 - DNA, 25 bp, Homo sapien
ggtggccatgtgcagtgctcatact

SEQ ID NO: 592150 - DNA, 25 bp, Homo sapien
atgtgcagtgctcatactcttaggg

SEQ ID NO: 592151 - DNA, 25 bp, Homo sapien
aacgaaacagggaggatggattcta

SEQ ID NO: 592152 - DNA, 25 bp, Homo sapien
aagggagaagtaacagcctctgcca

SEQ ID NO: 592153 - DNA, 25 bp, Homo sapien
aacagcctctgccacaatcaggatt

SEQ ID NO: 592154 - DNA, 25 bp, Homo sapien
ctctgccacaatcaggattcttctc

SEQ ID NO: 592155 - DNA, 25 bp, Homo sapien
agtccctgggaggatagaaattgga

SEQ ID NO: 592156 - DNA, 25 bp, Homo sapien
aacttttttgcctgtctcccatcct

SEQ ID NO: 592157 - DNA, 25 bp, Homo sapien
tactctcatttcaacttcctccata

SEQ ID NO: 592158 - DNA, 25 bp, Homo sapien
ctcatttcaacttcctccatagtat

SEQ ID NO: 592159 - DNA, 25 bp, Homo sapien
caacttcctccatagtattgctgta

SEQ ID NO: 592160 - DNA, 25 bp, Homo sapien
tcctccatagtattgctgtaattaa

SEQ ID NO: 592161 - DNA, 25 bp, Homo sapien
gctgtaattaatcaaagtaggcaaa

SEQ ID NO: 592162 - DNA, 25 bp, Homo sapien
caaagtaggcaaagaaggttgacta

SEQ ID NO: 592163 - DNA, 25 bp, Homo sapien
aggttgactaggtaattgcggctgc

SEQ ID NO: 592164 - DNA, 25 bp, Homo sapien
gactaggtaattgcggctgccgtcc

SEQ ID NO: 592165 - DNA, 25 bp, Homo sapien
gctgtttatggtactgtaaaactca

SEQ ID NO: 592166 - DNA, 25 bp, Homo sapien
aatcattgctgtttatggatttaaa

SEQ ID NO: 592167 - DNA, 25 bp, Homo sapien
ggcaggacttatttcccagtctcaa

SEQ ID NO: 592168 - DNA, 25 bp, Homo sapien
gcaggacttatttcccagtctcaat

SEQ ID NO: 592169 - DNA, 25 bp, Homo sapien
caggacttatttcccagtctcaatt

SEQ ID NO: 592170 - DNA, 25 bp, Homo sapien
ggacttatttcccagtctcaattga

SEQ ID NO: 592171 - DNA, 25 bp, Homo sapien
gacttatttcccagtctcaattgat

SEQ ID NO: 592172 - DNA, 25 bp, Homo sapien
acttatttcccagtctcaattgata

SEQ ID NO: 592173 - DNA, 25 bp, Homo sapien
cttatttcccagtctcaattgataa

SEQ ID NO: 592174 - DNA, 25 bp, Homo sapien
ttatttcccagtctcaattgataaa

SEQ ID NO: 592175 - DNA, 25 bp, Homo sapien
tatttcccagtctcaattgataaag

SEQ ID NO: 592176 - DNA, 25 bp, Homo sapien
tcccagtctcaattgataaagtgaa

SEQ ID NO: 592177 - DNA, 25 bp, Homo sapien
cccagtctcaattgataaagtgaaa

SEQ ID NO: 592178 - DNA, 25 bp, Homo sapien
aagaaactttgggttgtagcagcat

SEQ ID NO: 592179 - DNA, 25 bp, Homo sapien
aactttgggttgtagcagcataatg

SEQ ID NO: 592180 - DNA, 25 bp, Homo sapien
ggttgtagcagcataatgggaattg

SEQ ID NO: 592181 - DNA, 25 bp, Homo sapien
ggagccacagtataaaggaatgtct

SEQ ID NO: 592182 - DNA, 25 bp, Homo sapien
gaatgtctaggcaagtagtcagcaa

SEQ ID NO: 592183 - DNA, 25 bp, Homo sapien
aagtagtcagcaaactatgtcccat

SEQ ID NO: 592184 - DNA, 25 bp, Homo sapien
agtcagcaaactatgtcccatggag

SEQ ID NO: 592185 - DNA, 25 bp, Homo sapien
agcaaactatgtcccatggagccaa

SEQ ID NO: 592186 - DNA, 25 bp, Homo sapien
aactatgtcccatggagccaaattt

SEQ ID NO: 592187 - DNA, 25 bp, Homo sapien
ggagccaaatttagcccatgacctg

SEQ ID NO: 592188 - DNA, 25 bp, Homo sapien
aaatttagcccatgacctgcaaggt

SEQ ID NO: 592189 - DNA, 25 bp, Homo sapien
ttattacatgccagctacctcgggt

SEQ ID NO: 592190 - DNA, 25 bp, Homo sapien
tacctcgggtgtgtcagctcattta

SEQ ID NO: 592191 - DNA, 25 bp, Homo sapien
gggtgtgtcagctcatttaatcttg

SEQ ID NO: 592192 - DNA, 25 bp, Homo sapien
taatcttgacaacagctccacgaga

SEQ ID NO: 592193 - DNA, 25 bp, Homo sapien
cacgagacaccctcaatatcactgt

SEQ ID NO: 592194 - DNA, 25 bp, Homo sapien
gggacagattcctagggtgttatgt

SEQ ID NO: 592195 - DNA, 25 bp, Homo sapien
tagggtgttatgtaagtggtccccg

SEQ ID NO: 592196 - DNA, 25 bp, Homo sapien
agaggcaggtttgcaccaaggccca

SEQ ID NO: 592197 - DNA, 25 bp, Homo sapien
aggccacccatgtaaaggcagccaa

SEQ ID NO: 592198 - DNA, 25 bp, Homo sapien
taaaggcagccaattcagagccacc

SEQ ID NO: 592199 - DNA, 25 bp, Homo sapien
agagccacctcttatgcctgcatct

SEQ ID NO: 592200 - DNA, 25 bp, Homo sapien
tggaaatggctctgggtgagtgagt

SEQ ID NO: 592201 - DNA, 25 bp, Homo sapien
tggtgagtgaacgtgaaggcctgca

SEQ ID NO: 592202 - DNA, 25 bp, Homo sapien
ggtgagtgaacgtgaaggcctgcag

SEQ ID NO: 592203 - DNA, 25 bp, Homo sapien
gtgagtgaacgtgaaggcctgcagc

SEQ ID NO: 592204 - DNA, 25 bp, Homo sapien
gtacactaccatagatttttatcaa

SEQ ID NO: 592205 - DNA, 25 bp, Homo sapien
aaaataaattaacctcagctcactg

SEQ ID NO: 592206 - DNA, 25 bp, Homo sapien
aaataaattaacctcagctcactgt

SEQ ID NO: 592207 - DNA, 25 bp, Homo sapien
aacacattgtacagttacacaaaat

SEQ ID NO: 592208 - DNA, 25 bp, Homo sapien
acacattgtacagttacacaaaata

SEQ ID NO: 592209 - DNA, 25 bp, Homo sapien
cacattgtacagttacacaaaatat

SEQ ID NO: 592210 - DNA, 25 bp, Homo sapien
aatctacatggccaaggccaggcgt

SEQ ID NO: 592211 - DNA, 25 bp, Homo sapien
tctacatggccaaggccaggcgtgg

SEQ ID NO: 592212 - DNA, 25 bp, Homo sapien
tagccaggtgtgttgatgcagccct

SEQ ID NO: 592213 - DNA, 25 bp, Homo sapien
agccaggtgtgttgatgcagccctg

SEQ ID NO: 592214 - DNA, 25 bp, Homo sapien
aggtgtgttgatgcagccctgtaat

SEQ ID NO: 592215 - DNA, 25 bp, Homo sapien
ggtgtgttgatgcagccctgtaatc

SEQ ID NO: 592216 - DNA, 25 bp, Homo sapien
tgtgttgatgcagccctgtaatccc

SEQ ID NO: 592217 - DNA, 25 bp, Homo sapien
tgttgatgcagccctgtaatcccag

SEQ ID NO: 592218 - DNA, 25 bp, Homo sapien
gagatgggagaatcggttaaagccg

SEQ ID NO: 592219 - DNA, 25 bp, Homo sapien
tgggagaatcggttaaagccgggat

SEQ ID NO: 592220 - DNA, 25 bp, Homo sapien
gaatcggttaaagccgggatgtgga

SEQ ID NO: 592221 - DNA, 25 bp, Homo sapien
gctagctttgcccttgactcgtctt

SEQ ID NO: 592222 - DNA, 25 bp, Homo sapien
cttgactcgtcttctctgaacctca

SEQ ID NO: 592223 - DNA, 25 bp, Homo sapien
agcctcgtgcattgcctggaacctt

SEQ ID NO: 592224 - DNA, 25 bp, Homo sapien
gcctggaaccttcttctagcataaa

SEQ ID NO: 592225 - DNA, 25 bp, Homo sapien
atgaaggtttttcctcctacacaca

SEQ ID NO: 592226 - DNA, 25 bp, Homo sapien
tacacacattccttcctcggttatt

SEQ ID NO: 592227 - DNA, 25 bp, Homo sapien
cttcctcggttatttcattcagaga

SEQ ID NO: 592228 - DNA, 25 bp, Homo sapien
atgcctactgtgtgcaagtcatcca

SEQ ID NO: 592229 - DNA, 25 bp, Homo sapien
tactgtgtgcaagtcatccatcctt

SEQ ID NO: 592230 - DNA, 25 bp, Homo sapien
gtcatccatccttgaaaaggccact

SEQ ID NO: 592231 - DNA, 25 bp, Homo sapien
aaaggccacttctcagtgagggaga

SEQ ID NO: 592232 - DNA, 25 bp, Homo sapien
ataagataccttttcatctctatac

SEQ ID NO: 592233 - DNA, 25 bp, Homo sapien
aagataccttttcatctctatacta

SEQ ID NO: 592234 - DNA, 25 bp, Homo sapien
gataccttttcatctctatactagt

SEQ ID NO: 592235 - DNA, 25 bp, Homo sapien
ataccttttcatctctatactagtc

SEQ ID NO: 592236 - DNA, 25 bp, Homo sapien
taccttttcatctctatactagtcc

SEQ ID NO: 592237 - DNA, 25 bp, Homo sapien
ccttttcatctctatactagtcctt

SEQ ID NO: 592238 - DNA, 25 bp, Homo sapien
ttttcatctctatactagtcctttt

SEQ ID NO: 592239 - DNA, 25 bp, Homo sapien
ttcatctctatactagtccttttca

SEQ ID NO: 592240 - DNA, 25 bp, Homo sapien
catctctatactagtccttttcatt

SEQ ID NO: 592241 - DNA, 25 bp, Homo sapien
atgatgctgttgacttatgttatag

SEQ ID NO: 592242 - DNA, 25 bp, Homo sapien
ttgtttctgtcatggctttagctta

SEQ ID NO: 592243 - DNA, 25 bp, Homo sapien
aggttctccgccctttggcctctga

SEQ ID NO: 592244 - DNA, 25 bp, Homo sapien
ccgccctttggcctctgactgaatt

SEQ ID NO: 592245 - DNA, 25 bp, Homo sapien
cgccctttggcctctgactgaattc

SEQ ID NO: 592246 - DNA, 25 bp, Homo sapien
ccctttggcctctgactgaattcca

SEQ ID NO: 592247 - DNA, 25 bp, Homo sapien
tttggcctctgactgaattccacca

SEQ ID NO: 592248 - DNA, 25 bp, Homo sapien
ttggcctctgactgaattccaccac

SEQ ID NO: 592249 - DNA, 25 bp, Homo sapien
tctgactgaattccaccaccagctt

SEQ ID NO: 592250 - DNA, 25 bp, Homo sapien
tgaattccaccaccagcttttcagg

SEQ ID NO: 592251 - DNA, 25 bp, Homo sapien
gaattccaccaccagcttttcaggg

SEQ ID NO: 592252 - DNA, 25 bp, Homo sapien
aattccaccaccagcttttcagggt

SEQ ID NO: 592253 - DNA, 25 bp, Homo sapien
ttccaccaccagcttttcagggtct

SEQ ID NO: 592254 - DNA, 25 bp, Homo sapien
cctgaggttaggagttctgaggcca

SEQ ID NO: 592255 - DNA, 25 bp, Homo sapien
ggagttctgaggccagcctggccaa

SEQ ID NO: 592256 - DNA, 25 bp, Homo sapien
gagttctgaggccagcctggccaac

SEQ ID NO: 592257 - DNA, 25 bp, Homo sapien
agttctgaggccagcctggccaaca

SEQ ID NO: 592258 - DNA, 25 bp, Homo sapien
caacatggtgaagcctcgtatctac

SEQ ID NO: 592259 - DNA, 25 bp, Homo sapien
aacatggtgaagcctcgtatctact

SEQ ID NO: 592260 - DNA, 25 bp, Homo sapien
acatggtgaagcctcgtatctacta

SEQ ID NO: 592261 - DNA, 25 bp, Homo sapien
atggtgaagcctcgtatctactaaa

SEQ ID NO: 592262 - DNA, 25 bp, Homo sapien
tggtgaagcctcgtatctactaaaa

SEQ ID NO: 592263 - DNA, 25 bp, Homo sapien
ggtgaagcctcgtatctactaaaaa

SEQ ID NO: 592264 - DNA, 25 bp, Homo sapien
aatgagtatcacaaagccggagaac

SEQ ID NO: 592265 - DNA, 25 bp, Homo sapien
tgagtatcacaaagccggagaacga

SEQ ID NO: 592266 - DNA, 25 bp, Homo sapien
aaagccggagaacgaatgtgatgaa

SEQ ID NO: 592267 - DNA, 25 bp, Homo sapien
atgaagttctgggtgcttgtggaat

SEQ ID NO: 592268 - DNA, 25 bp, Homo sapien
gaagttctgggtgcttgtggaattc

SEQ ID NO: 592269 - DNA, 25 bp, Homo sapien
gaggtggacactttatctacctgca

SEQ ID NO: 592270 - DNA, 25 bp, Homo sapien
tggacactttatctacctgcacagg

SEQ ID NO: 592271 - DNA, 25 bp, Homo sapien
gacactttatctacctgcacaggtg

SEQ ID NO: 592272 - DNA, 25 bp, Homo sapien
actttatctacctgcacaggtggaa

SEQ ID NO: 592273 - DNA, 25 bp, Homo sapien
ctacctgcacaggtggaagatatgt

SEQ ID NO: 592274 - DNA, 25 bp, Homo sapien
tggaagatatgtgggtctggaactc

SEQ ID NO: 592275 - DNA, 25 bp, Homo sapien
ttttgcccaatatgtacagacctct

SEQ ID NO: 592276 - DNA, 25 bp, Homo sapien
acagacctctaatgacagtgtgcaa

SEQ ID NO: 592277 - DNA, 25 bp, Homo sapien
gtgcaaagactttttcgttcccaga

SEQ ID NO: 592278 - DNA, 25 bp, Homo sapien
gactttttcgttcccagattatgag

SEQ ID NO: 592279 - DNA, 25 bp, Homo sapien
agattatgaggctgccactttctcc

SEQ ID NO: 592280 - DNA, 25 bp, Homo sapien
ctgagccgcacttttctaaacagca

SEQ ID NO: 592281 - DNA, 25 bp, Homo sapien
gaaatatttgggaccgtgtcggcca

SEQ ID NO: 592282 - DNA, 25 bp, Homo sapien
gggcttgtggtcaccgtgttacaga

SEQ ID NO: 592283 - DNA, 25 bp, Homo sapien
tacagagtcaaatcacttcccagta

SEQ ID NO: 592284 - DNA, 25 bp, Homo sapien
atcacttcccagtaaacaccagttt

SEQ ID NO: 592285 - DNA, 25 bp, Homo sapien
acaccagtttccgatggctctctgg

SEQ ID NO: 592286 - DNA, 25 bp, Homo sapien
cacagtcggtgctgcggtgagccgt

SEQ ID NO: 592287 - DNA, 25 bp, Homo sapien
atatttggcgaatcagtgagtgaca

SEQ ID NO: 592288 - DNA, 25 bp, Homo sapien
atttggcgaatcagtgagtgacagc

SEQ ID NO: 592289 - DNA, 25 bp, Homo sapien
tttggcgaatcagtgagtgacagca

SEQ ID NO: 592290 - DNA, 25 bp, Homo sapien
tggcgaatcagtgagtgacagcagt

SEQ ID NO: 592291 - DNA, 25 bp, Homo sapien
gagtgacagcagttgtagtgctagt

SEQ ID NO: 592292 - DNA, 25 bp, Homo sapien
acagcagttgtagtgctagtgggtt

SEQ ID NO: 592293 - DNA, 25 bp, Homo sapien
gttgtagtgctagtgggttaaatca

SEQ ID NO: 592294 - DNA, 25 bp, Homo sapien
tgtagtgctagtgggttaaatcaag

SEQ ID NO: 592295 - DNA, 25 bp, Homo sapien
aatcaaggaataactgttgggaagt

SEQ ID NO: 592296 - DNA, 25 bp, Homo sapien
caaggaataactgttgggaagtgaa

SEQ ID NO: 592297 - DNA, 25 bp, Homo sapien
gtggttctcttccatcagctgcttc

SEQ ID NO: 592298 - DNA, 25 bp, Homo sapien
agctgcttcctgcatgctctatgga

SEQ ID NO: 592299 - DNA, 25 bp, Homo sapien
cttcctgcatgctctatggaggttt

SEQ ID NO: 592300 - DNA, 25 bp, Homo sapien
tgcatgctctatggaggttttctgt

SEQ ID NO: 592301 - DNA, 25 bp, Homo sapien
agaaatggccgtgcaagagccccct

SEQ ID NO: 592302 - DNA, 25 bp, Homo sapien
attggccacccatctactggctcag

SEQ ID NO: 592303 - DNA, 25 bp, Homo sapien
gggagcacagtttagggtcactgtc

SEQ ID NO: 592304 - DNA, 25 bp, Homo sapien
cacagtttagggtcactgtctttcc

SEQ ID NO: 592305 - DNA, 25 bp, Homo sapien
ccattctgcattcccaatgcggaga

SEQ ID NO: 592306 - DNA, 25 bp, Homo sapien
attcccaatgcggagaccttctttt

SEQ ID NO: 592307 - DNA, 25 bp, Homo sapien
ccaatgcggagaccttcttttcttt

SEQ ID NO: 592308 - DNA, 25 bp, Homo sapien
gagaaaatggcacacagcacctgaa

SEQ ID NO: 592309 - DNA, 25 bp, Homo sapien
gggcagtgacctctagaactcatgc

SEQ ID NO: 592310 - DNA, 25 bp, Homo sapien
acctctagaactcatgcattgccat

SEQ ID NO: 592311 - DNA, 25 bp, Homo sapien
ctcatgcattgccattggaaagcct

SEQ ID NO: 592312 - DNA, 25 bp, Homo sapien
aaagcctgtgttgggcatcgatgtc

SEQ ID NO: 592313 - DNA, 25 bp, Homo sapien
tgggcatcgatgtcagatcctgaag

SEQ ID NO: 592314 - DNA, 25 bp, Homo sapien
gaaaaaatcccatcctagaggcaag

SEQ ID NO: 592315 - DNA, 25 bp, Homo sapien
tagaggcaaggaggctacaccaaac

SEQ ID NO: 592316 - DNA, 25 bp, Homo sapien
ggaggctacaccaaaccatacacta

SEQ ID NO: 592317 - DNA, 25 bp, Homo sapien
aaccatacactacagtactttgtca

SEQ ID NO: 592318 - DNA, 25 bp, Homo sapien
cagtactttgtcacatggttgtcca

SEQ ID NO: 592319 - DNA, 25 bp, Homo sapien
cttcaaatgctgctggtaggaatgt

SEQ ID NO: 592320 - DNA, 25 bp, Homo sapien
aaatgctgctggtaggaatgtgaaa

SEQ ID NO: 592321 - DNA, 25 bp, Homo sapien
aatggtgtagccactttggaaaagc

SEQ ID NO: 592322 - DNA, 25 bp, Homo sapien
gtgtagccactttggaaaagcttgt

SEQ ID NO: 592323 - DNA, 25 bp, Homo sapien
gaaaagcttgtcatttcctcaaaat

SEQ ID NO: 592324 - DNA, 25 bp, Homo sapien
catacagttactgtgttctagcact

SEQ ID NO: 592325 - DNA, 25 bp, Homo sapien
gcacttcttctcctggctatatatg

SEQ ID NO: 592326 - DNA, 25 bp, Homo sapien
acttcttctcctggctatatatgcg

SEQ ID NO: 592327 - DNA, 25 bp, Homo sapien
tcttctcctggctatatatgcgaaa

SEQ ID NO: 592328 - DNA, 25 bp, Homo sapien
tcctggctatatatgcgaaagaaat

SEQ ID NO: 592329 - DNA, 25 bp, Homo sapien
ttcatatagaacatatgtcttgtac

SEQ ID NO: 592330 - DNA, 25 bp, Homo sapien
ccaaggggggagatcacttgaggtc

SEQ ID NO: 592331 - DNA, 25 bp, Homo sapien
gcgtggtggtgcacccctaaaatcc

SEQ ID NO: 592332 - DNA, 25 bp, Homo sapien
ggtggtgcacccctaaaatcccagc

SEQ ID NO: 592333 - DNA, 25 bp, Homo sapien
caaaatcatgccaatgtattccagt

SEQ ID NO: 592334 - DNA, 25 bp, Homo sapien
aaaatcatgccaatgtattccagtc

SEQ ID NO: 592335 - DNA, 25 bp, Homo sapien
aaatcatgccaatgtattccagtct

SEQ ID NO: 592336 - DNA, 25 bp, Homo sapien
aatcatgccaatgtattccagtctg

SEQ ID NO: 592337 - DNA, 25 bp, Homo sapien
tcatgccaatgtattccagtctggg

SEQ ID NO: 592338 - DNA, 25 bp, Homo sapien
catgccaatgtattccagtctgggt

SEQ ID NO: 592339 - DNA, 25 bp, Homo sapien
atgccaatgtattccagtctgggtg

SEQ ID NO: 592340 - DNA, 25 bp, Homo sapien
tgccaatgtattccagtctgggtga

SEQ ID NO: 592341 - DNA, 25 bp, Homo sapien
ttgctaaagctgtaagtatgatctc

SEQ ID NO: 592342 - DNA, 25 bp, Homo sapien
aaagctgtaagtatgatctcaagga

SEQ ID NO: 592343 - DNA, 25 bp, Homo sapien
gtaagtatgatctcaaggacttgtg

SEQ ID NO: 592344 - DNA, 25 bp, Homo sapien
gtatgatctcaaggacttgtgtaga

SEQ ID NO: 592345 - DNA, 25 bp, Homo sapien
aggacttgtgtagattatttgtaaa

SEQ ID NO: 592346 - DNA, 25 bp, Homo sapien
acaagaaaccatctctgatctgcct

SEQ ID NO: 592347 - DNA, 25 bp, Homo sapien
aagaaaccatctctgatctgcctgt

SEQ ID NO: 592348 - DNA, 25 bp, Homo sapien
aaaccatctctgatctgcctgtgct

SEQ ID NO: 592349 - DNA, 25 bp, Homo sapien
accatctctgatctgcctgtgctaa

SEQ ID NO: 592350 - DNA, 25 bp, Homo sapien
ctctgatctgcctgtgctaacccag

SEQ ID NO: 592351 - DNA, 25 bp, Homo sapien
aattgatttgtatatagttgctgcc

SEQ ID NO: 592352 - DNA, 25 bp, Homo sapien
gaatggcgtaaacccctccagcctg

SEQ ID NO: 592353 - DNA, 25 bp, Homo sapien
tcccctagcccagttagaaaataag

SEQ ID NO: 592354 - DNA, 25 bp, Homo sapien
ttagaaaataagtctgggccggcgg

SEQ ID NO: 592355 - DNA, 25 bp, Homo sapien
gaaaataagtctgggccggcggcgg

SEQ ID NO: 592356 - DNA, 25 bp, Homo sapien
tggctcacacctgcataggcagtgc

SEQ ID NO: 592357 - DNA, 25 bp, Homo sapien
cctgcataggcagtgctttggccag

SEQ ID NO: 592358 - DNA, 25 bp, Homo sapien
tgcataggcagtgctttggccagga

SEQ ID NO: 592359 - DNA, 25 bp, Homo sapien
agtgctttggccaggaggatccctt

SEQ ID NO: 592360 - DNA, 25 bp, Homo sapien
gtgctttggccaggaggatcccttg

SEQ ID NO: 592361 - DNA, 25 bp, Homo sapien
ggatcccttgatcccttgtggccag

SEQ ID NO: 592362 - DNA, 25 bp, Homo sapien
cccttgatcccttgtggccaggagt

SEQ ID NO: 592363 - DNA, 25 bp, Homo sapien
cagcagcatctttatgtagattgtg

SEQ ID NO: 592364 - DNA, 25 bp, Homo sapien
tttaagaattatctgggctgggcga

SEQ ID NO: 592365 - DNA, 25 bp, Homo sapien
tgggctgggcgagggtctctttttc

SEQ ID NO: 592366 - DNA, 25 bp, Homo sapien
ctttttctctttcagtgatcatcta

SEQ ID NO: 592367 - DNA, 25 bp, Homo sapien
ctttcagtgatcatctaggcagtta

SEQ ID NO: 592368 - DNA, 25 bp, Homo sapien
gatcatctaggcagttattatttaa

SEQ ID NO: 592369 - DNA, 25 bp, Homo sapien
gtttaatagctcaagtacattccaa

SEQ ID NO: 592370 - DNA, 25 bp, Homo sapien
gtacattccaatagacgaagtgcac

SEQ ID NO: 592371 - DNA, 25 bp, Homo sapien
gacgaagtgcacacaacacaatatg

SEQ ID NO: 592372 - DNA, 25 bp, Homo sapien
cacaatatgtgtgtacagtagtagt

SEQ ID NO: 592373 - DNA, 25 bp, Homo sapien
tagtaaagtttcttttgagtagtca

SEQ ID NO: 592374 - DNA, 25 bp, Homo sapien
catgaccctccacctgcacccagac

SEQ ID NO: 592375 - DNA, 25 bp, Homo sapien
tgccctcggtgagacgcagcccact

SEQ ID NO: 592376 - DNA, 25 bp, Homo sapien
ctcggtgagacgcagcccactgtgg

SEQ ID NO: 592377 - DNA, 25 bp, Homo sapien
tcggtgagacgcagcccactgtggg

SEQ ID NO: 592378 - DNA, 25 bp, Homo sapien
tgggcctgccatcagctcctgtgct

SEQ ID NO: 592379 - DNA, 25 bp, Homo sapien
tgccatcagctcctgtgctcctcgg

SEQ ID NO: 592380 - DNA, 25 bp, Homo sapien
atcagctcctgtgctcctcggcgcc

SEQ ID NO: 592381 - DNA, 25 bp, Homo sapien
tgccctgggcccgttcccacagcac

SEQ ID NO: 592382 - DNA, 25 bp, Homo sapien
ctgaatgaggagtggaaatgcgggc

SEQ ID NO: 592383 - DNA, 25 bp, Homo sapien
ggaaatgcgggcatgtcatgttttt

SEQ ID NO: 592384 - DNA, 25 bp, Homo sapien
gaaatgcgggcatgtcatgtttttg

SEQ ID NO: 592385 - DNA, 25 bp, Homo sapien
gaaacgtgtcgtagccttaaccaag

SEQ ID NO: 592386 - DNA, 25 bp, Homo sapien
gtgtcgtagccttaaccaagatcaa

SEQ ID NO: 592387 - DNA, 25 bp, Homo sapien
tagccttaaccaagatcaattacct

SEQ ID NO: 592388 - DNA, 25 bp, Homo sapien
ttaaccaagatcagtcacctccatg

SEQ ID NO: 592389 - DNA, 25 bp, Homo sapien
agtcacctccatgttggttgatctt

SEQ ID NO: 592390 - DNA, 25 bp, Homo sapien
ggttgatcttggttaaggctacaac

SEQ ID NO: 592391 - DNA, 25 bp, Homo sapien
ggttaaggctacaacaggcttgaag

SEQ ID NO: 592392 - DNA, 25 bp, Homo sapien
tctggagggtggctttactggctag

SEQ ID NO: 592393 - DNA, 25 bp, Homo sapien
agcaccagccagatcagacctatag

SEQ ID NO: 592394 - DNA, 25 bp, Homo sapien
ggatctaggcctcttgtactccata

SEQ ID NO: 592395 - DNA, 25 bp, Homo sapien
aggcctcttgtactccataccctgt

SEQ ID NO: 592396 - DNA, 25 bp, Homo sapien
agtaaacaactaagagcctcagaaa

SEQ ID NO: 592397 - DNA, 25 bp, Homo sapien
ataaaagccatctggaaagccaaaa

SEQ ID NO: 592398 - DNA, 25 bp, Homo sapien
aaaaattcacctattagggcatgtt

SEQ ID NO: 592399 - DNA, 25 bp, Homo sapien
attagggcatgttaagccacccatg

SEQ ID NO: 592400 - DNA, 25 bp, Homo sapien
tagggcatgttaagccacccatggt

SEQ ID NO: 592401 - DNA, 25 bp, Homo sapien
ggcatgttaagccacccatggtcta

SEQ ID NO: 592402 - DNA, 25 bp, Homo sapien
catgttaagccacccatggtctaaa

SEQ ID NO: 592403 - DNA, 25 bp, Homo sapien
cacccatggtctaaacttccttctt

SEQ ID NO: 592404 - DNA, 25 bp, Homo sapien
catggtctaaacttccttcttaata

SEQ ID NO: 592405 - DNA, 25 bp, Homo sapien
gcaaatactgaaaaaagaccgatag

SEQ ID NO: 592406 - DNA, 25 bp, Homo sapien
aaagcgatgagataggtttgaattc

SEQ ID NO: 592407 - DNA, 25 bp, Homo sapien
cagcaacaacatctgccacaagtgt

SEQ ID NO: 592408 - DNA, 25 bp, Homo sapien
aacatctgccacaagtgttcccttc

SEQ ID NO: 592409 - DNA, 25 bp, Homo sapien
cacaagtgttcccttcgctgcaaca

SEQ ID NO: 592410 - DNA, 25 bp, Homo sapien
acagccaaccagatacccataatat

SEQ ID NO: 592411 - DNA, 25 bp, Homo sapien
gatacccataatatctgccgaacat

SEQ ID NO: 592412 - DNA, 25 bp, Homo sapien
taatatctgccgaacatctgactag

SEQ ID NO: 592413 - DNA, 25 bp, Homo sapien
tgccgaacatctgactagccacaag

SEQ ID NO: 592414 - DNA, 25 bp, Homo sapien
tagccacaagtatgttacccagatg

SEQ ID NO: 592415 - DNA, 25 bp, Homo sapien
tgaaaaaaccaacggtgccaccgca

SEQ ID NO: 592416 - DNA, 25 bp, Homo sapien
gccaccgcagtctttaacactggta

SEQ ID NO: 592417 - DNA, 25 bp, Homo sapien
atgcagttacaacagcatacagcat

SEQ ID NO: 592418 - DNA, 25 bp, Homo sapien
ataagataccttttcatctctatac

SEQ ID NO: 592419 - DNA, 25 bp, Homo sapien
aagataccttttcatctctatacta

SEQ ID NO: 592420 - DNA, 25 bp, Homo sapien
gataccttttcatctctatactagt

SEQ ID NO: 592421 - DNA, 25 bp, Homo sapien
ataccttttcatctctatactagtc

SEQ ID NO: 592422 - DNA, 25 bp, Homo sapien
taccttttcatctctatactagtcc

SEQ ID NO: 592423 - DNA, 25 bp, Homo sapien
ccttttcatctctatactagtcctt

SEQ ID NO: 592424 - DNA, 25 bp, Homo sapien
ttttcatctctatactagtcctttt

SEQ ID NO: 592425 - DNA, 25 bp, Homo sapien
tttcatctctatactagtccttttc

SEQ ID NO: 592426 - DNA, 25 bp, Homo sapien
ttcatctctatactagtccttttca

SEQ ID NO: 592427 - DNA, 25 bp, Homo sapien
tcatctctatactagtccttttcat

SEQ ID NO: 592428 - DNA, 25 bp, Homo sapien
catctctatactagtccttttcatt

SEQ ID NO: 592429 - DNA, 25 bp, Homo sapien
caggcctcatgtgggtctcagttcc

SEQ ID NO: 592430 - DNA, 25 bp, Homo sapien
gaagttctccagtgcatgcataggg

SEQ ID NO: 592431 - DNA, 25 bp, Homo sapien
tagggttgaccagatgtcccaaggt

SEQ ID NO: 592432 - DNA, 25 bp, Homo sapien
tcccaaggtgctctaggacttatgc

SEQ ID NO: 592433 - DNA, 25 bp, Homo sapien
ggacttatgcctatgaagctgtttt

SEQ ID NO: 592434 - DNA, 25 bp, Homo sapien
tgttttagggcttcctagtcagtcc

SEQ ID NO: 592435 - DNA, 25 bp, Homo sapien
gatcattcccgctggctggtgtggc

SEQ ID NO: 592436 - DNA, 25 bp, Homo sapien
gcatttcttttatggcactacctgg

SEQ ID NO: 592437 - DNA, 25 bp, Homo sapien
tgggattgggccaccagacctgcgc

SEQ ID NO: 592438 - DNA, 25 bp, Homo sapien
agacctgcgctaacatgctgatttg

SEQ ID NO: 592439 - DNA, 25 bp, Homo sapien
tggactcttaacatcataggacaaa

SEQ ID NO: 592440 - DNA, 25 bp, Homo sapien
cctctatctgacaggtatactcact

SEQ ID NO: 592441 - DNA, 25 bp, Homo sapien
tatctgacaggtatactcactgccc

SEQ ID NO: 592442 - DNA, 25 bp, Homo sapien
gacaggtatactcactgccccatgt

SEQ ID NO: 592443 - DNA, 25 bp, Homo sapien
tgccccatgttgtcaggacctgaga

SEQ ID NO: 592444 - DNA, 25 bp, Homo sapien
atgttgtcaggacctgagaccctgg

SEQ ID NO: 592445 - DNA, 25 bp, Homo sapien
ttgtcaggacctgagaccctgggcc

SEQ ID NO: 592446 - DNA, 25 bp, Homo sapien
tgtggcccctgtctgattggagcca

SEQ ID NO: 592447 - DNA, 25 bp, Homo sapien
ctgattggagccagctctgggtggc

SEQ ID NO: 592448 - DNA, 25 bp, Homo sapien
cagctctgggtggccctcatgtgga

SEQ ID NO: 592449 - DNA, 25 bp, Homo sapien
tcatgtggagggaagagcaccaagg

SEQ ID NO: 592450 - DNA, 25 bp, Homo sapien
gggcctgcctgggtgcacgctcagg

SEQ ID NO: 592451 - DNA, 25 bp, Homo sapien
gaaatatcacattgcccctgatgtt

SEQ ID NO: 592452 - DNA, 25 bp, Homo sapien
atgttttgacagtctcctagtgctc

SEQ ID NO: 592453 - DNA, 25 bp, Homo sapien
agtgctcctggtagtgccactaagg

SEQ ID NO: 592454 - DNA, 25 bp, Homo sapien
gaaaaccaaggtgcgcattccttct

SEQ ID NO: 592455 - DNA, 25 bp, Homo sapien
tggactttaccttacttgttagtct

SEQ ID NO: 592456 - DNA, 25 bp, Homo sapien
tacttgttagtctacgccccactgt

SEQ ID NO: 592457 - DNA, 25 bp, Homo sapien
cccttagccaacctctgtctttttg

SEQ ID NO: 592458 - DNA, 25 bp, Homo sapien
ttttctgagaatattgtcctatcct

SEQ ID NO: 592459 - DNA, 25 bp, Homo sapien
ttgtcctatcctcttttatatatgg

SEQ ID NO: 592460 - DNA, 25 bp, Homo sapien
agttctctcctctttatatcctgag

SEQ ID NO: 592461 - DNA, 25 bp, Homo sapien
atatcctgagactttgacaccagat

SEQ ID NO: 592462 - DNA, 25 bp, Homo sapien
tgacctggaggattggtaaggtttt

SEQ ID NO: 592463 - DNA, 25 bp, Homo sapien
tgaaactctgtgatactgcaaataa

SEQ ID NO: 592464 - DNA, 25 bp, Homo sapien
gatactgcaaataaactatggtctt

SEQ ID NO: 592465 - DNA, 25 bp, Homo sapien
aaactatggtcttaggagaatttca

SEQ ID NO: 592466 - DNA, 25 bp, Homo sapien
ggagaatttcatggcactcttatta

SEQ ID NO: 592467 - DNA, 25 bp, Homo sapien
gaatttcatggcactcttattattt

SEQ ID NO: 592468 - DNA, 25 bp, Homo sapien
ttcatggcactcttattatttattc

SEQ ID NO: 592469 - DNA, 25 bp, Homo sapien
atggcactcttattatttattcctt

SEQ ID NO: 592470 - DNA, 25 bp, Homo sapien
gttgaaaatcagaaggcacctggga

SEQ ID NO: 592471 - DNA, 25 bp, Homo sapien
tcagaaggcacctgggaatcaattt

SEQ ID NO: 592472 - DNA, 25 bp, Homo sapien
tgggaatcaatttgtccttaaaaca

SEQ ID NO: 592473 - DNA, 25 bp, Homo sapien
gttgcctataaagcatatttcccag

SEQ ID NO: 592474 - DNA, 25 bp, Homo sapien
ttgcctataaagcatatttcccagt

SEQ ID NO: 592475 - DNA, 25 bp, Homo sapien
tgcctataaagcatatttcccagtt

SEQ ID NO: 592476 - DNA, 25 bp, Homo sapien
gcctataaagcatatttcccagttc

SEQ ID NO: 592477 - DNA, 25 bp, Homo sapien
cctataaagcatatttcccagttct

SEQ ID NO: 592478 - DNA, 25 bp, Homo sapien
ctataaagcatatttcccagttcta

SEQ ID NO: 592479 - DNA, 25 bp, Homo sapien
tataaagcatatttcccagttctac

SEQ ID NO: 592480 - DNA, 25 bp, Homo sapien
ataaagcatatttcccagttctact

SEQ ID NO: 592481 - DNA, 25 bp, Homo sapien
taaagcatatttcccagttctactc

SEQ ID NO: 592482 - DNA, 25 bp, Homo sapien
aagcatatttcccagttctactctc

SEQ ID NO: 592483 - DNA, 25 bp, Homo sapien
agcatatttcccagttctactctct

SEQ ID NO: 592484 - DNA, 25 bp, Homo sapien
attggaaggaggtagaagccgtgca

SEQ ID NO: 592485 - DNA, 25 bp, Homo sapien
gaggtagaagccgtgcagaggaaga

SEQ ID NO: 592486 - DNA, 25 bp, Homo sapien
gagtctggagaacaaagggtccttt

SEQ ID NO: 592487 - DNA, 25 bp, Homo sapien
gggctgacactgtcagccaatcctc

SEQ ID NO: 592488 - DNA, 25 bp, Homo sapien
actgtcagccaatcctcccatcggg

SEQ ID NO: 592489 - DNA, 25 bp, Homo sapien
agccaatcctcccatcggggaagag

SEQ ID NO: 592490 - DNA, 25 bp, Homo sapien
cccatcggggaagagaatcctggac

SEQ ID NO: 592491 - DNA, 25 bp, Homo sapien
agaatcctggacagggacaggatgg

SEQ ID NO: 592492 - DNA, 25 bp, Homo sapien
tataacgggctttttggtgggagat

SEQ ID NO: 592493 - DNA, 25 bp, Homo sapien
taacgggctttttggtgggagatgg

SEQ ID NO: 592494 - DNA, 25 bp, Homo sapien
ttttggtgggagatgggtacccagt

SEQ ID NO: 592495 - DNA, 25 bp, Homo sapien
acatgactctggcatttattctagc

SEQ ID NO: 592496 - DNA, 25 bp, Homo sapien
gactctggcatttattctagcctat

SEQ ID NO: 592497 - DNA, 25 bp, Homo sapien
cagggtggcctctaaggcctttgga

SEQ ID NO: 592498 - DNA, 25 bp, Homo sapien
gcctctaaggcctttggattttggg

SEQ ID NO: 592499 - DNA, 25 bp, Homo sapien
ttttgggtaaaggaatggtactcag

SEQ ID NO: 592500 - DNA, 25 bp, Homo sapien
gaccgatccagtgagggtcaggatt

SEQ ID NO: 592501 - DNA, 25 bp, Homo sapien
aaagtagtgactgagttgagactgg

SEQ ID NO: 592502 - DNA, 25 bp, Homo sapien
agactgggagcttgacagccacagt

SEQ ID NO: 592503 - DNA, 25 bp, Homo sapien
gggagcttgacagccacagtgtttg

SEQ ID NO: 592504 - DNA, 25 bp, Homo sapien
cagtgtttgccaagcaatggttgga

SEQ ID NO: 592505 - DNA, 25 bp, Homo sapien
gcaatggttggaagtgtatttttaa

SEQ ID NO: 592506 - DNA, 25 bp, Homo sapien
tccccactgatgtcaacagcactgt

SEQ ID NO: 592507 - DNA, 25 bp, Homo sapien
tcaacagcactgtctatgaatagaa

SEQ ID NO: 592508 - DNA, 25 bp, Homo sapien
agaaatgttcactctgcaagctcag

SEQ ID NO: 592509 - DNA, 25 bp, Homo sapien
ctgcaagctcagaggctcaacatat

SEQ ID NO: 592510 - DNA, 25 bp, Homo sapien
gctcagaggctcaacatataacttg

SEQ ID NO: 592511 - DNA, 25 bp, Homo sapien
ttatcataatattttccaggaactg

SEQ ID NO: 592512 - DNA, 25 bp, Homo sapien
gacaggtattctgaattgccttcta

SEQ ID NO: 592513 - DNA, 25 bp, Homo sapien
gaattgccttctattccgaatttaa

SEQ ID NO: 592514 - DNA, 25 bp, Homo sapien
tctattccgaatttaatgttttcct

SEQ ID NO: 592515 - DNA, 25 bp, Homo sapien
ttaccaggttagttacagtatttga

SEQ ID NO: 592516 - DNA, 25 bp, Homo sapien
aaatcatgtttctctagcctcaagc

SEQ ID NO: 592517 - DNA, 25 bp, Homo sapien
ggttattaaagcacatcctgagcca

SEQ ID NO: 592518 - DNA, 25 bp, Homo sapien
atcctgagccactttacctagttga

SEQ ID NO: 592519 - DNA, 25 bp, Homo sapien
gaagaagcaccaactatttagtgat

SEQ ID NO: 592520 - DNA, 25 bp, Homo sapien
atttagtgatttgatgttccatgca

SEQ ID NO: 592521 - DNA, 25 bp, Homo sapien
gatgttccatgcatatacgaaagta

SEQ ID NO: 592522 - DNA, 25 bp, Homo sapien
gaatacctatgtcttgaatcacaca

SEQ ID NO: 592523 - DNA, 25 bp, Homo sapien
tgaatcacacactgttactttccct

SEQ ID NO: 592524 - DNA, 25 bp, Homo sapien
cactgttactttccctcttaagatt

SEQ ID NO: 592525 - DNA, 25 bp, Homo sapien
aagatttctggtttagctggtctgt

SEQ ID NO: 592526 - DNA, 25 bp, Homo sapien
tagctggtctgtccctcagtgagag

SEQ ID NO: 592527 - DNA, 25 bp, Homo sapien
agtgagagtctctgtctcgttctct

SEQ ID NO: 592528 - DNA, 25 bp, Homo sapien
aaccctcaaagtgaagcctcctagg

SEQ ID NO: 592529 - DNA, 25 bp, Homo sapien
aagtgaagcctcctagggatgaaga

SEQ ID NO: 592530 - DNA, 25 bp, Homo sapien
ggtcagcctggactttaaataccta

SEQ ID NO: 592531 - DNA, 25 bp, Homo sapien
taaatacctaatgtggcccagcctt

SEQ ID NO: 592532 - DNA, 25 bp, Homo sapien
aatacctaatgtggcccagccttgg

SEQ ID NO: 592533 - DNA, 25 bp, Homo sapien
gggatttgtatctcccttcctcctc

SEQ ID NO: 592534 - DNA, 25 bp, Homo sapien
tgggtggcctctctaggtttctctg

SEQ ID NO: 592535 - DNA, 25 bp, Homo sapien
ctctctaggtttctctgtgttctct

SEQ ID NO: 592536 - DNA, 25 bp, Homo sapien
agccagagccaaggcagtcatcttg

SEQ ID NO: 592537 - DNA, 25 bp, Homo sapien
agccaaggcagtcatcttgttcccc

SEQ ID NO: 592538 - DNA, 25 bp, Homo sapien
ggccaggctgggtgccttcaggtga

SEQ ID NO: 592539 - DNA, 25 bp, Homo sapien
cagactagaagaccagcagaccagc

SEQ ID NO: 592540 - DNA, 25 bp, Homo sapien
gaccagtgatggtggaacaatgcag

SEQ ID NO: 592541 - DNA, 25 bp, Homo sapien
tctggacaccgaggggagttcagcc

SEQ ID NO: 592542 - DNA, 25 bp, Homo sapien
gtggttggagaagagtccgctcact

SEQ ID NO: 592543 - DNA, 25 bp, Homo sapien
tggttggagaagagtccgctcactg

SEQ ID NO: 592544 - DNA, 25 bp, Homo sapien
gagaagagtccgctcactgggccca

SEQ ID NO: 592545 - DNA, 25 bp, Homo sapien
agaagagtccgctcactgggcccaa

SEQ ID NO: 592546 - DNA, 25 bp, Homo sapien
gaagagtccgctcactgggcccaac

SEQ ID NO: 592547 - DNA, 25 bp, Homo sapien
aagagtccgctcactgggcccaact

SEQ ID NO: 592548 - DNA, 25 bp, Homo sapien
aactccagaggaaaccacattccca

SEQ ID NO: 592549 - DNA, 25 bp, Homo sapien
tccagaggaaaccacattcccactc

SEQ ID NO: 592550 - DNA, 25 bp, Homo sapien
agaaagcttggctagtggaacccat

SEQ ID NO: 592551 - DNA, 25 bp, Homo sapien
gaaagcttggctagtggaacccatt

SEQ ID NO: 592552 - DNA, 25 bp, Homo sapien
aaagcttggctagtggaacccattg

SEQ ID NO: 592553 - DNA, 25 bp, Homo sapien
aagcttggctagtggaacccattgt

SEQ ID NO: 592554 - DNA, 25 bp, Homo sapien
agcttggctagtggaacccattgtt

SEQ ID NO: 592555 - DNA, 25 bp, Homo sapien
gcttggctagtggaacccattgttt

SEQ ID NO: 592556 - DNA, 25 bp, Homo sapien
cttggctagtggaacccattgttta

SEQ ID NO: 592557 - DNA, 25 bp, Homo sapien
ttggctagtggaacccattgtttaa

SEQ ID NO: 592558 - DNA, 25 bp, Homo sapien
tggctagtggaacccattgtttaaa

SEQ ID NO: 592559 - DNA, 25 bp, Homo sapien
catcatacaaactacaggctacgat

SEQ ID NO: 592560 - DNA, 25 bp, Homo sapien
atcatacaaactacaggctacgatg

SEQ ID NO: 592561 - DNA, 25 bp, Homo sapien
catacaaactacaggctacgatgag

SEQ ID NO: 592562 - DNA, 25 bp, Homo sapien
atacaaactacaggctacgatgagc

SEQ ID NO: 592563 - DNA, 25 bp, Homo sapien
tacaaactacaggctacgatgagca

SEQ ID NO: 592564 - DNA, 25 bp, Homo sapien
gtcctgcacattcctatagtgcata

SEQ ID NO: 592565 - DNA, 25 bp, Homo sapien
tcctgcacattcctatagtgcatat

SEQ ID NO: 592566 - DNA, 25 bp, Homo sapien
cctgcacattcctatagtgcatatt

SEQ ID NO: 592567 - DNA, 25 bp, Homo sapien
acattcctatagtgcatatttaccc

SEQ ID NO: 592568 - DNA, 25 bp, Homo sapien
cattcctatagtgcatatttaccct

SEQ ID NO: 592569 - DNA, 25 bp, Homo sapien
attcctatagtgcatatttaccctt

SEQ ID NO: 592570 - DNA, 25 bp, Homo sapien
tcgtgacccctgtgactcacacgta

SEQ ID NO: 592571 - DNA, 25 bp, Homo sapien
ctgtgactcacacgtacacatccag

SEQ ID NO: 592572 - DNA, 25 bp, Homo sapien
ctagttcctgtcttagctgatcagc

SEQ ID NO: 592573 - DNA, 25 bp, Homo sapien
gttcctgtcttagctgatcagccaa

SEQ ID NO: 592574 - DNA, 25 bp, Homo sapien
gtcttagctgatcagccaaccttgt

SEQ ID NO: 592575 - DNA, 25 bp, Homo sapien
ttgtaacaggctgtaccctaactga

SEQ ID NO: 592576 - DNA, 25 bp, Homo sapien
aactgatcaatcaacctcatgacac

SEQ ID NO: 592577 - DNA, 25 bp, Homo sapien
gatcaatcaacctcatgacactgtg

SEQ ID NO: 592578 - DNA, 25 bp, Homo sapien
tcaatcaacctcatgacactgtgct

SEQ ID NO: 592579 - DNA, 25 bp, Homo sapien
atcaacctcatgacactgtgctctg

SEQ ID NO: 592580 - DNA, 25 bp, Homo sapien
acctcatgacactgtgctctgtaac

SEQ ID NO: 592581 - DNA, 25 bp, Homo sapien
tccagactaagacgtgcatacaaaa

SEQ ID NO: 592582 - DNA, 25 bp, Homo sapien
tttgttaaaacatcagtcggcagga

SEQ ID NO: 592583 - DNA, 25 bp, Homo sapien
cagtcggcaggaacagacatctcaa

SEQ ID NO: 592584 - DNA, 25 bp, Homo sapien
agacatctcaagctccactgataag

SEQ ID NO: 592585 - DNA, 25 bp, Homo sapien
aactggaactacatgccgcttttaa

SEQ ID NO: 592586 - DNA, 25 bp, Homo sapien
atgccgcttttaaaagtgtctcaaa

SEQ ID NO: 592587 - DNA, 25 bp, Homo sapien
gtctcaaatttaagctcactcaagg

SEQ ID NO: 592588 - DNA, 25 bp, Homo sapien
aactgacatgccgtttcatcattaa

SEQ ID NO: 592589 - DNA, 25 bp, Homo sapien
gtttgcaagtttccaagcctcaggg

SEQ ID NO: 592590 - DNA, 25 bp, Homo sapien
agcctcagggcttcattatgcatca

SEQ ID NO: 592591 - DNA, 25 bp, Homo sapien
atgcatcagcataggacaacaccag

SEQ ID NO: 592592 - DNA, 25 bp, Homo sapien
catttctcccaccaggctcaatatt

SEQ ID NO: 592593 - DNA, 25 bp, Homo sapien
atttctcccaccaggctcaatattg

SEQ ID NO: 592594 - DNA, 25 bp, Homo sapien
tttctcccaccaggctcaatattgt

SEQ ID NO: 592595 - DNA, 25 bp, Homo sapien
ccgctacaagtgttgttcccatggt

SEQ ID NO: 592596 - DNA, 25 bp, Homo sapien
cgctacaagtgttgttcccatggtg

SEQ ID NO: 592597 - DNA, 25 bp, Homo sapien
gctacaagtgttgttcccatggtgc

SEQ ID NO: 592598 - DNA, 25 bp, Homo sapien
ctacaagtgttgttcccatggtgca

SEQ ID NO: 592599 - DNA, 25 bp, Homo sapien
tacaagtgttgttcccatggtgcac

SEQ ID NO: 592600 - DNA, 25 bp, Homo sapien
aatgtctgacattccaggtgtagag

SEQ ID NO: 592601 - DNA, 25 bp, Homo sapien
cattccaggtgtagagttgtgtagc

SEQ ID NO: 592602 - DNA, 25 bp, Homo sapien
gagttgtgtagctgactagacttca

SEQ ID NO: 592603 - DNA, 25 bp, Homo sapien
tgactagacttcagacaacctcccg

SEQ ID NO: 592604 - DNA, 25 bp, Homo sapien
acaacctcccggtctgagccaggag

SEQ ID NO: 592605 - DNA, 25 bp, Homo sapien
gagccaggagcactacaacctgtga

SEQ ID NO: 592606 - DNA, 25 bp, Homo sapien
acctgtgaagaatgtgcacccggcc

SEQ ID NO: 592607 - DNA, 25 bp, Homo sapien
tggctacacagcaacagcacccaat

SEQ ID NO: 592608 - DNA, 25 bp, Homo sapien
aacagcacccaatgggcccaggagc

SEQ ID NO: 592609 - DNA, 25 bp, Homo sapien
ccagcaggagacctttcttggagga

SEQ ID NO: 592610 - DNA, 25 bp, Homo sapien
tcttggaggaaggagtcttttttct

SEQ ID NO: 592611 - DNA, 25 bp, Homo sapien
tatcaggatgcaccaggcccttggg

SEQ ID NO: 592612 - DNA, 25 bp, Homo sapien
caggcccttgggttttggacatata

SEQ ID NO: 592613 - DNA, 25 bp, Homo sapien
aaattacccaagatggttgccatat

SEQ ID NO: 592614 - DNA, 25 bp, Homo sapien
ggttgccatatacattccctttgaa

SEQ ID NO: 592615 - DNA, 25 bp, Homo sapien
attccctttgaatggcagctactag

SEQ ID NO: 592616 - DNA, 25 bp, Homo sapien
gcagctactagcctgctattggact

SEQ ID NO: 592617 - DNA, 25 bp, Homo sapien
gaacacttgaccactgaagcactgt

SEQ ID NO: 592618 - DNA, 25 bp, Homo sapien
atgtgaccttaagacctgagctgcc

SEQ ID NO: 592619 - DNA, 25 bp, Homo sapien
gcccatctcatgcaggtattattaa

SEQ ID NO: 592620 - DNA, 25 bp, Homo sapien
gaaataccctaaggctgactacccg

SEQ ID NO: 592621 - DNA, 25 bp, Homo sapien
tgactacccgcaaccgtgtaaccaa

SEQ ID NO: 592622 - DNA, 25 bp, Homo sapien
tgtttaattttctttgagttgtatt

SEQ ID NO: 592623 - DNA, 25 bp, Homo sapien
aaatctgttattaatatgcatccca

SEQ ID NO: 592624 - DNA, 25 bp, Homo sapien
aatatgcatcccaaaattgtatcat

SEQ ID NO: 592625 - DNA, 25 bp, Homo sapien
gcatcccaaaattgtatcatattgc

SEQ ID NO: 592626 - DNA, 25 bp, Homo sapien
cccaaaattgtatcatattgctaaa

SEQ ID NO: 592627 - DNA, 25 bp, Homo sapien
gatagatcttgttatatgttattgg

SEQ ID NO: 592628 - DNA, 25 bp, Homo sapien
ggtaataattgttatcctgttaaat

SEQ ID NO: 592629 - DNA, 25 bp, Homo sapien
atttctttgtcaattgcatcagtaa

SEQ ID NO: 592630 - DNA, 25 bp, Homo sapien
aagtcttttgtcattcacagatgat

SEQ ID NO: 592631 - DNA, 25 bp, Homo sapien
gtcttttgtcattcacagatgatta

SEQ ID NO: 592632 - DNA, 25 bp, Homo sapien
cacagatgattattgttttacttgg

SEQ ID NO: 592633 - DNA, 25 bp, Homo sapien
ctcgtctgtaaaatgcacatcacca

SEQ ID NO: 592634 - DNA, 25 bp, Homo sapien
gtctgtaaaatgcacatcaccacct

SEQ ID NO: 592635 - DNA, 25 bp, Homo sapien
tgtaaaatgcacatcaccacctact

SEQ ID NO: 592636 - DNA, 25 bp, Homo sapien
taaaatgcacatcaccacctacttg

SEQ ID NO: 592637 - DNA, 25 bp, Homo sapien
aatgcacatcaccacctacttgagt

SEQ ID NO: 592638 - DNA, 25 bp, Homo sapien
tgcacatcaccacctacttgagtgt

SEQ ID NO: 592639 - DNA, 25 bp, Homo sapien
cacatcaccacctacttgagtgttg

SEQ ID NO: 592640 - DNA, 25 bp, Homo sapien
catcaccacctacttgagtgttgag

SEQ ID NO: 592641 - DNA, 25 bp, Homo sapien
acttgagtgttgaggattcaattag

SEQ ID NO: 592642 - DNA, 25 bp, Homo sapien
ggattcaattagttaatgtacttca

SEQ ID NO: 592643 - DNA, 25 bp, Homo sapien
tgtacttcaaataatcatgtagtaa

SEQ ID NO: 592644 - DNA, 25 bp, Homo sapien
tggaaatggctctgggtgagtgagt

SEQ ID NO: 592645 - DNA, 25 bp, Homo sapien
tggtgagtgaacgtgaaggcctgca

SEQ ID NO: 592646 - DNA, 25 bp, Homo sapien
gtgagtgaacgtgaaggcctgcagc

SEQ ID NO: 592647 - DNA, 25 bp, Homo sapien
aggcctgcagcattactgtacacta

SEQ ID NO: 592648 - DNA, 25 bp, Homo sapien
gtacactaccatagatttttatcaa

SEQ ID NO: 592649 - DNA, 25 bp, Homo sapien
tagatttttatcaacactgtacact

SEQ ID NO: 592650 - DNA, 25 bp, Homo sapien
gatttttatcaacactgtacactta

SEQ ID NO: 592651 - DNA, 25 bp, Homo sapien
gtacacttagggacactaaacttat

SEQ ID NO: 592652 - DNA, 25 bp, Homo sapien
aaataaattaacctcagctcactgt

SEQ ID NO: 592653 - DNA, 25 bp, Homo sapien
ctcactgtaactttataagctttat

SEQ ID NO: 592654 - DNA, 25 bp, Homo sapien
aacacattgtacagttacacaaaat

SEQ ID NO: 592655 - DNA, 25 bp, Homo sapien
tatggttgttggcataacaggctat

SEQ ID NO: 592656 - DNA, 25 bp, Homo sapien
gcataacaggctatggatgtctcta

SEQ ID NO: 592657 - DNA, 25 bp, Homo sapien
ggctatggatgtctctagcatcaaa

SEQ ID NO: 592658 - DNA, 25 bp, Homo sapien
gcatcaaagcaatgttaataagtct

SEQ ID NO: 592659 - DNA, 25 bp, Homo sapien
gtctaataagactactggctatcat

SEQ ID NO: 592660 - DNA, 25 bp, Homo sapien
gactactggctatcatctatcaaca

SEQ ID NO: 592661 - DNA, 25 bp, Homo sapien
ggctatcatctatcaacattggtct

SEQ ID NO: 592662 - DNA, 25 bp, Homo sapien
caacattggtctgatttgtgataat

SEQ ID NO: 592663 - DNA, 25 bp, Homo sapien
ggtctgatttgtgataattgtgttc

SEQ ID NO: 592664 - DNA, 25 bp, Homo sapien
tttcctggcctctctgaactattgg

SEQ ID NO: 592665 - DNA, 25 bp, Homo sapien
ggcctctctgaactattggcttttt

SEQ ID NO: 592666 - DNA, 25 bp, Homo sapien
gtatacaagacaatgtacataggtt

SEQ ID NO: 592667 - DNA, 25 bp, Homo sapien
atcagggacttgagcgtctgagatt

SEQ ID NO: 592668 - DNA, 25 bp, Homo sapien
gacttgagcgtctgagattttggta

SEQ ID NO: 592669 - DNA, 25 bp, Homo sapien
attttggtatcctcacagcatccta

SEQ ID NO: 592670 - DNA, 25 bp, Homo sapien
tttggtatcctcacagcatcctaga

SEQ ID NO: 592671 - DNA, 25 bp, Homo sapien
tggtatcctcacagcatcctagaaa

SEQ ID NO: 592672 - DNA, 25 bp, Homo sapien
gcatcctagaaacagtatcctgcac

SEQ ID NO: 592673 - DNA, 25 bp, Homo sapien
gtatcctgcacatactgagcaacaa

SEQ ID NO: 592674 - DNA, 25 bp, Homo sapien
ctgcacatactgagcaacaactgta

SEQ ID NO: 592675 - DNA, 25 bp, Homo sapien
tactgagcaacaactgtatacataa

SEQ ID NO: 592676 - DNA, 25 bp, Homo sapien
tatacataaaggttgagggccgggt

SEQ ID NO: 592677 - DNA, 25 bp, Homo sapien
gcattaaacacacataatggtgact

SEQ ID NO: 592678 - DNA, 25 bp, Homo sapien
acacacataatggtgactaaaatta

SEQ ID NO: 592679 - DNA, 25 bp, Homo sapien
aatgttttcactacaatgaaatcag

SEQ ID NO: 592680 - DNA, 25 bp, Homo sapien
agcttaatttaatcatcccactatg

SEQ ID NO: 592681 - DNA, 25 bp, Homo sapien
gcttaatttaatcatcccactatga

SEQ ID NO: 592682 - DNA, 25 bp, Homo sapien
tcccactatgaatacatgtatcata

SEQ ID NO: 592683 - DNA, 25 bp, Homo sapien
tatcataacatcacagtataccctg

SEQ ID NO: 592684 - DNA, 25 bp, Homo sapien
ataacatcacagtataccctgtaaa

SEQ ID NO: 592685 - DNA, 25 bp, Homo sapien
acatcacagtataccctgtaaacat

SEQ ID NO: 592686 - DNA, 25 bp, Homo sapien
cagtataccctgtaaacatatacaa

SEQ ID NO: 592687 - DNA, 25 bp, Homo sapien
caattattatttgtaacctatgata

SEQ ID NO: 592688 - DNA, 25 bp, Homo sapien
gggagtggacctgcattagcaagca

SEQ ID NO: 592689 - DNA, 25 bp, Homo sapien
attagcaagcagagaatgtccagag

SEQ ID NO: 592690 - DNA, 25 bp, Homo sapien
aatgtccagagcctagagacagcca

SEQ ID NO: 592691 - DNA, 25 bp, Homo sapien
tagagacagccagcccatgcagagg

SEQ ID NO: 592692 - DNA, 25 bp, Homo sapien
gacagccagcccatgcagagggtag

SEQ ID NO: 592693 - DNA, 25 bp, Homo sapien
gagatccagaccatgagcagagaaa

SEQ ID NO: 592694 - DNA, 25 bp, Homo sapien
tccagaccatgagcagagaaaagtt

SEQ ID NO: 592695 - DNA, 25 bp, Homo sapien
gaaaagttcagtttatctcacggaa

SEQ ID NO: 592696 - DNA, 25 bp, Homo sapien
ttatctcacggaaaactttaatgtt

SEQ ID NO: 592697 - DNA, 25 bp, Homo sapien
atgttaggcttaatcctctgttcct

SEQ ID NO: 592698 - DNA, 25 bp, Homo sapien
taggcttaatcctctgttccttcct

SEQ ID NO: 592699 - DNA, 25 bp, Homo sapien
agaaatgcacaaatccagggattcc

SEQ ID NO: 592700 - DNA, 25 bp, Homo sapien
tgaaagccaacaactgttttccaaa

SEQ ID NO: 592701 - DNA, 25 bp, Homo sapien
aaccagatcacaaattactgtattt

SEQ ID NO: 592702 - DNA, 25 bp, Homo sapien
tttcttacaatagtgctgaactttt

SEQ ID NO: 592703 - DNA, 25 bp, Homo sapien
agtgctgaacttttatttgaggttt

SEQ ID NO: 592704 - DNA, 25 bp, Homo sapien
ttctgtttctgaaaagcagacatga

SEQ ID NO: 592705 - DNA, 25 bp, Homo sapien
gcagacatgatggattgaaataaaa

SEQ ID NO: 592706 - DNA, 25 bp, Homo sapien
aagataatttattgcaatgcttact

SEQ ID NO: 592707 - DNA, 25 bp, Homo sapien
tattgcaatgcttactttcatgtgc

SEQ ID NO: 592708 - DNA, 25 bp, Homo sapien
ttactttcatgtgcagagagaagca

SEQ ID NO: 592709 - DNA, 25 bp, Homo sapien
gcagagagaagcagtataattgtaa

SEQ ID NO: 592710 - DNA, 25 bp, Homo sapien
cacacccggccagaaatgcttttta

SEQ ID NO: 592711 - DNA, 25 bp, Homo sapien
ggttccacccgggcgtggtagctca

SEQ ID NO: 592712 - DNA, 25 bp, Homo sapien
acgcctgtaatccttcaaggcaggt

SEQ ID NO: 592713 - DNA, 25 bp, Homo sapien
cgcctgtaatccttcaaggcaggtg

SEQ ID NO: 592714 - DNA, 25 bp, Homo sapien
gcctgtaatccttcaaggcaggtgg

SEQ ID NO: 592715 - DNA, 25 bp, Homo sapien
cctgtaatccttcaaggcaggtggg

SEQ ID NO: 592716 - DNA, 25 bp, Homo sapien
ctgtaatccttcaaggcaggtgggt

SEQ ID NO: 592717 - DNA, 25 bp, Homo sapien
tgtaatccttcaaggcaggtgggtc

SEQ ID NO: 592718 - DNA, 25 bp, Homo sapien
aatccttcaaggcaggtgggtcacc

SEQ ID NO: 592719 - DNA, 25 bp, Homo sapien
tagcccggcgtggtgatgtgtacct

SEQ ID NO: 592720 - DNA, 25 bp, Homo sapien
agcccggcgtggtgatgtgtacctg

SEQ ID NO: 592721 - DNA, 25 bp, Homo sapien
gcgcctggcctatagtactttttaa

SEQ ID NO: 592722 - DNA, 25 bp, Homo sapien
cgcctggcctatagtactttttaat

SEQ ID NO: 592723 - DNA, 25 bp, Homo sapien
gcctggcctatagtactttttaatg

SEQ ID NO: 592724 - DNA, 25 bp, Homo sapien
cctggcctatagtactttttaatga

SEQ ID NO: 592725 - DNA, 25 bp, Homo sapien
ctggcctatagtactttttaatgaa

SEQ ID NO: 592726 - DNA, 25 bp, Homo sapien
tggcctatagtactttttaatgaac

SEQ ID NO: 592727 - DNA, 25 bp, Homo sapien
ggcctatagtactttttaatgaacg

SEQ ID NO: 592728 - DNA, 25 bp, Homo sapien
gcctatagtactttttaatgaacga

SEQ ID NO: 592729 - DNA, 25 bp, Homo sapien
atagtactttttaatgaacgaaatg

SEQ ID NO: 592730 - DNA, 25 bp, Homo sapien
actttttaatgaacgaaatgactat

SEQ ID NO: 592731 - DNA, 25 bp, Homo sapien
ttaatgaacgaaatgactatgttac

SEQ ID NO: 592732 - DNA, 25 bp, Homo sapien
acaagggaagaggtggaggtcaggc

SEQ ID NO: 592733 - DNA, 25 bp, Homo sapien
caagggaagaggtggaggtcaggca

SEQ ID NO: 592734 - DNA, 25 bp, Homo sapien
aagggaagaggtggaggtcaggcac

SEQ ID NO: 592735 - DNA, 25 bp, Homo sapien
agggaagaggtggaggtcaggcacg

SEQ ID NO: 592736 - DNA, 25 bp, Homo sapien
ggaagaggtggaggtcaggcacggt

SEQ ID NO: 592737 - DNA, 25 bp, Homo sapien
gaagaggtggaggtcaggcacggtg

SEQ ID NO: 592738 - DNA, 25 bp, Homo sapien
gaggtggaggtcaggcacggtggct

SEQ ID NO: 592739 - DNA, 25 bp, Homo sapien
ccgaggtgggtagatacctgaagtc

SEQ ID NO: 592740 - DNA, 25 bp, Homo sapien
cgaggtgggtagatacctgaagtca

SEQ ID NO: 592741 - DNA, 25 bp, Homo sapien
ggtgggtagatacctgaagtcagga

SEQ ID NO: 592742 - DNA, 25 bp, Homo sapien
gtgggtagatacctgaagtcaggag

SEQ ID NO: 592743 - DNA, 25 bp, Homo sapien
ttagccaggcgtggtagcacacgcc

SEQ ID NO: 592744 - DNA, 25 bp, Homo sapien
tagccaggcgtggtagcacacgcct

SEQ ID NO: 592745 - DNA, 25 bp, Homo sapien
ttgcttggactcaggaggcggagtt

SEQ ID NO: 592746 - DNA, 25 bp, Homo sapien
tgcttggactcaggaggcggagttt

SEQ ID NO: 592747 - DNA, 25 bp, Homo sapien
gcttggactcaggaggcggagtttg

SEQ ID NO: 592748 - DNA, 25 bp, Homo sapien
cttggactcaggaggcggagtttgc

SEQ ID NO: 592749 - DNA, 25 bp, Homo sapien
ttggactcaggaggcggagtttgca

SEQ ID NO: 592750 - DNA, 25 bp, Homo sapien
tggactcaggaggcggagtttgcag

SEQ ID NO: 592751 - DNA, 25 bp, Homo sapien
ggactcaggaggcggagtttgcagt

SEQ ID NO: 592752 - DNA, 25 bp, Homo sapien
tttgcagtgagctgaggtcacaccg

SEQ ID NO: 592753 - DNA, 25 bp, Homo sapien
caagagtgaaactcctctgaaaaaa

SEQ ID NO: 592754 - DNA, 25 bp, Homo sapien
ggcaggacttatttcccagtctcaa

SEQ ID NO: 592755 - DNA, 25 bp, Homo sapien
gcaggacttatttcccagtctcaat

SEQ ID NO: 592756 - DNA, 25 bp, Homo sapien
caggacttatttcccagtctcaatt

SEQ ID NO: 592757 - DNA, 25 bp, Homo sapien
ggacttatttcccagtctcaattga

SEQ ID NO: 592758 - DNA, 25 bp, Homo sapien
acttatttcccagtctcaattgata

SEQ ID NO: 592759 - DNA, 25 bp, Homo sapien
cttatttcccagtctcaattgataa

SEQ ID NO: 592760 - DNA, 25 bp, Homo sapien
tatttcccagtctcaattgataaag

SEQ ID NO: 592761 - DNA, 25 bp, Homo sapien
tcccagtctcaattgataaagtgaa

SEQ ID NO: 592762 - DNA, 25 bp, Homo sapien
cccagtctcaattgataaagtgaaa

SEQ ID NO: 592763 - DNA, 25 bp, Homo sapien
tgaaaaaactggcagctgggcgcgg

SEQ ID NO: 592764 - DNA, 25 bp, Homo sapien
ccgggagaggtggtacgtgcctata

SEQ ID NO: 592765 - DNA, 25 bp, Homo sapien
gtctcatccactaggtagctctgca

SEQ ID NO: 592766 - DNA, 25 bp, Homo sapien
tctcatccactaggtagctctgcag

SEQ ID NO: 592767 - DNA, 25 bp, Homo sapien
tcatccactaggtagctctgcagca

SEQ ID NO: 592768 - DNA, 25 bp, Homo sapien
catccactaggtagctctgcagcag

SEQ ID NO: 592769 - DNA, 25 bp, Homo sapien
atccactaggtagctctgcagcagt

SEQ ID NO: 592770 - DNA, 25 bp, Homo sapien
tccactaggtagctctgcagcagtg

SEQ ID NO: 592771 - DNA, 25 bp, Homo sapien
gctctgcagcagtgaagtctatagg

SEQ ID NO: 592772 - DNA, 25 bp, Homo sapien
ctctgcagcagtgaagtctatagga

SEQ ID NO: 592773 - DNA, 25 bp, Homo sapien
tctgcagcagtgaagtctataggat

SEQ ID NO: 592774 - DNA, 25 bp, Homo sapien
tgcagcagtgaagtctataggatga

SEQ ID NO: 592775 - DNA, 25 bp, Homo sapien
agcagtgaagtctataggatgactt

SEQ ID NO: 592776 - DNA, 25 bp, Homo sapien
gtccttgatgaaatgattggccact

SEQ ID NO: 592777 - DNA, 25 bp, Homo sapien
actgcctacctttggacttctggtt

SEQ ID NO: 592778 - DNA, 25 bp, Homo sapien
tttggacttctggttatcttaggcc

SEQ ID NO: 592779 - DNA, 25 bp, Homo sapien
taaggcactttgagccgggttttct

SEQ ID NO: 592780 - DNA, 25 bp, Homo sapien
gccgggttttctaagacctagcagt

SEQ ID NO: 592781 - DNA, 25 bp, Homo sapien
aactagatttcctgtcatgtccttc

SEQ ID NO: 592782 - DNA, 25 bp, Homo sapien
catgtccttcctgcctgattggtag

SEQ ID NO: 592783 - DNA, 25 bp, Homo sapien
tgcctgattggtagcccttgactcc

SEQ ID NO: 592784 - DNA, 25 bp, Homo sapien
tcattttccgtaccttactggctgc

SEQ ID NO: 592785 - DNA, 25 bp, Homo sapien
gtaccttactggctgccttttcctc

SEQ ID NO: 592786 - DNA, 25 bp, Homo sapien
tttcctctactcataggtcacttgg

SEQ ID NO: 592787 - DNA, 25 bp, Homo sapien
ctcctgccctttgtggtcttaggta

SEQ ID NO: 592788 - DNA, 25 bp, Homo sapien
ctgccctttgtggtcttaggtatgg

SEQ ID NO: 592789 - DNA, 25 bp, Homo sapien
ctttgtggtcttaggtatggtgcta

SEQ ID NO: 592790 - DNA, 25 bp, Homo sapien
tatggtgctataggttgcatgcgtc

SEQ ID NO: 592791 - DNA, 25 bp, Homo sapien
tgctataggttgcatgcgtctttat

SEQ ID NO: 592792 - DNA, 25 bp, Homo sapien
tataggttgcatgcgtctttatctt

SEQ ID NO: 592793 - DNA, 25 bp, Homo sapien
aggttgcatgcgtctttatcttgtt

SEQ ID NO: 592794 - DNA, 25 bp, Homo sapien
gcatgcgtctttatcttgtttgttt

SEQ ID NO: 592795 - DNA, 25 bp, Homo sapien
gcgtctttatcttgtttgtttggtt

SEQ ID NO: 592796 - DNA, 25 bp, Homo sapien
taattctgagctatggctgcttttg

SEQ ID NO: 592797 - DNA, 25 bp, Homo sapien
aattgtgagggtgtgttactatatt

SEQ ID NO: 592798 - DNA, 25 bp, Homo sapien
agccttcaagccctgactcgctaaa

SEQ ID NO: 592799 - DNA, 25 bp, Homo sapien
ttcaagccctgactcgctaaactag

SEQ ID NO: 592800 - DNA, 25 bp, Homo sapien
caagccctgactcgctaaactagga

SEQ ID NO: 592801 - DNA, 25 bp, Homo sapien
ctgactcgctaaactaggacctcta

SEQ ID NO: 592802 - DNA, 25 bp, Homo sapien
gactcgctaaactaggacctctaaa

SEQ ID NO: 592803 - DNA, 25 bp, Homo sapien
aggacctctaaatctacatctctcg

SEQ ID NO: 592804 - DNA, 25 bp, Homo sapien
tctaaatctacatctctcggccggg

SEQ ID NO: 592805 - DNA, 25 bp, Homo sapien
aatctacatctctcggccgggcgtg

SEQ ID NO: 592806 - DNA, 25 bp, Homo sapien
catctccacaaaaacgcaaaacaat

SEQ ID NO: 592807 - DNA, 25 bp, Homo sapien
ggagacggacgctacagtgagccca

SEQ ID NO: 592808 - DNA, 25 bp, Homo sapien
agacggacgctacagtgagcccaga

SEQ ID NO: 592809 - DNA, 25 bp, Homo sapien
aagcactgtacttccccttcagtaa

SEQ ID NO: 592810 - DNA, 25 bp, Homo sapien
actgtacttccccttcagtaatgtg

SEQ ID NO: 592811 - DNA, 25 bp, Homo sapien
gtacttccccttcagtaatgtgtgt

SEQ ID NO: 592812 - DNA, 25 bp, Homo sapien
acttccccttcagtaatgtgtgtgt

SEQ ID NO: 592813 - DNA, 25 bp, Homo sapien
ttccccttcagtaatgtgtgtgtgt

SEQ ID NO: 592814 - DNA, 25 bp, Homo sapien
ttgtttttagtttacagcaataatg

SEQ ID NO: 592815 - DNA, 25 bp, Homo sapien
gtttacagcaataatgaaagtcttt

SEQ ID NO: 592816 - DNA, 25 bp, Homo sapien
gaaagtctttcatggcttgacagaa

SEQ ID NO: 592817 - DNA, 25 bp, Homo sapien
agtctttcatggcttgacagaaaat

SEQ ID NO: 592818 - DNA, 25 bp, Homo sapien
agaaaatgtgtgatttgactgcttt

SEQ ID NO: 592819 - DNA, 25 bp, Homo sapien
gggaaacagcaatatctgtattttt

SEQ ID NO: 592820 - DNA, 25 bp, Homo sapien
ggcgctgccagaagagcccgagctc

SEQ ID NO: 592821 - DNA, 25 bp, Homo sapien
ggagaaccccagtccggcctgacct

SEQ ID NO: 592822 - DNA, 25 bp, Homo sapien
ggtcaggcgctccaaccagagcgac

SEQ ID NO: 592823 - DNA, 25 bp, Homo sapien
cagagcgactccagctcgaacagcg

SEQ ID NO: 592824 - DNA, 25 bp, Homo sapien
ctccagctcgaacagcgctgggtaa

SEQ ID NO: 592825 - DNA, 25 bp, Homo sapien
gctcgaacagcgctgggtaaactga

SEQ ID NO: 592826 - DNA, 25 bp, Homo sapien
ggtaaactgaggctgaaccccgctg

SEQ ID NO: 592827 - DNA, 25 bp, Homo sapien
aactgaggctgaaccccgctggctg

SEQ ID NO: 592828 - DNA, 25 bp, Homo sapien
caggagtcgggcgtttacggtcacg

SEQ ID NO: 592829 - DNA, 25 bp, Homo sapien
aggttaataaacttttacgcagcag

SEQ ID NO: 592830 - DNA, 25 bp, Homo sapien
taaacttttacgcagcagacccgga

SEQ ID NO: 592831 - DNA, 25 bp, Homo sapien
atggcagcctgcagcaactggaaca

SEQ ID NO: 592832 - DNA, 25 bp, Homo sapien
tggcagcctgcagcaactggaacaa

SEQ ID NO: 592833 - DNA, 25 bp, Homo sapien
ggcagcctgcagcaactggaacaag

SEQ ID NO: 592834 - DNA, 25 bp, Homo sapien
gaacaaggccccaccgtaaagctct

SEQ ID NO: 592835 - DNA, 25 bp, Homo sapien
aacaaggccccaccgtaaagctctg

SEQ ID NO: 592836 - DNA, 25 bp, Homo sapien
aaggccccaccgtaaagctctgtgt

SEQ ID NO: 592837 - DNA, 25 bp, Homo sapien
aggccccaccgtaaagctctgtgtg

SEQ ID NO: 592838 - DNA, 25 bp, Homo sapien
ggccccaccgtaaagctctgtgtgt

SEQ ID NO: 592839 - DNA, 25 bp, Homo sapien
gccccaccgtaaagctctgtgtgtc

SEQ ID NO: 592840 - DNA, 25 bp, Homo sapien
gtgtgtcccagggtcttcctgtcac

SEQ ID NO: 592841 - DNA, 25 bp, Homo sapien
tgtgtcccagggtcttcctgtcacc

SEQ ID NO: 592842 - DNA, 25 bp, Homo sapien
tttgttctgaatgtgcctcatcatc

SEQ ID NO: 592843 - DNA, 25 bp, Homo sapien
ttgttctgaatgtgcctcatcatcc

SEQ ID NO: 592844 - DNA, 25 bp, Homo sapien
tgttctgaatgtgcctcatcatccc

SEQ ID NO: 592845 - DNA, 25 bp, Homo sapien
gttctgaatgtgcctcatcatccca

SEQ ID NO: 592846 - DNA, 25 bp, Homo sapien
tgtgcctcatcatcccaggcaggca

SEQ ID NO: 592847 - DNA, 25 bp, Homo sapien
catcatcccaggcaggcatctgtaa

SEQ ID NO: 592848 - DNA, 25 bp, Homo sapien
gcaggcatctgtaagtttccattgt

SEQ ID NO: 592849 - DNA, 25 bp, Homo sapien
tttccattgtttccacaaaaaccag

SEQ ID NO: 592850 - DNA, 25 bp, Homo sapien
ttccattgtttccacaaaaaccagt

SEQ ID NO: 592851 - DNA, 25 bp, Homo sapien
tccattgtttccacaaaaaccagtg

SEQ ID NO: 592852 - DNA, 25 bp, Homo sapien
ccattgtttccacaaaaaccagtgg

SEQ ID NO: 592853 - DNA, 25 bp, Homo sapien
tcaccagcctagaaaattacagtcg

SEQ ID NO: 592854 - DNA, 25 bp, Homo sapien
tacagtcgacttcatgagcttcatt

SEQ ID NO: 592855 - DNA, 25 bp, Homo sapien
gagcttcatttggatttctcatcat

SEQ ID NO: 592856 - DNA, 25 bp, Homo sapien
ggatttctcatcatgcaatagcaaa

SEQ ID NO: 592857 - DNA, 25 bp, Homo sapien
tagcaaagtcacagttattcctact

SEQ ID NO: 592858 - DNA, 25 bp, Homo sapien
gttattcctactgagatcacaatga

SEQ ID NO: 592859 - DNA, 25 bp, Homo sapien
tgagatcacaatgatgctgccagag

SEQ ID NO: 592860 - DNA, 25 bp, Homo sapien
cttgagagccctcctcttctaagca

SEQ ID NO: 592861 - DNA, 25 bp, Homo sapien
ctaagcagcatttggagcatcctcc

SEQ ID NO: 592862 - DNA, 25 bp, Homo sapien
gagcatcctccattgtatagtggga

SEQ ID NO: 592863 - DNA, 25 bp, Homo sapien
aagtcacgacttttccagaatccaa

SEQ ID NO: 592864 - DNA, 25 bp, Homo sapien
aatgaatatgggacttcagtaacat

SEQ ID NO: 592865 - DNA, 25 bp, Homo sapien
atgggacttcagtaacatatttctt

SEQ ID NO: 592866 - DNA, 25 bp, Homo sapien
acatatttcttatccatgcccgggg

SEQ ID NO: 592867 - DNA, 25 bp, Homo sapien
tgttcctgactagcttaacccatta

SEQ ID NO: 592868 - DNA, 25 bp, Homo sapien
gttcctgactagcttaacccattat

SEQ ID NO: 592869 - DNA, 25 bp, Homo sapien
cctgactagcttaacccattatctt

SEQ ID NO: 592870 - DNA, 25 bp, Homo sapien
tgactagcttaacccattatcttcc

SEQ ID NO: 592871 - DNA, 25 bp, Homo sapien
actagcttaacccattatcttcctg

SEQ ID NO: 592872 - DNA, 25 bp, Homo sapien
tagcttaacccattatcttcctgtt

SEQ ID NO: 592873 - DNA, 25 bp, Homo sapien
agcttaacccattatcttcctgttt

SEQ ID NO: 592874 - DNA, 25 bp, Homo sapien
ctgtttctggaatttatgatacaaa

SEQ ID NO: 592875 - DNA, 25 bp, Homo sapien
ccctcaccagctgtagtaagttgat

SEQ ID NO: 592876 - DNA, 25 bp, Homo sapien
accagctgtagtaagttgataatcc

SEQ ID NO: 592877 - DNA, 25 bp, Homo sapien
gttgataatcctaaaaagccttggc

SEQ ID NO: 592878 - DNA, 25 bp, Homo sapien
aaagccttggctattcatcagacat

SEQ ID NO: 592879 - DNA, 25 bp, Homo sapien
gccttggctattcatcagacatttg

SEQ ID NO: 592880 - DNA, 25 bp, Homo sapien
ggctattcatcagacatttgttaag

SEQ ID NO: 592881 - DNA, 25 bp, Homo sapien
cagacatttgttaagcacagtggac

SEQ ID NO: 592882 - DNA, 25 bp, Homo sapien
agcacagtggacagacatttcttaa

SEQ ID NO: 592883 - DNA, 25 bp, Homo sapien
gtggacagacatttcttaagcattg

SEQ ID NO: 592884 - DNA, 25 bp, Homo sapien
gcattgtgctagatattaaggatac

SEQ ID NO: 592885 - DNA, 25 bp, Homo sapien
atataaagagtccagtctctacaaa

SEQ ID NO: 592886 - DNA, 25 bp, Homo sapien
atatatatatattatccagccccaa

SEQ ID NO: 592887 - DNA, 25 bp, Homo sapien
ttaaacaatcccacagtcggtgctg

SEQ ID NO: 592888 - DNA, 25 bp, Homo sapien
atcccacagtcggtgctgcggtgag

SEQ ID NO: 592889 - DNA, 25 bp, Homo sapien
cacagtcggtgctgcggtgagccgt

SEQ ID NO: 592890 - DNA, 25 bp, Homo sapien
atatttggcgaatcagtgagtgaca

SEQ ID NO: 592891 - DNA, 25 bp, Homo sapien
tggcgaatcagtgagtgacagcagt

SEQ ID NO: 592892 - DNA, 25 bp, Homo sapien
gagtgacagcagttgtagtgctagt

SEQ ID NO: 592893 - DNA, 25 bp, Homo sapien
acagcagttgtagtgctagtgggtt

SEQ ID NO: 592894 - DNA, 25 bp, Homo sapien
gttgtagtgctagtgggttaaatca

SEQ ID NO: 592895 - DNA, 25 bp, Homo sapien
tgtagtgctagtgggttaaatcaag

SEQ ID NO: 592896 - DNA, 25 bp, Homo sapien
aatcaaggaataactgttgggaagt

SEQ ID NO: 592897 - DNA, 25 bp, Homo sapien
tatttcacctaaaatgttagcatta

SEQ ID NO: 592898 - DNA, 25 bp, Homo sapien
atttcacctaaaatgttagcattat

SEQ ID NO: 592899 - DNA, 25 bp, Homo sapien
tttcacctaaaatgttagcattatc

SEQ ID NO: 592900 - DNA, 25 bp, Homo sapien
ttcacctaaaatgttagcattatcc

SEQ ID NO: 592901 - DNA, 25 bp, Homo sapien
tcacctaaaatgttagcattatcca

SEQ ID NO: 592902 - DNA, 25 bp, Homo sapien
cacctaaaatgttagcattatccaa

SEQ ID NO: 592903 - DNA, 25 bp, Homo sapien
acctaaaatgttagcattatccaaa

SEQ ID NO: 592904 - DNA, 25 bp, Homo sapien
cctaaaatgttagcattatccaaaa

SEQ ID NO: 592905 - DNA, 25 bp, Homo sapien
ctaaaatgttagcattatccaaaat

SEQ ID NO: 592906 - DNA, 25 bp, Homo sapien
tagaactggaccttcaggcatctct

SEQ ID NO: 592907 - DNA, 25 bp, Homo sapien
ttcaggcatctctgacccggcagag

SEQ ID NO: 592908 - DNA, 25 bp, Homo sapien
ggcagagccgcctcaatgatgagct

SEQ ID NO: 592909 - DNA, 25 bp, Homo sapien
ctcaatgatgagctgcaggcgctga

SEQ ID NO: 592910 - DNA, 25 bp, Homo sapien
aggcgctgagggacttgcggcagaa

SEQ ID NO: 592911 - DNA, 25 bp, Homo sapien
agctcagggagagactgaccttcca

SEQ ID NO: 592912 - DNA, 25 bp, Homo sapien
tgaccttccaccaggcgtgctggag

SEQ ID NO: 592913 - DNA, 25 bp, Homo sapien
gaggcttctgaagcaagctgagaag

SEQ ID NO: 592914 - DNA, 25 bp, Homo sapien
agctgagaagcaggctgaacagtcc

SEQ ID NO: 592915 - DNA, 25 bp, Homo sapien
tgatgaggcaagtctccaaggacgt

SEQ ID NO: 592916 - DNA, 25 bp, Homo sapien
aagtctccaaggacgtgtgtcggct

SEQ ID NO: 592917 - DNA, 25 bp, Homo sapien
aaatagggtgacttggtttgatctt

SEQ ID NO: 592918 - DNA, 25 bp, Homo sapien
ggtttgatcttggtttctataccta

SEQ ID NO: 592919 - DNA, 25 bp, Homo sapien
gtttctatacctattatggctgcct

SEQ ID NO: 592920 - DNA, 25 bp, Homo sapien
ctatacctattatggctgcctgact

SEQ ID NO: 592921 - DNA, 25 bp, Homo sapien
tacctattatggctgcctgactctg

SEQ ID NO: 592922 - DNA, 25 bp, Homo sapien
gctgcctgactctggtcatttggcc

SEQ ID NO: 592923 - DNA, 25 bp, Homo sapien
gcaggcctaagccacttggttttgc

SEQ ID NO: 592924 - DNA, 25 bp, Homo sapien
acttggttttgcttcacatattggg

SEQ ID NO: 592925 - DNA, 25 bp, Homo sapien
tattagaacagtacgtagggaagca

SEQ ID NO: 592926 - DNA, 25 bp, Homo sapien
ctgccttctaggtgctcctgggaaa

SEQ ID NO: 592927 - DNA, 25 bp, Homo sapien
ccttctaggtgctcctgggaaatcc

SEQ ID NO: 592928 - DNA, 25 bp, Homo sapien
tgctttcaaaccaccgccaatctgc

SEQ ID NO: 592929 - DNA, 25 bp, Homo sapien
caatctgctttctgttatatataca

SEQ ID NO: 592930 - DNA, 25 bp, Homo sapien
tacagattagtttggattttctaac

SEQ ID NO: 592931 - DNA, 25 bp, Homo sapien
gtttggattttctaacagttgtata

SEQ ID NO: 592932 - DNA, 25 bp, Homo sapien
ggattttctaacagttgtatataaa

SEQ ID NO: 592933 - DNA, 25 bp, Homo sapien
ataaatgcagtgacacatttgagtg

SEQ ID NO: 592934 - DNA, 25 bp, Homo sapien
gacacatttgagtgtactcttttgt

SEQ ID NO: 592935 - DNA, 25 bp, Homo sapien
ttgagtgtactcttttgtgatctgg

SEQ ID NO: 592936 - DNA, 25 bp, Homo sapien
tgagtgtactcttttgtgatctggt

SEQ ID NO: 592937 - DNA, 25 bp, Homo sapien
tgatctggtttattttactcagcat

SEQ ID NO: 592938 - DNA, 25 bp, Homo sapien
ctggtttattttactcagcataatt

SEQ ID NO: 592939 - DNA, 25 bp, Homo sapien
gtgcctgaccaggtaagaaactgaa

SEQ ID NO: 592940 - DNA, 25 bp, Homo sapien
cctgaccaggtaagaaactgaaagc

SEQ ID NO: 592941 - DNA, 25 bp, Homo sapien
gataaatgcccggagattccaagtg

SEQ ID NO: 592942 - DNA, 25 bp, Homo sapien
ataaatgcccggagattccaagtgg

SEQ ID NO: 592943 - DNA, 25 bp, Homo sapien
aaatgcccggagattccaagtggca

SEQ ID NO: 592944 - DNA, 25 bp, Homo sapien
atgcccggagattccaagtggcaga

SEQ ID NO: 592945 - DNA, 25 bp, Homo sapien
gcccggagattccaagtggcagaca

SEQ ID NO: 592946 - DNA, 25 bp, Homo sapien
cccggagattccaagtggcagacat

SEQ ID NO: 592947 - DNA, 25 bp, Homo sapien
cggagattccaagtggcagacattt

SEQ ID NO: 592948 - DNA, 25 bp, Homo sapien
gagattccaagtggcagacatttcc

SEQ ID NO: 592949 - DNA, 25 bp, Homo sapien
atgtgcctgaccaggtaagaaactg

SEQ ID NO: 592950 - DNA, 25 bp, Homo sapien
aaaccaagcatttccgcttggtcca

SEQ ID NO: 592951 - DNA, 25 bp, Homo sapien
gcatttccgcttggtccataattct

SEQ ID NO: 592952 - DNA, 25 bp, Homo sapien
atttccgcttggtccataattctat

SEQ ID NO: 592953 - DNA, 25 bp, Homo sapien
ttccgcttggtccataattctattt

SEQ ID NO: 592954 - DNA, 25 bp, Homo sapien
ccgcttggtccataattctatttga

SEQ ID NO: 592955 - DNA, 25 bp, Homo sapien
cgcttggtccataattctatttgat

SEQ ID NO: 592956 - DNA, 25 bp, Homo sapien
cttggtccataattctatttgatat

SEQ ID NO: 592957 - DNA, 25 bp, Homo sapien
aattatattgctatcattcagcatg

SEQ ID NO: 592958 - DNA, 25 bp, Homo sapien
tattgctatcattcagcatgtgaaa

SEQ ID NO: 592959 - DNA, 25 bp, Homo sapien
gctatcattcagcatgtgaaaattt

SEQ ID NO: 592960 - DNA, 25 bp, Homo sapien
gaggattataatagccctgctttat

SEQ ID NO: 592961 - DNA, 25 bp, Homo sapien
aaacaacaaagctagaggtatcaca

SEQ ID NO: 592962 - DNA, 25 bp, Homo sapien
gaggtatcacattgcttgacttcac

SEQ ID NO: 592963 - DNA, 25 bp, Homo sapien
ggtatcacattgcttgacttcacaa

SEQ ID NO: 592964 - DNA, 25 bp, Homo sapien
gcttgacttcacaatatatcataaa

SEQ ID NO: 592965 - DNA, 25 bp, Homo sapien
gacttcacaatatatcataaagcta

SEQ ID NO: 592966 - DNA, 25 bp, Homo sapien
gaatagagatcttggaaataaatcc

SEQ ID NO: 592967 - DNA, 25 bp, Homo sapien
aaatccacacatttatggtcaattg

SEQ ID NO: 592968 - DNA, 25 bp, Homo sapien
tccacacatttatggtcaattgatt

SEQ ID NO: 592969 - DNA, 25 bp, Homo sapien
gattttccacagagggtaagaatac

SEQ ID NO: 592970 - DNA, 25 bp, Homo sapien
ttccacagagggtaagaatacacaa

SEQ ID NO: 592971 - DNA, 25 bp, Homo sapien
gggtaagaatacacaatgaggaaaa

SEQ ID NO: 592972 - DNA, 25 bp, Homo sapien
gttagaaaataagtctgggccggcg

SEQ ID NO: 592973 - DNA, 25 bp, Homo sapien
ttagaaaataagtctgggccggcgg

SEQ ID NO: 592974 - DNA, 25 bp, Homo sapien
gaaaataagtctgggccggcggcgg

SEQ ID NO: 592975 - DNA, 25 bp, Homo sapien
cctgcataggcagtgctttggccag

SEQ ID NO: 592976 - DNA, 25 bp, Homo sapien
tgcataggcagtgctttggccagga

SEQ ID NO: 592977 - DNA, 25 bp, Homo sapien
agtgctttggccaggaggatccctt

SEQ ID NO: 592978 - DNA, 25 bp, Homo sapien
gtgctttggccaggaggatcccttg

SEQ ID NO: 592979 - DNA, 25 bp, Homo sapien
ggatcccttgatcccttgtggccag

SEQ ID NO: 592980 - DNA, 25 bp, Homo sapien
atcccttgatcccttgtggccagga

SEQ ID NO: 592981 - DNA, 25 bp, Homo sapien
tcccttgatcccttgtggccaggag

SEQ ID NO: 592982 - DNA, 25 bp, Homo sapien
cccttgatcccttgtggccaggagt

SEQ ID NO: 592983 - DNA, 25 bp, Homo sapien
actcttgtttacttcctgaatatta

SEQ ID NO: 592984 - DNA, 25 bp, Homo sapien
ctcttgtttacttcctgaatattaa

SEQ ID NO: 592985 - DNA, 25 bp, Homo sapien
tcttgtttacttcctgaatattaag

SEQ ID NO: 592986 - DNA, 25 bp, Homo sapien
cttgtttacttcctgaatattaagt

SEQ ID NO: 592987 - DNA, 25 bp, Homo sapien
tgtttacttcctgaatattaagtgt

SEQ ID NO: 592988 - DNA, 25 bp, Homo sapien
ttcctgaatattaagtgttgttttt

SEQ ID NO: 592989 - DNA, 25 bp, Homo sapien
tcctgaatattaagtgttgtttttt

SEQ ID NO: 592990 - DNA, 25 bp, Homo sapien
ctgaatattaagtgttgtttttttg

SEQ ID NO: 592991 - DNA, 25 bp, Homo sapien
tctcgggtcagtgcaacctcagcct

SEQ ID NO: 592992 - DNA, 25 bp, Homo sapien
gactacatgcgtgcccagctaagtt

SEQ ID NO: 592993 - DNA, 25 bp, Homo sapien
actacatgcgtgcccagctaagttt

SEQ ID NO: 592994 - DNA, 25 bp, Homo sapien
gtttatggcaaacagaagcccctgt

SEQ ID NO: 592995 - DNA, 25 bp, Homo sapien
tccaatggagataacccttgctgcc

SEQ ID NO: 592996 - DNA, 25 bp, Homo sapien
gtttttcttgatagactcatggtag

SEQ ID NO: 592997 - DNA, 25 bp, Homo sapien
gatagactcatggtagcttttacat

SEQ ID NO: 592998 - DNA, 25 bp, Homo sapien
gcttttacatcatttccatttgcga

SEQ ID NO: 592999 - DNA, 25 bp, Homo sapien
tttccatttgcgaatgaaactcagt

SEQ ID NO: 593000 - DNA, 25 bp, Homo sapien
gaatgaaactcagttgacccttgaa

SEQ ID NO: 593001 - DNA, 25 bp, Homo sapien
tgaacaacatgagcttgaactgcat

SEQ ID NO: 593002 - DNA, 25 bp, Homo sapien
gagcttgaactgcatgggtccactt

SEQ ID NO: 593003 - DNA, 25 bp, Homo sapien
atatatttcggagattttcaacaac

SEQ ID NO: 593004 - DNA, 25 bp, Homo sapien
gaaaacactcatagatatacaccat

SEQ ID NO: 593005 - DNA, 25 bp, Homo sapien
accaaggctttctgacgaagaagaa

SEQ ID NO: 593006 - DNA, 25 bp, Homo sapien
aaccttggactctgggatgaccgcc

SEQ ID NO: 593007 - DNA, 25 bp, Homo sapien
ggatgaccgccacaaataccaacag

SEQ ID NO: 593008 - DNA, 25 bp, Homo sapien
aataccaacaggtttgaggcagcct

SEQ ID NO: 593009 - DNA, 25 bp, Homo sapien
ttgaggcagcctgggatgtgatcca

SEQ ID NO: 593010 - DNA, 25 bp, Homo sapien
ccctgcatggctaactggaaactca

SEQ ID NO: 593011 - DNA, 25 bp, Homo sapien
ggaaactcaggatatttgctggaaa

SEQ ID NO: 593012 - DNA, 25 bp, Homo sapien
agactctgttgatccttttcattcc

SEQ ID NO: 593013 - DNA, 25 bp, Homo sapien
attcctgctgactgtgcaacttgta

SEQ ID NO: 593014 - DNA, 25 bp, Homo sapien
gtgcaacttgtaatctgcagtttga

SEQ ID NO: 593015 - DNA, 25 bp, Homo sapien
tctgcagtttgaatgataacagcat

SEQ ID NO: 593016 - DNA, 25 bp, Homo sapien
aatgtaactgactataaacacttta

SEQ ID NO: 593017 - DNA, 25 bp, Homo sapien
ataaacactttaacctaatcatctg

SEQ ID NO: 593018 - DNA, 25 bp, Homo sapien
aacactttaacctaatcatctgtat

SEQ ID NO: 593019 - DNA, 25 bp, Homo sapien
actttaacctaatcatctgtatcaa

SEQ ID NO: 593020 - DNA, 25 bp, Homo sapien
aacctaatcatctgtatcaaacttt

SEQ ID NO: 593021 - DNA, 25 bp, Homo sapien
gttccactttagagattctatgtaa

SEQ ID NO: 593022 - DNA, 25 bp, Homo sapien
tatacttgtcaaatagcacctatct

SEQ ID NO: 593023 - DNA, 25 bp, Homo sapien
acttgtcaaatagcacctatctatg

SEQ ID NO: 593024 - DNA, 25 bp, Homo sapien
gtcaaatagcacctatctatgcatt

SEQ ID NO: 593025 - DNA, 25 bp, Homo sapien
aaatagcacctatctatgcatttaa

SEQ ID NO: 593026 - DNA, 25 bp, Homo sapien
atagcacctatctatgcatttaaaa

SEQ ID NO: 593027 - DNA, 25 bp, Homo sapien
gtgccaactactggtccgtgcgctg

SEQ ID NO: 593028 - DNA, 25 bp, Homo sapien
gccaactactggtccgtgcgctggg

SEQ ID NO: 593029 - DNA, 25 bp, Homo sapien
ggatacagtagtgaaaagttttttg

SEQ ID NO: 593030 - DNA, 25 bp, Homo sapien
agttttttggagctttacattccat

SEQ ID NO: 593031 - DNA, 25 bp, Homo sapien
ttttggagctttacattccataaaa

SEQ ID NO: 593032 - DNA, 25 bp, Homo sapien
tacattccataaaacttttagccca

SEQ ID NO: 593033 - DNA, 25 bp, Homo sapien
aggtgcttaattttgaagatacgtt

SEQ ID NO: 593034 - DNA, 25 bp, Homo sapien
gatacgttgaagaatcttgtctctt

SEQ ID NO: 593035 - DNA, 25 bp, Homo sapien
ttgaagaatcttgtctctttcagtt

SEQ ID NO: 593036 - DNA, 25 bp, Homo sapien
gtttcctgtggcgtgttgcaaaaat

SEQ ID NO: 593037 - DNA, 25 bp, Homo sapien
tttcctgtggcgtgttgcaaaaatg

SEQ ID NO: 593038 - DNA, 25 bp, Homo sapien
gctcctgggaaatcctggttttcca

SEQ ID NO: 593039 - DNA, 25 bp, Homo sapien
ctggttttccatggttaggcaaatg

SEQ ID NO: 593040 - DNA, 25 bp, Homo sapien
tggttttccatggttaggcaaatgt

SEQ ID NO: 593041 - DNA, 25 bp, Homo sapien
ggttttccatggttaggcaaatgtc

SEQ ID NO: 593042 - DNA, 25 bp, Homo sapien
gttttccatggttaggcaaatgtca

SEQ ID NO: 593043 - DNA, 25 bp, Homo sapien
ttttccatggttaggcaaatgtcag

SEQ ID NO: 593044 - DNA, 25 bp, Homo sapien
tttccatggttaggcaaatgtcaga

SEQ ID NO: 593045 - DNA, 25 bp, Homo sapien
ttccatggttaggcaaatgtcagag

SEQ ID NO: 593046 - DNA, 25 bp, Homo sapien
tccatggttaggcaaatgtcagaga

SEQ ID NO: 593047 - DNA, 25 bp, Homo sapien
ccatggttaggcaaatgtcagagaa

SEQ ID NO: 593048 - DNA, 25 bp, Homo sapien
attgtctcaatgttttctaagttga

SEQ ID NO: 593049 - DNA, 25 bp, Homo sapien
ttggtagctattcttaagtgaatgc

SEQ ID NO: 593050 - DNA, 25 bp, Homo sapien
gctattcttaagtgaatgctggatt

SEQ ID NO: 593051 - DNA, 25 bp, Homo sapien
tgaatgctggatttttattaaggga

SEQ ID NO: 593052 - DNA, 25 bp, Homo sapien
tattaagggaagctaacagatattt

SEQ ID NO: 593053 - DNA, 25 bp, Homo sapien
acagatatttaaaagcaccctccat

SEQ ID NO: 593054 - DNA, 25 bp, Homo sapien
gatatttaaaagcaccctccatata

SEQ ID NO: 593055 - DNA, 25 bp, Homo sapien
taaaagcaccctccatatataaaag

SEQ ID NO: 593056 - DNA, 25 bp, Homo sapien
agcaccctccatatataaaagcaca

SEQ ID NO: 593057 - DNA, 25 bp, Homo sapien
ctccatatataaaagcacaatccat

SEQ ID NO: 593058 - DNA, 25 bp, Homo sapien
caatccatggaagcatagtgcaagg

SEQ ID NO: 593059 - DNA, 25 bp, Homo sapien
gttgattggctcactaatgtatgca

SEQ ID NO: 593060 - DNA, 25 bp, Homo sapien
tgattggctcactaatgtatgcaag

SEQ ID NO: 593061 - DNA, 25 bp, Homo sapien
attggctcactaatgtatgcaagca

SEQ ID NO: 593062 - DNA, 25 bp, Homo sapien
ggctcactaatgtatgcaagcattt

SEQ ID NO: 593063 - DNA, 25 bp, Homo sapien
gtatgcaagcatttttgggaatgta

SEQ ID NO: 593064 - DNA, 25 bp, Homo sapien
agcatttttgggaatgtatctgcaa

SEQ ID NO: 593065 - DNA, 25 bp, Homo sapien
atgtatctgcaattatccaaagact

SEQ ID NO: 593066 - DNA, 25 bp, Homo sapien
gtatctgcaattatccaaagactat

SEQ ID NO: 593067 - DNA, 25 bp, Homo sapien
gcaattatccaaagactatactcgg

SEQ ID NO: 593068 - DNA, 25 bp, Homo sapien
caaagactatactcgggaactgcca

SEQ ID NO: 593069 - DNA, 25 bp, Homo sapien
gactatactcgggaactgccaggta

SEQ ID NO: 593070 - DNA, 25 bp, Homo sapien
atccccaacctctatctgacaggta

SEQ ID NO: 593071 - DNA, 25 bp, Homo sapien
tatctgacaggtatactcactgccc

SEQ ID NO: 593072 - DNA, 25 bp, Homo sapien
gacaggtatactcactgccccatgt

SEQ ID NO: 593073 - DNA, 25 bp, Homo sapien
tgccccatgttgtcaggacctgaga

SEQ ID NO: 593074 - DNA, 25 bp, Homo sapien
atgttgtcaggacctgagaccctgg

SEQ ID NO: 593075 - DNA, 25 bp, Homo sapien
ttgtcaggacctgagaccctgggcc

SEQ ID NO: 593076 - DNA, 25 bp, Homo sapien
tgtggcccctgtctgattggagcca

SEQ ID NO: 593077 - DNA, 25 bp, Homo sapien
attggagccagctctgggtggccct

SEQ ID NO: 593078 - DNA, 25 bp, Homo sapien
ccagctctgggtggccctcatgtgg

SEQ ID NO: 593079 - DNA, 25 bp, Homo sapien
ggagggaagagcaccaaggccccac

SEQ ID NO: 593080 - DNA, 25 bp, Homo sapien
gggcctgcctgggtgcacgctcagg

SEQ ID NO: 593081 - DNA, 25 bp, Homo sapien
atgctacagataaatctttcggaaa

SEQ ID NO: 593082 - DNA, 25 bp, Homo sapien
gttgatgttgcagccttccttgttg

SEQ ID NO: 593083 - DNA, 25 bp, Homo sapien
ccttccttgttgtctcatttaaaga

SEQ ID NO: 593084 - DNA, 25 bp, Homo sapien
gaaatctctagagccacactaacct

SEQ ID NO: 593085 - DNA, 25 bp, Homo sapien
tagagccacactaaccttcagcaac

SEQ ID NO: 593086 - DNA, 25 bp, Homo sapien
acaccgatcattcagcagccatcaa

SEQ ID NO: 593087 - DNA, 25 bp, Homo sapien
gtgaggcaagactgtcttccagcaa

SEQ ID NO: 593088 - DNA, 25 bp, Homo sapien
tcttccagcaacaaagactcactga

SEQ ID NO: 593089 - DNA, 25 bp, Homo sapien
gacttagattatcgttagcatcttt

SEQ ID NO: 593090 - DNA, 25 bp, Homo sapien
attgtcagatataatgccattgcaa

SEQ ID NO: 593091 - DNA, 25 bp, Homo sapien
gccattgcaaacttaatagactata

SEQ ID NO: 593092 - DNA, 25 bp, Homo sapien
cttttattcgccaggcacataaaaa

SEQ ID NO: 593093 - DNA, 25 bp, Homo sapien
cgccaggcacataaaaagaatcttt

SEQ ID NO: 593094 - DNA, 25 bp, Homo sapien
agaatcttttgagtgttgataatgg

SEQ ID NO: 593095 - DNA, 25 bp, Homo sapien
gtgtgtttgttgtatggtgaggttg

SEQ ID NO: 593096 - DNA, 25 bp, Homo sapien
gaactctgtactttttgatcaattg

SEQ ID NO: 593097 - DNA, 25 bp, Homo sapien
gtactttttgatcaattgtgctgta

SEQ ID NO: 593098 - DNA, 25 bp, Homo sapien
tcaattgtgctgtaaaactaaaact

SEQ ID NO: 593099 - DNA, 25 bp, Homo sapien
ctttatctaacaaggaggctcccca

SEQ ID NO: 593100 - DNA, 25 bp, Homo sapien
tatctaacaaggaggctccccatct

SEQ ID NO: 593101 - DNA, 25 bp, Homo sapien
tctcagcctggcaaattgggtaaag

SEQ ID NO: 593102 - DNA, 25 bp, Homo sapien
agtcaagacccactggtgtgctgta

SEQ ID NO: 593103 - DNA, 25 bp, Homo sapien
gtactcagctaccagtgtgcagccc

SEQ ID NO: 593104 - DNA, 25 bp, Homo sapien
tgcagccctcgggagcacctgtaga

SEQ ID NO: 593105 - DNA, 25 bp, Homo sapien
tgtagagagcaggtctacctccctc

SEQ ID NO: 593106 - DNA, 25 bp, Homo sapien
cagccagtgcgggagccagctgttc

SEQ ID NO: 593107 - DNA, 25 bp, Homo sapien
gagccagctgttcccgatgcctctg

SEQ ID NO: 593108 - DNA, 25 bp, Homo sapien
agagagctgctcctacgagtcccca

SEQ ID NO: 593109 - DNA, 25 bp, Homo sapien
caaggtgcttggctcttcacagggc

SEQ ID NO: 593110 - DNA, 25 bp, Homo sapien
acagggccaggcagctccagattga

SEQ ID NO: 593111 - DNA, 25 bp, Homo sapien
agctccagattgaagggccacagat

SEQ ID NO: 593112 - DNA, 25 bp, Homo sapien
gaagggccacagatacaacttactc

SEQ ID NO: 593113 - DNA, 25 bp, Homo sapien
agatacaacttactcctctgctggg

SEQ ID NO: 593114 - DNA, 25 bp, Homo sapien
gtttcaggtttctatttaacatgta

SEQ ID NO: 593115 - DNA, 25 bp, Homo sapien
taccaaatgtaccagaaagggttat

SEQ ID NO: 593116 - DNA, 25 bp, Homo sapien
caaatgtaccagaaagggttatgtt

SEQ ID NO: 593117 - DNA, 25 bp, Homo sapien
caatagttatctaaaagttggttca

SEQ ID NO: 593118 - DNA, 25 bp, Homo sapien
aaggttattcataaaacaatgtagt

SEQ ID NO: 593119 - DNA, 25 bp, Homo sapien
acaatgtagtaaggaatcattaggc

SEQ ID NO: 593120 - DNA, 25 bp, Homo sapien
gaatcattaggcaaaaaatgtggga

SEQ ID NO: 593121 - DNA, 25 bp, Homo sapien
aaaccctgataaagaattggagacg

SEQ ID NO: 593122 - DNA, 25 bp, Homo sapien
aaagaattggagacgtttggctaat

SEQ ID NO: 593123 - DNA, 25 bp, Homo sapien
ttggagacgtttggctaattaaaca

SEQ ID NO: 593124 - DNA, 25 bp, Homo sapien
gagacgtttggctaattaaacattt

SEQ ID NO: 593125 - DNA, 25 bp, Homo sapien
gtaaaaagtcttatcctgctccata

SEQ ID NO: 593126 - DNA, 25 bp, Homo sapien
tatcctgctccatactggattttga

SEQ ID NO: 593127 - DNA, 25 bp, Homo sapien
atcctgctccatactggattttgaa

SEQ ID NO: 593128 - DNA, 25 bp, Homo sapien
gctccatactggattttgaaatatt

SEQ ID NO: 593129 - DNA, 25 bp, Homo sapien
aaattatctgatctctaataaccaa

SEQ ID NO: 593130 - DNA, 25 bp, Homo sapien
gatctctaataaccaaatctgtgtt

SEQ ID NO: 593131 - DNA, 25 bp, Homo sapien
tctaataaccaaatctgtgttctca

SEQ ID NO: 593132 - DNA, 25 bp, Homo sapien
gatttagattttcatagtaaactgc

SEQ ID NO: 593133 - DNA, 25 bp, Homo sapien
catagtaaactgcatttatctggaa

SEQ ID NO: 593134 - DNA, 25 bp, Homo sapien
ttccttacctaagacaaaatactca

SEQ ID NO: 593135 - DNA, 25 bp, Homo sapien
gacaaaatactcatgtaaaaagtct

SEQ ID NO: 593136 - DNA, 25 bp, Homo sapien
tatagtaagcagaccctcttcagac

SEQ ID NO: 593137 - DNA, 25 bp, Homo sapien
agacttggcatccaagcctgccttt

SEQ ID NO: 593138 - DNA, 25 bp, Homo sapien
tgccttttactctgatgaaatcaac

SEQ ID NO: 593139 - DNA, 25 bp, Homo sapien
atttccccatctgttatcttcctgt

SEQ ID NO: 593140 - DNA, 25 bp, Homo sapien
ctctccctgcaatgttaacagctgt

SEQ ID NO: 593141 - DNA, 25 bp, Homo sapien
cagaaatccttcctacttaacctct

SEQ ID NO: 593142 - DNA, 25 bp, Homo sapien
aatccttcctacttaacctctactg

SEQ ID NO: 593143 - DNA, 25 bp, Homo sapien
caccactcaggcagcttttgggaat

SEQ ID NO: 593144 - DNA, 25 bp, Homo sapien
gcagcttttgggaatttgactcccc

SEQ ID NO: 593145 - DNA, 25 bp, Homo sapien
atgtccacctttggcatctgctatg

SEQ ID NO: 593146 - DNA, 25 bp, Homo sapien
cctttggcatctgctatggtttgaa

SEQ ID NO: 593147 - DNA, 25 bp, Homo sapien
cccaggaattcaagtttaacatgag

SEQ ID NO: 593148 - DNA, 25 bp, Homo sapien
ggaattcaagtttaacatgagcagc

SEQ ID NO: 593149 - DNA, 25 bp, Homo sapien
gaattcaagtttaacatgagcagca

SEQ ID NO: 593150 - DNA, 25 bp, Homo sapien
attcaagtttaacatgagcagcaac

SEQ ID NO: 593151 - DNA, 25 bp, Homo sapien
tcaagtttaacatgagcagcaacat

SEQ ID NO: 593152 - DNA, 25 bp, Homo sapien
caagtttaacatgagcagcaacatt

SEQ ID NO: 593153 - DNA, 25 bp, Homo sapien
agtttaacatgagcagcaacattag

SEQ ID NO: 593154 - DNA, 25 bp, Homo sapien
gtttaacatgagcagcaacattagc

SEQ ID NO: 593155 - DNA, 25 bp, Homo sapien
ttaacatgagcagcaacattagcaa

SEQ ID NO: 593156 - DNA, 25 bp, Homo sapien
taacatgagcagcaacattagcaag

SEQ ID NO: 593157 - DNA, 25 bp, Homo sapien
aacatgagcagcaacattagcaaga

SEQ ID NO: 593158 - DNA, 25 bp, Homo sapien
gtgatcaatggataatcttccctag

SEQ ID NO: 593159 - DNA, 25 bp, Homo sapien
ggataatcttccctagaagcagata

SEQ ID NO: 593160 - DNA, 25 bp, Homo sapien
ggatgaatcagtgcaatgacggata

SEQ ID NO: 593161 - DNA, 25 bp, Homo sapien
gacggatatatagtgttactgccaa

SEQ ID NO: 593162 - DNA, 25 bp, Homo sapien
gtgttactgccaagagaatttaaga

SEQ ID NO: 593163 - DNA, 25 bp, Homo sapien
aactattcaagttcttatgggtaga

SEQ ID NO: 593164 - DNA, 25 bp, Homo sapien
tgggtagaatcaccattgtttatcc

SEQ ID NO: 593165 - DNA, 25 bp, Homo sapien
agagaattgccaggtattacatatc

SEQ ID NO: 593166 - DNA, 25 bp, Homo sapien
ttacatatcatatttgcagtcaaaa

SEQ ID NO: 593167 - DNA, 25 bp, Homo sapien
gtcaaaaacctgagagcctgcttgt

SEQ ID NO: 593168 - DNA, 25 bp, Homo sapien
acctgagagcctgcttgtggttaaa

SEQ ID NO: 593169 - DNA, 25 bp, Homo sapien
taccaaattatgtataacgtagatt

SEQ ID NO: 593170 - DNA, 25 bp, Homo sapien
accaaattatgtataacgtagattg

SEQ ID NO: 593171 - DNA, 25 bp, Homo sapien
ccaaattatgtataacgtagattga

SEQ ID NO: 593172 - DNA, 25 bp, Homo sapien
caaattatgtataacgtagattgaa

SEQ ID NO: 593173 - DNA, 25 bp, Homo sapien
aaattatgtataacgtagattgaat

SEQ ID NO: 593174 - DNA, 25 bp, Homo sapien
ttatgtataacgtagattgaatttt

SEQ ID NO: 593175 - DNA, 25 bp, Homo sapien
tatgtataacgtagattgaattttt

SEQ ID NO: 593176 - DNA, 25 bp, Homo sapien
atgtataacgtagattgaattttta

SEQ ID NO: 593177 - DNA, 25 bp, Homo sapien
gtataacgtagattgaatttttatg

SEQ ID NO: 593178 - DNA, 25 bp, Homo sapien
taacgtagattgaatttttatgaac

SEQ ID NO: 593179 - DNA, 25 bp, Homo sapien
ggagaaccccagtccggcctgacct

SEQ ID NO: 593180 - DNA, 25 bp, Homo sapien
gcggtcaggcgctccaaccagagcg

SEQ ID NO: 593181 - DNA, 25 bp, Homo sapien
gtcaggcgctccaaccagagcgact

SEQ ID NO: 593182 - DNA, 25 bp, Homo sapien
cagagcgactccagctcgaacagcg

SEQ ID NO: 593183 - DNA, 25 bp, Homo sapien
ctccagctcgaacagcgctgggtaa

SEQ ID NO: 593184 - DNA, 25 bp, Homo sapien
gctcgaacagcgctgggtaaactga

SEQ ID NO: 593185 - DNA, 25 bp, Homo sapien
tcgaacagcgctgggtaaactgagg

SEQ ID NO: 593186 - DNA, 25 bp, Homo sapien
gggtaaactgaggctgaaccccgct

SEQ ID NO: 593187 - DNA, 25 bp, Homo sapien
caggagtcgggcgtttacggtcacg

SEQ ID NO: 593188 - DNA, 25 bp, Homo sapien
aggttaataaacttttacgcagcag

SEQ ID NO: 593189 - DNA, 25 bp, Homo sapien
taaacttttacgcagcagacccgga

SEQ ID NO: 593190 - DNA, 25 bp, Homo sapien
cagagtttcatttactgtcctcaaa

SEQ ID NO: 593191 - DNA, 25 bp, Homo sapien
atacattaagccctactttgtcctc

SEQ ID NO: 593192 - DNA, 25 bp, Homo sapien
ttgtcctctgcacaaagatgtattt

SEQ ID NO: 593193 - DNA, 25 bp, Homo sapien
atgtatttgatgatccccagtggca

SEQ ID NO: 593194 - DNA, 25 bp, Homo sapien
atgatccccagtggcacagagctaa

SEQ ID NO: 593195 - DNA, 25 bp, Homo sapien
cctgcagtttaatctcctgttcatt

SEQ ID NO: 593196 - DNA, 25 bp, Homo sapien
cctgttcatttctgtctgacttgag

SEQ ID NO: 593197 - DNA, 25 bp, Homo sapien
agtcttgtccatcatttccaggtga

SEQ ID NO: 593198 - DNA, 25 bp, Homo sapien
catcatttccaggtgaggcggagca

SEQ ID NO: 593199 - DNA, 25 bp, Homo sapien
ggtgtgggatgtttgcattacgcta

SEQ ID NO: 593200 - DNA, 25 bp, Homo sapien
gcattacgctaggtcaattccattg

SEQ ID NO: 593201 - DNA, 25 bp, Homo sapien
ttggagtcatccaacagcgttccag

SEQ ID NO: 593202 - DNA, 25 bp, Homo sapien
agcgttccaggatacatagtggtca

SEQ ID NO: 593203 - DNA, 25 bp, Homo sapien
ggatacatagtggtcacttccattt

SEQ ID NO: 593204 - DNA, 25 bp, Homo sapien
ggtcacttccatttaagatgtttgc

SEQ ID NO: 593205 - DNA, 25 bp, Homo sapien
gcatttcagcacttttataattcaa

SEQ ID NO: 593206 - DNA, 25 bp, Homo sapien
aattcaaatatggtgctgtcccttg

SEQ ID NO: 593207 - DNA, 25 bp, Homo sapien
aatatggtgctgtcccttgagactc

SEQ ID NO: 593208 - DNA, 25 bp, Homo sapien
tgctgtcccttgagactcttgttga

SEQ ID NO: 593209 - DNA, 25 bp, Homo sapien
gttgagagccacatgtatctctttt

SEQ ID NO: 593210 - DNA, 25 bp, Homo sapien
agccacatgtatctctttttataac

SEQ ID NO: 593211 - DNA, 25 bp, Homo sapien
gtctgtaacaacattcaactcttgg

SEQ ID NO: 593212 - DNA, 25 bp, Homo sapien
ggagacctcgaggtgcaggactgtc

SEQ ID NO: 593213 - DNA, 25 bp, Homo sapien
aaagtggaatcggagctgttgtatt

SEQ ID NO: 593214 - DNA, 25 bp, Homo sapien
gggtgtctactgcagatatttcatc

SEQ ID NO: 593215 - DNA, 25 bp, Homo sapien
gtgtctactgcagatatttcatcaa

SEQ ID NO: 593216 - DNA, 25 bp, Homo sapien
tgtctactgcagatatttcatcaaa

SEQ ID NO: 593217 - DNA, 25 bp, Homo sapien
gtgacaagttcactttgaatcagga

SEQ ID NO: 593218 - DNA, 25 bp, Homo sapien
gacaagttcactttgaatcaggata

SEQ ID NO: 593219 - DNA, 25 bp, Homo sapien
gttcactttgaatcaggatatgtgt

SEQ ID NO: 593220 - DNA, 25 bp, Homo sapien
caggatatgtgtgtagtttgtggca

SEQ ID NO: 593221 - DNA, 25 bp, Homo sapien
atatgtgtgtagtttgtggcagttt

SEQ ID NO: 593222 - DNA, 25 bp, Homo sapien
tgtagtttgtggcagttttggccaa

SEQ ID NO: 593223 - DNA, 25 bp, Homo sapien
aagttattctcaaagatgtcccagt

SEQ ID NO: 593224 - DNA, 25 bp, Homo sapien
aaagatgtcccagttgcctagaaag

SEQ ID NO: 593225 - DNA, 25 bp, Homo sapien
gtcccagttgcctagaaaggatcaa

SEQ ID NO: 593226 - DNA, 25 bp, Homo sapien
aatggaacatttgacacacatactc

SEQ ID NO: 593227 - DNA, 25 bp, Homo sapien
ggaacatttgacacacatactcaaa

SEQ ID NO: 593228 - DNA, 25 bp, Homo sapien
acctaatcatctgtatcaaactttc

SEQ ID NO: 593229 - DNA, 25 bp, Homo sapien
aaatcaaatctcaggattgttccac

SEQ ID NO: 593230 - DNA, 25 bp, Homo sapien
atctcaggattgttccactttagag

SEQ ID NO: 593231 - DNA, 25 bp, Homo sapien
ggattgttccactttagagattcta

SEQ ID NO: 593232 - DNA, 25 bp, Homo sapien
tatacttgtcaaatagcacctatct

SEQ ID NO: 593233 - DNA, 25 bp, Homo sapien
acacatacactcatacatagagaga

SEQ ID NO: 593234 - DNA, 25 bp, Homo sapien
aacctgtttcacttgcttctctcat

SEQ ID NO: 593235 - DNA, 25 bp, Homo sapien
ctcatatctgctgccaagtaagatg

SEQ ID NO: 593236 - DNA, 25 bp, Homo sapien
atatctgctgccaagtaagatgtgc

SEQ ID NO: 593237 - DNA, 25 bp, Homo sapien
tatagctcctataattcccatacgt

SEQ ID NO: 593238 - DNA, 25 bp, Homo sapien
atagctcctataattcccatacgtt

SEQ ID NO: 593239 - DNA, 25 bp, Homo sapien
tagctcctataattcccatacgttg

SEQ ID NO: 593240 - DNA, 25 bp, Homo sapien
agctcctataattcccatacgttgt

SEQ ID NO: 593241 - DNA, 25 bp, Homo sapien
gctcctataattcccatacgttgtg

SEQ ID NO: 593242 - DNA, 25 bp, Homo sapien
tcctataattcccatacgttgtgag

SEQ ID NO: 593243 - DNA, 25 bp, Homo sapien
cctataattcccatacgttgtgaga

SEQ ID NO: 593244 - DNA, 25 bp, Homo sapien
tataattcccatacgttgtgagagg

SEQ ID NO: 593245 - DNA, 25 bp, Homo sapien
tagccccagaagtgacatcttttat

SEQ ID NO: 593246 - DNA, 25 bp, Homo sapien
ggtacagggtggtctccccaaacag

SEQ ID NO: 593247 - DNA, 25 bp, Homo sapien
tccccaaacaggctccaggtggttg

SEQ ID NO: 593248 - DNA, 25 bp, Homo sapien
aaacaggctccaggtggttgccatc

SEQ ID NO: 593249 - DNA, 25 bp, Homo sapien
aggtggttgccatctcgtgagtcag

SEQ ID NO: 593250 - DNA, 25 bp, Homo sapien
gttgccatctcgtgagtcagttgtc

SEQ ID NO: 593251 - DNA, 25 bp, Homo sapien
tgagtcagttgtcgcccttttaaag

SEQ ID NO: 593252 - DNA, 25 bp, Homo sapien
gttgtcgcccttttaaagtgctgtt

SEQ ID NO: 593253 - DNA, 25 bp, Homo sapien
gcccttttaaagtgctgttacatca

SEQ ID NO: 593254 - DNA, 25 bp, Homo sapien
agtgctgttacatcaagaggttaca

SEQ ID NO: 593255 - DNA, 25 bp, Homo sapien
aatagccaaagcaaaatccaaaggg

SEQ ID NO: 593256 - DNA, 25 bp, Homo sapien
gattcaacttggtgatgtgatgcaa

SEQ ID NO: 593257 - DNA, 25 bp, Homo sapien
tgatgtgatgcaaccttgggcctgg

SEQ ID NO: 593258 - DNA, 25 bp, Homo sapien
caaccttgggcctgggttgaatgga

SEQ ID NO: 593259 - DNA, 25 bp, Homo sapien
atggacagactgacattagaatcta

SEQ ID NO: 593260 - DNA, 25 bp, Homo sapien
ttagaatctacactgagcacacctt

SEQ ID NO: 593261 - DNA, 25 bp, Homo sapien
tctacactgagcacaccttaaaggg

SEQ ID NO: 593262 - DNA, 25 bp, Homo sapien
gtgtgtgtttaatgtagatgtacgt

SEQ ID NO: 593263 - DNA, 25 bp, Homo sapien
gtacgtataaggctcatttctgact

SEQ ID NO: 593264 - DNA, 25 bp, Homo sapien
agttgattagccgtagtaaatatta

SEQ ID NO: 593265 - DNA, 25 bp, Homo sapien
ttaaaaaatagcaagacatcacccc

SEQ ID NO: 593266 - DNA, 25 bp, Homo sapien
acttaacagtcaatgtctttcctga

SEQ ID NO: 593267 - DNA, 25 bp, Homo sapien
cgatgccgtgctggcctttatggct

SEQ ID NO: 593268 - DNA, 25 bp, Homo sapien
ctttatggctcgctgcctgcaggtt

SEQ ID NO: 593269 - DNA, 25 bp, Homo sapien
gctgcctgcaggttgtcatgtgcca

SEQ ID NO: 593270 - DNA, 25 bp, Homo sapien
tcgcttctccgcagccgctgaggag

SEQ ID NO: 593271 - DNA, 25 bp, Homo sapien
atggcagcctgcagcaactggaaca

SEQ ID NO: 593272 - DNA, 25 bp, Homo sapien
ggcagcctgcagcaactggaacaag

SEQ ID NO: 593273 - DNA, 25 bp, Homo sapien
gaacaaggccccaccgtaaagctct

SEQ ID NO: 593274 - DNA, 25 bp, Homo sapien
aaggccccaccgtaaagctctgtgt

SEQ ID NO: 593275 - DNA, 25 bp, Homo sapien
ggccccaccgtaaagctctgtgtgt

SEQ ID NO: 593276 - DNA, 25 bp, Homo sapien
gccccaccgtaaagctctgtgtgtc

SEQ ID NO: 593277 - DNA, 25 bp, Homo sapien
gtgtgtcccagggtcttcctgtcac

SEQ ID NO: 593278 - DNA, 25 bp, Homo sapien
ggaagaaagcccacaccgcaggtat

SEQ ID NO: 593279 - DNA, 25 bp, Homo sapien
aagcccacaccgcaggtatcagtag

SEQ ID NO: 593280 - DNA, 25 bp, Homo sapien
cacaccgcaggtatcagtagcaaat

SEQ ID NO: 593281 - DNA, 25 bp, Homo sapien
aactacagaatcagctccagaggac

SEQ ID NO: 593282 - DNA, 25 bp, Homo sapien
gaatcagctccagaggactttgtta

SEQ ID NO: 593283 - DNA, 25 bp, Homo sapien
gctccagaggactttgttaacaaga

SEQ ID NO: 593284 - DNA, 25 bp, Homo sapien
agagaagattgaaaacagccctggg

SEQ ID NO: 593285 - DNA, 25 bp, Homo sapien
tggggctacaccaactcaagagctc

SEQ ID NO: 593286 - DNA, 25 bp, Homo sapien
caaagtggcatcctggacccaccat

SEQ ID NO: 593287 - DNA, 25 bp, Homo sapien
tcggtacttccccaggcaccgtttg

SEQ ID NO: 593288 - DNA, 25 bp, Homo sapien
caccgtttgttctggcatggggcta

SEQ ID NO: 593289 - DNA, 25 bp, Homo sapien
ttttacgtattcagtgaatgggaac

SEQ ID NO: 593290 - DNA, 25 bp, Homo sapien
ttcagtgaatgggaacaacgaggtc

SEQ ID NO: 593291 - DNA, 25 bp, Homo sapien
gaacaacgaggtcatggttcatgtt

SEQ ID NO: 593292 - DNA, 25 bp, Homo sapien
aacgaggtcatggttcatgttgtgg

SEQ ID NO: 593293 - DNA, 25 bp, Homo sapien
ggagaatccagagtgtcccactggt

SEQ ID NO: 593294 - DNA, 25 bp, Homo sapien
aatccagagtgtcccactggtccag

SEQ ID NO: 593295 - DNA, 25 bp, Homo sapien
cagagtgtcccactggtccagacat

SEQ ID NO: 593296 - DNA, 25 bp, Homo sapien
gtgtcccactggtccagacatcatt

SEQ ID NO: 593297 - DNA, 25 bp, Homo sapien
ccagacatcattccaattgtagctg

SEQ ID NO: 593298 - DNA, 25 bp, Homo sapien
gacatcattccaattgtagctggtg

SEQ ID NO: 593299 - DNA, 25 bp, Homo sapien
attccaattgtagctggtgtggttg

SEQ ID NO: 593300 - DNA, 25 bp, Homo sapien
gattgaatggctttccatctacaca

SEQ ID NO: 593301 - DNA, 25 bp, Homo sapien
gctttccatctacacagagccagaa

SEQ ID NO: 593302 - DNA, 25 bp, Homo sapien
gaagaatttattggtgatcactttt

SEQ ID NO: 593303 - DNA, 25 bp, Homo sapien
aatcatgtggcctatctcagtagtc

SEQ ID NO: 593304 - DNA, 25 bp, Homo sapien
atctcagtagtctttaccctgctaa

SEQ ID NO: 593305 - DNA, 25 bp, Homo sapien
gtctttaccctgctaaaagtttcat

SEQ ID NO: 593306 - DNA, 25 bp, Homo sapien
atagatgcgtttatggatctgttac

SEQ ID NO: 593307 - DNA, 25 bp, Homo sapien
ggatctgttacataagcactagtca

SEQ ID NO: 593308 - DNA, 25 bp, Homo sapien
gcactagtcacaggactactcgtga

SEQ ID NO: 593309 - DNA, 25 bp, Homo sapien
acaggactactcgtgaatttcatca

SEQ ID NO: 593310 - DNA, 25 bp, Homo sapien
gtttattcatgatatcaccttagta

SEQ ID NO: 593311 - DNA, 25 bp, Homo sapien
gatcatagggtctaaaaaggaaagg

SEQ ID NO: 593312 - DNA, 25 bp, Homo sapien
tcatagggtctaaaaaggaaaggag

SEQ ID NO: 593313 - DNA, 25 bp, Homo sapien
aaggaaaggagggccgggcatggtg

SEQ ID NO: 593314 - DNA, 25 bp, Homo sapien
aggaaaggagggccgggcatggtgg

SEQ ID NO: 593315 - DNA, 25 bp, Homo sapien
tgcagtgaggcgagaacgtgccatt

SEQ ID NO: 593316 - DNA, 25 bp, Homo sapien
gcagtgaggcgagaacgtgccattg

SEQ ID NO: 593317 - DNA, 25 bp, Homo sapien
cagtgaggcgagaacgtgccattgc

SEQ ID NO: 593318 - DNA, 25 bp, Homo sapien
agtgaggcgagaacgtgccattgca

SEQ ID NO: 593319 - DNA, 25 bp, Homo sapien
tgaggcgagaacgtgccattgcact

SEQ ID NO: 593320 - DNA, 25 bp, Homo sapien
gaggcgagaacgtgccattgcactc

SEQ ID NO: 593321 - DNA, 25 bp, Homo sapien
tccagccagggtgacaagagaaact

SEQ ID NO: 593322 - DNA, 25 bp, Homo sapien
aagaagcacaagcaccgagccaagg

SEQ ID NO: 593323 - DNA, 25 bp, Homo sapien
gaagcacaagcaccgagccaaggag

SEQ ID NO: 593324 - DNA, 25 bp, Homo sapien
gcacaagcaccgagccaaggagagc

SEQ ID NO: 593325 - DNA, 25 bp, Homo sapien
aagcaccgagccaaggagagccagc

SEQ ID NO: 593326 - DNA, 25 bp, Homo sapien
gcaccgagccaaggagagccagcag

SEQ ID NO: 593327 - DNA, 25 bp, Homo sapien
tgcaggcaccactggcctcaggtgg

SEQ ID NO: 593328 - DNA, 25 bp, Homo sapien
cccgccttggtggtgtatgagagcc

SEQ ID NO: 593329 - DNA, 25 bp, Homo sapien
ccgccttggtggtgtatgagagcca

SEQ ID NO: 593330 - DNA, 25 bp, Homo sapien
gtggtgtatgagagccaggccgggc

SEQ ID NO: 593331 - DNA, 25 bp, Homo sapien
agccggtccagagacatgagcacca

SEQ ID NO: 593332 - DNA, 25 bp, Homo sapien
ggtccagagacatgagcaccaccac

SEQ ID NO: 593333 - DNA, 25 bp, Homo sapien
attggaaggaggtagaagccgtgca

SEQ ID NO: 593334 - DNA, 25 bp, Homo sapien
gaaggaggtagaagccgtgcagagg

SEQ ID NO: 593335 - DNA, 25 bp, Homo sapien
gggctgacactgtcagccaatcctc

SEQ ID NO: 593336 - DNA, 25 bp, Homo sapien
actgtcagccaatcctcccatcggg

SEQ ID NO: 593337 - DNA, 25 bp, Homo sapien
agccaatcctcccatcggggaagag

SEQ ID NO: 593338 - DNA, 25 bp, Homo sapien
cccatcggggaagagaatcctggac

SEQ ID NO: 593339 - DNA, 25 bp, Homo sapien
agaatcctggacagggacaggatgg

SEQ ID NO: 593340 - DNA, 25 bp, Homo sapien
tataacgggctttttggtgggagat

SEQ ID NO: 593341 - DNA, 25 bp, Homo sapien
taacgggctttttggtgggagatgg

SEQ ID NO: 593342 - DNA, 25 bp, Homo sapien
ttttggtgggagatgggtacccagt

SEQ ID NO: 593343 - DNA, 25 bp, Homo sapien
ttggtgggagatgggtacccagtgg

SEQ ID NO: 593344 - DNA, 25 bp, Homo sapien
agcatataaacccaagctgcccagc

SEQ ID NO: 593345 - DNA, 25 bp, Homo sapien
agaaccacattcttgtcccatatgc

SEQ ID NO: 593346 - DNA, 25 bp, Homo sapien
tcccatatgctatgcctctcaaaaa

SEQ ID NO: 593347 - DNA, 25 bp, Homo sapien
aaatgcctgccctgagctgtgtctc

SEQ ID NO: 593348 - DNA, 25 bp, Homo sapien
tgagctgtgtctctgtctaggtaca

SEQ ID NO: 593349 - DNA, 25 bp, Homo sapien
gtctctgtctaggtacacagttcat

SEQ ID NO: 593350 - DNA, 25 bp, Homo sapien
cagttcatgagtgaaggagctcctg

SEQ ID NO: 593351 - DNA, 25 bp, Homo sapien
tggaagtccagattggtcaagtaac

SEQ ID NO: 593352 - DNA, 25 bp, Homo sapien
ttggtcaagtaacttgtcccagccc

SEQ ID NO: 593353 - DNA, 25 bp, Homo sapien
cagcccatgcatctggtatgtggtt

SEQ ID NO: 593354 - DNA, 25 bp, Homo sapien
ggacaggtttctaactcattacgta

SEQ ID NO: 593355 - DNA, 25 bp, Homo sapien
tttgttctgaatgtgcctcatcatc

SEQ ID NO: 593356 - DNA, 25 bp, Homo sapien
ttgttctgaatgtgcctcatcatcc

SEQ ID NO: 593357 - DNA, 25 bp, Homo sapien
tgttctgaatgtgcctcatcatccc

SEQ ID NO: 593358 - DNA, 25 bp, Homo sapien
gttctgaatgtgcctcatcatccca

SEQ ID NO: 593359 - DNA, 25 bp, Homo sapien
gcaggcatctgtaagtttccattgt

SEQ ID NO: 593360 - DNA, 25 bp, Homo sapien
tttccattgtttccacaaaaaccag

SEQ ID NO: 593361 - DNA, 25 bp, Homo sapien
ttccattgtttccacaaaaaccagt

SEQ ID NO: 593362 - DNA, 25 bp, Homo sapien
tccattgtttccacaaaaaccagtg

SEQ ID NO: 593363 - DNA, 25 bp, Homo sapien
ccattgtttccacaaaaaccagtgg

SEQ ID NO: 593364 - DNA, 25 bp, Homo sapien
gcctgctacagggtctttagctttc

SEQ ID NO: 593365 - DNA, 25 bp, Homo sapien
cagggtctttagctttccttagatt

SEQ ID NO: 593366 - DNA, 25 bp, Homo sapien
agctttccttagattttcaaagagg

SEQ ID NO: 593367 - DNA, 25 bp, Homo sapien
caaagaggtttgtgatccaagaaga

SEQ ID NO: 593368 - DNA, 25 bp, Homo sapien
aacgatcactttagattttcaggag

SEQ ID NO: 593369 - DNA, 25 bp, Homo sapien
tttcaggagtgtgtgcctagtttgt

SEQ ID NO: 593370 - DNA, 25 bp, Homo sapien
gtgtgcctagtttgtgattaagtta

SEQ ID NO: 593371 - DNA, 25 bp, Homo sapien
gattaagttattctgcttcctttct

SEQ ID NO: 593372 - DNA, 25 bp, Homo sapien
gcttcctttcttataattgagttta

SEQ ID NO: 593373 - DNA, 25 bp, Homo sapien
tttcttcttcatattacctccatta

SEQ ID NO: 593374 - DNA, 25 bp, Homo sapien
ttcatattacctccattagttattg

SEQ ID NO: 593375 - DNA, 25 bp, Homo sapien
ccagcgtcatggaggacgacatcct

SEQ ID NO: 593376 - DNA, 25 bp, Homo sapien
gcgtcatggaggacgacatcctcat

SEQ ID NO: 593377 - DNA, 25 bp, Homo sapien
gtcatggaggacgacatcctcatgg

SEQ ID NO: 593378 - DNA, 25 bp, Homo sapien
cgacatcctcatggatctcatctga

SEQ ID NO: 593379 - DNA, 25 bp, Homo sapien
gacatcctcatggatctcatctgaa

SEQ ID NO: 593380 - DNA, 25 bp, Homo sapien
catcctcatggatctcatctgaatc

SEQ ID NO: 593381 - DNA, 25 bp, Homo sapien
tcctcatggatctcatctgaatccc

SEQ ID NO: 593382 - DNA, 25 bp, Homo sapien
tcatggatctcatctgaatccccaa

SEQ ID NO: 593383 - DNA, 25 bp, Homo sapien
atggatctcatctgaatccccaaca

SEQ ID NO: 593384 - DNA, 25 bp, Homo sapien
atctgaatccccaacacccaataaa

SEQ ID NO: 593385 - DNA, 25 bp, Homo sapien
ctgaatccccaacacccaataaagt

SEQ ID NO: 593386 - DNA, 25 bp, Homo sapien
ggagggtttaatagtattcttagct

SEQ ID NO: 593387 - DNA, 25 bp, Homo sapien
ggtttaatagtattcttagctgaag

SEQ ID NO: 593388 - DNA, 25 bp, Homo sapien
tcagaagacaatatccataccaaag

SEQ ID NO: 593389 - DNA, 25 bp, Homo sapien
aagacaatatccataccaaagcaca

SEQ ID NO: 593390 - DNA, 25 bp, Homo sapien
agcacagagagacaaaaggatggaa

SEQ ID NO: 593391 - DNA, 25 bp, Homo sapien
gtaagagacaaatgggacactgtta

SEQ ID NO: 593392 - DNA, 25 bp, Homo sapien
tgggacactgttaaaagtctaaaat

SEQ ID NO: 593393 - DNA, 25 bp, Homo sapien
acttataattggaatctcggagagg

SEQ ID NO: 593394 - DNA, 25 bp, Homo sapien
gacataataacttgagaatcttcca

SEQ ID NO: 593395 - DNA, 25 bp, Homo sapien
gagaatcttccaaaactaatacaga

SEQ ID NO: 593396 - DNA, 25 bp, Homo sapien
tatttgagaatcactgtagctctaa

SEQ ID NO: 593397 - DNA, 25 bp, Homo sapien
ctgtaatcccagctgaggtcaggag

SEQ ID NO: 593398 - DNA, 25 bp, Homo sapien
tgtaatcccagctgaggtcaggagt

SEQ ID NO: 593399 - DNA, 25 bp, Homo sapien
gtaatcccagctgaggtcaggagtt

SEQ ID NO: 593400 - DNA, 25 bp, Homo sapien
caggagaatcgcttagaacacggga

SEQ ID NO: 593401 - DNA, 25 bp, Homo sapien
aggagaatcgcttagaacacgggag

SEQ ID NO: 593402 - DNA, 25 bp, Homo sapien
agaatcgcttagaacacgggaggtg

SEQ ID NO: 593403 - DNA, 25 bp, Homo sapien
gaatcgcttagaacacgggaggtgg

SEQ ID NO: 593404 - DNA, 25 bp, Homo sapien
atcgcttagaacacgggaggtggag

SEQ ID NO: 593405 - DNA, 25 bp, Homo sapien
tcgcttagaacacgggaggtggagg

SEQ ID NO: 593406 - DNA, 25 bp, Homo sapien
cgcttagaacacgggaggtggaggt

SEQ ID NO: 593407 - DNA, 25 bp, Homo sapien
gcttagaacacgggaggtggaggtt

SEQ ID NO: 593408 - DNA, 25 bp, Homo sapien
tctaaagtttgtattgtgacttcca

SEQ ID NO: 593409 - DNA, 25 bp, Homo sapien
aaagtttgtattgtgacttccagta

SEQ ID NO: 593410 - DNA, 25 bp, Homo sapien
gtttgtattgtgacttccagtaatg

SEQ ID NO: 593411 - DNA, 25 bp, Homo sapien
gtattgtgacttccagtaatgtaaa

SEQ ID NO: 593412 - DNA, 25 bp, Homo sapien
ttgtgacttccagtaatgtaaacta

SEQ ID NO: 593413 - DNA, 25 bp, Homo sapien
gtgacttccagtaatgtaaactata

SEQ ID NO: 593414 - DNA, 25 bp, Homo sapien
atgtaaactatatgaggctaatcct

SEQ ID NO: 593415 - DNA, 25 bp, Homo sapien
tatatgaggctaatcctcttttcct

SEQ ID NO: 593416 - DNA, 25 bp, Homo sapien
cctcatttgggataactgtaactag

SEQ ID NO: 593417 - DNA, 25 bp, Homo sapien
catttgggataactgtaactagtat

SEQ ID NO: 593418 - DNA, 25 bp, Homo sapien
gggataactgtaactagtattattt

SEQ ID NO: 593419 - DNA, 25 bp, Homo sapien
ggccgaggttgttataatgagccga

SEQ ID NO: 593420 - DNA, 25 bp, Homo sapien
gccgaggttgttataatgagccgag

SEQ ID NO: 593421 - DNA, 25 bp, Homo sapien
ccgaggttgttataatgagccgaga

SEQ ID NO: 593422 - DNA, 25 bp, Homo sapien
aggttgttataatgagccgagatag

SEQ ID NO: 593423 - DNA, 25 bp, Homo sapien
ggttgttataatgagccgagatagt

SEQ ID NO: 593424 - DNA, 25 bp, Homo sapien
gttgttataatgagccgagatagtg

SEQ ID NO: 593425 - DNA, 25 bp, Homo sapien
agaacaatttaaatatccaggctgg

SEQ ID NO: 593426 - DNA, 25 bp, Homo sapien
gaacaatttaaatatccaggctggg

SEQ ID NO: 593427 - DNA, 25 bp, Homo sapien
aacaatttaaatatccaggctgggc

SEQ ID NO: 593428 - DNA, 25 bp, Homo sapien
acaatttaaatatccaggctgggca

SEQ ID NO: 593429 - DNA, 25 bp, Homo sapien
caatttaaatatccaggctgggcat

SEQ ID NO: 593430 - DNA, 25 bp, Homo sapien
gtatcccaaacacttgcattttcaa

SEQ ID NO: 593431 - DNA, 25 bp, Homo sapien
caaaaggttttgacatccacttcct

SEQ ID NO: 593432 - DNA, 25 bp, Homo sapien
ctacgctttgagatggataggtcct

SEQ ID NO: 593433 - DNA, 25 bp, Homo sapien
ggataggtcctattttacctctatt

SEQ ID NO: 593434 - DNA, 25 bp, Homo sapien
ttttacctctattgcatcgatgaag

SEQ ID NO: 593435 - DNA, 25 bp, Homo sapien
aactgcaatgcaaagaagtgtctaa

SEQ ID NO: 593436 - DNA, 25 bp, Homo sapien
gtgtctaattagtcatttgcttcct

SEQ ID NO: 593437 - DNA, 25 bp, Homo sapien
gcttcctttcatcaaatatgtccat

SEQ ID NO: 593438 - DNA, 25 bp, Homo sapien
aatatgtccattacaccagtgtttc

SEQ ID NO: 593439 - DNA, 25 bp, Homo sapien
gtgttccatagatcataaatcctga

SEQ ID NO: 593440 - DNA, 25 bp, Homo sapien
gggacccgtggatatataagtttgg

SEQ ID NO: 593441 - DNA, 25 bp, Homo sapien
aacaacactccaccatgtctgagaa

SEQ ID NO: 593442 - DNA, 25 bp, Homo sapien
cactccaccatgtctgagaatgtgt

SEQ ID NO: 593443 - DNA, 25 bp, Homo sapien
gaatgtgtgtattctaacctgtaac

SEQ ID NO: 593444 - DNA, 25 bp, Homo sapien
tattctaacctgtaacaccacctat

SEQ ID NO: 593445 - DNA, 25 bp, Homo sapien
acaccacctatgttatgcatgtaga

SEQ ID NO: 593446 - DNA, 25 bp, Homo sapien
tgcatgtagatatattgccgcatat

SEQ ID NO: 593447 - DNA, 25 bp, Homo sapien
attgccgcatatctacattttttgt

SEQ ID NO: 593448 - DNA, 25 bp, Homo sapien
aaatttagcatagtgtaatctgaaa

SEQ ID NO: 593449 - DNA, 25 bp, Homo sapien
taatgtattttcctgatgtgtcact

SEQ ID NO: 593450 - DNA, 25 bp, Homo sapien
gtattttcctgatgtgtcacttttt

SEQ ID NO: 593451 - DNA, 25 bp, Homo sapien
gatgtgtcactttttgatatcataa

SEQ ID NO: 593452 - DNA, 25 bp, Homo sapien
aagtagggtatatgtttggatcagt

SEQ ID NO: 593453 - DNA, 25 bp, Homo sapien
ggatcagtggatcagtgtcctttat

SEQ ID NO: 593454 - DNA, 25 bp, Homo sapien
tcagtgtcctttattgtgcagaaaa

SEQ ID NO: 593455 - DNA, 25 bp, Homo sapien
aaagctaaaattacagattcttctg

SEQ ID NO: 593456 - DNA, 25 bp, Homo sapien
gattcttctgaagggatacatagca

SEQ ID NO: 593457 - DNA, 25 bp, Homo sapien
gggatacatagcagccgtttcacca

SEQ ID NO: 593458 - DNA, 25 bp, Homo sapien
tacatagcagccgtttcaccaatgt

SEQ ID NO: 593459 - DNA, 25 bp, Homo sapien
tcaccaatgtccctcagtccatttg

SEQ ID NO: 593460 - DNA, 25 bp, Homo sapien
agtccatttgtccaggtccagaagt

SEQ ID NO: 593461 - DNA, 25 bp, Homo sapien
agtattcatgaggagctatgcgtta

SEQ ID NO: 593462 - DNA, 25 bp, Homo sapien
tgcgttagaagagagcacttgggct

SEQ ID NO: 593463 - DNA, 25 bp, Homo sapien
gtttttagtgtatccattgaaacac

SEQ ID NO: 593464 - DNA, 25 bp, Homo sapien
tttagtgccctgatgctaagggaat

SEQ ID NO: 593465 - DNA, 25 bp, Homo sapien
ggaatattccaactagcggcactga

SEQ ID NO: 593466 - DNA, 25 bp, Homo sapien
ggcactgattccactccaggttatt

SEQ ID NO: 593467 - DNA, 25 bp, Homo sapien
gattccactccaggttattaattaa

SEQ ID NO: 593468 - DNA, 25 bp, Homo sapien
aaacagtagcaatcagcccatctga

SEQ ID NO: 593469 - DNA, 25 bp, Homo sapien
ttaatattctattgctgctgactga

SEQ ID NO: 593470 - DNA, 25 bp, Homo sapien
atgcccagacatcagacattttgta

SEQ ID NO: 593471 - DNA, 25 bp, Homo sapien
aaaattgctctgtgcttaggactaa

SEQ ID NO: 593472 - DNA, 25 bp, Homo sapien
tcaagttccagaggatacgctggtt

SEQ ID NO: 593473 - DNA, 25 bp, Homo sapien
ggatacgctggttgtgtctttcaat

SEQ ID NO: 593474 - DNA, 25 bp, Homo sapien
agctactgcaaccaaaccatcatgg

SEQ ID NO: 593475 - DNA, 25 bp, Homo sapien
aaggctgctgcaaaggttttttcgg

SEQ ID NO: 593476 - DNA, 25 bp, Homo sapien
aacccctgctatggcaaaggcaatg

SEQ ID NO: 593477 - DNA, 25 bp, Homo sapien
aaaggcaatgtgagtcccatcctct

SEQ ID NO: 593478 - DNA, 25 bp, Homo sapien
gggaacacaaggactccttcaccgg

SEQ ID NO: 593479 - DNA, 25 bp, Homo sapien
tccttcaccggttggccagtgactg

SEQ ID NO: 593480 - DNA, 25 bp, Homo sapien
ttggccagtgactggctgtgtgtct

SEQ ID NO: 593481 - DNA, 25 bp, Homo sapien
gtgtgtctgggccaagcctgccact

SEQ ID NO: 593482 - DNA, 25 bp, Homo sapien
ggccttgggattctcatatctatgc

SEQ ID NO: 593483 - DNA, 25 bp, Homo sapien
tctatgcagtggaaagttggatcaa

SEQ ID NO: 593484 - DNA, 25 bp, Homo sapien
gttggatcaaattatttctcatatt

SEQ ID NO: 593485 - DNA, 25 bp, Homo sapien
aaggtgcctgtgaagaactaacgct

SEQ ID NO: 593486 - DNA, 25 bp, Homo sapien
gaagaactaacgctaggaacacagg

SEQ ID NO: 593487 - DNA, 25 bp, Homo sapien
agatgaaaggttacggctagttggc

SEQ ID NO: 593488 - DNA, 25 bp, Homo sapien
gaggccaagagagcatcctattctt

SEQ ID NO: 593489 - DNA, 25 bp, Homo sapien
gagagcatcctattcttagacccag

SEQ ID NO: 593490 - DNA, 25 bp, Homo sapien
cctattcttagacccagcaccttgg

SEQ ID NO: 593491 - DNA, 25 bp, Homo sapien
gttatctctactatgatgtgcaaca

SEQ ID NO: 593492 - DNA, 25 bp, Homo sapien
tgtgcaacaaaccatactgagccat

SEQ ID NO: 593493 - DNA, 25 bp, Homo sapien
aaaccatactgagccatatacttga

SEQ ID NO: 593494 - DNA, 25 bp, Homo sapien
tactgagccatatacttgatgccat

SEQ ID NO: 593495 - DNA, 25 bp, Homo sapien
gccatatacttgatgccatatactt

SEQ ID NO: 593496 - DNA, 25 bp, Homo sapien
aatgagatgtaatctggaggcccaa

SEQ ID NO: 593497 - DNA, 25 bp, Homo sapien
tctggaggcccaagtcattttctta

SEQ ID NO: 593498 - DNA, 25 bp, Homo sapien
gaggcccaagtcattttcttaggag

SEQ ID NO: 593499 - DNA, 25 bp, Homo sapien
atgtgtttggtgttatctaaccttc

SEQ ID NO: 593500 - DNA, 25 bp, Homo sapien
ggtgttatctaaccttctgcagttt

SEQ ID NO: 593501 - DNA, 25 bp, Homo sapien
ttatctaaccttctgcagtttatca

SEQ ID NO: 593502 - DNA, 25 bp, Homo sapien
tatcagtctgaaacaaatgcattct

SEQ ID NO: 593503 - DNA, 25 bp, Homo sapien
aatgcattctattctcatttgaaaa

SEQ ID NO: 593504 - DNA, 25 bp, Homo sapien
tgtctgaacagccaccaattttcaa

SEQ ID NO: 593505 - DNA, 25 bp, Homo sapien
gaacagccaccaattttcaaaatca

SEQ ID NO: 593506 - DNA, 25 bp, Homo sapien
ttttcaaaatcacccatttaactag

SEQ ID NO: 593507 - DNA, 25 bp, Homo sapien
atttaatgattattcctattcttta

SEQ ID NO: 593508 - DNA, 25 bp, Homo sapien
tattcctattctttataatttcaga

SEQ ID NO: 593509 - DNA, 25 bp, Homo sapien
aatgcagcaaaacggattacctctt

SEQ ID NO: 593510 - DNA, 25 bp, Homo sapien
cagcaaaacggattacctcttttat

SEQ ID NO: 593511 - DNA, 25 bp, Homo sapien
aaatcaacatgggtcaaatttgtaa

SEQ ID NO: 593512 - DNA, 25 bp, Homo sapien
aaatctgtacaatgggatttatcca

SEQ ID NO: 593513 - DNA, 25 bp, Homo sapien
gggatttatccatggtacattcaga

SEQ ID NO: 593514 - DNA, 25 bp, Homo sapien
tttatccatggtacattcagagcct

SEQ ID NO: 593515 - DNA, 25 bp, Homo sapien
tccatggtacattcagagcctaaca

SEQ ID NO: 593516 - DNA, 25 bp, Homo sapien
ggtacattcagagcctaacatatga

SEQ ID NO: 593517 - DNA, 25 bp, Homo sapien
tcagagcctaacatatgaggtacag

SEQ ID NO: 593518 - DNA, 25 bp, Homo sapien
gaacaaacttcaaagcctccaggag

SEQ ID NO: 593519 - DNA, 25 bp, Homo sapien
aggagcacacgtgacctcaggaaat

SEQ ID NO: 593520 - DNA, 25 bp, Homo sapien
agaaacaacctagctctccaaagag

SEQ ID NO: 593521 - DNA, 25 bp, Homo sapien
ctccaaagaggagtatttcattcaa

SEQ ID NO: 593522 - DNA, 25 bp, Homo sapien
atttcattcaactccgaactgctca

SEQ ID NO: 593523 - DNA, 25 bp, Homo sapien
aactgctcacacattatgcaactgt

SEQ ID NO: 593524 - DNA, 25 bp, Homo sapien
atgcaactgtgaacaaggctcattt

SEQ ID NO: 593525 - DNA, 25 bp, Homo sapien
atgaagcttctaatgttttcaccac

SEQ ID NO: 593526 - DNA, 25 bp, Homo sapien
tattgaggtgctggatatgttgact

SEQ ID NO: 593527 - DNA, 25 bp, Homo sapien
aatagtaacatcaccttgttcccca

SEQ ID NO: 593528 - DNA, 25 bp, Homo sapien
catcaccttgttccccataaaatta

SEQ ID NO: 593529 - DNA, 25 bp, Homo sapien
accgccatatgaggactcatgagaa

SEQ ID NO: 593530 - DNA, 25 bp, Homo sapien
gactcatgagaaaattaccctgcca

SEQ ID NO: 593531 - DNA, 25 bp, Homo sapien
gagaaaattaccctgccaagtgttc

SEQ ID NO: 593532 - DNA, 25 bp, Homo sapien
cagaagcttcctaagctgctggtct

SEQ ID NO: 593533 - DNA, 25 bp, Homo sapien
gcttcctaagctgctggtctgataa

SEQ ID NO: 593534 - DNA, 25 bp, Homo sapien
gctgctggtctgataatgtgtataa

SEQ ID NO: 593535 - DNA, 25 bp, Homo sapien
gcaagtatgtatattcctatagtat

SEQ ID NO: 593536 - DNA, 25 bp, Homo sapien
agatataatctcctgattatgcttt

SEQ ID NO: 593537 - DNA, 25 bp, Homo sapien
tattgtcttgcttcattaaaatgta

SEQ ID NO: 593538 - DNA, 25 bp, Homo sapien
gttttgttcactaaagtattccaag

SEQ ID NO: 593539 - DNA, 25 bp, Homo sapien
gtggaacatttccaagaaccaataa

SEQ ID NO: 593540 - DNA, 25 bp, Homo sapien
ttgtatgaacagagctggaggtaga

SEQ ID NO: 593541 - DNA, 25 bp, Homo sapien
cagagctggaggtagaattggaatc

SEQ ID NO: 593542 - DNA, 25 bp, Homo sapien
gtagaattggaatcatcacagatgc

SEQ ID NO: 593543 - DNA, 25 bp, Homo sapien
gaattggaatcatcacagatgctgt

SEQ ID NO: 593544 - DNA, 25 bp, Homo sapien
ggaatcatcacagatgctgtttaag

SEQ ID NO: 593545 - DNA, 25 bp, Homo sapien
gctgtttaagaattgtctgtggctc

SEQ ID NO: 593546 - DNA, 25 bp, Homo sapien
gtttaagaattgtctgtggctcaca

SEQ ID NO: 593547 - DNA, 25 bp, Homo sapien
tttaagaattgtctgtggctcacac

SEQ ID NO: 593548 - DNA, 25 bp, Homo sapien
ttaagaattgtctgtggctcacacc

SEQ ID NO: 593549 - DNA, 25 bp, Homo sapien
ggcgctttgtaaggccgaggctggt

SEQ ID NO: 593550 - DNA, 25 bp, Homo sapien
aattagccagtcacggtggccggcg

SEQ ID NO: 593551 - DNA, 25 bp, Homo sapien
tgacttgcccagttgtcagggatgg

SEQ ID NO: 593552 - DNA, 25 bp, Homo sapien
atgctgtggtgcccccttaaaggga

SEQ ID NO: 593553 - DNA, 25 bp, Homo sapien
tgtggtgcccccttaaagggaaatg

SEQ ID NO: 593554 - DNA, 25 bp, Homo sapien
gtgcctgcttttgtccaccaaatag

SEQ ID NO: 593555 - DNA, 25 bp, Homo sapien
tgcctgcttttgtccaccaaatagc

SEQ ID NO: 593556 - DNA, 25 bp, Homo sapien
gcttttgtccaccaaatagccagga

SEQ ID NO: 593557 - DNA, 25 bp, Homo sapien
cttttgtccaccaaatagccaggat

SEQ ID NO: 593558 - DNA, 25 bp, Homo sapien
ttttgtccaccaaatagccaggata

SEQ ID NO: 593559 - DNA, 25 bp, Homo sapien
agccaggataagaagtatgtggaaa

SEQ ID NO: 593560 - DNA, 25 bp, Homo sapien
gtatgtggaaattagtttcctgtct

SEQ ID NO: 593561 - DNA, 25 bp, Homo sapien
tatgtggaaattagtttcctgtctt

SEQ ID NO: 593562 - DNA, 25 bp, Homo sapien
cacgtttccggtgcacatgccttta

SEQ ID NO: 593563 - DNA, 25 bp, Homo sapien
cggtgcacatgcctttactcagact

SEQ ID NO: 593564 - DNA, 25 bp, Homo sapien
tttactcagactccgacactggcgt

SEQ ID NO: 593565 - DNA, 25 bp, Homo sapien
agactccgacactggcgttgctttt

SEQ ID NO: 593566 - DNA, 25 bp, Homo sapien
acactggcgttgcttttgtctcatc

SEQ ID NO: 593567 - DNA, 25 bp, Homo sapien
gttgcttttgtctcatcccagctag

SEQ ID NO: 593568 - DNA, 25 bp, Homo sapien
ttgtctcatcccagctaggcgacgt

SEQ ID NO: 593569 - DNA, 25 bp, Homo sapien
agctaggcgacgtctgcgtcagcgc

SEQ ID NO: 593570 - DNA, 25 bp, Homo sapien
agcgcctctcatctgtggcacgtgt

SEQ ID NO: 593571 - DNA, 25 bp, Homo sapien
agcgggctccctatgtgacggcttt

SEQ ID NO: 593572 - DNA, 25 bp, Homo sapien
ctatgtgacggcttttcccacctct

SEQ ID NO: 593573 - DNA, 25 bp, Homo sapien
gaaccacatgttcattcaaatatct

SEQ ID NO: 593574 - DNA, 25 bp, Homo sapien
aatgccagccagtactggacagtga

SEQ ID NO: 593575 - DNA, 25 bp, Homo sapien
ggacagtgaatgtcaaccaccgcag

SEQ ID NO: 593576 - DNA, 25 bp, Homo sapien
gaatgtcaaccaccgcagagtctga

SEQ ID NO: 593577 - DNA, 25 bp, Homo sapien
accgcagagtctgaggctcatttcc

SEQ ID NO: 593578 - DNA, 25 bp, Homo sapien
tccactagagaaaacgaaacccaag

SEQ ID NO: 593579 - DNA, 25 bp, Homo sapien
agggcattagccagactcatgtcta

SEQ ID NO: 593580 - DNA, 25 bp, Homo sapien
gactcatgtctaatgttataagctt

SEQ ID NO: 593581 - DNA, 25 bp, Homo sapien
ttataagcttttagccgagatggcc

SEQ ID NO: 593582 - DNA, 25 bp, Homo sapien
agccgagatggccttgttgcgactt

SEQ ID NO: 593583 - DNA, 25 bp, Homo sapien
ttgttgcgacttccctgaagtcagt

SEQ ID NO: 593584 - DNA, 25 bp, Homo sapien
aatctctatgtaatagctctgtctt

SEQ ID NO: 593585 - DNA, 25 bp, Homo sapien
tctatgtaatagctctgtcttaact

SEQ ID NO: 593586 - DNA, 25 bp, Homo sapien
tgtcttaactggcatccttgattaa

SEQ ID NO: 593587 - DNA, 25 bp, Homo sapien
aactggcatccttgattaatgtttc

SEQ ID NO: 593588 - DNA, 25 bp, Homo sapien
ggcatccttgattaatgtttccaca

SEQ ID NO: 593589 - DNA, 25 bp, Homo sapien
catccttgattaatgtttccacaca

SEQ ID NO: 593590 - DNA, 25 bp, Homo sapien
aatgtttccacacatagcagtgaag

SEQ ID NO: 593591 - DNA, 25 bp, Homo sapien
agcagtgaagagatagtgagttttc

SEQ ID NO: 593592 - DNA, 25 bp, Homo sapien
gtgagttttctaatgatgacactga

SEQ ID NO: 593593 - DNA, 25 bp, Homo sapien
gttttctaatgatgacactgaggtt

SEQ ID NO: 593594 - DNA, 25 bp, Homo sapien
gacactgaggttcaggaaaatcctc

SEQ ID NO: 593595 - DNA, 25 bp, Homo sapien
tttctacacttcactcaaactggca

SEQ ID NO: 593596 - DNA, 25 bp, Homo sapien
ctacacttcactcaaactggcaaaa

SEQ ID NO: 593597 - DNA, 25 bp, Homo sapien
cttcactcaaactggcaaaatgtca

SEQ ID NO: 593598 - DNA, 25 bp, Homo sapien
ggcaaaatgtcaataccagtacact

SEQ ID NO: 593599 - DNA, 25 bp, Homo sapien
aaatgtcaataccagtacactgtga

SEQ ID NO: 593600 - DNA, 25 bp, Homo sapien
gtcaataccagtacactgtgataag

SEQ ID NO: 593601 - DNA, 25 bp, Homo sapien
taccagtacactgtgataagctatg

SEQ ID NO: 593602 - DNA, 25 bp, Homo sapien
agtacactgtgataagctatgtatg

SEQ ID NO: 593603 - DNA, 25 bp, Homo sapien
gaaacactttatcaacaagagcaca

SEQ ID NO: 593604 - DNA, 25 bp, Homo sapien
actttatcaacaagagcacaggaaa

SEQ ID NO: 593605 - DNA, 25 bp, Homo sapien
aaaacagaaatgaaccaggtgtagt

SEQ ID NO: 593606 - DNA, 25 bp, Homo sapien
aatacacttcaagatacctctgtca

SEQ ID NO: 593607 - DNA, 25 bp, Homo sapien
aagatacctctgtcattccaaccct

SEQ ID NO: 593608 - DNA, 25 bp, Homo sapien
caaccctataggagacagtgaactt

SEQ ID NO: 593609 - DNA, 25 bp, Homo sapien
gacagtgaacttgctcactcaccga

SEQ ID NO: 593610 - DNA, 25 bp, Homo sapien
tcactcaccgagcacgttggtactg

SEQ ID NO: 593611 - DNA, 25 bp, Homo sapien
gagcacgttggtactgcaaccagca

SEQ ID NO: 593612 - DNA, 25 bp, Homo sapien
ggtactgcaaccagcatctgaggaa

SEQ ID NO: 593613 - DNA, 25 bp, Homo sapien
gcaaccagcatctgaggaagccatc

SEQ ID NO: 593614 - DNA, 25 bp, Homo sapien
ggaagccatcatacaaagactctct

SEQ ID NO: 593615 - DNA, 25 bp, Homo sapien
cattaaaagtcacatccttaaaggg

SEQ ID NO: 593616 - DNA, 25 bp, Homo sapien
caggagaaactgtctacccaaacta

SEQ ID NO: 593617 - DNA, 25 bp, Homo sapien
tgatggtcagctgggcgcttggaaa

SEQ ID NO: 593618 - DNA, 25 bp, Homo sapien
ggatctctttagtcctggcttccct

SEQ ID NO: 593619 - DNA, 25 bp, Homo sapien
ttcccttgggctcctcagagctagt

SEQ ID NO: 593620 - DNA, 25 bp, Homo sapien
gctgttttgaagtttcctaaacatt

SEQ ID NO: 593621 - DNA, 25 bp, Homo sapien
tttcctaaacatttatggctgggct

SEQ ID NO: 593622 - DNA, 25 bp, Homo sapien
tggctgggctaacatgaactcatca

SEQ ID NO: 593623 - DNA, 25 bp, Homo sapien
catcatggtaacactgggtatttca

SEQ ID NO: 593624 - DNA, 25 bp, Homo sapien
acactgggtatttcagctgatcaga

SEQ ID NO: 593625 - DNA, 25 bp, Homo sapien
gctgatcagaagctcagcatggcca

SEQ ID NO: 593626 - DNA, 25 bp, Homo sapien
gctcagcatggccattatgcctagt

SEQ ID NO: 593627 - DNA, 25 bp, Homo sapien
gcatggccattatgcctagttttga

SEQ ID NO: 593628 - DNA, 25 bp, Homo sapien
tataacacatagagattggcttttg

SEQ ID NO: 593629 - DNA, 25 bp, Homo sapien
cttgagatgcatccaaactgttgtg

SEQ ID NO: 593630 - DNA, 25 bp, Homo sapien
gagatgcatccaaactgttgtgtat

SEQ ID NO: 593631 - DNA, 25 bp, Homo sapien
gcatccaaactgttgtgtatatcag

SEQ ID NO: 593632 - DNA, 25 bp, Homo sapien
gtaatgcaatatgtttaatttctgt

SEQ ID NO: 593633 - DNA, 25 bp, Homo sapien
attccatggtagagatgtgccatag

SEQ ID NO: 593634 - DNA, 25 bp, Homo sapien
gtagagatgtgccatagtttaacta

SEQ ID NO: 593635 - DNA, 25 bp, Homo sapien
atagtttaactattcacctgttgaa

SEQ ID NO: 593636 - DNA, 25 bp, Homo sapien
gtttaactattcacctgttgaacaa

SEQ ID NO: 593637 - DNA, 25 bp, Homo sapien
aactattcacctgttgaacaacatt

SEQ ID NO: 593638 - DNA, 25 bp, Homo sapien
tgaacaacatttgtgttctttctac

SEQ ID NO: 593639 - DNA, 25 bp, Homo sapien
gttgttgatttttgattccgctata

SEQ ID NO: 593640 - DNA, 25 bp, Homo sapien
tttgattccgctatagtcagaaaat

SEQ ID NO: 593641 - DNA, 25 bp, Homo sapien
gtttttggtctagatggtctattgc

SEQ ID NO: 593642 - DNA, 25 bp, Homo sapien
tagatggtctattgctgtattcagt

SEQ ID NO: 593643 - DNA, 25 bp, Homo sapien
tgctgtattcagtgttcactttaaa

SEQ ID NO: 593644 - DNA, 25 bp, Homo sapien
tccacttatttatgggtattttata

SEQ ID NO: 593645 - DNA, 25 bp, Homo sapien
taaatgcctgttagataaaatcggt

SEQ ID NO: 593646 - DNA, 25 bp, Homo sapien
atcggttaattatgttattcaagtc

SEQ ID NO: 593647 - DNA, 25 bp, Homo sapien
tattcaagtcttctggagcctttct

SEQ ID NO: 593648 - DNA, 25 bp, Homo sapien
gtcttctggagcctttctgattttc

SEQ ID NO: 593649 - DNA, 25 bp, Homo sapien
tattaaaacctctgattatggactt

SEQ ID NO: 593650 - DNA, 25 bp, Homo sapien
ttcagcgtggtcttcacctgctcat

SEQ ID NO: 593651 - DNA, 25 bp, Homo sapien
tcagcgtggtcttcacctgctcata

SEQ ID NO: 593652 - DNA, 25 bp, Homo sapien
cagcgtggtcttcacctgctcatac

SEQ ID NO: 593653 - DNA, 25 bp, Homo sapien
agcgtggtcttcacctgctcatact

SEQ ID NO: 593654 - DNA, 25 bp, Homo sapien
gcgtggtcttcacctgctcatactc

SEQ ID NO: 593655 - DNA, 25 bp, Homo sapien
cgtggtcttcacctgctcatactcg

SEQ ID NO: 593656 - DNA, 25 bp, Homo sapien
gtggtcttcacctgctcatactcgc

SEQ ID NO: 593657 - DNA, 25 bp, Homo sapien
tggtcttcacctgctcatactcgct

SEQ ID NO: 593658 - DNA, 25 bp, Homo sapien
tgctcatactcgctctccagctggg

SEQ ID NO: 593659 - DNA, 25 bp, Homo sapien
catactcgctctccagctgggggct

SEQ ID NO: 593660 - DNA, 25 bp, Homo sapien
agctgggggctgaagggcatctcca

SEQ ID NO: 593661 - DNA, 25 bp, Homo sapien
agaaggttggttaccagaagctgga

SEQ ID NO: 593662 - DNA, 25 bp, Homo sapien
aggttggttaccagaagctggaaag

SEQ ID NO: 593663 - DNA, 25 bp, Homo sapien
tgggaggaaggtgggaatggttaat

SEQ ID NO: 593664 - DNA, 25 bp, Homo sapien
aacagtgtgactactgtcaataatc

SEQ ID NO: 593665 - DNA, 25 bp, Homo sapien
acagtgtgactactgtcaataatca

SEQ ID NO: 593666 - DNA, 25 bp, Homo sapien
cagtgtgactactgtcaataatcat

SEQ ID NO: 593667 - DNA, 25 bp, Homo sapien
agtgtgactactgtcaataatcatt

SEQ ID NO: 593668 - DNA, 25 bp, Homo sapien
gtgtgactactgtcaataatcattt

SEQ ID NO: 593669 - DNA, 25 bp, Homo sapien
tgtgactactgtcaataatcattta

SEQ ID NO: 593670 - DNA, 25 bp, Homo sapien
gtgactactgtcaataatcatttaa

SEQ ID NO: 593671 - DNA, 25 bp, Homo sapien
gactactgtcaataatcatttaatt

SEQ ID NO: 593672 - DNA, 25 bp, Homo sapien
tttgtgtcaatcatgaaaaggcgcc

SEQ ID NO: 593673 - DNA, 25 bp, Homo sapien
ttgtgtcaatcatgaaaaggcgccg

SEQ ID NO: 593674 - DNA, 25 bp, Homo sapien
tgtgtcaatcatgaaaaggcgccgg

SEQ ID NO: 593675 - DNA, 25 bp, Homo sapien
gtgtcaatcatgaaaaggcgccggc

SEQ ID NO: 593676 - DNA, 25 bp, Homo sapien
tgtcaatcatgaaaaggcgccggcc

SEQ ID NO: 593677 - DNA, 25 bp, Homo sapien
gtcaatcatgaaaaggcgccggccg

SEQ ID NO: 593678 - DNA, 25 bp, Homo sapien
tcaatcatgaaaaggcgccggccgg

SEQ ID NO: 593679 - DNA, 25 bp, Homo sapien
caatcatgaaaaggcgccggccggg

SEQ ID NO: 593680 - DNA, 25 bp, Homo sapien
aatcatgaaaaggcgccggccgggc

SEQ ID NO: 593681 - DNA, 25 bp, Homo sapien
tcatgaaaaggcgccggccgggcgc

SEQ ID NO: 593682 - DNA, 25 bp, Homo sapien
catgaaaaggcgccggccgggcgcg

SEQ ID NO: 593683 - DNA, 25 bp, Homo sapien
cagcttcttggcgtctccttgttgc

SEQ ID NO: 593684 - DNA, 25 bp, Homo sapien
ttcttggcgtctccttgttgccttc

SEQ ID NO: 593685 - DNA, 25 bp, Homo sapien
tggcgtctccttgttgccttctcag

SEQ ID NO: 593686 - DNA, 25 bp, Homo sapien
acacacacgcggtcacctgactttg

SEQ ID NO: 593687 - DNA, 25 bp, Homo sapien
acacgcggtcacctgactttgctca

SEQ ID NO: 593688 - DNA, 25 bp, Homo sapien
gttgggtgggtatttccttctacag

SEQ ID NO: 593689 - DNA, 25 bp, Homo sapien
tgggtgggtatttccttctacaggg

SEQ ID NO: 593690 - DNA, 25 bp, Homo sapien
gtgggtatttccttctacagggtca

SEQ ID NO: 593691 - DNA, 25 bp, Homo sapien
gggtatttccttctacagggtcact

SEQ ID NO: 593692 - DNA, 25 bp, Homo sapien
ggtatttccttctacagggtcactg

SEQ ID NO: 593693 - DNA, 25 bp, Homo sapien
tatttccttctacagggtcactggg

SEQ ID NO: 593694 - DNA, 25 bp, Homo sapien
caacagacatcctccacattgtgca

SEQ ID NO: 593695 - DNA, 25 bp, Homo sapien
agacatcctccacattgtgcacact

SEQ ID NO: 593696 - DNA, 25 bp, Homo sapien
atcctccacattgtgcacactggtt

SEQ ID NO: 593697 - DNA, 25 bp, Homo sapien
tccacattgtgcacactggttttgc

SEQ ID NO: 593698 - DNA, 25 bp, Homo sapien
cactggttttgcctttgtcctcaag

SEQ ID NO: 593699 - DNA, 25 bp, Homo sapien
ctttgtcctcaagagttgatacttg

SEQ ID NO: 593700 - DNA, 25 bp, Homo sapien
gtcctcaagagttgatacttggcat

SEQ ID NO: 593701 - DNA, 25 bp, Homo sapien
aagagttgatacttggcattagcat

SEQ ID NO: 593702 - DNA, 25 bp, Homo sapien
cttggcattagcatgaaacttgtgg

SEQ ID NO: 593703 - DNA, 25 bp, Homo sapien
gcattagcatgaaacttgtgggtgt

SEQ ID NO: 593704 - DNA, 25 bp, Homo sapien
aaaactctgttgtattttgacagaa

SEQ ID NO: 593705 - DNA, 25 bp, Homo sapien
gaaaaggaatcttctatttggttag

SEQ ID NO: 593706 - DNA, 25 bp, Homo sapien
ggaatcttctatttggttagtgcca

SEQ ID NO: 593707 - DNA, 25 bp, Homo sapien
aatcttctatttggttagtgccacc

SEQ ID NO: 593708 - DNA, 25 bp, Homo sapien
tcttctatttggttagtgccaccat

SEQ ID NO: 593709 - DNA, 25 bp, Homo sapien
cttctatttggttagtgccaccata

SEQ ID NO: 593710 - DNA, 25 bp, Homo sapien
tctatttggttagtgccaccatacc

SEQ ID NO: 593711 - DNA, 25 bp, Homo sapien
tatttggttagtgccaccataccat

SEQ ID NO: 593712 - DNA, 25 bp, Homo sapien
tttggttagtgccaccataccatcc

SEQ ID NO: 593713 - DNA, 25 bp, Homo sapien
ccagacactgtttagtaatcttttg

SEQ ID NO: 593714 - DNA, 25 bp, Homo sapien
gacactgtttagtaatcttttgaaa

SEQ ID NO: 593715 - DNA, 25 bp, Homo sapien
gtttttaataatgaggtccttctgt

SEQ ID NO: 593716 - DNA, 25 bp, Homo sapien
ctgggtctccgtttctctagctgtg

SEQ ID NO: 593717 - DNA, 25 bp, Homo sapien
tctctagctgtgaaatgactgttct

SEQ ID NO: 593718 - DNA, 25 bp, Homo sapien
gactgttctaaaagagccctgccgg

SEQ ID NO: 593719 - DNA, 25 bp, Homo sapien
tgttctaaaagagccctgccggact

SEQ ID NO: 593720 - DNA, 25 bp, Homo sapien
cctgccggactttggcagtctgtaa

SEQ ID NO: 593721 - DNA, 25 bp, Homo sapien
gcagtctgtaagaagacctgagttc

SEQ ID NO: 593722 - DNA, 25 bp, Homo sapien
tcttctctcagttccaagcaggaaa

SEQ ID NO: 593723 - DNA, 25 bp, Homo sapien
caggaaaattgaacgtaccctgagc

SEQ ID NO: 593724 - DNA, 25 bp, Homo sapien
gagcctgcaacaaactctgggcagc

SEQ ID NO: 593725 - DNA, 25 bp, Homo sapien
gaagtcaggcagtgaagtcggaaaa

SEQ ID NO: 593726 - DNA, 25 bp, Homo sapien
atgatctcttctgtatagggagaaa

SEQ ID NO: 593727 - DNA, 25 bp, Homo sapien
ctgaggggccgaactaccgctcgga

SEQ ID NO: 593728 - DNA, 25 bp, Homo sapien
aggggccgaactaccgctcggagct

SEQ ID NO: 593729 - DNA, 25 bp, Homo sapien
gccgaactaccgctcggagctccac

SEQ ID NO: 593730 - DNA, 25 bp, Homo sapien
cgaactaccgctcggagctccacat

SEQ ID NO: 593731 - DNA, 25 bp, Homo sapien
aactaccgctcggagctccacatct

SEQ ID NO: 593732 - DNA, 25 bp, Homo sapien
actaccgctcggagctccacatctt

SEQ ID NO: 593733 - DNA, 25 bp, Homo sapien
ctaccgctcggagctccacatcttc

SEQ ID NO: 593734 - DNA, 25 bp, Homo sapien
taccgctcggagctccacatcttcc

SEQ ID NO: 593735 - DNA, 25 bp, Homo sapien
tcggagctccacatcttcccggcct

SEQ ID NO: 593736 - DNA, 25 bp, Homo sapien
ggagctccacatcttcccggcctca

SEQ ID NO: 593737 - DNA, 25 bp, Homo sapien
tgcagccgcccctgctgggtgcgtc

SEQ ID NO: 593738 - DNA, 25 bp, Homo sapien
tcttgtcaaaagagtgctgggcacc

SEQ ID NO: 593739 - DNA, 25 bp, Homo sapien
actcccagcatttctggcacgttag

SEQ ID NO: 593740 - DNA, 25 bp, Homo sapien
cagcatttctggcacgttagatttg

SEQ ID NO: 593741 - DNA, 25 bp, Homo sapien
catttctggcacgttagatttggga

SEQ ID NO: 593742 - DNA, 25 bp, Homo sapien
gcacgttagatttgggatggcgccc

SEQ ID NO: 593743 - DNA, 25 bp, Homo sapien
tgggatggcgcccaataacttgcat

SEQ ID NO: 593744 - DNA, 25 bp, Homo sapien
tgtccaggaaacacaatttgagagt

SEQ ID NO: 593745 - DNA, 25 bp, Homo sapien
tttgagagtcatgtgaaacgtgctt

SEQ ID NO: 593746 - DNA, 25 bp, Homo sapien
gagtcatgtgaaacgtgcttgaagg

SEQ ID NO: 593747 - DNA, 25 bp, Homo sapien
ctcaaaagaagggtcagtgtgtgct

SEQ ID NO: 593748 - DNA, 25 bp, Homo sapien
gtgctgggggacttttgccttgttt

SEQ ID NO: 593749 - DNA, 25 bp, Homo sapien
ggtgacatgccactagatctgcaat

SEQ ID NO: 593750 - DNA, 25 bp, Homo sapien
gacatgccactagatctgcaattta

SEQ ID NO: 593751 - DNA, 25 bp, Homo sapien
catgccactagatctgcaatttaac

SEQ ID NO: 593752 - DNA, 25 bp, Homo sapien
aacttaaaatggttcagagaaggct

SEQ ID NO: 593753 - DNA, 25 bp, Homo sapien
tagccaggcacagtgtcgtgcacct

SEQ ID NO: 593754 - DNA, 25 bp, Homo sapien
aggcacagtgtcgtgcacctgcagt

SEQ ID NO: 593755 - DNA, 25 bp, Homo sapien
gagtcagagggatcccttgagcaca

SEQ ID NO: 593756 - DNA, 25 bp, Homo sapien
agagggatcccttgagcacaagagt

SEQ ID NO: 593757 - DNA, 25 bp, Homo sapien
gcaatgagctgttattgagccaccg

SEQ ID NO: 593758 - DNA, 25 bp, Homo sapien
tgagctgttattgagccaccgtact

SEQ ID NO: 593759 - DNA, 25 bp, Homo sapien
agctgttattgagccaccgtactca

SEQ ID NO: 593760 - DNA, 25 bp, Homo sapien
acctgcacatgaagacctttgcata

SEQ ID NO: 593761 - DNA, 25 bp, Homo sapien
tgcacatgaagacctttgcatacat

SEQ ID NO: 593762 - DNA, 25 bp, Homo sapien
tgacatcatcaggtttgtactctgg

SEQ ID NO: 593763 - DNA, 25 bp, Homo sapien
acatcatcaggtttgtactctggtg

SEQ ID NO: 593764 - DNA, 25 bp, Homo sapien
tcatcaggtttgtactctggtgtct

SEQ ID NO: 593765 - DNA, 25 bp, Homo sapien
atcaggtttgtactctggtgtcttg

SEQ ID NO: 593766 - DNA, 25 bp, Homo sapien
caggtttgtactctggtgtcttggt

SEQ ID NO: 593767 - DNA, 25 bp, Homo sapien
tttgtactctggtgtcttggtgccc

SEQ ID NO: 593768 - DNA, 25 bp, Homo sapien
tgtactctggtgtcttggtgccctt

SEQ ID NO: 593769 - DNA, 25 bp, Homo sapien
actctggtgtcttggtgcccttttg

SEQ ID NO: 593770 - DNA, 25 bp, Homo sapien
tggtgtcttggtgcccttttgccct

SEQ ID NO: 593771 - DNA, 25 bp, Homo sapien
gcatgtcctcaaactccactggctt

SEQ ID NO: 593772 - DNA, 25 bp, Homo sapien
tccactggctttaaagagggtctag

SEQ ID NO: 593773 - DNA, 25 bp, Homo sapien
ggcaagacaggcagacagcgataag

SEQ ID NO: 593774 - DNA, 25 bp, Homo sapien
gcagacagcgataaggaggttcaga

SEQ ID NO: 593775 - DNA, 25 bp, Homo sapien
cgataaggaggttcagagagacagc

SEQ ID NO: 593776 - DNA, 25 bp, Homo sapien
atgggctgcctctcgccccaggtat

SEQ ID NO: 593777 - DNA, 25 bp, Homo sapien
tcgccccaggtatgttggcacagct

SEQ ID NO: 593778 - DNA, 25 bp, Homo sapien
ttctggcctcaaagatgatgacagg

SEQ ID NO: 593779 - DNA, 25 bp, Homo sapien
aaagatgatgacaggacaacaggac

SEQ ID NO: 593780 - DNA, 25 bp, Homo sapien
aggagcggttcctgacccatgattt

SEQ ID NO: 593781 - DNA, 25 bp, Homo sapien
agcggttcctgacccatgatttgaa

SEQ ID NO: 593782 - DNA, 25 bp, Homo sapien
aaaagcaatggcatgctgctccacg

SEQ ID NO: 593783 - DNA, 25 bp, Homo sapien
aatggcatgctgctccacgctgtag

SEQ ID NO: 593784 - DNA, 25 bp, Homo sapien
tccacgctgtagcagggatagacct

SEQ ID NO: 593785 - DNA, 25 bp, Homo sapien
tagacctgggaaacatcgtgaaact

SEQ ID NO: 593786 - DNA, 25 bp, Homo sapien
tcgtgaaactcagtggaagaagcca

SEQ ID NO: 593787 - DNA, 25 bp, Homo sapien
gaagcccaagtattgtatcatccct

SEQ ID NO: 593788 - DNA, 25 bp, Homo sapien
tgtatcatccctatgaaatgtccag

SEQ ID NO: 593789 - DNA, 25 bp, Homo sapien
gaaatgtccagaactgcagattcct

SEQ ID NO: 593790 - DNA, 25 bp, Homo sapien
agaactgcagattcctagagacaca

SEQ ID NO: 593791 - DNA, 25 bp, Homo sapien
gcagatgacagattgcccgggcaga

SEQ ID NO: 593792 - DNA, 25 bp, Homo sapien
ttctggaaatggtggtggctgcaca

SEQ ID NO: 593793 - DNA, 25 bp, Homo sapien
aaaaatacatactggccaggtgcgg

SEQ ID NO: 593794 - DNA, 25 bp, Homo sapien
cgcgcccggccagggactttcatct

SEQ ID NO: 593795 - DNA, 25 bp, Homo sapien
agggactttcatctccctcagatgt

SEQ ID NO: 593796 - DNA, 25 bp, Homo sapien
gggactttcatctccctcagatgtc

SEQ ID NO: 593797 - DNA, 25 bp, Homo sapien
ggactttcatctccctcagatgtcc

SEQ ID NO: 593798 - DNA, 25 bp, Homo sapien
actttcatctccctcagatgtcccc

SEQ ID NO: 593799 - DNA, 25 bp, Homo sapien
tttcatctccctcagatgtcccctt

SEQ ID NO: 593800 - DNA, 25 bp, Homo sapien
ttcatctccctcagatgtccccttg

SEQ ID NO: 593801 - DNA, 25 bp, Homo sapien
tcatctccctcagatgtccccttga

SEQ ID NO: 593802 - DNA, 25 bp, Homo sapien
atctccctcagatgtccccttgacc

SEQ ID NO: 593803 - DNA, 25 bp, Homo sapien
cctcagatgtccccttgaccccagg

SEQ ID NO: 593804 - DNA, 25 bp, Homo sapien
tgctctctagacttagggcctctag

SEQ ID NO: 593805 - DNA, 25 bp, Homo sapien
gctctctagacttagggcctctagc

SEQ ID NO: 593806 - DNA, 25 bp, Homo sapien
ctctctagacttagggcctctagcc

SEQ ID NO: 593807 - DNA, 25 bp, Homo sapien
tctctagacttagggcctctagccg

SEQ ID NO: 593808 - DNA, 25 bp, Homo sapien
tagacttagggcctctagccgcaag

SEQ ID NO: 593809 - DNA, 25 bp, Homo sapien
agacttagggcctctagccgcaagc

SEQ ID NO: 593810 - DNA, 25 bp, Homo sapien
gacttagggcctctagccgcaagca

SEQ ID NO: 593811 - DNA, 25 bp, Homo sapien
acttagggcctctagccgcaagcac

SEQ ID NO: 593812 - DNA, 25 bp, Homo sapien
ttagggcctctagccgcaagcaccc

SEQ ID NO: 593813 - DNA, 25 bp, Homo sapien
tctagccgcaagcacccctcagtac

SEQ ID NO: 593814 - DNA, 25 bp, Homo sapien
aagcacccctcagtactcctcacta

SEQ ID NO: 593815 - DNA, 25 bp, Homo sapien
gcattttgtgcaatttagaaattac

SEQ ID NO: 593816 - DNA, 25 bp, Homo sapien
gaaattacttcaggcatgtgactag

SEQ ID NO: 593817 - DNA, 25 bp, Homo sapien
cttcaggcatgtgactagtaagcat

SEQ ID NO: 593818 - DNA, 25 bp, Homo sapien
atgtgactagtaagcatgttagtgc

SEQ ID NO: 593819 - DNA, 25 bp, Homo sapien
gcatgttagtgctaatactatctat

SEQ ID NO: 593820 - DNA, 25 bp, Homo sapien
agtgctaatactatctatgcagagg

SEQ ID NO: 593821 - DNA, 25 bp, Homo sapien
ctaatactatctatgcagaggagca

SEQ ID NO: 593822 - DNA, 25 bp, Homo sapien
ctatctatgcagaggagcaagtaca

SEQ ID NO: 593823 - DNA, 25 bp, Homo sapien
cagaggagcaagtacagtgtgaaat

SEQ ID NO: 593824 - DNA, 25 bp, Homo sapien
aaggaatgcgaacatttatgtgaaa

SEQ ID NO: 593825 - DNA, 25 bp, Homo sapien
gaaatgtgtattcatgctaaatctg

SEQ ID NO: 593826 - DNA, 25 bp, Homo sapien
gggagggagctacccccaggagaag

SEQ ID NO: 593827 - DNA, 25 bp, Homo sapien
ccccaggagaagagtcactcagaca

SEQ ID NO: 593828 - DNA, 25 bp, Homo sapien
agaagagtcactcagacagcagtat

SEQ ID NO: 593829 - DNA, 25 bp, Homo sapien
aagagtcactcagacagcagtatga

SEQ ID NO: 593830 - DNA, 25 bp, Homo sapien
gtcactcagacagcagtatgagcaa

SEQ ID NO: 593831 - DNA, 25 bp, Homo sapien
tcagacagcagtatgagcaagccag

SEQ ID NO: 593832 - DNA, 25 bp, Homo sapien
gacagcagtatgagcaagccagcca

SEQ ID NO: 593833 - DNA, 25 bp, Homo sapien
cagcagtatgagcaagccagccagc

SEQ ID NO: 593834 - DNA, 25 bp, Homo sapien
aagccagccagcagctccgtgcctg

SEQ ID NO: 593835 - DNA, 25 bp, Homo sapien
gaatcccagggggttcagatgccca

SEQ ID NO: 593836 - DNA, 25 bp, Homo sapien
gttcagatgcccaggaaggaaaagg

SEQ ID NO: 593837 - DNA, 25 bp, Homo sapien
acccagactgattaactggctcatg

SEQ ID NO: 593838 - DNA, 25 bp, Homo sapien
cccagactgattaactggctcatgt

SEQ ID NO: 593839 - DNA, 25 bp, Homo sapien
ccagactgattaactggctcatgtg

SEQ ID NO: 593840 - DNA, 25 bp, Homo sapien
cagactgattaactggctcatgtga

SEQ ID NO: 593841 - DNA, 25 bp, Homo sapien
agactgattaactggctcatgtgat

SEQ ID NO: 593842 - DNA, 25 bp, Homo sapien
gactgattaactggctcatgtgatc

SEQ ID NO: 593843 - DNA, 25 bp, Homo sapien
actgattaactggctcatgtgatct

SEQ ID NO: 593844 - DNA, 25 bp, Homo sapien
ctgattaactggctcatgtgatctt

SEQ ID NO: 593845 - DNA, 25 bp, Homo sapien
tgattaactggctcatgtgatcttg

SEQ ID NO: 593846 - DNA, 25 bp, Homo sapien
gattaactggctcatgtgatcttgt

SEQ ID NO: 593847 - DNA, 25 bp, Homo sapien
taactggctcatgtgatcttgtggt

SEQ ID NO: 593848 - DNA, 25 bp, Homo sapien
tagaaatttgcacctcatcatgccc

SEQ ID NO: 593849 - DNA, 25 bp, Homo sapien
ctcatcatgccccagaaataatcct

SEQ ID NO: 593850 - DNA, 25 bp, Homo sapien
aatccttctgaagcaaagcaccacg

SEQ ID NO: 593851 - DNA, 25 bp, Homo sapien
gaagcaaagcaccacgaatgaggtt

SEQ ID NO: 593852 - DNA, 25 bp, Homo sapien
taagggacaccagaaaatttgtact

SEQ ID NO: 593853 - DNA, 25 bp, Homo sapien
gcatatgattaaaaccctgtgtcca

SEQ ID NO: 593854 - DNA, 25 bp, Homo sapien
aaccctgtgtccaacagagaaacct

SEQ ID NO: 593855 - DNA, 25 bp, Homo sapien
atggtgaaagtttaggcacattttc

SEQ ID NO: 593856 - DNA, 25 bp, Homo sapien
gaggcctgttttttattgctaccac

SEQ ID NO: 593857 - DNA, 25 bp, Homo sapien
attgctaccaccatagatctggaga

SEQ ID NO: 593858 - DNA, 25 bp, Homo sapien
gatctggagatcttcgccagtaaca

SEQ ID NO: 593859 - DNA, 25 bp, Homo sapien
cagtgaaccgaaccgagatcgcgtc

SEQ ID NO: 593860 - DNA, 25 bp, Homo sapien
gtgaaccgaaccgagatcgcgtcgc

SEQ ID NO: 593861 - DNA, 25 bp, Homo sapien
tgaaccgaaccgagatcgcgtcgct

SEQ ID NO: 593862 - DNA, 25 bp, Homo sapien
gaaccgaaccgagatcgcgtcgctg

SEQ ID NO: 593863 - DNA, 25 bp, Homo sapien
aaccgaaccgagatcgcgtcgctgg

SEQ ID NO: 593864 - DNA, 25 bp, Homo sapien
accgaaccgagatcgcgtcgctgga

SEQ ID NO: 593865 - DNA, 25 bp, Homo sapien
ccgaaccgagatcgcgtcgctggac

SEQ ID NO: 593866 - DNA, 25 bp, Homo sapien
cgaaccgagatcgcgtcgctggact

SEQ ID NO: 593867 - DNA, 25 bp, Homo sapien
gaaccgagatcgcgtcgctggactc

SEQ ID NO: 593868 - DNA, 25 bp, Homo sapien
gatcgcgtcgctggactccagcccg

SEQ ID NO: 593869 - DNA, 25 bp, Homo sapien
tcgcgtcgctggactccagcccggg

SEQ ID NO: 593870 - DNA, 25 bp, Homo sapien
ggctcactctgggagtcctggcagc

SEQ ID NO: 593871 - DNA, 25 bp, Homo sapien
actctgggagtcctggcagctgttc

SEQ ID NO: 593872 - DNA, 25 bp, Homo sapien
gggagtcctggcagctgttcgcatc

SEQ ID NO: 593873 - DNA, 25 bp, Homo sapien
agctgttcgcatcctggctggcgtt

SEQ ID NO: 593874 - DNA, 25 bp, Homo sapien
tggctggcgttctggagcccctcct

SEQ ID NO: 593875 - DNA, 25 bp, Homo sapien
tggagcccctccttcagcgtggtct

SEQ ID NO: 593876 - DNA, 25 bp, Homo sapien
agcgtggtcttcacctgctcatact

SEQ ID NO: 593877 - DNA, 25 bp, Homo sapien
tgctcatactcgctctccagctggg

SEQ ID NO: 593878 - DNA, 25 bp, Homo sapien
tgaagggcatctccagcaggaccag

SEQ ID NO: 593879 - DNA, 25 bp, Homo sapien
ccagcaggaccagggatgggttctc

SEQ ID NO: 593880 - DNA, 25 bp, Homo sapien
tggcctgacgttctcgttgcatcaa

SEQ ID NO: 593881 - DNA, 25 bp, Homo sapien
tttaatttcctgtgatttcctgtga

SEQ ID NO: 593882 - DNA, 25 bp, Homo sapien
taatttcctgtgatttcctgtgatc

SEQ ID NO: 593883 - DNA, 25 bp, Homo sapien
aatttcctgtgatttcctgtgatca

SEQ ID NO: 593884 - DNA, 25 bp, Homo sapien
tttcctgtgatttcctgtgatcata

SEQ ID NO: 593885 - DNA, 25 bp, Homo sapien
tcctgtgatttcctgtgatcataaa

SEQ ID NO: 593886 - DNA, 25 bp, Homo sapien
gatttcctgtgatcataaagctctg

SEQ ID NO: 593887 - DNA, 25 bp, Homo sapien
gtgatcataaagctctgtcagaagt

SEQ ID NO: 593888 - DNA, 25 bp, Homo sapien
tgatcataaagctctgtcagaagtt

SEQ ID NO: 593889 - DNA, 25 bp, Homo sapien
tcataaagctctgtcagaagttttc

SEQ ID NO: 593890 - DNA, 25 bp, Homo sapien
ttctcctggactgaattattataac

SEQ ID NO: 593891 - DNA, 25 bp, Homo sapien
tcctggactgaattattataacaat

SEQ ID NO: 593892 - DNA, 25 bp, Homo sapien
cagcttcttggcgtctccttgttgc

SEQ ID NO: 593893 - DNA, 25 bp, Homo sapien
tcgtcactgatttgcacgcacacac

SEQ ID NO: 593894 - DNA, 25 bp, Homo sapien
acctgactttgctcagccatcagga

SEQ ID NO: 593895 - DNA, 25 bp, Homo sapien
tcagccatcaggaccctcctttggg

SEQ ID NO: 593896 - DNA, 25 bp, Homo sapien
cagccatcaggaccctcctttggga

SEQ ID NO: 593897 - DNA, 25 bp, Homo sapien
gccatcaggaccctcctttgggatc

SEQ ID NO: 593898 - DNA, 25 bp, Homo sapien
tcaggaccctcctttgggatcccct

SEQ ID NO: 593899 - DNA, 25 bp, Homo sapien
tgacccatctctcaggcttcaacag

SEQ ID NO: 593900 - DNA, 25 bp, Homo sapien
gacccatctctcaggcttcaacaga

SEQ ID NO: 593901 - DNA, 25 bp, Homo sapien
gttgggtgggtatttccttctacag

SEQ ID NO: 593902 - DNA, 25 bp, Homo sapien
tatttccttctacagggtcactggg

SEQ ID NO: 593903 - DNA, 25 bp, Homo sapien
tctagagcctttgaggtcactcctg

SEQ ID NO: 593904 - DNA, 25 bp, Homo sapien
agagcctttgaggtcactcctgacg

SEQ ID NO: 593905 - DNA, 25 bp, Homo sapien
tttgaggtcactcctgacgctgaca

SEQ ID NO: 593906 - DNA, 25 bp, Homo sapien
tgaggtcactcctgacgctgacatg

SEQ ID NO: 593907 - DNA, 25 bp, Homo sapien
aggtcactcctgacgctgacatggc

SEQ ID NO: 593908 - DNA, 25 bp, Homo sapien
actcctgacgctgacatggctgtga

SEQ ID NO: 593909 - DNA, 25 bp, Homo sapien
cctgacgctgacatggctgtgaaga

SEQ ID NO: 593910 - DNA, 25 bp, Homo sapien
gtgccaggcattactgcctccaagg

SEQ ID NO: 593911 - DNA, 25 bp, Homo sapien
ggcattactgcctccaaggttgctt

SEQ ID NO: 593912 - DNA, 25 bp, Homo sapien
attactgcctccaaggttgctttgc

SEQ ID NO: 593913 - DNA, 25 bp, Homo sapien
actgcctccaaggttgctttgcgag

SEQ ID NO: 593914 - DNA, 25 bp, Homo sapien
attcaaatcttcctgctatagtgtg

SEQ ID NO: 593915 - DNA, 25 bp, Homo sapien
aatcttcctgctatagtgtgaatgt

SEQ ID NO: 593916 - DNA, 25 bp, Homo sapien
ttaacctccaagctgatggtattag

SEQ ID NO: 593917 - DNA, 25 bp, Homo sapien
gagattagtgcccttgtgaattagg

SEQ ID NO: 593918 - DNA, 25 bp, Homo sapien
agtgcccttgtgaattaggcctgag

SEQ ID NO: 593919 - DNA, 25 bp, Homo sapien
ttaggcctgagagagatcccctcat

SEQ ID NO: 593920 - DNA, 25 bp, Homo sapien
atcccctcatctcaccatgtaagga

SEQ ID NO: 593921 - DNA, 25 bp, Homo sapien
agaaggtgctatctttgaaccagga

SEQ ID NO: 593922 - DNA, 25 bp, Homo sapien
tgaacctgccgatacctcaatcttg

SEQ ID NO: 593923 - DNA, 25 bp, Homo sapien
gatacctcaatcttgtccttctcag

SEQ ID NO: 593924 - DNA, 25 bp, Homo sapien
aatcttgtccttctcagtctccaga

SEQ ID NO: 593925 - DNA, 25 bp, Homo sapien
ttccctctctgtcaagagctcggta

SEQ ID NO: 593926 - DNA, 25 bp, Homo sapien
aagagctcggtatacggaccctgca

SEQ ID NO: 593927 - DNA, 25 bp, Homo sapien
cccgtcttcgacagctgggagaatg

SEQ ID NO: 593928 - DNA, 25 bp, Homo sapien
agctgggagaatggcacaggcttcc

SEQ ID NO: 593929 - DNA, 25 bp, Homo sapien
ggcacaggcttccagaacatgtcct

SEQ ID NO: 593930 - DNA, 25 bp, Homo sapien
aacatgtcctgctgggtgcggagcc

SEQ ID NO: 593931 - DNA, 25 bp, Homo sapien
ggagccccgtggtgcacagtgtcct

SEQ ID NO: 593932 - DNA, 25 bp, Homo sapien
tgcacagtgtcctggtcatgggcta

SEQ ID NO: 593933 - DNA, 25 bp, Homo sapien
gtccctcttcaacctggtggtgctg

SEQ ID NO: 593934 - DNA, 25 bp, Homo sapien
aagtgtcagggcctgccatgacact

SEQ ID NO: 593935 - DNA, 25 bp, Homo sapien
ggcctgccatgacactgtcactgtg

SEQ ID NO: 593936 - DNA, 25 bp, Homo sapien
caacttcctaagttaagcctcaagt

SEQ ID NO: 593937 - DNA, 25 bp, Homo sapien
gttaagcctcaagtgagaatctcag

SEQ ID NO: 593938 - DNA, 25 bp, Homo sapien
gagaatctcagcaaattgactttta

SEQ ID NO: 593939 - DNA, 25 bp, Homo sapien
ggtccagtgtggtgaatcctatagt

SEQ ID NO: 593940 - DNA, 25 bp, Homo sapien
gtgctagtttagatgccctgtttgc

SEQ ID NO: 593941 - DNA, 25 bp, Homo sapien
agatgccctgtttgcgtctaatcat

SEQ ID NO: 593942 - DNA, 25 bp, Homo sapien
gccctgtttgcgtctaatcatttta

SEQ ID NO: 593943 - DNA, 25 bp, Homo sapien
gcgtctaatcattttatgtcgaaaa

SEQ ID NO: 593944 - DNA, 25 bp, Homo sapien
aaacaatgtgaaccgggacctctga

SEQ ID NO: 593945 - DNA, 25 bp, Homo sapien
tgaaccgggacctctgatcttcatt

SEQ ID NO: 593946 - DNA, 25 bp, Homo sapien
tgatcttcattcctgttcccttttt

SEQ ID NO: 593947 - DNA, 25 bp, Homo sapien
gggcgggaggtcgtcggtggcctct

SEQ ID NO: 593948 - DNA, 25 bp, Homo sapien
gcgggaggtcgtcggtggcctctga

SEQ ID NO: 593949 - DNA, 25 bp, Homo sapien
tcgtcggtggcctctgagaacccgc

SEQ ID NO: 593950 - DNA, 25 bp, Homo sapien
tggcctctgagaacccgcccctgtg

SEQ ID NO: 593951 - DNA, 25 bp, Homo sapien
cctgtgcccaggttgccaatgccaa

SEQ ID NO: 593952 - DNA, 25 bp, Homo sapien
cctggcgccaggtgagtggcctcct

SEQ ID NO: 593953 - DNA, 25 bp, Homo sapien
ggcgccaggtgagtggcctcctcgg

SEQ ID NO: 593954 - DNA, 25 bp, Homo sapien
cgccaggtgagtggcctcctcgggt

SEQ ID NO: 593955 - DNA, 25 bp, Homo sapien
aggtgagtggcctcctcgggtcccg

SEQ ID NO: 593956 - DNA, 25 bp, Homo sapien
tgagtggcctcctcgggtcccggga

SEQ ID NO: 593957 - DNA, 25 bp, Homo sapien
tggcctcctcgggtcccgggaccag

SEQ ID NO: 593958 - DNA, 25 bp, Homo sapien
tagcctatattttgcgtagttgtgt

SEQ ID NO: 593959 - DNA, 25 bp, Homo sapien
gcgtagttgtgttcattagtttgct

SEQ ID NO: 593960 - DNA, 25 bp, Homo sapien
ctattgaaagcttaactttttctgt

SEQ ID NO: 593961 - DNA, 25 bp, Homo sapien
tttctcatcacttagtatctttgta

SEQ ID NO: 593962 - DNA, 25 bp, Homo sapien
agtatctttgtatagaacttgagta

SEQ ID NO: 593963 - DNA, 25 bp, Homo sapien
gaacttgagtaatttattcgttaat

SEQ ID NO: 593964 - DNA, 25 bp, Homo sapien
gaaatgttggtattatgtgactcag

SEQ ID NO: 593965 - DNA, 25 bp, Homo sapien
gactcagaagatcttgggttttaac

SEQ ID NO: 593966 - DNA, 25 bp, Homo sapien
gggttttaacatttctagcatgagt

SEQ ID NO: 593967 - DNA, 25 bp, Homo sapien
gaaatatccttgactagaaacactg

SEQ ID NO: 593968 - DNA, 25 bp, Homo sapien
atccttgactagaaacactgatgtt

SEQ ID NO: 593969 - DNA, 25 bp, Homo sapien
aaagagagccaagactaagttacct

SEQ ID NO: 593970 - DNA, 25 bp, Homo sapien
gccaagactaagttacctcaagact

SEQ ID NO: 593971 - DNA, 25 bp, Homo sapien
gactaagttacctcaagactatgta

SEQ ID NO: 593972 - DNA, 25 bp, Homo sapien
tcaagactatgtattcctccctatt

SEQ ID NO: 593973 - DNA, 25 bp, Homo sapien
agactatgtattcctccctattttg

SEQ ID NO: 593974 - DNA, 25 bp, Homo sapien
atgtattcctccctattttggagtc

SEQ ID NO: 593975 - DNA, 25 bp, Homo sapien
gtcagtttccatttctacagtgttg

SEQ ID NO: 593976 - DNA, 25 bp, Homo sapien
agtttccatttctacagtgttgtca

SEQ ID NO: 593977 - DNA, 25 bp, Homo sapien
tttctacagtgttgtcatcatcacc

SEQ ID NO: 593978 - DNA, 25 bp, Homo sapien
agtacatctaataaggtccttctgt

SEQ ID NO: 593979 - DNA, 25 bp, Homo sapien
acatctaataaggtccttctgtagt

SEQ ID NO: 593980 - DNA, 25 bp, Homo sapien
gattattttccctagatgtgataaa

SEQ ID NO: 593981 - DNA, 25 bp, Homo sapien
agaggaggatccatgttaattcata

SEQ ID NO: 593982 - DNA, 25 bp, Homo sapien
gaggatccatgttaattcatatgta

SEQ ID NO: 593983 - DNA, 25 bp, Homo sapien
ggaccctaatagtagtaggtgatgc

SEQ ID NO: 593984 - DNA, 25 bp, Homo sapien
gtagtaggtgatgcaatacatttta

SEQ ID NO: 593985 - DNA, 25 bp, Homo sapien
attatcccacatgttagcctggatg

SEQ ID NO: 593986 - DNA, 25 bp, Homo sapien
tcccacatgttagcctggatgcagg

SEQ ID NO: 593987 - DNA, 25 bp, Homo sapien
gttagcctggatgcaggtatcatat

SEQ ID NO: 593988 - DNA, 25 bp, Homo sapien
atttcatgtcctgctatttaaaaag

SEQ ID NO: 593989 - DNA, 25 bp, Homo sapien
taaaccttaggaatcctacctcctg

SEQ ID NO: 593990 - DNA, 25 bp, Homo sapien
tgcagagcttagagattggagtatt

SEQ ID NO: 593991 - DNA, 25 bp, Homo sapien
tgaacctgggcagtgaaggctgcaa

SEQ ID NO: 593992 - DNA, 25 bp, Homo sapien
gaacctgggcagtgaaggctgcaat

SEQ ID NO: 593993 - DNA, 25 bp, Homo sapien
aacctgggcagtgaaggctgcaatg

SEQ ID NO: 593994 - DNA, 25 bp, Homo sapien
tcgatctcaaacaacaaaacgccat

SEQ ID NO: 593995 - DNA, 25 bp, Homo sapien
cgatctcaaacaacaaaacgccata

SEQ ID NO: 593996 - DNA, 25 bp, Homo sapien
gatctcaaacaacaaaacgccatag

SEQ ID NO: 593997 - DNA, 25 bp, Homo sapien
tcaaacaacaaaacgccatagaaat

SEQ ID NO: 593998 - DNA, 25 bp, Homo sapien
acaacaaaacgccatagaaatataa

SEQ ID NO: 593999 - DNA, 25 bp, Homo sapien
caatgaaacagtagagaaactcaac

SEQ ID NO: 594000 - DNA, 25 bp, Homo sapien
aagcaaatagatttctagcagagtt

SEQ ID NO: 594001 - DNA, 25 bp, Homo sapien
agcaaatagatttctagcagagttg

SEQ ID NO: 594002 - DNA, 25 bp, Homo sapien
tgcgctgggccgcactgcacccatt

SEQ ID NO: 594003 - DNA, 25 bp, Homo sapien
gcgctgggccgcactgcacccattt

SEQ ID NO: 594004 - DNA, 25 bp, Homo sapien
cgctgggccgcactgcacccatttc

SEQ ID NO: 594005 - DNA, 25 bp, Homo sapien
ttcctcccagcaagggcggtccctg

SEQ ID NO: 594006 - DNA, 25 bp, Homo sapien
agtgtggattcattattgacaacac

SEQ ID NO: 594007 - DNA, 25 bp, Homo sapien
gtgtggattcattattgacaacacc

SEQ ID NO: 594008 - DNA, 25 bp, Homo sapien
tgtggattcattattgacaacacca

SEQ ID NO: 594009 - DNA, 25 bp, Homo sapien
gtggattcattattgacaacaccat

SEQ ID NO: 594010 - DNA, 25 bp, Homo sapien
tggattcattattgacaacaccatg

SEQ ID NO: 594011 - DNA, 25 bp, Homo sapien
ggattcattattgacaacaccatga

SEQ ID NO: 594012 - DNA, 25 bp, Homo sapien
gattcattattgacaacaccatgac

SEQ ID NO: 594013 - DNA, 25 bp, Homo sapien
gcttttatagtgaacccactcctgc

SEQ ID NO: 594014 - DNA, 25 bp, Homo sapien
ctcctgcaataacaacgttcaaatg

SEQ ID NO: 594015 - DNA, 25 bp, Homo sapien
aacgttcaaatgctaaccacctctt

SEQ ID NO: 594016 - DNA, 25 bp, Homo sapien
agtgtccaacacatgagctttggga

SEQ ID NO: 594017 - DNA, 25 bp, Homo sapien
tgagctttgggatacatgttccaac

SEQ ID NO: 594018 - DNA, 25 bp, Homo sapien
ggatacatgttccaactacagccgc

SEQ ID NO: 594019 - DNA, 25 bp, Homo sapien
tcttctctacacttctgccggattc

SEQ ID NO: 594020 - DNA, 25 bp, Homo sapien
ctgccggattctctagttggattaa

SEQ ID NO: 594021 - DNA, 25 bp, Homo sapien
ggattaatcttgaaacatcacttaa

SEQ ID NO: 594022 - DNA, 25 bp, Homo sapien
atcacttaattgttaccactctccc

SEQ ID NO: 594023 - DNA, 25 bp, Homo sapien
accactctcccaaaagcagtcaatt

SEQ ID NO: 594024 - DNA, 25 bp, Homo sapien
gacaacttgagcctcctcacaacat

SEQ ID NO: 594025 - DNA, 25 bp, Homo sapien
tcctcacaacatgacagctggctta

SEQ ID NO: 594026 - DNA, 25 bp, Homo sapien
ctcacaacatgacagctggcttagt

SEQ ID NO: 594027 - DNA, 25 bp, Homo sapien
aaagtgacattaactttggaagtca

SEQ ID NO: 594028 - DNA, 25 bp, Homo sapien
gaagtcacatgccaccttgtcattc

SEQ ID NO: 594029 - DNA, 25 bp, Homo sapien
atgccaccttgtcattcccatatat

SEQ ID NO: 594030 - DNA, 25 bp, Homo sapien
cagccctgctcagtgcaggagggtc

SEQ ID NO: 594031 - DNA, 25 bp, Homo sapien
gctcagtgcaggagggtcctacaca

SEQ ID NO: 594032 - DNA, 25 bp, Homo sapien
ggagggtcctacacaaggatgtaca

SEQ ID NO: 594033 - DNA, 25 bp, Homo sapien
ggtcctacacaaggatgtacataca

SEQ ID NO: 594034 - DNA, 25 bp, Homo sapien
atcttggaggctggttttctgggat

SEQ ID NO: 594035 - DNA, 25 bp, Homo sapien
tccccagcaatggttcataatcaga

SEQ ID NO: 594036 - DNA, 25 bp, Homo sapien
gcaatggttcataatcagactgaaa

SEQ ID NO: 594037 - DNA, 25 bp, Homo sapien
tcaggagaaagttgaaacccaatcc

SEQ ID NO: 594038 - DNA, 25 bp, Homo sapien
gaaacccaatcccaggaatctactg

SEQ ID NO: 594039 - DNA, 25 bp, Homo sapien
acccaatcccaggaatctactgaaa

SEQ ID NO: 594040 - DNA, 25 bp, Homo sapien
gctgagagatgaaatagccatttta

SEQ ID NO: 594041 - DNA, 25 bp, Homo sapien
accaaactgatctaatagaggtgaa

SEQ ID NO: 594042 - DNA, 25 bp, Homo sapien
gtgaaaaactcactacaagaaattc

SEQ ID NO: 594043 - DNA, 25 bp, Homo sapien
gaaattcattctatattcgaagtat

SEQ ID NO: 594044 - DNA, 25 bp, Homo sapien
ttcgaagtattcacagcagagcaga

SEQ ID NO: 594045 - DNA, 25 bp, Homo sapien
attcacagcagagcagaggtaaggt

SEQ ID NO: 594046 - DNA, 25 bp, Homo sapien
ttttttcaaatgacagggctctata

SEQ ID NO: 594047 - DNA, 25 bp, Homo sapien
gacagggctctataatgggatcatt

SEQ ID NO: 594048 - DNA, 25 bp, Homo sapien
gagtgagtactccttcatatgttta

SEQ ID NO: 594049 - DNA, 25 bp, Homo sapien
gtactccttcatatgtttagtagat

SEQ ID NO: 594050 - DNA, 25 bp, Homo sapien
tgttgttgtagctcttcatgaaaag

SEQ ID NO: 594051 - DNA, 25 bp, Homo sapien
gtagctcttcatgaaaagtactttc

SEQ ID NO: 594052 - DNA, 25 bp, Homo sapien
gttagagtatttgtcacaacatggc

SEQ ID NO: 594053 - DNA, 25 bp, Homo sapien
aagagaggcgaattcatccattaat

SEQ ID NO: 594054 - DNA, 25 bp, Homo sapien
cgaattcatccattaattgcttgcc

SEQ ID NO: 594055 - DNA, 25 bp, Homo sapien
attgcttgccatatgcttatcactg

SEQ ID NO: 594056 - DNA, 25 bp, Homo sapien
gccatatgcttatcactggaatata

SEQ ID NO: 594057 - DNA, 25 bp, Homo sapien
gaggctgagttatccgggtcgatga

SEQ ID NO: 594058 - DNA, 25 bp, Homo sapien
ggctggactggctgcagcttagtca

SEQ ID NO: 594059 - DNA, 25 bp, Homo sapien
ggactggctgcagcttagtcaactg

SEQ ID NO: 594060 - DNA, 25 bp, Homo sapien
cagcttagtcaactgcagatgaggc

SEQ ID NO: 594061 - DNA, 25 bp, Homo sapien
gaaggagttccgtgttggccctaag

SEQ ID NO: 594062 - DNA, 25 bp, Homo sapien
ttggccctaaggaaaatgcgaagct

SEQ ID NO: 594063 - DNA, 25 bp, Homo sapien
aatgcgaagctttctgaggttagat

SEQ ID NO: 594064 - DNA, 25 bp, Homo sapien
gtgatatggtcagattggctttaaa

SEQ ID NO: 594065 - DNA, 25 bp, Homo sapien
taaaatgagctgtctgggccgagcg

SEQ ID NO: 594066 - DNA, 25 bp, Homo sapien
gcagatctgagcaaggcttgagact

SEQ ID NO: 594067 - DNA, 25 bp, Homo sapien
cttgagactgaagggctgggctagc

SEQ ID NO: 594068 - DNA, 25 bp, Homo sapien
aagtgttccctgagttgggctgcca

SEQ ID NO: 594069 - DNA, 25 bp, Homo sapien
ggtgttgaacagtgaggaagtcctc

SEQ ID NO: 594070 - DNA, 25 bp, Homo sapien
tgaggaagtcctctcacctgagcag

SEQ ID NO: 594071 - DNA, 25 bp, Homo sapien
tcctctcacctgagcagcttctgat

SEQ ID NO: 594072 - DNA, 25 bp, Homo sapien
ggtgtcgtgagtgcctggaatccta

SEQ ID NO: 594073 - DNA, 25 bp, Homo sapien
tgcctggaatcctatgcctgtgggt

SEQ ID NO: 594074 - DNA, 25 bp, Homo sapien
tgcctgtgggtggagcgtgaactta

SEQ ID NO: 594075 - DNA, 25 bp, Homo sapien
gtgaacttagcctcttccctgaggg

SEQ ID NO: 594076 - DNA, 25 bp, Homo sapien
tccctgagggtaggcagcatgtcat

SEQ ID NO: 594077 - DNA, 25 bp, Homo sapien
agcatgtcataaccacttctggctg

SEQ ID NO: 594078 - DNA, 25 bp, Homo sapien
gaatcttctgtcaagtgttccctga

SEQ ID NO: 594079 - DNA, 25 bp, Homo sapien
ccacctcttcatctcagactttgca

SEQ ID NO: 594080 - DNA, 25 bp, Homo sapien
cacctcttcatctcagactttgcat

SEQ ID NO: 594081 - DNA, 25 bp, Homo sapien
acctcttcatctcagactttgcata

SEQ ID NO: 594082 - DNA, 25 bp, Homo sapien
cctcttcatctcagactttgcatac

SEQ ID NO: 594083 - DNA, 25 bp, Homo sapien
ctcttcatctcagactttgcatact

SEQ ID NO: 594084 - DNA, 25 bp, Homo sapien
tcttcatctcagactttgcatactg

SEQ ID NO: 594085 - DNA, 25 bp, Homo sapien
cttcatctcagactttgcatactgc

SEQ ID NO: 594086 - DNA, 25 bp, Homo sapien
ttcatctcagactttgcatactgct

SEQ ID NO: 594087 - DNA, 25 bp, Homo sapien
tcatctcagactttgcatactgctg

SEQ ID NO: 594088 - DNA, 25 bp, Homo sapien
catctcagactttgcatactgctgg

SEQ ID NO: 594089 - DNA, 25 bp, Homo sapien
gtggggctggcactgattgcaactg

SEQ ID NO: 594090 - DNA, 25 bp, Homo sapien
aaagagagccaagactaagttacct

SEQ ID NO: 594091 - DNA, 25 bp, Homo sapien
gactaagttacctcaagactatgta

SEQ ID NO: 594092 - DNA, 25 bp, Homo sapien
aagactatgtattcctccctatttt

SEQ ID NO: 594093 - DNA, 25 bp, Homo sapien
atgtattcctccctattttggagtc

SEQ ID NO: 594094 - DNA, 25 bp, Homo sapien
gtcagtttccatttctacagtgttg

SEQ ID NO: 594095 - DNA, 25 bp, Homo sapien
tttctacagtgttgtcatcatcacc

SEQ ID NO: 594096 - DNA, 25 bp, Homo sapien
agtacatctaataaggtccttctgt

SEQ ID NO: 594097 - DNA, 25 bp, Homo sapien
aggtccttctgtagtgccatggtag

SEQ ID NO: 594098 - DNA, 25 bp, Homo sapien
ttgaggatgtccctgaagtgccagc

SEQ ID NO: 594099 - DNA, 25 bp, Homo sapien
gaagtgccagcgtcggttaaaacat

SEQ ID NO: 594100 - DNA, 25 bp, Homo sapien
gccacaggccccagttattgtgaaa

SEQ ID NO: 594101 - DNA, 25 bp, Homo sapien
gtgccacaacgcttggctaacacat

SEQ ID NO: 594102 - DNA, 25 bp, Homo sapien
cacaacgcttggctaacacattttt

SEQ ID NO: 594103 - DNA, 25 bp, Homo sapien
gcttcttaggagatgcagccatggt

SEQ ID NO: 594104 - DNA, 25 bp, Homo sapien
ttcttaggagatgcagccatggtga

SEQ ID NO: 594105 - DNA, 25 bp, Homo sapien
cagccatggtgaagagccagtatta

SEQ ID NO: 594106 - DNA, 25 bp, Homo sapien
gaagagccagtattatgaattaatt

SEQ ID NO: 594107 - DNA, 25 bp, Homo sapien
gggaaactgatgcatatagatcagt

SEQ ID NO: 594108 - DNA, 25 bp, Homo sapien
agtttgaggctaggccagatggctc

SEQ ID NO: 594109 - DNA, 25 bp, Homo sapien
tgaggctaggccagatggctcacat

SEQ ID NO: 594110 - DNA, 25 bp, Homo sapien
taggccagatggctcacatgtctgt

SEQ ID NO: 594111 - DNA, 25 bp, Homo sapien
ggccagatggctcacatgtctgtaa

SEQ ID NO: 594112 - DNA, 25 bp, Homo sapien
agcgtcctccaaatttcacaacagg

SEQ ID NO: 594113 - DNA, 25 bp, Homo sapien
acaacaggctttaccatgtggatga

SEQ ID NO: 594114 - DNA, 25 bp, Homo sapien
tgtaaccagtcatcagtacatttct

SEQ ID NO: 594115 - DNA, 25 bp, Homo sapien
agcacacttttaaaaaccagccatg

SEQ ID NO: 594116 - DNA, 25 bp, Homo sapien
cagccatgctagtgggcctgaggat

SEQ ID NO: 594117 - DNA, 25 bp, Homo sapien
ggcctgaggattacctttcgtcttc

SEQ ID NO: 594118 - DNA, 25 bp, Homo sapien
cagcctcacgagaagccggtggata

SEQ ID NO: 594119 - DNA, 25 bp, Homo sapien
aagccggtggatacagcttattcca

SEQ ID NO: 594120 - DNA, 25 bp, Homo sapien
tacagcttattccagagggaggctt

SEQ ID NO: 594121 - DNA, 25 bp, Homo sapien
gccagcctgcagaggagagaagcct

SEQ ID NO: 594122 - DNA, 25 bp, Homo sapien
agagaagcctgagcaagcgtcctcc

SEQ ID NO: 594123 - DNA, 25 bp, Homo sapien
gccaaggtgggcgggtcacttgaga

SEQ ID NO: 594124 - DNA, 25 bp, Homo sapien
ccaaggtgggcgggtcacttgagat

SEQ ID NO: 594125 - DNA, 25 bp, Homo sapien
caaggtgggcgggtcacttgagatc

SEQ ID NO: 594126 - DNA, 25 bp, Homo sapien
aaggtgggcgggtcacttgagatca

SEQ ID NO: 594127 - DNA, 25 bp, Homo sapien
aggtgggcgggtcacttgagatcag

SEQ ID NO: 594128 - DNA, 25 bp, Homo sapien
ggtgggcgggtcacttgagatcagg

SEQ ID NO: 594129 - DNA, 25 bp, Homo sapien
gtgggcgggtcacttgagatcagga

SEQ ID NO: 594130 - DNA, 25 bp, Homo sapien
tgggcgggtcacttgagatcaggag

SEQ ID NO: 594131 - DNA, 25 bp, Homo sapien
gcatgtcctcaaactccactggctt

SEQ ID NO: 594132 - DNA, 25 bp, Homo sapien
tccactggctttaaagagggtctag

SEQ ID NO: 594133 - DNA, 25 bp, Homo sapien
ggcaagacaggcagacagcgataag

SEQ ID NO: 594134 - DNA, 25 bp, Homo sapien
gcagacagcgataaggaggttcaga

SEQ ID NO: 594135 - DNA, 25 bp, Homo sapien
caagagagagacaggcccgaggcca

SEQ ID NO: 594136 - DNA, 25 bp, Homo sapien
atgggctgcctctcgccccaggtat

SEQ ID NO: 594137 - DNA, 25 bp, Homo sapien
tcgccccaggtatgttggcacagct

SEQ ID NO: 594138 - DNA, 25 bp, Homo sapien
ttctggcctcaaagatgatgacagg

SEQ ID NO: 594139 - DNA, 25 bp, Homo sapien
aaagatgatgacaggacaacaggac

SEQ ID NO: 594140 - DNA, 25 bp, Homo sapien
aacaggactggcaggagcggttcct

SEQ ID NO: 594141 - DNA, 25 bp, Homo sapien
agcggttcctgacccatgatttgaa

SEQ ID NO: 594142 - DNA, 25 bp, Homo sapien
gtctctgtcatgaaatggattgaaa

SEQ ID NO: 594143 - DNA, 25 bp, Homo sapien
aagaaatatgaaatgccaggtgtgg

SEQ ID NO: 594144 - DNA, 25 bp, Homo sapien
agcgagtctccatcttgaagtgaaa

SEQ ID NO: 594145 - DNA, 25 bp, Homo sapien
gcgagtctccatcttgaagtgaaat

SEQ ID NO: 594146 - DNA, 25 bp, Homo sapien
agtctccatcttgaagtgaaatgaa

SEQ ID NO: 594147 - DNA, 25 bp, Homo sapien
gcaatagagcgcgtctccgtcttga

SEQ ID NO: 594148 - DNA, 25 bp, Homo sapien
aatagagcgcgtctccgtcttgaaa

SEQ ID NO: 594149 - DNA, 25 bp, Homo sapien
atagagcgcgtctccgtcttgaaat

SEQ ID NO: 594150 - DNA, 25 bp, Homo sapien
tagagcgcgtctccgtcttgaaatg

SEQ ID NO: 594151 - DNA, 25 bp, Homo sapien
gcgcgtctccgtcttgaaatgaaat

SEQ ID NO: 594152 - DNA, 25 bp, Homo sapien
cgtctccgtcttgaaatgaaatgaa

SEQ ID NO: 594153 - DNA, 25 bp, Homo sapien
aaatggactgtggtactggttgctt

SEQ ID NO: 594154 - DNA, 25 bp, Homo sapien
tggtactggttgcttattttaatat

SEQ ID NO: 594155 - DNA, 25 bp, Homo sapien
gtactggttgcttattttaatatat

SEQ ID NO: 594156 - DNA, 25 bp, Homo sapien
attgtacactttacatgaatcagct

SEQ ID NO: 594157 - DNA, 25 bp, Homo sapien
gtacactttacatgaatcagctata

SEQ ID NO: 594158 - DNA, 25 bp, Homo sapien
ttacatgaatcagctatacagtatg

SEQ ID NO: 594159 - DNA, 25 bp, Homo sapien
atacagtatgtgaactatttctcca

SEQ ID NO: 594160 - DNA, 25 bp, Homo sapien
acagtatgtgaactatttctccata

SEQ ID NO: 594161 - DNA, 25 bp, Homo sapien
gtatgtgaactatttctccataaag

SEQ ID NO: 594162 - DNA, 25 bp, Homo sapien
gtgaactatttctccataaagctgg

SEQ ID NO: 594163 - DNA, 25 bp, Homo sapien
tgaactatttctccataaagctggg

SEQ ID NO: 594164 - DNA, 25 bp, Homo sapien
ccccaggagaagagtcactcagaca

SEQ ID NO: 594165 - DNA, 25 bp, Homo sapien
aagagtcactcagacagcagtatga

SEQ ID NO: 594166 - DNA, 25 bp, Homo sapien
gtcactcagacagcagtatgagcaa

SEQ ID NO: 594167 - DNA, 25 bp, Homo sapien
gacagcagtatgagcaagccagcca

SEQ ID NO: 594168 - DNA, 25 bp, Homo sapien
cagcagtatgagcaagccagccagc

SEQ ID NO: 594169 - DNA, 25 bp, Homo sapien
gagcaagccagccagcagctccgtg

SEQ ID NO: 594170 - DNA, 25 bp, Homo sapien
gaatcccagggggttcagatgccca

SEQ ID NO: 594171 - DNA, 25 bp, Homo sapien
gttcagatgcccaggaaggaaaagg

SEQ ID NO: 594172 - DNA, 25 bp, Homo sapien
ggacagcgctactgctatggaatga

SEQ ID NO: 594173 - DNA, 25 bp, Homo sapien
agcgctactgctatggaatgagacc

SEQ ID NO: 594174 - DNA, 25 bp, Homo sapien
gctatggaatgagaccaccacttct

SEQ ID NO: 594175 - DNA, 25 bp, Homo sapien
cgcgcctgtaggttttccagaggtc

SEQ ID NO: 594176 - DNA, 25 bp, Homo sapien
aaactgtaaaaccacacactttgat

SEQ ID NO: 594177 - DNA, 25 bp, Homo sapien
gcttgaaggaaatgtctacttagct

SEQ ID NO: 594178 - DNA, 25 bp, Homo sapien
tagctagacatagtgccacctggat

SEQ ID NO: 594179 - DNA, 25 bp, Homo sapien
atagtgccacctggattcactgttg

SEQ ID NO: 594180 - DNA, 25 bp, Homo sapien
tggattcactgttggctccagaatc

SEQ ID NO: 594181 - DNA, 25 bp, Homo sapien
ccccacggtgtcatcacgttggaaa

SEQ ID NO: 594182 - DNA, 25 bp, Homo sapien
ggtgtcatcacgttggaaagttttt

SEQ ID NO: 594183 - DNA, 25 bp, Homo sapien
gtttttgtgggttagatgttctctg

SEQ ID NO: 594184 - DNA, 25 bp, Homo sapien
aagaatgcctgtacatgcccaagaa

SEQ ID NO: 594185 - DNA, 25 bp, Homo sapien
agcatatgagtttaatgggacccca

SEQ ID NO: 594186 - DNA, 25 bp, Homo sapien
actttattgctatattccaacaggt

SEQ ID NO: 594187 - DNA, 25 bp, Homo sapien
tgctatattccaacaggtcactcct

SEQ ID NO: 594188 - DNA, 25 bp, Homo sapien
atattccaacaggtcactcctattc

SEQ ID NO: 594189 - DNA, 25 bp, Homo sapien
aacaggtcactcctattcttagaga

SEQ ID NO: 594190 - DNA, 25 bp, Homo sapien
ggtcactcctattcttagagaatgt

SEQ ID NO: 594191 - DNA, 25 bp, Homo sapien
tgacttgtgtcacttcggagtgaca

SEQ ID NO: 594192 - DNA, 25 bp, Homo sapien
gaaagataattccagacaagttaaa

SEQ ID NO: 594193 - DNA, 25 bp, Homo sapien
atgttacattcaaagctcttgtttt

SEQ ID NO: 594194 - DNA, 25 bp, Homo sapien
attcaaagctcttgttttcatcaca

SEQ ID NO: 594195 - DNA, 25 bp, Homo sapien
aaagctcttgttttcatcacaaata

SEQ ID NO: 594196 - DNA, 25 bp, Homo sapien
gctcttgttttcatcacaaataagg

SEQ ID NO: 594197 - DNA, 25 bp, Homo sapien
tggtaagaacccaatttggccactt

SEQ ID NO: 594198 - DNA, 25 bp, Homo sapien
tttggccacttactaataaccatgt

SEQ ID NO: 594199 - DNA, 25 bp, Homo sapien
aataaccatgtagcccttgatcaag

SEQ ID NO: 594200 - DNA, 25 bp, Homo sapien
aaccatgtagcccttgatcaaggca

SEQ ID NO: 594201 - DNA, 25 bp, Homo sapien
gatcaaggcacttagcatctgcttc

SEQ ID NO: 594202 - DNA, 25 bp, Homo sapien
cacttagcatctgcttcaggttctt

SEQ ID NO: 594203 - DNA, 25 bp, Homo sapien
ttcttgctctgtaagaggaatggta

SEQ ID NO: 594204 - DNA, 25 bp, Homo sapien
aggaatggtagtagctgcctcccac

SEQ ID NO: 594205 - DNA, 25 bp, Homo sapien
atggtagtagctgcctcccacataa

SEQ ID NO: 594206 - DNA, 25 bp, Homo sapien
gctgcctcccacataagctgggtgt

SEQ ID NO: 594207 - DNA, 25 bp, Homo sapien
gaagaagctctcgaatctgggaggt

SEQ ID NO: 594208 - DNA, 25 bp, Homo sapien
ttgtatgaacagagctggaggtaga

SEQ ID NO: 594209 - DNA, 25 bp, Homo sapien
tatgaacagagctggaggtagaatt

SEQ ID NO: 594210 - DNA, 25 bp, Homo sapien
ggtagaattggaatcatcacagatg

SEQ ID NO: 594211 - DNA, 25 bp, Homo sapien
tagaattggaatcatcacagatgct

SEQ ID NO: 594212 - DNA, 25 bp, Homo sapien
gaattggaatcatcacagatgctgt

SEQ ID NO: 594213 - DNA, 25 bp, Homo sapien
gatgctgtttaagaattgtctgtgg

SEQ ID NO: 594214 - DNA, 25 bp, Homo sapien
gctgtttaagaattgtctgtggctc

SEQ ID NO: 594215 - DNA, 25 bp, Homo sapien
tgtttaagaattgtctgtggctcac

SEQ ID NO: 594216 - DNA, 25 bp, Homo sapien
gtttaagaattgtctgtggctcaca

SEQ ID NO: 594217 - DNA, 25 bp, Homo sapien
tttaagaattgtctgtggctcacac

SEQ ID NO: 594218 - DNA, 25 bp, Homo sapien
ttaagaattgtctgtggctcacacc

SEQ ID NO: 594219 - DNA, 25 bp, Homo sapien
cttgatccaaaaactacctttccat

SEQ ID NO: 594220 - DNA, 25 bp, Homo sapien
tacctttccataatgttctcacatc

SEQ ID NO: 594221 - DNA, 25 bp, Homo sapien
tgtccaaactttaacctcttgaagc

SEQ ID NO: 594222 - DNA, 25 bp, Homo sapien
ttaacctcttgaagctagtcctctc

SEQ ID NO: 594223 - DNA, 25 bp, Homo sapien
tctccccactttccatctttaaatg

SEQ ID NO: 594224 - DNA, 25 bp, Homo sapien
ccactttccatctttaaatgggcat

SEQ ID NO: 594225 - DNA, 25 bp, Homo sapien
tacaataaaggctctgtccatctcc

SEQ ID NO: 594226 - DNA, 25 bp, Homo sapien
tgtccatctccatctcttatatata

SEQ ID NO: 594227 - DNA, 25 bp, Homo sapien
tagagttctttcctgacctctagct

SEQ ID NO: 594228 - DNA, 25 bp, Homo sapien
tgacctctagctccatacttctgat

SEQ ID NO: 594229 - DNA, 25 bp, Homo sapien
gctccatacttctgattgcctaata

SEQ ID NO: 594230 - DNA, 25 bp, Homo sapien
aatgtctttctctttggtctaggag

SEQ ID NO: 594231 - DNA, 25 bp, Homo sapien
ctctttggtctaggagatatcgcac

SEQ ID NO: 594232 - DNA, 25 bp, Homo sapien
ttggtctaggagatatcgcactatg

SEQ ID NO: 594233 - DNA, 25 bp, Homo sapien
aggagatatcgcactatgggaatgt

SEQ ID NO: 594234 - DNA, 25 bp, Homo sapien
gggctctgtctgtcattactctggc

SEQ ID NO: 594235 - DNA, 25 bp, Homo sapien
tctgtctgtcattactctggcattt

SEQ ID NO: 594236 - DNA, 25 bp, Homo sapien
gtctgtcattactctggcatttcaa

SEQ ID NO: 594237 - DNA, 25 bp, Homo sapien
tcaactcctcattcatggcctaatt

SEQ ID NO: 594238 - DNA, 25 bp, Homo sapien
aactcctcattcatggcctaattcc

SEQ ID NO: 594239 - DNA, 25 bp, Homo sapien
gggcaccaataatactgtggcctgg

SEQ ID NO: 594240 - DNA, 25 bp, Homo sapien
caataatactgtggcctggcctgtg

SEQ ID NO: 594241 - DNA, 25 bp, Homo sapien
tgggattatagatgggagccccaag

SEQ ID NO: 594242 - DNA, 25 bp, Homo sapien
gggattatagatgggagccccaagc

SEQ ID NO: 594243 - DNA, 25 bp, Homo sapien
ggattatagatgggagccccaagcc

SEQ ID NO: 594244 - DNA, 25 bp, Homo sapien
ggtcttatgtaccttttgacaagaa

SEQ ID NO: 594245 - DNA, 25 bp, Homo sapien
gtcttatgtaccttttgacaagaaa

SEQ ID NO: 594246 - DNA, 25 bp, Homo sapien
tcttatgtaccttttgacaagaaag

SEQ ID NO: 594247 - DNA, 25 bp, Homo sapien
cttatgtaccttttgacaagaaagt

SEQ ID NO: 594248 - DNA, 25 bp, Homo sapien
ttatgtaccttttgacaagaaagta

SEQ ID NO: 594249 - DNA, 25 bp, Homo sapien
tatgtaccttttgacaagaaagtaa

SEQ ID NO: 594250 - DNA, 25 bp, Homo sapien
atgtaccttttgacaagaaagtaat

SEQ ID NO: 594251 - DNA, 25 bp, Homo sapien
tgtaccttttgacaagaaagtaatt

SEQ ID NO: 594252 - DNA, 25 bp, Homo sapien
ttctacccaatcctgcgagactctg

SEQ ID NO: 594253 - DNA, 25 bp, Homo sapien
tctacccaatcctgcgagactctgg

SEQ ID NO: 594254 - DNA, 25 bp, Homo sapien
aatcctgcgagactctggccactcc

SEQ ID NO: 594255 - DNA, 25 bp, Homo sapien
cacacctagagttcccaagggacta

SEQ ID NO: 594256 - DNA, 25 bp, Homo sapien
acacctagagttcccaagggactat

SEQ ID NO: 594257 - DNA, 25 bp, Homo sapien
acctagagttcccaagggactatag

SEQ ID NO: 594258 - DNA, 25 bp, Homo sapien
tagagttcccaagggactataggtt

SEQ ID NO: 594259 - DNA, 25 bp, Homo sapien
ttcccaagggactataggttttgct

SEQ ID NO: 594260 - DNA, 25 bp, Homo sapien
ccaagggactataggttttgctgtt

SEQ ID NO: 594261 - DNA, 25 bp, Homo sapien
tgtgttgagatagccccacttgaag

SEQ ID NO: 594262 - DNA, 25 bp, Homo sapien
tgttgagatagccccacttgaagaa

SEQ ID NO: 594263 - DNA, 25 bp, Homo sapien
ttctatgggccaagagacaagcagg

SEQ ID NO: 594264 - DNA, 25 bp, Homo sapien
atctttcctcttaggacaggacaat

SEQ ID NO: 594265 - DNA, 25 bp, Homo sapien
taggacaggacaatactttcctttt

SEQ ID NO: 594266 - DNA, 25 bp, Homo sapien
gtagtactgtgtatactcacggagt

SEQ ID NO: 594267 - DNA, 25 bp, Homo sapien
atactcacggagttgtaatttttga

SEQ ID NO: 594268 - DNA, 25 bp, Homo sapien
ttttacttcatcgatggaaaaacta

SEQ ID NO: 594269 - DNA, 25 bp, Homo sapien
ggaaaaactaatgcgtgggaaacat

SEQ ID NO: 594270 - DNA, 25 bp, Homo sapien
cgtgggaaacattacaccaatcttt

SEQ ID NO: 594271 - DNA, 25 bp, Homo sapien
ggaaacattacaccaatctttactg

SEQ ID NO: 594272 - DNA, 25 bp, Homo sapien
tttcttctgtttctggccttaccca

SEQ ID NO: 594273 - DNA, 25 bp, Homo sapien
ctggccttacccaacatattgttaa

SEQ ID NO: 594274 - DNA, 25 bp, Homo sapien
gaagcagtgggtaaataccagtctt

SEQ ID NO: 594275 - DNA, 25 bp, Homo sapien
gcagtgggtaaataccagtcttttt

SEQ ID NO: 594276 - DNA, 25 bp, Homo sapien
tttctgaaaatgtaccacaggtatg

SEQ ID NO: 594277 - DNA, 25 bp, Homo sapien
tgtaccacaggtatgatgcccgtta

SEQ ID NO: 594278 - DNA, 25 bp, Homo sapien
ccacaggtatgatgcccgttaattc

SEQ ID NO: 594279 - DNA, 25 bp, Homo sapien
ggtatgatgcccgttaattcagaag

SEQ ID NO: 594280 - DNA, 25 bp, Homo sapien
atgatgcccgttaattcagaaggta

SEQ ID NO: 594281 - DNA, 25 bp, Homo sapien
taattcagaaggtagctgtggcaca

SEQ ID NO: 594282 - DNA, 25 bp, Homo sapien
gaagatgtttctgaaataagatcaa

SEQ ID NO: 594283 - DNA, 25 bp, Homo sapien
gatcaaatgtgaaatggtcagcttt

SEQ ID NO: 594284 - DNA, 25 bp, Homo sapien
tttattaaaagtcctatgatctctc

SEQ ID NO: 594285 - DNA, 25 bp, Homo sapien
agccactgtgcacgttgggattaat

SEQ ID NO: 594286 - DNA, 25 bp, Homo sapien
gccactgtgcacgttgggattaata

SEQ ID NO: 594287 - DNA, 25 bp, Homo sapien
cactgtgcacgttgggattaatatt

SEQ ID NO: 594288 - DNA, 25 bp, Homo sapien
gtgcacgttgggattaatattttct

SEQ ID NO: 594289 - DNA, 25 bp, Homo sapien
gcacgttgggattaatattttctta

SEQ ID NO: 594290 - DNA, 25 bp, Homo sapien
taatattttcttattcgtatttcca

SEQ ID NO: 594291 - DNA, 25 bp, Homo sapien
atggcagaatattcctcactgctag

SEQ ID NO: 594292 - DNA, 25 bp, Homo sapien
ggcagaatattcctcactgctagaa

SEQ ID NO: 594293 - DNA, 25 bp, Homo sapien
agaatattcctcactgctagaatga

SEQ ID NO: 594294 - DNA, 25 bp, Homo sapien
aatattcctcactgctagaatgaga

SEQ ID NO: 594295 - DNA, 25 bp, Homo sapien
ctgctagaatgagaccagaggtcaa

SEQ ID NO: 594296 - DNA, 25 bp, Homo sapien
agagcccagggagagacaggcgttc

SEQ ID NO: 594297 - DNA, 25 bp, Homo sapien
tgaggaaatcagtagcgtggccaca

SEQ ID NO: 594298 - DNA, 25 bp, Homo sapien
aaatcagtagcgtggccacagctgc

SEQ ID NO: 594299 - DNA, 25 bp, Homo sapien
agtagcgtggccacagctgcacaaa

SEQ ID NO: 594300 - DNA, 25 bp, Homo sapien
agcgtggccacagctgcacaaatca

SEQ ID NO: 594301 - DNA, 25 bp, Homo sapien
gtggccacagctgcacaaatcacag

SEQ ID NO: 594302 - DNA, 25 bp, Homo sapien
agctgcacaaatcacagctgcctct

SEQ ID NO: 594303 - DNA, 25 bp, Homo sapien
acaaatcacagctgcctctcctggt

SEQ ID NO: 594304 - DNA, 25 bp, Homo sapien
tctgatccaggagacagccggccat

SEQ ID NO: 594305 - DNA, 25 bp, Homo sapien
agttttgtatccaccaccccagtca

SEQ ID NO: 594306 - DNA, 25 bp, Homo sapien
ttgtatccaccaccccagtcaagat

SEQ ID NO: 594307 - DNA, 25 bp, Homo sapien
cttaaccaagatgccgtgcctaaaa

SEQ ID NO: 594308 - DNA, 25 bp, Homo sapien
gtttcctccagttgaaatttggcat

SEQ ID NO: 594309 - DNA, 25 bp, Homo sapien
atttcctttgcttctgatgatagat

SEQ ID NO: 594310 - DNA, 25 bp, Homo sapien
gggtccctagtacctgtggctttgc

SEQ ID NO: 594311 - DNA, 25 bp, Homo sapien
gtggctttgccaacaatagaaatca

SEQ ID NO: 594312 - DNA, 25 bp, Homo sapien
cacagatgttttccatatcatagga

SEQ ID NO: 594313 - DNA, 25 bp, Homo sapien
atcataggaaagttttgcaggttta

SEQ ID NO: 594314 - DNA, 25 bp, Homo sapien
aaacatatcgcttatgcccacatgc

SEQ ID NO: 594315 - DNA, 25 bp, Homo sapien
ttatgcccacatgcctacttcaaaa

SEQ ID NO: 594316 - DNA, 25 bp, Homo sapien
tgcctacttcaaaatttcaggagtt

SEQ ID NO: 594317 - DNA, 25 bp, Homo sapien
ggagttctaagacctgctactgaat

SEQ ID NO: 594318 - DNA, 25 bp, Homo sapien
agcatcacccagtccacaagtgaaa

SEQ ID NO: 594319 - DNA, 25 bp, Homo sapien
agtccacaagtgaaacaccccttca

SEQ ID NO: 594320 - DNA, 25 bp, Homo sapien
agtgaaacaccccttcatttcagaa

SEQ ID NO: 594321 - DNA, 25 bp, Homo sapien
gtgcagtgacaggaccacggctcgt

SEQ ID NO: 594322 - DNA, 25 bp, Homo sapien
gtgacaggaccacggctcgttgcat

SEQ ID NO: 594323 - DNA, 25 bp, Homo sapien
aggaccacggctcgttgcatctttg

SEQ ID NO: 594324 - DNA, 25 bp, Homo sapien
gaccacggctcgttgcatctttgac

SEQ ID NO: 594325 - DNA, 25 bp, Homo sapien
ggctcgttgcatctttgacctcctg

SEQ ID NO: 594326 - DNA, 25 bp, Homo sapien
cagattaactgggtctcactctatc

SEQ ID NO: 594327 - DNA, 25 bp, Homo sapien
accaaggctggaattcagcggcaca

SEQ ID NO: 594328 - DNA, 25 bp, Homo sapien
gccactgggattcaaacgattatcc

SEQ ID NO: 594329 - DNA, 25 bp, Homo sapien
gagatagcctaacaacagtgattca

SEQ ID NO: 594330 - DNA, 25 bp, Homo sapien
cattggttgtatttgctcatgagaa

SEQ ID NO: 594331 - DNA, 25 bp, Homo sapien
gaagccaggacaactttggtattgt

SEQ ID NO: 594332 - DNA, 25 bp, Homo sapien
atctgtaaggatattttacctacca

SEQ ID NO: 594333 - DNA, 25 bp, Homo sapien
gtacagatgtcttcactttgcatgg

SEQ ID NO: 594334 - DNA, 25 bp, Homo sapien
gtcttcactttgcatggctcttata

SEQ ID NO: 594335 - DNA, 25 bp, Homo sapien
actttgcatggctcttatatacaca

SEQ ID NO: 594336 - DNA, 25 bp, Homo sapien
acacaaatttgttactgcactttag

SEQ ID NO: 594337 - DNA, 25 bp, Homo sapien
accagtcctcccacagaagtgtgaa

SEQ ID NO: 594338 - DNA, 25 bp, Homo sapien
gtgtgaattttggttaccactgcta

SEQ ID NO: 594339 - DNA, 25 bp, Homo sapien
ggttaccactgctacaaatcactat

SEQ ID NO: 594340 - DNA, 25 bp, Homo sapien
tgtccacggaacacaggacgagagt

SEQ ID NO: 594341 - DNA, 25 bp, Homo sapien
acaggacgagagttacacacccagc

SEQ ID NO: 594342 - DNA, 25 bp, Homo sapien
gccacaccactgtgaggacagagaa

SEQ ID NO: 594343 - DNA, 25 bp, Homo sapien
acagagaaggcatggcgtgacctgc

SEQ ID NO: 594344 - DNA, 25 bp, Homo sapien
atggcgtgacctgccacctggtgga

SEQ ID NO: 594345 - DNA, 25 bp, Homo sapien
ccacctggtggagggctgcgaccat

SEQ ID NO: 594346 - DNA, 25 bp, Homo sapien
gctgcgaccatggagggtgctggat

SEQ ID NO: 594347 - DNA, 25 bp, Homo sapien
cgggggaccatgagttcacctctgt

SEQ ID NO: 594348 - DNA, 25 bp, Homo sapien
tcacctctgtcatcagtgtcagcat

SEQ ID NO: 594349 - DNA, 25 bp, Homo sapien
acctctgtcatcagtgtcagcatga

SEQ ID NO: 594350 - DNA, 25 bp, Homo sapien
gtcagcatgacaaaccccactggtg

SEQ ID NO: 594351 - DNA, 25 bp, Homo sapien
agccaacaagcatctgttatatgcg

SEQ ID NO: 594352 - DNA, 25 bp, Homo sapien
aacaagcatctgttatatgcgctga

SEQ ID NO: 594353 - DNA, 25 bp, Homo sapien
aagcatctgttatatgcgctgatgg

SEQ ID NO: 594354 - DNA, 25 bp, Homo sapien
atatgcgctgatggaactgctgcta

SEQ ID NO: 594355 - DNA, 25 bp, Homo sapien
gcgctgatggaactgctgctaattg

SEQ ID NO: 594356 - DNA, 25 bp, Homo sapien
gaactgctgctaattgaactgtgtc

SEQ ID NO: 594357 - DNA, 25 bp, Homo sapien
tgtgtcctgagctgagagttcattt

SEQ ID NO: 594358 - DNA, 25 bp, Homo sapien
cctgagctgagagttcatttagatc

SEQ ID NO: 594359 - DNA, 25 bp, Homo sapien
tggccaagtttgagactacacaaat

SEQ ID NO: 594360 - DNA, 25 bp, Homo sapien
gagactacacaaataaaccaccaga

SEQ ID NO: 594361 - DNA, 25 bp, Homo sapien
aaaccaccagaaaaatgtctgtgta

SEQ ID NO: 594362 - DNA, 25 bp, Homo sapien
agttgtaatattttagtcagtcaat

SEQ ID NO: 594363 - DNA, 25 bp, Homo sapien
gtaatattttagtcagtcaattcta

SEQ ID NO: 594364 - DNA, 25 bp, Homo sapien
tagtcagtcaattctaataatgagc

SEQ ID NO: 594365 - DNA, 25 bp, Homo sapien
gtcagtcaattctaataatgagcaa

SEQ ID NO: 594366 - DNA, 25 bp, Homo sapien
gtcaattctaataatgagcaactat

SEQ ID NO: 594367 - DNA, 25 bp, Homo sapien
tctgtattgtagttgattaggaagg

SEQ ID NO: 594368 - DNA, 25 bp, Homo sapien
gtattgtagttgattaggaaggtat

SEQ ID NO: 594369 - DNA, 25 bp, Homo sapien
ggaaggtataacattttactatagc

SEQ ID NO: 594370 - DNA, 25 bp, Homo sapien
ggtataacattttactatagctatt

SEQ ID NO: 594371 - DNA, 25 bp, Homo sapien
taacattttactatagctattttta

SEQ ID NO: 594372 - DNA, 25 bp, Homo sapien
attttttctataaggatgtatacaa

SEQ ID NO: 594373 - DNA, 25 bp, Homo sapien
cactacctagaaacaccctatcaag

SEQ ID NO: 594374 - DNA, 25 bp, Homo sapien
acaccctatcaagaagtgcttttaa

SEQ ID NO: 594375 - DNA, 25 bp, Homo sapien
gaagtcttcaaagtactgtagctgg

SEQ ID NO: 594376 - DNA, 25 bp, Homo sapien
ctgtagctggaaatgcactgcactg

SEQ ID NO: 594377 - DNA, 25 bp, Homo sapien
tcctggcaatactcctgtcttattt

SEQ ID NO: 594378 - DNA, 25 bp, Homo sapien
atagcaatgcatctctttggcctca

SEQ ID NO: 594379 - DNA, 25 bp, Homo sapien
tttggcctcaactggcagctacagc

SEQ ID NO: 594380 - DNA, 25 bp, Homo sapien
caggaacaggtacaacgccactgtt

SEQ ID NO: 594381 - DNA, 25 bp, Homo sapien
actgttcagtactgcaaccccagga

SEQ ID NO: 594382 - DNA, 25 bp, Homo sapien
aggatacacaatggcatctggctct

SEQ ID NO: 594383 - DNA, 25 bp, Homo sapien
atctggctctgtttattcaccacct

SEQ ID NO: 594384 - DNA, 25 bp, Homo sapien
aggagagacgttgcatcctggcacc

SEQ ID NO: 594385 - DNA, 25 bp, Homo sapien
tggcacccagatccctggacttaaa

SEQ ID NO: 594386 - DNA, 25 bp, Homo sapien
tggacttaaagatcaatggccttga

SEQ ID NO: 594387 - DNA, 25 bp, Homo sapien
aaattacttcacagagaggattcct

SEQ ID NO: 594388 - DNA, 25 bp, Homo sapien
gagaggattcctgttaatgattaca

SEQ ID NO: 594389 - DNA, 25 bp, Homo sapien
tgattacagatccttcccaatacac

SEQ ID NO: 594390 - DNA, 25 bp, Homo sapien
tacactttatttatgggaccctctc

SEQ ID NO: 594391 - DNA, 25 bp, Homo sapien
atctctgctgtctctagcaccggaa

SEQ ID NO: 594392 - DNA, 25 bp, Homo sapien
agcaccggaaagatgctttctccag

SEQ ID NO: 594393 - DNA, 25 bp, Homo sapien
tgaattggcatgaaccctaccaggc

SEQ ID NO: 594394 - DNA, 25 bp, Homo sapien
taggagcttctgtagccttttcaag

SEQ ID NO: 594395 - DNA, 25 bp, Homo sapien
gacacttcagagtcccggccttggg

SEQ ID NO: 594396 - DNA, 25 bp, Homo sapien
agagtcccggccttgggctacctgg

SEQ ID NO: 594397 - DNA, 25 bp, Homo sapien
ttgggctacctggacgtgcgcatcg

SEQ ID NO: 594398 - DNA, 25 bp, Homo sapien
gctacctggacgtgcgcatcgtgga

SEQ ID NO: 594399 - DNA, 25 bp, Homo sapien
tggacgtgcgcatcgtggacacaga

SEQ ID NO: 594400 - DNA, 25 bp, Homo sapien
gtgcgcatcgtggacacagactaca

SEQ ID NO: 594401 - DNA, 25 bp, Homo sapien
atcgtggacacagactacagctcct

SEQ ID NO: 594402 - DNA, 25 bp, Homo sapien
tggacacagactacagctccttcgc

SEQ ID NO: 594403 - DNA, 25 bp, Homo sapien
ttcgccgtcctttacatctacaagg

SEQ ID NO: 594404 - DNA, 25 bp, Homo sapien
gtcctttacatctacaaggagctgg

SEQ ID NO: 594405 - DNA, 25 bp, Homo sapien
gacccaggatgtgagtccccaggct

SEQ ID NO: 594406 - DNA, 25 bp, Homo sapien
gggcgggaggtcgtcggtggcctct

SEQ ID NO: 594407 - DNA, 25 bp, Homo sapien
gcgggaggtcgtcggtggcctctga

SEQ ID NO: 594408 - DNA, 25 bp, Homo sapien
ggtggcctctgagaacccgcccctg

SEQ ID NO: 594409 - DNA, 25 bp, Homo sapien
tggcctctgagaacccgcccctgtg

SEQ ID NO: 594410 - DNA, 25 bp, Homo sapien
cctgtgcccaggttgccaatgccaa

SEQ ID NO: 594411 - DNA, 25 bp, Homo sapien
ggcgccaggtgagtggcctcctcgg

SEQ ID NO: 594412 - DNA, 25 bp, Homo sapien
cgccaggtgagtggcctcctcgggt

SEQ ID NO: 594413 - DNA, 25 bp, Homo sapien
aggtgagtggcctcctcgggtcccg

SEQ ID NO: 594414 - DNA, 25 bp, Homo sapien
ggtgagtggcctcctcgggtcccgg

SEQ ID NO: 594415 - DNA, 25 bp, Homo sapien
tgagtggcctcctcgggtcccggga

SEQ ID NO: 594416 - DNA, 25 bp, Homo sapien
tggcctcctcgggtcccgggaccag

SEQ ID NO: 594417 - DNA, 25 bp, Homo sapien
tgtcctgattactgggctctggccg

SEQ ID NO: 594418 - DNA, 25 bp, Homo sapien
gtcctgattactgggctctggccgc

SEQ ID NO: 594419 - DNA, 25 bp, Homo sapien
tgattactgggctctggccgctccc

SEQ ID NO: 594420 - DNA, 25 bp, Homo sapien
attactgggctctggccgctcccag

SEQ ID NO: 594421 - DNA, 25 bp, Homo sapien
tggccggcggcgctcaccgttcggg

SEQ ID NO: 594422 - DNA, 25 bp, Homo sapien
ggcgctcaccgttcgggccagggag

SEQ ID NO: 594423 - DNA, 25 bp, Homo sapien
ttcgggccagggaggtccggagctt

SEQ ID NO: 594424 - DNA, 25 bp, Homo sapien
gggccagggaggtccggagcttccg

SEQ ID NO: 594425 - DNA, 25 bp, Homo sapien
gaggtccggagcttccgccacgagc

SEQ ID NO: 594426 - DNA, 25 bp, Homo sapien
gggcggtcacgtgagagcgcgctgc

SEQ ID NO: 594427 - DNA, 25 bp, Homo sapien
ggtcacgtgagagcgcgctgcgcct

SEQ ID NO: 594428 - DNA, 25 bp, Homo sapien
gggattatagatgggagccccaagc

SEQ ID NO: 594429 - DNA, 25 bp, Homo sapien
ggtcttatgtaccttttgacaagaa

SEQ ID NO: 594430 - DNA, 25 bp, Homo sapien
taaaattatctcatgcaacagatga

SEQ ID NO: 594431 - DNA, 25 bp, Homo sapien
aattatctcatgcaacagatgaaag

SEQ ID NO: 594432 - DNA, 25 bp, Homo sapien
tatctcatgcaacagatgaaagaag

SEQ ID NO: 594433 - DNA, 25 bp, Homo sapien
gtatatatttctttatctgcacttt

SEQ ID NO: 594434 - DNA, 25 bp, Homo sapien
tatatatttctttatctgcactttg

SEQ ID NO: 594435 - DNA, 25 bp, Homo sapien
atctgcactttgtagttgaaagaaa

SEQ ID NO: 594436 - DNA, 25 bp, Homo sapien
gcactttgtagttgaaagaaaccaa

SEQ ID NO: 594437 - DNA, 25 bp, Homo sapien
agttgaaagaaaccaagctcagaga

SEQ ID NO: 594438 - DNA, 25 bp, Homo sapien
gaggttaaatatcatttccaatgtc

SEQ ID NO: 594439 - DNA, 25 bp, Homo sapien
actttgctcagccatcaggaccctc

SEQ ID NO: 594440 - DNA, 25 bp, Homo sapien
tcagccatcaggaccctcctttggg

SEQ ID NO: 594441 - DNA, 25 bp, Homo sapien
cagccatcaggaccctcctttggga

SEQ ID NO: 594442 - DNA, 25 bp, Homo sapien
agccatcaggaccctcctttgggat

SEQ ID NO: 594443 - DNA, 25 bp, Homo sapien
gccatcaggaccctcctttgggatc

SEQ ID NO: 594444 - DNA, 25 bp, Homo sapien
ccatcaggaccctcctttgggatcc

SEQ ID NO: 594445 - DNA, 25 bp, Homo sapien
catcaggaccctcctttgggatccc

SEQ ID NO: 594446 - DNA, 25 bp, Homo sapien
tcaggaccctcctttgggatcccct

SEQ ID NO: 594447 - DNA, 25 bp, Homo sapien
tgacccatctctcaggcttcaacag

SEQ ID NO: 594448 - DNA, 25 bp, Homo sapien
gacccatctctcaggcttcaacaga

SEQ ID NO: 594449 - DNA, 25 bp, Homo sapien
acccatctctcaggcttcaacagag

SEQ ID NO: 594450 - DNA, 25 bp, Homo sapien
acccagactgattaactggctcatg

SEQ ID NO: 594451 - DNA, 25 bp, Homo sapien
cagactgattaactggctcatgtga

SEQ ID NO: 594452 - DNA, 25 bp, Homo sapien
agactgattaactggctcatgtgat

SEQ ID NO: 594453 - DNA, 25 bp, Homo sapien
gactgattaactggctcatgtgatc

SEQ ID NO: 594454 - DNA, 25 bp, Homo sapien
ctgattaactggctcatgtgatctt

SEQ ID NO: 594455 - DNA, 25 bp, Homo sapien
gattaactggctcatgtgatcttgt

SEQ ID NO: 594456 - DNA, 25 bp, Homo sapien
taactggctcatgtgatcttgtggt

SEQ ID NO: 594457 - DNA, 25 bp, Homo sapien
ccacccaggaacttaatcagcacaa

SEQ ID NO: 594458 - DNA, 25 bp, Homo sapien
aggagacagcttcaactccctatga

SEQ ID NO: 594459 - DNA, 25 bp, Homo sapien
tccttaaaaagtctgctccccaaat

SEQ ID NO: 594460 - DNA, 25 bp, Homo sapien
aaatgctcgggtagactgatttggg

SEQ ID NO: 594461 - DNA, 25 bp, Homo sapien
cagatgtccccgttagatgcctaga

SEQ ID NO: 594462 - DNA, 25 bp, Homo sapien
gatgtccccgttagatgcctagaaa

SEQ ID NO: 594463 - DNA, 25 bp, Homo sapien
aagatgcattgttgacgaataatac

SEQ ID NO: 594464 - DNA, 25 bp, Homo sapien
tcttttatgtctacaggtggcagtg

SEQ ID NO: 594465 - DNA, 25 bp, Homo sapien
acaggtggcagtgtagaagccagac

SEQ ID NO: 594466 - DNA, 25 bp, Homo sapien
agtgtagaagccagaccgggagctt

SEQ ID NO: 594467 - DNA, 25 bp, Homo sapien
gccagaccgggagcttccagaagtg

SEQ ID NO: 594468 - DNA, 25 bp, Homo sapien
ggtttctgaaagagtcaaatgtaca

SEQ ID NO: 594469 - DNA, 25 bp, Homo sapien
aatgtacatgagtaagcaagcacag

SEQ ID NO: 594470 - DNA, 25 bp, Homo sapien
gagtaagcaagcacaggaatctgaa

SEQ ID NO: 594471 - DNA, 25 bp, Homo sapien
gcaagcacaggaatctgaaaaacca

SEQ ID NO: 594472 - DNA, 25 bp, Homo sapien
gcatgagataatcacttgggagctt

SEQ ID NO: 594473 - DNA, 25 bp, Homo sapien
tagcagtaccaagggatctcaccat

SEQ ID NO: 594474 - DNA, 25 bp, Homo sapien
gtaccaagggatctcaccattcaga

SEQ ID NO: 594475 - DNA, 25 bp, Homo sapien
tcaccattcagagatcctgattcag

SEQ ID NO: 594476 - DNA, 25 bp, Homo sapien
atcctgattcagttgtttatatggg

SEQ ID NO: 594477 - DNA, 25 bp, Homo sapien
ttcacttaagtcaattttgcattca

SEQ ID NO: 594478 - DNA, 25 bp, Homo sapien
gcattcaatgctgagaaccactgga

SEQ ID NO: 594479 - DNA, 25 bp, Homo sapien
gactagaacctaagggtcctgaaag

SEQ ID NO: 594480 - DNA, 25 bp, Homo sapien
agaatggaaaggtggcttgagctca

SEQ ID NO: 594481 - DNA, 25 bp, Homo sapien
tttatttgtatatgccgtcatcaca

SEQ ID NO: 594482 - DNA, 25 bp, Homo sapien
tgtatatgccgtcatcacaatgatg

SEQ ID NO: 594483 - DNA, 25 bp, Homo sapien
caacttgtacttaataaggaggaag

SEQ ID NO: 594484 - DNA, 25 bp, Homo sapien
acttgtacttaataaggaggaagct

SEQ ID NO: 594485 - DNA, 25 bp, Homo sapien
cttgtacttaataaggaggaagctg

SEQ ID NO: 594486 - DNA, 25 bp, Homo sapien
ttgtacttaataaggaggaagctga

SEQ ID NO: 594487 - DNA, 25 bp, Homo sapien
tgtacttaataaggaggaagctgaa

SEQ ID NO: 594488 - DNA, 25 bp, Homo sapien
gtacttaataaggaggaagctgaag

SEQ ID NO: 594489 - DNA, 25 bp, Homo sapien
tacttaataaggaggaagctgaagc

SEQ ID NO: 594490 - DNA, 25 bp, Homo sapien
cttaataaggaggaagctgaagcgg

SEQ ID NO: 594491 - DNA, 25 bp, Homo sapien
taaggaggaagctgaagcgggcaga

SEQ ID NO: 594492 - DNA, 25 bp, Homo sapien
cacacacaaattaggtgggcatggt

SEQ ID NO: 594493 - DNA, 25 bp, Homo sapien
cagcctagataacaagagtgagact

SEQ ID NO: 594494 - DNA, 25 bp, Homo sapien
cctggattcaagcacccacctacct

SEQ ID NO: 594495 - DNA, 25 bp, Homo sapien
ctggattcaagcacccacctacctt

SEQ ID NO: 594496 - DNA, 25 bp, Homo sapien
tggattcaagcacccacctaccttg

SEQ ID NO: 594497 - DNA, 25 bp, Homo sapien
ggattcaagcacccacctaccttgt

SEQ ID NO: 594498 - DNA, 25 bp, Homo sapien
gattcaagcacccacctaccttgtc

SEQ ID NO: 594499 - DNA, 25 bp, Homo sapien
attcaagcacccacctaccttgtcc

SEQ ID NO: 594500 - DNA, 25 bp, Homo sapien
ttcaagcacccacctaccttgtcct

SEQ ID NO: 594501 - DNA, 25 bp, Homo sapien
tcaagcacccacctaccttgtcctc

SEQ ID NO: 594502 - DNA, 25 bp, Homo sapien
caagcacccacctaccttgtcctcc

SEQ ID NO: 594503 - DNA, 25 bp, Homo sapien
agcacccacctaccttgtcctccca

SEQ ID NO: 594504 - DNA, 25 bp, Homo sapien
ccgcaacagccgcatgaacaaggag

SEQ ID NO: 594505 - DNA, 25 bp, Homo sapien
acagccgcatgaacaaggagccgtg

SEQ ID NO: 594506 - DNA, 25 bp, Homo sapien
gaacaaggagccgtgctttttccgc

SEQ ID NO: 594507 - DNA, 25 bp, Homo sapien
aaggagccgtgctttttccgcgcca

SEQ ID NO: 594508 - DNA, 25 bp, Homo sapien
ttttccgcgccatgctcgtggtgca

SEQ ID NO: 594509 - DNA, 25 bp, Homo sapien
atgctcgtggtgcacaagctgctgc

SEQ ID NO: 594510 - DNA, 25 bp, Homo sapien
gggctggtgcacagcaatctcacct

SEQ ID NO: 594511 - DNA, 25 bp, Homo sapien
tggtgcacagcaatctcacctgctc

SEQ ID NO: 594512 - DNA, 25 bp, Homo sapien
cagccgggctactaggacaggccag

SEQ ID NO: 594513 - DNA, 25 bp, Homo sapien
gctactaggacaggccagggcactt

SEQ ID NO: 594514 - DNA, 25 bp, Homo sapien
aggccagggcacttgctcctgagcc

SEQ ID NO: 594515 - DNA, 25 bp, Homo sapien
tggattcaagcacccacctaccttg

SEQ ID NO: 594516 - DNA, 25 bp, Homo sapien
ggattcaagcacccacctaccttgt

SEQ ID NO: 594517 - DNA, 25 bp, Homo sapien
gattcaagcacccacctaccttgtc

SEQ ID NO: 594518 - DNA, 25 bp, Homo sapien
attcaagcacccacctaccttgtcc

SEQ ID NO: 594519 - DNA, 25 bp, Homo sapien
ttcaagcacccacctaccttgtcct

SEQ ID NO: 594520 - DNA, 25 bp, Homo sapien
tcaagcacccacctaccttgtcctc

SEQ ID NO: 594521 - DNA, 25 bp, Homo sapien
agcacccacctaccttgtcctccca

SEQ ID NO: 594522 - DNA, 25 bp, Homo sapien
gtgctgagactacagacgtgcccac

SEQ ID NO: 594523 - DNA, 25 bp, Homo sapien
tgctgagactacagacgtgcccacc

SEQ ID NO: 594524 - DNA, 25 bp, Homo sapien
tgagactacagacgtgcccaccagc

SEQ ID NO: 594525 - DNA, 25 bp, Homo sapien
gagactacagacgtgcccaccagcc

SEQ ID NO: 594526 - DNA, 25 bp, Homo sapien
acgtctccattatacaacatgacaa

SEQ ID NO: 594527 - DNA, 25 bp, Homo sapien
actgcaatttggaatggtaaaagtg

SEQ ID NO: 594528 - DNA, 25 bp, Homo sapien
aaaagtgacttgttggctgaccctg

SEQ ID NO: 594529 - DNA, 25 bp, Homo sapien
aagtgacttgttggctgaccctgaa

SEQ ID NO: 594530 - DNA, 25 bp, Homo sapien
tgacttgttggctgaccctgaagac

SEQ ID NO: 594531 - DNA, 25 bp, Homo sapien
acttgttggctgaccctgaagacgt

SEQ ID NO: 594532 - DNA, 25 bp, Homo sapien
tgttggctgaccctgaagacgttaa

SEQ ID NO: 594533 - DNA, 25 bp, Homo sapien
ttggctgaccctgaagacgttaaca

SEQ ID NO: 594534 - DNA, 25 bp, Homo sapien
ggctgaccctgaagacgttaacatt

SEQ ID NO: 594535 - DNA, 25 bp, Homo sapien
ctgaccctgaagacgttaacatttt

SEQ ID NO: 594536 - DNA, 25 bp, Homo sapien
cctgaagacgttaacattttacatt

SEQ ID NO: 594537 - DNA, 25 bp, Homo sapien
gacttcaggtgatcctcctcgcctg

SEQ ID NO: 594538 - DNA, 25 bp, Homo sapien
gtgatcctcctcgcctgccttgcct

SEQ ID NO: 594539 - DNA, 25 bp, Homo sapien
acgcccggccctgcctcttgagctg

SEQ ID NO: 594540 - DNA, 25 bp, Homo sapien
gcccggccctgcctcttgagctggg

SEQ ID NO: 594541 - DNA, 25 bp, Homo sapien
ccggccctgcctcttgagctgggga

SEQ ID NO: 594542 - DNA, 25 bp, Homo sapien
cggccctgcctcttgagctggggag

SEQ ID NO: 594543 - DNA, 25 bp, Homo sapien
gccctgcctcttgagctggggagtt

SEQ ID NO: 594544 - DNA, 25 bp, Homo sapien
cctgcctcttgagctggggagttca

SEQ ID NO: 594545 - DNA, 25 bp, Homo sapien
ctgcctcttgagctggggagttcaa

SEQ ID NO: 594546 - DNA, 25 bp, Homo sapien
caacataatgagatttcagctctat

SEQ ID NO: 594547 - DNA, 25 bp, Homo sapien
aacataatgagatttcagctctatt

SEQ ID NO: 594548 - DNA, 25 bp, Homo sapien
atgacaaaccaccttaaaatgcttt

SEQ ID NO: 594549 - DNA, 25 bp, Homo sapien
gacaaaccaccttaaaatgctttgg

SEQ ID NO: 594550 - DNA, 25 bp, Homo sapien
caaaccaccttaaaatgctttggct

SEQ ID NO: 594551 - DNA, 25 bp, Homo sapien
aaccaccttaaaatgctttggcttg

SEQ ID NO: 594552 - DNA, 25 bp, Homo sapien
accaccttaaaatgctttggcttgg

SEQ ID NO: 594553 - DNA, 25 bp, Homo sapien
caccttaaaatgctttggcttggcc

SEQ ID NO: 594554 - DNA, 25 bp, Homo sapien
accttaaaatgctttggcttggcca

SEQ ID NO: 594555 - DNA, 25 bp, Homo sapien
ccttaaaatgctttggcttggccag

SEQ ID NO: 594556 - DNA, 25 bp, Homo sapien
aaatgctttggcttggccaggtgca

SEQ ID NO: 594557 - DNA, 25 bp, Homo sapien
aatgctttggcttggccaggtgcag

SEQ ID NO: 594558 - DNA, 25 bp, Homo sapien
tagctgggagtggtaatgggcacct

SEQ ID NO: 594559 - DNA, 25 bp, Homo sapien
gaaaagccagccatcttgtgtcata

SEQ ID NO: 594560 - DNA, 25 bp, Homo sapien
tcttgtgtcatacccatcagtcatt

SEQ ID NO: 594561 - DNA, 25 bp, Homo sapien
atcagtcatttcatcccatcctatc

SEQ ID NO: 594562 - DNA, 25 bp, Homo sapien
aaagcagtgccgagtgtcagactac

SEQ ID NO: 594563 - DNA, 25 bp, Homo sapien
agtgtcagactacggatactccaag

SEQ ID NO: 594564 - DNA, 25 bp, Homo sapien
gactacggatactccaagctgattg

SEQ ID NO: 594565 - DNA, 25 bp, Homo sapien
ggatactccaagctgattgagttat

SEQ ID NO: 594566 - DNA, 25 bp, Homo sapien
gagttattagaagcagtgcctcatg

SEQ ID NO: 594567 - DNA, 25 bp, Homo sapien
ggctccaaacgtctgctgaccctta

SEQ ID NO: 594568 - DNA, 25 bp, Homo sapien
ggcccaggtgaagcgctttactcag

SEQ ID NO: 594569 - DNA, 25 bp, Homo sapien
gaagcgctttactcaggatttacta

SEQ ID NO: 594570 - DNA, 25 bp, Homo sapien
gaaaaattaaccaggccgggcgcag

SEQ ID NO: 594571 - DNA, 25 bp, Homo sapien
aaaattaaccaggccgggcgcagtg

SEQ ID NO: 594572 - DNA, 25 bp, Homo sapien
aaattaaccaggccgggcgcagtgg

SEQ ID NO: 594573 - DNA, 25 bp, Homo sapien
ggcaggagaatcgcctgaatcgggg

SEQ ID NO: 594574 - DNA, 25 bp, Homo sapien
gcaggagaatcgcctgaatcgggga

SEQ ID NO: 594575 - DNA, 25 bp, Homo sapien
caggagaatcgcctgaatcggggag

SEQ ID NO: 594576 - DNA, 25 bp, Homo sapien
aggagaatcgcctgaatcggggagg

SEQ ID NO: 594577 - DNA, 25 bp, Homo sapien
ggagaatcgcctgaatcggggaggc

SEQ ID NO: 594578 - DNA, 25 bp, Homo sapien
tggctgactttgaactatgaagaaa

SEQ ID NO: 594579 - DNA, 25 bp, Homo sapien
agaggacttggcttgaacccgctcc

SEQ ID NO: 594580 - DNA, 25 bp, Homo sapien
cgctccaacacttacaacctgagtg

SEQ ID NO: 594581 - DNA, 25 bp, Homo sapien
ttacaacctgagtgaccgtgagaaa

SEQ ID NO: 594582 - DNA, 25 bp, Homo sapien
gaaagaactgtaactcctctaaact

SEQ ID NO: 594583 - DNA, 25 bp, Homo sapien
taaacttcaagttcctcacttctca

SEQ ID NO: 594584 - DNA, 25 bp, Homo sapien
agaacgtgaatagtacctccctcct

SEQ ID NO: 594585 - DNA, 25 bp, Homo sapien
ctccctcctagagttgtgaggattg

SEQ ID NO: 594586 - DNA, 25 bp, Homo sapien
aatgctagcaattgttatgccctaa

SEQ ID NO: 594587 - DNA, 25 bp, Homo sapien
tgttatgccctaaggaacagcacaa

SEQ ID NO: 594588 - DNA, 25 bp, Homo sapien
gaacagcacaagatacaataacacg

SEQ ID NO: 594589 - DNA, 25 bp, Homo sapien
gcaaatgcttgattatagttctgtg

SEQ ID NO: 594590 - DNA, 25 bp, Homo sapien
atagttctgtggtctgtttgttttc

SEQ ID NO: 594591 - DNA, 25 bp, Homo sapien
tgtttgttttctagagtctccatga

SEQ ID NO: 594592 - DNA, 25 bp, Homo sapien
gagtctccatgaattgcaagggaaa

SEQ ID NO: 594593 - DNA, 25 bp, Homo sapien
ggtacactggtatttctatttgata

SEQ ID NO: 594594 - DNA, 25 bp, Homo sapien
ctatttgataacctgttctctttgg

SEQ ID NO: 594595 - DNA, 25 bp, Homo sapien
tgttctctttggaattccggttaga

SEQ ID NO: 594596 - DNA, 25 bp, Homo sapien
tccggttagaaatcaaaggcttact

SEQ ID NO: 594597 - DNA, 25 bp, Homo sapien
gcttacttgagttttaatgctttcg

SEQ ID NO: 594598 - DNA, 25 bp, Homo sapien
aatgctttcgggacttcaaatgctt

SEQ ID NO: 594599 - DNA, 25 bp, Homo sapien
gggacttcaaatgcttttctatctt

SEQ ID NO: 594600 - DNA, 25 bp, Homo sapien
ggaataggaccaagaatgtcccgga

SEQ ID NO: 594601 - DNA, 25 bp, Homo sapien
aataggaccaagaatgtcccggagt

SEQ ID NO: 594602 - DNA, 25 bp, Homo sapien
taggaccaagaatgtcccggagtgg

SEQ ID NO: 594603 - DNA, 25 bp, Homo sapien
ggaccaagaatgtcccggagtggca

SEQ ID NO: 594604 - DNA, 25 bp, Homo sapien
tcccggagtggcaggcttagagttt

SEQ ID NO: 594605 - DNA, 25 bp, Homo sapien
cccggagtggcaggcttagagtttt

SEQ ID NO: 594606 - DNA, 25 bp, Homo sapien
agtggcaggcttagagttttggccc

SEQ ID NO: 594607 - DNA, 25 bp, Homo sapien
caggcttagagttttggcccggcgc

SEQ ID NO: 594608 - DNA, 25 bp, Homo sapien
aggcttagagttttggcccggcgca

SEQ ID NO: 594609 - DNA, 25 bp, Homo sapien
gcttagagttttggcccggcgcagt

SEQ ID NO: 594610 - DNA, 25 bp, Homo sapien
cttagagttttggcccggcgcagtg

SEQ ID NO: 594611 - DNA, 25 bp, Homo sapien
gggcatcaggaagaagccagttgca

SEQ ID NO: 594612 - DNA, 25 bp, Homo sapien
gaagccagttgcaggcaaggcctct

SEQ ID NO: 594613 - DNA, 25 bp, Homo sapien
agttgcaggcaaggcctctgctgat

SEQ ID NO: 594614 - DNA, 25 bp, Homo sapien
caggcaaggcctctgctgatgctgc

SEQ ID NO: 594615 - DNA, 25 bp, Homo sapien
tgctgcttttttctcctgtacccat

SEQ ID NO: 594616 - DNA, 25 bp, Homo sapien
ctgtacccatccatgggagggagct

SEQ ID NO: 594617 - DNA, 25 bp, Homo sapien
gagggagctgtgagatggcctggca

SEQ ID NO: 594618 - DNA, 25 bp, Homo sapien
ggcctggcagaacccgctcttggac

SEQ ID NO: 594619 - DNA, 25 bp, Homo sapien
ccgctcttggaccccacagaatgag

SEQ ID NO: 594620 - DNA, 25 bp, Homo sapien
agaatgagaggctcaccctgcacag

SEQ ID NO: 594621 - DNA, 25 bp, Homo sapien
agaggctcaccctgcacaggaacat

SEQ ID NO: 594622 - DNA, 25 bp, Homo sapien
ggacgtgctcagtggatggtaccca

SEQ ID NO: 594623 - DNA, 25 bp, Homo sapien
gtgctcagtggatggtacccaagcc

SEQ ID NO: 594624 - DNA, 25 bp, Homo sapien
tcagtggatggtacccaagcccctg

SEQ ID NO: 594625 - DNA, 25 bp, Homo sapien
ccaagcccctgcatttatctctttg

SEQ ID NO: 594626 - DNA, 25 bp, Homo sapien
cacctggaactgtgtatttttctgt

SEQ ID NO: 594627 - DNA, 25 bp, Homo sapien
gtaactatctctgtaaccattaatt

SEQ ID NO: 594628 - DNA, 25 bp, Homo sapien
ttaactttttgcgtgttctgcttct

SEQ ID NO: 594629 - DNA, 25 bp, Homo sapien
actttttgcgtgttctgcttctgta

SEQ ID NO: 594630 - DNA, 25 bp, Homo sapien
gctgagagaattttgagctctagcc

SEQ ID NO: 594631 - DNA, 25 bp, Homo sapien
aattttgagctctagccatctctcg

SEQ ID NO: 594632 - DNA, 25 bp, Homo sapien
ccatctctcggtcactggcaataaa

SEQ ID NO: 594633 - DNA, 25 bp, Homo sapien
ttatgctcacctgtggacaccgagg

SEQ ID NO: 594634 - DNA, 25 bp, Homo sapien
tgctcacctgtggacaccgaggatg

SEQ ID NO: 594635 - DNA, 25 bp, Homo sapien
gtggacaccgaggatgccctcacat

SEQ ID NO: 594636 - DNA, 25 bp, Homo sapien
ccgaggatgccctcacattggtgct

SEQ ID NO: 594637 - DNA, 25 bp, Homo sapien
cctttgccacaatggtatgatggct

SEQ ID NO: 594638 - DNA, 25 bp, Homo sapien
gtatgatggcttggtagcccctcga

SEQ ID NO: 594639 - DNA, 25 bp, Homo sapien
ttggtagcccctcgaggcagatgca

SEQ ID NO: 594640 - DNA, 25 bp, Homo sapien
tcgaggcagatgcacctgacttgct

SEQ ID NO: 594641 - DNA, 25 bp, Homo sapien
gcagatgcacctgacttgctgctat

SEQ ID NO: 594642 - DNA, 25 bp, Homo sapien
gctgctattaaaaagccgtgtgcct

SEQ ID NO: 594643 - DNA, 25 bp, Homo sapien
taaaaagccgtgtgccttctaccaa

SEQ ID NO: 594644 - DNA, 25 bp, Homo sapien
aagatttagtagttctctaaggcta

SEQ ID NO: 594645 - DNA, 25 bp, Homo sapien
agttctctaaggctactcgattctt

SEQ ID NO: 594646 - DNA, 25 bp, Homo sapien
aggctactcgattctttctccttta

SEQ ID NO: 594647 - DNA, 25 bp, Homo sapien
agaaaaccatcttagaactcggagg

SEQ ID NO: 594648 - DNA, 25 bp, Homo sapien
atttaacattctaggcattcagtaa

SEQ ID NO: 594649 - DNA, 25 bp, Homo sapien
acatttaataatgagccctttgctg

SEQ ID NO: 594650 - DNA, 25 bp, Homo sapien
gagccctttgctgattcattgtgca

SEQ ID NO: 594651 - DNA, 25 bp, Homo sapien
gctgattcattgtgcatattgcttt

SEQ ID NO: 594652 - DNA, 25 bp, Homo sapien
ttttgctttatcctctcaacttgca

SEQ ID NO: 594653 - DNA, 25 bp, Homo sapien
gctttatcctctcaacttgcatgga

SEQ ID NO: 594654 - DNA, 25 bp, Homo sapien
tatcctctcaacttgcatggagaaa

SEQ ID NO: 594655 - DNA, 25 bp, Homo sapien
gggtaatgaccaccgctaccgggtg

SEQ ID NO: 594656 - DNA, 25 bp, Homo sapien
gctgggaggagtgatgtggtaatat

SEQ ID NO: 594657 - DNA, 25 bp, Homo sapien
tagaatagaacctggcacccattta

SEQ ID NO: 594658 - DNA, 25 bp, Homo sapien
agaatagaacctggcacccatttac

SEQ ID NO: 594659 - DNA, 25 bp, Homo sapien
aatagaacctggcacccatttaccg

SEQ ID NO: 594660 - DNA, 25 bp, Homo sapien
tagaacctggcacccatttaccgtg

SEQ ID NO: 594661 - DNA, 25 bp, Homo sapien
gaacctggcacccatttaccgtgtg

SEQ ID NO: 594662 - DNA, 25 bp, Homo sapien
acctggcacccatttaccgtgtgaa

SEQ ID NO: 594663 - DNA, 25 bp, Homo sapien
tggcacccatttaccgtgtgaactg

SEQ ID NO: 594664 - DNA, 25 bp, Homo sapien
ggcacccatttaccgtgtgaactgt

SEQ ID NO: 594665 - DNA, 25 bp, Homo sapien
cacccatttaccgtgtgaactgtcc

SEQ ID NO: 594666 - DNA, 25 bp, Homo sapien
tttcctcctccttgcaacgagtatg

SEQ ID NO: 594667 - DNA, 25 bp, Homo sapien
tcctccttgcaacgagtatggctca

SEQ ID NO: 594668 - DNA, 25 bp, Homo sapien
tgcaacgagtatggctcagggaact

SEQ ID NO: 594669 - DNA, 25 bp, Homo sapien
tcagggaactgagcctcaacccatt

SEQ ID NO: 594670 - DNA, 25 bp, Homo sapien
agcctcaacccattgaatactgcac

SEQ ID NO: 594671 - DNA, 25 bp, Homo sapien
tgaatactgcactgattatccggaa

SEQ ID NO: 594672 - DNA, 25 bp, Homo sapien
tgcactgattatccggaagcagaac

SEQ ID NO: 594673 - DNA, 25 bp, Homo sapien
gggtgtgactgcactcatgaagagg

SEQ ID NO: 594674 - DNA, 25 bp, Homo sapien
ggaagccagggacactggcatcctc

SEQ ID NO: 594675 - DNA, 25 bp, Homo sapien
cagggacactggcatcctctgctgc

SEQ ID NO: 594676 - DNA, 25 bp, Homo sapien
ggcatcctctgctgcctgactcttg

SEQ ID NO: 594677 - DNA, 25 bp, Homo sapien
ctctgacccctgtgatggagggagg

SEQ ID NO: 594678 - DNA, 25 bp, Homo sapien
gaagggctcataatgcacacttgag

SEQ ID NO: 594679 - DNA, 25 bp, Homo sapien
agggctcataatgcacacttgagga

SEQ ID NO: 594680 - DNA, 25 bp, Homo sapien
gggctcataatgcacacttgaggat

SEQ ID NO: 594681 - DNA, 25 bp, Homo sapien
tcataatgcacacttgaggatgggc

SEQ ID NO: 594682 - DNA, 25 bp, Homo sapien
taatgcacacttgaggatgggcggc

SEQ ID NO: 594683 - DNA, 25 bp, Homo sapien
aatgcacacttgaggatgggcggca

SEQ ID NO: 594684 - DNA, 25 bp, Homo sapien
cacacttgaggatgggcggcagaaa

SEQ ID NO: 594685 - DNA, 25 bp, Homo sapien
acacttgaggatgggcggcagaaaa

SEQ ID NO: 594686 - DNA, 25 bp, Homo sapien
gcggcagaaaagacttccagctggg

SEQ ID NO: 594687 - DNA, 25 bp, Homo sapien
cggcagaaaagacttccagctgggt

SEQ ID NO: 594688 - DNA, 25 bp, Homo sapien
gagaagtggattgtttccctctctt

SEQ ID NO: 594689 - DNA, 25 bp, Homo sapien
tttccctctcttctacgagtttgga

SEQ ID NO: 594690 - DNA, 25 bp, Homo sapien
ctcttctacgagtttggatccctga

SEQ ID NO: 594691 - DNA, 25 bp, Homo sapien
tttggatccctgatcagtagacaga

SEQ ID NO: 594692 - DNA, 25 bp, Homo sapien
gatccctgatcagtagacagacaca

SEQ ID NO: 594693 - DNA, 25 bp, Homo sapien
gacagacacataagacaactttcta

SEQ ID NO: 594694 - DNA, 25 bp, Homo sapien
ataagacaactttctactgtgcaaa

SEQ ID NO: 594695 - DNA, 25 bp, Homo sapien
gacaactttctactgtgcaaattaa

SEQ ID NO: 594696 - DNA, 25 bp, Homo sapien
aaggattctgccagcaggccttcct

SEQ ID NO: 594697 - DNA, 25 bp, Homo sapien
ttccattaccgcctatttccatttt

SEQ ID NO: 594698 - DNA, 25 bp, Homo sapien
ttaccgcctatttccatttttcaag

SEQ ID NO: 594699 - DNA, 25 bp, Homo sapien
tctcgcctggtagaactgtgtgacc

SEQ ID NO: 594700 - DNA, 25 bp, Homo sapien
gcctggtagaactgtgtgacctcat

SEQ ID NO: 594701 - DNA, 25 bp, Homo sapien
gtagaactgtgtgacctcatcgaat

SEQ ID NO: 594702 - DNA, 25 bp, Homo sapien
tgtgtgacctcatcgaatccattcc

SEQ ID NO: 594703 - DNA, 25 bp, Homo sapien
acctcatcgaatccattcccaaaga

SEQ ID NO: 594704 - DNA, 25 bp, Homo sapien
atcgaatccattcccaaagaaaatg

SEQ ID NO: 594705 - DNA, 25 bp, Homo sapien
tcccaaagaaaatgtggaggcaatt

SEQ ID NO: 594706 - DNA, 25 bp, Homo sapien
tggaggcaattgagaggatgaaaca

SEQ ID NO: 594707 - DNA, 25 bp, Homo sapien
tgaaacagaaagaatggcggcaaaa

SEQ ID NO: 594708 - DNA, 25 bp, Homo sapien
aatggcggcaaaagtttcgtgatga

SEQ ID NO: 594709 - DNA, 25 bp, Homo sapien
ggcggcaaaagtttcgtgatgagaa

SEQ ID NO: 594710 - DNA, 25 bp, Homo sapien
cttttgaaaggatagggtctctaga

SEQ ID NO: 594711 - DNA, 25 bp, Homo sapien
aaggatagggtctctagatagaaaa

SEQ ID NO: 594712 - DNA, 25 bp, Homo sapien
atagaaaagcaaatgcctcattcca

SEQ ID NO: 594713 - DNA, 25 bp, Homo sapien
atgcctcattccagaaggtcttcaa

SEQ ID NO: 594714 - DNA, 25 bp, Homo sapien
gtggtgataacaaacataactgatt

SEQ ID NO: 594715 - DNA, 25 bp, Homo sapien
ctgattataatctattctgtgaaaa

SEQ ID NO: 594716 - DNA, 25 bp, Homo sapien
gcttatgaaacagtagatgtgtgta

SEQ ID NO: 594717 - DNA, 25 bp, Homo sapien
gtgtgtatctagtacataagagctg

SEQ ID NO: 594718 - DNA, 25 bp, Homo sapien
gtacataagagctgaatgtcaatat

SEQ ID NO: 594719 - DNA, 25 bp, Homo sapien
aattctagttgccttatattttctt

SEQ ID NO: 594720 - DNA, 25 bp, Homo sapien
tctagttgccttatattttcttctt

SEQ ID NO: 594721 - DNA, 25 bp, Homo sapien
ttgctggctggtcccactgtggctt

SEQ ID NO: 594722 - DNA, 25 bp, Homo sapien
tggaaagcccatgtgagtacctaat

SEQ ID NO: 594723 - DNA, 25 bp, Homo sapien
gcccatgtgagtacctaatggcggg

SEQ ID NO: 594724 - DNA, 25 bp, Homo sapien
ggtactcagaaagaggagccgcaga

SEQ ID NO: 594725 - DNA, 25 bp, Homo sapien
gagccgcagagttcttggtccacaa

SEQ ID NO: 594726 - DNA, 25 bp, Homo sapien
tcttggtccacaacaggctagcagg

SEQ ID NO: 594727 - DNA, 25 bp, Homo sapien
aagctgcctgaaatctatcttaatg

SEQ ID NO: 594728 - DNA, 25 bp, Homo sapien
atctatcttaatgtacctctctctc

SEQ ID NO: 594729 - DNA, 25 bp, Homo sapien
cacatacatggacatctaagtttat

SEQ ID NO: 594730 - DNA, 25 bp, Homo sapien
ctaagtttatgaggcatctttgcat

SEQ ID NO: 594731 - DNA, 25 bp, Homo sapien
gcatctttgcatgaatatgtattga

SEQ ID NO: 594732 - DNA, 25 bp, Homo sapien
gtcctatcacctaatattacaagag

SEQ ID NO: 594733 - DNA, 25 bp, Homo sapien
acaagagttggtaagcgctcatcat

SEQ ID NO: 594734 - DNA, 25 bp, Homo sapien
ggtaagcgctcatcattaattttat

SEQ ID NO: 594735 - DNA, 25 bp, Homo sapien
aagttagtatgacagaggcagtgct

SEQ ID NO: 594736 - DNA, 25 bp, Homo sapien
cctgtggacaggagcattttgcata

SEQ ID NO: 594737 - DNA, 25 bp, Homo sapien
ttccatctgaaagtatcactcagtt

SEQ ID NO: 594738 - DNA, 25 bp, Homo sapien
gtatcactcagttgatagtctggaa

SEQ ID NO: 594739 - DNA, 25 bp, Homo sapien
gatagtctggaatgcatgttatata

SEQ ID NO: 594740 - DNA, 25 bp, Homo sapien
aaacattctatatcggtatgtagca

SEQ ID NO: 594741 - DNA, 25 bp, Homo sapien
ggtatgtagcagaccaatctctaaa

SEQ ID NO: 594742 - DNA, 25 bp, Homo sapien
tctatatagccatttcagtgcaaac

SEQ ID NO: 594743 - DNA, 25 bp, Homo sapien
ggaggaaggccaggacaacagctca

SEQ ID NO: 594744 - DNA, 25 bp, Homo sapien
aggaaggccaggacaacagctcagt

SEQ ID NO: 594745 - DNA, 25 bp, Homo sapien
ggaaggccaggacaacagctcagta

SEQ ID NO: 594746 - DNA, 25 bp, Homo sapien
gaaggccaggacaacagctcagtaa

SEQ ID NO: 594747 - DNA, 25 bp, Homo sapien
aaggccaggacaacagctcagtaaa

SEQ ID NO: 594748 - DNA, 25 bp, Homo sapien
aggccaggacaacagctcagtaaag

SEQ ID NO: 594749 - DNA, 25 bp, Homo sapien
ggccaggacaacagctcagtaaagc

SEQ ID NO: 594750 - DNA, 25 bp, Homo sapien
gccaggacaacagctcagtaaagct

SEQ ID NO: 594751 - DNA, 25 bp, Homo sapien
gacaacagctcagtaaagctgaggt

SEQ ID NO: 594752 - DNA, 25 bp, Homo sapien
aacagctcagtaaagctgaggtgca

SEQ ID NO: 594753 - DNA, 25 bp, Homo sapien
cagctcagtaaagctgaggtgcaag

SEQ ID NO: 594754 - DNA, 25 bp, Homo sapien
cacagagcatcttggaactcctact

SEQ ID NO: 594755 - DNA, 25 bp, Homo sapien
agagcatcttggaactcctactaag

SEQ ID NO: 594756 - DNA, 25 bp, Homo sapien
gcatcttggaactcctactaagcag

SEQ ID NO: 594757 - DNA, 25 bp, Homo sapien
atcttggaactcctactaagcaggg

SEQ ID NO: 594758 - DNA, 25 bp, Homo sapien
ttggaactcctactaagcagggctt

SEQ ID NO: 594759 - DNA, 25 bp, Homo sapien
ggaactcctactaagcagggcttct

SEQ ID NO: 594760 - DNA, 25 bp, Homo sapien
actcctactaagcagggcttctaca

SEQ ID NO: 594761 - DNA, 25 bp, Homo sapien
tcctactaagcagggcttctacagg

SEQ ID NO: 594762 - DNA, 25 bp, Homo sapien
taaccactaattaaagttccgctgg

SEQ ID NO: 594763 - DNA, 25 bp, Homo sapien
cactaattaaagttccgctggagcg

SEQ ID NO: 594764 - DNA, 25 bp, Homo sapien
attaaagttccgctggagcgttttg

SEQ ID NO: 594765 - DNA, 25 bp, Homo sapien
ggaaccatttttgataactttctga

SEQ ID NO: 594766 - DNA, 25 bp, Homo sapien
tgataactttctgatcacagatgat

SEQ ID NO: 594767 - DNA, 25 bp, Homo sapien
aaccaagggtccagaaagggagatg

SEQ ID NO: 594768 - DNA, 25 bp, Homo sapien
agatggatgccatacaggccaagga

SEQ ID NO: 594769 - DNA, 25 bp, Homo sapien
gctgctgtcgggaaaaattaacagg

SEQ ID NO: 594770 - DNA, 25 bp, Homo sapien
aattaacaggcacgaacattacttc

SEQ ID NO: 594771 - DNA, 25 bp, Homo sapien
ggcacgaacattacttcaatcaatt

SEQ ID NO: 594772 - DNA, 25 bp, Homo sapien
aggaatgaactttagtgatccccat

SEQ ID NO: 594773 - DNA, 25 bp, Homo sapien
tgaactttagtgatccccattggat

SEQ ID NO: 594774 - DNA, 25 bp, Homo sapien
tccccattggatataaggatgactg

SEQ ID NO: 594775 - DNA, 25 bp, Homo sapien
ggatgactggtaaaatctcattgct

SEQ ID NO: 594776 - DNA, 25 bp, Homo sapien
atgaaaacatcagttcctctttttg

SEQ ID NO: 594777 - DNA, 25 bp, Homo sapien
cctctttttgcagggtacatttgtt

SEQ ID NO: 594778 - DNA, 25 bp, Homo sapien
gcagggtacatttgttacagggaat

SEQ ID NO: 594779 - DNA, 25 bp, Homo sapien
acatttgttacagggaatacctctg

SEQ ID NO: 594780 - DNA, 25 bp, Homo sapien
aatacctctgttctgtactctatca

SEQ ID NO: 594781 - DNA, 25 bp, Homo sapien
tgttctgtactctatcatcttgata

SEQ ID NO: 594782 - DNA, 25 bp, Homo sapien
gtactctatcatcttgatatgtgat

SEQ ID NO: 594783 - DNA, 25 bp, Homo sapien
cttgatatgtgatgttaatgctaaa

SEQ ID NO: 594784 - DNA, 25 bp, Homo sapien
ttggtatctcctagaagtgctccca

SEQ ID NO: 594785 - DNA, 25 bp, Homo sapien
atctcctagaagtgctcccatatga

SEQ ID NO: 594786 - DNA, 25 bp, Homo sapien
agtgctcccatatgactaattgttt

SEQ ID NO: 594787 - DNA, 25 bp, Homo sapien
ggacatgctgggtagatcatctatt

SEQ ID NO: 594788 - DNA, 25 bp, Homo sapien
tggtacgtggtaacacagttggaac

SEQ ID NO: 594789 - DNA, 25 bp, Homo sapien
aacgtgtttctcaacttgtgttctt

SEQ ID NO: 594790 - DNA, 25 bp, Homo sapien
ttgtgttcttagcagccaagctctg

SEQ ID NO: 594791 - DNA, 25 bp, Homo sapien
tgcccctgactctgatcacaggcaa

SEQ ID NO: 594792 - DNA, 25 bp, Homo sapien
aaagtctcatttcaatcctgagctt

SEQ ID NO: 594793 - DNA, 25 bp, Homo sapien
ctgagcttctcctaattcttgtgga

SEQ ID NO: 594794 - DNA, 25 bp, Homo sapien
aattcttgtggatcagagctgggat

SEQ ID NO: 594795 - DNA, 25 bp, Homo sapien
gggattatgtccatagctaacctgg

SEQ ID NO: 594796 - DNA, 25 bp, Homo sapien
gagtttgccaacttttgcaacccca

SEQ ID NO: 594797 - DNA, 25 bp, Homo sapien
tgcaaccccagtattctggtaattt

SEQ ID NO: 594798 - DNA, 25 bp, Homo sapien
gcgtaacaatattggtcttccaggt

SEQ ID NO: 594799 - DNA, 25 bp, Homo sapien
acaatattggtcttccaggtgttac

SEQ ID NO: 594800 - DNA, 25 bp, Homo sapien
attggtcttccaggtgttactcatt

SEQ ID NO: 594801 - DNA, 25 bp, Homo sapien
ggtcttccaggtgttactcatttca

SEQ ID NO: 594802 - DNA, 25 bp, Homo sapien
tccaggtgttactcatttcaattat

SEQ ID NO: 594803 - DNA, 25 bp, Homo sapien
gttactcatttcaattatgtgtagt

SEQ ID NO: 594804 - DNA, 25 bp, Homo sapien
tatgtgtagtataccaggacagacc

SEQ ID NO: 594805 - DNA, 25 bp, Homo sapien
gtagtataccaggacagacctattt

SEQ ID NO: 594806 - DNA, 25 bp, Homo sapien
ataccaggacagacctattttcatg

SEQ ID NO: 594807 - DNA, 25 bp, Homo sapien
aggacagacctattttcatgtctta

SEQ ID NO: 594808 - DNA, 25 bp, Homo sapien
tttctttaaagagctgcttcattgg

SEQ ID NO: 594809 - DNA, 25 bp, Homo sapien
agtgctcaattatttaggtgtgctt

SEQ ID NO: 594810 - DNA, 25 bp, Homo sapien
atttaggtgtgcttcacctgagata

SEQ ID NO: 594811 - DNA, 25 bp, Homo sapien
ggtgtgcttcacctgagatacacag

SEQ ID NO: 594812 - DNA, 25 bp, Homo sapien
gcttcacctgagatacacagagcat

SEQ ID NO: 594813 - DNA, 25 bp, Homo sapien
ccaggcagaaaccttaaaatgtatg

SEQ ID NO: 594814 - DNA, 25 bp, Homo sapien
ttgtgccaaattagattcccagccc

SEQ ID NO: 594815 - DNA, 25 bp, Homo sapien
aaattagattcccagcccctagaga

SEQ ID NO: 594816 - DNA, 25 bp, Homo sapien
cagcccctagagataaccactaatt

SEQ ID NO: 594817 - DNA, 25 bp, Homo sapien
cgctggagcgttttgcctgtatttt

SEQ ID NO: 594818 - DNA, 25 bp, Homo sapien
ctggagcgttttgcctgtattttgt

SEQ ID NO: 594819 - DNA, 25 bp, Homo sapien
atataaacgtggattttgtatttgt

SEQ ID NO: 594820 - DNA, 25 bp, Homo sapien
gtgctaccactgcagagttaagaag

SEQ ID NO: 594821 - DNA, 25 bp, Homo sapien
gctaccactgcagagttaagaagta

SEQ ID NO: 594822 - DNA, 25 bp, Homo sapien
taccactgcagagttaagaagtagc

SEQ ID NO: 594823 - DNA, 25 bp, Homo sapien
cactgcagagttaagaagtagcaca

SEQ ID NO: 594824 - DNA, 25 bp, Homo sapien
gaagtagcacagatgtcccacagcc

SEQ ID NO: 594825 - DNA, 25 bp, Homo sapien
ccacagcccacagaatcaggaatat

SEQ ID NO: 594826 - DNA, 25 bp, Homo sapien
aatcaggaatattttactctctggc

SEQ ID NO: 594827 - DNA, 25 bp, Homo sapien
ggcgaagggctcataatgcacactt

SEQ ID NO: 594828 - DNA, 25 bp, Homo sapien
cacacttgaggatgggcggcagaaa

SEQ ID NO: 594829 - DNA, 25 bp, Homo sapien
cggcagaaaagacttccagctgggt

SEQ ID NO: 594830 - DNA, 25 bp, Homo sapien
agcctggactaaagaatgagacctt

SEQ ID NO: 594831 - DNA, 25 bp, Homo sapien
gagtgttcgatttcaatcttcatag

SEQ ID NO: 594832 - DNA, 25 bp, Homo sapien
gtcattgtgcaatttcatcttactc

SEQ ID NO: 594833 - DNA, 25 bp, Homo sapien
tgcaatttcatcttactcagtcctg

SEQ ID NO: 594834 - DNA, 25 bp, Homo sapien
atcttactcagtcctgaacgcaggg

SEQ ID NO: 594835 - DNA, 25 bp, Homo sapien
gtcctgaacgcagggctagaggaat

SEQ ID NO: 594836 - DNA, 25 bp, Homo sapien
gggctagaaattaccctgcttctat

SEQ ID NO: 594837 - DNA, 25 bp, Homo sapien
gaaattaccctgcttctatttaaca

SEQ ID NO: 594838 - DNA, 25 bp, Homo sapien
taccctgcttctatttaacaaactg

SEQ ID NO: 594839 - DNA, 25 bp, Homo sapien
aactgtttttagtaatccagattct

SEQ ID NO: 594840 - DNA, 25 bp, Homo sapien
tcaatgtccctctaagtctatcctt

SEQ ID NO: 594841 - DNA, 25 bp, Homo sapien
atgtccctctaagtctatccttggg

SEQ ID NO: 594842 - DNA, 25 bp, Homo sapien
tgagcagagggctgcaccctgctta

SEQ ID NO: 594843 - DNA, 25 bp, Homo sapien
gctgcaccctgcttagttctaaaga

SEQ ID NO: 594844 - DNA, 25 bp, Homo sapien
aagacacctagactttatcctgaaa

SEQ ID NO: 594845 - DNA, 25 bp, Homo sapien
aaagccactgagaggcccatatttt

SEQ ID NO: 594846 - DNA, 25 bp, Homo sapien
gaggcccatattttgaaacactcag

SEQ ID NO: 594847 - DNA, 25 bp, Homo sapien
gaaatcgaacatagctgactccatg

SEQ ID NO: 594848 - DNA, 25 bp, Homo sapien
tgactccatgttgcttctgactcct

SEQ ID NO: 594849 - DNA, 25 bp, Homo sapien
gactcctcaagctaactgcttttag

SEQ ID NO: 594850 - DNA, 25 bp, Homo sapien
tgcttttaggcacttctgcacacgg

SEQ ID NO: 594851 - DNA, 25 bp, Homo sapien
ctgcacacgggccaagttaatcatg

SEQ ID NO: 594852 - DNA, 25 bp, Homo sapien
gatgataagcgttcctttccaaaac

SEQ ID NO: 594853 - DNA, 25 bp, Homo sapien
ttctaatttcccagtgatccctcca

SEQ ID NO: 594854 - DNA, 25 bp, Homo sapien
agtgatccctccaagtctgtgggat

SEQ ID NO: 594855 - DNA, 25 bp, Homo sapien
ccaagtctgtgggatggcctggaat

SEQ ID NO: 594856 - DNA, 25 bp, Homo sapien
ggatggcctggaatgtaaaaacact

SEQ ID NO: 594857 - DNA, 25 bp, Homo sapien
aaacaatggcggaagctttaagaat

SEQ ID NO: 594858 - DNA, 25 bp, Homo sapien
gaaagctgtggtacggaaagaaaga

SEQ ID NO: 594859 - DNA, 25 bp, Homo sapien
aagaaagagtgtggccacgagcttc

SEQ ID NO: 594860 - DNA, 25 bp, Homo sapien
tgtggccacgagcttccagtatgct

SEQ ID NO: 594861 - DNA, 25 bp, Homo sapien
gagcttccagtatgctcactgccaa

SEQ ID NO: 594862 - DNA, 25 bp, Homo sapien
tatgctcactgccaaggaatcctga

SEQ ID NO: 594863 - DNA, 25 bp, Homo sapien
cactgccaaggaatcctgacacgtt

SEQ ID NO: 594864 - DNA, 25 bp, Homo sapien
ggtgacatgccactagatctgcaat

SEQ ID NO: 594865 - DNA, 25 bp, Homo sapien
gacatgccactagatctgcaattta

SEQ ID NO: 594866 - DNA, 25 bp, Homo sapien
catgccactagatctgcaatttaac

SEQ ID NO: 594867 - DNA, 25 bp, Homo sapien
aacttaaaatggttcagagaaggct

SEQ ID NO: 594868 - DNA, 25 bp, Homo sapien
tagccaggcacagtgtcgtgcacct

SEQ ID NO: 594869 - DNA, 25 bp, Homo sapien
aggcacagtgtcgtgcacctgcagt

SEQ ID NO: 594870 - DNA, 25 bp, Homo sapien
ggcacagtgtcgtgcacctgcagtc

SEQ ID NO: 594871 - DNA, 25 bp, Homo sapien
gcaatgagctgttattgagccaccg

SEQ ID NO: 594872 - DNA, 25 bp, Homo sapien
aatgagctgttattgagccaccgta

SEQ ID NO: 594873 - DNA, 25 bp, Homo sapien
tgagctgttattgagccaccgtact

SEQ ID NO: 594874 - DNA, 25 bp, Homo sapien
agctgttattgagccaccgtactca

SEQ ID NO: 594875 - DNA, 25 bp, Homo sapien
tcaaagaggtccacggttggccagg

SEQ ID NO: 594876 - DNA, 25 bp, Homo sapien
caaagaggtccacggttggccaggt

SEQ ID NO: 594877 - DNA, 25 bp, Homo sapien
aaagaggtccacggttggccaggtg

SEQ ID NO: 594878 - DNA, 25 bp, Homo sapien
aagaggtccacggttggccaggtgc

SEQ ID NO: 594879 - DNA, 25 bp, Homo sapien
agaggtccacggttggccaggtgcg

SEQ ID NO: 594880 - DNA, 25 bp, Homo sapien
gaggtccacggttggccaggtgcgg

SEQ ID NO: 594881 - DNA, 25 bp, Homo sapien
aggtccacggttggccaggtgcggt

SEQ ID NO: 594882 - DNA, 25 bp, Homo sapien
ggtccacggttggccaggtgcggtg

SEQ ID NO: 594883 - DNA, 25 bp, Homo sapien
gcactccgggaggccgaagcgggca

SEQ ID NO: 594884 - DNA, 25 bp, Homo sapien
actccgggaggccgaagcgggcaga

SEQ ID NO: 594885 - DNA, 25 bp, Homo sapien
catctccactaaaaaacaagaacaa

SEQ ID NO: 594886 - DNA, 25 bp, Homo sapien
tgctggcctctcaaacttaatgtgt

SEQ ID NO: 594887 - DNA, 25 bp, Homo sapien
gctggcctctcaaacttaatgtgtt

SEQ ID NO: 594888 - DNA, 25 bp, Homo sapien
ctggcctctcaaacttaatgtgttc

SEQ ID NO: 594889 - DNA, 25 bp, Homo sapien
tggcctctcaaacttaatgtgttca

SEQ ID NO: 594890 - DNA, 25 bp, Homo sapien
ggcctctcaaacttaatgtgttcat

SEQ ID NO: 594891 - DNA, 25 bp, Homo sapien
gcctctcaaacttaatgtgttcatt

SEQ ID NO: 594892 - DNA, 25 bp, Homo sapien
cctctcaaacttaatgtgttcattg

SEQ ID NO: 594893 - DNA, 25 bp, Homo sapien
ctctcaaacttaatgtgttcattgc

SEQ ID NO: 594894 - DNA, 25 bp, Homo sapien
ctcaaacttaatgtgttcattgcgg

SEQ ID NO: 594895 - DNA, 25 bp, Homo sapien
tcaaacttaatgtgttcattgcgga

SEQ ID NO: 594896 - DNA, 25 bp, Homo sapien
caaacttaatgtgttcattgcggaa

SEQ ID NO: 594897 - DNA, 25 bp, Homo sapien
ctgcagttgagttgtgatagcactg

SEQ ID NO: 594898 - DNA, 25 bp, Homo sapien
agttgagttgtgatagcactgcagt

SEQ ID NO: 594899 - DNA, 25 bp, Homo sapien
ttgagttgtgatagcactgcagtgc

SEQ ID NO: 594900 - DNA, 25 bp, Homo sapien
tgagttgtgatagcactgcagtgca

SEQ ID NO: 594901 - DNA, 25 bp, Homo sapien
agttgtgatagcactgcagtgcagc

SEQ ID NO: 594902 - DNA, 25 bp, Homo sapien
gttgtgatagcactgcagtgcagcc

SEQ ID NO: 594903 - DNA, 25 bp, Homo sapien
aaaaaaggtgatcttcctccagcct

SEQ ID NO: 594904 - DNA, 25 bp, Homo sapien
aaaaaggtgatcttcctccagccta

SEQ ID NO: 594905 - DNA, 25 bp, Homo sapien
aaaaggtgatcttcctccagcctaa

SEQ ID NO: 594906 - DNA, 25 bp, Homo sapien
aaaggtgatcttcctccagcctaag

SEQ ID NO: 594907 - DNA, 25 bp, Homo sapien
aaggtgatcttcctccagcctaagc

SEQ ID NO: 594908 - DNA, 25 bp, Homo sapien
aataagctctcagtaagaaggttct

SEQ ID NO: 594909 - DNA, 25 bp, Homo sapien
cagtaagaaggttctgatggcccag

SEQ ID NO: 594910 - DNA, 25 bp, Homo sapien
gtaagaaggttctgatggcccaggc

SEQ ID NO: 594911 - DNA, 25 bp, Homo sapien
taagaaggttctgatggcccaggca

SEQ ID NO: 594912 - DNA, 25 bp, Homo sapien
aagaaggttctgatggcccaggcac

SEQ ID NO: 594913 - DNA, 25 bp, Homo sapien
gaaggttctgatggcccaggcacta

SEQ ID NO: 594914 - DNA, 25 bp, Homo sapien
gttctgatggcccaggcactatggc

SEQ ID NO: 594915 - DNA, 25 bp, Homo sapien
aggcactatggctcaggccagcact

SEQ ID NO: 594916 - DNA, 25 bp, Homo sapien
ggcactatggctcaggccagcactt

SEQ ID NO: 594917 - DNA, 25 bp, Homo sapien
gcactatggctcaggccagcacttt

SEQ ID NO: 594918 - DNA, 25 bp, Homo sapien
cactatggctcaggccagcactttg

SEQ ID NO: 594919 - DNA, 25 bp, Homo sapien
gggtgcttcttgtggcccaccatga

SEQ ID NO: 594920 - DNA, 25 bp, Homo sapien
ggtgcttcttgtggcccaccatgaa

SEQ ID NO: 594921 - DNA, 25 bp, Homo sapien
cttcttgtggcccaccatgaaggat

SEQ ID NO: 594922 - DNA, 25 bp, Homo sapien
ttcttgtggcccaccatgaaggatg

SEQ ID NO: 594923 - DNA, 25 bp, Homo sapien
tcttgtggcccaccatgaaggatga

SEQ ID NO: 594924 - DNA, 25 bp, Homo sapien
cttgtggcccaccatgaaggatgag

SEQ ID NO: 594925 - DNA, 25 bp, Homo sapien
ttgtggcccaccatgaaggatgagc

SEQ ID NO: 594926 - DNA, 25 bp, Homo sapien
atgagctgcacttttagtttaatgt

SEQ ID NO: 594927 - DNA, 25 bp, Homo sapien
tgagctgcacttttagtttaatgta

SEQ ID NO: 594928 - DNA, 25 bp, Homo sapien
gagctgcacttttagtttaatgtaa

SEQ ID NO: 594929 - DNA, 25 bp, Homo sapien
agctgcacttttagtttaatgtaac

SEQ ID NO: 594930 - DNA, 25 bp, Homo sapien
ttaaggacggtaaacgatatcatat

SEQ ID NO: 594931 - DNA, 25 bp, Homo sapien
cgatatcatatttaagggcttggca

SEQ ID NO: 594932 - DNA, 25 bp, Homo sapien
taagggcttggcacttcgttgactc

SEQ ID NO: 594933 - DNA, 25 bp, Homo sapien
gcttggcacttcgttgactcgataa

SEQ ID NO: 594934 - DNA, 25 bp, Homo sapien
gactcgataaatagtagctactact

SEQ ID NO: 594935 - DNA, 25 bp, Homo sapien
actactttgagctattattcccttt

SEQ ID NO: 594936 - DNA, 25 bp, Homo sapien
ttccctttcatgaaaatcctcctac

SEQ ID NO: 594937 - DNA, 25 bp, Homo sapien
atcctcctactaaaactatgtgctt

SEQ ID NO: 594938 - DNA, 25 bp, Homo sapien
gcttcttccaacagagacagccaaa

SEQ ID NO: 594939 - DNA, 25 bp, Homo sapien
ttaagactgatggagaaatttcccc

SEQ ID NO: 594940 - DNA, 25 bp, Homo sapien
gatggagaaatttcccccagcaata

SEQ ID NO: 594941 - DNA, 25 bp, Homo sapien
cacagcaataccacgtcaccttttt

SEQ ID NO: 594942 - DNA, 25 bp, Homo sapien
tcacctttttcccatcttgaggtat

SEQ ID NO: 594943 - DNA, 25 bp, Homo sapien
tttcccatcttgaggtatgaacact

SEQ ID NO: 594944 - DNA, 25 bp, Homo sapien
ggtatgaacacttcctttgttagga

SEQ ID NO: 594945 - DNA, 25 bp, Homo sapien
aatgcaagaaacactgcacaggatt

SEQ ID NO: 594946 - DNA, 25 bp, Homo sapien
tgcacaggattaccaaaaacagcaa

SEQ ID NO: 594947 - DNA, 25 bp, Homo sapien
cagcaacaaacatcacagtgtggtt

SEQ ID NO: 594948 - DNA, 25 bp, Homo sapien
caattcaacagagaccattttgttt

SEQ ID NO: 594949 - DNA, 25 bp, Homo sapien
aagtcacagtctcagtgggagccca

SEQ ID NO: 594950 - DNA, 25 bp, Homo sapien
cacagtctcagtgggagcccagtga

SEQ ID NO: 594951 - DNA, 25 bp, Homo sapien
agcccagtgagatgtacggcacctc

SEQ ID NO: 594952 - DNA, 25 bp, Homo sapien
ggaaatcatcttgccctgggccctg

SEQ ID NO: 594953 - DNA, 25 bp, Homo sapien
atcatcttgccctgggccctgtgat

SEQ ID NO: 594954 - DNA, 25 bp, Homo sapien
cctgtgatctgcttgaaaggaaagc

SEQ ID NO: 594955 - DNA, 25 bp, Homo sapien
ctataaggaggatgtgtagttgcaa

SEQ ID NO: 594956 - DNA, 25 bp, Homo sapien
gtgtagttgcaaaaatggctccatc

SEQ ID NO: 594957 - DNA, 25 bp, Homo sapien
aaatggctccatcggtaactcaagc

SEQ ID NO: 594958 - DNA, 25 bp, Homo sapien
atggctccatcggtaactcaagctt

SEQ ID NO: 594959 - DNA, 25 bp, Homo sapien
ctccatcggtaactcaagcttcaga

SEQ ID NO: 594960 - DNA, 25 bp, Homo sapien
atcggtaactcaagcttcagaatgt

SEQ ID NO: 594961 - DNA, 25 bp, Homo sapien
gtaactcaagcttcagaatgttatg

SEQ ID NO: 594962 - DNA, 25 bp, Homo sapien
gtctgtaatctggtcagattcagtt

SEQ ID NO: 594963 - DNA, 25 bp, Homo sapien
actgggagtcagacatctaaaatat

SEQ ID NO: 594964 - DNA, 25 bp, Homo sapien
atatgaagttccaccctcatgttgg

SEQ ID NO: 594965 - DNA, 25 bp, Homo sapien
agttccaccctcatgttggccattt

SEQ ID NO: 594966 - DNA, 25 bp, Homo sapien
tttcctgtggagacaatagcgtgtg

SEQ ID NO: 594967 - DNA, 25 bp, Homo sapien
aatagcgtgtggtggaactgcctga

SEQ ID NO: 594968 - DNA, 25 bp, Homo sapien
ggaactgcctgagtgcttactgaga

SEQ ID NO: 594969 - DNA, 25 bp, Homo sapien
gcctgagtgcttactgagaaggaga

SEQ ID NO: 594970 - DNA, 25 bp, Homo sapien
agcgcagattgtacagaagctgacg

SEQ ID NO: 594971 - DNA, 25 bp, Homo sapien
tgtacagaagctgacgaatgagtcc

SEQ ID NO: 594972 - DNA, 25 bp, Homo sapien
attgtggacaagtgatggcgctttt

SEQ ID NO: 594973 - DNA, 25 bp, Homo sapien
tggacaagtgatggcgctttttgta

SEQ ID NO: 594974 - DNA, 25 bp, Homo sapien
aaagtgccacgtctgacccgtgctg

SEQ ID NO: 594975 - DNA, 25 bp, Homo sapien
acgtctgacccgtgctggacacgat

SEQ ID NO: 594976 - DNA, 25 bp, Homo sapien
tgacccgtgctggacacgatcagga

SEQ ID NO: 594977 - DNA, 25 bp, Homo sapien
gtgctggacacgatcaggaactcaa

SEQ ID NO: 594978 - DNA, 25 bp, Homo sapien
ggacacgatcaggaactcaaagttt

SEQ ID NO: 594979 - DNA, 25 bp, Homo sapien
tcaggaactcaaagttttcctctga

SEQ ID NO: 594980 - DNA, 25 bp, Homo sapien
caagaccgtcctccctgatgtccat

SEQ ID NO: 594981 - DNA, 25 bp, Homo sapien
atgtccatcccgagcccctgggagt

SEQ ID NO: 594982 - DNA, 25 bp, Homo sapien
agcaggaagcccgagcacatgcagg

SEQ ID NO: 594983 - DNA, 25 bp, Homo sapien
tccccacttgttacctgctttataa

SEQ ID NO: 594984 - DNA, 25 bp, Homo sapien
cccacttgttacctgctttataaat

SEQ ID NO: 594985 - DNA, 25 bp, Homo sapien
ccttccatgtctaactgtaggattt

SEQ ID NO: 594986 - DNA, 25 bp, Homo sapien
aactgtaggatttgtcattccattg

SEQ ID NO: 594987 - DNA, 25 bp, Homo sapien
tgtcattccattgtgttagctgtgt

SEQ ID NO: 594988 - DNA, 25 bp, Homo sapien
ccattgtgttagctgtgtgggtaca

SEQ ID NO: 594989 - DNA, 25 bp, Homo sapien
gtacattagtaccatgattaaccaa

SEQ ID NO: 594990 - DNA, 25 bp, Homo sapien
tactcgccacagtgatcatctctat

SEQ ID NO: 594991 - DNA, 25 bp, Homo sapien
tgatcatctctatacacacactgca

SEQ ID NO: 594992 - DNA, 25 bp, Homo sapien
ctctatacacacactgcagtcattt

SEQ ID NO: 594993 - DNA, 25 bp, Homo sapien
gatgcaattcacatggcataaaatt

SEQ ID NO: 594994 - DNA, 25 bp, Homo sapien
ttcaccatgctatagaaccactgcc

SEQ ID NO: 594995 - DNA, 25 bp, Homo sapien
aaccactgcctgtatctagtttcaa

SEQ ID NO: 594996 - DNA, 25 bp, Homo sapien
gcaaactgggatggtgagtcactga

SEQ ID NO: 594997 - DNA, 25 bp, Homo sapien
atggtgagtcactgatatagtttga

SEQ ID NO: 594998 - DNA, 25 bp, Homo sapien
tggtgagtcactgatatagtttgac

SEQ ID NO: 594999 - DNA, 25 bp, Homo sapien
ttttaataatccctaggtgtcaaga

SEQ ID NO: 595000 - DNA, 25 bp, Homo sapien
ttaataatccctaggtgtcaagagc

SEQ ID NO: 595001 - DNA, 25 bp, Homo sapien
aataatccctaggtgtcaagagcag

SEQ ID NO: 595002 - DNA, 25 bp, Homo sapien
ataatccctaggtgtcaagagcagg

SEQ ID NO: 595003 - DNA, 25 bp, Homo sapien
aatccctaggtgtcaagagcaggac

SEQ ID NO: 595004 - DNA, 25 bp, Homo sapien
tccctaggtgtcaagagcaggacca

SEQ ID NO: 595005 - DNA, 25 bp, Homo sapien
ccctaggtgtcaagagcaggaccaa

SEQ ID NO: 595006 - DNA, 25 bp, Homo sapien
taggtgtcaagagcaggaccaagta

SEQ ID NO: 595007 - DNA, 25 bp, Homo sapien
ggaaggatcagcatcacggaaggtc

SEQ ID NO: 595008 - DNA, 25 bp, Homo sapien
gaaggatcagcatcacggaaggtct

SEQ ID NO: 595009 - DNA, 25 bp, Homo sapien
aaggatcagcatcacggaaggtctt

SEQ ID NO: 595010 - DNA, 25 bp, Homo sapien
aggatcagcatcacggaaggtcttg

SEQ ID NO: 595011 - DNA, 25 bp, Homo sapien
ggatcagcatcacggaaggtcttgt

SEQ ID NO: 595012 - DNA, 25 bp, Homo sapien
gatcagcatcacggaaggtcttgtc

SEQ ID NO: 595013 - DNA, 25 bp, Homo sapien
atcagcatcacggaaggtcttgtca

SEQ ID NO: 595014 - DNA, 25 bp, Homo sapien
tcagcatcacggaaggtcttgtcaa

SEQ ID NO: 595015 - DNA, 25 bp, Homo sapien
cagcatcacggaaggtcttgtcaaa

SEQ ID NO: 595016 - DNA, 25 bp, Homo sapien
agcatcacggaaggtcttgtcaaaa

SEQ ID NO: 595017 - DNA, 25 bp, Homo sapien
tgccttgtttgtaatgttaaagttt

SEQ ID NO: 595018 - DNA, 25 bp, Homo sapien
agccggagacagttatccttagcaa

SEQ ID NO: 595019 - DNA, 25 bp, Homo sapien
ccggagacagttatccttagcaaac

SEQ ID NO: 595020 - DNA, 25 bp, Homo sapien
gccaaatactgcatattcttacgta

SEQ ID NO: 595021 - DNA, 25 bp, Homo sapien
tgagcacaaagtaggaaaccacaga

SEQ ID NO: 595022 - DNA, 25 bp, Homo sapien
aaaccacagacagtggcatctcctt

SEQ ID NO: 595023 - DNA, 25 bp, Homo sapien
acagacagtggcatctccttgagga

SEQ ID NO: 595024 - DNA, 25 bp, Homo sapien
gacagtggcatctccttgaggatat

SEQ ID NO: 595025 - DNA, 25 bp, Homo sapien
agtggcatctccttgaggatatagg

SEQ ID NO: 595026 - DNA, 25 bp, Homo sapien
atctccttgaggatatagggtggga

SEQ ID NO: 595027 - DNA, 25 bp, Homo sapien
tgtataacaaaaccccgtgacatga

SEQ ID NO: 595028 - DNA, 25 bp, Homo sapien
ccgtgacatgagtttgcctatgtaa

SEQ ID NO: 595029 - DNA, 25 bp, Homo sapien
agccactgtgcacgttgggattaat

SEQ ID NO: 595030 - DNA, 25 bp, Homo sapien
cactgtgcacgttgggattaatatt

SEQ ID NO: 595031 - DNA, 25 bp, Homo sapien
gcacgttgggattaatattttctta

SEQ ID NO: 595032 - DNA, 25 bp, Homo sapien
attttcttattcgtatttccatggc

SEQ ID NO: 595033 - DNA, 25 bp, Homo sapien
tttcttattcgtatttccatggcag

SEQ ID NO: 595034 - DNA, 25 bp, Homo sapien
cttattcgtatttccatggcagaat

SEQ ID NO: 595035 - DNA, 25 bp, Homo sapien
atggcagaatattcctcactgctag

SEQ ID NO: 595036 - DNA, 25 bp, Homo sapien
ggcagaatattcctcactgctagaa

SEQ ID NO: 595037 - DNA, 25 bp, Homo sapien
agaatattcctcactgctagaatga

SEQ ID NO: 595038 - DNA, 25 bp, Homo sapien
aatattcctcactgctagaatgaga

SEQ ID NO: 595039 - DNA, 25 bp, Homo sapien
ctgctagaatgagaccagaggtcaa

SEQ ID NO: 595040 - DNA, 25 bp, Homo sapien
gtccaagaagtatctctattagata

SEQ ID NO: 595041 - DNA, 25 bp, Homo sapien
aagaatctggagaaaggctttccaa

SEQ ID NO: 595042 - DNA, 25 bp, Homo sapien
aaggctttccaaaatggtagaggat

SEQ ID NO: 595043 - DNA, 25 bp, Homo sapien
gatgcgtgtatgttgctggcagatt

SEQ ID NO: 595044 - DNA, 25 bp, Homo sapien
gttgctggcagattacaatggcaga

SEQ ID NO: 595045 - DNA, 25 bp, Homo sapien
ttacaatggcagattggcggcagaa

SEQ ID NO: 595046 - DNA, 25 bp, Homo sapien
gatgatagaaagcaactcactcgaa

SEQ ID NO: 595047 - DNA, 25 bp, Homo sapien
gcaactcactcgaatgttagcagat

SEQ ID NO: 595048 - DNA, 25 bp, Homo sapien
gttagcagattttcttcgttgtcaa

SEQ ID NO: 595049 - DNA, 25 bp, Homo sapien
gcagattttcttcgttgtcaaaagg

SEQ ID NO: 595050 - DNA, 25 bp, Homo sapien
tgtcaaaaggaagcccttgcagaga

SEQ ID NO: 595051 - DNA, 25 bp, Homo sapien
caataaatattaatcccttccccag

SEQ ID NO: 595052 - DNA, 25 bp, Homo sapien
ccttccccagaccaatgctgtattt

SEQ ID NO: 595053 - DNA, 25 bp, Homo sapien
cagaccaatgctgtatttccatttc

SEQ ID NO: 595054 - DNA, 25 bp, Homo sapien
gggcacatgccacattgtctaaatc

SEQ ID NO: 595055 - DNA, 25 bp, Homo sapien
tgttttattcactcatacatcaaag

SEQ ID NO: 595056 - DNA, 25 bp, Homo sapien
cctgatagactttgcattagaacat

SEQ ID NO: 595057 - DNA, 25 bp, Homo sapien
gactttgcattagaacattggtgga

SEQ ID NO: 595058 - DNA, 25 bp, Homo sapien
gaatgcaccagaaaatctcctcttt

SEQ ID NO: 595059 - DNA, 25 bp, Homo sapien
agaaaatctcctctttaggtgccca

SEQ ID NO: 595060 - DNA, 25 bp, Homo sapien
aaaatctcctctttaggtgcccact

SEQ ID NO: 595061 - DNA, 25 bp, Homo sapien
ctttaggtgcccacttctgagcttt

SEQ ID NO: 595062 - DNA, 25 bp, Homo sapien
tgagagccaccctaccttgttcctg

SEQ ID NO: 595063 - DNA, 25 bp, Homo sapien
gagccaccctaccttgttcctgtgg

SEQ ID NO: 595064 - DNA, 25 bp, Homo sapien
gcagttggcatctgacagcctggca

SEQ ID NO: 595065 - DNA, 25 bp, Homo sapien
agttggcatctgacagcctggcatc

SEQ ID NO: 595066 - DNA, 25 bp, Homo sapien
agcgaaagcaagctctagagagaaa

SEQ ID NO: 595067 - DNA, 25 bp, Homo sapien
tgccgcagggcaaactacttcaaac

SEQ ID NO: 595068 - DNA, 25 bp, Homo sapien
gcagggcaaactacttcaaacgaat

SEQ ID NO: 595069 - DNA, 25 bp, Homo sapien
ggcaaactacttcaaacgaattcgt

SEQ ID NO: 595070 - DNA, 25 bp, Homo sapien
aacgaattcgtttcgctcttgtgaa

SEQ ID NO: 595071 - DNA, 25 bp, Homo sapien
attcgtttcgctcttgtgaaactga

SEQ ID NO: 595072 - DNA, 25 bp, Homo sapien
tgtgaaactgaagacaatttccttt

SEQ ID NO: 595073 - DNA, 25 bp, Homo sapien
cagtaagaaggttctgatggcccag

SEQ ID NO: 595074 - DNA, 25 bp, Homo sapien
agtaagaaggttctgatggcccagg

SEQ ID NO: 595075 - DNA, 25 bp, Homo sapien
gtaagaaggttctgatggcccaggc

SEQ ID NO: 595076 - DNA, 25 bp, Homo sapien
taagaaggttctgatggcccaggca

SEQ ID NO: 595077 - DNA, 25 bp, Homo sapien
aagaaggttctgatggcccaggcac

SEQ ID NO: 595078 - DNA, 25 bp, Homo sapien
aggcactatggctcaggccagcact

SEQ ID NO: 595079 - DNA, 25 bp, Homo sapien
ggcactatggctcaggccagcactt

SEQ ID NO: 595080 - DNA, 25 bp, Homo sapien
gcactatggctcaggccagcacttt

SEQ ID NO: 595081 - DNA, 25 bp, Homo sapien
cactatggctcaggccagcactttg

SEQ ID NO: 595082 - DNA, 25 bp, Homo sapien
actatggctcaggccagcactttgg

SEQ ID NO: 595083 - DNA, 25 bp, Homo sapien
cgcgcccggccagggactttcatct

SEQ ID NO: 595084 - DNA, 25 bp, Homo sapien
agggactttcatctccctcagatgt

SEQ ID NO: 595085 - DNA, 25 bp, Homo sapien
gggactttcatctccctcagatgtc

SEQ ID NO: 595086 - DNA, 25 bp, Homo sapien
ggactttcatctccctcagatgtcc

SEQ ID NO: 595087 - DNA, 25 bp, Homo sapien
actttcatctccctcagatgtcccc

SEQ ID NO: 595088 - DNA, 25 bp, Homo sapien
tttcatctccctcagatgtcccctt

SEQ ID NO: 595089 - DNA, 25 bp, Homo sapien
ttcatctccctcagatgtccccttg

SEQ ID NO: 595090 - DNA, 25 bp, Homo sapien
tcatctccctcagatgtccccttga

SEQ ID NO: 595091 - DNA, 25 bp, Homo sapien
atctccctcagatgtccccttgacc

SEQ ID NO: 595092 - DNA, 25 bp, Homo sapien
tccctcagatgtccccttgacccca

SEQ ID NO: 595093 - DNA, 25 bp, Homo sapien
cctcagatgtccccttgaccccagg

SEQ ID NO: 595094 - DNA, 25 bp, Homo sapien
gagctctacccgatcgacgacgtct

SEQ ID NO: 595095 - DNA, 25 bp, Homo sapien
tacccgatcgacgacgtctttctgg

SEQ ID NO: 595096 - DNA, 25 bp, Homo sapien
ccgatcgacgacgtctttctgggca

SEQ ID NO: 595097 - DNA, 25 bp, Homo sapien
cccacgagggcttcaagactttcgg

SEQ ID NO: 595098 - DNA, 25 bp, Homo sapien
acgagggcttcaagactttcggcat

SEQ ID NO: 595099 - DNA, 25 bp, Homo sapien
gagggcttcaagactttcggcatct

SEQ ID NO: 595100 - DNA, 25 bp, Homo sapien
agggcttcaagactttcggcatctc

SEQ ID NO: 595101 - DNA, 25 bp, Homo sapien
gggcttcaagactttcggcatctcc

SEQ ID NO: 595102 - DNA, 25 bp, Homo sapien
gcttcaagactttcggcatctcccg

SEQ ID NO: 595103 - DNA, 25 bp, Homo sapien
caagactttcggcatctcccggaac

SEQ ID NO: 595104 - DNA, 25 bp, Homo sapien
gcatctcccggaaccgcaacagccg

SEQ ID NO: 595105 - DNA, 25 bp, Homo sapien
acctcttcatctcagactttgcata

SEQ ID NO: 595106 - DNA, 25 bp, Homo sapien
ctcttcatctcagactttgcatact

SEQ ID NO: 595107 - DNA, 25 bp, Homo sapien
ttcatctcagactttgcatactgct

SEQ ID NO: 595108 - DNA, 25 bp, Homo sapien
catctcagactttgcatactgctgg

SEQ ID NO: 595109 - DNA, 25 bp, Homo sapien
gactttgcatactgctgggaaaact

SEQ ID NO: 595110 - DNA, 25 bp, Homo sapien
ctttgtgtgcaatgaaggtcagcca

SEQ ID NO: 595111 - DNA, 25 bp, Homo sapien
caatgaaggtcagccattcatgcct

SEQ ID NO: 595112 - DNA, 25 bp, Homo sapien
catgccttggtacaaattcgatgac

SEQ ID NO: 595113 - DNA, 25 bp, Homo sapien
gatgacaattatgcatccctgcacc

SEQ ID NO: 595114 - DNA, 25 bp, Homo sapien
gggctggcactgattgcaactgaca

SEQ ID NO: 595115 - DNA, 25 bp, Homo sapien
gcactgattgcaactgacagccagg

SEQ ID NO: 595116 - DNA, 25 bp, Homo sapien
gagttcgtctgtttaaggtgtacct

SEQ ID NO: 595117 - DNA, 25 bp, Homo sapien
taaggtgtacctaccattcagcggt

SEQ ID NO: 595118 - DNA, 25 bp, Homo sapien
aggtgtacctaccattcagcggttt

SEQ ID NO: 595119 - DNA, 25 bp, Homo sapien
tgtacctaccattcagcggttttta

SEQ ID NO: 595120 - DNA, 25 bp, Homo sapien
tacctaccattcagcggtttttaag

SEQ ID NO: 595121 - DNA, 25 bp, Homo sapien
tgtttttgttagcatatgtcattaa

SEQ ID NO: 595122 - DNA, 25 bp, Homo sapien
atttatctatggtctttattaatta

SEQ ID NO: 595123 - DNA, 25 bp, Homo sapien
taattattatggaatggctgtatat

SEQ ID NO: 595124 - DNA, 25 bp, Homo sapien
gaatggctgtatatagataagagac

SEQ ID NO: 595125 - DNA, 25 bp, Homo sapien
attacgcataatcatacatcatact

SEQ ID NO: 595126 - DNA, 25 bp, Homo sapien
atcatacatcatactacccctaaaa

SEQ ID NO: 595127 - DNA, 25 bp, Homo sapien
ggcaaaggcaatgtgagtcccatcc

SEQ ID NO: 595128 - DNA, 25 bp, Homo sapien
aaaggcaatgtgagtcccatcctct

SEQ ID NO: 595129 - DNA, 25 bp, Homo sapien
ggtatggggaacacaaggactcctt

SEQ ID NO: 595130 - DNA, 25 bp, Homo sapien
tccttcaccggttggccagtgactg

SEQ ID NO: 595131 - DNA, 25 bp, Homo sapien
ttggccagtgactggctgtgtgtct

SEQ ID NO: 595132 - DNA, 25 bp, Homo sapien
gtgtgtctgggccaagcctgccact

SEQ ID NO: 595133 - DNA, 25 bp, Homo sapien
tggccttgggattctcatatctatg

SEQ ID NO: 595134 - DNA, 25 bp, Homo sapien
gccttgggattctcatatctatgca

SEQ ID NO: 595135 - DNA, 25 bp, Homo sapien
ctcatatctatgcagtggaaagttg

SEQ ID NO: 595136 - DNA, 25 bp, Homo sapien
tctatgcagtggaaagttggatcaa

SEQ ID NO: 595137 - DNA, 25 bp, Homo sapien
gttggatcaaattatttctcatatt

SEQ ID NO: 595138 - DNA, 25 bp, Homo sapien
gctttctactctatccgggaactta

SEQ ID NO: 595139 - DNA, 25 bp, Homo sapien
tttctactctatccgggaacttagg

SEQ ID NO: 595140 - DNA, 25 bp, Homo sapien
tctatccgggaacttagggagacct

SEQ ID NO: 595141 - DNA, 25 bp, Homo sapien
agggagaccttagtcttcctgattc

SEQ ID NO: 595142 - DNA, 25 bp, Homo sapien
gagaccttagtcttcctgattccat

SEQ ID NO: 595143 - DNA, 25 bp, Homo sapien
ttcctgattccatattcttctaaga

SEQ ID NO: 595144 - DNA, 25 bp, Homo sapien
atattcttctaagatttgcctctga

SEQ ID NO: 595145 - DNA, 25 bp, Homo sapien
gatttgcctctgaaagttgcttttg

SEQ ID NO: 595146 - DNA, 25 bp, Homo sapien
tttgcctctgaaagttgcttttgaa

SEQ ID NO: 595147 - DNA, 25 bp, Homo sapien
tttgaaatacacattccggatgggc

SEQ ID NO: 595148 - DNA, 25 bp, Homo sapien
gaaatacacattccggatgggcgtg

SEQ ID NO: 595149 - DNA, 25 bp, Homo sapien
gcaggaccaagtagagataattgaa

SEQ ID NO: 595150 - DNA, 25 bp, Homo sapien
caggaccaagtagagataattgaat

SEQ ID NO: 595151 - DNA, 25 bp, Homo sapien
ttccccctttgctcagtatcactct

SEQ ID NO: 595152 - DNA, 25 bp, Homo sapien
ccctttgctcagtatcactctccct

SEQ ID NO: 595153 - DNA, 25 bp, Homo sapien
cctttgctcagtatcactctccctc

SEQ ID NO: 595154 - DNA, 25 bp, Homo sapien
ctttgctcagtatcactctccctcc

SEQ ID NO: 595155 - DNA, 25 bp, Homo sapien
tttgctcagtatcactctccctcct

SEQ ID NO: 595156 - DNA, 25 bp, Homo sapien
ttgctcagtatcactctccctcctg

SEQ ID NO: 595157 - DNA, 25 bp, Homo sapien
tgctcagtatcactctccctcctgc

SEQ ID NO: 595158 - DNA, 25 bp, Homo sapien
gctcagtatcactctccctcctgcc

SEQ ID NO: 595159 - DNA, 25 bp, Homo sapien
ctcagtatcactctccctcctgccg

SEQ ID NO: 595160 - DNA, 25 bp, Homo sapien
actctgcctacgtagagccaaagga

SEQ ID NO: 595161 - DNA, 25 bp, Homo sapien
agattattcccatgaccacgtggac

SEQ ID NO: 595162 - DNA, 25 bp, Homo sapien
tgaccacgtggaccactatgcctca

SEQ ID NO: 595163 - DNA, 25 bp, Homo sapien
gcagtgaccacagacacagggagtc

SEQ ID NO: 595164 - DNA, 25 bp, Homo sapien
agacacagggagtcccggcaccgtt

SEQ ID NO: 595165 - DNA, 25 bp, Homo sapien
caccgttcccgggacgtggatcgag

SEQ ID NO: 595166 - DNA, 25 bp, Homo sapien
gatcgagagcaggaccacaacgagt

SEQ ID NO: 595167 - DNA, 25 bp, Homo sapien
gaccacaacgagtgcaacaagcagc

SEQ ID NO: 595168 - DNA, 25 bp, Homo sapien
gcagcgcagccgtcataaatccaag

SEQ ID NO: 595169 - DNA, 25 bp, Homo sapien
aaatccaaggatcgctactgtgaaa

SEQ ID NO: 595170 - DNA, 25 bp, Homo sapien
gagtggaacagggatgtttacatcc

SEQ ID NO: 595171 - DNA, 25 bp, Homo sapien
aacaatatttgctcatggcaaagac

SEQ ID NO: 595172 - DNA, 25 bp, Homo sapien
aagacaagaaaacgcctcaacaagg

SEQ ID NO: 595173 - DNA, 25 bp, Homo sapien
gttttaaggtgggatttactctcat

SEQ ID NO: 595174 - DNA, 25 bp, Homo sapien
aggtgggatttactctcatcccttt

SEQ ID NO: 595175 - DNA, 25 bp, Homo sapien
tactctcatccctttctctttaaat

SEQ ID NO: 595176 - DNA, 25 bp, Homo sapien
accatttcctttccacaaattctag

SEQ ID NO: 595177 - DNA, 25 bp, Homo sapien
agaaatttccaagcctattgtagaa

SEQ ID NO: 595178 - DNA, 25 bp, Homo sapien
tatctttccttacccaccactaagt

SEQ ID NO: 595179 - DNA, 25 bp, Homo sapien
ttacccaccactaagttcatagctg

SEQ ID NO: 595180 - DNA, 25 bp, Homo sapien
gttcatagctgagactcctataaca

SEQ ID NO: 595181 - DNA, 25 bp, Homo sapien
gagccttaagaatgaagaagcccct

SEQ ID NO: 595182 - DNA, 25 bp, Homo sapien
tagtgggagcctgtgactacctggc

SEQ ID NO: 595183 - DNA, 25 bp, Homo sapien
tgggagcctgtgactacctggctcg

SEQ ID NO: 595184 - DNA, 25 bp, Homo sapien
ggatccaggttgcagatgaaataag

SEQ ID NO: 595185 - DNA, 25 bp, Homo sapien
tgaaataaggttggatcagctgact

SEQ ID NO: 595186 - DNA, 25 bp, Homo sapien
ggttggatcagctgactttaaacta

SEQ ID NO: 595187 - DNA, 25 bp, Homo sapien
tcagctgactttaaactagggtggt

SEQ ID NO: 595188 - DNA, 25 bp, Homo sapien
actagggtggtgaccctggagcatc

SEQ ID NO: 595189 - DNA, 25 bp, Homo sapien
ggcccagtgtgatcacaaggtcctt

SEQ ID NO: 595190 - DNA, 25 bp, Homo sapien
ggaagccgaggcagcaggatcccct

SEQ ID NO: 595191 - DNA, 25 bp, Homo sapien
aggcagcaggatcccctgaatccag

SEQ ID NO: 595192 - DNA, 25 bp, Homo sapien
agccacatagtgagactgagtcctg

SEQ ID NO: 595193 - DNA, 25 bp, Homo sapien
agtcatagcctttgtgttcatcacc

SEQ ID NO: 595194 - DNA, 25 bp, Homo sapien
tcatcaccatactctccataatttg

SEQ ID NO: 595195 - DNA, 25 bp, Homo sapien
ttatttttaattccgaagcattcct

SEQ ID NO: 595196 - DNA, 25 bp, Homo sapien
cttttaatacattctcttgagggaa

SEQ ID NO: 595197 - DNA, 25 bp, Homo sapien
gtgattatgtgtggcctaagtggca

SEQ ID NO: 595198 - DNA, 25 bp, Homo sapien
gtggcaattgatcaataccccaatc

SEQ ID NO: 595199 - DNA, 25 bp, Homo sapien
atctcaagcctgtacattgttactg

SEQ ID NO: 595200 - DNA, 25 bp, Homo sapien
gcctgtacattgttactggttgact

SEQ ID NO: 595201 - DNA, 25 bp, Homo sapien
tactggttgactggttggttgcctg

SEQ ID NO: 595202 - DNA, 25 bp, Homo sapien
tggtgggctttttgtccttccagat

SEQ ID NO: 595203 - DNA, 25 bp, Homo sapien
ttccagatgtttttctaccttctgc

SEQ ID NO: 595204 - DNA, 25 bp, Homo sapien
attgtacactttacatgaatcagct

SEQ ID NO: 595205 - DNA, 25 bp, Homo sapien
gtacactttacatgaatcagctata

SEQ ID NO: 595206 - DNA, 25 bp, Homo sapien
ttacatgaatcagctatacagtatg

SEQ ID NO: 595207 - DNA, 25 bp, Homo sapien
atacagtatgtgaactatttctcca

SEQ ID NO: 595208 - DNA, 25 bp, Homo sapien
tacagtatgtgaactatttctccat

SEQ ID NO: 595209 - DNA, 25 bp, Homo sapien
acagtatgtgaactatttctccata

SEQ ID NO: 595210 - DNA, 25 bp, Homo sapien
gtatgtgaactatttctccataaag

SEQ ID NO: 595211 - DNA, 25 bp, Homo sapien
atgtgaactatttctccataaagct

SEQ ID NO: 595212 - DNA, 25 bp, Homo sapien
gtgaactatttctccataaagctgg

SEQ ID NO: 595213 - DNA, 25 bp, Homo sapien
tgaactatttctccataaagctggg

SEQ ID NO: 595214 - DNA, 25 bp, Homo sapien
aactatttctccataaagctggggg

SEQ ID NO: 595215 - DNA, 25 bp, Homo sapien
gacagtaaaataattgcttgaatgc

SEQ ID NO: 595216 - DNA, 25 bp, Homo sapien
aattgcttgaatgcataacccaact

SEQ ID NO: 595217 - DNA, 25 bp, Homo sapien
ttgcttgaatgcataacccaacttt

SEQ ID NO: 595218 - DNA, 25 bp, Homo sapien
gcttgaatgcataacccaactttga

SEQ ID NO: 595219 - DNA, 25 bp, Homo sapien
ttgaatgcataacccaactttgagg

SEQ ID NO: 595220 - DNA, 25 bp, Homo sapien
gagctgctgaggcacacctgtgtgt

SEQ ID NO: 595221 - DNA, 25 bp, Homo sapien
acacctgtgtgttgggctctcaagg

SEQ ID NO: 595222 - DNA, 25 bp, Homo sapien
cacctgtgtgttgggctctcaaggc

SEQ ID NO: 595223 - DNA, 25 bp, Homo sapien
ccagaggtgagtcggcagctgagat

SEQ ID NO: 595224 - DNA, 25 bp, Homo sapien
ttcctgcgtcctttaataagattct

SEQ ID NO: 595225 - DNA, 25 bp, Homo sapien
ctgcgtcctttaataagattctggg

SEQ ID NO: 595226 - DNA, 25 bp, Homo sapien
attacagttgcgtgccaccccgcct

SEQ ID NO: 595227 - DNA, 25 bp, Homo sapien
tcagcctccaaaatattggcattgc

SEQ ID NO: 595228 - DNA, 25 bp, Homo sapien
cagcctccaaaatattggcattgca

SEQ ID NO: 595229 - DNA, 25 bp, Homo sapien
agcctccaaaatattggcattgcag

SEQ ID NO: 595230 - DNA, 25 bp, Homo sapien
cctccaaaatattggcattgcaggc

SEQ ID NO: 595231 - DNA, 25 bp, Homo sapien
ctccaaaatattggcattgcaggca

SEQ ID NO: 595232 - DNA, 25 bp, Homo sapien
aaatattggcattgcaggcatgagc

SEQ ID NO: 595233 - DNA, 25 bp, Homo sapien
cacacctagccaaacttttaaacag

SEQ ID NO: 595234 - DNA, 25 bp, Homo sapien
ctagccaaacttttaaacagtgtgt

SEQ ID NO: 595235 - DNA, 25 bp, Homo sapien
gccaaacttttaaacagtgtgtatt

SEQ ID NO: 595236 - DNA, 25 bp, Homo sapien
catagcttattgcagcctcgaattc

SEQ ID NO: 595237 - DNA, 25 bp, Homo sapien
ttcccagcaaaaagggcagacctct

SEQ ID NO: 595238 - DNA, 25 bp, Homo sapien
gggcagacctctgaaagactaaaac

SEQ ID NO: 595239 - DNA, 25 bp, Homo sapien
cactgagtggaaaggtcagggccaa

SEQ ID NO: 595240 - DNA, 25 bp, Homo sapien
gccaaaagacacttctcagcagagc

SEQ ID NO: 595241 - DNA, 25 bp, Homo sapien
aaaagacacttctcagcagagcggg

SEQ ID NO: 595242 - DNA, 25 bp, Homo sapien
caggcagagtggaggttctcgtaac

SEQ ID NO: 595243 - DNA, 25 bp, Homo sapien
gaggttctcgtaactggaggccagt

SEQ ID NO: 595244 - DNA, 25 bp, Homo sapien
aggccagtctgcaggttggaaatgg

SEQ ID NO: 595245 - DNA, 25 bp, Homo sapien
ggaggtatgtacatgacaatcccta

SEQ ID NO: 595246 - DNA, 25 bp, Homo sapien
gtacatgacaatccctagaaatatc

SEQ ID NO: 595247 - DNA, 25 bp, Homo sapien
tgaacttcagaaattaatcccagga

SEQ ID NO: 595248 - DNA, 25 bp, Homo sapien
ggcaaactgcatatgatgaaggaga

SEQ ID NO: 595249 - DNA, 25 bp, Homo sapien
gggttcagaatattggtggcatctt

SEQ ID NO: 595250 - DNA, 25 bp, Homo sapien
ttcagaatattggtggcatcttcat

SEQ ID NO: 595251 - DNA, 25 bp, Homo sapien
cttcattgttctggcagccggcttg

SEQ ID NO: 595252 - DNA, 25 bp, Homo sapien
attgttctggcagccggcttggtgc

SEQ ID NO: 595253 - DNA, 25 bp, Homo sapien
tggcagccggcttggtgctttcagt

SEQ ID NO: 595254 - DNA, 25 bp, Homo sapien
gccggcttggtgctttcagtttttg

SEQ ID NO: 595255 - DNA, 25 bp, Homo sapien
gcttggtgctttcagtttttgtggc

SEQ ID NO: 595256 - DNA, 25 bp, Homo sapien
tggtgctttcagtttttgtggcagt

SEQ ID NO: 595257 - DNA, 25 bp, Homo sapien
tgctttcagtttttgtggcagtggg

SEQ ID NO: 595258 - DNA, 25 bp, Homo sapien
gtggcagtgggagaatttttataca

SEQ ID NO: 595259 - DNA, 25 bp, Homo sapien
aggcgcagagcctgctgcgctgcac

SEQ ID NO: 595260 - DNA, 25 bp, Homo sapien
tgctgcgctgcacggtcaacctgga

SEQ ID NO: 595261 - DNA, 25 bp, Homo sapien
ggcgcatgggtctcatccgagccgt

SEQ ID NO: 595262 - DNA, 25 bp, Homo sapien
gggtctcatccgagccgtcagcgcg

SEQ ID NO: 595263 - DNA, 25 bp, Homo sapien
cccagggtccgaatgagccctgtga

SEQ ID NO: 595264 - DNA, 25 bp, Homo sapien
acctgagccagagccgtggacatag

SEQ ID NO: 595265 - DNA, 25 bp, Homo sapien
gagccgtggacatagcttccaagga

SEQ ID NO: 595266 - DNA, 25 bp, Homo sapien
tagcttccaaggagtgcggccacaa

SEQ ID NO: 595267 - DNA, 25 bp, Homo sapien
gccacaagccggtgccagcatgaga

SEQ ID NO: 595268 - DNA, 25 bp, Homo sapien
caagccggtgccagcatgagagcag

SEQ ID NO: 595269 - DNA, 25 bp, Homo sapien
caggcacagaaggaccagtgaggaa

SEQ ID NO: 595270 - DNA, 25 bp, Homo sapien
ccacagtagggttgtcaaaatcagc

SEQ ID NO: 595271 - DNA, 25 bp, Homo sapien
gggttgtcaaaatcagcaaatctaa

SEQ ID NO: 595272 - DNA, 25 bp, Homo sapien
gatacactatacaatcctatgacca

SEQ ID NO: 595273 - DNA, 25 bp, Homo sapien
caatcctatgaccaatctcatctac

SEQ ID NO: 595274 - DNA, 25 bp, Homo sapien
cctatgaccaatctcatctacaact

SEQ ID NO: 595275 - DNA, 25 bp, Homo sapien
tattcaaattttatagaggctgagg

SEQ ID NO: 595276 - DNA, 25 bp, Homo sapien
aaggatcacttgagtttgaaaccag

SEQ ID NO: 595277 - DNA, 25 bp, Homo sapien
aaaaatagcgaggtgttgtggtaca

SEQ ID NO: 595278 - DNA, 25 bp, Homo sapien
agcgaggtgttgtggtacacgccca

SEQ ID NO: 595279 - DNA, 25 bp, Homo sapien
cgaggtgttgtggtacacgcccata

SEQ ID NO: 595280 - DNA, 25 bp, Homo sapien
aggtgttgtggtacacgcccatagt

SEQ ID NO: 595281 - DNA, 25 bp, Homo sapien
ctacctgcagctggattttgagggc

SEQ ID NO: 595282 - DNA, 25 bp, Homo sapien
gctggattttgagggcgtgctctac

SEQ ID NO: 595283 - DNA, 25 bp, Homo sapien
ttttgagggcgtgctctactagatg

SEQ ID NO: 595284 - DNA, 25 bp, Homo sapien
ggccttttgagagggcctgaaagca

SEQ ID NO: 595285 - DNA, 25 bp, Homo sapien
gagggcctgaaagcagatgccccag

SEQ ID NO: 595286 - DNA, 25 bp, Homo sapien
agagggcgcgcctctgcactaactc

SEQ ID NO: 595287 - DNA, 25 bp, Homo sapien
tctgcactaactcaggccaggtagc

SEQ ID NO: 595288 - DNA, 25 bp, Homo sapien
caggtgtggatgctgcaattcccaa

SEQ ID NO: 595289 - DNA, 25 bp, Homo sapien
ggatgctgcaattcccaatgcagag

SEQ ID NO: 595290 - DNA, 25 bp, Homo sapien
caatgcagagaagcggaccgacagc

SEQ ID NO: 595291 - DNA, 25 bp, Homo sapien
tctgatgaagacacactcctactgg

SEQ ID NO: 595292 - DNA, 25 bp, Homo sapien
caggtgagcacaagcagggctttgt

SEQ ID NO: 595293 - DNA, 25 bp, Homo sapien
aagcagggctttgtaaaacgagtag

SEQ ID NO: 595294 - DNA, 25 bp, Homo sapien
gaagctacagcaagggccaagtggc

SEQ ID NO: 595295 - DNA, 25 bp, Homo sapien
ggctcaggcacagaaacgaagcagc

SEQ ID NO: 595296 - DNA, 25 bp, Homo sapien
acgaagcagccacatgcaaaggtgt

SEQ ID NO: 595297 - DNA, 25 bp, Homo sapien
cggtgtctaacttatgtccctcccg

SEQ ID NO: 595298 - DNA, 25 bp, Homo sapien
cgcggttcacagaaggcccctgaca

SEQ ID NO: 595299 - DNA, 25 bp, Homo sapien
gaaggcccctgacactgggactaca

SEQ ID NO: 595300 - DNA, 25 bp, Homo sapien
cctgacactgggactacacggagca

SEQ ID NO: 595301 - DNA, 25 bp, Homo sapien
tacacggagcagaaagtggcacccc

SEQ ID NO: 595302 - DNA, 25 bp, Homo sapien
aaagtggcacccctttgcctcaggc

SEQ ID NO: 595303 - DNA, 25 bp, Homo sapien
attgggtacaatggttacatgcttc

SEQ ID NO: 595304 - DNA, 25 bp, Homo sapien
aatggttacatgcttcttaccctaa

SEQ ID NO: 595305 - DNA, 25 bp, Homo sapien
tggttacatgcttcttaccctaaaa

SEQ ID NO: 595306 - DNA, 25 bp, Homo sapien
taccctaaaactctggacttacaag

SEQ ID NO: 595307 - DNA, 25 bp, Homo sapien
aaactctggacttacaagtcatagt

SEQ ID NO: 595308 - DNA, 25 bp, Homo sapien
ggacttacaagtcatagttgtatgt

SEQ ID NO: 595309 - DNA, 25 bp, Homo sapien
gtatgtaagtattaaattcactgaa

SEQ ID NO: 595310 - DNA, 25 bp, Homo sapien
cactgaatgagatttttctctagac

SEQ ID NO: 595311 - DNA, 25 bp, Homo sapien
gagatttttctctagacagatatcc

SEQ ID NO: 595312 - DNA, 25 bp, Homo sapien
ttttctctagacagatatcctttct

SEQ ID NO: 595313 - DNA, 25 bp, Homo sapien
tctagacagatatcctttctgaatc

SEQ ID NO: 595314 - DNA, 25 bp, Homo sapien
ggaatgtacattatgtactcttttg

SEQ ID NO: 595315 - DNA, 25 bp, Homo sapien
tactcttttgtgtcttgattctttt

SEQ ID NO: 595316 - DNA, 25 bp, Homo sapien
attctttttttgagagtcatccatg

SEQ ID NO: 595317 - DNA, 25 bp, Homo sapien
gggttgtttgtatcaatagctcatt

SEQ ID NO: 595318 - DNA, 25 bp, Homo sapien
tttcttggtgaatagtatttcgttg

SEQ ID NO: 595319 - DNA, 25 bp, Homo sapien
gtatttcgttgtatgaatatatcca

SEQ ID NO: 595320 - DNA, 25 bp, Homo sapien
gaatatatccattctccttcgatgg

SEQ ID NO: 595321 - DNA, 25 bp, Homo sapien
cattctccttcgatggacacattga

SEQ ID NO: 595322 - DNA, 25 bp, Homo sapien
tccttcgatggacacattgattgtt

SEQ ID NO: 595323 - DNA, 25 bp, Homo sapien
gatggacacattgattgtttccaac

SEQ ID NO: 595324 - DNA, 25 bp, Homo sapien
ttgtttccaactttgggctattatg

SEQ ID NO: 595325 - DNA, 25 bp, Homo sapien
gtgctaccactgcagagttaagaag

SEQ ID NO: 595326 - DNA, 25 bp, Homo sapien
tgctaccactgcagagttaagaagt

SEQ ID NO: 595327 - DNA, 25 bp, Homo sapien
gctaccactgcagagttaagaagta

SEQ ID NO: 595328 - DNA, 25 bp, Homo sapien
ctaccactgcagagttaagaagtag

SEQ ID NO: 595329 - DNA, 25 bp, Homo sapien
taccactgcagagttaagaagtagc

SEQ ID NO: 595330 - DNA, 25 bp, Homo sapien
accactgcagagttaagaagtagca

SEQ ID NO: 595331 - DNA, 25 bp, Homo sapien
ccactgcagagttaagaagtagcac

SEQ ID NO: 595332 - DNA, 25 bp, Homo sapien
cactgcagagttaagaagtagcaca

SEQ ID NO: 595333 - DNA, 25 bp, Homo sapien
actgcagagttaagaagtagcacag

SEQ ID NO: 595334 - DNA, 25 bp, Homo sapien
ctcctaaagtgtggaaattatagca

SEQ ID NO: 595335 - DNA, 25 bp, Homo sapien
attatagcatgaaccactgtcaggc

SEQ ID NO: 595336 - DNA, 25 bp, Homo sapien
agcatgaaccactgtcaggctcttt

SEQ ID NO: 595337 - DNA, 25 bp, Homo sapien
atgaaccactgtcaggctcttttgt

SEQ ID NO: 595338 - DNA, 25 bp, Homo sapien
accactgtcaggctcttttgtcagt

SEQ ID NO: 595339 - DNA, 25 bp, Homo sapien
tgtcaggctcttttgtcagtcctat

SEQ ID NO: 595340 - DNA, 25 bp, Homo sapien
aggctcttttgtcagtcctatcaac

SEQ ID NO: 595341 - DNA, 25 bp, Homo sapien
ttttgtcagtcctatcaacctctaa

SEQ ID NO: 595342 - DNA, 25 bp, Homo sapien
tgtcagtcctatcaacctctaacat

SEQ ID NO: 595343 - DNA, 25 bp, Homo sapien
taacatcctcgcaccagacaggaca

SEQ ID NO: 595344 - DNA, 25 bp, Homo sapien
catcctcgcaccagacaggacaggt

SEQ ID NO: 595345 - DNA, 25 bp, Homo sapien
tacctgaaggtgggctccgagggac

SEQ ID NO: 595346 - DNA, 25 bp, Homo sapien
acctgaaggtgggctccgagggaca

SEQ ID NO: 595347 - DNA, 25 bp, Homo sapien
cctgaaggtgggctccgagggacac

SEQ ID NO: 595348 - DNA, 25 bp, Homo sapien
ctgaaggtgggctccgagggacact

SEQ ID NO: 595349 - DNA, 25 bp, Homo sapien
tgaaggtgggctccgagggacactt

SEQ ID NO: 595350 - DNA, 25 bp, Homo sapien
aaggtgggctccgagggacacttca

SEQ ID NO: 595351 - DNA, 25 bp, Homo sapien
aggtgggctccgagggacacttcag

SEQ ID NO: 595352 - DNA, 25 bp, Homo sapien
ggtgggctccgagggacacttcaga

SEQ ID NO: 595353 - DNA, 25 bp, Homo sapien
gtgggctccgagggacacttcagag

SEQ ID NO: 595354 - DNA, 25 bp, Homo sapien
tgggctccgagggacacttcagagt

SEQ ID NO: 595355 - DNA, 25 bp, Homo sapien
gggctccgagggacacttcagagtc

SEQ ID NO: 595356 - DNA, 25 bp, Homo sapien
accgcgtgaactcttacaccatgaa

SEQ ID NO: 595357 - DNA, 25 bp, Homo sapien
acaccatgaaggatactgccgcgca

SEQ ID NO: 595358 - DNA, 25 bp, Homo sapien
cccaactactccaggtgagcagctg

SEQ ID NO: 595359 - DNA, 25 bp, Homo sapien
tgagcagctgcctcgagctcggtgc

SEQ ID NO: 595360 - DNA, 25 bp, Homo sapien
gtgcgtccccagagaggcccacagg

SEQ ID NO: 595361 - DNA, 25 bp, Homo sapien
acagggaaatggcacccagcctgcc

SEQ ID NO: 595362 - DNA, 25 bp, Homo sapien
cccctaaggagggaagcctgccaag

SEQ ID NO: 595363 - DNA, 25 bp, Homo sapien
gcctgccaagatcactgctgaagat

SEQ ID NO: 595364 - DNA, 25 bp, Homo sapien
actgctgaagatgttgtttctttgt

SEQ ID NO: 595365 - DNA, 25 bp, Homo sapien
gatgttgtttctttgtgatggatgc

SEQ ID NO: 595366 - DNA, 25 bp, Homo sapien
ggatgctttatatattgcaaatgaa

SEQ ID NO: 595367 - DNA, 25 bp, Homo sapien
atgaccatcttacctaaattgatgt

SEQ ID NO: 595368 - DNA, 25 bp, Homo sapien
gatgttttcttagttgtgtggcagt

SEQ ID NO: 595369 - DNA, 25 bp, Homo sapien
cagtgtatatttttgagccccgaga

SEQ ID NO: 595370 - DNA, 25 bp, Homo sapien
gagccccgagactaccaaacagaaa

SEQ ID NO: 595371 - DNA, 25 bp, Homo sapien
gttcagagtcttctttgcaagaagc

SEQ ID NO: 595372 - DNA, 25 bp, Homo sapien
gaagcagaaactgactctaacacat

SEQ ID NO: 595373 - DNA, 25 bp, Homo sapien
cagacttgacaaggagcctggagaa

SEQ ID NO: 595374 - DNA, 25 bp, Homo sapien
ccaggcttggaaaatgggcaggcat

SEQ ID NO: 595375 - DNA, 25 bp, Homo sapien
gggcaggcattcctaaaatgtggct

SEQ ID NO: 595376 - DNA, 25 bp, Homo sapien
aaatgtggctatactctggctctgc

SEQ ID NO: 595377 - DNA, 25 bp, Homo sapien
ctatactctggctctgcctttgaag

SEQ ID NO: 595378 - DNA, 25 bp, Homo sapien
ctctatcactggcttattctattat

SEQ ID NO: 595379 - DNA, 25 bp, Homo sapien
ctatcactggcttattctattattt

SEQ ID NO: 595380 - DNA, 25 bp, Homo sapien
atcactggcttattctattatttta

SEQ ID NO: 595381 - DNA, 25 bp, Homo sapien
gcaaaatgatgatactcgttggtct

SEQ ID NO: 595382 - DNA, 25 bp, Homo sapien
aaatgatgatactcgttggtcttac

SEQ ID NO: 595383 - DNA, 25 bp, Homo sapien
atgatgatactcgttggtcttacca

SEQ ID NO: 595384 - DNA, 25 bp, Homo sapien
tgatgatactcgttggtcttaccaa

SEQ ID NO: 595385 - DNA, 25 bp, Homo sapien
gatgatactcgttggtcttaccaac

SEQ ID NO: 595386 - DNA, 25 bp, Homo sapien
ttggtcttaccaactttgctaaaga

SEQ ID NO: 595387 - DNA, 25 bp, Homo sapien
aaatgagaagtatccttggccaggc

SEQ ID NO: 595388 - DNA, 25 bp, Homo sapien
aatgagaagtatccttggccaggca

SEQ ID NO: 595389 - DNA, 25 bp, Homo sapien
gcaaaagggaggcatccccttctga

SEQ ID NO: 595390 - DNA, 25 bp, Homo sapien
aaagggaggcatccccttctgacca

SEQ ID NO: 595391 - DNA, 25 bp, Homo sapien
gaggcatccccttctgaccatgaag

SEQ ID NO: 595392 - DNA, 25 bp, Homo sapien
catccccttctgaccatgaagggtt

SEQ ID NO: 595393 - DNA, 25 bp, Homo sapien
ttctgaccatgaagggttaaccgct

SEQ ID NO: 595394 - DNA, 25 bp, Homo sapien
gaccatgaagggttaaccgctgtag

SEQ ID NO: 595395 - DNA, 25 bp, Homo sapien
aaccgctgtagaaattgcccatcta

SEQ ID NO: 595396 - DNA, 25 bp, Homo sapien
gtagaaattgcccatctacccagca

SEQ ID NO: 595397 - DNA, 25 bp, Homo sapien
gaaattgcccatctacccagcactt

SEQ ID NO: 595398 - DNA, 25 bp, Homo sapien
aggccacggcgagcgatcacctgag

SEQ ID NO: 595399 - DNA, 25 bp, Homo sapien
tgtggtagtgctcgcctgtaatttc

SEQ ID NO: 595400 - DNA, 25 bp, Homo sapien
cccaactactccaggtgagcagctg

SEQ ID NO: 595401 - DNA, 25 bp, Homo sapien
tgagcagctgcctcgagctcggtgc

SEQ ID NO: 595402 - DNA, 25 bp, Homo sapien
agcagctgcctcgagctcggtgcgt

SEQ ID NO: 595403 - DNA, 25 bp, Homo sapien
gtgcgtccccagagaggcccacagg

SEQ ID NO: 595404 - DNA, 25 bp, Homo sapien
acagggaaatggcacccagcctgcc

SEQ ID NO: 595405 - DNA, 25 bp, Homo sapien
cccctaaggagggaagcctgccaag

SEQ ID NO: 595406 - DNA, 25 bp, Homo sapien
ctaaggagggaagcctgccaagatc

SEQ ID NO: 595407 - DNA, 25 bp, Homo sapien
gcctgccaagatcactgctgaagat

SEQ ID NO: 595408 - DNA, 25 bp, Homo sapien
actgctgaagatgttgtttctttgt

SEQ ID NO: 595409 - DNA, 25 bp, Homo sapien
gatgttgtttctttgtgatggatgc

SEQ ID NO: 595410 - DNA, 25 bp, Homo sapien
ggatgctttatatattgcaaatgaa

SEQ ID NO: 595411 - DNA, 25 bp, Homo sapien
ctcacctgacttgcctgaacagtgg

SEQ ID NO: 595412 - DNA, 25 bp, Homo sapien
cctgtcttctcaacacagctatttt

SEQ ID NO: 595413 - DNA, 25 bp, Homo sapien
agctattttgatactgagtccagca

SEQ ID NO: 595414 - DNA, 25 bp, Homo sapien
gagtccagcagctcagatgagttct

SEQ ID NO: 595415 - DNA, 25 bp, Homo sapien
agatgagttcttctgccgctgccac

SEQ ID NO: 595416 - DNA, 25 bp, Homo sapien
accggccctactgtgaaatctgctt

SEQ ID NO: 595417 - DNA, 25 bp, Homo sapien
gtgaaatctgcttccagagctcttc

SEQ ID NO: 595418 - DNA, 25 bp, Homo sapien
gagctcttctgactctagtgacagt

SEQ ID NO: 595419 - DNA, 25 bp, Homo sapien
gactctagtgacagtggcacatcag

SEQ ID NO: 595420 - DNA, 25 bp, Homo sapien
tggcacatcagacactgaccctgag

SEQ ID NO: 595421 - DNA, 25 bp, Homo sapien
gggaaaagctgtgggcccgctccaa

SEQ ID NO: 595422 - DNA, 25 bp, Homo sapien
gtaaaactttcaattgtccctcaga

SEQ ID NO: 595423 - DNA, 25 bp, Homo sapien
aaaactttcaattgtccctcagact

SEQ ID NO: 595424 - DNA, 25 bp, Homo sapien
aactttcaattgtccctcagacttg

SEQ ID NO: 595425 - DNA, 25 bp, Homo sapien
actttcaattgtccctcagacttga

SEQ ID NO: 595426 - DNA, 25 bp, Homo sapien
tcaattgtccctcagacttgaaatg

SEQ ID NO: 595427 - DNA, 25 bp, Homo sapien
attgtccctcagacttgaaatgtat

SEQ ID NO: 595428 - DNA, 25 bp, Homo sapien
gtccctcagacttgaaatgtattac

SEQ ID NO: 595429 - DNA, 25 bp, Homo sapien
gacttgaaatgtattactgcatcag

SEQ ID NO: 595430 - DNA, 25 bp, Homo sapien
gaaatgtattactgcatcagggata

SEQ ID NO: 595431 - DNA, 25 bp, Homo sapien
tgtattactgcatcagggataaagg

SEQ ID NO: 595432 - DNA, 25 bp, Homo sapien
aattatctcttattttggtagatga

SEQ ID NO: 595433 - DNA, 25 bp, Homo sapien
ggagccctaacaagggcaaagaact

SEQ ID NO: 595434 - DNA, 25 bp, Homo sapien
tgccagtggtcaagagctcaaacac

SEQ ID NO: 595435 - DNA, 25 bp, Homo sapien
gtggtcaagagctcaaacacccgga

SEQ ID NO: 595436 - DNA, 25 bp, Homo sapien
tcaagagctcaaacacccggaacaa

SEQ ID NO: 595437 - DNA, 25 bp, Homo sapien
aacaacccagcgacattcacagaca

SEQ ID NO: 595438 - DNA, 25 bp, Homo sapien
gcaactacagccctgacccgagttg

SEQ ID NO: 595439 - DNA, 25 bp, Homo sapien
gagttggccctcagttcaactcttc

SEQ ID NO: 595440 - DNA, 25 bp, Homo sapien
tcagttcaactcttctgacggtcct

SEQ ID NO: 595441 - DNA, 25 bp, Homo sapien
tgacggtcctcctgattttgcagat

SEQ ID NO: 595442 - DNA, 25 bp, Homo sapien
ggtcctcctgattttgcagataaag

SEQ ID NO: 595443 - DNA, 25 bp, Homo sapien
aagatgtggattcaggccaggccct

SEQ ID NO: 595444 - DNA, 25 bp, Homo sapien
aaagaggaattataccatctggtga

SEQ ID NO: 595445 - DNA, 25 bp, Homo sapien
ataccatctggtgatattagaaaga

SEQ ID NO: 595446 - DNA, 25 bp, Homo sapien
gaaagccatggcatcaacaattttg

SEQ ID NO: 595447 - DNA, 25 bp, Homo sapien
gccatggcatcaacaattttgacct

SEQ ID NO: 595448 - DNA, 25 bp, Homo sapien
ggcatcaacaattttgacctcaagg

SEQ ID NO: 595449 - DNA, 25 bp, Homo sapien
attttgacctcaaggaagtctggga

SEQ ID NO: 595450 - DNA, 25 bp, Homo sapien
aaaggaatgcctttgacctgtaaca

SEQ ID NO: 595451 - DNA, 25 bp, Homo sapien
aggaatgcctttgacctgtaacaaa

SEQ ID NO: 595452 - DNA, 25 bp, Homo sapien
gaatgcctttgacctgtaacaaaaa

SEQ ID NO: 595453 - DNA, 25 bp, Homo sapien
tgcctttgacctgtaacaaaaatct

SEQ ID NO: 595454 - DNA, 25 bp, Homo sapien
aaatctcactcacagaaaagatcaa

SEQ ID NO: 595455 - DNA, 25 bp, Homo sapien
gtttggatgggcattgctggccttc

SEQ ID NO: 595456 - DNA, 25 bp, Homo sapien
gctggccttccttttaagatgtaac

SEQ ID NO: 595457 - DNA, 25 bp, Homo sapien
ttctgtttgtttgccttacgcccta

SEQ ID NO: 595458 - DNA, 25 bp, Homo sapien
ttacgccctacggtattcttcaaag

SEQ ID NO: 595459 - DNA, 25 bp, Homo sapien
cggtattcttcaaaggctagtccct

SEQ ID NO: 595460 - DNA, 25 bp, Homo sapien
aggctagtcccttgacagcataata

SEQ ID NO: 595461 - DNA, 25 bp, Homo sapien
ataagcatactgacaatctattgag

SEQ ID NO: 595462 - DNA, 25 bp, Homo sapien
acagcagtacatctttgtttcccta

SEQ ID NO: 595463 - DNA, 25 bp, Homo sapien
gtacatctttgtttccctatttaat

SEQ ID NO: 595464 - DNA, 25 bp, Homo sapien
taaggcttctactagttgttcccct

SEQ ID NO: 595465 - DNA, 25 bp, Homo sapien
tctactagttgttcccctttgtatt

SEQ ID NO: 595466 - DNA, 25 bp, Homo sapien
cagtgaaccgaaccgagatcgcgtc

SEQ ID NO: 595467 - DNA, 25 bp, Homo sapien
gtgaaccgaaccgagatcgcgtcgc

SEQ ID NO: 595468 - DNA, 25 bp, Homo sapien
tgaaccgaaccgagatcgcgtcgct

SEQ ID NO: 595469 - DNA, 25 bp, Homo sapien
gaaccgaaccgagatcgcgtcgctg

SEQ ID NO: 595470 - DNA, 25 bp, Homo sapien
aaccgaaccgagatcgcgtcgctgg

SEQ ID NO: 595471 - DNA, 25 bp, Homo sapien
accgaaccgagatcgcgtcgctgga

SEQ ID NO: 595472 - DNA, 25 bp, Homo sapien
ccgaaccgagatcgcgtcgctggac

SEQ ID NO: 595473 - DNA, 25 bp, Homo sapien
cgaaccgagatcgcgtcgctggact

SEQ ID NO: 595474 - DNA, 25 bp, Homo sapien
gaaccgagatcgcgtcgctggactc

SEQ ID NO: 595475 - DNA, 25 bp, Homo sapien
accgagatcgcgtcgctggactcca

SEQ ID NO: 595476 - DNA, 25 bp, Homo sapien
atcgcgtcgctggactccagcccgg

SEQ ID NO: 595477 - DNA, 25 bp, Homo sapien
gagaagtcaagtctggtgacccatt

SEQ ID NO: 595478 - DNA, 25 bp, Homo sapien
tcaagtctggtgacccattctcagc

SEQ ID NO: 595479 - DNA, 25 bp, Homo sapien
atccctttgatctccttggcagcat

SEQ ID NO: 595480 - DNA, 25 bp, Homo sapien
ttggcagcatcctaccctaaggcct

SEQ ID NO: 595481 - DNA, 25 bp, Homo sapien
cttctctatgcttctctggacttct

SEQ ID NO: 595482 - DNA, 25 bp, Homo sapien
tgacccttctcttcctttgaggaca

SEQ ID NO: 595483 - DNA, 25 bp, Homo sapien
acaaggtttttccaactctcgatct

SEQ ID NO: 595484 - DNA, 25 bp, Homo sapien
tcgatctcccagtatcccaaagaaa

SEQ ID NO: 595485 - DNA, 25 bp, Homo sapien
gatttcaaactgaacccatccagat

SEQ ID NO: 595486 - DNA, 25 bp, Homo sapien
ccatccagatgtcgtgggacctgaa

SEQ ID NO: 595487 - DNA, 25 bp, Homo sapien
gggacctgaagcttgtataactcct

SEQ ID NO: 595488 - DNA, 25 bp, Homo sapien
tgaacctgggcagtgaaggctgcaa

SEQ ID NO: 595489 - DNA, 25 bp, Homo sapien
gaacctgggcagtgaaggctgcaat

SEQ ID NO: 595490 - DNA, 25 bp, Homo sapien
aacctgggcagtgaaggctgcaatg

SEQ ID NO: 595491 - DNA, 25 bp, Homo sapien
tcgatctcaaacaacaaaacgccat

SEQ ID NO: 595492 - DNA, 25 bp, Homo sapien
cgatctcaaacaacaaaacgccata

SEQ ID NO: 595493 - DNA, 25 bp, Homo sapien
gatctcaaacaacaaaacgccatag

SEQ ID NO: 595494 - DNA, 25 bp, Homo sapien
tcaaacaacaaaacgccatagaaat

SEQ ID NO: 595495 - DNA, 25 bp, Homo sapien
acaacaaaacgccatagaaatataa

SEQ ID NO: 595496 - DNA, 25 bp, Homo sapien
caatgaaacagtagagaaactcaac

SEQ ID NO: 595497 - DNA, 25 bp, Homo sapien
gagaaactcaacaaagtcaaaagat

SEQ ID NO: 595498 - DNA, 25 bp, Homo sapien
agcaaatagatttctagcagagttg

SEQ ID NO: 595499 - DNA, 25 bp, Homo sapien
taaaattatctcatgcaacagatga

SEQ ID NO: 595500 - DNA, 25 bp, Homo sapien
aaaattatctcatgcaacagatgaa

SEQ ID NO: 595501 - DNA, 25 bp, Homo sapien
aattatctcatgcaacagatgaaag

SEQ ID NO: 595502 - DNA, 25 bp, Homo sapien
attatctcatgcaacagatgaaaga

SEQ ID NO: 595503 - DNA, 25 bp, Homo sapien
tatctcatgcaacagatgaaagaag

SEQ ID NO: 595504 - DNA, 25 bp, Homo sapien
gtatatatttctttatctgcacttt

SEQ ID NO: 595505 - DNA, 25 bp, Homo sapien
tatatatttctttatctgcactttg

SEQ ID NO: 595506 - DNA, 25 bp, Homo sapien
atctgcactttgtagttgaaagaaa

SEQ ID NO: 595507 - DNA, 25 bp, Homo sapien
ctgcactttgtagttgaaagaaacc

SEQ ID NO: 595508 - DNA, 25 bp, Homo sapien
gcactttgtagttgaaagaaaccaa

SEQ ID NO: 595509 - DNA, 25 bp, Homo sapien
cactttgtagttgaaagaaaccaag

SEQ ID NO: 595510 - DNA, 25 bp, Homo sapien
gctagaaagggtaaaagagttctcg

SEQ ID NO: 595511 - DNA, 25 bp, Homo sapien
taataaaaagcagctcctggccggt

SEQ ID NO: 595512 - DNA, 25 bp, Homo sapien
ataaaaagcagctcctggccggtga

SEQ ID NO: 595513 - DNA, 25 bp, Homo sapien
aaaaagcagctcctggccggtgact

SEQ ID NO: 595514 - DNA, 25 bp, Homo sapien
aaagcagctcctggccggtgacttt

SEQ ID NO: 595515 - DNA, 25 bp, Homo sapien
agctcctggccggtgactttgggag

SEQ ID NO: 595516 - DNA, 25 bp, Homo sapien
ctcctggccggtgactttgggaggc

SEQ ID NO: 595517 - DNA, 25 bp, Homo sapien
cctggccggtgactttgggaggctg

SEQ ID NO: 595518 - DNA, 25 bp, Homo sapien
gcagaagaaccacttgaaccgggac

SEQ ID NO: 595519 - DNA, 25 bp, Homo sapien
aagaaccacttgaaccgggacgcag

SEQ ID NO: 595520 - DNA, 25 bp, Homo sapien
gaaccacttgaaccgggacgcagag

SEQ ID NO: 595521 - DNA, 25 bp, Homo sapien
ggcccacagtttcttaatccatttg

SEQ ID NO: 595522 - DNA, 25 bp, Homo sapien
aatccatttgttgattgatgggcat

SEQ ID NO: 595523 - DNA, 25 bp, Homo sapien
ttgttgattgatgggcatatgggct

SEQ ID NO: 595524 - DNA, 25 bp, Homo sapien
ctggttccatatgtttgcaactgca

SEQ ID NO: 595525 - DNA, 25 bp, Homo sapien
ttgcaactgcaaattgtgagcactg

SEQ ID NO: 595526 - DNA, 25 bp, Homo sapien
ttgtgagcactgtttaattctaagc

SEQ ID NO: 595527 - DNA, 25 bp, Homo sapien
taattctaagcttccttgtaggtaa

SEQ ID NO: 595528 - DNA, 25 bp, Homo sapien
taagcttccttgtaggtaaggcaaa

SEQ ID NO: 595529 - DNA, 25 bp, Homo sapien
gcaaagtattttaggcaattcccat

SEQ ID NO: 595530 - DNA, 25 bp, Homo sapien
ttaggcaattcccataactaaaggg

SEQ ID NO: 595531 - DNA, 25 bp, Homo sapien
tattatatttgtccatttgaaaaga

SEQ ID NO: 595532 - DNA, 25 bp, Homo sapien
cttttgaaaggatagggtctctaga

SEQ ID NO: 595533 - DNA, 25 bp, Homo sapien
gaaaggatagggtctctagatagaa

SEQ ID NO: 595534 - DNA, 25 bp, Homo sapien
gatagggtctctagatagaaaagca

SEQ ID NO: 595535 - DNA, 25 bp, Homo sapien
gtggtgataacaaacataactgatt

SEQ ID NO: 595536 - DNA, 25 bp, Homo sapien
ctgattataatctattctgtgaaaa

SEQ ID NO: 595537 - DNA, 25 bp, Homo sapien
aaaagcttatgaaacagtagatgtg

SEQ ID NO: 595538 - DNA, 25 bp, Homo sapien
tatgaaacagtagatgtgtgtatct

SEQ ID NO: 595539 - DNA, 25 bp, Homo sapien
gtgtgtatctagtacataagagctg

SEQ ID NO: 595540 - DNA, 25 bp, Homo sapien
gtacataagagctgaatgtcaatat

SEQ ID NO: 595541 - DNA, 25 bp, Homo sapien
aattctagttgccttatattttctt

SEQ ID NO: 595542 - DNA, 25 bp, Homo sapien
tctagttgccttatattttcttctt

SEQ ID NO: 595543 - DNA, 25 bp, Homo sapien
ggaacttgggagaacctagacctct

SEQ ID NO: 595544 - DNA, 25 bp, Homo sapien
tgggagaacctagacctcttccaag

SEQ ID NO: 595545 - DNA, 25 bp, Homo sapien
cctgtgcactgtctaaagggcaatc

SEQ ID NO: 595546 - DNA, 25 bp, Homo sapien
gcactgtctaaagggcaatcctgag

SEQ ID NO: 595547 - DNA, 25 bp, Homo sapien
tgcacaaggccacacagcctgtaat

SEQ ID NO: 595548 - DNA, 25 bp, Homo sapien
acagcctgtaatggcagttaggact

SEQ ID NO: 595549 - DNA, 25 bp, Homo sapien
tccttggaggacagacacatggctt

SEQ ID NO: 595550 - DNA, 25 bp, Homo sapien
acctggtgaaccagaatggaactct

SEQ ID NO: 595551 - DNA, 25 bp, Homo sapien
gaactcttcaaggacagggactgta

SEQ ID NO: 595552 - DNA, 25 bp, Homo sapien
gacagggactgtatcattccttcca

SEQ ID NO: 595553 - DNA, 25 bp, Homo sapien
gactgtatcattccttccagtgtcc

SEQ ID NO: 595554 - DNA, 25 bp, Homo sapien
tacagaactgagtggccttcaaggc

SEQ ID NO: 595555 - DNA, 25 bp, Homo sapien
gcattgaactctgcccttgattctt

SEQ ID NO: 595556 - DNA, 25 bp, Homo sapien
tcagtgccacactaccagtatgtaa

SEQ ID NO: 595557 - DNA, 25 bp, Homo sapien
agtatgtaatgtttgcacctggcaa

SEQ ID NO: 595558 - DNA, 25 bp, Homo sapien
gtggtggtcaagatctaccctgaat

SEQ ID NO: 595559 - DNA, 25 bp, Homo sapien
agatctaccctgaatttactgaaaa

SEQ ID NO: 595560 - DNA, 25 bp, Homo sapien
ctgaaaaatgtctcctcttttcttt

SEQ ID NO: 595561 - DNA, 25 bp, Homo sapien
cttttctttctcaactactgtggtt

SEQ ID NO: 595562 - DNA, 25 bp, Homo sapien
caactactgtggttattaggctata

SEQ ID NO: 595563 - DNA, 25 bp, Homo sapien
ggctatattctttcagtaccttcac

SEQ ID NO: 595564 - DNA, 25 bp, Homo sapien
gtaccttcacactttaagaattgtt

SEQ ID NO: 595565 - DNA, 25 bp, Homo sapien
gagtgtatgaacgtggaaacacttt

SEQ ID NO: 595566 - DNA, 25 bp, Homo sapien
aacactttggccaaatacttattat

SEQ ID NO: 595567 - DNA, 25 bp, Homo sapien
ggccaaatacttattatcaataggg

SEQ ID NO: 595568 - DNA, 25 bp, Homo sapien
tacttattatcaatagggttttcaa

SEQ ID NO: 595569 - DNA, 25 bp, Homo sapien
gggttttcaaatagctgtaaatcct

SEQ ID NO: 595570 - DNA, 25 bp, Homo sapien
gctgtaaatcctgaagacttccggg

SEQ ID NO: 595571 - DNA, 25 bp, Homo sapien
taaatcctgaagacttccgggcctt

SEQ ID NO: 595572 - DNA, 25 bp, Homo sapien
gccttccaaaacgaatttgacctca

SEQ ID NO: 595573 - DNA, 25 bp, Homo sapien
gaatttgacctcattatacacagtg

SEQ ID NO: 595574 - DNA, 25 bp, Homo sapien
tttgacctcattatacacagtgaaa

SEQ ID NO: 595575 - DNA, 25 bp, Homo sapien
atagaggaggttgcatgccaagtct

SEQ ID NO: 595576 - DNA, 25 bp, Homo sapien
agccggagacagttatccttagcaa

SEQ ID NO: 595577 - DNA, 25 bp, Homo sapien
ccggagacagttatccttagcaaac

SEQ ID NO: 595578 - DNA, 25 bp, Homo sapien
tgagcacaaagtaggaaaccacaga

SEQ ID NO: 595579 - DNA, 25 bp, Homo sapien
aaaccacagacagtggcatctcctt

SEQ ID NO: 595580 - DNA, 25 bp, Homo sapien
cacagacagtggcatctccttgagg

SEQ ID NO: 595581 - DNA, 25 bp, Homo sapien
cagacagtggcatctccttgaggat

SEQ ID NO: 595582 - DNA, 25 bp, Homo sapien
gacagtggcatctccttgaggatat

SEQ ID NO: 595583 - DNA, 25 bp, Homo sapien
cagtggcatctccttgaggatatag

SEQ ID NO: 595584 - DNA, 25 bp, Homo sapien
tggcatctccttgaggatatagggt

SEQ ID NO: 595585 - DNA, 25 bp, Homo sapien
atctccttgaggatatagggtggga

SEQ ID NO: 595586 - DNA, 25 bp, Homo sapien
tgtataacaaaaccccgtgacatga

SEQ ID NO: 595587 - DNA, 25 bp, Homo sapien
atggaggacgcacagggccccgagc

SEQ ID NO: 595588 - DNA, 25 bp, Homo sapien
aggtccgctgcgacatccgccagtt

SEQ ID NO: 595589 - DNA, 25 bp, Homo sapien
aagttctccagcagggctgtggccc

SEQ ID NO: 595590 - DNA, 25 bp, Homo sapien
ccagcagggctgtggcccgcatctt

SEQ ID NO: 595591 - DNA, 25 bp, Homo sapien
gctacccggcccaggtgtacgggca

SEQ ID NO: 595592 - DNA, 25 bp, Homo sapien
tgtacgggcaggaccgacgcttctg

SEQ ID NO: 595593 - DNA, 25 bp, Homo sapien
ttctggagaaaatacctgcacctga

SEQ ID NO: 595594 - DNA, 25 bp, Homo sapien
gagaaaatacctgcacctgagcttc

SEQ ID NO: 595595 - DNA, 25 bp, Homo sapien
aaatacctgcacctgagcttccatg

SEQ ID NO: 595596 - DNA, 25 bp, Homo sapien
acctgagcttccatgccctggtggg

SEQ ID NO: 595597 - DNA, 25 bp, Homo sapien
gcctggccacggaagagctcctgca

SEQ ID NO: 595598 - DNA, 25 bp, Homo sapien
gggcctggcagtgggtagggtagag

SEQ ID NO: 595599 - DNA, 25 bp, Homo sapien
gtagggtagagggagggagagcatt

SEQ ID NO: 595600 - DNA, 25 bp, Homo sapien
cctatgaaacaaacctcacatcctg

SEQ ID NO: 595601 - DNA, 25 bp, Homo sapien
ctatgaaacaaacctcacatcctgc

SEQ ID NO: 595602 - DNA, 25 bp, Homo sapien
acaaacctcacatcctgcatatgta

SEQ ID NO: 595603 - DNA, 25 bp, Homo sapien
caaacctcacatcctgcatatgtac

SEQ ID NO: 595604 - DNA, 25 bp, Homo sapien
aaacctcacatcctgcatatgtacc

SEQ ID NO: 595605 - DNA, 25 bp, Homo sapien
aacctcacatcctgcatatgtacct

SEQ ID NO: 595606 - DNA, 25 bp, Homo sapien
acctcacatcctgcatatgtacctc

SEQ ID NO: 595607 - DNA, 25 bp, Homo sapien
ctcacatcctgcatatgtacctcag

SEQ ID NO: 595608 - DNA, 25 bp, Homo sapien
cacatcctgcatatgtacctcagaa

SEQ ID NO: 595609 - DNA, 25 bp, Homo sapien
ctgacggagatctaaaggcctgcgg

SEQ ID NO: 595610 - DNA, 25 bp, Homo sapien
gttcagtgcaggtgtttctagatct

SEQ ID NO: 595611 - DNA, 25 bp, Homo sapien
gcaggtgtttctagatcttacggtt

SEQ ID NO: 595612 - DNA, 25 bp, Homo sapien
agatcttacggtttggcaactgcag

SEQ ID NO: 595613 - DNA, 25 bp, Homo sapien
gtttggcaactgcaggtaaccccag

SEQ ID NO: 595614 - DNA, 25 bp, Homo sapien
agccatgtcgccagcacaggtctat

SEQ ID NO: 595615 - DNA, 25 bp, Homo sapien
cagcacaggtctatgtcgagggaat

SEQ ID NO: 595616 - DNA, 25 bp, Homo sapien
gcatctggcttggtggtagcattta

SEQ ID NO: 595617 - DNA, 25 bp, Homo sapien
gcatttaatctattgcattggtgtt

SEQ ID NO: 595618 - DNA, 25 bp, Homo sapien
gaaagagaaatccatataccattat

SEQ ID NO: 595619 - DNA, 25 bp, Homo sapien
tataccattatgtttgaatttcctg

SEQ ID NO: 595620 - DNA, 25 bp, Homo sapien
gaaggccccaagaggtgaagcatcc

SEQ ID NO: 595621 - DNA, 25 bp, Homo sapien
tcctctgcagaggagagagcacatc

SEQ ID NO: 595622 - DNA, 25 bp, Homo sapien
agagcacatccggaagtagaagaca

SEQ ID NO: 595623 - DNA, 25 bp, Homo sapien
ccggaagtagaagacagaccactgt

SEQ ID NO: 595624 - DNA, 25 bp, Homo sapien
agaccactgtctgggctccgtttaa

SEQ ID NO: 595625 - DNA, 25 bp, Homo sapien
ggctccgtttaactgctgtgatttg

SEQ ID NO: 595626 - DNA, 25 bp, Homo sapien
ctgtgatttgggattgtaacttact

SEQ ID NO: 595627 - DNA, 25 bp, Homo sapien
taacttactcccgtaaagcctcagt

SEQ ID NO: 595628 - DNA, 25 bp, Homo sapien
gatcattgttacaacatttcacttt

SEQ ID NO: 595629 - DNA, 25 bp, Homo sapien
tacacagtgctttcgtatacgttat

SEQ ID NO: 595630 - DNA, 25 bp, Homo sapien
gtatacgttatccaatttagcgaaa

SEQ ID NO: 595631 - DNA, 25 bp, Homo sapien
tttcctagactcctttgcagccacg

SEQ ID NO: 595632 - DNA, 25 bp, Homo sapien
tagactcctttgcagccacgggtgg

SEQ ID NO: 595633 - DNA, 25 bp, Homo sapien
tcctttgcagccacgggtggccatg

SEQ ID NO: 595634 - DNA, 25 bp, Homo sapien
ccatgagagatggttctggccagtg

SEQ ID NO: 595635 - DNA, 25 bp, Homo sapien
ccagtgggacaggaatagaacgcca

SEQ ID NO: 595636 - DNA, 25 bp, Homo sapien
ggaatagaacgccagtggtcctgcc

SEQ ID NO: 595637 - DNA, 25 bp, Homo sapien
atagaacgccagtggtcctgcccct

SEQ ID NO: 595638 - DNA, 25 bp, Homo sapien
ttccccttcatccagtctggaatgt

SEQ ID NO: 595639 - DNA, 25 bp, Homo sapien
atccagtctggaatgtggagaggct

SEQ ID NO: 595640 - DNA, 25 bp, Homo sapien
tggagctacagctgtcatcttgtgg

SEQ ID NO: 595641 - DNA, 25 bp, Homo sapien
ctacagctgtcatcttgtggccata

SEQ ID NO: 595642 - DNA, 25 bp, Homo sapien
ggtcccacaaatatttaagaaacat

SEQ ID NO: 595643 - DNA, 25 bp, Homo sapien
tatggaccaagaagatgtagaaagt

SEQ ID NO: 595644 - DNA, 25 bp, Homo sapien
aagtcacatttacatatattccgga

SEQ ID NO: 595645 - DNA, 25 bp, Homo sapien
cacatttacatatattccggaagat

SEQ ID NO: 595646 - DNA, 25 bp, Homo sapien
atattccggaagatgtgagagtcta

SEQ ID NO: 595647 - DNA, 25 bp, Homo sapien
gtgagagtctaatggtgagctctat

SEQ ID NO: 595648 - DNA, 25 bp, Homo sapien
gtctaatggtgagctctatgaagat

SEQ ID NO: 595649 - DNA, 25 bp, Homo sapien
ggtgagctctatgaagatgaattgg

SEQ ID NO: 595650 - DNA, 25 bp, Homo sapien
atgaattggacacagttcatacccc

SEQ ID NO: 595651 - DNA, 25 bp, Homo sapien
gttcatacccccagaggaatctggt

SEQ ID NO: 595652 - DNA, 25 bp, Homo sapien
aaagaagacaaacagggccaggcgc

SEQ ID NO: 595653 - DNA, 25 bp, Homo sapien
ataaatgatcataggaaaagaggtc

SEQ ID NO: 595654 - DNA, 25 bp, Homo sapien
taaatgatcataggaaaagaggtcc

SEQ ID NO: 595655 - DNA, 25 bp, Homo sapien
aaatgatcataggaaaagaggtccc

SEQ ID NO: 595656 - DNA, 25 bp, Homo sapien
aatgatcataggaaaagaggtccca

SEQ ID NO: 595657 - DNA, 25 bp, Homo sapien
atgatcataggaaaagaggtcccac

SEQ ID NO: 595658 - DNA, 25 bp, Homo sapien
tgatcataggaaaagaggtcccaca

SEQ ID NO: 595659 - DNA, 25 bp, Homo sapien
gctcacttctttaataccggcgctt

SEQ ID NO: 595660 - DNA, 25 bp, Homo sapien
ctcacttctttaataccggcgcttt

SEQ ID NO: 595661 - DNA, 25 bp, Homo sapien
tcacttctttaataccggcgctttg

SEQ ID NO: 595662 - DNA, 25 bp, Homo sapien
cacttctttaataccggcgctttgg

SEQ ID NO: 595663 - DNA, 25 bp, Homo sapien
ttctttaataccggcgctttgggag

SEQ ID NO: 595664 - DNA, 25 bp, Homo sapien
aagaacagtgttcttccctttggca

SEQ ID NO: 595665 - DNA, 25 bp, Homo sapien
ttggcagaaaggtacgccttgcctc

SEQ ID NO: 595666 - DNA, 25 bp, Homo sapien
gccttgcctctttacatgggatgga

SEQ ID NO: 595667 - DNA, 25 bp, Homo sapien
acatgggatggacttcatataccag

SEQ ID NO: 595668 - DNA, 25 bp, Homo sapien
tataccagagccacctattcaaggg

SEQ ID NO: 595669 - DNA, 25 bp, Homo sapien
cattgtgtcttgtttaggatcctta

SEQ ID NO: 595670 - DNA, 25 bp, Homo sapien
tgtgtgtatcaacctcagtcagtgc

SEQ ID NO: 595671 - DNA, 25 bp, Homo sapien
tcagtcagtgcctgggcgtgttgaa

SEQ ID NO: 595672 - DNA, 25 bp, Homo sapien
ttcgagcctgctgggagaaacaacc

SEQ ID NO: 595673 - DNA, 25 bp, Homo sapien
aaacaacctgcagtaggctgggtca

SEQ ID NO: 595674 - DNA, 25 bp, Homo sapien
gtaggctgggtcacagaggcaatct

SEQ ID NO: 595675 - DNA, 25 bp, Homo sapien
ggcatctgaagaaaacctctgctac

SEQ ID NO: 595676 - DNA, 25 bp, Homo sapien
gaaaacctctgctacaggagattga

SEQ ID NO: 595677 - DNA, 25 bp, Homo sapien
ggagattgagaccagaatacacact

SEQ ID NO: 595678 - DNA, 25 bp, Homo sapien
ccagagagcgtgcaggaaggagcct

SEQ ID NO: 595679 - DNA, 25 bp, Homo sapien
ggagccttagaaagcaggctgtcat

SEQ ID NO: 595680 - DNA, 25 bp, Homo sapien
gcaggctgtcattaatgtccacgcg

SEQ ID NO: 595681 - DNA, 25 bp, Homo sapien
ggctgtcattaatgtccacgcggag

SEQ ID NO: 595682 - DNA, 25 bp, Homo sapien
gtcattaatgtccacgcggaggtga

SEQ ID NO: 595683 - DNA, 25 bp, Homo sapien
atgtccacgcggaggtgagcgaaaa

SEQ ID NO: 595684 - DNA, 25 bp, Homo sapien
ggcaagaacaggaagctctaaaaaa

SEQ ID NO: 595685 - DNA, 25 bp, Homo sapien
agccaccaaaaggagtattcgaata

SEQ ID NO: 595686 - DNA, 25 bp, Homo sapien
aagaaggccttcaagcataatgcac

SEQ ID NO: 595687 - DNA, 25 bp, Homo sapien
agaaggccttcaagcataatgcaca

SEQ ID NO: 595688 - DNA, 25 bp, Homo sapien
gaaggccttcaagcataatgcacat

SEQ ID NO: 595689 - DNA, 25 bp, Homo sapien
aaggccttcaagcataatgcacatc

SEQ ID NO: 595690 - DNA, 25 bp, Homo sapien
aggccttcaagcataatgcacatct

SEQ ID NO: 595691 - DNA, 25 bp, Homo sapien
gtaagcaatgttggaaggcctttgc

SEQ ID NO: 595692 - DNA, 25 bp, Homo sapien
ttaataattatccaactcttactca

SEQ ID NO: 595693 - DNA, 25 bp, Homo sapien
aataattatccaactcttactcaac

SEQ ID NO: 595694 - DNA, 25 bp, Homo sapien
ataattatccaactcttactcaaca

SEQ ID NO: 595695 - DNA, 25 bp, Homo sapien
taattatccaactcttactcaacat

SEQ ID NO: 595696 - DNA, 25 bp, Homo sapien
aattatccaactcttactcaacatc

SEQ ID NO: 595697 - DNA, 25 bp, Homo sapien
aggagagttcgagcccggctaagat

SEQ ID NO: 595698 - DNA, 25 bp, Homo sapien
taagatcccctgagtcattctgtga

SEQ ID NO: 595699 - DNA, 25 bp, Homo sapien
attctgtgagggaccaagacccaca

SEQ ID NO: 595700 - DNA, 25 bp, Homo sapien
tacctcctggaatgctttcctggat

SEQ ID NO: 595701 - DNA, 25 bp, Homo sapien
ttcctggatccagcttcccgaagat

SEQ ID NO: 595702 - DNA, 25 bp, Homo sapien
cgaagatccgaccagacccagggag

SEQ ID NO: 595703 - DNA, 25 bp, Homo sapien
aagcatggtgcttcaccagctggac

SEQ ID NO: 595704 - DNA, 25 bp, Homo sapien
atgggcgcttgtcaacgtgatgtca

SEQ ID NO: 595705 - DNA, 25 bp, Homo sapien
gtgatgtcattcttttcccaccgtt

SEQ ID NO: 595706 - DNA, 25 bp, Homo sapien
accgtttcttcctgttgatattcaa

SEQ ID NO: 595707 - DNA, 25 bp, Homo sapien
ttcaatgaatccgtcaatctctctg

SEQ ID NO: 595708 - DNA, 25 bp, Homo sapien
tgcgcccggccgacggtgtgggttc

SEQ ID NO: 595709 - DNA, 25 bp, Homo sapien
gggttcgaatccctgaacggctgct

SEQ ID NO: 595710 - DNA, 25 bp, Homo sapien
tcgaatccctgaacggctgcttcct

SEQ ID NO: 595711 - DNA, 25 bp, Homo sapien
gctgtgtggtttggaacgagttcct

SEQ ID NO: 595712 - DNA, 25 bp, Homo sapien
tggaacgagttccttaatctctggg

SEQ ID NO: 595713 - DNA, 25 bp, Homo sapien
tcacctgcactctcacagtgctgtt

SEQ ID NO: 595714 - DNA, 25 bp, Homo sapien
cactctcacagtgctgttgcgagga

SEQ ID NO: 595715 - DNA, 25 bp, Homo sapien
tcacagtgctgttgcgaggataagt

SEQ ID NO: 595716 - DNA, 25 bp, Homo sapien
gttgcgaggataagtgagtcagtat

SEQ ID NO: 595717 - DNA, 25 bp, Homo sapien
gtcagtatgtataaaatgctcagaa

SEQ ID NO: 595718 - DNA, 25 bp, Homo sapien
gtgcctgtacaagctacatgattgt

SEQ ID NO: 595719 - DNA, 25 bp, Homo sapien
gacccggcgccaacagtgaggagac

SEQ ID NO: 595720 - DNA, 25 bp, Homo sapien
ctaacggtgctcatcgtgtggcacg

SEQ ID NO: 595721 - DNA, 25 bp, Homo sapien
ggagacgaacctggaagacatcccg

SEQ ID NO: 595722 - DNA, 25 bp, Homo sapien
aacggtgctcatcgtgtggcacgca

SEQ ID NO: 595723 - DNA, 25 bp, Homo sapien
acggtgctcatcgtgtggcacgcag

SEQ ID NO: 595724 - DNA, 25 bp, Homo sapien
tgtggcacgcaggtgcgttgttttc

SEQ ID NO: 595725 - DNA, 25 bp, Homo sapien
gcacgcaggtgcgttgttttctctc

SEQ ID NO: 595726 - DNA, 25 bp, Homo sapien
acgcaggtgcgttgttttctctcca

SEQ ID NO: 595727 - DNA, 25 bp, Homo sapien
gcaggtgcgttgttttctctccact

SEQ ID NO: 595728 - DNA, 25 bp, Homo sapien
aggtgcgttgttttctctccactaa

SEQ ID NO: 595729 - DNA, 25 bp, Homo sapien
ttttctctccactaaggctgctggg

SEQ ID NO: 595730 - DNA, 25 bp, Homo sapien
ggcgatggcccagtttcttttgggc

SEQ ID NO: 595731 - DNA, 25 bp, Homo sapien
tcttttgggctgaaaatggtctaaa

SEQ ID NO: 595732 - DNA, 25 bp, Homo sapien
ggtgatggctgtacaactttgaata

SEQ ID NO: 595733 - DNA, 25 bp, Homo sapien
tatgctgaaaactcgaattacacac

SEQ ID NO: 595734 - DNA, 25 bp, Homo sapien
gaattacacacttcagttgggcgaa

SEQ ID NO: 595735 - DNA, 25 bp, Homo sapien
gttgggcgaactgtactccatgtga

SEQ ID NO: 595736 - DNA, 25 bp, Homo sapien
gtactccatgtgaattacctctcga

SEQ ID NO: 595737 - DNA, 25 bp, Homo sapien
gtgaattacctctcgatggttctct

SEQ ID NO: 595738 - DNA, 25 bp, Homo sapien
tctcgatggttctctcctgggctca

SEQ ID NO: 595739 - DNA, 25 bp, Homo sapien
ggaactaccattcatgtgcggaaat

SEQ ID NO: 595740 - DNA, 25 bp, Homo sapien
gcggaaataaaacaactcggtctca

SEQ ID NO: 595741 - DNA, 25 bp, Homo sapien
atgtgattcttcttttaggtttgcc

SEQ ID NO: 595742 - DNA, 25 bp, Homo sapien
gattcttcttttaggtttgccttca

SEQ ID NO: 595743 - DNA, 25 bp, Homo sapien
acatattgctgggtttaacactcag

SEQ ID NO: 595744 - DNA, 25 bp, Homo sapien
gctgggtttaacactcaggtgatgt

SEQ ID NO: 595745 - DNA, 25 bp, Homo sapien
gtttaacactcaggtgatgtaactt

SEQ ID NO: 595746 - DNA, 25 bp, Homo sapien
gatgtaacttttatgcctaggcctt

SEQ ID NO: 595747 - DNA, 25 bp, Homo sapien
aacttttatgcctaggccttgctta

SEQ ID NO: 595748 - DNA, 25 bp, Homo sapien
ttatgcctaggccttgcttacagga

SEQ ID NO: 595749 - DNA, 25 bp, Homo sapien
atgcctaggccttgcttacaggagg

SEQ ID NO: 595750 - DNA, 25 bp, Homo sapien
aggccttgcttacaggaggcatttt

SEQ ID NO: 595751 - DNA, 25 bp, Homo sapien
gcttacaggaggcattttgaaatgt

SEQ ID NO: 595752 - DNA, 25 bp, Homo sapien
gatcctggcatgatgagagagcctt

SEQ ID NO: 595753 - DNA, 25 bp, Homo sapien
gatgagagagccttcctgggagccc

SEQ ID NO: 595754 - DNA, 25 bp, Homo sapien
cctgggagcccagtacagattggat

SEQ ID NO: 595755 - DNA, 25 bp, Homo sapien
acagattggatcatgccatcttctc

SEQ ID NO: 595756 - DNA, 25 bp, Homo sapien
atcttctcaaaagggcagcctggca

SEQ ID NO: 595757 - DNA, 25 bp, Homo sapien
ggcagcagagcatctcagccaagag

SEQ ID NO: 595758 - DNA, 25 bp, Homo sapien
tcagccaagagaaaagtaagctcct

SEQ ID NO: 595759 - DNA, 25 bp, Homo sapien
tggcatcttctgtccctgtgccaag

SEQ ID NO: 595760 - DNA, 25 bp, Homo sapien
aagcccaaggtcaacttcatttcca

SEQ ID NO: 595761 - DNA, 25 bp, Homo sapien
ggtcaacttcatttccaatgtctaa

SEQ ID NO: 595762 - DNA, 25 bp, Homo sapien
gaacttcgagacttttagtctggga

SEQ ID NO: 595763 - DNA, 25 bp, Homo sapien
taaacagccagctctcacaagaact

SEQ ID NO: 595764 - DNA, 25 bp, Homo sapien
agccagctctcacaagaactcacta

SEQ ID NO: 595765 - DNA, 25 bp, Homo sapien
actatcatgagtacagcaccaagac

SEQ ID NO: 595766 - DNA, 25 bp, Homo sapien
tcatgagtacagcaccaagacattc

SEQ ID NO: 595767 - DNA, 25 bp, Homo sapien
ccacttccaacattgcaatcacttt

SEQ ID NO: 595768 - DNA, 25 bp, Homo sapien
aacattgcaatcacttttcaacgtg

SEQ ID NO: 595769 - DNA, 25 bp, Homo sapien
gcaatcacttttcaacgtgagattt

SEQ ID NO: 595770 - DNA, 25 bp, Homo sapien
gggacgaatattcaaaccatatcag

SEQ ID NO: 595771 - DNA, 25 bp, Homo sapien
gcccacagtggcaactggcttgcta

SEQ ID NO: 595772 - DNA, 25 bp, Homo sapien
gtggcaactggcttgctaacatacc

SEQ ID NO: 595773 - DNA, 25 bp, Homo sapien
cttgctaacataccccacattgttg

SEQ ID NO: 595774 - DNA, 25 bp, Homo sapien
gcttgatggtagccaggacctcctc

SEQ ID NO: 595775 - DNA, 25 bp, Homo sapien
cttgatggtagccaggacctcctct

SEQ ID NO: 595776 - DNA, 25 bp, Homo sapien
ttgatggtagccaggacctcctctc

SEQ ID NO: 595777 - DNA, 25 bp, Homo sapien
tgatggtagccaggacctcctctct

SEQ ID NO: 595778 - DNA, 25 bp, Homo sapien
gatggtagccaggacctcctctcta

SEQ ID NO: 595779 - DNA, 25 bp, Homo sapien
atggtagccaggacctcctctctac

SEQ ID NO: 595780 - DNA, 25 bp, Homo sapien
tggtagccaggacctcctctctact

SEQ ID NO: 595781 - DNA, 25 bp, Homo sapien
ggtagccaggacctcctctctactg

SEQ ID NO: 595782 - DNA, 25 bp, Homo sapien
gtagccaggacctcctctctactgc

SEQ ID NO: 595783 - DNA, 25 bp, Homo sapien
tagccaggacctcctctctactgcg

SEQ ID NO: 595784 - DNA, 25 bp, Homo sapien
ccaattaatggtcctgtataagtgg

SEQ ID NO: 595785 - DNA, 25 bp, Homo sapien
aatggtcctgtataagtggaaaact

SEQ ID NO: 595786 - DNA, 25 bp, Homo sapien
ggtcctgtataagtggaaaactgtt

SEQ ID NO: 595787 - DNA, 25 bp, Homo sapien
tttttggaattgagaagggtagaca

SEQ ID NO: 595788 - DNA, 25 bp, Homo sapien
aagggtagacaaacttcaggatact

SEQ ID NO: 595789 - DNA, 25 bp, Homo sapien
agacaaacttcaggatactaggcaa

SEQ ID NO: 595790 - DNA, 25 bp, Homo sapien
caaacttcaggatactaggcaagaa

SEQ ID NO: 595791 - DNA, 25 bp, Homo sapien
ttcaggatactaggcaagaatatat

SEQ ID NO: 595792 - DNA, 25 bp, Homo sapien
gttttaaatccgtatgacccagtgt

SEQ ID NO: 595793 - DNA, 25 bp, Homo sapien
ttttaaatccgtatgacccagtgtt

SEQ ID NO: 595794 - DNA, 25 bp, Homo sapien
gataccaacaacaaataaagatgct

SEQ ID NO: 595795 - DNA, 25 bp, Homo sapien
agaccttagaagtgttctgaggccg

SEQ ID NO: 595796 - DNA, 25 bp, Homo sapien
gaccttagaagtgttctgaggccgg

SEQ ID NO: 595797 - DNA, 25 bp, Homo sapien
accttagaagtgttctgaggccggg

SEQ ID NO: 595798 - DNA, 25 bp, Homo sapien
ccttagaagtgttctgaggccgggc

SEQ ID NO: 595799 - DNA, 25 bp, Homo sapien
cttagaagtgttctgaggccgggcg

SEQ ID NO: 595800 - DNA, 25 bp, Homo sapien
ttagaagtgttctgaggccgggcgt

SEQ ID NO: 595801 - DNA, 25 bp, Homo sapien
tagaagtgttctgaggccgggcgtg

SEQ ID NO: 595802 - DNA, 25 bp, Homo sapien
agaagtgttctgaggccgggcgtgt

SEQ ID NO: 595803 - DNA, 25 bp, Homo sapien
gaagtgttctgaggccgggcgtgtg

SEQ ID NO: 595804 - DNA, 25 bp, Homo sapien
tgttctgaggccgggcgtgtggctc

SEQ ID NO: 595805 - DNA, 25 bp, Homo sapien
gcgtgaacccgggagtcgagatcgc

SEQ ID NO: 595806 - DNA, 25 bp, Homo sapien
tgacttttcctttggcccatggttt

SEQ ID NO: 595807 - DNA, 25 bp, Homo sapien
ttgtgttcttttacttccaaattat

SEQ ID NO: 595808 - DNA, 25 bp, Homo sapien
ttttctagatatctttctgttcttg

SEQ ID NO: 595809 - DNA, 25 bp, Homo sapien
tctagatatctttctgttcttgatt

SEQ ID NO: 595810 - DNA, 25 bp, Homo sapien
acctctatcagggtcagagaacaaa

SEQ ID NO: 595811 - DNA, 25 bp, Homo sapien
gaacaaacttaatatgatttcaatt

SEQ ID NO: 595812 - DNA, 25 bp, Homo sapien
cagaatatggtctatgttggtgaaa

SEQ ID NO: 595813 - DNA, 25 bp, Homo sapien
atgttttatgctgttgtctactgaa

SEQ ID NO: 595814 - DNA, 25 bp, Homo sapien
tatgctgttgtctactgaaaagtct

SEQ ID NO: 595815 - DNA, 25 bp, Homo sapien
gctgttgtctactgaaaagtctata

SEQ ID NO: 595816 - DNA, 25 bp, Homo sapien
gttgtctactgaaaagtctatatat

SEQ ID NO: 595817 - DNA, 25 bp, Homo sapien
ctaacggtgctcatcgtgtggcacg

SEQ ID NO: 595818 - DNA, 25 bp, Homo sapien
taacggtgctcatcgtgtggcacgc

SEQ ID NO: 595819 - DNA, 25 bp, Homo sapien
aacggtgctcatcgtgtggcacgca

SEQ ID NO: 595820 - DNA, 25 bp, Homo sapien
acggtgctcatcgtgtggcacgcag

SEQ ID NO: 595821 - DNA, 25 bp, Homo sapien
tgtggcacgcaggtgcgttgttttc

SEQ ID NO: 595822 - DNA, 25 bp, Homo sapien
gcacgcaggtgcgttgttttctctc

SEQ ID NO: 595823 - DNA, 25 bp, Homo sapien
acgcaggtgcgttgttttctctcca

SEQ ID NO: 595824 - DNA, 25 bp, Homo sapien
cgcaggtgcgttgttttctctccac

SEQ ID NO: 595825 - DNA, 25 bp, Homo sapien
gcaggtgcgttgttttctctccact

SEQ ID NO: 595826 - DNA, 25 bp, Homo sapien
caggtgcgttgttttctctccacta

SEQ ID NO: 595827 - DNA, 25 bp, Homo sapien
aggtgcgttgttttctctccactaa

SEQ ID NO: 595828 - DNA, 25 bp, Homo sapien
aatagaacaccgctaggacctcttt

SEQ ID NO: 595829 - DNA, 25 bp, Homo sapien
taggacctctttgtaataccctcca

SEQ ID NO: 595830 - DNA, 25 bp, Homo sapien
tgtaataccctccaagtcactactt

SEQ ID NO: 595831 - DNA, 25 bp, Homo sapien
gtcactacttctgcccaaaggtaat

SEQ ID NO: 595832 - DNA, 25 bp, Homo sapien
aaaggtaatcgctattttgcaacat

SEQ ID NO: 595833 - DNA, 25 bp, Homo sapien
gagatcgtacactgcgtaatcttat

SEQ ID NO: 595834 - DNA, 25 bp, Homo sapien
taaatattgcttgtgagattcatcc

SEQ ID NO: 595835 - DNA, 25 bp, Homo sapien
ccatgttgtcatgtcagcaatactt

SEQ ID NO: 595836 - DNA, 25 bp, Homo sapien
aatactttattctcattgccatata

SEQ ID NO: 595837 - DNA, 25 bp, Homo sapien
gatatatttacccattctgctattt

SEQ ID NO: 595838 - DNA, 25 bp, Homo sapien
cattctgctatttgtacatactgga

SEQ ID NO: 595839 - DNA, 25 bp, Homo sapien
atcagcacaaccttaggtaacattg

SEQ ID NO: 595840 - DNA, 25 bp, Homo sapien
ggtaacattgtgttgtaacattgca

SEQ ID NO: 595841 - DNA, 25 bp, Homo sapien
tgcaatgaaatttgagttctcccaa

SEQ ID NO: 595842 - DNA, 25 bp, Homo sapien
tgagttctcccaacatatacatagg

SEQ ID NO: 595843 - DNA, 25 bp, Homo sapien
acatagggctttgtaggtatcctta

SEQ ID NO: 595844 - DNA, 25 bp, Homo sapien
gcatttattgatacttctcctgact

SEQ ID NO: 595845 - DNA, 25 bp, Homo sapien
tctcctgactgtagtatttgcttag

SEQ ID NO: 595846 - DNA, 25 bp, Homo sapien
ttgcttagcattattctttcctatt

SEQ ID NO: 595847 - DNA, 25 bp, Homo sapien
gtgaagttctacaatttctcctcag

SEQ ID NO: 595848 - DNA, 25 bp, Homo sapien
ttctcctcagagtactttgctatag

SEQ ID NO: 595849 - DNA, 25 bp, Homo sapien
gagtactttgctatagtgcacatac

SEQ ID NO: 595850 - DNA, 25 bp, Homo sapien
ttcaccttgttgtcctcatagctga

SEQ ID NO: 595851 - DNA, 25 bp, Homo sapien
accttgttgtcctcatagctgattt

SEQ ID NO: 595852 - DNA, 25 bp, Homo sapien
tagctgattttattagggatcccta

SEQ ID NO: 595853 - DNA, 25 bp, Homo sapien
tagggatccctaaagacagcaagaa

SEQ ID NO: 595854 - DNA, 25 bp, Homo sapien
gacagcaagaaagcagcctatataa

SEQ ID NO: 595855 - DNA, 25 bp, Homo sapien
aaatgtttccatctactttacaaat

SEQ ID NO: 595856 - DNA, 25 bp, Homo sapien
taagttacagtgcaatagagatcat

SEQ ID NO: 595857 - DNA, 25 bp, Homo sapien
atagagatcataaactggcaggaag

SEQ ID NO: 595858 - DNA, 25 bp, Homo sapien
ttatatgatcaaatagccactcaag

SEQ ID NO: 595859 - DNA, 25 bp, Homo sapien
ccactcaagaagaatggcgccactt

SEQ ID NO: 595860 - DNA, 25 bp, Homo sapien
aataataggacgtcatggttacact

SEQ ID NO: 595861 - DNA, 25 bp, Homo sapien
gtgagtttaaatgccttatatttaa

SEQ ID NO: 595862 - DNA, 25 bp, Homo sapien
tgagtttaaatgccttatatttaac

SEQ ID NO: 595863 - DNA, 25 bp, Homo sapien
gagtttaaatgccttatatttaaca

SEQ ID NO: 595864 - DNA, 25 bp, Homo sapien
aatgccttatatttaacaatcataa

SEQ ID NO: 595865 - DNA, 25 bp, Homo sapien
atgccttatatttaacaatcataat

SEQ ID NO: 595866 - DNA, 25 bp, Homo sapien
tgccttatatttaacaatcataatt

SEQ ID NO: 595867 - DNA, 25 bp, Homo sapien
gccttatatttaacaatcataattt

SEQ ID NO: 595868 - DNA, 25 bp, Homo sapien
tagatatcgtgggttcttatttaat

SEQ ID NO: 595869 - DNA, 25 bp, Homo sapien
agatatcgtgggttcttatttaatt

SEQ ID NO: 595870 - DNA, 25 bp, Homo sapien
gatatcgtgggttcttatttaatta

SEQ ID NO: 595871 - DNA, 25 bp, Homo sapien
atatcgtgggttcttatttaattat

SEQ ID NO: 595872 - DNA, 25 bp, Homo sapien
gagattatctacattcctgaggagg

SEQ ID NO: 595873 - DNA, 25 bp, Homo sapien
tacttaaactaccttgatccaactt

SEQ ID NO: 595874 - DNA, 25 bp, Homo sapien
ccccaccatgcatatatcatacata

SEQ ID NO: 595875 - DNA, 25 bp, Homo sapien
tcatacatatatacctgctagcatg

SEQ ID NO: 595876 - DNA, 25 bp, Homo sapien
tacctgctagcatgaatacctgcat

SEQ ID NO: 595877 - DNA, 25 bp, Homo sapien
atacctgcatcatatctagaattaa

SEQ ID NO: 595878 - DNA, 25 bp, Homo sapien
tagtcatagggccaatctttcttat

SEQ ID NO: 595879 - DNA, 25 bp, Homo sapien
gggccaatctttcttatatcaagca

SEQ ID NO: 595880 - DNA, 25 bp, Homo sapien
caagcaagctgaacaagggtccaag

SEQ ID NO: 595881 - DNA, 25 bp, Homo sapien
gggtccaagggataaggccacagct

SEQ ID NO: 595882 - DNA, 25 bp, Homo sapien
agggataaggccacagctacttcct

SEQ ID NO: 595883 - DNA, 25 bp, Homo sapien
aaggagaacctttggcaggtgctta

SEQ ID NO: 595884 - DNA, 25 bp, Homo sapien
acctttggcaggtgcttaggacact

SEQ ID NO: 595885 - DNA, 25 bp, Homo sapien
gcaggtgcttaggacactgactacc

SEQ ID NO: 595886 - DNA, 25 bp, Homo sapien
gtgcttaggacactgactacctaga

SEQ ID NO: 595887 - DNA, 25 bp, Homo sapien
tgactacctagaaagtagacgcagc

SEQ ID NO: 595888 - DNA, 25 bp, Homo sapien
gtagacgcagcagagttgctcccaa

SEQ ID NO: 595889 - DNA, 25 bp, Homo sapien
agacgcagcagagttgctcccaagt

SEQ ID NO: 595890 - DNA, 25 bp, Homo sapien
agcagagttgctcccaagtcgaggc

SEQ ID NO: 595891 - DNA, 25 bp, Homo sapien
agagttgctcccaagtcgaggctcc

SEQ ID NO: 595892 - DNA, 25 bp, Homo sapien
cccaagtcgaggctcctcagagcag

SEQ ID NO: 595893 - DNA, 25 bp, Homo sapien
tgacagcagtggattctcccagcag

SEQ ID NO: 595894 - DNA, 25 bp, Homo sapien
gccagctgaagtcttctatgggcac

SEQ ID NO: 595895 - DNA, 25 bp, Homo sapien
tgaagtcttctatgggcacaggata

SEQ ID NO: 595896 - DNA, 25 bp, Homo sapien
tggcaggccaaaaaggtaacttcat

SEQ ID NO: 595897 - DNA, 25 bp, Homo sapien
gtaacttcatcttgacattctgcaa

SEQ ID NO: 595898 - DNA, 25 bp, Homo sapien
attctgcaaaacataattctggtcg

SEQ ID NO: 595899 - DNA, 25 bp, Homo sapien
attctggtcgactacatgagtggca

SEQ ID NO: 595900 - DNA, 25 bp, Homo sapien
gtggcatgatgctaatgtgacttat

SEQ ID NO: 595901 - DNA, 25 bp, Homo sapien
gtggcaaataccctacatgcccaaa

SEQ ID NO: 595902 - DNA, 25 bp, Homo sapien
atgcccaaatccgtgcaatctctgg

SEQ ID NO: 595903 - DNA, 25 bp, Homo sapien
atccgtgcaatctctggcactaggg

SEQ ID NO: 595904 - DNA, 25 bp, Homo sapien
aaacatctgttacccagtttcagga

SEQ ID NO: 595905 - DNA, 25 bp, Homo sapien
atctacttagcaattagctctggta

SEQ ID NO: 595906 - DNA, 25 bp, Homo sapien
ggtgatttatgtgcacactggcctg

SEQ ID NO: 595907 - DNA, 25 bp, Homo sapien
acactggcctgggttcattgagaac

SEQ ID NO: 595908 - DNA, 25 bp, Homo sapien
gaacaatcatcagagccactgtggg

SEQ ID NO: 595909 - DNA, 25 bp, Homo sapien
ttgaatctaatctcagccaccaaca

SEQ ID NO: 595910 - DNA, 25 bp, Homo sapien
atctcagccaccaacatatcgtgtg

SEQ ID NO: 595911 - DNA, 25 bp, Homo sapien
acatatcgtgtggattctggaacat

SEQ ID NO: 595912 - DNA, 25 bp, Homo sapien
ggattctggaacattatttaacctc

SEQ ID NO: 595913 - DNA, 25 bp, Homo sapien
ttaacctctctgaatgtcatctcct

SEQ ID NO: 595914 - DNA, 25 bp, Homo sapien
ctgaatgtcatctcctcacttgtaa

SEQ ID NO: 595915 - DNA, 25 bp, Homo sapien
agagatttgtaatattttccctcta

SEQ ID NO: 595916 - DNA, 25 bp, Homo sapien
cttcctttagaaactgaccttagag

SEQ ID NO: 595917 - DNA, 25 bp, Homo sapien
ttcctttagaaactgaccttagagg

SEQ ID NO: 595918 - DNA, 25 bp, Homo sapien
tcctttagaaactgaccttagaggc

SEQ ID NO: 595919 - DNA, 25 bp, Homo sapien
ctttagaaactgaccttagaggccg

SEQ ID NO: 595920 - DNA, 25 bp, Homo sapien
tttagaaactgaccttagaggccgg

SEQ ID NO: 595921 - DNA, 25 bp, Homo sapien
ttagaaactgaccttagaggccggg

SEQ ID NO: 595922 - DNA, 25 bp, Homo sapien
tagaaactgaccttagaggccgggc

SEQ ID NO: 595923 - DNA, 25 bp, Homo sapien
agaaactgaccttagaggccgggcg

SEQ ID NO: 595924 - DNA, 25 bp, Homo sapien
aaactgaccttagaggccgggcgca

SEQ ID NO: 595925 - DNA, 25 bp, Homo sapien
aactgaccttagaggccgggcgcag

SEQ ID NO: 595926 - DNA, 25 bp, Homo sapien
aatacaaacatttgttgagtgtggt

SEQ ID NO: 595927 - DNA, 25 bp, Homo sapien
ggtgtgttaaccaaccaagggagtg

SEQ ID NO: 595928 - DNA, 25 bp, Homo sapien
gtgtgttaaccaaccaagggagtgg

SEQ ID NO: 595929 - DNA, 25 bp, Homo sapien
tgtgttaaccaaccaagggagtggg

SEQ ID NO: 595930 - DNA, 25 bp, Homo sapien
cacccaggtgtctccgcaagaccac

SEQ ID NO: 595931 - DNA, 25 bp, Homo sapien
tccgcaagaccacaaaaagcccaaa

SEQ ID NO: 595932 - DNA, 25 bp, Homo sapien
ccgcaagaccacaaaaagcccaaag

SEQ ID NO: 595933 - DNA, 25 bp, Homo sapien
gcaagaccacaaaaagcccaaagat

SEQ ID NO: 595934 - DNA, 25 bp, Homo sapien
caagaccacaaaaagcccaaagatc

SEQ ID NO: 595935 - DNA, 25 bp, Homo sapien
tgatcattgtaaataaagtggacct

SEQ ID NO: 595936 - DNA, 25 bp, Homo sapien
atcattgtaaataaagtggacctgc

SEQ ID NO: 595937 - DNA, 25 bp, Homo sapien
tcattgtaaataaagtggacctgct

SEQ ID NO: 595938 - DNA, 25 bp, Homo sapien
ccggcacggcctatggttcggtgaa

SEQ ID NO: 595939 - DNA, 25 bp, Homo sapien
acggcctatggttcggtgaatctcc

SEQ ID NO: 595940 - DNA, 25 bp, Homo sapien
tatggttcggtgaatctcccaagct

SEQ ID NO: 595941 - DNA, 25 bp, Homo sapien
ttcggtgaatctcccaagctggcac

SEQ ID NO: 595942 - DNA, 25 bp, Homo sapien
tccactccaagtgccaagtggttgg

SEQ ID NO: 595943 - DNA, 25 bp, Homo sapien
aagtgccaagtggttggcttgtccc

SEQ ID NO: 595944 - DNA, 25 bp, Homo sapien
caagtggttggcttgtcccgcccgg

SEQ ID NO: 595945 - DNA, 25 bp, Homo sapien
ctggctccagctttgtttatctgta

SEQ ID NO: 595946 - DNA, 25 bp, Homo sapien
gtatttttcattgcaaattgacaaa

SEQ ID NO: 595947 - DNA, 25 bp, Homo sapien
gcaaattgacaaattacagctgtat

SEQ ID NO: 595948 - DNA, 25 bp, Homo sapien
cagctgtatgtatttacgggataca

SEQ ID NO: 595949 - DNA, 25 bp, Homo sapien
agggaagcccttcagaacatggctc

SEQ ID NO: 595950 - DNA, 25 bp, Homo sapien
aacatggctcccaacaaagcatttt

SEQ ID NO: 595951 - DNA, 25 bp, Homo sapien
ttttcaacagatatgctcagcaggt

SEQ ID NO: 595952 - DNA, 25 bp, Homo sapien
gatatgctcagcaggtatggtacct

SEQ ID NO: 595953 - DNA, 25 bp, Homo sapien
gcaggtatggtacctagcacccagg

SEQ ID NO: 595954 - DNA, 25 bp, Homo sapien
gagggacagccctcacaggccctta

SEQ ID NO: 595955 - DNA, 25 bp, Homo sapien
tcacaggcccttactgggatgcaga

SEQ ID NO: 595956 - DNA, 25 bp, Homo sapien
atgcagagaggagaagtgacttgat

SEQ ID NO: 595957 - DNA, 25 bp, Homo sapien
gacttgatggactattttacctgcc

SEQ ID NO: 595958 - DNA, 25 bp, Homo sapien
tgatggactattttacctgcctctc

SEQ ID NO: 595959 - DNA, 25 bp, Homo sapien
tggactattttacctgcctctcttc

SEQ ID NO: 595960 - DNA, 25 bp, Homo sapien
agataccaatctgtgtactgcatca

SEQ ID NO: 595961 - DNA, 25 bp, Homo sapien
atctgtgtactgcatcacaatgaaa

SEQ ID NO: 595962 - DNA, 25 bp, Homo sapien
acatgtatgttttactttgcggcaa

SEQ ID NO: 595963 - DNA, 25 bp, Homo sapien
aatgcttcctactgcaatcttagtg

SEQ ID NO: 595964 - DNA, 25 bp, Homo sapien
aatcttagtgccttccctctcttgt

SEQ ID NO: 595965 - DNA, 25 bp, Homo sapien
agaagcttaccatcaaccacaactc

SEQ ID NO: 595966 - DNA, 25 bp, Homo sapien
taaattgatcttctcttagccttat

SEQ ID NO: 595967 - DNA, 25 bp, Homo sapien
gatcttctcttagccttatttctct

SEQ ID NO: 595968 - DNA, 25 bp, Homo sapien
gccttatttctctaacttggaaatg

SEQ ID NO: 595969 - DNA, 25 bp, Homo sapien
gaaatgtggaatttccttgcctttt

SEQ ID NO: 595970 - DNA, 25 bp, Homo sapien
gctgttattctttattaaacttcct

SEQ ID NO: 595971 - DNA, 25 bp, Homo sapien
tgaatttccttttaccagatgtata

SEQ ID NO: 595972 - DNA, 25 bp, Homo sapien
ttaccagatgtataagagcactact

SEQ ID NO: 595973 - DNA, 25 bp, Homo sapien
gatgtataagagcactactaacttt

SEQ ID NO: 595974 - DNA, 25 bp, Homo sapien
gcactactaacttttggcccagcgt

SEQ ID NO: 595975 - DNA, 25 bp, Homo sapien
ctactaacttttggcccagcgtggt

SEQ ID NO: 595976 - DNA, 25 bp, Homo sapien
aggagggcagagatcacttgtggcc

SEQ ID NO: 595977 - DNA, 25 bp, Homo sapien
ctcatttctactaagggtacagaaa

SEQ ID NO: 595978 - DNA, 25 bp, Homo sapien
gaggcagaggttggtccacagcact

SEQ ID NO: 595979 - DNA, 25 bp, Homo sapien
aggcagaggttggtccacagcactc

SEQ ID NO: 595980 - DNA, 25 bp, Homo sapien
agaggttggtccacagcactccatt

SEQ ID NO: 595981 - DNA, 25 bp, Homo sapien
ttggtccacagcactccattctggg

SEQ ID NO: 595982 - DNA, 25 bp, Homo sapien
gaatagtttactgtgtttgctctta

SEQ ID NO: 595983 - DNA, 25 bp, Homo sapien
ggtgacaggcagcagggtggcgaca

SEQ ID NO: 595984 - DNA, 25 bp, Homo sapien
gctcaataaatcactaggtacaatc

SEQ ID NO: 595985 - DNA, 25 bp, Homo sapien
tcactaggtacaatcctggtatcat

SEQ ID NO: 595986 - DNA, 25 bp, Homo sapien
tacaatcctggtatcattgccaatt

SEQ ID NO: 595987 - DNA, 25 bp, Homo sapien
ggtatcattgccaattatcatcata

SEQ ID NO: 595988 - DNA, 25 bp, Homo sapien
tacattttctacaatcatgtgctta

SEQ ID NO: 595989 - DNA, 25 bp, Homo sapien
ggaaatgcttcagtcctcacatgat

SEQ ID NO: 595990 - DNA, 25 bp, Homo sapien
gcttcagtcctcacatgataataca

SEQ ID NO: 595991 - DNA, 25 bp, Homo sapien
gataatacactaacattttcagatt

SEQ ID NO: 595992 - DNA, 25 bp, Homo sapien
ttcagattaagttttggttcaagtt

SEQ ID NO: 595993 - DNA, 25 bp, Homo sapien
tattaaaaagcttcagaccaggcac

SEQ ID NO: 595994 - DNA, 25 bp, Homo sapien
aaaagcttcagaccaggcactgtga

SEQ ID NO: 595995 - DNA, 25 bp, Homo sapien
aagcttcagaccaggcactgtgact

SEQ ID NO: 595996 - DNA, 25 bp, Homo sapien
cttcagaccaggcactgtgacttat

SEQ ID NO: 595997 - DNA, 25 bp, Homo sapien
tcagaccaggcactgtgacttatgc

SEQ ID NO: 595998 - DNA, 25 bp, Homo sapien
aggcactgtgacttatgcttgtaat

SEQ ID NO: 595999 - DNA, 25 bp, Homo sapien
aatctgctttaggaggctcaggcag

SEQ ID NO: 596000 - DNA, 25 bp, Homo sapien
gggagatcccttctctagaaaaaat

SEQ ID NO: 596001 - DNA, 25 bp, Homo sapien
ctgcggtgggccatgtttgcagcat

SEQ ID NO: 596002 - DNA, 25 bp, Homo sapien
gtgggccatgtttgcagcattgcac

SEQ ID NO: 596003 - DNA, 25 bp, Homo sapien
gccatgtttgcagcattgcactcca

SEQ ID NO: 596004 - DNA, 25 bp, Homo sapien
aatcactgattgcaggtcaccctaa

SEQ ID NO: 596005 - DNA, 25 bp, Homo sapien
actgattgcaggtcaccctaacaga

SEQ ID NO: 596006 - DNA, 25 bp, Homo sapien
gattgcaggtcaccctaacagatat

SEQ ID NO: 596007 - DNA, 25 bp, Homo sapien
gcaggtcaccctaacagatataata

SEQ ID NO: 596008 - DNA, 25 bp, Homo sapien
gtctgagatgttgcgagaattacca

SEQ ID NO: 596009 - DNA, 25 bp, Homo sapien
attaccaaaatgtgatgcagacacg

SEQ ID NO: 596010 - DNA, 25 bp, Homo sapien
tgcagacacgaaatgagcatgtgct

SEQ ID NO: 596011 - DNA, 25 bp, Homo sapien
cgaaatgagcatgtgctgttggaaa

SEQ ID NO: 596012 - DNA, 25 bp, Homo sapien
gaacagatagacttgctggagacag

SEQ ID NO: 596013 - DNA, 25 bp, Homo sapien
aaatgtgatatctatgaaatgcaat

SEQ ID NO: 596014 - DNA, 25 bp, Homo sapien
atgcaataaagtgaagtccaataaa

SEQ ID NO: 596015 - DNA, 25 bp, Homo sapien
tatgcatttatatcataggcataga

SEQ ID NO: 596016 - DNA, 25 bp, Homo sapien
cattagtatctcatgtcacatttcc

SEQ ID NO: 596017 - DNA, 25 bp, Homo sapien
ttagtatctcatgtcacatttcctc

SEQ ID NO: 596018 - DNA, 25 bp, Homo sapien
agtatctcatgtcacatttcctcac

SEQ ID NO: 596019 - DNA, 25 bp, Homo sapien
gtatctcatgtcacatttcctcacc

SEQ ID NO: 596020 - DNA, 25 bp, Homo sapien
catgtcacatttcctcaccctgctt

SEQ ID NO: 596021 - DNA, 25 bp, Homo sapien
cctgcttttatgacaagttaggata

SEQ ID NO: 596022 - DNA, 25 bp, Homo sapien
gcttttatgacaagttaggatagag

SEQ ID NO: 596023 - DNA, 25 bp, Homo sapien
ggatagagaaaccatcagttcctta

SEQ ID NO: 596024 - DNA, 25 bp, Homo sapien
ccatcagttccttaaagggatttgg

SEQ ID NO: 596025 - DNA, 25 bp, Homo sapien
cagttccttaaagggatttggatat

SEQ ID NO: 596026 - DNA, 25 bp, Homo sapien
tcagggaaaaccgaagaatccgaga

SEQ ID NO: 596027 - DNA, 25 bp, Homo sapien
gaagaatccgagaacttctccagga

SEQ ID NO: 596028 - DNA, 25 bp, Homo sapien
atccgagaacttctccaggacacac

SEQ ID NO: 596029 - DNA, 25 bp, Homo sapien
acactcacgaggacaggcgtgcagg

SEQ ID NO: 596030 - DNA, 25 bp, Homo sapien
aggacaggcgtgcaggacaacccca

SEQ ID NO: 596031 - DNA, 25 bp, Homo sapien
gcgtgcaggacaaccccagagctct

SEQ ID NO: 596032 - DNA, 25 bp, Homo sapien
aatggcgtctctcaggcagacctgc

SEQ ID NO: 596033 - DNA, 25 bp, Homo sapien
tcaggcagacctgctggacggctgc

SEQ ID NO: 596034 - DNA, 25 bp, Homo sapien
gtctgctcctatgacctgaagtctc

SEQ ID NO: 596035 - DNA, 25 bp, Homo sapien
tgctcctatgacctgaagtctcatg

SEQ ID NO: 596036 - DNA, 25 bp, Homo sapien
tcctatgacctgaagtctcatgccc

SEQ ID NO: 596037 - DNA, 25 bp, Homo sapien
aagttttctagtcatgaaacctctt

SEQ ID NO: 596038 - DNA, 25 bp, Homo sapien
ctagtcatgaaacctcttcgaggta

SEQ ID NO: 596039 - DNA, 25 bp, Homo sapien
acctcttcgaggtatagaatcagct

SEQ ID NO: 596040 - DNA, 25 bp, Homo sapien
cgaggtatagaatcagctctgaaat

SEQ ID NO: 596041 - DNA, 25 bp, Homo sapien
gaaattctcaaagtgttttgatcat

SEQ ID NO: 596042 - DNA, 25 bp, Homo sapien
ttaactgagatttacattactatgt

SEQ ID NO: 596043 - DNA, 25 bp, Homo sapien
gttgtatcgtaatgtatttagccag

SEQ ID NO: 596044 - DNA, 25 bp, Homo sapien
atgtatttagccagaacttagtgtc

SEQ ID NO: 596045 - DNA, 25 bp, Homo sapien
gccagaacttagtgtctgtgagaaa

SEQ ID NO: 596046 - DNA, 25 bp, Homo sapien
gatactagaacttcttactaccttc

SEQ ID NO: 596047 - DNA, 25 bp, Homo sapien
gaacttcttactaccttctaagata

SEQ ID NO: 596048 - DNA, 25 bp, Homo sapien
ctttccttaaagaccttcactctgg

SEQ ID NO: 596049 - DNA, 25 bp, Homo sapien
ttcactctggtattcctgctgtctg

SEQ ID NO: 596050 - DNA, 25 bp, Homo sapien
tggtattcctgctgtctgtgttgtc

SEQ ID NO: 596051 - DNA, 25 bp, Homo sapien
gtgttgtccagagagcgagcacagt

SEQ ID NO: 596052 - DNA, 25 bp, Homo sapien
gcgagcacagtagtgcagttcctgt

SEQ ID NO: 596053 - DNA, 25 bp, Homo sapien
acagtagtgcagttcctgtgtgagt

SEQ ID NO: 596054 - DNA, 25 bp, Homo sapien
gtgtgagttctgtcttcacagactc

SEQ ID NO: 596055 - DNA, 25 bp, Homo sapien
gtcttcacagactcctcatcacaga

SEQ ID NO: 596056 - DNA, 25 bp, Homo sapien
attactatctaaaaccactgcaggg

SEQ ID NO: 596057 - DNA, 25 bp, Homo sapien
cactgcagggaagccatctggagac

SEQ ID NO: 596058 - DNA, 25 bp, Homo sapien
gagactgggcatcctgagagatttt

SEQ ID NO: 596059 - DNA, 25 bp, Homo sapien
aaccccagtgggtcacatagtgagg

SEQ ID NO: 596060 - DNA, 25 bp, Homo sapien
aaggcagtggctgaactatcccaga

SEQ ID NO: 596061 - DNA, 25 bp, Homo sapien
ccccagtgacaccaatgttgcagaa

SEQ ID NO: 596062 - DNA, 25 bp, Homo sapien
gaaacacctgcagtggcaagtcaga

SEQ ID NO: 596063 - DNA, 25 bp, Homo sapien
tggcaagtcagatgtcctccaggac

SEQ ID NO: 596064 - DNA, 25 bp, Homo sapien
caggaccaggcagataacaaggagt

SEQ ID NO: 596065 - DNA, 25 bp, Homo sapien
ggagggtctgcaccatccaaagaaa

SEQ ID NO: 596066 - DNA, 25 bp, Homo sapien
gaaatcaattgttctgcacagtggt

SEQ ID NO: 596067 - DNA, 25 bp, Homo sapien
ggtaaggatccagtgttcccagcac

SEQ ID NO: 596068 - DNA, 25 bp, Homo sapien
agtgttcccagcacttccaaacatt

SEQ ID NO: 596069 - DNA, 25 bp, Homo sapien
ttgaatgaagccagaattccagata

SEQ ID NO: 596070 - DNA, 25 bp, Homo sapien
gtgatgcctggagctaatgtatgtg

SEQ ID NO: 596071 - DNA, 25 bp, Homo sapien
atgtgttgtgaagttagaaggtacc

SEQ ID NO: 596072 - DNA, 25 bp, Homo sapien
gtgggagaaatatgcgtcagttcca

SEQ ID NO: 596073 - DNA, 25 bp, Homo sapien
aatatgcgtcagttccagtgcaact

SEQ ID NO: 596074 - DNA, 25 bp, Homo sapien
gtcagttccagtgcaactggcacag

SEQ ID NO: 596075 - DNA, 25 bp, Homo sapien
cagtgcaactggcacagcgtactat

SEQ ID NO: 596076 - DNA, 25 bp, Homo sapien
tggcacagcgtactatggattgctt

SEQ ID NO: 596077 - DNA, 25 bp, Homo sapien
gcgtactatggattgcttggaatca

SEQ ID NO: 596078 - DNA, 25 bp, Homo sapien
gcttggaatcacgaagaatgtgttt

SEQ ID NO: 596079 - DNA, 25 bp, Homo sapien
gcagttccggtcaccacaggaggag

SEQ ID NO: 596080 - DNA, 25 bp, Homo sapien
gttccggtcaccacaggaggagcac

SEQ ID NO: 596081 - DNA, 25 bp, Homo sapien
gaatccgagaacttctccaggacac

SEQ ID NO: 596082 - DNA, 25 bp, Homo sapien
aggacaggcgtgcaggacaacccca

SEQ ID NO: 596083 - DNA, 25 bp, Homo sapien
aatggcgtctctcaggcagacctgc

SEQ ID NO: 596084 - DNA, 25 bp, Homo sapien
tcaggcagacctgctggacggctgc

SEQ ID NO: 596085 - DNA, 25 bp, Homo sapien
tgctcctatgacctgaagtctcatg

SEQ ID NO: 596086 - DNA, 25 bp, Homo sapien
ctgctagaatctgcgggagcccgtg

SEQ ID NO: 596087 - DNA, 25 bp, Homo sapien
gggagcccgtggtgtagcctcctct

SEQ ID NO: 596088 - DNA, 25 bp, Homo sapien
tctggcctgaaaggtctgcctcaca

SEQ ID NO: 596089 - DNA, 25 bp, Homo sapien
gaaaggtctgcctcacacaggcctt

SEQ ID NO: 596090 - DNA, 25 bp, Homo sapien
agccggaggtgcgtaagcccactga

SEQ ID NO: 596091 - DNA, 25 bp, Homo sapien
tgcgtaagcccactgaacgctgcag

SEQ ID NO: 596092 - DNA, 25 bp, Homo sapien
aaaaccaattgacctctcagtagca

SEQ ID NO: 596093 - DNA, 25 bp, Homo sapien
ttgacctctcagtagcaaaggaaat

SEQ ID NO: 596094 - DNA, 25 bp, Homo sapien
taaagacccttctgtttggttccag

SEQ ID NO: 596095 - DNA, 25 bp, Homo sapien
ttggttccagcttttgctgtttcaa

SEQ ID NO: 596096 - DNA, 25 bp, Homo sapien
ccagcttttgctgtttcaatgaaga

SEQ ID NO: 596097 - DNA, 25 bp, Homo sapien
cagagtttttcctttagtaacacag

SEQ ID NO: 596098 - DNA, 25 bp, Homo sapien
tttcctttagtaacacagcctcatt

SEQ ID NO: 596099 - DNA, 25 bp, Homo sapien
gtaacacagcctcattaaaatacgg

SEQ ID NO: 596100 - DNA, 25 bp, Homo sapien
taaaatacggcatagtgcagaacaa

SEQ ID NO: 596101 - DNA, 25 bp, Homo sapien
ggctgtgtcctacagaaactcctgt

SEQ ID NO: 596102 - DNA, 25 bp, Homo sapien
agccgactgtgctcagcccggttac

SEQ ID NO: 596103 - DNA, 25 bp, Homo sapien
tttagacctctacccttcaacatta

SEQ ID NO: 596104 - DNA, 25 bp, Homo sapien
tagacctctacccttcaacattaca

SEQ ID NO: 596105 - DNA, 25 bp, Homo sapien
acctctacccttcaacattacatag

SEQ ID NO: 596106 - DNA, 25 bp, Homo sapien
tacccttcaacattacatagacttt

SEQ ID NO: 596107 - DNA, 25 bp, Homo sapien
cccttcaacattacatagactttct

SEQ ID NO: 596108 - DNA, 25 bp, Homo sapien
acatagactttctgtttaggaccat

SEQ ID NO: 596109 - DNA, 25 bp, Homo sapien
catagactttctgtttaggaccata

SEQ ID NO: 596110 - DNA, 25 bp, Homo sapien
atagactttctgtttaggaccatat

SEQ ID NO: 596111 - DNA, 25 bp, Homo sapien
agactttctgtttaggaccatataa

SEQ ID NO: 596112 - DNA, 25 bp, Homo sapien
gactttctgtttaggaccatataat

SEQ ID NO: 596113 - DNA, 25 bp, Homo sapien
ttctgtttaggaccatataattttg

SEQ ID NO: 596114 - DNA, 25 bp, Homo sapien
aagcggcccagcctgtggtcctttg

SEQ ID NO: 596115 - DNA, 25 bp, Homo sapien
cctttgtcacggcagccctggcaga

SEQ ID NO: 596116 - DNA, 25 bp, Homo sapien
gtgccactgtctgtggacagcatgc

SEQ ID NO: 596117 - DNA, 25 bp, Homo sapien
tctgtggacagcatgccagcctcat

SEQ ID NO: 596118 - DNA, 25 bp, Homo sapien
atgccagcctcatcgcacgagttat

SEQ ID NO: 596119 - DNA, 25 bp, Homo sapien
tggacaggcttcagaaaacattctc

SEQ ID NO: 596120 - DNA, 25 bp, Homo sapien
aggcttcagaaaacattctccctgg

SEQ ID NO: 596121 - DNA, 25 bp, Homo sapien
aacattctccctggtgatacagaca

SEQ ID NO: 596122 - DNA, 25 bp, Homo sapien
ttctccctggtgatacagacatctg

SEQ ID NO: 596123 - DNA, 25 bp, Homo sapien
tccctggtgatacagacatctgaaa

SEQ ID NO: 596124 - DNA, 25 bp, Homo sapien
tacagacatctgaaaacacacacac

SEQ ID NO: 596125 - DNA, 25 bp, Homo sapien
tgactccaagaccattctgagccca

SEQ ID NO: 596126 - DNA, 25 bp, Homo sapien
tgagcccatcacttcctcactttga

SEQ ID NO: 596127 - DNA, 25 bp, Homo sapien
tcctcactttgatggtgcaatggac

SEQ ID NO: 596128 - DNA, 25 bp, Homo sapien
tgatggtgcaatggactgtgtgttt

SEQ ID NO: 596129 - DNA, 25 bp, Homo sapien
gtgtgtttgtgtccctctaaaatat

SEQ ID NO: 596130 - DNA, 25 bp, Homo sapien
gtgtccctctaaaatatacatgttg

SEQ ID NO: 596131 - DNA, 25 bp, Homo sapien
gaaacactaatcctgatgtgatggt

SEQ ID NO: 596132 - DNA, 25 bp, Homo sapien
gtcatgagagtggaccctttatcaa

SEQ ID NO: 596133 - DNA, 25 bp, Homo sapien
gagtggaccctttatcaatgggatt

SEQ ID NO: 596134 - DNA, 25 bp, Homo sapien
gggccagagacctagctagttctct

SEQ ID NO: 596135 - DNA, 25 bp, Homo sapien
cctagctagttctcttctgccatgt

SEQ ID NO: 596136 - DNA, 25 bp, Homo sapien
gtattttcagctcaaacgtcactct

SEQ ID NO: 596137 - DNA, 25 bp, Homo sapien
gtcactcttagactccagcttatat

SEQ ID NO: 596138 - DNA, 25 bp, Homo sapien
gacagccagctgaatgtcttgctct

SEQ ID NO: 596139 - DNA, 25 bp, Homo sapien
gaatgtcttgctctggatgtcctac

SEQ ID NO: 596140 - DNA, 25 bp, Homo sapien
ggatgtcctaccagaatagcaaaat

SEQ ID NO: 596141 - DNA, 25 bp, Homo sapien
gcaaaattcaacatgtctcagtctg

SEQ ID NO: 596142 - DNA, 25 bp, Homo sapien
agtctgaatccatcatgtactccct

SEQ ID NO: 596143 - DNA, 25 bp, Homo sapien
atgtactccctcttaaatgctcaac

SEQ ID NO: 596144 - DNA, 25 bp, Homo sapien
aaatgctcaacagccttttccttat

SEQ ID NO: 596145 - DNA, 25 bp, Homo sapien
cttatgatgcccctatctctaatta

SEQ ID NO: 596146 - DNA, 25 bp, Homo sapien
tatctctaattaaccctaccacaac

SEQ ID NO: 596147 - DNA, 25 bp, Homo sapien
gggaaagatttcttatagaagacag

SEQ ID NO: 596148 - DNA, 25 bp, Homo sapien
aagacagtaaaagggctgagtacaa

SEQ ID NO: 596149 - DNA, 25 bp, Homo sapien
aagactaataaattcagctacgcta

SEQ ID NO: 596150 - DNA, 25 bp, Homo sapien
aattcagctacgctaaagcttagaa

SEQ ID NO: 596151 - DNA, 25 bp, Homo sapien
gctaaagcttagaacttttcctcat

SEQ ID NO: 596152 - DNA, 25 bp, Homo sapien
aagcttagaacttttcctcatcata

SEQ ID NO: 596153 - DNA, 25 bp, Homo sapien
gcttagaacttttcctcatcatagg

SEQ ID NO: 596154 - DNA, 25 bp, Homo sapien
gaacttttcctcatcataggacacc

SEQ ID NO: 596155 - DNA, 25 bp, Homo sapien
ttttcctcatcataggacaccttaa

SEQ ID NO: 596156 - DNA, 25 bp, Homo sapien
cctcatcataggacaccttaaagaa

SEQ ID NO: 596157 - DNA, 25 bp, Homo sapien
agtcctaagggttagcagtaagaat

SEQ ID NO: 596158 - DNA, 25 bp, Homo sapien
cacacacaggtgtgtactcacacag

SEQ ID NO: 596159 - DNA, 25 bp, Homo sapien
gtgtactcacacagcaagagcagta

SEQ ID NO: 596160 - DNA, 25 bp, Homo sapien
gcaagagcagtagagatcatctccc

SEQ ID NO: 596161 - DNA, 25 bp, Homo sapien
cccacaacacaagagctcatgaaga

SEQ ID NO: 596162 - DNA, 25 bp, Homo sapien
agtttagcatttttggagcctgaat

SEQ ID NO: 596163 - DNA, 25 bp, Homo sapien
tggagcctgaatgtgttgactttac

SEQ ID NO: 596164 - DNA, 25 bp, Homo sapien
aaatcccaagttgcagtctgcccag

SEQ ID NO: 596165 - DNA, 25 bp, Homo sapien
gtctgcccaggtaattcatgtctat

SEQ ID NO: 596166 - DNA, 25 bp, Homo sapien
aattcatgtctatcaagtgtctaca

SEQ ID NO: 596167 - DNA, 25 bp, Homo sapien
aagtgtctacaataccaatttctac

SEQ ID NO: 596168 - DNA, 25 bp, Homo sapien
tttctacatctttgggagtatttta

SEQ ID NO: 596169 - DNA, 25 bp, Homo sapien
cctctaggaagttctctccaaggaa

SEQ ID NO: 596170 - DNA, 25 bp, Homo sapien
aggaagttctctccaaggaatccca

SEQ ID NO: 596171 - DNA, 25 bp, Homo sapien
gggcgtgccaatgggttctgcactt

SEQ ID NO: 596172 - DNA, 25 bp, Homo sapien
atgggttctgcacttgtgtccaaca

SEQ ID NO: 596173 - DNA, 25 bp, Homo sapien
gtgtccaacacccttggtaaatcga

SEQ ID NO: 596174 - DNA, 25 bp, Homo sapien
ggtaaatcgacctttccagaggact

SEQ ID NO: 596175 - DNA, 25 bp, Homo sapien
aatcgacctttccagaggactttgg

SEQ ID NO: 596176 - DNA, 25 bp, Homo sapien
agaggactttggagcccttcgagga

SEQ ID NO: 596177 - DNA, 25 bp, Homo sapien
gagcccttcgaggattctcagcatc

SEQ ID NO: 596178 - DNA, 25 bp, Homo sapien
gaggattctcagcatctgcatctcc

SEQ ID NO: 596179 - DNA, 25 bp, Homo sapien
gatgactgtttgtagctaaggtact

SEQ ID NO: 596180 - DNA, 25 bp, Homo sapien
tttagattaaaagtctattccaaat

SEQ ID NO: 596181 - DNA, 25 bp, Homo sapien
gatttttcagatgttctaaattcta

SEQ ID NO: 596182 - DNA, 25 bp, Homo sapien
ttttcagatgttctaaattctagtg

SEQ ID NO: 596183 - DNA, 25 bp, Homo sapien
ttcagatgttctaaattctagtgtg

SEQ ID NO: 596184 - DNA, 25 bp, Homo sapien
cagatgttctaaattctagtgtgta

SEQ ID NO: 596185 - DNA, 25 bp, Homo sapien
gatgttctaaattctagtgtgtaaa

SEQ ID NO: 596186 - DNA, 25 bp, Homo sapien
gttctaaattctagtgtgtaaatat

SEQ ID NO: 596187 - DNA, 25 bp, Homo sapien
aagtgggtggagttccgtcgcctct

SEQ ID NO: 596188 - DNA, 25 bp, Homo sapien
agtgggtggagttccgtcgcctctc

SEQ ID NO: 596189 - DNA, 25 bp, Homo sapien
tgggtggagttccgtcgcctctctt

SEQ ID NO: 596190 - DNA, 25 bp, Homo sapien
ggattagcttctaaaacttaatgaa

SEQ ID NO: 596191 - DNA, 25 bp, Homo sapien
aaccctgcgcgcagagaaagggtct

SEQ ID NO: 596192 - DNA, 25 bp, Homo sapien
agagaaagggtctcagctccacaga

SEQ ID NO: 596193 - DNA, 25 bp, Homo sapien
gtctcagctccacagacgactgggt

SEQ ID NO: 596194 - DNA, 25 bp, Homo sapien
gggtccctcctcaccaaaaatggtg

SEQ ID NO: 596195 - DNA, 25 bp, Homo sapien
agatttcatctgtcggccgaggagc

SEQ ID NO: 596196 - DNA, 25 bp, Homo sapien
atctgtcggccgaggagccacaagc

SEQ ID NO: 596197 - DNA, 25 bp, Homo sapien
gagccacaagcaggtttgtctgaga

SEQ ID NO: 596198 - DNA, 25 bp, Homo sapien
gaaggctttggattgcatctcaaat

SEQ ID NO: 596199 - DNA, 25 bp, Homo sapien
gcatctcaaattaagctttgctcct

SEQ ID NO: 596200 - DNA, 25 bp, Homo sapien
gaattcttgagatttatggtgcacc

SEQ ID NO: 596201 - DNA, 25 bp, Homo sapien
atggtgcaccttattgatcaaattt

SEQ ID NO: 596202 - DNA, 25 bp, Homo sapien
ggtctccttaggacattcttttaga

SEQ ID NO: 596203 - DNA, 25 bp, Homo sapien
ataggcatagatcaacacttcctca

SEQ ID NO: 596204 - DNA, 25 bp, Homo sapien
taggcatagatcaacacttcctcaa

SEQ ID NO: 596205 - DNA, 25 bp, Homo sapien
aggcatagatcaacacttcctcaaa

SEQ ID NO: 596206 - DNA, 25 bp, Homo sapien
ggcatagatcaacacttcctcaaaa

SEQ ID NO: 596207 - DNA, 25 bp, Homo sapien
gcatagatcaacacttcctcaaaag

SEQ ID NO: 596208 - DNA, 25 bp, Homo sapien
atagatcaacacttcctcaaaagca

SEQ ID NO: 596209 - DNA, 25 bp, Homo sapien
acacttcctcaaaagcaatgtagac

SEQ ID NO: 596210 - DNA, 25 bp, Homo sapien
gacaacattagtatctcatgtcaca

SEQ ID NO: 596211 - DNA, 25 bp, Homo sapien
agtatctcatgtcacatttcctcac

SEQ ID NO: 596212 - DNA, 25 bp, Homo sapien
ggatagagaaaccatcagttcctta

SEQ ID NO: 596213 - DNA, 25 bp, Homo sapien
agtaccggcaggagatgcggcacct

SEQ ID NO: 596214 - DNA, 25 bp, Homo sapien
aggagatgcggcacctgcaccaggt

SEQ ID NO: 596215 - DNA, 25 bp, Homo sapien
gcaccaggtgctgaaggacaagcag

SEQ ID NO: 596216 - DNA, 25 bp, Homo sapien
ctggaccaggcgctgcagcagaaca

SEQ ID NO: 596217 - DNA, 25 bp, Homo sapien
accaggcgctgcagcagaacagaga

SEQ ID NO: 596218 - DNA, 25 bp, Homo sapien
cttgaagttatttgggaatctacct

SEQ ID NO: 596219 - DNA, 25 bp, Homo sapien
tatttgggaatctaccttcagggaa

SEQ ID NO: 596220 - DNA, 25 bp, Homo sapien
aggacaggcgtgcaggacaacccca

SEQ ID NO: 596221 - DNA, 25 bp, Homo sapien
aatggcgtctctcaggcagacctgc

SEQ ID NO: 596222 - DNA, 25 bp, Homo sapien
cagacctgctggacggctgcgatgt

SEQ ID NO: 596223 - DNA, 25 bp, Homo sapien
gatgtctgctcctatgacctgaagt

SEQ ID NO: 596224 - DNA, 25 bp, Homo sapien
aattcctggcttcctgctaatggct

SEQ ID NO: 596225 - DNA, 25 bp, Homo sapien
tggcttcctgctaatggcttatttc

SEQ ID NO: 596226 - DNA, 25 bp, Homo sapien
cctgctaatggcttatttccaaaaa

SEQ ID NO: 596227 - DNA, 25 bp, Homo sapien
ggtttgatgtttgtgacgtccatat

SEQ ID NO: 596228 - DNA, 25 bp, Homo sapien
gatgtttgtgacgtccatatctcca

SEQ ID NO: 596229 - DNA, 25 bp, Homo sapien
gtccatatctccacactgaacatgt

SEQ ID NO: 596230 - DNA, 25 bp, Homo sapien
atctccacactgaacatgtaataag

SEQ ID NO: 596231 - DNA, 25 bp, Homo sapien
aatggagggtcataggacttcgcta

SEQ ID NO: 596232 - DNA, 25 bp, Homo sapien
ggacttcgctaaaattctgatactg

SEQ ID NO: 596233 - DNA, 25 bp, Homo sapien
aaaaccggattttcagtagctgaag

SEQ ID NO: 596234 - DNA, 25 bp, Homo sapien
ggcactgtaagttaaaacccaatgg

SEQ ID NO: 596235 - DNA, 25 bp, Homo sapien
cagtaccggcaggagatgcggcacc

SEQ ID NO: 596236 - DNA, 25 bp, Homo sapien
agtaccggcaggagatgcggcacct

SEQ ID NO: 596237 - DNA, 25 bp, Homo sapien
taccggcaggagatgcggcacctgc

SEQ ID NO: 596238 - DNA, 25 bp, Homo sapien
accggcaggagatgcggcacctgca

SEQ ID NO: 596239 - DNA, 25 bp, Homo sapien
ccggcaggagatgcggcacctgcac

SEQ ID NO: 596240 - DNA, 25 bp, Homo sapien
gctggaccaggcgctgcagcagaac

SEQ ID NO: 596241 - DNA, 25 bp, Homo sapien
accaggcgctgcagcagaacagaga

SEQ ID NO: 596242 - DNA, 25 bp, Homo sapien
cagagaaatggaaggtgaacttgaa

SEQ ID NO: 596243 - DNA, 25 bp, Homo sapien
gaaatggaaggtgaacttgaagtta

SEQ ID NO: 596244 - DNA, 25 bp, Homo sapien
aaatggaaggtgaacttgaagttat

SEQ ID NO: 596245 - DNA, 25 bp, Homo sapien
gaacttgaagttatttgggaatcta

SEQ ID NO: 596246 - DNA, 25 bp, Homo sapien
atcttcctgacttgtgggattggca

SEQ ID NO: 596247 - DNA, 25 bp, Homo sapien
ggattggcaggaaagccctcatttc

SEQ ID NO: 596248 - DNA, 25 bp, Homo sapien
ggaaagccctcatttcatttgaaaa

SEQ ID NO: 596249 - DNA, 25 bp, Homo sapien
gctgttttattactggacctcaatc

SEQ ID NO: 596250 - DNA, 25 bp, Homo sapien
ctggacctcaatcctcaagcaatag

SEQ ID NO: 596251 - DNA, 25 bp, Homo sapien
ggataacatccatgtacacattctt

SEQ ID NO: 596252 - DNA, 25 bp, Homo sapien
ccatgtacacattctttgttgattt

SEQ ID NO: 596253 - DNA, 25 bp, Homo sapien
gttgattttaatccttgttggccta

SEQ ID NO: 596254 - DNA, 25 bp, Homo sapien
atccttgttggcctaattgtaccaa

SEQ ID NO: 596255 - DNA, 25 bp, Homo sapien
gaagatacttaccaagccataggga

SEQ ID NO: 596256 - DNA, 25 bp, Homo sapien
caaattgttatgtctgtgtatcagc

SEQ ID NO: 596257 - DNA, 25 bp, Homo sapien
tttggtcaacactggactcagcgct

SEQ ID NO: 596258 - DNA, 25 bp, Homo sapien
ttattgcttcaatcgtactggctgc

SEQ ID NO: 596259 - DNA, 25 bp, Homo sapien
aatcgtactggctgctttaaaccat

SEQ ID NO: 596260 - DNA, 25 bp, Homo sapien
tttaaaccatagagccggagcagaa

SEQ ID NO: 596261 - DNA, 25 bp, Homo sapien
aaattgctgccgtgatatttggctt

SEQ ID NO: 596262 - DNA, 25 bp, Homo sapien
atatttggcttcttggcgactgcgg

SEQ ID NO: 596263 - DNA, 25 bp, Homo sapien
tgcggcatatgcagtgaacacattc

SEQ ID NO: 596264 - DNA, 25 bp, Homo sapien
aaatggagagtcagcgtccgccagc

SEQ ID NO: 596265 - DNA, 25 bp, Homo sapien
cgccagcagagcaccaatgactaca

SEQ ID NO: 596266 - DNA, 25 bp, Homo sapien
tgactacatccgagcccgcacggag

SEQ ID NO: 596267 - DNA, 25 bp, Homo sapien
ggatgtggacagtcgccctgagatc

SEQ ID NO: 596268 - DNA, 25 bp, Homo sapien
gggaaacagtccctgcagagacgct

SEQ ID NO: 596269 - DNA, 25 bp, Homo sapien
gaaacagtccctgcagagacgctgc

SEQ ID NO: 596270 - DNA, 25 bp, Homo sapien
tgcagagacgctgcctgcttcagag

SEQ ID NO: 596271 - DNA, 25 bp, Homo sapien
gcctgcttcagagccctggtgtggc

SEQ ID NO: 596272 - DNA, 25 bp, Homo sapien
gtgtggcctcctggcaggatatcta

SEQ ID NO: 596273 - DNA, 25 bp, Homo sapien
gcctcctggcaggatatctatagcc

SEQ ID NO: 596274 - DNA, 25 bp, Homo sapien
ggcaggatatctatagcccaagagt

SEQ ID NO: 596275 - DNA, 25 bp, Homo sapien
atatctatagcccaagagtcactag

SEQ ID NO: 596276 - DNA, 25 bp, Homo sapien
tatagcccaagagtcactagatttg

SEQ ID NO: 596277 - DNA, 25 bp, Homo sapien
gagtcactagatttgcttccatcac

SEQ ID NO: 596278 - DNA, 25 bp, Homo sapien
actagatttgcttccatcaccctgc

SEQ ID NO: 596279 - DNA, 25 bp, Homo sapien
gaggatacaaagctccgattactaa

SEQ ID NO: 596280 - DNA, 25 bp, Homo sapien
aactgaccaggtatcgtagtgaaaa

SEQ ID NO: 596281 - DNA, 25 bp, Homo sapien
agatgaccctgagctatgctgaata

SEQ ID NO: 596282 - DNA, 25 bp, Homo sapien
agctatgctgaataccttgctcatc

SEQ ID NO: 596283 - DNA, 25 bp, Homo sapien
tgaataccttgctcatcgccagcat

SEQ ID NO: 596284 - DNA, 25 bp, Homo sapien
tcgccagcatcatcatttccaaaat

SEQ ID NO: 596285 - DNA, 25 bp, Homo sapien
caaaatggcattgggcatccccttc

SEQ ID NO: 596286 - DNA, 25 bp, Homo sapien
acaaccattattcctgacactgagc

SEQ ID NO: 596287 - DNA, 25 bp, Homo sapien
tacaccttcttggtctagctatctc

SEQ ID NO: 596288 - DNA, 25 bp, Homo sapien
ctagctatctcttttactgtaccat

SEQ ID NO: 596289 - DNA, 25 bp, Homo sapien
gatagtttccgttgccatggtgaag

SEQ ID NO: 596290 - DNA, 25 bp, Homo sapien
cattcctccctcattttaaactgtg

SEQ ID NO: 596291 - DNA, 25 bp, Homo sapien
aacattgctcttcagtacactagtg

SEQ ID NO: 596292 - DNA, 25 bp, Homo sapien
attattttgacaatggcagtctccc

SEQ ID NO: 596293 - DNA, 25 bp, Homo sapien
gaaacaggctaccatgtcatcccta

SEQ ID NO: 596294 - DNA, 25 bp, Homo sapien
atccctacgcttttctcttgtgtgt

SEQ ID NO: 596295 - DNA, 25 bp, Homo sapien
tcttgtgtgtctttgattgggtgtc

SEQ ID NO: 596296 - DNA, 25 bp, Homo sapien
gtgtcattgccagtccttacagaaa

SEQ ID NO: 596297 - DNA, 25 bp, Homo sapien
cttacagaaattggcttctggcccc

SEQ ID NO: 596298 - DNA, 25 bp, Homo sapien
atagtcactgtctatcggcaggacc

SEQ ID NO: 596299 - DNA, 25 bp, Homo sapien
ggacctatcacataattgctatctt

SEQ ID NO: 596300 - DNA, 25 bp, Homo sapien
aaagcaccatctgggcagctcagtg

SEQ ID NO: 596301 - DNA, 25 bp, Homo sapien
taacaatgcgttgttttggtgcctc

SEQ ID NO: 596302 - DNA, 25 bp, Homo sapien
gttttggtgcctccattaatgttgt

SEQ ID NO: 596303 - DNA, 25 bp, Homo sapien
ttggtgcctccattaatgttgtatt

SEQ ID NO: 596304 - DNA, 25 bp, Homo sapien
gtgcctccattaatgttgtattaaa

SEQ ID NO: 596305 - DNA, 25 bp, Homo sapien
caatgggtcttttaaattgattaat

SEQ ID NO: 596306 - DNA, 25 bp, Homo sapien
atatgtcattgaatcataccttctg

SEQ ID NO: 596307 - DNA, 25 bp, Homo sapien
gtcattgaatcataccttctgattt

SEQ ID NO: 596308 - DNA, 25 bp, Homo sapien
ggttaagtctttgccgttattgtca

SEQ ID NO: 596309 - DNA, 25 bp, Homo sapien
aagtctttgccgttattgtcaatat

SEQ ID NO: 596310 - DNA, 25 bp, Homo sapien
cgttattgtcaatatatcaaccaaa

SEQ ID NO: 596311 - DNA, 25 bp, Homo sapien
tttatggtattctcagaatgcgata

SEQ ID NO: 596312 - DNA, 25 bp, Homo sapien
cacctctagcacctccagtgataag

SEQ ID NO: 596313 - DNA, 25 bp, Homo sapien
acctctagcacctccagtgataagc

SEQ ID NO: 596314 - DNA, 25 bp, Homo sapien
cctctagcacctccagtgataagca

SEQ ID NO: 596315 - DNA, 25 bp, Homo sapien
ctctagcacctccagtgataagcac

SEQ ID NO: 596316 - DNA, 25 bp, Homo sapien
tctagcacctccagtgataagcact

SEQ ID NO: 596317 - DNA, 25 bp, Homo sapien
ctagcacctccagtgataagcacta

SEQ ID NO: 596318 - DNA, 25 bp, Homo sapien
tagcacctccagtgataagcactaa

SEQ ID NO: 596319 - DNA, 25 bp, Homo sapien
agcacctccagtgataagcactaat

SEQ ID NO: 596320 - DNA, 25 bp, Homo sapien
gcacctccagtgataagcactaatt

SEQ ID NO: 596321 - DNA, 25 bp, Homo sapien
cacctccagtgataagcactaattg

SEQ ID NO: 596322 - DNA, 25 bp, Homo sapien
acctccagtgataagcactaattgc

SEQ ID NO: 596323 - DNA, 25 bp, Homo sapien
tttttcctccttcacagtatcaagt

SEQ ID NO: 596324 - DNA, 25 bp, Homo sapien
cttcacagtatcaagtgccaggcca

SEQ ID NO: 596325 - DNA, 25 bp, Homo sapien
ccaggccagggcactttgtccaggc

SEQ ID NO: 596326 - DNA, 25 bp, Homo sapien
gtaatgttcaaggatggcagcagga

SEQ ID NO: 596327 - DNA, 25 bp, Homo sapien
ggaccctaatgaagaggtttatctg

SEQ ID NO: 596328 - DNA, 25 bp, Homo sapien
ctgattggtttactggagtcctatg

SEQ ID NO: 596329 - DNA, 25 bp, Homo sapien
tactggagtcctatgtgggatgaat

SEQ ID NO: 596330 - DNA, 25 bp, Homo sapien
gatgaatagcttcagcctttgcgct

SEQ ID NO: 596331 - DNA, 25 bp, Homo sapien
ctttgcgcttgcacctctttgctgt

SEQ ID NO: 596332 - DNA, 25 bp, Homo sapien
tttgctgtccactccaatcaagaac

SEQ ID NO: 596333 - DNA, 25 bp, Homo sapien
gctgtccactccaatcaagaacggg

SEQ ID NO: 596334 - DNA, 25 bp, Homo sapien
gtctgtgaaattctgtcaccataat

SEQ ID NO: 596335 - DNA, 25 bp, Homo sapien
aacccagcctatgaccctgagtaaa

SEQ ID NO: 596336 - DNA, 25 bp, Homo sapien
tatgaccctgagtaaaaccttctta

SEQ ID NO: 596337 - DNA, 25 bp, Homo sapien
aattcttttacttcagtagcacaca

SEQ ID NO: 596338 - DNA, 25 bp, Homo sapien
tgtcacctgcttgctgcagttaagt

SEQ ID NO: 596339 - DNA, 25 bp, Homo sapien
gcttgctgcagttaagtctgctctg

SEQ ID NO: 596340 - DNA, 25 bp, Homo sapien
aagtctgctctgtggcagttttcca

SEQ ID NO: 596341 - DNA, 25 bp, Homo sapien
ttttccatttgcaagcagggcaccc

SEQ ID NO: 596342 - DNA, 25 bp, Homo sapien
cagggcacccttccagttaagttgt

SEQ ID NO: 596343 - DNA, 25 bp, Homo sapien
ttatgtttaagtaagcccctgtgcc

SEQ ID NO: 596344 - DNA, 25 bp, Homo sapien
agcccctgtgcccttgaagaatagg

SEQ ID NO: 596345 - DNA, 25 bp, Homo sapien
tatgtgatttacactgcctgttaat

SEQ ID NO: 596346 - DNA, 25 bp, Homo sapien
gactcagacaccaaatatttgtgat

SEQ ID NO: 596347 - DNA, 25 bp, Homo sapien
gtgatgtttgtatagcaccatcgtt

SEQ ID NO: 596348 - DNA, 25 bp, Homo sapien
tagcaccatcgttatatgtgatttc

SEQ ID NO: 596349 - DNA, 25 bp, Homo sapien
ttcaaagggtaagcatctctgtcgt

SEQ ID NO: 596350 - DNA, 25 bp, Homo sapien
gggtaagcatctctgtcgtaatcat

SEQ ID NO: 596351 - DNA, 25 bp, Homo sapien
gtcgtaatcatgtaagcccacagaa

SEQ ID NO: 596352 - DNA, 25 bp, Homo sapien
gtaagcccacagaagaataaattcc

SEQ ID NO: 596353 - DNA, 25 bp, Homo sapien
ataaattcctgaggttatgtacaac

SEQ ID NO: 596354 - DNA, 25 bp, Homo sapien
gttatgtacaaccaactctcagaat

SEQ ID NO: 596355 - DNA, 25 bp, Homo sapien
tcagaattcagacttcctgcagctg

SEQ ID NO: 596356 - DNA, 25 bp, Homo sapien
gcttcatcatctgctgattgtggag

SEQ ID NO: 596357 - DNA, 25 bp, Homo sapien
atcatctgctgattgtggagctcta

SEQ ID NO: 596358 - DNA, 25 bp, Homo sapien
tctgctgattgtggagctctagggc

SEQ ID NO: 596359 - DNA, 25 bp, Homo sapien
gccttggtaagacccagtgctgtat

SEQ ID NO: 596360 - DNA, 25 bp, Homo sapien
taagacccagtgctgtattggcttc

SEQ ID NO: 596361 - DNA, 25 bp, Homo sapien
gtgctgtattggcttcaggtctaac

SEQ ID NO: 596362 - DNA, 25 bp, Homo sapien
gtattggcttcaggtctaacccagc

SEQ ID NO: 596363 - DNA, 25 bp, Homo sapien
gcttcaggtctaacccagcacagtt

SEQ ID NO: 596364 - DNA, 25 bp, Homo sapien
agcacagttctaatggtggtgccac

SEQ ID NO: 596365 - DNA, 25 bp, Homo sapien
acagttctaatggtggtgccacagt

SEQ ID NO: 596366 - DNA, 25 bp, Homo sapien
tctaatggtggtgccacagtggtac

SEQ ID NO: 596367 - DNA, 25 bp, Homo sapien
gaatgcgtgcaacacacacctgagg

SEQ ID NO: 596368 - DNA, 25 bp, Homo sapien
gaacgcgtgcaacacacacctgaga

SEQ ID NO: 596369 - DNA, 25 bp, Homo sapien
gaaagcacacaacacacacctgagg

SEQ ID NO: 596370 - DNA, 25 bp, Homo sapien
gaatgcacacaacacacacttgaga

SEQ ID NO: 596371 - DNA, 25 bp, Homo sapien
ttgagaggaagtgcacaacacacac

SEQ ID NO: 596372 - DNA, 25 bp, Homo sapien
gaatgtgcgcaacacacacctaagg

SEQ ID NO: 596373 - DNA, 25 bp, Homo sapien
gaacgcgtgcaacacacacctgagg

SEQ ID NO: 596374 - DNA, 25 bp, Homo sapien
acgcagcacacacctgacgggaagt

SEQ ID NO: 596375 - DNA, 25 bp, Homo sapien
ggaagtgtgcaacacgcacctgaaa

SEQ ID NO: 596376 - DNA, 25 bp, Homo sapien
ggcacgcaacacacacctgagagaa

SEQ ID NO: 596377 - DNA, 25 bp, Homo sapien
gagaaagcacacaacgcacacctga

SEQ ID NO: 596378 - DNA, 25 bp, Homo sapien
taagctctggttgcacattaggatt

SEQ ID NO: 596379 - DNA, 25 bp, Homo sapien
ctggttgcacattaggattcctaga

SEQ ID NO: 596380 - DNA, 25 bp, Homo sapien
ttattctaatgtacaaccacggctg

SEQ ID NO: 596381 - DNA, 25 bp, Homo sapien
gtacaaccacggctgagaaccactg

SEQ ID NO: 596382 - DNA, 25 bp, Homo sapien
tgccgctgacgtttcaacacaaagt

SEQ ID NO: 596383 - DNA, 25 bp, Homo sapien
gacgtttcaacacaaagtttgctgt

SEQ ID NO: 596384 - DNA, 25 bp, Homo sapien
aagtttgctgtttgaacctgcctgt

SEQ ID NO: 596385 - DNA, 25 bp, Homo sapien
ctgcctgtctcctggatttcaaaga

SEQ ID NO: 596386 - DNA, 25 bp, Homo sapien
ggatttcaaagaccactgtcttcat

SEQ ID NO: 596387 - DNA, 25 bp, Homo sapien
accactgtcttcattgcacaacaat

SEQ ID NO: 596388 - DNA, 25 bp, Homo sapien
cactattgaactgtacctaagaata

SEQ ID NO: 596389 - DNA, 25 bp, Homo sapien
agtgcgcatgcgtagatggagcaaa

SEQ ID NO: 596390 - DNA, 25 bp, Homo sapien
tagatggagcaaaaccgcctctcca

SEQ ID NO: 596391 - DNA, 25 bp, Homo sapien
atcgacccttgggtccagcaaggaa

SEQ ID NO: 596392 - DNA, 25 bp, Homo sapien
cttgggtccagcaaggaagccctaa

SEQ ID NO: 596393 - DNA, 25 bp, Homo sapien
ggaagccctaagtgacgtcaacctt

SEQ ID NO: 596394 - DNA, 25 bp, Homo sapien
gacgtcaacctttgttcccatggta

SEQ ID NO: 596395 - DNA, 25 bp, Homo sapien
ttcccatggtaacgcagaaccttgg

SEQ ID NO: 596396 - DNA, 25 bp, Homo sapien
gtttctccgggattaagcgagagtc

SEQ ID NO: 596397 - DNA, 25 bp, Homo sapien
cggaaaaccggctcagttgacgctg

SEQ ID NO: 596398 - DNA, 25 bp, Homo sapien
gttgacgctgcaggtaaaaagactt

SEQ ID NO: 596399 - DNA, 25 bp, Homo sapien
aggcccagccggaacgagatttacg

SEQ ID NO: 596400 - DNA, 25 bp, Homo sapien
gggtcttctctcagctaagagctga

SEQ ID NO: 596401 - DNA, 25 bp, Homo sapien
gtcttctctcagctaagagctgaac

SEQ ID NO: 596402 - DNA, 25 bp, Homo sapien
gctgaacagatatcaggatgacctg

SEQ ID NO: 596403 - DNA, 25 bp, Homo sapien
tgtgggtcttctcttagctgggagc

SEQ ID NO: 596404 - DNA, 25 bp, Homo sapien
ctgagcagatgctgggatgacctgc

SEQ ID NO: 596405 - DNA, 25 bp, Homo sapien
gcagatgctgggatgacctgcttgc

SEQ ID NO: 596406 - DNA, 25 bp, Homo sapien
cacttcagatctcctgcaagctgta

SEQ ID NO: 596407 - DNA, 25 bp, Homo sapien
ttcagatctcctgcaagctgtactg

SEQ ID NO: 596408 - DNA, 25 bp, Homo sapien
tcagatctcctgcaagctgtactgt

SEQ ID NO: 596409 - DNA, 25 bp, Homo sapien
agatctcctgcaagctgtactgttg

SEQ ID NO: 596410 - DNA, 25 bp, Homo sapien
atctcctgcaagctgtactgttgct

SEQ ID NO: 596411 - DNA, 25 bp, Homo sapien
tcctgccccgtccatggctgtggtg

SEQ ID NO: 596412 - DNA, 25 bp, Homo sapien
tggccgtgttggagtctacgctgtc

SEQ ID NO: 596413 - DNA, 25 bp, Homo sapien
ctacgctgtcttgtgaagcctgtaa

SEQ ID NO: 596414 - DNA, 25 bp, Homo sapien
taaaaatggcatgcctaccatctcc

SEQ ID NO: 596415 - DNA, 25 bp, Homo sapien
tcccggctcttacagatgccattat

SEQ ID NO: 596416 - DNA, 25 bp, Homo sapien
gatgccattattcagcgatgtttta

SEQ ID NO: 596417 - DNA, 25 bp, Homo sapien
gatgttttactaaccacttctgaaa

SEQ ID NO: 596418 - DNA, 25 bp, Homo sapien
accacagtttaagatccctacaaag

SEQ ID NO: 596419 - DNA, 25 bp, Homo sapien
acagaaacagattcaccagcatcga

SEQ ID NO: 596420 - DNA, 25 bp, Homo sapien
gattcaccagcatcgaagactgaca

SEQ ID NO: 596421 - DNA, 25 bp, Homo sapien
actgacaagagctcagtcccaccat

SEQ ID NO: 596422 - DNA, 25 bp, Homo sapien
ggagctgctcttatgctgactttat

SEQ ID NO: 596423 - DNA, 25 bp, Homo sapien
gctgctcttatgctgactttatctt

SEQ ID NO: 596424 - DNA, 25 bp, Homo sapien
gctcttatgctgactttatcttatg

SEQ ID NO: 596425 - DNA, 25 bp, Homo sapien
tatgctgactttatcttatgcaaag

SEQ ID NO: 596426 - DNA, 25 bp, Homo sapien
gcacaagacaaatacatgatggatg

SEQ ID NO: 596427 - DNA, 25 bp, Homo sapien
atgatggatgattcctgtacccgct

SEQ ID NO: 596428 - DNA, 25 bp, Homo sapien
ggatgattcctgtacccgctccttt

SEQ ID NO: 596429 - DNA, 25 bp, Homo sapien
gctcctttccaatgcgatgtgtgga

SEQ ID NO: 596430 - DNA, 25 bp, Homo sapien
ccaatgcgatgtgtggactcagaca

SEQ ID NO: 596431 - DNA, 25 bp, Homo sapien
tgcccctttcagtattaaagccctc

SEQ ID NO: 596432 - DNA, 25 bp, Homo sapien
gtattaaagccctcaaaatcctctt

SEQ ID NO: 596433 - DNA, 25 bp, Homo sapien
aatgtagacaattgagtgagagttc

SEQ ID NO: 596434 - DNA, 25 bp, Homo sapien
gttcaagggtgaaataacaatgtta

SEQ ID NO: 596435 - DNA, 25 bp, Homo sapien
aggacaattattaacttcaggaaag

SEQ ID NO: 596436 - DNA, 25 bp, Homo sapien
attgattgaaccacaattatgctct

SEQ ID NO: 596437 - DNA, 25 bp, Homo sapien
gaaccacaattatgctctaactata

SEQ ID NO: 596438 - DNA, 25 bp, Homo sapien
attatgctctaactatattgggaag

SEQ ID NO: 596439 - DNA, 25 bp, Homo sapien
gaaagagcgctaaatatttactcct

SEQ ID NO: 596440 - DNA, 25 bp, Homo sapien
gagcgctaaatatttactcctacag

SEQ ID NO: 596441 - DNA, 25 bp, Homo sapien
gctaaatatttactcctacaggaaa

SEQ ID NO: 596442 - DNA, 25 bp, Homo sapien
tttactcctacaggaaagagtcagt

SEQ ID NO: 596443 - DNA, 25 bp, Homo sapien
aagagtcagtgatctccaaaacaga

SEQ ID NO: 596444 - DNA, 25 bp, Homo sapien
gccaggtgcagccaccgtgcagcaa

SEQ ID NO: 596445 - DNA, 25 bp, Homo sapien
cgtgcagcaaggcacagctgcctga

SEQ ID NO: 596446 - DNA, 25 bp, Homo sapien
agcaaggcacagctgcctgatcaaa

SEQ ID NO: 596447 - DNA, 25 bp, Homo sapien
ggcacagctgcctgatcaaaccaga

SEQ ID NO: 596448 - DNA, 25 bp, Homo sapien
cagctgcctgatcaaaccagatcaa

SEQ ID NO: 596449 - DNA, 25 bp, Homo sapien
atcaaaagccattcgatcatccaag

SEQ ID NO: 596450 - DNA, 25 bp, Homo sapien
aaagccattcgatcatccaaggact

SEQ ID NO: 596451 - DNA, 25 bp, Homo sapien
gccattcgatcatccaaggactatt

SEQ ID NO: 596452 - DNA, 25 bp, Homo sapien
tcatccaaggactattttcattcga

SEQ ID NO: 596453 - DNA, 25 bp, Homo sapien
tccaaggactattttcattcgatat

SEQ ID NO: 596454 - DNA, 25 bp, Homo sapien
aaggactattttcattcgatattta

SEQ ID NO: 596455 - DNA, 25 bp, Homo sapien
cccacagtcccattcagcagaatgg

SEQ ID NO: 596456 - DNA, 25 bp, Homo sapien
gggaaactggactcagacacctttt

SEQ ID NO: 596457 - DNA, 25 bp, Homo sapien
aaactggactcagacaccttttgcc

SEQ ID NO: 596458 - DNA, 25 bp, Homo sapien
acgccgtgcggctttgaccactgat

SEQ ID NO: 596459 - DNA, 25 bp, Homo sapien
tgcggctttgaccactgatctccca

SEQ ID NO: 596460 - DNA, 25 bp, Homo sapien
gggcagcctcggtcagtccacagtt

SEQ ID NO: 596461 - DNA, 25 bp, Homo sapien
gggtgagcacaagccttgagcgcaa

SEQ ID NO: 596462 - DNA, 25 bp, Homo sapien
agcacaagccttgagcgcaacattt

SEQ ID NO: 596463 - DNA, 25 bp, Homo sapien
aagccttgagcgcaacatttaagaa

SEQ ID NO: 596464 - DNA, 25 bp, Homo sapien
gcaacatttaagaagggcgccgaaa

SEQ ID NO: 596465 - DNA, 25 bp, Homo sapien
agggcgccgaaaagtcagtaatcaa

SEQ ID NO: 596466 - DNA, 25 bp, Homo sapien
ggtcaacagccccacagaccaatgg

SEQ ID NO: 596467 - DNA, 25 bp, Homo sapien
agaccaatggctgcacctcagaaga

SEQ ID NO: 596468 - DNA, 25 bp, Homo sapien
ggctgcacctcagaagaggactgaa

SEQ ID NO: 596469 - DNA, 25 bp, Homo sapien
gaggactgaatagcgggtgttgccc

SEQ ID NO: 596470 - DNA, 25 bp, Homo sapien
ggtgttgcccccgagtgctcagagt

SEQ ID NO: 596471 - DNA, 25 bp, Homo sapien
gagtccctagggaagctcacacctg

SEQ ID NO: 596472 - DNA, 25 bp, Homo sapien
ggaagctcacacctgcgcaaccttg

SEQ ID NO: 596473 - DNA, 25 bp, Homo sapien
acacctgcgcaaccttgtccagagt

SEQ ID NO: 596474 - DNA, 25 bp, Homo sapien
gcaaccttgtccagagtcccctgtg

SEQ ID NO: 596475 - DNA, 25 bp, Homo sapien
gagtcccctgtgtatcctgccggca

SEQ ID NO: 596476 - DNA, 25 bp, Homo sapien
tgtcctccacagccttcagtgcagt

SEQ ID NO: 596477 - DNA, 25 bp, Homo sapien
ttggagtggcccagacccgaacttc

SEQ ID NO: 596478 - DNA, 25 bp, Homo sapien
gctcctgtgcccaaacttggaactc

SEQ ID NO: 596479 - DNA, 25 bp, Homo sapien
actggcgccttgagcttgggcgact

SEQ ID NO: 596480 - DNA, 25 bp, Homo sapien
tgcagagctgactccgggactattt

SEQ ID NO: 596481 - DNA, 25 bp, Homo sapien
tgactccgggactattttagtttct

SEQ ID NO: 596482 - DNA, 25 bp, Homo sapien
tagtttctaacgtcaacttgcccga

SEQ ID NO: 596483 - DNA, 25 bp, Homo sapien
gtcaacttgcccgattcaagagggt

SEQ ID NO: 596484 - DNA, 25 bp, Homo sapien
gcccgattcaagagggtttgcgcaa

SEQ ID NO: 596485 - DNA, 25 bp, Homo sapien
ttgcgcaaaaaacgtagcccgttgt

SEQ ID NO: 596486 - DNA, 25 bp, Homo sapien
ctgtgtggctgcgtttagtaggaat

SEQ ID NO: 596487 - DNA, 25 bp, Homo sapien
ccaactcaaattgggaagttcttca

SEQ ID NO: 596488 - DNA, 25 bp, Homo sapien
tatgagctgactccaaatggacagc

SEQ ID NO: 596489 - DNA, 25 bp, Homo sapien
tgactccaaatggacagcccagaag

SEQ ID NO: 596490 - DNA, 25 bp, Homo sapien
gatgagaattcttatcactcacctt

SEQ ID NO: 596491 - DNA, 25 bp, Homo sapien
gaattcttatcactcacctttatat

SEQ ID NO: 596492 - DNA, 25 bp, Homo sapien
ttcctttggatcacttacatccaat

SEQ ID NO: 596493 - DNA, 25 bp, Homo sapien
gtcatttaaatcagaacaaccactt

SEQ ID NO: 596494 - DNA, 25 bp, Homo sapien
aatcagaacaaccacttgaaattat

SEQ ID NO: 596495 - DNA, 25 bp, Homo sapien
atatacatacaattcttgtgtggaa

SEQ ID NO: 596496 - DNA, 25 bp, Homo sapien
cttgtgtggaatttaactccatgac

SEQ ID NO: 596497 - DNA, 25 bp, Homo sapien
ggaatttaactccatgactgaatag

SEQ ID NO: 596498 - DNA, 25 bp, Homo sapien
aactccatgactgaatagcataagg

SEQ ID NO: 596499 - DNA, 25 bp, Homo sapien
tctctgaaatcaccttgttctccca

SEQ ID NO: 596500 - DNA, 25 bp, Homo sapien
cagtcatctgctgcccttggctgtt

SEQ ID NO: 596501 - DNA, 25 bp, Homo sapien
acatggcactctgccttgcccactg

SEQ ID NO: 596502 - DNA, 25 bp, Homo sapien
aagaggcctggaggccactatggaa

SEQ ID NO: 596503 - DNA, 25 bp, Homo sapien
agctcctgccagatggtggtggagt

SEQ ID NO: 596504 - DNA, 25 bp, Homo sapien
ctttcccagccctgtggtcttggga

SEQ ID NO: 596505 - DNA, 25 bp, Homo sapien
gggaaagtcatttaactctgctaag

SEQ ID NO: 596506 - DNA, 25 bp, Homo sapien
agtcatttaactctgctaagcctca

SEQ ID NO: 596507 - DNA, 25 bp, Homo sapien
gtcatttaactctgctaagcctcag

SEQ ID NO: 596508 - DNA, 25 bp, Homo sapien
atttaactctgctaagcctcagttt

SEQ ID NO: 596509 - DNA, 25 bp, Homo sapien
actctctgaaatcaccttgttctcc

SEQ ID NO: 596510 - DNA, 25 bp, Homo sapien
aacagaatcctgaccatcattgaaa

SEQ ID NO: 596511 - DNA, 25 bp, Homo sapien
agaatcctgaccatcattgaaaagg

SEQ ID NO: 596512 - DNA, 25 bp, Homo sapien
ggagtggactattaatacatgcaat

SEQ ID NO: 596513 - DNA, 25 bp, Homo sapien
catgcaataacttggatcaatctca

SEQ ID NO: 596514 - DNA, 25 bp, Homo sapien
ggatcaatctcaaatgcattacact

SEQ ID NO: 596515 - DNA, 25 bp, Homo sapien
ttacactaagtgaaagagaccagac

SEQ ID NO: 596516 - DNA, 25 bp, Homo sapien
gagaccagacttaaagcctaccttc

SEQ ID NO: 596517 - DNA, 25 bp, Homo sapien
agacttaaagcctaccttctgtgac

SEQ ID NO: 596518 - DNA, 25 bp, Homo sapien
cttctgtgacattagagataaggtg

SEQ ID NO: 596519 - DNA, 25 bp, Homo sapien
gataaggtgaaaccacaggaacaga

SEQ ID NO: 596520 - DNA, 25 bp, Homo sapien
gaacagaaaacatattagtgttgcc

SEQ ID NO: 596521 - DNA, 25 bp, Homo sapien
aaacttcaaaaatgtcatgcctaca

SEQ ID NO: 596522 - DNA, 25 bp, Homo sapien
aaatgtcatgcctacaatcaaaatg

SEQ ID NO: 596523 - DNA, 25 bp, Homo sapien
atcaaaatgaataatccttggattt

SEQ ID NO: 596524 - DNA, 25 bp, Homo sapien
ggtatccatccagactattcacaca

SEQ ID NO: 596525 - DNA, 25 bp, Homo sapien
atccatccagactattcacacacat

SEQ ID NO: 596526 - DNA, 25 bp, Homo sapien
atccagactattcacacacattgtt

SEQ ID NO: 596527 - DNA, 25 bp, Homo sapien
cacacacattgtttatttatcttta

SEQ ID NO: 596528 - DNA, 25 bp, Homo sapien
tgagagttttgtaacttttattact

SEQ ID NO: 596529 - DNA, 25 bp, Homo sapien
ttactttgtacctttttcttatgtg

SEQ ID NO: 596530 - DNA, 25 bp, Homo sapien
ctttgtacctttttcttatgtggat

SEQ ID NO: 596531 - DNA, 25 bp, Homo sapien
tgtacctttttcttatgtggatttt

SEQ ID NO: 596532 - DNA, 25 bp, Homo sapien
tcacagtatttacaatttgccagaa

SEQ ID NO: 596533 - DNA, 25 bp, Homo sapien
cacagtatttacaatttgccagaat

SEQ ID NO: 596534 - DNA, 25 bp, Homo sapien
gtatttacaatttgccagaatttgg

SEQ ID NO: 596535 - DNA, 25 bp, Homo sapien
acaatttgccagaatttggtagtca

SEQ ID NO: 596536 - DNA, 25 bp, Homo sapien
aatttgccagaatttggtagtcagt

SEQ ID NO: 596537 - DNA, 25 bp, Homo sapien
tttgccagaatttggtagtcagtgt

SEQ ID NO: 596538 - DNA, 25 bp, Homo sapien
cagaatttggtagtcagtgtggcct

SEQ ID NO: 596539 - DNA, 25 bp, Homo sapien
aatttggtagtcagtgtggcctgct

SEQ ID NO: 596540 - DNA, 25 bp, Homo sapien
atttggtagtcagtgtggcctgctc

SEQ ID NO: 596541 - DNA, 25 bp, Homo sapien
gaatcaggcatcttatttagttctg

SEQ ID NO: 596542 - DNA, 25 bp, Homo sapien
gtgagggtctagtgccagggatggg

SEQ ID NO: 596543 - DNA, 25 bp, Homo sapien
gaagaggtaacgtttccgattgtga

SEQ ID NO: 596544 - DNA, 25 bp, Homo sapien
gtttccgattgtgaaaatcagcttt

SEQ ID NO: 596545 - DNA, 25 bp, Homo sapien
tcagcttttcagatttttaagcctt

SEQ ID NO: 596546 - DNA, 25 bp, Homo sapien
agcctttactgttgaattgatttcc

SEQ ID NO: 596547 - DNA, 25 bp, Homo sapien
tgatttccaatcttgagaggttctt

SEQ ID NO: 596548 - DNA, 25 bp, Homo sapien
ccaatcttgagaggttcttatttat

SEQ ID NO: 596549 - DNA, 25 bp, Homo sapien
atgtaagaaaagctctgtccaaggc

SEQ ID NO: 596550 - DNA, 25 bp, Homo sapien
ctctgtccaaggcacaatgtttcta

SEQ ID NO: 596551 - DNA, 25 bp, Homo sapien
aaggcacaatgtttctaaggaccat

SEQ ID NO: 596552 - DNA, 25 bp, Homo sapien
taaggaccattctgtttcttgcctc

SEQ ID NO: 596553 - DNA, 25 bp, Homo sapien
ggaccattctgtttcttgcctcctt

SEQ ID NO: 596554 - DNA, 25 bp, Homo sapien
gcaagccgcccttcgcagagccgga

SEQ ID NO: 596555 - DNA, 25 bp, Homo sapien
gctgtccatcgttgtgggtggtgcg

SEQ ID NO: 596556 - DNA, 25 bp, Homo sapien
gggtggtgcggtgggcgcggaaact

SEQ ID NO: 596557 - DNA, 25 bp, Homo sapien
cgcggaaactgagctggtggtacct

SEQ ID NO: 596558 - DNA, 25 bp, Homo sapien
gaaactgagctggtggtacctggac

SEQ ID NO: 596559 - DNA, 25 bp, Homo sapien
aactgagctggtggtacctggacac

SEQ ID NO: 596560 - DNA, 25 bp, Homo sapien
ctgagctggtggtacctggacacgc

SEQ ID NO: 596561 - DNA, 25 bp, Homo sapien
ctccaacctggctctggcggagctg

SEQ ID NO: 596562 - DNA, 25 bp, Homo sapien
ggccgagggcccatgtgccatgctc

SEQ ID NO: 596563 - DNA, 25 bp, Homo sapien
gagggcccatgtgccatgctcgctg

SEQ ID NO: 596564 - DNA, 25 bp, Homo sapien
gtgccatgctcgctgtgcccgtcta

SEQ ID NO: 596565 - DNA, 25 bp, Homo sapien
gggagctaaggtcgtgctctacacc

SEQ ID NO: 596566 - DNA, 25 bp, Homo sapien
agctaaggtcgtgctctacaccaag

SEQ ID NO: 596567 - DNA, 25 bp, Homo sapien
ctaaggtcgtgctctacaccaagaa

SEQ ID NO: 596568 - DNA, 25 bp, Homo sapien
aaggtcgtgctctacaccaagaaga

SEQ ID NO: 596569 - DNA, 25 bp, Homo sapien
gagatggagcccgtggcacactttg

SEQ ID NO: 596570 - DNA, 25 bp, Homo sapien
gatggagcccgtggcacactttggc

SEQ ID NO: 596571 - DNA, 25 bp, Homo sapien
agcccgtggcacactttggcctggg

SEQ ID NO: 596572 - DNA, 25 bp, Homo sapien
aggtgacgtggccagatggcaagat

SEQ ID NO: 596573 - DNA, 25 bp, Homo sapien
gatggtgagccggaacgtggccagc

SEQ ID NO: 596574 - DNA, 25 bp, Homo sapien
tggagatcctctacccccgggatga

SEQ ID NO: 596575 - DNA, 25 bp, Homo sapien
acccccgggatgaggacacacttca

SEQ ID NO: 596576 - DNA, 25 bp, Homo sapien
gtgaaatgtccttttaaggaacatg

SEQ ID NO: 596577 - DNA, 25 bp, Homo sapien
catgttttccaataacatttaaact

SEQ ID NO: 596578 - DNA, 25 bp, Homo sapien
catttaaactgagagccaaatcaag

SEQ ID NO: 596579 - DNA, 25 bp, Homo sapien
atcaagaacgcaatctcacttacaa

SEQ ID NO: 596580 - DNA, 25 bp, Homo sapien
gaaaaactacagaacactgctgaga

SEQ ID NO: 596581 - DNA, 25 bp, Homo sapien
cattccatgctcatgaattggaata

SEQ ID NO: 596582 - DNA, 25 bp, Homo sapien
catgctcatgaattggaataatcag

SEQ ID NO: 596583 - DNA, 25 bp, Homo sapien
gctcatgaattggaataatcagtat

SEQ ID NO: 596584 - DNA, 25 bp, Homo sapien
taatcagtattgttaaaatggccac

SEQ ID NO: 596585 - DNA, 25 bp, Homo sapien
agtattgttaaaatggccacactgc

SEQ ID NO: 596586 - DNA, 25 bp, Homo sapien
cacactgctcaaagcaacctacaga

SEQ ID NO: 596587 - DNA, 25 bp, Homo sapien
taaaagcccatttaggccgggcgcg

SEQ ID NO: 596588 - DNA, 25 bp, Homo sapien
aagcccatttaggccgggcgcggtg

SEQ ID NO: 596589 - DNA, 25 bp, Homo sapien
agcccatttaggccgggcgcggtgg

SEQ ID NO: 596590 - DNA, 25 bp, Homo sapien
gcccatttaggccgggcgcggtggt

SEQ ID NO: 596591 - DNA, 25 bp, Homo sapien
catttaggccgggcgcggtggttca

SEQ ID NO: 596592 - DNA, 25 bp, Homo sapien
tttaggccgggcgcggtggttcacg

SEQ ID NO: 596593 - DNA, 25 bp, Homo sapien
ttaggccgggcgcggtggttcacgc

SEQ ID NO: 596594 - DNA, 25 bp, Homo sapien
taggccgggcgcggtggttcacgcc

SEQ ID NO: 596595 - DNA, 25 bp, Homo sapien
tctacagaggcaggtgatgcgctgc

SEQ ID NO: 596596 - DNA, 25 bp, Homo sapien
cacgccgggagtagattccttcatt

SEQ ID NO: 596597 - DNA, 25 bp, Homo sapien
ggagtagattccttcatttgcagct

SEQ ID NO: 596598 - DNA, 25 bp, Homo sapien
agtagattccttcatttgcagctcg

SEQ ID NO: 596599 - DNA, 25 bp, Homo sapien
gattccttcatttgcagctcgggaa

SEQ ID NO: 596600 - DNA, 25 bp, Homo sapien
ttcatttgcagctcgggaagtcttt

SEQ ID NO: 596601 - DNA, 25 bp, Homo sapien
cagctcgggaagtctttgtgcagta

SEQ ID NO: 596602 - DNA, 25 bp, Homo sapien
tttgtgcagtagatggaaagcccag

SEQ ID NO: 596603 - DNA, 25 bp, Homo sapien
gcaaacttgaattcacaaagcctaa

SEQ ID NO: 596604 - DNA, 25 bp, Homo sapien
agcctaaaaattgttgtacatcaga

SEQ ID NO: 596605 - DNA, 25 bp, Homo sapien
aaattgttgtacatcagaaaactcc

SEQ ID NO: 596606 - DNA, 25 bp, Homo sapien
ggtccagttagaggtatttccttca

SEQ ID NO: 596607 - DNA, 25 bp, Homo sapien
gaggtatttccttcaagttgcaaga

SEQ ID NO: 596608 - DNA, 25 bp, Homo sapien
gaaaggaccaatacgttccagaagt

SEQ ID NO: 596609 - DNA, 25 bp, Homo sapien
gctttggacttgtctcacaccaaga

SEQ ID NO: 596610 - DNA, 25 bp, Homo sapien
gtctcacaccaagaaccaattggag

SEQ ID NO: 596611 - DNA, 25 bp, Homo sapien
gaggttgaccaacaaaccgctgact

SEQ ID NO: 596612 - DNA, 25 bp, Homo sapien
aaccgctgacttggttaagtctttg

SEQ ID NO: 596613 - DNA, 25 bp, Homo sapien
agtctttgggtttcgacttgccaat

SEQ ID NO: 596614 - DNA, 25 bp, Homo sapien
ttcgacttgccaatctctgtcattg

SEQ ID NO: 596615 - DNA, 25 bp, Homo sapien
tcaaagaggtgctgagagacgtttc

SEQ ID NO: 596616 - DNA, 25 bp, Homo sapien
gagaaactaagcatttttcctatat

SEQ ID NO: 596617 - DNA, 25 bp, Homo sapien
taggattttcatgaggcaatgagac

SEQ ID NO: 596618 - DNA, 25 bp, Homo sapien
gaggcaatgagacaccaaaggacta

SEQ ID NO: 596619 - DNA, 25 bp, Homo sapien
tgcatttatctctcctgagcatcca

SEQ ID NO: 596620 - DNA, 25 bp, Homo sapien
atctctcctgagcatccactaaaat

SEQ ID NO: 596621 - DNA, 25 bp, Homo sapien
gagcatccactaaaattattcttcc

SEQ ID NO: 596622 - DNA, 25 bp, Homo sapien
aaatatattgcctcactggtttctc

SEQ ID NO: 596623 - DNA, 25 bp, Homo sapien
atattgcctcactggtttctccacc

SEQ ID NO: 596624 - DNA, 25 bp, Homo sapien
aactttccagaaacattctagtaca

SEQ ID NO: 596625 - DNA, 25 bp, Homo sapien
aacattctagtacaataatttcaag

SEQ ID NO: 596626 - DNA, 25 bp, Homo sapien
aataatttcaagaggctttccagat

SEQ ID NO: 596627 - DNA, 25 bp, Homo sapien
ggctttccagattgttctaaagaag

SEQ ID NO: 596628 - DNA, 25 bp, Homo sapien
ggactgactgttgctagacattaca

SEQ ID NO: 596629 - DNA, 25 bp, Homo sapien
agacattacactaagcacattatat

SEQ ID NO: 596630 - DNA, 25 bp, Homo sapien
tgtacttcattttaccctttcaaca

SEQ ID NO: 596631 - DNA, 25 bp, Homo sapien
tagtagcttactgtgggtctgcaaa

SEQ ID NO: 596632 - DNA, 25 bp, Homo sapien
gtgggtctgcaaagccttactcaaa

SEQ ID NO: 596633 - DNA, 25 bp, Homo sapien
tagggctagaggttctcaggattct

SEQ ID NO: 596634 - DNA, 25 bp, Homo sapien
ttgtaaaggcttatggctctcacca

SEQ ID NO: 596635 - DNA, 25 bp, Homo sapien
tatggctctcaccactgttattcaa

SEQ ID NO: 596636 - DNA, 25 bp, Homo sapien
accactgttattcaacgttgcatta

SEQ ID NO: 596637 - DNA, 25 bp, Homo sapien
gttgcattaaagtttctacccagag

SEQ ID NO: 596638 - DNA, 25 bp, Homo sapien
aagtttctacccagagaaggcaata

SEQ ID NO: 596639 - DNA, 25 bp, Homo sapien
ttccccatgaagctcggacaggagg

SEQ ID NO: 596640 - DNA, 25 bp, Homo sapien
ccccatgaagctcggacaggaggac

SEQ ID NO: 596641 - DNA, 25 bp, Homo sapien
acaggaggacggaggagcaactgcc

SEQ ID NO: 596642 - DNA, 25 bp, Homo sapien
gggtcagagtctgtccccgctcctg

SEQ ID NO: 596643 - DNA, 25 bp, Homo sapien
cccgctcctgcaggccggaagcacg

SEQ ID NO: 596644 - DNA, 25 bp, Homo sapien
aagcacgtgcggtcagcggtgggcc

SEQ ID NO: 596645 - DNA, 25 bp, Homo sapien
tgcggtcagcggtgggccagagcct

SEQ ID NO: 596646 - DNA, 25 bp, Homo sapien
tcagcaagggccttcctgtagctct

SEQ ID NO: 596647 - DNA, 25 bp, Homo sapien
agcaagggccttcctgtagctctcg

SEQ ID NO: 596648 - DNA, 25 bp, Homo sapien
aagggccttcctgtagctctcggct

SEQ ID NO: 596649 - DNA, 25 bp, Homo sapien
agggccttcctgtagctctcggctc

SEQ ID NO: 596650 - DNA, 25 bp, Homo sapien
gaatttcaacatacttgttatcctg

SEQ ID NO: 596651 - DNA, 25 bp, Homo sapien
atttcaacatacttgttatcctgca

SEQ ID NO: 596652 - DNA, 25 bp, Homo sapien
ttcaacatacttgttatcctgcatt

SEQ ID NO: 596653 - DNA, 25 bp, Homo sapien
tgttatcctgcattccagttgactg

SEQ ID NO: 596654 - DNA, 25 bp, Homo sapien
gttatcctgcattccagttgactgt

SEQ ID NO: 596655 - DNA, 25 bp, Homo sapien
ttatcctgcattccagttgactgta

SEQ ID NO: 596656 - DNA, 25 bp, Homo sapien
tatcctgcattccagttgactgtag

SEQ ID NO: 596657 - DNA, 25 bp, Homo sapien
atcctgcattccagttgactgtaga

SEQ ID NO: 596658 - DNA, 25 bp, Homo sapien
cctgcattccagttgactgtagaga

SEQ ID NO: 596659 - DNA, 25 bp, Homo sapien
tgcattccagttgactgtagagaat

SEQ ID NO: 596660 - DNA, 25 bp, Homo sapien
ttccagttgactgtagagaatctct

SEQ ID NO: 596661 - DNA, 25 bp, Homo sapien
accacagtgccagaaagacatttct

SEQ ID NO: 596662 - DNA, 25 bp, Homo sapien
ttctaataaaacttgccagcaaagg

SEQ ID NO: 596663 - DNA, 25 bp, Homo sapien
taaaacttgccagcaaagggctggg

SEQ ID NO: 596664 - DNA, 25 bp, Homo sapien
tgggaagaccccaagtgtctcttgt

SEQ ID NO: 596665 - DNA, 25 bp, Homo sapien
accccaagtgtctcttgtcagggaa

SEQ ID NO: 596666 - DNA, 25 bp, Homo sapien
tcttgtcagggaagctttatagact

SEQ ID NO: 596667 - DNA, 25 bp, Homo sapien
tttatagacttagctcctgggagcc

SEQ ID NO: 596668 - DNA, 25 bp, Homo sapien
tagacttagctcctgggagccagct

SEQ ID NO: 596669 - DNA, 25 bp, Homo sapien
tgctagaccaccctgcaagggcttg

SEQ ID NO: 596670 - DNA, 25 bp, Homo sapien
agaccaccctgcaagggcttggcct

SEQ ID NO: 596671 - DNA, 25 bp, Homo sapien
ctgctggaagtagtggctggaaaga

SEQ ID NO: 596672 - DNA, 25 bp, Homo sapien
ttaccttaaagctagacaaacctgt

SEQ ID NO: 596673 - DNA, 25 bp, Homo sapien
gacaaacctgttatagctatggcaa

SEQ ID NO: 596674 - DNA, 25 bp, Homo sapien
tagctatggcaaagacacaatattc

SEQ ID NO: 596675 - DNA, 25 bp, Homo sapien
gacacaatattctggaaacctatgt

SEQ ID NO: 596676 - DNA, 25 bp, Homo sapien
aacctatgtaggtatttcattgtta

SEQ ID NO: 596677 - DNA, 25 bp, Homo sapien
ttcattgttacctattttagaagtc

SEQ ID NO: 596678 - DNA, 25 bp, Homo sapien
ttagaagtctttccttagaatttga

SEQ ID NO: 596679 - DNA, 25 bp, Homo sapien
tgatggtaaatttaaatcctcccca

SEQ ID NO: 596680 - DNA, 25 bp, Homo sapien
aaatcctccccaaacaatgtaacat

SEQ ID NO: 596681 - DNA, 25 bp, Homo sapien
ttggctaagcacaacttggccttta

SEQ ID NO: 596682 - DNA, 25 bp, Homo sapien
gctaagcacaacttggcctttaggt

SEQ ID NO: 596683 - DNA, 25 bp, Homo sapien
agaactggtgaaacccaaacatagt

SEQ ID NO: 596684 - DNA, 25 bp, Homo sapien
ggtgaaacccaaacatagtctcgaa

SEQ ID NO: 596685 - DNA, 25 bp, Homo sapien
gaaacccaaacatagtctcgaattt

SEQ ID NO: 596686 - DNA, 25 bp, Homo sapien
ccaaacatagtctcgaatttagctt

SEQ ID NO: 596687 - DNA, 25 bp, Homo sapien
tcttgcacttgcacaagtagagagg

SEQ ID NO: 596688 - DNA, 25 bp, Homo sapien
caagtagagaggagagttagttttt

SEQ ID NO: 596689 - DNA, 25 bp, Homo sapien
gttagtttttataccatcgcatccc

SEQ ID NO: 596690 - DNA, 25 bp, Homo sapien
gtttttataccatcgcatccccaat

SEQ ID NO: 596691 - DNA, 25 bp, Homo sapien
atccccaatcccagctttattgatg

SEQ ID NO: 596692 - DNA, 25 bp, Homo sapien
aatcccagctttattgatgcataac

SEQ ID NO: 596693 - DNA, 25 bp, Homo sapien
cccagctttattgatgcataacaaa

SEQ ID NO: 596694 - DNA, 25 bp, Homo sapien
atcagtggttgcctcgtaagagaaa

SEQ ID NO: 596695 - DNA, 25 bp, Homo sapien
gaaggagagattacaacgggactca

SEQ ID NO: 596696 - DNA, 25 bp, Homo sapien
gattacaacgggactcaaggacaag

SEQ ID NO: 596697 - DNA, 25 bp, Homo sapien
aacgggactcaaggacaagtttcat

SEQ ID NO: 596698 - DNA, 25 bp, Homo sapien
aggacaagtttcatgtttgcagatg

SEQ ID NO: 596699 - DNA, 25 bp, Homo sapien
agtttcatgtttgcagatgatggat

SEQ ID NO: 596700 - DNA, 25 bp, Homo sapien
tgatggatatgtttactgtcttgac

SEQ ID NO: 596701 - DNA, 25 bp, Homo sapien
tactgtcttgacatgtatacatata

SEQ ID NO: 596702 - DNA, 25 bp, Homo sapien
tcaaaacttctcaaattgcatactt

SEQ ID NO: 596703 - DNA, 25 bp, Homo sapien
gcatactttagatttgtgcagttta

SEQ ID NO: 596704 - DNA, 25 bp, Homo sapien
gtgcagtttatcatctgtcttttat

SEQ ID NO: 596705 - DNA, 25 bp, Homo sapien
aaccctgtcaactaagctaatgcta

SEQ ID NO: 596706 - DNA, 25 bp, Homo sapien
ttacatgcaggattagctaaagaac

SEQ ID NO: 596707 - DNA, 25 bp, Homo sapien
tactaattcttagggtctctgggtt

SEQ ID NO: 596708 - DNA, 25 bp, Homo sapien
ggtctctgggttttcttaatgttat

SEQ ID NO: 596709 - DNA, 25 bp, Homo sapien
ttcttaatgttatttccttcagaaa

SEQ ID NO: 596710 - DNA, 25 bp, Homo sapien
ctatctaatgacatctcacatcctc

SEQ ID NO: 596711 - DNA, 25 bp, Homo sapien
atgacatctcacatcctcatcaaga

SEQ ID NO: 596712 - DNA, 25 bp, Homo sapien
catcctcatcaagaagcaagtcatg

SEQ ID NO: 596713 - DNA, 25 bp, Homo sapien
agtcatgaaatttaagccttacaag

SEQ ID NO: 596714 - DNA, 25 bp, Homo sapien
agccttacaaggtatattctttttg

SEQ ID NO: 596715 - DNA, 25 bp, Homo sapien
aaagttgcaggaccaaccctgtcaa

SEQ ID NO: 596716 - DNA, 25 bp, Homo sapien
cctttagatgattgtgaaggtaaat

SEQ ID NO: 596717 - DNA, 25 bp, Homo sapien
ctttagatgattgtgaaggtaaatt

SEQ ID NO: 596718 - DNA, 25 bp, Homo sapien
ttagatgattgtgaaggtaaattgg

SEQ ID NO: 596719 - DNA, 25 bp, Homo sapien
tagatgattgtgaaggtaaattggt

SEQ ID NO: 596720 - DNA, 25 bp, Homo sapien
agatgattgtgaaggtaaattggtt

SEQ ID NO: 596721 - DNA, 25 bp, Homo sapien
gatgattgtgaaggtaaattggttt

SEQ ID NO: 596722 - DNA, 25 bp, Homo sapien
atgattgtgaaggtaaattggtttc

SEQ ID NO: 596723 - DNA, 25 bp, Homo sapien
tgattgtgaaggtaaattggtttca

SEQ ID NO: 596724 - DNA, 25 bp, Homo sapien
gattgtgaaggtaaattggtttcat

SEQ ID NO: 596725 - DNA, 25 bp, Homo sapien
attgtgaaggtaaattggtttcatt

SEQ ID NO: 596726 - DNA, 25 bp, Homo sapien
ttgtgaaggtaaattggtttcattc

SEQ ID NO: 596727 - DNA, 25 bp, Homo sapien
tagaatggggaacgttcacaacatt

SEQ ID NO: 596728 - DNA, 25 bp, Homo sapien
ttctcttaagttctaacaggaatac

SEQ ID NO: 596729 - DNA, 25 bp, Homo sapien
tctcttaagttctaacaggaatacc

SEQ ID NO: 596730 - DNA, 25 bp, Homo sapien
aagttctaacaggaataccattgtg

SEQ ID NO: 596731 - DNA, 25 bp, Homo sapien
agttctaacaggaataccattgtgg

SEQ ID NO: 596732 - DNA, 25 bp, Homo sapien
gttctaacaggaataccattgtggt

SEQ ID NO: 596733 - DNA, 25 bp, Homo sapien
ttctaacaggaataccattgtggtt

SEQ ID NO: 596734 - DNA, 25 bp, Homo sapien
tctaacaggaataccattgtggtta

SEQ ID NO: 596735 - DNA, 25 bp, Homo sapien
ctaacaggaataccattgtggttat

SEQ ID NO: 596736 - DNA, 25 bp, Homo sapien
aacaggaataccattgtggttatag

SEQ ID NO: 596737 - DNA, 25 bp, Homo sapien
caggaataccattgtggttatagaa

SEQ ID NO: 596738 - DNA, 25 bp, Homo sapien
gaatctctagtcatgtctatctgtt

SEQ ID NO: 596739 - DNA, 25 bp, Homo sapien
tagtcatgtctatctgtttttgatg

SEQ ID NO: 596740 - DNA, 25 bp, Homo sapien
atctgtttttgatgcctctacagaa

SEQ ID NO: 596741 - DNA, 25 bp, Homo sapien
tgcctctacagaataactgcccagc

SEQ ID NO: 596742 - DNA, 25 bp, Homo sapien
atctacctaccagaagtatgttgaa

SEQ ID NO: 596743 - DNA, 25 bp, Homo sapien
tcttccttctggctcgtacatcagt

SEQ ID NO: 596744 - DNA, 25 bp, Homo sapien
ggctcgtacatcagtgcttgtggtt

SEQ ID NO: 596745 - DNA, 25 bp, Homo sapien
atcagtgcttgtggttgccagctat

SEQ ID NO: 596746 - DNA, 25 bp, Homo sapien
gcttgtggttgccagctattcaaaa

SEQ ID NO: 596747 - DNA, 25 bp, Homo sapien
gccagctattcaaaaatatccttgt

SEQ ID NO: 596748 - DNA, 25 bp, Homo sapien
atatccttgtattgaaaccttcttt

SEQ ID NO: 596749 - DNA, 25 bp, Homo sapien
acagccccacagaccaatggctgca

SEQ ID NO: 596750 - DNA, 25 bp, Homo sapien
aatggctgcacctcagaagaggact

SEQ ID NO: 596751 - DNA, 25 bp, Homo sapien
gctgcacctcagaagaggactgaat

SEQ ID NO: 596752 - DNA, 25 bp, Homo sapien
gaggactgaatagcgggtgttgccc

SEQ ID NO: 596753 - DNA, 25 bp, Homo sapien
ggtgttgcccccgagtgctcagagt

SEQ ID NO: 596754 - DNA, 25 bp, Homo sapien
ggaagctcacacctgcgcaaccttg

SEQ ID NO: 596755 - DNA, 25 bp, Homo sapien
acacctgcgcaaccttgtccagagt

SEQ ID NO: 596756 - DNA, 25 bp, Homo sapien
gcaaccttgtccagagtcccctgtg

SEQ ID NO: 596757 - DNA, 25 bp, Homo sapien
gtccagagtcccctgtgtatcctgc

SEQ ID NO: 596758 - DNA, 25 bp, Homo sapien
gagtcccctgtgtatcctgccggca

SEQ ID NO: 596759 - DNA, 25 bp, Homo sapien
tgtcctccacagccttcagtgcagt

SEQ ID NO: 596760 - DNA, 25 bp, Homo sapien
tacggtccctttccttgcaaagcga

SEQ ID NO: 596761 - DNA, 25 bp, Homo sapien
tttccttgcaaagcgattaccagaa

SEQ ID NO: 596762 - DNA, 25 bp, Homo sapien
gcgattaccagaatcctctggctga

SEQ ID NO: 596763 - DNA, 25 bp, Homo sapien
accagaatcctctggctgaccacta

SEQ ID NO: 596764 - DNA, 25 bp, Homo sapien
ttccagggtggcatgccacgggcca

SEQ ID NO: 596765 - DNA, 25 bp, Homo sapien
agggcagccgcgtgctctaccactt

SEQ ID NO: 596766 - DNA, 25 bp, Homo sapien
tcagcagccagcaactggagaacat

SEQ ID NO: 596767 - DNA, 25 bp, Homo sapien
aactggagaacatctggtggcagcg

SEQ ID NO: 596768 - DNA, 25 bp, Homo sapien
gtcagctgtcactctgacggcagct

SEQ ID NO: 596769 - DNA, 25 bp, Homo sapien
tctgacggcagctactgccagtggc

SEQ ID NO: 596770 - DNA, 25 bp, Homo sapien
tgccagtggcccgtgtccagcgaag

SEQ ID NO: 596771 - DNA, 25 bp, Homo sapien
ctaatacttatggaagtaaccctat

SEQ ID NO: 596772 - DNA, 25 bp, Homo sapien
cgtgtatatcgggtacacaatttgg

SEQ ID NO: 596773 - DNA, 25 bp, Homo sapien
tttcaggatccttgtcaattgcagc

SEQ ID NO: 596774 - DNA, 25 bp, Homo sapien
ggatccttgtcaattgcagcaggaa

SEQ ID NO: 596775 - DNA, 25 bp, Homo sapien
ggaattagaactacaaaaggcctgg

SEQ ID NO: 596776 - DNA, 25 bp, Homo sapien
ggtctggatggcatggtgctcctct

SEQ ID NO: 596777 - DNA, 25 bp, Homo sapien
gtgctcctcttaagtgtgctggaat

SEQ ID NO: 596778 - DNA, 25 bp, Homo sapien
taaagtgctctgttgtacccctggt

SEQ ID NO: 596779 - DNA, 25 bp, Homo sapien
tgttaattctgccatcacattctca

SEQ ID NO: 596780 - DNA, 25 bp, Homo sapien
acatggcagaaacagcatctcccac

SEQ ID NO: 596781 - DNA, 25 bp, Homo sapien
atctcccacaccacttaatgaggtt

SEQ ID NO: 596782 - DNA, 25 bp, Homo sapien
tgtttgggaaggctctgggaaaaat

SEQ ID NO: 596783 - DNA, 25 bp, Homo sapien
tcaacttgaggggacatgctttctt

SEQ ID NO: 596784 - DNA, 25 bp, Homo sapien
tttctttaacctgattactgtttct

SEQ ID NO: 596785 - DNA, 25 bp, Homo sapien
aacctgattactgtttctaggtgct

SEQ ID NO: 596786 - DNA, 25 bp, Homo sapien
gtttctaggtgctgtaaattgctga

SEQ ID NO: 596787 - DNA, 25 bp, Homo sapien
gtgctgtaaattgctgatcattctc

SEQ ID NO: 596788 - DNA, 25 bp, Homo sapien
gatcattctcagtaaatcaccagca

SEQ ID NO: 596789 - DNA, 25 bp, Homo sapien
gtaaatcaccagcattctgttcttt

SEQ ID NO: 596790 - DNA, 25 bp, Homo sapien
ttctgttctttctcagtcttgacaa

SEQ ID NO: 596791 - DNA, 25 bp, Homo sapien
ctcagtcttgacaaagttgccattg

SEQ ID NO: 596792 - DNA, 25 bp, Homo sapien
aaagttgccattgtgcatatgtgta

SEQ ID NO: 596793 - DNA, 25 bp, Homo sapien
acacttcttcttagtctcatcttca

SEQ ID NO: 596794 - DNA, 25 bp, Homo sapien
acttcttcttagtctcatcttcagc

SEQ ID NO: 596795 - DNA, 25 bp, Homo sapien
ttcttcttagtctcatcttcagctt

SEQ ID NO: 596796 - DNA, 25 bp, Homo sapien
ttagtctcatcttcagcttcccata

SEQ ID NO: 596797 - DNA, 25 bp, Homo sapien
tcatcttcagcttcccatacgaggc

SEQ ID NO: 596798 - DNA, 25 bp, Homo sapien
tcttcagcttcccatacgaggccat

SEQ ID NO: 596799 - DNA, 25 bp, Homo sapien
ccatacgaggccatcctcatgaaat

SEQ ID NO: 596800 - DNA, 25 bp, Homo sapien
acgaggccatcctcatgaaatcagg

SEQ ID NO: 596801 - DNA, 25 bp, Homo sapien
tggggactgacaagtgccagctgtc

SEQ ID NO: 596802 - DNA, 25 bp, Homo sapien
acagtggccaaacctgaaactgagg

SEQ ID NO: 596803 - DNA, 25 bp, Homo sapien
gtggccaaacctgaaactgaggccc

SEQ ID NO: 596804 - DNA, 25 bp, Homo sapien
ttcactgttgaaaccatgccctgga

SEQ ID NO: 596805 - DNA, 25 bp, Homo sapien
gaaaccatgccctggaagacatatt

SEQ ID NO: 596806 - DNA, 25 bp, Homo sapien
ggaagacatattttgaactcctgaa

SEQ ID NO: 596807 - DNA, 25 bp, Homo sapien
gggctctcctgagtggaagccactc

SEQ ID NO: 596808 - DNA, 25 bp, Homo sapien
ttcccaggagttgacatatcagtgg

SEQ ID NO: 596809 - DNA, 25 bp, Homo sapien
ggagttgacatatcagtggctgagc

SEQ ID NO: 596810 - DNA, 25 bp, Homo sapien
gttctcttattttgcaagtgtctga

SEQ ID NO: 596811 - DNA, 25 bp, Homo sapien
gtgtctgaggttttatgacttggca

SEQ ID NO: 596812 - DNA, 25 bp, Homo sapien
gaaaatcctcattgtccaggttcct

SEQ ID NO: 596813 - DNA, 25 bp, Homo sapien
tgtccaggttcctcaagtagaatag

SEQ ID NO: 596814 - DNA, 25 bp, Homo sapien
ggttcctcaagtagaataggtcatt

SEQ ID NO: 596815 - DNA, 25 bp, Homo sapien
agtggcgctggagcagaggaatgca

SEQ ID NO: 596816 - DNA, 25 bp, Homo sapien
tggatctggagttagtatggtagct

SEQ ID NO: 596817 - DNA, 25 bp, Homo sapien
gatctggagttagtatggtagctga

SEQ ID NO: 596818 - DNA, 25 bp, Homo sapien
atctggagttagtatggtagctgag

SEQ ID NO: 596819 - DNA, 25 bp, Homo sapien
ctggagttagtatggtagctgagaa

SEQ ID NO: 596820 - DNA, 25 bp, Homo sapien
ggagttagtatggtagctgagaaca

SEQ ID NO: 596821 - DNA, 25 bp, Homo sapien
gagttagtatggtagctgagaacag

SEQ ID NO: 596822 - DNA, 25 bp, Homo sapien
gttagtatggtagctgagaacagga

SEQ ID NO: 596823 - DNA, 25 bp, Homo sapien
tagtatggtagctgagaacaggact

SEQ ID NO: 596824 - DNA, 25 bp, Homo sapien
agtatggtagctgagaacaggactt

SEQ ID NO: 596825 - DNA, 25 bp, Homo sapien
gtatggtagctgagaacaggacttc

SEQ ID NO: 596826 - DNA, 25 bp, Homo sapien
taatcatgttgtgtatctctcgtta

SEQ ID NO: 596827 - DNA, 25 bp, Homo sapien
catgttgtgtatctctcgttacagc

SEQ ID NO: 596828 - DNA, 25 bp, Homo sapien
tgtgtatctctcgttacagcccaca

SEQ ID NO: 596829 - DNA, 25 bp, Homo sapien
tatctctcgttacagcccacaatga

SEQ ID NO: 596830 - DNA, 25 bp, Homo sapien
ctcgttacagcccacaatgattctg

SEQ ID NO: 596831 - DNA, 25 bp, Homo sapien
gttacagcccacaatgattctgagc

SEQ ID NO: 596832 - DNA, 25 bp, Homo sapien
gcccacaatgattctgagctaaaac

SEQ ID NO: 596833 - DNA, 25 bp, Homo sapien
caatgattctgagctaaaacacaaa

SEQ ID NO: 596834 - DNA, 25 bp, Homo sapien
aaaaaccagattcattgccaccagc

SEQ ID NO: 596835 - DNA, 25 bp, Homo sapien
aaccagattcattgccaccagcgct

SEQ ID NO: 596836 - DNA, 25 bp, Homo sapien
gcgctcacctcgcctgacttaaaaa

SEQ ID NO: 596837 - DNA, 25 bp, Homo sapien
tatttgtggcccgtacgctggttca

SEQ ID NO: 596838 - DNA, 25 bp, Homo sapien
atttgtggcccgtacgctggttcat

SEQ ID NO: 596839 - DNA, 25 bp, Homo sapien
tttgtggcccgtacgctggttcatt

SEQ ID NO: 596840 - DNA, 25 bp, Homo sapien
ttgtggcccgtacgctggttcattg

SEQ ID NO: 596841 - DNA, 25 bp, Homo sapien
gtggcccgtacgctggttcattgat

SEQ ID NO: 596842 - DNA, 25 bp, Homo sapien
tggcccgtacgctggttcattgatg

SEQ ID NO: 596843 - DNA, 25 bp, Homo sapien
ggcccgtacgctggttcattgatga

SEQ ID NO: 596844 - DNA, 25 bp, Homo sapien
gcccgtacgctggttcattgatgag

SEQ ID NO: 596845 - DNA, 25 bp, Homo sapien
cccgtacgctggttcattgatgaga

SEQ ID NO: 596846 - DNA, 25 bp, Homo sapien
ccgtacgctggttcattgatgagac

SEQ ID NO: 596847 - DNA, 25 bp, Homo sapien
gtacgctggttcattgatgagactt

SEQ ID NO: 596848 - DNA, 25 bp, Homo sapien
tagatgcctccacgaggcctgaggt

SEQ ID NO: 596849 - DNA, 25 bp, Homo sapien
ccacgaggcctgaggttatggtgtc

SEQ ID NO: 596850 - DNA, 25 bp, Homo sapien
ctgaggttatggtgtcgtcaggtaa

SEQ ID NO: 596851 - DNA, 25 bp, Homo sapien
gtcgtcaggtaagagtgtggtttca

SEQ ID NO: 596852 - DNA, 25 bp, Homo sapien
gtaagagtgtggtttcagtgtcgcc

SEQ ID NO: 596853 - DNA, 25 bp, Homo sapien
agatattgtgtgtgttgtgctgctg

SEQ ID NO: 596854 - DNA, 25 bp, Homo sapien
tgtttgagttgagcccgggctgctg

SEQ ID NO: 596855 - DNA, 25 bp, Homo sapien
gctgctgtggtaggtcgtagattct

SEQ ID NO: 596856 - DNA, 25 bp, Homo sapien
tgtggtaggtcgtagattcttcaac

SEQ ID NO: 596857 - DNA, 25 bp, Homo sapien
gtagattcttcaacgaggcctgagg

SEQ ID NO: 596858 - DNA, 25 bp, Homo sapien
attcttcaacgaggcctgaggttgt

SEQ ID NO: 596859 - DNA, 25 bp, Homo sapien
aaatttaaacccaatcttgcgctag

SEQ ID NO: 596860 - DNA, 25 bp, Homo sapien
atttaaacccaatcttgcgctagtc

SEQ ID NO: 596861 - DNA, 25 bp, Homo sapien
ttaaacccaatcttgcgctagtctt

SEQ ID NO: 596862 - DNA, 25 bp, Homo sapien
aaacccaatcttgcgctagtcttgt

SEQ ID NO: 596863 - DNA, 25 bp, Homo sapien
ccaatcttgcgctagtcttgtggga

SEQ ID NO: 596864 - DNA, 25 bp, Homo sapien
aatcttgcgctagtcttgtgggaat

SEQ ID NO: 596865 - DNA, 25 bp, Homo sapien
atcttgcgctagtcttgtgggaatg

SEQ ID NO: 596866 - DNA, 25 bp, Homo sapien
cttgcgctagtcttgtgggaatgaa

SEQ ID NO: 596867 - DNA, 25 bp, Homo sapien
gcgctagtcttgtgggaatgaagat

SEQ ID NO: 596868 - DNA, 25 bp, Homo sapien
ttacctaaaaatgctcctctggttt

SEQ ID NO: 596869 - DNA, 25 bp, Homo sapien
cctaaaaatgctcctctggtttttg

SEQ ID NO: 596870 - DNA, 25 bp, Homo sapien
aggaggtatttggtgtagtcttaga

SEQ ID NO: 596871 - DNA, 25 bp, Homo sapien
gtatttggtgtagtcttagaaaaga

SEQ ID NO: 596872 - DNA, 25 bp, Homo sapien
aagagcaaagcttgttgagatgcaa

SEQ ID NO: 596873 - DNA, 25 bp, Homo sapien
caaagcttgttgagatgcaagggca

SEQ ID NO: 596874 - DNA, 25 bp, Homo sapien
aagggcaggtgaccagatagtttca

SEQ ID NO: 596875 - DNA, 25 bp, Homo sapien
gcaggtgaccagatagtttcactca

SEQ ID NO: 596876 - DNA, 25 bp, Homo sapien
gaccagatagtttcactcactgctt

SEQ ID NO: 596877 - DNA, 25 bp, Homo sapien
ccagatagtttcactcactgcttaa

SEQ ID NO: 596878 - DNA, 25 bp, Homo sapien
gatagtttcactcactgcttaaata

SEQ ID NO: 596879 - DNA, 25 bp, Homo sapien
ctcactgcttaaataaatggctcct

SEQ ID NO: 596880 - DNA, 25 bp, Homo sapien
agttatgtcaggaactttggaagtc

SEQ ID NO: 596881 - DNA, 25 bp, Homo sapien
gaaatcagctgtggtaaagtagcct

SEQ ID NO: 596882 - DNA, 25 bp, Homo sapien
aaatcagctgtggtaaagtagcctg

SEQ ID NO: 596883 - DNA, 25 bp, Homo sapien
atcagctgtggtaaagtagcctgaa

SEQ ID NO: 596884 - DNA, 25 bp, Homo sapien
tcagctgtggtaaagtagcctgaaa

SEQ ID NO: 596885 - DNA, 25 bp, Homo sapien
cagctgtggtaaagtagcctgaaag

SEQ ID NO: 596886 - DNA, 25 bp, Homo sapien
gctgtggtaaagtagcctgaaagcc

SEQ ID NO: 596887 - DNA, 25 bp, Homo sapien
ctgtggtaaagtagcctgaaagcca

SEQ ID NO: 596888 - DNA, 25 bp, Homo sapien
tgtggtaaagtagcctgaaagccag

SEQ ID NO: 596889 - DNA, 25 bp, Homo sapien
tggtaaagtagcctgaaagccagtg

SEQ ID NO: 596890 - DNA, 25 bp, Homo sapien
gtaaagtagcctgaaagccagtggt

SEQ ID NO: 596891 - DNA, 25 bp, Homo sapien
agcactaattgcctatatacaaccc

SEQ ID NO: 596892 - DNA, 25 bp, Homo sapien
gggctcatcctgcttattgcaagtg

SEQ ID NO: 596893 - DNA, 25 bp, Homo sapien
ctgcttattgcaagtgaggcccaaa

SEQ ID NO: 596894 - DNA, 25 bp, Homo sapien
gctgttattccctgatgtttcaggt

SEQ ID NO: 596895 - DNA, 25 bp, Homo sapien
gatgtttcaggtccatgtgcaactt

SEQ ID NO: 596896 - DNA, 25 bp, Homo sapien
tgtgcaacttattcccagatctttt

SEQ ID NO: 596897 - DNA, 25 bp, Homo sapien
tttgccagacagctggaccagaatg

SEQ ID NO: 596898 - DNA, 25 bp, Homo sapien
gataaggcccaaccgagaagtcaga

SEQ ID NO: 596899 - DNA, 25 bp, Homo sapien
aaagcttcacttttcattagctcca

SEQ ID NO: 596900 - DNA, 25 bp, Homo sapien
attagctccacattccaaagtaaga

SEQ ID NO: 596901 - DNA, 25 bp, Homo sapien
aatcaatgtgcttagctgcagttca

SEQ ID NO: 596902 - DNA, 25 bp, Homo sapien
gctgcagttcaaagcaattagtctt

SEQ ID NO: 596903 - DNA, 25 bp, Homo sapien
acacaacacacacttgagaggaagt

SEQ ID NO: 596904 - DNA, 25 bp, Homo sapien
ttgagaggaagtgcacaacacacac

SEQ ID NO: 596905 - DNA, 25 bp, Homo sapien
gagaatgtgcgcaacacacacctaa

SEQ ID NO: 596906 - DNA, 25 bp, Homo sapien
aatgtgcgcaacacacacctaagga

SEQ ID NO: 596907 - DNA, 25 bp, Homo sapien
tgcgcaacacacacctaaggagaac

SEQ ID NO: 596908 - DNA, 25 bp, Homo sapien
aatgcacgcagcacacacctgacgg

SEQ ID NO: 596909 - DNA, 25 bp, Homo sapien
acgcagcacacacctgacgggaagt

SEQ ID NO: 596910 - DNA, 25 bp, Homo sapien
gcagcacacacctgacgggaagtgt

SEQ ID NO: 596911 - DNA, 25 bp, Homo sapien
cacctgacgggaagtgtgcaacacg

SEQ ID NO: 596912 - DNA, 25 bp, Homo sapien
ggaagtgtgcaacacgcacctgaaa

SEQ ID NO: 596913 - DNA, 25 bp, Homo sapien
acgcacctgaaagaaggcacgcaac

SEQ ID NO: 596914 - DNA, 25 bp, Homo sapien
aaatgtgcacatcaaagatcatagc

SEQ ID NO: 596915 - DNA, 25 bp, Homo sapien
gtgcacatcaaagatcatagccccg

SEQ ID NO: 596916 - DNA, 25 bp, Homo sapien
tgcacatcaaagatcatagccccgg

SEQ ID NO: 596917 - DNA, 25 bp, Homo sapien
gcacatcaaagatcatagccccggc

SEQ ID NO: 596918 - DNA, 25 bp, Homo sapien
cacatcaaagatcatagccccggca

SEQ ID NO: 596919 - DNA, 25 bp, Homo sapien
acatcaaagatcatagccccggcac

SEQ ID NO: 596920 - DNA, 25 bp, Homo sapien
atcaaagatcatagccccggcacat

SEQ ID NO: 596921 - DNA, 25 bp, Homo sapien
tcatagccccggcacatcgaagctg

SEQ ID NO: 596922 - DNA, 25 bp, Homo sapien
atagccccggcacatcgaagctgca

SEQ ID NO: 596923 - DNA, 25 bp, Homo sapien
tagccccggcacatcgaagctgcaa

SEQ ID NO: 596924 - DNA, 25 bp, Homo sapien
gccccggcacatcgaagctgcaatg

SEQ ID NO: 596925 - DNA, 25 bp, Homo sapien
taaatgagtctagcccattgctgga

SEQ ID NO: 596926 - DNA, 25 bp, Homo sapien
gagtctagcccattgctggacgcat

SEQ ID NO: 596927 - DNA, 25 bp, Homo sapien
tagcccattgctggacgcatgagca

SEQ ID NO: 596928 - DNA, 25 bp, Homo sapien
tggacgcatgagcaatatacaaaca

SEQ ID NO: 596929 - DNA, 25 bp, Homo sapien
ttatatttctatgcacttgcaataa

SEQ ID NO: 596930 - DNA, 25 bp, Homo sapien
atgcacttgcaataaatgatctgaa

SEQ ID NO: 596931 - DNA, 25 bp, Homo sapien
gcaatcacattaacaatggcgtcaa

SEQ ID NO: 596932 - DNA, 25 bp, Homo sapien
ttaacaatggcgtcaaaaataatgc

SEQ ID NO: 596933 - DNA, 25 bp, Homo sapien
agagttgtacactgagcactaaaaa

SEQ ID NO: 596934 - DNA, 25 bp, Homo sapien
gtacactgagcactaaaaaacattt

SEQ ID NO: 596935 - DNA, 25 bp, Homo sapien
ataaaaagatatccgatacttgtgg

SEQ ID NO: 596936 - DNA, 25 bp, Homo sapien
gagcaacactgaacactttcctgga

SEQ ID NO: 596937 - DNA, 25 bp, Homo sapien
gaacactttcctggacagtcctgta

SEQ ID NO: 596938 - DNA, 25 bp, Homo sapien
gacagtcctgtacatgttttattgg

SEQ ID NO: 596939 - DNA, 25 bp, Homo sapien
tggtgatgcccaagcttatccctga

SEQ ID NO: 596940 - DNA, 25 bp, Homo sapien
aagcttatccctgaacactgggaaa

SEQ ID NO: 596941 - DNA, 25 bp, Homo sapien
gggaccgagtgactaactttcctct

SEQ ID NO: 596942 - DNA, 25 bp, Homo sapien
actttcctctgcaagctcaaagcaa

SEQ ID NO: 596943 - DNA, 25 bp, Homo sapien
ttttcatttgaactctgccccagca

SEQ ID NO: 596944 - DNA, 25 bp, Homo sapien
agcatcaacaaatcaccactctggg

SEQ ID NO: 596945 - DNA, 25 bp, Homo sapien
accactctgggtttatgcaacttgt

SEQ ID NO: 596946 - DNA, 25 bp, Homo sapien
atgcaacttgtttcctaattgaata

SEQ ID NO: 596947 - DNA, 25 bp, Homo sapien
ggacctgaccttgggactcaagtga

SEQ ID NO: 596948 - DNA, 25 bp, Homo sapien
gacccagagggagcggcttccacaa

SEQ ID NO: 596949 - DNA, 25 bp, Homo sapien
caagctcacctaccaacagcaatat

SEQ ID NO: 596950 - DNA, 25 bp, Homo sapien
caatatggcagtgttcatcggctcc

SEQ ID NO: 596951 - DNA, 25 bp, Homo sapien
tcatcggctcccacaagaggaacca

SEQ ID NO: 596952 - DNA, 25 bp, Homo sapien
agaggaaccactacatgctcctggt

SEQ ID NO: 596953 - DNA, 25 bp, Homo sapien
actacatgctcctggtatttgtgaa

SEQ ID NO: 596954 - DNA, 25 bp, Homo sapien
tgtgaaggtgcccatcttgctcatc

SEQ ID NO: 596955 - DNA, 25 bp, Homo sapien
atcttgctcatcttggtcactgcca

SEQ ID NO: 596956 - DNA, 25 bp, Homo sapien
gggaacagcctatctacatgaactt

SEQ ID NO: 596957 - DNA, 25 bp, Homo sapien
acttctccgaacctctgactaaaga

SEQ ID NO: 596958 - DNA, 25 bp, Homo sapien
gaactatttctcctcagggccgggt

SEQ ID NO: 596959 - DNA, 25 bp, Homo sapien
ctatttctcctcagggccgggtcca

SEQ ID NO: 596960 - DNA, 25 bp, Homo sapien
tatttctcctcagggccgggtccag

SEQ ID NO: 596961 - DNA, 25 bp, Homo sapien
atttctcctcagggccgggtccagt

SEQ ID NO: 596962 - DNA, 25 bp, Homo sapien
tttctcctcagggccgggtccagtg

SEQ ID NO: 596963 - DNA, 25 bp, Homo sapien
ttctcctcagggccgggtccagtgg

SEQ ID NO: 596964 - DNA, 25 bp, Homo sapien
tctcctcagggccgggtccagtggc

SEQ ID NO: 596965 - DNA, 25 bp, Homo sapien
ctcctcagggccgggtccagtggct

SEQ ID NO: 596966 - DNA, 25 bp, Homo sapien
tcctcagggccgggtccagtggctc

SEQ ID NO: 596967 - DNA, 25 bp, Homo sapien
cctcagggccgggtccagtggctca

SEQ ID NO: 596968 - DNA, 25 bp, Homo sapien
ctcagggccgggtccagtggctcac

SEQ ID NO: 596969 - DNA, 25 bp, Homo sapien
acccaccttattctcatttctgctg

SEQ ID NO: 596970 - DNA, 25 bp, Homo sapien
ttattctcatttctgctgcctgtaa

SEQ ID NO: 596971 - DNA, 25 bp, Homo sapien
atttctgctgcctgtaagaacccac

SEQ ID NO: 596972 - DNA, 25 bp, Homo sapien
tgtaagaacccacctgccccaaata

SEQ ID NO: 596973 - DNA, 25 bp, Homo sapien
aacaatttctggttgaggcactgaa

SEQ ID NO: 596974 - DNA, 25 bp, Homo sapien
gcactgaaaattaaacatggctgtt

SEQ ID NO: 596975 - DNA, 25 bp, Homo sapien
catggctgttttgactaatccacaa

SEQ ID NO: 596976 - DNA, 25 bp, Homo sapien
tgactaatccacaacttcactcagt

SEQ ID NO: 596977 - DNA, 25 bp, Homo sapien
aacttcactcagttgctctataata

SEQ ID NO: 596978 - DNA, 25 bp, Homo sapien
gtaaggacatgctccactgtaacta

SEQ ID NO: 596979 - DNA, 25 bp, Homo sapien
atgctccactgtaactataatcagg

SEQ ID NO: 596980 - DNA, 25 bp, Homo sapien
taattcacaatttattaagcatcag

SEQ ID NO: 596981 - DNA, 25 bp, Homo sapien
gagaataatcatgttgactttgtga

SEQ ID NO: 596982 - DNA, 25 bp, Homo sapien
atcatgttgactttgtgaatgtaga

SEQ ID NO: 596983 - DNA, 25 bp, Homo sapien
aaagcttttatctattacacgaatc

SEQ ID NO: 596984 - DNA, 25 bp, Homo sapien
atctattacacgaatctttttcagc

SEQ ID NO: 596985 - DNA, 25 bp, Homo sapien
atctttttcagcatcattatacttt

SEQ ID NO: 596986 - DNA, 25 bp, Homo sapien
cattatactttcaccagtttccacg

SEQ ID NO: 596987 - DNA, 25 bp, Homo sapien
tatactttcaccagtttccacgtct

SEQ ID NO: 596988 - DNA, 25 bp, Homo sapien
tcaccagtttccacgtctgttttat

SEQ ID NO: 596989 - DNA, 25 bp, Homo sapien
gtatacttcagattacaaatttctt

SEQ ID NO: 596990 - DNA, 25 bp, Homo sapien
caaatttcttacattgtgataaggt

SEQ ID NO: 596991 - DNA, 25 bp, Homo sapien
tgacttcaaagctggtcatcctacc

SEQ ID NO: 596992 - DNA, 25 bp, Homo sapien
aaagctggtcatcctaccactatgc

SEQ ID NO: 596993 - DNA, 25 bp, Homo sapien
gtcatcctaccactatgcctggttg

SEQ ID NO: 596994 - DNA, 25 bp, Homo sapien
gatgaaggcactaatgtgacaccca

SEQ ID NO: 596995 - DNA, 25 bp, Homo sapien
ggcactaatgtgacacccacaccgg

SEQ ID NO: 596996 - DNA, 25 bp, Homo sapien
cccacaccgggctcaatttattagt

SEQ ID NO: 596997 - DNA, 25 bp, Homo sapien
caccgggctcaatttattagtaatc

SEQ ID NO: 596998 - DNA, 25 bp, Homo sapien
tattagtaatccttctatatcacag

SEQ ID NO: 596999 - DNA, 25 bp, Homo sapien
ataattatattacacttctcaagtt

SEQ ID NO: 597000 - DNA, 25 bp, Homo sapien
tctcaagtttagtagtgctagacaa

SEQ ID NO: 597001 - DNA, 25 bp, Homo sapien
gcaataatttcatgattgtcgtaat

SEQ ID NO: 597002 - DNA, 25 bp, Homo sapien
ataagttatcaaaaactacaggcca

SEQ ID NO: 597003 - DNA, 25 bp, Homo sapien
taagttatcaaaaactacaggccag

SEQ ID NO: 597004 - DNA, 25 bp, Homo sapien
aagttatcaaaaactacaggccagg

SEQ ID NO: 597005 - DNA, 25 bp, Homo sapien
agttatcaaaaactacaggccaggc

SEQ ID NO: 597006 - DNA, 25 bp, Homo sapien
gttatcaaaaactacaggccaggca

SEQ ID NO: 597007 - DNA, 25 bp, Homo sapien
ttatcaaaaactacaggccaggcat

SEQ ID NO: 597008 - DNA, 25 bp, Homo sapien
tatcaaaaactacaggccaggcatg

SEQ ID NO: 597009 - DNA, 25 bp, Homo sapien
atcaaaaactacaggccaggcatgg

SEQ ID NO: 597010 - DNA, 25 bp, Homo sapien
tcaaaaactacaggccaggcatggt

SEQ ID NO: 597011 - DNA, 25 bp, Homo sapien
gcctggccagcatgatggaaccccg

SEQ ID NO: 597012 - DNA, 25 bp, Homo sapien
ggccagcatgatggaaccccgtctc

SEQ ID NO: 597013 - DNA, 25 bp, Homo sapien
tggccagggagttggacattcatcc

SEQ ID NO: 597014 - DNA, 25 bp, Homo sapien
ggccagggagttggacattcatccc

SEQ ID NO: 597015 - DNA, 25 bp, Homo sapien
gccagggagttggacattcatccca

SEQ ID NO: 597016 - DNA, 25 bp, Homo sapien
ggacattcatcccaccacaagaccc

SEQ ID NO: 597017 - DNA, 25 bp, Homo sapien
attcatcccaccacaagaccccatg

SEQ ID NO: 597018 - DNA, 25 bp, Homo sapien
ttcatcccaccacaagaccccatga

SEQ ID NO: 597019 - DNA, 25 bp, Homo sapien
tcatcccaccacaagaccccatgaa

SEQ ID NO: 597020 - DNA, 25 bp, Homo sapien
catcccaccacaagaccccatgaag

SEQ ID NO: 597021 - DNA, 25 bp, Homo sapien
atcccaccacaagaccccatgaaga

SEQ ID NO: 597022 - DNA, 25 bp, Homo sapien
gagttcctcaacagctctgtgtcct

SEQ ID NO: 597023 - DNA, 25 bp, Homo sapien
agttcctcaacagctctgtgtcctc

SEQ ID NO: 597024 - DNA, 25 bp, Homo sapien
atgtaatatttcttcatatggatga

SEQ ID NO: 597025 - DNA, 25 bp, Homo sapien
gatgattttgcaatggtttccccat

SEQ ID NO: 597026 - DNA, 25 bp, Homo sapien
aatggtttccccatttttgcatatt

SEQ ID NO: 597027 - DNA, 25 bp, Homo sapien
aggcttttttgaacatctttcaaca

SEQ ID NO: 597028 - DNA, 25 bp, Homo sapien
tatttgcggagcaaccactgggttt

SEQ ID NO: 597029 - DNA, 25 bp, Homo sapien
aaccactgggtttagccctgtgcta

SEQ ID NO: 597030 - DNA, 25 bp, Homo sapien
ggtttagccctgtgctagatgcagt

SEQ ID NO: 597031 - DNA, 25 bp, Homo sapien
gcagtgaattatatacgtctttttt

SEQ ID NO: 597032 - DNA, 25 bp, Homo sapien
aatggttgctgtatttaagtgtctt

SEQ ID NO: 597033 - DNA, 25 bp, Homo sapien
gatttcagacttctgcttctaacat

SEQ ID NO: 597034 - DNA, 25 bp, Homo sapien
gcttctaacatctaaaatcaccaca

SEQ ID NO: 597035 - DNA, 25 bp, Homo sapien
tctacagaggcaggtgatgcgctgc

SEQ ID NO: 597036 - DNA, 25 bp, Homo sapien
cacgccgggagtagattccttcatt

SEQ ID NO: 597037 - DNA, 25 bp, Homo sapien
ggagtagattccttcatttgcagct

SEQ ID NO: 597038 - DNA, 25 bp, Homo sapien
agtagattccttcatttgcagctcg

SEQ ID NO: 597039 - DNA, 25 bp, Homo sapien
gattccttcatttgcagctcgggaa

SEQ ID NO: 597040 - DNA, 25 bp, Homo sapien
ttcatttgcagctcgggaagtcttt

SEQ ID NO: 597041 - DNA, 25 bp, Homo sapien
cagctcgggaagtctttgtgcagta

SEQ ID NO: 597042 - DNA, 25 bp, Homo sapien
tttgtgcagtagatggaaagcccag

SEQ ID NO: 597043 - DNA, 25 bp, Homo sapien
gcaaacttgaattcacaaagcctaa

SEQ ID NO: 597044 - DNA, 25 bp, Homo sapien
agcctaaaaattgttgtacatcaga

SEQ ID NO: 597045 - DNA, 25 bp, Homo sapien
gttgtacatcagaaaactcctaaag

SEQ ID NO: 597046 - DNA, 25 bp, Homo sapien
aagtcgtctctagcttctttttatt

SEQ ID NO: 597047 - DNA, 25 bp, Homo sapien
gcttctttttattgtacaccctgtc

SEQ ID NO: 597048 - DNA, 25 bp, Homo sapien
aaatgtgcatactcccaatatctgg

SEQ ID NO: 597049 - DNA, 25 bp, Homo sapien
tgcatactcccaatatctggatatt

SEQ ID NO: 597050 - DNA, 25 bp, Homo sapien
cactgtttcaatttgtcttcccaat

SEQ ID NO: 597051 - DNA, 25 bp, Homo sapien
tgtcttcccaatttcttagggtgga

SEQ ID NO: 597052 - DNA, 25 bp, Homo sapien
ggtggaaccacccttcaagctctaa

SEQ ID NO: 597053 - DNA, 25 bp, Homo sapien
acccttcaagctctaacacaactga

SEQ ID NO: 597054 - DNA, 25 bp, Homo sapien
agggtttatacgtctgtgaccagga

SEQ ID NO: 597055 - DNA, 25 bp, Homo sapien
aagcttggtcttgctgtacataaat

SEQ ID NO: 597056 - DNA, 25 bp, Homo sapien
cttgctgtacataaattttctcttc

SEQ ID NO: 597057 - DNA, 25 bp, Homo sapien
gtgtttctgggctacgtgaggcaaa

SEQ ID NO: 597058 - DNA, 25 bp, Homo sapien
gtttctgggctacgtgaggcaaaaa

SEQ ID NO: 597059 - DNA, 25 bp, Homo sapien
ctgggctacgtgaggcaaaaataaa

SEQ ID NO: 597060 - DNA, 25 bp, Homo sapien
cacagtgtttttccttggatcccat

SEQ ID NO: 597061 - DNA, 25 bp, Homo sapien
agtgtttttccttggatcccatgat

SEQ ID NO: 597062 - DNA, 25 bp, Homo sapien
gtttttccttggatcccatgatgcc

SEQ ID NO: 597063 - DNA, 25 bp, Homo sapien
ttggatcccatgatgcccagatgct

SEQ ID NO: 597064 - DNA, 25 bp, Homo sapien
atgatgcccagatgctctacttttt

SEQ ID NO: 597065 - DNA, 25 bp, Homo sapien
tgatgcccagatgctctactttttc

SEQ ID NO: 597066 - DNA, 25 bp, Homo sapien
tcagaaggtgtttttataacatgta

SEQ ID NO: 597067 - DNA, 25 bp, Homo sapien
ttttcgttgtaccaagtagaggaat

SEQ ID NO: 597068 - DNA, 25 bp, Homo sapien
agggccccgagccagggcaggccag

SEQ ID NO: 597069 - DNA, 25 bp, Homo sapien
gggccccgagccagggcaggccaga

SEQ ID NO: 597070 - DNA, 25 bp, Homo sapien
ggccccgagccagggcaggccagac

SEQ ID NO: 597071 - DNA, 25 bp, Homo sapien
ccgagccagggcaggccagactcca

SEQ ID NO: 597072 - DNA, 25 bp, Homo sapien
cgagccagggcaggccagactccag

SEQ ID NO: 597073 - DNA, 25 bp, Homo sapien
ccagggcaggccagactccaggatt

SEQ ID NO: 597074 - DNA, 25 bp, Homo sapien
cagggcaggccagactccaggattg

SEQ ID NO: 597075 - DNA, 25 bp, Homo sapien
agggcaggccagactccaggattgg

SEQ ID NO: 597076 - DNA, 25 bp, Homo sapien
gggcaggccagactccaggattggg

SEQ ID NO: 597077 - DNA, 25 bp, Homo sapien
ggcaggccagactccaggattggga

SEQ ID NO: 597078 - DNA, 25 bp, Homo sapien
gcaggccagactccaggattgggag

SEQ ID NO: 597079 - DNA, 25 bp, Homo sapien
aaggatattcctagctttcagatac

SEQ ID NO: 597080 - DNA, 25 bp, Homo sapien
ctagctttcagatacttacggttaa

SEQ ID NO: 597081 - DNA, 25 bp, Homo sapien
ttaatgtttactgaagagacccgag

SEQ ID NO: 597082 - DNA, 25 bp, Homo sapien
gagacccgagtgtccagatagctgg

SEQ ID NO: 597083 - DNA, 25 bp, Homo sapien
caaacccttgtaacagaacacctct

SEQ ID NO: 597084 - DNA, 25 bp, Homo sapien
tctccccatgtgtacaagcattgta

SEQ ID NO: 597085 - DNA, 25 bp, Homo sapien
tgtacctagggtggatacgttcctt

SEQ ID NO: 597086 - DNA, 25 bp, Homo sapien
gatacgttccttctcttagtttcag

SEQ ID NO: 597087 - DNA, 25 bp, Homo sapien
ttagtttcaggaacgcccttctctg

SEQ ID NO: 597088 - DNA, 25 bp, Homo sapien
tctctgtctgtggagtagctgttct

SEQ ID NO: 597089 - DNA, 25 bp, Homo sapien
ggagtagctgttctttcaccacttt

SEQ ID NO: 597090 - DNA, 25 bp, Homo sapien
tttcctagactcctttgcagccacg

SEQ ID NO: 597091 - DNA, 25 bp, Homo sapien
tagactcctttgcagccacgggtgg

SEQ ID NO: 597092 - DNA, 25 bp, Homo sapien
tcctttgcagccacgggtggccatg

SEQ ID NO: 597093 - DNA, 25 bp, Homo sapien
ccatgagagatggttctggccagtg

SEQ ID NO: 597094 - DNA, 25 bp, Homo sapien
agagatggttctggccagtgggaca

SEQ ID NO: 597095 - DNA, 25 bp, Homo sapien
ccagtgggacaggaatagaacgcca

SEQ ID NO: 597096 - DNA, 25 bp, Homo sapien
ggaatagaacgccagtggtcctgcc

SEQ ID NO: 597097 - DNA, 25 bp, Homo sapien
atagaacgccagtggtcctgcccct

SEQ ID NO: 597098 - DNA, 25 bp, Homo sapien
ttccccttcatccagtctggaatgt

SEQ ID NO: 597099 - DNA, 25 bp, Homo sapien
cccttcatccagtctggaatgtgga

SEQ ID NO: 597100 - DNA, 25 bp, Homo sapien
atccagtctggaatgtggagaggct

SEQ ID NO: 597101 - DNA, 25 bp, Homo sapien
tggatgagccctgcaagcagccctg

SEQ ID NO: 597102 - DNA, 25 bp, Homo sapien
tgtatggcaccctgccataccagct

SEQ ID NO: 597103 - DNA, 25 bp, Homo sapien
ctgccctgtgactgcttgtaaagct

SEQ ID NO: 597104 - DNA, 25 bp, Homo sapien
agagctacagtgtgaatgtggacga

SEQ ID NO: 597105 - DNA, 25 bp, Homo sapien
aagagatggtgatttgctctgaagc

SEQ ID NO: 597106 - DNA, 25 bp, Homo sapien
gctctgaagcatctagtacttatca

SEQ ID NO: 597107 - DNA, 25 bp, Homo sapien
agaatagctgcaatctccatggcct

SEQ ID NO: 597108 - DNA, 25 bp, Homo sapien
tgcaatctccatggcctctaagata

SEQ ID NO: 597109 - DNA, 25 bp, Homo sapien
aacagacatgcagcttggaggttca

SEQ ID NO: 597110 - DNA, 25 bp, Homo sapien
ggagatcagcaagttaattaccaaa

SEQ ID NO: 597111 - DNA, 25 bp, Homo sapien
aaaggaagttcatcaagccaggctg

SEQ ID NO: 597112 - DNA, 25 bp, Homo sapien
tgaaagccagtggtgcaaccccatc

SEQ ID NO: 597113 - DNA, 25 bp, Homo sapien
cacctctagcacctccagtgataag

SEQ ID NO: 597114 - DNA, 25 bp, Homo sapien
acctctagcacctccagtgataagc

SEQ ID NO: 597115 - DNA, 25 bp, Homo sapien
cctctagcacctccagtgataagca

SEQ ID NO: 597116 - DNA, 25 bp, Homo sapien
ctctagcacctccagtgataagcac

SEQ ID NO: 597117 - DNA, 25 bp, Homo sapien
tctagcacctccagtgataagcact

SEQ ID NO: 597118 - DNA, 25 bp, Homo sapien
tagcacctccagtgataagcactaa

SEQ ID NO: 597119 - DNA, 25 bp, Homo sapien
agcacctccagtgataagcactaat

SEQ ID NO: 597120 - DNA, 25 bp, Homo sapien
gcacctccagtgataagcactaatt

SEQ ID NO: 597121 - DNA, 25 bp, Homo sapien
acctccagtgataagcactaattgc

SEQ ID NO: 597122 - DNA, 25 bp, Homo sapien
attgcctatatacaacccttttttg

SEQ ID NO: 597123 - DNA, 25 bp, Homo sapien
gcggagaactccagaattcctatcc

SEQ ID NO: 597124 - DNA, 25 bp, Homo sapien
cagaattcctatcctgtcagcgaag

SEQ ID NO: 597125 - DNA, 25 bp, Homo sapien
ccatcctcagagatatgctccttga

SEQ ID NO: 597126 - DNA, 25 bp, Homo sapien
atatgctccttgagccacatttctg

SEQ ID NO: 597127 - DNA, 25 bp, Homo sapien
ttttgagagttcctcagtctctacc

SEQ ID NO: 597128 - DNA, 25 bp, Homo sapien
agtctctaccctagtgtcagtgata

SEQ ID NO: 597129 - DNA, 25 bp, Homo sapien
gtgatagtgttacccctatagcctc

SEQ ID NO: 597130 - DNA, 25 bp, Homo sapien
ggacctggcgttaggattatctcct

SEQ ID NO: 597131 - DNA, 25 bp, Homo sapien
gtcgatatctcagaagagtcctcaa

SEQ ID NO: 597132 - DNA, 25 bp, Homo sapien
gagtcctcaactaacttaatggttc

SEQ ID NO: 597133 - DNA, 25 bp, Homo sapien
ggttcaccaacaactaggacctggg

SEQ ID NO: 597134 - DNA, 25 bp, Homo sapien
ggaacctggcctcctgaagcttctc

SEQ ID NO: 597135 - DNA, 25 bp, Homo sapien
gaagcttctcttcatctgtctaaat

SEQ ID NO: 597136 - DNA, 25 bp, Homo sapien
cttctcttcatctgtctaaattcct

SEQ ID NO: 597137 - DNA, 25 bp, Homo sapien
aaggcccagtgcaagtgacaccttc

SEQ ID NO: 597138 - DNA, 25 bp, Homo sapien
gtgcaagtgacaccttcatcaggaa

SEQ ID NO: 597139 - DNA, 25 bp, Homo sapien
aggaagggcttccacatgattctat

SEQ ID NO: 597140 - DNA, 25 bp, Homo sapien
ggcttccacatgattctatctgcaa

SEQ ID NO: 597141 - DNA, 25 bp, Homo sapien
tgattctatctgcaaatctcccttt

SEQ ID NO: 597142 - DNA, 25 bp, Homo sapien
gcaaatctcccttttctgaactatt

SEQ ID NO: 597143 - DNA, 25 bp, Homo sapien
ttatgcttatagtctgtaccaggcc

SEQ ID NO: 597144 - DNA, 25 bp, Homo sapien
gtaccaggccacatgacatatgtta

SEQ ID NO: 597145 - DNA, 25 bp, Homo sapien
cttatgaatggctaagatgataaat

SEQ ID NO: 597146 - DNA, 25 bp, Homo sapien
tatgaatggctaagatgataaatat

SEQ ID NO: 597147 - DNA, 25 bp, Homo sapien
atgaatggctaagatgataaatatt

SEQ ID NO: 597148 - DNA, 25 bp, Homo sapien
tgaatggctaagatgataaatatta

SEQ ID NO: 597149 - DNA, 25 bp, Homo sapien
gaatggctaagatgataaatattat

SEQ ID NO: 597150 - DNA, 25 bp, Homo sapien
aatggctaagatgataaatattatg

SEQ ID NO: 597151 - DNA, 25 bp, Homo sapien
atggctaagatgataaatattatgt

SEQ ID NO: 597152 - DNA, 25 bp, Homo sapien
aaaagtaatgaattctggccaggta

SEQ ID NO: 597153 - DNA, 25 bp, Homo sapien
aaagtaatgaattctggccaggtac

SEQ ID NO: 597154 - DNA, 25 bp, Homo sapien
tcacatgaaaggaaactacaggcct

SEQ ID NO: 597155 - DNA, 25 bp, Homo sapien
cacatgaaaggaaactacaggcctg

SEQ ID NO: 597156 - DNA, 25 bp, Homo sapien
acatgaaaggaaactacaggcctgg

SEQ ID NO: 597157 - DNA, 25 bp, Homo sapien
catgaaaggaaactacaggcctggg

SEQ ID NO: 597158 - DNA, 25 bp, Homo sapien
atgaaaggaaactacaggcctgggc

SEQ ID NO: 597159 - DNA, 25 bp, Homo sapien
tgaaaggaaactacaggcctgggcg

SEQ ID NO: 597160 - DNA, 25 bp, Homo sapien
aaaggaaactacaggcctgggcgca

SEQ ID NO: 597161 - DNA, 25 bp, Homo sapien
aaggaaactacaggcctgggcgcag

SEQ ID NO: 597162 - DNA, 25 bp, Homo sapien
aggaaactacaggcctgggcgcagt

SEQ ID NO: 597163 - DNA, 25 bp, Homo sapien
ggaaactacaggcctgggcgcagtg

SEQ ID NO: 597164 - DNA, 25 bp, Homo sapien
aactacaggcctgggcgcagtggct

SEQ ID NO: 597165 - DNA, 25 bp, Homo sapien
ttctgggaacgctgcaagctcttcc

SEQ ID NO: 597166 - DNA, 25 bp, Homo sapien
ggaccatgccttcctgcggcacgtg

SEQ ID NO: 597167 - DNA, 25 bp, Homo sapien
tggtgcagatcctctgcctggcggt

SEQ ID NO: 597168 - DNA, 25 bp, Homo sapien
agatcctctgcctggcggtgctctg

SEQ ID NO: 597169 - DNA, 25 bp, Homo sapien
tggcggtgctctggatcctcaaatc

SEQ ID NO: 597170 - DNA, 25 bp, Homo sapien
tctggatcctcaaatccacggtggc

SEQ ID NO: 597171 - DNA, 25 bp, Homo sapien
tcaaatccacggtggctgccatcat

SEQ ID NO: 597172 - DNA, 25 bp, Homo sapien
gggcctcatcatcgttcgaaggctt

SEQ ID NO: 597173 - DNA, 25 bp, Homo sapien
tcatcatcgttcgaaggcttctgga

SEQ ID NO: 597174 - DNA, 25 bp, Homo sapien
gttcgaaggcttctggatttcatct

SEQ ID NO: 597175 - DNA, 25 bp, Homo sapien
agcacgacctggcctggattgacaa

SEQ ID NO: 597176 - DNA, 25 bp, Homo sapien
taggaactgcagtacatcatcaccc

SEQ ID NO: 597177 - DNA, 25 bp, Homo sapien
agtacatcatcaccccaggtgtaag

SEQ ID NO: 597178 - DNA, 25 bp, Homo sapien
tcaccccaggtgtaagagttatttc

SEQ ID NO: 597179 - DNA, 25 bp, Homo sapien
ggtgtaagagttatttctctcccag

SEQ ID NO: 597180 - DNA, 25 bp, Homo sapien
gagacatcacagaatcacccgggtt

SEQ ID NO: 597181 - DNA, 25 bp, Homo sapien
atcacagaatcacccgggttctgac

SEQ ID NO: 597182 - DNA, 25 bp, Homo sapien
gatatcttgatgcactgcctgtttg

SEQ ID NO: 597183 - DNA, 25 bp, Homo sapien
gatgcactgcctgtttgtaacaaca

SEQ ID NO: 597184 - DNA, 25 bp, Homo sapien
gtaacaacatatacttctttgctga

SEQ ID NO: 597185 - DNA, 25 bp, Homo sapien
atatacttctttgctgaatgctaat

SEQ ID NO: 597186 - DNA, 25 bp, Homo sapien
gaatgctaataaacttctgggttca

SEQ ID NO: 597187 - DNA, 25 bp, Homo sapien
tggtaacgctgctcgtgacaacaag

SEQ ID NO: 597188 - DNA, 25 bp, Homo sapien
aagaagacccgtatcatcccaagac

SEQ ID NO: 597189 - DNA, 25 bp, Homo sapien
gtatcatcccaagacacttgcaatt

SEQ ID NO: 597190 - DNA, 25 bp, Homo sapien
acaagttgttgggtcacgtcaccat

SEQ ID NO: 597191 - DNA, 25 bp, Homo sapien
acgtcaccatcgctcaaggtggtgt

SEQ ID NO: 597192 - DNA, 25 bp, Homo sapien
aggtggtgtcttgccaaacattcac

SEQ ID NO: 597193 - DNA, 25 bp, Homo sapien
aaacattcaccaaaacttgttgcca

SEQ ID NO: 597194 - DNA, 25 bp, Homo sapien
cttgttgccaaagaagtcctctaag

SEQ ID NO: 597195 - DNA, 25 bp, Homo sapien
agtcctctaaggctaaggcttccca

SEQ ID NO: 597196 - DNA, 25 bp, Homo sapien
aaggcttcccaagagttgtaaacag

SEQ ID NO: 597197 - DNA, 25 bp, Homo sapien
aacagtgggtgtttgacatttctat

SEQ ID NO: 597198 - DNA, 25 bp, Homo sapien
gggtcgggccgcgacgagggaagct

SEQ ID NO: 597199 - DNA, 25 bp, Homo sapien
gtcgggccgcgacgagggaagctcg

SEQ ID NO: 597200 - DNA, 25 bp, Homo sapien
gggccgcgacgagggaagctcgcct

SEQ ID NO: 597201 - DNA, 25 bp, Homo sapien
gcgacgagggaagctcgcctgggca

SEQ ID NO: 597202 - DNA, 25 bp, Homo sapien
cgacgagggaagctcgcctgggcaa

SEQ ID NO: 597203 - DNA, 25 bp, Homo sapien
acgagggaagctcgcctgggcaagt

SEQ ID NO: 597204 - DNA, 25 bp, Homo sapien
agggaagctcgcctgggcaagtgcc

SEQ ID NO: 597205 - DNA, 25 bp, Homo sapien
gggaagctcgcctgggcaagtgccg

SEQ ID NO: 597206 - DNA, 25 bp, Homo sapien
ggaagctcgcctgggcaagtgccgc

SEQ ID NO: 597207 - DNA, 25 bp, Homo sapien
gctcgcctgggcaagtgccgcgcgg

SEQ ID NO: 597208 - DNA, 25 bp, Homo sapien
aggggctggagctttccctctgatc

SEQ ID NO: 597209 - DNA, 25 bp, Homo sapien
ttttccactttgactacaaagatat

SEQ ID NO: 597210 - DNA, 25 bp, Homo sapien
gactacaaagatatttcagagagct

SEQ ID NO: 597211 - DNA, 25 bp, Homo sapien
gatatttcagagagcttcttactgg

SEQ ID NO: 597212 - DNA, 25 bp, Homo sapien
cagagagcttcttactggatttctt

SEQ ID NO: 597213 - DNA, 25 bp, Homo sapien
catggtgtccattttatttagcaag

SEQ ID NO: 597214 - DNA, 25 bp, Homo sapien
tttatttagcaaggtgtttctgggc

SEQ ID NO: 597215 - DNA, 25 bp, Homo sapien
atttagcaaggtgtttctgggctac

SEQ ID NO: 597216 - DNA, 25 bp, Homo sapien
gtgtttctgggctacgtgaggcaaa

SEQ ID NO: 597217 - DNA, 25 bp, Homo sapien
acagtgtttttccttggatcccatg

SEQ ID NO: 597218 - DNA, 25 bp, Homo sapien
atgatgcccagatgctctacttttt

SEQ ID NO: 597219 - DNA, 25 bp, Homo sapien
aaatacaccaactccatatttccgg

SEQ ID NO: 597220 - DNA, 25 bp, Homo sapien
aggttatgctcctttagatctgtaa

SEQ ID NO: 597221 - DNA, 25 bp, Homo sapien
tgctcctttagatctgtaaactcag

SEQ ID NO: 597222 - DNA, 25 bp, Homo sapien
tttagatctgtaaactcagtctcct

SEQ ID NO: 597223 - DNA, 25 bp, Homo sapien
tcatattttgtagaagcctgttctg

SEQ ID NO: 597224 - DNA, 25 bp, Homo sapien
tagaagcctgttctgtaagtctctc

SEQ ID NO: 597225 - DNA, 25 bp, Homo sapien
ttcgtacaacagacactccttgaca

SEQ ID NO: 597226 - DNA, 25 bp, Homo sapien
acaacagacactccttgacaccaag

SEQ ID NO: 597227 - DNA, 25 bp, Homo sapien
ttgacaccaaggatctttcacttaa

SEQ ID NO: 597228 - DNA, 25 bp, Homo sapien
ccaaggatctttcacttaatccctc

SEQ ID NO: 597229 - DNA, 25 bp, Homo sapien
gatctttcacttaatccctcaaaaa

SEQ ID NO: 597230 - DNA, 25 bp, Homo sapien
ttcacttaatccctcaaaaataaag

SEQ ID NO: 597231 - DNA, 25 bp, Homo sapien
agaccttagaagtgttctgaggccg

SEQ ID NO: 597232 - DNA, 25 bp, Homo sapien
gaccttagaagtgttctgaggccgg

SEQ ID NO: 597233 - DNA, 25 bp, Homo sapien
accttagaagtgttctgaggccggg

SEQ ID NO: 597234 - DNA, 25 bp, Homo sapien
ccttagaagtgttctgaggccgggc

SEQ ID NO: 597235 - DNA, 25 bp, Homo sapien
cttagaagtgttctgaggccgggcg

SEQ ID NO: 597236 - DNA, 25 bp, Homo sapien
ttagaagtgttctgaggccgggcgt

SEQ ID NO: 597237 - DNA, 25 bp, Homo sapien
tagaagtgttctgaggccgggcgtg

SEQ ID NO: 597238 - DNA, 25 bp, Homo sapien
agaagtgttctgaggccgggcgtgt

SEQ ID NO: 597239 - DNA, 25 bp, Homo sapien
gaagtgttctgaggccgggcgtgtg

SEQ ID NO: 597240 - DNA, 25 bp, Homo sapien
ggctccatcaatacctgttatggac

SEQ ID NO: 597241 - DNA, 25 bp, Homo sapien
aatacctgttatggactaaatggca

SEQ ID NO: 597242 - DNA, 25 bp, Homo sapien
atacctgttatggactaaatggcac

SEQ ID NO: 597243 - DNA, 25 bp, Homo sapien
tacctgttatggactaaatggcacg

SEQ ID NO: 597244 - DNA, 25 bp, Homo sapien
acctgttatggactaaatggcacgg

SEQ ID NO: 597245 - DNA, 25 bp, Homo sapien
cctgttatggactaaatggcacggt

SEQ ID NO: 597246 - DNA, 25 bp, Homo sapien
ctgttatggactaaatggcacggtg

SEQ ID NO: 597247 - DNA, 25 bp, Homo sapien
tgttatggactaaatggcacggtgg

SEQ ID NO: 597248 - DNA, 25 bp, Homo sapien
gttatggactaaatggcacggtggc

SEQ ID NO: 597249 - DNA, 25 bp, Homo sapien
ttatggactaaatggcacggtggct

SEQ ID NO: 597250 - DNA, 25 bp, Homo sapien
tatggactaaatggcacggtggctc

SEQ ID NO: 597251 - DNA, 25 bp, Homo sapien
ttttaaaaagatctctgccaggcgc

SEQ ID NO: 597252 - DNA, 25 bp, Homo sapien
tttaaaaagatctctgccaggcgcg

SEQ ID NO: 597253 - DNA, 25 bp, Homo sapien
ttaaaaagatctctgccaggcgcgg

SEQ ID NO: 597254 - DNA, 25 bp, Homo sapien
taaaaagatctctgccaggcgcggt

SEQ ID NO: 597255 - DNA, 25 bp, Homo sapien
aaaaagatctctgccaggcgcggtg

SEQ ID NO: 597256 - DNA, 25 bp, Homo sapien
aaaagatctctgccaggcgcggtga

SEQ ID NO: 597257 - DNA, 25 bp, Homo sapien
aaagatctctgccaggcgcggtgac

SEQ ID NO: 597258 - DNA, 25 bp, Homo sapien
aagatctctgccaggcgcggtgact

SEQ ID NO: 597259 - DNA, 25 bp, Homo sapien
agatctctgccaggcgcggtgactc

SEQ ID NO: 597260 - DNA, 25 bp, Homo sapien
gatctctgccaggcgcggtgactca

SEQ ID NO: 597261 - DNA, 25 bp, Homo sapien
ccgggccgcctggtggcgcatgcct

SEQ ID NO: 597262 - DNA, 25 bp, Homo sapien
ttttccactttgactacaaagatat

SEQ ID NO: 597263 - DNA, 25 bp, Homo sapien
tttccactttgactacaaagatatt

SEQ ID NO: 597264 - DNA, 25 bp, Homo sapien
ttccactttgactacaaagatattt

SEQ ID NO: 597265 - DNA, 25 bp, Homo sapien
ctttgactacaaagatatttcagag

SEQ ID NO: 597266 - DNA, 25 bp, Homo sapien
tttgactacaaagatatttcagaga

SEQ ID NO: 597267 - DNA, 25 bp, Homo sapien
tgactacaaagatatttcagagagc

SEQ ID NO: 597268 - DNA, 25 bp, Homo sapien
gactacaaagatatttcagagagct

SEQ ID NO: 597269 - DNA, 25 bp, Homo sapien
actacaaagatatttcagagagctt

SEQ ID NO: 597270 - DNA, 25 bp, Homo sapien
aagatatttcagagagcttcttact

SEQ ID NO: 597271 - DNA, 25 bp, Homo sapien
catggtgtccattttatttagcaag

SEQ ID NO: 597272 - DNA, 25 bp, Homo sapien
atggtgtccattttatttagcaagg

SEQ ID NO: 597273 - DNA, 25 bp, Homo sapien
gtaggaaaatatgatattctggccg

SEQ ID NO: 597274 - DNA, 25 bp, Homo sapien
taggaaaatatgatattctggccgg

SEQ ID NO: 597275 - DNA, 25 bp, Homo sapien
aggaaaatatgatattctggccggg

SEQ ID NO: 597276 - DNA, 25 bp, Homo sapien
ggaaaatatgatattctggccgggc

SEQ ID NO: 597277 - DNA, 25 bp, Homo sapien
gaaaatatgatattctggccgggcg

SEQ ID NO: 597278 - DNA, 25 bp, Homo sapien
aaatatgatattctggccgggcgcg

SEQ ID NO: 597279 - DNA, 25 bp, Homo sapien
aatatgatattctggccgggcgcgg

SEQ ID NO: 597280 - DNA, 25 bp, Homo sapien
atatgatattctggccgggcgcggt

SEQ ID NO: 597281 - DNA, 25 bp, Homo sapien
tatgatattctggccgggcgcggtg

SEQ ID NO: 597282 - DNA, 25 bp, Homo sapien
atgatattctggccgggcgcggtgg

SEQ ID NO: 597283 - DNA, 25 bp, Homo sapien
aggcacggtggcgggggcctgtagt

SEQ ID NO: 597284 - DNA, 25 bp, Homo sapien
aaaacagagccacaggaatgcgtgt

SEQ ID NO: 597285 - DNA, 25 bp, Homo sapien
tagactacaagggtgagcactgagc

SEQ ID NO: 597286 - DNA, 25 bp, Homo sapien
gactacaagggtgagcactgagcca

SEQ ID NO: 597287 - DNA, 25 bp, Homo sapien
actacaagggtgagcactgagccat

SEQ ID NO: 597288 - DNA, 25 bp, Homo sapien
tacaagggtgagcactgagccatgc

SEQ ID NO: 597289 - DNA, 25 bp, Homo sapien
acaagggtgagcactgagccatgct

SEQ ID NO: 597290 - DNA, 25 bp, Homo sapien
aagggtgagcactgagccatgctct

SEQ ID NO: 597291 - DNA, 25 bp, Homo sapien
agggtgagcactgagccatgctctc

SEQ ID NO: 597292 - DNA, 25 bp, Homo sapien
ggtgagcactgagccatgctctcgg

SEQ ID NO: 597293 - DNA, 25 bp, Homo sapien
tgagccatgctctcggggaaccttc

SEQ ID NO: 597294 - DNA, 25 bp, Homo sapien
gctctcggggaaccttcactggagt

SEQ ID NO: 597295 - DNA, 25 bp, Homo sapien
gatatgctcagcaggtatggtacct

SEQ ID NO: 597296 - DNA, 25 bp, Homo sapien
atgctcagcaggtatggtacctagc

SEQ ID NO: 597297 - DNA, 25 bp, Homo sapien
gcaggtatggtacctagcacccagg

SEQ ID NO: 597298 - DNA, 25 bp, Homo sapien
gagggacagccctcacaggccctta

SEQ ID NO: 597299 - DNA, 25 bp, Homo sapien
tcacaggcccttactgggatgcaga

SEQ ID NO: 597300 - DNA, 25 bp, Homo sapien
atgcagagaggagaagtgacttgat

SEQ ID NO: 597301 - DNA, 25 bp, Homo sapien
gacttgatggactattttacctgcc

SEQ ID NO: 597302 - DNA, 25 bp, Homo sapien
ttgatggactattttacctgcctct

SEQ ID NO: 597303 - DNA, 25 bp, Homo sapien
gatggactattttacctgcctctct

SEQ ID NO: 597304 - DNA, 25 bp, Homo sapien
tggactattttacctgcctctcttc

SEQ ID NO: 597305 - DNA, 25 bp, Homo sapien
tgcctctcttcctggatcgtctcca

SEQ ID NO: 597306 - DNA, 25 bp, Homo sapien
cccgaaaggatggagttccttctgt

SEQ ID NO: 597307 - DNA, 25 bp, Homo sapien
cttctgttgtgtcaatcgccttcat

SEQ ID NO: 597308 - DNA, 25 bp, Homo sapien
gtgtcaatcgccttcattttagtga

SEQ ID NO: 597309 - DNA, 25 bp, Homo sapien
agtgaagtttccactcgcctgtcat

SEQ ID NO: 597310 - DNA, 25 bp, Homo sapien
gcctgtcatgcatacaacttcggag

SEQ ID NO: 597311 - DNA, 25 bp, Homo sapien
acttcggaggaggagatgatcgttt

SEQ ID NO: 597312 - DNA, 25 bp, Homo sapien
agcgacttgccgatgccatcctgct

SEQ ID NO: 597313 - DNA, 25 bp, Homo sapien
ccggcagggacttcctaagcggcag

SEQ ID NO: 597314 - DNA, 25 bp, Homo sapien
tcctaagcggcagcttgtggcgcta

SEQ ID NO: 597315 - DNA, 25 bp, Homo sapien
aagagcgcgggctttcgagcacata

SEQ ID NO: 597316 - DNA, 25 bp, Homo sapien
gggctttcgagcacatacaaacctg

SEQ ID NO: 597317 - DNA, 25 bp, Homo sapien
cagcagcaagggaaagatccatgcc

SEQ ID NO: 597318 - DNA, 25 bp, Homo sapien
gcagcaagggaaagatccatgccca

SEQ ID NO: 597319 - DNA, 25 bp, Homo sapien
agcaagggaaagatccatgcccaat

SEQ ID NO: 597320 - DNA, 25 bp, Homo sapien
gcaagggaaagatccatgcccaatt

SEQ ID NO: 597321 - DNA, 25 bp, Homo sapien
caagggaaagatccatgcccaattt

SEQ ID NO: 597322 - DNA, 25 bp, Homo sapien
aagggaaagatccatgcccaatttt

SEQ ID NO: 597323 - DNA, 25 bp, Homo sapien
agggaaagatccatgcccaatttta

SEQ ID NO: 597324 - DNA, 25 bp, Homo sapien
gggaaagatccatgcccaattttat

SEQ ID NO: 597325 - DNA, 25 bp, Homo sapien
ggaaagatccatgcccaattttatc

SEQ ID NO: 597326 - DNA, 25 bp, Homo sapien
agatccatgcccaattttatcttcc

SEQ ID NO: 597327 - DNA, 25 bp, Homo sapien
gatccatgcccaattttatcttcct

SEQ ID NO: 597328 - DNA, 25 bp, Homo sapien
atggctcccccgaagatgggcctcg

SEQ ID NO: 597329 - DNA, 25 bp, Homo sapien
cgaagatgggcctcgagtggtcttc

SEQ ID NO: 597330 - DNA, 25 bp, Homo sapien
agatgggcctcgagtggtcttcatc

SEQ ID NO: 597331 - DNA, 25 bp, Homo sapien
atgggcctcgagtggtcttcatcgt

SEQ ID NO: 597332 - DNA, 25 bp, Homo sapien
gcctcgagtggtcttcatcgtggac

SEQ ID NO: 597333 - DNA, 25 bp, Homo sapien
tcatcgtggacctctggcaccccaa

SEQ ID NO: 597334 - DNA, 25 bp, Homo sapien
cctctggcaccccaacgtggcaggg

SEQ ID NO: 597335 - DNA, 25 bp, Homo sapien
gagcgccaggccctcgactttgtct

SEQ ID NO: 597336 - DNA, 25 bp, Homo sapien
ttgtcttcgccccagacccttgaag

SEQ ID NO: 597337 - DNA, 25 bp, Homo sapien
tcgccccagacccttgaaggaaggt

SEQ ID NO: 597338 - DNA, 25 bp, Homo sapien
ggctggagagacactgcgctcaggg

SEQ ID NO: 597339 - DNA, 25 bp, Homo sapien
gggtaagcaaatccttccctgatcc

SEQ ID NO: 597340 - DNA, 25 bp, Homo sapien
gtaagcaaatccttccctgatccct

SEQ ID NO: 597341 - DNA, 25 bp, Homo sapien
aagcaaatccttccctgatccctgg

SEQ ID NO: 597342 - DNA, 25 bp, Homo sapien
tgatccctggtctccttatctgtaa

SEQ ID NO: 597343 - DNA, 25 bp, Homo sapien
atccctggtctccttatctgtaaat

SEQ ID NO: 597344 - DNA, 25 bp, Homo sapien
ccctggtctccttatctgtaaatga

SEQ ID NO: 597345 - DNA, 25 bp, Homo sapien
cctggtctccttatctgtaaatgag

SEQ ID NO: 597346 - DNA, 25 bp, Homo sapien
taaatgagaataccagcacccacct

SEQ ID NO: 597347 - DNA, 25 bp, Homo sapien
aaatgagaataccagcacccacctc

SEQ ID NO: 597348 - DNA, 25 bp, Homo sapien
acctcactgtgctgtaaacatgatg

SEQ ID NO: 597349 - DNA, 25 bp, Homo sapien
tcactgtgctgtaaacatgatgagt

SEQ ID NO: 597350 - DNA, 25 bp, Homo sapien
gtgaaatgtccttttaaggaacatg

SEQ ID NO: 597351 - DNA, 25 bp, Homo sapien
acatttaaactgagagccaaatcaa

SEQ ID NO: 597352 - DNA, 25 bp, Homo sapien
atcaagaacgcaatctcacttacaa

SEQ ID NO: 597353 - DNA, 25 bp, Homo sapien
aatctcacttacaatagccacacac

SEQ ID NO: 597354 - DNA, 25 bp, Homo sapien
gaaaaactacagaacactgctgaga

SEQ ID NO: 597355 - DNA, 25 bp, Homo sapien
tgctgagagaaatcacagatgacac

SEQ ID NO: 597356 - DNA, 25 bp, Homo sapien
cattccatgctcatgaattggaata

SEQ ID NO: 597357 - DNA, 25 bp, Homo sapien
catgctcatgaattggaataatcag

SEQ ID NO: 597358 - DNA, 25 bp, Homo sapien
taatcagtattgttaaaatggccac

SEQ ID NO: 597359 - DNA, 25 bp, Homo sapien
agtattgttaaaatggccacactgc

SEQ ID NO: 597360 - DNA, 25 bp, Homo sapien
cacactgctcaaagcaacctacaga

SEQ ID NO: 597361 - DNA, 25 bp, Homo sapien
cttaaatttgtcaggtacctggagt

SEQ ID NO: 597362 - DNA, 25 bp, Homo sapien
ttgtcaggtacctggagtttaatac

SEQ ID NO: 597363 - DNA, 25 bp, Homo sapien
tacagtgagctctagcaagggaggc

SEQ ID NO: 597364 - DNA, 25 bp, Homo sapien
aagggaggcgctgccttttgtttct

SEQ ID NO: 597365 - DNA, 25 bp, Homo sapien
gtttctagaatattatgttcctcaa

SEQ ID NO: 597366 - DNA, 25 bp, Homo sapien
agaatattatgttcctcaaggtcca

SEQ ID NO: 597367 - DNA, 25 bp, Homo sapien
attatgttcctcaaggtccattatt

SEQ ID NO: 597368 - DNA, 25 bp, Homo sapien
gttcctcaaggtccattattttgta

SEQ ID NO: 597369 - DNA, 25 bp, Homo sapien
ctcaaggtccattattttgtattct

SEQ ID NO: 597370 - DNA, 25 bp, Homo sapien
ttttgtattcttttccaagctcctt

SEQ ID NO: 597371 - DNA, 25 bp, Homo sapien
gtattcttttccaagctccttattg

SEQ ID NO: 597372 - DNA, 25 bp, Homo sapien
cttatgaatggctaagatgataaat

SEQ ID NO: 597373 - DNA, 25 bp, Homo sapien
gaatggctaagatgataaatattat

SEQ ID NO: 597374 - DNA, 25 bp, Homo sapien
aaaagtaatgaattctggccaggta

SEQ ID NO: 597375 - DNA, 25 bp, Homo sapien
aaagtaatgaattctggccaggtac

SEQ ID NO: 597376 - DNA, 25 bp, Homo sapien
aagtaatgaattctggccaggtaca

SEQ ID NO: 597377 - DNA, 25 bp, Homo sapien
agtaatgaattctggccaggtacag

SEQ ID NO: 597378 - DNA, 25 bp, Homo sapien
gtaatgaattctggccaggtacagt

SEQ ID NO: 597379 - DNA, 25 bp, Homo sapien
taatgaattctggccaggtacagtg

SEQ ID NO: 597380 - DNA, 25 bp, Homo sapien
aatgaattctggccaggtacagtgg

SEQ ID NO: 597381 - DNA, 25 bp, Homo sapien
catacctgtagtctctgctatttgg

SEQ ID NO: 597382 - DNA, 25 bp, Homo sapien
atacctgtagtctctgctatttggg

SEQ ID NO: 597383 - DNA, 25 bp, Homo sapien
gaggacctcggcctccagtgtcccc

SEQ ID NO: 597384 - DNA, 25 bp, Homo sapien
cctcggcctccagtgtccccctcca

SEQ ID NO: 597385 - DNA, 25 bp, Homo sapien
ctcggcctccagtgtccccctccac

SEQ ID NO: 597386 - DNA, 25 bp, Homo sapien
tcggcctccagtgtccccctccact

SEQ ID NO: 597387 - DNA, 25 bp, Homo sapien
cctccagtgtccccctccactcttt

SEQ ID NO: 597388 - DNA, 25 bp, Homo sapien
ctccagtgtccccctccactctttc

SEQ ID NO: 597389 - DNA, 25 bp, Homo sapien
tccagtgtccccctccactctttcc

SEQ ID NO: 597390 - DNA, 25 bp, Homo sapien
cagtgtccccctccactctttccca

SEQ ID NO: 597391 - DNA, 25 bp, Homo sapien
agtgtccccctccactctttcccag

SEQ ID NO: 597392 - DNA, 25 bp, Homo sapien
gtgtccccctccactctttcccagc

SEQ ID NO: 597393 - DNA, 25 bp, Homo sapien
tgtccccctccactctttcccagcc

SEQ ID NO: 597394 - DNA, 25 bp, Homo sapien
atatatcactccttgatgcacacaa

SEQ ID NO: 597395 - DNA, 25 bp, Homo sapien
gatgcacacaattgtgccacagcac

SEQ ID NO: 597396 - DNA, 25 bp, Homo sapien
tgccacagcacacaaacttgtccta

SEQ ID NO: 597397 - DNA, 25 bp, Homo sapien
cacacaaacttgtcctacagtgcac

SEQ ID NO: 597398 - DNA, 25 bp, Homo sapien
acagacactctgcagagcacgtaga

SEQ ID NO: 597399 - DNA, 25 bp, Homo sapien
agcacgtagagtcaccccgcaaagc

SEQ ID NO: 597400 - DNA, 25 bp, Homo sapien
gcaaagcacagactaaacccatact

SEQ ID NO: 597401 - DNA, 25 bp, Homo sapien
taaacccatactacagagactctcc

SEQ ID NO: 597402 - DNA, 25 bp, Homo sapien
actctccctatagctttcagacaag

SEQ ID NO: 597403 - DNA, 25 bp, Homo sapien
acagagacatgcaacggtacatctt

SEQ ID NO: 597404 - DNA, 25 bp, Homo sapien
ggtacatcttacaacatatatcact

SEQ ID NO: 597405 - DNA, 25 bp, Homo sapien
tatttaatgttactgttctggttgt

SEQ ID NO: 597406 - DNA, 25 bp, Homo sapien
gtacattttcgtacattgtatcacg

SEQ ID NO: 597407 - DNA, 25 bp, Homo sapien
gtacattgtatcacgtgaataggcc

SEQ ID NO: 597408 - DNA, 25 bp, Homo sapien
acgtgaataggccagattcctcttt

SEQ ID NO: 597409 - DNA, 25 bp, Homo sapien
gaataggccagattcctctttccta

SEQ ID NO: 597410 - DNA, 25 bp, Homo sapien
taggccagattcctctttcctattc

SEQ ID NO: 597411 - DNA, 25 bp, Homo sapien
tttctttggtgtattcacaagctta

SEQ ID NO: 597412 - DNA, 25 bp, Homo sapien
gtgtattcacaagcttatacttcca

SEQ ID NO: 597413 - DNA, 25 bp, Homo sapien
acaagcttatacttccatatattaa

SEQ ID NO: 597414 - DNA, 25 bp, Homo sapien
acatttatcttacctctgtaaagac

SEQ ID NO: 597415 - DNA, 25 bp, Homo sapien
ttatcttacctctgtaaagacaaaa

SEQ ID NO: 597416 - DNA, 25 bp, Homo sapien
tgagcaatggaacgcgtttccccct

SEQ ID NO: 597417 - DNA, 25 bp, Homo sapien
gcgtttccccctctcattattattt

SEQ ID NO: 597418 - DNA, 25 bp, Homo sapien
taaaaacagacacccagctgccgag

SEQ ID NO: 597419 - DNA, 25 bp, Homo sapien
agctgccgaggcaaaaaggagccag

SEQ ID NO: 597420 - DNA, 25 bp, Homo sapien
aggcaaaaaggagccaggcgctccc

SEQ ID NO: 597421 - DNA, 25 bp, Homo sapien
cagtctccgcgttttgcgattttaa

SEQ ID NO: 597422 - DNA, 25 bp, Homo sapien
gcgttttgcgattttaattttggcg

SEQ ID NO: 597423 - DNA, 25 bp, Homo sapien
ttgcgattttaattttggcgggagg

SEQ ID NO: 597424 - DNA, 25 bp, Homo sapien
aggaaagagagaggccaagacaatt

SEQ ID NO: 597425 - DNA, 25 bp, Homo sapien
agagaggccaagacaatttgtaact

SEQ ID NO: 597426 - DNA, 25 bp, Homo sapien
gacaatttgtaactagaatccgttt

SEQ ID NO: 597427 - DNA, 25 bp, Homo sapien
tgatgacctgtacgctgtgccacac

SEQ ID NO: 597428 - DNA, 25 bp, Homo sapien
tgacctgtacgctgtgccacacaga

SEQ ID NO: 597429 - DNA, 25 bp, Homo sapien
gtacgctgtgccacacagaaatcag

SEQ ID NO: 597430 - DNA, 25 bp, Homo sapien
gtgccacacagaaatcaggtgccat

SEQ ID NO: 597431 - DNA, 25 bp, Homo sapien
cagaaatcaggtgccattgttacat

SEQ ID NO: 597432 - DNA, 25 bp, Homo sapien
gaaaatatttctcatcaagatgggt

SEQ ID NO: 597433 - DNA, 25 bp, Homo sapien
tttctcatcaagatgggtttccagg

SEQ ID NO: 597434 - DNA, 25 bp, Homo sapien
aagatggtaaacaccctgttctgaa

SEQ ID NO: 597435 - DNA, 25 bp, Homo sapien
tggtaaacaccctgttctgaattta

SEQ ID NO: 597436 - DNA, 25 bp, Homo sapien
taaacaccctgttctgaatttaaag

SEQ ID NO: 597437 - DNA, 25 bp, Homo sapien
cattatgtgagaaacctccaccctc

SEQ ID NO: 597438 - DNA, 25 bp, Homo sapien
gccattttacctgtgatactgactt

SEQ ID NO: 597439 - DNA, 25 bp, Homo sapien
tgtgatactgactttcctgccaccc

SEQ ID NO: 597440 - DNA, 25 bp, Homo sapien
gactttcctgccaccctctaagaaa

SEQ ID NO: 597441 - DNA, 25 bp, Homo sapien
gaagaaaaatcctgagaaccgggag

SEQ ID NO: 597442 - DNA, 25 bp, Homo sapien
cctgagaaccgggaggaaattgagt

SEQ ID NO: 597443 - DNA, 25 bp, Homo sapien
gtagatatcgatagtacccgtgtgg

SEQ ID NO: 597444 - DNA, 25 bp, Homo sapien
gatagtacccgtgtggttgaccaaa

SEQ ID NO: 597445 - DNA, 25 bp, Homo sapien
gtctgcttggcatattttcacctta

SEQ ID NO: 597446 - DNA, 25 bp, Homo sapien
cttggcatattttcaccttaggtct

SEQ ID NO: 597447 - DNA, 25 bp, Homo sapien
attttcaccttaggtcttatcaaga

SEQ ID NO: 597448 - DNA, 25 bp, Homo sapien
ttaaagataggaaacaggcattgcc

SEQ ID NO: 597449 - DNA, 25 bp, Homo sapien
agttcatatatagaatttacgggag

SEQ ID NO: 597450 - DNA, 25 bp, Homo sapien
atttacgggagaaacttgagaccat

SEQ ID NO: 597451 - DNA, 25 bp, Homo sapien
ttacgggagaaacttgagaccattt

SEQ ID NO: 597452 - DNA, 25 bp, Homo sapien
tacgggagaaacttgagaccattta

SEQ ID NO: 597453 - DNA, 25 bp, Homo sapien
cgggagaaacttgagaccatttacg

SEQ ID NO: 597454 - DNA, 25 bp, Homo sapien
ggagaaacttgagaccatttacggg

SEQ ID NO: 597455 - DNA, 25 bp, Homo sapien
gaaacttgagaccatttacggggag

SEQ ID NO: 597456 - DNA, 25 bp, Homo sapien
ggaagatagcagagtacaaaccagc

SEQ ID NO: 597457 - DNA, 25 bp, Homo sapien
atagcagagtacaaaccagctgcct

SEQ ID NO: 597458 - DNA, 25 bp, Homo sapien
agcagagtacaaaccagctgcctca

SEQ ID NO: 597459 - DNA, 25 bp, Homo sapien
agagtacaaaccagctgcctcactt

SEQ ID NO: 597460 - DNA, 25 bp, Homo sapien
gcctgtaactggagaaatgcttgct

SEQ ID NO: 597461 - DNA, 25 bp, Homo sapien
gaaagaggctgagattccagtctca

SEQ ID NO: 597462 - DNA, 25 bp, Homo sapien
gagattccagtctcagctgtgtgac

SEQ ID NO: 597463 - DNA, 25 bp, Homo sapien
tctcagctgtgtgaccgtgggtaga

SEQ ID NO: 597464 - DNA, 25 bp, Homo sapien
cgtgggtagatcacctaacctctct

SEQ ID NO: 597465 - DNA, 25 bp, Homo sapien
atatttcccatctgccaactgcaga

SEQ ID NO: 597466 - DNA, 25 bp, Homo sapien
tctgctcacctcacgggattgtggt

SEQ ID NO: 597467 - DNA, 25 bp, Homo sapien
tggatgggaaaagcctctgtgaacg

SEQ ID NO: 597468 - DNA, 25 bp, Homo sapien
tctgtgaacggctttccaaatgtgg

SEQ ID NO: 597469 - DNA, 25 bp, Homo sapien
gtgatgagcatgttagcactgacat

SEQ ID NO: 597470 - DNA, 25 bp, Homo sapien
tagcactgacatgccagtttgccag

SEQ ID NO: 597471 - DNA, 25 bp, Homo sapien
tctctttcacaagtctatgtctata

SEQ ID NO: 597472 - DNA, 25 bp, Homo sapien
atttgcttgggaagtttcactacat

SEQ ID NO: 597473 - DNA, 25 bp, Homo sapien
catttaattccaaaactaccacatt

SEQ ID NO: 597474 - DNA, 25 bp, Homo sapien
gattattacataagtttccttgatg

SEQ ID NO: 597475 - DNA, 25 bp, Homo sapien
tttccttgatgattacagaagaact

SEQ ID NO: 597476 - DNA, 25 bp, Homo sapien
actattgggaggtcagtgttagcac

SEQ ID NO: 597477 - DNA, 25 bp, Homo sapien
ggtcagtgttagcacatcaaaatat

SEQ ID NO: 597478 - DNA, 25 bp, Homo sapien
atcaaaatatagtctggcatggcat

SEQ ID NO: 597479 - DNA, 25 bp, Homo sapien
agtctggcatggcattttaaattga

SEQ ID NO: 597480 - DNA, 25 bp, Homo sapien
cattttaaattgacccaggtatcta

SEQ ID NO: 597481 - DNA, 25 bp, Homo sapien
ggtatctaatattaaagcctttcaa

SEQ ID NO: 597482 - DNA, 25 bp, Homo sapien
gggaaggatgaacaatcccctttct

SEQ ID NO: 597483 - DNA, 25 bp, Homo sapien
ggaaggatgaacaatcccctttctc

SEQ ID NO: 597484 - DNA, 25 bp, Homo sapien
gaaggatgaacaatcccctttctcc

SEQ ID NO: 597485 - DNA, 25 bp, Homo sapien
aggatgaacaatcccctttctccct

SEQ ID NO: 597486 - DNA, 25 bp, Homo sapien
atgaacaatcccctttctcccttct

SEQ ID NO: 597487 - DNA, 25 bp, Homo sapien
tcccactccatctgtcctgtgggtc

SEQ ID NO: 597488 - DNA, 25 bp, Homo sapien
agggcacctaagtccatcttatggg

SEQ ID NO: 597489 - DNA, 25 bp, Homo sapien
ggcacctaagtccatcttatgggga

SEQ ID NO: 597490 - DNA, 25 bp, Homo sapien
ccatcttatggggagctgagcaaac

SEQ ID NO: 597491 - DNA, 25 bp, Homo sapien
aacacaattccacacagccaaggcc

SEQ ID NO: 597492 - DNA, 25 bp, Homo sapien
tcagcctcacccgaccaggcagaga

SEQ ID NO: 597493 - DNA, 25 bp, Homo sapien
aaagacaagaacgagagaggctgga

SEQ ID NO: 597494 - DNA, 25 bp, Homo sapien
aaagggagcgacaagagcagttaga

SEQ ID NO: 597495 - DNA, 25 bp, Homo sapien
gagcgcagaatatcaagtgctggta

SEQ ID NO: 597496 - DNA, 25 bp, Homo sapien
tcaagtgctggtaagaagtttacaa

SEQ ID NO: 597497 - DNA, 25 bp, Homo sapien
gtttacaaactcttctgtgttcttg

SEQ ID NO: 597498 - DNA, 25 bp, Homo sapien
aactcttctgtgttcttgtatctga

SEQ ID NO: 597499 - DNA, 25 bp, Homo sapien
ctgtgttcttgtatctgagcttgga

SEQ ID NO: 597500 - DNA, 25 bp, Homo sapien
agcttggatgatgtctcttgtgcag

SEQ ID NO: 597501 - DNA, 25 bp, Homo sapien
tggatgatgtctcttgtgcagtcat

SEQ ID NO: 597502 - DNA, 25 bp, Homo sapien
catttgagatgtttgggattaagcc

SEQ ID NO: 597503 - DNA, 25 bp, Homo sapien
gtttgggattaagccatacaatttg

SEQ ID NO: 597504 - DNA, 25 bp, Homo sapien
ccacaggaatgcgtgttgagggctt

SEQ ID NO: 597505 - DNA, 25 bp, Homo sapien
tgtacagtggagagtgccctccctg

SEQ ID NO: 597506 - DNA, 25 bp, Homo sapien
tggccagggagttggacattcatcc

SEQ ID NO: 597507 - DNA, 25 bp, Homo sapien
gccagggagttggacattcatccca

SEQ ID NO: 597508 - DNA, 25 bp, Homo sapien
atcccaccacaagaccccatgaaga

SEQ ID NO: 597509 - DNA, 25 bp, Homo sapien
agaccccatgaagagttcctcaaca

SEQ ID NO: 597510 - DNA, 25 bp, Homo sapien
gaagagttcctcaacagctctgtgt

SEQ ID NO: 597511 - DNA, 25 bp, Homo sapien
gagttcctcaacagctctgtgtcct

SEQ ID NO: 597512 - DNA, 25 bp, Homo sapien
gtgtcctcatcaaacctgtgtttgc

SEQ ID NO: 597513 - DNA, 25 bp, Homo sapien
aggccctggcctagactacaagggt

SEQ ID NO: 597514 - DNA, 25 bp, Homo sapien
tacaagggtgagcactgagccatgc

SEQ ID NO: 597515 - DNA, 25 bp, Homo sapien
gtgcccagtgaatatgagcttctct

SEQ ID NO: 597516 - DNA, 25 bp, Homo sapien
tatgagcttctctgaactgactgaa

SEQ ID NO: 597517 - DNA, 25 bp, Homo sapien
aaactggaaactcgcagccttcata

SEQ ID NO: 597518 - DNA, 25 bp, Homo sapien
aaggcatctggtatggaagcgttca

SEQ ID NO: 597519 - DNA, 25 bp, Homo sapien
tgcgggcttctctggctgatacact

SEQ ID NO: 597520 - DNA, 25 bp, Homo sapien
tgatacactcgccatggaccttgct

SEQ ID NO: 597521 - DNA, 25 bp, Homo sapien
catggaccttgctatccctgagctg

SEQ ID NO: 597522 - DNA, 25 bp, Homo sapien
gagctgggaccctaatggatgtgca

SEQ ID NO: 597523 - DNA, 25 bp, Homo sapien
gatgtgcatgagtttgtctccaact

SEQ ID NO: 597524 - DNA, 25 bp, Homo sapien
tatttacaatgcatacacctgacaa

SEQ ID NO: 597525 - DNA, 25 bp, Homo sapien
gacaaaggtttcacatccagaatat

SEQ ID NO: 597526 - DNA, 25 bp, Homo sapien
agctcctaagggtactcatgcccag

SEQ ID NO: 597527 - DNA, 25 bp, Homo sapien
tcctaagggtactcatgcccagtgg

SEQ ID NO: 597528 - DNA, 25 bp, Homo sapien
gggaaaggcgaatccactcatacat

SEQ ID NO: 597529 - DNA, 25 bp, Homo sapien
aggcgaatccactcatacatcttgg

SEQ ID NO: 597530 - DNA, 25 bp, Homo sapien
gaatccactcatacatcttggagtt

SEQ ID NO: 597531 - DNA, 25 bp, Homo sapien
catacatcttggagttgttttttca

SEQ ID NO: 597532 - DNA, 25 bp, Homo sapien
ttcagaaaatgaaccttcaccaagg

SEQ ID NO: 597533 - DNA, 25 bp, Homo sapien
atgaaccttcaccaaggtcttggaa

SEQ ID NO: 597534 - DNA, 25 bp, Homo sapien
ccaaggtcttggaacatgaagcaga

SEQ ID NO: 597535 - DNA, 25 bp, Homo sapien
aagcagagactctggtgctgactct

SEQ ID NO: 597536 - DNA, 25 bp, Homo sapien
gactctggtgctgactctatcattt

SEQ ID NO: 597537 - DNA, 25 bp, Homo sapien
gggaaggatgaacaatcccctttct

SEQ ID NO: 597538 - DNA, 25 bp, Homo sapien
aggatgaacaatcccctttctccct

SEQ ID NO: 597539 - DNA, 25 bp, Homo sapien
gggcgagatgacaccacacaggtct

SEQ ID NO: 597540 - DNA, 25 bp, Homo sapien
tcagggcccattcaagacctggtct

SEQ ID NO: 597541 - DNA, 25 bp, Homo sapien
tggtctttgaccattctccaagcca

SEQ ID NO: 597542 - DNA, 25 bp, Homo sapien
agggcacctaagtccatcttatggg

SEQ ID NO: 597543 - DNA, 25 bp, Homo sapien
ccatcttatggggagctgagcaaac

SEQ ID NO: 597544 - DNA, 25 bp, Homo sapien
agaggaacacaattccacacagcca

SEQ ID NO: 597545 - DNA, 25 bp, Homo sapien
attccacacagccaaggcctagaga

SEQ ID NO: 597546 - DNA, 25 bp, Homo sapien
gcctagagagctgctgacctggtca

SEQ ID NO: 597547 - DNA, 25 bp, Homo sapien
tcagcctcacccgaccaggcagaga

SEQ ID NO: 597548 - DNA, 25 bp, Homo sapien
atcgtgggcgcgctctgctacgcgg

SEQ ID NO: 597549 - DNA, 25 bp, Homo sapien
tgggcgcgctctgctacgcggagct

SEQ ID NO: 597550 - DNA, 25 bp, Homo sapien
accatctccaaatcgggcggcgact

SEQ ID NO: 597551 - DNA, 25 bp, Homo sapien
aaatcgggcggcgactacgcctaca

SEQ ID NO: 597552 - DNA, 25 bp, Homo sapien
atcgggcggcgactacgcctacatg

SEQ ID NO: 597553 - DNA, 25 bp, Homo sapien
cgggcggcgactacgcctacatgct

SEQ ID NO: 597554 - DNA, 25 bp, Homo sapien
ggcggcgactacgcctacatgctgg

SEQ ID NO: 597555 - DNA, 25 bp, Homo sapien
cttcctcaagctctggatcgagctg

SEQ ID NO: 597556 - DNA, 25 bp, Homo sapien
tcctcaagctctggatcgagctgct

SEQ ID NO: 597557 - DNA, 25 bp, Homo sapien
tcatccggccttcatcgcagtacat

SEQ ID NO: 597558 - DNA, 25 bp, Homo sapien
tggtcttcgccacctacctgctcaa

SEQ ID NO: 597559 - DNA, 25 bp, Homo sapien
atgctgaacttctggttgccctcct

SEQ ID NO: 597560 - DNA, 25 bp, Homo sapien
tgcgggtgtctgagcctacacaata

SEQ ID NO: 597561 - DNA, 25 bp, Homo sapien
ctacacaatagtctccttaccagaa

SEQ ID NO: 597562 - DNA, 25 bp, Homo sapien
ttaccagaagtatcctcacatccat

SEQ ID NO: 597563 - DNA, 25 bp, Homo sapien
ctcacatccatcactgacagtcaag

SEQ ID NO: 597564 - DNA, 25 bp, Homo sapien
ctgacagtcaagagccctacacttt

SEQ ID NO: 597565 - DNA, 25 bp, Homo sapien
agatttccatcacatctttgtgctc

SEQ ID NO: 597566 - DNA, 25 bp, Homo sapien
gtgctcacccaatgtgatccattta

SEQ ID NO: 597567 - DNA, 25 bp, Homo sapien
tatttgttggttacccaccatgtgc

SEQ ID NO: 597568 - DNA, 25 bp, Homo sapien
aagcacctcccagatactgggtata

SEQ ID NO: 597569 - DNA, 25 bp, Homo sapien
cagccctttttctgtgagcactaag

SEQ ID NO: 597570 - DNA, 25 bp, Homo sapien
aggactacagaggacaaggatcact

SEQ ID NO: 597571 - DNA, 25 bp, Homo sapien
tacagaggacaaggatcactgagga

SEQ ID NO: 597572 - DNA, 25 bp, Homo sapien
gaaggacagataagaatgcccaagt

SEQ ID NO: 597573 - DNA, 25 bp, Homo sapien
gacagataagaatgcccaagttcaa

SEQ ID NO: 597574 - DNA, 25 bp, Homo sapien
gaatgcccaagttcaagataccctc

SEQ ID NO: 597575 - DNA, 25 bp, Homo sapien
atgcccaagttcaagataccctcct

SEQ ID NO: 597576 - DNA, 25 bp, Homo sapien
caagttcaagataccctccttagga

SEQ ID NO: 597577 - DNA, 25 bp, Homo sapien
gttcaagataccctccttaggatgg

SEQ ID NO: 597578 - DNA, 25 bp, Homo sapien
aagataccctccttaggatggtcgc

SEQ ID NO: 597579 - DNA, 25 bp, Homo sapien
ataccctccttaggatggtcgccaa

SEQ ID NO: 597580 - DNA, 25 bp, Homo sapien
ccctccttaggatggtcgccaagca

SEQ ID NO: 597581 - DNA, 25 bp, Homo sapien
gcttcatcgggcctgtgagtatgtc

SEQ ID NO: 597582 - DNA, 25 bp, Homo sapien
ttcatcgggcctgtgagtatgtcct

SEQ ID NO: 597583 - DNA, 25 bp, Homo sapien
tcatcgggcctgtgagtatgtcctc

SEQ ID NO: 597584 - DNA, 25 bp, Homo sapien
atcgggcctgtgagtatgtcctcct

SEQ ID NO: 597585 - DNA, 25 bp, Homo sapien
gggcctgtgagtatgtcctcctgta

SEQ ID NO: 597586 - DNA, 25 bp, Homo sapien
ggcctgtgagtatgtcctcctgtac

SEQ ID NO: 597587 - DNA, 25 bp, Homo sapien
ctgtgagtatgtcctcctgtaccag

SEQ ID NO: 597588 - DNA, 25 bp, Homo sapien
tgtgagtatgtcctcctgtaccagc

SEQ ID NO: 597589 - DNA, 25 bp, Homo sapien
tcctgtaccagcactggcagtcaga

SEQ ID NO: 597590 - DNA, 25 bp, Homo sapien
ctgtaccagcactggcagtcagaga

SEQ ID NO: 597591 - DNA, 25 bp, Homo sapien
tgtaccagcactggcagtcagagaa

SEQ ID NO: 597592 - DNA, 25 bp, Homo sapien
gtcaatacattgcaggaggagaaat

SEQ ID NO: 597593 - DNA, 25 bp, Homo sapien
gaaatcagaactggctgcagaggaa

SEQ ID NO: 597594 - DNA, 25 bp, Homo sapien
tacagttaagagtgaacaattcagt

SEQ ID NO: 597595 - DNA, 25 bp, Homo sapien
gtactgaatgagcaaattgcagcaa

SEQ ID NO: 597596 - DNA, 25 bp, Homo sapien
ggaagaatcggagcctacttgtgag

SEQ ID NO: 597597 - DNA, 25 bp, Homo sapien
gagaggaggaaatgccagttgaaaa

SEQ ID NO: 597598 - DNA, 25 bp, Homo sapien
tgagaactatgatcccaagaccgag

SEQ ID NO: 597599 - DNA, 25 bp, Homo sapien
gatcccaagaccgaggatggccagg

SEQ ID NO: 597600 - DNA, 25 bp, Homo sapien
gatggccaggcaagccagagtcgat

SEQ ID NO: 597601 - DNA, 25 bp, Homo sapien
aggcaagccagagtcgatacagcaa

SEQ ID NO: 597602 - DNA, 25 bp, Homo sapien
agtcgatacagcaagcggaggattt

SEQ ID NO: 597603 - DNA, 25 bp, Homo sapien
ggttgcaaaccgcaagcgaaagtcg

SEQ ID NO: 597604 - DNA, 25 bp, Homo sapien
aaaccgcaagcgaaagtcgagaggg

SEQ ID NO: 597605 - DNA, 25 bp, Homo sapien
tacactgtgaaaaccgcaggcctgt

SEQ ID NO: 597606 - DNA, 25 bp, Homo sapien
tgtgaaaaccgcaggcctgtcgcct

SEQ ID NO: 597607 - DNA, 25 bp, Homo sapien
aaaccgcaggcctgtcgcctaggcg

SEQ ID NO: 597608 - DNA, 25 bp, Homo sapien
gcctaggcggccacttttaaattgg

SEQ ID NO: 597609 - DNA, 25 bp, Homo sapien
gcggccacttttaaattgggaagca

SEQ ID NO: 597610 - DNA, 25 bp, Homo sapien
caaaacaaacgtacgagctgacttt

SEQ ID NO: 597611 - DNA, 25 bp, Homo sapien
ttcccagctaagtttcccctcaata

SEQ ID NO: 597612 - DNA, 25 bp, Homo sapien
cctcaataaaaagcccgctttctgg

SEQ ID NO: 597613 - DNA, 25 bp, Homo sapien
aaagcccgctttctgggaaagacag

SEQ ID NO: 597614 - DNA, 25 bp, Homo sapien
tattaaaaagcttcagaccaggcac

SEQ ID NO: 597615 - DNA, 25 bp, Homo sapien
aaaaagcttcagaccaggcactgtg

SEQ ID NO: 597616 - DNA, 25 bp, Homo sapien
aaagcttcagaccaggcactgtgac

SEQ ID NO: 597617 - DNA, 25 bp, Homo sapien
agcttcagaccaggcactgtgactt

SEQ ID NO: 597618 - DNA, 25 bp, Homo sapien
cttcagaccaggcactgtgacttat

SEQ ID NO: 597619 - DNA, 25 bp, Homo sapien
tcagaccaggcactgtgacttatgc

SEQ ID NO: 597620 - DNA, 25 bp, Homo sapien
aatctgctttaggaggctcaggcag

SEQ ID NO: 597621 - DNA, 25 bp, Homo sapien
gggagatcccttctctagaaaaaat

SEQ ID NO: 597622 - DNA, 25 bp, Homo sapien
ggagatcccttctctagaaaaaata

SEQ ID NO: 597623 - DNA, 25 bp, Homo sapien
gttgaagctgcggtgggccatgttt

SEQ ID NO: 597624 - DNA, 25 bp, Homo sapien
ctgcggtgggccatgtttgcagcat

SEQ ID NO: 597625 - DNA, 25 bp, Homo sapien
acacttcttcttagtctcatcttca

SEQ ID NO: 597626 - DNA, 25 bp, Homo sapien
ttcttcttagtctcatcttcagctt

SEQ ID NO: 597627 - DNA, 25 bp, Homo sapien
ttagtctcatcttcagcttcccata

SEQ ID NO: 597628 - DNA, 25 bp, Homo sapien
tcttcagcttcccatacgaggccat

SEQ ID NO: 597629 - DNA, 25 bp, Homo sapien
ccatacgaggccatcctcatgaaat

SEQ ID NO: 597630 - DNA, 25 bp, Homo sapien
acgaggccatcctcatgaaatcagg

SEQ ID NO: 597631 - DNA, 25 bp, Homo sapien
ggactgacaagtgccagctgtccct

SEQ ID NO: 597632 - DNA, 25 bp, Homo sapien
aagtgccagctgtcccttgctgtct

SEQ ID NO: 597633 - DNA, 25 bp, Homo sapien
acagtggccaaacctgaaactgagg

SEQ ID NO: 597634 - DNA, 25 bp, Homo sapien
gtggccaaacctgaaactgaggccc

SEQ ID NO: 597635 - DNA, 25 bp, Homo sapien
aggcccagctctggttgggaaagaa

SEQ ID NO: 597636 - DNA, 25 bp, Homo sapien
cgctctgttcaggttttcaagggta

SEQ ID NO: 597637 - DNA, 25 bp, Homo sapien
gtgccaggtgctgtttatatggctg

SEQ ID NO: 597638 - DNA, 25 bp, Homo sapien
atggctgggtgtgcaatgatgaata

SEQ ID NO: 597639 - DNA, 25 bp, Homo sapien
aatgatgaataaaacacagtccctg

SEQ ID NO: 597640 - DNA, 25 bp, Homo sapien
ctgccttcaaggaccttacagactg

SEQ ID NO: 597641 - DNA, 25 bp, Homo sapien
ttcaaggaccttacagactggtgag

SEQ ID NO: 597642 - DNA, 25 bp, Homo sapien
gagacagtgtggtcaaatgcctctg

SEQ ID NO: 597643 - DNA, 25 bp, Homo sapien
aatgcctctgtagatgggtcttgca

SEQ ID NO: 597644 - DNA, 25 bp, Homo sapien
gtcttgcagtgagcttatcagggtg

SEQ ID NO: 597645 - DNA, 25 bp, Homo sapien
agtgagcttatcagggtgctgctgt

SEQ ID NO: 597646 - DNA, 25 bp, Homo sapien
ttgtaggtatatgcattctccccgc

SEQ ID NO: 597647 - DNA, 25 bp, Homo sapien
taggaaaagaccttagcctttccat

SEQ ID NO: 597648 - DNA, 25 bp, Homo sapien
gaccttagcctttccataaggcacg

SEQ ID NO: 597649 - DNA, 25 bp, Homo sapien
cataaggcacgattattctcctcta

SEQ ID NO: 597650 - DNA, 25 bp, Homo sapien
attctcctctatagagcctcaaaag

SEQ ID NO: 597651 - DNA, 25 bp, Homo sapien
gacacacacaaggactggagcaaaa

SEQ ID NO: 597652 - DNA, 25 bp, Homo sapien
ggagcaaaaccaaacatagtgtatc

SEQ ID NO: 597653 - DNA, 25 bp, Homo sapien
atagtgtatcatcaccgctgaaccc

SEQ ID NO: 597654 - DNA, 25 bp, Homo sapien
ccccagatgcttttgaacgtgaaag

SEQ ID NO: 597655 - DNA, 25 bp, Homo sapien
aagctgtcagagatcaggttgaatg

SEQ ID NO: 597656 - DNA, 25 bp, Homo sapien
tgggttaggtgtgcggcattgcctc

SEQ ID NO: 597657 - DNA, 25 bp, Homo sapien
ggcattgcctctgggtccctgcttt

SEQ ID NO: 597658 - DNA, 25 bp, Homo sapien
aatacctgttatggactaaatggca

SEQ ID NO: 597659 - DNA, 25 bp, Homo sapien
atacctgttatggactaaatggcac

SEQ ID NO: 597660 - DNA, 25 bp, Homo sapien
tacctgttatggactaaatggcacg

SEQ ID NO: 597661 - DNA, 25 bp, Homo sapien
acctgttatggactaaatggcacgg

SEQ ID NO: 597662 - DNA, 25 bp, Homo sapien
cctgttatggactaaatggcacggt

SEQ ID NO: 597663 - DNA, 25 bp, Homo sapien
ctgttatggactaaatggcacggtg

SEQ ID NO: 597664 - DNA, 25 bp, Homo sapien
tgttatggactaaatggcacggtgg

SEQ ID NO: 597665 - DNA, 25 bp, Homo sapien
gttatggactaaatggcacggtggc

SEQ ID NO: 597666 - DNA, 25 bp, Homo sapien
ttatggactaaatggcacggtggct

SEQ ID NO: 597667 - DNA, 25 bp, Homo sapien
tatggactaaatggcacggtggctc

SEQ ID NO: 597668 - DNA, 25 bp, Homo sapien
aggacatctagcacaatgttgaaaa

SEQ ID NO: 597669 - DNA, 25 bp, Homo sapien
agcacaatgttgaaaagtatggccc

SEQ ID NO: 597670 - DNA, 25 bp, Homo sapien
aagtatggcccagaccctatcagaa

SEQ ID NO: 597671 - DNA, 25 bp, Homo sapien
atggcccagaccctatcagaataat

SEQ ID NO: 597672 - DNA, 25 bp, Homo sapien
agaccctatcagaataatcccagcc

SEQ ID NO: 597673 - DNA, 25 bp, Homo sapien
agcccatcatagcaaaattggtgaa

SEQ ID NO: 597674 - DNA, 25 bp, Homo sapien
aataaggcaaatggctgacttttca

SEQ ID NO: 597675 - DNA, 25 bp, Homo sapien
ggctgacttttcaacagaagcaata

SEQ ID NO: 597676 - DNA, 25 bp, Homo sapien
gaaaccaaagacaatagagtgacat

SEQ ID NO: 597677 - DNA, 25 bp, Homo sapien
aaattactgccaatctagggttctg

SEQ ID NO: 597678 - DNA, 25 bp, Homo sapien
actgccaatctagggttctgtatct

SEQ ID NO: 597679 - DNA, 25 bp, Homo sapien
gaagaaatcatgagggaaattagca

SEQ ID NO: 597680 - DNA, 25 bp, Homo sapien
aattagcaaatactttgggttagat

SEQ ID NO: 597681 - DNA, 25 bp, Homo sapien
agcaaatactttgggttagatgaaa

SEQ ID NO: 597682 - DNA, 25 bp, Homo sapien
agcagtatttagaatgacatttata

SEQ ID NO: 597683 - DNA, 25 bp, Homo sapien
gaatgatagtgaatcaataacctat

SEQ ID NO: 597684 - DNA, 25 bp, Homo sapien
gaatcaataacctatatttctgcct

SEQ ID NO: 597685 - DNA, 25 bp, Homo sapien
atcaataacctatatttctgcctta

SEQ ID NO: 597686 - DNA, 25 bp, Homo sapien
aataacctatatttctgccttaaga

SEQ ID NO: 597687 - DNA, 25 bp, Homo sapien
taacctatatttctgccttaagaaa

SEQ ID NO: 597688 - DNA, 25 bp, Homo sapien
tctgccttaagaaattagaggccgg

SEQ ID NO: 597689 - DNA, 25 bp, Homo sapien
tcctggctaacatgtgttatggtaa

SEQ ID NO: 597690 - DNA, 25 bp, Homo sapien
tcagtgcacaggctggctaacacac

SEQ ID NO: 597691 - DNA, 25 bp, Homo sapien
agtgcacaggctggctaacacacac

SEQ ID NO: 597692 - DNA, 25 bp, Homo sapien
gcacaggctggctaacacacacgag

SEQ ID NO: 597693 - DNA, 25 bp, Homo sapien
aggctggctaacacacacgagccgc

SEQ ID NO: 597694 - DNA, 25 bp, Homo sapien
tggctaacacacacgagccgctttc

SEQ ID NO: 597695 - DNA, 25 bp, Homo sapien
acacgagccgctttccaaaccgaag

SEQ ID NO: 597696 - DNA, 25 bp, Homo sapien
gagccgctttccaaaccgaagtcat

SEQ ID NO: 597697 - DNA, 25 bp, Homo sapien
agccgctttccaaaccgaagtcatt

SEQ ID NO: 597698 - DNA, 25 bp, Homo sapien
gctttccaaaccgaagtcattccag

SEQ ID NO: 597699 - DNA, 25 bp, Homo sapien
tttccaaaccgaagtcattccagcc

SEQ ID NO: 597700 - DNA, 25 bp, Homo sapien
aaaccgaagtcattccagccccatg

SEQ ID NO: 597701 - DNA, 25 bp, Homo sapien
gaagacatcccgctgtccagacacc

SEQ ID NO: 597702 - DNA, 25 bp, Homo sapien
caccgcgagggaggcgagtggtgct

SEQ ID NO: 597703 - DNA, 25 bp, Homo sapien
agtggtgctcgcagcctgggactta

SEQ ID NO: 597704 - DNA, 25 bp, Homo sapien
gtgctcgcagcctgggacttaggaa

SEQ ID NO: 597705 - DNA, 25 bp, Homo sapien
tgctcgcagcctgggacttaggaac

SEQ ID NO: 597706 - DNA, 25 bp, Homo sapien
ctcgcagcctgggacttaggaacac

SEQ ID NO: 597707 - DNA, 25 bp, Homo sapien
cgcagcctgggacttaggaacacag

SEQ ID NO: 597708 - DNA, 25 bp, Homo sapien
tgggacttaggaacacagggaaaca

SEQ ID NO: 597709 - DNA, 25 bp, Homo sapien
acttaggaacacagggaaacagctt

SEQ ID NO: 597710 - DNA, 25 bp, Homo sapien
gaacacagggaaacagcttccacat

SEQ ID NO: 597711 - DNA, 25 bp, Homo sapien
gggccaaaatagtccaggcagccaa

SEQ ID NO: 597712 - DNA, 25 bp, Homo sapien
gagttgaagacggggcatggtggct

SEQ ID NO: 597713 - DNA, 25 bp, Homo sapien
acactttgggaatcttaggcgggag

SEQ ID NO: 597714 - DNA, 25 bp, Homo sapien
cactttgggaatcttaggcgggagg

SEQ ID NO: 597715 - DNA, 25 bp, Homo sapien
ttgggaatcttaggcgggaggatca

SEQ ID NO: 597716 - DNA, 25 bp, Homo sapien
tgggaatcttaggcgggaggatcac

SEQ ID NO: 597717 - DNA, 25 bp, Homo sapien
atggtagcacacacgtgtggtccca

SEQ ID NO: 597718 - DNA, 25 bp, Homo sapien
ctcaagaggtggaggcaggaagatc

SEQ ID NO: 597719 - DNA, 25 bp, Homo sapien
gtgccaccacactcccacactccag

SEQ ID NO: 597720 - DNA, 25 bp, Homo sapien
caccacactcccacactccagcctg

SEQ ID NO: 597721 - DNA, 25 bp, Homo sapien
ctgggtaacagtgagaccatgtcta

SEQ ID NO: 597722 - DNA, 25 bp, Homo sapien
tgggtaacagtgagaccatgtctag

SEQ ID NO: 597723 - DNA, 25 bp, Homo sapien
tgaggaacaggacaagggcagggaa

SEQ ID NO: 597724 - DNA, 25 bp, Homo sapien
gaggaacaggacaagggcagggaag

SEQ ID NO: 597725 - DNA, 25 bp, Homo sapien
aggaacaggacaagggcagggaaga

SEQ ID NO: 597726 - DNA, 25 bp, Homo sapien
ggaacaggacaagggcagggaagac

SEQ ID NO: 597727 - DNA, 25 bp, Homo sapien
gaacaggacaagggcagggaagaca

SEQ ID NO: 597728 - DNA, 25 bp, Homo sapien
aacaggacaagggcagggaagacac

SEQ ID NO: 597729 - DNA, 25 bp, Homo sapien
ccacagcaacagctgatagaagaga

SEQ ID NO: 597730 - DNA, 25 bp, Homo sapien
gagaacagagacgcacagaggaagg

SEQ ID NO: 597731 - DNA, 25 bp, Homo sapien
agaacagagacgcacagaggaagga

SEQ ID NO: 597732 - DNA, 25 bp, Homo sapien
gaacagagacgcacagaggaaggat

SEQ ID NO: 597733 - DNA, 25 bp, Homo sapien
ccaaatttctctaaccatgtgaaga

SEQ ID NO: 597734 - DNA, 25 bp, Homo sapien
caaatttctctaaccatgtgaagac

SEQ ID NO: 597735 - DNA, 25 bp, Homo sapien
aaatttctctaaccatgtgaagaca

SEQ ID NO: 597736 - DNA, 25 bp, Homo sapien
aatttctctaaccatgtgaagacat

SEQ ID NO: 597737 - DNA, 25 bp, Homo sapien
agacatgcttgattcccctcacctt

SEQ ID NO: 597738 - DNA, 25 bp, Homo sapien
gacatgcttgattcccctcaccttc

SEQ ID NO: 597739 - DNA, 25 bp, Homo sapien
acatgcttgattcccctcaccttca

SEQ ID NO: 597740 - DNA, 25 bp, Homo sapien
ctcaccttcaccatgatttttctgg

SEQ ID NO: 597741 - DNA, 25 bp, Homo sapien
tcaccttcaccatgatttttctggg

SEQ ID NO: 597742 - DNA, 25 bp, Homo sapien
aacattaatttcaggtgaagaaact

SEQ ID NO: 597743 - DNA, 25 bp, Homo sapien
acattaatttcaggtgaagaaactg

SEQ ID NO: 597744 - DNA, 25 bp, Homo sapien
tgaccccttcaatttcccaaaatgt

SEQ ID NO: 597745 - DNA, 25 bp, Homo sapien
ggaaaactcaactgcataatttatg

SEQ ID NO: 597746 - DNA, 25 bp, Homo sapien
ctacattcgcactttctcctgaaat

SEQ ID NO: 597747 - DNA, 25 bp, Homo sapien
tgcagtattagagcaaaggaccaat

SEQ ID NO: 597748 - DNA, 25 bp, Homo sapien
gataaaaactaactgaactacctct

SEQ ID NO: 597749 - DNA, 25 bp, Homo sapien
tgaactacctcttagtgcctggaat

SEQ ID NO: 597750 - DNA, 25 bp, Homo sapien
gtgcctggaatttaccttttcctga

SEQ ID NO: 597751 - DNA, 25 bp, Homo sapien
tttaccttttcctgacttactgtca

SEQ ID NO: 597752 - DNA, 25 bp, Homo sapien
gacttactgtcaaacttcgtgcatg

SEQ ID NO: 597753 - DNA, 25 bp, Homo sapien
gtcaaacttcgtgcatggcttttat

SEQ ID NO: 597754 - DNA, 25 bp, Homo sapien
aacttcgtgcatggcttttattaaa

SEQ ID NO: 597755 - DNA, 25 bp, Homo sapien
gggcctggcagtgggtagggtagag

SEQ ID NO: 597756 - DNA, 25 bp, Homo sapien
ggcctggcagtgggtagggtagagg

SEQ ID NO: 597757 - DNA, 25 bp, Homo sapien
tacctatgaaacaaacctcacatcc

SEQ ID NO: 597758 - DNA, 25 bp, Homo sapien
acctatgaaacaaacctcacatcct

SEQ ID NO: 597759 - DNA, 25 bp, Homo sapien
cctatgaaacaaacctcacatcctg

SEQ ID NO: 597760 - DNA, 25 bp, Homo sapien
ctatgaaacaaacctcacatcctgc

SEQ ID NO: 597761 - DNA, 25 bp, Homo sapien
acaaacctcacatcctgcatatgta

SEQ ID NO: 597762 - DNA, 25 bp, Homo sapien
caaacctcacatcctgcatatgtac

SEQ ID NO: 597763 - DNA, 25 bp, Homo sapien
aaacctcacatcctgcatatgtacc

SEQ ID NO: 597764 - DNA, 25 bp, Homo sapien
aacctcacatcctgcatatgtacct

SEQ ID NO: 597765 - DNA, 25 bp, Homo sapien
acctcacatcctgcatatgtacctc

SEQ ID NO: 597766 - DNA, 25 bp, Homo sapien
tgtaattcctcttaaccttcttcca

SEQ ID NO: 597767 - DNA, 25 bp, Homo sapien
accttcttccactgtgtttatggta

SEQ ID NO: 597768 - DNA, 25 bp, Homo sapien
gtaaatatgccagaccactcaactt

SEQ ID NO: 597769 - DNA, 25 bp, Homo sapien
accccgtctggcaaggtaagaactg

SEQ ID NO: 597770 - DNA, 25 bp, Homo sapien
aggtaagaactgctcctggaggatt

SEQ ID NO: 597771 - DNA, 25 bp, Homo sapien
tcctggaggattttagcacgctggt

SEQ ID NO: 597772 - DNA, 25 bp, Homo sapien
cgctggtggcgcctgtttttgacct

SEQ ID NO: 597773 - DNA, 25 bp, Homo sapien
tctgctgagaagacaggcccatcca

SEQ ID NO: 597774 - DNA, 25 bp, Homo sapien
atccaggagtccattcctttgcata

SEQ ID NO: 597775 - DNA, 25 bp, Homo sapien
tcatttcttcccaagggcagacagt

SEQ ID NO: 597776 - DNA, 25 bp, Homo sapien
ggcagacagtactgatcagctaccc

SEQ ID NO: 597777 - DNA, 25 bp, Homo sapien
agtggccagctcctgtcaatttatt

SEQ ID NO: 597778 - DNA, 25 bp, Homo sapien
ggccagctcctgtcaatttatttgc

SEQ ID NO: 597779 - DNA, 25 bp, Homo sapien
gctcctgtcaatttatttgcttaca

SEQ ID NO: 597780 - DNA, 25 bp, Homo sapien
tatttgcttacaagggagaatgctt

SEQ ID NO: 597781 - DNA, 25 bp, Homo sapien
cttggaaaggttgcattggttgaaa

SEQ ID NO: 597782 - DNA, 25 bp, Homo sapien
aggagcatcaccctggggatttcat

SEQ ID NO: 597783 - DNA, 25 bp, Homo sapien
gggatttcatgttttcactctgttc

SEQ ID NO: 597784 - DNA, 25 bp, Homo sapien
gatttcatgttttcactctgttctt

SEQ ID NO: 597785 - DNA, 25 bp, Homo sapien
atgttttcactctgttcttagtccc

SEQ ID NO: 597786 - DNA, 25 bp, Homo sapien
ttttcactctgttcttagtcccagg

SEQ ID NO: 597787 - DNA, 25 bp, Homo sapien
tctgttcttagtcccaggagccaca

SEQ ID NO: 597788 - DNA, 25 bp, Homo sapien
gttttcctcacggtggaaggcgaag

SEQ ID NO: 597789 - DNA, 25 bp, Homo sapien
cgaagcaggaacaggcacaccacat

SEQ ID NO: 597790 - DNA, 25 bp, Homo sapien
cttgtgaacaaccagatctgagtga

SEQ ID NO: 597791 - DNA, 25 bp, Homo sapien
gagtgaacacactcatcgccaaggg

SEQ ID NO: 597792 - DNA, 25 bp, Homo sapien
gggtggcactaagtcactcatgagg

SEQ ID NO: 597793 - DNA, 25 bp, Homo sapien
ttcaacactggccaacaactatatg

SEQ ID NO: 597794 - DNA, 25 bp, Homo sapien
acactggccaacaactatatgaaaa

SEQ ID NO: 597795 - DNA, 25 bp, Homo sapien
aatgctccacatcactaactattcg

SEQ ID NO: 597796 - DNA, 25 bp, Homo sapien
tgctccacatcactaactattcggg

SEQ ID NO: 597797 - DNA, 25 bp, Homo sapien
gggaatgtaaatcgaaaccaccacg

SEQ ID NO: 597798 - DNA, 25 bp, Homo sapien
gtaaatcgaaaccaccacgagatac

SEQ ID NO: 597799 - DNA, 25 bp, Homo sapien
atatactgcattaggccattactgc

SEQ ID NO: 597800 - DNA, 25 bp, Homo sapien
tatactgcattaggccattactgca

SEQ ID NO: 597801 - DNA, 25 bp, Homo sapien
atactgcattaggccattactgcat

SEQ ID NO: 597802 - DNA, 25 bp, Homo sapien
tactgcattaggccattactgcatt

SEQ ID NO: 597803 - DNA, 25 bp, Homo sapien
actgcattaggccattactgcattg

SEQ ID NO: 597804 - DNA, 25 bp, Homo sapien
ctgcattaggccattactgcattgc

SEQ ID NO: 597805 - DNA, 25 bp, Homo sapien
tgcattaggccattactgcattgct

SEQ ID NO: 597806 - DNA, 25 bp, Homo sapien
gcattaggccattactgcattgcta

SEQ ID NO: 597807 - DNA, 25 bp, Homo sapien
cattaggccattactgcattgctat

SEQ ID NO: 597808 - DNA, 25 bp, Homo sapien
aatacctgagattggccgggggcag

SEQ ID NO: 597809 - DNA, 25 bp, Homo sapien
atacctgagattggccgggggcagt

SEQ ID NO: 597810 - DNA, 25 bp, Homo sapien
aaatatgacagcttttgactttaac

SEQ ID NO: 597811 - DNA, 25 bp, Homo sapien
aatatgacagcttttgactttaaca

SEQ ID NO: 597812 - DNA, 25 bp, Homo sapien
atgacagcttttgactttaacaatg

SEQ ID NO: 597813 - DNA, 25 bp, Homo sapien
gacagcttttgactttaacaatgta

SEQ ID NO: 597814 - DNA, 25 bp, Homo sapien
cagcttttgactttaacaatgtagc

SEQ ID NO: 597815 - DNA, 25 bp, Homo sapien
cttttgactttaacaatgtagcttg

SEQ ID NO: 597816 - DNA, 25 bp, Homo sapien
gactttaacaatgtagcttgtgtaa

SEQ ID NO: 597817 - DNA, 25 bp, Homo sapien
tgacctcttctgctctcattttgtt

SEQ ID NO: 597818 - DNA, 25 bp, Homo sapien
tttacatgaaatttctacttggtct

SEQ ID NO: 597819 - DNA, 25 bp, Homo sapien
tcttatcattagatctcagctgact

SEQ ID NO: 597820 - DNA, 25 bp, Homo sapien
agaagtatgtctcttgattggaaag

SEQ ID NO: 597821 - DNA, 25 bp, Homo sapien
gagaatgacctccatccgcaggacg

SEQ ID NO: 597822 - DNA, 25 bp, Homo sapien
ctccatccgcaggacgaggtattaa

SEQ ID NO: 597823 - DNA, 25 bp, Homo sapien
aaatattcagcccatgccagagtga

SEQ ID NO: 597824 - DNA, 25 bp, Homo sapien
gccagagtgaggatctccttttcac

SEQ ID NO: 597825 - DNA, 25 bp, Homo sapien
accttctgtctgaattgtgccttga

SEQ ID NO: 597826 - DNA, 25 bp, Homo sapien
ttgtgccttgaatctgtttcgcgat

SEQ ID NO: 597827 - DNA, 25 bp, Homo sapien
gtgcgaactgggtgagacacttgtc

SEQ ID NO: 597828 - DNA, 25 bp, Homo sapien
agacacttgtcttagaaccgcagcc

SEQ ID NO: 597829 - DNA, 25 bp, Homo sapien
tcgagccggtttccatagcctgaat

SEQ ID NO: 597830 - DNA, 25 bp, Homo sapien
atccttcctctcatttgcaaacaac

SEQ ID NO: 597831 - DNA, 25 bp, Homo sapien
aaagcagaatgcaatcccttctata

SEQ ID NO: 597832 - DNA, 25 bp, Homo sapien
actgggtcagctttatgcttggtca

SEQ ID NO: 597833 - DNA, 25 bp, Homo sapien
tcattttatttccaattcttctccc

SEQ ID NO: 597834 - DNA, 25 bp, Homo sapien
ggttgccatggtgattattccaaat

SEQ ID NO: 597835 - DNA, 25 bp, Homo sapien
aaatgcattgtggtcagatggaact

SEQ ID NO: 597836 - DNA, 25 bp, Homo sapien
tggtgacctgttctaatttcccctt

SEQ ID NO: 597837 - DNA, 25 bp, Homo sapien
tttccccttcagttacaaaatgagc

SEQ ID NO: 597838 - DNA, 25 bp, Homo sapien
aaaatgagcccgttgctcttagcca

SEQ ID NO: 597839 - DNA, 25 bp, Homo sapien
gctcttagccatcaaaatctcacca

SEQ ID NO: 597840 - DNA, 25 bp, Homo sapien
caacacctactacttcagtttcaac

SEQ ID NO: 597841 - DNA, 25 bp, Homo sapien
tacttcagtttcaactctggttcct

SEQ ID NO: 597842 - DNA, 25 bp, Homo sapien
ttttcaaggcaatcactcaaagttg

SEQ ID NO: 597843 - DNA, 25 bp, Homo sapien
taatcgcagccccttggaaggccaa

SEQ ID NO: 597844 - DNA, 25 bp, Homo sapien
gagaatcgcctcaacactggaggtg

SEQ ID NO: 597845 - DNA, 25 bp, Homo sapien
agaatcgcctcaacactggaggtgg

SEQ ID NO: 597846 - DNA, 25 bp, Homo sapien
gaatcgcctcaacactggaggtgga

SEQ ID NO: 597847 - DNA, 25 bp, Homo sapien
aatcgcctcaacactggaggtggag

SEQ ID NO: 597848 - DNA, 25 bp, Homo sapien
tcgcctcaacactggaggtggaggt

SEQ ID NO: 597849 - DNA, 25 bp, Homo sapien
cgcctcaacactggaggtggaggtt

SEQ ID NO: 597850 - DNA, 25 bp, Homo sapien
tctagagtttcagtctaagggaaaa

SEQ ID NO: 597851 - DNA, 25 bp, Homo sapien
ctagagtttcagtctaagggaaaat

SEQ ID NO: 597852 - DNA, 25 bp, Homo sapien
agagtttcagtctaagggaaaatgt

SEQ ID NO: 597853 - DNA, 25 bp, Homo sapien
agtttcagtctaagggaaaatgtga

SEQ ID NO: 597854 - DNA, 25 bp, Homo sapien
atatcatcctttgcctgcctagatc

SEQ ID NO: 597855 - DNA, 25 bp, Homo sapien
ttgcctgcctagatcatagtgcttt

SEQ ID NO: 597856 - DNA, 25 bp, Homo sapien
atagtgcttttcacactcgttgtta

SEQ ID NO: 597857 - DNA, 25 bp, Homo sapien
acactcgttgttatcacctgtctat

SEQ ID NO: 597858 - DNA, 25 bp, Homo sapien
gttgttatcacctgtctatcgtggg

SEQ ID NO: 597859 - DNA, 25 bp, Homo sapien
gggtccatggacactgactgtcagc

SEQ ID NO: 597860 - DNA, 25 bp, Homo sapien
ggacactgactgtcagctccttgag

SEQ ID NO: 597861 - DNA, 25 bp, Homo sapien
tcagctccttgagggtggagaccgt

SEQ ID NO: 597862 - DNA, 25 bp, Homo sapien
gggtggagaccgtgacttgtttatc

SEQ ID NO: 597863 - DNA, 25 bp, Homo sapien
gtgacttgtttatccctgtgtttat

SEQ ID NO: 597864 - DNA, 25 bp, Homo sapien
ttgtttatccctgtgtttatccatg

SEQ ID NO: 597865 - DNA, 25 bp, Homo sapien
aaacagccacccctctgtcgcatac

SEQ ID NO: 597866 - DNA, 25 bp, Homo sapien
aacagccacccctctgtcgcatacg

SEQ ID NO: 597867 - DNA, 25 bp, Homo sapien
ctctgtcgcatacgccctggctcac

SEQ ID NO: 597868 - DNA, 25 bp, Homo sapien
tgtcgcatacgccctggctcacact

SEQ ID NO: 597869 - DNA, 25 bp, Homo sapien
tcacactcttctcctgccatgcttt

SEQ ID NO: 597870 - DNA, 25 bp, Homo sapien
tcctgccatgctttctcacaggctg

SEQ ID NO: 597871 - DNA, 25 bp, Homo sapien
cctgccatgctttctcacaggctgt

SEQ ID NO: 597872 - DNA, 25 bp, Homo sapien
ctgccatgctttctcacaggctgtg

SEQ ID NO: 597873 - DNA, 25 bp, Homo sapien
tgccatgctttctcacaggctgtgt

SEQ ID NO: 597874 - DNA, 25 bp, Homo sapien
gccatgctttctcacaggctgtgtt

SEQ ID NO: 597875 - DNA, 25 bp, Homo sapien
atgctttctcacaggctgtgttgtg

SEQ ID NO: 597876 - DNA, 25 bp, Homo sapien
gcataatgtttctgggtataaaaag

SEQ ID NO: 597877 - DNA, 25 bp, Homo sapien
cataatgtttctgggtataaaaagt

SEQ ID NO: 597878 - DNA, 25 bp, Homo sapien
taatgtttctgggtataaaaagtct

SEQ ID NO: 597879 - DNA, 25 bp, Homo sapien
ttctgggtataaaaagtcttaatat

SEQ ID NO: 597880 - DNA, 25 bp, Homo sapien
tctgggtataaaaagtcttaatata

SEQ ID NO: 597881 - DNA, 25 bp, Homo sapien
ctgggtataaaaagtcttaatatag

SEQ ID NO: 597882 - DNA, 25 bp, Homo sapien
gtataaaaagtcttaatataggtca

SEQ ID NO: 597883 - DNA, 25 bp, Homo sapien
tataaaaagtcttaatataggtcag

SEQ ID NO: 597884 - DNA, 25 bp, Homo sapien
ataaaaagtcttaatataggtcagg

SEQ ID NO: 597885 - DNA, 25 bp, Homo sapien
taaaaagtcttaatataggtcaggc

SEQ ID NO: 597886 - DNA, 25 bp, Homo sapien
gctactcggggcggggctaaggtag

SEQ ID NO: 597887 - DNA, 25 bp, Homo sapien
gcacagcaaaagaaataatcaggct

SEQ ID NO: 597888 - DNA, 25 bp, Homo sapien
cagcaaaagaaataatcaggctggg

SEQ ID NO: 597889 - DNA, 25 bp, Homo sapien
agcaaaagaaataatcaggctgggc

SEQ ID NO: 597890 - DNA, 25 bp, Homo sapien
gcaaaagaaataatcaggctgggcg

SEQ ID NO: 597891 - DNA, 25 bp, Homo sapien
caaaagaaataatcaggctgggcgc

SEQ ID NO: 597892 - DNA, 25 bp, Homo sapien
aaaagaaataatcaggctgggcgca

SEQ ID NO: 597893 - DNA, 25 bp, Homo sapien
aaagaaataatcaggctgggcgcag

SEQ ID NO: 597894 - DNA, 25 bp, Homo sapien
aagaaataatcaggctgggcgcagt

SEQ ID NO: 597895 - DNA, 25 bp, Homo sapien
agaaataatcaggctgggcgcagtg

SEQ ID NO: 597896 - DNA, 25 bp, Homo sapien
gaaataatcaggctgggcgcagtgg

SEQ ID NO: 597897 - DNA, 25 bp, Homo sapien
tcaaaagtgggaagtccccctctgg

SEQ ID NO: 597898 - DNA, 25 bp, Homo sapien
tctaagatgacagagccggtgccag

SEQ ID NO: 597899 - DNA, 25 bp, Homo sapien
atgacagagccggtgccagaatcta

SEQ ID NO: 597900 - DNA, 25 bp, Homo sapien
gagccggtgccagaatctaaacctt

SEQ ID NO: 597901 - DNA, 25 bp, Homo sapien
gccagaatctaaaccttgggactct

SEQ ID NO: 597902 - DNA, 25 bp, Homo sapien
ccttgggactctggttgctgtataa

SEQ ID NO: 597903 - DNA, 25 bp, Homo sapien
gcagaagagcaataagttgccaaat

SEQ ID NO: 597904 - DNA, 25 bp, Homo sapien
ttgatagttttttactctctaaatg

SEQ ID NO: 597905 - DNA, 25 bp, Homo sapien
actctctaaatgtaagctcctatat

SEQ ID NO: 597906 - DNA, 25 bp, Homo sapien
gtaagctcctatatttcctgtcttc

SEQ ID NO: 597907 - DNA, 25 bp, Homo sapien
tatgttagaagctcagtacaaacag

SEQ ID NO: 597908 - DNA, 25 bp, Homo sapien
atggagaacagtatgcagcattgcc

SEQ ID NO: 597909 - DNA, 25 bp, Homo sapien
gcctgataatattgctactgcattc

SEQ ID NO: 597910 - DNA, 25 bp, Homo sapien
gtttgtgatggctttgttcattgat

SEQ ID NO: 597911 - DNA, 25 bp, Homo sapien
attgatgttgggtggatgaatctgt

SEQ ID NO: 597912 - DNA, 25 bp, Homo sapien
tgaatctgtgagtgaatcttcaaca

SEQ ID NO: 597913 - DNA, 25 bp, Homo sapien
gattgtatttctttaacctggtggc

SEQ ID NO: 597914 - DNA, 25 bp, Homo sapien
tctttaacctggtggcatctagtgt

SEQ ID NO: 597915 - DNA, 25 bp, Homo sapien
ggtggcatctagtgtctcccagaaa

SEQ ID NO: 597916 - DNA, 25 bp, Homo sapien
gtctcccagaaagtggtttgttgaa

SEQ ID NO: 597917 - DNA, 25 bp, Homo sapien
gaagtaagtattccactaaagatca

SEQ ID NO: 597918 - DNA, 25 bp, Homo sapien
ttccactaaagatcaagcttcattt

SEQ ID NO: 597919 - DNA, 25 bp, Homo sapien
agacagggtgacagcaccaagctca

SEQ ID NO: 597920 - DNA, 25 bp, Homo sapien
aagctcagcctttcctccgaggctt

SEQ ID NO: 597921 - DNA, 25 bp, Homo sapien
tccgaggcttcgcaggactgaatga

SEQ ID NO: 597922 - DNA, 25 bp, Homo sapien
ggactgaatgaaggcaaacttccca

SEQ ID NO: 597923 - DNA, 25 bp, Homo sapien
aagccatgggattgtccttcctggg

SEQ ID NO: 597924 - DNA, 25 bp, Homo sapien
ccctgactgagctgtgacgggctgt

SEQ ID NO: 597925 - DNA, 25 bp, Homo sapien
gaggctcatctcagcacatataata

SEQ ID NO: 597926 - DNA, 25 bp, Homo sapien
aaaatggagacaaaaggatgccctt

SEQ ID NO: 597927 - DNA, 25 bp, Homo sapien
aaaggatgccctttgcatgggtttt

SEQ ID NO: 597928 - DNA, 25 bp, Homo sapien
tgccctttgcatgggttttgggaaa

SEQ ID NO: 597929 - DNA, 25 bp, Homo sapien
gggaaagattaagtcacatgtttat

SEQ ID NO: 597930 - DNA, 25 bp, Homo sapien
gtcactgtcttacattgtcatctca

SEQ ID NO: 597931 - DNA, 25 bp, Homo sapien
agtcccttccgattgaactttcatg

SEQ ID NO: 597932 - DNA, 25 bp, Homo sapien
gttcatcattccacagagtctactc

SEQ ID NO: 597933 - DNA, 25 bp, Homo sapien
gtctactcttcttaagaactccagt

SEQ ID NO: 597934 - DNA, 25 bp, Homo sapien
aactccagtgaccttccatgtttgt

SEQ ID NO: 597935 - DNA, 25 bp, Homo sapien
gaccttccatgtttgtggctcaatt

SEQ ID NO: 597936 - DNA, 25 bp, Homo sapien
ctctcagcagcattttatatatttg

SEQ ID NO: 597937 - DNA, 25 bp, Homo sapien
atatatttgaccattccctctttct

SEQ ID NO: 597938 - DNA, 25 bp, Homo sapien
gatattggttctcatgacttcatac

SEQ ID NO: 597939 - DNA, 25 bp, Homo sapien
atgacttcatactctcctgggtttc

SEQ ID NO: 597940 - DNA, 25 bp, Homo sapien
tagcccactctttctcaatttgctt

SEQ ID NO: 597941 - DNA, 25 bp, Homo sapien
gggctctgctggtctagcaagagat

SEQ ID NO: 597942 - DNA, 25 bp, Homo sapien
caagagatgctgatagaccccaggg

SEQ ID NO: 597943 - DNA, 25 bp, Homo sapien
gggcactggccacatttctagaggt

SEQ ID NO: 597944 - DNA, 25 bp, Homo sapien
tagaggtgtcataaacctggcggtt

SEQ ID NO: 597945 - DNA, 25 bp, Homo sapien
aaacctggcggttgtgtgcatggat

SEQ ID NO: 597946 - DNA, 25 bp, Homo sapien
tgtgcatggatctggaggcttcccc

SEQ ID NO: 597947 - DNA, 25 bp, Homo sapien
cactcgctagcccagctggtataat

SEQ ID NO: 597948 - DNA, 25 bp, Homo sapien
cccagctggtataatctctgtgcct

SEQ ID NO: 597949 - DNA, 25 bp, Homo sapien
gggataacaggagtctttaccttat

SEQ ID NO: 597950 - DNA, 25 bp, Homo sapien
gagttaatctgtgtaaagtgcttat

SEQ ID NO: 597951 - DNA, 25 bp, Homo sapien
gtgcttatgatcatgctggacacct

SEQ ID NO: 597952 - DNA, 25 bp, Homo sapien
caggaagctctggttctcggaatag

SEQ ID NO: 597953 - DNA, 25 bp, Homo sapien
ttctcggaatagctcctgcttggat

SEQ ID NO: 597954 - DNA, 25 bp, Homo sapien
ctgcttggattttcctcactgggaa

SEQ ID NO: 597955 - DNA, 25 bp, Homo sapien
ccttcagtcactgggcacagaacat

SEQ ID NO: 597956 - DNA, 25 bp, Homo sapien
cactgggcacagaacatcaatggta

SEQ ID NO: 597957 - DNA, 25 bp, Homo sapien
atcaatggtaagacaggcagcccta

SEQ ID NO: 597958 - DNA, 25 bp, Homo sapien
gcagccctaccgatcatggaactat

SEQ ID NO: 597959 - DNA, 25 bp, Homo sapien
atcatggaactatcacaagagctgt

SEQ ID NO: 597960 - DNA, 25 bp, Homo sapien
tcacaagagctgttccattctggat

SEQ ID NO: 597961 - DNA, 25 bp, Homo sapien
agctgttccattctggatgctttct

SEQ ID NO: 597962 - DNA, 25 bp, Homo sapien
gtatgtttgtgttgacagagaggca

SEQ ID NO: 597963 - DNA, 25 bp, Homo sapien
taagaagcaataatagggcaccggg

SEQ ID NO: 597964 - DNA, 25 bp, Homo sapien
aagaagcaataatagggcaccgggt

SEQ ID NO: 597965 - DNA, 25 bp, Homo sapien
agaagcaataatagggcaccgggta

SEQ ID NO: 597966 - DNA, 25 bp, Homo sapien
gaagcaataatagggcaccgggtac

SEQ ID NO: 597967 - DNA, 25 bp, Homo sapien
aagcaataatagggcaccgggtaca

SEQ ID NO: 597968 - DNA, 25 bp, Homo sapien
agcaataatagggcaccgggtacag

SEQ ID NO: 597969 - DNA, 25 bp, Homo sapien
gcaataatagggcaccgggtacagt

SEQ ID NO: 597970 - DNA, 25 bp, Homo sapien
caataatagggcaccgggtacagtg

SEQ ID NO: 597971 - DNA, 25 bp, Homo sapien
aataatagggcaccgggtacagtgg

SEQ ID NO: 597972 - DNA, 25 bp, Homo sapien
ataatagggcaccgggtacagtggc

SEQ ID NO: 597973 - DNA, 25 bp, Homo sapien
taatagggcaccgggtacagtggct

SEQ ID NO: 597974 - DNA, 25 bp, Homo sapien
tttcttacaccccaggtatctgctc

SEQ ID NO: 597975 - DNA, 25 bp, Homo sapien
caccccaggtatctgctcatcatct

SEQ ID NO: 597976 - DNA, 25 bp, Homo sapien
gctcatcatcttgggtaagaccaca

SEQ ID NO: 597977 - DNA, 25 bp, Homo sapien
tcatcatcttgggtaagaccacagg

SEQ ID NO: 597978 - DNA, 25 bp, Homo sapien
agggaccaccaagacacccagaaga

SEQ ID NO: 597979 - DNA, 25 bp, Homo sapien
gggaccaccaagacacccagaagag

SEQ ID NO: 597980 - DNA, 25 bp, Homo sapien
cacccagaagagacacttgattgtt

SEQ ID NO: 597981 - DNA, 25 bp, Homo sapien
gaagagacacttgattgtttcctgg

SEQ ID NO: 597982 - DNA, 25 bp, Homo sapien
aagagacacttgattgtttcctgga

SEQ ID NO: 597983 - DNA, 25 bp, Homo sapien
gggcccatagatatatgccatttac

SEQ ID NO: 597984 - DNA, 25 bp, Homo sapien
ggcccatagatatatgccatttact

SEQ ID NO: 597985 - DNA, 25 bp, Homo sapien
tcgggaccagcctagcctacatggt

SEQ ID NO: 597986 - DNA, 25 bp, Homo sapien
aaatataaaagttggctggatgtgg

SEQ ID NO: 597987 - DNA, 25 bp, Homo sapien
aatataaaagttggctggatgtggt

SEQ ID NO: 597988 - DNA, 25 bp, Homo sapien
atataaaagttggctggatgtggtg

SEQ ID NO: 597989 - DNA, 25 bp, Homo sapien
ataaaagttggctggatgtggtggt

SEQ ID NO: 597990 - DNA, 25 bp, Homo sapien
taaaagttggctggatgtggtggtg

SEQ ID NO: 597991 - DNA, 25 bp, Homo sapien
aggcggagtcaggagactctcttga

SEQ ID NO: 597992 - DNA, 25 bp, Homo sapien
ggcggagtcaggagactctcttgaa

SEQ ID NO: 597993 - DNA, 25 bp, Homo sapien
gcggagtcaggagactctcttgaac

SEQ ID NO: 597994 - DNA, 25 bp, Homo sapien
cggagtcaggagactctcttgaacc

SEQ ID NO: 597995 - DNA, 25 bp, Homo sapien
ggagtcaggagactctcttgaaccc

SEQ ID NO: 597996 - DNA, 25 bp, Homo sapien
gagaccaaagttttcccaagacctg

SEQ ID NO: 597997 - DNA, 25 bp, Homo sapien
agttttcccaagacctgtcttgccg

SEQ ID NO: 597998 - DNA, 25 bp, Homo sapien
tgtcttgccgtctctcacagtgagc

SEQ ID NO: 597999 - DNA, 25 bp, Homo sapien
ctctcacagtgagcagagttatcat

SEQ ID NO: 598000 - DNA, 25 bp, Homo sapien
tctacccacaggatcctctgagcgg

SEQ ID NO: 598001 - DNA, 25 bp, Homo sapien
acaggatcctctgagcggtcgcggt

SEQ ID NO: 598002 - DNA, 25 bp, Homo sapien
atcctctgagcggtcgcggtagaac

SEQ ID NO: 598003 - DNA, 25 bp, Homo sapien
tagaacccctgggaataagcaccgt

SEQ ID NO: 598004 - DNA, 25 bp, Homo sapien
ataagcaccgtttgagatgcagcca

SEQ ID NO: 598005 - DNA, 25 bp, Homo sapien
tgagatgcagccatcctttctcttt

SEQ ID NO: 598006 - DNA, 25 bp, Homo sapien
gatgcagccatcctttctctttctt

SEQ ID NO: 598007 - DNA, 25 bp, Homo sapien
tgctggggtcttcctctatgtggcc

SEQ ID NO: 598008 - DNA, 25 bp, Homo sapien
gctggggtcttcctctatgtggccc

SEQ ID NO: 598009 - DNA, 25 bp, Homo sapien
ctggggtcttcctctatgtggccct

SEQ ID NO: 598010 - DNA, 25 bp, Homo sapien
tggggtcttcctctatgtggccctt

SEQ ID NO: 598011 - DNA, 25 bp, Homo sapien
gggtcttcctctatgtggcccttgt

SEQ ID NO: 598012 - DNA, 25 bp, Homo sapien
ggcccttgtggacatgctaccagcc

SEQ ID NO: 598013 - DNA, 25 bp, Homo sapien
gcccttgtggacatgctaccagccc

SEQ ID NO: 598014 - DNA, 25 bp, Homo sapien
cccttgtggacatgctaccagccct

SEQ ID NO: 598015 - DNA, 25 bp, Homo sapien
ccttgtggacatgctaccagccctg

SEQ ID NO: 598016 - DNA, 25 bp, Homo sapien
cttgtggacatgctaccagccctgc

SEQ ID NO: 598017 - DNA, 25 bp, Homo sapien
ttgtggacatgctaccagccctgct

SEQ ID NO: 598018 - DNA, 25 bp, Homo sapien
gctgagattcagcacttctaaccgg

SEQ ID NO: 598019 - DNA, 25 bp, Homo sapien
cagcacttctaaccggctcctagat

SEQ ID NO: 598020 - DNA, 25 bp, Homo sapien
ggtctgagcactacacttagagcaa

SEQ ID NO: 598021 - DNA, 25 bp, Homo sapien
ttgcgacttataacagtggacccat

SEQ ID NO: 598022 - DNA, 25 bp, Homo sapien
aacagtggacccatggtgtagacaa

SEQ ID NO: 598023 - DNA, 25 bp, Homo sapien
gacccatggtgtagacaagtccaga

SEQ ID NO: 598024 - DNA, 25 bp, Homo sapien
cagtttttatgttagcttccgtata

SEQ ID NO: 598025 - DNA, 25 bp, Homo sapien
gttagcttccgtataccttcagaat

SEQ ID NO: 598026 - DNA, 25 bp, Homo sapien
ataccttcagaattcagtgtttgtg

SEQ ID NO: 598027 - DNA, 25 bp, Homo sapien
aattcagtgtttgtgtgcattctaa

SEQ ID NO: 598028 - DNA, 25 bp, Homo sapien
gtttgtgtgcattctaattctctaa

SEQ ID NO: 598029 - DNA, 25 bp, Homo sapien
gagcttttactcatggcaaaaggca

SEQ ID NO: 598030 - DNA, 25 bp, Homo sapien
aaggcaaagccagagcaggtatctt

SEQ ID NO: 598031 - DNA, 25 bp, Homo sapien
gcaggtatcttcacagggctagagc

SEQ ID NO: 598032 - DNA, 25 bp, Homo sapien
aggtatcttcacagggctagagcaa

SEQ ID NO: 598033 - DNA, 25 bp, Homo sapien
ggtatcttcacagggctagagcaag

SEQ ID NO: 598034 - DNA, 25 bp, Homo sapien
gtgctacacactttttatgcaacca

SEQ ID NO: 598035 - DNA, 25 bp, Homo sapien
ttttatgcaaccaaatctcatgaga

SEQ ID NO: 598036 - DNA, 25 bp, Homo sapien
gaactctatcacgagacagcagtag

SEQ ID NO: 598037 - DNA, 25 bp, Homo sapien
actctatcacgagacagcagtaggg

SEQ ID NO: 598038 - DNA, 25 bp, Homo sapien
gggacagtgctaaatcattcatgag

SEQ ID NO: 598039 - DNA, 25 bp, Homo sapien
aaatcattcatgagaaactacctgc

SEQ ID NO: 598040 - DNA, 25 bp, Homo sapien
gggaagctcacggatctgaaatgca

SEQ ID NO: 598041 - DNA, 25 bp, Homo sapien
tcacggatctgaaatgcaacctctt

SEQ ID NO: 598042 - DNA, 25 bp, Homo sapien
ggatctgaaatgcaacctcttctgc

SEQ ID NO: 598043 - DNA, 25 bp, Homo sapien
aaatgcaacctcttctgcaggagac

SEQ ID NO: 598044 - DNA, 25 bp, Homo sapien
ttctgcaggagacccggcacagcta

SEQ ID NO: 598045 - DNA, 25 bp, Homo sapien
aggagacccggcacagctaccggga

SEQ ID NO: 598046 - DNA, 25 bp, Homo sapien
ctgcgtggttgtggccccactgcag

SEQ ID NO: 598047 - DNA, 25 bp, Homo sapien
tgcagaaacgcctccgcttaacact

SEQ ID NO: 598048 - DNA, 25 bp, Homo sapien
tccagcctctcttctattcggtcag

SEQ ID NO: 598049 - DNA, 25 bp, Homo sapien
tcttctattcggtcaggccacagct

SEQ ID NO: 598050 - DNA, 25 bp, Homo sapien
tctattcggtcaggccacagctgct

SEQ ID NO: 598051 - DNA, 25 bp, Homo sapien
cttcctaagttcagtgggagcaaat

SEQ ID NO: 598052 - DNA, 25 bp, Homo sapien
gagcaaatgttggtaaaatcacttt

SEQ ID NO: 598053 - DNA, 25 bp, Homo sapien
aaaagtaccacaaaccagatggctt

SEQ ID NO: 598054 - DNA, 25 bp, Homo sapien
gtaccacaaaccagatggcttaaag

SEQ ID NO: 598055 - DNA, 25 bp, Homo sapien
tcatatctgagctttccacctctaa

SEQ ID NO: 598056 - DNA, 25 bp, Homo sapien
ctgagctttccacctctaatgagga

SEQ ID NO: 598057 - DNA, 25 bp, Homo sapien
acctctaatgaggagcggcttcatg

SEQ ID NO: 598058 - DNA, 25 bp, Homo sapien
gcttcatgaaggaacggacgggatt

SEQ ID NO: 598059 - DNA, 25 bp, Homo sapien
aggaacggacgggattgctccagaa

SEQ ID NO: 598060 - DNA, 25 bp, Homo sapien
ggacgggattgctccagaaggtcat

SEQ ID NO: 598061 - DNA, 25 bp, Homo sapien
gaaggtcattgattttcagcctcta

SEQ ID NO: 598062 - DNA, 25 bp, Homo sapien
gaagttataatcatgcctatcccta

SEQ ID NO: 598063 - DNA, 25 bp, Homo sapien
atgcctatccctagggccattggga

SEQ ID NO: 598064 - DNA, 25 bp, Homo sapien
tatccctagggccattgggaagatt

SEQ ID NO: 598065 - DNA, 25 bp, Homo sapien
gtaaaacacttagaccagcgcctgg

SEQ ID NO: 598066 - DNA, 25 bp, Homo sapien
tggcacataccaatcccgcaataag

SEQ ID NO: 598067 - DNA, 25 bp, Homo sapien
aatcccgcaataagctattcatgta

SEQ ID NO: 598068 - DNA, 25 bp, Homo sapien
atgtaaactgagagtaggttgtccc

SEQ ID NO: 598069 - DNA, 25 bp, Homo sapien
aggttgtcccactccatgtgggatt

SEQ ID NO: 598070 - DNA, 25 bp, Homo sapien
cagtgtaggaccagggtcagagatc

SEQ ID NO: 598071 - DNA, 25 bp, Homo sapien
gggagaatcacgcaaaaatttagta

SEQ ID NO: 598072 - DNA, 25 bp, Homo sapien
attagaggaccagtttgtgtccacc

SEQ ID NO: 598073 - DNA, 25 bp, Homo sapien
caaaatgttttcaaagtttatccat

SEQ ID NO: 598074 - DNA, 25 bp, Homo sapien
aaaatgttttcaaagtttatccatg

SEQ ID NO: 598075 - DNA, 25 bp, Homo sapien
aaatgttttcaaagtttatccatgt

SEQ ID NO: 598076 - DNA, 25 bp, Homo sapien
aatgttttcaaagtttatccatgtg

SEQ ID NO: 598077 - DNA, 25 bp, Homo sapien
atgttttcaaagtttatccatgtgg

SEQ ID NO: 598078 - DNA, 25 bp, Homo sapien
tgttttcaaagtttatccatgtggg

SEQ ID NO: 598079 - DNA, 25 bp, Homo sapien
gttttcaaagtttatccatgtgggc

SEQ ID NO: 598080 - DNA, 25 bp, Homo sapien
ttttcaaagtttatccatgtgggcc

SEQ ID NO: 598081 - DNA, 25 bp, Homo sapien
tttcaaagtttatccatgtgggccg

SEQ ID NO: 598082 - DNA, 25 bp, Homo sapien
aagtttatccatgtgggccgggcgc

SEQ ID NO: 598083 - DNA, 25 bp, Homo sapien
agtttatccatgtgggccgggcgcg

SEQ ID NO: 598084 - DNA, 25 bp, Homo sapien
gacttcttcctcagataaatgaaca

SEQ ID NO: 598085 - DNA, 25 bp, Homo sapien
cctacatgtggacttttgcttatca

SEQ ID NO: 598086 - DNA, 25 bp, Homo sapien
ggacttttgcttatcatgtattgta

SEQ ID NO: 598087 - DNA, 25 bp, Homo sapien
ttttctttgatacttagactgtgta

SEQ ID NO: 598088 - DNA, 25 bp, Homo sapien
caattttcacaaggaagggatttca

SEQ ID NO: 598089 - DNA, 25 bp, Homo sapien
tattctacctgaattctatttctca

SEQ ID NO: 598090 - DNA, 25 bp, Homo sapien
actaggtcaaactaacatgtgtact

SEQ ID NO: 598091 - DNA, 25 bp, Homo sapien
atgtctaacttaggcatacgctcta

SEQ ID NO: 598092 - DNA, 25 bp, Homo sapien
aggcatacgctctagagcagtgatt

SEQ ID NO: 598093 - DNA, 25 bp, Homo sapien
ggatgaaaactgcagacttcttcct

SEQ ID NO: 598094 - DNA, 25 bp, Homo sapien
aactgcagacttcttcctcagataa

SEQ ID NO: 598095 - DNA, 25 bp, Homo sapien
tgcggccaccgtttccgcaatagct

SEQ ID NO: 598096 - DNA, 25 bp, Homo sapien
cgtttccgcaatagctccaacctgg

SEQ ID NO: 598097 - DNA, 25 bp, Homo sapien
ggccctacagctgtcagacgtgcgg

SEQ ID NO: 598098 - DNA, 25 bp, Homo sapien
gccctacagctgtcagacgtgcggt

SEQ ID NO: 598099 - DNA, 25 bp, Homo sapien
cctacagctgtcagacgtgcggtcg

SEQ ID NO: 598100 - DNA, 25 bp, Homo sapien
tacagctgtcagacgtgcggtcgca

SEQ ID NO: 598101 - DNA, 25 bp, Homo sapien
cagctgtcagacgtgcggtcgcagc

SEQ ID NO: 598102 - DNA, 25 bp, Homo sapien
gctgtcagacgtgcggtcgcagctt

SEQ ID NO: 598103 - DNA, 25 bp, Homo sapien
gtcagacgtgcggtcgcagcttccg

SEQ ID NO: 598104 - DNA, 25 bp, Homo sapien
tcagacgtgcggtcgcagcttccgg

SEQ ID NO: 598105 - DNA, 25 bp, Homo sapien
acgtgcggtcgcagcttccggcgca

SEQ ID NO: 598106 - DNA, 25 bp, Homo sapien
tgctcgagctggaccatgagcagac

SEQ ID NO: 598107 - DNA, 25 bp, Homo sapien
gctcgagctggaccatgagcagacc

SEQ ID NO: 598108 - DNA, 25 bp, Homo sapien
tcgagctggaccatgagcagacccg

SEQ ID NO: 598109 - DNA, 25 bp, Homo sapien
gagctggaccatgagcagacccggc

SEQ ID NO: 598110 - DNA, 25 bp, Homo sapien
agctggaccatgagcagacccggcg

SEQ ID NO: 598111 - DNA, 25 bp, Homo sapien
gctggaccatgagcagacccggcgt

SEQ ID NO: 598112 - DNA, 25 bp, Homo sapien
tggaccatgagcagacccggcgtgg

SEQ ID NO: 598113 - DNA, 25 bp, Homo sapien
cagccacaccgagcctgtagagtag

SEQ ID NO: 598114 - DNA, 25 bp, Homo sapien
gccacaccgagcctgtagagtagct

SEQ ID NO: 598115 - DNA, 25 bp, Homo sapien
ccacaccgagcctgtagagtagctg

SEQ ID NO: 598116 - DNA, 25 bp, Homo sapien
cacaccgagcctgtagagtagctgc

SEQ ID NO: 598117 - DNA, 25 bp, Homo sapien
ggtgttgaccggaaatccccagagt

SEQ ID NO: 598118 - DNA, 25 bp, Homo sapien
ggaaatccccagagttgccgccagt

SEQ ID NO: 598119 - DNA, 25 bp, Homo sapien
cagagttgccgccagtggtttttcc

SEQ ID NO: 598120 - DNA, 25 bp, Homo sapien
acggtggatgcttcccgcggtcgct

SEQ ID NO: 598121 - DNA, 25 bp, Homo sapien
ctcttggtttttcccagttgtgccg

SEQ ID NO: 598122 - DNA, 25 bp, Homo sapien
tttttcccagttgtgccggattgaa

SEQ ID NO: 598123 - DNA, 25 bp, Homo sapien
gacgcggtcctgctttgctgacagt

SEQ ID NO: 598124 - DNA, 25 bp, Homo sapien
ggtcctgctttgctgacagtctgtc

SEQ ID NO: 598125 - DNA, 25 bp, Homo sapien
tgacagtctgtcttggctagttaac

SEQ ID NO: 598126 - DNA, 25 bp, Homo sapien
tggctagttaacacgcctatgtcgc

SEQ ID NO: 598127 - DNA, 25 bp, Homo sapien
acacgcctatgtcgcttattgaaac

SEQ ID NO: 598128 - DNA, 25 bp, Homo sapien
ggaagcagatctaagcacacatggg

SEQ ID NO: 598129 - DNA, 25 bp, Homo sapien
gaagcagatctaagcacacatgggc

SEQ ID NO: 598130 - DNA, 25 bp, Homo sapien
aagcagatctaagcacacatgggca

SEQ ID NO: 598131 - DNA, 25 bp, Homo sapien
agcagatctaagcacacatgggcat

SEQ ID NO: 598132 - DNA, 25 bp, Homo sapien
gcagatctaagcacacatgggcatc

SEQ ID NO: 598133 - DNA, 25 bp, Homo sapien
cagatctaagcacacatgggcatca

SEQ ID NO: 598134 - DNA, 25 bp, Homo sapien
agatctaagcacacatgggcatcaa

SEQ ID NO: 598135 - DNA, 25 bp, Homo sapien
gatctaagcacacatgggcatcaaa

SEQ ID NO: 598136 - DNA, 25 bp, Homo sapien
atctaagcacacatgggcatcaaac

SEQ ID NO: 598137 - DNA, 25 bp, Homo sapien
ctaagcacacatgggcatcaaacca

SEQ ID NO: 598138 - DNA, 25 bp, Homo sapien
gaacaaagtcacatgcagagggctg

SEQ ID NO: 598139 - DNA, 25 bp, Homo sapien
agtgagcttccttcaagttcacagt

SEQ ID NO: 598140 - DNA, 25 bp, Homo sapien
agttcacagtgagagccaaagtcct

SEQ ID NO: 598141 - DNA, 25 bp, Homo sapien
gtgagagccaaagtcctcttcatga

SEQ ID NO: 598142 - DNA, 25 bp, Homo sapien
gccaaagtcctcttcatgacatata

SEQ ID NO: 598143 - DNA, 25 bp, Homo sapien
catgacatataagagactgcacagt

SEQ ID NO: 598144 - DNA, 25 bp, Homo sapien
gagactgcacagtgtggctgctttt

SEQ ID NO: 598145 - DNA, 25 bp, Homo sapien
cacagtgtggctgcttttccataat

SEQ ID NO: 598146 - DNA, 25 bp, Homo sapien
gtggctgcttttccataatttttgg

SEQ ID NO: 598147 - DNA, 25 bp, Homo sapien
ttttgggacgcacaaatgtctgcat

SEQ ID NO: 598148 - DNA, 25 bp, Homo sapien
ggacgcacaaatgtctgcatgattt

SEQ ID NO: 598149 - DNA, 25 bp, Homo sapien
gtctgagagtaatagtttctgttga

SEQ ID NO: 598150 - DNA, 25 bp, Homo sapien
caaaaagttaccttgtgacctagca

SEQ ID NO: 598151 - DNA, 25 bp, Homo sapien
aaagttaccttgtgacctagcaatc

SEQ ID NO: 598152 - DNA, 25 bp, Homo sapien
agttaccttgtgacctagcaatccc

SEQ ID NO: 598153 - DNA, 25 bp, Homo sapien
ctagcaatcccattcgaagagagtt

SEQ ID NO: 598154 - DNA, 25 bp, Homo sapien
aatgttcctcagctgatgagtgggt

SEQ ID NO: 598155 - DNA, 25 bp, Homo sapien
gttcctcagctgatgagtgggtaaa

SEQ ID NO: 598156 - DNA, 25 bp, Homo sapien
atgagtgggtaaataaacgtggtat

SEQ ID NO: 598157 - DNA, 25 bp, Homo sapien
tggagaaatcaaacccttacacatt

SEQ ID NO: 598158 - DNA, 25 bp, Homo sapien
gaaatcaaacccttacacattgttg

SEQ ID NO: 598159 - DNA, 25 bp, Homo sapien
caaacccttacacattgttgatgag

SEQ ID NO: 598160 - DNA, 25 bp, Homo sapien
ctggcagttcttcagagttaaaaca

SEQ ID NO: 598161 - DNA, 25 bp, Homo sapien
acatctgatcttgatactggcttat

SEQ ID NO: 598162 - DNA, 25 bp, Homo sapien
tcttgatactggcttatgttgtctc

SEQ ID NO: 598163 - DNA, 25 bp, Homo sapien
atgttgtctcttgttaagcttttgc

SEQ ID NO: 598164 - DNA, 25 bp, Homo sapien
gcttctttgcattattcatgaccat

SEQ ID NO: 598165 - DNA, 25 bp, Homo sapien
atagccatacaggtaggattattac

SEQ ID NO: 598166 - DNA, 25 bp, Homo sapien
ggattattaccaagtgcctaccgtg

SEQ ID NO: 598167 - DNA, 25 bp, Homo sapien
gtgcctaccgtgtaccaggaatagt

SEQ ID NO: 598168 - DNA, 25 bp, Homo sapien
gtaccaggaatagttctaagccttg

SEQ ID NO: 598169 - DNA, 25 bp, Homo sapien
ctaagccttgagaatacagcactaa

SEQ ID NO: 598170 - DNA, 25 bp, Homo sapien
tacagcactaataaggcagactccc

SEQ ID NO: 598171 - DNA, 25 bp, Homo sapien
ggcagactccctgctcaaatagagc

SEQ ID NO: 598172 - DNA, 25 bp, Homo sapien
caaggaggatcccgctcacctgtct

SEQ ID NO: 598173 - DNA, 25 bp, Homo sapien
ggctccatcgtgtccttcaaaagtg

SEQ ID NO: 598174 - DNA, 25 bp, Homo sapien
ccatcgtgtccttcaaaagtgctga

SEQ ID NO: 598175 - DNA, 25 bp, Homo sapien
gtccttcaaaagtgctgacagcatc

SEQ ID NO: 598176 - DNA, 25 bp, Homo sapien
gtgctgacagcatcaaaagtcgacc

SEQ ID NO: 598177 - DNA, 25 bp, Homo sapien
tcaaaagtcgaccaggaatcccacg

SEQ ID NO: 598178 - DNA, 25 bp, Homo sapien
aggaatcccacgacttgcgggtgac

SEQ ID NO: 598179 - DNA, 25 bp, Homo sapien
ttgcgggtgacggtggcgagcgaac

SEQ ID NO: 598180 - DNA, 25 bp, Homo sapien
gaacgtcccccgagcggagagagcc

SEQ ID NO: 598181 - DNA, 25 bp, Homo sapien
gaaagacgacgatgttgcgagcata

SEQ ID NO: 598182 - DNA, 25 bp, Homo sapien
gacgacgatgttgcgagcataatga

SEQ ID NO: 598183 - DNA, 25 bp, Homo sapien
ttagggccagccaggcgtagtggct

SEQ ID NO: 598184 - DNA, 25 bp, Homo sapien
tagggccagccaggcgtagtggctc

SEQ ID NO: 598185 - DNA, 25 bp, Homo sapien
agggccagccaggcgtagtggctca

SEQ ID NO: 598186 - DNA, 25 bp, Homo sapien
gggccagccaggcgtagtggctcat

SEQ ID NO: 598187 - DNA, 25 bp, Homo sapien
ggccagccaggcgtagtggctcatg

SEQ ID NO: 598188 - DNA, 25 bp, Homo sapien
gccagccaggcgtagtggctcatgc

SEQ ID NO: 598189 - DNA, 25 bp, Homo sapien
ccagccaggcgtagtggctcatgcc

SEQ ID NO: 598190 - DNA, 25 bp, Homo sapien
gaggtcaggagttcagcctggccaa

SEQ ID NO: 598191 - DNA, 25 bp, Homo sapien
aggtcaggagttcagcctggccaat

SEQ ID NO: 598192 - DNA, 25 bp, Homo sapien
ggtcaggagttcagcctggccaata

SEQ ID NO: 598193 - DNA, 25 bp, Homo sapien
gtcaggagttcagcctggccaatat

SEQ ID NO: 598194 - DNA, 25 bp, Homo sapien
aacacatgctccaacttggactaga

SEQ ID NO: 598195 - DNA, 25 bp, Homo sapien
ggactagaatgtccttctctctggt

SEQ ID NO: 598196 - DNA, 25 bp, Homo sapien
tctctggtctcagttaactctgtcc

SEQ ID NO: 598197 - DNA, 25 bp, Homo sapien
tcagttaactctgtccctcaggtct

SEQ ID NO: 598198 - DNA, 25 bp, Homo sapien
cctcaggtctcagtgcagaagtcac

SEQ ID NO: 598199 - DNA, 25 bp, Homo sapien
ggtctcagtgcagaagtcacctcca

SEQ ID NO: 598200 - DNA, 25 bp, Homo sapien
tgcagaagtcacctccaccacgaag

SEQ ID NO: 598201 - DNA, 25 bp, Homo sapien
tgtctgaccctctgttttaaacttt

SEQ ID NO: 598202 - DNA, 25 bp, Homo sapien
taaactttttcctactgtaaatatg

SEQ ID NO: 598203 - DNA, 25 bp, Homo sapien
gtaaatatgtcccattttctgaaaa

SEQ ID NO: 598204 - DNA, 25 bp, Homo sapien
gctttcagagccatttatttatcta

SEQ ID NO: 598205 - DNA, 25 bp, Homo sapien
gtctggttttcaaagtggcgtaatg

SEQ ID NO: 598206 - DNA, 25 bp, Homo sapien
aaagtggcgtaatgcattgccctcc

SEQ ID NO: 598207 - DNA, 25 bp, Homo sapien
taatgcattgccctcccatcaggga

SEQ ID NO: 598208 - DNA, 25 bp, Homo sapien
tgccctcccatcagggatgtgtgag

SEQ ID NO: 598209 - DNA, 25 bp, Homo sapien
tcagggatgtgtgagacttccattt

SEQ ID NO: 598210 - DNA, 25 bp, Homo sapien
ggatgtgtgagacttccatttgttc

SEQ ID NO: 598211 - DNA, 25 bp, Homo sapien
gtgtgagacttccatttgttctact

SEQ ID NO: 598212 - DNA, 25 bp, Homo sapien
tgttctactttttgcacaacacttg

SEQ ID NO: 598213 - DNA, 25 bp, Homo sapien
aaccttttattatgagctattacct

SEQ ID NO: 598214 - DNA, 25 bp, Homo sapien
gctattacctacatatggaaaaatg

SEQ ID NO: 598215 - DNA, 25 bp, Homo sapien
aatgcataaaacaaggccgggagca

SEQ ID NO: 598216 - DNA, 25 bp, Homo sapien
aatttaataaatctccctgcttctt

SEQ ID NO: 598217 - DNA, 25 bp, Homo sapien
cctgcttcttttcttttgcatcata

SEQ ID NO: 598218 - DNA, 25 bp, Homo sapien
ttttgcatcataacaaccactgaaa

SEQ ID NO: 598219 - DNA, 25 bp, Homo sapien
aaataatatttctatggcagttggg

SEQ ID NO: 598220 - DNA, 25 bp, Homo sapien
caatagcttttgtgaccagaggtga

SEQ ID NO: 598221 - DNA, 25 bp, Homo sapien
acagctgagggcatcggtatttcca

SEQ ID NO: 598222 - DNA, 25 bp, Homo sapien
atcggtatttccacacacctataat

SEQ ID NO: 598223 - DNA, 25 bp, Homo sapien
tttccacacacctataatgtacagt

SEQ ID NO: 598224 - DNA, 25 bp, Homo sapien
cagtgccccagaacagagatcggat

SEQ ID NO: 598225 - DNA, 25 bp, Homo sapien
gagatcggatgctctgctttattca

SEQ ID NO: 598226 - DNA, 25 bp, Homo sapien
ggatgctctgctttattcagatggg

SEQ ID NO: 598227 - DNA, 25 bp, Homo sapien
gagtctggcagaaacaatggaacaa

SEQ ID NO: 598228 - DNA, 25 bp, Homo sapien
aacgggaaacaaccattgatcctga

SEQ ID NO: 598229 - DNA, 25 bp, Homo sapien
cattgatcctgaggaagacctgaac

SEQ ID NO: 598230 - DNA, 25 bp, Homo sapien
agacctgaacaaactagatgacaag

SEQ ID NO: 598231 - DNA, 25 bp, Homo sapien
ctagatgacaaggagcttgccaaaa

SEQ ID NO: 598232 - DNA, 25 bp, Homo sapien
tgacattgaggttgaatttccacag

SEQ ID NO: 598233 - DNA, 25 bp, Homo sapien
atttccacaggacgatcaactgcag

SEQ ID NO: 598234 - DNA, 25 bp, Homo sapien
atcaactgcagtcctgtggctggga

SEQ ID NO: 598235 - DNA, 25 bp, Homo sapien
tgggacacagagtcagctgatgagt

SEQ ID NO: 598236 - DNA, 25 bp, Homo sapien
agttctgataccaaacactcaaaac

SEQ ID NO: 598237 - DNA, 25 bp, Homo sapien
cactcaaaacatgcattgggctagc

SEQ ID NO: 598238 - DNA, 25 bp, Homo sapien
aggcgctgctccacgatccgtacaa

SEQ ID NO: 598239 - DNA, 25 bp, Homo sapien
gtacaatctcatttaacccctgcaa

SEQ ID NO: 598240 - DNA, 25 bp, Homo sapien
cactacgatcctctttctataggta

SEQ ID NO: 598241 - DNA, 25 bp, Homo sapien
tgaggctcacagcagctgcgtagtt

SEQ ID NO: 598242 - DNA, 25 bp, Homo sapien
gcagctgcgtagtttaccttaaggt

SEQ ID NO: 598243 - DNA, 25 bp, Homo sapien
aaattcaattgcagtggtgtattct

SEQ ID NO: 598244 - DNA, 25 bp, Homo sapien
gtccgaggtcttaaaccctactctg

SEQ ID NO: 598245 - DNA, 25 bp, Homo sapien
tactctgctcccttatcaggattca

SEQ ID NO: 598246 - DNA, 25 bp, Homo sapien
cttatcaggattcaggctcagggaa

SEQ ID NO: 598247 - DNA, 25 bp, Homo sapien
gaataaacccgggacagctaggaga

SEQ ID NO: 598248 - DNA, 25 bp, Homo sapien
tgtcgccggctagtaggcctgaaga

SEQ ID NO: 598249 - DNA, 25 bp, Homo sapien
gaatgttgctggctcataccttgag

SEQ ID NO: 598250 - DNA, 25 bp, Homo sapien
ttgctggctcataccttgaggccaa

SEQ ID NO: 598251 - DNA, 25 bp, Homo sapien
ataccttgaggccaatatctccggc

SEQ ID NO: 598252 - DNA, 25 bp, Homo sapien
gaggccaatatctccggctccggat

SEQ ID NO: 598253 - DNA, 25 bp, Homo sapien
ggatccactcaatttctctcagaag

SEQ ID NO: 598254 - DNA, 25 bp, Homo sapien
aatttctctcagaaggctgcaaaag

SEQ ID NO: 598255 - DNA, 25 bp, Homo sapien
tgtcaagaggtcatatatatagcat

SEQ ID NO: 598256 - DNA, 25 bp, Homo sapien
tagcatgaataaccagaagcatatt

SEQ ID NO: 598257 - DNA, 25 bp, Homo sapien
gaaactcactgcaggattccatgga

SEQ ID NO: 598258 - DNA, 25 bp, Homo sapien
actgcaggattccatggattccatg

SEQ ID NO: 598259 - DNA, 25 bp, Homo sapien
agaagatcccaggtggatcaccctt

SEQ ID NO: 598260 - DNA, 25 bp, Homo sapien
ctccctttctgttaagtcaaatcta

SEQ ID NO: 598261 - DNA, 25 bp, Homo sapien
gagttagttagcaactattcctaaa

SEQ ID NO: 598262 - DNA, 25 bp, Homo sapien
gaatatgtattaagctttcagctct

SEQ ID NO: 598263 - DNA, 25 bp, Homo sapien
agctttcagctctttagtaatgata

SEQ ID NO: 598264 - DNA, 25 bp, Homo sapien
atttttctctctaacactgtcaatt

SEQ ID NO: 598265 - DNA, 25 bp, Homo sapien
gttattctgatgactctttgaagaa

SEQ ID NO: 598266 - DNA, 25 bp, Homo sapien
gatacaattataacgttagctaaga

SEQ ID NO: 598267 - DNA, 25 bp, Homo sapien
gaagcatattgtaagtctttagaat

SEQ ID NO: 598268 - DNA, 25 bp, Homo sapien
acatctttaatcataaacctgtttc

SEQ ID NO: 598269 - DNA, 25 bp, Homo sapien
gtttcattgtaagacctccctttct

SEQ ID NO: 598270 - DNA, 25 bp, Homo sapien
taagacctccctttctgttaagtca

SEQ ID NO: 598271 - DNA, 25 bp, Homo sapien
ttggacggccccagtgaccctcagt

SEQ ID NO: 598272 - DNA, 25 bp, Homo sapien
ggacggccccagtgaccctcagtga

SEQ ID NO: 598273 - DNA, 25 bp, Homo sapien
actcactcagtgcttccctggaaag

SEQ ID NO: 598274 - DNA, 25 bp, Homo sapien
tccaggcagacccatcactggaagt

SEQ ID NO: 598275 - DNA, 25 bp, Homo sapien
caggcagacccatcactggaagtgg

SEQ ID NO: 598276 - DNA, 25 bp, Homo sapien
ggcagacccatcactggaagtggga

SEQ ID NO: 598277 - DNA, 25 bp, Homo sapien
gcagacccatcactggaagtgggat

SEQ ID NO: 598278 - DNA, 25 bp, Homo sapien
agacccatcactggaagtgggattt

SEQ ID NO: 598279 - DNA, 25 bp, Homo sapien
acccatcactggaagtgggatttga

SEQ ID NO: 598280 - DNA, 25 bp, Homo sapien
cactggaagtgggatttgaaatgca

SEQ ID NO: 598281 - DNA, 25 bp, Homo sapien
ggaagtgggatttgaaatgcagcca

SEQ ID NO: 598282 - DNA, 25 bp, Homo sapien
ctccctccccactaatattaatttg

SEQ ID NO: 598283 - DNA, 25 bp, Homo sapien
aaaagtctggacttgcttggtggct

SEQ ID NO: 598284 - DNA, 25 bp, Homo sapien
aaagtctggacttgcttggtggctc

SEQ ID NO: 598285 - DNA, 25 bp, Homo sapien
gtctggacttgcttggtggctcatg

SEQ ID NO: 598286 - DNA, 25 bp, Homo sapien
gcctgtaatactaatactttggtag

SEQ ID NO: 598287 - DNA, 25 bp, Homo sapien
gtaatactaatactttggtaggtca

SEQ ID NO: 598288 - DNA, 25 bp, Homo sapien
tactaatactttggtaggtcaaggc

SEQ ID NO: 598289 - DNA, 25 bp, Homo sapien
ctaatactttggtaggtcaaggcaa

SEQ ID NO: 598290 - DNA, 25 bp, Homo sapien
taatactttggtaggtcaaggcaaa

SEQ ID NO: 598291 - DNA, 25 bp, Homo sapien
tactttggtaggtcaaggcaaaagg

SEQ ID NO: 598292 - DNA, 25 bp, Homo sapien
aaaaaagctagctaggcatagtggc

SEQ ID NO: 598293 - DNA, 25 bp, Homo sapien
tggcttccttgggtaggtgaggaag

SEQ ID NO: 598294 - DNA, 25 bp, Homo sapien
gttccctggccctttggacttcctg

SEQ ID NO: 598295 - DNA, 25 bp, Homo sapien
gccctttggacttcctgggtgaggt

SEQ ID NO: 598296 - DNA, 25 bp, Homo sapien
ctttggacttcctgggtgaggtgat

SEQ ID NO: 598297 - DNA, 25 bp, Homo sapien
tgcttcagcttaccctccgtgggct

SEQ ID NO: 598298 - DNA, 25 bp, Homo sapien
ggccatcttgccagctgtctctatc

SEQ ID NO: 598299 - DNA, 25 bp, Homo sapien
ccatcttgccagctgtctctatcga

SEQ ID NO: 598300 - DNA, 25 bp, Homo sapien
atcttgccagctgtctctatcgact

SEQ ID NO: 598301 - DNA, 25 bp, Homo sapien
tcttgccagctgtctctatcgacta

SEQ ID NO: 598302 - DNA, 25 bp, Homo sapien
cttgccagctgtctctatcgactac

SEQ ID NO: 598303 - DNA, 25 bp, Homo sapien
ttgccagctgtctctatcgactacc

SEQ ID NO: 598304 - DNA, 25 bp, Homo sapien
ccttgctggctttgggcccaagttt

SEQ ID NO: 598305 - DNA, 25 bp, Homo sapien
tgggcccaagtttgatgtttatgag

SEQ ID NO: 598306 - DNA, 25 bp, Homo sapien
gaggatgattgctggtttcccttac

SEQ ID NO: 598307 - DNA, 25 bp, Homo sapien
tggtttcccttacacatagcagagc

SEQ ID NO: 598308 - DNA, 25 bp, Homo sapien
atagcagagctcactcagttctcac

SEQ ID NO: 598309 - DNA, 25 bp, Homo sapien
tcactcagttctcacagtagccaaa

SEQ ID NO: 598310 - DNA, 25 bp, Homo sapien
caaatgaagcagttatgtgttgtcc

SEQ ID NO: 598311 - DNA, 25 bp, Homo sapien
gttttccagaccaggactgaaatcc

SEQ ID NO: 598312 - DNA, 25 bp, Homo sapien
ggaatttggccccatgatgaagcca

SEQ ID NO: 598313 - DNA, 25 bp, Homo sapien
gaagccaaatctgaacccatgtcct

SEQ ID NO: 598314 - DNA, 25 bp, Homo sapien
acccatgtcctcacttcaaggttat

SEQ ID NO: 598315 - DNA, 25 bp, Homo sapien
tcctacctttccattgggcttaagt

SEQ ID NO: 598316 - DNA, 25 bp, Homo sapien
gaaactttgacatttgctattccgt

SEQ ID NO: 598317 - DNA, 25 bp, Homo sapien
gacatttgctattccgttggcgcct

SEQ ID NO: 598318 - DNA, 25 bp, Homo sapien
acctctgccctgtaaggtggccagg

SEQ ID NO: 598319 - DNA, 25 bp, Homo sapien
gtggccaggagttgtatttctgctt

SEQ ID NO: 598320 - DNA, 25 bp, Homo sapien
atttctgctttgctaggagggaact

SEQ ID NO: 598321 - DNA, 25 bp, Homo sapien
ctggctgggaagttctatgatgaac

SEQ ID NO: 598322 - DNA, 25 bp, Homo sapien
atgatgaacgctttgctgacagcag

SEQ ID NO: 598323 - DNA, 25 bp, Homo sapien
gctgacagcaggtgcattcctgctt

SEQ ID NO: 598324 - DNA, 25 bp, Homo sapien
ccatcctttctgcaattacagccat

SEQ ID NO: 598325 - DNA, 25 bp, Homo sapien
tgcaattacagccattttgggtccc

SEQ ID NO: 598326 - DNA, 25 bp, Homo sapien
tcaatggcagggaaggttgcctgta

SEQ ID NO: 598327 - DNA, 25 bp, Homo sapien
tgcctgtagccagcactgcagattc

SEQ ID NO: 598328 - DNA, 25 bp, Homo sapien
ctgtagccagcactgcagattcagg

SEQ ID NO: 598329 - DNA, 25 bp, Homo sapien
ctgcagattcaggacttagaaacgt

SEQ ID NO: 598330 - DNA, 25 bp, Homo sapien
gattcaggacttagaaacgtgcctc

SEQ ID NO: 598331 - DNA, 25 bp, Homo sapien
ttcaggacttagaaacgtgcctctg

SEQ ID NO: 598332 - DNA, 25 bp, Homo sapien
caggacttagaaacgtgcctctggg

SEQ ID NO: 598333 - DNA, 25 bp, Homo sapien
gaaacgtgcctctggggccgagcat

SEQ ID NO: 598334 - DNA, 25 bp, Homo sapien
ggtggatcacgtgtgatcaggagat

SEQ ID NO: 598335 - DNA, 25 bp, Homo sapien
gggaaacagtcttcactaaacatac

SEQ ID NO: 598336 - DNA, 25 bp, Homo sapien
gaaacagtcttcactaaacatacaa

SEQ ID NO: 598337 - DNA, 25 bp, Homo sapien
tcctgcctggagtacgcagcagctc

SEQ ID NO: 598338 - DNA, 25 bp, Homo sapien
tggagtacgcagcagctcctacctg

SEQ ID NO: 598339 - DNA, 25 bp, Homo sapien
ggagtacgcagcagctcctacctgg

SEQ ID NO: 598340 - DNA, 25 bp, Homo sapien
ggcactcttcagtggccctctagtg

SEQ ID NO: 598341 - DNA, 25 bp, Homo sapien
tcactgtagcctctaccacctggac

SEQ ID NO: 598342 - DNA, 25 bp, Homo sapien
cagtgatgtttcagcctgcttccac

SEQ ID NO: 598343 - DNA, 25 bp, Homo sapien
agtgatgtttcagcctgcttccact

SEQ ID NO: 598344 - DNA, 25 bp, Homo sapien
tgatgtttcagcctgcttccactct

SEQ ID NO: 598345 - DNA, 25 bp, Homo sapien
tgcttccactctcccgtgctcagga

SEQ ID NO: 598346 - DNA, 25 bp, Homo sapien
gccttggttcagtcactttcatgta

SEQ ID NO: 598347 - DNA, 25 bp, Homo sapien
ccttggttcagtcactttcatgtaa

SEQ ID NO: 598348 - DNA, 25 bp, Homo sapien
taccgcacaccgactctggagagtg

SEQ ID NO: 598349 - DNA, 25 bp, Homo sapien
gtgacttggagcctccaaattccaa

SEQ ID NO: 598350 - DNA, 25 bp, Homo sapien
aaattccaagcttcctgtgtgcgag

SEQ ID NO: 598351 - DNA, 25 bp, Homo sapien
gcgagtgaggctagcaaaccacatt

SEQ ID NO: 598352 - DNA, 25 bp, Homo sapien
aaccacattgagtaggacagcctga

SEQ ID NO: 598353 - DNA, 25 bp, Homo sapien
gacagcctgagggttaagttacacc

SEQ ID NO: 598354 - DNA, 25 bp, Homo sapien
tgatgcatggttctaacttgcccgg

SEQ ID NO: 598355 - DNA, 25 bp, Homo sapien
acttgcccgggcttgatattcaaaa

SEQ ID NO: 598356 - DNA, 25 bp, Homo sapien
aaagatgtctattccttttccattt

SEQ ID NO: 598357 - DNA, 25 bp, Homo sapien
ttaagacccttttgcaacactctgt

SEQ ID NO: 598358 - DNA, 25 bp, Homo sapien
aacactctgttttaacatggtgctt

SEQ ID NO: 598359 - DNA, 25 bp, Homo sapien
gtcctaggtactctactcgagaggc

SEQ ID NO: 598360 - DNA, 25 bp, Homo sapien
tcctaggtactctactcgagaggct

SEQ ID NO: 598361 - DNA, 25 bp, Homo sapien
cctaggtactctactcgagaggctg

SEQ ID NO: 598362 - DNA, 25 bp, Homo sapien
tttatttgaaaatcttcctgggccg

SEQ ID NO: 598363 - DNA, 25 bp, Homo sapien
ttatttgaaaatcttcctgggccgg

SEQ ID NO: 598364 - DNA, 25 bp, Homo sapien
tatttgaaaatcttcctgggccggg

SEQ ID NO: 598365 - DNA, 25 bp, Homo sapien
ttgaaaatcttcctgggccgggcat

SEQ ID NO: 598366 - DNA, 25 bp, Homo sapien
tgaaaatcttcctgggccgggcatg

SEQ ID NO: 598367 - DNA, 25 bp, Homo sapien
gaaaatcttcctgggccgggcatgg

SEQ ID NO: 598368 - DNA, 25 bp, Homo sapien
gaaatcccgtctatactaaagatag

SEQ ID NO: 598369 - DNA, 25 bp, Homo sapien
ggtcatggtgttgtgcatctgtagt

SEQ ID NO: 598370 - DNA, 25 bp, Homo sapien
ggaggtcaggtccaatgaataaaag

SEQ ID NO: 598371 - DNA, 25 bp, Homo sapien
gtgactttcaccttcatagagaaac

SEQ ID NO: 598372 - DNA, 25 bp, Homo sapien
ttcaccttcatagagaaacagcgat

SEQ ID NO: 598373 - DNA, 25 bp, Homo sapien
gagaaacagcgatgaaccgccttta

SEQ ID NO: 598374 - DNA, 25 bp, Homo sapien
aacagcgatgaaccgcctttaaggg

SEQ ID NO: 598375 - DNA, 25 bp, Homo sapien
gcgatgaaccgcctttaagggactt

SEQ ID NO: 598376 - DNA, 25 bp, Homo sapien
tgctctctgcacattcaggaactgt

SEQ ID NO: 598377 - DNA, 25 bp, Homo sapien
ggaactgtttctggctcactgagac

SEQ ID NO: 598378 - DNA, 25 bp, Homo sapien
aactgtttctggctcactgagactc

SEQ ID NO: 598379 - DNA, 25 bp, Homo sapien
actgtttctggctcactgagactca

SEQ ID NO: 598380 - DNA, 25 bp, Homo sapien
tctgtcccattatttctctctgtct

SEQ ID NO: 598381 - DNA, 25 bp, Homo sapien
gttttacttatctatgtatacagtg

SEQ ID NO: 598382 - DNA, 25 bp, Homo sapien
atacagtgtatctaaaggacaaacg

SEQ ID NO: 598383 - DNA, 25 bp, Homo sapien
gacaaacgagtcctaatttacaaca

SEQ ID NO: 598384 - DNA, 25 bp, Homo sapien
atttacaacagctagtctttccaga

SEQ ID NO: 598385 - DNA, 25 bp, Homo sapien
gaacttctatcaatagagtaaccta

SEQ ID NO: 598386 - DNA, 25 bp, Homo sapien
gtaacctatcactagagttcacctc

SEQ ID NO: 598387 - DNA, 25 bp, Homo sapien
tagagttcacctctatcaatagagt

SEQ ID NO: 598388 - DNA, 25 bp, Homo sapien
atagagtaacctcattctctgcctg

SEQ ID NO: 598389 - DNA, 25 bp, Homo sapien
agtaacctcattctctgcctgatga

SEQ ID NO: 598390 - DNA, 25 bp, Homo sapien
cattctctgcctgatgattcaaagg

SEQ ID NO: 598391 - DNA, 25 bp, Homo sapien
gaccaaaaccatgtggcagttcctg

SEQ ID NO: 598392 - DNA, 25 bp, Homo sapien
ttgatctgtgctaacatgaccgcct

SEQ ID NO: 598393 - DNA, 25 bp, Homo sapien
taacatgaccgcctgcagaagcaga

SEQ ID NO: 598394 - DNA, 25 bp, Homo sapien
aaagctgaaagcttggagtcaccaa

SEQ ID NO: 598395 - DNA, 25 bp, Homo sapien
ggagtcaccaaaccatagatagctt

SEQ ID NO: 598396 - DNA, 25 bp, Homo sapien
gatagcttcacctcttaccaagtgc

SEQ ID NO: 598397 - DNA, 25 bp, Homo sapien
caagtgcttgatgtgtggctaggtt

SEQ ID NO: 598398 - DNA, 25 bp, Homo sapien
gtgtggctaggttcttaaatcccct

SEQ ID NO: 598399 - DNA, 25 bp, Homo sapien
ttaaatcccctacaagttccagctt

SEQ ID NO: 598400 - DNA, 25 bp, Homo sapien
gcaagttaagactgggtgagttaat

SEQ ID NO: 598401 - DNA, 25 bp, Homo sapien
gtacttagtacagtactctacaaat

SEQ ID NO: 598402 - DNA, 25 bp, Homo sapien
ctacaaatagtaagtgcccaataaa

SEQ ID NO: 598403 - DNA, 25 bp, Homo sapien
caaaggttgccagatagcagggact

SEQ ID NO: 598404 - DNA, 25 bp, Homo sapien
tctttgctgagctttggtcataact

SEQ ID NO: 598405 - DNA, 25 bp, Homo sapien
gagctttggtcataactatttgtag

SEQ ID NO: 598406 - DNA, 25 bp, Homo sapien
ataactatttgtagaggacccctag

SEQ ID NO: 598407 - DNA, 25 bp, Homo sapien
tatttgtagaggacccctagacttt

SEQ ID NO: 598408 - DNA, 25 bp, Homo sapien
aaagtgatccaaaacatactgtctt

SEQ ID NO: 598409 - DNA, 25 bp, Homo sapien
tactgtcttcagtttttgagcattg

SEQ ID NO: 598410 - DNA, 25 bp, Homo sapien
cagtttttgagcattggactaccaa

SEQ ID NO: 598411 - DNA, 25 bp, Homo sapien
ttggactaccaaacaggaacattta

SEQ ID NO: 598412 - DNA, 25 bp, Homo sapien
gttgctgttgtaaagccttgatggt

SEQ ID NO: 598413 - DNA, 25 bp, Homo sapien
aagccttgatggtgggaagttatgt

SEQ ID NO: 598414 - DNA, 25 bp, Homo sapien
ctccagtcctgttcacagggcattt

SEQ ID NO: 598415 - DNA, 25 bp, Homo sapien
agggcattttcacctgctggcactt

SEQ ID NO: 598416 - DNA, 25 bp, Homo sapien
gctggcacttccaaagtgacacttc

SEQ ID NO: 598417 - DNA, 25 bp, Homo sapien
aagtgacacttccaaaccacttcct

SEQ ID NO: 598418 - DNA, 25 bp, Homo sapien
tctctaaaccaggtctttcttccta

SEQ ID NO: 598419 - DNA, 25 bp, Homo sapien
gagaatgtctctgccatgttctaaa

SEQ ID NO: 598420 - DNA, 25 bp, Homo sapien
gtctctgccatgttctaaactgaaa

SEQ ID NO: 598421 - DNA, 25 bp, Homo sapien
tgttctaaactgaaaacctcctagt

SEQ ID NO: 598422 - DNA, 25 bp, Homo sapien
aaaacctcctagtcaacttcacact

SEQ ID NO: 598423 - DNA, 25 bp, Homo sapien
tcaacttcacactttattccctgat

SEQ ID NO: 598424 - DNA, 25 bp, Homo sapien
gattcctgttttcagctccagtcct

SEQ ID NO: 598425 - DNA, 25 bp, Homo sapien
ttagccccttacacagtgcctgaaa

SEQ ID NO: 598426 - DNA, 25 bp, Homo sapien
gtgcctgaaacatataagaggcagt

SEQ ID NO: 598427 - DNA, 25 bp, Homo sapien
gaaacatataagaggcagtgaataa

SEQ ID NO: 598428 - DNA, 25 bp, Homo sapien
atataagaggcagtgaataaatgct

SEQ ID NO: 598429 - DNA, 25 bp, Homo sapien
ataaatgcttattgagtgattacat

SEQ ID NO: 598430 - DNA, 25 bp, Homo sapien
aaatgcttattgagtgattacataa

SEQ ID NO: 598431 - DNA, 25 bp, Homo sapien
aatgcttattgagtgattacataaa

SEQ ID NO: 598432 - DNA, 25 bp, Homo sapien
atgcttattgagtgattacataaag

SEQ ID NO: 598433 - DNA, 25 bp, Homo sapien
gcttattgagtgattacataaagag

SEQ ID NO: 598434 - DNA, 25 bp, Homo sapien
tattgagtgattacataaagagatg

SEQ ID NO: 598435 - DNA, 25 bp, Homo sapien
cataaagagatgaatgggaggctga

SEQ ID NO: 598436 - DNA, 25 bp, Homo sapien
taatacattagtcagaatttttcca

SEQ ID NO: 598437 - DNA, 25 bp, Homo sapien
gaatttttccatttccgtgttcaga

SEQ ID NO: 598438 - DNA, 25 bp, Homo sapien
ttttccatttccgtgttcagattaa

SEQ ID NO: 598439 - DNA, 25 bp, Homo sapien
tccatttccgtgttcagattaatct

SEQ ID NO: 598440 - DNA, 25 bp, Homo sapien
tttacctgtctttgttaacaggtat

SEQ ID NO: 598441 - DNA, 25 bp, Homo sapien
atgcttttaacttcttaactcctag

SEQ ID NO: 598442 - DNA, 25 bp, Homo sapien
taacttcttaactcctagtacatga

SEQ ID NO: 598443 - DNA, 25 bp, Homo sapien
ggtagtaatcatgacatagccaaat

SEQ ID NO: 598444 - DNA, 25 bp, Homo sapien
gccacaaagcatgtagttccttgta

SEQ ID NO: 598445 - DNA, 25 bp, Homo sapien
gcatgtagttccttgtaaatccttg

SEQ ID NO: 598446 - DNA, 25 bp, Homo sapien
tgagaaaggtaaattatctctctct

SEQ ID NO: 598447 - DNA, 25 bp, Homo sapien
tatttaatcctcatgacagcccctg

SEQ ID NO: 598448 - DNA, 25 bp, Homo sapien
taatcctcatgacagcccctgaagt

SEQ ID NO: 598449 - DNA, 25 bp, Homo sapien
tcatgacagcccctgaagtaggtgt

SEQ ID NO: 598450 - DNA, 25 bp, Homo sapien
gacagcccctgaagtaggtgttact

SEQ ID NO: 598451 - DNA, 25 bp, Homo sapien
cagcccctgaagtaggtgttacttt

SEQ ID NO: 598452 - DNA, 25 bp, Homo sapien
acagataaagactctgaggtttgga

SEQ ID NO: 598453 - DNA, 25 bp, Homo sapien
gatttgatcaatgtcacatggtagt

SEQ ID NO: 598454 - DNA, 25 bp, Homo sapien
ggtagtgagtgaggccaagaatcat

SEQ ID NO: 598455 - DNA, 25 bp, Homo sapien
gtgaggccaagaatcatagtttcat

SEQ ID NO: 598456 - DNA, 25 bp, Homo sapien
ggccaagaatcatagtttcatttta

SEQ ID NO: 598457 - DNA, 25 bp, Homo sapien
gtttcattttattcgagaagttggg

SEQ ID NO: 598458 - DNA, 25 bp, Homo sapien
tatgttccatctacttagggggaaa

SEQ ID NO: 598459 - DNA, 25 bp, Homo sapien
cagcaatactgctctttaaggcatt

SEQ ID NO: 598460 - DNA, 25 bp, Homo sapien
agcaatactgctctttaaggcattg

SEQ ID NO: 598461 - DNA, 25 bp, Homo sapien
gcaatactgctctttaaggcattga

SEQ ID NO: 598462 - DNA, 25 bp, Homo sapien
aatactgctctttaaggcattgaga

SEQ ID NO: 598463 - DNA, 25 bp, Homo sapien
tactgctctttaaggcattgagatg

SEQ ID NO: 598464 - DNA, 25 bp, Homo sapien
actgctctttaaggcattgagatgt

SEQ ID NO: 598465 - DNA, 25 bp, Homo sapien
gctctttaaggcattgagatgttta

SEQ ID NO: 598466 - DNA, 25 bp, Homo sapien
gtctgctgacctctccacaattatc

SEQ ID NO: 598467 - DNA, 25 bp, Homo sapien
tgctgacctctccacaattatccta

SEQ ID NO: 598468 - DNA, 25 bp, Homo sapien
ctgacctctccacaattatcctatg

SEQ ID NO: 598469 - DNA, 25 bp, Homo sapien
tcacaaaccaggactccttgctctg

SEQ ID NO: 598470 - DNA, 25 bp, Homo sapien
cctacctaccagaatgaccgtgaac

SEQ ID NO: 598471 - DNA, 25 bp, Homo sapien
ctaccagaatgaccgtgaacccttc

SEQ ID NO: 598472 - DNA, 25 bp, Homo sapien
ttccatctcctctctcagcttaggt

SEQ ID NO: 598473 - DNA, 25 bp, Homo sapien
ctcagcttaggtttccctaactgta

SEQ ID NO: 598474 - DNA, 25 bp, Homo sapien
gactaggttaaggacttcctgctat

SEQ ID NO: 598475 - DNA, 25 bp, Homo sapien
tttctctctcccacactctaaggtt

SEQ ID NO: 598476 - DNA, 25 bp, Homo sapien
tctcccacactctaaggttccttag

SEQ ID NO: 598477 - DNA, 25 bp, Homo sapien
gggcaaggatgccacttgagtccca

SEQ ID NO: 598478 - DNA, 25 bp, Homo sapien
atgccacttgagtcccagagcaact

SEQ ID NO: 598479 - DNA, 25 bp, Homo sapien
gagcaactccaatttcataggcaca

SEQ ID NO: 598480 - DNA, 25 bp, Homo sapien
agaatcagtctcttacactcataga

SEQ ID NO: 598481 - DNA, 25 bp, Homo sapien
gtctcttacactcatagaacttctt

SEQ ID NO: 598482 - DNA, 25 bp, Homo sapien
aaggaattctgctatttctcctcaa

SEQ ID NO: 598483 - DNA, 25 bp, Homo sapien
gaattctgctatttctcctcaaaag

SEQ ID NO: 598484 - DNA, 25 bp, Homo sapien
tatttctcctcaaaagatccataat

SEQ ID NO: 598485 - DNA, 25 bp, Homo sapien
aaagatccataatcagacagcaaga

SEQ ID NO: 598486 - DNA, 25 bp, Homo sapien
gacagcaagaaagagattcgttcag

SEQ ID NO: 598487 - DNA, 25 bp, Homo sapien
gattcgttcagaaatgcgttcttcc

SEQ ID NO: 598488 - DNA, 25 bp, Homo sapien
tcagaaatgcgttcttccattaaat

SEQ ID NO: 598489 - DNA, 25 bp, Homo sapien
gactatgcactcagccttagattgt

SEQ ID NO: 598490 - DNA, 25 bp, Homo sapien
gcactcagccttagattgtaagcaa

SEQ ID NO: 598491 - DNA, 25 bp, Homo sapien
aactaaacaggtctttatcaaagca

SEQ ID NO: 598492 - DNA, 25 bp, Homo sapien
aacaggtctttatcaaagcaacagg

SEQ ID NO: 598493 - DNA, 25 bp, Homo sapien
aggtctttatcaaagcaacaggaaa

SEQ ID NO: 598494 - DNA, 25 bp, Homo sapien
atgagcacttggtggcgtctgatgc

SEQ ID NO: 598495 - DNA, 25 bp, Homo sapien
gcacttggtggcgtctgatgctgaa

SEQ ID NO: 598496 - DNA, 25 bp, Homo sapien
acttggtggcgtctgatgctgaact

SEQ ID NO: 598497 - DNA, 25 bp, Homo sapien
cttggtggcgtctgatgctgaactg

SEQ ID NO: 598498 - DNA, 25 bp, Homo sapien
gtggcgtctgatgctgaactggatg

SEQ ID NO: 598499 - DNA, 25 bp, Homo sapien
tcactctgttcaagagacatgcact

SEQ ID NO: 598500 - DNA, 25 bp, Homo sapien
ctctgttcaagagacatgcactgaa

SEQ ID NO: 598501 - DNA, 25 bp, Homo sapien
aagagacatgcactgaacttctgaa

SEQ ID NO: 598502 - DNA, 25 bp, Homo sapien
ttcaaggcgctgctctgaagtggcc

SEQ ID NO: 598503 - DNA, 25 bp, Homo sapien
tgaagtggcccctccaggctctttg

SEQ ID NO: 598504 - DNA, 25 bp, Homo sapien
aggctctttggcagcctcttctcga

SEQ ID NO: 598505 - DNA, 25 bp, Homo sapien
tttggcagcctcttctcgacgtctc

SEQ ID NO: 598506 - DNA, 25 bp, Homo sapien
cgacgtctccttccggagctgagat

SEQ ID NO: 598507 - DNA, 25 bp, Homo sapien
agctgagatccagcccagggcgaat

SEQ ID NO: 598508 - DNA, 25 bp, Homo sapien
ccagcccagggcgaatggcgagctt

SEQ ID NO: 598509 - DNA, 25 bp, Homo sapien
aatggcgagcttggctcaggcctct

SEQ ID NO: 598510 - DNA, 25 bp, Homo sapien
ggagctgctcttcatccacttggag

SEQ ID NO: 598511 - DNA, 25 bp, Homo sapien
tcttcatccacttggagtgctgcgg

SEQ ID NO: 598512 - DNA, 25 bp, Homo sapien
ggaagaaatcaccaccggtcattct

SEQ ID NO: 598513 - DNA, 25 bp, Homo sapien
gtatgtggcactgagataccttgtg

SEQ ID NO: 598514 - DNA, 25 bp, Homo sapien
actgagataccttgtgtggacacca

SEQ ID NO: 598515 - DNA, 25 bp, Homo sapien
agataccttgtgtggacaccagggt

SEQ ID NO: 598516 - DNA, 25 bp, Homo sapien
tgagattgggtgatcagtagacatc

SEQ ID NO: 598517 - DNA, 25 bp, Homo sapien
gtagacatcacagaaaatgcaggga

SEQ ID NO: 598518 - DNA, 25 bp, Homo sapien
aagagctctggaacctgactgtcgg

SEQ ID NO: 598519 - DNA, 25 bp, Homo sapien
ttagcagcagcatgaacttaagttt

SEQ ID NO: 598520 - DNA, 25 bp, Homo sapien
aatttctctgtgctttagtttcttc

SEQ ID NO: 598521 - DNA, 25 bp, Homo sapien
ttagtttcttccactataaaatgag

SEQ ID NO: 598522 - DNA, 25 bp, Homo sapien
tgggccaaacttcaagggctattgt

SEQ ID NO: 598523 - DNA, 25 bp, Homo sapien
gattaaatgagctagaacaggtatt

SEQ ID NO: 598524 - DNA, 25 bp, Homo sapien
atgtactgcgaggaaagggcgcggt

SEQ ID NO: 598525 - DNA, 25 bp, Homo sapien
gtactgcgaggaaagggcgcggtca

SEQ ID NO: 598526 - DNA, 25 bp, Homo sapien
tactgcgaggaaagggcgcggtcag

SEQ ID NO: 598527 - DNA, 25 bp, Homo sapien
actgcgaggaaagggcgcggtcagc

SEQ ID NO: 598528 - DNA, 25 bp, Homo sapien
gaaagggcgcggtcagcccgcccca

SEQ ID NO: 598529 - DNA, 25 bp, Homo sapien
aagggcgcggtcagcccgccccagc

SEQ ID NO: 598530 - DNA, 25 bp, Homo sapien
gccccagcgacctcgtcgggccccg

SEQ ID NO: 598531 - DNA, 25 bp, Homo sapien
agcgggtggctcagtcccgggcctg

SEQ ID NO: 598532 - DNA, 25 bp, Homo sapien
gcgggtggctcagtcccgggcctgg

SEQ ID NO: 598533 - DNA, 25 bp, Homo sapien
gactccgcgtacctgtccgggctga

SEQ ID NO: 598534 - DNA, 25 bp, Homo sapien
actccgcgtacctgtccgggctgat

SEQ ID NO: 598535 - DNA, 25 bp, Homo sapien
aacacatccctttccaggaatgcat

SEQ ID NO: 598536 - DNA, 25 bp, Homo sapien
ggaatgcatgcttctgaggcagaca

SEQ ID NO: 598537 - DNA, 25 bp, Homo sapien
caaagattggagttgtactgccaca

SEQ ID NO: 598538 - DNA, 25 bp, Homo sapien
gagttgtactgccacaagcccaaga

SEQ ID NO: 598539 - DNA, 25 bp, Homo sapien
gtactgccacaagcccaagaatgag

SEQ ID NO: 598540 - DNA, 25 bp, Homo sapien
aaccaccaggagctagaagaaacaa

SEQ ID NO: 598541 - DNA, 25 bp, Homo sapien
aagaaacaagcaaggattcgtccct

SEQ ID NO: 598542 - DNA, 25 bp, Homo sapien
cctggattggtctttcaaagggagc

SEQ ID NO: 598543 - DNA, 25 bp, Homo sapien
tggtctttcaaagggagcatggccc

SEQ ID NO: 598544 - DNA, 25 bp, Homo sapien
gacactttaatttcagacttctagg

SEQ ID NO: 598545 - DNA, 25 bp, Homo sapien
taatttcagacttctaggctgcaga

SEQ ID NO: 598546 - DNA, 25 bp, Homo sapien
aaggttacatggctgttaagtggca

SEQ ID NO: 598547 - DNA, 25 bp, Homo sapien
agtggcagagccagtgtctttcaaa

SEQ ID NO: 598548 - DNA, 25 bp, Homo sapien
agtgtctttcaaatcaattcctgaa

SEQ ID NO: 598549 - DNA, 25 bp, Homo sapien
gaaattaatacagtcccttggatca

SEQ ID NO: 598550 - DNA, 25 bp, Homo sapien
cagtcccttggatcaatcttcaaaa

SEQ ID NO: 598551 - DNA, 25 bp, Homo sapien
gctgtggccaagaacgaaagtatat

SEQ ID NO: 598552 - DNA, 25 bp, Homo sapien
gtgaaaaatttctcaatattccatg

SEQ ID NO: 598553 - DNA, 25 bp, Homo sapien
gaggaatgttcatgcaaccctatta

SEQ ID NO: 598554 - DNA, 25 bp, Homo sapien
gcaaccctattacgtaatgcaaatt

SEQ ID NO: 598555 - DNA, 25 bp, Homo sapien
ataatttatctaacaagccgacttg

SEQ ID NO: 598556 - DNA, 25 bp, Homo sapien
ctaacaagccgacttgaggattttg

SEQ ID NO: 598557 - DNA, 25 bp, Homo sapien
tcaccctttacatacccagaatcat

SEQ ID NO: 598558 - DNA, 25 bp, Homo sapien
tacccagaatcatcagtatgtcact

SEQ ID NO: 598559 - DNA, 25 bp, Homo sapien
agtatgtcacttcctaatttctatc

SEQ ID NO: 598560 - DNA, 25 bp, Homo sapien
aatttctatcagtgtatctcattat

SEQ ID NO: 598561 - DNA, 25 bp, Homo sapien
catactgttttactaatcctaagtc

SEQ ID NO: 598562 - DNA, 25 bp, Homo sapien
aagtctaaacagatttgctcaaaag

SEQ ID NO: 598563 - DNA, 25 bp, Homo sapien
gctcaaaaggagaccattctatttt

SEQ ID NO: 598564 - DNA, 25 bp, Homo sapien
gtgatacacgtataagctttgcatg

SEQ ID NO: 598565 - DNA, 25 bp, Homo sapien
gcacattgaccttttcttgtacatt

SEQ ID NO: 598566 - DNA, 25 bp, Homo sapien
attcagaacctgaacatccatgtga

SEQ ID NO: 598567 - DNA, 25 bp, Homo sapien
atccatgtgaaaactgggtccattt

SEQ ID NO: 598568 - DNA, 25 bp, Homo sapien
ttgccttttcttgtaggtgtgtcct

SEQ ID NO: 598569 - DNA, 25 bp, Homo sapien
aggtgtgtccttttcaaattgattt

SEQ ID NO: 598570 - DNA, 25 bp, Homo sapien
tcctgtgtactaattctttgtcatt

SEQ ID NO: 598571 - DNA, 25 bp, Homo sapien
taatatctcctttcactgtgtggct

SEQ ID NO: 598572 - DNA, 25 bp, Homo sapien
ttcactgtgtggcttgtcttctcaa

SEQ ID NO: 598573 - DNA, 25 bp, Homo sapien
gtggcttgtcttctcaatttgtttt

SEQ ID NO: 598574 - DNA, 25 bp, Homo sapien
tgagtttgagcaattgtcatttgtt

SEQ ID NO: 598575 - DNA, 25 bp, Homo sapien
gtcatttgttggactgatcgttcaa

SEQ ID NO: 598576 - DNA, 25 bp, Homo sapien
gactgatcgttcaatttcctcttcg

SEQ ID NO: 598577 - DNA, 25 bp, Homo sapien
ttcaatttcctcttcggtccttggc

SEQ ID NO: 598578 - DNA, 25 bp, Homo sapien
ggtccttggccttttcatatatttt

SEQ ID NO: 598579 - DNA, 25 bp, Homo sapien
ctgttactccttctgccaactggaa

SEQ ID NO: 598580 - DNA, 25 bp, Homo sapien
tccttctgccaactggaagcagatg

SEQ ID NO: 598581 - DNA, 25 bp, Homo sapien
ctgccaactggaagcagatggtgac

SEQ ID NO: 598582 - DNA, 25 bp, Homo sapien
tgaagatgggagattcctaagtgga

SEQ ID NO: 598583 - DNA, 25 bp, Homo sapien
ggagaactgtgccttactgacctaa

SEQ ID NO: 598584 - DNA, 25 bp, Homo sapien
gaactgtgccttactgacctaaata

SEQ ID NO: 598585 - DNA, 25 bp, Homo sapien
ctgtgccttactgacctaaatatcc

SEQ ID NO: 598586 - DNA, 25 bp, Homo sapien
gccttactgacctaaatatccactc

SEQ ID NO: 598587 - DNA, 25 bp, Homo sapien
tgacctaaatatccactcagtattg

SEQ ID NO: 598588 - DNA, 25 bp, Homo sapien
aatatccactcagtattgttatgtg

SEQ ID NO: 598589 - DNA, 25 bp, Homo sapien
atccactcagtattgttatgtgaga

SEQ ID NO: 598590 - DNA, 25 bp, Homo sapien
tcacctcccagctggactagaggga

SEQ ID NO: 598591 - DNA, 25 bp, Homo sapien
tcccagctggactagagggagtgcc

SEQ ID NO: 598592 - DNA, 25 bp, Homo sapien
gagtgccgtgtgttctcaagagaat

SEQ ID NO: 598593 - DNA, 25 bp, Homo sapien
gccgtgtgttctcaagagaatgtac

SEQ ID NO: 598594 - DNA, 25 bp, Homo sapien
gagaatgtacaattacaacccctaa

SEQ ID NO: 598595 - DNA, 25 bp, Homo sapien
aattacaacccctaaaccacatgag

SEQ ID NO: 598596 - DNA, 25 bp, Homo sapien
ttacaacccctaaaccacatgagag

SEQ ID NO: 598597 - DNA, 25 bp, Homo sapien
aacccctaaaccacatgagagcctg

SEQ ID NO: 598598 - DNA, 25 bp, Homo sapien
taaaccacatgagagcctgtgtgtg

SEQ ID NO: 598599 - DNA, 25 bp, Homo sapien
ttttaacaggtgtttcaactctgag

SEQ ID NO: 598600 - DNA, 25 bp, Homo sapien
taacaggtgtttcaactctgagaca

SEQ ID NO: 598601 - DNA, 25 bp, Homo sapien
aaagaagcactggagttggcatttg

SEQ ID NO: 598602 - DNA, 25 bp, Homo sapien
gagttggcatttgagggtctgtttc

SEQ ID NO: 598603 - DNA, 25 bp, Homo sapien
tgagggtctgtttcagattctgctc

SEQ ID NO: 598604 - DNA, 25 bp, Homo sapien
cagattctgctcttcatttaatgtc

SEQ ID NO: 598605 - DNA, 25 bp, Homo sapien
ttcatttaatgtctgtgtggccttt

SEQ ID NO: 598606 - DNA, 25 bp, Homo sapien
tgtggcctttggcaattccgtttgc

SEQ ID NO: 598607 - DNA, 25 bp, Homo sapien
gtttgcctaagtttcacttaactgt

SEQ ID NO: 598608 - DNA, 25 bp, Homo sapien
gttggtaacattaacagttgcctta

SEQ ID NO: 598609 - DNA, 25 bp, Homo sapien
cagttgccttaagagtttagtgagt

SEQ ID NO: 598610 - DNA, 25 bp, Homo sapien
gtaaatgttcagatatctaggcact

SEQ ID NO: 598611 - DNA, 25 bp, Homo sapien
atctaggcacttaatgtcaattgaa

SEQ ID NO: 598612 - DNA, 25 bp, Homo sapien
aaatatgacagcttttgactttaac

SEQ ID NO: 598613 - DNA, 25 bp, Homo sapien
aatatgacagcttttgactttaaca

SEQ ID NO: 598614 - DNA, 25 bp, Homo sapien
atatgacagcttttgactttaacaa

SEQ ID NO: 598615 - DNA, 25 bp, Homo sapien
tatgacagcttttgactttaacaat

SEQ ID NO: 598616 - DNA, 25 bp, Homo sapien
atgacagcttttgactttaacaatg

SEQ ID NO: 598617 - DNA, 25 bp, Homo sapien
tgacagcttttgactttaacaatgt

SEQ ID NO: 598618 - DNA, 25 bp, Homo sapien
gacagcttttgactttaacaatgta

SEQ ID NO: 598619 - DNA, 25 bp, Homo sapien
cagcttttgactttaacaatgtagc

SEQ ID NO: 598620 - DNA, 25 bp, Homo sapien
cttttgactttaacaatgtagcttg

SEQ ID NO: 598621 - DNA, 25 bp, Homo sapien
ttgactttaacaatgtagcttgtgt

SEQ ID NO: 598622 - DNA, 25 bp, Homo sapien
gactttaacaatgtagcttgtgtaa

SEQ ID NO: 598623 - DNA, 25 bp, Homo sapien
gaaagatttcaaactgcagagaacc

SEQ ID NO: 598624 - DNA, 25 bp, Homo sapien
gcatttagtagcttcagtttctttt

SEQ ID NO: 598625 - DNA, 25 bp, Homo sapien
gtttcttttgaatacagtcttctct

SEQ ID NO: 598626 - DNA, 25 bp, Homo sapien
ttgaatacagtcttctctagtttct

SEQ ID NO: 598627 - DNA, 25 bp, Homo sapien
cttctctagtttctgaggtgaattg

SEQ ID NO: 598628 - DNA, 25 bp, Homo sapien
ggtgaattgattccagcaccctcag

SEQ ID NO: 598629 - DNA, 25 bp, Homo sapien
attgattccagcaccctcaggaata

SEQ ID NO: 598630 - DNA, 25 bp, Homo sapien
accctcaggaatacctatattcaga

SEQ ID NO: 598631 - DNA, 25 bp, Homo sapien
atattcagagatattcaagtccctg

SEQ ID NO: 598632 - DNA, 25 bp, Homo sapien
gtccctgatattaaaaacagcatat

SEQ ID NO: 598633 - DNA, 25 bp, Homo sapien
gcatataatctaggcacatttttct

SEQ ID NO: 598634 - DNA, 25 bp, Homo sapien
cagcctggccggtatgatggaaccg

SEQ ID NO: 598635 - DNA, 25 bp, Homo sapien
agcctggccggtatgatggaaccgt

SEQ ID NO: 598636 - DNA, 25 bp, Homo sapien
gcctggccggtatgatggaaccgtg

SEQ ID NO: 598637 - DNA, 25 bp, Homo sapien
cctggccggtatgatggaaccgtgt

SEQ ID NO: 598638 - DNA, 25 bp, Homo sapien
aacaacagaagtttagtggaggctg

SEQ ID NO: 598639 - DNA, 25 bp, Homo sapien
acaacagaagtttagtggaggctgg

SEQ ID NO: 598640 - DNA, 25 bp, Homo sapien
caacagaagtttagtggaggctggg

SEQ ID NO: 598641 - DNA, 25 bp, Homo sapien
agaagtttagtggaggctgggggca

SEQ ID NO: 598642 - DNA, 25 bp, Homo sapien
gaagtttagtggaggctgggggcag

SEQ ID NO: 598643 - DNA, 25 bp, Homo sapien
aaggtactattatgaaatggagaac

SEQ ID NO: 598644 - DNA, 25 bp, Homo sapien
atggagaacagtatgcagcattgcc

SEQ ID NO: 598645 - DNA, 25 bp, Homo sapien
gcctgataatattgctactgcattc

SEQ ID NO: 598646 - DNA, 25 bp, Homo sapien
attgatgttgggtggatgaatctgt

SEQ ID NO: 598647 - DNA, 25 bp, Homo sapien
tgaatctgtgagtgaatcttcaaca

SEQ ID NO: 598648 - DNA, 25 bp, Homo sapien
gattgtatttctttaacctggtggc

SEQ ID NO: 598649 - DNA, 25 bp, Homo sapien
gtatttctttaacctggtggcatct

SEQ ID NO: 598650 - DNA, 25 bp, Homo sapien
tctttaacctggtggcatctagtgt

SEQ ID NO: 598651 - DNA, 25 bp, Homo sapien
gtctcccagaaagtggtttgttgaa

SEQ ID NO: 598652 - DNA, 25 bp, Homo sapien
gaagtaagtattccactaaagatca

SEQ ID NO: 598653 - DNA, 25 bp, Homo sapien
ttccactaaagatcaagcttcattt

SEQ ID NO: 598654 - DNA, 25 bp, Homo sapien
taagttctgatgttagaaagcatac

SEQ ID NO: 598655 - DNA, 25 bp, Homo sapien
gaaagcatactagagtgaactatag

SEQ ID NO: 598656 - DNA, 25 bp, Homo sapien
actagagtgaactatagttagcaaa

SEQ ID NO: 598657 - DNA, 25 bp, Homo sapien
ttcaaagtagttggaagagaggact

SEQ ID NO: 598658 - DNA, 25 bp, Homo sapien
aaatgttaccaacacatagaagtgg

SEQ ID NO: 598659 - DNA, 25 bp, Homo sapien
aatactcaagatcatggatacccca

SEQ ID NO: 598660 - DNA, 25 bp, Homo sapien
tactcaagatcatggataccccaaa

SEQ ID NO: 598661 - DNA, 25 bp, Homo sapien
ttctatgcatgcaagaaatgctcat

SEQ ID NO: 598662 - DNA, 25 bp, Homo sapien
gaaatgctcatgtgtaccttatata

SEQ ID NO: 598663 - DNA, 25 bp, Homo sapien
aatgctcatgtgtaccttatatata

SEQ ID NO: 598664 - DNA, 25 bp, Homo sapien
gctcatgtgtaccttatatatatgt

SEQ ID NO: 598665 - DNA, 25 bp, Homo sapien
cttggattgtgatgctattggtact

SEQ ID NO: 598666 - DNA, 25 bp, Homo sapien
ggattgtgatgctattggtacttga

SEQ ID NO: 598667 - DNA, 25 bp, Homo sapien
tgtgatgctattggtacttgagaat

SEQ ID NO: 598668 - DNA, 25 bp, Homo sapien
gctattggtacttgagaatacccct

SEQ ID NO: 598669 - DNA, 25 bp, Homo sapien
ttggtacttgagaataccccttatc

SEQ ID NO: 598670 - DNA, 25 bp, Homo sapien
gtacttgagaataccccttatctga

SEQ ID NO: 598671 - DNA, 25 bp, Homo sapien
tacttgagaataccccttatctgag

SEQ ID NO: 598672 - DNA, 25 bp, Homo sapien
ttgagaataccccttatctgagtat

SEQ ID NO: 598673 - DNA, 25 bp, Homo sapien
gagaataccccttatctgagtataa

SEQ ID NO: 598674 - DNA, 25 bp, Homo sapien
gaataccccttatctgagtataaag

SEQ ID NO: 598675 - DNA, 25 bp, Homo sapien
aataccccttatctgagtataaaga

SEQ ID NO: 598676 - DNA, 25 bp, Homo sapien
cagaccaccactttttatagtaact

SEQ ID NO: 598677 - DNA, 25 bp, Homo sapien
tttatagtaacttattttctagtgt

SEQ ID NO: 598678 - DNA, 25 bp, Homo sapien
tttttcccttgccataatagctggc

SEQ ID NO: 598679 - DNA, 25 bp, Homo sapien
tcccttgccataatagctggcttgt

SEQ ID NO: 598680 - DNA, 25 bp, Homo sapien
taatagctggcttgtagagagagtt

SEQ ID NO: 598681 - DNA, 25 bp, Homo sapien
gagttatgtttgaaaaggcttgcct

SEQ ID NO: 598682 - DNA, 25 bp, Homo sapien
aggcttgccttttttccgtcgctct

SEQ ID NO: 598683 - DNA, 25 bp, Homo sapien
tgccttttttccgtcgctctgagca

SEQ ID NO: 598684 - DNA, 25 bp, Homo sapien
ttttccgtcgctctgagcaggatta

SEQ ID NO: 598685 - DNA, 25 bp, Homo sapien
cgtcgctctgagcaggattatgtta

SEQ ID NO: 598686 - DNA, 25 bp, Homo sapien
tgagcaggattatgttagggcccaa

SEQ ID NO: 598687 - DNA, 25 bp, Homo sapien
gtaggagacccagcgcccctaggag

SEQ ID NO: 598688 - DNA, 25 bp, Homo sapien
aagcaatgccaatcctatcttcatg

SEQ ID NO: 598689 - DNA, 25 bp, Homo sapien
aatcctatcttcatgcgcaaggaca

SEQ ID NO: 598690 - DNA, 25 bp, Homo sapien
ggacaccaagatgagtttccagtgg

SEQ ID NO: 598691 - DNA, 25 bp, Homo sapien
tttccagtggcggattcgaaacctc

SEQ ID NO: 598692 - DNA, 25 bp, Homo sapien
aacctcccctatcctaaggatgtct

SEQ ID NO: 598693 - DNA, 25 bp, Homo sapien
atgtctatagtgtctctgtggacca

SEQ ID NO: 598694 - DNA, 25 bp, Homo sapien
ctgtggaccagaaggagcgctgcat

SEQ ID NO: 598695 - DNA, 25 bp, Homo sapien
gagcgctgcatcattgtcagaacaa

SEQ ID NO: 598696 - DNA, 25 bp, Homo sapien
gaagttctccattcctgatctagat

SEQ ID NO: 598697 - DNA, 25 bp, Homo sapien
atctagatagacaccagctacctct

SEQ ID NO: 598698 - DNA, 25 bp, Homo sapien
cctcaaatagaagcttgccagcaaa

SEQ ID NO: 598699 - DNA, 25 bp, Homo sapien
tacgtcggtgaaattggttggagaa

SEQ ID NO: 598700 - DNA, 25 bp, Homo sapien
aatcaagactggagagtggctttca

SEQ ID NO: 598701 - DNA, 25 bp, Homo sapien
agagtggctttcatatcaagtatga

SEQ ID NO: 598702 - DNA, 25 bp, Homo sapien
agcttctcttgattcaataacccac

SEQ ID NO: 598703 - DNA, 25 bp, Homo sapien
gattcaataacccacagatatcaaa

SEQ ID NO: 598704 - DNA, 25 bp, Homo sapien
aaacctcatgtcctggatatgcaag

SEQ ID NO: 598705 - DNA, 25 bp, Homo sapien
aggaaaacagagtcgcgcttctttt

SEQ ID NO: 598706 - DNA, 25 bp, Homo sapien
agtcgcgcttcttttgcctggcata

SEQ ID NO: 598707 - DNA, 25 bp, Homo sapien
gcctggcatatgagtgctttcgagg

SEQ ID NO: 598708 - DNA, 25 bp, Homo sapien
tgctttcgaggacactgatcagaga

SEQ ID NO: 598709 - DNA, 25 bp, Homo sapien
gctctcagagcatttgaatcacctt

SEQ ID NO: 598710 - DNA, 25 bp, Homo sapien
ctctcagagcatttgaatcaccttt

SEQ ID NO: 598711 - DNA, 25 bp, Homo sapien
tctcagagcatttgaatcacctttc

SEQ ID NO: 598712 - DNA, 25 bp, Homo sapien
tcagagcatttgaatcacctttctt

SEQ ID NO: 598713 - DNA, 25 bp, Homo sapien
cagagcatttgaatcacctttcttc

SEQ ID NO: 598714 - DNA, 25 bp, Homo sapien
gagcatttgaatcacctttcttcaa

SEQ ID NO: 598715 - DNA, 25 bp, Homo sapien
catttgaatcacctttcttcaaaag

SEQ ID NO: 598716 - DNA, 25 bp, Homo sapien
atttgaatcacctttcttcaaaagg

SEQ ID NO: 598717 - DNA, 25 bp, Homo sapien
tttgaatcacctttcttcaaaagga

SEQ ID NO: 598718 - DNA, 25 bp, Homo sapien
ttgaatcacctttcttcaaaaggaa

SEQ ID NO: 598719 - DNA, 25 bp, Homo sapien
tgaatcacctttcttcaaaaggaac

SEQ ID NO: 598720 - DNA, 25 bp, Homo sapien
gggatgggaagaggctctttgcaaa

SEQ ID NO: 598721 - DNA, 25 bp, Homo sapien
ttcacttgccgggagagacttttta

SEQ ID NO: 598722 - DNA, 25 bp, Homo sapien
cacttgccgggagagactttttaca

SEQ ID NO: 598723 - DNA, 25 bp, Homo sapien
ttgccgggagagactttttacaact

SEQ ID NO: 598724 - DNA, 25 bp, Homo sapien
gggagagactttttacaactcatct

SEQ ID NO: 598725 - DNA, 25 bp, Homo sapien
gagactttttacaactcatctgcag

SEQ ID NO: 598726 - DNA, 25 bp, Homo sapien
actttttacaactcatctgcagctc

SEQ ID NO: 598727 - DNA, 25 bp, Homo sapien
tttttacaactcatctgcagctccg

SEQ ID NO: 598728 - DNA, 25 bp, Homo sapien
ttacaactcatctgcagctccgggt

SEQ ID NO: 598729 - DNA, 25 bp, Homo sapien
aactcatctgcagctccgggtgcgg

SEQ ID NO: 598730 - DNA, 25 bp, Homo sapien
ctcatctgcagctccgggtgcggtt

SEQ ID NO: 598731 - DNA, 25 bp, Homo sapien
agaccgtcagttagcccagcttctg

SEQ ID NO: 598732 - DNA, 25 bp, Homo sapien
gaccgtcagttagcccagcttctgg

SEQ ID NO: 598733 - DNA, 25 bp, Homo sapien
cttctgggataacgcgtctcatcga

SEQ ID NO: 598734 - DNA, 25 bp, Homo sapien
tgggataacgcgtctcatcgaactg

SEQ ID NO: 598735 - DNA, 25 bp, Homo sapien
ggataacgcgtctcatcgaactgga

SEQ ID NO: 598736 - DNA, 25 bp, Homo sapien
atcgaactggatctgagcgcaaaaa

SEQ ID NO: 598737 - DNA, 25 bp, Homo sapien
ttcccgtgaagccagaatgccttga

SEQ ID NO: 598738 - DNA, 25 bp, Homo sapien
tggaacttgccacactgagtgtctg

SEQ ID NO: 598739 - DNA, 25 bp, Homo sapien
aacttgccacactgagtgtctgggt

SEQ ID NO: 598740 - DNA, 25 bp, Homo sapien
ccacactgagtgtctgggtccaagg

SEQ ID NO: 598741 - DNA, 25 bp, Homo sapien
gaaacctgatggtcaatgccagatc

SEQ ID NO: 598742 - DNA, 25 bp, Homo sapien
gggattacaggggatcattgacatt

SEQ ID NO: 598743 - DNA, 25 bp, Homo sapien
ggattacaggggatcattgacattt

SEQ ID NO: 598744 - DNA, 25 bp, Homo sapien
attacaggggatcattgacatttag

SEQ ID NO: 598745 - DNA, 25 bp, Homo sapien
ttacaggggatcattgacatttagg

SEQ ID NO: 598746 - DNA, 25 bp, Homo sapien
cagacctgatcatttttctggagga

SEQ ID NO: 598747 - DNA, 25 bp, Homo sapien
agacctgatcatttttctggaggaa

SEQ ID NO: 598748 - DNA, 25 bp, Homo sapien
caggggcatcttcggtcttacactt

SEQ ID NO: 598749 - DNA, 25 bp, Homo sapien
aggggcatcttcggtcttacacttt

SEQ ID NO: 598750 - DNA, 25 bp, Homo sapien
ggggcatcttcggtcttacactttt

SEQ ID NO: 598751 - DNA, 25 bp, Homo sapien
gggcatcttcggtcttacactttta

SEQ ID NO: 598752 - DNA, 25 bp, Homo sapien
ggcatcttcggtcttacacttttaa

SEQ ID NO: 598753 - DNA, 25 bp, Homo sapien
agcgcgccggccaacttttctaaca

SEQ ID NO: 598754 - DNA, 25 bp, Homo sapien
gcgcgccggccaacttttctaacaa

SEQ ID NO: 598755 - DNA, 25 bp, Homo sapien
gcgccggccaacttttctaacaaat

SEQ ID NO: 598756 - DNA, 25 bp, Homo sapien
cgccggccaacttttctaacaaatg

SEQ ID NO: 598757 - DNA, 25 bp, Homo sapien
gccggccaacttttctaacaaatgg

SEQ ID NO: 598758 - DNA, 25 bp, Homo sapien
acgctggagtgcagccccaagtgat

SEQ ID NO: 598759 - DNA, 25 bp, Homo sapien
ggagtgcagccccaagtgattctcc

SEQ ID NO: 598760 - DNA, 25 bp, Homo sapien
tgggactacaaattagagccaccat

SEQ ID NO: 598761 - DNA, 25 bp, Homo sapien
gggactacaaattagagccaccatg

SEQ ID NO: 598762 - DNA, 25 bp, Homo sapien
gaggcgggcggggacttgctgtgtt

SEQ ID NO: 598763 - DNA, 25 bp, Homo sapien
aatgctgggatcacacacgtgaccc

SEQ ID NO: 598764 - DNA, 25 bp, Homo sapien
tgtctcttgcccctggttttgtggg

SEQ ID NO: 598765 - DNA, 25 bp, Homo sapien
gtctcttgcccctggttttgtgggt

SEQ ID NO: 598766 - DNA, 25 bp, Homo sapien
tctcttgcccctggttttgtgggtc

SEQ ID NO: 598767 - DNA, 25 bp, Homo sapien
tcttgcccctggttttgtgggtctg

SEQ ID NO: 598768 - DNA, 25 bp, Homo sapien
cttgcccctggttttgtgggtctgc

SEQ ID NO: 598769 - DNA, 25 bp, Homo sapien
ttgcccctggttttgtgggtctgcc

SEQ ID NO: 598770 - DNA, 25 bp, Homo sapien
tgcccctggttttgtgggtctgccc

SEQ ID NO: 598771 - DNA, 25 bp, Homo sapien
gcccctggttttgtgggtctgccct

SEQ ID NO: 598772 - DNA, 25 bp, Homo sapien
ccctggttttgtgggtctgccctga

SEQ ID NO: 598773 - DNA, 25 bp, Homo sapien
ctggttttgtgggtctgccctgagc

SEQ ID NO: 598774 - DNA, 25 bp, Homo sapien
tggttttgtgggtctgccctgagct

SEQ ID NO: 598775 - DNA, 25 bp, Homo sapien
gcataatgtttctgggtataaaaag

SEQ ID NO: 598776 - DNA, 25 bp, Homo sapien
cataatgtttctgggtataaaaagt

SEQ ID NO: 598777 - DNA, 25 bp, Homo sapien
taatgtttctgggtataaaaagtct

SEQ ID NO: 598778 - DNA, 25 bp, Homo sapien
ttctgggtataaaaagtcttaatat

SEQ ID NO: 598779 - DNA, 25 bp, Homo sapien
tctgggtataaaaagtcttaatata

SEQ ID NO: 598780 - DNA, 25 bp, Homo sapien
taaaaagtcttaatataggtcaggc

SEQ ID NO: 598781 - DNA, 25 bp, Homo sapien
aaaaagtcttaatataggtcaggca

SEQ ID NO: 598782 - DNA, 25 bp, Homo sapien
gctactcggggcggggctaaggtag

SEQ ID NO: 598783 - DNA, 25 bp, Homo sapien
gcggggctaaggtaggagaattgct

SEQ ID NO: 598784 - DNA, 25 bp, Homo sapien
cggggctaaggtaggagaattgctt

SEQ ID NO: 598785 - DNA, 25 bp, Homo sapien
gggctaaggtaggagaattgcttga

SEQ ID NO: 598786 - DNA, 25 bp, Homo sapien
tggtttgccataccaacattgagga

SEQ ID NO: 598787 - DNA, 25 bp, Homo sapien
ggtttgccataccaacattgaggat

SEQ ID NO: 598788 - DNA, 25 bp, Homo sapien
gtttgccataccaacattgaggatc

SEQ ID NO: 598789 - DNA, 25 bp, Homo sapien
tttgccataccaacattgaggatca

SEQ ID NO: 598790 - DNA, 25 bp, Homo sapien
ttgccataccaacattgaggatcat

SEQ ID NO: 598791 - DNA, 25 bp, Homo sapien
tgccataccaacattgaggatcatc

SEQ ID NO: 598792 - DNA, 25 bp, Homo sapien
gccataccaacattgaggatcatct

SEQ ID NO: 598793 - DNA, 25 bp, Homo sapien
ccataccaacattgaggatcatctt

SEQ ID NO: 598794 - DNA, 25 bp, Homo sapien
ataccaacattgaggatcatcttgc

SEQ ID NO: 598795 - DNA, 25 bp, Homo sapien
taccaacattgaggatcatcttgct

SEQ ID NO: 598796 - DNA, 25 bp, Homo sapien
accaacattgaggatcatcttgctc

SEQ ID NO: 598797 - DNA, 25 bp, Homo sapien
agggcatccaccactctacctttaa

SEQ ID NO: 598798 - DNA, 25 bp, Homo sapien
gacctaatgttgcttatcttccaag

SEQ ID NO: 598799 - DNA, 25 bp, Homo sapien
tatcttccaagattttgctgtattg

SEQ ID NO: 598800 - DNA, 25 bp, Homo sapien
gaatactctgcaacatacttccatc

SEQ ID NO: 598801 - DNA, 25 bp, Homo sapien
caacatacttccatcacctagtttt

SEQ ID NO: 598802 - DNA, 25 bp, Homo sapien
tcacctagttttatgatgatctatt

SEQ ID NO: 598803 - DNA, 25 bp, Homo sapien
tgatctattttctatgttcccctgc

SEQ ID NO: 598804 - DNA, 25 bp, Homo sapien
tccctaaaacttcagtctccttgag

SEQ ID NO: 598805 - DNA, 25 bp, Homo sapien
gtctccttgagagtggaaactaagt

SEQ ID NO: 598806 - DNA, 25 bp, Homo sapien
agtcttattttcattacatctctag

SEQ ID NO: 598807 - DNA, 25 bp, Homo sapien
cattacatctctagttcttaacagt

SEQ ID NO: 598808 - DNA, 25 bp, Homo sapien
ccctctgattctgttcacattacaa

SEQ ID NO: 598809 - DNA, 25 bp, Homo sapien
gatttctacatcatcttatcataga

SEQ ID NO: 598810 - DNA, 25 bp, Homo sapien
aaagatagctttactgctgtggtta

SEQ ID NO: 598811 - DNA, 25 bp, Homo sapien
tagctttactgctgtggttatcaca

SEQ ID NO: 598812 - DNA, 25 bp, Homo sapien
gggtacaaccagaacacatacagta

SEQ ID NO: 598813 - DNA, 25 bp, Homo sapien
accagaacacatacagtacttgaaa

SEQ ID NO: 598814 - DNA, 25 bp, Homo sapien
attatttccacctttggacacgaca

SEQ ID NO: 598815 - DNA, 25 bp, Homo sapien
tccacctttggacacgacagttagc

SEQ ID NO: 598816 - DNA, 25 bp, Homo sapien
ggacacgacagttagcgcatattta

SEQ ID NO: 598817 - DNA, 25 bp, Homo sapien
gttagcgcatatttatcactactat

SEQ ID NO: 598818 - DNA, 25 bp, Homo sapien
atcactactatattcatggcccaaa

SEQ ID NO: 598819 - DNA, 25 bp, Homo sapien
gtttgctgatccacagtgttgggca

SEQ ID NO: 598820 - DNA, 25 bp, Homo sapien
gatccacagtgttgggcacaacttt

SEQ ID NO: 598821 - DNA, 25 bp, Homo sapien
tgggcacaactttgacgtttcttaa

SEQ ID NO: 598822 - DNA, 25 bp, Homo sapien
aaaaatgccgaaaaccagcgattgt

SEQ ID NO: 598823 - DNA, 25 bp, Homo sapien
tgccgaaaaccagcgattgtggtgt

SEQ ID NO: 598824 - DNA, 25 bp, Homo sapien
ccgtgtttccctgcgagtggacgtg

SEQ ID NO: 598825 - DNA, 25 bp, Homo sapien
ctgcgagtggacgtgcccagctgtc

SEQ ID NO: 598826 - DNA, 25 bp, Homo sapien
aggcctctcctcagagggcggcaca

SEQ ID NO: 598827 - DNA, 25 bp, Homo sapien
gagggcggcacaggctgggctccag

SEQ ID NO: 598828 - DNA, 25 bp, Homo sapien
aggcgctgccgtcggctgtcaataa

SEQ ID NO: 598829 - DNA, 25 bp, Homo sapien
gctgccgtcggctgtcaataaacag

SEQ ID NO: 598830 - DNA, 25 bp, Homo sapien
tgaaccggagccaaagctggccgag

SEQ ID NO: 598831 - DNA, 25 bp, Homo sapien
attctgagactcacactttcatttg

SEQ ID NO: 598832 - DNA, 25 bp, Homo sapien
gagactcacactttcatttgtgaag

SEQ ID NO: 598833 - DNA, 25 bp, Homo sapien
ttgtgaagtgagatgctgactctat

SEQ ID NO: 598834 - DNA, 25 bp, Homo sapien
gatgctgactctattgttggttttg

SEQ ID NO: 598835 - DNA, 25 bp, Homo sapien
tacacacgaggaaatttactggcat

SEQ ID NO: 598836 - DNA, 25 bp, Homo sapien
gaggaaatttactggcattgtatta

SEQ ID NO: 598837 - DNA, 25 bp, Homo sapien
aaagttaatgtatgatgatgccgta

SEQ ID NO: 598838 - DNA, 25 bp, Homo sapien
atgtatgatgatgccgtagagtgat

SEQ ID NO: 598839 - DNA, 25 bp, Homo sapien
tgatgccgtagagtgattcatgaat

SEQ ID NO: 598840 - DNA, 25 bp, Homo sapien
gagtgattcatgaatggcattatga

SEQ ID NO: 598841 - DNA, 25 bp, Homo sapien
ggtcagagccaaaacatatgctagt

SEQ ID NO: 598842 - DNA, 25 bp, Homo sapien
aaggtatacttaagcaatttcattc

SEQ ID NO: 598843 - DNA, 25 bp, Homo sapien
aatttcattcttcttggcagggcaa

SEQ ID NO: 598844 - DNA, 25 bp, Homo sapien
gcagggcaagtgtgggctattcatt

SEQ ID NO: 598845 - DNA, 25 bp, Homo sapien
gtgtgggctattcatttctcattta

SEQ ID NO: 598846 - DNA, 25 bp, Homo sapien
catttctcatttattcacggtgatg

SEQ ID NO: 598847 - DNA, 25 bp, Homo sapien
cggtgatgatattccctgttcagct

SEQ ID NO: 598848 - DNA, 25 bp, Homo sapien
ctgttcagctggctagtgtgatcaa

SEQ ID NO: 598849 - DNA, 25 bp, Homo sapien
ggaagacagtcttaggcattagaat

SEQ ID NO: 598850 - DNA, 25 bp, Homo sapien
gaaagttgttcaatcatcgtgccat

SEQ ID NO: 598851 - DNA, 25 bp, Homo sapien
gttcaatcatcgtgccatttcattt

SEQ ID NO: 598852 - DNA, 25 bp, Homo sapien
agagctctccgacgctgaattatca

SEQ ID NO: 598853 - DNA, 25 bp, Homo sapien
atcagggcattctaaatcggctcaa

SEQ ID NO: 598854 - DNA, 25 bp, Homo sapien
ttctaaatcggctcaagcagttccc

SEQ ID NO: 598855 - DNA, 25 bp, Homo sapien
gcagttccccaggtgagagcaattc

SEQ ID NO: 598856 - DNA, 25 bp, Homo sapien
ttccccaggtgagagcaattccagg

SEQ ID NO: 598857 - DNA, 25 bp, Homo sapien
aggtctcacgctgggaaggagcccc

SEQ ID NO: 598858 - DNA, 25 bp, Homo sapien
cctagtgagtggtctagaggctgct

SEQ ID NO: 598859 - DNA, 25 bp, Homo sapien
tggcccaagagccaggctcaggaac

SEQ ID NO: 598860 - DNA, 25 bp, Homo sapien
agagccaggctcaggaacaggaagc

SEQ ID NO: 598861 - DNA, 25 bp, Homo sapien
aggaagccatgcagatacccagcat

SEQ ID NO: 598862 - DNA, 25 bp, Homo sapien
agatacccagcatggagaacccggc

SEQ ID NO: 598863 - DNA, 25 bp, Homo sapien
tgcgttcctggttggtgcgctgtca

SEQ ID NO: 598864 - DNA, 25 bp, Homo sapien
ttcacggaatccacccagactggtc

SEQ ID NO: 598865 - DNA, 25 bp, Homo sapien
agactggtcctcagccttgtggtag

SEQ ID NO: 598866 - DNA, 25 bp, Homo sapien
gtcctcagccttgtggtagcacaaa

SEQ ID NO: 598867 - DNA, 25 bp, Homo sapien
aaaatgcttgttggcctcaactgtg

SEQ ID NO: 598868 - DNA, 25 bp, Homo sapien
gcctcaactgtgacttgtaccagcg

SEQ ID NO: 598869 - DNA, 25 bp, Homo sapien
tgacttgtaccagcgttcacagaat

SEQ ID NO: 598870 - DNA, 25 bp, Homo sapien
gtaccagcgttcacagaatactgca

SEQ ID NO: 598871 - DNA, 25 bp, Homo sapien
gaatactgcactgaacctcaaatct

SEQ ID NO: 598872 - DNA, 25 bp, Homo sapien
gcactgaacctcaaatcttgttatt

SEQ ID NO: 598873 - DNA, 25 bp, Homo sapien
tagaaatcaagtgtttattccacta

SEQ ID NO: 598874 - DNA, 25 bp, Homo sapien
atgtgctaatatttacttactggag

SEQ ID NO: 598875 - DNA, 25 bp, Homo sapien
ggtattcaatatgataactgccttg

SEQ ID NO: 598876 - DNA, 25 bp, Homo sapien
gataactgccttgttactgcagaaa

SEQ ID NO: 598877 - DNA, 25 bp, Homo sapien
gtagaagtttggcattttaagtatc

SEQ ID NO: 598878 - DNA, 25 bp, Homo sapien
aaaaattaccagtgtcccacagcac

SEQ ID NO: 598879 - DNA, 25 bp, Homo sapien
gtgtcccacagcacagagagagaat

SEQ ID NO: 598880 - DNA, 25 bp, Homo sapien
agagaatatatgtttgcttgtgtcc

SEQ ID NO: 598881 - DNA, 25 bp, Homo sapien
gtttgcttgtgtccttttaatcttt

SEQ ID NO: 598882 - DNA, 25 bp, Homo sapien
tgtgtccttttaatctttcccctgt

SEQ ID NO: 598883 - DNA, 25 bp, Homo sapien
gtaaatgttgtgtcagatttccaat

SEQ ID NO: 598884 - DNA, 25 bp, Homo sapien
gtgtcagatttccaattcataagta

SEQ ID NO: 598885 - DNA, 25 bp, Homo sapien
tggttccgcattattactccttcct

SEQ ID NO: 598886 - DNA, 25 bp, Homo sapien
tttcttgggttacggattgaacact

SEQ ID NO: 598887 - DNA, 25 bp, Homo sapien
ggattgaacactgaccttttctttc

SEQ ID NO: 598888 - DNA, 25 bp, Homo sapien
tttctttcactcttctgcaagacaa

SEQ ID NO: 598889 - DNA, 25 bp, Homo sapien
gcaagacaaccccataagaaagctg

SEQ ID NO: 598890 - DNA, 25 bp, Homo sapien
tttgtgaaagcctatgattactata

SEQ ID NO: 598891 - DNA, 25 bp, Homo sapien
gattactataagacaggcacagagc

SEQ ID NO: 598892 - DNA, 25 bp, Homo sapien
aacaagacttggctggaatccccag

SEQ ID NO: 598893 - DNA, 25 bp, Homo sapien
tggaatccccagacccacgactttt

SEQ ID NO: 598894 - DNA, 25 bp, Homo sapien
aaggatattttgtccctgcaataca

SEQ ID NO: 598895 - DNA, 25 bp, Homo sapien
acagatactgaatgaggttggcaaa

SEQ ID NO: 598896 - DNA, 25 bp, Homo sapien
ttggtagctaaagaggcagtgaaac

SEQ ID NO: 598897 - DNA, 25 bp, Homo sapien
ggagaaagggccacccttgttatat

SEQ ID NO: 598898 - DNA, 25 bp, Homo sapien
cacccttgttatatagtggccaaag

SEQ ID NO: 598899 - DNA, 25 bp, Homo sapien
tagtggccaaagaatcagcaaaatg

SEQ ID NO: 598900 - DNA, 25 bp, Homo sapien
tgctgcaacctggaaagtagaaact

SEQ ID NO: 598901 - DNA, 25 bp, Homo sapien
aacttttcttaaactcacggatctg

SEQ ID NO: 598902 - DNA, 25 bp, Homo sapien
ttcttaaactcacggatctggctgg

SEQ ID NO: 598903 - DNA, 25 bp, Homo sapien
aatgtgaatcaactttgtatagctg

SEQ ID NO: 598904 - DNA, 25 bp, Homo sapien
gctgtgtataataaagtgtgctgta

SEQ ID NO: 598905 - DNA, 25 bp, Homo sapien
gtgtgctgtatttgtccattctgat

SEQ ID NO: 598906 - DNA, 25 bp, Homo sapien
gctgtatttgtccattctgatgctg

SEQ ID NO: 598907 - DNA, 25 bp, Homo sapien
ccagagtggtggctgtagaatactt

SEQ ID NO: 598908 - DNA, 25 bp, Homo sapien
agacttggtaattgactatttggga

SEQ ID NO: 598909 - DNA, 25 bp, Homo sapien
agagaggctatgcacaagctgagca

SEQ ID NO: 598910 - DNA, 25 bp, Homo sapien
aagctgagcaggtcgtgatactgat

SEQ ID NO: 598911 - DNA, 25 bp, Homo sapien
gatactgatggacctaccctgcctt

SEQ ID NO: 598912 - DNA, 25 bp, Homo sapien
tgccttgttctgtcctctagaggat

SEQ ID NO: 598913 - DNA, 25 bp, Homo sapien
aagaggaaacaaactgcaccaggga

SEQ ID NO: 598914 - DNA, 25 bp, Homo sapien
accagggaagctcaggccgattcaa

SEQ ID NO: 598915 - DNA, 25 bp, Homo sapien
gctcaggccgattcaatgcatgcaa

SEQ ID NO: 598916 - DNA, 25 bp, Homo sapien
caatgcatgcaagggtgatttaacc

SEQ ID NO: 598917 - DNA, 25 bp, Homo sapien
caagggtgatttaacctgggttctg

SEQ ID NO: 598918 - DNA, 25 bp, Homo sapien
cccgcatgacacagttaactttggg

SEQ ID NO: 598919 - DNA, 25 bp, Homo sapien
agataaggagtgatggcgcttgcca

SEQ ID NO: 598920 - DNA, 25 bp, Homo sapien
agtgatggcgcttgccagtaatccc

SEQ ID NO: 598921 - DNA, 25 bp, Homo sapien
agaggtcgagctggaaggatccctt

SEQ ID NO: 598922 - DNA, 25 bp, Homo sapien
ccttgagccgagtgcgaggctgcat

SEQ ID NO: 598923 - DNA, 25 bp, Homo sapien
agccgagtgcgaggctgcattgaac

SEQ ID NO: 598924 - DNA, 25 bp, Homo sapien
gacaagtgttatttgtgacagcaca

SEQ ID NO: 598925 - DNA, 25 bp, Homo sapien
gacagcacaatgtttgatacaaccc

SEQ ID NO: 598926 - DNA, 25 bp, Homo sapien
tgtttgatacaacccaaatgttgaa

SEQ ID NO: 598927 - DNA, 25 bp, Homo sapien
tgttgaatgaaagtggaccagctaa

SEQ ID NO: 598928 - DNA, 25 bp, Homo sapien
gaccagctaaataaaccatgaacat

SEQ ID NO: 598929 - DNA, 25 bp, Homo sapien
gctactaaatgatggtgctggattc

SEQ ID NO: 598930 - DNA, 25 bp, Homo sapien
atggtgctggattcaaaaccaggct

SEQ ID NO: 598931 - DNA, 25 bp, Homo sapien
caggctggtcaaatatctgggtcca

SEQ ID NO: 598932 - DNA, 25 bp, Homo sapien
gctggtcaaatatctgggtccattt

SEQ ID NO: 598933 - DNA, 25 bp, Homo sapien
gggtccatttttgtaaccactatgt

SEQ ID NO: 598934 - DNA, 25 bp, Homo sapien
gattcatcaaaggatcaaaactaat

SEQ ID NO: 598935 - DNA, 25 bp, Homo sapien
aaactaatactagatggctttcatg

SEQ ID NO: 598936 - DNA, 25 bp, Homo sapien
actagatggctttcatgtttcatgg

SEQ ID NO: 598937 - DNA, 25 bp, Homo sapien
cctgcacctcatggatacttttcag

SEQ ID NO: 598938 - DNA, 25 bp, Homo sapien
tcaggtgatggaggagtagaactac

SEQ ID NO: 598939 - DNA, 25 bp, Homo sapien
atggaggagtagaactacactgaaa

SEQ ID NO: 598940 - DNA, 25 bp, Homo sapien
ctggtttagagaggagggcgaggaa

SEQ ID NO: 598941 - DNA, 25 bp, Homo sapien
aggaagtggtttggaagtgtcactt

SEQ ID NO: 598942 - DNA, 25 bp, Homo sapien
gaagtgtcactttggaagtgccagc

SEQ ID NO: 598943 - DNA, 25 bp, Homo sapien
cagggaataaagtgtgaagttgact

SEQ ID NO: 598944 - DNA, 25 bp, Homo sapien
acaggactggagctgaaaacaggaa

SEQ ID NO: 598945 - DNA, 25 bp, Homo sapien
ggactggagctgaaaacaggaatca

SEQ ID NO: 598946 - DNA, 25 bp, Homo sapien
ttccatagatttccagttgatgttg

SEQ ID NO: 598947 - DNA, 25 bp, Homo sapien
gaagttgactaggaggttttcagtt

SEQ ID NO: 598948 - DNA, 25 bp, Homo sapien
gttgactaggaggttttcagtttag

SEQ ID NO: 598949 - DNA, 25 bp, Homo sapien
ctaggaggttttcagtttagaacat

SEQ ID NO: 598950 - DNA, 25 bp, Homo sapien
ggaggttttcagtttagaacatggc

SEQ ID NO: 598951 - DNA, 25 bp, Homo sapien
gggagagctccacaaaaccaggctt

SEQ ID NO: 598952 - DNA, 25 bp, Homo sapien
caggcttaggaaagctaactgtgta

SEQ ID NO: 598953 - DNA, 25 bp, Homo sapien
ctgtgtaaacattctagtgggtgtc

SEQ ID NO: 598954 - DNA, 25 bp, Homo sapien
agtgggtgtctatggccaattccaa

SEQ ID NO: 598955 - DNA, 25 bp, Homo sapien
tggccaattccaaattggagcctgt

SEQ ID NO: 598956 - DNA, 25 bp, Homo sapien
ggagcctgtagctatgaacaatgaa

SEQ ID NO: 598957 - DNA, 25 bp, Homo sapien
gatcctgaaagttctgttccagtct

SEQ ID NO: 598958 - DNA, 25 bp, Homo sapien
tctgttccagtctttaaacctcatc

SEQ ID NO: 598959 - DNA, 25 bp, Homo sapien
aacctcatcattcaagtggtggatt

SEQ ID NO: 598960 - DNA, 25 bp, Homo sapien
ttctttacccacattttcccttcat

SEQ ID NO: 598961 - DNA, 25 bp, Homo sapien
cttcatttccctaattctattggag

SEQ ID NO: 598962 - DNA, 25 bp, Homo sapien
ttatgatgcattatttcttatttcc

SEQ ID NO: 598963 - DNA, 25 bp, Homo sapien
tactacctttgttttgaatgattaa

SEQ ID NO: 598964 - DNA, 25 bp, Homo sapien
ggaaacatagcaccttttttcaaca

SEQ ID NO: 598965 - DNA, 25 bp, Homo sapien
tagttgaattgggagagacagcttg

SEQ ID NO: 598966 - DNA, 25 bp, Homo sapien
agacagcttgccaggcctactgcca

SEQ ID NO: 598967 - DNA, 25 bp, Homo sapien
tactgccacttgtcagcatcgcatc

SEQ ID NO: 598968 - DNA, 25 bp, Homo sapien
gtcagcatcgcatccctacattcaa

SEQ ID NO: 598969 - DNA, 25 bp, Homo sapien
tacattcaaccacacttgcatctaa

SEQ ID NO: 598970 - DNA, 25 bp, Homo sapien
aaccacacttgcatctaacgaccgt

SEQ ID NO: 598971 - DNA, 25 bp, Homo sapien
ctaacgaccgtctctttcattaaat

SEQ ID NO: 598972 - DNA, 25 bp, Homo sapien
ctttcattaaatttcttttgcacct

SEQ ID NO: 598973 - DNA, 25 bp, Homo sapien
gtttttcttctttcgtggctctaag

SEQ ID NO: 598974 - DNA, 25 bp, Homo sapien
ttctttcgtggctctaagggtcaag

SEQ ID NO: 598975 - DNA, 25 bp, Homo sapien
aagggtcaagatgctctatgttaat

SEQ ID NO: 598976 - DNA, 25 bp, Homo sapien
aagtactctgaaactgccacctact

SEQ ID NO: 598977 - DNA, 25 bp, Homo sapien
aaactgccacctactttgtctttag

SEQ ID NO: 598978 - DNA, 25 bp, Homo sapien
gccacctactttgtctttagggagg

SEQ ID NO: 598979 - DNA, 25 bp, Homo sapien
gtactgaagaccttgggttaattct

SEQ ID NO: 598980 - DNA, 25 bp, Homo sapien
aattttttattgacacacacagtcc

SEQ ID NO: 598981 - DNA, 25 bp, Homo sapien
agaggctgaggcgaactctgcccag

SEQ ID NO: 598982 - DNA, 25 bp, Homo sapien
tgaggcgaactctgcccaggagttc

SEQ ID NO: 598983 - DNA, 25 bp, Homo sapien
agtgagctatctgcactacaacctg

SEQ ID NO: 598984 - DNA, 25 bp, Homo sapien
acatccagatggccggttcctgcct

SEQ ID NO: 598985 - DNA, 25 bp, Homo sapien
aaagaaatgaaagtggcctgttcct

SEQ ID NO: 598986 - DNA, 25 bp, Homo sapien
aagaaatgaaagtggcctgttcctg

SEQ ID NO: 598987 - DNA, 25 bp, Homo sapien
agaaatgaaagtggcctgttcctgc

SEQ ID NO: 598988 - DNA, 25 bp, Homo sapien
gaaatgaaagtggcctgttcctgcc

SEQ ID NO: 598989 - DNA, 25 bp, Homo sapien
aaatgaaagtggcctgttcctgcct

SEQ ID NO: 598990 - DNA, 25 bp, Homo sapien
aatgaaagtggcctgttcctgcctt

SEQ ID NO: 598991 - DNA, 25 bp, Homo sapien
atgaaagtggcctgttcctgcctta

SEQ ID NO: 598992 - DNA, 25 bp, Homo sapien
aaagtggcctgttcctgccttaact

SEQ ID NO: 598993 - DNA, 25 bp, Homo sapien
tgaccgccccccctgcccgccagag

SEQ ID NO: 598994 - DNA, 25 bp, Homo sapien
gaccgccccccctgcccgccagaga

SEQ ID NO: 598995 - DNA, 25 bp, Homo sapien
tgagaattcagaggctgcgacagca

SEQ ID NO: 598996 - DNA, 25 bp, Homo sapien
ttcagaggctgcgacagcagcgcag

SEQ ID NO: 598997 - DNA, 25 bp, Homo sapien
aggctcctgcggctccttagctgtg

SEQ ID NO: 598998 - DNA, 25 bp, Homo sapien
ttagctgtgctcatccggctctcag

SEQ ID NO: 598999 - DNA, 25 bp, Homo sapien
tcatccggctctcagtggatggcag

SEQ ID NO: 599000 - DNA, 25 bp, Homo sapien
gcaggataatccgagagtcttttct

SEQ ID NO: 599001 - DNA, 25 bp, Homo sapien
ggataatccgagagtcttttctgtg

SEQ ID NO: 599002 - DNA, 25 bp, Homo sapien
ggatgtataaatctcttggcactga

SEQ ID NO: 599003 - DNA, 25 bp, Homo sapien
aaatctcttggcactgagtctttgg

SEQ ID NO: 599004 - DNA, 25 bp, Homo sapien
ggcactgagtctttgggacacacat

SEQ ID NO: 599005 - DNA, 25 bp, Homo sapien
gggacacacatatatatcgatacaa

SEQ ID NO: 599006 - DNA, 25 bp, Homo sapien
actctgggaggccaatgcatgtgga

SEQ ID NO: 599007 - DNA, 25 bp, Homo sapien
ctctgggaggccaatgcatgtggat

SEQ ID NO: 599008 - DNA, 25 bp, Homo sapien
tctgggaggccaatgcatgtggatc

SEQ ID NO: 599009 - DNA, 25 bp, Homo sapien
ctgggaggccaatgcatgtggatca

SEQ ID NO: 599010 - DNA, 25 bp, Homo sapien
gggaggccaatgcatgtggatcacc

SEQ ID NO: 599011 - DNA, 25 bp, Homo sapien
ggaggccaatgcatgtggatcacct

SEQ ID NO: 599012 - DNA, 25 bp, Homo sapien
aggccaatgcatgtggatcacctga

SEQ ID NO: 599013 - DNA, 25 bp, Homo sapien
ggccaatgcatgtggatcacctgag

SEQ ID NO: 599014 - DNA, 25 bp, Homo sapien
cctggccaactgcctgaaaccccat

SEQ ID NO: 599015 - DNA, 25 bp, Homo sapien
ggccaactgcctgaaaccccatctc

SEQ ID NO: 599016 - DNA, 25 bp, Homo sapien
gccaactgcctgaaaccccatctct

SEQ ID NO: 599017 - DNA, 25 bp, Homo sapien
gaagtctggtatattcctaccatgg

SEQ ID NO: 599018 - DNA, 25 bp, Homo sapien
attcctaccatggattactatgcag

SEQ ID NO: 599019 - DNA, 25 bp, Homo sapien
catggattactatgcagcagtgaaa

SEQ ID NO: 599020 - DNA, 25 bp, Homo sapien
atggatgcaccaaggcatacactga

SEQ ID NO: 599021 - DNA, 25 bp, Homo sapien
caaggcatacactgaacaaaaggat

SEQ ID NO: 599022 - DNA, 25 bp, Homo sapien
agttggtcagtacctaataaagttg

SEQ ID NO: 599023 - DNA, 25 bp, Homo sapien
gaaactattacacatgtttactagg

SEQ ID NO: 599024 - DNA, 25 bp, Homo sapien
gtttactaggatacatatacaggag

SEQ ID NO: 599025 - DNA, 25 bp, Homo sapien
ggagtatttgtgacagcactgttca

SEQ ID NO: 599026 - DNA, 25 bp, Homo sapien
tatacataggtagagtggatcattg

SEQ ID NO: 599027 - DNA, 25 bp, Homo sapien
gagtggatcattgaagtctggtata

SEQ ID NO: 599028 - DNA, 25 bp, Homo sapien
gtgcctgaaacatataagaggcagt

SEQ ID NO: 599029 - DNA, 25 bp, Homo sapien
gaaacatataagaggcagtgaataa

SEQ ID NO: 599030 - DNA, 25 bp, Homo sapien
atataagaggcagtgaataaatgct

SEQ ID NO: 599031 - DNA, 25 bp, Homo sapien
ataaatgcttattgagtgattacat

SEQ ID NO: 599032 - DNA, 25 bp, Homo sapien
aaatgcttattgagtgattacataa

SEQ ID NO: 599033 - DNA, 25 bp, Homo sapien
aatgcttattgagtgattacataaa

SEQ ID NO: 599034 - DNA, 25 bp, Homo sapien
atgcttattgagtgattacataaag

SEQ ID NO: 599035 - DNA, 25 bp, Homo sapien
gcttattgagtgattacataaagag

SEQ ID NO: 599036 - DNA, 25 bp, Homo sapien
tattgagtgattacataaagagatg

SEQ ID NO: 599037 - DNA, 25 bp, Homo sapien
cataaagagatgaatgggaggctga

SEQ ID NO: 599038 - DNA, 25 bp, Homo sapien
aaagagatgaatgggaggctgaggt

SEQ ID NO: 599039 - DNA, 25 bp, Homo sapien
tttttccctgatttggcacccgtat

SEQ ID NO: 599040 - DNA, 25 bp, Homo sapien
tggcacccgtatcaactcataaaaa

SEQ ID NO: 599041 - DNA, 25 bp, Homo sapien
aagaatttggcttccaatttgcctt

SEQ ID NO: 599042 - DNA, 25 bp, Homo sapien
gccttggaaggtgtagcagctgaca

SEQ ID NO: 599043 - DNA, 25 bp, Homo sapien
gcagctgacagcctttgacgtttat

SEQ ID NO: 599044 - DNA, 25 bp, Homo sapien
gacagcctttgacgtttatttcaac

SEQ ID NO: 599045 - DNA, 25 bp, Homo sapien
agtagatgttcatgttgggtgtgct

SEQ ID NO: 599046 - DNA, 25 bp, Homo sapien
ggtgtgctggctaatgttgaaacgt

SEQ ID NO: 599047 - DNA, 25 bp, Homo sapien
gttgaaacgtggtggcattgttttt

SEQ ID NO: 599048 - DNA, 25 bp, Homo sapien
gttttttcacagatttcattagcac

SEQ ID NO: 599049 - DNA, 25 bp, Homo sapien
tttcattagcacagttagatcaggt

SEQ ID NO: 599050 - DNA, 25 bp, Homo sapien
agcaaagtgggaggtgtgactagct

SEQ ID NO: 599051 - DNA, 25 bp, Homo sapien
gaggtgtgactagctggagacacaa

SEQ ID NO: 599052 - DNA, 25 bp, Homo sapien
ggtgtgactagctggagacacaact

SEQ ID NO: 599053 - DNA, 25 bp, Homo sapien
gtgactagctggagacacaactgca

SEQ ID NO: 599054 - DNA, 25 bp, Homo sapien
gactagctggagacacaactgcaga

SEQ ID NO: 599055 - DNA, 25 bp, Homo sapien
tagctggagacacaactgcagaaat

SEQ ID NO: 599056 - DNA, 25 bp, Homo sapien
tggagacacaactgcagaaatgatc

SEQ ID NO: 599057 - DNA, 25 bp, Homo sapien
gagacacaactgcagaaatgatcct

SEQ ID NO: 599058 - DNA, 25 bp, Homo sapien
gacacaactgcagaaatgatcctga

SEQ ID NO: 599059 - DNA, 25 bp, Homo sapien
gaaatgatcctgaaccgggaaggac

SEQ ID NO: 599060 - DNA, 25 bp, Homo sapien
aatgatcctgaaccgggaaggactg

SEQ ID NO: 599061 - DNA, 25 bp, Homo sapien
aacagggtctgggtgattctgaggt

SEQ ID NO: 599062 - DNA, 25 bp, Homo sapien
gtgattctgaggtaataggccccaa

SEQ ID NO: 599063 - DNA, 25 bp, Homo sapien
attctgaggtaataggccccaaaca

SEQ ID NO: 599064 - DNA, 25 bp, Homo sapien
ggtaataggccccaaacaaccatgg

SEQ ID NO: 599065 - DNA, 25 bp, Homo sapien
cagagggcaagctggcctagtgttt

SEQ ID NO: 599066 - DNA, 25 bp, Homo sapien
ggcaagctggcctagtgtttaacat

SEQ ID NO: 599067 - DNA, 25 bp, Homo sapien
gcaagctggcctagtgtttaacatt

SEQ ID NO: 599068 - DNA, 25 bp, Homo sapien
acagagcagctgatatcagcagttt

SEQ ID NO: 599069 - DNA, 25 bp, Homo sapien
gctgatatcagcagttttactagta

SEQ ID NO: 599070 - DNA, 25 bp, Homo sapien
gcagttttactagtatgcaggacct

SEQ ID NO: 599071 - DNA, 25 bp, Homo sapien
ttttactagtatgcaggacctgaaa

SEQ ID NO: 599072 - DNA, 25 bp, Homo sapien
tttgttgtcacggacagtggtgatg

SEQ ID NO: 599073 - DNA, 25 bp, Homo sapien
taaaagttcccctgaggtggtgact

SEQ ID NO: 599074 - DNA, 25 bp, Homo sapien
gtggtgacttccatgtgggttttat

SEQ ID NO: 599075 - DNA, 25 bp, Homo sapien
gggttttattgcagatatgtaactt

SEQ ID NO: 599076 - DNA, 25 bp, Homo sapien
acttgctttagttatgcctgactga

SEQ ID NO: 599077 - DNA, 25 bp, Homo sapien
cagagatgagtgttttgggccagat

SEQ ID NO: 599078 - DNA, 25 bp, Homo sapien
gggccagatcttcagaaggcagcct

SEQ ID NO: 599079 - DNA, 25 bp, Homo sapien
aaggcagcctcccatttaacaggca

SEQ ID NO: 599080 - DNA, 25 bp, Homo sapien
aggcacttatttatcatgctaacac

SEQ ID NO: 599081 - DNA, 25 bp, Homo sapien
atgctaacactatgtggtttgccat

SEQ ID NO: 599082 - DNA, 25 bp, Homo sapien
aggtaagtctgatgaagcctttttg

SEQ ID NO: 599083 - DNA, 25 bp, Homo sapien
aaaagtctggacttgcttggtggct

SEQ ID NO: 599084 - DNA, 25 bp, Homo sapien
aaagtctggacttgcttggtggctc

SEQ ID NO: 599085 - DNA, 25 bp, Homo sapien
gcctgtaatactaatactttggtag

SEQ ID NO: 599086 - DNA, 25 bp, Homo sapien
gtaatactaatactttggtaggtca

SEQ ID NO: 599087 - DNA, 25 bp, Homo sapien
aatactaatactttggtaggtcaag

SEQ ID NO: 599088 - DNA, 25 bp, Homo sapien
tactaatactttggtaggtcaaggc

SEQ ID NO: 599089 - DNA, 25 bp, Homo sapien
actaatactttggtaggtcaaggca

SEQ ID NO: 599090 - DNA, 25 bp, Homo sapien
ctaatactttggtaggtcaaggcaa

SEQ ID NO: 599091 - DNA, 25 bp, Homo sapien
taatactttggtaggtcaaggcaaa

SEQ ID NO: 599092 - DNA, 25 bp, Homo sapien
atactttggtaggtcaaggcaaaag

SEQ ID NO: 599093 - DNA, 25 bp, Homo sapien
tactttggtaggtcaaggcaaaagg

SEQ ID NO: 599094 - DNA, 25 bp, Homo sapien
aaaattatcctgctgtcattaagag

SEQ ID NO: 599095 - DNA, 25 bp, Homo sapien
tatcctgctgtcattaagagaaaac

SEQ ID NO: 599096 - DNA, 25 bp, Homo sapien
ataaatatttggacccctctctgag

SEQ ID NO: 599097 - DNA, 25 bp, Homo sapien
atttggacccctctctgagaacaaa

SEQ ID NO: 599098 - DNA, 25 bp, Homo sapien
cccctctctgagaacaaactactta

SEQ ID NO: 599099 - DNA, 25 bp, Homo sapien
taaaagtcatttcaatcattaacga

SEQ ID NO: 599100 - DNA, 25 bp, Homo sapien
aatatcataattgagggcctgtgct

SEQ ID NO: 599101 - DNA, 25 bp, Homo sapien
gggtgccagaaatctaccagtgagc

SEQ ID NO: 599102 - DNA, 25 bp, Homo sapien
cagcacggatctttgtccacagtaa

SEQ ID NO: 599103 - DNA, 25 bp, Homo sapien
ggatctttgtccacagtaaatttac

SEQ ID NO: 599104 - DNA, 25 bp, Homo sapien
aaaacaggtctgaaaattgcgtatg

SEQ ID NO: 599105 - DNA, 25 bp, Homo sapien
aaccttgttcagtacagcctggcct

SEQ ID NO: 599106 - DNA, 25 bp, Homo sapien
tgccattttctattcttcctagaga

SEQ ID NO: 599107 - DNA, 25 bp, Homo sapien
tggaaccaactagagcactgctttt

SEQ ID NO: 599108 - DNA, 25 bp, Homo sapien
ggctcatgtagcactagtgggtcct

SEQ ID NO: 599109 - DNA, 25 bp, Homo sapien
ctggcctagaggatccaagagcttt

SEQ ID NO: 599110 - DNA, 25 bp, Homo sapien
aagagcttttggtgccgatgcagcc

SEQ ID NO: 599111 - DNA, 25 bp, Homo sapien
gccgatgcagcctcagggcaaataa

SEQ ID NO: 599112 - DNA, 25 bp, Homo sapien
acagacacatctcagctaaggaaca

SEQ ID NO: 599113 - DNA, 25 bp, Homo sapien
tcatagattcttacagccctcaagg

SEQ ID NO: 599114 - DNA, 25 bp, Homo sapien
agccctcaaggtacttatgggtcaa

SEQ ID NO: 599115 - DNA, 25 bp, Homo sapien
tatgggtcaaagcagcaagggtcta

SEQ ID NO: 599116 - DNA, 25 bp, Homo sapien
ccaggagcagactcagagccatgtg

SEQ ID NO: 599117 - DNA, 25 bp, Homo sapien
agagccatgtgtcttggttgtgctc

SEQ ID NO: 599118 - DNA, 25 bp, Homo sapien
ggtcatttgcatttacattgccttt

SEQ ID NO: 599119 - DNA, 25 bp, Homo sapien
ttacattgccttttacagtgttgat

SEQ ID NO: 599120 - DNA, 25 bp, Homo sapien
cagtgttgattataaactcgtgcaa

SEQ ID NO: 599121 - DNA, 25 bp, Homo sapien
actcgtgcaaaaggtgtgccctgac

SEQ ID NO: 599122 - DNA, 25 bp, Homo sapien
ccctgactacaattaccatagtgag

SEQ ID NO: 599123 - DNA, 25 bp, Homo sapien
tagtgagaccccatacttatcttct

SEQ ID NO: 599124 - DNA, 25 bp, Homo sapien
gaaacaagcccagctctttatgata

SEQ ID NO: 599125 - DNA, 25 bp, Homo sapien
aaaggatcccttttgtttctggcag

SEQ ID NO: 599126 - DNA, 25 bp, Homo sapien
gtttctggcagtgaacaatagttcc

SEQ ID NO: 599127 - DNA, 25 bp, Homo sapien
aacactttaaacatcatctgtatag

SEQ ID NO: 599128 - DNA, 25 bp, Homo sapien
acatcatctgtatagtttgaacaag

SEQ ID NO: 599129 - DNA, 25 bp, Homo sapien
ttgaacaagaagttgtccctctgaa

SEQ ID NO: 599130 - DNA, 25 bp, Homo sapien
aagaagttgtccctctgaatggttg

SEQ ID NO: 599131 - DNA, 25 bp, Homo sapien
aagttgtccctctgaatggttggct

SEQ ID NO: 599132 - DNA, 25 bp, Homo sapien
tgtccctctgaatggttggctcttg

SEQ ID NO: 599133 - DNA, 25 bp, Homo sapien
gttggctcttgtgtagagtgaatca

SEQ ID NO: 599134 - DNA, 25 bp, Homo sapien
gagtgaatcaaagtcctccctagca

SEQ ID NO: 599135 - DNA, 25 bp, Homo sapien
gaatcaaagtcctccctagcatggg

SEQ ID NO: 599136 - DNA, 25 bp, Homo sapien
aaagtcctccctagcatgggaataa

SEQ ID NO: 599137 - DNA, 25 bp, Homo sapien
agcatgggaataaatcggtactgat

SEQ ID NO: 599138 - DNA, 25 bp, Homo sapien
ggaatcgggcgtcttgaaccttctg

SEQ ID NO: 599139 - DNA, 25 bp, Homo sapien
gggcgtcttgaaccttctgcccagc

SEQ ID NO: 599140 - DNA, 25 bp, Homo sapien
agcactccgagtggccggatgcggg

SEQ ID NO: 599141 - DNA, 25 bp, Homo sapien
gggcttaacctcagttggaaactgt

SEQ ID NO: 599142 - DNA, 25 bp, Homo sapien
taacctcagttggaaactgtccaga

SEQ ID NO: 599143 - DNA, 25 bp, Homo sapien
aggccccgagggttctgtgcgcacc

SEQ ID NO: 599144 - DNA, 25 bp, Homo sapien
cgagggttctgtgcgcaccgactgt

SEQ ID NO: 599145 - DNA, 25 bp, Homo sapien
gttctgtgcgcaccgactgtaggaa

SEQ ID NO: 599146 - DNA, 25 bp, Homo sapien
tctgtgcgcaccgactgtaggaagc

SEQ ID NO: 599147 - DNA, 25 bp, Homo sapien
gcgcaccgactgtaggaagcggaat

SEQ ID NO: 599148 - DNA, 25 bp, Homo sapien
cgactgtaggaagcggaatgttgaa

SEQ ID NO: 599149 - DNA, 25 bp, Homo sapien
gcagctttcctctgtaagagaagcc

SEQ ID NO: 599150 - DNA, 25 bp, Homo sapien
gggaagtcactgtttctcttttggg

SEQ ID NO: 599151 - DNA, 25 bp, Homo sapien
gtggcctgggttgctcacacatgga

SEQ ID NO: 599152 - DNA, 25 bp, Homo sapien
gctcacacatggagcaagtggctgg

SEQ ID NO: 599153 - DNA, 25 bp, Homo sapien
ctcccacgacttcctgttaagaggc

SEQ ID NO: 599154 - DNA, 25 bp, Homo sapien
acgacttcctgttaagaggccgaca

SEQ ID NO: 599155 - DNA, 25 bp, Homo sapien
acttcctgttaagaggccgacactc

SEQ ID NO: 599156 - DNA, 25 bp, Homo sapien
gaggccgacactcttggaaagaaaa

SEQ ID NO: 599157 - DNA, 25 bp, Homo sapien
gaaaatcaagctagcctttatatct

SEQ ID NO: 599158 - DNA, 25 bp, Homo sapien
agctagcctttatatctttgtgtga

SEQ ID NO: 599159 - DNA, 25 bp, Homo sapien
tatctttgtgtgatttaggatctaa

SEQ ID NO: 599160 - DNA, 25 bp, Homo sapien
agtcaggcagcactgaacacaattt

SEQ ID NO: 599161 - DNA, 25 bp, Homo sapien
ggcagcactgaacacaatttcaaca

SEQ ID NO: 599162 - DNA, 25 bp, Homo sapien
tttcaacattgcatggaactcctga

SEQ ID NO: 599163 - DNA, 25 bp, Homo sapien
caacattgcatggaactcctgatct

SEQ ID NO: 599164 - DNA, 25 bp, Homo sapien
gggctgcaagcccatttctaagcaa

SEQ ID NO: 599165 - DNA, 25 bp, Homo sapien
tgcaagcccatttctaagcaaggcg

SEQ ID NO: 599166 - DNA, 25 bp, Homo sapien
tgggaaagacctaccctttgggatg

SEQ ID NO: 599167 - DNA, 25 bp, Homo sapien
cagcttccctagtttccccagggag

SEQ ID NO: 599168 - DNA, 25 bp, Homo sapien
gtttccccagggaggcaaagtctct

SEQ ID NO: 599169 - DNA, 25 bp, Homo sapien
ggcaaagtctctcttcccagggact

SEQ ID NO: 599170 - DNA, 25 bp, Homo sapien
agggactctgtcctggtcacagctg

SEQ ID NO: 599171 - DNA, 25 bp, Homo sapien
gtaggtgaggaagttccctggccct

SEQ ID NO: 599172 - DNA, 25 bp, Homo sapien
tgaggaagttccctggccctttgga

SEQ ID NO: 599173 - DNA, 25 bp, Homo sapien
gccctttggacttcctgggtgaggt

SEQ ID NO: 599174 - DNA, 25 bp, Homo sapien
ctttggacttcctgggtgaggtgat

SEQ ID NO: 599175 - DNA, 25 bp, Homo sapien
tgcttcagcttaccctccgtgggct

SEQ ID NO: 599176 - DNA, 25 bp, Homo sapien
ggccatcttgccagctgtctctatc

SEQ ID NO: 599177 - DNA, 25 bp, Homo sapien
ccatcttgccagctgtctctatcga

SEQ ID NO: 599178 - DNA, 25 bp, Homo sapien
atcttgccagctgtctctatcgact

SEQ ID NO: 599179 - DNA, 25 bp, Homo sapien
tcttgccagctgtctctatcgacta

SEQ ID NO: 599180 - DNA, 25 bp, Homo sapien
ttgccagctgtctctatcgactacc

SEQ ID NO: 599181 - DNA, 25 bp, Homo sapien
ctatcgactacctcttattccaaaa

SEQ ID NO: 599182 - DNA, 25 bp, Homo sapien
cagtccctttttgagtaaagcagca

SEQ ID NO: 599183 - DNA, 25 bp, Homo sapien
gtccctttttgagtaaagcagcaag

SEQ ID NO: 599184 - DNA, 25 bp, Homo sapien
acatgctatgtggttaacaagattc

SEQ ID NO: 599185 - DNA, 25 bp, Homo sapien
gaaatgaactcattacagcagctaa

SEQ ID NO: 599186 - DNA, 25 bp, Homo sapien
aatgaactcattacagcagctaatc

SEQ ID NO: 599187 - DNA, 25 bp, Homo sapien
gaactcattacagcagctaatcaat

SEQ ID NO: 599188 - DNA, 25 bp, Homo sapien
attacagcagctaatcaatgcaaac

SEQ ID NO: 599189 - DNA, 25 bp, Homo sapien
agcagctaatcaatgcaaactttgt

SEQ ID NO: 599190 - DNA, 25 bp, Homo sapien
ttgtctttctaagagaaactgaatt

SEQ ID NO: 599191 - DNA, 25 bp, Homo sapien
tacagtgtctaaaacttggtaaaat

SEQ ID NO: 599192 - DNA, 25 bp, Homo sapien
atgaatttatttatgatggagcttc

SEQ ID NO: 599193 - DNA, 25 bp, Homo sapien
aacacatgctccaacttggactaga

SEQ ID NO: 599194 - DNA, 25 bp, Homo sapien
gctccaacttggactagaatgtcct

SEQ ID NO: 599195 - DNA, 25 bp, Homo sapien
ggactagaatgtccttctctctggt

SEQ ID NO: 599196 - DNA, 25 bp, Homo sapien
tctctggtctcagttaactctgtcc

SEQ ID NO: 599197 - DNA, 25 bp, Homo sapien
tggtctcagttaactctgtccctca

SEQ ID NO: 599198 - DNA, 25 bp, Homo sapien
tcagttaactctgtccctcaggtct

SEQ ID NO: 599199 - DNA, 25 bp, Homo sapien
cctcaggtctcagtgcagaagtcac

SEQ ID NO: 599200 - DNA, 25 bp, Homo sapien
ggtctcagtgcagaagtcacctcca

SEQ ID NO: 599201 - DNA, 25 bp, Homo sapien
gtctcagtgcagaagtcacctccac

SEQ ID NO: 599202 - DNA, 25 bp, Homo sapien
taaactttttcctactgtaaatatg

SEQ ID NO: 599203 - DNA, 25 bp, Homo sapien
tgtaaatatgtcccattttctgaaa

SEQ ID NO: 599204 - DNA, 25 bp, Homo sapien
gctcatccccagagataaaaaatga

SEQ ID NO: 599205 - DNA, 25 bp, Homo sapien
cccagcactgtaggaggtgaaggca

SEQ ID NO: 599206 - DNA, 25 bp, Homo sapien
tgagcaaagtggcaagacccccctg

SEQ ID NO: 599207 - DNA, 25 bp, Homo sapien
cgtggtggtcatatcacttgtagtc

SEQ ID NO: 599208 - DNA, 25 bp, Homo sapien
tggtggtcatatcacttgtagtccc

SEQ ID NO: 599209 - DNA, 25 bp, Homo sapien
ggtggtcatatcacttgtagtccca

SEQ ID NO: 599210 - DNA, 25 bp, Homo sapien
gtggtcatatcacttgtagtcccat

SEQ ID NO: 599211 - DNA, 25 bp, Homo sapien
ggtcatatcacttgtagtcccatct

SEQ ID NO: 599212 - DNA, 25 bp, Homo sapien
gtcatatcacttgtagtcccatcta

SEQ ID NO: 599213 - DNA, 25 bp, Homo sapien
tcatatcacttgtagtcccatctac

SEQ ID NO: 599214 - DNA, 25 bp, Homo sapien
catctacttgggagactggaatggg

SEQ ID NO: 599215 - DNA, 25 bp, Homo sapien
ccagctgctcccaagcgaggctgag

SEQ ID NO: 599216 - DNA, 25 bp, Homo sapien
atacaaatttattagcatgcagact

SEQ ID NO: 599217 - DNA, 25 bp, Homo sapien
caaatttattagcatgcagactggg

SEQ ID NO: 599218 - DNA, 25 bp, Homo sapien
tgggagaaccacaaggtgattatcc

SEQ ID NO: 599219 - DNA, 25 bp, Homo sapien
ggagaaccacaaggtgattatccct

SEQ ID NO: 599220 - DNA, 25 bp, Homo sapien
gagaaccacaaggtgattatcccta

SEQ ID NO: 599221 - DNA, 25 bp, Homo sapien
agaaccacaaggtgattatccctat

SEQ ID NO: 599222 - DNA, 25 bp, Homo sapien
gaaccacaaggtgattatccctatt

SEQ ID NO: 599223 - DNA, 25 bp, Homo sapien
aaccacaaggtgattatccctattt

SEQ ID NO: 599224 - DNA, 25 bp, Homo sapien
accacaaggtgattatccctatttt

SEQ ID NO: 599225 - DNA, 25 bp, Homo sapien
tgattatccctattttaaattttct

SEQ ID NO: 599226 - DNA, 25 bp, Homo sapien
gagcttttactcatggcaaaaggca

SEQ ID NO: 599227 - DNA, 25 bp, Homo sapien
agcaggtatcttcacagggctagag

SEQ ID NO: 599228 - DNA, 25 bp, Homo sapien
gcaggtatcttcacagggctagagc

SEQ ID NO: 599229 - DNA, 25 bp, Homo sapien
caggtatcttcacagggctagagca

SEQ ID NO: 599230 - DNA, 25 bp, Homo sapien
aggtatcttcacagggctagagcaa

SEQ ID NO: 599231 - DNA, 25 bp, Homo sapien
ggtatcttcacagggctagagcaag

SEQ ID NO: 599232 - DNA, 25 bp, Homo sapien
atcttcacagggctagagcaagagg

SEQ ID NO: 599233 - DNA, 25 bp, Homo sapien
gaactctatcacgagacagcagtag

SEQ ID NO: 599234 - DNA, 25 bp, Homo sapien
aactctatcacgagacagcagtagg

SEQ ID NO: 599235 - DNA, 25 bp, Homo sapien
actctatcacgagacagcagtaggg

SEQ ID NO: 599236 - DNA, 25 bp, Homo sapien
gggacagtgctaaatcattcatgag

SEQ ID NO: 599237 - DNA, 25 bp, Homo sapien
ctgctggtgtgtgctcaggtgtacc

SEQ ID NO: 599238 - DNA, 25 bp, Homo sapien
tgtgtgctcaggtgtacctgcctct

SEQ ID NO: 599239 - DNA, 25 bp, Homo sapien
ttcccgtcaggtccctgctttgcat

SEQ ID NO: 599240 - DNA, 25 bp, Homo sapien
gtagtctaagtgacacgggtctccc

SEQ ID NO: 599241 - DNA, 25 bp, Homo sapien
aagtgacacgggtctccctctcttt

SEQ ID NO: 599242 - DNA, 25 bp, Homo sapien
aactgcatcgctcaatcctgcaatg

SEQ ID NO: 599243 - DNA, 25 bp, Homo sapien
gctcaatcctgcaatgtgtcacaat

SEQ ID NO: 599244 - DNA, 25 bp, Homo sapien
caatgtgtcacaatggtgtggagct

SEQ ID NO: 599245 - DNA, 25 bp, Homo sapien
attctggatgatgtggcgtgacctc

SEQ ID NO: 599246 - DNA, 25 bp, Homo sapien
ggcgtgacctcacactgatgccatt

SEQ ID NO: 599247 - DNA, 25 bp, Homo sapien
ctccacccatggaataagccagaat

SEQ ID NO: 599248 - DNA, 25 bp, Homo sapien
tttaggacctacagatatatatttt

SEQ ID NO: 599249 - DNA, 25 bp, Homo sapien
ttttggagttgccactttataatgt

SEQ ID NO: 599250 - DNA, 25 bp, Homo sapien
gagttgccactttataatgtgtaaa

SEQ ID NO: 599251 - DNA, 25 bp, Homo sapien
aagtgtgcaacatcaatatcattta

SEQ ID NO: 599252 - DNA, 25 bp, Homo sapien
atggcctatctttaaaatatcctgt

SEQ ID NO: 599253 - DNA, 25 bp, Homo sapien
tttatgatactgtcaattgctgtca

SEQ ID NO: 599254 - DNA, 25 bp, Homo sapien
gatactgtcaattgctgtcattgag

SEQ ID NO: 599255 - DNA, 25 bp, Homo sapien
gtcaattgctgtcattgagatgata

SEQ ID NO: 599256 - DNA, 25 bp, Homo sapien
gagaaagcctggctattaaagtaaa

SEQ ID NO: 599257 - DNA, 25 bp, Homo sapien
acataagaattgtttcgccaaatga

SEQ ID NO: 599258 - DNA, 25 bp, Homo sapien
gtttcgccaaatgaatgttcctgtg

SEQ ID NO: 599259 - DNA, 25 bp, Homo sapien
tcttagctgggcgtgcaacagacca

SEQ ID NO: 599260 - DNA, 25 bp, Homo sapien
tagctgggcgtgcaacagaccaaca

SEQ ID NO: 599261 - DNA, 25 bp, Homo sapien
gggcgtgcaacagaccaacagataa

SEQ ID NO: 599262 - DNA, 25 bp, Homo sapien
gcgtgcaacagaccaacagataact

SEQ ID NO: 599263 - DNA, 25 bp, Homo sapien
gcaacagaccaacagataactcatc

SEQ ID NO: 599264 - DNA, 25 bp, Homo sapien
ctttcccttgtgaacaaaagcctag

SEQ ID NO: 599265 - DNA, 25 bp, Homo sapien
aaaagcctagttttgtgtgggcagc

SEQ ID NO: 599266 - DNA, 25 bp, Homo sapien
aagcctagttttgtgtgggcagcaa

SEQ ID NO: 599267 - DNA, 25 bp, Homo sapien
cctagttttgtgtgggcagcaatat

SEQ ID NO: 599268 - DNA, 25 bp, Homo sapien
gtgtgggcagcaatatagggtaaat

SEQ ID NO: 599269 - DNA, 25 bp, Homo sapien
aataaaaccacctgattctccagcc

SEQ ID NO: 599270 - DNA, 25 bp, Homo sapien
aatcccagcacccaaggatctcttg

SEQ ID NO: 599271 - DNA, 25 bp, Homo sapien
atcccagcacccaaggatctcttga

SEQ ID NO: 599272 - DNA, 25 bp, Homo sapien
tcccagcacccaaggatctcttgag

SEQ ID NO: 599273 - DNA, 25 bp, Homo sapien
ccagcacccaaggatctcttgaggc

SEQ ID NO: 599274 - DNA, 25 bp, Homo sapien
tcaagaccagcttaaacagcatagt

SEQ ID NO: 599275 - DNA, 25 bp, Homo sapien
caagaccagcttaaacagcatagtg

SEQ ID NO: 599276 - DNA, 25 bp, Homo sapien
taaaataagtaagctgggcactgtg

SEQ ID NO: 599277 - DNA, 25 bp, Homo sapien
tggctcataactgtagtcttagcca

SEQ ID NO: 599278 - DNA, 25 bp, Homo sapien
ataactgtagtcttagccactcgag

SEQ ID NO: 599279 - DNA, 25 bp, Homo sapien
actgtagtcttagccactcgagagg

SEQ ID NO: 599280 - DNA, 25 bp, Homo sapien
agagtgaaaccctgttgaaaggaag

SEQ ID NO: 599281 - DNA, 25 bp, Homo sapien
gtgattttgccatattagtttacca

SEQ ID NO: 599282 - DNA, 25 bp, Homo sapien
tttgccatattagtttaccatctgt

SEQ ID NO: 599283 - DNA, 25 bp, Homo sapien
gtttaccatctgtacaattatttgc

SEQ ID NO: 599284 - DNA, 25 bp, Homo sapien
ccatctgtacaattatttgctttat

SEQ ID NO: 599285 - DNA, 25 bp, Homo sapien
ctttaaattggctcattattcactt

SEQ ID NO: 599286 - DNA, 25 bp, Homo sapien
aattggctcattattcacttaatga

SEQ ID NO: 599287 - DNA, 25 bp, Homo sapien
gaaattattgcaacaggaatctttt

SEQ ID NO: 599288 - DNA, 25 bp, Homo sapien
gcaacaggaatcttttgtatcactt

SEQ ID NO: 599289 - DNA, 25 bp, Homo sapien
gaatcttttgtatcacttctgtaaa

SEQ ID NO: 599290 - DNA, 25 bp, Homo sapien
agtctcatttgccatcaatagaagg

SEQ ID NO: 599291 - DNA, 25 bp, Homo sapien
atttgccatcaatagaaggtaaaac

SEQ ID NO: 599292 - DNA, 25 bp, Homo sapien
acctcatggtccagccccagctacg

SEQ ID NO: 599293 - DNA, 25 bp, Homo sapien
tgctgccgccgacagagcgccccat

SEQ ID NO: 599294 - DNA, 25 bp, Homo sapien
agcacagaactgcccatcgggacgc

SEQ ID NO: 599295 - DNA, 25 bp, Homo sapien
ccgctcgggcgcagcacaagggaca

SEQ ID NO: 599296 - DNA, 25 bp, Homo sapien
cgcacccccagaatataagctatca

SEQ ID NO: 599297 - DNA, 25 bp, Homo sapien
ccccagaatataagctatcaagagt

SEQ ID NO: 599298 - DNA, 25 bp, Homo sapien
ggaatgagctgaggcggatttcccc

SEQ ID NO: 599299 - DNA, 25 bp, Homo sapien
tgagctgaggcggatttccccagag

SEQ ID NO: 599300 - DNA, 25 bp, Homo sapien
agctgaggcggatttccccagagaa

SEQ ID NO: 599301 - DNA, 25 bp, Homo sapien
gctgaggcggatttccccagagaaa

SEQ ID NO: 599302 - DNA, 25 bp, Homo sapien
tgaggcggatttccccagagaaaca

SEQ ID NO: 599303 - DNA, 25 bp, Homo sapien
atgcagagggctgcacatagacaca

SEQ ID NO: 599304 - DNA, 25 bp, Homo sapien
gagatgcacagaaacacgcagaccc

SEQ ID NO: 599305 - DNA, 25 bp, Homo sapien
tgcacagaaacacgcagaccccatg

SEQ ID NO: 599306 - DNA, 25 bp, Homo sapien
agaaacacgcagaccccatgcaggg

SEQ ID NO: 599307 - DNA, 25 bp, Homo sapien
gaaacacgcagaccccatgcaggga

SEQ ID NO: 599308 - DNA, 25 bp, Homo sapien
agggacctgctttcccgccacagag

SEQ ID NO: 599309 - DNA, 25 bp, Homo sapien
ttcccgccacagaggaaagcaatct

SEQ ID NO: 599310 - DNA, 25 bp, Homo sapien
cccgccacagaggaaagcaatctga

SEQ ID NO: 599311 - DNA, 25 bp, Homo sapien
agcaatctgatcaaacagacccact

SEQ ID NO: 599312 - DNA, 25 bp, Homo sapien
tctgatcaaacagacccactgtgca

SEQ ID NO: 599313 - DNA, 25 bp, Homo sapien
agccctccatgcttggggacaacac

SEQ ID NO: 599314 - DNA, 25 bp, Homo sapien
gcacctactacctgcatgtccagag

SEQ ID NO: 599315 - DNA, 25 bp, Homo sapien
atgtccagagcatgctcacccagct

SEQ ID NO: 599316 - DNA, 25 bp, Homo sapien
tgcctacccacgacaaggagacaga

SEQ ID NO: 599317 - DNA, 25 bp, Homo sapien
agctggtagccagccgccagatgag

SEQ ID NO: 599318 - DNA, 25 bp, Homo sapien
gatgagcttcctaaagctgaccctg

SEQ ID NO: 599319 - DNA, 25 bp, Homo sapien
aaagctgaccctgggtctggtgaat

SEQ ID NO: 599320 - DNA, 25 bp, Homo sapien
atgttagggtggtccagtacctggc

SEQ ID NO: 599321 - DNA, 25 bp, Homo sapien
agctgctgaagctgcactacatgca

SEQ ID NO: 599322 - DNA, 25 bp, Homo sapien
accccatgctcaggtttgactatgt

SEQ ID NO: 599323 - DNA, 25 bp, Homo sapien
atgctcaggtttgactatgtcccca

SEQ ID NO: 599324 - DNA, 25 bp, Homo sapien
ctatgtccccagctttttgtataaa

SEQ ID NO: 599325 - DNA, 25 bp, Homo sapien
agaccgtcagttagcccagcttctg

SEQ ID NO: 599326 - DNA, 25 bp, Homo sapien
gaccgtcagttagcccagcttctgg

SEQ ID NO: 599327 - DNA, 25 bp, Homo sapien
cttctgggataacgcgtctcatcga

SEQ ID NO: 599328 - DNA, 25 bp, Homo sapien
ctgggataacgcgtctcatcgaact

SEQ ID NO: 599329 - DNA, 25 bp, Homo sapien
tgggataacgcgtctcatcgaactg

SEQ ID NO: 599330 - DNA, 25 bp, Homo sapien
ggataacgcgtctcatcgaactgga

SEQ ID NO: 599331 - DNA, 25 bp, Homo sapien
tggaacttgccacactgagtgtctg

SEQ ID NO: 599332 - DNA, 25 bp, Homo sapien
gaacttgccacactgagtgtctggg

SEQ ID NO: 599333 - DNA, 25 bp, Homo sapien
acttgccacactgagtgtctgggtc

SEQ ID NO: 599334 - DNA, 25 bp, Homo sapien
gccacactgagtgtctgggtccaag

SEQ ID NO: 599335 - DNA, 25 bp, Homo sapien
ccacactgagtgtctgggtccaagg

SEQ ID NO: 599336 - DNA, 25 bp, Homo sapien
atatactgcattaggccattactgc

SEQ ID NO: 599337 - DNA, 25 bp, Homo sapien
tatactgcattaggccattactgca

SEQ ID NO: 599338 - DNA, 25 bp, Homo sapien
atactgcattaggccattactgcat

SEQ ID NO: 599339 - DNA, 25 bp, Homo sapien
actgcattaggccattactgcattg

SEQ ID NO: 599340 - DNA, 25 bp, Homo sapien
ctgcattaggccattactgcattgc

SEQ ID NO: 599341 - DNA, 25 bp, Homo sapien
tgcattaggccattactgcattgct

SEQ ID NO: 599342 - DNA, 25 bp, Homo sapien
gcattaggccattactgcattgcta

SEQ ID NO: 599343 - DNA, 25 bp, Homo sapien
cattaggccattactgcattgctat

SEQ ID NO: 599344 - DNA, 25 bp, Homo sapien
aggccattactgcattgctataaag

SEQ ID NO: 599345 - DNA, 25 bp, Homo sapien
aaatacctgagattggccgggggca

SEQ ID NO: 599346 - DNA, 25 bp, Homo sapien
atacctgagattggccgggggcagt

SEQ ID NO: 599347 - DNA, 25 bp, Homo sapien
ctgatagaagatttttgtccatgct

SEQ ID NO: 599348 - DNA, 25 bp, Homo sapien
gaagatttttgtccatgcttgattt

SEQ ID NO: 599349 - DNA, 25 bp, Homo sapien
gaaaaactttcatgggttagcatta

SEQ ID NO: 599350 - DNA, 25 bp, Homo sapien
catgggttagcattaccttaatctt

SEQ ID NO: 599351 - DNA, 25 bp, Homo sapien
taccttaatctttgttgctcaagtg

SEQ ID NO: 599352 - DNA, 25 bp, Homo sapien
taatctttgttgctcaagtgccaga

SEQ ID NO: 599353 - DNA, 25 bp, Homo sapien
ttgttgctcaagtgccagaggttgg

SEQ ID NO: 599354 - DNA, 25 bp, Homo sapien
gcagtgaattttagtcattaacttc

SEQ ID NO: 599355 - DNA, 25 bp, Homo sapien
aaataggtgcctcctttataaacag

SEQ ID NO: 599356 - DNA, 25 bp, Homo sapien
aacagtaatagctacgtttgggaag

SEQ ID NO: 599357 - DNA, 25 bp, Homo sapien
taatagctacgtttgggaaggagga

SEQ ID NO: 599358 - DNA, 25 bp, Homo sapien
gaagagatcattctcctgtttgcaa

SEQ ID NO: 599359 - DNA, 25 bp, Homo sapien
tgtgaagagacctgtccacagccat

SEQ ID NO: 599360 - DNA, 25 bp, Homo sapien
gaagatgggacctgatttcttacac

SEQ ID NO: 599361 - DNA, 25 bp, Homo sapien
tttcttacaccccaggtatctgctc

SEQ ID NO: 599362 - DNA, 25 bp, Homo sapien
gctcatcatcttgggtaagaccaca

SEQ ID NO: 599363 - DNA, 25 bp, Homo sapien
ggtaagaccacagggaccaccaaga

SEQ ID NO: 599364 - DNA, 25 bp, Homo sapien
agggaccaccaagacacccagaaga

SEQ ID NO: 599365 - DNA, 25 bp, Homo sapien
cacccagaagagacacttgattgtt

SEQ ID NO: 599366 - DNA, 25 bp, Homo sapien
aagagacacttgattgtttcctgga

SEQ ID NO: 599367 - DNA, 25 bp, Homo sapien
gggcccatagatatatgccatttac

SEQ ID NO: 599368 - DNA, 25 bp, Homo sapien
gccatttactttacatgctttctaa

SEQ ID NO: 599369 - DNA, 25 bp, Homo sapien
aagaagcaaaataggcagttcctgc

SEQ ID NO: 599370 - DNA, 25 bp, Homo sapien
gcaaaataggcagttcctgccttaa

SEQ ID NO: 599371 - DNA, 25 bp, Homo sapien
cctaactgaacaactgacctcgtga

SEQ ID NO: 599372 - DNA, 25 bp, Homo sapien
taactgaacaactgacctcgtgaca

SEQ ID NO: 599373 - DNA, 25 bp, Homo sapien
aactgaacaactgacctcgtgacat

SEQ ID NO: 599374 - DNA, 25 bp, Homo sapien
actgaacaactgacctcgtgacatt

SEQ ID NO: 599375 - DNA, 25 bp, Homo sapien
tgaacaactgacctcgtgacattcc

SEQ ID NO: 599376 - DNA, 25 bp, Homo sapien
gaacaactgacctcgtgacattcct

SEQ ID NO: 599377 - DNA, 25 bp, Homo sapien
aacaactgacctcgtgacattcctt

SEQ ID NO: 599378 - DNA, 25 bp, Homo sapien
caactgacctcgtgacattccttct

SEQ ID NO: 599379 - DNA, 25 bp, Homo sapien
ctggactgagtctcaggagctcccc

SEQ ID NO: 599380 - DNA, 25 bp, Homo sapien
atttacatagccttacacttctctc

SEQ ID NO: 599381 - DNA, 25 bp, Homo sapien
ccttacacttctctctactgaatat

SEQ ID NO: 599382 - DNA, 25 bp, Homo sapien
ttctctctactgaatatcatacgtt

SEQ ID NO: 599383 - DNA, 25 bp, Homo sapien
gaatatcatacgttacttttcttaa

SEQ ID NO: 599384 - DNA, 25 bp, Homo sapien
aatgtgtctagtcatatatgtgtga

SEQ ID NO: 599385 - DNA, 25 bp, Homo sapien
atgtataaaggccagttccctccag

SEQ ID NO: 599386 - DNA, 25 bp, Homo sapien
tataaaggccagttccctccaggag

SEQ ID NO: 599387 - DNA, 25 bp, Homo sapien
tccctccaggagcaatgacagtctt

SEQ ID NO: 599388 - DNA, 25 bp, Homo sapien
gcaatgacagtctttattcggagct

SEQ ID NO: 599389 - DNA, 25 bp, Homo sapien
tgacagtctttattcggagctttaa

SEQ ID NO: 599390 - DNA, 25 bp, Homo sapien
gtctttattcggagctttaaggtag

SEQ ID NO: 599391 - DNA, 25 bp, Homo sapien
aaaaatttatgtgggtacatggtat

SEQ ID NO: 599392 - DNA, 25 bp, Homo sapien
atgtgggtacatggtatgtgtatac

SEQ ID NO: 599393 - DNA, 25 bp, Homo sapien
ggtacatggtatgtgtatacattca

SEQ ID NO: 599394 - DNA, 25 bp, Homo sapien
acatggtatgtgtatacattcatgg

SEQ ID NO: 599395 - DNA, 25 bp, Homo sapien
tggcatagatgggttactttgatac

SEQ ID NO: 599396 - DNA, 25 bp, Homo sapien
gcatagatgggttactttgatacag

SEQ ID NO: 599397 - DNA, 25 bp, Homo sapien
tagatgggttactttgatacagaca

SEQ ID NO: 599398 - DNA, 25 bp, Homo sapien
gatgggttactttgatacagacatg

SEQ ID NO: 599399 - DNA, 25 bp, Homo sapien
acagacatgcaacatgtaatcacat

SEQ ID NO: 599400 - DNA, 25 bp, Homo sapien
gacatgcaacatgtaatcacatcag

SEQ ID NO: 599401 - DNA, 25 bp, Homo sapien
acaatccaattatacacttcatttt

SEQ ID NO: 599402 - DNA, 25 bp, Homo sapien
agctggattcttaagttcctgttag

SEQ ID NO: 599403 - DNA, 25 bp, Homo sapien
ctggattcttaagttcctgttagtg

SEQ ID NO: 599404 - DNA, 25 bp, Homo sapien
taaggcgctgctcagacttttagta

SEQ ID NO: 599405 - DNA, 25 bp, Homo sapien
ggcgctgctcagacttttagtaaag

SEQ ID NO: 599406 - DNA, 25 bp, Homo sapien
gctgctcagacttttagtaaaggtg

SEQ ID NO: 599407 - DNA, 25 bp, Homo sapien
tttagtaaaggtgagcgccatctac

SEQ ID NO: 599408 - DNA, 25 bp, Homo sapien
aaaggtgagcgccatctactgccaa

SEQ ID NO: 599409 - DNA, 25 bp, Homo sapien
gtgagcgccatctactgccaagtct

SEQ ID NO: 599410 - DNA, 25 bp, Homo sapien
gccatctactgccaagtctcacaaa

SEQ ID NO: 599411 - DNA, 25 bp, Homo sapien
gtcttgatgtgccacgatgactttt

SEQ ID NO: 599412 - DNA, 25 bp, Homo sapien
ttgatgtgccacgatgacttttttg

SEQ ID NO: 599413 - DNA, 25 bp, Homo sapien
gggctactttcacacaagtatggat

SEQ ID NO: 599414 - DNA, 25 bp, Homo sapien
ctttcacacaagtatggattcccct

SEQ ID NO: 599415 - DNA, 25 bp, Homo sapien
ttcacacaagtatggattccccttt

SEQ ID NO: 599416 - DNA, 25 bp, Homo sapien
cacaagtatggattccccttttcca

SEQ ID NO: 599417 - DNA, 25 bp, Homo sapien
cccttttccatgttcctaagaatgg

SEQ ID NO: 599418 - DNA, 25 bp, Homo sapien
ttcctaagaatggagaacacctttc

SEQ ID NO: 599419 - DNA, 25 bp, Homo sapien
gaatggagaacacctttcttttgta

SEQ ID NO: 599420 - DNA, 25 bp, Homo sapien
tggagaacacctttcttttgtataa

SEQ ID NO: 599421 - DNA, 25 bp, Homo sapien
gagaacacctttcttttgtataaag

SEQ ID NO: 599422 - DNA, 25 bp, Homo sapien
gaacacctttcttttgtataaagtg

SEQ ID NO: 599423 - DNA, 25 bp, Homo sapien
tgtataaagtgggatctcggagatc

SEQ ID NO: 599424 - DNA, 25 bp, Homo sapien
gtgattatgcatttgtaactgtgtt

SEQ ID NO: 599425 - DNA, 25 bp, Homo sapien
ctgaagacatcagtcacattggatt

SEQ ID NO: 599426 - DNA, 25 bp, Homo sapien
gtcacattggattagccacccttat

SEQ ID NO: 599427 - DNA, 25 bp, Homo sapien
ggattagccacccttatggctgcat

SEQ ID NO: 599428 - DNA, 25 bp, Homo sapien
ttatggctgcatttcaccttgatta

SEQ ID NO: 599429 - DNA, 25 bp, Homo sapien
ggctgcatttcaccttgattaccac

SEQ ID NO: 599430 - DNA, 25 bp, Homo sapien
catttcaccttgattaccactttaa

SEQ ID NO: 599431 - DNA, 25 bp, Homo sapien
gattaccactttaaaggccctgtct

SEQ ID NO: 599432 - DNA, 25 bp, Homo sapien
gggttatggctccaacatactcatt

SEQ ID NO: 599433 - DNA, 25 bp, Homo sapien
caacatactcatttggaagccaggt

SEQ ID NO: 599434 - DNA, 25 bp, Homo sapien
catactcatttggaagccaggtgtg

SEQ ID NO: 599435 - DNA, 25 bp, Homo sapien
gggtgatcagacaatcaaggttcta

SEQ ID NO: 599436 - DNA, 25 bp, Homo sapien
gacaatcaaggttctagtacagaga

SEQ ID NO: 599437 - DNA, 25 bp, Homo sapien
ctagtacagagaatccttttggagt

SEQ ID NO: 599438 - DNA, 25 bp, Homo sapien
gtacagagaatccttttggagtttc

SEQ ID NO: 599439 - DNA, 25 bp, Homo sapien
ccttttggagtttctgctagattga

SEQ ID NO: 599440 - DNA, 25 bp, Homo sapien
tttggagtttctgctagattgacag

SEQ ID NO: 599441 - DNA, 25 bp, Homo sapien
tgctagattgacagaaatccccaat

SEQ ID NO: 599442 - DNA, 25 bp, Homo sapien
gattgacagaaatccccaattcagg

SEQ ID NO: 599443 - DNA, 25 bp, Homo sapien
gacagaaatccccaattcaggagtt

SEQ ID NO: 599444 - DNA, 25 bp, Homo sapien
gaaatccccaattcaggagttaaca

SEQ ID NO: 599445 - DNA, 25 bp, Homo sapien
cccaattcaggagttaacagttaag

SEQ ID NO: 599446 - DNA, 25 bp, Homo sapien
aagattcttctttgcttcctgaacc

SEQ ID NO: 599447 - DNA, 25 bp, Homo sapien
gaaccccaggcatccttaggaattt

SEQ ID NO: 599448 - DNA, 25 bp, Homo sapien
aggaatttgcttcatgtcctcactt

SEQ ID NO: 599449 - DNA, 25 bp, Homo sapien
atgtcctcacttgtccttgaaggct

SEQ ID NO: 599450 - DNA, 25 bp, Homo sapien
gaaggcttgtttttcaggatgaact

SEQ ID NO: 599451 - DNA, 25 bp, Homo sapien
aacccaatgctattgttgctgatat

SEQ ID NO: 599452 - DNA, 25 bp, Homo sapien
aaaccattccaaactgagccaactg

SEQ ID NO: 599453 - DNA, 25 bp, Homo sapien
ggcccctaaacaagccagcaggcag

SEQ ID NO: 599454 - DNA, 25 bp, Homo sapien
gcccctcactaatgcccagtttaga

SEQ ID NO: 599455 - DNA, 25 bp, Homo sapien
gaacatgttaggaccaggctatctg

SEQ ID NO: 599456 - DNA, 25 bp, Homo sapien
ggaccaggctatctgcatagcttta

SEQ ID NO: 599457 - DNA, 25 bp, Homo sapien
tgctgctctgctgttgatctcatta

SEQ ID NO: 599458 - DNA, 25 bp, Homo sapien
gttgatctcattactgttaccttca

SEQ ID NO: 599459 - DNA, 25 bp, Homo sapien
tcattactgttaccttcatctttac

SEQ ID NO: 599460 - DNA, 25 bp, Homo sapien
catctttactattattaggtgctgg

SEQ ID NO: 599461 - DNA, 25 bp, Homo sapien
attaggtgctgggaacaaagttgtc

SEQ ID NO: 599462 - DNA, 25 bp, Homo sapien
caaagttgtccaccaaaacaaagcg

SEQ ID NO: 599463 - DNA, 25 bp, Homo sapien
aaagcgaaactatacccaccatggt

SEQ ID NO: 599464 - DNA, 25 bp, Homo sapien
aaactatacccaccatggttcctgt

SEQ ID NO: 599465 - DNA, 25 bp, Homo sapien
atggttcctgtccttatggagcacc

SEQ ID NO: 599466 - DNA, 25 bp, Homo sapien
atggagcaccaagtttcctgaggga

SEQ ID NO: 599467 - DNA, 25 bp, Homo sapien
gggaggcatacactgaataaaagac

SEQ ID NO: 599468 - DNA, 25 bp, Homo sapien
taccagccctgcttcgtcctccgga

SEQ ID NO: 599469 - DNA, 25 bp, Homo sapien
ctacgccccatgtgctcctgcaggg

SEQ ID NO: 599470 - DNA, 25 bp, Homo sapien
tcatgcttgccataaccctgctgga

SEQ ID NO: 599471 - DNA, 25 bp, Homo sapien
catgcttgccataaccctgctggag

SEQ ID NO: 599472 - DNA, 25 bp, Homo sapien
atgcttgccataaccctgctggagg

SEQ ID NO: 599473 - DNA, 25 bp, Homo sapien
tgcttgccataaccctgctggagga

SEQ ID NO: 599474 - DNA, 25 bp, Homo sapien
cttgccataaccctgctggaggagc

SEQ ID NO: 599475 - DNA, 25 bp, Homo sapien
aggagcggctactgcccgtgaccac

SEQ ID NO: 599476 - DNA, 25 bp, Homo sapien
ggctactgcccgtgaccactgaggg

SEQ ID NO: 599477 - DNA, 25 bp, Homo sapien
tactgcccgtgaccactgagggctg

SEQ ID NO: 599478 - DNA, 25 bp, Homo sapien
actgcccgtgaccactgagggctga

SEQ ID NO: 599479 - DNA, 25 bp, Homo sapien
attcagaaataaatgccagtagccc

SEQ ID NO: 599480 - DNA, 25 bp, Homo sapien
atgccagtagcccaggagcaaaaat

SEQ ID NO: 599481 - DNA, 25 bp, Homo sapien
gccagtagcccaggagcaaaaattt

SEQ ID NO: 599482 - DNA, 25 bp, Homo sapien
agtagcccaggagcaaaaatttttg

SEQ ID NO: 599483 - DNA, 25 bp, Homo sapien
cagatacctaggacacagagttgga

SEQ ID NO: 599484 - DNA, 25 bp, Homo sapien
gatacctaggacacagagttggaaa

SEQ ID NO: 599485 - DNA, 25 bp, Homo sapien
cctaggacacagagttggaaataac

SEQ ID NO: 599486 - DNA, 25 bp, Homo sapien
cctccagtaagaccttaagacagtt

SEQ ID NO: 599487 - DNA, 25 bp, Homo sapien
gtaagaccttaagacagttctgtca

SEQ ID NO: 599488 - DNA, 25 bp, Homo sapien
gaccttaagacagttctgtcataaa

SEQ ID NO: 599489 - DNA, 25 bp, Homo sapien
aaatacgaggtttggccgggtgcag

SEQ ID NO: 599490 - DNA, 25 bp, Homo sapien
gtactccaaccttcctcaacataag

SEQ ID NO: 599491 - DNA, 25 bp, Homo sapien
actccaaccttcctcaacataagag

SEQ ID NO: 599492 - DNA, 25 bp, Homo sapien
ccaaccttcctcaacataagagaac

SEQ ID NO: 599493 - DNA, 25 bp, Homo sapien
aatgtgggagcctttaagtcttcct

SEQ ID NO: 599494 - DNA, 25 bp, Homo sapien
tgtgggagcctttaagtcttcctca

SEQ ID NO: 599495 - DNA, 25 bp, Homo sapien
gtgggagcctttaagtcttcctcag

SEQ ID NO: 599496 - DNA, 25 bp, Homo sapien
gggagcctttaagtcttcctcagtc

SEQ ID NO: 599497 - DNA, 25 bp, Homo sapien
ctcagtcttttctaatcataattca

SEQ ID NO: 599498 - DNA, 25 bp, Homo sapien
cttttctaatcataattcatactgg

SEQ ID NO: 599499 - DNA, 25 bp, Homo sapien
tactgaatataattcttactgcaga

SEQ ID NO: 599500 - DNA, 25 bp, Homo sapien
tataattcttactgcagaaaacccc

SEQ ID NO: 599501 - DNA, 25 bp, Homo sapien
attgatactgatgatgcttgtggca

SEQ ID NO: 599502 - DNA, 25 bp, Homo sapien
actgatgatgcttgtggcattcaga

SEQ ID NO: 599503 - DNA, 25 bp, Homo sapien
atgcttgtggcattcagaaggaaac

SEQ ID NO: 599504 - DNA, 25 bp, Homo sapien
attcagaaggaaactcctggtaaat

SEQ ID NO: 599505 - DNA, 25 bp, Homo sapien
gaaactcctggtaaatttaactcat

SEQ ID NO: 599506 - DNA, 25 bp, Homo sapien
aaatttaactcatcattccggtgac

SEQ ID NO: 599507 - DNA, 25 bp, Homo sapien
ttaactcatcattccggtgacataa

SEQ ID NO: 599508 - DNA, 25 bp, Homo sapien
atcattccggtgacataaagcccat

SEQ ID NO: 599509 - DNA, 25 bp, Homo sapien
attccggtgacataaagcccatgaa

SEQ ID NO: 599510 - DNA, 25 bp, Homo sapien
tccggtgacataaagcccatgaaat

SEQ ID NO: 599511 - DNA, 25 bp, Homo sapien
tgacataaagcccatgaaattgttt

SEQ ID NO: 599512 - DNA, 25 bp, Homo sapien
aaaaatttatgtgggtacatggtat

SEQ ID NO: 599513 - DNA, 25 bp, Homo sapien
atgtgggtacatggtatgtgtatac

SEQ ID NO: 599514 - DNA, 25 bp, Homo sapien
gggtacatggtatgtgtatacattc

SEQ ID NO: 599515 - DNA, 25 bp, Homo sapien
gtacatggtatgtgtatacattcat

SEQ ID NO: 599516 - DNA, 25 bp, Homo sapien
acatggtatgtgtatacattcatgg

SEQ ID NO: 599517 - DNA, 25 bp, Homo sapien
tggcatagatgggttactttgatac

SEQ ID NO: 599518 - DNA, 25 bp, Homo sapien
gcatagatgggttactttgatacag

SEQ ID NO: 599519 - DNA, 25 bp, Homo sapien
atagatgggttactttgatacagac

SEQ ID NO: 599520 - DNA, 25 bp, Homo sapien
tagatgggttactttgatacagaca

SEQ ID NO: 599521 - DNA, 25 bp, Homo sapien
gatgggttactttgatacagacatg

SEQ ID NO: 599522 - DNA, 25 bp, Homo sapien
acagacatgcaacatgtaatcacat

SEQ ID NO: 599523 - DNA, 25 bp, Homo sapien
agtcgcaggacacatgccggccagt

SEQ ID NO: 599524 - DNA, 25 bp, Homo sapien
tcgcaggacacatgccggccagtta

SEQ ID NO: 599525 - DNA, 25 bp, Homo sapien
cgcaggacacatgccggccagttaa

SEQ ID NO: 599526 - DNA, 25 bp, Homo sapien
cacatgccggccagttaattcattc

SEQ ID NO: 599527 - DNA, 25 bp, Homo sapien
acatgccggccagttaattcattct

SEQ ID NO: 599528 - DNA, 25 bp, Homo sapien
catgccggccagttaattcattctc

SEQ ID NO: 599529 - DNA, 25 bp, Homo sapien
atgccggccagttaattcattctca

SEQ ID NO: 599530 - DNA, 25 bp, Homo sapien
tgccggccagttaattcattctcag

SEQ ID NO: 599531 - DNA, 25 bp, Homo sapien
gccggccagttaattcattctcagc

SEQ ID NO: 599532 - DNA, 25 bp, Homo sapien
ccggccagttaattcattctcagca

SEQ ID NO: 599533 - DNA, 25 bp, Homo sapien
gtccatgttataaacttgaaagttg

SEQ ID NO: 599534 - DNA, 25 bp, Homo sapien
aagcaagaatggatcccgctgccac

SEQ ID NO: 599535 - DNA, 25 bp, Homo sapien
tgcaaaatgcactggctggcaccac

SEQ ID NO: 599536 - DNA, 25 bp, Homo sapien
gctggcaccacctatcagagtgtag

SEQ ID NO: 599537 - DNA, 25 bp, Homo sapien
ggtagtgaggagcaccttgatccct

SEQ ID NO: 599538 - DNA, 25 bp, Homo sapien
caccttgatccctcagtgcagttga

SEQ ID NO: 599539 - DNA, 25 bp, Homo sapien
tgcagttgattcctaacctccggga

SEQ ID NO: 599540 - DNA, 25 bp, Homo sapien
gttggtgcctgatacaagtacccca

SEQ ID NO: 599541 - DNA, 25 bp, Homo sapien
caagtaccccagttagagcacacag

SEQ ID NO: 599542 - DNA, 25 bp, Homo sapien
agcacacagtctgggagttgggaac

SEQ ID NO: 599543 - DNA, 25 bp, Homo sapien
gtcagctgaatccaacttatactac

SEQ ID NO: 599544 - DNA, 25 bp, Homo sapien
tatactacaatcaaatcctcaaggt

SEQ ID NO: 599545 - DNA, 25 bp, Homo sapien
gggtggctctggtcttgagcctact

SEQ ID NO: 599546 - DNA, 25 bp, Homo sapien
tggtcttgagcctactgtttatctt

SEQ ID NO: 599547 - DNA, 25 bp, Homo sapien
gagcctactgtttatcttgcttctg

SEQ ID NO: 599548 - DNA, 25 bp, Homo sapien
tttatcttgcttctgcgcctggtgg

SEQ ID NO: 599549 - DNA, 25 bp, Homo sapien
gggcgtgctggcatatggcatctac

SEQ ID NO: 599550 - DNA, 25 bp, Homo sapien
ggcatatggcatctactactgctgg

SEQ ID NO: 599551 - DNA, 25 bp, Homo sapien
atggcatctactactgctgggagga

SEQ ID NO: 599552 - DNA, 25 bp, Homo sapien
actactgctgggaggagtaccgagt

SEQ ID NO: 599553 - DNA, 25 bp, Homo sapien
tgctgcgggacaagggcgcctccat

SEQ ID NO: 599554 - DNA, 25 bp, Homo sapien
agtgcctaccagagcgtgcaggaga

SEQ ID NO: 599555 - DNA, 25 bp, Homo sapien
cctaccagagcgtgcaggagacctg

SEQ ID NO: 599556 - DNA, 25 bp, Homo sapien
agcaggccgcacagcagcttgctgt

SEQ ID NO: 599557 - DNA, 25 bp, Homo sapien
cagcagcttgctgtaggagcggttc

SEQ ID NO: 599558 - DNA, 25 bp, Homo sapien
cagcttgctgtaggagcggttctgc

SEQ ID NO: 599559 - DNA, 25 bp, Homo sapien
aggagcggttctgcgcgccgccgat

SEQ ID NO: 599560 - DNA, 25 bp, Homo sapien
gccgatcttgccgatgctgtgcagg

SEQ ID NO: 599561 - DNA, 25 bp, Homo sapien
ttgccgatgctgtgcaggctgcaga

SEQ ID NO: 599562 - DNA, 25 bp, Homo sapien
tgcagagcgcgcacggctcgctgga

SEQ ID NO: 599563 - DNA, 25 bp, Homo sapien
ctggagccgccgaaggccatgagct

SEQ ID NO: 599564 - DNA, 25 bp, Homo sapien
aaggccatgagctggtccgggacca

SEQ ID NO: 599565 - DNA, 25 bp, Homo sapien
tggtccgggaccacgtgcaccgcga

SEQ ID NO: 599566 - DNA, 25 bp, Homo sapien
ggaccacgtgcaccgcgatgtactg

SEQ ID NO: 599567 - DNA, 25 bp, Homo sapien
ggacatcagcagataggcaacctca

SEQ ID NO: 599568 - DNA, 25 bp, Homo sapien
ggcaacctcaacaagtatatcacaa

SEQ ID NO: 599569 - DNA, 25 bp, Homo sapien
tatatcacaatgagtgacacacccc

SEQ ID NO: 599570 - DNA, 25 bp, Homo sapien
acagccaattttgatggtcctccca

SEQ ID NO: 599571 - DNA, 25 bp, Homo sapien
aattttgatggtcctcccatagctc

SEQ ID NO: 599572 - DNA, 25 bp, Homo sapien
catagctcttgccttattctttgta

SEQ ID NO: 599573 - DNA, 25 bp, Homo sapien
gctcttgccttattctttgtaatag

SEQ ID NO: 599574 - DNA, 25 bp, Homo sapien
tttaaaatccccatattctaccgca

SEQ ID NO: 599575 - DNA, 25 bp, Homo sapien
aaatccccatattctaccgcaaagt

SEQ ID NO: 599576 - DNA, 25 bp, Homo sapien
tctaccgcaaagtcatgttatcagg

SEQ ID NO: 599577 - DNA, 25 bp, Homo sapien
ccccagttccatggagtaaagatta

SEQ ID NO: 599578 - DNA, 25 bp, Homo sapien
aaaatgtaataatgggagcctcata

SEQ ID NO: 599579 - DNA, 25 bp, Homo sapien
aaatgtaataatgggagcctcatat

SEQ ID NO: 599580 - DNA, 25 bp, Homo sapien
atgtaataatgggagcctcatatgt

SEQ ID NO: 599581 - DNA, 25 bp, Homo sapien
gtaataatgggagcctcatatgtaa

SEQ ID NO: 599582 - DNA, 25 bp, Homo sapien
aataatgggagcctcatatgtaatt

SEQ ID NO: 599583 - DNA, 25 bp, Homo sapien
taatgggagcctcatatgtaattgt

SEQ ID NO: 599584 - DNA, 25 bp, Homo sapien
gtaattgtacattttctagcagtaa

SEQ ID NO: 599585 - DNA, 25 bp, Homo sapien
aattgtacattttctagcagtaaga

SEQ ID NO: 599586 - DNA, 25 bp, Homo sapien
ttgtacattttctagcagtaagagg

SEQ ID NO: 599587 - DNA, 25 bp, Homo sapien
gtacattttctagcagtaagaggaa

SEQ ID NO: 599588 - DNA, 25 bp, Homo sapien
cattttctagcagtaagaggaaatt

SEQ ID NO: 599589 - DNA, 25 bp, Homo sapien
tctttctggttcactcttgggaggg

SEQ ID NO: 599590 - DNA, 25 bp, Homo sapien
tctggttcactcttgggagggtgta

SEQ ID NO: 599591 - DNA, 25 bp, Homo sapien
gattttatagttcctgtcgcttgcc

SEQ ID NO: 599592 - DNA, 25 bp, Homo sapien
ttatagttcctgtcgcttgcccttt

SEQ ID NO: 599593 - DNA, 25 bp, Homo sapien
tgtcgcttgccctttcagtggacta

SEQ ID NO: 599594 - DNA, 25 bp, Homo sapien
gcttgccctttcagtggactatttt

SEQ ID NO: 599595 - DNA, 25 bp, Homo sapien
gccctttcagtggactatttttgtt

SEQ ID NO: 599596 - DNA, 25 bp, Homo sapien
ggaatgcttcacaaatatgcccctt

SEQ ID NO: 599597 - DNA, 25 bp, Homo sapien
aatatgccccttccttgcacagagg

SEQ ID NO: 599598 - DNA, 25 bp, Homo sapien
acagaggccatgctaatttgtgaag

SEQ ID NO: 599599 - DNA, 25 bp, Homo sapien
aatttgtgaagcattccatttaaaa

SEQ ID NO: 599600 - DNA, 25 bp, Homo sapien
ctacagggtaggaaaagacggcagt

SEQ ID NO: 599601 - DNA, 25 bp, Homo sapien
gggtccttcaggatgcttgctggga

SEQ ID NO: 599602 - DNA, 25 bp, Homo sapien
ccctcccagctgatttattcttagg

SEQ ID NO: 599603 - DNA, 25 bp, Homo sapien
ccagctgatttattcttaggatctg

SEQ ID NO: 599604 - DNA, 25 bp, Homo sapien
ttaggatctgtaatgctcgcctgca

SEQ ID NO: 599605 - DNA, 25 bp, Homo sapien
atctgtaatgctcgcctgcatgtgc

SEQ ID NO: 599606 - DNA, 25 bp, Homo sapien
aatgctcgcctgcatgtgccccgaa

SEQ ID NO: 599607 - DNA, 25 bp, Homo sapien
gcatgtgccccgaacttcagaaggc

SEQ ID NO: 599608 - DNA, 25 bp, Homo sapien
gtgccccgaacttcagaaggcccaa

SEQ ID NO: 599609 - DNA, 25 bp, Homo sapien
cgaacttcagaaggcccaagaatca

SEQ ID NO: 599610 - DNA, 25 bp, Homo sapien
agaaggcccaagaatcaaccctgac

SEQ ID NO: 599611 - DNA, 25 bp, Homo sapien
tgtgtcacgggcacgcatcttcaac

SEQ ID NO: 599612 - DNA, 25 bp, Homo sapien
gtgtcacgggcacgcatcttcaacc

SEQ ID NO: 599613 - DNA, 25 bp, Homo sapien
tcacgggcacgcatcttcaaccttg

SEQ ID NO: 599614 - DNA, 25 bp, Homo sapien
acgggcacgcatcttcaaccttggc

SEQ ID NO: 599615 - DNA, 25 bp, Homo sapien
gggcacgcatcttcaaccttggcaa

SEQ ID NO: 599616 - DNA, 25 bp, Homo sapien
ttggagaggcttgtcagaaacaaaa

SEQ ID NO: 599617 - DNA, 25 bp, Homo sapien
gagaggcttgtcagaaacaaaataa

SEQ ID NO: 599618 - DNA, 25 bp, Homo sapien
accatttgtctctcagctacctgcg

SEQ ID NO: 599619 - DNA, 25 bp, Homo sapien
catttgtctctcagctacctgcgac

SEQ ID NO: 599620 - DNA, 25 bp, Homo sapien
tgtctctcagctacctgcgacctgg

SEQ ID NO: 599621 - DNA, 25 bp, Homo sapien
cagctacctgcgacctggaagcccc

SEQ ID NO: 599622 - DNA, 25 bp, Homo sapien
taagaagcaataatagggcaccggg

SEQ ID NO: 599623 - DNA, 25 bp, Homo sapien
aagaagcaataatagggcaccgggt

SEQ ID NO: 599624 - DNA, 25 bp, Homo sapien
agaagcaataatagggcaccgggta

SEQ ID NO: 599625 - DNA, 25 bp, Homo sapien
gaagcaataatagggcaccgggtac

SEQ ID NO: 599626 - DNA, 25 bp, Homo sapien
aagcaataatagggcaccgggtaca

SEQ ID NO: 599627 - DNA, 25 bp, Homo sapien
agcaataatagggcaccgggtacag

SEQ ID NO: 599628 - DNA, 25 bp, Homo sapien
gcaataatagggcaccgggtacagt

SEQ ID NO: 599629 - DNA, 25 bp, Homo sapien
caataatagggcaccgggtacagtg

SEQ ID NO: 599630 - DNA, 25 bp, Homo sapien
aataatagggcaccgggtacagtgg

SEQ ID NO: 599631 - DNA, 25 bp, Homo sapien
taatagggcaccgggtacagtggct

SEQ ID NO: 599632 - DNA, 25 bp, Homo sapien
cgaggccaaggtagcggatcatttg

SEQ ID NO: 599633 - DNA, 25 bp, Homo sapien
ccaggtcaggggatcattaagtcaa

SEQ ID NO: 599634 - DNA, 25 bp, Homo sapien
caggtcaggggatcattaagtcaag

SEQ ID NO: 599635 - DNA, 25 bp, Homo sapien
aggtcaggggatcattaagtcaaga

SEQ ID NO: 599636 - DNA, 25 bp, Homo sapien
ggtcaggggatcattaagtcaagag

SEQ ID NO: 599637 - DNA, 25 bp, Homo sapien
gtcaggggatcattaagtcaagaga

SEQ ID NO: 599638 - DNA, 25 bp, Homo sapien
gggatcattaagtcaagagatcaag

SEQ ID NO: 599639 - DNA, 25 bp, Homo sapien
gccccgtctctgctggaaatagaaa

SEQ ID NO: 599640 - DNA, 25 bp, Homo sapien
gtctctgctggaaatagaaaaatga

SEQ ID NO: 599641 - DNA, 25 bp, Homo sapien
ctctgctggaaatagaaaaatgagc

SEQ ID NO: 599642 - DNA, 25 bp, Homo sapien
tctgctggaaatagaaaaatgagct

SEQ ID NO: 599643 - DNA, 25 bp, Homo sapien
ctggaaatagaaaaatgagctgggt

SEQ ID NO: 599644 - DNA, 25 bp, Homo sapien
tattttatttcaaacggcaactact

SEQ ID NO: 599645 - DNA, 25 bp, Homo sapien
acggcaactactttgagtaaacgat

SEQ ID NO: 599646 - DNA, 25 bp, Homo sapien
aacgttactaacagtgtattctttg

SEQ ID NO: 599647 - DNA, 25 bp, Homo sapien
attctttgtaagtgacatgactaat

SEQ ID NO: 599648 - DNA, 25 bp, Homo sapien
catgactaatgtactttgtgctggt

SEQ ID NO: 599649 - DNA, 25 bp, Homo sapien
actttgtgctggttgttgagactca

SEQ ID NO: 599650 - DNA, 25 bp, Homo sapien
ggttgttgagactcagcagggaaat

SEQ ID NO: 599651 - DNA, 25 bp, Homo sapien
gggaaataaagatccttctgtgcat

SEQ ID NO: 599652 - DNA, 25 bp, Homo sapien
aataaagatccttctgtgcattatt

SEQ ID NO: 599653 - DNA, 25 bp, Homo sapien
taaaactgaaccattgaaaacacat

SEQ ID NO: 599654 - DNA, 25 bp, Homo sapien
taactcaaaaccttgtgttatttct

SEQ ID NO: 599655 - DNA, 25 bp, Homo sapien
gacaatttattttactgttactctt

SEQ ID NO: 599656 - DNA, 25 bp, Homo sapien
tccccagccttcttaagcatgatta

SEQ ID NO: 599657 - DNA, 25 bp, Homo sapien
cctgtttttctttcaatgcagctac

SEQ ID NO: 599658 - DNA, 25 bp, Homo sapien
ttctttcaatgcagctacaaggcca

SEQ ID NO: 599659 - DNA, 25 bp, Homo sapien
gccacaagttgtgctatgctctaga

SEQ ID NO: 599660 - DNA, 25 bp, Homo sapien
gtgctatgctctagattatgtgacc

SEQ ID NO: 599661 - DNA, 25 bp, Homo sapien
gtgacctgtcatatgattagctgct

SEQ ID NO: 599662 - DNA, 25 bp, Homo sapien
ctgtcatatgattagctgcttttgt

SEQ ID NO: 599663 - DNA, 25 bp, Homo sapien
aaccccgctctgtctttgtttaatg

SEQ ID NO: 599664 - DNA, 25 bp, Homo sapien
gctctgtctttgtttaatgctcagc

SEQ ID NO: 599665 - DNA, 25 bp, Homo sapien
ggatgcgaatccactgagccaatgt

SEQ ID NO: 599666 - DNA, 25 bp, Homo sapien
gctcatccccagagataaaaaatga

SEQ ID NO: 599667 - DNA, 25 bp, Homo sapien
tgagcaaagtggcaagacccccctg

SEQ ID NO: 599668 - DNA, 25 bp, Homo sapien
gagcaaagtggcaagacccccctgc

SEQ ID NO: 599669 - DNA, 25 bp, Homo sapien
cgtggtggtcatatcacttgtagtc

SEQ ID NO: 599670 - DNA, 25 bp, Homo sapien
tggtggtcatatcacttgtagtccc

SEQ ID NO: 599671 - DNA, 25 bp, Homo sapien
ggtggtcatatcacttgtagtccca

SEQ ID NO: 599672 - DNA, 25 bp, Homo sapien
gtggtcatatcacttgtagtcccat

SEQ ID NO: 599673 - DNA, 25 bp, Homo sapien
tggtcatatcacttgtagtcccatc

SEQ ID NO: 599674 - DNA, 25 bp, Homo sapien
ggtcatatcacttgtagtcccatct

SEQ ID NO: 599675 - DNA, 25 bp, Homo sapien
gtcatatcacttgtagtcccatcta

SEQ ID NO: 599676 - DNA, 25 bp, Homo sapien
tcatatcacttgtagtcccatctac

SEQ ID NO: 599677 - DNA, 25 bp, Homo sapien
gaaggcctgagctgtagagcaacat

SEQ ID NO: 599678 - DNA, 25 bp, Homo sapien
acgccctacgtgagtcagcagaatc

SEQ ID NO: 599679 - DNA, 25 bp, Homo sapien
gcagaatccactgactgatggagat

SEQ ID NO: 599680 - DNA, 25 bp, Homo sapien
gacttagccattttgtctcaatgag

SEQ ID NO: 599681 - DNA, 25 bp, Homo sapien
atgaggtgtacctacaatgggtcat

SEQ ID NO: 599682 - DNA, 25 bp, Homo sapien
aatgggtcatatgagctccacagct

SEQ ID NO: 599683 - DNA, 25 bp, Homo sapien
cagctcagactgttgttgacttaca

SEQ ID NO: 599684 - DNA, 25 bp, Homo sapien
gacttacattgtacctcaacttctc

SEQ ID NO: 599685 - DNA, 25 bp, Homo sapien
tctctgccaaatctagctcccttta

SEQ ID NO: 599686 - DNA, 25 bp, Homo sapien
ccctttacctcacaatcataggcgt

SEQ ID NO: 599687 - DNA, 25 bp, Homo sapien
ataggcgttcatcccaaagacatcc

SEQ ID NO: 599688 - DNA, 25 bp, Homo sapien
aacagataactcatcctaaacagag

SEQ ID NO: 599689 - DNA, 25 bp, Homo sapien
acagataactcatcctaaacagaga

SEQ ID NO: 599690 - DNA, 25 bp, Homo sapien
cagataactcatcctaaacagagaa

SEQ ID NO: 599691 - DNA, 25 bp, Homo sapien
agataactcatcctaaacagagaaa

SEQ ID NO: 599692 - DNA, 25 bp, Homo sapien
gataactcatcctaaacagagaaat

SEQ ID NO: 599693 - DNA, 25 bp, Homo sapien
ataactcatcctaaacagagaaatg

SEQ ID NO: 599694 - DNA, 25 bp, Homo sapien
taactcatcctaaacagagaaatga

SEQ ID NO: 599695 - DNA, 25 bp, Homo sapien
aactcatcctaaacagagaaatgag

SEQ ID NO: 599696 - DNA, 25 bp, Homo sapien
actcatcctaaacagagaaatgaga

SEQ ID NO: 599697 - DNA, 25 bp, Homo sapien
tgccctctccaggaccaagccgggt

SEQ ID NO: 599698 - DNA, 25 bp, Homo sapien
gccctctccaggaccaagccgggtt

SEQ ID NO: 599699 - DNA, 25 bp, Homo sapien
aggcgtggccactgcgcccaggcac

SEQ ID NO: 599700 - DNA, 25 bp, Homo sapien
gcccaggcacattcctcccttctgc

SEQ ID NO: 599701 - DNA, 25 bp, Homo sapien
ccaggtccctgatctccaggcttgg

SEQ ID NO: 599702 - DNA, 25 bp, Homo sapien
caggtccctgatctccaggcttggc

SEQ ID NO: 599703 - DNA, 25 bp, Homo sapien
aggtccctgatctccaggcttggcc

SEQ ID NO: 599704 - DNA, 25 bp, Homo sapien
ggtccctgatctccaggcttggcct

SEQ ID NO: 599705 - DNA, 25 bp, Homo sapien
ctgatctccaggcttggcctccaga

SEQ ID NO: 599706 - DNA, 25 bp, Homo sapien
tgatctccaggcttggcctccagag

SEQ ID NO: 599707 - DNA, 25 bp, Homo sapien
gatctccaggcttggcctccagagc

SEQ ID NO: 599708 - DNA, 25 bp, Homo sapien
atctccaggcttggcctccagagca

SEQ ID NO: 599709 - DNA, 25 bp, Homo sapien
ggcttggcctccagagcagcccaca

SEQ ID NO: 599710 - DNA, 25 bp, Homo sapien
gggtcttcctctatgtggcccttgt

SEQ ID NO: 599711 - DNA, 25 bp, Homo sapien
ctatgtggcccttgtggacatgcta

SEQ ID NO: 599712 - DNA, 25 bp, Homo sapien
tatgtggcccttgtggacatgctac

SEQ ID NO: 599713 - DNA, 25 bp, Homo sapien
atgtggcccttgtggacatgctacc

SEQ ID NO: 599714 - DNA, 25 bp, Homo sapien
tgtggcccttgtggacatgctacca

SEQ ID NO: 599715 - DNA, 25 bp, Homo sapien
gtggcccttgtggacatgctaccag

SEQ ID NO: 599716 - DNA, 25 bp, Homo sapien
ggcccttgtggacatgctaccagcc

SEQ ID NO: 599717 - DNA, 25 bp, Homo sapien
cttgtggacatgctaccagccctgc

SEQ ID NO: 599718 - DNA, 25 bp, Homo sapien
ttgtggacatgctaccagccctgct

SEQ ID NO: 599719 - DNA, 25 bp, Homo sapien
tgcttgccataaccctgctggagga

SEQ ID NO: 599720 - DNA, 25 bp, Homo sapien
ggctactgcccgtgaccactgaggg

SEQ ID NO: 599721 - DNA, 25 bp, Homo sapien
ggcctactgtgaagctcacgtgcgg

SEQ ID NO: 599722 - DNA, 25 bp, Homo sapien
tgaagctcacgtgcgggaagatcct

SEQ ID NO: 599723 - DNA, 25 bp, Homo sapien
gaagatcctctcatcattccagtgc

SEQ ID NO: 599724 - DNA, 25 bp, Homo sapien
agtgcctgcatcagaaaaccccttt

SEQ ID NO: 599725 - DNA, 25 bp, Homo sapien
gagggcatgtctaataacagcacca

SEQ ID NO: 599726 - DNA, 25 bp, Homo sapien
tcagaaaacccctttcgcgagaaga

SEQ ID NO: 599727 - DNA, 25 bp, Homo sapien
gaagttcttttgtaccattctctaa

SEQ ID NO: 599728 - DNA, 25 bp, Homo sapien
tgtctaataacagcaccactagcat

SEQ ID NO: 599729 - DNA, 25 bp, Homo sapien
actagcatctcccaagccaggaaag

SEQ ID NO: 599730 - DNA, 25 bp, Homo sapien
ctaaagatggaagcctgtatggaca

SEQ ID NO: 599731 - DNA, 25 bp, Homo sapien
ggacagggtcaaggtctcccaggca

SEQ ID NO: 599732 - DNA, 25 bp, Homo sapien
aaagtgctgggatcaaatccactgt

SEQ ID NO: 599733 - DNA, 25 bp, Homo sapien
gtgctgggatcaaatccactgttaa

SEQ ID NO: 599734 - DNA, 25 bp, Homo sapien
aatccactgttaatcattaggctga

SEQ ID NO: 599735 - DNA, 25 bp, Homo sapien
aatcattaggctgaactgtctctta

SEQ ID NO: 599736 - DNA, 25 bp, Homo sapien
taggctgaactgtctcttatagaat

SEQ ID NO: 599737 - DNA, 25 bp, Homo sapien
gaactgtctcttatagaatgaggtc

SEQ ID NO: 599738 - DNA, 25 bp, Homo sapien
gaatgaggtcaaagacactcccagt

SEQ ID NO: 599739 - DNA, 25 bp, Homo sapien
gaggtcaaagacactcccagttgca

SEQ ID NO: 599740 - DNA, 25 bp, Homo sapien
gtcaaagacactcccagttgcaggg

SEQ ID NO: 599741 - DNA, 25 bp, Homo sapien
gacactcccagttgcagggagggta

SEQ ID NO: 599742 - DNA, 25 bp, Homo sapien
cagggagggtagatggccccaccca

SEQ ID NO: 599743 - DNA, 25 bp, Homo sapien
ggccagagaattgcagaaacccacc

SEQ ID NO: 599744 - DNA, 25 bp, Homo sapien
gaaacccacctgtaatatgcccaca

SEQ ID NO: 599745 - DNA, 25 bp, Homo sapien
taatatgcccacaggcgtcactcaa

SEQ ID NO: 599746 - DNA, 25 bp, Homo sapien
aggcgtcactcaaggagtctgcata

SEQ ID NO: 599747 - DNA, 25 bp, Homo sapien
gcatagccaggaacatcaagttttg

SEQ ID NO: 599748 - DNA, 25 bp, Homo sapien
tttggtgttactttcttgtctacag

SEQ ID NO: 599749 - DNA, 25 bp, Homo sapien
gttactttcttgtctacaggccaaa

SEQ ID NO: 599750 - DNA, 25 bp, Homo sapien
tgcgcacagttgattttcggtgtgt

SEQ ID NO: 599751 - DNA, 25 bp, Homo sapien
gtgtgttcctgtataacggcttgaa

SEQ ID NO: 599752 - DNA, 25 bp, Homo sapien
tgcgcagctcgtgtgccaaggaaat

SEQ ID NO: 599753 - DNA, 25 bp, Homo sapien
gctcgtgtgccaaggaaatgtgttt

SEQ ID NO: 599754 - DNA, 25 bp, Homo sapien
tacaggatccactgccttgacaatg

SEQ ID NO: 599755 - DNA, 25 bp, Homo sapien
gacaatggctggctgtacatctcac

SEQ ID NO: 599756 - DNA, 25 bp, Homo sapien
ggccctggtggaccattactctgag

SEQ ID NO: 599757 - DNA, 25 bp, Homo sapien
tggcccgctccctggcaaggatata

SEQ ID NO: 599758 - DNA, 25 bp, Homo sapien
ctggcaaggatatacccctacctgt

SEQ ID NO: 599759 - DNA, 25 bp, Homo sapien
gaggacaccactcaactggaaagag

SEQ ID NO: 599760 - DNA, 25 bp, Homo sapien
gacagctccctcctgttttctgaag

SEQ ID NO: 599761 - DNA, 25 bp, Homo sapien
aggagtctcttctcagtgagggtct

SEQ ID NO: 599762 - DNA, 25 bp, Homo sapien
tcagtgagggtctccgggagtccct

SEQ ID NO: 599763 - DNA, 25 bp, Homo sapien
gggagtccctcagcttctacatcag

SEQ ID NO: 599764 - DNA, 25 bp, Homo sapien
ggctgtctctttggatgatgcctag

SEQ ID NO: 599765 - DNA, 25 bp, Homo sapien
aagaatttacggatctactggcgca

SEQ ID NO: 599766 - DNA, 25 bp, Homo sapien
atttacggatctactggcgcaggac

SEQ ID NO: 599767 - DNA, 25 bp, Homo sapien
tactggcgcaggaccggacaccgat

SEQ ID NO: 599768 - DNA, 25 bp, Homo sapien
gaccggacaccgatagggaacagcc

SEQ ID NO: 599769 - DNA, 25 bp, Homo sapien
acaccgatagggaacagccgaccca

SEQ ID NO: 599770 - DNA, 25 bp, Homo sapien
tcaccgaggcgctcaaaggcatgga

SEQ ID NO: 599771 - DNA, 25 bp, Homo sapien
gaggcgctcaaaggcatggacaaga

SEQ ID NO: 599772 - DNA, 25 bp, Homo sapien
caaaggcatggacaagatgttcttg

SEQ ID NO: 599773 - DNA, 25 bp, Homo sapien
gatgttcttgaacaacaccaccact

SEQ ID NO: 599774 - DNA, 25 bp, Homo sapien
tgaacaacaccaccactaacaggca

SEQ ID NO: 599775 - DNA, 25 bp, Homo sapien
ggcccaggtagtaaaactggcgaca

SEQ ID NO: 599776 - DNA, 25 bp, Homo sapien
taatcccagcacccaaggatctctt

SEQ ID NO: 599777 - DNA, 25 bp, Homo sapien
aatcccagcacccaaggatctcttg

SEQ ID NO: 599778 - DNA, 25 bp, Homo sapien
atcccagcacccaaggatctcttga

SEQ ID NO: 599779 - DNA, 25 bp, Homo sapien
tcccagcacccaaggatctcttgag

SEQ ID NO: 599780 - DNA, 25 bp, Homo sapien
cccagcacccaaggatctcttgagg

SEQ ID NO: 599781 - DNA, 25 bp, Homo sapien
ccagcacccaaggatctcttgaggc

SEQ ID NO: 599782 - DNA, 25 bp, Homo sapien
tcaagaccagcttaaacagcatagt

SEQ ID NO: 599783 - DNA, 25 bp, Homo sapien
caagaccagcttaaacagcatagtg

SEQ ID NO: 599784 - DNA, 25 bp, Homo sapien
tggctcataactgtagtcttagcca

SEQ ID NO: 599785 - DNA, 25 bp, Homo sapien
ttgtgtatgtgatgactgactctag

SEQ ID NO: 599786 - DNA, 25 bp, Homo sapien
gactgactctagtcattatggaaaa

SEQ ID NO: 599787 - DNA, 25 bp, Homo sapien
cttttggcagtttagttcctacttg

SEQ ID NO: 599788 - DNA, 25 bp, Homo sapien
tggcagtttagttcctacttgttaa

SEQ ID NO: 599789 - DNA, 25 bp, Homo sapien
tcctacttgttaacaattcctcttt

SEQ ID NO: 599790 - DNA, 25 bp, Homo sapien
gaggtactacatttgatttctcaat

SEQ ID NO: 599791 - DNA, 25 bp, Homo sapien
tgatttctcaatttctcagtttgtt

SEQ ID NO: 599792 - DNA, 25 bp, Homo sapien
ctcaatttctcagtttgttttcaat

SEQ ID NO: 599793 - DNA, 25 bp, Homo sapien
ttttcaatacaaacagcaaccactg

SEQ ID NO: 599794 - DNA, 25 bp, Homo sapien
aacagcaaccactgaaatgcagaaa

SEQ ID NO: 599795 - DNA, 25 bp, Homo sapien
ggtaatcaagtgtgatgtttctata

SEQ ID NO: 599796 - DNA, 25 bp, Homo sapien
tcgaggccacggtgagccaggaact

SEQ ID NO: 599797 - DNA, 25 bp, Homo sapien
tgagcgacaaagagataacccatat

SEQ ID NO: 599798 - DNA, 25 bp, Homo sapien
aacaaaccagatacacgtgaaacgt

SEQ ID NO: 599799 - DNA, 25 bp, Homo sapien
cacgtgaaacgtcagccaacagggt

SEQ ID NO: 599800 - DNA, 25 bp, Homo sapien
ccaacagggtggtagattaatctca

SEQ ID NO: 599801 - DNA, 25 bp, Homo sapien
attaatctcactggtttgggcctgg

SEQ ID NO: 599802 - DNA, 25 bp, Homo sapien
ctgtgccatgtactcacgttttgat

SEQ ID NO: 599803 - DNA, 25 bp, Homo sapien
cgttttgatttttggcaagtcacat

SEQ ID NO: 599804 - DNA, 25 bp, Homo sapien
ggcaagtcacataatctccttggcc

SEQ ID NO: 599805 - DNA, 25 bp, Homo sapien
tccttggccctcgtttttgttagtg

SEQ ID NO: 599806 - DNA, 25 bp, Homo sapien
agataagatctgtcccggctacttg

SEQ ID NO: 599807 - DNA, 25 bp, Homo sapien
gggatgcctgctaagagggcatgga

SEQ ID NO: 599808 - DNA, 25 bp, Homo sapien
agagggcatggagtacagatcctcc

SEQ ID NO: 599809 - DNA, 25 bp, Homo sapien
gagggcatggagtacagatcctcca

SEQ ID NO: 599810 - DNA, 25 bp, Homo sapien
gggcatggagtacagatcctccact

SEQ ID NO: 599811 - DNA, 25 bp, Homo sapien
ggcatggagtacagatcctccactg

SEQ ID NO: 599812 - DNA, 25 bp, Homo sapien
gcatggagtacagatcctccactga

SEQ ID NO: 599813 - DNA, 25 bp, Homo sapien
atggagtacagatcctccactgaca

SEQ ID NO: 599814 - DNA, 25 bp, Homo sapien
tggagtacagatcctccactgacac

SEQ ID NO: 599815 - DNA, 25 bp, Homo sapien
ggagtacagatcctccactgacacc

SEQ ID NO: 599816 - DNA, 25 bp, Homo sapien
gcaagcaggacttagtggccccact

SEQ ID NO: 599817 - DNA, 25 bp, Homo sapien
caagcaggacttagtggccccactt

SEQ ID NO: 599818 - DNA, 25 bp, Homo sapien
gggcactgtcgatactctcagaatc

SEQ ID NO: 599819 - DNA, 25 bp, Homo sapien
atactctcagaatcacagcagccac

SEQ ID NO: 599820 - DNA, 25 bp, Homo sapien
ttataaaccgctccgaacttgctga

SEQ ID NO: 599821 - DNA, 25 bp, Homo sapien
aaaccgctccgaacttgctgatatg

SEQ ID NO: 599822 - DNA, 25 bp, Homo sapien
gctccgaacttgctgatatgctctg

SEQ ID NO: 599823 - DNA, 25 bp, Homo sapien
cgaacttgctgatatgctctgtact

SEQ ID NO: 599824 - DNA, 25 bp, Homo sapien
gctgatatgctctgtactgtataca

SEQ ID NO: 599825 - DNA, 25 bp, Homo sapien
gtactgtatacatagctcacgtgac

SEQ ID NO: 599826 - DNA, 25 bp, Homo sapien
gtatacatagctcacgtgacacaaa

SEQ ID NO: 599827 - DNA, 25 bp, Homo sapien
atagctcacgtgacacaaaacacaa

SEQ ID NO: 599828 - DNA, 25 bp, Homo sapien
acaaaacacaaaccaactgctgaga

SEQ ID NO: 599829 - DNA, 25 bp, Homo sapien
ttcaatgctagaagggcaacggctc

SEQ ID NO: 599830 - DNA, 25 bp, Homo sapien
gggcaacggctcctagaagacgcta

SEQ ID NO: 599831 - DNA, 25 bp, Homo sapien
gggttaggctactatagccatccaa

SEQ ID NO: 599832 - DNA, 25 bp, Homo sapien
atagccatccaatcagaagccgatt

SEQ ID NO: 599833 - DNA, 25 bp, Homo sapien
gaagccgattatcatgactttatgg

SEQ ID NO: 599834 - DNA, 25 bp, Homo sapien
aacagctttagcttgctttagattg

SEQ ID NO: 599835 - DNA, 25 bp, Homo sapien
agctttcttgtgtttgtggagttgt

SEQ ID NO: 599836 - DNA, 25 bp, Homo sapien
cagaagcatggatattgttgtgaat

SEQ ID NO: 599837 - DNA, 25 bp, Homo sapien
gttgtgaatgccatgctagctgatt

SEQ ID NO: 599838 - DNA, 25 bp, Homo sapien
gctagctgattgatgtttgtttgtt

SEQ ID NO: 599839 - DNA, 25 bp, Homo sapien
gagcctttggtgtgggaaagcccaa

SEQ ID NO: 599840 - DNA, 25 bp, Homo sapien
cagcctggccggtatgatggaaccg

SEQ ID NO: 599841 - DNA, 25 bp, Homo sapien
agcctggccggtatgatggaaccgt

SEQ ID NO: 599842 - DNA, 25 bp, Homo sapien
cctggccggtatgatggaaccgtgt

SEQ ID NO: 599843 - DNA, 25 bp, Homo sapien
ctggccggtatgatggaaccgtgtc

SEQ ID NO: 599844 - DNA, 25 bp, Homo sapien
tggccggtatgatggaaccgtgtct

SEQ ID NO: 599845 - DNA, 25 bp, Homo sapien
ggccggtatgatggaaccgtgtctc

SEQ ID NO: 599846 - DNA, 25 bp, Homo sapien
gccggtatgatggaaccgtgtctct

SEQ ID NO: 599847 - DNA, 25 bp, Homo sapien
ccggtatgatggaaccgtgtctcta

SEQ ID NO: 599848 - DNA, 25 bp, Homo sapien
aaatgcagggaaattggccgggcgt

SEQ ID NO: 599849 - DNA, 25 bp, Homo sapien
aacaacagaagtttagtggaggctg

SEQ ID NO: 599850 - DNA, 25 bp, Homo sapien
acaacagaagtttagtggaggctgg

SEQ ID NO: 599851 - DNA, 25 bp, Homo sapien
attattattcggcataatggacttg

SEQ ID NO: 599852 - DNA, 25 bp, Homo sapien
taatggacttggtagtttttctatt

SEQ ID NO: 599853 - DNA, 25 bp, Homo sapien
atttcacacaacatacaagagtacc

SEQ ID NO: 599854 - DNA, 25 bp, Homo sapien
aacatacaagagtaccattgttcct

SEQ ID NO: 599855 - DNA, 25 bp, Homo sapien
gttccttatatcgttaaatctttgt

SEQ ID NO: 599856 - DNA, 25 bp, Homo sapien
aaatctttgtgacacactttgacaa

SEQ ID NO: 599857 - DNA, 25 bp, Homo sapien
tgtagaacctataacaaattctttt

SEQ ID NO: 599858 - DNA, 25 bp, Homo sapien
ttacaagttactataaaggacacaa

SEQ ID NO: 599859 - DNA, 25 bp, Homo sapien
taccttccagaacaaaatgactcct

SEQ ID NO: 599860 - DNA, 25 bp, Homo sapien
cagaacaaaatgactcctgatgaac

SEQ ID NO: 599861 - DNA, 25 bp, Homo sapien
ggggatttgcttgtatgtattaaac

SEQ ID NO: 599862 - DNA, 25 bp, Homo sapien
aagcgggactggatgcacacaggcc

SEQ ID NO: 599863 - DNA, 25 bp, Homo sapien
agcgctcctggttgcagccagaatg

SEQ ID NO: 599864 - DNA, 25 bp, Homo sapien
ctggttgcagccagaatgcatgact

SEQ ID NO: 599865 - DNA, 25 bp, Homo sapien
gaatgcatgacttcaggaggactgt

SEQ ID NO: 599866 - DNA, 25 bp, Homo sapien
tcatcagtgtggtcaaagtgtgtga

SEQ ID NO: 599867 - DNA, 25 bp, Homo sapien
aaagtgtgtgagtccacgctgcgga

SEQ ID NO: 599868 - DNA, 25 bp, Homo sapien
ccacgctgcggaagaggctcacgga

SEQ ID NO: 599869 - DNA, 25 bp, Homo sapien
ggctcacggaatttgaagacacccc

SEQ ID NO: 599870 - DNA, 25 bp, Homo sapien
cccaccagtcagttgaccattgatg

SEQ ID NO: 599871 - DNA, 25 bp, Homo sapien
gtcagttgaccattgatgagttcat

SEQ ID NO: 599872 - DNA, 25 bp, Homo sapien
gagttcatgaagatcgacctggagg

SEQ ID NO: 599873 - DNA, 25 bp, Homo sapien
gatgcaataaggtttctcagtcaga

SEQ ID NO: 599874 - DNA, 25 bp, Homo sapien
aaggtttctcagtcagacatagcaa

SEQ ID NO: 599875 - DNA, 25 bp, Homo sapien
atgtcttgcttgtagactaatagga

SEQ ID NO: 599876 - DNA, 25 bp, Homo sapien
ggatatcaataagccatatgagcaa

SEQ ID NO: 599877 - DNA, 25 bp, Homo sapien
taaagtatcatgaaggtaaaccctg

SEQ ID NO: 599878 - DNA, 25 bp, Homo sapien
attagatttgaagtacttgtgacaa

SEQ ID NO: 599879 - DNA, 25 bp, Homo sapien
gtacttgtgacaaatgcaattgaca

SEQ ID NO: 599880 - DNA, 25 bp, Homo sapien
gcaattgacaatgcctttatgcagc

SEQ ID NO: 599881 - DNA, 25 bp, Homo sapien
aatgcctttatgcagctggaaaatt

SEQ ID NO: 599882 - DNA, 25 bp, Homo sapien
gctggaaaattgttgcttagcagaa

SEQ ID NO: 599883 - DNA, 25 bp, Homo sapien
gcagaaaagcttgtgctggacaaat

SEQ ID NO: 599884 - DNA, 25 bp, Homo sapien
gcagctttcctctgtaagagaagcc

SEQ ID NO: 599885 - DNA, 25 bp, Homo sapien
agctttcctctgtaagagaagccag

SEQ ID NO: 599886 - DNA, 25 bp, Homo sapien
gggtggcctgggttgctcacacatg

SEQ ID NO: 599887 - DNA, 25 bp, Homo sapien
tgctcacacatggagcaagtggctg

SEQ ID NO: 599888 - DNA, 25 bp, Homo sapien
ctcccacgacttcctgttaagaggc

SEQ ID NO: 599889 - DNA, 25 bp, Homo sapien
acgacttcctgttaagaggccgaca

SEQ ID NO: 599890 - DNA, 25 bp, Homo sapien
acttcctgttaagaggccgacactc

SEQ ID NO: 599891 - DNA, 25 bp, Homo sapien
gaggccgacactcttggaaagaaaa

SEQ ID NO: 599892 - DNA, 25 bp, Homo sapien
gaaaatcaagctagcctttatatct

SEQ ID NO: 599893 - DNA, 25 bp, Homo sapien
agctagcctttatatctttgtgtga

SEQ ID NO: 599894 - DNA, 25 bp, Homo sapien
tatctttgtgtgatttaggatctaa

SEQ ID NO: 599895 - DNA, 25 bp, Homo sapien
gtgtctcttgatccatccgaagcag

SEQ ID NO: 599896 - DNA, 25 bp, Homo sapien
gaagcaggccctccacgttatctag

SEQ ID NO: 599897 - DNA, 25 bp, Homo sapien
aggccctccacgttatctaggagat

SEQ ID NO: 599898 - DNA, 25 bp, Homo sapien
cacgttatctaggagatcgctacaa

SEQ ID NO: 599899 - DNA, 25 bp, Homo sapien
gatcgctacaagttttatctggaga

SEQ ID NO: 599900 - DNA, 25 bp, Homo sapien
tttatctggagaatctcaccctggg

SEQ ID NO: 599901 - DNA, 25 bp, Homo sapien
gatgagggatggtaccttatgaccc

SEQ ID NO: 599902 - DNA, 25 bp, Homo sapien
gatggtaccttatgaccctggagaa

SEQ ID NO: 599903 - DNA, 25 bp, Homo sapien
ggctatctttactttgttctgggag

SEQ ID NO: 599904 - DNA, 25 bp, Homo sapien
gggagctgatcatgataacctgcag

SEQ ID NO: 599905 - DNA, 25 bp, Homo sapien
ataacctgcagacctgatcaagcct

SEQ ID NO: 599906 - DNA, 25 bp, Homo sapien
atttattagcccaagaagccaatgg

SEQ ID NO: 599907 - DNA, 25 bp, Homo sapien
aagccaatgggttcaaggtcactcc

SEQ ID NO: 599908 - DNA, 25 bp, Homo sapien
aaggtcactcccaacatttttatgc

SEQ ID NO: 599909 - DNA, 25 bp, Homo sapien
atgccatcaagtatatcagctccaa

SEQ ID NO: 599910 - DNA, 25 bp, Homo sapien
caaaagaggcttttcctttgccatt

SEQ ID NO: 599911 - DNA, 25 bp, Homo sapien
tgtcgtttattttagttctccactg

SEQ ID NO: 599912 - DNA, 25 bp, Homo sapien
ttctccactgcttcggtgtagagga

SEQ ID NO: 599913 - DNA, 25 bp, Homo sapien
gtgtagaggacctatgctgcctgta

SEQ ID NO: 599914 - DNA, 25 bp, Homo sapien
atgctgcctgtaggcttgacctttc

SEQ ID NO: 599915 - DNA, 25 bp, Homo sapien
ttgacctttcctatactttttctgc

SEQ ID NO: 599916 - DNA, 25 bp, Homo sapien
tactttttctgctgtctgaagttgc

SEQ ID NO: 599917 - DNA, 25 bp, Homo sapien
acccaggaggcggaaatcgcactct

SEQ ID NO: 599918 - DNA, 25 bp, Homo sapien
ggaggcggaaatcgcactctagccc

SEQ ID NO: 599919 - DNA, 25 bp, Homo sapien
ggcggaaatcgcactctagcccggg

SEQ ID NO: 599920 - DNA, 25 bp, Homo sapien
gacactgcagctggctatatcttca

SEQ ID NO: 599921 - DNA, 25 bp, Homo sapien
cactgcagctggctatatcttcaaa

SEQ ID NO: 599922 - DNA, 25 bp, Homo sapien
ctgcagctggctatatcttcaaatt

SEQ ID NO: 599923 - DNA, 25 bp, Homo sapien
gcagctggctatatcttcaaattta

SEQ ID NO: 599924 - DNA, 25 bp, Homo sapien
cagctggctatatcttcaaatttaa

SEQ ID NO: 599925 - DNA, 25 bp, Homo sapien
ttaaacatgatttgcagccaggcgc

SEQ ID NO: 599926 - DNA, 25 bp, Homo sapien
aaacatgatttgcagccaggcgcgg

SEQ ID NO: 599927 - DNA, 25 bp, Homo sapien
aacatgatttgcagccaggcgcggt

SEQ ID NO: 599928 - DNA, 25 bp, Homo sapien
gcagttccccaggtgagagcaattc

SEQ ID NO: 599929 - DNA, 25 bp, Homo sapien
agttccccaggtgagagcaattcca

SEQ ID NO: 599930 - DNA, 25 bp, Homo sapien
ttccccaggtgagagcaattccagg

SEQ ID NO: 599931 - DNA, 25 bp, Homo sapien
gggccggaggtctcacgctgggaag

SEQ ID NO: 599932 - DNA, 25 bp, Homo sapien
aggtctcacgctgggaaggagcccc

SEQ ID NO: 599933 - DNA, 25 bp, Homo sapien
cctagtgagtggtctagaggctgct

SEQ ID NO: 599934 - DNA, 25 bp, Homo sapien
gagtggtctagaggctgctggccca

SEQ ID NO: 599935 - DNA, 25 bp, Homo sapien
tgctggcccaagagccaggctcagg

SEQ ID NO: 599936 - DNA, 25 bp, Homo sapien
ggcccaagagccaggctcaggaaca

SEQ ID NO: 599937 - DNA, 25 bp, Homo sapien
aggaagccatgcagatacccagcat

SEQ ID NO: 599938 - DNA, 25 bp, Homo sapien
agatacccagcatggagaacccggc

SEQ ID NO: 599939 - DNA, 25 bp, Homo sapien
aagagagccaccatttctgcccaag

SEQ ID NO: 599940 - DNA, 25 bp, Homo sapien
gtgtgacagtgacaatgggctctct

SEQ ID NO: 599941 - DNA, 25 bp, Homo sapien
ctctctgtgtgccatgacatagcag

SEQ ID NO: 599942 - DNA, 25 bp, Homo sapien
acatagcaggaaaggccaggccaga

SEQ ID NO: 599943 - DNA, 25 bp, Homo sapien
ccaggccagacggactgtggatgtc

SEQ ID NO: 599944 - DNA, 25 bp, Homo sapien
atgtctgatggctttgagtgaactc

SEQ ID NO: 599945 - DNA, 25 bp, Homo sapien
gaactcaacaaccattgactaggtg

SEQ ID NO: 599946 - DNA, 25 bp, Homo sapien
agggcaccagctgaatcctgaggac

SEQ ID NO: 599947 - DNA, 25 bp, Homo sapien
gaatcctgaggaccatcatctgttg

SEQ ID NO: 599948 - DNA, 25 bp, Homo sapien
atcatctgttgagcacctactgcca

SEQ ID NO: 599949 - DNA, 25 bp, Homo sapien
cgtgtgctctgcatgcatcacctca

SEQ ID NO: 599950 - DNA, 25 bp, Homo sapien
ggtggacatgcctcattcatgctta

SEQ ID NO: 599951 - DNA, 25 bp, Homo sapien
atgcctcattcatgcttatggagtg

SEQ ID NO: 599952 - DNA, 25 bp, Homo sapien
atgcttatggagtgaccgaccagcc

SEQ ID NO: 599953 - DNA, 25 bp, Homo sapien
gagtgaccgaccagcctttagtgac

SEQ ID NO: 599954 - DNA, 25 bp, Homo sapien
agcctttagtgacaccccctgaaat

SEQ ID NO: 599955 - DNA, 25 bp, Homo sapien
cccctgaaatgtgagtcatccatgg

SEQ ID NO: 599956 - DNA, 25 bp, Homo sapien
agtcatccatgggtcactagtcatt

SEQ ID NO: 599957 - DNA, 25 bp, Homo sapien
tccatgggtcactagtcattggaga

SEQ ID NO: 599958 - DNA, 25 bp, Homo sapien
ggagaagagccccttatacaaaact

SEQ ID NO: 599959 - DNA, 25 bp, Homo sapien
agagccccttatacaaaacttggag

SEQ ID NO: 599960 - DNA, 25 bp, Homo sapien
tacaaaacttggagctcagaccaca

SEQ ID NO: 599961 - DNA, 25 bp, Homo sapien
cattttccagcctacctaaaataat

SEQ ID NO: 599962 - DNA, 25 bp, Homo sapien
tccagcctacctaaaataataacct

SEQ ID NO: 599963 - DNA, 25 bp, Homo sapien
cctggactttcataaaactggcata

SEQ ID NO: 599964 - DNA, 25 bp, Homo sapien
ggactttcataaaactggcatatct

SEQ ID NO: 599965 - DNA, 25 bp, Homo sapien
aactggcatatcttctgttttacat

SEQ ID NO: 599966 - DNA, 25 bp, Homo sapien
tattttatcttaagtttccatttag

SEQ ID NO: 599967 - DNA, 25 bp, Homo sapien
tatcttaagtttccatttagttgat

SEQ ID NO: 599968 - DNA, 25 bp, Homo sapien
ataagtgatgatttattgcaaagga

SEQ ID NO: 599969 - DNA, 25 bp, Homo sapien
gcaaaggaaatatgtttcgaaaggt

SEQ ID NO: 599970 - DNA, 25 bp, Homo sapien
cgaaaggtcgaataatgtctgtaac

SEQ ID NO: 599971 - DNA, 25 bp, Homo sapien
aaggtcgaataatgtctgtaacaat

SEQ ID NO: 599972 - DNA, 25 bp, Homo sapien
gcccgcaggccggagagcgacaggg

SEQ ID NO: 599973 - DNA, 25 bp, Homo sapien
tgcgccaaacggaaggcgcccattg

SEQ ID NO: 599974 - DNA, 25 bp, Homo sapien
ggaaggcgcccattgctcgacccgg

SEQ ID NO: 599975 - DNA, 25 bp, Homo sapien
cgcccattgctcgacccggcaaggg

SEQ ID NO: 599976 - DNA, 25 bp, Homo sapien
gggactccgagcaagacgcagcccg

SEQ ID NO: 599977 - DNA, 25 bp, Homo sapien
gagcaagacgcagcccgcctcaaag

SEQ ID NO: 599978 - DNA, 25 bp, Homo sapien
gcctcaaagccaggcgccttggagt

SEQ ID NO: 599979 - DNA, 25 bp, Homo sapien
aagccaggcgccttggagtcgggac

SEQ ID NO: 599980 - DNA, 25 bp, Homo sapien
caggcgccttggagtcgggacggta

SEQ ID NO: 599981 - DNA, 25 bp, Homo sapien
ttggagtcgggacggtacgccttag

SEQ ID NO: 599982 - DNA, 25 bp, Homo sapien
tcgggacggtacgccttaggaagct

SEQ ID NO: 599983 - DNA, 25 bp, Homo sapien
aacttcaggctttgccctgccaggt

SEQ ID NO: 599984 - DNA, 25 bp, Homo sapien
caggctttgccctgccaggttcata

SEQ ID NO: 599985 - DNA, 25 bp, Homo sapien
gccaggttcatagtcggggatccgt

SEQ ID NO: 599986 - DNA, 25 bp, Homo sapien
gggatccgtattccaagcccagctc

SEQ ID NO: 599987 - DNA, 25 bp, Homo sapien
ctcccgggttgatcgatccaactgt

SEQ ID NO: 599988 - DNA, 25 bp, Homo sapien
cccgggttgatcgatccaactgtgg

SEQ ID NO: 599989 - DNA, 25 bp, Homo sapien
tatgtgacaacttcagcaggcccgg

SEQ ID NO: 599990 - DNA, 25 bp, Homo sapien
agcaggcccggaacacgccttcatc

SEQ ID NO: 599991 - DNA, 25 bp, Homo sapien
aatatgaccccaacaactcatttct

SEQ ID NO: 599992 - DNA, 25 bp, Homo sapien
taatcattacttggcacctttaatg

SEQ ID NO: 599993 - DNA, 25 bp, Homo sapien
tacttggcacctttaatgatttttt

SEQ ID NO: 599994 - DNA, 25 bp, Homo sapien
tatagtagtttgtagtatttcattg

SEQ ID NO: 599995 - DNA, 25 bp, Homo sapien
tttggatgtgtaaagcttctatgta

SEQ ID NO: 599996 - DNA, 25 bp, Homo sapien
tggatgtgtaaagcttctatgtatt

SEQ ID NO: 599997 - DNA, 25 bp, Homo sapien
ggatgtgtaaagcttctatgtattg

SEQ ID NO: 599998 - DNA, 25 bp, Homo sapien
gatgtgtaaagcttctatgtattga

SEQ ID NO: 599999 - DNA, 25 bp, Homo sapien
gtgtaaagcttctatgtattgaaat

SEQ ID NO: 600000 - DNA, 25 bp, Homo sapien
ttcttttttgtcagtgtaaagcagt

SEQ ID NO: 600001 - DNA, 25 bp, Homo sapien
ttttttgtcagtgtaaagcagtcat

SEQ ID NO: 600002 - DNA, 25 bp, Homo sapien
ttttgtcagtgtaaagcagtcatta

SEQ ID NO: 600003 - DNA, 25 bp, Homo sapien
ttgtcagtgtaaagcagtcattaga

SEQ ID NO: 600004 - DNA, 25 bp, Homo sapien
gtcagtgtaaagcagtcattagaat

SEQ ID NO: 600005 - DNA, 25 bp, Homo sapien
aaatacctacacagcttttcgagaa

SEQ ID NO: 600006 - DNA, 25 bp, Homo sapien
gtctgtggatgacatactctgtaga

SEQ ID NO: 600007 - DNA, 25 bp, Homo sapien
tagaaaagtttgcatgtgactccat

SEQ ID NO: 600008 - DNA, 25 bp, Homo sapien
gcatgtgactccatttctcttcctc

SEQ ID NO: 600009 - DNA, 25 bp, Homo sapien
ttctcttcctcggtggttacaatta

SEQ ID NO: 600010 - DNA, 25 bp, Homo sapien
acaattatattttgcttcactgaac

SEQ ID NO: 600011 - DNA, 25 bp, Homo sapien
gcttcactgaacttacagcctaaag

SEQ ID NO: 600012 - DNA, 25 bp, Homo sapien
catcatgattgagggtgagaccgca

SEQ ID NO: 600013 - DNA, 25 bp, Homo sapien
ggtgagaccgcatacatcagctcaa

SEQ ID NO: 600014 - DNA, 25 bp, Homo sapien
tcagctcaaaatgcatcttctctct

SEQ ID NO: 600015 - DNA, 25 bp, Homo sapien
tgctaagcaaaatggcagacgtcct

SEQ ID NO: 600016 - DNA, 25 bp, Homo sapien
attagctaggcttggttgtgttcac

SEQ ID NO: 600017 - DNA, 25 bp, Homo sapien
ttagctaggcttggttgtgttcacc

SEQ ID NO: 600018 - DNA, 25 bp, Homo sapien
tagctaggcttggttgtgttcacct

SEQ ID NO: 600019 - DNA, 25 bp, Homo sapien
agctaggcttggttgtgttcacctg

SEQ ID NO: 600020 - DNA, 25 bp, Homo sapien
gctaggcttggttgtgttcacctgt

SEQ ID NO: 600021 - DNA, 25 bp, Homo sapien
ctaggcttggttgtgttcacctgta

SEQ ID NO: 600022 - DNA, 25 bp, Homo sapien
taggcttggttgtgttcacctgtaa

SEQ ID NO: 600023 - DNA, 25 bp, Homo sapien
cttggttgtgttcacctgtaatccc

SEQ ID NO: 600024 - DNA, 25 bp, Homo sapien
aggaggatcgtttgaactggtgagg

SEQ ID NO: 600025 - DNA, 25 bp, Homo sapien
ggaggatcgtttgaactggtgaggt

SEQ ID NO: 600026 - DNA, 25 bp, Homo sapien
aggatcgtttgaactggtgaggtgg

SEQ ID NO: 600027 - DNA, 25 bp, Homo sapien
catctccttttgagggtaatattca

SEQ ID NO: 600028 - DNA, 25 bp, Homo sapien
gagtaccaaaggaataatgcagaaa

SEQ ID NO: 600029 - DNA, 25 bp, Homo sapien
tacaggtttaattagaagatatcaa

SEQ ID NO: 600030 - DNA, 25 bp, Homo sapien
aagggcttaattgtaactagtcata

SEQ ID NO: 600031 - DNA, 25 bp, Homo sapien
gaaaattagtttggctgtctccatt

SEQ ID NO: 600032 - DNA, 25 bp, Homo sapien
tggctgtctccatttgtcatgagga

SEQ ID NO: 600033 - DNA, 25 bp, Homo sapien
gtctccatttgtcatgaggacggac

SEQ ID NO: 600034 - DNA, 25 bp, Homo sapien
atttgtcatgaggacggacctttat

SEQ ID NO: 600035 - DNA, 25 bp, Homo sapien
gaggacggacctttataggttcata

SEQ ID NO: 600036 - DNA, 25 bp, Homo sapien
ataggttcatatgattctctcttga

SEQ ID NO: 600037 - DNA, 25 bp, Homo sapien
tcatatgattctctcttgatctgta

SEQ ID NO: 600038 - DNA, 25 bp, Homo sapien
gcttctgcatgatcccgaacagaag

SEQ ID NO: 600039 - DNA, 25 bp, Homo sapien
catgatcccgaacagaagcttgcac

SEQ ID NO: 600040 - DNA, 25 bp, Homo sapien
taaccgctggtcttcgtctctatga

SEQ ID NO: 600041 - DNA, 25 bp, Homo sapien
gctggtcttcgtctctatgaattaa

SEQ ID NO: 600042 - DNA, 25 bp, Homo sapien
atgaattaaactattccaggtacct

SEQ ID NO: 600043 - DNA, 25 bp, Homo sapien
ttccaggtacctcccatcagtggaa

SEQ ID NO: 600044 - DNA, 25 bp, Homo sapien
catctggcttatctgacttagcata

SEQ ID NO: 600045 - DNA, 25 bp, Homo sapien
acttagcataatcagacgaccccgt

SEQ ID NO: 600046 - DNA, 25 bp, Homo sapien
gacgaccccgtcttaacagacaagt

SEQ ID NO: 600047 - DNA, 25 bp, Homo sapien
acagagaggctatgggactcgcccc

SEQ ID NO: 600048 - DNA, 25 bp, Homo sapien
aggctatgggactcgccccagctgt

SEQ ID NO: 600049 - DNA, 25 bp, Homo sapien
ctttttgatgagtcttacaggaagg

SEQ ID NO: 600050 - DNA, 25 bp, Homo sapien
aaggcagtgtgtagagaatcggctt

SEQ ID NO: 600051 - DNA, 25 bp, Homo sapien
gtgtgtagagaatcggcttgctctg

SEQ ID NO: 600052 - DNA, 25 bp, Homo sapien
tttgcctgctgtccattgaagtctg

SEQ ID NO: 600053 - DNA, 25 bp, Homo sapien
tgctgtccattgaagtctgtgtgtt

SEQ ID NO: 600054 - DNA, 25 bp, Homo sapien
tgttggcatgagatgaatcaggaga

SEQ ID NO: 600055 - DNA, 25 bp, Homo sapien
tgtggagggaagtagtcattcctca

SEQ ID NO: 600056 - DNA, 25 bp, Homo sapien
agtcattcctcaggccctttgactc

SEQ ID NO: 600057 - DNA, 25 bp, Homo sapien
atgtagtcccgtctctctgtggaaa

SEQ ID NO: 600058 - DNA, 25 bp, Homo sapien
gtctctctgtggaaagcctgacttc

SEQ ID NO: 600059 - DNA, 25 bp, Homo sapien
tggaaagcctgacttctggcttcac

SEQ ID NO: 600060 - DNA, 25 bp, Homo sapien
tacaacctctgcctcaagcgatcct

SEQ ID NO: 600061 - DNA, 25 bp, Homo sapien
aacagagtgaaacctgtccctgttt

SEQ ID NO: 600062 - DNA, 25 bp, Homo sapien
cagagtgaaacctgtccctgttttc

SEQ ID NO: 600063 - DNA, 25 bp, Homo sapien
agtgaaacctgtccctgttttcctg

SEQ ID NO: 600064 - DNA, 25 bp, Homo sapien
tgaaacctgtccctgttttcctgct

SEQ ID NO: 600065 - DNA, 25 bp, Homo sapien
tgtccctgttttcctgctcttactc

SEQ ID NO: 600066 - DNA, 25 bp, Homo sapien
tgttttcctgctcttactctcacct

SEQ ID NO: 600067 - DNA, 25 bp, Homo sapien
tgctcttactctcacctccgaggcc

SEQ ID NO: 600068 - DNA, 25 bp, Homo sapien
gcctcctctgcctggaagagattac

SEQ ID NO: 600069 - DNA, 25 bp, Homo sapien
ctcctctgcctggaagagattacag

SEQ ID NO: 600070 - DNA, 25 bp, Homo sapien
gaagagattacagggaaattccagg

SEQ ID NO: 600071 - DNA, 25 bp, Homo sapien
aagcttcaggagcactcgaccagag

SEQ ID NO: 600072 - DNA, 25 bp, Homo sapien
tcgaccagagtcagtgtagcccttg

SEQ ID NO: 600073 - DNA, 25 bp, Homo sapien
gtagcccttggcagctggtgaagca

SEQ ID NO: 600074 - DNA, 25 bp, Homo sapien
gctggtgaagcacaacctgggacaa

SEQ ID NO: 600075 - DNA, 25 bp, Homo sapien
gaatctttcaagtgttgctaaccag

SEQ ID NO: 600076 - DNA, 25 bp, Homo sapien
agtgttgctaaccagaactgagcag

SEQ ID NO: 600077 - DNA, 25 bp, Homo sapien
gaactgagcagatccaagtagcaat

SEQ ID NO: 600078 - DNA, 25 bp, Homo sapien
gcagatccaagtagcaatcgtagcc

SEQ ID NO: 600079 - DNA, 25 bp, Homo sapien
agccattagtccatgtatggagaga

SEQ ID NO: 600080 - DNA, 25 bp, Homo sapien
gagagaccagagagggcatccccac

SEQ ID NO: 600081 - DNA, 25 bp, Homo sapien
tggtgatgcctcaagcttcaggagc

SEQ ID NO: 600082 - DNA, 25 bp, Homo sapien
gggcttggaaatcaaattcagctct

SEQ ID NO: 600083 - DNA, 25 bp, Homo sapien
atgccctctttctgggaccaggcta

SEQ ID NO: 600084 - DNA, 25 bp, Homo sapien
tgggaccaggctaaccctgcagaag

SEQ ID NO: 600085 - DNA, 25 bp, Homo sapien
taaccctgcagaagcacagacacta

SEQ ID NO: 600086 - DNA, 25 bp, Homo sapien
agacactacagaccacagcattcag

SEQ ID NO: 600087 - DNA, 25 bp, Homo sapien
ccatggagtttggtgtgcttgcctt

SEQ ID NO: 600088 - DNA, 25 bp, Homo sapien
tttggcttcagacctcaccatcttt

SEQ ID NO: 600089 - DNA, 25 bp, Homo sapien
accatctttgacagcccttgaaggt

SEQ ID NO: 600090 - DNA, 25 bp, Homo sapien
ttgaaggtggtagcccagctcctgt

SEQ ID NO: 600091 - DNA, 25 bp, Homo sapien
tcctgttcctgtgccttcaaaaggc

SEQ ID NO: 600092 - DNA, 25 bp, Homo sapien
ggcactatgagtaaaagaccgcttt

SEQ ID NO: 600093 - DNA, 25 bp, Homo sapien
tttggagaaagagatctccgtgccc

SEQ ID NO: 600094 - DNA, 25 bp, Homo sapien
gtgccctacagaccttttctcaacg

SEQ ID NO: 600095 - DNA, 25 bp, Homo sapien
cctacagaccttttctcaacgaatg

SEQ ID NO: 600096 - DNA, 25 bp, Homo sapien
acagaccttttctcaacgaatgtgg

SEQ ID NO: 600097 - DNA, 25 bp, Homo sapien
gaccttttctcaacgaatgtgggaa

SEQ ID NO: 600098 - DNA, 25 bp, Homo sapien
gaaggacctggctttaaaacacgca

SEQ ID NO: 600099 - DNA, 25 bp, Homo sapien
aggacctggctttaaaacacgcaca

SEQ ID NO: 600100 - DNA, 25 bp, Homo sapien
gacctggctttaaaacacgcacaca

SEQ ID NO: 600101 - DNA, 25 bp, Homo sapien
aagatgtcatcacgaaactgcccac

SEQ ID NO: 600102 - DNA, 25 bp, Homo sapien
atgtcatcacgaaactgcccacgga

SEQ ID NO: 600103 - DNA, 25 bp, Homo sapien
tcatcacgaaactgcccacggatct

SEQ ID NO: 600104 - DNA, 25 bp, Homo sapien
agcgatgcctgccagacacagacgg

SEQ ID NO: 600105 - DNA, 25 bp, Homo sapien
gcgatgcctgccagacacagacggt

SEQ ID NO: 600106 - DNA, 25 bp, Homo sapien
gctgtgatggaggagcagtgctggg

SEQ ID NO: 600107 - DNA, 25 bp, Homo sapien
ggctgggcctcagccattcctgtcc

SEQ ID NO: 600108 - DNA, 25 bp, Homo sapien
tcccagctgctgtttgttgccaata

SEQ ID NO: 600109 - DNA, 25 bp, Homo sapien
ccagctgctgtttgttgccaatatg

SEQ ID NO: 600110 - DNA, 25 bp, Homo sapien
cagctgctgtttgttgccaatatga

SEQ ID NO: 600111 - DNA, 25 bp, Homo sapien
agctgctgtttgttgccaatatgaa

SEQ ID NO: 600112 - DNA, 25 bp, Homo sapien
ctgctgtttgttgccaatatgaagt

SEQ ID NO: 600113 - DNA, 25 bp, Homo sapien
gtttgttgccaatatgaagtatcca

SEQ ID NO: 600114 - DNA, 25 bp, Homo sapien
ttgttgccaatatgaagtatccact

SEQ ID NO: 600115 - DNA, 25 bp, Homo sapien
tctagcaacttaattgacaaaagaa

SEQ ID NO: 600116 - DNA, 25 bp, Homo sapien
aagatctaagaactagagtcaccct

SEQ ID NO: 600117 - DNA, 25 bp, Homo sapien
agatctaagaactagagtcacccta

SEQ ID NO: 600118 - DNA, 25 bp, Homo sapien
gatctaagaactagagtcaccctaa

SEQ ID NO: 600119 - DNA, 25 bp, Homo sapien
tctaagaactagagtcaccctaaat

SEQ ID NO: 600120 - DNA, 25 bp, Homo sapien
taagaactagagtcaccctaaatcc

SEQ ID NO: 600121 - DNA, 25 bp, Homo sapien
aagaactagagtcaccctaaatcct

SEQ ID NO: 600122 - DNA, 25 bp, Homo sapien
agaactagagtcaccctaaatcctg

SEQ ID NO: 600123 - DNA, 25 bp, Homo sapien
gaactagagtcaccctaaatcctgg

SEQ ID NO: 600124 - DNA, 25 bp, Homo sapien
actagagtcaccctaaatcctggag

SEQ ID NO: 600125 - DNA, 25 bp, Homo sapien
gagtcaccctaaatcctggagaata

SEQ ID NO: 600126 - DNA, 25 bp, Homo sapien
gaactggccttaggaaatctaacta

SEQ ID NO: 600127 - DNA, 25 bp, Homo sapien
aaggttatggagtatcccacctcag

SEQ ID NO: 600128 - DNA, 25 bp, Homo sapien
gagtatcccacctcaggaaggaaca

SEQ ID NO: 600129 - DNA, 25 bp, Homo sapien
tgattgacagtcttcttgccgccag

SEQ ID NO: 600130 - DNA, 25 bp, Homo sapien
caccaagtggcccattaaccaagag

SEQ ID NO: 600131 - DNA, 25 bp, Homo sapien
taaccaagagaaccagcgcaaccag

SEQ ID NO: 600132 - DNA, 25 bp, Homo sapien
gagaaccagcgcaaccagatacgct

SEQ ID NO: 600133 - DNA, 25 bp, Homo sapien
atctcctacctctcatgtgctttgc

SEQ ID NO: 600134 - DNA, 25 bp, Homo sapien
agcctgcataccttactcatgatgt

SEQ ID NO: 600135 - DNA, 25 bp, Homo sapien
tgtcaattcccaagtttcgctaata

SEQ ID NO: 600136 - DNA, 25 bp, Homo sapien
aaaacatctctgcaagcctcttcag

SEQ ID NO: 600137 - DNA, 25 bp, Homo sapien
ggtcaacatgatgcagagatcacac

SEQ ID NO: 600138 - DNA, 25 bp, Homo sapien
tattttcactttcactatttattac

SEQ ID NO: 600139 - DNA, 25 bp, Homo sapien
ctttcactatttattacagcaggga

SEQ ID NO: 600140 - DNA, 25 bp, Homo sapien
cagcagggaaatatgtaagtatcag

SEQ ID NO: 600141 - DNA, 25 bp, Homo sapien
gtgtttgaggtgatatttctcctac

SEQ ID NO: 600142 - DNA, 25 bp, Homo sapien
tctcctactgaaataccaagtacta

SEQ ID NO: 600143 - DNA, 25 bp, Homo sapien
taccaagtactatagaggaacacaa

SEQ ID NO: 600144 - DNA, 25 bp, Homo sapien
aagtttaaatcaatgcttataccag

SEQ ID NO: 600145 - DNA, 25 bp, Homo sapien
aatgcttataccagtaactagtaac

SEQ ID NO: 600146 - DNA, 25 bp, Homo sapien
accagtaactagtaacaacaacaat

SEQ ID NO: 600147 - DNA, 25 bp, Homo sapien
acaacaataacaaaatctctgcaaa

SEQ ID NO: 600148 - DNA, 25 bp, Homo sapien
ccttttcctaagactctatgaagcg

SEQ ID NO: 600149 - DNA, 25 bp, Homo sapien
ttttcctaagactctatgaagcggg

SEQ ID NO: 600150 - DNA, 25 bp, Homo sapien
tttcctaagactctatgaagcgggc

SEQ ID NO: 600151 - DNA, 25 bp, Homo sapien
ttcctaagactctatgaagcgggcc

SEQ ID NO: 600152 - DNA, 25 bp, Homo sapien
tcctaagactctatgaagcgggccg

SEQ ID NO: 600153 - DNA, 25 bp, Homo sapien
cctaagactctatgaagcgggccgg

SEQ ID NO: 600154 - DNA, 25 bp, Homo sapien
ctaagactctatgaagcgggccggg

SEQ ID NO: 600155 - DNA, 25 bp, Homo sapien
taagactctatgaagcgggccgggc

SEQ ID NO: 600156 - DNA, 25 bp, Homo sapien
agactctatgaagcgggccgggcgc

SEQ ID NO: 600157 - DNA, 25 bp, Homo sapien
ggaggctgtggtgggccgacatcct

SEQ ID NO: 600158 - DNA, 25 bp, Homo sapien
ctgtggtgggccgacatcctgccac

SEQ ID NO: 600159 - DNA, 25 bp, Homo sapien
gagtctaaaagtgttgtacggatcc

SEQ ID NO: 600160 - DNA, 25 bp, Homo sapien
gcttgctgcttccaatggctccgtg

SEQ ID NO: 600161 - DNA, 25 bp, Homo sapien
caatggctccgtgcgacaggttatt

SEQ ID NO: 600162 - DNA, 25 bp, Homo sapien
tccgtgcgacaggttattttcttat

SEQ ID NO: 600163 - DNA, 25 bp, Homo sapien
tagtcttggactgacggaaggtttc

SEQ ID NO: 600164 - DNA, 25 bp, Homo sapien
gtgctcagatttctggcctgtcaac

SEQ ID NO: 600165 - DNA, 25 bp, Homo sapien
agatttctggcctgtcaacacaact

SEQ ID NO: 600166 - DNA, 25 bp, Homo sapien
ggcctgtcaacacaactcagatcat

SEQ ID NO: 600167 - DNA, 25 bp, Homo sapien
tcactccccagctcaaaactgttga

SEQ ID NO: 600168 - DNA, 25 bp, Homo sapien
ctgttgagtgggtccaagttttctt

SEQ ID NO: 600169 - DNA, 25 bp, Homo sapien
aaaacacaaagctgccgtgaggcct

SEQ ID NO: 600170 - DNA, 25 bp, Homo sapien
cttagatcaccaccctttctcaggg

SEQ ID NO: 600171 - DNA, 25 bp, Homo sapien
tgtagcaatctatagccaatcaaag

SEQ ID NO: 600172 - DNA, 25 bp, Homo sapien
tagccaatcaaagcactgtaacata

SEQ ID NO: 600173 - DNA, 25 bp, Homo sapien
acatacgcactggttttgtatggaa

SEQ ID NO: 600174 - DNA, 25 bp, Homo sapien
agtttggaatgctcaccccatgcct

SEQ ID NO: 600175 - DNA, 25 bp, Homo sapien
gcctttggagtcaatgcttactggg

SEQ ID NO: 600176 - DNA, 25 bp, Homo sapien
agtcaatgcttactgggtggctatt

SEQ ID NO: 600177 - DNA, 25 bp, Homo sapien
atgcttactgggtggctattctcaa

SEQ ID NO: 600178 - DNA, 25 bp, Homo sapien
actgggtggctattctcaaactttg

SEQ ID NO: 600179 - DNA, 25 bp, Homo sapien
ggctattctcaaactttgcactcaa

SEQ ID NO: 600180 - DNA, 25 bp, Homo sapien
aaagaaactctatacttagtcttat

SEQ ID NO: 600181 - DNA, 25 bp, Homo sapien
tcttcagtcagaggagattgttgct

SEQ ID NO: 600182 - DNA, 25 bp, Homo sapien
gagattgttgctgagttggtttata

SEQ ID NO: 600183 - DNA, 25 bp, Homo sapien
gctgagttggtttatagttttctga

SEQ ID NO: 600184 - DNA, 25 bp, Homo sapien
atagttttctgatcccagaggtgca

SEQ ID NO: 600185 - DNA, 25 bp, Homo sapien
gatcccagaggtgcaaaaatacttt

SEQ ID NO: 600186 - DNA, 25 bp, Homo sapien
ggaaacatattcttgcagcccatca

SEQ ID NO: 600187 - DNA, 25 bp, Homo sapien
caaacttgccaggaatgtgatattt

SEQ ID NO: 600188 - DNA, 25 bp, Homo sapien
tgccaggaatgtgatatttcagatc

SEQ ID NO: 600189 - DNA, 25 bp, Homo sapien
gatatttcagatcacttaatcaagg

SEQ ID NO: 600190 - DNA, 25 bp, Homo sapien
aatcaaggaaaagccgaacctatct

SEQ ID NO: 600191 - DNA, 25 bp, Homo sapien
aagccgaacctatcttcagtcagag

SEQ ID NO: 600192 - DNA, 25 bp, Homo sapien
cacttctgctctgggagcctctggg

SEQ ID NO: 600193 - DNA, 25 bp, Homo sapien
gagcctctgggttcctgggcgcacc

SEQ ID NO: 600194 - DNA, 25 bp, Homo sapien
cttccctgtttgtcactgggtgacc

SEQ ID NO: 600195 - DNA, 25 bp, Homo sapien
gtttgtcactgggtgacctcccgtc

SEQ ID NO: 600196 - DNA, 25 bp, Homo sapien
gtgacctcccgtccttgtgggcgct

SEQ ID NO: 600197 - DNA, 25 bp, Homo sapien
ctggtctcgggccttctgaggactt

SEQ ID NO: 600198 - DNA, 25 bp, Homo sapien
gaggacttgctctcctggtagcggc

SEQ ID NO: 600199 - DNA, 25 bp, Homo sapien
cttgctctcctggtagcggctgctg

SEQ ID NO: 600200 - DNA, 25 bp, Homo sapien
gctgctgactgtgagcccagagagc

SEQ ID NO: 600201 - DNA, 25 bp, Homo sapien
tgctgactgtgagcccagagagcag

SEQ ID NO: 600202 - DNA, 25 bp, Homo sapien
tggctgttgaccttaggtcctccca

SEQ ID NO: 600203 - DNA, 25 bp, Homo sapien
tgtgcccagtgcagcatactctgtt

SEQ ID NO: 600204 - DNA, 25 bp, Homo sapien
gtgcagcatactctgtttacaagca

SEQ ID NO: 600205 - DNA, 25 bp, Homo sapien
gtttacaagcacaagcagtgtagcc

SEQ ID NO: 600206 - DNA, 25 bp, Homo sapien
gcacaagcagtgtagccagaggact

SEQ ID NO: 600207 - DNA, 25 bp, Homo sapien
gtgtagccagaggacttcagtttga

SEQ ID NO: 600208 - DNA, 25 bp, Homo sapien
gaggacttcagtttgaatcttgact

SEQ ID NO: 600209 - DNA, 25 bp, Homo sapien
gaatcttgactttaccacttagttt

SEQ ID NO: 600210 - DNA, 25 bp, Homo sapien
ttaccacttagtttgtgttcccttg

SEQ ID NO: 600211 - DNA, 25 bp, Homo sapien
cacttagtttgtgttcccttgaaag

SEQ ID NO: 600212 - DNA, 25 bp, Homo sapien
gttcccttgaaagaagagcctgaga

SEQ ID NO: 600213 - DNA, 25 bp, Homo sapien
gaaaaagacttactggctgataggt

SEQ ID NO: 600214 - DNA, 25 bp, Homo sapien
gagattgttgctgagttggtttata

SEQ ID NO: 600215 - DNA, 25 bp, Homo sapien
ttgttgctgagttggtttatagttt

SEQ ID NO: 600216 - DNA, 25 bp, Homo sapien
tatagttttctgatcccagaggtgc

SEQ ID NO: 600217 - DNA, 25 bp, Homo sapien
atagttttctgatcccagaggtgca

SEQ ID NO: 600218 - DNA, 25 bp, Homo sapien
tagttttctgatcccagaggtgcaa

SEQ ID NO: 600219 - DNA, 25 bp, Homo sapien
gttttctgatcccagaggtgcaaaa

SEQ ID NO: 600220 - DNA, 25 bp, Homo sapien
gatcccagaggtgcaaaaatacttt

SEQ ID NO: 600221 - DNA, 25 bp, Homo sapien
cagaggtgcaaaaatactttgtcaa

SEQ ID NO: 600222 - DNA, 25 bp, Homo sapien
ggtgcaaaaatactttgtcaaagaa

SEQ ID NO: 600223 - DNA, 25 bp, Homo sapien
cctatcttcagtcagaggagattgt

SEQ ID NO: 600224 - DNA, 25 bp, Homo sapien
atcttcagtcagaggagattgttgc

SEQ ID NO: 600225 - DNA, 25 bp, Homo sapien
acaccaaaggagtgttggccgccat

SEQ ID NO: 600226 - DNA, 25 bp, Homo sapien
aaagtccagggagccagtatagatg

SEQ ID NO: 600227 - DNA, 25 bp, Homo sapien
gccagtatagatgcaggactgctct

SEQ ID NO: 600228 - DNA, 25 bp, Homo sapien
gatgcctcacaagcagcaacttctt

SEQ ID NO: 600229 - DNA, 25 bp, Homo sapien
acttcttcctccttatagttcttat

SEQ ID NO: 600230 - DNA, 25 bp, Homo sapien
agttcttatctgtgattcttccata

SEQ ID NO: 600231 - DNA, 25 bp, Homo sapien
tctgtgattcttccataattttgtc

SEQ ID NO: 600232 - DNA, 25 bp, Homo sapien
aattttgtccttctaagcttctgat

SEQ ID NO: 600233 - DNA, 25 bp, Homo sapien
aagcttctgatgcactgaattatgt

SEQ ID NO: 600234 - DNA, 25 bp, Homo sapien
atgtaaagtgcattcccttcaccag

SEQ ID NO: 600235 - DNA, 25 bp, Homo sapien
ttgtgcaccctattctgtaactgat

SEQ ID NO: 600236 - DNA, 25 bp, Homo sapien
ttctcaagtcattttaaagttacct

SEQ ID NO: 600237 - DNA, 25 bp, Homo sapien
tctcaagtcattttaaagttaccta

SEQ ID NO: 600238 - DNA, 25 bp, Homo sapien
tacctaacgttcttcttgaataact

SEQ ID NO: 600239 - DNA, 25 bp, Homo sapien
ctaacgttcttcttgaataactaat

SEQ ID NO: 600240 - DNA, 25 bp, Homo sapien
taacgttcttcttgaataactaata

SEQ ID NO: 600241 - DNA, 25 bp, Homo sapien
acgttcttcttgaataactaataca

SEQ ID NO: 600242 - DNA, 25 bp, Homo sapien
gaataactaatacagtgggtcaaat

SEQ ID NO: 600243 - DNA, 25 bp, Homo sapien
taactaatacagtgggtcaaatatt

SEQ ID NO: 600244 - DNA, 25 bp, Homo sapien
atacagtgggtcaaatattataaaa

SEQ ID NO: 600245 - DNA, 25 bp, Homo sapien
acagtgggtcaaatattataaaata

SEQ ID NO: 600246 - DNA, 25 bp, Homo sapien
atattataaaataggcaaacaccaa

SEQ ID NO: 600247 - DNA, 25 bp, Homo sapien
aaaatctggacttctgtcagaattt

SEQ ID NO: 600248 - DNA, 25 bp, Homo sapien
gctgtttgccttggcatatcatcta

SEQ ID NO: 600249 - DNA, 25 bp, Homo sapien
tgccttggcatatcatctacagaga

SEQ ID NO: 600250 - DNA, 25 bp, Homo sapien
atctacagagaattgatgacatcct

SEQ ID NO: 600251 - DNA, 25 bp, Homo sapien
aatagccaggccatctatgagtggt

SEQ ID NO: 600252 - DNA, 25 bp, Homo sapien
caggccatctatgagtggttgagga

SEQ ID NO: 600253 - DNA, 25 bp, Homo sapien
ttatagtttcctttctgttcccaca

SEQ ID NO: 600254 - DNA, 25 bp, Homo sapien
tgttcccacaagtagccttgctgtt

SEQ ID NO: 600255 - DNA, 25 bp, Homo sapien
gtagccttgctgttgggtgaatagt

SEQ ID NO: 600256 - DNA, 25 bp, Homo sapien
gctgttgggtgaatagtttgactct

SEQ ID NO: 600257 - DNA, 25 bp, Homo sapien
tttgactctaaagctacgtgaaaaa

SEQ ID NO: 600258 - DNA, 25 bp, Homo sapien
aaagtagctgttaaggaagctctat

SEQ ID NO: 600259 - DNA, 25 bp, Homo sapien
gctgttaaggaagctctatttaatt

SEQ ID NO: 600260 - DNA, 25 bp, Homo sapien
ttaatttatttgtcagtgtgggctg

SEQ ID NO: 600261 - DNA, 25 bp, Homo sapien
atttgtcagtgtgggctgagtcatc

SEQ ID NO: 600262 - DNA, 25 bp, Homo sapien
cagtgtgggctgagtcatcaacaac

SEQ ID NO: 600263 - DNA, 25 bp, Homo sapien
gtgggctgagtcatcaacaactata

SEQ ID NO: 600264 - DNA, 25 bp, Homo sapien
ggctgagtcatcaacaactatactt

SEQ ID NO: 600265 - DNA, 25 bp, Homo sapien
gtcatcaacaactatacttttcact

SEQ ID NO: 600266 - DNA, 25 bp, Homo sapien
tcaacaactatacttttcacttttt

SEQ ID NO: 600267 - DNA, 25 bp, Homo sapien
cacttttttcatagaatccaggaca

SEQ ID NO: 600268 - DNA, 25 bp, Homo sapien
ttttttcatagaatccaggacaaga

SEQ ID NO: 600269 - DNA, 25 bp, Homo sapien
cccctaacacatttagttggcttgg

SEQ ID NO: 600270 - DNA, 25 bp, Homo sapien
catttagttggcttggtgtttagtt

SEQ ID NO: 600271 - DNA, 25 bp, Homo sapien
ggcttggtgtttagtttaacaatca

SEQ ID NO: 600272 - DNA, 25 bp, Homo sapien
caattgctacaaatatgctgcttaa

SEQ ID NO: 600273 - DNA, 25 bp, Homo sapien
ttggcttttgtttcctactccaaag

SEQ ID NO: 600274 - DNA, 25 bp, Homo sapien
tggcttttgtttcctactccaaagt

SEQ ID NO: 600275 - DNA, 25 bp, Homo sapien
aaagttgattatggttcctctgtct

SEQ ID NO: 600276 - DNA, 25 bp, Homo sapien
ttgattatggttcctctgtcttgtc

SEQ ID NO: 600277 - DNA, 25 bp, Homo sapien
gattatggttcctctgtcttgtccc

SEQ ID NO: 600278 - DNA, 25 bp, Homo sapien
caaaggacgtgttaattatgtttct

SEQ ID NO: 600279 - DNA, 25 bp, Homo sapien
ttatgtttcttgtaaactgactttt

SEQ ID NO: 600280 - DNA, 25 bp, Homo sapien
aattcagtgcaccttgggatttaag

SEQ ID NO: 600281 - DNA, 25 bp, Homo sapien
gtgcaccttgggatttaagaatgga

SEQ ID NO: 600282 - DNA, 25 bp, Homo sapien
tcaggagacagagaggttatcagtt

SEQ ID NO: 600283 - DNA, 25 bp, Homo sapien
acaaacttttttccacttagcatct

SEQ ID NO: 600284 - DNA, 25 bp, Homo sapien
acttttttccacttagcatcttaat

SEQ ID NO: 600285 - DNA, 25 bp, Homo sapien
ttccacttagcatcttaatatatac

SEQ ID NO: 600286 - DNA, 25 bp, Homo sapien
atacatagcctgtatttgactttat

SEQ ID NO: 600287 - DNA, 25 bp, Homo sapien
actatagcatactgcatttagtgta

SEQ ID NO: 600288 - DNA, 25 bp, Homo sapien
tcatggacatttcattgcacaaatt

SEQ ID NO: 600289 - DNA, 25 bp, Homo sapien
ggacatttcattgcacaaatttgtt

SEQ ID NO: 600290 - DNA, 25 bp, Homo sapien
tttgtttctcttcatatgaactgta

SEQ ID NO: 600291 - DNA, 25 bp, Homo sapien
aaatagttccctaaggcagctttat

SEQ ID NO: 600292 - DNA, 25 bp, Homo sapien
agttccctaaggcagctttatggaa

SEQ ID NO: 600293 - DNA, 25 bp, Homo sapien
gcagctttatggaaactaatatagg

SEQ ID NO: 600294 - DNA, 25 bp, Homo sapien
gtttagtttcacacatacatagtac

SEQ ID NO: 600295 - DNA, 25 bp, Homo sapien
gtttcacacatacatagtaccatga

SEQ ID NO: 600296 - DNA, 25 bp, Homo sapien
acatagtaccatgattttctttgaa

SEQ ID NO: 600297 - DNA, 25 bp, Homo sapien
aagcatcatgtaaagaaatcctaac

SEQ ID NO: 600298 - DNA, 25 bp, Homo sapien
gtaaagaaatcctaacatttaagtg

SEQ ID NO: 600299 - DNA, 25 bp, Homo sapien
ttcatttcaaatgtcacaagtaaag

SEQ ID NO: 600300 - DNA, 25 bp, Homo sapien
gtcacaagtaaagcatcatcctcaa

SEQ ID NO: 600301 - DNA, 25 bp, Homo sapien
gtaaagcatcatcctcaaatatctc

SEQ ID NO: 600302 - DNA, 25 bp, Homo sapien
tctttactgccctagggtggatcta

SEQ ID NO: 600303 - DNA, 25 bp, Homo sapien
actgccctagggtggatctaaaata

SEQ ID NO: 600304 - DNA, 25 bp, Homo sapien
gccctagggtggatctaaaatattt

SEQ ID NO: 600305 - DNA, 25 bp, Homo sapien
gctgggagccctagctgaagcctgt

SEQ ID NO: 600306 - DNA, 25 bp, Homo sapien
gggagccctagctgaagcctgtgac

SEQ ID NO: 600307 - DNA, 25 bp, Homo sapien
gagccctagctgaagcctgtgaccc

SEQ ID NO: 600308 - DNA, 25 bp, Homo sapien
atttaaaatcagctggtcgtggtgc

SEQ ID NO: 600309 - DNA, 25 bp, Homo sapien
tggtcgtggtgcctcttgtagttcc

SEQ ID NO: 600310 - DNA, 25 bp, Homo sapien
tcgtggtgcctcttgtagttccatc

SEQ ID NO: 600311 - DNA, 25 bp, Homo sapien
aggctacagtgaaccgtgttttcac

SEQ ID NO: 600312 - DNA, 25 bp, Homo sapien
agtgaaccgtgttttcaccactgca

SEQ ID NO: 600313 - DNA, 25 bp, Homo sapien
cggattggaactatactggttgact

SEQ ID NO: 600314 - DNA, 25 bp, Homo sapien
gattggaactatactggttgactca

SEQ ID NO: 600315 - DNA, 25 bp, Homo sapien
ttggaactatactggttgactcagg

SEQ ID NO: 600316 - DNA, 25 bp, Homo sapien
tggttgactcaggtctggagcccaa

SEQ ID NO: 600317 - DNA, 25 bp, Homo sapien
gttgactcaggtctggagcccaaaa

SEQ ID NO: 600318 - DNA, 25 bp, Homo sapien
tgactcaggtctggagcccaaaatc

SEQ ID NO: 600319 - DNA, 25 bp, Homo sapien
actcaggtctggagcccaaaatcac

SEQ ID NO: 600320 - DNA, 25 bp, Homo sapien
tggagcccaaaatcacagccagaat

SEQ ID NO: 600321 - DNA, 25 bp, Homo sapien
gagcccaaaatcacagccagaatat

SEQ ID NO: 600322 - DNA, 25 bp, Homo sapien
gcccaaaatcacagccagaatataa

SEQ ID NO: 600323 - DNA, 25 bp, Homo sapien
agaatataaggtgaggctgttttct

SEQ ID NO: 600324 - DNA, 25 bp, Homo sapien
gggctgcacttcagagggccttgga

SEQ ID NO: 600325 - DNA, 25 bp, Homo sapien
ggaggaaacctcagatgccggcagt

SEQ ID NO: 600326 - DNA, 25 bp, Homo sapien
gaaacctcagatgccggcagttttc

SEQ ID NO: 600327 - DNA, 25 bp, Homo sapien
gatgccggcagttttcagaggttca

SEQ ID NO: 600328 - DNA, 25 bp, Homo sapien
gcagttttcagaggttcatgctcaa

SEQ ID NO: 600329 - DNA, 25 bp, Homo sapien
ggaatttgcctgatttatatactgg

SEQ ID NO: 600330 - DNA, 25 bp, Homo sapien
ctggagcctgtgttgtaagacagaa

SEQ ID NO: 600331 - DNA, 25 bp, Homo sapien
cagctatatttagccgggatcccca

SEQ ID NO: 600332 - DNA, 25 bp, Homo sapien
tttagccgggatccccagtccagga

SEQ ID NO: 600333 - DNA, 25 bp, Homo sapien
cagactttttccctcttctaagaat

SEQ ID NO: 600334 - DNA, 25 bp, Homo sapien
ttccctcttctaagaatttgattga

SEQ ID NO: 600335 - DNA, 25 bp, Homo sapien
gagaacagacatctttccctattcc

SEQ ID NO: 600336 - DNA, 25 bp, Homo sapien
tctttccctattcccaatcttagtg

SEQ ID NO: 600337 - DNA, 25 bp, Homo sapien
aatagatgcctttcatcagattgag

SEQ ID NO: 600338 - DNA, 25 bp, Homo sapien
catcagattgaggaagtttccttct

SEQ ID NO: 600339 - DNA, 25 bp, Homo sapien
ttccttctatttccagtttgctgat

SEQ ID NO: 600340 - DNA, 25 bp, Homo sapien
attttgctaattgcttttccttcaa

SEQ ID NO: 600341 - DNA, 25 bp, Homo sapien
aattgcttttccttcaactactgag

SEQ ID NO: 600342 - DNA, 25 bp, Homo sapien
tttccttcaactactgagatgttca

SEQ ID NO: 600343 - DNA, 25 bp, Homo sapien
gagatgttcatattgcactgcttct

SEQ ID NO: 600344 - DNA, 25 bp, Homo sapien
tcatattgcactgcttctttattct

SEQ ID NO: 600345 - DNA, 25 bp, Homo sapien
aatgctaaactattattgtattcct

SEQ ID NO: 600346 - DNA, 25 bp, Homo sapien
ctgcttcacattattgatgtcacta

SEQ ID NO: 600347 - DNA, 25 bp, Homo sapien
ttccacgtttttcatacacctacct

SEQ ID NO: 600348 - DNA, 25 bp, Homo sapien
tacacctacctttacgagaggtctt

SEQ ID NO: 600349 - DNA, 25 bp, Homo sapien
ggtctttatacctctatatgacttc

SEQ ID NO: 600350 - DNA, 25 bp, Homo sapien
atatgacttcacgttgctgtctaaa

SEQ ID NO: 600351 - DNA, 25 bp, Homo sapien
ttcacgttgctgtctaaacttcttt

SEQ ID NO: 600352 - DNA, 25 bp, Homo sapien
ctaaacttctttcatttcaaagtga

SEQ ID NO: 600353 - DNA, 25 bp, Homo sapien
tttcaaagtgaatgactctcttaag

SEQ ID NO: 600354 - DNA, 25 bp, Homo sapien
gcatttcttgtagagcagttctaat

SEQ ID NO: 600355 - DNA, 25 bp, Homo sapien
ttctaatggcaatgaactcctgcag

SEQ ID NO: 600356 - DNA, 25 bp, Homo sapien
gcagcttctacatcacatagtctta

SEQ ID NO: 600357 - DNA, 25 bp, Homo sapien
agtctccgtagaatctgccctatat

SEQ ID NO: 600358 - DNA, 25 bp, Homo sapien
tagatccctttatcatcctaactcg

SEQ ID NO: 600359 - DNA, 25 bp, Homo sapien
ctaactcgcaaaaacctcctgaatg

SEQ ID NO: 600360 - DNA, 25 bp, Homo sapien
tcctgaatggtttctctggccagag

SEQ ID NO: 600361 - DNA, 25 bp, Homo sapien
agagtttcttctctatcccagccat

SEQ ID NO: 600362 - DNA, 25 bp, Homo sapien
ggtgctggagtgatctttcttaagt

SEQ ID NO: 600363 - DNA, 25 bp, Homo sapien
taagctgtttgggtccagctccaga

SEQ ID NO: 600364 - DNA, 25 bp, Homo sapien
agatcctgctccttttgatcctgct

SEQ ID NO: 600365 - DNA, 25 bp, Homo sapien
tgctccttttgatacccttttttat

SEQ ID NO: 600366 - DNA, 25 bp, Homo sapien
agggtcccacatcacactataaata

SEQ ID NO: 600367 - DNA, 25 bp, Homo sapien
attccagtctggctcttatgttgta

SEQ ID NO: 600368 - DNA, 25 bp, Homo sapien
caatgactaacttctctgcaaatac

SEQ ID NO: 600369 - DNA, 25 bp, Homo sapien
caatagtttcattgccttcaggctt

SEQ ID NO: 600370 - DNA, 25 bp, Homo sapien
tcaggcttcttctatgtcttttaac

SEQ ID NO: 600371 - DNA, 25 bp, Homo sapien
gaaccttctggtgcattttagctta

SEQ ID NO: 600372 - DNA, 25 bp, Homo sapien
ttagcttaccaaacagcacatgctg

SEQ ID NO: 600373 - DNA, 25 bp, Homo sapien
catgctgctttgtacttgtgttgtt

SEQ ID NO: 600374 - DNA, 25 bp, Homo sapien
aattttccttgagtgccttgttcat

SEQ ID NO: 600375 - DNA, 25 bp, Homo sapien
tggaaggcgctattccaggaatttt

SEQ ID NO: 600376 - DNA, 25 bp, Homo sapien
gtgtagtttaagttacctccatcta

SEQ ID NO: 600377 - DNA, 25 bp, Homo sapien
ataattcatctttgtagttctacca

SEQ ID NO: 600378 - DNA, 25 bp, Homo sapien
gtagttctaccacaagcatattagt

SEQ ID NO: 600379 - DNA, 25 bp, Homo sapien
taagtcttaaaggaggagaataggc

SEQ ID NO: 600380 - DNA, 25 bp, Homo sapien
aagtcttaaaggaggagaataggca

SEQ ID NO: 600381 - DNA, 25 bp, Homo sapien
agtcttaaaggaggagaataggcag

SEQ ID NO: 600382 - DNA, 25 bp, Homo sapien
gtcttaaaggaggagaataggcagg

SEQ ID NO: 600383 - DNA, 25 bp, Homo sapien
tcttaaaggaggagaataggcaggg

SEQ ID NO: 600384 - DNA, 25 bp, Homo sapien
cttaaaggaggagaataggcagggc

SEQ ID NO: 600385 - DNA, 25 bp, Homo sapien
ttaaaggaggagaataggcagggca

SEQ ID NO: 600386 - DNA, 25 bp, Homo sapien
taaaggaggagaataggcagggcat

SEQ ID NO: 600387 - DNA, 25 bp, Homo sapien
ggaggagaataggcagggcatggtg

SEQ ID NO: 600388 - DNA, 25 bp, Homo sapien
tggcagggtgtggtgccatcgcctg

SEQ ID NO: 600389 - DNA, 25 bp, Homo sapien
ctgccttctactcatgcggtaatag

SEQ ID NO: 600390 - DNA, 25 bp, Homo sapien
tcatgcggtaatagaagctcttggc

SEQ ID NO: 600391 - DNA, 25 bp, Homo sapien
agaagctcttggcaaagtcacactg

SEQ ID NO: 600392 - DNA, 25 bp, Homo sapien
ttggcaaagtcacactgcgctgttg

SEQ ID NO: 600393 - DNA, 25 bp, Homo sapien
caaagtcacactgcgctgttgttgt

SEQ ID NO: 600394 - DNA, 25 bp, Homo sapien
gctgttgttgtctgttctccttttt

SEQ ID NO: 600395 - DNA, 25 bp, Homo sapien
gtttttaataatatctcttcacgtg

SEQ ID NO: 600396 - DNA, 25 bp, Homo sapien
ctcttcacgtgaaacttgttattct

SEQ ID NO: 600397 - DNA, 25 bp, Homo sapien
aagtgtagatgattctctctttaga

SEQ ID NO: 600398 - DNA, 25 bp, Homo sapien
gaaattgactacagtgggatctgca

SEQ ID NO: 600399 - DNA, 25 bp, Homo sapien
gtgggatctgcaagtaaatctgaac

SEQ ID NO: 600400 - DNA, 25 bp, Homo sapien
tgagttctaagtgagattctgcttc

SEQ ID NO: 600401 - DNA, 25 bp, Homo sapien
gtgagattctgcttctaaatactag

SEQ ID NO: 600402 - DNA, 25 bp, Homo sapien
gcttctaaatactagcttgggcatc

SEQ ID NO: 600403 - DNA, 25 bp, Homo sapien
gcttgggcatctaagtctctagacc

SEQ ID NO: 600404 - DNA, 25 bp, Homo sapien
aagtctctagacctatttttctcat

SEQ ID NO: 600405 - DNA, 25 bp, Homo sapien
ggtagatcagactaggtcatttcta

SEQ ID NO: 600406 - DNA, 25 bp, Homo sapien
taaattctctcccaaatttcaaaag

SEQ ID NO: 600407 - DNA, 25 bp, Homo sapien
tgggaattactctcagttacctatg

SEQ ID NO: 600408 - DNA, 25 bp, Homo sapien
tactctcagttacctatgtcaaata

SEQ ID NO: 600409 - DNA, 25 bp, Homo sapien
gtcaaataacattcttgttttttct

SEQ ID NO: 600410 - DNA, 25 bp, Homo sapien
gtgaaagtaatgcacagtcacagaa

SEQ ID NO: 600411 - DNA, 25 bp, Homo sapien
ctcccctggaaatgagagggactgg

SEQ ID NO: 600412 - DNA, 25 bp, Homo sapien
cagggtggtgcttcttgggttatac

SEQ ID NO: 600413 - DNA, 25 bp, Homo sapien
tgcttcttgggttatacccctctaa

SEQ ID NO: 600414 - DNA, 25 bp, Homo sapien
tgggttatacccctctaaggcagag

SEQ ID NO: 600415 - DNA, 25 bp, Homo sapien
tatacccctctaaggcagagagaat

SEQ ID NO: 600416 - DNA, 25 bp, Homo sapien
cagagagaatggcacctgtctcact

SEQ ID NO: 600417 - DNA, 25 bp, Homo sapien
acctgtctcactcaccttctgattt

SEQ ID NO: 600418 - DNA, 25 bp, Homo sapien
caccttctgattttgcaatgtaaga

SEQ ID NO: 600419 - DNA, 25 bp, Homo sapien
ggcagaaactctgttagacattcct

SEQ ID NO: 600420 - DNA, 25 bp, Homo sapien
actctgttagacattcctgcagctg

SEQ ID NO: 600421 - DNA, 25 bp, Homo sapien
ctgttagacattcctgcagctgaat

SEQ ID NO: 600422 - DNA, 25 bp, Homo sapien
agcgggcagcggagcggagcgcacg

SEQ ID NO: 600423 - DNA, 25 bp, Homo sapien
gcgggcagcggagcggagcgcacgg

SEQ ID NO: 600424 - DNA, 25 bp, Homo sapien
tccccggggacgtacctggctcagg

SEQ ID NO: 600425 - DNA, 25 bp, Homo sapien
gacgtacctggctcaggagagccgc

SEQ ID NO: 600426 - DNA, 25 bp, Homo sapien
tggctcaggagagccgccgggagtg

SEQ ID NO: 600427 - DNA, 25 bp, Homo sapien
agagccgccgggagtgcttaggcca

SEQ ID NO: 600428 - DNA, 25 bp, Homo sapien
gagccgccgggagtgcttaggccag

SEQ ID NO: 600429 - DNA, 25 bp, Homo sapien
agccgccgggagtgcttaggccagt

SEQ ID NO: 600430 - DNA, 25 bp, Homo sapien
gccgccgggagtgcttaggccagtt

SEQ ID NO: 600431 - DNA, 25 bp, Homo sapien
cgccgggagtgcttaggccagttgc

SEQ ID NO: 600432 - DNA, 25 bp, Homo sapien
ccgggagtgcttaggccagttgctg

SEQ ID NO: 600433 - DNA, 25 bp, Homo sapien
gaggaccggctgcagacctcactct

SEQ ID NO: 600434 - DNA, 25 bp, Homo sapien
gctgcagacctcactctgagtggca

SEQ ID NO: 600435 - DNA, 25 bp, Homo sapien
gacctcactctgagtggcaggcaga

SEQ ID NO: 600436 - DNA, 25 bp, Homo sapien
agagaaccaaagctgcttcgctgct

SEQ ID NO: 600437 - DNA, 25 bp, Homo sapien
agctgcttcgctgctctccagggag

SEQ ID NO: 600438 - DNA, 25 bp, Homo sapien
gggctgggatcggaacttcctgctc

SEQ ID NO: 600439 - DNA, 25 bp, Homo sapien
ggatcggaacttcctgctcttgttt

SEQ ID NO: 600440 - DNA, 25 bp, Homo sapien
cggaacttcctgctcttgtttctgg

SEQ ID NO: 600441 - DNA, 25 bp, Homo sapien
tcttgtttctggacaactttcccct

SEQ ID NO: 600442 - DNA, 25 bp, Homo sapien
tccccttctgctttaaaggttgtcg

SEQ ID NO: 600443 - DNA, 25 bp, Homo sapien
tctgctttaaaggttgtcgattatt

SEQ ID NO: 600444 - DNA, 25 bp, Homo sapien
gtttgcttgactccaaagcttatgt

SEQ ID NO: 600445 - DNA, 25 bp, Homo sapien
taatgtgctgcagtatcaatggtct

SEQ ID NO: 600446 - DNA, 25 bp, Homo sapien
gcagtatcaatggtctgtatgaaca

SEQ ID NO: 600447 - DNA, 25 bp, Homo sapien
ggtctgtatgaacaaaggccatatc

SEQ ID NO: 600448 - DNA, 25 bp, Homo sapien
aaggccatatcatttttattgacaa

SEQ ID NO: 600449 - DNA, 25 bp, Homo sapien
aatggtgactgaactggaacttgca

SEQ ID NO: 600450 - DNA, 25 bp, Homo sapien
gaactggaacttgcatcatctaatt

SEQ ID NO: 600451 - DNA, 25 bp, Homo sapien
gcatcatctaattccataactgagg

SEQ ID NO: 600452 - DNA, 25 bp, Homo sapien
ggactgcatgtatcccacaggatgt

SEQ ID NO: 600453 - DNA, 25 bp, Homo sapien
gttatttcatgatcttcacttctct

SEQ ID NO: 600454 - DNA, 25 bp, Homo sapien
gatcttcacttctctgttgattata

SEQ ID NO: 600455 - DNA, 25 bp, Homo sapien
agtgaggaacgcacagcggaaacat

SEQ ID NO: 600456 - DNA, 25 bp, Homo sapien
gaacgcacagcggaaacatattctt

SEQ ID NO: 600457 - DNA, 25 bp, Homo sapien
ggaaacatattcttgcagcccatca

SEQ ID NO: 600458 - DNA, 25 bp, Homo sapien
aacatattcttgcagcccatcagat

SEQ ID NO: 600459 - DNA, 25 bp, Homo sapien
ttgcagcccatcagatcatccacag

SEQ ID NO: 600460 - DNA, 25 bp, Homo sapien
ccatcagatcatccacagttacacg

SEQ ID NO: 600461 - DNA, 25 bp, Homo sapien
gatcatccacagttacacggaaagc

SEQ ID NO: 600462 - DNA, 25 bp, Homo sapien
gttacacggaaagcatggttcaaaa

SEQ ID NO: 600463 - DNA, 25 bp, Homo sapien
gatgaggcctcaaatgctgccatgt

SEQ ID NO: 600464 - DNA, 25 bp, Homo sapien
tgccatgttacttgagaaagaaact

SEQ ID NO: 600465 - DNA, 25 bp, Homo sapien
aagaagctgtacgaatcatcataaa

SEQ ID NO: 600466 - DNA, 25 bp, Homo sapien
cagtaaagaagccaaccaaatccca

SEQ ID NO: 600467 - DNA, 25 bp, Homo sapien
acactcctgacagcaccatgacagt

SEQ ID NO: 600468 - DNA, 25 bp, Homo sapien
atcaggaagttacccgatatgtccc

SEQ ID NO: 600469 - DNA, 25 bp, Homo sapien
gaagttacccgatatgtcccaaaag

SEQ ID NO: 600470 - DNA, 25 bp, Homo sapien
taaaagtgggcaaccagcagctcta

SEQ ID NO: 600471 - DNA, 25 bp, Homo sapien
aaagtgggcaaccagcagctctagg

SEQ ID NO: 600472 - DNA, 25 bp, Homo sapien
agtgggcaaccagcagctctaggcg

SEQ ID NO: 600473 - DNA, 25 bp, Homo sapien
tgggcaaccagcagctctaggcgct

SEQ ID NO: 600474 - DNA, 25 bp, Homo sapien
agctctaggcgctgctcttgtctat

SEQ ID NO: 600475 - DNA, 25 bp, Homo sapien
tctaggcgctgctcttgtctatgga

SEQ ID NO: 600476 - DNA, 25 bp, Homo sapien
taggcgctgctcttgtctatggagt

SEQ ID NO: 600477 - DNA, 25 bp, Homo sapien
taggtccaggcaaggtggctcatgc

SEQ ID NO: 600478 - DNA, 25 bp, Homo sapien
atgcctgcggtcccagaactttgag

SEQ ID NO: 600479 - DNA, 25 bp, Homo sapien
tgcctgcggtcccagaactttgaga

SEQ ID NO: 600480 - DNA, 25 bp, Homo sapien
gcctgcggtcccagaactttgagag

SEQ ID NO: 600481 - DNA, 25 bp, Homo sapien
cctgcggtcccagaactttgagagg

SEQ ID NO: 600482 - DNA, 25 bp, Homo sapien
tgcggtcccagaactttgagaggct

SEQ ID NO: 600483 - DNA, 25 bp, Homo sapien
gcggtcccagaactttgagaggctg

SEQ ID NO: 600484 - DNA, 25 bp, Homo sapien
cgtggtgaacccccgtctctgctga

SEQ ID NO: 600485 - DNA, 25 bp, Homo sapien
tgaacccccgtctctgctgaagata

SEQ ID NO: 600486 - DNA, 25 bp, Homo sapien
tgcaggcctgtggtctcggctactt

SEQ ID NO: 600487 - DNA, 25 bp, Homo sapien
gcatcactgcattccagtctggtga

SEQ ID NO: 600488 - DNA, 25 bp, Homo sapien
cacactgccatacccggctaatatt

SEQ ID NO: 600489 - DNA, 25 bp, Homo sapien
gtaaaagggcaagctaagttttgtg

SEQ ID NO: 600490 - DNA, 25 bp, Homo sapien
gtgggcttcctagggtagcatgcac

SEQ ID NO: 600491 - DNA, 25 bp, Homo sapien
ggcttcctagggtagcatgcacaag

SEQ ID NO: 600492 - DNA, 25 bp, Homo sapien
ttcctagggtagcatgcacaagatc

SEQ ID NO: 600493 - DNA, 25 bp, Homo sapien
gggtagcatgcacaagatcagacaa

SEQ ID NO: 600494 - DNA, 25 bp, Homo sapien
tagcatgcacaagatcagacaagtt

SEQ ID NO: 600495 - DNA, 25 bp, Homo sapien
tcagacaagttgttatgggttgaat

SEQ ID NO: 600496 - DNA, 25 bp, Homo sapien
gaaatattgaagtcttaacatccat

SEQ ID NO: 600497 - DNA, 25 bp, Homo sapien
gaagtcttaacatccatatcttaga

SEQ ID NO: 600498 - DNA, 25 bp, Homo sapien
acatccatatcttagaatacaccct

SEQ ID NO: 600499 - DNA, 25 bp, Homo sapien
gggcaattgatgttatcggtcagac

SEQ ID NO: 600500 - DNA, 25 bp, Homo sapien
tatcggtcagactataactatcagc

SEQ ID NO: 600501 - DNA, 25 bp, Homo sapien
ggtcagactataactatcagccgag

SEQ ID NO: 600502 - DNA, 25 bp, Homo sapien
taactatcagccgagtagaaggcag

SEQ ID NO: 600503 - DNA, 25 bp, Homo sapien
caggcgacgggcaaatgagaacagc

SEQ ID NO: 600504 - DNA, 25 bp, Homo sapien
tgagaacagcaacatacaggtcctt

SEQ ID NO: 600505 - DNA, 25 bp, Homo sapien
acatacaggtcctttctgaaagatc

SEQ ID NO: 600506 - DNA, 25 bp, Homo sapien
tcctttctgaaagatctgctactga

SEQ ID NO: 600507 - DNA, 25 bp, Homo sapien
gatctgctactgaagtagacaacaa

SEQ ID NO: 600508 - DNA, 25 bp, Homo sapien
caacaattttagcaaaccacctccg

SEQ ID NO: 600509 - DNA, 25 bp, Homo sapien
tgtcagcactgctccacctctgatt

SEQ ID NO: 600510 - DNA, 25 bp, Homo sapien
gaaagtatggcattccagagcacga

SEQ ID NO: 600511 - DNA, 25 bp, Homo sapien
ggcattccagagcacgagactcttg

SEQ ID NO: 600512 - DNA, 25 bp, Homo sapien
gcacgagactcttgttttaaaatga

SEQ ID NO: 600513 - DNA, 25 bp, Homo sapien
tacaattttggcctaatgacctata

SEQ ID NO: 600514 - DNA, 25 bp, Homo sapien
aatgacctataggaaagccatccac

SEQ ID NO: 600515 - DNA, 25 bp, Homo sapien
ggaaagccatccacactgttgttgg

SEQ ID NO: 600516 - DNA, 25 bp, Homo sapien
tccacactgttgttggccgcccgat

SEQ ID NO: 600517 - DNA, 25 bp, Homo sapien
cgatccctgttcgtcagactctgaa

SEQ ID NO: 600518 - DNA, 25 bp, Homo sapien
tgttcgtcagactctgaacccgacc

SEQ ID NO: 600519 - DNA, 25 bp, Homo sapien
tgaacccgacccaggagcagattga

SEQ ID NO: 600520 - DNA, 25 bp, Homo sapien
ggagttacatcagacctatatggag

SEQ ID NO: 600521 - DNA, 25 bp, Homo sapien
gttgagaagtgtgtcatacctcccc

SEQ ID NO: 600522 - DNA, 25 bp, Homo sapien
actctctgtcttttgttccggctct

SEQ ID NO: 600523 - DNA, 25 bp, Homo sapien
ttccggctctggcaatgtaacaagc

SEQ ID NO: 600524 - DNA, 25 bp, Homo sapien
tttctgagggctgaccagaagccca

SEQ ID NO: 600525 - DNA, 25 bp, Homo sapien
gtgagccagctaaacctctcctcat

SEQ ID NO: 600526 - DNA, 25 bp, Homo sapien
taaacctctcctcataaatcaccga

SEQ ID NO: 600527 - DNA, 25 bp, Homo sapien
tcataaatcaccgagccccaggttt

SEQ ID NO: 600528 - DNA, 25 bp, Homo sapien
agccccaggtttatctttacagcaa

SEQ ID NO: 600529 - DNA, 25 bp, Homo sapien
tttacagcaatgcaagacctgacta

SEQ ID NO: 600530 - DNA, 25 bp, Homo sapien
gacctgactaatacagcaccagctc

SEQ ID NO: 600531 - DNA, 25 bp, Homo sapien
gcaccagctccccaaaataaaaaga

SEQ ID NO: 600532 - DNA, 25 bp, Homo sapien
agcagagacaaaaccctggcctcct

SEQ ID NO: 600533 - DNA, 25 bp, Homo sapien
tccttcaggctgaggcccagagcca

SEQ ID NO: 600534 - DNA, 25 bp, Homo sapien
gctgaggcccagagccagtctcctg

SEQ ID NO: 600535 - DNA, 25 bp, Homo sapien
tctcctggtgggtaaggtggccaca

SEQ ID NO: 600536 - DNA, 25 bp, Homo sapien
cagctggcagcagggtattggcact

SEQ ID NO: 600537 - DNA, 25 bp, Homo sapien
gcctctccaacagaggtggtgccgg

SEQ ID NO: 600538 - DNA, 25 bp, Homo sapien
gcagtgcctggagaccgcttaggtt

SEQ ID NO: 600539 - DNA, 25 bp, Homo sapien
cctggagaccgcttaggttgtcaca

SEQ ID NO: 600540 - DNA, 25 bp, Homo sapien
gagaccgcttaggttgtcacaactg

SEQ ID NO: 600541 - DNA, 25 bp, Homo sapien
gtcacaactgggatttgtgtactag

SEQ ID NO: 600542 - DNA, 25 bp, Homo sapien
tgtgtactagttttctgtagctgcc

SEQ ID NO: 600543 - DNA, 25 bp, Homo sapien
agtgacattccaaataaggtatttt

SEQ ID NO: 600544 - DNA, 25 bp, Homo sapien
ggtatttttctctctgtcttgtaag

SEQ ID NO: 600545 - DNA, 25 bp, Homo sapien
tctctgtcttgtaaggtctacctga

SEQ ID NO: 600546 - DNA, 25 bp, Homo sapien
aaaaggtaatgacctgtcttctcct

SEQ ID NO: 600547 - DNA, 25 bp, Homo sapien
agcctgtctcccactttatcagttc

SEQ ID NO: 600548 - DNA, 25 bp, Homo sapien
tttatcagttcccatagtcctcttg

SEQ ID NO: 600549 - DNA, 25 bp, Homo sapien
ttcccatagtcctcttggcacagta

SEQ ID NO: 600550 - DNA, 25 bp, Homo sapien
tagtcctcttggcacagtatggctg

SEQ ID NO: 600551 - DNA, 25 bp, Homo sapien
tcctcttggcacagtatggctgtgt

SEQ ID NO: 600552 - DNA, 25 bp, Homo sapien
tgtacacatgtgtatgcacgtaagg

SEQ ID NO: 600553 - DNA, 25 bp, Homo sapien
acatgtgtatgcacgtaagggccag

SEQ ID NO: 600554 - DNA, 25 bp, Homo sapien
ttagccaattcagaggtcttgttct

SEQ ID NO: 600555 - DNA, 25 bp, Homo sapien
aattcagaggtcttgttctccataa

SEQ ID NO: 600556 - DNA, 25 bp, Homo sapien
aaaactgaaactcatcttccctgct

SEQ ID NO: 600557 - DNA, 25 bp, Homo sapien
tgaaactcatcttccctgctggaaa

SEQ ID NO: 600558 - DNA, 25 bp, Homo sapien
aactcatcttccctgctggaaacga

SEQ ID NO: 600559 - DNA, 25 bp, Homo sapien
atcttccctgctggaaacgagctca

SEQ ID NO: 600560 - DNA, 25 bp, Homo sapien
tccctgctggaaacgagctcaaact

SEQ ID NO: 600561 - DNA, 25 bp, Homo sapien
ggaaacgagctcaaactccagaaag

SEQ ID NO: 600562 - DNA, 25 bp, Homo sapien
aacgagctcaaactccagaaaggag

SEQ ID NO: 600563 - DNA, 25 bp, Homo sapien
tcatggacgcaggaaaatttgcctt

SEQ ID NO: 600564 - DNA, 25 bp, Homo sapien
gcaggaaaatttgccttccttgttg

SEQ ID NO: 600565 - DNA, 25 bp, Homo sapien
agggtggacattgcccatctctgcc

SEQ ID NO: 600566 - DNA, 25 bp, Homo sapien
gggctgctgacccactggttccaga

SEQ ID NO: 600567 - DNA, 25 bp, Homo sapien
tgacccactggttccagagtctgag

SEQ ID NO: 600568 - DNA, 25 bp, Homo sapien
ccactggttccagagtctgagcctg

SEQ ID NO: 600569 - DNA, 25 bp, Homo sapien
tgagcctgtcctgcacaagtaccat

SEQ ID NO: 600570 - DNA, 25 bp, Homo sapien
gtcctgcacaagtaccatggacagg

SEQ ID NO: 600571 - DNA, 25 bp, Homo sapien
ggtcagccgggcactgaagaggcgt

SEQ ID NO: 600572 - DNA, 25 bp, Homo sapien
ctggcaagctggagtcagggcaatt

SEQ ID NO: 600573 - DNA, 25 bp, Homo sapien
gagtcagggcaattccaaccaagaa

SEQ ID NO: 600574 - DNA, 25 bp, Homo sapien
aaccaagaaactgcggcaggccggg

SEQ ID NO: 600575 - DNA, 25 bp, Homo sapien
gaccagcattggtaacatagagacc

SEQ ID NO: 600576 - DNA, 25 bp, Homo sapien
atgtgactgcgcctctcctcatggg

SEQ ID NO: 600577 - DNA, 25 bp, Homo sapien
ctcatgggcatccaccaaaggtgtt

SEQ ID NO: 600578 - DNA, 25 bp, Homo sapien
gggcatccaccaaaggtgtttgctt

SEQ ID NO: 600579 - DNA, 25 bp, Homo sapien
tgaaatgcctgatcacgccttttga

SEQ ID NO: 600580 - DNA, 25 bp, Homo sapien
gatcacgccttttgactttatgttg

SEQ ID NO: 600581 - DNA, 25 bp, Homo sapien
tatgttgggttatttgtactctttt

SEQ ID NO: 600582 - DNA, 25 bp, Homo sapien
gtactctttttattcatttgtcaaa

SEQ ID NO: 600583 - DNA, 25 bp, Homo sapien
gttctgcaggtatcttcctccagcc

SEQ ID NO: 600584 - DNA, 25 bp, Homo sapien
cctgttcttggtggtacttcctaat

SEQ ID NO: 600585 - DNA, 25 bp, Homo sapien
ggtacttcctaatagaggttcataa

SEQ ID NO: 600586 - DNA, 25 bp, Homo sapien
tagtggttaacaagttgggagcctt

SEQ ID NO: 600587 - DNA, 25 bp, Homo sapien
caggagggacggagcaggatcacac

SEQ ID NO: 600588 - DNA, 25 bp, Homo sapien
aggagggacggagcaggatcacact

SEQ ID NO: 600589 - DNA, 25 bp, Homo sapien
tcacactggatgctctctgtgggcc

SEQ ID NO: 600590 - DNA, 25 bp, Homo sapien
cacactggatgctctctgtgggccc

SEQ ID NO: 600591 - DNA, 25 bp, Homo sapien
acactggatgctctctgtgggccca

SEQ ID NO: 600592 - DNA, 25 bp, Homo sapien
cactggatgctctctgtgggcccag

SEQ ID NO: 600593 - DNA, 25 bp, Homo sapien
actggatgctctctgtgggcccagt

SEQ ID NO: 600594 - DNA, 25 bp, Homo sapien
ctggatgctctctgtgggcccagtg

SEQ ID NO: 600595 - DNA, 25 bp, Homo sapien
agtgaaattcacaatggcataccct

SEQ ID NO: 600596 - DNA, 25 bp, Homo sapien
aatggcataccctagtgcgggtctg

SEQ ID NO: 600597 - DNA, 25 bp, Homo sapien
gtttttatatattgtgctgggcact

SEQ ID NO: 600598 - DNA, 25 bp, Homo sapien
ctgggcactggaaagccatggcttt

SEQ ID NO: 600599 - DNA, 25 bp, Homo sapien
aagccatggctttcagtttcattgg

SEQ ID NO: 600600 - DNA, 25 bp, Homo sapien
gctttcagtttcattggtgatttcc

SEQ ID NO: 600601 - DNA, 25 bp, Homo sapien
ttctgttctctttatggcatgctta

SEQ ID NO: 600602 - DNA, 25 bp, Homo sapien
attcagatctgaggccttttgttct

SEQ ID NO: 600603 - DNA, 25 bp, Homo sapien
gaggccttttgttctggtcttttct

SEQ ID NO: 600604 - DNA, 25 bp, Homo sapien
ctttcctactttctgcagtgagtca

SEQ ID NO: 600605 - DNA, 25 bp, Homo sapien
ctagttcaggtattccttgtagtga

SEQ ID NO: 600606 - DNA, 25 bp, Homo sapien
atccttgcgttggtctgcggcgttt

SEQ ID NO: 600607 - DNA, 25 bp, Homo sapien
tgtgggctactctaatgacttctct

SEQ ID NO: 600608 - DNA, 25 bp, Homo sapien
tttcctcctcgaacaacttctggag

SEQ ID NO: 600609 - DNA, 25 bp, Homo sapien
cttctggagaagtcgcaccgttgca

SEQ ID NO: 600610 - DNA, 25 bp, Homo sapien
accgttgcagagtggtgccgctaca

SEQ ID NO: 600611 - DNA, 25 bp, Homo sapien
gtgccgctacacattgatcatctaa

SEQ ID NO: 600612 - DNA, 25 bp, Homo sapien
cattgatcatctaaccttacctggg

SEQ ID NO: 600613 - DNA, 25 bp, Homo sapien
ttacctgggtcctcagctatagggc

SEQ ID NO: 600614 - DNA, 25 bp, Homo sapien
agctatagggccgtctgtctcgagt

SEQ ID NO: 600615 - DNA, 25 bp, Homo sapien
tgtctcgagtcagctgtcacttaaa

SEQ ID NO: 600616 - DNA, 25 bp, Homo sapien
cattttctctggtttgacttgctga

SEQ ID NO: 600617 - DNA, 25 bp, Homo sapien
ataaaggggcattctggcccttcaa

SEQ ID NO: 600618 - DNA, 25 bp, Homo sapien
ctggcccttcaaaacaatgatcttc

SEQ ID NO: 600619 - DNA, 25 bp, Homo sapien
tggcccttcaaaacaatgatcttca

SEQ ID NO: 600620 - DNA, 25 bp, Homo sapien
ggcccttcaaaacaatgatcttcaa

SEQ ID NO: 600621 - DNA, 25 bp, Homo sapien
gcccttcaaaacaatgatcttcaac

SEQ ID NO: 600622 - DNA, 25 bp, Homo sapien
ttcaaaacaatgatcttcaacagta

SEQ ID NO: 600623 - DNA, 25 bp, Homo sapien
caatgatcttcaacagtaaatgcaa

SEQ ID NO: 600624 - DNA, 25 bp, Homo sapien
gatcttcaacagtaaatgcaagcac

SEQ ID NO: 600625 - DNA, 25 bp, Homo sapien
cttcaacagtaaatgcaagcacaag

SEQ ID NO: 600626 - DNA, 25 bp, Homo sapien
gtaaatgcaagcacaagaaggctcc

SEQ ID NO: 600627 - DNA, 25 bp, Homo sapien
aaatgcaagcacaagaaggctccag

SEQ ID NO: 600628 - DNA, 25 bp, Homo sapien
gatgagtaagtcctagcaatctatt

SEQ ID NO: 600629 - DNA, 25 bp, Homo sapien
gcaatctattgtgtagcgtggacat

SEQ ID NO: 600630 - DNA, 25 bp, Homo sapien
gtagcgtggacatatcattagcaac

SEQ ID NO: 600631 - DNA, 25 bp, Homo sapien
ggacatatcattagcaacactgtat

SEQ ID NO: 600632 - DNA, 25 bp, Homo sapien
aggatagatcttgtgtttgtatcac

SEQ ID NO: 600633 - DNA, 25 bp, Homo sapien
ggtgatggatatgcttacggcataa

SEQ ID NO: 600634 - DNA, 25 bp, Homo sapien
ggcataaattatggtgaggtttcac

SEQ ID NO: 600635 - DNA, 25 bp, Homo sapien
tcacaggtgagtacttatctccaaa

SEQ ID NO: 600636 - DNA, 25 bp, Homo sapien
ccaaactcatcaagttgtagacata

SEQ ID NO: 600637 - DNA, 25 bp, Homo sapien
tgtacagctttttctacgtcaatta

SEQ ID NO: 600638 - DNA, 25 bp, Homo sapien
gctttttctacgtcaattagacttc

SEQ ID NO: 600639 - DNA, 25 bp, Homo sapien
agcacgagggctggcatctctcctt

SEQ ID NO: 600640 - DNA, 25 bp, Homo sapien
tcccaacacgtgtagcagtcatcag

SEQ ID NO: 600641 - DNA, 25 bp, Homo sapien
gtagcagtcatcagccattccttaa

SEQ ID NO: 600642 - DNA, 25 bp, Homo sapien
gtcatcagccattccttaacaatga

SEQ ID NO: 600643 - DNA, 25 bp, Homo sapien
tccttaacaatgaatgtggtacctg

SEQ ID NO: 600644 - DNA, 25 bp, Homo sapien
tgtggtacctggttagtgccagcct

SEQ ID NO: 600645 - DNA, 25 bp, Homo sapien
tacctggttagtgccagccttggga

SEQ ID NO: 600646 - DNA, 25 bp, Homo sapien
aggaagagtgttgcctttgctgtgg

SEQ ID NO: 600647 - DNA, 25 bp, Homo sapien
ggaatcgatccttggctatggccta

SEQ ID NO: 600648 - DNA, 25 bp, Homo sapien
ccctggctgaagagtgccaatcatt

SEQ ID NO: 600649 - DNA, 25 bp, Homo sapien
gtgccaatcattacaaatcagcttc

SEQ ID NO: 600650 - DNA, 25 bp, Homo sapien
aaaagtgttcttgtataccatgttt

SEQ ID NO: 600651 - DNA, 25 bp, Homo sapien
aaagtgttcttgtataccatgtttg

SEQ ID NO: 600652 - DNA, 25 bp, Homo sapien
aagtgttcttgtataccatgtttga

SEQ ID NO: 600653 - DNA, 25 bp, Homo sapien
agtgttcttgtataccatgtttgaa

SEQ ID NO: 600654 - DNA, 25 bp, Homo sapien
gtgttcttgtataccatgtttgaaa

SEQ ID NO: 600655 - DNA, 25 bp, Homo sapien
tgttcttgtataccatgtttgaaaa

SEQ ID NO: 600656 - DNA, 25 bp, Homo sapien
gttcttgtataccatgtttgaaaag

SEQ ID NO: 600657 - DNA, 25 bp, Homo sapien
tcttgtataccatgtttgaaaagca

SEQ ID NO: 600658 - DNA, 25 bp, Homo sapien
atgtttgaaaagcatagttgataaa

SEQ ID NO: 600659 - DNA, 25 bp, Homo sapien
ttgataaaggaagaacatgtaaggc

SEQ ID NO: 600660 - DNA, 25 bp, Homo sapien
taaaggaagaacatgtaaggcaaaa

SEQ ID NO: 600661 - DNA, 25 bp, Homo sapien
ctgtttcagtctccgtcttagttaa

SEQ ID NO: 600662 - DNA, 25 bp, Homo sapien
ttcagtctccgtcttagttaaataa

SEQ ID NO: 600663 - DNA, 25 bp, Homo sapien
gtgcctcagtgactgtaattgcatt

SEQ ID NO: 600664 - DNA, 25 bp, Homo sapien
cagtgactgtaattgcattgcatgg

SEQ ID NO: 600665 - DNA, 25 bp, Homo sapien
aaagttctaattgggcagtgccaca

SEQ ID NO: 600666 - DNA, 25 bp, Homo sapien
aaggaccgaatgatccactttttct

SEQ ID NO: 600667 - DNA, 25 bp, Homo sapien
tagtgagggcctgtgttcagcagca

SEQ ID NO: 600668 - DNA, 25 bp, Homo sapien
gagggcctgtgttcagcagcacagt

SEQ ID NO: 600669 - DNA, 25 bp, Homo sapien
gtgttcagcagcacagtagccagga

SEQ ID NO: 600670 - DNA, 25 bp, Homo sapien
agcagcacagtagccaggagccacg

SEQ ID NO: 600671 - DNA, 25 bp, Homo sapien
agccacgtgtggctgtttcagtctc

SEQ ID NO: 600672 - DNA, 25 bp, Homo sapien
tgctgcgggaaaggcaagactcact

SEQ ID NO: 600673 - DNA, 25 bp, Homo sapien
gggaaaggcaagactcactcccttg

SEQ ID NO: 600674 - DNA, 25 bp, Homo sapien
gaaaggcaagactcactcccttgca

SEQ ID NO: 600675 - DNA, 25 bp, Homo sapien
aaggcaagactcactcccttgcagg

SEQ ID NO: 600676 - DNA, 25 bp, Homo sapien
gcaagactcactcccttgcaggaaa

SEQ ID NO: 600677 - DNA, 25 bp, Homo sapien
aagactcactcccttgcaggaaaca

SEQ ID NO: 600678 - DNA, 25 bp, Homo sapien
gactcactcccttgcaggaaacaaa

SEQ ID NO: 600679 - DNA, 25 bp, Homo sapien
ctcactcccttgcaggaaacaaaga

SEQ ID NO: 600680 - DNA, 25 bp, Homo sapien
tcccttgcaggaaacaaagacccct

SEQ ID NO: 600681 - DNA, 25 bp, Homo sapien
tgcaggaaacaaagaccccttagga

SEQ ID NO: 600682 - DNA, 25 bp, Homo sapien
aagaccccttaggagagagaaatgt

SEQ ID NO: 600683 - DNA, 25 bp, Homo sapien
ttgttaccatctgagcaaaatggag

SEQ ID NO: 600684 - DNA, 25 bp, Homo sapien
gtgtttaatttatgtggccacagtt

SEQ ID NO: 600685 - DNA, 25 bp, Homo sapien
atgtggccacagttattacatggaa

SEQ ID NO: 600686 - DNA, 25 bp, Homo sapien
cacagttattacatggaagacacat

SEQ ID NO: 600687 - DNA, 25 bp, Homo sapien
tggaagacacatattttaattttgg

SEQ ID NO: 600688 - DNA, 25 bp, Homo sapien
ggccataaaatatactcaacatcat

SEQ ID NO: 600689 - DNA, 25 bp, Homo sapien
caacatcataaggaagcacctggag

SEQ ID NO: 600690 - DNA, 25 bp, Homo sapien
taaggaagcacctggagagctgtgt

SEQ ID NO: 600691 - DNA, 25 bp, Homo sapien
cttccctgttccttgtgataactta

SEQ ID NO: 600692 - DNA, 25 bp, Homo sapien
ccctgttccttgtgataacttacat

SEQ ID NO: 600693 - DNA, 25 bp, Homo sapien
tccttgtgataacttacatacttgg

SEQ ID NO: 600694 - DNA, 25 bp, Homo sapien
gctgagcttttattcatcccagctt

SEQ ID NO: 600695 - DNA, 25 bp, Homo sapien
ttattcatcccagctttgctactga

SEQ ID NO: 600696 - DNA, 25 bp, Homo sapien
tcccagctttgctactgacaagtta

SEQ ID NO: 600697 - DNA, 25 bp, Homo sapien
tgctactgacaagttaggtggtctt

SEQ ID NO: 600698 - DNA, 25 bp, Homo sapien
tgggccttcctgtgtaaaacgcatg

SEQ ID NO: 600699 - DNA, 25 bp, Homo sapien
ttcctgtgtaaaacgcatgctccca

SEQ ID NO: 600700 - DNA, 25 bp, Homo sapien
aaaacgcatgctcccatctcaaggt

SEQ ID NO: 600701 - DNA, 25 bp, Homo sapien
ctcaaggtccttttctactttacag

SEQ ID NO: 600702 - DNA, 25 bp, Homo sapien
tctactttacagattctcttgcttt

SEQ ID NO: 600703 - DNA, 25 bp, Homo sapien
gattctcttgcttttagaatgctaa

SEQ ID NO: 600704 - DNA, 25 bp, Homo sapien
atgctaatttcattgactgtggcct

SEQ ID NO: 600705 - DNA, 25 bp, Homo sapien
ggatctggaaacagtttaggccaat

SEQ ID NO: 600706 - DNA, 25 bp, Homo sapien
aggccaattgggattctcattcgcc

SEQ ID NO: 600707 - DNA, 25 bp, Homo sapien
ttgggattctcattcgcctgggaaa

SEQ ID NO: 600708 - DNA, 25 bp, Homo sapien
ttcgcctgggaaagaacttgattct

SEQ ID NO: 600709 - DNA, 25 bp, Homo sapien
gaacttgattctcaaatagtgaagc

SEQ ID NO: 600710 - DNA, 25 bp, Homo sapien
tagtgaagcaacacagctgagaggt

SEQ ID NO: 600711 - DNA, 25 bp, Homo sapien
gctgagaggtagtgagatccctgca

SEQ ID NO: 600712 - DNA, 25 bp, Homo sapien
gagatccctgcagggactccctgga

SEQ ID NO: 600713 - DNA, 25 bp, Homo sapien
ggctgaatggaggtcccgttcgacc

SEQ ID NO: 600714 - DNA, 25 bp, Homo sapien
aggtcccgttcgacccttgatgctg

SEQ ID NO: 600715 - DNA, 25 bp, Homo sapien
gaggatctcagtatatttgtttcgt

SEQ ID NO: 600716 - DNA, 25 bp, Homo sapien
actgcacccggctcaccactagttt

SEQ ID NO: 600717 - DNA, 25 bp, Homo sapien
aggagaggcggatacagaaacttgt

SEQ ID NO: 600718 - DNA, 25 bp, Homo sapien
agaggcggatacagaaacttgtgag

SEQ ID NO: 600719 - DNA, 25 bp, Homo sapien
gaggcggatacagaaacttgtgaga

SEQ ID NO: 600720 - DNA, 25 bp, Homo sapien
aggcggatacagaaacttgtgagaa

SEQ ID NO: 600721 - DNA, 25 bp, Homo sapien
ggcggatacagaaacttgtgagaat

SEQ ID NO: 600722 - DNA, 25 bp, Homo sapien
gcggatacagaaacttgtgagaatg

SEQ ID NO: 600723 - DNA, 25 bp, Homo sapien
cggatacagaaacttgtgagaatgt

SEQ ID NO: 600724 - DNA, 25 bp, Homo sapien
gatacagaaacttgtgagaatgtga

SEQ ID NO: 600725 - DNA, 25 bp, Homo sapien
tacagaaacttgtgagaatgtgatg

SEQ ID NO: 600726 - DNA, 25 bp, Homo sapien
tgaaccccctataaaaaatgtgcat

SEQ ID NO: 600727 - DNA, 25 bp, Homo sapien
gaactgagagaaccagcaatatctg

SEQ ID NO: 600728 - DNA, 25 bp, Homo sapien
gaatattattttggcatggtcttgt

SEQ ID NO: 600729 - DNA, 25 bp, Homo sapien
ggcatggtcttgttatcaatacata

SEQ ID NO: 600730 - DNA, 25 bp, Homo sapien
actattatcattacgtcttttgcaa

SEQ ID NO: 600731 - DNA, 25 bp, Homo sapien
acttagctctagatttttcattgac

SEQ ID NO: 600732 - DNA, 25 bp, Homo sapien
cattgacatctggttatttgagagc

SEQ ID NO: 600733 - DNA, 25 bp, Homo sapien
atttgagagctaatcacttcattta

SEQ ID NO: 600734 - DNA, 25 bp, Homo sapien
gtaaatctctctattgctatttttc

SEQ ID NO: 600735 - DNA, 25 bp, Homo sapien
ttttctcttttgatggcttttagcc

SEQ ID NO: 600736 - DNA, 25 bp, Homo sapien
cattttattgtctctgggcctgtag

SEQ ID NO: 600737 - DNA, 25 bp, Homo sapien
tctctgggcctgtagacctatggaa

SEQ ID NO: 600738 - DNA, 25 bp, Homo sapien
taaggaagggcccatcctcactgca

SEQ ID NO: 600739 - DNA, 25 bp, Homo sapien
gtcctccccagtgattcctggagta

SEQ ID NO: 600740 - DNA, 25 bp, Homo sapien
agtgattcctggagtagtgctgagt

SEQ ID NO: 600741 - DNA, 25 bp, Homo sapien
agtgctgagtctacttctgctgaca

SEQ ID NO: 600742 - DNA, 25 bp, Homo sapien
gagtccaaagtttgggatctcccat

SEQ ID NO: 600743 - DNA, 25 bp, Homo sapien
agtttgggatctcccatcaacatcc

SEQ ID NO: 600744 - DNA, 25 bp, Homo sapien
catcaacatcccacgtgtcaatgtg

SEQ ID NO: 600745 - DNA, 25 bp, Homo sapien
aacgagtgattctgtgtcttctcct

SEQ ID NO: 600746 - DNA, 25 bp, Homo sapien
tcctcagcctggagcatctgataca

SEQ ID NO: 600747 - DNA, 25 bp, Homo sapien
gagcatctgatacagcagttcctga

SEQ ID NO: 600748 - DNA, 25 bp, Homo sapien
gatggatggaatacccatgtcaatg

SEQ ID NO: 600749 - DNA, 25 bp, Homo sapien
tgacttcccgtcaagtcggctggta

SEQ ID NO: 600750 - DNA, 25 bp, Homo sapien
cttcccgtcaagtcggctggtagga

SEQ ID NO: 600751 - DNA, 25 bp, Homo sapien
ggcccccggaacacgcagatcagag

SEQ ID NO: 600752 - DNA, 25 bp, Homo sapien
ttttgtcccacagtaaaaacagcaa

SEQ ID NO: 600753 - DNA, 25 bp, Homo sapien
taaaaacagcaaggcggtgtgatgg

SEQ ID NO: 600754 - DNA, 25 bp, Homo sapien
cattcacgtcaccacatggcattac

SEQ ID NO: 600755 - DNA, 25 bp, Homo sapien
atggcattacctactccaggtgcgg

SEQ ID NO: 600756 - DNA, 25 bp, Homo sapien
aggcagcaggaaaggcccttcccct

SEQ ID NO: 600757 - DNA, 25 bp, Homo sapien
ccttcccctagtgcggtgtgggcag

SEQ ID NO: 600758 - DNA, 25 bp, Homo sapien
cagtcttcagccaggttggaatcca

SEQ ID NO: 600759 - DNA, 25 bp, Homo sapien
agccaggttggaatccaccagaaat

SEQ ID NO: 600760 - DNA, 25 bp, Homo sapien
cttttcattcccctgcaaaggagga

SEQ ID NO: 600761 - DNA, 25 bp, Homo sapien
tcccctgcaaaggaggaaagtgtgt

SEQ ID NO: 600762 - DNA, 25 bp, Homo sapien
aaagtgtgtcctcatttggcctttc

SEQ ID NO: 600763 - DNA, 25 bp, Homo sapien
tcatttggcctttcttgcaggacta

SEQ ID NO: 600764 - DNA, 25 bp, Homo sapien
atttggcctttcttgcaggactatt

SEQ ID NO: 600765 - DNA, 25 bp, Homo sapien
ggcctttcttgcaggactatttgaa

SEQ ID NO: 600766 - DNA, 25 bp, Homo sapien
cttgcaggactatttgaaactcatt

SEQ ID NO: 600767 - DNA, 25 bp, Homo sapien
gaaactcatttatgcctctaatctt

SEQ ID NO: 600768 - DNA, 25 bp, Homo sapien
actcatttatgcctctaatctttag

SEQ ID NO: 600769 - DNA, 25 bp, Homo sapien
atgcctctaatctttaggaattctc

SEQ ID NO: 600770 - DNA, 25 bp, Homo sapien
taggaattctcagctttcatgtttt

SEQ ID NO: 600771 - DNA, 25 bp, Homo sapien
agacaggcggatcacctgagattgg

SEQ ID NO: 600772 - DNA, 25 bp, Homo sapien
acaggcggatcacctgagattggga

SEQ ID NO: 600773 - DNA, 25 bp, Homo sapien
cgatgagccgagatggcaccgctgc

SEQ ID NO: 600774 - DNA, 25 bp, Homo sapien
gatgagccgagatggcaccgctgca

SEQ ID NO: 600775 - DNA, 25 bp, Homo sapien
agccgagatggcaccgctgcactgc

SEQ ID NO: 600776 - DNA, 25 bp, Homo sapien
gccgagatggcaccgctgcactgca

SEQ ID NO: 600777 - DNA, 25 bp, Homo sapien
ccgagatggcaccgctgcactgcag

SEQ ID NO: 600778 - DNA, 25 bp, Homo sapien
cgagatggcaccgctgcactgcagc

SEQ ID NO: 600779 - DNA, 25 bp, Homo sapien
gagatggcaccgctgcactgcagcc

SEQ ID NO: 600780 - DNA, 25 bp, Homo sapien
agatggcaccgctgcactgcagcct

SEQ ID NO: 600781 - DNA, 25 bp, Homo sapien
gctccagccatgtagcacgtgcctg

SEQ ID NO: 600782 - DNA, 25 bp, Homo sapien
tgcgtcctgtacaacctgtggaacc

SEQ ID NO: 600783 - DNA, 25 bp, Homo sapien
gcgtcctgtacaacctgtggaacca

SEQ ID NO: 600784 - DNA, 25 bp, Homo sapien
cgtcctgtacaacctgtggaaccag

SEQ ID NO: 600785 - DNA, 25 bp, Homo sapien
gtcctgtacaacctgtggaaccagg

SEQ ID NO: 600786 - DNA, 25 bp, Homo sapien
ctgtacaacctgtggaaccaggagc

SEQ ID NO: 600787 - DNA, 25 bp, Homo sapien
gtacaacctgtggaaccaggagcca

SEQ ID NO: 600788 - DNA, 25 bp, Homo sapien
tacaacctgtggaaccaggagccaa

SEQ ID NO: 600789 - DNA, 25 bp, Homo sapien
acaacctgtggaaccaggagccaat

SEQ ID NO: 600790 - DNA, 25 bp, Homo sapien
caacctgtggaaccaggagccaatt

SEQ ID NO: 600791 - DNA, 25 bp, Homo sapien
acctgtggaaccaggagccaattaa

SEQ ID NO: 600792 - DNA, 25 bp, Homo sapien
aatatttccaaccagtgaatactgg

SEQ ID NO: 600793 - DNA, 25 bp, Homo sapien
atatacttctatcaacattttctaa

SEQ ID NO: 600794 - DNA, 25 bp, Homo sapien
tctaatttcgatttcagaagctggg

SEQ ID NO: 600795 - DNA, 25 bp, Homo sapien
ggcagtccagtcactcactttactt

SEQ ID NO: 600796 - DNA, 25 bp, Homo sapien
cactcactttacttatgtgtaagtt

SEQ ID NO: 600797 - DNA, 25 bp, Homo sapien
gtgtaagttcctatacttgcacaat

SEQ ID NO: 600798 - DNA, 25 bp, Homo sapien
tattcactgtaatacccacatcctg

SEQ ID NO: 600799 - DNA, 25 bp, Homo sapien
actgtaatacccacatcctgattta

SEQ ID NO: 600800 - DNA, 25 bp, Homo sapien
acccacatcctgatttatgattttt

SEQ ID NO: 600801 - DNA, 25 bp, Homo sapien
gatttttgcctcacgattttcagat

SEQ ID NO: 600802 - DNA, 25 bp, Homo sapien
gcctcacgattttcagattatattc

SEQ ID NO: 600803 - DNA, 25 bp, Homo sapien
tcgctgacacgttgcttctcttatc

SEQ ID NO: 600804 - DNA, 25 bp, Homo sapien
tgacacgttgcttctcttatcccac

SEQ ID NO: 600805 - DNA, 25 bp, Homo sapien
gggcaaaggcactgccttgtctgaa

SEQ ID NO: 600806 - DNA, 25 bp, Homo sapien
aaggcactgccttgtctgaatgcgg

SEQ ID NO: 600807 - DNA, 25 bp, Homo sapien
ctgccttgtctgaatgcgggtctga

SEQ ID NO: 600808 - DNA, 25 bp, Homo sapien
tctgaatgcgggtctgaggcgcttt

SEQ ID NO: 600809 - DNA, 25 bp, Homo sapien
aatgcgggtctgaggcgctttctgc

SEQ ID NO: 600810 - DNA, 25 bp, Homo sapien
gtcctttcccttcaatggtgatgtg

SEQ ID NO: 600811 - DNA, 25 bp, Homo sapien
ctttcccttcaatggtgatgtgtgt

SEQ ID NO: 600812 - DNA, 25 bp, Homo sapien
ccttcaatggtgatgtgtgtggtct

SEQ ID NO: 600813 - DNA, 25 bp, Homo sapien
gatgtgtgtggtcttgctgagccag

SEQ ID NO: 600814 - DNA, 25 bp, Homo sapien
gtggcctgtgcctcactgcaggtac

SEQ ID NO: 600815 - DNA, 25 bp, Homo sapien
gcagcactgatgacaggccggctgt

SEQ ID NO: 600816 - DNA, 25 bp, Homo sapien
atgacaggccggctgtgctgggcac

SEQ ID NO: 600817 - DNA, 25 bp, Homo sapien
tgctgggcaccgagaatgcaccggc

SEQ ID NO: 600818 - DNA, 25 bp, Homo sapien
tctcgcagggcccacagaccaggga

SEQ ID NO: 600819 - DNA, 25 bp, Homo sapien
atgaagtgagcaaggcaccgtgcat

SEQ ID NO: 600820 - DNA, 25 bp, Homo sapien
aaggcaccgtgcatgtattctacca

SEQ ID NO: 600821 - DNA, 25 bp, Homo sapien
caccgtgcatgtattctaccagtgt

SEQ ID NO: 600822 - DNA, 25 bp, Homo sapien
cagagcccatgctctgagccaggca

SEQ ID NO: 600823 - DNA, 25 bp, Homo sapien
tctgagccaggcactagtctagtaa

SEQ ID NO: 600824 - DNA, 25 bp, Homo sapien
aataaacatcgctaacgtgtttcag

SEQ ID NO: 600825 - DNA, 25 bp, Homo sapien
tatgcagaaaaagacgctgttcctt

SEQ ID NO: 600826 - DNA, 25 bp, Homo sapien
agacgctgttccttaagtgtggccc

SEQ ID NO: 600827 - DNA, 25 bp, Homo sapien
aagaaaggacagcagtcacctccga

SEQ ID NO: 600828 - DNA, 25 bp, Homo sapien
aggacagcagtcacctccgacaatg

SEQ ID NO: 600829 - DNA, 25 bp, Homo sapien
tccgacaatgctccgttctatggaa

SEQ ID NO: 600830 - DNA, 25 bp, Homo sapien
attgattaactgcattttggctgga

SEQ ID NO: 600831 - DNA, 25 bp, Homo sapien
ggagacacccaagtgaagcaatctt

SEQ ID NO: 600832 - DNA, 25 bp, Homo sapien
aatatttaaaggcagatgtacgctt

SEQ ID NO: 600833 - DNA, 25 bp, Homo sapien
tgtacgctttaaattggtctccatt

SEQ ID NO: 600834 - DNA, 25 bp, Homo sapien
ggtctccatttcttcttagaatgtt

SEQ ID NO: 600835 - DNA, 25 bp, Homo sapien
ggataagcataactaaacttgtcaa

SEQ ID NO: 600836 - DNA, 25 bp, Homo sapien
acccagtctctaacatatacatata

SEQ ID NO: 600837 - DNA, 25 bp, Homo sapien
ccagtctctaacatatacatataca

SEQ ID NO: 600838 - DNA, 25 bp, Homo sapien
atagaagggttattgtgtgttatat

SEQ ID NO: 600839 - DNA, 25 bp, Homo sapien
gtgtgttatattactttccagggac

SEQ ID NO: 600840 - DNA, 25 bp, Homo sapien
gtgttatattactttccagggacat

SEQ ID NO: 600841 - DNA, 25 bp, Homo sapien
gttatattactttccagggacattc

SEQ ID NO: 600842 - DNA, 25 bp, Homo sapien
tatattactttccagggacattcaa

SEQ ID NO: 600843 - DNA, 25 bp, Homo sapien
ctttccagggacattcaaatgtttt

SEQ ID NO: 600844 - DNA, 25 bp, Homo sapien
ccagggacattcaaatgttttacat

SEQ ID NO: 600845 - DNA, 25 bp, Homo sapien
atgttttacattactttaagaatct

SEQ ID NO: 600846 - DNA, 25 bp, Homo sapien
gaatctttacttgatataagaacaa

SEQ ID NO: 600847 - DNA, 25 bp, Homo sapien
gggcgtccgcactgcctcgggagtc

SEQ ID NO: 600848 - DNA, 25 bp, Homo sapien
gagcgccgccactggctgaactcgt

SEQ ID NO: 600849 - DNA, 25 bp, Homo sapien
gccactggctgaactcgtacatgca

SEQ ID NO: 600850 - DNA, 25 bp, Homo sapien
ctggctgaactcgtacatgcacaag

SEQ ID NO: 600851 - DNA, 25 bp, Homo sapien
tgaactcgtacatgcacaagctgct

SEQ ID NO: 600852 - DNA, 25 bp, Homo sapien
acaagctgctggtgttggatgcgcc

SEQ ID NO: 600853 - DNA, 25 bp, Homo sapien
aagctgctggtgttggatgcgccct

SEQ ID NO: 600854 - DNA, 25 bp, Homo sapien
ttggatgcgccctgagcgcgctgcc

SEQ ID NO: 600855 - DNA, 25 bp, Homo sapien
tgcccgtccccatcttaataaagac

SEQ ID NO: 600856 - DNA, 25 bp, Homo sapien
tcttaataaagaccatgccctgcgc

SEQ ID NO: 600857 - DNA, 25 bp, Homo sapien
ttaataaagaccatgccctgcgctc

SEQ ID NO: 600858 - DNA, 25 bp, Homo sapien
tggaaaaaatccttctagacattgg

SEQ ID NO: 600859 - DNA, 25 bp, Homo sapien
cattggcttaggcaaggatttcatg

SEQ ID NO: 600860 - DNA, 25 bp, Homo sapien
ggatttcatgagcaagaacccaaaa

SEQ ID NO: 600861 - DNA, 25 bp, Homo sapien
gaggagagaacacttgcttctcatt

SEQ ID NO: 600862 - DNA, 25 bp, Homo sapien
ctcattttatgaggctaatcttatc

SEQ ID NO: 600863 - DNA, 25 bp, Homo sapien
taccaaaatcaaagacatcacaagg

SEQ ID NO: 600864 - DNA, 25 bp, Homo sapien
gacatcacaaggaaagagggctaca

SEQ ID NO: 600865 - DNA, 25 bp, Homo sapien
aggaaagagggctacagaccaaaat

SEQ ID NO: 600866 - DNA, 25 bp, Homo sapien
tacagaccaaaatcccttatggata

SEQ ID NO: 600867 - DNA, 25 bp, Homo sapien
atcccttatggatatagatgcaaaa

SEQ ID NO: 600868 - DNA, 25 bp, Homo sapien
gatgcaaaaattctcaataaagtat

SEQ ID NO: 600869 - DNA, 25 bp, Homo sapien
ccaaactggaaacccaagtgtccat

SEQ ID NO: 600870 - DNA, 25 bp, Homo sapien
caagtgtccatctccatcggaacag

SEQ ID NO: 600871 - DNA, 25 bp, Homo sapien
aagtgtccatctccatcggaacaga

SEQ ID NO: 600872 - DNA, 25 bp, Homo sapien
agtgtccatctccatcggaacagaa

SEQ ID NO: 600873 - DNA, 25 bp, Homo sapien
gtgtccatctccatcggaacagaaa

SEQ ID NO: 600874 - DNA, 25 bp, Homo sapien
tgtccatctccatcggaacagaaaa

SEQ ID NO: 600875 - DNA, 25 bp, Homo sapien
gtccatctccatcggaacagaaaac

SEQ ID NO: 600876 - DNA, 25 bp, Homo sapien
atctccatcggaacagaaaactata

SEQ ID NO: 600877 - DNA, 25 bp, Homo sapien
tccatcggaacagaaaactatactt

SEQ ID NO: 600878 - DNA, 25 bp, Homo sapien
gaaaactatactttggtctgcttct

SEQ ID NO: 600879 - DNA, 25 bp, Homo sapien
aaaactatactttggtctgcttcta

SEQ ID NO: 600880 - DNA, 25 bp, Homo sapien
gcatcagaatcaccttggacacttt

SEQ ID NO: 600881 - DNA, 25 bp, Homo sapien
catcagaatcaccttggacactttt

SEQ ID NO: 600882 - DNA, 25 bp, Homo sapien
atcagaatcaccttggacacttttt

SEQ ID NO: 600883 - DNA, 25 bp, Homo sapien
tcagaatcaccttggacacttttta

SEQ ID NO: 600884 - DNA, 25 bp, Homo sapien
cagaatcaccttggacactttttaa

SEQ ID NO: 600885 - DNA, 25 bp, Homo sapien
agccaggcttggtagtgggctcctg

SEQ ID NO: 600886 - DNA, 25 bp, Homo sapien
ccaggcttggtagtgggctcctgta

SEQ ID NO: 600887 - DNA, 25 bp, Homo sapien
caggcttggtagtgggctcctgtag

SEQ ID NO: 600888 - DNA, 25 bp, Homo sapien
aggcttggtagtgggctcctgtagt

SEQ ID NO: 600889 - DNA, 25 bp, Homo sapien
tcttccttgtttaagactttaacag

SEQ ID NO: 600890 - DNA, 25 bp, Homo sapien
tttaagactttaacagtatcagccg

SEQ ID NO: 600891 - DNA, 25 bp, Homo sapien
ttaagactttaacagtatcagccgg

SEQ ID NO: 600892 - DNA, 25 bp, Homo sapien
taagactttaacagtatcagccggg

SEQ ID NO: 600893 - DNA, 25 bp, Homo sapien
aagactttaacagtatcagccgggc

SEQ ID NO: 600894 - DNA, 25 bp, Homo sapien
agactttaacagtatcagccgggcg

SEQ ID NO: 600895 - DNA, 25 bp, Homo sapien
gactttaacagtatcagccgggcgt

SEQ ID NO: 600896 - DNA, 25 bp, Homo sapien
actttaacagtatcagccgggcgtg

SEQ ID NO: 600897 - DNA, 25 bp, Homo sapien
ctttaacagtatcagccgggcgtgg

SEQ ID NO: 600898 - DNA, 25 bp, Homo sapien
tttaacagtatcagccgggcgtggt

SEQ ID NO: 600899 - DNA, 25 bp, Homo sapien
ttaacagtatcagccgggcgtggtg

SEQ ID NO: 600900 - DNA, 25 bp, Homo sapien
actcacttccatcttgactgggtga

SEQ ID NO: 600901 - DNA, 25 bp, Homo sapien
gactgggtgacaagtggtaatgaca

SEQ ID NO: 600902 - DNA, 25 bp, Homo sapien
cacagatttgtagcgtgaaagactg

SEQ ID NO: 600903 - DNA, 25 bp, Homo sapien
ctgaatacagtgtttggccaaaaat

SEQ ID NO: 600904 - DNA, 25 bp, Homo sapien
ggagtttctctataaatgacacttt

SEQ ID NO: 600905 - DNA, 25 bp, Homo sapien
ttatatcttctttattcgtcgttaa

SEQ ID NO: 600906 - DNA, 25 bp, Homo sapien
attaccctgaaatgtcgccttgcaa

SEQ ID NO: 600907 - DNA, 25 bp, Homo sapien
tgtcgccttgcaattatttcactga

SEQ ID NO: 600908 - DNA, 25 bp, Homo sapien
gaagatattccaatttccatactat

SEQ ID NO: 600909 - DNA, 25 bp, Homo sapien
caatttccatactatttcctccaat

SEQ ID NO: 600910 - DNA, 25 bp, Homo sapien
tatttcctccaatagacccttgttg

SEQ ID NO: 600911 - DNA, 25 bp, Homo sapien
cttcaagacgcagcacagaaggctc

SEQ ID NO: 600912 - DNA, 25 bp, Homo sapien
acagaaggctctcactgatgaaagt

SEQ ID NO: 600913 - DNA, 25 bp, Homo sapien
cagaaggctctcactgatgaaagtg

SEQ ID NO: 600914 - DNA, 25 bp, Homo sapien
agaaggctctcactgatgaaagtgc

SEQ ID NO: 600915 - DNA, 25 bp, Homo sapien
gaaggctctcactgatgaaagtgcc

SEQ ID NO: 600916 - DNA, 25 bp, Homo sapien
aaggctctcactgatgaaagtgcca

SEQ ID NO: 600917 - DNA, 25 bp, Homo sapien
aggctctcactgatgaaagtgccag

SEQ ID NO: 600918 - DNA, 25 bp, Homo sapien
ggctctcactgatgaaagtgccagg

SEQ ID NO: 600919 - DNA, 25 bp, Homo sapien
gctctcactgatgaaagtgccagga

SEQ ID NO: 600920 - DNA, 25 bp, Homo sapien
ctctcactgatgaaagtgccaggaa

SEQ ID NO: 600921 - DNA, 25 bp, Homo sapien
tctcactgatgaaagtgccaggaag

SEQ ID NO: 600922 - DNA, 25 bp, Homo sapien
gcaatgtgccctgcaacagaatctg

SEQ ID NO: 600923 - DNA, 25 bp, Homo sapien
gaagaagctacatcgatgatcactg

SEQ ID NO: 600924 - DNA, 25 bp, Homo sapien
atgatcactgggttgtacctctcaa

SEQ ID NO: 600925 - DNA, 25 bp, Homo sapien
tacctctcaagtactttctcagaag

SEQ ID NO: 600926 - DNA, 25 bp, Homo sapien
gaagccacatccatgttattgctga

SEQ ID NO: 600927 - DNA, 25 bp, Homo sapien
attgctgagagtacatgctttgcta

SEQ ID NO: 600928 - DNA, 25 bp, Homo sapien
tgctttgctataaaccctaactggg

SEQ ID NO: 600929 - DNA, 25 bp, Homo sapien
cctaactgggttgaatcctggctgt

SEQ ID NO: 600930 - DNA, 25 bp, Homo sapien
tggctgtgccacttagtagctaaga

SEQ ID NO: 600931 - DNA, 25 bp, Homo sapien
gaccaaatcactggcggagaccttt

SEQ ID NO: 600932 - DNA, 25 bp, Homo sapien
aaatagctaccgctctgagactttt

SEQ ID NO: 600933 - DNA, 25 bp, Homo sapien
tgtgggtgtgtgattattccagcac

SEQ ID NO: 600934 - DNA, 25 bp, Homo sapien
attgaaaagactgtcccttccctat

SEQ ID NO: 600935 - DNA, 25 bp, Homo sapien
tccctattgaattgccgtagcatct

SEQ ID NO: 600936 - DNA, 25 bp, Homo sapien
atttccggattctgagttctctttt

SEQ ID NO: 600937 - DNA, 25 bp, Homo sapien
gttctcttttgttctgtaggtgtat

SEQ ID NO: 600938 - DNA, 25 bp, Homo sapien
gtaggtgtatccttcatgctaatac

SEQ ID NO: 600939 - DNA, 25 bp, Homo sapien
catgctaatactgcactgtcttact

SEQ ID NO: 600940 - DNA, 25 bp, Homo sapien
gcactgtcttactgactgtagcttt

SEQ ID NO: 600941 - DNA, 25 bp, Homo sapien
tataagccctctaactttttcagga

SEQ ID NO: 600942 - DNA, 25 bp, Homo sapien
gaatgttttgactatgccgggtcct

SEQ ID NO: 600943 - DNA, 25 bp, Homo sapien
atgccgggtcctgtacagttccata

SEQ ID NO: 600944 - DNA, 25 bp, Homo sapien
atgagtgagccccagcacccgtgag

SEQ ID NO: 600945 - DNA, 25 bp, Homo sapien
acccgtgagctcaccagtgtaatat

SEQ ID NO: 600946 - DNA, 25 bp, Homo sapien
gtgattccagctacactatgtttaa

SEQ ID NO: 600947 - DNA, 25 bp, Homo sapien
ctatgtttaaatatgggcagagcta

SEQ ID NO: 600948 - DNA, 25 bp, Homo sapien
agccaggacagtgggatccttgcat

SEQ ID NO: 600949 - DNA, 25 bp, Homo sapien
atggtgctggtaggttctggtaatt

SEQ ID NO: 600950 - DNA, 25 bp, Homo sapien
gttctggtaatttcctcttcttgat

SEQ ID NO: 600951 - DNA, 25 bp, Homo sapien
taatttcctcttcttgatctgggtg

SEQ ID NO: 600952 - DNA, 25 bp, Homo sapien
tcttgatctgggtgtaaacattttg

SEQ ID NO: 600953 - DNA, 25 bp, Homo sapien
gagctgtacatttatgactggtaca

SEQ ID NO: 600954 - DNA, 25 bp, Homo sapien
atgactggtacatttatgactttgt

SEQ ID NO: 600955 - DNA, 25 bp, Homo sapien
ctttgggaggtaactgggcttagat

SEQ ID NO: 600956 - DNA, 25 bp, Homo sapien
agaaaaacacaccacaggttttcat

SEQ ID NO: 600957 - DNA, 25 bp, Homo sapien
aggttttcattcttcctctgccaca

SEQ ID NO: 600958 - DNA, 25 bp, Homo sapien
ctctgccacatgaggccacagtaag

SEQ ID NO: 600959 - DNA, 25 bp, Homo sapien
gaggccacagtaagaatgtgaccat

SEQ ID NO: 600960 - DNA, 25 bp, Homo sapien
aatgtgaccatctgctagccaggag

SEQ ID NO: 600961 - DNA, 25 bp, Homo sapien
tctgctagccaggaggaaagtcctc

SEQ ID NO: 600962 - DNA, 25 bp, Homo sapien
caggaggaaagtcctcactggaacc

SEQ ID NO: 600963 - DNA, 25 bp, Homo sapien
cgcccataataacactccagtctgg

SEQ ID NO: 600964 - DNA, 25 bp, Homo sapien
gaaggcctaactctcaatgtgatga

SEQ ID NO: 600965 - DNA, 25 bp, Homo sapien
actctcaatgtgatgattatgtgga

SEQ ID NO: 600966 - DNA, 25 bp, Homo sapien
gtttagatcccaaaccttagctcaa

SEQ ID NO: 600967 - DNA, 25 bp, Homo sapien
gggtaagactggttggaagctgact

SEQ ID NO: 600968 - DNA, 25 bp, Homo sapien
aagctgactgcagactttgtttccc

SEQ ID NO: 600969 - DNA, 25 bp, Homo sapien
actttgtttccccttagtatgtgct

SEQ ID NO: 600970 - DNA, 25 bp, Homo sapien
tttccccttagtatgtgctgtgttg

SEQ ID NO: 600971 - DNA, 25 bp, Homo sapien
ccccttagtatgtgctgtgttgtaa

SEQ ID NO: 600972 - DNA, 25 bp, Homo sapien
tgtgttgtaaatttttctcctccct

SEQ ID NO: 600973 - DNA, 25 bp, Homo sapien
ttgagttggctgctggttagcaaac

SEQ ID NO: 600974 - DNA, 25 bp, Homo sapien
tggctgctggttagcaaactccttt

SEQ ID NO: 600975 - DNA, 25 bp, Homo sapien
tagcaaactcctttttacccatata

SEQ ID NO: 600976 - DNA, 25 bp, Homo sapien
gcaaactcctttttacccatataag

SEQ ID NO: 600977 - DNA, 25 bp, Homo sapien
ggatgactctgattgtccttcagca

SEQ ID NO: 600978 - DNA, 25 bp, Homo sapien
ctctgattgtccttcagcagggatg

SEQ ID NO: 600979 - DNA, 25 bp, Homo sapien
cagggatgagtctgttttgctccga

SEQ ID NO: 600980 - DNA, 25 bp, Homo sapien
gttttgctccgatggaagcatctgt

SEQ ID NO: 600981 - DNA, 25 bp, Homo sapien
gaagcatctgtagtgtccatcagca

SEQ ID NO: 600982 - DNA, 25 bp, Homo sapien
cagcaggtgaatggccaaagtggta

SEQ ID NO: 600983 - DNA, 25 bp, Homo sapien
tatactgtagtcacattcagctata

SEQ ID NO: 600984 - DNA, 25 bp, Homo sapien
gaataaagtatcgatgcatgccaca

SEQ ID NO: 600985 - DNA, 25 bp, Homo sapien
gcatgccacaacatgggtgaaccta

SEQ ID NO: 600986 - DNA, 25 bp, Homo sapien
gggtgaacctagaaaatactgatct

SEQ ID NO: 600987 - DNA, 25 bp, Homo sapien
tactgatctaaatgcaagaagccag

SEQ ID NO: 600988 - DNA, 25 bp, Homo sapien
ctggcattagaacacagctgtcctt

SEQ ID NO: 600989 - DNA, 25 bp, Homo sapien
tggcattagaacacagctgtcctta

SEQ ID NO: 600990 - DNA, 25 bp, Homo sapien
ctggtcaacatagtggaccccagac

SEQ ID NO: 600991 - DNA, 25 bp, Homo sapien
tggtcaacatagtggaccccagact

SEQ ID NO: 600992 - DNA, 25 bp, Homo sapien
ggtcaacatagtggaccccagactt

SEQ ID NO: 600993 - DNA, 25 bp, Homo sapien
gtcaacatagtggaccccagacttt

SEQ ID NO: 600994 - DNA, 25 bp, Homo sapien
tcaacatagtggaccccagacttta

SEQ ID NO: 600995 - DNA, 25 bp, Homo sapien
caacatagtggaccccagactttac

SEQ ID NO: 600996 - DNA, 25 bp, Homo sapien
aacatagtggaccccagactttact

SEQ ID NO: 600997 - DNA, 25 bp, Homo sapien
acatagtggaccccagactttacta

SEQ ID NO: 600998 - DNA, 25 bp, Homo sapien
gtccaggaccaacttctgcagatca

SEQ ID NO: 600999 - DNA, 25 bp, Homo sapien
ggaccaacttctgcagatcatgact

SEQ ID NO: 601000 - DNA, 25 bp, Homo sapien
gatcatgactaagattattcccaat

SEQ ID NO: 601001 - DNA, 25 bp, Homo sapien
cctagggatagacaatttagcagtt

SEQ ID NO: 601002 - DNA, 25 bp, Homo sapien
ttagcagttggaaatctcaaatttt

SEQ ID NO: 601003 - DNA, 25 bp, Homo sapien
gggactttatataatgttttgttct

SEQ ID NO: 601004 - DNA, 25 bp, Homo sapien
gaatatgaatgttcattgacttgaa

SEQ ID NO: 601005 - DNA, 25 bp, Homo sapien
ggcatttcagaacacaagtatcaca

SEQ ID NO: 601006 - DNA, 25 bp, Homo sapien
tcagaacacaagtatcacagagatg

SEQ ID NO: 601007 - DNA, 25 bp, Homo sapien
tcacagagatggacagttacaattt

SEQ ID NO: 601008 - DNA, 25 bp, Homo sapien
attgctatattgtgatacgtgaggg

SEQ ID NO: 601009 - DNA, 25 bp, Homo sapien
gatacgtttgccagcaaagctgctg

SEQ ID NO: 601010 - DNA, 25 bp, Homo sapien
aaagctgctgccctccaggatgtat

SEQ ID NO: 601011 - DNA, 25 bp, Homo sapien
tgctgccctccaggatgtatatgca

SEQ ID NO: 601012 - DNA, 25 bp, Homo sapien
tccaggatgtatatgcagacgcctc

SEQ ID NO: 601013 - DNA, 25 bp, Homo sapien
gcagacgcctccattggcaacgtga

SEQ ID NO: 601014 - DNA, 25 bp, Homo sapien
tccattggcaacgtgacgggcagca

SEQ ID NO: 601015 - DNA, 25 bp, Homo sapien
acgtgacgggcagcaacgccgtcaa

SEQ ID NO: 601016 - DNA, 25 bp, Homo sapien
aacgccgtcaatgtcttcctgggca

SEQ ID NO: 601017 - DNA, 25 bp, Homo sapien
cgtggccgccatctactgggctctg

SEQ ID NO: 601018 - DNA, 25 bp, Homo sapien
caggagttccacgtgtcggccggca

SEQ ID NO: 601019 - DNA, 25 bp, Homo sapien
gtgtcggccggcacactggccttct

SEQ ID NO: 601020 - DNA, 25 bp, Homo sapien
ctttcagtgtctttagggctctgag

SEQ ID NO: 601021 - DNA, 25 bp, Homo sapien
tgtctttagggctctgagggccctg

SEQ ID NO: 601022 - DNA, 25 bp, Homo sapien
tgagggccctggagagcctcaccca

SEQ ID NO: 601023 - DNA, 25 bp, Homo sapien
cctctgtgcacttatgagtcaatgt

SEQ ID NO: 601024 - DNA, 25 bp, Homo sapien
tatgagtcaatgttgccgcacttca

SEQ ID NO: 601025 - DNA, 25 bp, Homo sapien
gttgccgcacttcattacatgctgt

SEQ ID NO: 601026 - DNA, 25 bp, Homo sapien
aaagcctatcttcttcaatcgggta

SEQ ID NO: 601027 - DNA, 25 bp, Homo sapien
tcttcaatcgggtagtaagaccatt

SEQ ID NO: 601028 - DNA, 25 bp, Homo sapien
gtaagaccattgtgggttgaggcat

SEQ ID NO: 601029 - DNA, 25 bp, Homo sapien
tgaggcatgtttcatacttcccaca

SEQ ID NO: 601030 - DNA, 25 bp, Homo sapien
atacttcccacataatcactccaga

SEQ ID NO: 601031 - DNA, 25 bp, Homo sapien
tagcacacagacatatgccagccaa

SEQ ID NO: 601032 - DNA, 25 bp, Homo sapien
atgccagccaatccagctcagaagg

SEQ ID NO: 601033 - DNA, 25 bp, Homo sapien
gcagcactcagacatatgccagcca

SEQ ID NO: 601034 - DNA, 25 bp, Homo sapien
atatgccagccaaaccagatcagaa

SEQ ID NO: 601035 - DNA, 25 bp, Homo sapien
gcagtcaagctgatactagcaaatc

SEQ ID NO: 601036 - DNA, 25 bp, Homo sapien
gaagcatatactagcagatccaaat

SEQ ID NO: 601037 - DNA, 25 bp, Homo sapien
ggacagtacccaaacacaaagcagt

SEQ ID NO: 601038 - DNA, 25 bp, Homo sapien
gtaactagtgattccttcagaaggc

SEQ ID NO: 601039 - DNA, 25 bp, Homo sapien
aacggataacatcgagagtctcgct

SEQ ID NO: 601040 - DNA, 25 bp, Homo sapien
tgaaaattctgtctttccttccgtg

SEQ ID NO: 601041 - DNA, 25 bp, Homo sapien
ttccgtggtcacagctgaaagaaac

SEQ ID NO: 601042 - DNA, 25 bp, Homo sapien
gcagatgacgacatagtgtgcgttt

SEQ ID NO: 601043 - DNA, 25 bp, Homo sapien
agtgtgcgttttgttccaagctttt

SEQ ID NO: 601044 - DNA, 25 bp, Homo sapien
ttccaagcttttttctcttactcga

SEQ ID NO: 601045 - DNA, 25 bp, Homo sapien
gcttttttctcttactcgacgttat

SEQ ID NO: 601046 - DNA, 25 bp, Homo sapien
ttttttaggtctagatggtccaact

SEQ ID NO: 601047 - DNA, 25 bp, Homo sapien
gatggtccaactaaatctcattgag

SEQ ID NO: 601048 - DNA, 25 bp, Homo sapien
tgagttctgtaagcagctggttacc

SEQ ID NO: 601049 - DNA, 25 bp, Homo sapien
tccatttccacactttccatttagg

SEQ ID NO: 601050 - DNA, 25 bp, Homo sapien
ctttccatttaggaagctaaggctt

SEQ ID NO: 601051 - DNA, 25 bp, Homo sapien
ggatcgcttgaatctaagagtgtga

SEQ ID NO: 601052 - DNA, 25 bp, Homo sapien
agcctggacagcctagcaagaaccc

SEQ ID NO: 601053 - DNA, 25 bp, Homo sapien
taaaggtcattttgcctccatagtg

SEQ ID NO: 601054 - DNA, 25 bp, Homo sapien
ggtcattttgcctccatagtgggaa

SEQ ID NO: 601055 - DNA, 25 bp, Homo sapien
ttttgcctccatagtgggaaagaaa

SEQ ID NO: 601056 - DNA, 25 bp, Homo sapien
gcagttgactaatagctgctcttat

SEQ ID NO: 601057 - DNA, 25 bp, Homo sapien
tgactaatagctgctcttatcctgc

SEQ ID NO: 601058 - DNA, 25 bp, Homo sapien
taatagctgctcttatcctgcctaa

SEQ ID NO: 601059 - DNA, 25 bp, Homo sapien
atagctgctcttatcctgcctaaaa

SEQ ID NO: 601060 - DNA, 25 bp, Homo sapien
gacatgtcaatgtaagttcatcaac

SEQ ID NO: 601061 - DNA, 25 bp, Homo sapien
tcaactgtaacaaatgtgccattct

SEQ ID NO: 601062 - DNA, 25 bp, Homo sapien
aacaaatgtgccattctggagagag

SEQ ID NO: 601063 - DNA, 25 bp, Homo sapien
atgtgccattctggagagagatgtt

SEQ ID NO: 601064 - DNA, 25 bp, Homo sapien
attcagaaagatgcaaactagcttg

SEQ ID NO: 601065 - DNA, 25 bp, Homo sapien
aactagcttgaaaagcctgttctaa

SEQ ID NO: 601066 - DNA, 25 bp, Homo sapien
aagcctgttctaaacaatactgcac

SEQ ID NO: 601067 - DNA, 25 bp, Homo sapien
gttctaaacaatactgcacagcagt

SEQ ID NO: 601068 - DNA, 25 bp, Homo sapien
gccaatactatgagacgtaactggt

SEQ ID NO: 601069 - DNA, 25 bp, Homo sapien
gagacgtaactggtgcttgtgcatg

SEQ ID NO: 601070 - DNA, 25 bp, Homo sapien
aactggtgcttgtgcatgcaaatta

SEQ ID NO: 601071 - DNA, 25 bp, Homo sapien
ttatatctgcataaacatacacata

SEQ ID NO: 601072 - DNA, 25 bp, Homo sapien
actatgtacatatatgcctatgtgt

SEQ ID NO: 601073 - DNA, 25 bp, Homo sapien
atgcctatgtgtgtgaagcttggtt

SEQ ID NO: 601074 - DNA, 25 bp, Homo sapien
aagcttggttgtgtcttcatacatt

SEQ ID NO: 601075 - DNA, 25 bp, Homo sapien
taccccttttcctaagactctatga

SEQ ID NO: 601076 - DNA, 25 bp, Homo sapien
ccttttcctaagactctatgaagcg

SEQ ID NO: 601077 - DNA, 25 bp, Homo sapien
ttttcctaagactctatgaagcggg

SEQ ID NO: 601078 - DNA, 25 bp, Homo sapien
tttcctaagactctatgaagcgggc

SEQ ID NO: 601079 - DNA, 25 bp, Homo sapien
ttcctaagactctatgaagcgggcc

SEQ ID NO: 601080 - DNA, 25 bp, Homo sapien
tcctaagactctatgaagcgggccg

SEQ ID NO: 601081 - DNA, 25 bp, Homo sapien
ctaagactctatgaagcgggccggg

SEQ ID NO: 601082 - DNA, 25 bp, Homo sapien
taagactctatgaagcgggccgggc

SEQ ID NO: 601083 - DNA, 25 bp, Homo sapien
agactctatgaagcgggccgggcgc

SEQ ID NO: 601084 - DNA, 25 bp, Homo sapien
ggaggctgtggtgggccgacatcct

SEQ ID NO: 601085 - DNA, 25 bp, Homo sapien
ctgtggtgggccgacatcctgccac

SEQ ID NO: 601086 - DNA, 25 bp, Homo sapien
gatatcttctctgtctgtagaactg

SEQ ID NO: 601087 - DNA, 25 bp, Homo sapien
gtgcctgttagttaactcagtatcg

SEQ ID NO: 601088 - DNA, 25 bp, Homo sapien
aactcagtatcgtcaattatattgt

SEQ ID NO: 601089 - DNA, 25 bp, Homo sapien
atattgttcagattcatgtgttatc

SEQ ID NO: 601090 - DNA, 25 bp, Homo sapien
gtgttatctaattttggcctattat

SEQ ID NO: 601091 - DNA, 25 bp, Homo sapien
ggttatgtgaaactttgttagtaca

SEQ ID NO: 601092 - DNA, 25 bp, Homo sapien
gctttatgtactcaacagctgtgta

SEQ ID NO: 601093 - DNA, 25 bp, Homo sapien
caacagctgtgtaattcgaggcata

SEQ ID NO: 601094 - DNA, 25 bp, Homo sapien
attcgaggcatataagtgcagcatt

SEQ ID NO: 601095 - DNA, 25 bp, Homo sapien
aagtgcagcattgttatgtccttgt

SEQ ID NO: 601096 - DNA, 25 bp, Homo sapien
aacaccatatgacaatggctggcag

SEQ ID NO: 601097 - DNA, 25 bp, Homo sapien
cccctaacacatttagttggcttgg

SEQ ID NO: 601098 - DNA, 25 bp, Homo sapien
catttagttggcttggtgtttagtt

SEQ ID NO: 601099 - DNA, 25 bp, Homo sapien
ggcttggtgtttagtttaacaatca

SEQ ID NO: 601100 - DNA, 25 bp, Homo sapien
caattgctacaaatatgctgcttaa

SEQ ID NO: 601101 - DNA, 25 bp, Homo sapien
taacttaagaatcccctctttggct

SEQ ID NO: 601102 - DNA, 25 bp, Homo sapien
taagaatcccctctttggcttttgt

SEQ ID NO: 601103 - DNA, 25 bp, Homo sapien
tggcttttgtttcctactccaaagt

SEQ ID NO: 601104 - DNA, 25 bp, Homo sapien
aagttgattatggttcctctgtctt

SEQ ID NO: 601105 - DNA, 25 bp, Homo sapien
gattatggttcctctgtcttgtccc

SEQ ID NO: 601106 - DNA, 25 bp, Homo sapien
caaaggacgtgttaattatgtttct

SEQ ID NO: 601107 - DNA, 25 bp, Homo sapien
ttatgtttcttgtaaactgactttt

SEQ ID NO: 601108 - DNA, 25 bp, Homo sapien
agtcagatcctgtcccaccatttat

SEQ ID NO: 601109 - DNA, 25 bp, Homo sapien
gtcccaccatttatcagtcgggaat

SEQ ID NO: 601110 - DNA, 25 bp, Homo sapien
ccaccatttatcagtcgggaatgga

SEQ ID NO: 601111 - DNA, 25 bp, Homo sapien
tatcagtcgggaatggaagggacat

SEQ ID NO: 601112 - DNA, 25 bp, Homo sapien
ggaagggacataaggagaaacacag

SEQ ID NO: 601113 - DNA, 25 bp, Homo sapien
agctcaccacaactgacgcttcttt

SEQ ID NO: 601114 - DNA, 25 bp, Homo sapien
tcaccacaactgacgcttcttttca

SEQ ID NO: 601115 - DNA, 25 bp, Homo sapien
ccacaactgacgcttcttttcagat

SEQ ID NO: 601116 - DNA, 25 bp, Homo sapien
aactgacgcttcttttcagatgcct

SEQ ID NO: 601117 - DNA, 25 bp, Homo sapien
cctgaagttactggaaagaatcgct

SEQ ID NO: 601118 - DNA, 25 bp, Homo sapien
tgaagttactggaaagaatcgctat

SEQ ID NO: 601119 - DNA, 25 bp, Homo sapien
gtacctggcctgctattacctctta

SEQ ID NO: 601120 - DNA, 25 bp, Homo sapien
tacctggcctgctattacctcttaa

SEQ ID NO: 601121 - DNA, 25 bp, Homo sapien
acctggcctgctattacctcttaat

SEQ ID NO: 601122 - DNA, 25 bp, Homo sapien
ctggcctgctattacctcttaatta

SEQ ID NO: 601123 - DNA, 25 bp, Homo sapien
tggcctgctattacctcttaattag

SEQ ID NO: 601124 - DNA, 25 bp, Homo sapien
ggcctgctattacctcttaattaga

SEQ ID NO: 601125 - DNA, 25 bp, Homo sapien
gcctgctattacctcttaattagaa

SEQ ID NO: 601126 - DNA, 25 bp, Homo sapien
gctattacctcttaattagaatttg

SEQ ID NO: 601127 - DNA, 25 bp, Homo sapien
attacctcttaattagaatttgagt

SEQ ID NO: 601128 - DNA, 25 bp, Homo sapien
gtcttttgtcactaaataaatgctt

SEQ ID NO: 601129 - DNA, 25 bp, Homo sapien
ttttgtcactaaataaatgcttcta

SEQ ID NO: 601130 - DNA, 25 bp, Homo sapien
gcagatgcttgatcgggccccagaa

SEQ ID NO: 601131 - DNA, 25 bp, Homo sapien
gatcgggccccagaaagttcatcag

SEQ ID NO: 601132 - DNA, 25 bp, Homo sapien
gggccccagaaagttcatcagaaat

SEQ ID NO: 601133 - DNA, 25 bp, Homo sapien
taactgatcagctgaaccatggact

SEQ ID NO: 601134 - DNA, 25 bp, Homo sapien
gatcagctgaaccatggactcagga

SEQ ID NO: 601135 - DNA, 25 bp, Homo sapien
tgaaccatggactcaggaaaaattt

SEQ ID NO: 601136 - DNA, 25 bp, Homo sapien
gttttttaacataccagtagctaca

SEQ ID NO: 601137 - DNA, 25 bp, Homo sapien
agtagctacatagcccatattgcaa

SEQ ID NO: 601138 - DNA, 25 bp, Homo sapien
tagcccatattgcaaatgacatcaa

SEQ ID NO: 601139 - DNA, 25 bp, Homo sapien
gacagaatggttactgggttgtaat

SEQ ID NO: 601140 - DNA, 25 bp, Homo sapien
agtgctgtacttgattaaaaactca

SEQ ID NO: 601141 - DNA, 25 bp, Homo sapien
gctcttcgggaagattggctactac

SEQ ID NO: 601142 - DNA, 25 bp, Homo sapien
aagattggctactacctggtgctgg

SEQ ID NO: 601143 - DNA, 25 bp, Homo sapien
ctgggctggtgctgcgtagccatct

SEQ ID NO: 601144 - DNA, 25 bp, Homo sapien
atctttgtgttcatgtttccccttt

SEQ ID NO: 601145 - DNA, 25 bp, Homo sapien
ttcatgtttccccttttgccgggcg

SEQ ID NO: 601146 - DNA, 25 bp, Homo sapien
tcatgtttccccttttgccgggcgc

SEQ ID NO: 601147 - DNA, 25 bp, Homo sapien
catgtttccccttttgccgggcgcg

SEQ ID NO: 601148 - DNA, 25 bp, Homo sapien
gaaccagctgcgcatgtacctgacc

SEQ ID NO: 601149 - DNA, 25 bp, Homo sapien
ggtggccttcttgggctacaaatat

SEQ ID NO: 601150 - DNA, 25 bp, Homo sapien
tacaaatatgtcgggatgattggcg

SEQ ID NO: 601151 - DNA, 25 bp, Homo sapien
caaatatgtcgggatgattggcggg

SEQ ID NO: 601152 - DNA, 25 bp, Homo sapien
gggagttttctcatgatttaacaac

SEQ ID NO: 601153 - DNA, 25 bp, Homo sapien
ctcatgatttaacaacatccgccct

SEQ ID NO: 601154 - DNA, 25 bp, Homo sapien
atgatttaacaacatccgccctttg

SEQ ID NO: 601155 - DNA, 25 bp, Homo sapien
tgatttaacaacatccgccctttgt

SEQ ID NO: 601156 - DNA, 25 bp, Homo sapien
atttaacaacatccgccctttgttg

SEQ ID NO: 601157 - DNA, 25 bp, Homo sapien
acaacatccgccctttgttgtcatg

SEQ ID NO: 601158 - DNA, 25 bp, Homo sapien
taaaaatatgtgacacctcccccca

SEQ ID NO: 601159 - DNA, 25 bp, Homo sapien
gctctggccatgtaaagtgctcact

SEQ ID NO: 601160 - DNA, 25 bp, Homo sapien
ctctggccatgtaaagtgctcactc

SEQ ID NO: 601161 - DNA, 25 bp, Homo sapien
atgtaaagtgctcactccccctttg

SEQ ID NO: 601162 - DNA, 25 bp, Homo sapien
atcatgcttgctgtgcagcctgcag

SEQ ID NO: 601163 - DNA, 25 bp, Homo sapien
aggcgatgccctgtacttgagtttc

SEQ ID NO: 601164 - DNA, 25 bp, Homo sapien
cgatgccctgtacttgagtttcaac

SEQ ID NO: 601165 - DNA, 25 bp, Homo sapien
tgtacttgagtttcaaccccccaca

SEQ ID NO: 601166 - DNA, 25 bp, Homo sapien
ggcactgaccgcctggatctacctg

SEQ ID NO: 601167 - DNA, 25 bp, Homo sapien
tggatctacctgtcactactcgctc

SEQ ID NO: 601168 - DNA, 25 bp, Homo sapien
tcactactcgctctgtccatcgaaa

SEQ ID NO: 601169 - DNA, 25 bp, Homo sapien
tccatcgaaactttgaggaccgaga

SEQ ID NO: 601170 - DNA, 25 bp, Homo sapien
gaaactttgaggaccgagagaggca

SEQ ID NO: 601171 - DNA, 25 bp, Homo sapien
tgcaagacagcagtgaccctgacac

SEQ ID NO: 601172 - DNA, 25 bp, Homo sapien
tgaccctgacactggcagcgaggag

SEQ ID NO: 601173 - DNA, 25 bp, Homo sapien
gaggaaggtagcagccgtctgtctc

SEQ ID NO: 601174 - DNA, 25 bp, Homo sapien
attagctaggcttggttgtgttcac

SEQ ID NO: 601175 - DNA, 25 bp, Homo sapien
ttagctaggcttggttgtgttcacc

SEQ ID NO: 601176 - DNA, 25 bp, Homo sapien
tagctaggcttggttgtgttcacct

SEQ ID NO: 601177 - DNA, 25 bp, Homo sapien
agctaggcttggttgtgttcacctg

SEQ ID NO: 601178 - DNA, 25 bp, Homo sapien
gctaggcttggttgtgttcacctgt

SEQ ID NO: 601179 - DNA, 25 bp, Homo sapien
ctaggcttggttgtgttcacctgta

SEQ ID NO: 601180 - DNA, 25 bp, Homo sapien
taggcttggttgtgttcacctgtaa

SEQ ID NO: 601181 - DNA, 25 bp, Homo sapien
aggaggatcgtttgaactggtgagg

SEQ ID NO: 601182 - DNA, 25 bp, Homo sapien
ggaggatcgtttgaactggtgaggt

SEQ ID NO: 601183 - DNA, 25 bp, Homo sapien
gaggatcgtttgaactggtgaggtg

SEQ ID NO: 601184 - DNA, 25 bp, Homo sapien
aggatcgtttgaactggtgaggtgg

SEQ ID NO: 601185 - DNA, 25 bp, Homo sapien
agtaaatgtgatttaactccaaaat

SEQ ID NO: 601186 - DNA, 25 bp, Homo sapien
aaaatgcatttagttttgatacttg

SEQ ID NO: 601187 - DNA, 25 bp, Homo sapien
aaatgcatttagttttgatacttgt

SEQ ID NO: 601188 - DNA, 25 bp, Homo sapien
aatgcatttagttttgatacttgta

SEQ ID NO: 601189 - DNA, 25 bp, Homo sapien
atgcatttagttttgatacttgtaa

SEQ ID NO: 601190 - DNA, 25 bp, Homo sapien
tgcatttagttttgatacttgtaaa

SEQ ID NO: 601191 - DNA, 25 bp, Homo sapien
gcatttagttttgatacttgtaaaa

SEQ ID NO: 601192 - DNA, 25 bp, Homo sapien
tggctttataagaagcagtttaaaa

SEQ ID NO: 601193 - DNA, 25 bp, Homo sapien
gctttataagaagcagtttaaaaag

SEQ ID NO: 601194 - DNA, 25 bp, Homo sapien
gagaaaacacgcagattccaaagag

SEQ ID NO: 601195 - DNA, 25 bp, Homo sapien
aaccattaattgtgcctgcgttagg

SEQ ID NO: 601196 - DNA, 25 bp, Homo sapien
aattgtgcctgcgttaggtaccagg

SEQ ID NO: 601197 - DNA, 25 bp, Homo sapien
aagtgttgtgagtgccctctgtcat

SEQ ID NO: 601198 - DNA, 25 bp, Homo sapien
tctgtcatttaatctccacggagtc

SEQ ID NO: 601199 - DNA, 25 bp, Homo sapien
aatctccacggagtcctgaaggtgc

SEQ ID NO: 601200 - DNA, 25 bp, Homo sapien
ctgaaggtgcttcccaggtttgtcc

SEQ ID NO: 601201 - DNA, 25 bp, Homo sapien
atgaggcaatcgttctgttaagact

SEQ ID NO: 601202 - DNA, 25 bp, Homo sapien
ctgttaagactgtccttgggtcatt

SEQ ID NO: 601203 - DNA, 25 bp, Homo sapien
gtccttgggtcattatgtcagcaat

SEQ ID NO: 601204 - DNA, 25 bp, Homo sapien
gcaatgaaatcggtgctgccattac

SEQ ID NO: 601205 - DNA, 25 bp, Homo sapien
aaagccgaacagtcaattcgttctt

SEQ ID NO: 601206 - DNA, 25 bp, Homo sapien
gccgaacagtcaattcgttcttggt

SEQ ID NO: 601207 - DNA, 25 bp, Homo sapien
gattttcttaattgggtcttagctg

SEQ ID NO: 601208 - DNA, 25 bp, Homo sapien
ttcttaattgggtcttagctgggcc

SEQ ID NO: 601209 - DNA, 25 bp, Homo sapien
cttaattgggtcttagctgggcctt

SEQ ID NO: 601210 - DNA, 25 bp, Homo sapien
taattgggtcttagctgggccttcc

SEQ ID NO: 601211 - DNA, 25 bp, Homo sapien
ttgggtcttagctgggccttccttt

SEQ ID NO: 601212 - DNA, 25 bp, Homo sapien
cttagctgggccttcctttctcttt

SEQ ID NO: 601213 - DNA, 25 bp, Homo sapien
gggctttgtgactatcagaaacacc

SEQ ID NO: 601214 - DNA, 25 bp, Homo sapien
gtgactatcagaaacacctgccagg

SEQ ID NO: 601215 - DNA, 25 bp, Homo sapien
ctatcagaaacacctgccaggcctg

SEQ ID NO: 601216 - DNA, 25 bp, Homo sapien
cagagcatgaatgggcctacacctg

SEQ ID NO: 601217 - DNA, 25 bp, Homo sapien
atgaatgggcctacacctgccaagg

SEQ ID NO: 601218 - DNA, 25 bp, Homo sapien
cacctgccaaggctgaatccctggg

SEQ ID NO: 601219 - DNA, 25 bp, Homo sapien
cacaggcattgcacacggtgtgagg

SEQ ID NO: 601220 - DNA, 25 bp, Homo sapien
tgcacacggtgtgaggagtgtacac

SEQ ID NO: 601221 - DNA, 25 bp, Homo sapien
tgaggagtgtacacctgcaagggct

SEQ ID NO: 601222 - DNA, 25 bp, Homo sapien
tgctcagagtgcaggcattgcacat

SEQ ID NO: 601223 - DNA, 25 bp, Homo sapien
ggtgtgagaaggtctacacctgcaa

SEQ ID NO: 601224 - DNA, 25 bp, Homo sapien
ctgcaagggacgagtccccgggcct

SEQ ID NO: 601225 - DNA, 25 bp, Homo sapien
tgagggccatgcatgctagtatgag

SEQ ID NO: 601226 - DNA, 25 bp, Homo sapien
acacctgcaaggactgagaggcttt

SEQ ID NO: 601227 - DNA, 25 bp, Homo sapien
cagccttaaggttgattccaaagat

SEQ ID NO: 601228 - DNA, 25 bp, Homo sapien
ggttgattccaaagatagttctcat

SEQ ID NO: 601229 - DNA, 25 bp, Homo sapien
aagatagttctcataactccacaaa

SEQ ID NO: 601230 - DNA, 25 bp, Homo sapien
agttctcataactccacaaactctg

SEQ ID NO: 601231 - DNA, 25 bp, Homo sapien
gttctcataactccacaaactctga

SEQ ID NO: 601232 - DNA, 25 bp, Homo sapien
ataactccacaaactctgaatttgc

SEQ ID NO: 601233 - DNA, 25 bp, Homo sapien
ctgaagctgagggtcagaatgatac

SEQ ID NO: 601234 - DNA, 25 bp, Homo sapien
aagctgagggtcagaatgatacaat

SEQ ID NO: 601235 - DNA, 25 bp, Homo sapien
ctgtcattgacaaatgctctccacc

SEQ ID NO: 601236 - DNA, 25 bp, Homo sapien
attgacaaatgctctccacccctag

SEQ ID NO: 601237 - DNA, 25 bp, Homo sapien
aaatgctctccacccctagagttct

SEQ ID NO: 601238 - DNA, 25 bp, Homo sapien
ctgcctgtgtcgtgtggcctggcca

SEQ ID NO: 601239 - DNA, 25 bp, Homo sapien
gtggacgtggcctgtgcttcgcccg

SEQ ID NO: 601240 - DNA, 25 bp, Homo sapien
cccaacctctgtccgcatgcctggg

SEQ ID NO: 601241 - DNA, 25 bp, Homo sapien
ggaacccgcccggacggcatcgcca

SEQ ID NO: 601242 - DNA, 25 bp, Homo sapien
gacggcatcgccaggcactggctgg

SEQ ID NO: 601243 - DNA, 25 bp, Homo sapien
ggcccagtggagccggtggccagga

SEQ ID NO: 601244 - DNA, 25 bp, Homo sapien
ggccaggaaggctgaagcccgcttc

SEQ ID NO: 601245 - DNA, 25 bp, Homo sapien
aggaaggctgaagcccgcttcccat

SEQ ID NO: 601246 - DNA, 25 bp, Homo sapien
gcttcccatgctcctgcatcaggtg

SEQ ID NO: 601247 - DNA, 25 bp, Homo sapien
tcctgcatcaggtgcccagccgtgg

SEQ ID NO: 601248 - DNA, 25 bp, Homo sapien
gcatcaggtgcccagccgtgggtgg

SEQ ID NO: 601249 - DNA, 25 bp, Homo sapien
agaatggttgccatctgaggccagg

SEQ ID NO: 601250 - DNA, 25 bp, Homo sapien
gaatggttgccatctgaggccaggc

SEQ ID NO: 601251 - DNA, 25 bp, Homo sapien
aatggttgccatctgaggccaggca

SEQ ID NO: 601252 - DNA, 25 bp, Homo sapien
atggttgccatctgaggccaggcat

SEQ ID NO: 601253 - DNA, 25 bp, Homo sapien
tggttgccatctgaggccaggcatg

SEQ ID NO: 601254 - DNA, 25 bp, Homo sapien
gttgccatctgaggccaggcatggt

SEQ ID NO: 601255 - DNA, 25 bp, Homo sapien
tgcccaaccctaactgttcaactga

SEQ ID NO: 601256 - DNA, 25 bp, Homo sapien
aaccctaactgttcaactgactttg

SEQ ID NO: 601257 - DNA, 25 bp, Homo sapien
aactgttcaactgactttgtgacaa

SEQ ID NO: 601258 - DNA, 25 bp, Homo sapien
tcaactgactttgtgacaatatacc

SEQ ID NO: 601259 - DNA, 25 bp, Homo sapien
aactgactttgtgacaatataccct

SEQ ID NO: 601260 - DNA, 25 bp, Homo sapien
atggtccccgagaccacgtctgtgc

SEQ ID NO: 601261 - DNA, 25 bp, Homo sapien
gaaagcgttcgttgagagctcaaaa

SEQ ID NO: 601262 - DNA, 25 bp, Homo sapien
gagagaagccgtttcggtgcacttt

SEQ ID NO: 601263 - DNA, 25 bp, Homo sapien
agccgtttcggtgcacttttgaagg

SEQ ID NO: 601264 - DNA, 25 bp, Homo sapien
gaagggtgcggaaagcgcttctctc

SEQ ID NO: 601265 - DNA, 25 bp, Homo sapien
aaagcgcttctctctggactttaat

SEQ ID NO: 601266 - DNA, 25 bp, Homo sapien
tctggactttaatttgcgtacgcac

SEQ ID NO: 601267 - DNA, 25 bp, Homo sapien
atttgcgtacgcacgtgcgcatcca

SEQ ID NO: 601268 - DNA, 25 bp, Homo sapien
cgtttcgtgtgtccctttcaaggct

SEQ ID NO: 601269 - DNA, 25 bp, Homo sapien
gtgtccctttcaaggctgcaacagg

SEQ ID NO: 601270 - DNA, 25 bp, Homo sapien
aaagcccacatcctaacgcatgcaa

SEQ ID NO: 601271 - DNA, 25 bp, Homo sapien
aggatgtgctggtttgttgaatcaa

SEQ ID NO: 601272 - DNA, 25 bp, Homo sapien
gttttggttcactattcacaggaca

SEQ ID NO: 601273 - DNA, 25 bp, Homo sapien
tcacaggacattggcattatctact

SEQ ID NO: 601274 - DNA, 25 bp, Homo sapien
ttggcattatctactaaggctgaaa

SEQ ID NO: 601275 - DNA, 25 bp, Homo sapien
aaatgtgcatattccatgactcagg

SEQ ID NO: 601276 - DNA, 25 bp, Homo sapien
atgactcaggattttatctcctaga

SEQ ID NO: 601277 - DNA, 25 bp, Homo sapien
tatctcctagatatatattcaacag

SEQ ID NO: 601278 - DNA, 25 bp, Homo sapien
aatgcatgagtatgtgcaccaacag

SEQ ID NO: 601279 - DNA, 25 bp, Homo sapien
agtatgtgcaccaacaggcatgaca

SEQ ID NO: 601280 - DNA, 25 bp, Homo sapien
gtagtggtgttcacaatagtcccaa

SEQ ID NO: 601281 - DNA, 25 bp, Homo sapien
ggtgttcacaatagtcccaaactgg

SEQ ID NO: 601282 - DNA, 25 bp, Homo sapien
tagacttactgcaggtgggcaccca

SEQ ID NO: 601283 - DNA, 25 bp, Homo sapien
tggtccctcatcttcatgcaagttt

SEQ ID NO: 601284 - DNA, 25 bp, Homo sapien
catcttcatgcaagtttcttctcct

SEQ ID NO: 601285 - DNA, 25 bp, Homo sapien
caacaaggcggtggccatggtgact

SEQ ID NO: 601286 - DNA, 25 bp, Homo sapien
tggtgactgcaatggtaaccccttt

SEQ ID NO: 601287 - DNA, 25 bp, Homo sapien
ctgcaatggtaacccctttcctcaa

SEQ ID NO: 601288 - DNA, 25 bp, Homo sapien
ttcatcttcaccttccggaatgaga

SEQ ID NO: 601289 - DNA, 25 bp, Homo sapien
ggatgtgactaaaaggatcttcctt

SEQ ID NO: 601290 - DNA, 25 bp, Homo sapien
gggctagagagcacctgacaagtca

SEQ ID NO: 601291 - DNA, 25 bp, Homo sapien
gagcacctgacaagtcacgaggagt

SEQ ID NO: 601292 - DNA, 25 bp, Homo sapien
gtcacgaggagtagacttactgcag

SEQ ID NO: 601293 - DNA, 25 bp, Homo sapien
ttgccgcagcttaaagcagtcacaa

SEQ ID NO: 601294 - DNA, 25 bp, Homo sapien
aagcagtcacaatctcctggagaaa

SEQ ID NO: 601295 - DNA, 25 bp, Homo sapien
aggaggaagatacccctgtacccat

SEQ ID NO: 601296 - DNA, 25 bp, Homo sapien
tagggacccttgtagccaggcaggt

SEQ ID NO: 601297 - DNA, 25 bp, Homo sapien
acccttgtagccaggcaggtgctgg

SEQ ID NO: 601298 - DNA, 25 bp, Homo sapien
agggcaggacaccagtcctgatgtc

SEQ ID NO: 601299 - DNA, 25 bp, Homo sapien
agtcctgatgtccaccttgatgtct

SEQ ID NO: 601300 - DNA, 25 bp, Homo sapien
atgtccaccttgatgtctaccttaa

SEQ ID NO: 601301 - DNA, 25 bp, Homo sapien
cttgatgtctaccttaacccttgta

SEQ ID NO: 601302 - DNA, 25 bp, Homo sapien
gatgtctaccttaacccttgtagtg

SEQ ID NO: 601303 - DNA, 25 bp, Homo sapien
tctaccttaacccttgtagtgtaat

SEQ ID NO: 601304 - DNA, 25 bp, Homo sapien
aatttatacttcagccaggcatagt

SEQ ID NO: 601305 - DNA, 25 bp, Homo sapien
aattggttaattcgtatttatatat

SEQ ID NO: 601306 - DNA, 25 bp, Homo sapien
gtaataagtaggtgggcgtctcgct

SEQ ID NO: 601307 - DNA, 25 bp, Homo sapien
taataagtaggtgggcgtctcgctc

SEQ ID NO: 601308 - DNA, 25 bp, Homo sapien
ataagtaggtgggcgtctcgctctg

SEQ ID NO: 601309 - DNA, 25 bp, Homo sapien
tggagtctagtgtcgtgatctaggc

SEQ ID NO: 601310 - DNA, 25 bp, Homo sapien
agtctagtgtcgtgatctaggctca

SEQ ID NO: 601311 - DNA, 25 bp, Homo sapien
tgatctaggctcacttcagactcca

SEQ ID NO: 601312 - DNA, 25 bp, Homo sapien
gatctaggctcacttcagactccaa

SEQ ID NO: 601313 - DNA, 25 bp, Homo sapien
tctaggctcacttcagactccaact

SEQ ID NO: 601314 - DNA, 25 bp, Homo sapien
tcacttcagactccaactcccgggt

SEQ ID NO: 601315 - DNA, 25 bp, Homo sapien
atgtaagcagtaaagccaggtgcgg

SEQ ID NO: 601316 - DNA, 25 bp, Homo sapien
tgtaagcagtaaagccaggtgcggt

SEQ ID NO: 601317 - DNA, 25 bp, Homo sapien
gtaagcagtaaagccaggtgcggtg

SEQ ID NO: 601318 - DNA, 25 bp, Homo sapien
taagcagtaaagccaggtgcggtgg

SEQ ID NO: 601319 - DNA, 25 bp, Homo sapien
gagattgcagtgagcaaaaggttgc

SEQ ID NO: 601320 - DNA, 25 bp, Homo sapien
agattgcagtgagcaaaaggttgca

SEQ ID NO: 601321 - DNA, 25 bp, Homo sapien
gattgcagtgagcaaaaggttgcag

SEQ ID NO: 601322 - DNA, 25 bp, Homo sapien
attgcagtgagcaaaaggttgcagt

SEQ ID NO: 601323 - DNA, 25 bp, Homo sapien
ttgcagtgagcaaaaggttgcagtg

SEQ ID NO: 601324 - DNA, 25 bp, Homo sapien
tgcagtgagcaaaaggttgcagtga

SEQ ID NO: 601325 - DNA, 25 bp, Homo sapien
gcagtgagcaaaaggttgcagtgag

SEQ ID NO: 601326 - DNA, 25 bp, Homo sapien
gaaaaagctcagatgatatccataa

SEQ ID NO: 601327 - DNA, 25 bp, Homo sapien
gatatccataaccatgccagacact

SEQ ID NO: 601328 - DNA, 25 bp, Homo sapien
ataaccatgccagacactctgcaag

SEQ ID NO: 601329 - DNA, 25 bp, Homo sapien
agacactctgcaagaccatatactg

SEQ ID NO: 601330 - DNA, 25 bp, Homo sapien
aagaccatatactgctccggaggtt

SEQ ID NO: 601331 - DNA, 25 bp, Homo sapien
tatactgctccggaggttaacaagc

SEQ ID NO: 601332 - DNA, 25 bp, Homo sapien
tccggaggttaacaagcaacgagaa

SEQ ID NO: 601333 - DNA, 25 bp, Homo sapien
gcaacgagaaagctacagtggaaag

SEQ ID NO: 601334 - DNA, 25 bp, Homo sapien
ctacagtggaaagtttacaagtcgt

SEQ ID NO: 601335 - DNA, 25 bp, Homo sapien
acaagtcgtcgaatggtttcatcag

SEQ ID NO: 601336 - DNA, 25 bp, Homo sapien
ggtttcatcaggcttagttcatata

SEQ ID NO: 601337 - DNA, 25 bp, Homo sapien
agtcataccctgctgacttactggg

SEQ ID NO: 601338 - DNA, 25 bp, Homo sapien
tgctgacttactgggccttacatgg

SEQ ID NO: 601339 - DNA, 25 bp, Homo sapien
tactgggccttacatgggcctgcca

SEQ ID NO: 601340 - DNA, 25 bp, Homo sapien
ggcctgccacttgttgctgcaagag

SEQ ID NO: 601341 - DNA, 25 bp, Homo sapien
gctgcaagagtgtttgtgcctcttc

SEQ ID NO: 601342 - DNA, 25 bp, Homo sapien
tgtgcctcttccttgtataagtggg

SEQ ID NO: 601343 - DNA, 25 bp, Homo sapien
ggattgagcttcagggacgcagcat

SEQ ID NO: 601344 - DNA, 25 bp, Homo sapien
gcttcagggacgcagcatagagcct

SEQ ID NO: 601345 - DNA, 25 bp, Homo sapien
catagagcctgtctcctcctgataa

SEQ ID NO: 601346 - DNA, 25 bp, Homo sapien
ctcctgataacattcgtccacttga

SEQ ID NO: 601347 - DNA, 25 bp, Homo sapien
gataacattcgtccacttgaaaggg

SEQ ID NO: 601348 - DNA, 25 bp, Homo sapien
gttgagagccaagtcttatgggact

SEQ ID NO: 601349 - DNA, 25 bp, Homo sapien
aagtcttatgggacttgcctccttc

SEQ ID NO: 601350 - DNA, 25 bp, Homo sapien
tcttatgggacttgcctccttctct

SEQ ID NO: 601351 - DNA, 25 bp, Homo sapien
tggcccagaggcatgtggatacctc

SEQ ID NO: 601352 - DNA, 25 bp, Homo sapien
aggcatgtggatacctccagtggga

SEQ ID NO: 601353 - DNA, 25 bp, Homo sapien
gaggttaggagagtgctacacagaa

SEQ ID NO: 601354 - DNA, 25 bp, Homo sapien
gagtgctacacagaaactctgagtt

SEQ ID NO: 601355 - DNA, 25 bp, Homo sapien
gaaactctgagttctaacactcttg

SEQ ID NO: 601356 - DNA, 25 bp, Homo sapien
agttctaacactcttgggaccataa

SEQ ID NO: 601357 - DNA, 25 bp, Homo sapien
atggaacaagtctgggcatggtaac

SEQ ID NO: 601358 - DNA, 25 bp, Homo sapien
caagtctgggcatggtaactcacgc

SEQ ID NO: 601359 - DNA, 25 bp, Homo sapien
aagtcttaaaggaggagaataggca

SEQ ID NO: 601360 - DNA, 25 bp, Homo sapien
agtcttaaaggaggagaataggcag

SEQ ID NO: 601361 - DNA, 25 bp, Homo sapien
taaaggaggagaataggcagggcat

SEQ ID NO: 601362 - DNA, 25 bp, Homo sapien
aaaggaggagaataggcagggcatg

SEQ ID NO: 601363 - DNA, 25 bp, Homo sapien
aaggaggagaataggcagggcatgg

SEQ ID NO: 601364 - DNA, 25 bp, Homo sapien
aggaggagaataggcagggcatggt

SEQ ID NO: 601365 - DNA, 25 bp, Homo sapien
ctaaggcgaatggatcacttgagga

SEQ ID NO: 601366 - DNA, 25 bp, Homo sapien
aataaatacaaaagattggcagggt

SEQ ID NO: 601367 - DNA, 25 bp, Homo sapien
tggcagggtgtggtgccatcgcctg

SEQ ID NO: 601368 - DNA, 25 bp, Homo sapien
ggcagggtgtggtgccatcgcctgt

SEQ ID NO: 601369 - DNA, 25 bp, Homo sapien
agggtgtggtgccatcgcctgtaat

SEQ ID NO: 601370 - DNA, 25 bp, Homo sapien
ggaaatagagacacacaagaaccct

SEQ ID NO: 601371 - DNA, 25 bp, Homo sapien
gaaatagagacacacaagaaccctt

SEQ ID NO: 601372 - DNA, 25 bp, Homo sapien
atagagacacacaagaacccttcaa

SEQ ID NO: 601373 - DNA, 25 bp, Homo sapien
tagagacacacaagaacccttcaaa

SEQ ID NO: 601374 - DNA, 25 bp, Homo sapien
caagaacccttcaaaaaaatcaatg

SEQ ID NO: 601375 - DNA, 25 bp, Homo sapien
gaacccttcaaaaaaatcaatgaat

SEQ ID NO: 601376 - DNA, 25 bp, Homo sapien
ccttcaaaaaaatcaatgaatccag

SEQ ID NO: 601377 - DNA, 25 bp, Homo sapien
aaaaaaatcaatgaatccaggggct

SEQ ID NO: 601378 - DNA, 25 bp, Homo sapien
cacatcctctcagggaaagcccaaa

SEQ ID NO: 601379 - DNA, 25 bp, Homo sapien
acaggtgccaggccctgcaagacac

SEQ ID NO: 601380 - DNA, 25 bp, Homo sapien
aagacacagggcagcatgggcatca

SEQ ID NO: 601381 - DNA, 25 bp, Homo sapien
acagggcagcatgggcatcataact

SEQ ID NO: 601382 - DNA, 25 bp, Homo sapien
gcatgggcatcataactggccacag

SEQ ID NO: 601383 - DNA, 25 bp, Homo sapien
ataactggccacagtcagcagagcc

SEQ ID NO: 601384 - DNA, 25 bp, Homo sapien
tcacccatagccctgaaggaatcat

SEQ ID NO: 601385 - DNA, 25 bp, Homo sapien
tagccctgaaggaatcatagctcac

SEQ ID NO: 601386 - DNA, 25 bp, Homo sapien
aatcatagctcacttgatcccggcc

SEQ ID NO: 601387 - DNA, 25 bp, Homo sapien
atagctcacttgatcccggcctgtt

SEQ ID NO: 601388 - DNA, 25 bp, Homo sapien
ccggcctgttctccttcgcaaataa

SEQ ID NO: 601389 - DNA, 25 bp, Homo sapien
gctgttaacacaattctctgatgcg

SEQ ID NO: 601390 - DNA, 25 bp, Homo sapien
caattctctgatgcggtgctgtaca

SEQ ID NO: 601391 - DNA, 25 bp, Homo sapien
tgatgcggtgctgtacagtcatttt

SEQ ID NO: 601392 - DNA, 25 bp, Homo sapien
aatctcttgctaacattttattggc

SEQ ID NO: 601393 - DNA, 25 bp, Homo sapien
ttggcagtatgtatttctaccattg

SEQ ID NO: 601394 - DNA, 25 bp, Homo sapien
tctaccattgtaaccaccattgtgc

SEQ ID NO: 601395 - DNA, 25 bp, Homo sapien
accaccattgtgctattgtatctct

SEQ ID NO: 601396 - DNA, 25 bp, Homo sapien
tgtgctattgtatctcttcacttct

SEQ ID NO: 601397 - DNA, 25 bp, Homo sapien
gtatctcttcacttctgtgaaagta

SEQ ID NO: 601398 - DNA, 25 bp, Homo sapien
agaataatcttcttggcttacccct

SEQ ID NO: 601399 - DNA, 25 bp, Homo sapien
tggcttacccctttacataagcatt

SEQ ID NO: 601400 - DNA, 25 bp, Homo sapien
cacgcccggctgatactgttaaagt

SEQ ID NO: 601401 - DNA, 25 bp, Homo sapien
acgcccggctgatactgttaaagtc

SEQ ID NO: 601402 - DNA, 25 bp, Homo sapien
cgcccggctgatactgttaaagtct

SEQ ID NO: 601403 - DNA, 25 bp, Homo sapien
gcccggctgatactgttaaagtctt

SEQ ID NO: 601404 - DNA, 25 bp, Homo sapien
cccggctgatactgttaaagtctta

SEQ ID NO: 601405 - DNA, 25 bp, Homo sapien
ccggctgatactgttaaagtcttaa

SEQ ID NO: 601406 - DNA, 25 bp, Homo sapien
cggctgatactgttaaagtcttaaa

SEQ ID NO: 601407 - DNA, 25 bp, Homo sapien
ggctgatactgttaaagtcttaaac

SEQ ID NO: 601408 - DNA, 25 bp, Homo sapien
ctggcattagaacacagctgtcctt

SEQ ID NO: 601409 - DNA, 25 bp, Homo sapien
tggcattagaacacagctgtcctta

SEQ ID NO: 601410 - DNA, 25 bp, Homo sapien
gctgtccttacttccaggctgggtg

SEQ ID NO: 601411 - DNA, 25 bp, Homo sapien
ttccaggctgggtgccgtaactcac

SEQ ID NO: 601412 - DNA, 25 bp, Homo sapien
ctggtcaacatagtggaccccagac

SEQ ID NO: 601413 - DNA, 25 bp, Homo sapien
tggtcaacatagtggaccccagact

SEQ ID NO: 601414 - DNA, 25 bp, Homo sapien
ggtcaacatagtggaccccagactt

SEQ ID NO: 601415 - DNA, 25 bp, Homo sapien
gtcaacatagtggaccccagacttt

SEQ ID NO: 601416 - DNA, 25 bp, Homo sapien
tcaacatagtggaccccagacttta

SEQ ID NO: 601417 - DNA, 25 bp, Homo sapien
caacatagtggaccccagactttac

SEQ ID NO: 601418 - DNA, 25 bp, Homo sapien
acatagtggaccccagactttacta

SEQ ID NO: 601419 - DNA, 25 bp, Homo sapien
gggaaggaaaccctgttacagagct

SEQ ID NO: 601420 - DNA, 25 bp, Homo sapien
aaccctgttacagagcttgacaaca

SEQ ID NO: 601421 - DNA, 25 bp, Homo sapien
acataacatcatctaaaggagcctt

SEQ ID NO: 601422 - DNA, 25 bp, Homo sapien
aaggagccttagaattaacagtgaa

SEQ ID NO: 601423 - DNA, 25 bp, Homo sapien
aagtcaacatacagcagtgaagacc

SEQ ID NO: 601424 - DNA, 25 bp, Homo sapien
agtgaagaccaagcagcgtgacctt

SEQ ID NO: 601425 - DNA, 25 bp, Homo sapien
aagcagcgtgaccttcagcctcaag

SEQ ID NO: 601426 - DNA, 25 bp, Homo sapien
ttcagcctcaagcaggaagaacaaa

SEQ ID NO: 601427 - DNA, 25 bp, Homo sapien
gaacttggcaagttttctccatttg

SEQ ID NO: 601428 - DNA, 25 bp, Homo sapien
aagttttctccatttgttgcaagta

SEQ ID NO: 601429 - DNA, 25 bp, Homo sapien
gtatgtttactagctgaatctcaat

SEQ ID NO: 601430 - DNA, 25 bp, Homo sapien
aagaaagaacatggccaggcgtggt

SEQ ID NO: 601431 - DNA, 25 bp, Homo sapien
agaaagaacatggccaggcgtggtg

SEQ ID NO: 601432 - DNA, 25 bp, Homo sapien
gaggcagtcagatcatgaggccagt

SEQ ID NO: 601433 - DNA, 25 bp, Homo sapien
aggcagtcagatcatgaggccagtt

SEQ ID NO: 601434 - DNA, 25 bp, Homo sapien
ggcagtcagatcatgaggccagttt

SEQ ID NO: 601435 - DNA, 25 bp, Homo sapien
gcagtcagatcatgaggccagtttg

SEQ ID NO: 601436 - DNA, 25 bp, Homo sapien
cagtcagatcatgaggccagtttga

SEQ ID NO: 601437 - DNA, 25 bp, Homo sapien
agtcagatcatgaggccagtttgaa

SEQ ID NO: 601438 - DNA, 25 bp, Homo sapien
gtcagatcatgaggccagtttgaaa

SEQ ID NO: 601439 - DNA, 25 bp, Homo sapien
tcagatcatgaggccagtttgaaac

SEQ ID NO: 601440 - DNA, 25 bp, Homo sapien
agatcatgaggccagtttgaaacca

SEQ ID NO: 601441 - DNA, 25 bp, Homo sapien
agcagagacaaaaccctggcctcct

SEQ ID NO: 601442 - DNA, 25 bp, Homo sapien
tctcctggtgggtaaggtggccaca

SEQ ID NO: 601443 - DNA, 25 bp, Homo sapien
gctggcagcagggtattggcactga

SEQ ID NO: 601444 - DNA, 25 bp, Homo sapien
gcctctccaacagaggtggtgccgg

SEQ ID NO: 601445 - DNA, 25 bp, Homo sapien
gcagtgcctggagaccgcttaggtt

SEQ ID NO: 601446 - DNA, 25 bp, Homo sapien
gcctggagaccgcttaggttgtcac

SEQ ID NO: 601447 - DNA, 25 bp, Homo sapien
ggagaccgcttaggttgtcacaact

SEQ ID NO: 601448 - DNA, 25 bp, Homo sapien
agaccgcttaggttgtcacaactgg

SEQ ID NO: 601449 - DNA, 25 bp, Homo sapien
gtcacaactgggatttgtgtactag

SEQ ID NO: 601450 - DNA, 25 bp, Homo sapien
ctgggatttgtgtactagttttctg

SEQ ID NO: 601451 - DNA, 25 bp, Homo sapien
tgtgtactagttttctgtagctgcc

SEQ ID NO: 601452 - DNA, 25 bp, Homo sapien
accagcactatctcaagcagcaaca

SEQ ID NO: 601453 - DNA, 25 bp, Homo sapien
agcagcaacaatggcaaacgtgcat

SEQ ID NO: 601454 - DNA, 25 bp, Homo sapien
gcaaacgtgcatctgccagtggcca

SEQ ID NO: 601455 - DNA, 25 bp, Homo sapien
tgcatctgccagtggccagcagcca

SEQ ID NO: 601456 - DNA, 25 bp, Homo sapien
atcccgttacctgcctcgtgaggtg

SEQ ID NO: 601457 - DNA, 25 bp, Homo sapien
cacgcttccgccagcaagaacagaa

SEQ ID NO: 601458 - DNA, 25 bp, Homo sapien
gcagctattaaagagaggccagcca

SEQ ID NO: 601459 - DNA, 25 bp, Homo sapien
gggactctaaccagtgtgagcccaa

SEQ ID NO: 601460 - DNA, 25 bp, Homo sapien
tacctggagccggaacacagcatca

SEQ ID NO: 601461 - DNA, 25 bp, Homo sapien
gaacacagcatcatcccagtaagct

SEQ ID NO: 601462 - DNA, 25 bp, Homo sapien
atcccagtaagctccaaccagggag

SEQ ID NO: 601463 - DNA, 25 bp, Homo sapien
ggtagggtaatggaactccctctca

SEQ ID NO: 601464 - DNA, 25 bp, Homo sapien
gggtaatggaactccctctcaggcc

SEQ ID NO: 601465 - DNA, 25 bp, Homo sapien
ctctcaggcctctgaatatggagaa

SEQ ID NO: 601466 - DNA, 25 bp, Homo sapien
ttaatctagagttacccatttggag

SEQ ID NO: 601467 - DNA, 25 bp, Homo sapien
ttacccatttggagagagatacagg

SEQ ID NO: 601468 - DNA, 25 bp, Homo sapien
gatacagggttatatcctaacggta

SEQ ID NO: 601469 - DNA, 25 bp, Homo sapien
agtcataagtatgctcatgccctaa

SEQ ID NO: 601470 - DNA, 25 bp, Homo sapien
aagtatgctcatgccctaacaagtt

SEQ ID NO: 601471 - DNA, 25 bp, Homo sapien
atgctcatgccctaacaagttagtg

SEQ ID NO: 601472 - DNA, 25 bp, Homo sapien
taacaagttagtgaatttttccagt

SEQ ID NO: 601473 - DNA, 25 bp, Homo sapien
gaaagccatggtaaattacccattt

SEQ ID NO: 601474 - DNA, 25 bp, Homo sapien
cagaagcatcttcagttttcatatg

SEQ ID NO: 601475 - DNA, 25 bp, Homo sapien
gagtgatttgtgcagccaaggacac

SEQ ID NO: 601476 - DNA, 25 bp, Homo sapien
gacacacagcaagttagtggctgca

SEQ ID NO: 601477 - DNA, 25 bp, Homo sapien
gcaagttagtggctgcaccagaaat

SEQ ID NO: 601478 - DNA, 25 bp, Homo sapien
ggctgcaccagaaatagtactcact

SEQ ID NO: 601479 - DNA, 25 bp, Homo sapien
agaaatagtactcactgcctcagac

SEQ ID NO: 601480 - DNA, 25 bp, Homo sapien
tccaccccaaggtctggttctgaat

SEQ ID NO: 601481 - DNA, 25 bp, Homo sapien
ccaaggtctggttctgaatcattca

SEQ ID NO: 601482 - DNA, 25 bp, Homo sapien
ggtgtgattacagctcatgtagcct

SEQ ID NO: 601483 - DNA, 25 bp, Homo sapien
attacagctcatgtagcctggacct

SEQ ID NO: 601484 - DNA, 25 bp, Homo sapien
gctcatgtagcctggacctcccaag

SEQ ID NO: 601485 - DNA, 25 bp, Homo sapien
cacgcccggctgatactgttaaagt

SEQ ID NO: 601486 - DNA, 25 bp, Homo sapien
acgcccggctgatactgttaaagtc

SEQ ID NO: 601487 - DNA, 25 bp, Homo sapien
cgcccggctgatactgttaaagtct

SEQ ID NO: 601488 - DNA, 25 bp, Homo sapien
gcccggctgatactgttaaagtctt

SEQ ID NO: 601489 - DNA, 25 bp, Homo sapien
cccggctgatactgttaaagtctta

SEQ ID NO: 601490 - DNA, 25 bp, Homo sapien
ccggctgatactgttaaagtcttaa

SEQ ID NO: 601491 - DNA, 25 bp, Homo sapien
cggctgatactgttaaagtcttaaa

SEQ ID NO: 601492 - DNA, 25 bp, Homo sapien
ggctgatactgttaaagtcttaaac

SEQ ID NO: 601493 - DNA, 25 bp, Homo sapien
gctgatactgttaaagtcttaaaca

SEQ ID NO: 601494 - DNA, 25 bp, Homo sapien
gatactgttaaagtcttaaacaagg

SEQ ID NO: 601495 - DNA, 25 bp, Homo sapien
tgttaaagtcttaaacaaggaagat

SEQ ID NO: 601496 - DNA, 25 bp, Homo sapien
ttattagaaatgaggactctcagcc

SEQ ID NO: 601497 - DNA, 25 bp, Homo sapien
tattagaaatgaggactctcagccg

SEQ ID NO: 601498 - DNA, 25 bp, Homo sapien
attagaaatgaggactctcagccgg

SEQ ID NO: 601499 - DNA, 25 bp, Homo sapien
ttagaaatgaggactctcagccggg

SEQ ID NO: 601500 - DNA, 25 bp, Homo sapien
tagaaatgaggactctcagccgggc

SEQ ID NO: 601501 - DNA, 25 bp, Homo sapien
ggcgggcggattgtctgagctcggg

SEQ ID NO: 601502 - DNA, 25 bp, Homo sapien
gcgggcggattgtctgagctcggga

SEQ ID NO: 601503 - DNA, 25 bp, Homo sapien
cgggcggattgtctgagctcgggag

SEQ ID NO: 601504 - DNA, 25 bp, Homo sapien
gggcggattgtctgagctcgggagt

SEQ ID NO: 601505 - DNA, 25 bp, Homo sapien
cggattgtctgagctcgggagttcg

SEQ ID NO: 601506 - DNA, 25 bp, Homo sapien
ggattgtctgagctcgggagttcga

SEQ ID NO: 601507 - DNA, 25 bp, Homo sapien
cctccctctgtgcagatggaagtgg

SEQ ID NO: 601508 - DNA, 25 bp, Homo sapien
gtgaccagcttgtgacaagaagact

SEQ ID NO: 601509 - DNA, 25 bp, Homo sapien
tgaagggtccagagtccatgctcac

SEQ ID NO: 601510 - DNA, 25 bp, Homo sapien
agagtccatgctcacggaacagcac

SEQ ID NO: 601511 - DNA, 25 bp, Homo sapien
tgataatatggctggaatggcttct

SEQ ID NO: 601512 - DNA, 25 bp, Homo sapien
ctggaatggcttcttaagatgtata

SEQ ID NO: 601513 - DNA, 25 bp, Homo sapien
aaaatggcagttccccattgcagca

SEQ ID NO: 601514 - DNA, 25 bp, Homo sapien
attgcagcatcacctacttgtatgt

SEQ ID NO: 601515 - DNA, 25 bp, Homo sapien
tacttgtatgtctttctgcctctgt

SEQ ID NO: 601516 - DNA, 25 bp, Homo sapien
tgcctctgtatatgttctcccagaa

SEQ ID NO: 601517 - DNA, 25 bp, Homo sapien
atcaaatgccctaggatgcttccat

SEQ ID NO: 601518 - DNA, 25 bp, Homo sapien
tattatgcagtagtttcgaccctgg

SEQ ID NO: 601519 - DNA, 25 bp, Homo sapien
tatgcagtagtttcgaccctggaag

SEQ ID NO: 601520 - DNA, 25 bp, Homo sapien
tgcagtagtttcgaccctggaagac

SEQ ID NO: 601521 - DNA, 25 bp, Homo sapien
gtagtttcgaccctggaagacgagt

SEQ ID NO: 601522 - DNA, 25 bp, Homo sapien
cctggaagacgagtgtgcatctttg

SEQ ID NO: 601523 - DNA, 25 bp, Homo sapien
gacgagtgtgcatctttgagttgta

SEQ ID NO: 601524 - DNA, 25 bp, Homo sapien
gtgtacctcgcccatccaggcgtag

SEQ ID NO: 601525 - DNA, 25 bp, Homo sapien
gcccatccaggcgtagtttcatttg

SEQ ID NO: 601526 - DNA, 25 bp, Homo sapien
ccaggcgtagtttcatttggaatct

SEQ ID NO: 601527 - DNA, 25 bp, Homo sapien
gcgtagtttcatttggaatctggtt

SEQ ID NO: 601528 - DNA, 25 bp, Homo sapien
gaatctggttatcctgtagttgctt

SEQ ID NO: 601529 - DNA, 25 bp, Homo sapien
tatagtagtttgtagtatttcattg

SEQ ID NO: 601530 - DNA, 25 bp, Homo sapien
atatgtactgtattttggatgtgta

SEQ ID NO: 601531 - DNA, 25 bp, Homo sapien
tttggatgtgtaaagcttctatgta

SEQ ID NO: 601532 - DNA, 25 bp, Homo sapien
tggatgtgtaaagcttctatgtatt

SEQ ID NO: 601533 - DNA, 25 bp, Homo sapien
gatgtgtaaagcttctatgtattga

SEQ ID NO: 601534 - DNA, 25 bp, Homo sapien
gtgtaaagcttctatgtattgaaat

SEQ ID NO: 601535 - DNA, 25 bp, Homo sapien
ttttttgtcagtgtaaagcagtcat

SEQ ID NO: 601536 - DNA, 25 bp, Homo sapien
ttttgtcagtgtaaagcagtcatta

SEQ ID NO: 601537 - DNA, 25 bp, Homo sapien
ttgtcagtgtaaagcagtcattaga

SEQ ID NO: 601538 - DNA, 25 bp, Homo sapien
gtcagtgtaaagcagtcattagaat

SEQ ID NO: 601539 - DNA, 25 bp, Homo sapien
gtgtaaagcagtcattagaattgat

SEQ ID NO: 601540 - DNA, 25 bp, Homo sapien
cagcagagacgcctcttcgggagag

SEQ ID NO: 601541 - DNA, 25 bp, Homo sapien
tacagatacgtgtcccaagcacagc

SEQ ID NO: 601542 - DNA, 25 bp, Homo sapien
atacgtgtcccaagcacagcccagg

SEQ ID NO: 601543 - DNA, 25 bp, Homo sapien
ccaggggaaagccacgccaggacac

SEQ ID NO: 601544 - DNA, 25 bp, Homo sapien
tcgacgtccccaccaacatcatgaa

SEQ ID NO: 601545 - DNA, 25 bp, Homo sapien
acatcatgaacctcctcttcaacat

SEQ ID NO: 601546 - DNA, 25 bp, Homo sapien
atcgccaaggccaagaacctgcgtg

SEQ ID NO: 601547 - DNA, 25 bp, Homo sapien
aaggccaagaacctgcgtgcccagg

SEQ ID NO: 601548 - DNA, 25 bp, Homo sapien
gccaatgcccacctgatggcgcaaa

SEQ ID NO: 601549 - DNA, 25 bp, Homo sapien
atgcccacctgatggcgcaaattgg

SEQ ID NO: 601550 - DNA, 25 bp, Homo sapien
acctgatggcgcaaattgggaggaa

SEQ ID NO: 601551 - DNA, 25 bp, Homo sapien
gccctctgttactttgtaaaagcaa

SEQ ID NO: 601552 - DNA, 25 bp, Homo sapien
ccctctgttactttgtaaaagcaag

SEQ ID NO: 601553 - DNA, 25 bp, Homo sapien
cctctgttactttgtaaaagcaaga

SEQ ID NO: 601554 - DNA, 25 bp, Homo sapien
ctctgttactttgtaaaagcaagaa

SEQ ID NO: 601555 - DNA, 25 bp, Homo sapien
tactttgtaaaagcaagaatgggcc

SEQ ID NO: 601556 - DNA, 25 bp, Homo sapien
actttgtaaaagcaagaatgggcca

SEQ ID NO: 601557 - DNA, 25 bp, Homo sapien
ctttgtaaaagcaagaatgggccag

SEQ ID NO: 601558 - DNA, 25 bp, Homo sapien
ttgtaaaagcaagaatgggccaggc

SEQ ID NO: 601559 - DNA, 25 bp, Homo sapien
tgtaaaagcaagaatgggccaggcg

SEQ ID NO: 601560 - DNA, 25 bp, Homo sapien
taaaagcaagaatgggccaggcgca

SEQ ID NO: 601561 - DNA, 25 bp, Homo sapien
aacatgatgaagcctcgcctctact

SEQ ID NO: 601562 - DNA, 25 bp, Homo sapien
ggaagacatagcacagatggcttta

SEQ ID NO: 601563 - DNA, 25 bp, Homo sapien
catagcacagatggctttaaaggag

SEQ ID NO: 601564 - DNA, 25 bp, Homo sapien
gtgaaggcgcgggaacctccagacc

SEQ ID NO: 601565 - DNA, 25 bp, Homo sapien
gcgggaacctccagaccccggagag

SEQ ID NO: 601566 - DNA, 25 bp, Homo sapien
ggcaggacccggattctccccaggg

SEQ ID NO: 601567 - DNA, 25 bp, Homo sapien
agcagccagccctttcaacacatgg

SEQ ID NO: 601568 - DNA, 25 bp, Homo sapien
agccctttcaacacatggactttag

SEQ ID NO: 601569 - DNA, 25 bp, Homo sapien
catggactttagatttatttcactt

SEQ ID NO: 601570 - DNA, 25 bp, Homo sapien
atttatttcacttttgggactgcaa

SEQ ID NO: 601571 - DNA, 25 bp, Homo sapien
ttcacttttgggactgcaagagaat

SEQ ID NO: 601572 - DNA, 25 bp, Homo sapien
aagagaataaactgtgacttttgtt

SEQ ID NO: 601573 - DNA, 25 bp, Homo sapien
ccacctaagttctcttcgcttaaag

SEQ ID NO: 601574 - DNA, 25 bp, Homo sapien
ttcgcttaaagatatgtcccagggc

SEQ ID NO: 601575 - DNA, 25 bp, Homo sapien
gtcccagggcaagacaacaggatca

SEQ ID NO: 601576 - DNA, 25 bp, Homo sapien
aacaggatcagagaacttgccagat

SEQ ID NO: 601577 - DNA, 25 bp, Homo sapien
taaatggagaaccagcccatgcctc

SEQ ID NO: 601578 - DNA, 25 bp, Homo sapien
atgcctcacagacagtaggatccca

SEQ ID NO: 601579 - DNA, 25 bp, Homo sapien
cagacagtaggatcccagtaaatat

SEQ ID NO: 601580 - DNA, 25 bp, Homo sapien
atatttggacctttaaacagcttgt

SEQ ID NO: 601581 - DNA, 25 bp, Homo sapien
aaacagcttgttttcccatggagaa

SEQ ID NO: 601582 - DNA, 25 bp, Homo sapien
gcttgttttcccatggagaagatga

SEQ ID NO: 601583 - DNA, 25 bp, Homo sapien
atgccaatcataggcattttttcat

SEQ ID NO: 601584 - DNA, 25 bp, Homo sapien
caatagactagggtaggccgcgatg

SEQ ID NO: 601585 - DNA, 25 bp, Homo sapien
gccgcgatggcctgtagaaggttgc

SEQ ID NO: 601586 - DNA, 25 bp, Homo sapien
gtgttgagtaagttggtctttcccg

SEQ ID NO: 601587 - DNA, 25 bp, Homo sapien
taagttggtctttcccggtgctata

SEQ ID NO: 601588 - DNA, 25 bp, Homo sapien
gtctttcccggtgctatacttgcct

SEQ ID NO: 601589 - DNA, 25 bp, Homo sapien
tgcctcctctccacggaagaattgt

SEQ ID NO: 601590 - DNA, 25 bp, Homo sapien
agaattgttcaggagatgcgcttgg

SEQ ID NO: 601591 - DNA, 25 bp, Homo sapien
tgatgacttccttaaatacacgctg

SEQ ID NO: 601592 - DNA, 25 bp, Homo sapien
acttccttaaatacacgctgtaggg

SEQ ID NO: 601593 - DNA, 25 bp, Homo sapien
aagagcttggaggaccaggcacttt

SEQ ID NO: 601594 - DNA, 25 bp, Homo sapien
cttggaggaccaggcactttgagga

SEQ ID NO: 601595 - DNA, 25 bp, Homo sapien
gcctccgttgatttctgccatcatt

SEQ ID NO: 601596 - DNA, 25 bp, Homo sapien
atttctgccatcattctctctttct

SEQ ID NO: 601597 - DNA, 25 bp, Homo sapien
ctctctccctcctctaatataaaat

SEQ ID NO: 601598 - DNA, 25 bp, Homo sapien
gacactatcaattcctcgtattcat

SEQ ID NO: 601599 - DNA, 25 bp, Homo sapien
taaagatcagtttgccacagttcgc

SEQ ID NO: 601600 - DNA, 25 bp, Homo sapien
acagttcgcaaaattgagcctcacc

SEQ ID NO: 601601 - DNA, 25 bp, Homo sapien
agatggattccctgagacctagcaa

SEQ ID NO: 601602 - DNA, 25 bp, Homo sapien
gacctagcaactacttgaattcccc

SEQ ID NO: 601603 - DNA, 25 bp, Homo sapien
aaaagatgctttcatgtctccccag

SEQ ID NO: 601604 - DNA, 25 bp, Homo sapien
tgtctccccagactgagtttctagc

SEQ ID NO: 601605 - DNA, 25 bp, Homo sapien
tttctagcctcaggaaactacgcct

SEQ ID NO: 601606 - DNA, 25 bp, Homo sapien
tgcagaagaaccagcttcgggccct

SEQ ID NO: 601607 - DNA, 25 bp, Homo sapien
tcaaaggaagacagtgtggagcaga

SEQ ID NO: 601608 - DNA, 25 bp, Homo sapien
aagggtcgtctctgagcacggagca

SEQ ID NO: 601609 - DNA, 25 bp, Homo sapien
tctgagcacggagcaggctggtcct

SEQ ID NO: 601610 - DNA, 25 bp, Homo sapien
agcaggctggtcctgccttgaccca

SEQ ID NO: 601611 - DNA, 25 bp, Homo sapien
tctcgccaggaacaggctccgacga

SEQ ID NO: 601612 - DNA, 25 bp, Homo sapien
caggaacaggctccgacgagatctt

SEQ ID NO: 601613 - DNA, 25 bp, Homo sapien
aacaggctccgacgagatcttcctg

SEQ ID NO: 601614 - DNA, 25 bp, Homo sapien
ccctgagggtcgtcctccagcaggg

SEQ ID NO: 601615 - DNA, 25 bp, Homo sapien
gggcttcttggacccctgtctgagg

SEQ ID NO: 601616 - DNA, 25 bp, Homo sapien
tcgcgtcttagtgggcgggattctt

SEQ ID NO: 601617 - DNA, 25 bp, Homo sapien
atctttgtgttcatgtttccccttt

SEQ ID NO: 601618 - DNA, 25 bp, Homo sapien
ttcatgtttccccttttgccgggcg

SEQ ID NO: 601619 - DNA, 25 bp, Homo sapien
tcatgtttccccttttgccgggcgc

SEQ ID NO: 601620 - DNA, 25 bp, Homo sapien
catgtttccccttttgccgggcgcg

SEQ ID NO: 601621 - DNA, 25 bp, Homo sapien
tacaaatatgtcgggatgattggcg

SEQ ID NO: 601622 - DNA, 25 bp, Homo sapien
acaaatatgtcgggatgattggcgg

SEQ ID NO: 601623 - DNA, 25 bp, Homo sapien
caaatatgtcgggatgattggcggg

SEQ ID NO: 601624 - DNA, 25 bp, Homo sapien
aaatatgtcgggatgattggcgggg

SEQ ID NO: 601625 - DNA, 25 bp, Homo sapien
atatgtcgggatgattggcggggtc

SEQ ID NO: 601626 - DNA, 25 bp, Homo sapien
gtcgggatgattggcggggtcctca

SEQ ID NO: 601627 - DNA, 25 bp, Homo sapien
tcgggatgattggcggggtcctcat

SEQ ID NO: 601628 - DNA, 25 bp, Homo sapien
ttaaggtccacctgcgcccactgaa

SEQ ID NO: 601629 - DNA, 25 bp, Homo sapien
acctgcgcccactgaagctggacaa

SEQ ID NO: 601630 - DNA, 25 bp, Homo sapien
gaagctggacaagagcctcaataag

SEQ ID NO: 601631 - DNA, 25 bp, Homo sapien
gcctcaataaggacaccctggcgag

SEQ ID NO: 601632 - DNA, 25 bp, Homo sapien
taaggacaccctggcgaggaagctg

SEQ ID NO: 601633 - DNA, 25 bp, Homo sapien
ggagcagcagctctacacccaggag

SEQ ID NO: 601634 - DNA, 25 bp, Homo sapien
aggagcagctcttcgaccgcacgtg

SEQ ID NO: 601635 - DNA, 25 bp, Homo sapien
tcgaccgcacgtgcatgatgctcgg

SEQ ID NO: 601636 - DNA, 25 bp, Homo sapien
agcagctgtgctccgggtagatcac

SEQ ID NO: 601637 - DNA, 25 bp, Homo sapien
tgtgctccgggtagatcactatggg

SEQ ID NO: 601638 - DNA, 25 bp, Homo sapien
aggaaggtcacccagagtgcctacg

SEQ ID NO: 601639 - DNA, 25 bp, Homo sapien
cagctgttgaacactatgggtcaga

SEQ ID NO: 601640 - DNA, 25 bp, Homo sapien
gctgttgaacactatgggtcagact

SEQ ID NO: 601641 - DNA, 25 bp, Homo sapien
ctgttgaacactatgggtcagactt

SEQ ID NO: 601642 - DNA, 25 bp, Homo sapien
gtgtcacctacccatgactaaattc

SEQ ID NO: 601643 - DNA, 25 bp, Homo sapien
gtcacctacccatgactaaattcat

SEQ ID NO: 601644 - DNA, 25 bp, Homo sapien
tacccatgactaaattcatatgctg

SEQ ID NO: 601645 - DNA, 25 bp, Homo sapien
ttcatatgctgaagctctgacctcc

SEQ ID NO: 601646 - DNA, 25 bp, Homo sapien
atatgctgaagctctgacctccaac

SEQ ID NO: 601647 - DNA, 25 bp, Homo sapien
tatgctgaagctctgacctccaaca

SEQ ID NO: 601648 - DNA, 25 bp, Homo sapien
tgaagctctgacctccaacagggac

SEQ ID NO: 601649 - DNA, 25 bp, Homo sapien
taagctgacaaaagggaggctggtt

SEQ ID NO: 601650 - DNA, 25 bp, Homo sapien
tgttctcttcaaaatatgccaaagg

SEQ ID NO: 601651 - DNA, 25 bp, Homo sapien
gtcaagaccattttgccctgtaagc

SEQ ID NO: 601652 - DNA, 25 bp, Homo sapien
gaccattttgccctgtaagctgaga

SEQ ID NO: 601653 - DNA, 25 bp, Homo sapien
tttgccctgtaagctgagaatagaa

SEQ ID NO: 601654 - DNA, 25 bp, Homo sapien
gaaaaatcaacatgcagggtgccat

SEQ ID NO: 601655 - DNA, 25 bp, Homo sapien
gccatttccaggatgttacgaaaca

SEQ ID NO: 601656 - DNA, 25 bp, Homo sapien
acagcgaacatgtgaatccgtctca

SEQ ID NO: 601657 - DNA, 25 bp, Homo sapien
atgtgaatccgtctcaacaccattt

SEQ ID NO: 601658 - DNA, 25 bp, Homo sapien
gtctcaacaccatttggcaactttg

SEQ ID NO: 601659 - DNA, 25 bp, Homo sapien
gatgatatttctcacccacaaactc

SEQ ID NO: 601660 - DNA, 25 bp, Homo sapien
acccacaaactcctcactgagttta

SEQ ID NO: 601661 - DNA, 25 bp, Homo sapien
gatttccctcaaattgaatttatct

SEQ ID NO: 601662 - DNA, 25 bp, Homo sapien
tatctggtgttttatcatgatttga

SEQ ID NO: 601663 - DNA, 25 bp, Homo sapien
aagccacagaagtgatgtgcttttc

SEQ ID NO: 601664 - DNA, 25 bp, Homo sapien
gtgatgtgcttttcatgcttgtcag

SEQ ID NO: 601665 - DNA, 25 bp, Homo sapien
tttcatgcttgtcaggaggcacatt

SEQ ID NO: 601666 - DNA, 25 bp, Homo sapien
aggcacattatgttgatttgtctca

SEQ ID NO: 601667 - DNA, 25 bp, Homo sapien
gatttgtctcaatacttgtaatgtt

SEQ ID NO: 601668 - DNA, 25 bp, Homo sapien
taaggtggtatctgctggtttgtgt

SEQ ID NO: 601669 - DNA, 25 bp, Homo sapien
agggagagattctttgagactgtaa
